United States Patent 7,250,496 (BIOINFORMATICALLY DETECTABLE GROUP OF NOVEL REGULATORY GENES AND USES THEREOF) - sequence listing, part 13

SEQ ID NO: 514432 - RNA, 22 nt, Human
caccacaaacacugggaagccu

SEQ ID NO: 514433 - RNA, 20 nt, Human
caccaccacaaacacuggga

SEQ ID NO: 514434 - RNA, 24 nt, Human
caccaccacaaacacugggaagcc

SEQ ID NO: 514435 - RNA, 19 nt, Human
cacuguacuccagccuggg

SEQ ID NO: 514436 - RNA, 19 nt, Human
cacuguacuccagccuggg

SEQ ID NO: 514437 - RNA, 21 nt, Human
cacuguacuccagccugggua

SEQ ID NO: 514438 - RNA, 22 nt, Human
cacuguacuccagccuggguaa

SEQ ID NO: 514439 - RNA, 23 nt, Human
cacuguacuccagccuggguaac

SEQ ID NO: 514440 - RNA, 24 nt, Human
cacuguacuccagccuggguaaca

SEQ ID NO: 514441 - RNA, 19 nt, Human
cagaaaagcccccagguga

SEQ ID NO: 514442 - RNA, 18 nt, Human
cagaagccuuuggggucg

SEQ ID NO: 514443 - RNA, 19 nt, Human
cagaagccuuuggggucgu

SEQ ID NO: 514444 - RNA, 24 nt, Human
caguugacagccccagaaaagccc

SEQ ID NO: 514445 - RNA, 20 nt, Human
ccacuguacuccagccuggg

SEQ ID NO: 514446 - RNA, 20 nt, Human
ccacuguacuccagccuggg

SEQ ID NO: 514447 - RNA, 20 nt, Human
ccacuguacuccagccuggg

SEQ ID NO: 514448 - RNA, 21 nt, Human
ccacuguacuccagccugggu

SEQ ID NO: 514449 - RNA, 22 nt, Human
ccacuguacuccagccugggua

SEQ ID NO: 514450 - RNA, 24 nt, Human
ccacuguacuccagccuggguaac

SEQ ID NO: 514451 - RNA, 21 nt, Human
ccaggcagauccaccaccaca

SEQ ID NO: 514452 - RNA, 24 nt, Human
gccuggguaacaaagacagacccu

SEQ ID NO: 514453 - RNA, 20 nt, Human
ggaggcugcacugagcuuug

SEQ ID NO: 514454 - RNA, 21 nt, Human
guguuccaguugacagcccca

SEQ ID NO: 514455 - RNA, 22 nt, Human
uaacaaagacagacccugucuc

SEQ ID NO: 514456 - RNA, 24 nt, Human
uaacaaagacagacccugucucuu

SEQ ID NO: 514457 - RNA, 27 nt, Human
uaacaaagacagacccugucucuuaau

SEQ ID NO: 514458 - RNA, 22 nt, Human
uacuccagccuggguaacaaag

SEQ ID NO: 514459 - RNA, 23 nt, Human
uagggugucaaauugagaaccag

SEQ ID NO: 514460 - RNA, 20 nt, Human
ugacaccacuguacuccagc

SEQ ID NO: 514461 - RNA, 22 nt, Human
ugacaccacuguacuccagccu

SEQ ID NO: 514462 - RNA, 21 nt, Human
ugacagccccagaaaagcccc

SEQ ID NO: 514463 - RNA, 23 nt, Human
ugaggaaacccaggccacaugga

SEQ ID NO: 514464 - RNA, 21 nt, Human
ugaggcaagaguauugagccc

SEQ ID NO: 514465 - RNA, 20 nt, Human
uggagaaauccugcgguguu

SEQ ID NO: 514466 - RNA, 24 nt, Human
ugucuguaguugcagcuacucagg

SEQ ID NO: 514467 - RNA, 22 nt, Human
uucauguugacuugauaccuac

SEQ ID NO: 514468 - RNA, 22 nt, Human
uuccaguugacagccccagaaa

SEQ ID NO: 514469 - RNA, 21 nt, Human
uugacagccccagaaaagccc

SEQ ID NO: 514470 - RNA, 18 nt, Human
uugguuccagaagccuuu

SEQ ID NO: 514471 - RNA, 20 nt, Human
uugguuccagaagccuuugg

SEQ ID NO: 514472 - RNA, 20 nt, Human
uuuuucuuuuucgaacuugg

SEQ ID NO: 514473 - RNA, 19 nt, Human
uuuuuuuucaucuccacaa

SEQ ID NO: 514474 - RNA, 24 nt, Human
aaacaaaaauccagucucauuagc

SEQ ID NO: 514475 - RNA, 21 nt, Human
aaagcacauccaaagcuaggc

SEQ ID NO: 514476 - RNA, 24 nt, Human
aaaugaucagugaaaacauaaaac

SEQ ID NO: 514477 - RNA, 23 nt, Human
aacacggaauggaaaucaugauc

SEQ ID NO: 514478 - RNA, 24 nt, Human
aaccaacuccuuuccuagcccgcg

SEQ ID NO: 514479 - RNA, 22 nt, Human
aacuggccccacuccuccccug

SEQ ID NO: 514480 - RNA, 20 nt, Human
aagaaagaggaaccucacau

SEQ ID NO: 514481 - RNA, 21 nt, Human
acaaagacauugucaucaaga

SEQ ID NO: 514482 - RNA, 21 nt, Human
acauaaaacauccaugaucug

SEQ ID NO: 514483 - RNA, 22 nt, Human
acuggaccgcaaagaagaaccc

SEQ ID NO: 514484 - RNA, 24 nt, Human
agacgcagcccacggccagcgcca

SEQ ID NO: 514485 - RNA, 25 nt, Human
agagaagaugaaucgguuggcaugg

SEQ ID NO: 514486 - RNA, 20 nt, Human
agagaccaggauguugggug

SEQ ID NO: 514487 - RNA, 18 nt, Human
agagcaggagacugagaa

SEQ ID NO: 514488 - RNA, 20 nt, Human
agccugggccacgugaaccu

SEQ ID NO: 514489 - RNA, 19 nt, Human
agcgagcuccagagagagc

SEQ ID NO: 514490 - RNA, 20 nt, Human
agcgcagcgccgagccuggc

SEQ ID NO: 514491 - RNA, 22 nt, Human
aggcucagaacgaacaaaaauc

SEQ ID NO: 514492 - RNA, 20 nt, Human
agugggcaaggaagaacugc

SEQ ID NO: 514493 - RNA, 25 nt, Human
auccacuuccugcaaugacucuggu

SEQ ID NO: 514494 - RNA, 22 nt, Human
auggcagaaagcacauccaaag

SEQ ID NO: 514495 - RNA, 21 nt, Human
auguagcuuuggaccaacugg

SEQ ID NO: 514496 - RNA, 22 nt, Human
auuguaacacggaauggaaauc

SEQ ID NO: 514497 - RNA, 24 nt, Human
caaagaagaaccccacugccacgc

SEQ ID NO: 514498 - RNA, 23 nt, Human
cacugagcugaaagaaagaggaa

SEQ ID NO: 514499 - RNA, 23 nt, Human
cacugccacgcggcgccagcgcc

SEQ ID NO: 514500 - RNA, 18 nt, Human
cagaggcuccccagcccc

SEQ ID NO: 514501 - RNA, 25 nt, Human
cagccagccuauaaccuauggagcc

SEQ ID NO: 514502 - RNA, 19 nt, Human
cagcgccgagccuggcagg

SEQ ID NO: 514503 - RNA, 23 nt, Human
ccaacaggcuggaauguaccuga

SEQ ID NO: 514504 - RNA, 23 nt, Human
ccacuuccugcaaugacucuggu

SEQ ID NO: 514505 - RNA, 24 nt, Human
ccaggauguugggugagugggcgu

SEQ ID NO: 514506 - RNA, 23 nt, Human
cccacggccagcgccaggaagcc

SEQ ID NO: 514507 - RNA, 18 nt, Human
cccaugggcacugagcug

SEQ ID NO: 514508 - RNA, 23 nt, Human
ccccagacacagcgagcuccaga

SEQ ID NO: 514509 - RNA, 22 nt, Human
cccucagaggcuccccagcccc

SEQ ID NO: 514510 - RNA, 20 nt, Human
ccuauggagccaggacagga

SEQ ID NO: 514511 - RNA, 22 nt, Human
ccucagaggcuccccagccccu

SEQ ID NO: 514512 - RNA, 21 nt, Human
ccuggcagcucuggcuccagc

SEQ ID NO: 514513 - RNA, 21 nt, Human
ccuucagcucaugacgccacc

SEQ ID NO: 514514 - RNA, 22 nt, Human
ccuuccucagaaaaauuacccc

SEQ ID NO: 514515 - RNA, 23 nt, Human
ccuugcccaugggcacugagcug

SEQ ID NO: 514516 - RNA, 21 nt, Human
cuaaaaugagguggaacucau

SEQ ID NO: 514517 - RNA, 24 nt, Human
cucagaacgaacaaaaaucagucu

SEQ ID NO: 514518 - RNA, 21 nt, Human
cucauccacuuccugcaauga

SEQ ID NO: 514519 - RNA, 21 nt, Human
cuccagcaggaagacgcagcc

SEQ ID NO: 514520 - RNA, 19 nt, Human
cucuguccuaaauuugaga

SEQ ID NO: 514521 - RNA, 22 nt, Human
cugaaagaaagaggaaccucac

SEQ ID NO: 514522 - RNA, 24 nt, Human
cugcagaaugaaagagucccucag

SEQ ID NO: 514523 - RNA, 23 nt, Human
cugcuuuucuccagcugacaugc

SEQ ID NO: 514524 - RNA, 24 nt, Human
cuggaauguaccugauacaauuua

SEQ ID NO: 514525 - RNA, 23 nt, Human
cuguaauucuuaaguuggcuagu

SEQ ID NO: 514526 - RNA, 18 nt, Human
cugucuuccaaaccacuu

SEQ ID NO: 514527 - RNA, 21 nt, Human
gacacacaacauaaaaaacaa

SEQ ID NO: 514528 - RNA, 20 nt, Human
gaccaggauguugggugagu

SEQ ID NO: 514529 - RNA, 22 nt, Human
gagcuuuuaacuggccccacuc

SEQ ID NO: 514530 - RNA, 19 nt, Human
gccacgcggcgccagcgcc

SEQ ID NO: 514531 - RNA, 22 nt, Human
gccagcgccggacuggccgcac

SEQ ID NO: 514532 - RNA, 21 nt, Human
gccccacuccuccccugcuug

SEQ ID NO: 514533 - RNA, 22 nt, Human
gccgcgccacagcgccaugggg

SEQ ID NO: 514534 - RNA, 18 nt, Human
gccugggccacgugaacc

SEQ ID NO: 514535 - RNA, 19 nt, Human
gccugggccacgugaaccu

SEQ ID NO: 514536 - RNA, 25 nt, Human
gcgagcuccagagagaggggaacgc

SEQ ID NO: 514537 - RNA, 19 nt, Human
gcgggccccagacacagcg

SEQ ID NO: 514538 - RNA, 22 nt, Human
ggcagaaagcacauccaaagcu

SEQ ID NO: 514539 - RNA, 21 nt, Human
ggcuaguucuccuuccucaga

SEQ ID NO: 514540 - RNA, 21 nt, Human
ggcucggcgcgcgccgauguc

SEQ ID NO: 514541 - RNA, 18 nt, Human
gggagggauuguuuuguc

SEQ ID NO: 514542 - RNA, 22 nt, Human
gggccccagacacagcgagcuc

SEQ ID NO: 514543 - RNA, 23 nt, Human
gggccccagacacagcgagcucc

SEQ ID NO: 514544 - RNA, 19 nt, Human
uaacacacacaggagcaua

SEQ ID NO: 514545 - RNA, 19 nt, Human
uaacaugacaaauuuacug

SEQ ID NO: 514546 - RNA, 19 nt, Human
ucaagugggcaaggaagaa

SEQ ID NO: 514547 - RNA, 19 nt, Human
ucagaacgaacaaaaauca

SEQ ID NO: 514548 - RNA, 25 nt, Human
uccaaaccacuuucuuccuguaauu

SEQ ID NO: 514549 - RNA, 22 nt, Human
ugaaccuuucaccagccagccu

SEQ ID NO: 514550 - RNA, 20 nt, Human
ugaagaaguuuagcuuaaaa

SEQ ID NO: 514551 - RNA, 20 nt, Human
ugaaucgguuggcaugggga

SEQ ID NO: 514552 - RNA, 21 nt, Human
ugagagaagaugaaucgguug

SEQ ID NO: 514553 - RNA, 23 nt, Human
ugaguuuuuagcucugugacaca

SEQ ID NO: 514554 - RNA, 21 nt, Human
ugcacuucucaagugggcaag

SEQ ID NO: 514555 - RNA, 22 nt, Human
ugcagaaugaaagagucccuca

SEQ ID NO: 514556 - RNA, 21 nt, Human
uggagccaggacaggaaagcu

SEQ ID NO: 514557 - RNA, 20 nt, Human
uggcagaaagcacauccaaa

SEQ ID NO: 514558 - RNA, 22 nt, Human
uggcagaaagcacauccaaagc

SEQ ID NO: 514559 - RNA, 18 nt, Human
ugggaacugaguuuuuag

SEQ ID NO: 514560 - RNA, 21 nt, Human
uuccaaaccacuuucuuccug

SEQ ID NO: 514561 - RNA, 24 nt, Human
uuccaguuguaaaaaacaaauucc

SEQ ID NO: 514562 - RNA, 22 nt, Human
uuccuagagaccaggauguugg

SEQ ID NO: 514563 - RNA, 20 nt, Human
uuccucagaaaaauuacccc

SEQ ID NO: 514564 - RNA, 18 nt, Human
uucuuuggcugucuucca

SEQ ID NO: 514565 - RNA, 22 nt, Human
uuggcuaguucuccuuccucag

SEQ ID NO: 514566 - RNA, 23 nt, Human
uuuaacuggccccacuccucccc

SEQ ID NO: 514567 - RNA, 25 nt, Human
aggcuaaaaaagaauuugugacuga

SEQ ID NO: 514568 - RNA, 22 nt, Human
gagugaauuuuuucuuggggac

SEQ ID NO: 514569 - RNA, 22 nt, Human
uaaaaaaccauauauauugugg

SEQ ID NO: 514570 - RNA, 21 nt, Human
uaaaugauccaacauuuucuu

SEQ ID NO: 514571 - RNA, 23 nt, Human
ugagagaaaauauuuuuucucua

SEQ ID NO: 514572 - RNA, 20 nt, Human
acagcagcgugaccggccgc

SEQ ID NO: 514573 - RNA, 24 nt, Human
accccugcccggccucccccaagc

SEQ ID NO: 514574 - RNA, 22 nt, Human
aggggucccgguggcuccagug

SEQ ID NO: 514575 - RNA, 18 nt, Human
aguggugucucuggggcu

SEQ ID NO: 514576 - RNA, 22 nt, Human
caacggggagcccgccaggccc

SEQ ID NO: 514577 - RNA, 21 nt, Human
caagcaucacagcugcgugag

SEQ ID NO: 514578 - RNA, 20 nt, Human
cacaaccacagccaggagca

SEQ ID NO: 514579 - RNA, 18 nt, Human
cacaggccccaggucugg

SEQ ID NO: 514580 - RNA, 20 nt, Human
caccucagcgccucuggcug

SEQ ID NO: 514581 - RNA, 24 nt, Human
cacgcagagcccgccucaccuccc

SEQ ID NO: 514582 - RNA, 19 nt, Human
cacguacagguaccuguug

SEQ ID NO: 514583 - RNA, 24 nt, Human
cacugggccaccguccagggcccc

SEQ ID NO: 514584 - RNA, 20 nt, Human
cagagcccgccucaccuccc

SEQ ID NO: 514585 - RNA, 23 nt, Human
cagcacaccucagcgccucuggc

SEQ ID NO: 514586 - RNA, 22 nt, Human
cagccaggagcagccccugcca

SEQ ID NO: 514587 - RNA, 19 nt, Human
caggaccccugcccggccu

SEQ ID NO: 514588 - RNA, 25 nt, Human
caucuccaccucucccgcucgggaa

SEQ ID NO: 514589 - RNA, 26 nt, Human
ccacugaguugaccacauccucgugc

SEQ ID NO: 514590 - RNA, 22 nt, Human
ccagggccccacaggaccagcc

SEQ ID NO: 514591 - RNA, 20 nt, Human
cccacaggaccagccgaagg

SEQ ID NO: 514592 - RNA, 23 nt, Human
cccacaggccccaggucugggcu

SEQ ID NO: 514593 - RNA, 19 nt, Human
cccaggcggcccacggccg

SEQ ID NO: 514594 - RNA, 18 nt, Human
cccccaguauccugugua

SEQ ID NO: 514595 - RNA, 22 nt, Human
cccccaguauccuguguacccc

SEQ ID NO: 514596 - RNA, 20 nt, Human
ccccgcccugcgcgacccgg

SEQ ID NO: 514597 - RNA, 21 nt, Human
ccccgcccugcgcgacccgga

SEQ ID NO: 514598 - RNA, 24 nt, Human
ccccugcccggccucccccaagcu

SEQ ID NO: 514599 - RNA, 19 nt, Human
cccgcugcgccgcccccgc

SEQ ID NO: 514600 - RNA, 22 nt, Human
cccgcuuccgcugccgcagccg

SEQ ID NO: 514601 - RNA, 22 nt, Human
cccgggcgcacaaccacagcca

SEQ ID NO: 514602 - RNA, 18 nt, Human
cccugcccggccuccccc

SEQ ID NO: 514603 - RNA, 18 nt, Human
ccgacgccacgagccccg

SEQ ID NO: 514604 - RNA, 20 nt, Human
ccgcccgcugcgccgccccc

SEQ ID NO: 514605 - RNA, 22 nt, Human
ccgcucccaagccccgggcgca

SEQ ID NO: 514606 - RNA, 20 nt, Human
ccgcugcgccgcccccgccc

SEQ ID NO: 514607 - RNA, 21 nt, Human
ccgcugcgccgcccccgcccu

SEQ ID NO: 514608 - RNA, 21 nt, Human
ccggacccgcuuccgcugccg

SEQ ID NO: 514609 - RNA, 22 nt, Human
ccgugccgguccuccgccccgc

SEQ ID NO: 514610 - RNA, 23 nt, Human
ccguguaugucuaugacgugguc

SEQ ID NO: 514611 - RNA, 21 nt, Human
ccucaguggugucucuggggc

SEQ ID NO: 514612 - RNA, 20 nt, Human
ccucgugccgcagccuggcc

SEQ ID NO: 514613 - RNA, 21 nt, Human
ccuguggacuugcuugcuguc

SEQ ID NO: 514614 - RNA, 22 nt, Human
cgcccccgcccugcgcgacccg

SEQ ID NO: 514615 - RNA, 18 nt, Human
cgccucaccucccgcaug

SEQ ID NO: 514616 - RNA, 21 nt, Human
cgcucccaagccccgggcgca

SEQ ID NO: 514617 - RNA, 22 nt, Human
cgggaaaaagccacagagccug

SEQ ID NO: 514618 - RNA, 21 nt, Human
cguccagggccccacaggacc

SEQ ID NO: 514619 - RNA, 19 nt, Human
cgugaccggccgcucccaa

SEQ ID NO: 514620 - RNA, 23 nt, Human
cgugccaagcaucacagcugcgu

SEQ ID NO: 514621 - RNA, 20 nt, Human
cguguaugucuaugacgugg

SEQ ID NO: 514622 - RNA, 21 nt, Human
cucaggaccccugcccggccu

SEQ ID NO: 514623 - RNA, 20 nt, Human
cugcgccgcccccgcccugc

SEQ ID NO: 514624 - RNA, 23 nt, Human
gaccacauccucgugccgcagcc

SEQ ID NO: 514625 - RNA, 20 nt, Human
gagcguguggcggggccugg

SEQ ID NO: 514626 - RNA, 18 nt, Human
gauguguccguguauguc

SEQ ID NO: 514627 - RNA, 20 nt, Human
gcagccccugccaccacugg

SEQ ID NO: 514628 - RNA, 18 nt, Human
gcccccgcccugcgcgac

SEQ ID NO: 514629 - RNA, 19 nt, Human
gccgcccccgcccaacggg

SEQ ID NO: 514630 - RNA, 18 nt, Human
gcgccgcccccgcccugc

SEQ ID NO: 514631 - RNA, 21 nt, Human
gcuugugaccccaggggcgag

SEQ ID NO: 514632 - RNA, 20 nt, Human
ggaccgccgcccccgcccaa

SEQ ID NO: 514633 - RNA, 21 nt, Human
ggagccccggcccucacccag

SEQ ID NO: 514634 - RNA, 18 nt, Human
ggaggacgcgcauggugc

SEQ ID NO: 514635 - RNA, 24 nt, Human
ggccgaggccagcugggucaggug

SEQ ID NO: 514636 - RNA, 22 nt, Human
ggcgcacaaccacagccaggag

SEQ ID NO: 514637 - RNA, 26 nt, Human
gggccgaggccagcugggucaggugu

SEQ ID NO: 514638 - RNA, 21 nt, Human
ggucuugaggucgaacaccag

SEQ ID NO: 514639 - RNA, 19 nt, Human
guaccuguugucgggcgac

SEQ ID NO: 514640 - RNA, 22 nt, Human
guggggagcgccaggcuuugau

SEQ ID NO: 514641 - RNA, 18 nt, Human
guggugucucuggggcug

SEQ ID NO: 514642 - RNA, 18 nt, Human
guuguccccuuccuaagg

SEQ ID NO: 514643 - RNA, 18 nt, Human
uauaagcaucuccaccuc

SEQ ID NO: 514644 - RNA, 21 nt, Human
ucccacaggccccaggucugg

SEQ ID NO: 514645 - RNA, 19 nt, Human
ucccugcugacguccagga

SEQ ID NO: 514646 - RNA, 22 nt, Human
ucccugcugacguccaggaaga

SEQ ID NO: 514647 - RNA, 22 nt, Human
uccgugggcacugccugcuccg

SEQ ID NO: 514648 - RNA, 23 nt, Human
ucugcuugaugccucaguggugu

SEQ ID NO: 514649 - RNA, 19 nt, Human
ugacgugguccagcgcguc

SEQ ID NO: 514650 - RNA, 18 nt, Human
ugcaacacacucgggccc

SEQ ID NO: 514651 - RNA, 19 nt, Human
ugcacuggccaccccgugc

SEQ ID NO: 514652 - RNA, 28 nt, Human
ugcccaggaggccgagggggccuugggc

SEQ ID NO: 514653 - RNA, 20 nt, Human
ugccccgggccgaggccagc

SEQ ID NO: 514654 - RNA, 19 nt, Human
ugccgguccuccgccccgc

SEQ ID NO: 514655 - RNA, 19 nt, Human
ugcgaggccgugggcgagg

SEQ ID NO: 514656 - RNA, 23 nt, Human
ugcgaggccgugggcgaggugcc

SEQ ID NO: 514657 - RNA, 23 nt, Human
uggccacgaagucccugcugacg

SEQ ID NO: 514658 - RNA, 21 nt, Human
uggcuccagugcacccagcac

SEQ ID NO: 514659 - RNA, 23 nt, Human
uggugcguggggagcgccaggcu

SEQ ID NO: 514660 - RNA, 19 nt, Human
uguaccccaaguugcccag

SEQ ID NO: 514661 - RNA, 20 nt, Human
ugugagcguguggcggggcc

SEQ ID NO: 514662 - RNA, 18 nt, Human
uguggcaggaucugcuug

SEQ ID NO: 514663 - RNA, 23 nt, Human
caccuucuaagcaaccuuuauuu

SEQ ID NO: 514664 - RNA, 18 nt, Human
cagcccacucccgcccaa

SEQ ID NO: 514665 - RNA, 20 nt, Human
ccaaacccaaaaugcagagg

SEQ ID NO: 514666 - RNA, 23 nt, Human
ccagcccacucccgcccaaaccc

SEQ ID NO: 514667 - RNA, 25 nt, Human
cccaaacccaaaaugcagaggagac

SEQ ID NO: 514668 - RNA, 19 nt, Human
cccagcccacucccgccca

SEQ ID NO: 514669 - RNA, 21 nt, Human
cccagcccacucccgcccaaa

SEQ ID NO: 514670 - RNA, 22 nt, Human
ccccccagcccacucccgccca

SEQ ID NO: 514671 - RNA, 18 nt, Human
ccgcccaaacccaaaaug

SEQ ID NO: 514672 - RNA, 22 nt, Human
cgaggcggacagugucacguuu

SEQ ID NO: 514673 - RNA, 27 nt, Human
cgcccaaacccaaaaugcagaggagac

SEQ ID NO: 514674 - RNA, 24 nt, Human
cuccccccagcccacucccgccca

SEQ ID NO: 514675 - RNA, 24 nt, Human
cuuuauuugcaaacucugagguug

SEQ ID NO: 514676 - RNA, 18 nt, Human
gacuucucucucucucuc

SEQ ID NO: 514677 - RNA, 21 nt, Human
ggacagugucacguuucucuc

SEQ ID NO: 514678 - RNA, 21 nt, Human
gggaggcagcauggcagcagu

SEQ ID NO: 514679 - RNA, 21 nt, Human
gucacguuucucucccuccac

SEQ ID NO: 514680 - RNA, 20 nt, Human
ucagggacccaggcgggggc

SEQ ID NO: 514681 - RNA, 22 nt, Human
ucccgcccaaacccaaaaugca

SEQ ID NO: 514682 - RNA, 20 nt, Human
ucccuccacuuuccccuggc

SEQ ID NO: 514683 - RNA, 24 nt, Human
ugcuccagccucuccccccagccc

SEQ ID NO: 514684 - RNA, 20 nt, Human
ugcucgcuccucuggggcca

SEQ ID NO: 514685 - RNA, 23 nt, Human
uggggaggcagcauggcagcagu

SEQ ID NO: 514686 - RNA, 23 nt, Human
uggggccagccuggggaggcagc

SEQ ID NO: 514687 - RNA, 21 nt, Human
uucuaagcaaccuuuauuugc

SEQ ID NO: 514688 - RNA, 23 nt, Human
uucucucucucucucucccgcca

SEQ ID NO: 514689 - RNA, 22 nt, Human
uuggggugcuccagccucuccc

SEQ ID NO: 514690 - RNA, 22 nt, Human
uuugcaaacucugagguuggac

SEQ ID NO: 514691 - RNA, 18 nt, Human
aaaaaaaaccaaggaaca

SEQ ID NO: 514692 - RNA, 22 nt, Human
aaaaaaaaccaaggaacagaag

SEQ ID NO: 514693 - RNA, 19 nt, Human
aaaaacagaaacacaaacc

SEQ ID NO: 514694 - RNA, 27 nt, Human
aaaacagaaacacaaaccaaaagagaa

SEQ ID NO: 514695 - RNA, 18 nt, Human
aaaacccaaaagauacag

SEQ ID NO: 514696 - RNA, 23 nt, Human
aaaagaaaaaaaaaaaaaccaag

SEQ ID NO: 514697 - RNA, 21 nt, Human
aaaagggacaaggacaauaua

SEQ ID NO: 514698 - RNA, 22 nt, Human
aaacaacuauuucuuucauaaa

SEQ ID NO: 514699 - RNA, 18 nt, Human
aaacagaaaagaaaaaaa

SEQ ID NO: 514700 - RNA, 19 nt, Human
aaacagaaacacaaaccaa

SEQ ID NO: 514701 - RNA, 21 nt, Human
aaacagaaacacaaaccaaaa

SEQ ID NO: 514702 - RNA, 21 nt, Human
aaaccaaggaacagaagccug

SEQ ID NO: 514703 - RNA, 22 nt, Human
aaagaaauguucauauuagaaa

SEQ ID NO: 514704 - RNA, 21 nt, Human
aaaguuuauuuuaaggcuuua

SEQ ID NO: 514705 - RNA, 24 nt, Human
aaauccuuaccaaaacaaaacaaa

SEQ ID NO: 514706 - RNA, 23 nt, Human
aacaagucacacacauacauagu

SEQ ID NO: 514707 - RNA, 24 nt, Human
aacagaaacacaaaccaaaagaga

SEQ ID NO: 514708 - RNA, 21 nt, Human
aaccagaugugucacuuccac

SEQ ID NO: 514709 - RNA, 28 nt, Human
aaccuucugguuuuuaaaacucagagga

SEQ ID NO: 514710 - RNA, 20 nt, Human
aacuaagaaauccuucugaa

SEQ ID NO: 514711 - RNA, 21 nt, Human
aacuucuaccucugaaugcuc

SEQ ID NO: 514712 - RNA, 24 nt, Human
aagaaaaaacaacuauuucuuuca

SEQ ID NO: 514713 - RNA, 18 nt, Human
aagccaaucuuaguucaa

SEQ ID NO: 514714 - RNA, 19 nt, Human
aauucugcauccauacgaa

SEQ ID NO: 514715 - RNA, 24 nt, Human
acaaccuauuuucaacaucacaca

SEQ ID NO: 514716 - RNA, 18 nt, Human
accaaacagaaaagaaaa

SEQ ID NO: 514717 - RNA, 25 nt, Human
accaaacagaaaagaaaaaaaaaaa

SEQ ID NO: 514718 - RNA, 24 nt, Human
accuauuggacauguacggauucu

SEQ ID NO: 514719 - RNA, 22 nt, Human
agaaaaaaaaaaaaaccaagga

SEQ ID NO: 514720 - RNA, 20 nt, Human
agaaaaaugaaacauuuaau

SEQ ID NO: 514721 - RNA, 22 nt, Human
agaaagggcucaagagacaaaa

SEQ ID NO: 514722 - RNA, 18 nt, Human
agaagaaaucaaagaaag

SEQ ID NO: 514723 - RNA, 22 nt, Human
agaagccuggcauaauagagga

SEQ ID NO: 514724 - RNA, 22 nt, Human
agaaucacagaaauaauugccg

SEQ ID NO: 514725 - RNA, 18 nt, Human
agagacaaaacaguaaaa

SEQ ID NO: 514726 - RNA, 19 nt, Human
agagacaaaacaguaaaac

SEQ ID NO: 514727 - RNA, 18 nt, Human
auaaagaaggaagccaua

SEQ ID NO: 514728 - RNA, 19 nt, Human
auacauaaagaaggaagcc

SEQ ID NO: 514729 - RNA, 25 nt, Human
aucauuauuuccagauggggaaaca

SEQ ID NO: 514730 - RNA, 24 nt, Human
augccccaucgauacagaauaaaa

SEQ ID NO: 514731 - RNA, 24 nt, Human
caaaaaugacuauaauaaugccau

SEQ ID NO: 514732 - RNA, 28 nt, Human
caaaacaaaacaaacccagguagguuca

SEQ ID NO: 514733 - RNA, 22 nt, Human
caaaacccaaaagauacagaaa

SEQ ID NO: 514734 - RNA, 23 nt, Human
caaaagauacagaaauauuucac

SEQ ID NO: 514735 - RNA, 23 nt, Human
caaauggccauaauaugucacuc

SEQ ID NO: 514736 - RNA, 20 nt, Human
caagauaaucccaccucuga

SEQ ID NO: 514737 - RNA, 20 nt, Human
caaguaucucugcgguuuua

SEQ ID NO: 514738 - RNA, 18 nt, Human
caccaugaaagacugcua

SEQ ID NO: 514739 - RNA, 21 nt, Human
cacuaaaugcccagauuuuaa

SEQ ID NO: 514740 - RNA, 20 nt, Human
cacuugaaugguaucaaaug

SEQ ID NO: 514741 - RNA, 19 nt, Human
cagaagccuggcauaauag

SEQ ID NO: 514742 - RNA, 20 nt, Human
caguacacuuguacugggac

SEQ ID NO: 514743 - RNA, 23 nt, Human
ccaaacagaaaagaaaaaaaaaa

SEQ ID NO: 514744 - RNA, 19 nt, Human
ccacuccagcuccagagca

SEQ ID NO: 514745 - RNA, 22 nt, Human
cccacuccagcuccagagcaca

SEQ ID NO: 514746 - RNA, 18 nt, Human
cccauguuucagaaauca

SEQ ID NO: 514747 - RNA, 22 nt, Human
cccuuucugauaaucaucauca

SEQ ID NO: 514748 - RNA, 20 nt, Human
ccuguuuauccucuuggucu

SEQ ID NO: 514749 - RNA, 22 nt, Human
cgccagaaggaauuuaacuuag

SEQ ID NO: 514750 - RNA, 25 nt, Human
cuaacauagaaauuagcaacuucua

SEQ ID NO: 514751 - RNA, 22 nt, Human
cucaagagacaaaacaguaaaa

SEQ ID NO: 514752 - RNA, 23 nt, Human
cucaagagacaaaacaguaaaac

SEQ ID NO: 514753 - RNA, 25 nt, Human
cugaaaauacacaaauuauuuucaa

SEQ ID NO: 514754 - RNA, 21 nt, Human
cugaagccaaucuuaguucaa

SEQ ID NO: 514755 - RNA, 24 nt, Human
cugaagccaaucuuaguucaagua

SEQ ID NO: 514756 - RNA, 20 nt, Human
gaaaaacagaaacacaaacc

SEQ ID NO: 514757 - RNA, 21 nt, Human
gaucauuuuugugacuuuaac

SEQ ID NO: 514758 - RNA, 20 nt, Human
gcuuuaggggguuucguggg

SEQ ID NO: 514759 - RNA, 25 nt, Human
ggaaaaacagaaacacaaaccaaaa

SEQ ID NO: 514760 - RNA, 18 nt, Human
ggaagccauacaugguua

SEQ ID NO: 514761 - RNA, 18 nt, Human
gguuuucuuuuuuuauuu

SEQ ID NO: 514762 - RNA, 19 nt, Human
guccuguuuauccucuugg

SEQ ID NO: 514763 - RNA, 20 nt, Human
uaaaaagucuuccaugaaga

SEQ ID NO: 514764 - RNA, 21 nt, Human
uaaaacuccaaauaggaauua

SEQ ID NO: 514765 - RNA, 19 nt, Human
uaaaauagcccauacuuac

SEQ ID NO: 514766 - RNA, 20 nt, Human
uaaauauauacauauguaug

SEQ ID NO: 514767 - RNA, 23 nt, Human
uaaauauauacauauguaugacc

SEQ ID NO: 514768 - RNA, 23 nt, Human
uaaauccuuaccaaaacaaaaca

SEQ ID NO: 514769 - RNA, 25 nt, Human
uaauugccgaggcuccauggcuagu

SEQ ID NO: 514770 - RNA, 18 nt, Human
uacaguacacaaaccugg

SEQ ID NO: 514771 - RNA, 24 nt, Human
uacauagugcuuacuauauguuag

SEQ ID NO: 514772 - RNA, 19 nt, Human
uaccaaaacaaaacaaacc

SEQ ID NO: 514773 - RNA, 19 nt, Human
uaccaaaacaaaacaaacc

SEQ ID NO: 514774 - RNA, 21 nt, Human
uaccaaaacaaaacaaaccca

SEQ ID NO: 514775 - RNA, 23 nt, Human
uagaaaugagaccauaccacuca

SEQ ID NO: 514776 - RNA, 22 nt, Human
uagauagauggauauguauuuu

SEQ ID NO: 514777 - RNA, 18 nt, Human
uauaugccugaaaacaga

SEQ ID NO: 514778 - RNA, 24 nt, Human
uaucagagaaauucaguucuauaa

SEQ ID NO: 514779 - RNA, 20 nt, Human
uaucuugcucaccuauucuc

SEQ ID NO: 514780 - RNA, 19 nt, Human
uaugcauaacaauauauag

SEQ ID NO: 514781 - RNA, 21 nt, Human
uauuagucagguuaaaucaaa

SEQ ID NO: 514782 - RNA, 21 nt, Human
ucaaaacccaaaagauacaga

SEQ ID NO: 514783 - RNA, 18 nt, Human
ucaaaagggacaaggaca

SEQ ID NO: 514784 - RNA, 18 nt, Human
ucaacuuucccuaacucu

SEQ ID NO: 514785 - RNA, 21 nt, Human
ucaauauuucaacugucaaaa

SEQ ID NO: 514786 - RNA, 23 nt, Human
ucacacauuaaaagaacuaagaa

SEQ ID NO: 514787 - RNA, 20 nt, Human
ucacugcaaugcuaugagau

SEQ ID NO: 514788 - RNA, 21 nt, Human
ucacuugaaugguaucaaaug

SEQ ID NO: 514789 - RNA, 23 nt, Human
ucagcacugauaugaaaaauacg

SEQ ID NO: 514790 - RNA, 24 nt, Human
ucauuauuuccagauggggaaaca

SEQ ID NO: 514791 - RNA, 20 nt, Human
uccagauggggaaacagaau

SEQ ID NO: 514792 - RNA, 18 nt, Human
uccagcuccagagcacau

SEQ ID NO: 514793 - RNA, 21 nt, Human
ucucacugcaaugcuaugaga

SEQ ID NO: 514794 - RNA, 22 nt, Human
ucugaaugcucacucaguaaau

SEQ ID NO: 514795 - RNA, 19 nt, Human
ucugucacuaaaugcccag

SEQ ID NO: 514796 - RNA, 26 nt, Human
ugaaaaaauaucugauuuuaagucag

SEQ ID NO: 514797 - RNA, 23 nt, Human
ugaaaaguauucaucaaagcuaa

SEQ ID NO: 514798 - RNA, 26 nt, Human
ugaaagagccaaagcuugcaucugag

SEQ ID NO: 514799 - RNA, 24 nt, Human
ugaaaggauggauuauuaaggcca

SEQ ID NO: 514800 - RNA, 21 nt, Human
ugaacccacuccagcuccaga

SEQ ID NO: 514801 - RNA, 21 nt, Human
ugaagaaauucacagcuuaaa

SEQ ID NO: 514802 - RNA, 20 nt, Human
ugaaguuuuuauuaaagagc

SEQ ID NO: 514803 - RNA, 19 nt, Human
ugagauaagugguauuauc

SEQ ID NO: 514804 - RNA, 22 nt, Human
ugaucugucacuaaaugcccag

SEQ ID NO: 514805 - RNA, 27 nt, Human
ugccauguggcuuuggggacucuggag

SEQ ID NO: 514806 - RNA, 19 nt, Human
ugccccaucgauacagaau

SEQ ID NO: 514807 - RNA, 18 nt, Human
ugcgguuuuaguccuuca

SEQ ID NO: 514808 - RNA, 23 nt, Human
uggaaaaacagaaacacaaacca

SEQ ID NO: 514809 - RNA, 25 nt, Human
uggaaaaacagaaacacaaaccaaa

SEQ ID NO: 514810 - RNA, 28 nt, Human
uggaaaaacagaaacacaaaccaaaaga

SEQ ID NO: 514811 - RNA, 21 nt, Human
uguauacacaguuuauauaua

SEQ ID NO: 514812 - RNA, 22 nt, Human
uguauggagacacauaugcaua

SEQ ID NO: 514813 - RNA, 19 nt, Human
ugucagcacugauaugaaa

SEQ ID NO: 514814 - RNA, 19 nt, Human
uuaaauaaacaucacaaaa

SEQ ID NO: 514815 - RNA, 21 nt, Human
uuauauuguccuguuuauccu

SEQ ID NO: 514816 - RNA, 19 nt, Human
uucaaaaaguuugacuauu

SEQ ID NO: 514817 - RNA, 18 nt, Human
uucaaccagaugugucac

SEQ ID NO: 514818 - RNA, 18 nt, Human
uuccaaguaucucugcgg

SEQ ID NO: 514819 - RNA, 20 nt, Human
uuccagauggggaaacagaa

SEQ ID NO: 514820 - RNA, 18 nt, Human
uucuggaaaaacagaaac

SEQ ID NO: 514821 - RNA, 22 nt, Human
uuuaugaaagagccaaagcuug

SEQ ID NO: 514822 - RNA, 20 nt, Human
aaaacacaaaagggaaugua

SEQ ID NO: 514823 - RNA, 28 nt, Human
aaaauaggagaaaacucucaauaaggaa

SEQ ID NO: 514824 - RNA, 19 nt, Human
aaagagacaaaacagccaa

SEQ ID NO: 514825 - RNA, 19 nt, Human
aacccgagcacagggacac

SEQ ID NO: 514826 - RNA, 18 nt, Human
aagagaagagaacaaaga

SEQ ID NO: 514827 - RNA, 25 nt, Human
aagagaagagaacaaagagacaaaa

SEQ ID NO: 514828 - RNA, 22 nt, Human
aagagacaaaacagccaaagcg

SEQ ID NO: 514829 - RNA, 20 nt, Human
aagcccagggaaagaaggau

SEQ ID NO: 514830 - RNA, 21 nt, Human
aaugugcagccuccaaacccc

SEQ ID NO: 514831 - RNA, 20 nt, Human
acaaaagggaauguagacac

SEQ ID NO: 514832 - RNA, 19 nt, Human
acaaacagggucacggugc

SEQ ID NO: 514833 - RNA, 19 nt, Human
acccgagcacagggacaca

SEQ ID NO: 514834 - RNA, 20 nt, Human
acuguguuugaacugggauu

SEQ ID NO: 514835 - RNA, 23 nt, Human
agaaccaccaggggugggaggaa

SEQ ID NO: 514836 - RNA, 18 nt, Human
agacaaaacagccaaagc

SEQ ID NO: 514837 - RNA, 21 nt, Human
agagaggggcacacagggucu

SEQ ID NO: 514838 - RNA, 24 nt, Human
agaggaagagaagagaacaaagag

SEQ ID NO: 514839 - RNA, 18 nt, Human
agaguugaaaggaagaug

SEQ ID NO: 514840 - RNA, 24 nt, Human
agccaaagcggggucccacaaaca

SEQ ID NO: 514841 - RNA, 25 nt, Human
agccaaagcggggucccacaaacag

SEQ ID NO: 514842 - RNA, 24 nt, Human
agcgggugggcuggggaagcccag

SEQ ID NO: 514843 - RNA, 22 nt, Human
agugaauaaaacacaaaaggga

SEQ ID NO: 514844 - RNA, 27 nt, Human
auaaaacacaaaagggaauguagacaa

SEQ ID NO: 514845 - RNA, 23 nt, Human
caagaacagcuccaggggagucc

SEQ ID NO: 514846 - RNA, 18 nt, Human
caauaagcucuaccaacc

SEQ ID NO: 514847 - RNA, 18 nt, Human
cacagggucugagagucu

SEQ ID NO: 514848 - RNA, 23 nt, Human
cagcggcuaacuagauggcuggu

SEQ ID NO: 514849 - RNA, 20 nt, Human
cagggucugagagucugggg

SEQ ID NO: 514850 - RNA, 23 nt, Human
cauauaaaacuccccucauggaa

SEQ ID NO: 514851 - RNA, 22 nt, Human
ccacuucacgaaaggaccagcu

SEQ ID NO: 514852 - RNA, 18 nt, Human
ccccucauggaagccagg

SEQ ID NO: 514853 - RNA, 26 nt, Human
ccgcugagugaccagugcagccaugc

SEQ ID NO: 514854 - RNA, 18 nt, Human
ccuccagcagcaugaggg

SEQ ID NO: 514855 - RNA, 18 nt, Human
ccucuaggauacucaacu

SEQ ID NO: 514856 - RNA, 24 nt, Human
cggugcagagaggggcacacaggg

SEQ ID NO: 514857 - RNA, 22 nt, Human
cuaccaaccaacaaucuauguu

SEQ ID NO: 514858 - RNA, 18 nt, Human
cucucaauaaggauuuuu

SEQ ID NO: 514859 - RNA, 22 nt, Human
cugcacugacugggacaccgca

SEQ ID NO: 514860 - RNA, 20 nt, Human
cuucacgaaaggaccagcuu

SEQ ID NO: 514861 - RNA, 25 nt, Human
cuuucuggcaaugugcagccuccaa

SEQ ID NO: 514862 - RNA, 19 nt, Human
gaaaggcuuccugaaggag

SEQ ID NO: 514863 - RNA, 20 nt, Human
gaaaucaaucauuugucagg

SEQ ID NO: 514864 - RNA, 19 nt, Human
gaagagaagagaacaaaga

SEQ ID NO: 514865 - RNA, 20 nt, Human
gaagagaagagaacaaagag

SEQ ID NO: 514866 - RNA, 23 nt, Human
gaagaggcuccaaaagccaggga

SEQ ID NO: 514867 - RNA, 24 nt, Human
gaagcuguaugcguggucugcagg

SEQ ID NO: 514868 - RNA, 20 nt, Human
gacucagaaaacggagucag

SEQ ID NO: 514869 - RNA, 18 nt, Human
gacuguguuugaacuggg

SEQ ID NO: 514870 - RNA, 22 nt, Human
gagaacaaagagacaaaacagc

SEQ ID NO: 514871 - RNA, 19 nt, Human
gagacaaaacagccaaagc

SEQ ID NO: 514872 - RNA, 21 nt, Human
gagugacgaagagggaaggga

SEQ ID NO: 514873 - RNA, 22 nt, Human
gaguugaaaggaagaugaggcu

SEQ ID NO: 514874 - RNA, 20 nt, Human
ggaaagaaggaucucuucag

SEQ ID NO: 514875 - RNA, 22 nt, Human
ggaaaucacagaaagguggagc

SEQ ID NO: 514876 - RNA, 20 nt, Human
ggaagcccagggaaagaagg

SEQ ID NO: 514877 - RNA, 23 nt, Human
ggagauagcugggccgcugagug

SEQ ID NO: 514878 - RNA, 18 nt, Human
ggagcuggaacuagguag

SEQ ID NO: 514879 - RNA, 23 nt, Human
ggccgcugagugaccagugcagc

SEQ ID NO: 514880 - RNA, 19 nt, Human
gggaagcccagggaaagaa

SEQ ID NO: 514881 - RNA, 18 nt, Human
gggagugacgaagaggga

SEQ ID NO: 514882 - RNA, 24 nt, Human
ggggugggaggaaggggauggcug

SEQ ID NO: 514883 - RNA, 26 nt, Human
gucaagaacagcuccaggggagucca

SEQ ID NO: 514884 - RNA, 24 nt, Human
gugaagaucacaguaaggaccaga

SEQ ID NO: 514885 - RNA, 22 nt, Human
uaaaauaggagaaaacucucaa

SEQ ID NO: 514886 - RNA, 20 nt, Human
uaaauucuuucaugucaccu

SEQ ID NO: 514887 - RNA, 19 nt, Human
uaagaacacaaaucacucc

SEQ ID NO: 514888 - RNA, 24 nt, Human
uaagaagacaagguucuugacuca

SEQ ID NO: 514889 - RNA, 19 nt, Human
uaagcucuaccaaccaaca

SEQ ID NO: 514890 - RNA, 21 nt, Human
uagcaggacucagaaaacgga

SEQ ID NO: 514891 - RNA, 26 nt, Human
uaggagaagcuguaugcguggucugc

SEQ ID NO: 514892 - RNA, 24 nt, Human
ucaaauuuagcaauaagcucuacc

SEQ ID NO: 514893 - RNA, 26 nt, Human
ucaagaacagcuccaggggaguccac

SEQ ID NO: 514894 - RNA, 22 nt, Human
ucaagaggaagagaagagaaca

SEQ ID NO: 514895 - RNA, 22 nt, Human
ucacaguaaggaccagacaauc

SEQ ID NO: 514896 - RNA, 21 nt, Human
ucuucagagaccaagaaaggc

SEQ ID NO: 514897 - RNA, 24 nt, Human
ugaauaaaacacaaaagggaaugu

SEQ ID NO: 514898 - RNA, 23 nt, Human
ugaggcuucuaagaacacaaauc

SEQ ID NO: 514899 - RNA, 20 nt, Human
ugauuuaaaauaggagaaaa

SEQ ID NO: 514900 - RNA, 20 nt, Human
ugcguggucugcaggcagau

SEQ ID NO: 514901 - RNA, 21 nt, Human
uggcuggugauaccauucaca

SEQ ID NO: 514902 - RNA, 20 nt, Human
ugggaggaaggggauggcug

SEQ ID NO: 514903 - RNA, 24 nt, Human
ugugcagccuccaaaccccacuuc

SEQ ID NO: 514904 - RNA, 23 nt, Human
ugugugccugaggccugcauggg

SEQ ID NO: 514905 - RNA, 20 nt, Human
uguuuggggaugccagugag

SEQ ID NO: 514906 - RNA, 21 nt, Human
uguuuggggaugccagugagg

SEQ ID NO: 514907 - RNA, 24 nt, Human
uguuuggggaugccagugaggcug

SEQ ID NO: 514908 - RNA, 22 nt, Human
uucaagaggaagagaagagaac

SEQ ID NO: 514909 - RNA, 24 nt, Human
aaaaccaccaugagacaccagcuc

SEQ ID NO: 514910 - RNA, 19 nt, Human
aaacaaaaaaaagucacug

SEQ ID NO: 514911 - RNA, 19 nt, Human
aaacagcagcaagcacaug

SEQ ID NO: 514912 - RNA, 19 nt, Human
aaaccaccaugagacacca

SEQ ID NO: 514913 - RNA, 22 nt, Human
aaagcuccguggccugggcagg

SEQ ID NO: 514914 - RNA, 26 nt, Human
aaccugcugcccaaacugacccaugg

SEQ ID NO: 514915 - RNA, 23 nt, Human
aagagcacaugcguccaagaaca

SEQ ID NO: 514916 - RNA, 19 nt, Human
aagcaggugaggugaggga

SEQ ID NO: 514917 - RNA, 23 nt, Human
aagcaggugaggugagggacaga

SEQ ID NO: 514918 - RNA, 18 nt, Human
aagccucggaacacagac

SEQ ID NO: 514919 - RNA, 23 nt, Human
aaggacucccuccccaacgagcc

SEQ ID NO: 514920 - RNA, 20 nt, Human
aauugcuugagcccaggagg

SEQ ID NO: 514921 - RNA, 24 nt, Human
aauugcuugagcccaggaggcgga

SEQ ID NO: 514922 - RNA, 22 nt, Human
acaagaaaaaauauauuaauua

SEQ ID NO: 514923 - RNA, 21 nt, Human
acaagacccccagccucacac

SEQ ID NO: 514924 - RNA, 20 nt, Human
acagagcaagacccugucuc

SEQ ID NO: 514925 - RNA, 20 nt, Human
acagagcaagacccugucuc

SEQ ID NO: 514926 - RNA, 22 nt, Human
accagagucaccguggcaacag

SEQ ID NO: 514927 - RNA, 19 nt, Human
acccaaccugcugcccaaa

SEQ ID NO: 514928 - RNA, 18 nt, Human
acgccacuguacuccagc

SEQ ID NO: 514929 - RNA, 21 nt, Human
acgccacuguacuccagccug

SEQ ID NO: 514930 - RNA, 24 nt, Human
acgcccccuggccagccccgacuc

SEQ ID NO: 514931 - RNA, 20 nt, Human
acucaagaggcugagguggg

SEQ ID NO: 514932 - RNA, 24 nt, Human
acugcuguuuuaaaccacuaaggu

SEQ ID NO: 514933 - RNA, 24 nt, Human
acuguacuccagccugggugacag

SEQ ID NO: 514934 - RNA, 26 nt, Human
acuguacuccagccugggugacagag

SEQ ID NO: 514935 - RNA, 21 nt, Human
agaaaaauuugaggacagagg

SEQ ID NO: 514936 - RNA, 22 nt, Human
agaaaaauuugaggacagaggg

SEQ ID NO: 514937 - RNA, 22 nt, Human
agaaacaaacaaaaaaaaguca

SEQ ID NO: 514938 - RNA, 18 nt, Human
agacagaaaucacacaac

SEQ ID NO: 514939 - RNA, 20 nt, Human
agacccccagccucacacaa

SEQ ID NO: 514940 - RNA, 22 nt, Human
agacgcucaaagucacgagucc

SEQ ID NO: 514941 - RNA, 20 nt, Human
agagacaccuggccuuggga

SEQ ID NO: 514942 - RNA, 18 nt, Human
agccaccaucccguccug

SEQ ID NO: 514943 - RNA, 21 nt, Human
agcccagcagcccugagccuu

SEQ ID NO: 514944 - RNA, 22 nt, Human
agccugggcaacauacugagac

SEQ ID NO: 514945 - RNA, 18 nt, Human
agccuugugcugggggau

SEQ ID NO: 514946 - RNA, 24 nt, Human
agcuacucaggaggcugagguggg

SEQ ID NO: 514947 - RNA, 22 nt, Human
agcuggcaugguggugcgugcc

SEQ ID NO: 514948 - RNA, 20 nt, Human
aggaauuugagaucagccug

SEQ ID NO: 514949 - RNA, 24 nt, Human
aggaucgcuugaggccaggaauuu

SEQ ID NO: 514950 - RNA, 23 nt, Human
aggcaggcagggagugcaccugg

SEQ ID NO: 514951 - RNA, 23 nt, Human
aggcagggagugcaccuggaggg

SEQ ID NO: 514952 - RNA, 21 nt, Human
aggccucuccuccucccgccu

SEQ ID NO: 514953 - RNA, 19 nt, Human
aggcggaggcuguaaugag

SEQ ID NO: 514954 - RNA, 24 nt, Human
aggcugaggugggagaauugcuug

SEQ ID NO: 514955 - RNA, 24 nt, Human
aggcugaggugggaggaucgcuug

SEQ ID NO: 514956 - RNA, 21 nt, Human
aggugaggugagggacagaga

SEQ ID NO: 514957 - RNA, 18 nt, Human
aggugggaggaucgcuug

SEQ ID NO: 514958 - RNA, 23 nt, Human
aggugggaggaucgcuugaggcc

SEQ ID NO: 514959 - RNA, 24 nt, Human
aguggcucucgccuauaaucccag

SEQ ID NO: 514960 - RNA, 24 nt, Human
aucacgccacuguacuccagccug

SEQ ID NO: 514961 - RNA, 20 nt, Human
aucgcuugaggccaggaauu

SEQ ID NO: 514962 - RNA, 22 nt, Human
augacccugaggccgugugggc

SEQ ID NO: 514963 - RNA, 20 nt, Human
augcaggggugcaaagagga

SEQ ID NO: 514964 - RNA, 24 nt, Human
caaaaccaccaugagacaccagcu

SEQ ID NO: 514965 - RNA, 24 nt, Human
caaaaucacgccacuguacuccag

SEQ ID NO: 514966 - RNA, 23 nt, Human
caacauacugagacccagucagu

SEQ ID NO: 514967 - RNA, 22 nt, Human
caagacccccagccucacacaa

SEQ ID NO: 514968 - RNA, 25 nt, Human
caagacccccagccucacacaaugg

SEQ ID NO: 514969 - RNA, 24 nt, Human
caaggacucccuccccaacgagcc

SEQ ID NO: 514970 - RNA, 22 nt, Human
cacaugcguccaagaacagcag

SEQ ID NO: 514971 - RNA, 22 nt, Human
caccagaagagcacaugcgucc

SEQ ID NO: 514972 - RNA, 22 nt, Human
caccaggggccuggcuccccac

SEQ ID NO: 514973 - RNA, 25 nt, Human
caccaugagacaccagcucacccca

SEQ ID NO: 514974 - RNA, 20 nt, Human
caccguggcaacaggugaca

SEQ ID NO: 514975 - RNA, 21 nt, Human
cacguauucacgggucccacc

SEQ ID NO: 514976 - RNA, 22 nt, Human
cacugcaggaccaacauucucc

SEQ ID NO: 514977 - RNA, 19 nt, Human
cacuguacuccagccuggg

SEQ ID NO: 514978 - RNA, 19 nt, Human
cacuguacuccagccuggg

SEQ ID NO: 514979 - RNA, 19 nt, Human
cacuguacuccagccuggg

SEQ ID NO: 514980 - RNA, 21 nt, Human
cacuguacuccagccugggug

SEQ ID NO: 514981 - RNA, 22 nt, Human
cacuguacuccagccuggguga

SEQ ID NO: 514982 - RNA, 24 nt, Human
cacuguacuccagccugggugaca

SEQ ID NO: 514983 - RNA, 25 nt, Human
cacuguacuccagccugggugacag

SEQ ID NO: 514984 - RNA, 26 nt, Human
cagaagagcacaugcguccaagaaca

SEQ ID NO: 514985 - RNA, 21 nt, Human
cagagcaagacccugucucuu

SEQ ID NO: 514986 - RNA, 21 nt, Human
cagcagcccugagccuuacac

SEQ ID NO: 514987 - RNA, 19 nt, Human
cagccccucucugagccac

SEQ ID NO: 514988 - RNA, 19 nt, Human
cagccggccccuccugaag

SEQ ID NO: 514989 - RNA, 24 nt, Human
cagcuacucaggaggcugaggugg

SEQ ID NO: 514990 - RNA, 22 nt, Human
caggacaggcaaaucaaaacca

SEQ ID NO: 514991 - RNA, 18 nt, Human
caggaccaacauucucca

SEQ ID NO: 514992 - RNA, 19 nt, Human
caggaggcaggcagggagu

SEQ ID NO: 514993 - RNA, 24 nt, Human
cagguacucaagaggcugaggugg

SEQ ID NO: 514994 - RNA, 20 nt, Human
caguuccccucuccccaaac

SEQ ID NO: 514995 - RNA, 20 nt, Human
caucagagcccagcagcccu

SEQ ID NO: 514996 - RNA, 26 nt, Human
caugacccugaggccgugugggcaga

SEQ ID NO: 514997 - RNA, 21 nt, Human
caugucagaugugcacaugcc

SEQ ID NO: 514998 - RNA, 22 nt, Human
ccacacaccuccaaugggugcu

SEQ ID NO: 514999 - RNA, 20 nt, Human
ccacuguacuccagccuggg

SEQ ID NO: 515000 - RNA, 20 nt, Human
ccacuguacuccagccuggg

SEQ ID NO: 515001 - RNA, 20 nt, Human
ccacuguacuccagccuggg

SEQ ID NO: 515002 - RNA, 21 nt, Human
ccacuguacuccagccugggu

SEQ ID NO: 515003 - RNA, 21 nt, Human
ccacuguacuccagccugggu

SEQ ID NO: 515004 - RNA, 24 nt, Human
ccacuguacuccagccugggugac

SEQ ID NO: 515005 - RNA, 21 nt, Human
ccagaccaggcagccccucuc

SEQ ID NO: 515006 - RNA, 19 nt, Human
ccaugcccaggaaaggaac

SEQ ID NO: 515007 - RNA, 24 nt, Human
cccaaacugacccaugggggagac

SEQ ID NO: 515008 - RNA, 21 nt, Human
cccacaagacccccagccuca

SEQ ID NO: 515009 - RNA, 24 nt, Human
cccacaccaggggccuggcucccc

SEQ ID NO: 515010 - RNA, 23 nt, Human
cccagcagcccugagccuuacac

SEQ ID NO: 515011 - RNA, 21 nt, Human
cccccgccugacugccuccuc

SEQ ID NO: 515012 - RNA, 18 nt, Human
ccccucucugagccacca

SEQ ID NO: 515013 - RNA, 22 nt, Human
ccccucucugagccaccauccc

SEQ ID NO: 515014 - RNA, 18 nt, Human
ccccuggccagccccgac

SEQ ID NO: 515015 - RNA, 20 nt, Human
ccccuggccagccccgacuc

SEQ ID NO: 515016 - RNA, 21 nt, Human
ccuauaaucccagcuacucag

SEQ ID NO: 515017 - RNA, 22 nt, Human
ccuauaaucccagcuacucagg

SEQ ID NO: 515018 - RNA, 24 nt, Human
ccucccgccugucaggccccagac

SEQ ID NO: 515019 - RNA, 18 nt, Human
ccucuccuccucccgccu

SEQ ID NO: 515020 - RNA, 22 nt, Human
ccugcagaaaacucaugacccu

SEQ ID NO: 515021 - RNA, 22 nt, Human
ccuggagggugggcucugugga

SEQ ID NO: 515022 - RNA, 20 nt, Human
ccugggugacagagcaagac

SEQ ID NO: 515023 - RNA, 20 nt, Human
ccuugugcugggggaucccc

SEQ ID NO: 515024 - RNA, 24 nt, Human
cgccaaggacucccuccccaacga

SEQ ID NO: 515025 - RNA, 18 nt, Human
cgccuauaaucccagcua

SEQ ID NO: 515026 - RNA, 24 nt, Human
cgccuauaaucccagcuacucagg

SEQ ID NO: 515027 - RNA, 21 nt, Human
cggaacacagacggggaccaa

SEQ ID NO: 515028 - RNA, 18 nt, Human
cucaagaggcugaggugg

SEQ ID NO: 515029 - RNA, 21 nt, Human
cucacacaauggggugugccc

SEQ ID NO: 515030 - RNA, 18 nt, Human
cucaggaggcugaggugg

SEQ ID NO: 515031 - RNA, 24 nt, Human
cucccgccugucaggccccagacc

SEQ ID NO: 515032 - RNA, 20 nt, Human
cuccguggccugggcaggag

SEQ ID NO: 515033 - RNA, 21 nt, Human
cugggccaccaugcccaggaa

SEQ ID NO: 515034 - RNA, 24 nt, Human
cuggguccugucugcccuaugcgg

SEQ ID NO: 515035 - RNA, 21 nt, Human
cugucaggccccagaccaggc

SEQ ID NO: 515036 - RNA, 18 nt, Human
gaacagcagcugggcagg

SEQ ID NO: 515037 - RNA, 20 nt, Human
gaacagcagcugggcagggg

SEQ ID NO: 515038 - RNA, 23 nt, Human
gaagggaguagucugauccuagc

SEQ ID NO: 515039 - RNA, 19 nt, Human
gacaccagcucaccccauc

SEQ ID NO: 515040 - RNA, 24 nt, Human
gaccaacaguuccccucuccccaa

SEQ ID NO: 515041 - RNA, 18 nt, Human
gagggacagagagggcug

SEQ ID NO: 515042 - RNA, 24 nt, Human
gaggugggagaauugcuugagccc

SEQ ID NO: 515043 - RNA, 22 nt, Human
gaggugggaggaucgcuugagg

SEQ ID NO: 515044 - RNA, 24 nt, Human
gaggugggaggaucgcuugaggcc

SEQ ID NO: 515045 - RNA, 24 nt, Human
gaucgcuugaggccaggaauuuga

SEQ ID NO: 515046 - RNA, 23 nt, Human
gcaagaaugagagggaagacaga

SEQ ID NO: 515047 - RNA, 23 nt, Human
gcaggcaggcacguguguccugc

SEQ ID NO: 515048 - RNA, 23 nt, Human
gcauuggcugagcgucuguggug

SEQ ID NO: 515049 - RNA, 19 nt, Human
gccacuguacuccagccug

SEQ ID NO: 515050 - RNA, 24 nt, Human
gccacuguacuccagccuggguga

SEQ ID NO: 515051 - RNA, 19 nt, Human
gccccgacucucucucuca

SEQ ID NO: 515052 - RNA, 22 nt, Human
gccuggcugagcagcugagggg

SEQ ID NO: 515053 - RNA, 22 nt, Human
gcugggccaccaugcccaggaa

SEQ ID NO: 515054 - RNA, 23 nt, Human
ggcaaaucaaaaccaccaugaga

SEQ ID NO: 515055 - RNA, 23 nt, Human
ggccccaauuaagugaagaaugc

SEQ ID NO: 515056 - RNA, 20 nt, Human
gggcuucugagcagggaccc

SEQ ID NO: 515057 - RNA, 22 nt, Human
ggggcugcguggggcuucugag

SEQ ID NO: 515058 - RNA, 20 nt, Human
ggguagcaggcaggcacgug

SEQ ID NO: 515059 - RNA, 20 nt, Human
gggugggcucuguggacagg

SEQ ID NO: 515060 - RNA, 24 nt, Human
guacuccagccugggugacagagc

SEQ ID NO: 515061 - RNA, 19 nt, Human
guggguauggggggcuuuc

SEQ ID NO: 515062 - RNA, 20 nt, Human
uaaaagguuaaaaugguaag

SEQ ID NO: 515063 - RNA, 19 nt, Human
uaaaaugguaaguccuaug

SEQ ID NO: 515064 - RNA, 26 nt, Human
uaaaccacuaagguuugcuagaauuu

SEQ ID NO: 515065 - RNA, 23 nt, Human
uaaucgccacugcaggaccaaca

SEQ ID NO: 515066 - RNA, 22 nt, Human
uacuccagccugggugacagag

SEQ ID NO: 515067 - RNA, 22 nt, Human
uagcaaccagagucaccguggc

SEQ ID NO: 515068 - RNA, 21 nt, Human
ucaaaucugagcgccaaggac

SEQ ID NO: 515069 - RNA, 23 nt, Human
ucaccaagccucggaacacagac

SEQ ID NO: 515070 - RNA, 23 nt, Human
ucacgccacuguacuccagccug

SEQ ID NO: 515071 - RNA, 22 nt, Human
ucaggacaggcaaaucaaaacc

SEQ ID NO: 515072 - RNA, 19 nt, Human
ucagguggcugccugcaga

SEQ ID NO: 515073 - RNA, 24 nt, Human
uccagccugggugacagagcaaga

SEQ ID NO: 515074 - RNA, 26 nt, Human
ucccaccagaagagcacaugcgucca

SEQ ID NO: 515075 - RNA, 22 nt, Human
uccccaaacaagacaggggcca

SEQ ID NO: 515076 - RNA, 19 nt, Human
uccccaacgagccuugugc

SEQ ID NO: 515077 - RNA, 22 nt, Human
ucuccccaaacaagacaggggc

SEQ ID NO: 515078 - RNA, 19 nt, Human
ucucugagccaccaucccg

SEQ ID NO: 515079 - RNA, 18 nt, Human
ucugagcgccaaggacuc

SEQ ID NO: 515080 - RNA, 18 nt, Human
ucugcccaagccacgccc

SEQ ID NO: 515081 - RNA, 23 nt, Human
ucugcccuaugcggaacaagauc

SEQ ID NO: 515082 - RNA, 22 nt, Human
ugacagagcaagacccugucuc

SEQ ID NO: 515083 - RNA, 21 nt, Human
ugagcacucuccucugcccaa

SEQ ID NO: 515084 - RNA, 21 nt, Human
ugagcagcugaggggucagcc

SEQ ID NO: 515085 - RNA, 23 nt, Human
ugagcagggacccacaccagggg

SEQ ID NO: 515086 - RNA, 21 nt, Human
ugagccuuacacgggacccaa

SEQ ID NO: 515087 - RNA, 20 nt, Human
ugaggugagggacagagagg

SEQ ID NO: 515088 - RNA, 23 nt, Human
ugaggugggagaauugcuugagc

SEQ ID NO: 515089 - RNA, 24 nt, Human
ugaggugggagaauugcuugagcc

SEQ ID NO: 515090 - RNA, 20 nt, Human
ugaggugggaggaucgcuug

SEQ ID NO: 515091 - RNA, 23 nt, Human
ugaggugggaggaucgcuugagg

SEQ ID NO: 515092 - RNA, 24 nt, Human
ugaggugggaggaucgcuugaggc

SEQ ID NO: 515093 - RNA, 26 nt, Human
ugaggugggaggaucgcuugaggcca

SEQ ID NO: 515094 - RNA, 19 nt, Human
ugcaggaggcaggcaggga

SEQ ID NO: 515095 - RNA, 21 nt, Human
ugcccaaacugacccaugggg

SEQ ID NO: 515096 - RNA, 18 nt, Human
ugccccaggaccgugagc

SEQ ID NO: 515097 - RNA, 18 nt, Human
ugcugcccaaacugaccc

SEQ ID NO: 515098 - RNA, 19 nt, Human
ugcugggcgaccacacacc

SEQ ID NO: 515099 - RNA, 21 nt, Human
ugcuguguccucuggguccug

SEQ ID NO: 515100 - RNA, 18 nt, Human
uggaugcaguggcucucg

SEQ ID NO: 515101 - RNA, 21 nt, Human
uggcaacaggugacaucagag

SEQ ID NO: 515102 - RNA, 26 nt, Human
uggccagccccgacucucucucucaa

SEQ ID NO: 515103 - RNA, 19 nt, Human
ugggcaggagcgcccccgc

SEQ ID NO: 515104 - RNA, 24 nt, Human
ugguggugcgugccuaccauccca

SEQ ID NO: 515105 - RNA, 24 nt, Human
ugguguguccacugcaaaggcaga

SEQ ID NO: 515106 - RNA, 21 nt, Human
ugucaggccccagaccaggca

SEQ ID NO: 515107 - RNA, 24 nt, Human
uguccucuggguccugucugcccu

SEQ ID NO: 515108 - RNA, 21 nt, Human
ugugcugggggauccccuugg

SEQ ID NO: 515109 - RNA, 19 nt, Human
uuagcuggcaugguggugc

SEQ ID NO: 515110 - RNA, 19 nt, Human
uuagcuggcaugguggugc

SEQ ID NO: 515111 - RNA, 24 nt, Human
uucgggauacagugugcccaggaa

SEQ ID NO: 515112 - RNA, 20 nt, Human
uugaggacagagggcugugg

SEQ ID NO: 515113 - RNA, 24 nt, Human
uugcuugagcccaggaggcggagg

SEQ ID NO: 515114 - RNA, 20 nt, Human
uuugcuagaauuugucacca

SEQ ID NO: 515115 - RNA, 24 nt, Human
uuuuaaaccacuaagguuugcuag

SEQ ID NO: 515116 - RNA, 20 nt, Human
uuuuuuuuuucuucagcugg

SEQ ID NO: 515117 - RNA, 25 nt, Human
uuuuuuuuuuuuuucuucagcuggg

SEQ ID NO: 515118 - RNA, 22 nt, Human
uuuuuuuuuuuuuuuucuucag

SEQ ID NO: 515119 - RNA, 21 nt, Human
aagccaaucccccacauccuc

SEQ ID NO: 515120 - RNA, 23 nt, Human
aagcccaacaggaaaccagcagg

SEQ ID NO: 515121 - RNA, 21 nt, Human
aagccucugggcaggcaucug

SEQ ID NO: 515122 - RNA, 18 nt, Human
aagggccgagagacaaca

SEQ ID NO: 515123 - RNA, 26 nt, Human
acaacagaaacagacaccggcacagg

SEQ ID NO: 515124 - RNA, 21 nt, Human
acaacccacuccccacugccu

SEQ ID NO: 515125 - RNA, 21 nt, Human
acagaaaucccaucaagaaca

SEQ ID NO: 515126 - RNA, 21 nt, Human
agaaaucccaucaagaacagc

SEQ ID NO: 515127 - RNA, 22 nt, Human
agagggcccggccugggcuccu

SEQ ID NO: 515128 - RNA, 20 nt, Human
agcacaacccacuccccacu

SEQ ID NO: 515129 - RNA, 19 nt, Human
agcaucaggguuaggguga

SEQ ID NO: 515130 - RNA, 21 nt, Human
agccagcuccuguggggccug

SEQ ID NO: 515131 - RNA, 22 nt, Human
agcugcccaagacggcagcccc

SEQ ID NO: 515132 - RNA, 23 nt, Human
aggaagccucugggcaggcaucu

SEQ ID NO: 515133 - RNA, 22 nt, Human
aggaaggccagccagaccaggc

SEQ ID NO: 515134 - RNA, 20 nt, Human
aggacuccgcgccgcccucc

SEQ ID NO: 515135 - RNA, 22 nt, Human
aggauugggucgggucaggggu

SEQ ID NO: 515136 - RNA, 23 nt, Human
aggcaaggcugggggccccaggc

SEQ ID NO: 515137 - RNA, 18 nt, Human
aggcaucuggggcuccaa

SEQ ID NO: 515138 - RNA, 23 nt, Human
agggugaggauugggucaggggu

SEQ ID NO: 515139 - RNA, 27 nt, Human
aggguuagggugaggauugggucaggg

SEQ ID NO: 515140 - RNA, 23 nt, Human
caacagaaacagacaccggcaca

SEQ ID NO: 515141 - RNA, 18 nt, Human
caacccacuccccacugc

SEQ ID NO: 515142 - RNA, 19 nt, Human
caacccacuccccacugcc

SEQ ID NO: 515143 - RNA, 18 nt, Human
caagaacagcugcaggga

SEQ ID NO: 515144 - RNA, 19 nt, Human
caagacggcagccccacuc

SEQ ID NO: 515145 - RNA, 26 nt, Human
caagacggcagccccacuccagaccc

SEQ ID NO: 515146 - RNA, 21 nt, Human
cacaguucaggauccaagucc

SEQ ID NO: 515147 - RNA, 24 nt, Human
cacgcaacccccggcaggcccacg

SEQ ID NO: 515148 - RNA, 23 nt, Human
cagccagaccaggccuaagccaa

SEQ ID NO: 515149 - RNA, 20 nt, Human
cagcucugggcccauccccc

SEQ ID NO: 515150 - RNA, 20 nt, Human
caucuggggcuccaaagccc

SEQ ID NO: 515151 - RNA, 23 nt, Human
ccacaccugcucagaguuccuua

SEQ ID NO: 515152 - RNA, 18 nt, Human
ccagccagaccaggccua

SEQ ID NO: 515153 - RNA, 18 nt, Human
ccagccagcuccuguggg

SEQ ID NO: 515154 - RNA, 23 nt, Human
ccagcuccuguggggccugcgcc

SEQ ID NO: 515155 - RNA, 19 nt, Human
cccacagcugccagcacaa

SEQ ID NO: 515156 - RNA, 23 nt, Human
cccacagcugccagcacaaccca

SEQ ID NO: 515157 - RNA, 25 nt, Human
cccacagcugccagcacaacccacu

SEQ ID NO: 515158 - RNA, 18 nt, Human
cccaccccgcacaaggaa

SEQ ID NO: 515159 - RNA, 19 nt, Human
cccagguagguucccgggg

SEQ ID NO: 515160 - RNA, 20 nt, Human
cccauagccuccagccagcu

SEQ ID NO: 515161 - RNA, 26 nt, Human
ccccacugccugucacgcaacccccg

SEQ ID NO: 515162 - RNA, 18 nt, Human
ccccauguccugcccaga

SEQ ID NO: 515163 - RNA, 22 nt, Human
ccccgcacccauagccuccagc

SEQ ID NO: 515164 - RNA, 19 nt, Human
cccggcaggcccacgcccc

SEQ ID NO: 515165 - RNA, 21 nt, Human
cccuggccucaguggccuucc

SEQ ID NO: 515166 - RNA, 20 nt, Human
cccuguaggcaaggcugggg

SEQ ID NO: 515167 - RNA, 21 nt, Human
ccgcacccauagccuccagcc

SEQ ID NO: 515168 - RNA, 18 nt, Human
ccgcgccgcccuccgugc

SEQ ID NO: 515169 - RNA, 24 nt, Human
ccucacucacccacagcugccagc

SEQ ID NO: 515170 - RNA, 23 nt, Human
ccuccagccagcuccuguggggc

SEQ ID NO: 515171 - RNA, 24 nt, Human
ccucccagccauggaccacaccug

SEQ ID NO: 515172 - RNA, 24 nt, Human
ccucugggcaggcaucuggggcuc

SEQ ID NO: 515173 - RNA, 22 nt, Human
ccuggccacugcgguccaggaa

SEQ ID NO: 515174 - RNA, 19 nt, Human
ccuugccuugcugccuugg

SEQ ID NO: 515175 - RNA, 21 nt, Human
cgaggauuggguuaggguggg

SEQ ID NO: 515176 - RNA, 18 nt, Human
cgcacccauagccuccag

SEQ ID NO: 515177 - RNA, 24 nt, Human
cgggaggagcugcccaagacggca

SEQ ID NO: 515178 - RNA, 22 nt, Human
cguccaggacuccgcgccgccc

SEQ ID NO: 515179 - RNA, 23 nt, Human
cucacccacagcugccagcacaa

SEQ ID NO: 515180 - RNA, 25 nt, Human
cuccaaagcccaacaggaaaccagc

SEQ ID NO: 515181 - RNA, 25 nt, Human
cucccagccauggaccacaccugcu

SEQ ID NO: 515182 - RNA, 19 nt, Human
cuccuguggggccugcgcc

SEQ ID NO: 515183 - RNA, 20 nt, Human
cuccuguggggccugcgccg

SEQ ID NO: 515184 - RNA, 20 nt, Human
cucucagggccagauuccac

SEQ ID NO: 515185 - RNA, 18 nt, Human
cugccucccaugaugccc

SEQ ID NO: 515186 - RNA, 18 nt, Human
cuggccucaguggccuuc

SEQ ID NO: 515187 - RNA, 21 nt, Human
cuggccucaguggccuuccug

SEQ ID NO: 515188 - RNA, 21 nt, Human
cuguggggccagcugccuccc

SEQ ID NO: 515189 - RNA, 24 nt, Human
cuuccccagggcccuucaugagag

SEQ ID NO: 515190 - RNA, 20 nt, Human
gaguuagcuuuagaguuggg

SEQ ID NO: 515191 - RNA, 25 nt, Human
gaguuagggcuggguuggguuaggu

SEQ ID NO: 515192 - RNA, 19 nt, Human
gccaaucccccacauccuc

SEQ ID NO: 515193 - RNA, 23 nt, Human
gccccgcacccauagccuccagc

SEQ ID NO: 515194 - RNA, 19 nt, Human
gccuaagccaaucccccac

SEQ ID NO: 515195 - RNA, 24 nt, Human
gcuccaaagcccaacaggaaacca

SEQ ID NO: 515196 - RNA, 27 nt, Human
gcuccaaagcccaacaggaaaccagca

SEQ ID NO: 515197 - RNA, 20 nt, Human
gcugggggccccaggcucug

SEQ ID NO: 515198 - RNA, 18 nt, Human
ggaaggccagccagacca

SEQ ID NO: 515199 - RNA, 20 nt, Human
ggaggugguccccgguuccc

SEQ ID NO: 515200 - RNA, 26 nt, Human
ggaucaggauggcucugcugguggcc

SEQ ID NO: 515201 - RNA, 18 nt, Human
ggcacaggcugggccagc

SEQ ID NO: 515202 - RNA, 19 nt, Human
ggccccaccccaccaggga

SEQ ID NO: 515203 - RNA, 24 nt, Human
ggucagggguuagcaucaggguua

SEQ ID NO: 515204 - RNA, 24 nt, Human
ggucagggguuagcauuaggguua

SEQ ID NO: 515205 - RNA, 20 nt, Human
gguuaggaguuagcuuuaga

SEQ ID NO: 515206 - RNA, 19 nt, Human
gugaccucugcauuuugca

SEQ ID NO: 515207 - RNA, 23 nt, Human
gugguccccgguuccccuccugc

SEQ ID NO: 515208 - RNA, 27 nt, Human
guucccggggugaaaguggugaauggg

SEQ ID NO: 515209 - RNA, 23 nt, Human
guuuacacucucaucuacccucc

SEQ ID NO: 515210 - RNA, 24 nt, Human
uacaaaauggcccucugcuggccg

SEQ ID NO: 515211 - RNA, 20 nt, Human
uacacucucaucuacccucc

SEQ ID NO: 515212 - RNA, 20 nt, Human
uagcccaaccucauaugcag

SEQ ID NO: 515213 - RNA, 19 nt, Human
uagccuccagccagcuccu

SEQ ID NO: 515214 - RNA, 18 nt, Human
ucacgcaacccccggcag

SEQ ID NO: 515215 - RNA, 24 nt, Human
ucacgcaacccccggcaggcccac

SEQ ID NO: 515216 - RNA, 19 nt, Human
ucacugggcagagccggag

SEQ ID NO: 515217 - RNA, 20 nt, Human
ucacugggcagagccggaga

SEQ ID NO: 515218 - RNA, 22 nt, Human
ucaggauggcucugcugguggc

SEQ ID NO: 515219 - RNA, 21 nt, Human
uccaaagcccaacaggaaacc

SEQ ID NO: 515220 - RNA, 25 nt, Human
uccaaagcccaacaggaaaccagca

SEQ ID NO: 515221 - RNA, 23 nt, Human
uccaggaaggccagccagaccag

SEQ ID NO: 515222 - RNA, 23 nt, Human
uccagguuuagcccaaccucaua

SEQ ID NO: 515223 - RNA, 22 nt, Human
ucccaugaugcccagguagguu

SEQ ID NO: 515224 - RNA, 30 nt, Human
ucccccacauccuccaugaggggaccugcu

SEQ ID NO: 515225 - RNA, 20 nt, Human
uccccgguuccccuccugcc

SEQ ID NO: 515226 - RNA, 21 nt, Human
uccccgguuccccuccugcca

SEQ ID NO: 515227 - RNA, 24 nt, Human
ucccuggccucaguggccuuccug

SEQ ID NO: 515228 - RNA, 23 nt, Human
ucccuguaggcaaggcugggggc

SEQ ID NO: 515229 - RNA, 23 nt, Human
uccuccaugaggggaccugccaa

SEQ ID NO: 515230 - RNA, 21 nt, Human
uccuggcugcuuugguuauga

SEQ ID NO: 515231 - RNA, 24 nt, Human
ucugacuggcgaacagaaauccca

SEQ ID NO: 515232 - RNA, 25 nt, Human
ugaccagcuguggagcuucgaggcc

SEQ ID NO: 515233 - RNA, 24 nt, Human
ugaccucugcauuuugcagacacc

SEQ ID NO: 515234 - RNA, 24 nt, Human
ugaggggaccugccaagagcgucc

SEQ ID NO: 515235 - RNA, 23 nt, Human
ugaucacugggcagagccggaga

SEQ ID NO: 515236 - RNA, 19 nt, Human
ugcccaagacggcagcccc

SEQ ID NO: 515237 - RNA, 23 nt, Human
ugccuugcugccuuggcucuggu

SEQ ID NO: 515238 - RNA, 20 nt, Human
ugccuuggcucuggugaccu

SEQ ID NO: 515239 - RNA, 21 nt, Human
ugcuaugugcuguggggccag

SEQ ID NO: 515240 - RNA, 22 nt, Human
uggccgggcccugacuucagcc

SEQ ID NO: 515241 - RNA, 18 nt, Human
ugggcaggcaucuggggc

SEQ ID NO: 515242 - RNA, 18 nt, Human
uggggccagcugccuccc

SEQ ID NO: 515243 - RNA, 23 nt, Human
ugggggccccaggcucuguggcg

SEQ ID NO: 515244 - RNA, 28 nt, Human
uggggucacgguuuucagccgggucccc

SEQ ID NO: 515245 - RNA, 23 nt, Human
ugggucagggguuagcaucaggg

SEQ ID NO: 515246 - RNA, 22 nt, Human
uggguuggguuagguuaagggu

SEQ ID NO: 515247 - RNA, 18 nt, Human
uguccugcccagaugauc

SEQ ID NO: 515248 - RNA, 21 nt, Human
uuagcaucaggguuaggguga

SEQ ID NO: 515249 - RNA, 25 nt, Human
uuagggugggggaugguuuaggggu

SEQ ID NO: 515250 - RNA, 19 nt, Human
uuccccuccugccagcagc

SEQ ID NO: 515251 - RNA, 20 nt, Human
uuccccuccugccagcagcc

SEQ ID NO: 515252 - RNA, 20 nt, Human
uuggguugggguucaggcuc

SEQ ID NO: 515253 - RNA, 18 nt, Human
aaagaaguccagagccuu

SEQ ID NO: 515254 - RNA, 24 nt, Human
aaaggggggcugcccgaagagggc

SEQ ID NO: 515255 - RNA, 22 nt, Human
aaauucacuuuguccucauaag

SEQ ID NO: 515256 - RNA, 19 nt, Human
aagaagccugcucgccagg

SEQ ID NO: 515257 - RNA, 22 nt, Human
aagccacuuccagggcagcuag

SEQ ID NO: 515258 - RNA, 18 nt, Human
aaggaacccuccugagug

SEQ ID NO: 515259 - RNA, 21 nt, Human
acaaagaaguccagagccuug

SEQ ID NO: 515260 - RNA, 22 nt, Human
acagcucuugcccaaggaagca

SEQ ID NO: 515261 - RNA, 28 nt, Human
acaggacccaguaaccaccgaguaacaa

SEQ ID NO: 515262 - RNA, 18 nt, Human
accaagauggcgggcagg

SEQ ID NO: 515263 - RNA, 23 nt, Human
accgaguaacaaaggucucauga

SEQ ID NO: 515264 - RNA, 21 nt, Human
accuggaggcaaaggggggcu

SEQ ID NO: 515265 - RNA, 19 nt, Human
agaaagacugguggguucu

SEQ ID NO: 515266 - RNA, 19 nt, Human
agaaguacccugcgggggc

SEQ ID NO: 515267 - RNA, 23 nt, Human
agagaaaauaauuuaauagagaa

SEQ ID NO: 515268 - RNA, 19 nt, Human
agagaugaggaccaaggaa

SEQ ID NO: 515269 - RNA, 20 nt, Human
agcaggggcccugggccagc

SEQ ID NO: 515270 - RNA, 24 nt, Human
agccugcucgccagggcugcagug

SEQ ID NO: 515271 - RNA, 19 nt, Human
agcucccgccuccggcccg

SEQ ID NO: 515272 - RNA, 23 nt, Human
aggaagcauuuaagggcagaagg

SEQ ID NO: 515273 - RNA, 20 nt, Human
aggcacaggacccaguaacc

SEQ ID NO: 515274 - RNA, 23 nt, Human
aggcugggagggaaugggucaag

SEQ ID NO: 515275 - RNA, 19 nt, Human
agggaggcuggggacucug

SEQ ID NO: 515276 - RNA, 25 nt, Human
agguccccugccucagcagggccug

SEQ ID NO: 515277 - RNA, 24 nt, Human
aggucucaugaaagaagugcuguu

SEQ ID NO: 515278 - RNA, 24 nt, Human
aguaacaaaggucucaugaaagaa

SEQ ID NO: 515279 - RNA, 23 nt, Human
agugccccucugcuccagauggc

SEQ ID NO: 515280 - RNA, 20 nt, Human
agugcuguucucccagaguc

SEQ ID NO: 515281 - RNA, 19 nt, Human
auagagggcugcaugcccc

SEQ ID NO: 515282 - RNA, 18 nt, Human
aucuugaccugcuccuuc

SEQ ID NO: 515283 - RNA, 22 nt, Human
caaaacggacaggcacaggacc

SEQ ID NO: 515284 - RNA, 27 nt, Human
caaaacggacaggcacaggacccagua

SEQ ID NO: 515285 - RNA, 20 nt, Human
caaguauucagcucgggcca

SEQ ID NO: 515286 - RNA, 19 nt, Human
cacguggggauacggaggc

SEQ ID NO: 515287 - RNA, 19 nt, Human
cagccuggguuagugcccc

SEQ ID NO: 515288 - RNA, 23 nt, Human
cagccuggguuagugccccucug

SEQ ID NO: 515289 - RNA, 21 nt, Human
cagcugcugaaucccccuccu

SEQ ID NO: 515290 - RNA, 25 nt, Human
caggaacaaggcuugggcuucuuaa

SEQ ID NO: 515291 - RNA, 20 nt, Human
caggacccaguaaccaccga

SEQ ID NO: 515292 - RNA, 20 nt, Human
caguaggucccggcagucuc

SEQ ID NO: 515293 - RNA, 20 nt, Human
caucagaacccuucagaagu

SEQ ID NO: 515294 - RNA, 20 nt, Human
caugccccaaaacggacagg

SEQ ID NO: 515295 - RNA, 22 nt, Human
ccaaggaagcauuuaagggcag

SEQ ID NO: 515296 - RNA, 23 nt, Human
ccaccgaguaacaaaggucucau

SEQ ID NO: 515297 - RNA, 23 nt, Human
cccaaaagauccagcuuucaugc

SEQ ID NO: 515298 - RNA, 19 nt, Human
cccagaaaggggaaagagc

SEQ ID NO: 515299 - RNA, 20 nt, Human
ccccaaaacggacaggcaca

SEQ ID NO: 515300 - RNA, 18 nt, Human
ccccugccucagcagggc

SEQ ID NO: 515301 - RNA, 26 nt, Human
ccccuugcccucuucucggagccaaa

SEQ ID NO: 515302 - RNA, 20 nt, Human
ccggcucccggcgccccucc

SEQ ID NO: 515303 - RNA, 19 nt, Human
ccuaggccagggcaggaac

SEQ ID NO: 515304 - RNA, 24 nt, Human
ccuaggccagggcaggaacaaggc

SEQ ID NO: 515305 - RNA, 23 nt, Human
ccuccccuccaguauacagcacc

SEQ ID NO: 515306 - RNA, 22 nt, Human
ccucccucucccugucccaggc

SEQ ID NO: 515307 - RNA, 20 nt, Human
ccugcgggggccccuugccc

SEQ ID NO: 515308 - RNA, 18 nt, Human
ccuggccugacgccccuc

SEQ ID NO: 515309 - RNA, 21 nt, Human
ccuggccugacgccccucagc

SEQ ID NO: 515310 - RNA, 21 nt, Human
ccuucaaguauucagcucggg

SEQ ID NO: 515311 - RNA, 18 nt, Human
ccuucagaaguggcccag

SEQ ID NO: 515312 - RNA, 18 nt, Human
ccuugccugaggaaacug

SEQ ID NO: 515313 - RNA, 19 nt, Human
cgccuccggcccgggggcu

SEQ ID NO: 515314 - RNA, 26 nt, Human
cggacaggcacaggacccaguaacca

SEQ ID NO: 515315 - RNA, 19 nt, Human
cggaggcugggagggaaug

SEQ ID NO: 515316 - RNA, 22 nt, Human
cggcucccggcgccccuccccu

SEQ ID NO: 515317 - RNA, 23 nt, Human
cgggcaggugugaguucccagaa

SEQ ID NO: 515318 - RNA, 22 nt, Human
cuccccacugggcaugugcucc

SEQ ID NO: 515319 - RNA, 23 nt, Human
cugcgggggccccuugcccucuu

SEQ ID NO: 515320 - RNA, 22 nt, Human
cugcuccagauggcucacaucu

SEQ ID NO: 515321 - RNA, 24 nt, Human
cuucuagggucacugaagggugca

SEQ ID NO: 515322 - RNA, 20 nt, Human
cuugucccgggccaucucuc

SEQ ID NO: 515323 - RNA, 19 nt, Human
gaagggcaggccaggggca

SEQ ID NO: 515324 - RNA, 23 nt, Human
gaaguacccugcgggggccccuc

SEQ ID NO: 515325 - RNA, 20 nt, Human
gaccaaggaacccuccugag

SEQ ID NO: 515326 - RNA, 18 nt, Human
gaccugcuccuucaagua

SEQ ID NO: 515327 - RNA, 21 nt, Human
gaccuggaggcaaaggggggc

SEQ ID NO: 515328 - RNA, 25 nt, Human
gagauucccucaucuugaccugcuc

SEQ ID NO: 515329 - RNA, 19 nt, Human
gaggcuggggacucuggga

SEQ ID NO: 515330 - RNA, 21 nt, Human
gcaaagaggagcugaguugga

SEQ ID NO: 515331 - RNA, 19 nt, Human
gcagggaggacagacagcu

SEQ ID NO: 515332 - RNA, 21 nt, Human
gcagggaggacagacagcucu

SEQ ID NO: 515333 - RNA, 18 nt, Human
gcccagagggaacggagg

SEQ ID NO: 515334 - RNA, 18 nt, Human
gccccagacucuccccac

SEQ ID NO: 515335 - RNA, 22 nt, Human
gcccgaagagggcuucugugga

SEQ ID NO: 515336 - RNA, 20 nt, Human
gcccgggacacguacugccc

SEQ ID NO: 515337 - RNA, 20 nt, Human
gcgccccgccaguuccugca

SEQ ID NO: 515338 - RNA, 18 nt, Human
gcucccggcgccccuccc

SEQ ID NO: 515339 - RNA, 19 nt, Human
gcuugcccagggcuccacg

SEQ ID NO: 515340 - RNA, 23 nt, Human
ggcagaagggcuacaaaucacca

SEQ ID NO: 515341 - RNA, 25 nt, Human
ggccauggcagcugaagccacuucc

SEQ ID NO: 515342 - RNA, 20 nt, Human
ggcccgggggcuccgcuugg

SEQ ID NO: 515343 - RNA, 21 nt, Human
ggcggcagggcaggccuagaa

SEQ ID NO: 515344 - RNA, 18 nt, Human
gggaaagagcuugcccag

SEQ ID NO: 515345 - RNA, 19 nt, Human
gggaacggaggugggagag

SEQ ID NO: 515346 - RNA, 22 nt, Human
gggagagcaggggccgcaaggg

SEQ ID NO: 515347 - RNA, 24 nt, Human
gggcaggaacaaggcuugggcuuc

SEQ ID NO: 515348 - RNA, 21 nt, Human
ggggacucugggauauggggg

SEQ ID NO: 515349 - RNA, 19 nt, Human
gggggcugcccgaagaggg

SEQ ID NO: 515350 - RNA, 19 nt, Human
ggguucuguggggcugagu

SEQ ID NO: 515351 - RNA, 21 nt, Human
ggguucuguggggcugagugc

SEQ ID NO: 515352 - RNA, 22 nt, Human
gguggucccugagggguguugg

SEQ ID NO: 515353 - RNA, 24 nt, Human
gucaguuuucaucagaacccuuca

SEQ ID NO: 515354 - RNA, 24 nt, Human
gucccgggaagggcaggccagggg

SEQ ID NO: 515355 - RNA, 19 nt, Human
guggaagggaggcagagcg

SEQ ID NO: 515356 - RNA, 19 nt, Human
uaaaccccaaaagauccag

SEQ ID NO: 515357 - RNA, 19 nt, Human
uaggccagggcaggaacaa

SEQ ID NO: 515358 - RNA, 22 nt, Human
ucaaaccaucuguggggugcag

SEQ ID NO: 515359 - RNA, 25 nt, Human
ucaaauacauucuuuuccagguucc

SEQ ID NO: 515360 - RNA, 20 nt, Human
ucacaucuguccaaucauuc

SEQ ID NO: 515361 - RNA, 21 nt, Human
ucagcacuguccauccaagaa

SEQ ID NO: 515362 - RNA, 22 nt, Human
ucagcccgggacacguacugcc

SEQ ID NO: 515363 - RNA, 19 nt, Human
uccaagccucccucucccu

SEQ ID NO: 515364 - RNA, 20 nt, Human
uccagcacaaggcccgcgcu

SEQ ID NO: 515365 - RNA, 23 nt, Human
ucccagaguccugcccuccccuc

SEQ ID NO: 515366 - RNA, 21 nt, Human
ucccagcgagauucccucauc

SEQ ID NO: 515367 - RNA, 24 nt, Human
ucccccuccuggucuuucuucaca

SEQ ID NO: 515368 - RNA, 18 nt, Human
uccccugccucagcaggg

SEQ ID NO: 515369 - RNA, 21 nt, Human
uccgcccggcucccggcgccc

SEQ ID NO: 515370 - RNA, 23 nt, Human
uccugcagggcccacguggggau

SEQ ID NO: 515371 - RNA, 23 nt, Human
uccuggucuuucuucacagccug

SEQ ID NO: 515372 - RNA, 18 nt, Human
ugagguucugaaccucag

SEQ ID NO: 515373 - RNA, 19 nt, Human
ugaguuggaauaagggguc

SEQ ID NO: 515374 - RNA, 25 nt, Human
ugcccgaagagggcuucuguggaag

SEQ ID NO: 515375 - RNA, 20 nt, Human
ugccugaggaaacuguaggc

SEQ ID NO: 515376 - RNA, 21 nt, Human
ugcuacggaucuucucuucca

SEQ ID NO: 515377 - RNA, 19 nt, Human
ugcuugagggauuaaccua

SEQ ID NO: 515378 - RNA, 21 nt, Human
uggaaggagaugcgacggcug

SEQ ID NO: 515379 - RNA, 22 nt, Human
uggaaggagaugcgacggcugg

SEQ ID NO: 515380 - RNA, 21 nt, Human
uggccuugagcuccucagccc

SEQ ID NO: 515381 - RNA, 18 nt, Human
ugggcugugaagguauca

SEQ ID NO: 515382 - RNA, 25 nt, Human
uggggcccagagggaacggaggugg

SEQ ID NO: 515383 - RNA, 23 nt, Human
ugggucaagccuggccugacgcc

SEQ ID NO: 515384 - RNA, 21 nt, Human
ugggucagacugucuccaagc

SEQ ID NO: 515385 - RNA, 22 nt, Human
ugucccaggcucaaacuccagc

SEQ ID NO: 515386 - RNA, 19 nt, Human
ugugaagguaucagcccca

SEQ ID NO: 515387 - RNA, 18 nt, Human
uuacacucagccuccugc

SEQ ID NO: 515388 - RNA, 24 nt, Human
uuccugcagggcccacguggggau

SEQ ID NO: 515389 - RNA, 22 nt, Human
uucuagggucacugaagggugc

SEQ ID NO: 515390 - RNA, 24 nt, Human
uucuguggaagggaggcagagcgg

SEQ ID NO: 515391 - RNA, 21 nt, Human
uugcccagggcuccacggcgg

SEQ ID NO: 515392 - RNA, 26 nt, Human
uuggaagaggagacgauggccuugag

SEQ ID NO: 515393 - RNA, 19 nt, Human
aaaacaaugcuuucuaaag

SEQ ID NO: 515394 - RNA, 24 nt, Human
aaacagagcaaaggauaagacccg

SEQ ID NO: 515395 - RNA, 24 nt, Human
aaagugcugggauuacaggcguga

SEQ ID NO: 515396 - RNA, 20 nt, Human
aaccuagaaacagaaggaga

SEQ ID NO: 515397 - RNA, 22 nt, Human
aaccuugugauccacccaccuc

SEQ ID NO: 515398 - RNA, 22 nt, Human
aaccuugugauccacccaccuc

SEQ ID NO: 515399 - RNA, 24 nt, Human
aaccuugugauccacccaccucgg

SEQ ID NO: 515400 - RNA, 18 nt, Human
aagcucuccagcuccugc

SEQ ID NO: 515401 - RNA, 19 nt, Human
aagcugcugggacuacagg

SEQ ID NO: 515402 - RNA, 20 nt, Human
aagcugcugggacuacaggc

SEQ ID NO: 515403 - RNA, 23 nt, Human
aagcuuccugagaaggauccgaa

SEQ ID NO: 515404 - RNA, 19 nt, Human
aagugcugggauuacaggc

SEQ ID NO: 515405 - RNA, 19 nt, Human
aagugcugggauuacaggc

SEQ ID NO: 515406 - RNA, 26 nt, Human
aagugcugggauuacaggcgugagcc

SEQ ID NO: 515407 - RNA, 21 nt, Human
aaucacgucuacuccuggaca

SEQ ID NO: 515408 - RNA, 25 nt, Human
aauuuuuuguauuuuuuuaguagag

SEQ ID NO: 515409 - RNA, 26 nt, Human
aauuuuuuguauuuuuuuaguagaga

SEQ ID NO: 515410 - RNA, 22 nt, Human
acacuccccccaaccccuacuc

SEQ ID NO: 515411 - RNA, 21 nt, Human
acagacuaucaggacuggacg

SEQ ID NO: 515412 - RNA, 18 nt, Human
acaggguuucacuguguu

SEQ ID NO: 515413 - RNA, 19 nt, Human
acaggguuucacuguguua

SEQ ID NO: 515414 - RNA, 20 nt, Human
acaggguuucacuguguuag

SEQ ID NO: 515415 - RNA, 24 nt, Human
acaggguuucacuguguuagccag

SEQ ID NO: 515416 - RNA, 18 nt, Human
accauucuccagccucag

SEQ ID NO: 515417 - RNA, 19 nt, Human
accuagaaacagaaggaga

SEQ ID NO: 515418 - RNA, 20 nt, Human
accugucugaccauggcugg

SEQ ID NO: 515419 - RNA, 24 nt, Human
accuugugauccacccaccucggc

SEQ ID NO: 515420 - RNA, 22 nt, Human
acuaaaacaaugcuuucuaaag

SEQ ID NO: 515421 - RNA, 26 nt, Human
acuacaggcgcccaccaccacgccaa

SEQ ID NO: 515422 - RNA, 20 nt, Human
acugcaagcuccgccuccug

SEQ ID NO: 515423 - RNA, 20 nt, Human
agaaaaacagagcaaagggg

SEQ ID NO: 515424 - RNA, 22 nt, Human
agaaggauccgaaauccacaga

SEQ ID NO: 515425 - RNA, 21 nt, Human
agacaauccuagaaugggaca

SEQ ID NO: 515426 - RNA, 18 nt, Human
agacaggguuucacugug

SEQ ID NO: 515427 - RNA, 18 nt, Human
agacccggaugacagaug

SEQ ID NO: 515428 - RNA, 21 nt, Human
agagaaaaacagagcaaagga

SEQ ID NO: 515429 - RNA, 19 nt, Human
agagacaggguuucacugu

SEQ ID NO: 515430 - RNA, 22 nt, Human
agagcaaaggauaagacccgga

SEQ ID NO: 515431 - RNA, 22 nt, Human
agcacagcacuccccuagccuc

SEQ ID NO: 515432 - RNA, 21 nt, Human
agccccaagggccuucagaga

SEQ ID NO: 515433 - RNA, 20 nt, Human
agccucaccucuucccccag

SEQ ID NO: 515434 - RNA, 18 nt, Human
agcuccgccuccuggguu

SEQ ID NO: 515435 - RNA, 18 nt, Human
agcugugaggucagucug

SEQ ID NO: 515436 - RNA, 22 nt, Human
aggaagaggagcucuggcuacu

SEQ ID NO: 515437 - RNA, 19 nt, Human
aggaccaggggagggaggg

SEQ ID NO: 515438 - RNA, 22 nt, Human
agggguaaacugaggcucugag

SEQ ID NO: 515439 - RNA, 20 nt, Human
agugcaguggcgcgaucaug

SEQ ID NO: 515440 - RNA, 23 nt, Human
agugcaguggcgcgaucauggcu

SEQ ID NO: 515441 - RNA, 24 nt, Human
agugcaguggcgcgaucauggcuc

SEQ ID NO: 515442 - RNA, 18 nt, Human
agugcugggauuacaggc

SEQ ID NO: 515443 - RNA, 18 nt, Human
caaaggauaagacccgga

SEQ ID NO: 515444 - RNA, 24 nt, Human
caaagugcugggauuacaggcgug

SEQ ID NO: 515445 - RNA, 22 nt, Human
caaccaccaagcuugccccugu

SEQ ID NO: 515446 - RNA, 26 nt, Human
caagacugaagggccaggagggcuga

SEQ ID NO: 515447 - RNA, 18 nt, Human
cacagcacuccccuagcc

SEQ ID NO: 515448 - RNA, 22 nt, Human
cacagcacuccccuagccucac

SEQ ID NO: 515449 - RNA, 26 nt, Human
caccaagacugaagggccaggagggc

SEQ ID NO: 515450 - RNA, 22 nt, Human
caccaaucacgucuacuccugg

SEQ ID NO: 515451 - RNA, 22 nt, Human
cacccaccucggccucccaaag

SEQ ID NO: 515452 - RNA, 23 nt, Human
cacccaccucggccucccaaagu

SEQ ID NO: 515453 - RNA, 22 nt, Human
caccccuuuucacugaugggga

SEQ ID NO: 515454 - RNA, 24 nt, Human
cacccgggcuggagugcaguggcg

SEQ ID NO: 515455 - RNA, 24 nt, Human
caccucggccucccaaagugcugg

SEQ ID NO: 515456 - RNA, 21 nt, Human
caccucugaacuucuaaaccu

SEQ ID NO: 515457 - RNA, 24 nt, Human
caccucugaacuucuaaaccuaga

SEQ ID NO: 515458 - RNA, 20 nt, Human
caccuuccccacucugauuu

SEQ ID NO: 515459 - RNA, 18 nt, Human
cacuccccuagccucacc

SEQ ID NO: 515460 - RNA, 19 nt, Human
cacuccccuagccucaccu

SEQ ID NO: 515461 - RNA, 18 nt, Human
cacuguguuagccaggau

SEQ ID NO: 515462 - RNA, 19 nt, Human
cacuguguuagccaggaug

SEQ ID NO: 515463 - RNA, 24 nt, Human
cacuguguuagccaggauggucuc

SEQ ID NO: 515464 - RNA, 18 nt, Human
cagaaggagacuguacac

SEQ ID NO: 515465 - RNA, 20 nt, Human
cagagcaaaggauaagaccc

SEQ ID NO: 515466 - RNA, 24 nt, Human
cagaugugcuuugcaaaaagcuuc

SEQ ID NO: 515467 - RNA, 23 nt, Human
cagccucagccucccaagcugcu

SEQ ID NO: 515468 - RNA, 25 nt, Human
cagccucagccucccaagcugcugg

SEQ ID NO: 515469 - RNA, 20 nt, Human
caggacuggacggccugcug

SEQ ID NO: 515470 - RNA, 21 nt, Human
caggacuggacggccugcuga

SEQ ID NO: 515471 - RNA, 24 nt, Human
caggguuucacuguguuagccagg

SEQ ID NO: 515472 - RNA, 21 nt, Human
caguggcgcgaucauggcuca

SEQ ID NO: 515473 - RNA, 20 nt, Human
cauggcucacugcaagcucc

SEQ ID NO: 515474 - RNA, 20 nt, Human
ccaaagugcugggauuacag

SEQ ID NO: 515475 - RNA, 22 nt, Human
ccaaagugcugggauuacaggc

SEQ ID NO: 515476 - RNA, 22 nt, Human
ccaaagugcugggauuacaggc

SEQ ID NO: 515477 - RNA, 24 nt, Human
ccaaagugcugggauuacaggcgu

SEQ ID NO: 515478 - RNA, 19 nt, Human
ccaagcuugccccugugcc

SEQ ID NO: 515479 - RNA, 19 nt, Human
ccaccaccacgccaagcga

SEQ ID NO: 515480 - RNA, 20 nt, Human
ccaccauuuuaaugcagggg

SEQ ID NO: 515481 - RNA, 19 nt, Human
ccaugaggaucagccgccu

SEQ ID NO: 515482 - RNA, 22 nt, Human
cccaaccuugugauccacccac

SEQ ID NO: 515483 - RNA, 23 nt, Human
cccaagcugcugggacuacaggc

SEQ ID NO: 515484 - RNA, 18 nt, Human
cccagaacuggcuggggc

SEQ ID NO: 515485 - RNA, 18 nt, Human
ccccaaauaacuuggcca

SEQ ID NO: 515486 - RNA, 21 nt, Human
ccccaaauaacuuggccacca

SEQ ID NO: 515487 - RNA, 21 nt, Human
ccccaagggccuucagagacc

SEQ ID NO: 515488 - RNA, 20 nt, Human
cccccaaccccuacucuggc

SEQ ID NO: 515489 - RNA, 23 nt, Human
ccccucucuaccacucaccuucc

SEQ ID NO: 515490 - RNA, 23 nt, Human
ccccugugcccagguggcaccaa

SEQ ID NO: 515491 - RNA, 18 nt, Human
cccucucuaccacucacc

SEQ ID NO: 515492 - RNA, 24 nt, Human
ccucucuaccacucaccuucccca

SEQ ID NO: 515493 - RNA, 18 nt, Human
ccuggacuaaaacaaugc

SEQ ID NO: 515494 - RNA, 28 nt, Human
ccuggacuaaaacaaugcuuucuaaagc

SEQ ID NO: 515495 - RNA, 19 nt, Human
ccuggggcugaagcugggg

SEQ ID NO: 515496 - RNA, 19 nt, Human
cgccuccuggguucacacc

SEQ ID NO: 515497 - RNA, 22 nt, Human
cuccagccucagccucccaagc

SEQ ID NO: 515498 - RNA, 25 nt, Human
cucccaaccuugugauccacccacc

SEQ ID NO: 515499 - RNA, 21 nt, Human
cucccaagcugcugggacuac

SEQ ID NO: 515500 - RNA, 27 nt, Human
cucccagaacuggcuggggcucccaua

SEQ ID NO: 515501 - RNA, 23 nt, Human
cuccccuagccucaccucuuccc

SEQ ID NO: 515502 - RNA, 18 nt, Human
cucccuuuccuucuccac

SEQ ID NO: 515503 - RNA, 20 nt, Human
cuccuccacccucuucauuu

SEQ ID NO: 515504 - RNA, 21 nt, Human
cuccuggguucacaccauucu

SEQ ID NO: 515505 - RNA, 21 nt, Human
cugacgcuggcuuagggccug

SEQ ID NO: 515506 - RNA, 19 nt, Human
cugcagccugaugugccug

SEQ ID NO: 515507 - RNA, 24 nt, Human
cugccuggcccugucagccccaag

SEQ ID NO: 515508 - RNA, 23 nt, Human
cuggggcugaagcuggggaccuu

SEQ ID NO: 515509 - RNA, 22 nt, Human
cuggugccgcucagccuccucu

SEQ ID NO: 515510 - RNA, 19 nt, Human
cugugccuggacuaaaaca

SEQ ID NO: 515511 - RNA, 18 nt, Human
cuucagagacccccucuc

SEQ ID NO: 515512 - RNA, 24 nt, Human
cuucuaaaccuagaaacagaagga

SEQ ID NO: 515513 - RNA, 24 nt, Human
cuugcucugucacccgggcuggag

SEQ ID NO: 515514 - RNA, 18 nt, Human
gaccauggcuggagaauc

SEQ ID NO: 515515 - RNA, 18 nt, Human
gaccuugagcaaggcccu

SEQ ID NO: 515516 - RNA, 21 nt, Human
gagacggagucuugcucuguc

SEQ ID NO: 515517 - RNA, 18 nt, Human
gaggcucugagcaggcca

SEQ ID NO: 515518 - RNA, 18 nt, Human
gauuacaggcgugagcca

SEQ ID NO: 515519 - RNA, 21 nt, Human
gauuacaggcgugagccacug

SEQ ID NO: 515520 - RNA, 24 nt, Human
gauuacaggcgugagccacugugc

SEQ ID NO: 515521 - RNA, 18 nt, Human
gccucaccucuuccccca

SEQ ID NO: 515522 - RNA, 25 nt, Human
gccuccuggguucacaccauucucc

SEQ ID NO: 515523 - RNA, 18 nt, Human
gccuggaaagccuccagc

SEQ ID NO: 515524 - RNA, 20 nt, Human
gccuucagagacccccucuc

SEQ ID NO: 515525 - RNA, 21 nt, Human
gcucacugcaagcuccgccuc

SEQ ID NO: 515526 - RNA, 19 nt, Human
gcuggagugcaguggcgcg

SEQ ID NO: 515527 - RNA, 23 nt, Human
gcuguggaaauggagaaacacag

SEQ ID NO: 515528 - RNA, 22 nt, Human
ggacaguuauagcugugucccc

SEQ ID NO: 515529 - RNA, 20 nt, Human
ggagaaacacagucaccucu

SEQ ID NO: 515530 - RNA, 21 nt, Human
ggaucaggggcagugggagga

SEQ ID NO: 515531 - RNA, 22 nt, Human
ggaucaggggcagugggaggag

SEQ ID NO: 515532 - RNA, 18 nt, Human
ggaugcaccuugccuggu

SEQ ID NO: 515533 - RNA, 20 nt, Human
ggcagugggaggaggaguua

SEQ ID NO: 515534 - RNA, 19 nt, Human
gggccagggagaggaagau

SEQ ID NO: 515535 - RNA, 19 nt, Human
ggugagaggugugggaggg

SEQ ID NO: 515536 - RNA, 22 nt, Human
ggugagggccagggagaggaag

SEQ ID NO: 515537 - RNA, 24 nt, Human
ggugugggagggacagaagcuuug

SEQ ID NO: 515538 - RNA, 18 nt, Human
guaaaagccugggccugg

SEQ ID NO: 515539 - RNA, 24 nt, Human
gugauccacccaccucggccuccc

SEQ ID NO: 515540 - RNA, 19 nt, Human
guggacacgacucuggccc

SEQ ID NO: 515541 - RNA, 23 nt, Human
uaaaccuagaaacagaaggagac

SEQ ID NO: 515542 - RNA, 23 nt, Human
uaagaguccuuugaccagucccc

SEQ ID NO: 515543 - RNA, 22 nt, Human
uacaggcgugagccacugugcc

SEQ ID NO: 515544 - RNA, 22 nt, Human
uacaggcgugagccacugugcc

SEQ ID NO: 515545 - RNA, 23 nt, Human
uacaggcgugagccacugugccu

SEQ ID NO: 515546 - RNA, 21 nt, Human
uacgcucauucuucaucucga

SEQ ID NO: 515547 - RNA, 22 nt, Human
uacucuggccuucagacaaucc

SEQ ID NO: 515548 - RNA, 22 nt, Human
uagagacaggguuucacugugu

SEQ ID NO: 515549 - RNA, 22 nt, Human
uagaugaauggacucacaacca

SEQ ID NO: 515550 - RNA, 20 nt, Human
uaguagagacaggguuucac

SEQ ID NO: 515551 - RNA, 24 nt, Human
uaguagagacaggguuucacugug

SEQ ID NO: 515552 - RNA, 19 nt, Human
ucaaucucccaaccuugug

SEQ ID NO: 515553 - RNA, 20 nt, Human
ucaaucucccaaccuuguga

SEQ ID NO: 515554 - RNA, 19 nt, Human
ucacagaucugauuuucca

SEQ ID NO: 515555 - RNA, 24 nt, Human
ucacccgggcuggagugcaguggc

SEQ ID NO: 515556 - RNA, 18 nt, Human
ucacugcaagcuccgccu

SEQ ID NO: 515557 - RNA, 23 nt, Human
ucacugcaagcuccgccuccugg

SEQ ID NO: 515558 - RNA, 24 nt, Human
ucacugcaagcuccgccuccuggg

SEQ ID NO: 515559 - RNA, 24 nt, Human
ucacuguguuagccaggauggucu

SEQ ID NO: 515560 - RNA, 20 nt, Human
uccacacuccccccaacccc

SEQ ID NO: 515561 - RNA, 24 nt, Human
ucccaaagugcugggauuacaggc

SEQ ID NO: 515562 - RNA, 23 nt, Human
ucccaaccuugugauccacccac

SEQ ID NO: 515563 - RNA, 24 nt, Human
ucccaagcugcugggacuacaggc

SEQ ID NO: 515564 - RNA, 20 nt, Human
uccccaaauaacuuggccac

SEQ ID NO: 515565 - RNA, 24 nt, Human
uccccccaaccccuacucuggccu

SEQ ID NO: 515566 - RNA, 21 nt, Human
uccccccaccauuuuaaugca

SEQ ID NO: 515567 - RNA, 22 nt, Human
uccgaaauccacagacuaucag

SEQ ID NO: 515568 - RNA, 22 nt, Human
uccugcucccagaacuggcugg

SEQ ID NO: 515569 - RNA, 19 nt, Human
uccuguugcagggucguaa

SEQ ID NO: 515570 - RNA, 24 nt, Human
ucgaugacaaaguguaagcucucc

SEQ ID NO: 515571 - RNA, 18 nt, Human
ucggccucccaaagugcu

SEQ ID NO: 515572 - RNA, 23 nt, Human
ucuaaagcgcauucugcagccug

SEQ ID NO: 515573 - RNA, 18 nt, Human
ucuauggucuccugcugg

SEQ ID NO: 515574 - RNA, 24 nt, Human
ucuccagccucagccucccaagcu

SEQ ID NO: 515575 - RNA, 20 nt, Human
ucuccagcuccugcucccag

SEQ ID NO: 515576 - RNA, 24 nt, Human
ucugucacccgggcuggagugcag

SEQ ID NO: 515577 - RNA, 23 nt, Human
ucuugcucugucacccgggcugg

SEQ ID NO: 515578 - RNA, 24 nt, Human
ucuugcucugucacccgggcugga

SEQ ID NO: 515579 - RNA, 20 nt, Human
ugaaaaagaaacuaaguggg

SEQ ID NO: 515580 - RNA, 25 nt, Human
ugaacuucuaaaccuagaaacagaa

SEQ ID NO: 515581 - RNA, 19 nt, Human
ugaagggccaggagggcug

SEQ ID NO: 515582 - RNA, 22 nt, Human
ugaauggacucacaaccaccaa

SEQ ID NO: 515583 - RNA, 19 nt, Human
ugagcaggccaggguggag

SEQ ID NO: 515584 - RNA, 18 nt, Human
ugaggaauaggaaccugc

SEQ ID NO: 515585 - RNA, 23 nt, Human
ugagggccagggagaggaagauu

SEQ ID NO: 515586 - RNA, 21 nt, Human
ugaggugagaggugugggagg

SEQ ID NO: 515587 - RNA, 24 nt, Human
ugauccacccaccucggccuccca

SEQ ID NO: 515588 - RNA, 22 nt, Human
ugaugccucagcuggggaggcu

SEQ ID NO: 515589 - RNA, 22 nt, Human
ugcccagguggcaccaagacug

SEQ ID NO: 515590 - RNA, 19 nt, Human
ugccgcucagccuccucug

SEQ ID NO: 515591 - RNA, 20 nt, Human
ugccuggacuaaaacaaugc

SEQ ID NO: 515592 - RNA, 24 nt, Human
ugcgggguuuguccacacuccccc

SEQ ID NO: 515593 - RNA, 24 nt, Human
ugcucugucacccgggcuggagug

SEQ ID NO: 515594 - RNA, 21 nt, Human
ugcugggacuacaggcgccca

SEQ ID NO: 515595 - RNA, 24 nt, Human
ugcugggauuacaggcgugagcca

SEQ ID NO: 515596 - RNA, 22 nt, Human
uggagaaacacagucaccucug

SEQ ID NO: 515597 - RNA, 21 nt, Human
uggagugcaguggcgcgauca

SEQ ID NO: 515598 - RNA, 24 nt, Human
uggagugcaguggcgcgaucaugg

SEQ ID NO: 515599 - RNA, 20 nt, Human
uggccuggaaagccuccagc

SEQ ID NO: 515600 - RNA, 23 nt, Human
uggccuggaaagccuccagcugu

SEQ ID NO: 515601 - RNA, 18 nt, Human
uggccuucagacaauccu

SEQ ID NO: 515602 - RNA, 20 nt, Human
uggcuggggcucccauaauc

SEQ ID NO: 515603 - RNA, 25 nt, Human
uggcuguggaaauggagaaacacag

SEQ ID NO: 515604 - RNA, 21 nt, Human
ugggacuacaggcgcccacca

SEQ ID NO: 515605 - RNA, 24 nt, Human
ugggacuacaggcgcccaccacca

SEQ ID NO: 515606 - RNA, 18 nt, Human
ugggaucaggggcagugg

SEQ ID NO: 515607 - RNA, 18 nt, Human
ugggauuacaggcgugag

SEQ ID NO: 515608 - RNA, 21 nt, Human
ugggauuacaggcgugagcca

SEQ ID NO: 515609 - RNA, 22 nt, Human
ugggauuacaggcgugagccac

SEQ ID NO: 515610 - RNA, 22 nt, Human
ugggauuacaggcgugagccac

SEQ ID NO: 515611 - RNA, 22 nt, Human
ugggauuacaggcgugagccac

SEQ ID NO: 515612 - RNA, 23 nt, Human
ugggauuacaggcgugagccacu

SEQ ID NO: 515613 - RNA, 24 nt, Human
ugggauuacaggcgugagccacug

SEQ ID NO: 515614 - RNA, 18 nt, Human
uguaaaagccugggccug

SEQ ID NO: 515615 - RNA, 23 nt, Human
ugugaggugagaggugugggagg

SEQ ID NO: 515616 - RNA, 21 nt, Human
uuaguagagacaggguuucac

SEQ ID NO: 515617 - RNA, 24 nt, Human
uuaguagagacaggguuucacugu

SEQ ID NO: 515618 - RNA, 21 nt, Human
uucacuguguuagccaggaug

SEQ ID NO: 515619 - RNA, 23 nt, Human
uuccagagccugaagagaaaaac

SEQ ID NO: 515620 - RNA, 26 nt, Human
uucuucuuuuccuccucauguugcug

SEQ ID NO: 515621 - RNA, 22 nt, Human
uugcagggucguaauuuuuucc

SEQ ID NO: 515622 - RNA, 24 nt, Human
uugcucugucacccgggcuggagu

SEQ ID NO: 515623 - RNA, 20 nt, Human
uugguggacacgacucuggc

SEQ ID NO: 515624 - RNA, 23 nt, Human
uuguccacacuccccccaacccc

SEQ ID NO: 515625 - RNA, 19 nt, Human
uuucacuguguuagccagg

SEQ ID NO: 515626 - RNA, 24 nt, Human
uuuuuaguagagacaggguuucac

SEQ ID NO: 515627 - RNA, 23 nt, Human
uuuuuguauuuuuuuaguagaga

SEQ ID NO: 515628 - RNA, 23 nt, Human
uuuuuuaguagagacaggguuuc

SEQ ID NO: 515629 - RNA, 26 nt, Human
uuuuuuguauuuuuuuaguagagaca

SEQ ID NO: 515630 - RNA, 19 nt, Human
aaacaaagaagaaaacacc

SEQ ID NO: 515631 - RNA, 22 nt, Human
aaacaaagaagaaaacaccugu

SEQ ID NO: 515632 - RNA, 18 nt, Human
aaacauaacuagcuggca

SEQ ID NO: 515633 - RNA, 23 nt, Human
aaacauggaauaaacaaagaaga

SEQ ID NO: 515634 - RNA, 22 nt, Human
aacauuucucuaaacauaacua

SEQ ID NO: 515635 - RNA, 18 nt, Human
aaccucggccucuugagc

SEQ ID NO: 515636 - RNA, 24 nt, Human
aagugauccuucugccuuggccuc

SEQ ID NO: 515637 - RNA, 19 nt, Human
aaugugcugggauuacagg

SEQ ID NO: 515638 - RNA, 22 nt, Human
acaugcucacaauucuacaaga

SEQ ID NO: 515639 - RNA, 19 nt, Human
acuacaggugugugccauu

SEQ ID NO: 515640 - RNA, 21 nt, Human
acuugugcuuugugugugguu

SEQ ID NO: 515641 - RNA, 22 nt, Human
agaaaauaacccauuucuuaac

SEQ ID NO: 515642 - RNA, 18 nt, Human
agaucugaaccugaacuc

SEQ ID NO: 515643 - RNA, 21 nt, Human
agcuaaucugaauacugucuc

SEQ ID NO: 515644 - RNA, 18 nt, Human
agcuacuuuagauuucca

SEQ ID NO: 515645 - RNA, 21 nt, Human
agcuucccgaguagcugggac

SEQ ID NO: 515646 - RNA, 22 nt, Human
aggcacugagagguuaguaacu

SEQ ID NO: 515647 - RNA, 22 nt, Human
agggaacaggcacugagagguu

SEQ ID NO: 515648 - RNA, 25 nt, Human
aggugauccucccaccuuagcuucc

SEQ ID NO: 515649 - RNA, 23 nt, Human
aguagcugggacuacaggugugu

SEQ ID NO: 515650 - RNA, 24 nt, Human
aguggcaucugauguauggggaga

SEQ ID NO: 515651 - RNA, 21 nt, Human
aguuucacauuauuuugcuag

SEQ ID NO: 515652 - RNA, 24 nt, Human
auccucauuuugcaaacgagggaa

SEQ ID NO: 515653 - RNA, 19 nt, Human
augugcugggauuacaggu

SEQ ID NO: 515654 - RNA, 18 nt, Human
caaagacccggcaugaag

SEQ ID NO: 515655 - RNA, 19 nt, Human
caacuaaaccaacaagcag

SEQ ID NO: 515656 - RNA, 19 nt, Human
caaggcuggguccagcauc

SEQ ID NO: 515657 - RNA, 22 nt, Human
caagugauccuucugccuuggc

SEQ ID NO: 515658 - RNA, 27 nt, Human
caagugauccuucugccuuggccuccc

SEQ ID NO: 515659 - RNA, 27 nt, Human
caagugauccuucugccuuggccuccc

SEQ ID NO: 515660 - RNA, 27 nt, Human
caaugugcugggauuacaggugucagu

SEQ ID NO: 515661 - RNA, 24 nt, Human
caccuuagcuucccgaguagcugg

SEQ ID NO: 515662 - RNA, 19 nt, Human
cagaauacauagauguuca

SEQ ID NO: 515663 - RNA, 19 nt, Human
cagcccaggaaaagggcua

SEQ ID NO: 515664 - RNA, 24 nt, Human
cagcggcauuagguugguuagugg

SEQ ID NO: 515665 - RNA, 24 nt, Human
caggguuuucccauguuguccagg

SEQ ID NO: 515666 - RNA, 25 nt, Human
caggugugugccauuaugccuggcu

SEQ ID NO: 515667 - RNA, 19 nt, Human
caguaccaaaauuacacac

SEQ ID NO: 515668 - RNA, 21 nt, Human
caugauacaaaaucugaaaac

SEQ ID NO: 515669 - RNA, 19 nt, Human
caugcucacaucccuggcu

SEQ ID NO: 515670 - RNA, 23 nt, Human
cauguuguccaggcuggucucaa

SEQ ID NO: 515671 - RNA, 24 nt, Human
cauguuguccaggcuggucucaaa

SEQ ID NO: 515672 - RNA, 25 nt, Human
ccaaacucuaguugacuauguauau

SEQ ID NO: 515673 - RNA, 18 nt, Human
ccaacuaaaccaacaagc

SEQ ID NO: 515674 - RNA, 21 nt, Human
ccaaugugcugggauuacagg

SEQ ID NO: 515675 - RNA, 24 nt, Human
ccaaugugcugggauuacaggugu

SEQ ID NO: 515676 - RNA, 19 nt, Human
ccaccaggaccucuggaac

SEQ ID NO: 515677 - RNA, 23 nt, Human
ccagaauacauagauguucagua

SEQ ID NO: 515678 - RNA, 19 nt, Human
ccauccaacuaaaccaaca

SEQ ID NO: 515679 - RNA, 24 nt, Human
ccauccaacuaaaccaacaagcag

SEQ ID NO: 515680 - RNA, 24 nt, Human
cccaccuuagcuucccgaguagcu

SEQ ID NO: 515681 - RNA, 19 nt, Human
cccauguuguccaggcugg

SEQ ID NO: 515682 - RNA, 22 nt, Human
cccccuggguugugccagcagc

SEQ ID NO: 515683 - RNA, 23 nt, Human
cccgaguagcugggacuacaggu

SEQ ID NO: 515684 - RNA, 24 nt, Human
cccgaguagcugggacuacaggug

SEQ ID NO: 515685 - RNA, 19 nt, Human
ccuccauuuucuccccuuc

SEQ ID NO: 515686 - RNA, 24 nt, Human
ccucccaccuuagcuucccgagua

SEQ ID NO: 515687 - RNA, 19 nt, Human
ccugggcucaagugauccu

SEQ ID NO: 515688 - RNA, 20 nt, Human
ccugggcucaagugauccuu

SEQ ID NO: 515689 - RNA, 22 nt, Human
ccugggcucaagugauccuucu

SEQ ID NO: 515690 - RNA, 24 nt, Human
cggcacaaucacggcucacugcaa

SEQ ID NO: 515691 - RNA, 28 nt, Human
cggcacaaucacggcucacugcaaccuc

SEQ ID NO: 515692 - RNA, 21 nt, Human
cggcaugaagucuugccagag

SEQ ID NO: 515693 - RNA, 20 nt, Human
cuaaaaaucagcaaaaugcu

SEQ ID NO: 515694 - RNA, 24 nt, Human
cucaagugauccuucugccuuggc

SEQ ID NO: 515695 - RNA, 24 nt, Human
cucaggugauccucccaccuuagc

SEQ ID NO: 515696 - RNA, 18 nt, Human
cuccauuuucuccccuuc

SEQ ID NO: 515697 - RNA, 21 nt, Human
cucgcaagccccggaucucag

SEQ ID NO: 515698 - RNA, 18 nt, Human
cugcagcaggcucugacc

SEQ ID NO: 515699 - RNA, 20 nt, Human
cugccuuggccucccaaugu

SEQ ID NO: 515700 - RNA, 23 nt, Human
cugccuuggccucccaaugugcu

SEQ ID NO: 515701 - RNA, 25 nt, Human
cugggcugcacugcagcaggcuccc

SEQ ID NO: 515702 - RNA, 23 nt, Human
cuggggccacugacuggucuucu

SEQ ID NO: 515703 - RNA, 22 nt, Human
cuggguccagcaucucccuggg

SEQ ID NO: 515704 - RNA, 20 nt, Human
cuguugcuuaguuacaaagu

SEQ ID NO: 515705 - RNA, 24 nt, Human
cuuagcuucccgaguagcugggac

SEQ ID NO: 515706 - RNA, 18 nt, Human
cuucugcuggaagcugag

SEQ ID NO: 515707 - RNA, 24 nt, Human
gaagaugcaugcccuuugaauggc

SEQ ID NO: 515708 - RNA, 23 nt, Human
gacaggguuuucccauguugucc

SEQ ID NO: 515709 - RNA, 24 nt, Human
gacuacaggugugugccauuaugc

SEQ ID NO: 515710 - RNA, 20 nt, Human
gagacaggguuuucccaugu

SEQ ID NO: 515711 - RNA, 24 nt, Human
gagcucaggugauccucccaccuu

SEQ ID NO: 515712 - RNA, 26 nt, Human
gaguagcugggacuacaggugugugc

SEQ ID NO: 515713 - RNA, 25 nt, Human
gaguggcucucugguuagagaaagg

SEQ ID NO: 515714 - RNA, 23 nt, Human
gauccagcugcuuccaaaacugg

SEQ ID NO: 515715 - RNA, 21 nt, Human
gcggacacauauguaugaaug

SEQ ID NO: 515716 - RNA, 24 nt, Human
ggacuacaggugugugccauuaug

SEQ ID NO: 515717 - RNA, 26 nt, Human
ggagaugcaaauucccacauaccccc

SEQ ID NO: 515718 - RNA, 24 nt, Human
ggccucuugagcucaggugauccu

SEQ ID NO: 515719 - RNA, 19 nt, Human
ggcucacugcaaccucggc

SEQ ID NO: 515720 - RNA, 18 nt, Human
gggacacagucgugcucc

SEQ ID NO: 515721 - RNA, 22 nt, Human
gggagagggggauagagacagg

SEQ ID NO: 515722 - RNA, 21 nt, Human
gggcucaagugauccuucugc

SEQ ID NO: 515723 - RNA, 22 nt, Human
gggcucaagugauccuucugcc

SEQ ID NO: 515724 - RNA, 24 nt, Human
gggggagagggggauagagacagg

SEQ ID NO: 515725 - RNA, 19 nt, Human
guaaaacauggaauaaaca

SEQ ID NO: 515726 - RNA, 18 nt, Human
guacauuuugguagcuuu

SEQ ID NO: 515727 - RNA, 18 nt, Human
guggagugccuggugucc

SEQ ID NO: 515728 - RNA, 23 nt, Human
guggagugccugguguccaguau

SEQ ID NO: 515729 - RNA, 22 nt, Human
guuuucccauguuguccaggcu

SEQ ID NO: 515730 - RNA, 23 nt, Human
guuuucccauguuguccaggcug

SEQ ID NO: 515731 - RNA, 24 nt, Human
guuuucccauguuguccaggcugg

SEQ ID NO: 515732 - RNA, 25 nt, Human
uaaacaaaggucacgccaaucaacg

SEQ ID NO: 515733 - RNA, 24 nt, Human
uaacugcccgcggugacacaacua

SEQ ID NO: 515734 - RNA, 25 nt, Human
uaagugcaaagcccagaucugaacc

SEQ ID NO: 515735 - RNA, 19 nt, Human
uacaaaaucugaaaacuga

SEQ ID NO: 515736 - RNA, 23 nt, Human
uagaaaauaacccauuucuuaac

SEQ ID NO: 515737 - RNA, 22 nt, Human
uagagacaggguuuucccaugu

SEQ ID NO: 515738 - RNA, 22 nt, Human
uaguacaagauggcggcacuuu

SEQ ID NO: 515739 - RNA, 22 nt, Human
uaguaucauccucauuuugcaa

SEQ ID NO: 515740 - RNA, 23 nt, Human
uaucuguuuucucagucuucaaa

SEQ ID NO: 515741 - RNA, 19 nt, Human
ucacaaaggacacaagagc

SEQ ID NO: 515742 - RNA, 19 nt, Human
ucacugcaaccucggccuc

SEQ ID NO: 515743 - RNA, 22 nt, Human
ucacugcaaccucggccucuug

SEQ ID NO: 515744 - RNA, 24 nt, Human
ucacugcaaccucggccucuugag

SEQ ID NO: 515745 - RNA, 23 nt, Human
ucagaggcagcccaggaaaaggg

SEQ ID NO: 515746 - RNA, 18 nt, Human
ucauguaaucuuuuacau

SEQ ID NO: 515747 - RNA, 23 nt, Human
ucccaaugugcugggauuacagg

SEQ ID NO: 515748 - RNA, 24 nt, Human
ucccauguuguccaggcuggucuc

SEQ ID NO: 515749 - RNA, 22 nt, Human
uccccguggccacagacugccc

SEQ ID NO: 515750 - RNA, 23 nt, Human
ucccgaguagcugggacuacagg

SEQ ID NO: 515751 - RNA, 24 nt, Human
ucccuggcugguucuacaggccuu

SEQ ID NO: 515752 - RNA, 19 nt, Human
ucccugggcugcacugcag

SEQ ID NO: 515753 - RNA, 24 nt, Human
uccgucauccaggcugaggugguu

SEQ ID NO: 515754 - RNA, 20 nt, Human
uccugggcucaagugauccu

SEQ ID NO: 515755 - RNA, 21 nt, Human
uccugggcucaagugauccuu

SEQ ID NO: 515756 - RNA, 24 nt, Human
uccugggcucaagugauccuucug

SEQ ID NO: 515757 - RNA, 18 nt, Human
ucgcaagccccggaucuc

SEQ ID NO: 515758 - RNA, 24 nt, Human
ucgugcuccgucauccaggcugag

SEQ ID NO: 515759 - RNA, 22 nt, Human
ucuacaggccuuccaccaggga

SEQ ID NO: 515760 - RNA, 24 nt, Human
ugagcucaggugauccucccaccu

SEQ ID NO: 515761 - RNA, 23 nt, Human
ugaggugguugcggcacaaucac

SEQ ID NO: 515762 - RNA, 25 nt, Human
ugauacaaaaucugaaaacugaaua

SEQ ID NO: 515763 - RNA, 18 nt, Human
ugaugcaauuuuuuccaa

SEQ ID NO: 515764 - RNA, 18 nt, Human
ugcaaggcuuuacuugug

SEQ ID NO: 515765 - RNA, 21 nt, Human
ugcggaaaggcaacgcucauc

SEQ ID NO: 515766 - RNA, 22 nt, Human
ugcuacaccauuuccuaaacuc

SEQ ID NO: 515767 - RNA, 20 nt, Human
ugcugggaguggcaucugau

SEQ ID NO: 515768 - RNA, 22 nt, Human
ugcugggaguggcaucugaugu

SEQ ID NO: 515769 - RNA, 20 nt, Human
ugcugggauuacagguguca

SEQ ID NO: 515770 - RNA, 28 nt, Human
uggaauaaacaaagaagaaaacaccugu

SEQ ID NO: 515771 - RNA, 21 nt, Human
uggauacagacuccaaagacc

SEQ ID NO: 515772 - RNA, 19 nt, Human
uggcaaaggucucguauaa

SEQ ID NO: 515773 - RNA, 18 nt, Human
uggccagaauacauagau

SEQ ID NO: 515774 - RNA, 22 nt, Human
uggcucucugguuagagaaagg

SEQ ID NO: 515775 - RNA, 22 nt, Human
uggcugcggacacauauguaug

SEQ ID NO: 515776 - RNA, 19 nt, Human
ugggacuacaggugugugc

SEQ ID NO: 515777 - RNA, 21 nt, Human
ugggacuacaggugugugcca

SEQ ID NO: 515778 - RNA, 21 nt, Human
ugggacuacaggugugugcca

SEQ ID NO: 515779 - RNA, 22 nt, Human
ugggacuacaggugugugccau

SEQ ID NO: 515780 - RNA, 24 nt, Human
ugggacuacaggugugugccauua

SEQ ID NO: 515781 - RNA, 18 nt, Human
ugggauuacaggugucag

SEQ ID NO: 515782 - RNA, 18 nt, Human
ugggauuacaggugucag

SEQ ID NO: 515783 - RNA, 21 nt, Human
ugggauuacaggugucaguau

SEQ ID NO: 515784 - RNA, 20 nt, Human
ugggcucaagugauccuucu

SEQ ID NO: 515785 - RNA, 24 nt, Human
ugggcucaagugauccuucugccu

SEQ ID NO: 515786 - RNA, 21 nt, Human
uggguagaaaauaacccauuu

SEQ ID NO: 515787 - RNA, 22 nt, Human
uggguccagcaucucccugggc

SEQ ID NO: 515788 - RNA, 20 nt, Human
uggucagcaaauaugucugg

SEQ ID NO: 515789 - RNA, 24 nt, Human
uguccaggcuggucucaaauuccu

SEQ ID NO: 515790 - RNA, 21 nt, Human
ugugaaaaaccaauuuggcac

SEQ ID NO: 515791 - RNA, 18 nt, Human
uguuacucauaucuuccu

SEQ ID NO: 515792 - RNA, 21 nt, Human
uguuauagguaaaacauggaa

SEQ ID NO: 515793 - RNA, 25 nt, Human
uucaauuauauucugacuucuugau

SEQ ID NO: 515794 - RNA, 19 nt, Human
uucccauguuguccaggcu

SEQ ID NO: 515795 - RNA, 23 nt, Human
uuccugggcucaagugauccuuc

SEQ ID NO: 515796 - RNA, 24 nt, Human
uucucagucuucaaagggucccac

SEQ ID NO: 515797 - RNA, 21 nt, Human
uugaaacccagaauacaauuu

SEQ ID NO: 515798 - RNA, 20 nt, Human
uugauuucaauuauauucug

SEQ ID NO: 515799 - RNA, 21 nt, Human
uuggguagaaaauaacccauu

SEQ ID NO: 515800 - RNA, 20 nt, Human
uugguccauggacuuaugaa

SEQ ID NO: 515801 - RNA, 22 nt, Human
uugguccauggacuuaugaaua

SEQ ID NO: 515802 - RNA, 20 nt, Human
uuggucccgaauggccagaa

SEQ ID NO: 515803 - RNA, 19 nt, Human
uuguuccuaaucaccauuu

SEQ ID NO: 515804 - RNA, 22 nt, Human
uuuaagucugaggaagccagac

SEQ ID NO: 515805 - RNA, 19 nt, Human
uuuauguauguuaacucau

SEQ ID NO: 515806 - RNA, 23 nt, Human
aaaaggaaagaaagggaauccaa

SEQ ID NO: 515807 - RNA, 20 nt, Human
aaaccagacagugauggccc

SEQ ID NO: 515808 - RNA, 23 nt, Human
aaaccagacagugauggcccaug

SEQ ID NO: 515809 - RNA, 19 nt, Human
aaagaucucagagacagac

SEQ ID NO: 515810 - RNA, 23 nt, Human
aaagcagcugaugcaccuucuca

SEQ ID NO: 515811 - RNA, 18 nt, Human
aaaugaauaagaaggggu

SEQ ID NO: 515812 - RNA, 19 nt, Human
aacacuuuguguguucucc

SEQ ID NO: 515813 - RNA, 20 nt, Human
aacacuuuguguguucuccu

SEQ ID NO: 515814 - RNA, 19 nt, Human
aacauggugaaaccccguu

SEQ ID NO: 515815 - RNA, 20 nt, Human
aacauggugaaaccccguuu

SEQ ID NO: 515816 - RNA, 21 nt, Human
aacauggugaaaccccguuuc

SEQ ID NO: 515817 - RNA, 21 nt, Human
aacauggugaaaccccguuuc

SEQ ID NO: 515818 - RNA, 21 nt, Human
aacucagaaaggaaagagccc

SEQ ID NO: 515819 - RNA, 18 nt, Human
aaggcagcccuguccauc

SEQ ID NO: 515820 - RNA, 23 nt, Human
aaggcggguggaucacgagguca

SEQ ID NO: 515821 - RNA, 20 nt, Human
aaggcugaaguaaauggacu

SEQ ID NO: 515822 - RNA, 19 nt, Human
aauaaaaggaaagaaaggg

SEQ ID NO: 515823 - RNA, 19 nt, Human
aaugcaaaccaaacuauga

SEQ ID NO: 515824 - RNA, 26 nt, Human
acaaugcaaaccaaacuaugaaaaca

SEQ ID NO: 515825 - RNA, 21 nt, Human
acagacuuuuuuucagaagag

SEQ ID NO: 515826 - RNA, 23 nt, Human
acagggugagacucugucucaaa

SEQ ID NO: 515827 - RNA, 24 nt, Human
acagggugagacucugucucaaaa

SEQ ID NO: 515828 - RNA, 22 nt, Human
accauugcacuccagccugggc

SEQ ID NO: 515829 - RNA, 24 nt, Human
accccguuucuacuaaaaauacaa

SEQ ID NO: 515830 - RNA, 24 nt, Human
acuccagccugggcaacaggguga

SEQ ID NO: 515831 - RNA, 22 nt, Human
acuuuuuguuuuuugcuuuuaa

SEQ ID NO: 515832 - RNA, 23 nt, Human
acuuuuuuucagaagagggaaau

SEQ ID NO: 515833 - RNA, 20 nt, Human
agaaaaaaaaaaucucucau

SEQ ID NO: 515834 - RNA, 19 nt, Human
agacagacaacagagagcc

SEQ ID NO: 515835 - RNA, 21 nt, Human
agacagacaacagagagccuc

SEQ ID NO: 515836 - RNA, 19 nt, Human
agaucuguuugucugauua

SEQ ID NO: 515837 - RNA, 22 nt, Human
agccaaugaagugcacgacucu

SEQ ID NO: 515838 - RNA, 24 nt, Human
agccugggcaacagggugagacuc

SEQ ID NO: 515839 - RNA, 21 nt, Human
aggaaagaaagggaauccaag

SEQ ID NO: 515840 - RNA, 18 nt, Human
aggcagaaaccacauccc

SEQ ID NO: 515841 - RNA, 18 nt, Human
aggcaggggaaucacuug

SEQ ID NO: 515842 - RNA, 21 nt, Human
aggcaggggaaucacuugaac

SEQ ID NO: 515843 - RNA, 26 nt, Human
aggcauaaagaaaaucuaguuucugg

SEQ ID NO: 515844 - RNA, 21 nt, Human
aggccaaggcggguggaucac

SEQ ID NO: 515845 - RNA, 24 nt, Human
aggcggguggaucacgaggucagg

SEQ ID NO: 515846 - RNA, 24 nt, Human
aggcugaggcaggggaaucacuug

SEQ ID NO: 515847 - RNA, 21 nt, Human
agggguggaggcauaaagaaa

SEQ ID NO: 515848 - RNA, 22 nt, Human
aggucucagaaaucacacagcu

SEQ ID NO: 515849 - RNA, 24 nt, Human
agguggagguugcagugagccaag

SEQ ID NO: 515850 - RNA, 19 nt, Human
auaagaagggguggaggca

SEQ ID NO: 515851 - RNA, 20 nt, Human
aucacgaggucaggagauuc

SEQ ID NO: 515852 - RNA, 21 nt, Human
auccuggccaacauggugaaa

SEQ ID NO: 515853 - RNA, 24 nt, Human
aucgcaccauugcacuccagccug

SEQ ID NO: 515854 - RNA, 28 nt, Human
aucgcaccauugcacuccagccugggca

SEQ ID NO: 515855 - RNA, 18 nt, Human
aucuaggucucagaaauc

SEQ ID NO: 515856 - RNA, 19 nt, Human
augaguuaaauccuguaac

SEQ ID NO: 515857 - RNA, 22 nt, Human
auggcccauguacaagacuugu

SEQ ID NO: 515858 - RNA, 24 nt, Human
auugcacuccagccugggcaacag

SEQ ID NO: 515859 - RNA, 21 nt, Human
caaaacaaucuucagccuuca

SEQ ID NO: 515860 - RNA, 24 nt, Human
caaaacaaucuucagccuucaaag

SEQ ID NO: 515861 - RNA, 21 nt, Human
caaaaggacauuucauaguac

SEQ ID NO: 515862 - RNA, 23 nt, Human
caaaccaaacuaugaaaacacag

SEQ ID NO: 515863 - RNA, 24 nt, Human
caacauggugaaaccccguuucua

SEQ ID NO: 515864 - RNA, 25 nt, Human
caacucagaaaggaaagagcccaaa

SEQ ID NO: 515865 - RNA, 20 nt, Human
cacacagcuggccucgugau

SEQ ID NO: 515866 - RNA, 22 nt, Human
cacagaaaccugccaaaauaga

SEQ ID NO: 515867 - RNA, 23 nt, Human
cacgcuuguaaucccgcacuuug

SEQ ID NO: 515868 - RNA, 20 nt, Human
cacuccagccugggcaacag

SEQ ID NO: 515869 - RNA, 23 nt, Human
cacuccagccugggcaacagggu

SEQ ID NO: 515870 - RNA, 24 nt, Human
cacuccagccugggcaacagggug

SEQ ID NO: 515871 - RNA, 26 nt, Human
cagaaaccacaucccacaaccuucag

SEQ ID NO: 515872 - RNA, 19 nt, Human
caggcaccaaaacccauuc

SEQ ID NO: 515873 - RNA, 18 nt, Human
caucaaacuccauaccua

SEQ ID NO: 515874 - RNA, 19 nt, Human
cauugcacuccagccuggg

SEQ ID NO: 515875 - RNA, 21 nt, Human
cauugcacuccagccugggca

SEQ ID NO: 515876 - RNA, 24 nt, Human
cauugcacuccagccugggcaaca

SEQ ID NO: 515877 - RNA, 23 nt, Human
ccagcaaccaaagaggaggcaau

SEQ ID NO: 515878 - RNA, 20 nt, Human
ccauugcacuccagccuggg

SEQ ID NO: 515879 - RNA, 21 nt, Human
ccauugcacuccagccugggc

SEQ ID NO: 515880 - RNA, 23 nt, Human
ccauugcacuccagccugggcaa

SEQ ID NO: 515881 - RNA, 24 nt, Human
ccauugcacuccagccugggcaac

SEQ ID NO: 515882 - RNA, 23 nt, Human
cccacacuccuaugcaauuuguu

SEQ ID NO: 515883 - RNA, 24 nt, Human
ccgcacuuugggaggccaaggcgg

SEQ ID NO: 515884 - RNA, 22 nt, Human
ccuggccaacauggugaaaccc

SEQ ID NO: 515885 - RNA, 23 nt, Human
ccuggccaacauggugaaacccc

SEQ ID NO: 515886 - RNA, 24 nt, Human
ccuggccaacauggugaaaccccg

SEQ ID NO: 515887 - RNA, 22 nt, Human
ccugggcaacagggugagacuc

SEQ ID NO: 515888 - RNA, 25 nt, Human
ccuguaacaaugaauuucaaccauu

SEQ ID NO: 515889 - RNA, 20 nt, Human
ccuguaguccuagcuacucg

SEQ ID NO: 515890 - RNA, 23 nt, Human
ccuguaguccuagcuacucgcga

SEQ ID NO: 515891 - RNA, 18 nt, Human
ccuucuuuccauuagaug

SEQ ID NO: 515892 - RNA, 24 nt, Human
cgagagaaccugcuuguuagcuca

SEQ ID NO: 515893 - RNA, 19 nt, Human
cgaggcugaggcaggggaa

SEQ ID NO: 515894 - RNA, 21 nt, Human
cgcaccauugcacuccagccu

SEQ ID NO: 515895 - RNA, 22 nt, Human
cgccuguaguccuagcuacucg

SEQ ID NO: 515896 - RNA, 24 nt, Human
cgcgaggcugaggcaggggaauca

SEQ ID NO: 515897 - RNA, 23 nt, Human
cgcuuguaaucccgcacuuuggg

SEQ ID NO: 515898 - RNA, 20 nt, Human
cuccagcaaccaaagaggag

SEQ ID NO: 515899 - RNA, 23 nt, Human
cugcugccuuggugggccuugga

SEQ ID NO: 515900 - RNA, 22 nt, Human
cuguacauggauuucuugaccu

SEQ ID NO: 515901 - RNA, 24 nt, Human
cuugaacugggagguggagguugc

SEQ ID NO: 515902 - RNA, 24 nt, Human
gaaaacacagacuuuuuuucagaa

SEQ ID NO: 515903 - RNA, 19 nt, Human
gaagaaccaccauaaagua

SEQ ID NO: 515904 - RNA, 21 nt, Human
gacacaaagaucucagagaca

SEQ ID NO: 515905 - RNA, 22 nt, Human
gacagugauggcccauguacaa

SEQ ID NO: 515906 - RNA, 21 nt, Human
gagaaccugcuuguuagcuca

SEQ ID NO: 515907 - RNA, 19 nt, Human
gagcucugucugggauuuc

SEQ ID NO: 515908 - RNA, 24 nt, Human
gaggaucauccuggccaacauggu

SEQ ID NO: 515909 - RNA, 18 nt, Human
gagguugcagugagccaa

SEQ ID NO: 515910 - RNA, 23 nt, Human
gagguugcagugagccaagaucg

SEQ ID NO: 515911 - RNA, 22 nt, Human
gauuaacagucugcugccuugg

SEQ ID NO: 515912 - RNA, 24 nt, Human
gcaacagggugagacucugucuca

SEQ ID NO: 515913 - RNA, 20 nt, Human
gcaccauugcacuccagccu

SEQ ID NO: 515914 - RNA, 21 nt, Human
gcacuccagccugggcaacag

SEQ ID NO: 515915 - RNA, 22 nt, Human
gcacuuugggaggccaaggcgg

SEQ ID NO: 515916 - RNA, 21 nt, Human
gccaaaauagauauuuuuuuc

SEQ ID NO: 515917 - RNA, 21 nt, Human
gccaacauggugaaaccccgu

SEQ ID NO: 515918 - RNA, 19 nt, Human
gcccuguccaucaaacucc

SEQ ID NO: 515919 - RNA, 25 nt, Human
ggaaauaaaggcacagaaaccugcc

SEQ ID NO: 515920 - RNA, 23 nt, Human
ggaaucacuugaacugggaggug

SEQ ID NO: 515921 - RNA, 20 nt, Human
ggagguugcagugagccaag

SEQ ID NO: 515922 - RNA, 24 nt, Human
ggagguugcagugagccaagaucg

SEQ ID NO: 515923 - RNA, 22 nt, Human
ggcuuggugacaugcgccugua

SEQ ID NO: 515924 - RNA, 22 nt, Human
gggaaucacuugaacugggagg

SEQ ID NO: 515925 - RNA, 18 nt, Human
gggagguggagguugcag

SEQ ID NO: 515926 - RNA, 24 nt, Human
ggugacaugcgccuguaguccuag

SEQ ID NO: 515927 - RNA, 21 nt, Human
gguggaucacgaggucaggag

SEQ ID NO: 515928 - RNA, 22 nt, Human
ggugguucacgcuuguaauccc

SEQ ID NO: 515929 - RNA, 23 nt, Human
ggugguucacgcuuguaaucccg

SEQ ID NO: 515930 - RNA, 19 nt, Human
uaaaaaagcagcuaaaugu

SEQ ID NO: 515931 - RNA, 19 nt, Human
uaaaaggaaagaaagggaa

SEQ ID NO: 515932 - RNA, 23 nt, Human
uaaaauaaaaggaaagaaaggga

SEQ ID NO: 515933 - RNA, 21 nt, Human
uaaaggcacagaaaccugcca

SEQ ID NO: 515934 - RNA, 22 nt, Human
uaaauggacucucaucuagguc

SEQ ID NO: 515935 - RNA, 23 nt, Human
uaacauggaauagacuuagcaac

SEQ ID NO: 515936 - RNA, 24 nt, Human
uaagugacuuagugaccuucacac

SEQ ID NO: 515937 - RNA, 18 nt, Human
uagaaggcagaaaccaca

SEQ ID NO: 515938 - RNA, 24 nt, Human
uagauaaugccacuaacgcaccac

SEQ ID NO: 515939 - RNA, 24 nt, Human
uaggaaacacacgaagugaaacca

SEQ ID NO: 515940 - RNA, 18 nt, Human
ucacgaggucaggagauu

SEQ ID NO: 515941 - RNA, 21 nt, Human
ucacgaggucaggagauugag

SEQ ID NO: 515942 - RNA, 22 nt, Human
ucacgcuuguaaucccgcacuu

SEQ ID NO: 515943 - RNA, 20 nt, Human
ucagagaucuguuugucuga

SEQ ID NO: 515944 - RNA, 21 nt, Human
ucaggcaccaaaacccauucc

SEQ ID NO: 515945 - RNA, 23 nt, Human
uccagccugggcaacagggugag

SEQ ID NO: 515946 - RNA, 24 nt, Human
uccagccugggcaacagggugaga

SEQ ID NO: 515947 - RNA, 22 nt, Human
uccguguucaucugcccgaggc

SEQ ID NO: 515948 - RNA, 23 nt, Human
ucgcaccauugcacuccagccug

SEQ ID NO: 515949 - RNA, 31 nt, Human
ucgcaccauugcacuccagccugggcaacaa

SEQ ID NO: 515950 - RNA, 19 nt, Human
ucucagagaucuguuuguc

SEQ ID NO: 515951 - RNA, 22 nt, Human
ucucuccagcaaccaaagagga

SEQ ID NO: 515952 - RNA, 18 nt, Human
ucuggcugggcagggugg

SEQ ID NO: 515953 - RNA, 20 nt, Human
ugaauaaucaucaaaaauau

SEQ ID NO: 515954 - RNA, 23 nt, Human
ugacuuagugaccuucacacuca

SEQ ID NO: 515955 - RNA, 20 nt, Human
ugaggcaggggaaucacuuc

SEQ ID NO: 515956 - RNA, 20 nt, Human
ugaggcaggggaaucacuug

SEQ ID NO: 515957 - RNA, 23 nt, Human
ugaggcaggggaaucacuugaac

SEQ ID NO: 515958 - RNA, 23 nt, Human
ugaggcaggggaaucacuugaac

SEQ ID NO: 515959 - RNA, 18 nt, Human
ugauuaacagucugcugc

SEQ ID NO: 515960 - RNA, 22 nt, Human
ugcacuccagccugggcaacag

SEQ ID NO: 515961 - RNA, 19 nt, Human
ugcagagaaaaaaaaaauc

SEQ ID NO: 515962 - RNA, 21 nt, Human
ugcgccuguaguccuagcuac

SEQ ID NO: 515963 - RNA, 24 nt, Human
uggccaacauggugaaaccccguu

SEQ ID NO: 515964 - RNA, 22 nt, Human
uggcugggcagggugguucacg

SEQ ID NO: 515965 - RNA, 24 nt, Human
ugggaggccaaggcggguggauca

SEQ ID NO: 515966 - RNA, 18 nt, Human
ugggagguggagguugca

SEQ ID NO: 515967 - RNA, 29 nt, Human
ugggagguggagguugcagugacaacggu

SEQ ID NO: 515968 - RNA, 24 nt, Human
ugggagguggagguugcagugagc

SEQ ID NO: 515969 - RNA, 21 nt, Human
ugggcaacagggugagacucu

SEQ ID NO: 515970 - RNA, 22 nt, Human
uggugacaugcgccuguagucc

SEQ ID NO: 515971 - RNA, 23 nt, Human
ugguucacgcuuguaaucccgca

SEQ ID NO: 515972 - RNA, 22 nt, Human
uguguaaauaacacuuugugug

SEQ ID NO: 515973 - RNA, 27 nt, Human
uguuccuuuuuaugucauguaugguug

SEQ ID NO: 515974 - RNA, 20 nt, Human
uguuuuguuuuuuauacuua

SEQ ID NO: 515975 - RNA, 20 nt, Human
uguuuuguuuuuuauacuua

SEQ ID NO: 515976 - RNA, 19 nt, Human
uuacugaaucaaaggcuga

SEQ ID NO: 515977 - RNA, 20 nt, Human
uucacaagacaguaugucac

SEQ ID NO: 515978 - RNA, 24 nt, Human
uucagaagagggaaauaaaggcac

SEQ ID NO: 515979 - RNA, 22 nt, Human
uugcagugagccaagaucgcac

SEQ ID NO: 515980 - RNA, 20 nt, Human
uuggugggccuuggucuugg

SEQ ID NO: 515981 - RNA, 19 nt, Human
uuuaaaauaaaaggaaaga

SEQ ID NO: 515982 - RNA, 20 nt, Human
uuuaucacuaguaaaacuug

SEQ ID NO: 515983 - RNA, 21 nt, Human
uuucuacuaaaaauacaaaaa

SEQ ID NO: 515984 - RNA, 22 nt, Human
uuucuggcugggcagggugguu

SEQ ID NO: 515985 - RNA, 20 nt, Human
aaaaugccuuuccccucgug

SEQ ID NO: 515986 - RNA, 19 nt, Human
acaaaucccuggccugcca

SEQ ID NO: 515987 - RNA, 20 nt, Human
auggagccacuggccagcug

SEQ ID NO: 515988 - RNA, 21 nt, Human
caaaucccuggccugccaccu

SEQ ID NO: 515989 - RNA, 21 nt, Human
caaaucccuggccugccaccu

SEQ ID NO: 515990 - RNA, 24 nt, Human
cccacagaguucaguccccuuuau

SEQ ID NO: 515991 - RNA, 25 nt, Human
ccuggccugccaccugguccccugg

SEQ ID NO: 515992 - RNA, 19 nt, Human
gauacugaaguccacacag

SEQ ID NO: 515993 - RNA, 20 nt, Human
gccagcugcuuuguguugau

SEQ ID NO: 515994 - RNA, 22 nt, Human
uccaccgagcuccugauuccug

SEQ ID NO: 515995 - RNA, 22 nt, Human
ucccacagaguucaguccccuu

SEQ ID NO: 515996 - RNA, 24 nt, Human
ucucgguggcccuuaaaaugccuu

SEQ ID NO: 515997 - RNA, 21 nt, Human
ugaguccauggagccacuggc

SEQ ID NO: 515998 - RNA, 23 nt, Human
ugaguccauggagccacuggcca

SEQ ID NO: 515999 - RNA, 21 nt, Human
uggccugccaccugcaaaucc

SEQ ID NO: 516000 - RNA, 25 nt, Human
uugauacugaaguccacacagguaa

SEQ ID NO: 516001 - RNA, 23 nt, Human
uuuuuuuuuuuuuuuuuuuccca

SEQ ID NO: 516002 - RNA, 23 nt, Human
uuuuuuuuuuuuuuuuuuuuccc

SEQ ID NO: 516003 - RNA, 24 nt, Human
uuuuuuuuuuuuuuuuuuuuuccu

SEQ ID NO: 516004 - RNA, 25 nt, Human
aaaaaaaaaauuguuagauauaaaa

SEQ ID NO: 516005 - RNA, 28 nt, Human
aaaaauauaaaagagguaaccgguaccc

SEQ ID NO: 516006 - RNA, 18 nt, Human
aaaguccuggccgcugcc

SEQ ID NO: 516007 - RNA, 18 nt, Human
acaacacuugaagcaucu

SEQ ID NO: 516008 - RNA, 19 nt, Human
acaggaagaaaaccccauu

SEQ ID NO: 516009 - RNA, 23 nt, Human
auagaaaauaccugaaaaagaua

SEQ ID NO: 516010 - RNA, 21 nt, Human
cauaauccaaacaagucucug

SEQ ID NO: 516011 - RNA, 23 nt, Human
cgccccuuuuuuuuuuuuuuuuu

SEQ ID NO: 516012 - RNA, 25 nt, Human
cugagguaaacaccaaaaguuuaaa

SEQ ID NO: 516013 - RNA, 23 nt, Human
gaaaaguccuggccgcugccucc

SEQ ID NO: 516014 - RNA, 29 nt, Human
gagcggccgccccuuuuuuuuuuuuuuuu

SEQ ID NO: 516015 - RNA, 21 nt, Human
gccccuuuuuuuuuuuuuuuu

SEQ ID NO: 516016 - RNA, 23 nt, Human
ggccgccccuuuuuuuuuuuuuu

SEQ ID NO: 516017 - RNA, 23 nt, Human
uaaaacuccaaauaugaaaaaag

SEQ ID NO: 516018 - RNA, 24 nt, Human
uaaaacuccaaauaugaaaaaagu

SEQ ID NO: 516019 - RNA, 18 nt, Human
uacaaaucaaccucuuuc

SEQ ID NO: 516020 - RNA, 26 nt, Human
uagagcggccgccccuuuuuuuuuuu

SEQ ID NO: 516021 - RNA, 21 nt, Human
uauagaaaauaccugaaaaag

SEQ ID NO: 516022 - RNA, 18 nt, Human
uccaaauaugaaaaaagu

SEQ ID NO: 516023 - RNA, 20 nt, Human
uccccaggucggccuuugga

SEQ ID NO: 516024 - RNA, 22 nt, Human
ucccugcaggaucgcccaguuu

SEQ ID NO: 516025 - RNA, 24 nt, Human
ugaaaaagauacauguauauaaaa

SEQ ID NO: 516026 - RNA, 19 nt, Human
uuagagcggccgccccuuu

SEQ ID NO: 516027 - RNA, 20 nt, Human
uucacaagaaaaaaugaagu

SEQ ID NO: 516028 - RNA, 24 nt, Human
uugaagcaucugaaaacuauuaaa

SEQ ID NO: 516029 - RNA, 22 nt, Human
uuuguaaaaaaaaaaaauuguu

SEQ ID NO: 516030 - RNA, 26 nt, Human
uuuuuuuuuuagagcggccgccccuu

SEQ ID NO: 516031 - RNA, 21 nt, Human
uuuuuuuuuuuuagagcggcc

SEQ ID NO: 516032 - RNA, 19 nt, Human
uuuuuuuuuuuuagagucu

SEQ ID NO: 516033 - RNA, 19 nt, Human
uaaaaacaguuccuuuaga

SEQ ID NO: 516034 - RNA, 24 nt, Human
ucacaucuccuuccugcuuuggug

SEQ ID NO: 516035 - RNA, 18 nt, Human
ucaggcuaagacaaugca

SEQ ID NO: 516036 - RNA, 20 nt, Human
uggaaaacacauaauaggga

SEQ ID NO: 516037 - RNA, 22 nt, Human
uggaaaacacauaauagggaaa

SEQ ID NO: 516038 - RNA, 20 nt, Human
uuagaauucuuauuguuuuc

SEQ ID NO: 516039 - RNA, 19 nt, Human
uucacaucuccuuccugcu

SEQ ID NO: 516040 - RNA, 21 nt, Human
uuucucuauucuuuuucaggc

SEQ ID NO: 516041 - RNA, 25 nt, Human
ccccaaaugaguaucaaaugguaca

SEQ ID NO: 516042 - RNA, 22 nt, Human
ccuccccuucuuccuuuauucu

SEQ ID NO: 516043 - RNA, 24 nt, Human
cuuucagggauccuggcaucuggc

SEQ ID NO: 516044 - RNA, 19 nt, Human
ggucuccuuucagggaucc

SEQ ID NO: 516045 - RNA, 21 nt, Human
uaaaacuccccaaauauauau

SEQ ID NO: 516046 - RNA, 19 nt, Human
uaaacuaaaacuccccaaa

SEQ ID NO: 516047 - RNA, 20 nt, Human
uaaauauaaugccccaaaug

SEQ ID NO: 516048 - RNA, 19 nt, Human
uacaguauauggucuccuu

SEQ ID NO: 516049 - RNA, 24 nt, Human
uagaagauguacacaucuauagca

SEQ ID NO: 516050 - RNA, 19 nt, Human
uauagcauauaaaagaauu

SEQ ID NO: 516051 - RNA, 24 nt, Human
uauauauagaagauguacacaucu

SEQ ID NO: 516052 - RNA, 18 nt, Human
ugggauauaaauauaaug

SEQ ID NO: 516053 - RNA, 21 nt, Human
uguacacaucuauagcauaua

SEQ ID NO: 516054 - RNA, 19 nt, Human
uguggaccuuccuggaauc

SEQ ID NO: 516055 - RNA, 20 nt, Human
uguuaucaaguauuggaaaa

SEQ ID NO: 516056 - RNA, 21 nt, Human
uuaaucuucaaauaugccugg

SEQ ID NO: 516057 - RNA, 24 nt, Human
uuccuccccuucuuccuuuauucu

SEQ ID NO: 516058 - RNA, 21 nt, Human
uuucagggauccuggcaucug

SEQ ID NO: 516059 - RNA, 22 nt, Human
aaaaacaaacaaaaaacaaaaa

SEQ ID NO: 516060 - RNA, 23 nt, Human
aaaaacaaacaaaaaacaaaaac

SEQ ID NO: 516061 - RNA, 19 nt, Human
aaaaagacccacccauaag

SEQ ID NO: 516062 - RNA, 21 nt, Human
aaaacaaacaaaaaacaaaaa

SEQ ID NO: 516063 - RNA, 31 nt, Human
aaaagacacacacauacacacacacacacag

SEQ ID NO: 516064 - RNA, 19 nt, Human
aaacaaaaaacaaaaaccc

SEQ ID NO: 516065 - RNA, 19 nt, Human
aaacaaaaaacaaaaaccc

SEQ ID NO: 516066 - RNA, 25 nt, Human
aaacaaaaaacaaaaacccagugcu

SEQ ID NO: 516067 - RNA, 26 nt, Human
aaacaaaaaacaaaaacccagugcug

SEQ ID NO: 516068 - RNA, 26 nt, Human
aaacaaaaucaaaaauguuaagccug

SEQ ID NO: 516069 - RNA, 21 nt, Human
aaacaaacaaaaaacaaaaac

SEQ ID NO: 516070 - RNA, 24 nt, Human
aaacaaacaaaaaacaaaaaccca

SEQ ID NO: 516071 - RNA, 18 nt, Human
aacacaaaaguggccaga

SEQ ID NO: 516072 - RNA, 22 nt, Human
aacacaguaucacggcccuauc

SEQ ID NO: 516073 - RNA, 19 nt, Human
aagaaaaaaagacccaccc

SEQ ID NO: 516074 - RNA, 19 nt, Human
aagaaauuacuuaaccuuc

SEQ ID NO: 516075 - RNA, 18 nt, Human
aagcaaacagcacugaac

SEQ ID NO: 516076 - RNA, 22 nt, Human
aagcuaccucauauuacaggau

SEQ ID NO: 516077 - RNA, 19 nt, Human
aaugaaaccaaauuacaaa

SEQ ID NO: 516078 - RNA, 25 nt, Human
acaaacaaaaaacaaaaacccagug

SEQ ID NO: 516079 - RNA, 23 nt, Human
acacaaccuucuguggcucaaaa

SEQ ID NO: 516080 - RNA, 23 nt, Human
acacacacacacacacacacaca

SEQ ID NO: 516081 - RNA, 23 nt, Human
acacacacacacacacacacaca

SEQ ID NO: 516082 - RNA, 23 nt, Human
acacacacacacacacacacaca

SEQ ID NO: 516083 - RNA, 23 nt, Human
acacacacacacacacacacaca

SEQ ID NO: 516084 - RNA, 23 nt, Human
acacacacacacacacacacaca

SEQ ID NO: 516085 - RNA, 23 nt, Human
acacacacacacacacacacaca

SEQ ID NO: 516086 - RNA, 29 nt, Human
acacacacacacacacacacacaaccuuc

SEQ ID NO: 516087 - RNA, 23 nt, Human
acacacacauacacacacacaca

SEQ ID NO: 516088 - RNA, 23 nt, Human
acaugcaagcaaacagcacugaa

SEQ ID NO: 516089 - RNA, 23 nt, Human
acccagugcuggugacaaaugua

SEQ ID NO: 516090 - RNA, 24 nt, Human
agacccaacauggcggcggcgccg

SEQ ID NO: 516091 - RNA, 19 nt, Human
agauaaugaaauaauguau

SEQ ID NO: 516092 - RNA, 20 nt, Human
aggaaaaacagguucauuga

SEQ ID NO: 516093 - RNA, 22 nt, Human
aggcauaauaggaaaaacaggu

SEQ ID NO: 516094 - RNA, 25 nt, Human
aggcauaauaggaaaaaccgguacc

SEQ ID NO: 516095 - RNA, 23 nt, Human
auaaaaugaaaauaaaaaauguc

SEQ ID NO: 516096 - RNA, 24 nt, Human
auaaugaaaccaaauuacaaaaca

SEQ ID NO: 516097 - RNA, 23 nt, Human
auacacacacacacacacacaca

SEQ ID NO: 516098 - RNA, 21 nt, Human
auaugccauuugcuacaaaau

SEQ ID NO: 516099 - RNA, 21 nt, Human
augaaaaaauacuuguuaagu

SEQ ID NO: 516100 - RNA, 25 nt, Human
augaaaccaaauuacaaaacacugc

SEQ ID NO: 516101 - RNA, 21 nt, Human
augagccuuccacccccaaaa

SEQ ID NO: 516102 - RNA, 19 nt, Human
caaaacacaguaucacggc

SEQ ID NO: 516103 - RNA, 18 nt, Human
caaagacugaaaucaaug

SEQ ID NO: 516104 - RNA, 21 nt, Human
caagcaaacagcacugaacaa

SEQ ID NO: 516105 - RNA, 18 nt, Human
caaggacacaguauguuu

SEQ ID NO: 516106 - RNA, 22 nt, Human
caauugccaaauacaauuuagu

SEQ ID NO: 516107 - RNA, 22 nt, Human
cacaaccuucuguggcucaaaa

SEQ ID NO: 516108 - RNA, 20 nt, Human
cacacacacacacacacaca

SEQ ID NO: 516109 - RNA, 20 nt, Human
cacacacacacacacacaca

SEQ ID NO: 516110 - RNA, 20 nt, Human
cacacacacacacacacaca

SEQ ID NO: 516111 - RNA, 20 nt, Human
cacacacacacacacacaca

SEQ ID NO: 516112 - RNA, 20 nt, Human
cacacacacacacacacaca

SEQ ID NO: 516113 - RNA, 20 nt, Human
cacacacacacacacacaca

SEQ ID NO: 516114 - RNA, 20 nt, Human
cacacacacacacacacaca

SEQ ID NO: 516115 - RNA, 20 nt, Human
cacacacacacacacacaca

SEQ ID NO: 516116 - RNA, 20 nt, Human
cacacacacacacacacaca

SEQ ID NO: 516117 - RNA, 20 nt, Human
cacacacacacacacacaca

SEQ ID NO: 516118 - RNA, 22 nt, Human
cacacacacacacacacacaca

SEQ ID NO: 516119 - RNA, 22 nt, Human
cacacacacacacacacacaca

SEQ ID NO: 516120 - RNA, 22 nt, Human
cacacacacacacacacacaca

SEQ ID NO: 516121 - RNA, 22 nt, Human
cacacacacacacacacacaca

SEQ ID NO: 516122 - RNA, 26 nt, Human
cacacacacacacacacacacacaca

SEQ ID NO: 516123 - RNA, 26 nt, Human
cacacacacacacacacacacacaca

SEQ ID NO: 516124 - RNA, 26 nt, Human
cacacacacacacacacacacacaca

SEQ ID NO: 516125 - RNA, 26 nt, Human
cacacacacacacacacacacacaca

SEQ ID NO: 516126 - RNA, 26 nt, Human
cacacacacacacacacacacacaca

SEQ ID NO: 516127 - RNA, 20 nt, Human
cacacacauacacacacaca

SEQ ID NO: 516128 - RNA, 28 nt, Human
cacacacauacacacacacacacacaca

SEQ ID NO: 516129 - RNA, 22 nt, Human
cacacauacacacacacacaca

SEQ ID NO: 516130 - RNA, 26 nt, Human
cacaguaucacggcccuaucugcagg

SEQ ID NO: 516131 - RNA, 26 nt, Human
cacauacacacacacacacacacaca

SEQ ID NO: 516132 - RNA, 23 nt, Human
cacaucaacuucugcaaggacac

SEQ ID NO: 516133 - RNA, 18 nt, Human
cagagaggcagaucccac

SEQ ID NO: 516134 - RNA, 23 nt, Human
cagaucccacgccacugucgccc

SEQ ID NO: 516135 - RNA, 21 nt, Human
cagcagccgcuucagacccaa

SEQ ID NO: 516136 - RNA, 19 nt, Human
cagccgcuucagacccaac

SEQ ID NO: 516137 - RNA, 20 nt, Human
cagcuauacaaaguucuuaa

SEQ ID NO: 516138 - RNA, 19 nt, Human
cagugcaguuucuauaucu

SEQ ID NO: 516139 - RNA, 19 nt, Human
cagugcaguuucuauaucu

SEQ ID NO: 516140 - RNA, 24 nt, Human
caucuccaacagucuacacaugua

SEQ ID NO: 516141 - RNA, 27 nt, Human
ccaacauggcggcggcgccggcuccuu

SEQ ID NO: 516142 - RNA, 18 nt, Human
ccacugucgcccgcuccg

SEQ ID NO: 516143 - RNA, 19 nt, Human
cccacgccacugucgcccg

SEQ ID NO: 516144 - RNA, 23 nt, Human
ccccagccucccgcccucaagcc

SEQ ID NO: 516145 - RNA, 20 nt, Human
ccgccgccgcucccagcugc

SEQ ID NO: 516146 - RNA, 20 nt, Human
ccgccgccgcucccagcugc

SEQ ID NO: 516147 - RNA, 22 nt, Human
ccgccgccgcucccagcugcuc

SEQ ID NO: 516148 - RNA, 22 nt, Human
ccgcuccgcacgcccgcucgcu

SEQ ID NO: 516149 - RNA, 24 nt, Human
ccuacagcagccgcuucagaccca

SEQ ID NO: 516150 - RNA, 18 nt, Human
ccuacagugcaguuucua

SEQ ID NO: 516151 - RNA, 22 nt, Human
cgccgccgccgccgcucccagc

SEQ ID NO: 516152 - RNA, 21 nt, Human
cgccggcuccgcuacccuccc

SEQ ID NO: 516153 - RNA, 29 nt, Human
cgcggcgcggcggcggcggcggcggcgac

SEQ ID NO: 516154 - RNA, 21 nt, Human
cgcggcggcggcggcggcggc

SEQ ID NO: 516155 - RNA, 18 nt, Human
cggcgccuacagcagccg

SEQ ID NO: 516156 - RNA, 20 nt, Human
cggcgccuacagcagccgcu

SEQ ID NO: 516157 - RNA, 22 nt, Human
cuaccaaaauaauuucuagcac

SEQ ID NO: 516158 - RNA, 18 nt, Human
cuugcaauugccaaauac

SEQ ID NO: 516159 - RNA, 19 nt, Human
gagccuuccacccccaaaa

SEQ ID NO: 516160 - RNA, 22 nt, Human
gauaugccauuugcuacaaaau

SEQ ID NO: 516161 - RNA, 26 nt, Human
gcaagcaaacagcacugaacaauauu

SEQ ID NO: 516162 - RNA, 19 nt, Human
gcagguaugccaugcugcc

SEQ ID NO: 516163 - RNA, 20 nt, Human
gcggcggcggcggcggcggc

SEQ ID NO: 516164 - RNA, 18 nt, Human
gcuccgcuacccuccccc

SEQ ID NO: 516165 - RNA, 24 nt, Human
gcuccgcuacccucccccagccuc

SEQ ID NO: 516166 - RNA, 21 nt, Human
gcuggggcacaaaacgcccca

SEQ ID NO: 516167 - RNA, 22 nt, Human
ggaaaaacaaacaaaaaacaaa

SEQ ID NO: 516168 - RNA, 30 nt, Human
ggaaaaagacacacacauacacacacacag

SEQ ID NO: 516169 - RNA, 19 nt, Human
ggcaauggaauauaaugga

SEQ ID NO: 516170 - RNA, 22 nt, Human
ggcgcggcggcggcggcggcgg

SEQ ID NO: 516171 - RNA, 20 nt, Human
ggcggcggcggcggcggcgg

SEQ ID NO: 516172 - RNA, 19 nt, Human
ggcucaaaacacaguauca

SEQ ID NO: 516173 - RNA, 21 nt, Human
guaagggguacugcagguaug

SEQ ID NO: 516174 - RNA, 25 nt, Human
guacuggaucuucauaaugaaacca

SEQ ID NO: 516175 - RNA, 23 nt, Human
guuaacaugcaagcaaacagcac

SEQ ID NO: 516176 - RNA, 20 nt, Human
uaaaaacacaaaaguggcca

SEQ ID NO: 516177 - RNA, 18 nt, Human
uaagaaaaaaagacccac

SEQ ID NO: 516178 - RNA, 23 nt, Human
uaagaaaacaaucaaaauauuag

SEQ ID NO: 516179 - RNA, 19 nt, Human
uaagaugagccuuccaccc

SEQ ID NO: 516180 - RNA, 26 nt, Human
uacaaaagauauaaaaugaaaauaaa

SEQ ID NO: 516181 - RNA, 20 nt, Human
uacacacacacacacacaca

SEQ ID NO: 516182 - RNA, 25 nt, Human
uacacacacacacacacacacacac

SEQ ID NO: 516183 - RNA, 21 nt, Human
uaccaaaauaauuucuagcac

SEQ ID NO: 516184 - RNA, 18 nt, Human
uaggaaaaacagguucau

SEQ ID NO: 516185 - RNA, 23 nt, Human
uaggaaaaacagguucauugaug

SEQ ID NO: 516186 - RNA, 18 nt, Human
uauacaaaagauauaaaa

SEQ ID NO: 516187 - RNA, 19 nt, Human
uauacaaaagauauaaaau

SEQ ID NO: 516188 - RNA, 20 nt, Human
uaucuggacagauccuguga

SEQ ID NO: 516189 - RNA, 24 nt, Human
ucaagccgcggcgcggcggcggcg

SEQ ID NO: 516190 - RNA, 23 nt, Human
ucagacccaacauggcggcggcg

SEQ ID NO: 516191 - RNA, 24 nt, Human
ucagcacaucaacuucugcaagga

SEQ ID NO: 516192 - RNA, 18 nt, Human
ucagugaugaaaaaauac

SEQ ID NO: 516193 - RNA, 24 nt, Human
uccaaacauuaaaaaacaaaauca

SEQ ID NO: 516194 - RNA, 25 nt, Human
uccaacagucuacacauguauugcc

SEQ ID NO: 516195 - RNA, 21 nt, Human
ucccacgccacugucgcccgc

SEQ ID NO: 516196 - RNA, 22 nt, Human
uccccaaaagaaaggaggaaaa

SEQ ID NO: 516197 - RNA, 21 nt, Human
uccgcacgcccgcucgcuccg

SEQ ID NO: 516198 - RNA, 19 nt, Human
uccuacaaaaggggggaag

SEQ ID NO: 516199 - RNA, 22 nt, Human
ucugugauuauuuacauuugua

SEQ ID NO: 516200 - RNA, 21 nt, Human
ugaaaauacagcuaaguacau

SEQ ID NO: 516201 - RNA, 25 nt, Human
ugacugacaaaauucucuaccaucc

SEQ ID NO: 516202 - RNA, 21 nt, Human
ugcucgcagagaggcagaucc

SEQ ID NO: 516203 - RNA, 22 nt, Human
uggaaaacuaagaaaaaaagac

SEQ ID NO: 516204 - RNA, 22 nt, Human
uggcccgggacaucuccaacag

SEQ ID NO: 516205 - RNA, 23 nt, Human
uggcucaaaacacaguaucacgg

SEQ ID NO: 516206 - RNA, 23 nt, Human
uuauuccauggccuucauaaaaa

SEQ ID NO: 516207 - RNA, 21 nt, Human
uucaauaucaugauuuguggg

SEQ ID NO: 516208 - RNA, 24 nt, Human
uuccauggccuucauaaaaacaca

SEQ ID NO: 516209 - RNA, 23 nt, Human
uugaugccuaguuuuaaaguccu

SEQ ID NO: 516210 - RNA, 20 nt, Human
uuguuaagucccacugaagu

SEQ ID NO: 516211 - RNA, 22 nt, Human
uuuaaggagaaaguuaagaaaa

SEQ ID NO: 516212 - RNA, 21 nt, Human
uuuguggguccucuaaaaggu

SEQ ID NO: 516213 - RNA, 26 nt, Human
uuuuacaacuauauaaaaaaguuacc

SEQ ID NO: 516214 - RNA, 23 nt, Human
aaaagaaaaaaaaaggcagggaa

SEQ ID NO: 516215 - RNA, 19 nt, Human
aaacuaggaggagcagaga

SEQ ID NO: 516216 - RNA, 20 nt, Human
aacaauaaaacuagcccaga

SEQ ID NO: 516217 - RNA, 20 nt, Human
aacaugaugaaacccugucu

SEQ ID NO: 516218 - RNA, 21 nt, Human
aacaugaugaaacccugucuc

SEQ ID NO: 516219 - RNA, 24 nt, Human
aacuagcccagaaccaaccagccc

SEQ ID NO: 516220 - RNA, 24 nt, Human
aagcagagguugcagugggccaag

SEQ ID NO: 516221 - RNA, 25 nt, Human
aagcagagguugcagugggccaaga

SEQ ID NO: 516222 - RNA, 18 nt, Human
aauaaaacuagcccagaa

SEQ ID NO: 516223 - RNA, 24 nt, Human
aaucacuugaaccuaggaagcaga

SEQ ID NO: 516224 - RNA, 24 nt, Human
accacuauacucuagccugggcga

SEQ ID NO: 516225 - RNA, 24 nt, Human
acccugucucuacuaaaaauacaa

SEQ ID NO: 516226 - RNA, 18 nt, Human
acuauacucuagccuggg

SEQ ID NO: 516227 - RNA, 24 nt, Human
acuauacucuagccugggcgacag

SEQ ID NO: 516228 - RNA, 22 nt, Human
agaaucacuugaaccuaggaag

SEQ ID NO: 516229 - RNA, 21 nt, Human
agagaccauccuggccaacau

SEQ ID NO: 516230 - RNA, 20 nt, Human
agagguugcagugggccaag

SEQ ID NO: 516231 - RNA, 23 nt, Human
agagguugcagugggccaagauc

SEQ ID NO: 516232 - RNA, 24 nt, Human
agagguugcagugggccaagauca

SEQ ID NO: 516233 - RNA, 24 nt, Human
agcacccacuaccccguggguggc

SEQ ID NO: 516234 - RNA, 20 nt, Human
agcccagaaccaaccagccc

SEQ ID NO: 516235 - RNA, 21 nt, Human
agccugggcgacagagguggg

SEQ ID NO: 516236 - RNA, 18 nt, Human
agcgcagccgcgagagcu

SEQ ID NO: 516237 - RNA, 20 nt, Human
agcugggcgugguggcauac

SEQ ID NO: 516238 - RNA, 20 nt, Human
aggaagcagagguugcagug

SEQ ID NO: 516239 - RNA, 18 nt, Human
aggcaggagaaucacuug

SEQ ID NO: 516240 - RNA, 22 nt, Human
aggcaggagaaucacuugaacc

SEQ ID NO: 516241 - RNA, 24 nt, Human
aggcaggagaaucacuugaaccua

SEQ ID NO: 516242 - RNA, 24 nt, Human
aggcugaggcaggagaaucacuug

SEQ ID NO: 516243 - RNA, 24 nt, Human
aguaacaaaagaccaucugagaga

SEQ ID NO: 516244 - RNA, 23 nt, Human
agugggccaagaucacaccacua

SEQ ID NO: 516245 - RNA, 24 nt, Human
aucacaccacuauacucuagccug

SEQ ID NO: 516246 - RNA, 21 nt, Human
auccuggccaacaugaugaaa

SEQ ID NO: 516247 - RNA, 19 nt, Human
augccuauaaucccagcac

SEQ ID NO: 516248 - RNA, 18 nt, Human
caaaagaccaucugagag

SEQ ID NO: 516249 - RNA, 24 nt, Human
caaaauuaacaauaaaacuagccc

SEQ ID NO: 516250 - RNA, 24 nt, Human
caacaugaugaaacccugucucua

SEQ ID NO: 516251 - RNA, 24 nt, Human
cacuauacucuagccugggcgaca

SEQ ID NO: 516252 - RNA, 20 nt, Human
cagaaccaaccagcccggua

SEQ ID NO: 516253 - RNA, 18 nt, Human
cagcacuuggggaggccg

SEQ ID NO: 516254 - RNA, 20 nt, Human
cagcacuuggggaggccgag

SEQ ID NO: 516255 - RNA, 24 nt, Human
cagcuacuugggaggcugaggcag

SEQ ID NO: 516256 - RNA, 20 nt, Human
caugccuauaaucccagcac

SEQ ID NO: 516257 - RNA, 23 nt, Human
caugccuauaaucccagcacuug

SEQ ID NO: 516258 - RNA, 20 nt, Human
ccacuauacucuagccuggg

SEQ ID NO: 516259 - RNA, 21 nt, Human
ccacuauacucuagccugggc

SEQ ID NO: 516260 - RNA, 21 nt, Human
ccacuauacucuagccugggc

SEQ ID NO: 516261 - RNA, 24 nt, Human
ccacuauacucuagccugggcgac

SEQ ID NO: 516262 - RNA, 19 nt, Human
cccguggguggcccggguc

SEQ ID NO: 516263 - RNA, 21 nt, Human
ccuauaaucccagcacuuggg

SEQ ID NO: 516264 - RNA, 22 nt, Human
ccuggccaacaugaugaaaccc

SEQ ID NO: 516265 - RNA, 24 nt, Human
ccuggccaacaugaugaaacccug

SEQ ID NO: 516266 - RNA, 20 nt, Human
cucaccuucugaacucuacc

SEQ ID NO: 516267 - RNA, 24 nt, Human
cucaugccuauaaucccagcacuu

SEQ ID NO: 516268 - RNA, 21 nt, Human
cucuacuaaaaauacaaaaag

SEQ ID NO: 516269 - RNA, 24 nt, Human
cucuuacaaucccagcuacuuggg

SEQ ID NO: 516270 - RNA, 18 nt, Human
cugaacucuaccaguucc

SEQ ID NO: 516271 - RNA, 21 nt, Human
cuuacaaucccagcuacuugg

SEQ ID NO: 516272 - RNA, 24 nt, Human
cuuuccuucuaaugaggaaaaagg

SEQ ID NO: 516273 - RNA, 19 nt, Human
gaaacccugucucuacuaa

SEQ ID NO: 516274 - RNA, 21 nt, Human
gaggaucuccucucuggugga

SEQ ID NO: 516275 - RNA, 18 nt, Human
gaucacuugagggcagga

SEQ ID NO: 516276 - RNA, 23 nt, Human
gaucacuugagggcaggaguuaa

SEQ ID NO: 516277 - RNA, 21 nt, Human
gcaggagaaucacuugaaccu

SEQ ID NO: 516278 - RNA, 24 nt, Human
gccaacaugaugaaacccugucuc

SEQ ID NO: 516279 - RNA, 19 nt, Human
gcuaauacugggagaacca

SEQ ID NO: 516280 - RNA, 22 nt, Human
gcugggcacgguggcucaugcc

SEQ ID NO: 516281 - RNA, 22 nt, Human
ggaacaaccuggcaagcuuaaa

SEQ ID NO: 516282 - RNA, 23 nt, Human
ggcacgguggcucaugccuauaa

SEQ ID NO: 516283 - RNA, 21 nt, Human
ggcgacagagguggggaaaaa

SEQ ID NO: 516284 - RNA, 21 nt, Human
ggcucaugccuauaaucccag

SEQ ID NO: 516285 - RNA, 23 nt, Human
ggcugggcacgguggcucaugcc

SEQ ID NO: 516286 - RNA, 23 nt, Human
ggugaaacuaggaggagcagaga

SEQ ID NO: 516287 - RNA, 23 nt, Human
gguggcucaugccuauaauccca

SEQ ID NO: 516288 - RNA, 24 nt, Human
gguggcucaugccuauaaucccag

SEQ ID NO: 516289 - RNA, 18 nt, Human
guguaccucaggaggucu

SEQ ID NO: 516290 - RNA, 25 nt, Human
uaaaaucagauguaaaaaaagaaaa

SEQ ID NO: 516291 - RNA, 23 nt, Human
uaacaauaaaacuagcccagaac

SEQ ID NO: 516292 - RNA, 22 nt, Human
uaagagaccauccuggccaaca

SEQ ID NO: 516293 - RNA, 19 nt, Human
uaagugucgugcaaaucuu

SEQ ID NO: 516294 - RNA, 22 nt, Human
uaauacugggagaaccauacaa

SEQ ID NO: 516295 - RNA, 23 nt, Human
uaaugcaaggauagagaaaacca

SEQ ID NO: 516296 - RNA, 22 nt, Human
uacucuagccugggcgacagag

SEQ ID NO: 516297 - RNA, 25 nt, Human
uacucuagccugggcgacagaggug

SEQ ID NO: 516298 - RNA, 19 nt, Human
uagaaaaacaacagcucac

SEQ ID NO: 516299 - RNA, 19 nt, Human
uagcugggcgugguggcau

SEQ ID NO: 516300 - RNA, 24 nt, Human
uaggaagcagagguugcagugggc

SEQ ID NO: 516301 - RNA, 23 nt, Human
uaggcugggcacgguggcucaug

SEQ ID NO: 516302 - RNA, 20 nt, Human
uauugccagaacauggugaa

SEQ ID NO: 516303 - RNA, 18 nt, Human
ucacuugagggcaggagu

SEQ ID NO: 516304 - RNA, 19 nt, Human
ucacuugagggcaggaguu

SEQ ID NO: 516305 - RNA, 24 nt, Human
ucagauguaaaaaaagaaaaaaaa

SEQ ID NO: 516306 - RNA, 22 nt, Human
ucaugccuauaaucccagcacu

SEQ ID NO: 516307 - RNA, 25 nt, Human
ucuagccugggcgacagaggugggg

SEQ ID NO: 516308 - RNA, 20 nt, Human
ucucacauauaugaacccau

SEQ ID NO: 516309 - RNA, 23 nt, Human
ucucuacuaaaaauacaaaaagu

SEQ ID NO: 516310 - RNA, 23 nt, Human
ucuuacaaucccagcuacuuggg

SEQ ID NO: 516311 - RNA, 24 nt, Human
ugacaaaauuaacaauaaaacuag

SEQ ID NO: 516312 - RNA, 20 nt, Human
ugaccugaucccugaaguga

SEQ ID NO: 516313 - RNA, 20 nt, Human
ugaggcaggagaaucacuug

SEQ ID NO: 516314 - RNA, 24 nt, Human
ugaggcaggagaaucacuugaacc

SEQ ID NO: 516315 - RNA, 25 nt, Human
ugaggcaggagaaucacuugaaccu

SEQ ID NO: 516316 - RNA, 23 nt, Human
uggaucacuugagggcaggaguu

SEQ ID NO: 516317 - RNA, 24 nt, Human
uggccaacaugaugaaacccuguc

SEQ ID NO: 516318 - RNA, 21 nt, Human
uggcucaugccuauaauccca

SEQ ID NO: 516319 - RNA, 24 nt, Human
uggcucaugccuauaaucccagca

SEQ ID NO: 516320 - RNA, 19 nt, Human
ugggaggcugaggcaggag

SEQ ID NO: 516321 - RNA, 24 nt, Human
ugggaggcugaggcaggagaauca

SEQ ID NO: 516322 - RNA, 19 nt, Human
ugguggaucacuugagggc

SEQ ID NO: 516323 - RNA, 20 nt, Human
uugcagugggccaagaucac

SEQ ID NO: 516324 - RNA, 25 nt, Human
uugggaggcugaggcaggagaauca

SEQ ID NO: 516325 - RNA, 18 nt, Human
uuuacagauauacaaucu

SEQ ID NO: 516326 - RNA, 18 nt, Human
uuuucguucuuuuaauua

SEQ ID NO: 516327 - RNA, 18 nt, Human
aaaauaacuuuggacaaa

SEQ ID NO: 516328 - RNA, 21 nt, Human
aaacaaaccaacacugaagau

SEQ ID NO: 516329 - RNA, 20 nt, Human
aacaacacacacuagcaaaa

SEQ ID NO: 516330 - RNA, 20 nt, Human
aaggaucccuccuguguuac

SEQ ID NO: 516331 - RNA, 21 nt, Human
aaggugucucuaaaagggaca

SEQ ID NO: 516332 - RNA, 21 nt, Human
aauaauagacacaggcaggga

SEQ ID NO: 516333 - RNA, 19 nt, Human
aaugacaacaacaaaaaga

SEQ ID NO: 516334 - RNA, 21 nt, Human
acacugaagauacaaagaaug

SEQ ID NO: 516335 - RNA, 18 nt, Human
acagcugaccuguccucu

SEQ ID NO: 516336 - RNA, 21 nt, Human
acagcugaccuguccucuaca

SEQ ID NO: 516337 - RNA, 21 nt, Human
accaaaaucaaugacaacaac

SEQ ID NO: 516338 - RNA, 19 nt, Human
accgcgcucgcucagaagc

SEQ ID NO: 516339 - RNA, 22 nt, Human
acuggaauacaggacauuucua

SEQ ID NO: 516340 - RNA, 18 nt, Human
agaccuucucugcccaca

SEQ ID NO: 516341 - RNA, 18 nt, Human
agacugagcacagguggc

SEQ ID NO: 516342 - RNA, 21 nt, Human
agcaggacuaaggccucccaa

SEQ ID NO: 516343 - RNA, 23 nt, Human
agcagucagugguucugaaauac

SEQ ID NO: 516344 - RNA, 23 nt, Human
aggcacccucaggaggacggcaa

SEQ ID NO: 516345 - RNA, 21 nt, Human
aggcagcaaauuuccagcgua

SEQ ID NO: 516346 - RNA, 27 nt, Human
augaaaccaggguaacaccuuuggaug

SEQ ID NO: 516347 - RNA, 25 nt, Human
augacaacaacaaaaagaugaggaa

SEQ ID NO: 516348 - RNA, 24 nt, Human
caaaaacaaaggcacaguaaacaa

SEQ ID NO: 516349 - RNA, 26 nt, Human
caaaagcaccgcgcucgcucagaagc

SEQ ID NO: 516350 - RNA, 24 nt, Human
caaaaucaaugacaacaacaaaaa

SEQ ID NO: 516351 - RNA, 26 nt, Human
caaaccaacacugaagauacaaagaa

SEQ ID NO: 516352 - RNA, 27 nt, Human
caacacacacuagcaaaaacaaaggca

SEQ ID NO: 516353 - RNA, 22 nt, Human
caagagcacacagcacugaagc

SEQ ID NO: 516354 - RNA, 19 nt, Human
caaugaaaccaggguaaca

SEQ ID NO: 516355 - RNA, 18 nt, Human
cacacagcacugaagcuc

SEQ ID NO: 516356 - RNA, 22 nt, Human
cacacagcacugaagcuccaga

SEQ ID NO: 516357 - RNA, 21 nt, Human
cacacagugcuuaagcuccag

SEQ ID NO: 516358 - RNA, 21 nt, Human
caccaaaaucaaugacaacaa

SEQ ID NO: 516359 - RNA, 21 nt, Human
cacuggcagagucccagguga

SEQ ID NO: 516360 - RNA, 19 nt, Human
cagacaacuucagaaugua

SEQ ID NO: 516361 - RNA, 19 nt, Human
cagcaaauuuccagcguag

SEQ ID NO: 516362 - RNA, 21 nt, Human
cagcacugaagcuccagauac

SEQ ID NO: 516363 - RNA, 21 nt, Human
caguguggaggccaagagcac

SEQ ID NO: 516364 - RNA, 21 nt, Human
caguguggaggccaagagcac

SEQ ID NO: 516365 - RNA, 20 nt, Human
caucagugauucgggcuccu

SEQ ID NO: 516366 - RNA, 23 nt, Human
caugcccacuuucccauccuaug

SEQ ID NO: 516367 - RNA, 21 nt, Human
caugugcuacauagucgugug

SEQ ID NO: 516368 - RNA, 24 nt, Human
ccaucagugauucgggcuccuucc

SEQ ID NO: 516369 - RNA, 19 nt, Human
cccaaaauaucucuccucc

SEQ ID NO: 516370 - RNA, 24 nt, Human
cccaaaauaucucuccuccuuuuu

SEQ ID NO: 516371 - RNA, 26 nt, Human
ccccuccuuaaccaaguaaccagucc

SEQ ID NO: 516372 - RNA, 21 nt, Human
cccgucccgcguucccaaaag

SEQ ID NO: 516373 - RNA, 18 nt, Human
ccgccacccagccccucg

SEQ ID NO: 516374 - RNA, 24 nt, Human
ccgccgcgccucggcccagcuccu

SEQ ID NO: 516375 - RNA, 23 nt, Human
ccgcgccgccgcgccucggccca

SEQ ID NO: 516376 - RNA, 20 nt, Human
ccucagaaacgcugggugga

SEQ ID NO: 516377 - RNA, 18 nt, Human
ccugcaaaaugaaacccc

SEQ ID NO: 516378 - RNA, 19 nt, Human
ccugccugcagcaaugaca

SEQ ID NO: 516379 - RNA, 20 nt, Human
ccuuccaaggcuccccauga

SEQ ID NO: 516380 - RNA, 22 nt, Human
cgcccgucccgcguucccaaaa

SEQ ID NO: 516381 - RNA, 21 nt, Human
cguagagauaugaauauaaua

SEQ ID NO: 516382 - RNA, 23 nt, Human
cuaaaacaaaccaacacugaaga

SEQ ID NO: 516383 - RNA, 21 nt, Human
cuccagauacccucaggagga

SEQ ID NO: 516384 - RNA, 25 nt, Human
cucgcgacccucaccuacgccuccc

SEQ ID NO: 516385 - RNA, 18 nt, Human
cucggcccagcuccuggc

SEQ ID NO: 516386 - RNA, 21 nt, Human
cucugcccacagaugggcuga

SEQ ID NO: 516387 - RNA, 18 nt, Human
cucuugccagcggcuccu

SEQ ID NO: 516388 - RNA, 19 nt, Human
cugaacccaaaauaucucu

SEQ ID NO: 516389 - RNA, 22 nt, Human
cugaccuugagcagguauagaa

SEQ ID NO: 516390 - RNA, 22 nt, Human
cugcugaaccaucuccaugcac

SEQ ID NO: 516391 - RNA, 23 nt, Human
cuugaugaaacguuuaggcugaa

SEQ ID NO: 516392 - RNA, 21 nt, Human
cuugccagcggcuccugacuc

SEQ ID NO: 516393 - RNA, 19 nt, Human
cuuugaaaaaccacucucc

SEQ ID NO: 516394 - RNA, 18 nt, Human
gaaaaaccacucucccaa

SEQ ID NO: 516395 - RNA, 19 nt, Human
gaaagauuggccaucuucc

SEQ ID NO: 516396 - RNA, 21 nt, Human
gaacccaaaauaucucuccuc

SEQ ID NO: 516397 - RNA, 18 nt, Human
gaagacauuuucagacaa

SEQ ID NO: 516398 - RNA, 20 nt, Human
gaccuggacuugccccugca

SEQ ID NO: 516399 - RNA, 22 nt, Human
gaccuucucugcccacagaugg

SEQ ID NO: 516400 - RNA, 20 nt, Human
gagcacagguggccacuggc

SEQ ID NO: 516401 - RNA, 21 nt, Human
gagccaugcccacuuucccaa

SEQ ID NO: 516402 - RNA, 18 nt, Human
gauuaccuccuaugaaac

SEQ ID NO: 516403 - RNA, 19 nt, Human
gcccgggucaccgggaacc

SEQ ID NO: 516404 - RNA, 24 nt, Human
ggaaccuucgccugggucuaaaca

SEQ ID NO: 516405 - RNA, 24 nt, Human
ggaaccuucgccugggucuaaaca

SEQ ID NO: 516406 - RNA, 23 nt, Human
gggguucaaaauaacuaaagaaa

SEQ ID NO: 516407 - RNA, 19 nt, Human
gucccgcguucccaaaagc

SEQ ID NO: 516408 - RNA, 25 nt, Human
gugguucugaaauacaauccucagc

SEQ ID NO: 516409 - RNA, 21 nt, Human
uaaaacaaaccaacacugaag

SEQ ID NO: 516410 - RNA, 24 nt, Human
uaaaacaaaccaacacugaagaua

SEQ ID NO: 516411 - RNA, 18 nt, Human
uaaagaaauguagcuaca

SEQ ID NO: 516412 - RNA, 22 nt, Human
uaacuaaagaaauguagcuaca

SEQ ID NO: 516413 - RNA, 23 nt, Human
uaacuaaagaaauguagcuacau

SEQ ID NO: 516414 - RNA, 23 nt, Human
uaacuuggguccaacgucuucag

SEQ ID NO: 516415 - RNA, 24 nt, Human
uacagauggaucagcuaaaacaaa

SEQ ID NO: 516416 - RNA, 19 nt, Human
uagaccuucucugcccaca

SEQ ID NO: 516417 - RNA, 22 nt, Human
uagagccaugcccacuuucccc

SEQ ID NO: 516418 - RNA, 19 nt, Human
uagaggaugaucacuggaa

SEQ ID NO: 516419 - RNA, 18 nt, Human
uagcaaaaacaaaggcac

SEQ ID NO: 516420 - RNA, 19 nt, Human
uagcaaaaacaaaggcaca

SEQ ID NO: 516421 - RNA, 21 nt, Human
uagcaaaaacaaaggcacagu

SEQ ID NO: 516422 - RNA, 22 nt, Human
uagcuguggucuuccuaaguau

SEQ ID NO: 516423 - RNA, 20 nt, Human
uaggaauagagccaugccca

SEQ ID NO: 516424 - RNA, 23 nt, Human
uaucauuuacuucuucugaaccc

SEQ ID NO: 516425 - RNA, 18 nt, Human
ucagagacaugccugcaa

SEQ ID NO: 516426 - RNA, 21 nt, Human
uccaaggcuccccaugacugc

SEQ ID NO: 516427 - RNA, 26 nt, Human
ucccgcguucccaaaagcaccgcgcu

SEQ ID NO: 516428 - RNA, 21 nt, Human
uccuguucuuuacaggaugga

SEQ ID NO: 516429 - RNA, 21 nt, Human
ucucaaccgccacccagcccc

SEQ ID NO: 516430 - RNA, 19 nt, Human
ucucucagcuuaguaaggg

SEQ ID NO: 516431 - RNA, 21 nt, Human
ucucucagcuuaguaagggcu

SEQ ID NO: 516432 - RNA, 24 nt, Human
ucuugaugaaacguuuaggcugaa

SEQ ID NO: 516433 - RNA, 19 nt, Human
ugaaaaaccacucucccaa

SEQ ID NO: 516434 - RNA, 21 nt, Human
ugaaaccaggguaacaccuuu

SEQ ID NO: 516435 - RNA, 18 nt, Human
ugaaaccccugaggaacu

SEQ ID NO: 516436 - RNA, 21 nt, Human
ugaaauacaauccucagccaa

SEQ ID NO: 516437 - RNA, 21 nt, Human
ugaauauaauaauagacacag

SEQ ID NO: 516438 - RNA, 22 nt, Human
ugaauucuuagcaguacgauuc

SEQ ID NO: 516439 - RNA, 24 nt, Human
ugacaacaacaaaaagaugaggaa

SEQ ID NO: 516440 - RNA, 24 nt, Human
ugacaugcugucucuugccagcgg

SEQ ID NO: 516441 - RNA, 22 nt, Human
ugaccuguccucuacaaacaag

SEQ ID NO: 516442 - RNA, 26 nt, Human
ugagagccugggucaccaggaaccuu

SEQ ID NO: 516443 - RNA, 18 nt, Human
ugagccagacagcugacc

SEQ ID NO: 516444 - RNA, 24 nt, Human
ugaggaacuuuguagcuacccaga

SEQ ID NO: 516445 - RNA, 24 nt, Human
ugauucgggcuccuuccaaggcuc

SEQ ID NO: 516446 - RNA, 21 nt, Human
ugcugauggacaaacuagacc

SEQ ID NO: 516447 - RNA, 22 nt, Human
uggaaacucacaguaucgacuc

SEQ ID NO: 516448 - RNA, 29 nt, Human
ugucucaaccgccacccagccccucgcug

SEQ ID NO: 516449 - RNA, 19 nt, Human
uguggaggccaagagcaca

SEQ ID NO: 516450 - RNA, 19 nt, Human
uguggaggccaagagcaca

SEQ ID NO: 516451 - RNA, 24 nt, Human
uucaaugaaaccaggguaacaccu

SEQ ID NO: 516452 - RNA, 23 nt, Human
uucagauugccucagaaacgcug

SEQ ID NO: 516453 - RNA, 22 nt, Human
uuuuuuuuuuugauaggcaaaa

SEQ ID NO: 516454 - RNA, 23 nt, Human
uuuuuuuuuuuuuuuuugauagg

SEQ ID NO: 516455 - RNA, 20 nt, Human
uuuuuuuuuuuuuuuuuugg

SEQ ID NO: 516456 - RNA, 26 nt, Human
aacuuguuuccucaaucaagaaaucc

SEQ ID NO: 516457 - RNA, 19 nt, Human
aaggaccccacguugagaa

SEQ ID NO: 516458 - RNA, 19 nt, Human
aaggauaauaagucacugu

SEQ ID NO: 516459 - RNA, 18 nt, Human
aauaguaucauuauccuc

SEQ ID NO: 516460 - RNA, 18 nt, Human
acauuugguuuuaacugu

SEQ ID NO: 516461 - RNA, 20 nt, Human
acugcucuuguuuuuucugg

SEQ ID NO: 516462 - RNA, 24 nt, Human
aggaaggauaauaagucacugucc

SEQ ID NO: 516463 - RNA, 18 nt, Human
aggauaauaagucacugu

SEQ ID NO: 516464 - RNA, 23 nt, Human
agucucuucuuugaaauugugcu

SEQ ID NO: 516465 - RNA, 21 nt, Human
auaguaucuuuuccucaccca

SEQ ID NO: 516466 - RNA, 18 nt, Human
aucaauauccaauguucu

SEQ ID NO: 516467 - RNA, 24 nt, Human
caagaaauugugacaucaacaaug

SEQ ID NO: 516468 - RNA, 21 nt, Human
cacagcccacaggcaccuagg

SEQ ID NO: 516469 - RNA, 21 nt, Human
cagcaaucacaaccuuuagau

SEQ ID NO: 516470 - RNA, 20 nt, Human
cagcaugaaagacucaucug

SEQ ID NO: 516471 - RNA, 23 nt, Human
cagcaugaaagacucaucuguua

SEQ ID NO: 516472 - RNA, 19 nt, Human
caucugccuuuuuuguuuc

SEQ ID NO: 516473 - RNA, 18 nt, Human
cauuugguuuuaacuguu

SEQ ID NO: 516474 - RNA, 24 nt, Human
ccacaggcaccuaggggugcugag

SEQ ID NO: 516475 - RNA, 22 nt, Human
cccaauucaucucugggcucac

SEQ ID NO: 516476 - RNA, 21 nt, Human
cccacaagguagaugaaaggg

SEQ ID NO: 516477 - RNA, 24 nt, Human
cccacaggcaccuaggggugcuga

SEQ ID NO: 516478 - RNA, 22 nt, Human
cccaucacuugcuguccaagga

SEQ ID NO: 516479 - RNA, 22 nt, Human
cccauccugccccaggaaaugu

SEQ ID NO: 516480 - RNA, 18 nt, Human
ccccacagcaaucacaac

SEQ ID NO: 516481 - RNA, 18 nt, Human
ccccugggaacaucgucu

SEQ ID NO: 516482 - RNA, 20 nt, Human
ccuagucuuucuccaggaac

SEQ ID NO: 516483 - RNA, 20 nt, Human
ccucuggauaucccaggcuu

SEQ ID NO: 516484 - RNA, 24 nt, Human
ccucuuugagacccaaaugaaaau

SEQ ID NO: 516485 - RNA, 23 nt, Human
ccuucagaauauggauuagcuug

SEQ ID NO: 516486 - RNA, 25 nt, Human
cuguuuugacugcucuuguuuuuuc

SEQ ID NO: 516487 - RNA, 20 nt, Human
gaagaugccucuggauaucc

SEQ ID NO: 516488 - RNA, 24 nt, Human
gagagguugacuuguugaaucugu

SEQ ID NO: 516489 - RNA, 19 nt, Human
gauucugaaugcccagguu

SEQ ID NO: 516490 - RNA, 20 nt, Human
guacuuuuucauuuccagaa

SEQ ID NO: 516491 - RNA, 24 nt, Human
uaaauguaaggcacagcccacagg

SEQ ID NO: 516492 - RNA, 18 nt, Human
uacuugaacauuuucagu

SEQ ID NO: 516493 - RNA, 23 nt, Human
uaggcugcaaagagccaucuuca

SEQ ID NO: 516494 - RNA, 24 nt, Human
uaggcugcaaagagccaucuucaa

SEQ ID NO: 516495 - RNA, 24 nt, Human
uauaaagaggaugucucaccagga

SEQ ID NO: 516496 - RNA, 20 nt, Human
uauacuugaacauuuucagu

SEQ ID NO: 516497 - RNA, 19 nt, Human
uauuuucuguauucuuuaa

SEQ ID NO: 516498 - RNA, 18 nt, Human
ucacuauuucaacagaau

SEQ ID NO: 516499 - RNA, 21 nt, Human
uccagaauuagcauuguagag

SEQ ID NO: 516500 - RNA, 25 nt, Human
ucccaaaucacagcaugaaagacuc

SEQ ID NO: 516501 - RNA, 19 nt, Human
ucccauccugccccaggaa

SEQ ID NO: 516502 - RNA, 25 nt, Human
uccuaaaucucccacguuuccaagg

SEQ ID NO: 516503 - RNA, 25 nt, Human
uccuucagaauauggauuagcuuga

SEQ ID NO: 516504 - RNA, 18 nt, Human
ugagguugugauuuuucc

SEQ ID NO: 516505 - RNA, 24 nt, Human
ugcccaauucaucucugggcucaa

SEQ ID NO: 516506 - RNA, 23 nt, Human
ugccucuggauaucccaggcuug

SEQ ID NO: 516507 - RNA, 25 nt, Human
ugccugaacagagagguucggugcc

SEQ ID NO: 516508 - RNA, 20 nt, Human
ugcugaggaagaugccucug

SEQ ID NO: 516509 - RNA, 18 nt, Human
uggaaaagggauuccaau

SEQ ID NO: 516510 - RNA, 19 nt, Human
uggaaaauauugucuucaa

SEQ ID NO: 516511 - RNA, 19 nt, Human
ugggcuuacaggugcuugc

SEQ ID NO: 516512 - RNA, 18 nt, Human
ugucugacgucuguaguu

SEQ ID NO: 516513 - RNA, 21 nt, Human
uuaaucccaaaucacagcaug

SEQ ID NO: 516514 - RNA, 18 nt, Human
uucaagaaauugugacau

SEQ ID NO: 516515 - RNA, 24 nt, Human
uucaauuuuuuagguaagaugaaa

SEQ ID NO: 516516 - RNA, 25 nt, Human
uucagaauauggauuagcuugagaa

SEQ ID NO: 516517 - RNA, 21 nt, Human
uucauuuccagaauuagcauu

SEQ ID NO: 516518 - RNA, 19 nt, Human
uuccugagguugugauuuu

SEQ ID NO: 516519 - RNA, 22 nt, Human
uuuaaaaaaaccuucaauuuuc

SEQ ID NO: 516520 - RNA, 23 nt, Human
uuugaaauguuaucaacuuugca

SEQ ID NO: 516521 - RNA, 18 nt, Human
aaaaaagacuuucagaca

SEQ ID NO: 516522 - RNA, 21 nt, Human
aaaaaccaaaaaggagaccaa

SEQ ID NO: 516523 - RNA, 19 nt, Human
aaaaaggagaccaaaaaaa

SEQ ID NO: 516524 - RNA, 25 nt, Human
aaaauagaagacaaaagaaagaaaa

SEQ ID NO: 516525 - RNA, 18 nt, Human
aaacaagaauaggaugca

SEQ ID NO: 516526 - RNA, 29 nt, Human
aaacaagaauaggaugcaaaagggacccc

SEQ ID NO: 516527 - RNA, 19 nt, Human
aaacagauguuagucaucu

SEQ ID NO: 516528 - RNA, 20 nt, Human
aaaccucuuuccuuuauaaa

SEQ ID NO: 516529 - RNA, 22 nt, Human
aaagaaaaccaaagacuaaucu

SEQ ID NO: 516530 - RNA, 20 nt, Human
aaagagacagggucuugcug

SEQ ID NO: 516531 - RNA, 24 nt, Human
aaaguacuaggauuacaggcauga

SEQ ID NO: 516532 - RNA, 24 nt, Human
aaagugcugggauuauaaguguga

SEQ ID NO: 516533 - RNA, 24 nt, Human
aaagugcugggauuauagguguga

SEQ ID NO: 516534 - RNA, 22 nt, Human
aagagacagggucuugcugugu

SEQ ID NO: 516535 - RNA, 21 nt, Human
aagcaagugaaagacaugaga

SEQ ID NO: 516536 - RNA, 25 nt, Human
aagcaauccucccgcccuggccucc

SEQ ID NO: 516537 - RNA, 25 nt, Human
aagcaauccucccgcccuggccucc

SEQ ID NO: 516538 - RNA, 19 nt, Human
aaguacuaggauuacaggc

SEQ ID NO: 516539 - RNA, 24 nt, Human
aagugauccuccugccuuggccuc

SEQ ID NO: 516540 - RNA, 18 nt, Human
aagugcugggauuauaag

SEQ ID NO: 516541 - RNA, 26 nt, Human
aagugcugggauuauaagugugagcc

SEQ ID NO: 516542 - RNA, 18 nt, Human
aagugcugggauuauagg

SEQ ID NO: 516543 - RNA, 26 nt, Human
aagugcugggauuauaggugugagcc

SEQ ID NO: 516544 - RNA, 19 nt, Human
aagugugagccaccaugcc

SEQ ID NO: 516545 - RNA, 20 nt, Human
aaugagagugugcaccaagc

SEQ ID NO: 516546 - RNA, 24 nt, Human
acaagcaccuaaaagauacaaagc

SEQ ID NO: 516547 - RNA, 21 nt, Human
acacucaacagaaggguugga

SEQ ID NO: 516548 - RNA, 20 nt, Human
acagacaaaaaagacuuuca

SEQ ID NO: 516549 - RNA, 24 nt, Human
acaguaaaugggggacccccuaga

SEQ ID NO: 516550 - RNA, 22 nt, Human
accagcuccccagcaaucucaa

SEQ ID NO: 516551 - RNA, 25 nt, Human
accauguugcccaggcugaucucaa

SEQ ID NO: 516552 - RNA, 25 nt, Human
accauguugcccaggcuggucucaa

SEQ ID NO: 516553 - RNA, 21 nt, Human
accuaaaagauacaaagcuuu

SEQ ID NO: 516554 - RNA, 22 nt, Human
acggauuuccaaagcucuuacc

SEQ ID NO: 516555 - RNA, 18 nt, Human
acgggguuucaccauguu

SEQ ID NO: 516556 - RNA, 19 nt, Human
acgggguuucaccauguug

SEQ ID NO: 516557 - RNA, 24 nt, Human
acgggguuucaccauguugcccag

SEQ ID NO: 516558 - RNA, 21 nt, Human
acucacaucaaagcacaucac

SEQ ID NO: 516559 - RNA, 21 nt, Human
acugaaaacuaauuagccaaa

SEQ ID NO: 516560 - RNA, 23 nt, Human
agaaaaaaaccaaaaaggagacc

SEQ ID NO: 516561 - RNA, 19 nt, Human
agaaagagaacagagaaaa

SEQ ID NO: 516562 - RNA, 19 nt, Human
agacaaaagaaagaaaacc

SEQ ID NO: 516563 - RNA, 23 nt, Human
agacaaaagaaagaaaaccaaag

SEQ ID NO: 516564 - RNA, 18 nt, Human
agacagggucuugcugug

SEQ ID NO: 516565 - RNA, 23 nt, Human
agacagggucuugcuguguugcc

SEQ ID NO: 516566 - RNA, 20 nt, Human
agaccaaaaaaacccaaaac

SEQ ID NO: 516567 - RNA, 22 nt, Human
agagaaaacagaugggacaaaa

SEQ ID NO: 516568 - RNA, 19 nt, Human
agagaacagcaagaaaaga

SEQ ID NO: 516569 - RNA, 28 nt, Human
agagaacagcaagaaaagagagaguuac

SEQ ID NO: 516570 - RNA, 24 nt, Human
agagaagaacauuaugcagggaag

SEQ ID NO: 516571 - RNA, 19 nt, Human
agagacaggguuccaccau

SEQ ID NO: 516572 - RNA, 22 nt, Human
agaggugugaccauaccagcuc

SEQ ID NO: 516573 - RNA, 24 nt, Human
agcaagaaaagagagaguuccugg

SEQ ID NO: 516574 - RNA, 20 nt, Human
agcaagugaaagacaugaga

SEQ ID NO: 516575 - RNA, 21 nt, Human
agcaauccucccgcccuggcc

SEQ ID NO: 516576 - RNA, 23 nt, Human
agcaauccucccgcccuggccuc

SEQ ID NO: 516577 - RNA, 24 nt, Human
agcacaucacugagagaauucaga

SEQ ID NO: 516578 - RNA, 23 nt, Human
aggacucaagugauccuccugcc

SEQ ID NO: 516579 - RNA, 23 nt, Human
aggagaccaaaaaaacccaaaac

SEQ ID NO: 516580 - RNA, 23 nt, Human
aggcaguggcacaaucuuggcuc

SEQ ID NO: 516581 - RNA, 20 nt, Human
agggccaaaugcucagagga

SEQ ID NO: 516582 - RNA, 18 nt, Human
aguaaaugggggaccccc

SEQ ID NO: 516583 - RNA, 22 nt, Human
aguagagacgggguuucaccau

SEQ ID NO: 516584 - RNA, 19 nt, Human
aguauucuccuacucugcu

SEQ ID NO: 516585 - RNA, 24 nt, Human
agugcugggauuauaagugugagc

SEQ ID NO: 516586 - RNA, 21 nt, Human
auaaaaacagacucacaucaa

SEQ ID NO: 516587 - RNA, 20 nt, Human
auagaagacaaaagaaagaa

SEQ ID NO: 516588 - RNA, 21 nt, Human
augcuuccagaaauaacauac

SEQ ID NO: 516589 - RNA, 18 nt, Human
augugccaccacgcccag

SEQ ID NO: 516590 - RNA, 24 nt, Human
auuuuaguagagacgggguuucac

SEQ ID NO: 516591 - RNA, 18 nt, Human
caaaaaggagaccaaaaa

SEQ ID NO: 516592 - RNA, 20 nt, Human
caaaaaggagaccaaaaaaa

SEQ ID NO: 516593 - RNA, 26 nt, Human
caaaaaggagaccaaaaaaacccaag

SEQ ID NO: 516594 - RNA, 22 nt, Human
caaaagaaagaaaaccaaagac

SEQ ID NO: 516595 - RNA, 19 nt, Human
caaaaugagagugugcacc

SEQ ID NO: 516596 - RNA, 24 nt, Human
caaaguacuaggauuacaggcaug

SEQ ID NO: 516597 - RNA, 24 nt, Human
caaagugcugggauuauaagugug

SEQ ID NO: 516598 - RNA, 24 nt, Human
caaagugcugggauuauaggugug

SEQ ID NO: 516599 - RNA, 20 nt, Human
caagcaagugaaagacauga

SEQ ID NO: 516600 - RNA, 27 nt, Human
caagcaauccucccgcccuggccuccc

SEQ ID NO: 516601 - RNA, 22 nt, Human
caagcaauucuccugccucagc

SEQ ID NO: 516602 - RNA, 22 nt, Human
caagugauccuccugccuuggc

SEQ ID NO: 516603 - RNA, 27 nt, Human
caagugauccuccugccuuggccuccc

SEQ ID NO: 516604 - RNA, 27 nt, Human
caagugauccuccugccuuggccuccc

SEQ ID NO: 516605 - RNA, 20 nt, Human
caccaagcaagugaaagaca

SEQ ID NO: 516606 - RNA, 20 nt, Human
caccaugccuggccuuguug

SEQ ID NO: 516607 - RNA, 24 nt, Human
caccauguugcccaggcugaucuc

SEQ ID NO: 516608 - RNA, 27 nt, Human
caccauguugcccaggcugaucucaaa

SEQ ID NO: 516609 - RNA, 24 nt, Human
caccauguugcccaggcuggucuc

SEQ ID NO: 516610 - RNA, 27 nt, Human
caccauguugcccaggcuggucucaaa

SEQ ID NO: 516611 - RNA, 21 nt, Human
cacugcaacuuccgccuccca

SEQ ID NO: 516612 - RNA, 21 nt, Human
cagagcacuggggaaaaauaa

SEQ ID NO: 516613 - RNA, 23 nt, Human
cagauaaaaacagacucacauca

SEQ ID NO: 516614 - RNA, 27 nt, Human
cagauaaaacagauaaaaacagacuuc

SEQ ID NO: 516615 - RNA, 23 nt, Human
cagcaaugaucucaaaauuuuaa

SEQ ID NO: 516616 - RNA, 21 nt, Human
cagcaugagaacagacuaacg

SEQ ID NO: 516617 - RNA, 21 nt, Human
cagccaaucaaaccaccaaau

SEQ ID NO: 516618 - RNA, 23 nt, Human
cagggucuugcuguguugcccag

SEQ ID NO: 516619 - RNA, 24 nt, Human
caggguuccaccauguugcccagg

SEQ ID NO: 516620 - RNA, 26 nt, Human
cauaauagugaauaaguguuacgaga

SEQ ID NO: 516621 - RNA, 21 nt, Human
caugugccaccacgcccagcu

SEQ ID NO: 516622 - RNA, 21 nt, Human
cauguuccccuucucaggaaa

SEQ ID NO: 516623 - RNA, 23 nt, Human
cauguugcccaggcugaucucaa

SEQ ID NO: 516624 - RNA, 24 nt, Human
cauguugcccaggcugaucucaaa

SEQ ID NO: 516625 - RNA, 23 nt, Human
cauguugcccaggcuggucucaa

SEQ ID NO: 516626 - RNA, 24 nt, Human
cauguugcccaggcuggucucaaa

SEQ ID NO: 516627 - RNA, 18 nt, Human
ccaaagcagagcaaaaga

SEQ ID NO: 516628 - RNA, 24 nt, Human
ccaaaguacuaggauuacaggcau

SEQ ID NO: 516629 - RNA, 18 nt, Human
ccaaagugcugggauuau

SEQ ID NO: 516630 - RNA, 21 nt, Human
ccaaagugcugggauuauaag

SEQ ID NO: 516631 - RNA, 24 nt, Human
ccaaagugcugggauuauaagugu

SEQ ID NO: 516632 - RNA, 20 nt, Human
ccaaagugcugggauuauag

SEQ ID NO: 516633 - RNA, 21 nt, Human
ccaaagugcugggauuauagg

SEQ ID NO: 516634 - RNA, 24 nt, Human
ccaaagugcugggauuauaggugu

SEQ ID NO: 516635 - RNA, 22 nt, Human
ccaagcagcugggcuaugagac

SEQ ID NO: 516636 - RNA, 20 nt, Human
ccaccacgcccagcuaauuu

SEQ ID NO: 516637 - RNA, 19 nt, Human
ccaggccggaggcaguggc

SEQ ID NO: 516638 - RNA, 22 nt, Human
ccaggccggaggcaguggcaca

SEQ ID NO: 516639 - RNA, 23 nt, Human
cccaagcaauccucccgcccugg

SEQ ID NO: 516640 - RNA, 23 nt, Human
cccagguucaagcaauucuccug

SEQ ID NO: 516641 - RNA, 21 nt, Human
ccccugcacaugcucucuugc

SEQ ID NO: 516642 - RNA, 27 nt, Human
ccgccucccagguucaagcaauucuuu

SEQ ID NO: 516643 - RNA, 18 nt, Human
ccucauucaccuuccgcc

SEQ ID NO: 516644 - RNA, 24 nt, Human
ccucccagguucaagcaauucucc

SEQ ID NO: 516645 - RNA, 26 nt, Human
ccucccgcccuggccucccaaagugc

SEQ ID NO: 516646 - RNA, 26 nt, Human
ccuccugccuuggccucccaaagugc

SEQ ID NO: 516647 - RNA, 24 nt, Human
cgggguuucaccauguugcccagg

SEQ ID NO: 516648 - RNA, 22 nt, Human
cguuguguucacuuuuguaucc

SEQ ID NO: 516649 - RNA, 22 nt, Human
cucaaaggugggacuacaggca

SEQ ID NO: 516650 - RNA, 24 nt, Human
cucaagugauccuccugccuuggc

SEQ ID NO: 516651 - RNA, 19 nt, Human
cucacaucaaagcacauca

SEQ ID NO: 516652 - RNA, 23 nt, Human
cugcaacuuccgccucccagguu

SEQ ID NO: 516653 - RNA, 23 nt, Human
cugccuuggccucccaaagugcu

SEQ ID NO: 516654 - RNA, 21 nt, Human
cugggauuauaggugugagcc

SEQ ID NO: 516655 - RNA, 22 nt, Human
cuguaaccaagaguguggaagc

SEQ ID NO: 516656 - RNA, 23 nt, Human
cuuccagaaauaacauacacaaa

SEQ ID NO: 516657 - RNA, 22 nt, Human
cuugcuguguugcccagacugg

SEQ ID NO: 516658 - RNA, 24 nt, Human
cuuuguccuccaaagagaugucaa

SEQ ID NO: 516659 - RNA, 26 nt, Human
gaaaaaaaccaaaaaggagaccaaaa

SEQ ID NO: 516660 - RNA, 30 nt, Human
gaaaaaaaccaaaaaggagaccaaaaaaag

SEQ ID NO: 516661 - RNA, 21 nt, Human
gaagacaaaagaaagaaaacc

SEQ ID NO: 516662 - RNA, 21 nt, Human
gaagacaaaagaaagaaaacc

SEQ ID NO: 516663 - RNA, 21 nt, Human
gaccaaaaaaacccaaaacag

SEQ ID NO: 516664 - RNA, 22 nt, Human
gacucaagugauccuccugccu

SEQ ID NO: 516665 - RNA, 18 nt, Human
gagaaaaaaaccaaaaag

SEQ ID NO: 516666 - RNA, 20 nt, Human
gagaaaaaaaccaaaaagga

SEQ ID NO: 516667 - RNA, 23 nt, Human
gagacgggguuucaccauguugc

SEQ ID NO: 516668 - RNA, 24 nt, Human
gagacgggguuucaccauguugcc

SEQ ID NO: 516669 - RNA, 19 nt, Human
gagcagcuggcacaugaga

SEQ ID NO: 516670 - RNA, 24 nt, Human
gauaaaaacagacucacaucaaag

SEQ ID NO: 516671 - RNA, 18 nt, Human
gauuacaggcaugaguca

SEQ ID NO: 516672 - RNA, 21 nt, Human
gauuacaggcaugagucacca

SEQ ID NO: 516673 - RNA, 22 nt, Human
gauuacaggcaugagucaccac

SEQ ID NO: 516674 - RNA, 18 nt, Human
gauuauaagugugagcca

SEQ ID NO: 516675 - RNA, 24 nt, Human
gauuauaagugugagccaccaugc

SEQ ID NO: 516676 - RNA, 18 nt, Human
gauuauaggugugagcca

SEQ ID NO: 516677 - RNA, 22 nt, Human
gauuauaggugugagccaccgc

SEQ ID NO: 516678 - RNA, 23 nt, Human
gauuauaggugugagccaccgca

SEQ ID NO: 516679 - RNA, 23 nt, Human
gcaaaaaacaggagcauucagag

SEQ ID NO: 516680 - RNA, 22 nt, Human
gcaacuuccgccucccagguuc

SEQ ID NO: 516681 - RNA, 25 nt, Human
gcaaucucaaacccagggauuagaa

SEQ ID NO: 516682 - RNA, 21 nt, Human
gcaguggcacaaucuuggcuc

SEQ ID NO: 516683 - RNA, 23 nt, Human
gcccagcuaauuuuuuguauuuu

SEQ ID NO: 516684 - RNA, 20 nt, Human
gcccaggccggaggcagugg

SEQ ID NO: 516685 - RNA, 22 nt, Human
gcccuggccucccaaagugcug

SEQ ID NO: 516686 - RNA, 22 nt, Human
gccuuggccucccaaagugcug

SEQ ID NO: 516687 - RNA, 22 nt, Human
gcucaaaggugggacuacaggc

SEQ ID NO: 516688 - RNA, 22 nt, Human
ggaaagguguacucuguggcuc

SEQ ID NO: 516689 - RNA, 21 nt, Human
ggaagaaaagaguauucuccu

SEQ ID NO: 516690 - RNA, 19 nt, Human
ggacuacaggcaugugcca

SEQ ID NO: 516691 - RNA, 22 nt, Human
ggaggcaguggcacaaucuugg

SEQ ID NO: 516692 - RNA, 23 nt, Human
ggagggugcguacauuugaugag

SEQ ID NO: 516693 - RNA, 19 nt, Human
ggauuacaggcaugaguca

SEQ ID NO: 516694 - RNA, 22 nt, Human
ggauuacaggcaugagucacca

SEQ ID NO: 516695 - RNA, 24 nt, Human
ggauuauaagugugagccaccaug

SEQ ID NO: 516696 - RNA, 23 nt, Human
ggcaaucugccugucucggccuc

SEQ ID NO: 516697 - RNA, 21 nt, Human
gggaaggaaagguguacucug

SEQ ID NO: 516698 - RNA, 22 nt, Human
gggaaggaaagguguacucugu

SEQ ID NO: 516699 - RNA, 23 nt, Human
gggguuucaccauguugcccagg

SEQ ID NO: 516700 - RNA, 22 nt, Human
gguaaaacagauaaaacagaua

SEQ ID NO: 516701 - RNA, 20 nt, Human
gguaauugaaucacgaaggc

SEQ ID NO: 516702 - RNA, 20 nt, Human
guaagacaugauuuugcucc

SEQ ID NO: 516703 - RNA, 19 nt, Human
guagagaaggaccaacgaa

SEQ ID NO: 516704 - RNA, 23 nt, Human
guagagacgggguuucaccaugu

SEQ ID NO: 516705 - RNA, 23 nt, Human
uaaaaaauagaagacaaaagaaa

SEQ ID NO: 516706 - RNA, 22 nt, Human
uaaaagggagcuccccugcaca

SEQ ID NO: 516707 - RNA, 22 nt, Human
uaacauacacaaaggauuaaga

SEQ ID NO: 516708 - RNA, 23 nt, Human
uaacauacacaaaggauuaagaa

SEQ ID NO: 516709 - RNA, 21 nt, Human
uaaccaagaguguggaagcca

SEQ ID NO: 516710 - RNA, 22 nt, Human
uaauuagccaaaaccaccagac

SEQ ID NO: 516711 - RNA, 23 nt, Human
uaauuuuuuguauuuuaguagag

SEQ ID NO: 516712 - RNA, 24 nt, Human
uaauuuuuuguauuuuaguagaga

SEQ ID NO: 516713 - RNA, 21 nt, Human
uacacuguaaccaagagugug

SEQ ID NO: 516714 - RNA, 19 nt, Human
uacagccacuuuguccucc

SEQ ID NO: 516715 - RNA, 24 nt, Human
uacaggcaugagucaccacaucca

SEQ ID NO: 516716 - RNA, 24 nt, Human
uacaggcaugugccaccacgccca

SEQ ID NO: 516717 - RNA, 24 nt, Human
uacuaggauuacaggcaugaguca

SEQ ID NO: 516718 - RNA, 18 nt, Human
uagaagacaaaagaaaga

SEQ ID NO: 516719 - RNA, 24 nt, Human
uagaagacaaaagaaagaaaacca

SEQ ID NO: 516720 - RNA, 25 nt, Human
uagaagacaaaagaaagaaaaccaa

SEQ ID NO: 516721 - RNA, 22 nt, Human
uagagacaggguuccaccaugu

SEQ ID NO: 516722 - RNA, 22 nt, Human
uagagacgggguuucaccaugu

SEQ ID NO: 516723 - RNA, 23 nt, Human
uagcagcaugagaacagacuaac

SEQ ID NO: 516724 - RNA, 18 nt, Human
uagcaugucucuuuuccc

SEQ ID NO: 516725 - RNA, 18 nt, Human
uaggauuacaggcaugag

SEQ ID NO: 516726 - RNA, 22 nt, Human
uaggauuacaggcaugagucac

SEQ ID NO: 516727 - RNA, 24 nt, Human
uaggauuacaggcaugagucacca

SEQ ID NO: 516728 - RNA, 24 nt, Human
uaguagagacgggguuucaccaug

SEQ ID NO: 516729 - RNA, 26 nt, Human
uaguagagacgggguuucaccauguu

SEQ ID NO: 516730 - RNA, 21 nt, Human
uauaaacacucaacagaaggg

SEQ ID NO: 516731 - RNA, 23 nt, Human
uauaggugugagccaccgcaucu

SEQ ID NO: 516732 - RNA, 26 nt, Human
uaugagacacugagaggugugaccau

SEQ ID NO: 516733 - RNA, 23 nt, Human
ucacaagcaccuaaaagauacaa

SEQ ID NO: 516734 - RNA, 19 nt, Human
ucacugcaacuuccgccuc

SEQ ID NO: 516735 - RNA, 23 nt, Human
ucacugcaacuuccgccucccag

SEQ ID NO: 516736 - RNA, 24 nt, Human
ucacugcaacuuccgccucccagg

SEQ ID NO: 516737 - RNA, 19 nt, Human
ucacuugaugaugccaaau

SEQ ID NO: 516738 - RNA, 18 nt, Human
uccaaagcucuuaccagc

SEQ ID NO: 516739 - RNA, 27 nt, Human
uccagaaagagaacagagaaaacagau

SEQ ID NO: 516740 - RNA, 24 nt, Human
ucccaaaguacuaggauuacaggc

SEQ ID NO: 516741 - RNA, 23 nt, Human
ucccaaagugcugggauuauaag

SEQ ID NO: 516742 - RNA, 23 nt, Human
ucccaaagugcugggauuauagg

SEQ ID NO: 516743 - RNA, 21 nt, Human
ucccagguucaagcaauucuc

SEQ ID NO: 516744 - RNA, 24 nt, Human
ucccagguucaagcaauucuccug

SEQ ID NO: 516745 - RNA, 22 nt, Human
uccccuuuuugggcuaccucug

SEQ ID NO: 516746 - RNA, 21 nt, Human
uccuagaaguaaaagauaaau

SEQ ID NO: 516747 - RNA, 19 nt, Human
ucucacucucgcccaggcc

SEQ ID NO: 516748 - RNA, 22 nt, Human
ucucacucucgcccaggccgga

SEQ ID NO: 516749 - RNA, 24 nt, Human
ucugagacacccccagccaugugg

SEQ ID NO: 516750 - RNA, 19 nt, Human
ucuuauacuagacggucuc

SEQ ID NO: 516751 - RNA, 21 nt, Human
ucuugaacucuugagcccaag

SEQ ID NO: 516752 - RNA, 18 nt, Human
ucuugcuguguugcccag

SEQ ID NO: 516753 - RNA, 19 nt, Human
ucuugcuguguugcccaga

SEQ ID NO: 516754 - RNA, 24 nt, Human
ucuugcuguguugcccagacuggu

SEQ ID NO: 516755 - RNA, 20 nt, Human
ucuuuccagugauucaggag

SEQ ID NO: 516756 - RNA, 23 nt, Human
ugaaagcccugcgagaaaaaaac

SEQ ID NO: 516757 - RNA, 26 nt, Human
ugaaagcccugcgagaaaaaaaccaa

SEQ ID NO: 516758 - RNA, 22 nt, Human
ugaagaaagccugaacuagaaa

SEQ ID NO: 516759 - RNA, 24 nt, Human
ugaagaaagccugaacuagaaaag

SEQ ID NO: 516760 - RNA, 18 nt, Human
ugauacagccacuuuguc

SEQ ID NO: 516761 - RNA, 24 nt, Human
ugauucugagacacccccagccau

SEQ ID NO: 516762 - RNA, 23 nt, Human
ugcaacuuccgccucccagguuc

SEQ ID NO: 516763 - RNA, 24 nt, Human
ugcccagacuggucuugaacucuu

SEQ ID NO: 516764 - RNA, 28 nt, Human
ugcccaggcuggucucaaaccccugagc

SEQ ID NO: 516765 - RNA, 19 nt, Human
ugccugccgccauguaaga

SEQ ID NO: 516766 - RNA, 24 nt, Human
ugcgagaaaaaaaccaaaaaggag

SEQ ID NO: 516767 - RNA, 24 nt, Human
ugcugggauuauaagugugagcca

SEQ ID NO: 516768 - RNA, 24 nt, Human
ugcuguguugcccagacuggucuu

SEQ ID NO: 516769 - RNA, 19 nt, Human
uggaaaaaaugggaagaaa

SEQ ID NO: 516770 - RNA, 22 nt, Human
uggaaaaugugcuucaccaaaa

SEQ ID NO: 516771 - RNA, 24 nt, Human
uggcacaaucuuggcucacugcaa

SEQ ID NO: 516772 - RNA, 18 nt, Human
ugggacuacaggcaugug

SEQ ID NO: 516773 - RNA, 21 nt, Human
ugggacuacaggcaugugcca

SEQ ID NO: 516774 - RNA, 22 nt, Human
ugggacuacaggcaugugccac

SEQ ID NO: 516775 - RNA, 24 nt, Human
ugggacuacaggcaugugccacca

SEQ ID NO: 516776 - RNA, 18 nt, Human
ugggauuauaagugugag

SEQ ID NO: 516777 - RNA, 22 nt, Human
ugggauuauaagugugagccac

SEQ ID NO: 516778 - RNA, 23 nt, Human
ugggauuauaagugugagccacc

SEQ ID NO: 516779 - RNA, 24 nt, Human
ugggauuauaagugugagccacca

SEQ ID NO: 516780 - RNA, 25 nt, Human
ugggauuauaagugugagccaccau

SEQ ID NO: 516781 - RNA, 18 nt, Human
ugggauuauaggugugag

SEQ ID NO: 516782 - RNA, 19 nt, Human
ugggauuauaggugugagc

SEQ ID NO: 516783 - RNA, 21 nt, Human
ugggauuauaggugugagcca

SEQ ID NO: 516784 - RNA, 22 nt, Human
ugggauuauaggugugagccac

SEQ ID NO: 516785 - RNA, 23 nt, Human
ugggauuauaggugugagccacc

SEQ ID NO: 516786 - RNA, 24 nt, Human
ugggauuauaggugugagccaccg

SEQ ID NO: 516787 - RNA, 19 nt, Human
uggggaaaaauaaagaccu

SEQ ID NO: 516788 - RNA, 25 nt, Human
ugugagccaccaugccuggccuugu

SEQ ID NO: 516789 - RNA, 19 nt, Human
uguguucacuuuuguaucc

SEQ ID NO: 516790 - RNA, 24 nt, Human
uguguugcccagacuggucuugaa

SEQ ID NO: 516791 - RNA, 22 nt, Human
uguugcccagacuggucuugaa

SEQ ID NO: 516792 - RNA, 24 nt, Human
uuagccaaaaccaccagacaacua

SEQ ID NO: 516793 - RNA, 18 nt, Human
uuaguagagacgggguuu

SEQ ID NO: 516794 - RNA, 22 nt, Human
uuaguagagacgggguuucacc

SEQ ID NO: 516795 - RNA, 24 nt, Human
uuaguagagacgggguuucaccau

SEQ ID NO: 516796 - RNA, 21 nt, Human
uucaagcaauucuccugccuc

SEQ ID NO: 516797 - RNA, 26 nt, Human
uucaagcaauucuccugccucagccg

SEQ ID NO: 516798 - RNA, 22 nt, Human
uucacaagcaccuaaaagauac

SEQ ID NO: 516799 - RNA, 20 nt, Human
uuccccuucucaggaaauua

SEQ ID NO: 516800 - RNA, 23 nt, Human
uucugagacacccccagccaugu

SEQ ID NO: 516801 - RNA, 18 nt, Human
uugagaaauucgagaaaa

SEQ ID NO: 516802 - RNA, 21 nt, Human
uugagaaauucgagaaaaucu

SEQ ID NO: 516803 - RNA, 18 nt, Human
uuggccucccaaagugcu

SEQ ID NO: 516804 - RNA, 22 nt, Human
uuucaccauguugcccaggcug

SEQ ID NO: 516805 - RNA, 23 nt, Human
uuucaccauguugcccaggcugg

SEQ ID NO: 516806 - RNA, 24 nt, Human
uuucaccauguugcccaggcuggu

SEQ ID NO: 516807 - RNA, 24 nt, Human
uuuuagagacaggguuccaccaug

SEQ ID NO: 516808 - RNA, 20 nt, Human
uuuuguauuuuaguagagac

SEQ ID NO: 516809 - RNA, 20 nt, Human
uuuuuguauuuuaguagaga

SEQ ID NO: 516810 - RNA, 27 nt, Human
uuuuuuuuuuuuuuuuuuuuuuugggg

SEQ ID NO: 516811 - RNA, 19 nt, Human
aaguagcugggacuacagg

SEQ ID NO: 516812 - RNA, 20 nt, Human
aaguagcugggacuacaggc

SEQ ID NO: 516813 - RNA, 25 nt, Human
aaguagcugggacuacaggcgcccg

SEQ ID NO: 516814 - RNA, 18 nt, Human
acugcaagcuccgccucc

SEQ ID NO: 516815 - RNA, 21 nt, Human
auucuccugccucagccuccc

SEQ ID NO: 516816 - RNA, 22 nt, Human
cacaccauucuccugccucagc

SEQ ID NO: 516817 - RNA, 24 nt, Human
caccaaagucaucuuaugcacuga

SEQ ID NO: 516818 - RNA, 27 nt, Human
cacugaguccuuuuccuugagagguuu

SEQ ID NO: 516819 - RNA, 21 nt, Human
caggcgcccgccacuacgccc

SEQ ID NO: 516820 - RNA, 23 nt, Human
cccaaguagcugggacuacaggc

SEQ ID NO: 516821 - RNA, 23 nt, Human
cccaaguagcugggacuacaggc

SEQ ID NO: 516822 - RNA, 24 nt, Human
ccugccucagccucccaaguagcu

SEQ ID NO: 516823 - RNA, 19 nt, Human
cgccucccggguucacacc

SEQ ID NO: 516824 - RNA, 23 nt, Human
cgugcaguggcgggaucucggcu

SEQ ID NO: 516825 - RNA, 24 nt, Human
cucagccucccaaguagcugggac

SEQ ID NO: 516826 - RNA, 21 nt, Human
cucccggguucacaccauucu

SEQ ID NO: 516827 - RNA, 20 nt, Human
cucugucgcccaggcuggcg

SEQ ID NO: 516828 - RNA, 25 nt, Human
cucuuucuucuucccucauccucau

SEQ ID NO: 516829 - RNA, 23 nt, Human
cuggcgugcaguggcgggaucuc

SEQ ID NO: 516830 - RNA, 19 nt, Human
cuuucuucuucccucaucc

SEQ ID NO: 516831 - RNA, 23 nt, Human
gcccggcuaauuuuuuguauuuu

SEQ ID NO: 516832 - RNA, 20 nt, Human
gccucagccucccaaguagc

SEQ ID NO: 516833 - RNA, 25 nt, Human
gccucccggguucacaccauucucc

SEQ ID NO: 516834 - RNA, 25 nt, Human
gcucugucgcccaggcuggcgugca

SEQ ID NO: 516835 - RNA, 23 nt, Human
gugcaguggcgggaucucggcuc

SEQ ID NO: 516836 - RNA, 24 nt, Human
uaauuuuuuguauuuuuaguagag

SEQ ID NO: 516837 - RNA, 25 nt, Human
uaauuuuuuguauuuuuaguagaga

SEQ ID NO: 516838 - RNA, 26 nt, Human
uacucuuucuucuucccucauccuca

SEQ ID NO: 516839 - RNA, 22 nt, Human
uaguagagacgggguuucacca

SEQ ID NO: 516840 - RNA, 23 nt, Human
uaguagagacgggguuucaccaa

SEQ ID NO: 516841 - RNA, 26 nt, Human
uaguagagacgggguuucaccaaagu

SEQ ID NO: 516842 - RNA, 21 nt, Human
ucacaccauucuccugccuca

SEQ ID NO: 516843 - RNA, 18 nt, Human
ucacugcaagcuccgccu

SEQ ID NO: 516844 - RNA, 19 nt, Human
ucacugcaagcuccgccuc

SEQ ID NO: 516845 - RNA, 24 nt, Human
ucacugcaagcuccgccucccggg

SEQ ID NO: 516846 - RNA, 18 nt, Human
ucagccucccaaguagcu

SEQ ID NO: 516847 - RNA, 20 nt, Human
ucagccucccaaguagcugg

SEQ ID NO: 516848 - RNA, 24 nt, Human
ucccaaguagcugggacuacaggc

SEQ ID NO: 516849 - RNA, 21 nt, Human
ucccggguucacaccauucuc

SEQ ID NO: 516850 - RNA, 24 nt, Human
ucccggguucacaccauucuccug

SEQ ID NO: 516851 - RNA, 18 nt, Human
ucgcccaggcuggcgugc

SEQ ID NO: 516852 - RNA, 26 nt, Human
ucuccugccucagccucccaaguagc

SEQ ID NO: 516853 - RNA, 18 nt, Human
ucucgcucugucgcccag

SEQ ID NO: 516854 - RNA, 18 nt, Human
ucucgcucugucgcccag

SEQ ID NO: 516855 - RNA, 19 nt, Human
ucucgcucugucgcccagg

SEQ ID NO: 516856 - RNA, 23 nt, Human
ucucgcucugucgcccaggcugg

SEQ ID NO: 516857 - RNA, 24 nt, Human
ucucgcucugucgcccaggcuggc

SEQ ID NO: 516858 - RNA, 26 nt, Human
ucucgcucugucgcccaggcuggcgu

SEQ ID NO: 516859 - RNA, 27 nt, Human
ucucgcucugucgcccaggcuggcgug

SEQ ID NO: 516860 - RNA, 24 nt, Human
ucugucgcccaggcuggcgugcag

SEQ ID NO: 516861 - RNA, 22 nt, Human
ugagacggagucucgcucuguc

SEQ ID NO: 516862 - RNA, 24 nt, Human
ugccucagccucccaaguagcugg

SEQ ID NO: 516863 - RNA, 24 nt, Human
uggcgugcaguggcgggaucucgg

SEQ ID NO: 516864 - RNA, 21 nt, Human
ugggacuacaggcgcccgcca

SEQ ID NO: 516865 - RNA, 22 nt, Human
ugggacuacaggcgcccgccac

SEQ ID NO: 516866 - RNA, 22 nt, Human
ugggacuacaggcgcccgccac

SEQ ID NO: 516867 - RNA, 24 nt, Human
ugggacuacaggcgcccgccacua

SEQ ID NO: 516868 - RNA, 21 nt, Human
uguauuuuuaguagagacggg

SEQ ID NO: 516869 - RNA, 21 nt, Human
uuacucuuucuucuucccuca

SEQ ID NO: 516870 - RNA, 18 nt, Human
uuaguagagacgggguuu

SEQ ID NO: 516871 - RNA, 22 nt, Human
uuaguagagacgggguuucacc

SEQ ID NO: 516872 - RNA, 23 nt, Human
uuaguagagacgggguuucacca

SEQ ID NO: 516873 - RNA, 23 nt, Human
uuguauuuuuaguagagacgggg

SEQ ID NO: 516874 - RNA, 21 nt, Human
uuuuguauuuuuaguagagac

SEQ ID NO: 516875 - RNA, 24 nt, Human
uuuuuaguagagacgggguuucac

SEQ ID NO: 516876 - RNA, 21 nt, Human
uuuuuguauuuuuaguagaga

SEQ ID NO: 516877 - RNA, 25 nt, Human
uuuuuuuuuuuugagacggagucuc

SEQ ID NO: 516878 - RNA, 22 nt, Human
uuuuuuuuuuuuuugagacgga

SEQ ID NO: 516879 - RNA, 18 nt, Human
uuuuuuuuuuuuuuuuug

SEQ ID NO: 516880 - RNA, 23 nt, Human
aagaacauuucugagaacagcua

SEQ ID NO: 516881 - RNA, 26 nt, Human
aaggacaccaaggguggcuggagacc

SEQ ID NO: 516882 - RNA, 19 nt, Human
aaggugucugggagcugac

SEQ ID NO: 516883 - RNA, 21 nt, Human
agggcuggggccacagggcgg

SEQ ID NO: 516884 - RNA, 20 nt, Human
auagucaacaaccguggagc

SEQ ID NO: 516885 - RNA, 23 nt, Human
caaaagcugacaaugugaucuug

SEQ ID NO: 516886 - RNA, 24 nt, Human
caccaaggguggcaguauauaguc

SEQ ID NO: 516887 - RNA, 21 nt, Human
cacuugggccaccagguucug

SEQ ID NO: 516888 - RNA, 19 nt, Human
cagagcauaugcugguacu

SEQ ID NO: 516889 - RNA, 23 nt, Human
cagcuaacaaaccugggcuuccc

SEQ ID NO: 516890 - RNA, 20 nt, Human
caggcagugcuaaccuuagc

SEQ ID NO: 516891 - RNA, 23 nt, Human
caggcagugcuaaccuuagccca

SEQ ID NO: 516892 - RNA, 18 nt, Human
cauccgagggcuggggcc

SEQ ID NO: 516893 - RNA, 18 nt, Human
cccacacagagagggaaa

SEQ ID NO: 516894 - RNA, 28 nt, Human
gagcaaccgcaagcuaaagagucuccac

SEQ ID NO: 516895 - RNA, 22 nt, Human
gcuucccagaugcauuccacag

SEQ ID NO: 516896 - RNA, 22 nt, Human
ggaaagaacauuucugagaaca

SEQ ID NO: 516897 - RNA, 19 nt, Human
ggcuggggccacagggcgg

SEQ ID NO: 516898 - RNA, 21 nt, Human
uaaccuuagcccaccuggccc

SEQ ID NO: 516899 - RNA, 21 nt, Human
uccugguucacgaguagagau

SEQ ID NO: 516900 - RNA, 20 nt, Human
ucugggagcugaccuugcuu

SEQ ID NO: 516901 - RNA, 19 nt, Human
ugaggggauguggcaaagg

SEQ ID NO: 516902 - RNA, 21 nt, Human
uggcuuugaaccaaggacacc

SEQ ID NO: 516903 - RNA, 20 nt, Human
uucaaaagcugacaauguga

SEQ ID NO: 516904 - RNA, 23 nt, Human
aaaaaaaaaauucuaaaaaugaa

SEQ ID NO: 516905 - RNA, 20 nt, Human
aaacaagaaagagcaugcag

SEQ ID NO: 516906 - RNA, 22 nt, Human
aaacaagaaagagcaugcagag

SEQ ID NO: 516907 - RNA, 21 nt, Human
aaagcucugucccuccuaccc

SEQ ID NO: 516908 - RNA, 23 nt, Human
aaagcucugucccuccuaccccc

SEQ ID NO: 516909 - RNA, 20 nt, Human
aaauucaccugcaccaaacc

SEQ ID NO: 516910 - RNA, 22 nt, Human
aacaaaacaaaaaaaaaauucu

SEQ ID NO: 516911 - RNA, 27 nt, Human
aacaaaacaaaaaaaaaauucuaaaaa

SEQ ID NO: 516912 - RNA, 18 nt, Human
aacauacauacuauacau

SEQ ID NO: 516913 - RNA, 23 nt, Human
aaccaauaaggcaccaagaaaaa

SEQ ID NO: 516914 - RNA, 22 nt, Human
aacugcuguuucuacugacucc

SEQ ID NO: 516915 - RNA, 22 nt, Human
aagcagaaacaaaaacucauca

SEQ ID NO: 516916 - RNA, 23 nt, Human
aagcagaaacaaaaacucaucaa

SEQ ID NO: 516917 - RNA, 24 nt, Human
aagcagaaacaaaaacucaucaag

SEQ ID NO: 516918 - RNA, 27 nt, Human
aagcagaaacaaaaacucaucaagcug

SEQ ID NO: 516919 - RNA, 21 nt, Human
acacuauccuggcugaaauaa

SEQ ID NO: 516920 - RNA, 18 nt, Human
agaaagcaguuauucaaa

SEQ ID NO: 516921 - RNA, 20 nt, Human
agaaagcaguuauucaaagc

SEQ ID NO: 516922 - RNA, 22 nt, Human
agccggugucaggauuagcgca

SEQ ID NO: 516923 - RNA, 22 nt, Human
aguuggucuggaauuagacccc

SEQ ID NO: 516924 - RNA, 25 nt, Human
auacaacccacaaaacauacauacu

SEQ ID NO: 516925 - RNA, 20 nt, Human
aucuuugucucucuuagggg

SEQ ID NO: 516926 - RNA, 21 nt, Human
augaagucauacugucuuaaa

SEQ ID NO: 516927 - RNA, 19 nt, Human
auggauggaaacagggggu

SEQ ID NO: 516928 - RNA, 24 nt, Human
caauucuuagccacugucccucac

SEQ ID NO: 516929 - RNA, 21 nt, Human
cacagacagacacuauccugg

SEQ ID NO: 516930 - RNA, 21 nt, Human
cacuauccuggcugaaauaaa

SEQ ID NO: 516931 - RNA, 24 nt, Human
cagcagaggugagaacagagacaa

SEQ ID NO: 516932 - RNA, 18 nt, Human
cagcccaggaggcaacag

SEQ ID NO: 516933 - RNA, 22 nt, Human
cagcuccagcccaggaggcaac

SEQ ID NO: 516934 - RNA, 20 nt, Human
caucaggcugcuagcuuuug

SEQ ID NO: 516935 - RNA, 18 nt, Human
ccagacagauuuguuucc

SEQ ID NO: 516936 - RNA, 21 nt, Human
ccagacagauuuguuucccag

SEQ ID NO: 516937 - RNA, 20 nt, Human
ccaggaacgaagcagaaaca

SEQ ID NO: 516938 - RNA, 20 nt, Human
cccacaauuacacacaacac

SEQ ID NO: 516939 - RNA, 19 nt, Human
ccccaaagauccugacuaa

SEQ ID NO: 516940 - RNA, 21 nt, Human
ccccccacuugggcuuagcgu

SEQ ID NO: 516941 - RNA, 24 nt, Human
ccugcaccaaacccguaucaaaag

SEQ ID NO: 516942 - RNA, 26 nt, Human
cuaaaacaaaacaaaaaaaaaauucu

SEQ ID NO: 516943 - RNA, 25 nt, Human
cucaaaugauuauuuuaccuuccca

SEQ ID NO: 516944 - RNA, 20 nt, Human
cucugucccuccuacccccc

SEQ ID NO: 516945 - RNA, 18 nt, Human
cuggagagugcaggucac

SEQ ID NO: 516946 - RNA, 21 nt, Human
cuuauauucugccuacucuuc

SEQ ID NO: 516947 - RNA, 19 nt, Human
cuugacucagguuagcuac

SEQ ID NO: 516948 - RNA, 20 nt, Human
cuuucagaaccacccuccgc

SEQ ID NO: 516949 - RNA, 19 nt, Human
gaaacaagaaagagcaugc

SEQ ID NO: 516950 - RNA, 23 nt, Human
gaacuguaaucauguaucaucug

SEQ ID NO: 516951 - RNA, 19 nt, Human
gaagcagaaacaaaaacuc

SEQ ID NO: 516952 - RNA, 23 nt, Human
gagcaggcaauucuuagccacug

SEQ ID NO: 516953 - RNA, 26 nt, Human
gaggugagaacagagacaaagaagug

SEQ ID NO: 516954 - RNA, 21 nt, Human
gcaguucuuucagaaccaccc

SEQ ID NO: 516955 - RNA, 19 nt, Human
ggaaacaagaaagagcaug

SEQ ID NO: 516956 - RNA, 21 nt, Human
gggacagcagaggugagaaca

SEQ ID NO: 516957 - RNA, 21 nt, Human
ggggaugagggaagagaggga

SEQ ID NO: 516958 - RNA, 19 nt, Human
gugauccaugagguuuucu

SEQ ID NO: 516959 - RNA, 19 nt, Human
uaaaaaucucaaaugauua

SEQ ID NO: 516960 - RNA, 22 nt, Human
uaaggcaccaagaaaaagggag

SEQ ID NO: 516961 - RNA, 22 nt, Human
uacaaaauuuuucugaaguaag

SEQ ID NO: 516962 - RNA, 21 nt, Human
uacaacugcuguuucuacuga

SEQ ID NO: 516963 - RNA, 24 nt, Human
uacacacaacacacacaugggccu

SEQ ID NO: 516964 - RNA, 22 nt, Human
uacauacuauacauaguuugua

SEQ ID NO: 516965 - RNA, 20 nt, Human
uacgugugaugugcucuguc

SEQ ID NO: 516966 - RNA, 21 nt, Human
uauauauuauguauauauaca

SEQ ID NO: 516967 - RNA, 23 nt, Human
uauggauggaaacaggggguggc

SEQ ID NO: 516968 - RNA, 20 nt, Human
ucauacugucuuaaaaugau

SEQ ID NO: 516969 - RNA, 22 nt, Human
ucccacaaauauaauacauaca

SEQ ID NO: 516970 - RNA, 19 nt, Human
ucccaggaucacuugauug

SEQ ID NO: 516971 - RNA, 22 nt, Human
ucgcuggcucuaguguaacuuc

SEQ ID NO: 516972 - RNA, 21 nt, Human
ugacuacagcaugggauaggc

SEQ ID NO: 516973 - RNA, 25 nt, Human
ugagggaagagagggacagcagagg

SEQ ID NO: 516974 - RNA, 24 nt, Human
ugcaccaaacccguaucaaaaguc

SEQ ID NO: 516975 - RNA, 24 nt, Human
ugcccacaauuacacacaacacac

SEQ ID NO: 516976 - RNA, 25 nt, Human
ugcccuggacuucaacuacugacuc

SEQ ID NO: 516977 - RNA, 25 nt, Human
ugcucuguccuguuggccacauuua

SEQ ID NO: 516978 - RNA, 21 nt, Human
uggaaacaagaaagagcaugc

SEQ ID NO: 516979 - RNA, 21 nt, Human
uguaaucauguaucaucugcc

SEQ ID NO: 516980 - RNA, 25 nt, Human
uguagagcacaaaagugaaagaagc

SEQ ID NO: 516981 - RNA, 18 nt, Human
ugucccucacaccugccu

SEQ ID NO: 516982 - RNA, 25 nt, Human
uguugcuaaaacaaaacaaaaaaaa

SEQ ID NO: 516983 - RNA, 27 nt, Human
uguugcuaaaacaaaacaaaaaaaaaa

SEQ ID NO: 516984 - RNA, 20 nt, Human
uuacacacaacacacacaug

SEQ ID NO: 516985 - RNA, 20 nt, Human
uuagaccccaaagauccuga

SEQ ID NO: 516986 - RNA, 22 nt, Human
uucagcauguugcuaaaacaaa

SEQ ID NO: 516987 - RNA, 18 nt, Human
uugccccccacuugggcu

SEQ ID NO: 516988 - RNA, 21 nt, Human
uuggccacauuuaguguuaga

SEQ ID NO: 516989 - RNA, 22 nt, Human
uuggccacauuuaguguuagaa

SEQ ID NO: 516990 - RNA, 19 nt, Human
aaaguauguauuuccagaa

SEQ ID NO: 516991 - RNA, 23 nt, Human
cucgugacaacggaagggguggg

SEQ ID NO: 516992 - RNA, 21 nt, Human
gacgguuggucauucagaaag

SEQ ID NO: 516993 - RNA, 23 nt, Human
gcaggccggaacauuccacaguc

SEQ ID NO: 516994 - RNA, 22 nt, Human
gugacaacggaaggggugggca

SEQ ID NO: 516995 - RNA, 19 nt, Human
uccacaguccagggacggu

SEQ ID NO: 516996 - RNA, 20 nt, Human
ugggcagaaaugcaggccgg

SEQ ID NO: 516997 - RNA, 24 nt, Human
aaaaauaccccaaaugggauaaag

SEQ ID NO: 516998 - RNA, 18 nt, Human
aaaagacagauaaaaacc

SEQ ID NO: 516999 - RNA, 20 nt, Human
aaaauaccccaaaugggaua

SEQ ID NO: 517000 - RNA, 18 nt, Human
aaacaauguggcugaaga

SEQ ID NO: 517001 - RNA, 18 nt, Human
aaaccuuaaaaacugaua

SEQ ID NO: 517002 - RNA, 19 nt, Human
aaagugcugggauuacagg

SEQ ID NO: 517003 - RNA, 24 nt, Human
aaagugcugggauuacaggcuuga

SEQ ID NO: 517004 - RNA, 23 nt, Human
aaauaugaaaccucaccacgacc

SEQ ID NO: 517005 - RNA, 18 nt, Human
aacaugaauuuaaaaugg

SEQ ID NO: 517006 - RNA, 19 nt, Human
aacucuacgaacguaaaaa

SEQ ID NO: 517007 - RNA, 18 nt, Human
aacuguaacaugacggca

SEQ ID NO: 517008 - RNA, 19 nt, Human
aacuuccgcccgcgcccuc

SEQ ID NO: 517009 - RNA, 20 nt, Human
aagaaaaaucugcaaucuug

SEQ ID NO: 517010 - RNA, 19 nt, Human
aagcagccgguauuucauc

SEQ ID NO: 517011 - RNA, 19 nt, Human
aagugcugggauuacaggc

SEQ ID NO: 517012 - RNA, 19 nt, Human
aagugcugggauuacaggc

SEQ ID NO: 517013 - RNA, 26 nt, Human
aagugcugggauuacaggcuugagcc

SEQ ID NO: 517014 - RNA, 23 nt, Human
aauccuuucaacuuuuuuuuuuu

SEQ ID NO: 517015 - RNA, 24 nt, Human
aaucgcuugaacccgggaggcgga

SEQ ID NO: 517016 - RNA, 23 nt, Human
aaucuuguaacucaagucuaaca

SEQ ID NO: 517017 - RNA, 25 nt, Human
acagacuaacaaacugaaccaaaac

SEQ ID NO: 517018 - RNA, 21 nt, Human
acaggacacuuccuacaacac

SEQ ID NO: 517019 - RNA, 30 nt, Human
acccgggugggaggcaggagugggucuggg

SEQ ID NO: 517020 - RNA, 27 nt, Human
acccugucgcccaggcuggagugcaau

SEQ ID NO: 517021 - RNA, 18 nt, Human
acgggguuucaccauauu

SEQ ID NO: 517022 - RNA, 20 nt, Human
acgggguuucaccauauugg

SEQ ID NO: 517023 - RNA, 24 nt, Human
acgggguuucaccauauuggccag

SEQ ID NO: 517024 - RNA, 24 nt, Human
acugcacuccagccugggcaacag

SEQ ID NO: 517025 - RNA, 21 nt, Human
acuuaguggcaagaugcauaa

SEQ ID NO: 517026 - RNA, 21 nt, Human
acuuggaauucuggcccuccu

SEQ ID NO: 517027 - RNA, 22 nt, Human
agaaugcaguauaacgagcugu

SEQ ID NO: 517028 - RNA, 19 nt, Human
agacacgauccugaaguuc

SEQ ID NO: 517029 - RNA, 25 nt, Human
agacggccucccugaggggaagagg

SEQ ID NO: 517030 - RNA, 22 nt, Human
agacuaacaaacugaaccaaaa

SEQ ID NO: 517031 - RNA, 19 nt, Human
agccacagcgcccggccuc

SEQ ID NO: 517032 - RNA, 24 nt, Human
agccugggcaacagacugagacuc

SEQ ID NO: 517033 - RNA, 23 nt, Human
aggaagacgacauucugaaaaaa

SEQ ID NO: 517034 - RNA, 24 nt, Human
aggcaggagaaucgcuugaacccg

SEQ ID NO: 517035 - RNA, 24 nt, Human
aggcaggagugggucuggucagga

SEQ ID NO: 517036 - RNA, 24 nt, Human
aggcaggagugggucuggucagga

SEQ ID NO: 517037 - RNA, 21 nt, Human
aggcggagguugcagugagcc

SEQ ID NO: 517038 - RNA, 24 nt, Human
aggcggagguugcagugagccgag

SEQ ID NO: 517039 - RNA, 18 nt, Human
aggcguugcaaagcaucu

SEQ ID NO: 517040 - RNA, 20 nt, Human
aggcugaggcaggagaaucg

SEQ ID NO: 517041 - RNA, 24 nt, Human
aggcugaggcaggagaaucgcuug

SEQ ID NO: 517042 - RNA, 24 nt, Human
agggauucuccugccucagccucc

SEQ ID NO: 517043 - RNA, 19 nt, Human
aguagcugggauuacaagc

SEQ ID NO: 517044 - RNA, 23 nt, Human
agugcaauggugugaucuuggcu

SEQ ID NO: 517045 - RNA, 24 nt, Human
agugcaauggugugaucuuggcuc

SEQ ID NO: 517046 - RNA, 20 nt, Human
aucauggucugcaaaauuug

SEQ ID NO: 517047 - RNA, 24 nt, Human
auccucaugauccaccugauccuc

SEQ ID NO: 517048 - RNA, 23 nt, Human
auccucaugauccuccugaccuc

SEQ ID NO: 517049 - RNA, 24 nt, Human
aucgcgccacugcacuccagccug

SEQ ID NO: 517050 - RNA, 21 nt, Human
aucuccccccaaguuuuguca

SEQ ID NO: 517051 - RNA, 24 nt, Human
augauccacccgccucggccuccc

SEQ ID NO: 517052 - RNA, 20 nt, Human
auucugaaaaaauaaaucga

SEQ ID NO: 517053 - RNA, 20 nt, Human
caaaagacagauaaaaacca

SEQ ID NO: 517054 - RNA, 23 nt, Human
caaagugcugggauuacaggcuu

SEQ ID NO: 517055 - RNA, 25 nt, Human
caacagacuaacaaacugaaccaaa

SEQ ID NO: 517056 - RNA, 24 nt, Human
caacagacugagacuccauucccc

SEQ ID NO: 517057 - RNA, 22 nt, Human
caagggauucuccugccucagc

SEQ ID NO: 517058 - RNA, 24 nt, Human
cacaauacuggauggcuggggcaa

SEQ ID NO: 517059 - RNA, 21 nt, Human
caccauauuggccaggcugac

SEQ ID NO: 517060 - RNA, 24 nt, Human
caccauauuggccaggcugaccuc

SEQ ID NO: 517061 - RNA, 23 nt, Human
cacccgccucggccucccaaagu

SEQ ID NO: 517062 - RNA, 24 nt, Human
cacccugucgcccaggcuggagug

SEQ ID NO: 517063 - RNA, 25 nt, Human
cacccugucgcccaggcuggagugc

SEQ ID NO: 517064 - RNA, 25 nt, Human
caccuacaacuguaacaugacggca

SEQ ID NO: 517065 - RNA, 22 nt, Human
cacgauccugaaguucaacaga

SEQ ID NO: 517066 - RNA, 21 nt, Human
cacugcaaccuccgccuccca

SEQ ID NO: 517067 - RNA, 18 nt, Human
cacugcacuccagccugg

SEQ ID NO: 517068 - RNA, 19 nt, Human
cacugcacuccagccuggg

SEQ ID NO: 517069 - RNA, 21 nt, Human
cacugcacuccagccugggca

SEQ ID NO: 517070 - RNA, 23 nt, Human
cacugcacuccagccugggcaac

SEQ ID NO: 517071 - RNA, 24 nt, Human
cacugcacuccagccugggcaaca

SEQ ID NO: 517072 - RNA, 23 nt, Human
cagccuaaaauaacccuaaacac

SEQ ID NO: 517073 - RNA, 20 nt, Human
cagccuccugaguagcuggg

SEQ ID NO: 517074 - RNA, 19 nt, Human
cagcgcccggccucaacuu

SEQ ID NO: 517075 - RNA, 24 nt, Human
cagcuauucgggaggcugaggcag

SEQ ID NO: 517076 - RNA, 25 nt, Human
cauauuggccaggcugaccuccuga

SEQ ID NO: 517077 - RNA, 19 nt, Human
ccaaagugcugggauuaca

SEQ ID NO: 517078 - RNA, 22 nt, Human
ccaaagugcugggauuacaggc

SEQ ID NO: 517079 - RNA, 23 nt, Human
ccaaagugcugggauuacaggcu

SEQ ID NO: 517080 - RNA, 21 nt, Human
ccacaauugaaacagugaggc

SEQ ID NO: 517081 - RNA, 18 nt, Human
ccacagcgcccggccuca

SEQ ID NO: 517082 - RNA, 19 nt, Human
ccacuagcguuugccccgg

SEQ ID NO: 517083 - RNA, 18 nt, Human
ccacugcacuccagccug

SEQ ID NO: 517084 - RNA, 20 nt, Human
ccacugcacuccagccuggg

SEQ ID NO: 517085 - RNA, 21 nt, Human
ccacugcacuccagccugggc

SEQ ID NO: 517086 - RNA, 22 nt, Human
ccacugcacuccagccugggca

SEQ ID NO: 517087 - RNA, 23 nt, Human
ccacugcacuccagccugggcaa

SEQ ID NO: 517088 - RNA, 24 nt, Human
ccacugcacuccagccugggcaac

SEQ ID NO: 517089 - RNA, 24 nt, Human
cccaaagugcugggauuacaggcu

SEQ ID NO: 517090 - RNA, 21 nt, Human
cccaacucugcauucugggac

SEQ ID NO: 517091 - RNA, 21 nt, Human
cccagguucaagggauucucc

SEQ ID NO: 517092 - RNA, 24 nt, Human
cccccaaguuuugucagugagaau

SEQ ID NO: 517093 - RNA, 21 nt, Human
cccgaccccgucccccuaaaa

SEQ ID NO: 517094 - RNA, 18 nt, Human
cccggccccacgccuggc

SEQ ID NO: 517095 - RNA, 24 nt, Human
ccgcgcccucgcccucgcccggcg

SEQ ID NO: 517096 - RNA, 24 nt, Human
ccucccagguucaagggauucucc

SEQ ID NO: 517097 - RNA, 23 nt, Human
ccucgcccggcgcugccccggcc

SEQ ID NO: 517098 - RNA, 20 nt, Human
ccucuguacacaaagaugaa

SEQ ID NO: 517099 - RNA, 20 nt, Human
ccugaccucaugauccaccc

SEQ ID NO: 517100 - RNA, 19 nt, Human
ccugaguagcugggauuac

SEQ ID NO: 517101 - RNA, 23 nt, Human
ccugccucagccuccugaguagc

SEQ ID NO: 517102 - RNA, 21 nt, Human
ccuguaaucccagcuauucgg

SEQ ID NO: 517103 - RNA, 21 nt, Human
ccugucaaaccuuucaacaac

SEQ ID NO: 517104 - RNA, 24 nt, Human
ccugucgcccaggcuggagugcaa

SEQ ID NO: 517105 - RNA, 22 nt, Human
cgaaauaugaaaccucaccacg

SEQ ID NO: 517106 - RNA, 26 nt, Human
cgaacguaaaaaaaaacauacuagca

SEQ ID NO: 517107 - RNA, 24 nt, Human
cgagaucgcgccacugcacuccag

SEQ ID NO: 517108 - RNA, 24 nt, Human
cgccucggccucccaaagugcugg

SEQ ID NO: 517109 - RNA, 23 nt, Human
cgccuguaaucccagcuauucgg

SEQ ID NO: 517110 - RNA, 24 nt, Human
cgccuguaaucccagcuauucggg

SEQ ID NO: 517111 - RNA, 29 nt, Human
cggcuaauuuuguauuuuuaguagagacg

SEQ ID NO: 517112 - RNA, 24 nt, Human
cgggaggcggagguugcagugagc

SEQ ID NO: 517113 - RNA, 24 nt, Human
cgggguuucaccauauuggccagg

SEQ ID NO: 517114 - RNA, 25 nt, Human
cguaaaaaaaaacauacuagcaaau

SEQ ID NO: 517115 - RNA, 24 nt, Human
cguggcgggcgccuguaaucccag

SEQ ID NO: 517116 - RNA, 20 nt, Human
cuaccuauaaaacucuacga

SEQ ID NO: 517117 - RNA, 24 nt, Human
cucacccugucgcccaggcuggag

SEQ ID NO: 517118 - RNA, 24 nt, Human
cucacugcaaccuccgccucccag

SEQ ID NO: 517119 - RNA, 23 nt, Human
cucagccuccugaguagcuggga

SEQ ID NO: 517120 - RNA, 19 nt, Human
cucaugauccuccugaccu

SEQ ID NO: 517121 - RNA, 24 nt, Human
cuccugaccucaugauccacccgc

SEQ ID NO: 517122 - RNA, 22 nt, Human
cuccugccucagccuccugagu

SEQ ID NO: 517123 - RNA, 21 nt, Human
cugaaguucaacagacuaaca

SEQ ID NO: 517124 - RNA, 23 nt, Human
cugcaaccuccgccucccagguu

SEQ ID NO: 517125 - RNA, 24 nt, Human
cugcaaccuccgccucccagguuc

SEQ ID NO: 517126 - RNA, 23 nt, Human
cugccucagccuccugaguagcu

SEQ ID NO: 517127 - RNA, 20 nt, Human
cugggaccacuagcguuugc

SEQ ID NO: 517128 - RNA, 22 nt, Human
cuucagcacagaagcgagcucc

SEQ ID NO: 517129 - RNA, 22 nt, Human
gaccucaugauccacccgccuc

SEQ ID NO: 517130 - RNA, 23 nt, Human
gagaaucgcuugaacccgggagg

SEQ ID NO: 517131 - RNA, 24 nt, Human
gagacgggguuucaccauauuggc

SEQ ID NO: 517132 - RNA, 23 nt, Human
gagguugcagugagccgagaucg

SEQ ID NO: 517133 - RNA, 24 nt, Human
gaguagcugggauuacaagcacgc

SEQ ID NO: 517134 - RNA, 18 nt, Human
gauuacaggcuugagcca

SEQ ID NO: 517135 - RNA, 22 nt, Human
gauuacaggcuugagccacagc

SEQ ID NO: 517136 - RNA, 21 nt, Human
gauucuccugccucagccucc

SEQ ID NO: 517137 - RNA, 23 nt, Human
gcaaagcaucuucagcacagaag

SEQ ID NO: 517138 - RNA, 22 nt, Human
gcaaccuccgccucccagguuc

SEQ ID NO: 517139 - RNA, 22 nt, Human
gccacugcacuccagccugggc

SEQ ID NO: 517140 - RNA, 24 nt, Human
gccacugcacuccagccugggcaa

SEQ ID NO: 517141 - RNA, 20 nt, Human
gcccaggcuggagugcaaug

SEQ ID NO: 517142 - RNA, 24 nt, Human
gcccaggcuggagugcaauggugu

SEQ ID NO: 517143 - RNA, 21 nt, Human
gcccccaacucugcauucugg

SEQ ID NO: 517144 - RNA, 18 nt, Human
gccccgaacccuagacuc

SEQ ID NO: 517145 - RNA, 20 nt, Human
gccgagaucgcgccacugca

SEQ ID NO: 517146 - RNA, 18 nt, Human
gccuuuuugccuuuacuu

SEQ ID NO: 517147 - RNA, 20 nt, Human
gcgggcgccuguaaucccag

SEQ ID NO: 517148 - RNA, 21 nt, Human
gcucaucccugauuuuucuca

SEQ ID NO: 517149 - RNA, 19 nt, Human
gcugcgaaauaugaaaccu

SEQ ID NO: 517150 - RNA, 21 nt, Human
gcugggauuacaggcuugagc

SEQ ID NO: 517151 - RNA, 19 nt, Human
ggaaaacaauguacaaaag

SEQ ID NO: 517152 - RNA, 23 nt, Human
ggaaaaccauucuaucuauccac

SEQ ID NO: 517153 - RNA, 22 nt, Human
ggaagaacucuaaaauuaaucc

SEQ ID NO: 517154 - RNA, 24 nt, Human
ggaauaguuaucauggucugcaaa

SEQ ID NO: 517155 - RNA, 20 nt, Human
ggagguugcagugagccgag

SEQ ID NO: 517156 - RNA, 22 nt, Human
ggagguugcagugagccgagau

SEQ ID NO: 517157 - RNA, 24 nt, Human
ggagguugcagugagccgagaucg

SEQ ID NO: 517158 - RNA, 20 nt, Human
ggcaggagugggucugguca

SEQ ID NO: 517159 - RNA, 23 nt, Human
ggcgccguggcgggcgccuguaa

SEQ ID NO: 517160 - RNA, 22 nt, Human
ggcuggagugcaauggugugau

SEQ ID NO: 517161 - RNA, 23 nt, Human
gggguuucaccauauuggccagg

SEQ ID NO: 517162 - RNA, 18 nt, Human
guagcugggauuacaagc

SEQ ID NO: 517163 - RNA, 19 nt, Human
guugcagugagccgagauc

SEQ ID NO: 517164 - RNA, 21 nt, Human
guugcagugagccgagaucgc

SEQ ID NO: 517165 - RNA, 20 nt, Human
uaaaaggaaaacuacccgaa

SEQ ID NO: 517166 - RNA, 23 nt, Human
uaaauagcucucagugcuaaguc

SEQ ID NO: 517167 - RNA, 19 nt, Human
uaaaucacuuacaaaaaua

SEQ ID NO: 517168 - RNA, 21 nt, Human
uaacaaacugaaccaaaacca

SEQ ID NO: 517169 - RNA, 19 nt, Human
uaauauagguccaucuaac

SEQ ID NO: 517170 - RNA, 23 nt, Human
uacaagcacgcgccaccacaccc

SEQ ID NO: 517171 - RNA, 24 nt, Human
uacgaacguaaaaaaaaacauacu

SEQ ID NO: 517172 - RNA, 24 nt, Human
uacuacuucucucacuuuuggugu

SEQ ID NO: 517173 - RNA, 23 nt, Human
uagcaaaucaagaaaaaucugca

SEQ ID NO: 517174 - RNA, 23 nt, Human
uaguagagacgggguuucaccau

SEQ ID NO: 517175 - RNA, 26 nt, Human
uaguagagacgggguuucaccauauu

SEQ ID NO: 517176 - RNA, 21 nt, Human
uaucuaccuauaaaacucuac

SEQ ID NO: 517177 - RNA, 20 nt, Human
ucaauuuucguuuaaguucu

SEQ ID NO: 517178 - RNA, 21 nt, Human
ucaauuuucguuuaaguucuu

SEQ ID NO: 517179 - RNA, 22 nt, Human
ucaauuuucguuuaaguucuug

SEQ ID NO: 517180 - RNA, 24 nt, Human
ucacccugucgcccaggcuggagu

SEQ ID NO: 517181 - RNA, 19 nt, Human
ucacugcaaccuccgccuc

SEQ ID NO: 517182 - RNA, 24 nt, Human
ucacugcaaccuccgccucccagg

SEQ ID NO: 517183 - RNA, 25 nt, Human
ucacugcaaccuccgccucccaggu

SEQ ID NO: 517184 - RNA, 27 nt, Human
ucacugcaaccuccgccucccagguuc

SEQ ID NO: 517185 - RNA, 20 nt, Human
ucagccuccugaguagcugg

SEQ ID NO: 517186 - RNA, 24 nt, Human
ucccaaagugcugggauuacaggc

SEQ ID NO: 517187 - RNA, 21 nt, Human
ucccagguucaagggauucuc

SEQ ID NO: 517188 - RNA, 24 nt, Human
ucccagguucaagggauucuccug

SEQ ID NO: 517189 - RNA, 18 nt, Human
ucccugaggggaagaggu

SEQ ID NO: 517190 - RNA, 18 nt, Human
uccgcccgcgcccucgcc

SEQ ID NO: 517191 - RNA, 18 nt, Human
uccugaguagcugggauu

SEQ ID NO: 517192 - RNA, 22 nt, Human
uccuggaacuuccgcccgcgcc

SEQ ID NO: 517193 - RNA, 20 nt, Human
uccuugaggcccccaacucu

SEQ ID NO: 517194 - RNA, 18 nt, Human
ucgcccaggcuggagugc

SEQ ID NO: 517195 - RNA, 24 nt, Human
ucgcuugaacccgggaggcggagg

SEQ ID NO: 517196 - RNA, 18 nt, Human
ucggccucccaaagugcu

SEQ ID NO: 517197 - RNA, 24 nt, Human
ucgggaggcugaggcaggagaauc

SEQ ID NO: 517198 - RNA, 24 nt, Human
ucucacccugucgcccaggcugga

SEQ ID NO: 517199 - RNA, 26 nt, Human
ucucacccugucgcccaggcuggagu

SEQ ID NO: 517200 - RNA, 27 nt, Human
ucucacccugucgcccaggcuggagug

SEQ ID NO: 517201 - RNA, 18 nt, Human
ucucagugcuaagucaag

SEQ ID NO: 517202 - RNA, 19 nt, Human
ucugcgccgaggcagccug

SEQ ID NO: 517203 - RNA, 22 nt, Human
ugaaaaaauaaaucgcgcuuca

SEQ ID NO: 517204 - RNA, 20 nt, Human
ugaaaccucaccacgaccuc

SEQ ID NO: 517205 - RNA, 21 nt, Human
ugaccucaugauccacccgcc

SEQ ID NO: 517206 - RNA, 22 nt, Human
ugagacuccauuccccgacccc

SEQ ID NO: 517207 - RNA, 22 nt, Human
ugagccgagaucgcgccacugc

SEQ ID NO: 517208 - RNA, 20 nt, Human
ugaggcaggagaaucgcuug

SEQ ID NO: 517209 - RNA, 24 nt, Human
ugaggcaggagaaucgcuugaacc

SEQ ID NO: 517210 - RNA, 25 nt, Human
ugaggcaggagaaucgcuugaaccc

SEQ ID NO: 517211 - RNA, 23 nt, Human
ugaggcccccaacucugcauucu

SEQ ID NO: 517212 - RNA, 23 nt, Human
ugcaauggugugaucuuggcucc

SEQ ID NO: 517213 - RNA, 24 nt, Human
ugccucagccuccugaguagcugg

SEQ ID NO: 517214 - RNA, 24 nt, Human
uggaaauuguuuuaaaggugaacu

SEQ ID NO: 517215 - RNA, 19 nt, Human
uggagugcaauggugugau

SEQ ID NO: 517216 - RNA, 23 nt, Human
uggagugcaauggugugaucuug

SEQ ID NO: 517217 - RNA, 24 nt, Human
uggagugcaauggugugaucuugg

SEQ ID NO: 517218 - RNA, 21 nt, Human
uggcaagaugcauaaaagagg

SEQ ID NO: 517219 - RNA, 23 nt, Human
uggcaagaugcauaaaagaucuu

SEQ ID NO: 517220 - RNA, 21 nt, Human
uggcgggcgccuguaauccca

SEQ ID NO: 517221 - RNA, 22 nt, Human
uggcgggcgccuguaaucccag

SEQ ID NO: 517222 - RNA, 18 nt, Human
ugggaggcaggagugggu

SEQ ID NO: 517223 - RNA, 22 nt, Human
ugggaggcaggagugggucugg

SEQ ID NO: 517224 - RNA, 21 nt, Human
ugggauuacaagcacgcgcca

SEQ ID NO: 517225 - RNA, 22 nt, Human
ugggauuacaagcacgcgccac

SEQ ID NO: 517226 - RNA, 24 nt, Human
ugggauuacaagcacgcgccacca

SEQ ID NO: 517227 - RNA, 18 nt, Human
ugggauuacaggcuugag

SEQ ID NO: 517228 - RNA, 19 nt, Human
ugggauuacaggcuugagc

SEQ ID NO: 517229 - RNA, 21 nt, Human
ugggauuacaggcuugagcca

SEQ ID NO: 517230 - RNA, 22 nt, Human
ugggauuacaggcuugagccac

SEQ ID NO: 517231 - RNA, 26 nt, Human
ugggauuacaggcuugagccacagcg

SEQ ID NO: 517232 - RNA, 23 nt, Human
uguagaaagggaaaacaauguac

SEQ ID NO: 517233 - RNA, 23 nt, Human
uguagaauccuuucaacuuuuuu

SEQ ID NO: 517234 - RNA, 21 nt, Human
uguauuuuuaguagagacggg

SEQ ID NO: 517235 - RNA, 20 nt, Human
ugucgcccaggcuggagugc

SEQ ID NO: 517236 - RNA, 20 nt, Human
uguuaacaacuuuagaauuu

SEQ ID NO: 517237 - RNA, 27 nt, Human
uguuccugucaaaccuuucccccgucg

SEQ ID NO: 517238 - RNA, 21 nt, Human
uuaaauagcucucagugcuaa

SEQ ID NO: 517239 - RNA, 18 nt, Human
uuaguagagacgggguuu

SEQ ID NO: 517240 - RNA, 22 nt, Human
uuaguagagacgggguuucacc

SEQ ID NO: 517241 - RNA, 24 nt, Human
uuaguagagacgggguuucaccau

SEQ ID NO: 517242 - RNA, 22 nt, Human
uuauaaagacaaaagacccacg

SEQ ID NO: 517243 - RNA, 22 nt, Human
uucaacagacuaacaaacugaa

SEQ ID NO: 517244 - RNA, 18 nt, Human
uucaagggauucuccugc

SEQ ID NO: 517245 - RNA, 23 nt, Human
uucaagggauucuccugccucag

SEQ ID NO: 517246 - RNA, 25 nt, Human
uucacaucuccccccaaguuuuguc

SEQ ID NO: 517247 - RNA, 22 nt, Human
uugaaacagugaggcuuuggcc

SEQ ID NO: 517248 - RNA, 24 nt, Human
uugaacccgggaggcggagguugc

SEQ ID NO: 517249 - RNA, 19 nt, Human
uugcagugagccgagaucg

SEQ ID NO: 517250 - RNA, 22 nt, Human
uugcagugagccgagaucgcgc

SEQ ID NO: 517251 - RNA, 23 nt, Human
uuguauuuuuaguagagacgggg

SEQ ID NO: 517252 - RNA, 21 nt, Human
uuucaccauauuggccaggcu

SEQ ID NO: 517253 - RNA, 19 nt, Human
uuuuguauuuuuaguagag

SEQ ID NO: 517254 - RNA, 20 nt, Human
uuuuguauuuuuaguagaga

SEQ ID NO: 517255 - RNA, 24 nt, Human
uuuuuaguagagacgggguuucac

SEQ ID NO: 517256 - RNA, 24 nt, Human
aaaaauuaacagaagacugaauua

SEQ ID NO: 517257 - RNA, 21 nt, Human
aaaauaauuuuacaaacuaca

SEQ ID NO: 517258 - RNA, 24 nt, Human
aaaguacacauccuucaaaacccc

SEQ ID NO: 517259 - RNA, 23 nt, Human
aaccaaaauaauuuuacaaacua

SEQ ID NO: 517260 - RNA, 18 nt, Human
acaagccgcguccuggaa

SEQ ID NO: 517261 - RNA, 21 nt, Human
acacauccuucaaaaccccgc

SEQ ID NO: 517262 - RNA, 21 nt, Human
acauccuucaaaaccccgcua

SEQ ID NO: 517263 - RNA, 22 nt, Human
agccgcggaagcccccacugcc

SEQ ID NO: 517264 - RNA, 22 nt, Human
auauuuuaauucuggacuuuca

SEQ ID NO: 517265 - RNA, 19 nt, Human
cacuucugaauucagcccu

SEQ ID NO: 517266 - RNA, 18 nt, Human
ccgcuggcuugcagccgc

SEQ ID NO: 517267 - RNA, 22 nt, Human
cggcgagaaaggcugcaggacc

SEQ ID NO: 517268 - RNA, 23 nt, Human
cuaccaagcauccuaaucaauua

SEQ ID NO: 517269 - RNA, 25 nt, Human
cucacucccgcgcccuuucuccgcc

SEQ ID NO: 517270 - RNA, 24 nt, Human
cuccuccucaaccuucccucgcug

SEQ ID NO: 517271 - RNA, 20 nt, Human
cucucucacucccgcgcccu

SEQ ID NO: 517272 - RNA, 18 nt, Human
gaacagacugcggcacgg

SEQ ID NO: 517273 - RNA, 19 nt, Human
gacaguggcugacucaccc

SEQ ID NO: 517274 - RNA, 24 nt, Human
gaccaggcucuggcuccuccucaa

SEQ ID NO: 517275 - RNA, 18 nt, Human
gcccgggagaacuccgcu

SEQ ID NO: 517276 - RNA, 21 nt, Human
gccgcggaagcccccacugcc

SEQ ID NO: 517277 - RNA, 23 nt, Human
ggcugacucacccucucucacuc

SEQ ID NO: 517278 - RNA, 20 nt, Human
guaaaauuuugaaaaucuac

SEQ ID NO: 517279 - RNA, 19 nt, Human
guggcugacucacccucuc

SEQ ID NO: 517280 - RNA, 23 nt, Human
uaaaaaaaaagcauacuaacuaa

SEQ ID NO: 517281 - RNA, 23 nt, Human
uaaaauuuugaaaaucuaccacu

SEQ ID NO: 517282 - RNA, 22 nt, Human
uaaucaacuuuuuuuccaagaa

SEQ ID NO: 517283 - RNA, 20 nt, Human
uauugcauagacaguggcug

SEQ ID NO: 517284 - RNA, 18 nt, Human
ucaaaacaauccacugug

SEQ ID NO: 517285 - RNA, 21 nt, Human
uccgcucgcccucacaggacc

SEQ ID NO: 517286 - RNA, 24 nt, Human
uccuaaucaacuuuuuuuccaaga

SEQ ID NO: 517287 - RNA, 24 nt, Human
ucugcacauuaucaaaaugaaauc

SEQ ID NO: 517288 - RNA, 22 nt, Human
ucuggcuccuccucaaccuucc

SEQ ID NO: 517289 - RNA, 21 nt, Human
ugaaaaaaaccuaccaagcau

SEQ ID NO: 517290 - RNA, 19 nt, Human
ugacggcgagaaaggcugc

SEQ ID NO: 517291 - RNA, 23 nt, Human
ugcggcacgggccgcacuucuga

SEQ ID NO: 517292 - RNA, 20 nt, Human
uuccaagaaaaagaaacgau

SEQ ID NO: 517293 - RNA, 21 nt, Human
uuuuuuuuuuuuuuuugcuuu

SEQ ID NO: 517294 - RNA, 24 nt, Human
uuuuuuuuuuuuuuuugcuuucug

SEQ ID NO: 517295 - RNA, 19 nt, Human
aaacaucaccuccucuccc

SEQ ID NO: 517296 - RNA, 21 nt, Human
aaaccagcauacagaccaauu

SEQ ID NO: 517297 - RNA, 24 nt, Human
aaagaaaccaauauaaauuucaaa

SEQ ID NO: 517298 - RNA, 20 nt, Human
aaagacuaguaggacuugga

SEQ ID NO: 517299 - RNA, 20 nt, Human
aacauggcgaaacccugucu

SEQ ID NO: 517300 - RNA, 21 nt, Human
aacauggcgaaacccugucuc

SEQ ID NO: 517301 - RNA, 23 nt, Human
aaccuguuuguuuaaagaaugaa

SEQ ID NO: 517302 - RNA, 22 nt, Human
aagaauuugccuuucuaacaag

SEQ ID NO: 517303 - RNA, 21 nt, Human
aagcaguuaggauucgaaugc

SEQ ID NO: 517304 - RNA, 23 nt, Human
aagccccagaaccuaacagagaa

SEQ ID NO: 517305 - RNA, 24 nt, Human
aagccccagaaccuaacagagaag

SEQ ID NO: 517306 - RNA, 25 nt, Human
aaggugggcggaucacauaaggcca

SEQ ID NO: 517307 - RNA, 24 nt, Human
aauugcuugaacccaggagucgga

SEQ ID NO: 517308 - RNA, 21 nt, Human
acaccagcuugaaaagaaacc

SEQ ID NO: 517309 - RNA, 23 nt, Human
acagagugagacucugucucaaa

SEQ ID NO: 517310 - RNA, 24 nt, Human
acagagugagacucugucucaaaa

SEQ ID NO: 517311 - RNA, 24 nt, Human
acauaaggccaggaguucaagacc

SEQ ID NO: 517312 - RNA, 24 nt, Human
accacuccucucuuuuuucuccca

SEQ ID NO: 517313 - RNA, 21 nt, Human
acccagaagacauaacuugau

SEQ ID NO: 517314 - RNA, 24 nt, Human
acccugucucuacuaaaaauacaa

SEQ ID NO: 517315 - RNA, 23 nt, Human
acucagguugcugggccccacag

SEQ ID NO: 517316 - RNA, 21 nt, Human
acuccagccuaggugacagag

SEQ ID NO: 517317 - RNA, 23 nt, Human
acuccagccuaggugacagagug

SEQ ID NO: 517318 - RNA, 24 nt, Human
acuccagccuaggugacagaguga

SEQ ID NO: 517319 - RNA, 21 nt, Human
acugccccagggugcacguac

SEQ ID NO: 517320 - RNA, 19 nt, Human
acuuagaugacggcuucac

SEQ ID NO: 517321 - RNA, 23 nt, Human
acuucauacccaggccgcaucug

SEQ ID NO: 517322 - RNA, 24 nt, Human
agaaaccaauauaaauuucaaaau

SEQ ID NO: 517323 - RNA, 20 nt, Human
agacuucuacaaccacuccu

SEQ ID NO: 517324 - RNA, 22 nt, Human
agaggaaaaguuugcugcugcu

SEQ ID NO: 517325 - RNA, 24 nt, Human
agcacuuugggaagccaagguggg

SEQ ID NO: 517326 - RNA, 24 nt, Human
agccuaggugacagagugagacuc

SEQ ID NO: 517327 - RNA, 24 nt, Human
agccuggccaacauggcgaaaccc

SEQ ID NO: 517328 - RNA, 23 nt, Human
aggcagaagaauugcuugaaccc

SEQ ID NO: 517329 - RNA, 24 nt, Human
aggcgagguggcucaugccuguaa

SEQ ID NO: 517330 - RNA, 24 nt, Human
aggcugaggcagaagaauugcuug

SEQ ID NO: 517331 - RNA, 18 nt, Human
aggguccucucuggguuc

SEQ ID NO: 517332 - RNA, 19 nt, Human
aguacuuggaggacuggau

SEQ ID NO: 517333 - RNA, 24 nt, Human
agucggagguugcagugagccgag

SEQ ID NO: 517334 - RNA, 21 nt, Human
agugagccgagaucaaaccac

SEQ ID NO: 517335 - RNA, 21 nt, Human
agugaugggaaaagaagggcu

SEQ ID NO: 517336 - RNA, 22 nt, Human
auacacccaaaauaugagagga

SEQ ID NO: 517337 - RNA, 21 nt, Human
aucaccuccucuccccgaccc

SEQ ID NO: 517338 - RNA, 22 nt, Human
aucccagcacuuugggaagcca

SEQ ID NO: 517339 - RNA, 24 nt, Human
aucuuuguuuuacacagucucaga

SEQ ID NO: 517340 - RNA, 19 nt, Human
augccuguaaucccagcac

SEQ ID NO: 517341 - RNA, 22 nt, Human
auuauucaaauguauuucuuga

SEQ ID NO: 517342 - RNA, 23 nt, Human
caaaauaaaccagcauacagacc

SEQ ID NO: 517343 - RNA, 24 nt, Human
caaaauaaaccagcauacagacca

SEQ ID NO: 517344 - RNA, 20 nt, Human
caaaccacugcaacuccagc

SEQ ID NO: 517345 - RNA, 19 nt, Human
caaaggaucacuuaaaaca

SEQ ID NO: 517346 - RNA, 22 nt, Human
caaaguaucguuccaaaguaga

SEQ ID NO: 517347 - RNA, 26 nt, Human
caacacaucaccaccauaagacaagc

SEQ ID NO: 517348 - RNA, 24 nt, Human
caacauggcgaaacccugucucua

SEQ ID NO: 517349 - RNA, 24 nt, Human
caacuccagccuaggugacagagu

SEQ ID NO: 517350 - RNA, 20 nt, Human
caagaguugcuacauuuaac

SEQ ID NO: 517351 - RNA, 23 nt, Human
caagccccagaaccuaacagaga

SEQ ID NO: 517352 - RNA, 22 nt, Human
caaggaaagcaaugcuauuucc

SEQ ID NO: 517353 - RNA, 19 nt, Human
caaggugggcggaucacau

SEQ ID NO: 517354 - RNA, 19 nt, Human
cacacaguagugacaaagc

SEQ ID NO: 517355 - RNA, 19 nt, Human
cacaucuguaaucccagcu

SEQ ID NO: 517356 - RNA, 18 nt, Human
caccuccucuccccgacc

SEQ ID NO: 517357 - RNA, 20 nt, Human
caccuccucuccccgacccc

SEQ ID NO: 517358 - RNA, 19 nt, Human
cacuauaugagccagcacc

SEQ ID NO: 517359 - RNA, 21 nt, Human
cacuauaugagccagcaccau

SEQ ID NO: 517360 - RNA, 18 nt, Human
cacugcaacuccagccua

SEQ ID NO: 517361 - RNA, 23 nt, Human
cagaccccaaagugaaaaugcaa

SEQ ID NO: 517362 - RNA, 18 nt, Human
cagcaccaggguccucuc

SEQ ID NO: 517363 - RNA, 24 nt, Human
cagcacuuugggaagccaaggugg

SEQ ID NO: 517364 - RNA, 24 nt, Human
cagcuacucaggaggcugaggcag

SEQ ID NO: 517365 - RNA, 21 nt, Human
cagcuugaaaagaaaccaaua

SEQ ID NO: 517366 - RNA, 27 nt, Human
caggaggcugaggcagaagaauugcuu

SEQ ID NO: 517367 - RNA, 18 nt, Human
caggagugccugcccagc

SEQ ID NO: 517368 - RNA, 22 nt, Human
caggcgggaaacacugcccccu

SEQ ID NO: 517369 - RNA, 18 nt, Human
cagugagccgagaucaaa

SEQ ID NO: 517370 - RNA, 21 nt, Human
cauaagacaagcuauuuuguc

SEQ ID NO: 517371 - RNA, 24 nt, Human
caucuguaaucccagcuacucagg

SEQ ID NO: 517372 - RNA, 20 nt, Human
caugccuguaaucccagcac

SEQ ID NO: 517373 - RNA, 24 nt, Human
caugccuguaaucccagcacuuug

SEQ ID NO: 517374 - RNA, 23 nt, Human
cauuuaacuguauccccauuuau

SEQ ID NO: 517375 - RNA, 21 nt, Human
ccacugcaacuccagccuagg

SEQ ID NO: 517376 - RNA, 22 nt, Human
ccacugcaacuccagccuaggu

SEQ ID NO: 517377 - RNA, 25 nt, Human
ccacugcaacuccagccuaggugac

SEQ ID NO: 517378 - RNA, 19 nt, Human
ccagaaccuaacagagaag

SEQ ID NO: 517379 - RNA, 28 nt, Human
ccagaagacauaacuugauaggacauca

SEQ ID NO: 517380 - RNA, 21 nt, Human
ccaucacucucuucugaacac

SEQ ID NO: 517381 - RNA, 18 nt, Human
ccauuccagggacuacac

SEQ ID NO: 517382 - RNA, 21 nt, Human
cccagaaccuaacagagaagc

SEQ ID NO: 517383 - RNA, 21 nt, Human
cccaucacucucuucugaaca

SEQ ID NO: 517384 - RNA, 23 nt, Human
ccccagaaccuaacagagaagca

SEQ ID NO: 517385 - RNA, 22 nt, Human
ccuaggugacagagugagacuc

SEQ ID NO: 517386 - RNA, 19 nt, Human
ccuccucuccccgacccca

SEQ ID NO: 517387 - RNA, 22 nt, Human
ccucggucauuagggggaaagg

SEQ ID NO: 517388 - RNA, 19 nt, Human
ccugccuuagaaacucaaa

SEQ ID NO: 517389 - RNA, 22 nt, Human
ccuggccaacauggcgaaaccc

SEQ ID NO: 517390 - RNA, 24 nt, Human
ccuggccaacauggcgaaacccug

SEQ ID NO: 517391 - RNA, 20 nt, Human
ccuuagaaauaaagugggcc

SEQ ID NO: 517392 - RNA, 20 nt, Human
ccuuggucaucugugaacga

SEQ ID NO: 517393 - RNA, 22 nt, Human
cgagaucaaaccacugcaacuc

SEQ ID NO: 517394 - RNA, 24 nt, Human
cggaucacauaaggccaggaguuc

SEQ ID NO: 517395 - RNA, 23 nt, Human
cucaugccuguaaucccagcacu

SEQ ID NO: 517396 - RNA, 24 nt, Human
cucaugccuguaaucccagcacuu

SEQ ID NO: 517397 - RNA, 24 nt, Human
cuccuuuauugugaaacagaacaa

SEQ ID NO: 517398 - RNA, 19 nt, Human
cucucucucucucauuuug

SEQ ID NO: 517399 - RNA, 19 nt, Human
cucugucucaaaaaaaaaa

SEQ ID NO: 517400 - RNA, 22 nt, Human
cugaaaaugcagaacccaguga

SEQ ID NO: 517401 - RNA, 22 nt, Human
cugaggggaaagggaagaggag

SEQ ID NO: 517402 - RNA, 18 nt, Human
cugauugcuugacauguc

SEQ ID NO: 517403 - RNA, 21 nt, Human
cuguaaucccagcuacucagg

SEQ ID NO: 517404 - RNA, 24 nt, Human
cuguuuguuuaaagaaugaaggcc

SEQ ID NO: 517405 - RNA, 20 nt, Human
cuucaaaaacaguuuuucuc

SEQ ID NO: 517406 - RNA, 26 nt, Human
cuugcaaagagccucagcagucuccc

SEQ ID NO: 517407 - RNA, 20 nt, Human
gaaaaugcaacacaucacca

SEQ ID NO: 517408 - RNA, 19 nt, Human
gaaacccugucucuacuaa

SEQ ID NO: 517409 - RNA, 26 nt, Human
gaaacuugcucuuauuauuuucuaaa

SEQ ID NO: 517410 - RNA, 19 nt, Human
gaagaggaggagauaucag

SEQ ID NO: 517411 - RNA, 20 nt, Human
gagaugacaccagcuugaaa

SEQ ID NO: 517412 - RNA, 22 nt, Human
gagguugcagugagccgagauc

SEQ ID NO: 517413 - RNA, 21 nt, Human
gagucggagguugcagugagc

SEQ ID NO: 517414 - RNA, 24 nt, Human
gaucacauaaggccaggaguucaa

SEQ ID NO: 517415 - RNA, 18 nt, Human
gauugcaagccccagaac

SEQ ID NO: 517416 - RNA, 21 nt, Human
gcaaaauaccuucaggauaaa

SEQ ID NO: 517417 - RNA, 22 nt, Human
gcagaagaauugcuugaaccca

SEQ ID NO: 517418 - RNA, 24 nt, Human
gccaacauggcgaaacccugucuc

SEQ ID NO: 517419 - RNA, 19 nt, Human
gcugauuugcucuggauuc

SEQ ID NO: 517420 - RNA, 18 nt, Human
gcugcuuccaaaagugcc

SEQ ID NO: 517421 - RNA, 24 nt, Human
gcuggugcacaucuguaaucccag

SEQ ID NO: 517422 - RNA, 18 nt, Human
ggacugucuaacucaaaa

SEQ ID NO: 517423 - RNA, 18 nt, Human
ggacuucaaagacuagua

SEQ ID NO: 517424 - RNA, 20 nt, Human
ggaggacuggauugggagcc

SEQ ID NO: 517425 - RNA, 20 nt, Human
ggagguugcagugagccgag

SEQ ID NO: 517426 - RNA, 22 nt, Human
ggagguugcagugagccgagau

SEQ ID NO: 517427 - RNA, 23 nt, Human
ggagguugcagugagccgagauc

SEQ ID NO: 517428 - RNA, 24 nt, Human
ggagguugcagugagccgagauca

SEQ ID NO: 517429 - RNA, 21 nt, Human
ggccaggcgagguggcucaug

SEQ ID NO: 517430 - RNA, 24 nt, Human
gggcagggucagggaccccgaaau

SEQ ID NO: 517431 - RNA, 23 nt, Human
gggugugcuggugcacaucugua

SEQ ID NO: 517432 - RNA, 23 nt, Human
gguggcucaugccuguaauccca

SEQ ID NO: 517433 - RNA, 24 nt, Human
gguggcucaugccuguaaucccag

SEQ ID NO: 517434 - RNA, 24 nt, Human
gugacagagugagacucugucuca

SEQ ID NO: 517435 - RNA, 23 nt, Human
guggcucaugccuguaaucccag

SEQ ID NO: 517436 - RNA, 24 nt, Human
guuacaucccuuauucauacggug

SEQ ID NO: 517437 - RNA, 19 nt, Human
guugcagugagccgagauc

SEQ ID NO: 517438 - RNA, 20 nt, Human
guuggcagucgcuccaucua

SEQ ID NO: 517439 - RNA, 19 nt, Human
uaaaacaggagugccugcc

SEQ ID NO: 517440 - RNA, 23 nt, Human
uaaaacaggagugccugcccagc

SEQ ID NO: 517441 - RNA, 23 nt, Human
uaaaauuaaaugcaaacacuaaa

SEQ ID NO: 517442 - RNA, 21 nt, Human
uaaagugggccacugaaauca

SEQ ID NO: 517443 - RNA, 24 nt, Human
uaaauuucaaaauaaaccagcaua

SEQ ID NO: 517444 - RNA, 21 nt, Human
uaacaaguuccugggugaugu

SEQ ID NO: 517445 - RNA, 22 nt, Human
uaacagagaagcacuuaaacau

SEQ ID NO: 517446 - RNA, 25 nt, Human
uaacccagcuugguguuuuccuaag

SEQ ID NO: 517447 - RNA, 21 nt, Human
uaaugggcuuuuaguguuaca

SEQ ID NO: 517448 - RNA, 24 nt, Human
uagaaacaucaccuccucuccccg

SEQ ID NO: 517449 - RNA, 18 nt, Human
uagaggcaaaugccuucc

SEQ ID NO: 517450 - RNA, 20 nt, Human
uagcauuuguuguagugauu

SEQ ID NO: 517451 - RNA, 21 nt, Human
uagggagacuucuacaaccac

SEQ ID NO: 517452 - RNA, 21 nt, Human
uaggugacagagugagacucu

SEQ ID NO: 517453 - RNA, 25 nt, Human
uaucucacaacagggugagauuuua

SEQ ID NO: 517454 - RNA, 23 nt, Human
ucaaaauaaaccagcauacagac

SEQ ID NO: 517455 - RNA, 22 nt, Human
ucaaggaaagcaaugcuauuuc

SEQ ID NO: 517456 - RNA, 23 nt, Human
uccagccuaggugacagagugag

SEQ ID NO: 517457 - RNA, 24 nt, Human
uccagccuaggugacagagugaga

SEQ ID NO: 517458 - RNA, 22 nt, Human
ucccugaaggagagagacaauc

SEQ ID NO: 517459 - RNA, 26 nt, Human
ucccugaaggagagagacaaucaagg

SEQ ID NO: 517460 - RNA, 24 nt, Human
uccuaagggagcuacaaauucugg

SEQ ID NO: 517461 - RNA, 24 nt, Human
ucucaagcccaggacugucuaacu

SEQ ID NO: 517462 - RNA, 22 nt, Human
ucucuacuaaaaauacaaaaaa

SEQ ID NO: 517463 - RNA, 22 nt, Human
ucuguaaucccagcuacucagg

SEQ ID NO: 517464 - RNA, 22 nt, Human
ucugucucaaaaaaaaaaaaaa

SEQ ID NO: 517465 - RNA, 18 nt, Human
ucuuacagaccccaaagu

SEQ ID NO: 517466 - RNA, 21 nt, Human
ugaaaaugcaacacaucaccc

SEQ ID NO: 517467 - RNA, 25 nt, Human
ugaaacaaaacaauucaucuaaaau

SEQ ID NO: 517468 - RNA, 20 nt, Human
ugaaggccuuaaggaaaagc

SEQ ID NO: 517469 - RNA, 25 nt, Human
ugaaggccuuaaggaaaagccuuau

SEQ ID NO: 517470 - RNA, 19 nt, Human
ugacaccagcuugaaaaga

SEQ ID NO: 517471 - RNA, 25 nt, Human
ugacaggugcccgagggcaagugca

SEQ ID NO: 517472 - RNA, 24 nt, Human
ugaggcagaagaauugcuugaacc

SEQ ID NO: 517473 - RNA, 25 nt, Human
ugaggcagaagaauugcuugaaccc

SEQ ID NO: 517474 - RNA, 22 nt, Human
ugauacacccaaaauaugagag

SEQ ID NO: 517475 - RNA, 25 nt, Human
ugcaaagagccucagcagucuccca

SEQ ID NO: 517476 - RNA, 25 nt, Human
ugcauguauggucccaaagacuuuu

SEQ ID NO: 517477 - RNA, 23 nt, Human
ugccuguaaucccagcacuuugg

SEQ ID NO: 517478 - RNA, 23 nt, Human
ugccuguaaucccagcacuuugg

SEQ ID NO: 517479 - RNA, 24 nt, Human
ugccuguaaucccagcacuuuggg

SEQ ID NO: 517480 - RNA, 19 nt, Human
ugcuagcaucuggccaggc

SEQ ID NO: 517481 - RNA, 25 nt, Human
ugcugcuguuacuguugcugcuucc

SEQ ID NO: 517482 - RNA, 18 nt, Human
ugcugcuuccaaaagugc

SEQ ID NO: 517483 - RNA, 19 nt, Human
ugcugggccccacagccag

SEQ ID NO: 517484 - RNA, 24 nt, Human
ugcuggugcacaucuguaauccca

SEQ ID NO: 517485 - RNA, 18 nt, Human
uggagaggacccagagga

SEQ ID NO: 517486 - RNA, 22 nt, Human
uggagcaucccaugaggaugau

SEQ ID NO: 517487 - RNA, 21 nt, Human
uggagucccuagagaagccgu

SEQ ID NO: 517488 - RNA, 24 nt, Human
uggccaacauggcgaaacccuguc

SEQ ID NO: 517489 - RNA, 22 nt, Human
uggcucaugccuguaaucccag

SEQ ID NO: 517490 - RNA, 24 nt, Human
uggcucaugccuguaaucccagca

SEQ ID NO: 517491 - RNA, 19 nt, Human
uggcuucugggacacaguc

SEQ ID NO: 517492 - RNA, 20 nt, Human
uggcuucugggacacagucu

SEQ ID NO: 517493 - RNA, 24 nt, Human
ugggaagccaaggugggcggauca

SEQ ID NO: 517494 - RNA, 26 nt, Human
ugggaagggugcggacagauugggua

SEQ ID NO: 517495 - RNA, 23 nt, Human
ugggagccacucaggaaaggccu

SEQ ID NO: 517496 - RNA, 22 nt, Human
ugggccccacagccaggacccu

SEQ ID NO: 517497 - RNA, 24 nt, Human
ugggcggaucacauaaggccagga

SEQ ID NO: 517498 - RNA, 24 nt, Human
ugucgggaaaugaaguuggcaguc

SEQ ID NO: 517499 - RNA, 24 nt, Human
ugugaaacaaaacaauucaucuaa

SEQ ID NO: 517500 - RNA, 21 nt, Human
uuaacuguauccccauuuauc

SEQ ID NO: 517501 - RNA, 23 nt, Human
uucaagacucuccacacuuacuu

SEQ ID NO: 517502 - RNA, 26 nt, Human
uucacugacaguuucuuacagacccc

SEQ ID NO: 517503 - RNA, 24 nt, Human
uucgugaaagcucaucaaggggau

SEQ ID NO: 517504 - RNA, 18 nt, Human
uugcagugagccgagauc

SEQ ID NO: 517505 - RNA, 19 nt, Human
uugcagugagccgagauca

SEQ ID NO: 517506 - RNA, 25 nt, Human
uugcagugagccgagaucaaaccac

SEQ ID NO: 517507 - RNA, 24 nt, Human
uugcugcugcuguuacuguugcug

SEQ ID NO: 517508 - RNA, 25 nt, Human
uugcugcugcuguuacuguugcugc

SEQ ID NO: 517509 - RNA, 24 nt, Human
uugcuugaacccaggagucggagg

SEQ ID NO: 517510 - RNA, 18 nt, Human
uugcuugacaugucugau

SEQ ID NO: 517511 - RNA, 21 nt, Human
uuggaggacuggauugggagc

SEQ ID NO: 517512 - RNA, 26 nt, Human
uuuaaacuuaagcauuaauaaaagau

SEQ ID NO: 517513 - RNA, 21 nt, Human
uuuacacagucucagagagau

SEQ ID NO: 517514 - RNA, 21 nt, Human
uuucucauccuuugccuucgg

SEQ ID NO: 517515 - RNA, 18 nt, Human
uuugaggacuucaaagac

SEQ ID NO: 517516 - RNA, 18 nt, Human
uuugauaaaggaaaagga

SEQ ID NO: 517517 - RNA, 19 nt, Human
uuuguuguagugauuuuca

SEQ ID NO: 517518 - RNA, 18 nt, Human
uuuugucugucacccaga

SEQ ID NO: 517519 - RNA, 21 nt, Human
aaccccaaucuuuuacuaaaa

SEQ ID NO: 517520 - RNA, 22 nt, Human
accccggaguacaggguuccug

SEQ ID NO: 517521 - RNA, 20 nt, Human
agagaagccggcgaccccgg

SEQ ID NO: 517522 - RNA, 21 nt, Human
agaggggagggaacagagggc

SEQ ID NO: 517523 - RNA, 25 nt, Human
agcccuucucccccgcgcgaacccc

SEQ ID NO: 517524 - RNA, 26 nt, Human
agggaacagagggcuagaggggcccg

SEQ ID NO: 517525 - RNA, 21 nt, Human
agggaggaacaaaagagggga

SEQ ID NO: 517526 - RNA, 22 nt, Human
aggggagggaacagagggcuag

SEQ ID NO: 517527 - RNA, 23 nt, Human
aggugggcuggccuggucagccu

SEQ ID NO: 517528 - RNA, 21 nt, Human
cacacugucagcccugagggc

SEQ ID NO: 517529 - RNA, 18 nt, Human
cagcaggggagcgaggag

SEQ ID NO: 517530 - RNA, 19 nt, Human
caggcaagcucaaauucac

SEQ ID NO: 517531 - RNA, 18 nt, Human
ccaaucagccugacaggc

SEQ ID NO: 517532 - RNA, 23 nt, Human
ccacacugucagcccugagggcg

SEQ ID NO: 517533 - RNA, 21 nt, Human
cccagcaggggagcgaggaga

SEQ ID NO: 517534 - RNA, 21 nt, Human
cccagguugggaccccagaac

SEQ ID NO: 517535 - RNA, 20 nt, Human
cccggaguacaggguuccug

SEQ ID NO: 517536 - RNA, 23 nt, Human
cccuggcugagcggugaggggac

SEQ ID NO: 517537 - RNA, 23 nt, Human
cgggaagggcccagagggacguc

SEQ ID NO: 517538 - RNA, 18 nt, Human
cucccccgcgcgaacccc

SEQ ID NO: 517539 - RNA, 19 nt, Human
cucgguacccccaucagcc

SEQ ID NO: 517540 - RNA, 20 nt, Human
cucggucagucaaucccagc

SEQ ID NO: 517541 - RNA, 18 nt, Human
cugcuuggucccgggcug

SEQ ID NO: 517542 - RNA, 23 nt, Human
cugucaguuucaugucugacuuc

SEQ ID NO: 517543 - RNA, 21 nt, Human
gagggcuagaggggcccgggg

SEQ ID NO: 517544 - RNA, 22 nt, Human
gcagcccuucucccccgcgcga

SEQ ID NO: 517545 - RNA, 26 nt, Human
gcaggagagaagccggcgaccccgga

SEQ ID NO: 517546 - RNA, 20 nt, Human
gcuggccuggucagccuggg

SEQ ID NO: 517547 - RNA, 24 nt, Human
gcuggccuggucagccugggugga

SEQ ID NO: 517548 - RNA, 23 nt, Human
ggaagacucuagcuggacauucc

SEQ ID NO: 517549 - RNA, 24 nt, Human
ggacgagaaccagagggcccgggg

SEQ ID NO: 517550 - RNA, 21 nt, Human
ggacgucaaggaccgagcuac

SEQ ID NO: 517551 - RNA, 22 nt, Human
ggaggaacaaaagaggggaggg

SEQ ID NO: 517552 - RNA, 23 nt, Human
ggaggaacaaaagaggggaggga

SEQ ID NO: 517553 - RNA, 22 nt, Human
ggagggaacagagggcuagagg

SEQ ID NO: 517554 - RNA, 22 nt, Human
ggccaccucucgguacccccau

SEQ ID NO: 517555 - RNA, 19 nt, Human
ggccuggucagccugggug

SEQ ID NO: 517556 - RNA, 25 nt, Human
ggcgaccccggaguacaggguuccu

SEQ ID NO: 517557 - RNA, 21 nt, Human
ggcgcaguggcgcgggggagc

SEQ ID NO: 517558 - RNA, 23 nt, Human
ggcggcggggcucuagggaggaa

SEQ ID NO: 517559 - RNA, 18 nt, Human
gggaccggaggcaggaga

SEQ ID NO: 517560 - RNA, 22 nt, Human
gggaggaacaaaagaggggagg

SEQ ID NO: 517561 - RNA, 20 nt, Human
gggcccggggacucaggcga

SEQ ID NO: 517562 - RNA, 22 nt, Human
ggucagugaggugggcuggccu

SEQ ID NO: 517563 - RNA, 20 nt, Human
ggucccgggcuggucagucu

SEQ ID NO: 517564 - RNA, 24 nt, Human
ucagccaaucagccugacaggcaa

SEQ ID NO: 517565 - RNA, 20 nt, Human
uccugggagcggcgcagugg

SEQ ID NO: 517566 - RNA, 21 nt, Human
ugagggcggcggggcucuagg

SEQ ID NO: 517567 - RNA, 23 nt, Human
ugaggucaggggucaggagguca

SEQ ID NO: 517568 - RNA, 21 nt, Human
ugaggugggcuggccugguca

SEQ ID NO: 517569 - RNA, 24 nt, Human
ugggagcggcgcaguggcgcgggg

SEQ ID NO: 517570 - RNA, 23 nt, Human
ugggcuggccuggucagccuggg

SEQ ID NO: 517571 - RNA, 23 nt, Human
uuagugagccaauccagggcugu

SEQ ID NO: 517572 - RNA, 22 nt, Human
uucacuggagucugucagucca

SEQ ID NO: 517573 - RNA, 22 nt, Human
uucaugucugacuuccacggaa

SEQ ID NO: 517574 - RNA, 18 nt, Human
uuccugggagcggcgcag

SEQ ID NO: 517575 - RNA, 22 nt, Human
uucucccccgcgcgaaccccaa

SEQ ID NO: 517576 - RNA, 18 nt, Human
aaaccccaaucucacagc

SEQ ID NO: 517577 - RNA, 18 nt, Human
aauuacagucgugagcca

SEQ ID NO: 517578 - RNA, 21 nt, Human
aauuacagucgugagccacug

SEQ ID NO: 517579 - RNA, 19 nt, Human
acaccagaagagccacacu

SEQ ID NO: 517580 - RNA, 21 nt, Human
acaggcgcccgccaccacacc

SEQ ID NO: 517581 - RNA, 18 nt, Human
acaggguuucaccauguu

SEQ ID NO: 517582 - RNA, 21 nt, Human
acaggguuucaccauguuggc

SEQ ID NO: 517583 - RNA, 24 nt, Human
acaggguuucaccauguuggccag

SEQ ID NO: 517584 - RNA, 18 nt, Human
accauguuggccaggcug

SEQ ID NO: 517585 - RNA, 23 nt, Human
accccucucuccccaagcugaaa

SEQ ID NO: 517586 - RNA, 21 nt, Human
accgcaaccuccgccugcugg

SEQ ID NO: 517587 - RNA, 18 nt, Human
accuccgccugcuggguu

SEQ ID NO: 517588 - RNA, 21 nt, Human
acuuuaguaggcuuuucacua

SEQ ID NO: 517589 - RNA, 26 nt, Human
agaggaaggccaccccucucucccca

SEQ ID NO: 517590 - RNA, 18 nt, Human
agagggagcaagaugggc

SEQ ID NO: 517591 - RNA, 23 nt, Human
agccucagccuccugaguaguug

SEQ ID NO: 517592 - RNA, 18 nt, Human
aggccauaaagccugaaa

SEQ ID NO: 517593 - RNA, 18 nt, Human
aguaguugggauuacagg

SEQ ID NO: 517594 - RNA, 22 nt, Human
aguccggcucggcgccggccuc

SEQ ID NO: 517595 - RNA, 23 nt, Human
agucgugagccacugugccuggu

SEQ ID NO: 517596 - RNA, 24 nt, Human
agugauucucuagccucagccucc

SEQ ID NO: 517597 - RNA, 20 nt, Human
agugcaauggcgugaucucg

SEQ ID NO: 517598 - RNA, 24 nt, Human
agugcaauggcgugaucucgacuc

SEQ ID NO: 517599 - RNA, 21 nt, Human
aguggugggaaguacaaguac

SEQ ID NO: 517600 - RNA, 19 nt, Human
auaaaauguucuaaacccc

SEQ ID NO: 517601 - RNA, 19 nt, Human
caaagaaugaaauguggcc

SEQ ID NO: 517602 - RNA, 22 nt, Human
caagugauucucuagccucagc

SEQ ID NO: 517603 - RNA, 24 nt, Human
caccacaccuggcuaauuuuugua

SEQ ID NO: 517604 - RNA, 21 nt, Human
caccauguuggccaggcuggu

SEQ ID NO: 517605 - RNA, 24 nt, Human
caccauguuggccaggcuggucuc

SEQ ID NO: 517606 - RNA, 18 nt, Human
caccccucucuccccaag

SEQ ID NO: 517607 - RNA, 27 nt, Human
caccuuaguguacugaaagaaaaacaa

SEQ ID NO: 517608 - RNA, 20 nt, Human
cagccuccugaguaguuggg

SEQ ID NO: 517609 - RNA, 23 nt, Human
cagcucccacacuccauuggccu

SEQ ID NO: 517610 - RNA, 24 nt, Human
caggguuucaccauguuggccagg

SEQ ID NO: 517611 - RNA, 20 nt, Human
caucacauuacauucacacc

SEQ ID NO: 517612 - RNA, 25 nt, Human
cauguuggccaggcuggucuccgga

SEQ ID NO: 517613 - RNA, 20 nt, Human
ccaccccucucuccccaagc

SEQ ID NO: 517614 - RNA, 25 nt, Human
ccaccccucucuccccaagcugaaa

SEQ ID NO: 517615 - RNA, 21 nt, Human
ccaccuacagggcccgggaau

SEQ ID NO: 517616 - RNA, 24 nt, Human
cccaagcugaaacaccagaagagc

SEQ ID NO: 517617 - RNA, 21 nt, Human
cccaccuacagggcccgggaa

SEQ ID NO: 517618 - RNA, 19 nt, Human
ccccucucuccccaagcug

SEQ ID NO: 517619 - RNA, 21 nt, Human
ccccucucuccccaagcugaa

SEQ ID NO: 517620 - RNA, 24 nt, Human
ccgcaaccuccgccugcuggguuc

SEQ ID NO: 517621 - RNA, 23 nt, Human
ccugaguaguugggauuacaggc

SEQ ID NO: 517622 - RNA, 24 nt, Human
ccugaguaguugggauuacaggcg

SEQ ID NO: 517623 - RNA, 20 nt, Human
ccuuucagcucccacacucc

SEQ ID NO: 517624 - RNA, 21 nt, Human
cggcgccggccucaacugcaa

SEQ ID NO: 517625 - RNA, 20 nt, Human
cgggaauccuagggagcggg

SEQ ID NO: 517626 - RNA, 24 nt, Human
cuaaacugcuggaauuacagucgu

SEQ ID NO: 517627 - RNA, 22 nt, Human
cuagccucagccuccugaguag

SEQ ID NO: 517628 - RNA, 24 nt, Human
cuagccucagccuccugaguaguu

SEQ ID NO: 517629 - RNA, 24 nt, Human
cuaguagagacaggguuucaccau

SEQ ID NO: 517630 - RNA, 20 nt, Human
cucacagcacuuuaguaggc

SEQ ID NO: 517631 - RNA, 21 nt, Human
cucggcgccggccucaacugc

SEQ ID NO: 517632 - RNA, 25 nt, Human
cugaaaauaaaauguucuaaacccc

SEQ ID NO: 517633 - RNA, 22 nt, Human
cugaacaccauucacaaaaugu

SEQ ID NO: 517634 - RNA, 22 nt, Human
cuuucagcucccacacuccauu

SEQ ID NO: 517635 - RNA, 23 nt, Human
gaccucaggugaucugcacacuu

SEQ ID NO: 517636 - RNA, 19 nt, Human
gagagggagcaagaugggc

SEQ ID NO: 517637 - RNA, 18 nt, Human
gagggagcaagaugggcu

SEQ ID NO: 517638 - RNA, 25 nt, Human
gaguaguugggauuacaggcgcccg

SEQ ID NO: 517639 - RNA, 18 nt, Human
gauuacaggcgcccgcca

SEQ ID NO: 517640 - RNA, 24 nt, Human
gcacaggcuggagugcaauggcgu

SEQ ID NO: 517641 - RNA, 20 nt, Human
gcaguaccuuugauaauucc

SEQ ID NO: 517642 - RNA, 23 nt, Human
gccacacucggccguucccaacc

SEQ ID NO: 517643 - RNA, 19 nt, Human
gccucagccuccugaguag

SEQ ID NO: 517644 - RNA, 21 nt, Human
gccugaaguccggcucggcgc

SEQ ID NO: 517645 - RNA, 23 nt, Human
gcugaaacaccagaagagccagu

SEQ ID NO: 517646 - RNA, 19 nt, Human
gcuggagugcaauggcgug

SEQ ID NO: 517647 - RNA, 22 nt, Human
ggcuggagugcaauggcgugau

SEQ ID NO: 517648 - RNA, 22 nt, Human
ggguuucaccauguuggccagg

SEQ ID NO: 517649 - RNA, 21 nt, Human
gguaaacuuuccuauaggucu

SEQ ID NO: 517650 - RNA, 20 nt, Human
ggucaggucacgccgccgga

SEQ ID NO: 517651 - RNA, 24 nt, Human
gugauucucuagccucagccuccu

SEQ ID NO: 517652 - RNA, 21 nt, Human
uaaaaucuuuuugagacagag

SEQ ID NO: 517653 - RNA, 18 nt, Human
uaaaauguucuaaacccc

SEQ ID NO: 517654 - RNA, 22 nt, Human
uaaaccccaaucucacagcacu

SEQ ID NO: 517655 - RNA, 19 nt, Human
uaaagaacuugagcaacug

SEQ ID NO: 517656 - RNA, 23 nt, Human
uaauuugguuuguuggucccaca

SEQ ID NO: 517657 - RNA, 24 nt, Human
uaauuuuuguauuucuaguagaga

SEQ ID NO: 517658 - RNA, 22 nt, Human
uacaggcgcccgccaccacacc

SEQ ID NO: 517659 - RNA, 22 nt, Human
uacagucgugagccacugugcc

SEQ ID NO: 517660 - RNA, 22 nt, Human
uagagacaggguuucaccaugu

SEQ ID NO: 517661 - RNA, 18 nt, Human
uagcaaagcugcaaagaa

SEQ ID NO: 517662 - RNA, 18 nt, Human
uaggcaucuuuaaaguau

SEQ ID NO: 517663 - RNA, 19 nt, Human
uaggccauaaagccugaaa

SEQ ID NO: 517664 - RNA, 24 nt, Human
uaguagagacaggguuucaccaug

SEQ ID NO: 517665 - RNA, 26 nt, Human
uaguagagacaggguuucaccauguu

SEQ ID NO: 517666 - RNA, 22 nt, Human
uaguaggcuuuucacuaggcau

SEQ ID NO: 517667 - RNA, 22 nt, Human
ucaaaagagcuucaaggaaaaa

SEQ ID NO: 517668 - RNA, 22 nt, Human
ucaauguaugugcuauuuacaa

SEQ ID NO: 517669 - RNA, 18 nt, Human
ucacaccuuuugcuaacc

SEQ ID NO: 517670 - RNA, 20 nt, Human
ucaccgcaaccuccgccugc

SEQ ID NO: 517671 - RNA, 24 nt, Human
ucaccgcaaccuccgccugcuggg

SEQ ID NO: 517672 - RNA, 27 nt, Human
ucaccgcaaccuccgccugcuggguuc

SEQ ID NO: 517673 - RNA, 20 nt, Human
ucagccuccugaguaguugg

SEQ ID NO: 517674 - RNA, 22 nt, Human
uccaagaucccuaacacugucu

SEQ ID NO: 517675 - RNA, 18 nt, Human
uccaucacauuacauuca

SEQ ID NO: 517676 - RNA, 20 nt, Human
uccaucacauuacauucaca

SEQ ID NO: 517677 - RNA, 25 nt, Human
uccccaagcugaaacaccagaagag

SEQ ID NO: 517678 - RNA, 24 nt, Human
uccugaguaguugggauuacaggc

SEQ ID NO: 517679 - RNA, 18 nt, Human
ucgcacaggcuggagugc

SEQ ID NO: 517680 - RNA, 22 nt, Human
ucgcucuugucgcacaggcugg

SEQ ID NO: 517681 - RNA, 22 nt, Human
ucuaaaccccaaucucacagca

SEQ ID NO: 517682 - RNA, 21 nt, Human
ucugcccuuccuuugggccag

SEQ ID NO: 517683 - RNA, 23 nt, Human
ucuugcggucaggucacgccgcc

SEQ ID NO: 517684 - RNA, 21 nt, Human
ugacacaauggaaaauaggcc

SEQ ID NO: 517685 - RNA, 21 nt, Human
ugcaaagaaugaaauguggcc

SEQ ID NO: 517686 - RNA, 25 nt, Human
ugcuucauuccuucagguugaggua

SEQ ID NO: 517687 - RNA, 22 nt, Human
uggaauuacagucgugagccac

SEQ ID NO: 517688 - RNA, 22 nt, Human
uggaauuacagucgugagccac

SEQ ID NO: 517689 - RNA, 24 nt, Human
uggaauuacagucgugagccacug

SEQ ID NO: 517690 - RNA, 19 nt, Human
uggagugcaauggcgugau

SEQ ID NO: 517691 - RNA, 23 nt, Human
uggagugcaauggcgugaucucg

SEQ ID NO: 517692 - RNA, 23 nt, Human
uggauuagcaaagcugcaaagaa

SEQ ID NO: 517693 - RNA, 23 nt, Human
uggccaggcuggucuccggaccu

SEQ ID NO: 517694 - RNA, 21 nt, Human
uggcgugaucucgacucaccg

SEQ ID NO: 517695 - RNA, 21 nt, Human
ugggauuacaggcgcccgcca

SEQ ID NO: 517696 - RNA, 22 nt, Human
ugggauuacaggcgcccgccac

SEQ ID NO: 517697 - RNA, 24 nt, Human
ugggauuacaggcgcccgccacca

SEQ ID NO: 517698 - RNA, 23 nt, Human
uggguucaagugauucucuagcc

SEQ ID NO: 517699 - RNA, 20 nt, Human
uggguucaagugauucucuu

SEQ ID NO: 517700 - RNA, 18 nt, Human
ugucgcacaggcuggagu

SEQ ID NO: 517701 - RNA, 22 nt, Human
ugucgcacaggcuggagugcaa

SEQ ID NO: 517702 - RNA, 19 nt, Human
uuaaugugaauaacagaug

SEQ ID NO: 517703 - RNA, 21 nt, Human
uuauguucucugcccuuccuu

SEQ ID NO: 517704 - RNA, 23 nt, Human
uucaagugauucucuagccucag

SEQ ID NO: 517705 - RNA, 18 nt, Human
uuggucccacaccccauc

SEQ ID NO: 517706 - RNA, 24 nt, Human
uuucaccauguuggccaggcuggu

SEQ ID NO: 517707 - RNA, 24 nt, Human
uuucgcucuugucgcacaggcugg

SEQ ID NO: 517708 - RNA, 24 nt, Human
uuucuaguagagacaggguuucac

SEQ ID NO: 517709 - RNA, 20 nt, Human
uuuuuccucuccaaguucuu

SEQ ID NO: 517710 - RNA, 20 nt, Human
uuuuuguauuucuaguagag

SEQ ID NO: 517711 - RNA, 23 nt, Human
uuuuuguauuucuaguagagaca

SEQ ID NO: 517712 - RNA, 19 nt, Human
acccuuuucuaaaguaugu

SEQ ID NO: 517713 - RNA, 19 nt, Human
aggcaaagacaagaaaaga

SEQ ID NO: 517714 - RNA, 20 nt, Human
caaguaauuuuaugcugcua

SEQ ID NO: 517715 - RNA, 19 nt, Human
gguccccuuuaauuugccu

SEQ ID NO: 517716 - RNA, 23 nt, Human
uaagcaauuuuuuucaauuauaa

SEQ ID NO: 517717 - RNA, 22 nt, Human
uccccuuuaauuugccuuauug

SEQ ID NO: 517718 - RNA, 20 nt, Human
ucuaaaguauguucuuccaa

SEQ ID NO: 517719 - RNA, 21 nt, Human
uuuauuguucauuuuccaacc

SEQ ID NO: 517720 - RNA, 23 nt, Human
uuuuuuuuuuuuuuuuccacuag

SEQ ID NO: 517721 - RNA, 22 nt, Human
uuuuuuuuuuuuuuuuuccacu

SEQ ID NO: 517722 - RNA, 24 nt, Human
uuuuuuuuuuuuuuuuuccacuag

SEQ ID NO: 517723 - RNA, 20 nt, Human
aaaaagcgaaagcuaggccu

SEQ ID NO: 517724 - RNA, 28 nt, Human
aaaggcaggcgcuuggcuucccaagggg

SEQ ID NO: 517725 - RNA, 19 nt, Human
aaagugaacaaaugagagu

SEQ ID NO: 517726 - RNA, 21 nt, Human
aagaagaggccaauuugagga

SEQ ID NO: 517727 - RNA, 21 nt, Human
aagaggaaugagcugggccua

SEQ ID NO: 517728 - RNA, 23 nt, Human
aaggccacagugaggcaugagcg

SEQ ID NO: 517729 - RNA, 20 nt, Human
acacagcagggaggaagagc

SEQ ID NO: 517730 - RNA, 24 nt, Human
accaaaaggcaggagcugggccug

SEQ ID NO: 517731 - RNA, 23 nt, Human
agaaaauuuugagccuacaaagg

SEQ ID NO: 517732 - RNA, 22 nt, Human
agacacagcagggaggaagagc

SEQ ID NO: 517733 - RNA, 24 nt, Human
agaggcaucaacuggaccuaaaca

SEQ ID NO: 517734 - RNA, 19 nt, Human
agaggccauugucaggcag

SEQ ID NO: 517735 - RNA, 27 nt, Human
agaggcugacugggggaaguucuggga

SEQ ID NO: 517736 - RNA, 19 nt, Human
agaucugagguaggagaug

SEQ ID NO: 517737 - RNA, 18 nt, Human
agcagggccugcagaggc

SEQ ID NO: 517738 - RNA, 22 nt, Human
agcuggaucuggaagaggcaac

SEQ ID NO: 517739 - RNA, 27 nt, Human
agcuggguguggagagucccgugugug

SEQ ID NO: 517740 - RNA, 21 nt, Human
aggaagagcucggccugcaga

SEQ ID NO: 517741 - RNA, 22 nt, Human
aggaaugagcugggccuaaaca

SEQ ID NO: 517742 - RNA, 21 nt, Human
aggaggcagcaacugggccua

SEQ ID NO: 517743 - RNA, 18 nt, Human
aggcaagagaugggccug

SEQ ID NO: 517744 - RNA, 18 nt, Human
aggcaagagcaaaaccag

SEQ ID NO: 517745 - RNA, 19 nt, Human
aggcaagagcaaaaccaga

SEQ ID NO: 517746 - RNA, 24 nt, Human
aggcaagagcaaaaccagaagagg

SEQ ID NO: 517747 - RNA, 21 nt, Human
aggcaagaggugggacuggaa

SEQ ID NO: 517748 - RNA, 23 nt, Human
aggcaagaggugggacuggaagg

SEQ ID NO: 517749 - RNA, 18 nt, Human
aggcaugagcugggccug

SEQ ID NO: 517750 - RNA, 18 nt, Human
aggccaccaggagcuggg

SEQ ID NO: 517751 - RNA, 23 nt, Human
aggcugcugggaggcaggcggga

SEQ ID NO: 517752 - RNA, 18 nt, Human
agggaaaaacugggccug

SEQ ID NO: 517753 - RNA, 19 nt, Human
aguucugggccuggagagg

SEQ ID NO: 517754 - RNA, 22 nt, Human
caaaaccagaagaggcuaccau

SEQ ID NO: 517755 - RNA, 25 nt, Human
caacaggcaaaagcugggccuggag

SEQ ID NO: 517756 - RNA, 19 nt, Human
caacuggaggacgauuugg

SEQ ID NO: 517757 - RNA, 19 nt, Human
caagagaugggccuggaga

SEQ ID NO: 517758 - RNA, 20 nt, Human
caagagcagggccugcagag

SEQ ID NO: 517759 - RNA, 24 nt, Human
caaguucugggccugaagaggcca

SEQ ID NO: 517760 - RNA, 18 nt, Human
caccaaaaggcaggagcu

SEQ ID NO: 517761 - RNA, 20 nt, Human
caccaagucaaaagcagggc

SEQ ID NO: 517762 - RNA, 21 nt, Human
caccaagucaaaagcagggcc

SEQ ID NO: 517763 - RNA, 23 nt, Human
caccaagucaaaagcagggccug

SEQ ID NO: 517764 - RNA, 18 nt, Human
cacugugaggcagaagau

SEQ ID NO: 517765 - RNA, 22 nt, Human
cagaagaggcuaccaugaggca

SEQ ID NO: 517766 - RNA, 19 nt, Human
caguaggccuggagagcuu

SEQ ID NO: 517767 - RNA, 21 nt, Human
cagugugaggcagaagcuggg

SEQ ID NO: 517768 - RNA, 21 nt, Human
cagugugaggcaggagcuggg

SEQ ID NO: 517769 - RNA, 20 nt, Human
cauugucaggcaggagcugg

SEQ ID NO: 517770 - RNA, 18 nt, Human
ccagaagaggcuaccaug

SEQ ID NO: 517771 - RNA, 23 nt, Human
ccaugaggcaaaagaugggccuu

SEQ ID NO: 517772 - RNA, 21 nt, Human
ccuaaacaagccauugugagg

SEQ ID NO: 517773 - RNA, 18 nt, Human
ccugcagaggaugccagg

SEQ ID NO: 517774 - RNA, 20 nt, Human
ccugcagagguugcugggag

SEQ ID NO: 517775 - RNA, 20 nt, Human
cgaggcaggagaaaagccug

SEQ ID NO: 517776 - RNA, 23 nt, Human
cgccaaaagggaaaaacugggcc

SEQ ID NO: 517777 - RNA, 20 nt, Human
cuaggccuggaaaggccaca

SEQ ID NO: 517778 - RNA, 19 nt, Human
cuggaaaaaccaacuggag

SEQ ID NO: 517779 - RNA, 22 nt, Human
cuggagaggccauugucaggca

SEQ ID NO: 517780 - RNA, 18 nt, Human
cuggagagggagcuaaga

SEQ ID NO: 517781 - RNA, 18 nt, Human
cugggccuaaagaggccg

SEQ ID NO: 517782 - RNA, 22 nt, Human
cugggccugaagaggccaccaa

SEQ ID NO: 517783 - RNA, 22 nt, Human
cugggccuggagaggccgccaa

SEQ ID NO: 517784 - RNA, 23 nt, Human
gagcggggccuaaagaggucauu

SEQ ID NO: 517785 - RNA, 26 nt, Human
gagcugggccuggaaagccugcugcg

SEQ ID NO: 517786 - RNA, 21 nt, Human
gaggcaagagcaaaaccagaa

SEQ ID NO: 517787 - RNA, 19 nt, Human
gaggcaugagcugggccug

SEQ ID NO: 517788 - RNA, 23 nt, Human
gaggcugacuugaguucaaguuc

SEQ ID NO: 517789 - RNA, 18 nt, Human
gcaggagaaaagccugga

SEQ ID NO: 517790 - RNA, 19 nt, Human
gccgaaaggcaggaaccug

SEQ ID NO: 517791 - RNA, 22 nt, Human
gccuaaacaggccaguaugaga

SEQ ID NO: 517792 - RNA, 24 nt, Human
gcgaggcaggagaaaagccuggag

SEQ ID NO: 517793 - RNA, 20 nt, Human
ggaaaaaccaacuggaggac

SEQ ID NO: 517794 - RNA, 28 nt, Human
ggaaaaaccaacuggaggacgauuuggg

SEQ ID NO: 517795 - RNA, 19 nt, Human
ggaaccuggucagaggagg

SEQ ID NO: 517796 - RNA, 18 nt, Human
ggaaggccaccaugaggc

SEQ ID NO: 517797 - RNA, 19 nt, Human
ggaaguucugggccuggag

SEQ ID NO: 517798 - RNA, 21 nt, Human
ggaccuaaacaagccauugug

SEQ ID NO: 517799 - RNA, 18 nt, Human
ggaggaaguuuugcaccu

SEQ ID NO: 517800 - RNA, 24 nt, Human
ggaggcagaucugagguaggagaa

SEQ ID NO: 517801 - RNA, 20 nt, Human
ggcaggagcuggguguguag

SEQ ID NO: 517802 - RNA, 21 nt, Human
ggcaugagcguggccuacaaa

SEQ ID NO: 517803 - RNA, 22 nt, Human
ggccaccaagucaaaagcaggg

SEQ ID NO: 517804 - RNA, 23 nt, Human
ggccuaaacaggccaguaugaga

SEQ ID NO: 517805 - RNA, 18 nt, Human
ggccuaaagaggucauug

SEQ ID NO: 517806 - RNA, 22 nt, Human
gggaggaaguuuugcaccugga

SEQ ID NO: 517807 - RNA, 18 nt, Human
ggucagaggaggccaugg

SEQ ID NO: 517808 - RNA, 19 nt, Human
ggugggacuggaaggugca

SEQ ID NO: 517809 - RNA, 23 nt, Human
guaagagagaccaccaugagaca

SEQ ID NO: 517810 - RNA, 18 nt, Human
guccagggaagcuuuagg

SEQ ID NO: 517811 - RNA, 20 nt, Human
gugaggcagaagcugggccg

SEQ ID NO: 517812 - RNA, 21 nt, Human
gugaggcagaugcugggccug

SEQ ID NO: 517813 - RNA, 19 nt, Human
gugcacugugagguagagg

SEQ ID NO: 517814 - RNA, 18 nt, Human
guggagaguccgcuguga

SEQ ID NO: 517815 - RNA, 22 nt, Human
uaaagugaacaaaugagagucc

SEQ ID NO: 517816 - RNA, 22 nt, Human
uaaagugaacaaaugagagucc

SEQ ID NO: 517817 - RNA, 20 nt, Human
uagaggcugccgaaaggcag

SEQ ID NO: 517818 - RNA, 20 nt, Human
uagaggcugcugaaaggcag

SEQ ID NO: 517819 - RNA, 21 nt, Human
ucuucagaggccaccaggagg

SEQ ID NO: 517820 - RNA, 22 nt, Human
ugaaaggcaggcgcuuggcuug

SEQ ID NO: 517821 - RNA, 20 nt, Human
ugagaaggccaccaagaggc

SEQ ID NO: 517822 - RNA, 19 nt, Human
ugaggcaaaagaugggccu

SEQ ID NO: 517823 - RNA, 20 nt, Human
ugaggcaagagaugggccuc

SEQ ID NO: 517824 - RNA, 20 nt, Human
ugaggcaagagaugggccug

SEQ ID NO: 517825 - RNA, 23 nt, Human
ugaggcaagagcaaaaccagaag

SEQ ID NO: 517826 - RNA, 20 nt, Human
ugaggcaagagcugggccug

SEQ ID NO: 517827 - RNA, 19 nt, Human
ugaggcaagaggugggacu

SEQ ID NO: 517828 - RNA, 19 nt, Human
ugaggcaagaggugggacu

SEQ ID NO: 517829 - RNA, 18 nt, Human
ugaggcagaagaugggcc

SEQ ID NO: 517830 - RNA, 18 nt, Human
ugaggcagaagaugggcc

SEQ ID NO: 517831 - RNA, 18 nt, Human
ugaggcagaugcugggcc

SEQ ID NO: 517832 - RNA, 18 nt, Human
ugaggcaggagcugggcc

SEQ ID NO: 517833 - RNA, 20 nt, Human
ugaggcaggagcugggccug

SEQ ID NO: 517834 - RNA, 20 nt, Human
ugaggcaggaguugggccug

SEQ ID NO: 517835 - RNA, 22 nt, Human
ugagguaggagaugggcguagu

SEQ ID NO: 517836 - RNA, 21 nt, Human
ugaguccaaggagguuguugu

SEQ ID NO: 517837 - RNA, 23 nt, Human
ugauuugggccugcagagguugc

SEQ ID NO: 517838 - RNA, 21 nt, Human
ugccagaggcaucaacuggac

SEQ ID NO: 517839 - RNA, 19 nt, Human
ugccgaaaggcaggaaccu

SEQ ID NO: 517840 - RNA, 21 nt, Human
ugcugggaggaagagcugggc

SEQ ID NO: 517841 - RNA, 20 nt, Human
uggaagaggcaacugugagg

SEQ ID NO: 517842 - RNA, 19 nt, Human
uggagaggcugacuggggg

SEQ ID NO: 517843 - RNA, 21 nt, Human
uggcaggagcuggguguguag

SEQ ID NO: 517844 - RNA, 26 nt, Human
uggcaggagcuggguguguagaggcu

SEQ ID NO: 517845 - RNA, 22 nt, Human
uggccaaaaagcgaaagcuagg

SEQ ID NO: 517846 - RNA, 24 nt, Human
uggccggggaaggccaccaugagg

SEQ ID NO: 517847 - RNA, 21 nt, Human
ugggaggaaguuuugcaccug

SEQ ID NO: 517848 - RNA, 21 nt, Human
ugggaggaaguuuugcaccug

SEQ ID NO: 517849 - RNA, 21 nt, Human
ugggccuggaaagccugcugc

SEQ ID NO: 517850 - RNA, 18 nt, Human
ugggccuggaaaggccgu

SEQ ID NO: 517851 - RNA, 21 nt, Human
ugggccuggacagguugccag

SEQ ID NO: 517852 - RNA, 18 nt, Human
ugggccuggaguggccaa

SEQ ID NO: 517853 - RNA, 21 nt, Human
ugggccuguagacacagcagg

SEQ ID NO: 517854 - RNA, 18 nt, Human
uggggaggcuacagugag

SEQ ID NO: 517855 - RNA, 22 nt, Human
uggggggccacggugaggcaga

SEQ ID NO: 517856 - RNA, 18 nt, Human
uggguggcaggagcuggg

SEQ ID NO: 517857 - RNA, 22 nt, Human
uggguggcaggagcugggugug

SEQ ID NO: 517858 - RNA, 19 nt, Human
uguaaggaaugagcggggc

SEQ ID NO: 517859 - RNA, 18 nt, Human
ugugaggcaggagcuggg

SEQ ID NO: 517860 - RNA, 18 nt, Human
ugugagguagaggcuggg

SEQ ID NO: 517861 - RNA, 19 nt, Human
uguggggggccacggugag

SEQ ID NO: 517862 - RNA, 26 nt, Human
uuuuuuuuuugaaaccacacaggggu

SEQ ID NO: 517863 - RNA, 19 nt, Human
aaacaaaaaguacaagugc

SEQ ID NO: 517864 - RNA, 20 nt, Human
aacauggcgaaaucccaucu

SEQ ID NO: 517865 - RNA, 21 nt, Human
aacauggcgaaaucccaucuc

SEQ ID NO: 517866 - RNA, 24 nt, Human
aauagcuggaacccaggaggcaga

SEQ ID NO: 517867 - RNA, 23 nt, Human
aauggcuuaugccuguaauccca

SEQ ID NO: 517868 - RNA, 23 nt, Human
accaagggacaaccccuaacccc

SEQ ID NO: 517869 - RNA, 21 nt, Human
agacaggccacaggggucccc

SEQ ID NO: 517870 - RNA, 24 nt, Human
agagccugcagugagcugagauca

SEQ ID NO: 517871 - RNA, 24 nt, Human
agccuggccaacauggcgaaaucc

SEQ ID NO: 517872 - RNA, 18 nt, Human
aggaacuuucauucaauu

SEQ ID NO: 517873 - RNA, 24 nt, Human
aggaagucccagcacaggcagauc

SEQ ID NO: 517874 - RNA, 25 nt, Human
aggaggcagagccugcagugagcug

SEQ ID NO: 517875 - RNA, 19 nt, Human
aggcagagccugcagugag

SEQ ID NO: 517876 - RNA, 20 nt, Human
aggcagagccugcagugagc

SEQ ID NO: 517877 - RNA, 24 nt, Human
aggcagagccugcagugagcugag

SEQ ID NO: 517878 - RNA, 24 nt, Human
aggcaggacaauagcuggaaccca

SEQ ID NO: 517879 - RNA, 30 nt, Human
aggccgggcacaauggcuuaugccuguaaa

SEQ ID NO: 517880 - RNA, 22 nt, Human
aggggguggaggauucuggagg

SEQ ID NO: 517881 - RNA, 23 nt, Human
aucacccauugcacuccagccug

SEQ ID NO: 517882 - RNA, 18 nt, Human
aucagacacuugaucuca

SEQ ID NO: 517883 - RNA, 18 nt, Human
auugcacuccagccuggg

SEQ ID NO: 517884 - RNA, 21 nt, Human
caagggacaaccccuaacccc

SEQ ID NO: 517885 - RNA, 22 nt, Human
caauagcuggaacccaggaggc

SEQ ID NO: 517886 - RNA, 25 nt, Human
cacacgccaccuuuccuuuuuuaca

SEQ ID NO: 517887 - RNA, 22 nt, Human
cacaggcagaucugcugacgcc

SEQ ID NO: 517888 - RNA, 25 nt, Human
cacaggccgggcacaauggcuuaug

SEQ ID NO: 517889 - RNA, 23 nt, Human
caccuggaaucccagcuacucgg

SEQ ID NO: 517890 - RNA, 24 nt, Human
caccuggaaucccagcuacucggg

SEQ ID NO: 517891 - RNA, 24 nt, Human
cacuccagccugggaaacaagagc

SEQ ID NO: 517892 - RNA, 21 nt, Human
cacuuuggccaaggucaggag

SEQ ID NO: 517893 - RNA, 21 nt, Human
cagcacaagcgcaucaaugaa

SEQ ID NO: 517894 - RNA, 24 nt, Human
cagcacaggcagaucugcugacgc

SEQ ID NO: 517895 - RNA, 24 nt, Human
cagcuacucgggaggcugaggcag

SEQ ID NO: 517896 - RNA, 20 nt, Human
caggaguuggagaacagccu

SEQ ID NO: 517897 - RNA, 20 nt, Human
caggcagaucugcugacgcc

SEQ ID NO: 517898 - RNA, 18 nt, Human
cauaaaaauuagccaggc

SEQ ID NO: 517899 - RNA, 22 nt, Human
cauucaauuaaagcuucuagga

SEQ ID NO: 517900 - RNA, 18 nt, Human
cauugcacuccagccugg

SEQ ID NO: 517901 - RNA, 19 nt, Human
cauugcacuccagccuggg

SEQ ID NO: 517902 - RNA, 19 nt, Human
cauugcacuccagccuggg

SEQ ID NO: 517903 - RNA, 23 nt, Human
cauugcacuccagccugggaaac

SEQ ID NO: 517904 - RNA, 24 nt, Human
cauugcacuccagccugggaaaca

SEQ ID NO: 517905 - RNA, 21 nt, Human
ccagcaaugugaugcuuacag

SEQ ID NO: 517906 - RNA, 19 nt, Human
ccauugcacuccagccugg

SEQ ID NO: 517907 - RNA, 20 nt, Human
ccauugcacuccagccuggg

SEQ ID NO: 517908 - RNA, 24 nt, Human
ccauugcacuccagccugggaaac

SEQ ID NO: 517909 - RNA, 19 nt, Human
cccaucucuacuaaaaaca

SEQ ID NO: 517910 - RNA, 24 nt, Human
cccauugcacuccagccugggaaa

SEQ ID NO: 517911 - RNA, 20 nt, Human
ccccagggaggaucaggggg

SEQ ID NO: 517912 - RNA, 21 nt, Human
ccuaguaccaggccuccccuc

SEQ ID NO: 517913 - RNA, 24 nt, Human
ccuggccaacauggcgaaauccca

SEQ ID NO: 517914 - RNA, 23 nt, Human
ccugggaaacaagagcaagacuc

SEQ ID NO: 517915 - RNA, 20 nt, Human
ccuguaaucccaacacuuug

SEQ ID NO: 517916 - RNA, 25 nt, Human
ccuuggccuugaggaagucaucuua

SEQ ID NO: 517917 - RNA, 23 nt, Human
cucaaacaaacaaacaaaaagua

SEQ ID NO: 517918 - RNA, 24 nt, Human
cucagugagacaggccacaggggu

SEQ ID NO: 517919 - RNA, 20 nt, Human
cucauauucugguuuguauu

SEQ ID NO: 517920 - RNA, 23 nt, Human
cucuguucuggaccuguuuuuuc

SEQ ID NO: 517921 - RNA, 20 nt, Human
cugcagugagcugagaucac

SEQ ID NO: 517922 - RNA, 26 nt, Human
cugcagugagcugagaucacccauug

SEQ ID NO: 517923 - RNA, 19 nt, Human
cuggagguuuccagccuug

SEQ ID NO: 517924 - RNA, 23 nt, Human
cuggccaacauggcgaaauccca

SEQ ID NO: 517925 - RNA, 23 nt, Human
gacaauagcuggaacccaggagg

SEQ ID NO: 517926 - RNA, 20 nt, Human
gagcaagacucaaucucaaa

SEQ ID NO: 517927 - RNA, 19 nt, Human
gaggagaaaccagcccaac

SEQ ID NO: 517928 - RNA, 24 nt, Human
gccaacauggcgaaaucccaucuc

SEQ ID NO: 517929 - RNA, 25 nt, Human
gccuccccucccacgauucaaagac

SEQ ID NO: 517930 - RNA, 19 nt, Human
gccuguaaucccaacacuu

SEQ ID NO: 517931 - RNA, 21 nt, Human
ggacaauagcuggaacccagg

SEQ ID NO: 517932 - RNA, 22 nt, Human
ggacucccuuguacagcagccc

SEQ ID NO: 517933 - RNA, 23 nt, Human
ggccgggcacaauggcuuaugcc

SEQ ID NO: 517934 - RNA, 20 nt, Human
ggcuuaugccuguaauccca

SEQ ID NO: 517935 - RNA, 19 nt, Human
gggacaaccccuaaccccu

SEQ ID NO: 517936 - RNA, 25 nt, Human
gggcucugugguuccucaaagaggu

SEQ ID NO: 517937 - RNA, 20 nt, Human
guauuugaagccugcuaaua

SEQ ID NO: 517938 - RNA, 21 nt, Human
gucaagacuacuguccaaggu

SEQ ID NO: 517939 - RNA, 20 nt, Human
gugaugagggccacugcugc

SEQ ID NO: 517940 - RNA, 24 nt, Human
gugccacgaugaaauuaaaaacac

SEQ ID NO: 517941 - RNA, 18 nt, Human
uaaaaacacaggccgggc

SEQ ID NO: 517942 - RNA, 21 nt, Human
uaaaaacacaggccgggcaca

SEQ ID NO: 517943 - RNA, 19 nt, Human
uaaaaauuagccaggcaca

SEQ ID NO: 517944 - RNA, 18 nt, Human
uaagauccuggagaagcc

SEQ ID NO: 517945 - RNA, 24 nt, Human
uacacugaggcuugaucagacacu

SEQ ID NO: 517946 - RNA, 21 nt, Human
uacauggcagacuagcugugu

SEQ ID NO: 517947 - RNA, 25 nt, Human
uaccaggccuccccucccacgauuc

SEQ ID NO: 517948 - RNA, 21 nt, Human
uaccuccugaauuaagauccu

SEQ ID NO: 517949 - RNA, 23 nt, Human
uaggaacuuuaacauccuccuuu

SEQ ID NO: 517950 - RNA, 20 nt, Human
uaugccuguaaucccaacac

SEQ ID NO: 517951 - RNA, 21 nt, Human
ucaaucucaaacaaacaaaca

SEQ ID NO: 517952 - RNA, 21 nt, Human
ucagcacaagcgcaucaauga

SEQ ID NO: 517953 - RNA, 24 nt, Human
uccagcaucaggaacucuguucug

SEQ ID NO: 517954 - RNA, 21 nt, Human
ucccagcacaggcagaucugc

SEQ ID NO: 517955 - RNA, 20 nt, Human
ucccuuguacagcagcccag

SEQ ID NO: 517956 - RNA, 21 nt, Human
ucucaagcuccauucuaccuc

SEQ ID NO: 517957 - RNA, 23 nt, Human
ucucuacuaaaaacauaaaaauu

SEQ ID NO: 517958 - RNA, 22 nt, Human
ucucugauccucaugauccauu

SEQ ID NO: 517959 - RNA, 23 nt, Human
ucuggcaugagauuuuccuccag

SEQ ID NO: 517960 - RNA, 18 nt, Human
ucugguuuguauuugaag

SEQ ID NO: 517961 - RNA, 18 nt, Human
ucuguucuggaccuguuu

SEQ ID NO: 517962 - RNA, 19 nt, Human
ucuguucuggaccuguuuu

SEQ ID NO: 517963 - RNA, 20 nt, Human
ugaaauuaaaaacacaggcc

SEQ ID NO: 517964 - RNA, 21 nt, Human
ugaaauuaaaaacacaggccg

SEQ ID NO: 517965 - RNA, 19 nt, Human
ugaauuaagauccuggaga

SEQ ID NO: 517966 - RNA, 22 nt, Human
ugagacaggccacagggguccc

SEQ ID NO: 517967 - RNA, 20 nt, Human
ugagaucacccauugcacuc

SEQ ID NO: 517968 - RNA, 23 nt, Human
ugagaucacccauugcacuccag

SEQ ID NO: 517969 - RNA, 20 nt, Human
ugagccugauaagaaaguug

SEQ ID NO: 517970 - RNA, 19 nt, Human
ugaggcaggacaauagcug

SEQ ID NO: 517971 - RNA, 24 nt, Human
ugaggcaggacaauagcuggaacc

SEQ ID NO: 517972 - RNA, 25 nt, Human
ugaggcaggacaauagcuggaaccc

SEQ ID NO: 517973 - RNA, 18 nt, Human
ugaggguacugagcucca

SEQ ID NO: 517974 - RNA, 23 nt, Human
ugccuguaaucccaacacuuugg

SEQ ID NO: 517975 - RNA, 21 nt, Human
uggauguuugcuggggaccuc

SEQ ID NO: 517976 - RNA, 19 nt, Human
uggcagcacucccgauguc

SEQ ID NO: 517977 - RNA, 21 nt, Human
uggcaugagauuuuccuccag

SEQ ID NO: 517978 - RNA, 24 nt, Human
uggcuuaugccuguaaucccaaca

SEQ ID NO: 517979 - RNA, 18 nt, Human
ugggcaagugacuuuucc

SEQ ID NO: 517980 - RNA, 19 nt, Human
uggggucuccauuucccug

SEQ ID NO: 517981 - RNA, 21 nt, Human
ugguuuguauuugaagccugc

SEQ ID NO: 517982 - RNA, 21 nt, Human
uguauuugaagccugcuaaua

SEQ ID NO: 517983 - RNA, 23 nt, Human
ugucagcaauaaguucacuggca

SEQ ID NO: 517984 - RNA, 23 nt, Human
ugugaugagggccacugcugcug

SEQ ID NO: 517985 - RNA, 20 nt, Human
uucaccauuccccuagaaca

SEQ ID NO: 517986 - RNA, 20 nt, Human
uucacuggcauuccugcagg

SEQ ID NO: 517987 - RNA, 20 nt, Human
uuggggucuccauuucccug

SEQ ID NO: 517988 - RNA, 22 nt, Human
uuuuuacauggcagacuagcug

SEQ ID NO: 517989 - RNA, 23 nt, Human
aaacaggacuggaacccaggacu

SEQ ID NO: 517990 - RNA, 18 nt, Human
aaagugcugggauuacaa

SEQ ID NO: 517991 - RNA, 24 nt, Human
aaagugcugggauuacaaauguga

SEQ ID NO: 517992 - RNA, 20 nt, Human
aacaggacuggaacccagga

SEQ ID NO: 517993 - RNA, 18 nt, Human
aagacugcggccaacuug

SEQ ID NO: 517994 - RNA, 24 nt, Human
aagcaaucccgccucagccuccca

SEQ ID NO: 517995 - RNA, 21 nt, Human
aagcagucaggauggaacuga

SEQ ID NO: 517996 - RNA, 20 nt, Human
aagcauggauggacucaagg

SEQ ID NO: 517997 - RNA, 26 nt, Human
aagugcugggauuacaaaugugaacc

SEQ ID NO: 517998 - RNA, 21 nt, Human
accacccguuauaaucauccc

SEQ ID NO: 517999 - RNA, 18 nt, Human
acuacaggugugugccac

SEQ ID NO: 518000 - RNA, 18 nt, Human
acugcccagacccucagc

SEQ ID NO: 518001 - RNA, 23 nt, Human
acuggucuggaacuccugggcuc

SEQ ID NO: 518002 - RNA, 19 nt, Human
aggaauugagaucuucagg

SEQ ID NO: 518003 - RNA, 20 nt, Human
aggcaggguuucacuacguu

SEQ ID NO: 518004 - RNA, 23 nt, Human
aggcaggguuucacuacguugcc

SEQ ID NO: 518005 - RNA, 23 nt, Human
agggucuugcuauacugcccagg

SEQ ID NO: 518006 - RNA, 22 nt, Human
aguaauggcaaacaggacugga

SEQ ID NO: 518007 - RNA, 24 nt, Human
caaagugcugggauuacaaaugug

SEQ ID NO: 518008 - RNA, 20 nt, Human
caaaugugaaccacugugcc

SEQ ID NO: 518009 - RNA, 22 nt, Human
caaggaguucacaaaccacugg

SEQ ID NO: 518010 - RNA, 22 nt, Human
caagugauucuucuaccuuggc

SEQ ID NO: 518011 - RNA, 22 nt, Human
cacaugaaacagagggccuggg

SEQ ID NO: 518012 - RNA, 18 nt, Human
cacccguuauaaucaucc

SEQ ID NO: 518013 - RNA, 20 nt, Human
cacuccccaccccaaccuuu

SEQ ID NO: 518014 - RNA, 23 nt, Human
cagaguccauccuuuuucuuuuc

SEQ ID NO: 518015 - RNA, 19 nt, Human
cagcagccuccuaagaaca

SEQ ID NO: 518016 - RNA, 24 nt, Human
cagcucccugccuaccaucugccc

SEQ ID NO: 518017 - RNA, 18 nt, Human
caggguuucacuacguug

SEQ ID NO: 518018 - RNA, 22 nt, Human
cagguaggacaugacccugcca

SEQ ID NO: 518019 - RNA, 18 nt, Human
cauggauggacucaaggu

SEQ ID NO: 518020 - RNA, 18 nt, Human
cauuaugugcuaagggcu

SEQ ID NO: 518021 - RNA, 21 nt, Human
ccaaagugcugggauuacaaa

SEQ ID NO: 518022 - RNA, 21 nt, Human
ccaaagugcugggauuacaaa

SEQ ID NO: 518023 - RNA, 22 nt, Human
ccaaagugcugggauuacaaau

SEQ ID NO: 518024 - RNA, 24 nt, Human
ccaaagugcugggauuacaaaugu

SEQ ID NO: 518025 - RNA, 24 nt, Human
ccaacuagcagagaauucuuaaca

SEQ ID NO: 518026 - RNA, 25 nt, Human
ccaagcccaacuugcuguaucagaa

SEQ ID NO: 518027 - RNA, 19 nt, Human
ccauguagcugggacuaca

SEQ ID NO: 518028 - RNA, 18 nt, Human
cccacacuggucuggaac

SEQ ID NO: 518029 - RNA, 26 nt, Human
cccccagcucccugccuaccaucugc

SEQ ID NO: 518030 - RNA, 22 nt, Human
ccuaagaacaccuguagucuca

SEQ ID NO: 518031 - RNA, 24 nt, Human
ccucaucucuucacuuuucuccag

SEQ ID NO: 518032 - RNA, 23 nt, Human
ccugccuaccaucugcccagggg

SEQ ID NO: 518033 - RNA, 22 nt, Human
ccugggcucaagugauucuucu

SEQ ID NO: 518034 - RNA, 19 nt, Human
ccuugcuguugcuuacuua

SEQ ID NO: 518035 - RNA, 20 nt, Human
cgcuuuauucuuuuuaugag

SEQ ID NO: 518036 - RNA, 21 nt, Human
cgcuuuauucuuuuuaugaga

SEQ ID NO: 518037 - RNA, 22 nt, Human
cuaagaacaccuguagucucac

SEQ ID NO: 518038 - RNA, 24 nt, Human
cuagcagagaauucuuaacaagcc

SEQ ID NO: 518039 - RNA, 21 nt, Human
cucaagcaaucccgccucagc

SEQ ID NO: 518040 - RNA, 20 nt, Human
cucaagugauucuucuaccu

SEQ ID NO: 518041 - RNA, 24 nt, Human
cucaagugauucuucuaccuuggc

SEQ ID NO: 518042 - RNA, 23 nt, Human
cucaccaugaaugucaccccaga

SEQ ID NO: 518043 - RNA, 24 nt, Human
cucagccucccauguagcugggac

SEQ ID NO: 518044 - RNA, 24 nt, Human
cuccagcagccuccuaagaacacc

SEQ ID NO: 518045 - RNA, 23 nt, Human
cuccaggaccacuacuuuagccu

SEQ ID NO: 518046 - RNA, 23 nt, Human
cucccauguagcugggacuacag

SEQ ID NO: 518047 - RNA, 20 nt, Human
cuccugggcucaagugauuc

SEQ ID NO: 518048 - RNA, 21 nt, Human
cuccugggcucaagugauucu

SEQ ID NO: 518049 - RNA, 18 nt, Human
cucuuccacaucccccag

SEQ ID NO: 518050 - RNA, 25 nt, Human
cugaggauagagacuuuuuucucac

SEQ ID NO: 518051 - RNA, 19 nt, Human
cugcaugccuguuccugcc

SEQ ID NO: 518052 - RNA, 21 nt, Human
cugggucuuguuugaccuagg

SEQ ID NO: 518053 - RNA, 23 nt, Human
gacuacaggugugugccacugca

SEQ ID NO: 518054 - RNA, 24 nt, Human
gagggucuugcuauacugcccagg

SEQ ID NO: 518055 - RNA, 20 nt, Human
gccucagccucccauguagc

SEQ ID NO: 518056 - RNA, 23 nt, Human
gccucagccucccauguagcugg

SEQ ID NO: 518057 - RNA, 21 nt, Human
ggaaacugggcagguaugagc

SEQ ID NO: 518058 - RNA, 20 nt, Human
ggacuacaggugugugccac

SEQ ID NO: 518059 - RNA, 22 nt, Human
ggacuacaggugugugccacug

SEQ ID NO: 518060 - RNA, 23 nt, Human
ggcaaacaggacuggaacccagg

SEQ ID NO: 518061 - RNA, 19 nt, Human
ggcacuuucuacuuucuuc

SEQ ID NO: 518062 - RNA, 22 nt, Human
gggcucaagugauucuucuacc

SEQ ID NO: 518063 - RNA, 22 nt, Human
guagcugggacuacaggugugu

SEQ ID NO: 518064 - RNA, 19 nt, Human
gugaaccacugugccuggc

SEQ ID NO: 518065 - RNA, 18 nt, Human
guggauccugccaucugu

SEQ ID NO: 518066 - RNA, 18 nt, Human
uaaaagggugaaaagugg

SEQ ID NO: 518067 - RNA, 23 nt, Human
uaacagaguccauccuuuuucuu

SEQ ID NO: 518068 - RNA, 24 nt, Human
uacguugcccacacuggucuggaa

SEQ ID NO: 518069 - RNA, 21 nt, Human
uagacugcccagacccucagc

SEQ ID NO: 518070 - RNA, 24 nt, Human
uaggacaugacccugccaaggagu

SEQ ID NO: 518071 - RNA, 23 nt, Human
uaggaggaagcuaacauguaaug

SEQ ID NO: 518072 - RNA, 23 nt, Human
uauacugcccaggcuggacucaa

SEQ ID NO: 518073 - RNA, 19 nt, Human
uaucuggaccaucccugcu

SEQ ID NO: 518074 - RNA, 24 nt, Human
uaugugcuaagggcuauacauggu

SEQ ID NO: 518075 - RNA, 23 nt, Human
ucaccucuucuucucuggugaga

SEQ ID NO: 518076 - RNA, 19 nt, Human
ucacuccccaccccaaccu

SEQ ID NO: 518077 - RNA, 21 nt, Human
ucacugguacugauaauucuc

SEQ ID NO: 518078 - RNA, 24 nt, Human
ucccauguagcugggacuacaggu

SEQ ID NO: 518079 - RNA, 21 nt, Human
ucccccagcucccugccuacc

SEQ ID NO: 518080 - RNA, 25 nt, Human
ucccuggggccugaacaguugccuu

SEQ ID NO: 518081 - RNA, 23 nt, Human
uccuaagaacaccuguagucuca

SEQ ID NO: 518082 - RNA, 21 nt, Human
uccugggcucaagugauucuu

SEQ ID NO: 518083 - RNA, 23 nt, Human
uccugggcucaagugauucuucu

SEQ ID NO: 518084 - RNA, 18 nt, Human
ucucacuccccaccccaa

SEQ ID NO: 518085 - RNA, 18 nt, Human
ucucacuccccaccccaa

SEQ ID NO: 518086 - RNA, 22 nt, Human
ucuccagccucaucucuucacu

SEQ ID NO: 518087 - RNA, 23 nt, Human
ucucuggugagagucugaggaua

SEQ ID NO: 518088 - RNA, 22 nt, Human
ucucuguuaccaucuacuaccc

SEQ ID NO: 518089 - RNA, 21 nt, Human
ucuggaacuccugggcucaag

SEQ ID NO: 518090 - RNA, 23 nt, Human
ucuugcuauacugcccaggcugg

SEQ ID NO: 518091 - RNA, 24 nt, Human
ucuugcuauacugcccaggcugga

SEQ ID NO: 518092 - RNA, 20 nt, Human
ugaaaagugguuugcugaag

SEQ ID NO: 518093 - RNA, 21 nt, Human
ugaaaagugguuugcugaaga

SEQ ID NO: 518094 - RNA, 20 nt, Human
ugaggauagagacuuuuuuc

SEQ ID NO: 518095 - RNA, 20 nt, Human
ugcccaggcuggacucaagc

SEQ ID NO: 518096 - RNA, 24 nt, Human
ugcuauacugcccaggcuggacuc

SEQ ID NO: 518097 - RNA, 18 nt, Human
ugcugggauuacaaaugu

SEQ ID NO: 518098 - RNA, 23 nt, Human
ugcugggauuacaaaugugaacc

SEQ ID NO: 518099 - RNA, 23 nt, Human
uggaacccaggacuucaggccuc

SEQ ID NO: 518100 - RNA, 21 nt, Human
uggcagguaggacaugacccu

SEQ ID NO: 518101 - RNA, 21 nt, Human
ugggacuacaggugugugcca

SEQ ID NO: 518102 - RNA, 22 nt, Human
ugggacuacaggugugugccac

SEQ ID NO: 518103 - RNA, 22 nt, Human
ugggacuacaggugugugccac

SEQ ID NO: 518104 - RNA, 24 nt, Human
ugggacuacaggugugugccacug

SEQ ID NO: 518105 - RNA, 21 nt, Human
ugggagguaggguacagucuc

SEQ ID NO: 518106 - RNA, 21 nt, Human
ugggauuacaaaugugaacca

SEQ ID NO: 518107 - RNA, 22 nt, Human
ugggauuacaaaugugaaccac

SEQ ID NO: 518108 - RNA, 24 nt, Human
ugggauuacaaaugugaaccacug

SEQ ID NO: 518109 - RNA, 19 nt, Human
ugggcucaagugauucuuc

SEQ ID NO: 518110 - RNA, 25 nt, Human
uguagcugggacuacaggugugugc

SEQ ID NO: 518111 - RNA, 20 nt, Human
ugugaagguauuagaggcug

SEQ ID NO: 518112 - RNA, 24 nt, Human
uguggguaacagaguccauccuuu

SEQ ID NO: 518113 - RNA, 20 nt, Human
ugugugccacugcacccaac

SEQ ID NO: 518114 - RNA, 19 nt, Human
uuaaaaggaugauaucacc

SEQ ID NO: 518115 - RNA, 26 nt, Human
uugcugaggagcagcugcuaaagcau

SEQ ID NO: 518116 - RNA, 22 nt, Human
uuugggcacuuucuacuuucuu

SEQ ID NO: 518117 - RNA, 22 nt, Human
uuuuuuuuuucuagaggcaggg

SEQ ID NO: 518118 - RNA, 27 nt, Human
uuuuuuuuuucuagaggcaggguuuca

SEQ ID NO: 518119 - RNA, 25 nt, Human
aacaagaaaccaauuccugagacag

SEQ ID NO: 518120 - RNA, 20 nt, Human
aagaaaccaauuccugagac

SEQ ID NO: 518121 - RNA, 19 nt, Human
aaguguuaucugcagagac

SEQ ID NO: 518122 - RNA, 22 nt, Human
aaguguuaucugcagagacccu

SEQ ID NO: 518123 - RNA, 21 nt, Human
acacuauucaacaugggaaac

SEQ ID NO: 518124 - RNA, 19 nt, Human
augccuguaaucccagcac

SEQ ID NO: 518125 - RNA, 24 nt, Human
auuuggucaugccuguaaucccag

SEQ ID NO: 518126 - RNA, 21 nt, Human
caagaaaccaauuccugaggg

SEQ ID NO: 518127 - RNA, 27 nt, Human
caauuccugagacagaaacaauuggua

SEQ ID NO: 518128 - RNA, 20 nt, Human
caugccuguaaucccagcac

SEQ ID NO: 518129 - RNA, 23 nt, Human
ccaguugaggaaagacaugaaac

SEQ ID NO: 518130 - RNA, 20 nt, Human
ccgucuucccuguaggucuc

SEQ ID NO: 518131 - RNA, 18 nt, Human
ccgugacuguaggcagcg

SEQ ID NO: 518132 - RNA, 18 nt, Human
ccugagacagaaacaauu

SEQ ID NO: 518133 - RNA, 20 nt, Human
ccuguaaucccagcacuuug

SEQ ID NO: 518134 - RNA, 23 nt, Human
cguaacuccagacucugccuccc

SEQ ID NO: 518135 - RNA, 19 nt, Human
gacacagccauuggcuuua

SEQ ID NO: 518136 - RNA, 22 nt, Human
gacagaaacaauugguaaagga

SEQ ID NO: 518137 - RNA, 24 nt, Human
gagcacauuuggucaugccuguaa

SEQ ID NO: 518138 - RNA, 20 nt, Human
ggucaugccuguaaucccag

SEQ ID NO: 518139 - RNA, 26 nt, Human
guaucacagugcaacaagaaaccaau

SEQ ID NO: 518140 - RNA, 23 nt, Human
gucaugccuguaaucccagcacu

SEQ ID NO: 518141 - RNA, 25 nt, Human
gucaugccuguaaucccagcacuuu

SEQ ID NO: 518142 - RNA, 19 nt, Human
uaaagcccccuuucuuuuc

SEQ ID NO: 518143 - RNA, 30 nt, Human
uaaugaguucugccucuguuauaaagcccu

SEQ ID NO: 518144 - RNA, 23 nt, Human
uaggcagcguaacuccagacucu

SEQ ID NO: 518145 - RNA, 18 nt, Human
ucacgaggccagaaauuc

SEQ ID NO: 518146 - RNA, 23 nt, Human
ucaugccuguaaucccagcacuu

SEQ ID NO: 518147 - RNA, 21 nt, Human
ucccauggccgucuucccugu

SEQ ID NO: 518148 - RNA, 23 nt, Human
uccgugacuguaggcagcguaac

SEQ ID NO: 518149 - RNA, 21 nt, Human
ucugcagagacccuguuucca

SEQ ID NO: 518150 - RNA, 21 nt, Human
ugacuguaggcagcguaacuc

SEQ ID NO: 518151 - RNA, 20 nt, Human
ugagacagaaacaauuggua

SEQ ID NO: 518152 - RNA, 22 nt, Human
ugccuguaaucccagcacuuug

SEQ ID NO: 518153 - RNA, 20 nt, Human
uggucaugccuguaauccca

SEQ ID NO: 518154 - RNA, 21 nt, Human
uggucaugccuguaaucccag

SEQ ID NO: 518155 - RNA, 23 nt, Human
uggucaugccuguaaucccagca

SEQ ID NO: 518156 - RNA, 21 nt, Human
ugucccauggccgucuucccu

SEQ ID NO: 518157 - RNA, 24 nt, Human
uuggucaugccuguaaucccagca

SEQ ID NO: 518158 - RNA, 23 nt, Human
uuuccagcuguccuuggcauucc

SEQ ID NO: 518159 - RNA, 18 nt, Human
uuuuuuuuuuuuuuuuug

SEQ ID NO: 518160 - RNA, 24 nt, Human
aaacucacuuuaauaugagauaag

SEQ ID NO: 518161 - RNA, 24 nt, Human
aacaagaaaacauaaaugucagga

SEQ ID NO: 518162 - RNA, 22 nt, Human
aacuccaaacucacuuuaauau

SEQ ID NO: 518163 - RNA, 22 nt, Human
aagagaaauaaugguuguaacc

SEQ ID NO: 518164 - RNA, 24 nt, Human
agaacuccaaacucacuuuaauau

SEQ ID NO: 518165 - RNA, 19 nt, Human
agaggcggaccuauguaua

SEQ ID NO: 518166 - RNA, 19 nt, Human
agcaaaugaagagaaauaa

SEQ ID NO: 518167 - RNA, 24 nt, Human
agccaaaaaagaaauacuuguuga

SEQ ID NO: 518168 - RNA, 20 nt, Human
caagaaaacauaaaugucaa

SEQ ID NO: 518169 - RNA, 19 nt, Human
cucacauaugaacgaacau

SEQ ID NO: 518170 - RNA, 24 nt, Human
cugugaguccaggugguacuucca

SEQ ID NO: 518171 - RNA, 25 nt, Human
uaaauguagacugaacugaaaugaa

SEQ ID NO: 518172 - RNA, 25 nt, Human
uaaaugucaggagcuacaaacuuua

SEQ ID NO: 518173 - RNA, 23 nt, Human
uacaaacuuuaguauucagaggc

SEQ ID NO: 518174 - RNA, 23 nt, Human
uagacugaacugaaaugaacucc

SEQ ID NO: 518175 - RNA, 24 nt, Human
uccaacauauaaacaagaaaacau

SEQ ID NO: 518176 - RNA, 21 nt, Human
uccuugcuaucucccaccccc

SEQ ID NO: 518177 - RNA, 20 nt, Human
ugaaaugaacuccugugcaa

SEQ ID NO: 518178 - RNA, 21 nt, Human
ugcaaugcugcacuaaagcag

SEQ ID NO: 518179 - RNA, 21 nt, Human
uuaguauucagaggcggaccu

SEQ ID NO: 518180 - RNA, 18 nt, Human
uugcuaucucccaccccc

SEQ ID NO: 518181 - RNA, 19 nt, Human
agaauaaggauccugagaa

SEQ ID NO: 518182 - RNA, 23 nt, Human
aggugccuggagucccgcgggug

SEQ ID NO: 518183 - RNA, 28 nt, Human
aggugccuggagucccgcgggugggccg

SEQ ID NO: 518184 - RNA, 21 nt, Human
auucuuagcaaaucccucuuu

SEQ ID NO: 518185 - RNA, 24 nt, Human
caagggggacgccgggggcaggcc

SEQ ID NO: 518186 - RNA, 21 nt, Human
caccaaggaguaaagauucag

SEQ ID NO: 518187 - RNA, 21 nt, Human
ccaagccugaccuauacccag

SEQ ID NO: 518188 - RNA, 19 nt, Human
cccgggaggggucgcgggg

SEQ ID NO: 518189 - RNA, 19 nt, Human
cccucuuuuauuuuugcca

SEQ ID NO: 518190 - RNA, 21 nt, Human
ccggggucccgggaggggucg

SEQ ID NO: 518191 - RNA, 21 nt, Human
cgccgggggcaggccggcugu

SEQ ID NO: 518192 - RNA, 22 nt, Human
cgccgggggcaggccggcuguc

SEQ ID NO: 518193 - RNA, 21 nt, Human
cgggcagaagaggugccugga

SEQ ID NO: 518194 - RNA, 23 nt, Human
cgggcagaagaggugccuggagu

SEQ ID NO: 518195 - RNA, 21 nt, Human
cuagcugacuugacucccagc

SEQ ID NO: 518196 - RNA, 21 nt, Human
cugggaucaaggcugccaagc

SEQ ID NO: 518197 - RNA, 23 nt, Human
gacuagaauaugaguagaaagug

SEQ ID NO: 518198 - RNA, 18 nt, Human
gaguagaaagugugaggu

SEQ ID NO: 518199 - RNA, 20 nt, Human
gcagaagaggugccuggagu

SEQ ID NO: 518200 - RNA, 19 nt, Human
ggaaaaacggagcaagggg

SEQ ID NO: 518201 - RNA, 18 nt, Human
ggggcaggccggcugucu

SEQ ID NO: 518202 - RNA, 21 nt, Human
gucccgggaggggucgcgggg

SEQ ID NO: 518203 - RNA, 19 nt, Human
uaacaggugggagugagga

SEQ ID NO: 518204 - RNA, 18 nt, Human
uaagaaguuacuccagga

SEQ ID NO: 518205 - RNA, 21 nt, Human
ucagaguuacuguugccugcg

SEQ ID NO: 518206 - RNA, 18 nt, Human
ucaggagaucgucggugg

SEQ ID NO: 518207 - RNA, 20 nt, Human
ucaguuccaugggccccacu

SEQ ID NO: 518208 - RNA, 22 nt, Human
uccaggcguauuuucugaaacu

SEQ ID NO: 518209 - RNA, 20 nt, Human
uccggggucccgggaggggu

SEQ ID NO: 518210 - RNA, 21 nt, Human
uccggggucccgggagggguc

SEQ ID NO: 518211 - RNA, 18 nt, Human
ugccuggagucccgcggg

SEQ ID NO: 518212 - RNA, 24 nt, Human
ugcgggcagaagaggugccuggag

SEQ ID NO: 518213 - RNA, 23 nt, Human
ugggaaaaacggagcaaggcaac

SEQ ID NO: 518214 - RNA, 19 nt, Human
uugaugaagccagugcuuu

SEQ ID NO: 518215 - RNA, 18 nt, Human
uugggaaaaacggagcaa

SEQ ID NO: 518216 - RNA, 24 nt, Human
uugugauaggccagguguuuuguc

SEQ ID NO: 518217 - RNA, 23 nt, Human
uuugggaaaaacggagcaaggca

SEQ ID NO: 518218 - RNA, 18 nt, Human
aagccgcgacgggacacc

SEQ ID NO: 518219 - RNA, 19 nt, Human
agaaaguucacacccuggc

SEQ ID NO: 518220 - RNA, 24 nt, Human
agagacuaaaccaugggagaaagu

SEQ ID NO: 518221 - RNA, 21 nt, Human
cacaacacacaggcugcugag

SEQ ID NO: 518222 - RNA, 18 nt, Human
cacacaggcugcugaggg

SEQ ID NO: 518223 - RNA, 21 nt, Human
cacagcacuugccaggcgccc

SEQ ID NO: 518224 - RNA, 19 nt, Human
caccaggaaagaaaacggc

SEQ ID NO: 518225 - RNA, 23 nt, Human
cacccuggccugggccacccacc

SEQ ID NO: 518226 - RNA, 26 nt, Human
cccaagccgcgacgggacaccaggaa

SEQ ID NO: 518227 - RNA, 18 nt, Human
ccuggccugggccaccca

SEQ ID NO: 518228 - RNA, 19 nt, Human
cgcacgcuggccccaagag

SEQ ID NO: 518229 - RNA, 23 nt, Human
cgugggcacagcacuugccaggc

SEQ ID NO: 518230 - RNA, 18 nt, Human
cuggccccaagagcuuca

SEQ ID NO: 518231 - RNA, 19 nt, Human
gccccuggcaggggcucuu

SEQ ID NO: 518232 - RNA, 23 nt, Human
gccugggccacccaccuucagcu

SEQ ID NO: 518233 - RNA, 18 nt, Human
ggccugggccacccaccu

SEQ ID NO: 518234 - RNA, 22 nt, Human
ucaguugaacuuccggcccagu

SEQ ID NO: 518235 - RNA, 26 nt, Human
ugccaggcgccccuggcaggggcucu

SEQ ID NO: 518236 - RNA, 24 nt, Human
uggccugggccacccaccuucagc

SEQ ID NO: 518237 - RNA, 18 nt, Human
uggguccugggcggacgu

SEQ ID NO: 518238 - RNA, 19 nt, Human
uuucacacaacacacaggc

SEQ ID NO: 518239 - RNA, 21 nt, Human
uuuuuuuuuuuuuucuuguuu

SEQ ID NO: 518240 - RNA, 20 nt, Human
uuuuuuuuuuuuuuucuugg

SEQ ID NO: 518241 - RNA, 20 nt, Human
aacuacaaauggaaauauca

SEQ ID NO: 518242 - RNA, 20 nt, Human
acuccaaggagccugugugg

SEQ ID NO: 518243 - RNA, 20 nt, Human
agacccugaggacaauauua

SEQ ID NO: 518244 - RNA, 26 nt, Human
aguuucucacacucuuacuccaagga

SEQ ID NO: 518245 - RNA, 22 nt, Human
aucucugcacuuaagcuagaag

SEQ ID NO: 518246 - RNA, 19 nt, Human
auuugaugauguaaaugug

SEQ ID NO: 518247 - RNA, 26 nt, Human
caccauaaagaggaccacuugauucc

SEQ ID NO: 518248 - RNA, 29 nt, Human
caccauaaagaggaccacuugauuccuca

SEQ ID NO: 518249 - RNA, 27 nt, Human
cacucuuacuccaaggagccugugugg

SEQ ID NO: 518250 - RNA, 21 nt, Human
ccaguaauauuuauuuguagc

SEQ ID NO: 518251 - RNA, 24 nt, Human
ccucacuuccagaugugcucagac

SEQ ID NO: 518252 - RNA, 24 nt, Human
cucauaauaugucuagacugaguu

SEQ ID NO: 518253 - RNA, 21 nt, Human
cucugcacuuaagcuagaagu

SEQ ID NO: 518254 - RNA, 26 nt, Human
ucccagccucauaauaugucuagacu

SEQ ID NO: 518255 - RNA, 18 nt, Human
uguugaucuccuuaaauc

SEQ ID NO: 518256 - RNA, 23 nt, Human
uguugaucuccuuaaaucucugc

SEQ ID NO: 518257 - RNA, 21 nt, Human
uucucacacucuuacuccaag

SEQ ID NO: 518258 - RNA, 21 nt, Human
uugugguguguuuauuuuccc

SEQ ID NO: 518259 - RNA, 23 nt, Human
uuugugguguguuuauuuucccc

SEQ ID NO: 518260 - RNA, 23 nt, Human
uuuuuagauuuacaugugccacc

SEQ ID NO: 518261 - RNA, 25 nt, Human
acagucccccagcacugggacucag

SEQ ID NO: 518262 - RNA, 19 nt, Human
agggagcucugggcccggc

SEQ ID NO: 518263 - RNA, 20 nt, Human
caccuggacagggcaggggg

SEQ ID NO: 518264 - RNA, 19 nt, Human
cacgagcuucugcuucucg

SEQ ID NO: 518265 - RNA, 20 nt, Human
cagccuccuucagcuggggg

SEQ ID NO: 518266 - RNA, 19 nt, Human
caggcagagggagcucugg

SEQ ID NO: 518267 - RNA, 22 nt, Human
caggggguucucuugccaacuc

SEQ ID NO: 518268 - RNA, 24 nt, Human
ccaccuggacagggcaggggguuc

SEQ ID NO: 518269 - RNA, 22 nt, Human
cggggaaggggaccuugguccg

SEQ ID NO: 518270 - RNA, 19 nt, Human
cuugccaacuccugccagc

SEQ ID NO: 518271 - RNA, 19 nt, Human
cuuuauucucaugccccuc

SEQ ID NO: 518272 - RNA, 23 nt, Human
gcgcaugggugccggggaagggg

SEQ ID NO: 518273 - RNA, 19 nt, Human
ggcccggcgcaugggugcc

SEQ ID NO: 518274 - RNA, 23 nt, Human
gggaccuugguccggggcagggg

SEQ ID NO: 518275 - RNA, 20 nt, Human
gggcacaggcuccagcacgc

SEQ ID NO: 518276 - RNA, 23 nt, Human
gggcaggggcacaggcuccagca

SEQ ID NO: 518277 - RNA, 20 nt, Human
ggggaaggggaccuuggucc

SEQ ID NO: 518278 - RNA, 23 nt, Human
ucagcuucccaccuggacagggc

SEQ ID NO: 518279 - RNA, 22 nt, Human
uccacgagcuucugcuucucgc

SEQ ID NO: 518280 - RNA, 22 nt, Human
ucccccagcacugggacucagc

SEQ ID NO: 518281 - RNA, 24 nt, Human
ucccccagcacugggacucagcuu

SEQ ID NO: 518282 - RNA, 20 nt, Human
ugguccggggcaggggcaca

SEQ ID NO: 518283 - RNA, 20 nt, Human
uucucaugccccucaugucc

SEQ ID NO: 518284 - RNA, 19 nt, Human
uuuuuuuuuuucaggaggc

SEQ ID NO: 518285 - RNA, 23 nt, Human
uuuuuuuuuuuuuuuuuuucagg

SEQ ID NO: 518286 - RNA, 24 nt, Human
acccauucucacccgccucccccc

SEQ ID NO: 518287 - RNA, 18 nt, Human
agccuggaaagggcagca

SEQ ID NO: 518288 - RNA, 21 nt, Human
aggcaguggcugagcaggaaa

SEQ ID NO: 518289 - RNA, 21 nt, Human
cccccgguagagagaaaugga

SEQ ID NO: 518290 - RNA, 24 nt, Human
cccccgguagagagaaauggaagc

SEQ ID NO: 518291 - RNA, 20 nt, Human
gggcagcacgaugaagacuu

SEQ ID NO: 518292 - RNA, 26 nt, Human
uacagacccauucucacccgccuccc

SEQ ID NO: 518293 - RNA, 21 nt, Human
uccacgcugggggcgcaggaa

SEQ ID NO: 518294 - RNA, 19 nt, Human
uggaaagggcagcacgaug

SEQ ID NO: 518295 - RNA, 21 nt, Human
uggaacaagaucuucucuauc

SEQ ID NO: 518296 - RNA, 23 nt, Human
uggaagccuuuccacgcuggggg

SEQ ID NO: 518297 - RNA, 20 nt, Human
uggaggcaguggcugagcag

SEQ ID NO: 518298 - RNA, 24 nt, Human
aagcugcugguagcugaggcagug

SEQ ID NO: 518299 - RNA, 18 nt, Human
aauuucuggcaaucaauu

SEQ ID NO: 518300 - RNA, 28 nt, Human
acaaaaaaaaauagcuuacaauuucuca

SEQ ID NO: 518301 - RNA, 19 nt, Human
accacuaaaaaauacacca

SEQ ID NO: 518302 - RNA, 25 nt, Human
accacuaaaaaauacaccaaaaaau

SEQ ID NO: 518303 - RNA, 20 nt, Human
accuuuucauucugcaaucc

SEQ ID NO: 518304 - RNA, 19 nt, Human
agccuggggcggcagucgg

SEQ ID NO: 518305 - RNA, 22 nt, Human
agcgccccugccacugaauccc

SEQ ID NO: 518306 - RNA, 24 nt, Human
aucacaauauuuccuugggcaauu

SEQ ID NO: 518307 - RNA, 23 nt, Human
aucacugcaauuuagacaucagg

SEQ ID NO: 518308 - RNA, 26 nt, Human
aucaggacaaaaaaaaauagcuuaca

SEQ ID NO: 518309 - RNA, 23 nt, Human
auuguagcugaaauugaucuucu

SEQ ID NO: 518310 - RNA, 21 nt, Human
auuucuggcaaucaauucuaa

SEQ ID NO: 518311 - RNA, 18 nt, Human
caaucaauucuaagacaa

SEQ ID NO: 518312 - RNA, 20 nt, Human
cacucuuguccauuacuuca

SEQ ID NO: 518313 - RNA, 20 nt, Human
cacugcaauuuagacaucag

SEQ ID NO: 518314 - RNA, 20 nt, Human
cagaugaguauuguagcuga

SEQ ID NO: 518315 - RNA, 21 nt, Human
ccaggauauggcaucuugcca

SEQ ID NO: 518316 - RNA, 23 nt, Human
ccaucuacuaaauuaaaaaguua

SEQ ID NO: 518317 - RNA, 20 nt, Human
ccaucuggaagacacaaagc

SEQ ID NO: 518318 - RNA, 27 nt, Human
ccaucuggaagacacaaagcuagucac

SEQ ID NO: 518319 - RNA, 21 nt, Human
ccccgauccagagaugcuccc

SEQ ID NO: 518320 - RNA, 20 nt, Human
ccccugccacugaauccccg

SEQ ID NO: 518321 - RNA, 22 nt, Human
ccccugccacugaauccccgau

SEQ ID NO: 518322 - RNA, 18 nt, Human
ccggagaagcugcuggua

SEQ ID NO: 518323 - RNA, 22 nt, Human
cggagccuggggcggcagucgg

SEQ ID NO: 518324 - RNA, 19 nt, Human
cggggucgagcgccccugc

SEQ ID NO: 518325 - RNA, 18 nt, Human
cucaaagauaauaucacc

SEQ ID NO: 518326 - RNA, 19 nt, Human
cucuuuuuucccacucuug

SEQ ID NO: 518327 - RNA, 19 nt, Human
cuuaucacugcaauuuaga

SEQ ID NO: 518328 - RNA, 21 nt, Human
cuuuugguccauaacauaacu

SEQ ID NO: 518329 - RNA, 19 nt, Human
gcggagccuggggcggcag

SEQ ID NO: 518330 - RNA, 21 nt, Human
ggguauuucauuaaccuaaaa

SEQ ID NO: 518331 - RNA, 22 nt, Human
uaaaaaguuauuucuaugagag

SEQ ID NO: 518332 - RNA, 24 nt, Human
uaaaauaaccacuaaaaaauacac

SEQ ID NO: 518333 - RNA, 28 nt, Human
uaaaauaaccacuaaaaaauacaccaaa

SEQ ID NO: 518334 - RNA, 18 nt, Human
uaacauaacugacuuggc

SEQ ID NO: 518335 - RNA, 22 nt, Human
uaaccuuuucauucugcaaucc

SEQ ID NO: 518336 - RNA, 22 nt, Human
uagcugaaauugaucuucucaa

SEQ ID NO: 518337 - RNA, 25 nt, Human
ucaaugguuuuaaugaauauuuccu

SEQ ID NO: 518338 - RNA, 22 nt, Human
ucacugcaauuuagacaucagg

SEQ ID NO: 518339 - RNA, 23 nt, Human
ucacuucuauuacagacaagcca

SEQ ID NO: 518340 - RNA, 19 nt, Human
ucccuaggcccaacuucua

SEQ ID NO: 518341 - RNA, 20 nt, Human
ucuauuacagacaagccagu

SEQ ID NO: 518342 - RNA, 19 nt, Human
ucuggaagacacaaagcua

SEQ ID NO: 518343 - RNA, 19 nt, Human
ugaauaguccuccugcucc

SEQ ID NO: 518344 - RNA, 22 nt, Human
ugaauaguccuccugcuccuca

SEQ ID NO: 518345 - RNA, 19 nt, Human
ugacaauauguacacagug

SEQ ID NO: 518346 - RNA, 21 nt, Human
ugacuuaaucuauccaguuau

SEQ ID NO: 518347 - RNA, 23 nt, Human
ugaggccacacacucugcauacu

SEQ ID NO: 518348 - RNA, 24 nt, Human
ugccacugaauccccgauccagag

SEQ ID NO: 518349 - RNA, 18 nt, Human
ugcuaaaauuauguaggg

SEQ ID NO: 518350 - RNA, 18 nt, Human
ugggaaagucgauugaua

SEQ ID NO: 518351 - RNA, 19 nt, Human
uguaggaacuauaaccuuu

SEQ ID NO: 518352 - RNA, 20 nt, Human
uguagggucagauggagauu

SEQ ID NO: 518353 - RNA, 23 nt, Human
ugugaucagccaucugugguacc

SEQ ID NO: 518354 - RNA, 22 nt, Human
uuaacagauguuagccauacuu

SEQ ID NO: 518355 - RNA, 21 nt, Human
uuagacaucaggacaaaaaaa

SEQ ID NO: 518356 - RNA, 19 nt, Human
uuaggaucacaauauuucc

SEQ ID NO: 518357 - RNA, 22 nt, Human
uugcaauuucuggcaaucaauu

SEQ ID NO: 518358 - RNA, 19 nt, Human
uuugaaaaggaucucuuuu

SEQ ID NO: 518359 - RNA, 22 nt, Human
aaaaaaaucaacaacauacuca

SEQ ID NO: 518360 - RNA, 27 nt, Human
aaaaacaggaaagggugaccgguaccc

SEQ ID NO: 518361 - RNA, 22 nt, Human
aaacaggaaagggugacauaua

SEQ ID NO: 518362 - RNA, 20 nt, Human
aaaccaacaaaaauuaaaau

SEQ ID NO: 518363 - RNA, 19 nt, Human
acacaaaaaaaucaacaac

SEQ ID NO: 518364 - RNA, 20 nt, Human
acacacaaaaaaaucaacaa

SEQ ID NO: 518365 - RNA, 24 nt, Human
acacacaaaaaaaucaacaacaua

SEQ ID NO: 518366 - RNA, 27 nt, Human
accacacacaaaaaaaucaacaacaua

SEQ ID NO: 518367 - RNA, 18 nt, Human
agauguugaaacugaagc

SEQ ID NO: 518368 - RNA, 20 nt, Human
aggaaagggugacauauauu

SEQ ID NO: 518369 - RNA, 20 nt, Human
auagcuucucuuccuucuuu

SEQ ID NO: 518370 - RNA, 19 nt, Human
auauauaugguuauaccaa

SEQ ID NO: 518371 - RNA, 25 nt, Human
caaaaugguuaaacuggcuuaagua

SEQ ID NO: 518372 - RNA, 22 nt, Human
cacaguaauccuaugagguagg

SEQ ID NO: 518373 - RNA, 20 nt, Human
cccaacacacccauauuuaa

SEQ ID NO: 518374 - RNA, 23 nt, Human
cgccccuuuuuuuuuuuuuuuuu

SEQ ID NO: 518375 - RNA, 21 nt, Human
cucuuccuucuuuuggauuuu

SEQ ID NO: 518376 - RNA, 29 nt, Human
gagcggccgccccuuuuuuuuuuuuuuuu

SEQ ID NO: 518377 - RNA, 19 nt, Human
gccagucauuccuccccaa

SEQ ID NO: 518378 - RNA, 21 nt, Human
gccccuuuuuuuuuuuuuuuu

SEQ ID NO: 518379 - RNA, 21 nt, Human
gcucagaucuuccuaaaucaa

SEQ ID NO: 518380 - RNA, 24 nt, Human
ggaagggauuuucauuuauuugcu

SEQ ID NO: 518381 - RNA, 23 nt, Human
ggccgccccuuuuuuuuuuuuuu

SEQ ID NO: 518382 - RNA, 23 nt, Human
gugggauaguuaaaccaacaaaa

SEQ ID NO: 518383 - RNA, 19 nt, Human
uaaaauuuucaaaugggca

SEQ ID NO: 518384 - RNA, 22 nt, Human
uaaccacacacaaaaaaaucaa

SEQ ID NO: 518385 - RNA, 25 nt, Human
uauauuguucugaucaauaauuuca

SEQ ID NO: 518386 - RNA, 21 nt, Human
uccaaacuugcaucugcagac

SEQ ID NO: 518387 - RNA, 22 nt, Human
uccuaaaucaauacaugucuac

SEQ ID NO: 518388 - RNA, 23 nt, Human
uccuaaugcuaacauuucccaaa

SEQ ID NO: 518389 - RNA, 23 nt, Human
uccuccagcaacagaaaaugugg

SEQ ID NO: 518390 - RNA, 23 nt, Human
ucuaucacaaacagagguauggc

SEQ ID NO: 518391 - RNA, 25 nt, Human
ugagguaggcaauguuaacaugccc

SEQ ID NO: 518392 - RNA, 24 nt, Human
ugccaggcacuuuuuaaaguugcu

SEQ ID NO: 518393 - RNA, 18 nt, Human
uguauuucaaucuucauc

SEQ ID NO: 518394 - RNA, 21 nt, Human
uguuuuguuccuccagcaaca

SEQ ID NO: 518395 - RNA, 24 nt, Human
uugauucuaucaguaaccacacac

SEQ ID NO: 518396 - RNA, 21 nt, Human
uugcauauagcuucucuuccu

SEQ ID NO: 518397 - RNA, 24 nt, Human
uuuaaauaacuuucccaaggcugc

SEQ ID NO: 518398 - RNA, 24 nt, Human
uuuacagauguugaaacugaagcc

SEQ ID NO: 518399 - RNA, 26 nt, Human
uuucauuuauuugcuuuucucuucca

SEQ ID NO: 518400 - RNA, 22 nt, Human
uuuuuuuuuuuuuuuucaucuu

SEQ ID NO: 518401 - RNA, 22 nt, Human
uuuuuuuuuuuuuuuucaucuu

SEQ ID NO: 518402 - RNA, 27 nt, Human
uuuuuuuuuuuuuuuuucaucuugauu

SEQ ID NO: 518403 - RNA, 23 nt, Human
aaaggaggggcuggggggugggg

SEQ ID NO: 518404 - RNA, 21 nt, Human
aacccgcuguuccaggacccu

SEQ ID NO: 518405 - RNA, 19 nt, Human
aaggaggggcuggggggug

SEQ ID NO: 518406 - RNA, 20 nt, Human
aaggcaggagauggaaguca

SEQ ID NO: 518407 - RNA, 24 nt, Human
acaagccuuuucagccugggugac

SEQ ID NO: 518408 - RNA, 21 nt, Human
acagagccacagcugcaauag

SEQ ID NO: 518409 - RNA, 18 nt, Human
acaguguguccugcccaa

SEQ ID NO: 518410 - RNA, 22 nt, Human
agaaaggaggggcuggggggug

SEQ ID NO: 518411 - RNA, 21 nt, Human
agaaggggacaugucuuccag

SEQ ID NO: 518412 - RNA, 25 nt, Human
agagcagggagaaaggaggggcugg

SEQ ID NO: 518413 - RNA, 20 nt, Human
agcagggagaaaggaggggc

SEQ ID NO: 518414 - RNA, 24 nt, Human
agccaagaauaccauaggcuucca

SEQ ID NO: 518415 - RNA, 19 nt, Human
agcccucggaagccucaua

SEQ ID NO: 518416 - RNA, 24 nt, Human
aggaaagaaggggacaugucuucc

SEQ ID NO: 518417 - RNA, 24 nt, Human
aggaggggcugggggguggggggc

SEQ ID NO: 518418 - RNA, 20 nt, Human
aggcaggagauggaagucag

SEQ ID NO: 518419 - RNA, 20 nt, Human
aggcugaggagauggggaca

SEQ ID NO: 518420 - RNA, 24 nt, Human
aggcugaggagauggggacacaug

SEQ ID NO: 518421 - RNA, 19 nt, Human
agggagaaaggaggggcug

SEQ ID NO: 518422 - RNA, 20 nt, Human
agggagaaaggaggggcugg

SEQ ID NO: 518423 - RNA, 19 nt, Human
aggggcugggggguggggg

SEQ ID NO: 518424 - RNA, 20 nt, Human
aggggcuggggggugggggg

SEQ ID NO: 518425 - RNA, 22 nt, Human
caagaauaccauaggcuuccac

SEQ ID NO: 518426 - RNA, 23 nt, Human
caagaauaccauaggcuuccagu

SEQ ID NO: 518427 - RNA, 18 nt, Human
cacagaaagaaagagggg

SEQ ID NO: 518428 - RNA, 18 nt, Human
cacuccaugaggcagaac

SEQ ID NO: 518429 - RNA, 18 nt, Human
cacuguggguccugagag

SEQ ID NO: 518430 - RNA, 22 nt, Human
cauacagagccacagcugcaau

SEQ ID NO: 518431 - RNA, 22 nt, Human
ccacagcugcaauagccaagaa

SEQ ID NO: 518432 - RNA, 20 nt, Human
cccugccucccagccuccuc

SEQ ID NO: 518433 - RNA, 19 nt, Human
ccucagaacccgcuguucc

SEQ ID NO: 518434 - RNA, 23 nt, Human
ccucccagccuccucagaacccg

SEQ ID NO: 518435 - RNA, 21 nt, Human
ccucucacagcccucggaagc

SEQ ID NO: 518436 - RNA, 19 nt, Human
ccucucagcccugccuccc

SEQ ID NO: 518437 - RNA, 21 nt, Human
ccugagagcagggagaaagga

SEQ ID NO: 518438 - RNA, 22 nt, Human
cgggcuggggugcagaggaaag

SEQ ID NO: 518439 - RNA, 19 nt, Human
cuccccacaagccuuuuca

SEQ ID NO: 518440 - RNA, 19 nt, Human
cuggcugcgggcuggggug

SEQ ID NO: 518441 - RNA, 24 nt, Human
cuuccagcuccucgaggcucuggg

SEQ ID NO: 518442 - RNA, 18 nt, Human
gagaaaggaggggcuggg

SEQ ID NO: 518443 - RNA, 18 nt, Human
gagcagggagaaaggagg

SEQ ID NO: 518444 - RNA, 20 nt, Human
gagggugguggccacugggg

SEQ ID NO: 518445 - RNA, 24 nt, Human
gccugggugacugaggcugaggag

SEQ ID NO: 518446 - RNA, 20 nt, Human
gccuuuucagccugggugac

SEQ ID NO: 518447 - RNA, 22 nt, Human
gcugaggagauggggacacaug

SEQ ID NO: 518448 - RNA, 19 nt, Human
ggacaugucuuccagcucc

SEQ ID NO: 518449 - RNA, 26 nt, Human
ggaggggcugggggguggggggcugg

SEQ ID NO: 518450 - RNA, 18 nt, Human
ggcugggggguggggggc

SEQ ID NO: 518451 - RNA, 21 nt, Human
ggcugggggguggggggcugg

SEQ ID NO: 518452 - RNA, 25 nt, Human
ggcugggggguggggggcuggcugc

SEQ ID NO: 518453 - RNA, 21 nt, Human
gggggcuggcugcgggcuggg

SEQ ID NO: 518454 - RNA, 18 nt, Human
ggggguggggggcuggcu

SEQ ID NO: 518455 - RNA, 19 nt, Human
gggugguggccacugggga

SEQ ID NO: 518456 - RNA, 20 nt, Human
gucacuguggguccugagag

SEQ ID NO: 518457 - RNA, 19 nt, Human
gucagccgcuccccacaag

SEQ ID NO: 518458 - RNA, 20 nt, Human
uaacacauacagagccacag

SEQ ID NO: 518459 - RNA, 18 nt, Human
uaccauaggcuuccacaa

SEQ ID NO: 518460 - RNA, 25 nt, Human
ucagcccugccucccagccuccuca

SEQ ID NO: 518461 - RNA, 20 nt, Human
uccugcccaaagcugagggu

SEQ ID NO: 518462 - RNA, 24 nt, Human
ucggaagccucauaggagccuagg

SEQ ID NO: 518463 - RNA, 23 nt, Human
ucggccaccucucagcccugccu

SEQ ID NO: 518464 - RNA, 18 nt, Human
ucucucucggccaccucu

SEQ ID NO: 518465 - RNA, 24 nt, Human
ucuggcggcucugcgacuccucuc

SEQ ID NO: 518466 - RNA, 21 nt, Human
ugagggugguggccacugggg

SEQ ID NO: 518467 - RNA, 25 nt, Human
ugcacagaaagaaagagggggugug

SEQ ID NO: 518468 - RNA, 21 nt, Human
ugcccaaagcugaggguggug

SEQ ID NO: 518469 - RNA, 19 nt, Human
uggcggcucugcgacuccu

SEQ ID NO: 518470 - RNA, 18 nt, Human
ugggggguggggggcugg

SEQ ID NO: 518471 - RNA, 23 nt, Human
ugggggguggggggcuggcugcg

SEQ ID NO: 518472 - RNA, 21 nt, Human
uggguaacacauacagagcca

SEQ ID NO: 518473 - RNA, 21 nt, Human
uguuccaggacccucuugcuu

SEQ ID NO: 518474 - RNA, 21 nt, Human
aaacagcucaaccccacaggc

SEQ ID NO: 518475 - RNA, 18 nt, Human
aaagugcugggauuacaa

SEQ ID NO: 518476 - RNA, 24 nt, Human
aaagugcugggauuacaagcguga

SEQ ID NO: 518477 - RNA, 24 nt, Human
aaagugcugggauuacaggcauga

SEQ ID NO: 518478 - RNA, 21 nt, Human
aagcaauucuccugccucagc

SEQ ID NO: 518479 - RNA, 21 nt, Human
aagcucaugguccaggagccu

SEQ ID NO: 518480 - RNA, 24 nt, Human
aagugaucugccugccuuggccuc

SEQ ID NO: 518481 - RNA, 19 nt, Human
aagugcugggauuacaagc

SEQ ID NO: 518482 - RNA, 19 nt, Human
aagugcugggauuacaagc

SEQ ID NO: 518483 - RNA, 26 nt, Human
aagugcugggauuacaagcgugagcc

SEQ ID NO: 518484 - RNA, 19 nt, Human
aagugcugggauuacaggc

SEQ ID NO: 518485 - RNA, 21 nt, Human
aagugcugggauuacaggcau

SEQ ID NO: 518486 - RNA, 26 nt, Human
aagugcugggauuacaggcaugagcc

SEQ ID NO: 518487 - RNA, 21 nt, Human
acaggcaccugcuaccaugcc

SEQ ID NO: 518488 - RNA, 18 nt, Human
acaggguuucaccauguu

SEQ ID NO: 518489 - RNA, 21 nt, Human
acaggguuucaccauguuggc

SEQ ID NO: 518490 - RNA, 24 nt, Human
acaggguuucaccauguuggccag

SEQ ID NO: 518491 - RNA, 23 nt, Human
accaugccuggcuaauuuuugua

SEQ ID NO: 518492 - RNA, 22 nt, Human
accauguuggccaggcuggucu

SEQ ID NO: 518493 - RNA, 18 nt, Human
acgggguuuugccguguu

SEQ ID NO: 518494 - RNA, 24 nt, Human
acgggguuuugccguguuggccag

SEQ ID NO: 518495 - RNA, 21 nt, Human
acucccugcucuaggcucagg

SEQ ID NO: 518496 - RNA, 19 nt, Human
agaagaaaaacguaacuag

SEQ ID NO: 518497 - RNA, 19 nt, Human
agaagggcugaaguccugg

SEQ ID NO: 518498 - RNA, 18 nt, Human
agaagugauaaagcaaca

SEQ ID NO: 518499 - RNA, 18 nt, Human
agacagagucucgcugug

SEQ ID NO: 518500 - RNA, 22 nt, Human
agacagagucucgcugugucuc

SEQ ID NO: 518501 - RNA, 21 nt, Human
agaggaguggaaggccugggg

SEQ ID NO: 518502 - RNA, 21 nt, Human
agccaccacauccggccuaaa

SEQ ID NO: 518503 - RNA, 25 nt, Human
agcuagucagugagagggguccaac

SEQ ID NO: 518504 - RNA, 18 nt, Human
aggaaagugugcaagagc

SEQ ID NO: 518505 - RNA, 25 nt, Human
aggcuggagugcaguggugccaucu

SEQ ID NO: 518506 - RNA, 20 nt, Human
agggagggaagcacauucug

SEQ ID NO: 518507 - RNA, 24 nt, Human
aggugauccacccaccuuggccuc

SEQ ID NO: 518508 - RNA, 20 nt, Human
aguagaaacgggguuuugcc

SEQ ID NO: 518509 - RNA, 18 nt, Human
aguagcugggauuacagg

SEQ ID NO: 518510 - RNA, 18 nt, Human
aguagcugggauuacagg

SEQ ID NO: 518511 - RNA, 21 nt, Human
agugcaguggugccaucucag

SEQ ID NO: 518512 - RNA, 24 nt, Human
agugcugggauuacaagcgugagc

SEQ ID NO: 518513 - RNA, 18 nt, Human
agugcugggauuacaggc

SEQ ID NO: 518514 - RNA, 19 nt, Human
augccugcugacucaacac

SEQ ID NO: 518515 - RNA, 20 nt, Human
augcuccugccucagccucc

SEQ ID NO: 518516 - RNA, 24 nt, Human
auuaugcuccccacuaaauccaaa

SEQ ID NO: 518517 - RNA, 24 nt, Human
auuuuuguauuuuuaguagagaca

SEQ ID NO: 518518 - RNA, 18 nt, Human
caaacagcucaaccccac

SEQ ID NO: 518519 - RNA, 24 nt, Human
caaagugcugggauuacaagcgug

SEQ ID NO: 518520 - RNA, 24 nt, Human
caaagugcugggauuacaggcaug

SEQ ID NO: 518521 - RNA, 22 nt, Human
caagcaaugcuccugccucagc

SEQ ID NO: 518522 - RNA, 22 nt, Human
caagugaucugccugccuuggc

SEQ ID NO: 518523 - RNA, 24 nt, Human
caccacacccagcuaauuuuugua

SEQ ID NO: 518524 - RNA, 22 nt, Human
caccacugcucccggauggagg

SEQ ID NO: 518525 - RNA, 21 nt, Human
caccauguuggccaggcuggu

SEQ ID NO: 518526 - RNA, 23 nt, Human
caccauguuggccaggcuggucu

SEQ ID NO: 518527 - RNA, 24 nt, Human
caccauguuggccaggcuggucuu

SEQ ID NO: 518528 - RNA, 27 nt, Human
caccauguuggccaggcuggucuugaa

SEQ ID NO: 518529 - RNA, 22 nt, Human
cacccaccuuggccucccaaag

SEQ ID NO: 518530 - RNA, 23 nt, Human
cacccaccuuggccucccaaagu

SEQ ID NO: 518531 - RNA, 22 nt, Human
caccccaagugaccucccucac

SEQ ID NO: 518532 - RNA, 22 nt, Human
caccccaggccaccuguuccac

SEQ ID NO: 518533 - RNA, 23 nt, Human
caccccaggccaccuguuccacc

SEQ ID NO: 518534 - RNA, 19 nt, Human
caccccuaccagacagcua

SEQ ID NO: 518535 - RNA, 22 nt, Human
caccccuaccagacagcuaguc

SEQ ID NO: 518536 - RNA, 18 nt, Human
caccgccaccacugcucc

SEQ ID NO: 518537 - RNA, 18 nt, Human
cacuaaauccaaagaaug

SEQ ID NO: 518538 - RNA, 21 nt, Human
cacugcaaccucugccucccg

SEQ ID NO: 518539 - RNA, 23 nt, Human
cacugcaaccucugccucccggg

SEQ ID NO: 518540 - RNA, 18 nt, Human
cagccccagcagggcuga

SEQ ID NO: 518541 - RNA, 20 nt, Human
cagccuccugaguagcuggg

SEQ ID NO: 518542 - RNA, 20 nt, Human
cagcucaaccccacaggcga

SEQ ID NO: 518543 - RNA, 18 nt, Human
cagcuuuucccuggaagu

SEQ ID NO: 518544 - RNA, 18 nt, Human
caggcugggcugcagggc

SEQ ID NO: 518545 - RNA, 24 nt, Human
caggguuucaccauguuggccagg

SEQ ID NO: 518546 - RNA, 24 nt, Human
caguagcugggauuacaggcaccu

SEQ ID NO: 518547 - RNA, 20 nt, Human
caugccugcugacucaacac

SEQ ID NO: 518548 - RNA, 18 nt, Human
cauggcccaagucaaggc

SEQ ID NO: 518549 - RNA, 24 nt, Human
cauguuggccaggcuggucuugaa

SEQ ID NO: 518550 - RNA, 27 nt, Human
cauuccuguacaugugcgaaccaaggg

SEQ ID NO: 518551 - RNA, 20 nt, Human
ccaaagugcugggauuacaa

SEQ ID NO: 518552 - RNA, 22 nt, Human
ccaaagugcugggauuacaagc

SEQ ID NO: 518553 - RNA, 24 nt, Human
ccaaagugcugggauuacaagcgu

SEQ ID NO: 518554 - RNA, 23 nt, Human
ccaaagugcugggauuacaggca

SEQ ID NO: 518555 - RNA, 24 nt, Human
ccaaagugcugggauuacaggcau

SEQ ID NO: 518556 - RNA, 23 nt, Human
ccaccgccaccacugcucccgga

SEQ ID NO: 518557 - RNA, 22 nt, Human
ccaguagcugggauuacaggca

SEQ ID NO: 518558 - RNA, 24 nt, Human
cccaaagugcugggauuacaggca

SEQ ID NO: 518559 - RNA, 27 nt, Human
cccaagugaccucccucaccugggauc

SEQ ID NO: 518560 - RNA, 22 nt, Human
cccacuguauccuggacaggcu

SEQ ID NO: 518561 - RNA, 21 nt, Human
cccagccccagcagggcugac

SEQ ID NO: 518562 - RNA, 19 nt, Human
cccaggcuggagugcagug

SEQ ID NO: 518563 - RNA, 22 nt, Human
cccaggcuggagugcaguggug

SEQ ID NO: 518564 - RNA, 23 nt, Human
cccaguagcugggauuacaggca

SEQ ID NO: 518565 - RNA, 18 nt, Human
ccccacuguauccuggac

SEQ ID NO: 518566 - RNA, 23 nt, Human
ccccaguagcugggauuacaggc

SEQ ID NO: 518567 - RNA, 18 nt, Human
cccggguucaagcaaugc

SEQ ID NO: 518568 - RNA, 23 nt, Human
cccggguucaagcaaugcuccuc

SEQ ID NO: 518569 - RNA, 23 nt, Human
cccggguucaagcaaugcuccug

SEQ ID NO: 518570 - RNA, 19 nt, Human
ccguguuggccaggcuggu

SEQ ID NO: 518571 - RNA, 22 nt, Human
ccguguuggccaggcuggucuc

SEQ ID NO: 518572 - RNA, 19 nt, Human
ccuaaaaggcacuuuuuuu

SEQ ID NO: 518573 - RNA, 21 nt, Human
ccucuugggucugggcccugg

SEQ ID NO: 518574 - RNA, 21 nt, Human
ccugaccucaagugaucugcc

SEQ ID NO: 518575 - RNA, 23 nt, Human
ccugaccucaagugaucugccug

SEQ ID NO: 518576 - RNA, 24 nt, Human
ccugaccucaggugauccacccac

SEQ ID NO: 518577 - RNA, 23 nt, Human
ccugaguagcugggauuacaggc

SEQ ID NO: 518578 - RNA, 23 nt, Human
ccugaguagcugggauuacaggc

SEQ ID NO: 518579 - RNA, 23 nt, Human
ccugccucagccuccugaguagc

SEQ ID NO: 518580 - RNA, 22 nt, Human
ccugccuuggccucccaaagug

SEQ ID NO: 518581 - RNA, 24 nt, Human
ccugccuuggccucccaaagugcu

SEQ ID NO: 518582 - RNA, 20 nt, Human
ccugcugggccacaccccaa

SEQ ID NO: 518583 - RNA, 20 nt, Human
ccuggagguucaggccagcu

SEQ ID NO: 518584 - RNA, 24 nt, Human
cgcugugucucccaggcuggagug

SEQ ID NO: 518585 - RNA, 24 nt, Human
cgggguuuugccguguuggccagg

SEQ ID NO: 518586 - RNA, 23 nt, Human
cuaauuuuuguauuuuuaguaga

SEQ ID NO: 518587 - RNA, 21 nt, Human
cuaguggucuguucacugccc

SEQ ID NO: 518588 - RNA, 18 nt, Human
cucaaacagcucaacccc

SEQ ID NO: 518589 - RNA, 23 nt, Human
cucaagugaucugccugccuugg

SEQ ID NO: 518590 - RNA, 24 nt, Human
cucacugcaaccucugccucccgg

SEQ ID NO: 518591 - RNA, 24 nt, Human
cucacugcaaccucugccuuccag

SEQ ID NO: 518592 - RNA, 23 nt, Human
cucagccuccugaguagcuggga

SEQ ID NO: 518593 - RNA, 24 nt, Human
cucaggugauccacccaccuuggc

SEQ ID NO: 518594 - RNA, 20 nt, Human
cuccagcaccccaggccacc

SEQ ID NO: 518595 - RNA, 26 nt, Human
cuccugaccucaagugaucugccugc

SEQ ID NO: 518596 - RNA, 18 nt, Human
cucuuguugcccaggcug

SEQ ID NO: 518597 - RNA, 23 nt, Human
cugagccucagugucuucaucug

SEQ ID NO: 518598 - RNA, 22 nt, Human
cugaguagcugggauuacaggc

SEQ ID NO: 518599 - RNA, 19 nt, Human
cugcaaccucugccucccg

SEQ ID NO: 518600 - RNA, 23 nt, Human
cugcaaccucugccucccggguu

SEQ ID NO: 518601 - RNA, 24 nt, Human
cugcaaccucugccucccggguuc

SEQ ID NO: 518602 - RNA, 18 nt, Human
cugcaaccucugccuucc

SEQ ID NO: 518603 - RNA, 23 nt, Human
cugcaaccucugccuuccagauu

SEQ ID NO: 518604 - RNA, 23 nt, Human
cugccucagccuccugaguagcu

SEQ ID NO: 518605 - RNA, 24 nt, Human
cugccucagcuuuccccaguagcu

SEQ ID NO: 518606 - RNA, 18 nt, Human
cugcugggccacacccca

SEQ ID NO: 518607 - RNA, 19 nt, Human
cugcugggccacaccccaa

SEQ ID NO: 518608 - RNA, 21 nt, Human
cugcugggccacaccccaagu

SEQ ID NO: 518609 - RNA, 24 nt, Human
cuggccccacuuugcaccacacau

SEQ ID NO: 518610 - RNA, 22 nt, Human
cugggcccuggccccacuuugc

SEQ ID NO: 518611 - RNA, 23 nt, Human
cugguguggcaaugaucacucuu

SEQ ID NO: 518612 - RNA, 18 nt, Human
cugugaaugcagaaguuc

SEQ ID NO: 518613 - RNA, 25 nt, Human
cuuccuugucucacacccgcgagga

SEQ ID NO: 518614 - RNA, 20 nt, Human
gaagcacauucuguuuaacu

SEQ ID NO: 518615 - RNA, 24 nt, Human
gaccucaagugaucugccugccuu

SEQ ID NO: 518616 - RNA, 23 nt, Human
gaccucaggugauccacccaccu

SEQ ID NO: 518617 - RNA, 20 nt, Human
gagacagagucucgcugugu

SEQ ID NO: 518618 - RNA, 21 nt, Human
gagacggaguuucccucuugu

SEQ ID NO: 518619 - RNA, 18 nt, Human
gagagggggugcauggcc

SEQ ID NO: 518620 - RNA, 21 nt, Human
gagccucagugucuucaucug

SEQ ID NO: 518621 - RNA, 23 nt, Human
gagccucagugucuucaucuggu

SEQ ID NO: 518622 - RNA, 18 nt, Human
gagggaagcacauucugu

SEQ ID NO: 518623 - RNA, 26 nt, Human
gaguagcugggauuacaggcgcacgc

SEQ ID NO: 518624 - RNA, 18 nt, Human
gauuacaagcgugagcca

SEQ ID NO: 518625 - RNA, 24 nt, Human
gauuacaagcgugagccaccaugc

SEQ ID NO: 518626 - RNA, 24 nt, Human
gauuacaggcaccugcuaccaugc

SEQ ID NO: 518627 - RNA, 18 nt, Human
gauuacaggcaugagcca

SEQ ID NO: 518628 - RNA, 21 nt, Human
gauuacaggcaugagccacca

SEQ ID NO: 518629 - RNA, 22 nt, Human
gauuacaggcaugagccaccac

SEQ ID NO: 518630 - RNA, 18 nt, Human
gauuacaggcgcacgcca

SEQ ID NO: 518631 - RNA, 21 nt, Human
gcaaccucugccuuccagauu

SEQ ID NO: 518632 - RNA, 19 nt, Human
gcagagguuacaacacagg

SEQ ID NO: 518633 - RNA, 21 nt, Human
gcaggugccaaacuuccugca

SEQ ID NO: 518634 - RNA, 19 nt, Human
gccacugccuaccucucca

SEQ ID NO: 518635 - RNA, 23 nt, Human
gccccugcacccuguucccagca

SEQ ID NO: 518636 - RNA, 20 nt, Human
gccguguuggccaggcuggu

SEQ ID NO: 518637 - RNA, 25 nt, Human
gccucagcuuuccccaguagcuggg

SEQ ID NO: 518638 - RNA, 20 nt, Human
gccugccugcugggccacac

SEQ ID NO: 518639 - RNA, 22 nt, Human
gccuuggccucccaaagugcug

SEQ ID NO: 518640 - RNA, 20 nt, Human
gcucagccccacuguauccu

SEQ ID NO: 518641 - RNA, 24 nt, Human
gcuccugccucagccuccugagua

SEQ ID NO: 518642 - RNA, 21 nt, Human
gcuggagugcaguggugccag

SEQ ID NO: 518643 - RNA, 23 nt, Human
gcuggucucaaacuccugaccuc

SEQ ID NO: 518644 - RNA, 18 nt, Human
gcuggucuccauggaggc

SEQ ID NO: 518645 - RNA, 23 nt, Human
gcuggucuugaacuccugaccuc

SEQ ID NO: 518646 - RNA, 18 nt, Human
ggagccuucuggugccca

SEQ ID NO: 518647 - RNA, 24 nt, Human
ggauuacaagcgugagccaccaug

SEQ ID NO: 518648 - RNA, 19 nt, Human
ggauuacaggcaugagcca

SEQ ID NO: 518649 - RNA, 21 nt, Human
ggcaggugccaaacuuccugc

SEQ ID NO: 518650 - RNA, 22 nt, Human
ggcaggugccaaacuuccugca

SEQ ID NO: 518651 - RNA, 24 nt, Human
ggcuggucucaaacuccugaccuc

SEQ ID NO: 518652 - RNA, 24 nt, Human
ggcuggucuugaacuccugaccuc

SEQ ID NO: 518653 - RNA, 19 nt, Human
gggaagaagaaucuuccag

SEQ ID NO: 518654 - RNA, 19 nt, Human
ggggcagggucagcaggga

SEQ ID NO: 518655 - RNA, 23 nt, Human
gggguuuugccguguuggccagg

SEQ ID NO: 518656 - RNA, 18 nt, Human
ggguucuacagagaagcc

SEQ ID NO: 518657 - RNA, 22 nt, Human
ggguuucaccauguuggccagg

SEQ ID NO: 518658 - RNA, 19 nt, Human
ggucuugaacuccugaccu

SEQ ID NO: 518659 - RNA, 21 nt, Human
ggucuugaggacgcagagguu

SEQ ID NO: 518660 - RNA, 23 nt, Human
guagaaacgggguuuugccgugu

SEQ ID NO: 518661 - RNA, 18 nt, Human
guagcugggauuacaggc

SEQ ID NO: 518662 - RNA, 24 nt, Human
guccuggcccgcagcagcucgggu

SEQ ID NO: 518663 - RNA, 19 nt, Human
gugaaauaacagaacagga

SEQ ID NO: 518664 - RNA, 24 nt, Human
gugauccacccaccuuggccuccc

SEQ ID NO: 518665 - RNA, 18 nt, Human
guuacaacacaggcuggg

SEQ ID NO: 518666 - RNA, 24 nt, Human
uaauuuuuguauuuuuaguagaga

SEQ ID NO: 518667 - RNA, 24 nt, Human
uacaagcgugagccaccaugccca

SEQ ID NO: 518668 - RNA, 22 nt, Human
uacaggcaccugcuaccaugcc

SEQ ID NO: 518669 - RNA, 23 nt, Human
uacaggcaugagccaccacaucc

SEQ ID NO: 518670 - RNA, 24 nt, Human
uacaggcgcacgccaccacaccca

SEQ ID NO: 518671 - RNA, 22 nt, Human
uagagacaggguuucaccaugu

SEQ ID NO: 518672 - RNA, 23 nt, Human
uagccacugccuaccucuccagg

SEQ ID NO: 518673 - RNA, 19 nt, Human
uaguagaaacgggguuuug

SEQ ID NO: 518674 - RNA, 21 nt, Human
uaguagaaacgggguuuugcc

SEQ ID NO: 518675 - RNA, 24 nt, Human
uaguagaaacgggguuuugccgug

SEQ ID NO: 518676 - RNA, 24 nt, Human
uaguagagacaggguuucaccaug

SEQ ID NO: 518677 - RNA, 26 nt, Human
uaguagagacaggguuucaccauguu

SEQ ID NO: 518678 - RNA, 19 nt, Human
uauccuggacaggcugggc

SEQ ID NO: 518679 - RNA, 21 nt, Human
ucaaccucaacauuuucaaaa

SEQ ID NO: 518680 - RNA, 18 nt, Human
ucacugcaaccucugccu

SEQ ID NO: 518681 - RNA, 24 nt, Human
ucacugcaaccucugccucccggg

SEQ ID NO: 518682 - RNA, 25 nt, Human
ucacugcaaccucugccucccgggu

SEQ ID NO: 518683 - RNA, 19 nt, Human
ucacugcaaccucugccuu

SEQ ID NO: 518684 - RNA, 23 nt, Human
ucacugcaaccucugccuuccag

SEQ ID NO: 518685 - RNA, 24 nt, Human
ucacugcaaccucugccuuccaga

SEQ ID NO: 518686 - RNA, 20 nt, Human
ucagccuccugaguagcugg

SEQ ID NO: 518687 - RNA, 22 nt, Human
ucagggaagggccccagccggg

SEQ ID NO: 518688 - RNA, 22 nt, Human
uccaaagaauguugguucccau

SEQ ID NO: 518689 - RNA, 20 nt, Human
uccaccgccaccacugcucc

SEQ ID NO: 518690 - RNA, 23 nt, Human
uccaccgccaccacugcucccgg

SEQ ID NO: 518691 - RNA, 18 nt, Human
ucccaaagugcugggauu

SEQ ID NO: 518692 - RNA, 24 nt, Human
ucccaaagugcugggauuacaagc

SEQ ID NO: 518693 - RNA, 24 nt, Human
ucccaaagugcugggauuacaggc

SEQ ID NO: 518694 - RNA, 18 nt, Human
ucccagccccagcagggc

SEQ ID NO: 518695 - RNA, 22 nt, Human
ucccaggcuggagugcaguggu

SEQ ID NO: 518696 - RNA, 23 nt, Human
ucccaggcuggagugcaguggug

SEQ ID NO: 518697 - RNA, 24 nt, Human
uccccaguagcugggauuacaggc

SEQ ID NO: 518698 - RNA, 21 nt, Human
ucccggguucaagcaaugcuc

SEQ ID NO: 518699 - RNA, 24 nt, Human
ucccggguucaagcaaugcuccug

SEQ ID NO: 518700 - RNA, 23 nt, Human
ucccucuuguugcccaggcugga

SEQ ID NO: 518701 - RNA, 19 nt, Human
ucccuggaaguggggcagg

SEQ ID NO: 518702 - RNA, 24 nt, Human
uccugaguagcugggauuacaggc

SEQ ID NO: 518703 - RNA, 25 nt, Human
uccugguguggcaaugaucacucuu

SEQ ID NO: 518704 - RNA, 19 nt, Human
ucgcugugucucccaggcu

SEQ ID NO: 518705 - RNA, 21 nt, Human
ucucaccccaugccugcugac

SEQ ID NO: 518706 - RNA, 24 nt, Human
ucucccaggcuggagugcaguggu

SEQ ID NO: 518707 - RNA, 20 nt, Human
ucuccuucaaagggaagaag

SEQ ID NO: 518708 - RNA, 23 nt, Human
ucucgcugugucucccaggcugg

SEQ ID NO: 518709 - RNA, 24 nt, Human
ucucgcugugucucccaggcugga

SEQ ID NO: 518710 - RNA, 22 nt, Human
ucugccuuccagauugaagcaa

SEQ ID NO: 518711 - RNA, 24 nt, Human
ucugcggccguuuacuaagcguga

SEQ ID NO: 518712 - RNA, 23 nt, Human
ucuugaacuccugaccucaggug

SEQ ID NO: 518713 - RNA, 22 nt, Human
ucuuguugcccaggcuggaaug

SEQ ID NO: 518714 - RNA, 18 nt, Human
ugaaauaacagaacagga

SEQ ID NO: 518715 - RNA, 21 nt, Human
ugaaggaggaacgcuuggccc

SEQ ID NO: 518716 - RNA, 18 nt, Human
ugaccucaagugaucugc

SEQ ID NO: 518717 - RNA, 24 nt, Human
ugaccucaagugaucugccugccu

SEQ ID NO: 518718 - RNA, 21 nt, Human
ugaccucaggugauccaccca

SEQ ID NO: 518719 - RNA, 24 nt, Human
ugaccucaggugauccacccaccu

SEQ ID NO: 518720 - RNA, 20 nt, Human
ugacucaacacagcacccgg

SEQ ID NO: 518721 - RNA, 21 nt, Human
ugaggucauaaccagaggacu

SEQ ID NO: 518722 - RNA, 24 nt, Human
ugauccacccaccuuggccuccca

SEQ ID NO: 518723 - RNA, 22 nt, Human
ugcaguggugccaucucagcuc

SEQ ID NO: 518724 - RNA, 21 nt, Human
ugcccagccucuaaaaggcac

SEQ ID NO: 518725 - RNA, 21 nt, Human
ugcccaggcuggaaugcaaug

SEQ ID NO: 518726 - RNA, 19 nt, Human
ugccccaacugggucccau

SEQ ID NO: 518727 - RNA, 24 nt, Human
ugccucagccuccugaguagcugg

SEQ ID NO: 518728 - RNA, 22 nt, Human
ugccucagcuuuccccaguagc

SEQ ID NO: 518729 - RNA, 25 nt, Human
ugccucagcuuuccccaguagcugg

SEQ ID NO: 518730 - RNA, 18 nt, Human
ugccugccuuggccuccc

SEQ ID NO: 518731 - RNA, 26 nt, Human
ugcugggauuacaagcgugagccacc

SEQ ID NO: 518732 - RNA, 23 nt, Human
ugcugggccacaccccaagugac

SEQ ID NO: 518733 - RNA, 22 nt, Human
uggaggcucagaaggaaagugu

SEQ ID NO: 518734 - RNA, 18 nt, Human
uggagugcaguggugcca

SEQ ID NO: 518735 - RNA, 28 nt, Human
uggagugcaguggugccauccuagcacg

SEQ ID NO: 518736 - RNA, 23 nt, Human
uggagugcaguggugccaucuca

SEQ ID NO: 518737 - RNA, 28 nt, Human
uggagugcaguggugccauggcucuagc

SEQ ID NO: 518738 - RNA, 24 nt, Human
uggccaggcuggucucaaacuccu

SEQ ID NO: 518739 - RNA, 24 nt, Human
uggccaggcuggucuugaacuccu

SEQ ID NO: 518740 - RNA, 21 nt, Human
uggccccugcacccuguuccc

SEQ ID NO: 518741 - RNA, 18 nt, Human
ugggauuacaagcgugag

SEQ ID NO: 518742 - RNA, 22 nt, Human
ugggauuacaagcgugagccac

SEQ ID NO: 518743 - RNA, 23 nt, Human
ugggauuacaagcgugagccacc

SEQ ID NO: 518744 - RNA, 24 nt, Human
ugggauuacaagcgugagccacca

SEQ ID NO: 518745 - RNA, 25 nt, Human
ugggauuacaagcgugagccaccau

SEQ ID NO: 518746 - RNA, 22 nt, Human
ugggauuacaggcaccugcuac

SEQ ID NO: 518747 - RNA, 24 nt, Human
ugggauuacaggcaccugcuacca

SEQ ID NO: 518748 - RNA, 25 nt, Human
ugggauuacaggcaccugcuaccau

SEQ ID NO: 518749 - RNA, 18 nt, Human
ugggauuacaggcaugag

SEQ ID NO: 518750 - RNA, 19 nt, Human
ugggauuacaggcaugagc

SEQ ID NO: 518751 - RNA, 22 nt, Human
ugggauuacaggcaugagccac

SEQ ID NO: 518752 - RNA, 23 nt, Human
ugggauuacaggcaugagccacc

SEQ ID NO: 518753 - RNA, 24 nt, Human
ugggauuacaggcaugagccacca

SEQ ID NO: 518754 - RNA, 24 nt, Human
ugggauuacaggcaugagccacca

SEQ ID NO: 518755 - RNA, 22 nt, Human
ugggauuacaggcgcacgccac

SEQ ID NO: 518756 - RNA, 24 nt, Human
ugggauuacaggcgcacgccacca

SEQ ID NO: 518757 - RNA, 20 nt, Human
ugggcugcagggcccaagua

SEQ ID NO: 518758 - RNA, 19 nt, Human
uggugcaaucucacugcaa

SEQ ID NO: 518759 - RNA, 24 nt, Human
uggugccaucucagcucacugcaa

SEQ ID NO: 518760 - RNA, 21 nt, Human
uguauuuuuaguagaaacggg

SEQ ID NO: 518761 - RNA, 21 nt, Human
ugucucccaggcuggagugca

SEQ ID NO: 518762 - RNA, 23 nt, Human
ugucugcggaccacccucuccuc

SEQ ID NO: 518763 - RNA, 19 nt, Human
uuacaggcaccugcuacca

SEQ ID NO: 518764 - RNA, 22 nt, Human
uuaguagaaacgggguuuugcc

SEQ ID NO: 518765 - RNA, 24 nt, Human
uuaguagaaacgggguuuugccgu

SEQ ID NO: 518766 - RNA, 24 nt, Human
uuaguagagacaggguuucaccau

SEQ ID NO: 518767 - RNA, 21 nt, Human
uucaagcaaugcuccugccuc

SEQ ID NO: 518768 - RNA, 19 nt, Human
uucacugcccagcgggcac

SEQ ID NO: 518769 - RNA, 22 nt, Human
uuccaccgccaccacugcuccc

SEQ ID NO: 518770 - RNA, 26 nt, Human
uuccaccgccaccacugcucccggau

SEQ ID NO: 518771 - RNA, 24 nt, Human
uuccagauugaagcaauucuccug

SEQ ID NO: 518772 - RNA, 24 nt, Human
uucccucuuguugcccaggcugga

SEQ ID NO: 518773 - RNA, 24 nt, Human
uucccuggaaguggggcaggguca

SEQ ID NO: 518774 - RNA, 18 nt, Human
uugcccaggcuggaaugc

SEQ ID NO: 518775 - RNA, 19 nt, Human
uugccguguuggccaggcu

SEQ ID NO: 518776 - RNA, 24 nt, Human
uugccguguuggccaggcuggucu

SEQ ID NO: 518777 - RNA, 18 nt, Human
uuggccucccaaagugcu

SEQ ID NO: 518778 - RNA, 18 nt, Human
uuggccucccaaagugcu

SEQ ID NO: 518779 - RNA, 23 nt, Human
uuguugcccaggcuggaaugcaa

SEQ ID NO: 518780 - RNA, 24 nt, Human
uuucaccauguuggccaggcuggu

SEQ ID NO: 518781 - RNA, 24 nt, Human
uuucccucuuguugcccaggcugg

SEQ ID NO: 518782 - RNA, 20 nt, Human
uuugguuauaacaauugugg

SEQ ID NO: 518783 - RNA, 22 nt, Human
uuuguccucaaacagcucaacc

SEQ ID NO: 518784 - RNA, 24 nt, Human
uuuuuaguagaaacgggguuuugc

SEQ ID NO: 518785 - RNA, 24 nt, Human
uuuuuaguagagacaggguuucac

SEQ ID NO: 518786 - RNA, 18 nt, Human
uuuuuguauuuuuaguag

SEQ ID NO: 518787 - RNA, 20 nt, Human
uuuuuguauuuuuaguagag

SEQ ID NO: 518788 - RNA, 19 nt, Human
aaacaaaacaaaacagcaa

SEQ ID NO: 518789 - RNA, 27 nt, Human
aaacaaaacagcaaauagaagggaccc

SEQ ID NO: 518790 - RNA, 19 nt, Human
aaccuggaggaguagggcu

SEQ ID NO: 518791 - RNA, 19 nt, Human
aagcuuccaugauccaagu

SEQ ID NO: 518792 - RNA, 20 nt, Human
aauguacagagacuuuuuuu

SEQ ID NO: 518793 - RNA, 19 nt, Human
acaaaacagcaaauagaag

SEQ ID NO: 518794 - RNA, 20 nt, Human
acaaaacagcaaauagaagu

SEQ ID NO: 518795 - RNA, 21 nt, Human
acagccuuuaggaaaaagggg

SEQ ID NO: 518796 - RNA, 21 nt, Human
acccaguaaaaccugauggac

SEQ ID NO: 518797 - RNA, 24 nt, Human
acuuucuccuuuaaaaucucuuuu

SEQ ID NO: 518798 - RNA, 24 nt, Human
agcuguuuguuugaagacaucaga

SEQ ID NO: 518799 - RNA, 18 nt, Human
aggagacuuugaaaguag

SEQ ID NO: 518800 - RNA, 18 nt, Human
aggagguccuaacgggga

SEQ ID NO: 518801 - RNA, 23 nt, Human
aggaugaaaagggggaagucagg

SEQ ID NO: 518802 - RNA, 24 nt, Human
auaaaaaaacaaaacaaaacagca

SEQ ID NO: 518803 - RNA, 24 nt, Human
caaaacaaaacagcaaauagaagu

SEQ ID NO: 518804 - RNA, 19 nt, Human
caaccuggaggaguagggc

SEQ ID NO: 518805 - RNA, 21 nt, Human
caacucaacuuccagaagaca

SEQ ID NO: 518806 - RNA, 21 nt, Human
caacuggaccccuucgggguu

SEQ ID NO: 518807 - RNA, 20 nt, Human
caagagaaggggacaaacag

SEQ ID NO: 518808 - RNA, 20 nt, Human
cacacacgcucuaguagagc

SEQ ID NO: 518809 - RNA, 22 nt, Human
cacacauaaaaaaacaaaacaa

SEQ ID NO: 518810 - RNA, 21 nt, Human
cacuuugugcucagcaaauuu

SEQ ID NO: 518811 - RNA, 25 nt, Human
cagaagacaucuauagcaauagcag

SEQ ID NO: 518812 - RNA, 20 nt, Human
cagcacuaagaaaugucauu

SEQ ID NO: 518813 - RNA, 22 nt, Human
cagcagcgcgguucacgcagag

SEQ ID NO: 518814 - RNA, 19 nt, Human
cagcagggaacugggccuc

SEQ ID NO: 518815 - RNA, 20 nt, Human
cagcaucaaaaauguauaca

SEQ ID NO: 518816 - RNA, 18 nt, Human
caggaucaggaugaaaag

SEQ ID NO: 518817 - RNA, 20 nt, Human
caggguaugagcccagauuu

SEQ ID NO: 518818 - RNA, 19 nt, Human
caucuggggauuuucucac

SEQ ID NO: 518819 - RNA, 22 nt, Human
cauuuugcuacuuccuguuucc

SEQ ID NO: 518820 - RNA, 23 nt, Human
ccagcaguguuuauaugcuuucu

SEQ ID NO: 518821 - RNA, 23 nt, Human
cccaauauauucagucauucaga

SEQ ID NO: 518822 - RNA, 24 nt, Human
ccccaggcagccacgaacuggcuu

SEQ ID NO: 518823 - RNA, 18 nt, Human
ccccuggggacagguccc

SEQ ID NO: 518824 - RNA, 20 nt, Human
ccccuggggacaggucccag

SEQ ID NO: 518825 - RNA, 24 nt, Human
ccuacaagcuuccaugauccaagu

SEQ ID NO: 518826 - RNA, 23 nt, Human
ccugacccagcccccuuuccagc

SEQ ID NO: 518827 - RNA, 20 nt, Human
cucugcuucagcugaucaga

SEQ ID NO: 518828 - RNA, 24 nt, Human
cuuccuguuucccaagagucucug

SEQ ID NO: 518829 - RNA, 18 nt, Human
gaaaaaggggaggagggu

SEQ ID NO: 518830 - RNA, 20 nt, Human
gaaugagggugggucacagg

SEQ ID NO: 518831 - RNA, 21 nt, Human
gaauguacagagacuuuuuuu

SEQ ID NO: 518832 - RNA, 18 nt, Human
gacuuguugcugcucuuc

SEQ ID NO: 518833 - RNA, 20 nt, Human
gagcagcagcgcgguucacg

SEQ ID NO: 518834 - RNA, 18 nt, Human
gagccugggcaggguggg

SEQ ID NO: 518835 - RNA, 19 nt, Human
gagcugguugcagcaggga

SEQ ID NO: 518836 - RNA, 18 nt, Human
gagguccuaacggggagg

SEQ ID NO: 518837 - RNA, 18 nt, Human
gcauuuugcuacuuccug

SEQ ID NO: 518838 - RNA, 19 nt, Human
gcuugcuccguucagauuu

SEQ ID NO: 518839 - RNA, 24 nt, Human
ggaauuucccccuuuugaccacac

SEQ ID NO: 518840 - RNA, 18 nt, Human
ggacaaacagccuuuagg

SEQ ID NO: 518841 - RNA, 21 nt, Human
ggacuacaugaaggaugaggc

SEQ ID NO: 518842 - RNA, 21 nt, Human
ggcagggugggugucaagugg

SEQ ID NO: 518843 - RNA, 20 nt, Human
guaaaaccugauggacuugu

SEQ ID NO: 518844 - RNA, 21 nt, Human
guggcucuggcaacuggaccc

SEQ ID NO: 518845 - RNA, 23 nt, Human
uaaaaaaggcacacacgcucuag

SEQ ID NO: 518846 - RNA, 22 nt, Human
uaaagaaaucauuacuccuuuu

SEQ ID NO: 518847 - RNA, 23 nt, Human
uaaugggucuuaauuagccaaca

SEQ ID NO: 518848 - RNA, 18 nt, Human
uacagugauguaguggga

SEQ ID NO: 518849 - RNA, 22 nt, Human
uagaauaaauauagaauaggug

SEQ ID NO: 518850 - RNA, 18 nt, Human
uagaauaucuauccucua

SEQ ID NO: 518851 - RNA, 22 nt, Human
uagauuaaaacccaguaaaacc

SEQ ID NO: 518852 - RNA, 19 nt, Human
uagcaauagcagcaucaaa

SEQ ID NO: 518853 - RNA, 23 nt, Human
uagcagcagcucguuucaagagg

SEQ ID NO: 518854 - RNA, 21 nt, Human
uaggcugucaugauggagucu

SEQ ID NO: 518855 - RNA, 23 nt, Human
uaggggccaaaauuccugcuauu

SEQ ID NO: 518856 - RNA, 25 nt, Human
uauagcaagugacugugagggacac

SEQ ID NO: 518857 - RNA, 22 nt, Human
uauagcaauagcagcaucaaaa

SEQ ID NO: 518858 - RNA, 22 nt, Human
uauuuugcguaaguguacagua

SEQ ID NO: 518859 - RNA, 20 nt, Human
ucaagagaaggggacaaaca

SEQ ID NO: 518860 - RNA, 18 nt, Human
ucagucauucagaaucug

SEQ ID NO: 518861 - RNA, 21 nt, Human
uccacauagugaaagacaaau

SEQ ID NO: 518862 - RNA, 20 nt, Human
ucccagaagaaaaauggaaa

SEQ ID NO: 518863 - RNA, 24 nt, Human
ucccuaggggccaaaauuccugcu

SEQ ID NO: 518864 - RNA, 23 nt, Human
ucuauagcaauagcagcaucaaa

SEQ ID NO: 518865 - RNA, 24 nt, Human
ucucuuaaacagcaguuuuccguu

SEQ ID NO: 518866 - RNA, 21 nt, Human
ucugaggcaguauccagggcu

SEQ ID NO: 518867 - RNA, 18 nt, Human
ucugggacuucgccaaug

SEQ ID NO: 518868 - RNA, 18 nt, Human
ucuucaaggugggacuga

SEQ ID NO: 518869 - RNA, 20 nt, Human
ugacccagcccccuuuccag

SEQ ID NO: 518870 - RNA, 24 nt, Human
ugacccagcccccuuuccagcagg

SEQ ID NO: 518871 - RNA, 18 nt, Human
ugcccggagacuuguugc

SEQ ID NO: 518872 - RNA, 20 nt, Human
uggauuccuaaagccuaugc

SEQ ID NO: 518873 - RNA, 22 nt, Human
ugggaauggaaaugauucacgg

SEQ ID NO: 518874 - RNA, 26 nt, Human
ugggcagggugggugucaaguggcuc

SEQ ID NO: 518875 - RNA, 21 nt, Human
ugguugcagcagggaacuggg

SEQ ID NO: 518876 - RNA, 24 nt, Human
ugucuagaauuuucaaguguagga

SEQ ID NO: 518877 - RNA, 21 nt, Human
uucaagaggcuggguguugcg

SEQ ID NO: 518878 - RNA, 24 nt, Human
uucacgcagagagcaccccaggca

SEQ ID NO: 518879 - RNA, 23 nt, Human
uuccauuaguuaucccaacacaa

SEQ ID NO: 518880 - RNA, 23 nt, Human
uuccugagggacuguuuuugagc

SEQ ID NO: 518881 - RNA, 22 nt, Human
uuccuguuucccaagagucucu

SEQ ID NO: 518882 - RNA, 23 nt, Human
uugauuguuggaagcugucauua

SEQ ID NO: 518883 - RNA, 18 nt, Human
uugcuccguucagauuuc

SEQ ID NO: 518884 - RNA, 25 nt, Human
uuggacuacaugaaggaugaggccg

SEQ ID NO: 518885 - RNA, 20 nt, Human
uuuaggaaaaaggggaggag

SEQ ID NO: 518886 - RNA, 23 nt, Human
uuugugcucagcaaauuugacag

SEQ ID NO: 518887 - RNA, 23 nt, Human
uuuguggggaggauuccucccug

SEQ ID NO: 518888 - RNA, 19 nt, Human
uuuguuggacuacaugaag

SEQ ID NO: 518889 - RNA, 26 nt, Human
uuuuaauagaauuuuaaacccagagu

SEQ ID NO: 518890 - RNA, 24 nt, Human
aaaaggcaacaaauauuuaaaaaa

SEQ ID NO: 518891 - RNA, 19 nt, Human
aaauacuugaauacuucuc

SEQ ID NO: 518892 - RNA, 21 nt, Human
aacacaaaagaagaaaacaaa

SEQ ID NO: 518893 - RNA, 18 nt, Human
aagaagaaaacaaagagu

SEQ ID NO: 518894 - RNA, 24 nt, Human
aauguaucaaaacauaauagagaa

SEQ ID NO: 518895 - RNA, 19 nt, Human
acaaaagaagaaaacaaag

SEQ ID NO: 518896 - RNA, 25 nt, Human
acauuaaaguauuuuugaaaaggaa

SEQ ID NO: 518897 - RNA, 21 nt, Human
acuaccauuuacuaaaauguc

SEQ ID NO: 518898 - RNA, 21 nt, Human
agaacacaaaagaagaaaaca

SEQ ID NO: 518899 - RNA, 23 nt, Human
auaaauacuugaauacuucucuu

SEQ ID NO: 518900 - RNA, 18 nt, Human
auaauagagaaccaaaua

SEQ ID NO: 518901 - RNA, 22 nt, Human
auaauagagaaccaaauacauc

SEQ ID NO: 518902 - RNA, 21 nt, Human
caccaugguaacuuacacuca

SEQ ID NO: 518903 - RNA, 19 nt, Human
cacucacuucaggcccagg

SEQ ID NO: 518904 - RNA, 25 nt, Human
cuugaauacuucucuucaugugccu

SEQ ID NO: 518905 - RNA, 20 nt, Human
gaagaaaacaaagaguuuca

SEQ ID NO: 518906 - RNA, 18 nt, Human
uaaaacuaagcugccacc

SEQ ID NO: 518907 - RNA, 19 nt, Human
uaaaacuaagcugccacca

SEQ ID NO: 518908 - RNA, 19 nt, Human
uaagaugggucuucuuuca

SEQ ID NO: 518909 - RNA, 20 nt, Human
uaauauaucaaguagcaagg

SEQ ID NO: 518910 - RNA, 18 nt, Human
uaauuuaacucacuacca

SEQ ID NO: 518911 - RNA, 18 nt, Human
uagaacacaaaagaagaa

SEQ ID NO: 518912 - RNA, 21 nt, Human
uagaacacaaaagaagaaaac

SEQ ID NO: 518913 - RNA, 24 nt, Human
uaguaaaacuaagcugccaccaug

SEQ ID NO: 518914 - RNA, 22 nt, Human
uauuggauaaacuuugaaaagc

SEQ ID NO: 518915 - RNA, 23 nt, Human
ucaaagauuuuaaauauauuuuu

SEQ ID NO: 518916 - RNA, 23 nt, Human
ucugcuugcugaaaguacuuggg

SEQ ID NO: 518917 - RNA, 21 nt, Human
uuagaacacaaaagaagaaaa

SEQ ID NO: 518918 - RNA, 20 nt, Human
uugcuugguuuugaagugau

SEQ ID NO: 518919 - RNA, 23 nt, Human
uuuuaugggcacauauauuuaca

SEQ ID NO: 518920 - RNA, 19 nt, Human
uuuuuuuuuuuuucacuuu

SEQ ID NO: 518921 - RNA, 23 nt, Human
uuuuuuuuuuuuuuuuucacuuu

SEQ ID NO: 518922 - RNA, 25 nt, Human
uuuuuuuuuuuuuuuuucacuuuaa

SEQ ID NO: 518923 - RNA, 26 nt, Human
uuuuuuuuuuuuuuuuucacuuuaau

SEQ ID NO: 518924 - RNA, 20 nt, Human
aaagcagagacaaucaaaga

SEQ ID NO: 518925 - RNA, 20 nt, Human
acaaucaaagaaaagcugga

SEQ ID NO: 518926 - RNA, 25 nt, Human
agacaaucaaagaaaagcuggagaa

SEQ ID NO: 518927 - RNA, 20 nt, Human
agugauggaaagcagcagaa

SEQ ID NO: 518928 - RNA, 20 nt, Human
cagcuuccugauccucaucu

SEQ ID NO: 518929 - RNA, 18 nt, Human
cccaugaucccucugaac

SEQ ID NO: 518930 - RNA, 25 nt, Human
ccucugaacaccagcuuccugaucc

SEQ ID NO: 518931 - RNA, 20 nt, Human
cgcuugaaaauccaguuuaa

SEQ ID NO: 518932 - RNA, 22 nt, Human
gagacaaucaaagaaaagcugg

SEQ ID NO: 518933 - RNA, 20 nt, Human
ggaaagcagcagaaguaaaa

SEQ ID NO: 518934 - RNA, 24 nt, Human
ucaaagaaaagcuggagaaccucu

SEQ ID NO: 518935 - RNA, 22 nt, Human
uccuauaacagacaaaucgcuu

SEQ ID NO: 518936 - RNA, 20 nt, Human
uggcaaaauagugauggaaa

SEQ ID NO: 518937 - RNA, 21 nt, Human
uuaauggcaaaauagugauuu

SEQ ID NO: 518938 - RNA, 20 nt, Human
uuuuuuuuuuuugcaagagu

SEQ ID NO: 518939 - RNA, 18 nt, Human
uuuuuuuuuuuuuuuuug

SEQ ID NO: 518940 - RNA, 20 nt, Human
aaaaccccaaaaccagcccc

SEQ ID NO: 518941 - RNA, 23 nt, Human
aaaaccccaaaaccagccccugc

SEQ ID NO: 518942 - RNA, 19 nt, Human
aaaccccaaaaccagcccc

SEQ ID NO: 518943 - RNA, 24 nt, Human
aaaccucaggcuccccauaacccc

SEQ ID NO: 518944 - RNA, 23 nt, Human
aacccagccccauuacaccccuu

SEQ ID NO: 518945 - RNA, 21 nt, Human
aagcagcaggggagggggccu

SEQ ID NO: 518946 - RNA, 18 nt, Human
aagcaggaaaaccccaaa

SEQ ID NO: 518947 - RNA, 21 nt, Human
aaggccccuccucuggggagc

SEQ ID NO: 518948 - RNA, 20 nt, Human
aaucucaucucuccacccag

SEQ ID NO: 518949 - RNA, 20 nt, Human
acaagcaggaaaaccccaaa

SEQ ID NO: 518950 - RNA, 26 nt, Human
acccagcacccccagccuggcuccag

SEQ ID NO: 518951 - RNA, 21 nt, Human
accccaaaaccagccccugca

SEQ ID NO: 518952 - RNA, 24 nt, Human
accccagacccucagggagggccc

SEQ ID NO: 518953 - RNA, 24 nt, Human
accccaugaggcacccccuaaauc

SEQ ID NO: 518954 - RNA, 23 nt, Human
acccccagccuggcuccagccug

SEQ ID NO: 518955 - RNA, 25 nt, Human
acccccuccuuccccuucccuccag

SEQ ID NO: 518956 - RNA, 21 nt, Human
accccuaacugcggaaggagc

SEQ ID NO: 518957 - RNA, 19 nt, Human
accugcacguucugggccu

SEQ ID NO: 518958 - RNA, 18 nt, Human
acggccugugccaugugg

SEQ ID NO: 518959 - RNA, 21 nt, Human
acucacucccagcauccccca

SEQ ID NO: 518960 - RNA, 18 nt, Human
acucaggacacuuccccu

SEQ ID NO: 518961 - RNA, 18 nt, Human
agaccugugggccaggcg

SEQ ID NO: 518962 - RNA, 22 nt, Human
agcaggggagggggccuggggg

SEQ ID NO: 518963 - RNA, 23 nt, Human
agccccccagcaguguccagccc

SEQ ID NO: 518964 - RNA, 23 nt, Human
aggaacaagaagcugaggaggga

SEQ ID NO: 518965 - RNA, 23 nt, Human
aggaaggauggcagcacccauga

SEQ ID NO: 518966 - RNA, 21 nt, Human
aggccaaagccugaccccaga

SEQ ID NO: 518967 - RNA, 19 nt, Human
aggccacagaaggacagga

SEQ ID NO: 518968 - RNA, 23 nt, Human
aggcuggggccgggagaagggga

SEQ ID NO: 518969 - RNA, 19 nt, Human
agggaagagaugcgccaga

SEQ ID NO: 518970 - RNA, 21 nt, Human
agggaagagaugcgccagaga

SEQ ID NO: 518971 - RNA, 18 nt, Human
agggccaggagggcagca

SEQ ID NO: 518972 - RNA, 18 nt, Human
aggggagggggccugggg

SEQ ID NO: 518973 - RNA, 23 nt, Human
aggggagggggccuggggguccu

SEQ ID NO: 518974 - RNA, 19 nt, Human
auccaaagaagggacugga

SEQ ID NO: 518975 - RNA, 19 nt, Human
aucucacucacucacuccc

SEQ ID NO: 518976 - RNA, 18 nt, Human
aucucaucucuccaccca

SEQ ID NO: 518977 - RNA, 28 nt, Human
aucucaucucuccacccagcacccccag

SEQ ID NO: 518978 - RNA, 22 nt, Human
caagcaggaaaaccccaaaacc

SEQ ID NO: 518979 - RNA, 22 nt, Human
cacaagcaggaaaaccccaaaa

SEQ ID NO: 518980 - RNA, 24 nt, Human
cacaagcaggaaaaccccaaaacc

SEQ ID NO: 518981 - RNA, 24 nt, Human
cacaaggacauccaaagaagggac

SEQ ID NO: 518982 - RNA, 20 nt, Human
cacagaccagggugcccucc

SEQ ID NO: 518983 - RNA, 20 nt, Human
cacagcccugccccgccucc

SEQ ID NO: 518984 - RNA, 20 nt, Human
cacccagcacccccagccug

SEQ ID NO: 518985 - RNA, 23 nt, Human
cacccccagccuggcuccagccu

SEQ ID NO: 518986 - RNA, 19 nt, Human
cacccccuaaaucucaucu

SEQ ID NO: 518987 - RNA, 24 nt, Human
cacccccuaaaucucaucucucca

SEQ ID NO: 518988 - RNA, 21 nt, Human
caccucccucucuccaggaag

SEQ ID NO: 518989 - RNA, 19 nt, Human
cacggaggaugcagggcug

SEQ ID NO: 518990 - RNA, 23 nt, Human
cagaacaguggggaaagcgaggc

SEQ ID NO: 518991 - RNA, 24 nt, Human
cagaacccagccccauuacacccc

SEQ ID NO: 518992 - RNA, 19 nt, Human
cagagaccagggcugcggc

SEQ ID NO: 518993 - RNA, 18 nt, Human
cagagcugagccugccug

SEQ ID NO: 518994 - RNA, 28 nt, Human
cagaggccaaagccugaccccagacccu

SEQ ID NO: 518995 - RNA, 18 nt, Human
cagccccccagcaguguc

SEQ ID NO: 518996 - RNA, 21 nt, Human
caggaagggaggggcuuucca

SEQ ID NO: 518997 - RNA, 21 nt, Human
caggagggcagcagugcuccc

SEQ ID NO: 518998 - RNA, 23 nt, Human
caggagggcagcagugcucccuc

SEQ ID NO: 518999 - RNA, 19 nt, Human
caggcgccaccacacgucc

SEQ ID NO: 519000 - RNA, 19 nt, Human
caggcuccccauaacccuc

SEQ ID NO: 519001 - RNA, 23 nt, Human
cauuucaccccaggccugcccac

SEQ ID NO: 519002 - RNA, 25 nt, Human
ccacaaggcacagaccagggugcca

SEQ ID NO: 519003 - RNA, 21 nt, Human
ccagaacaguggggaaagcga

SEQ ID NO: 519004 - RNA, 21 nt, Human
ccaggcccagagugacucaca

SEQ ID NO: 519005 - RNA, 22 nt, Human
cccacugggcucacaccagcuu

SEQ ID NO: 519006 - RNA, 23 nt, Human
cccauaaaaccucaggcucccca

SEQ ID NO: 519007 - RNA, 18 nt, Human
cccaugaggcacccccua

SEQ ID NO: 519008 - RNA, 19 nt, Human
ccccaaaaccagccccugc

SEQ ID NO: 519009 - RNA, 20 nt, Human
ccccaaaaccagccccugca

SEQ ID NO: 519010 - RNA, 18 nt, Human
ccccagacccucagggag

SEQ ID NO: 519011 - RNA, 20 nt, Human
ccccagcaguguccagcccu

SEQ ID NO: 519012 - RNA, 24 nt, Human
ccccaggcaaccacugaggaccuc

SEQ ID NO: 519013 - RNA, 21 nt, Human
ccccauaacccucacucagcc

SEQ ID NO: 519014 - RNA, 19 nt, Human
ccccccagcaguguccagc

SEQ ID NO: 519015 - RNA, 21 nt, Human
cccccgcucccgccgcucccc

SEQ ID NO: 519016 - RNA, 23 nt, Human
cccccuccuuccccuucccucca

SEQ ID NO: 519017 - RNA, 21 nt, Human
ccccuaaaucucaucucucca

SEQ ID NO: 519018 - RNA, 23 nt, Human
cccggcccgcccugcuucccccg

SEQ ID NO: 519019 - RNA, 18 nt, Human
cccugagugccaggcgcc

SEQ ID NO: 519020 - RNA, 18 nt, Human
cccugcuucccccgcucc

SEQ ID NO: 519021 - RNA, 18 nt, Human
ccgacgccgccgcuguug

SEQ ID NO: 519022 - RNA, 19 nt, Human
ccgacgccgccgcuguugc

SEQ ID NO: 519023 - RNA, 21 nt, Human
ccgacgccgccgcuguugccc

SEQ ID NO: 519024 - RNA, 19 nt, Human
ccgccgcccggcugcggcu

SEQ ID NO: 519025 - RNA, 18 nt, Human
ccgccgcucccgccgccc

SEQ ID NO: 519026 - RNA, 19 nt, Human
ccgccgcuguugcccgcgc

SEQ ID NO: 519027 - RNA, 19 nt, Human
ccgcuggcgccauggagcc

SEQ ID NO: 519028 - RNA, 19 nt, Human
ccgcuguugcccgcgcugc

SEQ ID NO: 519029 - RNA, 21 nt, Human
ccggccgccuuggcccccucc

SEQ ID NO: 519030 - RNA, 20 nt, Human
ccgggagaaggggauacaca

SEQ ID NO: 519031 - RNA, 19 nt, Human
ccuaaaucucaucucucca

SEQ ID NO: 519032 - RNA, 25 nt, Human
ccucaggagccccguccggcucccc

SEQ ID NO: 519033 - RNA, 21 nt, Human
ccucaggcuccccauaacccu

SEQ ID NO: 519034 - RNA, 22 nt, Human
ccucagggagggcccacccaac

SEQ ID NO: 519035 - RNA, 23 nt, Human
ccuccagccggccgccuuggccc

SEQ ID NO: 519036 - RNA, 27 nt, Human
ccugaagacccccuccuuccccuuccc

SEQ ID NO: 519037 - RNA, 22 nt, Human
ccugaccccagacccucaggga

SEQ ID NO: 519038 - RNA, 24 nt, Human
ccugcacguucugggccuuucuca

SEQ ID NO: 519039 - RNA, 19 nt, Human
ccugccccgccuccaccca

SEQ ID NO: 519040 - RNA, 20 nt, Human
ccugccccgccuccacccac

SEQ ID NO: 519041 - RNA, 18 nt, Human
ccuggcccagccagcucc

SEQ ID NO: 519042 - RNA, 20 nt, Human
ccuggggugggggaucccag

SEQ ID NO: 519043 - RNA, 24 nt, Human
cgauccggccgacgccgccgcugu

SEQ ID NO: 519044 - RNA, 22 nt, Human
cgccgcccggcugcggcuuccg

SEQ ID NO: 519045 - RNA, 21 nt, Human
cgccgcuguugcccgcgcugc

SEQ ID NO: 519046 - RNA, 20 nt, Human
cgccuuggcccccucccugc

SEQ ID NO: 519047 - RNA, 23 nt, Human
cgcggcccgauccggccgacgcc

SEQ ID NO: 519048 - RNA, 18 nt, Human
cggaagggaacggccugu

SEQ ID NO: 519049 - RNA, 18 nt, Human
cucacucccagcaucccc

SEQ ID NO: 519050 - RNA, 21 nt, Human
cucacucccagcaucccccag

SEQ ID NO: 519051 - RNA, 25 nt, Human
cucacucccagcaucccccaggaug

SEQ ID NO: 519052 - RNA, 19 nt, Human
cuccagaacaguggggaaa

SEQ ID NO: 519053 - RNA, 22 nt, Human
cuccagccggccgccuuggccc

SEQ ID NO: 519054 - RNA, 21 nt, Human
cuccccauaacccucacucag

SEQ ID NO: 519055 - RNA, 18 nt, Human
cuccugggugagugggcg

SEQ ID NO: 519056 - RNA, 21 nt, Human
gaacccacugggcucacacca

SEQ ID NO: 519057 - RNA, 22 nt, Human
gaagacagaacccagccccauu

SEQ ID NO: 519058 - RNA, 19 nt, Human
gaagagaugcgccagagac

SEQ ID NO: 519059 - RNA, 22 nt, Human
gagaaaacagggagcaagaaag

SEQ ID NO: 519060 - RNA, 21 nt, Human
gagaggcagcagaggccaaag

SEQ ID NO: 519061 - RNA, 19 nt, Human
gaggaccucgggguggccu

SEQ ID NO: 519062 - RNA, 20 nt, Human
gagggggccuggggguccug

SEQ ID NO: 519063 - RNA, 18 nt, Human
gaucccaggccugggccc

SEQ ID NO: 519064 - RNA, 20 nt, Human
gcagcaggggagggggccug

SEQ ID NO: 519065 - RNA, 25 nt, Human
gccuggcuccagccugaagaccccc

SEQ ID NO: 519066 - RNA, 22 nt, Human
gcggcccgauccggccgacgcc

SEQ ID NO: 519067 - RNA, 21 nt, Human
gcuuccgcuccggcuccgcuc

SEQ ID NO: 519068 - RNA, 19 nt, Human
ggaaaaccccaaaaccagc

SEQ ID NO: 519069 - RNA, 25 nt, Human
ggacaggaagggaggggcuuuccag

SEQ ID NO: 519070 - RNA, 23 nt, Human
ggacagggaccagagggagaccu

SEQ ID NO: 519071 - RNA, 21 nt, Human
ggacuggauuuucagagggag

SEQ ID NO: 519072 - RNA, 21 nt, Human
ggaggaugcagggcugggagg

SEQ ID NO: 519073 - RNA, 20 nt, Human
ggagggcccacccaaccugu

SEQ ID NO: 519074 - RNA, 23 nt, Human
ggccacagaaggacaggaaggga

SEQ ID NO: 519075 - RNA, 19 nt, Human
ggcccagccagcuccuggg

SEQ ID NO: 519076 - RNA, 18 nt, Human
ggccuggggguccugggg

SEQ ID NO: 519077 - RNA, 21 nt, Human
ggccuggggguccuggggugg

SEQ ID NO: 519078 - RNA, 19 nt, Human
ggcugggaggggaccccac

SEQ ID NO: 519079 - RNA, 21 nt, Human
gggagcaagaaaguguugacu

SEQ ID NO: 519080 - RNA, 23 nt, Human
gggcaggagggaggcaggcuggg

SEQ ID NO: 519081 - RNA, 20 nt, Human
gggccaggcgggcaggaggg

SEQ ID NO: 519082 - RNA, 19 nt, Human
ggggauggaggccacagaa

SEQ ID NO: 519083 - RNA, 22 nt, Human
ggggauggaggccacagaagga

SEQ ID NO: 519084 - RNA, 20 nt, Human
ggguccccuccuucacucag

SEQ ID NO: 519085 - RNA, 24 nt, Human
ggucgggccccgucccuccagccg

SEQ ID NO: 519086 - RNA, 18 nt, Human
guccauuucugcccugcc

SEQ ID NO: 519087 - RNA, 18 nt, Human
guccugugggucaaggcc

SEQ ID NO: 519088 - RNA, 18 nt, Human
uaacugcggaaggagcag

SEQ ID NO: 519089 - RNA, 25 nt, Human
uacaauaucagggagggaugauggg

SEQ ID NO: 519090 - RNA, 23 nt, Human
uagaggcgcagaucuucgggaca

SEQ ID NO: 519091 - RNA, 22 nt, Human
ucacaccagcuuucaccucccu

SEQ ID NO: 519092 - RNA, 18 nt, Human
ucacucacucacucccag

SEQ ID NO: 519093 - RNA, 19 nt, Human
ucagccaucucacucacuc

SEQ ID NO: 519094 - RNA, 20 nt, Human
ucagggagggcccacccaac

SEQ ID NO: 519095 - RNA, 23 nt, Human
ucaucccacagaagagaaaacag

SEQ ID NO: 519096 - RNA, 18 nt, Human
uccaaagaagggacugga

SEQ ID NO: 519097 - RNA, 23 nt, Human
uccagaacaguggggaaagcgag

SEQ ID NO: 519098 - RNA, 23 nt, Human
uccagccccccagcaguguccag

SEQ ID NO: 519099 - RNA, 18 nt, Human
uccccagagcugagccug

SEQ ID NO: 519100 - RNA, 20 nt, Human
uccccagagcugagccugcc

SEQ ID NO: 519101 - RNA, 23 nt, Human
ucccccgcucccgccgcucccgc

SEQ ID NO: 519102 - RNA, 19 nt, Human
ucccuccagaacagugggg

SEQ ID NO: 519103 - RNA, 18 nt, Human
ucccuccagccggccgcc

SEQ ID NO: 519104 - RNA, 19 nt, Human
uccgcuccggcuccgcucc

SEQ ID NO: 519105 - RNA, 20 nt, Human
ucgggacaagagggaagaga

SEQ ID NO: 519106 - RNA, 24 nt, Human
ugaagacccccuccuuccccuucc

SEQ ID NO: 519107 - RNA, 20 nt, Human
ugacucaggugggcccgcuc

SEQ ID NO: 519108 - RNA, 18 nt, Human
ugagaucaucccacagaa

SEQ ID NO: 519109 - RNA, 19 nt, Human
ugaggaccucgggguggcc

SEQ ID NO: 519110 - RNA, 23 nt, Human
ugaggagggacgacagccaggcc

SEQ ID NO: 519111 - RNA, 21 nt, Human
ugaugggaaccccucaaaagg

SEQ ID NO: 519112 - RNA, 23 nt, Human
ugccaggcgccaccacacguccu

SEQ ID NO: 519113 - RNA, 20 nt, Human
ugccccccgcaaagcagcag

SEQ ID NO: 519114 - RNA, 21 nt, Human
ugcccugccccccgcaaagca

SEQ ID NO: 519115 - RNA, 23 nt, Human
ugcccugccccccgcaaagcagc

SEQ ID NO: 519116 - RNA, 24 nt, Human
ugcucccucucccgguccuggccc

SEQ ID NO: 519117 - RNA, 18 nt, Human
uggcccagccagcuccug

SEQ ID NO: 519118 - RNA, 18 nt, Human
uggcgccauggagcccgg

SEQ ID NO: 519119 - RNA, 24 nt, Human
ugggugagugggcgggaacccacu

SEQ ID NO: 519120 - RNA, 18 nt, Human
uucaccucccucucucca

SEQ ID NO: 519121 - RNA, 21 nt, Human
uucccccgcucccgccgcucc

SEQ ID NO: 519122 - RNA, 22 nt, Human
uugcugccgcuccauccccaac

SEQ ID NO: 519123 - RNA, 23 nt, Human
aaagcccauguguguucucuagg

SEQ ID NO: 519124 - RNA, 25 nt, Human
aagaacacgagccgggauucaagcc

SEQ ID NO: 519125 - RNA, 22 nt, Human
aaugggcugccuccagggccca

SEQ ID NO: 519126 - RNA, 21 nt, Human
acagacaagggcuguugagcg

SEQ ID NO: 519127 - RNA, 23 nt, Human
acaggccuggggccuccuggggu

SEQ ID NO: 519128 - RNA, 22 nt, Human
acucaaauccagggcuaccucc

SEQ ID NO: 519129 - RNA, 24 nt, Human
acucaaauccagggcuaccuccuc

SEQ ID NO: 519130 - RNA, 24 nt, Human
acucccugaggggcccuccugggc

SEQ ID NO: 519131 - RNA, 24 nt, Human
agaacgggaagccuugacagggga

SEQ ID NO: 519132 - RNA, 18 nt, Human
agacaagggcuguugagc

SEQ ID NO: 519133 - RNA, 24 nt, Human
agcagccacagccccagcauccac

SEQ ID NO: 519134 - RNA, 21 nt, Human
agcagcuuggccagcagcccc

SEQ ID NO: 519135 - RNA, 18 nt, Human
agcauccccacaacaacc

SEQ ID NO: 519136 - RNA, 20 nt, Human
agccgggauucaagcccagg

SEQ ID NO: 519137 - RNA, 19 nt, Human
agcuacggcuggagggcug

SEQ ID NO: 519138 - RNA, 20 nt, Human
agcuggaucccgggcugaag

SEQ ID NO: 519139 - RNA, 22 nt, Human
agcuguggaaguugguccuugg

SEQ ID NO: 519140 - RNA, 19 nt, Human
aggaagguucucugccucc

SEQ ID NO: 519141 - RNA, 23 nt, Human
aggcaaaggugccggacggagga

SEQ ID NO: 519142 - RNA, 24 nt, Human
aggcagcauccccacaacaacccu

SEQ ID NO: 519143 - RNA, 18 nt, Human
aggcagggucccccugca

SEQ ID NO: 519144 - RNA, 18 nt, Human
aggcccagaacaaggacg

SEQ ID NO: 519145 - RNA, 18 nt, Human
agggguuuacucccugag

SEQ ID NO: 519146 - RNA, 21 nt, Human
agggguuuacucccugagggg

SEQ ID NO: 519147 - RNA, 20 nt, Human
auaaagacccucacguuaaa

SEQ ID NO: 519148 - RNA, 24 nt, Human
aucaggcagcauccccacaacaac

SEQ ID NO: 519149 - RNA, 23 nt, Human
augggccacagggucagagaugg

SEQ ID NO: 519150 - RNA, 22 nt, Human
auggugacaggguauguaucag

SEQ ID NO: 519151 - RNA, 24 nt, Human
caaagcccauguguguucucuagg

SEQ ID NO: 519152 - RNA, 26 nt, Human
caagaacacgagccgggauucaagcc

SEQ ID NO: 519153 - RNA, 22 nt, Human
cacaacaacccugugagguagg

SEQ ID NO: 519154 - RNA, 20 nt, Human
cacacagcacuggcaaccag

SEQ ID NO: 519155 - RNA, 23 nt, Human
cacacucaaauccagggcuaccu

SEQ ID NO: 519156 - RNA, 23 nt, Human
cagaaauagcaucacacagggac

SEQ ID NO: 519157 - RNA, 23 nt, Human
cagaacaaggacgccagcuccag

SEQ ID NO: 519158 - RNA, 21 nt, Human
cagcacuccacaggcaggugg

SEQ ID NO: 519159 - RNA, 21 nt, Human
cagcagaggugaaguuucuug

SEQ ID NO: 519160 - RNA, 23 nt, Human
cagcagccccugcacacccuggc

SEQ ID NO: 519161 - RNA, 18 nt, Human
cagcaggccuggcugaug

SEQ ID NO: 519162 - RNA, 19 nt, Human
cagcauccccacaacaacc

SEQ ID NO: 519163 - RNA, 26 nt, Human
cagcaugcgugaggugcagccugauc

SEQ ID NO: 519164 - RNA, 22 nt, Human
cagcugggcaggcagaagggaa

SEQ ID NO: 519165 - RNA, 23 nt, Human
caggcagaagggaaggguggaga

SEQ ID NO: 519166 - RNA, 25 nt, Human
caggcagaagggaaggguggagagu

SEQ ID NO: 519167 - RNA, 22 nt, Human
caggcagcauccccacaacaac

SEQ ID NO: 519168 - RNA, 21 nt, Human
caggggagcagccacagcccc

SEQ ID NO: 519169 - RNA, 18 nt, Human
cagggucccccugcagcc

SEQ ID NO: 519170 - RNA, 20 nt, Human
cagguggcucacagcaggcc

SEQ ID NO: 519171 - RNA, 21 nt, Human
caucacacagggacgcaugua

SEQ ID NO: 519172 - RNA, 23 nt, Human
caucccugcaccaguagcgggga

SEQ ID NO: 519173 - RNA, 20 nt, Human
caugguccacagaagcgggu

SEQ ID NO: 519174 - RNA, 20 nt, Human
ccaacccaaccccaaaugcu

SEQ ID NO: 519175 - RNA, 22 nt, Human
ccaacccaaccccaaaugcugg

SEQ ID NO: 519176 - RNA, 18 nt, Human
ccagaacaaggacgccag

SEQ ID NO: 519177 - RNA, 20 nt, Human
ccaggcuggaguagggccaa

SEQ ID NO: 519178 - RNA, 21 nt, Human
cccauguguguucucuaggca

SEQ ID NO: 519179 - RNA, 21 nt, Human
ccccugcagccuuugucccuc

SEQ ID NO: 519180 - RNA, 25 nt, Human
ccccuggggcugaaguagaugcugg

SEQ ID NO: 519181 - RNA, 18 nt, Human
cccugcaccaguagcggg

SEQ ID NO: 519182 - RNA, 18 nt, Human
ccgggauucaagcccagg

SEQ ID NO: 519183 - RNA, 18 nt, Human
ccuccagggcccaucggc

SEQ ID NO: 519184 - RNA, 19 nt, Human
ccuccugggcaggcagggu

SEQ ID NO: 519185 - RNA, 26 nt, Human
ccugcaacuggagcuggagcuggagc

SEQ ID NO: 519186 - RNA, 28 nt, Human
ccugcagcaagaacacgagccggggucc

SEQ ID NO: 519187 - RNA, 19 nt, Human
ccugcagccuuugucccuc

SEQ ID NO: 519188 - RNA, 26 nt, Human
ccuggggcugaaguagaugcuggagc

SEQ ID NO: 519189 - RNA, 22 nt, Human
cucaaauccagggcuaccuccu

SEQ ID NO: 519190 - RNA, 21 nt, Human
cucccgcagugcccgcuccuc

SEQ ID NO: 519191 - RNA, 22 nt, Human
cucccucagggagcuccaggcu

SEQ ID NO: 519192 - RNA, 18 nt, Human
cugaaguagaugcuggag

SEQ ID NO: 519193 - RNA, 24 nt, Human
cugcagcugagacagcagcuuggc

SEQ ID NO: 519194 - RNA, 24 nt, Human
cuggagcaggggcaggggaggcca

SEQ ID NO: 519195 - RNA, 21 nt, Human
cuggaucccgggcugaagcug

SEQ ID NO: 519196 - RNA, 18 nt, Human
cuggggccuccuggggug

SEQ ID NO: 519197 - RNA, 23 nt, Human
cugucccagagaggaagcagaga

SEQ ID NO: 519198 - RNA, 23 nt, Human
cugucgggcuccaaagcccaugu

SEQ ID NO: 519199 - RNA, 24 nt, Human
cuucuaggacugagcugccacuuu

SEQ ID NO: 519200 - RNA, 20 nt, Human
cuugacaggggaggccucug

SEQ ID NO: 519201 - RNA, 22 nt, Human
gaaauagcaucacacagggacg

SEQ ID NO: 519202 - RNA, 19 nt, Human
gaaccccuccaggggagca

SEQ ID NO: 519203 - RNA, 19 nt, Human
gaaggccacagagcugugg

SEQ ID NO: 519204 - RNA, 23 nt, Human
gagccggagcaggggauggagcu

SEQ ID NO: 519205 - RNA, 22 nt, Human
gagcugccacucagccuaccug

SEQ ID NO: 519206 - RNA, 18 nt, Human
gaggaagcagagaccaaa

SEQ ID NO: 519207 - RNA, 21 nt, Human
gaugggcucuggcuuggggag

SEQ ID NO: 519208 - RNA, 19 nt, Human
gcaccagucccugaguccc

SEQ ID NO: 519209 - RNA, 24 nt, Human
gcagcgccaguaacuucagcaugc

SEQ ID NO: 519210 - RNA, 18 nt, Human
gcaggcagaagggaaggg

SEQ ID NO: 519211 - RNA, 21 nt, Human
gcaggcucccucagggagcuc

SEQ ID NO: 519212 - RNA, 19 nt, Human
gcaguccugccacgcagcc

SEQ ID NO: 519213 - RNA, 19 nt, Human
gcaguccugccacgcagcc

SEQ ID NO: 519214 - RNA, 21 nt, Human
gcccugucccagagaggaagc

SEQ ID NO: 519215 - RNA, 24 nt, Human
gccgcagcuccacacgaugcuccu

SEQ ID NO: 519216 - RNA, 21 nt, Human
gccugcaacuggagcuggagc

SEQ ID NO: 519217 - RNA, 21 nt, Human
gcggcagcagcaggcccagaa

SEQ ID NO: 519218 - RNA, 21 nt, Human
gcuggagggcugggcagugcc

SEQ ID NO: 519219 - RNA, 22 nt, Human
ggaccacggcugcaggcaaagg

SEQ ID NO: 519220 - RNA, 18 nt, Human
ggagcugaggugggcgug

SEQ ID NO: 519221 - RNA, 20 nt, Human
ggaggagagugggcgacggg

SEQ ID NO: 519222 - RNA, 20 nt, Human
ggaguccccuggggcugaag

SEQ ID NO: 519223 - RNA, 20 nt, Human
ggcagcagcaggcccagaac

SEQ ID NO: 519224 - RNA, 20 nt, Human
ggcagcauccccacaacaac

SEQ ID NO: 519225 - RNA, 19 nt, Human
ggcagccgagggaagagcc

SEQ ID NO: 519226 - RNA, 18 nt, Human
ggcagcugggcaggcaga

SEQ ID NO: 519227 - RNA, 24 nt, Human
ggcaggcagaagggaaggguggag

SEQ ID NO: 519228 - RNA, 18 nt, Human
ggccccggggcagcuggg

SEQ ID NO: 519229 - RNA, 22 nt, Human
ggccuggggccuccuggggugg

SEQ ID NO: 519230 - RNA, 18 nt, Human
gggauugggagcagggag

SEQ ID NO: 519231 - RNA, 18 nt, Human
gggcaccggugggugcga

SEQ ID NO: 519232 - RNA, 18 nt, Human
gggcacgaagauggcgcc

SEQ ID NO: 519233 - RNA, 18 nt, Human
ggggauugggagcaggga

SEQ ID NO: 519234 - RNA, 19 nt, Human
ggggauugggagcagggag

SEQ ID NO: 519235 - RNA, 23 nt, Human
ggguggcagccgagggaagagcc

SEQ ID NO: 519236 - RNA, 19 nt, Human
ggguggcggcagcagcagg

SEQ ID NO: 519237 - RNA, 24 nt, Human
guggcggcagcagcaggcccagaa

SEQ ID NO: 519238 - RNA, 22 nt, Human
uaagugagccccuuagggguuu

SEQ ID NO: 519239 - RNA, 22 nt, Human
uaaugggcugccuccagggccc

SEQ ID NO: 519240 - RNA, 22 nt, Human
uacacacagcacuggcaaccag

SEQ ID NO: 519241 - RNA, 19 nt, Human
uagcaggguccucaguccu

SEQ ID NO: 519242 - RNA, 20 nt, Human
ucacagcaggccuggcugau

SEQ ID NO: 519243 - RNA, 21 nt, Human
ucagagaccuucuaggacuga

SEQ ID NO: 519244 - RNA, 21 nt, Human
ucagcagaggugaaguuucuu

SEQ ID NO: 519245 - RNA, 21 nt, Human
ucagccuaccugcaccagucc

SEQ ID NO: 519246 - RNA, 20 nt, Human
uccaaagcccauguguguuc

SEQ ID NO: 519247 - RNA, 23 nt, Human
uccacagaacgggaagccuugac

SEQ ID NO: 519248 - RNA, 21 nt, Human
uccacugccuaagguaccacu

SEQ ID NO: 519249 - RNA, 18 nt, Human
uccaggggagcagccaca

SEQ ID NO: 519250 - RNA, 23 nt, Human
ucccagagaggaagcagagaccc

SEQ ID NO: 519251 - RNA, 18 nt, Human
ucccagcagcugcuuagc

SEQ ID NO: 519252 - RNA, 22 nt, Human
uccccacaacaacccugugagg

SEQ ID NO: 519253 - RNA, 20 nt, Human
ucccccugcagccuuugucc

SEQ ID NO: 519254 - RNA, 19 nt, Human
ucccgggcugaagcuggag

SEQ ID NO: 519255 - RNA, 22 nt, Human
ucccugaggggcccuccugggc

SEQ ID NO: 519256 - RNA, 25 nt, Human
ucccugaggggcccuccugggcagg

SEQ ID NO: 519257 - RNA, 22 nt, Human
ucccugcaccaguagcggggau

SEQ ID NO: 519258 - RNA, 24 nt, Human
uccucacacucaaauccagggcua

SEQ ID NO: 519259 - RNA, 25 nt, Human
ucgcaccacaugggggaaggggccg

SEQ ID NO: 519260 - RNA, 20 nt, Human
ucguggccccggggcagcug

SEQ ID NO: 519261 - RNA, 24 nt, Human
ucuacgauagccaaguccuaggac

SEQ ID NO: 519262 - RNA, 23 nt, Human
ucuaggcccugucccagagaggg

SEQ ID NO: 519263 - RNA, 22 nt, Human
ucugcugugggcuuccucacac

SEQ ID NO: 519264 - RNA, 20 nt, Human
ugagcucgagccggagcagg

SEQ ID NO: 519265 - RNA, 23 nt, Human
ugagcucgagccggagcagggga

SEQ ID NO: 519266 - RNA, 22 nt, Human
ugaggcccagagcuugccagaa

SEQ ID NO: 519267 - RNA, 19 nt, Human
ugagucccagcagcugcuu

SEQ ID NO: 519268 - RNA, 18 nt, Human
ugcagccuggcagggcga

SEQ ID NO: 519269 - RNA, 21 nt, Human
ugcccacaucuggcacaucca

SEQ ID NO: 519270 - RNA, 19 nt, Human
ugcccgcuccuccgacagc

SEQ ID NO: 519271 - RNA, 19 nt, Human
ugcuggagcagggccugca

SEQ ID NO: 519272 - RNA, 21 nt, Human
uggcgcagcgccaguaacuuc

SEQ ID NO: 519273 - RNA, 18 nt, Human
uggcucacagcaggccug

SEQ ID NO: 519274 - RNA, 23 nt, Human
uggcugcaguaggcuuggcaugc

SEQ ID NO: 519275 - RNA, 22 nt, Human
uggcuuggggaguagcaggguc

SEQ ID NO: 519276 - RNA, 18 nt, Human
ugggagcagggagugcag

SEQ ID NO: 519277 - RNA, 18 nt, Human
ugggcugccuccagggcc

SEQ ID NO: 519278 - RNA, 24 nt, Human
ugggcugccuccagggcccaucgg

SEQ ID NO: 519279 - RNA, 23 nt, Human
uggggaguagcaggguccucagu

SEQ ID NO: 519280 - RNA, 19 nt, Human
uggggggugacuccugaga

SEQ ID NO: 519281 - RNA, 21 nt, Human
ugggguggcggcagcagcagg

SEQ ID NO: 519282 - RNA, 22 nt, Human
uggugcuucugugucuaucuuu

SEQ ID NO: 519283 - RNA, 19 nt, Human
uuccaaaaacgagccaggg

SEQ ID NO: 519284 - RNA, 19 nt, Human
acagcccagguggccggac

SEQ ID NO: 519285 - RNA, 24 nt, Human
agcacagcugccacucaccugccc

SEQ ID NO: 519286 - RNA, 21 nt, Human
caccaccuggcagggcagggc

SEQ ID NO: 519287 - RNA, 23 nt, Human
caccccaggguugcucuccugga

SEQ ID NO: 519288 - RNA, 19 nt, Human
cacugagcacugagaccag

SEQ ID NO: 519289 - RNA, 19 nt, Human
cagcccguggugggcacug

SEQ ID NO: 519290 - RNA, 21 nt, Human
ccagccccacgcugcggaugc

SEQ ID NO: 519291 - RNA, 23 nt, Human
ccaggagaacacgggcggcggga

SEQ ID NO: 519292 - RNA, 22 nt, Human
cccaggguugcucuccuggaac

SEQ ID NO: 519293 - RNA, 24 nt, Human
cccagugugcccaggggccaccga

SEQ ID NO: 519294 - RNA, 21 nt, Human
ccgcaggagcuggagcacagc

SEQ ID NO: 519295 - RNA, 21 nt, Human
ccuucagggcccagugugccc

SEQ ID NO: 519296 - RNA, 22 nt, Human
cggcgggagaggcccccaggcc

SEQ ID NO: 519297 - RNA, 21 nt, Human
cgggaugaagucagccucguu

SEQ ID NO: 519298 - RNA, 20 nt, Human
cgucacaggggacaccggug

SEQ ID NO: 519299 - RNA, 22 nt, Human
cuccccacaugucacugagcac

SEQ ID NO: 519300 - RNA, 19 nt, Human
gccacucaccugcccacca

SEQ ID NO: 519301 - RNA, 19 nt, Human
gccugagccuucagggccc

SEQ ID NO: 519302 - RNA, 19 nt, Human
gcucugcucauccagcccc

SEQ ID NO: 519303 - RNA, 20 nt, Human
gcuggaggagccgcugccug

SEQ ID NO: 519304 - RNA, 19 nt, Human
ggagcuccgccacagcccu

SEQ ID NO: 519305 - RNA, 19 nt, Human
ggcgcagggggcgggagcu

SEQ ID NO: 519306 - RNA, 21 nt, Human
ggcgggugaagggcguggggc

SEQ ID NO: 519307 - RNA, 18 nt, Human
gggcgcagggggcgggag

SEQ ID NO: 519308 - RNA, 19 nt, Human
gggcguggggccagguggu

SEQ ID NO: 519309 - RNA, 21 nt, Human
ggggacaccggugucauuggu

SEQ ID NO: 519310 - RNA, 21 nt, Human
uaccuuuuuugagggggagga

SEQ ID NO: 519311 - RNA, 18 nt, Human
ucacagugcuccucgucc

SEQ ID NO: 519312 - RNA, 18 nt, Human
uccagggcccauaaugcc

SEQ ID NO: 519313 - RNA, 19 nt, Human
ucguagugcaccccagggu

SEQ ID NO: 519314 - RNA, 18 nt, Human
ucugcacaccucugccgc

SEQ ID NO: 519315 - RNA, 20 nt, Human
ugagggggaggaggucccca

SEQ ID NO: 519316 - RNA, 18 nt, Human
ugaugaggcgggugaagg

SEQ ID NO: 519317 - RNA, 21 nt, Human
ugcacuugguccagggcccau

SEQ ID NO: 519318 - RNA, 20 nt, Human
ugcccaggggccaccgacag

SEQ ID NO: 519319 - RNA, 20 nt, Human
ugccugagccuucagggccc

SEQ ID NO: 519320 - RNA, 22 nt, Human
ugccuggcuugggugaugaggc

SEQ ID NO: 519321 - RNA, 19 nt, Human
uggaugguguacucguagu

SEQ ID NO: 519322 - RNA, 18 nt, Human
uggcagagagcaggugac

SEQ ID NO: 519323 - RNA, 21 nt, Human
uggcagggcagggcugcucgc

SEQ ID NO: 519324 - RNA, 19 nt, Human
uggugcgggaugaagucag

SEQ ID NO: 519325 - RNA, 24 nt, Human
uucagggcccagugugcccagggg

SEQ ID NO: 519326 - RNA, 23 nt, Human
uuuugagggggaggaggucccca

SEQ ID NO: 519327 - RNA, 24 nt, Human
aggagggagucuagcagcuguggg

SEQ ID NO: 519328 - RNA, 21 nt, Human
auuuggaggaggagggagucu

SEQ ID NO: 519329 - RNA, 20 nt, Human
cagcccagggguggggugcc

SEQ ID NO: 519330 - RNA, 21 nt, Human
cccauaccacucugccagacc

SEQ ID NO: 519331 - RNA, 19 nt, Human
ccccgggcccgcagggugc

SEQ ID NO: 519332 - RNA, 26 nt, Human
ccccuauguagccuuggccccagccc

SEQ ID NO: 519333 - RNA, 20 nt, Human
ccugagaugccuccagguga

SEQ ID NO: 519334 - RNA, 18 nt, Human
cgggcccgcagggugcug

SEQ ID NO: 519335 - RNA, 21 nt, Human
cucugguuucugagggccugg

SEQ ID NO: 519336 - RNA, 23 nt, Human
cucugguuucugagggccugggg

SEQ ID NO: 519337 - RNA, 20 nt, Human
cuggugguaugguaggucuc

SEQ ID NO: 519338 - RNA, 20 nt, Human
cugguuucugagggccuggg

SEQ ID NO: 519339 - RNA, 18 nt, Human
cugugggcaguggcugag

SEQ ID NO: 519340 - RNA, 20 nt, Human
gagggguguccuggggcccu

SEQ ID NO: 519341 - RNA, 19 nt, Human
gcaguggcugagccuggca

SEQ ID NO: 519342 - RNA, 19 nt, Human
ggcaguggcugagccuggc

SEQ ID NO: 519343 - RNA, 18 nt, Human
gggaugacacccgucacc

SEQ ID NO: 519344 - RNA, 18 nt, Human
ggggugcccauaccacuc

SEQ ID NO: 519345 - RNA, 21 nt, Human
ucugguuucugagggccuggg

SEQ ID NO: 519346 - RNA, 18 nt, Human
ugagaugccuccagguga

SEQ ID NO: 519347 - RNA, 19 nt, Human
ugagaugccuccaggugaa

SEQ ID NO: 519348 - RNA, 22 nt, Human
ugagggaccuagacccagccca

SEQ ID NO: 519349 - RNA, 20 nt, Human
ugagggccugggguugaagc

SEQ ID NO: 519350 - RNA, 21 nt, Human
ugagggccugggguugaagcu

SEQ ID NO: 519351 - RNA, 24 nt, Human
ugcccauaccacucugccagaccc

SEQ ID NO: 519352 - RNA, 23 nt, Human
uggaggaggagggagucuagcag

SEQ ID NO: 519353 - RNA, 23 nt, Human
uggcauggccuggccugagaugc

SEQ ID NO: 519354 - RNA, 19 nt, Human
uggcucugguuucugaggg

SEQ ID NO: 519355 - RNA, 24 nt, Human
uggcucugguuucugagggccugg

SEQ ID NO: 519356 - RNA, 21 nt, Human
uggcugagccuggcauggccu

SEQ ID NO: 519357 - RNA, 21 nt, Human
ugggcaguggcugagccuggc

SEQ ID NO: 519358 - RNA, 21 nt, Human
ugguaggucucauggcucugg

SEQ ID NO: 519359 - RNA, 22 nt, Human
ugugggcaguggcugagccugg

SEQ ID NO: 519360 - RNA, 18 nt, Human
uuuuuuuuuuuuuuuuug

SEQ ID NO: 519361 - RNA, 24 nt, Human
aaacaaacugaacugcauguucuu

SEQ ID NO: 519362 - RNA, 26 nt, Human
aggaagaagauggaaaggagggaccc

SEQ ID NO: 519363 - RNA, 22 nt, Human
agucacaauaacaaaacuguau

SEQ ID NO: 519364 - RNA, 24 nt, Human
aucuuucuuaaaguccuuccacug

SEQ ID NO: 519365 - RNA, 24 nt, Human
augaauacaguuauuauuugaggu

SEQ ID NO: 519366 - RNA, 19 nt, Human
cuuaggaagaagauggaaa

SEQ ID NO: 519367 - RNA, 26 nt, Human
gaaaaaggugauacucuauucaaugc

SEQ ID NO: 519368 - RNA, 20 nt, Human
gaacugauguguugaccuug

SEQ ID NO: 519369 - RNA, 19 nt, Human
gucacaauaacaaaacugu

SEQ ID NO: 519370 - RNA, 23 nt, Human
uaaaucuuguugaaaaaggugau

SEQ ID NO: 519371 - RNA, 24 nt, Human
uaacucucuugaaaaaaaauuaau

SEQ ID NO: 519372 - RNA, 19 nt, Human
ucuuugggaaauacagguu

SEQ ID NO: 519373 - RNA, 21 nt, Human
ugaacugauguguugaccuug

SEQ ID NO: 519374 - RNA, 19 nt, Human
ugaagaccgcaaagaggga

SEQ ID NO: 519375 - RNA, 23 nt, Human
uggaaaggaagcaggcaaucucg

SEQ ID NO: 519376 - RNA, 20 nt, Human
uuaggaaaugauauguaaua

SEQ ID NO: 519377 - RNA, 22 nt, Human
uuccuugaaucuuuaaaauaac

SEQ ID NO: 519378 - RNA, 22 nt, Human
uuucuuugggaaauacagguuu

SEQ ID NO: 519379 - RNA, 23 nt, Human
uuugaggucuccauucacuuaca

SEQ ID NO: 519380 - RNA, 23 nt, Human
aaaaauccaggguaauuuaagca

SEQ ID NO: 519381 - RNA, 19 nt, Human
aaauaaccuuugagucaga

SEQ ID NO: 519382 - RNA, 19 nt, Human
aagaacuuggcauuauuua

SEQ ID NO: 519383 - RNA, 23 nt, Human
aagaccagaagcucucgaaagcu

SEQ ID NO: 519384 - RNA, 19 nt, Human
aagcaggauauuuaaccug

SEQ ID NO: 519385 - RNA, 21 nt, Human
aagccgcaccccuguuuccuu

SEQ ID NO: 519386 - RNA, 20 nt, Human
aagcucuccaggccgcccuc

SEQ ID NO: 519387 - RNA, 19 nt, Human
aaguguagaggucaaaaac

SEQ ID NO: 519388 - RNA, 20 nt, Human
aaguguagaggucaaaaacc

SEQ ID NO: 519389 - RNA, 19 nt, Human
aauccucccuucccgccgc

SEQ ID NO: 519390 - RNA, 23 nt, Human
acaaagcgcuugcacuuccacca

SEQ ID NO: 519391 - RNA, 18 nt, Human
acauauuacacucccagg

SEQ ID NO: 519392 - RNA, 24 nt, Human
acccccuccuccagguggaaagac

SEQ ID NO: 519393 - RNA, 18 nt, Human
accuuacccccuccucca

SEQ ID NO: 519394 - RNA, 22 nt, Human
acuacugcuucccaaggaggua

SEQ ID NO: 519395 - RNA, 20 nt, Human
acuaggguccagggacagaa

SEQ ID NO: 519396 - RNA, 25 nt, Human
acugcaguuuacaaagcgcuugcac

SEQ ID NO: 519397 - RNA, 21 nt, Human
agaaagaaccauucguaaaag

SEQ ID NO: 519398 - RNA, 20 nt, Human
agaccugaaacaggccaaca

SEQ ID NO: 519399 - RNA, 21 nt, Human
agcgacaaagaaaagcaggga

SEQ ID NO: 519400 - RNA, 20 nt, Human
agcuauaggaacaaccugaa

SEQ ID NO: 519401 - RNA, 19 nt, Human
aggaaaccgcuacagacca

SEQ ID NO: 519402 - RNA, 22 nt, Human
aggaagagggggaaaaacaaaa

SEQ ID NO: 519403 - RNA, 21 nt, Human
aggcggcagcggcgguggcgg

SEQ ID NO: 519404 - RNA, 23 nt, Human
aggcggcagcggcgguggcggcu

SEQ ID NO: 519405 - RNA, 22 nt, Human
agggggaggggaggaauguauu

SEQ ID NO: 519406 - RNA, 19 nt, Human
agguauauguuauacagaa

SEQ ID NO: 519407 - RNA, 22 nt, Human
auaggaacaaccugaacaacau

SEQ ID NO: 519408 - RNA, 18 nt, Human
auccauuacuacugcuuc

SEQ ID NO: 519409 - RNA, 23 nt, Human
caacgcugggucucaccccacgc

SEQ ID NO: 519410 - RNA, 27 nt, Human
caauacaaggaacuaaagagaugcaga

SEQ ID NO: 519411 - RNA, 22 nt, Human
cacaguauuuagauccuuaucu

SEQ ID NO: 519412 - RNA, 20 nt, Human
cacauccuccuuugccccuc

SEQ ID NO: 519413 - RNA, 18 nt, Human
cacguaaagacagaaaaa

SEQ ID NO: 519414 - RNA, 21 nt, Human
cacugaugaaccaagaccaga

SEQ ID NO: 519415 - RNA, 24 nt, Human
cacuuauuuuagaaagaaaauaac

SEQ ID NO: 519416 - RNA, 19 nt, Human
cagaggauggcucccuucc

SEQ ID NO: 519417 - RNA, 20 nt, Human
cauucauucaucaaacauuu

SEQ ID NO: 519418 - RNA, 23 nt, Human
ccaauccucccuucccgccgccc

SEQ ID NO: 519419 - RNA, 24 nt, Human
ccagaagcucucgaaagcuccaag

SEQ ID NO: 519420 - RNA, 18 nt, Human
cccaaaggagcagucccc

SEQ ID NO: 519421 - RNA, 20 nt, Human
ccccucucaccaccuuuccc

SEQ ID NO: 519422 - RNA, 24 nt, Human
ccccucucaccaccuuucccgcag

SEQ ID NO: 519423 - RNA, 18 nt, Human
ccccuuccucucuucagu

SEQ ID NO: 519424 - RNA, 21 nt, Human
cccucucaccaccuuucccgc

SEQ ID NO: 519425 - RNA, 23 nt, Human
ccgcggcccgaggcgcacccacc

SEQ ID NO: 519426 - RNA, 19 nt, Human
ccgcuacagaccaagcucu

SEQ ID NO: 519427 - RNA, 18 nt, Human
ccuaaacuggaaacaacc

SEQ ID NO: 519428 - RNA, 18 nt, Human
ccucccuucccgccgccc

SEQ ID NO: 519429 - RNA, 24 nt, Human
ccuugguuuugccacauccuccuu

SEQ ID NO: 519430 - RNA, 27 nt, Human
ccuuugccccucucaccaccuuucccg

SEQ ID NO: 519431 - RNA, 19 nt, Human
cgaaagcuccaaaccguaa

SEQ ID NO: 519432 - RNA, 20 nt, Human
cgacaaagcgacaaagaaaa

SEQ ID NO: 519433 - RNA, 18 nt, Human
cggcuccuccccuuccuc

SEQ ID NO: 519434 - RNA, 23 nt, Human
cucauacuauucacugaagacag

SEQ ID NO: 519435 - RNA, 23 nt, Human
cuccccuuccucucuucaguucu

SEQ ID NO: 519436 - RNA, 25 nt, Human
cuccuuccucccaaaggagcagucc

SEQ ID NO: 519437 - RNA, 22 nt, Human
cucuguacucaagccgcacccc

SEQ ID NO: 519438 - RNA, 23 nt, Human
cugcugcuuuaaucuuuuucuca

SEQ ID NO: 519439 - RNA, 18 nt, Human
cuggaaauauuccauuuc

SEQ ID NO: 519440 - RNA, 24 nt, Human
cuguuaucaagcugggugcugagg

SEQ ID NO: 519441 - RNA, 21 nt, Human
gaaagcuccaaaccguaagaa

SEQ ID NO: 519442 - RNA, 25 nt, Human
gaaccaagaccagaagcucucgaaa

SEQ ID NO: 519443 - RNA, 23 nt, Human
gaacuucugaguugcuggaaaua

SEQ ID NO: 519444 - RNA, 23 nt, Human
gacaaagcgacaaagaaaagcag

SEQ ID NO: 519445 - RNA, 18 nt, Human
gaccaagcucuccaggcc

SEQ ID NO: 519446 - RNA, 18 nt, Human
gaccaucacuuguugguc

SEQ ID NO: 519447 - RNA, 20 nt, Human
gauaggaagagggggaaaaa

SEQ ID NO: 519448 - RNA, 31 nt, Human
gauccuuaucuuaaauugaugaaccagggag

SEQ ID NO: 519449 - RNA, 20 nt, Human
gcaaaagcagcaagaacaag

SEQ ID NO: 519450 - RNA, 21 nt, Human
gcacugcaguuuacaaagcgc

SEQ ID NO: 519451 - RNA, 23 nt, Human
gcagcggcgguggcggcugcgag

SEQ ID NO: 519452 - RNA, 21 nt, Human
gcgacaaagcgacaaagaaaa

SEQ ID NO: 519453 - RNA, 19 nt, Human
gcggcagcggcgguggcgg

SEQ ID NO: 519454 - RNA, 21 nt, Human
ggagcaguccccaccugcccc

SEQ ID NO: 519455 - RNA, 18 nt, Human
ggcgcucucucccuggag

SEQ ID NO: 519456 - RNA, 18 nt, Human
ggcggcagcggcgguggc

SEQ ID NO: 519457 - RNA, 23 nt, Human
gggaacuucugaguugcuggaaa

SEQ ID NO: 519458 - RNA, 23 nt, Human
gggacagaauuguggaaucugcu

SEQ ID NO: 519459 - RNA, 22 nt, Human
gggauuggucacguaaagacag

SEQ ID NO: 519460 - RNA, 19 nt, Human
ggguggugcgcgcagcugc

SEQ ID NO: 519461 - RNA, 19 nt, Human
guagaguguacuagggucc

SEQ ID NO: 519462 - RNA, 21 nt, Human
gucauggcagggaggggaacu

SEQ ID NO: 519463 - RNA, 19 nt, Human
gucucaccccacgccacgg

SEQ ID NO: 519464 - RNA, 23 nt, Human
gugauggaauacauauaugaaga

SEQ ID NO: 519465 - RNA, 22 nt, Human
uaaacuggaaacaacccagaug

SEQ ID NO: 519466 - RNA, 19 nt, Human
uaaagacagaaaaauccag

SEQ ID NO: 519467 - RNA, 24 nt, Human
uaacccucuagaaaagaacuuggc

SEQ ID NO: 519468 - RNA, 18 nt, Human
uaacuccucgaucagucc

SEQ ID NO: 519469 - RNA, 20 nt, Human
uacaaggaacuaaagagaug

SEQ ID NO: 519470 - RNA, 18 nt, Human
uacccaguuaaaaguuuc

SEQ ID NO: 519471 - RNA, 20 nt, Human
uagaaaagaacuuggcauua

SEQ ID NO: 519472 - RNA, 20 nt, Human
uagaaagaaaauaaccuuug

SEQ ID NO: 519473 - RNA, 22 nt, Human
uaggaaaagcugcauaauagua

SEQ ID NO: 519474 - RNA, 24 nt, Human
uagucugugagucucuccuugguu

SEQ ID NO: 519475 - RNA, 24 nt, Human
uaugaacuuccuucucuccagucu

SEQ ID NO: 519476 - RNA, 21 nt, Human
uauuuggaaggcuguagcagg

SEQ ID NO: 519477 - RNA, 23 nt, Human
ucaaaaaccuuauaagagucucc

SEQ ID NO: 519478 - RNA, 21 nt, Human
ucacauuagcauuuauaacaa

SEQ ID NO: 519479 - RNA, 20 nt, Human
uccagcuguuuccuccuguu

SEQ ID NO: 519480 - RNA, 20 nt, Human
uccagggacagaauugugga

SEQ ID NO: 519481 - RNA, 25 nt, Human
ucccagaggauggcucccuuccaau

SEQ ID NO: 519482 - RNA, 19 nt, Human
uccuccuguuaucaagcug

SEQ ID NO: 519483 - RNA, 21 nt, Human
uccuugguuuugccacaucuu

SEQ ID NO: 519484 - RNA, 22 nt, Human
ucgggucagggguaagaucggg

SEQ ID NO: 519485 - RNA, 19 nt, Human
ucucaccccacgccacggg

SEQ ID NO: 519486 - RNA, 21 nt, Human
ucuccaggccgcccucggguc

SEQ ID NO: 519487 - RNA, 23 nt, Human
ucuccuugguuuugccacauccu

SEQ ID NO: 519488 - RNA, 20 nt, Human
ugaaccaagaccagaagcuc

SEQ ID NO: 519489 - RNA, 18 nt, Human
ugaagacgcggccugggc

SEQ ID NO: 519490 - RNA, 24 nt, Human
ugaauuaaaaacaauguugagcaa

SEQ ID NO: 519491 - RNA, 19 nt, Human
ugacaguaaaagccacuga

SEQ ID NO: 519492 - RNA, 25 nt, Human
ugaccugguugauugguuacauggg

SEQ ID NO: 519493 - RNA, 18 nt, Human
ugacucuguacucaagcc

SEQ ID NO: 519494 - RNA, 18 nt, Human
ugaugaaccaagaccaga

SEQ ID NO: 519495 - RNA, 22 nt, Human
ugaugaaccaagaccagaagcu

SEQ ID NO: 519496 - RNA, 21 nt, Human
ugcgacaaagcgacaaagaaa

SEQ ID NO: 519497 - RNA, 25 nt, Human
ugcuccuaccuuacccccuccucca

SEQ ID NO: 519498 - RNA, 21 nt, Human
uggaaggcuguagcaggggau

SEQ ID NO: 519499 - RNA, 23 nt, Human
uggaauacauauaugaagaaugu

SEQ ID NO: 519500 - RNA, 23 nt, Human
uggcaguagugggagaaacccag

SEQ ID NO: 519501 - RNA, 18 nt, Human
uggcauuauuuauucaaa

SEQ ID NO: 519502 - RNA, 22 nt, Human
ugggagaaacccagagcuuccc

SEQ ID NO: 519503 - RNA, 20 nt, Human
uggggccaaaugccucaccc

SEQ ID NO: 519504 - RNA, 19 nt, Human
uggucugauuaccugugag

SEQ ID NO: 519505 - RNA, 20 nt, Human
ugguuacauggugguuuccu

SEQ ID NO: 519506 - RNA, 19 nt, Human
uguagaggucaaaaaccuu

SEQ ID NO: 519507 - RNA, 21 nt, Human
uguuaucaagcugggugcuga

SEQ ID NO: 519508 - RNA, 19 nt, Human
uguuuucuccucuggauua

SEQ ID NO: 519509 - RNA, 20 nt, Human
uuacagcuauaggaacaacc

SEQ ID NO: 519510 - RNA, 19 nt, Human
uucaaaagaaagagugaga

SEQ ID NO: 519511 - RNA, 20 nt, Human
uuccaggauaacaucuguag

SEQ ID NO: 519512 - RNA, 23 nt, Human
uucccgccgcccuaacaaucugc

SEQ ID NO: 519513 - RNA, 22 nt, Human
uugccagauaauuuagcuuaca

SEQ ID NO: 519514 - RNA, 19 nt, Human
uugccccucucaccaccuu

SEQ ID NO: 519515 - RNA, 22 nt, Human
uuggaacuucaggucaagggca

SEQ ID NO: 519516 - RNA, 23 nt, Human
uuguuuagggaugcaugcuugcg

SEQ ID NO: 519517 - RNA, 20 nt, Human
uuuccuuaguuuacuguuug

SEQ ID NO: 519518 - RNA, 19 nt, Human
uuugccccucucaccaccu

SEQ ID NO: 519519 - RNA, 20 nt, Human
uuugccccucucaccaccuu

SEQ ID NO: 519520 - RNA, 21 nt, Human
uuuggaaggcuguagcagggg

SEQ ID NO: 519521 - RNA, 19 nt, Human
aaacucacagaacugaggc

SEQ ID NO: 519522 - RNA, 23 nt, Human
aaccauuuuccaauaaaucuccu

SEQ ID NO: 519523 - RNA, 25 nt, Human
aagaaugcugucaucuggcugcugu

SEQ ID NO: 519524 - RNA, 23 nt, Human
aauuugugagagguugcaagccu

SEQ ID NO: 519525 - RNA, 25 nt, Human
agaauucucuccuguucuaaggcuu

SEQ ID NO: 519526 - RNA, 20 nt, Human
agccuuaaaauuugugagag

SEQ ID NO: 519527 - RNA, 18 nt, Human
agcugguggaauacugga

SEQ ID NO: 519528 - RNA, 21 nt, Human
aggcuucuauauacuuugagu

SEQ ID NO: 519529 - RNA, 20 nt, Human
aguaguuguuuuauucuaaa

SEQ ID NO: 519530 - RNA, 20 nt, Human
caaguccuuauauuuuugua

SEQ ID NO: 519531 - RNA, 22 nt, Human
caauaaaucuccuuuuagagcc

SEQ ID NO: 519532 - RNA, 23 nt, Human
caccuggaaaauccagaaucaaa

SEQ ID NO: 519533 - RNA, 20 nt, Human
caucugugccucucuaaaua

SEQ ID NO: 519534 - RNA, 21 nt, Human
cauucacaagaaugcugucau

SEQ ID NO: 519535 - RNA, 21 nt, Human
ccaaaaauugucaucugugcc

SEQ ID NO: 519536 - RNA, 21 nt, Human
cccaccuggaaaauccagaau

SEQ ID NO: 519537 - RNA, 23 nt, Human
ccccaaaaauugucaucugugcc

SEQ ID NO: 519538 - RNA, 24 nt, Human
ccuucaaaaaaacaaaucacugga

SEQ ID NO: 519539 - RNA, 26 nt, Human
ccuucaaaaaaacaaaucacuggagc

SEQ ID NO: 519540 - RNA, 21 nt, Human
cgaaaagcaaugauuuuacaa

SEQ ID NO: 519541 - RNA, 18 nt, Human
cucuaaauacauaugguc

SEQ ID NO: 519542 - RNA, 22 nt, Human
cugauacagaccuucaaaaaaa

SEQ ID NO: 519543 - RNA, 25 nt, Human
cuggaauuaauaaagcaguugauaa

SEQ ID NO: 519544 - RNA, 18 nt, Human
cuucuaggacugccaauu

SEQ ID NO: 519545 - RNA, 19 nt, Human
cuugaaccuaucagcagca

SEQ ID NO: 519546 - RNA, 24 nt, Human
gcacugaaguauuugcauauuguu

SEQ ID NO: 519547 - RNA, 18 nt, Human
gucaauuuguaaagcugg

SEQ ID NO: 519548 - RNA, 21 nt, Human
uaaaacacucauaauauuuuc

SEQ ID NO: 519549 - RNA, 22 nt, Human
uauucuugucuucucucuaaaa

SEQ ID NO: 519550 - RNA, 18 nt, Human
ucaauuuguaaagcuggu

SEQ ID NO: 519551 - RNA, 18 nt, Human
ucacuggagcuucucaug

SEQ ID NO: 519552 - RNA, 20 nt, Human
ucucuaaauacauauggucc

SEQ ID NO: 519553 - RNA, 19 nt, Human
ucuuauagucuuguauguc

SEQ ID NO: 519554 - RNA, 24 nt, Human
ugaagagcuagccuuaaaauuugu

SEQ ID NO: 519555 - RNA, 19 nt, Human
ugagaauggcacaaguccu

SEQ ID NO: 519556 - RNA, 19 nt, Human
ugauuccauccuuuccaga

SEQ ID NO: 519557 - RNA, 22 nt, Human
ugccaaaagaguaaaccauuuu

SEQ ID NO: 519558 - RNA, 19 nt, Human
uggcugcugugggcagaca

SEQ ID NO: 519559 - RNA, 21 nt, Human
uuccuugaaccuaucagcagc

SEQ ID NO: 519560 - RNA, 19 nt, Human
uucgucuucuaggacugcc

SEQ ID NO: 519561 - RNA, 22 nt, Human
uucuaaggcuucuauauacuuu

SEQ ID NO: 519562 - RNA, 19 nt, Human
uucuuauagucuuguaugu

SEQ ID NO: 519563 - RNA, 24 nt, Human
uugcauauuguuugauuccauccu

SEQ ID NO: 519564 - RNA, 21 nt, Human
uuuaaagaauuccuugaaccu

SEQ ID NO: 519565 - RNA, 24 nt, Human
aaacacgcgcucugccacguccuc

SEQ ID NO: 519566 - RNA, 21 nt, Human
aagcaggaacaaacagggcug

SEQ ID NO: 519567 - RNA, 18 nt, Human
agccaggcugcgggaaga

SEQ ID NO: 519568 - RNA, 18 nt, Human
aggcauuggcuggauaga

SEQ ID NO: 519569 - RNA, 23 nt, Human
caggagccaggcugcgggaagag

SEQ ID NO: 519570 - RNA, 22 nt, Human
cgaccagaaacacgcgcucugc

SEQ ID NO: 519571 - RNA, 21 nt, Human
cucuggcugaggccccaggag

SEQ ID NO: 519572 - RNA, 20 nt, Human
cuggcagcucuggcugaggc

SEQ ID NO: 519573 - RNA, 21 nt, Human
gcagugguagcgcagcuggau

SEQ ID NO: 519574 - RNA, 23 nt, Human
ggaagagguuuccuuucucuggc

SEQ ID NO: 519575 - RNA, 19 nt, Human
ggaggugggcuggcaguga

SEQ ID NO: 519576 - RNA, 20 nt, Human
ggccggggguuugacucugc

SEQ ID NO: 519577 - RNA, 27 nt, Human
ggcugcgggaagagguuuccuuucucu

SEQ ID NO: 519578 - RNA, 24 nt, Human
gugggcuggcagugaggccaggug

SEQ ID NO: 519579 - RNA, 22 nt, Human
uccgcgggcuucgcuggguugc

SEQ ID NO: 519580 - RNA, 21 nt, Human
ucugccacguccuccuccgcg

SEQ ID NO: 519581 - RNA, 18 nt, Human
uggcagugaggccaggug

SEQ ID NO: 519582 - RNA, 23 nt, Human
uguuuauuuacaggaaaaucaug

SEQ ID NO: 519583 - RNA, 22 nt, Human
aagcgcuucagugucaggacuc

SEQ ID NO: 519584 - RNA, 22 nt, Human
aaggugccuccgggccaggggc

SEQ ID NO: 519585 - RNA, 21 nt, Human
acacaaggcccccaaggcacu

SEQ ID NO: 519586 - RNA, 21 nt, Human
acauuuacacacaaggccccc

SEQ ID NO: 519587 - RNA, 23 nt, Human
agcaagaucagcacuggaggaga

SEQ ID NO: 519588 - RNA, 25 nt, Human
aggcccagcaagaucagcacuggag

SEQ ID NO: 519589 - RNA, 18 nt, Human
cacaaggcccccaaggca

SEQ ID NO: 519590 - RNA, 22 nt, Human
caggagucguccggccgggccu

SEQ ID NO: 519591 - RNA, 23 nt, Human
caggcccucccuuccugcccucc

SEQ ID NO: 519592 - RNA, 23 nt, Human
ccaugggaccagccucccucaca

SEQ ID NO: 519593 - RNA, 26 nt, Human
ccccaaggcacugcuucccacccccc

SEQ ID NO: 519594 - RNA, 22 nt, Human
cccccaggcccucccuuccugc

SEQ ID NO: 519595 - RNA, 26 nt, Human
cccuccccguucagccaccuucuccc

SEQ ID NO: 519596 - RNA, 19 nt, Human
cccucccuuccugcccucc

SEQ ID NO: 519597 - RNA, 22 nt, Human
ccggccgggccuuggccuggga

SEQ ID NO: 519598 - RNA, 21 nt, Human
ccucccuuccugcccuccccg

SEQ ID NO: 519599 - RNA, 21 nt, Human
ccugcccuccccguucagcca

SEQ ID NO: 519600 - RNA, 20 nt, Human
ccuuguggccauggccuagc

SEQ ID NO: 519601 - RNA, 18 nt, Human
cugcccuccccguucagc

SEQ ID NO: 519602 - RNA, 21 nt, Human
cuggaggagaagcagccuuug

SEQ ID NO: 519603 - RNA, 24 nt, Human
gacuucagagccccacuuuugggg

SEQ ID NO: 519604 - RNA, 21 nt, Human
gagccccacuuuuggggacug

SEQ ID NO: 519605 - RNA, 22 nt, Human
gcacugcuucccaccccccagg

SEQ ID NO: 519606 - RNA, 21 nt, Human
gccuagcguucccuggggaca

SEQ ID NO: 519607 - RNA, 19 nt, Human
gccugggagggagccaggc

SEQ ID NO: 519608 - RNA, 21 nt, Human
gccuuggccugggagggagcc

SEQ ID NO: 519609 - RNA, 23 nt, Human
ggacacgaugggggccaccuggg

SEQ ID NO: 519610 - RNA, 23 nt, Human
ggagaagcagccuuugcuuuggg

SEQ ID NO: 519611 - RNA, 19 nt, Human
ggcagccgguggugguggu

SEQ ID NO: 519612 - RNA, 19 nt, Human
ggccauggccuagcguucc

SEQ ID NO: 519613 - RNA, 22 nt, Human
ggccuagcguucccuggggaca

SEQ ID NO: 519614 - RNA, 21 nt, Human
ggccugggagggagccaggcu

SEQ ID NO: 519615 - RNA, 23 nt, Human
ggccuuggccugggagggagcca

SEQ ID NO: 519616 - RNA, 18 nt, Human
uacacacaaggcccccaa

SEQ ID NO: 519617 - RNA, 18 nt, Human
ucagugucaggacucugg

SEQ ID NO: 519618 - RNA, 23 nt, Human
uccaugagccccuuguggccaug

SEQ ID NO: 519619 - RNA, 26 nt, Human
ucccaccccccaggcccucccuuccu

SEQ ID NO: 519620 - RNA, 21 nt, Human
uccccguucagccaccuucuc

SEQ ID NO: 519621 - RNA, 24 nt, Human
ucccuggggacacgaugggggcca

SEQ ID NO: 519622 - RNA, 23 nt, Human
uccgagacuucagagccccacuu

SEQ ID NO: 519623 - RNA, 23 nt, Human
uccggccgggccuuggccuggga

SEQ ID NO: 519624 - RNA, 23 nt, Human
ugcuucccaccccccaggcccuc

SEQ ID NO: 519625 - RNA, 19 nt, Human
uggaagaggaaggccaugg

SEQ ID NO: 519626 - RNA, 22 nt, Human
ugggaccagccucccucacagg

SEQ ID NO: 519627 - RNA, 21 nt, Human
uggguuuacaggagucguccg

SEQ ID NO: 519628 - RNA, 19 nt, Human
uucucccuccccuccuucc

SEQ ID NO: 519629 - RNA, 20 nt, Human
aagaaacuucaaaacaucuu

SEQ ID NO: 519630 - RNA, 19 nt, Human
aagaagacccuucugugac

SEQ ID NO: 519631 - RNA, 25 nt, Human
acuccaagaagugaugacugugaag

SEQ ID NO: 519632 - RNA, 21 nt, Human
agaagcaagguaaccaacucc

SEQ ID NO: 519633 - RNA, 21 nt, Human
agagaacaggguacggaucau

SEQ ID NO: 519634 - RNA, 22 nt, Human
ccagauaacugcuaagucuaaa

SEQ ID NO: 519635 - RNA, 19 nt, Human
cuaaauugguccuucaaug

SEQ ID NO: 519636 - RNA, 18 nt, Human
uaaaugaaaaacuucuuc

SEQ ID NO: 519637 - RNA, 23 nt, Human
uaaccaacuccaagaagugauga

SEQ ID NO: 519638 - RNA, 21 nt, Human
uaauaagccuuucuauuuccc

SEQ ID NO: 519639 - RNA, 18 nt, Human
uaucuaaagagaacaggg

SEQ ID NO: 519640 - RNA, 22 nt, Human
ucuccagauaacugcuaagucu

SEQ ID NO: 519641 - RNA, 20 nt, Human
ugaaaaacuucuucuaggag

SEQ ID NO: 519642 - RNA, 22 nt, Human
ugaaaaacuucuucuaggaggu

SEQ ID NO: 519643 - RNA, 24 nt, Human
ugaaaaacuucuucuaggagguua

SEQ ID NO: 519644 - RNA, 21 nt, Human
ugaugacugugaagauaucua

SEQ ID NO: 519645 - RNA, 20 nt, Human
ugggaaagacuuaacagguu

SEQ ID NO: 519646 - RNA, 23 nt, Human
uuagguaucaaacaaauucugcu

SEQ ID NO: 519647 - RNA, 23 nt, Human
acauugaaaagaaguaaaaggaa

SEQ ID NO: 519648 - RNA, 20 nt, Human
agcgacagaagccuggguac

SEQ ID NO: 519649 - RNA, 25 nt, Human
aggcaccaggucccucucgggcugg

SEQ ID NO: 519650 - RNA, 24 nt, Human
aggcgacagagcgacagaagccug

SEQ ID NO: 519651 - RNA, 23 nt, Human
auagaguuucucccaagugugaa

SEQ ID NO: 519652 - RNA, 23 nt, Human
auaggguuucacuccaguguaac

SEQ ID NO: 519653 - RNA, 25 nt, Human
caccaggucccucucgggcuggucu

SEQ ID NO: 519654 - RNA, 21 nt, Human
cagaagccuggguacaggcac

SEQ ID NO: 519655 - RNA, 22 nt, Human
ccgguuaccaaccgccgcccgc

SEQ ID NO: 519656 - RNA, 23 nt, Human
ccuuucaugacauugaaaagaag

SEQ ID NO: 519657 - RNA, 20 nt, Human
cucgggcuggucugaccggu

SEQ ID NO: 519658 - RNA, 20 nt, Human
gaaagcgacccccuccauuu

SEQ ID NO: 519659 - RNA, 22 nt, Human
gcgcagcgaggaaggugaggaa

SEQ ID NO: 519660 - RNA, 19 nt, Human
uauucaaagaaucuuggca

SEQ ID NO: 519661 - RNA, 22 nt, Human
ucucccaagugugaacccuucc

SEQ ID NO: 519662 - RNA, 19 nt, Human
ugaaaagaaguaaaaggaa

SEQ ID NO: 519663 - RNA, 21 nt, Human
ugaaaagaaguaaaaggaaug

SEQ ID NO: 519664 - RNA, 18 nt, Human
ugaccgguuaccaaccgc

SEQ ID NO: 519665 - RNA, 23 nt, Human
uggguacaggcaccaggucccuc

SEQ ID NO: 519666 - RNA, 24 nt, Human
uucaugauaucaaacggaacuaga

SEQ ID NO: 519667 - RNA, 24 nt, Human
uucaugauaucgaaaagaacugga

SEQ ID NO: 519668 - RNA, 21 nt, Human
uugaaggugcgaggcacaucu

SEQ ID NO: 519669 - RNA, 28 nt, Human
aaaacaaaacaaaacaaaacacaaaccc

SEQ ID NO: 519670 - RNA, 22 nt, Human
aaaacaaaacaaaacacaaacc

SEQ ID NO: 519671 - RNA, 24 nt, Human
aaacaaaacaaaacaaaacacaaa

SEQ ID NO: 519672 - RNA, 19 nt, Human
aaagugcuggaauuacagg

SEQ ID NO: 519673 - RNA, 20 nt, Human
aaagugcuggaauuacaggg

SEQ ID NO: 519674 - RNA, 19 nt, Human
aaauuccuggcaaguuagc

SEQ ID NO: 519675 - RNA, 19 nt, Human
aacuagaccucuaagggca

SEQ ID NO: 519676 - RNA, 26 nt, Human
aagugcuggaauuacagggaugagcc

SEQ ID NO: 519677 - RNA, 21 nt, Human
aauuacagggaugagccacug

SEQ ID NO: 519678 - RNA, 22 nt, Human
acaaaacaaaacaaaacacaaa

SEQ ID NO: 519679 - RNA, 23 nt, Human
accauguuggucaggcuggucuc

SEQ ID NO: 519680 - RNA, 19 nt, Human
accccacgcacacacacaa

SEQ ID NO: 519681 - RNA, 21 nt, Human
acgggguuucaccauguuggu

SEQ ID NO: 519682 - RNA, 23 nt, Human
acgggguuucaccauguugguca

SEQ ID NO: 519683 - RNA, 24 nt, Human
acgggguuucaccauguuggucag

SEQ ID NO: 519684 - RNA, 25 nt, Human
acucugucgcccaggcuggagugca

SEQ ID NO: 519685 - RNA, 24 nt, Human
acuucgugauccgcccgccuuggc

SEQ ID NO: 519686 - RNA, 23 nt, Human
agcugggauuacaggugugugcc

SEQ ID NO: 519687 - RNA, 25 nt, Human
aggcuggagugcaguggcacaaucu

SEQ ID NO: 519688 - RNA, 18 nt, Human
aguagcugggauuacagg

SEQ ID NO: 519689 - RNA, 21 nt, Human
aguagcugggauuacaggugu

SEQ ID NO: 519690 - RNA, 23 nt, Human
aguagcugggauuacaggugugu

SEQ ID NO: 519691 - RNA, 25 nt, Human
aguagcugggauuacaggugugugc

SEQ ID NO: 519692 - RNA, 20 nt, Human
agugcaguggcacaaucuug

SEQ ID NO: 519693 - RNA, 24 nt, Human
agugcaguggcacaaucuuggcuc

SEQ ID NO: 519694 - RNA, 18 nt, Human
auccgcccgccuuggccu

SEQ ID NO: 519695 - RNA, 19 nt, Human
auuacaggugugugccacc

SEQ ID NO: 519696 - RNA, 24 nt, Human
auuuuuguauuuuuaguagagacg

SEQ ID NO: 519697 - RNA, 21 nt, Human
caaaaauguuaaguaugcugu

SEQ ID NO: 519698 - RNA, 25 nt, Human
caaaacaaaacaaaacacaaacccc

SEQ ID NO: 519699 - RNA, 20 nt, Human
caaaacaaaacacaaacccc

SEQ ID NO: 519700 - RNA, 21 nt, Human
caaaacacaaaccccacgcac

SEQ ID NO: 519701 - RNA, 24 nt, Human
caaagugcuggaauuacagggaug

SEQ ID NO: 519702 - RNA, 22 nt, Human
caagcgauuuuccugccucggc

SEQ ID NO: 519703 - RNA, 21 nt, Human
caccaaaggcaaugaucaagu

SEQ ID NO: 519704 - RNA, 24 nt, Human
caccacacccggcuaauuuuugua

SEQ ID NO: 519705 - RNA, 21 nt, Human
caccauguuggucaggcuggu

SEQ ID NO: 519706 - RNA, 24 nt, Human
caccauguuggucaggcuggucuc

SEQ ID NO: 519707 - RNA, 24 nt, Human
cacucugucgcccaggcuggagug

SEQ ID NO: 519708 - RNA, 19 nt, Human
cacugcaaccucugccugc

SEQ ID NO: 519709 - RNA, 22 nt, Human
cacugugccgggccaaagcaga

SEQ ID NO: 519710 - RNA, 24 nt, Human
cacugugccgggccaaagcagaau

SEQ ID NO: 519711 - RNA, 25 nt, Human
cacuugugucuacaaugucccuuuu

SEQ ID NO: 519712 - RNA, 26 nt, Human
cagcaauugggauacaauauuagugc

SEQ ID NO: 519713 - RNA, 22 nt, Human
caguggauuguuuaguaaguuu

SEQ ID NO: 519714 - RNA, 19 nt, Human
ccaaagugcuggaauuaca

SEQ ID NO: 519715 - RNA, 21 nt, Human
ccaaagugcuggaauuacagg

SEQ ID NO: 519716 - RNA, 20 nt, Human
ccaccacacccggcuaauuu

SEQ ID NO: 519717 - RNA, 22 nt, Human
ccagguucaagcgauuuuccug

SEQ ID NO: 519718 - RNA, 22 nt, Human
cccgccuuggccuuccaaagug

SEQ ID NO: 519719 - RNA, 22 nt, Human
ccugaguagcugggauuacagg

SEQ ID NO: 519720 - RNA, 22 nt, Human
ccugaguagcugggauuacagg

SEQ ID NO: 519721 - RNA, 23 nt, Human
ccugaguagcugggauuacaggu

SEQ ID NO: 519722 - RNA, 24 nt, Human
ccugaguagcugggauuacaggug

SEQ ID NO: 519723 - RNA, 24 nt, Human
ccugccagguucaagcgauuuucc

SEQ ID NO: 519724 - RNA, 24 nt, Human
ccugccucggccuccugaguagcu

SEQ ID NO: 519725 - RNA, 18 nt, Human
cgcacacacacaaaaaug

SEQ ID NO: 519726 - RNA, 22 nt, Human
cgcacacacacaaaaauguuaa

SEQ ID NO: 519727 - RNA, 24 nt, Human
cgggguuucaccauguuggucagg

SEQ ID NO: 519728 - RNA, 23 nt, Human
cuaauuuuuguauuuuuaguaga

SEQ ID NO: 519729 - RNA, 24 nt, Human
cucacucugucgcccaggcuggag

SEQ ID NO: 519730 - RNA, 19 nt, Human
cucacugcaaccucugccu

SEQ ID NO: 519731 - RNA, 19 nt, Human
cucccacguagaaacccug

SEQ ID NO: 519732 - RNA, 24 nt, Human
cucccgacuucgugauccgcccgc

SEQ ID NO: 519733 - RNA, 24 nt, Human
cucggccuccugaguagcugggau

SEQ ID NO: 519734 - RNA, 21 nt, Human
cugaguagcugggauuacagg

SEQ ID NO: 519735 - RNA, 24 nt, Human
cugaguagcugggauuacaggugu

SEQ ID NO: 519736 - RNA, 24 nt, Human
cugcaaccucugccugccagguuc

SEQ ID NO: 519737 - RNA, 25 nt, Human
cugccagguucaagcgauuuuccug

SEQ ID NO: 519738 - RNA, 19 nt, Human
cugucgcccaggcuggagu

SEQ ID NO: 519739 - RNA, 21 nt, Human
gacuucgugauccgcccgccu

SEQ ID NO: 519740 - RNA, 24 nt, Human
gacuucgugauccgcccgccuugg

SEQ ID NO: 519741 - RNA, 23 nt, Human
gagacgggguuucaccauguugg

SEQ ID NO: 519742 - RNA, 24 nt, Human
gagacgggguuucaccauguuggu

SEQ ID NO: 519743 - RNA, 19 nt, Human
gaguagcugggauuacagg

SEQ ID NO: 519744 - RNA, 18 nt, Human
gauuacaggugugugcca

SEQ ID NO: 519745 - RNA, 22 nt, Human
gcaaccucugccugccagguuc

SEQ ID NO: 519746 - RNA, 19 nt, Human
gcccaggcuggagugcagu

SEQ ID NO: 519747 - RNA, 23 nt, Human
gcccaggcuggagugcaguggca

SEQ ID NO: 519748 - RNA, 18 nt, Human
gccuccugaguagcuggg

SEQ ID NO: 519749 - RNA, 20 nt, Human
gccucggccuccugaguagc

SEQ ID NO: 519750 - RNA, 21 nt, Human
gccucggccuccugaguagcu

SEQ ID NO: 519751 - RNA, 26 nt, Human
gcuggaauuacagggaugagccaguc

SEQ ID NO: 519752 - RNA, 19 nt, Human
gcuggagugcaguggcaca

SEQ ID NO: 519753 - RNA, 23 nt, Human
gggguuucaccauguuggucagg

SEQ ID NO: 519754 - RNA, 23 nt, Human
guagagacgggguuucaccaugu

SEQ ID NO: 519755 - RNA, 22 nt, Human
uaaaacaaucaacuagaccucu

SEQ ID NO: 519756 - RNA, 23 nt, Human
uaaguauaccacauauguaugga

SEQ ID NO: 519757 - RNA, 24 nt, Human
uaauuuuuguauuuuuaguagaga

SEQ ID NO: 519758 - RNA, 19 nt, Human
uacagggaugagccacugu

SEQ ID NO: 519759 - RNA, 22 nt, Human
uacagggaugagccacugugcc

SEQ ID NO: 519760 - RNA, 23 nt, Human
uacaggugugugccaccacaccc

SEQ ID NO: 519761 - RNA, 18 nt, Human
uacuuugaagagucacag

SEQ ID NO: 519762 - RNA, 22 nt, Human
uagaaaaacaaaacaaaacaaa

SEQ ID NO: 519763 - RNA, 22 nt, Human
uagagacgggguuucaccaugu

SEQ ID NO: 519764 - RNA, 24 nt, Human
uaguagagacgggguuucaccaug

SEQ ID NO: 519765 - RNA, 25 nt, Human
uaguagagacgggguuucaccaugu

SEQ ID NO: 519766 - RNA, 18 nt, Human
ucacugcaaccucugccu

SEQ ID NO: 519767 - RNA, 19 nt, Human
ucacugcaaccucugccug

SEQ ID NO: 519768 - RNA, 24 nt, Human
ucacugcaaccucugccugccagg

SEQ ID NO: 519769 - RNA, 24 nt, Human
uccacuggcucgaaggaauccuga

SEQ ID NO: 519770 - RNA, 24 nt, Human
uccugaacucccacguagaaaccc

SEQ ID NO: 519771 - RNA, 25 nt, Human
uccugaacucccacguagaaacccu

SEQ ID NO: 519772 - RNA, 24 nt, Human
uccugaguagcugggauuacaggu

SEQ ID NO: 519773 - RNA, 22 nt, Human
ucgcccaggcuggagugcagug

SEQ ID NO: 519774 - RNA, 23 nt, Human
ucggccuccugaguagcugggau

SEQ ID NO: 519775 - RNA, 23 nt, Human
ucucacucugucgcccaggcugg

SEQ ID NO: 519776 - RNA, 24 nt, Human
ucucacucugucgcccaggcugga

SEQ ID NO: 519777 - RNA, 26 nt, Human
ucucacucugucgcccaggcuggagu

SEQ ID NO: 519778 - RNA, 27 nt, Human
ucucacucugucgcccaggcuggagug

SEQ ID NO: 519779 - RNA, 24 nt, Human
ucugucgcccaggcuggagugcag

SEQ ID NO: 519780 - RNA, 22 nt, Human
ugcaguggcacaaucuuggcuc

SEQ ID NO: 519781 - RNA, 24 nt, Human
ugccagguucaagcgauuuuccug

SEQ ID NO: 519782 - RNA, 20 nt, Human
ugccucggccuccugaguaa

SEQ ID NO: 519783 - RNA, 24 nt, Human
ugccucggccuccugaguagcugg

SEQ ID NO: 519784 - RNA, 22 nt, Human
uggaauuacagggaugagccac

SEQ ID NO: 519785 - RNA, 22 nt, Human
uggaauuacagggaugagccac

SEQ ID NO: 519786 - RNA, 24 nt, Human
uggaauuacagggaugagccacug

SEQ ID NO: 519787 - RNA, 26 nt, Human
uggaauuacagggaugagccacugug

SEQ ID NO: 519788 - RNA, 24 nt, Human
uggagucucacucugucgcccagg

SEQ ID NO: 519789 - RNA, 23 nt, Human
uggagugcaguggcacaaucuug

SEQ ID NO: 519790 - RNA, 24 nt, Human
uggagugcaguggcacaaucuugg

SEQ ID NO: 519791 - RNA, 24 nt, Human
uggcacaaucuuggcucacugcaa

SEQ ID NO: 519792 - RNA, 21 nt, Human
uggcucacugcaaccucugcc

SEQ ID NO: 519793 - RNA, 18 nt, Human
ugggauuacaggugugug

SEQ ID NO: 519794 - RNA, 19 nt, Human
ugggauuacaggugugugc

SEQ ID NO: 519795 - RNA, 21 nt, Human
ugggauuacaggugugugcca

SEQ ID NO: 519796 - RNA, 22 nt, Human
ugggauuacaggugugugccac

SEQ ID NO: 519797 - RNA, 24 nt, Human
ugggauuacaggugugugccacca

SEQ ID NO: 519798 - RNA, 21 nt, Human
uggucaggcuggucucaaacu

SEQ ID NO: 519799 - RNA, 21 nt, Human
ugucccuuuugucaccaaagg

SEQ ID NO: 519800 - RNA, 18 nt, Human
uuaguagagacgggguuu

SEQ ID NO: 519801 - RNA, 22 nt, Human
uuaguagagacgggguuucacc

SEQ ID NO: 519802 - RNA, 24 nt, Human
uuaguagagacgggguuucaccau

SEQ ID NO: 519803 - RNA, 21 nt, Human
uucaagcgauuuuccugccuc

SEQ ID NO: 519804 - RNA, 23 nt, Human
uucaagcgauuuuccugccucgg

SEQ ID NO: 519805 - RNA, 24 nt, Human
uucaagcgauuuuccugccucggc

SEQ ID NO: 519806 - RNA, 23 nt, Human
uuguauuuuuaguagagacgggg

SEQ ID NO: 519807 - RNA, 24 nt, Human
uuucaccauguuggucaggcuggu

SEQ ID NO: 519808 - RNA, 24 nt, Human
uuuuuaguagagacgggguuucac

SEQ ID NO: 519809 - RNA, 20 nt, Human
uuuuuguauuuuuaguagag

SEQ ID NO: 519810 - RNA, 26 nt, Human
aaaaggagaacaaauaaacaacaaaa

SEQ ID NO: 519811 - RNA, 22 nt, Human
aaacaacaaaaacaacaacaac

SEQ ID NO: 519812 - RNA, 24 nt, Human
aacaacaaaaacaacaacaacaac

SEQ ID NO: 519813 - RNA, 20 nt, Human
acaaaaacaacaacaacaaa

SEQ ID NO: 519814 - RNA, 24 nt, Human
acaaaaacaacaacaacaacaaaa

SEQ ID NO: 519815 - RNA, 20 nt, Human
acaacaacaacaacaaaaag

SEQ ID NO: 519816 - RNA, 24 nt, Human
acaacaacaacaacaaaaaggcaa

SEQ ID NO: 519817 - RNA, 19 nt, Human
caaaaacaacaacaacaac

SEQ ID NO: 519818 - RNA, 27 nt, Human
caaaaacaacaacaacaacaaaaaggc

SEQ ID NO: 519819 - RNA, 20 nt, Human
caacaaaaacaacaacaaca

SEQ ID NO: 519820 - RNA, 26 nt, Human
caacaaaaacaacaacaacaacaaaa

SEQ ID NO: 519821 - RNA, 23 nt, Human
caacaaaaaggcaaauucaacug

SEQ ID NO: 519822 - RNA, 22 nt, Human
caacaacaacaacaaaaaggca

SEQ ID NO: 519823 - RNA, 24 nt, Human
caacaacaacaacaaaaaggcaaa

SEQ ID NO: 519824 - RNA, 27 nt, Human
caacaacaacaacaaaaaggcaaauuc

SEQ ID NO: 519825 - RNA, 20 nt, Human
cacacacccacacuugcgug

SEQ ID NO: 519826 - RNA, 25 nt, Human
cacacacccacacuugcguggcccc

SEQ ID NO: 519827 - RNA, 22 nt, Human
cacauacgcacacucacacacc

SEQ ID NO: 519828 - RNA, 18 nt, Human
caccaacccccaaaacac

SEQ ID NO: 519829 - RNA, 23 nt, Human
caccaacccccaaaacacaaaac

SEQ ID NO: 519830 - RNA, 22 nt, Human
caccaugcccuggggggucccc

SEQ ID NO: 519831 - RNA, 22 nt, Human
cagucccgggcugggaccuccu

SEQ ID NO: 519832 - RNA, 21 nt, Human
cauacgcacacucacacaccc

SEQ ID NO: 519833 - RNA, 24 nt, Human
cauacgcacacucacacacccaca

SEQ ID NO: 519834 - RNA, 21 nt, Human
cccaccaugcccugggggguc

SEQ ID NO: 519835 - RNA, 25 nt, Human
ccccacauacgcacacucacacacc

SEQ ID NO: 519836 - RNA, 18 nt, Human
ccccuuggacugguuccc

SEQ ID NO: 519837 - RNA, 20 nt, Human
cccuuggacugguucccagg

SEQ ID NO: 519838 - RNA, 21 nt, Human
ccucagaccccaccaugcccu

SEQ ID NO: 519839 - RNA, 22 nt, Human
cgccucagaccccaccaugccc

SEQ ID NO: 519840 - RNA, 19 nt, Human
cuaggcacagcaacagagc

SEQ ID NO: 519841 - RNA, 20 nt, Human
cuuggacugguucccagggc

SEQ ID NO: 519842 - RNA, 18 nt, Human
cuuuguccaccaaccccc

SEQ ID NO: 519843 - RNA, 25 nt, Human
guccccacauacgcacacucacaca

SEQ ID NO: 519844 - RNA, 21 nt, Human
uaaaaggagaacaaauaaaca

SEQ ID NO: 519845 - RNA, 19 nt, Human
uccaccaacccccaaaaca

SEQ ID NO: 519846 - RNA, 22 nt, Human
uccaccaacccccaaaacacaa

SEQ ID NO: 519847 - RNA, 24 nt, Human
uucccagggcagaggggcgggcaa

SEQ ID NO: 519848 - RNA, 21 nt, Human
uuuguccaccaacccccaaaa

SEQ ID NO: 519849 - RNA, 19 nt, Human
uuuuuuuuuuuuuuuuuaa

SEQ ID NO: 519850 - RNA, 20 nt, Human
aaaccaaaccccacaacuga

SEQ ID NO: 519851 - RNA, 20 nt, Human
aaacgcccuggagaggccga

SEQ ID NO: 519852 - RNA, 19 nt, Human
aacacaugaaaccaaaccc

SEQ ID NO: 519853 - RNA, 20 nt, Human
aaguggaagggaaagaaggg

SEQ ID NO: 519854 - RNA, 22 nt, Human
acaaaaaacaccgaacaaugca

SEQ ID NO: 519855 - RNA, 21 nt, Human
acacaugaaaccaaaccccac

SEQ ID NO: 519856 - RNA, 22 nt, Human
acacaugaaaccaaaccccaca

SEQ ID NO: 519857 - RNA, 22 nt, Human
acgaguugacauguacaaaaaa

SEQ ID NO: 519858 - RNA, 18 nt, Human
agaggccgaagggaggag

SEQ ID NO: 519859 - RNA, 20 nt, Human
agcguguuggagaucucaag

SEQ ID NO: 519860 - RNA, 22 nt, Human
agcuaaauuuuccccuccccaa

SEQ ID NO: 519861 - RNA, 24 nt, Human
agggaggguggggggaggcagaga

SEQ ID NO: 519862 - RNA, 21 nt, Human
aggggacagggaggguggggg

SEQ ID NO: 519863 - RNA, 23 nt, Human
caacugagcuccuccugccuauc

SEQ ID NO: 519864 - RNA, 18 nt, Human
cagcguguuggagaucuc

SEQ ID NO: 519865 - RNA, 19 nt, Human
cagcguguuggagaucuca

SEQ ID NO: 519866 - RNA, 19 nt, Human
ccaaaccccacaacugagg

SEQ ID NO: 519867 - RNA, 28 nt, Human
cccacaacugaggcuaagauuuaagagc

SEQ ID NO: 519868 - RNA, 19 nt, Human
cccuccauguuugcaggca

SEQ ID NO: 519869 - RNA, 23 nt, Human
ccgacaacugagcuccuccugcc

SEQ ID NO: 519870 - RNA, 27 nt, Human
ccuccagcaccaccggacagggacugg

SEQ ID NO: 519871 - RNA, 21 nt, Human
ccucccugcucuagaagugga

SEQ ID NO: 519872 - RNA, 19 nt, Human
cgcccuggagaggccgaag

SEQ ID NO: 519873 - RNA, 22 nt, Human
gagccuccagcaccaccggaca

SEQ ID NO: 519874 - RNA, 23 nt, Human
gagcuaaauuuuccccuccccaa

SEQ ID NO: 519875 - RNA, 23 nt, Human
gaggguggggggaggcagagggg

SEQ ID NO: 519876 - RNA, 20 nt, Human
gcuaaauuuuccccucccca

SEQ ID NO: 519877 - RNA, 20 nt, Human
ggccaacaggggacagggag

SEQ ID NO: 519878 - RNA, 21 nt, Human
gggaggaggggcagcacugga

SEQ ID NO: 519879 - RNA, 23 nt, Human
ggggacagggaggguggggggag

SEQ ID NO: 519880 - RNA, 21 nt, Human
ggguggggggaggcagagggg

SEQ ID NO: 519881 - RNA, 18 nt, Human
gguggggggaggcagagg

SEQ ID NO: 519882 - RNA, 20 nt, Human
uaaauuuuccccuccccaag

SEQ ID NO: 519883 - RNA, 21 nt, Human
uaacacaugaaaccaaacccc

SEQ ID NO: 519884 - RNA, 22 nt, Human
uagaaguggaagggaaagaagg

SEQ ID NO: 519885 - RNA, 23 nt, Human
uaucuaacacaugaaaccaaacc

SEQ ID NO: 519886 - RNA, 23 nt, Human
uccccaagccucccugcucuaga

SEQ ID NO: 519887 - RNA, 22 nt, Human
ucuaacacaugaaaccaaaccc

SEQ ID NO: 519888 - RNA, 22 nt, Human
ugcagaauucaucgcaagacua

SEQ ID NO: 519889 - RNA, 19 nt, Human
uggagaggccgaagggagg

SEQ ID NO: 519890 - RNA, 21 nt, Human
uguccgacaacugagcuccuc

SEQ ID NO: 519891 - RNA, 22 nt, Human
uguccgacaacugagcuccucc

SEQ ID NO: 519892 - RNA, 21 nt, Human
uguggccaaaugcccuccaug

SEQ ID NO: 519893 - RNA, 26 nt, Human
uguggccaaaugcccuccauguuugc

SEQ ID NO: 519894 - RNA, 21 nt, Human
uuaagagcuacccagagcuaa

SEQ ID NO: 519895 - RNA, 19 nt, Human
uucaagaacccaauuuaau

SEQ ID NO: 519896 - RNA, 23 nt, Human
uuccccuccccaagccucccugc

SEQ ID NO: 519897 - RNA, 24 nt, Human
uuuuuuuuuuuuuuuuuuuucaag

SEQ ID NO: 519898 - RNA, 22 nt, Human
aaagcaccucccaggguccccc

SEQ ID NO: 519899 - RNA, 21 nt, Human
aacaccacccccccggccacc

SEQ ID NO: 519900 - RNA, 26 nt, Human
aagcaccucccagggucccccgaccc

SEQ ID NO: 519901 - RNA, 21 nt, Human
acccuggagaggagccguggu

SEQ ID NO: 519902 - RNA, 20 nt, Human
agaggacccuggcucccaac

SEQ ID NO: 519903 - RNA, 21 nt, Human
agagguccccucucuccaccc

SEQ ID NO: 519904 - RNA, 21 nt, Human
agcaccucccagggucccccg

SEQ ID NO: 519905 - RNA, 20 nt, Human
agccuugagaggucaguagc

SEQ ID NO: 519906 - RNA, 25 nt, Human
aggacccuggcucccaaccccagcc

SEQ ID NO: 519907 - RNA, 18 nt, Human
aggcccgagggccagcgg

SEQ ID NO: 519908 - RNA, 22 nt, Human
aguagggggaagagguccccuc

SEQ ID NO: 519909 - RNA, 20 nt, Human
caccagggacauggcagggc

SEQ ID NO: 519910 - RNA, 18 nt, Human
caccuccuucccccaacc

SEQ ID NO: 519911 - RNA, 21 nt, Human
caccuccuucccccaacccaa

SEQ ID NO: 519912 - RNA, 23 nt, Human
cacucgggaggcccgagggccag

SEQ ID NO: 519913 - RNA, 20 nt, Human
cagcauaggggcugggaugg

SEQ ID NO: 519914 - RNA, 18 nt, Human
cagggcccgagggcgcga

SEQ ID NO: 519915 - RNA, 20 nt, Human
ccaccuccuucccccaaccc

SEQ ID NO: 519916 - RNA, 23 nt, Human
ccagcgcaagggugugcaggaag

SEQ ID NO: 519917 - RNA, 27 nt, Human
cccaaccccagccaucagccccagagc

SEQ ID NO: 519918 - RNA, 18 nt, Human
cccagauuggaggaagcc

SEQ ID NO: 519919 - RNA, 18 nt, Human
ccccacaagcccuccugc

SEQ ID NO: 519920 - RNA, 19 nt, Human
ccccagagcccugucucca

SEQ ID NO: 519921 - RNA, 22 nt, Human
ccccagccaucagccccagagc

SEQ ID NO: 519922 - RNA, 24 nt, Human
cccccaacccaacagacuaguuca

SEQ ID NO: 519923 - RNA, 22 nt, Human
ccccgggguugucagcacuggg

SEQ ID NO: 519924 - RNA, 19 nt, Human
ccccucucuccacccccuc

SEQ ID NO: 519925 - RNA, 24 nt, Human
ccccucucuccacccccucagucc

SEQ ID NO: 519926 - RNA, 19 nt, Human
ccuccccacaagcccuccu

SEQ ID NO: 519927 - RNA, 20 nt, Human
ccuccuccagcgcaaggguu

SEQ ID NO: 519928 - RNA, 25 nt, Human
ccuccucccagcguagcuggggcag

SEQ ID NO: 519929 - RNA, 18 nt, Human
ccuccugcccucaguggg

SEQ ID NO: 519930 - RNA, 26 nt, Human
ccuggcucccaaccccagccaucagc

SEQ ID NO: 519931 - RNA, 21 nt, Human
ccugguccccuugaaacccug

SEQ ID NO: 519932 - RNA, 21 nt, Human
ccugucuccacgggggugggg

SEQ ID NO: 519933 - RNA, 20 nt, Human
ccuguuggugucccucccca

SEQ ID NO: 519934 - RNA, 22 nt, Human
cggccaccaucggggucagcau

SEQ ID NO: 519935 - RNA, 21 nt, Human
cgugaaggggcagggaggccg

SEQ ID NO: 519936 - RNA, 23 nt, Human
cucccaaccccagccaucagccc

SEQ ID NO: 519937 - RNA, 23 nt, Human
cucccagcguagcuggggcagcc

SEQ ID NO: 519938 - RNA, 24 nt, Human
cuccccacaagcccuccugcccuc

SEQ ID NO: 519939 - RNA, 18 nt, Human
cuccccuccuccagcgca

SEQ ID NO: 519940 - RNA, 20 nt, Human
cuccccuccuccagcgcaag

SEQ ID NO: 519941 - RNA, 30 nt, Human
cugagacaaugacugcgucggccuccuccu

SEQ ID NO: 519942 - RNA, 21 nt, Human
cugguccccuugaaacccugu

SEQ ID NO: 519943 - RNA, 22 nt, Human
gaacaccacccccccggccacc

SEQ ID NO: 519944 - RNA, 21 nt, Human
gaagagguccccucucuccac

SEQ ID NO: 519945 - RNA, 19 nt, Human
gacaaugacugcgucggcc

SEQ ID NO: 519946 - RNA, 21 nt, Human
gccaccuccuucccccaaccc

SEQ ID NO: 519947 - RNA, 21 nt, Human
gccccagagcccugucuccac

SEQ ID NO: 519948 - RNA, 18 nt, Human
ggagcccugggggauggc

SEQ ID NO: 519949 - RNA, 25 nt, Human
ggaggcccgagggccagcggggguu

SEQ ID NO: 519950 - RNA, 20 nt, Human
ggcagaguagggggaagagg

SEQ ID NO: 519951 - RNA, 18 nt, Human
ggccucuucccuuucggg

SEQ ID NO: 519952 - RNA, 24 nt, Human
gggaacaccacccccccggccacc

SEQ ID NO: 519953 - RNA, 19 nt, Human
gggcagggaggcaggcggg

SEQ ID NO: 519954 - RNA, 21 nt, Human
gggcagggaggcaggcgggcc

SEQ ID NO: 519955 - RNA, 20 nt, Human
ggggagggggagggucccgg

SEQ ID NO: 519956 - RNA, 18 nt, Human
ggggguggggagggggag

SEQ ID NO: 519957 - RNA, 19 nt, Human
gggguggggguggggaggg

SEQ ID NO: 519958 - RNA, 19 nt, Human
ggguggggguggggagggg

SEQ ID NO: 519959 - RNA, 21 nt, Human
gggugugcaggaagggggcag

SEQ ID NO: 519960 - RNA, 22 nt, Human
ggugauggggagcccuggggga

SEQ ID NO: 519961 - RNA, 22 nt, Human
ggugugcaggaagggggcagag

SEQ ID NO: 519962 - RNA, 18 nt, Human
guaaagcaccucccaggg

SEQ ID NO: 519963 - RNA, 18 nt, Human
uccacccccucagucccc

SEQ ID NO: 519964 - RNA, 23 nt, Human
uccccacaagcccuccugcccuc

SEQ ID NO: 519965 - RNA, 27 nt, Human
uccccacauucugacuccugguccccu

SEQ ID NO: 519966 - RNA, 18 nt, Human
uccccuugaaacccuguu

SEQ ID NO: 519967 - RNA, 23 nt, Human
uccgggcaagaggacccuggcuc

SEQ ID NO: 519968 - RNA, 19 nt, Human
uccugggguuguccgggca

SEQ ID NO: 519969 - RNA, 18 nt, Human
ucuccacggggguggggg

SEQ ID NO: 519970 - RNA, 22 nt, Human
ucuccacggggguggggguggg

SEQ ID NO: 519971 - RNA, 20 nt, Human
ucucuccacccccucagucc

SEQ ID NO: 519972 - RNA, 24 nt, Human
ugacuccugguccccuugaaaccc

SEQ ID NO: 519973 - RNA, 25 nt, Human
ugacuccugguccccuugaaacccu

SEQ ID NO: 519974 - RNA, 23 nt, Human
ugcagccggccacucgggaggcc

SEQ ID NO: 519975 - RNA, 22 nt, Human
ugcccucagugggugggaggcg

SEQ ID NO: 519976 - RNA, 23 nt, Human
uggagaggaggaagaguccgggg

SEQ ID NO: 519977 - RNA, 19 nt, Human
uggcucaggacuugggcag

SEQ ID NO: 519978 - RNA, 19 nt, Human
uggcucaggacuugggcag

SEQ ID NO: 519979 - RNA, 21 nt, Human
ugggaaggcuuggggguagca

SEQ ID NO: 519980 - RNA, 23 nt, Human
uggggagcccugggggauggcag

SEQ ID NO: 519981 - RNA, 21 nt, Human
uggggagggggagggucccgg

SEQ ID NO: 519982 - RNA, 25 nt, Human
uggggcagccgcuggagcguguucu

SEQ ID NO: 519983 - RNA, 19 nt, Human
ugggggauggcagcauagg

SEQ ID NO: 519984 - RNA, 22 nt, Human
ugucccuccccacaagcccucc

SEQ ID NO: 519985 - RNA, 21 nt, Human
ugucuccacgggggugggggu

SEQ ID NO: 519986 - RNA, 24 nt, Human
ugucuccacggggguggggguggg

SEQ ID NO: 519987 - RNA, 23 nt, Human
uuagcggucuguaaagcaccucc

SEQ ID NO: 519988 - RNA, 23 nt, Human
uuggggcguccucuccucucggg

SEQ ID NO: 519989 - RNA, 18 nt, Human
uuuuuuuuuuuuuuuuug

SEQ ID NO: 519990 - RNA, 22 nt, Human
uuuuuuuuuuuuuuuuuuuggc

SEQ ID NO: 519991 - RNA, 28 nt, Human
uuuuuuuuuuuuuuuuuuuuuuuggggg

SEQ ID NO: 519992 - RNA, 21 nt, Human
aaaauaacgaaacugccccag

SEQ ID NO: 519993 - RNA, 18 nt, Human
aaaggccuaacaaccagu

SEQ ID NO: 519994 - RNA, 24 nt, Human
aaccaguaagauaauuuuagacaa

SEQ ID NO: 519995 - RNA, 23 nt, Human
acagcauggaaacacccaauguc

SEQ ID NO: 519996 - RNA, 18 nt, Human
accgcgcugaagacaguc

SEQ ID NO: 519997 - RNA, 21 nt, Human
agccuacagcauggaaacacc

SEQ ID NO: 519998 - RNA, 19 nt, Human
aggcauuggggaucagcuu

SEQ ID NO: 519999 - RNA, 24 nt, Human
aucacacaucaaagaccuagacuc

SEQ ID NO: 520000 - RNA, 24 nt, Human
caaaauaacgaaacugccccagua

SEQ ID NO: 520001 - RNA, 24 nt, Human
caaccagacuucccuagagaggcc

SEQ ID NO: 520002 - RNA, 25 nt, Human
caaccagacuucccuagagaggccc

SEQ ID NO: 520003 - RNA, 22 nt, Human
caaugcaggcgaagggcauggg

SEQ ID NO: 520004 - RNA, 24 nt, Human
cacccaaugucugcucuagccuau

SEQ ID NO: 520005 - RNA, 21 nt, Human
caccuguguucuuccugaggg

SEQ ID NO: 520006 - RNA, 19 nt, Human
cagcauggaaacacccaau

SEQ ID NO: 520007 - RNA, 24 nt, Human
cagccacacccuggucacagcaga

SEQ ID NO: 520008 - RNA, 20 nt, Human
caggagaaggggucaugggg

SEQ ID NO: 520009 - RNA, 21 nt, Human
caggagccuauucaggcucua

SEQ ID NO: 520010 - RNA, 21 nt, Human
ccacacacaucagaaagggua

SEQ ID NO: 520011 - RNA, 21 nt, Human
ccaggaaaggcaagcaugagg

SEQ ID NO: 520012 - RNA, 23 nt, Human
cgggagagggcugggucucagug

SEQ ID NO: 520013 - RNA, 21 nt, Human
cuauucaggcucuacaaccag

SEQ ID NO: 520014 - RNA, 20 nt, Human
cuccucaccgaggagccuuc

SEQ ID NO: 520015 - RNA, 22 nt, Human
cucugagacaccaaaggccuaa

SEQ ID NO: 520016 - RNA, 20 nt, Human
cuuugagccucacccuccuc

SEQ ID NO: 520017 - RNA, 24 nt, Human
gagaggccccgugccaguuagucc

SEQ ID NO: 520018 - RNA, 20 nt, Human
gagcuggggacaggagaagg

SEQ ID NO: 520019 - RNA, 18 nt, Human
ggaaaggcaagcaugagg

SEQ ID NO: 520020 - RNA, 20 nt, Human
ggaucuacugcucguccagu

SEQ ID NO: 520021 - RNA, 19 nt, Human
gggagagggcugggucuca

SEQ ID NO: 520022 - RNA, 21 nt, Human
gggaugggagcuggggacagg

SEQ ID NO: 520023 - RNA, 19 nt, Human
gggcaaugcaggcgaaggg

SEQ ID NO: 520024 - RNA, 21 nt, Human
gggcgcuccaggaacucugcu

SEQ ID NO: 520025 - RNA, 23 nt, Human
ggggccaggaaaggcaagcauga

SEQ ID NO: 520026 - RNA, 21 nt, Human
ggggcugggccugggggccag

SEQ ID NO: 520027 - RNA, 19 nt, Human
ggucauggggccaggagcc

SEQ ID NO: 520028 - RNA, 23 nt, Human
guucuuccugaggggugggggca

SEQ ID NO: 520029 - RNA, 18 nt, Human
guugcacauguagguugg

SEQ ID NO: 520030 - RNA, 18 nt, Human
uaaaaaggggcugggccu

SEQ ID NO: 520031 - RNA, 19 nt, Human
uagagguggaccugucccu

SEQ ID NO: 520032 - RNA, 25 nt, Human
uauaaacaaauaaaagauuaaauca

SEQ ID NO: 520033 - RNA, 18 nt, Human
ucaaagaccuagacuccu

SEQ ID NO: 520034 - RNA, 19 nt, Human
ucacacaucaaagaccuag

SEQ ID NO: 520035 - RNA, 21 nt, Human
uccucaccgaggagccuucuu

SEQ ID NO: 520036 - RNA, 20 nt, Human
ugcacauguagguuggaggu

SEQ ID NO: 520037 - RNA, 24 nt, Human
ugccagucuuagugccagggcaca

SEQ ID NO: 520038 - RNA, 18 nt, Human
ugggaugggagcugggga

SEQ ID NO: 520039 - RNA, 20 nt, Human
ugggccugggggccaggaaa

SEQ ID NO: 520040 - RNA, 21 nt, Human
uggggccaggagccuauucag

SEQ ID NO: 520041 - RNA, 20 nt, Human
ugggggccaggaaaggcaag

SEQ ID NO: 520042 - RNA, 23 nt, Human
uuaacccacaacugggaugggag

SEQ ID NO: 520043 - RNA, 21 nt, Human
uuccuuggagcugcaggcugc

SEQ ID NO: 520044 - RNA, 22 nt, Human
uuggagguagcccaggugucag

SEQ ID NO: 520045 - RNA, 25 nt, Human
cacucugucagucacaaaacauccu

SEQ ID NO: 520046 - RNA, 21 nt, Human
uacugggccuucaggaaguuc

SEQ ID NO: 520047 - RNA, 20 nt, Human
uccacaggccuggacacaca

SEQ ID NO: 520048 - RNA, 24 nt, Human
uggggagaauccacauugaccauc

SEQ ID NO: 520049 - RNA, 18 nt, Human
uguugccugcuuuggagg

SEQ ID NO: 520050 - RNA, 24 nt, Human
uuuuuuuuuuuuuuaaagccugga

SEQ ID NO: 520051 - RNA, 19 nt, Human
uuuuuuuuuuuuuuuuuaa

SEQ ID NO: 520052 - RNA, 19 nt, Human
aagcggccaagacagccag

SEQ ID NO: 520053 - RNA, 22 nt, Human
aagcggccaagacagccagaac

SEQ ID NO: 520054 - RNA, 23 nt, Human
aagcggccaagacagccagaaca

SEQ ID NO: 520055 - RNA, 24 nt, Human
accugccucucuccugcucuccua

SEQ ID NO: 520056 - RNA, 21 nt, Human
acugugcgacucaggcaccug

SEQ ID NO: 520057 - RNA, 24 nt, Human
aggcagggcuggcagaucuuggcu

SEQ ID NO: 520058 - RNA, 23 nt, Human
aggugggaguggagcuggcggga

SEQ ID NO: 520059 - RNA, 26 nt, Human
augggguggggcccaggaugggugcc

SEQ ID NO: 520060 - RNA, 22 nt, Human
caaacagaaagcggccaagaca

SEQ ID NO: 520061 - RNA, 25 nt, Human
cacaaacagaaagcggccaagacag

SEQ ID NO: 520062 - RNA, 22 nt, Human
cagggacucuccccaggucgaa

SEQ ID NO: 520063 - RNA, 20 nt, Human
cauuggccuccaugccuugu

SEQ ID NO: 520064 - RNA, 18 nt, Human
ccaugcagcgcugcugug

SEQ ID NO: 520065 - RNA, 21 nt, Human
cccaggucgaaggcccaaggc

SEQ ID NO: 520066 - RNA, 21 nt, Human
ccucugggggcucuucaacuc

SEQ ID NO: 520067 - RNA, 20 nt, Human
ccugggagguggccggugac

SEQ ID NO: 520068 - RNA, 23 nt, Human
ccugucuucuccauuggccucca

SEQ ID NO: 520069 - RNA, 18 nt, Human
cgaaggcccaaggccugg

SEQ ID NO: 520070 - RNA, 19 nt, Human
cggggcggggucugagcug

SEQ ID NO: 520071 - RNA, 25 nt, Human
cucacacuccucugggggcucuuca

SEQ ID NO: 520072 - RNA, 19 nt, Human
cucauggaggagacaggga

SEQ ID NO: 520073 - RNA, 21 nt, Human
cuggaaucuucuugaacacca

SEQ ID NO: 520074 - RNA, 22 nt, Human
cuucaacuccuucucuguuuca

SEQ ID NO: 520075 - RNA, 18 nt, Human
cuuccagcaccaucuccc

SEQ ID NO: 520076 - RNA, 19 nt, Human
cuuggaagcccacaugucc

SEQ ID NO: 520077 - RNA, 21 nt, Human
gaaggugggaguggagcuggc

SEQ ID NO: 520078 - RNA, 19 nt, Human
gacgugcucagcccguguc

SEQ ID NO: 520079 - RNA, 25 nt, Human
gagcaaggccacucggcgcacgcgg

SEQ ID NO: 520080 - RNA, 18 nt, Human
gagcuggugaucagccga

SEQ ID NO: 520081 - RNA, 25 nt, Human
gaucauuucaugggguggugggggg

SEQ ID NO: 520082 - RNA, 22 nt, Human
gaugugcaucuuccguggggcc

SEQ ID NO: 520083 - RNA, 18 nt, Human
gcagaucuuggcuucuuc

SEQ ID NO: 520084 - RNA, 22 nt, Human
gcugggagaccugccucucucc

SEQ ID NO: 520085 - RNA, 20 nt, Human
gcuuugugucagacacuggu

SEQ ID NO: 520086 - RNA, 23 nt, Human
ggaccccugggacucacacuccu

SEQ ID NO: 520087 - RNA, 20 nt, Human
ggaggacaugaguggaugaa

SEQ ID NO: 520088 - RNA, 19 nt, Human
ggcagaucuuggcuucuuc

SEQ ID NO: 520089 - RNA, 19 nt, Human
gggaguggaggcagggaga

SEQ ID NO: 520090 - RNA, 19 nt, Human
gggcggggucugagcuggg

SEQ ID NO: 520091 - RNA, 18 nt, Human
ggggcggggucugagcug

SEQ ID NO: 520092 - RNA, 24 nt, Human
gggugagagaacaggcagggcugg

SEQ ID NO: 520093 - RNA, 22 nt, Human
gguccacuuggaagcccacaug

SEQ ID NO: 520094 - RNA, 19 nt, Human
ggugagagaacaggcaggg

SEQ ID NO: 520095 - RNA, 20 nt, Human
ggugguggggggaguggagg

SEQ ID NO: 520096 - RNA, 25 nt, Human
guggagcuggcgggaccccugggaa

SEQ ID NO: 520097 - RNA, 18 nt, Human
guggggggaguggaggca

SEQ ID NO: 520098 - RNA, 21 nt, Human
ucaggcccuggacggcucaug

SEQ ID NO: 520099 - RNA, 19 nt, Human
ucccugucuucuccauugg

SEQ ID NO: 520100 - RNA, 18 nt, Human
uccguggggccgucccgg

SEQ ID NO: 520101 - RNA, 21 nt, Human
ucuccugcucuccuagaguca

SEQ ID NO: 520102 - RNA, 24 nt, Human
ucuccugcucuccuagagucacuu

SEQ ID NO: 520103 - RNA, 23 nt, Human
ucuggcccuccugcagagacagg

SEQ ID NO: 520104 - RNA, 21 nt, Human
ucuguuucauuaauggucauu

SEQ ID NO: 520105 - RNA, 23 nt, Human
ucuucaacuccuucucuggggcc

SEQ ID NO: 520106 - RNA, 23 nt, Human
ucuucaacuccuucucuguuuca

SEQ ID NO: 520107 - RNA, 22 nt, Human
ucuucuggaaucuucuugaaca

SEQ ID NO: 520108 - RNA, 25 nt, Human
ucuucuggaaucuucuugaacacca

SEQ ID NO: 520109 - RNA, 20 nt, Human
ugaaggcccugggcuucagc

SEQ ID NO: 520110 - RNA, 20 nt, Human
ugagaggaucccugggaggu

SEQ ID NO: 520111 - RNA, 19 nt, Human
ugagcaaggccacucggcg

SEQ ID NO: 520112 - RNA, 18 nt, Human
ugcaucuuccguggggcc

SEQ ID NO: 520113 - RNA, 20 nt, Human
ugccaggggucuggaggacc

SEQ ID NO: 520114 - RNA, 20 nt, Human
ugcgacucaggcaccugacu

SEQ ID NO: 520115 - RNA, 19 nt, Human
ugcucuggggcggcugcag

SEQ ID NO: 520116 - RNA, 18 nt, Human
uggaagcccacauguccc

SEQ ID NO: 520117 - RNA, 24 nt, Human
uggaggagacagggacucucccca

SEQ ID NO: 520118 - RNA, 24 nt, Human
ugggagagacugugcgacucaggc

SEQ ID NO: 520119 - RNA, 21 nt, Human
ugggagguggccggugacuug

SEQ ID NO: 520120 - RNA, 24 nt, Human
ugggagguggccggugacuuggua

SEQ ID NO: 520121 - RNA, 20 nt, Human
ugggguggggcccaggaugg

SEQ ID NO: 520122 - RNA, 18 nt, Human
ugugcaucuuccgugggg

SEQ ID NO: 520123 - RNA, 18 nt, Human
uguuucauuaauggucau

SEQ ID NO: 520124 - RNA, 19 nt, Human
uucaugggguggugggggg

SEQ ID NO: 520125 - RNA, 23 nt, Human
uugcuuggauccaggaagcgggg

SEQ ID NO: 520126 - RNA, 21 nt, Human
uuuauccaggagagguccacu

SEQ ID NO: 520127 - RNA, 22 nt, Human
uuuauucuuacuacauaagauc

SEQ ID NO: 520128 - RNA, 19 nt, Human
aacaggcaauguggacucu

SEQ ID NO: 520129 - RNA, 20 nt, Human
aaggaaggguuagguggggc

SEQ ID NO: 520130 - RNA, 19 nt, Human
aaggcaccauguguacaga

SEQ ID NO: 520131 - RNA, 24 nt, Human
aaucgcuugaacccgggaggcgga

SEQ ID NO: 520132 - RNA, 24 nt, Human
accaacauggagaaacccugucuc

SEQ ID NO: 520133 - RNA, 24 nt, Human
acccugucucuacuaaaaauacaa

SEQ ID NO: 520134 - RNA, 21 nt, Human
agaaccauugaagaaacagag

SEQ ID NO: 520135 - RNA, 22 nt, Human
agaaucgcuugaacccgggagg

SEQ ID NO: 520136 - RNA, 24 nt, Human
agcacuuugggaggccgagguggg

SEQ ID NO: 520137 - RNA, 20 nt, Human
agccacagcaguaccagagc

SEQ ID NO: 520138 - RNA, 21 nt, Human
aggauggaaaagggaagagaa

SEQ ID NO: 520139 - RNA, 19 nt, Human
aggcagaaguucugaguca

SEQ ID NO: 520140 - RNA, 24 nt, Human
aggcaggagaaucgcuugaacccg

SEQ ID NO: 520141 - RNA, 21 nt, Human
aggccgagguggguggaucac

SEQ ID NO: 520142 - RNA, 20 nt, Human
aggcggagguugaggugagc

SEQ ID NO: 520143 - RNA, 20 nt, Human
aggcugaggcaggagaaucg

SEQ ID NO: 520144 - RNA, 24 nt, Human
aggcugaggcaggagaaucgcuug

SEQ ID NO: 520145 - RNA, 25 nt, Human
aggcugggccccuugagaugaaguc

SEQ ID NO: 520146 - RNA, 24 nt, Human
agggaagagaaccauugaagaaac

SEQ ID NO: 520147 - RNA, 19 nt, Human
agggcggcaggggaaucag

SEQ ID NO: 520148 - RNA, 24 nt, Human
agggcugaagacagacacugaacc

SEQ ID NO: 520149 - RNA, 19 nt, Human
agguggggcgcgguggcuc

SEQ ID NO: 520150 - RNA, 19 nt, Human
aggugggggagaaggcauc

SEQ ID NO: 520151 - RNA, 22 nt, Human
agguggguggaucaccugaggu

SEQ ID NO: 520152 - RNA, 23 nt, Human
agguugaggugagcugagaucgc

SEQ ID NO: 520153 - RNA, 20 nt, Human
aucaccugaggucgggaguu

SEQ ID NO: 520154 - RNA, 22 nt, Human
augcagguccugggaggugggg

SEQ ID NO: 520155 - RNA, 24 nt, Human
augggcccugggagaguucucuuu

SEQ ID NO: 520156 - RNA, 24 nt, Human
auugcacucuagccugggcaccaa

SEQ ID NO: 520157 - RNA, 24 nt, Human
caacauggagaaacccugucucua

SEQ ID NO: 520158 - RNA, 22 nt, Human
caacuucaggaggcucaggccu

SEQ ID NO: 520159 - RNA, 24 nt, Human
cacaaagccaagaacauaaaaaua

SEQ ID NO: 520160 - RNA, 24 nt, Human
cacgccuguaaucccagcacuuug

SEQ ID NO: 520161 - RNA, 21 nt, Human
cagaguauucaugggaugcag

SEQ ID NO: 520162 - RNA, 27 nt, Human
cagcaacuucaggaggcucaggccagg

SEQ ID NO: 520163 - RNA, 24 nt, Human
cagcacuuugggaggccgaggugg

SEQ ID NO: 520164 - RNA, 22 nt, Human
cagcagggcugaagacagacac

SEQ ID NO: 520165 - RNA, 24 nt, Human
cagccugaccaacauggagaaacc

SEQ ID NO: 520166 - RNA, 24 nt, Human
caggaugccucaugcacauuaggg

SEQ ID NO: 520167 - RNA, 21 nt, Human
cagguccugggagguggggga

SEQ ID NO: 520168 - RNA, 21 nt, Human
caucuccccucggggugcaac

SEQ ID NO: 520169 - RNA, 20 nt, Human
caugcacauuaggggugcca

SEQ ID NO: 520170 - RNA, 26 nt, Human
cauguacacaagaaacaggcaaugug

SEQ ID NO: 520171 - RNA, 18 nt, Human
cauugcacucuagccugg

SEQ ID NO: 520172 - RNA, 19 nt, Human
cauugcacucuagccuggg

SEQ ID NO: 520173 - RNA, 20 nt, Human
cauugcacucuagccugggc

SEQ ID NO: 520174 - RNA, 21 nt, Human
cauugcacucuagccugggca

SEQ ID NO: 520175 - RNA, 24 nt, Human
cauugcacucuagccugggcacca

SEQ ID NO: 520176 - RNA, 24 nt, Human
ccaagguggaguccagaggaggcu

SEQ ID NO: 520177 - RNA, 21 nt, Human
ccaccauccaguucugguggu

SEQ ID NO: 520178 - RNA, 20 nt, Human
ccauugcacucuagccuggg

SEQ ID NO: 520179 - RNA, 21 nt, Human
ccauugcacucuagccugggc

SEQ ID NO: 520180 - RNA, 23 nt, Human
ccauugcacucuagccugggcac

SEQ ID NO: 520181 - RNA, 23 nt, Human
cccauguacacaagaaacaggca

SEQ ID NO: 520182 - RNA, 21 nt, Human
ccccauguacacaagaaacag

SEQ ID NO: 520183 - RNA, 19 nt, Human
cccgcaccaggacggggag

SEQ ID NO: 520184 - RNA, 20 nt, Human
cccgcaccaggacggggagc

SEQ ID NO: 520185 - RNA, 21 nt, Human
cccugggagaguucucuuucc

SEQ ID NO: 520186 - RNA, 20 nt, Human
ccucggggugcaaccagcug

SEQ ID NO: 520187 - RNA, 25 nt, Human
ccucucagccuucugagcugggaug

SEQ ID NO: 520188 - RNA, 19 nt, Human
ccucucuuuaguauccucu

SEQ ID NO: 520189 - RNA, 22 nt, Human
ccugaccaacauggagaaaccc

SEQ ID NO: 520190 - RNA, 24 nt, Human
ccugaccaacauggagaaacccug

SEQ ID NO: 520191 - RNA, 23 nt, Human
ccugaccgggcuggggcaaugcc

SEQ ID NO: 520192 - RNA, 22 nt, Human
ccugaggucgggaguuugagac

SEQ ID NO: 520193 - RNA, 22 nt, Human
ccuguaaucccagcacuuuggg

SEQ ID NO: 520194 - RNA, 22 nt, Human
ccuguaaucccagcuacuaggg

SEQ ID NO: 520195 - RNA, 24 nt, Human
cgagguggguggaucaccugaggu

SEQ ID NO: 520196 - RNA, 24 nt, Human
cgccauugcacucuagccugggca

SEQ ID NO: 520197 - RNA, 23 nt, Human
cgccuguaaucccagcacuuugg

SEQ ID NO: 520198 - RNA, 23 nt, Human
cgccuguaaucccagcuacuagg

SEQ ID NO: 520199 - RNA, 22 nt, Human
cucacgccuguaaucccagcac

SEQ ID NO: 520200 - RNA, 24 nt, Human
cucacgccuguaaucccagcacuu

SEQ ID NO: 520201 - RNA, 20 nt, Human
cucagccuucugagcuggga

SEQ ID NO: 520202 - RNA, 21 nt, Human
cuccacugcaaacccucucag

SEQ ID NO: 520203 - RNA, 22 nt, Human
cugaagacagacacugaacccu

SEQ ID NO: 520204 - RNA, 21 nt, Human
cugcucagggcuccacugcaa

SEQ ID NO: 520205 - RNA, 20 nt, Human
cuggugguugguaggaacgg

SEQ ID NO: 520206 - RNA, 21 nt, Human
gaagagaaccauugaagaaac

SEQ ID NO: 520207 - RNA, 19 nt, Human
gaccauucccaggaugccu

SEQ ID NO: 520208 - RNA, 21 nt, Human
gagaaacccugucucuacuaa

SEQ ID NO: 520209 - RNA, 18 nt, Human
gagcaggaggugagcaag

SEQ ID NO: 520210 - RNA, 21 nt, Human
gaggauggaaaagggaagaga

SEQ ID NO: 520211 - RNA, 20 nt, Human
gagguggaaauaguugcaaa

SEQ ID NO: 520212 - RNA, 19 nt, Human
gaguccagaggaggcuggg

SEQ ID NO: 520213 - RNA, 23 nt, Human
gagugugggggguugugggagga

SEQ ID NO: 520214 - RNA, 24 nt, Human
gaucaccugaggucgggaguuuga

SEQ ID NO: 520215 - RNA, 21 nt, Human
gaugcagguccugggaggugg

SEQ ID NO: 520216 - RNA, 20 nt, Human
gcaacuucaggaggcucagg

SEQ ID NO: 520217 - RNA, 20 nt, Human
gcagggcugaagacagacac

SEQ ID NO: 520218 - RNA, 22 nt, Human
gccaagaacauaaaaauaaaua

SEQ ID NO: 520219 - RNA, 20 nt, Human
gccauugcacucuagccugg

SEQ ID NO: 520220 - RNA, 23 nt, Human
gcgagcaggaggugagcaagggc

SEQ ID NO: 520221 - RNA, 20 nt, Human
gcgggcgccuguaaucccag

SEQ ID NO: 520222 - RNA, 25 nt, Human
gcugaagcgcggggcacaggucccg

SEQ ID NO: 520223 - RNA, 21 nt, Human
gcugcaucugagagccugacc

SEQ ID NO: 520224 - RNA, 21 nt, Human
ggaaucaguaggcugugcggg

SEQ ID NO: 520225 - RNA, 19 nt, Human
ggaggagguggaaauaggg

SEQ ID NO: 520226 - RNA, 22 nt, Human
ggagguugaggugagcugagau

SEQ ID NO: 520227 - RNA, 24 nt, Human
ggagguugaggugagcugagaucg

SEQ ID NO: 520228 - RNA, 18 nt, Human
ggaguggagugugggggg

SEQ ID NO: 520229 - RNA, 19 nt, Human
ggaguuugagaccagccug

SEQ ID NO: 520230 - RNA, 23 nt, Human
ggcugggccccuugagaugaagu

SEQ ID NO: 520231 - RNA, 21 nt, Human
gggaaugaguagggaaggagc

SEQ ID NO: 520232 - RNA, 23 nt, Human
gggaggagguggaaauaggggac

SEQ ID NO: 520233 - RNA, 22 nt, Human
gggaggcugaggcaggagaauc

SEQ ID NO: 520234 - RNA, 19 nt, Human
gggaggugggggagaaggc

SEQ ID NO: 520235 - RNA, 24 nt, Human
gggcaugguggcgggcgccuguaa

SEQ ID NO: 520236 - RNA, 24 nt, Human
gggcgcgguggcucacgccuguaa

SEQ ID NO: 520237 - RNA, 22 nt, Human
ggggagggcugaagcgcggggc

SEQ ID NO: 520238 - RNA, 19 nt, Human
ggucgggaguuugagacca

SEQ ID NO: 520239 - RNA, 24 nt, Human
gguggcgggcgccuguaaucccag

SEQ ID NO: 520240 - RNA, 23 nt, Human
gguggcucacgccuguaauccca

SEQ ID NO: 520241 - RNA, 24 nt, Human
gguggcucacgccuguaaucccag

SEQ ID NO: 520242 - RNA, 21 nt, Human
guccaagguggaguccagagg

SEQ ID NO: 520243 - RNA, 20 nt, Human
gugguugguaggaacgggaa

SEQ ID NO: 520244 - RNA, 22 nt, Human
uaaaaauacaaaauuagccggg

SEQ ID NO: 520245 - RNA, 23 nt, Human
uaaaaauacaaaauuagccgggc

SEQ ID NO: 520246 - RNA, 19 nt, Human
uaaaacacaaagccaagaa

SEQ ID NO: 520247 - RNA, 23 nt, Human
uaaaacacaaagccaagaacaua

SEQ ID NO: 520248 - RNA, 21 nt, Human
uaaauauggacauucuagagu

SEQ ID NO: 520249 - RNA, 18 nt, Human
uacuagggaggcugaggc

SEQ ID NO: 520250 - RNA, 19 nt, Human
uacuagggaggcugaggca

SEQ ID NO: 520251 - RNA, 19 nt, Human
ucacugagguccaaggugg

SEQ ID NO: 520252 - RNA, 21 nt, Human
ucaggccagguuuggaggaug

SEQ ID NO: 520253 - RNA, 21 nt, Human
ucaguaggcugugcggggagg

SEQ ID NO: 520254 - RNA, 20 nt, Human
uccacacagcaggcggaggc

SEQ ID NO: 520255 - RNA, 22 nt, Human
uccauagucuggacuuuagagc

SEQ ID NO: 520256 - RNA, 24 nt, Human
uccuaaaacacaaagccaagaaca

SEQ ID NO: 520257 - RNA, 24 nt, Human
ucgcuugaacccgggaggcggagg

SEQ ID NO: 520258 - RNA, 20 nt, Human
ucucuacuaaaaauacaaaa

SEQ ID NO: 520259 - RNA, 19 nt, Human
ugaaaacagcaagauucac

SEQ ID NO: 520260 - RNA, 24 nt, Human
ugaccaacauggagaaacccuguc

SEQ ID NO: 520261 - RNA, 21 nt, Human
ugaccgggcuggggcaaugcc

SEQ ID NO: 520262 - RNA, 24 nt, Human
ugagaccagccugaccaacaugga

SEQ ID NO: 520263 - RNA, 22 nt, Human
ugagcugagaucgcgccauugc

SEQ ID NO: 520264 - RNA, 20 nt, Human
ugaggcaggagaaucgcuug

SEQ ID NO: 520265 - RNA, 24 nt, Human
ugaggcaggagaaucgcuugaacc

SEQ ID NO: 520266 - RNA, 25 nt, Human
ugaggcaggagaaucgcuugaaccc

SEQ ID NO: 520267 - RNA, 18 nt, Human
ugaggucgggaguuugag

SEQ ID NO: 520268 - RNA, 23 nt, Human
ugaggugagcugagaucgcgcca

SEQ ID NO: 520269 - RNA, 20 nt, Human
ugcggggagggcugaagcgc

SEQ ID NO: 520270 - RNA, 23 nt, Human
ugcucagggcuccacugcaaacc

SEQ ID NO: 520271 - RNA, 23 nt, Human
uggaucaccugaggucgggaguu

SEQ ID NO: 520272 - RNA, 24 nt, Human
uggaucaccugaggucgggaguuu

SEQ ID NO: 520273 - RNA, 22 nt, Human
uggcgggcgccuguaaucccag

SEQ ID NO: 520274 - RNA, 22 nt, Human
uggcucacgccuguaaucccag

SEQ ID NO: 520275 - RNA, 24 nt, Human
uggcucacgccuguaaucccagca

SEQ ID NO: 520276 - RNA, 23 nt, Human
ugggaggccgagguggguggauc

SEQ ID NO: 520277 - RNA, 24 nt, Human
ugggaggccgagguggguggauca

SEQ ID NO: 520278 - RNA, 21 nt, Human
ugggaggugggggagaaggca

SEQ ID NO: 520279 - RNA, 24 nt, Human
uggguggaucaccugaggucggga

SEQ ID NO: 520280 - RNA, 24 nt, Human
ugguggcgggcgccuguaauccca

SEQ ID NO: 520281 - RNA, 19 nt, Human
uguacagaguauucauggg

SEQ ID NO: 520282 - RNA, 20 nt, Human
uguccuuagaaggcaccaug

SEQ ID NO: 520283 - RNA, 27 nt, Human
ugugcggggagggcugaagcgcggggc

SEQ ID NO: 520284 - RNA, 18 nt, Human
ugugggggguugugggag

SEQ ID NO: 520285 - RNA, 19 nt, Human
uguguacagaguauucaug

SEQ ID NO: 520286 - RNA, 18 nt, Human
uuagccgggcaugguggc

SEQ ID NO: 520287 - RNA, 24 nt, Human
uuagguggggcgcgguggcucacg

SEQ ID NO: 520288 - RNA, 21 nt, Human
uucguucagcagggcugaaga

SEQ ID NO: 520289 - RNA, 21 nt, Human
uugaagaaacagagauugugu

SEQ ID NO: 520290 - RNA, 22 nt, Human
uugaagaaacagagauuguguu

SEQ ID NO: 520291 - RNA, 20 nt, Human
uugccuacuucccauaucca

SEQ ID NO: 520292 - RNA, 23 nt, Human
uugccuacuucccauauccagcc

SEQ ID NO: 520293 - RNA, 25 nt, Human
uugggaggccgagguggguggauca

SEQ ID NO: 520294 - RNA, 19 nt, Human
uuuggaggauggaaaaggg

SEQ ID NO: 520295 - RNA, 22 nt, Human
uuuuuuuccaaucaccuuucug

SEQ ID NO: 520296 - RNA, 18 nt, Human
aagcagcagggcugcggu

SEQ ID NO: 520297 - RNA, 22 nt, Human
aaguagcaauccagguccuggg

SEQ ID NO: 520298 - RNA, 22 nt, Human
aagugcugcuucaugcaguugg

SEQ ID NO: 520299 - RNA, 23 nt, Human
aggccaagccaucugccacauca

SEQ ID NO: 520300 - RNA, 24 nt, Human
caucaucguccccuagcagccgcu

SEQ ID NO: 520301 - RNA, 23 nt, Human
caucuuggcaaugcacucgcccg

SEQ ID NO: 520302 - RNA, 23 nt, Human
ccaggauggucuugaggggcucu

SEQ ID NO: 520303 - RNA, 22 nt, Human
ccaucugccacaucaucguccc

SEQ ID NO: 520304 - RNA, 18 nt, Human
ccuagcagccgcuuugcc

SEQ ID NO: 520305 - RNA, 23 nt, Human
cuagcagccgcuuugcccacagu

SEQ ID NO: 520306 - RNA, 22 nt, Human
cuccagaucauccucuguuugc

SEQ ID NO: 520307 - RNA, 18 nt, Human
gaacacgcagcugucucc

SEQ ID NO: 520308 - RNA, 19 nt, Human
gccacuccgcuucuuguca

SEQ ID NO: 520309 - RNA, 28 nt, Human
ggccacuccgcuucuugucccguccccg

SEQ ID NO: 520310 - RNA, 22 nt, Human
gggcauccaggauggucuugag

SEQ ID NO: 520311 - RNA, 20 nt, Human
gguagcugcgcuuggcgugg

SEQ ID NO: 520312 - RNA, 19 nt, Human
gugugcugcugcugcugcc

SEQ ID NO: 520313 - RNA, 20 nt, Human
uaaaguagcaauccaggucu

SEQ ID NO: 520314 - RNA, 19 nt, Human
uaccuaaguccucagaagc

SEQ ID NO: 520315 - RNA, 21 nt, Human
uagguguggacacauacguau

SEQ ID NO: 520316 - RNA, 24 nt, Human
ucaucguccccuagcagccgcuuu

SEQ ID NO: 520317 - RNA, 27 nt, Human
ucuccgggcccaggugccagaugaaca

SEQ ID NO: 520318 - RNA, 21 nt, Human
ugaucuccgggcccaggugcc

SEQ ID NO: 520319 - RNA, 26 nt, Human
ugcccagcggccguggggcuggggcc

SEQ ID NO: 520320 - RNA, 23 nt, Human
uggcagcuugccguugguuagca

SEQ ID NO: 520321 - RNA, 19 nt, Human
uggccggcccgcucugccc

SEQ ID NO: 520322 - RNA, 21 nt, Human
uuuauucgcuuaaaauaccua

SEQ ID NO: 520323 - RNA, 18 nt, Human
aaacaguccacacauccc

SEQ ID NO: 520324 - RNA, 18 nt, Human
aaagaggauggggagggg

SEQ ID NO: 520325 - RNA, 18 nt, Human
aagcuccucucggaucuc

SEQ ID NO: 520326 - RNA, 24 nt, Human
acaaaggggaacacacuaaacagu

SEQ ID NO: 520327 - RNA, 19 nt, Human
acacaucccauagcacuac

SEQ ID NO: 520328 - RNA, 18 nt, Human
agaagggagagggggggc

SEQ ID NO: 520329 - RNA, 19 nt, Human
aggagaagggagagggggg

SEQ ID NO: 520330 - RNA, 20 nt, Human
aggcaggcgagcgcugggga

SEQ ID NO: 520331 - RNA, 20 nt, Human
agggagagggggggcaccca

SEQ ID NO: 520332 - RNA, 22 nt, Human
agguuguggccacagggcacca

SEQ ID NO: 520333 - RNA, 23 nt, Human
aguguugguggggccgggaagga

SEQ ID NO: 520334 - RNA, 26 nt, Human
auggggagggguucccccuuccccca

SEQ ID NO: 520335 - RNA, 21 nt, Human
auuguuuccguugugcgcaaa

SEQ ID NO: 520336 - RNA, 21 nt, Human
cacccacaaaggggaacacac

SEQ ID NO: 520337 - RNA, 21 nt, Human
cacuaaacaguccacacaucc

SEQ ID NO: 520338 - RNA, 18 nt, Human
cagaccgggcacucgggc

SEQ ID NO: 520339 - RNA, 21 nt, Human
ccacaaaggggaacacacuaa

SEQ ID NO: 520340 - RNA, 18 nt, Human
cccauagcacuacuauca

SEQ ID NO: 520341 - RNA, 23 nt, Human
cccauagcacuacuaucaucuuc

SEQ ID NO: 520342 - RNA, 18 nt, Human
ccuuccacgaacauucaa

SEQ ID NO: 520343 - RNA, 21 nt, Human
ccuuccacgaacauucaaaaa

SEQ ID NO: 520344 - RNA, 19 nt, Human
cuuuccaagcuccucucgg

SEQ ID NO: 520345 - RNA, 19 nt, Human
gaacuccuggcccuuccac

SEQ ID NO: 520346 - RNA, 24 nt, Human
gagcggauacuacagcuuuccaag

SEQ ID NO: 520347 - RNA, 21 nt, Human
gcagaagagguuguggccaca

SEQ ID NO: 520348 - RNA, 22 nt, Human
gccgcugcgcugcugcuggucc

SEQ ID NO: 520349 - RNA, 26 nt, Human
gccgggaaggagaagggagagggggg

SEQ ID NO: 520350 - RNA, 21 nt, Human
gcggauacuacagcuuuccaa

SEQ ID NO: 520351 - RNA, 19 nt, Human
gcggauggccugagugacc

SEQ ID NO: 520352 - RNA, 20 nt, Human
gcugcgcugcugcugguccc

SEQ ID NO: 520353 - RNA, 18 nt, Human
ggaaagaggauggggagg

SEQ ID NO: 520354 - RNA, 18 nt, Human
ggaaggagaagggagagg

SEQ ID NO: 520355 - RNA, 19 nt, Human
ggauggggagggguucccc

SEQ ID NO: 520356 - RNA, 19 nt, Human
ggcggggcuaggggggcug

SEQ ID NO: 520357 - RNA, 19 nt, Human
gggaaagaggauggggagg

SEQ ID NO: 520358 - RNA, 19 nt, Human
gggaaggagaagggagagg

SEQ ID NO: 520359 - RNA, 20 nt, Human
gggaaggagaagggagaggg

SEQ ID NO: 520360 - RNA, 22 nt, Human
gggaaggagaagggagaggggg

SEQ ID NO: 520361 - RNA, 18 nt, Human
ggggccgggaaggagaag

SEQ ID NO: 520362 - RNA, 18 nt, Human
uagcagcgcccgcugccu

SEQ ID NO: 520363 - RNA, 19 nt, Human
uagccgcugcgcugcugcu

SEQ ID NO: 520364 - RNA, 20 nt, Human
uagccgcugcgcugcugcug

SEQ ID NO: 520365 - RNA, 19 nt, Human
ucagggcggggcuaggggg

SEQ ID NO: 520366 - RNA, 19 nt, Human
uccaugcagaagagguugu

SEQ ID NO: 520367 - RNA, 24 nt, Human
ugcagaagagguuguggccacagg

SEQ ID NO: 520368 - RNA, 18 nt, Human
uggcagaccgggcacucg

SEQ ID NO: 520369 - RNA, 22 nt, Human
uggggaaagaggauggggaggg

SEQ ID NO: 520370 - RNA, 19 nt, Human
uguucagguuucccaggcu

SEQ ID NO: 520371 - RNA, 24 nt, Human
uuuuuuuuuuuuuuuaacuuuuaa

SEQ ID NO: 520372 - RNA, 22 nt, Human
aacugcugcagcucacaacccc

SEQ ID NO: 520373 - RNA, 24 nt, Human
aagagucaggucaagcaggaagug

SEQ ID NO: 520374 - RNA, 21 nt, Human
aagcagcuggggggagagggg

SEQ ID NO: 520375 - RNA, 22 nt, Human
aaggagcuuuucagguggaggc

SEQ ID NO: 520376 - RNA, 24 nt, Human
aaggagcuuuucagguggaggcgg

SEQ ID NO: 520377 - RNA, 25 nt, Human
aaggagcuuuucagguggaggcggg

SEQ ID NO: 520378 - RNA, 20 nt, Human
acaaccccugccccagacga

SEQ ID NO: 520379 - RNA, 21 nt, Human
acgccuccagcgcccaugaac

SEQ ID NO: 520380 - RNA, 19 nt, Human
acuccagggauauuccagg

SEQ ID NO: 520381 - RNA, 18 nt, Human
agcucacaaccccugccc

SEQ ID NO: 520382 - RNA, 25 nt, Human
caaccccugccccagacgacuuggu

SEQ ID NO: 520383 - RNA, 19 nt, Human
caaggcaccagcaacugcu

SEQ ID NO: 520384 - RNA, 22 nt, Human
caccagcaacugcugcagcuca

SEQ ID NO: 520385 - RNA, 23 nt, Human
caccuucccacaaggcaccagca

SEQ ID NO: 520386 - RNA, 19 nt, Human
cagaccccucaaagggcag

SEQ ID NO: 520387 - RNA, 22 nt, Human
cagcuccaccucuuccuccuuu

SEQ ID NO: 520388 - RNA, 21 nt, Human
cagguggaggcgggugggggg

SEQ ID NO: 520389 - RNA, 22 nt, Human
cagguggaggcggguggggggu

SEQ ID NO: 520390 - RNA, 22 nt, Human
caugugaagagucaggucaagc

SEQ ID NO: 520391 - RNA, 19 nt, Human
ccagcgcccaugaacccgg

SEQ ID NO: 520392 - RNA, 19 nt, Human
cccagccccagcaauggca

SEQ ID NO: 520393 - RNA, 21 nt, Human
cccugccccaccuucccacaa

SEQ ID NO: 520394 - RNA, 19 nt, Human
ccuccagcgcccaugaacc

SEQ ID NO: 520395 - RNA, 18 nt, Human
ccucccggccaggcagcc

SEQ ID NO: 520396 - RNA, 19 nt, Human
cgugugcuguuucagcccc

SEQ ID NO: 520397 - RNA, 24 nt, Human
cuccagcgcccaugaacccggguc

SEQ ID NO: 520398 - RNA, 19 nt, Human
cugccccaccuucccacaa

SEQ ID NO: 520399 - RNA, 18 nt, Human
gaauccggaagaugauga

SEQ ID NO: 520400 - RNA, 24 nt, Human
gaugaugaugaugguggaagccuu

SEQ ID NO: 520401 - RNA, 19 nt, Human
gcugcagcucacaaccccu

SEQ ID NO: 520402 - RNA, 19 nt, Human
gcuggggggagaggggcag

SEQ ID NO: 520403 - RNA, 24 nt, Human
ggagaagcagcuggggggagaggg

SEQ ID NO: 520404 - RNA, 24 nt, Human
gguggaagccuuuuacuccaggga

SEQ ID NO: 520405 - RNA, 26 nt, Human
guuugcuuccuccccgaauuucuccu

SEQ ID NO: 520406 - RNA, 21 nt, Human
ucacaaccccugccccagacg

SEQ ID NO: 520407 - RNA, 23 nt, Human
ucaccaggaucgaagauuuucca

SEQ ID NO: 520408 - RNA, 26 nt, Human
ucagggaauccggaagaugaugauga

SEQ ID NO: 520409 - RNA, 18 nt, Human
ucccugccccaccuuccc

SEQ ID NO: 520410 - RNA, 21 nt, Human
ucccugccccaccuucccaca

SEQ ID NO: 520411 - RNA, 22 nt, Human
uggaggcggguggggggucccc

SEQ ID NO: 520412 - RNA, 18 nt, Human
ugggggcagagguggcgg

SEQ ID NO: 520413 - RNA, 26 nt, Human
ugggggcagagguggcgggcagccuc

SEQ ID NO: 520414 - RNA, 23 nt, Human
ugguggaagccuuuuacuccaga

SEQ ID NO: 520415 - RNA, 23 nt, Human
uguguaaaauguagcaggugugu

SEQ ID NO: 520416 - RNA, 23 nt, Human
uucccugguggguguccaguccu

SEQ ID NO: 520417 - RNA, 24 nt, Human
uucccugguggguguccaguccuc

SEQ ID NO: 520418 - RNA, 21 nt, Human
uugcuuccuccccgaauuucu

SEQ ID NO: 520419 - RNA, 19 nt, Human
uuucccggagggaaaaccu

SEQ ID NO: 520420 - RNA, 21 nt, Human
uuuuccacgugugucucacca

SEQ ID NO: 520421 - RNA, 22 nt, Human
aaaaagcuaaaauucauaagca

SEQ ID NO: 520422 - RNA, 19 nt, Human
aaaacaaacaaacaaaaag

SEQ ID NO: 520423 - RNA, 20 nt, Human
aaaagccacugaagugaaaa

SEQ ID NO: 520424 - RNA, 25 nt, Human
aaacaaaaagcuaaaauucauaagc

SEQ ID NO: 520425 - RNA, 25 nt, Human
aaacaagaucagaaacaaaagucca

SEQ ID NO: 520426 - RNA, 18 nt, Human
aacaaaaagcuaaaauuc

SEQ ID NO: 520427 - RNA, 23 nt, Human
aacaaaaagcuaaaauucauaag

SEQ ID NO: 520428 - RNA, 25 nt, Human
aaccucgcuguccuccaauauccac

SEQ ID NO: 520429 - RNA, 20 nt, Human
aagagaaaacaaacaaacaa

SEQ ID NO: 520430 - RNA, 22 nt, Human
aagagaaaacaaacaaacaaaa

SEQ ID NO: 520431 - RNA, 24 nt, Human
aagaucagaaacaaaaguccacca

SEQ ID NO: 520432 - RNA, 22 nt, Human
aaugauguauuuccucagcguu

SEQ ID NO: 520433 - RNA, 20 nt, Human
acacgaaagacaaagguucc

SEQ ID NO: 520434 - RNA, 23 nt, Human
accacuacaaucuuuuuuuuuuu

SEQ ID NO: 520435 - RNA, 18 nt, Human
accauggaagaaauccca

SEQ ID NO: 520436 - RNA, 20 nt, Human
accauggaagaaaucccaga

SEQ ID NO: 520437 - RNA, 18 nt, Human
agaagaacagaucauuua

SEQ ID NO: 520438 - RNA, 23 nt, Human
agagaaaacaaacaaacaaaaag

SEQ ID NO: 520439 - RNA, 25 nt, Human
agggaaaacaagaucagaaacaaaa

SEQ ID NO: 520440 - RNA, 21 nt, Human
aguccaccauggaagaaaucc

SEQ ID NO: 520441 - RNA, 21 nt, Human
auauccacagggaaaacaaga

SEQ ID NO: 520442 - RNA, 22 nt, Human
caaacaaaaagcuaaaauucau

SEQ ID NO: 520443 - RNA, 19 nt, Human
caaccgccgccucaucccg

SEQ ID NO: 520444 - RNA, 23 nt, Human
caagaucagaaacaaaaguccac

SEQ ID NO: 520445 - RNA, 22 nt, Human
caagcagacccacugugcgcga

SEQ ID NO: 520446 - RNA, 19 nt, Human
caccauggaagaaauccca

SEQ ID NO: 520447 - RNA, 21 nt, Human
cacguucaugcaugcaaagcg

SEQ ID NO: 520448 - RNA, 20 nt, Human
cagccccugggccugucacu

SEQ ID NO: 520449 - RNA, 23 nt, Human
caggucaaaguucauagcagcaa

SEQ ID NO: 520450 - RNA, 20 nt, Human
caugcaaagcgaggagguuu

SEQ ID NO: 520451 - RNA, 20 nt, Human
ccacagggaaaacaagauca

SEQ ID NO: 520452 - RNA, 20 nt, Human
cgcgcggcgagugggcccgg

SEQ ID NO: 520453 - RNA, 18 nt, Human
cuuggcacguucaugcau

SEQ ID NO: 520454 - RNA, 20 nt, Human
cuuugcuccagcgaguccag

SEQ ID NO: 520455 - RNA, 24 nt, Human
gaacagaucauuuaauuauacaaa

SEQ ID NO: 520456 - RNA, 23 nt, Human
gcacaaaguccucugugaagcca

SEQ ID NO: 520457 - RNA, 19 nt, Human
gccauccucucccccgacu

SEQ ID NO: 520458 - RNA, 19 nt, Human
gcccuagggagaucggacu

SEQ ID NO: 520459 - RNA, 23 nt, Human
gcccuagggagaucggacuucug

SEQ ID NO: 520460 - RNA, 19 nt, Human
gcgcgcgcgcgagggcggg

SEQ ID NO: 520461 - RNA, 21 nt, Human
gcuguccuccaauauccacag

SEQ ID NO: 520462 - RNA, 18 nt, Human
ggcgcgcggcgagugggc

SEQ ID NO: 520463 - RNA, 21 nt, Human
ggcuuggcacguucaugcaug

SEQ ID NO: 520464 - RNA, 19 nt, Human
gucagaggucacaggucaa

SEQ ID NO: 520465 - RNA, 24 nt, Human
gucucugccauccucucccccgac

SEQ ID NO: 520466 - RNA, 23 nt, Human
uaaaacggagggaaaauggucca

SEQ ID NO: 520467 - RNA, 19 nt, Human
uagcagcaaugcacaaagg

SEQ ID NO: 520468 - RNA, 21 nt, Human
uagcuccccuaugcuggcuug

SEQ ID NO: 520469 - RNA, 20 nt, Human
uaugaaaaaacccaacggca

SEQ ID NO: 520470 - RNA, 21 nt, Human
uaugaaaaaacccaacggcag

SEQ ID NO: 520471 - RNA, 18 nt, Human
ucaucccguccccgcucu

SEQ ID NO: 520472 - RNA, 19 nt, Human
uccacagggaaaacaagau

SEQ ID NO: 520473 - RNA, 26 nt, Human
uccaccauggaagaaaucccagagcu

SEQ ID NO: 520474 - RNA, 18 nt, Human
ucgccgccucggucgccg

SEQ ID NO: 520475 - RNA, 26 nt, Human
ugaaaaaacccaacggcagcgucgac

SEQ ID NO: 520476 - RNA, 20 nt, Human
ugaaagaaagguuuuuagua

SEQ ID NO: 520477 - RNA, 19 nt, Human
ugaaguagaagaacagauc

SEQ ID NO: 520478 - RNA, 21 nt, Human
ugcacaaaguccucugugaag

SEQ ID NO: 520479 - RNA, 20 nt, Human
ugcaugcaaagcgaggaggu

SEQ ID NO: 520480 - RNA, 24 nt, Human
uggcaaaaagagaaaacaaacaaa

SEQ ID NO: 520481 - RNA, 25 nt, Human
uggcaaaaagagaaaacaaacaaac

SEQ ID NO: 520482 - RNA, 18 nt, Human
ugggaucaaccgccgccu

SEQ ID NO: 520483 - RNA, 19 nt, Human
ugggaucaaccgccgccuc

SEQ ID NO: 520484 - RNA, 21 nt, Human
uguacagauaugaaaaaaccc

SEQ ID NO: 520485 - RNA, 22 nt, Human
uuuggcaaaaagagaaaacaaa

SEQ ID NO: 520486 - RNA, 19 nt, Human
uuuuuuuuuuuuuuuuuaa

SEQ ID NO: 520487 - RNA, 19 nt, Human
aaaaggcagcccucugaca

SEQ ID NO: 520488 - RNA, 19 nt, Human
aaacgugaagggaaagugg

SEQ ID NO: 520489 - RNA, 23 nt, Human
aaagaaaaacccaauguaaauaa

SEQ ID NO: 520490 - RNA, 21 nt, Human
aacaacacagaaacuagaaga

SEQ ID NO: 520491 - RNA, 22 nt, Human
aacacagaaacuagaagauccc

SEQ ID NO: 520492 - RNA, 21 nt, Human
aaccuguaaaguaauuuuucc

SEQ ID NO: 520493 - RNA, 21 nt, Human
aaccuguaaaguaauuuuucc

SEQ ID NO: 520494 - RNA, 18 nt, Human
aacgugaagggaaagugg

SEQ ID NO: 520495 - RNA, 20 nt, Human
aagcaccgcgugcaggagag

SEQ ID NO: 520496 - RNA, 18 nt, Human
aauguucauucauuccca

SEQ ID NO: 520497 - RNA, 23 nt, Human
accaaaacuacgaaagaaaaacc

SEQ ID NO: 520498 - RNA, 19 nt, Human
accgguagguuccucacgc

SEQ ID NO: 520499 - RNA, 18 nt, Human
acgaaauauaaauauaug

SEQ ID NO: 520500 - RNA, 21 nt, Human
acucccccauccucaaacccu

SEQ ID NO: 520501 - RNA, 21 nt, Human
agaaaaacccaauguaaauaa

SEQ ID NO: 520502 - RNA, 24 nt, Human
agaaaacaaugaagaaucuccuca

SEQ ID NO: 520503 - RNA, 20 nt, Human
agaaacuagaagaucccuuu

SEQ ID NO: 520504 - RNA, 21 nt, Human
agcaaauaacaaagaauacau

SEQ ID NO: 520505 - RNA, 25 nt, Human
agccacaccggcgacuaccagcgcg

SEQ ID NO: 520506 - RNA, 22 nt, Human
aggaaagaaaacaaugaagaau

SEQ ID NO: 520507 - RNA, 23 nt, Human
aggaaagaaaacaaugaagaauc

SEQ ID NO: 520508 - RNA, 19 nt, Human
aggcguggaggacgcugcc

SEQ ID NO: 520509 - RNA, 21 nt, Human
aguacaacugcaagucuaaga

SEQ ID NO: 520510 - RNA, 20 nt, Human
auaaaaauaacuucaguuau

SEQ ID NO: 520511 - RNA, 24 nt, Human
auuccacaaaaauauaccuugcca

SEQ ID NO: 520512 - RNA, 21 nt, Human
caaaacaaaguucagaaggca

SEQ ID NO: 520513 - RNA, 22 nt, Human
caaccuuugagaaggaaagaaa

SEQ ID NO: 520514 - RNA, 21 nt, Human
caacugcaagucuaagauaau

SEQ ID NO: 520515 - RNA, 22 nt, Human
cagccacaccggcgacuaccag

SEQ ID NO: 520516 - RNA, 25 nt, Human
cagccaccugaaacauuauaagucc

SEQ ID NO: 520517 - RNA, 21 nt, Human
cagcgcgcggccgguaccggu

SEQ ID NO: 520518 - RNA, 20 nt, Human
caggucagccaaaaaacgug

SEQ ID NO: 520519 - RNA, 18 nt, Human
cauggacugaauccagcc

SEQ ID NO: 520520 - RNA, 25 nt, Human
ccaaaacuacgaaagaaaaaccccu

SEQ ID NO: 520521 - RNA, 19 nt, Human
ccagccuacuuuuguaugg

SEQ ID NO: 520522 - RNA, 19 nt, Human
cccaauguaaauaaaggau

SEQ ID NO: 520523 - RNA, 19 nt, Human
cccagccgcggcgcacggg

SEQ ID NO: 520524 - RNA, 22 nt, Human
cccggagcugagggaacugccc

SEQ ID NO: 520525 - RNA, 24 nt, Human
ccucaaacccuggcggcggacccc

SEQ ID NO: 520526 - RNA, 26 nt, Human
ccucugacaguaaacuaguaacuggg

SEQ ID NO: 520527 - RNA, 25 nt, Human
cgagggggacagcaaucuauggucc

SEQ ID NO: 520528 - RNA, 23 nt, Human
cggcaaacuacagaauuugugca

SEQ ID NO: 520529 - RNA, 23 nt, Human
cggcuccggcuccggcuccaacc

SEQ ID NO: 520530 - RNA, 21 nt, Human
cugcacuguuucucggcugug

SEQ ID NO: 520531 - RNA, 19 nt, Human
cuuccuguagcuacucccc

SEQ ID NO: 520532 - RNA, 23 nt, Human
gaaaaacccaauguaaauaaagg

SEQ ID NO: 520533 - RNA, 27 nt, Human
gaaaacaaugaagaaucuccgguaccc

SEQ ID NO: 520534 - RNA, 18 nt, Human
gacgcugccuggggagac

SEQ ID NO: 520535 - RNA, 24 nt, Human
gcaaauaacaaagaauacaugaug

SEQ ID NO: 520536 - RNA, 22 nt, Human
gccacaccggcgacuaccagcg

SEQ ID NO: 520537 - RNA, 24 nt, Human
gccgguaccgguagguuccucacg

SEQ ID NO: 520538 - RNA, 18 nt, Human
ggagagggcgguguaggu

SEQ ID NO: 520539 - RNA, 25 nt, Human
ggcggugggguggagagggcggugu

SEQ ID NO: 520540 - RNA, 18 nt, Human
ggcguggaggacgcugcc

SEQ ID NO: 520541 - RNA, 20 nt, Human
gggcggggccuggcgcggag

SEQ ID NO: 520542 - RNA, 18 nt, Human
gugcuguagauaauucug

SEQ ID NO: 520543 - RNA, 22 nt, Human
gugggaaaauuucuaugaaagc

SEQ ID NO: 520544 - RNA, 24 nt, Human
uaaaacgaaauauaaauauauggu

SEQ ID NO: 520545 - RNA, 19 nt, Human
uaaaagcaaauaacaaaga

SEQ ID NO: 520546 - RNA, 19 nt, Human
uaaaagcauuuuuucaacc

SEQ ID NO: 520547 - RNA, 20 nt, Human
uaaaagcauuuuuucaaccu

SEQ ID NO: 520548 - RNA, 21 nt, Human
uaaaagcauuuuuucaaccuu

SEQ ID NO: 520549 - RNA, 21 nt, Human
uaaacaacacagaaacuagaa

SEQ ID NO: 520550 - RNA, 23 nt, Human
uaaacaacuacauguuacugaca

SEQ ID NO: 520551 - RNA, 24 nt, Human
uaaauaaaggauacaggucaaaac

SEQ ID NO: 520552 - RNA, 19 nt, Human
uaacaaagaauacaugaug

SEQ ID NO: 520553 - RNA, 24 nt, Human
uaacuucaguuauuaugucaauau

SEQ ID NO: 520554 - RNA, 19 nt, Human
uaagcuacaguaaaacaaa

SEQ ID NO: 520555 - RNA, 21 nt, Human
uaauacagcauaacaggguuu

SEQ ID NO: 520556 - RNA, 28 nt, Human
uaauugcuauaauuuuuuucccucaggu

SEQ ID NO: 520557 - RNA, 23 nt, Human
uacagaauuugugcacuuacugu

SEQ ID NO: 520558 - RNA, 21 nt, Human
uacugugugcacauauacugc

SEQ ID NO: 520559 - RNA, 26 nt, Human
uacuuacugugugcacauauacugcu

SEQ ID NO: 520560 - RNA, 23 nt, Human
uacuuccuuuucauuccacaaaa

SEQ ID NO: 520561 - RNA, 18 nt, Human
uagcacagcagacucaug

SEQ ID NO: 520562 - RNA, 23 nt, Human
uagcuacucccccauccucaaac

SEQ ID NO: 520563 - RNA, 21 nt, Human
uaggagaacaagugaccaaaa

SEQ ID NO: 520564 - RNA, 22 nt, Human
uaggagaacaagugaccaaaaa

SEQ ID NO: 520565 - RNA, 19 nt, Human
uaguaacuggaauaacuac

SEQ ID NO: 520566 - RNA, 23 nt, Human
ucaaaacaaaguucagaaggcaa

SEQ ID NO: 520567 - RNA, 23 nt, Human
ucagcucauuucuaauacuuccu

SEQ ID NO: 520568 - RNA, 23 nt, Human
uccuagauuuauauacuugauuu

SEQ ID NO: 520569 - RNA, 19 nt, Human
ucuaaauacuugauaacau

SEQ ID NO: 520570 - RNA, 21 nt, Human
ucuccgacggcccagccgcgg

SEQ ID NO: 520571 - RNA, 24 nt, Human
ucuucagcucauuucuaauacuuc

SEQ ID NO: 520572 - RNA, 19 nt, Human
ugaaaaaccaaaacuacga

SEQ ID NO: 520573 - RNA, 22 nt, Human
ugaaagcaauuucagaaaauac

SEQ ID NO: 520574 - RNA, 24 nt, Human
ugacaguaaacuaguaacuggaau

SEQ ID NO: 520575 - RNA, 25 nt, Human
ugagucuaaacaacacagaaacuag

SEQ ID NO: 520576 - RNA, 21 nt, Human
ugauacggcaaacuacagaau

SEQ ID NO: 520577 - RNA, 19 nt, Human
ugcacauauacugcugcac

SEQ ID NO: 520578 - RNA, 20 nt, Human
ugccuggggagacccgcugc

SEQ ID NO: 520579 - RNA, 20 nt, Human
ugccuggggagacccgcugc

SEQ ID NO: 520580 - RNA, 23 nt, Human
ugccuggggagacccgcugcggg

SEQ ID NO: 520581 - RNA, 23 nt, Human
uggacaggagugaaaaaccaaaa

SEQ ID NO: 520582 - RNA, 22 nt, Human
uggacuuuauacaacuuagaca

SEQ ID NO: 520583 - RNA, 21 nt, Human
ugggaaaauuucuaugaaagc

SEQ ID NO: 520584 - RNA, 21 nt, Human
uguguacuuacugugugcaca

SEQ ID NO: 520585 - RNA, 24 nt, Human
uuaaaagcaaauaacaaagaauac

SEQ ID NO: 520586 - RNA, 20 nt, Human
uucaaccuuugagaaggaaa

SEQ ID NO: 520587 - RNA, 23 nt, Human
uucacugcugguuccaguugaug

SEQ ID NO: 520588 - RNA, 19 nt, Human
uugaccucuuuugacugau

SEQ ID NO: 520589 - RNA, 24 nt, Human
uuuaggagaacaagugaccaaaaa

SEQ ID NO: 520590 - RNA, 24 nt, Human
uuuucaggucagccaaaaaacgug

SEQ ID NO: 520591 - RNA, 23 nt, Human
uuuucauuccacaaaaauauuau

SEQ ID NO: 520592 - RNA, 22 nt, Human
aacacaauacaguggagauaag

SEQ ID NO: 520593 - RNA, 23 nt, Human
aacauuuucuuuucugguuuugg

SEQ ID NO: 520594 - RNA, 20 nt, Human
aacccaaagaucccaagcaa

SEQ ID NO: 520595 - RNA, 21 nt, Human
aacuacgugacccugcucccu

SEQ ID NO: 520596 - RNA, 25 nt, Human
aacuacgugacccugcucccuacca

SEQ ID NO: 520597 - RNA, 20 nt, Human
acacuaagggcaagcagaac

SEQ ID NO: 520598 - RNA, 19 nt, Human
agauuuguggucacuuucu

SEQ ID NO: 520599 - RNA, 21 nt, Human
aggagagugguggagaagggg

SEQ ID NO: 520600 - RNA, 18 nt, Human
aggcaugagaaucaacuu

SEQ ID NO: 520601 - RNA, 21 nt, Human
agggcuggagcugccaggcuu

SEQ ID NO: 520602 - RNA, 21 nt, Human
agguacucugaccuccaacua

SEQ ID NO: 520603 - RNA, 21 nt, Human
agugguggggguggccugggg

SEQ ID NO: 520604 - RNA, 21 nt, Human
auggaaaugaaaauacugguc

SEQ ID NO: 520605 - RNA, 18 nt, Human
caaaagcaccuccucaag

SEQ ID NO: 520606 - RNA, 20 nt, Human
caaagaucccaagcaagcac

SEQ ID NO: 520607 - RNA, 18 nt, Human
caagagacuucugugugg

SEQ ID NO: 520608 - RNA, 18 nt, Human
caagcaagcacugaugua

SEQ ID NO: 520609 - RNA, 19 nt, Human
cacaauacaguggagauaa

SEQ ID NO: 520610 - RNA, 19 nt, Human
cacagguacucugaccucc

SEQ ID NO: 520611 - RNA, 26 nt, Human
cacccugucggcuucucugucuuacu

SEQ ID NO: 520612 - RNA, 22 nt, Human
cagaggugaacccaaagauccc

SEQ ID NO: 520613 - RNA, 20 nt, Human
cagcaggauuacagcaggcu

SEQ ID NO: 520614 - RNA, 19 nt, Human
cagcaggcuccaagaugga

SEQ ID NO: 520615 - RNA, 21 nt, Human
cagccucccucuuggacuuca

SEQ ID NO: 520616 - RNA, 18 nt, Human
caggaagagugucuggug

SEQ ID NO: 520617 - RNA, 20 nt, Human
cagggagaagucagaggaga

SEQ ID NO: 520618 - RNA, 19 nt, Human
cagugaucccucccaaagc

SEQ ID NO: 520619 - RNA, 19 nt, Human
caguggcagagaacaugga

SEQ ID NO: 520620 - RNA, 20 nt, Human
cagugguggggguggccugg

SEQ ID NO: 520621 - RNA, 25 nt, Human
cauggcaaggagagugguggagaag

SEQ ID NO: 520622 - RNA, 24 nt, Human
ccaccagcauauuuauggaaauga

SEQ ID NO: 520623 - RNA, 20 nt, Human
ccacucaaggacagugacga

SEQ ID NO: 520624 - RNA, 25 nt, Human
cccaccagcauauuuauggaaauga

SEQ ID NO: 520625 - RNA, 20 nt, Human
ccccuucuggauuaggggcu

SEQ ID NO: 520626 - RNA, 24 nt, Human
cccugggccugugggacaggcccu

SEQ ID NO: 520627 - RNA, 20 nt, Human
cccugguuggggggcacaag

SEQ ID NO: 520628 - RNA, 22 nt, Human
cccuucaucacacuaagggcaa

SEQ ID NO: 520629 - RNA, 24 nt, Human
cccuuugccuuuugucuugggguu

SEQ ID NO: 520630 - RNA, 23 nt, Human
ccucaaggagggaauacuguggc

SEQ ID NO: 520631 - RNA, 20 nt, Human
ccuccuggcucuaggcucau

SEQ ID NO: 520632 - RNA, 23 nt, Human
ccugcucccuaccaaucccuggg

SEQ ID NO: 520633 - RNA, 21 nt, Human
ccuggguacaagcugcuggca

SEQ ID NO: 520634 - RNA, 26 nt, Human
ccugugggacaggcccuucugucggg

SEQ ID NO: 520635 - RNA, 20 nt, Human
ccuucuggauuaggggcagg

SEQ ID NO: 520636 - RNA, 21 nt, Human
cuaggaccuuuuuucucaggu

SEQ ID NO: 520637 - RNA, 21 nt, Human
cucagugaucccucccaaagc

SEQ ID NO: 520638 - RNA, 20 nt, Human
cuccaacuacgugacccugc

SEQ ID NO: 520639 - RNA, 25 nt, Human
cuccaagauggauuuucuagaaaga

SEQ ID NO: 520640 - RNA, 19 nt, Human
cucccuaccaaucccuggg

SEQ ID NO: 520641 - RNA, 26 nt, Human
cucccucacaccuucccuuaacacaa

SEQ ID NO: 520642 - RNA, 20 nt, Human
cuccuggcucuaggcucauu

SEQ ID NO: 520643 - RNA, 21 nt, Human
cucucuucaccauuucuuagc

SEQ ID NO: 520644 - RNA, 20 nt, Human
cugcucccuaccaaucccug

SEQ ID NO: 520645 - RNA, 20 nt, Human
cuggaucugacaucugucuu

SEQ ID NO: 520646 - RNA, 21 nt, Human
cuggugggaugggcaguuccu

SEQ ID NO: 520647 - RNA, 19 nt, Human
cugucuuuucucuauucuc

SEQ ID NO: 520648 - RNA, 22 nt, Human
cuugccucucuucaccauuucu

SEQ ID NO: 520649 - RNA, 27 nt, Human
cuugggccuuggguuugccuccuggcu

SEQ ID NO: 520650 - RNA, 21 nt, Human
cuuugcaacauuuucuuuucu

SEQ ID NO: 520651 - RNA, 19 nt, Human
cuuuugguucugcugcacu

SEQ ID NO: 520652 - RNA, 22 nt, Human
cuuuugguucugcugcacugcc

SEQ ID NO: 520653 - RNA, 18 nt, Human
gacacuuuccaaaagccu

SEQ ID NO: 520654 - RNA, 23 nt, Human
gagaagggcuccaggcacaggug

SEQ ID NO: 520655 - RNA, 21 nt, Human
gcaagcagaacuaagcucagu

SEQ ID NO: 520656 - RNA, 20 nt, Human
gcacgaugagauugggccuu

SEQ ID NO: 520657 - RNA, 19 nt, Human
gcagcugaucucauuguua

SEQ ID NO: 520658 - RNA, 22 nt, Human
gcaguuccuggagcaaugucuc

SEQ ID NO: 520659 - RNA, 20 nt, Human
gcauuaaauuguagauuugu

SEQ ID NO: 520660 - RNA, 18 nt, Human
gccaccuucacaguggca

SEQ ID NO: 520661 - RNA, 21 nt, Human
gcccuuugccuuuugucuugg

SEQ ID NO: 520662 - RNA, 18 nt, Human
gcucuuugcaacauuuuc

SEQ ID NO: 520663 - RNA, 22 nt, Human
gcugcagcaguuggggagccua

SEQ ID NO: 520664 - RNA, 27 nt, Human
ggacagugguggggguggccugggguu

SEQ ID NO: 520665 - RNA, 21 nt, Human
ggcuggcaucaccagcccaug

SEQ ID NO: 520666 - RNA, 19 nt, Human
gggaauuccccauuguauc

SEQ ID NO: 520667 - RNA, 22 nt, Human
gggguggccugggguugaggca

SEQ ID NO: 520668 - RNA, 22 nt, Human
gggugggugcccugguuggggg

SEQ ID NO: 520669 - RNA, 23 nt, Human
ggguugaggcagagccagguugu

SEQ ID NO: 520670 - RNA, 21 nt, Human
ggugggaugggcaguuccugg

SEQ ID NO: 520671 - RNA, 22 nt, Human
guauuccuagcaucuaccccca

SEQ ID NO: 520672 - RNA, 25 nt, Human
gucuuacuucuccccacagggcucu

SEQ ID NO: 520673 - RNA, 24 nt, Human
uaaacagggagaagucagaggaga

SEQ ID NO: 520674 - RNA, 22 nt, Human
uacaguggagauaaggagcaga

SEQ ID NO: 520675 - RNA, 23 nt, Human
uaccugagugugccagaggugaa

SEQ ID NO: 520676 - RNA, 24 nt, Human
uaggaccuuuuuucucagguggaa

SEQ ID NO: 520677 - RNA, 18 nt, Human
uaggagcuagggugggug

SEQ ID NO: 520678 - RNA, 18 nt, Human
uauacccuucaugugacu

SEQ ID NO: 520679 - RNA, 21 nt, Human
uauagaaacaguaggccuggg

SEQ ID NO: 520680 - RNA, 23 nt, Human
uaucugaacugaggguuaggagc

SEQ ID NO: 520681 - RNA, 19 nt, Human
uaugagcagcugaucucau

SEQ ID NO: 520682 - RNA, 22 nt, Human
ucaaggacagugacgaggacag

SEQ ID NO: 520683 - RNA, 23 nt, Human
ucaucacacuaagggcaagcaga

SEQ ID NO: 520684 - RNA, 19 nt, Human
uccaaaagccuugucuucu

SEQ ID NO: 520685 - RNA, 18 nt, Human
ucccaguauaaacaggga

SEQ ID NO: 520686 - RNA, 19 nt, Human
ucccaguauaaacagggag

SEQ ID NO: 520687 - RNA, 19 nt, Human
ucccuggacuuccuugccc

SEQ ID NO: 520688 - RNA, 19 nt, Human
uccucuggagggcugcagc

SEQ ID NO: 520689 - RNA, 19 nt, Human
uccuugagcagaccaaugu

SEQ ID NO: 520690 - RNA, 20 nt, Human
ucuaaaaugaaccaucugaa

SEQ ID NO: 520691 - RNA, 21 nt, Human
ucucagguggaaguuuaguuu

SEQ ID NO: 520692 - RNA, 22 nt, Human
ucuguggugccguccuuggcag

SEQ ID NO: 520693 - RNA, 19 nt, Human
ugaaacauauagagugcau

SEQ ID NO: 520694 - RNA, 20 nt, Human
ugaagauaaauuuaaggagu

SEQ ID NO: 520695 - RNA, 24 nt, Human
ugaagcuagacucuguaaggcugg

SEQ ID NO: 520696 - RNA, 18 nt, Human
ugacagccaaggugauug

SEQ ID NO: 520697 - RNA, 23 nt, Human
ugaccuccaacuacgugacccuu

SEQ ID NO: 520698 - RNA, 18 nt, Human
ugagaggcaguggaggca

SEQ ID NO: 520699 - RNA, 20 nt, Human
ugaggaaaaggcaccaggua

SEQ ID NO: 520700 - RNA, 21 nt, Human
ugaggaaaaggcaccagguag

SEQ ID NO: 520701 - RNA, 19 nt, Human
ugaggcagagccagguugu

SEQ ID NO: 520702 - RNA, 22 nt, Human
ugaggcagagccagguugucug

SEQ ID NO: 520703 - RNA, 25 nt, Human
ugcccuucaucacacuaagggcaag

SEQ ID NO: 520704 - RNA, 21 nt, Human
uggcaaggagagugguggaga

SEQ ID NO: 520705 - RNA, 19 nt, Human
uggccaccuucacaguggc

SEQ ID NO: 520706 - RNA, 20 nt, Human
uggcucuguguguucuccuu

SEQ ID NO: 520707 - RNA, 21 nt, Human
ugggacaggcccuucuccauu

SEQ ID NO: 520708 - RNA, 19 nt, Human
ugggaggggauucagcuga

SEQ ID NO: 520709 - RNA, 19 nt, Human
ugggcagaacccuggggua

SEQ ID NO: 520710 - RNA, 22 nt, Human
uggggggcacaagccacucaag

SEQ ID NO: 520711 - RNA, 20 nt, Human
uggggguggccugggguuga

SEQ ID NO: 520712 - RNA, 18 nt, Human
ugggguacugcuuuggaa

SEQ ID NO: 520713 - RNA, 21 nt, Human
ugguauagaaacaguaggccu

SEQ ID NO: 520714 - RNA, 18 nt, Human
uggugccguccuuggcag

SEQ ID NO: 520715 - RNA, 22 nt, Human
uggugggaugggcaguuccugg

SEQ ID NO: 520716 - RNA, 18 nt, Human
ugguggggguggccuggg

SEQ ID NO: 520717 - RNA, 21 nt, Human
ugguggggguggccugggguu

SEQ ID NO: 520718 - RNA, 20 nt, Human
uguaaggcugggcuucuuuu

SEQ ID NO: 520719 - RNA, 20 nt, Human
uguccuggucaggcaugaga

SEQ ID NO: 520720 - RNA, 21 nt, Human
ugucuggaguguaaccgaagc

SEQ ID NO: 520721 - RNA, 24 nt, Human
ugucuggugggaugggcaguuccu

SEQ ID NO: 520722 - RNA, 19 nt, Human
ugugggacaggcccuucuc

SEQ ID NO: 520723 - RNA, 19 nt, Human
uguggugccguccuuggca

SEQ ID NO: 520724 - RNA, 24 nt, Human
uuagccucccucacaccuucccuu

SEQ ID NO: 520725 - RNA, 18 nt, Human
uuuguggucacuuucugu

SEQ ID NO: 520726 - RNA, 24 nt, Human
uuugugguucuuucccagaaacuu

SEQ ID NO: 520727 - RNA, 20 nt, Human
aaaaaagcauuuucuagcac

SEQ ID NO: 520728 - RNA, 19 nt, Human
aaaaaggaacaagucucau

SEQ ID NO: 520729 - RNA, 20 nt, Human
aaaagcauuuucuagcacuu

SEQ ID NO: 520730 - RNA, 22 nt, Human
aaacagacugauucacugagac

SEQ ID NO: 520731 - RNA, 20 nt, Human
aacacaguaauaaccuuauc

SEQ ID NO: 520732 - RNA, 23 nt, Human
aacccucaagacugccuuuaacc

SEQ ID NO: 520733 - RNA, 21 nt, Human
aauuagcugcccaacuccuuc

SEQ ID NO: 520734 - RNA, 19 nt, Human
aauuccguucucuugguga

SEQ ID NO: 520735 - RNA, 23 nt, Human
acaagcuaggucuggaacccgaa

SEQ ID NO: 520736 - RNA, 24 nt, Human
acccagucccacccauucaaaacc

SEQ ID NO: 520737 - RNA, 19 nt, Human
acccucaagacugccuuua

SEQ ID NO: 520738 - RNA, 18 nt, Human
agaauccucacauugcuc

SEQ ID NO: 520739 - RNA, 25 nt, Human
agauacaucuugcuuaaacaacaca

SEQ ID NO: 520740 - RNA, 18 nt, Human
agcuggaccacuggcaca

SEQ ID NO: 520741 - RNA, 23 nt, Human
aguuccaguaaguuuuaucaaac

SEQ ID NO: 520742 - RNA, 21 nt, Human
auauaaccacaaacauuaccu

SEQ ID NO: 520743 - RNA, 21 nt, Human
augaacuuauacuauaccaaa

SEQ ID NO: 520744 - RNA, 23 nt, Human
augccaauggcagcaaacaacag

SEQ ID NO: 520745 - RNA, 22 nt, Human
caaaaccugcuacaaaugcugg

SEQ ID NO: 520746 - RNA, 23 nt, Human
caaaaccugcuacaaaugcuggu

SEQ ID NO: 520747 - RNA, 19 nt, Human
caaagcagguguaggagug

SEQ ID NO: 520748 - RNA, 21 nt, Human
cacaagcuaggucuggaaccc

SEQ ID NO: 520749 - RNA, 20 nt, Human
cacauugcucacagccucca

SEQ ID NO: 520750 - RNA, 21 nt, Human
cagcaaauacuuuugcuaaua

SEQ ID NO: 520751 - RNA, 20 nt, Human
cagcauauucaccaaacguu

SEQ ID NO: 520752 - RNA, 22 nt, Human
cccaacuccuucaaauuggaaa

SEQ ID NO: 520753 - RNA, 23 nt, Human
cccucaagacugccuuuaaccaa

SEQ ID NO: 520754 - RNA, 19 nt, Human
cucucugaacugaggaaac

SEQ ID NO: 520755 - RNA, 22 nt, Human
cuuagggagaaaaaaaggaaca

SEQ ID NO: 520756 - RNA, 18 nt, Human
gaacccgaaaaggaagua

SEQ ID NO: 520757 - RNA, 18 nt, Human
gagaaaaaaaggaacaag

SEQ ID NO: 520758 - RNA, 21 nt, Human
gcaaaacacaguaauaaccuu

SEQ ID NO: 520759 - RNA, 20 nt, Human
gccagggaacccagcuguau

SEQ ID NO: 520760 - RNA, 22 nt, Human
gcuaggucuggaacccgaaaag

SEQ ID NO: 520761 - RNA, 20 nt, Human
gcucacagccuccauuccau

SEQ ID NO: 520762 - RNA, 21 nt, Human
ggagugggacugccaucuacc

SEQ ID NO: 520763 - RNA, 23 nt, Human
guugugcuccagcuggaccacug

SEQ ID NO: 520764 - RNA, 18 nt, Human
uaaauagaauccucacau

SEQ ID NO: 520765 - RNA, 24 nt, Human
uaacaacacaaaaaucacauuuca

SEQ ID NO: 520766 - RNA, 26 nt, Human
uaauuccagcaaauacuuuugcuaau

SEQ ID NO: 520767 - RNA, 20 nt, Human
uaccaggagagcuugguaac

SEQ ID NO: 520768 - RNA, 19 nt, Human
uagaacucugaauucuggg

SEQ ID NO: 520769 - RNA, 20 nt, Human
uagcugcccaacuccuucaa

SEQ ID NO: 520770 - RNA, 20 nt, Human
uagucuuuuccacacugagu

SEQ ID NO: 520771 - RNA, 24 nt, Human
ucacugguuuacaaguuauaauug

SEQ ID NO: 520772 - RNA, 19 nt, Human
ucaguacagauacaucuuc

SEQ ID NO: 520773 - RNA, 23 nt, Human
uccagcaaauacuuuugcuaaua

SEQ ID NO: 520774 - RNA, 25 nt, Human
ucuaacccucaagacugccuuuaac

SEQ ID NO: 520775 - RNA, 21 nt, Human
ucuaccaggcccaagccacau

SEQ ID NO: 520776 - RNA, 20 nt, Human
ucucauaaaaccaaauaagc

SEQ ID NO: 520777 - RNA, 18 nt, Human
ucugaacugaggaaacag

SEQ ID NO: 520778 - RNA, 20 nt, Human
ucugaacugaggaaacagca

SEQ ID NO: 520779 - RNA, 20 nt, Human
ucuggaacccgaaaaggaag

SEQ ID NO: 520780 - RNA, 23 nt, Human
ucuggggcaaacucugcagaagu

SEQ ID NO: 520781 - RNA, 25 nt, Human
ugaaaagaguguguaaucuguaguc

SEQ ID NO: 520782 - RNA, 18 nt, Human
ugaaagaauuccauggcg

SEQ ID NO: 520783 - RNA, 24 nt, Human
ugaaugaaagaacuguaacagccc

SEQ ID NO: 520784 - RNA, 19 nt, Human
ugacaaagcagguguagga

SEQ ID NO: 520785 - RNA, 23 nt, Human
ugaggaaacagcauauucaccaa

SEQ ID NO: 520786 - RNA, 23 nt, Human
ugaggaaacagcauauucacccc

SEQ ID NO: 520787 - RNA, 24 nt, Human
ugcuaauauacuuugugcaaaaca

SEQ ID NO: 520788 - RNA, 24 nt, Human
uggaauggaugauaaugaaagaga

SEQ ID NO: 520789 - RNA, 24 nt, Human
uggauugaguucauaucaaauaau

SEQ ID NO: 520790 - RNA, 22 nt, Human
uguaaauccagguauuugcuuu

SEQ ID NO: 520791 - RNA, 23 nt, Human
uguagucuuuuccacacugagua

SEQ ID NO: 520792 - RNA, 18 nt, Human
ugugaacaacuacuuuca

SEQ ID NO: 520793 - RNA, 20 nt, Human
uuagugaaaaguuuugcugg

SEQ ID NO: 520794 - RNA, 20 nt, Human
aaagauccguggguaugugg

SEQ ID NO: 520795 - RNA, 22 nt, Human
accccuuccaacuucaaggcua

SEQ ID NO: 520796 - RNA, 19 nt, Human
accucuuuccuccagucca

SEQ ID NO: 520797 - RNA, 20 nt, Human
accuggcacuuuaccuccuc

SEQ ID NO: 520798 - RNA, 21 nt, Human
agacaggaggggguggcagag

SEQ ID NO: 520799 - RNA, 23 nt, Human
agccaccuuccugccccagccuc

SEQ ID NO: 520800 - RNA, 18 nt, Human
aggacagagggcaggccu

SEQ ID NO: 520801 - RNA, 19 nt, Human
aggccaggagagucccacg

SEQ ID NO: 520802 - RNA, 22 nt, Human
aggggagauggcagggccugag

SEQ ID NO: 520803 - RNA, 18 nt, Human
aggggguggcagagaaga

SEQ ID NO: 520804 - RNA, 20 nt, Human
auggaguuggcagauggcag

SEQ ID NO: 520805 - RNA, 23 nt, Human
auuucagccaccucuuuccucca

SEQ ID NO: 520806 - RNA, 20 nt, Human
caauguguagcucaacggau

SEQ ID NO: 520807 - RNA, 19 nt, Human
caccccuuccaacuucaag

SEQ ID NO: 520808 - RNA, 18 nt, Human
cacuguucccuggaugga

SEQ ID NO: 520809 - RNA, 18 nt, Human
cagagaugaaaaucccug

SEQ ID NO: 520810 - RNA, 18 nt, Human
cagcagagcaggggguug

SEQ ID NO: 520811 - RNA, 24 nt, Human
cagcaucccucuccccagugcugc

SEQ ID NO: 520812 - RNA, 18 nt, Human
cagcccuugcugaccagg

SEQ ID NO: 520813 - RNA, 22 nt, Human
cagccucugccccagcgcugcu

SEQ ID NO: 520814 - RNA, 21 nt, Human
caggaggcuccauuccacccc

SEQ ID NO: 520815 - RNA, 23 nt, Human
caguggggcccgccccaccuccc

SEQ ID NO: 520816 - RNA, 21 nt, Human
ccagagaugaaaaucccuggg

SEQ ID NO: 520817 - RNA, 22 nt, Human
cccacgguggggaggacagggc

SEQ ID NO: 520818 - RNA, 19 nt, Human
ccccagccucugccccagc

SEQ ID NO: 520819 - RNA, 22 nt, Human
ccccagccucugccccagcgcu

SEQ ID NO: 520820 - RNA, 24 nt, Human
ccccugggcuacuuucaccggccc

SEQ ID NO: 520821 - RNA, 25 nt, Human
cccuagagauugaauaaucuauacu

SEQ ID NO: 520822 - RNA, 19 nt, Human
cccuggggacaguugcucc

SEQ ID NO: 520823 - RNA, 23 nt, Human
ccuccacuguaaggcagggauug

SEQ ID NO: 520824 - RNA, 18 nt, Human
ccuccuggcccugcuccc

SEQ ID NO: 520825 - RNA, 23 nt, Human
ccugccccagccucugccccagc

SEQ ID NO: 520826 - RNA, 21 nt, Human
ccugggcuggccucuacgccc

SEQ ID NO: 520827 - RNA, 21 nt, Human
ccuuccugccccagccucugc

SEQ ID NO: 520828 - RNA, 18 nt, Human
cgcccauuacccauuaac

SEQ ID NO: 520829 - RNA, 19 nt, Human
cgcccauuacccauuaacc

SEQ ID NO: 520830 - RNA, 21 nt, Human
cgguggggaggacagggcugu

SEQ ID NO: 520831 - RNA, 20 nt, Human
cuccuggcccugcucccacu

SEQ ID NO: 520832 - RNA, 19 nt, Human
cuggcugccucgaaugucu

SEQ ID NO: 520833 - RNA, 18 nt, Human
cuugcggaguccugcccc

SEQ ID NO: 520834 - RNA, 21 nt, Human
cuuugagcccuccucuuccuc

SEQ ID NO: 520835 - RNA, 20 nt, Human
gaacuggagagggcaccauu

SEQ ID NO: 520836 - RNA, 19 nt, Human
gacaggaggggguggcaga

SEQ ID NO: 520837 - RNA, 20 nt, Human
gagaacuuagaugaugguca

SEQ ID NO: 520838 - RNA, 18 nt, Human
gagaagccaggggcacag

SEQ ID NO: 520839 - RNA, 19 nt, Human
gagagucccacggugggga

SEQ ID NO: 520840 - RNA, 18 nt, Human
gagauggcagggccugag

SEQ ID NO: 520841 - RNA, 19 nt, Human
gagggcaccauuuacugau

SEQ ID NO: 520842 - RNA, 24 nt, Human
gcagagaagaaccucagcucugaa

SEQ ID NO: 520843 - RNA, 20 nt, Human
gccuuggggacuagguggag

SEQ ID NO: 520844 - RNA, 24 nt, Human
gcguggccugguccuggucccugg

SEQ ID NO: 520845 - RNA, 20 nt, Human
gcuccauuccaccccuucca

SEQ ID NO: 520846 - RNA, 20 nt, Human
gcucuggcccagcguggccu

SEQ ID NO: 520847 - RNA, 21 nt, Human
gcuggcugccucgaaugucuu

SEQ ID NO: 520848 - RNA, 23 nt, Human
ggaggccaggagagucccacggu

SEQ ID NO: 520849 - RNA, 19 nt, Human
ggccugguccuggucccug

SEQ ID NO: 520850 - RNA, 21 nt, Human
gggacagugaugggugcugag

SEQ ID NO: 520851 - RNA, 23 nt, Human
gggccgggggccgggggggccuc

SEQ ID NO: 520852 - RNA, 20 nt, Human
gggggggccucugccacugu

SEQ ID NO: 520853 - RNA, 21 nt, Human
ggguggaggaggggcagggug

SEQ ID NO: 520854 - RNA, 18 nt, Human
gguggaggaggggcaggg

SEQ ID NO: 520855 - RNA, 24 nt, Human
guguaacaggggagauggcagggc

SEQ ID NO: 520856 - RNA, 20 nt, Human
uacgcccauuacccauuaac

SEQ ID NO: 520857 - RNA, 18 nt, Human
uauauuguauagagcugu

SEQ ID NO: 520858 - RNA, 22 nt, Human
ucaccggcccagccaccuuccu

SEQ ID NO: 520859 - RNA, 18 nt, Human
ucccuggggacaguugcu

SEQ ID NO: 520860 - RNA, 20 nt, Human
uccgcaggcaggccugaccc

SEQ ID NO: 520861 - RNA, 21 nt, Human
uccgcaggcaggccugacccc

SEQ ID NO: 520862 - RNA, 23 nt, Human
uccuccaguccagagaugaaaau

SEQ ID NO: 520863 - RNA, 19 nt, Human
uccuuguaugcaagucccc

SEQ ID NO: 520864 - RNA, 18 nt, Human
ucuccugggcuggccucu

SEQ ID NO: 520865 - RNA, 18 nt, Human
ugaccaggacagggacaa

SEQ ID NO: 520866 - RNA, 22 nt, Human
ugaccccggguggaggaggggc

SEQ ID NO: 520867 - RNA, 23 nt, Human
ugagcccuccucuuccucugcga

SEQ ID NO: 520868 - RNA, 20 nt, Human
ugaggacagagggcaggccu

SEQ ID NO: 520869 - RNA, 23 nt, Human
ugaggccucugaggacagagggc

SEQ ID NO: 520870 - RNA, 22 nt, Human
ugaugggccccccuagguccuu

SEQ ID NO: 520871 - RNA, 23 nt, Human
ugcaagacaggaggggguggcag

SEQ ID NO: 520872 - RNA, 22 nt, Human
ugccagcaucccucuccccagu

SEQ ID NO: 520873 - RNA, 20 nt, Human
ugccccagccucugccccag

SEQ ID NO: 520874 - RNA, 21 nt, Human
ugccccagccucugccccagc

SEQ ID NO: 520875 - RNA, 21 nt, Human
ugcugagagcugauuggaacu

SEQ ID NO: 520876 - RNA, 22 nt, Human
ugcuguguggguccacaggagg

SEQ ID NO: 520877 - RNA, 20 nt, Human
uggaacuggagagggcacca

SEQ ID NO: 520878 - RNA, 23 nt, Human
uggcagccucaacucuuggcuga

SEQ ID NO: 520879 - RNA, 20 nt, Human
uggcagggccugagcucccu

SEQ ID NO: 520880 - RNA, 18 nt, Human
uggcauggggccgggggc

SEQ ID NO: 520881 - RNA, 18 nt, Human
uggcauggggccgggggc

SEQ ID NO: 520882 - RNA, 24 nt, Human
uggcauggggccgggggccggggg

SEQ ID NO: 520883 - RNA, 21 nt, Human
uggccucuacgcccauuaccc

SEQ ID NO: 520884 - RNA, 22 nt, Human
uggccugguccuggucccuggc

SEQ ID NO: 520885 - RNA, 22 nt, Human
uggcugccucgaaugucuuugc

SEQ ID NO: 520886 - RNA, 27 nt, Human
uggggacaguugcuccuuucccccugg

SEQ ID NO: 520887 - RNA, 18 nt, Human
uggggcccgccccaccuc

SEQ ID NO: 520888 - RNA, 24 nt, Human
uggugagaacuuagaugaugguca

SEQ ID NO: 520889 - RNA, 24 nt, Human
uguaggcgggugucuacuuugucc

SEQ ID NO: 520890 - RNA, 21 nt, Human
uuccaccccuuccaacuucaa

SEQ ID NO: 520891 - RNA, 19 nt, Human
uucccuucuaccuccagcc

SEQ ID NO: 520892 - RNA, 18 nt, Human
uugaguugcagggaggga

SEQ ID NO: 520893 - RNA, 22 nt, Human
uugcagcagagcaggggguugg

SEQ ID NO: 520894 - RNA, 18 nt, Human
uuggaacuggagagggca

SEQ ID NO: 520895 - RNA, 19 nt, Human
uuggagacaccuguccagc

SEQ ID NO: 520896 - RNA, 21 nt, Human
aaaaccuccuccacuacuugg

SEQ ID NO: 520897 - RNA, 18 nt, Human
aaaagacccuguacuccu

SEQ ID NO: 520898 - RNA, 21 nt, Human
aaagcagcacgaauacucuuc

SEQ ID NO: 520899 - RNA, 21 nt, Human
aaagucaaacuacugauuuaa

SEQ ID NO: 520900 - RNA, 24 nt, Human
aaccacagcagaugaaucagaacc

SEQ ID NO: 520901 - RNA, 21 nt, Human
acaagaaaggcuaaacuagga

SEQ ID NO: 520902 - RNA, 18 nt, Human
agacaagaaaggcuaaac

SEQ ID NO: 520903 - RNA, 21 nt, Human
agaugaaucagaaccgcacaa

SEQ ID NO: 520904 - RNA, 24 nt, Human
agcagaugaaucagaaccgcacaa

SEQ ID NO: 520905 - RNA, 21 nt, Human
auucugguuuugacacaaauu

SEQ ID NO: 520906 - RNA, 24 nt, Human
caagaaaggcuaaacuagagcucu

SEQ ID NO: 520907 - RNA, 22 nt, Human
caagaguaaauuuaaaaacuug

SEQ ID NO: 520908 - RNA, 19 nt, Human
cacuacuuggaccaccacu

SEQ ID NO: 520909 - RNA, 18 nt, Human
cagcacaucugugagaca

SEQ ID NO: 520910 - RNA, 20 nt, Human
ccuccuccacuacuuggacc

SEQ ID NO: 520911 - RNA, 26 nt, Human
gaaccgcacaaacacugguuaaagag

SEQ ID NO: 520912 - RNA, 19 nt, Human
gcucugcuucuucuaaucc

SEQ ID NO: 520913 - RNA, 21 nt, Human
ggauacagcacaucugugaga

SEQ ID NO: 520914 - RNA, 18 nt, Human
uaagaguuuugaaaaaga

SEQ ID NO: 520915 - RNA, 22 nt, Human
uacagcacaucugugagacaag

SEQ ID NO: 520916 - RNA, 18 nt, Human
uacccuggcaaaagucaa

SEQ ID NO: 520917 - RNA, 24 nt, Human
uaguaugccugggauacagcacau

SEQ ID NO: 520918 - RNA, 23 nt, Human
uccacuacuuggaccaccacuug

SEQ ID NO: 520919 - RNA, 20 nt, Human
ucuacaaaaccuccuccacu

SEQ ID NO: 520920 - RNA, 18 nt, Human
ugaaaaagagccauaagu

SEQ ID NO: 520921 - RNA, 23 nt, Human
ugggauacagcacaucugugaga

SEQ ID NO: 520922 - RNA, 24 nt, Human
ugguaaaucacuggaaccauacuc

SEQ ID NO: 520923 - RNA, 20 nt, Human
ugguuuuaaaauuauucacu

SEQ ID NO: 520924 - RNA, 22 nt, Human
uuaucgguaauagaucuuccuu

SEQ ID NO: 520925 - RNA, 20 nt, Human
uugucguguauuuucuuccu

SEQ ID NO: 520926 - RNA, 21 nt, Human
uuuaagaguuuugaaaaagag

SEQ ID NO: 520927 - RNA, 21 nt, Human
uuuuuugugccugucuucuug

SEQ ID NO: 520928 - RNA, 18 nt, Human
agacucaaaauacacuaa

SEQ ID NO: 520929 - RNA, 20 nt, Human
agacucaaaauacacuaaua

SEQ ID NO: 520930 - RNA, 20 nt, Human
agccagcauggcucggcggg

SEQ ID NO: 520931 - RNA, 24 nt, Human
caucauuaacccgguuuuccagga

SEQ ID NO: 520932 - RNA, 21 nt, Human
cauggcucggcggguguacca

SEQ ID NO: 520933 - RNA, 20 nt, Human
ccucaaagucuggagaggag

SEQ ID NO: 520934 - RNA, 24 nt, Human
ccugcaaugcaugcuggugucaug

SEQ ID NO: 520935 - RNA, 18 nt, Human
uacagacucaaaauacac

SEQ ID NO: 520936 - RNA, 24 nt, Human
uauuuuuacagacucaaaauacac

SEQ ID NO: 520937 - RNA, 20 nt, Human
uccugcaaugcaugcuggug

SEQ ID NO: 520938 - RNA, 19 nt, Human
ugcaucaucaccagcucug

SEQ ID NO: 520939 - RNA, 21 nt, Human
uggcagccagcauggcucggc

SEQ ID NO: 520940 - RNA, 23 nt, Human
uucauugcaucauuaacccgguu

SEQ ID NO: 520941 - RNA, 19 nt, Human
uuccaggaagcgccaagug

SEQ ID NO: 520942 - RNA, 18 nt, Human
aaccagagcugcugaacc

SEQ ID NO: 520943 - RNA, 22 nt, Human
aagcucucucagccagcaauuu

SEQ ID NO: 520944 - RNA, 21 nt, Human
aaguacagaugcaggaugcag

SEQ ID NO: 520945 - RNA, 21 nt, Human
accuccccguccucuccgcug

SEQ ID NO: 520946 - RNA, 28 nt, Human
aggaaagagguaccuuuuaugaaaagga

SEQ ID NO: 520947 - RNA, 18 nt, Human
aggacccggaaagaccaa

SEQ ID NO: 520948 - RNA, 19 nt, Human
aggcaccgaggacucaaac

SEQ ID NO: 520949 - RNA, 19 nt, Human
aggcagggaggguuaacua

SEQ ID NO: 520950 - RNA, 24 nt, Human
agguaccuuuuaugaaaaggacuu

SEQ ID NO: 520951 - RNA, 22 nt, Human
aguccuuuuuguuaagaaaagg

SEQ ID NO: 520952 - RNA, 18 nt, Human
auccaucuuuccuuccaa

SEQ ID NO: 520953 - RNA, 19 nt, Human
auggcucugggcugugccc

SEQ ID NO: 520954 - RNA, 20 nt, Human
auuguuugguagaaaaacag

SEQ ID NO: 520955 - RNA, 23 nt, Human
cacugggcuucuucaaugggcuc

SEQ ID NO: 520956 - RNA, 24 nt, Human
cacuucucuccuagcagccagagg

SEQ ID NO: 520957 - RNA, 26 nt, Human
cccuugaaucugacauucaagucacc

SEQ ID NO: 520958 - RNA, 22 nt, Human
ccggaaagaccaagguguagcg

SEQ ID NO: 520959 - RNA, 20 nt, Human
ccuuugacgccgggcccuug

SEQ ID NO: 520960 - RNA, 20 nt, Human
cggaacauucagcacuucuc

SEQ ID NO: 520961 - RNA, 25 nt, Human
cgugcaaggacccggaaagaccaag

SEQ ID NO: 520962 - RNA, 28 nt, Human
cucaaauaacuuuccugagcaucuccac

SEQ ID NO: 520963 - RNA, 20 nt, Human
cuccacacggaacauucagc

SEQ ID NO: 520964 - RNA, 26 nt, Human
cuccggcucagcucugcaggaguugg

SEQ ID NO: 520965 - RNA, 18 nt, Human
cucugcaggaguuggagc

SEQ ID NO: 520966 - RNA, 23 nt, Human
cucuugguuuuauuguuugguag

SEQ ID NO: 520967 - RNA, 19 nt, Human
cugaauaaacaucucacga

SEQ ID NO: 520968 - RNA, 18 nt, Human
cuguucagcgugucccuu

SEQ ID NO: 520969 - RNA, 22 nt, Human
gacucaaaccaucucaccgucu

SEQ ID NO: 520970 - RNA, 22 nt, Human
gcucuuggaggaagaagcuuuu

SEQ ID NO: 520971 - RNA, 21 nt, Human
uaauagaaaccagagcugcug

SEQ ID NO: 520972 - RNA, 24 nt, Human
uagauuacaaaaagucaaaaccaa

SEQ ID NO: 520973 - RNA, 21 nt, Human
ucaaugggcucuuggaggaag

SEQ ID NO: 520974 - RNA, 19 nt, Human
uccacacggaacauucagc

SEQ ID NO: 520975 - RNA, 21 nt, Human
uccggcucagcucugcaggag

SEQ ID NO: 520976 - RNA, 20 nt, Human
uccuagauuacaaaaaguca

SEQ ID NO: 520977 - RNA, 18 nt, Human
uccugcuacccaggcacc

SEQ ID NO: 520978 - RNA, 26 nt, Human
ucuucaguccuuagaaaaguccuuuu

SEQ ID NO: 520979 - RNA, 19 nt, Human
ucuugguuuuauuguuugg

SEQ ID NO: 520980 - RNA, 25 nt, Human
ugaaaaggacuuccaagcucucuca

SEQ ID NO: 520981 - RNA, 19 nt, Human
uggcucugggcugugcccu

SEQ ID NO: 520982 - RNA, 19 nt, Human
uuccccaaguacagaugca

SEQ ID NO: 520983 - RNA, 23 nt, Human
uuuccuuugacgccgggcccuug

SEQ ID NO: 520984 - RNA, 18 nt, Human
uuuguuaagaaaaggcag

SEQ ID NO: 520985 - RNA, 25 nt, Human
acccaggggagucuggaccacaggg

SEQ ID NO: 520986 - RNA, 22 nt, Human
accuugccucaggacuuuauug

SEQ ID NO: 520987 - RNA, 18 nt, Human
agauggccaagaagggga

SEQ ID NO: 520988 - RNA, 22 nt, Human
augacaggacccuuggccaggu

SEQ ID NO: 520989 - RNA, 19 nt, Human
caacaaugcuggcagugac

SEQ ID NO: 520990 - RNA, 23 nt, Human
caggacccuuggccagguccagg

SEQ ID NO: 520991 - RNA, 21 nt, Human
caggauggagauggccaagaa

SEQ ID NO: 520992 - RNA, 19 nt, Human
ccacugggguaaguccugu

SEQ ID NO: 520993 - RNA, 20 nt, Human
ccauugucaugucagauccc

SEQ ID NO: 520994 - RNA, 23 nt, Human
cuuucaguccugacucacaggau

SEQ ID NO: 520995 - RNA, 20 nt, Human
gcagugaccugucugugccc

SEQ ID NO: 520996 - RNA, 24 nt, Human
gcuggcagugaccugucugugccc

SEQ ID NO: 520997 - RNA, 22 nt, Human
ggggagucuggaccacagggcc

SEQ ID NO: 520998 - RNA, 22 nt, Human
ggucagaccugcuuagcugcuu

SEQ ID NO: 520999 - RNA, 18 nt, Human
gugaccugucugugcccu

SEQ ID NO: 521000 - RNA, 22 nt, Human
uaaguugguuuuccaaaccuug

SEQ ID NO: 521001 - RNA, 18 nt, Human
ucccaacccaggggaguc

SEQ ID NO: 521002 - RNA, 24 nt, Human
ucccaacccaggggagucuggacc

SEQ ID NO: 521003 - RNA, 19 nt, Human
ucuccagcacaugggcuca

SEQ ID NO: 521004 - RNA, 22 nt, Human
ugaguguguauuuucuccagca

SEQ ID NO: 521005 - RNA, 27 nt, Human
uucuccagcacaugggcucacccuggg

SEQ ID NO: 521006 - RNA, 19 nt, Human
aaaaaaaaaaccccaucac

SEQ ID NO: 521007 - RNA, 22 nt, Human
aaaaaaccccaucaccaaagac

SEQ ID NO: 521008 - RNA, 23 nt, Human
aaaaccuaguaagaacaaagcaa

SEQ ID NO: 521009 - RNA, 24 nt, Human
aaacaccaagggccaaaacgccag

SEQ ID NO: 521010 - RNA, 27 nt, Human
aaacaccaucagcagcugccagcucuu

SEQ ID NO: 521011 - RNA, 21 nt, Human
aaacagaaauggggaaauccc

SEQ ID NO: 521012 - RNA, 18 nt, Human
aaccaacacgacaggcac

SEQ ID NO: 521013 - RNA, 20 nt, Human
aacguggccauggcucaaaa

SEQ ID NO: 521014 - RNA, 21 nt, Human
aacugcuuugaaaaccagucc

SEQ ID NO: 521015 - RNA, 18 nt, Human
aaggacucuccuuggccu

SEQ ID NO: 521016 - RNA, 23 nt, Human
aaugguccuuuugcuuugcaccu

SEQ ID NO: 521017 - RNA, 22 nt, Human
acaaagcaaaaccaccgugguu

SEQ ID NO: 521018 - RNA, 23 nt, Human
acauuuuuuuuuuuuuuuacuaa

SEQ ID NO: 521019 - RNA, 18 nt, Human
accaagagacagaauucc

SEQ ID NO: 521020 - RNA, 23 nt, Human
accaagggccaaaacgccagcag

SEQ ID NO: 521021 - RNA, 29 nt, Human
accccgagaacagagcacgugugaagaac

SEQ ID NO: 521022 - RNA, 21 nt, Human
acccuacugccaggucuacag

SEQ ID NO: 521023 - RNA, 22 nt, Human
acccucacccuccaagaaggca

SEQ ID NO: 521024 - RNA, 18 nt, Human
accuacggcaccuuccuu

SEQ ID NO: 521025 - RNA, 18 nt, Human
acgcagcccaggcucccc

SEQ ID NO: 521026 - RNA, 20 nt, Human
agaagccugcacaaagagaa

SEQ ID NO: 521027 - RNA, 18 nt, Human
agacggcagugaaaacuc

SEQ ID NO: 521028 - RNA, 24 nt, Human
agcagccacuaacccaaacccacg

SEQ ID NO: 521029 - RNA, 20 nt, Human
agcccugcgccaccucaggc

SEQ ID NO: 521030 - RNA, 20 nt, Human
agcugaggaaaaaggcgcca

SEQ ID NO: 521031 - RNA, 21 nt, Human
aggagggagauacaaagaaga

SEQ ID NO: 521032 - RNA, 19 nt, Human
aggcacgggauggcagcac

SEQ ID NO: 521033 - RNA, 19 nt, Human
aggcagcaaacagaaaugg

SEQ ID NO: 521034 - RNA, 21 nt, Human
agggagaggggaaggggaggc

SEQ ID NO: 521035 - RNA, 23 nt, Human
caaaacgccagcagccacuaacc

SEQ ID NO: 521036 - RNA, 20 nt, Human
caaaguguccugcauuaaaa

SEQ ID NO: 521037 - RNA, 19 nt, Human
caagaaauauucugaaaaa

SEQ ID NO: 521038 - RNA, 24 nt, Human
caagggccaaaacgccagcagcca

SEQ ID NO: 521039 - RNA, 18 nt, Human
cagaaacaccaagggcca

SEQ ID NO: 521040 - RNA, 22 nt, Human
cagcaaaucagucuccacaacc

SEQ ID NO: 521041 - RNA, 23 nt, Human
cagcaaaucagucuccacaacca

SEQ ID NO: 521042 - RNA, 20 nt, Human
cagccacuaacccaaaccca

SEQ ID NO: 521043 - RNA, 24 nt, Human
caggcuccccuagaucccuggagg

SEQ ID NO: 521044 - RNA, 23 nt, Human
caugaggaccugaagcugggggu

SEQ ID NO: 521045 - RNA, 21 nt, Human
ccagcagccacuaacccaaac

SEQ ID NO: 521046 - RNA, 23 nt, Human
ccaugaggaccugaagcuggggg

SEQ ID NO: 521047 - RNA, 22 nt, Human
cccaaacccacgucuuccuccu

SEQ ID NO: 521048 - RNA, 26 nt, Human
cccaagccacccucacccuccaagaa

SEQ ID NO: 521049 - RNA, 20 nt, Human
cccagacucugaauaugauu

SEQ ID NO: 521050 - RNA, 22 nt, Human
cccagcaaaucagucuccacaa

SEQ ID NO: 521051 - RNA, 19 nt, Human
ccccaucaccaaagacacc

SEQ ID NO: 521052 - RNA, 20 nt, Human
cccuagaucccuggaggcuc

SEQ ID NO: 521053 - RNA, 20 nt, Human
cccuuuauuccucucuuucc

SEQ ID NO: 521054 - RNA, 18 nt, Human
cgcagcccaggcuccccu

SEQ ID NO: 521055 - RNA, 21 nt, Human
cgcagcccaggcuccccuaga

SEQ ID NO: 521056 - RNA, 18 nt, Human
cgugcccuccccucccca

SEQ ID NO: 521057 - RNA, 22 nt, Human
cucacaaugacaacguggccau

SEQ ID NO: 521058 - RNA, 20 nt, Human
cucucucccuuuauuccucu

SEQ ID NO: 521059 - RNA, 19 nt, Human
cugcacaaagagaaaaauc

SEQ ID NO: 521060 - RNA, 19 nt, Human
cugcugcccgggugggcug

SEQ ID NO: 521061 - RNA, 24 nt, Human
cuuuuuuuuuuuuuuuuugccccu

SEQ ID NO: 521062 - RNA, 20 nt, Human
cuuuuuuuuuuuuuuuuugg

SEQ ID NO: 521063 - RNA, 21 nt, Human
gaacgugcccuccccucccca

SEQ ID NO: 521064 - RNA, 19 nt, Human
gaauaaacaguuucccaag

SEQ ID NO: 521065 - RNA, 21 nt, Human
gacaaacucacagaugggauu

SEQ ID NO: 521066 - RNA, 19 nt, Human
gagggagaggggaagggga

SEQ ID NO: 521067 - RNA, 21 nt, Human
gcacaaagagaaaaauccgua

SEQ ID NO: 521068 - RNA, 24 nt, Human
gcccuccccuccccaugaggaccc

SEQ ID NO: 521069 - RNA, 21 nt, Human
ggaggagagggggcacaagcg

SEQ ID NO: 521070 - RNA, 23 nt, Human
ggcaccaaaaccuaguaagaaca

SEQ ID NO: 521071 - RNA, 26 nt, Human
gggaaggagggagauacaaagaagaa

SEQ ID NO: 521072 - RNA, 19 nt, Human
gggccaaaacgccagcagc

SEQ ID NO: 521073 - RNA, 20 nt, Human
gggcugggaaggagggagau

SEQ ID NO: 521074 - RNA, 22 nt, Human
ggggaaggggaggcccuccuga

SEQ ID NO: 521075 - RNA, 20 nt, Human
gguggaagggaggcaaggag

SEQ ID NO: 521076 - RNA, 20 nt, Human
gguugucuugggaagugagg

SEQ ID NO: 521077 - RNA, 23 nt, Human
uaaaaaaaaaaaccccaucacca

SEQ ID NO: 521078 - RNA, 23 nt, Human
uaaaaaaaaaaaccccaucacca

SEQ ID NO: 521079 - RNA, 25 nt, Human
uaaaaaaaaaaaccccaucaccaaa

SEQ ID NO: 521080 - RNA, 22 nt, Human
uaaaugguccuuuugcuuugca

SEQ ID NO: 521081 - RNA, 22 nt, Human
uaacugcuuugaaaaccagucc

SEQ ID NO: 521082 - RNA, 19 nt, Human
uaagaacaaagcaaaacca

SEQ ID NO: 521083 - RNA, 23 nt, Human
uaaggcugcucaacacacagccc

SEQ ID NO: 521084 - RNA, 24 nt, Human
uacaaagaagaaaguaggcaugau

SEQ ID NO: 521085 - RNA, 23 nt, Human
uaugauuccaagaaauauucuga

SEQ ID NO: 521086 - RNA, 19 nt, Human
uauuccucucuuuccugcc

SEQ ID NO: 521087 - RNA, 24 nt, Human
uauuguugcuguaaaaacauuaca

SEQ ID NO: 521088 - RNA, 20 nt, Human
ucaaacagcuuucuaaagac

SEQ ID NO: 521089 - RNA, 23 nt, Human
ucaagaacgugcccuccccuccc

SEQ ID NO: 521090 - RNA, 23 nt, Human
ucacaaugacaacguggccaugg

SEQ ID NO: 521091 - RNA, 19 nt, Human
ucaccaaagacaccugugc

SEQ ID NO: 521092 - RNA, 18 nt, Human
ucacgggugcaaggacuc

SEQ ID NO: 521093 - RNA, 24 nt, Human
ucacugggucgguucccaagccac

SEQ ID NO: 521094 - RNA, 26 nt, Human
uccagaaacaccaagggccaaaacgc

SEQ ID NO: 521095 - RNA, 18 nt, Human
ucccaagccacccucacc

SEQ ID NO: 521096 - RNA, 22 nt, Human
uccccuagaucccuggaggcuc

SEQ ID NO: 521097 - RNA, 19 nt, Human
uccuuuugcuuugcaccug

SEQ ID NO: 521098 - RNA, 18 nt, Human
ucugucaccaaccuaggg

SEQ ID NO: 521099 - RNA, 22 nt, Human
ugaaauuacaaaauugcuuucu

SEQ ID NO: 521100 - RNA, 25 nt, Human
ugaauggaacaaccccgagaacaga

SEQ ID NO: 521101 - RNA, 21 nt, Human
ugaggaccugaagcugggggu

SEQ ID NO: 521102 - RNA, 18 nt, Human
ugagugucuagcauccuu

SEQ ID NO: 521103 - RNA, 24 nt, Human
ugcacaaagagaaaaauccguaua

SEQ ID NO: 521104 - RNA, 22 nt, Human
uggaagacagcugaggaaaaag

SEQ ID NO: 521105 - RNA, 21 nt, Human
uggaagggaggcaaggaggcc

SEQ ID NO: 521106 - RNA, 20 nt, Human
uggcuuugagcuuuaccaag

SEQ ID NO: 521107 - RNA, 23 nt, Human
ugggaaggagggagauacaaaga

SEQ ID NO: 521108 - RNA, 18 nt, Human
ugucuugggaagugaggg

SEQ ID NO: 521109 - RNA, 23 nt, Human
ugucuugggaagugagggggguu

SEQ ID NO: 521110 - RNA, 22 nt, Human
uuauaaaaaaaaaaaccccauc

SEQ ID NO: 521111 - RNA, 24 nt, Human
uucaaacagcuuucuaaagacgag

SEQ ID NO: 521112 - RNA, 19 nt, Human
uucacauuuuuaaaaaauu

SEQ ID NO: 521113 - RNA, 18 nt, Human
uucgcuggacucccuggg

SEQ ID NO: 521114 - RNA, 18 nt, Human
uugcaccugagaccucgc

SEQ ID NO: 521115 - RNA, 26 nt, Human
uuucugagccaauuuaaaagucacau

SEQ ID NO: 521116 - RNA, 24 nt, Human
uuuuacuaaguuauaaaaaaaaaa

SEQ ID NO: 521117 - RNA, 19 nt, Human
uuuuuuuucagacaaggua

SEQ ID NO: 521118 - RNA, 25 nt, Human
uuuuuuuuuuuuuuuuugccccugg

SEQ ID NO: 521119 - RNA, 26 nt, Human
aaauucagccaaacauccacauccaa

SEQ ID NO: 521120 - RNA, 24 nt, Human
aacauccaagcuguaagacugacu

SEQ ID NO: 521121 - RNA, 18 nt, Human
acauccacauccaaacau

SEQ ID NO: 521122 - RNA, 24 nt, Human
agcaaauuuuccucauuauguacc

SEQ ID NO: 521123 - RNA, 22 nt, Human
aggcucaagugaucuucuugcc

SEQ ID NO: 521124 - RNA, 21 nt, Human
agguuccaggaauuacaguuu

SEQ ID NO: 521125 - RNA, 20 nt, Human
agguuggagugcaguggcau

SEQ ID NO: 521126 - RNA, 22 nt, Human
agugcaguggcaugaucauacc

SEQ ID NO: 521127 - RNA, 22 nt, Human
agugcaguggcaugaucauacc

SEQ ID NO: 521128 - RNA, 22 nt, Human
auaaauucagccaaacauccac

SEQ ID NO: 521129 - RNA, 18 nt, Human
auucuguugcccagguug

SEQ ID NO: 521130 - RNA, 19 nt, Human
auucuguugcccagguugg

SEQ ID NO: 521131 - RNA, 23 nt, Human
caaaauguugguauuacaggcac

SEQ ID NO: 521132 - RNA, 19 nt, Human
caaacauccacauccaaac

SEQ ID NO: 521133 - RNA, 24 nt, Human
caaauguauaagcauaucauuuua

SEQ ID NO: 521134 - RNA, 21 nt, Human
caacaaaacauuauuagaaga

SEQ ID NO: 521135 - RNA, 22 nt, Human
caagugaucuucuugccucagc

SEQ ID NO: 521136 - RNA, 22 nt, Human
cagcugggacuacaggcaugga

SEQ ID NO: 521137 - RNA, 22 nt, Human
cagggaauuagcacacucuuaa

SEQ ID NO: 521138 - RNA, 24 nt, Human
cagggucucauucuguugcccagg

SEQ ID NO: 521139 - RNA, 22 nt, Human
cauuuuauuuucauuuaagcca

SEQ ID NO: 521140 - RNA, 26 nt, Human
ccaaacauccaagcuguaagacugac

SEQ ID NO: 521141 - RNA, 26 nt, Human
ccaaacauccacauccaaacauccaa

SEQ ID NO: 521142 - RNA, 20 nt, Human
ccuaggcucaagugaucuuc

SEQ ID NO: 521143 - RNA, 22 nt, Human
ccuaggcucaagugaucuucuu

SEQ ID NO: 521144 - RNA, 20 nt, Human
cucaagugaucuucuugccu

SEQ ID NO: 521145 - RNA, 21 nt, Human
cucacuguaacaucaaauucc

SEQ ID NO: 521146 - RNA, 24 nt, Human
cucgaacagcugggacuacaggca

SEQ ID NO: 521147 - RNA, 18 nt, Human
cugccuuggccucccaaa

SEQ ID NO: 521148 - RNA, 24 nt, Human
cuugccucagccucucgaacagcu

SEQ ID NO: 521149 - RNA, 27 nt, Human
gaacagcugggacuacaggcauggacu

SEQ ID NO: 521150 - RNA, 24 nt, Human
gacuacaggcauggacuaccaugc

SEQ ID NO: 521151 - RNA, 24 nt, Human
gaucauaccucacuguaacaucaa

SEQ ID NO: 521152 - RNA, 24 nt, Human
ggacuacaggcauggacuaccaug

SEQ ID NO: 521153 - RNA, 24 nt, Human
gugaucuucuugccucagccucuc

SEQ ID NO: 521154 - RNA, 21 nt, Human
uaaaaaugcccuccaaacuac

SEQ ID NO: 521155 - RNA, 22 nt, Human
uaccaugcuaggcuuuuuguuu

SEQ ID NO: 521156 - RNA, 24 nt, Human
uaccucacuguaacaucaaauucc

SEQ ID NO: 521157 - RNA, 19 nt, Human
uaggcucaagugaucuucu

SEQ ID NO: 521158 - RNA, 18 nt, Human
uauccugccuaggcuggu

SEQ ID NO: 521159 - RNA, 24 nt, Human
uauuauccugccuaggcuggucuu

SEQ ID NO: 521160 - RNA, 24 nt, Human
ucccaaaauguugguauuacaggc

SEQ ID NO: 521161 - RNA, 20 nt, Human
uccuaggcucaagugaucuu

SEQ ID NO: 521162 - RNA, 23 nt, Human
uccuaggcucaagugaucuucuu

SEQ ID NO: 521163 - RNA, 19 nt, Human
ucucauucuguugcccagg

SEQ ID NO: 521164 - RNA, 23 nt, Human
ucucauucuguugcccagguugg

SEQ ID NO: 521165 - RNA, 24 nt, Human
ucucauucuguugcccagguugga

SEQ ID NO: 521166 - RNA, 23 nt, Human
ucucgaacagcugggacuacagg

SEQ ID NO: 521167 - RNA, 24 nt, Human
ucucgaacagcugggacuacaggc

SEQ ID NO: 521168 - RNA, 25 nt, Human
ucugaaauacauuuccugcaacaaa

SEQ ID NO: 521169 - RNA, 24 nt, Human
ucuguugcccagguuggagugcag

SEQ ID NO: 521170 - RNA, 23 nt, Human
ugaaauacauuuccugcaacaaa

SEQ ID NO: 521171 - RNA, 18 nt, Human
ugcccagguuggagugca

SEQ ID NO: 521172 - RNA, 21 nt, Human
ugcccagguuggagugcagug

SEQ ID NO: 521173 - RNA, 22 nt, Human
ugcccagguuggagugcagugg

SEQ ID NO: 521174 - RNA, 24 nt, Human
ugccuaggcuggucuugaaugccu

SEQ ID NO: 521175 - RNA, 24 nt, Human
ugccucagccucucgaacagcugg

SEQ ID NO: 521176 - RNA, 20 nt, Human
ugcuguaagcuauuuagaca

SEQ ID NO: 521177 - RNA, 19 nt, Human
uggagcaaauuuuccucau

SEQ ID NO: 521178 - RNA, 19 nt, Human
uggagugcaguggcaugau

SEQ ID NO: 521179 - RNA, 19 nt, Human
uggagugcaguggcaugau

SEQ ID NO: 521180 - RNA, 21 nt, Human
uggagugcaguggcaugauca

SEQ ID NO: 521181 - RNA, 24 nt, Human
uggcaugaucauaccucacuguaa

SEQ ID NO: 521182 - RNA, 21 nt, Human
ugggacuacaggcauggacua

SEQ ID NO: 521183 - RNA, 24 nt, Human
ugggacuacaggcauggacuacca

SEQ ID NO: 521184 - RNA, 21 nt, Human
ugguauuacaggcacgagcua

SEQ ID NO: 521185 - RNA, 22 nt, Human
ugguauuacaggcacgagcuac

SEQ ID NO: 521186 - RNA, 24 nt, Human
ugguauuacaggcacgagcuaccg

SEQ ID NO: 521187 - RNA, 23 nt, Human
uguuuuuuaaauagagacaaggu

SEQ ID NO: 521188 - RNA, 24 nt, Human
uucagccaaacauccacauccaaa

SEQ ID NO: 521189 - RNA, 24 nt, Human
uugcccagguuggagugcaguggc

SEQ ID NO: 521190 - RNA, 24 nt, Human
uugcucccguguccgcugaacgug

SEQ ID NO: 521191 - RNA, 24 nt, Human
aaacuggaguugguggggagacca

SEQ ID NO: 521192 - RNA, 25 nt, Human
aaacuggaguugguggggagaccac

SEQ ID NO: 521193 - RNA, 23 nt, Human
aaccugccggcuucucuggcccc

SEQ ID NO: 521194 - RNA, 19 nt, Human
aagacugggugauguuggg

SEQ ID NO: 521195 - RNA, 25 nt, Human
aagcacaccugaggcauaugugcac

SEQ ID NO: 521196 - RNA, 18 nt, Human
acaggcuggguggugggg

SEQ ID NO: 521197 - RNA, 22 nt, Human
acaggcugggugguggggccuu

SEQ ID NO: 521198 - RNA, 19 nt, Human
acugcagacuugcuuuccu

SEQ ID NO: 521199 - RNA, 18 nt, Human
agacugggugauguuggg

SEQ ID NO: 521200 - RNA, 20 nt, Human
aggacccagggggauccaca

SEQ ID NO: 521201 - RNA, 23 nt, Human
aggacgccugccagagccaagga

SEQ ID NO: 521202 - RNA, 18 nt, Human
aggagagccaacuuccca

SEQ ID NO: 521203 - RNA, 22 nt, Human
aggcaaaugagaaggggucaga

SEQ ID NO: 521204 - RNA, 20 nt, Human
aggcagggaguggggcuagg

SEQ ID NO: 521205 - RNA, 21 nt, Human
aggcagggaguggggcuaggg

SEQ ID NO: 521206 - RNA, 21 nt, Human
aggcaggggcagagauacuag

SEQ ID NO: 521207 - RNA, 23 nt, Human
aggccggagcugggcaaucugga

SEQ ID NO: 521208 - RNA, 22 nt, Human
agggaguggggcuaggggcugg

SEQ ID NO: 521209 - RNA, 25 nt, Human
aggggcugggcgggguggugggggg

SEQ ID NO: 521210 - RNA, 22 nt, Human
aggggucagagacacagggcgg

SEQ ID NO: 521211 - RNA, 19 nt, Human
aucaccauuguucccaaca

SEQ ID NO: 521212 - RNA, 21 nt, Human
aucacccccacagacuccacg

SEQ ID NO: 521213 - RNA, 20 nt, Human
auccaugcagucccaaaagc

SEQ ID NO: 521214 - RNA, 24 nt, Human
caaaugagaaggggucagagacac

SEQ ID NO: 521215 - RNA, 19 nt, Human
caagaucuucugauagccc

SEQ ID NO: 521216 - RNA, 23 nt, Human
cacacacccaucacaccaccaca

SEQ ID NO: 521217 - RNA, 21 nt, Human
cacacauauccaugcaguccc

SEQ ID NO: 521218 - RNA, 22 nt, Human
cacccccacagacuccacagcc

SEQ ID NO: 521219 - RNA, 21 nt, Human
caccgaggagccacccccccc

SEQ ID NO: 521220 - RNA, 22 nt, Human
caccuugccacccucugucacc

SEQ ID NO: 521221 - RNA, 22 nt, Human
cagacucuccccuuugcccucc

SEQ ID NO: 521222 - RNA, 21 nt, Human
cagccggggcucagacagcgu

SEQ ID NO: 521223 - RNA, 21 nt, Human
caggacgccugccagagccaa

SEQ ID NO: 521224 - RNA, 23 nt, Human
caggggaggcugggggccuggca

SEQ ID NO: 521225 - RNA, 24 nt, Human
caguauggggggcauggggugccg

SEQ ID NO: 521226 - RNA, 18 nt, Human
caguggcugaccccagcc

SEQ ID NO: 521227 - RNA, 21 nt, Human
caucacaccaccacaugggcc

SEQ ID NO: 521228 - RNA, 20 nt, Human
ccaaaagcacaccugaggcu

SEQ ID NO: 521229 - RNA, 22 nt, Human
ccacaagaucuucugauagccc

SEQ ID NO: 521230 - RNA, 21 nt, Human
cccacagacuccacagccauc

SEQ ID NO: 521231 - RNA, 18 nt, Human
cccccaaauuccugccgg

SEQ ID NO: 521232 - RNA, 21 nt, Human
cccccacagacuccacagcca

SEQ ID NO: 521233 - RNA, 22 nt, Human
ccccuuugcccuccucccuggg

SEQ ID NO: 521234 - RNA, 18 nt, Human
cccgaaacaaggcgacag

SEQ ID NO: 521235 - RNA, 21 nt, Human
ccucagaaucuccggcugaag

SEQ ID NO: 521236 - RNA, 20 nt, Human
ccugcugagacugggacagg

SEQ ID NO: 521237 - RNA, 22 nt, Human
ccuuugcccuccucccugggag

SEQ ID NO: 521238 - RNA, 21 nt, Human
cgcagcuggcaagacugggug

SEQ ID NO: 521239 - RNA, 23 nt, Human
cgccuggguuuuccuccugaaag

SEQ ID NO: 521240 - RNA, 22 nt, Human
cggcuuagaagaugugaggucu

SEQ ID NO: 521241 - RNA, 22 nt, Human
cgggcugggcggggugccggag

SEQ ID NO: 521242 - RNA, 21 nt, Human
cgggggcaccgaggagccacc

SEQ ID NO: 521243 - RNA, 20 nt, Human
cgggggcaccgaggagccag

SEQ ID NO: 521244 - RNA, 22 nt, Human
cggggggccugacgcacacucc

SEQ ID NO: 521245 - RNA, 23 nt, Human
cuccacagccaucaggacgccug

SEQ ID NO: 521246 - RNA, 25 nt, Human
cuccacagccaucaggacgccugcc

SEQ ID NO: 521247 - RNA, 19 nt, Human
cucuuuuucacccucugcc

SEQ ID NO: 521248 - RNA, 20 nt, Human
cugcccagcugggccuugcu

SEQ ID NO: 521249 - RNA, 20 nt, Human
cugggccuugcucuggagag

SEQ ID NO: 521250 - RNA, 22 nt, Human
cugggcgggguggugggggagc

SEQ ID NO: 521251 - RNA, 24 nt, Human
cuguguaaccucuuuuugaaaagu

SEQ ID NO: 521252 - RNA, 19 nt, Human
gaaccugccggcuucucug

SEQ ID NO: 521253 - RNA, 19 nt, Human
gaagaugugaggucugaac

SEQ ID NO: 521254 - RNA, 20 nt, Human
gacagacucuccccuuugcc

SEQ ID NO: 521255 - RNA, 20 nt, Human
gacucuccccuuugcccucc

SEQ ID NO: 521256 - RNA, 19 nt, Human
gcagcuggagaccccaggg

SEQ ID NO: 521257 - RNA, 20 nt, Human
gcagcuggcggugcugggug

SEQ ID NO: 521258 - RNA, 19 nt, Human
gccaacuucccaauggcca

SEQ ID NO: 521259 - RNA, 19 nt, Human
gccagagccaaggauccca

SEQ ID NO: 521260 - RNA, 23 nt, Human
gccaggggguucagagugggccg

SEQ ID NO: 521261 - RNA, 22 nt, Human
gccggcuucucuggccccggcc

SEQ ID NO: 521262 - RNA, 18 nt, Human
gccugggguccgggcugg

SEQ ID NO: 521263 - RNA, 18 nt, Human
ggagaugcagaggaaaau

SEQ ID NO: 521264 - RNA, 19 nt, Human
ggaguggggcuaggggcug

SEQ ID NO: 521265 - RNA, 24 nt, Human
ggccugacgcacacuccugcucgc

SEQ ID NO: 521266 - RNA, 20 nt, Human
ggccuggcacccgcggcaca

SEQ ID NO: 521267 - RNA, 18 nt, Human
ggccuucagccgacagac

SEQ ID NO: 521268 - RNA, 18 nt, Human
ggcgggguggugggggag

SEQ ID NO: 521269 - RNA, 18 nt, Human
ggcuaggggcugggcggg

SEQ ID NO: 521270 - RNA, 23 nt, Human
ggcugggggccuggcacccgcgg

SEQ ID NO: 521271 - RNA, 19 nt, Human
gggacagggggcucugggg

SEQ ID NO: 521272 - RNA, 19 nt, Human
gggcaccgaggagccaccc

SEQ ID NO: 521273 - RNA, 20 nt, Human
gggcgggguggugggggagc

SEQ ID NO: 521274 - RNA, 23 nt, Human
gggcuaggggcugggcggggugg

SEQ ID NO: 521275 - RNA, 21 nt, Human
gggcugggcgggguggugggg

SEQ ID NO: 521276 - RNA, 24 nt, Human
ggggacagggggcucugggguggg

SEQ ID NO: 521277 - RNA, 22 nt, Human
ggggcugggcgggguggugggg

SEQ ID NO: 521278 - RNA, 20 nt, Human
gggguccgggcugggcgggg

SEQ ID NO: 521279 - RNA, 19 nt, Human
ggugaagagaugacauacu

SEQ ID NO: 521280 - RNA, 23 nt, Human
ggugccugggguccgggcugggc

SEQ ID NO: 521281 - RNA, 24 nt, Human
gucacaggccucucugcugggggg

SEQ ID NO: 521282 - RNA, 20 nt, Human
gugccugggguccgggcugg

SEQ ID NO: 521283 - RNA, 20 nt, Human
uaggacccagggggauccac

SEQ ID NO: 521284 - RNA, 21 nt, Human
uaugugcacacacccaucaca

SEQ ID NO: 521285 - RNA, 24 nt, Human
ucacaccaccacaugggccugacc

SEQ ID NO: 521286 - RNA, 26 nt, Human
ucaccuggaggacaucccugcugaga

SEQ ID NO: 521287 - RNA, 24 nt, Human
ucaucacccccacagacuccacag

SEQ ID NO: 521288 - RNA, 24 nt, Human
uccacaagaucuucugauagccca

SEQ ID NO: 521289 - RNA, 19 nt, Human
ucccaguauggggggcaug

SEQ ID NO: 521290 - RNA, 18 nt, Human
ucucaaggaaacaggucu

SEQ ID NO: 521291 - RNA, 20 nt, Human
ucucaaggauuggaggaggu

SEQ ID NO: 521292 - RNA, 19 nt, Human
ucuccggcugaagcugggg

SEQ ID NO: 521293 - RNA, 22 nt, Human
ucucugcuggggggcugcgggg

SEQ ID NO: 521294 - RNA, 20 nt, Human
ucucuggccccggccgcacc

SEQ ID NO: 521295 - RNA, 19 nt, Human
ucugauagcccagggggcc

SEQ ID NO: 521296 - RNA, 22 nt, Human
ugagaaggggucagagacacag

SEQ ID NO: 521297 - RNA, 18 nt, Human
ugagacugggacaggcug

SEQ ID NO: 521298 - RNA, 22 nt, Human
ugagcacacacauauccaugca

SEQ ID NO: 521299 - RNA, 19 nt, Human
ugaugauggaccggccccc

SEQ ID NO: 521300 - RNA, 22 nt, Human
ugcacacacccaucacaccacc

SEQ ID NO: 521301 - RNA, 20 nt, Human
ugcagaggaaaauggggcgc

SEQ ID NO: 521302 - RNA, 27 nt, Human
ugccggcuucucuggccccggccgcac

SEQ ID NO: 521303 - RNA, 21 nt, Human
ugccguggcaggguucagggg

SEQ ID NO: 521304 - RNA, 19 nt, Human
ugcggggggccugacgcac

SEQ ID NO: 521305 - RNA, 21 nt, Human
ugcucgcucacuucaucacca

SEQ ID NO: 521306 - RNA, 22 nt, Human
ugcuggggggcugcggggggcc

SEQ ID NO: 521307 - RNA, 21 nt, Human
uggagcuaggccggagcuggg

SEQ ID NO: 521308 - RNA, 18 nt, Human
uggaggacaucccugcug

SEQ ID NO: 521309 - RNA, 21 nt, Human
uggaggacaucccugcugaga

SEQ ID NO: 521310 - RNA, 19 nt, Human
uggaguugguggggagacc

SEQ ID NO: 521311 - RNA, 23 nt, Human
uggcaggguucaggggaggcugg

SEQ ID NO: 521312 - RNA, 23 nt, Human
uggcuccaaggagagccaacuuc

SEQ ID NO: 521313 - RNA, 22 nt, Human
ugggcaaucuggagccgcaagg

SEQ ID NO: 521314 - RNA, 19 nt, Human
uggggcuaggggcugggcg

SEQ ID NO: 521315 - RNA, 26 nt, Human
ugggggacagggggcucugggguggg

SEQ ID NO: 521316 - RNA, 24 nt, Human
ugggggagcggaugcucacauuuc

SEQ ID NO: 521317 - RNA, 20 nt, Human
uggggugggguucucaagga

SEQ ID NO: 521318 - RNA, 20 nt, Human
ugggugauguugggccgggg

SEQ ID NO: 521319 - RNA, 21 nt, Human
ugggugccggggccacaggag

SEQ ID NO: 521320 - RNA, 18 nt, Human
ugucaggggcuccaggcu

SEQ ID NO: 521321 - RNA, 19 nt, Human
ugucaggggcuccaggcug

SEQ ID NO: 521322 - RNA, 21 nt, Human
uuggcaguggcugaccccagc

SEQ ID NO: 521323 - RNA, 23 nt, Human
uuggcaguggcugaccccagccc

SEQ ID NO: 521324 - RNA, 27 nt, Human
uuggcaguggcugaccccagcccuagc

SEQ ID NO: 521325 - RNA, 20 nt, Human
uuugcccuccucccugggag

SEQ ID NO: 521326 - RNA, 24 nt, Human
aaaaauauucacugaaagaccccc

SEQ ID NO: 521327 - RNA, 24 nt, Human
aagacccccccccacccccaucgg

SEQ ID NO: 521328 - RNA, 20 nt, Human
acccccccccacccccaucg

SEQ ID NO: 521329 - RNA, 22 nt, Human
agacccccccccacccccaucg

SEQ ID NO: 521330 - RNA, 21 nt, Human
agcccggcacuggcguccgcg

SEQ ID NO: 521331 - RNA, 23 nt, Human
cacugaaagacccccccccaccc

SEQ ID NO: 521332 - RNA, 22 nt, Human
cccacccccaucggcccaaagc

SEQ ID NO: 521333 - RNA, 27 nt, Human
ccccacccccaucggcccaaagcugaa

SEQ ID NO: 521334 - RNA, 19 nt, Human
ccccaucggcccaaagcug

SEQ ID NO: 521335 - RNA, 22 nt, Human
cccccccacccccaucggccca

SEQ ID NO: 521336 - RNA, 23 nt, Human
ccccccccacccccaucggccca

SEQ ID NO: 521337 - RNA, 23 nt, Human
cccccccccacccccaucggccc

SEQ ID NO: 521338 - RNA, 22 nt, Human
cccgcgcugacccagucggcca

SEQ ID NO: 521339 - RNA, 21 nt, Human
ccuggagcccggcacuggcgu

SEQ ID NO: 521340 - RNA, 22 nt, Human
cgcgcugacccagucggccacc

SEQ ID NO: 521341 - RNA, 20 nt, Human
cugacccagucggccacccc

SEQ ID NO: 521342 - RNA, 20 nt, Human
gaaagacccccccccacccc

SEQ ID NO: 521343 - RNA, 20 nt, Human
ggcgcagcccgcgcugaccc

SEQ ID NO: 521344 - RNA, 19 nt, Human
ucacugaaagacccccccc

SEQ ID NO: 521345 - RNA, 18 nt, Human
uccacaguagaguuuaau

SEQ ID NO: 521346 - RNA, 23 nt, Human
uccacaguagaguuuaauaaaaa

SEQ ID NO: 521347 - RNA, 18 nt, Human
ugaaagacccccccccac

SEQ ID NO: 521348 - RNA, 23 nt, Human
ugaaagacccccccccaccccca

SEQ ID NO: 521349 - RNA, 22 nt, Human
uucacugaaagaccccccccca

SEQ ID NO: 521350 - RNA, 26 nt, Human
aaaaaaaaaaaguugggggcaaaggg

SEQ ID NO: 521351 - RNA, 21 nt, Human
aaaaaaaaaaucaaauccagc

SEQ ID NO: 521352 - RNA, 22 nt, Human
aaaacaguuccacgggagcuaa

SEQ ID NO: 521353 - RNA, 20 nt, Human
aacagguagcccacuuggug

SEQ ID NO: 521354 - RNA, 18 nt, Human
acacauccccacacacac

SEQ ID NO: 521355 - RNA, 27 nt, Human
acccaaaacccuuugggaaaaguucca

SEQ ID NO: 521356 - RNA, 22 nt, Human
acggcgcggggcacaggcccgc

SEQ ID NO: 521357 - RNA, 20 nt, Human
acuaugguacacaagaagcu

SEQ ID NO: 521358 - RNA, 23 nt, Human
agagaggcccagugaggcuugaa

SEQ ID NO: 521359 - RNA, 18 nt, Human
agaugaucaaucccaaag

SEQ ID NO: 521360 - RNA, 24 nt, Human
agcacaucaaagcauauuucuuuu

SEQ ID NO: 521361 - RNA, 23 nt, Human
aggcagauacaaaacaguuccac

SEQ ID NO: 521362 - RNA, 25 nt, Human
aggggaagacaaguuuuacacaaaa

SEQ ID NO: 521363 - RNA, 22 nt, Human
augguacacaagaagcuagagc

SEQ ID NO: 521364 - RNA, 23 nt, Human
caaaacaguuccacgggagcuaa

SEQ ID NO: 521365 - RNA, 24 nt, Human
caaaacccuuugggaaaaguucca

SEQ ID NO: 521366 - RNA, 23 nt, Human
caagaugaucaaucccaaagcca

SEQ ID NO: 521367 - RNA, 22 nt, Human
cacacacauccccacacacacc

SEQ ID NO: 521368 - RNA, 22 nt, Human
cacaguacuaugguacacaagg

SEQ ID NO: 521369 - RNA, 18 nt, Human
cacauccccacacacacc

SEQ ID NO: 521370 - RNA, 21 nt, Human
cagggaugcacuacaaaaccc

SEQ ID NO: 521371 - RNA, 25 nt, Human
caggucccagauaaaaccuaauggg

SEQ ID NO: 521372 - RNA, 23 nt, Human
ccaaagccaaacugcagguccca

SEQ ID NO: 521373 - RNA, 23 nt, Human
ccacacacacauccccacacaca

SEQ ID NO: 521374 - RNA, 26 nt, Human
ccacacacacauccccacacacaccc

SEQ ID NO: 521375 - RNA, 22 nt, Human
ccaccaggcucccgcccggccc

SEQ ID NO: 521376 - RNA, 18 nt, Human
ccagccacacacagguca

SEQ ID NO: 521377 - RNA, 22 nt, Human
ccaggcucccgcccggcccccg

SEQ ID NO: 521378 - RNA, 23 nt, Human
cccacacacacauccccacacac

SEQ ID NO: 521379 - RNA, 24 nt, Human
cccacacacacauccccacacaca

SEQ ID NO: 521380 - RNA, 28 nt, Human
cccacacacacauccccacacacacccc

SEQ ID NO: 521381 - RNA, 19 nt, Human
cccagugaggcuugaaagg

SEQ ID NO: 521382 - RNA, 19 nt, Human
ccccacacacaccccaagu

SEQ ID NO: 521383 - RNA, 18 nt, Human
cccgagaacggcgcgggg

SEQ ID NO: 521384 - RNA, 20 nt, Human
ccggcccccggcccagcgug

SEQ ID NO: 521385 - RNA, 22 nt, Human
ccggcccccggcccagcgugcu

SEQ ID NO: 521386 - RNA, 21 nt, Human
cgagaacggcgcggggcacag

SEQ ID NO: 521387 - RNA, 19 nt, Human
cgccgaagcggacugccag

SEQ ID NO: 521388 - RNA, 18 nt, Human
cggcgcggggcacaggcc

SEQ ID NO: 521389 - RNA, 21 nt, Human
cucccgcccggcccccggccc

SEQ ID NO: 521390 - RNA, 25 nt, Human
cucgagugaccagaaaaaaaaaauc

SEQ ID NO: 521391 - RNA, 24 nt, Human
gagugaccagaaaaaaaaaaucaa

SEQ ID NO: 521392 - RNA, 20 nt, Human
gcugcaccagccacacacag

SEQ ID NO: 521393 - RNA, 23 nt, Human
ggagaggagcagugaccaugaua

SEQ ID NO: 521394 - RNA, 19 nt, Human
gggcaaaggggaagacaag

SEQ ID NO: 521395 - RNA, 20 nt, Human
gggcacaggcccgccgaagc

SEQ ID NO: 521396 - RNA, 21 nt, Human
gggggcaaaggggaagacaag

SEQ ID NO: 521397 - RNA, 22 nt, Human
ggucagguggccaugucccaga

SEQ ID NO: 521398 - RNA, 20 nt, Human
gugaccagaaaaaaaaaauc

SEQ ID NO: 521399 - RNA, 23 nt, Human
gugccaggcugcaccagccacac

SEQ ID NO: 521400 - RNA, 22 nt, Human
guuacccgccaccaggcucccg

SEQ ID NO: 521401 - RNA, 18 nt, Human
uacaaaaaaaaaaaaaaa

SEQ ID NO: 521402 - RNA, 18 nt, Human
uacacaagaagcuagagc

SEQ ID NO: 521403 - RNA, 25 nt, Human
uauguacaaaaaaacaaguuaaaau

SEQ ID NO: 521404 - RNA, 24 nt, Human
ucaccgcaaagcugcuucggccgc

SEQ ID NO: 521405 - RNA, 21 nt, Human
ucaggaauaaaauccacaaga

SEQ ID NO: 521406 - RNA, 19 nt, Human
ucaugcucagggaugcacu

SEQ ID NO: 521407 - RNA, 20 nt, Human
ucccgcccggcccccggccc

SEQ ID NO: 521408 - RNA, 25 nt, Human
ugagugcauaggcccacacacacag

SEQ ID NO: 521409 - RNA, 27 nt, Human
ugcuugcauggacuuccuuccccucca

SEQ ID NO: 521410 - RNA, 20 nt, Human
uggggaggggagaggagcag

SEQ ID NO: 521411 - RNA, 22 nt, Human
ugggggcaaaggggaagacaag

SEQ ID NO: 521412 - RNA, 22 nt, Human
ugggggcaaaggggaagacaag

SEQ ID NO: 521413 - RNA, 20 nt, Human
ugggugaucuuagaugugcu

SEQ ID NO: 521414 - RNA, 19 nt, Human
uguaagguauucauguucc

SEQ ID NO: 521415 - RNA, 23 nt, Human
uguacaaaaaaacaaguuaaaau

SEQ ID NO: 521416 - RNA, 23 nt, Human
ugucagagaguaaagcuggugga

SEQ ID NO: 521417 - RNA, 18 nt, Human
ugucccagagaggcccag

SEQ ID NO: 521418 - RNA, 18 nt, Human
ugucuuguacaucuguuc

SEQ ID NO: 521419 - RNA, 21 nt, Human
ugugugcaagcaaacugcaug

SEQ ID NO: 521420 - RNA, 26 nt, Human
ugugugcgugugugugucagagagua

SEQ ID NO: 521421 - RNA, 20 nt, Human
ugugugugugugcgugugug

SEQ ID NO: 521422 - RNA, 22 nt, Human
ugugugugugugcgugugugug

SEQ ID NO: 521423 - RNA, 18 nt, Human
ugugugugugugugcgug

SEQ ID NO: 521424 - RNA, 21 nt, Human
ugugugugugugugcgugugu

SEQ ID NO: 521425 - RNA, 21 nt, Human
uugagguugagaaccagagga

SEQ ID NO: 521426 - RNA, 22 nt, Human
uugugugugugugugcgugugu

SEQ ID NO: 521427 - RNA, 22 nt, Human
uuuuguaaaugcaucuccaucc

SEQ ID NO: 521428 - RNA, 23 nt, Human
uuuuuccuuuuguggggagggga

SEQ ID NO: 521429 - RNA, 18 nt, Human
aaaaagcauguugagcac

SEQ ID NO: 521430 - RNA, 19 nt, Human
aaaacgcccaugugaaaua

SEQ ID NO: 521431 - RNA, 26 nt, Human
aaacaaaaacaaaaaacacauacgca

SEQ ID NO: 521432 - RNA, 27 nt, Human
aaacaaaaacaaaaaacacauacgcaa

SEQ ID NO: 521433 - RNA, 19 nt, Human
aaacacauacgcaaaacaa

SEQ ID NO: 521434 - RNA, 19 nt, Human
aaacauaauuagguaucau

SEQ ID NO: 521435 - RNA, 20 nt, Human
aaagucacauuucacgagua

SEQ ID NO: 521436 - RNA, 19 nt, Human
aacuucaguuccuugguug

SEQ ID NO: 521437 - RNA, 18 nt, Human
aagaaaccaagagauacu

SEQ ID NO: 521438 - RNA, 20 nt, Human
aaggcaccacuaugguugaa

SEQ ID NO: 521439 - RNA, 23 nt, Human
aagguuccgcugcaugauuuuuu

SEQ ID NO: 521440 - RNA, 23 nt, Human
acagccaauaaaaauuaaaaggu

SEQ ID NO: 521441 - RNA, 21 nt, Human
agaaaaagcauguugagcacc

SEQ ID NO: 521442 - RNA, 23 nt, Human
agacagccaauaaaaauuaaaag

SEQ ID NO: 521443 - RNA, 21 nt, Human
auagaaaacaaugaauccuag

SEQ ID NO: 521444 - RNA, 26 nt, Human
caaaaaacacauacgcaaaacaagac

SEQ ID NO: 521445 - RNA, 22 nt, Human
caaauucuuucaugcacggcuu

SEQ ID NO: 521446 - RNA, 28 nt, Human
caauaaaaauuaaaaggugaucaccaug

SEQ ID NO: 521447 - RNA, 18 nt, Human
ccagagccauauuugcag

SEQ ID NO: 521448 - RNA, 20 nt, Human
ccuuuguucccaaaggugaa

SEQ ID NO: 521449 - RNA, 25 nt, Human
cgaguagugacccauguuguaauga

SEQ ID NO: 521450 - RNA, 23 nt, Human
cucucauaugaugaaaacuucag

SEQ ID NO: 521451 - RNA, 24 nt, Human
cuggugggagaaagucacauuuca

SEQ ID NO: 521452 - RNA, 24 nt, Human
ggauuuuuaaucaaguagcaauuu

SEQ ID NO: 521453 - RNA, 20 nt, Human
gggagaaagucacauuucac

SEQ ID NO: 521454 - RNA, 23 nt, Human
gggcgcggggcgacugcacacgg

SEQ ID NO: 521455 - RNA, 26 nt, Human
gugaagggcaggauuuuuaaucaagu

SEQ ID NO: 521456 - RNA, 21 nt, Human
guuagguaacuguuccacacu

SEQ ID NO: 521457 - RNA, 21 nt, Human
guucccaaaggugaagggcag

SEQ ID NO: 521458 - RNA, 25 nt, Human
uaaagucaguaauagcuugugcaau

SEQ ID NO: 521459 - RNA, 23 nt, Human
uaagaaaccaagagauacuuccu

SEQ ID NO: 521460 - RNA, 23 nt, Human
uacaaaaggaaagacuaaauuuu

SEQ ID NO: 521461 - RNA, 24 nt, Human
uacauauacaaaaggaaagacuaa

SEQ ID NO: 521462 - RNA, 21 nt, Human
uacccgaagggucgcgcgggg

SEQ ID NO: 521463 - RNA, 22 nt, Human
uacgcaaaacaagacauuaaac

SEQ ID NO: 521464 - RNA, 24 nt, Human
uagaaaacaaugaauccuagaaaa

SEQ ID NO: 521465 - RNA, 20 nt, Human
ucagaacucccaguucguag

SEQ ID NO: 521466 - RNA, 21 nt, Human
ucaugcacggcuucucuaccu

SEQ ID NO: 521467 - RNA, 19 nt, Human
uccaguugucaaagucacc

SEQ ID NO: 521468 - RNA, 23 nt, Human
uccuugguugucugggacuuugu

SEQ ID NO: 521469 - RNA, 21 nt, Human
ugaaaagcaaucucuagagga

SEQ ID NO: 521470 - RNA, 22 nt, Human
ugcaauugugaaaagcaaucuc

SEQ ID NO: 521471 - RNA, 24 nt, Human
uggaucuccuauuacugaauuuug

SEQ ID NO: 521472 - RNA, 21 nt, Human
uguauacaaaacgcccaugug

SEQ ID NO: 521473 - RNA, 22 nt, Human
ugugaaaagcaaucucuagagg

SEQ ID NO: 521474 - RNA, 26 nt, Human
uguucccaaaggugaagggcaggauu

SEQ ID NO: 521475 - RNA, 21 nt, Human
uucccaaaggugaagggcagg

SEQ ID NO: 521476 - RNA, 25 nt, Human
uuuaauuaggaaaacauaauuaggu

SEQ ID NO: 521477 - RNA, 18 nt, Human
uuugaggaguucccuugc

SEQ ID NO: 521478 - RNA, 25 nt, Human
uuuuaaaguuacacucaagguugcu

SEQ ID NO: 521479 - RNA, 23 nt, Human
aaacaaauggacauaacaaagau

SEQ ID NO: 521480 - RNA, 19 nt, Human
aaacguaauccaacaugcc

SEQ ID NO: 521481 - RNA, 21 nt, Human
aacaggacaaacguaauccaa

SEQ ID NO: 521482 - RNA, 18 nt, Human
aaccaacacauuacccug

SEQ ID NO: 521483 - RNA, 19 nt, Human
aagaaagguggacagccug

SEQ ID NO: 521484 - RNA, 20 nt, Human
aaggggacuaccuggaaggc

SEQ ID NO: 521485 - RNA, 22 nt, Human
acaagagcccugaggaagaagc

SEQ ID NO: 521486 - RNA, 18 nt, Human
acaggcuguagcccuggg

SEQ ID NO: 521487 - RNA, 24 nt, Human
accacccccaacacaagagaggca

SEQ ID NO: 521488 - RNA, 21 nt, Human
acccccaacacaagagaggcc

SEQ ID NO: 521489 - RNA, 18 nt, Human
acccugaggcuucuggga

SEQ ID NO: 521490 - RNA, 23 nt, Human
agaaaacccagaaagccagcuca

SEQ ID NO: 521491 - RNA, 21 nt, Human
agaagaaagguggacagccug

SEQ ID NO: 521492 - RNA, 19 nt, Human
agaaggcuggcacaugggg

SEQ ID NO: 521493 - RNA, 18 nt, Human
agcagacaagagaauguc

SEQ ID NO: 521494 - RNA, 22 nt, Human
agccagcucaguucccaagaag

SEQ ID NO: 521495 - RNA, 21 nt, Human
aggacaaacguaauccaacau

SEQ ID NO: 521496 - RNA, 19 nt, Human
aggccagagcaggaaaggg

SEQ ID NO: 521497 - RNA, 21 nt, Human
aucacaguuauuuaagccaaa

SEQ ID NO: 521498 - RNA, 21 nt, Human
aucuguuguaccugccaaaag

SEQ ID NO: 521499 - RNA, 18 nt, Human
auggccaggacccuaggg

SEQ ID NO: 521500 - RNA, 21 nt, Human
caagagcccugaggaagaagc

SEQ ID NO: 521501 - RNA, 18 nt, Human
caaggugugaagugggaa

SEQ ID NO: 521502 - RNA, 21 nt, Human
cacaguucccuaaucagcccu

SEQ ID NO: 521503 - RNA, 23 nt, Human
cacauggccaggacccuagggac

SEQ ID NO: 521504 - RNA, 18 nt, Human
caccacccccaacacaag

SEQ ID NO: 521505 - RNA, 26 nt, Human
cacuaaacacauggccaggacccuag

SEQ ID NO: 521506 - RNA, 23 nt, Human
cagaaagccagcucaguucccaa

SEQ ID NO: 521507 - RNA, 21 nt, Human
caguucccuaaucagcccuug

SEQ ID NO: 521508 - RNA, 22 nt, Human
caugagaaaacccagaaagcca

SEQ ID NO: 521509 - RNA, 19 nt, Human
ccaacacaagagaggcaca

SEQ ID NO: 521510 - RNA, 20 nt, Human
ccacagagaagaguuugcac

SEQ ID NO: 521511 - RNA, 21 nt, Human
ccaccacccccaacacaagag

SEQ ID NO: 521512 - RNA, 22 nt, Human
ccagagcaggaaagggaaagga

SEQ ID NO: 521513 - RNA, 26 nt, Human
ccaggccccucugaugagcucucucc

SEQ ID NO: 521514 - RNA, 22 nt, Human
cccaaggcuagaaccacagaga

SEQ ID NO: 521515 - RNA, 22 nt, Human
cccucugagaccucucugggaa

SEQ ID NO: 521516 - RNA, 21 nt, Human
ccucugagaccucucuggggg

SEQ ID NO: 521517 - RNA, 21 nt, Human
cggcgaaaucccucacucggg

SEQ ID NO: 521518 - RNA, 21 nt, Human
cgucugcggugagcggugguu

SEQ ID NO: 521519 - RNA, 20 nt, Human
cucagcagcccagcuccucc

SEQ ID NO: 521520 - RNA, 20 nt, Human
cucccugggggaauccccca

SEQ ID NO: 521521 - RNA, 24 nt, Human
cugcggugagcggugguucccucc

SEQ ID NO: 521522 - RNA, 19 nt, Human
gaagaagcaguaagaccag

SEQ ID NO: 521523 - RNA, 21 nt, Human
gaauaacccccaccaccccca

SEQ ID NO: 521524 - RNA, 23 nt, Human
gagaacaaaggagaaaguuuagc

SEQ ID NO: 521525 - RNA, 24 nt, Human
gagaacaagagcccugaggaagaa

SEQ ID NO: 521526 - RNA, 20 nt, Human
gcacaggcuguagcccuggg

SEQ ID NO: 521527 - RNA, 24 nt, Human
gccuagggcugggaacaguuuggc

SEQ ID NO: 521528 - RNA, 18 nt, Human
ggaauagcagacaagaga

SEQ ID NO: 521529 - RNA, 19 nt, Human
ggagaaaguuuagcacacu

SEQ ID NO: 521530 - RNA, 20 nt, Human
ggagaacaagagcccugagg

SEQ ID NO: 521531 - RNA, 20 nt, Human
ggcgaaaucccucacucggg

SEQ ID NO: 521532 - RNA, 18 nt, Human
ggcucuccccuccccucu

SEQ ID NO: 521533 - RNA, 21 nt, Human
ggcugacuuguacuggguacu

SEQ ID NO: 521534 - RNA, 22 nt, Human
gggcugggaacaguuugugagg

SEQ ID NO: 521535 - RNA, 19 nt, Human
ggugaggggguaagcagcu

SEQ ID NO: 521536 - RNA, 20 nt, Human
guccaggaaggggacuaccu

SEQ ID NO: 521537 - RNA, 19 nt, Human
uaagcagcuugacaguugc

SEQ ID NO: 521538 - RNA, 28 nt, Human
uacuggguacucugaacuuucaaggagg

SEQ ID NO: 521539 - RNA, 22 nt, Human
uaggcucucagcagcccagcuc

SEQ ID NO: 521540 - RNA, 22 nt, Human
uauaaacuuuaugaggaaaaau

SEQ ID NO: 521541 - RNA, 23 nt, Human
ucacugguacuugcucagccuuu

SEQ ID NO: 521542 - RNA, 21 nt, Human
ucccuaaucagcccuuggccc

SEQ ID NO: 521543 - RNA, 21 nt, Human
ucucuaaucagcaggaccaag

SEQ ID NO: 521544 - RNA, 23 nt, Human
ucuguuguaccugccaaaaguua

SEQ ID NO: 521545 - RNA, 24 nt, Human
ugaagugggaaugaacauggaucc

SEQ ID NO: 521546 - RNA, 20 nt, Human
ugacugcagccacuacgucc

SEQ ID NO: 521547 - RNA, 21 nt, Human
ugacuuguacuggguacucug

SEQ ID NO: 521548 - RNA, 19 nt, Human
ugagaaaacccagaaagcc

SEQ ID NO: 521549 - RNA, 20 nt, Human
ugagaaaacccagaaagccg

SEQ ID NO: 521550 - RNA, 27 nt, Human
ugagaacaaaggagaaaguuuagcaca

SEQ ID NO: 521551 - RNA, 30 nt, Human
ugcaggcucuccccuccccucugagaccuu

SEQ ID NO: 521552 - RNA, 20 nt, Human
ugcggugagcggugguuccc

SEQ ID NO: 521553 - RNA, 21 nt, Human
uggaaggccugagaacaaagg

SEQ ID NO: 521554 - RNA, 24 nt, Human
uggcccccagaugcaggcucuccc

SEQ ID NO: 521555 - RNA, 24 nt, Human
uggcuauaaucccuagggccccaa

SEQ ID NO: 521556 - RNA, 22 nt, Human
ugguucccucccucagcuccuc

SEQ ID NO: 521557 - RNA, 18 nt, Human
uuaaauggccauugucac

SEQ ID NO: 521558 - RNA, 23 nt, Human
uuaaauggccauugucacuggua

SEQ ID NO: 521559 - RNA, 23 nt, Human
uuccaggccccucugaugagcuc

SEQ ID NO: 521560 - RNA, 23 nt, Human
uuuccaggccccucugaugagcu

SEQ ID NO: 521561 - RNA, 20 nt, Human
aaacggacucaggacaaacc

SEQ ID NO: 521562 - RNA, 21 nt, Human
aacaaaaagggauguuucuag

SEQ ID NO: 521563 - RNA, 18 nt, Human
aagaaucauaaaguuuac

SEQ ID NO: 521564 - RNA, 22 nt, Human
aauaaauggcaauaaauucuaa

SEQ ID NO: 521565 - RNA, 21 nt, Human
aauaacaguauaaucuauaga

SEQ ID NO: 521566 - RNA, 23 nt, Human
acccucauacuuaaaaagaagca

SEQ ID NO: 521567 - RNA, 20 nt, Human
agaaauacugcuacaggugc

SEQ ID NO: 521568 - RNA, 21 nt, Human
agggagguucucaacaaaaag

SEQ ID NO: 521569 - RNA, 21 nt, Human
auaaauggcaauaaauucuaa

SEQ ID NO: 521570 - RNA, 26 nt, Human
augacauuucagccuggccucuacag

SEQ ID NO: 521571 - RNA, 18 nt, Human
auuacuuacuucucucca

SEQ ID NO: 521572 - RNA, 25 nt, Human
caaacccucauacuuaaaaagaagc

SEQ ID NO: 521573 - RNA, 23 nt, Human
caacaaaaagggauguuucuaga

SEQ ID NO: 521574 - RNA, 20 nt, Human
caccucuggcuuaaggaucu

SEQ ID NO: 521575 - RNA, 23 nt, Human
cccauccugggcgacggcggcac

SEQ ID NO: 521576 - RNA, 23 nt, Human
ccuaucacaaggucauuugaaaa

SEQ ID NO: 521577 - RNA, 19 nt, Human
cgaugcccaccacccucgc

SEQ ID NO: 521578 - RNA, 22 nt, Human
cuagcaguggguucaacaacuc

SEQ ID NO: 521579 - RNA, 18 nt, Human
cucguccgcugcugggac

SEQ ID NO: 521580 - RNA, 19 nt, Human
cucuccagcuuaauccuag

SEQ ID NO: 521581 - RNA, 24 nt, Human
cugggcgacggcggcaccucccuc

SEQ ID NO: 521582 - RNA, 24 nt, Human
gaaaaauaaucccucccuuccuuc

SEQ ID NO: 521583 - RNA, 23 nt, Human
gaaaccucucccacugugaccaa

SEQ ID NO: 521584 - RNA, 23 nt, Human
gaagaggagagagaugguggugg

SEQ ID NO: 521585 - RNA, 21 nt, Human
gcccaccacccucgcgcggcg

SEQ ID NO: 521586 - RNA, 24 nt, Human
gcggcaccucccucguccgcugcu

SEQ ID NO: 521587 - RNA, 22 nt, Human
gcugcugggaccucgaugccca

SEQ ID NO: 521588 - RNA, 22 nt, Human
ggugcugaagacuucucaagcc

SEQ ID NO: 521589 - RNA, 22 nt, Human
guagaaaaauaaucccucccuu

SEQ ID NO: 521590 - RNA, 22 nt, Human
guggaggaauucuagcuguggu

SEQ ID NO: 521591 - RNA, 21 nt, Human
guugcauucuuuccugccaca

SEQ ID NO: 521592 - RNA, 22 nt, Human
uaaaaaggaauaaauggcaaua

SEQ ID NO: 521593 - RNA, 21 nt, Human
uacacaggucagagagguuua

SEQ ID NO: 521594 - RNA, 21 nt, Human
uacaguaccaugaaaccuaaa

SEQ ID NO: 521595 - RNA, 22 nt, Human
uacaucgcuucauucccagccc

SEQ ID NO: 521596 - RNA, 19 nt, Human
uaccaugaaaccuaaauua

SEQ ID NO: 521597 - RNA, 27 nt, Human
uaccaugaaaccuaaauuacuuacuuc

SEQ ID NO: 521598 - RNA, 21 nt, Human
uagaaggaaaaugauaaccac

SEQ ID NO: 521599 - RNA, 22 nt, Human
uagcaccuuuugggaggaggag

SEQ ID NO: 521600 - RNA, 22 nt, Human
uagguggaggaauucuagcugu

SEQ ID NO: 521601 - RNA, 21 nt, Human
uaugacauuucagccuggccu

SEQ ID NO: 521602 - RNA, 21 nt, Human
uaugacauuucagccuggccu

SEQ ID NO: 521603 - RNA, 21 nt, Human
uccaagaacauggacaaaacc

SEQ ID NO: 521604 - RNA, 22 nt, Human
uccaagaacauggacaaaacca

SEQ ID NO: 521605 - RNA, 27 nt, Human
ucccucguccgcugcugggaccucgau

SEQ ID NO: 521606 - RNA, 21 nt, Human
ucuuuugguucgaguguugcu

SEQ ID NO: 521607 - RNA, 19 nt, Human
ugaaaacggacucaggaca

SEQ ID NO: 521608 - RNA, 18 nt, Human
ugaaaccuaaauuacuua

SEQ ID NO: 521609 - RNA, 24 nt, Human
ugaagaggagagagaugguggugg

SEQ ID NO: 521610 - RNA, 21 nt, Human
ugaccaacaaacccucauacu

SEQ ID NO: 521611 - RNA, 22 nt, Human
uggacaaaaccauuucccuauc

SEQ ID NO: 521612 - RNA, 20 nt, Human
ugggaggaggaggucagaau

SEQ ID NO: 521613 - RNA, 27 nt, Human
ugggaggaggaggucagaaugcggugg

SEQ ID NO: 521614 - RNA, 22 nt, Human
uguugcauccuugcuuccuagc

SEQ ID NO: 521615 - RNA, 19 nt, Human
uucccagcccauccugggc

SEQ ID NO: 521616 - RNA, 23 nt, Human
uugaagaggagagagaugguggu

SEQ ID NO: 521617 - RNA, 27 nt, Human
uugaagaggagagagaugguggugguu

SEQ ID NO: 521618 - RNA, 19 nt, Human
uuguugcauccuugcuucc

SEQ ID NO: 521619 - RNA, 20 nt, Human
uuuuuguugcauucuuuccu

SEQ ID NO: 521620 - RNA, 21 nt, Human
uuuuuguugcauucuuuccug

SEQ ID NO: 521621 - RNA, 19 nt, Human
uuuuuuuuuuuuuuuuuaa

SEQ ID NO: 521622 - RNA, 18 nt, Human
aaaccauauccuuccuca

SEQ ID NO: 521623 - RNA, 18 nt, Human
acacaauccuugagaaac

SEQ ID NO: 521624 - RNA, 21 nt, Human
accccgcgaccaacucacaga

SEQ ID NO: 521625 - RNA, 22 nt, Human
accccgcgaccaacucacagac

SEQ ID NO: 521626 - RNA, 18 nt, Human
acccugggcaugagaacc

SEQ ID NO: 521627 - RNA, 18 nt, Human
acuugcuggcuggucacu

SEQ ID NO: 521628 - RNA, 19 nt, Human
acuugcuggcuggucacug

SEQ ID NO: 521629 - RNA, 19 nt, Human
agcagagcugcaccccgaa

SEQ ID NO: 521630 - RNA, 22 nt, Human
agcuacagaaacaaauugaaga

SEQ ID NO: 521631 - RNA, 19 nt, Human
agggaugucccaauaccug

SEQ ID NO: 521632 - RNA, 22 nt, Human
augcuacuaugguaacucagga

SEQ ID NO: 521633 - RNA, 18 nt, Human
auuuaggaaaaaacaaua

SEQ ID NO: 521634 - RNA, 19 nt, Human
caccuuggugcacuccggg

SEQ ID NO: 521635 - RNA, 19 nt, Human
cagagugucgauauaaaca

SEQ ID NO: 521636 - RNA, 23 nt, Human
cagucaggcuggaaagaaaggaa

SEQ ID NO: 521637 - RNA, 19 nt, Human
ccaacucacagaccccgcc

SEQ ID NO: 521638 - RNA, 22 nt, Human
ccagagugucgauauaaacacc

SEQ ID NO: 521639 - RNA, 21 nt, Human
ccccgcgaccaacucacagac

SEQ ID NO: 521640 - RNA, 24 nt, Human
ccccgcgaccaacucacagacccc

SEQ ID NO: 521641 - RNA, 21 nt, Human
cccgccaagaccccgcgacca

SEQ ID NO: 521642 - RNA, 23 nt, Human
cccgccaagaccccgcgaccaac

SEQ ID NO: 521643 - RNA, 21 nt, Human
cuccgggucccacguuuauuc

SEQ ID NO: 521644 - RNA, 18 nt, Human
cugcaccccgaaagcaac

SEQ ID NO: 521645 - RNA, 23 nt, Human
gaccccgcgaccaacucacagac

SEQ ID NO: 521646 - RNA, 20 nt, Human
gcugcaccccgaaagcaacg

SEQ ID NO: 521647 - RNA, 19 nt, Human
gucacuguggacccugggc

SEQ ID NO: 521648 - RNA, 21 nt, Human
uaaauucauccugcuaagugu

SEQ ID NO: 521649 - RNA, 19 nt, Human
uccccgccaagaccccgcg

SEQ ID NO: 521650 - RNA, 21 nt, Human
ugaagauaaauguggcucuuc

SEQ ID NO: 521651 - RNA, 19 nt, Human
ugcaccccgaaagcaacgg

SEQ ID NO: 521652 - RNA, 22 nt, Human
uggacccugggcaugagaaccu

SEQ ID NO: 521653 - RNA, 18 nt, Human
uuaguaauuuuuuuuuuc

SEQ ID NO: 521654 - RNA, 23 nt, Human
uugagaaaccauauccuuccuca

SEQ ID NO: 521655 - RNA, 19 nt, Human
uuuuuuuuucucaccuugg

SEQ ID NO: 521656 - RNA, 19 nt, Human
uuuuuuuuuucucaccuug

SEQ ID NO: 521657 - RNA, 21 nt, Human
aacaucuuuuacaaaauguau

SEQ ID NO: 521658 - RNA, 22 nt, Human
acuuuguuauagcaaccugaag

SEQ ID NO: 521659 - RNA, 22 nt, Human
agaagauggcagucugcaacca

SEQ ID NO: 521660 - RNA, 18 nt, Human
aggaauggacgcacucgu

SEQ ID NO: 521661 - RNA, 23 nt, Human
cacaugcaccagaguuauaagca

SEQ ID NO: 521662 - RNA, 18 nt, Human
cagaacccaaccaugcug

SEQ ID NO: 521663 - RNA, 25 nt, Human
cagaacccaaccaugcugguaaucu

SEQ ID NO: 521664 - RNA, 21 nt, Human
ccaaccaugcugguaaucuga

SEQ ID NO: 521665 - RNA, 21 nt, Human
ccaagacggcucucaccagaa

SEQ ID NO: 521666 - RNA, 19 nt, Human
ccucugcagcagucugugc

SEQ ID NO: 521667 - RNA, 24 nt, Human
cggucuccgggauggaaaucuggu

SEQ ID NO: 521668 - RNA, 21 nt, Human
cugcagcagucugugcaucag

SEQ ID NO: 521669 - RNA, 24 nt, Human
cuuaaaaaggucagaguccauaaa

SEQ ID NO: 521670 - RNA, 19 nt, Human
gcaaagccgucucuagaag

SEQ ID NO: 521671 - RNA, 19 nt, Human
gccaugugaggauacaaga

SEQ ID NO: 521672 - RNA, 20 nt, Human
gguacuuuguuauagcaacu

SEQ ID NO: 521673 - RNA, 20 nt, Human
gugaggauacaagaagaugg

SEQ ID NO: 521674 - RNA, 22 nt, Human
uaaucugaucucagacuuccag

SEQ ID NO: 521675 - RNA, 23 nt, Human
ucaaacagacuccagagaguucu

SEQ ID NO: 521676 - RNA, 23 nt, Human
ucucuuguccucuuuuggccaug

SEQ ID NO: 521677 - RNA, 30 nt, Human
ucugcaaccaagacggcucucaccagaacc

SEQ ID NO: 521678 - RNA, 22 nt, Human
ugaaauauuuugggacacacaa

SEQ ID NO: 521679 - RNA, 21 nt, Human
ugcaagcagaaaauuauauuu

SEQ ID NO: 521680 - RNA, 18 nt, Human
uggaaaucuggugcgagg

SEQ ID NO: 521681 - RNA, 21 nt, Human
ugggaaggaugccugguaaug

SEQ ID NO: 521682 - RNA, 20 nt, Human
ugggaggagccaugugaaga

SEQ ID NO: 521683 - RNA, 25 nt, Human
uguaagaaauaaauuucugucguuu

SEQ ID NO: 521684 - RNA, 20 nt, Human
uuuccaucacuuuuccaugg

SEQ ID NO: 521685 - RNA, 21 nt, Human
uuuguuauagcaaccugaagu

SEQ ID NO: 521686 - RNA, 19 nt, Human
uuuuugaugcauaaacauc

SEQ ID NO: 521687 - RNA, 24 nt, Human
aaaacacucucgaucccaguccag

SEQ ID NO: 521688 - RNA, 22 nt, Human
aaaagaagcgagaggcaaauga

SEQ ID NO: 521689 - RNA, 19 nt, Human
aaagcacaugaccaguuga

SEQ ID NO: 521690 - RNA, 23 nt, Human
aacuccuuaggccuccaggccuu

SEQ ID NO: 521691 - RNA, 22 nt, Human
aagagccagcaaagagucccgc

SEQ ID NO: 521692 - RNA, 22 nt, Human
aagagccagcaaggagucccgc

SEQ ID NO: 521693 - RNA, 20 nt, Human
aaggacaccacagucacugc

SEQ ID NO: 521694 - RNA, 18 nt, Human
acagacagcaccauggag

SEQ ID NO: 521695 - RNA, 20 nt, Human
acagcaccauggagccacgg

SEQ ID NO: 521696 - RNA, 21 nt, Human
acccgcagcgucucccacuuc

SEQ ID NO: 521697 - RNA, 23 nt, Human
acccuggaacguggcccuggagc

SEQ ID NO: 521698 - RNA, 21 nt, Human
agaaacggagugaaaccuggg

SEQ ID NO: 521699 - RNA, 18 nt, Human
agacaggucugagaggga

SEQ ID NO: 521700 - RNA, 22 nt, Human
agccacugaggagccaacaucc

SEQ ID NO: 521701 - RNA, 25 nt, Human
agccagucuguguccucauuuacac

SEQ ID NO: 521702 - RNA, 20 nt, Human
aggaggccaaaagacacggg

SEQ ID NO: 521703 - RNA, 19 nt, Human
aggaggccccgccgcuauc

SEQ ID NO: 521704 - RNA, 18 nt, Human
aggcgauggaccacauag

SEQ ID NO: 521705 - RNA, 18 nt, Human
agggcgccccgcggcggc

SEQ ID NO: 521706 - RNA, 24 nt, Human
augaggcaucaggaguguuuggaa

SEQ ID NO: 521707 - RNA, 21 nt, Human
auggaccacauagucucugac

SEQ ID NO: 521708 - RNA, 19 nt, Human
caaacccgacccuggaacg

SEQ ID NO: 521709 - RNA, 18 nt, Human
caaggacaccacagucac

SEQ ID NO: 521710 - RNA, 21 nt, Human
caaggacaccacagucacugc

SEQ ID NO: 521711 - RNA, 24 nt, Human
cacaaaagcuuuucagucacagcc

SEQ ID NO: 521712 - RNA, 18 nt, Human
cacagucacugcgaccaa

SEQ ID NO: 521713 - RNA, 19 nt, Human
caccacagucacugcgacc

SEQ ID NO: 521714 - RNA, 19 nt, Human
caccauggagccacggaua

SEQ ID NO: 521715 - RNA, 18 nt, Human
caccuuucgccuccuucc

SEQ ID NO: 521716 - RNA, 22 nt, Human
cacucucgaucccaguccaggg

SEQ ID NO: 521717 - RNA, 24 nt, Human
cacugccacaccucccuaaggaag

SEQ ID NO: 521718 - RNA, 20 nt, Human
cagcaccauggagccacgga

SEQ ID NO: 521719 - RNA, 25 nt, Human
cagcccccaaaaugguggucgaaaa

SEQ ID NO: 521720 - RNA, 20 nt, Human
cagcgccauggagccacgga

SEQ ID NO: 521721 - RNA, 21 nt, Human
caguccagggaggcacccaga

SEQ ID NO: 521722 - RNA, 23 nt, Human
ccaaaagacacggggguggggca

SEQ ID NO: 521723 - RNA, 21 nt, Human
ccaacauccaugguaaaacac

SEQ ID NO: 521724 - RNA, 21 nt, Human
ccacagccacaucuccaggca

SEQ ID NO: 521725 - RNA, 20 nt, Human
cccacagcccggcgcggcca

SEQ ID NO: 521726 - RNA, 28 nt, Human
cccacugcacccugacagcugacaaauc

SEQ ID NO: 521727 - RNA, 20 nt, Human
cccagggcgccccgcggcgg

SEQ ID NO: 521728 - RNA, 21 nt, Human
ccccaaaaugguggucgaaaa

SEQ ID NO: 521729 - RNA, 23 nt, Human
ccccaaaaugguggucgaaaaga

SEQ ID NO: 521730 - RNA, 20 nt, Human
ccccacgcauccggugccag

SEQ ID NO: 521731 - RNA, 20 nt, Human
ccccgugagugccucagccc

SEQ ID NO: 521732 - RNA, 22 nt, Human
ccccuuguuccaucuuuccugu

SEQ ID NO: 521733 - RNA, 30 nt, Human
ccccuuguuccaucuuuccugucucuaauu

SEQ ID NO: 521734 - RNA, 23 nt, Human
cccgcccaucccaaggccugggc

SEQ ID NO: 521735 - RNA, 22 nt, Human
cccuuguuccaucuuuccuguc

SEQ ID NO: 521736 - RNA, 22 nt, Human
ccgcccaucccaaggccugggc

SEQ ID NO: 521737 - RNA, 22 nt, Human
ccgggagaugggagauccaugg

SEQ ID NO: 521738 - RNA, 20 nt, Human
ccucaaagacaggucugaga

SEQ ID NO: 521739 - RNA, 22 nt, Human
ccugcagugcccacagcccggc

SEQ ID NO: 521740 - RNA, 24 nt, Human
ccugcuaucucagccuccagagua

SEQ ID NO: 521741 - RNA, 20 nt, Human
ccuguauggccaccgugagu

SEQ ID NO: 521742 - RNA, 18 nt, Human
ccuuaggccuccaggccu

SEQ ID NO: 521743 - RNA, 19 nt, Human
cgcaggcgcuucuguuugg

SEQ ID NO: 521744 - RNA, 19 nt, Human
cgccauggagccacggaua

SEQ ID NO: 521745 - RNA, 24 nt, Human
cgccuuguagagccgcacaaaagc

SEQ ID NO: 521746 - RNA, 21 nt, Human
cgcggccaagccuucccgccc

SEQ ID NO: 521747 - RNA, 18 nt, Human
cgcggccaggccuucccg

SEQ ID NO: 521748 - RNA, 21 nt, Human
cuccaccucaauguccgagau

SEQ ID NO: 521749 - RNA, 21 nt, Human
cuccagaguagccugcuucuc

SEQ ID NO: 521750 - RNA, 18 nt, Human
cuccuuaggccuccaggc

SEQ ID NO: 521751 - RNA, 21 nt, Human
cucguacccaccacggguacc

SEQ ID NO: 521752 - RNA, 21 nt, Human
cucucguacccaccacgggua

SEQ ID NO: 521753 - RNA, 22 nt, Human
cugacacaugagagauagggcu

SEQ ID NO: 521754 - RNA, 25 nt, Human
cuuccacaguuguuucuccaccaca

SEQ ID NO: 521755 - RNA, 21 nt, Human
cuuccacugccacaccucccu

SEQ ID NO: 521756 - RNA, 18 nt, Human
gaaaagaagcgagaggca

SEQ ID NO: 521757 - RNA, 20 nt, Human
gaagcccucucguacccacc

SEQ ID NO: 521758 - RNA, 23 nt, Human
gacaccacagucacugcgaccaa

SEQ ID NO: 521759 - RNA, 19 nt, Human
gaccaagccagucuguguc

SEQ ID NO: 521760 - RNA, 19 nt, Human
gacuugcucuccccugcua

SEQ ID NO: 521761 - RNA, 18 nt, Human
gagcaucucaaggacacc

SEQ ID NO: 521762 - RNA, 19 nt, Human
gagggaggaaaacugaugg

SEQ ID NO: 521763 - RNA, 18 nt, Human
gauauggggguggagaag

SEQ ID NO: 521764 - RNA, 21 nt, Human
gcaacagaaaauaggaggcca

SEQ ID NO: 521765 - RNA, 21 nt, Human
gcaggaggcaggggcccagag

SEQ ID NO: 521766 - RNA, 19 nt, Human
gcccaggacccgcagcguc

SEQ ID NO: 521767 - RNA, 21 nt, Human
gcgaccaagccagucuguguc

SEQ ID NO: 521768 - RNA, 22 nt, Human
ggaaggcaacagaaaauaggag

SEQ ID NO: 521769 - RNA, 18 nt, Human
ggaggugggauacacaug

SEQ ID NO: 521770 - RNA, 22 nt, Human
ggaguguuuggaaaggggccga

SEQ ID NO: 521771 - RNA, 22 nt, Human
gggcuccgacuguguagaaacg

SEQ ID NO: 521772 - RNA, 24 nt, Human
gguggucgaaaagaagcgagaggc

SEQ ID NO: 521773 - RNA, 24 nt, Human
gucacagccacugaggagccaaca

SEQ ID NO: 521774 - RNA, 18 nt, Human
gucucccacuucccggag

SEQ ID NO: 521775 - RNA, 23 nt, Human
guggggcagccaggcagucgaag

SEQ ID NO: 521776 - RNA, 23 nt, Human
uaucccagggcgccccgcggcgg

SEQ ID NO: 521777 - RNA, 24 nt, Human
uaucucaaucuccucauucccaga

SEQ ID NO: 521778 - RNA, 19 nt, Human
uauggggguggagaagggu

SEQ ID NO: 521779 - RNA, 19 nt, Human
ucacagaucucuccaccuu

SEQ ID NO: 521780 - RNA, 27 nt, Human
ucagccuccagaguagccugcuucucu

SEQ ID NO: 521781 - RNA, 23 nt, Human
ucagcucaugucuccucacuccc

SEQ ID NO: 521782 - RNA, 22 nt, Human
ucagggagaugaugggcaucag

SEQ ID NO: 521783 - RNA, 22 nt, Human
uccaccaaacccgacccuggaa

SEQ ID NO: 521784 - RNA, 20 nt, Human
uccccacgcauccggugcca

SEQ ID NO: 521785 - RNA, 18 nt, Human
ucccuaaggaaggccucc

SEQ ID NO: 521786 - RNA, 24 nt, Human
ucccuaaggaaggccucccggcuc

SEQ ID NO: 521787 - RNA, 18 nt, Human
uccucauucccagacuuc

SEQ ID NO: 521788 - RNA, 23 nt, Human
uccugcagugcccacagcccggc

SEQ ID NO: 521789 - RNA, 20 nt, Human
ucgaaaagaagcgagaggca

SEQ ID NO: 521790 - RNA, 22 nt, Human
ucgaaaagaagcgagaggcaaa

SEQ ID NO: 521791 - RNA, 18 nt, Human
ucgaagcuguguguggcc

SEQ ID NO: 521792 - RNA, 21 nt, Human
ucucaaggacaccacagucac

SEQ ID NO: 521793 - RNA, 23 nt, Human
ucuccaggcagcgucucuggccu

SEQ ID NO: 521794 - RNA, 24 nt, Human
ucucucgcaggcgcuucuguuugg

SEQ ID NO: 521795 - RNA, 23 nt, Human
ugaaccagggacccacagcacuu

SEQ ID NO: 521796 - RNA, 24 nt, Human
ugaagaagcccucucguacccacc

SEQ ID NO: 521797 - RNA, 21 nt, Human
ugagagggaggaaaacugaug

SEQ ID NO: 521798 - RNA, 18 nt, Human
ugaggaauccaccaaacc

SEQ ID NO: 521799 - RNA, 21 nt, Human
ugcaggaggcaggggcccaga

SEQ ID NO: 521800 - RNA, 23 nt, Human
ugccucagcccccaaaauggugg

SEQ ID NO: 521801 - RNA, 20 nt, Human
uggaaaggggccgagaucug

SEQ ID NO: 521802 - RNA, 19 nt, Human
uggcccuggagccgcgcgg

SEQ ID NO: 521803 - RNA, 23 nt, Human
ugggcccaggacccgcagcgucu

SEQ ID NO: 521804 - RNA, 23 nt, Human
uggggguggagaagggucacucc

SEQ ID NO: 521805 - RNA, 18 nt, Human
uuccaucuuuccugucuc

SEQ ID NO: 521806 - RNA, 21 nt, Human
uucugguuugaagaagcccuc

SEQ ID NO: 521807 - RNA, 21 nt, Human
uucugguuugaagaagcccuc

SEQ ID NO: 521808 - RNA, 18 nt, Human
uuuaucucaaucuccuca

SEQ ID NO: 521809 - RNA, 23 nt, Human
uuugaagaagcccucucguaccc

SEQ ID NO: 521810 - RNA, 18 nt, Human
aaacauuaucuguaaaac

SEQ ID NO: 521811 - RNA, 19 nt, Human
aaauggcauuauacaaaag

SEQ ID NO: 521812 - RNA, 22 nt, Human
acaaaagcucaaacauccuuca

SEQ ID NO: 521813 - RNA, 23 nt, Human
acaaacugguuuggccacaagga

SEQ ID NO: 521814 - RNA, 20 nt, Human
acugguuuggccacaaggaa

SEQ ID NO: 521815 - RNA, 26 nt, Human
agagaugaaggcaaacuuuggaggaa

SEQ ID NO: 521816 - RNA, 24 nt, Human
agaugaaggcaaacuuuggaggaa

SEQ ID NO: 521817 - RNA, 18 nt, Human
aggaaaagaaaaaacauu

SEQ ID NO: 521818 - RNA, 19 nt, Human
agugugcaaacuagaacca

SEQ ID NO: 521819 - RNA, 19 nt, Human
agugugcaaacuagaaccg

SEQ ID NO: 521820 - RNA, 19 nt, Human
auacucauuuaagauacag

SEQ ID NO: 521821 - RNA, 25 nt, Human
caaacuagaaccaguuauacuuuca

SEQ ID NO: 521822 - RNA, 24 nt, Human
cacaaggaaaagaaaaaacauuuc

SEQ ID NO: 521823 - RNA, 24 nt, Human
cuuucaucacuucacagaacacaa

SEQ ID NO: 521824 - RNA, 25 nt, Human
ggugcaucaagagaugucggggccc

SEQ ID NO: 521825 - RNA, 22 nt, Human
guaacauuuauacauagauuaa

SEQ ID NO: 521826 - RNA, 24 nt, Human
guacaacuguauagguauaaauaa

SEQ ID NO: 521827 - RNA, 18 nt, Human
uaaaacugcagguauaaa

SEQ ID NO: 521828 - RNA, 23 nt, Human
uaaaacugcagguauaaauggca

SEQ ID NO: 521829 - RNA, 22 nt, Human
uaaaagaaacaguacaacugua

SEQ ID NO: 521830 - RNA, 23 nt, Human
uaaaauccacauuaauaacucag

SEQ ID NO: 521831 - RNA, 23 nt, Human
uacaguuaccucuacuuuaaucc

SEQ ID NO: 521832 - RNA, 19 nt, Human
uacauagauuaacagaaag

SEQ ID NO: 521833 - RNA, 24 nt, Human
uaccucuacuuuaauccccagcuc

SEQ ID NO: 521834 - RNA, 21 nt, Human
uagcagaugaauauaaucaga

SEQ ID NO: 521835 - RNA, 24 nt, Human
uccaaacuguagaggagagaugaa

SEQ ID NO: 521836 - RNA, 23 nt, Human
uccuucaaaacuuggacuauuga

SEQ ID NO: 521837 - RNA, 20 nt, Human
ugaauauaaucagauuaaca

SEQ ID NO: 521838 - RNA, 19 nt, Human
ugcaccaucaccuccaaac

SEQ ID NO: 521839 - RNA, 18 nt, Human
ugcaccaucaccuccaac

SEQ ID NO: 521840 - RNA, 21 nt, Human
ugcugcaccaucaccuccaaa

SEQ ID NO: 521841 - RNA, 24 nt, Human
ugcuuuaaaagaaacaguacaacu

SEQ ID NO: 521842 - RNA, 23 nt, Human
uguggugcaucaagagauguucc

SEQ ID NO: 521843 - RNA, 18 nt, Human
uuaaaagaaacaguacaa

SEQ ID NO: 521844 - RNA, 18 nt, Human
uuaacagaaagguaaacu

SEQ ID NO: 521845 - RNA, 21 nt, Human
uuaccucuacuuuaaucccca

SEQ ID NO: 521846 - RNA, 19 nt, Human
uuggccacaaggaaaagaa

SEQ ID NO: 521847 - RNA, 24 nt, Human
uuuuaaaauccacauuaauaacuc

SEQ ID NO: 521848 - RNA, 18 nt, Human
uuuuuuuuuuuuuuucug

SEQ ID NO: 521849 - RNA, 26 nt, Human
uuuuuuuuuuuuuuuuucugauuuuu

SEQ ID NO: 521850 - RNA, 23 nt, Human
aaaaaagagccacaugcaaagaa

SEQ ID NO: 521851 - RNA, 19 nt, Human
aaaagagaaccccagagac

SEQ ID NO: 521852 - RNA, 23 nt, Human
aaaggccuucagagaaaacagac

SEQ ID NO: 521853 - RNA, 22 nt, Human
aagagaagguaaguuuugacaa

SEQ ID NO: 521854 - RNA, 19 nt, Human
aagagggaauucugccucc

SEQ ID NO: 521855 - RNA, 21 nt, Human
acagacacuucuccauaagca

SEQ ID NO: 521856 - RNA, 20 nt, Human
acauugcuuccugucagccu

SEQ ID NO: 521857 - RNA, 18 nt, Human
acuuucaguagggcagau

SEQ ID NO: 521858 - RNA, 18 nt, Human
agaaaagagaaccccaga

SEQ ID NO: 521859 - RNA, 20 nt, Human
agcaccuccccugaccaucu

SEQ ID NO: 521860 - RNA, 21 nt, Human
agcccagacugagggaugggc

SEQ ID NO: 521861 - RNA, 23 nt, Human
aggacaacuguagaacuaugauc

SEQ ID NO: 521862 - RNA, 24 nt, Human
aggcauuuguucacauugcuuccu

SEQ ID NO: 521863 - RNA, 23 nt, Human
agucugagcuggggguguugguu

SEQ ID NO: 521864 - RNA, 23 nt, Human
augcagcuaaaaaagagccacau

SEQ ID NO: 521865 - RNA, 19 nt, Human
caaaaggaacuucaggauc

SEQ ID NO: 521866 - RNA, 18 nt, Human
caauccucaaccagccuc

SEQ ID NO: 521867 - RNA, 21 nt, Human
cacauugcuuccugucagccu

SEQ ID NO: 521868 - RNA, 21 nt, Human
caccaaaauaucuuuuucuuc

SEQ ID NO: 521869 - RNA, 18 nt, Human
cagcccagacugagggau

SEQ ID NO: 521870 - RNA, 24 nt, Human
cagccuccagccuucucuccuucu

SEQ ID NO: 521871 - RNA, 25 nt, Human
cauccacaguuauugcuuugcuacu

SEQ ID NO: 521872 - RNA, 18 nt, Human
caucucauuagcacccuc

SEQ ID NO: 521873 - RNA, 20 nt, Human
ccacaugcaaagaaagagug

SEQ ID NO: 521874 - RNA, 19 nt, Human
ccaggacaacuguagaacu

SEQ ID NO: 521875 - RNA, 20 nt, Human
cccugggaaagagggaauuc

SEQ ID NO: 521876 - RNA, 18 nt, Human
ccuccaaccacaguauuu

SEQ ID NO: 521877 - RNA, 24 nt, Human
ccuucagagaaaacagacuggaau

SEQ ID NO: 521878 - RNA, 20 nt, Human
cuagugccaggacaacugua

SEQ ID NO: 521879 - RNA, 19 nt, Human
cucuuuccggggugcccag

SEQ ID NO: 521880 - RNA, 21 nt, Human
cuuauggaagccccauuggcc

SEQ ID NO: 521881 - RNA, 19 nt, Human
cuugauacccucaguagca

SEQ ID NO: 521882 - RNA, 19 nt, Human
gaaaucuccuccaaccaca

SEQ ID NO: 521883 - RNA, 19 nt, Human
gaccugguuucuccaaacu

SEQ ID NO: 521884 - RNA, 24 nt, Human
gaggcuuuuuuacuuaacaaguua

SEQ ID NO: 521885 - RNA, 21 nt, Human
gcaaaaggaacuucaggauca

SEQ ID NO: 521886 - RNA, 19 nt, Human
gcaucuuuggcaaaaggaa

SEQ ID NO: 521887 - RNA, 26 nt, Human
gccacaugcaaagaaagagugggauu

SEQ ID NO: 521888 - RNA, 21 nt, Human
gcuugagaccccugauugcca

SEQ ID NO: 521889 - RNA, 22 nt, Human
ggagaauccagcccagacugag

SEQ ID NO: 521890 - RNA, 18 nt, Human
ggcagagucugagcuggg

SEQ ID NO: 521891 - RNA, 19 nt, Human
ggcaucuuguauuugugga

SEQ ID NO: 521892 - RNA, 18 nt, Human
uaaaaaagagccacaugc

SEQ ID NO: 521893 - RNA, 19 nt, Human
uaaaaaagagccacaugca

SEQ ID NO: 521894 - RNA, 22 nt, Human
uaaaccucuaagucaggacccu

SEQ ID NO: 521895 - RNA, 24 nt, Human
uaaauguaaauguaaacaagguca

SEQ ID NO: 521896 - RNA, 19 nt, Human
uacccucaguagcagauuu

SEQ ID NO: 521897 - RNA, 20 nt, Human
uacuugauacccucaguagc

SEQ ID NO: 521898 - RNA, 22 nt, Human
uagcagauuuaauugcccauau

SEQ ID NO: 521899 - RNA, 18 nt, Human
uauaaaagaaugaugaaa

SEQ ID NO: 521900 - RNA, 20 nt, Human
uauggaagccccauuggcca

SEQ ID NO: 521901 - RNA, 25 nt, Human
uccaaccacaguauuuccacgauga

SEQ ID NO: 521902 - RNA, 19 nt, Human
uccagcccagacugaggga

SEQ ID NO: 521903 - RNA, 21 nt, Human
uccccugaccaucuguugccc

SEQ ID NO: 521904 - RNA, 20 nt, Human
uccucaaccagccuccccgc

SEQ ID NO: 521905 - RNA, 18 nt, Human
uccugucagccuccagcc

SEQ ID NO: 521906 - RNA, 23 nt, Human
ucugcagccauaaaauggccauc

SEQ ID NO: 521907 - RNA, 19 nt, Human
ucugucuccugcucuucuc

SEQ ID NO: 521908 - RNA, 18 nt, Human
ugaaacaucacagcauuc

SEQ ID NO: 521909 - RNA, 19 nt, Human
ugaaaugcacauuuucaug

SEQ ID NO: 521910 - RNA, 22 nt, Human
ugaaaugcacauuuucaugaaa

SEQ ID NO: 521911 - RNA, 23 nt, Human
ugacaauaaauguaaauguaaac

SEQ ID NO: 521912 - RNA, 19 nt, Human
ugagaccccugauugccac

SEQ ID NO: 521913 - RNA, 20 nt, Human
ugcccugcagauuuuggacu

SEQ ID NO: 521914 - RNA, 22 nt, Human
uggaauugguuugaaaagagcc

SEQ ID NO: 521915 - RNA, 21 nt, Human
uggcaaaaggaacuucaggau

SEQ ID NO: 521916 - RNA, 19 nt, Human
ugucagauuggcuaggcca

SEQ ID NO: 521917 - RNA, 23 nt, Human
ugucaugaguucuagugccagga

SEQ ID NO: 521918 - RNA, 19 nt, Human
uugccacucuuauggaagc

SEQ ID NO: 521919 - RNA, 21 nt, Human
uugugaauagaaaagagaacc

SEQ ID NO: 521920 - RNA, 22 nt, Human
uuguggaccacaggguauagag

SEQ ID NO: 521921 - RNA, 22 nt, Human
uuuacauacuuauuauuccaaa

SEQ ID NO: 521922 - RNA, 24 nt, Human
uuuccaugugugugggggccucau

SEQ ID NO: 521923 - RNA, 22 nt, Human
uuuugcaaguuaagucaccuac

SEQ ID NO: 521924 - RNA, 18 nt, Human
aaacucccccacauuccc

SEQ ID NO: 521925 - RNA, 20 nt, Human
aaccuucuggccuuccaaga

SEQ ID NO: 521926 - RNA, 21 nt, Human
acaacagagagcauagcaagc

SEQ ID NO: 521927 - RNA, 23 nt, Human
acagagagcauagcaagcaacaa

SEQ ID NO: 521928 - RNA, 23 nt, Human
acagggagaaugcuuccccgccu

SEQ ID NO: 521929 - RNA, 24 nt, Human
accucaucuccaccugucucccca

SEQ ID NO: 521930 - RNA, 24 nt, Human
accuguggguaauuaacucccccu

SEQ ID NO: 521931 - RNA, 21 nt, Human
acugcugcagaugacccaggu

SEQ ID NO: 521932 - RNA, 21 nt, Human
acuggggggcgggggccccug

SEQ ID NO: 521933 - RNA, 19 nt, Human
agaaugcuuccccgccucu

SEQ ID NO: 521934 - RNA, 20 nt, Human
agagagggaggcagggugcu

SEQ ID NO: 521935 - RNA, 22 nt, Human
agcaggguucugggcagcugcc

SEQ ID NO: 521936 - RNA, 22 nt, Human
agccugggugcuccuggagguu

SEQ ID NO: 521937 - RNA, 23 nt, Human
agcuaugcaaaccuucuggccuu

SEQ ID NO: 521938 - RNA, 22 nt, Human
aggaccacaugaguaaacaagc

SEQ ID NO: 521939 - RNA, 24 nt, Human
aggcagggugcugugggagcccuc

SEQ ID NO: 521940 - RNA, 21 nt, Human
aggcugcugguucugcuggcu

SEQ ID NO: 521941 - RNA, 19 nt, Human
agggagaggcggggauggg

SEQ ID NO: 521942 - RNA, 21 nt, Human
agggagaggcggggauggggg

SEQ ID NO: 521943 - RNA, 18 nt, Human
aucuucaccucaucucca

SEQ ID NO: 521944 - RNA, 18 nt, Human
caauguacaacagagagc

SEQ ID NO: 521945 - RNA, 22 nt, Human
caccucauuguucucaucaguc

SEQ ID NO: 521946 - RNA, 23 nt, Human
cagccaaauccuuuacugaagcu

SEQ ID NO: 521947 - RNA, 19 nt, Human
cagcuccaccuguggguaa

SEQ ID NO: 521948 - RNA, 19 nt, Human
cccgcaacucuuggcagcc

SEQ ID NO: 521949 - RNA, 24 nt, Human
ccuaccacacagcugugugacuga

SEQ ID NO: 521950 - RNA, 21 nt, Human
ccuccgauaucacagggcagg

SEQ ID NO: 521951 - RNA, 18 nt, Human
ccugaggcugcugguucu

SEQ ID NO: 521952 - RNA, 18 nt, Human
cgauaucacagggcaggg

SEQ ID NO: 521953 - RNA, 20 nt, Human
cgggggccccuggagugggc

SEQ ID NO: 521954 - RNA, 21 nt, Human
cgggggccccuggagugggcu

SEQ ID NO: 521955 - RNA, 23 nt, Human
cguccgaggacacugcauuaucc

SEQ ID NO: 521956 - RNA, 22 nt, Human
cucaucuccaccugucucccca

SEQ ID NO: 521957 - RNA, 19 nt, Human
cucccuuagggcucccugc

SEQ ID NO: 521958 - RNA, 23 nt, Human
cuccgauaucacagggcagggag

SEQ ID NO: 521959 - RNA, 22 nt, Human
cuccugggucucccgcaacucu

SEQ ID NO: 521960 - RNA, 18 nt, Human
cucuuauuccggcuuugc

SEQ ID NO: 521961 - RNA, 21 nt, Human
cucuuggcagcccaucuuggc

SEQ ID NO: 521962 - RNA, 19 nt, Human
cuggagguucugcaucuca

SEQ ID NO: 521963 - RNA, 20 nt, Human
cuggcucuucagcuccaccu

SEQ ID NO: 521964 - RNA, 18 nt, Human
cuuucuuuuccuuuuucu

SEQ ID NO: 521965 - RNA, 19 nt, Human
gaccuguaacugcucccuu

SEQ ID NO: 521966 - RNA, 20 nt, Human
gagagcauagcaagcaacaa

SEQ ID NO: 521967 - RNA, 24 nt, Human
gagccuccagccccacuuccccag

SEQ ID NO: 521968 - RNA, 22 nt, Human
gcaaaccuucuggccuuccaag

SEQ ID NO: 521969 - RNA, 19 nt, Human
gcaagggcugcugcccaag

SEQ ID NO: 521970 - RNA, 23 nt, Human
gcacucuuucuuuuccuuuuucu

SEQ ID NO: 521971 - RNA, 24 nt, Human
gcgggggccccuggagugggcuca

SEQ ID NO: 521972 - RNA, 23 nt, Human
gcuggaauccaaagaggaccugg

SEQ ID NO: 521973 - RNA, 24 nt, Human
ggaggcagggugcugugggagccc

SEQ ID NO: 521974 - RNA, 24 nt, Human
ggcacucuuucuuuuccuuuuucu

SEQ ID NO: 521975 - RNA, 24 nt, Human
gggaaggggugguagggacauggu

SEQ ID NO: 521976 - RNA, 21 nt, Human
gguaggggcagagccuccagc

SEQ ID NO: 521977 - RNA, 18 nt, Human
guugccguccgaggacac

SEQ ID NO: 521978 - RNA, 21 nt, Human
uaaacucccccacauucccau

SEQ ID NO: 521979 - RNA, 21 nt, Human
uaacuucaucuuacaauuuuc

SEQ ID NO: 521980 - RNA, 20 nt, Human
uacaaaaaaggaaugcaagg

SEQ ID NO: 521981 - RNA, 25 nt, Human
uacaacagagagcauagcaagcaac

SEQ ID NO: 521982 - RNA, 26 nt, Human
uaccacacagcugugugacugagcca

SEQ ID NO: 521983 - RNA, 20 nt, Human
uacccuggcuugucaguagc

SEQ ID NO: 521984 - RNA, 24 nt, Human
uacugguccugcugcugcugccgu

SEQ ID NO: 521985 - RNA, 22 nt, Human
uacugugaggguaaaggguuga

SEQ ID NO: 521986 - RNA, 18 nt, Human
uagcuuccaggugcuccu

SEQ ID NO: 521987 - RNA, 20 nt, Human
ucagcaggguucugggcagc

SEQ ID NO: 521988 - RNA, 21 nt, Human
ucagcaggguucugggcagcu

SEQ ID NO: 521989 - RNA, 21 nt, Human
ucauucagccuccucaguugc

SEQ ID NO: 521990 - RNA, 22 nt, Human
uccaggugcuccugggucuccc

SEQ ID NO: 521991 - RNA, 20 nt, Human
uccccacauuagacaggggu

SEQ ID NO: 521992 - RNA, 25 nt, Human
uccccacauuagacaggggucuuau

SEQ ID NO: 521993 - RNA, 26 nt, Human
uccccgccucuccuugugcagacucc

SEQ ID NO: 521994 - RNA, 20 nt, Human
uccugggucucccgcaacuc

SEQ ID NO: 521995 - RNA, 22 nt, Human
uccugggucucccgcaacucuu

SEQ ID NO: 521996 - RNA, 20 nt, Human
ucuccaccugucuccccaca

SEQ ID NO: 521997 - RNA, 22 nt, Human
ucuggagugaauggugucugug

SEQ ID NO: 521998 - RNA, 19 nt, Human
ucuggccuuccaagaaggu

SEQ ID NO: 521999 - RNA, 20 nt, Human
ucugucagguuuccuccgaa

SEQ ID NO: 522000 - RNA, 20 nt, Human
ucuuucuuuuccuuuuucuu

SEQ ID NO: 522001 - RNA, 21 nt, Human
ucuuuggagagagggaggcaa

SEQ ID NO: 522002 - RNA, 25 nt, Human
ugacccagguacugguccugcugcu

SEQ ID NO: 522003 - RNA, 23 nt, Human
ugagccuccuggcucuucagcuc

SEQ ID NO: 522004 - RNA, 21 nt, Human
ugauagguggccacauacugc

SEQ ID NO: 522005 - RNA, 20 nt, Human
ugauggugaucuucaccuca

SEQ ID NO: 522006 - RNA, 20 nt, Human
ugcagcuccuccuccucaga

SEQ ID NO: 522007 - RNA, 18 nt, Human
ugccugaggacucuacuc

SEQ ID NO: 522008 - RNA, 19 nt, Human
ugcuugcuacugugagggu

SEQ ID NO: 522009 - RNA, 18 nt, Human
uggaauccaaagaggacc

SEQ ID NO: 522010 - RNA, 18 nt, Human
uggcuugucaguagcccc

SEQ ID NO: 522011 - RNA, 21 nt, Human
ugggaaggggugguagggaca

SEQ ID NO: 522012 - RNA, 24 nt, Human
ugggaaggggugguagggacaugg

SEQ ID NO: 522013 - RNA, 27 nt, Human
ugggaaggggugguagggacaugguag

SEQ ID NO: 522014 - RNA, 18 nt, Human
uggggccacaucagcaug

SEQ ID NO: 522015 - RNA, 22 nt, Human
uggggggcgggggccccuggag

SEQ ID NO: 522016 - RNA, 26 nt, Human
ugguacaaaaaaggaaugcaagggcu

SEQ ID NO: 522017 - RNA, 19 nt, Human
uguaaacaaggucgcacua

SEQ ID NO: 522018 - RNA, 21 nt, Human
ugugacugagccaggggaggu

SEQ ID NO: 522019 - RNA, 20 nt, Human
ugugcagacuccccacugcu

SEQ ID NO: 522020 - RNA, 24 nt, Human
ugugcagcuccuccuccucagagg

SEQ ID NO: 522021 - RNA, 19 nt, Human
uuagaugauggugaucuuc

SEQ ID NO: 522022 - RNA, 24 nt, Human
uuagggcucccugcuuuugguggc

SEQ ID NO: 522023 - RNA, 19 nt, Human
uucauuggagaguacaggu

SEQ ID NO: 522024 - RNA, 21 nt, Human
uucccauguuauuugcucuau

SEQ ID NO: 522025 - RNA, 21 nt, Human
uucugcugcugcagccggucc

SEQ ID NO: 522026 - RNA, 22 nt, Human
uucuuggccauggccaauuugc

SEQ ID NO: 522027 - RNA, 21 nt, Human
uugcaugaucugcugcucagu

SEQ ID NO: 522028 - RNA, 22 nt, Human
uugcugacaguggccggcuuuu

SEQ ID NO: 522029 - RNA, 25 nt, Human
uuucuagguuggguccuagucacgu

SEQ ID NO: 522030 - RNA, 25 nt, Human
aggcuaaaaaggaauuugugacuga

SEQ ID NO: 522031 - RNA, 19 nt, Human
augucgcaggccccauugc

SEQ ID NO: 522032 - RNA, 18 nt, Human
cgccuggagccuugaaac

SEQ ID NO: 522033 - RNA, 22 nt, Human
cugaccaaauuagauaccuccc

SEQ ID NO: 522034 - RNA, 18 nt, Human
gagcaagaguuggggaug

SEQ ID NO: 522035 - RNA, 21 nt, Human
gagugaauuuuuucuugguga

SEQ ID NO: 522036 - RNA, 21 nt, Human
ggggagcaagaguuggggaug

SEQ ID NO: 522037 - RNA, 20 nt, Human
ggucaguggugaugguggcc

SEQ ID NO: 522038 - RNA, 21 nt, Human
ggugacuuguuuuucucuagg

SEQ ID NO: 522039 - RNA, 18 nt, Human
ucaguggugaugguggcu

SEQ ID NO: 522040 - RNA, 24 nt, Human
ucaguggugaugguggcuggaggc

SEQ ID NO: 522041 - RNA, 28 nt, Human
ucauuguugcaccggacacuuuucaacu

SEQ ID NO: 522042 - RNA, 19 nt, Human
ucccugaaaaagacagugc

SEQ ID NO: 522043 - RNA, 22 nt, Human
ucccugaaaaagacagugccuu

SEQ ID NO: 522044 - RNA, 18 nt, Human
ucgcaggccccauugcuc

SEQ ID NO: 522045 - RNA, 20 nt, Human
ucgcaggccccauugcucau

SEQ ID NO: 522046 - RNA, 24 nt, Human
ugagagaaaauacuuuuccucuac

SEQ ID NO: 522047 - RNA, 21 nt, Human
ugagggggacugacuggggau

SEQ ID NO: 522048 - RNA, 20 nt, Human
ugcugagggggacugacugg

SEQ ID NO: 522049 - RNA, 22 nt, Human
uuguugcaccggacacuuuuca

SEQ ID NO: 522050 - RNA, 20 nt, Human
uuucuuggggagcaagaguu

SEQ ID NO: 522051 - RNA, 23 nt, Human
aaacacccccucggacaggagcc

SEQ ID NO: 522052 - RNA, 18 nt, Human
aagcagcagcaaagccaa

SEQ ID NO: 522053 - RNA, 21 nt, Human
aagcagcagcaaagccaagcc

SEQ ID NO: 522054 - RNA, 22 nt, Human
aaggagcagaagggagcggggg

SEQ ID NO: 522055 - RNA, 19 nt, Human
agcgguccuggcccgacac

SEQ ID NO: 522056 - RNA, 24 nt, Human
agcuggggccccugugcggcugcc

SEQ ID NO: 522057 - RNA, 24 nt, Human
aggagcagaagggagcggggggug

SEQ ID NO: 522058 - RNA, 25 nt, Human
aggagcagaagggagcggggggugg

SEQ ID NO: 522059 - RNA, 19 nt, Human
agggagcgggggguggggg

SEQ ID NO: 522060 - RNA, 24 nt, Human
agggagcggggggugggggggugg

SEQ ID NO: 522061 - RNA, 20 nt, Human
caagccaaggaggacagagg

SEQ ID NO: 522062 - RNA, 18 nt, Human
caagcuuucuccccccac

SEQ ID NO: 522063 - RNA, 20 nt, Human
cacccacaaugcaucuaccc

SEQ ID NO: 522064 - RNA, 19 nt, Human
caccucucccccaacuaca

SEQ ID NO: 522065 - RNA, 18 nt, Human
cagcagcaaagccaagcc

SEQ ID NO: 522066 - RNA, 22 nt, Human
ccaacuacaagcagcagcaaag

SEQ ID NO: 522067 - RNA, 19 nt, Human
ccagggcgggcgagggcag

SEQ ID NO: 522068 - RNA, 24 nt, Human
cccaaacacccccucggacaggag

SEQ ID NO: 522069 - RNA, 20 nt, Human
cccaacuacaagcagcagca

SEQ ID NO: 522070 - RNA, 23 nt, Human
cccacccacaaugcaucuacccc

SEQ ID NO: 522071 - RNA, 28 nt, Human
cccacccacaaugcaucuaccccagggg

SEQ ID NO: 522072 - RNA, 23 nt, Human
ccccaacuacaagcagcagcaaa

SEQ ID NO: 522073 - RNA, 22 nt, Human
ccccccacccacaaugcaucua

SEQ ID NO: 522074 - RNA, 24 nt, Human
cccccucggacaggagccacaagc

SEQ ID NO: 522075 - RNA, 18 nt, Human
cccgacacgccgccgccg

SEQ ID NO: 522076 - RNA, 19 nt, Human
ccucagccacggccuccuc

SEQ ID NO: 522077 - RNA, 23 nt, Human
ccucagccacggccuccucacgg

SEQ ID NO: 522078 - RNA, 21 nt, Human
cggcagcgguggguggcaaag

SEQ ID NO: 522079 - RNA, 18 nt, Human
cgggggcggcagcugggg

SEQ ID NO: 522080 - RNA, 23 nt, Human
cucagccacggccuccucacggc

SEQ ID NO: 522081 - RNA, 22 nt, Human
cuggggcugggccugcgggggc

SEQ ID NO: 522082 - RNA, 21 nt, Human
cugggucggggagggaauaau

SEQ ID NO: 522083 - RNA, 26 nt, Human
cuucucaaggaggaggggggcaccuc

SEQ ID NO: 522084 - RNA, 18 nt, Human
gagcagaagggagcgggg

SEQ ID NO: 522085 - RNA, 21 nt, Human
gagcgaguuuucaggaggucc

SEQ ID NO: 522086 - RNA, 19 nt, Human
gagcggggggugggggggu

SEQ ID NO: 522087 - RNA, 26 nt, Human
gaggacagagggaaacuggaggggcc

SEQ ID NO: 522088 - RNA, 20 nt, Human
gagggcagggggaggcggcc

SEQ ID NO: 522089 - RNA, 22 nt, Human
gaggucccuucucaaggaggag

SEQ ID NO: 522090 - RNA, 19 nt, Human
gcacugggcugggucgggg

SEQ ID NO: 522091 - RNA, 23 nt, Human
gccacaagcuuucuccccccacc

SEQ ID NO: 522092 - RNA, 24 nt, Human
ggagcgggggguggggggguggga

SEQ ID NO: 522093 - RNA, 22 nt, Human
ggcgagggcagggggaggcggc

SEQ ID NO: 522094 - RNA, 21 nt, Human
gggccaagggaccccaaacac

SEQ ID NO: 522095 - RNA, 23 nt, Human
gggcgagggcagggggaggcggc

SEQ ID NO: 522096 - RNA, 20 nt, Human
ggggcugggccugcgggggc

SEQ ID NO: 522097 - RNA, 19 nt, Human
gggggugggggggugggaa

SEQ ID NO: 522098 - RNA, 21 nt, Human
gguggcaaaggggcagagggc

SEQ ID NO: 522099 - RNA, 23 nt, Human
gguggguggcaaaggggcagagg

SEQ ID NO: 522100 - RNA, 19 nt, Human
guuuauugaaggagcagaa

SEQ ID NO: 522101 - RNA, 18 nt, Human
uccuugguggccgggugc

SEQ ID NO: 522102 - RNA, 23 nt, Human
ugcgggggcggcagcuggggccc

SEQ ID NO: 522103 - RNA, 18 nt, Human
uggcaaaggggcagaggg

SEQ ID NO: 522104 - RNA, 20 nt, Human
uggggcugggccugcggggg

SEQ ID NO: 522105 - RNA, 23 nt, Human
uggguggcaaaggggcagagggc

SEQ ID NO: 522106 - RNA, 23 nt, Human
uucuccccccacccacaaugcau

SEQ ID NO: 522107 - RNA, 19 nt, Human
aaccagcacucugcccuuc

SEQ ID NO: 522108 - RNA, 18 nt, Human
aaccuggagaaaccagca

SEQ ID NO: 522109 - RNA, 22 nt, Human
acccuggccaugcagccccaac

SEQ ID NO: 522110 - RNA, 20 nt, Human
acucugcccuuccuuuuccg

SEQ ID NO: 522111 - RNA, 19 nt, Human
acuggcgcgacagcuggau

SEQ ID NO: 522112 - RNA, 19 nt, Human
agaaaccagcacucugccc

SEQ ID NO: 522113 - RNA, 19 nt, Human
agagggaagcuggggccuu

SEQ ID NO: 522114 - RNA, 19 nt, Human
agagggaagcuggggccuu

SEQ ID NO: 522115 - RNA, 23 nt, Human
agcacggguacaguggcuggauc

SEQ ID NO: 522116 - RNA, 22 nt, Human
agcacuccggggaguggcagcc

SEQ ID NO: 522117 - RNA, 21 nt, Human
aggaaugggggugugaauggg

SEQ ID NO: 522118 - RNA, 20 nt, Human
aggcaucuggggaugggcug

SEQ ID NO: 522119 - RNA, 22 nt, Human
aggcaucuggggaugggcuggg

SEQ ID NO: 522120 - RNA, 22 nt, Human
aggucuugcaagaugcccccug

SEQ ID NO: 522121 - RNA, 25 nt, Human
agguggcggagacugcugcuggagu

SEQ ID NO: 522122 - RNA, 24 nt, Human
agugaccucacuuuggacaaaggc

SEQ ID NO: 522123 - RNA, 21 nt, Human
aguggcuggauccuagggggu

SEQ ID NO: 522124 - RNA, 18 nt, Human
agugggcugggauggagg

SEQ ID NO: 522125 - RNA, 23 nt, Human
augcagccccaaccccgcaagga

SEQ ID NO: 522126 - RNA, 23 nt, Human
caaggagcuugaugaagccaacg

SEQ ID NO: 522127 - RNA, 19 nt, Human
cagccccaaccccgcaagg

SEQ ID NO: 522128 - RNA, 20 nt, Human
cagccccaaccccgcaagga

SEQ ID NO: 522129 - RNA, 18 nt, Human
cagcuggauccccgggag

SEQ ID NO: 522130 - RNA, 25 nt, Human
caugcagccccaaccccgcaaggag

SEQ ID NO: 522131 - RNA, 20 nt, Human
ccaaagucagaaguuggggc

SEQ ID NO: 522132 - RNA, 20 nt, Human
ccagugggcugggauggagg

SEQ ID NO: 522133 - RNA, 20 nt, Human
ccaguuccugaccugaccuu

SEQ ID NO: 522134 - RNA, 27 nt, Human
cccagagcacuccggggaguggcagcc

SEQ ID NO: 522135 - RNA, 19 nt, Human
ccccaaccccgcaaggagc

SEQ ID NO: 522136 - RNA, 18 nt, Human
ccccgggaugcagccgcc

SEQ ID NO: 522137 - RNA, 18 nt, Human
cccuggccaugcagcccc

SEQ ID NO: 522138 - RNA, 19 nt, Human
cccuuccuuuuccuuucuu

SEQ ID NO: 522139 - RNA, 22 nt, Human
ccgggcgcccguuccucuaggg

SEQ ID NO: 522140 - RNA, 22 nt, Human
ccuccgcgccucugcgccgccc

SEQ ID NO: 522141 - RNA, 24 nt, Human
ccugagagacacaagaguuggcuu

SEQ ID NO: 522142 - RNA, 24 nt, Human
ccugcaaggccucugggauaggcu

SEQ ID NO: 522143 - RNA, 20 nt, Human
ccugcucucuuccucuccca

SEQ ID NO: 522144 - RNA, 19 nt, Human
ccuggccaugcagccccaa

SEQ ID NO: 522145 - RNA, 24 nt, Human
ccuggccaugcagccccaaccccg

SEQ ID NO: 522146 - RNA, 23 nt, Human
ccuuucuuccugucuugcaaccc

SEQ ID NO: 522147 - RNA, 20 nt, Human
ccuuuuccuuucuuccuguc

SEQ ID NO: 522148 - RNA, 22 nt, Human
cgcaaagcugaccugacugccc

SEQ ID NO: 522149 - RNA, 24 nt, Human
cgcggguacuggcgcgacagcugg

SEQ ID NO: 522150 - RNA, 21 nt, Human
cgcugcuagagucccggaggc

SEQ ID NO: 522151 - RNA, 18 nt, Human
cggggaguggcagccggu

SEQ ID NO: 522152 - RNA, 25 nt, Human
cggguacaguggcuggauccuaggg

SEQ ID NO: 522153 - RNA, 19 nt, Human
cuccacgccgaggcccggc

SEQ ID NO: 522154 - RNA, 28 nt, Human
cuccacgccgaggcccggccgggcuccu

SEQ ID NO: 522155 - RNA, 24 nt, Human
cucuguauauaaauacaaugacac

SEQ ID NO: 522156 - RNA, 22 nt, Human
cugacugccccgucacaccaug

SEQ ID NO: 522157 - RNA, 22 nt, Human
cugccuuguccugcucucuucc

SEQ ID NO: 522158 - RNA, 22 nt, Human
cugggauaggcugggggugcag

SEQ ID NO: 522159 - RNA, 22 nt, Human
gacugccccgucacaccaugcc

SEQ ID NO: 522160 - RNA, 23 nt, Human
gagccaggaggaaugggggugug

SEQ ID NO: 522161 - RNA, 19 nt, Human
gagcccggagguggcggag

SEQ ID NO: 522162 - RNA, 20 nt, Human
gauaggcugggggugcagag

SEQ ID NO: 522163 - RNA, 21 nt, Human
gccuggguuuggggagcacgg

SEQ ID NO: 522164 - RNA, 21 nt, Human
gcggagggcgcucuaguccca

SEQ ID NO: 522165 - RNA, 19 nt, Human
gcuggagcccggagguggc

SEQ ID NO: 522166 - RNA, 20 nt, Human
ggaagcuggggccuuggggu

SEQ ID NO: 522167 - RNA, 22 nt, Human
ggacugggaccaggggcugggc

SEQ ID NO: 522168 - RNA, 23 nt, Human
ggagacgacggcuggagccuggg

SEQ ID NO: 522169 - RNA, 18 nt, Human
ggauaaggagccaggagg

SEQ ID NO: 522170 - RNA, 21 nt, Human
ggauaggcugggggugcagag

SEQ ID NO: 522171 - RNA, 19 nt, Human
ggauggaggggggaugucu

SEQ ID NO: 522172 - RNA, 22 nt, Human
ggcugggcaguggugggaggcc

SEQ ID NO: 522173 - RNA, 24 nt, Human
gggcaguggugggaggcccucagg

SEQ ID NO: 522174 - RNA, 20 nt, Human
gguacaguggcuggauccua

SEQ ID NO: 522175 - RNA, 21 nt, Human
gugaccucacuuuggacaaag

SEQ ID NO: 522176 - RNA, 21 nt, Human
gugcagagggaagcuggggcc

SEQ ID NO: 522177 - RNA, 23 nt, Human
guguccaugaauucucgagugac

SEQ ID NO: 522178 - RNA, 18 nt, Human
uccuagcuggagggggga

SEQ ID NO: 522179 - RNA, 21 nt, Human
uccuagggggucgcggagacc

SEQ ID NO: 522180 - RNA, 22 nt, Human
uccugccacccuggccaugcag

SEQ ID NO: 522181 - RNA, 23 nt, Human
uccuuuuccuuucuuccugucuu

SEQ ID NO: 522182 - RNA, 20 nt, Human
ucucccaguucugguccagu

SEQ ID NO: 522183 - RNA, 22 nt, Human
ucucccaguucugguccagugg

SEQ ID NO: 522184 - RNA, 24 nt, Human
ucucccaguucugguccagugggc

SEQ ID NO: 522185 - RNA, 25 nt, Human
ucugcccuuccuuuuccuuucuucc

SEQ ID NO: 522186 - RNA, 23 nt, Human
ucugccuuguccugcucucuucc

SEQ ID NO: 522187 - RNA, 23 nt, Human
ucugggauaggcugggggugcag

SEQ ID NO: 522188 - RNA, 23 nt, Human
ucuguauauaaauacaaugacac

SEQ ID NO: 522189 - RNA, 21 nt, Human
ucuugcaacccacuuguccug

SEQ ID NO: 522190 - RNA, 20 nt, Human
ugaaaaauuaaagucauaag

SEQ ID NO: 522191 - RNA, 19 nt, Human
ugacacugcuggucaccug

SEQ ID NO: 522192 - RNA, 23 nt, Human
ugaccugacugccccgucacacc

SEQ ID NO: 522193 - RNA, 21 nt, Human
ugacugggggccguguccaug

SEQ ID NO: 522194 - RNA, 19 nt, Human
ugagagacacaagaguugg

SEQ ID NO: 522195 - RNA, 27 nt, Human
ugcccggggcucccccagccgggcgcc

SEQ ID NO: 522196 - RNA, 18 nt, Human
ugccgcuguccucgcggg

SEQ ID NO: 522197 - RNA, 19 nt, Human
uggagaaaccagcacucug

SEQ ID NO: 522198 - RNA, 18 nt, Human
uggauccuagggggucgc

SEQ ID NO: 522199 - RNA, 19 nt, Human
uggauccuagggggucgcg

SEQ ID NO: 522200 - RNA, 23 nt, Human
uggcggagacugcugcuggaguc

SEQ ID NO: 522201 - RNA, 21 nt, Human
uggcuggaguuugggggcgcc

SEQ ID NO: 522202 - RNA, 20 nt, Human
ugggaccaggggcugggcag

SEQ ID NO: 522203 - RNA, 20 nt, Human
ugggcugggauggagggggg

SEQ ID NO: 522204 - RNA, 21 nt, Human
ugggcugggauggagggggga

SEQ ID NO: 522205 - RNA, 20 nt, Human
uggggaggugcucgaugcuu

SEQ ID NO: 522206 - RNA, 19 nt, Human
uggggccuuggggucccca

SEQ ID NO: 522207 - RNA, 22 nt, Human
ugggggugcagagggaagcugg

SEQ ID NO: 522208 - RNA, 28 nt, Human
ugggggugcagagggaagcuggggccuu

SEQ ID NO: 522209 - RNA, 19 nt, Human
ugggggugugaauggggag

SEQ ID NO: 522210 - RNA, 24 nt, Human
ugggggugugaauggggaggugcu

SEQ ID NO: 522211 - RNA, 23 nt, Human
ugggguccccaggggcaugggga

SEQ ID NO: 522212 - RNA, 24 nt, Human
uguccugcucucuuccucucccaa

SEQ ID NO: 522213 - RNA, 26 nt, Human
uuccugccacccuggccaugcagccc

SEQ ID NO: 522214 - RNA, 20 nt, Human
acagcaccguccagagcagc

SEQ ID NO: 522215 - RNA, 18 nt, Human
acuucaauagaugcagaa

SEQ ID NO: 522216 - RNA, 20 nt, Human
agaagagcuaggggcggggc

SEQ ID NO: 522217 - RNA, 21 nt, Human
agccacaaaaaaaggaaacaa

SEQ ID NO: 522218 - RNA, 22 nt, Human
agcccgaggguagcccgacaca

SEQ ID NO: 522219 - RNA, 21 nt, Human
aggagaaaaaauuuaaaccca

SEQ ID NO: 522220 - RNA, 19 nt, Human
agggagcgccuagcgggcu

SEQ ID NO: 522221 - RNA, 19 nt, Human
cacaaaaaaaggaaacaau

SEQ ID NO: 522222 - RNA, 20 nt, Human
caccagaaauaaagccggug

SEQ ID NO: 522223 - RNA, 19 nt, Human
caccuccccuugcagaagc

SEQ ID NO: 522224 - RNA, 21 nt, Human
caccuggagccaggcgcgggg

SEQ ID NO: 522225 - RNA, 21 nt, Human
cacucucaggagaggagugca

SEQ ID NO: 522226 - RNA, 22 nt, Human
cacuucaauagaugcagaaaac

SEQ ID NO: 522227 - RNA, 21 nt, Human
cagcaccguccagagcagcga

SEQ ID NO: 522228 - RNA, 21 nt, Human
cagcagcuccugcgucgcggc

SEQ ID NO: 522229 - RNA, 20 nt, Human
cagcgacagccccaggaaga

SEQ ID NO: 522230 - RNA, 20 nt, Human
ccagaaauaaagccggugcc

SEQ ID NO: 522231 - RNA, 21 nt, Human
ccccaggaagaggagcggcag

SEQ ID NO: 522232 - RNA, 22 nt, Human
ccgcagcagccuccgcucccgc

SEQ ID NO: 522233 - RNA, 27 nt, Human
ccgccgaacagccgcgucucucggucc

SEQ ID NO: 522234 - RNA, 26 nt, Human
ccgcugcgcgcgcucccgcgccgccu

SEQ ID NO: 522235 - RNA, 18 nt, Human
ccucgcgcaccuccccuu

SEQ ID NO: 522236 - RNA, 22 nt, Human
ccucgcgcaccuccccuugcag

SEQ ID NO: 522237 - RNA, 18 nt, Human
ccugcugcagcuucuccu

SEQ ID NO: 522238 - RNA, 20 nt, Human
cgaggugaggcuccagagcc

SEQ ID NO: 522239 - RNA, 22 nt, Human
cgcacccgcugcgcgcgcuccc

SEQ ID NO: 522240 - RNA, 24 nt, Human
cgccgggguccaacagcaccgucc

SEQ ID NO: 522241 - RNA, 19 nt, Human
cgcgcucccgcgccgccuc

SEQ ID NO: 522242 - RNA, 18 nt, Human
cggcagggagcgccuagc

SEQ ID NO: 522243 - RNA, 21 nt, Human
cggccggaggcgggucaggcc

SEQ ID NO: 522244 - RNA, 18 nt, Human
cggugcuguacugcacuc

SEQ ID NO: 522245 - RNA, 23 nt, Human
cguccugcugcagcuucuccucc

SEQ ID NO: 522246 - RNA, 18 nt, Human
cgucgcggccauggcugu

SEQ ID NO: 522247 - RNA, 22 nt, Human
cgucucucgguccgcccuggcc

SEQ ID NO: 522248 - RNA, 19 nt, Human
cgugcucuucuggcucugc

SEQ ID NO: 522249 - RNA, 21 nt, Human
cuacggucugcuccuggaaua

SEQ ID NO: 522250 - RNA, 19 nt, Human
cuccagucuucugcgcacc

SEQ ID NO: 522251 - RNA, 25 nt, Human
cucggccucgagcccgcgcaucagc

SEQ ID NO: 522252 - RNA, 21 nt, Human
cucuucuggcucugcaguucc

SEQ ID NO: 522253 - RNA, 22 nt, Human
cugcagcgucaccaauugggcu

SEQ ID NO: 522254 - RNA, 19 nt, Human
cugcugcagcuucuccucc

SEQ ID NO: 522255 - RNA, 24 nt, Human
cuucucuagcuccugcuuccgcug

SEQ ID NO: 522256 - RNA, 20 nt, Human
gaguccaccuggagccaggc

SEQ ID NO: 522257 - RNA, 20 nt, Human
gccacaaaaaaaggaaacaa

SEQ ID NO: 522258 - RNA, 21 nt, Human
gccccaggaagaggagcggca

SEQ ID NO: 522259 - RNA, 18 nt, Human
gcccuggccaucuccucc

SEQ ID NO: 522260 - RNA, 22 nt, Human
gccucgcgcaccuccccuugca

SEQ ID NO: 522261 - RNA, 23 nt, Human
gcggcagggagcgccuagcgggc

SEQ ID NO: 522262 - RNA, 19 nt, Human
gcugcagcuucuccuccug

SEQ ID NO: 522263 - RNA, 20 nt, Human
gcugcgaguugcugcuccgu

SEQ ID NO: 522264 - RNA, 22 nt, Human
ggcggcaggggaagcccgaggg

SEQ ID NO: 522265 - RNA, 20 nt, Human
ggcugcgaguugcugcuccg

SEQ ID NO: 522266 - RNA, 22 nt, Human
ggcuucgccuccgcagcagccu

SEQ ID NO: 522267 - RNA, 22 nt, Human
gggaagcccgaggguagcccga

SEQ ID NO: 522268 - RNA, 23 nt, Human
guccagagcagcgacagccccag

SEQ ID NO: 522269 - RNA, 26 nt, Human
uacaguagccacaaaaaaaggaaaca

SEQ ID NO: 522270 - RNA, 23 nt, Human
uagccacaaaaaaaggaaacaau

SEQ ID NO: 522271 - RNA, 21 nt, Human
ucaaugaaagguuaaugaaau

SEQ ID NO: 522272 - RNA, 21 nt, Human
ucccccacagugcagauggcu

SEQ ID NO: 522273 - RNA, 20 nt, Human
uccgccuccuccagucuucu

SEQ ID NO: 522274 - RNA, 23 nt, Human
uccguaguagaagagcuaggggc

SEQ ID NO: 522275 - RNA, 21 nt, Human
uccugcgucgcggccauggcu

SEQ ID NO: 522276 - RNA, 21 nt, Human
ucucuuguggaaaagaaccca

SEQ ID NO: 522277 - RNA, 24 nt, Human
ucucuuguggaaaagaacccauaa

SEQ ID NO: 522278 - RNA, 24 nt, Human
ugcaccagaaauaaagccggugcc

SEQ ID NO: 522279 - RNA, 19 nt, Human
ugcagcuucuccuccugca

SEQ ID NO: 522280 - RNA, 21 nt, Human
ugcccuggaguccaccuggag

SEQ ID NO: 522281 - RNA, 19 nt, Human
ugcgcacccgcugcgcgcg

SEQ ID NO: 522282 - RNA, 22 nt, Human
ugcugcuccgugcucuucuggc

SEQ ID NO: 522283 - RNA, 24 nt, Human
uggaauauggcccaggccuccgcu

SEQ ID NO: 522284 - RNA, 24 nt, Human
uggcaggcgucacaaugggcggca

SEQ ID NO: 522285 - RNA, 20 nt, Human
ugucaaagagccguaauuag

SEQ ID NO: 522286 - RNA, 20 nt, Human
uguggcgcuccgccuccucc

SEQ ID NO: 522287 - RNA, 25 nt, Human
uuacaguagccacaaaaaaaggaaa

SEQ ID NO: 522288 - RNA, 22 nt, Human
uuaggcgaccuuggucuacacu

SEQ ID NO: 522289 - RNA, 22 nt, Human
uugcugcuccgugcucuucugg

SEQ ID NO: 522290 - RNA, 23 nt, Human
uuuuuuuuuuuuuuuuuaucccu

SEQ ID NO: 522291 - RNA, 21 nt, Human
aagcaaacggaugauuuuaau

SEQ ID NO: 522292 - RNA, 20 nt, Human
aaggcggcgggcgcggggcc

SEQ ID NO: 522293 - RNA, 20 nt, Human
aggcaaggcggcgggcgcgg

SEQ ID NO: 522294 - RNA, 23 nt, Human
cacagcccggggaggugucgucc

SEQ ID NO: 522295 - RNA, 18 nt, Human
cacuccgcaggugcgggc

SEQ ID NO: 522296 - RNA, 22 nt, Human
cagugagucuugcaaggggcuc

SEQ ID NO: 522297 - RNA, 24 nt, Human
cccggguuggaacaaaccgggguc

SEQ ID NO: 522298 - RNA, 21 nt, Human
cccuuuccccuccggggggac

SEQ ID NO: 522299 - RNA, 23 nt, Human
ccggugggagcggggccuucucu

SEQ ID NO: 522300 - RNA, 23 nt, Human
ccuugaagggugccugggagggg

SEQ ID NO: 522301 - RNA, 26 nt, Human
cgcaggugcgggcagcggcgggcugc

SEQ ID NO: 522302 - RNA, 22 nt, Human
cgcggccccggguuggaacaaa

SEQ ID NO: 522303 - RNA, 22 nt, Human
cggggcccagcaccggugggag

SEQ ID NO: 522304 - RNA, 22 nt, Human
cucccugggcuccagcaggguc

SEQ ID NO: 522305 - RNA, 19 nt, Human
cuccgcaggugcgggcagc

SEQ ID NO: 522306 - RNA, 21 nt, Human
cugcggucggggcccagcacc

SEQ ID NO: 522307 - RNA, 24 nt, Human
gaaggccuugaagggugccuggga

SEQ ID NO: 522308 - RNA, 25 nt, Human
gcagcggcgggcugcggucggggcc

SEQ ID NO: 522309 - RNA, 21 nt, Human
gcaggcaaggcggcgggcgcg

SEQ ID NO: 522310 - RNA, 25 nt, Human
gcaggugcgggcagcggcgggcugc

SEQ ID NO: 522311 - RNA, 18 nt, Human
gggcagcggcgggcugcg

SEQ ID NO: 522312 - RNA, 21 nt, Human
gggcaugugagcacagcaggu

SEQ ID NO: 522313 - RNA, 18 nt, Human
gggcccagcaccgguggg

SEQ ID NO: 522314 - RNA, 20 nt, Human
gggcucaggagcggggacag

SEQ ID NO: 522315 - RNA, 21 nt, Human
ggggcccagcaccggugggag

SEQ ID NO: 522316 - RNA, 19 nt, Human
ggugcgggcagcggcgggc

SEQ ID NO: 522317 - RNA, 22 nt, Human
ucccugggcuccagcagggucu

SEQ ID NO: 522318 - RNA, 21 nt, Human
uccucgcuggacaggggggca

SEQ ID NO: 522319 - RNA, 19 nt, Human
ucgugaaccuuccgaaauc

SEQ ID NO: 522320 - RNA, 20 nt, Human
ucugcaguugggagggcgug

SEQ ID NO: 522321 - RNA, 22 nt, Human
ugaagggugccugggagggggc

SEQ ID NO: 522322 - RNA, 24 nt, Human
ugagcacagcagguccuccaggga

SEQ ID NO: 522323 - RNA, 20 nt, Human
ugaggaaggccuugaagggu

SEQ ID NO: 522324 - RNA, 20 nt, Human
ugcggucggggcccagcacc

SEQ ID NO: 522325 - RNA, 23 nt, Human
uggcucugggggacugaggaagg

SEQ ID NO: 522326 - RNA, 19 nt, Human
ugggagggggcugcacagc

SEQ ID NO: 522327 - RNA, 20 nt, Human
aaaucagcuuugaaauccga

SEQ ID NO: 522328 - RNA, 22 nt, Human
aagggcggguaaaagcugugug

SEQ ID NO: 522329 - RNA, 20 nt, Human
acacugugccagggcacagg

SEQ ID NO: 522330 - RNA, 20 nt, Human
accacaguucuuucagccug

SEQ ID NO: 522331 - RNA, 19 nt, Human
agaagcaggcagaggaggc

SEQ ID NO: 522332 - RNA, 23 nt, Human
agcaggcagaggaggcagcucug

SEQ ID NO: 522333 - RNA, 19 nt, Human
agccaagguccaugacgug

SEQ ID NO: 522334 - RNA, 21 nt, Human
agccugagcaucaugggguca

SEQ ID NO: 522335 - RNA, 19 nt, Human
agcugggcgcaggugggga

SEQ ID NO: 522336 - RNA, 19 nt, Human
aggggcuccaggaagggac

SEQ ID NO: 522337 - RNA, 24 nt, Human
agggugcagccaagguccaugacg

SEQ ID NO: 522338 - RNA, 23 nt, Human
aucacaucccaaaauuccugagg

SEQ ID NO: 522339 - RNA, 20 nt, Human
auccagugcuccuuccguga

SEQ ID NO: 522340 - RNA, 22 nt, Human
augcuguucuuugaagggugca

SEQ ID NO: 522341 - RNA, 18 nt, Human
auuucacucccuuccucc

SEQ ID NO: 522342 - RNA, 20 nt, Human
auuucacucccuuccuccuc

SEQ ID NO: 522343 - RNA, 24 nt, Human
caaaaugaauccagugcuccuucc

SEQ ID NO: 522344 - RNA, 18 nt, Human
caaaauuccugaggcugc

SEQ ID NO: 522345 - RNA, 24 nt, Human
cacccuccucaggggcaaucaugg

SEQ ID NO: 522346 - RNA, 24 nt, Human
cagaagcaggcagaggaggcagcc

SEQ ID NO: 522347 - RNA, 18 nt, Human
cagccccugaccgguccu

SEQ ID NO: 522348 - RNA, 19 nt, Human
cagccccugaccgguccug

SEQ ID NO: 522349 - RNA, 22 nt, Human
cagcguguuagaaaucagcuuu

SEQ ID NO: 522350 - RNA, 23 nt, Human
ccugucccuagggacacugaugg

SEQ ID NO: 522351 - RNA, 24 nt, Human
cgaaccaucacuucacccuccuca

SEQ ID NO: 522352 - RNA, 24 nt, Human
cuggguccacgguggugaugcugu

SEQ ID NO: 522353 - RNA, 24 nt, Human
cuucacccuccucaggggcaauca

SEQ ID NO: 522354 - RNA, 22 nt, Human
gaaccaucacuucacccuccuc

SEQ ID NO: 522355 - RNA, 23 nt, Human
gaaccaucacuucacccuccuca

SEQ ID NO: 522356 - RNA, 18 nt, Human
gaggaaacaagcggggga

SEQ ID NO: 522357 - RNA, 19 nt, Human
gaggcgcccuguagcuccc

SEQ ID NO: 522358 - RNA, 19 nt, Human
gaucacaucccaaaauucc

SEQ ID NO: 522359 - RNA, 20 nt, Human
gaucugcauuucacucccuu

SEQ ID NO: 522360 - RNA, 23 nt, Human
gcaaaauauuccucaauguuucg

SEQ ID NO: 522361 - RNA, 24 nt, Human
gccagggcacaggggcccggauca

SEQ ID NO: 522362 - RNA, 19 nt, Human
gcuccucguuccacuucuu

SEQ ID NO: 522363 - RNA, 23 nt, Human
gcugcuguucuggacucauuggu

SEQ ID NO: 522364 - RNA, 19 nt, Human
gcuucagguccugggccau

SEQ ID NO: 522365 - RNA, 21 nt, Human
ggagcaaaaugaauccagugc

SEQ ID NO: 522366 - RNA, 19 nt, Human
ggagucacuuuuggcgauc

SEQ ID NO: 522367 - RNA, 18 nt, Human
ggauggggaggggcggcc

SEQ ID NO: 522368 - RNA, 18 nt, Human
gggcgcagguggggaucc

SEQ ID NO: 522369 - RNA, 20 nt, Human
uaacaugacaucgagcugcu

SEQ ID NO: 522370 - RNA, 24 nt, Human
uaauaguaucucuccagguccgau

SEQ ID NO: 522371 - RNA, 26 nt, Human
uagaccuucagcagaucuuucagcuu

SEQ ID NO: 522372 - RNA, 25 nt, Human
uauuccucaauguuucgacuugagu

SEQ ID NO: 522373 - RNA, 18 nt, Human
ucacuggguccacggugg

SEQ ID NO: 522374 - RNA, 25 nt, Human
ucacuucacccuccucaggggcaau

SEQ ID NO: 522375 - RNA, 21 nt, Human
ucagcagcguguuagaaauca

SEQ ID NO: 522376 - RNA, 23 nt, Human
uccaggaagggacucgucagcag

SEQ ID NO: 522377 - RNA, 22 nt, Human
uccuugggucucccuggcuuuu

SEQ ID NO: 522378 - RNA, 25 nt, Human
ucuccagguccgauucagauggcuu

SEQ ID NO: 522379 - RNA, 23 nt, Human
ucuuucagcuucagguccugggc

SEQ ID NO: 522380 - RNA, 21 nt, Human
ugaaucugcaaaccacaguuc

SEQ ID NO: 522381 - RNA, 19 nt, Human
ugacaugacagucugauag

SEQ ID NO: 522382 - RNA, 23 nt, Human
ugagguaaaaagcugggcgcagg

SEQ ID NO: 522383 - RNA, 19 nt, Human
ugaugccacagaagcaaaa

SEQ ID NO: 522384 - RNA, 18 nt, Human
ugcagaugcuccucguuc

SEQ ID NO: 522385 - RNA, 20 nt, Human
ugggaguggcucaugugaug

SEQ ID NO: 522386 - RNA, 26 nt, Human
uggggaggggcggccagugugagcuc

SEQ ID NO: 522387 - RNA, 21 nt, Human
ugucuuugcgaauuccauugg

SEQ ID NO: 522388 - RNA, 19 nt, Human
ugugcagaugcuccucguu

SEQ ID NO: 522389 - RNA, 24 nt, Human
aaacgacugugaaguauacauuuu

SEQ ID NO: 522390 - RNA, 23 nt, Human
aacacuuauuuauugaugagugu

SEQ ID NO: 522391 - RNA, 22 nt, Human
aacauaguaacagccaaaaaca

SEQ ID NO: 522392 - RNA, 22 nt, Human
aagauggcaaaaugacaugccc

SEQ ID NO: 522393 - RNA, 24 nt, Human
acauaguaacagccaaaaacaaaa

SEQ ID NO: 522394 - RNA, 20 nt, Human
accggucaaucuaaccugga

SEQ ID NO: 522395 - RNA, 21 nt, Human
acggaggggggaaaaaaagua

SEQ ID NO: 522396 - RNA, 23 nt, Human
agcaagcuccuucacagcaauau

SEQ ID NO: 522397 - RNA, 20 nt, Human
aggccgcacucgcacugcuu

SEQ ID NO: 522398 - RNA, 24 nt, Human
auacaagaugcacucaauauccau

SEQ ID NO: 522399 - RNA, 18 nt, Human
auccaagacacaaacgac

SEQ ID NO: 522400 - RNA, 19 nt, Human
aucuacucacucucuccca

SEQ ID NO: 522401 - RNA, 21 nt, Human
augacaagcagcuuaaauaca

SEQ ID NO: 522402 - RNA, 24 nt, Human
caaagauggcaaaaugacaugccc

SEQ ID NO: 522403 - RNA, 25 nt, Human
caauagcaagcuccuucacagcaau

SEQ ID NO: 522404 - RNA, 21 nt, Human
cacacaguuguacuguagaga

SEQ ID NO: 522405 - RNA, 19 nt, Human
cacacugucaacacuuugc

SEQ ID NO: 522406 - RNA, 25 nt, Human
cacuaaccugacuaaaaggccgcac

SEQ ID NO: 522407 - RNA, 19 nt, Human
cauaguaacagccaaaaac

SEQ ID NO: 522408 - RNA, 24 nt, Human
cauccccauuuuaagacuggucua

SEQ ID NO: 522409 - RNA, 18 nt, Human
ccaccgcucgcccccucg

SEQ ID NO: 522410 - RNA, 18 nt, Human
ccccauuuuaagacuggu

SEQ ID NO: 522411 - RNA, 22 nt, Human
cccgccaccgccaccgcucgcc

SEQ ID NO: 522412 - RNA, 21 nt, Human
ccgccaccgccaccgcucgcc

SEQ ID NO: 522413 - RNA, 19 nt, Human
ccgccaccgcucgcccccu

SEQ ID NO: 522414 - RNA, 19 nt, Human
ccgccgccaugugccgccg

SEQ ID NO: 522415 - RNA, 27 nt, Human
ccgcuccgccgccaugugccgccgcuc

SEQ ID NO: 522416 - RNA, 23 nt, Human
ccugccguacccgccaccgccac

SEQ ID NO: 522417 - RNA, 23 nt, Human
cuagauauuuaauaauccacacu

SEQ ID NO: 522418 - RNA, 25 nt, Human
cuaguauuuuaauuauagagaaaaa

SEQ ID NO: 522419 - RNA, 18 nt, Human
cucaauauccauaaacag

SEQ ID NO: 522420 - RNA, 26 nt, Human
cucccaaccucaauaaucugugccug

SEQ ID NO: 522421 - RNA, 18 nt, Human
cuuccacagcgccgcucc

SEQ ID NO: 522422 - RNA, 20 nt, Human
gaaccggucaaucuaaccug

SEQ ID NO: 522423 - RNA, 25 nt, Human
gagaauuugccaguuuuaaaaccug

SEQ ID NO: 522424 - RNA, 21 nt, Human
gagccugccguacccgccacc

SEQ ID NO: 522425 - RNA, 21 nt, Human
gauuuauuuuacauuucccuu

SEQ ID NO: 522426 - RNA, 22 nt, Human
gcgcccgcgagccugccguacc

SEQ ID NO: 522427 - RNA, 18 nt, Human
ggaaaaaaaguacacuua

SEQ ID NO: 522428 - RNA, 22 nt, Human
guuagagccuacaucaaguacc

SEQ ID NO: 522429 - RNA, 24 nt, Human
uaaaauauuaaaagcccacgaaag

SEQ ID NO: 522430 - RNA, 18 nt, Human
uaaaguucauuuagaaca

SEQ ID NO: 522431 - RNA, 18 nt, Human
uaaaugcagaaagcacac

SEQ ID NO: 522432 - RNA, 18 nt, Human
uaacauaguaacagccaa

SEQ ID NO: 522433 - RNA, 27 nt, Human
uacauacauucauuuaaaauauaugua

SEQ ID NO: 522434 - RNA, 24 nt, Human
uaccacacaucuauauucaccaaa

SEQ ID NO: 522435 - RNA, 18 nt, Human
uacuguagagaacagggc

SEQ ID NO: 522436 - RNA, 23 nt, Human
uagaaaaauaaaugcagaaagca

SEQ ID NO: 522437 - RNA, 21 nt, Human
ucaauauuccauaaaugacaa

SEQ ID NO: 522438 - RNA, 22 nt, Human
ucagacaucucauccuaucaau

SEQ ID NO: 522439 - RNA, 23 nt, Human
uccaaacuagauauuuaauaauc

SEQ ID NO: 522440 - RNA, 24 nt, Human
uccaaacuagauauuuaauaaucu

SEQ ID NO: 522441 - RNA, 20 nt, Human
uccacagcgccgcuccgccg

SEQ ID NO: 522442 - RNA, 25 nt, Human
uccacagcgccgcuccgccgccaug

SEQ ID NO: 522443 - RNA, 19 nt, Human
uccauaaaugacaagcagc

SEQ ID NO: 522444 - RNA, 22 nt, Human
ucuacucacucucucccaaccu

SEQ ID NO: 522445 - RNA, 18 nt, Human
ugaaacuacaaagauggc

SEQ ID NO: 522446 - RNA, 19 nt, Human
ugaaacuacaaagauggca

SEQ ID NO: 522447 - RNA, 18 nt, Human
ugcaagugagcagugaac

SEQ ID NO: 522448 - RNA, 22 nt, Human
ugccgaauaagagaugccaaca

SEQ ID NO: 522449 - RNA, 22 nt, Human
ugccgccgcuccuccgguccga

SEQ ID NO: 522450 - RNA, 18 nt, Human
ugcguugguuuaaaaaag

SEQ ID NO: 522451 - RNA, 20 nt, Human
ugcuuaugaucuacauucac

SEQ ID NO: 522452 - RNA, 18 nt, Human
uguaugaagucuuaauau

SEQ ID NO: 522453 - RNA, 19 nt, Human
ugugaaacuacaaagaugg

SEQ ID NO: 522454 - RNA, 19 nt, Human
uuagaacaggcaauuuguu

SEQ ID NO: 522455 - RNA, 24 nt, Human
uuauugaagaccuucuguuuacau

SEQ ID NO: 522456 - RNA, 23 nt, Human
uuccacagcgccgcuccgccgcc

SEQ ID NO: 522457 - RNA, 18 nt, Human
uucuacaucuacucacuc

SEQ ID NO: 522458 - RNA, 23 nt, Human
uugcuuaauugcacacaguugua

SEQ ID NO: 522459 - RNA, 18 nt, Human
uuuagaacaggcaauuug

SEQ ID NO: 522460 - RNA, 21 nt, Human
uuugugaaacuacaaagaugg

SEQ ID NO: 522461 - RNA, 24 nt, Human
uuuuaacauaguaacagccaaaaa

SEQ ID NO: 522462 - RNA, 21 nt, Human
aaaauacagacaauaacacua

SEQ ID NO: 522463 - RNA, 20 nt, Human
aaagcuuauuucugccuaca

SEQ ID NO: 522464 - RNA, 26 nt, Human
acagacaauaacacuaucaaaaugua

SEQ ID NO: 522465 - RNA, 26 nt, Human
aguaauaacaacugucuuagaagaga

SEQ ID NO: 522466 - RNA, 24 nt, Human
aguacgggagcuacgaugaaggga

SEQ ID NO: 522467 - RNA, 26 nt, Human
caucuauugauaagcuuuuaagaaau

SEQ ID NO: 522468 - RNA, 22 nt, Human
ccacauuuaucugauuuuuagu

SEQ ID NO: 522469 - RNA, 20 nt, Human
cgggagcuacgaugaaggga

SEQ ID NO: 522470 - RNA, 23 nt, Human
gcagaacuagcacuuuaacaaaa

SEQ ID NO: 522471 - RNA, 24 nt, Human
gcagcaguggcuaaaaaugaguac

SEQ ID NO: 522472 - RNA, 22 nt, Human
ggcagcaguggcuaaaaaugag

SEQ ID NO: 522473 - RNA, 23 nt, Human
uaaacaucagcagauaagccauu

SEQ ID NO: 522474 - RNA, 18 nt, Human
uaacaguuaagcuuccuu

SEQ ID NO: 522475 - RNA, 20 nt, Human
uaagaaauaugucauaccau

SEQ ID NO: 522476 - RNA, 20 nt, Human
uaccauaugacuucaaaaga

SEQ ID NO: 522477 - RNA, 21 nt, Human
uauauucacacuagcaagauu

SEQ ID NO: 522478 - RNA, 18 nt, Human
ucaacaaaauauacaaac

SEQ ID NO: 522479 - RNA, 25 nt, Human
uccaguuucaguuuuauaaugucac

SEQ ID NO: 522480 - RNA, 23 nt, Human
ucugccuacacauaugaugacau

SEQ ID NO: 522481 - RNA, 22 nt, Human
ugcagaacuagcacuuuaacaa

SEQ ID NO: 522482 - RNA, 20 nt, Human
uuauuucugccuacacauau

SEQ ID NO: 522483 - RNA, 20 nt, Human
cccggcccagacugcagccg

SEQ ID NO: 522484 - RNA, 22 nt, Human
ggccccggcccagacugcagcc

SEQ ID NO: 522485 - RNA, 21 nt, Human
gggccccggcccagacugcag

SEQ ID NO: 522486 - RNA, 26 nt, Human
uuaccaaccuguccucccccuaggcc

SEQ ID NO: 522487 - RNA, 21 nt, Human
uuuuuuuuuucaaacaaguaa

SEQ ID NO: 522488 - RNA, 18 nt, Human
agacaccgaggcugcgcc

SEQ ID NO: 522489 - RNA, 21 nt, Human
cagagacaccgaggcugcgcc

SEQ ID NO: 522490 - RNA, 22 nt, Human
cagagacaccgaggcugcgccg

SEQ ID NO: 522491 - RNA, 19 nt, Human
ccagaagguugcuugggcc

SEQ ID NO: 522492 - RNA, 22 nt, Human
cccacugccgccggcccagaga

SEQ ID NO: 522493 - RNA, 18 nt, Human
cccagagacaccgaggcu

SEQ ID NO: 522494 - RNA, 23 nt, Human
ccggcccagagacaccgaggcug

SEQ ID NO: 522495 - RNA, 23 nt, Human
cggcccagagacaccgaggcugc

SEQ ID NO: 522496 - RNA, 21 nt, Human
uucuuuauugauuuauuuauu

SEQ ID NO: 522497 - RNA, 24 nt, Human
aaagugcugggauuacaggcauga

SEQ ID NO: 522498 - RNA, 20 nt, Human
aaccgccccucacgcccccg

SEQ ID NO: 522499 - RNA, 19 nt, Human
aagugcugggauuacaggc

SEQ ID NO: 522500 - RNA, 21 nt, Human
aagugcugggauuacaggcau

SEQ ID NO: 522501 - RNA, 26 nt, Human
aagugcugggauuacaggcaugagcc

SEQ ID NO: 522502 - RNA, 20 nt, Human
acaccgcaaagccccaaagu

SEQ ID NO: 522503 - RNA, 21 nt, Human
acagccccggccugccccgcg

SEQ ID NO: 522504 - RNA, 21 nt, Human
acaggcgcccaccaccaugcc

SEQ ID NO: 522505 - RNA, 18 nt, Human
acgggguuucaccacguu

SEQ ID NO: 522506 - RNA, 20 nt, Human
acgggguuucaccacguuag

SEQ ID NO: 522507 - RNA, 20 nt, Human
acugcaagcucugccuccag

SEQ ID NO: 522508 - RNA, 18 nt, Human
acuuuauugccuccucuu

SEQ ID NO: 522509 - RNA, 18 nt, Human
agaagccgagggcgagug

SEQ ID NO: 522510 - RNA, 19 nt, Human
aggaauucuuuuuuuuuuu

SEQ ID NO: 522511 - RNA, 22 nt, Human
aggcagccaggcccaagcguga

SEQ ID NO: 522512 - RNA, 24 nt, Human
aggcucccagcaacucaugcacuu

SEQ ID NO: 522513 - RNA, 18 nt, Human
aggcuggagugcaguggc

SEQ ID NO: 522514 - RNA, 18 nt, Human
agggagaagccgagggcg

SEQ ID NO: 522515 - RNA, 18 nt, Human
agggagcugaccuugggg

SEQ ID NO: 522516 - RNA, 20 nt, Human
agggagcugaccuugggggc

SEQ ID NO: 522517 - RNA, 25 nt, Human
agggagcugaccuugggggccagug

SEQ ID NO: 522518 - RNA, 24 nt, Human
aguaagagacgggguuucaccacg

SEQ ID NO: 522519 - RNA, 18 nt, Human
aguagcugggacuacagg

SEQ ID NO: 522520 - RNA, 19 nt, Human
aguagcugggacuacaggc

SEQ ID NO: 522521 - RNA, 24 nt, Human
agugcaguggcgcauauucggcuc

SEQ ID NO: 522522 - RNA, 24 nt, Human
augauccucccgccucggccuccc

SEQ ID NO: 522523 - RNA, 23 nt, Human
caaacccccggccuaguccgcag

SEQ ID NO: 522524 - RNA, 28 nt, Human
caaagccccaaaguggaggguccgggag

SEQ ID NO: 522525 - RNA, 24 nt, Human
caaagugcugggauuacaggcaug

SEQ ID NO: 522526 - RNA, 18 nt, Human
caaccggcccccaggaau

SEQ ID NO: 522527 - RNA, 22 nt, Human
cacagcauucuccugccucagc

SEQ ID NO: 522528 - RNA, 18 nt, Human
caccacguuagccaggau

SEQ ID NO: 522529 - RNA, 22 nt, Human
caccacguuagccaggaugguc

SEQ ID NO: 522530 - RNA, 24 nt, Human
caccacguuagccaggauggucuc

SEQ ID NO: 522531 - RNA, 23 nt, Human
caccucaaucugggccugucugc

SEQ ID NO: 522532 - RNA, 20 nt, Human
cacgcaaccugccccgcgcg

SEQ ID NO: 522533 - RNA, 20 nt, Human
cagaaggcaccaccucaauc

SEQ ID NO: 522534 - RNA, 20 nt, Human
cagccuccugaguagcuggg

SEQ ID NO: 522535 - RNA, 23 nt, Human
ccaaagugcugggauuacaggca

SEQ ID NO: 522536 - RNA, 24 nt, Human
ccaaagugcugggauuacaggcau

SEQ ID NO: 522537 - RNA, 20 nt, Human
ccaaaguggaggguccggga

SEQ ID NO: 522538 - RNA, 21 nt, Human
ccaccgcaaccggcccccagg

SEQ ID NO: 522539 - RNA, 18 nt, Human
ccaggcccaagcgugacc

SEQ ID NO: 522540 - RNA, 24 nt, Human
cccaaagugcugggauuacaggca

SEQ ID NO: 522541 - RNA, 18 nt, Human
ccccaaaguggagggucc

SEQ ID NO: 522542 - RNA, 21 nt, Human
ccccgcacgcguccucagggc

SEQ ID NO: 522543 - RNA, 21 nt, Human
ccccgcgcgccccgaacccgg

SEQ ID NO: 522544 - RNA, 22 nt, Human
cccgcacgcguccucagggccg

SEQ ID NO: 522545 - RNA, 19 nt, Human
cccggcagaaccgccccuc

SEQ ID NO: 522546 - RNA, 21 nt, Human
ccgcaggcgggcugcccccuu

SEQ ID NO: 522547 - RNA, 22 nt, Human
ccgcuacaccgcaaagccccaa

SEQ ID NO: 522548 - RNA, 19 nt, Human
ccggcagagccgccuccuc

SEQ ID NO: 522549 - RNA, 23 nt, Human
ccgggcacggggcgguuuuuccu

SEQ ID NO: 522550 - RNA, 22 nt, Human
ccgugcaggguggcuccugagg

SEQ ID NO: 522551 - RNA, 24 nt, Human
ccuccaggguucacagcauucucc

SEQ ID NO: 522552 - RNA, 26 nt, Human
ccucccgccucggccucccaaagugc

SEQ ID NO: 522553 - RNA, 23 nt, Human
ccugaguagcugggacuacaggc

SEQ ID NO: 522554 - RNA, 23 nt, Human
ccugaguagcugggacuacaggc

SEQ ID NO: 522555 - RNA, 23 nt, Human
ccugccucagccuccugaguagc

SEQ ID NO: 522556 - RNA, 23 nt, Human
ccuugggggccagugcagaugug

SEQ ID NO: 522557 - RNA, 18 nt, Human
cgaucagggcagaggcag

SEQ ID NO: 522558 - RNA, 24 nt, Human
cgccucggccucccaaagugcugg

SEQ ID NO: 522559 - RNA, 24 nt, Human
cgcgcgccccgaacccggcagaac

SEQ ID NO: 522560 - RNA, 19 nt, Human
cggccuaguccgcaggcgg

SEQ ID NO: 522561 - RNA, 19 nt, Human
cgggacaccggcggccggg

SEQ ID NO: 522562 - RNA, 25 nt, Human
cgggaugagcacggaggggccuggg

SEQ ID NO: 522563 - RNA, 23 nt, Human
cuagcugggcauuccacagcuuc

SEQ ID NO: 522564 - RNA, 24 nt, Human
cucagccuccugaguagcugggac

SEQ ID NO: 522565 - RNA, 18 nt, Human
cucagggacggagcgguc

SEQ ID NO: 522566 - RNA, 19 nt, Human
cucagggacggagcggucc

SEQ ID NO: 522567 - RNA, 27 nt, Human
cucaugauccucccgccucggccuccc

SEQ ID NO: 522568 - RNA, 24 nt, Human
cuccugaccucaugauccucccgc

SEQ ID NO: 522569 - RNA, 22 nt, Human
cuccugccucagccuccugagu

SEQ ID NO: 522570 - RNA, 23 nt, Human
cugaccucaugauccucccgccu

SEQ ID NO: 522571 - RNA, 24 nt, Human
cugcaagcucugccuccaggguuc

SEQ ID NO: 522572 - RNA, 23 nt, Human
cugccucagccuccugaguagcu

SEQ ID NO: 522573 - RNA, 19 nt, Human
cuguugcccaggcuggagu

SEQ ID NO: 522574 - RNA, 21 nt, Human
cuuuuuuuuuuuuuuuuuuuu

SEQ ID NO: 522575 - RNA, 20 nt, Human
gaauucuuuuuuuuuuuuuu

SEQ ID NO: 522576 - RNA, 18 nt, Human
gacaccggcggccgggca

SEQ ID NO: 522577 - RNA, 22 nt, Human
gaccucaugauccucccgccuc

SEQ ID NO: 522578 - RNA, 24 nt, Human
gacuacaggcgcccaccaccaugc

SEQ ID NO: 522579 - RNA, 25 nt, Human
gacuuuccgccucuucacgcaaccu

SEQ ID NO: 522580 - RNA, 20 nt, Human
gagacgggguuucaccacgu

SEQ ID NO: 522581 - RNA, 22 nt, Human
gagcugcagcggcccguacgug

SEQ ID NO: 522582 - RNA, 25 nt, Human
gaguagcugggacuacaggcgccca

SEQ ID NO: 522583 - RNA, 21 nt, Human
gauacuaucaacauggcagcu

SEQ ID NO: 522584 - RNA, 18 nt, Human
gauccucccgccucggcc

SEQ ID NO: 522585 - RNA, 18 nt, Human
gauuacaggcaugagcca

SEQ ID NO: 522586 - RNA, 22 nt, Human
gauuacaggcaugagccaccgc

SEQ ID NO: 522587 - RNA, 23 nt, Human
gauuacaggcaugagccaccgca

SEQ ID NO: 522588 - RNA, 19 nt, Human
gcccaggcuggagugcagu

SEQ ID NO: 522589 - RNA, 20 nt, Human
gcccaggcuggagugcagug

SEQ ID NO: 522590 - RNA, 19 nt, Human
gccccgaacccggcagaac

SEQ ID NO: 522591 - RNA, 20 nt, Human
gccccgaacccggcagaacc

SEQ ID NO: 522592 - RNA, 20 nt, Human
gccgggcagggagaagccga

SEQ ID NO: 522593 - RNA, 24 nt, Human
gccuggcuaauuuuuuuguauuuu

SEQ ID NO: 522594 - RNA, 22 nt, Human
gcgcgccccgaacccggcagaa

SEQ ID NO: 522595 - RNA, 24 nt, Human
gcuacaccgcaaagccccaaagug

SEQ ID NO: 522596 - RNA, 25 nt, Human
gcucuguugcccaggcuggagugca

SEQ ID NO: 522597 - RNA, 19 nt, Human
gcugcugcaucuguuaggc

SEQ ID NO: 522598 - RNA, 19 nt, Human
gcuggagugcaguggcgca

SEQ ID NO: 522599 - RNA, 23 nt, Human
ggaauucuuuuuuuuuuuuuuuu

SEQ ID NO: 522600 - RNA, 18 nt, Human
ggagaagccgagggcgag

SEQ ID NO: 522601 - RNA, 22 nt, Human
ggagacggagucuugcucuguu

SEQ ID NO: 522602 - RNA, 21 nt, Human
ggagcgguccgggaugagcac

SEQ ID NO: 522603 - RNA, 22 nt, Human
ggagcugaccuugggggccagu

SEQ ID NO: 522604 - RNA, 23 nt, Human
ggagucuugcucuguugcccagg

SEQ ID NO: 522605 - RNA, 19 nt, Human
ggaugagcacggaggggcc

SEQ ID NO: 522606 - RNA, 22 nt, Human
ggauuacaggcaugagccaccg

SEQ ID NO: 522607 - RNA, 21 nt, Human
gggcagaggcagaaggcacca

SEQ ID NO: 522608 - RNA, 20 nt, Human
gggccgggcugcgcggggag

SEQ ID NO: 522609 - RNA, 21 nt, Human
gggcugcccccucacagcccc

SEQ ID NO: 522610 - RNA, 22 nt, Human
ggguuucaccacguuagccagg

SEQ ID NO: 522611 - RNA, 20 nt, Human
ggucucgaucuccugaccuc

SEQ ID NO: 522612 - RNA, 23 nt, Human
uacaggcaugagccaccgcaacc

SEQ ID NO: 522613 - RNA, 23 nt, Human
uaccacuguguuucauguuuuug

SEQ ID NO: 522614 - RNA, 23 nt, Human
ucaaacccccggccuaguccgca

SEQ ID NO: 522615 - RNA, 24 nt, Human
ucaccacguuagccaggauggucu

SEQ ID NO: 522616 - RNA, 18 nt, Human
ucacugcaagcucugccu

SEQ ID NO: 522617 - RNA, 23 nt, Human
ucacugcaagcucugccuccagg

SEQ ID NO: 522618 - RNA, 24 nt, Human
ucacugcaagcucugccuccaggg

SEQ ID NO: 522619 - RNA, 19 nt, Human
ucagaaguggugcuaccac

SEQ ID NO: 522620 - RNA, 23 nt, Human
ucagccuccugaguagcugggac

SEQ ID NO: 522621 - RNA, 21 nt, Human
ucaggcucccagcaacucaug

SEQ ID NO: 522622 - RNA, 24 nt, Human
ucagggacggagcgguccgggaug

SEQ ID NO: 522623 - RNA, 24 nt, Human
uccaggguucacagcauucuccug

SEQ ID NO: 522624 - RNA, 24 nt, Human
ucccaaagugcugggauuacaggc

SEQ ID NO: 522625 - RNA, 22 nt, Human
uccccggcagagccgccuccuc

SEQ ID NO: 522626 - RNA, 18 nt, Human
uccucagggccgccccag

SEQ ID NO: 522627 - RNA, 24 nt, Human
uccugaguagcugggacuacaggc

SEQ ID NO: 522628 - RNA, 21 nt, Human
uccuggagcugcagcggcccg

SEQ ID NO: 522629 - RNA, 18 nt, Human
ucggccucccaaagugcu

SEQ ID NO: 522630 - RNA, 18 nt, Human
ucgggccgggcugcgcgg

SEQ ID NO: 522631 - RNA, 22 nt, Human
ucucaucagaaguggugcuacc

SEQ ID NO: 522632 - RNA, 22 nt, Human
ucuggcuaaagacugcugcugc

SEQ ID NO: 522633 - RNA, 18 nt, Human
ucuguugcccaggcugga

SEQ ID NO: 522634 - RNA, 24 nt, Human
ucuguugcccaggcuggagugcag

SEQ ID NO: 522635 - RNA, 23 nt, Human
ucuugcucuguugcccaggcugg

SEQ ID NO: 522636 - RNA, 24 nt, Human
ucuugcucuguugcccaggcugga

SEQ ID NO: 522637 - RNA, 28 nt, Human
ucuuuuuuuuuuuuuuuuuuuuuggggg

SEQ ID NO: 522638 - RNA, 22 nt, Human
ugaccucaugauccucccgccu

SEQ ID NO: 522639 - RNA, 21 nt, Human
ugaggcagccaggcccaagcg

SEQ ID NO: 522640 - RNA, 18 nt, Human
ugcccaggcuggagugca

SEQ ID NO: 522641 - RNA, 21 nt, Human
ugcccaggcuggagugcagug

SEQ ID NO: 522642 - RNA, 22 nt, Human
ugcccaggcuggagugcagugg

SEQ ID NO: 522643 - RNA, 24 nt, Human
ugcccaggcuggagugcaguggcg

SEQ ID NO: 522644 - RNA, 24 nt, Human
ugccucagccuccugaguagcugg

SEQ ID NO: 522645 - RNA, 19 nt, Human
ugcgcggggaggcggcggg

SEQ ID NO: 522646 - RNA, 19 nt, Human
ugcucaggcucccagcaac

SEQ ID NO: 522647 - RNA, 24 nt, Human
ugcucuguugcccaggcuggagug

SEQ ID NO: 522648 - RNA, 24 nt, Human
uggagugcaguggcgcauauucgg

SEQ ID NO: 522649 - RNA, 20 nt, Human
uggcuuagaugaaaugucuu

SEQ ID NO: 522650 - RNA, 21 nt, Human
ugggacuacaggcgcccacca

SEQ ID NO: 522651 - RNA, 24 nt, Human
ugggacuacaggcgcccaccacca

SEQ ID NO: 522652 - RNA, 25 nt, Human
ugggacuacaggcgcccaccaccau

SEQ ID NO: 522653 - RNA, 22 nt, Human
ugggagaagccgcgguuccggg

SEQ ID NO: 522654 - RNA, 18 nt, Human
ugggauuacaggcaugag

SEQ ID NO: 522655 - RNA, 19 nt, Human
ugggauuacaggcaugagc

SEQ ID NO: 522656 - RNA, 21 nt, Human
ugggauuacaggcaugagcca

SEQ ID NO: 522657 - RNA, 22 nt, Human
ugggauuacaggcaugagccac

SEQ ID NO: 522658 - RNA, 23 nt, Human
ugggauuacaggcaugagccacc

SEQ ID NO: 522659 - RNA, 24 nt, Human
ugggauuacaggcaugagccaccg

SEQ ID NO: 522660 - RNA, 24 nt, Human
ugggauuacaggcaugagccaccg

SEQ ID NO: 522661 - RNA, 22 nt, Human
uguauuuuuaguaagagacggg

SEQ ID NO: 522662 - RNA, 19 nt, Human
ugucugcuguggcugguca

SEQ ID NO: 522663 - RNA, 18 nt, Human
ugucuuuuuuuuuuuugg

SEQ ID NO: 522664 - RNA, 23 nt, Human
uuaaugguuccagagaguucucu

SEQ ID NO: 522665 - RNA, 24 nt, Human
uucaccacugguacaccucagaua

SEQ ID NO: 522666 - RNA, 25 nt, Human
uuuguccccggcagagccgccuccc

SEQ ID NO: 522667 - RNA, 25 nt, Human
uuuuuaguaagagacgggguuucac

SEQ ID NO: 522668 - RNA, 25 nt, Human
uuuuuuguauuuuuaguaagagacg

SEQ ID NO: 522669 - RNA, 25 nt, Human
uuuuuuuuuuuuggagacggagucu

SEQ ID NO: 522670 - RNA, 23 nt, Human
uuuuuuuuuuuuuuggagacgga

SEQ ID NO: 522671 - RNA, 18 nt, Human
aaacaacccucccgucac

SEQ ID NO: 522672 - RNA, 19 nt, Human
aaacaacccucccgucacc

SEQ ID NO: 522673 - RNA, 19 nt, Human
aaagugcugggauuacaga

SEQ ID NO: 522674 - RNA, 24 nt, Human
aaagugcugggauuacagacguga

SEQ ID NO: 522675 - RNA, 21 nt, Human
aaauccuaagauucccacccc

SEQ ID NO: 522676 - RNA, 21 nt, Human
aaaucuggcaacaaauccuaa

SEQ ID NO: 522677 - RNA, 19 nt, Human
aaccagaagaaaauucccc

SEQ ID NO: 522678 - RNA, 25 nt, Human
aacuugcugaucuccuccugaaucu

SEQ ID NO: 522679 - RNA, 20 nt, Human
aagcucuugccuugcccucc

SEQ ID NO: 522680 - RNA, 19 nt, Human
aagugcugggauuacagac

SEQ ID NO: 522681 - RNA, 19 nt, Human
aagugcugggauuacagac

SEQ ID NO: 522682 - RNA, 20 nt, Human
acuuggagcuggaguccugu

SEQ ID NO: 522683 - RNA, 21 nt, Human
agggaggagacggggacaagg

SEQ ID NO: 522684 - RNA, 24 nt, Human
agugcugggauuacagacgugagu

SEQ ID NO: 522685 - RNA, 24 nt, Human
augggucuugcuguguugcccagg

SEQ ID NO: 522686 - RNA, 21 nt, Human
auuguucucaauguucuucau

SEQ ID NO: 522687 - RNA, 28 nt, Human
caaaaauacaauauuuuuuuccucuccc

SEQ ID NO: 522688 - RNA, 24 nt, Human
caaagugcugggauuacagacgug

SEQ ID NO: 522689 - RNA, 23 nt, Human
caacacuauucuauaucagacaa

SEQ ID NO: 522690 - RNA, 22 nt, Human
caagaaaacccacuuggagcug

SEQ ID NO: 522691 - RNA, 24 nt, Human
cacccccuccugcaacaaugauuc

SEQ ID NO: 522692 - RNA, 25 nt, Human
cacccccuccugcaacaaugauuca

SEQ ID NO: 522693 - RNA, 19 nt, Human
caggggagccaagaaaacc

SEQ ID NO: 522694 - RNA, 23 nt, Human
caggggagccaagaaaacccacu

SEQ ID NO: 522695 - RNA, 18 nt, Human
cauaaaacccacacccca

SEQ ID NO: 522696 - RNA, 18 nt, Human
cauaaaacccacacccca

SEQ ID NO: 522697 - RNA, 22 nt, Human
ccaaagugcugggauuacagac

SEQ ID NO: 522698 - RNA, 24 nt, Human
ccaaagugcugggauuacagacgu

SEQ ID NO: 522699 - RNA, 24 nt, Human
ccacaccccagcaucagcccuggc

SEQ ID NO: 522700 - RNA, 18 nt, Human
ccacccccuccugcaaca

SEQ ID NO: 522701 - RNA, 21 nt, Human
cccagcaucagcccuggcgcc

SEQ ID NO: 522702 - RNA, 24 nt, Human
cccagcaucagcccuggcgccaau

SEQ ID NO: 522703 - RNA, 22 nt, Human
ccccagcaucagcccuggcgcc

SEQ ID NO: 522704 - RNA, 21 nt, Human
ccuuggggagugugagugggg

SEQ ID NO: 522705 - RNA, 19 nt, Human
cgguuugcucccggucugg

SEQ ID NO: 522706 - RNA, 21 nt, Human
cugauggugaaauguacccuc

SEQ ID NO: 522707 - RNA, 19 nt, Human
cuugcugaucuccuccuga

SEQ ID NO: 522708 - RNA, 22 nt, Human
cuugcuguguugcccaggcugg

SEQ ID NO: 522709 - RNA, 18 nt, Human
gauuacagacgugaguca

SEQ ID NO: 522710 - RNA, 19 nt, Human
gauuacagacgugagucac

SEQ ID NO: 522711 - RNA, 21 nt, Human
gauuacagacgugagucacca

SEQ ID NO: 522712 - RNA, 20 nt, Human
gggaacagggaggagacggg

SEQ ID NO: 522713 - RNA, 22 nt, Human
gggucuugcuguguugcccagg

SEQ ID NO: 522714 - RNA, 19 nt, Human
gugacaaggacagaaucug

SEQ ID NO: 522715 - RNA, 22 nt, Human
uaaaacccacaccccagcauca

SEQ ID NO: 522716 - RNA, 23 nt, Human
uaaaaugaaaauaugcaaguucc

SEQ ID NO: 522717 - RNA, 22 nt, Human
uaagucacagagccuguccuga

SEQ ID NO: 522718 - RNA, 25 nt, Human
uaauuaccagcugauuguucucaau

SEQ ID NO: 522719 - RNA, 19 nt, Human
uacccucaacuugcugauc

SEQ ID NO: 522720 - RNA, 23 nt, Human
uccauaauuaccagcugauuguu

SEQ ID NO: 522721 - RNA, 18 nt, Human
ucccaaagugcugggauu

SEQ ID NO: 522722 - RNA, 24 nt, Human
ucccaaagugcugggauuacagac

SEQ ID NO: 522723 - RNA, 21 nt, Human
ucccuucaucugaaugagggu

SEQ ID NO: 522724 - RNA, 23 nt, Human
uccuaagauucccacccccuccu

SEQ ID NO: 522725 - RNA, 19 nt, Human
uccucucccucuuccucca

SEQ ID NO: 522726 - RNA, 20 nt, Human
uccugaaucucaaacaaccc

SEQ ID NO: 522727 - RNA, 19 nt, Human
ucucccucuuccuccaucc

SEQ ID NO: 522728 - RNA, 21 nt, Human
ucuccuccugaaucucaaaca

SEQ ID NO: 522729 - RNA, 22 nt, Human
ucugucuugugaaacaaccaga

SEQ ID NO: 522730 - RNA, 18 nt, Human
ucuugcuguguugcccag

SEQ ID NO: 522731 - RNA, 19 nt, Human
ucuugcuguguugcccagg

SEQ ID NO: 522732 - RNA, 23 nt, Human
ucuugcuguguugcccaggcugg

SEQ ID NO: 522733 - RNA, 24 nt, Human
ucuugcuguguugcccaggcuggu

SEQ ID NO: 522734 - RNA, 19 nt, Human
ugaucuccuccugaaucuc

SEQ ID NO: 522735 - RNA, 19 nt, Human
ugcaaguuccagugacuuu

SEQ ID NO: 522736 - RNA, 24 nt, Human
ugccuugcccucccaaagugcugg

SEQ ID NO: 522737 - RNA, 24 nt, Human
ugcugggauuacagacgugaguca

SEQ ID NO: 522738 - RNA, 24 nt, Human
ugcuguguugcccaggcuggucuu

SEQ ID NO: 522739 - RNA, 18 nt, Human
uggcugguccccgccucc

SEQ ID NO: 522740 - RNA, 18 nt, Human
ugggauuacagacgugag

SEQ ID NO: 522741 - RNA, 18 nt, Human
ugggauuacagacgugag

SEQ ID NO: 522742 - RNA, 22 nt, Human
ugggauuacagacgugagucac

SEQ ID NO: 522743 - RNA, 24 nt, Human
ugggauuacagacgugagucacca

SEQ ID NO: 522744 - RNA, 18 nt, Human
uggggagugugagugggg

SEQ ID NO: 522745 - RNA, 19 nt, Human
uguccugagucccuucauc

SEQ ID NO: 522746 - RNA, 19 nt, Human
ugugaaacaaccagaagaa

SEQ ID NO: 522747 - RNA, 20 nt, Human
ugugaaacaaccagaagaaa

SEQ ID NO: 522748 - RNA, 19 nt, Human
uguguugcccaggcugguc

SEQ ID NO: 522749 - RNA, 21 nt, Human
uuaaaugugggggaugaaggg

SEQ ID NO: 522750 - RNA, 21 nt, Human
uucccacccccuccugcaaca

SEQ ID NO: 522751 - RNA, 19 nt, Human
uugagccgugggccuuggg

SEQ ID NO: 522752 - RNA, 24 nt, Human
uugccuugcccucccaaagugcug

SEQ ID NO: 522753 - RNA, 21 nt, Human
uuuuuuuccucucccucuucc

SEQ ID NO: 522754 - RNA, 23 nt, Human
aaacacaaccggcgccagccccg

SEQ ID NO: 522755 - RNA, 18 nt, Human
aaacauagaucauuuguc

SEQ ID NO: 522756 - RNA, 18 nt, Human
aacacaacuucugcuggu

SEQ ID NO: 522757 - RNA, 21 nt, Human
aacaccuucccuagaaaacca

SEQ ID NO: 522758 - RNA, 24 nt, Human
aaccuuuacaaaacccuacccccc

SEQ ID NO: 522759 - RNA, 24 nt, Human
aagaaggcaagguggacacaaaca

SEQ ID NO: 522760 - RNA, 24 nt, Human
aagcgccucccaaggcccccccac

SEQ ID NO: 522761 - RNA, 26 nt, Human
aagcgccucccaaggcccccccaccc

SEQ ID NO: 522762 - RNA, 19 nt, Human
aaggcccccccacccugcc

SEQ ID NO: 522763 - RNA, 21 nt, Human
aaggcccccccacccugccca

SEQ ID NO: 522764 - RNA, 21 nt, Human
aagguggacacaaacacaacc

SEQ ID NO: 522765 - RNA, 25 nt, Human
aaguccaaaucaaggucaaaggcac

SEQ ID NO: 522766 - RNA, 18 nt, Human
aagucccacuccacaaaa

SEQ ID NO: 522767 - RNA, 28 nt, Human
accauuguaaaagaaaagucauccugaa

SEQ ID NO: 522768 - RNA, 21 nt, Human
acccacacagaucccccacaa

SEQ ID NO: 522769 - RNA, 20 nt, Human
accccuccgcauccuccccc

SEQ ID NO: 522770 - RNA, 22 nt, Human
accccuccgcauccuccccccg

SEQ ID NO: 522771 - RNA, 19 nt, Human
agaggcaaggaucccggag

SEQ ID NO: 522772 - RNA, 25 nt, Human
agcugcccucgggacagagcagguu

SEQ ID NO: 522773 - RNA, 23 nt, Human
aggcccccccacccugcccaggg

SEQ ID NO: 522774 - RNA, 18 nt, Human
agguguguggcgcagacg

SEQ ID NO: 522775 - RNA, 21 nt, Human
auccugaauccugaaagaccc

SEQ ID NO: 522776 - RNA, 20 nt, Human
augcaucuuuaauucacaaa

SEQ ID NO: 522777 - RNA, 19 nt, Human
caagaagcgccucccaagg

SEQ ID NO: 522778 - RNA, 22 nt, Human
caagaagcgccucccaaggccc

SEQ ID NO: 522779 - RNA, 22 nt, Human
cacaaccggcgccagccccggc

SEQ ID NO: 522780 - RNA, 23 nt, Human
caccaaaugcaaaagggagaaaa

SEQ ID NO: 522781 - RNA, 19 nt, Human
cacuccgucuccucucuga

SEQ ID NO: 522782 - RNA, 20 nt, Human
cagagcagguucucgggaag

SEQ ID NO: 522783 - RNA, 24 nt, Human
cagcccgcugcacgcccccuccuc

SEQ ID NO: 522784 - RNA, 21 nt, Human
caggcgcagcggggccgggcu

SEQ ID NO: 522785 - RNA, 27 nt, Human
ccacacuccgucuccucucugagacuc

SEQ ID NO: 522786 - RNA, 19 nt, Human
ccacuccacaaaaacugcu

SEQ ID NO: 522787 - RNA, 18 nt, Human
ccagccgccuccgccggc

SEQ ID NO: 522788 - RNA, 23 nt, Human
ccaggauggaucugcguugagaa

SEQ ID NO: 522789 - RNA, 19 nt, Human
cccagaacaccuucccuag

SEQ ID NO: 522790 - RNA, 23 nt, Human
ccccacaacccgggcucugccga

SEQ ID NO: 522791 - RNA, 25 nt, Human
ccccacccugcccagggugcccccc

SEQ ID NO: 522792 - RNA, 19 nt, Human
cccccacacuccgucuccu

SEQ ID NO: 522793 - RNA, 18 nt, Human
cccccaccacauccucgc

SEQ ID NO: 522794 - RNA, 19 nt, Human
ccccccacccugcccaggg

SEQ ID NO: 522795 - RNA, 22 nt, Human
cccgcagcccccaccacauccu

SEQ ID NO: 522796 - RNA, 23 nt, Human
cccguccuccagcccgcugcacc

SEQ ID NO: 522797 - RNA, 21 nt, Human
cccuaccccccaucuuuguug

SEQ ID NO: 522798 - RNA, 19 nt, Human
cccuccgcauccucccccc

SEQ ID NO: 522799 - RNA, 20 nt, Human
cccugcucugggccggcccc

SEQ ID NO: 522800 - RNA, 22 nt, Human
cccugcucugggccggccccgg

SEQ ID NO: 522801 - RNA, 22 nt, Human
ccgaguggcccugcucugggcc

SEQ ID NO: 522802 - RNA, 25 nt, Human
ccgcagcccccaccacauccucgcu

SEQ ID NO: 522803 - RNA, 21 nt, Human
ccucccaaggcccccccaccc

SEQ ID NO: 522804 - RNA, 24 nt, Human
ccucccaaggcccccccacccugc

SEQ ID NO: 522805 - RNA, 25 nt, Human
ccucccaaggcccccccacccugcc

SEQ ID NO: 522806 - RNA, 22 nt, Human
ccucccacagcuggagagagcc

SEQ ID NO: 522807 - RNA, 20 nt, Human
ccuccgcauccuccccccgc

SEQ ID NO: 522808 - RNA, 21 nt, Human
ccugaaagaccccuggggcgg

SEQ ID NO: 522809 - RNA, 22 nt, Human
ccuuuacaaaacccuacccccc

SEQ ID NO: 522810 - RNA, 24 nt, Human
cgacaggcuggcagggccccaggu

SEQ ID NO: 522811 - RNA, 22 nt, Human
cgcauccuccccccgcagcccc

SEQ ID NO: 522812 - RNA, 23 nt, Human
cgcuccgucccacgucccguccu

SEQ ID NO: 522813 - RNA, 22 nt, Human
cggcaccagccgccuccgccgg

SEQ ID NO: 522814 - RNA, 21 nt, Human
cggcccggacaggcgcagcgg

SEQ ID NO: 522815 - RNA, 23 nt, Human
cggcccucccucccccacacucc

SEQ ID NO: 522816 - RNA, 21 nt, Human
cucgaggucagccaucccugc

SEQ ID NO: 522817 - RNA, 21 nt, Human
cuggagagagcccggccccca

SEQ ID NO: 522818 - RNA, 18 nt, Human
cugucggguggugacggu

SEQ ID NO: 522819 - RNA, 21 nt, Human
cuguuuuguuuuuugcuugug

SEQ ID NO: 522820 - RNA, 22 nt, Human
gaaaaguccaaaucaaggucaa

SEQ ID NO: 522821 - RNA, 23 nt, Human
gaaaccccuccgcauccuccccc

SEQ ID NO: 522822 - RNA, 22 nt, Human
gacaggcuggcagggccccagg

SEQ ID NO: 522823 - RNA, 21 nt, Human
gagcugcugcagguguguggc

SEQ ID NO: 522824 - RNA, 19 nt, Human
gcacagaaaccccuccgca

SEQ ID NO: 522825 - RNA, 25 nt, Human
gccggcccucccucccccacacucc

SEQ ID NO: 522826 - RNA, 20 nt, Human
ggagcagggcggcugccgca

SEQ ID NO: 522827 - RNA, 21 nt, Human
ggcaagaagcgccucccaagg

SEQ ID NO: 522828 - RNA, 20 nt, Human
ggcaguggcggcaccagccc

SEQ ID NO: 522829 - RNA, 20 nt, Human
ggcccccccacccugcccag

SEQ ID NO: 522830 - RNA, 23 nt, Human
ggcgccagccccggcccggacag

SEQ ID NO: 522831 - RNA, 21 nt, Human
gguaaaaauuccugccgugga

SEQ ID NO: 522832 - RNA, 21 nt, Human
gucccgggcccgcugaccagc

SEQ ID NO: 522833 - RNA, 26 nt, Human
uaaaagaaaagucauccugaauccug

SEQ ID NO: 522834 - RNA, 18 nt, Human
uacaaaacccuacccccc

SEQ ID NO: 522835 - RNA, 23 nt, Human
uagcuugucgagaagcagggcag

SEQ ID NO: 522836 - RNA, 19 nt, Human
ucacaaauaaaagcuguag

SEQ ID NO: 522837 - RNA, 18 nt, Human
ucagaaaguaugagccug

SEQ ID NO: 522838 - RNA, 21 nt, Human
ucccacagcuggagagagccc

SEQ ID NO: 522839 - RNA, 20 nt, Human
ucccacgucccguccuccag

SEQ ID NO: 522840 - RNA, 21 nt, Human
ucccccacacuccgucuccuc

SEQ ID NO: 522841 - RNA, 23 nt, Human
ucccccacacuccgucuccucuc

SEQ ID NO: 522842 - RNA, 21 nt, Human
ucccgugugagcugcugcagg

SEQ ID NO: 522843 - RNA, 20 nt, Human
ucccuagaaaaccauaaaaa

SEQ ID NO: 522844 - RNA, 20 nt, Human
uccuaugcuaugcacgaucc

SEQ ID NO: 522845 - RNA, 20 nt, Human
ucggccucugggcgacaggc

SEQ ID NO: 522846 - RNA, 20 nt, Human
ucgggacagagcagguucuc

SEQ ID NO: 522847 - RNA, 21 nt, Human
ucguguggcaguggcggcacc

SEQ ID NO: 522848 - RNA, 19 nt, Human
ucugcuggugucucaaguc

SEQ ID NO: 522849 - RNA, 22 nt, Human
ucuguuuuguuuuuugcuugug

SEQ ID NO: 522850 - RNA, 23 nt, Human
ugaacacaacuucugcugguguc

SEQ ID NO: 522851 - RNA, 19 nt, Human
ugaauccugaaagaccccu

SEQ ID NO: 522852 - RNA, 18 nt, Human
ugagaacccacacagauc

SEQ ID NO: 522853 - RNA, 20 nt, Human
ugauauaaaaauaugaaccu

SEQ ID NO: 522854 - RNA, 23 nt, Human
ugcacagaaaccccuccgcaucc

SEQ ID NO: 522855 - RNA, 22 nt, Human
uggaucugcguugagaacccac

SEQ ID NO: 522856 - RNA, 18 nt, Human
uggcaagaagcgccuccc

SEQ ID NO: 522857 - RNA, 24 nt, Human
uggcaagaagcgccucccaaggcc

SEQ ID NO: 522858 - RNA, 18 nt, Human
uggcagggccccaggugc

SEQ ID NO: 522859 - RNA, 20 nt, Human
uggcagggccccaggugcug

SEQ ID NO: 522860 - RNA, 21 nt, Human
uggcagggccccaggugcugg

SEQ ID NO: 522861 - RNA, 18 nt, Human
uggcgcagacgucacagc

SEQ ID NO: 522862 - RNA, 22 nt, Human
uguagcaagaugucaucuacac

SEQ ID NO: 522863 - RNA, 18 nt, Human
uuuacaaaacccuacccc

SEQ ID NO: 522864 - RNA, 21 nt, Human
uuuacaaaacccuacccccca

SEQ ID NO: 522865 - RNA, 19 nt, Human
aaccugcaagaauaaaaag

SEQ ID NO: 522866 - RNA, 21 nt, Human
acugacuuaaaaggacacagu

SEQ ID NO: 522867 - RNA, 19 nt, Human
caacguguacaucuuagcc

SEQ ID NO: 522868 - RNA, 18 nt, Human
cagagccucaccccaaug

SEQ ID NO: 522869 - RNA, 21 nt, Human
cagcaccccgggccggggccu

SEQ ID NO: 522870 - RNA, 22 nt, Human
cagcagcacuggacgugguggu

SEQ ID NO: 522871 - RNA, 22 nt, Human
cagggcugggcuggcaagaagc

SEQ ID NO: 522872 - RNA, 21 nt, Human
ccccgggccggggccuggcuc

SEQ ID NO: 522873 - RNA, 19 nt, Human
cggggaggcagggcugggc

SEQ ID NO: 522874 - RNA, 31 nt, Human
cugguggugguggagguaguggcuucuucuu

SEQ ID NO: 522875 - RNA, 18 nt, Human
gaagcuuggaggacaggg

SEQ ID NO: 522876 - RNA, 19 nt, Human
gacuuaaaaggacacagua

SEQ ID NO: 522877 - RNA, 20 nt, Human
gacuuaguucaauuuacuga

SEQ ID NO: 522878 - RNA, 21 nt, Human
gccggggccuggcucacuugg

SEQ ID NO: 522879 - RNA, 24 nt, Human
ggagaccggggaggcagggcuggg

SEQ ID NO: 522880 - RNA, 20 nt, Human
ggcaagaagccccagcaccc

SEQ ID NO: 522881 - RNA, 24 nt, Human
ggcagggcugggcuggcaagaagc

SEQ ID NO: 522882 - RNA, 19 nt, Human
ggccuggcucacuuggcug

SEQ ID NO: 522883 - RNA, 19 nt, Human
gggaggcagggcugggcug

SEQ ID NO: 522884 - RNA, 19 nt, Human
gggcuggcaagaagcccca

SEQ ID NO: 522885 - RNA, 21 nt, Human
ggggaggcagggcugggcugg

SEQ ID NO: 522886 - RNA, 19 nt, Human
ggugggagagaggguggag

SEQ ID NO: 522887 - RNA, 20 nt, Human
guggagcgcuuggcugcccc

SEQ ID NO: 522888 - RNA, 25 nt, Human
guggggaccuuuuguagcuagagau

SEQ ID NO: 522889 - RNA, 21 nt, Human
gugguggugcuggugguggug

SEQ ID NO: 522890 - RNA, 21 nt, Human
guggugguggagguaguggcu

SEQ ID NO: 522891 - RNA, 21 nt, Human
uauggcaugggcuacuccagg

SEQ ID NO: 522892 - RNA, 23 nt, Human
uauggcaugggcuacuccagguu

SEQ ID NO: 522893 - RNA, 25 nt, Human
uauuauagaagcuuggaggacaggg

SEQ ID NO: 522894 - RNA, 21 nt, Human
ugcaagaauaaaaagauguuu

SEQ ID NO: 522895 - RNA, 19 nt, Human
ugccaagaugggcauggaa

SEQ ID NO: 522896 - RNA, 20 nt, Human
uggaggacagggugggagac

SEQ ID NO: 522897 - RNA, 23 nt, Human
uggcaagaagccccagcaccccg

SEQ ID NO: 522898 - RNA, 24 nt, Human
ugggagaccggggaggcagggcug

SEQ ID NO: 522899 - RNA, 26 nt, Human
ugggagaccggggaggcagggcuggg

SEQ ID NO: 522900 - RNA, 19 nt, Human
ugguggugcuggugguggu

SEQ ID NO: 522901 - RNA, 20 nt, Human
ugguggugguggagguagug

SEQ ID NO: 522902 - RNA, 21 nt, Human
uuaaaaggacacaguauggca

SEQ ID NO: 522903 - RNA, 24 nt, Human
aaaaguacaagaaccuggagcuca

SEQ ID NO: 522904 - RNA, 24 nt, Human
aacuaagaaaaguacaagaaccug

SEQ ID NO: 522905 - RNA, 19 nt, Human
aacucccaccccagaccuc

SEQ ID NO: 522906 - RNA, 18 nt, Human
aagaaaaguacaagaacc

SEQ ID NO: 522907 - RNA, 24 nt, Human
acucccaccccagaccuccccagg

SEQ ID NO: 522908 - RNA, 29 nt, Human
agaaaaguacaagaaccuggagcucaggg

SEQ ID NO: 522909 - RNA, 21 nt, Human
caaauucccucccucacaacu

SEQ ID NO: 522910 - RNA, 26 nt, Human
ccaccccagaccuccccagggaaacc

SEQ ID NO: 522911 - RNA, 25 nt, Human
cggggaggagcccacgcgggccgcc

SEQ ID NO: 522912 - RNA, 22 nt, Human
cucccaccccagaccuccccag

SEQ ID NO: 522913 - RNA, 26 nt, Human
cucccucacaacuaagaaaaguacaa

SEQ ID NO: 522914 - RNA, 19 nt, Human
gaaccuggagcucagggcg

SEQ ID NO: 522915 - RNA, 20 nt, Human
gaggagcccacgcgggccgc

SEQ ID NO: 522916 - RNA, 19 nt, Human
gcccagccgcccucgccgg

SEQ ID NO: 522917 - RNA, 21 nt, Human
gccggguucgcacugagccag

SEQ ID NO: 522918 - RNA, 21 nt, Human
ggaaaccuacagagguuccug

SEQ ID NO: 522919 - RNA, 21 nt, Human
ucccaccccagaccuccccag

SEQ ID NO: 522920 - RNA, 24 nt, Human
ucgcaaauucccucccucacaacu

SEQ ID NO: 522921 - RNA, 19 nt, Human
uggccugcagggcaguucu

SEQ ID NO: 522922 - RNA, 19 nt, Human
uuccuggccugcagggcag

SEQ ID NO: 522923 - RNA, 25 nt, Human
uucgcaaauucccucccucacaacu

SEQ ID NO: 522924 - RNA, 21 nt, Human
uuucgcaaauucccucccuca

SEQ ID NO: 522925 - RNA, 22 nt, Human
aaaaagcagcacaaaacccaca

SEQ ID NO: 522926 - RNA, 24 nt, Human
aaaaagcagcacaaaacccacaag

SEQ ID NO: 522927 - RNA, 19 nt, Human
aagaaaaagcagcacaaaa

SEQ ID NO: 522928 - RNA, 21 nt, Human
aagaaagaaaaagcagcacaa

SEQ ID NO: 522929 - RNA, 26 nt, Human
aagaaagaaagaaaaagcagcacaaa

SEQ ID NO: 522930 - RNA, 24 nt, Human
aagcagcacaaaacccacaagucc

SEQ ID NO: 522931 - RNA, 21 nt, Human
acaaaacccacaagucccacg

SEQ ID NO: 522932 - RNA, 19 nt, Human
accaccccacaguaauaag

SEQ ID NO: 522933 - RNA, 27 nt, Human
agaaacgacucccaaggaguccaaguc

SEQ ID NO: 522934 - RNA, 22 nt, Human
agaaagaaaaagcagcacaaaa

SEQ ID NO: 522935 - RNA, 24 nt, Human
agcacaaaacccacaagucccacg

SEQ ID NO: 522936 - RNA, 21 nt, Human
agcgaagggacugcaaagcug

SEQ ID NO: 522937 - RNA, 20 nt, Human
agcuauauagagaaguccca

SEQ ID NO: 522938 - RNA, 22 nt, Human
aguggguagaucacauucaugg

SEQ ID NO: 522939 - RNA, 19 nt, Human
augcugccguucuuccucu

SEQ ID NO: 522940 - RNA, 21 nt, Human
cacagcagagucugcgccccu

SEQ ID NO: 522941 - RNA, 23 nt, Human
cagcaaggauacgcugaaccccg

SEQ ID NO: 522942 - RNA, 21 nt, Human
cagcugcugcaggccaugcug

SEQ ID NO: 522943 - RNA, 23 nt, Human
ccagcagugcuggucucuaagac

SEQ ID NO: 522944 - RNA, 23 nt, Human
cccagaccaaggcuggccucggc

SEQ ID NO: 522945 - RNA, 22 nt, Human
cgcugcugcagcugcugcaggc

SEQ ID NO: 522946 - RNA, 19 nt, Human
cggcccagaccaaggcugg

SEQ ID NO: 522947 - RNA, 20 nt, Human
cucacagcagagucugcgcc

SEQ ID NO: 522948 - RNA, 26 nt, Human
cugcagcugcugcaggccaugcugcc

SEQ ID NO: 522949 - RNA, 19 nt, Human
cugccgcugcugcagcugc

SEQ ID NO: 522950 - RNA, 22 nt, Human
gaaaaagcagcacaaaacccac

SEQ ID NO: 522951 - RNA, 23 nt, Human
gaagugcgcaguggaaucaagag

SEQ ID NO: 522952 - RNA, 21 nt, Human
ggcuggggcuucgcacaccuc

SEQ ID NO: 522953 - RNA, 21 nt, Human
guaagcaggcacaagcucuac

SEQ ID NO: 522954 - RNA, 19 nt, Human
uaagacgguugcccagcaa

SEQ ID NO: 522955 - RNA, 18 nt, Human
uaagugacugugcaggcc

SEQ ID NO: 522956 - RNA, 22 nt, Human
uacagcuucacacggaagcgaa

SEQ ID NO: 522957 - RNA, 21 nt, Human
uacuucugccgcugcugcagc

SEQ ID NO: 522958 - RNA, 22 nt, Human
uauugcugaaguuggaaaaggg

SEQ ID NO: 522959 - RNA, 19 nt, Human
uccacugggcuuggaauag

SEQ ID NO: 522960 - RNA, 21 nt, Human
ucccaaggaguccaaguccag

SEQ ID NO: 522961 - RNA, 24 nt, Human
ucggcccagaccaaggcuggccuc

SEQ ID NO: 522962 - RNA, 18 nt, Human
ugagaggacuugauagug

SEQ ID NO: 522963 - RNA, 20 nt, Human
ugcugccguucuuccucuga

SEQ ID NO: 522964 - RNA, 25 nt, Human
uggaaaaggggaagaaagaaagaaa

SEQ ID NO: 522965 - RNA, 19 nt, Human
uggaugugagccugugaga

SEQ ID NO: 522966 - RNA, 19 nt, Human
uggccgagaaacgacuccc

SEQ ID NO: 522967 - RNA, 19 nt, Human
uggccucggccaacagcag

SEQ ID NO: 522968 - RNA, 24 nt, Human
uggggacugccaguggguagauca

SEQ ID NO: 522969 - RNA, 22 nt, Human
uguaccaccccacaguaauaag

SEQ ID NO: 522970 - RNA, 23 nt, Human
uguaccaccccacaguaauaagu

SEQ ID NO: 522971 - RNA, 22 nt, Human
uguauugcugaaguuggaaaag

SEQ ID NO: 522972 - RNA, 18 nt, Human
ugucccagucagccuucu

SEQ ID NO: 522973 - RNA, 19 nt, Human
uguuggaugugagccugug

SEQ ID NO: 522974 - RNA, 19 nt, Human
uucacacggaagcgaaggg

SEQ ID NO: 522975 - RNA, 24 nt, Human
uuugcccaguaaauccauuuguug

SEQ ID NO: 522976 - RNA, 21 nt, Human
aaccaggcaccagcuuggcuu

SEQ ID NO: 522977 - RNA, 24 nt, Human
aagagcaaugaucuggacucagag

SEQ ID NO: 522978 - RNA, 19 nt, Human
aaggaauccaggcaccgaa

SEQ ID NO: 522979 - RNA, 20 nt, Human
acaggcugcuucagccaaga

SEQ ID NO: 522980 - RNA, 18 nt, Human
accaggcaccagcuuggc

SEQ ID NO: 522981 - RNA, 21 nt, Human
accagggccuggaaugcacug

SEQ ID NO: 522982 - RNA, 22 nt, Human
accgcaguccacaggaccacga

SEQ ID NO: 522983 - RNA, 24 nt, Human
accgcaguccacaggaccacgagu

SEQ ID NO: 522984 - RNA, 31 nt, Human
agcuuggcuucggggccuggagagaaguccc

SEQ ID NO: 522985 - RNA, 24 nt, Human
aggaaccaggcaccagcuuggcuc

SEQ ID NO: 522986 - RNA, 20 nt, Human
aggaugcagaugucuuggau

SEQ ID NO: 522987 - RNA, 21 nt, Human
auagcaaugagagcagcaguc

SEQ ID NO: 522988 - RNA, 23 nt, Human
augcccugugugacacccuuuaa

SEQ ID NO: 522989 - RNA, 22 nt, Human
caaccuucacuccaccugccac

SEQ ID NO: 522990 - RNA, 23 nt, Human
cacaaccaggugcacaggucucc

SEQ ID NO: 522991 - RNA, 21 nt, Human
caccagcuuggcuucggggcc

SEQ ID NO: 522992 - RNA, 18 nt, Human
cacccuuuaaaaugcuca

SEQ ID NO: 522993 - RNA, 18 nt, Human
caccgaaggguaugcccu

SEQ ID NO: 522994 - RNA, 19 nt, Human
caccugccaccuuaauccc

SEQ ID NO: 522995 - RNA, 22 nt, Human
cagaaucccaagcuuucccucc

SEQ ID NO: 522996 - RNA, 21 nt, Human
cagagacuaccacguuccuug

SEQ ID NO: 522997 - RNA, 20 nt, Human
cagccccucucccaacccag

SEQ ID NO: 522998 - RNA, 22 nt, Human
caguucuggaggucagaagucc

SEQ ID NO: 522999 - RNA, 21 nt, Human
cauggcaccuaguggaauccc

SEQ ID NO: 523000 - RNA, 18 nt, Human
ccaccugccaccuuaauc

SEQ ID NO: 523001 - RNA, 20 nt, Human
ccaccugccaccuuaauccc

SEQ ID NO: 523002 - RNA, 19 nt, Human
ccagccccucucccaaccc

SEQ ID NO: 523003 - RNA, 19 nt, Human
cccaggagggccaggccgc

SEQ ID NO: 523004 - RNA, 24 nt, Human
ccccaacgcagcgucuauuccuug

SEQ ID NO: 523005 - RNA, 20 nt, Human
cccucucccaacccagagga

SEQ ID NO: 523006 - RNA, 22 nt, Human
ccuaguggaaucccagguucca

SEQ ID NO: 523007 - RNA, 24 nt, Human
ccuccuccuguccaugcccagccc

SEQ ID NO: 523008 - RNA, 20 nt, Human
ccucguggcagggaccaugc

SEQ ID NO: 523009 - RNA, 21 nt, Human
ccugugacuugcuggguucac

SEQ ID NO: 523010 - RNA, 18 nt, Human
ccuugagugauggcaaug

SEQ ID NO: 523011 - RNA, 23 nt, Human
cgucuugaguuucccuccagccu

SEQ ID NO: 523012 - RNA, 18 nt, Human
cugugugccaggcucugg

SEQ ID NO: 523013 - RNA, 19 nt, Human
gacucagagcucagggcca

SEQ ID NO: 523014 - RNA, 18 nt, Human
gagaccagggccuggaau

SEQ ID NO: 523015 - RNA, 20 nt, Human
gagcagcagucacaaugacc

SEQ ID NO: 523016 - RNA, 19 nt, Human
gcugguuccuucugguggc

SEQ ID NO: 523017 - RNA, 19 nt, Human
gucccuuuucccuccuccu

SEQ ID NO: 523018 - RNA, 24 nt, Human
guucucucuuuugucuccgggccc

SEQ ID NO: 523019 - RNA, 23 nt, Human
uaaaaugcucacaaccaggugcc

SEQ ID NO: 523020 - RNA, 20 nt, Human
ucaaagucagcaguugcauu

SEQ ID NO: 523021 - RNA, 23 nt, Human
ucaccugcuagcacaggucccuu

SEQ ID NO: 523022 - RNA, 21 nt, Human
ucagggccaacuccugcugga

SEQ ID NO: 523023 - RNA, 20 nt, Human
uccacaccgcaguccacagg

SEQ ID NO: 523024 - RNA, 20 nt, Human
uccagagacuaccacguucc

SEQ ID NO: 523025 - RNA, 26 nt, Human
ucccaacccagaggaaccaggcacca

SEQ ID NO: 523026 - RNA, 20 nt, Human
ucccacuuccgccacccagg

SEQ ID NO: 523027 - RNA, 22 nt, Human
ucccacuuccgccacccaggag

SEQ ID NO: 523028 - RNA, 18 nt, Human
ucccagguuccagggauu

SEQ ID NO: 523029 - RNA, 20 nt, Human
ucccggauccgccagggcuc

SEQ ID NO: 523030 - RNA, 22 nt, Human
ucucauucaggaucaucucccu

SEQ ID NO: 523031 - RNA, 19 nt, Human
ugacagggcugguuccuuc

SEQ ID NO: 523032 - RNA, 20 nt, Human
ugagaggggaggaagcuucc

SEQ ID NO: 523033 - RNA, 21 nt, Human
ugagaggggaggaagcuuccg

SEQ ID NO: 523034 - RNA, 22 nt, Human
ugcugagaggggaggaagcuuc

SEQ ID NO: 523035 - RNA, 24 nt, Human
uggccuagggacgacucuucuuca

SEQ ID NO: 523036 - RNA, 18 nt, Human
uggccucccggauccgcc

SEQ ID NO: 523037 - RNA, 25 nt, Human
uguccaugcccagccccucucccaa

SEQ ID NO: 523038 - RNA, 21 nt, Human
uucccuccuccuguccaugcc

SEQ ID NO: 523039 - RNA, 18 nt, Human
uucugguggccccaacgc

SEQ ID NO: 523040 - RNA, 22 nt, Human
uucugugaguguuucuuucuuu

SEQ ID NO: 523041 - RNA, 19 nt, Human
uuuacaguucuggagguca

SEQ ID NO: 523042 - RNA, 20 nt, Human
uuuugaguccuucucaugaa

SEQ ID NO: 523043 - RNA, 25 nt, Human
aaaggcucccaacaagccugcagga

SEQ ID NO: 523044 - RNA, 21 nt, Human
aaccugggaggugcucagucc

SEQ ID NO: 523045 - RNA, 19 nt, Human
aacuuugugagccacugcc

SEQ ID NO: 523046 - RNA, 20 nt, Human
aagaagagacuuccucagga

SEQ ID NO: 523047 - RNA, 21 nt, Human
aagccugcaggagugccucuc

SEQ ID NO: 523048 - RNA, 19 nt, Human
aaggaggaacaaggcagcg

SEQ ID NO: 523049 - RNA, 22 nt, Human
aagggcagcuggagccugagca

SEQ ID NO: 523050 - RNA, 18 nt, Human
accauguggccuuggccc

SEQ ID NO: 523051 - RNA, 18 nt, Human
accccaccauguggccuu

SEQ ID NO: 523052 - RNA, 24 nt, Human
acuuugugagccacugcccaacug

SEQ ID NO: 523053 - RNA, 23 nt, Human
agacacccacuccugugaauaug

SEQ ID NO: 523054 - RNA, 18 nt, Human
agcaaaaugcaccuagga

SEQ ID NO: 523055 - RNA, 23 nt, Human
agccagagucaccguggaaguaa

SEQ ID NO: 523056 - RNA, 19 nt, Human
agccccaggaggaggggcu

SEQ ID NO: 523057 - RNA, 18 nt, Human
agcugcaccagugcccag

SEQ ID NO: 523058 - RNA, 21 nt, Human
agggcagaggugacugggaag

SEQ ID NO: 523059 - RNA, 22 nt, Human
agggcagaggugacugggaagg

SEQ ID NO: 523060 - RNA, 20 nt, Human
auacggccugggaaccucac

SEQ ID NO: 523061 - RNA, 23 nt, Human
auguggccuuggcccuggggagg

SEQ ID NO: 523062 - RNA, 20 nt, Human
auugggucuggcuucuuucc

SEQ ID NO: 523063 - RNA, 22 nt, Human
caaaguggcuaugccaugucac

SEQ ID NO: 523064 - RNA, 18 nt, Human
caccauguggccuuggcc

SEQ ID NO: 523065 - RNA, 18 nt, Human
caccauguggccuuggcc

SEQ ID NO: 523066 - RNA, 22 nt, Human
cacccucccaucuggugacccc

SEQ ID NO: 523067 - RNA, 22 nt, Human
caccuaggauccacccacguuc

SEQ ID NO: 523068 - RNA, 23 nt, Human
caccuaggauccacccacguuca

SEQ ID NO: 523069 - RNA, 29 nt, Human
cagagccccccagaccccgaggccucccc

SEQ ID NO: 523070 - RNA, 18 nt, Human
cagcugcagagcccccca

SEQ ID NO: 523071 - RNA, 25 nt, Human
caguuuccaggucccugaaucuccc

SEQ ID NO: 523072 - RNA, 24 nt, Human
caugaaaucagagccuucccccaa

SEQ ID NO: 523073 - RNA, 20 nt, Human
caugacaagagccauaucca

SEQ ID NO: 523074 - RNA, 21 nt, Human
ccaccaccugcaacagccaga

SEQ ID NO: 523075 - RNA, 22 nt, Human
ccaccauguggccuuggcccug

SEQ ID NO: 523076 - RNA, 24 nt, Human
ccacccagacugcuucucaguccc

SEQ ID NO: 523077 - RNA, 22 nt, Human
ccacccucccaucuggugaccc

SEQ ID NO: 523078 - RNA, 20 nt, Human
ccaccugcaacagccagagu

SEQ ID NO: 523079 - RNA, 23 nt, Human
ccagugcccagaauguguccucc

SEQ ID NO: 523080 - RNA, 19 nt, Human
cccagccucuccccgaucc

SEQ ID NO: 523081 - RNA, 18 nt, Human
cccaggaggaggggcuug

SEQ ID NO: 523082 - RNA, 18 nt, Human
ccccagaccccgaggccu

SEQ ID NO: 523083 - RNA, 21 nt, Human
cccccagaccccgaggccucc

SEQ ID NO: 523084 - RNA, 23 nt, Human
cccccuugcuggagguuuaugcc

SEQ ID NO: 523085 - RNA, 19 nt, Human
ccccuccuggagcgacucc

SEQ ID NO: 523086 - RNA, 21 nt, Human
ccccuggaggccuccugggcc

SEQ ID NO: 523087 - RNA, 21 nt, Human
cccuccaaccugccacccucc

SEQ ID NO: 523088 - RNA, 21 nt, Human
ccuaaaggcucccaacaagcc

SEQ ID NO: 523089 - RNA, 19 nt, Human
ccuccaaccugccacccuc

SEQ ID NO: 523090 - RNA, 22 nt, Human
ccuccaagucuccaggguggcc

SEQ ID NO: 523091 - RNA, 23 nt, Human
ccucccacccucccaucugguga

SEQ ID NO: 523092 - RNA, 21 nt, Human
ccucugugucucagcuugacc

SEQ ID NO: 523093 - RNA, 22 nt, Human
ccuuuucacucugaaugaucuu

SEQ ID NO: 523094 - RNA, 21 nt, Human
cgacacucccaccagacaccc

SEQ ID NO: 523095 - RNA, 20 nt, Human
cgacagggggcggccagaac

SEQ ID NO: 523096 - RNA, 18 nt, Human
cucagcuugaccccuuga

SEQ ID NO: 523097 - RNA, 25 nt, Human
cucccacccucccaucuggugaccc

SEQ ID NO: 523098 - RNA, 20 nt, Human
cucucacuggccagcagcug

SEQ ID NO: 523099 - RNA, 18 nt, Human
cucuuggguucuggcccc

SEQ ID NO: 523100 - RNA, 25 nt, Human
cugaagggcaggaggacucucaggu

SEQ ID NO: 523101 - RNA, 22 nt, Human
cuggagccugagcaacugaagg

SEQ ID NO: 523102 - RNA, 20 nt, Human
cuggccacccagacugcuuc

SEQ ID NO: 523103 - RNA, 22 nt, Human
cuuacgggcccuccaaccugcc

SEQ ID NO: 523104 - RNA, 18 nt, Human
gacgcgugguucaagucc

SEQ ID NO: 523105 - RNA, 19 nt, Human
gacugcuucucagucccua

SEQ ID NO: 523106 - RNA, 18 nt, Human
gagaugccuucugcugau

SEQ ID NO: 523107 - RNA, 22 nt, Human
gaggauguagaauaguuccugc

SEQ ID NO: 523108 - RNA, 20 nt, Human
gaggccucccacccucccau

SEQ ID NO: 523109 - RNA, 18 nt, Human
gagggcguggcuccagga

SEQ ID NO: 523110 - RNA, 21 nt, Human
gaggguccuaccauggguccc

SEQ ID NO: 523111 - RNA, 18 nt, Human
gaggugacugggaaggcu

SEQ ID NO: 523112 - RNA, 19 nt, Human
gcagcugcagagcccccca

SEQ ID NO: 523113 - RNA, 21 nt, Human
gccacugcccaacuggcugcc

SEQ ID NO: 523114 - RNA, 20 nt, Human
gccccaggaggaggggcuug

SEQ ID NO: 523115 - RNA, 21 nt, Human
gccggagggcguggcuccagg

SEQ ID NO: 523116 - RNA, 19 nt, Human
gccucucacuggccagcag

SEQ ID NO: 523117 - RNA, 20 nt, Human
gccugggaaacagagaaagg

SEQ ID NO: 523118 - RNA, 20 nt, Human
gccuuggcccuggggaggag

SEQ ID NO: 523119 - RNA, 23 nt, Human
gcguggcuccaggacacagaggg

SEQ ID NO: 523120 - RNA, 24 nt, Human
gcuaccacuccagccccuccugga

SEQ ID NO: 523121 - RNA, 19 nt, Human
gcuuuguggucgucuccug

SEQ ID NO: 523122 - RNA, 22 nt, Human
ggaggugccccuggaggccucc

SEQ ID NO: 523123 - RNA, 18 nt, Human
ggcccuggggaggagggg

SEQ ID NO: 523124 - RNA, 21 nt, Human
gggcagccccaggaggagggg

SEQ ID NO: 523125 - RNA, 24 nt, Human
gggcaggaggacucucagguugcg

SEQ ID NO: 523126 - RNA, 19 nt, Human
gggcggccagaacagggug

SEQ ID NO: 523127 - RNA, 23 nt, Human
gggcggccagaacagggugggug

SEQ ID NO: 523128 - RNA, 24 nt, Human
ggggggucaguuccggguuccuuu

SEQ ID NO: 523129 - RNA, 19 nt, Human
gguaccaagggcagcugga

SEQ ID NO: 523130 - RNA, 25 nt, Human
gucuacaaacccuaacaacaaaucc

SEQ ID NO: 523131 - RNA, 21 nt, Human
guggccccuaugcacccagcc

SEQ ID NO: 523132 - RNA, 18 nt, Human
guggguaccacaugcucc

SEQ ID NO: 523133 - RNA, 24 nt, Human
uaaaagaagcaacgacacucccac

SEQ ID NO: 523134 - RNA, 22 nt, Human
uaaaauccacaucugugacaug

SEQ ID NO: 523135 - RNA, 19 nt, Human
uaccaagggcagcuggagc

SEQ ID NO: 523136 - RNA, 20 nt, Human
uaccaagggcagcuggagcc

SEQ ID NO: 523137 - RNA, 21 nt, Human
uaccauggguccccauggguc

SEQ ID NO: 523138 - RNA, 24 nt, Human
uacuaacuuuaaaagaagcaacga

SEQ ID NO: 523139 - RNA, 18 nt, Human
ucaagcagugaaccuggc

SEQ ID NO: 523140 - RNA, 23 nt, Human
ucacugggucuuccguuugaagg

SEQ ID NO: 523141 - RNA, 21 nt, Human
ucacuugggagggcugagguc

SEQ ID NO: 523142 - RNA, 20 nt, Human
ucagguucagaugauucacc

SEQ ID NO: 523143 - RNA, 18 nt, Human
ucaguccauggugccgcc

SEQ ID NO: 523144 - RNA, 18 nt, Human
ucagucccuaugguuugg

SEQ ID NO: 523145 - RNA, 23 nt, Human
ucagucuuuggguguacaggucc

SEQ ID NO: 523146 - RNA, 22 nt, Human
uccaaaaugucuccugauagca

SEQ ID NO: 523147 - RNA, 22 nt, Human
uccaagucuccaggguggcccc

SEQ ID NO: 523148 - RNA, 24 nt, Human
uccccagcuuuugguacuaucagu

SEQ ID NO: 523149 - RNA, 22 nt, Human
ucccggcuaccacuccagcccc

SEQ ID NO: 523150 - RNA, 19 nt, Human
ucccgggcuuuggggcagc

SEQ ID NO: 523151 - RNA, 22 nt, Human
ucccuuagcaaaaugcaccuag

SEQ ID NO: 523152 - RNA, 20 nt, Human
uccuggaaguggggcugggc

SEQ ID NO: 523153 - RNA, 31 nt, Human
ucuccaggguggccccuaugcacccagccuu

SEQ ID NO: 523154 - RNA, 20 nt, Human
ucucccggcuaccacuccag

SEQ ID NO: 523155 - RNA, 18 nt, Human
ugaaaggcgucugacuug

SEQ ID NO: 523156 - RNA, 21 nt, Human
ugaagggcaggaggacucuca

SEQ ID NO: 523157 - RNA, 19 nt, Human
ugaauauggaaauacggcc

SEQ ID NO: 523158 - RNA, 21 nt, Human
ugaccccuugagaccaccccc

SEQ ID NO: 523159 - RNA, 19 nt, Human
ugagaccacccccuugcug

SEQ ID NO: 523160 - RNA, 18 nt, Human
ugagaugccuucugcuga

SEQ ID NO: 523161 - RNA, 19 nt, Human
ugaucuuuuuuuuuuucag

SEQ ID NO: 523162 - RNA, 19 nt, Human
ugcagagccccccagaccc

SEQ ID NO: 523163 - RNA, 24 nt, Human
ugcagagucucccggcuaccacuc

SEQ ID NO: 523164 - RNA, 25 nt, Human
ugcagagucucccggcuaccacucc

SEQ ID NO: 523165 - RNA, 19 nt, Human
ugccaaaguggcuaugcca

SEQ ID NO: 523166 - RNA, 26 nt, Human
ugccaagcucccgggcuuuggggcag

SEQ ID NO: 523167 - RNA, 18 nt, Human
ugccagcggugagcugga

SEQ ID NO: 523168 - RNA, 18 nt, Human
ugccaggaggauguagaa

SEQ ID NO: 523169 - RNA, 23 nt, Human
ugcccagaauguguccuccucag

SEQ ID NO: 523170 - RNA, 18 nt, Human
uggaaccugggaggugcu

SEQ ID NO: 523171 - RNA, 24 nt, Human
uggaaguaagucacuugggaggga

SEQ ID NO: 523172 - RNA, 18 nt, Human
uggaauccugagaagccc

SEQ ID NO: 523173 - RNA, 19 nt, Human
uggaauccugagaagcccc

SEQ ID NO: 523174 - RNA, 21 nt, Human
uggaggccuccugggccaggg

SEQ ID NO: 523175 - RNA, 22 nt, Human
uggaggccuccugggccagggu

SEQ ID NO: 523176 - RNA, 20 nt, Human
uggccuuggcccuggggagg

SEQ ID NO: 523177 - RNA, 18 nt, Human
uggcucaggucccugcag

SEQ ID NO: 523178 - RNA, 22 nt, Human
uggcucaggucccugcaguagc

SEQ ID NO: 523179 - RNA, 23 nt, Human
uggcucaggucccugcaguagcc

SEQ ID NO: 523180 - RNA, 22 nt, Human
ugggaggugcucaguccauggu

SEQ ID NO: 523181 - RNA, 18 nt, Human
ugggcagcugcagagccc

SEQ ID NO: 523182 - RNA, 23 nt, Human
ugggcagcugcagagccccccag

SEQ ID NO: 523183 - RNA, 22 nt, Human
ugggcucuggggggucaguucc

SEQ ID NO: 523184 - RNA, 21 nt, Human
uggguaccaagggcagcugga

SEQ ID NO: 523185 - RNA, 20 nt, Human
ugucacguucccagcagacc

SEQ ID NO: 523186 - RNA, 23 nt, Human
ugugagccacugcccaacuggcu

SEQ ID NO: 523187 - RNA, 21 nt, Human
uucauccuccaagucuccagg

SEQ ID NO: 523188 - RNA, 18 nt, Human
uuccagucuggcccaggg

SEQ ID NO: 523189 - RNA, 18 nt, Human
uugggucuggcuucuuuc

SEQ ID NO: 523190 - RNA, 25 nt, Human
uugugagccacugcccaacuggcug

SEQ ID NO: 523191 - RNA, 24 nt, Human
uuucaugacaagagccauauccau

SEQ ID NO: 523192 - RNA, 24 nt, Human
aagagaaaugugucaugaaaagaa

SEQ ID NO: 523193 - RNA, 18 nt, Human
acaaacaagggacaccuc

SEQ ID NO: 523194 - RNA, 21 nt, Human
acaagaucuuccucaucgcca

SEQ ID NO: 523195 - RNA, 25 nt, Human
accaaaaucuucuguuaauuggcau

SEQ ID NO: 523196 - RNA, 20 nt, Human
accacacaaacaagggacaa

SEQ ID NO: 523197 - RNA, 20 nt, Human
accaugaaaccccuccgucu

SEQ ID NO: 523198 - RNA, 19 nt, Human
agcaagguguuaacaugua

SEQ ID NO: 523199 - RNA, 27 nt, Human
aggaagggcaacuuuuuuuuuucuuuu

SEQ ID NO: 523200 - RNA, 18 nt, Human
agguagucuaaggugaca

SEQ ID NO: 523201 - RNA, 23 nt, Human
auggaagaaaguuuaaauccaca

SEQ ID NO: 523202 - RNA, 22 nt, Human
auucaucuggcuuuaccacaca

SEQ ID NO: 523203 - RNA, 20 nt, Human
caaagccaagucuauccuuc

SEQ ID NO: 523204 - RNA, 19 nt, Human
caaaguaaaauuuugagga

SEQ ID NO: 523205 - RNA, 18 nt, Human
caacugcugagacaaauc

SEQ ID NO: 523206 - RNA, 29 nt, Human
caacuuuuuuuuuucuuuuuaauagagaa

SEQ ID NO: 523207 - RNA, 22 nt, Human
caagagugcugcaauuugcuga

SEQ ID NO: 523208 - RNA, 20 nt, Human
caauucugaagaauuacaaa

SEQ ID NO: 523209 - RNA, 18 nt, Human
cacauacacugcaaacca

SEQ ID NO: 523210 - RNA, 24 nt, Human
cacuucucacuuggaaugcugagu

SEQ ID NO: 523211 - RNA, 20 nt, Human
ccaagucuauccuucuccuu

SEQ ID NO: 523212 - RNA, 23 nt, Human
ccaaugccccacugggcucuuag

SEQ ID NO: 523213 - RNA, 23 nt, Human
ccacacaaacaagggacaccuca

SEQ ID NO: 523214 - RNA, 18 nt, Human
ccacugggcucuuaguug

SEQ ID NO: 523215 - RNA, 20 nt, Human
ccucagcuggaacaacauuc

SEQ ID NO: 523216 - RNA, 19 nt, Human
ccuuucuuucucuugcuga

SEQ ID NO: 523217 - RNA, 19 nt, Human
cgauaacaaacaucacuaa

SEQ ID NO: 523218 - RNA, 18 nt, Human
cucaucgccagcauucaa

SEQ ID NO: 523219 - RNA, 19 nt, Human
cucccaccaaaaucuucug

SEQ ID NO: 523220 - RNA, 22 nt, Human
cucuagccuuacacuucucacu

SEQ ID NO: 523221 - RNA, 19 nt, Human
cugaagaauuacaaaguaa

SEQ ID NO: 523222 - RNA, 24 nt, Human
cuguugaaucucuucuaacugugu

SEQ ID NO: 523223 - RNA, 21 nt, Human
gaaaccccuccgucugagcca

SEQ ID NO: 523224 - RNA, 21 nt, Human
gccaagucuauccuucuccuu

SEQ ID NO: 523225 - RNA, 23 nt, Human
ggaagaaaguuuaaauccacaga

SEQ ID NO: 523226 - RNA, 24 nt, Human
ggaucaaccgauggaagaaaguuu

SEQ ID NO: 523227 - RNA, 18 nt, Human
gugcuggcucucaaucuc

SEQ ID NO: 523228 - RNA, 22 nt, Human
uaaaauaaccucaaagccaagu

SEQ ID NO: 523229 - RNA, 23 nt, Human
uaaacuucucaaaaaccagccuc

SEQ ID NO: 523230 - RNA, 25 nt, Human
uaaagcuuuaaagcaaguuuucagu

SEQ ID NO: 523231 - RNA, 24 nt, Human
uaacaaacaucacuaaguuguugc

SEQ ID NO: 523232 - RNA, 18 nt, Human
uaaggugacacucagcuc

SEQ ID NO: 523233 - RNA, 19 nt, Human
uaauaagccauccaacugc

SEQ ID NO: 523234 - RNA, 23 nt, Human
uaccacacaaacaagggacaccu

SEQ ID NO: 523235 - RNA, 24 nt, Human
uaccacacaaacaagggacaccuc

SEQ ID NO: 523236 - RNA, 19 nt, Human
uaucaaagaucugaaaggc

SEQ ID NO: 523237 - RNA, 21 nt, Human
uaucaaagaucugaaaggcuu

SEQ ID NO: 523238 - RNA, 22 nt, Human
ucaucuggcuuuaccacacaaa

SEQ ID NO: 523239 - RNA, 18 nt, Human
uccaaaaacaaaaaugcg

SEQ ID NO: 523240 - RNA, 19 nt, Human
uccacaagaucuuccucau

SEQ ID NO: 523241 - RNA, 21 nt, Human
uccacaagaucuuccucaucg

SEQ ID NO: 523242 - RNA, 19 nt, Human
uccacaaucacgguaaauc

SEQ ID NO: 523243 - RNA, 23 nt, Human
ucccaccaaaaucuucuguuaau

SEQ ID NO: 523244 - RNA, 21 nt, Human
ucuauccuucuccuuccaaaa

SEQ ID NO: 523245 - RNA, 22 nt, Human
ucugaagaacuguuucaggauc

SEQ ID NO: 523246 - RNA, 23 nt, Human
ucuucuaacugugugcgcuugcu

SEQ ID NO: 523247 - RNA, 18 nt, Human
ugaaaagaaaugagacuu

SEQ ID NO: 523248 - RNA, 22 nt, Human
ugaaaagaaaugagacuuauuu

SEQ ID NO: 523249 - RNA, 19 nt, Human
ugaaaugcaucuuaaggug

SEQ ID NO: 523250 - RNA, 18 nt, Human
ugaagaacuguuucagga

SEQ ID NO: 523251 - RNA, 22 nt, Human
ugcaauguuuauaguuccuucu

SEQ ID NO: 523252 - RNA, 19 nt, Human
uggaacaacauucuguagc

SEQ ID NO: 523253 - RNA, 20 nt, Human
uggaggaagggcaacuuuuu

SEQ ID NO: 523254 - RNA, 22 nt, Human
uggaggaagggcaacuuuuuuu

SEQ ID NO: 523255 - RNA, 21 nt, Human
ugucaugaaaagaaaugagac

SEQ ID NO: 523256 - RNA, 22 nt, Human
ugucugaagaacuguuucagga

SEQ ID NO: 523257 - RNA, 20 nt, Human
uuccacauacacugcaaacc

SEQ ID NO: 523258 - RNA, 22 nt, Human
uuggcggacacuaaaauaaccu

SEQ ID NO: 523259 - RNA, 23 nt, Human
uugggcaacaccaugaaauucaa

SEQ ID NO: 523260 - RNA, 21 nt, Human
uugguaguagcaagguguuuu

SEQ ID NO: 523261 - RNA, 23 nt, Human
uuuguaaacuucucaaaaaccag

SEQ ID NO: 523262 - RNA, 22 nt, Human
aaaaaccucagacuaaacagac

SEQ ID NO: 523263 - RNA, 19 nt, Human
aaaaagcaaaacaacuuuc

SEQ ID NO: 523264 - RNA, 19 nt, Human
aaaacagaaaaucucaaac

SEQ ID NO: 523265 - RNA, 26 nt, Human
aaacaaaaagcaaaacaacuuucaga

SEQ ID NO: 523266 - RNA, 22 nt, Human
aaacaagauacagacuaguccc

SEQ ID NO: 523267 - RNA, 24 nt, Human
aaacaagauacagacuagucccaa

SEQ ID NO: 523268 - RNA, 26 nt, Human
aaacaagauacagacuagucccaaag

SEQ ID NO: 523269 - RNA, 21 nt, Human
aaacagaaaaucucaaacaau

SEQ ID NO: 523270 - RNA, 20 nt, Human
aaagcaaaacaacuuucaga

SEQ ID NO: 523271 - RNA, 25 nt, Human
aaaugauagaaguucugugagaacu

SEQ ID NO: 523272 - RNA, 21 nt, Human
aacagaaaaucucaaacaauc

SEQ ID NO: 523273 - RNA, 24 nt, Human
aacuucccacacgggggacacacc

SEQ ID NO: 523274 - RNA, 21 nt, Human
aagaaaaauagggauuagccg

SEQ ID NO: 523275 - RNA, 19 nt, Human
aagaagccagagacaggag

SEQ ID NO: 523276 - RNA, 20 nt, Human
aagccuacaaucuaacuaag

SEQ ID NO: 523277 - RNA, 23 nt, Human
aaggagcccuaccucucaagagu

SEQ ID NO: 523278 - RNA, 18 nt, Human
aaggggaaaacaaaaagc

SEQ ID NO: 523279 - RNA, 21 nt, Human
acacacacacagacacacaca

SEQ ID NO: 523280 - RNA, 27 nt, Human
acacgcagacaagaucucucucucaca

SEQ ID NO: 523281 - RNA, 19 nt, Human
acaucacagucagcugccu

SEQ ID NO: 523282 - RNA, 22 nt, Human
acuaaaacacaagagccucaca

SEQ ID NO: 523283 - RNA, 25 nt, Human
acuuaaaaaacaagauacagacuag

SEQ ID NO: 523284 - RNA, 21 nt, Human
acuugcugucucuccucucca

SEQ ID NO: 523285 - RNA, 21 nt, Human
acuugcugucucuccucucca

SEQ ID NO: 523286 - RNA, 19 nt, Human
agaaagucugagagcaacc

SEQ ID NO: 523287 - RNA, 20 nt, Human
agacacacacagcucccaaa

SEQ ID NO: 523288 - RNA, 19 nt, Human
agacuuaaaaaacaagaua

SEQ ID NO: 523289 - RNA, 20 nt, Human
agagagaagcuaggaugggg

SEQ ID NO: 523290 - RNA, 20 nt, Human
agauaaacccccugcucacc

SEQ ID NO: 523291 - RNA, 22 nt, Human
agauacagacuagucccaaagc

SEQ ID NO: 523292 - RNA, 23 nt, Human
agaugugagggugggaaggggaa

SEQ ID NO: 523293 - RNA, 23 nt, Human
agcuggacucugugaauaaaguu

SEQ ID NO: 523294 - RNA, 22 nt, Human
aggaaaaaaaaaaucaaaagaa

SEQ ID NO: 523295 - RNA, 18 nt, Human
agggguguggcuacuggc

SEQ ID NO: 523296 - RNA, 24 nt, Human
aggugggaagacagguagggcugg

SEQ ID NO: 523297 - RNA, 19 nt, Human
aguguuguuagacuuaaaa

SEQ ID NO: 523298 - RNA, 19 nt, Human
auaaaggagcccuaccucu

SEQ ID NO: 523299 - RNA, 18 nt, Human
auaguacaaaacauccua

SEQ ID NO: 523300 - RNA, 18 nt, Human
aucacagucagcugccug

SEQ ID NO: 523301 - RNA, 24 nt, Human
aucucucucucacacacacacaga

SEQ ID NO: 523302 - RNA, 24 nt, Human
augaagccuuuuguagccucugga

SEQ ID NO: 523303 - RNA, 20 nt, Human
auggcagagaggauucuccu

SEQ ID NO: 523304 - RNA, 23 nt, Human
cacacacacacacgcagacaaga

SEQ ID NO: 523305 - RNA, 18 nt, Human
cacacagacacacacagc

SEQ ID NO: 523306 - RNA, 21 nt, Human
cacacagacacacacagcucc

SEQ ID NO: 523307 - RNA, 22 nt, Human
cacacagcucccaaacuuucac

SEQ ID NO: 523308 - RNA, 22 nt, Human
cacacaguaccuacaggcacac

SEQ ID NO: 523309 - RNA, 22 nt, Human
cacacaguaccuacaggcacac

SEQ ID NO: 523310 - RNA, 23 nt, Human
cacacaugaagcacucacuacac

SEQ ID NO: 523311 - RNA, 26 nt, Human
cacagauaaacccccugcucaccccc

SEQ ID NO: 523312 - RNA, 27 nt, Human
cacagauaaacccccugcucacccccc

SEQ ID NO: 523313 - RNA, 23 nt, Human
cacaguaccuacaggcacacaag

SEQ ID NO: 523314 - RNA, 27 nt, Human
cacuacacacagauaaacccccugcuc

SEQ ID NO: 523315 - RNA, 22 nt, Human
cagaaagucugagagcaaccau

SEQ ID NO: 523316 - RNA, 22 nt, Human
cagacacacacagcucccaaac

SEQ ID NO: 523317 - RNA, 23 nt, Human
cagcuccucagucaccuuccccu

SEQ ID NO: 523318 - RNA, 19 nt, Human
caggcacacaagaucacac

SEQ ID NO: 523319 - RNA, 18 nt, Human
caggccccuuaaaaccag

SEQ ID NO: 523320 - RNA, 18 nt, Human
caggccccuuaaaaccag

SEQ ID NO: 523321 - RNA, 20 nt, Human
caggucuugaggggaaggag

SEQ ID NO: 523322 - RNA, 22 nt, Human
caucucagggcuaagccaacag

SEQ ID NO: 523323 - RNA, 18 nt, Human
caugauguguaaaaauca

SEQ ID NO: 523324 - RNA, 20 nt, Human
cauuucagccugaagaagcc

SEQ ID NO: 523325 - RNA, 21 nt, Human
ccaccuucuuagacuuaaccc

SEQ ID NO: 523326 - RNA, 22 nt, Human
ccccaagucccacugcaguaag

SEQ ID NO: 523327 - RNA, 18 nt, Human
ccuaaacuauaggcaaac

SEQ ID NO: 523328 - RNA, 21 nt, Human
ccucuggagcugcaccuggau

SEQ ID NO: 523329 - RNA, 26 nt, Human
ccuguaguuuaauaauagaaaaaaaa

SEQ ID NO: 523330 - RNA, 19 nt, Human
cgaaaugcuucagccccuc

SEQ ID NO: 523331 - RNA, 23 nt, Human
cuacaggcacacaagaucacaca

SEQ ID NO: 523332 - RNA, 23 nt, Human
cucacacacacacagacacacac

SEQ ID NO: 523333 - RNA, 25 nt, Human
cugccugcaaguuuaaaaaccucag

SEQ ID NO: 523334 - RNA, 24 nt, Human
cuggauggugagucugauguuuua

SEQ ID NO: 523335 - RNA, 25 nt, Human
cuuagacuuaacccaauuuagaaaa

SEQ ID NO: 523336 - RNA, 22 nt, Human
cuucaccauucccuuuagauuc

SEQ ID NO: 523337 - RNA, 21 nt, Human
cuugagacucccagcuccagg

SEQ ID NO: 523338 - RNA, 21 nt, Human
gaaaauaauagcaaaacccac

SEQ ID NO: 523339 - RNA, 24 nt, Human
gaagacagguagggcuggaucacu

SEQ ID NO: 523340 - RNA, 18 nt, Human
gacuugcugucucuccuc

SEQ ID NO: 523341 - RNA, 21 nt, Human
gacuugcugucucuccucucc

SEQ ID NO: 523342 - RNA, 19 nt, Human
gauguuuuagggguguggc

SEQ ID NO: 523343 - RNA, 19 nt, Human
gcagacuugagacucccag

SEQ ID NO: 523344 - RNA, 19 nt, Human
gcucacccccaccuucuua

SEQ ID NO: 523345 - RNA, 24 nt, Human
ggcaaacuuugguguucccacuaa

SEQ ID NO: 523346 - RNA, 23 nt, Human
gggaagacagguagggcuggauc

SEQ ID NO: 523347 - RNA, 23 nt, Human
gggaaggagagagaagcuaggau

SEQ ID NO: 523348 - RNA, 24 nt, Human
gggacacacaggugggaagacagg

SEQ ID NO: 523349 - RNA, 22 nt, Human
guccuggcaugggaggccccag

SEQ ID NO: 523350 - RNA, 23 nt, Human
uaaaaacagaaaaucucaaacaa

SEQ ID NO: 523351 - RNA, 22 nt, Human
uaaaaaccucagacuaaacaga

SEQ ID NO: 523352 - RNA, 21 nt, Human
uaaaagaucuauagcauccag

SEQ ID NO: 523353 - RNA, 21 nt, Human
uaacuaaaaagauuuucccag

SEQ ID NO: 523354 - RNA, 18 nt, Human
uaagaaaucuacagccug

SEQ ID NO: 523355 - RNA, 22 nt, Human
uaauuucagugacacacaguac

SEQ ID NO: 523356 - RNA, 19 nt, Human
uacaaaacauccuacugaa

SEQ ID NO: 523357 - RNA, 31 nt, Human
uacaggcacacaagaucacacacacacacgg

SEQ ID NO: 523358 - RNA, 20 nt, Human
uagccucuggagcugcaccu

SEQ ID NO: 523359 - RNA, 22 nt, Human
uaggguggacuugcugucucuc

SEQ ID NO: 523360 - RNA, 23 nt, Human
ucaaacaaucaaacgcauuaccc

SEQ ID NO: 523361 - RNA, 18 nt, Human
ucaaccccaagucccacu

SEQ ID NO: 523362 - RNA, 21 nt, Human
ucaagggaggaacagacaaau

SEQ ID NO: 523363 - RNA, 25 nt, Human
ucacacaauuaggaaaaaaaaaauc

SEQ ID NO: 523364 - RNA, 24 nt, Human
ucacccccaccuucuuagacuuaa

SEQ ID NO: 523365 - RNA, 20 nt, Human
ucagccccucagucaguuuc

SEQ ID NO: 523366 - RNA, 21 nt, Human
ucagggcuaagccaacagagu

SEQ ID NO: 523367 - RNA, 24 nt, Human
ucaguuucagcuccucagucaccu

SEQ ID NO: 523368 - RNA, 21 nt, Human
uccaauuucccuucuuacacc

SEQ ID NO: 523369 - RNA, 19 nt, Human
uccacacaugaagcacuca

SEQ ID NO: 523370 - RNA, 21 nt, Human
ucccaaacuuucacagaaagu

SEQ ID NO: 523371 - RNA, 18 nt, Human
ucugagagcaaccaugua

SEQ ID NO: 523372 - RNA, 26 nt, Human
ucugucuccuccugauccuuucuccu

SEQ ID NO: 523373 - RNA, 18 nt, Human
ugagaauuccagaaccug

SEQ ID NO: 523374 - RNA, 19 nt, Human
ugagggugggaaggggaag

SEQ ID NO: 523375 - RNA, 21 nt, Human
ugccuaaacuauaggcaaacu

SEQ ID NO: 523376 - RNA, 23 nt, Human
ugcuucagccccucagucaguuu

SEQ ID NO: 523377 - RNA, 25 nt, Human
ugcuucagccccucagucaguuuca

SEQ ID NO: 523378 - RNA, 18 nt, Human
uggauggugagucugaug

SEQ ID NO: 523379 - RNA, 20 nt, Human
uggcagagaggauucuccuc

SEQ ID NO: 523380 - RNA, 19 nt, Human
uggcuaagcagaugugagg

SEQ ID NO: 523381 - RNA, 24 nt, Human
ugggagaacaaguuaaaaaacugg

SEQ ID NO: 523382 - RNA, 23 nt, Human
ugggauguugacagaaaagcaga

SEQ ID NO: 523383 - RNA, 23 nt, Human
ugggugggaacagcuguuaucuu

SEQ ID NO: 523384 - RNA, 20 nt, Human
ugucucuccucuccaguagc

SEQ ID NO: 523385 - RNA, 25 nt, Human
ugucucuccucuccaguagcccccc

SEQ ID NO: 523386 - RNA, 20 nt, Human
uguguaaaaaucagggaaca

SEQ ID NO: 523387 - RNA, 22 nt, Human
uguguaaaaaucagggaacaag

SEQ ID NO: 523388 - RNA, 21 nt, Human
ugugucacuuaaagaaaaaua

SEQ ID NO: 523389 - RNA, 22 nt, Human
uucacagaaagucugagagcaa

SEQ ID NO: 523390 - RNA, 22 nt, Human
uugagacucccagcuccaggcc

SEQ ID NO: 523391 - RNA, 22 nt, Human
uugauuaccaaaggggaaaaca

SEQ ID NO: 523392 - RNA, 23 nt, Human
uuuagaaaauaauagcaaaaccc

SEQ ID NO: 523393 - RNA, 20 nt, Human
uuuguagccucuggagcugc

SEQ ID NO: 523394 - RNA, 21 nt, Human
aaaaggcacaaugauggggca

SEQ ID NO: 523395 - RNA, 18 nt, Human
aaagaugcccccugcucc

SEQ ID NO: 523396 - RNA, 18 nt, Human
aacccaaaaggcacaaug

SEQ ID NO: 523397 - RNA, 18 nt, Human
aagagaccccaggccagc

SEQ ID NO: 523398 - RNA, 19 nt, Human
aagggccucugcccugcug

SEQ ID NO: 523399 - RNA, 25 nt, Human
acaaugauggggcaagugaugcugu

SEQ ID NO: 523400 - RNA, 18 nt, Human
acaccccauacaccaaau

SEQ ID NO: 523401 - RNA, 18 nt, Human
acagccucucuccagcca

SEQ ID NO: 523402 - RNA, 18 nt, Human
acauuccuuuuguggugg

SEQ ID NO: 523403 - RNA, 28 nt, Human
acccuccugccuccccuugccaggcccu

SEQ ID NO: 523404 - RNA, 21 nt, Human
agagggagaagcccccaguca

SEQ ID NO: 523405 - RNA, 24 nt, Human
agagggcccuggagcacacagacc

SEQ ID NO: 523406 - RNA, 24 nt, Human
agagggccuggaugugguggcggg

SEQ ID NO: 523407 - RNA, 18 nt, Human
agcaacccaaaaggcaca

SEQ ID NO: 523408 - RNA, 20 nt, Human
agcagcagaagcuccuugga

SEQ ID NO: 523409 - RNA, 20 nt, Human
agccgguuccccccggcugu

SEQ ID NO: 523410 - RNA, 19 nt, Human
agcuccuuggaagggcagc

SEQ ID NO: 523411 - RNA, 21 nt, Human
aggcaauaccgguuccugggc

SEQ ID NO: 523412 - RNA, 24 nt, Human
aggcacucaguuggguaggaggca

SEQ ID NO: 523413 - RNA, 24 nt, Human
aggcaggugggcauggggccacug

SEQ ID NO: 523414 - RNA, 19 nt, Human
aggcccuggggcuugggga

SEQ ID NO: 523415 - RNA, 22 nt, Human
agggccuggaugugguggcggg

SEQ ID NO: 523416 - RNA, 25 nt, Human
agggccuggaugugguggcgggggg

SEQ ID NO: 523417 - RNA, 21 nt, Human
aggggcugcaggggcuggggg

SEQ ID NO: 523418 - RNA, 19 nt, Human
agguaguggggagguccag

SEQ ID NO: 523419 - RNA, 23 nt, Human
agguggggggaggggggcaaugg

SEQ ID NO: 523420 - RNA, 20 nt, Human
aggugugggcugaggcagga

SEQ ID NO: 523421 - RNA, 20 nt, Human
aguagguggggggagggggg

SEQ ID NO: 523422 - RNA, 23 nt, Human
aguagguugguggcagggaccca

SEQ ID NO: 523423 - RNA, 21 nt, Human
aguggagggucaggcaggugg

SEQ ID NO: 523424 - RNA, 22 nt, Human
aucccagaggcagaagccgguu

SEQ ID NO: 523425 - RNA, 21 nt, Human
auggaaccuucuccacaugcu

SEQ ID NO: 523426 - RNA, 20 nt, Human
auuuccccuuuauuccuagc

SEQ ID NO: 523427 - RNA, 20 nt, Human
cacaauuucucaccugcggu

SEQ ID NO: 523428 - RNA, 22 nt, Human
cacacccccucccccccgaccg

SEQ ID NO: 523429 - RNA, 18 nt, Human
caccacaccccuggcagg

SEQ ID NO: 523430 - RNA, 18 nt, Human
cacccccucccccccgac

SEQ ID NO: 523431 - RNA, 19 nt, Human
cacccccucccccccgacc

SEQ ID NO: 523432 - RNA, 25 nt, Human
cacuuugcuuccaggggcaguggag

SEQ ID NO: 523433 - RNA, 21 nt, Human
cacuuuguguuacccagcaag

SEQ ID NO: 523434 - RNA, 18 nt, Human
cagaguggugaugacccc

SEQ ID NO: 523435 - RNA, 24 nt, Human
cagcaaagaagagaccccaggcca

SEQ ID NO: 523436 - RNA, 18 nt, Human
caggcuccuucagcacug

SEQ ID NO: 523437 - RNA, 21 nt, Human
cagggacccagaccuuugggg

SEQ ID NO: 523438 - RNA, 18 nt, Human
caugcucaccaccuucuc

SEQ ID NO: 523439 - RNA, 23 nt, Human
ccaaaaggcacaaugauggggca

SEQ ID NO: 523440 - RNA, 24 nt, Human
ccacuggcccuucucauguccucc

SEQ ID NO: 523441 - RNA, 18 nt, Human
ccagccaacccaagcucu

SEQ ID NO: 523442 - RNA, 21 nt, Human
ccagcuucuggugugaccccc

SEQ ID NO: 523443 - RNA, 22 nt, Human
ccaggacuuuucccauaugugg

SEQ ID NO: 523444 - RNA, 23 nt, Human
ccaggcccacacuggaggccgcu

SEQ ID NO: 523445 - RNA, 21 nt, Human
ccaguggaggccucagguccc

SEQ ID NO: 523446 - RNA, 20 nt, Human
ccaugaauucggcuucuguc

SEQ ID NO: 523447 - RNA, 23 nt, Human
ccaugcagggaacccugugauga

SEQ ID NO: 523448 - RNA, 20 nt, Human
cccauauguggcuuccacag

SEQ ID NO: 523449 - RNA, 24 nt, Human
cccaugcagggaacccugugauga

SEQ ID NO: 523450 - RNA, 19 nt, Human
cccauucagcuuggcuugu

SEQ ID NO: 523451 - RNA, 18 nt, Human
ccccacaccccauacacc

SEQ ID NO: 523452 - RNA, 20 nt, Human
ccccacaccccauacaccaa

SEQ ID NO: 523453 - RNA, 24 nt, Human
ccccacaccccauacaccaaauac

SEQ ID NO: 523454 - RNA, 19 nt, Human
cccccacaccccauacacc

SEQ ID NO: 523455 - RNA, 21 nt, Human
cccccacaccccauacaccaa

SEQ ID NO: 523456 - RNA, 22 nt, Human
ccccccacaccccauacaccaa

SEQ ID NO: 523457 - RNA, 19 nt, Human
ccccccgaccgggggcccc

SEQ ID NO: 523458 - RNA, 20 nt, Human
ccccuugccaggcccucccc

SEQ ID NO: 523459 - RNA, 21 nt, Human
cccugugaugaggugguccuc

SEQ ID NO: 523460 - RNA, 20 nt, Human
cccuucccaggcuccuucag

SEQ ID NO: 523461 - RNA, 26 nt, Human
ccggcuguggcaaaggugcugagugu

SEQ ID NO: 523462 - RNA, 19 nt, Human
ccggggcuccagccaccuc

SEQ ID NO: 523463 - RNA, 18 nt, Human
ccucccccccgaccgggg

SEQ ID NO: 523464 - RNA, 20 nt, Human
ccuccuggaggcucuaggca

SEQ ID NO: 523465 - RNA, 19 nt, Human
ccugcggugaagcuuggag

SEQ ID NO: 523466 - RNA, 21 nt, Human
ccuggagcuggccaccucccc

SEQ ID NO: 523467 - RNA, 19 nt, Human
ccuucagcacugccgagca

SEQ ID NO: 523468 - RNA, 23 nt, Human
ccuuguugguuggugaaauucca

SEQ ID NO: 523469 - RNA, 21 nt, Human
cgaccgggggccccagaggac

SEQ ID NO: 523470 - RNA, 21 nt, Human
cgccaguggaggccucagguc

SEQ ID NO: 523471 - RNA, 21 nt, Human
cggcagccuccuucugucucc

SEQ ID NO: 523472 - RNA, 21 nt, Human
cggcuucugucgucucacccc

SEQ ID NO: 523473 - RNA, 21 nt, Human
cgggggccggccuucaguagg

SEQ ID NO: 523474 - RNA, 22 nt, Human
cgguuccugggcggcagcuccu

SEQ ID NO: 523475 - RNA, 20 nt, Human
cguggccuuccccuccacca

SEQ ID NO: 523476 - RNA, 21 nt, Human
cugccgagcacccccaguucc

SEQ ID NO: 523477 - RNA, 18 nt, Human
cugccuccccuugccagg

SEQ ID NO: 523478 - RNA, 21 nt, Human
cuggaaagacacccucaugcc

SEQ ID NO: 523479 - RNA, 18 nt, Human
cugucgucucaccccacu

SEQ ID NO: 523480 - RNA, 19 nt, Human
gaaagacagccucucucca

SEQ ID NO: 523481 - RNA, 21 nt, Human
gaaccuucuccacaugcucac

SEQ ID NO: 523482 - RNA, 19 nt, Human
gacugcaggggaggaaugg

SEQ ID NO: 523483 - RNA, 20 nt, Human
gagcagcagcagaagcuccu

SEQ ID NO: 523484 - RNA, 24 nt, Human
gagcuggccaccuccccaucaugu

SEQ ID NO: 523485 - RNA, 25 nt, Human
gagcuucuggggcuaggauggggca

SEQ ID NO: 523486 - RNA, 24 nt, Human
gaggcuaaaagaugcccccugcuc

SEQ ID NO: 523487 - RNA, 18 nt, Human
gcagaggagugggauggc

SEQ ID NO: 523488 - RNA, 25 nt, Human
gccaccuccccaucaugugccaagc

SEQ ID NO: 523489 - RNA, 22 nt, Human
gcccugggaggacagccuugcu

SEQ ID NO: 523490 - RNA, 22 nt, Human
gccuggggccuggugcaggugc

SEQ ID NO: 523491 - RNA, 23 nt, Human
gcuaugcuguaacagcguacuuu

SEQ ID NO: 523492 - RNA, 19 nt, Human
gcucaccaccuucucucag

SEQ ID NO: 523493 - RNA, 23 nt, Human
ggagaagaccccccuuccaugaa

SEQ ID NO: 523494 - RNA, 21 nt, Human
ggaggaaggguccuacuuggg

SEQ ID NO: 523495 - RNA, 18 nt, Human
ggaggacagccuugcuuc

SEQ ID NO: 523496 - RNA, 21 nt, Human
ggagguaguggggagguccag

SEQ ID NO: 523497 - RNA, 18 nt, Human
ggauggaguggggugggg

SEQ ID NO: 523498 - RNA, 21 nt, Human
ggcaaaggugcugagugucac

SEQ ID NO: 523499 - RNA, 20 nt, Human
ggcagggacaaggucuaggu

SEQ ID NO: 523500 - RNA, 18 nt, Human
ggcaguagguggggggag

SEQ ID NO: 523501 - RNA, 20 nt, Human
ggccacuggaggccugagga

SEQ ID NO: 523502 - RNA, 22 nt, Human
ggcuaggauggggcaaaggugg

SEQ ID NO: 523503 - RNA, 19 nt, Human
ggcuccuucagcacugccg

SEQ ID NO: 523504 - RNA, 21 nt, Human
ggcugggggcaggggccaggg

SEQ ID NO: 523505 - RNA, 18 nt, Human
gggaacccugugaugagg

SEQ ID NO: 523506 - RNA, 20 nt, Human
gggaccuggguguguagggg

SEQ ID NO: 523507 - RNA, 22 nt, Human
gggaggaaggguccuacuuggg

SEQ ID NO: 523508 - RNA, 19 nt, Human
gggcagggccuggagcugg

SEQ ID NO: 523509 - RNA, 19 nt, Human
gggcauggggccacuggag

SEQ ID NO: 523510 - RNA, 21 nt, Human
gggccggggcugggaggagga

SEQ ID NO: 523511 - RNA, 23 nt, Human
gggccggggcugggaggaggagc

SEQ ID NO: 523512 - RNA, 18 nt, Human
gggccugugggaccuggg

SEQ ID NO: 523513 - RNA, 19 nt, Human
ggggagggggcugaagagg

SEQ ID NO: 523514 - RNA, 21 nt, Human
gggggcaggggccagggagcu

SEQ ID NO: 523515 - RNA, 20 nt, Human
gggguggggcggcugggaag

SEQ ID NO: 523516 - RNA, 24 nt, Human
ggucaggcaggugggcauggggcc

SEQ ID NO: 523517 - RNA, 18 nt, Human
ggugaggcaggugugggc

SEQ ID NO: 523518 - RNA, 23 nt, Human
ggugauuugguggauggaguggg

SEQ ID NO: 523519 - RNA, 19 nt, Human
gguggauggaguggggugg

SEQ ID NO: 523520 - RNA, 19 nt, Human
guaacagcguacuuucccc

SEQ ID NO: 523521 - RNA, 22 nt, Human
guggccaagguuagcccacacc

SEQ ID NO: 523522 - RNA, 18 nt, Human
guggggggaggggggcaa

SEQ ID NO: 523523 - RNA, 21 nt, Human
gugggguggggcggcugggaa

SEQ ID NO: 523524 - RNA, 22 nt, Human
uaaaagaugcccccugcuccac

SEQ ID NO: 523525 - RNA, 18 nt, Human
uaccgguuccugggcggc

SEQ ID NO: 523526 - RNA, 18 nt, Human
uauccucccaucccuucc

SEQ ID NO: 523527 - RNA, 20 nt, Human
ucaaggcagggugcaggggc

SEQ ID NO: 523528 - RNA, 24 nt, Human
uccaucuuggucccaggaagggac

SEQ ID NO: 523529 - RNA, 23 nt, Human
ucccagaggcagaagccgguucc

SEQ ID NO: 523530 - RNA, 22 nt, Human
ucccagaggcagaagccgguuu

SEQ ID NO: 523531 - RNA, 21 nt, Human
ucccuucccaggcuccuucag

SEQ ID NO: 523532 - RNA, 21 nt, Human
uccucccaucccuucccaggc

SEQ ID NO: 523533 - RNA, 22 nt, Human
uccucccaucccuucccaggcu

SEQ ID NO: 523534 - RNA, 24 nt, Human
uccuucagcacugccgagcacccc

SEQ ID NO: 523535 - RNA, 23 nt, Human
ucggaauucagcucccccagguc

SEQ ID NO: 523536 - RNA, 23 nt, Human
ucggcagccuccuucugucuccu

SEQ ID NO: 523537 - RNA, 23 nt, Human
ucuccagaaagggcuucucccug

SEQ ID NO: 523538 - RNA, 19 nt, Human
ucugccaggacuuuuccca

SEQ ID NO: 523539 - RNA, 18 nt, Human
ucuggaaagacacccuca

SEQ ID NO: 523540 - RNA, 21 nt, Human
ucugugccggggcuccagcca

SEQ ID NO: 523541 - RNA, 19 nt, Human
ucuuuaggcccuggggcuu

SEQ ID NO: 523542 - RNA, 25 nt, Human
ugaccccacagagccuucggcagcc

SEQ ID NO: 523543 - RNA, 23 nt, Human
ugaccccccacaccccauacacc

SEQ ID NO: 523544 - RNA, 19 nt, Human
ugagagcccaucccagagg

SEQ ID NO: 523545 - RNA, 21 nt, Human
ugagagggccuggauguggug

SEQ ID NO: 523546 - RNA, 18 nt, Human
ugaggagggccccuccug

SEQ ID NO: 523547 - RNA, 18 nt, Human
ugaggcaggaggugccug

SEQ ID NO: 523548 - RNA, 19 nt, Human
ugaggcaggugugggcuga

SEQ ID NO: 523549 - RNA, 19 nt, Human
ugagggcagaggagcagga

SEQ ID NO: 523550 - RNA, 21 nt, Human
ugauaggcacuuugcuuccag

SEQ ID NO: 523551 - RNA, 21 nt, Human
ugauuugguggauggaguggg

SEQ ID NO: 523552 - RNA, 18 nt, Human
ugcaggggcugggggcag

SEQ ID NO: 523553 - RNA, 22 nt, Human
ugccaggcccuccccugacccc

SEQ ID NO: 523554 - RNA, 19 nt, Human
ugcccugcugcuccugggg

SEQ ID NO: 523555 - RNA, 21 nt, Human
ugccgagcacccccaguucca

SEQ ID NO: 523556 - RNA, 18 nt, Human
ugccuggggccuggugca

SEQ ID NO: 523557 - RNA, 19 nt, Human
ugccuggggccuggugcag

SEQ ID NO: 523558 - RNA, 25 nt, Human
ugccuguauccucccaucccuuccc

SEQ ID NO: 523559 - RNA, 19 nt, Human
ugcugagugucaccaucac

SEQ ID NO: 523560 - RNA, 24 nt, Human
uggagcuucuggggcuaggauggg

SEQ ID NO: 523561 - RNA, 28 nt, Human
uggaggccgcuuggguggucgguagacc

SEQ ID NO: 523562 - RNA, 22 nt, Human
uggagugggguggggcggcugg

SEQ ID NO: 523563 - RNA, 23 nt, Human
uggaugucuccacugugggcuuc

SEQ ID NO: 523564 - RNA, 20 nt, Human
uggcaaaggugcugaguguc

SEQ ID NO: 523565 - RNA, 19 nt, Human
uggcagcccugggaggaca

SEQ ID NO: 523566 - RNA, 20 nt, Human
uggcagggacccagaccuuu

SEQ ID NO: 523567 - RNA, 21 nt, Human
uggcagggacccagaccuuug

SEQ ID NO: 523568 - RNA, 21 nt, Human
uggcuggggugguggaugucu

SEQ ID NO: 523569 - RNA, 21 nt, Human
uggcuuccacaguccggcagg

SEQ ID NO: 523570 - RNA, 18 nt, Human
ugggaggaggagcagcag

SEQ ID NO: 523571 - RNA, 18 nt, Human
ugggauggcaguaggugg

SEQ ID NO: 523572 - RNA, 24 nt, Human
ugggcggcagcuccuuccagaaag

SEQ ID NO: 523573 - RNA, 20 nt, Human
ugggcugaggcaggaggugg

SEQ ID NO: 523574 - RNA, 19 nt, Human
uggggagggggccuguggg

SEQ ID NO: 523575 - RNA, 22 nt, Human
uggggagggggccugugggacc

SEQ ID NO: 523576 - RNA, 23 nt, Human
uggggagggggccugugggaccu

SEQ ID NO: 523577 - RNA, 24 nt, Human
ugggggagggggcugaagagggcc

SEQ ID NO: 523578 - RNA, 22 nt, Human
ugggggcccaggcacucaguug

SEQ ID NO: 523579 - RNA, 25 nt, Human
uggguaggaggcaggagacgcuuuu

SEQ ID NO: 523580 - RNA, 22 nt, Human
uggguggucuucaaggcagggu

SEQ ID NO: 523581 - RNA, 19 nt, Human
uggucccaggaagggaccc

SEQ ID NO: 523582 - RNA, 27 nt, Human
ugguggcagggacccagaccuuugggg

SEQ ID NO: 523583 - RNA, 20 nt, Human
uggugguggccaagguuagc

SEQ ID NO: 523584 - RNA, 24 nt, Human
uguaggggccaggcuaggaccauu

SEQ ID NO: 523585 - RNA, 22 nt, Human
ugugaugaggugguccuccgug

SEQ ID NO: 523586 - RNA, 24 nt, Human
uguggcuuccacaguccggcaggg

SEQ ID NO: 523587 - RNA, 20 nt, Human
uucagcucccccaggucucu

SEQ ID NO: 523588 - RNA, 23 nt, Human
uucauugaggcccccacuggccc

SEQ ID NO: 523589 - RNA, 19 nt, Human
uuccccuuguugguuggug

SEQ ID NO: 523590 - RNA, 18 nt, Human
uuccugggcggcagcucc

SEQ ID NO: 523591 - RNA, 18 nt, Human
uucuccacaugcucacca

SEQ ID NO: 523592 - RNA, 22 nt, Human
uugguggauggagugggguggg

SEQ ID NO: 523593 - RNA, 19 nt, Human
uuguugguuggugaaauuc

SEQ ID NO: 523594 - RNA, 24 nt, Human
uuucccauauguggcuuccacagu

SEQ ID NO: 523595 - RNA, 20 nt, Human
uuuuguggugguggccaagg

SEQ ID NO: 523596 - RNA, 20 nt, Human
aacgcccgcacgcccaccuc

SEQ ID NO: 523597 - RNA, 20 nt, Human
acccuaucgaacgcccgcac

SEQ ID NO: 523598 - RNA, 24 nt, Human
accgcggcccccgcgugggcuccu

SEQ ID NO: 523599 - RNA, 20 nt, Human
cacccuaucgaacgcccgca

SEQ ID NO: 523600 - RNA, 23 nt, Human
ccaguccgcacccuaucgaacgc

SEQ ID NO: 523601 - RNA, 23 nt, Human
cccaggaggcauguccacgugcc

SEQ ID NO: 523602 - RNA, 24 nt, Human
ccccaggaggcauguccacgugcc

SEQ ID NO: 523603 - RNA, 23 nt, Human
ccgcacgcccaccuccugcuccu

SEQ ID NO: 523604 - RNA, 25 nt, Human
cgcuggccugggagaagugcugcac

SEQ ID NO: 523605 - RNA, 22 nt, Human
cuccagcccccuguuugccacc

SEQ ID NO: 523606 - RNA, 19 nt, Human
cucccaguccgcacccuau

SEQ ID NO: 523607 - RNA, 19 nt, Human
cuccugcuccuccggccac

SEQ ID NO: 523608 - RNA, 19 nt, Human
cucuccagcccccuguuug

SEQ ID NO: 523609 - RNA, 20 nt, Human
gagcggugcuggaccgcggc

SEQ ID NO: 523610 - RNA, 19 nt, Human
gaggcggagcugggcgggu

SEQ ID NO: 523611 - RNA, 22 nt, Human
ggccaggucaagcccgcuggcc

SEQ ID NO: 523612 - RNA, 20 nt, Human
gugcugcacgugcguggcga

SEQ ID NO: 523613 - RNA, 19 nt, Human
uacucccaguccgcacccu

SEQ ID NO: 523614 - RNA, 19 nt, Human
ucagguccuccaccuggcc

SEQ ID NO: 523615 - RNA, 22 nt, Human
uccugcuccuccggccacucua

SEQ ID NO: 523616 - RNA, 21 nt, Human
ucgaacgcccgcacgcccacc

SEQ ID NO: 523617 - RNA, 21 nt, Human
uggccugggagaagugcugca

SEQ ID NO: 523618 - RNA, 24 nt, Human
ugggcuccucgagccccuccccag

SEQ ID NO: 523619 - RNA, 21 nt, Human
uguuugccaccgaggcggagc

SEQ ID NO: 523620 - RNA, 24 nt, Human
uuuuuuuuuuuuuuuuccuccuga

SEQ ID NO: 523621 - RNA, 24 nt, Human
aaaaaaacaaaaaagaacaaaaaa

SEQ ID NO: 523622 - RNA, 20 nt, Human
aaaaaaaccaaaaaaaaaac

SEQ ID NO: 523623 - RNA, 24 nt, Human
aaaaaaccaaaaaaaaaacagugc

SEQ ID NO: 523624 - RNA, 25 nt, Human
aaaaacagugcaaaaacccauuuuc

SEQ ID NO: 523625 - RNA, 24 nt, Human
aaaaaccaaaaaaaaaacagugca

SEQ ID NO: 523626 - RNA, 23 nt, Human
aaaagaacaaaaaaaccaaaaaa

SEQ ID NO: 523627 - RNA, 26 nt, Human
aaagaacaaaaaaaccaaaaaaaaaa

SEQ ID NO: 523628 - RNA, 21 nt, Human
aaaggaaaaaaacaaaaaaga

SEQ ID NO: 523629 - RNA, 19 nt, Human
aacucccucugcaccccuc

SEQ ID NO: 523630 - RNA, 24 nt, Human
aacugugggguggaaaaaacggag

SEQ ID NO: 523631 - RNA, 21 nt, Human
aaggaaaaaaacaaaaaagaa

SEQ ID NO: 523632 - RNA, 24 nt, Human
aaggccagccgcccauagucccag

SEQ ID NO: 523633 - RNA, 21 nt, Human
aaugaaagcaggggcugggga

SEQ ID NO: 523634 - RNA, 21 nt, Human
accaggugcaccagguacucc

SEQ ID NO: 523635 - RNA, 22 nt, Human
acccccacccccaggccacccc

SEQ ID NO: 523636 - RNA, 21 nt, Human
acucagcacccccuccccccu

SEQ ID NO: 523637 - RNA, 22 nt, Human
agccuugcccacccccaccccc

SEQ ID NO: 523638 - RNA, 20 nt, Human
aggaaaaaaacaaaaaagaa

SEQ ID NO: 523639 - RNA, 23 nt, Human
aggaaaaaaacaaaaaagaacaa

SEQ ID NO: 523640 - RNA, 24 nt, Human
aggaaaaaaacaaaaaagaacaaa

SEQ ID NO: 523641 - RNA, 25 nt, Human
aggaaaaaaacaaaaaagaacaaaa

SEQ ID NO: 523642 - RNA, 18 nt, Human
aggaggaacuguggggug

SEQ ID NO: 523643 - RNA, 19 nt, Human
aggggcuggggaggaaggg

SEQ ID NO: 523644 - RNA, 24 nt, Human
caaaaaagaacaaaaaaaccaaaa

SEQ ID NO: 523645 - RNA, 18 nt, Human
cacccccacccccaggcc

SEQ ID NO: 523646 - RNA, 18 nt, Human
cagccaccggcaccaggu

SEQ ID NO: 523647 - RNA, 22 nt, Human
cagccccagauccaccugcccc

SEQ ID NO: 523648 - RNA, 20 nt, Human
caggaggaacuguggggugg

SEQ ID NO: 523649 - RNA, 23 nt, Human
cagugaaacccccaaguuuaaau

SEQ ID NO: 523650 - RNA, 18 nt, Human
cagugcaaaaacccauuu

SEQ ID NO: 523651 - RNA, 18 nt, Human
ccacacugucugcaucug

SEQ ID NO: 523652 - RNA, 24 nt, Human
ccagguacuccucuuggcucucau

SEQ ID NO: 523653 - RNA, 22 nt, Human
cccacccccaggccaccccagc

SEQ ID NO: 523654 - RNA, 23 nt, Human
ccccacccccaggccaccccagc

SEQ ID NO: 523655 - RNA, 20 nt, Human
cccccacccccaggccaccc

SEQ ID NO: 523656 - RNA, 18 nt, Human
ccccggggccggcucggg

SEQ ID NO: 523657 - RNA, 20 nt, Human
ccccggggccggcucggggc

SEQ ID NO: 523658 - RNA, 22 nt, Human
ccccggggccggcucggggcuc

SEQ ID NO: 523659 - RNA, 23 nt, Human
ccccucaugcauccccuaggggc

SEQ ID NO: 523660 - RNA, 18 nt, Human
ccuccagggccccucccu

SEQ ID NO: 523661 - RNA, 22 nt, Human
ccucccacucagcacccccucc

SEQ ID NO: 523662 - RNA, 18 nt, Human
cggcucggggcucuccuc

SEQ ID NO: 523663 - RNA, 18 nt, Human
cuacuagcuggggagggg

SEQ ID NO: 523664 - RNA, 21 nt, Human
cuccuggucaugcuacuagcu

SEQ ID NO: 523665 - RNA, 24 nt, Human
cugaagccacacugucugcaucug

SEQ ID NO: 523666 - RNA, 18 nt, Human
cugaucugggggaacucc

SEQ ID NO: 523667 - RNA, 18 nt, Human
cugcaccccucuuugccc

SEQ ID NO: 523668 - RNA, 19 nt, Human
cugcaccccucuuugcccc

SEQ ID NO: 523669 - RNA, 21 nt, Human
cugcaccccucuuugccccgg

SEQ ID NO: 523670 - RNA, 18 nt, Human
cugccccccaggucucca

SEQ ID NO: 523671 - RNA, 18 nt, Human
cuggggaggggugggggg

SEQ ID NO: 523672 - RNA, 23 nt, Human
cugucugcaucugucaccaaggc

SEQ ID NO: 523673 - RNA, 23 nt, Human
gaaaaaaacaaaaaagaacaaaa

SEQ ID NO: 523674 - RNA, 18 nt, Human
gagcuuuucuuuguuuuu

SEQ ID NO: 523675 - RNA, 25 nt, Human
gaggauagagaauaagaacagcagu

SEQ ID NO: 523676 - RNA, 21 nt, Human
gaggggggggaacagccccag

SEQ ID NO: 523677 - RNA, 20 nt, Human
gagugggggugggguggggc

SEQ ID NO: 523678 - RNA, 24 nt, Human
gcaccagguacuccucuuggcucu

SEQ ID NO: 523679 - RNA, 19 nt, Human
gcaggauguggccuccagg

SEQ ID NO: 523680 - RNA, 21 nt, Human
gccugacucuuccucccacuc

SEQ ID NO: 523681 - RNA, 22 nt, Human
gccuugcccacccccaccccca

SEQ ID NO: 523682 - RNA, 19 nt, Human
gcuggggaggaaggggcuu

SEQ ID NO: 523683 - RNA, 23 nt, Human
ggaaaaaaacaaaaaagaacaaa

SEQ ID NO: 523684 - RNA, 26 nt, Human
ggaaaaaacggaggggggggaacagc

SEQ ID NO: 523685 - RNA, 18 nt, Human
ggcuggggaggaaggggc

SEQ ID NO: 523686 - RNA, 22 nt, Human
gggagugggggugggguggggc

SEQ ID NO: 523687 - RNA, 19 nt, Human
gggcuggaggcuccacuuc

SEQ ID NO: 523688 - RNA, 18 nt, Human
gguggaaaaaacggaggg

SEQ ID NO: 523689 - RNA, 20 nt, Human
uaaaggaaaaaaacaaaaaa

SEQ ID NO: 523690 - RNA, 24 nt, Human
ucccacucagcacccccucccccc

SEQ ID NO: 523691 - RNA, 18 nt, Human
ucucauuaacccucuccu

SEQ ID NO: 523692 - RNA, 25 nt, Human
ugcccacccccacccccaggccacc

SEQ ID NO: 523693 - RNA, 20 nt, Human
uggaaaaaacggaggggggg

SEQ ID NO: 523694 - RNA, 22 nt, Human
uggccuccagggccccucccuc

SEQ ID NO: 523695 - RNA, 21 nt, Human
ugggggugggguggggcaggg

SEQ ID NO: 523696 - RNA, 27 nt, Human
ugggguggaaaaaacggagggggggga

SEQ ID NO: 523697 - RNA, 20 nt, Human
ugugggguggaaaaaacgga

SEQ ID NO: 523698 - RNA, 23 nt, Human
ugugggguggaaaaaacggaggg

SEQ ID NO: 523699 - RNA, 18 nt, Human
agaaugagggagacguga

SEQ ID NO: 523700 - RNA, 30 nt, Human
cuaaaaccaguucuugaaaaacuuuccacc

SEQ ID NO: 523701 - RNA, 23 nt, Human
uaaaaaauacuucagcuacucac

SEQ ID NO: 523702 - RNA, 21 nt, Human
ucuuaagaaugagggagacgu

SEQ ID NO: 523703 - RNA, 23 nt, Human
uucuacuguuaaucugcaucaug

SEQ ID NO: 523704 - RNA, 23 nt, Human
uuuuccauaauaccuaacaagaa

SEQ ID NO: 523705 - RNA, 19 nt, Human
uuuuuuuuuuuuuuuuuaa

SEQ ID NO: 523706 - RNA, 21 nt, Human
aaaaaacgaaaacaaccuccc

SEQ ID NO: 523707 - RNA, 26 nt, Human
aaaaagaaaaaacuuauugaauagaa

SEQ ID NO: 523708 - RNA, 22 nt, Human
aaaaagguagauggaaagagaa

SEQ ID NO: 523709 - RNA, 21 nt, Human
aaacaaagagagaguuuauga

SEQ ID NO: 523710 - RNA, 26 nt, Human
aaacaaccuccccaucccccaccaaa

SEQ ID NO: 523711 - RNA, 19 nt, Human
aaacaauguugggaacuga

SEQ ID NO: 523712 - RNA, 22 nt, Human
aaagcaauuuggggaaucuguc

SEQ ID NO: 523713 - RNA, 21 nt, Human
aaagugccugauaacuuaaaa

SEQ ID NO: 523714 - RNA, 21 nt, Human
aacaaccuccccaucccccac

SEQ ID NO: 523715 - RNA, 23 nt, Human
aacaaccuccccaucccccacca

SEQ ID NO: 523716 - RNA, 20 nt, Human
aagaagcauaaaucuaugcu

SEQ ID NO: 523717 - RNA, 31 nt, Human
aagacaaaaaaauccaaaaaacgaaaacaaa

SEQ ID NO: 523718 - RNA, 19 nt, Human
aagcaacaugauaccaaga

SEQ ID NO: 523719 - RNA, 18 nt, Human
aaggcacugcuaauacac

SEQ ID NO: 523720 - RNA, 26 nt, Human
aaggcauuauuauuuguucacugaca

SEQ ID NO: 523721 - RNA, 24 nt, Human
aagugauccgccugccuuagccuc

SEQ ID NO: 523722 - RNA, 18 nt, Human
aagugcugggauuugagc

SEQ ID NO: 523723 - RNA, 19 nt, Human
aaugcugguucuugaguaa

SEQ ID NO: 523724 - RNA, 24 nt, Human
aauguaaagauauuuaaaaucaaa

SEQ ID NO: 523725 - RNA, 21 nt, Human
acacccccugguauuccccca

SEQ ID NO: 523726 - RNA, 19 nt, Human
acacuuuuguuuaaaugaa

SEQ ID NO: 523727 - RNA, 24 nt, Human
acagauaguugacauuuuggacua

SEQ ID NO: 523728 - RNA, 18 nt, Human
acagcaggucuaaagacc

SEQ ID NO: 523729 - RNA, 19 nt, Human
acagggcuucaucauguug

SEQ ID NO: 523730 - RNA, 24 nt, Human
acagggcuucaucauguuggccag

SEQ ID NO: 523731 - RNA, 22 nt, Human
accaagguucaguagaggugac

SEQ ID NO: 523732 - RNA, 22 nt, Human
accacaaaaauacauucggagu

SEQ ID NO: 523733 - RNA, 22 nt, Human
accuccccaucccccaccaaac

SEQ ID NO: 523734 - RNA, 24 nt, Human
acgaaaacaaccuccccauccccc

SEQ ID NO: 523735 - RNA, 26 nt, Human
acgaaaacaaccuccccaucccccac

SEQ ID NO: 523736 - RNA, 22 nt, Human
acuguuuuucuucuuccaucug

SEQ ID NO: 523737 - RNA, 24 nt, Human
acuuaaguugcucaaaaaagaaaa

SEQ ID NO: 523738 - RNA, 23 nt, Human
agaaaccuauuuggccuggacaa

SEQ ID NO: 523739 - RNA, 23 nt, Human
agaagcgugacagaacuaacuug

SEQ ID NO: 523740 - RNA, 28 nt, Human
agacaaaaaaauccaaaaaacgaaaaca

SEQ ID NO: 523741 - RNA, 23 nt, Human
agacaaccacuauaaaaggucac

SEQ ID NO: 523742 - RNA, 23 nt, Human
agacaaccacuauaaacaguuau

SEQ ID NO: 523743 - RNA, 25 nt, Human
agacaggaaaggugcauaaugauaa

SEQ ID NO: 523744 - RNA, 18 nt, Human
agaccaaaaaguuugaaa

SEQ ID NO: 523745 - RNA, 26 nt, Human
agagagaacuuaaagcuaacuaugga

SEQ ID NO: 523746 - RNA, 22 nt, Human
agcacagcaucuauuacucaca

SEQ ID NO: 523747 - RNA, 18 nt, Human
agcagcuacagauaguug

SEQ ID NO: 523748 - RNA, 24 nt, Human
agccaaaagacaaaaaaagggacc

SEQ ID NO: 523749 - RNA, 21 nt, Human
agccaaaagacaaaaaaaucc

SEQ ID NO: 523750 - RNA, 25 nt, Human
agccaaaagacaaaaaaauccaaaa

SEQ ID NO: 523751 - RNA, 22 nt, Human
aggaagagagaacuuaaagcua

SEQ ID NO: 523752 - RNA, 24 nt, Human
aggcaaaagaaaauaugauacuua

SEQ ID NO: 523753 - RNA, 22 nt, Human
aggcauuauuauuuguucacug

SEQ ID NO: 523754 - RNA, 18 nt, Human
agguagauggaaagagaa

SEQ ID NO: 523755 - RNA, 21 nt, Human
aguaaauaauguaugucacaa

SEQ ID NO: 523756 - RNA, 18 nt, Human
aguagagacagggcuuca

SEQ ID NO: 523757 - RNA, 23 nt, Human
aguccucagaagauucaaguuga

SEQ ID NO: 523758 - RNA, 19 nt, Human
agugcaguugguguacggc

SEQ ID NO: 523759 - RNA, 21 nt, Human
agugcaguugguguacggcug

SEQ ID NO: 523760 - RNA, 22 nt, Human
aguuuuaaacaaguggcaucuu

SEQ ID NO: 523761 - RNA, 18 nt, Human
auaaugauaaggauaaua

SEQ ID NO: 523762 - RNA, 20 nt, Human
auaccuauaaaacaaaacug

SEQ ID NO: 523763 - RNA, 21 nt, Human
auauauauauauauauaaaca

SEQ ID NO: 523764 - RNA, 19 nt, Human
aucauguuggccaggcuug

SEQ ID NO: 523765 - RNA, 30 nt, Human
aucauguuggccaggcuugucuggaacucc

SEQ ID NO: 523766 - RNA, 21 nt, Human
auccaaaaaacgaaaacaacc

SEQ ID NO: 523767 - RNA, 23 nt, Human
augaaaaucagauauaacaagcu

SEQ ID NO: 523768 - RNA, 19 nt, Human
auuagagugguacauuuua

SEQ ID NO: 523769 - RNA, 21 nt, Human
auuuuugcuggcugcuggaag

SEQ ID NO: 523770 - RNA, 21 nt, Human
caaaaauuacaaaaugagcac

SEQ ID NO: 523771 - RNA, 18 nt, Human
caaaaugagcacauaaaa

SEQ ID NO: 523772 - RNA, 21 nt, Human
caaacacaguaaauauggaua

SEQ ID NO: 523773 - RNA, 21 nt, Human
caaauuacuaaaacagcuaca

SEQ ID NO: 523774 - RNA, 20 nt, Human
caacauggggcagaaauggc

SEQ ID NO: 523775 - RNA, 23 nt, Human
caacauggggcagaaauggccuc

SEQ ID NO: 523776 - RNA, 21 nt, Human
caacugcugaaacaaccaagu

SEQ ID NO: 523777 - RNA, 24 nt, Human
caagaagcacuacauaccgaccaa

SEQ ID NO: 523778 - RNA, 22 nt, Human
caagugauccgccugccuuagc

SEQ ID NO: 523779 - RNA, 19 nt, Human
caaugauaguguaaaaaau

SEQ ID NO: 523780 - RNA, 20 nt, Human
cacaaaaacuaaagaauaaa

SEQ ID NO: 523781 - RNA, 24 nt, Human
cacacacacaaaagcagcuacaga

SEQ ID NO: 523782 - RNA, 18 nt, Human
caccacaacaaaugugau

SEQ ID NO: 523783 - RNA, 20 nt, Human
caccuuggaacuuaaacaac

SEQ ID NO: 523784 - RNA, 23 nt, Human
cagaagguuuagaaacaccaaaa

SEQ ID NO: 523785 - RNA, 25 nt, Human
cagcaccacaacaaaugugauccuu

SEQ ID NO: 523786 - RNA, 21 nt, Human
cagcaugaaaagugccugaua

SEQ ID NO: 523787 - RNA, 19 nt, Human
caggcaaaagaaaauauga

SEQ ID NO: 523788 - RNA, 24 nt, Human
cagggcuucaucauguuggccagg

SEQ ID NO: 523789 - RNA, 24 nt, Human
caguaaaaacaaaauuuggaagca

SEQ ID NO: 523790 - RNA, 18 nt, Human
caguagaggugacuuuaa

SEQ ID NO: 523791 - RNA, 21 nt, Human
cagucuaaaaugaaagcaggu

SEQ ID NO: 523792 - RNA, 21 nt, Human
cagucuuuuaaacagcaugaa

SEQ ID NO: 523793 - RNA, 24 nt, Human
cauaaagcuaaaaauauagaauca

SEQ ID NO: 523794 - RNA, 19 nt, Human
caucauguuggccaggcuu

SEQ ID NO: 523795 - RNA, 18 nt, Human
caucauuaaaaagagaaa

SEQ ID NO: 523796 - RNA, 21 nt, Human
caugaaaagugccugauaacu

SEQ ID NO: 523797 - RNA, 22 nt, Human
cauuuuaaaaaacaaguaagac

SEQ ID NO: 523798 - RNA, 19 nt, Human
ccaaaagacaaaaaaaucc

SEQ ID NO: 523799 - RNA, 25 nt, Human
ccaaaagacaaaaaaauccaaaaaa

SEQ ID NO: 523800 - RNA, 19 nt, Human
ccaacugcuuuucagauau

SEQ ID NO: 523801 - RNA, 19 nt, Human
ccccaucccccaccaaacc

SEQ ID NO: 523802 - RNA, 22 nt, Human
cccuaaacaguccaccauuuuc

SEQ ID NO: 523803 - RNA, 20 nt, Human
cccuuugaaaagcaagaaaa

SEQ ID NO: 523804 - RNA, 25 nt, Human
ccgccugccuuagccucccgaagug

SEQ ID NO: 523805 - RNA, 23 nt, Human
ccggaccucaagugauccgccug

SEQ ID NO: 523806 - RNA, 18 nt, Human
ccucccucucucugccuc

SEQ ID NO: 523807 - RNA, 19 nt, Human
ccucccucucucugccucc

SEQ ID NO: 523808 - RNA, 18 nt, Human
ccucucucugccuccucu

SEQ ID NO: 523809 - RNA, 24 nt, Human
ccugccuuagccucccgaagugcu

SEQ ID NO: 523810 - RNA, 23 nt, Human
ccugcuaacauuuaaacucugaa

SEQ ID NO: 523811 - RNA, 26 nt, Human
ccuuuaaaaacaaagagagaguuuau

SEQ ID NO: 523812 - RNA, 20 nt, Human
cgaaaacaaccuccccaucc

SEQ ID NO: 523813 - RNA, 19 nt, Human
cuaaaaauauagaaucaga

SEQ ID NO: 523814 - RNA, 24 nt, Human
cuaaaacagcuacagaaaccuauu

SEQ ID NO: 523815 - RNA, 19 nt, Human
cuaacacaaauagaacaca

SEQ ID NO: 523816 - RNA, 21 nt, Human
cucaagucuuuaauuaaaauc

SEQ ID NO: 523817 - RNA, 20 nt, Human
cucaagugauccgccugccu

SEQ ID NO: 523818 - RNA, 24 nt, Human
cugacacacacacaaaagcagcua

SEQ ID NO: 523819 - RNA, 19 nt, Human
cugaccacuauccagccau

SEQ ID NO: 523820 - RNA, 20 nt, Human
cugauaaacaucugaacuua

SEQ ID NO: 523821 - RNA, 23 nt, Human
cugauacugugauauuauuuuaa

SEQ ID NO: 523822 - RNA, 22 nt, Human
cugccauguuucuggagacuug

SEQ ID NO: 523823 - RNA, 24 nt, Human
cugccuuagccucccgaagugcug

SEQ ID NO: 523824 - RNA, 25 nt, Human
cugcuaacauuuaaacucugaaauc

SEQ ID NO: 523825 - RNA, 19 nt, Human
cugcucugccauguuuccu

SEQ ID NO: 523826 - RNA, 25 nt, Human
cuuaaagccaaaagacaaaaaaauc

SEQ ID NO: 523827 - RNA, 24 nt, Human
cuuauacgacuaugauaaaugaca

SEQ ID NO: 523828 - RNA, 24 nt, Human
cuucaucauguuggccaggcuugu

SEQ ID NO: 523829 - RNA, 23 nt, Human
cuugccaggauaccugcugccca

SEQ ID NO: 523830 - RNA, 20 nt, Human
cuugugcuagaaagauacgg

SEQ ID NO: 523831 - RNA, 23 nt, Human
gaaaacaaccuccccauccccca

SEQ ID NO: 523832 - RNA, 18 nt, Human
gaaaggaagcuccugcaa

SEQ ID NO: 523833 - RNA, 19 nt, Human
gaacagauguuuaaacucu

SEQ ID NO: 523834 - RNA, 18 nt, Human
gaaguccaacugcuuuuc

SEQ ID NO: 523835 - RNA, 23 nt, Human
gaccucaagugauccgccugccu

SEQ ID NO: 523836 - RNA, 25 nt, Human
gaggcaacaaagcauaaguuaaaac

SEQ ID NO: 523837 - RNA, 20 nt, Human
gaggcaguuucaacuugaaa

SEQ ID NO: 523838 - RNA, 22 nt, Human
gauacuuaaagccaaaagacaa

SEQ ID NO: 523839 - RNA, 21 nt, Human
gaugguuucacugacaaagcu

SEQ ID NO: 523840 - RNA, 21 nt, Human
gauuguuuccucaacaugggg

SEQ ID NO: 523841 - RNA, 22 nt, Human
gcaggaaaaugugaaaaggaac

SEQ ID NO: 523842 - RNA, 20 nt, Human
gcaguugguguacggcugga

SEQ ID NO: 523843 - RNA, 20 nt, Human
gccaaaagacaaaaaaaucc

SEQ ID NO: 523844 - RNA, 19 nt, Human
gccuccucucauuaaaacc

SEQ ID NO: 523845 - RNA, 21 nt, Human
gcuauuuauaguucuaagcag

SEQ ID NO: 523846 - RNA, 18 nt, Human
gcuccauauaaagauugu

SEQ ID NO: 523847 - RNA, 23 nt, Human
ggaaaaaaacccuucaaucuuua

SEQ ID NO: 523848 - RNA, 22 nt, Human
ggaagagagaacuuaaagcuaa

SEQ ID NO: 523849 - RNA, 18 nt, Human
ggaccucaagugauccgc

SEQ ID NO: 523850 - RNA, 24 nt, Human
ggagcucucuccuaucuuaaucuc

SEQ ID NO: 523851 - RNA, 18 nt, Human
ggaggcccaaauuucaug

SEQ ID NO: 523852 - RNA, 19 nt, Human
ggaguaaugagugaggcaa

SEQ ID NO: 523853 - RNA, 22 nt, Human
gggcuucaucauguuggccagg

SEQ ID NO: 523854 - RNA, 21 nt, Human
guauauacugagcacugccag

SEQ ID NO: 523855 - RNA, 20 nt, Human
gucuuauuuaacuguuuuuc

SEQ ID NO: 523856 - RNA, 18 nt, Human
gugagauauacuauggcc

SEQ ID NO: 523857 - RNA, 21 nt, Human
gugaggcaaauucucaaugcu

SEQ ID NO: 523858 - RNA, 24 nt, Human
gugauccgccugccuuagccuccc

SEQ ID NO: 523859 - RNA, 20 nt, Human
uaaaaaaaaaguaaggauaa

SEQ ID NO: 523860 - RNA, 22 nt, Human
uaaaaaacaaguaagacuacuu

SEQ ID NO: 523861 - RNA, 23 nt, Human
uaaaaaacaaguaagacuacuuu

SEQ ID NO: 523862 - RNA, 22 nt, Human
uaaaaagagaaauaaaauccac

SEQ ID NO: 523863 - RNA, 18 nt, Human
uaaaacagcuacagaaac

SEQ ID NO: 523864 - RNA, 21 nt, Human
uaaaacagcuacagaaaccua

SEQ ID NO: 523865 - RNA, 24 nt, Human
uaaaauccauagagcauuuaacau

SEQ ID NO: 523866 - RNA, 21 nt, Human
uaaaaugaaagcagguaccug

SEQ ID NO: 523867 - RNA, 23 nt, Human
uaaagaaacaauguugggaacug

SEQ ID NO: 523868 - RNA, 24 nt, Human
uaacaccacaaaaauacauucgga

SEQ ID NO: 523869 - RNA, 21 nt, Human
uaagaaaaauaggccccauuu

SEQ ID NO: 523870 - RNA, 24 nt, Human
uaagcaaauaaaaagcuauacaaa

SEQ ID NO: 523871 - RNA, 18 nt, Human
uaauaguauaccaacugc

SEQ ID NO: 523872 - RNA, 22 nt, Human
uaauuuguaaucauuguacccu

SEQ ID NO: 523873 - RNA, 22 nt, Human
uacaguuuaucuauuuccuugu

SEQ ID NO: 523874 - RNA, 23 nt, Human
uaccaagaaauacagcaagcuca

SEQ ID NO: 523875 - RNA, 23 nt, Human
uagaaagaaacaauaaaaaaacu

SEQ ID NO: 523876 - RNA, 24 nt, Human
uagaaauuacuaaugcugguucuu

SEQ ID NO: 523877 - RNA, 26 nt, Human
uagaacacauaaauaaaaagugagua

SEQ ID NO: 523878 - RNA, 19 nt, Human
uagaacugucagcuugcug

SEQ ID NO: 523879 - RNA, 23 nt, Human
uagaaugggucuacagggggaaa

SEQ ID NO: 523880 - RNA, 22 nt, Human
uagagacagggcuucaucaugu

SEQ ID NO: 523881 - RNA, 24 nt, Human
uaggccaagaucccuggcucuauu

SEQ ID NO: 523882 - RNA, 24 nt, Human
uaguagagacagggcuucaucaug

SEQ ID NO: 523883 - RNA, 22 nt, Human
uaguauaccaacugcugaaacu

SEQ ID NO: 523884 - RNA, 28 nt, Human
uauaaacauaggcccugcugagaaaucg

SEQ ID NO: 523885 - RNA, 22 nt, Human
uauuauuuuaaugcaagguuua

SEQ ID NO: 523886 - RNA, 19 nt, Human
uauuguagcacaccuugga

SEQ ID NO: 523887 - RNA, 20 nt, Human
ucaaaauucacuuaaguugc

SEQ ID NO: 523888 - RNA, 24 nt, Human
ucaaugauaguguaaaaaaugcuu

SEQ ID NO: 523889 - RNA, 22 nt, Human
ucacauuaaacuagaugaaaau

SEQ ID NO: 523890 - RNA, 18 nt, Human
ucagauauaacaagcugc

SEQ ID NO: 523891 - RNA, 18 nt, Human
ucagugacucucauauuu

SEQ ID NO: 523892 - RNA, 23 nt, Human
ucauaaaguuaagaaaaauaggc

SEQ ID NO: 523893 - RNA, 18 nt, Human
ucauuaaaaccaagaauc

SEQ ID NO: 523894 - RNA, 20 nt, Human
uccaaaaaacgaaaacaacc

SEQ ID NO: 523895 - RNA, 24 nt, Human
uccaaaaaacgaaaacaaccuccc

SEQ ID NO: 523896 - RNA, 28 nt, Human
uccaaaaaacgaaaacaaccuccccauc

SEQ ID NO: 523897 - RNA, 21 nt, Human
uccaccaaucgggaaaaaaac

SEQ ID NO: 523898 - RNA, 19 nt, Human
uccaccccaucucaaagag

SEQ ID NO: 523899 - RNA, 22 nt, Human
ucccccaccaaacccuuaacug

SEQ ID NO: 523900 - RNA, 18 nt, Human
ucccgaagugcugggauu

SEQ ID NO: 523901 - RNA, 18 nt, Human
ucccgaagugcugggauu

SEQ ID NO: 523902 - RNA, 20 nt, Human
ucccuuuggaguuuucagaa

SEQ ID NO: 523903 - RNA, 21 nt, Human
uccuaugcccuaaacaguccc

SEQ ID NO: 523904 - RNA, 21 nt, Human
uccucaaugauaguguaaaaa

SEQ ID NO: 523905 - RNA, 27 nt, Human
ucuacaguaaaaacaaaauuuggaagc

SEQ ID NO: 523906 - RNA, 20 nt, Human
ucuacugaaauuucccuuug

SEQ ID NO: 523907 - RNA, 23 nt, Human
ucucccauugaccucaggcccac

SEQ ID NO: 523908 - RNA, 21 nt, Human
ucugaacuuaugaaaauaaca

SEQ ID NO: 523909 - RNA, 20 nt, Human
ucugccauguuucuggagac

SEQ ID NO: 523910 - RNA, 24 nt, Human
ucugccucccucucucugccuccu

SEQ ID NO: 523911 - RNA, 23 nt, Human
ucugccuccucucauuaaaacca

SEQ ID NO: 523912 - RNA, 22 nt, Human
ucugcucugccauguuucugga

SEQ ID NO: 523913 - RNA, 19 nt, Human
ucuugacuaggaaaggaag

SEQ ID NO: 523914 - RNA, 23 nt, Human
ucuuuaauuaaaauccauagagc

SEQ ID NO: 523915 - RNA, 22 nt, Human
ucuuugggguccuccaaaaaaa

SEQ ID NO: 523916 - RNA, 23 nt, Human
ugaaaagaagaugcagguugagc

SEQ ID NO: 523917 - RNA, 18 nt, Human
ugaaaagcaagaaaaauc

SEQ ID NO: 523918 - RNA, 21 nt, Human
ugaaaauacucaaagaagcag

SEQ ID NO: 523919 - RNA, 22 nt, Human
ugaaauaggcaguaaauaaugu

SEQ ID NO: 523920 - RNA, 18 nt, Human
ugaauaaagucaguccga

SEQ ID NO: 523921 - RNA, 20 nt, Human
ugaaugcauugauugagcaa

SEQ ID NO: 523922 - RNA, 19 nt, Human
ugacaauguuggaagaauc

SEQ ID NO: 523923 - RNA, 23 nt, Human
ugacacacacacaaaagcagcua

SEQ ID NO: 523924 - RNA, 21 nt, Human
ugacauacaacaaacugcaca

SEQ ID NO: 523925 - RNA, 23 nt, Human
ugagaaaucgucauaaauucuaa

SEQ ID NO: 523926 - RNA, 19 nt, Human
ugagaacucugggcuuccu

SEQ ID NO: 523927 - RNA, 21 nt, Human
ugagaacucugggcuuccuua

SEQ ID NO: 523928 - RNA, 21 nt, Human
ugaggugaaacauuucacacu

SEQ ID NO: 523929 - RNA, 23 nt, Human
ugauaaggauaauaccuauaaaa

SEQ ID NO: 523930 - RNA, 22 nt, Human
ugauuauucuaaaguugcuuug

SEQ ID NO: 523931 - RNA, 18 nt, Human
ugauugugcacacccccu

SEQ ID NO: 523932 - RNA, 21 nt, Human
ugcaauugauuuuuaaagaca

SEQ ID NO: 523933 - RNA, 21 nt, Human
ugcauaaugauaaggauaaua

SEQ ID NO: 523934 - RNA, 24 nt, Human
ugccuuagccucccgaagugcugg

SEQ ID NO: 523935 - RNA, 23 nt, Human
uggaaagagaagaaauuaacuua

SEQ ID NO: 523936 - RNA, 26 nt, Human
uggaaauaugaauaaagucaguccga

SEQ ID NO: 523937 - RNA, 19 nt, Human
uggauauaaguaaacaaaa

SEQ ID NO: 523938 - RNA, 19 nt, Human
ugggaagaagcgugacaga

SEQ ID NO: 523939 - RNA, 23 nt, Human
uggggcagaaauggccucugcuu

SEQ ID NO: 523940 - RNA, 18 nt, Human
ugguacauuuuaauguuu

SEQ ID NO: 523941 - RNA, 20 nt, Human
uguaaaaaaugcuuauuauu

SEQ ID NO: 523942 - RNA, 20 nt, Human
uguaaagcaaaaagugcagg

SEQ ID NO: 523943 - RNA, 18 nt, Human
uguacagcugaggugaaa

SEQ ID NO: 523944 - RNA, 23 nt, Human
uguauaaauauuagagcuagggu

SEQ ID NO: 523945 - RNA, 24 nt, Human
uguauaucagacaggaaaggugca

SEQ ID NO: 523946 - RNA, 23 nt, Human
uguauuggagaaguuugauggaa

SEQ ID NO: 523947 - RNA, 22 nt, Human
ugucugcucugccauguuucug

SEQ ID NO: 523948 - RNA, 20 nt, Human
ugugaaaaggaacgagacug

SEQ ID NO: 523949 - RNA, 18 nt, Human
uuaaaaaaaaaguaagga

SEQ ID NO: 523950 - RNA, 18 nt, Human
uuaaaacacacauaaauu

SEQ ID NO: 523951 - RNA, 19 nt, Human
uuaaacaaguggcaucuuu

SEQ ID NO: 523952 - RNA, 25 nt, Human
uuaaagccaaaagacaaaaaaaucc

SEQ ID NO: 523953 - RNA, 23 nt, Human
uuacaucauuaaaaagagaaaua

SEQ ID NO: 523954 - RNA, 21 nt, Human
uuaccccuuugaaaagcaaga

SEQ ID NO: 523955 - RNA, 24 nt, Human
uuagauguuuaagacuuuagucua

SEQ ID NO: 523956 - RNA, 24 nt, Human
uuaguagagacagggcuucaucau

SEQ ID NO: 523957 - RNA, 18 nt, Human
uuauacuggaggcccaaa

SEQ ID NO: 523958 - RNA, 23 nt, Human
uucaaaauggauuuugaguguac

SEQ ID NO: 523959 - RNA, 27 nt, Human
uucaaacacaguaaauauggauauaag

SEQ ID NO: 523960 - RNA, 21 nt, Human
uucacaaaaaguccucagaag

SEQ ID NO: 523961 - RNA, 22 nt, Human
uucagaagauggcaggugccgc

SEQ ID NO: 523962 - RNA, 23 nt, Human
uucugagaccaaaaaguuugaaa

SEQ ID NO: 523963 - RNA, 18 nt, Human
uugaagaagagauuggug

SEQ ID NO: 523964 - RNA, 19 nt, Human
uugaagaagagauuggugu

SEQ ID NO: 523965 - RNA, 18 nt, Human
uugacauacaacaaacug

SEQ ID NO: 523966 - RNA, 24 nt, Human
uugaccucaggcccacauuuagaa

SEQ ID NO: 523967 - RNA, 20 nt, Human
uuuaaacucugaaaucagca

SEQ ID NO: 523968 - RNA, 21 nt, Human
uuuaagcuuuaucuugacuag

SEQ ID NO: 523969 - RNA, 18 nt, Human
uuuaauaguauaccaacu

SEQ ID NO: 523970 - RNA, 19 nt, Human
uuuacucaaauuuagaaug

SEQ ID NO: 523971 - RNA, 22 nt, Human
uuuagaaugggucuacaggggg

SEQ ID NO: 523972 - RNA, 21 nt, Human
uuucuggagacuugaugcugg

SEQ ID NO: 523973 - RNA, 18 nt, Human
uuucuucuuuaagaaaag

SEQ ID NO: 523974 - RNA, 19 nt, Human
uuuuaaacuuugggggugg

SEQ ID NO: 523975 - RNA, 21 nt, Human
uuuuggacuacuaaaacuauu

SEQ ID NO: 523976 - RNA, 21 nt, Human
uuuuuguauuuuuaguagaga

SEQ ID NO: 523977 - RNA, 21 nt, Human
uuuuuuguauuuuuaguagag

SEQ ID NO: 523978 - RNA, 24 nt, Human
uuuuuuguauuuuuaguagagaca

SEQ ID NO: 523979 - RNA, 26 nt, Human
acccagagcccggagcccggaacccc

SEQ ID NO: 523980 - RNA, 21 nt, Human
agggcaguucuucaccguugg

SEQ ID NO: 523981 - RNA, 24 nt, Human
caccugcccuccacuuucagcugc

SEQ ID NO: 523982 - RNA, 22 nt, Human
cagagcccggagcccggaaccc

SEQ ID NO: 523983 - RNA, 18 nt, Human
ccacccagagcccggagc

SEQ ID NO: 523984 - RNA, 22 nt, Human
cccagagcccggagcccggaac

SEQ ID NO: 523985 - RNA, 23 nt, Human
cccgcggccgacagggccggggc

SEQ ID NO: 523986 - RNA, 20 nt, Human
cccuccacuuucagcugccu

SEQ ID NO: 523987 - RNA, 27 nt, Human
ccugcgccgcagugccgccgcucacag

SEQ ID NO: 523988 - RNA, 18 nt, Human
cgcucacagccgccgcca

SEQ ID NO: 523989 - RNA, 24 nt, Human
cgcuggccugcgccgcagugccgc

SEQ ID NO: 523990 - RNA, 22 nt, Human
cugcgccgcagugccgccgcuc

SEQ ID NO: 523991 - RNA, 22 nt, Human
cugcugcucuucgaugaccgug

SEQ ID NO: 523992 - RNA, 20 nt, Human
gccgccgcucacagccgccg

SEQ ID NO: 523993 - RNA, 18 nt, Human
gcucacagccgccgccac

SEQ ID NO: 523994 - RNA, 22 nt, Human
ggaauucaccugcccuccacuu

SEQ ID NO: 523995 - RNA, 20 nt, Human
ggcgagggcugggaauucac

SEQ ID NO: 523996 - RNA, 19 nt, Human
uaucuagaguuacagacuu

SEQ ID NO: 523997 - RNA, 19 nt, Human
ugcaguuagcacaugguau

SEQ ID NO: 523998 - RNA, 20 nt, Human
uuaguuuuaguuuugucugc

SEQ ID NO: 523999 - RNA, 19 nt, Human
uuugucugcugcucuucga

SEQ ID NO: 524000 - RNA, 22 nt, Human
aaccaagccacuuuccccagca

SEQ ID NO: 524001 - RNA, 24 nt, Human
aagcgcugcauggggugggggcag

SEQ ID NO: 524002 - RNA, 24 nt, Human
aaggugcuaggggguggcaccuug

SEQ ID NO: 524003 - RNA, 21 nt, Human
accaagccacuuuccccagca

SEQ ID NO: 524004 - RNA, 19 nt, Human
acccagagggaacuggggc

SEQ ID NO: 524005 - RNA, 18 nt, Human
acccuuacccagauaggg

SEQ ID NO: 524006 - RNA, 22 nt, Human
acuggggcaggagcgacagaga

SEQ ID NO: 524007 - RNA, 18 nt, Human
agaaccaaaggacagaag

SEQ ID NO: 524008 - RNA, 18 nt, Human
agaaucugaaacugcuga

SEQ ID NO: 524009 - RNA, 18 nt, Human
agacaaaagcaggggggc

SEQ ID NO: 524010 - RNA, 21 nt, Human
agacaaaagcaggggggccug

SEQ ID NO: 524011 - RNA, 19 nt, Human
agacagggagggcugaaga

SEQ ID NO: 524012 - RNA, 21 nt, Human
agcccuggccaggaagugggg

SEQ ID NO: 524013 - RNA, 23 nt, Human
agcgagcacccccaccccaggcc

SEQ ID NO: 524014 - RNA, 21 nt, Human
aggaagugggggagacaggga

SEQ ID NO: 524015 - RNA, 23 nt, Human
agggugcaggaagggagaugggg

SEQ ID NO: 524016 - RNA, 24 nt, Human
agucccagaggggccugugccagg

SEQ ID NO: 524017 - RNA, 21 nt, Human
agugcauguccccuuaaauaa

SEQ ID NO: 524018 - RNA, 22 nt, Human
auggaguguaagaaucugaaac

SEQ ID NO: 524019 - RNA, 22 nt, Human
caaggugaaagguauggguccu

SEQ ID NO: 524020 - RNA, 19 nt, Human
caccccaggccaacgccau

SEQ ID NO: 524021 - RNA, 18 nt, Human
cacccccaccccaggcca

SEQ ID NO: 524022 - RNA, 21 nt, Human
caccccugggaugacaacggg

SEQ ID NO: 524023 - RNA, 18 nt, Human
cagaagacaaagcgagca

SEQ ID NO: 524024 - RNA, 20 nt, Human
cagaagacaaagcgagcacc

SEQ ID NO: 524025 - RNA, 18 nt, Human
cagacucauuugcagcug

SEQ ID NO: 524026 - RNA, 22 nt, Human
cagagaccccagcugagccuca

SEQ ID NO: 524027 - RNA, 20 nt, Human
cagcaccuaggaggggaccc

SEQ ID NO: 524028 - RNA, 22 nt, Human
cagcagguucuuuuccaauucc

SEQ ID NO: 524029 - RNA, 24 nt, Human
cagcguguccggggccugcccucg

SEQ ID NO: 524030 - RNA, 24 nt, Human
caggggggccugagaacacagagc

SEQ ID NO: 524031 - RNA, 20 nt, Human
caguccagccccagggcaga

SEQ ID NO: 524032 - RNA, 24 nt, Human
caucaccaggagucaccccuggga

SEQ ID NO: 524033 - RNA, 23 nt, Human
caugcaguccagccccagggcag

SEQ ID NO: 524034 - RNA, 21 nt, Human
cauguccccuuaaauaaacug

SEQ ID NO: 524035 - RNA, 18 nt, Human
cccaggcuggacguggag

SEQ ID NO: 524036 - RNA, 19 nt, Human
ccccugggaugacaacggg

SEQ ID NO: 524037 - RNA, 19 nt, Human
ccggagccucacaaguccc

SEQ ID NO: 524038 - RNA, 19 nt, Human
ccugacaaggugcuagggg

SEQ ID NO: 524039 - RNA, 21 nt, Human
ccugcccucgaggcccagaga

SEQ ID NO: 524040 - RNA, 21 nt, Human
ccugugccagggccugagggg

SEQ ID NO: 524041 - RNA, 19 nt, Human
ccuugggccaggccuguuc

SEQ ID NO: 524042 - RNA, 21 nt, Human
ccuugggccaggccuguucuu

SEQ ID NO: 524043 - RNA, 20 nt, Human
cucaagggaagacccuuacc

SEQ ID NO: 524044 - RNA, 18 nt, Human
cugaaacugcugacuccc

SEQ ID NO: 524045 - RNA, 22 nt, Human
cugaaacugcugacucccauca

SEQ ID NO: 524046 - RNA, 20 nt, Human
cugugccagggccugagggg

SEQ ID NO: 524047 - RNA, 22 nt, Human
gacaaaagcaggggggccugag

SEQ ID NO: 524048 - RNA, 20 nt, Human
gagacaaaagcaggggggcc

SEQ ID NO: 524049 - RNA, 24 nt, Human
gaggcccagagaugccagguccca

SEQ ID NO: 524050 - RNA, 18 nt, Human
gagggagcacagcagggu

SEQ ID NO: 524051 - RNA, 18 nt, Human
gagggguccucaggagcc

SEQ ID NO: 524052 - RNA, 20 nt, Human
gagggguccucaggagccug

SEQ ID NO: 524053 - RNA, 18 nt, Human
gcaguccagccccagggc

SEQ ID NO: 524054 - RNA, 21 nt, Human
gccuguucuuggcugagggaa

SEQ ID NO: 524055 - RNA, 18 nt, Human
ggacuaacuggaggggug

SEQ ID NO: 524056 - RNA, 23 nt, Human
ggagacagggagggcugaagaca

SEQ ID NO: 524057 - RNA, 18 nt, Human
ggcaccuugggccaggcc

SEQ ID NO: 524058 - RNA, 22 nt, Human
ggccugagggguccucaggagc

SEQ ID NO: 524059 - RNA, 23 nt, Human
gggcaggagcgacagagacccca

SEQ ID NO: 524060 - RNA, 23 nt, Human
gguacaggagcauuauggaagga

SEQ ID NO: 524061 - RNA, 19 nt, Human
guccccuuaaauaaacugg

SEQ ID NO: 524062 - RNA, 23 nt, Human
guggaagggaacaaggugaaagg

SEQ ID NO: 524063 - RNA, 21 nt, Human
uaaacauuggguuccaccccc

SEQ ID NO: 524064 - RNA, 24 nt, Human
uaggaggggacccagagggaacuu

SEQ ID NO: 524065 - RNA, 22 nt, Human
ucagcaggcuccggagcugggg

SEQ ID NO: 524066 - RNA, 21 nt, Human
ucaggacagcaccuaggaggg

SEQ ID NO: 524067 - RNA, 18 nt, Human
uccugcugaugcugaugu

SEQ ID NO: 524068 - RNA, 21 nt, Human
ucuuggcugagggaaagaggg

SEQ ID NO: 524069 - RNA, 18 nt, Human
ugacaaggugcuaggggg

SEQ ID NO: 524070 - RNA, 27 nt, Human
ugacucccaucaccaggagucaccccc

SEQ ID NO: 524071 - RNA, 18 nt, Human
ugagagcccuggccagga

SEQ ID NO: 524072 - RNA, 22 nt, Human
ugagagcccuggccaggaagug

SEQ ID NO: 524073 - RNA, 22 nt, Human
ugagggaaagaggggggccaug

SEQ ID NO: 524074 - RNA, 18 nt, Human
ugcauggggugggggcag

SEQ ID NO: 524075 - RNA, 20 nt, Human
ugccagggccugaggggucc

SEQ ID NO: 524076 - RNA, 18 nt, Human
ugcuaggggguggcaccu

SEQ ID NO: 524077 - RNA, 22 nt, Human
uggccaggaagugggggagaca

SEQ ID NO: 524078 - RNA, 24 nt, Human
ugggagaugagaggcuccagacuc

SEQ ID NO: 524079 - RNA, 18 nt, Human
uggggcaggagcgacaga

SEQ ID NO: 524080 - RNA, 19 nt, Human
uguaagaaucugaaacugc

SEQ ID NO: 524081 - RNA, 25 nt, Human
uucuuggcugagggaaagagggggg

SEQ ID NO: 524082 - RNA, 25 nt, Human
aaaucacauccuacucaucagcaag

SEQ ID NO: 524083 - RNA, 20 nt, Human
aaauugaaggcaggauccca

SEQ ID NO: 524084 - RNA, 20 nt, Human
aaccucaaaaagcaggggac

SEQ ID NO: 524085 - RNA, 19 nt, Human
aagcaugguuucaaacaug

SEQ ID NO: 524086 - RNA, 23 nt, Human
aaggacaugucggugaugaugag

SEQ ID NO: 524087 - RNA, 20 nt, Human
aaggaggccgcugcauuucc

SEQ ID NO: 524088 - RNA, 22 nt, Human
aaucucugcucacugcaaccuc

SEQ ID NO: 524089 - RNA, 22 nt, Human
acaccgggucugaccucccagc

SEQ ID NO: 524090 - RNA, 20 nt, Human
acaggcugcuaaccccaggc

SEQ ID NO: 524091 - RNA, 20 nt, Human
acaugccgugaagacagagc

SEQ ID NO: 524092 - RNA, 20 nt, Human
acgagccccucagucuuggg

SEQ ID NO: 524093 - RNA, 25 nt, Human
acucugucgaccaggcuggagugua

SEQ ID NO: 524094 - RNA, 18 nt, Human
agaacucaaguuaaggcc

SEQ ID NO: 524095 - RNA, 21 nt, Human
agaaggcucugugugcagccc

SEQ ID NO: 524096 - RNA, 18 nt, Human
agagagguccaaggugcc

SEQ ID NO: 524097 - RNA, 19 nt, Human
agagggcaucggugagcau

SEQ ID NO: 524098 - RNA, 25 nt, Human
agagggcuccccaucccuauuccuc

SEQ ID NO: 524099 - RNA, 21 nt, Human
agcacucugggagggcugugg

SEQ ID NO: 524100 - RNA, 22 nt, Human
agcacucugggagggcuguggg

SEQ ID NO: 524101 - RNA, 23 nt, Human
agcacucugggagggcugugggc

SEQ ID NO: 524102 - RNA, 18 nt, Human
agcagcugcucuagcggc

SEQ ID NO: 524103 - RNA, 19 nt, Human
agcugcccugggcuggaga

SEQ ID NO: 524104 - RNA, 23 nt, Human
aggaaggaaggcagggcuugcag

SEQ ID NO: 524105 - RNA, 18 nt, Human
aggaaggcagggcuugca

SEQ ID NO: 524106 - RNA, 19 nt, Human
aggcauggaggaggugggc

SEQ ID NO: 524107 - RNA, 23 nt, Human
agggcuaaacacuggugcccagg

SEQ ID NO: 524108 - RNA, 22 nt, Human
agggcugugggcaugagcagcg

SEQ ID NO: 524109 - RNA, 20 nt, Human
agggggugguggcaggaguu

SEQ ID NO: 524110 - RNA, 19 nt, Human
aggucugccucccgggccc

SEQ ID NO: 524111 - RNA, 19 nt, Human
agugcuccauggcccaggc

SEQ ID NO: 524112 - RNA, 19 nt, Human
augagcagcgaggacucca

SEQ ID NO: 524113 - RNA, 22 nt, Human
caaccucaaaaagcaggggacc

SEQ ID NO: 524114 - RNA, 22 nt, Human
cacagcacguggguggcaggac

SEQ ID NO: 524115 - RNA, 27 nt, Human
cacagcacguggguggcaggaccaaca

SEQ ID NO: 524116 - RNA, 19 nt, Human
cacagccccucugccucuc

SEQ ID NO: 524117 - RNA, 21 nt, Human
cacaugccgugaagacagagc

SEQ ID NO: 524118 - RNA, 19 nt, Human
caccacgccccacccccaa

SEQ ID NO: 524119 - RNA, 28 nt, Human
cacccccaacugcacggcagccacucgc

SEQ ID NO: 524120 - RNA, 20 nt, Human
cacccucugcuuccguccuc

SEQ ID NO: 524121 - RNA, 23 nt, Human
caccuguggccucugcaucaccc

SEQ ID NO: 524122 - RNA, 18 nt, Human
cacggcagccacucgcau

SEQ ID NO: 524123 - RNA, 19 nt, Human
cacguguccggccggugug

SEQ ID NO: 524124 - RNA, 22 nt, Human
cacucugucgaccaggcuggag

SEQ ID NO: 524125 - RNA, 19 nt, Human
cagaaccgagccuguccug

SEQ ID NO: 524126 - RNA, 21 nt, Human
cagaggagaaaagcacuuagc

SEQ ID NO: 524127 - RNA, 19 nt, Human
cagaguucacucugucgac

SEQ ID NO: 524128 - RNA, 20 nt, Human
cagugcguggaggagaucgg

SEQ ID NO: 524129 - RNA, 24 nt, Human
caucagcaaggcagguagacauca

SEQ ID NO: 524130 - RNA, 19 nt, Human
ccaagugggugaaaugguc

SEQ ID NO: 524131 - RNA, 24 nt, Human
ccaccgcucuggcacgagccccuc

SEQ ID NO: 524132 - RNA, 23 nt, Human
ccaggugcucuugccaugggucc

SEQ ID NO: 524133 - RNA, 19 nt, Human
ccagucaaucagaagcaaa

SEQ ID NO: 524134 - RNA, 22 nt, Human
ccaugcugagccuccccugccu

SEQ ID NO: 524135 - RNA, 18 nt, Human
cccaggauggaaucuggc

SEQ ID NO: 524136 - RNA, 20 nt, Human
cccagggcaggggucaggga

SEQ ID NO: 524137 - RNA, 18 nt, Human
ccccaauacuuucauuuu

SEQ ID NO: 524138 - RNA, 21 nt, Human
ccccucuuccgcuuuuguucc

SEQ ID NO: 524139 - RNA, 21 nt, Human
cccugggcuggagaugggcau

SEQ ID NO: 524140 - RNA, 21 nt, Human
ccucaaaaagcaggggaccag

SEQ ID NO: 524141 - RNA, 18 nt, Human
ccucccacuucccaccuc

SEQ ID NO: 524142 - RNA, 19 nt, Human
ccuccugcugcuguucacc

SEQ ID NO: 524143 - RNA, 25 nt, Human
ccugcagaccagggcuaaacacugg

SEQ ID NO: 524144 - RNA, 24 nt, Human
ccugcugaguccagccuuucuacc

SEQ ID NO: 524145 - RNA, 24 nt, Human
ccuggcagcauuuggucuuccucu

SEQ ID NO: 524146 - RNA, 20 nt, Human
ccuuccugcagaccagggcu

SEQ ID NO: 524147 - RNA, 19 nt, Human
ccuugcucauccccagagg

SEQ ID NO: 524148 - RNA, 20 nt, Human
ccuugggcucccuggggagg

SEQ ID NO: 524149 - RNA, 20 nt, Human
ccuugugucccucacucccc

SEQ ID NO: 524150 - RNA, 22 nt, Human
cggcagccacucgcauagcacu

SEQ ID NO: 524151 - RNA, 19 nt, Human
cuaaacaccacgccccacc

SEQ ID NO: 524152 - RNA, 23 nt, Human
cuaaacaccacgccccaccccca

SEQ ID NO: 524153 - RNA, 22 nt, Human
cucacugcaaccuccaccccaa

SEQ ID NO: 524154 - RNA, 22 nt, Human
cuccagaacaacaacaaaaaaa

SEQ ID NO: 524155 - RNA, 19 nt, Human
cuccccaucccuauuccuc

SEQ ID NO: 524156 - RNA, 19 nt, Human
cuccccugccuugggcucc

SEQ ID NO: 524157 - RNA, 24 nt, Human
cucuaucugggcccggugggcucc

SEQ ID NO: 524158 - RNA, 18 nt, Human
cugagccccucuucacug

SEQ ID NO: 524159 - RNA, 24 nt, Human
cugcaaccuccaccccaauacuuu

SEQ ID NO: 524160 - RNA, 19 nt, Human
cugcuguccuccuuccugc

SEQ ID NO: 524161 - RNA, 22 nt, Human
cuggaaggccuugcucaucccc

SEQ ID NO: 524162 - RNA, 23 nt, Human
cuggaggacgcccuggaacucgg

SEQ ID NO: 524163 - RNA, 20 nt, Human
cugggccucugaccuugcug

SEQ ID NO: 524164 - RNA, 22 nt, Human
cuggugguggcguugaaacagc

SEQ ID NO: 524165 - RNA, 19 nt, Human
cuucuuagaguugucuuga

SEQ ID NO: 524166 - RNA, 19 nt, Human
cuugguggggcugggaccc

SEQ ID NO: 524167 - RNA, 21 nt, Human
cuuucugccucccugcucccc

SEQ ID NO: 524168 - RNA, 19 nt, Human
gaacaucccugauuaagaa

SEQ ID NO: 524169 - RNA, 19 nt, Human
gaacucggagcacacagca

SEQ ID NO: 524170 - RNA, 24 nt, Human
gaaggacaugucggugaugaugag

SEQ ID NO: 524171 - RNA, 20 nt, Human
gaaggcagccuucgauguca

SEQ ID NO: 524172 - RNA, 21 nt, Human
gacacugagaacauucccccc

SEQ ID NO: 524173 - RNA, 18 nt, Human
gacgggauggaggugugg

SEQ ID NO: 524174 - RNA, 20 nt, Human
gagcgugcagcaccuguggc

SEQ ID NO: 524175 - RNA, 24 nt, Human
gaggacucuagcacggcacagccc

SEQ ID NO: 524176 - RNA, 19 nt, Human
gagggggugguggcaggag

SEQ ID NO: 524177 - RNA, 19 nt, Human
gagggggugguggcaggag

SEQ ID NO: 524178 - RNA, 23 nt, Human
gaguccagccuuucuaccaccuc

SEQ ID NO: 524179 - RNA, 27 nt, Human
gcaaaacagaacucaaguuaaggccuc

SEQ ID NO: 524180 - RNA, 19 nt, Human
gcacagccagggucgaggu

SEQ ID NO: 524181 - RNA, 21 nt, Human
gcacaggcugcuaaccccagg

SEQ ID NO: 524182 - RNA, 21 nt, Human
gcaggucugccucccgggccc

SEQ ID NO: 524183 - RNA, 21 nt, Human
gcccuggaacucggagcacac

SEQ ID NO: 524184 - RNA, 20 nt, Human
gccuccccugccuugggcuc

SEQ ID NO: 524185 - RNA, 19 nt, Human
gcgccagugcguggaggag

SEQ ID NO: 524186 - RNA, 22 nt, Human
gcuugcaggaucauggaaaacc

SEQ ID NO: 524187 - RNA, 21 nt, Human
ggacaggcaugcagaaggcuc

SEQ ID NO: 524188 - RNA, 21 nt, Human
ggacccucccacuucccaccu

SEQ ID NO: 524189 - RNA, 20 nt, Human
ggacugggucaauggccaug

SEQ ID NO: 524190 - RNA, 24 nt, Human
ggaggacaggcaugcagaaggcuc

SEQ ID NO: 524191 - RNA, 22 nt, Human
ggaggacgcccuggaacucgga

SEQ ID NO: 524192 - RNA, 20 nt, Human
ggaggccuuggccucguggg

SEQ ID NO: 524193 - RNA, 21 nt, Human
ggaugggaccuggaagucuuu

SEQ ID NO: 524194 - RNA, 22 nt, Human
ggcaacccuucauucauucguc

SEQ ID NO: 524195 - RNA, 23 nt, Human
ggcacaggcugcuaaccccaggc

SEQ ID NO: 524196 - RNA, 21 nt, Human
ggcugugggcaugagcagcga

SEQ ID NO: 524197 - RNA, 19 nt, Human
ggcuucuucuuucuuuucu

SEQ ID NO: 524198 - RNA, 19 nt, Human
gggcagugguguccgcgau

SEQ ID NO: 524199 - RNA, 18 nt, Human
ggugcugcugagcccaag

SEQ ID NO: 524200 - RNA, 18 nt, Human
gucgaccaggcuggagug

SEQ ID NO: 524201 - RNA, 21 nt, Human
gugaaauggucagcacugcca

SEQ ID NO: 524202 - RNA, 25 nt, Human
gugcagccccagaccuggguaccuu

SEQ ID NO: 524203 - RNA, 24 nt, Human
guggcaggaguugcccaagggcug

SEQ ID NO: 524204 - RNA, 19 nt, Human
gugguggcguugaaacagc

SEQ ID NO: 524205 - RNA, 24 nt, Human
guucacucugucgaccaggcugga

SEQ ID NO: 524206 - RNA, 23 nt, Human
uaaaauaaacaauuuacuuuucc

SEQ ID NO: 524207 - RNA, 22 nt, Human
uaaacaccacgccccaccccca

SEQ ID NO: 524208 - RNA, 20 nt, Human
uaagcgccuggcuccgcugu

SEQ ID NO: 524209 - RNA, 20 nt, Human
uaaguucugcaaauucaguu

SEQ ID NO: 524210 - RNA, 24 nt, Human
uagacaucauuuucacaaugacuu

SEQ ID NO: 524211 - RNA, 23 nt, Human
uagcacggcacagccccucugcc

SEQ ID NO: 524212 - RNA, 27 nt, Human
uagcacggcacagccccucugccucuc

SEQ ID NO: 524213 - RNA, 19 nt, Human
uagcacucugggagggcug

SEQ ID NO: 524214 - RNA, 24 nt, Human
uagcacucugggagggcugugggc

SEQ ID NO: 524215 - RNA, 25 nt, Human
ucaaaaagcaggggaccagaaccga

SEQ ID NO: 524216 - RNA, 20 nt, Human
ucacucugucgaccaggcug

SEQ ID NO: 524217 - RNA, 22 nt, Human
ucacucugucgaccaggcugga

SEQ ID NO: 524218 - RNA, 23 nt, Human
ucacucugucgaccaggcuggag

SEQ ID NO: 524219 - RNA, 18 nt, Human
ucacugcaaccuccaccc

SEQ ID NO: 524220 - RNA, 21 nt, Human
ucacugcaaccuccaccccaa

SEQ ID NO: 524221 - RNA, 20 nt, Human
ucagaugcccuucccgugcu

SEQ ID NO: 524222 - RNA, 19 nt, Human
ucagugcaguggcugagcu

SEQ ID NO: 524223 - RNA, 23 nt, Human
ucauggaaaaccuucuuagaguu

SEQ ID NO: 524224 - RNA, 21 nt, Human
ucauucauucgucggaugugu

SEQ ID NO: 524225 - RNA, 23 nt, Human
uccagaacaacaacaaaaaaauc

SEQ ID NO: 524226 - RNA, 23 nt, Human
uccagcauuuuaaugaacauccc

SEQ ID NO: 524227 - RNA, 26 nt, Human
uccagccaagcaugguuucaaacaug

SEQ ID NO: 524228 - RNA, 21 nt, Human
uccaucagcagcucccccaga

SEQ ID NO: 524229 - RNA, 22 nt, Human
uccaucagcagcucccccagau

SEQ ID NO: 524230 - RNA, 24 nt, Human
uccaucagcagcucccccagauaa

SEQ ID NO: 524231 - RNA, 18 nt, Human
uccaugcugagccucccc

SEQ ID NO: 524232 - RNA, 19 nt, Human
uccaugugcacugcugccc

SEQ ID NO: 524233 - RNA, 21 nt, Human
uccaugugcacugcugcccuu

SEQ ID NO: 524234 - RNA, 18 nt, Human
ucccaccuccuugugucc

SEQ ID NO: 524235 - RNA, 19 nt, Human
ucccagccgggggcacagg

SEQ ID NO: 524236 - RNA, 19 nt, Human
ucccccagauaagcccugc

SEQ ID NO: 524237 - RNA, 24 nt, Human
ucccucacuccccuguuucauucc

SEQ ID NO: 524238 - RNA, 21 nt, Human
ucccuggacaauccguguccu

SEQ ID NO: 524239 - RNA, 21 nt, Human
ucccuggggaggggguggugg

SEQ ID NO: 524240 - RNA, 26 nt, Human
uccgcuguucucaggaguggguucug

SEQ ID NO: 524241 - RNA, 23 nt, Human
uccgggauuugguguuccugcug

SEQ ID NO: 524242 - RNA, 20 nt, Human
uccucuaagcgccuggcucc

SEQ ID NO: 524243 - RNA, 18 nt, Human
uccugcugcuguucaccg

SEQ ID NO: 524244 - RNA, 18 nt, Human
ucgaccaggcuggagugu

SEQ ID NO: 524245 - RNA, 22 nt, Human
ucucccagccugcaggugcccc

SEQ ID NO: 524246 - RNA, 24 nt, Human
ucucccagccugcaggugccccug

SEQ ID NO: 524247 - RNA, 28 nt, Human
ucugccucccugcuccccuuuuuuuuuu

SEQ ID NO: 524248 - RNA, 19 nt, Human
ucugucgaccaggcuggag

SEQ ID NO: 524249 - RNA, 24 nt, Human
ucugucgaccaggcuggaguguag

SEQ ID NO: 524250 - RNA, 24 nt, Human
ucuugggugguuucugccuggucc

SEQ ID NO: 524251 - RNA, 20 nt, Human
ugaagguuucuuacucuagu

SEQ ID NO: 524252 - RNA, 21 nt, Human
ugaccugacccuuagucaacc

SEQ ID NO: 524253 - RNA, 20 nt, Human
ugacgaguucuaccccagcu

SEQ ID NO: 524254 - RNA, 25 nt, Human
ugagaaagcacaugccgugaagaca

SEQ ID NO: 524255 - RNA, 18 nt, Human
ugagaacauuccccccuc

SEQ ID NO: 524256 - RNA, 21 nt, Human
ugagaacauuccccccuccca

SEQ ID NO: 524257 - RNA, 18 nt, Human
ugagacagaguucacucu

SEQ ID NO: 524258 - RNA, 21 nt, Human
ugaugaugagcgagacggaca

SEQ ID NO: 524259 - RNA, 22 nt, Human
ugcaaaacagaacucaaguuaa

SEQ ID NO: 524260 - RNA, 21 nt, Human
ugccaugggucccgguccagc

SEQ ID NO: 524261 - RNA, 19 nt, Human
ugcugagccuccccugccu

SEQ ID NO: 524262 - RNA, 18 nt, Human
ugcugcugagcccaaggc

SEQ ID NO: 524263 - RNA, 22 nt, Human
uggaggugugggcagugguguc

SEQ ID NO: 524264 - RNA, 19 nt, Human
uggcagcauuuggucuucc

SEQ ID NO: 524265 - RNA, 23 nt, Human
uggcaggaccaacaccgggucug

SEQ ID NO: 524266 - RNA, 19 nt, Human
uggcaggaguugcccaagg

SEQ ID NO: 524267 - RNA, 20 nt, Human
uggcagugggaugaggcugg

SEQ ID NO: 524268 - RNA, 22 nt, Human
uggcagugggaugaggcuggga

SEQ ID NO: 524269 - RNA, 27 nt, Human
uggcauccagauuugcauaagauggac

SEQ ID NO: 524270 - RNA, 21 nt, Human
uggccaggccacuagccaguc

SEQ ID NO: 524271 - RNA, 21 nt, Human
uggccgcagacauccaggcac

SEQ ID NO: 524272 - RNA, 18 nt, Human
uggccucugcaucacccu

SEQ ID NO: 524273 - RNA, 19 nt, Human
uggcuuccaucucugucuc

SEQ ID NO: 524274 - RNA, 22 nt, Human
ugggaaccugagcugugacccc

SEQ ID NO: 524275 - RNA, 20 nt, Human
ugggcagugguguccgcgau

SEQ ID NO: 524276 - RNA, 22 nt, Human
ugggcaugagcagcgaggacuc

SEQ ID NO: 524277 - RNA, 19 nt, Human
uggggagggggugguggca

SEQ ID NO: 524278 - RNA, 24 nt, Human
ugggguccuaaagucugcuguccu

SEQ ID NO: 524279 - RNA, 22 nt, Human
ugguggcaggaguugcccaagg

SEQ ID NO: 524280 - RNA, 23 nt, Human
uucacucugucgaccaggcugga

SEQ ID NO: 524281 - RNA, 21 nt, Human
uuccaggacuuucugccuccc

SEQ ID NO: 524282 - RNA, 18 nt, Human
uugcagagggaggacagg

SEQ ID NO: 524283 - RNA, 25 nt, Human
uugggcucccuggggaggggguggu

SEQ ID NO: 524284 - RNA, 20 nt, Human
uugguuugagagcaguucau

SEQ ID NO: 524285 - RNA, 24 nt, Human
uuuaacccaaccucaaaaagcagg

SEQ ID NO: 524286 - RNA, 21 nt, Human
uuugcauaagauggacugggu

SEQ ID NO: 524287 - RNA, 22 nt, Human
uuuguugguuugagagcaguuc

SEQ ID NO: 524288 - RNA, 20 nt, Human
uuuuuuuuuuugagacagag

SEQ ID NO: 524289 - RNA, 22 nt, Human
aauuauccagccaugagcccug

SEQ ID NO: 524290 - RNA, 22 nt, Human
acagagcugcucacagauacca

SEQ ID NO: 524291 - RNA, 23 nt, Human
aggggcugggcaugguuggcuuu

SEQ ID NO: 524292 - RNA, 24 nt, Human
cacagagcugcucacagauaccac

SEQ ID NO: 524293 - RNA, 19 nt, Human
ccucucagggagaaaaccu

SEQ ID NO: 524294 - RNA, 21 nt, Human
cgucagaauucagaacgaugg

SEQ ID NO: 524295 - RNA, 22 nt, Human
gaaaaccuuugaguccacagag

SEQ ID NO: 524296 - RNA, 24 nt, Human
gagcugcucacagauaccacugcc

SEQ ID NO: 524297 - RNA, 20 nt, Human
ggagaaaaccuuugagucca

SEQ ID NO: 524298 - RNA, 24 nt, Human
ggagaaaaccuuugaguccacaga

SEQ ID NO: 524299 - RNA, 22 nt, Human
ggcugggggugcugggaggggc

SEQ ID NO: 524300 - RNA, 20 nt, Human
ggggcugggggugcugggag

SEQ ID NO: 524301 - RNA, 26 nt, Human
ggggugcugggaggggcugggcaugg

SEQ ID NO: 524302 - RNA, 18 nt, Human
gugcugggaggggcuggg

SEQ ID NO: 524303 - RNA, 19 nt, Human
uaaaacgaggaugcgaagc

SEQ ID NO: 524304 - RNA, 18 nt, Human
uaaccaaaaauaaaacga

SEQ ID NO: 524305 - RNA, 21 nt, Human
uaaccaaaaauaaaacgagga

SEQ ID NO: 524306 - RNA, 24 nt, Human
uauccagccaugagcccuggccca

SEQ ID NO: 524307 - RNA, 20 nt, Human
ucacagauaccacugccugu

SEQ ID NO: 524308 - RNA, 23 nt, Human
ucucucgagcugcacucuuucuu

SEQ ID NO: 524309 - RNA, 26 nt, Human
ugaaucagcuggccugggucggaucc

SEQ ID NO: 524310 - RNA, 23 nt, Human
uggcuuugugaucuggggucugg

SEQ ID NO: 524311 - RNA, 18 nt, Human
ugggaggggcugggcaug

SEQ ID NO: 524312 - RNA, 18 nt, Human
ugggaggggcugggcaug

SEQ ID NO: 524313 - RNA, 20 nt, Human
ugggaggggcugggcauggu

SEQ ID NO: 524314 - RNA, 18 nt, Human
uggggcugggggugcugg

SEQ ID NO: 524315 - RNA, 18 nt, Human
uggggcugggggugcugg

SEQ ID NO: 524316 - RNA, 22 nt, Human
ugggggugcugggaggggcugg

SEQ ID NO: 524317 - RNA, 23 nt, Human
aaaaagaugugagccauaaaaau

SEQ ID NO: 524318 - RNA, 22 nt, Human
aaaaggaaauagacuuaaauua

SEQ ID NO: 524319 - RNA, 24 nt, Human
aaagugauaagauuacaggcauga

SEQ ID NO: 524320 - RNA, 18 nt, Human
aagcagauggagcugaac

SEQ ID NO: 524321 - RNA, 24 nt, Human
aaucauauaaccacugugucugag

SEQ ID NO: 524322 - RNA, 19 nt, Human
acacugggguuaguuuagc

SEQ ID NO: 524323 - RNA, 24 nt, Human
acagaaugaguaaccauuuccuau

SEQ ID NO: 524324 - RNA, 21 nt, Human
acaguuggaaaguuuggaggc

SEQ ID NO: 524325 - RNA, 24 nt, Human
acccaccuuuagaaggauucccau

SEQ ID NO: 524326 - RNA, 24 nt, Human
acuauguugaugaggcuggucuug

SEQ ID NO: 524327 - RNA, 18 nt, Human
agagauccucccaucuca

SEQ ID NO: 524328 - RNA, 22 nt, Human
agauuacaggcaugagccacug

SEQ ID NO: 524329 - RNA, 22 nt, Human
agauuacaggcaugagccacug

SEQ ID NO: 524330 - RNA, 24 nt, Human
agauuacaggcaugagccacugug

SEQ ID NO: 524331 - RNA, 18 nt, Human
agcaggaggucagggcug

SEQ ID NO: 524332 - RNA, 19 nt, Human
agcauuuuuauuuuucaug

SEQ ID NO: 524333 - RNA, 19 nt, Human
agcuguuuuacaucgcuug

SEQ ID NO: 524334 - RNA, 23 nt, Human
aggcaugagccacugugccuggc

SEQ ID NO: 524335 - RNA, 23 nt, Human
auagucuuauuuggcagaggggg

SEQ ID NO: 524336 - RNA, 23 nt, Human
aucagaaguuccuuacacaacag

SEQ ID NO: 524337 - RNA, 19 nt, Human
auggggucucacuauguug

SEQ ID NO: 524338 - RNA, 21 nt, Human
caaaaguacaagaaaaucagc

SEQ ID NO: 524339 - RNA, 24 nt, Human
caaagugauaagauuacaggcaug

SEQ ID NO: 524340 - RNA, 26 nt, Human
cacaaaaucauauaaccacugugucu

SEQ ID NO: 524341 - RNA, 24 nt, Human
cacuauguugaugaggcuggucuu

SEQ ID NO: 524342 - RNA, 27 nt, Human
cagcaaucagaaucagaaguuccuuac

SEQ ID NO: 524343 - RNA, 20 nt, Human
cagcaccccaacugcuuagu

SEQ ID NO: 524344 - RNA, 19 nt, Human
caggaggguuucucaaggg

SEQ ID NO: 524345 - RNA, 23 nt, Human
cauuaaaagaggauuaaaagcag

SEQ ID NO: 524346 - RNA, 24 nt, Human
ccaaagugauaagauuacaggcau

SEQ ID NO: 524347 - RNA, 19 nt, Human
cccacugcucccagcuguu

SEQ ID NO: 524348 - RNA, 20 nt, Human
cccauccacagcggcugagg

SEQ ID NO: 524349 - RNA, 24 nt, Human
cccccucagccgcccggcgggggc

SEQ ID NO: 524350 - RNA, 25 nt, Human
ccccuccgccuccacuccccaucca

SEQ ID NO: 524351 - RNA, 19 nt, Human
cccuccgccuccacucccc

SEQ ID NO: 524352 - RNA, 22 nt, Human
cccuccgccuccacuccccauc

SEQ ID NO: 524353 - RNA, 24 nt, Human
ccgcuccccuccgccuccacuccc

SEQ ID NO: 524354 - RNA, 23 nt, Human
ccucccaucucagccucccaaag

SEQ ID NO: 524355 - RNA, 18 nt, Human
ccuguauggacacaaaau

SEQ ID NO: 524356 - RNA, 18 nt, Human
cgccuccacuccccaucc

SEQ ID NO: 524357 - RNA, 22 nt, Human
cgccuccacuccccauccacag

SEQ ID NO: 524358 - RNA, 23 nt, Human
cgggcuccgcuccccuccgccuc

SEQ ID NO: 524359 - RNA, 19 nt, Human
cucaagagauccucccauc

SEQ ID NO: 524360 - RNA, 22 nt, Human
cugugccuggccagcucugccu

SEQ ID NO: 524361 - RNA, 25 nt, Human
cuuucuggcuucaguaaaaagaugu

SEQ ID NO: 524362 - RNA, 18 nt, Human
gauuacaggcaugagcca

SEQ ID NO: 524363 - RNA, 19 nt, Human
gauuacaggcaugagccac

SEQ ID NO: 524364 - RNA, 20 nt, Human
gcuccgcuccccuccgccuc

SEQ ID NO: 524365 - RNA, 22 nt, Human
gcuggucuugaacaccuggucu

SEQ ID NO: 524366 - RNA, 22 nt, Human
ggcuccgcuccccuccgccucc

SEQ ID NO: 524367 - RNA, 18 nt, Human
ggcugcuggauagauguu

SEQ ID NO: 524368 - RNA, 19 nt, Human
gugccuggccagcucugcc

SEQ ID NO: 524369 - RNA, 21 nt, Human
guguguguauguuaaacaugu

SEQ ID NO: 524370 - RNA, 19 nt, Human
uaaaagcaguguugguuuu

SEQ ID NO: 524371 - RNA, 19 nt, Human
uaaaaugccauuagcaugg

SEQ ID NO: 524372 - RNA, 22 nt, Human
uaaaaugccauuagcauggugg

SEQ ID NO: 524373 - RNA, 21 nt, Human
uaagauuacaggcaugagcca

SEQ ID NO: 524374 - RNA, 23 nt, Human
uaagauuacaggcaugagccacu

SEQ ID NO: 524375 - RNA, 24 nt, Human
uaagauuacaggcaugagccacug

SEQ ID NO: 524376 - RNA, 24 nt, Human
uaauagagauggggucucacuaug

SEQ ID NO: 524377 - RNA, 18 nt, Human
uaaucugacucagaaguc

SEQ ID NO: 524378 - RNA, 22 nt, Human
uacaggcaugagccacugugcc

SEQ ID NO: 524379 - RNA, 23 nt, Human
uagaaugaaagagguugcaacuu

SEQ ID NO: 524380 - RNA, 22 nt, Human
uagagauggggucucacuaugu

SEQ ID NO: 524381 - RNA, 25 nt, Human
uagcaaaucaccaccuggugauucg

SEQ ID NO: 524382 - RNA, 18 nt, Human
uauacagauauauguaua

SEQ ID NO: 524383 - RNA, 22 nt, Human
uauauuuaaaaugccauuagca

SEQ ID NO: 524384 - RNA, 23 nt, Human
uaugcagccuuguuucagaacac

SEQ ID NO: 524385 - RNA, 20 nt, Human
uauguguuuaagugugugua

SEQ ID NO: 524386 - RNA, 22 nt, Human
uauguguuuaaguguguguaug

SEQ ID NO: 524387 - RNA, 24 nt, Human
uauguugaugaggcuggucuugaa

SEQ ID NO: 524388 - RNA, 24 nt, Human
uauuuuguguuuuuugcugcagaa

SEQ ID NO: 524389 - RNA, 21 nt, Human
ucaaguaacagcaaucagaau

SEQ ID NO: 524390 - RNA, 22 nt, Human
ucaccugccuuuuuacuaucaa

SEQ ID NO: 524391 - RNA, 18 nt, Human
ucagggcugcuggauaga

SEQ ID NO: 524392 - RNA, 18 nt, Human
ucauuuggaauuuccuca

SEQ ID NO: 524393 - RNA, 24 nt, Human
ucccaaagugauaagauuacaggc

SEQ ID NO: 524394 - RNA, 18 nt, Human
uccccauccacagcggcu

SEQ ID NO: 524395 - RNA, 25 nt, Human
uccgggcuccgcuccccuccgccuc

SEQ ID NO: 524396 - RNA, 20 nt, Human
uccucccaucucagccuccc

SEQ ID NO: 524397 - RNA, 24 nt, Human
uccuguggacaaaauuccuccuuu

SEQ ID NO: 524398 - RNA, 24 nt, Human
ucucacuauguugaugaggcuggu

SEQ ID NO: 524399 - RNA, 24 nt, Human
ugaacagaugcccuuuuuaaaugc

SEQ ID NO: 524400 - RNA, 23 nt, Human
ugaagacaccaaggccucuccug

SEQ ID NO: 524401 - RNA, 23 nt, Human
ugaggcuggucuugaacaccugg

SEQ ID NO: 524402 - RNA, 20 nt, Human
ugauacugaagaucuaggcu

SEQ ID NO: 524403 - RNA, 20 nt, Human
ugcaugaaccacuucugcau

SEQ ID NO: 524404 - RNA, 21 nt, Human
uggacacaaaaucauauaacc

SEQ ID NO: 524405 - RNA, 19 nt, Human
uggcagagggggauagcca

SEQ ID NO: 524406 - RNA, 24 nt, Human
ugggcacuuuaguuugccacagcu

SEQ ID NO: 524407 - RNA, 24 nt, Human
uggggucucacuauguugaugagg

SEQ ID NO: 524408 - RNA, 23 nt, Human
uggguuguggauagucuuauuug

SEQ ID NO: 524409 - RNA, 21 nt, Human
ugucugagcuggguuguggau

SEQ ID NO: 524410 - RNA, 21 nt, Human
ugugagccauaaaaauccaaa

SEQ ID NO: 524411 - RNA, 19 nt, Human
uguguuuaaguguguguau

SEQ ID NO: 524412 - RNA, 21 nt, Human
uguguuuuuugcugcagaauc

SEQ ID NO: 524413 - RNA, 24 nt, Human
uuaauagagauggggucucacuau

SEQ ID NO: 524414 - RNA, 21 nt, Human
uucaucuggaauaaaaaucug

SEQ ID NO: 524415 - RNA, 18 nt, Human
uuuauguguuuaagugug

SEQ ID NO: 524416 - RNA, 18 nt, Human
uuugaggugccuuucugg

SEQ ID NO: 524417 - RNA, 23 nt, Human
uuuggaauuuccucaccuuccug

SEQ ID NO: 524418 - RNA, 19 nt, Human
uuuuuaauagagauggggu

SEQ ID NO: 524419 - RNA, 19 nt, Human
aaaaacagcuccuaccuaa

SEQ ID NO: 524420 - RNA, 23 nt, Human
aaaaagucuaaaaaaauagaaaa

SEQ ID NO: 524421 - RNA, 19 nt, Human
aaaaauagaaaacucucuc

SEQ ID NO: 524422 - RNA, 20 nt, Human
aaaacucucuccauaccugg

SEQ ID NO: 524423 - RNA, 24 nt, Human
aaagugcugggauuacagguguga

SEQ ID NO: 524424 - RNA, 20 nt, Human
aacagcuccuaccuaaaguu

SEQ ID NO: 524425 - RNA, 18 nt, Human
aacaguggucucugggga

SEQ ID NO: 524426 - RNA, 18 nt, Human
aacuggacucuggcggcg

SEQ ID NO: 524427 - RNA, 20 nt, Human
aacuggggugaggggaaguu

SEQ ID NO: 524428 - RNA, 18 nt, Human
aacuuacuucuuccacug

SEQ ID NO: 524429 - RNA, 19 nt, Human
aagcaaauaugcuuggauc

SEQ ID NO: 524430 - RNA, 21 nt, Human
aagcaagugguuacacaaaca

SEQ ID NO: 524431 - RNA, 20 nt, Human
aagcagagaucuaacaagac

SEQ ID NO: 524432 - RNA, 25 nt, Human
aagcagagaucuaacaagacaauga

SEQ ID NO: 524433 - RNA, 20 nt, Human
aagccaaugaaguuauggga

SEQ ID NO: 524434 - RNA, 18 nt, Human
aagugcugggauuacagg

SEQ ID NO: 524435 - RNA, 19 nt, Human
aagugcugggauuacaggu

SEQ ID NO: 524436 - RNA, 26 nt, Human
aagugcugggauuacaggugugagcc

SEQ ID NO: 524437 - RNA, 24 nt, Human
acaauugcaacuggggugagggga

SEQ ID NO: 524438 - RNA, 26 nt, Human
acacaaacaucuaauaauacuaaaau

SEQ ID NO: 524439 - RNA, 21 nt, Human
accaagagaugaaaacacugu

SEQ ID NO: 524440 - RNA, 24 nt, Human
accauguuggccaggauggucucg

SEQ ID NO: 524441 - RNA, 18 nt, Human
acgggguuucaccauguu

SEQ ID NO: 524442 - RNA, 23 nt, Human
acgggguuucaccauguuggcca

SEQ ID NO: 524443 - RNA, 24 nt, Human
acgggguuucaccauguuggccag

SEQ ID NO: 524444 - RNA, 21 nt, Human
acuauucaacagacuacaauc

SEQ ID NO: 524445 - RNA, 18 nt, Human
agcugcgaccuaagcaga

SEQ ID NO: 524446 - RNA, 24 nt, Human
aggaacaguuuggcuuaucaugug

SEQ ID NO: 524447 - RNA, 18 nt, Human
aggcaguacucaaaauuc

SEQ ID NO: 524448 - RNA, 22 nt, Human
aggcagugaaaaaccuuuugca

SEQ ID NO: 524449 - RNA, 25 nt, Human
aggcuggagugcagugguaugaucu

SEQ ID NO: 524450 - RNA, 24 nt, Human
agguugcucucuugaaacacauuu

SEQ ID NO: 524451 - RNA, 22 nt, Human
aguagagacgggguuucaccau

SEQ ID NO: 524452 - RNA, 18 nt, Human
aguagcugggauuacagg

SEQ ID NO: 524453 - RNA, 20 nt, Human
agugcagugguaugaucucg

SEQ ID NO: 524454 - RNA, 23 nt, Human
agugcagugguaugaucucggcu

SEQ ID NO: 524455 - RNA, 24 nt, Human
agugcagugguaugaucucggcuc

SEQ ID NO: 524456 - RNA, 24 nt, Human
agugguaugaucucggcucacugu

SEQ ID NO: 524457 - RNA, 18 nt, Human
auagaaaacaaacuaguc

SEQ ID NO: 524458 - RNA, 21 nt, Human
augaagcauagcuauguuugc

SEQ ID NO: 524459 - RNA, 33 nt, Human; identical to SEQ ID NO: 258803

SEQ ID NO: 524460 - RNA, 24 nt, Human
caaaauacagcuagagaaauacaa

SEQ ID NO: 524461 - RNA, 18 nt, Human
caaacaaaaacagcuccu

SEQ ID NO: 524462 - RNA, 24 nt, Human
caaagugcugggauuacaggugug

SEQ ID NO: 524463 - RNA, 21 nt, Human
caagaaauaucgcagagugac

SEQ ID NO: 524464 - RNA, 20 nt, Human
caagcgauucuccugccuca

SEQ ID NO: 524465 - RNA, 22 nt, Human
caagcgauucuccugccucagc

SEQ ID NO: 524466 - RNA, 18 nt, Human
caccauguuggccaggau

SEQ ID NO: 524467 - RNA, 22 nt, Human
caccauguuggccaggaugguc

SEQ ID NO: 524468 - RNA, 24 nt, Human
caccauguuggccaggauggucuc

SEQ ID NO: 524469 - RNA, 21 nt, Human
cacuguaaccuccaccucccg

SEQ ID NO: 524470 - RNA, 23 nt, Human
cacuguaaccuccaccucccggg

SEQ ID NO: 524471 - RNA, 22 nt, Human
cagaaugagauucagcuaaacc

SEQ ID NO: 524472 - RNA, 24 nt, Human
cagaaugagguccaagcaugaacc

SEQ ID NO: 524473 - RNA, 21 nt, Human
caggcacccaccaccacgccc

SEQ ID NO: 524474 - RNA, 21 nt, Human
ccaaagugcugggauuacagg

SEQ ID NO: 524475 - RNA, 21 nt, Human
ccaaagugcugggauuacagg

SEQ ID NO: 524476 - RNA, 24 nt, Human
ccaaagugcugggauuacaggugu

SEQ ID NO: 524477 - RNA, 19 nt, Human
ccaagagaugaaaacacug

SEQ ID NO: 524478 - RNA, 24 nt, Human
ccaccucccggguucaagcgauuc

SEQ ID NO: 524479 - RNA, 21 nt, Human
cccaccaccacgcccagcuaa

SEQ ID NO: 524480 - RNA, 23 nt, Human
ccccaaagugcugggauuacagg

SEQ ID NO: 524481 - RNA, 26 nt, Human
ccccaggcgcuccggcuacgcgcucc

SEQ ID NO: 524482 - RNA, 23 nt, Human
cccgaguagcugggauuacaggc

SEQ ID NO: 524483 - RNA, 24 nt, Human
cccgaguagcugggauuacaggca

SEQ ID NO: 524484 - RNA, 23 nt, Human
cccggguucaagcgauucuccug

SEQ ID NO: 524485 - RNA, 23 nt, Human
ccgaguagcugggauuacaggca

SEQ ID NO: 524486 - RNA, 24 nt, Human
ccggcgcgcggcggcguggucuuc

SEQ ID NO: 524487 - RNA, 23 nt, Human
ccucagcuccccaaagugcuggg

SEQ ID NO: 524488 - RNA, 24 nt, Human
ccucccggguucaagcgauucucc

SEQ ID NO: 524489 - RNA, 23 nt, Human
ccugccucagccucccgaguagc

SEQ ID NO: 524490 - RNA, 24 nt, Human
cgccaggcuggagugcagugguau

SEQ ID NO: 524491 - RNA, 22 nt, Human
cuagcagcaguagucaugaaaa

SEQ ID NO: 524492 - RNA, 25 nt, Human
cucaaguaauugcuuccaaauuugc

SEQ ID NO: 524493 - RNA, 24 nt, Human
cucacuguaaccuccaccucccgg

SEQ ID NO: 524494 - RNA, 24 nt, Human
cucagccucccgaguagcugggau

SEQ ID NO: 524495 - RNA, 24 nt, Human
cucuugaccucgugauccgcccgc

SEQ ID NO: 524496 - RNA, 23 nt, Human
cugccucagccucccgaguagcu

SEQ ID NO: 524497 - RNA, 24 nt, Human
cuggagugcagugguaugaucucg

SEQ ID NO: 524498 - RNA, 21 nt, Human
cuguaaccuccaccucccggg

SEQ ID NO: 524499 - RNA, 24 nt, Human
cuguaaccuccaccucccggguuc

SEQ ID NO: 524500 - RNA, 33 nt, Human
cuguacuauuuuauuuauuuauuuauuuauuuu

SEQ ID NO: 524501 - RNA, 19 nt, Human
cuuguaagccucaugaagc

SEQ ID NO: 524502 - RNA, 22 nt, Human
gaauuaugaccaagagaugaaa

SEQ ID NO: 524503 - RNA, 22 nt, Human
gaccucgugauccgcccgccuc

SEQ ID NO: 524504 - RNA, 24 nt, Human
gaccucgugauccgcccgccucag

SEQ ID NO: 524505 - RNA, 19 nt, Human
gacuuagcuuagguugcuc

SEQ ID NO: 524506 - RNA, 24 nt, Human
gagacgggguuucaccauguuggc

SEQ ID NO: 524507 - RNA, 25 nt, Human
gaguagcugggauuacaggcaccca

SEQ ID NO: 524508 - RNA, 20 nt, Human
gagucuugcucugucgccag

SEQ ID NO: 524509 - RNA, 18 nt, Human
gauuacaggugugagcca

SEQ ID NO: 524510 - RNA, 22 nt, Human
gauuacaggugugagccacugc

SEQ ID NO: 524511 - RNA, 22 nt, Human
gauuacaggugugagccacugc

SEQ ID NO: 524512 - RNA, 21 nt, Human
gauucuccugccucagccucc

SEQ ID NO: 524513 - RNA, 20 nt, Human
gccacaauaugagcagucac

SEQ ID NO: 524514 - RNA, 23 nt, Human
gccacaauaugagcagucacugg

SEQ ID NO: 524515 - RNA, 23 nt, Human
gccucagcuccccaaagugcugg

SEQ ID NO: 524516 - RNA, 24 nt, Human
gcgauucuccugccucagccuccc

SEQ ID NO: 524517 - RNA, 25 nt, Human
ggcaugcauacaaucacugugugca

SEQ ID NO: 524518 - RNA, 23 nt, Human
gggguuucaccauguuggccagg

SEQ ID NO: 524519 - RNA, 22 nt, Human
ggguuucaccauguuggccagg

SEQ ID NO: 524520 - RNA, 21 nt, Human
gguauaaaauaccauggguau

SEQ ID NO: 524521 - RNA, 24 nt, Human
gguuucaccauguuggccaggaug

SEQ ID NO: 524522 - RNA, 23 nt, Human
guagagacgggguuucaccaugu

SEQ ID NO: 524523 - RNA, 18 nt, Human
guagcugggauuacaggc

SEQ ID NO: 524524 - RNA, 24 nt, Human
gucuugcucugucgccaggcugga

SEQ ID NO: 524525 - RNA, 23 nt, Human
gugauccgcccgccucagcuccc

SEQ ID NO: 524526 - RNA, 19 nt, Human
guggucucuggggaucucg

SEQ ID NO: 524527 - RNA, 19 nt, Human
uaaaauaccauggguauga

SEQ ID NO: 524528 - RNA, 20 nt, Human
uaaaauaccauggguaugaa

SEQ ID NO: 524529 - RNA, 23 nt, Human
uaaauaagcaagugguuacacaa

SEQ ID NO: 524530 - RNA, 21 nt, Human
uaacccaguuccgcaagaggc

SEQ ID NO: 524531 - RNA, 19 nt, Human
uaagugucaacuggacucu

SEQ ID NO: 524532 - RNA, 20 nt, Human
uaauauugccccuugacaua

SEQ ID NO: 524533 - RNA, 25 nt, Human
uaauuuuuguuauuuuuaguagaga

SEQ ID NO: 524534 - RNA, 19 nt, Human
uacaggugugagccacugc

SEQ ID NO: 524535 - RNA, 23 nt, Human
uacaggugugagccacugcgccc

SEQ ID NO: 524536 - RNA, 18 nt, Human
uacaguagaaugacaugu

SEQ ID NO: 524537 - RNA, 21 nt, Human
uaccauggguaugaaaugcca

SEQ ID NO: 524538 - RNA, 23 nt, Human
uagaaaacaaacuagucagcacu

SEQ ID NO: 524539 - RNA, 22 nt, Human
uagagacgggguuucaccaugu

SEQ ID NO: 524540 - RNA, 24 nt, Human
uaguagagacgggguuucaccaug

SEQ ID NO: 524541 - RNA, 25 nt, Human
uaguagagacgggguuucaccaugu

SEQ ID NO: 524542 - RNA, 18 nt, Human
uaucaaggcaagauguaa

SEQ ID NO: 524543 - RNA, 19 nt, Human
uaucaaggcaagauguaac

SEQ ID NO: 524544 - RNA, 23 nt, Human
uauuuauuuuugagauggagucu

SEQ ID NO: 524545 - RNA, 27 nt, Human
ucaaaguaagugucaacuggacuccug

SEQ ID NO: 524546 - RNA, 19 nt, Human
ucaauaaauuaaaaggcuu

SEQ ID NO: 524547 - RNA, 24 nt, Human
ucaccauguuggccaggauggucu

SEQ ID NO: 524548 - RNA, 23 nt, Human
ucacuguaaccuccaccucccgg

SEQ ID NO: 524549 - RNA, 24 nt, Human
ucacuguaaccuccaccucccggg

SEQ ID NO: 524550 - RNA, 25 nt, Human
ucacuguaaccuccaccucccgggu

SEQ ID NO: 524551 - RNA, 20 nt, Human
ucagccucccgaguagcugg

SEQ ID NO: 524552 - RNA, 20 nt, Human
uccccaaagugcugggauua

SEQ ID NO: 524553 - RNA, 24 nt, Human
uccccaaagugcugggauuacagg

SEQ ID NO: 524554 - RNA, 23 nt, Human
uccccaagcaaauaugcuuggau

SEQ ID NO: 524555 - RNA, 19 nt, Human
uccccaggcgcuccggcua

SEQ ID NO: 524556 - RNA, 24 nt, Human
ucccgaguagcugggauuacaggc

SEQ ID NO: 524557 - RNA, 21 nt, Human
ucccggguucaagcgauucuc

SEQ ID NO: 524558 - RNA, 24 nt, Human
ucccggguucaagcgauucuccug

SEQ ID NO: 524559 - RNA, 18 nt, Human
uccgcccgccucagcucc

SEQ ID NO: 524560 - RNA, 21 nt, Human
uccgcccgccucagcucccca

SEQ ID NO: 524561 - RNA, 24 nt, Human
ucuccugccucagccucccgagua

SEQ ID NO: 524562 - RNA, 18 nt, Human
ucugucgccaggcuggag

SEQ ID NO: 524563 - RNA, 21 nt, Human
ucugucgccaggcuggagugc

SEQ ID NO: 524564 - RNA, 23 nt, Human
ucugucgccaggcuggagugcag

SEQ ID NO: 524565 - RNA, 18 nt, Human
ucuuccacugauacaaga

SEQ ID NO: 524566 - RNA, 21 nt, Human
ucuugcucugucgccaggcug

SEQ ID NO: 524567 - RNA, 21 nt, Human
ucuugcucugucgccaggcug

SEQ ID NO: 524568 - RNA, 22 nt, Human
ucuugcucugucgccaggcugg

SEQ ID NO: 524569 - RNA, 23 nt, Human
ucuugcucugucgccaggcugga

SEQ ID NO: 524570 - RNA, 23 nt, Human
ugaaaugccaugguaaauacuau

SEQ ID NO: 524571 - RNA, 22 nt, Human
ugaaccuggcuugaagagcuag

SEQ ID NO: 524572 - RNA, 23 nt, Human
ugaacuguccucaaguaauugcu

SEQ ID NO: 524573 - RNA, 20 nt, Human
ugacauguaauuuauucaua

SEQ ID NO: 524574 - RNA, 22 nt, Human
ugagauggagucuugcucuguc

SEQ ID NO: 524575 - RNA, 23 nt, Human
ugagcugcgaccuaagcagagau

SEQ ID NO: 524576 - RNA, 22 nt, Human
ugcaguacuucaaacaaaaaca

SEQ ID NO: 524577 - RNA, 23 nt, Human
ugccaugguaaauacuauucaac

SEQ ID NO: 524578 - RNA, 24 nt, Human
ugccucagccucccgaguagcugg

SEQ ID NO: 524579 - RNA, 23 nt, Human
ugcucugucgccaggcuggagug

SEQ ID NO: 524580 - RNA, 24 nt, Human
ugcugggauuacaggugugagcca

SEQ ID NO: 524581 - RNA, 18 nt, Human
uggagucuugcucugucg

SEQ ID NO: 524582 - RNA, 19 nt, Human
uggagugcagugguaugau

SEQ ID NO: 524583 - RNA, 24 nt, Human
uggagugcagugguaugaucucgg

SEQ ID NO: 524584 - RNA, 24 nt, Human
uggccaggauggucucgaucucuu

SEQ ID NO: 524585 - RNA, 19 nt, Human
ugggauuacaggcacccac

SEQ ID NO: 524586 - RNA, 21 nt, Human
ugggauuacaggcacccacca

SEQ ID NO: 524587 - RNA, 24 nt, Human
ugggauuacaggcacccaccacca

SEQ ID NO: 524588 - RNA, 18 nt, Human
ugggauuacaggugugag

SEQ ID NO: 524589 - RNA, 19 nt, Human
ugggauuacaggugugagc

SEQ ID NO: 524590 - RNA, 21 nt, Human
ugggauuacaggugugagcca

SEQ ID NO: 524591 - RNA, 22 nt, Human
ugggauuacaggugugagccac

SEQ ID NO: 524592 - RNA, 22 nt, Human
ugggauuacaggugugagccac

SEQ ID NO: 524593 - RNA, 24 nt, Human
ugggauuacaggugugagccacug

SEQ ID NO: 524594 - RNA, 24 nt, Human
ugguaugaucucggcucacuguaa

SEQ ID NO: 524595 - RNA, 20 nt, Human
ugugugcauucaaugcgugg

SEQ ID NO: 524596 - RNA, 18 nt, Human
uuaguagagacgggguuu

SEQ ID NO: 524597 - RNA, 22 nt, Human
uuaguagagacgggguuucacc

SEQ ID NO: 524598 - RNA, 24 nt, Human
uuaguagagacgggguuucaccau

SEQ ID NO: 524599 - RNA, 18 nt, Human
uuauuuauuuauuuauuu

SEQ ID NO: 524600 - RNA, 18 nt, Human
uuauuuauuuauuuauuu

SEQ ID NO: 524601 - RNA, 19 nt, Human
uuauuuauuuauuuauuua

SEQ ID NO: 524602 - RNA, 19 nt, Human
uuauuuauuuauuuauuua

SEQ ID NO: 524603 - RNA, 19 nt, Human
uuauuuauuuauuuauuua

SEQ ID NO: 524604 - RNA, 19 nt, Human
uuauuuauuuauuuauuua

SEQ ID NO: 524605 - RNA, 19 nt, Human
uuauuuauuuauuuauuua

SEQ ID NO: 524606 - RNA, 25 nt, Human
uuauuuauuuauuuauuuauuuauu

SEQ ID NO: 524607 - RNA, 25 nt, Human
uuauuuauuuauuuauuuauuuauu

SEQ ID NO: 524608 - RNA, 25 nt, Human
uuauuuauuuauuuauuuauuuauu

SEQ ID NO: 524609 - RNA, 25 nt, Human
uuauuuauuuauuuauuuauuuauu

SEQ ID NO: 524610 - RNA, 25 nt, Human
uuauuuauuuauuuauuuauuuauu

SEQ ID NO: 524611 - RNA, 25 nt, Human
uuauuuauuuauuuauuuauuuauu

SEQ ID NO: 524612 - RNA, 25 nt, Human
uuauuuauuuauuuauuuauuuauu

SEQ ID NO: 524613 - RNA, 25 nt, Human
uuauuuauuuauuuauuuauuuauu

SEQ ID NO: 524614 - RNA, 21 nt, Human
uucaagcgauucuccugccuc

SEQ ID NO: 524615 - RNA, 23 nt, Human
uucaagcgauucuccugccucag

SEQ ID NO: 524616 - RNA, 24 nt, Human
uucaagcgauucuccugccucagc

SEQ ID NO: 524617 - RNA, 22 nt, Human
uucaucuccgccuuccccaggc

SEQ ID NO: 524618 - RNA, 22 nt, Human
uuccaaacuaaaucaugguuuu

SEQ ID NO: 524619 - RNA, 23 nt, Human
uuccccaggcgcuccggcuacgc

SEQ ID NO: 524620 - RNA, 24 nt, Human
uucuuuaaugcugaauuaugaggg

SEQ ID NO: 524621 - RNA, 19 nt, Human
uuucaccauguuggccagg

SEQ ID NO: 524622 - RNA, 20 nt, Human
uuucaccauguuggccagga

SEQ ID NO: 524623 - RNA, 24 nt, Human
uuuuuaguagagacgggguuucac

SEQ ID NO: 524624 - RNA, 24 nt, Human
uuuuugagauggagucuugcucug

SEQ ID NO: 524625 - RNA, 21 nt, Human
uuuuuguuauuuuuaguagag

SEQ ID NO: 524626 - RNA, 24 nt, Human
uuuuuguuauuuuuaguagagacg

SEQ ID NO: 524627 - RNA, 19 nt, Human
aaacaugcacacagcagcc

SEQ ID NO: 524628 - RNA, 21 nt, Human
aaacaugcacacagcagccuu

SEQ ID NO: 524629 - RNA, 22 nt, Human
aaacaugcacacagcagccuuc

SEQ ID NO: 524630 - RNA, 19 nt, Human
aaacggacagagaagacac

SEQ ID NO: 524631 - RNA, 18 nt, Human
aaacuggggccaauggga

SEQ ID NO: 524632 - RNA, 18 nt, Human
aagcagaacccacuaaaa

SEQ ID NO: 524633 - RNA, 20 nt, Human
aagcuaacauauacagccuc

SEQ ID NO: 524634 - RNA, 24 nt, Human
acaauuucaacccaaauacaccac

SEQ ID NO: 524635 - RNA, 24 nt, Human
acacaauuucaacccaaauacacc

SEQ ID NO: 524636 - RNA, 22 nt, Human
acacacacuguuuugaaaacac

SEQ ID NO: 524637 - RNA, 24 nt, Human
acacagcagccuucaaaugucucu

SEQ ID NO: 524638 - RNA, 19 nt, Human
acacauucuuacacaagcu

SEQ ID NO: 524639 - RNA, 18 nt, Human
acagcagccuucaaaugu

SEQ ID NO: 524640 - RNA, 23 nt, Human
acgcucaccucaccuggugcacg

SEQ ID NO: 524641 - RNA, 19 nt, Human
acugccccauuuguaugug

SEQ ID NO: 524642 - RNA, 24 nt, Human
agagcguggggugacaggaguggg

SEQ ID NO: 524643 - RNA, 23 nt, Human
agccccuugacugagcaagcugg

SEQ ID NO: 524644 - RNA, 22 nt, Human
aggacgggguggggagaggggu

SEQ ID NO: 524645 - RNA, 18 nt, Human
aggcaggagccccccaag

SEQ ID NO: 524646 - RNA, 22 nt, Human
aggggacauuuggugggaggca

SEQ ID NO: 524647 - RNA, 23 nt, Human
agguggccaacugugaccagugg

SEQ ID NO: 524648 - RNA, 20 nt, Human
aucugggcugcaauacuucu

SEQ ID NO: 524649 - RNA, 25 nt, Human
aucuuacccacguucuuucucccca

SEQ ID NO: 524650 - RNA, 23 nt, Human
augggauccugggcccuucccug

SEQ ID NO: 524651 - RNA, 20 nt, Human
augggggcagcuuggccaca

SEQ ID NO: 524652 - RNA, 22 nt, Human
cacacauccaugcacacaacug

SEQ ID NO: 524653 - RNA, 18 nt, Human
caccggggucucaccagg

SEQ ID NO: 524654 - RNA, 27 nt, Human
cacuguacucuagccacaaggcugugg

SEQ ID NO: 524655 - RNA, 21 nt, Human
cagacccccaaacaugcacac

SEQ ID NO: 524656 - RNA, 30 nt, Human
cagagcaacucucacguauucugugcacuu

SEQ ID NO: 524657 - RNA, 19 nt, Human
cagcaggggugggcaaccc

SEQ ID NO: 524658 - RNA, 23 nt, Human
cagcaggggugggcaacccugcc

SEQ ID NO: 524659 - RNA, 20 nt, Human
cagcccagggcgauccacag

SEQ ID NO: 524660 - RNA, 20 nt, Human
caggcaggagccccccaagg

SEQ ID NO: 524661 - RNA, 19 nt, Human
caggggggcugagggggug

SEQ ID NO: 524662 - RNA, 24 nt, Human
caugcacacugccccauuuguaug

SEQ ID NO: 524663 - RNA, 18 nt, Human
caugucugucucugaaau

SEQ ID NO: 524664 - RNA, 24 nt, Human
ccaauacacacacuguuuugaaaa

SEQ ID NO: 524665 - RNA, 21 nt, Human
ccacuguacucuagccacaag

SEQ ID NO: 524666 - RNA, 23 nt, Human
ccacuguacucuagccacaaggc

SEQ ID NO: 524667 - RNA, 21 nt, Human
ccagcccagggcgauccacag

SEQ ID NO: 524668 - RNA, 21 nt, Human
cccaaacaugcacacagcagc

SEQ ID NO: 524669 - RNA, 24 nt, Human
cccacgcacacauccaugcacaca

SEQ ID NO: 524670 - RNA, 23 nt, Human
cccacuguacucuagccacaagg

SEQ ID NO: 524671 - RNA, 22 nt, Human
ccccacuguacucuagccacaa

SEQ ID NO: 524672 - RNA, 23 nt, Human
cccccaaacaugcacacagcagc

SEQ ID NO: 524673 - RNA, 21 nt, Human
cccccugauaggggaucuggg

SEQ ID NO: 524674 - RNA, 23 nt, Human
ccgccuuuuugcuucucucuggc

SEQ ID NO: 524675 - RNA, 22 nt, Human
ccucccaggcaugggauccugg

SEQ ID NO: 524676 - RNA, 22 nt, Human
ccugccagcuggguacuagggc

SEQ ID NO: 524677 - RNA, 18 nt, Human
ccuggggcgcugccuggg

SEQ ID NO: 524678 - RNA, 19 nt, Human
cgacuuccugauuccaucu

SEQ ID NO: 524679 - RNA, 20 nt, Human
cgcugccuggguccauugca

SEQ ID NO: 524680 - RNA, 21 nt, Human
cuacaacccaucacauaccua

SEQ ID NO: 524681 - RNA, 23 nt, Human
cucaccaggacuccccgcuccca

SEQ ID NO: 524682 - RNA, 23 nt, Human
cugaaauaaaagcagaacccacu

SEQ ID NO: 524683 - RNA, 19 nt, Human
cugcaauacuucuguaucc

SEQ ID NO: 524684 - RNA, 21 nt, Human
cugccagagcaacucucacgu

SEQ ID NO: 524685 - RNA, 26 nt, Human
cuggccccugcuuuugggaggucgac

SEQ ID NO: 524686 - RNA, 20 nt, Human
cugggcugcaauacuucugu

SEQ ID NO: 524687 - RNA, 23 nt, Human
cuggugcacgcucccuugaaccu

SEQ ID NO: 524688 - RNA, 20 nt, Human
gaaauaaaagcagaacccac

SEQ ID NO: 524689 - RNA, 27 nt, Human
gacaggacgggguggggagaggggugg

SEQ ID NO: 524690 - RNA, 22 nt, Human
gacgggguggggagaggggugg

SEQ ID NO: 524691 - RNA, 18 nt, Human
gagaagacacaugucugu

SEQ ID NO: 524692 - RNA, 24 nt, Human
gagaccaggcuggccccagccucc

SEQ ID NO: 524693 - RNA, 18 nt, Human
gagcguggggugacagga

SEQ ID NO: 524694 - RNA, 20 nt, Human
gaggacucuaggccaaggac

SEQ ID NO: 524695 - RNA, 22 nt, Human
gauaggcccuggcgggggccca

SEQ ID NO: 524696 - RNA, 21 nt, Human
gcaacaaugacacagcacgga

SEQ ID NO: 524697 - RNA, 19 nt, Human
gccuggcagccccuugacu

SEQ ID NO: 524698 - RNA, 18 nt, Human
ggacagcaggggugggca

SEQ ID NO: 524699 - RNA, 25 nt, Human
ggagaccaggcuggccccagccucc

SEQ ID NO: 524700 - RNA, 23 nt, Human
ggcaugggauccugggcccuucc

SEQ ID NO: 524701 - RNA, 23 nt, Human
ggcgcugccuggguccauugcag

SEQ ID NO: 524702 - RNA, 18 nt, Human
ggcugggaagggacaucu

SEQ ID NO: 524703 - RNA, 24 nt, Human
gggaaaggggaucccccacggggg

SEQ ID NO: 524704 - RNA, 21 nt, Human
ggggagagggguggauaggga

SEQ ID NO: 524705 - RNA, 19 nt, Human
gggguggggagaggggugg

SEQ ID NO: 524706 - RNA, 18 nt, Human
gguggggagaggggugga

SEQ ID NO: 524707 - RNA, 19 nt, Human
guggaacccuagaggaugg

SEQ ID NO: 524708 - RNA, 23 nt, Human
guggggugacaggagugggacug

SEQ ID NO: 524709 - RNA, 27 nt, Human
uaaaauggaaaaccugcagaaugcaaa

SEQ ID NO: 524710 - RNA, 22 nt, Human
uacacaagcuaacauauacagc

SEQ ID NO: 524711 - RNA, 19 nt, Human
uacucuagccacaaggcug

SEQ ID NO: 524712 - RNA, 22 nt, Human
uacucuagccacaaggcugugg

SEQ ID NO: 524713 - RNA, 20 nt, Human
uacuucuguauccucccugu

SEQ ID NO: 524714 - RNA, 18 nt, Human
uauuggggcuggaggguc

SEQ ID NO: 524715 - RNA, 21 nt, Human
ucaacccaaauacaccaccuc

SEQ ID NO: 524716 - RNA, 23 nt, Human
ucacacacaccucaccucccagg

SEQ ID NO: 524717 - RNA, 21 nt, Human
ucacauaccuaacacauaccc

SEQ ID NO: 524718 - RNA, 24 nt, Human
ucacauaccuaacacauacccauc

SEQ ID NO: 524719 - RNA, 19 nt, Human
ucccaauacacacacuguu

SEQ ID NO: 524720 - RNA, 27 nt, Human
uccccauggcauagaccaucgcuaccc

SEQ ID NO: 524721 - RNA, 18 nt, Human
ucccuaaacauauggauu

SEQ ID NO: 524722 - RNA, 22 nt, Human
uccugggcccuucccugagagc

SEQ ID NO: 524723 - RNA, 23 nt, Human
ucgcuacccgauggcuccaagug

SEQ ID NO: 524724 - RNA, 20 nt, Human
ucuguauccucccuguucuc

SEQ ID NO: 524725 - RNA, 21 nt, Human
ucuguauccucccuguucucu

SEQ ID NO: 524726 - RNA, 26 nt, Human
ugaaaacacauucuuacacaagcuaa

SEQ ID NO: 524727 - RNA, 19 nt, Human
ugaaauaaaagcagaaccc

SEQ ID NO: 524728 - RNA, 20 nt, Human
ugaauucuggggccacuccu

SEQ ID NO: 524729 - RNA, 21 nt, Human
ugacugagcaagcugggccca

SEQ ID NO: 524730 - RNA, 18 nt, Human
ugauugcuccuuccuauu

SEQ ID NO: 524731 - RNA, 20 nt, Human
ugcaauacuucuguauccuc

SEQ ID NO: 524732 - RNA, 25 nt, Human
ugcacagcuuugcaguuaaggacac

SEQ ID NO: 524733 - RNA, 28 nt, Human
ugcaugcacacugccccauuuguaugug

SEQ ID NO: 524734 - RNA, 18 nt, Human
ugccuggguccauugcag

SEQ ID NO: 524735 - RNA, 19 nt, Human
ugcggucaggggccugugg

SEQ ID NO: 524736 - RNA, 20 nt, Human
ugcggucaggggccugugga

SEQ ID NO: 524737 - RNA, 23 nt, Human
ugcggucaggggccuguggaacc

SEQ ID NO: 524738 - RNA, 25 nt, Human
uggacagcaggggugggcaacccug

SEQ ID NO: 524739 - RNA, 24 nt, Human
ugggaggacucuaggccaaggaca

SEQ ID NO: 524740 - RNA, 18 nt, Human
ugggauccugggcccuuc

SEQ ID NO: 524741 - RNA, 22 nt, Human
ugggauccugggcccuucccug

SEQ ID NO: 524742 - RNA, 18 nt, Human
ugggauccugggcccuuu

SEQ ID NO: 524743 - RNA, 25 nt, Human
ugggauggugucucgacuuccugau

SEQ ID NO: 524744 - RNA, 21 nt, Human
uggggccaaugggaacaaggg

SEQ ID NO: 524745 - RNA, 24 nt, Human
ugggggccuggcagccccuugacu

SEQ ID NO: 524746 - RNA, 19 nt, Human
uguacauuucagcauuugc

SEQ ID NO: 524747 - RNA, 22 nt, Human
ugugaccaguggucucagggcu

SEQ ID NO: 524748 - RNA, 21 nt, Human
ugugcgugcugaauucugggg

SEQ ID NO: 524749 - RNA, 21 nt, Human
uucaggggcaggcaagucgcc

SEQ ID NO: 524750 - RNA, 21 nt, Human
uuccuauuuucucaucugggg

SEQ ID NO: 524751 - RNA, 22 nt, Human
uuccuauuuucucaucuggggg

SEQ ID NO: 524752 - RNA, 19 nt, Human
uugacugagcaagcugggc

SEQ ID NO: 524753 - RNA, 20 nt, Human
uugcaugcacacugccccau

SEQ ID NO: 524754 - RNA, 21 nt, Human
uuggaggggaggacguccaug

SEQ ID NO: 524755 - RNA, 24 nt, Human
uuguaugugcacacucauugcccu

SEQ ID NO: 524756 - RNA, 23 nt, Human
uuugaaaacacauucuuacacaa

SEQ ID NO: 524757 - RNA, 20 nt, Human
uuuggucagguucagggggg

SEQ ID NO: 524758 - RNA, 23 nt, Human
uuuugcuucucucuggcagcucc

SEQ ID NO: 524759 - RNA, 25 nt, Human
aaacacauuuaaagcuucuagacuc

SEQ ID NO: 524760 - RNA, 19 nt, Human
aaacagagcaaggaaguac

SEQ ID NO: 524761 - RNA, 20 nt, Human
aaaugccuucgcucuacucu

SEQ ID NO: 524762 - RNA, 18 nt, Human
aacacacacacauaaaca

SEQ ID NO: 524763 - RNA, 18 nt, Human
aacauacuuucugcaaga

SEQ ID NO: 524764 - RNA, 21 nt, Human
aacuaaaaugaccuuucucac

SEQ ID NO: 524765 - RNA, 24 nt, Human
aagccgcugucuccucauuucuuc

SEQ ID NO: 524766 - RNA, 21 nt, Human
aagcugccacugggaaggggc

SEQ ID NO: 524767 - RNA, 19 nt, Human
acaagcaccaggaaaugcc

SEQ ID NO: 524768 - RNA, 23 nt, Human
accaaaugccuucgcucuacucu

SEQ ID NO: 524769 - RNA, 19 nt, Human
agaggcacuuuuaugagga

SEQ ID NO: 524770 - RNA, 24 nt, Human
agcugugcacaguuaauaauaggg

SEQ ID NO: 524771 - RNA, 22 nt, Human
aggaggccaaagagcucccaag

SEQ ID NO: 524772 - RNA, 20 nt, Human
aggcuccagugguuuucuua

SEQ ID NO: 524773 - RNA, 23 nt, Human
aggugaugugagcgaucuggagc

SEQ ID NO: 524774 - RNA, 23 nt, Human
auaucucuguugacaguaagaca

SEQ ID NO: 524775 - RNA, 18 nt, Human
aucaaaaaaggaagaucu

SEQ ID NO: 524776 - RNA, 24 nt, Human
augaaacaaagaaguuacuucuaa

SEQ ID NO: 524777 - RNA, 24 nt, Human
caaagagcucccaaggcuccagug

SEQ ID NO: 524778 - RNA, 19 nt, Human
caaagauaaccccugcuaa

SEQ ID NO: 524779 - RNA, 21 nt, Human
caaagauaaccccugcuaaga

SEQ ID NO: 524780 - RNA, 21 nt, Human
caagaugccaccucacuggcu

SEQ ID NO: 524781 - RNA, 20 nt, Human
caagauguguuauagcagaa

SEQ ID NO: 524782 - RNA, 19 nt, Human
caggaggccaaagagcucc

SEQ ID NO: 524783 - RNA, 21 nt, Human
caggaggccaaagagcuccca

SEQ ID NO: 524784 - RNA, 22 nt, Human
caggaggccaaagagcucccaa

SEQ ID NO: 524785 - RNA, 25 nt, Human
cagguacaauuuauauuauaaagaa

SEQ ID NO: 524786 - RNA, 19 nt, Human
caggugaugugagcgaucu

SEQ ID NO: 524787 - RNA, 20 nt, Human
cauuacagagucauucacaa

SEQ ID NO: 524788 - RNA, 23 nt, Human
ccaaagauaaccccugcuaagau

SEQ ID NO: 524789 - RNA, 19 nt, Human
ccaaaugccuucgcucuac

SEQ ID NO: 524790 - RNA, 20 nt, Human
ccaaggcuccagugguuuuc

SEQ ID NO: 524791 - RNA, 18 nt, Human
ccaggaggccaaagagcu

SEQ ID NO: 524792 - RNA, 25 nt, Human
ccagugguuuucuuagcucauuucc

SEQ ID NO: 524793 - RNA, 20 nt, Human
cccauguacuccacucccaa

SEQ ID NO: 524794 - RNA, 24 nt, Human
cguggcggggcccaagggcguguu

SEQ ID NO: 524795 - RNA, 19 nt, Human
cuggaaggcauaucuauua

SEQ ID NO: 524796 - RNA, 24 nt, Human
cuuuaaaauuguguauguauuuau

SEQ ID NO: 524797 - RNA, 22 nt, Human
gaagaucuuuuccugcuucucu

SEQ ID NO: 524798 - RNA, 19 nt, Human
gcaucugcugcuacuuugc

SEQ ID NO: 524799 - RNA, 18 nt, Human
gcccacuccccgcaagcu

SEQ ID NO: 524800 - RNA, 18 nt, Human
gcuaagauuuggguauau

SEQ ID NO: 524801 - RNA, 22 nt, Human
ggaaaaacauacuuucugcaag

SEQ ID NO: 524802 - RNA, 22 nt, Human
ggaaagauaacuaagacucagg

SEQ ID NO: 524803 - RNA, 23 nt, Human
gggcaagauguguuauagcagaa

SEQ ID NO: 524804 - RNA, 19 nt, Human
gggguuggaaaggggagac

SEQ ID NO: 524805 - RNA, 22 nt, Human
guagaaggcacaccuuugugua

SEQ ID NO: 524806 - RNA, 28 nt, Human
uaaaugauguccuaucuccccugaaagg

SEQ ID NO: 524807 - RNA, 24 nt, Human
uacaauuuauauuauaaagaagau

SEQ ID NO: 524808 - RNA, 18 nt, Human
uacaggugacuuuaaaau

SEQ ID NO: 524809 - RNA, 20 nt, Human
uagcagaauuaccaaaugcu

SEQ ID NO: 524810 - RNA, 22 nt, Human
uagugagccccuaucgugagcc

SEQ ID NO: 524811 - RNA, 22 nt, Human
uccacuccaucaacagccaugc

SEQ ID NO: 524812 - RNA, 23 nt, Human
uccacuccaucaacagccaugcg

SEQ ID NO: 524813 - RNA, 22 nt, Human
uccauggucaaugugcuccaaa

SEQ ID NO: 524814 - RNA, 24 nt, Human
ucccaaggcuccagugguuuucuu

SEQ ID NO: 524815 - RNA, 19 nt, Human
ucccauguacuccacuccc

SEQ ID NO: 524816 - RNA, 24 nt, Human
uccccaccuuaggucuuucuuaca

SEQ ID NO: 524817 - RNA, 23 nt, Human
uccucggucccagaggcuggcuc

SEQ ID NO: 524818 - RNA, 20 nt, Human
ugaagaaagcaaaaucccau

SEQ ID NO: 524819 - RNA, 25 nt, Human
ugaccgauccaccaaaugccuucgc

SEQ ID NO: 524820 - RNA, 18 nt, Human
ugaguugacucauagggg

SEQ ID NO: 524821 - RNA, 21 nt, Human
ugaucuucugacuuuguccuu

SEQ ID NO: 524822 - RNA, 18 nt, Human
ugaugugagcgaucugga

SEQ ID NO: 524823 - RNA, 23 nt, Human
ugcguaucacaauuuuaccaccc

SEQ ID NO: 524824 - RNA, 24 nt, Human
ugggaaccuacauugcugguguca

SEQ ID NO: 524825 - RNA, 23 nt, Human
ugggaaggggcugggaaccuaca

SEQ ID NO: 524826 - RNA, 21 nt, Human
ugggagagagcaguaacauuu

SEQ ID NO: 524827 - RNA, 23 nt, Human
uguaacguggcggggcccaaggg

SEQ ID NO: 524828 - RNA, 19 nt, Human
ugucccaggugaugugagc

SEQ ID NO: 524829 - RNA, 20 nt, Human
uguugugcuaaaguaauugg

SEQ ID NO: 524830 - RNA, 23 nt, Human
uuccauauacagugacuggacuc

SEQ ID NO: 524831 - RNA, 28 nt, Human
uucucacaucacuaagauguuccacucc

SEQ ID NO: 524832 - RNA, 22 nt, Human
uuggacauuuggcuaggacaag

SEQ ID NO: 524833 - RNA, 23 nt, Human
uuguagaucaaaaaaggaagauc

SEQ ID NO: 524834 - RNA, 20 nt, Human
uuuaaaauaucucuguugac

SEQ ID NO: 524835 - RNA, 19 nt, Human
uuuaaagcuucuagacuca

SEQ ID NO: 524836 - RNA, 27 nt, Human
aaaaaaaaaaaaaaagagacaguuaca

SEQ ID NO: 524837 - RNA, 25 nt, Human
aaaaaaggaaacacaauggguagaa

SEQ ID NO: 524838 - RNA, 24 nt, Human
aaaaaggaaacacaauggguagaa

SEQ ID NO: 524839 - RNA, 23 nt, Human
aaaaggaaacacaauggguagaa

SEQ ID NO: 524840 - RNA, 18 nt, Human
aaacaagggcaaaacaaa

SEQ ID NO: 524841 - RNA, 25 nt, Human
aacagaacccuauuucagaaaccua

SEQ ID NO: 524842 - RNA, 20 nt, Human
aaccagaaauacaagauucc

SEQ ID NO: 524843 - RNA, 23 nt, Human
aaccagaaauacaagauuccacu

SEQ ID NO: 524844 - RNA, 20 nt, Human
aaggggaaaaaaaaaaaaaa

SEQ ID NO: 524845 - RNA, 23 nt, Human
aaggggaaaaaaaaaaaaaaaga

SEQ ID NO: 524846 - RNA, 28 nt, Human
acaaagcuaaugaguggaaaaguccaag

SEQ ID NO: 524847 - RNA, 18 nt, Human
accacauguaagcaaccu

SEQ ID NO: 524848 - RNA, 19 nt, Human
accccgaccuggcccaaag

SEQ ID NO: 524849 - RNA, 20 nt, Human
agaaauacaagauuccacug

SEQ ID NO: 524850 - RNA, 23 nt, Human
agaacgcauuuuugagcuccaga

SEQ ID NO: 524851 - RNA, 18 nt, Human
agaauaugguugaacuua

SEQ ID NO: 524852 - RNA, 24 nt, Human
agaggagaaaucuggaaaaaaagg

SEQ ID NO: 524853 - RNA, 23 nt, Human
aggggaaaaaaaaaaaaaaagag

SEQ ID NO: 524854 - RNA, 23 nt, Human
aggugguaacaagagcacagagc

SEQ ID NO: 524855 - RNA, 23 nt, Human
agugcaauucaacccaacacgcu

SEQ ID NO: 524856 - RNA, 18 nt, Human
auauugcaguauaaacca

SEQ ID NO: 524857 - RNA, 19 nt, Human
augagcuagcugaccucau

SEQ ID NO: 524858 - RNA, 24 nt, Human
caaacccagaaggaaagucuguaa

SEQ ID NO: 524859 - RNA, 21 nt, Human
caaaucaaauggcuucugauc

SEQ ID NO: 524860 - RNA, 22 nt, Human
caccuaccaaaucaaauggcuu

SEQ ID NO: 524861 - RNA, 25 nt, Human
cagaaggaaagucuguaaaucucau

SEQ ID NO: 524862 - RNA, 24 nt, Human
cagauaaccccauuugguaagaua

SEQ ID NO: 524863 - RNA, 21 nt, Human
cagggcaaagaggagaaaucu

SEQ ID NO: 524864 - RNA, 20 nt, Human
cauggaaagcacacauaaug

SEQ ID NO: 524865 - RNA, 20 nt, Human
ccaaaggggaaaaaaaaaaa

SEQ ID NO: 524866 - RNA, 21 nt, Human
ccaacccuauaguaccccucu

SEQ ID NO: 524867 - RNA, 18 nt, Human
ccacauguaagcaaccuc

SEQ ID NO: 524868 - RNA, 28 nt, Human
ccacggccucggccucggccuccaaagc

SEQ ID NO: 524869 - RNA, 25 nt, Human
ccagaaggaaagucuguaaaucuca

SEQ ID NO: 524870 - RNA, 21 nt, Human
cccuucugacacaccuaccaa

SEQ ID NO: 524871 - RNA, 22 nt, Human
ccuaagauaaaauuaccuaaca

SEQ ID NO: 524872 - RNA, 24 nt, Human
ccuaccaaaucaaauggcuucuga

SEQ ID NO: 524873 - RNA, 19 nt, Human
ccuccaaagcccccucuuc

SEQ ID NO: 524874 - RNA, 21 nt, Human
ccucuaucacaugaucaucuc

SEQ ID NO: 524875 - RNA, 24 nt, Human
cggccuccaaagcccccucuuccc

SEQ ID NO: 524876 - RNA, 24 nt, Human
cucguccacggccucggccucggc

SEQ ID NO: 524877 - RNA, 20 nt, Human
cuucugaccucuuccagcag

SEQ ID NO: 524878 - RNA, 25 nt, Human
cuuuuguuuucgacauauaugcauc

SEQ ID NO: 524879 - RNA, 19 nt, Human
gaaaaaaaaaaaaaaagag

SEQ ID NO: 524880 - RNA, 21 nt, Human
gaccucaugugucaggagacu

SEQ ID NO: 524881 - RNA, 20 nt, Human
gcaaagaggagaaaucugga

SEQ ID NO: 524882 - RNA, 21 nt, Human
gcaguggggccuagcugagaa

SEQ ID NO: 524883 - RNA, 22 nt, Human
gcauuuuugagcuccagaccuu

SEQ ID NO: 524884 - RNA, 23 nt, Human
gccuccaaagcccccucuucccu

SEQ ID NO: 524885 - RNA, 21 nt, Human
gcugaccucaugugucaggag

SEQ ID NO: 524886 - RNA, 19 nt, Human
ggaaaaaaaggaaacacaa

SEQ ID NO: 524887 - RNA, 20 nt, Human
ggcaacagggaugaacaaaa

SEQ ID NO: 524888 - RNA, 24 nt, Human
ggcaacagggaugaacaaaagaaa

SEQ ID NO: 524889 - RNA, 24 nt, Human
ggccuagcugagaaaagcugaagg

SEQ ID NO: 524890 - RNA, 25 nt, Human
gggcaacagggaugaacaaaagaaa

SEQ ID NO: 524891 - RNA, 22 nt, Human
ggggcaacagggaugaacaaaa

SEQ ID NO: 524892 - RNA, 23 nt, Human
gggggcaacagggaugaacaaaa

SEQ ID NO: 524893 - RNA, 27 nt, Human
gguaacaagagcacagaagggagggcc

SEQ ID NO: 524894 - RNA, 19 nt, Human
gguuaugguauaugugcug

SEQ ID NO: 524895 - RNA, 20 nt, Human
guggggccuagcugagaaaa

SEQ ID NO: 524896 - RNA, 24 nt, Human
uaacagaacccuauuucagaaacc

SEQ ID NO: 524897 - RNA, 19 nt, Human
uaaguuuaauaggugcugu

SEQ ID NO: 524898 - RNA, 18 nt, Human
uacaagauuccacugaaa

SEQ ID NO: 524899 - RNA, 23 nt, Human
uagcugaccucaugugucaggag

SEQ ID NO: 524900 - RNA, 21 nt, Human
uaugugcugucaauguacaug

SEQ ID NO: 524901 - RNA, 18 nt, Human
uauuggagacccuucugg

SEQ ID NO: 524902 - RNA, 22 nt, Human
ucaaaccagagcugcuaccaca

SEQ ID NO: 524903 - RNA, 19 nt, Human
ucaugggaggaugggcaag

SEQ ID NO: 524904 - RNA, 20 nt, Human
uccaaagcccccucuucccc

SEQ ID NO: 524905 - RNA, 24 nt, Human
uccaaagcccccucuuccccgacc

SEQ ID NO: 524906 - RNA, 18 nt, Human
uccccgaccuaucauacc

SEQ ID NO: 524907 - RNA, 18 nt, Human
uccuaagauaaaauuacc

SEQ ID NO: 524908 - RNA, 18 nt, Human
ucuauauugcaguauaaa

SEQ ID NO: 524909 - RNA, 20 nt, Human
ucucucaugggaggaugggc

SEQ ID NO: 524910 - RNA, 18 nt, Human
ucugccaucauucucccu

SEQ ID NO: 524911 - RNA, 19 nt, Human
ugagaaaagcugaagggca

SEQ ID NO: 524912 - RNA, 21 nt, Human
uggaaaaaaaggaaacacaau

SEQ ID NO: 524913 - RNA, 19 nt, Human
ugggauguuucuguggggg

SEQ ID NO: 524914 - RNA, 19 nt, Human
uggggccuagcugagaaaa

SEQ ID NO: 524915 - RNA, 24 nt, Human
ugggggcaacagggaugaacaaaa

SEQ ID NO: 524916 - RNA, 22 nt, Human
ugucaauguacaugguagcaac

SEQ ID NO: 524917 - RNA, 18 nt, Human
uguccagcugcuccuugg

SEQ ID NO: 524918 - RNA, 21 nt, Human
uucaagggaaacaagggcaaa

SEQ ID NO: 524919 - RNA, 21 nt, Human
uuccccgaccuaucauacccc

SEQ ID NO: 524920 - RNA, 28 nt, Human
uucgucugccaucauucucccuucugac

SEQ ID NO: 524921 - RNA, 19 nt, Human
uugcaguauaaaccaaccc

SEQ ID NO: 524922 - RNA, 23 nt, Human
uuuuuuuaagcgaacaguuuguu

SEQ ID NO: 524923 - RNA, 24 nt, Human
aaacaaaccaaaugcuguccaaca

SEQ ID NO: 524924 - RNA, 20 nt, Human
aaagugcaguauaaaaguuu

SEQ ID NO: 524925 - RNA, 21 nt, Human
aaauucaaaguuuaacaucug

SEQ ID NO: 524926 - RNA, 22 nt, Human
aacuuuguucuuucaaaggcca

SEQ ID NO: 524927 - RNA, 18 nt, Human
aaggacaugccaaaaaag

SEQ ID NO: 524928 - RNA, 18 nt, Human
aauugcaauuagacaaau

SEQ ID NO: 524929 - RNA, 24 nt, Human
acucuguuauaagaacaaaaacca

SEQ ID NO: 524930 - RNA, 23 nt, Human
auugcaauuagacaaaugagauu

SEQ ID NO: 524931 - RNA, 26 nt, Human
caagaauaaugaaaauauucuaccuc

SEQ ID NO: 524932 - RNA, 23 nt, Human
cacugcauaaccugcaucauaug

SEQ ID NO: 524933 - RNA, 19 nt, Human
cauguuuagacaaaugccc

SEQ ID NO: 524934 - RNA, 22 nt, Human
ccaaagacugucugggaggcca

SEQ ID NO: 524935 - RNA, 28 nt, Human
ccaaaugcuguccaacaucucaugaacu

SEQ ID NO: 524936 - RNA, 19 nt, Human
cgggaacaggacccacuaa

SEQ ID NO: 524937 - RNA, 20 nt, Human
cuauaauaguagccauaaga

SEQ ID NO: 524938 - RNA, 18 nt, Human
cuuaaacacagggaguuu

SEQ ID NO: 524939 - RNA, 23 nt, Human
gaacaaaaaccauagccagggga

SEQ ID NO: 524940 - RNA, 25 nt, Human
gagaaaaaaauuacuuaaaaauagu

SEQ ID NO: 524941 - RNA, 19 nt, Human
gaggaaauggggaagagua

SEQ ID NO: 524942 - RNA, 21 nt, Human
gauugcuuuucaaagauuugu

SEQ ID NO: 524943 - RNA, 19 nt, Human
ggaaaagcuaucuagagua

SEQ ID NO: 524944 - RNA, 18 nt, Human
ggaagaguacuacaggug

SEQ ID NO: 524945 - RNA, 18 nt, Human
ggagcauaagaaaauuuu

SEQ ID NO: 524946 - RNA, 21 nt, Human
guaaaauagugguccaaagac

SEQ ID NO: 524947 - RNA, 20 nt, Human
guaauccccuauucuuaaac

SEQ ID NO: 524948 - RNA, 19 nt, Human
guccaaagacugucuggga

SEQ ID NO: 524949 - RNA, 24 nt, Human
uaaaauagugguccaaagacuguc

SEQ ID NO: 524950 - RNA, 18 nt, Human
uaaacucuguuauaagaa

SEQ ID NO: 524951 - RNA, 20 nt, Human
uaagaacaaaaaccauagcc

SEQ ID NO: 524952 - RNA, 23 nt, Human
uaauuuguacuaaagggauggua

SEQ ID NO: 524953 - RNA, 24 nt, Human
uagauaugaaggcacugcauaacc

SEQ ID NO: 524954 - RNA, 22 nt, Human
uagcugcaagaauaaugaaaau

SEQ ID NO: 524955 - RNA, 25 nt, Human
uauaaaaguuuuagauaugaaggca

SEQ ID NO: 524956 - RNA, 19 nt, Human
uauaaaggagaagaaaaua

SEQ ID NO: 524957 - RNA, 25 nt, Human
uauacaacucagaauccauguuuag

SEQ ID NO: 524958 - RNA, 20 nt, Human
uauggagcauaagaaaauuu

SEQ ID NO: 524959 - RNA, 21 nt, Human
ucagaacaaauaaaauaacac

SEQ ID NO: 524960 - RNA, 23 nt, Human
uccacaauuuguucaaauacugg

SEQ ID NO: 524961 - RNA, 24 nt, Human
uccuuuccaagauugcuuuucaaa

SEQ ID NO: 524962 - RNA, 21 nt, Human
ucguauucuucacuuucugca

SEQ ID NO: 524963 - RNA, 20 nt, Human
ucuguuauaagaacaaaaac

SEQ ID NO: 524964 - RNA, 22 nt, Human
ugaacuaguuaauggacaauau

SEQ ID NO: 524965 - RNA, 19 nt, Human
uggcaaaacuuugcuucac

SEQ ID NO: 524966 - RNA, 18 nt, Human
ugucagaggaaaugggga

SEQ ID NO: 524967 - RNA, 24 nt, Human
uuagagaaaaaaauuacuuaaaaa

SEQ ID NO: 524968 - RNA, 22 nt, Human
uuccucaacauaaaagcuuuaa

SEQ ID NO: 524969 - RNA, 21 nt, Human
uuggauccuaaaguucuuggu

SEQ ID NO: 524970 - RNA, 21 nt, Human
uuguacuaaagggaugguagg

SEQ ID NO: 524971 - RNA, 22 nt, Human
uuucaaaggccaguaaaauagu

SEQ ID NO: 524972 - RNA, 19 nt, Human
aaaaggccuaacucaaagg

SEQ ID NO: 524973 - RNA, 24 nt, Human
aaaggccuaacucaaagguagagc

SEQ ID NO: 524974 - RNA, 22 nt, Human
aaagguagagcccaguugugcc

SEQ ID NO: 524975 - RNA, 19 nt, Human
aaugccugaaggagggguc

SEQ ID NO: 524976 - RNA, 19 nt, Human
acugguugagguggggagg

SEQ ID NO: 524977 - RNA, 21 nt, Human
agcagguggcugcgcuccugg

SEQ ID NO: 524978 - RNA, 19 nt, Human
agcuggagucaaaaggccu

SEQ ID NO: 524979 - RNA, 23 nt, Human
agcuggcaccuucuucuccagcc

SEQ ID NO: 524980 - RNA, 18 nt, Human
agguagagcccaguugug

SEQ ID NO: 524981 - RNA, 20 nt, Human
caaccaccccacccccgccc

SEQ ID NO: 524982 - RNA, 18 nt, Human
caagccgguuggaccccu

SEQ ID NO: 524983 - RNA, 22 nt, Human
cacaccucccagcagguggcug

SEQ ID NO: 524984 - RNA, 21 nt, Human
cacccaagccgguuggacccc

SEQ ID NO: 524985 - RNA, 21 nt, Human
cagcagggacugguugaggug

SEQ ID NO: 524986 - RNA, 18 nt, Human
cagccauggcucugcccc

SEQ ID NO: 524987 - RNA, 21 nt, Human
ccacccgagggcccccgcacc

SEQ ID NO: 524988 - RNA, 22 nt, Human
ccccacccccgcccauggaacc

SEQ ID NO: 524989 - RNA, 20 nt, Human
ccccgcaccucgggcccuac

SEQ ID NO: 524990 - RNA, 22 nt, Human
cccucagcuggagucaaaaggc

SEQ ID NO: 524991 - RNA, 26 nt, Human
cccuggaucugucccccucagcugga

SEQ ID NO: 524992 - RNA, 20 nt, Human
ccggccccgcgcagcguccc

SEQ ID NO: 524993 - RNA, 21 nt, Human
ccucccagcagguggcugcgc

SEQ ID NO: 524994 - RNA, 19 nt, Human
ccugugugggggcccagga

SEQ ID NO: 524995 - RNA, 18 nt, Human
cugccccuggcuggacau

SEQ ID NO: 524996 - RNA, 22 nt, Human
gcccccgcaccucgggcccuac

SEQ ID NO: 524997 - RNA, 20 nt, Human
gccccuggcuggacauggcc

SEQ ID NO: 524998 - RNA, 22 nt, Human
gcuacagcuggcaccuucuucu

SEQ ID NO: 524999 - RNA, 21 nt, Human
gcuggacauggcagaugugug

SEQ ID NO: 525000 - RNA, 19 nt, Human
gcuggagucaaaaggccua

SEQ ID NO: 525001 - RNA, 19 nt, Human
gggggcccaggagcccugg

SEQ ID NO: 525002 - RNA, 20 nt, Human
gugggggucggggaggggug

SEQ ID NO: 525003 - RNA, 23 nt, Human
uagaaucaguacaaaauaggugc

SEQ ID NO: 525004 - RNA, 19 nt, Human
ucccugaucuaggggccua

SEQ ID NO: 525005 - RNA, 24 nt, Human
ucgggcccuacuuguagaaucagu

SEQ ID NO: 525006 - RNA, 21 nt, Human
ucuccagccauggcucugccc

SEQ ID NO: 525007 - RNA, 27 nt, Human
ucugcaucugccguucuucccuggccc

SEQ ID NO: 525008 - RNA, 23 nt, Human
ugaaggaggggucuugggggcaa

SEQ ID NO: 525009 - RNA, 23 nt, Human
ugccugaaggaggggucuugggg

SEQ ID NO: 525010 - RNA, 25 nt, Human
ugccugaaggaggggucuugggggc

SEQ ID NO: 525011 - RNA, 18 nt, Human
uggccuggcacauaguag

SEQ ID NO: 525012 - RNA, 23 nt, Human
uggcuggacauggcagaugugug

SEQ ID NO: 525013 - RNA, 19 nt, Human
ugugugggggcccaggagc

SEQ ID NO: 525014 - RNA, 26 nt, Human
aaagcaugcauucccaaggauguaag

SEQ ID NO: 525015 - RNA, 24 nt, Human
aaagugcuagaauuacaggcguga

SEQ ID NO: 525016 - RNA, 22 nt, Human
aaaucauuuaucacagaaacug

SEQ ID NO: 525017 - RNA, 19 nt, Human
aacucaucaacccacccac

SEQ ID NO: 525018 - RNA, 22 nt, Human
aacuccuacuugugugaucuug

SEQ ID NO: 525019 - RNA, 26 nt, Human
aagugcuagaauuacaggcgugagcc

SEQ ID NO: 525020 - RNA, 19 nt, Human
aauaaaggguuguccugaa

SEQ ID NO: 525021 - RNA, 18 nt, Human
aauuacaggcgugagcca

SEQ ID NO: 525022 - RNA, 22 nt, Human
aauuacaggcgugagccaccgc

SEQ ID NO: 525023 - RNA, 18 nt, Human
acagcugggauuacaggc

SEQ ID NO: 525024 - RNA, 24 nt, Human
acaggcuccugcuaccaugccugg

SEQ ID NO: 525025 - RNA, 23 nt, Human
accaugccuggcuaauuuuugua

SEQ ID NO: 525026 - RNA, 18 nt, Human
acucaguugccccaucuc

SEQ ID NO: 525027 - RNA, 22 nt, Human
agaggcuuaucuguguuccacc

SEQ ID NO: 525028 - RNA, 20 nt, Human
agagguagaaugaaauauag

SEQ ID NO: 525029 - RNA, 24 nt, Human
aggaagaggaauacuuauuuuggc

SEQ ID NO: 525030 - RNA, 24 nt, Human
aggugauccgcucaccuuggccuc

SEQ ID NO: 525031 - RNA, 21 nt, Human
agguucaagugauucuccugc

SEQ ID NO: 525032 - RNA, 22 nt, Human
agguucaagugauucuccugcc

SEQ ID NO: 525033 - RNA, 23 nt, Human
agguucaagugauucuccugccu

SEQ ID NO: 525034 - RNA, 20 nt, Human
agucccuaccuuccagaagc

SEQ ID NO: 525035 - RNA, 24 nt, Human
agugauucuccugccucagccucc

SEQ ID NO: 525036 - RNA, 18 nt, Human
aguuggguauuauuugca

SEQ ID NO: 525037 - RNA, 18 nt, Human
augggguuucgccauguu

SEQ ID NO: 525038 - RNA, 24 nt, Human
augggguuucgccauguuggccag

SEQ ID NO: 525039 - RNA, 23 nt, Human
auguguguauccuuuaaggauuu

SEQ ID NO: 525040 - RNA, 24 nt, Human
auuuuuguauuuuuaguagagaug

SEQ ID NO: 525041 - RNA, 23 nt, Human
caaagacaauuuacuguaccuca

SEQ ID NO: 525042 - RNA, 24 nt, Human
caaagugcuagaauuacaggcgug

SEQ ID NO: 525043 - RNA, 21 nt, Human
caaaucccugacuucagguga

SEQ ID NO: 525044 - RNA, 19 nt, Human
caacccacccacacaacag

SEQ ID NO: 525045 - RNA, 20 nt, Human
caagugauucuccugccuca

SEQ ID NO: 525046 - RNA, 22 nt, Human
caagugauucuccugccucagc

SEQ ID NO: 525047 - RNA, 21 nt, Human
cacugcaaccuccgccuccca

SEQ ID NO: 525048 - RNA, 23 nt, Human
cagcugggauuacaggcuccugc

SEQ ID NO: 525049 - RNA, 24 nt, Human
cauguuggccaggcuggucucaaa

SEQ ID NO: 525050 - RNA, 22 nt, Human
ccaaagugcuagaauuacaggc

SEQ ID NO: 525051 - RNA, 24 nt, Human
ccaaagugcuagaauuacaggcgu

SEQ ID NO: 525052 - RNA, 18 nt, Human
ccacacaacaguuacuaa

SEQ ID NO: 525053 - RNA, 19 nt, Human
ccauguuggccaggcuggu

SEQ ID NO: 525054 - RNA, 22 nt, Human
ccauguuggccaggcuggucuc

SEQ ID NO: 525055 - RNA, 21 nt, Human
cccacacaacaguuacuaagc

SEQ ID NO: 525056 - RNA, 21 nt, Human
cccagguucaagugauucucc

SEQ ID NO: 525057 - RNA, 23 nt, Human
cccagguucaagugauucuccug

SEQ ID NO: 525058 - RNA, 24 nt, Human
cccgaacagcugggauuacaggcu

SEQ ID NO: 525059 - RNA, 19 nt, Human
ccgccacaaauugcuuaaa

SEQ ID NO: 525060 - RNA, 24 nt, Human
ccgccucccagguucaagugauuc

SEQ ID NO: 525061 - RNA, 23 nt, Human
ccucagcugccccaugucuuguu

SEQ ID NO: 525062 - RNA, 24 nt, Human
ccucccagguucaagugauucucc

SEQ ID NO: 525063 - RNA, 24 nt, Human
ccugacuucaggugauccgcucac

SEQ ID NO: 525064 - RNA, 24 nt, Human
ccugccucagccucccgaacagcu

SEQ ID NO: 525065 - RNA, 24 nt, Human
cgccauguuggccaggcuggucuc

SEQ ID NO: 525066 - RNA, 22 nt, Human
cgccucccagguucaagugauu

SEQ ID NO: 525067 - RNA, 21 nt, Human
cgcgcaugacucaguugcccc

SEQ ID NO: 525068 - RNA, 18 nt, Human
cgguaggaucagaagaau

SEQ ID NO: 525069 - RNA, 24 nt, Human
cucacugcaaccuccgccucccag

SEQ ID NO: 525070 - RNA, 19 nt, Human
cucccagguucaagugauu

SEQ ID NO: 525071 - RNA, 20 nt, Human
cucccgucucuauuuguccc

SEQ ID NO: 525072 - RNA, 23 nt, Human
cugcaaccuccgccucccagguu

SEQ ID NO: 525073 - RNA, 24 nt, Human
cugcaaccuccgccucccagguuc

SEQ ID NO: 525074 - RNA, 24 nt, Human
gacuucaggugauccgcucaccuu

SEQ ID NO: 525075 - RNA, 18 nt, Human
gagaugggguuucgccau

SEQ ID NO: 525076 - RNA, 24 nt, Human
gagaugggguuucgccauguuggc

SEQ ID NO: 525077 - RNA, 24 nt, Human
gauuacaggcuccugcuaccaugc

SEQ ID NO: 525078 - RNA, 21 nt, Human
gcaguauauccucaggcaauu

SEQ ID NO: 525079 - RNA, 18 nt, Human
gccauguuggccaggcug

SEQ ID NO: 525080 - RNA, 21 nt, Human
gccucccgaacagcugggauu

SEQ ID NO: 525081 - RNA, 22 nt, Human
gcgcgaucucaacucacugcaa

SEQ ID NO: 525082 - RNA, 20 nt, Human
gcucuugucgcccaggcugg

SEQ ID NO: 525083 - RNA, 21 nt, Human
gcucuugucgcccaggcugga

SEQ ID NO: 525084 - RNA, 24 nt, Human
gcucuugucgcccaggcuggagcg

SEQ ID NO: 525085 - RNA, 18 nt, Human
ggauuuggagucaggaga

SEQ ID NO: 525086 - RNA, 22 nt, Human
gggguuucgccauguuggccag

SEQ ID NO: 525087 - RNA, 18 nt, Human
ggguuucgccauguuggc

SEQ ID NO: 525088 - RNA, 19 nt, Human
gguuguccugaauucuguu

SEQ ID NO: 525089 - RNA, 26 nt, Human
gguuguccugaauucuguuuggccuc

SEQ ID NO: 525090 - RNA, 20 nt, Human
guagaaugaaauauagcccc

SEQ ID NO: 525091 - RNA, 23 nt, Human
guagagaugggguuucgccaugu

SEQ ID NO: 525092 - RNA, 24 nt, Human
gugauucuccugccucagccuccc

SEQ ID NO: 525093 - RNA, 21 nt, Human
guucaccugccugacaguuaa

SEQ ID NO: 525094 - RNA, 24 nt, Human
uaaaggguuguccugaauucuguu

SEQ ID NO: 525095 - RNA, 20 nt, Human
uaacaaauguaaaagaauaa

SEQ ID NO: 525096 - RNA, 24 nt, Human
uaauuuuuguauuuuuaguagaga

SEQ ID NO: 525097 - RNA, 23 nt, Human
uacaaaaggccucagcugcccca

SEQ ID NO: 525098 - RNA, 22 nt, Human
uacaaaaggugauggaagucaa

SEQ ID NO: 525099 - RNA, 18 nt, Human
uacaggcuccugcuacca

SEQ ID NO: 525100 - RNA, 24 nt, Human
uaccuguuucuguuuccucuucua

SEQ ID NO: 525101 - RNA, 21 nt, Human
uagaaugaaauauagcccccc

SEQ ID NO: 525102 - RNA, 21 nt, Human
uagaauuacaggcgugagcca

SEQ ID NO: 525103 - RNA, 24 nt, Human
uagaauuacaggcgugagccaccg

SEQ ID NO: 525104 - RNA, 25 nt, Human
uagaauuacaggcgugagccaccgc

SEQ ID NO: 525105 - RNA, 22 nt, Human
uagagaugggguuucgccaugu

SEQ ID NO: 525106 - RNA, 24 nt, Human
uaguagagaugggguuucgccaug

SEQ ID NO: 525107 - RNA, 19 nt, Human
uauagccccccacccuccg

SEQ ID NO: 525108 - RNA, 19 nt, Human
ucaagugauucuccugccu

SEQ ID NO: 525109 - RNA, 21 nt, Human
ucacgugcugucucauuuccu

SEQ ID NO: 525110 - RNA, 19 nt, Human
ucacugcaaccuccgccuc

SEQ ID NO: 525111 - RNA, 24 nt, Human
ucacugcaaccuccgccucccagg

SEQ ID NO: 525112 - RNA, 25 nt, Human
ucacugcaaccuccgccucccaggu

SEQ ID NO: 525113 - RNA, 27 nt, Human
ucacugcaaccuccgccucccagguuc

SEQ ID NO: 525114 - RNA, 18 nt, Human
ucagccucccgaacagcu

SEQ ID NO: 525115 - RNA, 23 nt, Human
ucaguagauggcaauuguaauau

SEQ ID NO: 525116 - RNA, 24 nt, Human
ucccaaagugcuagaauuacaggc

SEQ ID NO: 525117 - RNA, 18 nt, Human
ucccaaauucacuuccaa

SEQ ID NO: 525118 - RNA, 21 nt, Human
ucccagguucaagugauucuc

SEQ ID NO: 525119 - RNA, 24 nt, Human
ucccagguucaagugauucuccug

SEQ ID NO: 525120 - RNA, 23 nt, Human
ucccgaacagcugggauuacagg

SEQ ID NO: 525121 - RNA, 24 nt, Human
ucccgaacagcugggauuacaggc

SEQ ID NO: 525122 - RNA, 22 nt, Human
ucgccauguuggccaggcuggu

SEQ ID NO: 525123 - RNA, 24 nt, Human
ucgccauguuggccaggcuggucu

SEQ ID NO: 525124 - RNA, 21 nt, Human
ucucccgucucuauuuguccc

SEQ ID NO: 525125 - RNA, 22 nt, Human
ucucggauuuggagucaggaga

SEQ ID NO: 525126 - RNA, 21 nt, Human
ucucucucuguaaaaaggaag

SEQ ID NO: 525127 - RNA, 18 nt, Human
ugaaaggauucucggauu

SEQ ID NO: 525128 - RNA, 23 nt, Human
ugaaauauagccccccacccucc

SEQ ID NO: 525129 - RNA, 26 nt, Human
ugaaauauagccccccacccuccgga

SEQ ID NO: 525130 - RNA, 18 nt, Human
ugaaauauucuagacauc

SEQ ID NO: 525131 - RNA, 23 nt, Human
ugacuaaugaccuguguuuuuuu

SEQ ID NO: 525132 - RNA, 19 nt, Human
ugacuucaggugauccgcu

SEQ ID NO: 525133 - RNA, 25 nt, Human
ugacuucaggugauccgcucaccuu

SEQ ID NO: 525134 - RNA, 24 nt, Human
ugauaagcaauugcuacaaaagca

SEQ ID NO: 525135 - RNA, 24 nt, Human
ugauccgcucaccuuggccuccca

SEQ ID NO: 525136 - RNA, 20 nt, Human
ugauucuccugccucagccu

SEQ ID NO: 525137 - RNA, 23 nt, Human
ugcagaaaaauucaagaccuauu

SEQ ID NO: 525138 - RNA, 26 nt, Human
ugccucagccucccgaacagcuggga

SEQ ID NO: 525139 - RNA, 19 nt, Human
ugcuacaaaagcaugcauu

SEQ ID NO: 525140 - RNA, 24 nt, Human
ugcuagaauuacaggcgugagcca

SEQ ID NO: 525141 - RNA, 24 nt, Human
uggaguuuugcucuugucgcccag

SEQ ID NO: 525142 - RNA, 24 nt, Human
uggccaggcuggucucaaaucccu

SEQ ID NO: 525143 - RNA, 22 nt, Human
ugggauuacaggcuccugcuac

SEQ ID NO: 525144 - RNA, 24 nt, Human
ugggauuacaggcuccugcuacca

SEQ ID NO: 525145 - RNA, 25 nt, Human
ugggauuacaggcuccugcuaccau

SEQ ID NO: 525146 - RNA, 24 nt, Human
ugggguuucgccauguuggccagg

SEQ ID NO: 525147 - RNA, 20 nt, Human
ugguguaacaaauguaaaag

SEQ ID NO: 525148 - RNA, 20 nt, Human
uguaaguggcuauaaacacu

SEQ ID NO: 525149 - RNA, 20 nt, Human
ugucuuguuuuguuuuuucu

SEQ ID NO: 525150 - RNA, 23 nt, Human
ugucuuguuuuguuuuuucuuug

SEQ ID NO: 525151 - RNA, 18 nt, Human
uuaguagagaugggguuu

SEQ ID NO: 525152 - RNA, 22 nt, Human
uuaguagagaugggguuucgcc

SEQ ID NO: 525153 - RNA, 24 nt, Human
uuaguagagaugggguuucgccau

SEQ ID NO: 525154 - RNA, 21 nt, Human
uucaagugauucuccugccuc

SEQ ID NO: 525155 - RNA, 23 nt, Human
uucaagugauucuccugccucag

SEQ ID NO: 525156 - RNA, 24 nt, Human
uucaagugauucuccugccucagc

SEQ ID NO: 525157 - RNA, 24 nt, Human
uucaggugauccgcucaccuuggc

SEQ ID NO: 525158 - RNA, 19 nt, Human
uuccagaagcucagggucc

SEQ ID NO: 525159 - RNA, 23 nt, Human
uugcucuugucgcccaggcugga

SEQ ID NO: 525160 - RNA, 18 nt, Human
uuggccucccaaagugcu

SEQ ID NO: 525161 - RNA, 22 nt, Human
uuggccucccaaagugcuagaa

SEQ ID NO: 525162 - RNA, 23 nt, Human
uuguauuuuuaguagagaugggg

SEQ ID NO: 525163 - RNA, 19 nt, Human
uuguucuugcuucugcaag

SEQ ID NO: 525164 - RNA, 25 nt, Human
uuguuuuuucuuugagguggaguuu

SEQ ID NO: 525165 - RNA, 18 nt, Human
uuuacaacuuaccugcug

SEQ ID NO: 525166 - RNA, 24 nt, Human
uuucgccauguuggccaggcuggu

SEQ ID NO: 525167 - RNA, 24 nt, Human
uuugcucuugucgcccaggcugga

SEQ ID NO: 525168 - RNA, 24 nt, Human
uuuugcucuugucgcccaggcugg

SEQ ID NO: 525169 - RNA, 23 nt, Human
uuuuuaguagagaugggguuucg

SEQ ID NO: 525170 - RNA, 24 nt, Human
uuuuuaguagagaugggguuucgc

SEQ ID NO: 525171 - RNA, 20 nt, Human
uuuuuguauuuuuaguagag

SEQ ID NO: 525172 - RNA, 24 nt, Human
uuuuuuuuguuaccuguuucuguu

SEQ ID NO: 525173 - RNA, 22 nt, Human
uuuuuuuuuguuaccuguuucu

SEQ ID NO: 525174 - RNA, 21 nt, Human
aaaagcauuaacaauuuuuag

SEQ ID NO: 525175 - RNA, 19 nt, Human
aacauggugaaaccucauc

SEQ ID NO: 525176 - RNA, 20 nt, Human
aacauggugaaaccucaucu

SEQ ID NO: 525177 - RNA, 21 nt, Human
aacauggugaaaccucaucuc

SEQ ID NO: 525178 - RNA, 23 nt, Human
aagaaucacuugaacccaggagg

SEQ ID NO: 525179 - RNA, 18 nt, Human
aauaaagaaacuccuaga

SEQ ID NO: 525180 - RNA, 24 nt, Human
aaucacuugaacccaggaggugga

SEQ ID NO: 525181 - RNA, 25 nt, Human
aaugauguuuuaugacgcagacuau

SEQ ID NO: 525182 - RNA, 24 nt, Human
aauggagcgagacucugucucaaa

SEQ ID NO: 525183 - RNA, 24 nt, Human
accucaucucuacuaaaaauauaa

SEQ ID NO: 525184 - RNA, 24 nt, Human
acgcugcugcaguccagccugggc

SEQ ID NO: 525185 - RNA, 24 nt, Human
agcacuuugggaggcugaggcggg

SEQ ID NO: 525186 - RNA, 23 nt, Human
agccuggccaacauggugaaacc

SEQ ID NO: 525187 - RNA, 25 nt, Human
agccuggccaacauggugaaaccuc

SEQ ID NO: 525188 - RNA, 24 nt, Human
agccugggcaauggagcgagacuc

SEQ ID NO: 525189 - RNA, 26 nt, Human
aggcggguggaucacuugaagucaag

SEQ ID NO: 525190 - RNA, 21 nt, Human
aggcugaggcggguggaucac

SEQ ID NO: 525191 - RNA, 24 nt, Human
aggcugaggcggguggaucacuug

SEQ ID NO: 525192 - RNA, 24 nt, Human
agguggagguugcagugagcugag

SEQ ID NO: 525193 - RNA, 24 nt, Human
aucacgcugcugcaguccagccug

SEQ ID NO: 525194 - RNA, 24 nt, Human
auggagcgagacucugucucaaaa

SEQ ID NO: 525195 - RNA, 20 nt, Human
auugcuauuugcuuuucugu

SEQ ID NO: 525196 - RNA, 23 nt, Human
auuucacuuucacauuuccccaa

SEQ ID NO: 525197 - RNA, 24 nt, Human
caacauggugaaaccucaucucua

SEQ ID NO: 525198 - RNA, 19 nt, Human
cacaccauaaguucagcca

SEQ ID NO: 525199 - RNA, 24 nt, Human
cacaccuguaaucccagcacuuug

SEQ ID NO: 525200 - RNA, 20 nt, Human
caccacaccauaaguucagc

SEQ ID NO: 525201 - RNA, 19 nt, Human
caccuguaaucccagcacu

SEQ ID NO: 525202 - RNA, 24 nt, Human
caccuguaaucccagcacuuuggg

SEQ ID NO: 525203 - RNA, 21 nt, Human
cacuugaagucaagaguuuga

SEQ ID NO: 525204 - RNA, 24 nt, Human
cagaauuaaugccaucagguugua

SEQ ID NO: 525205 - RNA, 24 nt, Human
cagcacuuugggaggcugaggcgg

SEQ ID NO: 525206 - RNA, 29 nt, Human
caggagguggagguugcagugacaacggu

SEQ ID NO: 525207 - RNA, 23 nt, Human
caguccagccugggcaauggagc

SEQ ID NO: 525208 - RNA, 19 nt, Human
cauaagccuaaggggccuu

SEQ ID NO: 525209 - RNA, 21 nt, Human
ccaccccccaccacaccauaa

SEQ ID NO: 525210 - RNA, 22 nt, Human
ccaggagguggagguugcagug

SEQ ID NO: 525211 - RNA, 21 nt, Human
cccaggagguggagguugcag

SEQ ID NO: 525212 - RNA, 28 nt, Human
ccccccaccacaccauaaguucagccaa

SEQ ID NO: 525213 - RNA, 19 nt, Human
ccccugaaaccaucuagag

SEQ ID NO: 525214 - RNA, 23 nt, Human
ccuggccaacauggugaaaccuc

SEQ ID NO: 525215 - RNA, 24 nt, Human
ccuggccaacauggugaaaccuca

SEQ ID NO: 525216 - RNA, 22 nt, Human
ccugggcaauggagcgagacuc

SEQ ID NO: 525217 - RNA, 19 nt, Human
ccuuuaaucccagcuacuu

SEQ ID NO: 525218 - RNA, 22 nt, Human
ccuuuaaucccagcuacuuggg

SEQ ID NO: 525219 - RNA, 24 nt, Human
cggguggaucacuugaagucaaga

SEQ ID NO: 525220 - RNA, 22 nt, Human
cucacaccuguaaucccagcac

SEQ ID NO: 525221 - RNA, 24 nt, Human
cucacaccuguaaucccagcacuu

SEQ ID NO: 525222 - RNA, 18 nt, Human
cugcaguccagccugggc

SEQ ID NO: 525223 - RNA, 20 nt, Human
cugcaguccagccugggcaa

SEQ ID NO: 525224 - RNA, 21 nt, Human
cugcaguccagccugggcaau

SEQ ID NO: 525225 - RNA, 25 nt, Human
cugcaguccagccugggcaauggag

SEQ ID NO: 525226 - RNA, 24 nt, Human
cugcugcaguccagccugggcaau

SEQ ID NO: 525227 - RNA, 23 nt, Human
cuggccaacauggugaaaccuca

SEQ ID NO: 525228 - RNA, 24 nt, Human
cugugauuggaguauuguuaaggc

SEQ ID NO: 525229 - RNA, 21 nt, Human
cuugaacccaggagguggagg

SEQ ID NO: 525230 - RNA, 20 nt, Human
cuuuuuuuuuuuuuuuuugc

SEQ ID NO: 525231 - RNA, 20 nt, Human
cuuuuuuuuuuuuuuuuugg

SEQ ID NO: 525232 - RNA, 21 nt, Human
gagguggagguugcagugagc

SEQ ID NO: 525233 - RNA, 22 nt, Human
gagguugcagugagcugagauc

SEQ ID NO: 525234 - RNA, 24 nt, Human
gaucacuugaagucaagaguuuga

SEQ ID NO: 525235 - RNA, 24 nt, Human
gcaauggagcgagacucugucuca

SEQ ID NO: 525236 - RNA, 22 nt, Human
gcacaagaaucacuugaaccca

SEQ ID NO: 525237 - RNA, 21 nt, Human
gcaggugauuacauuugcuuu

SEQ ID NO: 525238 - RNA, 24 nt, Human
gccaacauggugaaaccucaucuc

SEQ ID NO: 525239 - RNA, 22 nt, Human
gccagucaugguggcacgugcc

SEQ ID NO: 525240 - RNA, 24 nt, Human
gcugcugcaguccagccugggcaa

SEQ ID NO: 525241 - RNA, 18 nt, Human
ggagguugcagugagcug

SEQ ID NO: 525242 - RNA, 22 nt, Human
ggagguugcagugagcugagau

SEQ ID NO: 525243 - RNA, 23 nt, Human
ggagguugcagugagcugagauc

SEQ ID NO: 525244 - RNA, 24 nt, Human
ggagguugcagugagcugagauca

SEQ ID NO: 525245 - RNA, 24 nt, Human
gggccugguggcucacaccuguaa

SEQ ID NO: 525246 - RNA, 19 nt, Human
gguggagguugcagugagc

SEQ ID NO: 525247 - RNA, 24 nt, Human
gguggcacgugccuuuaaucccag

SEQ ID NO: 525248 - RNA, 24 nt, Human
gguggcucacaccuguaaucccag

SEQ ID NO: 525249 - RNA, 20 nt, Human
gucaugguggcacgugccuu

SEQ ID NO: 525250 - RNA, 20 nt, Human
guggagguugcagugagcug

SEQ ID NO: 525251 - RNA, 19 nt, Human
guugcagugagcugagauc

SEQ ID NO: 525252 - RNA, 18 nt, Human
uaaaaggacacacacaug

SEQ ID NO: 525253 - RNA, 21 nt, Human
uaaaauaaagaaacuccuaga

SEQ ID NO: 525254 - RNA, 21 nt, Human
uaacaaacugugauuuauguu

SEQ ID NO: 525255 - RNA, 22 nt, Human
uacaaagaacuaauucaaacaa

SEQ ID NO: 525256 - RNA, 22 nt, Human
uaccaccccccaccacaccaua

SEQ ID NO: 525257 - RNA, 18 nt, Human
uaguuccccugaaaccau

SEQ ID NO: 525258 - RNA, 25 nt, Human
ucacgcugcugcaguccagccuggg

SEQ ID NO: 525259 - RNA, 30 nt, Human
ucagaaacacaccuauuuucaaaaugcagg

SEQ ID NO: 525260 - RNA, 23 nt, Human
uccagccugggcaauggagcgag

SEQ ID NO: 525261 - RNA, 24 nt, Human
uccagccugggcaauggagcgaga

SEQ ID NO: 525262 - RNA, 21 nt, Human
uccuuuugccaggcgagugag

SEQ ID NO: 525263 - RNA, 20 nt, Human
ucuaaucuguguccuuuugc

SEQ ID NO: 525264 - RNA, 21 nt, Human
ucucuacuaaaaauauaaaaa

SEQ ID NO: 525265 - RNA, 20 nt, Human
ucuuugggaugggaugcauu

SEQ ID NO: 525266 - RNA, 19 nt, Human
ugaaaccucaucucuacua

SEQ ID NO: 525267 - RNA, 18 nt, Human
ugaaaggcaaaugauguu

SEQ ID NO: 525268 - RNA, 23 nt, Human
ugagaccagccuggccaacaugg

SEQ ID NO: 525269 - RNA, 24 nt, Human
ugagaccagccuggccaacauggu

SEQ ID NO: 525270 - RNA, 21 nt, Human
ugagaucacgcugcugcaguc

SEQ ID NO: 525271 - RNA, 24 nt, Human
ugagaucacgcugcugcaguccag

SEQ ID NO: 525272 - RNA, 21 nt, Human
ugagcugagaucacgcugcug

SEQ ID NO: 525273 - RNA, 22 nt, Human
ugagcugagaucacgcugcugc

SEQ ID NO: 525274 - RNA, 20 nt, Human
ugaggcacaagaaucacuug

SEQ ID NO: 525275 - RNA, 24 nt, Human
ugaggcacaagaaucacuugaacc

SEQ ID NO: 525276 - RNA, 24 nt, Human
ugaggcggguggaucacuugaagu

SEQ ID NO: 525277 - RNA, 26 nt, Human
ugaggcggguggaucacuugaaguca

SEQ ID NO: 525278 - RNA, 22 nt, Human
ugccaugguaucccugucagag

SEQ ID NO: 525279 - RNA, 23 nt, Human
ugccuuuaaucccagcuacuugg

SEQ ID NO: 525280 - RNA, 24 nt, Human
ugccuuuaaucccagcuacuuggg

SEQ ID NO: 525281 - RNA, 19 nt, Human
ugcuauuugcuuuucuguc

SEQ ID NO: 525282 - RNA, 20 nt, Human
ugcugcaguccagccugggc

SEQ ID NO: 525283 - RNA, 21 nt, Human
ugcugcaguccagccugggca

SEQ ID NO: 525284 - RNA, 20 nt, Human
uggaagguauaaauugaaag

SEQ ID NO: 525285 - RNA, 21 nt, Human
uggaucacuugaagucaagag

SEQ ID NO: 525286 - RNA, 23 nt, Human
uggaucacuugaagucaagaguu

SEQ ID NO: 525287 - RNA, 24 nt, Human
uggaucacuugaagucaagaguuu

SEQ ID NO: 525288 - RNA, 27 nt, Human
uggaucacuugaagucaagaguuugag

SEQ ID NO: 525289 - RNA, 24 nt, Human
uggccaacauggugaaaccucauc

SEQ ID NO: 525290 - RNA, 21 nt, Human
uggcucacaccuguaauccca

SEQ ID NO: 525291 - RNA, 22 nt, Human
uggcucacaccuguaaucccag

SEQ ID NO: 525292 - RNA, 24 nt, Human
uggcucacaccuguaaucccagca

SEQ ID NO: 525293 - RNA, 27 nt, Human
ugggaggcugaggcacaagaaucacuu

SEQ ID NO: 525294 - RNA, 20 nt, Human
ugggaggcugaggcgggugg

SEQ ID NO: 525295 - RNA, 23 nt, Human
ugggaggcugaggcggguggauc

SEQ ID NO: 525296 - RNA, 24 nt, Human
ugggaggcugaggcggguggauca

SEQ ID NO: 525297 - RNA, 24 nt, Human
ugguggcacgugccuuuaauccca

SEQ ID NO: 525298 - RNA, 24 nt, Human
ugguggcucacaccuguaauccca

SEQ ID NO: 525299 - RNA, 19 nt, Human
ugugauuuauguuuuuguu

SEQ ID NO: 525300 - RNA, 21 nt, Human
uguuuuuguucauuucuucua

SEQ ID NO: 525301 - RNA, 20 nt, Human
uucacauuuccccaaccaca

SEQ ID NO: 525302 - RNA, 19 nt, Human
uucacuuucacauuucccc

SEQ ID NO: 525303 - RNA, 24 nt, Human
uugaacccaggagguggagguugc

SEQ ID NO: 525304 - RNA, 22 nt, Human
uugaagucaagaguuugagacc

SEQ ID NO: 525305 - RNA, 18 nt, Human
uugcagugagcugagauc

SEQ ID NO: 525306 - RNA, 20 nt, Human
uugcagugagcugagaucac

SEQ ID NO: 525307 - RNA, 24 nt, Human
uugcagugagcugagaucacgcug

SEQ ID NO: 525308 - RNA, 25 nt, Human
uugggaggcugaggcacaagaauca

SEQ ID NO: 525309 - RNA, 25 nt, Human
uugggaggcugaggcggguggauca

SEQ ID NO: 525310 - RNA, 20 nt, Human
uuguuaaggcuuaugguuuc

SEQ ID NO: 525311 - RNA, 21 nt, Human
uuuaacugugauuggaguauu

SEQ ID NO: 525312 - RNA, 24 nt, Human
uuugcauucaaaauccuguuuuau

SEQ ID NO: 525313 - RNA, 18 nt, Human
uuuuuugaauucauaagc

SEQ ID NO: 525314 - RNA, 19 nt, Human
uuuuuuuuuuuuuuuugca

SEQ ID NO: 525315 - RNA, 20 nt, Human
aaaaaaagaagaaauuagag

SEQ ID NO: 525316 - RNA, 22 nt, Human
aaaaaaagaagaaauuagagaa

SEQ ID NO: 525317 - RNA, 19 nt, Human
aaaaagaagaaauuagaga

SEQ ID NO: 525318 - RNA, 20 nt, Human
agaagggagguaggggggac

SEQ ID NO: 525319 - RNA, 22 nt, Human
agaagggagguaggggggacag

SEQ ID NO: 525320 - RNA, 22 nt, Human
agcagggcccuagggagguagg

SEQ ID NO: 525321 - RNA, 20 nt, Human
agccuggccgcgggggaggg

SEQ ID NO: 525322 - RNA, 23 nt, Human
agcggcaggcgccgggcccccaa

SEQ ID NO: 525323 - RNA, 21 nt, Human
aggcagaaguggggcucaggg

SEQ ID NO: 525324 - RNA, 21 nt, Human
aggcaggugugaggcuggggg

SEQ ID NO: 525325 - RNA, 20 nt, Human
aggcccccaugucccagcag

SEQ ID NO: 525326 - RNA, 24 nt, Human
aggcgggaaccagaggcaggugug

SEQ ID NO: 525327 - RNA, 18 nt, Human
agggcccugguacugcgg

SEQ ID NO: 525328 - RNA, 24 nt, Human
caagccugggggcaggggcugggg

SEQ ID NO: 525329 - RNA, 20 nt, Human
cacucaggcccccauguccc

SEQ ID NO: 525330 - RNA, 19 nt, Human
cagcccggggccgcagccc

SEQ ID NO: 525331 - RNA, 18 nt, Human
cagcggcaggcgccgggc

SEQ ID NO: 525332 - RNA, 21 nt, Human
cagcuccugggucccuccaga

SEQ ID NO: 525333 - RNA, 25 nt, Human
caggagcccagcucgggucccaggc

SEQ ID NO: 525334 - RNA, 18 nt, Human
cauugagcagaggggccu

SEQ ID NO: 525335 - RNA, 19 nt, Human
ccaagccugggggcagggg

SEQ ID NO: 525336 - RNA, 23 nt, Human
ccaagccugggggcaggggcugg

SEQ ID NO: 525337 - RNA, 23 nt, Human
ccaggcgcgcgcccccccacccc

SEQ ID NO: 525338 - RNA, 18 nt, Human
cccaugucccagcagggc

SEQ ID NO: 525339 - RNA, 18 nt, Human
ccccaugucccagcaggg

SEQ ID NO: 525340 - RNA, 21 nt, Human
ccccaugucccagcagggccc

SEQ ID NO: 525341 - RNA, 18 nt, Human
cccccccacccccgccgc

SEQ ID NO: 525342 - RNA, 19 nt, Human
cccccccacccccgccgcc

SEQ ID NO: 525343 - RNA, 20 nt, Human
cccgucccuucucuguccug

SEQ ID NO: 525344 - RNA, 18 nt, Human
cccuccagagccuggccg

SEQ ID NO: 525345 - RNA, 20 nt, Human
cccucuucaggccgucgcug

SEQ ID NO: 525346 - RNA, 19 nt, Human
ccgccgccgucagcggcag

SEQ ID NO: 525347 - RNA, 20 nt, Human
ccgccgucagcggcaggcgc

SEQ ID NO: 525348 - RNA, 19 nt, Human
ccggaggcugggucucucc

SEQ ID NO: 525349 - RNA, 19 nt, Human
ccgucccuucucuguccug

SEQ ID NO: 525350 - RNA, 19 nt, Human
ccuucucccucuucaggcc

SEQ ID NO: 525351 - RNA, 23 nt, Human
ccuugccgguguccuugagagcc

SEQ ID NO: 525352 - RNA, 20 nt, Human
cgcgcauggaccccggcccc

SEQ ID NO: 525353 - RNA, 21 nt, Human
cgcgcgcccccccacccccgc

SEQ ID NO: 525354 - RNA, 24 nt, Human
cuccgcgcauggaccccggccccc

SEQ ID NO: 525355 - RNA, 21 nt, Human
cuccugggucccuccagagcc

SEQ ID NO: 525356 - RNA, 23 nt, Human
cugaggccggcggcagcuccugg

SEQ ID NO: 525357 - RNA, 21 nt, Human
cuucuggggaccaaggcccag

SEQ ID NO: 525358 - RNA, 21 nt, Human
gaggaccaggcgggaaccaga

SEQ ID NO: 525359 - RNA, 19 nt, Human
gauccgggcgacccuccuu

SEQ ID NO: 525360 - RNA, 19 nt, Human
gcagaaguggggcucaggg

SEQ ID NO: 525361 - RNA, 18 nt, Human
gccggcggcagcuccugg

SEQ ID NO: 525362 - RNA, 21 nt, Human
gcgcgcccccccacccccgcc

SEQ ID NO: 525363 - RNA, 27 nt, Human
gcucgggucccaggcagaggugaaggc

SEQ ID NO: 525364 - RNA, 18 nt, Human
ggcagaaguggggcucag

SEQ ID NO: 525365 - RNA, 23 nt, Human
ggcaggggcuggggaggccggug

SEQ ID NO: 525366 - RNA, 22 nt, Human
ggccgcgggggagggcgcagcc

SEQ ID NO: 525367 - RNA, 19 nt, Human
ggcgcgcgcccccccaccc

SEQ ID NO: 525368 - RNA, 25 nt, Human
gggagguaggggggacaggagagug

SEQ ID NO: 525369 - RNA, 18 nt, Human
gggccuuuggaggugggg

SEQ ID NO: 525370 - RNA, 23 nt, Human
gggcgcagcccggggccgcagcc

SEQ ID NO: 525371 - RNA, 20 nt, Human
ggggacaggagagugaagga

SEQ ID NO: 525372 - RNA, 25 nt, Human
uaaaaaaaagaagaaauuagagaag

SEQ ID NO: 525373 - RNA, 19 nt, Human
ucauuaaaaaaaagaagaa

SEQ ID NO: 525374 - RNA, 21 nt, Human
uccgcgcauggaccccggccc

SEQ ID NO: 525375 - RNA, 21 nt, Human
uccuggcggcgaggcccuagc

SEQ ID NO: 525376 - RNA, 19 nt, Human
ugagcagaggggccuuugg

SEQ ID NO: 525377 - RNA, 18 nt, Human
ugaggcugggggucacag

SEQ ID NO: 525378 - RNA, 18 nt, Human
uggaugggcacucaggcc

SEQ ID NO: 525379 - RNA, 22 nt, Human
uggggaccaaggcccaggagcc

SEQ ID NO: 525380 - RNA, 23 nt, Human
aaaauaauaaguaggauaagaua

SEQ ID NO: 525381 - RNA, 19 nt, Human
aaagaaacuagauccuggu

SEQ ID NO: 525382 - RNA, 21 nt, Human
aagcagcaucuuuccuuuuca

SEQ ID NO: 525383 - RNA, 22 nt, Human
aauuccugcccccccauccagu

SEQ ID NO: 525384 - RNA, 19 nt, Human
acaagaaaaagaggugaga

SEQ ID NO: 525385 - RNA, 20 nt, Human
acaccauuuaaguccaggag

SEQ ID NO: 525386 - RNA, 22 nt, Human
acaccgaaggaaggggacugga

SEQ ID NO: 525387 - RNA, 19 nt, Human
acaguaauaaucucucuca

SEQ ID NO: 525388 - RNA, 18 nt, Human
accacaugcaaagaacaa

SEQ ID NO: 525389 - RNA, 18 nt, Human
acucugcaucagucacaa

SEQ ID NO: 525390 - RNA, 24 nt, Human
acuggccuaaagacucaaaugaaa

SEQ ID NO: 525391 - RNA, 23 nt, Human
agaaaguaagacucaagaucaaa

SEQ ID NO: 525392 - RNA, 19 nt, Human
agaguagagagaaagaaac

SEQ ID NO: 525393 - RNA, 23 nt, Human
agaguagagagaaagaaacuaga

SEQ ID NO: 525394 - RNA, 22 nt, Human
agauuaaaauacaaaucacuuu

SEQ ID NO: 525395 - RNA, 22 nt, Human
agcacaagccagggucaugauc

SEQ ID NO: 525396 - RNA, 19 nt, Human
aggaaguaaaauaauaagu

SEQ ID NO: 525397 - RNA, 22 nt, Human
agggcaucaccuggccuguugg

SEQ ID NO: 525398 - RNA, 20 nt, Human
aguccaagggggccagggac

SEQ ID NO: 525399 - RNA, 20 nt, Human
aguuugcaaacaaaaugguc

SEQ ID NO: 525400 - RNA, 21 nt, Human
auaaucaggagccaguggaac

SEQ ID NO: 525401 - RNA, 25 nt, Human
aucaacaccacucaagagacaaauu

SEQ ID NO: 525402 - RNA, 24 nt, Human
aucuccuucauuaccuuccuccaa

SEQ ID NO: 525403 - RNA, 24 nt, Human
caaacaccgaaggaaggggacugg

SEQ ID NO: 525404 - RNA, 26 nt, Human
caaagcaucauaaucaggagccagug

SEQ ID NO: 525405 - RNA, 24 nt, Human
caccacucaagagacaaauuaucc

SEQ ID NO: 525406 - RNA, 24 nt, Human
caccagcgggagaagcacaugauc

SEQ ID NO: 525407 - RNA, 20 nt, Human
caccauuuaaguccaggagu

SEQ ID NO: 525408 - RNA, 21 nt, Human
caggagccaguggaacauaug

SEQ ID NO: 525409 - RNA, 20 nt, Human
caggaugcauuccugagaaa

SEQ ID NO: 525410 - RNA, 20 nt, Human
cagggaccuggggcaaccau

SEQ ID NO: 525411 - RNA, 21 nt, Human
caguaagcccuugggcaagcu

SEQ ID NO: 525412 - RNA, 21 nt, Human
caugcaaagaacaaggaacug

SEQ ID NO: 525413 - RNA, 23 nt, Human
ccaauuuuguuggcaacauccaa

SEQ ID NO: 525414 - RNA, 18 nt, Human
ccacaugcaaagaacaag

SEQ ID NO: 525415 - RNA, 19 nt, Human
ccagaguagagagaaagaa

SEQ ID NO: 525416 - RNA, 18 nt, Human
ccaguaucauuuaaccug

SEQ ID NO: 525417 - RNA, 20 nt, Human
ccauucuccucuuccucuuu

SEQ ID NO: 525418 - RNA, 23 nt, Human
cccuugggcaagcuucuuaaucu

SEQ ID NO: 525419 - RNA, 23 nt, Human
ccgggccaugguaagcagaaaag

SEQ ID NO: 525420 - RNA, 22 nt, Human
ccugcuugugaacagagccugc

SEQ ID NO: 525421 - RNA, 21 nt, Human
ccuggaaucagaaaguaagac

SEQ ID NO: 525422 - RNA, 21 nt, Human
cgccagugagacugauauauc

SEQ ID NO: 525423 - RNA, 22 nt, Human
cuagcacaagccagggucauga

SEQ ID NO: 525424 - RNA, 23 nt, Human
cucaagagauucuucugucccac

SEQ ID NO: 525425 - RNA, 27 nt, Human
cucacuagcaaugcucucugccaauga

SEQ ID NO: 525426 - RNA, 19 nt, Human
cuccaacaccagcgggaga

SEQ ID NO: 525427 - RNA, 23 nt, Human
cuggaggcucuccucucaaacug

SEQ ID NO: 525428 - RNA, 27 nt, Human
cuuuccuuuucaauauuuugcccuggu

SEQ ID NO: 525429 - RNA, 19 nt, Human
gauacuaaggacagcugga

SEQ ID NO: 525430 - RNA, 23 nt, Human
uaacaagcccucuacuuuucaaa

SEQ ID NO: 525431 - RNA, 23 nt, Human
uaaguaggauaagauaaucuccu

SEQ ID NO: 525432 - RNA, 18 nt, Human
uacaguuacugagggacc

SEQ ID NO: 525433 - RNA, 19 nt, Human
uacugaauuguucuguaac

SEQ ID NO: 525434 - RNA, 22 nt, Human
uacugaauuguucuguaacucc

SEQ ID NO: 525435 - RNA, 23 nt, Human
uaggaaagaccacaugcaaagaa

SEQ ID NO: 525436 - RNA, 19 nt, Human
uaugccggcauuucccaca

SEQ ID NO: 525437 - RNA, 22 nt, Human
uauuccagacacuacugaauug

SEQ ID NO: 525438 - RNA, 22 nt, Human
ucaacaccacucaagagacaaa

SEQ ID NO: 525439 - RNA, 19 nt, Human
ucagucacaaaaugugauc

SEQ ID NO: 525440 - RNA, 24 nt, Human
uccaaagcaucauaaucaggagcc

SEQ ID NO: 525441 - RNA, 21 nt, Human
uccauucuccucuuccucuuu

SEQ ID NO: 525442 - RNA, 20 nt, Human
uccccaagccagggcaucac

SEQ ID NO: 525443 - RNA, 27 nt, Human
uccccaagccagggcaucaccuggccu

SEQ ID NO: 525444 - RNA, 21 nt, Human
ucccgugcuuuaacaagcccu

SEQ ID NO: 525445 - RNA, 21 nt, Human
uccuagacuuuagcucggucc

SEQ ID NO: 525446 - RNA, 24 nt, Human
uccuccaacagauggguuuccugg

SEQ ID NO: 525447 - RNA, 21 nt, Human
ucuacuggguuugaaacuuua

SEQ ID NO: 525448 - RNA, 22 nt, Human
ucuuguaaauucacugaaugca

SEQ ID NO: 525449 - RNA, 22 nt, Human
ugaaacuuuauuucuuccuaga

SEQ ID NO: 525450 - RNA, 22 nt, Human
ugaacagagccugcacuagaaa

SEQ ID NO: 525451 - RNA, 22 nt, Human
ugaauaguuuuucuguaguaca

SEQ ID NO: 525452 - RNA, 23 nt, Human
ugagggaccuagguaaacauccu

SEQ ID NO: 525453 - RNA, 19 nt, Human
ugaucaaucacgccaguga

SEQ ID NO: 525454 - RNA, 23 nt, Human
ugcacuagaaaauaaagccagag

SEQ ID NO: 525455 - RNA, 21 nt, Human
ugccuucagccacuuagcagc

SEQ ID NO: 525456 - RNA, 19 nt, Human
ugguaagcagaaaagcauc

SEQ ID NO: 525457 - RNA, 21 nt, Human
uuaugggauuaacuguuaaua

SEQ ID NO: 525458 - RNA, 25 nt, Human
uuuacuuuacugaauacugaaaaag

SEQ ID NO: 525459 - RNA, 18 nt, Human
uuucccacagugccuggc

SEQ ID NO: 525460 - RNA, 29 nt, Human
uuuggaugaucccaauuuuguuggcaacc

SEQ ID NO: 525461 - RNA, 18 nt, Human
uuuuuuuuuuuuuuuuug

SEQ ID NO: 525462 - RNA, 25 nt, Human
uuuuuuuuuuuuuuuuuuuuugggg

SEQ ID NO: 525463 - RNA, 24 nt, Human
aaagugcugggauuacagguguga

SEQ ID NO: 525464 - RNA, 20 nt, Human
aaauaaaaauacaggacgcc

SEQ ID NO: 525465 - RNA, 19 nt, Human
aaccaggagagaggaacug

SEQ ID NO: 525466 - RNA, 19 nt, Human
aacccugcccugcccucca

SEQ ID NO: 525467 - RNA, 23 nt, Human
aagaaggcagggcaacaggggug

SEQ ID NO: 525468 - RNA, 22 nt, Human
aagaugcugcguuugguuuugg

SEQ ID NO: 525469 - RNA, 25 nt, Human
aagcaauccuccugccucagccucu

SEQ ID NO: 525470 - RNA, 19 nt, Human
aagccaauucccgccaccg

SEQ ID NO: 525471 - RNA, 21 nt, Human
aagccaauucccgccaccgac

SEQ ID NO: 525472 - RNA, 25 nt, Human
aagcgauccucccaccucggccucc

SEQ ID NO: 525473 - RNA, 19 nt, Human
aaggagcaggggcugcaga

SEQ ID NO: 525474 - RNA, 23 nt, Human
aaggggcucaugggcucggggca

SEQ ID NO: 525475 - RNA, 18 nt, Human
aagugcugggauuacagg

SEQ ID NO: 525476 - RNA, 19 nt, Human
aagugcugggauuacaggu

SEQ ID NO: 525477 - RNA, 26 nt, Human
aagugcugggauuacaggugugagcc

SEQ ID NO: 525478 - RNA, 18 nt, Human
aauucccgccaccgacuc

SEQ ID NO: 525479 - RNA, 23 nt, Human
acagggacccuaaaggaagccau

SEQ ID NO: 525480 - RNA, 22 nt, Human
acagugguaagagcacugugga

SEQ ID NO: 525481 - RNA, 22 nt, Human
accacaaucaaguuuuucugcc

SEQ ID NO: 525482 - RNA, 25 nt, Human
accauguugcccaggcugguuucaa

SEQ ID NO: 525483 - RNA, 18 nt, Human
accuggagccccugcccu

SEQ ID NO: 525484 - RNA, 19 nt, Human
acuacaggugugcgcuacc

SEQ ID NO: 525485 - RNA, 25 nt, Human
acucugccgcccaggcuggagugca

SEQ ID NO: 525486 - RNA, 26 nt, Human
agacagcuucagagaggagggaacgc

SEQ ID NO: 525487 - RNA, 19 nt, Human
agagaggaacuggacugug

SEQ ID NO: 525488 - RNA, 21 nt, Human
agccaccacgcccagcuuaaa

SEQ ID NO: 525489 - RNA, 23 nt, Human
agccuggggcuggagucccggcu

SEQ ID NO: 525490 - RNA, 19 nt, Human
aggaagcacaggucuggga

SEQ ID NO: 525491 - RNA, 23 nt, Human
aggaagcuggcuggguuugggag

SEQ ID NO: 525492 - RNA, 19 nt, Human
aggacaaaaggggcucaug

SEQ ID NO: 525493 - RNA, 19 nt, Human
aggagcaggggcugcagag

SEQ ID NO: 525494 - RNA, 21 nt, Human
aggaggagccaggaucggggg

SEQ ID NO: 525495 - RNA, 23 nt, Human
aggaugacuuaaacacaucccug

SEQ ID NO: 525496 - RNA, 19 nt, Human
aggcagaggaugacacaua

SEQ ID NO: 525497 - RNA, 21 nt, Human
aggcagcaccccagcgcuggu

SEQ ID NO: 525498 - RNA, 24 nt, Human
aggcaggaaggcagcagugccuga

SEQ ID NO: 525499 - RNA, 21 nt, Human
aggcccgggaggcuggaggug

SEQ ID NO: 525500 - RNA, 18 nt, Human
agggaagggggaugaggg

SEQ ID NO: 525501 - RNA, 18 nt, Human
agggacccuaaaggaagc

SEQ ID NO: 525502 - RNA, 19 nt, Human
agggcugaaccauuucaaa

SEQ ID NO: 525503 - RNA, 20 nt, Human
aggggaaugggaaauggcag

SEQ ID NO: 525504 - RNA, 22 nt, Human
auaaucaagcagccaccaggcc

SEQ ID NO: 525505 - RNA, 18 nt, Human
augagguuucaccauguu

SEQ ID NO: 525506 - RNA, 19 nt, Human
augagguuucaccauguug

SEQ ID NO: 525507 - RNA, 24 nt, Human
augagguuucaccauguugcccag

SEQ ID NO: 525508 - RNA, 25 nt, Human
caaacuccugggcucaagcgauccu

SEQ ID NO: 525509 - RNA, 24 nt, Human
caaagugcugggauuacaggugug

SEQ ID NO: 525510 - RNA, 20 nt, Human
caagagacucacucaccucc

SEQ ID NO: 525511 - RNA, 21 nt, Human
caagagacucacucaccuccu

SEQ ID NO: 525512 - RNA, 22 nt, Human
caagcaauccuccugccucagc

SEQ ID NO: 525513 - RNA, 27 nt, Human
caagcgauccucccaccucggccuccc

SEQ ID NO: 525514 - RNA, 28 nt, Human
caagcgauccucccaccucggccuccca

SEQ ID NO: 525515 - RNA, 23 nt, Human
cacaugagugcaaguaaagagga

SEQ ID NO: 525516 - RNA, 21 nt, Human
caccauguugcccaggcuggu

SEQ ID NO: 525517 - RNA, 24 nt, Human
caccauguugcccaggcugguuuc

SEQ ID NO: 525518 - RNA, 31 nt, Human
caccauguugcccaggcugguuucaaacucc

SEQ ID NO: 525519 - RNA, 25 nt, Human
cacccuuagcuccuacugccagaga

SEQ ID NO: 525520 - RNA, 24 nt, Human
caccucggccucccaaagugcugg

SEQ ID NO: 525521 - RNA, 18 nt, Human
caccugacuaauuuuugu

SEQ ID NO: 525522 - RNA, 23 nt, Human
cacgccugccuaagagucagaga

SEQ ID NO: 525523 - RNA, 24 nt, Human
cacucugccgcccaggcuggagug

SEQ ID NO: 525524 - RNA, 19 nt, Human
cacuguccacccacaugcc

SEQ ID NO: 525525 - RNA, 21 nt, Human
cagagacagcuucagagagga

SEQ ID NO: 525526 - RNA, 23 nt, Human
cagcaaggagacucaagaagcuu

SEQ ID NO: 525527 - RNA, 21 nt, Human
cagcaccccagcgcuggugcc

SEQ ID NO: 525528 - RNA, 20 nt, Human
caggaucgggggcugaggag

SEQ ID NO: 525529 - RNA, 21 nt, Human
caggcagauggggaggaacca

SEQ ID NO: 525530 - RNA, 21 nt, Human
caggcaugggggccaaggugg

SEQ ID NO: 525531 - RNA, 23 nt, Human
caguaaaggcagaggaugacaca

SEQ ID NO: 525532 - RNA, 21 nt, Human
caucccugcccuucuugggag

SEQ ID NO: 525533 - RNA, 23 nt, Human
cauguugcccaggcugguuucaa

SEQ ID NO: 525534 - RNA, 23 nt, Human
cauguugcccaggcugguuucaa

SEQ ID NO: 525535 - RNA, 24 nt, Human
cauguugcccaggcugguuucaaa

SEQ ID NO: 525536 - RNA, 20 nt, Human
ccaaagugcugggauuacag

SEQ ID NO: 525537 - RNA, 21 nt, Human
ccaaagugcugggauuacagg

SEQ ID NO: 525538 - RNA, 21 nt, Human
ccaaagugcugggauuacagg

SEQ ID NO: 525539 - RNA, 24 nt, Human
ccaaagugcugggauuacaggugu

SEQ ID NO: 525540 - RNA, 19 nt, Human
ccacaaucaaguuuuucug

SEQ ID NO: 525541 - RNA, 20 nt, Human
ccagagaagucaagagucaa

SEQ ID NO: 525542 - RNA, 18 nt, Human
ccaggagagaggaacugg

SEQ ID NO: 525543 - RNA, 20 nt, Human
ccagggcucaagcaauccuc

SEQ ID NO: 525544 - RNA, 20 nt, Human
cccacagcagcccugggaac

SEQ ID NO: 525545 - RNA, 24 nt, Human
cccacagcagcccugggaacccgg

SEQ ID NO: 525546 - RNA, 23 nt, Human
ccccgagccccagccagugacuc

SEQ ID NO: 525547 - RNA, 23 nt, Human
cccgggaggcuggagguguccuu

SEQ ID NO: 525548 - RNA, 18 nt, Human
ccgcccaggcuggagugc

SEQ ID NO: 525549 - RNA, 19 nt, Human
ccgcucccucuccccugcc

SEQ ID NO: 525550 - RNA, 20 nt, Human
ccguaacagggagaacaaca

SEQ ID NO: 525551 - RNA, 19 nt, Human
ccucagccucuggaguagc

SEQ ID NO: 525552 - RNA, 21 nt, Human
ccucagccucuggaguagcug

SEQ ID NO: 525553 - RNA, 26 nt, Human
ccucccaccucggccucccaaagugc

SEQ ID NO: 525554 - RNA, 23 nt, Human
ccuccugccucagccucuggagu

SEQ ID NO: 525555 - RNA, 24 nt, Human
ccucuccccugccugcuggcuccu

SEQ ID NO: 525556 - RNA, 23 nt, Human
ccugccaugaacagggaaaaggu

SEQ ID NO: 525557 - RNA, 24 nt, Human
ccugccucagccucuggaguagcu

SEQ ID NO: 525558 - RNA, 22 nt, Human
ccugccugcuggcuccucaccu

SEQ ID NO: 525559 - RNA, 23 nt, Human
ccugcuggcuccucaccuggagc

SEQ ID NO: 525560 - RNA, 19 nt, Human
ccuggagccccugcccugc

SEQ ID NO: 525561 - RNA, 21 nt, Human
cgcugcacucaacagacaaac

SEQ ID NO: 525562 - RNA, 21 nt, Human
cguuugguuuugggcaggugg

SEQ ID NO: 525563 - RNA, 23 nt, Human
cuaauuuuuguauuuuuuguaga

SEQ ID NO: 525564 - RNA, 24 nt, Human
cucaagcaauccuccugccucagc

SEQ ID NO: 525565 - RNA, 24 nt, Human
cucaagcgauccucccaccucggc

SEQ ID NO: 525566 - RNA, 20 nt, Human
cuccccugccugcuggcucc

SEQ ID NO: 525567 - RNA, 18 nt, Human
cuccugagcuuuacuccc

SEQ ID NO: 525568 - RNA, 23 nt, Human
cuccugggcucaagcgauccucc

SEQ ID NO: 525569 - RNA, 25 nt, Human
cuccugggcucaagcgauccuccca

SEQ ID NO: 525570 - RNA, 22 nt, Human
cugcagagccacagccuggggc

SEQ ID NO: 525571 - RNA, 21 nt, Human
cugcuggucagcaaggagacu

SEQ ID NO: 525572 - RNA, 18 nt, Human
cuggagccccugcccugc

SEQ ID NO: 525573 - RNA, 19 nt, Human
cuggagccccugcccugcc

SEQ ID NO: 525574 - RNA, 24 nt, Human
cuggaguagcugugacuacaggug

SEQ ID NO: 525575 - RNA, 20 nt, Human
cuguuuuuccuuuccagcag

SEQ ID NO: 525576 - RNA, 20 nt, Human
cuuaggggagagcuaggaga

SEQ ID NO: 525577 - RNA, 19 nt, Human
cuuguuuaucugaaauccc

SEQ ID NO: 525578 - RNA, 20 nt, Human
gaacccggaaggagacagug

SEQ ID NO: 525579 - RNA, 19 nt, Human
gaagacgugcacgccugcc

SEQ ID NO: 525580 - RNA, 18 nt, Human
gacaauggaggaacucgg

SEQ ID NO: 525581 - RNA, 19 nt, Human
gacaauggaggaacucgga

SEQ ID NO: 525582 - RNA, 20 nt, Human
gacagcuucagagaggaggu

SEQ ID NO: 525583 - RNA, 20 nt, Human
gacauaaucaagcagccacc

SEQ ID NO: 525584 - RNA, 26 nt, Human
gagccaggaucgggggcugaggagga

SEQ ID NO: 525585 - RNA, 19 nt, Human
gagggaagggggaugaggc

SEQ ID NO: 525586 - RNA, 22 nt, Human
gagguuucaccauguugcccag

SEQ ID NO: 525587 - RNA, 18 nt, Human
gauuacaggugugagcca

SEQ ID NO: 525588 - RNA, 21 nt, Human
gauuacaggugugagccacca

SEQ ID NO: 525589 - RNA, 22 nt, Human
gauuacaggugugagccaccac

SEQ ID NO: 525590 - RNA, 18 nt, Human
gcaacccugcccugcccu

SEQ ID NO: 525591 - RNA, 22 nt, Human
gcagggcaacaggggugaggaa

SEQ ID NO: 525592 - RNA, 26 nt, Human
gcaguagagggcugaaaggucuacac

SEQ ID NO: 525593 - RNA, 21 nt, Human
gcaguggcgcucacuuccucu

SEQ ID NO: 525594 - RNA, 19 nt, Human
gccacccuuagcuccuacu

SEQ ID NO: 525595 - RNA, 24 nt, Human
gcccaggcuggagugcaggggugu

SEQ ID NO: 525596 - RNA, 20 nt, Human
gccucagccucuggaguagc

SEQ ID NO: 525597 - RNA, 22 nt, Human
gcgcucacuuccucucccucag

SEQ ID NO: 525598 - RNA, 19 nt, Human
gcuggagugcaggggugua

SEQ ID NO: 525599 - RNA, 20 nt, Human
ggaggaacucggaggggggc

SEQ ID NO: 525600 - RNA, 18 nt, Human
ggaggaugggaagaugcu

SEQ ID NO: 525601 - RNA, 23 nt, Human
ggcagaggguacuucucauggcc

SEQ ID NO: 525602 - RNA, 26 nt, Human
ggcagauggggaggaaccaggagaga

SEQ ID NO: 525603 - RNA, 21 nt, Human
gggacaguugguacuggggaa

SEQ ID NO: 525604 - RNA, 22 nt, Human
gggaggcuggagguguccuucu

SEQ ID NO: 525605 - RNA, 18 nt, Human
ggggagagcuaggagagg

SEQ ID NO: 525606 - RNA, 22 nt, Human
gggggcugaggaggaagggaag

SEQ ID NO: 525607 - RNA, 20 nt, Human
ggugaugggcuccagcucag

SEQ ID NO: 525608 - RNA, 21 nt, Human
guagagaugagguuucaccau

SEQ ID NO: 525609 - RNA, 22 nt, Human
guagagaugagguuucaccaug

SEQ ID NO: 525610 - RNA, 19 nt, Human
guccccgagccccagccag

SEQ ID NO: 525611 - RNA, 24 nt, Human
guuucaccauguugcccaggcugg

SEQ ID NO: 525612 - RNA, 20 nt, Human
uaaacacaucccugcccuuc

SEQ ID NO: 525613 - RNA, 21 nt, Human
uaagccaauucccgccaccga

SEQ ID NO: 525614 - RNA, 22 nt, Human
uaauuuuuguauuuuuuguaga

SEQ ID NO: 525615 - RNA, 24 nt, Human
uaauuuuuguauuuuuuguagaga

SEQ ID NO: 525616 - RNA, 24 nt, Human
uacaggugugagccaccacgccca

SEQ ID NO: 525617 - RNA, 22 nt, Human
uacaggugugcgcuaccacacc

SEQ ID NO: 525618 - RNA, 24 nt, Human
uacaggugugcgcuaccacaccug

SEQ ID NO: 525619 - RNA, 22 nt, Human
uagagaugagguuucaccaugu

SEQ ID NO: 525620 - RNA, 23 nt, Human
uagcugggguccccgucuagggg

SEQ ID NO: 525621 - RNA, 18 nt, Human
uaggaagcacaggucugg

SEQ ID NO: 525622 - RNA, 25 nt, Human
uaucugaaaucccaguuuaaauagg

SEQ ID NO: 525623 - RNA, 20 nt, Human
ucaaacuccugggcucaagc

SEQ ID NO: 525624 - RNA, 25 nt, Human
ucacaagcaguggcgcucacuuccu

SEQ ID NO: 525625 - RNA, 21 nt, Human
ucaccauguugcccaggcugg

SEQ ID NO: 525626 - RNA, 24 nt, Human
ucacucugccgcccaggcuggagu

SEQ ID NO: 525627 - RNA, 23 nt, Human
ucacugcagccuugaacuccagg

SEQ ID NO: 525628 - RNA, 24 nt, Human
ucacugcagccuugaacuccaggg

SEQ ID NO: 525629 - RNA, 18 nt, Human
ucagccucuggaguagcu

SEQ ID NO: 525630 - RNA, 23 nt, Human
ucccaaagugcugggauuacagg

SEQ ID NO: 525631 - RNA, 18 nt, Human
ucccucaaggcccgggag

SEQ ID NO: 525632 - RNA, 21 nt, Human
uccugggcucaagcgauccuc

SEQ ID NO: 525633 - RNA, 19 nt, Human
ucggaggggggcggagaaa

SEQ ID NO: 525634 - RNA, 18 nt, Human
ucggccucccaaagugcu

SEQ ID NO: 525635 - RNA, 23 nt, Human
ucgggggcugaggaggaagggaa

SEQ ID NO: 525636 - RNA, 18 nt, Human
ucuagugccacccuuagc

SEQ ID NO: 525637 - RNA, 22 nt, Human
ucucacucugccgcccaggcug

SEQ ID NO: 525638 - RNA, 23 nt, Human
ucucacucugccgcccaggcugg

SEQ ID NO: 525639 - RNA, 24 nt, Human
ucucacucugccgcccaggcugga

SEQ ID NO: 525640 - RNA, 26 nt, Human
ucucacucugccgcccaggcuggagu

SEQ ID NO: 525641 - RNA, 27 nt, Human
ucucacucugccgcccaggcuggagug

SEQ ID NO: 525642 - RNA, 24 nt, Human
ucugccgcccaggcuggagugcag

SEQ ID NO: 525643 - RNA, 24 nt, Human
ucuggaguagcugugacuacaggu

SEQ ID NO: 525644 - RNA, 21 nt, Human
ucuggcaacccugcccugccc

SEQ ID NO: 525645 - RNA, 18 nt, Human
ucuuuuuuuuuuuuuuuu

SEQ ID NO: 525646 - RNA, 22 nt, Human
ugaaauuucccaggcuggucac

SEQ ID NO: 525647 - RNA, 24 nt, Human
ugaacuccagggcucaagcaaucc

SEQ ID NO: 525648 - RNA, 18 nt, Human
ugacauaaucaagcagcc

SEQ ID NO: 525649 - RNA, 18 nt, Human
ugacauaaucaagcagcc

SEQ ID NO: 525650 - RNA, 26 nt, Human
ugagaaacacaaggaugacuuaaaca

SEQ ID NO: 525651 - RNA, 18 nt, Human
ugagacagagucucacuc

SEQ ID NO: 525652 - RNA, 22 nt, Human
ugagacagagucucacucugcc

SEQ ID NO: 525653 - RNA, 22 nt, Human
ugagcagcguccccgagccccc

SEQ ID NO: 525654 - RNA, 23 nt, Human
ugaggaggaagggaagaaguccc

SEQ ID NO: 525655 - RNA, 18 nt, Human
ugaggccgaggaggagcc

SEQ ID NO: 525656 - RNA, 24 nt, Human
ugagguuucaccauguugcccagg

SEQ ID NO: 525657 - RNA, 19 nt, Human
ugaugugcccugggggcac

SEQ ID NO: 525658 - RNA, 18 nt, Human
ugcaggaugcaggaggga

SEQ ID NO: 525659 - RNA, 20 nt, Human
ugccagagagcucaggcagg

SEQ ID NO: 525660 - RNA, 24 nt, Human
ugcccaggcugguuucaaacuccu

SEQ ID NO: 525661 - RNA, 28 nt, Human
ugcccaggcugguuucaaacuccugggc

SEQ ID NO: 525662 - RNA, 19 nt, Human
ugcccgggccauggccugc

SEQ ID NO: 525663 - RNA, 26 nt, Human
ugcccgggccauggccugccaugaac

SEQ ID NO: 525664 - RNA, 25 nt, Human
ugcccugcccuccacagggacccua

SEQ ID NO: 525665 - RNA, 18 nt, Human
ugcccugggggcacagga

SEQ ID NO: 525666 - RNA, 21 nt, Human
ugcccugugugagacgugaga

SEQ ID NO: 525667 - RNA, 21 nt, Human
ugccguaacagggagaacaac

SEQ ID NO: 525668 - RNA, 20 nt, Human
ugccucagccucuggaguag

SEQ ID NO: 525669 - RNA, 21 nt, Human
ugccucagccucuggaguagc

SEQ ID NO: 525670 - RNA, 24 nt, Human
ugcugggauuacaggugugagcca

SEQ ID NO: 525671 - RNA, 25 nt, Human
uggagccccugcccugccucguuuc

SEQ ID NO: 525672 - RNA, 20 nt, Human
uggaggaacucggagggggg

SEQ ID NO: 525673 - RNA, 22 nt, Human
uggagggcgcccaggcaugggg

SEQ ID NO: 525674 - RNA, 21 nt, Human
uggagugcagggguguaauca

SEQ ID NO: 525675 - RNA, 23 nt, Human
ugggaggaugggaagaugcugcg

SEQ ID NO: 525676 - RNA, 22 nt, Human
ugggaggcaggaaggcagcagu

SEQ ID NO: 525677 - RNA, 18 nt, Human
ugggauuacaggugugag

SEQ ID NO: 525678 - RNA, 19 nt, Human
ugggauuacaggugugagc

SEQ ID NO: 525679 - RNA, 22 nt, Human
ugggauuacaggugugagccac

SEQ ID NO: 525680 - RNA, 23 nt, Human
ugggauuacaggugugagccacc

SEQ ID NO: 525681 - RNA, 24 nt, Human
ugggauuacaggugugagccacca

SEQ ID NO: 525682 - RNA, 25 nt, Human
uggggucagagcuggagaaguggcc

SEQ ID NO: 525683 - RNA, 19 nt, Human
uggugacuugucgcugcac

SEQ ID NO: 525684 - RNA, 24 nt, Human
uguagagaugagguuucaccaugu

SEQ ID NO: 525685 - RNA, 19 nt, Human
uguccuucuuuccucccuc

SEQ ID NO: 525686 - RNA, 20 nt, Human
uucaaacacaugagugcaag

SEQ ID NO: 525687 - RNA, 22 nt, Human
uucccacagcagcccugggaac

SEQ ID NO: 525688 - RNA, 21 nt, Human
uucuuccccguuccucucccu

SEQ ID NO: 525689 - RNA, 24 nt, Human
uuguagagaugagguuucaccaug

SEQ ID NO: 525690 - RNA, 24 nt, Human
uuucaccauguugcccaggcuggu

SEQ ID NO: 525691 - RNA, 25 nt, Human
uuucccaggcuggucacuagguguc

SEQ ID NO: 525692 - RNA, 24 nt, Human
uuuguagagaugagguuucaccau

SEQ ID NO: 525693 - RNA, 27 nt, Human
uuuuucuuuuuuuuuuuuuuuuugggg

SEQ ID NO: 525694 - RNA, 20 nt, Human
uuuuuguauuuuuuguagag

SEQ ID NO: 525695 - RNA, 23 nt, Human
uuuuuguauuuuuuguagagaug

SEQ ID NO: 525696 - RNA, 24 nt, Human
uuuuuuguagagaugagguuucac

SEQ ID NO: 525697 - RNA, 26 nt, Human
uuuuuuuuuuuugagacagagucuca

SEQ ID NO: 525698 - RNA, 23 nt, Human
uuuuuuuuuuuuuuuuucuuuuu

SEQ ID NO: 525699 - RNA, 21 nt, Human
aaaaaacacagauuucccaaa

SEQ ID NO: 525700 - RNA, 22 nt, Human
aaaaaacacagauuucccaaag

SEQ ID NO: 525701 - RNA, 21 nt, Human
aaaaauguauauucuguugau

SEQ ID NO: 525702 - RNA, 21 nt, Human
aaacacugcucucuucaaagc

SEQ ID NO: 525703 - RNA, 22 nt, Human
aaagcaaacaaacuacagauca

SEQ ID NO: 525704 - RNA, 20 nt, Human
aacuucaaugaaucugacaa

SEQ ID NO: 525705 - RNA, 20 nt, Human
aacuugguuccauucucccc

SEQ ID NO: 525706 - RNA, 19 nt, Human
aagcagccuucugauaguu

SEQ ID NO: 525707 - RNA, 21 nt, Human
aagcagccuucugauaguuga

SEQ ID NO: 525708 - RNA, 18 nt, Human
aaggggaaugaaaaaggg

SEQ ID NO: 525709 - RNA, 20 nt, Human
aagguggaaagccaaagccc

SEQ ID NO: 525710 - RNA, 21 nt, Human
aauggucaggucccuaguacc

SEQ ID NO: 525711 - RNA, 22 nt, Human
acaacagucacguaucucaaca

SEQ ID NO: 525712 - RNA, 20 nt, Human
accccugccuuuuuuuguuu

SEQ ID NO: 525713 - RNA, 24 nt, Human
accucaccuugccugagggcccag

SEQ ID NO: 525714 - RNA, 22 nt, Human
accuggugauucagcugagcua

SEQ ID NO: 525715 - RNA, 22 nt, Human
acgaaaaugcagaaaucaccca

SEQ ID NO: 525716 - RNA, 24 nt, Human
acucuaccuaaaagcaaacaaacc

SEQ ID NO: 525717 - RNA, 19 nt, Human
acuguggucugagagacag

SEQ ID NO: 525718 - RNA, 18 nt, Human
agaaagcuucaucacacu

SEQ ID NO: 525719 - RNA, 21 nt, Human
agacagggacauuuaagucug

SEQ ID NO: 525720 - RNA, 25 nt, Human
agacgaaaaugcagaaaucacccau

SEQ ID NO: 525721 - RNA, 25 nt, Human
agauaucuauuucuacaaaacaaaa

SEQ ID NO: 525722 - RNA, 18 nt, Human
agauuucccaaaguauaa

SEQ ID NO: 525723 - RNA, 19 nt, Human
aggauaguuagcucuucuu

SEQ ID NO: 525724 - RNA, 20 nt, Human
aggcugcucgggggucaggg

SEQ ID NO: 525725 - RNA, 23 nt, Human
aguaacaccaggaaagguaaagg

SEQ ID NO: 525726 - RNA, 20 nt, Human
auggucaggucccuaguacc

SEQ ID NO: 525727 - RNA, 22 nt, Human
auuucauucacuucaucuucca

SEQ ID NO: 525728 - RNA, 19 nt, Human
caaaaaaccagcuccugga

SEQ ID NO: 525729 - RNA, 21 nt, Human
caaaaaaccagcuccuggagg

SEQ ID NO: 525730 - RNA, 30 nt, Human
caaaaagacaacuggucaagugaauccuag

SEQ ID NO: 525731 - RNA, 23 nt, Human
caaaauuaccccacucacacacc

SEQ ID NO: 525732 - RNA, 24 nt, Human
caacucuaccuaaaagcaaacaaa

SEQ ID NO: 525733 - RNA, 22 nt, Human
caacuguaccuugcucagaagc

SEQ ID NO: 525734 - RNA, 22 nt, Human
caagaagcacaccuccacaaca

SEQ ID NO: 525735 - RNA, 18 nt, Human
cacgcugggagcuguaga

SEQ ID NO: 525736 - RNA, 23 nt, Human
cacucugccaaaaagacaacugg

SEQ ID NO: 525737 - RNA, 19 nt, Human
cacugcuuugaaugcaucc

SEQ ID NO: 525738 - RNA, 21 nt, Human
cacugcuuugaaugcauccca

SEQ ID NO: 525739 - RNA, 22 nt, Human
cacugucuugacuaacccaugu

SEQ ID NO: 525740 - RNA, 24 nt, Human
cacuugucuaauuuuaacacccca

SEQ ID NO: 525741 - RNA, 24 nt, Human
cagcuccuuuaagcacuucucugu

SEQ ID NO: 525742 - RNA, 19 nt, Human
cagcugcaggucuguugga

SEQ ID NO: 525743 - RNA, 21 nt, Human
caggcaucucucucauucuuu

SEQ ID NO: 525744 - RNA, 23 nt, Human
cagggacauuuaagucugcagag

SEQ ID NO: 525745 - RNA, 24 nt, Human
ccagagguggagccuccagaggca

SEQ ID NO: 525746 - RNA, 19 nt, Human
ccccagagguggagccucc

SEQ ID NO: 525747 - RNA, 23 nt, Human
cccccauaagcucuauaauaauu

SEQ ID NO: 525748 - RNA, 20 nt, Human
cccugcuggggggugccucc

SEQ ID NO: 525749 - RNA, 19 nt, Human
ccgagccaggugcgggaua

SEQ ID NO: 525750 - RNA, 21 nt, Human
ccuucugcuagcuuuugaaug

SEQ ID NO: 525751 - RNA, 19 nt, Human
cgaaaaugcagaaaucacc

SEQ ID NO: 525752 - RNA, 24 nt, Human
cgaggaguagcuuuguggcguucu

SEQ ID NO: 525753 - RNA, 23 nt, Human
cgcacccauugacuugcgcccac

SEQ ID NO: 525754 - RNA, 19 nt, Human
cggcaaaaaacacagauuu

SEQ ID NO: 525755 - RNA, 22 nt, Human
cgggcgccccuccccaagccuc

SEQ ID NO: 525756 - RNA, 21 nt, Human
cgugcugggagaaacacugcu

SEQ ID NO: 525757 - RNA, 20 nt, Human
cuaaaagcaaacaaacuaca

SEQ ID NO: 525758 - RNA, 23 nt, Human
cuaaaagcaaacaaacuacagau

SEQ ID NO: 525759 - RNA, 27 nt, Human
cuaaaagcaaacaaacuacagaucaua

SEQ ID NO: 525760 - RNA, 23 nt, Human
cuaaagguuugggagccaagacc

SEQ ID NO: 525761 - RNA, 22 nt, Human
cucaacaagguggaaagccaaa

SEQ ID NO: 525762 - RNA, 23 nt, Human
cuccagaggcaggcaggccuccu

SEQ ID NO: 525763 - RNA, 20 nt, Human
cucuacacacugcuuugaau

SEQ ID NO: 525764 - RNA, 18 nt, Human
cucuguuuuuuccccauc

SEQ ID NO: 525765 - RNA, 19 nt, Human
cugaauacagcacacugau

SEQ ID NO: 525766 - RNA, 21 nt, Human
cugccccugcuggggggugcc

SEQ ID NO: 525767 - RNA, 21 nt, Human
cugccccugcuggggggugcc

SEQ ID NO: 525768 - RNA, 24 nt, Human
cuguauugguuauucuaguuauac

SEQ ID NO: 525769 - RNA, 18 nt, Human
cuguucuuuuacauuugc

SEQ ID NO: 525770 - RNA, 20 nt, Human
cuguugauaugggguggaga

SEQ ID NO: 525771 - RNA, 18 nt, Human
gaaaaugcagaaaucacc

SEQ ID NO: 525772 - RNA, 20 nt, Human
gaaaaugcagaaaucaccca

SEQ ID NO: 525773 - RNA, 19 nt, Human
gaagaaauggucagguccc

SEQ ID NO: 525774 - RNA, 28 nt, Human
gaauaggugugguguggugacgaccucg

SEQ ID NO: 525775 - RNA, 18 nt, Human
gaaucugaauguuggccu

SEQ ID NO: 525776 - RNA, 19 nt, Human
gaaucugaauguuggccug

SEQ ID NO: 525777 - RNA, 24 nt, Human
gauucugguauguugugucuuugu

SEQ ID NO: 525778 - RNA, 25 nt, Human
gcaaacaaacuacagaucauauuaa

SEQ ID NO: 525779 - RNA, 22 nt, Human
gcacccauugacuugcgcccac

SEQ ID NO: 525780 - RNA, 23 nt, Human
gcagagaaagccuucagaccaca

SEQ ID NO: 525781 - RNA, 18 nt, Human
gccugggcaauggcgggc

SEQ ID NO: 525782 - RNA, 19 nt, Human
gcucuguuuuuuccccauc

SEQ ID NO: 525783 - RNA, 20 nt, Human
gcugaaauccaaaauuaccc

SEQ ID NO: 525784 - RNA, 22 nt, Human
gcuggcuuuucugcugaucuca

SEQ ID NO: 525785 - RNA, 24 nt, Human
gcuguggugggcuccacccaguug

SEQ ID NO: 525786 - RNA, 21 nt, Human
ggcuccuccccccauaagcuc

SEQ ID NO: 525787 - RNA, 20 nt, Human
guaaagaaagcuucaucaca

SEQ ID NO: 525788 - RNA, 20 nt, Human
gucauucaggagcagguugu

SEQ ID NO: 525789 - RNA, 20 nt, Human
gucuaauguugacagugggg

SEQ ID NO: 525790 - RNA, 26 nt, Human
gugaauccuacauuggaagaaauggu

SEQ ID NO: 525791 - RNA, 21 nt, Human
gugaugaauuauguuccuuug

SEQ ID NO: 525792 - RNA, 19 nt, Human
gugcugggagaaacacugc

SEQ ID NO: 525793 - RNA, 24 nt, Human
uaaauauauuuauucauaugugga

SEQ ID NO: 525794 - RNA, 22 nt, Human
uaacaccaggaaagguaaaggg

SEQ ID NO: 525795 - RNA, 23 nt, Human
uaacuuucugucucguugaucug

SEQ ID NO: 525796 - RNA, 19 nt, Human
uaauggccuucuuugucuc

SEQ ID NO: 525797 - RNA, 20 nt, Human
uacaaaacaaaacacuccca

SEQ ID NO: 525798 - RNA, 23 nt, Human
uacaaaacaaaacacucccaaau

SEQ ID NO: 525799 - RNA, 24 nt, Human
uacaaaacaaaacacucccaaauu

SEQ ID NO: 525800 - RNA, 22 nt, Human
uacauuggaagaaauggucagg

SEQ ID NO: 525801 - RNA, 23 nt, Human
uacauuggaagaaauggucaggu

SEQ ID NO: 525802 - RNA, 20 nt, Human
uagaggaacuagaaccucac

SEQ ID NO: 525803 - RNA, 19 nt, Human
uagcugaagaacaagcucu

SEQ ID NO: 525804 - RNA, 23 nt, Human
uagguaugauagaaacuaacacu

SEQ ID NO: 525805 - RNA, 24 nt, Human
uagugcuauaaauuucccucuaca

SEQ ID NO: 525806 - RNA, 20 nt, Human
uaguuacaaauauuaggaag

SEQ ID NO: 525807 - RNA, 23 nt, Human
uauccuugcuaacuuucuguccu

SEQ ID NO: 525808 - RNA, 19 nt, Human
uauguggauucucaacaug

SEQ ID NO: 525809 - RNA, 22 nt, Human
uauuccucuugcaaaagcagcc

SEQ ID NO: 525810 - RNA, 22 nt, Human
uauuccucuugcaaaagcagcc

SEQ ID NO: 525811 - RNA, 22 nt, Human
ucaagugaauccuacauuggaa

SEQ ID NO: 525812 - RNA, 19 nt, Human
ucaucuaucuguauuccuc

SEQ ID NO: 525813 - RNA, 22 nt, Human
ucauucaggagcagguuguuca

SEQ ID NO: 525814 - RNA, 24 nt, Human
ucauucaggagcagguuguucagu

SEQ ID NO: 525815 - RNA, 24 nt, Human
ucccagagauucugguauguugug

SEQ ID NO: 525816 - RNA, 21 nt, Human
uccccaucacuuucaguuaca

SEQ ID NO: 525817 - RNA, 18 nt, Human
uccgagccaggugcggga

SEQ ID NO: 525818 - RNA, 21 nt, Human
uccugcuuccucuugugggca

SEQ ID NO: 525819 - RNA, 20 nt, Human
uccuuuggaggaggagaggc

SEQ ID NO: 525820 - RNA, 22 nt, Human
ucgcaucggcuccugaggcuuc

SEQ ID NO: 525821 - RNA, 24 nt, Human
ucucagaucuccagcugcgugcug

SEQ ID NO: 525822 - RNA, 22 nt, Human
ucucgagccuuggucuucagcu

SEQ ID NO: 525823 - RNA, 26 nt, Human
ucucguugguuucaaagaacaucuuu

SEQ ID NO: 525824 - RNA, 19 nt, Human
ucucucaacuguaccuugc

SEQ ID NO: 525825 - RNA, 23 nt, Human
ucucuguauuucugaaucugaau

SEQ ID NO: 525826 - RNA, 22 nt, Human
ucugacaggacccucagcugca

SEQ ID NO: 525827 - RNA, 25 nt, Human
ucugagcaaggcucagcuggcuggc

SEQ ID NO: 525828 - RNA, 21 nt, Human
ucuuauaccaacugcaucuuc

SEQ ID NO: 525829 - RNA, 20 nt, Human
ucuucagcuccaucagcucc

SEQ ID NO: 525830 - RNA, 21 nt, Human
ucuucagcuccaucagcuccu

SEQ ID NO: 525831 - RNA, 18 nt, Human
ucuuggcuccucccccca

SEQ ID NO: 525832 - RNA, 21 nt, Human
ucuuugacuaggaaagggaac

SEQ ID NO: 525833 - RNA, 21 nt, Human
ucuuuguucucguugguuuca

SEQ ID NO: 525834 - RNA, 19 nt, Human
ugaaauccaaaauuacccc

SEQ ID NO: 525835 - RNA, 18 nt, Human
ugaaggguuuuuuguguc

SEQ ID NO: 525836 - RNA, 19 nt, Human
ugaaguaaauguguaaguc

SEQ ID NO: 525837 - RNA, 18 nt, Human
ugaauacagcacacugau

SEQ ID NO: 525838 - RNA, 22 nt, Human
ugacagugggguguuaaagucu

SEQ ID NO: 525839 - RNA, 20 nt, Human
ugacuugcgcccacugucug

SEQ ID NO: 525840 - RNA, 22 nt, Human
ugagacuccaugggcguaggac

SEQ ID NO: 525841 - RNA, 18 nt, Human
ugagaugaacccaguacc

SEQ ID NO: 525842 - RNA, 22 nt, Human
ugaggcaaugccucgcccugcu

SEQ ID NO: 525843 - RNA, 21 nt, Human
ugagugaguuucuucauccug

SEQ ID NO: 525844 - RNA, 20 nt, Human
ugaguuucuucauccugagu

SEQ ID NO: 525845 - RNA, 18 nt, Human
ugcccugcccccagaggu

SEQ ID NO: 525846 - RNA, 23 nt, Human
ugcccugcccccagagguggagc

SEQ ID NO: 525847 - RNA, 24 nt, Human
ugcucuguuuaccuaagcaagccu

SEQ ID NO: 525848 - RNA, 20 nt, Human
uggaaaaguaugaccuuagc

SEQ ID NO: 525849 - RNA, 18 nt, Human
uggagaacaaugcaggga

SEQ ID NO: 525850 - RNA, 22 nt, Human
uggcaugauuuugcagcggcug

SEQ ID NO: 525851 - RNA, 28 nt, Human
uggggcugaaauccaaaauuaccccacu

SEQ ID NO: 525852 - RNA, 19 nt, Human
ugguauguugugucuuugu

SEQ ID NO: 525853 - RNA, 24 nt, Human
ugguauguugugucuuuguucucg

SEQ ID NO: 525854 - RNA, 22 nt, Human
uggucuucagcuccaucagcuc

SEQ ID NO: 525855 - RNA, 20 nt, Human
ugguguggauguccuuucug

SEQ ID NO: 525856 - RNA, 19 nt, Human
uguggugggcuccacccag

SEQ ID NO: 525857 - RNA, 18 nt, Human
uguuuuccauuugcuucg

SEQ ID NO: 525858 - RNA, 26 nt, Human
uuacuuccaaguauguggucaauuuu

SEQ ID NO: 525859 - RNA, 19 nt, Human
uuaugugugaauuugaucc

SEQ ID NO: 525860 - RNA, 21 nt, Human
uucaaaaaaccagcuccugga

SEQ ID NO: 525861 - RNA, 24 nt, Human
uucaacuucaaugaaucugacaau

SEQ ID NO: 525862 - RNA, 19 nt, Human
uucacuucaucuuccaucg

SEQ ID NO: 525863 - RNA, 23 nt, Human
uucugaaucugaauguuggccug

SEQ ID NO: 525864 - RNA, 19 nt, Human
uucuucuaaacuuuucuca

SEQ ID NO: 525865 - RNA, 18 nt, Human
uugaaggaagaccaagaa

SEQ ID NO: 525866 - RNA, 24 nt, Human
uugcacuguggucugagagacagu

SEQ ID NO: 525867 - RNA, 18 nt, Human
uugcugaggagagcuuua

SEQ ID NO: 525868 - RNA, 20 nt, Human
uuggaggaggagaggcgcuc

SEQ ID NO: 525869 - RNA, 24 nt, Human
uugguguggauguccuuucuguuu

SEQ ID NO: 525870 - RNA, 18 nt, Human
uugugugugcccugcccc

SEQ ID NO: 525871 - RNA, 30 nt, Human
uuguugaauugaucccuuucccauuauguu

SEQ ID NO: 525872 - RNA, 23 nt, Human
uuuacaaucugagcaaggcucag

SEQ ID NO: 525873 - RNA, 21 nt, Human
uuuagcagauucaaaugacuc

SEQ ID NO: 525874 - RNA, 21 nt, Human
uuuccaguuuuucugcucugu

SEQ ID NO: 525875 - RNA, 24 nt, Human
uuugaucaucugaagccuucuucu

SEQ ID NO: 525876 - RNA, 19 nt, Human
uuuuccccaucuugguggu

SEQ ID NO: 525877 - RNA, 20 nt, Human
uuuuuuuucuuuauuagucu

SEQ ID NO: 525878 - RNA, 25 nt, Human
aaacauaaccugccaaaauauuuuc

SEQ ID NO: 525879 - RNA, 22 nt, Human
aagcuccacagacguuuaauaa

SEQ ID NO: 525880 - RNA, 20 nt, Human
aaguacaagaaaguuaacug

SEQ ID NO: 525881 - RNA, 20 nt, Human
aaugcagagggcggagggga

SEQ ID NO: 525882 - RNA, 18 nt, Human
acacgcccccgcgugcca

SEQ ID NO: 525883 - RNA, 18 nt, Human
agaaaaagaaguccccuc

SEQ ID NO: 525884 - RNA, 21 nt, Human
agacaagagcaaaaagaaucc

SEQ ID NO: 525885 - RNA, 22 nt, Human
agagcaaaaagaaucccauugg

SEQ ID NO: 525886 - RNA, 25 nt, Human
agagcacacgcccccgcgugccacu

SEQ ID NO: 525887 - RNA, 20 nt, Human
agagccccaagagacagcag

SEQ ID NO: 525888 - RNA, 24 nt, Human
agagggcggaggggagagagcccc

SEQ ID NO: 525889 - RNA, 19 nt, Human
agcaaaaaaguacaagaaa

SEQ ID NO: 525890 - RNA, 24 nt, Human
agccccagcuucugucucuuucug

SEQ ID NO: 525891 - RNA, 22 nt, Human
aggaugaagggagggguggagg

SEQ ID NO: 525892 - RNA, 26 nt, Human
agggagggggccuggcugggcugagu

SEQ ID NO: 525893 - RNA, 19 nt, Human
agggagggguggaggggcu

SEQ ID NO: 525894 - RNA, 30 nt, Human
aguuuaugucuuuuuuuuuuuuuuccuuuu

SEQ ID NO: 525895 - RNA, 19 nt, Human
aucaccuccaacauggacu

SEQ ID NO: 525896 - RNA, 23 nt, Human
auggggccgcugagugggguggg

SEQ ID NO: 525897 - RNA, 22 nt, Human
caaaaaaguacaagaaaguuaa

SEQ ID NO: 525898 - RNA, 21 nt, Human
caaaacuuaaagaaacaaaga

SEQ ID NO: 525899 - RNA, 20 nt, Human
caagacaagagcaaaaagaa

SEQ ID NO: 525900 - RNA, 22 nt, Human
caagacaagagcaaaaagaauc

SEQ ID NO: 525901 - RNA, 23 nt, Human
caagacaagagcaaaaagaaucc

SEQ ID NO: 525902 - RNA, 21 nt, Human
caagagcaaaaagaaucccau

SEQ ID NO: 525903 - RNA, 27 nt, Human
caagagcaaaaagaaucccauugguga

SEQ ID NO: 525904 - RNA, 24 nt, Human
caauaaguuaaaacuacaagaagc

SEQ ID NO: 525905 - RNA, 22 nt, Human
cacacgcccccgcgugccacuc

SEQ ID NO: 525906 - RNA, 20 nt, Human
cacccccgccccaguuggua

SEQ ID NO: 525907 - RNA, 22 nt, Human
cagacaccaaacguggggacac

SEQ ID NO: 525908 - RNA, 23 nt, Human
cagggagggggccuggcugggcu

SEQ ID NO: 525909 - RNA, 28 nt, Human
caguuuaugucuuuuuuuuuuuuuuccu

SEQ ID NO: 525910 - RNA, 26 nt, Human
cauagcaauaaguuaaaacuacaaga

SEQ ID NO: 525911 - RNA, 24 nt, Human
ccaagucccccucgccugggagcc

SEQ ID NO: 525912 - RNA, 21 nt, Human
ccaguugguaaacauaacccu

SEQ ID NO: 525913 - RNA, 19 nt, Human
ccccagggugggggacaaa

SEQ ID NO: 525914 - RNA, 21 nt, Human
ccccaguugguaaacauaacc

SEQ ID NO: 525915 - RNA, 22 nt, Human
cccccagggacguggaagcccc

SEQ ID NO: 525916 - RNA, 18 nt, Human
ccccccacccccgcccca

SEQ ID NO: 525917 - RNA, 27 nt, Human
ccccccacccccgccccaguugguaaa

SEQ ID NO: 525918 - RNA, 21 nt, Human
cccccugcggggaggggcugg

SEQ ID NO: 525919 - RNA, 22 nt, Human
cccccugcggggaggggcuggc

SEQ ID NO: 525920 - RNA, 23 nt, Human
ccccgcgugccacucggcuacca

SEQ ID NO: 525921 - RNA, 22 nt, Human
ccccgugggcugcuagccccua

SEQ ID NO: 525922 - RNA, 22 nt, Human
ccccuaagcccugcucccuggg

SEQ ID NO: 525923 - RNA, 21 nt, Human
ccccucgccugggagccccgg

SEQ ID NO: 525924 - RNA, 18 nt, Human
cccgcagagcacacgccc

SEQ ID NO: 525925 - RNA, 24 nt, Human
cccuaagcccugcucccugggccc

SEQ ID NO: 525926 - RNA, 25 nt, Human
cccuaagcccugcucccugggcccc

SEQ ID NO: 525927 - RNA, 20 nt, Human
cccugcucccugggcccccc

SEQ ID NO: 525928 - RNA, 23 nt, Human
cccugcucccugggcccccccca

SEQ ID NO: 525929 - RNA, 26 nt, Human
ccgugggcugcuagccccuaagcccu

SEQ ID NO: 525930 - RNA, 21 nt, Human
ccuccaacauggacucugucg

SEQ ID NO: 525931 - RNA, 23 nt, Human
ccuccaacauggacucugucgug

SEQ ID NO: 525932 - RNA, 22 nt, Human
ccugccccccagggacguggaa

SEQ ID NO: 525933 - RNA, 19 nt, Human
ccugcccugcugcagggga

SEQ ID NO: 525934 - RNA, 23 nt, Human
ccuggcccccugcggggaggggc

SEQ ID NO: 525935 - RNA, 21 nt, Human
ccuggccccugccccccaggg

SEQ ID NO: 525936 - RNA, 21 nt, Human
ccugggccccccccacccccg

SEQ ID NO: 525937 - RNA, 18 nt, Human
cggccuggcccccugcgg

SEQ ID NO: 525938 - RNA, 23 nt, Human
cguagccccagcuucugucucuu

SEQ ID NO: 525939 - RNA, 19 nt, Human
cgugggcugcuagccccua

SEQ ID NO: 525940 - RNA, 21 nt, Human
cucaagacaagagcaaaaaga

SEQ ID NO: 525941 - RNA, 18 nt, Human
cucccugggcccccccca

SEQ ID NO: 525942 - RNA, 24 nt, Human
cucucuggagccuggcccccccca

SEQ ID NO: 525943 - RNA, 22 nt, Human
cugcggggaggggcuggccucc

SEQ ID NO: 525944 - RNA, 21 nt, Human
cuggccguggggacugucccg

SEQ ID NO: 525945 - RNA, 18 nt, Human
cuggugccaguuuauguc

SEQ ID NO: 525946 - RNA, 24 nt, Human
cugucucuuucugucuaucccugu

SEQ ID NO: 525947 - RNA, 20 nt, Human
cuuuuuuuuuuuuuuuuugg

SEQ ID NO: 525948 - RNA, 25 nt, Human
cuuuuuuuuuuuuuuuuugucuuuu

SEQ ID NO: 525949 - RNA, 19 nt, Human
gagcacacgcccccgcgug

SEQ ID NO: 525950 - RNA, 19 nt, Human
gaggggcuggccuccaggg

SEQ ID NO: 525951 - RNA, 18 nt, Human
gagggggccuggcugggc

SEQ ID NO: 525952 - RNA, 20 nt, Human
gagggguggaggggcugagc

SEQ ID NO: 525953 - RNA, 21 nt, Human
gccccagcuucugucucuuuc

SEQ ID NO: 525954 - RNA, 21 nt, Human
gcucccugggccccccccacc

SEQ ID NO: 525955 - RNA, 25 nt, Human
gcuuuuuuuuccucuucuguuugug

SEQ ID NO: 525956 - RNA, 21 nt, Human
ggacaaacccagcccuuauug

SEQ ID NO: 525957 - RNA, 21 nt, Human
ggagggguggaggggcugagc

SEQ ID NO: 525958 - RNA, 21 nt, Human
ggcagggaggacuuaaaacca

SEQ ID NO: 525959 - RNA, 19 nt, Human
ggcuccggccuguggcuuc

SEQ ID NO: 525960 - RNA, 19 nt, Human
gggacugucccgcagagca

SEQ ID NO: 525961 - RNA, 23 nt, Human
gggagggggccuggcugggcuga

SEQ ID NO: 525962 - RNA, 24 nt, Human
gggagggggccuggcugggcugag

SEQ ID NO: 525963 - RNA, 21 nt, Human
gggccccccccacccccgccc

SEQ ID NO: 525964 - RNA, 24 nt, Human
gggugggggacaaacccagcccuu

SEQ ID NO: 525965 - RNA, 20 nt, Human
gggugggggagagagagcug

SEQ ID NO: 525966 - RNA, 23 nt, Human
gucuuuuuuuuuuuuuuccuuuu

SEQ ID NO: 525967 - RNA, 18 nt, Human
gugcgagggcucccaggg

SEQ ID NO: 525968 - RNA, 21 nt, Human
uacaagaagcuaaauucagca

SEQ ID NO: 525969 - RNA, 21 nt, Human
uagccccuaagcccugcuccc

SEQ ID NO: 525970 - RNA, 26 nt, Human
uaggcauaaccaugucucggcaagac

SEQ ID NO: 525971 - RNA, 24 nt, Human
uaucaagaacaagcuagggauuuc

SEQ ID NO: 525972 - RNA, 25 nt, Human
uccacagacguuuaauaacaacacc

SEQ ID NO: 525973 - RNA, 19 nt, Human
ucccaggggcuccggccug

SEQ ID NO: 525974 - RNA, 24 nt, Human
ucccccucgccugggagccccggc

SEQ ID NO: 525975 - RNA, 20 nt, Human
ucccugggccccccccaccc

SEQ ID NO: 525976 - RNA, 23 nt, Human
uccgaauaaauaacaggaugaag

SEQ ID NO: 525977 - RNA, 18 nt, Human
ucgcuguguccgucugcg

SEQ ID NO: 525978 - RNA, 20 nt, Human
ucuaucccuguccacguguc

SEQ ID NO: 525979 - RNA, 23 nt, Human
ucuuuuuuuuuuuuuuccuuuuu

SEQ ID NO: 525980 - RNA, 18 nt, Human
ucuuuuuuuuuuuuuuuu

SEQ ID NO: 525981 - RNA, 21 nt, Human
ugagcccccuccccccuggcc

SEQ ID NO: 525982 - RNA, 20 nt, Human
ugagugggguggggagcggu

SEQ ID NO: 525983 - RNA, 22 nt, Human
ugcggggaggggcuggccucca

SEQ ID NO: 525984 - RNA, 19 nt, Human
ugcucccugggcccccccc

SEQ ID NO: 525985 - RNA, 21 nt, Human
uggagccuggccccccccagg

SEQ ID NO: 525986 - RNA, 21 nt, Human
uggcaggggccuaggccucgg

SEQ ID NO: 525987 - RNA, 21 nt, Human
uggcugggcugaguuuugugu

SEQ ID NO: 525988 - RNA, 23 nt, Human
ugggccccccccacccccgcccc

SEQ ID NO: 525989 - RNA, 20 nt, Human
uggggcaugucgcugugucc

SEQ ID NO: 525990 - RNA, 26 nt, Human
uggggccgcugagugggguggggagc

SEQ ID NO: 525991 - RNA, 18 nt, Human
ugggggagagagagcugg

SEQ ID NO: 525992 - RNA, 22 nt, Human
ugggggggggguguguggggag

SEQ ID NO: 525993 - RNA, 25 nt, Human
ugggguggggagcggugcgagggcu

SEQ ID NO: 525994 - RNA, 23 nt, Human
ugucugaguuuggccaaccaguc

SEQ ID NO: 525995 - RNA, 20 nt, Human
uguguuuucuuuuuuuguug

SEQ ID NO: 525996 - RNA, 22 nt, Human
uguguuuuuuugucgcuuuuuu

SEQ ID NO: 525997 - RNA, 23 nt, Human
uguuuguguuuuuuugucgcuuu

SEQ ID NO: 525998 - RNA, 27 nt, Human
uguuuguguuuuuuugucgcuuuuuuc

SEQ ID NO: 525999 - RNA, 19 nt, Human
uuaaaacuacaagaagcua

SEQ ID NO: 526000 - RNA, 23 nt, Human
uuaaaacuacaagaagcuaaauu

SEQ ID NO: 526001 - RNA, 21 nt, Human
uuccuugcagcagaagcucca

SEQ ID NO: 526002 - RNA, 18 nt, Human
uucugucuaucccugucc

SEQ ID NO: 526003 - RNA, 23 nt, Human
uugcaaaccggaugaaguaacag

SEQ ID NO: 526004 - RNA, 20 nt, Human
uuggggguggcaggggccua

SEQ ID NO: 526005 - RNA, 19 nt, Human
uuuacaguuuuuuaucacc

SEQ ID NO: 526006 - RNA, 23 nt, Human
uuuguugcuuuuuuuuccucuuc

SEQ ID NO: 526007 - RNA, 20 nt, Human
uuuucuuuuuuuuuuuuugg

SEQ ID NO: 526008 - RNA, 24 nt, Human
uuuucuuuuuuuuuuuuugucuuu

SEQ ID NO: 526009 - RNA, 20 nt, Human
uuuuuuugucgcuuuuuuga

SEQ ID NO: 526010 - RNA, 26 nt, Human
uuuuuuuuuuuuuuuuuacaguuuuu

SEQ ID NO: 526011 - RNA, 22 nt, Human
uuuuuuuuuuuuuuuuuuacag

SEQ ID NO: 526012 - RNA, 21 nt, Human
aaccuagccgaggaguccucc

SEQ ID NO: 526013 - RNA, 19 nt, Human
acaccgcggggcggggcag

SEQ ID NO: 526014 - RNA, 24 nt, Human
acgcagcccugcgaggguccuccu

SEQ ID NO: 526015 - RNA, 21 nt, Human
acggcaagguguggguccucu

SEQ ID NO: 526016 - RNA, 19 nt, Human
agccagaguccagggugug

SEQ ID NO: 526017 - RNA, 18 nt, Human
aggacaccgcggggcggg

SEQ ID NO: 526018 - RNA, 19 nt, Human
agggcauggcgggacaggg

SEQ ID NO: 526019 - RNA, 18 nt, Human
agggugcgguggggcagg

SEQ ID NO: 526020 - RNA, 19 nt, Human
aggguguggcagggcagga

SEQ ID NO: 526021 - RNA, 22 nt, Human
agguccucuggaaccacagucc

SEQ ID NO: 526022 - RNA, 18 nt, Human
aggugccgcaguccagaa

SEQ ID NO: 526023 - RNA, 22 nt, Human
aguccagaacacugcagggcgg

SEQ ID NO: 526024 - RNA, 18 nt, Human
auccagggugccgcgggg

SEQ ID NO: 526025 - RNA, 22 nt, Human
cacggcaagguguggguccucu

SEQ ID NO: 526026 - RNA, 19 nt, Human
cagggugccgcggggcggg

SEQ ID NO: 526027 - RNA, 23 nt, Human
caguccaggacaccgcggggcgg

SEQ ID NO: 526028 - RNA, 20 nt, Human
caguccagggcacggcuggg

SEQ ID NO: 526029 - RNA, 23 nt, Human
caguccagggcgcugaggggcag

SEQ ID NO: 526030 - RNA, 21 nt, Human
ccacaguccagggcgcugagg

SEQ ID NO: 526031 - RNA, 20 nt, Human
ccagagcucagugaggcugg

SEQ ID NO: 526032 - RNA, 21 nt, Human
ccagggcgcugaggggcagga

SEQ ID NO: 526033 - RNA, 21 nt, Human
ccaggguguggcagggcagga

SEQ ID NO: 526034 - RNA, 19 nt, Human
ccagugcccggcggaucgg

SEQ ID NO: 526035 - RNA, 19 nt, Human
cccgugccauagucuaggg

SEQ ID NO: 526036 - RNA, 21 nt, Human
cgaggggcuggguccucuggu

SEQ ID NO: 526037 - RNA, 21 nt, Human
cggcguugcagguguccucca

SEQ ID NO: 526038 - RNA, 24 nt, Human
cgguagcacaaguugccccaggac

SEQ ID NO: 526039 - RNA, 21 nt, Human
cuccaguacaggaguccaugg

SEQ ID NO: 526040 - RNA, 22 nt, Human
cuguagugcaggacgcgguggc

SEQ ID NO: 526041 - RNA, 25 nt, Human
gagcagcaguccagggcgcgauggg

SEQ ID NO: 526042 - RNA, 23 nt, Human
gagccagaguccaggguguggaa

SEQ ID NO: 526043 - RNA, 24 nt, Human
gagccggggccaagguccucggga

SEQ ID NO: 526044 - RNA, 21 nt, Human
gaggcaggggugaggcuccuu

SEQ ID NO: 526045 - RNA, 24 nt, Human
gaguacacgaugcugcgggguccu

SEQ ID NO: 526046 - RNA, 22 nt, Human
gaguccuguggagcagcagucc

SEQ ID NO: 526047 - RNA, 21 nt, Human
gccacaguccagggcacggcu

SEQ ID NO: 526048 - RNA, 18 nt, Human
gcccugcgaggguccucc

SEQ ID NO: 526049 - RNA, 20 nt, Human
gccugagaccacggcagguc

SEQ ID NO: 526050 - RNA, 18 nt, Human
gcgcagcggggcgggggg

SEQ ID NO: 526051 - RNA, 24 nt, Human
gcguggaaggacugggguccugga

SEQ ID NO: 526052 - RNA, 18 nt, Human
ggaaggacugggguccug

SEQ ID NO: 526053 - RNA, 24 nt, Human
ggcaaugguccuccagugcuggag

SEQ ID NO: 526054 - RNA, 21 nt, Human
ggcgagucagagguucucccg

SEQ ID NO: 526055 - RNA, 21 nt, Human
ggcggggauccuccggugccu

SEQ ID NO: 526056 - RNA, 18 nt, Human
ggcguggaaggacugggg

SEQ ID NO: 526057 - RNA, 18 nt, Human
gggcgcgauggggcaugg

SEQ ID NO: 526058 - RNA, 18 nt, Human
gggucccucugugcagga

SEQ ID NO: 526059 - RNA, 21 nt, Human
gggugaggcuccuucaguagc

SEQ ID NO: 526060 - RNA, 18 nt, Human
ggugcugcugugccucag

SEQ ID NO: 526061 - RNA, 18 nt, Human
guaaggcaaugguccucc

SEQ ID NO: 526062 - RNA, 19 nt, Human
guccagggugcgguggggc

SEQ ID NO: 526063 - RNA, 20 nt, Human
guccaggguguggaagggug

SEQ ID NO: 526064 - RNA, 19 nt, Human
guccaggguguggcagggc

SEQ ID NO: 526065 - RNA, 20 nt, Human
gugcagguguccagggugug

SEQ ID NO: 526066 - RNA, 20 nt, Human
gugccauaguccagggugca

SEQ ID NO: 526067 - RNA, 19 nt, Human
uacacauaauguuuucagc

SEQ ID NO: 526068 - RNA, 20 nt, Human
uagcacaaguugccccagga

SEQ ID NO: 526069 - RNA, 18 nt, Human
uagccgaggaguccucca

SEQ ID NO: 526070 - RNA, 18 nt, Human
uaguccggggcacggcaa

SEQ ID NO: 526071 - RNA, 18 nt, Human
ucaggcgagggucuuggc

SEQ ID NO: 526072 - RNA, 21 nt, Human
ucagggcgagccggggccaag

SEQ ID NO: 526073 - RNA, 24 nt, Human
ucaguagcucaguccaggacgcag

SEQ ID NO: 526074 - RNA, 18 nt, Human
uccaacgcgcagcggggc

SEQ ID NO: 526075 - RNA, 20 nt, Human
uccucgggagccagagucca

SEQ ID NO: 526076 - RNA, 26 nt, Human
ucuagcgcacggcguugcaggugucc

SEQ ID NO: 526077 - RNA, 19 nt, Human
ugagaccacggcaggucgc

SEQ ID NO: 526078 - RNA, 20 nt, Human
ugagccgcgguagagguccu

SEQ ID NO: 526079 - RNA, 23 nt, Human
ugaggcaggggugaggcuccuuc

SEQ ID NO: 526080 - RNA, 19 nt, Human
ugcaggaguccaggacgug

SEQ ID NO: 526081 - RNA, 22 nt, Human
ugcagguguccaggguguggca

SEQ ID NO: 526082 - RNA, 18 nt, Human
ugcgaggggcuggguccu

SEQ ID NO: 526083 - RNA, 22 nt, Human
ugcgaggggcuggguccucugg

SEQ ID NO: 526084 - RNA, 24 nt, Human
ugcgaggggcuggguccucuggug

SEQ ID NO: 526085 - RNA, 18 nt, Human
ugcggggccggguucccc

SEQ ID NO: 526086 - RNA, 18 nt, Human
ugcuauauccagggugcc

SEQ ID NO: 526087 - RNA, 21 nt, Human
uggaaggguggggguucugca

SEQ ID NO: 526088 - RNA, 23 nt, Human
uggauucucaggugccgcagucc

SEQ ID NO: 526089 - RNA, 21 nt, Human
uggcaggggguccuccagugc

SEQ ID NO: 526090 - RNA, 19 nt, Human
uguccaggguguggcaggg

SEQ ID NO: 526091 - RNA, 27 nt, Human
ugugcaggaguacacgaugcugcgggg

SEQ ID NO: 526092 - RNA, 21 nt, Human
uguggagcagcaguccagggc

SEQ ID NO: 526093 - RNA, 19 nt, Human
uguucaggcgagggucuug

SEQ ID NO: 526094 - RNA, 20 nt, Human
uuccgugcuguaguccgggg

SEQ ID NO: 526095 - RNA, 22 nt, Human
uucuuugucuuguguaauugau

SEQ ID NO: 526096 - RNA, 24 nt, Human
aaaaaaaagaucaagaaaagagga

SEQ ID NO: 526097 - RNA, 24 nt, Human
aaaaaagaaaaaaauaauaaaaaa

SEQ ID NO: 526098 - RNA, 21 nt, Human
aaaaaagaagaaaagaaaaaa

SEQ ID NO: 526099 - RNA, 19 nt, Human
aaaaacuaccccauugaaa

SEQ ID NO: 526100 - RNA, 25 nt, Human
aaaaagaaaaaaauaauaaaaaaga

SEQ ID NO: 526101 - RNA, 25 nt, Human
aaaagaaaaaaauaauaaaaaagaa

SEQ ID NO: 526102 - RNA, 21 nt, Human
aaaagaagaaaagaaaaaaag

SEQ ID NO: 526103 - RNA, 19 nt, Human
aaaauccuugagcucuacc

SEQ ID NO: 526104 - RNA, 18 nt, Human
aaacaaaacaaaacccaa

SEQ ID NO: 526105 - RNA, 21 nt, Human
aaaugaaaacaaaacaaaacc

SEQ ID NO: 526106 - RNA, 18 nt, Human
aaccacggucagaacuuu

SEQ ID NO: 526107 - RNA, 25 nt, Human
aagaaaaaaauaauaaaaaagaaga

SEQ ID NO: 526108 - RNA, 19 nt, Human
aagaagaaaagaaaaaaag

SEQ ID NO: 526109 - RNA, 20 nt, Human
aagaagaaaagaaaaaaaga

SEQ ID NO: 526110 - RNA, 21 nt, Human
aagaagaaaagaaaaaaagac

SEQ ID NO: 526111 - RNA, 23 nt, Human
aaggaaaaugcaaaaaaaagauc

SEQ ID NO: 526112 - RNA, 18 nt, Human
aaggagacagacggagga

SEQ ID NO: 526113 - RNA, 20 nt, Human
aaggagacagacggaggagg

SEQ ID NO: 526114 - RNA, 23 nt, Human
aaugaaggaaaaugcaaaaaaaa

SEQ ID NO: 526115 - RNA, 23 nt, Human
acaaaaaaauuuacagcgcuaca

SEQ ID NO: 526116 - RNA, 23 nt, Human
acaaaacaaaacccaaaauccuu

SEQ ID NO: 526117 - RNA, 19 nt, Human
accagcagcggaccccgcc

SEQ ID NO: 526118 - RNA, 23 nt, Human
accccucccugcccacccuccca

SEQ ID NO: 526119 - RNA, 19 nt, Human
acggaggaggaggaggagg

SEQ ID NO: 526120 - RNA, 18 nt, Human
acuggggggugggguggg

SEQ ID NO: 526121 - RNA, 23 nt, Human
agaaaagaaaaaaagacuucugg

SEQ ID NO: 526122 - RNA, 27 nt, Human
agaaaagaggauaggaguggaagagaa

SEQ ID NO: 526123 - RNA, 20 nt, Human
agacagacggaggaggagga

SEQ ID NO: 526124 - RNA, 18 nt, Human
agacagucccaaauccac

SEQ ID NO: 526125 - RNA, 19 nt, Human
aggaggaggaggaagagga

SEQ ID NO: 526126 - RNA, 19 nt, Human
aggaggaggaggaagagga

SEQ ID NO: 526127 - RNA, 22 nt, Human
aggaggaggaggaggaagagga

SEQ ID NO: 526128 - RNA, 19 nt, Human
aggaggaggaggaggagga

SEQ ID NO: 526129 - RNA, 20 nt, Human
aggaggcggcggaagggaug

SEQ ID NO: 526130 - RNA, 21 nt, Human
aggaggcggcggaagggaugg

SEQ ID NO: 526131 - RNA, 18 nt, Human
aggauaggaguggaagag

SEQ ID NO: 526132 - RNA, 24 nt, Human
aggcaggaggucagaaaacacggg

SEQ ID NO: 526133 - RNA, 24 nt, Human
aggcggcggaagggauggggcgcg

SEQ ID NO: 526134 - RNA, 21 nt, Human
agggauggggcgcguuucucc

SEQ ID NO: 526135 - RNA, 19 nt, Human
agggucgggggggaaagga

SEQ ID NO: 526136 - RNA, 28 nt, Human
augcaaaaaaaagaucaagaaaagagga

SEQ ID NO: 526137 - RNA, 25 nt, Human
caaaaaaaagaucaagaaaagagga

SEQ ID NO: 526138 - RNA, 23 nt, Human
caaaacccaaaauccuugagcuc

SEQ ID NO: 526139 - RNA, 21 nt, Human
caaagcccaugaagaguccag

SEQ ID NO: 526140 - RNA, 20 nt, Human
cacagcucagcacccccucc

SEQ ID NO: 526141 - RNA, 25 nt, Human
cacagcucagcacccccucccaucc

SEQ ID NO: 526142 - RNA, 19 nt, Human
cacccccucccauccucgc

SEQ ID NO: 526143 - RNA, 24 nt, Human
cagacaccccuagggcaggggcac

SEQ ID NO: 526144 - RNA, 19 nt, Human
cagaggguggcgagccggu

SEQ ID NO: 526145 - RNA, 21 nt, Human
cagccccagccucugcuaaaa

SEQ ID NO: 526146 - RNA, 27 nt, Human
cagccccagccucugcuaaaacagcuu

SEQ ID NO: 526147 - RNA, 19 nt, Human
cagggaggaccgaccuggc

SEQ ID NO: 526148 - RNA, 19 nt, Human
caggugccgggacccccac

SEQ ID NO: 526149 - RNA, 20 nt, Human
cagucccaaauccacauccc

SEQ ID NO: 526150 - RNA, 18 nt, Human
caugaagaguccaggaaa

SEQ ID NO: 526151 - RNA, 22 nt, Human
caugccccugcacccaaacccc

SEQ ID NO: 526152 - RNA, 19 nt, Human
cauuaacuuucaacacaua

SEQ ID NO: 526153 - RNA, 22 nt, Human
cauuuuugacuuaaaaccugaa

SEQ ID NO: 526154 - RNA, 21 nt, Human
ccauggggaccucagccccag

SEQ ID NO: 526155 - RNA, 19 nt, Human
cccaaaauccuugagcucu

SEQ ID NO: 526156 - RNA, 21 nt, Human
ccccaaacucaggcaggaggu

SEQ ID NO: 526157 - RNA, 22 nt, Human
ccccacagcccgaccccccgag

SEQ ID NO: 526158 - RNA, 22 nt, Human
ccccagacagucccaaauccac

SEQ ID NO: 526159 - RNA, 23 nt, Human
cccccagacagucccaaauccac

SEQ ID NO: 526160 - RNA, 19 nt, Human
ccccgaagucugcacuggg

SEQ ID NO: 526161 - RNA, 22 nt, Human
ccccuuuuacuccuuuuuuuuc

SEQ ID NO: 526162 - RNA, 19 nt, Human
cccugcccacccucccaca

SEQ ID NO: 526163 - RNA, 23 nt, Human
cccugcccacccucccacaaaaa

SEQ ID NO: 526164 - RNA, 21 nt, Human
ccgaagucugcacuggggggu

SEQ ID NO: 526165 - RNA, 19 nt, Human
ccgccucggccgccgggcc

SEQ ID NO: 526166 - RNA, 21 nt, Human
ccuagggcaggggcacugaga

SEQ ID NO: 526167 - RNA, 22 nt, Human
ccucugggaccccucccugccc

SEQ ID NO: 526168 - RNA, 22 nt, Human
ccugcccacccucccacaaaaa

SEQ ID NO: 526169 - RNA, 22 nt, Human
ccugggcuggggugcgaggggc

SEQ ID NO: 526170 - RNA, 19 nt, Human
cgccaggugccgggacccc

SEQ ID NO: 526171 - RNA, 24 nt, Human
cgggacccccacagcccgaccccc

SEQ ID NO: 526172 - RNA, 27 nt, Human
cggucagaacuuuuuaaaaaaagaaaa

SEQ ID NO: 526173 - RNA, 20 nt, Human
cguuaaaaaacaaaacagaa

SEQ ID NO: 526174 - RNA, 22 nt, Human
cguuaaaaaacaaaacagaaca

SEQ ID NO: 526175 - RNA, 22 nt, Human
cuacacggaguugucgcccccu

SEQ ID NO: 526176 - RNA, 27 nt, Human
cucagccccagccucugcuaaaacagc

SEQ ID NO: 526177 - RNA, 19 nt, Human
cuccccagcacccagccau

SEQ ID NO: 526178 - RNA, 21 nt, Human
cucuacccucugggaccccuc

SEQ ID NO: 526179 - RNA, 21 nt, Human
cugcggccccuccccucaucu

SEQ ID NO: 526180 - RNA, 25 nt, Human
cugcggccccuccccucaucuguaa

SEQ ID NO: 526181 - RNA, 23 nt, Human
cuggagguuccacccucaaccag

SEQ ID NO: 526182 - RNA, 21 nt, Human
cuggcgcagaggugaaaggag

SEQ ID NO: 526183 - RNA, 23 nt, Human
cuuaaaaccugaauagggucggg

SEQ ID NO: 526184 - RNA, 20 nt, Human
gaaaggagacagacggagga

SEQ ID NO: 526185 - RNA, 20 nt, Human
gaaggaaaaugcaaaaaaaa

SEQ ID NO: 526186 - RNA, 23 nt, Human
gagaacaacggugggggacaggc

SEQ ID NO: 526187 - RNA, 20 nt, Human
gaggaagaggagggcaggag

SEQ ID NO: 526188 - RNA, 20 nt, Human
gaggaagaggagggcaggag

SEQ ID NO: 526189 - RNA, 19 nt, Human
gaggaggaggaggaagagg

SEQ ID NO: 526190 - RNA, 21 nt, Human
gaggcggcggaagggaugggg

SEQ ID NO: 526191 - RNA, 20 nt, Human
gagggcaggcugggggggua

SEQ ID NO: 526192 - RNA, 20 nt, Human
gagguuccacccucaaccag

SEQ ID NO: 526193 - RNA, 21 nt, Human
gaguugucgcccccugcccag

SEQ ID NO: 526194 - RNA, 18 nt, Human
gcagggaggaccgaccug

SEQ ID NO: 526195 - RNA, 19 nt, Human
gcggguaaugcuuucuugg

SEQ ID NO: 526196 - RNA, 19 nt, Human
ggaaagggugccaugcccc

SEQ ID NO: 526197 - RNA, 18 nt, Human
ggaagaggagggcaggag

SEQ ID NO: 526198 - RNA, 20 nt, Human
ggaagcaaagcccaugaaga

SEQ ID NO: 526199 - RNA, 19 nt, Human
ggaccccucccugcccacc

SEQ ID NO: 526200 - RNA, 21 nt, Human
ggaccucagccccagccucug

SEQ ID NO: 526201 - RNA, 19 nt, Human
ggagacagacggaggagga

SEQ ID NO: 526202 - RNA, 20 nt, Human
ggaggaaacagcacaguccg

SEQ ID NO: 526203 - RNA, 18 nt, Human
ggaggaggaggaagagga

SEQ ID NO: 526204 - RNA, 21 nt, Human
ggaggaggaggaagaggaggg

SEQ ID NO: 526205 - RNA, 21 nt, Human
ggaggaggaggaggaggagga

SEQ ID NO: 526206 - RNA, 20 nt, Human
ggaguugucgcccccugccc

SEQ ID NO: 526207 - RNA, 18 nt, Human
ggcagaggguggcgagcc

SEQ ID NO: 526208 - RNA, 19 nt, Human
ggcugggggaguggccgcc

SEQ ID NO: 526209 - RNA, 19 nt, Human
gggaaaaaaauccaaaaac

SEQ ID NO: 526210 - RNA, 20 nt, Human
gggcaggagugaagggugaa

SEQ ID NO: 526211 - RNA, 21 nt, Human
gggccacguucucuccggggc

SEQ ID NO: 526212 - RNA, 20 nt, Human
ggggaaaggaggcggcggaa

SEQ ID NO: 526213 - RNA, 18 nt, Human
ggggaagguuggcaggga

SEQ ID NO: 526214 - RNA, 23 nt, Human
ggggaagguuggcagggaggacc

SEQ ID NO: 526215 - RNA, 22 nt, Human
gggggaaaggaggcggcggaag

SEQ ID NO: 526216 - RNA, 18 nt, Human
ggggggugggguggguuc

SEQ ID NO: 526217 - RNA, 18 nt, Human
ggggugaggaagggucca

SEQ ID NO: 526218 - RNA, 19 nt, Human
ggggugggguggguucugc

SEQ ID NO: 526219 - RNA, 22 nt, Human
ggguggagaccccgaagucugc

SEQ ID NO: 526220 - RNA, 24 nt, Human
gugaguggggaaaaaaauccaaaa

SEQ ID NO: 526221 - RNA, 28 nt, Human
uaaaaaaagaaaaaaauaauaaaaaaga

SEQ ID NO: 526222 - RNA, 18 nt, Human
uaccccauugaaauggcc

SEQ ID NO: 526223 - RNA, 24 nt, Human
uagggucgggggggaaaggaggcg

SEQ ID NO: 526224 - RNA, 19 nt, Human
uaguuccccucucccuucc

SEQ ID NO: 526225 - RNA, 19 nt, Human
ucaacacauaaaggggggg

SEQ ID NO: 526226 - RNA, 23 nt, Human
ucagaaaauuaauagucuauaaa

SEQ ID NO: 526227 - RNA, 27 nt, Human
ucagaacuuuuuaaaaaaagaaaaaaa

SEQ ID NO: 526228 - RNA, 22 nt, Human
ucagccccagccucugcuaaaa

SEQ ID NO: 526229 - RNA, 23 nt, Human
uccagggcugggccacguucucu

SEQ ID NO: 526230 - RNA, 22 nt, Human
ucccacaaaaaaauuuacagcg

SEQ ID NO: 526231 - RNA, 22 nt, Human
uccccagcacccagccauucuc

SEQ ID NO: 526232 - RNA, 22 nt, Human
uccgccauccagagagacugcu

SEQ ID NO: 526233 - RNA, 20 nt, Human
uccuugagcucuacccucug

SEQ ID NO: 526234 - RNA, 21 nt, Human
ucggaguccccgccgcccugg

SEQ ID NO: 526235 - RNA, 18 nt, Human
ucuucaaaaaacaaaccc

SEQ ID NO: 526236 - RNA, 18 nt, Human
ugaaaacaaaacaaaacc

SEQ ID NO: 526237 - RNA, 22 nt, Human
ugaaaacaaaacaaaacccaaa

SEQ ID NO: 526238 - RNA, 23 nt, Human
ugaaaacaaaacaaaacccaaaa

SEQ ID NO: 526239 - RNA, 19 nt, Human
ugaaacucacgccaggugc

SEQ ID NO: 526240 - RNA, 18 nt, Human
ugaaauggccccaguagg

SEQ ID NO: 526241 - RNA, 21 nt, Human
ugaaggaaaaugcaaaaaaaa

SEQ ID NO: 526242 - RNA, 21 nt, Human
ugaaggagguaggaagcaaag

SEQ ID NO: 526243 - RNA, 24 nt, Human
ugaggaaggguccagacaucucca

SEQ ID NO: 526244 - RNA, 26 nt, Human
ugccaugccccugcacccaaaccccu

SEQ ID NO: 526245 - RNA, 26 nt, Human
uggaaaaaugaaaacaaaacaaaacc

SEQ ID NO: 526246 - RNA, 22 nt, Human
uggagacagacaccccuagggc

SEQ ID NO: 526247 - RNA, 24 nt, Human
uggagcuggggaagguuggcaggg

SEQ ID NO: 526248 - RNA, 23 nt, Human
uggcagggaggaccgaccuggcg

SEQ ID NO: 526249 - RNA, 21 nt, Human
uggggaagguuggcagggagg

SEQ ID NO: 526250 - RNA, 20 nt, Human
uguagguuuuuuuuuuuuuu

SEQ ID NO: 526251 - RNA, 20 nt, Human
uuaaaaaauaaaaagugagu

SEQ ID NO: 526252 - RNA, 26 nt, Human
uucuucaaaaaacaaacccgccccuu

SEQ ID NO: 526253 - RNA, 19 nt, Human
uugucgcccccugcccagg

SEQ ID NO: 526254 - RNA, 19 nt, Human
uuuauguuuucauacauga

SEQ ID NO: 526255 - RNA, 24 nt, Human
uuuuacuccuuuuuuuucuauuuu

SEQ ID NO: 526256 - RNA, 23 nt, Human
uuuuuuuuucuuuuuuuuuuggg

SEQ ID NO: 526257 - RNA, 21 nt, Human
aaaagauauuucuucagugcc

SEQ ID NO: 526258 - RNA, 21 nt, Human
aaaauaaguaaaucauuauca

SEQ ID NO: 526259 - RNA, 18 nt, Human
aaaaucccaaacagccaa

SEQ ID NO: 526260 - RNA, 26 nt, Human
aaagaaaaaagauauuucuucagugc

SEQ ID NO: 526261 - RNA, 19 nt, Human
aaagagcagcaugagacac

SEQ ID NO: 526262 - RNA, 20 nt, Human
aaaggcagcaauuaagcuuc

SEQ ID NO: 526263 - RNA, 22 nt, Human
aaauaaguaaaucauuaucaaa

SEQ ID NO: 526264 - RNA, 19 nt, Human
aacaaaaccccaggccacc

SEQ ID NO: 526265 - RNA, 21 nt, Human
aacagccaaccccuagugaac

SEQ ID NO: 526266 - RNA, 18 nt, Human
aaccccuagugaacacag

SEQ ID NO: 526267 - RNA, 28 nt, Human
acaaaaccccaggccaccaucgcaggac

SEQ ID NO: 526268 - RNA, 21 nt, Human
acagucaaagagcagcaugag

SEQ ID NO: 526269 - RNA, 22 nt, Human
acaucgcuaccacucaccaccc

SEQ ID NO: 526270 - RNA, 25 nt, Human
accacucaccacccaucaaagggca

SEQ ID NO: 526271 - RNA, 18 nt, Human
acuaaccuuuaccuccuc

SEQ ID NO: 526272 - RNA, 27 nt, Human
acuauaauaaauacuuuaaaauauguc

SEQ ID NO: 526273 - RNA, 23 nt, Human
acugcagcacagaugcaaaucug

SEQ ID NO: 526274 - RNA, 21 nt, Human
agcuaugaucucaccugagca

SEQ ID NO: 526275 - RNA, 22 nt, Human
aggaaacugaaauauucccuca

SEQ ID NO: 526276 - RNA, 21 nt, Human
aggaagauucugaccugcagg

SEQ ID NO: 526277 - RNA, 24 nt, Human
agugcaguuugcuuuagaaaaugc

SEQ ID NO: 526278 - RNA, 21 nt, Human
aucgcuaccacucaccaccca

SEQ ID NO: 526279 - RNA, 18 nt, Human
caaaaacacauuaaaggc

SEQ ID NO: 526280 - RNA, 23 nt, Human
caaagaaaaaagauauuucuuca

SEQ ID NO: 526281 - RNA, 22 nt, Human
caacagccuaggaagauucuga

SEQ ID NO: 526282 - RNA, 22 nt, Human
cacaaaauguagagauggccaa

SEQ ID NO: 526283 - RNA, 21 nt, Human
cacaagaauuaacacucagug

SEQ ID NO: 526284 - RNA, 23 nt, Human
cacaucgcuaccacucaccaccc

SEQ ID NO: 526285 - RNA, 22 nt, Human
caccacccaucaaagggcacca

SEQ ID NO: 526286 - RNA, 21 nt, Human
caccaucgcaggacucagagu

SEQ ID NO: 526287 - RNA, 21 nt, Human
cacugggccacaucgcuacca

SEQ ID NO: 526288 - RNA, 23 nt, Human
cacuuuccccuuucccuguaagc

SEQ ID NO: 526289 - RNA, 23 nt, Human
cagacacguuuaacuaaaauccc

SEQ ID NO: 526290 - RNA, 21 nt, Human
cagcaugagacacccagggga

SEQ ID NO: 526291 - RNA, 24 nt, Human
cagcgacaugaaagaaaauuuuaa

SEQ ID NO: 526292 - RNA, 23 nt, Human
caggaagaaagacuacugcagca

SEQ ID NO: 526293 - RNA, 24 nt, Human
cagucaaagagcagcaugagacac

SEQ ID NO: 526294 - RNA, 20 nt, Human
ccaggaagaaagacuacugc

SEQ ID NO: 526295 - RNA, 24 nt, Human
ccccaggccaccaucgcaggacuc

SEQ ID NO: 526296 - RNA, 21 nt, Human
cccucacuuccauggaaaaaa

SEQ ID NO: 526297 - RNA, 24 nt, Human
cugcauagaucaaugcaaucauau

SEQ ID NO: 526298 - RNA, 19 nt, Human
cuggaagccacgugacacu

SEQ ID NO: 526299 - RNA, 19 nt, Human
cugugcaaaugauuucuuu

SEQ ID NO: 526300 - RNA, 25 nt, Human
cuuccauggaaaaaaauguauuaua

SEQ ID NO: 526301 - RNA, 21 nt, Human
gaaagcucuuuuugugagcca

SEQ ID NO: 526302 - RNA, 19 nt, Human
gaauccgauuauaaaaauu

SEQ ID NO: 526303 - RNA, 21 nt, Human
gaguuuuuugguuuuuguuuu

SEQ ID NO: 526304 - RNA, 25 nt, Human
gcacagaugcaaaucuggaagccac

SEQ ID NO: 526305 - RNA, 24 nt, Human
gcagcacagaugcaaaucuggaag

SEQ ID NO: 526306 - RNA, 19 nt, Human
gccaaccccuagugaacac

SEQ ID NO: 526307 - RNA, 20 nt, Human
gcuggaaaacaggggcugug

SEQ ID NO: 526308 - RNA, 18 nt, Human
gcugugcaaaugauuucu

SEQ ID NO: 526309 - RNA, 23 nt, Human
ggaagccacgugacacucacuga

SEQ ID NO: 526310 - RNA, 23 nt, Human
uaaaaucccaaacagccaacccc

SEQ ID NO: 526311 - RNA, 23 nt, Human
uaauucucauuucucccuugggc

SEQ ID NO: 526312 - RNA, 18 nt, Human
uacacuagugcaguuugc

SEQ ID NO: 526313 - RNA, 21 nt, Human
uacagcuauugugguacuuua

SEQ ID NO: 526314 - RNA, 20 nt, Human
uaccuuggaagagcaacagc

SEQ ID NO: 526315 - RNA, 20 nt, Human
uagagauggccaacgcccuc

SEQ ID NO: 526316 - RNA, 21 nt, Human
uagagauggccaacgcccucc

SEQ ID NO: 526317 - RNA, 20 nt, Human
ucaaaaacacauuaaaggca

SEQ ID NO: 526318 - RNA, 20 nt, Human
ucaaugcaaucauaugaaag

SEQ ID NO: 526319 - RNA, 20 nt, Human
ucccuguaagcauuuaccua

SEQ ID NO: 526320 - RNA, 20 nt, Human
uccgcagcuauugagcccca

SEQ ID NO: 526321 - RNA, 22 nt, Human
uccgcagcuauugagccccagu

SEQ ID NO: 526322 - RNA, 24 nt, Human
uccgcagcuauugagccccagucc

SEQ ID NO: 526323 - RNA, 21 nt, Human
ucgucuauauggucugauuau

SEQ ID NO: 526324 - RNA, 21 nt, Human
ucugggccuacaacccagaaa

SEQ ID NO: 526325 - RNA, 24 nt, Human
ugaaacauucuauagcugcaguuc

SEQ ID NO: 526326 - RNA, 21 nt, Human
ugagaauauuuucuaccuuaa

SEQ ID NO: 526327 - RNA, 21 nt, Human
ugcauagaucaaugcaaucau

SEQ ID NO: 526328 - RNA, 21 nt, Human
ugcuuuagaaaaugcauguuc

SEQ ID NO: 526329 - RNA, 21 nt, Human
uggaagagcaacagccuagga

SEQ ID NO: 526330 - RNA, 22 nt, Human
uguauuaagaguguuuaaaaca

SEQ ID NO: 526331 - RNA, 25 nt, Human
uuuaagcuaugaucucaccugagca

SEQ ID NO: 526332 - RNA, 23 nt, Human
uuuuaaacauguuuaaggggaga

SEQ ID NO: 526333 - RNA, 18 nt, Human
uuuuuugguuuuuguuuu

SEQ ID NO: 526334 - RNA, 26 nt, Human
aaccaaacaccugacaggauucccca

SEQ ID NO: 526335 - RNA, 24 nt, Human
acaaaaguaucuaaaaauuauaca

SEQ ID NO: 526336 - RNA, 21 nt, Human
agcacccugagacacaaaaca

SEQ ID NO: 526337 - RNA, 23 nt, Human
cacuguuuaguaaaagugggaca

SEQ ID NO: 526338 - RNA, 33 nt, Human
cagaacuuccugacuggcugacauagcacauua

SEQ ID NO: 526339 - RNA, 22 nt, Human
cagcuaaacucaauauaaaauu

SEQ ID NO: 526340 - RNA, 25 nt, Human
caggaucacaggcgggguccgccgg

SEQ ID NO: 526341 - RNA, 21 nt, Human
ccacuguuuaguaaaaguggg

SEQ ID NO: 526342 - RNA, 20 nt, Human
ccagauaacuuuccacuguu

SEQ ID NO: 526343 - RNA, 18 nt, Human
ccuuaagagcaagaaaga

SEQ ID NO: 526344 - RNA, 21 nt, Human
gaaagaacaaaaguaucuaaa

SEQ ID NO: 526345 - RNA, 25 nt, Human
gcaagaaagaacaaaaguaucuaaa

SEQ ID NO: 526346 - RNA, 18 nt, Human
gcaagagugaauguagca

SEQ ID NO: 526347 - RNA, 23 nt, Human
gcugccacuguuuaggggagccc

SEQ ID NO: 526348 - RNA, 22 nt, Human
ggaaaguauacaaauaaaaaga

SEQ ID NO: 526349 - RNA, 19 nt, Human
ggcuggcuccccaguuacg

SEQ ID NO: 526350 - RNA, 22 nt, Human
uaacagguuuuuaaaauccuua

SEQ ID NO: 526351 - RNA, 26 nt, Human
uauaaccaaacaccugacaggauucc

SEQ ID NO: 526352 - RNA, 21 nt, Human
uauacuuuguagucuagauug

SEQ ID NO: 526353 - RNA, 24 nt, Human
uaucuaaaaauuauacacgacagg

SEQ ID NO: 526354 - RNA, 20 nt, Human
ugaauguagcacccugagac

SEQ ID NO: 526355 - RNA, 19 nt, Human
ugacaggauuccccauaug

SEQ ID NO: 526356 - RNA, 19 nt, Human
ugacauagcacauuaguga

SEQ ID NO: 526357 - RNA, 20 nt, Human
ugagaaaacagcuaaacuca

SEQ ID NO: 526358 - RNA, 21 nt, Human
ugagaaaacagcuaaacucag

SEQ ID NO: 526359 - RNA, 24 nt, Human
ugcuaaauuuugagaaaacagcua

SEQ ID NO: 526360 - RNA, 18 nt, Human
uggcuccccaguuacgcc

SEQ ID NO: 526361 - RNA, 18 nt, Human
ugugaacuagauuauaac

SEQ ID NO: 526362 - RNA, 25 nt, Human
uguuacuaaaaauauuccaaaagaa

SEQ ID NO: 526363 - RNA, 21 nt, Human
uuacaguauaccuaaggcaag

SEQ ID NO: 526364 - RNA, 18 nt, Human
uuccagauaacuuuccac

SEQ ID NO: 526365 - RNA, 24 nt, Human
uuccugacuggcugacauagcaca

SEQ ID NO: 526366 - RNA, 25 nt, Human
uuuaaaauauagaaaauacaguucc

SEQ ID NO: 526367 - RNA, 25 nt, Human
uuuuuuuuuuuugcacaaaugguau

SEQ ID NO: 526368 - RNA, 18 nt, Human
uuuuuuuuuuuuuuuuug

SEQ ID NO: 526369 - RNA, 23 nt, Human
uuuuuuuuuuuuuuuuugcacaa

SEQ ID NO: 526370 - RNA, 20 nt, Human
aaguuacagggaagggcuga

SEQ ID NO: 526371 - RNA, 23 nt, Human
acgggcugcacaaggaccugggc

SEQ ID NO: 526372 - RNA, 24 nt, Human
aucggccccacagcccccaauggc

SEQ ID NO: 526373 - RNA, 21 nt, Human
cagcccccaauggccuugucc

SEQ ID NO: 526374 - RNA, 18 nt, Human
cccacagcccccaauggc

SEQ ID NO: 526375 - RNA, 21 nt, Human
cccccaauggccuuguccugc

SEQ ID NO: 526376 - RNA, 21 nt, Human
ccugccaggacaccugcccca

SEQ ID NO: 526377 - RNA, 24 nt, Human
cugcacaaggaccugggccuguua

SEQ ID NO: 526378 - RNA, 23 nt, Human
gagggcuggggccuugucuucuc

SEQ ID NO: 526379 - RNA, 23 nt, Human
gccccacagcccccaauggccuu

SEQ ID NO: 526380 - RNA, 20 nt, Human
gcuggggccuugucuucucc

SEQ ID NO: 526381 - RNA, 20 nt, Human
ggagcaaggacucugagugc

SEQ ID NO: 526382 - RNA, 24 nt, Human
ggccuuguccugcuggucucaggu

SEQ ID NO: 526383 - RNA, 22 nt, Human
gggaagggcugagaucaggggu

SEQ ID NO: 526384 - RNA, 22 nt, Human
ggugugaggcucccagaggagg

SEQ ID NO: 526385 - RNA, 18 nt, Human
uccaccucaucggcccca

SEQ ID NO: 526386 - RNA, 19 nt, Human
ucccagaggagggcugggg

SEQ ID NO: 526387 - RNA, 24 nt, Human
ucccuggcuggccuggcccaggac

SEQ ID NO: 526388 - RNA, 18 nt, Human
ucuccugucccccugcca

SEQ ID NO: 526389 - RNA, 23 nt, Human
ugaggcucccagaggagggcugg

SEQ ID NO: 526390 - RNA, 24 nt, Human
ugaggcucccagaggagggcuggg

SEQ ID NO: 526391 - RNA, 19 nt, Human
ugccagggaccauggcaug

SEQ ID NO: 526392 - RNA, 23 nt, Human
ugugaggcucccagaggagggcu

SEQ ID NO: 526393 - RNA, 21 nt, Human
ugugggaaguuacagggaagg

SEQ ID NO: 526394 - RNA, 19 nt, Human
aaaaaaaaaacaccccaaa

SEQ ID NO: 526395 - RNA, 24 nt, Human
aaaaaaaaaacaccccaaaaaaga

SEQ ID NO: 526396 - RNA, 20 nt, Human
aaaaaagaaaacacaaaaaa

SEQ ID NO: 526397 - RNA, 19 nt, Human
aaaaaccccaaacaaccaa

SEQ ID NO: 526398 - RNA, 23 nt, Human
aaaaaccccaaacaaccaaacaa

SEQ ID NO: 526399 - RNA, 25 nt, Human
aaaaagaaaacacaaaaaaccccaa

SEQ ID NO: 526400 - RNA, 23 nt, Human
aaaacaccccaaaaaagaaaaca

SEQ ID NO: 526401 - RNA, 23 nt, Human
aaaagaaaacacaaaaaacccca

SEQ ID NO: 526402 - RNA, 24 nt, Human
aaaagaaaacacaaaaaaccccaa

SEQ ID NO: 526403 - RNA, 23 nt, Human
aaacacaaaaaaccccaaacaac

SEQ ID NO: 526404 - RNA, 23 nt, Human
aaacaccccaaaaaagaaaacac

SEQ ID NO: 526405 - RNA, 23 nt, Human
aaaccccaaacaaccaaacaaaa

SEQ ID NO: 526406 - RNA, 24 nt, Human
aaaccccaaacaaccaaacaaaaa

SEQ ID NO: 526407 - RNA, 23 nt, Human
aaagaaaacacaaaaaaccccaa

SEQ ID NO: 526408 - RNA, 18 nt, Human
aagaaaacacaaaaaacc

SEQ ID NO: 526409 - RNA, 19 nt, Human
aaggagagaccccguggac

SEQ ID NO: 526410 - RNA, 20 nt, Human
acaaaaaaccccaaacaacc

SEQ ID NO: 526411 - RNA, 24 nt, Human
acaaaaaaccccaaacaaccaaac

SEQ ID NO: 526412 - RNA, 25 nt, Human
acaaaaaaccccaaacaaccaaaca

SEQ ID NO: 526413 - RNA, 23 nt, Human
acacaaaaaaccccaaacaacca

SEQ ID NO: 526414 - RNA, 21 nt, Human
accccaaaaaagaaaacaaua

SEQ ID NO: 526415 - RNA, 25 nt, Human
agccagagguuggggggaggcaggu

SEQ ID NO: 526416 - RNA, 22 nt, Human
aggagagaccccguggacagaa

SEQ ID NO: 526417 - RNA, 23 nt, Human
agggggccucucugggagcuggg

SEQ ID NO: 526418 - RNA, 18 nt, Human
aggggugccugggguggg

SEQ ID NO: 526419 - RNA, 24 nt, Human
augcagaggcuguggcccccagga

SEQ ID NO: 526420 - RNA, 19 nt, Human
caaaaaaccccaaacaacc

SEQ ID NO: 526421 - RNA, 26 nt, Human
caaaaaaccccaaacaaccaaacaaa

SEQ ID NO: 526422 - RNA, 24 nt, Human
caaacaaccaaacaaaaaagcuuu

SEQ ID NO: 526423 - RNA, 23 nt, Human
caacacgacccuccucaaauauc

SEQ ID NO: 526424 - RNA, 25 nt, Human
caaccccggccccuguccguggccu

SEQ ID NO: 526425 - RNA, 22 nt, Human
caaguccggucgcccccacugg

SEQ ID NO: 526426 - RNA, 18 nt, Human
cacccaccucagcagggu

SEQ ID NO: 526427 - RNA, 23 nt, Human
caccccaaaaaagaaaacacaaa

SEQ ID NO: 526428 - RNA, 25 nt, Human
caccccccaaguccggucgccccca

SEQ ID NO: 526429 - RNA, 19 nt, Human
cacuggcuaggacgacagc

SEQ ID NO: 526430 - RNA, 21 nt, Human
cagagcgucuauuuucggggu

SEQ ID NO: 526431 - RNA, 20 nt, Human
cagagguuggggggaggcag

SEQ ID NO: 526432 - RNA, 22 nt, Human
cagcuccuugguggccaugcgg

SEQ ID NO: 526433 - RNA, 20 nt, Human
caugcagaggcuguggcccc

SEQ ID NO: 526434 - RNA, 21 nt, Human
ccaaacaaccaaacaaaaaag

SEQ ID NO: 526435 - RNA, 22 nt, Human
ccaaacaaccaaacaaaaaagc

SEQ ID NO: 526436 - RNA, 18 nt, Human
ccaggacgggcggguagu

SEQ ID NO: 526437 - RNA, 26 nt, Human
cccaaacaaccaaacaaaaggaguuc

SEQ ID NO: 526438 - RNA, 25 nt, Human
cccaaccccggccccuguccguggc

SEQ ID NO: 526439 - RNA, 22 nt, Human
cccagagggcuccaccccccaa

SEQ ID NO: 526440 - RNA, 25 nt, Human
ccccaaacaaccaaacaaaaaagcu

SEQ ID NO: 526441 - RNA, 20 nt, Human
ccccaaccccggccccuguc

SEQ ID NO: 526442 - RNA, 23 nt, Human
ccccaaccccggccccuguccgu

SEQ ID NO: 526443 - RNA, 24 nt, Human
cccggccccuguccgucggggccg

SEQ ID NO: 526444 - RNA, 23 nt, Human
ccggccccuguccguggccugug

SEQ ID NO: 526445 - RNA, 21 nt, Human
ccucagggggccucucuggga

SEQ ID NO: 526446 - RNA, 19 nt, Human
ccuggcaucuggcgacaua

SEQ ID NO: 526447 - RNA, 19 nt, Human
ccugggguggggagagggg

SEQ ID NO: 526448 - RNA, 20 nt, Human
cggcucugggcccaugcaga

SEQ ID NO: 526449 - RNA, 18 nt, Human
cuccccaaccccggcccc

SEQ ID NO: 526450 - RNA, 20 nt, Human
cucugggagcuggggagggg

SEQ ID NO: 526451 - RNA, 19 nt, Human
cuggcgacauagucucccc

SEQ ID NO: 526452 - RNA, 21 nt, Human
cugggcccaugcagaggcugu

SEQ ID NO: 526453 - RNA, 21 nt, Human
cuggggagggcggggcugggc

SEQ ID NO: 526454 - RNA, 21 nt, Human
cuggggagggcggggcugggc

SEQ ID NO: 526455 - RNA, 24 nt, Human
gaggcaggucccagucccccaagg

SEQ ID NO: 526456 - RNA, 23 nt, Human
gauuggggggugccggaugggga

SEQ ID NO: 526457 - RNA, 23 nt, Human
gcaggucccagucccccuggauu

SEQ ID NO: 526458 - RNA, 28 nt, Human
gcaguuaaaaaaaaaacaccccaaaaaa

SEQ ID NO: 526459 - RNA, 22 nt, Human
gcgacauagucuccccaacccc

SEQ ID NO: 526460 - RNA, 19 nt, Human
gcggagcuaggaacgaggg

SEQ ID NO: 526461 - RNA, 18 nt, Human
gcucggucaacaccgggc

SEQ ID NO: 526462 - RNA, 22 nt, Human
gcugggggggucccggcucugg

SEQ ID NO: 526463 - RNA, 19 nt, Human
ggccccugucacccaccuc

SEQ ID NO: 526464 - RNA, 20 nt, Human
gggagggcggggcugggcug

SEQ ID NO: 526465 - RNA, 19 nt, Human
gggcggggcugggcugggg

SEQ ID NO: 526466 - RNA, 21 nt, Human
gggcugggggggucccggcuc

SEQ ID NO: 526467 - RNA, 19 nt, Human
ggggagggcggggcugggc

SEQ ID NO: 526468 - RNA, 22 nt, Human
ggggagggcggggcugggcugg

SEQ ID NO: 526469 - RNA, 19 nt, Human
gggguggggagaggggcgg

SEQ ID NO: 526470 - RNA, 18 nt, Human
gggucccggcucugggcc

SEQ ID NO: 526471 - RNA, 19 nt, Human
gguuuuauugcgagggggu

SEQ ID NO: 526472 - RNA, 20 nt, Human
guggggggccccugucaccc

SEQ ID NO: 526473 - RNA, 21 nt, Human
guggggggccccugucaccca

SEQ ID NO: 526474 - RNA, 24 nt, Human
guucuaaggcccuggagguggggg

SEQ ID NO: 526475 - RNA, 19 nt, Human
uaaaaaaaaaacaccccaa

SEQ ID NO: 526476 - RNA, 25 nt, Human
uaaaaaaaaaacaccccaaaaaaga

SEQ ID NO: 526477 - RNA, 20 nt, Human
uagcauugcauaugcaaacg

SEQ ID NO: 526478 - RNA, 23 nt, Human
uagggaggaggaaggagagaccc

SEQ ID NO: 526479 - RNA, 18 nt, Human
ucagugcagcagagcguc

SEQ ID NO: 526480 - RNA, 26 nt, Human
ucagugcagcagagcgucuauuuucg

SEQ ID NO: 526481 - RNA, 18 nt, Human
ucccugagcuagggagga

SEQ ID NO: 526482 - RNA, 19 nt, Human
ucccugagcuagggaggag

SEQ ID NO: 526483 - RNA, 20 nt, Human
ucuaaggcccuggagguggg

SEQ ID NO: 526484 - RNA, 23 nt, Human
ucuaaggcccuggaggugggggg

SEQ ID NO: 526485 - RNA, 18 nt, Human
ucuauauacaguauguga

SEQ ID NO: 526486 - RNA, 21 nt, Human
ucuggcgacauagucucccca

SEQ ID NO: 526487 - RNA, 22 nt, Human
ugccugggguggggagaggggc

SEQ ID NO: 526488 - RNA, 22 nt, Human
ugccugggguggggagaggggc

SEQ ID NO: 526489 - RNA, 18 nt, Human
ugcgggagggacaggcgu

SEQ ID NO: 526490 - RNA, 26 nt, Human
uggcaacacuuuaucacgaccuuaau

SEQ ID NO: 526491 - RNA, 20 nt, Human
ugggagcuggggaggggugu

SEQ ID NO: 526492 - RNA, 20 nt, Human
ugggcugggggggucccggc

SEQ ID NO: 526493 - RNA, 22 nt, Human
uggggaggggugucccuggccu

SEQ ID NO: 526494 - RNA, 20 nt, Human
ugggguggggagaggggcgg

SEQ ID NO: 526495 - RNA, 21 nt, Human
ugggguggggagaggggcggu

SEQ ID NO: 526496 - RNA, 23 nt, Human
ugggguggggagaggggcggugg

SEQ ID NO: 526497 - RNA, 24 nt, Human
uguaccaggcaguuaaaaaaaaaa

SEQ ID NO: 526498 - RNA, 20 nt, Human
uuggggggugccggaugggg

SEQ ID NO: 526499 - RNA, 18 nt, Human
uuuuguuuguuuguuucc

SEQ ID NO: 526500 - RNA, 18 nt, Human
uuuuuuuuguaccaggca

SEQ ID NO: 526501 - RNA, 20 nt, Human
uuuuuuuuuuuuuuuucucu

SEQ ID NO: 526502 - RNA, 24 nt, Human
uuuuuuuuuuuuuuuucucuuuuu

SEQ ID NO: 526503 - RNA, 23 nt, Human
aaaaggcagaacugcuccaaaug

SEQ ID NO: 526504 - RNA, 19 nt, Human
aaagugcuaggauuacagg

SEQ ID NO: 526505 - RNA, 24 nt, Human
aaagugcuaggauuacaggcguga

SEQ ID NO: 526506 - RNA, 20 nt, Human
aacccacuagacguccccuu

SEQ ID NO: 526507 - RNA, 21 nt, Human
aacugcuccaaaugcacaaaa

SEQ ID NO: 526508 - RNA, 26 nt, Human
aagugcuaggauuacaggcgugagcc

SEQ ID NO: 526509 - RNA, 19 nt, Human
acaggcgccugccaccacg

SEQ ID NO: 526510 - RNA, 23 nt, Human
accagaaugaaaaggcagaacug

SEQ ID NO: 526511 - RNA, 18 nt, Human
accccgcccggccauguu

SEQ ID NO: 526512 - RNA, 25 nt, Human
acccgccucagccucccaaagugcu

SEQ ID NO: 526513 - RNA, 19 nt, Human
accgcucccgccaccccuc

SEQ ID NO: 526514 - RNA, 22 nt, Human
accgcucccgccaccccucccg

SEQ ID NO: 526515 - RNA, 24 nt, Human
accuugugaucuacccgccucagc

SEQ ID NO: 526516 - RNA, 18 nt, Human
acgggguuucaccauguu

SEQ ID NO: 526517 - RNA, 19 nt, Human
acgggguuucaccauguua

SEQ ID NO: 526518 - RNA, 20 nt, Human
acgggguuucaccauguuag

SEQ ID NO: 526519 - RNA, 24 nt, Human
acgggguuucaccauguuagccag

SEQ ID NO: 526520 - RNA, 25 nt, Human
acucuguugcccaggcuggagugca

SEQ ID NO: 526521 - RNA, 18 nt, Human
aggcuggagugcaguggc

SEQ ID NO: 526522 - RNA, 18 nt, Human
aguagcugggacuacagg

SEQ ID NO: 526523 - RNA, 19 nt, Human
aguagcugggacuacaggc

SEQ ID NO: 526524 - RNA, 23 nt, Human
agugcaguggcgcaauccaccuc

SEQ ID NO: 526525 - RNA, 20 nt, Human
aguggcgcaauccaccuccu

SEQ ID NO: 526526 - RNA, 22 nt, Human
auuaaucuaaguaauucugggg

SEQ ID NO: 526527 - RNA, 24 nt, Human
caaagugcuaggauuacaggcgug

SEQ ID NO: 526528 - RNA, 24 nt, Human
caaauaauuaauuauaccagaaug

SEQ ID NO: 526529 - RNA, 20 nt, Human
cacaaaacuuagcuagcacu

SEQ ID NO: 526530 - RNA, 18 nt, Human
caccauguuagccaggau

SEQ ID NO: 526531 - RNA, 22 nt, Human
caccauguuagccaggaugguc

SEQ ID NO: 526532 - RNA, 19 nt, Human
caccccucccgggcaacca

SEQ ID NO: 526533 - RNA, 24 nt, Human
cacucuguugcccaggcuggagug

SEQ ID NO: 526534 - RNA, 20 nt, Human
caggaccgcucccgccaccc

SEQ ID NO: 526535 - RNA, 22 nt, Human
caggaugguccugaucuccuga

SEQ ID NO: 526536 - RNA, 21 nt, Human
caggcgccugccaccacgccu

SEQ ID NO: 526537 - RNA, 23 nt, Human
caggcgccugccaccacgccugg

SEQ ID NO: 526538 - RNA, 22 nt, Human
ccaaagugcuaggauuacaggc

SEQ ID NO: 526539 - RNA, 24 nt, Human
ccaaagugcuaggauuacaggcgu

SEQ ID NO: 526540 - RNA, 20 nt, Human
ccaccacgccuggcuaauuu

SEQ ID NO: 526541 - RNA, 22 nt, Human
ccaggucucuccaccgcgaagg

SEQ ID NO: 526542 - RNA, 23 nt, Human
cccgaguagcugggacuacaggc

SEQ ID NO: 526543 - RNA, 24 nt, Human
cccgaguagcugggacuacaggcg

SEQ ID NO: 526544 - RNA, 18 nt, Human
cccucccgggcaacccac

SEQ ID NO: 526545 - RNA, 24 nt, Human
ccgccucagccucccaaagugcua

SEQ ID NO: 526546 - RNA, 20 nt, Human
cgcaauccaccuccuggguu

SEQ ID NO: 526547 - RNA, 24 nt, Human
cgcacgcgcacugccgagcuuccg

SEQ ID NO: 526548 - RNA, 24 nt, Human
cgccucagccucccaaagugcuag

SEQ ID NO: 526549 - RNA, 23 nt, Human
cgcucccgccaccccucccgggc

SEQ ID NO: 526550 - RNA, 24 nt, Human
cgggguuucaccauguuagccagg

SEQ ID NO: 526551 - RNA, 21 nt, Human
cgggugcgggcgcacgcgcag

SEQ ID NO: 526552 - RNA, 25 nt, Human
cuaaguaauucuggggaaaagaaaa

SEQ ID NO: 526553 - RNA, 24 nt, Human
cuaguaaacucaguuuuguuuucu

SEQ ID NO: 526554 - RNA, 24 nt, Human
cucacucuguugcccaggcuggag

SEQ ID NO: 526555 - RNA, 24 nt, Human
cucagccucccgaguagcugggac

SEQ ID NO: 526556 - RNA, 18 nt, Human
cucccgccaccccucccg

SEQ ID NO: 526557 - RNA, 24 nt, Human
cuccugaccuugugaucuacccgc

SEQ ID NO: 526558 - RNA, 20 nt, Human
cuccuggguuuacgccauuc

SEQ ID NO: 526559 - RNA, 24 nt, Human
gaccuugugaucuacccgccucag

SEQ ID NO: 526560 - RNA, 24 nt, Human
gagacgggguuucaccauguuagc

SEQ ID NO: 526561 - RNA, 24 nt, Human
gagagggagucucacucuguugcc

SEQ ID NO: 526562 - RNA, 26 nt, Human
gaguagcugggacuacaggcgccugc

SEQ ID NO: 526563 - RNA, 18 nt, Human
gauuacaggcgugagcca

SEQ ID NO: 526564 - RNA, 20 nt, Human
gauuacaggcgugagccacc

SEQ ID NO: 526565 - RNA, 20 nt, Human
gauuacaggcgugagccacc

SEQ ID NO: 526566 - RNA, 19 nt, Human
gccauucuucugccucagc

SEQ ID NO: 526567 - RNA, 19 nt, Human
gcccaggcuggagugcagu

SEQ ID NO: 526568 - RNA, 20 nt, Human
gcccaggcuggagugcagug

SEQ ID NO: 526569 - RNA, 23 nt, Human
gccuggcuaauuuuuuguauuuu

SEQ ID NO: 526570 - RNA, 24 nt, Human
gcuggagugcaguggcgcaaucca

SEQ ID NO: 526571 - RNA, 24 nt, Human
ggaugguccugaucuccugaccuu

SEQ ID NO: 526572 - RNA, 22 nt, Human
ggauuacaggcgugagccaccc

SEQ ID NO: 526573 - RNA, 23 nt, Human
gggguuucaccauguuagccagg

SEQ ID NO: 526574 - RNA, 20 nt, Human
gguccugaucuccugaccuu

SEQ ID NO: 526575 - RNA, 24 nt, Human
gguuucaccauguuagccaggaug

SEQ ID NO: 526576 - RNA, 23 nt, Human
guagagacgggguuucaccaugu

SEQ ID NO: 526577 - RNA, 24 nt, Human
gugaucuacccgccucagccuccc

SEQ ID NO: 526578 - RNA, 25 nt, Human
uaaacuagaauaugauaucgaagua

SEQ ID NO: 526579 - RNA, 24 nt, Human
uaauuuuuuguauuuuuaguagag

SEQ ID NO: 526580 - RNA, 25 nt, Human
uaauuuuuuguauuuuuaguagaga

SEQ ID NO: 526581 - RNA, 22 nt, Human
uacaggcgccugccaccacgcc

SEQ ID NO: 526582 - RNA, 23 nt, Human
uaccagaaugaaaaggcagaacu

SEQ ID NO: 526583 - RNA, 23 nt, Human
uacccgccucagccucccaaagu

SEQ ID NO: 526584 - RNA, 25 nt, Human
uagaacuucaaacaugaaaauucca

SEQ ID NO: 526585 - RNA, 22 nt, Human
uagagacgggguuucaccaugu

SEQ ID NO: 526586 - RNA, 18 nt, Human
uaggauuacaggcgugag

SEQ ID NO: 526587 - RNA, 19 nt, Human
uaggauuacaggcgugagc

SEQ ID NO: 526588 - RNA, 21 nt, Human
uaggauuacaggcgugagcca

SEQ ID NO: 526589 - RNA, 22 nt, Human
uaggauuacaggcgugagccac

SEQ ID NO: 526590 - RNA, 24 nt, Human
uaggauuacaggcgugagccaccc

SEQ ID NO: 526591 - RNA, 24 nt, Human
uaguagagacgggguuucaccaug

SEQ ID NO: 526592 - RNA, 26 nt, Human
uaguagagacgggguuucaccauguu

SEQ ID NO: 526593 - RNA, 24 nt, Human
ucacucuguugcccaggcuggagu

SEQ ID NO: 526594 - RNA, 23 nt, Human
ucagccucccgaguagcugggac

SEQ ID NO: 526595 - RNA, 22 nt, Human
ucauugcuuuauacugccaugg

SEQ ID NO: 526596 - RNA, 24 nt, Human
ucccaaagugcuaggauuacaggc

SEQ ID NO: 526597 - RNA, 24 nt, Human
ucccgaguagcugggacuacaggc

SEQ ID NO: 526598 - RNA, 21 nt, Human
ucuacccgccucagccuccca

SEQ ID NO: 526599 - RNA, 22 nt, Human
ucucacucuguugcccaggcug

SEQ ID NO: 526600 - RNA, 23 nt, Human
ucucacucuguugcccaggcugg

SEQ ID NO: 526601 - RNA, 24 nt, Human
ucucacucuguugcccaggcugga

SEQ ID NO: 526602 - RNA, 26 nt, Human
ucucacucuguugcccaggcuggagu

SEQ ID NO: 526603 - RNA, 27 nt, Human
ucucacucuguugcccaggcuggagug

SEQ ID NO: 526604 - RNA, 24 nt, Human
ucugccucagccucccgaguagcu

SEQ ID NO: 526605 - RNA, 18 nt, Human
ucuguugcccaggcugga

SEQ ID NO: 526606 - RNA, 27 nt, Human
ucuuucaguuucagcugauagcaaaua

SEQ ID NO: 526607 - RNA, 23 nt, Human
ugaaaaggcagaacugcuccaaa

SEQ ID NO: 526608 - RNA, 24 nt, Human
ugaaaaggcagaacugcuccaaau

SEQ ID NO: 526609 - RNA, 18 nt, Human
ugcccaggcuggagugca

SEQ ID NO: 526610 - RNA, 21 nt, Human
ugcccaggcuggagugcagug

SEQ ID NO: 526611 - RNA, 22 nt, Human
ugcccaggcuggagugcagugg

SEQ ID NO: 526612 - RNA, 24 nt, Human
ugcccaggcuggagugcaguggcg

SEQ ID NO: 526613 - RNA, 24 nt, Human
ugccucagccucccgaguagcugg

SEQ ID NO: 526614 - RNA, 24 nt, Human
ugcuaggauuacaggcgugagcca

SEQ ID NO: 526615 - RNA, 21 nt, Human
uggaacaaaaauauuuagaug

SEQ ID NO: 526616 - RNA, 18 nt, Human
uggagugcaguggcgcaa

SEQ ID NO: 526617 - RNA, 19 nt, Human
uggagugcaguggcgcaau

SEQ ID NO: 526618 - RNA, 21 nt, Human
ugggacuacaggcgccugcca

SEQ ID NO: 526619 - RNA, 22 nt, Human
ugggacuacaggcgccugccac

SEQ ID NO: 526620 - RNA, 24 nt, Human
ugggacuacaggcgccugccacca

SEQ ID NO: 526621 - RNA, 18 nt, Human
uguaaacuagaauaugau

SEQ ID NO: 526622 - RNA, 19 nt, Human
uguaaacuagaauaugaua

SEQ ID NO: 526623 - RNA, 24 nt, Human
ugugaucuacccgccucagccucc

SEQ ID NO: 526624 - RNA, 21 nt, Human
uguugcccaggcuggagugca

SEQ ID NO: 526625 - RNA, 18 nt, Human
uuaguagagacgggguuu

SEQ ID NO: 526626 - RNA, 22 nt, Human
uuaguagagacgggguuucacc

SEQ ID NO: 526627 - RNA, 24 nt, Human
uuaguagagacgggguuucaccau

SEQ ID NO: 526628 - RNA, 23 nt, Human
uucuacauuagcucagauauccu

SEQ ID NO: 526629 - RNA, 23 nt, Human
uuguauuuuuaguagagacgggg

SEQ ID NO: 526630 - RNA, 22 nt, Human
uuucacagcuauauauuaucau

SEQ ID NO: 526631 - RNA, 19 nt, Human
uuucaccauguuagccagg

SEQ ID NO: 526632 - RNA, 20 nt, Human
uuucaccauguuagccagga

SEQ ID NO: 526633 - RNA, 24 nt, Human
uuuuuaguagagacgggguuucac

SEQ ID NO: 526634 - RNA, 20 nt, Human
uuuuucaucuuaauucuucu

SEQ ID NO: 526635 - RNA, 21 nt, Human
uuuuuguauuuuuaguagaga

SEQ ID NO: 526636 - RNA, 24 nt, Human
uuuuuuguauuuuuaguagagacg

SEQ ID NO: 526637 - RNA, 23 nt, Human
aaacucccaacacccacugcccu

SEQ ID NO: 526638 - RNA, 20 nt, Human
aacucccaacacccacugcc

SEQ ID NO: 526639 - RNA, 18 nt, Human
aacuuccaucccggcccc

SEQ ID NO: 526640 - RNA, 29 nt, Human
acaacuuccaucccggccccaaacuccca

SEQ ID NO: 526641 - RNA, 21 nt, Human
acacccacugcccugucccca

SEQ ID NO: 526642 - RNA, 21 nt, Human
acgcucgacucuucgcccagc

SEQ ID NO: 526643 - RNA, 18 nt, Human
acucuucgcccagccuag

SEQ ID NO: 526644 - RNA, 21 nt, Human
agggagagccaggguggggcc

SEQ ID NO: 526645 - RNA, 21 nt, Human
caacacccacugcccuguccc

SEQ ID NO: 526646 - RNA, 19 nt, Human
ccaaacucccaacacccac

SEQ ID NO: 526647 - RNA, 18 nt, Human
ccauuggccgagcaaagu

SEQ ID NO: 526648 - RNA, 20 nt, Human
cccaaacucccaacacccac

SEQ ID NO: 526649 - RNA, 19 nt, Human
ccccaaacucccaacaccc

SEQ ID NO: 526650 - RNA, 22 nt, Human
ccccucagggagagccagggug

SEQ ID NO: 526651 - RNA, 24 nt, Human
ccccucagggagagccaggguggg

SEQ ID NO: 526652 - RNA, 26 nt, Human
cccggccccaaacucccaacacccac

SEQ ID NO: 526653 - RNA, 25 nt, Human
ccuccugucacccuggcccggagcc

SEQ ID NO: 526654 - RNA, 21 nt, Human
ccugucacccuggcccggagc

SEQ ID NO: 526655 - RNA, 24 nt, Human
ccuuguguucaguuuuggaggagu

SEQ ID NO: 526656 - RNA, 22 nt, Human
cggccccaaacucccaacaccc

SEQ ID NO: 526657 - RNA, 19 nt, Human
cuccaagucugcucauccg

SEQ ID NO: 526658 - RNA, 18 nt, Human
cucccaacacccacugcc

SEQ ID NO: 526659 - RNA, 18 nt, Human
cuccugacaaauguaaug

SEQ ID NO: 526660 - RNA, 18 nt, Human
cucuccucaaagggccua

SEQ ID NO: 526661 - RNA, 24 nt, Human
cugacaaauguaaugaucuuuccc

SEQ ID NO: 526662 - RNA, 23 nt, Human
cuggaguccuccaagucugcuca

SEQ ID NO: 526663 - RNA, 21 nt, Human
cuuggggcaucuccuuuggcu

SEQ ID NO: 526664 - RNA, 18 nt, Human
cuuggguccaagucuuuc

SEQ ID NO: 526665 - RNA, 19 nt, Human
gaguccuccaagucugcuc

SEQ ID NO: 526666 - RNA, 20 nt, Human
gcaaaguuccccucagggag

SEQ ID NO: 526667 - RNA, 23 nt, Human
gccauguugcucccacuuggggc

SEQ ID NO: 526668 - RNA, 22 nt, Human
gcccggagcccccuucacgcuc

SEQ ID NO: 526669 - RNA, 23 nt, Human
ggagcccccuucacgcucgacuc

SEQ ID NO: 526670 - RNA, 19 nt, Human
ggaguccuccaagucugcu

SEQ ID NO: 526671 - RNA, 23 nt, Human
ggcccggagcccccuucacgcuc

SEQ ID NO: 526672 - RNA, 19 nt, Human
guaaugaucuuucccuccc

SEQ ID NO: 526673 - RNA, 23 nt, Human
guaauucucacuguauccccacu

SEQ ID NO: 526674 - RNA, 19 nt, Human
guggggccugguaugcucu

SEQ ID NO: 526675 - RNA, 22 nt, Human
uagucucuggccuggaguccuu

SEQ ID NO: 526676 - RNA, 21 nt, Human
ucaaagggccuaccugccauc

SEQ ID NO: 526677 - RNA, 19 nt, Human
ucagggagagccagggugg

SEQ ID NO: 526678 - RNA, 25 nt, Human
ucaucuugaaauaucuucuuucagu

SEQ ID NO: 526679 - RNA, 19 nt, Human
ucccaacacccacugcccu

SEQ ID NO: 526680 - RNA, 25 nt, Human
uccuagggaguauauggccaucuug

SEQ ID NO: 526681 - RNA, 20 nt, Human
ucgcacuggccuucccguca

SEQ ID NO: 526682 - RNA, 23 nt, Human
ucugcucauccgcagccucugac

SEQ ID NO: 526683 - RNA, 18 nt, Human
ugacuguauacaaaugcu

SEQ ID NO: 526684 - RNA, 23 nt, Human
ugccaucuugaaucucuuuuaca

SEQ ID NO: 526685 - RNA, 22 nt, Human
uggccuggaguccuccaagucu

SEQ ID NO: 526686 - RNA, 19 nt, Human
uggcuagaaacaacuucca

SEQ ID NO: 526687 - RNA, 19 nt, Human
uggguccaagucuuucuga

SEQ ID NO: 526688 - RNA, 20 nt, Human
uuccaucccggccccaaacu

SEQ ID NO: 526689 - RNA, 21 nt, Human
aaagagcccggcugagggugc

SEQ ID NO: 526690 - RNA, 20 nt, Human
aaagccuaaggagagugggg

SEQ ID NO: 526691 - RNA, 24 nt, Human
aaauaggaaauagccguauaugua

SEQ ID NO: 526692 - RNA, 24 nt, Human
aagaacaguaaaauaggaaauagc

SEQ ID NO: 526693 - RNA, 19 nt, Human
aagcaaguggcggcagcag

SEQ ID NO: 526694 - RNA, 18 nt, Human
aagcccacccccucaguc

SEQ ID NO: 526695 - RNA, 18 nt, Human
aaggggccagugguccug

SEQ ID NO: 526696 - RNA, 26 nt, Human
aaggggccagugguccuggggcuggg

SEQ ID NO: 526697 - RNA, 24 nt, Human
aaugcuaggggcuacugaaaaaaa

SEQ ID NO: 526698 - RNA, 22 nt, Human
agagcagagcacaaagccuaag

SEQ ID NO: 526699 - RNA, 24 nt, Human
agagcagagcacaaagccuaagga

SEQ ID NO: 526700 - RNA, 22 nt, Human
agccaaugcuaggggcuacuga

SEQ ID NO: 526701 - RNA, 18 nt, Human
aggaggugcugcaggaag

SEQ ID NO: 526702 - RNA, 22 nt, Human
agguauaucaagaggccggggc

SEQ ID NO: 526703 - RNA, 21 nt, Human
caaugcuaggggcuacugaaa

SEQ ID NO: 526704 - RNA, 18 nt, Human
caccaacgugagccacug

SEQ ID NO: 526705 - RNA, 21 nt, Human
caccacccgcccaugcuacuc

SEQ ID NO: 526706 - RNA, 19 nt, Human
caccauagccaggaagcau

SEQ ID NO: 526707 - RNA, 22 nt, Human
caccccaccauagccaggaagc

SEQ ID NO: 526708 - RNA, 18 nt, Human
cagacacagggcccaugg

SEQ ID NO: 526709 - RNA, 21 nt, Human
cauagccaggaagcaucagaa

SEQ ID NO: 526710 - RNA, 22 nt, Human
ccacugccguccccaccacccg

SEQ ID NO: 526711 - RNA, 19 nt, Human
ccagacagggagaaagcca

SEQ ID NO: 526712 - RNA, 24 nt, Human
cccacagucagcggugcugcuuug

SEQ ID NO: 526713 - RNA, 18 nt, Human
cccaggccgaggcgugag

SEQ ID NO: 526714 - RNA, 21 nt, Human
ccccaagacugcccagggagu

SEQ ID NO: 526715 - RNA, 21 nt, Human
cccccaagacugcccagggag

SEQ ID NO: 526716 - RNA, 22 nt, Human
ccccucaggccaaggggccagu

SEQ ID NO: 526717 - RNA, 21 nt, Human
cccggacucgacgcugcaggu

SEQ ID NO: 526718 - RNA, 20 nt, Human
ccgcagcccuggcucccugc

SEQ ID NO: 526719 - RNA, 23 nt, Human
ccgcccggaccguccgagggauc

SEQ ID NO: 526720 - RNA, 22 nt, Human
ccuaacccgugaggaacuggaa

SEQ ID NO: 526721 - RNA, 18 nt, Human
ccugagccaggcgcgggg

SEQ ID NO: 526722 - RNA, 19 nt, Human
cgcucaccgcugcugggca

SEQ ID NO: 526723 - RNA, 25 nt, Human
cggcagcagcacgccagguggguga

SEQ ID NO: 526724 - RNA, 21 nt, Human
cucagcucuggcccccaagac

SEQ ID NO: 526725 - RNA, 21 nt, Human
cucccaggccgaggcgugagc

SEQ ID NO: 526726 - RNA, 22 nt, Human
cugccguccccaccacccgccc

SEQ ID NO: 526727 - RNA, 19 nt, Human
gacaagggcagccuggcag

SEQ ID NO: 526728 - RNA, 22 nt, Human
gcccacagucagcggugcugcu

SEQ ID NO: 526729 - RNA, 26 nt, Human
gcccccaagacugcccagggaguaag

SEQ ID NO: 526730 - RNA, 20 nt, Human
gccguccccaccacccgccc

SEQ ID NO: 526731 - RNA, 19 nt, Human
ggacaagggcagccuggca

SEQ ID NO: 526732 - RNA, 20 nt, Human
ggagcaggguaggaggugcu

SEQ ID NO: 526733 - RNA, 19 nt, Human
ggcccccaagacugcccag

SEQ ID NO: 526734 - RNA, 21 nt, Human
ggcggaggcucucagcaaggc

SEQ ID NO: 526735 - RNA, 25 nt, Human
gggaagacuuugggggaaacugagg

SEQ ID NO: 526736 - RNA, 20 nt, Human
gggcagccuggcagggcaga

SEQ ID NO: 526737 - RNA, 23 nt, Human
gggcccccagccccucaggccaa

SEQ ID NO: 526738 - RNA, 22 nt, Human
ggggagagggaggacacggagc

SEQ ID NO: 526739 - RNA, 24 nt, Human
ggggguucugcgguguuaaaggac

SEQ ID NO: 526740 - RNA, 18 nt, Human
gugaugcaggagccccua

SEQ ID NO: 526741 - RNA, 24 nt, Human
uaggaaauagccguauauguacac

SEQ ID NO: 526742 - RNA, 20 nt, Human
uaggaggugcugcaggaagc

SEQ ID NO: 526743 - RNA, 18 nt, Human
uaucaagaggccaggcuc

SEQ ID NO: 526744 - RNA, 19 nt, Human
uauggacuggccucagcuc

SEQ ID NO: 526745 - RNA, 19 nt, Human
ucacauggacaagggcagc

SEQ ID NO: 526746 - RNA, 21 nt, Human
uccagcacuccugagccaggc

SEQ ID NO: 526747 - RNA, 23 nt, Human
uccagggaagacuuugggggaaa

SEQ ID NO: 526748 - RNA, 18 nt, Human
ucccugcagacacagggc

SEQ ID NO: 526749 - RNA, 23 nt, Human
ucucagcaaggccgagccgagau

SEQ ID NO: 526750 - RNA, 18 nt, Human
ucuggcccccaagacugc

SEQ ID NO: 526751 - RNA, 25 nt, Human
ugaaaaaaacagcccagccacugua

SEQ ID NO: 526752 - RNA, 25 nt, Human
ugaaaccagacagggagaaagccag

SEQ ID NO: 526753 - RNA, 22 nt, Human
ugaagaacaguaaaauaggaaa

SEQ ID NO: 526754 - RNA, 23 nt, Human
ugagggugcccgcccggaccguc

SEQ ID NO: 526755 - RNA, 19 nt, Human
ugcaaagagcccggcugag

SEQ ID NO: 526756 - RNA, 18 nt, Human
uggacuggccucagcucu

SEQ ID NO: 526757 - RNA, 18 nt, Human
uggcccccaagacugccc

SEQ ID NO: 526758 - RNA, 20 nt, Human
uggcggcagcagcacgccag

SEQ ID NO: 526759 - RNA, 22 nt, Human
uggcucccugcagacacagggc

SEQ ID NO: 526760 - RNA, 20 nt, Human
ugggaggggguucugcggug

SEQ ID NO: 526761 - RNA, 20 nt, Human
ugggggaaacugagguuccu

SEQ ID NO: 526762 - RNA, 18 nt, Human
uuuuuuuuuuuuuuuuug

SEQ ID NO: 526763 - RNA, 22 nt, Human
uuuuuuuuuuuuuuuuuuuggc

SEQ ID NO: 526764 - RNA, 19 nt, Human
aaaaacaccagauguuaaa

SEQ ID NO: 526765 - RNA, 19 nt, Human
aaacccgaccaacccgggg

SEQ ID NO: 526766 - RNA, 25 nt, Human
aagcaucaacagaucaagcaaagcc

SEQ ID NO: 526767 - RNA, 23 nt, Human
aagugcuggagcucgggucagcc

SEQ ID NO: 526768 - RNA, 19 nt, Human
caaaagcgcauguguccuc

SEQ ID NO: 526769 - RNA, 26 nt, Human
cagaucaagcaaagccaugaaaauua

SEQ ID NO: 526770 - RNA, 21 nt, Human
cagcagaucauguuugucuga

SEQ ID NO: 526771 - RNA, 22 nt, Human
cuacaacacagguugcuaacug

SEQ ID NO: 526772 - RNA, 18 nt, Human
cuggagcucgggucagcc

SEQ ID NO: 526773 - RNA, 19 nt, Human
gaaaaaucaggcgcggaaa

SEQ ID NO: 526774 - RNA, 18 nt, Human
gcgcggaaaaagugcugg

SEQ ID NO: 526775 - RNA, 22 nt, Human
gcuacaacacagguugcuaacu

SEQ ID NO: 526776 - RNA, 22 nt, Human
ggaaaaagugcuggagcucggg

SEQ ID NO: 526777 - RNA, 21 nt, Human
gggcagggaaccaaaacugag

SEQ ID NO: 526778 - RNA, 22 nt, Human
uaagagaggaugacacaaccau

SEQ ID NO: 526779 - RNA, 19 nt, Human
uagaauuaguaaaaaugau

SEQ ID NO: 526780 - RNA, 23 nt, Human
ucagccacaucuugauuuuccua

SEQ ID NO: 526781 - RNA, 22 nt, Human
ucaggcgcggaaaaagugcugg

SEQ ID NO: 526782 - RNA, 21 nt, Human
ucuucagccacaucuugauuu

SEQ ID NO: 526783 - RNA, 21 nt, Human
ucuuuuggcagcgaauugggu

SEQ ID NO: 526784 - RNA, 19 nt, Human
ugauuaagagaggaugaca

SEQ ID NO: 526785 - RNA, 24 nt, Human
uggaauaggcccugggaauccaca

SEQ ID NO: 526786 - RNA, 22 nt, Human
acuuucaacuuugaauaaauuc

SEQ ID NO: 526787 - RNA, 25 nt, Human
agaaaggacacuuucaacuuugaau

SEQ ID NO: 526788 - RNA, 18 nt, Human
gagaaaggacacuuucaa

SEQ ID NO: 526789 - RNA, 20 nt, Human
uaaagagagagagaaaggac

SEQ ID NO: 526790 - RNA, 19 nt, Human
uauauaggauuucuaacau

SEQ ID NO: 526791 - RNA, 26 nt, Human
uaucaaguaccaaacugaguuuaaua

SEQ ID NO: 526792 - RNA, 24 nt, Human
ugaguuuauuaaagagagagagaa

SEQ ID NO: 526793 - RNA, 23 nt, Human
uuuaaaauauacuugauuuucua

SEQ ID NO: 526794 - RNA, 24 nt, Human
aaagugcugggauuacaggcguga

SEQ ID NO: 526795 - RNA, 24 nt, Human
aagcgauccaccugccuuggcuuc

SEQ ID NO: 526796 - RNA, 19 nt, Human
aagugcugggauuacaggc

SEQ ID NO: 526797 - RNA, 19 nt, Human
aagugcugggauuacaggc

SEQ ID NO: 526798 - RNA, 26 nt, Human
aagugcugggauuacaggcgugagcc

SEQ ID NO: 526799 - RNA, 24 nt, Human
aauuuuguauuuuuaguagagaca

SEQ ID NO: 526800 - RNA, 20 nt, Human
acaggguuucuccauguugg

SEQ ID NO: 526801 - RNA, 24 nt, Human
acaggguuucuccauguugguuag

SEQ ID NO: 526802 - RNA, 24 nt, Human
accaagagucuuggaaguauccac

SEQ ID NO: 526803 - RNA, 25 nt, Human
accauguugcccaggcuggucucua

SEQ ID NO: 526804 - RNA, 18 nt, Human
acgggauuucaccauguu

SEQ ID NO: 526805 - RNA, 19 nt, Human
acgggauuucaccauguug

SEQ ID NO: 526806 - RNA, 24 nt, Human
acgggauuucaccauguugcccag

SEQ ID NO: 526807 - RNA, 19 nt, Human
acuacaggugcaugccacc

SEQ ID NO: 526808 - RNA, 22 nt, Human
acucuuguugcccaggcuggag

SEQ ID NO: 526809 - RNA, 18 nt, Human
agacaggguuucuccaug

SEQ ID NO: 526810 - RNA, 18 nt, Human
agcaauucuccugcugua

SEQ ID NO: 526811 - RNA, 19 nt, Human
agccaccacacccagccua

SEQ ID NO: 526812 - RNA, 18 nt, Human
agccuccagaguagcugg

SEQ ID NO: 526813 - RNA, 25 nt, Human
aggcuggagugcaguggugcgaucu

SEQ ID NO: 526814 - RNA, 22 nt, Human
agggcagugucaugaccauggc

SEQ ID NO: 526815 - RNA, 24 nt, Human
aggugauccacuccccucggccuc

SEQ ID NO: 526816 - RNA, 22 nt, Human
aguagagacaggguuucuccau

SEQ ID NO: 526817 - RNA, 18 nt, Human
aguagcugggacuacagg

SEQ ID NO: 526818 - RNA, 21 nt, Human
aguagcugggauuacaggcau

SEQ ID NO: 526819 - RNA, 23 nt, Human
aguagcugggauuacaggcaugc

SEQ ID NO: 526820 - RNA, 23 nt, Human
agugcaguggugcgaucuuggcu

SEQ ID NO: 526821 - RNA, 24 nt, Human
agugcaguggugcgaucuuggcuc

SEQ ID NO: 526822 - RNA, 25 nt, Human
agugcaguggugcgaucuuggcucu

SEQ ID NO: 526823 - RNA, 18 nt, Human
agugcugggauuacaggc

SEQ ID NO: 526824 - RNA, 24 nt, Human
auuucaccauguugcccaggcugg

SEQ ID NO: 526825 - RNA, 24 nt, Human
caaagugcugggauuacaggcgug

SEQ ID NO: 526826 - RNA, 23 nt, Human
caacuucccugggcucaggugau

SEQ ID NO: 526827 - RNA, 23 nt, Human
cacacccagccuaauaauccuuu

SEQ ID NO: 526828 - RNA, 19 nt, Human
caccacacccagccuaaua

SEQ ID NO: 526829 - RNA, 24 nt, Human
caccauguugcccaggcuggucuc

SEQ ID NO: 526830 - RNA, 27 nt, Human
caccauguugcccaggcuggucucuaa

SEQ ID NO: 526831 - RNA, 24 nt, Human
caccucagccuccagaguagcugg

SEQ ID NO: 526832 - RNA, 23 nt, Human
caccugccuuggcuucccaaagc

SEQ ID NO: 526833 - RNA, 24 nt, Human
cacucuuguugcccaggcuggagu

SEQ ID NO: 526834 - RNA, 24 nt, Human
cagcaauacugccaauaauuuuaa

SEQ ID NO: 526835 - RNA, 23 nt, Human
cagcagccucaacuucccugggc

SEQ ID NO: 526836 - RNA, 24 nt, Human
caggguuucuccauguugguuagg

SEQ ID NO: 526837 - RNA, 19 nt, Human
caguggugcgaucuuggcu

SEQ ID NO: 526838 - RNA, 24 nt, Human
caugccaccacgcccaguuaauuu

SEQ ID NO: 526839 - RNA, 19 nt, Human
cauguugcccaggcugguc

SEQ ID NO: 526840 - RNA, 24 nt, Human
cauguugcccaggcuggucucuaa

SEQ ID NO: 526841 - RNA, 21 nt, Human
cauucagcaauacugccaaua

SEQ ID NO: 526842 - RNA, 20 nt, Human
ccaaagugcugggauuacag

SEQ ID NO: 526843 - RNA, 22 nt, Human
ccaaagugcugggauuacaggc

SEQ ID NO: 526844 - RNA, 22 nt, Human
ccaaagugcugggauuacaggc

SEQ ID NO: 526845 - RNA, 24 nt, Human
ccaaagugcugggauuacaggcgu

SEQ ID NO: 526846 - RNA, 20 nt, Human
ccaccacgccuggcuaauuu

SEQ ID NO: 526847 - RNA, 24 nt, Human
ccagaguagcugggacuacaggug

SEQ ID NO: 526848 - RNA, 19 nt, Human
ccaggcuccaggccaggcu

SEQ ID NO: 526849 - RNA, 20 nt, Human
ccaggcuccaggccaggcuu

SEQ ID NO: 526850 - RNA, 19 nt, Human
ccauguugguuaggcuggu

SEQ ID NO: 526851 - RNA, 22 nt, Human
ccauguugguuaggcuggucuc

SEQ ID NO: 526852 - RNA, 23 nt, Human
ccauguugguuaggcuggucucg

SEQ ID NO: 526853 - RNA, 22 nt, Human
cccaguuaauuuuugcauuuuu

SEQ ID NO: 526854 - RNA, 24 nt, Human
ccccucaccucagccuccagagua

SEQ ID NO: 526855 - RNA, 23 nt, Human
cccgaguucaagcaauucuccug

SEQ ID NO: 526856 - RNA, 20 nt, Human
cccugugccugggcuccuuc

SEQ ID NO: 526857 - RNA, 21 nt, Human
ccgcccgacaagcccugaccc

SEQ ID NO: 526858 - RNA, 24 nt, Human
ccucaccucagccuccagaguagc

SEQ ID NO: 526859 - RNA, 24 nt, Human
ccucccgaguucaagcaauucucc

SEQ ID NO: 526860 - RNA, 22 nt, Human
ccugacccgcucgucaggacug

SEQ ID NO: 526861 - RNA, 21 nt, Human
ccugagcucaagcgauccacc

SEQ ID NO: 526862 - RNA, 23 nt, Human
ccugaguagcugggauuacaggc

SEQ ID NO: 526863 - RNA, 24 nt, Human
ccugaguagcugggauuacaggca

SEQ ID NO: 526864 - RNA, 22 nt, Human
cgaacucaggugauccacuccc

SEQ ID NO: 526865 - RNA, 18 nt, Human
cgggagccccugugccug

SEQ ID NO: 526866 - RNA, 24 nt, Human
cgggauuucaccauguugcccagg

SEQ ID NO: 526867 - RNA, 20 nt, Human
cgggguugguggugcggagc

SEQ ID NO: 526868 - RNA, 22 nt, Human
cgucucccccuuccaggcucca

SEQ ID NO: 526869 - RNA, 22 nt, Human
cuaauaauccuuuuuaauauau

SEQ ID NO: 526870 - RNA, 24 nt, Human
cuaauuuuguauuuuuaguagaga

SEQ ID NO: 526871 - RNA, 24 nt, Human
cucaagcgauccaccugccuuggc

SEQ ID NO: 526872 - RNA, 24 nt, Human
cucagccuccagaguagcugggac

SEQ ID NO: 526873 - RNA, 23 nt, Human
cucaggugauucccccggcucag

SEQ ID NO: 526874 - RNA, 24 nt, Human
cucaggugauuccccucaccucag

SEQ ID NO: 526875 - RNA, 24 nt, Human
cuccauguugguuaggcuggucuc

SEQ ID NO: 526876 - RNA, 18 nt, Human
cucuuguugcccaggcug

SEQ ID NO: 526877 - RNA, 23 nt, Human
cugaguagcugggauuacaggca

SEQ ID NO: 526878 - RNA, 24 nt, Human
cugaguagcugggauuacaggcau

SEQ ID NO: 526879 - RNA, 23 nt, Human
cugcuguagccuccugaguagcu

SEQ ID NO: 526880 - RNA, 24 nt, Human
cuuguugcccaggcuggagugcag

SEQ ID NO: 526881 - RNA, 19 nt, Human
gaacucaggugauccacuc

SEQ ID NO: 526882 - RNA, 20 nt, Human
gagacaggguuucuccaugu

SEQ ID NO: 526883 - RNA, 21 nt, Human
gagacaggguuucuccauguu

SEQ ID NO: 526884 - RNA, 24 nt, Human
gagcucaagcgauccaccugccuu

SEQ ID NO: 526885 - RNA, 26 nt, Human
gagggcagugucaugaccauggccaa

SEQ ID NO: 526886 - RNA, 26 nt, Human
gaguagcugggacuacaggugcaugc

SEQ ID NO: 526887 - RNA, 22 nt, Human
gaguagcugggauuacaggcau

SEQ ID NO: 526888 - RNA, 18 nt, Human
gauuacaggcaugcgcca

SEQ ID NO: 526889 - RNA, 18 nt, Human
gauuacaggcgugagcca

SEQ ID NO: 526890 - RNA, 21 nt, Human
gauuacaggcgugagccacca

SEQ ID NO: 526891 - RNA, 22 nt, Human
gauuacaggcgugagccaccac

SEQ ID NO: 526892 - RNA, 19 nt, Human
gcccaggcuggagugcagu

SEQ ID NO: 526893 - RNA, 22 nt, Human
gcccaguuaauuuuugcauuuu

SEQ ID NO: 526894 - RNA, 24 nt, Human
gccucccgaguucaagcaauucuu

SEQ ID NO: 526895 - RNA, 24 nt, Human
gccuuggcuucccaaagcuuuggg

SEQ ID NO: 526896 - RNA, 24 nt, Human
gcgauccaccugccuuggcuuccc

SEQ ID NO: 526897 - RNA, 24 nt, Human
gcucaagcgauccaccugccuugg

SEQ ID NO: 526898 - RNA, 19 nt, Human
ggauuacaggcaugcgcca

SEQ ID NO: 526899 - RNA, 19 nt, Human
ggauuacaggcgugagcca

SEQ ID NO: 526900 - RNA, 22 nt, Human
ggauuucaccauguugcccagg

SEQ ID NO: 526901 - RNA, 24 nt, Human
ggcucaggugauuccccucaccuc

SEQ ID NO: 526902 - RNA, 23 nt, Human
gggauuucaccauguugcccagg

SEQ ID NO: 526903 - RNA, 24 nt, Human
ggugauccacuccccucggccucc

SEQ ID NO: 526904 - RNA, 20 nt, Human
guagcugggauuacaggcau

SEQ ID NO: 526905 - RNA, 24 nt, Human
gugauccacuccccucggccuccc

SEQ ID NO: 526906 - RNA, 23 nt, Human
uaacuccugagcucaagcgaucc

SEQ ID NO: 526907 - RNA, 22 nt, Human
uaauuuuugcauuuuuuugugg

SEQ ID NO: 526908 - RNA, 22 nt, Human
uacaggcaugcgccaccacgcc

SEQ ID NO: 526909 - RNA, 24 nt, Human
uacaggcgugagccaccacaccca

SEQ ID NO: 526910 - RNA, 24 nt, Human
uacaggugcaugccaccacgccca

SEQ ID NO: 526911 - RNA, 22 nt, Human
uagagacaggguuucuccaugu

SEQ ID NO: 526912 - RNA, 20 nt, Human
uagccuccugaguagcuggg

SEQ ID NO: 526913 - RNA, 21 nt, Human
uagccuccugaguagcuggga

SEQ ID NO: 526914 - RNA, 24 nt, Human
uaguagagacaggguuucuccaug

SEQ ID NO: 526915 - RNA, 25 nt, Human
uauauaaagaaaagaacucagggau

SEQ ID NO: 526916 - RNA, 23 nt, Human
ucacucuuguugcccaggcugga

SEQ ID NO: 526917 - RNA, 19 nt, Human
ucaggugauucccccggcu

SEQ ID NO: 526918 - RNA, 24 nt, Human
uccagaguagcugggacuacaggu

SEQ ID NO: 526919 - RNA, 20 nt, Human
uccaggcuccaggccaggcu

SEQ ID NO: 526920 - RNA, 24 nt, Human
uccaggcuccaggccaggcuuccg

SEQ ID NO: 526921 - RNA, 24 nt, Human
ucccaaagugcugggauuacaggc

SEQ ID NO: 526922 - RNA, 21 nt, Human
ucccgaguucaagcaauucuc

SEQ ID NO: 526923 - RNA, 24 nt, Human
ucccgaguucaagcaauucuccug

SEQ ID NO: 526924 - RNA, 21 nt, Human
ucccgcucgggccgucucccc

SEQ ID NO: 526925 - RNA, 24 nt, Human
uccugaguagcugggauuacaggc

SEQ ID NO: 526926 - RNA, 18 nt, Human
ucggccucccaaagugcu

SEQ ID NO: 526927 - RNA, 22 nt, Human
ucucaaucuguuguccaggcug

SEQ ID NO: 526928 - RNA, 22 nt, Human
ucucaaucuguuguccaggcug

SEQ ID NO: 526929 - RNA, 24 nt, Human
ucucaaucuguuguccaggcugga

SEQ ID NO: 526930 - RNA, 23 nt, Human
ucucuaacuccugagcucaagcg

SEQ ID NO: 526931 - RNA, 22 nt, Human
ucuuguugcccaggcuggagug

SEQ ID NO: 526932 - RNA, 23 nt, Human
ugagacagaguuucacucuuguu

SEQ ID NO: 526933 - RNA, 20 nt, Human
ugagacagggucucaaucug

SEQ ID NO: 526934 - RNA, 22 nt, Human
ugcaguggugcgaucuuggcuc

SEQ ID NO: 526935 - RNA, 19 nt, Human
ugcaugccaccacgcccag

SEQ ID NO: 526936 - RNA, 21 nt, Human
ugcaugccaccacgcccaguu

SEQ ID NO: 526937 - RNA, 18 nt, Human
ugcccaggcuggagugca

SEQ ID NO: 526938 - RNA, 21 nt, Human
ugcccaggcuggagugcagug

SEQ ID NO: 526939 - RNA, 24 nt, Human
ugcccaggcuggagugcaguggug

SEQ ID NO: 526940 - RNA, 24 nt, Human
ugcccaggcuggucucuaacuccu

SEQ ID NO: 526941 - RNA, 28 nt, Human
ugcccaggcuggucucuaacuccugagc

SEQ ID NO: 526942 - RNA, 19 nt, Human
ugccuuggcuucccaaagc

SEQ ID NO: 526943 - RNA, 24 nt, Human
ugcugggauuacaggcgugagcca

SEQ ID NO: 526944 - RNA, 23 nt, Human
uggagugcaguggugcgaucuug

SEQ ID NO: 526945 - RNA, 24 nt, Human
uggagugcaguggugcgaucuugg

SEQ ID NO: 526946 - RNA, 21 nt, Human
ugggacuacaggugcaugcca

SEQ ID NO: 526947 - RNA, 22 nt, Human
ugggacuacaggugcaugccac

SEQ ID NO: 526948 - RNA, 24 nt, Human
ugggacuacaggugcaugccacca

SEQ ID NO: 526949 - RNA, 18 nt, Human
ugggauuacaggcaugcg

SEQ ID NO: 526950 - RNA, 21 nt, Human
ugggauuacaggcaugcgcca

SEQ ID NO: 526951 - RNA, 22 nt, Human
ugggauuacaggcaugcgccac

SEQ ID NO: 526952 - RNA, 24 nt, Human
ugggauuacaggcaugcgccacca

SEQ ID NO: 526953 - RNA, 18 nt, Human
ugggauuacaggcgugag

SEQ ID NO: 526954 - RNA, 19 nt, Human
ugggauuacaggcgugagc

SEQ ID NO: 526955 - RNA, 22 nt, Human
ugggauuacaggcgugagccac

SEQ ID NO: 526956 - RNA, 23 nt, Human
ugggauuacaggcgugagccacc

SEQ ID NO: 526957 - RNA, 24 nt, Human
ugggauuacaggcgugagccacca

SEQ ID NO: 526958 - RNA, 20 nt, Human
ugggcuccuucugcuuucua

SEQ ID NO: 526959 - RNA, 19 nt, Human
uggugacgggauuucacca

SEQ ID NO: 526960 - RNA, 23 nt, Human
ugguuaggcuggucucgaacuca

SEQ ID NO: 526961 - RNA, 22 nt, Human
ugucaugaccauggcucacagc

SEQ ID NO: 526962 - RNA, 24 nt, Human
uuaguagagacaggguuucuccau

SEQ ID NO: 526963 - RNA, 21 nt, Human
uucaagcaauucuccugcugu

SEQ ID NO: 526964 - RNA, 24 nt, Human
uucacucuuguugcccaggcugga

SEQ ID NO: 526965 - RNA, 27 nt, Human
uucaguuguugucacuuggugaaaaaa

SEQ ID NO: 526966 - RNA, 21 nt, Human
uucccccggcucaggugauuc

SEQ ID NO: 526967 - RNA, 24 nt, Human
uucucuuugagucaugcugguuuc

SEQ ID NO: 526968 - RNA, 22 nt, Human
uugagacagggucucaaucugu

SEQ ID NO: 526969 - RNA, 23 nt, Human
uugagacagggucucaaucuguu

SEQ ID NO: 526970 - RNA, 24 nt, Human
uugcccaggcuggagugcaguggu

SEQ ID NO: 526971 - RNA, 24 nt, Human
uuguccaggcuggagggcaguguc

SEQ ID NO: 526972 - RNA, 21 nt, Human
uuguggugacgggauuucacc

SEQ ID NO: 526973 - RNA, 24 nt, Human
uuguggugacgggauuucaccaug

SEQ ID NO: 526974 - RNA, 23 nt, Human
uuucaccauguugcccaggcugg

SEQ ID NO: 526975 - RNA, 24 nt, Human
uuucaccauguugcccaggcuggu

SEQ ID NO: 526976 - RNA, 24 nt, Human
uuucacucuuguugcccaggcugg

SEQ ID NO: 526977 - RNA, 21 nt, Human
uuucuccauguugguuaggcu

SEQ ID NO: 526978 - RNA, 23 nt, Human
uuuguggugacgggauuucacca

SEQ ID NO: 526979 - RNA, 24 nt, Human
uuuguggugacgggauuucaccau

SEQ ID NO: 526980 - RNA, 19 nt, Human
uuuuguauuuuuaguagag

SEQ ID NO: 526981 - RNA, 20 nt, Human
uuuuguauuuuuaguagaga

SEQ ID NO: 526982 - RNA, 21 nt, Human
uuuuguggugacgggauuuca

SEQ ID NO: 526983 - RNA, 18 nt, Human
uuuuuuuuuaucaggucu

SEQ ID NO: 526984 - RNA, 23 nt, Human
uuuuuuuuuugagacagggucuc

SEQ ID NO: 526985 - RNA, 23 nt, Human
uuuuuuuuuuuugagacaggguc

SEQ ID NO: 526986 - RNA, 26 nt, Human
uuuuuuuuuuuugagacagggucuca

SEQ ID NO: 526987 - RNA, 30 nt, Human
uuuuuuuuuuuuuuuuuuuugagacagggg

SEQ ID NO: 526988 - RNA, 18 nt, Human
aaaacuauccagcaguua

SEQ ID NO: 526989 - RNA, 23 nt, Human
aaacaacacaaaccccauaaacu

SEQ ID NO: 526990 - RNA, 20 nt, Human
aaacagcaggaauugguuuu

SEQ ID NO: 526991 - RNA, 20 nt, Human
aaagagagagaaaagggaau

SEQ ID NO: 526992 - RNA, 23 nt, Human
aaauaaaagcaagacaguggcaa

SEQ ID NO: 526993 - RNA, 20 nt, Human
aacaaugacaaaaagucccc

SEQ ID NO: 526994 - RNA, 22 nt, Human
aaccauugccuuauugugaaga

SEQ ID NO: 526995 - RNA, 18 nt, Human
aacuuuucuccuucuccu

SEQ ID NO: 526996 - RNA, 21 nt, Human
aagagcccuggguuuuucuag

SEQ ID NO: 526997 - RNA, 26 nt, Human
aagaggaaagaggaacaaugacaaaa

SEQ ID NO: 526998 - RNA, 20 nt, Human
aagcaagacaguggcaagga

SEQ ID NO: 526999 - RNA, 24 nt, Human
aagcaagcuaaauugcaacaacau

SEQ ID NO: 527000 - RNA, 19 nt, Human
aagcuaccauucccauuca

SEQ ID NO: 527001 - RNA, 19 nt, Human
aauaauuggaaagagagag

SEQ ID NO: 527002 - RNA, 23 nt, Human
acaaaguauucuucugguuuuaa

SEQ ID NO: 527003 - RNA, 21 nt, Human
accaccucucauuuacuccug

SEQ ID NO: 527004 - RNA, 25 nt, Human
acugucuucucagcuggacugagau

SEQ ID NO: 527005 - RNA, 23 nt, Human
agaauuuuaaaagcagcucaaag

SEQ ID NO: 527006 - RNA, 20 nt, Human
agacagcaggcgaaagcagg

SEQ ID NO: 527007 - RNA, 21 nt, Human
agacagcaggcgaaagcaggc

SEQ ID NO: 527008 - RNA, 22 nt, Human
agacaguggcaaggaugaaagc

SEQ ID NO: 527009 - RNA, 19 nt, Human
agaggaacaaugacaaaaa

SEQ ID NO: 527010 - RNA, 18 nt, Human
agaggggaggaaaauaac

SEQ ID NO: 527011 - RNA, 19 nt, Human
agaggggaggaaaauaacg

SEQ ID NO: 527012 - RNA, 22 nt, Human
agagguuugagugggagacagg

SEQ ID NO: 527013 - RNA, 28 nt, Human
agauuucuuucaaaggaccccccugcuu

SEQ ID NO: 527014 - RNA, 24 nt, Human
agcaaaaaagggaaauaaaaauau

SEQ ID NO: 527015 - RNA, 22 nt, Human
agcaccccccauccuuugaugc

SEQ ID NO: 527016 - RNA, 23 nt, Human
aggaaaauaacggcaccuucucc

SEQ ID NO: 527017 - RNA, 23 nt, Human
aguaaaaaauaaaagcaagacag

SEQ ID NO: 527018 - RNA, 20 nt, Human
auaccauuugaacccaagca

SEQ ID NO: 527019 - RNA, 21 nt, Human
auaccauuugaacccaagcag

SEQ ID NO: 527020 - RNA, 21 nt, Human
auccuuuaccauuuuuucuuu

SEQ ID NO: 527021 - RNA, 20 nt, Human
augauaacacaaugccaaaa

SEQ ID NO: 527022 - RNA, 18 nt, Human
auggagucucaaaguucc

SEQ ID NO: 527023 - RNA, 19 nt, Human
auugcaacaacauauugau

SEQ ID NO: 527024 - RNA, 21 nt, Human
caaaauuagaagcaaaauggu

SEQ ID NO: 527025 - RNA, 22 nt, Human
caagacaguggcaaggaugaaa

SEQ ID NO: 527026 - RNA, 24 nt, Human
cacaaacagcacagccacaaagua

SEQ ID NO: 527027 - RNA, 19 nt, Human
cacucagagggaaacagua

SEQ ID NO: 527028 - RNA, 23 nt, Human
cauucccauucaaacagcaggaa

SEQ ID NO: 527029 - RNA, 24 nt, Human
ccaccugguucuaagucauauccc

SEQ ID NO: 527030 - RNA, 19 nt, Human
ccaguaccuaaguagcagg

SEQ ID NO: 527031 - RNA, 25 nt, Human
ccccccugcuucuuuuauagcaccc

SEQ ID NO: 527032 - RNA, 19 nt, Human
cccccucccacuaucuucu

SEQ ID NO: 527033 - RNA, 20 nt, Human
cccugaggaauauuucagga

SEQ ID NO: 527034 - RNA, 23 nt, Human
ccgaugauaacacaaugccaaaa

SEQ ID NO: 527035 - RNA, 24 nt, Human
ccuggcccccucccacuaucuucu

SEQ ID NO: 527036 - RNA, 20 nt, Human
ccuucaaacaacacaaaccc

SEQ ID NO: 527037 - RNA, 21 nt, Human
cgaugauaacacaaugccaaa

SEQ ID NO: 527038 - RNA, 18 nt, Human
cuccugcagccuggcccc

SEQ ID NO: 527039 - RNA, 19 nt, Human
cuccuguuuagcaaaaaaa

SEQ ID NO: 527040 - RNA, 22 nt, Human
cuccuguuuagcaaaaaaaaac

SEQ ID NO: 527041 - RNA, 20 nt, Human
cucuauauacacauauccag

SEQ ID NO: 527042 - RNA, 27 nt, Human
cuucuugcugcaaaccaacuuugccag

SEQ ID NO: 527043 - RNA, 25 nt, Human
gaaaaaaaaaguuaugcauagaagg

SEQ ID NO: 527044 - RNA, 21 nt, Human
gaacuguucucccaaaacucu

SEQ ID NO: 527045 - RNA, 25 nt, Human
gaagaauuuuaaaagcagcucaaag

SEQ ID NO: 527046 - RNA, 21 nt, Human
gacaguggcaaggaugaaagc

SEQ ID NO: 527047 - RNA, 20 nt, Human
gacuuucucauggagucuca

SEQ ID NO: 527048 - RNA, 24 nt, Human
gagagguuugagugggagacaggu

SEQ ID NO: 527049 - RNA, 19 nt, Human
gagcauccugcauuggcga

SEQ ID NO: 527050 - RNA, 27 nt, Human
gaguuuuuaagguuuuuuuuuucuuuc

SEQ ID NO: 527051 - RNA, 18 nt, Human
gcaaaaaaaaacuuccuu

SEQ ID NO: 527052 - RNA, 21 nt, Human
gcaagcauugaaccuucaaac

SEQ ID NO: 527053 - RNA, 20 nt, Human
gcuaccauucccauucaaac

SEQ ID NO: 527054 - RNA, 22 nt, Human
ggaaaauaacggcaccuucucc

SEQ ID NO: 527055 - RNA, 20 nt, Human
gggcaugauauaacuuuggu

SEQ ID NO: 527056 - RNA, 20 nt, Human
ggugaaaagauaugaaggga

SEQ ID NO: 527057 - RNA, 22 nt, Human
gguuuuggcuuccuuuaaaacc

SEQ ID NO: 527058 - RNA, 21 nt, Human
gucaaaucgccucgcaaaagc

SEQ ID NO: 527059 - RNA, 24 nt, Human
gucuauuggcacaaacagcacagc

SEQ ID NO: 527060 - RNA, 25 nt, Human
guuuuuuuuuuuuuuuuuuuauggg

SEQ ID NO: 527061 - RNA, 18 nt, Human
uaaaaccugccucugagc

SEQ ID NO: 527062 - RNA, 24 nt, Human
uaaaagcaagacaguggcaaggau

SEQ ID NO: 527063 - RNA, 22 nt, Human
uaaagauacugguugauaccau

SEQ ID NO: 527064 - RNA, 20 nt, Human
uaaauaaacacaugcaagca

SEQ ID NO: 527065 - RNA, 22 nt, Human
uaagccgaugauaacacaaugc

SEQ ID NO: 527066 - RNA, 21 nt, Human
uaaggagcauccugcauuggc

SEQ ID NO: 527067 - RNA, 19 nt, Human
uagaagguucaguaacagc

SEQ ID NO: 527068 - RNA, 19 nt, Human
uagacagugggccucagaa

SEQ ID NO: 527069 - RNA, 24 nt, Human
uauaaagauacugguugauaccau

SEQ ID NO: 527070 - RNA, 22 nt, Human
uaucuucauuuccucagcaaaa

SEQ ID NO: 527071 - RNA, 22 nt, Human
uauuucaggacuguccuugcug

SEQ ID NO: 527072 - RNA, 19 nt, Human
uauuugccuggccucucaa

SEQ ID NO: 527073 - RNA, 24 nt, Human
ucaaacaacacaaaccccauaaac

SEQ ID NO: 527074 - RNA, 26 nt, Human
ucaaacaacacaaaccccauaaacuc

SEQ ID NO: 527075 - RNA, 25 nt, Human
ucaaacagcaggaauugguuuuugc

SEQ ID NO: 527076 - RNA, 22 nt, Human
ucaaagccugaaucguuaaaug

SEQ ID NO: 527077 - RNA, 20 nt, Human
uccaaaaugucacaggaaaa

SEQ ID NO: 527078 - RNA, 24 nt, Human
uccaggugaccagccaccugguuc

SEQ ID NO: 527079 - RNA, 23 nt, Human
ucccacuaucuucuugcugcaaa

SEQ ID NO: 527080 - RNA, 18 nt, Human
ucucauuuacuccuguuu

SEQ ID NO: 527081 - RNA, 23 nt, Human
ucuggcaagguagacagugggcc

SEQ ID NO: 527082 - RNA, 23 nt, Human
ugaaaauaaauaaacacaugcaa

SEQ ID NO: 527083 - RNA, 19 nt, Human
ugagcgaaacccaacagcc

SEQ ID NO: 527084 - RNA, 21 nt, Human
ugaguggugccaggggaagaa

SEQ ID NO: 527085 - RNA, 19 nt, Human
ugauaacacaaugccaaaa

SEQ ID NO: 527086 - RNA, 23 nt, Human
ugauagauuucuuucaaaggacc

SEQ ID NO: 527087 - RNA, 22 nt, Human
ugcaagaggaaagaggaacaau

SEQ ID NO: 527088 - RNA, 20 nt, Human
ugcauagaagguucaguaac

SEQ ID NO: 527089 - RNA, 26 nt, Human
ugccaggggaagaauuuuaaaagcag

SEQ ID NO: 527090 - RNA, 24 nt, Human
ugcuaaaauuggaacuuuaggcau

SEQ ID NO: 527091 - RNA, 22 nt, Human
ugcuuaucuucauuuccucagc

SEQ ID NO: 527092 - RNA, 23 nt, Human
uggaaagagagagaaaagggaau

SEQ ID NO: 527093 - RNA, 19 nt, Human
uggaaaggucagcaaauag

SEQ ID NO: 527094 - RNA, 23 nt, Human
uggaaauaggugaaaagauauga

SEQ ID NO: 527095 - RNA, 20 nt, Human
uggaguccuugccagagcca

SEQ ID NO: 527096 - RNA, 18 nt, Human
uggcaaggaugaaagcag

SEQ ID NO: 527097 - RNA, 22 nt, Human
uggcacaaacagcacagccaca

SEQ ID NO: 527098 - RNA, 24 nt, Human
uggcacaaacagcacagccacaaa

SEQ ID NO: 527099 - RNA, 19 nt, Human
uggcgauacgcacugagga

SEQ ID NO: 527100 - RNA, 20 nt, Human
uggugccaggggaagaauuu

SEQ ID NO: 527101 - RNA, 19 nt, Human
ugguucuaagucauauccc

SEQ ID NO: 527102 - RNA, 27 nt, Human
ugguugauaccauaggaccacagacgc

SEQ ID NO: 527103 - RNA, 20 nt, Human
uguccuugcuggcuccuuuc

SEQ ID NO: 527104 - RNA, 23 nt, Human
uguuuacuuguuauuuuugaagu

SEQ ID NO: 527105 - RNA, 20 nt, Human
uuaaaugccauccuuuacca

SEQ ID NO: 527106 - RNA, 24 nt, Human
uuaagaucaauuuucauauuuuga

SEQ ID NO: 527107 - RNA, 27 nt, Human
uuaagguuuuuuuuuucuuuuuuuuaa

SEQ ID NO: 527108 - RNA, 23 nt, Human
uucaaacaacacaaaccccauaa

SEQ ID NO: 527109 - RNA, 21 nt, Human
uucaucugagcaagaggggag

SEQ ID NO: 527110 - RNA, 23 nt, Human
uuccaaaaugucacaggaaaaga

SEQ ID NO: 527111 - RNA, 20 nt, Human
uuggcuuccuuuaaaaccug

SEQ ID NO: 527112 - RNA, 20 nt, Human
uugggagaugggagagguuu

SEQ ID NO: 527113 - RNA, 21 nt, Human
uuuucuccuucuccugcagcc

SEQ ID NO: 527114 - RNA, 23 nt, Human
uuuugcuuaucuucauuuccuca

SEQ ID NO: 527115 - RNA, 22 nt, Human
uuuuggucaugacaaagucuau

SEQ ID NO: 527116 - RNA, 19 nt, Human
uuuuuuuucuuuuuuuuaa

SEQ ID NO: 527117 - RNA, 24 nt, Human
uuuuuuuuucuuuuuuuuaaguuu

SEQ ID NO: 527118 - RNA, 20 nt, Human
uuuuuuuuuuuuaugggagu

SEQ ID NO: 527119 - RNA, 25 nt, Human
aaaaauaaggaaaaaaccuuuguac

SEQ ID NO: 527120 - RNA, 21 nt, Human
aacugguccacaggagaaaau

SEQ ID NO: 527121 - RNA, 25 nt, Human
acagcgaacucuucccagagcaccc

SEQ ID NO: 527122 - RNA, 19 nt, Human
acccgcccccaggcccaag

SEQ ID NO: 527123 - RNA, 18 nt, Human
agaagaaaacaggauucu

SEQ ID NO: 527124 - RNA, 26 nt, Human
agaagaaaacaggauucuaggcaaaa

SEQ ID NO: 527125 - RNA, 21 nt, Human
agagauucgauuugguugcca

SEQ ID NO: 527126 - RNA, 19 nt, Human
aggcaaaacuaacuggucc

SEQ ID NO: 527127 - RNA, 18 nt, Human
aggggcccggccaggagg

SEQ ID NO: 527128 - RNA, 24 nt, Human
aggggcugggcuggcaaaagaggg

SEQ ID NO: 527129 - RNA, 18 nt, Human
aucuccgucaaacgucuc

SEQ ID NO: 527130 - RNA, 19 nt, Human
caaaacuaacugguccaca

SEQ ID NO: 527131 - RNA, 23 nt, Human
caaaaggcacccaucagagagac

SEQ ID NO: 527132 - RNA, 20 nt, Human
cacaggagaaaaugagagau

SEQ ID NO: 527133 - RNA, 18 nt, Human
cagggggcucuccuuccu

SEQ ID NO: 527134 - RNA, 19 nt, Human
ccccaggcccaagggucuc

SEQ ID NO: 527135 - RNA, 19 nt, Human
cccgcccccaggcccaagg

SEQ ID NO: 527136 - RNA, 25 nt, Human
ccgcccccaggcccaagggucuccc

SEQ ID NO: 527137 - RNA, 21 nt, Human
cgcccccaggcccaagggucu

SEQ ID NO: 527138 - RNA, 20 nt, Human
cggcccaggagcugcagcag

SEQ ID NO: 527139 - RNA, 24 nt, Human
cgggaggggacaggagcgcagggg

SEQ ID NO: 527140 - RNA, 20 nt, Human
cgggugaugaggaacgucac

SEQ ID NO: 527141 - RNA, 19 nt, Human
cguccacgaacauguagga

SEQ ID NO: 527142 - RNA, 23 nt, Human
cuauuccuggaacaaaggcaagc

SEQ ID NO: 527143 - RNA, 25 nt, Human
cuccagcgacgcgccgcgggguacc

SEQ ID NO: 527144 - RNA, 20 nt, Human
cucccauccaaagacccgcu

SEQ ID NO: 527145 - RNA, 24 nt, Human
gagcugcagcaggagccuggagcg

SEQ ID NO: 527146 - RNA, 18 nt, Human
gcagggcuggccccguga

SEQ ID NO: 527147 - RNA, 23 nt, Human
ggcaaaacuaacugguccacagg

SEQ ID NO: 527148 - RNA, 19 nt, Human
gggacaucgcggcggcucg

SEQ ID NO: 527149 - RNA, 19 nt, Human
ggggagggaggcgcggagg

SEQ ID NO: 527150 - RNA, 21 nt, Human
ggggagggaggcgcggaggga

SEQ ID NO: 527151 - RNA, 18 nt, Human
gggggagggaggcgcgga

SEQ ID NO: 527152 - RNA, 22 nt, Human
gggucucccggccuagaagucc

SEQ ID NO: 527153 - RNA, 20 nt, Human
gguaaucauugagcaggggg

SEQ ID NO: 527154 - RNA, 19 nt, Human
ggugaugaggaacgucacc

SEQ ID NO: 527155 - RNA, 23 nt, Human
guccuccucccauccaaagaccc

SEQ ID NO: 527156 - RNA, 20 nt, Human
uagagugcggcccaggagcu

SEQ ID NO: 527157 - RNA, 26 nt, Human
ucgagggggagggaggcgcggaggga

SEQ ID NO: 527158 - RNA, 24 nt, Human
ucguccuccucccauccaaagacc

SEQ ID NO: 527159 - RNA, 21 nt, Human
ucugcacgaugaacuccggga

SEQ ID NO: 527160 - RNA, 21 nt, Human
ugccaggcacacuuaagcccu

SEQ ID NO: 527161 - RNA, 23 nt, Human
uucaucagcugcacccgaccguc

SEQ ID NO: 527162 - RNA, 18 nt, Human
uuccuggaacaaaggcaa

SEQ ID NO: 527163 - RNA, 18 nt, Human
uugaacaaaaggcaccca

SEQ ID NO: 527164 - RNA, 18 nt, Human
aaguaugguuuauuacgg

SEQ ID NO: 527165 - RNA, 23 nt, Human
agaaaaauguuacuaauauccau

SEQ ID NO: 527166 - RNA, 20 nt, Human
aucaagaacuagcuaccagu

SEQ ID NO: 527167 - RNA, 21 nt, Human
caaaugguagaaaaauguuac

SEQ ID NO: 527168 - RNA, 23 nt, Human
caaugguuuuguccacaucuaga

SEQ ID NO: 527169 - RNA, 19 nt, Human
ccuucccgcggcuuucccu

SEQ ID NO: 527170 - RNA, 23 nt, Human
cuaaacacacaguuagcuuugcu

SEQ ID NO: 527171 - RNA, 19 nt, Human
cuggcugacaacgaagggg

SEQ ID NO: 527172 - RNA, 23 nt, Human
gagcuagucacuuuuccugccac

SEQ ID NO: 527173 - RNA, 18 nt, Human
uggcagccgggugggagc

SEQ ID NO: 527174 - RNA, 19 nt, Human
uuuguccacaucuagauug

SEQ ID NO: 527175 - RNA, 21 nt, Human
uuuuuuuuuuacgagcaagua

SEQ ID NO: 527176 - RNA, 18 nt, Human
aagggugcugggaggccu

SEQ ID NO: 527177 - RNA, 18 nt, Human
accuuacuuaucuaagac

SEQ ID NO: 527178 - RNA, 25 nt, Human
acgaaaucgucccccgcagaaaagc

SEQ ID NO: 527179 - RNA, 30 nt, Human
acuggcccuggcccuggagucugcucagcc

SEQ ID NO: 527180 - RNA, 19 nt, Human
agcaccagagggacagagc

SEQ ID NO: 527181 - RNA, 22 nt, Human
agccauagggugccagguagcc

SEQ ID NO: 527182 - RNA, 21 nt, Human
aggaggacggacacuagguug

SEQ ID NO: 527183 - RNA, 23 nt, Human
agggugcugggaggccuuaggca

SEQ ID NO: 527184 - RNA, 27 nt, Human
cacauggaccaaacgggaaaaucagga

SEQ ID NO: 527185 - RNA, 21 nt, Human
caccagccugccucugcagga

SEQ ID NO: 527186 - RNA, 28 nt, Human
caccucuggccucuaaggagaaaggccu

SEQ ID NO: 527187 - RNA, 19 nt, Human
cacuagcuggagggaggcc

SEQ ID NO: 527188 - RNA, 21 nt, Human
cagcagagggguguuuuccag

SEQ ID NO: 527189 - RNA, 18 nt, Human
cagcucccaccuucaucc

SEQ ID NO: 527190 - RNA, 25 nt, Human
cagcuuccuagagucugggucuggg

SEQ ID NO: 527191 - RNA, 24 nt, Human
caggacaagaggaccaagcugccc

SEQ ID NO: 527192 - RNA, 19 nt, Human
cagggcagcaccucuggcc

SEQ ID NO: 527193 - RNA, 19 nt, Human
caggucccccugcaccucc

SEQ ID NO: 527194 - RNA, 20 nt, Human
ccacagcaagccccgccaga

SEQ ID NO: 527195 - RNA, 18 nt, Human
ccaccccagaugauggca

SEQ ID NO: 527196 - RNA, 18 nt, Human
ccaccuguuguucccggg

SEQ ID NO: 527197 - RNA, 22 nt, Human
ccacucccauccauguuccagg

SEQ ID NO: 527198 - RNA, 22 nt, Human
ccagcuuccuagagucuggguc

SEQ ID NO: 527199 - RNA, 19 nt, Human
ccagguagcccggccaccc

SEQ ID NO: 527200 - RNA, 22 nt, Human
cccagggucacaccagccugcc

SEQ ID NO: 527201 - RNA, 21 nt, Human
ccccaaggggccucugcuucc

SEQ ID NO: 527202 - RNA, 19 nt, Human
cccccgcagaaaagccccu

SEQ ID NO: 527203 - RNA, 20 nt, Human
ccccgcguggccagucaggu

SEQ ID NO: 527204 - RNA, 19 nt, Human
ccccugcaccuccagcucc

SEQ ID NO: 527205 - RNA, 21 nt, Human
ccccugcaccuccagcuccca

SEQ ID NO: 527206 - RNA, 23 nt, Human
cccgccagagucugaagggccuc

SEQ ID NO: 527207 - RNA, 22 nt, Human
cccuggcccuggagucugcuca

SEQ ID NO: 527208 - RNA, 23 nt, Human
ccuccacugcccccgcguggcca

SEQ ID NO: 527209 - RNA, 19 nt, Human
ccugcaccuccagcuccca

SEQ ID NO: 527210 - RNA, 21 nt, Human
cgggaaaaucaggaaagcugg

SEQ ID NO: 527211 - RNA, 24 nt, Human
cucccaccuucaucccgacaucuc

SEQ ID NO: 527212 - RNA, 19 nt, Human
cugauggccugacgcucuc

SEQ ID NO: 527213 - RNA, 24 nt, Human
cuggaccaccuguuguucccgggu

SEQ ID NO: 527214 - RNA, 24 nt, Human
cuucacauggaccaaacgggaaaa

SEQ ID NO: 527215 - RNA, 26 nt, Human
gaagaugcccuacaagccuccugugg

SEQ ID NO: 527216 - RNA, 21 nt, Human
gaccaaacgggaaaaucagga

SEQ ID NO: 527217 - RNA, 20 nt, Human
gaggggagaagggaacuggc

SEQ ID NO: 527218 - RNA, 19 nt, Human
gaggggccaggccacacuc

SEQ ID NO: 527219 - RNA, 19 nt, Human
gauggagggugaggaacag

SEQ ID NO: 527220 - RNA, 19 nt, Human
gccucugcuuccucagugc

SEQ ID NO: 527221 - RNA, 21 nt, Human
gcuuccucagugcccccugag

SEQ ID NO: 527222 - RNA, 23 nt, Human
gggcacccccaaggggccucugc

SEQ ID NO: 527223 - RNA, 18 nt, Human
gucugcucagccacacca

SEQ ID NO: 527224 - RNA, 25 nt, Human
guuccaggucccccugcaccuccag

SEQ ID NO: 527225 - RNA, 18 nt, Human
uauacugaggcauguuuu

SEQ ID NO: 527226 - RNA, 24 nt, Human
ucacucccagccagggcagcaccu

SEQ ID NO: 527227 - RNA, 21 nt, Human
uccacucccauccauguucca

SEQ ID NO: 527228 - RNA, 22 nt, Human
ucccagggucacaccagccugc

SEQ ID NO: 527229 - RNA, 18 nt, Human
ucccccgcagaaaagccc

SEQ ID NO: 527230 - RNA, 21 nt, Human
ucccccugcaccuccagcucc

SEQ ID NO: 527231 - RNA, 24 nt, Human
uccucagugcccccugagcuuuau

SEQ ID NO: 527232 - RNA, 18 nt, Human
ugcagcugcucccagaga

SEQ ID NO: 527233 - RNA, 22 nt, Human
ugccagguagcccggccacccu

SEQ ID NO: 527234 - RNA, 24 nt, Human
ugccuuuaaacucaagacuggcuc

SEQ ID NO: 527235 - RNA, 18 nt, Human
ugcugggaggccuuaggc

SEQ ID NO: 527236 - RNA, 23 nt, Human
uggaagaugcccuacaagccucc

SEQ ID NO: 527237 - RNA, 20 nt, Human
uggcagggcaaggaagacug

SEQ ID NO: 527238 - RNA, 24 nt, Human
uggcccuggcccuggagucugcuc

SEQ ID NO: 527239 - RNA, 20 nt, Human
ugggccaggagcacucuccc

SEQ ID NO: 527240 - RNA, 22 nt, Human
ugggccaggagcacucucccag

SEQ ID NO: 527241 - RNA, 23 nt, Human
ugggucuggguuuggccgggagg

SEQ ID NO: 527242 - RNA, 28 nt, Human
ugggucuggguuuggccgggaggggaga

SEQ ID NO: 527243 - RNA, 25 nt, Human
uguccacucccauccauguuccagg

SEQ ID NO: 527244 - RNA, 18 nt, Human
ugugaggcuggggcucgu

SEQ ID NO: 527245 - RNA, 19 nt, Human
uucacaugcagucugcugu

SEQ ID NO: 527246 - RNA, 21 nt, Human
uucaucccgacaucucccaug

SEQ ID NO: 527247 - RNA, 21 nt, Human
uuccaggucccccugcaccuc

SEQ ID NO: 527248 - RNA, 18 nt, Human
uucccgggucaaguuccc

SEQ ID NO: 527249 - RNA, 22 nt, Human
uuugaaguguaugggcccaaca

SEQ ID NO: 527250 - RNA, 24 nt, Human
uuuuuuuuuuuuuuuuuucguuuu

SEQ ID NO: 527251 - RNA, 26 nt, Human
uuuuuuuuuuuuuuuuuuuuucgggg

SEQ ID NO: 527252 - RNA, 21 nt, Human
aaacaaauuucaaagacuugg

SEQ ID NO: 527253 - RNA, 18 nt, Human
aaaggaaacaaauuucaa

SEQ ID NO: 527254 - RNA, 22 nt, Human
aacccgaagcgugcaccccacu

SEQ ID NO: 527255 - RNA, 21 nt, Human
aacugcacagacgccagccuc

SEQ ID NO: 527256 - RNA, 18 nt, Human
aagguggguggaagggcc

SEQ ID NO: 527257 - RNA, 24 nt, Human
aauggacgaggucugcauacugag

SEQ ID NO: 527258 - RNA, 20 nt, Human
acaauggcccugccuccccc

SEQ ID NO: 527259 - RNA, 18 nt, Human
accccacuuccggcccca

SEQ ID NO: 527260 - RNA, 21 nt, Human
acugccagggagguggaaaca

SEQ ID NO: 527261 - RNA, 23 nt, Human
aggcagaaccuggugcaaaugga

SEQ ID NO: 527262 - RNA, 18 nt, Human
agggccaggggccuugaa

SEQ ID NO: 527263 - RNA, 20 nt, Human
agguggguggaagggccagg

SEQ ID NO: 527264 - RNA, 22 nt, Human
caacacaauggcccugccuccc

SEQ ID NO: 527265 - RNA, 21 nt, Human
cacaccagcccagcccagccc

SEQ ID NO: 527266 - RNA, 24 nt, Human
caccaacccgaagcgugcacccca

SEQ ID NO: 527267 - RNA, 21 nt, Human
cacuuccggccccagaaugcc

SEQ ID NO: 527268 - RNA, 20 nt, Human
cagcagccacaccagcccag

SEQ ID NO: 527269 - RNA, 19 nt, Human
cagcagcccacaguugugg

SEQ ID NO: 527270 - RNA, 20 nt, Human
cagccacaccagcccagccc

SEQ ID NO: 527271 - RNA, 18 nt, Human
cagccucuaggccugacu

SEQ ID NO: 527272 - RNA, 19 nt, Human
cccagaaugccgcgcggcu

SEQ ID NO: 527273 - RNA, 24 nt, Human
cccggcagccccuacaggcccccc

SEQ ID NO: 527274 - RNA, 22 nt, Human
cccgugucuacugccuccccca

SEQ ID NO: 527275 - RNA, 21 nt, Human
ccgaagcgugcaccccacuuc

SEQ ID NO: 527276 - RNA, 18 nt, Human
ccuacaggccccccagau

SEQ ID NO: 527277 - RNA, 19 nt, Human
ccuacaggccccccagaug

SEQ ID NO: 527278 - RNA, 23 nt, Human
ccuacaggccccccagaugggcu

SEQ ID NO: 527279 - RNA, 22 nt, Human
cgugcaccccacuuccggcccc

SEQ ID NO: 527280 - RNA, 21 nt, Human
cuccccccgcuuuauuucuuu

SEQ ID NO: 527281 - RNA, 21 nt, Human
gaagccuuccccuggaacugg

SEQ ID NO: 527282 - RNA, 18 nt, Human
gaagcgugcaccccacuu

SEQ ID NO: 527283 - RNA, 19 nt, Human
gagggcaaaggugggugga

SEQ ID NO: 527284 - RNA, 22 nt, Human
gagggcaaagguggguggaagg

SEQ ID NO: 527285 - RNA, 22 nt, Human
gagugaaggcagaaccuggugc

SEQ ID NO: 527286 - RNA, 24 nt, Human
gccuugaagccuuccccuggaacu

SEQ ID NO: 527287 - RNA, 23 nt, Human
gcuucagcagccacaccagccca

SEQ ID NO: 527288 - RNA, 19 nt, Human
ggaagggccaggggccuug

SEQ ID NO: 527289 - RNA, 21 nt, Human
uacugccucccccaacugcac

SEQ ID NO: 527290 - RNA, 20 nt, Human
ucaaaggaaaggaaacaaau

SEQ ID NO: 527291 - RNA, 25 nt, Human
ucucgauacguuuggucuuucaugc

SEQ ID NO: 527292 - RNA, 20 nt, Human
ugacuucagcagcccacagu

SEQ ID NO: 527293 - RNA, 23 nt, Human
uggaaacacuggccaccagcccg

SEQ ID NO: 527294 - RNA, 25 nt, Human
ugucccgugucuacugccuccccca

SEQ ID NO: 527295 - RNA, 30 nt, Human
uucaaaggaaaggaaacaaauuucaaagaa

SEQ ID NO: 527296 - RNA, 18 nt, Human
uuccggccccagaaugcc

SEQ ID NO: 527297 - RNA, 23 nt, Human
agaggugccagcagccccacagg

SEQ ID NO: 527298 - RNA, 20 nt, Human
agcagcuacauagggucaac

SEQ ID NO: 527299 - RNA, 21 nt, Human
agcaggugguggugaagggac

SEQ ID NO: 527300 - RNA, 20 nt, Human
agcccucucccugccugagg

SEQ ID NO: 527301 - RNA, 18 nt, Human
agcuauggaauagaagca

SEQ ID NO: 527302 - RNA, 18 nt, Human
agcuguaaugaccuugcg

SEQ ID NO: 527303 - RNA, 21 nt, Human
aggaagugguggaggggaggc

SEQ ID NO: 527304 - RNA, 22 nt, Human
aggaagugguggaggggaggcu

SEQ ID NO: 527305 - RNA, 22 nt, Human
aggcugccaaugacugcagcug

SEQ ID NO: 527306 - RNA, 18 nt, Human
aggugguggugaagggac

SEQ ID NO: 527307 - RNA, 22 nt, Human
aggugguggugaagggacuggg

SEQ ID NO: 527308 - RNA, 24 nt, Human
aggugguggugaagggacuggggu

SEQ ID NO: 527309 - RNA, 20 nt, Human
caagcaauagccccgcacau

SEQ ID NO: 527310 - RNA, 20 nt, Human
caagucccugaaauccaggg

SEQ ID NO: 527311 - RNA, 23 nt, Human
cacagucccaugagccgucacag

SEQ ID NO: 527312 - RNA, 24 nt, Human
cacuucucgucccggcaucggaaa

SEQ ID NO: 527313 - RNA, 20 nt, Human
cagagccuaagccacagggu

SEQ ID NO: 527314 - RNA, 22 nt, Human
cagcccagggcgaugaccagga

SEQ ID NO: 527315 - RNA, 24 nt, Human
cagggaaggaagugguggagggga

SEQ ID NO: 527316 - RNA, 20 nt, Human
cccacucaucacugccgucc

SEQ ID NO: 527317 - RNA, 18 nt, Human
cccaggccagagccuaag

SEQ ID NO: 527318 - RNA, 21 nt, Human
ccguccgcacagucuggcugc

SEQ ID NO: 527319 - RNA, 19 nt, Human
ccugagggacacuuaacuu

SEQ ID NO: 527320 - RNA, 23 nt, Human
ccuucgccagcucccaggccaga

SEQ ID NO: 527321 - RNA, 25 nt, Human
cgcacacccacgucucauacacgca

SEQ ID NO: 527322 - RNA, 22 nt, Human
cggcaucggaaauugccaggcu

SEQ ID NO: 527323 - RNA, 19 nt, Human
cgggagaggggggcaaagg

SEQ ID NO: 527324 - RNA, 19 nt, Human
cuaguuaauuggcauuccg

SEQ ID NO: 527325 - RNA, 24 nt, Human
cucuaagaacuuuacuuuuuaaaa

SEQ ID NO: 527326 - RNA, 24 nt, Human
cuggcaaugccgacagcgucucuc

SEQ ID NO: 527327 - RNA, 18 nt, Human
cugguaguugcagcgguc

SEQ ID NO: 527328 - RNA, 18 nt, Human
gaaauugccaggcuggca

SEQ ID NO: 527329 - RNA, 20 nt, Human
gaaggaagugguggagggga

SEQ ID NO: 527330 - RNA, 19 nt, Human
gagcuugcaggugcagccc

SEQ ID NO: 527331 - RNA, 18 nt, Human
gcaaagaugcuguacucc

SEQ ID NO: 527332 - RNA, 19 nt, Human
gcacacccacgucucauac

SEQ ID NO: 527333 - RNA, 25 nt, Human
gccgcacacuaggcugccaaugacu

SEQ ID NO: 527334 - RNA, 18 nt, Human
ggaaggaagugguggagg

SEQ ID NO: 527335 - RNA, 18 nt, Human
ggacacuuaacuuuauag

SEQ ID NO: 527336 - RNA, 21 nt, Human
ggagaggggggcaaagaugcu

SEQ ID NO: 527337 - RNA, 19 nt, Human
ggcugcccaucgcacaccc

SEQ ID NO: 527338 - RNA, 19 nt, Human
gggaaggaagugguggagg

SEQ ID NO: 527339 - RNA, 23 nt, Human
ggucagcaggcagguagcaggcu

SEQ ID NO: 527340 - RNA, 21 nt, Human
ggucugucccaaggcaagcaa

SEQ ID NO: 527341 - RNA, 19 nt, Human
guagguggcauugaagccu

SEQ ID NO: 527342 - RNA, 21 nt, Human
guaguugcagcggucagcagg

SEQ ID NO: 527343 - RNA, 21 nt, Human
gugguggugaagggacugggg

SEQ ID NO: 527344 - RNA, 20 nt, Human
uagaagcauuuguugcacuc

SEQ ID NO: 527345 - RNA, 18 nt, Human
uagagcccccaggucccc

SEQ ID NO: 527346 - RNA, 22 nt, Human
uagcagcgcucaccuaggccuc

SEQ ID NO: 527347 - RNA, 21 nt, Human
uaggagcagucccacucauca

SEQ ID NO: 527348 - RNA, 21 nt, Human
uaggagggauuguggauggca

SEQ ID NO: 527349 - RNA, 27 nt, Human
ucacuguagcagcgcucaccuaggccu

SEQ ID NO: 527350 - RNA, 22 nt, Human
ucauacacgcacuucucguccc

SEQ ID NO: 527351 - RNA, 18 nt, Human
uccaggugggcagccugg

SEQ ID NO: 527352 - RNA, 19 nt, Human
uccaggugggcagccuggg

SEQ ID NO: 527353 - RNA, 21 nt, Human
ucccugaaauccagggacagg

SEQ ID NO: 527354 - RNA, 20 nt, Human
ucgccagcucccaggccaga

SEQ ID NO: 527355 - RNA, 19 nt, Human
ucugcccaaauccuccccu

SEQ ID NO: 527356 - RNA, 19 nt, Human
ugaccaggagcaggccgca

SEQ ID NO: 527357 - RNA, 21 nt, Human
ugaccaggagcaggccgcaca

SEQ ID NO: 527358 - RNA, 28 nt, Human
ugagggacacuuaacuuuauagcagcua

SEQ ID NO: 527359 - RNA, 24 nt, Human
ugcccaaauccuccccuugggggc

SEQ ID NO: 527360 - RNA, 24 nt, Human
ugccguagcuauggaauagaagca

SEQ ID NO: 527361 - RNA, 21 nt, Human
uggcaaugccgacagcgucuc

SEQ ID NO: 527362 - RNA, 18 nt, Human
uggcauugaagccucgug

SEQ ID NO: 527363 - RNA, 24 nt, Human
uggcguggggagcaggugguggug

SEQ ID NO: 527364 - RNA, 24 nt, Human
ugggcagccugggcaguccuccuc

SEQ ID NO: 527365 - RNA, 19 nt, Human
ugguagguggcauugaagc

SEQ ID NO: 527366 - RNA, 24 nt, Human
ugguggcguggggagcagguggug

SEQ ID NO: 527367 - RNA, 20 nt, Human
ugucccaaggcaagcaauag

SEQ ID NO: 527368 - RNA, 22 nt, Human
ugugagcccucucccugccuga

SEQ ID NO: 527369 - RNA, 23 nt, Human
uguggauggcaaaaccucagguu

SEQ ID NO: 527370 - RNA, 23 nt, Human
uuaaaaacagccacccaaauggu

SEQ ID NO: 527371 - RNA, 23 nt, Human
uuacuuuuuaaaaacagccaccc

SEQ ID NO: 527372 - RNA, 22 nt, Human
uugcaggugcagcccagggcga

SEQ ID NO: 527373 - RNA, 21 nt, Human
uugggggcuggagggucucua

SEQ ID NO: 527374 - RNA, 22 nt, Human
uugggggcuggagggucucuag

SEQ ID NO: 527375 - RNA, 25 nt, Human
uuuggcaaggauggaguguccagac

SEQ ID NO: 527376 - RNA, 22 nt, Human
uuuuuugagauguaugauuccu

SEQ ID NO: 527377 - RNA, 18 nt, Human
uuuuuuuuuuuuuuuuug

SEQ ID NO: 527378 - RNA, 18 nt, Human
aaaaagacagcaggaauc

SEQ ID NO: 527379 - RNA, 24 nt, Human
aaaccagaccaaaccaaaucaaaa

SEQ ID NO: 527380 - RNA, 21 nt, Human
aaagcagaaccccaccgcgga

SEQ ID NO: 527381 - RNA, 25 nt, Human
aaaggaagagggaaaucggcaggag

SEQ ID NO: 527382 - RNA, 22 nt, Human
aaccaaaucaaaauagcccauu

SEQ ID NO: 527383 - RNA, 21 nt, Human
aagaaaagcagaaccccaccg

SEQ ID NO: 527384 - RNA, 19 nt, Human
aagcaggauccccacugcg

SEQ ID NO: 527385 - RNA, 23 nt, Human
acccucacccuggccuccucgcg

SEQ ID NO: 527386 - RNA, 20 nt, Human
acuuucuauuucguuaauga

SEQ ID NO: 527387 - RNA, 24 nt, Human
agaaaagcagaaccccaccgcgga

SEQ ID NO: 527388 - RNA, 22 nt, Human
agacagcaggaaucagguagcc

SEQ ID NO: 527389 - RNA, 19 nt, Human
agaccaaaccaaaucaaaa

SEQ ID NO: 527390 - RNA, 20 nt, Human
agaccaaaccaaaucaaaau

SEQ ID NO: 527391 - RNA, 21 nt, Human
agcagggaggaacuuggaggu

SEQ ID NO: 527392 - RNA, 21 nt, Human
aggaacuguaggaggaagggg

SEQ ID NO: 527393 - RNA, 22 nt, Human
agggaguacgcggguggggugg

SEQ ID NO: 527394 - RNA, 22 nt, Human
aggggcugcagcgaagaggaga

SEQ ID NO: 527395 - RNA, 19 nt, Human
aggucucagagaaggaucu

SEQ ID NO: 527396 - RNA, 18 nt, Human
aucuaggguucguucuuc

SEQ ID NO: 527397 - RNA, 25 nt, Human
caaaccaaaucaaaauagcccauua

SEQ ID NO: 527398 - RNA, 25 nt, Human
caaaccagaccaaaccaaaucaaaa

SEQ ID NO: 527399 - RNA, 21 nt, Human
cacagcucguugaucccaaaa

SEQ ID NO: 527400 - RNA, 18 nt, Human
cacccucacccuggccuc

SEQ ID NO: 527401 - RNA, 22 nt, Human
caccuggcguagaaaaagacag

SEQ ID NO: 527402 - RNA, 19 nt, Human
caccuuauccccuccaaga

SEQ ID NO: 527403 - RNA, 27 nt, Human
caccuuauccccuccaagagucuccca

SEQ ID NO: 527404 - RNA, 19 nt, Human
cagagcagggaggaacuug

SEQ ID NO: 527405 - RNA, 22 nt, Human
cagcaggaaucagguagccaaa

SEQ ID NO: 527406 - RNA, 23 nt, Human
cagguagccaaaccagaccaaac

SEQ ID NO: 527407 - RNA, 23 nt, Human
cauaccaggcgcuggcagcauga

SEQ ID NO: 527408 - RNA, 24 nt, Human
cauuguacugccgcaagcgcugcg

SEQ ID NO: 527409 - RNA, 18 nt, Human
ccaauccgauugucuucu

SEQ ID NO: 527410 - RNA, 19 nt, Human
ccagaccaaaccaaaucaa

SEQ ID NO: 527411 - RNA, 18 nt, Human
cccaccuuauccccucca

SEQ ID NO: 527412 - RNA, 19 nt, Human
ccccaccuuauccccucca

SEQ ID NO: 527413 - RNA, 20 nt, Human
ccccaccuuauccccuccaa

SEQ ID NO: 527414 - RNA, 19 nt, Human
ccgggccccaccuuauccc

SEQ ID NO: 527415 - RNA, 20 nt, Human
ccgugagugggcggcgcguc

SEQ ID NO: 527416 - RNA, 23 nt, Human
ccucacccuggccuccucgcggc

SEQ ID NO: 527417 - RNA, 22 nt, Human
ccucacuagguggcucucuuug

SEQ ID NO: 527418 - RNA, 21 nt, Human
cggcaggcucgcgacagcuag

SEQ ID NO: 527419 - RNA, 21 nt, Human
gaaaaagacagcaggaaucag

SEQ ID NO: 527420 - RNA, 23 nt, Human
gauagcuccuuaagugacuccac

SEQ ID NO: 527421 - RNA, 24 nt, Human
gccaagcgccaccagccggucucu

SEQ ID NO: 527422 - RNA, 25 nt, Human
ggaggcgugcaaaaaggaagaggga

SEQ ID NO: 527423 - RNA, 21 nt, Human
ggagggaguacgcgggugggg

SEQ ID NO: 527424 - RNA, 25 nt, Human
ggcguugagggacugcugggaggaa

SEQ ID NO: 527425 - RNA, 23 nt, Human
gggaggggcugcagcgaagagga

SEQ ID NO: 527426 - RNA, 23 nt, Human
gggcggggcgggugauugggggc

SEQ ID NO: 527427 - RNA, 24 nt, Human
ggggaggggcugcagcgaagagga

SEQ ID NO: 527428 - RNA, 24 nt, Human
ggggcggggcgggugauugggggc

SEQ ID NO: 527429 - RNA, 24 nt, Human
ggggugccuaucagagugauggcg

SEQ ID NO: 527430 - RNA, 21 nt, Human
gggguggauuugggggagggg

SEQ ID NO: 527431 - RNA, 23 nt, Human
guagaaagaaaagcagaacccca

SEQ ID NO: 527432 - RNA, 18 nt, Human
gucacgccgcaccauacc

SEQ ID NO: 527433 - RNA, 30 nt, Human
gucuuuaaauuaaaaaaaaaaaagaaaaaa

SEQ ID NO: 527434 - RNA, 25 nt, Human
uaaaaaaucuaaccaauacacgauc

SEQ ID NO: 527435 - RNA, 24 nt, Human
uaaaacacugcagacccgugagaa

SEQ ID NO: 527436 - RNA, 22 nt, Human
uagaaagaaaagcagaacccca

SEQ ID NO: 527437 - RNA, 23 nt, Human
uagaaagaaaagcagaaccccac

SEQ ID NO: 527438 - RNA, 21 nt, Human
uagguggcucucuuugccgug

SEQ ID NO: 527439 - RNA, 23 nt, Human
uauuggugcaggucucagagaag

SEQ ID NO: 527440 - RNA, 18 nt, Human
ucaccuggcguagaaaaa

SEQ ID NO: 527441 - RNA, 18 nt, Human
ucagagugauggcgcuag

SEQ ID NO: 527442 - RNA, 22 nt, Human
uccgggccccaccuuauccccu

SEQ ID NO: 527443 - RNA, 20 nt, Human
ucuguccuuggaauuuauuu

SEQ ID NO: 527444 - RNA, 20 nt, Human
ucuuuauuucagcuuuuugg

SEQ ID NO: 527445 - RNA, 18 nt, Human
ugagaagagaaagguugc

SEQ ID NO: 527446 - RNA, 20 nt, Human
ugcaaaaaggaagagggaaa

SEQ ID NO: 527447 - RNA, 20 nt, Human
ugcaaaaaggaagagggaaa

SEQ ID NO: 527448 - RNA, 20 nt, Human
uggcagcaugaggggcauag

SEQ ID NO: 527449 - RNA, 21 nt, Human
uggcguagaaaaagacagcag

SEQ ID NO: 527450 - RNA, 22 nt, Human
uucaccuggcguagaaaaagac

SEQ ID NO: 527451 - RNA, 25 nt, Human
uuuccagcuauuucucauacacuuc

SEQ ID NO: 527452 - RNA, 20 nt, Human
agggauuuucagaaaaaggc

SEQ ID NO: 527453 - RNA, 21 nt, Human
caccagaaaaagggauuuuca

SEQ ID NO: 527454 - RNA, 18 nt, Human
uccaccagaaaaagggau

SEQ ID NO: 527455 - RNA, 23 nt, Human
ucugcgguuugggaagugcuggu

SEQ ID NO: 527456 - RNA, 19 nt, Human
uuuucagaaaaaggcacag

SEQ ID NO: 527457 - RNA, 23 nt, Human
uuuuuuuuuuuuuuuuccaccag

SEQ ID NO: 527458 - RNA, 25 nt, Human
uuuuuuuuuuuuuuuuuuccaccag

SEQ ID NO: 527459 - RNA, 23 nt, Human
uuuuuuuuuuuuuuuuuuuucca

SEQ ID NO: 527460 - RNA, 25 nt, Human
aaaauuacagaugccaguggaucca

SEQ ID NO: 527461 - RNA, 22 nt, Human
aaagaaaaauucugaauuucac

SEQ ID NO: 527462 - RNA, 23 nt, Human
aaagcucucccauaucucagacu

SEQ ID NO: 527463 - RNA, 18 nt, Human
aaauagcuuccugauuga

SEQ ID NO: 527464 - RNA, 24 nt, Human
aacccuugaccuuaucaaugaccu

SEQ ID NO: 527465 - RNA, 24 nt, Human
aauauuuuuauagaaguugucuga

SEQ ID NO: 527466 - RNA, 22 nt, Human
acccucccccgugaaagccaag

SEQ ID NO: 527467 - RNA, 19 nt, Human
acuagcuauugcagaccca

SEQ ID NO: 527468 - RNA, 18 nt, Human
acuccaaagugugugaag

SEQ ID NO: 527469 - RNA, 20 nt, Human
acuccaucaucuaagaacaa

SEQ ID NO: 527470 - RNA, 19 nt, Human
agaaagaagaugcagaaaa

SEQ ID NO: 527471 - RNA, 24 nt, Human
agaaccugauacuucccagauaac

SEQ ID NO: 527472 - RNA, 18 nt, Human
agagcaaaugugaaaaag

SEQ ID NO: 527473 - RNA, 18 nt, Human
agaucccagaaggcacag

SEQ ID NO: 527474 - RNA, 21 nt, Human
agaugccaguggauccacuug

SEQ ID NO: 527475 - RNA, 18 nt, Human
agcaagcaagcauuacuc

SEQ ID NO: 527476 - RNA, 22 nt, Human
aggccucuagguuccagguucu

SEQ ID NO: 527477 - RNA, 19 nt, Human
agguuccagguucuggacu

SEQ ID NO: 527478 - RNA, 20 nt, Human
agguuuguaugcagcagccu

SEQ ID NO: 527479 - RNA, 21 nt, Human
auacagaaucuucuggacuua

SEQ ID NO: 527480 - RNA, 22 nt, Human
auggaacaguaauaaaaaaccc

SEQ ID NO: 527481 - RNA, 24 nt, Human
auggaagaaauauauuaaaaagaa

SEQ ID NO: 527482 - RNA, 21 nt, Human
auucauuagcaagcaagcauu

SEQ ID NO: 527483 - RNA, 26 nt, Human
caaaauggaacaguaauaaaaaaccc

SEQ ID NO: 527484 - RNA, 24 nt, Human
cacagaugggaugaugcacuuccu

SEQ ID NO: 527485 - RNA, 20 nt, Human
cagauucuggauaguaaugu

SEQ ID NO: 527486 - RNA, 25 nt, Human
cagccugauccauaaauaauacacc

SEQ ID NO: 527487 - RNA, 26 nt, Human
cagccugauccauaaauaauacaccu

SEQ ID NO: 527488 - RNA, 20 nt, Human
caggauguugcaaaauggaa

SEQ ID NO: 527489 - RNA, 19 nt, Human
caguggauccacuuguccu

SEQ ID NO: 527490 - RNA, 26 nt, Human
cauccugacguguuccauccuccaaa

SEQ ID NO: 527491 - RNA, 18 nt, Human
caucugcuggagccaggc

SEQ ID NO: 527492 - RNA, 23 nt, Human
cauuagcaagcaagcauuacuca

SEQ ID NO: 527493 - RNA, 22 nt, Human
ccagaaccugauacuucccaga

SEQ ID NO: 527494 - RNA, 18 nt, Human
ccagaaugucuccuuuuc

SEQ ID NO: 527495 - RNA, 25 nt, Human
ccagagcaaaugugaaaaagcacag

SEQ ID NO: 527496 - RNA, 21 nt, Human
ccaucuaucuugccagaccuc

SEQ ID NO: 527497 - RNA, 24 nt, Human
ccaucuggaaauacgauucauuau

SEQ ID NO: 527498 - RNA, 23 nt, Human
cccagaaccugauacuucccaga

SEQ ID NO: 527499 - RNA, 18 nt, Human
ccgaguuguaauauucac

SEQ ID NO: 527500 - RNA, 20 nt, Human
ccucauuaucucaucaucug

SEQ ID NO: 527501 - RNA, 21 nt, Human
ccugauccauaaauaauacac

SEQ ID NO: 527502 - RNA, 20 nt, Human
cgugcagagagaaaggccuc

SEQ ID NO: 527503 - RNA, 23 nt, Human
cuaaaagcucucccauaucucag

SEQ ID NO: 527504 - RNA, 24 nt, Human
cucccagaaccugauacuucccag

SEQ ID NO: 527505 - RNA, 21 nt, Human
cucugugugcaacacauccug

SEQ ID NO: 527506 - RNA, 21 nt, Human
cugaauacaacccucccccgu

SEQ ID NO: 527507 - RNA, 23 nt, Human
cugaaucucugugugcaacacau

SEQ ID NO: 527508 - RNA, 23 nt, Human
cugacacacaaguaguuuuuaga

SEQ ID NO: 527509 - RNA, 23 nt, Human
cuuaaagucuccaaagcaaggac

SEQ ID NO: 527510 - RNA, 22 nt, Human
cuuaaugcuguugccucccaga

SEQ ID NO: 527511 - RNA, 22 nt, Human
cuuguccacucucaaaauccag

SEQ ID NO: 527512 - RNA, 23 nt, Human
gaacaaaacucucaauggggaaa

SEQ ID NO: 527513 - RNA, 19 nt, Human
gauguugcaaaauggaaca

SEQ ID NO: 527514 - RNA, 22 nt, Human
ggaagaaauauauuaaaaagaa

SEQ ID NO: 527515 - RNA, 20 nt, Human
gugcuguggcugaagguguc

SEQ ID NO: 527516 - RNA, 24 nt, Human
uaaagacauuaaaacuuugugcug

SEQ ID NO: 527517 - RNA, 19 nt, Human
uaauuugaaugucuccccu

SEQ ID NO: 527518 - RNA, 25 nt, Human
uaucucagacugcaaacuaccuguu

SEQ ID NO: 527519 - RNA, 23 nt, Human
ucaaaauccaucuggaaauacga

SEQ ID NO: 527520 - RNA, 19 nt, Human
ucagaagaugacucaagca

SEQ ID NO: 527521 - RNA, 19 nt, Human
uccacuuguccacucucaa

SEQ ID NO: 527522 - RNA, 24 nt, Human
uccauccuccaaaacuuucuuguu

SEQ ID NO: 527523 - RNA, 22 nt, Human
ucccagauaacccagagcaaau

SEQ ID NO: 527524 - RNA, 18 nt, Human
ucccccgugaaagccaag

SEQ ID NO: 527525 - RNA, 20 nt, Human
ucucagacugcaaacuaccu

SEQ ID NO: 527526 - RNA, 18 nt, Human
ucuccaaagcaaggacag

SEQ ID NO: 527527 - RNA, 21 nt, Human
ucugcuggagccaggcaaaua

SEQ ID NO: 527528 - RNA, 21 nt, Human
ucugugugcaacacauccuga

SEQ ID NO: 527529 - RNA, 21 nt, Human
ucuugucucccaggauggugu

SEQ ID NO: 527530 - RNA, 19 nt, Human
ugaaaaagcacagcaugca

SEQ ID NO: 527531 - RNA, 20 nt, Human
ugacaugauaauauuuuuau

SEQ ID NO: 527532 - RNA, 19 nt, Human
ugccuuuaagcagauuggc

SEQ ID NO: 527533 - RNA, 24 nt, Human
uggaacaguaauaaaaaacccacu

SEQ ID NO: 527534 - RNA, 19 nt, Human
uggacagggaugauugaug

SEQ ID NO: 527535 - RNA, 21 nt, Human
ugguguugcaggauguugcaa

SEQ ID NO: 527536 - RNA, 23 nt, Human
uguccacucucaaaauccaucug

SEQ ID NO: 527537 - RNA, 24 nt, Human
ugucuuaaagucuccaaagcaagg

SEQ ID NO: 527538 - RNA, 20 nt, Human
ugugugaagugguuacacag

SEQ ID NO: 527539 - RNA, 26 nt, Human
ugugugcaacacauccugacguggug

SEQ ID NO: 527540 - RNA, 23 nt, Human
uuaaagcuucagaagaugacuca

SEQ ID NO: 527541 - RNA, 23 nt, Human
uuccugaguucuuguauguuuga

SEQ ID NO: 527542 - RNA, 22 nt, Human
uuccuuggaacaaaacucucaa

SEQ ID NO: 527543 - RNA, 26 nt, Human
uucuguggcuacugagucauguuacu

SEQ ID NO: 527544 - RNA, 19 nt, Human
aaaaaaaucuggaaccaaa

SEQ ID NO: 527545 - RNA, 21 nt, Human
aaaacucuuuauuguccugcc

SEQ ID NO: 527546 - RNA, 22 nt, Human
aaaacucuuuauuguccugccc

SEQ ID NO: 527547 - RNA, 23 nt, Human
aaggggcuuccagggccggaguc

SEQ ID NO: 527548 - RNA, 18 nt, Human
acccuggugggugugggg

SEQ ID NO: 527549 - RNA, 23 nt, Human
agaaaaaaaucuggaaccaaaag

SEQ ID NO: 527550 - RNA, 21 nt, Human
agagcaggggggcgaggcggg

SEQ ID NO: 527551 - RNA, 23 nt, Human
agccaucaccagcaugaggucca

SEQ ID NO: 527552 - RNA, 25 nt, Human
aggagaaaaaaaucuggaaccaaaa

SEQ ID NO: 527553 - RNA, 20 nt, Human
aggaggggacagggugcuuc

SEQ ID NO: 527554 - RNA, 20 nt, Human
aggcaggaccccagcaggug

SEQ ID NO: 527555 - RNA, 18 nt, Human
agggacccagccagcccc

SEQ ID NO: 527556 - RNA, 21 nt, Human
agguccacucaccucucuggc

SEQ ID NO: 527557 - RNA, 21 nt, Human
aggugggggacagccccuuca

SEQ ID NO: 527558 - RNA, 21 nt, Human
auccugccagccccgaccccc

SEQ ID NO: 527559 - RNA, 26 nt, Human
caacagaagaacaaaggggcuuccag

SEQ ID NO: 527560 - RNA, 18 nt, Human
cacaacagcaggcccaac

SEQ ID NO: 527561 - RNA, 21 nt, Human
caccagcaugagguccacacc

SEQ ID NO: 527562 - RNA, 22 nt, Human
caccuugacaggugagcccaaa

SEQ ID NO: 527563 - RNA, 21 nt, Human
cacugcucugucuacacgguu

SEQ ID NO: 527564 - RNA, 18 nt, Human
cacuggcugugcuggcag

SEQ ID NO: 527565 - RNA, 23 nt, Human
cacuugucagguccacucaccuc

SEQ ID NO: 527566 - RNA, 22 nt, Human
cagcaggugguggcgggagcag

SEQ ID NO: 527567 - RNA, 20 nt, Human
cagccccgacccccggucca

SEQ ID NO: 527568 - RNA, 26 nt, Human
cagccccgacccccgguccacaacag

SEQ ID NO: 527569 - RNA, 20 nt, Human
cagcugccggcaggagucug

SEQ ID NO: 527570 - RNA, 20 nt, Human
cagggagacaacaaaccccc

SEQ ID NO: 527571 - RNA, 19 nt, Human
cauccugccagccccgacc

SEQ ID NO: 527572 - RNA, 23 nt, Human
ccaaauguccuccucuccccaua

SEQ ID NO: 527573 - RNA, 20 nt, Human
ccacagagcaggggggcgag

SEQ ID NO: 527574 - RNA, 18 nt, Human
ccacucaccucucuggcc

SEQ ID NO: 527575 - RNA, 22 nt, Human
ccagcaggugguggcgggagca

SEQ ID NO: 527576 - RNA, 24 nt, Human
ccagcucuggucccagggccaccu

SEQ ID NO: 527577 - RNA, 21 nt, Human
ccauccugccagccccgaccc

SEQ ID NO: 527578 - RNA, 19 nt, Human
cccaaauguccuccucucc

SEQ ID NO: 527579 - RNA, 25 nt, Human
cccaaauguccuccucuccccauac

SEQ ID NO: 527580 - RNA, 24 nt, Human
cccauacugggcacugggcugagg

SEQ ID NO: 527581 - RNA, 22 nt, Human
ccccacuucaugcugguccuca

SEQ ID NO: 527582 - RNA, 19 nt, Human
ccccagggcagcugccggc

SEQ ID NO: 527583 - RNA, 23 nt, Human
ccccagggcagcugccggcaggg

SEQ ID NO: 527584 - RNA, 20 nt, Human
ccccaugcugggaccagcuc

SEQ ID NO: 527585 - RNA, 18 nt, Human
ccucgggacccugguggg

SEQ ID NO: 527586 - RNA, 21 nt, Human
ccucgggacccuggugggugu

SEQ ID NO: 527587 - RNA, 24 nt, Human
ccugccagccccgacccccggucc

SEQ ID NO: 527588 - RNA, 21 nt, Human
ccuggggcuggggcugagccg

SEQ ID NO: 527589 - RNA, 21 nt, Human
cgaggcgggcggcacagggcc

SEQ ID NO: 527590 - RNA, 20 nt, Human
cgggagcagcucuacagagg

SEQ ID NO: 527591 - RNA, 18 nt, Human
cuggccucaaacugcagg

SEQ ID NO: 527592 - RNA, 19 nt, Human
cuggccucaaacugcaggg

SEQ ID NO: 527593 - RNA, 24 nt, Human
cuucaugcugguccucaguccuuc

SEQ ID NO: 527594 - RNA, 25 nt, Human
gaagccaaagccuuucaacagaaga

SEQ ID NO: 527595 - RNA, 23 nt, Human
gacagggugcuucugagaggcag

SEQ ID NO: 527596 - RNA, 20 nt, Human
gacugcacgggcuggaggau

SEQ ID NO: 527597 - RNA, 23 nt, Human
gagaaaaaaaucuggaaccaaaa

SEQ ID NO: 527598 - RNA, 25 nt, Human
gagcagcucuacagagggaagccaa

SEQ ID NO: 527599 - RNA, 21 nt, Human
gagcaggggggcgaggcgggc

SEQ ID NO: 527600 - RNA, 18 nt, Human
gagcgcugucuacacugc

SEQ ID NO: 527601 - RNA, 18 nt, Human
gcacugggcugaggcagg

SEQ ID NO: 527602 - RNA, 21 nt, Human
gcacugggcugaggcaggacc

SEQ ID NO: 527603 - RNA, 19 nt, Human
gcccagggagcccuuccca

SEQ ID NO: 527604 - RNA, 24 nt, Human
gcgggagcagcucuacagagggaa

SEQ ID NO: 527605 - RNA, 21 nt, Human
gcggggguggcggcggcggca

SEQ ID NO: 527606 - RNA, 20 nt, Human
ggacagccccuucagcuccc

SEQ ID NO: 527607 - RNA, 20 nt, Human
ggaccauucuagaggccagu

SEQ ID NO: 527608 - RNA, 20 nt, Human
ggacccuggugggugugggg

SEQ ID NO: 527609 - RNA, 18 nt, Human
ggagaaaaaaaucuggaa

SEQ ID NO: 527610 - RNA, 20 nt, Human
ggaggaggggacagggugcu

SEQ ID NO: 527611 - RNA, 18 nt, Human
ggaggcacugggaggccg

SEQ ID NO: 527612 - RNA, 24 nt, Human
ggccuggggaggaggggacagggu

SEQ ID NO: 527613 - RNA, 21 nt, Human
ggcugugcuggcaggccaccc

SEQ ID NO: 527614 - RNA, 21 nt, Human
gggcggggguggcggcggcgg

SEQ ID NO: 527615 - RNA, 18 nt, Human
gggcuggggcugagcgcu

SEQ ID NO: 527616 - RNA, 19 nt, Human
ggggcgaggcgggcggcac

SEQ ID NO: 527617 - RNA, 22 nt, Human
ggugaggagaaaaaaaucugga

SEQ ID NO: 527618 - RNA, 27 nt, Human
gguggcgggagcagcucuacagaggga

SEQ ID NO: 527619 - RNA, 20 nt, Human
guccaaugcugggaggcacu

SEQ ID NO: 527620 - RNA, 19 nt, Human
guccacaacagcaggccca

SEQ ID NO: 527621 - RNA, 18 nt, Human
gugggggacagccccuuc

SEQ ID NO: 527622 - RNA, 22 nt, Human
uacccggugcaccccaugcugg

SEQ ID NO: 527623 - RNA, 19 nt, Human
uacucuggcacuugucagg

SEQ ID NO: 527624 - RNA, 19 nt, Human
ucacaggccuggggaggag

SEQ ID NO: 527625 - RNA, 19 nt, Human
ucaguccuuccauccugcc

SEQ ID NO: 527626 - RNA, 23 nt, Human
uccacaacagcaggcccaacccu

SEQ ID NO: 527627 - RNA, 18 nt, Human
ucccccagggcagcugcc

SEQ ID NO: 527628 - RNA, 23 nt, Human
ucccccagggcagcugccggcag

SEQ ID NO: 527629 - RNA, 18 nt, Human
ucccugauggcacuggcu

SEQ ID NO: 527630 - RNA, 21 nt, Human
uccuccucuccccauacuggg

SEQ ID NO: 527631 - RNA, 25 nt, Human
uccugcccagggagcccuucccaaa

SEQ ID NO: 527632 - RNA, 26 nt, Human
ugacaggugagcccaaauguccuccu

SEQ ID NO: 527633 - RNA, 18 nt, Human
ugagguccacaccugggg

SEQ ID NO: 527634 - RNA, 19 nt, Human
uggaggaugccagaugggc

SEQ ID NO: 527635 - RNA, 23 nt, Human
ugggcacugggcugaggcaggac

SEQ ID NO: 527636 - RNA, 22 nt, Human
ugggcugaggcaggaccccagc

SEQ ID NO: 527637 - RNA, 18 nt, Human
uggggaggaggggacagg

SEQ ID NO: 527638 - RNA, 22 nt, Human
ugguggcgggagcagcucuaca

SEQ ID NO: 527639 - RNA, 23 nt, Human
ugguggguguggggccaccgagc

SEQ ID NO: 527640 - RNA, 24 nt, Human
uuaggugggggacagccccuucag

SEQ ID NO: 527641 - RNA, 18 nt, Human
uuccauccugccagcccc

SEQ ID NO: 527642 - RNA, 21 nt, Human
uuggugacaacgugaaggggg

SEQ ID NO: 527643 - RNA, 18 nt, Human
uuuuuuuuuuuuggaguc

SEQ ID NO: 527644 - RNA, 18 nt, Human
uuuuuuuuuuuuuuuuug

SEQ ID NO: 527645 - RNA, 18 nt, Human
uuuuuuuuuuuuuuuuug

SEQ ID NO: 527646 - RNA, 30 nt, Human
aaacugaauuuauuuccucuuggaaaacaa

SEQ ID NO: 527647 - RNA, 19 nt, Human
aaagaguaaaacauguucc

SEQ ID NO: 527648 - RNA, 18 nt, Human
aaauggaagcaaggcccc

SEQ ID NO: 527649 - RNA, 20 nt, Human
aagaaaaggaaguccaacca

SEQ ID NO: 527650 - RNA, 18 nt, Human
aagaguaaaacauguucc

SEQ ID NO: 527651 - RNA, 19 nt, Human
aagcaaggcccccaaagcc

SEQ ID NO: 527652 - RNA, 20 nt, Human
aaggcccccaaagccaucag

SEQ ID NO: 527653 - RNA, 26 nt, Human
agaguaaacauuaauaacaguaacau

SEQ ID NO: 527654 - RNA, 22 nt, Human
agggggccccuaacccgcaggg

SEQ ID NO: 527655 - RNA, 18 nt, Human
auaauaauggaaaaugga

SEQ ID NO: 527656 - RNA, 21 nt, Human
caugugcaacacuuuauauac

SEQ ID NO: 527657 - RNA, 23 nt, Human
ccugcaaggucuuggacugcgcu

SEQ ID NO: 527658 - RNA, 22 nt, Human
cugaauagggcccaaguccacu

SEQ ID NO: 527659 - RNA, 19 nt, Human
cugcaaggucuuggacugc

SEQ ID NO: 527660 - RNA, 20 nt, Human
cuuggacugcgcugucgcuc

SEQ ID NO: 527661 - RNA, 23 nt, Human
gaacauccaacaguuugauaaua

SEQ ID NO: 527662 - RNA, 28 nt, Human
ggaaaaccuugaacacucaaagcuucaa

SEQ ID NO: 527663 - RNA, 19 nt, Human
uacauaacaacuauugcau

SEQ ID NO: 527664 - RNA, 19 nt, Human
uaccugucacauugcaagg

SEQ ID NO: 527665 - RNA, 22 nt, Human
ucauuaaggaaaaccuugaaca

SEQ ID NO: 527666 - RNA, 18 nt, Human
uccacauaauaauggaaa

SEQ ID NO: 527667 - RNA, 22 nt, Human
uccagggaaaaaaaaauucuuu

SEQ ID NO: 527668 - RNA, 19 nt, Human
ucuaggcuuaaguguaaag

SEQ ID NO: 527669 - RNA, 22 nt, Human
ucucuucaugguuugcaagaau

SEQ ID NO: 527670 - RNA, 21 nt, Human
ugcgcaaaaguucaaacacau

SEQ ID NO: 527671 - RNA, 25 nt, Human
uggaaaauggaagcaaggcccccaa

SEQ ID NO: 527672 - RNA, 23 nt, Human
uggaagcaaggcccccaaagcca

SEQ ID NO: 527673 - RNA, 23 nt, Human
ugguacaauacaauguuucugaa

SEQ ID NO: 527674 - RNA, 24 nt, Human
uggucauagucuuuuuuuuuuuuu

SEQ ID NO: 527675 - RNA, 19 nt, Human
uguaaagaaaaggaagucc

SEQ ID NO: 527676 - RNA, 23 nt, Human
uucuuugacagucuacauaacaa

SEQ ID NO: 527677 - RNA, 21 nt, Human
uuuuuuuuaaucuugccugaa

SEQ ID NO: 527678 - RNA, 23 nt, Human
aaccagacaaaaucaacagccag

SEQ ID NO: 527679 - RNA, 27 nt, Human
aagaaaaaggcagaaauaaagggaccc

SEQ ID NO: 527680 - RNA, 19 nt, Human
acaaagcucucaaccaguu

SEQ ID NO: 527681 - RNA, 23 nt, Human
acuuuggaaacugaggagaaaga

SEQ ID NO: 527682 - RNA, 29 nt, Human
aggcagaaauaaaugguaggggggacccc

SEQ ID NO: 527683 - RNA, 25 nt, Human
auuccuucaguuagguccucuauua

SEQ ID NO: 527684 - RNA, 19 nt, Human
caacaaagcucucaaccag

SEQ ID NO: 527685 - RNA, 19 nt, Human
cagagagcuaugaugaaua

SEQ ID NO: 527686 - RNA, 20 nt, Human
cagagcccaaagcagagagc

SEQ ID NO: 527687 - RNA, 21 nt, Human
cagccagcaguuuucuguucc

SEQ ID NO: 527688 - RNA, 20 nt, Human
caguuagcuccucuacaguc

SEQ ID NO: 527689 - RNA, 19 nt, Human
cauuugcuaguagaaaaga

SEQ ID NO: 527690 - RNA, 20 nt, Human
ccagcaguuuucuguuccaa

SEQ ID NO: 527691 - RNA, 19 nt, Human
cccaacugugccugagggc

SEQ ID NO: 527692 - RNA, 25 nt, Human
ccugcagagcccaaagcagagagcu

SEQ ID NO: 527693 - RNA, 21 nt, Human
ccuuguaaacauucagcuagg

SEQ ID NO: 527694 - RNA, 18 nt, Human
cugcuuggcccaacugug

SEQ ID NO: 527695 - RNA, 22 nt, Human
ggagaaagaacugcuuucccca

SEQ ID NO: 527696 - RNA, 20 nt, Human
ggauuccuucaguuaggucc

SEQ ID NO: 527697 - RNA, 19 nt, Human
ggcaaagggugugcccaga

SEQ ID NO: 527698 - RNA, 22 nt, Human
gguggccugcagagcccaaagc

SEQ ID NO: 527699 - RNA, 22 nt, Human
uaacauaaccagaaaggcugaa

SEQ ID NO: 527700 - RNA, 19 nt, Human
uagggaaaacugaaaucug

SEQ ID NO: 527701 - RNA, 19 nt, Human
ucauagggaaaacugaaau

SEQ ID NO: 527702 - RNA, 22 nt, Human
ucccagcuugagaaguaggggc

SEQ ID NO: 527703 - RNA, 19 nt, Human
uccuaaaugcucucugguc

SEQ ID NO: 527704 - RNA, 23 nt, Human
ucuaaaauaacuccuuucauaua

SEQ ID NO: 527705 - RNA, 18 nt, Human
ucugcuuggcccaacugu

SEQ ID NO: 527706 - RNA, 23 nt, Human
ugaacggaagaaaaaggcagaaa

SEQ ID NO: 527707 - RNA, 22 nt, Human
ugccucagaguuucucauaggg

SEQ ID NO: 527708 - RNA, 18 nt, Human
uggcccaacugugccuga

SEQ ID NO: 527709 - RNA, 21 nt, Human
ugguagggucauuugcuagua

SEQ ID NO: 527710 - RNA, 18 nt, Human
uucaaggugacagcagaa

SEQ ID NO: 527711 - RNA, 19 nt, Human
uuccugaguucauucaagg

SEQ ID NO: 527712 - RNA, 18 nt, Human
uuuccucacaaugaacgg

SEQ ID NO: 527713 - RNA, 20 nt, Human
aaaagaggguuaaaaagcga

SEQ ID NO: 527714 - RNA, 26 nt, Human
aaacaagcaucaaaacccgaagcuca

SEQ ID NO: 527715 - RNA, 22 nt, Human
aacaagcaucaaaacccgaagc

SEQ ID NO: 527716 - RNA, 20 nt, Human
aagacugcugaucucuaaac

SEQ ID NO: 527717 - RNA, 19 nt, Human
aagcaucaaaacccgaagc

SEQ ID NO: 527718 - RNA, 21 nt, Human
acaagcaucaaaacccgaagc

SEQ ID NO: 527719 - RNA, 18 nt, Human
acuacagccuaaugcacc

SEQ ID NO: 527720 - RNA, 25 nt, Human
agagauuagcaaggcuuacuggcua

SEQ ID NO: 527721 - RNA, 18 nt, Human
agcaucaaaacccgaagc

SEQ ID NO: 527722 - RNA, 19 nt, Human
agugaagagacagcagaga

SEQ ID NO: 527723 - RNA, 23 nt, Human
auauuuuaaaaggaauggcacaa

SEQ ID NO: 527724 - RNA, 18 nt, Human
aucacaguaugcaaaugc

SEQ ID NO: 527725 - RNA, 18 nt, Human
aucuucaguuacaaaaua

SEQ ID NO: 527726 - RNA, 19 nt, Human
caaaagaggguuaaaaagc

SEQ ID NO: 527727 - RNA, 25 nt, Human
caauauuagaacuacagccuaaugc

SEQ ID NO: 527728 - RNA, 25 nt, Human
cacaguauaauagguaucugcaaug

SEQ ID NO: 527729 - RNA, 21 nt, Human
cacaguaugcaaaugcacuag

SEQ ID NO: 527730 - RNA, 25 nt, Human
caccuuuuaauacauuacuuuauaa

SEQ ID NO: 527731 - RNA, 18 nt, Human
cagccacccgcacuggcc

SEQ ID NO: 527732 - RNA, 20 nt, Human
cagccgggauagacagcccc

SEQ ID NO: 527733 - RNA, 18 nt, Human
caggaaaggcccccgcua

SEQ ID NO: 527734 - RNA, 24 nt, Human
caggaaaggcccccgcuaauggca

SEQ ID NO: 527735 - RNA, 22 nt, Human
cauuuuacagcuguaguaacca

SEQ ID NO: 527736 - RNA, 21 nt, Human
cccccacagccccaccuaacc

SEQ ID NO: 527737 - RNA, 21 nt, Human
cccccacagccccaccuaacu

SEQ ID NO: 527738 - RNA, 18 nt, Human
ccccccucccuguuuucc

SEQ ID NO: 527739 - RNA, 18 nt, Human
ccguacgccguccucagg

SEQ ID NO: 527740 - RNA, 18 nt, Human
cugaaauccccccucccu

SEQ ID NO: 527741 - RNA, 24 nt, Human
cugaucucuaaacaagcaucaaaa

SEQ ID NO: 527742 - RNA, 18 nt, Human
cuucaaaaaugcaugguc

SEQ ID NO: 527743 - RNA, 21 nt, Human
gcaccuuuuaauacauuacuu

SEQ ID NO: 527744 - RNA, 19 nt, Human
ggcuaaagaacaauucacu

SEQ ID NO: 527745 - RNA, 19 nt, Human
ggcuaaugaagagaaaaag

SEQ ID NO: 527746 - RNA, 26 nt, Human
ggguccucagccgggauagacagccc

SEQ ID NO: 527747 - RNA, 19 nt, Human
uaaaaagcgaucagcacug

SEQ ID NO: 527748 - RNA, 26 nt, Human
uaaaauuuccaaaacaacuguuacac

SEQ ID NO: 527749 - RNA, 18 nt, Human
uaaagcaaauucacugua

SEQ ID NO: 527750 - RNA, 24 nt, Human
uaacaugagaagaauaauccaugc

SEQ ID NO: 527751 - RNA, 18 nt, Human
uaauucaaugcccaagag

SEQ ID NO: 527752 - RNA, 20 nt, Human
uagcaaggcuuacuggcuag

SEQ ID NO: 527753 - RNA, 20 nt, Human
uagcuucuaaaaaauuuuuc

SEQ ID NO: 527754 - RNA, 22 nt, Human
uagcuucuaaaaaauuuuuccc

SEQ ID NO: 527755 - RNA, 22 nt, Human
uagguuauuaauggaaauauua

SEQ ID NO: 527756 - RNA, 22 nt, Human
uccaaaacaacuguuacacagu

SEQ ID NO: 527757 - RNA, 19 nt, Human
uccaugcuacaagacgaga

SEQ ID NO: 527758 - RNA, 25 nt, Human
uccccacacuccguacgccguccuc

SEQ ID NO: 527759 - RNA, 22 nt, Human
ucccccacagccccaccuaacc

SEQ ID NO: 527760 - RNA, 20 nt, Human
uccucaggaaaggcccccgc

SEQ ID NO: 527761 - RNA, 19 nt, Human
ucuaaauuuaaauuaguca

SEQ ID NO: 527762 - RNA, 21 nt, Human
ucugaaauccccccucccugu

SEQ ID NO: 527763 - RNA, 19 nt, Human
ucugcaaugaguagguuau

SEQ ID NO: 527764 - RNA, 19 nt, Human
ugcaaauguacaguuaaua

SEQ ID NO: 527765 - RNA, 23 nt, Human
uggguuuaacaugagaagaauaa

SEQ ID NO: 527766 - RNA, 24 nt, Human
uuaaagcaaauucacuguaccacu

SEQ ID NO: 527767 - RNA, 20 nt, Human
uuaaugcacaacaaaagagg

SEQ ID NO: 527768 - RNA, 21 nt, Human
uuaaugcacaacaaaagaggg

SEQ ID NO: 527769 - RNA, 20 nt, Human
uuagaacuacagccuaaugc

SEQ ID NO: 527770 - RNA, 19 nt, Human
uucaacuuucuucacaguc

SEQ ID NO: 527771 - RNA, 23 nt, Human
uucaacuuucuucacagucugaa

SEQ ID NO: 527772 - RNA, 18 nt, Human
uucaauaccuuucuuucu

SEQ ID NO: 527773 - RNA, 22 nt, Human
uucaauaccuuucuuucuaauu

SEQ ID NO: 527774 - RNA, 19 nt, Human
uuccagugaagagacaggg

SEQ ID NO: 527775 - RNA, 21 nt, Human
uucccccacagccccaccuaa

SEQ ID NO: 527776 - RNA, 26 nt, Human
uuucccauagugucagaggcaaaaau

SEQ ID NO: 527777 - RNA, 20 nt, Human
uuuuacagcuguaguaaccu

SEQ ID NO: 527778 - RNA, 23 nt, Human
uuuuuuuuuuuuuuuuucaccaa

SEQ ID NO: 527779 - RNA, 20 nt, Human
aaaaagaaaacgaaaauagu

SEQ ID NO: 527780 - RNA, 23 nt, Human
aaacaaaauacuaugaggccaga

SEQ ID NO: 527781 - RNA, 27 nt, Human
aaaccuccgagcaauauagcaagaccc

SEQ ID NO: 527782 - RNA, 18 nt, Human
aacaccguggguuaagag

SEQ ID NO: 527783 - RNA, 21 nt, Human
aacugugugcuccugcaggau

SEQ ID NO: 527784 - RNA, 23 nt, Human
aagaaugaaauaacgugagagaa

SEQ ID NO: 527785 - RNA, 21 nt, Human
aagacccagcuaagaucagaa

SEQ ID NO: 527786 - RNA, 24 nt, Human
aaucaugccacugcacucuggccu

SEQ ID NO: 527787 - RNA, 23 nt, Human
aauugcucuggaaaggaagguaa

SEQ ID NO: 527788 - RNA, 24 nt, Human
aauugcucuggaaaggaagguaag

SEQ ID NO: 527789 - RNA, 25 nt, Human
acagaacaagacuuugucucuaaaa

SEQ ID NO: 527790 - RNA, 21 nt, Human
acauaaagcaaacauauuuug

SEQ ID NO: 527791 - RNA, 18 nt, Human
acuaugaggccagacuuu

SEQ ID NO: 527792 - RNA, 24 nt, Human
acugcacucuggccuaggcaacag

SEQ ID NO: 527793 - RNA, 26 nt, Human
agaaaaagaaugaaauaacgugagag

SEQ ID NO: 527794 - RNA, 23 nt, Human
agaacaagacuuugucucuaaaa

SEQ ID NO: 527795 - RNA, 21 nt, Human
agagaugugaggaauaagaca

SEQ ID NO: 527796 - RNA, 22 nt, Human
agaggaacauuucuuuuuuagg

SEQ ID NO: 527797 - RNA, 24 nt, Human
agcgcuuugggaggccacaguggg

SEQ ID NO: 527798 - RNA, 19 nt, Human
aggaaaaaaauaaagcuga

SEQ ID NO: 527799 - RNA, 20 nt, Human
aggaaaaaaauaaagcugaa

SEQ ID NO: 527800 - RNA, 23 nt, Human
aggaggagacaauugcucuggaa

SEQ ID NO: 527801 - RNA, 24 nt, Human
aggcucuguuuaaaaaaaaaaaaa

SEQ ID NO: 527802 - RNA, 26 nt, Human
agggagaggaacauuucuuuuuuagg

SEQ ID NO: 527803 - RNA, 21 nt, Human
aggugcccuuggucagucuga

SEQ ID NO: 527804 - RNA, 21 nt, Human
agugugaauuuagaaaaagaa

SEQ ID NO: 527805 - RNA, 19 nt, Human
aguuucccaagcaccucuc

SEQ ID NO: 527806 - RNA, 23 nt, Human
aucacugugcuacaguaaacuuc

SEQ ID NO: 527807 - RNA, 23 nt, Human
aucaugccacugcacucuggccu

SEQ ID NO: 527808 - RNA, 22 nt, Human
auccuagcgcuuugggaggcca

SEQ ID NO: 527809 - RNA, 22 nt, Human
auggacacaggauuuaacccag

SEQ ID NO: 527810 - RNA, 25 nt, Human
caacagaacaagacuuugucucuaa

SEQ ID NO: 527811 - RNA, 19 nt, Human
cacauuugugagaccagca

SEQ ID NO: 527812 - RNA, 19 nt, Human
cacugcacucuggccuagg

SEQ ID NO: 527813 - RNA, 21 nt, Human
cacugcacucuggccuaggca

SEQ ID NO: 527814 - RNA, 22 nt, Human
cacugcacucuggccuaggcaa

SEQ ID NO: 527815 - RNA, 23 nt, Human
cacugcacucuggccuaggcaac

SEQ ID NO: 527816 - RNA, 24 nt, Human
cacugcacucuggccuaggcaaca

SEQ ID NO: 527817 - RNA, 20 nt, Human
cacuucuccuuccucucuuu

SEQ ID NO: 527818 - RNA, 24 nt, Human
cagacuuuuuuuucccagaggccc

SEQ ID NO: 527819 - RNA, 18 nt, Human
cagaggugaaagggaaga

SEQ ID NO: 527820 - RNA, 19 nt, Human
caggacugaaacaaaauac

SEQ ID NO: 527821 - RNA, 21 nt, Human
caggaugaaggugucuggucc

SEQ ID NO: 527822 - RNA, 24 nt, Human
caguauagaggacucuuaggacag

SEQ ID NO: 527823 - RNA, 24 nt, Human
caugcuuguaauccuagcgcuuug

SEQ ID NO: 527824 - RNA, 20 nt, Human
cauggcuaaguuuucuucuc

SEQ ID NO: 527825 - RNA, 20 nt, Human
ccaaaggaguggaggagucc

SEQ ID NO: 527826 - RNA, 19 nt, Human
ccacugcacucuggccuag

SEQ ID NO: 527827 - RNA, 20 nt, Human
ccacugcacucuggccuagg

SEQ ID NO: 527828 - RNA, 20 nt, Human
ccacugcacucuggccuagg

SEQ ID NO: 527829 - RNA, 21 nt, Human
ccacugcacucuggccuaggc

SEQ ID NO: 527830 - RNA, 24 nt, Human
ccacugcacucuggccuaggcaac

SEQ ID NO: 527831 - RNA, 22 nt, Human
ccagcacucucucugaucuccu

SEQ ID NO: 527832 - RNA, 21 nt, Human
cccaaaggaguggaggagucc

SEQ ID NO: 527833 - RNA, 24 nt, Human
cccugcacauaugcagaaccagca

SEQ ID NO: 527834 - RNA, 22 nt, Human
ccucguaacagcacugaauacc

SEQ ID NO: 527835 - RNA, 23 nt, Human
cgcagaaugaagucauacuauga

SEQ ID NO: 527836 - RNA, 24 nt, Human
cguggcucaugcuuguaauccuag

SEQ ID NO: 527837 - RNA, 20 nt, Human
cucacuucuccuuccucucu

SEQ ID NO: 527838 - RNA, 24 nt, Human
cucaugcuuguaauccuagcgcuu

SEQ ID NO: 527839 - RNA, 23 nt, Human
cucuguuuaaaaaaaaaaaaaaa

SEQ ID NO: 527840 - RNA, 21 nt, Human
gaaaggcuuagagccugcagg

SEQ ID NO: 527841 - RNA, 22 nt, Human
gaacugauaagaguuuugagau

SEQ ID NO: 527842 - RNA, 19 nt, Human
gaagagaugggauguugcc

SEQ ID NO: 527843 - RNA, 23 nt, Human
gaagggcuggcugccguggcuca

SEQ ID NO: 527844 - RNA, 19 nt, Human
gaaugagcaacaccguggg

SEQ ID NO: 527845 - RNA, 21 nt, Human
gagccugcaggugucauuugg

SEQ ID NO: 527846 - RNA, 25 nt, Human
gagcucgaucacagugaugaagggc

SEQ ID NO: 527847 - RNA, 19 nt, Human
gcaggauggauggcagugg

SEQ ID NO: 527848 - RNA, 20 nt, Human
gccacugcacucuggccuag

SEQ ID NO: 527849 - RNA, 22 nt, Human
gcccacauuugugagaccagca

SEQ ID NO: 527850 - RNA, 20 nt, Human
gcccugcacauaugcagaac

SEQ ID NO: 527851 - RNA, 22 nt, Human
gccuaggcaacagaacaagacu

SEQ ID NO: 527852 - RNA, 20 nt, Human
gcgcuuugggaggccacagu

SEQ ID NO: 527853 - RNA, 21 nt, Human
ggaagguaaguacuuccuucu

SEQ ID NO: 527854 - RNA, 24 nt, Human
ggcugccguggcucaugcuuguaa

SEQ ID NO: 527855 - RNA, 20 nt, Human
guccagaccugccacugcag

SEQ ID NO: 527856 - RNA, 19 nt, Human
guggcccugcacauaugca

SEQ ID NO: 527857 - RNA, 20 nt, Human
guggcucaugcuuguaaucc

SEQ ID NO: 527858 - RNA, 25 nt, Human
uaaaagagcagcuugguagaaugua

SEQ ID NO: 527859 - RNA, 21 nt, Human
uaaaguccucaguuuguuuuc

SEQ ID NO: 527860 - RNA, 28 nt, Human
uaaauaaaccucugagagcgaaacagga

SEQ ID NO: 527861 - RNA, 24 nt, Human
uaacagcacugaauaccgcagaau

SEQ ID NO: 527862 - RNA, 23 nt, Human
uaacgugagagaaugagcaacac

SEQ ID NO: 527863 - RNA, 18 nt, Human
uaagaguguagaggagga

SEQ ID NO: 527864 - RNA, 19 nt, Human
uaagaguguagaggaggag

SEQ ID NO: 527865 - RNA, 19 nt, Human
uaagauuaaaagagacuuu

SEQ ID NO: 527866 - RNA, 20 nt, Human
uaaggcaaaguagaggugag

SEQ ID NO: 527867 - RNA, 24 nt, Human
uaaguauggacacaggauuuaacc

SEQ ID NO: 527868 - RNA, 24 nt, Human
uaagugacuuguucaagcccuugu

SEQ ID NO: 527869 - RNA, 24 nt, Human
uacaaucaugccacugcacucugg

SEQ ID NO: 527870 - RNA, 20 nt, Human
uacaggcaccuugagaugag

SEQ ID NO: 527871 - RNA, 18 nt, Human
uagagugguggucuucaa

SEQ ID NO: 527872 - RNA, 22 nt, Human
uagagugguggucuucaaggac

SEQ ID NO: 527873 - RNA, 21 nt, Human
uagcaaaccuccgagcaauau

SEQ ID NO: 527874 - RNA, 24 nt, Human
uagcgcuuugggaggccacagugg

SEQ ID NO: 527875 - RNA, 21 nt, Human
uaguaacgaggcccaguuauc

SEQ ID NO: 527876 - RNA, 21 nt, Human
uauagcaagacccugccucua

SEQ ID NO: 527877 - RNA, 22 nt, Human
uaucucuuucaaugcuuacacu

SEQ ID NO: 527878 - RNA, 18 nt, Human
ucaguacuaacagaagca

SEQ ID NO: 527879 - RNA, 25 nt, Human
ucaguacuaacagaagcacuucgag

SEQ ID NO: 527880 - RNA, 24 nt, Human
ucccacuuucuccccucguaacag

SEQ ID NO: 527881 - RNA, 18 nt, Human
ucgcucuuguugcccagg

SEQ ID NO: 527882 - RNA, 22 nt, Human
ucuaaggcaaaguagaggugag

SEQ ID NO: 527883 - RNA, 23 nt, Human
ucuacacaugaaaggcuuagagc

SEQ ID NO: 527884 - RNA, 19 nt, Human
ucuccauggcuaaguuuuc

SEQ ID NO: 527885 - RNA, 18 nt, Human
ucucugaucuccucuccc

SEQ ID NO: 527886 - RNA, 18 nt, Human
ucugguccuguucucauc

SEQ ID NO: 527887 - RNA, 19 nt, Human
ucuuguugcccaggcucug

SEQ ID NO: 527888 - RNA, 18 nt, Human
ugaaaagugcgauugaga

SEQ ID NO: 527889 - RNA, 18 nt, Human
ugaaagaugaagaaaagg

SEQ ID NO: 527890 - RNA, 23 nt, Human
ugaaagaugaagaaaaggauggc

SEQ ID NO: 527891 - RNA, 19 nt, Human
ugacagcaauaguaagaag

SEQ ID NO: 527892 - RNA, 19 nt, Human
ugagagagguuaagugacu

SEQ ID NO: 527893 - RNA, 18 nt, Human
ugauauacucuacccaga

SEQ ID NO: 527894 - RNA, 20 nt, Human
ugcacaaucacugugcuaca

SEQ ID NO: 527895 - RNA, 23 nt, Human
ugcuuguaauccuagcgcuuugg

SEQ ID NO: 527896 - RNA, 24 nt, Human
ugcuuguaauccuagcgcuuuggg

SEQ ID NO: 527897 - RNA, 20 nt, Human
uggaguaaauaaaccucuga

SEQ ID NO: 527898 - RNA, 25 nt, Human
uggaguaaauaaaccucugagagcg

SEQ ID NO: 527899 - RNA, 25 nt, Human
uggcagaggugaaagggaagagaug

SEQ ID NO: 527900 - RNA, 23 nt, Human
uggcaguggcccugcacauaugc

SEQ ID NO: 527901 - RNA, 19 nt, Human
uggcuaaguuuucuucucu

SEQ ID NO: 527902 - RNA, 19 nt, Human
uggcucaugcuuguaaucc

SEQ ID NO: 527903 - RNA, 23 nt, Human
uggcucaugcuuguaauccuagc

SEQ ID NO: 527904 - RNA, 24 nt, Human
uggcucaugcuuguaauccuagcg

SEQ ID NO: 527905 - RNA, 18 nt, Human
ugguggcacauaccuaua

SEQ ID NO: 527906 - RNA, 22 nt, Human
ugucauuugguccagaccugcc

SEQ ID NO: 527907 - RNA, 23 nt, Human
ugugugcuccugcaggauggaug

SEQ ID NO: 527908 - RNA, 23 nt, Human
uuaaaaaaaaaaaaaaaaaaagg

SEQ ID NO: 527909 - RNA, 20 nt, Human
uucauggaagccagaaugca

SEQ ID NO: 527910 - RNA, 20 nt, Human
uuccucucuuuguuaaaaag

SEQ ID NO: 527911 - RNA, 24 nt, Human
uuguagaaacugagaaaaaaggua

SEQ ID NO: 527912 - RNA, 23 nt, Human
uuguugcccaggcucuguuuaaa

SEQ ID NO: 527913 - RNA, 23 nt, Human
uuucgcucuuguugcccaggcuc

SEQ ID NO: 527914 - RNA, 24 nt, Human
uuuguagaaacugagaaaaaaggu

SEQ ID NO: 527915 - RNA, 20 nt, Human
aaaaaccuagugaaaaugga

SEQ ID NO: 527916 - RNA, 28 nt, Human
aaaacacaacacaauuuauaauaccuug

SEQ ID NO: 527917 - RNA, 21 nt, Human
aacaauaauaaugcaauccag

SEQ ID NO: 527918 - RNA, 22 nt, Human
aagcacgaggcagaaacucgag

SEQ ID NO: 527919 - RNA, 26 nt, Human
aagcagaaaacuaaaaggagggaccc

SEQ ID NO: 527920 - RNA, 21 nt, Human
aauaaaaaggccacauccuga

SEQ ID NO: 527921 - RNA, 20 nt, Human
acaaugccacacaguacaca

SEQ ID NO: 527922 - RNA, 18 nt, Human
acgacccugggcucuggg

SEQ ID NO: 527923 - RNA, 19 nt, Human
acucauuuuaagccaucug

SEQ ID NO: 527924 - RNA, 19 nt, Human
agaaagcuccaaagcaaua

SEQ ID NO: 527925 - RNA, 23 nt, Human
agaaauucuuucacaccaagucc

SEQ ID NO: 527926 - RNA, 24 nt, Human
aggaaacaaaaauggggaagaaga

SEQ ID NO: 527927 - RNA, 20 nt, Human
aggcagggcgcugucagccu

SEQ ID NO: 527928 - RNA, 20 nt, Human
aggcugcagagcacaaaggu

SEQ ID NO: 527929 - RNA, 18 nt, Human
agggggaagcagcagcgg

SEQ ID NO: 527930 - RNA, 18 nt, Human
agugcuaaaaauuauacc

SEQ ID NO: 527931 - RNA, 23 nt, Human
auaaugcaauccaggucaaagca

SEQ ID NO: 527932 - RNA, 20 nt, Human
auagaaccaaugaauguacu

SEQ ID NO: 527933 - RNA, 18 nt, Human
aucauucuggaaaggauc

SEQ ID NO: 527934 - RNA, 23 nt, Human
augauuucagagaaggaauagca

SEQ ID NO: 527935 - RNA, 19 nt, Human
augccacacaguacacauu

SEQ ID NO: 527936 - RNA, 25 nt, Human
caaaaauauuguuaacacuggccgu

SEQ ID NO: 527937 - RNA, 28 nt, Human
caaaugugcuugauguuguuucggcucg

SEQ ID NO: 527938 - RNA, 18 nt, Human
caacaaacccauaaucaa

SEQ ID NO: 527939 - RNA, 19 nt, Human
cacuuuaaaaaaggaugaa

SEQ ID NO: 527940 - RNA, 23 nt, Human
cagcccgcaggaagcacgaccag

SEQ ID NO: 527941 - RNA, 23 nt, Human
cagcgcccgcgcggucuccuuca

SEQ ID NO: 527942 - RNA, 20 nt, Human
caggucaaagcacgaggcag

SEQ ID NO: 527943 - RNA, 21 nt, Human
caggugcagaagcuucgccaa

SEQ ID NO: 527944 - RNA, 22 nt, Human
cagucucuucugaaaucagaga

SEQ ID NO: 527945 - RNA, 23 nt, Human
caguucaccacuacuucuaaaau

SEQ ID NO: 527946 - RNA, 19 nt, Human
cauuccccaaacuacaugg

SEQ ID NO: 527947 - RNA, 23 nt, Human
cauuguuuugguuuuaacagucu

SEQ ID NO: 527948 - RNA, 18 nt, Human
ccaguugagagcggggaa

SEQ ID NO: 527949 - RNA, 20 nt, Human
ccccgucgcgcucgcuccuc

SEQ ID NO: 527950 - RNA, 21 nt, Human
cccgcgcucagcccgcaggaa

SEQ ID NO: 527951 - RNA, 20 nt, Human
cccuacagaggaagcggagu

SEQ ID NO: 527952 - RNA, 23 nt, Human
ccggaacacugcugaagauacca

SEQ ID NO: 527953 - RNA, 20 nt, Human
ccuauagaaagcuccaaagc

SEQ ID NO: 527954 - RNA, 20 nt, Human
ccucugggcugcuacagcuc

SEQ ID NO: 527955 - RNA, 23 nt, Human
cgaggugaacauuauuacauuua

SEQ ID NO: 527956 - RNA, 22 nt, Human
cgcauaaacaauaauaaugcaa

SEQ ID NO: 527957 - RNA, 21 nt, Human
cgcucagcccgcaggaagcac

SEQ ID NO: 527958 - RNA, 24 nt, Human
cugagcacugaaaaaacaucuuua

SEQ ID NO: 527959 - RNA, 20 nt, Human
cugcagagcacaaagguuuc

SEQ ID NO: 527960 - RNA, 24 nt, Human
cuuaaaaaaaaaaaaaaaagaggu

SEQ ID NO: 527961 - RNA, 19 nt, Human
gaaaacacaacacaauuua

SEQ ID NO: 527962 - RNA, 23 nt, Human
gaaaagaacaguuauuaaaggua

SEQ ID NO: 527963 - RNA, 26 nt, Human
gaaauucuuucacaccaaguccuuuc

SEQ ID NO: 527964 - RNA, 21 nt, Human
gaacacugcugaagauaccau

SEQ ID NO: 527965 - RNA, 22 nt, Human
gaauguacuuguaugucaaaca

SEQ ID NO: 527966 - RNA, 20 nt, Human
gccuaacuccaggaaagcuc

SEQ ID NO: 527967 - RNA, 24 nt, Human
gccucccccgucgcgcucgcuccu

SEQ ID NO: 527968 - RNA, 25 nt, Human
gggaagaagaucagaacaaaaauau

SEQ ID NO: 527969 - RNA, 24 nt, Human
gggcugggaguccgcucgacacag

SEQ ID NO: 527970 - RNA, 22 nt, Human
ggucccgaaaugaaaacaggga

SEQ ID NO: 527971 - RNA, 20 nt, Human
gugggugcgccagggcggcc

SEQ ID NO: 527972 - RNA, 21 nt, Human
guuuuaaaguauuagaggcaa

SEQ ID NO: 527973 - RNA, 21 nt, Human
uaaaaaaauucucucccuaga

SEQ ID NO: 527974 - RNA, 21 nt, Human
uaaggagggggaagcagcagc

SEQ ID NO: 527975 - RNA, 20 nt, Human
uagauguauauaucacgacc

SEQ ID NO: 527976 - RNA, 24 nt, Human
uaguugauuuugcuuaaguaacac

SEQ ID NO: 527977 - RNA, 24 nt, Human
uauacugaaaacacaacacaauuu

SEQ ID NO: 527978 - RNA, 21 nt, Human
uauuuagauguauauaucacg

SEQ ID NO: 527979 - RNA, 26 nt, Human
uauuucacaguguuggccacaucuuc

SEQ ID NO: 527980 - RNA, 23 nt, Human
uauuuuacacaguucaccacuac

SEQ ID NO: 527981 - RNA, 21 nt, Human
ucagaagaaaaaggcugcaga

SEQ ID NO: 527982 - RNA, 23 nt, Human
ucagcaaaaccuuaacaucuccu

SEQ ID NO: 527983 - RNA, 21 nt, Human
ucccgaaaugaaaacagggag

SEQ ID NO: 527984 - RNA, 20 nt, Human
ucccuagaagggccuaacuc

SEQ ID NO: 527985 - RNA, 19 nt, Human
ucccucugggcugcuacag

SEQ ID NO: 527986 - RNA, 23 nt, Human
uccuacauuacaaagaaucugau

SEQ ID NO: 527987 - RNA, 20 nt, Human
uccuuaaaaaaaaaaaaaaa

SEQ ID NO: 527988 - RNA, 21 nt, Human
ugaaaaauauauucaauucac

SEQ ID NO: 527989 - RNA, 21 nt, Human
ugaaaaugggaccuucacacc

SEQ ID NO: 527990 - RNA, 23 nt, Human
ugacuuuaaaucuccacucuccu

SEQ ID NO: 527991 - RNA, 21 nt, Human
ugcacacacuuuaaaaaagga

SEQ ID NO: 527992 - RNA, 18 nt, Human
uggaaaucugaagucugg

SEQ ID NO: 527993 - RNA, 19 nt, Human
uggaauagaaguuugcucc

SEQ ID NO: 527994 - RNA, 21 nt, Human
uggcagcgcucagcccgcgcu

SEQ ID NO: 527995 - RNA, 26 nt, Human
uguuuugguuuuaacagucucuucug

SEQ ID NO: 527996 - RNA, 22 nt, Human
uucacaccaaguccuucucuuc

SEQ ID NO: 527997 - RNA, 20 nt, Human
uucacaguguuggccacauc

SEQ ID NO: 527998 - RNA, 21 nt, Human
uuccugaugacaauaaaaaaa

SEQ ID NO: 527999 - RNA, 19 nt, Human
uuuauaaaugcuauaaaau

SEQ ID NO: 528000 - RNA, 25 nt, Human
uuuuuaugcagaguuguuuuuuuuu

SEQ ID NO: 528001 - RNA, 21 nt, Human
aaaacuacaggauacguggaa

SEQ ID NO: 528002 - RNA, 22 nt, Human
aagaacaaugaggaauuaaaac

SEQ ID NO: 528003 - RNA, 21 nt, Human
aagcaaucaaaucuguaaagc

SEQ ID NO: 528004 - RNA, 22 nt, Human
aagcaaucaaaucuguaaagca

SEQ ID NO: 528005 - RNA, 21 nt, Human
caauugaauugaaggucaaga

SEQ ID NO: 528006 - RNA, 18 nt, Human
cagaaagcauauacuuuc

SEQ ID NO: 528007 - RNA, 24 nt, Human
caugcaggguauaauuucauacua

SEQ ID NO: 528008 - RNA, 24 nt, Human
cccaaagaagguccugauacuuaa

SEQ ID NO: 528009 - RNA, 18 nt, Human
gaaauuccuccucaagcu

SEQ ID NO: 528010 - RNA, 20 nt, Human
gaagaguaccaaaaaagcac

SEQ ID NO: 528011 - RNA, 18 nt, Human
gcacuguaacugugaaau

SEQ ID NO: 528012 - RNA, 23 nt, Human
ggguuugaucaaagcagaaagca

SEQ ID NO: 528013 - RNA, 19 nt, Human
uaaaacuacaggauacgug

SEQ ID NO: 528014 - RNA, 22 nt, Human
uaacugugaaauuccuccucaa

SEQ ID NO: 528015 - RNA, 25 nt, Human
uaagaacaaugaggaauuaaaacua

SEQ ID NO: 528016 - RNA, 23 nt, Human
uaauucuuuugcuucugcuucug

SEQ ID NO: 528017 - RNA, 25 nt, Human
uacuauugauaaaguucaccaugaa

SEQ ID NO: 528018 - RNA, 18 nt, Human
uagcugcugccaugcauu

SEQ ID NO: 528019 - RNA, 23 nt, Human
ugaaacaaaucacaugugaaagc

SEQ ID NO: 528020 - RNA, 19 nt, Human
ugaaauguuacugugaaga

SEQ ID NO: 528021 - RNA, 19 nt, Human
ugagaaaacagcaguggca

SEQ ID NO: 528022 - RNA, 20 nt, Human
ugagaagcccuuuucuguuu

SEQ ID NO: 528023 - RNA, 18 nt, Human
uggcaggcuugagucuuc

SEQ ID NO: 528024 - RNA, 19 nt, Human
uguaacugugaaauuccuc

SEQ ID NO: 528025 - RNA, 19 nt, Human
uuaauucuuuugcuucugc

SEQ ID NO: 528026 - RNA, 22 nt, Human
uuagguccaugaaaaaguuuca

SEQ ID NO: 528027 - RNA, 19 nt, Human
uucaacuuuacaaagcauc

SEQ ID NO: 528028 - RNA, 30 nt, Human
uucauggauauaccuacaucuugaaaaacc

SEQ ID NO: 528029 - RNA, 21 nt, Human
uuuuguuuaggagaggggaug

SEQ ID NO: 528030 - RNA, 21 nt, Human
aaacagcccaguguuucaaau

SEQ ID NO: 528031 - RNA, 20 nt, Human
aaagagcacuuguugaccug

SEQ ID NO: 528032 - RNA, 22 nt, Human
aaaugcuuucuguuguuuuuca

SEQ ID NO: 528033 - RNA, 23 nt, Human
aacaacuuaaaaucaaggcccaa

SEQ ID NO: 528034 - RNA, 20 nt, Human
aacauacuacacaaugaggc

SEQ ID NO: 528035 - RNA, 23 nt, Human
aacucagaaugcacuuuggucau

SEQ ID NO: 528036 - RNA, 18 nt, Human
aagauuaugauuuaggga

SEQ ID NO: 528037 - RNA, 18 nt, Human
acaaagccuaaguuuuca

SEQ ID NO: 528038 - RNA, 24 nt, Human
acacaacaucugccacaauucucu

SEQ ID NO: 528039 - RNA, 21 nt, Human
acaccaacaugauaaguucuc

SEQ ID NO: 528040 - RNA, 24 nt, Human
acggugcugagcaauggcuucuau

SEQ ID NO: 528041 - RNA, 24 nt, Human
acuaaguacaucaaugcuuaaaaa

SEQ ID NO: 528042 - RNA, 24 nt, Human
agaaaauuauuuacuugaguaaac

SEQ ID NO: 528043 - RNA, 22 nt, Human
agaaauauuuuauugguucuua

SEQ ID NO: 528044 - RNA, 19 nt, Human
agagagaaaaacauacaaa

SEQ ID NO: 528045 - RNA, 20 nt, Human
aggaaaaacaucagacaaag

SEQ ID NO: 528046 - RNA, 27 nt, Human
aguaaaauaaauauaagaauugcacaa

SEQ ID NO: 528047 - RNA, 19 nt, Human
aguacaucaaugcuuaaaa

SEQ ID NO: 528048 - RNA, 28 nt, Human
auaaauuuuuagaaaccagaugcccagg

SEQ ID NO: 528049 - RNA, 19 nt, Human
aucauauuugcccgauuua

SEQ ID NO: 528050 - RNA, 22 nt, Human
caaaaggagacugaacagcaug

SEQ ID NO: 528051 - RNA, 22 nt, Human
caacucccuagcugagacuccu

SEQ ID NO: 528052 - RNA, 19 nt, Human
caagagagaaaaacauaca

SEQ ID NO: 528053 - RNA, 24 nt, Human
caagagagaaaaacauacaaauga

SEQ ID NO: 528054 - RNA, 26 nt, Human
cacacaacaucugccacaauucucuu

SEQ ID NO: 528055 - RNA, 21 nt, Human
caccaacaugauaaguucuca

SEQ ID NO: 528056 - RNA, 18 nt, Human
cacggcauugauggagaa

SEQ ID NO: 528057 - RNA, 18 nt, Human
cagcaugcagacauagca

SEQ ID NO: 528058 - RNA, 24 nt, Human
caguaggcacuucacuugugagau

SEQ ID NO: 528059 - RNA, 21 nt, Human
cauagaaagaaaaaacauacu

SEQ ID NO: 528060 - RNA, 21 nt, Human
ccacaugauacacuuugcacc

SEQ ID NO: 528061 - RNA, 27 nt, Human
ccuacacuagaguguaccauggggaga

SEQ ID NO: 528062 - RNA, 19 nt, Human
ccucaaucuaaaacaagca

SEQ ID NO: 528063 - RNA, 19 nt, Human
cuaaaaacaaccucaacau

SEQ ID NO: 528064 - RNA, 23 nt, Human
cuagcugagacuccugaagcaaa

SEQ ID NO: 528065 - RNA, 20 nt, Human
cucaaaaauauuuccauucu

SEQ ID NO: 528066 - RNA, 18 nt, Human
cuuagccuuauucuucag

SEQ ID NO: 528067 - RNA, 20 nt, Human
gacaauagaggaaggaaaaa

SEQ ID NO: 528068 - RNA, 23 nt, Human
gacagucugauguaaacacuuca

SEQ ID NO: 528069 - RNA, 21 nt, Human
gaccaauuaccaggaucucaa

SEQ ID NO: 528070 - RNA, 21 nt, Human
gcaagagagaaaaacauacaa

SEQ ID NO: 528071 - RNA, 25 nt, Human
ggaaaaacaucagacaaagccuaag

SEQ ID NO: 528072 - RNA, 24 nt, Human
guaaaacuuucaaauacaacacau

SEQ ID NO: 528073 - RNA, 23 nt, Human
uaaaacaagcauuuucuuaaacc

SEQ ID NO: 528074 - RNA, 21 nt, Human
uaaaagcaucuaaaauagccc

SEQ ID NO: 528075 - RNA, 30 nt, Human
uaaaauaaauauaagaauugcacaagacaa

SEQ ID NO: 528076 - RNA, 26 nt, Human
uaaaauaugguaaaaauaugaggaua

SEQ ID NO: 528077 - RNA, 23 nt, Human
uaauacugaagggugcuuaaacu

SEQ ID NO: 528078 - RNA, 24 nt, Human
uacaaaugacuuuauuucccaccg

SEQ ID NO: 528079 - RNA, 19 nt, Human
uacaacacauguggcaaag

SEQ ID NO: 528080 - RNA, 23 nt, Human
uaccaggaucucaaguaucugga

SEQ ID NO: 528081 - RNA, 22 nt, Human
uagaguguaccauggggagaaa

SEQ ID NO: 528082 - RNA, 21 nt, Human
uauaagaauugcacaagacag

SEQ ID NO: 528083 - RNA, 20 nt, Human
uccaaaauaauucaagagaa

SEQ ID NO: 528084 - RNA, 18 nt, Human
ucccuagcugagacuccu

SEQ ID NO: 528085 - RNA, 23 nt, Human
ucccuagcugagacuccugaagc

SEQ ID NO: 528086 - RNA, 19 nt, Human
ucuccacacauuccugauu

SEQ ID NO: 528087 - RNA, 19 nt, Human
ugaaaaaacucagaaugca

SEQ ID NO: 528088 - RNA, 22 nt, Human
ugacauggcucuguucuccaca

SEQ ID NO: 528089 - RNA, 22 nt, Human
ugagacuccugaagcaaagaau

SEQ ID NO: 528090 - RNA, 19 nt, Human
ugaggcugaauugaggcug

SEQ ID NO: 528091 - RNA, 21 nt, Human
ugauaaguucucauuggacac

SEQ ID NO: 528092 - RNA, 22 nt, Human
ugcaagagagaaaaacauacaa

SEQ ID NO: 528093 - RNA, 21 nt, Human
ugcccuaguauacuauaacag

SEQ ID NO: 528094 - RNA, 24 nt, Human
uggaaaagaggcuacaucuucuuu

SEQ ID NO: 528095 - RNA, 28 nt, Human
uggcaaagaaacaacaguucacacacaa

SEQ ID NO: 528096 - RNA, 18 nt, Human
ugggggugggguggggag

SEQ ID NO: 528097 - RNA, 22 nt, Human
ugggggugggguggggagaaug

SEQ ID NO: 528098 - RNA, 23 nt, Human
ugggggugggguggggagaaugc

SEQ ID NO: 528099 - RNA, 22 nt, Human
ugggguggggagaaugcaccag

SEQ ID NO: 528100 - RNA, 23 nt, Human
ugguucuuagccuuauucuucag

SEQ ID NO: 528101 - RNA, 25 nt, Human
ugugcaaacagcccaguguuucaaa

SEQ ID NO: 528102 - RNA, 18 nt, Human
uuagaaaccagaugccca

SEQ ID NO: 528103 - RNA, 21 nt, Human
uucacacacaacaucugccac

SEQ ID NO: 528104 - RNA, 20 nt, Human
uucaucuuuuauuccuaaca

SEQ ID NO: 528105 - RNA, 23 nt, Human
uucaucuuuuauuccuaacagaa

SEQ ID NO: 528106 - RNA, 24 nt, Human
uucaugguauucuuaaaggcagca

SEQ ID NO: 528107 - RNA, 23 nt, Human
uuccacaugauacacuuugcacc

SEQ ID NO: 528108 - RNA, 19 nt, Human
uuucuaaaauacucgauug

SEQ ID NO: 528109 - RNA, 20 nt, Human
uuuuaagauuaugauuuagg

SEQ ID NO: 528110 - RNA, 20 nt, Human
uuuuagaaaccagaugccca

SEQ ID NO: 528111 - RNA, 18 nt, Human
uuuuucauagaaagaaaa

SEQ ID NO: 528112 - RNA, 22 nt, Human
aaaaauaagguugaaggaggaa

SEQ ID NO: 528113 - RNA, 18 nt, Human
aaacugcauauugaaaac

SEQ ID NO: 528114 - RNA, 25 nt, Human
aaccaccuuuuaaaaaauuuuucau

SEQ ID NO: 528115 - RNA, 21 nt, Human
aacugugcuuggaaaauagga

SEQ ID NO: 528116 - RNA, 20 nt, Human
aagcaaaacacauauaaaug

SEQ ID NO: 528117 - RNA, 18 nt, Human
aaugugcuaucugcaaaa

SEQ ID NO: 528118 - RNA, 19 nt, Human
aucaugaagcacacguggc

SEQ ID NO: 528119 - RNA, 19 nt, Human
augcuuaugccaagcagga

SEQ ID NO: 528120 - RNA, 20 nt, Human
auuucaaguaaaaauaaggu

SEQ ID NO: 528121 - RNA, 23 nt, Human
caaaaacccagcaagaagcauca

SEQ ID NO: 528122 - RNA, 21 nt, Human
cacacaaagcacaccuccagc

SEQ ID NO: 528123 - RNA, 20 nt, Human
cagauacuuuauugcucacc

SEQ ID NO: 528124 - RNA, 21 nt, Human
caguaagggagaauguaaaac

SEQ ID NO: 528125 - RNA, 19 nt, Human
caugucauguagauuucag

SEQ ID NO: 528126 - RNA, 19 nt, Human
ccuacaaaugcuuaugcca

SEQ ID NO: 528127 - RNA, 21 nt, Human
ccuccugcacuuagcaaaaau

SEQ ID NO: 528128 - RNA, 22 nt, Human
ccuccugcacuuagcaaaaauc

SEQ ID NO: 528129 - RNA, 23 nt, Human
cuaaaaaagucuaggugaauccu

SEQ ID NO: 528130 - RNA, 18 nt, Human
cuaaaugccuacauguac

SEQ ID NO: 528131 - RNA, 21 nt, Human
cucagccaggcuuuuguuuuc

SEQ ID NO: 528132 - RNA, 21 nt, Human
cugaaugugcuaucugcaaaa

SEQ ID NO: 528133 - RNA, 23 nt, Human
gagccagugguauuaacucaugc

SEQ ID NO: 528134 - RNA, 20 nt, Human
gauacuuuauugcucaccuu

SEQ ID NO: 528135 - RNA, 21 nt, Human
uaaaaauaagguugaaggagg

SEQ ID NO: 528136 - RNA, 24 nt, Human
uaaaggcaauuuuaaccaccuuuu

SEQ ID NO: 528137 - RNA, 21 nt, Human
uaaaugccuacauguacuaua

SEQ ID NO: 528138 - RNA, 24 nt, Human
uacauguacaaaaacccagcaaga

SEQ ID NO: 528139 - RNA, 20 nt, Human
uaggaacugaccuaaaaguu

SEQ ID NO: 528140 - RNA, 26 nt, Human
uagucuacugggcaauuaaaggcaau

SEQ ID NO: 528141 - RNA, 21 nt, Human
uauuucuucuagcaaauuuca

SEQ ID NO: 528142 - RNA, 19 nt, Human
uccaucaacaaaauaaggc

SEQ ID NO: 528143 - RNA, 19 nt, Human
uccuaguaguaaaucuaaa

SEQ ID NO: 528144 - RNA, 24 nt, Human
ucuuccauuacaaaaaaaguuacc

SEQ ID NO: 528145 - RNA, 18 nt, Human
ugaaaacaugaaaacuac

SEQ ID NO: 528146 - RNA, 22 nt, Human
ugaagaccuacaaaugcuuauu

SEQ ID NO: 528147 - RNA, 19 nt, Human
ugcaaaagagcucauuuaa

SEQ ID NO: 528148 - RNA, 28 nt, Human
ugcagcaauaauaaagggccuccugcac

SEQ ID NO: 528149 - RNA, 21 nt, Human
ugcauaaaacaaauuucgguu

SEQ ID NO: 528150 - RNA, 19 nt, Human
uggaaaauaggcauuggaa

SEQ ID NO: 528151 - RNA, 18 nt, Human
uggauggaugcaggucag

SEQ ID NO: 528152 - RNA, 24 nt, Human
uguaaaacaucaacucagccaggc

SEQ ID NO: 528153 - RNA, 22 nt, Human
uguacaaaaacccagcaagaag

SEQ ID NO: 528154 - RNA, 24 nt, Human
uguacaaaaacccagcaagaagca

SEQ ID NO: 528155 - RNA, 23 nt, Human
uucaaguaauuucuucaaaaaag

SEQ ID NO: 528156 - RNA, 21 nt, Human
uucucaaauaaacggcauuau

SEQ ID NO: 528157 - RNA, 24 nt, Human
uugcucaccuuucacacaaagcac

SEQ ID NO: 528158 - RNA, 18 nt, Human
uuguagugcauuucuucc

SEQ ID NO: 528159 - RNA, 22 nt, Human
uuuauaaucuuuauggauuuug

SEQ ID NO: 528160 - RNA, 22 nt, Human
uuucaaaacugcauauugaaaa

SEQ ID NO: 528161 - RNA, 18 nt, Human
uuucacacaaagcacacc

SEQ ID NO: 528162 - RNA, 24 nt, Human
uuugcuauuucuucuagcaaauuu

SEQ ID NO: 528163 - RNA, 19 nt, Human
aagaaacuuuuggcuaccg

SEQ ID NO: 528164 - RNA, 22 nt, Human
accccagcuccauuuggauuuc

SEQ ID NO: 528165 - RNA, 23 nt, Human
auggaagaaaaacauuucuuuua

SEQ ID NO: 528166 - RNA, 20 nt, Human
cuuuuggcuaccgacacucu

SEQ ID NO: 528167 - RNA, 22 nt, Human
gaauguaccugaccacaguguu

SEQ ID NO: 528168 - RNA, 21 nt, Human
gcaaacuuuacaccuuuaaga

SEQ ID NO: 528169 - RNA, 18 nt, Human
gccuacaucccacgcaac

SEQ ID NO: 528170 - RNA, 18 nt, Human
uaaggaauguaccugacc

SEQ ID NO: 528171 - RNA, 24 nt, Human
uaaggaauguaccugaccccugaa

SEQ ID NO: 528172 - RNA, 25 nt, Human
ucccaaccccagcuccauuuggauu

SEQ ID NO: 528173 - RNA, 18 nt, Human
uccuagauggaagaaaaa

SEQ ID NO: 528174 - RNA, 19 nt, Human
uggcagggaggucacuuuc

SEQ ID NO: 528175 - RNA, 22 nt, Human
ugggcguccuuucauuuuagcc

SEQ ID NO: 528176 - RNA, 23 nt, Human
uuccauguucuucccaaccccag

SEQ ID NO: 528177 - RNA, 18 nt, Human
uuccuagauggaagaaaa

SEQ ID NO: 528178 - RNA, 20 nt, Human
uuuaagauaucuacaaagau

SEQ ID NO: 528179 - RNA, 22 nt, Human
aaaagaaagaggaauaggagau

SEQ ID NO: 528180 - RNA, 24 nt, Human
aaacaaagaauaaggaaugaucug

SEQ ID NO: 528181 - RNA, 21 nt, Human
aaacuuacuguaacccuuuaa

SEQ ID NO: 528182 - RNA, 18 nt, Human
aacagaaaaguuaaucug

SEQ ID NO: 528183 - RNA, 20 nt, Human
aacauggugaaauccugucu

SEQ ID NO: 528184 - RNA, 21 nt, Human
aacauggugaaauccugucuc

SEQ ID NO: 528185 - RNA, 23 nt, Human
aaccccaggaacauguuuaauac

SEQ ID NO: 528186 - RNA, 19 nt, Human
aaccuggaaggcagaggcu

SEQ ID NO: 528187 - RNA, 23 nt, Human
aacuccgucucaaaaauaaaaaa

SEQ ID NO: 528188 - RNA, 22 nt, Human
aagcaucaaauguauuuugaca

SEQ ID NO: 528189 - RNA, 18 nt, Human
aagcuuucuuuucauccu

SEQ ID NO: 528190 - RNA, 18 nt, Human
aaggggaaaagaaagagg

SEQ ID NO: 528191 - RNA, 24 nt, Human
aaucacuugaaccuggaaggcaga

SEQ ID NO: 528192 - RNA, 23 nt, Human
aaugguuaccaagauuugaaggu

SEQ ID NO: 528193 - RNA, 20 nt, Human
acaagagcgaaacuccgucu

SEQ ID NO: 528194 - RNA, 21 nt, Human
acaagagcgaaacuccgucuc

SEQ ID NO: 528195 - RNA, 23 nt, Human
acagcaaugcuacaauaaagcua

SEQ ID NO: 528196 - RNA, 24 nt, Human
acaggcugggcgcaguggcucacg

SEQ ID NO: 528197 - RNA, 20 nt, Human
acauggguauauacacagaa

SEQ ID NO: 528198 - RNA, 26 nt, Human
accccaggaacauguuuaauaccuua

SEQ ID NO: 528199 - RNA, 21 nt, Human
accuuuuuuuauaaauguucu

SEQ ID NO: 528200 - RNA, 22 nt, Human
acuaaaaaugcaaaauuagcag

SEQ ID NO: 528201 - RNA, 18 nt, Human
acugcacuacagccuggg

SEQ ID NO: 528202 - RNA, 19 nt, Human
acugcacuacagccugggc

SEQ ID NO: 528203 - RNA, 20 nt, Human
acugcacuacagccugggcg

SEQ ID NO: 528204 - RNA, 25 nt, Human
acugcacuacagccugggcgacaag

SEQ ID NO: 528205 - RNA, 24 nt, Human
acuguaccacugcacuacagccug

SEQ ID NO: 528206 - RNA, 24 nt, Human
acuugaggucaggaguucaagacc

SEQ ID NO: 528207 - RNA, 24 nt, Human
agagggaggagcaaaaacaaaccu

SEQ ID NO: 528208 - RNA, 22 nt, Human
agauuacuugaggucaggaguu

SEQ ID NO: 528209 - RNA, 23 nt, Human
agauuacuugaggucaggaguuc

SEQ ID NO: 528210 - RNA, 23 nt, Human
agcagggcgugguggugugugcc

SEQ ID NO: 528211 - RNA, 24 nt, Human
agccuggccaacauggugaaaucc

SEQ ID NO: 528212 - RNA, 20 nt, Human
agcucaaaaucuuuuuuauu

SEQ ID NO: 528213 - RNA, 22 nt, Human
aggaaggggaaaagaaagagga

SEQ ID NO: 528214 - RNA, 20 nt, Human
aggcagaggcuccagugagc

SEQ ID NO: 528215 - RNA, 24 nt, Human
aggcagaggcuccagugagcugag

SEQ ID NO: 528216 - RNA, 22 nt, Human
aggcaggagaaucacuugaacc

SEQ ID NO: 528217 - RNA, 24 nt, Human
aggcaggagaaucacuugaaccug

SEQ ID NO: 528218 - RNA, 24 nt, Human
aggcugaggcaggagaaucacuug

SEQ ID NO: 528219 - RNA, 18 nt, Human
aggggaggguaaagaggg

SEQ ID NO: 528220 - RNA, 24 nt, Human
aguggcucacgccuguaauuccag

SEQ ID NO: 528221 - RNA, 21 nt, Human
auaaaaaggggacauauaaug

SEQ ID NO: 528222 - RNA, 24 nt, Human
auaaagcaaacuuacuguaacccu

SEQ ID NO: 528223 - RNA, 18 nt, Human
auauacauaucacaugca

SEQ ID NO: 528224 - RNA, 22 nt, Human
augagggcagauuacuugaggu

SEQ ID NO: 528225 - RNA, 24 nt, Human
auuacuugaggucaggaguucaag

SEQ ID NO: 528226 - RNA, 22 nt, Human
auuccagcacuucgggaggcca

SEQ ID NO: 528227 - RNA, 22 nt, Human
auucuauaauuccuaugcuacu

SEQ ID NO: 528228 - RNA, 25 nt, Human
caaauauuuacuguccagaaacauc

SEQ ID NO: 528229 - RNA, 24 nt, Human
caacauggugaaauccugucucua

SEQ ID NO: 528230 - RNA, 24 nt, Human
caagaccagccuggccaacauggu

SEQ ID NO: 528231 - RNA, 20 nt, Human
caagguagauaaaucaauga

SEQ ID NO: 528232 - RNA, 24 nt, Human
caccucuagugacuuccaucucuu

SEQ ID NO: 528233 - RNA, 24 nt, Human
cacgccuguaauuccagcacuucg

SEQ ID NO: 528234 - RNA, 24 nt, Human
cacuacagccugggcgacaagagc

SEQ ID NO: 528235 - RNA, 23 nt, Human
cacugcacuacagccugggcgac

SEQ ID NO: 528236 - RNA, 24 nt, Human
cacugcacuacagccugggcgaca

SEQ ID NO: 528237 - RNA, 24 nt, Human
cagauuacuugaggucaggaguuc

SEQ ID NO: 528238 - RNA, 21 nt, Human
cagcacuucgggaggccaaug

SEQ ID NO: 528239 - RNA, 28 nt, Human
cagcacuucgggaggccaaugagggcag

SEQ ID NO: 528240 - RNA, 24 nt, Human
cagcuacucaggaggcugaggcag

SEQ ID NO: 528241 - RNA, 22 nt, Human
caggaacauguuuaauaccuua

SEQ ID NO: 528242 - RNA, 24 nt, Human
caggaggcugaggcaggagaauca

SEQ ID NO: 528243 - RNA, 25 nt, Human
cauaaaacuuaauaaacugagcaua

SEQ ID NO: 528244 - RNA, 20 nt, Human
cauaaaauggaugggaaagg

SEQ ID NO: 528245 - RNA, 20 nt, Human
ccacugcacuacagccuggg

SEQ ID NO: 528246 - RNA, 21 nt, Human
ccacugcacuacagccugggc

SEQ ID NO: 528247 - RNA, 21 nt, Human
ccacugcacuacagccugggc

SEQ ID NO: 528248 - RNA, 23 nt, Human
ccacugcacuacagccugggcga

SEQ ID NO: 528249 - RNA, 22 nt, Human
ccuggccaacauggugaaaucc

SEQ ID NO: 528250 - RNA, 24 nt, Human
ccuggccaacauggugaaauccug

SEQ ID NO: 528251 - RNA, 21 nt, Human
ccuguaaucccagcuacucag

SEQ ID NO: 528252 - RNA, 23 nt, Human
cgccuguaauuccagcacuucgg

SEQ ID NO: 528253 - RNA, 24 nt, Human
cgccuguaauuccagcacuucggg

SEQ ID NO: 528254 - RNA, 26 nt, Human
cgucucaaaaauaaaaaauaaaaaac

SEQ ID NO: 528255 - RNA, 19 nt, Human
cuaaaaaugcaaaauuagc

SEQ ID NO: 528256 - RNA, 23 nt, Human
cuaaugauaaauuaauuuuuccc

SEQ ID NO: 528257 - RNA, 20 nt, Human
cuacugaauuaacauagcac

SEQ ID NO: 528258 - RNA, 24 nt, Human
cucacgccuguaauuccagcacuu

SEQ ID NO: 528259 - RNA, 20 nt, Human
cucucuauaaaugaaagaac

SEQ ID NO: 528260 - RNA, 24 nt, Human
cuggccaacauggugaaauccugu

SEQ ID NO: 528261 - RNA, 20 nt, Human
cugugacugaaacaagcuaa

SEQ ID NO: 528262 - RNA, 18 nt, Human
cuuacuguaacccuuuaa

SEQ ID NO: 528263 - RNA, 21 nt, Human
gaaacaauuaaaaaaaaaaac

SEQ ID NO: 528264 - RNA, 22 nt, Human
gaaccuggaaggcagaggcucc

SEQ ID NO: 528265 - RNA, 21 nt, Human
gagcaaaaacaaaccuuuaaa

SEQ ID NO: 528266 - RNA, 23 nt, Human
gauuacuugaggucaggaguuca

SEQ ID NO: 528267 - RNA, 24 nt, Human
gauuacuugaggucaggaguucaa

SEQ ID NO: 528268 - RNA, 22 nt, Human
gcaggagaaucacuugaaccug

SEQ ID NO: 528269 - RNA, 20 nt, Human
gccaacauggugaaauccug

SEQ ID NO: 528270 - RNA, 24 nt, Human
gccaacauggugaaauccugucuc

SEQ ID NO: 528271 - RNA, 20 nt, Human
gcgcaguggcucacgccugu

SEQ ID NO: 528272 - RNA, 23 nt, Human
gcuacaauaaagcuacugugacu

SEQ ID NO: 528273 - RNA, 20 nt, Human
ggaacaggcugggcgcagug

SEQ ID NO: 528274 - RNA, 19 nt, Human
ggaaggggaaaagaaagag

SEQ ID NO: 528275 - RNA, 19 nt, Human
ggaggggaggguaaagagg

SEQ ID NO: 528276 - RNA, 21 nt, Human
ggcagauuacuugaggucagg

SEQ ID NO: 528277 - RNA, 23 nt, Human
ggcgugguggugugugccuguaa

SEQ ID NO: 528278 - RNA, 21 nt, Human
gggaggccaaugagggcagau

SEQ ID NO: 528279 - RNA, 24 nt, Human
gggcgcaguggcucacgccuguaa

SEQ ID NO: 528280 - RNA, 21 nt, Human
ggugauaggaaggggaaaaga

SEQ ID NO: 528281 - RNA, 24 nt, Human
gguggugugugccuguaaucccag

SEQ ID NO: 528282 - RNA, 24 nt, Human
guggugugugccuguaaucccagc

SEQ ID NO: 528283 - RNA, 19 nt, Human
uaaaaaaaaaaacccuccc

SEQ ID NO: 528284 - RNA, 23 nt, Human
uaaaaaugcaaaauuagcagggc

SEQ ID NO: 528285 - RNA, 21 nt, Human
uaaaauggaugggaaagggug

SEQ ID NO: 528286 - RNA, 21 nt, Human
uaacagcaaugcuacaauaaa

SEQ ID NO: 528287 - RNA, 19 nt, Human
uaacaguaucccgcacagc

SEQ ID NO: 528288 - RNA, 23 nt, Human
uacauacagguauaaauacaugg

SEQ ID NO: 528289 - RNA, 18 nt, Human
uaccaagcauauaaaaag

SEQ ID NO: 528290 - RNA, 18 nt, Human
uaccacugcacuacagcc

SEQ ID NO: 528291 - RNA, 20 nt, Human
uacuaaaaaugcaaaauuag

SEQ ID NO: 528292 - RNA, 20 nt, Human
uacugugacugaaacaagcu

SEQ ID NO: 528293 - RNA, 23 nt, Human
uacuugaggucaggaguucaaga

SEQ ID NO: 528294 - RNA, 18 nt, Human
uagcagggcgugguggug

SEQ ID NO: 528295 - RNA, 23 nt, Human
uagcagggcgugguggugugugc

SEQ ID NO: 528296 - RNA, 21 nt, Human
uauagucagauauucuauacc

SEQ ID NO: 528297 - RNA, 18 nt, Human
uaucacaugcagcagucu

SEQ ID NO: 528298 - RNA, 22 nt, Human
ucacgccuguaauuccagcacu

SEQ ID NO: 528299 - RNA, 25 nt, Human
ucacugcaaccuuuuuuugggcccc

SEQ ID NO: 528300 - RNA, 26 nt, Human
ucacugcaaccuuuuuuugggcccuc

SEQ ID NO: 528301 - RNA, 26 nt, Human
ucacugcaaccuuuuuuuggguacuc

SEQ ID NO: 528302 - RNA, 25 nt, Human
ucacugcaaccuuuuuuuggguccc

SEQ ID NO: 528303 - RNA, 26 nt, Human
ucacugcaaccuuuuuuuggguccuc

SEQ ID NO: 528304 - RNA, 18 nt, Human
ucauccuuuccuuaaucc

SEQ ID NO: 528305 - RNA, 21 nt, Human
uccagaaacaucaaagaaaca

SEQ ID NO: 528306 - RNA, 19 nt, Human
ucccaacagaaaaguuaau

SEQ ID NO: 528307 - RNA, 18 nt, Human
uccgcugaccugcucuaa

SEQ ID NO: 528308 - RNA, 24 nt, Human
ucucaacauaaaauggaugggaaa

SEQ ID NO: 528309 - RNA, 19 nt, Human
ucucccugaguucuuguuc

SEQ ID NO: 528310 - RNA, 20 nt, Human
ucucuacuaaaaaugcaaaa

SEQ ID NO: 528311 - RNA, 23 nt, Human
ucuguaaugaaagaggccggggc

SEQ ID NO: 528312 - RNA, 22 nt, Human
ugaaagaacucucaacauaaaa

SEQ ID NO: 528313 - RNA, 18 nt, Human
ugacuuccaucucuuacc

SEQ ID NO: 528314 - RNA, 20 nt, Human
ugaggcaggagaaucacuug

SEQ ID NO: 528315 - RNA, 24 nt, Human
ugaggcaggagaaucacuugaacc

SEQ ID NO: 528316 - RNA, 24 nt, Human
ugaggcaggagaaucacuugaacc

SEQ ID NO: 528317 - RNA, 20 nt, Human
ugaguucuuguucuaaaaug

SEQ ID NO: 528318 - RNA, 24 nt, Human
ugccuguaaucccagcuacucagg

SEQ ID NO: 528319 - RNA, 23 nt, Human
ugcucacggaccaaggauuugac

SEQ ID NO: 528320 - RNA, 27 nt, Human
uggaugggaaagggugauaggaagggg

SEQ ID NO: 528321 - RNA, 24 nt, Human
uggccaacauggugaaauccuguc

SEQ ID NO: 528322 - RNA, 22 nt, Human
uggcucacgccuguaauuccag

SEQ ID NO: 528323 - RNA, 24 nt, Human
uggcucacgccuguaauuccagca

SEQ ID NO: 528324 - RNA, 24 nt, Human
ugguggugugugccuguaauccca

SEQ ID NO: 528325 - RNA, 21 nt, Human
uggugugugccuguaauccca

SEQ ID NO: 528326 - RNA, 24 nt, Human
uggugugugccuguaaucccagcu

SEQ ID NO: 528327 - RNA, 23 nt, Human
uguccagaaacaucaaagaaaca

SEQ ID NO: 528328 - RNA, 21 nt, Human
uuaacaaagacccccaaaaaa

SEQ ID NO: 528329 - RNA, 26 nt, Human
uuaacaucucucaccucuagugacuu

SEQ ID NO: 528330 - RNA, 21 nt, Human
uuaccaagauuugaagguuuu

SEQ ID NO: 528331 - RNA, 23 nt, Human
uuagaauaccaaaugcauuuauu

SEQ ID NO: 528332 - RNA, 22 nt, Human
uuagcagggcgugguggugugu

SEQ ID NO: 528333 - RNA, 24 nt, Human
uuagcagggcgugguggugugugc

SEQ ID NO: 528334 - RNA, 23 nt, Human
uucaaauauuuacuguccagaaa

SEQ ID NO: 528335 - RNA, 24 nt, Human
uuccuacuuuuaacaucucucacc

SEQ ID NO: 528336 - RNA, 18 nt, Human
uuuaacaaagacccccaa

SEQ ID NO: 528337 - RNA, 22 nt, Human
uuuaacaaagacccccaaaaaa

SEQ ID NO: 528338 - RNA, 24 nt, Human
uuuagaauaccaaaugcauuuauu

SEQ ID NO: 528339 - RNA, 19 nt, Human
uuugacaacuccaagucca

SEQ ID NO: 528340 - RNA, 20 nt, Human
uuuuuuuuuuuuuuuuuugg

SEQ ID NO: 528341 - RNA, 22 nt, Human
aaaagaccagaacuggacaaua

SEQ ID NO: 528342 - RNA, 24 nt, Human
aaaaggaaggaauuuuuuaaagaa

SEQ ID NO: 528343 - RNA, 22 nt, Human
aaacagauuuagcuuaagagau

SEQ ID NO: 528344 - RNA, 18 nt, Human
aaagaaaaccaaaagagu

SEQ ID NO: 528345 - RNA, 18 nt, Human
aaagaauucuuuuauucc

SEQ ID NO: 528346 - RNA, 18 nt, Human
aaagucuccacacucuuc

SEQ ID NO: 528347 - RNA, 22 nt, Human
aacaaagaagaagaaaacugga

SEQ ID NO: 528348 - RNA, 23 nt, Human
aaccauucagaacuuacacccuc

SEQ ID NO: 528349 - RNA, 20 nt, Human
aaccucauauaagucaccuc

SEQ ID NO: 528350 - RNA, 24 nt, Human
aagaacaacaaagaagaagaaaac

SEQ ID NO: 528351 - RNA, 20 nt, Human
aagaagaaaacuggaaugaa

SEQ ID NO: 528352 - RNA, 21 nt, Human
aagaagaaaacuggaaugaac

SEQ ID NO: 528353 - RNA, 21 nt, Human
acaaagaagaagaaaacugga

SEQ ID NO: 528354 - RNA, 23 nt, Human
acaacaaagaagaagaaaacugg

SEQ ID NO: 528355 - RNA, 19 nt, Human
acacuagaagaacaacaaa

SEQ ID NO: 528356 - RNA, 21 nt, Human
acccaaagucagcaaggaacc

SEQ ID NO: 528357 - RNA, 26 nt, Human
agaaagaauucuuuuauucccacaug

SEQ ID NO: 528358 - RNA, 18 nt, Human
agaagaacaacaaagaag

SEQ ID NO: 528359 - RNA, 24 nt, Human
agaccagaacuggacaauauuaaa

SEQ ID NO: 528360 - RNA, 19 nt, Human
agccaguaugugguacaug

SEQ ID NO: 528361 - RNA, 19 nt, Human
agcuauauaaagaaaacca

SEQ ID NO: 528362 - RNA, 19 nt, Human
agcuauauaaagaaaacca

SEQ ID NO: 528363 - RNA, 24 nt, Human
aggaaaaaggagggagggaaaaug

SEQ ID NO: 528364 - RNA, 19 nt, Human
aggagggagggaaaauggg

SEQ ID NO: 528365 - RNA, 21 nt, Human
agucaggccaguuuuauuuua

SEQ ID NO: 528366 - RNA, 24 nt, Human
agucccuuuuauauuuuuuaaaag

SEQ ID NO: 528367 - RNA, 19 nt, Human
auaaaacaagauuuggcug

SEQ ID NO: 528368 - RNA, 19 nt, Human
auaaaacagaauguaguag

SEQ ID NO: 528369 - RNA, 23 nt, Human
auggguguggggucauuuggggu

SEQ ID NO: 528370 - RNA, 20 nt, Human
auguaguaggaaagaaagaa

SEQ ID NO: 528371 - RNA, 19 nt, Human
cagaaaagaccagaacugg

SEQ ID NO: 528372 - RNA, 23 nt, Human
cagaaaagaccagaacuggacaa

SEQ ID NO: 528373 - RNA, 22 nt, Human
cauagaaaacauugucaagucc

SEQ ID NO: 528374 - RNA, 22 nt, Human
cauuugggguaccaacagacuc

SEQ ID NO: 528375 - RNA, 19 nt, Human
cccaaagucagcaaggaac

SEQ ID NO: 528376 - RNA, 19 nt, Human
ccgccgguaccggccucca

SEQ ID NO: 528377 - RNA, 21 nt, Human
ccuggacuggcucacacggcc

SEQ ID NO: 528378 - RNA, 25 nt, Human
cucacagcacuggguuugcagccag

SEQ ID NO: 528379 - RNA, 24 nt, Human
cuccucagccuaugaucaguuauu

SEQ ID NO: 528380 - RNA, 18 nt, Human
cuggggagugaggagcag

SEQ ID NO: 528381 - RNA, 25 nt, Human
gcacuggguuugcagccagcuacau

SEQ ID NO: 528382 - RNA, 22 nt, Human
ggcccagugguaauucacagaa

SEQ ID NO: 528383 - RNA, 19 nt, Human
guggacacagucuuuaacc

SEQ ID NO: 528384 - RNA, 23 nt, Human
gugguacaugugucacccaaagu

SEQ ID NO: 528385 - RNA, 21 nt, Human
uaaaacaagauuuggcugagc

SEQ ID NO: 528386 - RNA, 19 nt, Human
uaaacaagggaaccagagu

SEQ ID NO: 528387 - RNA, 21 nt, Human
uaaauaaaacagaauguagua

SEQ ID NO: 528388 - RNA, 18 nt, Human
uaagucaggccaguuuua

SEQ ID NO: 528389 - RNA, 30 nt, Human
uacaauagaaccaugacuuaaacugagccc

SEQ ID NO: 528390 - RNA, 24 nt, Human
uaccaacagacucagauaaacaag

SEQ ID NO: 528391 - RNA, 21 nt, Human
uagaaaaaacucaucuggcca

SEQ ID NO: 528392 - RNA, 19 nt, Human
uagaagaacaacaaagaag

SEQ ID NO: 528393 - RNA, 24 nt, Human
uagaagaacaacaaagaagaagaa

SEQ ID NO: 528394 - RNA, 22 nt, Human
uaguaggaaagaaagaauucuu

SEQ ID NO: 528395 - RNA, 24 nt, Human
uaugaucaguuauuaauacauacc

SEQ ID NO: 528396 - RNA, 20 nt, Human
uaugugguacaugugucacc

SEQ ID NO: 528397 - RNA, 19 nt, Human
uauguuucccauagccucu

SEQ ID NO: 528398 - RNA, 21 nt, Human
ucacacggccugucuuugauc

SEQ ID NO: 528399 - RNA, 22 nt, Human
uccaaacagauuuagcuuaaga

SEQ ID NO: 528400 - RNA, 19 nt, Human
ucuaagaaagagaagagaa

SEQ ID NO: 528401 - RNA, 19 nt, Human
ugaaauagcaacaaugagu

SEQ ID NO: 528402 - RNA, 21 nt, Human
ugacaagauuuucaauuggug

SEQ ID NO: 528403 - RNA, 18 nt, Human
ugacagagcucuagaaaa

SEQ ID NO: 528404 - RNA, 26 nt, Human
ugaggacaggacauaaaacaagauuu

SEQ ID NO: 528405 - RNA, 19 nt, Human
ugagguaaggggcccagug

SEQ ID NO: 528406 - RNA, 22 nt, Human
ugcccaaaguggacacagucuu

SEQ ID NO: 528407 - RNA, 25 nt, Human
uggaaaggaaaaaggagggagggaa

SEQ ID NO: 528408 - RNA, 21 nt, Human
uggacaauauuaaagucagga

SEQ ID NO: 528409 - RNA, 24 nt, Human
uggacacagucuuuaaccuguacu

SEQ ID NO: 528410 - RNA, 18 nt, Human
uggacuggcucacacggc

SEQ ID NO: 528411 - RNA, 23 nt, Human
uggcugagcuauauaaagaaaac

SEQ ID NO: 528412 - RNA, 18 nt, Human
uggguguggggucauuug

SEQ ID NO: 528413 - RNA, 22 nt, Human
uggguguggggucauuuggggu

SEQ ID NO: 528414 - RNA, 20 nt, Human
uuaaacugagccaguaugug

SEQ ID NO: 528415 - RNA, 24 nt, Human
uuaaagaaauauaaaagucaaguc

SEQ ID NO: 528416 - RNA, 25 nt, Human
uucccauagccucuuucuuuucaga

SEQ ID NO: 528417 - RNA, 23 nt, Human
aaaaaaugaaacauuacagaaag

SEQ ID NO: 528418 - RNA, 18 nt, Human
aagaagcucguagauuuu

SEQ ID NO: 528419 - RNA, 23 nt, Human
acagaaaguucaggaacaacaca

SEQ ID NO: 528420 - RNA, 28 nt, Human
acuccaaugcccaaagaucaaggaacag

SEQ ID NO: 528421 - RNA, 21 nt, Human
agagucugggaggaaaggggg

SEQ ID NO: 528422 - RNA, 20 nt, Human
auggagccguacagaagacu

SEQ ID NO: 528423 - RNA, 22 nt, Human
auuacagaaaguucaggaacaa

SEQ ID NO: 528424 - RNA, 28 nt, Human
caaaacaaccucugcaagaaggucaucc

SEQ ID NO: 528425 - RNA, 18 nt, Human
caacuccaaugcccaaag

SEQ ID NO: 528426 - RNA, 25 nt, Human
caaugcccaaagaucaaggaacaga

SEQ ID NO: 528427 - RNA, 24 nt, Human
cauggagccguacagaagacugac

SEQ ID NO: 528428 - RNA, 20 nt, Human
ccaacuccaaugcccaaaga

SEQ ID NO: 528429 - RNA, 22 nt, Human
ccaaugcccaaagaucaagggg

SEQ ID NO: 528430 - RNA, 19 nt, Human
cccaaagaucaaggaacag

SEQ ID NO: 528431 - RNA, 22 nt, Human
ccccaucaccuauguaacuccc

SEQ ID NO: 528432 - RNA, 21 nt, Human
cucccuaaauaaauaaaaauu

SEQ ID NO: 528433 - RNA, 22 nt, Human
cucgccaacuccaaugcccaaa

SEQ ID NO: 528434 - RNA, 28 nt, Human
cucuucccugaugguagccaucuuuaac

SEQ ID NO: 528435 - RNA, 24 nt, Human
cugacacagaugcugaucucuucc

SEQ ID NO: 528436 - RNA, 18 nt, Human
cugaugguagccaucuuu

SEQ ID NO: 528437 - RNA, 24 nt, Human
cuucacagccguggagugccuacc

SEQ ID NO: 528438 - RNA, 21 nt, Human
gauguaaccuugacuucccag

SEQ ID NO: 528439 - RNA, 20 nt, Human
ggaggaaagggggcagcagu

SEQ ID NO: 528440 - RNA, 24 nt, Human
gucagagucugggaggaaaggggg

SEQ ID NO: 528441 - RNA, 21 nt, Human
uaaccuugacuucccaggaaa

SEQ ID NO: 528442 - RNA, 20 nt, Human
uacagaaaguucaggaacaa

SEQ ID NO: 528443 - RNA, 21 nt, Human
uaguuugucagauuuaaaaaa

SEQ ID NO: 528444 - RNA, 18 nt, Human
ucacagccguggagugcc

SEQ ID NO: 528445 - RNA, 19 nt, Human
ucccauggagccguacaga

SEQ ID NO: 528446 - RNA, 18 nt, Human
ucccuaaauaaauaaaaa

SEQ ID NO: 528447 - RNA, 20 nt, Human
uccuuaacucagaagggccc

SEQ ID NO: 528448 - RNA, 21 nt, Human
ugacacagaugcugaucucuu

SEQ ID NO: 528449 - RNA, 19 nt, Human
uguaaccuugacuucccag

SEQ ID NO: 528450 - RNA, 19 nt, Human
ugucagauuuaaaaaauga

SEQ ID NO: 528451 - RNA, 21 nt, Human
uuacagaaaguucaggaacaa

SEQ ID NO: 528452 - RNA, 19 nt, Human
uucucuuuguucugacacc

SEQ ID NO: 528453 - RNA, 19 nt, Human
uuuaaaaaaugaaacauua

SEQ ID NO: 528454 - RNA, 18 nt, Human
uuuuuuuuuuuucuuuug

SEQ ID NO: 528455 - RNA, 24 nt, Human
uuuuuuuuuuuuuuuuuuucuuuu

SEQ ID NO: 528456 - RNA, 25 nt, Human
aaaaagaaaacaaaaaaccuuagga

SEQ ID NO: 528457 - RNA, 19 nt, Human
aaaaagacaaaaacaaaaa

SEQ ID NO: 528458 - RNA, 21 nt, Human
aaaaaggagauaaaaagcaag

SEQ ID NO: 528459 - RNA, 19 nt, Human
aaaagaaugaaggauaggc

SEQ ID NO: 528460 - RNA, 22 nt, Human
aaaaguuauuugaaaccacacu

SEQ ID NO: 528461 - RNA, 19 nt, Human
aaacaaaaaacaccuuuca

SEQ ID NO: 528462 - RNA, 20 nt, Human
aaaguacuugaggccuuacc

SEQ ID NO: 528463 - RNA, 20 nt, Human
aaaguacuugaggccuuacc

SEQ ID NO: 528464 - RNA, 21 nt, Human
aaauaaguaccaaagugcuuu

SEQ ID NO: 528465 - RNA, 18 nt, Human
aacccguucuuucucccc

SEQ ID NO: 528466 - RNA, 23 nt, Human
aacccguucuuucuccccgcccc

SEQ ID NO: 528467 - RNA, 21 nt, Human
aacuugauucucuauuaacaa

SEQ ID NO: 528468 - RNA, 21 nt, Human
aagcuuucuucuggcagaggc

SEQ ID NO: 528469 - RNA, 25 nt, Human
aaggaggaaucuguuuuguuucaag

SEQ ID NO: 528470 - RNA, 24 nt, Human
aaguagcugggaacacaggcaugc

SEQ ID NO: 528471 - RNA, 18 nt, Human
aauaaaacaauuugaugc

SEQ ID NO: 528472 - RNA, 18 nt, Human
aaucagagauaauaccac

SEQ ID NO: 528473 - RNA, 19 nt, Human
aaugaagaugaaguaaccu

SEQ ID NO: 528474 - RNA, 19 nt, Human
aauuccaauucaacagcau

SEQ ID NO: 528475 - RNA, 28 nt, Human
acaaaaacaaaaaacaccuuucaaacac

SEQ ID NO: 528476 - RNA, 24 nt, Human
acauggcggacacaacccguucuu

SEQ ID NO: 528477 - RNA, 18 nt, Human
accaaaggacuuuacagc

SEQ ID NO: 528478 - RNA, 18 nt, Human
acccguucuuucuccccg

SEQ ID NO: 528479 - RNA, 23 nt, Human
acccguucuuucuccccgccccc

SEQ ID NO: 528480 - RNA, 23 nt, Human
accuuagccucccaaguagcugg

SEQ ID NO: 528481 - RNA, 22 nt, Human
acucauucagcgcccuuagguc

SEQ ID NO: 528482 - RNA, 25 nt, Human
acuccauugcccaggcuggagugca

SEQ ID NO: 528483 - RNA, 23 nt, Human
acucuacaggaaagauuacagca

SEQ ID NO: 528484 - RNA, 21 nt, Human
agacaaaaacaaaaaacaccu

SEQ ID NO: 528485 - RNA, 26 nt, Human
agagaacaaaugaacagaagaucugu

SEQ ID NO: 528486 - RNA, 21 nt, Human
agcaagauuuauaacauucac

SEQ ID NO: 528487 - RNA, 19 nt, Human
agcaguuuuaaggucaugu

SEQ ID NO: 528488 - RNA, 24 nt, Human
aggaugucuucauguguaaaucag

SEQ ID NO: 528489 - RNA, 23 nt, Human
aggcauuccuuaguaaagagagu

SEQ ID NO: 528490 - RNA, 23 nt, Human
aggguuccuauuaaacauuagug

SEQ ID NO: 528491 - RNA, 21 nt, Human
agugcagucgugcaaucacag

SEQ ID NO: 528492 - RNA, 23 nt, Human
agugcagucgugcaaucacagcu

SEQ ID NO: 528493 - RNA, 23 nt, Human
auaaaacucucucaaggcugcaa

SEQ ID NO: 528494 - RNA, 22 nt, Human
augaagaggaaaaaaaaagccc

SEQ ID NO: 528495 - RNA, 19 nt, Human
augaugauuauauguuggc

SEQ ID NO: 528496 - RNA, 21 nt, Human
auuuauagcuauguuuuccuu

SEQ ID NO: 528497 - RNA, 19 nt, Human
caaaaacaaaaaacaccuu

SEQ ID NO: 528498 - RNA, 19 nt, Human
caaacugaaagcagcauuu

SEQ ID NO: 528499 - RNA, 22 nt, Human
caacagcauuuaccaaaggacu

SEQ ID NO: 528500 - RNA, 24 nt, Human
caacccguucuuucuccccgcccc

SEQ ID NO: 528501 - RNA, 31 nt, Human
cacagcucacuauagccucaaccuccuaggg

SEQ ID NO: 528502 - RNA, 22 nt, Human
caccaacauggcggacacaacc

SEQ ID NO: 528503 - RNA, 19 nt, Human
cacuauagccucaaccucc

SEQ ID NO: 528504 - RNA, 24 nt, Human
cacuccauugcccaggcuggagug

SEQ ID NO: 528505 - RNA, 24 nt, Human
cagccuucccuuucucuuuauuaa

SEQ ID NO: 528506 - RNA, 22 nt, Human
cauaauucaggucaaaugccaa

SEQ ID NO: 528507 - RNA, 19 nt, Human
cauugcccaggcuggagug

SEQ ID NO: 528508 - RNA, 20 nt, Human
cauuugauuauaaaaagguc

SEQ ID NO: 528509 - RNA, 18 nt, Human
ccaacuguaccaagccag

SEQ ID NO: 528510 - RNA, 23 nt, Human
cccaccuuagccucccaaguagc

SEQ ID NO: 528511 - RNA, 22 nt, Human
cccuccuggagcucuagucgcc

SEQ ID NO: 528512 - RNA, 22 nt, Human
ccgaaugaauaaauaaauugca

SEQ ID NO: 528513 - RNA, 19 nt, Human
ccuauauuauagcaaaauu

SEQ ID NO: 528514 - RNA, 25 nt, Human
ccugcggugggugugacccuaggac

SEQ ID NO: 528515 - RNA, 18 nt, Human
ccuucccuuucucuuuau

SEQ ID NO: 528516 - RNA, 19 nt, Human
ccuucccuuucucuuuauu

SEQ ID NO: 528517 - RNA, 21 nt, Human
ccuuugcauuuccuugggagg

SEQ ID NO: 528518 - RNA, 20 nt, Human
cgugcaaucacagcucacua

SEQ ID NO: 528519 - RNA, 24 nt, Human
cuaaaaaaggagauaaaaagcaag

SEQ ID NO: 528520 - RNA, 21 nt, Human
cuagagcccacagaacuggcc

SEQ ID NO: 528521 - RNA, 18 nt, Human
cucacuccauugcccagg

SEQ ID NO: 528522 - RNA, 21 nt, Human
cugaauuccaauucaacagca

SEQ ID NO: 528523 - RNA, 19 nt, Human
cuggcugcuaagcuuucuu

SEQ ID NO: 528524 - RNA, 19 nt, Human
cuguucuuuuaacaguagu

SEQ ID NO: 528525 - RNA, 24 nt, Human
cuucacauucaaauauuuucaaaa

SEQ ID NO: 528526 - RNA, 26 nt, Human
cuucccaccuuagccucccaaguagc

SEQ ID NO: 528527 - RNA, 22 nt, Human
cuuucuucuggcagaggcugga

SEQ ID NO: 528528 - RNA, 21 nt, Human
cuuuggcagcgguccucagag

SEQ ID NO: 528529 - RNA, 24 nt, Human
gacaaaaacaaaaaacaccuuuca

SEQ ID NO: 528530 - RNA, 23 nt, Human
gagaacaaauaaguaccaaagug

SEQ ID NO: 528531 - RNA, 20 nt, Human
gagacaggagucucacucca

SEQ ID NO: 528532 - RNA, 24 nt, Human
gagccaagcaaaugcaauccuaaa

SEQ ID NO: 528533 - RNA, 19 nt, Human
gcccaggcuggagugcagu

SEQ ID NO: 528534 - RNA, 19 nt, Human
gcccccaagagggagcgga

SEQ ID NO: 528535 - RNA, 22 nt, Human
gcccuuaggucucuacugaggc

SEQ ID NO: 528536 - RNA, 25 nt, Human
ggaaaaaauucuucucuaaguuaaa

SEQ ID NO: 528537 - RNA, 25 nt, Human
ggacacaacccguucuuucuccccg

SEQ ID NO: 528538 - RNA, 25 nt, Human
ggcagaaaauaauguaauauuccuu

SEQ ID NO: 528539 - RNA, 20 nt, Human
gggggcggaggcgaaggacg

SEQ ID NO: 528540 - RNA, 21 nt, Human
guaaccuuguccaaaauuugu

SEQ ID NO: 528541 - RNA, 21 nt, Human
gugaaauaaagcaaacccuuu

SEQ ID NO: 528542 - RNA, 25 nt, Human
uaaaaaaaaaacuaucaaacugaaa

SEQ ID NO: 528543 - RNA, 24 nt, Human
uaaaaagaaaacaaaaaaccuuag

SEQ ID NO: 528544 - RNA, 19 nt, Human
uaaaaagcaagcugauguc

SEQ ID NO: 528545 - RNA, 23 nt, Human
uaaaacaauuugaugcaaagagu

SEQ ID NO: 528546 - RNA, 18 nt, Human
uaaaaggaagagguguuu

SEQ ID NO: 528547 - RNA, 24 nt, Human
uaaaauagauauggucagugaaug

SEQ ID NO: 528548 - RNA, 21 nt, Human
uaacauucacaaaaagauuuu

SEQ ID NO: 528549 - RNA, 21 nt, Human
uaagagacuuuuccuaccuuu

SEQ ID NO: 528550 - RNA, 22 nt, Human
uaagcuuucuucuggcagaggc

SEQ ID NO: 528551 - RNA, 21 nt, Human
uaagguagacaaauguauguu

SEQ ID NO: 528552 - RNA, 20 nt, Human
uaccacacagaauguaagga

SEQ ID NO: 528553 - RNA, 24 nt, Human
uacucuacaggaaagauuacagca

SEQ ID NO: 528554 - RNA, 18 nt, Human
uagcaaaaaaaugaaauu

SEQ ID NO: 528555 - RNA, 23 nt, Human
uagcaaaaaaaugaaauuuuuaa

SEQ ID NO: 528556 - RNA, 23 nt, Human
uagggaacauuuaauuucccuua

SEQ ID NO: 528557 - RNA, 24 nt, Human
uaugaagaggaaaaaaaaagccca

SEQ ID NO: 528558 - RNA, 23 nt, Human
ucaauauaaggaggaaucuguuu

SEQ ID NO: 528559 - RNA, 22 nt, Human
ucacagacauacacauauuucu

SEQ ID NO: 528560 - RNA, 22 nt, Human
ucacuaaaaaaggagauaaaaa

SEQ ID NO: 528561 - RNA, 23 nt, Human
ucacuauagccucaaccuccuag

SEQ ID NO: 528562 - RNA, 24 nt, Human
ucacuccauugcccaggcuggagu

SEQ ID NO: 528563 - RNA, 20 nt, Human
ucaggacagcacaaugaaaa

SEQ ID NO: 528564 - RNA, 21 nt, Human
ucagugaauguuugaugauga

SEQ ID NO: 528565 - RNA, 21 nt, Human
ucauucaauaaaacaccauaa

SEQ ID NO: 528566 - RNA, 24 nt, Human
ucccaaguagcugggaacacaggc

SEQ ID NO: 528567 - RNA, 18 nt, Human
uccuaaauagcaaaaaaa

SEQ ID NO: 528568 - RNA, 20 nt, Human
uccuagguucaauugaucuu

SEQ ID NO: 528569 - RNA, 18 nt, Human
ucuacaguuuauaguucu

SEQ ID NO: 528570 - RNA, 23 nt, Human
ucucacuccauugcccaggcugg

SEQ ID NO: 528571 - RNA, 24 nt, Human
ucucacuccauugcccaggcugga

SEQ ID NO: 528572 - RNA, 26 nt, Human
ucucacuccauugcccaggcuggagu

SEQ ID NO: 528573 - RNA, 23 nt, Human
ucucuacugaggcgcuggcugcu

SEQ ID NO: 528574 - RNA, 18 nt, Human
ucuucuggcagaggcugg

SEQ ID NO: 528575 - RNA, 19 nt, Human
ucuucuggcagaggcugga

SEQ ID NO: 528576 - RNA, 20 nt, Human
ugaauuaaauaaguugaguu

SEQ ID NO: 528577 - RNA, 19 nt, Human
ugacuugguuuaugcuacc

SEQ ID NO: 528578 - RNA, 21 nt, Human
ugagaaaugagauaaaacaca

SEQ ID NO: 528579 - RNA, 22 nt, Human
ugagaaaugagauaaaacacaa

SEQ ID NO: 528580 - RNA, 22 nt, Human
ugagagcuuagucgugagagcg

SEQ ID NO: 528581 - RNA, 21 nt, Human
ugagguauaguaugcauuugg

SEQ ID NO: 528582 - RNA, 19 nt, Human
ugaguaguaguuuaauacu

SEQ ID NO: 528583 - RNA, 25 nt, Human
ugauuuauccuauuuuaguaaccug

SEQ ID NO: 528584 - RNA, 20 nt, Human
ugcaauaugccaacuuuggu

SEQ ID NO: 528585 - RNA, 22 nt, Human
ugcauuaacaaggaugucuuca

SEQ ID NO: 528586 - RNA, 18 nt, Human
ugcccaggcuggagugca

SEQ ID NO: 528587 - RNA, 24 nt, Human
ugcccaggcuggagugcagucgug

SEQ ID NO: 528588 - RNA, 23 nt, Human
ugcggugggugugacccuaggac

SEQ ID NO: 528589 - RNA, 18 nt, Human
ugcuaagcuuucuucugg

SEQ ID NO: 528590 - RNA, 19 nt, Human
uggagugcagucgugcaau

SEQ ID NO: 528591 - RNA, 23 nt, Human
ugggaacugggcuacacaaauaa

SEQ ID NO: 528592 - RNA, 19 nt, Human
ugggugugacccuaggacc

SEQ ID NO: 528593 - RNA, 23 nt, Human
ugguacaggaaaaaauucuucuc

SEQ ID NO: 528594 - RNA, 18 nt, Human
ugugaagauauaaguagu

SEQ ID NO: 528595 - RNA, 21 nt, Human
ugugaauaaagcuaguuuuaa

SEQ ID NO: 528596 - RNA, 20 nt, Human
uuaauacaaaacccagcagu

SEQ ID NO: 528597 - RNA, 19 nt, Human
uuagagacaggagucucac

SEQ ID NO: 528598 - RNA, 19 nt, Human
uuaggaguuuugguuauca

SEQ ID NO: 528599 - RNA, 22 nt, Human
uuaguuuauggucagagugauu

SEQ ID NO: 528600 - RNA, 21 nt, Human
uuaucaacaaauauggaagca

SEQ ID NO: 528601 - RNA, 23 nt, Human
uucaaauauuuucaaaauauuuu

SEQ ID NO: 528602 - RNA, 24 nt, Human
uucaauugaucuucccaccuuagc

SEQ ID NO: 528603 - RNA, 18 nt, Human
uucauuuuaaaggguaaa

SEQ ID NO: 528604 - RNA, 23 nt, Human
uucccaccuuagccucccaagua

SEQ ID NO: 528605 - RNA, 22 nt, Human
uugcccaggcuggagugcaguc

SEQ ID NO: 528606 - RNA, 19 nt, Human
uuuaccaaaggacuuuaca

SEQ ID NO: 528607 - RNA, 21 nt, Human
uuucuucuggcagaggcugga

SEQ ID NO: 528608 - RNA, 28 nt, Human
uuugguacaggaaaaaauucuucucuaa

SEQ ID NO: 528609 - RNA, 23 nt, Human
aaaaaacaauucuaaacuguaug

SEQ ID NO: 528610 - RNA, 18 nt, Human
aaaacgcaguggugaaaa

SEQ ID NO: 528611 - RNA, 22 nt, Human
aaacaaaaguuuacacauucuc

SEQ ID NO: 528612 - RNA, 19 nt, Human
aaagaugugccucaaacuu

SEQ ID NO: 528613 - RNA, 24 nt, Human
aaagugcugggauuacaggcguga

SEQ ID NO: 528614 - RNA, 19 nt, Human
aacaaauugguagauuaca

SEQ ID NO: 528615 - RNA, 20 nt, Human
aacauacuguauacacagau

SEQ ID NO: 528616 - RNA, 21 nt, Human
aagcaaugccacaguugccuc

SEQ ID NO: 528617 - RNA, 19 nt, Human
aagugcugggauuacaggc

SEQ ID NO: 528618 - RNA, 19 nt, Human
aagugcugggauuacaggc

SEQ ID NO: 528619 - RNA, 21 nt, Human
aauaguaauaaaaauacaauc

SEQ ID NO: 528620 - RNA, 21 nt, Human
acacaguuacuaccacuggca

SEQ ID NO: 528621 - RNA, 23 nt, Human
acaguuaucacacuuaaagccca

SEQ ID NO: 528622 - RNA, 23 nt, Human
accagggaaaccuuugcucacca

SEQ ID NO: 528623 - RNA, 24 nt, Human
accauguuggccagguuggucuug

SEQ ID NO: 528624 - RNA, 25 nt, Human
acucuguugcccagccuggagugca

SEQ ID NO: 528625 - RNA, 18 nt, Human
acuuugucuucucauuau

SEQ ID NO: 528626 - RNA, 24 nt, Human
agaaucuuuccaaacugugcacau

SEQ ID NO: 528627 - RNA, 27 nt, Human
agacuaaauuuaaucacuuguuuaaaa

SEQ ID NO: 528628 - RNA, 21 nt, Human
agcuguacuugacgagaacac

SEQ ID NO: 528629 - RNA, 22 nt, Human
agggugcugucgucugcuuguu

SEQ ID NO: 528630 - RNA, 20 nt, Human
agugcaguggcaugauccug

SEQ ID NO: 528631 - RNA, 23 nt, Human
agugcaguggcaugauccuggcu

SEQ ID NO: 528632 - RNA, 24 nt, Human
agugcaguggcaugauccuggcuc

SEQ ID NO: 528633 - RNA, 18 nt, Human
agugcugggauuacaggc

SEQ ID NO: 528634 - RNA, 20 nt, Human
auaguccuaaagaugcagaa

SEQ ID NO: 528635 - RNA, 19 nt, Human
augcaaccucugccuccug

SEQ ID NO: 528636 - RNA, 21 nt, Human
augcaaccucugccuccuggg

SEQ ID NO: 528637 - RNA, 21 nt, Human
auuucuggaggacaauccugg

SEQ ID NO: 528638 - RNA, 24 nt, Human
caaagugcugggauuacaggcgug

SEQ ID NO: 528639 - RNA, 19 nt, Human
caaaugaacaucauucaag

SEQ ID NO: 528640 - RNA, 25 nt, Human
caacaaaaauaagaaugcacuuuga

SEQ ID NO: 528641 - RNA, 26 nt, Human
caacaaaaauaagaaugcacuuugaa

SEQ ID NO: 528642 - RNA, 19 nt, Human
caacaaaauccagcaguau

SEQ ID NO: 528643 - RNA, 22 nt, Human
caagcaauucuccugccucagc

SEQ ID NO: 528644 - RNA, 19 nt, Human
caagugauccacccauauc

SEQ ID NO: 528645 - RNA, 22 nt, Human
caauauacaccugacucaaaau

SEQ ID NO: 528646 - RNA, 19 nt, Human
caaugcaaccucugccucc

SEQ ID NO: 528647 - RNA, 22 nt, Human
cacacaccaugagcugguuaag

SEQ ID NO: 528648 - RNA, 21 nt, Human
cacacccggcuaauuuuugua

SEQ ID NO: 528649 - RNA, 22 nt, Human
cacacgccaucacacccggcua

SEQ ID NO: 528650 - RNA, 18 nt, Human
cacagaaauccaaagaca

SEQ ID NO: 528651 - RNA, 21 nt, Human
caccauguuggccagguuggu

SEQ ID NO: 528652 - RNA, 22 nt, Human
caccauguuggccagguugguc

SEQ ID NO: 528653 - RNA, 23 nt, Human
caccauguuggccagguuggucu

SEQ ID NO: 528654 - RNA, 24 nt, Human
caccauguuggccagguuggucuu

SEQ ID NO: 528655 - RNA, 22 nt, Human
caccauugacagccaaauagcc

SEQ ID NO: 528656 - RNA, 23 nt, Human
caccauugacagccaaauagccu

SEQ ID NO: 528657 - RNA, 19 nt, Human
cacccacuaacaacccuag

SEQ ID NO: 528658 - RNA, 24 nt, Human
caccgaacacccuggauggguucu

SEQ ID NO: 528659 - RNA, 19 nt, Human
caccucccuucgacaacaa

SEQ ID NO: 528660 - RNA, 24 nt, Human
cacucuguugcccagccuggagug

SEQ ID NO: 528661 - RNA, 20 nt, Human
cacugaaaucacuaaaucca

SEQ ID NO: 528662 - RNA, 18 nt, Human
cagcuccaauuuacuaaa

SEQ ID NO: 528663 - RNA, 20 nt, Human
cagggaacaaugaaauuaga

SEQ ID NO: 528664 - RNA, 23 nt, Human
caguggugaaaaauucaccaggg

SEQ ID NO: 528665 - RNA, 24 nt, Human
cauguuggccagguuggucuugaa

SEQ ID NO: 528666 - RNA, 21 nt, Human
ccaaagcuuuuuauaaacugu

SEQ ID NO: 528667 - RNA, 22 nt, Human
ccaaagugcugggauuacaggc

SEQ ID NO: 528668 - RNA, 22 nt, Human
ccaaagugcugggauuacaggc

SEQ ID NO: 528669 - RNA, 24 nt, Human
ccaaagugcugggauuacaggcgu

SEQ ID NO: 528670 - RNA, 18 nt, Human
ccacaguuaucacacuua

SEQ ID NO: 528671 - RNA, 20 nt, Human
ccacauguugcacaaaucca

SEQ ID NO: 528672 - RNA, 24 nt, Human
ccauauacacuggcgguucaugug

SEQ ID NO: 528673 - RNA, 21 nt, Human
ccauuuaagaucaccaccuaa

SEQ ID NO: 528674 - RNA, 19 nt, Human
cccacuaacaacccuagcc

SEQ ID NO: 528675 - RNA, 23 nt, Human
cccagccuggagugcaguggcau

SEQ ID NO: 528676 - RNA, 22 nt, Human
ccccuacaguuuuaacaaaaac

SEQ ID NO: 528677 - RNA, 19 nt, Human
cccgaguagcugggauuau

SEQ ID NO: 528678 - RNA, 24 nt, Human
ccuccuggguucaagcaauucucc

SEQ ID NO: 528679 - RNA, 19 nt, Human
ccucugccuccuggguuca

SEQ ID NO: 528680 - RNA, 23 nt, Human
ccugacuucaagugauccaccca

SEQ ID NO: 528681 - RNA, 23 nt, Human
ccuggguucaagcaauucuccug

SEQ ID NO: 528682 - RNA, 19 nt, Human
cgagauucuacuucuucag

SEQ ID NO: 528683 - RNA, 23 nt, Human
cuaauuuuuguauuuuuaguagg

SEQ ID NO: 528684 - RNA, 24 nt, Human
cucaaugcaaccucugccuccugg

SEQ ID NO: 528685 - RNA, 24 nt, Human
cucagccucccgaguagcugggau

SEQ ID NO: 528686 - RNA, 20 nt, Human
cucccaaagcuacauuacaa

SEQ ID NO: 528687 - RNA, 21 nt, Human
cuccuggguucaagcaauucu

SEQ ID NO: 528688 - RNA, 24 nt, Human
cugcagaauuaaguggcccuuccu

SEQ ID NO: 528689 - RNA, 23 nt, Human
cugccucagccucccgaguagcu

SEQ ID NO: 528690 - RNA, 24 nt, Human
cuggaugcuugaaauaaauagauu

SEQ ID NO: 528691 - RNA, 23 nt, Human
cuucacccacuaacaacccuagc

SEQ ID NO: 528692 - RNA, 24 nt, Human
gacuucaagugauccacccauauc

SEQ ID NO: 528693 - RNA, 26 nt, Human
gaguagcugggauuauauaugcacac

SEQ ID NO: 528694 - RNA, 19 nt, Human
gagugucauuucugggaaa

SEQ ID NO: 528695 - RNA, 18 nt, Human
gauuacaggcgugagcca

SEQ ID NO: 528696 - RNA, 21 nt, Human
gauuacaggcgugagccacug

SEQ ID NO: 528697 - RNA, 24 nt, Human
gauuacaggcgugagccacuggac

SEQ ID NO: 528698 - RNA, 22 nt, Human
gcaaccucugccuccuggguuc

SEQ ID NO: 528699 - RNA, 19 nt, Human
gcacaaauccacuuucagc

SEQ ID NO: 528700 - RNA, 27 nt, Human
gccauuagccaaaaaacaauucuaaac

SEQ ID NO: 528701 - RNA, 20 nt, Human
gcccagccuggagugcagug

SEQ ID NO: 528702 - RNA, 20 nt, Human
gccucagccucccgaguagc

SEQ ID NO: 528703 - RNA, 21 nt, Human
ggguuucaccauguuggccag

SEQ ID NO: 528704 - RNA, 22 nt, Human
ggguuucaccauguuggccagg

SEQ ID NO: 528705 - RNA, 24 nt, Human
gguuggucuugaacuccugacuuc

SEQ ID NO: 528706 - RNA, 23 nt, Human
guaggguuucaccauguuggcca

SEQ ID NO: 528707 - RNA, 24 nt, Human
guaggguuucaccauguuggccag

SEQ ID NO: 528708 - RNA, 25 nt, Human
guaggguuucaccauguuggccagg

SEQ ID NO: 528709 - RNA, 24 nt, Human
gugauccacccauaucagccuccc

SEQ ID NO: 528710 - RNA, 24 nt, Human
guucaugugaagucaugaaagugg

SEQ ID NO: 528711 - RNA, 21 nt, Human
uaaacagacaguauccacaua

SEQ ID NO: 528712 - RNA, 20 nt, Human
uaaagcccacauguugcaca

SEQ ID NO: 528713 - RNA, 18 nt, Human
uaaagcccacauguugcc

SEQ ID NO: 528714 - RNA, 20 nt, Human
uaaaggccaucaaugaccac

SEQ ID NO: 528715 - RNA, 21 nt, Human
uaaaguguauauccuagaagc

SEQ ID NO: 528716 - RNA, 22 nt, Human
uaaaugaugcacaacaaaaucc

SEQ ID NO: 528717 - RNA, 20 nt, Human
uaacacauaggaaccaaugc

SEQ ID NO: 528718 - RNA, 26 nt, Human
uaagaaaacagaaaauaaguaaacaa

SEQ ID NO: 528719 - RNA, 19 nt, Human
uaaguggcccuuccucacu

SEQ ID NO: 528720 - RNA, 22 nt, Human
uacaggcgugagccacuggacc

SEQ ID NO: 528721 - RNA, 22 nt, Human
uacaggcgugagccacuggacc

SEQ ID NO: 528722 - RNA, 23 nt, Human
uacaggcgugagccacuggaccu

SEQ ID NO: 528723 - RNA, 22 nt, Human
uacuguauacacagauaagaag

SEQ ID NO: 528724 - RNA, 18 nt, Human
uacuucuguacucggcug

SEQ ID NO: 528725 - RNA, 26 nt, Human
uagccaaaaaacaauucuaaacugua

SEQ ID NO: 528726 - RNA, 24 nt, Human
uaggguuucaccauguuggccagg

SEQ ID NO: 528727 - RNA, 21 nt, Human
uauaaacagacaguauccaca

SEQ ID NO: 528728 - RNA, 20 nt, Human
uauaugcacacgccaucaca

SEQ ID NO: 528729 - RNA, 22 nt, Human
uaucacacuuaaagcccacaug

SEQ ID NO: 528730 - RNA, 21 nt, Human
uauccuagaagcaaacaccau

SEQ ID NO: 528731 - RNA, 22 nt, Human
uaugaccaaguucuuugaaacc

SEQ ID NO: 528732 - RNA, 29 nt, Human
uauucuauccacuucuacuccccucucaa

SEQ ID NO: 528733 - RNA, 21 nt, Human
ucaacaccauugacagccaaa

SEQ ID NO: 528734 - RNA, 19 nt, Human
ucaagcaauucuccugccu

SEQ ID NO: 528735 - RNA, 20 nt, Human
ucaaugaccaccacugggac

SEQ ID NO: 528736 - RNA, 24 nt, Human
ucaaugcaaccucugccuccuggg

SEQ ID NO: 528737 - RNA, 18 nt, Human
ucacagaaauccaaagac

SEQ ID NO: 528738 - RNA, 21 nt, Human
ucaccauguuggccagguugg

SEQ ID NO: 528739 - RNA, 18 nt, Human
ucagccucccaaagugcu

SEQ ID NO: 528740 - RNA, 20 nt, Human
ucagccucccgaguagcugg

SEQ ID NO: 528741 - RNA, 21 nt, Human
ucagcuugcauuugcugaagu

SEQ ID NO: 528742 - RNA, 21 nt, Human
ucauugguuaaaacuuugucu

SEQ ID NO: 528743 - RNA, 21 nt, Human
uccacccauaucagccuccca

SEQ ID NO: 528744 - RNA, 22 nt, Human
uccagcaguauaaaagaaugca

SEQ ID NO: 528745 - RNA, 24 nt, Human
ucccaaagugcugggauuacaggc

SEQ ID NO: 528746 - RNA, 18 nt, Human
ucccgaguagcugggauu

SEQ ID NO: 528747 - RNA, 20 nt, Human
uccuagaagcaaacaccauc

SEQ ID NO: 528748 - RNA, 24 nt, Human
uccucaccucccuucgacaacaaa

SEQ ID NO: 528749 - RNA, 26 nt, Human
uccugacaaaugaacaucauucaaga

SEQ ID NO: 528750 - RNA, 21 nt, Human
uccuggguucaagcaauucuc

SEQ ID NO: 528751 - RNA, 24 nt, Human
uccuggguucaagcaauucuccug

SEQ ID NO: 528752 - RNA, 23 nt, Human
uccuguugcccaauucaucugcu

SEQ ID NO: 528753 - RNA, 26 nt, Human
ucuaugccacaguuaucacacuuaaa

SEQ ID NO: 528754 - RNA, 24 nt, Human
ucucacucuguugcccagccugga

SEQ ID NO: 528755 - RNA, 19 nt, Human
ucuccugacaaaugaacau

SEQ ID NO: 528756 - RNA, 25 nt, Human
ucuccugacaaaugaacaucauuca

SEQ ID NO: 528757 - RNA, 24 nt, Human
ucuccugccucagccucccgagua

SEQ ID NO: 528758 - RNA, 22 nt, Human
ucugaccuauaaauagguucua

SEQ ID NO: 528759 - RNA, 23 nt, Human
ucugaccuauaaauagguucuaa

SEQ ID NO: 528760 - RNA, 24 nt, Human
ucugccuccuggguucaagcaauu

SEQ ID NO: 528761 - RNA, 23 nt, Human
ucuguacucggcuggcaaccugu

SEQ ID NO: 528762 - RNA, 27 nt, Human
ucuguacucggcuggcaaccuguuuuu

SEQ ID NO: 528763 - RNA, 24 nt, Human
ucuguugcccagccuggagugcag

SEQ ID NO: 528764 - RNA, 21 nt, Human
ucuugaacuccugacuucaag

SEQ ID NO: 528765 - RNA, 19 nt, Human
ucuuugaugaguuguacug

SEQ ID NO: 528766 - RNA, 19 nt, Human
ugaaaucacuaaauccacu

SEQ ID NO: 528767 - RNA, 20 nt, Human
ugaaauccaagaaaagaugg

SEQ ID NO: 528768 - RNA, 19 nt, Human
ugaccaaguucuuugaaac

SEQ ID NO: 528769 - RNA, 21 nt, Human
ugacuucaagugauccaccca

SEQ ID NO: 528770 - RNA, 20 nt, Human
ugcaaccucugccuccuggg

SEQ ID NO: 528771 - RNA, 23 nt, Human
ugcaaccucugccuccuggguuc

SEQ ID NO: 528772 - RNA, 21 nt, Human
ugcagaaaaaucuggaugcuu

SEQ ID NO: 528773 - RNA, 21 nt, Human
ugcagaaaaaucuggaugcuu

SEQ ID NO: 528774 - RNA, 18 nt, Human
ugccaccgaacacccugg

SEQ ID NO: 528775 - RNA, 24 nt, Human
ugccucaaacuucacccacuaaca

SEQ ID NO: 528776 - RNA, 24 nt, Human
ugccucagccucccgaguagcugg

SEQ ID NO: 528777 - RNA, 24 nt, Human
ugcugggauuacaggcgugagcca

SEQ ID NO: 528778 - RNA, 24 nt, Human
uggaaugccagcuuuaguuagcuu

SEQ ID NO: 528779 - RNA, 19 nt, Human
uggagugcaguggcaugau

SEQ ID NO: 528780 - RNA, 23 nt, Human
uggagugcaguggcaugauccug

SEQ ID NO: 528781 - RNA, 24 nt, Human
uggagugcaguggcaugauccugg

SEQ ID NO: 528782 - RNA, 22 nt, Human
uggcaaugccaccgaacacccu

SEQ ID NO: 528783 - RNA, 24 nt, Human
uggccagguuggucuugaacuccu

SEQ ID NO: 528784 - RNA, 19 nt, Human
ugggauuacaggcgugagc

SEQ ID NO: 528785 - RNA, 21 nt, Human
ugggauuacaggcgugagcca

SEQ ID NO: 528786 - RNA, 22 nt, Human
ugggauuacaggcgugagccac

SEQ ID NO: 528787 - RNA, 22 nt, Human
ugggauuacaggcgugagccac

SEQ ID NO: 528788 - RNA, 23 nt, Human
ugggauuacaggcgugagccacu

SEQ ID NO: 528789 - RNA, 24 nt, Human
ugggauuacaggcgugagccacug

SEQ ID NO: 528790 - RNA, 26 nt, Human
ugggauuauauaugcacacgccauca

SEQ ID NO: 528791 - RNA, 21 nt, Human
uggguucaagcaauucuccug

SEQ ID NO: 528792 - RNA, 23 nt, Human
uggguucaagcaauucuccugcc

SEQ ID NO: 528793 - RNA, 24 nt, Human
uggguucaagcaauucuccugccu

SEQ ID NO: 528794 - RNA, 20 nt, Human
uguaacuggugcccugagac

SEQ ID NO: 528795 - RNA, 20 nt, Human
ugucuaaagaagucaguuuc

SEQ ID NO: 528796 - RNA, 24 nt, Human
uguucauguggcuaugaaaacaag

SEQ ID NO: 528797 - RNA, 27 nt, Human
uuaagcagcuccaauuuacuaaaggcc

SEQ ID NO: 528798 - RNA, 23 nt, Human
uuacauuuaaaaaauauaucuga

SEQ ID NO: 528799 - RNA, 18 nt, Human
uuaguaggguuucaccau

SEQ ID NO: 528800 - RNA, 23 nt, Human
uuauccccaaacaaaaguuuaca

SEQ ID NO: 528801 - RNA, 20 nt, Human
uucaacuacugcagaauuaa

SEQ ID NO: 528802 - RNA, 21 nt, Human
uucaagcaauucuccugccuc

SEQ ID NO: 528803 - RNA, 24 nt, Human
uucaagcaauucuccugccucagc

SEQ ID NO: 528804 - RNA, 24 nt, Human
uucaagugauccacccauaucagc

SEQ ID NO: 528805 - RNA, 24 nt, Human
uucacccacuaacaacccuagcca

SEQ ID NO: 528806 - RNA, 22 nt, Human
uucauugugguuaaaagaaauu

SEQ ID NO: 528807 - RNA, 22 nt, Human
uucuguacucggcuggcaaccu

SEQ ID NO: 528808 - RNA, 19 nt, Human
uugcauuugcugaaguuuc

SEQ ID NO: 528809 - RNA, 19 nt, Human
uugcugaaguuucugcuuc

SEQ ID NO: 528810 - RNA, 20 nt, Human
uugcugaaguuucugcuucu

SEQ ID NO: 528811 - RNA, 19 nt, Human
uuguacugacaacuccaaa

SEQ ID NO: 528812 - RNA, 19 nt, Human
uuuaaaacucauggcuaac

SEQ ID NO: 528813 - RNA, 24 nt, Human
uuuaaaguguauauccuagaagca

SEQ ID NO: 528814 - RNA, 18 nt, Human
uuuaguaggguuucacca

SEQ ID NO: 528815 - RNA, 19 nt, Human
uuucaccauguuggccagg

SEQ ID NO: 528816 - RNA, 20 nt, Human
uuucaccauguuggccaggu

SEQ ID NO: 528817 - RNA, 21 nt, Human
uuuccuguaacacauaggaac

SEQ ID NO: 528818 - RNA, 18 nt, Human
uuuuuguauuuuuaguag

SEQ ID NO: 528819 - RNA, 18 nt, Human
aaauagugauuuccucaa

SEQ ID NO: 528820 - RNA, 24 nt, Human
aacacagaacaccugccugcccac

SEQ ID NO: 528821 - RNA, 20 nt, Human
aaccugggggggaaacgggg

SEQ ID NO: 528822 - RNA, 20 nt, Human
aaggguccaggggaguuguu

SEQ ID NO: 528823 - RNA, 19 nt, Human
accgaccagucaaggaggu

SEQ ID NO: 528824 - RNA, 21 nt, Human
acucuuuaagaacuccuccug

SEQ ID NO: 528825 - RNA, 22 nt, Human
agaauaaccacugaaucccaaa

SEQ ID NO: 528826 - RNA, 25 nt, Human
agagcuucuccgaagcagcggucau

SEQ ID NO: 528827 - RNA, 21 nt, Human
agcagggaaccagggcuggcc

SEQ ID NO: 528828 - RNA, 21 nt, Human
agccccuggcacccacagccc

SEQ ID NO: 528829 - RNA, 24 nt, Human
agcgacgccagcuucagcagcgcg

SEQ ID NO: 528830 - RNA, 21 nt, Human
agcuuuagaaaagccccuagg

SEQ ID NO: 528831 - RNA, 23 nt, Human
aggacgguggcugcagcagggaa

SEQ ID NO: 528832 - RNA, 18 nt, Human
aggcagcuuugcuccucu

SEQ ID NO: 528833 - RNA, 19 nt, Human
agggagcagccugggcugc

SEQ ID NO: 528834 - RNA, 24 nt, Human
aguaacagugacugcaguuagggu

SEQ ID NO: 528835 - RNA, 19 nt, Human
agucagaugcaggcccaag

SEQ ID NO: 528836 - RNA, 19 nt, Human
agugacaggaacgugggga

SEQ ID NO: 528837 - RNA, 23 nt, Human
auagauauccuaauaaaaguuuu

SEQ ID NO: 528838 - RNA, 20 nt, Human
augugcaauauucagucaac

SEQ ID NO: 528839 - RNA, 22 nt, Human
caaggagguguuggugggagug

SEQ ID NO: 528840 - RNA, 22 nt, Human
cacccacagccccggcgcgcuc

SEQ ID NO: 528841 - RNA, 19 nt, Human
caccugccugcccaccccc

SEQ ID NO: 528842 - RNA, 19 nt, Human
cacugaaucccaaaaaguc

SEQ ID NO: 528843 - RNA, 21 nt, Human
cacuuggaaggcagcuuugcu

SEQ ID NO: 528844 - RNA, 22 nt, Human
cagacaggcacuuggaaggcag

SEQ ID NO: 528845 - RNA, 19 nt, Human
cagaugggacaaacugggg

SEQ ID NO: 528846 - RNA, 23 nt, Human
cagaugggacaaacugggggccu

SEQ ID NO: 528847 - RNA, 22 nt, Human
cagcagcgcggggcggcggcgc

SEQ ID NO: 528848 - RNA, 19 nt, Human
cagccagggcaccccgggc

SEQ ID NO: 528849 - RNA, 21 nt, Human
cagccagggcaccccgggcga

SEQ ID NO: 528850 - RNA, 23 nt, Human
cagccccuggcacccacagcccc

SEQ ID NO: 528851 - RNA, 26 nt, Human
cagccgcugcaggucgggcccugguc

SEQ ID NO: 528852 - RNA, 21 nt, Human
cagcggcgucuccuccugcuc

SEQ ID NO: 528853 - RNA, 20 nt, Human
cagcuuugcuccucuggcca

SEQ ID NO: 528854 - RNA, 20 nt, Human
caggauuucggugaugggcc

SEQ ID NO: 528855 - RNA, 22 nt, Human
caggcccaaggguccaggggag

SEQ ID NO: 528856 - RNA, 19 nt, Human
caugcaggcuuuugugugg

SEQ ID NO: 528857 - RNA, 22 nt, Human
ccacccggaaaccucccagcag

SEQ ID NO: 528858 - RNA, 23 nt, Human
ccacccggaaaccucccagcagu

SEQ ID NO: 528859 - RNA, 19 nt, Human
ccacccugagaccgggcgc

SEQ ID NO: 528860 - RNA, 23 nt, Human
ccaggugcgacagcucaggccgg

SEQ ID NO: 528861 - RNA, 26 nt, Human
cccacagcuggaggggcacuuaaggc

SEQ ID NO: 528862 - RNA, 19 nt, Human
ccccggccugcuccgauga

SEQ ID NO: 528863 - RNA, 20 nt, Human
ccccuaggaguguccaccuc

SEQ ID NO: 528864 - RNA, 22 nt, Human
cccgccaggccaccucucaccc

SEQ ID NO: 528865 - RNA, 20 nt, Human
cccugagaccgggcgcgggc

SEQ ID NO: 528866 - RNA, 18 nt, Human
cccugaguccuggcgcuc

SEQ ID NO: 528867 - RNA, 24 nt, Human
ccgccaggccaccucucacccagc

SEQ ID NO: 528868 - RNA, 20 nt, Human
ccggcagcggugggaaaggg

SEQ ID NO: 528869 - RNA, 21 nt, Human
ccuagcacucagccccuggcc

SEQ ID NO: 528870 - RNA, 19 nt, Human
ccucgucuguggggacggg

SEQ ID NO: 528871 - RNA, 21 nt, Human
ccuggacucagcuucugacuc

SEQ ID NO: 528872 - RNA, 21 nt, Human
cgacagcucaggccggagacc

SEQ ID NO: 528873 - RNA, 20 nt, Human
cgagcggccagccauggcgc

SEQ ID NO: 528874 - RNA, 25 nt, Human
cgcggacccuucccgccggcggcgu

SEQ ID NO: 528875 - RNA, 23 nt, Human
cggccagccauggcgcgcggacc

SEQ ID NO: 528876 - RNA, 18 nt, Human
cggugaugggcccucccu

SEQ ID NO: 528877 - RNA, 18 nt, Human
cggugcugaagaccgacc

SEQ ID NO: 528878 - RNA, 20 nt, Human
cucacccagccagggcaccc

SEQ ID NO: 528879 - RNA, 21 nt, Human
cucacccagccagggcacccc

SEQ ID NO: 528880 - RNA, 28 nt, Human
cucagccccuggcacccacagccccggc

SEQ ID NO: 528881 - RNA, 20 nt, Human
cuccaccacuuccaccgugc

SEQ ID NO: 528882 - RNA, 23 nt, Human
cugcagcagggaaccagggcugg

SEQ ID NO: 528883 - RNA, 21 nt, Human
cugcagccgcugcaggucggg

SEQ ID NO: 528884 - RNA, 20 nt, Human
cugcaguuagggucgagagc

SEQ ID NO: 528885 - RNA, 24 nt, Human
cugcccacccccggugcugaagac

SEQ ID NO: 528886 - RNA, 21 nt, Human
cugcucuguucucccaggcac

SEQ ID NO: 528887 - RNA, 24 nt, Human
cuucagcagcgcggggcggcggcg

SEQ ID NO: 528888 - RNA, 19 nt, Human
gaaggcagcuuugcuccuc

SEQ ID NO: 528889 - RNA, 21 nt, Human
gacaggaacguggggaucccc

SEQ ID NO: 528890 - RNA, 18 nt, Human
gacugggcagggcuugcu

SEQ ID NO: 528891 - RNA, 18 nt, Human
gagucccuagcacucagc

SEQ ID NO: 528892 - RNA, 18 nt, Human
gcacuuggaaggcagcuu

SEQ ID NO: 528893 - RNA, 21 nt, Human
gcacuuggaaggcagcuuugc

SEQ ID NO: 528894 - RNA, 18 nt, Human
gcagcggugggaaagggc

SEQ ID NO: 528895 - RNA, 24 nt, Human
gccucgguuucccggcagcggugg

SEQ ID NO: 528896 - RNA, 21 nt, Human
ggaaggcagcuuugcuccucu

SEQ ID NO: 528897 - RNA, 22 nt, Human
ggaucuguccaguagggucacu

SEQ ID NO: 528898 - RNA, 18 nt, Human
ggccugcagccgcugcag

SEQ ID NO: 528899 - RNA, 21 nt, Human
ggcgcggggcucgguuggggg

SEQ ID NO: 528900 - RNA, 18 nt, Human
gggcagguacuggcuuua

SEQ ID NO: 528901 - RNA, 19 nt, Human
gguaaccggguguccaggg

SEQ ID NO: 528902 - RNA, 18 nt, Human
gguagggagcagccuggg

SEQ ID NO: 528903 - RNA, 18 nt, Human
gguccccgagucaguccc

SEQ ID NO: 528904 - RNA, 23 nt, Human
gguccccgagucaguccccgggc

SEQ ID NO: 528905 - RNA, 20 nt, Human
gugauucuuggcaagcuccu

SEQ ID NO: 528906 - RNA, 18 nt, Human
gugccgggaaggccaggc

SEQ ID NO: 528907 - RNA, 24 nt, Human
gugcguggcacgagggcggcagcg

SEQ ID NO: 528908 - RNA, 21 nt, Human
guguccaccuccaccacuucc

SEQ ID NO: 528909 - RNA, 23 nt, Human
uaaauagauauccuaauaaaagu

SEQ ID NO: 528910 - RNA, 18 nt, Human
uaacagugacugcaguua

SEQ ID NO: 528911 - RNA, 22 nt, Human
uaaccacugaaucccaaaaagu

SEQ ID NO: 528912 - RNA, 19 nt, Human
uaauuuaaaauauuuugau

SEQ ID NO: 528913 - RNA, 25 nt, Human
uacacaauuuucacucauaauuuaa

SEQ ID NO: 528914 - RNA, 25 nt, Human
uaccgcaucuucuuugcugacuuug

SEQ ID NO: 528915 - RNA, 25 nt, Human
ucagaugggacaaacugggggccug

SEQ ID NO: 528916 - RNA, 18 nt, Human
ucagccccuggcacccac

SEQ ID NO: 528917 - RNA, 20 nt, Human
ucaguauuaaauagauaucc

SEQ ID NO: 528918 - RNA, 18 nt, Human
ucccaaaaagucacugcg

SEQ ID NO: 528919 - RNA, 19 nt, Human
uccccaaacgcugagcaga

SEQ ID NO: 528920 - RNA, 23 nt, Human
uccccacucaugacgagucccua

SEQ ID NO: 528921 - RNA, 21 nt, Human
uccccgagucaguccccgggc

SEQ ID NO: 528922 - RNA, 19 nt, Human
uccccgggcgcggggcucg

SEQ ID NO: 528923 - RNA, 20 nt, Human
ucccuagcacucagccccug

SEQ ID NO: 528924 - RNA, 24 nt, Human
ucccuagcacucagccccuggcac

SEQ ID NO: 528925 - RNA, 19 nt, Human
uccgcgccaggugcgacag

SEQ ID NO: 528926 - RNA, 22 nt, Human
uccggggccgccacccugagac

SEQ ID NO: 528927 - RNA, 24 nt, Human
ucuaguaaucguucaggauuucgg

SEQ ID NO: 528928 - RNA, 20 nt, Human
ugaaauguuuuuaauagaau

SEQ ID NO: 528929 - RNA, 19 nt, Human
ugacagcagugacaggaac

SEQ ID NO: 528930 - RNA, 24 nt, Human
ugagaccgggcgcgggcaggacgg

SEQ ID NO: 528931 - RNA, 23 nt, Human
ugaguccuggcgcucgggagguc

SEQ ID NO: 528932 - RNA, 19 nt, Human
ugauuaauauuauagcugc

SEQ ID NO: 528933 - RNA, 22 nt, Human
ugauuagaauuacacgaaauuu

SEQ ID NO: 528934 - RNA, 18 nt, Human
ugccgggaaggccaggcc

SEQ ID NO: 528935 - RNA, 22 nt, Human
ugccgugagugagguguucuca

SEQ ID NO: 528936 - RNA, 19 nt, Human
ugcgacagcucaggccgga

SEQ ID NO: 528937 - RNA, 23 nt, Human
ugcgggcgcugggccugcagccg

SEQ ID NO: 528938 - RNA, 19 nt, Human
ugcucuguucucccaggca

SEQ ID NO: 528939 - RNA, 21 nt, Human
ugcucuguucucccaggcaca

SEQ ID NO: 528940 - RNA, 18 nt, Human
uggcaagcuccgcccgcc

SEQ ID NO: 528941 - RNA, 20 nt, Human
uggcaagcuccgcccgccag

SEQ ID NO: 528942 - RNA, 20 nt, Human
uggccuuggaucuguccagu

SEQ ID NO: 528943 - RNA, 18 nt, Human
uggcugacgcuucccuuu

SEQ ID NO: 528944 - RNA, 18 nt, Human
uggcugacgcuucccuuu

SEQ ID NO: 528945 - RNA, 22 nt, Human
uggcugcagcagggaaccaggg

SEQ ID NO: 528946 - RNA, 22 nt, Human
uggcugcauuuugugcucagag

SEQ ID NO: 528947 - RNA, 18 nt, Human
ugggaaagggcgcgagcg

SEQ ID NO: 528948 - RNA, 18 nt, Human
ugguagggagcagccugg

SEQ ID NO: 528949 - RNA, 19 nt, Human
uguggcugacgcuucccuu

SEQ ID NO: 528950 - RNA, 20 nt, Human
uuguguggcugacgcuuccc

SEQ ID NO: 528951 - RNA, 24 nt, Human
aaaaaaaaaaaacucauuugaagg

SEQ ID NO: 528952 - RNA, 20 nt, Human
aaaaccuuuugcuuugccaa

SEQ ID NO: 528953 - RNA, 21 nt, Human
aacugacagaggaaagaggaa

SEQ ID NO: 528954 - RNA, 20 nt, Human
aaucucugccucccugguuc

SEQ ID NO: 528955 - RNA, 24 nt, Human
aaugauucuacugccucagccucc

SEQ ID NO: 528956 - RNA, 25 nt, Human
acacugucacccaggcuagagugca

SEQ ID NO: 528957 - RNA, 23 nt, Human
acagaggaaagaggaagacaagg

SEQ ID NO: 528958 - RNA, 23 nt, Human
acagaguaagacucugucuaaaa

SEQ ID NO: 528959 - RNA, 23 nt, Human
acgccacaggcuggguuaccagu

SEQ ID NO: 528960 - RNA, 20 nt, Human
acucccaccugcccaccccu

SEQ ID NO: 528961 - RNA, 24 nt, Human
acugcacuccagccuaggugacag

SEQ ID NO: 528962 - RNA, 26 nt, Human
acugcacuccagccuaggugacagag

SEQ ID NO: 528963 - RNA, 23 nt, Human
acugccucagccuccugaguaga

SEQ ID NO: 528964 - RNA, 19 nt, Human
acugggcaauucuuagccu

SEQ ID NO: 528965 - RNA, 20 nt, Human
acugugccacugcacuccag

SEQ ID NO: 528966 - RNA, 18 nt, Human
agacagagucucacacug

SEQ ID NO: 528967 - RNA, 24 nt, Human
agagacugugccacugcacuccag

SEQ ID NO: 528968 - RNA, 22 nt, Human
agaggaaagaggaagacaaggc

SEQ ID NO: 528969 - RNA, 21 nt, Human
agaguaagacucugucuaaaa

SEQ ID NO: 528970 - RNA, 24 nt, Human
agccuaggugacagaguaagacuc

SEQ ID NO: 528971 - RNA, 23 nt, Human
aggcgguccuccgccucagccuc

SEQ ID NO: 528972 - RNA, 24 nt, Human
aggcgguccuccgccucagccucc

SEQ ID NO: 528973 - RNA, 23 nt, Human
augauucuacugccucagccucc

SEQ ID NO: 528974 - RNA, 22 nt, Human
caaaauggugggauuacaggug

SEQ ID NO: 528975 - RNA, 24 nt, Human
cacacugucacccaggcuagagug

SEQ ID NO: 528976 - RNA, 20 nt, Human
caccugcccaccccucuaga

SEQ ID NO: 528977 - RNA, 18 nt, Human
cacugcaaucucugccuc

SEQ ID NO: 528978 - RNA, 19 nt, Human
cacugcacuccagccuagg

SEQ ID NO: 528979 - RNA, 21 nt, Human
cacugcacuccagccuaggug

SEQ ID NO: 528980 - RNA, 23 nt, Human
cacugcacuccagccuaggugac

SEQ ID NO: 528981 - RNA, 24 nt, Human
cacugcacuccagccuaggugaca

SEQ ID NO: 528982 - RNA, 24 nt, Human
cacugcacuccagccuaggugaca

SEQ ID NO: 528983 - RNA, 18 nt, Human
cagagcacugcgacugac

SEQ ID NO: 528984 - RNA, 23 nt, Human
ccaaagccaauuaaguccuagca

SEQ ID NO: 528985 - RNA, 21 nt, Human
ccacagugccuggccaaagcu

SEQ ID NO: 528986 - RNA, 19 nt, Human
ccacugcacuccagccuag

SEQ ID NO: 528987 - RNA, 20 nt, Human
ccacugcacuccagccuagg

SEQ ID NO: 528988 - RNA, 20 nt, Human
ccacugcacuccagccuagg

SEQ ID NO: 528989 - RNA, 21 nt, Human
ccacugcacuccagccuaggu

SEQ ID NO: 528990 - RNA, 24 nt, Human
ccacugcacuccagccuaggugac

SEQ ID NO: 528991 - RNA, 22 nt, Human
cccaccugcccaccccucuaga

SEQ ID NO: 528992 - RNA, 18 nt, Human
cccuugaggccaagguag

SEQ ID NO: 528993 - RNA, 22 nt, Human
ccgccucagccucccaaaaugg

SEQ ID NO: 528994 - RNA, 22 nt, Human
ccuaggugacagaguaagacuc

SEQ ID NO: 528995 - RNA, 18 nt, Human
ccuccgccucagccuccc

SEQ ID NO: 528996 - RNA, 20 nt, Human
ccucuagaaccgacuacacc

SEQ ID NO: 528997 - RNA, 25 nt, Human
cucacugcaaucucugccucccugg

SEQ ID NO: 528998 - RNA, 23 nt, Human
cucugucuaaaaaaaaaaaaaaa

SEQ ID NO: 528999 - RNA, 24 nt, Human
cugaaugaacccaagguguuacau

SEQ ID NO: 529000 - RNA, 24 nt, Human
cugagguagguacuuuuuuuuuuu

SEQ ID NO: 529001 - RNA, 24 nt, Human
cugcaaucucugccucccugguuc

SEQ ID NO: 529002 - RNA, 24 nt, Human
cugcuauguaaaagagcuggaggu

SEQ ID NO: 529003 - RNA, 23 nt, Human
cugucacccaggcuagagugcag

SEQ ID NO: 529004 - RNA, 24 nt, Human
cugucuaaaaaaaaaaaaaaaacu

SEQ ID NO: 529005 - RNA, 18 nt, Human
cuuuuuuuuuuuuuuuug

SEQ ID NO: 529006 - RNA, 24 nt, Human
gcacuccagccuaggugacagagu

SEQ ID NO: 529007 - RNA, 23 nt, Human
gccagguauuuuuccaaagugcc

SEQ ID NO: 529008 - RNA, 18 nt, Human
gcccaccccucuagaacc

SEQ ID NO: 529009 - RNA, 23 nt, Human
gccucagccucccaaaauggugg

SEQ ID NO: 529010 - RNA, 23 nt, Human
gcgguccuccgccucagccuccc

SEQ ID NO: 529011 - RNA, 22 nt, Human
ggcugguggccuuggguagggc

SEQ ID NO: 529012 - RNA, 24 nt, Human
gggaaaaugaggagagccgguacc

SEQ ID NO: 529013 - RNA, 21 nt, Human
gguacuuuuuuuuuuuuuuuu

SEQ ID NO: 529014 - RNA, 25 nt, Human
uaaaaaaaaaaaaaaaacucauuug

SEQ ID NO: 529015 - RNA, 23 nt, Human
uacacaugagggagaagaauaag

SEQ ID NO: 529016 - RNA, 24 nt, Human
uacacaugagggagaagaauaagc

SEQ ID NO: 529017 - RNA, 21 nt, Human
uacuuuuuuuuuuuuuuuuga

SEQ ID NO: 529018 - RNA, 18 nt, Human
uagaaccgacuacaccca

SEQ ID NO: 529019 - RNA, 21 nt, Human
uagaaccgacuacacccauga

SEQ ID NO: 529020 - RNA, 26 nt, Human
uaugccagguauuuuuccaaagugcc

SEQ ID NO: 529021 - RNA, 24 nt, Human
uauguugcccagagugguucugaa

SEQ ID NO: 529022 - RNA, 22 nt, Human
ucaaaaauaguaaucuuguacu

SEQ ID NO: 529023 - RNA, 24 nt, Human
ucacacugucacccaggcuagagu

SEQ ID NO: 529024 - RNA, 25 nt, Human
ucacacugucacccaggcuagagug

SEQ ID NO: 529025 - RNA, 19 nt, Human
ucacugcaaucucugccuc

SEQ ID NO: 529026 - RNA, 24 nt, Human
ucacugcaaucucugccucccugg

SEQ ID NO: 529027 - RNA, 24 nt, Human
ucacugcaaucucugccucccugg

SEQ ID NO: 529028 - RNA, 22 nt, Human
ucagccuccugaguagagacug

SEQ ID NO: 529029 - RNA, 23 nt, Human
ucccaaaauggugggauuacagg

SEQ ID NO: 529030 - RNA, 19 nt, Human
ucccaccugcccaccccuc

SEQ ID NO: 529031 - RNA, 19 nt, Human
ucccugguucaaaugauuc

SEQ ID NO: 529032 - RNA, 21 nt, Human
ucccuguuuuggggaaaauga

SEQ ID NO: 529033 - RNA, 24 nt, Human
ucucacacugucacccaggcuaga

SEQ ID NO: 529034 - RNA, 22 nt, Human
ucugucuaaaaaaaaaaaaaaa

SEQ ID NO: 529035 - RNA, 23 nt, Human
ucugucuaaaaaaaaaaaaaaaa

SEQ ID NO: 529036 - RNA, 24 nt, Human
ucuucauggaagaucucuacuaua

SEQ ID NO: 529037 - RNA, 24 nt, Human
ucuuccucagcuacucccaccugc

SEQ ID NO: 529038 - RNA, 22 nt, Human
ugagacagagucucacacuguc

SEQ ID NO: 529039 - RNA, 22 nt, Human
ugagggagaagaauaagcccug

SEQ ID NO: 529040 - RNA, 22 nt, Human
ugcagccaugcaaucucggcuc

SEQ ID NO: 529041 - RNA, 23 nt, Human
ugcagccaugcaaucucggcuca

SEQ ID NO: 529042 - RNA, 19 nt, Human
ugcccaccccucuagaacc

SEQ ID NO: 529043 - RNA, 22 nt, Human
ugccucagccuccugaguagag

SEQ ID NO: 529044 - RNA, 23 nt, Human
ugcgacugacgccacaggcuggg

SEQ ID NO: 529045 - RNA, 24 nt, Human
ugcuauaguguuggccagagcacu

SEQ ID NO: 529046 - RNA, 21 nt, Human
ugggaaaaguuauucuccugg

SEQ ID NO: 529047 - RNA, 18 nt, Human
ugggauuacaggugagcg

SEQ ID NO: 529048 - RNA, 21 nt, Human
ugggauuacaggugagcgcca

SEQ ID NO: 529049 - RNA, 22 nt, Human
ugggauuacaggugagcgccac

SEQ ID NO: 529050 - RNA, 21 nt, Human
uggggaaaaugaggagagcug

SEQ ID NO: 529051 - RNA, 21 nt, Human
uggguuaccaguuaaagucuc

SEQ ID NO: 529052 - RNA, 20 nt, Human
ugguucugaauuccuugccu

SEQ ID NO: 529053 - RNA, 23 nt, Human
uucaaaugauucuacugccucag

SEQ ID NO: 529054 - RNA, 23 nt, Human
uucagucccuaccugagguaggu

SEQ ID NO: 529055 - RNA, 23 nt, Human
uucccuugguucuagccuugauu

SEQ ID NO: 529056 - RNA, 23 nt, Human
uugauccucauucauaugucauu

SEQ ID NO: 529057 - RNA, 20 nt, Human
uuuuuuuuuuugagacagag

SEQ ID NO: 529058 - RNA, 26 nt, Human
uuuuuuuuuuuugagacagagucuca

SEQ ID NO: 529059 - RNA, 25 nt, Human
aaaagaagaaaaauugcagucagag

SEQ ID NO: 529060 - RNA, 21 nt, Human
aagcaaucauucuggaaucca

SEQ ID NO: 529061 - RNA, 19 nt, Human
aagccagauacugcagaga

SEQ ID NO: 529062 - RNA, 23 nt, Human
aaugguagcuguauguauguaac

SEQ ID NO: 529063 - RNA, 18 nt, Human
accagauggacaagccag

SEQ ID NO: 529064 - RNA, 21 nt, Human
accuuaaaaauacaguaaagc

SEQ ID NO: 529065 - RNA, 21 nt, Human
agacagaaaguauuucuccuu

SEQ ID NO: 529066 - RNA, 24 nt, Human
agaucaaccucaacuugaaaccca

SEQ ID NO: 529067 - RNA, 22 nt, Human
agaugacuugucaaucuggaac

SEQ ID NO: 529068 - RNA, 25 nt, Human
agcacagacacccugaaugaagccc

SEQ ID NO: 529069 - RNA, 25 nt, Human
agugacagaggaaauaacugaaaga

SEQ ID NO: 529070 - RNA, 25 nt, Human
auaagacagaaaguauuucuccuuc

SEQ ID NO: 529071 - RNA, 23 nt, Human
aucaagaucaaccucaacuugaa

SEQ ID NO: 529072 - RNA, 22 nt, Human
auuaaaauauauauauauauau

SEQ ID NO: 529073 - RNA, 21 nt, Human
caacaauuguagaucaagauc

SEQ ID NO: 529074 - RNA, 22 nt, Human
cagacacccugaaugaagcccc

SEQ ID NO: 529075 - RNA, 20 nt, Human
cagaggccaccaugcacugu

SEQ ID NO: 529076 - RNA, 23 nt, Human
cccaacaauuguagaucaagauc

SEQ ID NO: 529077 - RNA, 18 nt, Human
cccugaaugaagccccug

SEQ ID NO: 529078 - RNA, 19 nt, Human
ccuauuccccaaccuggcu

SEQ ID NO: 529079 - RNA, 21 nt, Human
ccuuccucuccucucaccucc

SEQ ID NO: 529080 - RNA, 19 nt, Human
cugacucauggcuggggaa

SEQ ID NO: 529081 - RNA, 24 nt, Human
cugcauugcuuccuuuucccaaca

SEQ ID NO: 529082 - RNA, 23 nt, Human
cugggcuuuucggggaagacucu

SEQ ID NO: 529083 - RNA, 25 nt, Human
cuuaugaaggcagucgaguggcauu

SEQ ID NO: 529084 - RNA, 19 nt, Human
gaacaaagucuaucaugua

SEQ ID NO: 529085 - RNA, 19 nt, Human
gaagaagcagccaccuuag

SEQ ID NO: 529086 - RNA, 23 nt, Human
gaagaagcagccaccuuagacca

SEQ ID NO: 529087 - RNA, 28 nt, Human
gcacagcuuucaacaaaaagggaacgcc

SEQ ID NO: 529088 - RNA, 28 nt, Human
ggaaauaacugaaagaugaccgguaccc

SEQ ID NO: 529089 - RNA, 19 nt, Human
ggaggguuccuggagaagg

SEQ ID NO: 529090 - RNA, 23 nt, Human
guggcauuugcaaaagaagaaaa

SEQ ID NO: 529091 - RNA, 19 nt, Human
uaagagcuccuauucccca

SEQ ID NO: 529092 - RNA, 22 nt, Human
uacaguaaagcagucauggaaa

SEQ ID NO: 529093 - RNA, 20 nt, Human
uagcuguauguauguaacuc

SEQ ID NO: 529094 - RNA, 24 nt, Human
uauccuauggacgcuuaugaaggc

SEQ ID NO: 529095 - RNA, 18 nt, Human
uaugaaggcagucgagug

SEQ ID NO: 529096 - RNA, 19 nt, Human
uauugggcaagcuggaguu

SEQ ID NO: 529097 - RNA, 23 nt, Human
uauugggcaagcuggaguuuuga

SEQ ID NO: 529098 - RNA, 23 nt, Human
uccaugucugcuguaauguaucc

SEQ ID NO: 529099 - RNA, 19 nt, Human
uccccaaccuggcuucccu

SEQ ID NO: 529100 - RNA, 18 nt, Human
ugaaggcagucgaguggc

SEQ ID NO: 529101 - RNA, 18 nt, Human
ugauuugaaaggaaaaaa

SEQ ID NO: 529102 - RNA, 18 nt, Human
ugcagagaaguuucuggg

SEQ ID NO: 529103 - RNA, 21 nt, Human
ugcagagaaguuucugggcuu

SEQ ID NO: 529104 - RNA, 21 nt, Human
ugcagucagagcacagacacc

SEQ ID NO: 529105 - RNA, 23 nt, Human
ugcagucagagcacagacacccu

SEQ ID NO: 529106 - RNA, 19 nt, Human
uggcuggggaagaagcagc

SEQ ID NO: 529107 - RNA, 22 nt, Human
uguaaacacaaaagaaaguguc

SEQ ID NO: 529108 - RNA, 28 nt, Human
uguaaacacaaaagaaagugucucagca

SEQ ID NO: 529109 - RNA, 18 nt, Human
uuagaccagauggacaag

SEQ ID NO: 529110 - RNA, 27 nt, Human
uuccuggagaagguaauauaacagugg

SEQ ID NO: 529111 - RNA, 18 nt, Human
uugaccuuaaaaauacag

SEQ ID NO: 529112 - RNA, 20 nt, Human
uugaccuuaaaaauacagua

SEQ ID NO: 529113 - RNA, 24 nt, Human
uuuucauauaaaaugguagcugua

SEQ ID NO: 529114 - RNA, 20 nt, Human
aagcagccagcuuagcaaag

SEQ ID NO: 529115 - RNA, 23 nt, Human
acaacagccccugggaccaggcc

SEQ ID NO: 529116 - RNA, 18 nt, Human
acaguuucugaaacacug

SEQ ID NO: 529117 - RNA, 19 nt, Human
agagaugaaacaaggagga

SEQ ID NO: 529118 - RNA, 21 nt, Human
agaugguagaagcagccagcu

SEQ ID NO: 529119 - RNA, 19 nt, Human
aggaggaacuggugugaaa

SEQ ID NO: 529120 - RNA, 21 nt, Human
aucccaucauuccuccuccuu

SEQ ID NO: 529121 - RNA, 23 nt, Human
aucccaucauuccuccuccuuca

SEQ ID NO: 529122 - RNA, 20 nt, Human
caaagaaucacacccagggc

SEQ ID NO: 529123 - RNA, 23 nt, Human
cacaacagccccugggaccaggc

SEQ ID NO: 529124 - RNA, 19 nt, Human
cagccccugggaccaggcc

SEQ ID NO: 529125 - RNA, 25 nt, Human
cagggugaccaccccuuuguguccc

SEQ ID NO: 529126 - RNA, 18 nt, Human
ccacaacagccccuggga

SEQ ID NO: 529127 - RNA, 23 nt, Human
cccacaacagccccugggaccag

SEQ ID NO: 529128 - RNA, 20 nt, Human
ccccugggaccaggccacuu

SEQ ID NO: 529129 - RNA, 20 nt, Human
cuccccacaacagccccugg

SEQ ID NO: 529130 - RNA, 23 nt, Human
cuguuugcucuguaucuucuuua

SEQ ID NO: 529131 - RNA, 21 nt, Human
cuucaaauugaagccaaagaa

SEQ ID NO: 529132 - RNA, 23 nt, Human
gagaugaaacaaggaggaacugg

SEQ ID NO: 529133 - RNA, 26 nt, Human
gaugguagaagcagccagcuuagcaa

SEQ ID NO: 529134 - RNA, 18 nt, Human
gccaaagaaucacaccca

SEQ ID NO: 529135 - RNA, 20 nt, Human
gggcagggugaccaccccuu

SEQ ID NO: 529136 - RNA, 24 nt, Human
gggcagggugaccaccccuuugug

SEQ ID NO: 529137 - RNA, 20 nt, Human
uauuagaugguagaagcagc

SEQ ID NO: 529138 - RNA, 21 nt, Human
uccccacaacagccccuggga

SEQ ID NO: 529139 - RNA, 23 nt, Human
uccccacaacagccccugggacc

SEQ ID NO: 529140 - RNA, 24 nt, Human
ugaaauaaaauaugaaaucccauc

SEQ ID NO: 529141 - RNA, 18 nt, Human
ugaaaucccaucauuccu

SEQ ID NO: 529142 - RNA, 19 nt, Human
ugaaaucccaucauuccuc

SEQ ID NO: 529143 - RNA, 21 nt, Human
ugagggcagggugaccacccc

SEQ ID NO: 529144 - RNA, 24 nt, Human
ugcucuguaucuucuuuacucuca

SEQ ID NO: 529145 - RNA, 19 nt, Human
ugggaccaggccacugucc

SEQ ID NO: 529146 - RNA, 23 nt, Human
ugggaccaggccacuguccuagg

SEQ ID NO: 529147 - RNA, 22 nt, Human
uguuugcucuguaucuucuuua

SEQ ID NO: 529148 - RNA, 21 nt, Human
uugaagccaaagaaucacacc

SEQ ID NO: 529149 - RNA, 22 nt, Human
uugaagccaaagaaucacaccc

SEQ ID NO: 529150 - RNA, 25 nt, Human
uuuuuuuuuuuuuuuuuuaacuugg

SEQ ID NO: 529151 - RNA, 27 nt, Human
aaaaagaauccuucucaaaagaguaaa

SEQ ID NO: 529152 - RNA, 24 nt, Human
aaggaaaagaaaugcuuccaagag

SEQ ID NO: 529153 - RNA, 18 nt, Human
aaggcacuaaguggcaca

SEQ ID NO: 529154 - RNA, 20 nt, Human
aguaauaugaaaauagacac

SEQ ID NO: 529155 - RNA, 19 nt, Human
auccuccauccccucccca

SEQ ID NO: 529156 - RNA, 22 nt, Human
auccuccauccccuccccaucg

SEQ ID NO: 529157 - RNA, 25 nt, Human
augagguuauccuccauccccuccc

SEQ ID NO: 529158 - RNA, 23 nt, Human
cagaaacccagaaaucaguaggg

SEQ ID NO: 529159 - RNA, 20 nt, Human
cauaaagaacuuaaaagcug

SEQ ID NO: 529160 - RNA, 22 nt, Human
ccuccauccccuccccaucgug

SEQ ID NO: 529161 - RNA, 28 nt, Human
ccuguggccguggcagaaaccggggucc

SEQ ID NO: 529162 - RNA, 19 nt, Human
cuuaaaaggcacuaagugg

SEQ ID NO: 529163 - RNA, 23 nt, Human
gaaaugucaaguuucacccgaaa

SEQ ID NO: 529164 - RNA, 23 nt, Human
gaaucaaucuuaaaaggcacuaa

SEQ ID NO: 529165 - RNA, 23 nt, Human
ggccauguuuuagcucuuccugg

SEQ ID NO: 529166 - RNA, 18 nt, Human
uaaaaggcacuaaguggc

SEQ ID NO: 529167 - RNA, 27 nt, Human
uaaaaggcacuaaguggcacauaaaga

SEQ ID NO: 529168 - RNA, 24 nt, Human
uaauaauuugaaaccacaggagag

SEQ ID NO: 529169 - RNA, 26 nt, Human
uaauaauuugaaaccacaggagaggu

SEQ ID NO: 529170 - RNA, 23 nt, Human
uauaacagcaaggaaaagaaaug

SEQ ID NO: 529171 - RNA, 19 nt, Human
uggauaugaaccuguggcc

SEQ ID NO: 529172 - RNA, 19 nt, Human
uggccguggcagaaaccca

SEQ ID NO: 529173 - RNA, 25 nt, Human
uggccguggcagaaacccagaaauc

SEQ ID NO: 529174 - RNA, 19 nt, Human
uuccucuggauaugaaccu

SEQ ID NO: 529175 - RNA, 21 nt, Human
uugaaaccacaggagaggucu

SEQ ID NO: 529176 - RNA, 22 nt, Human
uuuccucuagcuuccuccucca

SEQ ID NO: 529177 - RNA, 21 nt, Human
aagaaucuuugcuccucacag

SEQ ID NO: 529178 - RNA, 21 nt, Human
accgcugcacugacugugaac

SEQ ID NO: 529179 - RNA, 22 nt, Human
agacacacagauaaauauaaca

SEQ ID NO: 529180 - RNA, 23 nt, Human
agaggugugggcucccgugggug

SEQ ID NO: 529181 - RNA, 25 nt, Human
auaaauauaacacuuguuccuccau

SEQ ID NO: 529182 - RNA, 21 nt, Human
cacaggugcuccaaugguucu

SEQ ID NO: 529183 - RNA, 21 nt, Human
cgcugcacugacugugaacug

SEQ ID NO: 529184 - RNA, 20 nt, Human
cuccaggaauaaacggagcc

SEQ ID NO: 529185 - RNA, 25 nt, Human
cuccaggaauaaacggagccccucu

SEQ ID NO: 529186 - RNA, 22 nt, Human
cucuccguggaugagccggugg

SEQ ID NO: 529187 - RNA, 20 nt, Human
cucucggucuaacaucucac

SEQ ID NO: 529188 - RNA, 21 nt, Human
cucuguguggccgacccagac

SEQ ID NO: 529189 - RNA, 20 nt, Human
cuuccagccugacaagcuug

SEQ ID NO: 529190 - RNA, 24 nt, Human
gacaagcuugcacgugcugggguc

SEQ ID NO: 529191 - RNA, 25 nt, Human
gacgauagggaagguggguagaaag

SEQ ID NO: 529192 - RNA, 18 nt, Human
gggcgaacgagcuugaaa

SEQ ID NO: 529193 - RNA, 22 nt, Human
ggugugggcucccgugggugua

SEQ ID NO: 529194 - RNA, 21 nt, Human
guagagcucuguguggccgac

SEQ ID NO: 529195 - RNA, 26 nt, Human
uauaacacuuguuccuccauuuuuca

SEQ ID NO: 529196 - RNA, 23 nt, Human
ucaauggcuuucugcacauuucu

SEQ ID NO: 529197 - RNA, 21 nt, Human
ucacaguaaaaccgugccuuc

SEQ ID NO: 529198 - RNA, 23 nt, Human
ucagacacacagauaaauauaac

SEQ ID NO: 529199 - RNA, 20 nt, Human
ucccagaguaaccgcugcaa

SEQ ID NO: 529200 - RNA, 23 nt, Human
ucucacacugucagacacacaga

SEQ ID NO: 529201 - RNA, 21 nt, Human
ugacgauagggaaggugggua

SEQ ID NO: 529202 - RNA, 19 nt, Human
uggggucaggccaccucuc

SEQ ID NO: 529203 - RNA, 18 nt, Human
aaauuccccaaguaugcc

SEQ ID NO: 529204 - RNA, 24 nt, Human
agagcagaacuggugagacuugag

SEQ ID NO: 529205 - RNA, 18 nt, Human
agcagggugaggcucagg

SEQ ID NO: 529206 - RNA, 21 nt, Human
agcagggugaggcucaggugg

SEQ ID NO: 529207 - RNA, 18 nt, Human
aggggguggggagcacaa

SEQ ID NO: 529208 - RNA, 21 nt, Human
aggggguggggagcacaaggg

SEQ ID NO: 529209 - RNA, 22 nt, Human
agguaggggguggggagcacaa

SEQ ID NO: 529210 - RNA, 24 nt, Human
agguaggggguggggagcacaagg

SEQ ID NO: 529211 - RNA, 19 nt, Human
auuuccacaaaccucccca

SEQ ID NO: 529212 - RNA, 23 nt, Human
caaccaaauggacucuacuuccc

SEQ ID NO: 529213 - RNA, 21 nt, Human
ccacucagggcucaacagcag

SEQ ID NO: 529214 - RNA, 24 nt, Human
ccgccgccugggcuugcugcguuc

SEQ ID NO: 529215 - RNA, 21 nt, Human
ccuccuuuagccuuuccaccg

SEQ ID NO: 529216 - RNA, 21 nt, Human
cgcagucaaagcucaucaacc

SEQ ID NO: 529217 - RNA, 22 nt, Human
cugccuaauucauuagcuauau

SEQ ID NO: 529218 - RNA, 19 nt, Human
cuucaaaaaauagcucccc

SEQ ID NO: 529219 - RNA, 18 nt, Human
gcaacaagauggccaggc

SEQ ID NO: 529220 - RNA, 23 nt, Human
gccaggccauggcaauccucuuc

SEQ ID NO: 529221 - RNA, 20 nt, Human
gcugcguucuccuucgcagu

SEQ ID NO: 529222 - RNA, 22 nt, Human
gcuugcugcguucuccuucgca

SEQ ID NO: 529223 - RNA, 19 nt, Human
gggcuacauucccccagua

SEQ ID NO: 529224 - RNA, 22 nt, Human
uaaggaggagagguaagguucc

SEQ ID NO: 529225 - RNA, 18 nt, Human
uaggacccaagacagcau

SEQ ID NO: 529226 - RNA, 20 nt, Human
uaggacccaagacagcauau

SEQ ID NO: 529227 - RNA, 21 nt, Human
uaggggguggggagcacaagg

SEQ ID NO: 529228 - RNA, 22 nt, Human
uaggggguggggagcacaaggg

SEQ ID NO: 529229 - RNA, 23 nt, Human
uaggggguggggagcacaagggc

SEQ ID NO: 529230 - RNA, 22 nt, Human
uagugcaaccaacaaaaggccu

SEQ ID NO: 529231 - RNA, 20 nt, Human
uauugggcuaaggaggagag

SEQ ID NO: 529232 - RNA, 19 nt, Human
ucaucaaccaaauggacuc

SEQ ID NO: 529233 - RNA, 21 nt, Human
uccacaaaccuccccaaucac

SEQ ID NO: 529234 - RNA, 23 nt, Human
uccacaaaccuccccaaucacaa

SEQ ID NO: 529235 - RNA, 19 nt, Human
ugaauaggacccaagacag

SEQ ID NO: 529236 - RNA, 19 nt, Human
ugagaccaggagaaauaac

SEQ ID NO: 529237 - RNA, 21 nt, Human
ugagacuugagggaagggucc

SEQ ID NO: 529238 - RNA, 19 nt, Human
ugaucuaaccaagcagcaa

SEQ ID NO: 529239 - RNA, 23 nt, Human
ugccaacauuacaaaaaagauag

SEQ ID NO: 529240 - RNA, 20 nt, Human
ugcugcguucuccuucgcag

SEQ ID NO: 529241 - RNA, 18 nt, Human
uggagguagggggugggg

SEQ ID NO: 529242 - RNA, 19 nt, Human
uggggagcacaagggcuac

SEQ ID NO: 529243 - RNA, 21 nt, Human
uuccccuagccacucagggcu

SEQ ID NO: 529244 - RNA, 23 nt, Human
uugaauaggacccaagacagcau

SEQ ID NO: 529245 - RNA, 22 nt, Human
uugcugcguucuccuucgcagu

SEQ ID NO: 529246 - RNA, 27 nt, Human
uuuuuuuuuuuuuuuuuuuuuuugggg

SEQ ID NO: 529247 - RNA, 25 nt, Human
aaaaaaaaucaaagcaugaacaaaa

SEQ ID NO: 529248 - RNA, 18 nt, Human
aaauccacaucuuugcag

SEQ ID NO: 529249 - RNA, 20 nt, Human
aacaaguacagucuugacca

SEQ ID NO: 529250 - RNA, 23 nt, Human
aagcaugaacaaaacuuuaacaa

SEQ ID NO: 529251 - RNA, 25 nt, Human
acagagugagacccugucucuaaaa

SEQ ID NO: 529252 - RNA, 24 nt, Human
acuccagccugggcaacagaguga

SEQ ID NO: 529253 - RNA, 21 nt, Human
acucuuccugccccaggcccc

SEQ ID NO: 529254 - RNA, 24 nt, Human
acugcacuccagccugggcaacag

SEQ ID NO: 529255 - RNA, 24 nt, Human
acugcacuccagccugggcaacag

SEQ ID NO: 529256 - RNA, 18 nt, Human
agacguggccagcacucc

SEQ ID NO: 529257 - RNA, 22 nt, Human
agcauuuugggaggccgaggca

SEQ ID NO: 529258 - RNA, 24 nt, Human
agcauuuugggaggccgaggcagg

SEQ ID NO: 529259 - RNA, 23 nt, Human
agccccaacaaacuacuguagcc

SEQ ID NO: 529260 - RNA, 22 nt, Human
agccugggcaacagagugagac

SEQ ID NO: 529261 - RNA, 26 nt, Human
agcuggaaacguggugucccgccgac

SEQ ID NO: 529262 - RNA, 21 nt, Human
aggaucacuugaggccagaag

SEQ ID NO: 529263 - RNA, 24 nt, Human
aggaucacuugaggccagaaguuu

SEQ ID NO: 529264 - RNA, 18 nt, Human
aggcaggaggaucacuug

SEQ ID NO: 529265 - RNA, 18 nt, Human
aggcagucgggggacggc

SEQ ID NO: 529266 - RNA, 24 nt, Human
aggccgaggcaggaggaucacuug

SEQ ID NO: 529267 - RNA, 21 nt, Human
aggcgcugggaggccccagcc

SEQ ID NO: 529268 - RNA, 19 nt, Human
aguagggucccccgccccc

SEQ ID NO: 529269 - RNA, 20 nt, Human
agucuugagggagggacugg

SEQ ID NO: 529270 - RNA, 21 nt, Human
agugagacccugucucuaaaa

SEQ ID NO: 529271 - RNA, 24 nt, Human
aucaugccacugcacuccagccug

SEQ ID NO: 529272 - RNA, 24 nt, Human
augccacugcacuccagccugggc

SEQ ID NO: 529273 - RNA, 22 nt, Human
caacagagugagacccugucuc

SEQ ID NO: 529274 - RNA, 20 nt, Human
caaguccggcucccccacca

SEQ ID NO: 529275 - RNA, 24 nt, Human
cacaucuguaaucccagcauuuug

SEQ ID NO: 529276 - RNA, 23 nt, Human
caccuccacuuugaaguucagag

SEQ ID NO: 529277 - RNA, 22 nt, Human
cacuccagccugggcaacagag

SEQ ID NO: 529278 - RNA, 22 nt, Human
cacuccagccugggcaacagag

SEQ ID NO: 529279 - RNA, 24 nt, Human
cacuccagccugggcaacagagug

SEQ ID NO: 529280 - RNA, 19 nt, Human
cacugcacuccagccuggg

SEQ ID NO: 529281 - RNA, 21 nt, Human
cacugcacuccagccugggca

SEQ ID NO: 529282 - RNA, 22 nt, Human
cacugcacuccagccugggcaa

SEQ ID NO: 529283 - RNA, 23 nt, Human
cacugcacuccagccugggcaac

SEQ ID NO: 529284 - RNA, 24 nt, Human
cacugcacuccagccugggcaaca

SEQ ID NO: 529285 - RNA, 21 nt, Human
cacuugaggccagaaguuuga

SEQ ID NO: 529286 - RNA, 24 nt, Human
cagcauuuugggaggccgaggcag

SEQ ID NO: 529287 - RNA, 25 nt, Human
cagcauuuugggaggccgaggcagg

SEQ ID NO: 529288 - RNA, 25 nt, Human
cagcgacucuuccugccccaggccc

SEQ ID NO: 529289 - RNA, 22 nt, Human
caggccccagggacgcggcugg

SEQ ID NO: 529290 - RNA, 19 nt, Human
caguagggucccccgcccu

SEQ ID NO: 529291 - RNA, 22 nt, Human
ccaaucucuucgccugcaacaa

SEQ ID NO: 529292 - RNA, 19 nt, Human
ccaccguggaguccuccuc

SEQ ID NO: 529293 - RNA, 20 nt, Human
ccacugcacuccagccuggg

SEQ ID NO: 529294 - RNA, 21 nt, Human
ccacugcacuccagccugggc

SEQ ID NO: 529295 - RNA, 23 nt, Human
ccacugcacuccagccugggcaa

SEQ ID NO: 529296 - RNA, 24 nt, Human
ccacugcacuccagccugggcaac

SEQ ID NO: 529297 - RNA, 23 nt, Human
cccagcuccaggcugaccuugac

SEQ ID NO: 529298 - RNA, 21 nt, Human
ccccaacaaacuacuguagcc

SEQ ID NO: 529299 - RNA, 19 nt, Human
ccccaccguggaguccucc

SEQ ID NO: 529300 - RNA, 23 nt, Human
ccccacgggcuuuagggcuucca

SEQ ID NO: 529301 - RNA, 26 nt, Human
cccccacguggcuuuucucgagaguc

SEQ ID NO: 529302 - RNA, 21 nt, Human
cccccaggcaggccgccaccc

SEQ ID NO: 529303 - RNA, 26 nt, Human
cccccaggcaggccgccacccagcuc

SEQ ID NO: 529304 - RNA, 26 nt, Human
ccccccacguggcuuuucucgagagu

SEQ ID NO: 529305 - RNA, 19 nt, Human
ccuccaaucucuucgccug

SEQ ID NO: 529306 - RNA, 22 nt, Human
ccuccaguagggucccccgccc

SEQ ID NO: 529307 - RNA, 20 nt, Human
cgaggcaggaggaucacuug

SEQ ID NO: 529308 - RNA, 25 nt, Human
cgaggcaggaggaucacuugaggcc

SEQ ID NO: 529309 - RNA, 26 nt, Human
cgaggcaggaggaucacuugaggcca

SEQ ID NO: 529310 - RNA, 20 nt, Human
cgaggucagucccaaggcuc

SEQ ID NO: 529311 - RNA, 19 nt, Human
cggcaggaagccccagggg

SEQ ID NO: 529312 - RNA, 25 nt, Human
cguccaaauccacaucuuugcagac

SEQ ID NO: 529313 - RNA, 22 nt, Human
cguggagcgcgcgggcagcccc

SEQ ID NO: 529314 - RNA, 21 nt, Human
cucacaucuguaaucccagca

SEQ ID NO: 529315 - RNA, 18 nt, Human
cuccaaagaaugaggcag

SEQ ID NO: 529316 - RNA, 22 nt, Human
cuccaggcugaccuugacgcgc

SEQ ID NO: 529317 - RNA, 18 nt, Human
cuggauggggggaguucc

SEQ ID NO: 529318 - RNA, 21 nt, Human
cuguaaucccagcauuuuggg

SEQ ID NO: 529319 - RNA, 23 nt, Human
cuuccugccccaggccccaggga

SEQ ID NO: 529320 - RNA, 21 nt, Human
cuuggagggagggcccguggg

SEQ ID NO: 529321 - RNA, 19 nt, Human
gaccuugacgcgccgcagc

SEQ ID NO: 529322 - RNA, 22 nt, Human
gacggcaggaagccccagggga

SEQ ID NO: 529323 - RNA, 18 nt, Human
gaggccccagcccgggcc

SEQ ID NO: 529324 - RNA, 22 nt, Human
gaggcgcugggaggccccagcc

SEQ ID NO: 529325 - RNA, 24 nt, Human
gaucacuugaggccagaaguuuga

SEQ ID NO: 529326 - RNA, 21 nt, Human
gaucaugccacugcacuccag

SEQ ID NO: 529327 - RNA, 21 nt, Human
gauggugugugugguggcuca

SEQ ID NO: 529328 - RNA, 24 nt, Human
gcacuccagccugggcaacagagu

SEQ ID NO: 529329 - RNA, 18 nt, Human
gcagagcaucucucccuc

SEQ ID NO: 529330 - RNA, 22 nt, Human
gccacugcacuccagccugggc

SEQ ID NO: 529331 - RNA, 24 nt, Human
gccacugcacuccagccugggcaa

SEQ ID NO: 529332 - RNA, 23 nt, Human
gccagaaguuugaggcugcagug

SEQ ID NO: 529333 - RNA, 18 nt, Human
gccccagcccgggccucc

SEQ ID NO: 529334 - RNA, 23 nt, Human
gcccgugggcugucucuagcccu

SEQ ID NO: 529335 - RNA, 18 nt, Human
gccgcagccugccagccc

SEQ ID NO: 529336 - RNA, 20 nt, Human
ggacgcuccaaagaaugagg

SEQ ID NO: 529337 - RNA, 22 nt, Human
ggaucacuugaggccagaaguu

SEQ ID NO: 529338 - RNA, 21 nt, Human
ggcaaugagccccaacaaacu

SEQ ID NO: 529339 - RNA, 18 nt, Human
ggcucccccaccaaggac

SEQ ID NO: 529340 - RNA, 23 nt, Human
gggaggccccagcccgggccucc

SEQ ID NO: 529341 - RNA, 24 nt, Human
gguggcucacaucuguaaucccag

SEQ ID NO: 529342 - RNA, 18 nt, Human
ggugugugugguggcuca

SEQ ID NO: 529343 - RNA, 30 nt, Human
uaaaaaaaaaucaaagcaugaacaaaacuu

SEQ ID NO: 529344 - RNA, 19 nt, Human
uaacaagagaauaaagagg

SEQ ID NO: 529345 - RNA, 22 nt, Human
ucagaggcagagcaucucuccc

SEQ ID NO: 529346 - RNA, 23 nt, Human
ucaugccacugcacuccagccug

SEQ ID NO: 529347 - RNA, 23 nt, Human
uccaaauccacaucuuugcagac

SEQ ID NO: 529348 - RNA, 21 nt, Human
uccaaguuggggcgcgcgggc

SEQ ID NO: 529349 - RNA, 23 nt, Human
uccaaguuggggcgcgcgggcug

SEQ ID NO: 529350 - RNA, 23 nt, Human
uccagccugggcaacagagugag

SEQ ID NO: 529351 - RNA, 24 nt, Human
uccagccugggcaacagagugaga

SEQ ID NO: 529352 - RNA, 19 nt, Human
uccagggugauaucugggg

SEQ ID NO: 529353 - RNA, 18 nt, Human
ucccaaggcucaaggccc

SEQ ID NO: 529354 - RNA, 21 nt, Human
ucccacacuuggagggagggc

SEQ ID NO: 529355 - RNA, 25 nt, Human
ucccucccacacuuggagggagggc

SEQ ID NO: 529356 - RNA, 22 nt, Human
ucugcaccguggagcgcgcggg

SEQ ID NO: 529357 - RNA, 21 nt, Human
ugaccaaguccggcuccccca

SEQ ID NO: 529358 - RNA, 23 nt, Human
ugaggcugcagugaguuaugauc

SEQ ID NO: 529359 - RNA, 18 nt, Human
ugagggggcaaugagccc

SEQ ID NO: 529360 - RNA, 20 nt, Human
ugauaucuggggugaggggg

SEQ ID NO: 529361 - RNA, 22 nt, Human
ugcaacaaguacagucuugacc

SEQ ID NO: 529362 - RNA, 24 nt, Human
ugccacugcacuccagccugggca

SEQ ID NO: 529363 - RNA, 22 nt, Human
ugccagcccgcgcgcuuagagc

SEQ ID NO: 529364 - RNA, 21 nt, Human
uggcucacaucuguaauccca

SEQ ID NO: 529365 - RNA, 24 nt, Human
uggcucacaucuguaaucccagca

SEQ ID NO: 529366 - RNA, 20 nt, Human
ugggaggccgaggcaggagg

SEQ ID NO: 529367 - RNA, 24 nt, Human
ugggaggccgaggcaggaggauca

SEQ ID NO: 529368 - RNA, 21 nt, Human
ugggcaacagagugagacccu

SEQ ID NO: 529369 - RNA, 24 nt, Human
ugggcaacagagugagacccuguc

SEQ ID NO: 529370 - RNA, 24 nt, Human
ugguggcucacaucuguaauccca

SEQ ID NO: 529371 - RNA, 25 nt, Human
ugucucuaaaaaauuuaaaaaaaaa

SEQ ID NO: 529372 - RNA, 23 nt, Human
uuccugccccaggccccagggac

SEQ ID NO: 529373 - RNA, 21 nt, Human
uugagggagggacuggauggg

SEQ ID NO: 529374 - RNA, 20 nt, Human
uuggagggagggcccguggg

SEQ ID NO: 529375 - RNA, 25 nt, Human
uugggaggccgaggcaggaggauca

SEQ ID NO: 529376 - RNA, 22 nt, Human
uuuuuuuuuuuuuuuuuggguu

SEQ ID NO: 529377 - RNA, 23 nt, Human
uuuuuuuuuuuuuuuuuuugggu

SEQ ID NO: 529378 - RNA, 23 nt, Human
uuuuuuuuuuuuuuuuuuuuggg

SEQ ID NO: 529379 - RNA, 21 nt, Human
aaaaagacaaacgaaauuuag

SEQ ID NO: 529380 - RNA, 19 nt, Human
aaaauaagcacccccaccu

SEQ ID NO: 529381 - RNA, 25 nt, Human
aaacaaacucugucucacacaaaca

SEQ ID NO: 529382 - RNA, 20 nt, Human
aaagggcaggacgcucuaca

SEQ ID NO: 529383 - RNA, 25 nt, Human
aacagcuucuggaagaggaaggcug

SEQ ID NO: 529384 - RNA, 19 nt, Human
aagaggaguguuuggaccc

SEQ ID NO: 529385 - RNA, 21 nt, Human
aagaguccaugugacuuccca

SEQ ID NO: 529386 - RNA, 23 nt, Human
aagcaugcacagaucugcuucaa

SEQ ID NO: 529387 - RNA, 26 nt, Human
aaggcccucuccugucucuggagucc

SEQ ID NO: 529388 - RNA, 18 nt, Human
aauaagcacccccaccuc

SEQ ID NO: 529389 - RNA, 22 nt, Human
aaugcaaaacaaaugaccugga

SEQ ID NO: 529390 - RNA, 25 nt, Human
acacaaccucagagagaggggaacc

SEQ ID NO: 529391 - RNA, 23 nt, Human
acacaauggaaacaagaauggcc

SEQ ID NO: 529392 - RNA, 22 nt, Human
acacacccgcuuagacccaaca

SEQ ID NO: 529393 - RNA, 21 nt, Human
acaccaaaucacuccguaucc

SEQ ID NO: 529394 - RNA, 18 nt, Human
acaugccaccugcaccuc

SEQ ID NO: 529395 - RNA, 25 nt, Human
accaaaucacuccguauccacuucc

SEQ ID NO: 529396 - RNA, 19 nt, Human
acccaccacuggagcugcc

SEQ ID NO: 529397 - RNA, 19 nt, Human
accugcaccuccagcacug

SEQ ID NO: 529398 - RNA, 23 nt, Human
agaaacagaagcaacagaggaga

SEQ ID NO: 529399 - RNA, 18 nt, Human
agaaacaugacaaggggc

SEQ ID NO: 529400 - RNA, 22 nt, Human
agacagaaacaugacaaggggc

SEQ ID NO: 529401 - RNA, 22 nt, Human
agacccaacacaaccucagaga

SEQ ID NO: 529402 - RNA, 24 nt, Human
agacugcgucagaaacagaagcaa

SEQ ID NO: 529403 - RNA, 22 nt, Human
aggaaaagcaugcacagaucug

SEQ ID NO: 529404 - RNA, 21 nt, Human
aggaagugauuucccaugaaa

SEQ ID NO: 529405 - RNA, 23 nt, Human
aggccuccaaggcaagccugauu

SEQ ID NO: 529406 - RNA, 24 nt, Human
agggaaaggcccucuccugucucu

SEQ ID NO: 529407 - RNA, 21 nt, Human
augcacuuccauaaacacacc

SEQ ID NO: 529408 - RNA, 22 nt, Human
augucucuccaacagcuucugg

SEQ ID NO: 529409 - RNA, 18 nt, Human
caaaagagaacaaaaaag

SEQ ID NO: 529410 - RNA, 22 nt, Human
caaaauuccccaggagguucuc

SEQ ID NO: 529411 - RNA, 19 nt, Human
cacacauaggaaacaggau

SEQ ID NO: 529412 - RNA, 23 nt, Human
cacauaggaaacaggauccuauc

SEQ ID NO: 529413 - RNA, 23 nt, Human
caccacacuaccaugugagagca

SEQ ID NO: 529414 - RNA, 24 nt, Human
cacccgcuuagacccaacacaacc

SEQ ID NO: 529415 - RNA, 19 nt, Human
cacccuucagaacccacca

SEQ ID NO: 529416 - RNA, 21 nt, Human
cacccuucagaacccaccacu

SEQ ID NO: 529417 - RNA, 19 nt, Human
cagaaacagaagcaacaga

SEQ ID NO: 529418 - RNA, 23 nt, Human
cagaagcaacagaggagacaaag

SEQ ID NO: 529419 - RNA, 22 nt, Human
caggagaagucuaucuuuagga

SEQ ID NO: 529420 - RNA, 18 nt, Human
caggagguucuccgauua

SEQ ID NO: 529421 - RNA, 22 nt, Human
cagggaaaggcccucuccuguc

SEQ ID NO: 529422 - RNA, 24 nt, Human
cauggaaagccugaaagagagcug

SEQ ID NO: 529423 - RNA, 21 nt, Human
cauuaaaaaugcaaaacaaau

SEQ ID NO: 529424 - RNA, 19 nt, Human
ccaaaucagaccaagagcu

SEQ ID NO: 529425 - RNA, 23 nt, Human
ccaagugucucccacaaaauucc

SEQ ID NO: 529426 - RNA, 21 nt, Human
ccacacuaccaugugagagca

SEQ ID NO: 529427 - RNA, 19 nt, Human
ccaccacuggagcugccug

SEQ ID NO: 529428 - RNA, 21 nt, Human
ccaggggcagcuuagugugcu

SEQ ID NO: 529429 - RNA, 23 nt, Human
ccauccacacaauggaaacaaga

SEQ ID NO: 529430 - RNA, 21 nt, Human
cccaccauccacacaauggaa

SEQ ID NO: 529431 - RNA, 18 nt, Human
cccagcaagcuccuccuc

SEQ ID NO: 529432 - RNA, 20 nt, Human
cccagggugucuguuuuguu

SEQ ID NO: 529433 - RNA, 21 nt, Human
cccaugaauuuaaauaaauuu

SEQ ID NO: 529434 - RNA, 19 nt, Human
ccccaggagguucuccgau

SEQ ID NO: 529435 - RNA, 21 nt, Human
ccccgugauacagcacaucua

SEQ ID NO: 529436 - RNA, 21 nt, Human
cccgugauacagcacaucuag

SEQ ID NO: 529437 - RNA, 19 nt, Human
cccuagccaucacugucuc

SEQ ID NO: 529438 - RNA, 21 nt, Human
ccgcuagccgucaacuacuca

SEQ ID NO: 529439 - RNA, 21 nt, Human
ccuccaaggcaagccugauuc

SEQ ID NO: 529440 - RNA, 22 nt, Human
ccugcaccuccagcacugccuu

SEQ ID NO: 529441 - RNA, 22 nt, Human
ccuucagaacccaccacuggag

SEQ ID NO: 529442 - RNA, 22 nt, Human
cgaagacagaaaggccagggaa

SEQ ID NO: 529443 - RNA, 19 nt, Human
cgcuuagacccaacacaac

SEQ ID NO: 529444 - RNA, 21 nt, Human
cgucagaaacagaagcaacag

SEQ ID NO: 529445 - RNA, 22 nt, Human
cgucagaaacagaagcaacaga

SEQ ID NO: 529446 - RNA, 24 nt, Human
cuccaaaucagaccaagagcucac

SEQ ID NO: 529447 - RNA, 19 nt, Human
cucucuccugaaugucucu

SEQ ID NO: 529448 - RNA, 20 nt, Human
cugcagcaugggagguacca

SEQ ID NO: 529449 - RNA, 24 nt, Human
cugucucacacaaacaugggaaua

SEQ ID NO: 529450 - RNA, 24 nt, Human
cuuaacauaauuugcuaucaaaaa

SEQ ID NO: 529451 - RNA, 30 nt, Human
cuuagacccaacacaaccucagagagagac

SEQ ID NO: 529452 - RNA, 25 nt, Human
gaaacagaagcaacagaggagacaa

SEQ ID NO: 529453 - RNA, 19 nt, Human
gagcugucucacuccagga

SEQ ID NO: 529454 - RNA, 22 nt, Human
gagguucuccgauuaaaugucc

SEQ ID NO: 529455 - RNA, 21 nt, Human
gcacagacugcgucagaaaca

SEQ ID NO: 529456 - RNA, 23 nt, Human
gcagaggaaaagcaugcacagaa

SEQ ID NO: 529457 - RNA, 20 nt, Human
gcagcccacgagaccguucc

SEQ ID NO: 529458 - RNA, 18 nt, Human
gcugccugagggaaggag

SEQ ID NO: 529459 - RNA, 18 nt, Human
ggacaccaaaucacuccg

SEQ ID NO: 529460 - RNA, 23 nt, Human
ggagaggcagugauguccaggga

SEQ ID NO: 529461 - RNA, 21 nt, Human
ggagcagaugaccugcugggc

SEQ ID NO: 529462 - RNA, 21 nt, Human
gggcaggacgcucuacaugca

SEQ ID NO: 529463 - RNA, 22 nt, Human
gugcuugcaacugcauucccag

SEQ ID NO: 529464 - RNA, 20 nt, Human
uaaaaaauaagcacccccac

SEQ ID NO: 529465 - RNA, 21 nt, Human
uaaauaaauuugcuuagugga

SEQ ID NO: 529466 - RNA, 18 nt, Human
uacagcacaucuaguaau

SEQ ID NO: 529467 - RNA, 23 nt, Human
uaccaugugagagcacagacugc

SEQ ID NO: 529468 - RNA, 22 nt, Human
uacucaggagacuaccugugag

SEQ ID NO: 529469 - RNA, 21 nt, Human
uagcucuuagcacacaggaca

SEQ ID NO: 529470 - RNA, 18 nt, Human
uaucaaaagagaacaaaa

SEQ ID NO: 529471 - RNA, 19 nt, Human
uaucaaaagagaacaaaaa

SEQ ID NO: 529472 - RNA, 25 nt, Human
uaucaaaagagaacaaaaaagagaa

SEQ ID NO: 529473 - RNA, 23 nt, Human
ucaacuacucaggagacuaccuu

SEQ ID NO: 529474 - RNA, 23 nt, Human
ucagaacccaccacuggagcugc

SEQ ID NO: 529475 - RNA, 18 nt, Human
ucagagugaaaagcaugg

SEQ ID NO: 529476 - RNA, 21 nt, Human
uccaaaucagaccaagagcuc

SEQ ID NO: 529477 - RNA, 22 nt, Human
uccacacaauggaaacaagaau

SEQ ID NO: 529478 - RNA, 23 nt, Human
uccauaaacacaccaaaaaaaug

SEQ ID NO: 529479 - RNA, 19 nt, Human
ucccacaaaauuccccagg

SEQ ID NO: 529480 - RNA, 22 nt, Human
ucggcugcugcuucaucggcuu

SEQ ID NO: 529481 - RNA, 19 nt, Human
ucucccacaaaauucccca

SEQ ID NO: 529482 - RNA, 19 nt, Human
ucuccucuugcacgugggc

SEQ ID NO: 529483 - RNA, 19 nt, Human
ucuccugaaugucucucca

SEQ ID NO: 529484 - RNA, 21 nt, Human
ucuccugucucuccucuugca

SEQ ID NO: 529485 - RNA, 18 nt, Human
ucucucuccuguagaucu

SEQ ID NO: 529486 - RNA, 19 nt, Human
ugaaagcacccuucagaac

SEQ ID NO: 529487 - RNA, 20 nt, Human
ugaaagcacccuucagaacc

SEQ ID NO: 529488 - RNA, 19 nt, Human
ugaacagagacagaaacau

SEQ ID NO: 529489 - RNA, 22 nt, Human
ugaaugucucuccaacagcuuc

SEQ ID NO: 529490 - RNA, 20 nt, Human
ugacgagaggacaggcugga

SEQ ID NO: 529491 - RNA, 25 nt, Human
ugagagcacagacugcgucagaaac

SEQ ID NO: 529492 - RNA, 26 nt, Human
ugagagcacagacugcgucagaaaca

SEQ ID NO: 529493 - RNA, 18 nt, Human
ugcaaaacaaaugaccug

SEQ ID NO: 529494 - RNA, 21 nt, Human
ugccugggaugcucggccugg

SEQ ID NO: 529495 - RNA, 18 nt, Human
ugcgucagaaacagaagc

SEQ ID NO: 529496 - RNA, 18 nt, Human
ugcuccaguucaaugagu

SEQ ID NO: 529497 - RNA, 21 nt, Human
ugcugugaggauaucagagga

SEQ ID NO: 529498 - RNA, 18 nt, Human
uggaaagccugaaagaga

SEQ ID NO: 529499 - RNA, 20 nt, Human
uggcagcaucugugcuugca

SEQ ID NO: 529500 - RNA, 20 nt, Human
ugggcacaacccaccaucca

SEQ ID NO: 529501 - RNA, 25 nt, Human
ugggcacaacccaccauccacacaa

SEQ ID NO: 529502 - RNA, 19 nt, Human
uggucagagacacuggugg

SEQ ID NO: 529503 - RNA, 18 nt, Human
uguaaacagugaacauug

SEQ ID NO: 529504 - RNA, 19 nt, Human
ugucaccacacuaccaugu

SEQ ID NO: 529505 - RNA, 21 nt, Human
ugucaggccuccaaggcaagc

SEQ ID NO: 529506 - RNA, 20 nt, Human
ugucucacacaaacauggga

SEQ ID NO: 529507 - RNA, 24 nt, Human
uguuuuguucccaagugucuccca

SEQ ID NO: 529508 - RNA, 24 nt, Human
uucccaugaauuuaaauaaauuug

SEQ ID NO: 529509 - RNA, 23 nt, Human
uuguugcagaggaaaagcaugca

SEQ ID NO: 529510 - RNA, 24 nt, Human
uuugcacacauaggaaacaggauc

SEQ ID NO: 529511 - RNA, 21 nt, Human
aaaaaaagagguaauacagaa

SEQ ID NO: 529512 - RNA, 21 nt, Human
aaacacacacgauuuucguuu

SEQ ID NO: 529513 - RNA, 19 nt, Human
aaagugcugagauuacagg

SEQ ID NO: 529514 - RNA, 20 nt, Human
aaagugcugagauuacaggc

SEQ ID NO: 529515 - RNA, 23 nt, Human
aaagugcugagauuacaggcgua

SEQ ID NO: 529516 - RNA, 21 nt, Human
accauacucaagcagaaauua

SEQ ID NO: 529517 - RNA, 24 nt, Human
accauguuggccaggauggucucg

SEQ ID NO: 529518 - RNA, 24 nt, Human
accucgugaucugccugccuuggc

SEQ ID NO: 529519 - RNA, 18 nt, Human
acgggguuucaccauguu

SEQ ID NO: 529520 - RNA, 23 nt, Human
acgggguuucaccauguuggcca

SEQ ID NO: 529521 - RNA, 24 nt, Human
acgggguuucaccauguuggccag

SEQ ID NO: 529522 - RNA, 18 nt, Human
acucuaucacucaggcug

SEQ ID NO: 529523 - RNA, 25 nt, Human
acucuaucacucaggcuggagcgca

SEQ ID NO: 529524 - RNA, 23 nt, Human
agauuacaggcguaagucacugc

SEQ ID NO: 529525 - RNA, 21 nt, Human
aggaaauaugcaaggaggagg

SEQ ID NO: 529526 - RNA, 20 nt, Human
aggagauggaaugaaucuga

SEQ ID NO: 529527 - RNA, 25 nt, Human
aggcuggagugcaguggcgugaucu

SEQ ID NO: 529528 - RNA, 24 nt, Human
agugauucucgugccucagccucc

SEQ ID NO: 529529 - RNA, 19 nt, Human
agugcaguggcgugaucuc

SEQ ID NO: 529530 - RNA, 20 nt, Human
agugcaguggcgugaucucg

SEQ ID NO: 529531 - RNA, 23 nt, Human
agugcaguggcgugaucucggcu

SEQ ID NO: 529532 - RNA, 24 nt, Human
agugcaguggcgugaucucggcuc

SEQ ID NO: 529533 - RNA, 19 nt, Human
aucugccugccuuggccuc

SEQ ID NO: 529534 - RNA, 24 nt, Human
auuuuuauauuuuuaguagagacg

SEQ ID NO: 529535 - RNA, 24 nt, Human
caaagugcugagauuacaggcgua

SEQ ID NO: 529536 - RNA, 22 nt, Human
caagugauucucgugccucagc

SEQ ID NO: 529537 - RNA, 25 nt, Human
caagugauucucgugccucagccuc

SEQ ID NO: 529538 - RNA, 27 nt, Human
cacauccacacaaagaugaagaagcua

SEQ ID NO: 529539 - RNA, 18 nt, Human
caccauguuggccaggau

SEQ ID NO: 529540 - RNA, 22 nt, Human
caccauguuggccaggaugguc

SEQ ID NO: 529541 - RNA, 24 nt, Human
caccauguuggccaggauggucuc

SEQ ID NO: 529542 - RNA, 23 nt, Human
cacucuaucacucaggcuggagc

SEQ ID NO: 529543 - RNA, 24 nt, Human
cacucuaucacucaggcuggagcg

SEQ ID NO: 529544 - RNA, 23 nt, Human
cagaggauugcuuguuaaggcac

SEQ ID NO: 529545 - RNA, 26 nt, Human
cagggaguccuuuucuaacugagccu

SEQ ID NO: 529546 - RNA, 22 nt, Human
ccaaagugcugagauuacaggc

SEQ ID NO: 529547 - RNA, 22 nt, Human
ccaaagugcugagauuacaggc

SEQ ID NO: 529548 - RNA, 24 nt, Human
ccaaagugcugagauuacaggcgu

SEQ ID NO: 529549 - RNA, 19 nt, Human
ccacacaaagaugaagaag

SEQ ID NO: 529550 - RNA, 24 nt, Human
ccaucuccugaguucaagugauuc

SEQ ID NO: 529551 - RNA, 21 nt, Human
ccucucccuucuauaaguccc

SEQ ID NO: 529552 - RNA, 21 nt, Human
ccugaccucgugaucugccug

SEQ ID NO: 529553 - RNA, 20 nt, Human
ccugaguucaagugauucuc

SEQ ID NO: 529554 - RNA, 22 nt, Human
ccugccuuggccucccaaagug

SEQ ID NO: 529555 - RNA, 24 nt, Human
ccugugcagcugggauuacaggcu

SEQ ID NO: 529556 - RNA, 26 nt, Human
cgcuccucucccuucuauaaguccca

SEQ ID NO: 529557 - RNA, 24 nt, Human
cgggguuucaccauguuggccagg

SEQ ID NO: 529558 - RNA, 27 nt, Human
cucacucuaucacucaggcuggagcgc

SEQ ID NO: 529559 - RNA, 21 nt, Human
cucacugaaaccuccaucucc

SEQ ID NO: 529560 - RNA, 24 nt, Human
cucacugaaaccuccaucuccuga

SEQ ID NO: 529561 - RNA, 21 nt, Human
cucccaaagugcugagauuac

SEQ ID NO: 529562 - RNA, 24 nt, Human
cuccugaccucgugaucugccugc

SEQ ID NO: 529563 - RNA, 19 nt, Human
cuccugaguucaagugauu

SEQ ID NO: 529564 - RNA, 23 nt, Human
cucgcucuguugccaggcuggag

SEQ ID NO: 529565 - RNA, 23 nt, Human
cucgugccucagccuccugugca

SEQ ID NO: 529566 - RNA, 24 nt, Human
cugaaaccuccaucuccugaguuc

SEQ ID NO: 529567 - RNA, 23 nt, Human
cugccuuggccucccaaagugcu

SEQ ID NO: 529568 - RNA, 21 nt, Human
cuggccagggaguccuuuucu

SEQ ID NO: 529569 - RNA, 19 nt, Human
cuuuuuuuuugagacagag

SEQ ID NO: 529570 - RNA, 21 nt, Human
gaccucgugaucugccugccu

SEQ ID NO: 529571 - RNA, 24 nt, Human
gaccucgugaucugccugccuugg

SEQ ID NO: 529572 - RNA, 24 nt, Human
gagacgggguuucaccauguuggc

SEQ ID NO: 529573 - RNA, 20 nt, Human
gagucucgcucuguugccag

SEQ ID NO: 529574 - RNA, 18 nt, Human
gauuacaggcguaaguca

SEQ ID NO: 529575 - RNA, 22 nt, Human
gauuacaggcguaagucacugc

SEQ ID NO: 529576 - RNA, 18 nt, Human
gcagcugggauuacaggc

SEQ ID NO: 529577 - RNA, 22 nt, Human
gccuuggccucccaaagugcug

SEQ ID NO: 529578 - RNA, 19 nt, Human
gcuggagugcaguggcgug

SEQ ID NO: 529579 - RNA, 22 nt, Human
ggcuggagugcaguggcgugau

SEQ ID NO: 529580 - RNA, 23 nt, Human
gggguuucaccauguuggccagg

SEQ ID NO: 529581 - RNA, 20 nt, Human
ggucucgaacuccugaccuc

SEQ ID NO: 529582 - RNA, 24 nt, Human
gguuucaccauguuggccaggaug

SEQ ID NO: 529583 - RNA, 23 nt, Human
guagagacgggguuucaccaugu

SEQ ID NO: 529584 - RNA, 24 nt, Human
gucucgcucuguugccaggcugga

SEQ ID NO: 529585 - RNA, 23 nt, Human
gugauucucgugccucagccucc

SEQ ID NO: 529586 - RNA, 26 nt, Human
uaaaucacuugaaaaaaagagguaau

SEQ ID NO: 529587 - RNA, 24 nt, Human
uaauuuuuauauuuuuaguagaga

SEQ ID NO: 529588 - RNA, 25 nt, Human
uacaagguaguuaacaccauacuca

SEQ ID NO: 529589 - RNA, 24 nt, Human
uacaggcuccugccaccacaccca

SEQ ID NO: 529590 - RNA, 22 nt, Human
uagagacgggguuucaccaugu

SEQ ID NO: 529591 - RNA, 24 nt, Human
uaguagagacgggguuucaccaug

SEQ ID NO: 529592 - RNA, 26 nt, Human
uaguagagacgggguuucaccauguu

SEQ ID NO: 529593 - RNA, 20 nt, Human
uauacacauccacacaaaga

SEQ ID NO: 529594 - RNA, 22 nt, Human
uauacacauccacacaaagaug

SEQ ID NO: 529595 - RNA, 24 nt, Human
ucaccauguuggccaggauggucu

SEQ ID NO: 529596 - RNA, 20 nt, Human
ucacugaaaccuccaucucc

SEQ ID NO: 529597 - RNA, 22 nt, Human
ucacugaaaccuccaucuccug

SEQ ID NO: 529598 - RNA, 21 nt, Human
uccacacaaagaugaagaagc

SEQ ID NO: 529599 - RNA, 24 nt, Human
ucccaaagugcugagauuacaggc

SEQ ID NO: 529600 - RNA, 21 nt, Human
uccugaguucaagugauucuc

SEQ ID NO: 529601 - RNA, 24 nt, Human
uccugaguucaagugauucucgug

SEQ ID NO: 529602 - RNA, 24 nt, Human
uccugugcagcugggauuacaggc

SEQ ID NO: 529603 - RNA, 23 nt, Human
ucucacucuaucacucaggcugg

SEQ ID NO: 529604 - RNA, 24 nt, Human
ucucacucuaucacucaggcugga

SEQ ID NO: 529605 - RNA, 19 nt, Human
ucucgaacuccugaccucg

SEQ ID NO: 529606 - RNA, 22 nt, Human
ucucgcucuguugccaggcugg

SEQ ID NO: 529607 - RNA, 23 nt, Human
ucucgcucuguugccaggcugga

SEQ ID NO: 529608 - RNA, 18 nt, Human
ucuguugccaggcuggag

SEQ ID NO: 529609 - RNA, 25 nt, Human
ugaaaaaaagagguaauacagaaua

SEQ ID NO: 529610 - RNA, 19 nt, Human
ugacagaggauugcuuguu

SEQ ID NO: 529611 - RNA, 18 nt, Human
ugagacagagucucacuc

SEQ ID NO: 529612 - RNA, 22 nt, Human
ugagacagagucucacucuauc

SEQ ID NO: 529613 - RNA, 22 nt, Human
ugagauggagucucgcucuguu

SEQ ID NO: 529614 - RNA, 21 nt, Human
ugagauuacaggcguaaguca

SEQ ID NO: 529615 - RNA, 22 nt, Human
ugagauuacaggcguaagucac

SEQ ID NO: 529616 - RNA, 22 nt, Human
ugagauuacaggcguaagucac

SEQ ID NO: 529617 - RNA, 24 nt, Human
ugagauuacaggcguaagucacug

SEQ ID NO: 529618 - RNA, 18 nt, Human
ugaguucaagugauucuc

SEQ ID NO: 529619 - RNA, 22 nt, Human
ugcaaggaggaggagaaacaac

SEQ ID NO: 529620 - RNA, 25 nt, Human
ugcagcugggauuacaggcuccugc

SEQ ID NO: 529621 - RNA, 22 nt, Human
ugcaguggcgugaucucggcuc

SEQ ID NO: 529622 - RNA, 21 nt, Human
ugccaggcuggagugcagugg

SEQ ID NO: 529623 - RNA, 23 nt, Human
ugccaggcuggagugcaguggcg

SEQ ID NO: 529624 - RNA, 24 nt, Human
ugccaggcuggagugcaguggcgu

SEQ ID NO: 529625 - RNA, 22 nt, Human
ugccucagccuccugugcagcu

SEQ ID NO: 529626 - RNA, 24 nt, Human
ugccucagccuccugugcagcugg

SEQ ID NO: 529627 - RNA, 18 nt, Human
ugccugccuuggccuccc

SEQ ID NO: 529628 - RNA, 24 nt, Human
ugcugagauuacaggcguaaguca

SEQ ID NO: 529629 - RNA, 19 nt, Human
uggagugcaguggcgugau

SEQ ID NO: 529630 - RNA, 23 nt, Human
uggagugcaguggcgugaucucg

SEQ ID NO: 529631 - RNA, 24 nt, Human
uggagugcaguggcgugaucucgg

SEQ ID NO: 529632 - RNA, 24 nt, Human
uggccaggauggucucgaacuccu

SEQ ID NO: 529633 - RNA, 23 nt, Human
ugggaacaccuggucaggacuua

SEQ ID NO: 529634 - RNA, 22 nt, Human
ugggauuacaggcuccugccac

SEQ ID NO: 529635 - RNA, 24 nt, Human
ugggauuacaggcuccugccacca

SEQ ID NO: 529636 - RNA, 20 nt, Human
uguugccaggcuggagugca

SEQ ID NO: 529637 - RNA, 18 nt, Human
uuaguagagacgggguuu

SEQ ID NO: 529638 - RNA, 22 nt, Human
uuaguagagacgggguuucacc

SEQ ID NO: 529639 - RNA, 24 nt, Human
uuaguagagacgggguuucaccau

SEQ ID NO: 529640 - RNA, 23 nt, Human
uucaagugauucucgugccucag

SEQ ID NO: 529641 - RNA, 23 nt, Human
uugcauucuucuuuucaaacaca

SEQ ID NO: 529642 - RNA, 21 nt, Human
uugccaggcuggagugcagug

SEQ ID NO: 529643 - RNA, 24 nt, Human
uugccaggcuggagugcaguggcg

SEQ ID NO: 529644 - RNA, 18 nt, Human
uuggccucccaaagugcu

SEQ ID NO: 529645 - RNA, 19 nt, Human
uuucaccauguuggccagg

SEQ ID NO: 529646 - RNA, 20 nt, Human
uuucaccauguuggccagga

SEQ ID NO: 529647 - RNA, 24 nt, Human
uuuuaggccauguauaaguuacac

SEQ ID NO: 529648 - RNA, 24 nt, Human
uuuuuaguagagacgggguuucac

SEQ ID NO: 529649 - RNA, 20 nt, Human
uuuuuauauuuuuaguagag

SEQ ID NO: 529650 - RNA, 25 nt, Human
uuuuuuuuuuuugagauggagucuc

SEQ ID NO: 529651 - RNA, 22 nt, Human
uuuuuuuuuuuuuugagaugga

SEQ ID NO: 529652 - RNA, 18 nt, Human
uuuuuuuuuuuuuuuuug

SEQ ID NO: 529653 - RNA, 25 nt, Human
aaacacuaggugagcuaaauaaagc

SEQ ID NO: 529654 - RNA, 19 nt, Human
aaacccaaaccugcaaggg

SEQ ID NO: 529655 - RNA, 19 nt, Human
aaacccaaaccugcaaggg

SEQ ID NO: 529656 - RNA, 18 nt, Human
aagaaaccccuacuuagu

SEQ ID NO: 529657 - RNA, 26 nt, Human
aauacaaauaaaugaaacaggccagg

SEQ ID NO: 529658 - RNA, 19 nt, Human
aauggcaucuccccuaacu

SEQ ID NO: 529659 - RNA, 22 nt, Human
agguaaaauugcaggcauaaag

SEQ ID NO: 529660 - RNA, 20 nt, Human
agguuccuccacgacaccuu

SEQ ID NO: 529661 - RNA, 21 nt, Human
auaauacaaauaaaugaaaca

SEQ ID NO: 529662 - RNA, 21 nt, Human
caaaagaggcauaaacugacg

SEQ ID NO: 529663 - RNA, 21 nt, Human
cacgacaccugcagagaccug

SEQ ID NO: 529664 - RNA, 23 nt, Human
ccagccacaguuugcaacugcaa

SEQ ID NO: 529665 - RNA, 19 nt, Human
ccaggcagauaauacaaau

SEQ ID NO: 529666 - RNA, 21 nt, Human
ccaguuuucaauacuccucuu

SEQ ID NO: 529667 - RNA, 24 nt, Human
ccgaucgagagaggccagaaauuc

SEQ ID NO: 529668 - RNA, 19 nt, Human
ccucuucugaaaaugcaga

SEQ ID NO: 529669 - RNA, 18 nt, Human
ccucuugcagagagugaa

SEQ ID NO: 529670 - RNA, 19 nt, Human
cgccucagggaccaggcag

SEQ ID NO: 529671 - RNA, 19 nt, Human
cuccacgacaccugcagag

SEQ ID NO: 529672 - RNA, 21 nt, Human
gagcuaaauaaagcugacagu

SEQ ID NO: 529673 - RNA, 20 nt, Human
gaggagagacccagacgccu

SEQ ID NO: 529674 - RNA, 24 nt, Human
gcuaaauaaagcugacaguccacc

SEQ ID NO: 529675 - RNA, 20 nt, Human
ggaagaggauggcaggugcu

SEQ ID NO: 529676 - RNA, 18 nt, Human
uaaaauugcaggcauaaa

SEQ ID NO: 529677 - RNA, 18 nt, Human
uaaaauugcaggcauaaa

SEQ ID NO: 529678 - RNA, 19 nt, Human
uaacucuauaggaaaaagu

SEQ ID NO: 529679 - RNA, 24 nt, Human
uaacucuauaggaaaaaguagaag

SEQ ID NO: 529680 - RNA, 21 nt, Human
ucuuagacgguggcucaauuu

SEQ ID NO: 529681 - RNA, 19 nt, Human
ugaaaacacuaggugagcu

SEQ ID NO: 529682 - RNA, 18 nt, Human
ugagcuaaauaaagcuga

SEQ ID NO: 529683 - RNA, 21 nt, Human
ugcaagggagaggagagaccc

SEQ ID NO: 529684 - RNA, 19 nt, Human
ugccaaaagaagaaacccc

SEQ ID NO: 529685 - RNA, 18 nt, Human
uggcaaaguccgggcgcg

SEQ ID NO: 529686 - RNA, 19 nt, Human
uggcucccgggcgcauccc

SEQ ID NO: 529687 - RNA, 21 nt, Human
uguggcucccgggcgcauccc

SEQ ID NO: 529688 - RNA, 21 nt, Human
uguggcucccgggcgcauccc

SEQ ID NO: 529689 - RNA, 22 nt, Human
uucaauacuccucuugcagaga

SEQ ID NO: 529690 - RNA, 18 nt, Human
uuccucagcuucaaaccc

SEQ ID NO: 529691 - RNA, 18 nt, Human
uuccuccacgacaccugc

SEQ ID NO: 529692 - RNA, 23 nt, Human
uugauuguccucuucugaaaaug

SEQ ID NO: 529693 - RNA, 18 nt, Human
uugcaacugcaaaagagg

SEQ ID NO: 529694 - RNA, 24 nt, Human
uuuuuuuuuuuuuuuuuuuuaggg

SEQ ID NO: 529695 - RNA, 25 nt, Human
aaaacacauguucccaggggcccag

SEQ ID NO: 529696 - RNA, 22 nt, Human
aaacaagugcuguaagaacuug

SEQ ID NO: 529697 - RNA, 20 nt, Human
aacugagacuucugacucca

SEQ ID NO: 529698 - RNA, 26 nt, Human
aaguacccaguccccuuucuucagcc

SEQ ID NO: 529699 - RNA, 23 nt, Human
aaucuuaugcucccccgccacac

SEQ ID NO: 529700 - RNA, 21 nt, Human
auuuauucaccacaaaacaca

SEQ ID NO: 529701 - RNA, 22 nt, Human
caaagucuccaaguacccaguc

SEQ ID NO: 529702 - RNA, 20 nt, Human
cacacccaucccaugaaaca

SEQ ID NO: 529703 - RNA, 21 nt, Human
caggggcccaggcaaagucuc

SEQ ID NO: 529704 - RNA, 24 nt, Human
ccaggacaaaugacagaacugaga

SEQ ID NO: 529705 - RNA, 24 nt, Human
cccacacccaucccaugaaacaag

SEQ ID NO: 529706 - RNA, 21 nt, Human
ccccaccaccugcugcccccc

SEQ ID NO: 529707 - RNA, 21 nt, Human
ccucuuugccuuucucuuuca

SEQ ID NO: 529708 - RNA, 24 nt, Human
cucccccgccacaccucuuugccu

SEQ ID NO: 529709 - RNA, 20 nt, Human
cucuuaacaaaaacuucugg

SEQ ID NO: 529710 - RNA, 21 nt, Human
cuugcccacacccucagccuu

SEQ ID NO: 529711 - RNA, 20 nt, Human
gccuugcccacacccucagc

SEQ ID NO: 529712 - RNA, 18 nt, Human
gcucccccgccacaccuc

SEQ ID NO: 529713 - RNA, 23 nt, Human
ucccacacccaucccaugaaaca

SEQ ID NO: 529714 - RNA, 22 nt, Human
ucuucagccuugcccacaccuu

SEQ ID NO: 529715 - RNA, 22 nt, Human
ugacuccaaaucuuaugcuccc

SEQ ID NO: 529716 - RNA, 27 nt, Human
uucaaagagacucaauaaccugcucca

SEQ ID NO: 529717 - RNA, 21 nt, Human
uucccacacccaucccaugaa

SEQ ID NO: 529718 - RNA, 21 nt, Human
uuuacagaugugaaaaccaag

SEQ ID NO: 529719 - RNA, 18 nt, Human
uuuuuuuuuuuuuuuuug

SEQ ID NO: 529720 - RNA, 23 nt, Human
aaaaccucucacaccccaaccgg

SEQ ID NO: 529721 - RNA, 19 nt, Human
aaaccucucacaccccaac

SEQ ID NO: 529722 - RNA, 22 nt, Human
aacagagccagccaguccacaa

SEQ ID NO: 529723 - RNA, 24 nt, Human
accaagcaaaucaagccugcaaga

SEQ ID NO: 529724 - RNA, 18 nt, Human
agaaaaccucucacaccc

SEQ ID NO: 529725 - RNA, 22 nt, Human
agcagcaaaaauauaauuugca

SEQ ID NO: 529726 - RNA, 22 nt, Human
caacaauaauagguaacuuuaa

SEQ ID NO: 529727 - RNA, 23 nt, Human
caacaauaauagguaacuuuaau

SEQ ID NO: 529728 - RNA, 21 nt, Human
caagaccaagacagcaucucu

SEQ ID NO: 529729 - RNA, 20 nt, Human
caccauggaaugcaaauucu

SEQ ID NO: 529730 - RNA, 18 nt, Human
cagcagcaaaaauauaau

SEQ ID NO: 529731 - RNA, 21 nt, Human
caucuaacuaaagcaagcucc

SEQ ID NO: 529732 - RNA, 18 nt, Human
ccaaaccagcuugcucau

SEQ ID NO: 529733 - RNA, 20 nt, Human
ccaguccacaaaacaggcag

SEQ ID NO: 529734 - RNA, 19 nt, Human
ccggcuuccgaucccugca

SEQ ID NO: 529735 - RNA, 23 nt, Human
ccuagagcgagaaaaccucucac

SEQ ID NO: 529736 - RNA, 20 nt, Human
cgagaaaaccucucacaccc

SEQ ID NO: 529737 - RNA, 26 nt, Human
cuaaagcaagcuccuccaacaagacc

SEQ ID NO: 529738 - RNA, 19 nt, Human
cugcaggcgcacccagucc

SEQ ID NO: 529739 - RNA, 22 nt, Human
cuuucuggauuugguuuaaaca

SEQ ID NO: 529740 - RNA, 27 nt, Human
gaaaaccucucacaccccaaccggcuu

SEQ ID NO: 529741 - RNA, 22 nt, Human
ggaagccaauauucaaaaugcc

SEQ ID NO: 529742 - RNA, 20 nt, Human
uaacaccauggaaugcaaaa

SEQ ID NO: 529743 - RNA, 24 nt, Human
uauaucagcagcaaaaauauaauu

SEQ ID NO: 529744 - RNA, 19 nt, Human
uauuucuauuucaagauga

SEQ ID NO: 529745 - RNA, 26 nt, Human
uccaaaauaucugacauucugcagca

SEQ ID NO: 529746 - RNA, 24 nt, Human
uccaugcacuuuuuggacagagaa

SEQ ID NO: 529747 - RNA, 22 nt, Human
ucccugcaggcgcacccagucc

SEQ ID NO: 529748 - RNA, 19 nt, Human
ucuuuagaacuaaguucau

SEQ ID NO: 529749 - RNA, 18 nt, Human
ugcaagaaaggaagccaa

SEQ ID NO: 529750 - RNA, 22 nt, Human
ugccauguuaccaucuaaaccc

SEQ ID NO: 529751 - RNA, 21 nt, Human
ugcuugaagaaucucccuaga

SEQ ID NO: 529752 - RNA, 21 nt, Human
uggugauucuuuaauaaauac

SEQ ID NO: 529753 - RNA, 21 nt, Human
ugguuuaaacacaugcauaua

SEQ ID NO: 529754 - RNA, 24 nt, Human
uguuaucuucuuuagaacuaaguu

SEQ ID NO: 529755 - RNA, 19 nt, Human
uuaaccaaauccauuauag

SEQ ID NO: 529756 - RNA, 22 nt, Human
uucaaaaugccauguuaccauc

SEQ ID NO: 529757 - RNA, 23 nt, Human
uucauuuaccuuugcgugagugc

SEQ ID NO: 529758 - RNA, 26 nt, Human
uuuuuuuuuuuuuuuuuuuucauggg

SEQ ID NO: 529759 - RNA, 19 nt, Human
aaacuccauaaacaaguuu

SEQ ID NO: 529760 - RNA, 22 nt, Human
agaaauauguuucuuuauuuuc

SEQ ID NO: 529761 - RNA, 22 nt, Human
agauggugcagaaagugcuugg

SEQ ID NO: 529762 - RNA, 21 nt, Human
agucaaacucuauaaauccaa

SEQ ID NO: 529763 - RNA, 18 nt, Human
agugucuuuccacccugg

SEQ ID NO: 529764 - RNA, 23 nt, Human
augcagugucuuuccacccuggc

SEQ ID NO: 529765 - RNA, 20 nt, Human
caaauggucugcagcaaagc

SEQ ID NO: 529766 - RNA, 20 nt, Human
caacacucaauaauguuuuc

SEQ ID NO: 529767 - RNA, 24 nt, Human
caauaacuuaugacacuccccaag

SEQ ID NO: 529768 - RNA, 22 nt, Human
ccaaaacacuuccgaauucuaa

SEQ ID NO: 529769 - RNA, 19 nt, Human
ccacuucaguugcucagca

SEQ ID NO: 529770 - RNA, 20 nt, Human
ccccaagggaugucaacaga

SEQ ID NO: 529771 - RNA, 18 nt, Human
ccuaagcgagcaagcucu

SEQ ID NO: 529772 - RNA, 18 nt, Human
ccuucuacuagagcccca

SEQ ID NO: 529773 - RNA, 23 nt, Human
cuagagccccaagggaugucaac

SEQ ID NO: 529774 - RNA, 19 nt, Human
cugcagcaaagcacagagc

SEQ ID NO: 529775 - RNA, 19 nt, Human
gagauggaaccaggacagu

SEQ ID NO: 529776 - RNA, 19 nt, Human
gagcaagcucugcgcucca

SEQ ID NO: 529777 - RNA, 22 nt, Human
ggaaaagccugccucgaucaag

SEQ ID NO: 529778 - RNA, 24 nt, Human
uaacaaauacaaaucuaaucgaaa

SEQ ID NO: 529779 - RNA, 23 nt, Human
uaacaaauacaaauugaauagaa

SEQ ID NO: 529780 - RNA, 22 nt, Human
uaacugcaucaaagaagggggc

SEQ ID NO: 529781 - RNA, 18 nt, Human
uaacuuaugacacucccc

SEQ ID NO: 529782 - RNA, 20 nt, Human
uaacuuaugacacuccccaa

SEQ ID NO: 529783 - RNA, 21 nt, Human
uaacuuaugacacuccccaag

SEQ ID NO: 529784 - RNA, 21 nt, Human
uagagccccaagggaugucaa

SEQ ID NO: 529785 - RNA, 25 nt, Human
uagagccccaagggaugucaacaga

SEQ ID NO: 529786 - RNA, 18 nt, Human
uagcagagauggaaccag

SEQ ID NO: 529787 - RNA, 20 nt, Human
ucagcaaaguccaaacucca

SEQ ID NO: 529788 - RNA, 22 nt, Human
uccaaacuccaugcucccccug

SEQ ID NO: 529789 - RNA, 19 nt, Human
uccaugcucccccugcucc

SEQ ID NO: 529790 - RNA, 21 nt, Human
ucuauaaauccaacuugauuu

SEQ ID NO: 529791 - RNA, 19 nt, Human
ucugcagcaaagcacagag

SEQ ID NO: 529792 - RNA, 20 nt, Human
ugcagaaagugcuuggcaug

SEQ ID NO: 529793 - RNA, 20 nt, Human
uggaaccaggacagugaugc

SEQ ID NO: 529794 - RNA, 22 nt, Human
aaaagcauuaagcaauaaccac

SEQ ID NO: 529795 - RNA, 21 nt, Human
aaaaguacugcaaacaagcuc

SEQ ID NO: 529796 - RNA, 25 nt, Human
aaaaguacugcaaacaagcucaaaa

SEQ ID NO: 529797 - RNA, 23 nt, Human
aaacaagcucaaaacaugauuca

SEQ ID NO: 529798 - RNA, 22 nt, Human
aaaugcuaaauggcugauacuu

SEQ ID NO: 529799 - RNA, 22 nt, Human
agaaauuggugcuaauaaacaa

SEQ ID NO: 529800 - RNA, 18 nt, Human
agaacuagaggugaaaac

SEQ ID NO: 529801 - RNA, 18 nt, Human
agcuuaguggcaagaaau

SEQ ID NO: 529802 - RNA, 23 nt, Human
agucagcauagaguuaaagcuca

SEQ ID NO: 529803 - RNA, 25 nt, Human
aguuuucuuaagaguuuuuuuuuuu

SEQ ID NO: 529804 - RNA, 18 nt, Human
auaaagcucuccucuagg

SEQ ID NO: 529805 - RNA, 20 nt, Human
auaaagcucuccucuagggg

SEQ ID NO: 529806 - RNA, 24 nt, Human
auaaagcucuccucuaggguccug

SEQ ID NO: 529807 - RNA, 19 nt, Human
auggaaauggaauguacau

SEQ ID NO: 529808 - RNA, 18 nt, Human
cagaacuagaggugaaaa

SEQ ID NO: 529809 - RNA, 20 nt, Human
cauccagaacuagaggugaa

SEQ ID NO: 529810 - RNA, 20 nt, Human
cccaccacuacugccgggcc

SEQ ID NO: 529811 - RNA, 18 nt, Human
cccgccgccaucuugagg

SEQ ID NO: 529812 - RNA, 22 nt, Human
cgcucugggcgcccgccgccau

SEQ ID NO: 529813 - RNA, 18 nt, Human
cucuaaauaccccaacuu

SEQ ID NO: 529814 - RNA, 19 nt, Human
cugcugcagccacucccgg

SEQ ID NO: 529815 - RNA, 20 nt, Human
cugcugcagccacucccggg

SEQ ID NO: 529816 - RNA, 23 nt, Human
cugcugcagccacucccggggcg

SEQ ID NO: 529817 - RNA, 25 nt, Human
cugcugcagccacucccggggcggc

SEQ ID NO: 529818 - RNA, 27 nt, Human
gagccagcauuuagauuacaggcucua

SEQ ID NO: 529819 - RNA, 22 nt, Human
gcaggccccagcagcuagugcc

SEQ ID NO: 529820 - RNA, 20 nt, Human
gcugcagccacucccggggc

SEQ ID NO: 529821 - RNA, 19 nt, Human
ggugaaaacuaagaccugg

SEQ ID NO: 529822 - RNA, 23 nt, Human
uaaaacaaauagcuuaguggcaa

SEQ ID NO: 529823 - RNA, 23 nt, Human
uaaaacaaauagguccacaacca

SEQ ID NO: 529824 - RNA, 19 nt, Human
uaagcaauaaccacacaca

SEQ ID NO: 529825 - RNA, 27 nt, Human
uaagcaauaaccacacacaagaugaaa

SEQ ID NO: 529826 - RNA, 19 nt, Human
uaaggaaaugguagcagag

SEQ ID NO: 529827 - RNA, 21 nt, Human
uaauuguauaaagcucuccuc

SEQ ID NO: 529828 - RNA, 24 nt, Human
uacugugacaguccugaaaggcca

SEQ ID NO: 529829 - RNA, 20 nt, Human
uagcuuaguggcaagaaauu

SEQ ID NO: 529830 - RNA, 19 nt, Human
uagugcaucugcauuaagg

SEQ ID NO: 529831 - RNA, 22 nt, Human
uauacaauuuuuacaaaguaac

SEQ ID NO: 529832 - RNA, 21 nt, Human
uaucuaagaaguuacauauau

SEQ ID NO: 529833 - RNA, 18 nt, Human
uaugcaaacauuaaaaga

SEQ ID NO: 529834 - RNA, 19 nt, Human
ucccggggcggcaggcccc

SEQ ID NO: 529835 - RNA, 20 nt, Human
uccuggcgcugcugcagcca

SEQ ID NO: 529836 - RNA, 20 nt, Human
ucuuuggaaaacugucuggu

SEQ ID NO: 529837 - RNA, 21 nt, Human
ugauagaaaaaucuuccugau

SEQ ID NO: 529838 - RNA, 19 nt, Human
ugcaaacaagcucaaaaca

SEQ ID NO: 529839 - RNA, 22 nt, Human
ugguauaagaaguagcugggga

SEQ ID NO: 529840 - RNA, 22 nt, Human
ugguucuaaguucccacuuccu

SEQ ID NO: 529841 - RNA, 22 nt, Human
uguauaaagcucuccucuaggg

SEQ ID NO: 529842 - RNA, 23 nt, Human
uuaagaccuuauuuaaccauagu

SEQ ID NO: 529843 - RNA, 20 nt, Human
uuaguacaguuuucuuaaga

SEQ ID NO: 529844 - RNA, 21 nt, Human
uucaugcagauacauuucuua

SEQ ID NO: 529845 - RNA, 22 nt, Human
uucccacuuccuuuaguuccca

SEQ ID NO: 529846 - RNA, 19 nt, Human
uuuaacuuuauuaacagaa

SEQ ID NO: 529847 - RNA, 22 nt, Human
uuuuuuuuuuaaaugcaaacaa

SEQ ID NO: 529848 - RNA, 20 nt, Human
aaaacugaaguagaagggcc

SEQ ID NO: 529849 - RNA, 25 nt, Human
aaacaugcagcuaagcaggcucuag

SEQ ID NO: 529850 - RNA, 25 nt, Human
aaacccaacgaauggauggucagaa

SEQ ID NO: 529851 - RNA, 23 nt, Human
aaauucucuucacaccucugcuc

SEQ ID NO: 529852 - RNA, 20 nt, Human
aaccagcugcuagagacaag

SEQ ID NO: 529853 - RNA, 19 nt, Human
aagaacacucuccaggcug

SEQ ID NO: 529854 - RNA, 20 nt, Human
aagaacacucuccaggcugc

SEQ ID NO: 529855 - RNA, 21 nt, Human
aagacccaugcuagggaacag

SEQ ID NO: 529856 - RNA, 24 nt, Human
aagcagaaagccaucucccuaggg

SEQ ID NO: 529857 - RNA, 18 nt, Human
aaggacugcagggaaagg

SEQ ID NO: 529858 - RNA, 20 nt, Human
aaggacugcagggaaaggca

SEQ ID NO: 529859 - RNA, 20 nt, Human
acaaaacaugcagcuaagca

SEQ ID NO: 529860 - RNA, 24 nt, Human
acaagaacacucuccaggcugcau

SEQ ID NO: 529861 - RNA, 22 nt, Human
acugaaguagaagggccuucug

SEQ ID NO: 529862 - RNA, 21 nt, Human
agaaaaaaaaagccaaauuuc

SEQ ID NO: 529863 - RNA, 21 nt, Human
agaggcauccaaaugccuuuc

SEQ ID NO: 529864 - RNA, 18 nt, Human
agcaggcucuagcaaguc

SEQ ID NO: 529865 - RNA, 23 nt, Human
agccaaacuucacugagggccug

SEQ ID NO: 529866 - RNA, 21 nt, Human
agccugggcuaugaaauucug

SEQ ID NO: 529867 - RNA, 19 nt, Human
aggaggacucagaguucca

SEQ ID NO: 529868 - RNA, 23 nt, Human
aggcucuagcaaguccagaaaca

SEQ ID NO: 529869 - RNA, 21 nt, Human
aguggaauaaggguugacaga

SEQ ID NO: 529870 - RNA, 18 nt, Human
agugguggcagcaggagg

SEQ ID NO: 529871 - RNA, 21 nt, Human
auaggaggacucagaguucca

SEQ ID NO: 529872 - RNA, 18 nt, Human
aucaaaccuggagcuggu

SEQ ID NO: 529873 - RNA, 19 nt, Human
auccaaaugccuuucccag

SEQ ID NO: 529874 - RNA, 26 nt, Human
augcuagggaacagugauccaaagca

SEQ ID NO: 529875 - RNA, 24 nt, Human
caaaacccaacgaauggaugguca

SEQ ID NO: 529876 - RNA, 27 nt, Human
caaagugggauuccaaaaaucguaacu

SEQ ID NO: 529877 - RNA, 19 nt, Human
caaaugccuuucccagcuc

SEQ ID NO: 529878 - RNA, 19 nt, Human
caacagagaggcauccaaa

SEQ ID NO: 529879 - RNA, 19 nt, Human
caagcccaagguguaagaa

SEQ ID NO: 529880 - RNA, 22 nt, Human
caccucugcucccacauggaag

SEQ ID NO: 529881 - RNA, 20 nt, Human
caggcccuccaaggagacuc

SEQ ID NO: 529882 - RNA, 26 nt, Human
caugggugacagucacaaaaguggug

SEQ ID NO: 529883 - RNA, 20 nt, Human
ccaacagagaggcauccaaa

SEQ ID NO: 529884 - RNA, 22 nt, Human
ccagaccagaguuagauguccc

SEQ ID NO: 529885 - RNA, 19 nt, Human
cccaccaacgacccuucau

SEQ ID NO: 529886 - RNA, 19 nt, Human
cccaugcacaaccauggga

SEQ ID NO: 529887 - RNA, 26 nt, Human
ccccaaccagcugcuagagacaagaa

SEQ ID NO: 529888 - RNA, 25 nt, Human
ccccaggccccaacagagaggcauc

SEQ ID NO: 529889 - RNA, 18 nt, Human
ccugggcuaugaaauucu

SEQ ID NO: 529890 - RNA, 25 nt, Human
ccuguaacugauuuaaucccagggc

SEQ ID NO: 529891 - RNA, 24 nt, Human
cggggucccugcauucaaaacucc

SEQ ID NO: 529892 - RNA, 19 nt, Human
cuacaaaacaugcagcuaa

SEQ ID NO: 529893 - RNA, 21 nt, Human
cuccagugacagaauauaguc

SEQ ID NO: 529894 - RNA, 20 nt, Human
cucucagacuuggaacauga

SEQ ID NO: 529895 - RNA, 21 nt, Human
cucuugauuuuuacaccaacc

SEQ ID NO: 529896 - RNA, 20 nt, Human
cuggucaguugcacagcuaa

SEQ ID NO: 529897 - RNA, 18 nt, Human
cuguucugugauuuuggc

SEQ ID NO: 529898 - RNA, 19 nt, Human
cuuggaacaugagaacagc

SEQ ID NO: 529899 - RNA, 23 nt, Human
gacaaugaauggagugaaaggaa

SEQ ID NO: 529900 - RNA, 18 nt, Human
gaccagaguuagaugucc

SEQ ID NO: 529901 - RNA, 25 nt, Human
gacugcagggaaaggcacaucacag

SEQ ID NO: 529902 - RNA, 19 nt, Human
gauguccccaugcacaacc

SEQ ID NO: 529903 - RNA, 24 nt, Human
gcccugggguggguggcuucccag

SEQ ID NO: 529904 - RNA, 21 nt, Human
gcuagagacaagaacacucuc

SEQ ID NO: 529905 - RNA, 23 nt, Human
ggacaaugaauggagugaaagga

SEQ ID NO: 529906 - RNA, 21 nt, Human
ggccugaagagacuugauugg

SEQ ID NO: 529907 - RNA, 18 nt, Human
ggguugacagaggccagc

SEQ ID NO: 529908 - RNA, 23 nt, Human
guaaggugagcagcauguaaccc

SEQ ID NO: 529909 - RNA, 23 nt, Human
gucaaaugcaaaacccaacgaau

SEQ ID NO: 529910 - RNA, 23 nt, Human
uaagaaaaaaaaagccaaauuuc

SEQ ID NO: 529911 - RNA, 21 nt, Human
uaccaguuuuuaauucuuugu

SEQ ID NO: 529912 - RNA, 26 nt, Human
uagacccaagacccaugcuccgaggg

SEQ ID NO: 529913 - RNA, 19 nt, Human
uagagacaagaacacucuc

SEQ ID NO: 529914 - RNA, 21 nt, Human
uagccaaacuucacugagggc

SEQ ID NO: 529915 - RNA, 23 nt, Human
ucagaccacaugacaaauguugc

SEQ ID NO: 529916 - RNA, 26 nt, Human
ucagaccacaugacaaauguugcuuu

SEQ ID NO: 529917 - RNA, 19 nt, Human
uccaaaugccuuucccagc

SEQ ID NO: 529918 - RNA, 22 nt, Human
uccauccugguuuccaaagaaa

SEQ ID NO: 529919 - RNA, 24 nt, Human
uccccaaccagcugcuagagacaa

SEQ ID NO: 529920 - RNA, 20 nt, Human
ugagucaaacaacacggcag

SEQ ID NO: 529921 - RNA, 20 nt, Human
ugcacaaccaugggaaugcg

SEQ ID NO: 529922 - RNA, 21 nt, Human
ugccugcuccuuccauaccuc

SEQ ID NO: 529923 - RNA, 18 nt, Human
ugcucaggccagugccug

SEQ ID NO: 529924 - RNA, 20 nt, Human
ugcucaggccagugccugcu

SEQ ID NO: 529925 - RNA, 18 nt, Human
uggaauaaggguugacag

SEQ ID NO: 529926 - RNA, 20 nt, Human
ugugcugcucaaugacagug

SEQ ID NO: 529927 - RNA, 21 nt, Human
uuccaaagaaagcuccucagg

SEQ ID NO: 529928 - RNA, 19 nt, Human
uugguuugaucaaaccugg

SEQ ID NO: 529929 - RNA, 21 nt, Human
aaacuuagaccagaccuggca

SEQ ID NO: 529930 - RNA, 23 nt, Human
aagaaacuuagaccagaccuggc

SEQ ID NO: 529931 - RNA, 20 nt, Human
acuagcuguuugaccuuggc

SEQ ID NO: 529932 - RNA, 22 nt, Human
agaccagaccuggcaaucaagg

SEQ ID NO: 529933 - RNA, 22 nt, Human
ccaaagagaccagauccuggca

SEQ ID NO: 529934 - RNA, 19 nt, Human
ccagaccuggcaaucaagg

SEQ ID NO: 529935 - RNA, 23 nt, Human
cccaccagaauccgggacucacc

SEQ ID NO: 529936 - RNA, 28 nt, Human
cccaccagaauccgggacucaccaaacg

SEQ ID NO: 529937 - RNA, 20 nt, Human
ccuuuuguuuuccccgcucc

SEQ ID NO: 529938 - RNA, 20 nt, Human
cgccgggaggcugcugccgg

SEQ ID NO: 529939 - RNA, 19 nt, Human
cugagucacuuaaccucuc

SEQ ID NO: 529940 - RNA, 20 nt, Human
cuggaaucucccugaggcca

SEQ ID NO: 529941 - RNA, 21 nt, Human
cugugggcagggguugggggu

SEQ ID NO: 529942 - RNA, 21 nt, Human
gacccggaagcgcuucaccca

SEQ ID NO: 529943 - RNA, 25 nt, Human
ggaggcugcugccggcggcgacccg

SEQ ID NO: 529944 - RNA, 20 nt, Human
ggccaucagcugguucugug

SEQ ID NO: 529945 - RNA, 18 nt, Human
gggcagggguuggggguu

SEQ ID NO: 529946 - RNA, 18 nt, Human
ggggguugggaugcaggg

SEQ ID NO: 529947 - RNA, 21 nt, Human
guaguuugggcuggccuggaa

SEQ ID NO: 529948 - RNA, 19 nt, Human
guuucaggcccuggggauu

SEQ ID NO: 529949 - RNA, 25 nt, Human
uccaccacuuacuagcuguuugacc

SEQ ID NO: 529950 - RNA, 18 nt, Human
ucccugaggccacccugc

SEQ ID NO: 529951 - RNA, 20 nt, Human
ucccugaggccacccugccu

SEQ ID NO: 529952 - RNA, 23 nt, Human
uccuggcagcagcugaggaggug

SEQ ID NO: 529953 - RNA, 23 nt, Human
ugcccaagggcacuuucaggcac

SEQ ID NO: 529954 - RNA, 20 nt, Human
uggcaaucaaggggugaggu

SEQ ID NO: 529955 - RNA, 24 nt, Human
uggcuccaccacuuacuagcuguu

SEQ ID NO: 529956 - RNA, 23 nt, Human
uucgucuccuuuuguuuuccccg

SEQ ID NO: 529957 - RNA, 21 nt, Human
uuucaggcccuggggauuuca

SEQ ID NO: 529958 - RNA, 22 nt, Human
uuugaaaaucacuccuuugucu

SEQ ID NO: 529959 - RNA, 19 nt, Human
uuuguuuuccccgcucccc

SEQ ID NO: 529960 - RNA, 18 nt, Human
uuuuccccgcuccccccc

SEQ ID NO: 529961 - RNA, 20 nt, Human
uuuuuuuuuuuuuuuuuugg

SEQ ID NO: 529962 - RNA, 19 nt, Human
aaagagucuuggaauaugu

SEQ ID NO: 529963 - RNA, 24 nt, Human
aaagugcugggauuacaggcguga

SEQ ID NO: 529964 - RNA, 21 nt, Human
aaagugcugggauuauguugc

SEQ ID NO: 529965 - RNA, 23 nt, Human
aaagugcugggauuauguugcga

SEQ ID NO: 529966 - RNA, 21 nt, Human
aacaagcucagcaugaaagcc

SEQ ID NO: 529967 - RNA, 21 nt, Human
aagaagcugggaccacaggca

SEQ ID NO: 529968 - RNA, 24 nt, Human
aagaagcugggaccacaggcaugu

SEQ ID NO: 529969 - RNA, 25 nt, Human
aagcaauccucccaccucagccucc

SEQ ID NO: 529970 - RNA, 26 nt, Human
aagcaauccucucaccuuggcuaccu

SEQ ID NO: 529971 - RNA, 22 nt, Human
aagcucagcaugaaagccaaga

SEQ ID NO: 529972 - RNA, 20 nt, Human
aagcuuagaccaacaagcuc

SEQ ID NO: 529973 - RNA, 22 nt, Human
aaguagcugggauuacaggugc

SEQ ID NO: 529974 - RNA, 21 nt, Human
aagugauucuccugcuucagc

SEQ ID NO: 529975 - RNA, 19 nt, Human
aagugcugggauuacaggc

SEQ ID NO: 529976 - RNA, 19 nt, Human
aagugcugggauuacaggc

SEQ ID NO: 529977 - RNA, 25 nt, Human
acacugucacccaggcuacagcaca

SEQ ID NO: 529978 - RNA, 19 nt, Human
acagacaggguuucaccau

SEQ ID NO: 529979 - RNA, 18 nt, Human
acaggguuucaccauguu

SEQ ID NO: 529980 - RNA, 21 nt, Human
acaggguuucaccauguuggc

SEQ ID NO: 529981 - RNA, 24 nt, Human
acaggguuucaccauguuggccag

SEQ ID NO: 529982 - RNA, 20 nt, Human
acauuagcaaauacacagaa

SEQ ID NO: 529983 - RNA, 24 nt, Human
accauguuggccaggauggucucg

SEQ ID NO: 529984 - RNA, 20 nt, Human
acccuaacaggguuacagau

SEQ ID NO: 529985 - RNA, 22 nt, Human
acccucacugggccacucuggg

SEQ ID NO: 529986 - RNA, 19 nt, Human
accgccccuggacuacuua

SEQ ID NO: 529987 - RNA, 24 nt, Human
accuugugauccgccugccucggc

SEQ ID NO: 529988 - RNA, 19 nt, Human
acucuuugcuggagacuuc

SEQ ID NO: 529989 - RNA, 19 nt, Human
acugcaucuagcacccaca

SEQ ID NO: 529990 - RNA, 18 nt, Human
agacagaaucucacacug

SEQ ID NO: 529991 - RNA, 23 nt, Human
agaccaacaagcucagcaugaaa

SEQ ID NO: 529992 - RNA, 18 nt, Human
agcaggugaggaaaaggg

SEQ ID NO: 529993 - RNA, 22 nt, Human
agccaccgccccuggacuacuu

SEQ ID NO: 529994 - RNA, 20 nt, Human
agccucgugaggagcuggga

SEQ ID NO: 529995 - RNA, 22 nt, Human
agcucacggccuucacagccuc

SEQ ID NO: 529996 - RNA, 18 nt, Human
agcucugugcuaaagggu

SEQ ID NO: 529997 - RNA, 24 nt, Human
aggcuggagugcaggaucgugauc

SEQ ID NO: 529998 - RNA, 18 nt, Human
aggcuggagugcaguggc

SEQ ID NO: 529999 - RNA, 25 nt, Human
aggcuggagugcaguggugugaucu

SEQ ID NO: 530000 - RNA, 18 nt, Human
agggaagggggcaguggg

SEQ ID NO: 530001 - RNA, 20 nt, Human
aggugccacaucaucuuuac

SEQ ID NO: 530002 - RNA, 22 nt, Human
aguagagaugggguuucaccau

SEQ ID NO: 530003 - RNA, 18 nt, Human
aguagcugggauuacagg

SEQ ID NO: 530004 - RNA, 18 nt, Human
agugcaguggcucacugc

SEQ ID NO: 530005 - RNA, 19 nt, Human
agugcaguggugugaucuc

SEQ ID NO: 530006 - RNA, 21 nt, Human
agugcaguggugugaucucag

SEQ ID NO: 530007 - RNA, 23 nt, Human
agugcaguggugugaucucagcu

SEQ ID NO: 530008 - RNA, 24 nt, Human
agugcaguggugugaucucagcuc

SEQ ID NO: 530009 - RNA, 24 nt, Human
aguggugugaucucagcucacugc

SEQ ID NO: 530010 - RNA, 19 nt, Human
auacuuuguuuuuucugag

SEQ ID NO: 530011 - RNA, 19 nt, Human
auauugcccaggauggucu

SEQ ID NO: 530012 - RNA, 19 nt, Human
augcaagaacauuccugca

SEQ ID NO: 530013 - RNA, 24 nt, Human
augggguuucaccauguaagccag

SEQ ID NO: 530014 - RNA, 19 nt, Human
augggguuuugccauauug

SEQ ID NO: 530015 - RNA, 21 nt, Human
auucuccugccucagccuccc

SEQ ID NO: 530016 - RNA, 18 nt, Human
auucuccugcuucagccu

SEQ ID NO: 530017 - RNA, 24 nt, Human
caaagugcugggauuacaggcgug

SEQ ID NO: 530018 - RNA, 23 nt, Human
caaagugcugggauuauguugcg

SEQ ID NO: 530019 - RNA, 22 nt, Human
caaccacagagaagcacucuau

SEQ ID NO: 530020 - RNA, 21 nt, Human
caaccccacugcuggcuucug

SEQ ID NO: 530021 - RNA, 24 nt, Human
caaccuccaccucccggguuaaag

SEQ ID NO: 530022 - RNA, 18 nt, Human
caagaacauuccugcacc

SEQ ID NO: 530023 - RNA, 27 nt, Human
caagcaauccucccaccucagccuccc

SEQ ID NO: 530024 - RNA, 27 nt, Human
caagcaauccucccaccucagccuccc

SEQ ID NO: 530025 - RNA, 24 nt, Human
caagcaauccucucaccuuggcua

SEQ ID NO: 530026 - RNA, 22 nt, Human
caagcaauucuccugccucagc

SEQ ID NO: 530027 - RNA, 22 nt, Human
caaguagcagagcaaaugcuaa

SEQ ID NO: 530028 - RNA, 18 nt, Human
caccauaaucuaagccca

SEQ ID NO: 530029 - RNA, 24 nt, Human
caccaugccuggcuaguuuuugua

SEQ ID NO: 530030 - RNA, 21 nt, Human
caccauguaagccaggcuggu

SEQ ID NO: 530031 - RNA, 24 nt, Human
caccauguaagccaggcuggucuc

SEQ ID NO: 530032 - RNA, 18 nt, Human
caccauguuggccaggau

SEQ ID NO: 530033 - RNA, 22 nt, Human
caccauguuggccaggaugguc

SEQ ID NO: 530034 - RNA, 24 nt, Human
caccauguuggccaggauggucuc

SEQ ID NO: 530035 - RNA, 19 nt, Human
cacccuaacaggguuacag

SEQ ID NO: 530036 - RNA, 24 nt, Human
caccucagccucccaagaagcugg

SEQ ID NO: 530037 - RNA, 24 nt, Human
caccucagccucgugaggagcugg

SEQ ID NO: 530038 - RNA, 21 nt, Human
cacugcaaccuccaccucccg

SEQ ID NO: 530039 - RNA, 23 nt, Human
cacugcaaccuccaccucccggg

SEQ ID NO: 530040 - RNA, 21 nt, Human
cacugcaaccuccgccuccca

SEQ ID NO: 530041 - RNA, 19 nt, Human
cagacucugcagcuuuugg

SEQ ID NO: 530042 - RNA, 20 nt, Human
cagccucuaccucccggguu

SEQ ID NO: 530043 - RNA, 23 nt, Human
cagccucuaccucccggguucaa

SEQ ID NO: 530044 - RNA, 21 nt, Human
cagcgagacccucacugggcc

SEQ ID NO: 530045 - RNA, 23 nt, Human
caggccugacguuuagagaaggu

SEQ ID NO: 530046 - RNA, 24 nt, Human
caggguuucaccauguuggccagg

SEQ ID NO: 530047 - RNA, 19 nt, Human
cagguguccaccaccaugc

SEQ ID NO: 530048 - RNA, 24 nt, Human
cauauugcccaggauggucucgaa

SEQ ID NO: 530049 - RNA, 18 nt, Human
caucaucuuuacuaagaa

SEQ ID NO: 530050 - RNA, 19 nt, Human
cauuagcuggagucuucuu

SEQ ID NO: 530051 - RNA, 22 nt, Human
ccaaagugcugggauuacaggc

SEQ ID NO: 530052 - RNA, 22 nt, Human
ccaaagugcugggauuacaggc

SEQ ID NO: 530053 - RNA, 24 nt, Human
ccaaagugcugggauuacaggcgu

SEQ ID NO: 530054 - RNA, 18 nt, Human
ccaaagugcugggauuau

SEQ ID NO: 530055 - RNA, 19 nt, Human
ccaaagugcugggauuaug

SEQ ID NO: 530056 - RNA, 21 nt, Human
ccaaguagcugggauuacagg

SEQ ID NO: 530057 - RNA, 21 nt, Human
ccaccacgcccagccucauuu

SEQ ID NO: 530058 - RNA, 22 nt, Human
ccagagcucacggccuucaccg

SEQ ID NO: 530059 - RNA, 22 nt, Human
ccaggaucgacuguaacuugag

SEQ ID NO: 530060 - RNA, 20 nt, Human
ccauaaucuaagcccagggc

SEQ ID NO: 530061 - RNA, 24 nt, Human
ccauugcagccucuaccucccggg

SEQ ID NO: 530062 - RNA, 22 nt, Human
cccaaguagcugggauuacagg

SEQ ID NO: 530063 - RNA, 23 nt, Human
cccaaguagcugggauuacaggu

SEQ ID NO: 530064 - RNA, 24 nt, Human
cccaaguagcugggauuacaggug

SEQ ID NO: 530065 - RNA, 22 nt, Human
cccaauuaauuuuuguauuuuu

SEQ ID NO: 530066 - RNA, 24 nt, Human
cccacauuaucuuugaaagcaguu

SEQ ID NO: 530067 - RNA, 22 nt, Human
cccaggcuacagcacagugggg

SEQ ID NO: 530068 - RNA, 23 nt, Human
cccagguucaagcaauucuccug

SEQ ID NO: 530069 - RNA, 23 nt, Human
cccggguuaaagugauucuccug

SEQ ID NO: 530070 - RNA, 20 nt, Human
cccggguucaagcaauccuc

SEQ ID NO: 530071 - RNA, 23 nt, Human
cccuaguagcugggauuacaggu

SEQ ID NO: 530072 - RNA, 22 nt, Human
ccgcccaggcuggagugcagug

SEQ ID NO: 530073 - RNA, 26 nt, Human
ccgccucccagguucaagcaauucuu

SEQ ID NO: 530074 - RNA, 23 nt, Human
ccuaguagcugggauuacaggug

SEQ ID NO: 530075 - RNA, 24 nt, Human
ccuaguagcugggauuacaggugu

SEQ ID NO: 530076 - RNA, 21 nt, Human
ccucacugggccacucuggga

SEQ ID NO: 530077 - RNA, 24 nt, Human
ccucccagguucaagcaauucucc

SEQ ID NO: 530078 - RNA, 24 nt, Human
ccucccggguuaaagugauucucc

SEQ ID NO: 530079 - RNA, 21 nt, Human
ccucccggguucaagcaaucc

SEQ ID NO: 530080 - RNA, 24 nt, Human
ccugcacugcagugaaucugugaa

SEQ ID NO: 530081 - RNA, 24 nt, Human
ccuggccucaagcaauccucucac

SEQ ID NO: 530082 - RNA, 18 nt, Human
ccuggccucaagugaucu

SEQ ID NO: 530083 - RNA, 26 nt, Human
ccuuccaccucagccucgugaggagc

SEQ ID NO: 530084 - RNA, 24 nt, Human
cgcccaggcuggagugcaguggug

SEQ ID NO: 530085 - RNA, 20 nt, Human
cuaguagcugggauuacagg

SEQ ID NO: 530086 - RNA, 22 nt, Human
cuaguagcugggauuacaggug

SEQ ID NO: 530087 - RNA, 25 nt, Human
cucaagcaauccucucaccuuggcu

SEQ ID NO: 530088 - RNA, 24 nt, Human
cucacugcaaccuccaccucccgg

SEQ ID NO: 530089 - RNA, 24 nt, Human
cucacugcaaccuccgccucccag

SEQ ID NO: 530090 - RNA, 21 nt, Human
cucagaacuccuggccucaag

SEQ ID NO: 530091 - RNA, 24 nt, Human
cucagccucccuaguagcugggau

SEQ ID NO: 530092 - RNA, 22 nt, Human
cucccaccucagccucccaaga

SEQ ID NO: 530093 - RNA, 18 nt, Human
cucccggguuaaagugau

SEQ ID NO: 530094 - RNA, 24 nt, Human
cucucucuguugcccaggcuggag

SEQ ID NO: 530095 - RNA, 19 nt, Human
cucucuguugcccaggcug

SEQ ID NO: 530096 - RNA, 19 nt, Human
cucugccgcccaggcugga

SEQ ID NO: 530097 - RNA, 20 nt, Human
cucuguugcccaggcuggag

SEQ ID NO: 530098 - RNA, 18 nt, Human
cugcaaccuccaccuccc

SEQ ID NO: 530099 - RNA, 23 nt, Human
cugcaaccuccaccucccggguu

SEQ ID NO: 530100 - RNA, 23 nt, Human
cugcaaccuccgccucccagguu

SEQ ID NO: 530101 - RNA, 24 nt, Human
cugcaaccuccgccucccagguuc

SEQ ID NO: 530102 - RNA, 19 nt, Human
cugccgcccaggcuggagu

SEQ ID NO: 530103 - RNA, 23 nt, Human
cugccucagccucccuaguagcu

SEQ ID NO: 530104 - RNA, 23 nt, Human
cugccucggccucccaaagugcu

SEQ ID NO: 530105 - RNA, 23 nt, Human
cugcuucagccucccaaguagcu

SEQ ID NO: 530106 - RNA, 24 nt, Human
cuggagccucaaccucuugcgcuc

SEQ ID NO: 530107 - RNA, 24 nt, Human
cuggagugcaguggugugaucuca

SEQ ID NO: 530108 - RNA, 22 nt, Human
cuggccucaagcaauccucuca

SEQ ID NO: 530109 - RNA, 19 nt, Human
cuggggucucagacucugc

SEQ ID NO: 530110 - RNA, 20 nt, Human
cuuagaccaacaagcucagc

SEQ ID NO: 530111 - RNA, 25 nt, Human
cuucagccucccaaguagcugggau

SEQ ID NO: 530112 - RNA, 23 nt, Human
cuugcucugucaucaggcuggag

SEQ ID NO: 530113 - RNA, 20 nt, Human
cuuuggguuuuuugggccau

SEQ ID NO: 530114 - RNA, 22 nt, Human
gaccuugugauccgccugccuc

SEQ ID NO: 530115 - RNA, 24 nt, Human
gaccuugugauccgccugccucgg

SEQ ID NO: 530116 - RNA, 20 nt, Human
gagaugggguuucaccaugu

SEQ ID NO: 530117 - RNA, 24 nt, Human
gagaugggguuucaccauguaagc

SEQ ID NO: 530118 - RNA, 21 nt, Human
gagcaaaugcuaaaccaucac

SEQ ID NO: 530119 - RNA, 19 nt, Human
gaguccaugugaauaaugg

SEQ ID NO: 530120 - RNA, 23 nt, Human
gaguguugggagaagcugaggca

SEQ ID NO: 530121 - RNA, 21 nt, Human
gaguugucauacauaagcaaa

SEQ ID NO: 530122 - RNA, 18 nt, Human
gauuacagaugugagcca

SEQ ID NO: 530123 - RNA, 21 nt, Human
gauuacagaugugagccacca

SEQ ID NO: 530124 - RNA, 18 nt, Human
gauuacaggcgugagcca

SEQ ID NO: 530125 - RNA, 21 nt, Human
gauuacaggcgugagccaccg

SEQ ID NO: 530126 - RNA, 22 nt, Human
gauuacaggcgugagccaccgc

SEQ ID NO: 530127 - RNA, 24 nt, Human
gauuacaggugccucccaccaugc

SEQ ID NO: 530128 - RNA, 19 nt, Human
gauuacagguguccaccac

SEQ ID NO: 530129 - RNA, 21 nt, Human
gauucuccugcuucagccucc

SEQ ID NO: 530130 - RNA, 21 nt, Human
gcaaccuccaccucccggguu

SEQ ID NO: 530131 - RNA, 22 nt, Human
gcaaccuccgccucccagguuc

SEQ ID NO: 530132 - RNA, 24 nt, Human
gcaauccucucaccuuggcuaccu

SEQ ID NO: 530133 - RNA, 20 nt, Human
gcccaauuaauuuuuguauu

SEQ ID NO: 530134 - RNA, 24 nt, Human
gcccaggcuggagugcaggaucgu

SEQ ID NO: 530135 - RNA, 20 nt, Human
gcccaggcuggagugcagug

SEQ ID NO: 530136 - RNA, 23 nt, Human
gcccaggcuggagugcaguggug

SEQ ID NO: 530137 - RNA, 24 nt, Human
gcccaggcuggagugcaguggugu

SEQ ID NO: 530138 - RNA, 21 nt, Human
gcccauugcagccucuaccuc

SEQ ID NO: 530139 - RNA, 19 nt, Human
gcuagucucaaacuccugg

SEQ ID NO: 530140 - RNA, 23 nt, Human
gcuagucucaaacuccuggccuc

SEQ ID NO: 530141 - RNA, 20 nt, Human
gcucugccgcccaggcugga

SEQ ID NO: 530142 - RNA, 25 nt, Human
gcucugccgcccaggcuggagugca

SEQ ID NO: 530143 - RNA, 22 nt, Human
gcuggagugcaguggcucacug

SEQ ID NO: 530144 - RNA, 18 nt, Human
gcuggcuccuugcucucc

SEQ ID NO: 530145 - RNA, 24 nt, Human
gcuggucucagaacuccuggccuc

SEQ ID NO: 530146 - RNA, 23 nt, Human
ggaaagccaacaguauacucaga

SEQ ID NO: 530147 - RNA, 19 nt, Human
ggaagauaaaucauguucu

SEQ ID NO: 530148 - RNA, 21 nt, Human
ggaguccaugugaauaauggu

SEQ ID NO: 530149 - RNA, 20 nt, Human
ggaugcauaccaauucacaa

SEQ ID NO: 530150 - RNA, 22 nt, Human
ggccaggaucugaguauuucca

SEQ ID NO: 530151 - RNA, 24 nt, Human
ggccucaagugaucugccagccuu

SEQ ID NO: 530152 - RNA, 19 nt, Human
ggcuggagugcaguggcuc

SEQ ID NO: 530153 - RNA, 22 nt, Human
ggcuggagugcaguggugugau

SEQ ID NO: 530154 - RNA, 18 nt, Human
gggguuucaccauguaag

SEQ ID NO: 530155 - RNA, 22 nt, Human
gggguuucaccauguaagccag

SEQ ID NO: 530156 - RNA, 22 nt, Human
gggguuuugccauauugcccag

SEQ ID NO: 530157 - RNA, 22 nt, Human
ggguuacagauguaagccacug

SEQ ID NO: 530158 - RNA, 22 nt, Human
ggguuucaccauguuggccagg

SEQ ID NO: 530159 - RNA, 19 nt, Human
ggucaagggucuaaaaccc

SEQ ID NO: 530160 - RNA, 21 nt, Human
ggucucagaacuccuggccuc

SEQ ID NO: 530161 - RNA, 18 nt, Human
gguuacagauguaagcca

SEQ ID NO: 530162 - RNA, 24 nt, Human
gguuucaccauguuggccaggaug

SEQ ID NO: 530163 - RNA, 19 nt, Human
guaaagaugggguuuugcc

SEQ ID NO: 530164 - RNA, 21 nt, Human
guaaagaugggguuuugccau

SEQ ID NO: 530165 - RNA, 24 nt, Human
guaaaucaugugcuuaaugcaagg

SEQ ID NO: 530166 - RNA, 21 nt, Human
guacagacaggguuucaccau

SEQ ID NO: 530167 - RNA, 23 nt, Human
guagagaugggguuucaccaugu

SEQ ID NO: 530168 - RNA, 19 nt, Human
guagagaugggguuuuacc

SEQ ID NO: 530169 - RNA, 18 nt, Human
guagcugggauuacaggu

SEQ ID NO: 530170 - RNA, 18 nt, Human
guagcugggauuacaggu

SEQ ID NO: 530171 - RNA, 24 nt, Human
gucuugcucugucaucaggcugga

SEQ ID NO: 530172 - RNA, 24 nt, Human
gugaagaggcgcgugugcaacccc

SEQ ID NO: 530173 - RNA, 24 nt, Human
gugauucuccugcuucagccuccc

SEQ ID NO: 530174 - RNA, 18 nt, Human
guggucuuuggaacacca

SEQ ID NO: 530175 - RNA, 21 nt, Human
guugcccaggcuagucucaaa

SEQ ID NO: 530176 - RNA, 24 nt, Human
guuuugcucugccgcccaggcugg

SEQ ID NO: 530177 - RNA, 24 nt, Human
guuuuuguauuuuuaguagagaug

SEQ ID NO: 530178 - RNA, 23 nt, Human
uaaaagaaccugcucuccaucau

SEQ ID NO: 530179 - RNA, 20 nt, Human
uaaagaugggguuuugccau

SEQ ID NO: 530180 - RNA, 18 nt, Human
uaacuugggcuuuuccuc

SEQ ID NO: 530181 - RNA, 24 nt, Human
uaauuuuuguauuuuugguacaga

SEQ ID NO: 530182 - RNA, 22 nt, Human
uacagacaggguuucaccaugu

SEQ ID NO: 530183 - RNA, 20 nt, Human
uacagauguaagccacugca

SEQ ID NO: 530184 - RNA, 24 nt, Human
uacagaugugagccaccacgccca

SEQ ID NO: 530185 - RNA, 22 nt, Human
uacaggcgugagccaccgcccc

SEQ ID NO: 530186 - RNA, 23 nt, Human
uacaggcgugagccaccgccccu

SEQ ID NO: 530187 - RNA, 27 nt, Human
uaccaaguugcccaggcuagucucaaa

SEQ ID NO: 530188 - RNA, 27 nt, Human
uaccaaguugcccaggcuagucucaaa

SEQ ID NO: 530189 - RNA, 24 nt, Human
uaccucccggguucaagcaauccu

SEQ ID NO: 530190 - RNA, 18 nt, Human
uacucagaagcaaagcaa

SEQ ID NO: 530191 - RNA, 22 nt, Human
uagagaugggguuucaccaugu

SEQ ID NO: 530192 - RNA, 19 nt, Human
uagcuggagucuucuuucc

SEQ ID NO: 530193 - RNA, 24 nt, Human
uaguagagaugggguuucaccaug

SEQ ID NO: 530194 - RNA, 25 nt, Human
uaguagcugggauuacaggugucca

SEQ ID NO: 530195 - RNA, 24 nt, Human
uaguuuuuguauuuuuaguagaga

SEQ ID NO: 530196 - RNA, 24 nt, Human
uaugucaggauuacuuauggaggu

SEQ ID NO: 530197 - RNA, 22 nt, Human
uauguugcgaaaagcugagugu

SEQ ID NO: 530198 - RNA, 19 nt, Human
ucacacugucacccaggcu

SEQ ID NO: 530199 - RNA, 23 nt, Human
ucacacugucacccaggcuacag

SEQ ID NO: 530200 - RNA, 18 nt, Human
ucacagccuccaccaucc

SEQ ID NO: 530201 - RNA, 19 nt, Human
ucacagccuccaccauccc

SEQ ID NO: 530202 - RNA, 24 nt, Human
ucaccauguuggccaggauggucu

SEQ ID NO: 530203 - RNA, 23 nt, Human
ucacugcaaccuccaccucccgg

SEQ ID NO: 530204 - RNA, 24 nt, Human
ucacugcaaccuccaccucccggg

SEQ ID NO: 530205 - RNA, 25 nt, Human
ucacugcaaccuccaccucccgggu

SEQ ID NO: 530206 - RNA, 27 nt, Human
ucacugcaaccuccaccucccggguua

SEQ ID NO: 530207 - RNA, 19 nt, Human
ucacugcaaccuccgccuc

SEQ ID NO: 530208 - RNA, 23 nt, Human
ucacugcaaccuccgccucccag

SEQ ID NO: 530209 - RNA, 24 nt, Human
ucacugcaaccuccgccucccagg

SEQ ID NO: 530210 - RNA, 27 nt, Human
ucacugcaaccuccgccucccagguuc

SEQ ID NO: 530211 - RNA, 19 nt, Human
ucacuggagccucaaccuc

SEQ ID NO: 530212 - RNA, 18 nt, Human
ucagccucccaaguagcu

SEQ ID NO: 530213 - RNA, 20 nt, Human
ucagccucccaaguagcugg

SEQ ID NO: 530214 - RNA, 23 nt, Human
ucauacauaagcaaauccauaug

SEQ ID NO: 530215 - RNA, 22 nt, Human
uccaccaucccgauggucugcu

SEQ ID NO: 530216 - RNA, 22 nt, Human
uccagggucaagggucuaaaac

SEQ ID NO: 530217 - RNA, 24 nt, Human
ucccaaagugcugggauuacaggc

SEQ ID NO: 530218 - RNA, 23 nt, Human
ucccaagaagcugggaccacagg

SEQ ID NO: 530219 - RNA, 23 nt, Human
ucccaaguagcugggauuacagg

SEQ ID NO: 530220 - RNA, 21 nt, Human
ucccagguucaagcaauucuc

SEQ ID NO: 530221 - RNA, 24 nt, Human
ucccagguucaagcaauucuccug

SEQ ID NO: 530222 - RNA, 24 nt, Human
ucccggguuaaagugauucuccug

SEQ ID NO: 530223 - RNA, 18 nt, Human
ucccggguucaagcaauc

SEQ ID NO: 530224 - RNA, 24 nt, Human
ucccggguucaagcaauccuccca

SEQ ID NO: 530225 - RNA, 24 nt, Human
ucccuaguagcugggauuacaggu

SEQ ID NO: 530226 - RNA, 22 nt, Human
uccuaaauuccguagccgacuc

SEQ ID NO: 530227 - RNA, 27 nt, Human
uccucccaccucagccucccaagaagc

SEQ ID NO: 530228 - RNA, 18 nt, Human
uccuggguucaagcaauc

SEQ ID NO: 530229 - RNA, 18 nt, Human
ucggccucccaaagugcu

SEQ ID NO: 530230 - RNA, 24 nt, Human
ucguugaccuugugauccgccugc

SEQ ID NO: 530231 - RNA, 25 nt, Human
ucucacacugucacccaggcuacag

SEQ ID NO: 530232 - RNA, 26 nt, Human
ucucacacugucacccaggcuacagc

SEQ ID NO: 530233 - RNA, 25 nt, Human
ucuccugccucagccucccuaguag

SEQ ID NO: 530234 - RNA, 19 nt, Human
ucucgaacuccuggguuca

SEQ ID NO: 530235 - RNA, 23 nt, Human
ucucgaacuccuggguucaagca

SEQ ID NO: 530236 - RNA, 23 nt, Human
ucucucucuguugcccaggcugg

SEQ ID NO: 530237 - RNA, 24 nt, Human
ucucucucuguugcccaggcugga

SEQ ID NO: 530238 - RNA, 24 nt, Human
ucucucuguugcccaggcuggagu

SEQ ID NO: 530239 - RNA, 18 nt, Human
ucucuguugcccaggcug

SEQ ID NO: 530240 - RNA, 23 nt, Human
ucucuguugcccaggcuggagug

SEQ ID NO: 530241 - RNA, 25 nt, Human
ucucuguugcccaggcuggagugca

SEQ ID NO: 530242 - RNA, 24 nt, Human
ucugccgcccaggcuggagugcag

SEQ ID NO: 530243 - RNA, 18 nt, Human
ucugucaucaggcuggag

SEQ ID NO: 530244 - RNA, 23 nt, Human
ucugucaucaggcuggagugcag

SEQ ID NO: 530245 - RNA, 23 nt, Human
ucugugaacuuacuacuacggau

SEQ ID NO: 530246 - RNA, 19 nt, Human
ucuguuccuucuuugauuc

SEQ ID NO: 530247 - RNA, 24 nt, Human
ucuguugcccaggcuggagugcag

SEQ ID NO: 530248 - RNA, 25 nt, Human
ucuguugcccaggcuggagugcagg

SEQ ID NO: 530249 - RNA, 21 nt, Human
ucuugcucugucaucaggcug

SEQ ID NO: 530250 - RNA, 22 nt, Human
ucuugcucugucaucaggcugg

SEQ ID NO: 530251 - RNA, 23 nt, Human
ucuugcucugucaucaggcugga

SEQ ID NO: 530252 - RNA, 23 nt, Human
ucuuugcuggagacuucuuuccu

SEQ ID NO: 530253 - RNA, 24 nt, Human
ucuuuuguagagaugggguuuuac

SEQ ID NO: 530254 - RNA, 21 nt, Human
ugaaaggccacguaccuaaaa

SEQ ID NO: 530255 - RNA, 26 nt, Human
ugaacaaccacagagaagcacucuau

SEQ ID NO: 530256 - RNA, 24 nt, Human
ugaauaugauggaguccaugugaa

SEQ ID NO: 530257 - RNA, 18 nt, Human
ugagacugggccagggaa

SEQ ID NO: 530258 - RNA, 21 nt, Human
ugaguauuuccaaaaagcucu

SEQ ID NO: 530259 - RNA, 23 nt, Human
ugaguuaaaagaaccugcucucc

SEQ ID NO: 530260 - RNA, 22 nt, Human
ugcaguggugugaucucagcuc

SEQ ID NO: 530261 - RNA, 27 nt, Human
ugccauauugcccaggauggucucgaa

SEQ ID NO: 530262 - RNA, 24 nt, Human
ugcccaggauggucucgaacuccu

SEQ ID NO: 530263 - RNA, 25 nt, Human
ugcccaggauggucucgaacuccug

SEQ ID NO: 530264 - RNA, 19 nt, Human
ugcccaggcuggagugcag

SEQ ID NO: 530265 - RNA, 21 nt, Human
ugcccaggcuggagugcagga

SEQ ID NO: 530266 - RNA, 24 nt, Human
ugccucagccucccuaguagcugg

SEQ ID NO: 530267 - RNA, 25 nt, Human
ugccuccgguagguaggauucaauu

SEQ ID NO: 530268 - RNA, 21 nt, Human
ugccucggccucccaaagugc

SEQ ID NO: 530269 - RNA, 24 nt, Human
ugccucggccucccaaagugcugg

SEQ ID NO: 530270 - RNA, 24 nt, Human
ugcucugccgcccaggcuggagug

SEQ ID NO: 530271 - RNA, 23 nt, Human
ugcucugucaucaggcuggagug

SEQ ID NO: 530272 - RNA, 23 nt, Human
ugcugaacaaccacagagaagca

SEQ ID NO: 530273 - RNA, 24 nt, Human
ugcugggauuacaggcgugagcca

SEQ ID NO: 530274 - RNA, 24 nt, Human
ugcuucagccucccaaguagcugg

SEQ ID NO: 530275 - RNA, 26 nt, Human
uggaaacguuagcaaucuacucuucc

SEQ ID NO: 530276 - RNA, 22 nt, Human
uggaaagccaacaguauacuca

SEQ ID NO: 530277 - RNA, 19 nt, Human
uggagugcaguggugugau

SEQ ID NO: 530278 - RNA, 24 nt, Human
uggagugcaguggugugaucucag

SEQ ID NO: 530279 - RNA, 19 nt, Human
uggcauguuuuugaaucuc

SEQ ID NO: 530280 - RNA, 21 nt, Human
uggccaggauggucucgaucu

SEQ ID NO: 530281 - RNA, 23 nt, Human
uggccaggauggucucgaucucg

SEQ ID NO: 530282 - RNA, 21 nt, Human
uggccucaagcaauccucuca

SEQ ID NO: 530283 - RNA, 24 nt, Human
uggccucaagcaauccucucaccu

SEQ ID NO: 530284 - RNA, 18 nt, Human
uggccucaagugaucugc

SEQ ID NO: 530285 - RNA, 24 nt, Human
uggccucaagugaucugccagccu

SEQ ID NO: 530286 - RNA, 20 nt, Human
ugggaagcuuuucucacaga

SEQ ID NO: 530287 - RNA, 24 nt, Human
ugggaccacaggcauguuccacca

SEQ ID NO: 530288 - RNA, 19 nt, Human
ugggagaagcugaggcagg

SEQ ID NO: 530289 - RNA, 21 nt, Human
ugggagaagcugaggcagggc

SEQ ID NO: 530290 - RNA, 21 nt, Human
ugggagaagcugaggcagggc

SEQ ID NO: 530291 - RNA, 21 nt, Human
ugggagcacagaugcaugcca

SEQ ID NO: 530292 - RNA, 18 nt, Human
ugggauuacagaugugag

SEQ ID NO: 530293 - RNA, 19 nt, Human
ugggauuacagaugugagc

SEQ ID NO: 530294 - RNA, 22 nt, Human
ugggauuacagaugugagccac

SEQ ID NO: 530295 - RNA, 24 nt, Human
ugggauuacagaugugagccacca

SEQ ID NO: 530296 - RNA, 19 nt, Human
ugggauuacaggcgugagc

SEQ ID NO: 530297 - RNA, 21 nt, Human
ugggauuacaggcgugagcca

SEQ ID NO: 530298 - RNA, 22 nt, Human
ugggauuacaggcgugagccac

SEQ ID NO: 530299 - RNA, 23 nt, Human
ugggauuacaggcgugagccacc

SEQ ID NO: 530300 - RNA, 24 nt, Human
ugggauuacaggcgugagccaccg

SEQ ID NO: 530301 - RNA, 22 nt, Human
ugggauuacaggugccucccac

SEQ ID NO: 530302 - RNA, 24 nt, Human
ugggauuacaggugccucccacca

SEQ ID NO: 530303 - RNA, 25 nt, Human
ugggauuacaggugccucccaccau

SEQ ID NO: 530304 - RNA, 21 nt, Human
ugggauuacagguguccacca

SEQ ID NO: 530305 - RNA, 24 nt, Human
ugggauuacagguguccaccacca

SEQ ID NO: 530306 - RNA, 25 nt, Human
ugggauuacagguguccaccaccau

SEQ ID NO: 530307 - RNA, 19 nt, Human
ugggccauuuuuugggggu

SEQ ID NO: 530308 - RNA, 21 nt, Human
uggggucucagaugcuggcaa

SEQ ID NO: 530309 - RNA, 24 nt, Human
ugggguuucaccauguaagccagg

SEQ ID NO: 530310 - RNA, 24 nt, Human
ugggguuuuaccaaguugcccagg

SEQ ID NO: 530311 - RNA, 24 nt, Human
ugggguuuugccauauugcccagg

SEQ ID NO: 530312 - RNA, 21 nt, Human
uggguucaagcaauccaccca

SEQ ID NO: 530313 - RNA, 23 nt, Human
ugguaaagaugggguuuugccau

SEQ ID NO: 530314 - RNA, 24 nt, Human
ugguacagacaggguuucaccaug

SEQ ID NO: 530315 - RNA, 24 nt, Human
uggugugaucucagcucacugcaa

SEQ ID NO: 530316 - RNA, 21 nt, Human
uguauuuuuaguagagauggg

SEQ ID NO: 530317 - RNA, 22 nt, Human
uguuccaccacacccagcuuau

SEQ ID NO: 530318 - RNA, 23 nt, Human
uuaaagugauucuccugcuucag

SEQ ID NO: 530319 - RNA, 21 nt, Human
uuacagauguaagccacugca

SEQ ID NO: 530320 - RNA, 18 nt, Human
uuaguagagaugggguuu

SEQ ID NO: 530321 - RNA, 22 nt, Human
uuaguagagaugggguuucacc

SEQ ID NO: 530322 - RNA, 24 nt, Human
uuaguagagaugggguuucaccau

SEQ ID NO: 530323 - RNA, 18 nt, Human
uucaagcaauccacccag

SEQ ID NO: 530324 - RNA, 24 nt, Human
uucaagcaauccucccaccucagc

SEQ ID NO: 530325 - RNA, 21 nt, Human
uucaagcaauucuccugccuc

SEQ ID NO: 530326 - RNA, 24 nt, Human
uucaagcaauucuccugccucagc

SEQ ID NO: 530327 - RNA, 21 nt, Human
uucacaaccagugaaaggcca

SEQ ID NO: 530328 - RNA, 18 nt, Human
uucacagccuccaccauc

SEQ ID NO: 530329 - RNA, 18 nt, Human
uuccuguggcauguuuuu

SEQ ID NO: 530330 - RNA, 21 nt, Human
uucucugggcuuuucccuggg

SEQ ID NO: 530331 - RNA, 23 nt, Human
uucuuuccuguggcauguuuuug

SEQ ID NO: 530332 - RNA, 20 nt, Human
uugcagccucuaccucccgg

SEQ ID NO: 530333 - RNA, 24 nt, Human
uugcagccucuaccucccggguuc

SEQ ID NO: 530334 - RNA, 24 nt, Human
uugcccaggcuggagugcaggauc

SEQ ID NO: 530335 - RNA, 22 nt, Human
uugcucugccgcccaggcugga

SEQ ID NO: 530336 - RNA, 20 nt, Human
uugcuggcuccuugcucucc

SEQ ID NO: 530337 - RNA, 24 nt, Human
uuggcuucuucucugggaggacgc

SEQ ID NO: 530338 - RNA, 20 nt, Human
uugggggugugggaagcuuu

SEQ ID NO: 530339 - RNA, 24 nt, Human
uugguaaagaugggguuuugccau

SEQ ID NO: 530340 - RNA, 21 nt, Human
uugguacagacaggguuucac

SEQ ID NO: 530341 - RNA, 24 nt, Human
uugguacagacaggguuucaccau

SEQ ID NO: 530342 - RNA, 18 nt, Human
uugguaccagcuguggga

SEQ ID NO: 530343 - RNA, 24 nt, Human
uuguagagaugggguuuuaccaag

SEQ ID NO: 530344 - RNA, 23 nt, Human
uuguauuuuuaguagagaugggg

SEQ ID NO: 530345 - RNA, 19 nt, Human
uuucaccauguuggccagg

SEQ ID NO: 530346 - RNA, 20 nt, Human
uuucaccauguuggccagga

SEQ ID NO: 530347 - RNA, 22 nt, Human
uuucauuagcuggagucuucuu

SEQ ID NO: 530348 - RNA, 26 nt, Human
uuuggcuucuucucugggaggacggc

SEQ ID NO: 530349 - RNA, 19 nt, Human
uuuggguuuuuugggccau

SEQ ID NO: 530350 - RNA, 23 nt, Human
uuuguagagaugggguuuuacca

SEQ ID NO: 530351 - RNA, 18 nt, Human
uuuucauuagcuggaguc

SEQ ID NO: 530352 - RNA, 24 nt, Human
uuuugcucugccgcccaggcugga

SEQ ID NO: 530353 - RNA, 24 nt, Human
uuuuuaguagagaugggguuucac

SEQ ID NO: 530354 - RNA, 21 nt, Human
uuuuugguaaagaugggguuu

SEQ ID NO: 530355 - RNA, 24 nt, Human
uuuuugguaaagaugggguuuugc

SEQ ID NO: 530356 - RNA, 24 nt, Human
uuuuugguacagacaggguuucac

SEQ ID NO: 530357 - RNA, 20 nt, Human
uuuuuguauuuuuaguagag

SEQ ID NO: 530358 - RNA, 21 nt, Human
uuuuuguauuuuuaguagaga

SEQ ID NO: 530359 - RNA, 20 nt, Human
uuuuuguauuuuugguacag

SEQ ID NO: 530360 - RNA, 22 nt, Human
aaaaaaaaaagaaagaaagaaa

SEQ ID NO: 530361 - RNA, 23 nt, Human
aaaaaaauaaaugaaacacccaa

SEQ ID NO: 530362 - RNA, 26 nt, Human
aaaagggccaaggccagaagcaccac

SEQ ID NO: 530363 - RNA, 20 nt, Human
aaagaaacaaacacucaggg

SEQ ID NO: 530364 - RNA, 22 nt, Human
aaauccccaagccugacacccu

SEQ ID NO: 530365 - RNA, 19 nt, Human
aacauagugagaccccauc

SEQ ID NO: 530366 - RNA, 20 nt, Human
aacauagugagaccccaucu

SEQ ID NO: 530367 - RNA, 21 nt, Human
aacauagugagaccccaucuc

SEQ ID NO: 530368 - RNA, 18 nt, Human
aacgaaggcuacacggga

SEQ ID NO: 530369 - RNA, 26 nt, Human
aagaaacaaacacucaguccaggcgc

SEQ ID NO: 530370 - RNA, 24 nt, Human
aagaagcccagcuuaaaaggaagc

SEQ ID NO: 530371 - RNA, 18 nt, Human
aagcagcuugguacagac

SEQ ID NO: 530372 - RNA, 21 nt, Human
aagcugcggguucagaggugc

SEQ ID NO: 530373 - RNA, 22 nt, Human
aagcugggcugcuguggugguc

SEQ ID NO: 530374 - RNA, 18 nt, Human
aaggaccccaagggaaag

SEQ ID NO: 530375 - RNA, 18 nt, Human
aaucaugccagccuggcc

SEQ ID NO: 530376 - RNA, 18 nt, Human
acacacaccuccuggcca

SEQ ID NO: 530377 - RNA, 20 nt, Human
acagacgaggacacacccca

SEQ ID NO: 530378 - RNA, 21 nt, Human
acaggaacaucauggaggacc

SEQ ID NO: 530379 - RNA, 24 nt, Human
acaggaguuuggggcagcuuaaaa

SEQ ID NO: 530380 - RNA, 20 nt, Human
accacaaauacaagacugca

SEQ ID NO: 530381 - RNA, 26 nt, Human
accacucuucugcaggagcccugcca

SEQ ID NO: 530382 - RNA, 19 nt, Human
accccaggagaugcaucuc

SEQ ID NO: 530383 - RNA, 18 nt, Human
accugaggcucagcuccu

SEQ ID NO: 530384 - RNA, 21 nt, Human
acucaguagagcucuggaucc

SEQ ID NO: 530385 - RNA, 23 nt, Human
acugcugcagcaggguggcuuuu

SEQ ID NO: 530386 - RNA, 18 nt, Human
agacaaguguauaaaccu

SEQ ID NO: 530387 - RNA, 25 nt, Human
agacaaguuagcacagaccggaccc

SEQ ID NO: 530388 - RNA, 21 nt, Human
agacaccugaggcucagcucc

SEQ ID NO: 530389 - RNA, 21 nt, Human
agacccuccucccaggccccc

SEQ ID NO: 530390 - RNA, 18 nt, Human
agacuaguccucccuugg

SEQ ID NO: 530391 - RNA, 23 nt, Human
agagggcuuugccucggaaggca

SEQ ID NO: 530392 - RNA, 22 nt, Human
agccugggcaacauagugagac

SEQ ID NO: 530393 - RNA, 23 nt, Human
agccugggcaacauagugagacc

SEQ ID NO: 530394 - RNA, 24 nt, Human
agccugggcaacauagugagaccc

SEQ ID NO: 530395 - RNA, 18 nt, Human
agcgcacugcugcagcag

SEQ ID NO: 530396 - RNA, 22 nt, Human
agcugguacauggaggcagaug

SEQ ID NO: 530397 - RNA, 22 nt, Human
agcugucuuuggcaagaagucc

SEQ ID NO: 530398 - RNA, 24 nt, Human
aggaggacagcuugaggagggagu

SEQ ID NO: 530399 - RNA, 19 nt, Human
aggcaggaacuguaggaag

SEQ ID NO: 530400 - RNA, 24 nt, Human
aggcgcaguggcucacaccuguaa

SEQ ID NO: 530401 - RNA, 26 nt, Human
aggcgcaguggcucacaccuguaacc

SEQ ID NO: 530402 - RNA, 27 nt, Human
aggcggccaaagcugucggcgggcgcc

SEQ ID NO: 530403 - RNA, 22 nt, Human
agggagcugguuccuguggacc

SEQ ID NO: 530404 - RNA, 22 nt, Human
agggcgugggggaagcguaggg

SEQ ID NO: 530405 - RNA, 23 nt, Human
agggggcuguggaggagggacag

SEQ ID NO: 530406 - RNA, 18 nt, Human
aguuugcuguuuuuggaa

SEQ ID NO: 530407 - RNA, 23 nt, Human
auacaacagcaccaauguggcag

SEQ ID NO: 530408 - RNA, 23 nt, Human
augaagccaucuaugauccucug

SEQ ID NO: 530409 - RNA, 20 nt, Human
augggacucugagcccagga

SEQ ID NO: 530410 - RNA, 23 nt, Human
auguaguagcuguuccggacuug

SEQ ID NO: 530411 - RNA, 22 nt, Human
caaaggccaccaagcaccuccc

SEQ ID NO: 530412 - RNA, 18 nt, Human
caacagcaccaauguggc

SEQ ID NO: 530413 - RNA, 20 nt, Human
caaggaaaaagggaacaaaa

SEQ ID NO: 530414 - RNA, 18 nt, Human
caaggccagaagcaccac

SEQ ID NO: 530415 - RNA, 23 nt, Human
cacaccuguaaccccagcacuuc

SEQ ID NO: 530416 - RNA, 18 nt, Human
cacagccaaggaagaugg

SEQ ID NO: 530417 - RNA, 21 nt, Human
cacaggaaaaauauaagaucc

SEQ ID NO: 530418 - RNA, 19 nt, Human
cagaauucauuuuccacac

SEQ ID NO: 530419 - RNA, 21 nt, Human
cagacaccugaggcucagcuc

SEQ ID NO: 530420 - RNA, 21 nt, Human
cagacagguuggugguuaugg

SEQ ID NO: 530421 - RNA, 24 nt, Human
cagcacuucaggaggccaaggugg

SEQ ID NO: 530422 - RNA, 22 nt, Human
cagcauggggguggcaccgaca

SEQ ID NO: 530423 - RNA, 22 nt, Human
cagcuccugccaggacggccga

SEQ ID NO: 530424 - RNA, 22 nt, Human
caggaacaucauggaggaccaa

SEQ ID NO: 530425 - RNA, 19 nt, Human
caggaguuuggggcagcuu

SEQ ID NO: 530426 - RNA, 22 nt, Human
caggguuaggccuucacacuca

SEQ ID NO: 530427 - RNA, 19 nt, Human
cagguccuacagacccucc

SEQ ID NO: 530428 - RNA, 19 nt, Human
caggucuucacugauguca

SEQ ID NO: 530429 - RNA, 22 nt, Human
cagucaagauacaguguuagaa

SEQ ID NO: 530430 - RNA, 18 nt, Human
caguccaggcgcaguggc

SEQ ID NO: 530431 - RNA, 25 nt, Human
cauagugagaccccaucucuaugaa

SEQ ID NO: 530432 - RNA, 19 nt, Human
caucacucccuuuacuccu

SEQ ID NO: 530433 - RNA, 19 nt, Human
cauuccagaggggguaaga

SEQ ID NO: 530434 - RNA, 19 nt, Human
ccaaggccagaagcaccac

SEQ ID NO: 530435 - RNA, 18 nt, Human
ccacagaagcugggcugc

SEQ ID NO: 530436 - RNA, 21 nt, Human
ccacagcaggccugcagagca

SEQ ID NO: 530437 - RNA, 22 nt, Human
ccaccacucuucugcaggagcc

SEQ ID NO: 530438 - RNA, 20 nt, Human
ccagaagcagcuugguacag

SEQ ID NO: 530439 - RNA, 19 nt, Human
ccagaaggccggaauugcc

SEQ ID NO: 530440 - RNA, 20 nt, Human
ccagagccuccugugagugg

SEQ ID NO: 530441 - RNA, 27 nt, Human
ccagcucaugccucccacagcaggccu

SEQ ID NO: 530442 - RNA, 21 nt, Human
ccaggaugggacugaucaacu

SEQ ID NO: 530443 - RNA, 24 nt, Human
ccaguacaccuggccaucugggac

SEQ ID NO: 530444 - RNA, 21 nt, Human
cccacaucacacuggguaccu

SEQ ID NO: 530445 - RNA, 23 nt, Human
cccauaaaaguuccauuuucuaa

SEQ ID NO: 530446 - RNA, 22 nt, Human
cccauggucacccaguacaccu

SEQ ID NO: 530447 - RNA, 28 nt, Human
ccccaagaaguuuugguugccucccuuu

SEQ ID NO: 530448 - RNA, 20 nt, Human
ccccagcacuucaggaggcc

SEQ ID NO: 530449 - RNA, 22 nt, Human
cccccugcccucacugcucccc

SEQ ID NO: 530450 - RNA, 19 nt, Human
cccucgccugggccuuccc

SEQ ID NO: 530451 - RNA, 18 nt, Human
ccucccaucucccagagc

SEQ ID NO: 530452 - RNA, 22 nt, Human
ccugaggccaggaguuugagaa

SEQ ID NO: 530453 - RNA, 18 nt, Human
ccugcagcccaaauggaa

SEQ ID NO: 530454 - RNA, 21 nt, Human
ccugcaugccuuccccuuccu

SEQ ID NO: 530455 - RNA, 22 nt, Human
ccuggacuuugagcaguggaug

SEQ ID NO: 530456 - RNA, 24 nt, Human
ccugggcaacauagugagacccca

SEQ ID NO: 530457 - RNA, 20 nt, Human
ccuugccuuuggcauuccag

SEQ ID NO: 530458 - RNA, 19 nt, Human
ccuuuaaagaaacaaacac

SEQ ID NO: 530459 - RNA, 24 nt, Human
cucacaccuguaaccccagcacuu

SEQ ID NO: 530460 - RNA, 25 nt, Human
cucacaccuguaaccccagcacuuc

SEQ ID NO: 530461 - RNA, 18 nt, Human
cucagcaucaccgcccuc

SEQ ID NO: 530462 - RNA, 20 nt, Human
cucaggaugggagucgaugc

SEQ ID NO: 530463 - RNA, 19 nt, Human
cuccagacuaguccucccu

SEQ ID NO: 530464 - RNA, 19 nt, Human
cuccccaagaaguuuuggu

SEQ ID NO: 530465 - RNA, 24 nt, Human
cuccccaucagcacacacagccaa

SEQ ID NO: 530466 - RNA, 21 nt, Human
cuccugggcuuaguggcugcc

SEQ ID NO: 530467 - RNA, 20 nt, Human
cucuaucaccucagcaauga

SEQ ID NO: 530468 - RNA, 20 nt, Human
cucuccccacagaagcuggg

SEQ ID NO: 530469 - RNA, 23 nt, Human
cucucuguacuucauauguaaaa

SEQ ID NO: 530470 - RNA, 19 nt, Human
cugcaagugguaaaacugc

SEQ ID NO: 530471 - RNA, 19 nt, Human
cugcaggagcccugccaag

SEQ ID NO: 530472 - RNA, 20 nt, Human
cugcauuuauuuacagccuu

SEQ ID NO: 530473 - RNA, 24 nt, Human
cugcccagucugccuugccaucau

SEQ ID NO: 530474 - RNA, 20 nt, Human
cugggaucccucaggagaug

SEQ ID NO: 530475 - RNA, 21 nt, Human
cuucugugcccccuccugguu

SEQ ID NO: 530476 - RNA, 19 nt, Human
cuugggaacugcccugcuc

SEQ ID NO: 530477 - RNA, 21 nt, Human
cuuguguucuucaggccaaac

SEQ ID NO: 530478 - RNA, 19 nt, Human
cuuuggggagggggcugug

SEQ ID NO: 530479 - RNA, 19 nt, Human
gaaagcuugaacaggaguu

SEQ ID NO: 530480 - RNA, 19 nt, Human
gaacaaggggcucccagcu

SEQ ID NO: 530481 - RNA, 22 nt, Human
gacucugagcccaggauguuau

SEQ ID NO: 530482 - RNA, 18 nt, Human
gagaagaaauccaccacu

SEQ ID NO: 530483 - RNA, 20 nt, Human
gaguuuggggcagcuuaaaa

SEQ ID NO: 530484 - RNA, 24 nt, Human
gaucgccugaggccaggaguuuga

SEQ ID NO: 530485 - RNA, 22 nt, Human
gcaagaaguccuugguccucuc

SEQ ID NO: 530486 - RNA, 21 nt, Human
gcaagugguaaaacugcauuc

SEQ ID NO: 530487 - RNA, 23 nt, Human
gcagacagguuggugguuauggu

SEQ ID NO: 530488 - RNA, 18 nt, Human
gcagcccaaauggaaacc

SEQ ID NO: 530489 - RNA, 21 nt, Human
gcaguaauuuaccugcaugcc

SEQ ID NO: 530490 - RNA, 18 nt, Human
gccaaacuguuuuccauc

SEQ ID NO: 530491 - RNA, 19 nt, Human
gccagcagcagccgcaagg

SEQ ID NO: 530492 - RNA, 18 nt, Human
gccaggucuggcuccugg

SEQ ID NO: 530493 - RNA, 22 nt, Human
gcgaaaucuccucuccccaaga

SEQ ID NO: 530494 - RNA, 19 nt, Human
gcgaagauuuguuuuucuu

SEQ ID NO: 530495 - RNA, 18 nt, Human
gcgcaguggcucacaccu

SEQ ID NO: 530496 - RNA, 23 nt, Human
gcugccucagcuugggcgugcuc

SEQ ID NO: 530497 - RNA, 22 nt, Human
ggaaaccaacucaaaagggcca

SEQ ID NO: 530498 - RNA, 19 nt, Human
ggacacacaccuccuggcc

SEQ ID NO: 530499 - RNA, 20 nt, Human
ggacaugcacugaacugucu

SEQ ID NO: 530500 - RNA, 26 nt, Human
ggcaccgccagacaccugaggcucag

SEQ ID NO: 530501 - RNA, 22 nt, Human
ggcagaugggacuuugggaacu

SEQ ID NO: 530502 - RNA, 26 nt, Human
ggcgccugaggcagacagguuggugg

SEQ ID NO: 530503 - RNA, 22 nt, Human
ggcuguggaggagggacagggc

SEQ ID NO: 530504 - RNA, 26 nt, Human
ggcuguggaggagggacagggcgugg

SEQ ID NO: 530505 - RNA, 22 nt, Human
gggaucccucaggagauguguc

SEQ ID NO: 530506 - RNA, 21 nt, Human
gggauccuucaacuucucucc

SEQ ID NO: 530507 - RNA, 18 nt, Human
gggcaaccaguggacaag

SEQ ID NO: 530508 - RNA, 22 nt, Human
gggggggugggauaaaaaggaa

SEQ ID NO: 530509 - RNA, 19 nt, Human
gggguaggagagaaggcag

SEQ ID NO: 530510 - RNA, 18 nt, Human
ggugguggcagaggggcu

SEQ ID NO: 530511 - RNA, 19 nt, Human
gguugccagaaggccggaa

SEQ ID NO: 530512 - RNA, 23 nt, Human
gugccuuaaauagagagguuuuc

SEQ ID NO: 530513 - RNA, 21 nt, Human
gugguggcagaggggcugagg

SEQ ID NO: 530514 - RNA, 19 nt, Human
gugguuucaggcuuguuau

SEQ ID NO: 530515 - RNA, 22 nt, Human
guguugggugaauccagggcug

SEQ ID NO: 530516 - RNA, 20 nt, Human
uaaaaguuccauuuucuaag

SEQ ID NO: 530517 - RNA, 20 nt, Human
uagacaaguguauaaaccua

SEQ ID NO: 530518 - RNA, 21 nt, Human
uagagcuccccaucagcacac

SEQ ID NO: 530519 - RNA, 20 nt, Human
uagcugucuuuggcaagaag

SEQ ID NO: 530520 - RNA, 18 nt, Human
uaugaaaaaaaaaagaaa

SEQ ID NO: 530521 - RNA, 19 nt, Human
uaugucacuggucuggggg

SEQ ID NO: 530522 - RNA, 20 nt, Human
ucacacuacagaaaaaaaua

SEQ ID NO: 530523 - RNA, 22 nt, Human
ucagcacacacagccaaggaag

SEQ ID NO: 530524 - RNA, 19 nt, Human
ucaguccaggcgcaguggc

SEQ ID NO: 530525 - RNA, 18 nt, Human
ucagugguggcggcugag

SEQ ID NO: 530526 - RNA, 22 nt, Human
ucagugguggcggcugaguggu

SEQ ID NO: 530527 - RNA, 23 nt, Human
ucagugguggcggcugaguggug

SEQ ID NO: 530528 - RNA, 22 nt, Human
ucauugugaucacacuacagaa

SEQ ID NO: 530529 - RNA, 20 nt, Human
uccacacuuaauguaaaugu

SEQ ID NO: 530530 - RNA, 22 nt, Human
uccagacuucaggaaaaugauu

SEQ ID NO: 530531 - RNA, 18 nt, Human
ucccagcauggggguggc

SEQ ID NO: 530532 - RNA, 21 nt, Human
ucccccugcccucacugcucc

SEQ ID NO: 530533 - RNA, 24 nt, Human
uccccgggccaggucuggcuccug

SEQ ID NO: 530534 - RNA, 21 nt, Human
ucccugcuucugagagggcuc

SEQ ID NO: 530535 - RNA, 18 nt, Human
ucccuggagcaagaugaa

SEQ ID NO: 530536 - RNA, 19 nt, Human
uccuacagacccuccuccc

SEQ ID NO: 530537 - RNA, 22 nt, Human
uccuacagacccuccucccagg

SEQ ID NO: 530538 - RNA, 18 nt, Human
ucgccugaggccaggagu

SEQ ID NO: 530539 - RNA, 22 nt, Human
ucuacaaaacacugcccagucu

SEQ ID NO: 530540 - RNA, 22 nt, Human
ucuacgggcacccaccuuggga

SEQ ID NO: 530541 - RNA, 22 nt, Human
ucuccagcucaugccucccaca

SEQ ID NO: 530542 - RNA, 19 nt, Human
ucucccugacgacacaggc

SEQ ID NO: 530543 - RNA, 22 nt, Human
ucuccugugggcaggcuuuggg

SEQ ID NO: 530544 - RNA, 23 nt, Human
ucuccugugggcaggcuuugggu

SEQ ID NO: 530545 - RNA, 18 nt, Human
ucucuaugaaaaaaaaaa

SEQ ID NO: 530546 - RNA, 29 nt, Human
ucugagguugucauaaaaugucgggaccg

SEQ ID NO: 530547 - RNA, 24 nt, Human
ucugcaggagcccugccaaggagc

SEQ ID NO: 530548 - RNA, 21 nt, Human
ucuggcuuugggagaaaggag

SEQ ID NO: 530549 - RNA, 24 nt, Human
ucugguguugggugaauccagggc

SEQ ID NO: 530550 - RNA, 18 nt, Human
ugacacccugcugagagc

SEQ ID NO: 530551 - RNA, 21 nt, Human
ugaccucugagcagacauccc

SEQ ID NO: 530552 - RNA, 23 nt, Human
ugaccucugagcagacaucccuu

SEQ ID NO: 530553 - RNA, 18 nt, Human
ugagagcuugaaagcuca

SEQ ID NO: 530554 - RNA, 23 nt, Human
ugagaggcguaagucccuucugg

SEQ ID NO: 530555 - RNA, 22 nt, Human
ugagugguggagggaagauacu

SEQ ID NO: 530556 - RNA, 23 nt, Human
ugaugugccuuaaauagagaggu

SEQ ID NO: 530557 - RNA, 23 nt, Human
ugcacugaacugucuguaucacu

SEQ ID NO: 530558 - RNA, 19 nt, Human
ugcagcaguguguagaagg

SEQ ID NO: 530559 - RNA, 25 nt, Human
ugcauccuuggcauaaccaucgucu

SEQ ID NO: 530560 - RNA, 22 nt, Human
ugccagccuggccucccagauc

SEQ ID NO: 530561 - RNA, 18 nt, Human
ugccaugccuuugccaug

SEQ ID NO: 530562 - RNA, 21 nt, Human
ugccauggguggccuucuguu

SEQ ID NO: 530563 - RNA, 19 nt, Human
ugcccugcuccuggugggg

SEQ ID NO: 530564 - RNA, 25 nt, Human
ugccuugccaucaucuucugugccc

SEQ ID NO: 530565 - RNA, 22 nt, Human
ugcgggguaggagagaaggcag

SEQ ID NO: 530566 - RNA, 19 nt, Human
uggaagcccagccugcccc

SEQ ID NO: 530567 - RNA, 18 nt, Human
uggaagguuaaaugaaag

SEQ ID NO: 530568 - RNA, 21 nt, Human
uggaucgccugaggccaggag

SEQ ID NO: 530569 - RNA, 23 nt, Human
uggaucgccugaggccaggaguu

SEQ ID NO: 530570 - RNA, 24 nt, Human
uggaucgccugaggccaggaguuu

SEQ ID NO: 530571 - RNA, 22 nt, Human
uggcagugaggcgcauaacacu

SEQ ID NO: 530572 - RNA, 22 nt, Human
uggcauaaccaucgucuccaga

SEQ ID NO: 530573 - RNA, 21 nt, Human
uggcucacaccuguaacccca

SEQ ID NO: 530574 - RNA, 22 nt, Human
uggcucacaccuguaaccccag

SEQ ID NO: 530575 - RNA, 23 nt, Human
uggcucacaccuguaaccccagc

SEQ ID NO: 530576 - RNA, 24 nt, Human
uggcucacaccuguaaccccagca

SEQ ID NO: 530577 - RNA, 23 nt, Human
uggcugcugccucagcuugggcg

SEQ ID NO: 530578 - RNA, 19 nt, Human
uggcuuccccucccaucuc

SEQ ID NO: 530579 - RNA, 18 nt, Human
ugggaacugcccugcucc

SEQ ID NO: 530580 - RNA, 23 nt, Human
ugggaccaccagccagaggggca

SEQ ID NO: 530581 - RNA, 21 nt, Human
ugggagaaaggaggagaugaa

SEQ ID NO: 530582 - RNA, 22 nt, Human
ugggauucugguguugggugaa

SEQ ID NO: 530583 - RNA, 22 nt, Human
ugggcaacauagugagacccca

SEQ ID NO: 530584 - RNA, 19 nt, Human
ugggcugcuguggugguau

SEQ ID NO: 530585 - RNA, 19 nt, Human
uggggcagcuuaaaaaagg

SEQ ID NO: 530586 - RNA, 28 nt, Human
ugggggaagcguagggagcugguuccug

SEQ ID NO: 530587 - RNA, 19 nt, Human
uggguggccuucuguucug

SEQ ID NO: 530588 - RNA, 23 nt, Human
ugguaucaaacagauagagcucc

SEQ ID NO: 530589 - RNA, 18 nt, Human
uggugagugucaaaaggg

SEQ ID NO: 530590 - RNA, 19 nt, Human
uguaacccauaaaaguucc

SEQ ID NO: 530591 - RNA, 19 nt, Human
ugucacuggucugggggaa

SEQ ID NO: 530592 - RNA, 23 nt, Human
uguccuuguguggucacacucuu

SEQ ID NO: 530593 - RNA, 24 nt, Human
ugugaagguuggagaggauaaggu

SEQ ID NO: 530594 - RNA, 20 nt, Human
uguucuggguguugaggaaa

SEQ ID NO: 530595 - RNA, 21 nt, Human
uguucuguggacauggugccc

SEQ ID NO: 530596 - RNA, 22 nt, Human
uuaguuccagacuucaggaaaa

SEQ ID NO: 530597 - RNA, 19 nt, Human
uucaggaggccaaggugga

SEQ ID NO: 530598 - RNA, 18 nt, Human
uuccugaccucugagcag

SEQ ID NO: 530599 - RNA, 23 nt, Human
uuccuggaagcccagccugcccc

SEQ ID NO: 530600 - RNA, 22 nt, Human
uucucuagaggggaagcuguuu

SEQ ID NO: 530601 - RNA, 22 nt, Human
uucugauucuuuguucuguguc

SEQ ID NO: 530602 - RNA, 21 nt, Human
uugaaggcuugcugugcagug

SEQ ID NO: 530603 - RNA, 22 nt, Human
uuggagccuauuacauaggcac

SEQ ID NO: 530604 - RNA, 19 nt, Human
uuguacagguagucuccug

SEQ ID NO: 530605 - RNA, 23 nt, Human
uuguacagguagucuccuguggg

SEQ ID NO: 530606 - RNA, 19 nt, Human
uuuccacacuuaauguaaa

SEQ ID NO: 530607 - RNA, 22 nt, Human
uuuggcaagaaguccuuggucc

SEQ ID NO: 530608 - RNA, 23 nt, Human
uuuggcuuccccucccaucuccc

SEQ ID NO: 530609 - RNA, 24 nt, Human
uuuuuuguuaagcauuuuuccaga

SEQ ID NO: 530610 - RNA, 22 nt, Human
aaaccgacgccaggacauucuc

SEQ ID NO: 530611 - RNA, 19 nt, Human
acaagaaacccagaaaugc

SEQ ID NO: 530612 - RNA, 23 nt, Human
accacauaugcuaaaaaccgacg

SEQ ID NO: 530613 - RNA, 19 nt, Human
accgcaggacuacgucaag

SEQ ID NO: 530614 - RNA, 22 nt, Human
acuacaauuagcugaacuaugg

SEQ ID NO: 530615 - RNA, 27 nt, Human
agaaaucaauaggaaauuagggccggu

SEQ ID NO: 530616 - RNA, 18 nt, Human
agaaugccacuaccguaa

SEQ ID NO: 530617 - RNA, 21 nt, Human
agggcauggucaacagggguu

SEQ ID NO: 530618 - RNA, 22 nt, Human
agguauaacaaggugaggacaa

SEQ ID NO: 530619 - RNA, 19 nt, Human
auaugcuaaaaaccgacgc

SEQ ID NO: 530620 - RNA, 23 nt, Human
cacugaguagccaaccgcggaaa

SEQ ID NO: 530621 - RNA, 27 nt, Human
cccugcggcggucaccgccugccgccu

SEQ ID NO: 530622 - RNA, 18 nt, Human
ccgcaggcccugcggcgg

SEQ ID NO: 530623 - RNA, 20 nt, Human
ccucccgcgggcuggcggac

SEQ ID NO: 530624 - RNA, 23 nt, Human
ccucuguagcuauaaauuuuucc

SEQ ID NO: 530625 - RNA, 18 nt, Human
ccugcugagggaucugcc

SEQ ID NO: 530626 - RNA, 21 nt, Human
ccuguauuuugaaacaaaaaa

SEQ ID NO: 530627 - RNA, 18 nt, Human
cgcgggcuggcggacagc

SEQ ID NO: 530628 - RNA, 25 nt, Human
cggcggucaccgccugccgccuguc

SEQ ID NO: 530629 - RNA, 28 nt, Human
cuauaaauuuuucccuuccugaaaaucu

SEQ ID NO: 530630 - RNA, 22 nt, Human
cuuagggaguauuaaaaaagaa

SEQ ID NO: 530631 - RNA, 21 nt, Human
gaaauguggaauccugccaug

SEQ ID NO: 530632 - RNA, 18 nt, Human
gggcauggucaacagggg

SEQ ID NO: 530633 - RNA, 23 nt, Human
uaaaacuacaauuagcugaacua

SEQ ID NO: 530634 - RNA, 18 nt, Human
uaaauaccacauaugcua

SEQ ID NO: 530635 - RNA, 22 nt, Human
uaaugcauacgcugagagaacc

SEQ ID NO: 530636 - RNA, 24 nt, Human
uaccacauaugcuaaaaaccgacg

SEQ ID NO: 530637 - RNA, 26 nt, Human
uagaaugccacuaccguaaaugcugc

SEQ ID NO: 530638 - RNA, 23 nt, Human
uagcuauaaauuuuucccuuccu

SEQ ID NO: 530639 - RNA, 22 nt, Human
uaucuucagacaucacauucua

SEQ ID NO: 530640 - RNA, 21 nt, Human
ucagaaagguaauaggaaugu

SEQ ID NO: 530641 - RNA, 20 nt, Human
uccacacaagaaacccagaa

SEQ ID NO: 530642 - RNA, 22 nt, Human
uccacacaagaaacccagaaau

SEQ ID NO: 530643 - RNA, 21 nt, Human
uccagcuucuugcagggugag

SEQ ID NO: 530644 - RNA, 20 nt, Human
uccugaaaaucucucuucca

SEQ ID NO: 530645 - RNA, 25 nt, Human
uccugaaaaucucucuuccacaccu

SEQ ID NO: 530646 - RNA, 24 nt, Human
ucuugcagggugaggaucauccac

SEQ ID NO: 530647 - RNA, 25 nt, Human
ugaacauaaagccuuucuucauuuc

SEQ ID NO: 530648 - RNA, 24 nt, Human
ugagaccaagacacugaguagcug

SEQ ID NO: 530649 - RNA, 21 nt, Human
ugaggcaacuugagaccaaga

SEQ ID NO: 530650 - RNA, 20 nt, Human
ugccauggugccacgcaggu

SEQ ID NO: 530651 - RNA, 22 nt, Human
uguauugggaacgccagccgca

SEQ ID NO: 530652 - RNA, 26 nt, Human
uuagggaguauuaaaaaagaaacgau

SEQ ID NO: 530653 - RNA, 24 nt, Human
uucacauauaaguuaugauuuuuc

SEQ ID NO: 530654 - RNA, 23 nt, Human
uucagaguguucaggaucauuuc

SEQ ID NO: 530655 - RNA, 19 nt, Human
uugagaccaagacacugag

SEQ ID NO: 530656 - RNA, 21 nt, Human
uuucaggaaguaccuuuuuua

SEQ ID NO: 530657 - RNA, 18 nt, Human
aaaaacagcuucuuucca

SEQ ID NO: 530658 - RNA, 23 nt, Human
aaaacugacaaaaugccaaaaca

SEQ ID NO: 530659 - RNA, 24 nt, Human
aaaaugauguccaaugcuccuucu

SEQ ID NO: 530660 - RNA, 18 nt, Human
aacagaaaaacauauccc

SEQ ID NO: 530661 - RNA, 23 nt, Human
aagugugugugugagcauguggu

SEQ ID NO: 530662 - RNA, 24 nt, Human
acuccacgagguguccgcuaggag

SEQ ID NO: 530663 - RNA, 21 nt, Human
agaaaacuuuuucuguaaagg

SEQ ID NO: 530664 - RNA, 21 nt, Human
agacagacacuccagaccagg

SEQ ID NO: 530665 - RNA, 27 nt, Human
agaccuaaacagacgacauguaguggu

SEQ ID NO: 530666 - RNA, 23 nt, Human
agagaaagaucuggaguccaagg

SEQ ID NO: 530667 - RNA, 23 nt, Human
agcaaagaaaaauauaacuauaa

SEQ ID NO: 530668 - RNA, 22 nt, Human
agccauaauaaguaaaacauac

SEQ ID NO: 530669 - RNA, 18 nt, Human
aggaaggaagauggagga

SEQ ID NO: 530670 - RNA, 23 nt, Human
aggcaggugggccacauguggcu

SEQ ID NO: 530671 - RNA, 22 nt, Human
aggcaggugggccacauguggg

SEQ ID NO: 530672 - RNA, 24 nt, Human
auagagacagacacuccagaccag

SEQ ID NO: 530673 - RNA, 22 nt, Human
augaagcauugguaccuuacca

SEQ ID NO: 530674 - RNA, 18 nt, Human
caaaaugccaaaacacca

SEQ ID NO: 530675 - RNA, 23 nt, Human
caaaugucuacuugcuguccaca

SEQ ID NO: 530676 - RNA, 19 nt, Human
caacagaaaaacauauccc

SEQ ID NO: 530677 - RNA, 22 nt, Human
caacagaaaaacauaucccuac

SEQ ID NO: 530678 - RNA, 21 nt, Human
caaucuccaacucuucccuua

SEQ ID NO: 530679 - RNA, 18 nt, Human
cacauguggcucacagac

SEQ ID NO: 530680 - RNA, 22 nt, Human
cacugucuuuccuaauauugca

SEQ ID NO: 530681 - RNA, 22 nt, Human
cagacuuaugagcaaagaaaaa

SEQ ID NO: 530682 - RNA, 25 nt, Human
caggcaggugggccacauguggcuc

SEQ ID NO: 530683 - RNA, 22 nt, Human
caguaauuccucaaggccaagc

SEQ ID NO: 530684 - RNA, 20 nt, Human
caugcaguucaacaauaauc

SEQ ID NO: 530685 - RNA, 24 nt, Human
ccaaugcuccuucuucugaccucc

SEQ ID NO: 530686 - RNA, 20 nt, Human
ccucuaacaaugcuuaacuc

SEQ ID NO: 530687 - RNA, 24 nt, Human
ccuucaggacagcuucauuucuaa

SEQ ID NO: 530688 - RNA, 25 nt, Human
cuccucuaacaaugcuuaacucuag

SEQ ID NO: 530689 - RNA, 19 nt, Human
cugcagcaucucauuuucc

SEQ ID NO: 530690 - RNA, 18 nt, Human
cuguccacauguggcaaa

SEQ ID NO: 530691 - RNA, 24 nt, Human
gaacugaaauuauuaagccauaau

SEQ ID NO: 530692 - RNA, 21 nt, Human
gaagauggaggauggagugaa

SEQ ID NO: 530693 - RNA, 18 nt, Human
gaggauggagugagaaag

SEQ ID NO: 530694 - RNA, 18 nt, Human
gccaaucuccaacucuuc

SEQ ID NO: 530695 - RNA, 20 nt, Human
ggacagcuucauuucuaaau

SEQ ID NO: 530696 - RNA, 18 nt, Human
ggaguuccgcccaccgcc

SEQ ID NO: 530697 - RNA, 20 nt, Human
ggcaaaugcacacaccucuc

SEQ ID NO: 530698 - RNA, 22 nt, Human
ggcaauuacuuaacucugccau

SEQ ID NO: 530699 - RNA, 21 nt, Human
gggcaaaugcacacaccucuc

SEQ ID NO: 530700 - RNA, 23 nt, Human
guaaaacauacuuaaaaaaaaac

SEQ ID NO: 530701 - RNA, 19 nt, Human
guucagagaaagaucugga

SEQ ID NO: 530702 - RNA, 20 nt, Human
uaaaacaagacuauauuuac

SEQ ID NO: 530703 - RNA, 20 nt, Human
uaaacagacgacauguagug

SEQ ID NO: 530704 - RNA, 24 nt, Human
uaaacagacgacauguaguggcca

SEQ ID NO: 530705 - RNA, 20 nt, Human
uaacaaugcuuaacucuagu

SEQ ID NO: 530706 - RNA, 25 nt, Human
uaauagagacagacacuccagacca

SEQ ID NO: 530707 - RNA, 20 nt, Human
uaauuaccaugcaguucaac

SEQ ID NO: 530708 - RNA, 26 nt, Human
uacuuccuaucuuuuaucagguuggg

SEQ ID NO: 530709 - RNA, 21 nt, Human
uagagacagacacuccagacc

SEQ ID NO: 530710 - RNA, 20 nt, Human
uauaacuaauuaccaugcag

SEQ ID NO: 530711 - RNA, 18 nt, Human
uauaauagagacagacac

SEQ ID NO: 530712 - RNA, 19 nt, Human
ucagaacucauuuacaauc

SEQ ID NO: 530713 - RNA, 19 nt, Human
uccccaggucauugaacau

SEQ ID NO: 530714 - RNA, 24 nt, Human
uccucuaacaaugcuuaacucuag

SEQ ID NO: 530715 - RNA, 22 nt, Human
uccucugacuucucaguaauuc

SEQ ID NO: 530716 - RNA, 23 nt, Human
ucucuguggcaauuacuuaacuc

SEQ ID NO: 530717 - RNA, 19 nt, Human
ucugaccuccaaggcaggu

SEQ ID NO: 530718 - RNA, 20 nt, Human
ucuggaguccaagggcuagc

SEQ ID NO: 530719 - RNA, 21 nt, Human
ucuuccggccggacuccacga

SEQ ID NO: 530720 - RNA, 21 nt, Human
ucuugaauuuggauagcacuu

SEQ ID NO: 530721 - RNA, 19 nt, Human
ugaaauuauuaagccauaa

SEQ ID NO: 530722 - RNA, 21 nt, Human
ugaaggcaugaguaaaacuaa

SEQ ID NO: 530723 - RNA, 19 nt, Human
ugacaaaaugccaaaacac

SEQ ID NO: 530724 - RNA, 20 nt, Human
ugacaaaaugccaaaacacc

SEQ ID NO: 530725 - RNA, 19 nt, Human
ugacuucucaguaauuccu

SEQ ID NO: 530726 - RNA, 20 nt, Human
ugacuucucaguaauuccuc

SEQ ID NO: 530727 - RNA, 21 nt, Human
ugagcaugugguaguugcagg

SEQ ID NO: 530728 - RNA, 23 nt, Human
ugcaguucaacaauaaucacaaa

SEQ ID NO: 530729 - RNA, 25 nt, Human
uggcugacuucuagcagagcucuau

SEQ ID NO: 530730 - RNA, 21 nt, Human
ugguaguugcaggaagagugu

SEQ ID NO: 530731 - RNA, 21 nt, Human
ugucuacuugcuguccacaug

SEQ ID NO: 530732 - RNA, 21 nt, Human
uuaagaaaaaguucagagaaa

SEQ ID NO: 530733 - RNA, 25 nt, Human
uucaacagaaaaacauaucccuacu

SEQ ID NO: 530734 - RNA, 21 nt, Human
uucaucccaaaugucuacuug

SEQ ID NO: 530735 - RNA, 23 nt, Human
uuccuaucuuuuaucagguuggg

SEQ ID NO: 530736 - RNA, 20 nt, Human
aaaaaacaaagaaaugacuu

SEQ ID NO: 530737 - RNA, 23 nt, Human
aaaaaacaaagaaaugacuuuag

SEQ ID NO: 530738 - RNA, 22 nt, Human
aaagaagaaaugggccaggcgc

SEQ ID NO: 530739 - RNA, 20 nt, Human
aacagagcaagacuccaucu

SEQ ID NO: 530740 - RNA, 20 nt, Human
aauauggugaaaacccaucu

SEQ ID NO: 530741 - RNA, 24 nt, Human
aaucgcuugaacccgggaggugga

SEQ ID NO: 530742 - RNA, 25 nt, Human
acauuaaguaugggucaaaaaaaga

SEQ ID NO: 530743 - RNA, 24 nt, Human
acgccacugcauuccagccugggc

SEQ ID NO: 530744 - RNA, 24 nt, Human
acgccacugcauuccagccugggc

SEQ ID NO: 530745 - RNA, 21 nt, Human
acuccaucucccaaaaaacaa

SEQ ID NO: 530746 - RNA, 24 nt, Human
acugcauuccagccugggcaacag

SEQ ID NO: 530747 - RNA, 24 nt, Human
acugcauuccagccugggcaacag

SEQ ID NO: 530748 - RNA, 18 nt, Human
agccaggcaugguggugc

SEQ ID NO: 530749 - RNA, 23 nt, Human
agccaggcaugguggugcacgcc

SEQ ID NO: 530750 - RNA, 24 nt, Human
agccugggcaacagagcaagacuc

SEQ ID NO: 530751 - RNA, 24 nt, Human
aggcaggagaaucgcuugaacccg

SEQ ID NO: 530752 - RNA, 19 nt, Human
aggcagguguaucacaagg

SEQ ID NO: 530753 - RNA, 24 nt, Human
aggcagguguaucacaaggucagg

SEQ ID NO: 530754 - RNA, 21 nt, Human
aggcaugguggugcacgccug

SEQ ID NO: 530755 - RNA, 24 nt, Human
aggcaugguggugcacgccuguaa

SEQ ID NO: 530756 - RNA, 24 nt, Human
aggcgcgguggcucaucccuuugg

SEQ ID NO: 530757 - RNA, 20 nt, Human
aggcugaggcaggagaaucg

SEQ ID NO: 530758 - RNA, 24 nt, Human
aggcugaggcaggagaaucgcuug

SEQ ID NO: 530759 - RNA, 24 nt, Human
agguggagguugcagugagccgag

SEQ ID NO: 530760 - RNA, 24 nt, Human
agguguaucacaaggucaggaguu

SEQ ID NO: 530761 - RNA, 21 nt, Human
aucacaaggucaggaguucga

SEQ ID NO: 530762 - RNA, 24 nt, Human
aucacgccacugcauuccagccug

SEQ ID NO: 530763 - RNA, 18 nt, Human
auggugaaaacccaucuc

SEQ ID NO: 530764 - RNA, 23 nt, Human
caaaaaaagaagaaaugggccag

SEQ ID NO: 530765 - RNA, 22 nt, Human
caaaaaauaccagcaguaaaau

SEQ ID NO: 530766 - RNA, 24 nt, Human
caacagagcaagacuccaucuccc

SEQ ID NO: 530767 - RNA, 25 nt, Human
caacagagcaagacuccaucuccca

SEQ ID NO: 530768 - RNA, 20 nt, Human
cacgccuguaaucccagaua

SEQ ID NO: 530769 - RNA, 19 nt, Human
cacugcauuccagccuggg

SEQ ID NO: 530770 - RNA, 22 nt, Human
cacugcauuccagccugggcaa

SEQ ID NO: 530771 - RNA, 23 nt, Human
cacugcauuccagccugggcaac

SEQ ID NO: 530772 - RNA, 24 nt, Human
cacugcauuccagccugggcaaca

SEQ ID NO: 530773 - RNA, 21 nt, Human
cagagcaagacuccaucuccc

SEQ ID NO: 530774 - RNA, 24 nt, Human
cagauacucaggaggcugaggcag

SEQ ID NO: 530775 - RNA, 24 nt, Human
caggcuaaaaauaaauaauaaaug

SEQ ID NO: 530776 - RNA, 24 nt, Human
caucccuuugggaggcugaggcag

SEQ ID NO: 530777 - RNA, 20 nt, Human
ccacugcauuccagccuggg

SEQ ID NO: 530778 - RNA, 21 nt, Human
ccacugcauuccagccugggc

SEQ ID NO: 530779 - RNA, 23 nt, Human
ccacugcauuccagccugggcaa

SEQ ID NO: 530780 - RNA, 24 nt, Human
ccacugcauuccagccugggcaac

SEQ ID NO: 530781 - RNA, 22 nt, Human
cccaucucuacuaaaaaaaaca

SEQ ID NO: 530782 - RNA, 21 nt, Human
cccgggagguggagguugcag

SEQ ID NO: 530783 - RNA, 24 nt, Human
ccugaccaauauggugaaaaccca

SEQ ID NO: 530784 - RNA, 22 nt, Human
ccugggcaacagagcaagacuc

SEQ ID NO: 530785 - RNA, 24 nt, Human
cgagaccagccugaccaauauggu

SEQ ID NO: 530786 - RNA, 24 nt, Human
cgagaucacgccacugcauuccag

SEQ ID NO: 530787 - RNA, 24 nt, Human
cgccacugcauuccagccugggca

SEQ ID NO: 530788 - RNA, 24 nt, Human
cgccuguaaucccagauacucagg

SEQ ID NO: 530789 - RNA, 29 nt, Human
cgggagguggagguugcagugacaacggu

SEQ ID NO: 530790 - RNA, 24 nt, Human
cgggagguggagguugcagugagc

SEQ ID NO: 530791 - RNA, 22 nt, Human
cuccaucucccaaaaaacaaag

SEQ ID NO: 530792 - RNA, 21 nt, Human
cucuacuaaaaaaaacacaaa

SEQ ID NO: 530793 - RNA, 23 nt, Human
gagaaucgcuugaacccgggagg

SEQ ID NO: 530794 - RNA, 22 nt, Human
gagcaagacuccaucucccaaa

SEQ ID NO: 530795 - RNA, 22 nt, Human
gagguugcagugagccgagauc

SEQ ID NO: 530796 - RNA, 20 nt, Human
gcacucuauauucuucuucu

SEQ ID NO: 530797 - RNA, 20 nt, Human
gcaguaaaaucucuugaaga

SEQ ID NO: 530798 - RNA, 24 nt, Human
gcauuccagccugggcaacagagc

SEQ ID NO: 530799 - RNA, 22 nt, Human
gccacugcauuccagccugggc

SEQ ID NO: 530800 - RNA, 24 nt, Human
gccacugcauuccagccugggcaa

SEQ ID NO: 530801 - RNA, 20 nt, Human
gccgagaucacgccacugca

SEQ ID NO: 530802 - RNA, 18 nt, Human
ggagguugcagugagccg

SEQ ID NO: 530803 - RNA, 20 nt, Human
ggagguugcagugagccgag

SEQ ID NO: 530804 - RNA, 22 nt, Human
ggagguugcagugagccgagau

SEQ ID NO: 530805 - RNA, 23 nt, Human
ggagguugcagugagccgagauc

SEQ ID NO: 530806 - RNA, 24 nt, Human
ggagguugcagugagccgagauca

SEQ ID NO: 530807 - RNA, 21 nt, Human
ggcacucuauauucuucuucu

SEQ ID NO: 530808 - RNA, 21 nt, Human
gguggcucaucccuuugggag

SEQ ID NO: 530809 - RNA, 24 nt, Human
gguggugcacgccuguaaucccag

SEQ ID NO: 530810 - RNA, 19 nt, Human
guugcagugagccgagauc

SEQ ID NO: 530811 - RNA, 25 nt, Human
uacuaaaaaaaacacaaaacuuagc

SEQ ID NO: 530812 - RNA, 18 nt, Human
uagacaaauggcuugaau

SEQ ID NO: 530813 - RNA, 24 nt, Human
uaucacaaggucaggaguucgaga

SEQ ID NO: 530814 - RNA, 21 nt, Human
ucaaaaaaagaagaaaugggc

SEQ ID NO: 530815 - RNA, 23 nt, Human
ucaaaaaaagaagaaaugggcca

SEQ ID NO: 530816 - RNA, 20 nt, Human
ucaaaaaauaccagcaguaa

SEQ ID NO: 530817 - RNA, 18 nt, Human
ucacaaggucaggaguuc

SEQ ID NO: 530818 - RNA, 24 nt, Human
ucacaaggucaggaguucgagacc

SEQ ID NO: 530819 - RNA, 23 nt, Human
ucacgccacugcauuccagccug

SEQ ID NO: 530820 - RNA, 19 nt, Human
ucccaaaaaacaaagaaau

SEQ ID NO: 530821 - RNA, 23 nt, Human
ucccaaaaaacaaagaaaugacu

SEQ ID NO: 530822 - RNA, 24 nt, Human
ucgcuugaacccgggagguggagg

SEQ ID NO: 530823 - RNA, 21 nt, Human
ucucccaaaaaacaaagaaau

SEQ ID NO: 530824 - RNA, 23 nt, Human
ugaaaacccaucucuacuaaaaa

SEQ ID NO: 530825 - RNA, 22 nt, Human
ugaaauuacaaagaggagugca

SEQ ID NO: 530826 - RNA, 23 nt, Human
ugaaugaaauuacaaagaggagu

SEQ ID NO: 530827 - RNA, 22 nt, Human
ugacaagaauaguuucugcaac

SEQ ID NO: 530828 - RNA, 19 nt, Human
ugacuuuagacaaauggcu

SEQ ID NO: 530829 - RNA, 22 nt, Human
ugagccgagaucacgccacugc

SEQ ID NO: 530830 - RNA, 24 nt, Human
ugaggcaggagaaucgcuugaacc

SEQ ID NO: 530831 - RNA, 25 nt, Human
ugaggcaggagaaucgcuugaaccc

SEQ ID NO: 530832 - RNA, 24 nt, Human
ugaggcagguguaucacaagguca

SEQ ID NO: 530833 - RNA, 19 nt, Human
ugggaggcugaggcaggug

SEQ ID NO: 530834 - RNA, 24 nt, Human
ugggaggcugaggcagguguauca

SEQ ID NO: 530835 - RNA, 21 nt, Human
uggugcacgccuguaauccca

SEQ ID NO: 530836 - RNA, 22 nt, Human
uggugcacgccuguaaucccag

SEQ ID NO: 530837 - RNA, 24 nt, Human
ugguggugcacgccuguaauccca

SEQ ID NO: 530838 - RNA, 22 nt, Human
uguaucacaaggucaggaguuc

SEQ ID NO: 530839 - RNA, 24 nt, Human
uguaucacaaggucaggaguucga

SEQ ID NO: 530840 - RNA, 20 nt, Human
uucuauuguaaaguuuccau

SEQ ID NO: 530841 - RNA, 24 nt, Human
uugaacccgggagguggagguugc

SEQ ID NO: 530842 - RNA, 18 nt, Human
uugcagugagccgagauc

SEQ ID NO: 530843 - RNA, 20 nt, Human
uugcagugagccgagaucac

SEQ ID NO: 530844 - RNA, 21 nt, Human
uugcagugagccgagaucacg

SEQ ID NO: 530845 - RNA, 24 nt, Human
aaacaacccaaauccuccuccucg

SEQ ID NO: 530846 - RNA, 26 nt, Human
aaaguaaccccuaacaaaacaaccca

SEQ ID NO: 530847 - RNA, 21 nt, Human
aacaaaaacaaccauaccaac

SEQ ID NO: 530848 - RNA, 21 nt, Human
aacaaaacaacccaaauccuc

SEQ ID NO: 530849 - RNA, 23 nt, Human
aacaaaacaacccaaauccuccu

SEQ ID NO: 530850 - RNA, 22 nt, Human
aaccauaccaacaaaacagggc

SEQ ID NO: 530851 - RNA, 22 nt, Human
aaccccuaacaaaacaacccaa

SEQ ID NO: 530852 - RNA, 22 nt, Human
aagcaggcagcauccugucaga

SEQ ID NO: 530853 - RNA, 24 nt, Human
acaaaaacaaccauaccaacaaaa

SEQ ID NO: 530854 - RNA, 26 nt, Human
agccaagcaggcagcauccugucaga

SEQ ID NO: 530855 - RNA, 22 nt, Human
aggcagcauccugucagaaaca

SEQ ID NO: 530856 - RNA, 23 nt, Human
agguggccuggaggggagaacag

SEQ ID NO: 530857 - RNA, 21 nt, Human
caaaacaacccaaauccuccu

SEQ ID NO: 530858 - RNA, 23 nt, Human
caaaacaacccaaauccuccucc

SEQ ID NO: 530859 - RNA, 19 nt, Human
caaccauaccaacaaaaca

SEQ ID NO: 530860 - RNA, 21 nt, Human
caaccauaccaacaaaacagg

SEQ ID NO: 530861 - RNA, 24 nt, Human
cacaaaugaaauguuccccugaaa

SEQ ID NO: 530862 - RNA, 23 nt, Human
cacuugugggcugggaucccagc

SEQ ID NO: 530863 - RNA, 24 nt, Human
cagagacagguggccuggagggga

SEQ ID NO: 530864 - RNA, 23 nt, Human
cagcauccugucagaaacaacca

SEQ ID NO: 530865 - RNA, 20 nt, Human
cagcccggggcgggcggcaa

SEQ ID NO: 530866 - RNA, 19 nt, Human
cagcuaagaagcugcuuuc

SEQ ID NO: 530867 - RNA, 22 nt, Human
cagcuucucuuccacuucccca

SEQ ID NO: 530868 - RNA, 23 nt, Human
cauuuuacagccauuauccaaca

SEQ ID NO: 530869 - RNA, 23 nt, Human
ccacuuccccacaccguacaugc

SEQ ID NO: 530870 - RNA, 25 nt, Human
ccauaccaacaaaacagggcuuaag

SEQ ID NO: 530871 - RNA, 23 nt, Human
ccccacaccguacaugccucucc

SEQ ID NO: 530872 - RNA, 20 nt, Human
ccccgccagcuucucuucca

SEQ ID NO: 530873 - RNA, 22 nt, Human
ccccgccagcuucucuuccacu

SEQ ID NO: 530874 - RNA, 22 nt, Human
ccguacaugccucucccuuucu

SEQ ID NO: 530875 - RNA, 18 nt, Human
ccugucagaaacaaccag

SEQ ID NO: 530876 - RNA, 21 nt, Human
cugcucucucccaugcagggu

SEQ ID NO: 530877 - RNA, 19 nt, Human
cuggcccacuucagcugca

SEQ ID NO: 530878 - RNA, 18 nt, Human
cuguggauaucucuggcc

SEQ ID NO: 530879 - RNA, 21 nt, Human
cuuguaccagaaaggggaagu

SEQ ID NO: 530880 - RNA, 22 nt, Human
gaaagaagccuucaccauggug

SEQ ID NO: 530881 - RNA, 18 nt, Human
gaacagagcagacauccu

SEQ ID NO: 530882 - RNA, 19 nt, Human
gaacagagcagacauccuu

SEQ ID NO: 530883 - RNA, 28 nt, Human
gaccugcuggcccccuccagggcacuuc

SEQ ID NO: 530884 - RNA, 21 nt, Human
gaggaaaacaaaaacaaccau

SEQ ID NO: 530885 - RNA, 18 nt, Human
gcaguggggaaagaagcc

SEQ ID NO: 530886 - RNA, 18 nt, Human
gccuggcuggugcaaggc

SEQ ID NO: 530887 - RNA, 22 nt, Human
ggaaaacaaaaacaaccauacc

SEQ ID NO: 530888 - RNA, 23 nt, Human
ggagaacagguaggggcacacug

SEQ ID NO: 530889 - RNA, 23 nt, Human
ggagccgggaggcgcgaacagcu

SEQ ID NO: 530890 - RNA, 22 nt, Human
ggaggcgcgaacagcuccagug

SEQ ID NO: 530891 - RNA, 21 nt, Human
ggagggcgcgaggcaaacgag

SEQ ID NO: 530892 - RNA, 21 nt, Human
ggccuggcuggugcaaggcug

SEQ ID NO: 530893 - RNA, 23 nt, Human
gggcuccuccaagcuguggauau

SEQ ID NO: 530894 - RNA, 20 nt, Human
gguagccugguauuuggugc

SEQ ID NO: 530895 - RNA, 22 nt, Human
gguccugcaguggggaaagaag

SEQ ID NO: 530896 - RNA, 22 nt, Human
gguggucuggccuggcuggugc

SEQ ID NO: 530897 - RNA, 25 nt, Human
uaaaaaggaaucugagaaaacccug

SEQ ID NO: 530898 - RNA, 18 nt, Human
uaacaaaacaacccaaau

SEQ ID NO: 530899 - RNA, 20 nt, Human
uaacacaaaugaaauguucc

SEQ ID NO: 530900 - RNA, 20 nt, Human
uaacucagcucaucucauag

SEQ ID NO: 530901 - RNA, 25 nt, Human
uacagagacagguggccuggagggg

SEQ ID NO: 530902 - RNA, 22 nt, Human
uacagccauuauccaacagaca

SEQ ID NO: 530903 - RNA, 21 nt, Human
uccuccucgguccuucucaaa

SEQ ID NO: 530904 - RNA, 18 nt, Human
ucucccccgccagcuucu

SEQ ID NO: 530905 - RNA, 18 nt, Human
ugaccugcuggcccccuc

SEQ ID NO: 530906 - RNA, 19 nt, Human
ugguagcgacuccucugcc

SEQ ID NO: 530907 - RNA, 23 nt, Human
ugguggucuggccuggcuggugc

SEQ ID NO: 530908 - RNA, 23 nt, Human
uuccccugaaaguaaccccuaac

SEQ ID NO: 530909 - RNA, 20 nt, Human
uucucuuccacuuccccaca

SEQ ID NO: 530910 - RNA, 19 nt, Human
uugcggacugacagagcgc

SEQ ID NO: 530911 - RNA, 19 nt, Human
uuuaaagaaugguucuucu

SEQ ID NO: 530912 - RNA, 23 nt, Human
uuuuaaacauuuuacagccauua

SEQ ID NO: 530913 - RNA, 24 nt, Human
aaugaauuccagggaaaaccaccu

SEQ ID NO: 530914 - RNA, 21 nt, Human
agcaaacaauuaaugaauucc

SEQ ID NO: 530915 - RNA, 21 nt, Human
aggaugacaaaaaauauacaa

SEQ ID NO: 530916 - RNA, 24 nt, Human
cucaggaugacaaaaaauauacaa

SEQ ID NO: 530917 - RNA, 21 nt, Human
uacaaugaaauuagaaguauc

SEQ ID NO: 530918 - RNA, 22 nt, Human
uagaaguaucucaggaugacug

SEQ ID NO: 530919 - RNA, 24 nt, Human
uaguaaggcucuuuccacaugucc

SEQ ID NO: 530920 - RNA, 24 nt, Human
aaaaagaaaaaagaaaaguuauga

SEQ ID NO: 530921 - RNA, 20 nt, Human
aaaagacaagcaacagauac

SEQ ID NO: 530922 - RNA, 23 nt, Human
aagcauugucauaguuguaguac

SEQ ID NO: 530923 - RNA, 20 nt, Human
aaguaagcaaaauaguauga

SEQ ID NO: 530924 - RNA, 23 nt, Human
acaaaagacaagcaacagauaca

SEQ ID NO: 530925 - RNA, 18 nt, Human
acaagcaacagauacaga

SEQ ID NO: 530926 - RNA, 20 nt, Human
agaagucaacuuuuuacaca

SEQ ID NO: 530927 - RNA, 21 nt, Human
agcuguaaccaccuaugguca

SEQ ID NO: 530928 - RNA, 21 nt, Human
aggcaggacccgcggaaggcu

SEQ ID NO: 530929 - RNA, 20 nt, Human
aguuuauuuaucaaaaaaug

SEQ ID NO: 530930 - RNA, 22 nt, Human
aguuuauuuaucaaaaaaugug

SEQ ID NO: 530931 - RNA, 19 nt, Human
auuuuuuuuuuuuuugcaa

SEQ ID NO: 530932 - RNA, 24 nt, Human
caaaagacaagcaacagauacaga

SEQ ID NO: 530933 - RNA, 21 nt, Human
caaaggacaggaggaaaagga

SEQ ID NO: 530934 - RNA, 21 nt, Human
cccggcucggcccgguccggc

SEQ ID NO: 530935 - RNA, 22 nt, Human
cccgggcggcccggcucggccc

SEQ ID NO: 530936 - RNA, 19 nt, Human
cccucuuuaaguuggugcc

SEQ ID NO: 530937 - RNA, 22 nt, Human
ccgcagccgcgucacccggagc

SEQ ID NO: 530938 - RNA, 25 nt, Human
ccuauggucauaacacauaaucacu

SEQ ID NO: 530939 - RNA, 24 nt, Human
cuaaauagccauggguuaggaaac

SEQ ID NO: 530940 - RNA, 24 nt, Human
gauaaucuuuguauugaggccuug

SEQ ID NO: 530941 - RNA, 24 nt, Human
uaagacagauguuuaaauagcacu

SEQ ID NO: 530942 - RNA, 25 nt, Human
uaagcaaaauaguaugacuucuuuu

SEQ ID NO: 530943 - RNA, 25 nt, Human
uacagaauuaacgauauacuuuuaa

SEQ ID NO: 530944 - RNA, 24 nt, Human
uauuuuagaaauguaggucaagca

SEQ ID NO: 530945 - RNA, 26 nt, Human
ucacuccuaaacaguucuaauuaaaa

SEQ ID NO: 530946 - RNA, 22 nt, Human
ugagaauaauggcuucaauuug

SEQ ID NO: 530947 - RNA, 20 nt, Human
ugagaccaggaaaaccuggu

SEQ ID NO: 530948 - RNA, 22 nt, Human
uguucuccuaauggaaaaagaa

SEQ ID NO: 530949 - RNA, 20 nt, Human
uuacaaaagacaagcaacag

SEQ ID NO: 530950 - RNA, 24 nt, Human
uuagaacauaaacugacaugaagu

SEQ ID NO: 530951 - RNA, 18 nt, Human
uuaggcccacagagauag

SEQ ID NO: 530952 - RNA, 21 nt, Human
uucuuuggcaaaagauucuaa

SEQ ID NO: 530953 - RNA, 18 nt, Human
uugaggccuugauuucag

SEQ ID NO: 530954 - RNA, 27 nt, Human
uuuaagacagauguuuaaauagcacuc

SEQ ID NO: 530955 - RNA, 23 nt, Human
aaacagaaucacagcauuucugc

SEQ ID NO: 530956 - RNA, 18 nt, Human
aaagcccucaaacucucc

SEQ ID NO: 530957 - RNA, 19 nt, Human
accucuggucaaagauaga

SEQ ID NO: 530958 - RNA, 24 nt, Human
agauguuuaacagagcugagauug

SEQ ID NO: 530959 - RNA, 20 nt, Human
auacuagagcauccugaagc

SEQ ID NO: 530960 - RNA, 27 nt, Human
caaccacugcguacuuucuucucaaau

SEQ ID NO: 530961 - RNA, 21 nt, Human
cagagacucuuccugacguua

SEQ ID NO: 530962 - RNA, 21 nt, Human
cagcaauguucuccuuccucc

SEQ ID NO: 530963 - RNA, 20 nt, Human
cuacagcaauguucuccuuc

SEQ ID NO: 530964 - RNA, 18 nt, Human
gaaaauauuucaagcaga

SEQ ID NO: 530965 - RNA, 23 nt, Human
gacucuuccugacguuaucugua

SEQ ID NO: 530966 - RNA, 18 nt, Human
gagcauuucauugaaaau

SEQ ID NO: 530967 - RNA, 22 nt, Human
guuaucuguaaugcacagcugg

SEQ ID NO: 530968 - RNA, 21 nt, Human
uaacagagcugagauugauca

SEQ ID NO: 530969 - RNA, 20 nt, Human
ucauugaaaauauuucaagc

SEQ ID NO: 530970 - RNA, 23 nt, Human
ucccuuuuucccucaauuaaaau

SEQ ID NO: 530971 - RNA, 18 nt, Human
ucuccuuccuccuuuucu

SEQ ID NO: 530972 - RNA, 24 nt, Human
ucugcgaaagcccucaaacucucc

SEQ ID NO: 530973 - RNA, 21 nt, Human
ucuguaaugcacagcuggaag

SEQ ID NO: 530974 - RNA, 21 nt, Human
ugacacacucacguaaggcac

SEQ ID NO: 530975 - RNA, 21 nt, Human
ugcaagcugcugaaugcagua

SEQ ID NO: 530976 - RNA, 20 nt, Human
uggaagagguguucaaagua

SEQ ID NO: 530977 - RNA, 21 nt, Human
uggaagagguguucaaaguaa

SEQ ID NO: 530978 - RNA, 21 nt, Human
uuaaaacagaaucacagcauu

SEQ ID NO: 530979 - RNA, 22 nt, Human
uucauaaaguuaaaaccucugg

SEQ ID NO: 530980 - RNA, 23 nt, Human
uucauugaaaauauuucaagcag

SEQ ID NO: 530981 - RNA, 24 nt, Human
uucauugaaaauauuucaagcaga

SEQ ID NO: 530982 - RNA, 19 nt, Human
uuugcaagcugcugaaugc

SEQ ID NO: 530983 - RNA, 23 nt, Human
aaaaaagaaggaaagcuccaaaa

SEQ ID NO: 530984 - RNA, 22 nt, Human
aaaaagaaggaaagcuccaaaa

SEQ ID NO: 530985 - RNA, 23 nt, Human
aaaagcacuuaagaguuaccacc

SEQ ID NO: 530986 - RNA, 21 nt, Human
aaagaaggaaagcuccaaaag

SEQ ID NO: 530987 - RNA, 18 nt, Human
aaccccaacaagcagcga

SEQ ID NO: 530988 - RNA, 23 nt, Human
aagaguuaccaccacauuuugcc

SEQ ID NO: 530989 - RNA, 24 nt, Human
aagcauuuucaguugaaaugaaaa

SEQ ID NO: 530990 - RNA, 21 nt, Human
aagcccaaccagccaaccacc

SEQ ID NO: 530991 - RNA, 19 nt, Human
agaaugcaaacagacagcu

SEQ ID NO: 530992 - RNA, 20 nt, Human
agaaugcaaacagacagcua

SEQ ID NO: 530993 - RNA, 20 nt, Human
agagggcgaaaucgugcagu

SEQ ID NO: 530994 - RNA, 21 nt, Human
agcccaaccagccaaccaccu

SEQ ID NO: 530995 - RNA, 23 nt, Human
agccccugccggucagguuuccc

SEQ ID NO: 530996 - RNA, 21 nt, Human
aggcagccucaggaaggucuu

SEQ ID NO: 530997 - RNA, 25 nt, Human
aggcaggggugcucuaugcucauca

SEQ ID NO: 530998 - RNA, 24 nt, Human
agggaagaggugaagcuuucagga

SEQ ID NO: 530999 - RNA, 20 nt, Human
aggggagcugagcagagggc

SEQ ID NO: 531000 - RNA, 24 nt, Human
agggggcagaggggagcugagcag

SEQ ID NO: 531001 - RNA, 24 nt, Human
aguggugguguguuuguacucagc

SEQ ID NO: 531002 - RNA, 24 nt, Human
caaaagcacuuaagaguuaccagu

SEQ ID NO: 531003 - RNA, 18 nt, Human
caagagauaccaaaagca

SEQ ID NO: 531004 - RNA, 19 nt, Human
cagaaugcaaacagacagc

SEQ ID NO: 531005 - RNA, 27 nt, Human
cagaaugcaaacagacagcuauaaacg

SEQ ID NO: 531006 - RNA, 22 nt, Human
cagcaagcuccagacagucuga

SEQ ID NO: 531007 - RNA, 25 nt, Human
cagcuauaaacgaagaaaugcuuaa

SEQ ID NO: 531008 - RNA, 18 nt, Human
caggaaggucuuugggug

SEQ ID NO: 531009 - RNA, 26 nt, Human
cauaaccccuucaccuguaaccccaa

SEQ ID NO: 531010 - RNA, 25 nt, Human
cauacuaguagagucauucaaaaca

SEQ ID NO: 531011 - RNA, 23 nt, Human
ccaagcuuaaaaauuaugaaucc

SEQ ID NO: 531012 - RNA, 19 nt, Human
ccaccacauuuugcccaag

SEQ ID NO: 531013 - RNA, 25 nt, Human
cccauaaccccuucaccuguaaccc

SEQ ID NO: 531014 - RNA, 20 nt, Human
cccaucaugggaacagcagc

SEQ ID NO: 531015 - RNA, 24 nt, Human
ccccggaacuggcgccucacagac

SEQ ID NO: 531016 - RNA, 20 nt, Human
ccgccacgguggcgggaagg

SEQ ID NO: 531017 - RNA, 19 nt, Human
ccuguaaccccaacaagca

SEQ ID NO: 531018 - RNA, 22 nt, Human
cgccucacagacagcgcggggc

SEQ ID NO: 531019 - RNA, 23 nt, Human
cgguggcgggaaggccaagcgcu

SEQ ID NO: 531020 - RNA, 29 nt, Human
cucaagagauaccaaaagcacuuaagagg

SEQ ID NO: 531021 - RNA, 23 nt, Human
cucagagcgaggggaggccggga

SEQ ID NO: 531022 - RNA, 19 nt, Human
cuccagacagucugaguug

SEQ ID NO: 531023 - RNA, 25 nt, Human
cugaggcagccucaggaaggucuuu

SEQ ID NO: 531024 - RNA, 26 nt, Human
cuggggaccccgagccucagagcgag

SEQ ID NO: 531025 - RNA, 22 nt, Human
cuguaaccccaacaagcagcga

SEQ ID NO: 531026 - RNA, 20 nt, Human
cuucaccuguaaccccaacc

SEQ ID NO: 531027 - RNA, 19 nt, Human
gagcagcgccccggaacug

SEQ ID NO: 531028 - RNA, 18 nt, Human
gaggaaggcaggggugcu

SEQ ID NO: 531029 - RNA, 22 nt, Human
gaggccgggagcagcgccccgg

SEQ ID NO: 531030 - RNA, 20 nt, Human
ggaaguuaaagcccaaccag

SEQ ID NO: 531031 - RNA, 23 nt, Human
ggcgggaaggccaagcgcuggcc

SEQ ID NO: 531032 - RNA, 19 nt, Human
ggggagcugagcagagggc

SEQ ID NO: 531033 - RNA, 22 nt, Human
ggggcggccgccacgguggcgg

SEQ ID NO: 531034 - RNA, 18 nt, Human
ggguggcuauucuagagg

SEQ ID NO: 531035 - RNA, 23 nt, Human
ggguggcuauucuagaggugaac

SEQ ID NO: 531036 - RNA, 20 nt, Human
guaaccccaacaagcagcga

SEQ ID NO: 531037 - RNA, 22 nt, Human
guugaaaugaaaaaagaaggaa

SEQ ID NO: 531038 - RNA, 18 nt, Human
uaaccccaacaagcagcg

SEQ ID NO: 531039 - RNA, 20 nt, Human
uaaccccuucaccuguaacc

SEQ ID NO: 531040 - RNA, 21 nt, Human
uaaccccuucaccuguaaccc

SEQ ID NO: 531041 - RNA, 18 nt, Human
ucaagagauaccaaaagc

SEQ ID NO: 531042 - RNA, 22 nt, Human
ucaggaaaugugcccaucaugg

SEQ ID NO: 531043 - RNA, 19 nt, Human
ucagucauucaagcuucuc

SEQ ID NO: 531044 - RNA, 21 nt, Human
ucaguugaaaugaaaaaagaa

SEQ ID NO: 531045 - RNA, 22 nt, Human
ucaguugaaaugaaaaaagaag

SEQ ID NO: 531046 - RNA, 24 nt, Human
ucaguugaaaugaaaaaagaagga

SEQ ID NO: 531047 - RNA, 23 nt, Human
uccaagcuuaaaaauuaugaauc

SEQ ID NO: 531048 - RNA, 21 nt, Human
ucccaggaaguuaaagcccaa

SEQ ID NO: 531049 - RNA, 19 nt, Human
uccugaggaaggcaggggu

SEQ ID NO: 531050 - RNA, 24 nt, Human
ugaaaaaagaaggaaagcuccaaa

SEQ ID NO: 531051 - RNA, 24 nt, Human
ugaaaaugaucccaguguucccaa

SEQ ID NO: 531052 - RNA, 24 nt, Human
ugaaaaugcccuuacaguugagau

SEQ ID NO: 531053 - RNA, 21 nt, Human
ugaggcagccucaggaagguc

SEQ ID NO: 531054 - RNA, 19 nt, Human
ugggaucuggaagucucuc

SEQ ID NO: 531055 - RNA, 18 nt, Human
uggggaccccgagccuca

SEQ ID NO: 531056 - RNA, 19 nt, Human
uggugguguguuuguacuc

SEQ ID NO: 531057 - RNA, 23 nt, Human
uguaaccccaacaagcagcgaaa

SEQ ID NO: 531058 - RNA, 19 nt, Human
uguacucagcaagcuccag

SEQ ID NO: 531059 - RNA, 18 nt, Human
ugugggaucuggaagucu

SEQ ID NO: 531060 - RNA, 23 nt, Human
uuaaagcccaaccagccaaccac

SEQ ID NO: 531061 - RNA, 26 nt, Human
uuaguggugguguguuuguacucagc

SEQ ID NO: 531062 - RNA, 18 nt, Human
uucaaaacagcaaguggu

SEQ ID NO: 531063 - RNA, 23 nt, Human
uucaccuguaaccccaacaagca

SEQ ID NO: 531064 - RNA, 22 nt, Human
uucuucacccauaaccccuuca

SEQ ID NO: 531065 - RNA, 18 nt, Human
aaaagacaacagaaacaa

SEQ ID NO: 531066 - RNA, 19 nt, Human
aaaaucuugcagguuauga

SEQ ID NO: 531067 - RNA, 18 nt, Human
aaacagauccggaacuuu

SEQ ID NO: 531068 - RNA, 20 nt, Human
aacaaauccacagauuacuc

SEQ ID NO: 531069 - RNA, 22 nt, Human
aagaaaauuuagguuucaacug

SEQ ID NO: 531070 - RNA, 18 nt, Human
aagaagcucacagacuca

SEQ ID NO: 531071 - RNA, 25 nt, Human
aagagacuccgcgccccccuaaucc

SEQ ID NO: 531072 - RNA, 20 nt, Human
aagcagacgcagaaucggac

SEQ ID NO: 531073 - RNA, 22 nt, Human
acaaauccuccguucacaaaac

SEQ ID NO: 531074 - RNA, 25 nt, Human
acaacaaccaaaaaaaaaaaaaaaa

SEQ ID NO: 531075 - RNA, 21 nt, Human
acaacagaaacaaauccacag

SEQ ID NO: 531076 - RNA, 26 nt, Human
acaaccaaaaaaaaaaaaaaaauagg

SEQ ID NO: 531077 - RNA, 18 nt, Human
acaaucaccacaacauaa

SEQ ID NO: 531078 - RNA, 20 nt, Human
agacaacagaaacaaaucca

SEQ ID NO: 531079 - RNA, 19 nt, Human
agcacauuucuguaucugg

SEQ ID NO: 531080 - RNA, 26 nt, Human
agccagagaagagaaaaacaaaucuc

SEQ ID NO: 531081 - RNA, 20 nt, Human
auuauacauaaaauuaccau

SEQ ID NO: 531082 - RNA, 25 nt, Human
caaaagcucuugguauauucaguag

SEQ ID NO: 531083 - RNA, 22 nt, Human
caacaaccaaaaaaaaaaaaaa

SEQ ID NO: 531084 - RNA, 28 nt, Human
caacagaaacaaauccacagauuacucu

SEQ ID NO: 531085 - RNA, 22 nt, Human
caaccgggaccuaugcacucaa

SEQ ID NO: 531086 - RNA, 18 nt, Human
cacaaaacaguggcaaaa

SEQ ID NO: 531087 - RNA, 21 nt, Human
cacagauuacuccaccuuuac

SEQ ID NO: 531088 - RNA, 19 nt, Human
caccccauucaccccaaac

SEQ ID NO: 531089 - RNA, 23 nt, Human
caccccauucaccccaaacuuaa

SEQ ID NO: 531090 - RNA, 23 nt, Human
caccuccgccgaccgccuccgac

SEQ ID NO: 531091 - RNA, 19 nt, Human
cacucuccgcuuugcccca

SEQ ID NO: 531092 - RNA, 21 nt, Human
cacuguacauauuuacagaga

SEQ ID NO: 531093 - RNA, 18 nt, Human
cauccaccccauucaccc

SEQ ID NO: 531094 - RNA, 19 nt, Human
ccacagauuacuccaccuu

SEQ ID NO: 531095 - RNA, 19 nt, Human
ccaccccauucaccccaaa

SEQ ID NO: 531096 - RNA, 28 nt, Human
cccaaaaacaauaaaaaguuuaaaaaua

SEQ ID NO: 531097 - RNA, 21 nt, Human
cccaaacuuaagauaaaaaaa

SEQ ID NO: 531098 - RNA, 20 nt, Human
ccccaaacuuaagauaaaaa

SEQ ID NO: 531099 - RNA, 18 nt, Human
ccccagaaggcagggcgg

SEQ ID NO: 531100 - RNA, 19 nt, Human
ccccagaaggcagggcggg

SEQ ID NO: 531101 - RNA, 20 nt, Human
ccgcgccccccuaauccgcc

SEQ ID NO: 531102 - RNA, 23 nt, Human
ccgcgccccccuaauccgccucc

SEQ ID NO: 531103 - RNA, 19 nt, Human
ccuaauccgccuccucagc

SEQ ID NO: 531104 - RNA, 26 nt, Human
cgccgaccgccuccgaccggcgcucc

SEQ ID NO: 531105 - RNA, 18 nt, Human
cgggguagacaccuccgc

SEQ ID NO: 531106 - RNA, 19 nt, Human
cguucaacgccaucaccgg

SEQ ID NO: 531107 - RNA, 23 nt, Human
cuaauuaaucacccagaaagcca

SEQ ID NO: 531108 - RNA, 21 nt, Human
cucauccaccccauucacccc

SEQ ID NO: 531109 - RNA, 23 nt, Human
cuccgcgccccccuaauccgccu

SEQ ID NO: 531110 - RNA, 24 nt, Human
cuccgcgccccccuaauccgccuc

SEQ ID NO: 531111 - RNA, 24 nt, Human
cuuaaaggaaaaaaaaaaggguuc

SEQ ID NO: 531112 - RNA, 18 nt, Human
gaaauagauuuccuuuau

SEQ ID NO: 531113 - RNA, 19 nt, Human
gaagagacuccgcgccccc

SEQ ID NO: 531114 - RNA, 23 nt, Human
gauuacuccaccuuuacccccac

SEQ ID NO: 531115 - RNA, 21 nt, Human
gccgaccgccuccgaccggcg

SEQ ID NO: 531116 - RNA, 22 nt, Human
gcucccggagaacuccagccuc

SEQ ID NO: 531117 - RNA, 18 nt, Human
ggaauaaagucuaugacc

SEQ ID NO: 531118 - RNA, 22 nt, Human
gggguagacaccuccgccgacc

SEQ ID NO: 531119 - RNA, 20 nt, Human
guagcuugaaauagauuucc

SEQ ID NO: 531120 - RNA, 24 nt, Human
gucucauccaccccauucacccca

SEQ ID NO: 531121 - RNA, 21 nt, Human
guuuuaagaaaaaucuugcag

SEQ ID NO: 531122 - RNA, 18 nt, Human
uaacaacaaccaaaaaaa

SEQ ID NO: 531123 - RNA, 31 nt, Human
uaaccauguuugacacucuucuuuuaucccc

SEQ ID NO: 531124 - RNA, 23 nt, Human
uaaccuacuaaauaugucuauua

SEQ ID NO: 531125 - RNA, 19 nt, Human
uaccaauauaugaaauuau

SEQ ID NO: 531126 - RNA, 23 nt, Human
uaccauauaaaguaauauuuaac

SEQ ID NO: 531127 - RNA, 21 nt, Human
uagcuugaaauagauuuccuu

SEQ ID NO: 531128 - RNA, 23 nt, Human
uaggauggaaaugugucacuaaa

SEQ ID NO: 531129 - RNA, 18 nt, Human
uagucccucgcagccuuc

SEQ ID NO: 531130 - RNA, 22 nt, Human
uauuccuucuuuuucauuccug

SEQ ID NO: 531131 - RNA, 18 nt, Human
ucaaacauaaacuuaagg

SEQ ID NO: 531132 - RNA, 20 nt, Human
ucaaguaagcuuuuauagua

SEQ ID NO: 531133 - RNA, 20 nt, Human
ucaaucagucucauccaccc

SEQ ID NO: 531134 - RNA, 20 nt, Human
ucacaaaacaguggcaaaaa

SEQ ID NO: 531135 - RNA, 19 nt, Human
ucauccaccccauucaccc

SEQ ID NO: 531136 - RNA, 19 nt, Human
ucucauagcccgugcacuu

SEQ ID NO: 531137 - RNA, 24 nt, Human
ucuuuccucgcguuacuguggggc

SEQ ID NO: 531138 - RNA, 20 nt, Human
ugaaugugucauuaaauuaa

SEQ ID NO: 531139 - RNA, 21 nt, Human
ugccccagaaggcagggcggg

SEQ ID NO: 531140 - RNA, 19 nt, Human
ugccucaaugaacugccuc

SEQ ID NO: 531141 - RNA, 26 nt, Human
uggggcagaaccgaccacucuccgcu

SEQ ID NO: 531142 - RNA, 22 nt, Human
uguccauucauucauucacuua

SEQ ID NO: 531143 - RNA, 23 nt, Human
uguugcuaucucauagcccgugc

SEQ ID NO: 531144 - RNA, 20 nt, Human
uuaaaagacaacagaaacaa

SEQ ID NO: 531145 - RNA, 20 nt, Human
uuuacagagaaaaaaauaaa

SEQ ID NO: 531146 - RNA, 23 nt, Human
aaagcagauuuaguuaaugcaaa

SEQ ID NO: 531147 - RNA, 21 nt, Human
aagacagagagggaaguucac

SEQ ID NO: 531148 - RNA, 24 nt, Human
aagcagauuuaguuaaugcaaaau

SEQ ID NO: 531149 - RNA, 26 nt, Human
aagccuuuaaucacauagaucagcuu

SEQ ID NO: 531150 - RNA, 22 nt, Human
agcuuauaaaagcagauuuagu

SEQ ID NO: 531151 - RNA, 24 nt, Human
agcuuucaaacaucaucuaaacaa

SEQ ID NO: 531152 - RNA, 18 nt, Human
aguaaucuuuuauaauua

SEQ ID NO: 531153 - RNA, 20 nt, Human
caaaaaggauaaauaaggca

SEQ ID NO: 531154 - RNA, 20 nt, Human
caaacaagacagagagggaa

SEQ ID NO: 531155 - RNA, 22 nt, Human
caaacaagacagagagggaagu

SEQ ID NO: 531156 - RNA, 24 nt, Human
cacuguacuuuuaaaaacgaaaac

SEQ ID NO: 531157 - RNA, 22 nt, Human
cccuuagccucagagaaggacu

SEQ ID NO: 531158 - RNA, 19 nt, Human
cucucaaaugacaaaacau

SEQ ID NO: 531159 - RNA, 20 nt, Human
cugaccuaggggagcugcuc

SEQ ID NO: 531160 - RNA, 22 nt, Human
cuugcugugggagcugagacug

SEQ ID NO: 531161 - RNA, 22 nt, Human
gaaggugagcagggagaggcca

SEQ ID NO: 531162 - RNA, 19 nt, Human
gaccaacaaugaacaugau

SEQ ID NO: 531163 - RNA, 23 nt, Human
gagagggaaguucacugcugggg

SEQ ID NO: 531164 - RNA, 18 nt, Human
gagcugcucagguucggc

SEQ ID NO: 531165 - RNA, 26 nt, Human
gcagggagaggccacaccaggcugga

SEQ ID NO: 531166 - RNA, 19 nt, Human
gcagguccucuucaggaag

SEQ ID NO: 531167 - RNA, 23 nt, Human
gguuugcaaagaagggcaucugu

SEQ ID NO: 531168 - RNA, 25 nt, Human
uaaaaacaaaaaggauaaauaaggc

SEQ ID NO: 531169 - RNA, 24 nt, Human
uaaaaggggguaacagaaauagua

SEQ ID NO: 531170 - RNA, 22 nt, Human
uauagaacaguuuuacucuugg

SEQ ID NO: 531171 - RNA, 19 nt, Human
ucaaaggugagaggaggga

SEQ ID NO: 531172 - RNA, 18 nt, Human
ucaggcucuugagguucu

SEQ ID NO: 531173 - RNA, 23 nt, Human
ucgugggcagaugcugcagggug

SEQ ID NO: 531174 - RNA, 23 nt, Human
ucugcaaguucccuucuccaucu

SEQ ID NO: 531175 - RNA, 26 nt, Human
ugaaaggcuugauaagcuuauaaaag

SEQ ID NO: 531176 - RNA, 25 nt, Human
ugacaaaacaucaaaggugagagga

SEQ ID NO: 531177 - RNA, 19 nt, Human
ugaccuaggggagcugcuc

SEQ ID NO: 531178 - RNA, 23 nt, Human
ugauaagcuuauaaaagcagauu

SEQ ID NO: 531179 - RNA, 18 nt, Human
ugggcagaugcugcaggg

SEQ ID NO: 531180 - RNA, 22 nt, Human
uucaggguugucuucucuggga

SEQ ID NO: 531181 - RNA, 19 nt, Human
uucccuucuccaucugaga

SEQ ID NO: 531182 - RNA, 19 nt, Human
uugaaaggcuugauaagcu

SEQ ID NO: 531183 - RNA, 18 nt, Human
uuuagaauacaugcucuc

SEQ ID NO: 531184 - RNA, 21 nt, Human
aguagcaaagaucaaagucuc

SEQ ID NO: 531185 - RNA, 20 nt, Human
auagauccucuucuuugagc

SEQ ID NO: 531186 - RNA, 25 nt, Human
caaaguaaguuggacuucccaaauc

SEQ ID NO: 531187 - RNA, 26 nt, Human
caaaguaaguuggacuucccaaauca

SEQ ID NO: 531188 - RNA, 20 nt, Human
caaagucuccgaauuuugcc

SEQ ID NO: 531189 - RNA, 24 nt, Human
ccagcaaaccuggaaauaucuccu

SEQ ID NO: 531190 - RNA, 24 nt, Human
ccaguagcaaagaucaaagucucc

SEQ ID NO: 531191 - RNA, 21 nt, Human
cccugcgagucgccgccgccc

SEQ ID NO: 531192 - RNA, 20 nt, Human
ccugcgagucgccgccgccc

SEQ ID NO: 531193 - RNA, 21 nt, Human
ccugcgagucgccgccgcccu

SEQ ID NO: 531194 - RNA, 24 nt, Human
cgccgccgcccugcucugccgccc

SEQ ID NO: 531195 - RNA, 21 nt, Human
cuagaguccuguagcuuuucu

SEQ ID NO: 531196 - RNA, 21 nt, Human
cuggccaaaguaaguuggacu

SEQ ID NO: 531197 - RNA, 18 nt, Human
cuguagcuuuucuguccu

SEQ ID NO: 531198 - RNA, 23 nt, Human
gacaagaaggaaacgguuaugua

SEQ ID NO: 531199 - RNA, 22 nt, Human
gccgcccgcuccgccgccgccg

SEQ ID NO: 531200 - RNA, 22 nt, Human
gcugcugucuggccaaaguaag

SEQ ID NO: 531201 - RNA, 19 nt, Human
uagaguccuguagcuuuuc

SEQ ID NO: 531202 - RNA, 21 nt, Human
uagcaaagaucaaagucuccg

SEQ ID NO: 531203 - RNA, 19 nt, Human
ucagugacaagaaggaaac

SEQ ID NO: 531204 - RNA, 25 nt, Human
ucgccgccgcccugcucugccgccc

SEQ ID NO: 531205 - RNA, 19 nt, Human
ugaaccagcuuagcugcug

SEQ ID NO: 531206 - RNA, 24 nt, Human
uggaaauaucuccugugauucagu

SEQ ID NO: 531207 - RNA, 19 nt, Human
uuaugcucugcuggguuga

SEQ ID NO: 531208 - RNA, 19 nt, Human
uuugccuuuggagaagggg

SEQ ID NO: 531209 - RNA, 18 nt, Human
uuuuuuuuuuuuuuuuug

SEQ ID NO: 531210 - RNA, 21 nt, Human
aaaagaaaauggacccaaagu

SEQ ID NO: 531211 - RNA, 26 nt, Human
aaaagaaaauggacccaaagucagaa

SEQ ID NO: 531212 - RNA, 18 nt, Human
aaaaggaggcaaugaaaa

SEQ ID NO: 531213 - RNA, 27 nt, Human
aaacaaaauagaaaguacccauucacc

SEQ ID NO: 531214 - RNA, 20 nt, Human
aaacaagaguuaagugcuuu

SEQ ID NO: 531215 - RNA, 18 nt, Human
aaacagaaaagaguagug

SEQ ID NO: 531216 - RNA, 21 nt, Human
aaagagcuccccugaaacuuu

SEQ ID NO: 531217 - RNA, 24 nt, Human
aaagcacagccucuugaaccuccu

SEQ ID NO: 531218 - RNA, 19 nt, Human
aacucggucgccaucuugg

SEQ ID NO: 531219 - RNA, 19 nt, Human
acacagcacagacucguac

SEQ ID NO: 531220 - RNA, 22 nt, Human
acagguaucaaagccuugggca

SEQ ID NO: 531221 - RNA, 18 nt, Human
acauguaaacacacaaga

SEQ ID NO: 531222 - RNA, 22 nt, Human
accaacacaacccucuuaucau

SEQ ID NO: 531223 - RNA, 24 nt, Human
agaaaaagugaagaagagaaucca

SEQ ID NO: 531224 - RNA, 21 nt, Human
agaaaauagguucccaguauu

SEQ ID NO: 531225 - RNA, 21 nt, Human
agaaauuaaaagaugagacaa

SEQ ID NO: 531226 - RNA, 22 nt, Human
agaacacaacauggaggaagau

SEQ ID NO: 531227 - RNA, 21 nt, Human
agacuacacagcagagaccca

SEQ ID NO: 531228 - RNA, 21 nt, Human
agagacccaggaaauaggucu

SEQ ID NO: 531229 - RNA, 18 nt, Human
agagggaaaggaaaguag

SEQ ID NO: 531230 - RNA, 19 nt, Human
agcaaagagcuccccugaa

SEQ ID NO: 531231 - RNA, 19 nt, Human
agcugcaagaaauuaaaca

SEQ ID NO: 531232 - RNA, 26 nt, Human
aggcaaugaaaagaaaauggacccaa

SEQ ID NO: 531233 - RNA, 25 nt, Human
agguaucaaagccuugggcaaaacc

SEQ ID NO: 531234 - RNA, 23 nt, Human
auggcagggcagagggaaaggaa

SEQ ID NO: 531235 - RNA, 24 nt, Human
caaagaacacaacauggaggaaga

SEQ ID NO: 531236 - RNA, 23 nt, Human
caaaguagcggcuagaaucuguc

SEQ ID NO: 531237 - RNA, 24 nt, Human
caaagucagaaaaagugaagaaga

SEQ ID NO: 531238 - RNA, 19 nt, Human
caaucaggcuggucuaauu

SEQ ID NO: 531239 - RNA, 25 nt, Human
caaucaggcuggucuaauuuccagu

SEQ ID NO: 531240 - RNA, 21 nt, Human
cacaauucaaacucaacaaac

SEQ ID NO: 531241 - RNA, 28 nt, Human
cacccagcacuggauguucacugagcac

SEQ ID NO: 531242 - RNA, 19 nt, Human
cacuggauguucacugagc

SEQ ID NO: 531243 - RNA, 19 nt, Human
cagagacccaggaaauagg

SEQ ID NO: 531244 - RNA, 18 nt, Human
cagcaaccagauggagcu

SEQ ID NO: 531245 - RNA, 23 nt, Human
cagcaauaccaggaaauuguucu

SEQ ID NO: 531246 - RNA, 18 nt, Human
caggggagugacauaaac

SEQ ID NO: 531247 - RNA, 19 nt, Human
ccaaaacuaugauaagauc

SEQ ID NO: 531248 - RNA, 21 nt, Human
ccaaaacuaugauaagaucca

SEQ ID NO: 531249 - RNA, 21 nt, Human
ccaacucggucgccaucuugg

SEQ ID NO: 531250 - RNA, 23 nt, Human
ccaacuuccuucacaaaugacaa

SEQ ID NO: 531251 - RNA, 25 nt, Human
ccagauacccaggcagcaaggcaau

SEQ ID NO: 531252 - RNA, 23 nt, Human
ccccucaaacagacgcuggccuu

SEQ ID NO: 531253 - RNA, 24 nt, Human
ccccugaaacuuuauccucgaggg

SEQ ID NO: 531254 - RNA, 21 nt, Human
cccucaaggucauuuuuauuc

SEQ ID NO: 531255 - RNA, 23 nt, Human
cggggcggaauccgguagacgcu

SEQ ID NO: 531256 - RNA, 19 nt, Human
cuccccugaaacuuuaucc

SEQ ID NO: 531257 - RNA, 21 nt, Human
cugaaaagaaauguuuaugga

SEQ ID NO: 531258 - RNA, 20 nt, Human
cugaaggagacuacacagca

SEQ ID NO: 531259 - RNA, 22 nt, Human
cugagcacaauaagccugaagg

SEQ ID NO: 531260 - RNA, 20 nt, Human
cugcuauggcucugcaagaa

SEQ ID NO: 531261 - RNA, 21 nt, Human
cuuaaacauuuuccauuuuuc

SEQ ID NO: 531262 - RNA, 18 nt, Human
cuuucuuggcuguacaag

SEQ ID NO: 531263 - RNA, 22 nt, Human
gaaaauggacccaaagucagaa

SEQ ID NO: 531264 - RNA, 18 nt, Human
gaaagagacauguaaaca

SEQ ID NO: 531265 - RNA, 19 nt, Human
gaccaguccaaucaggcug

SEQ ID NO: 531266 - RNA, 26 nt, Human
gcaaugaaaagaaaauggacccaaaa

SEQ ID NO: 531267 - RNA, 23 nt, Human
ggaaaaggaggcaaugaaaagaa

SEQ ID NO: 531268 - RNA, 18 nt, Human
ggaaaguagugggagaac

SEQ ID NO: 531269 - RNA, 22 nt, Human
ggaggugccaccaacacaaccc

SEQ ID NO: 531270 - RNA, 20 nt, Human
ggcagggcagagggaaagga

SEQ ID NO: 531271 - RNA, 24 nt, Human
gugauggagaagcuaugaaaaaga

SEQ ID NO: 531272 - RNA, 19 nt, Human
uaaagaacuacaugaacug

SEQ ID NO: 531273 - RNA, 22 nt, Human
uacacaauucaaacucaacaaa

SEQ ID NO: 531274 - RNA, 24 nt, Human
uacagcauacacuuuauauacaua

SEQ ID NO: 531275 - RNA, 21 nt, Human
uacaugaacugaaaagaaaug

SEQ ID NO: 531276 - RNA, 19 nt, Human
uaccaggaaauuguucuac

SEQ ID NO: 531277 - RNA, 20 nt, Human
uacccaccaguaccauccug

SEQ ID NO: 531278 - RNA, 22 nt, Human
ucaaagccuugggcaaaaccug

SEQ ID NO: 531279 - RNA, 18 nt, Human
ucacagauuggugcccuc

SEQ ID NO: 531280 - RNA, 19 nt, Human
ucagccaaaacuaugauaa

SEQ ID NO: 531281 - RNA, 20 nt, Human
uccaaucaggcuggucuaau

SEQ ID NO: 531282 - RNA, 20 nt, Human
ucccccucaaacagacgcug

SEQ ID NO: 531283 - RNA, 23 nt, Human
uccuuggaaaucucagauuccug

SEQ ID NO: 531284 - RNA, 19 nt, Human
ucucagauuccugcuuuac

SEQ ID NO: 531285 - RNA, 22 nt, Human
ugaaacuuuauccucgaguuug

SEQ ID NO: 531286 - RNA, 22 nt, Human
ugagcaaagagcuccccugaaa

SEQ ID NO: 531287 - RNA, 20 nt, Human
ugauauaggcagucuucccu

SEQ ID NO: 531288 - RNA, 21 nt, Human
ugauuccacagacuuucccuu

SEQ ID NO: 531289 - RNA, 26 nt, Human
ugcaagaaauuaaacacuccuauaga

SEQ ID NO: 531290 - RNA, 25 nt, Human
ugccuggaaaaggaggcaaugaaag

SEQ ID NO: 531291 - RNA, 24 nt, Human
uggaaaaggaggcaaugaaaagaa

SEQ ID NO: 531292 - RNA, 21 nt, Human
uggcuguacaaguaacaacac

SEQ ID NO: 531293 - RNA, 19 nt, Human
uggggaggaaauggguucc

SEQ ID NO: 531294 - RNA, 23 nt, Human
ugggugacagguaucaaagccuu

SEQ ID NO: 531295 - RNA, 22 nt, Human
uuaaagaaauuaaaagaugaga

SEQ ID NO: 531296 - RNA, 24 nt, Human
uucaaacucaacaaacagaaaaga

SEQ ID NO: 531297 - RNA, 20 nt, Human
uuugacuccccugaaauugc

SEQ ID NO: 531298 - RNA, 22 nt, Human
uuugauauaggcagucuucccu

SEQ ID NO: 531299 - RNA, 19 nt, Human
uuuuaagauacccugggug

SEQ ID NO: 531300 - RNA, 27 nt, Human
uuuuuuuuuuucuuuuuucauauuuuu

SEQ ID NO: 531301 - RNA, 21 nt, Human
aaacccgcgcuagccccgcgc

SEQ ID NO: 531302 - RNA, 21 nt, Human
aacccgcgcuagccccgcgcg

SEQ ID NO: 531303 - RNA, 23 nt, Human
aaugugggagagauaaagaggaa

SEQ ID NO: 531304 - RNA, 21 nt, Human
agaggaaggaagggguaggug

SEQ ID NO: 531305 - RNA, 26 nt, Human
agaggaaggaagggguagguggggag

SEQ ID NO: 531306 - RNA, 28 nt, Human
agaggaaggaagggguagguggggaggg

SEQ ID NO: 531307 - RNA, 29 nt, Human
agaggaaggaagggguagguggggagggg

SEQ ID NO: 531308 - RNA, 25 nt, Human
aggaaggaagggguagguggggagg

SEQ ID NO: 531309 - RNA, 26 nt, Human
aggaaggaagggguagguggggaggg

SEQ ID NO: 531310 - RNA, 20 nt, Human
cagcucaguggcagcugcaa

SEQ ID NO: 531311 - RNA, 19 nt, Human
caggcaucaaggagguacu

SEQ ID NO: 531312 - RNA, 23 nt, Human
ccgucgcugaaacccgcgcuagc

SEQ ID NO: 531313 - RNA, 19 nt, Human
ccuugagggcucccgucgc

SEQ ID NO: 531314 - RNA, 22 nt, Human
cggagugggcaagaugugggcc

SEQ ID NO: 531315 - RNA, 24 nt, Human
cugaaacccgcgcuagccccgcgc

SEQ ID NO: 531316 - RNA, 20 nt, Human
gaagguagacguccaggguc

SEQ ID NO: 531317 - RNA, 24 nt, Human
gccuugugccuuucagaagugccg

SEQ ID NO: 531318 - RNA, 20 nt, Human
ggaaggaagggguagguggg

SEQ ID NO: 531319 - RNA, 22 nt, Human
ggagugggcaagaugugggccu

SEQ ID NO: 531320 - RNA, 19 nt, Human
ggcagcugcaaaccccauc

SEQ ID NO: 531321 - RNA, 21 nt, Human
gggagggguucucaaaggagc

SEQ ID NO: 531322 - RNA, 21 nt, Human
ggucgagaagaggugggaucc

SEQ ID NO: 531323 - RNA, 23 nt, Human
uaauuaccaagucuauauuuagc

SEQ ID NO: 531324 - RNA, 19 nt, Human
uaccaagucuauauuuagc

SEQ ID NO: 531325 - RNA, 18 nt, Human
uagcaagacaauguggga

SEQ ID NO: 531326 - RNA, 19 nt, Human
uagcaagacaaugugggag

SEQ ID NO: 531327 - RNA, 23 nt, Human
uccagggucgagaagagguggga

SEQ ID NO: 531328 - RNA, 23 nt, Human
ucugcagcugcgggaaagaggac

SEQ ID NO: 531329 - RNA, 19 nt, Human
ucugcauuggcugcagagc

SEQ ID NO: 531330 - RNA, 21 nt, Human
ugcagcugcgggaaagaggac

SEQ ID NO: 531331 - RNA, 23 nt, Human
uggccaggaguucuuggccuugu

SEQ ID NO: 531332 - RNA, 25 nt, Human
uggccaggaguucuuggccuugugc

SEQ ID NO: 531333 - RNA, 18 nt, Human
ugggagagauaaagagga

SEQ ID NO: 531334 - RNA, 21 nt, Human
ugggagagauaaagaggaagg

SEQ ID NO: 531335 - RNA, 22 nt, Human
uuuaauagucuuccuccucucu

SEQ ID NO: 531336 - RNA, 20 nt, Human
aaaaaagaacauagaaacac

SEQ ID NO: 531337 - RNA, 18 nt, Human
aaaacucccccugcccuc

SEQ ID NO: 531338 - RNA, 18 nt, Human
aaaaggccacaaucugaa

SEQ ID NO: 531339 - RNA, 26 nt, Human
aaaaggccacaaucugaaaacaaaug

SEQ ID NO: 531340 - RNA, 18 nt, Human
aagaacauagaaacacca

SEQ ID NO: 531341 - RNA, 21 nt, Human
aagaagaguuaauacuaaaau

SEQ ID NO: 531342 - RNA, 22 nt, Human
aagcuacaaauuauuuaaaauu

SEQ ID NO: 531343 - RNA, 20 nt, Human
aagucauuaaagugcuucuc

SEQ ID NO: 531344 - RNA, 21 nt, Human
aagugcuucucaacaaauucu

SEQ ID NO: 531345 - RNA, 20 nt, Human
acaaucugaaaacaaauggc

SEQ ID NO: 531346 - RNA, 18 nt, Human
accugcgcugcuguggga

SEQ ID NO: 531347 - RNA, 22 nt, Human
acgcagcuucauggacaugcgg

SEQ ID NO: 531348 - RNA, 26 nt, Human
acugcugggcugcuugucuccuuagg

SEQ ID NO: 531349 - RNA, 22 nt, Human
agaauaaaacucccccugcccu

SEQ ID NO: 531350 - RNA, 20 nt, Human
agacauuggagaggccaggu

SEQ ID NO: 531351 - RNA, 18 nt, Human
aggccacaaucugaaaac

SEQ ID NO: 531352 - RNA, 24 nt, Human
auggacaugcggcuuuugcuaguu

SEQ ID NO: 531353 - RNA, 20 nt, Human
caacaaauucuuuuucuucu

SEQ ID NO: 531354 - RNA, 24 nt, Human
caaucugaaaacaaauggcauuua

SEQ ID NO: 531355 - RNA, 19 nt, Human
cacagccaagaaaugagac

SEQ ID NO: 531356 - RNA, 22 nt, Human
cagccaauaauaaaaggccaca

SEQ ID NO: 531357 - RNA, 26 nt, Human
cagugauaccacuugaaaugcaaaac

SEQ ID NO: 531358 - RNA, 21 nt, Human
caucuucuucaucucuuauug

SEQ ID NO: 531359 - RNA, 18 nt, Human
ccuucagauaaacagaac

SEQ ID NO: 531360 - RNA, 20 nt, Human
cuaaagaccauuuauuuuga

SEQ ID NO: 531361 - RNA, 22 nt, Human
cugugggaguuucacuggguag

SEQ ID NO: 531362 - RNA, 24 nt, Human
cuucauggacaugcggcuuuugcu

SEQ ID NO: 531363 - RNA, 19 nt, Human
gacauuggagaggccaggu

SEQ ID NO: 531364 - RNA, 19 nt, Human
gcacagccaagaaaugaga

SEQ ID NO: 531365 - RNA, 23 nt, Human
gcuugucuccuuaggauuuauug

SEQ ID NO: 531366 - RNA, 19 nt, Human
guagaauaaaacucccccu

SEQ ID NO: 531367 - RNA, 19 nt, Human
uaaaacucccccugcccuc

SEQ ID NO: 531368 - RNA, 21 nt, Human
uaaaaggccacaaucugaaaa

SEQ ID NO: 531369 - RNA, 23 nt, Human
uaaaaggccacaaucugaaaaca

SEQ ID NO: 531370 - RNA, 18 nt, Human
uacuuggaagcuaaacau

SEQ ID NO: 531371 - RNA, 22 nt, Human
uagaauaaaacucccccugccc

SEQ ID NO: 531372 - RNA, 23 nt, Human
uagaaucucuggguaggagccuu

SEQ ID NO: 531373 - RNA, 23 nt, Human
uauaacauggcaucaccugcaca

SEQ ID NO: 531374 - RNA, 18 nt, Human
ucacuggguagaaucucu

SEQ ID NO: 531375 - RNA, 18 nt, Human
ucucuguaagcauucagg

SEQ ID NO: 531376 - RNA, 19 nt, Human
ucucuguaagcauucagga

SEQ ID NO: 531377 - RNA, 23 nt, Human
ucuucuguauguugcuuaaggau

SEQ ID NO: 531378 - RNA, 22 nt, Human
ugaaacaauaaauaacuuaaau

SEQ ID NO: 531379 - RNA, 24 nt, Human
ugaaacaauaaauaacuuaaaucu

SEQ ID NO: 531380 - RNA, 24 nt, Human
ugaaggccugaaaggguuaacccu

SEQ ID NO: 531381 - RNA, 19 nt, Human
ugagaugcuaaagaccauu

SEQ ID NO: 531382 - RNA, 19 nt, Human
ugcacacagguuguggagc

SEQ ID NO: 531383 - RNA, 19 nt, Human
ugcuuugggaagaagaguu

SEQ ID NO: 531384 - RNA, 21 nt, Human
uggauauaacauggcaucacc

SEQ ID NO: 531385 - RNA, 18 nt, Human
uggcugagccagaggaac

SEQ ID NO: 531386 - RNA, 23 nt, Human
uggcugagccagaggaacgacgc

SEQ ID NO: 531387 - RNA, 20 nt, Human
uggguagaaucucuggguag

SEQ ID NO: 531388 - RNA, 21 nt, Human
uguagaauaaaacuccccccu

SEQ ID NO: 531389 - RNA, 28 nt, Human
uguagaauaaaacucccccugcccucaa

SEQ ID NO: 531390 - RNA, 19 nt, Human
uguuauggcagacaugaag

SEQ ID NO: 531391 - RNA, 23 nt, Human
uuaagcuacaaauuauuuaaaau

SEQ ID NO: 531392 - RNA, 22 nt, Human
uuaauacuaaaaugauuucagu

SEQ ID NO: 531393 - RNA, 21 nt, Human
uucaggacuaguaacacccaa

SEQ ID NO: 531394 - RNA, 18 nt, Human
uucuguguauuaacaggu

SEQ ID NO: 531395 - RNA, 22 nt, Human
uugcuguaacuuuacaaaugcu

SEQ ID NO: 531396 - RNA, 22 nt, Human
uugguacaguuucucuaaaucu

SEQ ID NO: 531397 - RNA, 19 nt, Human
aaaaaacuugacagaugca

SEQ ID NO: 531398 - RNA, 25 nt, Human
aaaaauagagguucuaugaaaggaa

SEQ ID NO: 531399 - RNA, 21 nt, Human
aaacaaauagcaccacaauga

SEQ ID NO: 531400 - RNA, 24 nt, Human
aaacucaaguuuagaaaaaaaaaa

SEQ ID NO: 531401 - RNA, 20 nt, Human
aauaucuuuaaacaugcuaa

SEQ ID NO: 531402 - RNA, 19 nt, Human
accuaaaauccugaaaaaa

SEQ ID NO: 531403 - RNA, 23 nt, Human
agacaaaaaauggcacaucagaa

SEQ ID NO: 531404 - RNA, 21 nt, Human
aggggcaagggggggaaucgg

SEQ ID NO: 531405 - RNA, 22 nt, Human
aggggcaagggggggaaucggg

SEQ ID NO: 531406 - RNA, 24 nt, Human
aggugcuaaaggagguaccuuauu

SEQ ID NO: 531407 - RNA, 21 nt, Human
agugcugagauuuggaagagg

SEQ ID NO: 531408 - RNA, 21 nt, Human
auauagauauauuuauaugca

SEQ ID NO: 531409 - RNA, 23 nt, Human
augaaaucaauauuuuccuguga

SEQ ID NO: 531410 - RNA, 25 nt, Human
augcauccauauucuacuaaaaaca

SEQ ID NO: 531411 - RNA, 18 nt, Human
auuaccuaaaauccugaa

SEQ ID NO: 531412 - RNA, 24 nt, Human
auucuacuaaaaacaaacaaaaua

SEQ ID NO: 531413 - RNA, 19 nt, Human
auucuguuagcauauaaaa

SEQ ID NO: 531414 - RNA, 21 nt, Human
caaaauaaucagaccgaugug

SEQ ID NO: 531415 - RNA, 27 nt, Human
caaauuaccuaaaauccugaaaaaagu

SEQ ID NO: 531416 - RNA, 25 nt, Human
caagaaguguaaaaauuuuuaaaaa

SEQ ID NO: 531417 - RNA, 20 nt, Human
caaggcgauuagagcggugg

SEQ ID NO: 531418 - RNA, 23 nt, Human
caaggcgauuagagcgguggcca

SEQ ID NO: 531419 - RNA, 21 nt, Human
caaguuuaaaaauuuggauuu

SEQ ID NO: 531420 - RNA, 20 nt, Human
caccgaaaaacagggcacgg

SEQ ID NO: 531421 - RNA, 19 nt, Human
cagcgcagcaugaacuccc

SEQ ID NO: 531422 - RNA, 22 nt, Human
cagggcacggccaucuuccucu

SEQ ID NO: 531423 - RNA, 23 nt, Human
cauaacaaggacucaaacucaag

SEQ ID NO: 531424 - RNA, 18 nt, Human
cauaauguuacauaguuu

SEQ ID NO: 531425 - RNA, 18 nt, Human
ccacugagcccccgagcc

SEQ ID NO: 531426 - RNA, 19 nt, Human
cccccgagccugggacaaa

SEQ ID NO: 531427 - RNA, 20 nt, Human
cccccgagccugggacaaac

SEQ ID NO: 531428 - RNA, 20 nt, Human
ccgccaggggcaaggggggg

SEQ ID NO: 531429 - RNA, 20 nt, Human
ccuuggaauaaauaagaaaa

SEQ ID NO: 531430 - RNA, 22 nt, Human
cggcacaaggcgauuagagcgg

SEQ ID NO: 531431 - RNA, 21 nt, Human
cuaaccauuaccuuaugauga

SEQ ID NO: 531432 - RNA, 23 nt, Human
cuaggcacgaagggacgcgcgcu

SEQ ID NO: 531433 - RNA, 19 nt, Human
cuagggucucuguauuuuc

SEQ ID NO: 531434 - RNA, 18 nt, Human
cuaugaaaggaagauuag

SEQ ID NO: 531435 - RNA, 23 nt, Human
gaaaauugcauuccuucuaguuc

SEQ ID NO: 531436 - RNA, 18 nt, Human
gaacaaacauucaaauua

SEQ ID NO: 531437 - RNA, 25 nt, Human
gagccuccagcgcagcaugaacucc

SEQ ID NO: 531438 - RNA, 26 nt, Human
gagccugggacaaacgcaucucccgg

SEQ ID NO: 531439 - RNA, 19 nt, Human
ggccaagagccuccagcgc

SEQ ID NO: 531440 - RNA, 23 nt, Human
gguaaaaacaaauagcaccacaa

SEQ ID NO: 531441 - RNA, 20 nt, Human
guaaaaacaaauagcaccac

SEQ ID NO: 531442 - RNA, 20 nt, Human
uaaaaagacaaaaaauggca

SEQ ID NO: 531443 - RNA, 26 nt, Human
uaaaaagacaaaaaauggcacaucag

SEQ ID NO: 531444 - RNA, 20 nt, Human
uaaacaugcuaaccauuacc

SEQ ID NO: 531445 - RNA, 24 nt, Human
uaaaucauauuuucaauaaggguc

SEQ ID NO: 531446 - RNA, 20 nt, Human
uacuuggaccuucaaaccac

SEQ ID NO: 531447 - RNA, 20 nt, Human
uagaaaaaaaaaaaauagag

SEQ ID NO: 531448 - RNA, 22 nt, Human
uagaaaaaaaaaaaauagaggu

SEQ ID NO: 531449 - RNA, 19 nt, Human
uagagcgguggccaagagc

SEQ ID NO: 531450 - RNA, 20 nt, Human
uauugcaacauauaaaugca

SEQ ID NO: 531451 - RNA, 24 nt, Human
ucagaaaacucgcugaaauucuua

SEQ ID NO: 531452 - RNA, 20 nt, Human
uccaggaguguuuuagauau

SEQ ID NO: 531453 - RNA, 18 nt, Human
ucccacugagcccccgag

SEQ ID NO: 531454 - RNA, 19 nt, Human
ucccugcagagugaacgcu

SEQ ID NO: 531455 - RNA, 22 nt, Human
ucccugcagagugaacgcuccu

SEQ ID NO: 531456 - RNA, 20 nt, Human
uccugaaaaaaguuuaagcu

SEQ ID NO: 531457 - RNA, 23 nt, Human
ucucuaaacuccuuucaaauuac

SEQ ID NO: 531458 - RNA, 21 nt, Human
ugaaaggauuaaauauguagg

SEQ ID NO: 531459 - RNA, 19 nt, Human
ugccuuacaccgaaaaaca

SEQ ID NO: 531460 - RNA, 27 nt, Human
uggaauaaauaagaaaaauuuuaagug

SEQ ID NO: 531461 - RNA, 23 nt, Human
uucacuguaucguauuacugaug

SEQ ID NO: 531462 - RNA, 19 nt, Human
uugcauuccuucuaguuca

SEQ ID NO: 531463 - RNA, 20 nt, Human
uuggaagaggaauaucuuua

SEQ ID NO: 531464 - RNA, 24 nt, Human
uuuuuuuuuuuuuuuuucagcuuu

SEQ ID NO: 531465 - RNA, 21 nt, Human
uuuuuuuuuuuuuuuuuucag

SEQ ID NO: 531466 - RNA, 27 nt, Human
uuuuuuuuuuuuuuuuuucagcuuuaa

SEQ ID NO: 531467 - RNA, 24 nt, Human
aaaccccaggcugagugcgguccc

SEQ ID NO: 531468 - RNA, 21 nt, Human
aacccacagucagucuaaaaa

SEQ ID NO: 531469 - RNA, 27 nt, Human
aacuagucauccaccuagccaaagauc

SEQ ID NO: 531470 - RNA, 24 nt, Human
aagcaaaaucagagguagaggcaa

SEQ ID NO: 531471 - RNA, 26 nt, Human
aagcaucaucaaucaaauccaagauc

SEQ ID NO: 531472 - RNA, 24 nt, Human
aagccuuguuccuugcuagaaaug

SEQ ID NO: 531473 - RNA, 25 nt, Human
aagggcuuugagaaaaggcuuugaa

SEQ ID NO: 531474 - RNA, 18 nt, Human
acaaaccaugcuuuaucu

SEQ ID NO: 531475 - RNA, 24 nt, Human
acaagaaaggagccaagcgucagu

SEQ ID NO: 531476 - RNA, 20 nt, Human
agaaaauccauccacaagaa

SEQ ID NO: 531477 - RNA, 24 nt, Human
agcaaagcaaaaucagagguagag

SEQ ID NO: 531478 - RNA, 25 nt, Human
agcaaagcaaaaucagagguagagg

SEQ ID NO: 531479 - RNA, 18 nt, Human
aggcagcuugucuucucg

SEQ ID NO: 531480 - RNA, 23 nt, Human
aggcagcuugucuucucgccaag

SEQ ID NO: 531481 - RNA, 19 nt, Human
aggccgccuccaaacccca

SEQ ID NO: 531482 - RNA, 19 nt, Human
auaaaaucaaagcgggaaa

SEQ ID NO: 531483 - RNA, 18 nt, Human
augaaugucuuuccaaac

SEQ ID NO: 531484 - RNA, 20 nt, Human
auggagguacuguaaggcua

SEQ ID NO: 531485 - RNA, 22 nt, Human
caaagcaaaaucagagguagag

SEQ ID NO: 531486 - RNA, 18 nt, Human
caagauccuuccaucucu

SEQ ID NO: 531487 - RNA, 22 nt, Human
cacaacaucuacaggcuaaaua

SEQ ID NO: 531488 - RNA, 18 nt, Human
caccaccauccgcaccgu

SEQ ID NO: 531489 - RNA, 18 nt, Human
cagcagcacaaaaggaau

SEQ ID NO: 531490 - RNA, 22 nt, Human
ccaagcaucaucaaucaaaucc

SEQ ID NO: 531491 - RNA, 19 nt, Human
ccaggcugagugcgguccc

SEQ ID NO: 531492 - RNA, 18 nt, Human
cccgguacccaccccucc

SEQ ID NO: 531493 - RNA, 19 nt, Human
cccgguacccaccccucca

SEQ ID NO: 531494 - RNA, 22 nt, Human
ccugcguuuccagggacaggga

SEQ ID NO: 531495 - RNA, 24 nt, Human
ccuugcuagaaaugagccucgcag

SEQ ID NO: 531496 - RNA, 20 nt, Human
cggucccgguacccaccccu

SEQ ID NO: 531497 - RNA, 21 nt, Human
cuaagcacagagcauggcacc

SEQ ID NO: 531498 - RNA, 19 nt, Human
gaauaaauauacaugaaug

SEQ ID NO: 531499 - RNA, 22 nt, Human
gacagcaaagcaaaaucagagg

SEQ ID NO: 531500 - RNA, 25 nt, Human
gagaaaaggcuuugaauaaaacuag

SEQ ID NO: 531501 - RNA, 24 nt, Human
ggagaacagagauuaacugucaga

SEQ ID NO: 531502 - RNA, 19 nt, Human
gggcuuugagaaaaggcuu

SEQ ID NO: 531503 - RNA, 20 nt, Human
gucccgaugccugcaaugcu

SEQ ID NO: 531504 - RNA, 23 nt, Human
uaacugucagauaucuuucuaau

SEQ ID NO: 531505 - RNA, 23 nt, Human
uacccaccccuccaggggucuca

SEQ ID NO: 531506 - RNA, 22 nt, Human
uaucacaacaucuacaggcuaa

SEQ ID NO: 531507 - RNA, 23 nt, Human
uauccaaaguuugaaaauaccau

SEQ ID NO: 531508 - RNA, 20 nt, Human
uauucaguguuuucagaguu

SEQ ID NO: 531509 - RNA, 21 nt, Human
ucaaagguuugaauuuggaga

SEQ ID NO: 531510 - RNA, 21 nt, Human
ucagaguuucaacaagggaua

SEQ ID NO: 531511 - RNA, 22 nt, Human
ucagugguauugcgacauccuc

SEQ ID NO: 531512 - RNA, 21 nt, Human
uccgcaccguacgacaggccg

SEQ ID NO: 531513 - RNA, 18 nt, Human
uccuuuuuauuccaguga

SEQ ID NO: 531514 - RNA, 22 nt, Human
ucgcauugcacuuugcuaccac

SEQ ID NO: 531515 - RNA, 24 nt, Human
ucuacaggcuaaauacacuccgaa

SEQ ID NO: 531516 - RNA, 20 nt, Human
ucuguccacuucauuucuug

SEQ ID NO: 531517 - RNA, 22 nt, Human
ugacagcaaagcaaaaucagag

SEQ ID NO: 531518 - RNA, 20 nt, Human
ugagaaaaggcuuugaauag

SEQ ID NO: 531519 - RNA, 21 nt, Human
ugagaaaauccauccacaaga

SEQ ID NO: 531520 - RNA, 23 nt, Human
ugccuuucccucucauacguuca

SEQ ID NO: 531521 - RNA, 18 nt, Human
uggagguacuguaaggcu

SEQ ID NO: 531522 - RNA, 19 nt, Human
ugguauugcgacauccuca

SEQ ID NO: 531523 - RNA, 22 nt, Human
ugucuuguucagguucaggaag

SEQ ID NO: 531524 - RNA, 18 nt, Human
uguggugccaccauuguc

SEQ ID NO: 531525 - RNA, 22 nt, Human
uucaccauuacugagaaaucuc

SEQ ID NO: 531526 - RNA, 18 nt, Human
uuccuuuuucuuugccuu

SEQ ID NO: 531527 - RNA, 19 nt, Human
uucucauggagguacugua

SEQ ID NO: 531528 - RNA, 24 nt, Human
uugaauaaaacuagucauccaccu

SEQ ID NO: 531529 - RNA, 22 nt, Human
uuucgcauugcacuuugcuacc

SEQ ID NO: 531530 - RNA, 22 nt, Human
uuuucuuugccuuucccucuca

SEQ ID NO: 531531 - RNA, 23 nt, Human
aaaaaaaaaaaacucucaaaaga

SEQ ID NO: 531532 - RNA, 19 nt, Human
aaaaaaauaaacuacccuc

SEQ ID NO: 531533 - RNA, 19 nt, Human
aaaacucucaaaagaucgu

SEQ ID NO: 531534 - RNA, 22 nt, Human
aaaaggacagagaaaaaaaaua

SEQ ID NO: 531535 - RNA, 19 nt, Human
aaaaguaaagcagauucaa

SEQ ID NO: 531536 - RNA, 20 nt, Human
aaacuuggaaaguuaaguug

SEQ ID NO: 531537 - RNA, 19 nt, Human
aaauagcaaaaacaaugga

SEQ ID NO: 531538 - RNA, 20 nt, Human
aagauggauaaaaggaauca

SEQ ID NO: 531539 - RNA, 23 nt, Human
aagcagauucaauaaguagaaac

SEQ ID NO: 531540 - RNA, 21 nt, Human
aaucuccaaagucacgccuga

SEQ ID NO: 531541 - RNA, 23 nt, Human
acaaaagucccccagaaagauuc

SEQ ID NO: 531542 - RNA, 20 nt, Human
acuuuucuacagugucucaa

SEQ ID NO: 531543 - RNA, 21 nt, Human
agaaaauugcuaaaaaguaaa

SEQ ID NO: 531544 - RNA, 24 nt, Human
agaaagauuccuaaacgcugugga

SEQ ID NO: 531545 - RNA, 24 nt, Human
agaaaucuacuguaucacacagcu

SEQ ID NO: 531546 - RNA, 18 nt, Human
agagcauuuaguaugcag

SEQ ID NO: 531547 - RNA, 24 nt, Human
agauguuuuuuaacaacaagagau

SEQ ID NO: 531548 - RNA, 20 nt, Human
aggaagaaaauugcuaaaaa

SEQ ID NO: 531549 - RNA, 18 nt, Human
aguaaagcagauucaaua

SEQ ID NO: 531550 - RNA, 18 nt, Human
auacaauuuaaacuugag

SEQ ID NO: 531551 - RNA, 22 nt, Human
auugcaaauauuuugacuguaa

SEQ ID NO: 531552 - RNA, 24 nt, Human
auuuauaguuaugagagcauuuag

SEQ ID NO: 531553 - RNA, 21 nt, Human
caaaacagaagcaacaauuuu

SEQ ID NO: 531554 - RNA, 19 nt, Human
caaaagacugaagacagga

SEQ ID NO: 531555 - RNA, 20 nt, Human
caaaaggacagagaaaaaaa

SEQ ID NO: 531556 - RNA, 22 nt, Human
caaggaagaaaauugcuaaaaa

SEQ ID NO: 531557 - RNA, 22 nt, Human
cacaguggacaguaccagcucc

SEQ ID NO: 531558 - RNA, 25 nt, Human
caccuguauacaaccuaagaccaac

SEQ ID NO: 531559 - RNA, 25 nt, Human
cagaaagauuccuaaacgcugugga

SEQ ID NO: 531560 - RNA, 22 nt, Human
cagaggacucucucccacgucc

SEQ ID NO: 531561 - RNA, 18 nt, Human
caguaccagcuccuuuca

SEQ ID NO: 531562 - RNA, 21 nt, Human
caguugacaucccagacaaac

SEQ ID NO: 531563 - RNA, 19 nt, Human
cauuaagucacagacacuu

SEQ ID NO: 531564 - RNA, 18 nt, Human
cccacguccgauaccaca

SEQ ID NO: 531565 - RNA, 23 nt, Human
cccagacaaacuugcauuaaaaa

SEQ ID NO: 531566 - RNA, 24 nt, Human
cccauuaacauuuuuuugcaacaa

SEQ ID NO: 531567 - RNA, 22 nt, Human
cccuauauaugguuuacuuuag

SEQ ID NO: 531568 - RNA, 18 nt, Human
cccuuccuccccacuuuc

SEQ ID NO: 531569 - RNA, 18 nt, Human
ccuguauacaaccuaaga

SEQ ID NO: 531570 - RNA, 19 nt, Human
cguugccuucaggugcugg

SEQ ID NO: 531571 - RNA, 23 nt, Human
cuaccucgcauguuucugcuaag

SEQ ID NO: 531572 - RNA, 19 nt, Human
cuuuagucuuccuuuuccu

SEQ ID NO: 531573 - RNA, 21 nt, Human
gacaggaccgaauauuuugaa

SEQ ID NO: 531574 - RNA, 25 nt, Human
gcccauuaacauuuuuuugcaacaa

SEQ ID NO: 531575 - RNA, 20 nt, Human
gggugcaagagggcguugcc

SEQ ID NO: 531576 - RNA, 19 nt, Human
ggugcaagagggcguugcc

SEQ ID NO: 531577 - RNA, 18 nt, Human
gguucauguucacaagga

SEQ ID NO: 531578 - RNA, 23 nt, Human
guuugucucagucacugaaccag

SEQ ID NO: 531579 - RNA, 20 nt, Human
uaaaacaaaacagaagcaac

SEQ ID NO: 531580 - RNA, 18 nt, Human
uaaaaggaaucauuugug

SEQ ID NO: 531581 - RNA, 23 nt, Human
uaaagcauaauuuacauauuuga

SEQ ID NO: 531582 - RNA, 26 nt, Human
uaacagucacaaaagucccccagaaa

SEQ ID NO: 531583 - RNA, 22 nt, Human
uaaguacaaggauuuucaaaac

SEQ ID NO: 531584 - RNA, 24 nt, Human
uacaaaagaaggauguaugcgaca

SEQ ID NO: 531585 - RNA, 20 nt, Human
uacacacuauaaaauuucag

SEQ ID NO: 531586 - RNA, 23 nt, Human
uaccaaaaggacagagaaaaaaa

SEQ ID NO: 531587 - RNA, 20 nt, Human
uagcagacaaaaguaauguu

SEQ ID NO: 531588 - RNA, 26 nt, Human
uauaaaucacaauaaaaaaaaaaaac

SEQ ID NO: 531589 - RNA, 19 nt, Human
uaucacacagcucaggaug

SEQ ID NO: 531590 - RNA, 28 nt, Human
uauggguccuguuggugaagcggguccc

SEQ ID NO: 531591 - RNA, 23 nt, Human
uauuugauucuugugacugaugu

SEQ ID NO: 531592 - RNA, 23 nt, Human
uauuuggaccaaccaaguaaauu

SEQ ID NO: 531593 - RNA, 21 nt, Human
ucaagcagugucuacagacag

SEQ ID NO: 531594 - RNA, 25 nt, Human
ucacaaaagucccccagaaagauuc

SEQ ID NO: 531595 - RNA, 19 nt, Human
ucauaccaaaaggacagag

SEQ ID NO: 531596 - RNA, 24 nt, Human
uccacaugguguaagcuacaaaag

SEQ ID NO: 531597 - RNA, 18 nt, Human
ucccccagaaagauuccu

SEQ ID NO: 531598 - RNA, 21 nt, Human
ucccccagaaagauuccuaaa

SEQ ID NO: 531599 - RNA, 18 nt, Human
ucucuugccaguuuucuu

SEQ ID NO: 531600 - RNA, 21 nt, Human
ugacuguaauuauuuuuccuc

SEQ ID NO: 531601 - RNA, 21 nt, Human
uggacaguaccagcuccuuuc

SEQ ID NO: 531602 - RNA, 19 nt, Human
uggcaaacagaggacucuc

SEQ ID NO: 531603 - RNA, 28 nt, Human
ugguaguucauugaggguuccggcaccg

SEQ ID NO: 531604 - RNA, 22 nt, Human
uggugaagcgggucccacaggg

SEQ ID NO: 531605 - RNA, 24 nt, Human
ugguguaagcuacaaaagaaggau

SEQ ID NO: 531606 - RNA, 19 nt, Human
uucuaagccacuaauaccu

SEQ ID NO: 531607 - RNA, 21 nt, Human
uucucauuuccucuuaaaaca

SEQ ID NO: 531608 - RNA, 20 nt, Human
uugcaacaauaaaaacaaaa

SEQ ID NO: 531609 - RNA, 19 nt, Human
uugcuuuucaccuuauuuu

SEQ ID NO: 531610 - RNA, 21 nt, Human
uuuaaucuacuucugcuggcc

SEQ ID NO: 531611 - RNA, 18 nt, Human
uuuacuuuagcagacaaa

SEQ ID NO: 531612 - RNA, 23 nt, Human
uuuguuguuuauuaaaucuaccu

SEQ ID NO: 531613 - RNA, 26 nt, Human
aaacaaaagaaaugguuuaaaagcaa

SEQ ID NO: 531614 - RNA, 22 nt, Human
aaggagcugcugugucauaaug

SEQ ID NO: 531615 - RNA, 20 nt, Human
accaagggauggacaugacc

SEQ ID NO: 531616 - RNA, 22 nt, Human
agccggcgcuggcgcaggcgca

SEQ ID NO: 531617 - RNA, 27 nt, Human
auaauggaaacagcauauuaggagaaa

SEQ ID NO: 531618 - RNA, 23 nt, Human
caucagcgugagaaaaaaaaacc

SEQ ID NO: 531619 - RNA, 23 nt, Human
ccaagccaucagcgugagaaaaa

SEQ ID NO: 531620 - RNA, 19 nt, Human
ccaagggauggacaugacc

SEQ ID NO: 531621 - RNA, 21 nt, Human
ccagaaguugccuccagauaa

SEQ ID NO: 531622 - RNA, 18 nt, Human
ccagcagccacggcccca

SEQ ID NO: 531623 - RNA, 18 nt, Human
gaaaaaaaaaccaccaga

SEQ ID NO: 531624 - RNA, 24 nt, Human
gcuuuauuuacuuauuuauuuauu

SEQ ID NO: 531625 - RNA, 25 nt, Human
gugagaaaaaaaaaccaccagaagu

SEQ ID NO: 531626 - RNA, 20 nt, Human
uaccaagggauggacaugac

SEQ ID NO: 531627 - RNA, 18 nt, Human
ugagaaaaaaaaaccacc

SEQ ID NO: 531628 - RNA, 23 nt, Human
ugagaaaaaaaaaccaccagaag

SEQ ID NO: 531629 - RNA, 22 nt, Human
uucgugugcugucugcuugagu

SEQ ID NO: 531630 - RNA, 19 nt, Human
uuuuuuuuuuuuuuuugca

SEQ ID NO: 531631 - RNA, 18 nt, Human
uuuuuuuuuuuuuuuuug

SEQ ID NO: 531632 - RNA, 24 nt, Human
uuuuuuuuuuuuuuuuuugcauuu

SEQ ID NO: 531633 - RNA, 18 nt, Human
caagccuuuagcgcaguu

SEQ ID NO: 531634 - RNA, 19 nt, Human
caggaucaggagaacaggc

SEQ ID NO: 531635 - RNA, 24 nt, Human
caguuuuccgucgggcucccagug

SEQ ID NO: 531636 - RNA, 18 nt, Human
cccauggaaagccuaagg

SEQ ID NO: 531637 - RNA, 19 nt, Human
ccgcaagucccugggcagc

SEQ ID NO: 531638 - RNA, 22 nt, Human
ccgccauggucugggaacccau

SEQ ID NO: 531639 - RNA, 24 nt, Human
cuagcuuuuucaguagcuucuuuu

SEQ ID NO: 531640 - RNA, 22 nt, Human
cugcacagcuccgcgugccucc

SEQ ID NO: 531641 - RNA, 19 nt, Human
gaaaauaaggaagcuguag

SEQ ID NO: 531642 - RNA, 24 nt, Human
gggaacccauggaaagccuaaggg

SEQ ID NO: 531643 - RNA, 21 nt, Human
ggucaugaacuugaacauccc

SEQ ID NO: 531644 - RNA, 23 nt, Human
uagaacacgcaggaucaggagaa

SEQ ID NO: 531645 - RNA, 23 nt, Human
uagcgcaguuuuccgucgggcuc

SEQ ID NO: 531646 - RNA, 22 nt, Human
ucaguagcuucuuuuaucuucu

SEQ ID NO: 531647 - RNA, 19 nt, Human
ucccaggcuucagugucuc

SEQ ID NO: 531648 - RNA, 18 nt, Human
ucgggcaggggaaagaca

SEQ ID NO: 531649 - RNA, 20 nt, Human
ucuuuuaucuucuggucaug

SEQ ID NO: 531650 - RNA, 21 nt, Human
ugccgcaagucccugggcagc

SEQ ID NO: 531651 - RNA, 20 nt, Human
ugggcagcgccaccgccaug

SEQ ID NO: 531652 - RNA, 22 nt, Human
ugggcagcgccaccgccauggu

SEQ ID NO: 531653 - RNA, 18 nt, Human
uggucaugaacuugaaca

SEQ ID NO: 531654 - RNA, 24 nt, Human
uucaugucuagcuuuuucaguagc

SEQ ID NO: 531655 - RNA, 25 nt, Human
uuuuuuuuuuuuuuuuuuuuuaagg

SEQ ID NO: 531656 - RNA, 21 nt, Human
caagaagggccaagccuugaa

SEQ ID NO: 531657 - RNA, 19 nt, Human
cacuggcuaggagugcccc

SEQ ID NO: 531658 - RNA, 21 nt, Human
cccaugcccaguucuuagaga

SEQ ID NO: 531659 - RNA, 21 nt, Human
ccugugguggagguauaaggc

SEQ ID NO: 531660 - RNA, 21 nt, Human
cuuagagacccuugauagcuc

SEQ ID NO: 531661 - RNA, 18 nt, Human
uagaagacaggaggcugc

SEQ ID NO: 531662 - RNA, 18 nt, Human
uaugaccaugacucacug

SEQ ID NO: 531663 - RNA, 19 nt, Human
ucaagaagggccaagccuu

SEQ ID NO: 531664 - RNA, 19 nt, Human
uggagguauaaggcucagg

SEQ ID NO: 531665 - RNA, 18 nt, Human
aaaacucuccaaaauuga

SEQ ID NO: 531666 - RNA, 23 nt, Human
aaaauaaauaguuaaaacaagug

SEQ ID NO: 531667 - RNA, 24 nt, Human
aaaugugcuagaugcauaauuuuu

SEQ ID NO: 531668 - RNA, 19 nt, Human
aacagggaaaguugucuga

SEQ ID NO: 531669 - RNA, 22 nt, Human
aacccuccccccgcccaacacc

SEQ ID NO: 531670 - RNA, 22 nt, Human
acuuaucaagaacaaguaacag

SEQ ID NO: 531671 - RNA, 18 nt, Human
aggcagcggcuuggcggc

SEQ ID NO: 531672 - RNA, 19 nt, Human
aggcagcggcuuggcggcg

SEQ ID NO: 531673 - RNA, 19 nt, Human
auacuauuuugccuugaac

SEQ ID NO: 531674 - RNA, 21 nt, Human
auuuccuagcuaugaaucuuc

SEQ ID NO: 531675 - RNA, 21 nt, Human
caagaacaaguaacagggaaa

SEQ ID NO: 531676 - RNA, 21 nt, Human
cacuaugaagguguccaacgc

SEQ ID NO: 531677 - RNA, 18 nt, Human
ccaaaauugaaaagacaa

SEQ ID NO: 531678 - RNA, 23 nt, Human
ccaguuaaaauaugcagccuuca

SEQ ID NO: 531679 - RNA, 21 nt, Human
ccccgcccaacaccugggaug

SEQ ID NO: 531680 - RNA, 18 nt, Human
ccuccccccgcccaacac

SEQ ID NO: 531681 - RNA, 18 nt, Human
cggcuuggcggcguccag

SEQ ID NO: 531682 - RNA, 19 nt, Human
cuauuccauuuuuucugug

SEQ ID NO: 531683 - RNA, 28 nt, Human
cuuacagucagacuuuuuccaacccguu

SEQ ID NO: 531684 - RNA, 21 nt, Human
cuugccacaacccuccccccg

SEQ ID NO: 531685 - RNA, 23 nt, Human
cuugccacaacccuccccccgcc

SEQ ID NO: 531686 - RNA, 22 nt, Human
gacgcagucguugagaucaggc

SEQ ID NO: 531687 - RNA, 18 nt, Human
gauacaaaauguaaacau

SEQ ID NO: 531688 - RNA, 21 nt, Human
gcauguaucgauccaucccuu

SEQ ID NO: 531689 - RNA, 19 nt, Human
ggaaggagaguuuacucau

SEQ ID NO: 531690 - RNA, 18 nt, Human
ggauuuauuuuuacaaga

SEQ ID NO: 531691 - RNA, 20 nt, Human
uacaaaauguaaacauggca

SEQ ID NO: 531692 - RNA, 18 nt, Human
uacuauaguccauuuagg

SEQ ID NO: 531693 - RNA, 23 nt, Human
uagaaaaaaauuacaagaauuuc

SEQ ID NO: 531694 - RNA, 20 nt, Human
uaucuagacuuccaauaauu

SEQ ID NO: 531695 - RNA, 20 nt, Human
uaugugauguguuacaguuu

SEQ ID NO: 531696 - RNA, 21 nt, Human
ucaggcauguccuugccgcgg

SEQ ID NO: 531697 - RNA, 24 nt, Human
uccuauuccauuuuuucuguguaa

SEQ ID NO: 531698 - RNA, 20 nt, Human
ugaaaacuuuacaguuccuu

SEQ ID NO: 531699 - RNA, 18 nt, Human
ugaaaagacaaucuugcc

SEQ ID NO: 531700 - RNA, 19 nt, Human
ugacugcacaccaucagca

SEQ ID NO: 531701 - RNA, 21 nt, Human
ugacugcacaccaucagcaca

SEQ ID NO: 531702 - RNA, 22 nt, Human
ugauacaaauaaacuauuuuac

SEQ ID NO: 531703 - RNA, 21 nt, Human
ugauccacagaguguugccuu

SEQ ID NO: 531704 - RNA, 22 nt, Human
ugcaguuuucacuuaucaagaa

SEQ ID NO: 531705 - RNA, 22 nt, Human
uguaaacauggcaaaauaaaua

SEQ ID NO: 531706 - RNA, 22 nt, Human
uuaaaacaagugaugcaggauc

SEQ ID NO: 531707 - RNA, 19 nt, Human
uucccugcaguuuucacuu

SEQ ID NO: 531708 - RNA, 22 nt, Human
uugccuuuugcauucagcugga

SEQ ID NO: 531709 - RNA, 22 nt, Human
uuuccuagcuaugaaucuuuaa

SEQ ID NO: 531710 - RNA, 22 nt, Human
uuugacagugaaaugccacuaa

SEQ ID NO: 531711 - RNA, 18 nt, Human
uuuuuuuuuuuuuuuuug

SEQ ID NO: 531712 - RNA, 22 nt, Human
uuuuuuuuuuuuuuuuuguuuu

SEQ ID NO: 531713 - RNA, 23 nt, Human
aaaacaugucuaaauuaugccag

SEQ ID NO: 531714 - RNA, 19 nt, Human
aaaaggaaaaggauuccac

SEQ ID NO: 531715 - RNA, 18 nt, Human
aaacagagcugcagcccc

SEQ ID NO: 531716 - RNA, 23 nt, Human
aaacucacuauauagaacacaaa

SEQ ID NO: 531717 - RNA, 20 nt, Human
aaaugaucacuuugugcccu

SEQ ID NO: 531718 - RNA, 25 nt, Human
aacccugaagaaauggcuucccgag

SEQ ID NO: 531719 - RNA, 19 nt, Human
aagcagcugagggccagag

SEQ ID NO: 531720 - RNA, 23 nt, Human
aagcagcugagggccagagcugg

SEQ ID NO: 531721 - RNA, 19 nt, Human
aagcugguuugggaagggg

SEQ ID NO: 531722 - RNA, 18 nt, Human
aagggcuuugggagcucc

SEQ ID NO: 531723 - RNA, 19 nt, Human
aaugcccacuucucugaug

SEQ ID NO: 531724 - RNA, 21 nt, Human
acaacaaaaacaaaguuucua

SEQ ID NO: 531725 - RNA, 22 nt, Human
acacuaucacuugucuaccuga

SEQ ID NO: 531726 - RNA, 24 nt, Human
acagugccgggaggcaguggccac

SEQ ID NO: 531727 - RNA, 21 nt, Human
accacuaagaccaaugcccac

SEQ ID NO: 531728 - RNA, 20 nt, Human
accugaugauccaccacuaa

SEQ ID NO: 531729 - RNA, 22 nt, Human
accugaugauccaccacuaaga

SEQ ID NO: 531730 - RNA, 25 nt, Human
accugaugauccaccacuaagacca

SEQ ID NO: 531731 - RNA, 20 nt, Human
acuggccccagcccacauca

SEQ ID NO: 531732 - RNA, 22 nt, Human
agcagcacugguagguauugca

SEQ ID NO: 531733 - RNA, 19 nt, Human
agcgaguggcucuccgugg

SEQ ID NO: 531734 - RNA, 21 nt, Human
agcucagaaacaacaaaaaca

SEQ ID NO: 531735 - RNA, 27 nt, Human
aggcagaggugguguggcuggaugggg

SEQ ID NO: 531736 - RNA, 18 nt, Human
agggauggauggguucca

SEQ ID NO: 531737 - RNA, 18 nt, Human
agguaauuaucugggggu

SEQ ID NO: 531738 - RNA, 24 nt, Human
agguccuccugcuuggcguugccu

SEQ ID NO: 531739 - RNA, 23 nt, Human
aguacacuuucacugaguccaaa

SEQ ID NO: 531740 - RNA, 21 nt, Human
auaaaaaucagaccauggacg

SEQ ID NO: 531741 - RNA, 19 nt, Human
auaauugaggcauaugggc

SEQ ID NO: 531742 - RNA, 19 nt, Human
auagagucaccuuuaaaag

SEQ ID NO: 531743 - RNA, 23 nt, Human
auccucacuggugccccccccau

SEQ ID NO: 531744 - RNA, 20 nt, Human
auggguuucuuccaggaccg

SEQ ID NO: 531745 - RNA, 22 nt, Human
auugaaacugguauucugguga

SEQ ID NO: 531746 - RNA, 21 nt, Human
auugugugggggaguuggggu

SEQ ID NO: 531747 - RNA, 21 nt, Human
caaaauuaggagcaaaaauac

SEQ ID NO: 531748 - RNA, 22 nt, Human
caaaguccugccuucccuuuuc

SEQ ID NO: 531749 - RNA, 21 nt, Human
caagcaggucagagcacccgu

SEQ ID NO: 531750 - RNA, 21 nt, Human
caaguggcuccuccacuucca

SEQ ID NO: 531751 - RNA, 23 nt, Human
caauuggcugcagaaaagcuggu

SEQ ID NO: 531752 - RNA, 25 nt, Human
cacacacaaaaauaaauauuuacac

SEQ ID NO: 531753 - RNA, 23 nt, Human
cacacacuaucacuugucuaccu

SEQ ID NO: 531754 - RNA, 19 nt, Human
cacagcucugcagcaaagu

SEQ ID NO: 531755 - RNA, 19 nt, Human
caccagcagccaauaagag

SEQ ID NO: 531756 - RNA, 22 nt, Human
cacuaaauuauauaaaaaucag

SEQ ID NO: 531757 - RNA, 19 nt, Human
cacuauauagaacacaaau

SEQ ID NO: 531758 - RNA, 18 nt, Human
cacuccagggauuauggg

SEQ ID NO: 531759 - RNA, 22 nt, Human
cacuggugccccccccaucccu

SEQ ID NO: 531760 - RNA, 27 nt, Human
cacuuucacugaguccaaaauuaggag

SEQ ID NO: 531761 - RNA, 21 nt, Human
cagaacacacagggacugggg

SEQ ID NO: 531762 - RNA, 19 nt, Human
cagacagacacagacuagc

SEQ ID NO: 531763 - RNA, 19 nt, Human
cagaccauggacggauuga

SEQ ID NO: 531764 - RNA, 24 nt, Human
cagaccauggacggauugaaacug

SEQ ID NO: 531765 - RNA, 21 nt, Human
cagcgccuugucaggggagcc

SEQ ID NO: 531766 - RNA, 18 nt, Human
cagcuccuggacacccag

SEQ ID NO: 531767 - RNA, 26 nt, Human
cagucuggacuuacuuaccucccagg

SEQ ID NO: 531768 - RNA, 18 nt, Human
caugaaggagcugccccc

SEQ ID NO: 531769 - RNA, 23 nt, Human
cauucugaccuucccacucccag

SEQ ID NO: 531770 - RNA, 22 nt, Human
ccaaaaaaaaaaaaaaaaaaaa

SEQ ID NO: 531771 - RNA, 23 nt, Human
ccaaaaaaaaaaaaaaaaaaaaa

SEQ ID NO: 531772 - RNA, 21 nt, Human
ccacagcugcaacaggcaauu

SEQ ID NO: 531773 - RNA, 18 nt, Human
ccagcaguccguccuguc

SEQ ID NO: 531774 - RNA, 22 nt, Human
cccaacccuuccagagcugccc

SEQ ID NO: 531775 - RNA, 24 nt, Human
cccaaguggcuccuccacuuccac

SEQ ID NO: 531776 - RNA, 21 nt, Human
cccacgcuggagugugaggua

SEQ ID NO: 531777 - RNA, 22 nt, Human
cccccccaucccuccuuggggg

SEQ ID NO: 531778 - RNA, 20 nt, Human
ccccuggggccucucugcuc

SEQ ID NO: 531779 - RNA, 18 nt, Human
cccuaaauccuggauggc

SEQ ID NO: 531780 - RNA, 18 nt, Human
cccuccuaacucccugcc

SEQ ID NO: 531781 - RNA, 18 nt, Human
cccugggggccugcugag

SEQ ID NO: 531782 - RNA, 19 nt, Human
cccugggggccugcugagg

SEQ ID NO: 531783 - RNA, 21 nt, Human
cccuguggcagcacugggauc

SEQ ID NO: 531784 - RNA, 18 nt, Human
ccuaggauccacucggcc

SEQ ID NO: 531785 - RNA, 19 nt, Human
ccucacuggugcccccccc

SEQ ID NO: 531786 - RNA, 20 nt, Human
ccucacuggugcccccccca

SEQ ID NO: 531787 - RNA, 19 nt, Human
ccuccggaagggcuggucu

SEQ ID NO: 531788 - RNA, 19 nt, Human
ccuccuaacucccugccug

SEQ ID NO: 531789 - RNA, 21 nt, Human
ccugccccuacuggccccagc

SEQ ID NO: 531790 - RNA, 18 nt, Human
ccugccuucccuuuuccu

SEQ ID NO: 531791 - RNA, 22 nt, Human
ccuggcaccuguccugccccua

SEQ ID NO: 531792 - RNA, 22 nt, Human
ccuggcuccccuggggccucuc

SEQ ID NO: 531793 - RNA, 18 nt, Human
ccugguggugucccugug

SEQ ID NO: 531794 - RNA, 23 nt, Human
cucgaaaacccuccuaacucccu

SEQ ID NO: 531795 - RNA, 21 nt, Human
cucggcccuggcuccccuggg

SEQ ID NO: 531796 - RNA, 22 nt, Human
cugaugcuacccuucuuguggg

SEQ ID NO: 531797 - RNA, 19 nt, Human
cugccccguuggccucuuc

SEQ ID NO: 531798 - RNA, 21 nt, Human
cuggagcccugugccccuccc

SEQ ID NO: 531799 - RNA, 22 nt, Human
cuggagcccugugccccucccc

SEQ ID NO: 531800 - RNA, 24 nt, Human
cuggccaagggcuagcggccacag

SEQ ID NO: 531801 - RNA, 21 nt, Human
cugguggugucccuguggcag

SEQ ID NO: 531802 - RNA, 19 nt, Human
cugugccccuccccggagg

SEQ ID NO: 531803 - RNA, 22 nt, Human
cugugcuaagggugagucucag

SEQ ID NO: 531804 - RNA, 19 nt, Human
cuucccuuuuccucugucc

SEQ ID NO: 531805 - RNA, 21 nt, Human
cuuugugcccugaggcccuuc

SEQ ID NO: 531806 - RNA, 24 nt, Human
gaaaacccuccuaacucccugccu

SEQ ID NO: 531807 - RNA, 25 nt, Human
gaaaaggauuccacauacuuaugaa

SEQ ID NO: 531808 - RNA, 18 nt, Human
gaaagucuuaaaucucau

SEQ ID NO: 531809 - RNA, 18 nt, Human
gaacugguaguuaauccu

SEQ ID NO: 531810 - RNA, 22 nt, Human
gaaggcagucccucuggugagg

SEQ ID NO: 531811 - RNA, 20 nt, Human
gaagggcuggucuuaggaga

SEQ ID NO: 531812 - RNA, 22 nt, Human
gaaggggugccuguucugggag

SEQ ID NO: 531813 - RNA, 18 nt, Human
gaauggggucggggugcc

SEQ ID NO: 531814 - RNA, 21 nt, Human
gaccugaggcaggauggggca

SEQ ID NO: 531815 - RNA, 23 nt, Human
gagaggcccugggggccugcuga

SEQ ID NO: 531816 - RNA, 20 nt, Human
gagcaaaaauacaaagguuc

SEQ ID NO: 531817 - RNA, 19 nt, Human
gagcccccaacccuuccag

SEQ ID NO: 531818 - RNA, 19 nt, Human
gagcugcagcccgcccugg

SEQ ID NO: 531819 - RNA, 18 nt, Human
gagguccuccugcuuggc

SEQ ID NO: 531820 - RNA, 18 nt, Human
gaguggcucuccguggcc

SEQ ID NO: 531821 - RNA, 22 nt, Human
gauaacgaccacccccaaccuc

SEQ ID NO: 531822 - RNA, 19 nt, Human
gaucacuuugugcccugag

SEQ ID NO: 531823 - RNA, 24 nt, Human
gcaacaggcaauuggcugcagaaa

SEQ ID NO: 531824 - RNA, 23 nt, Human
gccagagcuggagggcugcagug

SEQ ID NO: 531825 - RNA, 20 nt, Human
gcccugggggccugcugagg

SEQ ID NO: 531826 - RNA, 18 nt, Human
gcugcagccccagcgccu

SEQ ID NO: 531827 - RNA, 18 nt, Human
gcuuugccaugggugugg

SEQ ID NO: 531828 - RNA, 22 nt, Human
ggcaggggcgggcagcagagag

SEQ ID NO: 531829 - RNA, 18 nt, Human
ggcuggaugggguauugg

SEQ ID NO: 531830 - RNA, 20 nt, Human
ggcuggggugugggagaggc

SEQ ID NO: 531831 - RNA, 22 nt, Human
ggcuggggugugggagaggccu

SEQ ID NO: 531832 - RNA, 19 nt, Human
gggaauagggauggauggg

SEQ ID NO: 531833 - RNA, 22 nt, Human
gggaggaaaggcaacagagggc

SEQ ID NO: 531834 - RNA, 20 nt, Human
gggauuggucagauggaagg

SEQ ID NO: 531835 - RNA, 18 nt, Human
gggcacuggagguugugc

SEQ ID NO: 531836 - RNA, 20 nt, Human
gggcacuggagguugugcug

SEQ ID NO: 531837 - RNA, 19 nt, Human
gggcauccucacuggugcc

SEQ ID NO: 531838 - RNA, 23 nt, Human
ggguuucuuccaggaccggcccc

SEQ ID NO: 531839 - RNA, 24 nt, Human
guaagcacggggugggcacccuac

SEQ ID NO: 531840 - RNA, 21 nt, Human
gugagacagcagugagcuuag

SEQ ID NO: 531841 - RNA, 28 nt, Human
gugagauuccaaaaaaaaaaaaaaaaaa

SEQ ID NO: 531842 - RNA, 21 nt, Human
guggauggcugggguguggga

SEQ ID NO: 531843 - RNA, 26 nt, Human
guggauggcuggggugugggagaggc

SEQ ID NO: 531844 - RNA, 23 nt, Human
guggugacgguaaaaugaauuuc

SEQ ID NO: 531845 - RNA, 24 nt, Human
guuaaguaacugauaccaggaauu

SEQ ID NO: 531846 - RNA, 25 nt, Human
uaagaccaaugcccacuucucugau

SEQ ID NO: 531847 - RNA, 19 nt, Human
uaccaggaauucuagggug

SEQ ID NO: 531848 - RNA, 20 nt, Human
uaccaggaauucuagggugg

SEQ ID NO: 531849 - RNA, 21 nt, Human
uaccugaugauccaccacuaa

SEQ ID NO: 531850 - RNA, 18 nt, Human
uacuuuguaguauuguuc

SEQ ID NO: 531851 - RNA, 19 nt, Human
uagcucagaaacaacaaaa

SEQ ID NO: 531852 - RNA, 18 nt, Human
uaggaucccaaaugauca

SEQ ID NO: 531853 - RNA, 22 nt, Human
ucaaaaggaaaaggauuccaca

SEQ ID NO: 531854 - RNA, 22 nt, Human
ucaagcagcugagggccagagc

SEQ ID NO: 531855 - RNA, 18 nt, Human
ucagaaacaacaaaaaca

SEQ ID NO: 531856 - RNA, 20 nt, Human
ucagggaggaaggaaaccag

SEQ ID NO: 531857 - RNA, 23 nt, Human
ucaguguagugauauggaauguu

SEQ ID NO: 531858 - RNA, 20 nt, Human
ucauuccacaaacaaaacag

SEQ ID NO: 531859 - RNA, 22 nt, Human
uccacgaaggugauucuaaaca

SEQ ID NO: 531860 - RNA, 21 nt, Human
uccaugcaguuacccaccagc

SEQ ID NO: 531861 - RNA, 22 nt, Human
uccaugcaguuacccaccagca

SEQ ID NO: 531862 - RNA, 26 nt, Human
uccaugcaguuacccaccagcagcca

SEQ ID NO: 531863 - RNA, 23 nt, Human
ucccaaaugaucacuuugugccc

SEQ ID NO: 531864 - RNA, 19 nt, Human
ucccucuggugagggugag

SEQ ID NO: 531865 - RNA, 18 nt, Human
uccuaggauccacucggc

SEQ ID NO: 531866 - RNA, 22 nt, Human
uccuaggauccacucggcccug

SEQ ID NO: 531867 - RNA, 19 nt, Human
uccuggacacccagucugg

SEQ ID NO: 531868 - RNA, 18 nt, Human
uccuggauggcuugaucc

SEQ ID NO: 531869 - RNA, 25 nt, Human
uccuggauggcuugauccugaaggc

SEQ ID NO: 531870 - RNA, 18 nt, Human
uccuucugaucagacaga

SEQ ID NO: 531871 - RNA, 21 nt, Human
uccuugggaauaaacuguccu

SEQ ID NO: 531872 - RNA, 23 nt, Human
ucucagguguccuggcccugacc

SEQ ID NO: 531873 - RNA, 21 nt, Human
ucuuuuguuuugcuuugccau

SEQ ID NO: 531874 - RNA, 22 nt, Human
ugagauuccaaaaaaaaaaaaa

SEQ ID NO: 531875 - RNA, 21 nt, Human
ugagguagaauacaggugacc

SEQ ID NO: 531876 - RNA, 19 nt, Human
ugagguccuccugcuuggc

SEQ ID NO: 531877 - RNA, 23 nt, Human
ugagguccuccugcuuggcguug

SEQ ID NO: 531878 - RNA, 19 nt, Human
ugaguaguacugagcaggu

SEQ ID NO: 531879 - RNA, 20 nt, Human
ugauaccaggaauucuaggg

SEQ ID NO: 531880 - RNA, 23 nt, Human
ugcaccaggcaugcagaggaaca

SEQ ID NO: 531881 - RNA, 21 nt, Human
ugcacggagaggcccuggggg

SEQ ID NO: 531882 - RNA, 22 nt, Human
ugcacggagaggcccugggggc

SEQ ID NO: 531883 - RNA, 18 nt, Human
ugcagaaaagcugguuug

SEQ ID NO: 531884 - RNA, 21 nt, Human
ugccacagugccgggaggcag

SEQ ID NO: 531885 - RNA, 24 nt, Human
ugccauccacuguuugccuuaagu

SEQ ID NO: 531886 - RNA, 18 nt, Human
ugccccccccaucccucc

SEQ ID NO: 531887 - RNA, 20 nt, Human
ugccccguuggccucuucca

SEQ ID NO: 531888 - RNA, 19 nt, Human
ugcccugaggcccuucaga

SEQ ID NO: 531889 - RNA, 20 nt, Human
ugccgggaggcaguggccac

SEQ ID NO: 531890 - RNA, 21 nt, Human
ugccugguggugucccugugg

SEQ ID NO: 531891 - RNA, 22 nt, Human
uggaaaaagcccacgcuggagu

SEQ ID NO: 531892 - RNA, 23 nt, Human
uggaaaaagcccacgcuggagug

SEQ ID NO: 531893 - RNA, 20 nt, Human
uggauggcugggguguggga

SEQ ID NO: 531894 - RNA, 23 nt, Human
uggccaagggcuagcggccacag

SEQ ID NO: 531895 - RNA, 18 nt, Human
uggccuggccaagggcua

SEQ ID NO: 531896 - RNA, 23 nt, Human
uggcuacggaguguugcacggag

SEQ ID NO: 531897 - RNA, 23 nt, Human
uggcuggaugggguauuggaggc

SEQ ID NO: 531898 - RNA, 18 nt, Human
uggcugugggacaagggc

SEQ ID NO: 531899 - RNA, 22 nt, Human
ugggaaggggugccuguucugg

SEQ ID NO: 531900 - RNA, 19 nt, Human
ugggaauagggauggaugg

SEQ ID NO: 531901 - RNA, 19 nt, Human
ugggacaagggcuuuggga

SEQ ID NO: 531902 - RNA, 21 nt, Human
ugggacaagggcuuugggagc

SEQ ID NO: 531903 - RNA, 18 nt, Human
ugggagaggccuugggca

SEQ ID NO: 531904 - RNA, 21 nt, Human
ugggagcgaguggcucuccgu

SEQ ID NO: 531905 - RNA, 19 nt, Human
uggggauuggucagaugga

SEQ ID NO: 531906 - RNA, 21 nt, Human
uggggcauccucacuggugcc

SEQ ID NO: 531907 - RNA, 18 nt, Human
ugggugagguccuccugc

SEQ ID NO: 531908 - RNA, 25 nt, Human
uggucagauggaaggcagagguggu

SEQ ID NO: 531909 - RNA, 21 nt, Human
ugguuagggacaggacgcucc

SEQ ID NO: 531910 - RNA, 18 nt, Human
uguaaacaguacacuuuc

SEQ ID NO: 531911 - RNA, 24 nt, Human
uguaaacaguacacuuucacugag

SEQ ID NO: 531912 - RNA, 19 nt, Human
uguaagaguggugacggua

SEQ ID NO: 531913 - RNA, 20 nt, Human
uguacaaacacaaaagaauc

SEQ ID NO: 531914 - RNA, 21 nt, Human
uguacaaacacaaaagaaucc

SEQ ID NO: 531915 - RNA, 23 nt, Human
uguacaaacacaaaagaauccau

SEQ ID NO: 531916 - RNA, 24 nt, Human
uguccuggcccugaccagaggccu

SEQ ID NO: 531917 - RNA, 22 nt, Human
ugucuaaauuaugccagaggac

SEQ ID NO: 531918 - RNA, 21 nt, Human
ugucucugccagguuuuaaca

SEQ ID NO: 531919 - RNA, 22 nt, Human
uuaugccagaggacuaaagacc

SEQ ID NO: 531920 - RNA, 20 nt, Human
uucacauuggucuuagguag

SEQ ID NO: 531921 - RNA, 21 nt, Human
uucagaguucuggaccugagg

SEQ ID NO: 531922 - RNA, 19 nt, Human
uuccagagcugccccguug

SEQ ID NO: 531923 - RNA, 20 nt, Human
uugauccugaaggcaacaug

SEQ ID NO: 531924 - RNA, 21 nt, Human
uugauccugaaggcaacaugg

SEQ ID NO: 531925 - RNA, 22 nt, Human
uugcuuugccaugggugugggu

SEQ ID NO: 531926 - RNA, 18 nt, Human
uuggucagauggaaggca

SEQ ID NO: 531927 - RNA, 22 nt, Human
uuggugccauccacuguuugcc

SEQ ID NO: 531928 - RNA, 19 nt, Human
uugucuaccugaugaucca

SEQ ID NO: 531929 - RNA, 25 nt, Human
uuuaaaaguuggugccauccacugu

SEQ ID NO: 531930 - RNA, 28 nt, Human
uuucacacuccagggauuauggguuucu

SEQ ID NO: 531931 - RNA, 20 nt, Human
uuuguaguauuguucacaca

SEQ ID NO: 531932 - RNA, 20 nt, Human
uuuugcaaaagaucuuacug

SEQ ID NO: 531933 - RNA, 18 nt, Human
aaaaggauaggugugggu

SEQ ID NO: 531934 - RNA, 20 nt, Human
aagccccucaaaaggauagg

SEQ ID NO: 531935 - RNA, 20 nt, Human
agcagaagcggaguucugcg

SEQ ID NO: 531936 - RNA, 20 nt, Human
agcgggaggaaagaggcuga

SEQ ID NO: 531937 - RNA, 23 nt, Human
aggagcagaagcggaguucugcg

SEQ ID NO: 531938 - RNA, 18 nt, Human
agggagaagcuugggaug

SEQ ID NO: 531939 - RNA, 24 nt, Human
aggggacggagccuaacacaggug

SEQ ID NO: 531940 - RNA, 19 nt, Human
auggaauguccccuauccc

SEQ ID NO: 531941 - RNA, 19 nt, Human
caaccacccccagguccca

SEQ ID NO: 531942 - RNA, 24 nt, Human
cagaagcggaguucugcgcccucc

SEQ ID NO: 531943 - RNA, 22 nt, Human
ccacccccaggucccacuuccc

SEQ ID NO: 531944 - RNA, 18 nt, Human
ccaggucccacuucccag

SEQ ID NO: 531945 - RNA, 22 nt, Human
ccccagcuccaccccaaagccc

SEQ ID NO: 531946 - RNA, 22 nt, Human
cccccaggucccacuucccagc

SEQ ID NO: 531947 - RNA, 18 nt, Human
ccgguccucuccucccuc

SEQ ID NO: 531948 - RNA, 20 nt, Human
ccucuggaaaagggcuuccg

SEQ ID NO: 531949 - RNA, 18 nt, Human
cucaaagaaugagauauc

SEQ ID NO: 531950 - RNA, 19 nt, Human
cucaaagaaugagauaucc

SEQ ID NO: 531951 - RNA, 22 nt, Human
cuccaccccaaagccccucaaa

SEQ ID NO: 531952 - RNA, 25 nt, Human
cucccugccccuccuuuaggauccc

SEQ ID NO: 531953 - RNA, 21 nt, Human
gaagacccagucccucugcuu

SEQ ID NO: 531954 - RNA, 19 nt, Human
gagcagaagcggaguucug

SEQ ID NO: 531955 - RNA, 22 nt, Human
gaggaaagaggcugaggaggcc

SEQ ID NO: 531956 - RNA, 22 nt, Human
gggaaggguggcggagcucaag

SEQ ID NO: 531957 - RNA, 21 nt, Human
ggugacagaaaaacuucggga

SEQ ID NO: 531958 - RNA, 18 nt, Human
uacggggauaaaacgcgg

SEQ ID NO: 531959 - RNA, 20 nt, Human
uccaacccguuuaguggagc

SEQ ID NO: 531960 - RNA, 21 nt, Human
uccaacccguuuaguggagcu

SEQ ID NO: 531961 - RNA, 24 nt, Human
ucccugccccuccuuuaggauccc

SEQ ID NO: 531962 - RNA, 24 nt, Human
ugcuaggugggccguguucccucu

SEQ ID NO: 531963 - RNA, 19 nt, Human
uggaaaagggcuuccggua

SEQ ID NO: 531964 - RNA, 19 nt, Human
uggaaaagggcuuccggua

SEQ ID NO: 531965 - RNA, 18 nt, Human
uggaauguccccuauccc

SEQ ID NO: 531966 - RNA, 18 nt, Human
ugggaggcacuaaaugua

SEQ ID NO: 531967 - RNA, 23 nt, Human
ugguagcaaggagcagaagcgga

SEQ ID NO: 531968 - RNA, 23 nt, Human
uguucccagccucuggaaaaggg

SEQ ID NO: 531969 - RNA, 22 nt, Human
uuagcccaagaagugaagaccc

SEQ ID NO: 531970 - RNA, 22 nt, Human
uucugcgcccucccugccccuc

SEQ ID NO: 531971 - RNA, 24 nt, Human
uuggaugcuugagaugaaggacuu

SEQ ID NO: 531972 - RNA, 27 nt, Human
aaaaaaaaaaaaaagucuuucaaagaa

SEQ ID NO: 531973 - RNA, 22 nt, Human
aaaaacaaaacaaaaugaaaac

SEQ ID NO: 531974 - RNA, 23 nt, Human
aaaaacaaugaacaaacauugac

SEQ ID NO: 531975 - RNA, 24 nt, Human
aaaaggagggggguuauagcagaa

SEQ ID NO: 531976 - RNA, 22 nt, Human
aaacaaaacaaaaugaaaacaa

SEQ ID NO: 531977 - RNA, 23 nt, Human
aaacaagaaaaagguaggggacc

SEQ ID NO: 531978 - RNA, 25 nt, Human
aaacaagaaaaagguaggggaccug

SEQ ID NO: 531979 - RNA, 22 nt, Human
aaacagaacaaggacagccugc

SEQ ID NO: 531980 - RNA, 25 nt, Human
aaacauuucagcaggaauaaaaacg

SEQ ID NO: 531981 - RNA, 20 nt, Human
aaacgaaacaaaacagagcc

SEQ ID NO: 531982 - RNA, 20 nt, Human
aaacgaaaccaagagaaugc

SEQ ID NO: 531983 - RNA, 18 nt, Human
aaagugcugggauuacag

SEQ ID NO: 531984 - RNA, 20 nt, Human
aaagugcugggauuacaggc

SEQ ID NO: 531985 - RNA, 23 nt, Human
aaagugcugggauuacaggcgug

SEQ ID NO: 531986 - RNA, 24 nt, Human
aaagugcugggauuacaggcguga

SEQ ID NO: 531987 - RNA, 25 nt, Human
aaauuuggaaaucuuucagugaacc

SEQ ID NO: 531988 - RNA, 21 nt, Human
aacuguaugcaacagcaaaac

SEQ ID NO: 531989 - RNA, 24 nt, Human
aagacgcucuauucauacaaggcu

SEQ ID NO: 531990 - RNA, 19 nt, Human
aagcacuggaauagacaga

SEQ ID NO: 531991 - RNA, 23 nt, Human
aagcaggagaaagugagcaccaa

SEQ ID NO: 531992 - RNA, 18 nt, Human
aagccugucuccacccag

SEQ ID NO: 531993 - RNA, 24 nt, Human
aagggccaggugcgguggcucaua

SEQ ID NO: 531994 - RNA, 18 nt, Human
aaguauaggagacugccu

SEQ ID NO: 531995 - RNA, 19 nt, Human
aagugcugggauuacaggc

SEQ ID NO: 531996 - RNA, 19 nt, Human
aagugcugggauuacaggc

SEQ ID NO: 531997 - RNA, 26 nt, Human
aagugcugggauuacaggcgugagcc

SEQ ID NO: 531998 - RNA, 20 nt, Human
aaucggcaacagaaugacgc

SEQ ID NO: 531999 - RNA, 21 nt, Human
aaugaaaacaaaacacaaaga

SEQ ID NO: 532000 - RNA, 31 nt, Human
acaaaacaaaaugaaaacaaaacacaaagaa

SEQ ID NO: 532001 - RNA, 24 nt, Human
acaaguaucccaauuucuucagga

SEQ ID NO: 532002 - RNA, 23 nt, Human
acacauauaugaggcaagccaua

SEQ ID NO: 532003 - RNA, 25 nt, Human
acacucuugaaaaacaagaaaaagg

SEQ ID NO: 532004 - RNA, 20 nt, Human
acaggcaagacguuacuacg

SEQ ID NO: 532005 - RNA, 19 nt, Human
acauauaugaggcaagcca

SEQ ID NO: 532006 - RNA, 22 nt, Human
accaacuuccuuccucuaucau

SEQ ID NO: 532007 - RNA, 22 nt, Human
accugaauuaaccaagcugcac

SEQ ID NO: 532008 - RNA, 24 nt, Human
accuugagcaaauucccuaaccuc

SEQ ID NO: 532009 - RNA, 22 nt, Human
acuccauucauaggaaguucaa

SEQ ID NO: 532010 - RNA, 24 nt, Human
acugcaguggcgcaaucucggcuc

SEQ ID NO: 532011 - RNA, 23 nt, Human
agaaagcuucagaaacuuuucaa

SEQ ID NO: 532012 - RNA, 27 nt, Human
agaaagugagcaccaaauuccagucgg

SEQ ID NO: 532013 - RNA, 22 nt, Human
agacacucuugaaaaacaagaa

SEQ ID NO: 532014 - RNA, 19 nt, Human
agacagagagaccaacaga

SEQ ID NO: 532015 - RNA, 18 nt, Human
agacaugcaaaacuaaua

SEQ ID NO: 532016 - RNA, 21 nt, Human
agagauggugaaugguaaugg

SEQ ID NO: 532017 - RNA, 24 nt, Human
agcagaaccauaaaugcccaacag

SEQ ID NO: 532018 - RNA, 19 nt, Human
agcaggagaaagugagcac

SEQ ID NO: 532019 - RNA, 22 nt, Human
agcaggagaaagugagcaccaa

SEQ ID NO: 532020 - RNA, 20 nt, Human
agcuguggccugaagcacca

SEQ ID NO: 532021 - RNA, 18 nt, Human
aggagggggguuauagca

SEQ ID NO: 532022 - RNA, 22 nt, Human
aggauggaagugccaaaaagga

SEQ ID NO: 532023 - RNA, 26 nt, Human
aggauggaagugccaaaaaggagccg

SEQ ID NO: 532024 - RNA, 23 nt, Human
aggcaacuaugggguuugugagc

SEQ ID NO: 532025 - RNA, 18 nt, Human
aggcgugagccaccaagc

SEQ ID NO: 532026 - RNA, 19 nt, Human
aggcuggagugcaguggca

SEQ ID NO: 532027 - RNA, 24 nt, Human
aggugcgguggcucauaccuguaa

SEQ ID NO: 532028 - RNA, 24 nt, Human
aguaagugacaggauuuuuucuug

SEQ ID NO: 532029 - RNA, 22 nt, Human
aguagggauggcguuucaccau

SEQ ID NO: 532030 - RNA, 24 nt, Human
agucugugcaaucuuuuuuuuuuu

SEQ ID NO: 532031 - RNA, 19 nt, Human
agugcaguggcauggucuc

SEQ ID NO: 532032 - RNA, 21 nt, Human
agugcaguggcauggucucag

SEQ ID NO: 532033 - RNA, 23 nt, Human
agugcaguggcauggucucagcu

SEQ ID NO: 532034 - RNA, 26 nt, Human
agugcuccugcacauacacguaugca

SEQ ID NO: 532035 - RNA, 18 nt, Human
agugcugggauuacaggc

SEQ ID NO: 532036 - RNA, 24 nt, Human
aguggcauggucucagcucacugc

SEQ ID NO: 532037 - RNA, 19 nt, Human
aguucacaaucugaaagau

SEQ ID NO: 532038 - RNA, 19 nt, Human
auaagaaauuuggaaaucu

SEQ ID NO: 532039 - RNA, 22 nt, Human
auagacagagagaccaacagaa

SEQ ID NO: 532040 - RNA, 19 nt, Human
auccaccugccuuggccuc

SEQ ID NO: 532041 - RNA, 24 nt, Human
aucucaugauccaccugccuuggc

SEQ ID NO: 532042 - RNA, 28 nt, Human
augacgccacacaagaucauuaaacauu

SEQ ID NO: 532043 - RNA, 24 nt, Human
augauccaccugccuuggccuccu

SEQ ID NO: 532044 - RNA, 22 nt, Human
augcaacagcaaaacacuggaa

SEQ ID NO: 532045 - RNA, 19 nt, Human
auggagaaaaaccaccaca

SEQ ID NO: 532046 - RNA, 24 nt, Human
auggcguuucaccaugcugaccag

SEQ ID NO: 532047 - RNA, 26 nt, Human
caaaaaggagccggcacacaugcuca

SEQ ID NO: 532048 - RNA, 28 nt, Human
caaaacaaaaugaaaacaaaacacaaag

SEQ ID NO: 532049 - RNA, 25 nt, Human
caaaacacuggaaccaacugaaaug

SEQ ID NO: 532050 - RNA, 18 nt, Human
caaaacagagccuugcuc

SEQ ID NO: 532051 - RNA, 23 nt, Human
caaaucuagaaaaagacaaucaa

SEQ ID NO: 532052 - RNA, 22 nt, Human
caacacuuccaccagcuuggcu

SEQ ID NO: 532053 - RNA, 25 nt, Human
caacagaacaaaacagcuuagaaaa

SEQ ID NO: 532054 - RNA, 23 nt, Human
caacagcaaaacacuggaaccaa

SEQ ID NO: 532055 - RNA, 22 nt, Human
caacagcccacugaggccaccu

SEQ ID NO: 532056 - RNA, 26 nt, Human
caaccagcagaaccauaaaugcccaa

SEQ ID NO: 532057 - RNA, 24 nt, Human
caaccuccaccuccuggguuuaag

SEQ ID NO: 532058 - RNA, 24 nt, Human
caacucucucacucagcugugacc

SEQ ID NO: 532059 - RNA, 19 nt, Human
caaggacagccugcugagc

SEQ ID NO: 532060 - RNA, 26 nt, Human
caauggaugcccggcuucugaggcuu

SEQ ID NO: 532061 - RNA, 24 nt, Human
caauuuuuguauccuuaguaggga

SEQ ID NO: 532062 - RNA, 18 nt, Human
cacaaucggcaacagaau

SEQ ID NO: 532063 - RNA, 23 nt, Human
cacaggcacgcgccaccgcaccc

SEQ ID NO: 532064 - RNA, 26 nt, Human
cacauacacguaugcacuaaugugcg

SEQ ID NO: 532065 - RNA, 18 nt, Human
cacauauaugaggcaagc

SEQ ID NO: 532066 - RNA, 20 nt, Human
caccaucacuccacucuuaa

SEQ ID NO: 532067 - RNA, 21 nt, Human
caccaugcugaccaggcuagu

SEQ ID NO: 532068 - RNA, 27 nt, Human
caccaugcugaccaggcuagucucaaa

SEQ ID NO: 532069 - RNA, 21 nt, Human
caccuaagaagccugucucca

SEQ ID NO: 532070 - RNA, 24 nt, Human
caccugccuuggccuccuaaagug

SEQ ID NO: 532071 - RNA, 19 nt, Human
cacucuugaaaaacaagaa

SEQ ID NO: 532072 - RNA, 21 nt, Human
cacugcaaccuccaccuccug

SEQ ID NO: 532073 - RNA, 23 nt, Human
cacugcaaccuccaccuccuggg

SEQ ID NO: 532074 - RNA, 19 nt, Human
cagaacaaggacagccugc

SEQ ID NO: 532075 - RNA, 19 nt, Human
cagaaccauaaaugcccaa

SEQ ID NO: 532076 - RNA, 23 nt, Human
cagaaugacgccacacaagauca

SEQ ID NO: 532077 - RNA, 22 nt, Human
cagauacgcauaccuguaacuc

SEQ ID NO: 532078 - RNA, 20 nt, Human
cagcagaacuguaugcaaca

SEQ ID NO: 532079 - RNA, 20 nt, Human
cagcaggaauaaaaacgaaa

SEQ ID NO: 532080 - RNA, 28 nt, Human
cagccacgugcgcaugcgugcguguggu

SEQ ID NO: 532081 - RNA, 24 nt, Human
caggaauaaaaacgaaaccaagag

SEQ ID NO: 532082 - RNA, 20 nt, Human
caggaccaaagcucaaaagc

SEQ ID NO: 532083 - RNA, 20 nt, Human
caggaugcagagcugccucu

SEQ ID NO: 532084 - RNA, 21 nt, Human
cagugauaagaaauuuggaaa

SEQ ID NO: 532085 - RNA, 21 nt, Human
cauaacagguaccuuucuaga

SEQ ID NO: 532086 - RNA, 22 nt, Human
cauaaggaaaaggagggggguu

SEQ ID NO: 532087 - RNA, 20 nt, Human
cauaccuguaaucccagcug

SEQ ID NO: 532088 - RNA, 24 nt, Human
caugcugaccaggcuagucucaaa

SEQ ID NO: 532089 - RNA, 28 nt, Human
cauuaaaguaaaaaacaaaacaaaauga

SEQ ID NO: 532090 - RNA, 22 nt, Human
ccaacugaaauguccaucaaca

SEQ ID NO: 532091 - RNA, 24 nt, Human
ccaccuccuggguuuaagugauuc

SEQ ID NO: 532092 - RNA, 19 nt, Human
ccauaaggaaaaggagggg

SEQ ID NO: 532093 - RNA, 21 nt, Human
cccaucaagagcuuuuuuaaa

SEQ ID NO: 532094 - RNA, 18 nt, Human
cccuccucccuuuccucc

SEQ ID NO: 532095 - RNA, 18 nt, Human
ccgaugcgccuguuucca

SEQ ID NO: 532096 - RNA, 23 nt, Human
ccuaaagugcugggauuacaggc

SEQ ID NO: 532097 - RNA, 22 nt, Human
ccuaaaugaccaagagagauuu

SEQ ID NO: 532098 - RNA, 20 nt, Human
ccucccuuuccuccgacugg

SEQ ID NO: 532099 - RNA, 21 nt, Human
ccucccuuuccuccgacugga

SEQ ID NO: 532100 - RNA, 27 nt, Human
ccucucgggauaaaggggaaugaaaac

SEQ ID NO: 532101 - RNA, 23 nt, Human
ccugccuuaagagcacucaggaa

SEQ ID NO: 532102 - RNA, 20 nt, Human
ccuguaacucaaaaauuguc

SEQ ID NO: 532103 - RNA, 21 nt, Human
ccuguaaucccagcugguuag

SEQ ID NO: 532104 - RNA, 24 nt, Human
ccuugagcaaauucccuaaccucu

SEQ ID NO: 532105 - RNA, 22 nt, Human
ccuugcucuguugcccaggcug

SEQ ID NO: 532106 - RNA, 23 nt, Human
ccuugcucuguugcccaggcugg

SEQ ID NO: 532107 - RNA, 24 nt, Human
ccuugcucuguugcccaggcugga

SEQ ID NO: 532108 - RNA, 24 nt, Human
ccuuuauaggguuguggugaggau

SEQ ID NO: 532109 - RNA, 18 nt, Human
cgaaacaaaacagagccu

SEQ ID NO: 532110 - RNA, 19 nt, Human
cgaaacaaaacagagccuu

SEQ ID NO: 532111 - RNA, 25 nt, Human
cgaagaacauacacuuauguuacaa

SEQ ID NO: 532112 - RNA, 21 nt, Human
cgcagcuuaggcuuuggcuca

SEQ ID NO: 532113 - RNA, 22 nt, Human
cgcagcuuaggcuuuggcucag

SEQ ID NO: 532114 - RNA, 26 nt, Human
cgccacgagcucccuccuuuauaggg

SEQ ID NO: 532115 - RNA, 21 nt, Human
cgcccaggcuggacugcggac

SEQ ID NO: 532116 - RNA, 24 nt, Human
cgcucugucgcccaggcuggacug

SEQ ID NO: 532117 - RNA, 19 nt, Human
cggcuucugaggcuuaccu

SEQ ID NO: 532118 - RNA, 22 nt, Human
cgggauaaaggggaaugaaaac

SEQ ID NO: 532119 - RNA, 22 nt, Human
cuaaagugcugggauuacaggc

SEQ ID NO: 532120 - RNA, 24 nt, Human
cuaaagugcugggauuacaggcgu

SEQ ID NO: 532121 - RNA, 21 nt, Human
cuaaguuaaaaaaaaaaaaaa

SEQ ID NO: 532122 - RNA, 22 nt, Human
cuaaguuaaaaaaaaaaaaaag

SEQ ID NO: 532123 - RNA, 23 nt, Human
cuauacccuaaagaauucgugug

SEQ ID NO: 532124 - RNA, 24 nt, Human
cucacugcaaccuccaccuccugg

SEQ ID NO: 532125 - RNA, 22 nt, Human
cucauacaucacugaguccugc

SEQ ID NO: 532126 - RNA, 21 nt, Human
cucauaccuguaaucccagcu

SEQ ID NO: 532127 - RNA, 18 nt, Human
cucaugauccaccugccu

SEQ ID NO: 532128 - RNA, 21 nt, Human
cuccagugaucucagguccac

SEQ ID NO: 532129 - RNA, 23 nt, Human
cuccagugaucucagguccaccg

SEQ ID NO: 532130 - RNA, 25 nt, Human
cucccucaaccucccgagcagcugg

SEQ ID NO: 532131 - RNA, 24 nt, Human
cuccugaucucaugauccaccugc

SEQ ID NO: 532132 - RNA, 21 nt, Human
cuccuggguuuaagugauucu

SEQ ID NO: 532133 - RNA, 23 nt, Human
cucgggauaaaggggaaugaaaa

SEQ ID NO: 532134 - RNA, 23 nt, Human
cucuuggccucuguuucuucauu

SEQ ID NO: 532135 - RNA, 21 nt, Human
cugaaauguccaucaacagca

SEQ ID NO: 532136 - RNA, 23 nt, Human
cugaagaucucagcugcaaccag

SEQ ID NO: 532137 - RNA, 18 nt, Human
cugcaaccuccaccuccu

SEQ ID NO: 532138 - RNA, 23 nt, Human
cugcaaccuccaccuccuggguu

SEQ ID NO: 532139 - RNA, 24 nt, Human
cugcaaccuccaccuccuggguuu

SEQ ID NO: 532140 - RNA, 21 nt, Human
cugcgcaaucauuagcagagu

SEQ ID NO: 532141 - RNA, 19 nt, Human
cuggagugcaguggcaugg

SEQ ID NO: 532142 - RNA, 22 nt, Human
cuggguuuaagugauucuucuc

SEQ ID NO: 532143 - RNA, 24 nt, Human
cuguacauuaaaguaaaaaacaaa

SEQ ID NO: 532144 - RNA, 26 nt, Human
cuuccugcaggcagauagcaagaggc

SEQ ID NO: 532145 - RNA, 19 nt, Human
cuucugaggcuuaccucuc

SEQ ID NO: 532146 - RNA, 23 nt, Human
cuugcacuuuaaugcagaauuag

SEQ ID NO: 532147 - RNA, 23 nt, Human
cuuggcuccagugaucucagguc

SEQ ID NO: 532148 - RNA, 18 nt, Human
cuuucagugaaccauuuc

SEQ ID NO: 532149 - RNA, 24 nt, Human
gaaaaaccaccacaggaagguuaa

SEQ ID NO: 532150 - RNA, 24 nt, Human
gaaaaagacaaucaaauugaaaag

SEQ ID NO: 532151 - RNA, 19 nt, Human
gaaaaggaccagaaacuca

SEQ ID NO: 532152 - RNA, 24 nt, Human
gaaacagauucacacucuuacgga

SEQ ID NO: 532153 - RNA, 23 nt, Human
gaaacucaauucgcagcuuaggc

SEQ ID NO: 532154 - RNA, 23 nt, Human
gaaccauuucaaaauugagcuaa

SEQ ID NO: 532155 - RNA, 21 nt, Human
gacagagagaccaacagaaca

SEQ ID NO: 532156 - RNA, 22 nt, Human
gaccaagagagauuucuaacaa

SEQ ID NO: 532157 - RNA, 21 nt, Human
gaccuugagcaaauucccuaa

SEQ ID NO: 532158 - RNA, 19 nt, Human
gagaaaaacaaugaacaaa

SEQ ID NO: 532159 - RNA, 24 nt, Human
gagcagcuggaaccacaggcacgc

SEQ ID NO: 532160 - RNA, 23 nt, Human
gaggauggaagugccaaaaagga

SEQ ID NO: 532161 - RNA, 24 nt, Human
gaucucaugauccaccugccuugg

SEQ ID NO: 532162 - RNA, 18 nt, Human
gauuacaggcgugagcca

SEQ ID NO: 532163 - RNA, 21 nt, Human
gauuacaggcgugagccacca

SEQ ID NO: 532164 - RNA, 24 nt, Human
gauuacaggcgugagccaccaagc

SEQ ID NO: 532165 - RNA, 23 nt, Human
gcaacacaaaucaguggagaaaa

SEQ ID NO: 532166 - RNA, 23 nt, Human
gcaacagaaugacgccacacaag

SEQ ID NO: 532167 - RNA, 26 nt, Human
gcaacuaugggguuugucgucucgac

SEQ ID NO: 532168 - RNA, 24 nt, Human
gcacuggaauagacagagagacca

SEQ ID NO: 532169 - RNA, 24 nt, Human
gcccaggcuggagugcaguggcau

SEQ ID NO: 532170 - RNA, 22 nt, Human
gccuuggccuccuaaagugcug

SEQ ID NO: 532171 - RNA, 25 nt, Human
gcucugucgcccaggcuggacugcg

SEQ ID NO: 532172 - RNA, 25 nt, Human
gcucuguugcccaggcuggagugca

SEQ ID NO: 532173 - RNA, 21 nt, Human
gcucuuaacaaaacagaacaa

SEQ ID NO: 532174 - RNA, 18 nt, Human
gcugcacugugguccaau

SEQ ID NO: 532175 - RNA, 21 nt, Human
gcuggacugcggacugcagug

SEQ ID NO: 532176 - RNA, 24 nt, Human
gcuggagcacauagagacuuccug

SEQ ID NO: 532177 - RNA, 19 nt, Human
gcuggagugcaguggcaug

SEQ ID NO: 532178 - RNA, 25 nt, Human
gcuucccggguucacgccauucucc

SEQ ID NO: 532179 - RNA, 21 nt, Human
ggaauaaaaacgaaaccaaga

SEQ ID NO: 532180 - RNA, 24 nt, Human
ggaccaaagcucaaaagcaggaga

SEQ ID NO: 532181 - RNA, 21 nt, Human
ggagucacuaacagucauaaa

SEQ ID NO: 532182 - RNA, 19 nt, Human
ggauuacaggcgugagcca

SEQ ID NO: 532183 - RNA, 18 nt, Human
ggccaggugcgguggcuc

SEQ ID NO: 532184 - RNA, 22 nt, Human
ggcguuucaccaugcugaccag

SEQ ID NO: 532185 - RNA, 23 nt, Human
ggcguuucaccaugcugaccagg

SEQ ID NO: 532186 - RNA, 21 nt, Human
ggcucauaccuguaaucccag

SEQ ID NO: 532187 - RNA, 23 nt, Human
gguggcucauaccuguaauccca

SEQ ID NO: 532188 - RNA, 24 nt, Human
gguggcucauaccuguaaucccag

SEQ ID NO: 532189 - RNA, 23 nt, Human
gugcgcaugcgugcgugugcaug

SEQ ID NO: 532190 - RNA, 23 nt, Human
gugugcaugagagagcgcgcaug

SEQ ID NO: 532191 - RNA, 20 nt, Human
guuaaaaaaaaaaaaaaguu

SEQ ID NO: 532192 - RNA, 26 nt, Human
uaaaaaacaaaacaaaaugaaaacaa

SEQ ID NO: 532193 - RNA, 18 nt, Human
uaaaagugaaauaacuca

SEQ ID NO: 532194 - RNA, 24 nt, Human
uaaaauagcagauacgcauaccug

SEQ ID NO: 532195 - RNA, 21 nt, Human
uaaagcuagacagugaagcac

SEQ ID NO: 532196 - RNA, 19 nt, Human
uaaagugccacuaaucaag

SEQ ID NO: 532197 - RNA, 20 nt, Human
uaaaugcccaacagcccacu

SEQ ID NO: 532198 - RNA, 19 nt, Human
uaacaaaacagaacaagga

SEQ ID NO: 532199 - RNA, 21 nt, Human
uaacaaaacagaacaaggaca

SEQ ID NO: 532200 - RNA, 22 nt, Human
uaacaaaacagaacaaggacag

SEQ ID NO: 532201 - RNA, 24 nt, Human
uaacacaggaccaaagcucaaaag

SEQ ID NO: 532202 - RNA, 20 nt, Human
uaacagucauaaaagugaaa

SEQ ID NO: 532203 - RNA, 23 nt, Human
uaagaugaguaucuagaacucuu

SEQ ID NO: 532204 - RNA, 18 nt, Human
uaagccacaagccagaag

SEQ ID NO: 532205 - RNA, 21 nt, Human
uaaggaaccuccucgagacuc

SEQ ID NO: 532206 - RNA, 24 nt, Human
uacaaaucuaugaugaaaccacac

SEQ ID NO: 532207 - RNA, 20 nt, Human
uacaggcgugagccaccaag

SEQ ID NO: 532208 - RNA, 22 nt, Human
uacaggcgugagccaccaagcc

SEQ ID NO: 532209 - RNA, 22 nt, Human
uacaggcgugagccaccaagcc

SEQ ID NO: 532210 - RNA, 23 nt, Human
uacaggcgugagccaccaagccu

SEQ ID NO: 532211 - RNA, 25 nt, Human
uacauaaaacagaggagucacuaac

SEQ ID NO: 532212 - RNA, 26 nt, Human
uaccacaggaugcagagcugccucuc

SEQ ID NO: 532213 - RNA, 19 nt, Human
uaccuguaaucccagcugg

SEQ ID NO: 532214 - RNA, 24 nt, Human
uacucucaaaaaugaaaaugauuu

SEQ ID NO: 532215 - RNA, 23 nt, Human
uagaaaaagacaaucaaauugaa

SEQ ID NO: 532216 - RNA, 23 nt, Human
uagaaaacaguaaguauaggaga

SEQ ID NO: 532217 - RNA, 22 nt, Human
uaggaaguucaaagacaugcaa

SEQ ID NO: 532218 - RNA, 24 nt, Human
uaguagggauggcguuucaccaug

SEQ ID NO: 532219 - RNA, 18 nt, Human
uaucccaauuucuucagg

SEQ ID NO: 532220 - RNA, 20 nt, Human
uauuacagaaacaaguaaau

SEQ ID NO: 532221 - RNA, 20 nt, Human
ucaaaagcaggagaaaguga

SEQ ID NO: 532222 - RNA, 24 nt, Human
ucacgcugugagaauccucuggac

SEQ ID NO: 532223 - RNA, 23 nt, Human
ucacugcaaccuccaccuccugg

SEQ ID NO: 532224 - RNA, 24 nt, Human
ucacugcaaccuccaccuccuggg

SEQ ID NO: 532225 - RNA, 25 nt, Human
ucacugcaaccuccaccuccugggu

SEQ ID NO: 532226 - RNA, 23 nt, Human
ucacugcaagcuccgcuucccgg

SEQ ID NO: 532227 - RNA, 24 nt, Human
ucacugcaagcuccgcuucccggg

SEQ ID NO: 532228 - RNA, 24 nt, Human
ucaguaagugacaggauuuuuucu

SEQ ID NO: 532229 - RNA, 24 nt, Human
uccaaugacacuuuggcacuaaaa

SEQ ID NO: 532230 - RNA, 22 nt, Human
uccagagaugacacugggacac

SEQ ID NO: 532231 - RNA, 20 nt, Human
ucccggguucacgccauucu

SEQ ID NO: 532232 - RNA, 21 nt, Human
ucccggguucacgccauucuc

SEQ ID NO: 532233 - RNA, 24 nt, Human
ucccggguucacgccauucuccug

SEQ ID NO: 532234 - RNA, 24 nt, Human
ucccucaaccucccgagcagcugg

SEQ ID NO: 532235 - RNA, 24 nt, Human
uccuaaagugcugggauuacaggc

SEQ ID NO: 532236 - RNA, 25 nt, Human
ucgagacucuccuuaucuagaaacc

SEQ ID NO: 532237 - RNA, 18 nt, Human
ucgcccaggcuggacugc

SEQ ID NO: 532238 - RNA, 21 nt, Human
ucuagaaaaagacaaucaaau

SEQ ID NO: 532239 - RNA, 22 nt, Human
ucuagccuuuuucaacuggagu

SEQ ID NO: 532240 - RNA, 22 nt, Human
ucucagguccaccuuugugccc

SEQ ID NO: 532241 - RNA, 26 nt, Human
ucuccuaugaacggaacauaacaggu

SEQ ID NO: 532242 - RNA, 25 nt, Human
ucuccugcuuaaaaaaaaaaaaaaa

SEQ ID NO: 532243 - RNA, 19 nt, Human
ucucgcucugucgcccagg

SEQ ID NO: 532244 - RNA, 23 nt, Human
ucucgcucugucgcccaggcugg

SEQ ID NO: 532245 - RNA, 24 nt, Human
ucucgcucugucgcccaggcugga

SEQ ID NO: 532246 - RNA, 24 nt, Human
ucucucagaacuccgagugagaac

SEQ ID NO: 532247 - RNA, 27 nt, Human
ucucuuggccucuguuucuucauuuua

SEQ ID NO: 532248 - RNA, 24 nt, Human
ucugucgcccaggcuggacugcgg

SEQ ID NO: 532249 - RNA, 22 nt, Human
ucugucugaagaucucagcugc

SEQ ID NO: 532250 - RNA, 18 nt, Human
ucuguugcccaggcugga

SEQ ID NO: 532251 - RNA, 24 nt, Human
ucuguugcccaggcuggagugcag

SEQ ID NO: 532252 - RNA, 24 nt, Human
ucuucaggaccagguggcacucuc

SEQ ID NO: 532253 - RNA, 20 nt, Human
ucuuuuuuuuuuuuuuuugg

SEQ ID NO: 532254 - RNA, 18 nt, Human
ugaaaaacaagaaaaagg

SEQ ID NO: 532255 - RNA, 18 nt, Human
ugaaaaacaagaaaaagg

SEQ ID NO: 532256 - RNA, 21 nt, Human
ugaaaaacaagaaaaagguag

SEQ ID NO: 532257 - RNA, 21 nt, Human
ugaaaaacaagaaaaagguag

SEQ ID NO: 532258 - RNA, 21 nt, Human
ugaaaacagcaaggugcagga

SEQ ID NO: 532259 - RNA, 23 nt, Human
ugaaaacagcaaggugcaggaca

SEQ ID NO: 532260 - RNA, 22 nt, Human
ugaaaaguaagcaaaagauuua

SEQ ID NO: 532261 - RNA, 18 nt, Human
ugaaaaugauuuccccag

SEQ ID NO: 532262 - RNA, 24 nt, Human
ugaaauguccaucaacagcagaaa

SEQ ID NO: 532263 - RNA, 23 nt, Human
ugagaacagcugccacuggcugc

SEQ ID NO: 532264 - RNA, 22 nt, Human
ugagacggagucucgcucuguc

SEQ ID NO: 532265 - RNA, 23 nt, Human
ugaggauggaagugccaaaaagg

SEQ ID NO: 532266 - RNA, 19 nt, Human
ugaggcaagccauaaggaa

SEQ ID NO: 532267 - RNA, 18 nt, Human
ugaguaucuagaacucuu

SEQ ID NO: 532268 - RNA, 23 nt, Human
ugaucucaugauccaccugccuu

SEQ ID NO: 532269 - RNA, 21 nt, Human
ugcaacagcaaaacacuggaa

SEQ ID NO: 532270 - RNA, 20 nt, Human
ugcaaucuuuuuuuuuuuuu

SEQ ID NO: 532271 - RNA, 22 nt, Human
ugcaccagaaauacauaaaaca

SEQ ID NO: 532272 - RNA, 22 nt, Human
ugcaguggcauggucucagcuc

SEQ ID NO: 532273 - RNA, 18 nt, Human
ugcaguggcgcaaucucg

SEQ ID NO: 532274 - RNA, 23 nt, Human
ugcaguggcgcaaucucggcuca

SEQ ID NO: 532275 - RNA, 21 nt, Human
ugccacuggcugcacgaccuu

SEQ ID NO: 532276 - RNA, 20 nt, Human
ugcccaagggccaggugcgg

SEQ ID NO: 532277 - RNA, 19 nt, Human
ugcccacaaguaucccaau

SEQ ID NO: 532278 - RNA, 18 nt, Human
ugcccaggcuggagugca

SEQ ID NO: 532279 - RNA, 21 nt, Human
ugcccaggcuggagugcagug

SEQ ID NO: 532280 - RNA, 22 nt, Human
ugcccaggcuggagugcagugg

SEQ ID NO: 532281 - RNA, 24 nt, Human
ugcccaggcuggagugcaguggca

SEQ ID NO: 532282 - RNA, 18 nt, Human
ugccugacacaagauggg

SEQ ID NO: 532283 - RNA, 23 nt, Human
ugcgcuuggaauuuaccagaaca

SEQ ID NO: 532284 - RNA, 19 nt, Human
ugcuacacaaucaccaaac

SEQ ID NO: 532285 - RNA, 24 nt, Human
ugcucuguugcccaggcuggagug

SEQ ID NO: 532286 - RNA, 24 nt, Human
ugcugggauuacaggcgugagcca

SEQ ID NO: 532287 - RNA, 21 nt, Human
uggaaccacaggcacgcgcca

SEQ ID NO: 532288 - RNA, 24 nt, Human
uggaaccacaggcacgcgccaccg

SEQ ID NO: 532289 - RNA, 23 nt, Human
uggaauagacagagagaccaaca

SEQ ID NO: 532290 - RNA, 20 nt, Human
uggaauuuaccagaacacac

SEQ ID NO: 532291 - RNA, 18 nt, Human
uggagaaaaacaaugaac

SEQ ID NO: 532292 - RNA, 20 nt, Human
uggagugcaguggcaugguc

SEQ ID NO: 532293 - RNA, 23 nt, Human
uggagugcaguggcauggucuca

SEQ ID NO: 532294 - RNA, 24 nt, Human
uggagugcaguggcauggucucag

SEQ ID NO: 532295 - RNA, 19 nt, Human
uggcauggucucagcucac

SEQ ID NO: 532296 - RNA, 24 nt, Human
uggcauggucucagcucacugcaa

SEQ ID NO: 532297 - RNA, 24 nt, Human
uggcguuucaccaugcugaccagg

SEQ ID NO: 532298 - RNA, 21 nt, Human
uggcucauaccuguaauccca

SEQ ID NO: 532299 - RNA, 22 nt, Human
uggcucauaccuguaaucccag

SEQ ID NO: 532300 - RNA, 20 nt, Human
uggcugcacgaccuugagca

SEQ ID NO: 532301 - RNA, 18 nt, Human
ugggauuacaggcgugag

SEQ ID NO: 532302 - RNA, 19 nt, Human
ugggauuacaggcgugagc

SEQ ID NO: 532303 - RNA, 22 nt, Human
ugggauuacaggcgugagccac

SEQ ID NO: 532304 - RNA, 23 nt, Human
ugggauuacaggcgugagccacc

SEQ ID NO: 532305 - RNA, 24 nt, Human
ugggauuacaggcgugagccacca

SEQ ID NO: 532306 - RNA, 19 nt, Human
ugucugaagaucucagcug

SEQ ID NO: 532307 - RNA, 28 nt, Human
ugucuuaacuauacccuaaagaauucgu

SEQ ID NO: 532308 - RNA, 25 nt, Human
ugugcaaucuuuuuuuuuuuuuuuu

SEQ ID NO: 532309 - RNA, 19 nt, Human
ugugcuggagcacauagag

SEQ ID NO: 532310 - RNA, 22 nt, Human
uguguagcaauacacauauaug

SEQ ID NO: 532311 - RNA, 19 nt, Human
ugugugccaguugaugugu

SEQ ID NO: 532312 - RNA, 22 nt, Human
ugugugccaguugaugugugca

SEQ ID NO: 532313 - RNA, 19 nt, Human
uguuggcuaggaugugaag

SEQ ID NO: 532314 - RNA, 19 nt, Human
uuaagggacuuagaacauc

SEQ ID NO: 532315 - RNA, 19 nt, Human
uuacaauuuaugcccaagg

SEQ ID NO: 532316 - RNA, 18 nt, Human
uuaguagggauggcguuu

SEQ ID NO: 532317 - RNA, 24 nt, Human
uuaguagggauggcguuucaccau

SEQ ID NO: 532318 - RNA, 18 nt, Human
uuccccuccucccuuucc

SEQ ID NO: 532319 - RNA, 19 nt, Human
uuccugcaggcagauagca

SEQ ID NO: 532320 - RNA, 30 nt, Human
uucuccugcuuaaaaaaaaaaaaaaaaaaa

SEQ ID NO: 532321 - RNA, 21 nt, Human
uugaaaaacaagaaaaaggua

SEQ ID NO: 532322 - RNA, 24 nt, Human
uugcccaggcuggagugcaguggc

SEQ ID NO: 532323 - RNA, 24 nt, Human
uugcucuguugcccaggcuggagu

SEQ ID NO: 532324 - RNA, 18 nt, Human
uuggccuccuaaagugcu

SEQ ID NO: 532325 - RNA, 19 nt, Human
uuggcuccagugaucucag

SEQ ID NO: 532326 - RNA, 22 nt, Human
uuggcuccagugaucucagguc

SEQ ID NO: 532327 - RNA, 23 nt, Human
uuuaagaugaguaucuagaacuc

SEQ ID NO: 532328 - RNA, 18 nt, Human
uuuuaaggucugauucua

SEQ ID NO: 532329 - RNA, 23 nt, Human
uuuuuguauccuuaguagggaug

SEQ ID NO: 532330 - RNA, 25 nt, Human
uuuuuuuuuuuugagacggagucuc

SEQ ID NO: 532331 - RNA, 18 nt, Human
uuuuuuuuuuuuuuaaac

SEQ ID NO: 532332 - RNA, 22 nt, Human
uuuuuuuuuuuuuugagacgga

SEQ ID NO: 532333 - RNA, 23 nt, Human
uuuuuuuuuuuuuuuuuuaaacg

SEQ ID NO: 532334 - RNA, 20 nt, Human
aaaaauucaaaaaauuagcc

SEQ ID NO: 532335 - RNA, 20 nt, Human
aaacaaugucagcuuccuga

SEQ ID NO: 532336 - RNA, 21 nt, Human
aagaaagcauucuccuuccac

SEQ ID NO: 532337 - RNA, 18 nt, Human
aauuagccaggcauggug

SEQ ID NO: 532338 - RNA, 21 nt, Human
acaaagaaagcauucuccuuc

SEQ ID NO: 532339 - RNA, 23 nt, Human
acaaagaaagcauucuccuucca

SEQ ID NO: 532340 - RNA, 24 nt, Human
acagagaaagacccugucucaaaa

SEQ ID NO: 532341 - RNA, 23 nt, Human
acaguggaaacuaguuuccuuca

SEQ ID NO: 532342 - RNA, 24 nt, Human
accagugcacucuagccugggcaa

SEQ ID NO: 532343 - RNA, 26 nt, Human
accagugcacucuagccugggcaaca

SEQ ID NO: 532344 - RNA, 28 nt, Human
acccugucucaaaaaaaaaaaaaaaaaa

SEQ ID NO: 532345 - RNA, 25 nt, Human
acgaaaccacagaugaggccacaaa

SEQ ID NO: 532346 - RNA, 27 nt, Human
acgaaaccacagaugaggccacaaaga

SEQ ID NO: 532347 - RNA, 21 nt, Human
acugaacugugcuuuaaauag

SEQ ID NO: 532348 - RNA, 23 nt, Human
acuuguagucccagcuacucagg

SEQ ID NO: 532349 - RNA, 24 nt, Human
agcacuuugggaggucgagguggg

SEQ ID NO: 532350 - RNA, 18 nt, Human
agccaggcaugguggugc

SEQ ID NO: 532351 - RNA, 24 nt, Human
agcuacucaggaggcugagguggg

SEQ ID NO: 532352 - RNA, 24 nt, Human
aggaucgcuugaggccaggaguuc

SEQ ID NO: 532353 - RNA, 24 nt, Human
aggcgagguggcucacaccuguaa

SEQ ID NO: 532354 - RNA, 21 nt, Human
aggcuagagugagccgugauc

SEQ ID NO: 532355 - RNA, 24 nt, Human
aggcugaggugggagaauugcuug

SEQ ID NO: 532356 - RNA, 20 nt, Human
agggagaaagggggagagaa

SEQ ID NO: 532357 - RNA, 24 nt, Human
aggucgaggugggaggaucgcuug

SEQ ID NO: 532358 - RNA, 18 nt, Human
aggugggaggaucgcuug

SEQ ID NO: 532359 - RNA, 23 nt, Human
aggugggaggaucgcuugaggcc

SEQ ID NO: 532360 - RNA, 24 nt, Human
agugcacucuagccugggcaacag

SEQ ID NO: 532361 - RNA, 24 nt, Human
aguucgagaccacccugggcaaca

SEQ ID NO: 532362 - RNA, 23 nt, Human
aucaucugguucucccagacccc

SEQ ID NO: 532363 - RNA, 19 nt, Human
auuugcuuugugauuccca

SEQ ID NO: 532364 - RNA, 22 nt, Human
caacagagaaagacccugucuc

SEQ ID NO: 532365 - RNA, 19 nt, Human
caacagagcgagaucccau

SEQ ID NO: 532366 - RNA, 24 nt, Human
caacagagcgagaucccaucacua

SEQ ID NO: 532367 - RNA, 24 nt, Human
cacaccuguaaucccagcacuuug

SEQ ID NO: 532368 - RNA, 20 nt, Human
cacagcaacuggcugagaaa

SEQ ID NO: 532369 - RNA, 18 nt, Human
cacccugggcaacagagc

SEQ ID NO: 532370 - RNA, 19 nt, Human
caccuguaaucccagcacu

SEQ ID NO: 532371 - RNA, 24 nt, Human
caccuguaaucccagcacuuuggg

SEQ ID NO: 532372 - RNA, 24 nt, Human
cacuuguagucccagcuacucagg

SEQ ID NO: 532373 - RNA, 24 nt, Human
cagcacuuugggaggucgaggugg

SEQ ID NO: 532374 - RNA, 24 nt, Human
cagcuacucaggaggcugaggugg

SEQ ID NO: 532375 - RNA, 24 nt, Human
cagcuuccugaaucauccagggag

SEQ ID NO: 532376 - RNA, 26 nt, Human
cagcuuccugaaucauccagggagaa

SEQ ID NO: 532377 - RNA, 18 nt, Human
caggaauucaaggcuaga

SEQ ID NO: 532378 - RNA, 20 nt, Human
caggcuacucuccagggaca

SEQ ID NO: 532379 - RNA, 19 nt, Human
cagugcacucuagccuggg

SEQ ID NO: 532380 - RNA, 23 nt, Human
cagugcacucuagccugggcaac

SEQ ID NO: 532381 - RNA, 24 nt, Human
cagugcacucuagccugggcaaca

SEQ ID NO: 532382 - RNA, 25 nt, Human
caucugguucucccagacccuuuua

SEQ ID NO: 532383 - RNA, 25 nt, Human
ccaggaguucgagaccacccugggc

SEQ ID NO: 532384 - RNA, 18 nt, Human
ccaggcgagguggcucac

SEQ ID NO: 532385 - RNA, 20 nt, Human
ccagugcacucuagccuggg

SEQ ID NO: 532386 - RNA, 21 nt, Human
ccagugcacucuagccugggc

SEQ ID NO: 532387 - RNA, 23 nt, Human
ccagugcacucuagccugggcaa

SEQ ID NO: 532388 - RNA, 24 nt, Human
ccagugcacucuagccugggcaac

SEQ ID NO: 532389 - RNA, 24 nt, Human
cccaucacuacaaaaauucaaaaa

SEQ ID NO: 532390 - RNA, 19 nt, Human
cccugucucaaaaaaaaaa

SEQ ID NO: 532391 - RNA, 23 nt, Human
ccgcgcugcgccgcguacaccca

SEQ ID NO: 532392 - RNA, 23 nt, Human
ccugucucaaaaaaaaaaaaaaa

SEQ ID NO: 532393 - RNA, 24 nt, Human
cgaaaccacagaugaggccacaaa

SEQ ID NO: 532394 - RNA, 23 nt, Human
cgaggugggaggaucgcuugagg

SEQ ID NO: 532395 - RNA, 24 nt, Human
cgaggugggaggaucgcuugaggc

SEQ ID NO: 532396 - RNA, 26 nt, Human
cgaggugggaggaucgcuugaggcca

SEQ ID NO: 532397 - RNA, 18 nt, Human
cucaaaaaaaaaaaaaaa

SEQ ID NO: 532398 - RNA, 22 nt, Human
cucacaccuguaaucccagcac

SEQ ID NO: 532399 - RNA, 24 nt, Human
cucacaccuguaaucccagcacuu

SEQ ID NO: 532400 - RNA, 18 nt, Human
cucaggaggcugaggugg

SEQ ID NO: 532401 - RNA, 18 nt, Human
cugccuugaggaaacaau

SEQ ID NO: 532402 - RNA, 19 nt, Human
gaaaccacagaugaggcca

SEQ ID NO: 532403 - RNA, 24 nt, Human
gaggugggagaauugcuugggccc

SEQ ID NO: 532404 - RNA, 24 nt, Human
gaggugggaggaucgcuugaggcc

SEQ ID NO: 532405 - RNA, 18 nt, Human
gaucgcuugaggccagga

SEQ ID NO: 532406 - RNA, 24 nt, Human
gaucgcuugaggccaggaguucga

SEQ ID NO: 532407 - RNA, 23 nt, Human
ggaucgcuugaggccaggaguuc

SEQ ID NO: 532408 - RNA, 21 nt, Human
ggcucacaccuguaaucccag

SEQ ID NO: 532409 - RNA, 22 nt, Human
ggugcacacuuguagucccagc

SEQ ID NO: 532410 - RNA, 23 nt, Human
gguggcucacaccuguaauccca

SEQ ID NO: 532411 - RNA, 24 nt, Human
gguggcucacaccuguaaucccag

SEQ ID NO: 532412 - RNA, 18 nt, Human
uagccugggcaacagaga

SEQ ID NO: 532413 - RNA, 22 nt, Human
ucaaaaaaaaaaaaaaaaaaaa

SEQ ID NO: 532414 - RNA, 23 nt, Human
ucaaaaaaaaaaaaaaaaaaaaa

SEQ ID NO: 532415 - RNA, 18 nt, Human
ucaccagugcacucuagc

SEQ ID NO: 532416 - RNA, 18 nt, Human
uccagggagaaaggggga

SEQ ID NO: 532417 - RNA, 23 nt, Human
uccagggagaaagggggagagaa

SEQ ID NO: 532418 - RNA, 23 nt, Human
ucgcuugaggccaggaguucgag

SEQ ID NO: 532419 - RNA, 21 nt, Human
ugaggaaacaaugucagcuuc

SEQ ID NO: 532420 - RNA, 22 nt, Human
ugaggaaacaaugucagcuucc

SEQ ID NO: 532421 - RNA, 21 nt, Human
ugaggccacaaagaaagcauu

SEQ ID NO: 532422 - RNA, 23 nt, Human
ugaggugggagaauugcuugggc

SEQ ID NO: 532423 - RNA, 24 nt, Human
ugaggugggagaauugcuugggcc

SEQ ID NO: 532424 - RNA, 21 nt, Human
uggcucacaccuguaauccca

SEQ ID NO: 532425 - RNA, 24 nt, Human
uggcucacaccuguaaucccagca

SEQ ID NO: 532426 - RNA, 24 nt, Human
uggcugagaaaacagaaccaggaa

SEQ ID NO: 532427 - RNA, 23 nt, Human
ugggaggucgaggugggaggauc

SEQ ID NO: 532428 - RNA, 21 nt, Human
ugggcaacagagaaagacccu

SEQ ID NO: 532429 - RNA, 18 nt, Human
uggugcacacuuguaguc

SEQ ID NO: 532430 - RNA, 24 nt, Human
ugguggugcacacuuguaguccca

SEQ ID NO: 532431 - RNA, 24 nt, Human
uguuccaauuguuuguguguuugc

SEQ ID NO: 532432 - RNA, 22 nt, Human
uugaggccaggaguucgagacc

SEQ ID NO: 532433 - RNA, 24 nt, Human
uugcuugggcccaggaauucaagg

SEQ ID NO: 532434 - RNA, 22 nt, Human
uuguuuguguguuugcaauccu

SEQ ID NO: 532435 - RNA, 22 nt, Human
uuuggaggcauauggagaaggg

SEQ ID NO: 532436 - RNA, 22 nt, Human
aaaaaaaaaaaaaaggcaagaa

SEQ ID NO: 532437 - RNA, 25 nt, Human
aaaaaaaaaaaaaaggcaagaaaag

SEQ ID NO: 532438 - RNA, 23 nt, Human
aaaaaaaaaaaggcaagaaaaga

SEQ ID NO: 532439 - RNA, 22 nt, Human
aaaaacagcacucgcuccccuc

SEQ ID NO: 532440 - RNA, 27 nt, Human
aaaaacauguauuuuuucuuuugccuc

SEQ ID NO: 532441 - RNA, 22 nt, Human
aaaaacggucccugcgucccga

SEQ ID NO: 532442 - RNA, 21 nt, Human
aaaagaaaaccaacucgguga

SEQ ID NO: 532443 - RNA, 23 nt, Human
aaaaggcaagacccccguccaca

SEQ ID NO: 532444 - RNA, 18 nt, Human
aaacagacacauacacaa

SEQ ID NO: 532445 - RNA, 19 nt, Human
aaacagaccaagauccccc

SEQ ID NO: 532446 - RNA, 21 nt, Human
aaacagaccaagaucccccau

SEQ ID NO: 532447 - RNA, 20 nt, Human
aaagaacagauagaaguuac

SEQ ID NO: 532448 - RNA, 23 nt, Human
aaagcaaagggugggguggguga

SEQ ID NO: 532449 - RNA, 20 nt, Human
aaaugaaagcaaaggguggg

SEQ ID NO: 532450 - RNA, 19 nt, Human
aacaagacacauaaaaagc

SEQ ID NO: 532451 - RNA, 23 nt, Human
aacacaccugaaaugaaagcaaa

SEQ ID NO: 532452 - RNA, 19 nt, Human
aaccaacucggugaucugc

SEQ ID NO: 532453 - RNA, 23 nt, Human
aaccuggacugacuggagaccug

SEQ ID NO: 532454 - RNA, 18 nt, Human
aagcagugggaggugggg

SEQ ID NO: 532455 - RNA, 20 nt, Human
aagcggggagcaagagagag

SEQ ID NO: 532456 - RNA, 19 nt, Human
aagggcagcaguuaaggga

SEQ ID NO: 532457 - RNA, 22 nt, Human
acaacaggcauuuuuacugaaa

SEQ ID NO: 532458 - RNA, 22 nt, Human
acacacgccccugugauuuaaa

SEQ ID NO: 532459 - RNA, 18 nt, Human
acaccugaaaugaaagca

SEQ ID NO: 532460 - RNA, 20 nt, Human
acaggaauugaaaaggcaag

SEQ ID NO: 532461 - RNA, 20 nt, Human
accuggacugacuggagacc

SEQ ID NO: 532462 - RNA, 27 nt, Human
acuaggaauuuuuucaauacaaucagu

SEQ ID NO: 532463 - RNA, 19 nt, Human
acucucugcagccaaaaca

SEQ ID NO: 532464 - RNA, 23 nt, Human
acugcagcugggcagacuggcgg

SEQ ID NO: 532465 - RNA, 22 nt, Human
agaaaagaaaaccaacucggug

SEQ ID NO: 532466 - RNA, 18 nt, Human
agccccuggccugcucag

SEQ ID NO: 532467 - RNA, 19 nt, Human
aggaagcagugggaggugg

SEQ ID NO: 532468 - RNA, 18 nt, Human
aggaaggcucugagucca

SEQ ID NO: 532469 - RNA, 25 nt, Human
aggcaagaaaagaaaagaaaaccaa

SEQ ID NO: 532470 - RNA, 26 nt, Human
aggcaagaaaagaaaagaagggaccc

SEQ ID NO: 532471 - RNA, 23 nt, Human
agggaccagcaaaaauaauaaac

SEQ ID NO: 532472 - RNA, 18 nt, Human
agggaugaggaccacugu

SEQ ID NO: 532473 - RNA, 18 nt, Human
agggcagcaguuaaggga

SEQ ID NO: 532474 - RNA, 19 nt, Human
auaaacagacacauacaca

SEQ ID NO: 532475 - RNA, 24 nt, Human
auacagcuauauacacacguccag

SEQ ID NO: 532476 - RNA, 24 nt, Human
caaaaaaaaaaaaaaggcaagaaa

SEQ ID NO: 532477 - RNA, 22 nt, Human
caaaaauaauaaaccaccccca

SEQ ID NO: 532478 - RNA, 26 nt, Human
caagaaaaacagaccaagauccccca

SEQ ID NO: 532479 - RNA, 22 nt, Human
caagaaaagaaaagaaaaccaa

SEQ ID NO: 532480 - RNA, 20 nt, Human
caagaccaggacaggugauu

SEQ ID NO: 532481 - RNA, 23 nt, Human
caagucaccuccccaacaagaca

SEQ ID NO: 532482 - RNA, 21 nt, Human
caaucaguuagaaauacacac

SEQ ID NO: 532483 - RNA, 21 nt, Human
cacacagcaagaccaggacag

SEQ ID NO: 532484 - RNA, 21 nt, Human
cacagcgcacccucguccucc

SEQ ID NO: 532485 - RNA, 22 nt, Human
cacagcugggagcagagaggcc

SEQ ID NO: 532486 - RNA, 24 nt, Human
caccaugcaagucaccuccccaac

SEQ ID NO: 532487 - RNA, 21 nt, Human
cacccucguccuccugcccug

SEQ ID NO: 532488 - RNA, 22 nt, Human
cacgacagccuuguccccacca

SEQ ID NO: 532489 - RNA, 18 nt, Human
cacgucugcucuccacua

SEQ ID NO: 532490 - RNA, 24 nt, Human
cagaacggaauuccgcggacugcu

SEQ ID NO: 532491 - RNA, 19 nt, Human
cagcaaaaauaauaaacca

SEQ ID NO: 532492 - RNA, 18 nt, Human
cagcacucgcuccccuca

SEQ ID NO: 532493 - RNA, 18 nt, Human
cagccccacggcuagcga

SEQ ID NO: 532494 - RNA, 19 nt, Human
cagccuggaagaccacgcc

SEQ ID NO: 532495 - RNA, 22 nt, Human
cagcgcacccucguccuccugc

SEQ ID NO: 532496 - RNA, 23 nt, Human
caggacagccccacggcuagcga

SEQ ID NO: 532497 - RNA, 21 nt, Human
caggcagacaacagagggagg

SEQ ID NO: 532498 - RNA, 22 nt, Human
cauccuggcugcaguucucugc

SEQ ID NO: 532499 - RNA, 21 nt, Human
caugaugggaaaaacacaguu

SEQ ID NO: 532500 - RNA, 22 nt, Human
caugcaagucaccuccccaaca

SEQ ID NO: 532501 - RNA, 24 nt, Human
caugcaagucaccuccccaacaag

SEQ ID NO: 532502 - RNA, 22 nt, Human
cauggaguagaauggggugacc

SEQ ID NO: 532503 - RNA, 23 nt, Human
cauggggcgugaguacugcagcu

SEQ ID NO: 532504 - RNA, 23 nt, Human
cauguuuguuuucuuaccccaaa

SEQ ID NO: 532505 - RNA, 25 nt, Human
ccaaaggccaacuuucucauacaac

SEQ ID NO: 532506 - RNA, 18 nt, Human
ccacaaggggaggcgagg

SEQ ID NO: 532507 - RNA, 22 nt, Human
ccacagcugggagcagagaggc

SEQ ID NO: 532508 - RNA, 20 nt, Human
ccacugccucuacuaggcug

SEQ ID NO: 532509 - RNA, 18 nt, Human
ccagccuggaagaccacg

SEQ ID NO: 532510 - RNA, 21 nt, Human
cccacccaccaagacccauug

SEQ ID NO: 532511 - RNA, 20 nt, Human
cccacuccaucucgggagca

SEQ ID NO: 532512 - RNA, 24 nt, Human
ccccaccaugcaagucaccucccc

SEQ ID NO: 532513 - RNA, 18 nt, Human
ccccagagccacaaugac

SEQ ID NO: 532514 - RNA, 21 nt, Human
cccugagccucaaaaaagaac

SEQ ID NO: 532515 - RNA, 19 nt, Human
ccucaaaaaagaacagaua

SEQ ID NO: 532516 - RNA, 22 nt, Human
ccuucccaggacagccccacgg

SEQ ID NO: 532517 - RNA, 22 nt, Human
cgaggaguuggaagaaguuauu

SEQ ID NO: 532518 - RNA, 21 nt, Human
cgcccacuccaucucgggagc

SEQ ID NO: 532519 - RNA, 22 nt, Human
cgccccugugauuuaaaaacgg

SEQ ID NO: 532520 - RNA, 25 nt, Human
cgccccugugauuuaaaaacggucc

SEQ ID NO: 532521 - RNA, 25 nt, Human
cgcugaggguccugacauuagcugu

SEQ ID NO: 532522 - RNA, 18 nt, Human
cuacaauaagaaauccua

SEQ ID NO: 532523 - RNA, 18 nt, Human
cucauacaacuggugccc

SEQ ID NO: 532524 - RNA, 18 nt, Human
cucccacccaccaagacc

SEQ ID NO: 532525 - RNA, 24 nt, Human
cucuccacuaggcucccacaagaa

SEQ ID NO: 532526 - RNA, 25 nt, Human
cucuccacugagcacucagcccccc

SEQ ID NO: 532527 - RNA, 20 nt, Human
cucuccuuuacucuccuccc

SEQ ID NO: 532528 - RNA, 25 nt, Human
cucuuggccacacgguacugcuuug

SEQ ID NO: 532529 - RNA, 24 nt, Human
cugaguccaccucuuggccacacu

SEQ ID NO: 532530 - RNA, 23 nt, Human
cugcagccaaaacagaacgaagc

SEQ ID NO: 532531 - RNA, 19 nt, Human
cugccucuacuaggcugcc

SEQ ID NO: 532532 - RNA, 20 nt, Human
cugccucuacuaggcugccu

SEQ ID NO: 532533 - RNA, 18 nt, Human
cuggcauccccagagcca

SEQ ID NO: 532534 - RNA, 21 nt, Human
cuuccuuucucagagggccuu

SEQ ID NO: 532535 - RNA, 19 nt, Human
gaaaaaaaaaaaaaagagg

SEQ ID NO: 532536 - RNA, 21 nt, Human
gaaugagaguauggaugaacc

SEQ ID NO: 532537 - RNA, 24 nt, Human
gaccuuuccuuuccugcacuucac

SEQ ID NO: 532538 - RNA, 21 nt, Human
gagaaggaagggccagccugg

SEQ ID NO: 532539 - RNA, 19 nt, Human
gaggaguuggaagaaguua

SEQ ID NO: 532540 - RNA, 19 nt, Human
gcacugccucuuaaaaacc

SEQ ID NO: 532541 - RNA, 23 nt, Human
gcagcuuccuuucucagagggcc

SEQ ID NO: 532542 - RNA, 23 nt, Human
gcucaaggaaggcucugagucca

SEQ ID NO: 532543 - RNA, 19 nt, Human
gcuccaccgcugagggucc

SEQ ID NO: 532544 - RNA, 24 nt, Human
ggaagggccagccuggaagaccac

SEQ ID NO: 532545 - RNA, 19 nt, Human
ggagagagagaugaagacu

SEQ ID NO: 532546 - RNA, 20 nt, Human
ggagguggggagggaugagg

SEQ ID NO: 532547 - RNA, 21 nt, Human
ggcaggcugacacacgccccu

SEQ ID NO: 532548 - RNA, 18 nt, Human
ggcagggaagguggcggu

SEQ ID NO: 532549 - RNA, 19 nt, Human
ggcggccgagugcggacac

SEQ ID NO: 532550 - RNA, 20 nt, Human
ggcugccggccucucccacu

SEQ ID NO: 532551 - RNA, 21 nt, Human
gggcacggcaggcggccgagu

SEQ ID NO: 532552 - RNA, 22 nt, Human
gggcaggcugacacacgccccu

SEQ ID NO: 532553 - RNA, 19 nt, Human
ggggcagggaagguggcgg

SEQ ID NO: 532554 - RNA, 22 nt, Human
ggggcuggggcagggaaggugg

SEQ ID NO: 532555 - RNA, 18 nt, Human
gggugggugaaacuggag

SEQ ID NO: 532556 - RNA, 22 nt, Human
gggugggugaaacuggagagag

SEQ ID NO: 532557 - RNA, 22 nt, Human
gguccccccagcaggcuccacc

SEQ ID NO: 532558 - RNA, 24 nt, Human
guggacacaacuccccgcucucca

SEQ ID NO: 532559 - RNA, 18 nt, Human
uaaacagacacauacaca

SEQ ID NO: 532560 - RNA, 20 nt, Human
uaaacagacacauacacaaa

SEQ ID NO: 532561 - RNA, 23 nt, Human
uaaacagacacauacacaaagua

SEQ ID NO: 532562 - RNA, 19 nt, Human
uaagaaauccuaaguccaa

SEQ ID NO: 532563 - RNA, 19 nt, Human
uaagcagcuuccuuucuca

SEQ ID NO: 532564 - RNA, 25 nt, Human
uaauaaaccacccccauaaacagac

SEQ ID NO: 532565 - RNA, 21 nt, Human
uacaaucaguuagaaauacac

SEQ ID NO: 532566 - RNA, 21 nt, Human
uaccccaaauguuccuugcuu

SEQ ID NO: 532567 - RNA, 22 nt, Human
uacuccuaaaaagugcugggaa

SEQ ID NO: 532568 - RNA, 24 nt, Human
uagcgacgucggcaagguggacac

SEQ ID NO: 532569 - RNA, 21 nt, Human
uauauacacacguccagaacu

SEQ ID NO: 532570 - RNA, 20 nt, Human
ucaaaaaaaaaaaaaaggca

SEQ ID NO: 532571 - RNA, 21 nt, Human
ucaaaaacagcacucgcuccc

SEQ ID NO: 532572 - RNA, 19 nt, Human
ucagccccuggccugcuca

SEQ ID NO: 532573 - RNA, 19 nt, Human
ucagccccuggccugcuca

SEQ ID NO: 532574 - RNA, 18 nt, Human
uccacugagcacucagcc

SEQ ID NO: 532575 - RNA, 19 nt, Human
uccacugagcacucagccc

SEQ ID NO: 532576 - RNA, 22 nt, Human
uccccaccaugcaagucaccuc

SEQ ID NO: 532577 - RNA, 21 nt, Human
uccccagagccacaaugaccu

SEQ ID NO: 532578 - RNA, 22 nt, Human
ucccugcgucccgagugaggau

SEQ ID NO: 532579 - RNA, 20 nt, Human
ucccuugccaugccucccuu

SEQ ID NO: 532580 - RNA, 22 nt, Human
ucccuugccaugccucccuucu

SEQ ID NO: 532581 - RNA, 23 nt, Human
uccgucaugaugggaaaaacaca

SEQ ID NO: 532582 - RNA, 24 nt, Human
ucggcaagguggacacaacucccc

SEQ ID NO: 532583 - RNA, 28 nt, Human
ucucaaaaacagcacucgcuccccucac

SEQ ID NO: 532584 - RNA, 23 nt, Human
ucucaaacucgaucccaagguuc

SEQ ID NO: 532585 - RNA, 21 nt, Human
ucucugcagccaaaacagaac

SEQ ID NO: 532586 - RNA, 21 nt, Human
ucugcagccaaaacagaacga

SEQ ID NO: 532587 - RNA, 24 nt, Human
ucugcagccaaaacagaacgaagc

SEQ ID NO: 532588 - RNA, 21 nt, Human
ugaaagcaaaggguggggugg

SEQ ID NO: 532589 - RNA, 22 nt, Human
ugaagcauuuguccugcaaccu

SEQ ID NO: 532590 - RNA, 23 nt, Human
ugacaaaaaguaguuuggaaaaa

SEQ ID NO: 532591 - RNA, 18 nt, Human
ugagcacucagccccccc

SEQ ID NO: 532592 - RNA, 24 nt, Human
ugagccuaccacagcugggagcag

SEQ ID NO: 532593 - RNA, 23 nt, Human
ugaggggacaugcugcgugccuu

SEQ ID NO: 532594 - RNA, 23 nt, Human
ugcaaaacagaagccucguuuga

SEQ ID NO: 532595 - RNA, 23 nt, Human
ugcaggaagcagugggagguggg

SEQ ID NO: 532596 - RNA, 23 nt, Human
ugccacgacagccuuguccccac

SEQ ID NO: 532597 - RNA, 22 nt, Human
ugccccaccucccacccaccaa

SEQ ID NO: 532598 - RNA, 23 nt, Human
ugcccuggcauccccagagccac

SEQ ID NO: 532599 - RNA, 20 nt, Human
ugccucuacuaggcugccug

SEQ ID NO: 532600 - RNA, 20 nt, Human
uggaagggcagcaguuaagg

SEQ ID NO: 532601 - RNA, 19 nt, Human
uggcucuaagcagcuuccu

SEQ ID NO: 532602 - RNA, 19 nt, Human
uggcugcuggggcuggggc

SEQ ID NO: 532603 - RNA, 19 nt, Human
ugggagcagagaggccaug

SEQ ID NO: 532604 - RNA, 19 nt, Human
ugggagguggggagggaug

SEQ ID NO: 532605 - RNA, 18 nt, Human
uggggagaagccagggau

SEQ ID NO: 532606 - RNA, 19 nt, Human
uggggcuggggcagggaag

SEQ ID NO: 532607 - RNA, 24 nt, Human
ugucacacaggcagacaacagagg

SEQ ID NO: 532608 - RNA, 19 nt, Human
uguccgggaacaacauggg

SEQ ID NO: 532609 - RNA, 25 nt, Human
ugugagccuaccacagcugggagca

SEQ ID NO: 532610 - RNA, 25 nt, Human
ugugugucacacaggcagacaacag

SEQ ID NO: 532611 - RNA, 23 nt, Human
uucaggguagcagauaagggaag

SEQ ID NO: 532612 - RNA, 25 nt, Human
uugccaugccucccuucugcccuug

SEQ ID NO: 532613 - RNA, 21 nt, Human
uuggaaaaaaaaaaaugcuag

SEQ ID NO: 532614 - RNA, 23 nt, Human
uuucaaaaaaaaaaaaaaggcaa

SEQ ID NO: 532615 - RNA, 18 nt, Human
uuuuuuuuuuuuuuuuug

SEQ ID NO: 532616 - RNA, 24 nt, Human
aaacaacggaaaguuaucuggaac

SEQ ID NO: 532617 - RNA, 18 nt, Human
aaacaggugaaaucuuca

SEQ ID NO: 532618 - RNA, 21 nt, Human
aaagucuucucuaauccaguu

SEQ ID NO: 532619 - RNA, 24 nt, Human
aaagugcugcgauuacaggcguga

SEQ ID NO: 532620 - RNA, 21 nt, Human
aaaucaucucccgaacucaga

SEQ ID NO: 532621 - RNA, 20 nt, Human
acaacggaaaguuaucugga

SEQ ID NO: 532622 - RNA, 23 nt, Human
acaggcgcccgccaccacgcccg

SEQ ID NO: 532623 - RNA, 21 nt, Human
acaguggcgcaaucucagcuc

SEQ ID NO: 532624 - RNA, 19 nt, Human
acccuguuagccaagaugg

SEQ ID NO: 532625 - RNA, 22 nt, Human
acggagucucgcuguugcccag

SEQ ID NO: 532626 - RNA, 18 nt, Human
acgggguuucacccuguu

SEQ ID NO: 532627 - RNA, 20 nt, Human
acgggguuucacccuguuag

SEQ ID NO: 532628 - RNA, 24 nt, Human
acuugccuguuuucauuucuggcc

SEQ ID NO: 532629 - RNA, 18 nt, Human
agccuccagaguagcugg

SEQ ID NO: 532630 - RNA, 21 nt, Human
aguacaguggcgcaaucucag

SEQ ID NO: 532631 - RNA, 20 nt, Human
aguagagacgggguuucacc

SEQ ID NO: 532632 - RNA, 18 nt, Human
aguagcugggacuacagg

SEQ ID NO: 532633 - RNA, 18 nt, Human
auucuccugccucagccu

SEQ ID NO: 532634 - RNA, 24 nt, Human
auugauucuccugccucagccucc

SEQ ID NO: 532635 - RNA, 24 nt, Human
caaagugcugcgauuacaggcgug

SEQ ID NO: 532636 - RNA, 22 nt, Human
caauugauucuccugccucagc

SEQ ID NO: 532637 - RNA, 18 nt, Human
cagcucacuguaagcucc

SEQ ID NO: 532638 - RNA, 20 nt, Human
cagcuucacuggagauuaau

SEQ ID NO: 532639 - RNA, 21 nt, Human
caggcgcccgccaccacgccc

SEQ ID NO: 532640 - RNA, 22 nt, Human
ccaaagugcugcgauuacaggc

SEQ ID NO: 532641 - RNA, 24 nt, Human
ccaaagugcugcgauuacaggcgu

SEQ ID NO: 532642 - RNA, 24 nt, Human
ccagaguagcugggacuacaggcg

SEQ ID NO: 532643 - RNA, 23 nt, Human
cccggguucaauugauucuccug

SEQ ID NO: 532644 - RNA, 24 nt, Human
ccgccucccggguucaauugauuc

SEQ ID NO: 532645 - RNA, 24 nt, Human
ccucccggguucaauugauucucc

SEQ ID NO: 532646 - RNA, 20 nt, Human
cgaugggucuggguagauac

SEQ ID NO: 532647 - RNA, 25 nt, Human
cgccucggccucccaaagugcugcg

SEQ ID NO: 532648 - RNA, 23 nt, Human
cgcguccggccaauaaaugguuu

SEQ ID NO: 532649 - RNA, 19 nt, Human
cgugagccaccgcguccgg

SEQ ID NO: 532650 - RNA, 23 nt, Human
cuaauccaguuuuacaaaaggaa

SEQ ID NO: 532651 - RNA, 24 nt, Human
cucacuguaagcuccgccucccgg

SEQ ID NO: 532652 - RNA, 24 nt, Human
cucagccuccagaguagcugggac

SEQ ID NO: 532653 - RNA, 24 nt, Human
cuccugacgucgugagccgcccgc

SEQ ID NO: 532654 - RNA, 23 nt, Human
cugccucagccuccagaguagcu

SEQ ID NO: 532655 - RNA, 18 nt, Human
cuguaaacacagcuucac

SEQ ID NO: 532656 - RNA, 20 nt, Human
gagacgggguuucacccugu

SEQ ID NO: 532657 - RNA, 20 nt, Human
gaguagcugggacuacaggc

SEQ ID NO: 532658 - RNA, 25 nt, Human
gaguagcugggacuacaggcgcccg

SEQ ID NO: 532659 - RNA, 18 nt, Human
gauuacaggcgugagcca

SEQ ID NO: 532660 - RNA, 22 nt, Human
gauuacaggcgugagccaccgc

SEQ ID NO: 532661 - RNA, 23 nt, Human
gcccggcuaauuuuuuguauuuu

SEQ ID NO: 532662 - RNA, 18 nt, Human
gccucccggguucaauug

SEQ ID NO: 532663 - RNA, 24 nt, Human
gugagccgcccgccucggccuccc

SEQ ID NO: 532664 - RNA, 27 nt, Human
guuucuuuuuuuuuuuuuuuuuuuuga

SEQ ID NO: 532665 - RNA, 24 nt, Human
uaauuuuuuguauuuuuaguagag

SEQ ID NO: 532666 - RNA, 25 nt, Human
uaauuuuuuguauuuuuaguagaga

SEQ ID NO: 532667 - RNA, 23 nt, Human
uacaggcgcccgccaccacgccc

SEQ ID NO: 532668 - RNA, 23 nt, Human
uacaggcgugagccaccgcgucc

SEQ ID NO: 532669 - RNA, 23 nt, Human
uacaguggcgcaaucucagcuca

SEQ ID NO: 532670 - RNA, 21 nt, Human
uagauacccuaaguaaacagg

SEQ ID NO: 532671 - RNA, 24 nt, Human
uaguagagacgggguuucacccug

SEQ ID NO: 532672 - RNA, 26 nt, Human
uaguagagacgggguuucacccuguu

SEQ ID NO: 532673 - RNA, 25 nt, Human
ucaauugauucuccugccucagccu

SEQ ID NO: 532674 - RNA, 18 nt, Human
ucacuguaagcuccgccu

SEQ ID NO: 532675 - RNA, 19 nt, Human
ucacuguaagcuccgccuc

SEQ ID NO: 532676 - RNA, 24 nt, Human
ucacuguaagcuccgccucccggg

SEQ ID NO: 532677 - RNA, 19 nt, Human
ucagcaaguccgagauggg

SEQ ID NO: 532678 - RNA, 24 nt, Human
uccagaguagcugggacuacaggc

SEQ ID NO: 532679 - RNA, 24 nt, Human
ucccaaagugcugcgauuacaggc

SEQ ID NO: 532680 - RNA, 24 nt, Human
ucccggguucaauugauucuccug

SEQ ID NO: 532681 - RNA, 23 nt, Human
uccgaagaaauacuuuacuugcc

SEQ ID NO: 532682 - RNA, 18 nt, Human
ucggccucccaaagugcu

SEQ ID NO: 532683 - RNA, 24 nt, Human
ucuccugccucagccuccagagua

SEQ ID NO: 532684 - RNA, 18 nt, Human
ucucgcuguugcccagga

SEQ ID NO: 532685 - RNA, 23 nt, Human
ucuugcucccuucucucucgaaa

SEQ ID NO: 532686 - RNA, 21 nt, Human
ugaguugaggcauagcaaucu

SEQ ID NO: 532687 - RNA, 22 nt, Human
ugauaagaaucacuuggaaaaa

SEQ ID NO: 532688 - RNA, 18 nt, Human
ugcccaggaguacagugg

SEQ ID NO: 532689 - RNA, 24 nt, Human
ugccucagccuccagaguagcugg

SEQ ID NO: 532690 - RNA, 19 nt, Human
ugcgauuacaggcgugagc

SEQ ID NO: 532691 - RNA, 22 nt, Human
ugcgauuacaggcgugagccac

SEQ ID NO: 532692 - RNA, 24 nt, Human
ugcgauuacaggcgugagccaccg

SEQ ID NO: 532693 - RNA, 20 nt, Human
uggcgcaaucucagcucacu

SEQ ID NO: 532694 - RNA, 21 nt, Human
ugggacuacaggcgcccgcca

SEQ ID NO: 532695 - RNA, 22 nt, Human
ugggacuacaggcgcccgccac

SEQ ID NO: 532696 - RNA, 24 nt, Human
ugggacuacaggcgcccgccacca

SEQ ID NO: 532697 - RNA, 18 nt, Human
ugggucuggguagauacc

SEQ ID NO: 532698 - RNA, 23 nt, Human
ugguuucuuuuuuuuuuuuuuuu

SEQ ID NO: 532699 - RNA, 26 nt, Human
ugguuugauaaaauguuuuccgaaga

SEQ ID NO: 532700 - RNA, 21 nt, Human
uguauuuuuaguagagacggg

SEQ ID NO: 532701 - RNA, 22 nt, Human
ugucuugcucccuucucucucg

SEQ ID NO: 532702 - RNA, 18 nt, Human
uuaguagagacgggguuu

SEQ ID NO: 532703 - RNA, 22 nt, Human
uuaguagagacgggguuucacc

SEQ ID NO: 532704 - RNA, 24 nt, Human
uuaguagagacgggguuucacccu

SEQ ID NO: 532705 - RNA, 25 nt, Human
uuaguagagacgggguuucacccug

SEQ ID NO: 532706 - RNA, 22 nt, Human
uucaaaaucaucucccgaacuc

SEQ ID NO: 532707 - RNA, 18 nt, Human
uucaauugauucuccugc

SEQ ID NO: 532708 - RNA, 23 nt, Human
uucaauugauucuccugccucag

SEQ ID NO: 532709 - RNA, 23 nt, Human
uuguauuuuuaguagagacgggg

SEQ ID NO: 532710 - RNA, 24 nt, Human
uuuuuaguagagacgggguuucac

SEQ ID NO: 532711 - RNA, 21 nt, Human
uuuuuguauuuuuaguagaga

SEQ ID NO: 532712 - RNA, 24 nt, Human
uuuuuuguauuuuuaguagagacg

SEQ ID NO: 532713 - RNA, 21 nt, Human
uuuuuuuuuuuggaagggagc

SEQ ID NO: 532714 - RNA, 25 nt, Human
uuuuuuuuuuuugagacggagucuc

SEQ ID NO: 532715 - RNA, 22 nt, Human
uuuuuuuuuuuuggaagggagc

SEQ ID NO: 532716 - RNA, 22 nt, Human
uuuuuuuuuuuuuugagacgga

SEQ ID NO: 532717 - RNA, 21 nt, Human
uuuuuuuuuuuuuuggaaggg

SEQ ID NO: 532718 - RNA, 18 nt, Human
uuuuuuuuuuuuuuuuug

SEQ ID NO: 532719 - RNA, 18 nt, Human
uuuuuuuuuuuuuuuuug

SEQ ID NO: 532720 - RNA, 24 nt, Human
uuuuuuuuuuuuuuuuuggaaggg

SEQ ID NO: 532721 - RNA, 21 nt, Human
aacaacaaaaaacacugcuau

SEQ ID NO: 532722 - RNA, 22 nt, Human
aaccuagccuuuccuggcaaac

SEQ ID NO: 532723 - RNA, 19 nt, Human
aaguccugcaguuucaaau

SEQ ID NO: 532724 - RNA, 22 nt, Human
aaugcaaaaacaacaaaaaaca

SEQ ID NO: 532725 - RNA, 22 nt, Human
aauuaaccacuccccaaaucca

SEQ ID NO: 532726 - RNA, 23 nt, Human
acacuaaucauuuucucuuugca

SEQ ID NO: 532727 - RNA, 19 nt, Human
acauaguuucaaacaaaua

SEQ ID NO: 532728 - RNA, 22 nt, Human
acuggcuuuuguuccugaaguu

SEQ ID NO: 532729 - RNA, 23 nt, Human
cccaaauccaaugcaaaaacaac

SEQ ID NO: 532730 - RNA, 21 nt, Human
cccccggccguaaugggcccu

SEQ ID NO: 532731 - RNA, 24 nt, Human
cuaaaagauuccugucuuccauuu

SEQ ID NO: 532732 - RNA, 22 nt, Human
cugcaguuucaaauuccuuuug

SEQ ID NO: 532733 - RNA, 20 nt, Human
cuggcuuuuguuccugaagu

SEQ ID NO: 532734 - RNA, 19 nt, Human
gcaaaaacaacaaaaaaca

SEQ ID NO: 532735 - RNA, 23 nt, Human
ggagaaaagcuucuuaaguccug

SEQ ID NO: 532736 - RNA, 26 nt, Human
uaaaacagaacuggcuuuuguuccug

SEQ ID NO: 532737 - RNA, 20 nt, Human
uaaccacuccccaaauccaa

SEQ ID NO: 532738 - RNA, 22 nt, Human
uacaaauucggagaaaagcuuc

SEQ ID NO: 532739 - RNA, 24 nt, Human
uacacuaaucauuuucucuuugca

SEQ ID NO: 532740 - RNA, 24 nt, Human
uacugaaccuagccuuuccuggca

SEQ ID NO: 532741 - RNA, 21 nt, Human
uacuuuggagguuuucugaag

SEQ ID NO: 532742 - RNA, 24 nt, Human
uccccaaauccaaugcaaaaacaa

SEQ ID NO: 532743 - RNA, 20 nt, Human
ucugaagaaucaaguacuca

SEQ ID NO: 532744 - RNA, 22 nt, Human
ugccagaaaccuuuuguguucu

SEQ ID NO: 532745 - RNA, 22 nt, Human
ugggcccccggccguaaugggc

SEQ ID NO: 532746 - RNA, 20 nt, Human
uuaaccacuccccaaaucca

SEQ ID NO: 532747 - RNA, 27 nt, Human
uuggagguuuucugaagaaucaaguac

SEQ ID NO: 532748 - RNA, 20 nt, Human
aaacaugagauauaccauga

SEQ ID NO: 532749 - RNA, 21 nt, Human
aaagaaaauaaacugauaaac

SEQ ID NO: 532750 - RNA, 26 nt, Human
aaauauuaaaggccaauucgagucac

SEQ ID NO: 532751 - RNA, 22 nt, Human
aaaugcuucccagaccaacagg

SEQ ID NO: 532752 - RNA, 22 nt, Human
aacauuuucucaauacauagaa

SEQ ID NO: 532753 - RNA, 20 nt, Human
aagaucaauaaguaaacacu

SEQ ID NO: 532754 - RNA, 21 nt, Human
aaguccuggaaauccucagcu

SEQ ID NO: 532755 - RNA, 21 nt, Human
aauauacucauucagccaaaa

SEQ ID NO: 532756 - RNA, 21 nt, Human
acaguaacagagagaaaauaa

SEQ ID NO: 532757 - RNA, 21 nt, Human
accagaacuccuuguccaaaa

SEQ ID NO: 532758 - RNA, 18 nt, Human
agaaagaaaauaaacuga

SEQ ID NO: 532759 - RNA, 22 nt, Human
agaaagaaaauaaacugauaaa

SEQ ID NO: 532760 - RNA, 20 nt, Human
agacaucugucuuaaaaaug

SEQ ID NO: 532761 - RNA, 19 nt, Human
agcaaagcccuucagcaca

SEQ ID NO: 532762 - RNA, 25 nt, Human
aggcagcaguaugaaaauguaggaa

SEQ ID NO: 532763 - RNA, 24 nt, Human
auacucauucagccaaaagaacaa

SEQ ID NO: 532764 - RNA, 23 nt, Human
aucguuuuauguaacaucuguuu

SEQ ID NO: 532765 - RNA, 23 nt, Human
augaaucugguuuuccaaaauug

SEQ ID NO: 532766 - RNA, 18 nt, Human
augcuucccagaccaaca

SEQ ID NO: 532767 - RNA, 19 nt, Human
auggaacucuggaaaaaaa

SEQ ID NO: 532768 - RNA, 21 nt, Human
auggaacucuggaaaaaaaac

SEQ ID NO: 532769 - RNA, 23 nt, Human
auuuuaguuuuggacuguucacc

SEQ ID NO: 532770 - RNA, 21 nt, Human
auuuuuggcauauaauuauuu

SEQ ID NO: 532771 - RNA, 23 nt, Human
caaacuuuauuaguuagcuaaag

SEQ ID NO: 532772 - RNA, 25 nt, Human
caaagcagacuaaguaauauguuaa

SEQ ID NO: 532773 - RNA, 19 nt, Human
caaccaaauagccaagcug

SEQ ID NO: 532774 - RNA, 23 nt, Human
caccagaacuccuuguccaaaau

SEQ ID NO: 532775 - RNA, 24 nt, Human
cagaacuccuuguccaaaauauca

SEQ ID NO: 532776 - RNA, 24 nt, Human
cagcacagugcaaacauguucuuu

SEQ ID NO: 532777 - RNA, 25 nt, Human
cagccaccuuuccaaauaaaaucuu

SEQ ID NO: 532778 - RNA, 22 nt, Human
ccaagccaaaugauauugcccu

SEQ ID NO: 532779 - RNA, 18 nt, Human
ccagcaaaaaguacaggc

SEQ ID NO: 532780 - RNA, 18 nt, Human
ccuggaaauccucagcuc

SEQ ID NO: 532781 - RNA, 19 nt, Human
cuccuuguccaaaauauca

SEQ ID NO: 532782 - RNA, 24 nt, Human
cuccuuguccaaaauaucacuauu

SEQ ID NO: 532783 - RNA, 23 nt, Human
cucucuccagccaccuuuccaaa

SEQ ID NO: 532784 - RNA, 23 nt, Human
cucuugggcuuucuauauaaaca

SEQ ID NO: 532785 - RNA, 24 nt, Human
cuggaaauccucagcucucuccag

SEQ ID NO: 532786 - RNA, 22 nt, Human
gaaaaggagccuuaguguccug

SEQ ID NO: 532787 - RNA, 22 nt, Human
gcaaaguccuauaauaaaauua

SEQ ID NO: 532788 - RNA, 27 nt, Human
ggagcucucccuauccaugaaaugcuu

SEQ ID NO: 532789 - RNA, 22 nt, Human
gucaggccaaaggucuaguuag

SEQ ID NO: 532790 - RNA, 23 nt, Human
uaaacugauaaaccaagaaagca

SEQ ID NO: 532791 - RNA, 19 nt, Human
uaaacuguacaaacacuca

SEQ ID NO: 532792 - RNA, 22 nt, Human
uaaguaaacacugaucacccca

SEQ ID NO: 532793 - RNA, 24 nt, Human
uacaguaacagagagaaaauaaaa

SEQ ID NO: 532794 - RNA, 25 nt, Human
uagaaagaaaauaaacugauaaacc

SEQ ID NO: 532795 - RNA, 24 nt, Human
uagcauagaauucuucugaagaaa

SEQ ID NO: 532796 - RNA, 24 nt, Human
uagcuaaagaacaugaauagacau

SEQ ID NO: 532797 - RNA, 23 nt, Human
uaggaaagaacucaggcauggca

SEQ ID NO: 532798 - RNA, 19 nt, Human
ucaacagaggugagaaagu

SEQ ID NO: 532799 - RNA, 20 nt, Human
ucaacagaggugagaaagua

SEQ ID NO: 532800 - RNA, 22 nt, Human
ucaacagaggugagaaaguaaa

SEQ ID NO: 532801 - RNA, 24 nt, Human
ucaaccaauucaaauauacucauu

SEQ ID NO: 532802 - RNA, 22 nt, Human
uccagccaccuuuccaaauaaa

SEQ ID NO: 532803 - RNA, 19 nt, Human
uccaugaaaugcuucccag

SEQ ID NO: 532804 - RNA, 24 nt, Human
ucuaaauguuucaacagaggugag

SEQ ID NO: 532805 - RNA, 22 nt, Human
ugaaaaauacaucaaacaugaa

SEQ ID NO: 532806 - RNA, 23 nt, Human
ugaaaaauacaucaaacaugaga

SEQ ID NO: 532807 - RNA, 22 nt, Human
ugaaaugcuucccagaccaaca

SEQ ID NO: 532808 - RNA, 21 nt, Human
ugaacaauguaaacagaauca

SEQ ID NO: 532809 - RNA, 18 nt, Human
ugagacugguaaaaggcu

SEQ ID NO: 532810 - RNA, 19 nt, Human
ugaggaggugcaaacccac

SEQ ID NO: 532811 - RNA, 22 nt, Human
ugaguuaaacuguacaaacacu

SEQ ID NO: 532812 - RNA, 27 nt, Human
ugauuuaauggaacucuggaaaaaaaa

SEQ ID NO: 532813 - RNA, 22 nt, Human
uggaagaggucaugauuauugg

SEQ ID NO: 532814 - RNA, 23 nt, Human
ugggaaguuauuuugauauuguu

SEQ ID NO: 532815 - RNA, 19 nt, Human
uggguucccaaauccaguu

SEQ ID NO: 532816 - RNA, 26 nt, Human
uguaugcauagcaaagcccuucagca

SEQ ID NO: 532817 - RNA, 22 nt, Human
uguccaaaauaucacuauuaau

SEQ ID NO: 532818 - RNA, 19 nt, Human
uguguccaaaguuagucca

SEQ ID NO: 532819 - RNA, 18 nt, Human
uguuagggugggauagga

SEQ ID NO: 532820 - RNA, 19 nt, Human
uuaaaggccaauuaucaaa

SEQ ID NO: 532821 - RNA, 20 nt, Human
uuaaaggccaauuaucaaaa

SEQ ID NO: 532822 - RNA, 18 nt, Human
uuagcuaaagggcaaaga

SEQ ID NO: 532823 - RNA, 19 nt, Human
uuagguauagcuugucacc

SEQ ID NO: 532824 - RNA, 21 nt, Human
uucuaaauguuucaacagagg

SEQ ID NO: 532825 - RNA, 22 nt, Human
uuggccuuauguucucccagaa

SEQ ID NO: 532826 - RNA, 25 nt, Human
uuuagaaagaaaauaaacugauaaa

SEQ ID NO: 532827 - RNA, 24 nt, Human
aaacacugcaaguuacauguuacc

SEQ ID NO: 532828 - RNA, 23 nt, Human
aaaguaugaccgagaacaacugg

SEQ ID NO: 532829 - RNA, 19 nt, Human
aauauucucgggaguggua

SEQ ID NO: 532830 - RNA, 22 nt, Human
aaucacuuaacuuggaaacaaa

SEQ ID NO: 532831 - RNA, 22 nt, Human
aaugcuuuucccccauuucuac

SEQ ID NO: 532832 - RNA, 21 nt, Human
acagcaaugguguggcaugcc

SEQ ID NO: 532833 - RNA, 20 nt, Human
acauuuaggcuccuccuaga

SEQ ID NO: 532834 - RNA, 20 nt, Human
accaucuuguaugugaggga

SEQ ID NO: 532835 - RNA, 19 nt, Human
acuggaugcaggaacauca

SEQ ID NO: 532836 - RNA, 19 nt, Human
agagguuugggaggcacug

SEQ ID NO: 532837 - RNA, 23 nt, Human
agcacaaaauacagaugggaaua

SEQ ID NO: 532838 - RNA, 21 nt, Human
agcgcgaggggcggagaggaa

SEQ ID NO: 532839 - RNA, 18 nt, Human
aggaagcacaacauuuga

SEQ ID NO: 532840 - RNA, 20 nt, Human
aggagcagcuccuuaggcug

SEQ ID NO: 532841 - RNA, 22 nt, Human
aggcgcuggaguuaagcgaccu

SEQ ID NO: 532842 - RNA, 22 nt, Human
agggugagggaggugguggagc

SEQ ID NO: 532843 - RNA, 18 nt, Human
aggugguggagcugaggc

SEQ ID NO: 532844 - RNA, 21 nt, Human
aguggcuggagcgcgaggggc

SEQ ID NO: 532845 - RNA, 23 nt, Human
caaaacaccaaaguuagucagug

SEQ ID NO: 532846 - RNA, 21 nt, Human
caagagacggcuccaaggccg

SEQ ID NO: 532847 - RNA, 25 nt, Human
cacaaaauacagaugggaauauucu

SEQ ID NO: 532848 - RNA, 22 nt, Human
cacaauaccuuaagcuacuuaa

SEQ ID NO: 532849 - RNA, 23 nt, Human
cacaauaccuuaagcuacuuaaa

SEQ ID NO: 532850 - RNA, 23 nt, Human
cagcuccuuaggcuguggccccc

SEQ ID NO: 532851 - RNA, 19 nt, Human
cccaagagacggcuccaag

SEQ ID NO: 532852 - RNA, 22 nt, Human
cccccggaaucuggauaccgcc

SEQ ID NO: 532853 - RNA, 18 nt, Human
cccgcgccgucgccgccg

SEQ ID NO: 532854 - RNA, 22 nt, Human
cccgcgccgucgccgccguccg

SEQ ID NO: 532855 - RNA, 20 nt, Human
cccuacaacuccugucacuu

SEQ ID NO: 532856 - RNA, 20 nt, Human
ccgcgccgucgccgccgucc

SEQ ID NO: 532857 - RNA, 22 nt, Human
ccuacaacuccugucacuuuaa

SEQ ID NO: 532858 - RNA, 23 nt, Human
ccucggccagcuacgugaggugg

SEQ ID NO: 532859 - RNA, 22 nt, Human
ccugcgcugguuuaucuaaaag

SEQ ID NO: 532860 - RNA, 22 nt, Human
ccuuaagcuacuuaaaagaguu

SEQ ID NO: 532861 - RNA, 20 nt, Human
cgcagcugggggcgagggag

SEQ ID NO: 532862 - RNA, 21 nt, Human
cgcagcugggggcgagggagu

SEQ ID NO: 532863 - RNA, 18 nt, Human
cgccgucgccgccguccg

SEQ ID NO: 532864 - RNA, 19 nt, Human
cgcgcagcugggggcgagg

SEQ ID NO: 532865 - RNA, 20 nt, Human
cggcugcggccgaguggcuu

SEQ ID NO: 532866 - RNA, 20 nt, Human
cgggcaggaggaggagaggu

SEQ ID NO: 532867 - RNA, 21 nt, Human
cgggcuuuugaggagcagcuc

SEQ ID NO: 532868 - RNA, 22 nt, Human
cuacuaggcuaggccauugcac

SEQ ID NO: 532869 - RNA, 18 nt, Human
cuaugccaaggagcgaga

SEQ ID NO: 532870 - RNA, 22 nt, Human
cuccaaggccgcgcgcuucccc

SEQ ID NO: 532871 - RNA, 19 nt, Human
cuccagugcugcgcccucc

SEQ ID NO: 532872 - RNA, 18 nt, Human
cugaagacuauggaagcu

SEQ ID NO: 532873 - RNA, 22 nt, Human
cugaggcugccgcuaggaaccc

SEQ ID NO: 532874 - RNA, 21 nt, Human
cugcggccgaguggcuggagc

SEQ ID NO: 532875 - RNA, 21 nt, Human
cuggcccgcaggccgccgcgc

SEQ ID NO: 532876 - RNA, 22 nt, Human
cuggcgcggcggcuccgggggg

SEQ ID NO: 532877 - RNA, 18 nt, Human
cuguggccccccucccca

SEQ ID NO: 532878 - RNA, 26 nt, Human
cuguggccccccuccccacucggcga

SEQ ID NO: 532879 - RNA, 22 nt, Human
cuuucaaaauaaccagggcuag

SEQ ID NO: 532880 - RNA, 20 nt, Human
gagcagcuccuuaggcugug

SEQ ID NO: 532881 - RNA, 23 nt, Human
gccgaguggcuggagcgcgaggg

SEQ ID NO: 532882 - RNA, 18 nt, Human
gccgccguccgcccgggc

SEQ ID NO: 532883 - RNA, 21 nt, Human
gcgcggggagggugagggagg

SEQ ID NO: 532884 - RNA, 18 nt, Human
gcggauccggcgccagcc

SEQ ID NO: 532885 - RNA, 19 nt, Human
gcggccgaguggcuggagc

SEQ ID NO: 532886 - RNA, 20 nt, Human
gcuccggggggcggaggaca

SEQ ID NO: 532887 - RNA, 21 nt, Human
gcuccuccuagaacagccccg

SEQ ID NO: 532888 - RNA, 20 nt, Human
gcuuccccaucccccgcucc

SEQ ID NO: 532889 - RNA, 20 nt, Human
ggagcgagacccccggaauc

SEQ ID NO: 532890 - RNA, 21 nt, Human
ggaggcacugggaaggcgcug

SEQ ID NO: 532891 - RNA, 21 nt, Human
ggcuccggggggcggaggaca

SEQ ID NO: 532892 - RNA, 21 nt, Human
gggagggugagggagguggug

SEQ ID NO: 532893 - RNA, 22 nt, Human
ggggagggugagggagguggug

SEQ ID NO: 532894 - RNA, 19 nt, Human
gggggcggaggacagcgcc

SEQ ID NO: 532895 - RNA, 23 nt, Human
ggucuggcgcggcggcuccgggg

SEQ ID NO: 532896 - RNA, 20 nt, Human
ggugagggaggugguggagc

SEQ ID NO: 532897 - RNA, 25 nt, Human
uaccauauuacacaugggaggaccc

SEQ ID NO: 532898 - RNA, 20 nt, Human
uagaacagccccgggcagga

SEQ ID NO: 532899 - RNA, 18 nt, Human
uauuuguccuucuaguuu

SEQ ID NO: 532900 - RNA, 26 nt, Human
ugaacaaaaaaaaggaggaaucacuu

SEQ ID NO: 532901 - RNA, 19 nt, Human
ugaccgagaacaacuggau

SEQ ID NO: 532902 - RNA, 20 nt, Human
ugagggaggugguggagcug

SEQ ID NO: 532903 - RNA, 20 nt, Human
ugccaaggagcgagaccccc

SEQ ID NO: 532904 - RNA, 21 nt, Human
uggaauggucaagagcaggaa

SEQ ID NO: 532905 - RNA, 18 nt, Human
uggcuggagcgcgagggg

SEQ ID NO: 532906 - RNA, 20 nt, Human
ugggaggcacugggaaggcg

SEQ ID NO: 532907 - RNA, 18 nt, Human
ugguggagcugaggcugc

SEQ ID NO: 532908 - RNA, 21 nt, Human
ugucacuuuaacaauggucca

SEQ ID NO: 532909 - RNA, 18 nt, Human
ugucugaagacuauggaa

SEQ ID NO: 532910 - RNA, 20 nt, Human
uguuuacgcaccacaauccc

SEQ ID NO: 532911 - RNA, 23 nt, Human
uuaacaaugguccacagcaaugc

SEQ ID NO: 532912 - RNA, 18 nt, Human
uuaauccuguuuacgcac

SEQ ID NO: 532913 - RNA, 23 nt, Human
uucccccauuucuacuaggcuag

SEQ ID NO: 532914 - RNA, 21 nt, Human
uugggaggcacugggaaggcg

SEQ ID NO: 532915 - RNA, 19 nt, Human
uuguccaguagcaucagaa

SEQ ID NO: 532916 - RNA, 27 nt, Human
aaacauaaaaaggagccugugcccuag

SEQ ID NO: 532917 - RNA, 19 nt, Human
aaaguccuuuugucacugg

SEQ ID NO: 532918 - RNA, 21 nt, Human
aagcccagaggucacuggcca

SEQ ID NO: 532919 - RNA, 18 nt, Human
aggcaggcugggcaggac

SEQ ID NO: 532920 - RNA, 22 nt, Human
aggcaggcugggcaggacuggc

SEQ ID NO: 532921 - RNA, 19 nt, Human
aggcuggaauggcaagccc

SEQ ID NO: 532922 - RNA, 23 nt, Human
caagcccagaggucacuggccag

SEQ ID NO: 532923 - RNA, 21 nt, Human
cacccauggcccugauugucc

SEQ ID NO: 532924 - RNA, 22 nt, Human
cagcccgggccacccauggccc

SEQ ID NO: 532925 - RNA, 19 nt, Human
ccaguagcugcccauggag

SEQ ID NO: 532926 - RNA, 20 nt, Human
ccauggcccugauuguccau

SEQ ID NO: 532927 - RNA, 28 nt, Human
ccuagccccagcccgggccacccauggc

SEQ ID NO: 532928 - RNA, 24 nt, Human
ccuccaaacauaaaaaggagccug

SEQ ID NO: 532929 - RNA, 25 nt, Human
ccugugcccuagccccagcccgggc

SEQ ID NO: 532930 - RNA, 23 nt, Human
gcaagcccagaggucacuggcca

SEQ ID NO: 532931 - RNA, 18 nt, Human
gccccagcccgggccacc

SEQ ID NO: 532932 - RNA, 21 nt, Human
gcccgggccacccauggcccu

SEQ ID NO: 532933 - RNA, 19 nt, Human
gccugugcccuagccccag

SEQ ID NO: 532934 - RNA, 27 nt, Human
uaaaaaggagccugugcccuagcccca

SEQ ID NO: 532935 - RNA, 19 nt, Human
ugaggauuugccagcugga

SEQ ID NO: 532936 - RNA, 19 nt, Human
ugaggauuugccagcugga

SEQ ID NO: 532937 - RNA, 25 nt, Human
uggcagccagaggccuacacucuga

SEQ ID NO: 532938 - RNA, 25 nt, Human
ugugucuccagucugcuucauccgg

SEQ ID NO: 532939 - RNA, 20 nt, Human
uuuggagauuucccuuuuau

SEQ ID NO: 532940 - RNA, 18 nt, Human
uuuuuuuuuuuuuuuuug

SEQ ID NO: 532941 - RNA, 24 nt, Human
uuuuuuuuuuuuuuuuuggagauu

SEQ ID NO: 532942 - RNA, 27 nt, Human
aaaaauaaugauuaaaaaugcuaaaac

SEQ ID NO: 532943 - RNA, 22 nt, Human
aaccaaagaguaaaacaaaucc

SEQ ID NO: 532944 - RNA, 18 nt, Human
acauaaccucuauaagga

SEQ ID NO: 532945 - RNA, 19 nt, Human
acaugaaaagauucaacaa

SEQ ID NO: 532946 - RNA, 19 nt, Human
acuucaggaauuuaacaaa

SEQ ID NO: 532947 - RNA, 21 nt, Human
agcauuuuaaacagagguaau

SEQ ID NO: 532948 - RNA, 24 nt, Human
caacagaaaauuuaguuucucaau

SEQ ID NO: 532949 - RNA, 26 nt, Human
caagucaaauugccgauuguaaagua

SEQ ID NO: 532950 - RNA, 22 nt, Human
cacaaaaaaauuaaaucaacag

SEQ ID NO: 532951 - RNA, 18 nt, Human
cacuauguaacaacaugu

SEQ ID NO: 532952 - RNA, 19 nt, Human
cagaaguaauacagcauca

SEQ ID NO: 532953 - RNA, 24 nt, Human
cccuccagacaugcagcagagcaa

SEQ ID NO: 532954 - RNA, 21 nt, Human
cuuuauauauauauauauauu

SEQ ID NO: 532955 - RNA, 30 nt, Human
cuuuugaaucuuuauauauauauauauauu

SEQ ID NO: 532956 - RNA, 26 nt, Human
gaccagcugggucauguuuccuuuuc

SEQ ID NO: 532957 - RNA, 20 nt, Human
gagcaagucaaauugccgau

SEQ ID NO: 532958 - RNA, 22 nt, Human
gguugcuccggcggcuuugagg

SEQ ID NO: 532959 - RNA, 18 nt, Human
uaaaguaaagaccugggg

SEQ ID NO: 532960 - RNA, 20 nt, Human
uaacaaaguuuuaaggcaca

SEQ ID NO: 532961 - RNA, 23 nt, Human
uaacacuauguaacaacauguuu

SEQ ID NO: 532962 - RNA, 18 nt, Human
uaaccaaagaguaaaaca

SEQ ID NO: 532963 - RNA, 19 nt, Human
uaaccaaagaguaaaacaa

SEQ ID NO: 532964 - RNA, 19 nt, Human
uaaccaaagaguaaaacaa

SEQ ID NO: 532965 - RNA, 21 nt, Human
uaaccaaagaguaaaacaaau

SEQ ID NO: 532966 - RNA, 20 nt, Human
uaaggcacaaaaaaauuaaa

SEQ ID NO: 532967 - RNA, 20 nt, Human
uaaggcacaaaaaaauuaaa

SEQ ID NO: 532968 - RNA, 21 nt, Human
uaauacagcaucacaaaaacc

SEQ ID NO: 532969 - RNA, 19 nt, Human
uacaauaauaauuaacaga

SEQ ID NO: 532970 - RNA, 22 nt, Human
uacaauaauaauuaacagagca

SEQ ID NO: 532971 - RNA, 22 nt, Human
uauugucuaaaacccagaagua

SEQ ID NO: 532972 - RNA, 23 nt, Human
ucacugauuuuacucucaauuau

SEQ ID NO: 532973 - RNA, 24 nt, Human
uccacacuuuccuuggucccucca

SEQ ID NO: 532974 - RNA, 19 nt, Human
uccagacaugcagcagagc

SEQ ID NO: 532975 - RNA, 23 nt, Human
ucuaaaacccagaaguaauacag

SEQ ID NO: 532976 - RNA, 21 nt, Human
ucucagaagcauccaagccag

SEQ ID NO: 532977 - RNA, 20 nt, Human
uguaaaguaaagaccugggg

SEQ ID NO: 532978 - RNA, 18 nt, Human
ugucuaaaacccagaagu

SEQ ID NO: 532979 - RNA, 18 nt, Human
uucaaaauccucaguccc

SEQ ID NO: 532980 - RNA, 26 nt, Human
uuccuugaauucauuaaauggaauuu

SEQ ID NO: 532981 - RNA, 22 nt, Human
uuggucccuccagacaugcagc

SEQ ID NO: 532982 - RNA, 19 nt, Human
uugucuaaaacccagaagu

SEQ ID NO: 532983 - RNA, 18 nt, Human
uuucucagaagcauccaa

SEQ ID NO: 532984 - RNA, 20 nt, Human
uuugacagugaaauguacaa

SEQ ID NO: 532985 - RNA, 21 nt, Human
uuuucaagcuccgaucaccuu

SEQ ID NO: 532986 - RNA, 23 nt, Human
uuuuguuuauuuguuuggcuuuu

SEQ ID NO: 532987 - RNA, 18 nt, Human
uuuuuuuuuuuuuuuuug

SEQ ID NO: 532988 - RNA, 20 nt, Human
uuuuuuuuuuuuuuuuuguu

SEQ ID NO: 532989 - RNA, 22 nt, Human
aaaaacgccagucccagcugga

SEQ ID NO: 532990 - RNA, 25 nt, Human
aaagaucucauccuacccaugagaa

SEQ ID NO: 532991 - RNA, 19 nt, Human
aaaggagagacuuggaacc

SEQ ID NO: 532992 - RNA, 18 nt, Human
aacauguuugaugggggc

SEQ ID NO: 532993 - RNA, 20 nt, Human
aaccaggaguggcagggcca

SEQ ID NO: 532994 - RNA, 23 nt, Human
aagaaaccagauguucaguuaaa

SEQ ID NO: 532995 - RNA, 26 nt, Human
aagcgcggcggggacucgagucagaa

SEQ ID NO: 532996 - RNA, 20 nt, Human
accugccaggaaaggagaga

SEQ ID NO: 532997 - RNA, 24 nt, Human
agaaaacuuccaaaaagaaaccag

SEQ ID NO: 532998 - RNA, 21 nt, Human
agaacgucuuguuccuuacag

SEQ ID NO: 532999 - RNA, 19 nt, Human
agacuuggaaccaggagug

SEQ ID NO: 533000 - RNA, 23 nt, Human
agcgauccaucucucacagacug

SEQ ID NO: 533001 - RNA, 22 nt, Human
agcgcaggcucagagcaccacc

SEQ ID NO: 533002 - RNA, 18 nt, Human
auggauguucagguucug

SEQ ID NO: 533003 - RNA, 21 nt, Human
caccgaagaccuuucugccaa

SEQ ID NO: 533004 - RNA, 22 nt, Human
caccgaagaccuuucugccaaa

SEQ ID NO: 533005 - RNA, 19 nt, Human
cagcauauagauauaugca

SEQ ID NO: 533006 - RNA, 23 nt, Human
cagcgcaggcucagagcaccacc

SEQ ID NO: 533007 - RNA, 18 nt, Human
cagguucugaauguacaa

SEQ ID NO: 533008 - RNA, 18 nt, Human
cauauagauauaugcaua

SEQ ID NO: 533009 - RNA, 20 nt, Human
caucucucaaaaauggaccc

SEQ ID NO: 533010 - RNA, 23 nt, Human
caugugaaagaaaacuuccaaaa

SEQ ID NO: 533011 - RNA, 25 nt, Human
cccaugagaaccaucauacuccaga

SEQ ID NO: 533012 - RNA, 21 nt, Human
cggugcggguuggggaacacu

SEQ ID NO: 533013 - RNA, 18 nt, Human
cucagagcaccaccgaag

SEQ ID NO: 533014 - RNA, 21 nt, Human
cuccagagacuaaaaaacgcc

SEQ ID NO: 533015 - RNA, 18 nt, Human
cucucaaaaauggaccca

SEQ ID NO: 533016 - RNA, 18 nt, Human
cuuaacacagcauauaga

SEQ ID NO: 533017 - RNA, 20 nt, Human
cuucccuuaagaccugccag

SEQ ID NO: 533018 - RNA, 22 nt, Human
gaaagaaaacuuccaaaaagaa

SEQ ID NO: 533019 - RNA, 20 nt, Human
gaaauaaugagauacacuga

SEQ ID NO: 533020 - RNA, 20 nt, Human
gccaggaaaggagagacuug

SEQ ID NO: 533021 - RNA, 18 nt, Human
gcgcggcggggacucgag

SEQ ID NO: 533022 - RNA, 19 nt, Human
gcugcggaucccggcggcg

SEQ ID NO: 533023 - RNA, 23 nt, Human
ggaaacuccucaucucgaugguc

SEQ ID NO: 533024 - RNA, 18 nt, Human
ggaggaggugggucugcu

SEQ ID NO: 533025 - RNA, 18 nt, Human
ggcucagagcaccaccga

SEQ ID NO: 533026 - RNA, 22 nt, Human
gggggcggcaggugaugggggc

SEQ ID NO: 533027 - RNA, 19 nt, Human
ggucugcucaguccuaugc

SEQ ID NO: 533028 - RNA, 22 nt, Human
uacaaaacagguaaaggucuuu

SEQ ID NO: 533029 - RNA, 22 nt, Human
uacagaacggugcggguugggg

SEQ ID NO: 533030 - RNA, 22 nt, Human
uagaaauuaggaagugacauac

SEQ ID NO: 533031 - RNA, 20 nt, Human
uaugcagcgcaggcucagag

SEQ ID NO: 533032 - RNA, 22 nt, Human
ucuacagaaucuaaaccuaccg

SEQ ID NO: 533033 - RNA, 21 nt, Human
ugacaaaccaugugaaagaaa

SEQ ID NO: 533034 - RNA, 22 nt, Human
ugagagguacagaacggugcgg

SEQ ID NO: 533035 - RNA, 19 nt, Human
ugagauacacugauagaaa

SEQ ID NO: 533036 - RNA, 18 nt, Human
ugccaggaaaggagagac

SEQ ID NO: 533037 - RNA, 19 nt, Human
ugcccgggcaagcaguggu

SEQ ID NO: 533038 - RNA, 20 nt, Human
ugcggaucccggcggcggcg

SEQ ID NO: 533039 - RNA, 22 nt, Human
uggauguucagguucugaaugu

SEQ ID NO: 533040 - RNA, 21 nt, Human
uggcagggccacccaagcugg

SEQ ID NO: 533041 - RNA, 21 nt, Human
ugggggcggcaggugaugggg

SEQ ID NO: 533042 - RNA, 23 nt, Human
uggugugagagguacagaacggu

SEQ ID NO: 533043 - RNA, 23 nt, Human
uucguccaugcaaagcuuauacg

SEQ ID NO: 533044 - RNA, 23 nt, Human
uuugaugggggcggcaggugaug

SEQ ID NO: 533045 - RNA, 20 nt, Human
caaaugcaacugucccuugg

SEQ ID NO: 533046 - RNA, 21 nt, Human
ccccagcuccauauuuauucc

SEQ ID NO: 533047 - RNA, 22 nt, Human
cucugcccuggcccuggcuggu

SEQ ID NO: 533048 - RNA, 22 nt, Human
gagugcugcuucucugcccugg

SEQ ID NO: 533049 - RNA, 18 nt, Human
gcuuguugucguuuuuga

SEQ ID NO: 533050 - RNA, 21 nt, Human
uauuccuuaaguguuuccccu

SEQ ID NO: 533051 - RNA, 22 nt, Human
ugcccuggcccuggcuggucag

SEQ ID NO: 533052 - RNA, 19 nt, Human
uuguccucugccagcagau

SEQ ID NO: 533053 - RNA, 22 nt, Human
uuuuuuuuuuuuuuuacuguuu

SEQ ID NO: 533054 - RNA, 18 nt, Human
aagggaaacaaguuccca

SEQ ID NO: 533055 - RNA, 24 nt, Human
aauaggaugugaacuugaacaaaa

SEQ ID NO: 533056 - RNA, 23 nt, Human
acaaguucccagccuaugucaca

SEQ ID NO: 533057 - RNA, 23 nt, Human
acuaugagccuaaugaaaaagga

SEQ ID NO: 533058 - RNA, 24 nt, Human
aguuuucucuccugaguggggccu

SEQ ID NO: 533059 - RNA, 24 nt, Human
aucagaaagguagaauuuaucuuc

SEQ ID NO: 533060 - RNA, 18 nt, Human
ccaaggguaaauguaaua

SEQ ID NO: 533061 - RNA, 18 nt, Human
cccauggucagccccacc

SEQ ID NO: 533062 - RNA, 22 nt, Human
cuuguaagaucucccacagcca

SEQ ID NO: 533063 - RNA, 23 nt, Human
cuuuccgguaaaaggauuuucug

SEQ ID NO: 533064 - RNA, 20 nt, Human
ggauaagggaaacaaguucc

SEQ ID NO: 533065 - RNA, 25 nt, Human
uacauucauaaaguuugaaucccac

SEQ ID NO: 533066 - RNA, 26 nt, Human
ucaccaaauuuaucuccagcuugugu

SEQ ID NO: 533067 - RNA, 18 nt, Human
ucccauggucagccccac

SEQ ID NO: 533068 - RNA, 20 nt, Human
ucuccugaguggggccucug

SEQ ID NO: 533069 - RNA, 19 nt, Human
ucuguacauucauuauguu

SEQ ID NO: 533070 - RNA, 19 nt, Human
ugacagaaagcuuucccac

SEQ ID NO: 533071 - RNA, 20 nt, Human
uguaauauuuaucauuagca

SEQ ID NO: 533072 - RNA, 20 nt, Human
uuaucuucugugugaauucu

SEQ ID NO: 533073 - RNA, 23 nt, Human
aaaagacaauggagagugaaggc

SEQ ID NO: 533074 - RNA, 20 nt, Human
aaacccaacuuacuaacuau

SEQ ID NO: 533075 - RNA, 20 nt, Human
aaguacaugcauggacacaa

SEQ ID NO: 533076 - RNA, 22 nt, Human
acaauggagagugaaggcuaga

SEQ ID NO: 533077 - RNA, 23 nt, Human
acagcaacaacaaaaacccacag

SEQ ID NO: 533078 - RNA, 24 nt, Human
acagugcuucaugcauuuacaaua

SEQ ID NO: 533079 - RNA, 23 nt, Human
acaguggaggcagcagaguugaa

SEQ ID NO: 533080 - RNA, 26 nt, Human
acugaacacaucacaguaaaagccca

SEQ ID NO: 533081 - RNA, 22 nt, Human
agcaacaacaaaaacccacaga

SEQ ID NO: 533082 - RNA, 27 nt, Human
agccaaaaauuuucuaacagcaacaac

SEQ ID NO: 533083 - RNA, 23 nt, Human
agcccaugccagugaaggugaca

SEQ ID NO: 533084 - RNA, 21 nt, Human
agcccauggccccugcuccuc

SEQ ID NO: 533085 - RNA, 18 nt, Human
aguuacccaucagaaaaa

SEQ ID NO: 533086 - RNA, 27 nt, Human
auacuauacgacugcaggacaaugcca

SEQ ID NO: 533087 - RNA, 21 nt, Human
auagaauauuccugcaaguua

SEQ ID NO: 533088 - RNA, 19 nt, Human
cacacacaaaagcuaaacc

SEQ ID NO: 533089 - RNA, 19 nt, Human
cacacggaccaccccuagc

SEQ ID NO: 533090 - RNA, 23 nt, Human
cacacggaccaccccuagcaaga

SEQ ID NO: 533091 - RNA, 22 nt, Human
cacacuuaacaguacacacaga

SEQ ID NO: 533092 - RNA, 20 nt, Human
cacaguggaggcagcagagu

SEQ ID NO: 533093 - RNA, 20 nt, Human
cagcaacaacaaaaacccac

SEQ ID NO: 533094 - RNA, 21 nt, Human
cagcagaguugaagauccaca

SEQ ID NO: 533095 - RNA, 21 nt, Human
cagccacugucaguuacaguu

SEQ ID NO: 533096 - RNA, 26 nt, Human
caugccagugaaggugacaaaaaaca

SEQ ID NO: 533097 - RNA, 18 nt, Human
ccucccacacacuuaaca

SEQ ID NO: 533098 - RNA, 22 nt, Human
ccucuccugaucuccccaggcu

SEQ ID NO: 533099 - RNA, 19 nt, Human
ccucucucugccucccaca

SEQ ID NO: 533100 - RNA, 19 nt, Human
cuaaacccaacuuacuaac

SEQ ID NO: 533101 - RNA, 28 nt, Human
cucccacacacuuaacaguacacacaga

SEQ ID NO: 533102 - RNA, 19 nt, Human
cuccucucucugccuccca

SEQ ID NO: 533103 - RNA, 19 nt, Human
cugaucuccccaggcuggg

SEQ ID NO: 533104 - RNA, 18 nt, Human
cugcuccucucucugccu

SEQ ID NO: 533105 - RNA, 19 nt, Human
cugcuccucucucugccuc

SEQ ID NO: 533106 - RNA, 18 nt, Human
gaacugaacacaucacag

SEQ ID NO: 533107 - RNA, 19 nt, Human
gaagcccauggccccugcu

SEQ ID NO: 533108 - RNA, 21 nt, Human
gcccauggccccugcuccucu

SEQ ID NO: 533109 - RNA, 25 nt, Human
gguuuguuucaguucuagcugugag

SEQ ID NO: 533110 - RNA, 24 nt, Human
guacacacagacuuugcuggcaag

SEQ ID NO: 533111 - RNA, 21 nt, Human
guagaggcugcugccaguucc

SEQ ID NO: 533112 - RNA, 22 nt, Human
gugaaggugacaaaaaacaaaa

SEQ ID NO: 533113 - RNA, 18 nt, Human
gugacaaaaaacaaaaca

SEQ ID NO: 533114 - RNA, 24 nt, Human
uaacagcaacaacaaaaacccaca

SEQ ID NO: 533115 - RNA, 25 nt, Human
uaacagcaacaacaaaaacccacag

SEQ ID NO: 533116 - RNA, 26 nt, Human
uaacagcaacaacaaaaacccacaga

SEQ ID NO: 533117 - RNA, 19 nt, Human
uaaggauucccaccugggg

SEQ ID NO: 533118 - RNA, 20 nt, Human
uacaugcauggacacaagug

SEQ ID NO: 533119 - RNA, 19 nt, Human
uacuauacgacugcaggac

SEQ ID NO: 533120 - RNA, 22 nt, Human
uagaggcugcugccaguuccag

SEQ ID NO: 533121 - RNA, 25 nt, Human
uaucuuuuccaauagaauauuccug

SEQ ID NO: 533122 - RNA, 21 nt, Human
uaugcagaccucuccugaucu

SEQ ID NO: 533123 - RNA, 25 nt, Human
uauuccugcaaguuacccaucagaa

SEQ ID NO: 533124 - RNA, 18 nt, Human
uccauggcccagagaagg

SEQ ID NO: 533125 - RNA, 26 nt, Human
uccauggcccagagaaggcagccacu

SEQ ID NO: 533126 - RNA, 19 nt, Human
ucccacaggugugccaugc

SEQ ID NO: 533127 - RNA, 21 nt, Human
ucccacaggugugccaugcug

SEQ ID NO: 533128 - RNA, 19 nt, Human
ucuaacagcaacaacaaaa

SEQ ID NO: 533129 - RNA, 22 nt, Human
ugaaaaagaagugguuagccca

SEQ ID NO: 533130 - RNA, 22 nt, Human
ugacaaaaaacaaaacaacuug

SEQ ID NO: 533131 - RNA, 24 nt, Human
ugaggaaggggucaagaagcacuu

SEQ ID NO: 533132 - RNA, 19 nt, Human
ugcacacacaaaagcuaaa

SEQ ID NO: 533133 - RNA, 22 nt, Human
ugcacacacaaaagcuaaaccc

SEQ ID NO: 533134 - RNA, 22 nt, Human
uuagcccaugccagugaaggug

SEQ ID NO: 533135 - RNA, 20 nt, Human
uuuuuuuuuuuuuuuuccau

SEQ ID NO: 533136 - RNA, 23 nt, Human
aaaaaaaaaaccaacaacaaacc

SEQ ID NO: 533137 - RNA, 26 nt, Human
aaaaaaaaaaccaacaacaaaccaaa

SEQ ID NO: 533138 - RNA, 22 nt, Human
aaaaaaaccaacaacaaaccaa

SEQ ID NO: 533139 - RNA, 24 nt, Human
aaaccaaaaaaaccgccccccaaa

SEQ ID NO: 533140 - RNA, 28 nt, Human
aacaacaaaccaaaaaaaccgcccccca

SEQ ID NO: 533141 - RNA, 20 nt, Human
aacacagugagacccugucu

SEQ ID NO: 533142 - RNA, 21 nt, Human
aacacagugagacccugucuc

SEQ ID NO: 533143 - RNA, 20 nt, Human
aaccaaaaaaaccgcccccc

SEQ ID NO: 533144 - RNA, 24 nt, Human
aaccaaaaaaaccgccccccaaaa

SEQ ID NO: 533145 - RNA, 24 nt, Human
aaccaccucaaauaguuuuaugga

SEQ ID NO: 533146 - RNA, 21 nt, Human
aaguauuaaggaaaaugaacc

SEQ ID NO: 533147 - RNA, 24 nt, Human
aaucacuugagcccaggaguucaa

SEQ ID NO: 533148 - RNA, 26 nt, Human
aaucacuugagcccaggaguucaaga

SEQ ID NO: 533149 - RNA, 21 nt, Human
accuaggauaccuaauuauuc

SEQ ID NO: 533150 - RNA, 24 nt, Human
accuuaaccaccucaaauaguuuu

SEQ ID NO: 533151 - RNA, 18 nt, Human
acuggaauaaaagacaua

SEQ ID NO: 533152 - RNA, 21 nt, Human
acuucuuuuuuuuuuuuuuuu

SEQ ID NO: 533153 - RNA, 27 nt, Human
acuucuuuuuuuuuuuuuuuuuuuuuu

SEQ ID NO: 533154 - RNA, 24 nt, Human
agaaucacuugagcccaggaguuc

SEQ ID NO: 533155 - RNA, 22 nt, Human
agcucuuaacugccagcucaca

SEQ ID NO: 533156 - RNA, 18 nt, Human
aggaguucaagaccggcc

SEQ ID NO: 533157 - RNA, 18 nt, Human
aggugggagaaucacuug

SEQ ID NO: 533158 - RNA, 23 nt, Human
aggugggagaaucacuugagccc

SEQ ID NO: 533159 - RNA, 23 nt, Human
aucacuugagcccaggaguucaa

SEQ ID NO: 533160 - RNA, 23 nt, Human
aucuuuaucuuaagacuugagaa

SEQ ID NO: 533161 - RNA, 21 nt, Human
augaacccaagaaccuuaacc

SEQ ID NO: 533162 - RNA, 24 nt, Human
caaaaaaaagguuucucuucuccc

SEQ ID NO: 533163 - RNA, 19 nt, Human
caaaaaaaccgccccccaa

SEQ ID NO: 533164 - RNA, 21 nt, Human
caacaaaccaaaaaaaccgcc

SEQ ID NO: 533165 - RNA, 22 nt, Human
caacacagugagacccugucuc

SEQ ID NO: 533166 - RNA, 21 nt, Human
caaucuacaauauucagcaaa

SEQ ID NO: 533167 - RNA, 19 nt, Human
cacaccuguaaucccaaca

SEQ ID NO: 533168 - RNA, 24 nt, Human
cacaccuguaaucccaacaauuua

SEQ ID NO: 533169 - RNA, 23 nt, Human
ccaaaaaaaaaaaaaaaaccaac

SEQ ID NO: 533170 - RNA, 24 nt, Human
ccaaaaaaaccgccccccaaaaaa

SEQ ID NO: 533171 - RNA, 25 nt, Human
ccaaaaaaaccgccccccaaaaaaa

SEQ ID NO: 533172 - RNA, 22 nt, Human
cccaaaaaaaagguuucucuuc

SEQ ID NO: 533173 - RNA, 21 nt, Human
cccccaaaaaaaagguuucuc

SEQ ID NO: 533174 - RNA, 21 nt, Human
cucacaccuguaaucccaaca

SEQ ID NO: 533175 - RNA, 21 nt, Human
cucacaccuguaaucccaaca

SEQ ID NO: 533176 - RNA, 22 nt, Human
cucuaaccaaccuaacacucgc

SEQ ID NO: 533177 - RNA, 21 nt, Human
cugaagcuuuaaauucuuuga

SEQ ID NO: 533178 - RNA, 24 nt, Human
cuuccauaguugcaaagaacaaag

SEQ ID NO: 533179 - RNA, 19 nt, Human
gaacaaagaaaucaucuuc

SEQ ID NO: 533180 - RNA, 24 nt, Human
gagacggagucuugccaaaaaaaa

SEQ ID NO: 533181 - RNA, 19 nt, Human
gccaaaaaaaaaaaaaaaa

SEQ ID NO: 533182 - RNA, 22 nt, Human
gcccaggaguucaagaccggcc

SEQ ID NO: 533183 - RNA, 24 nt, Human
uaaaauaguacuuuuacaaaauca

SEQ ID NO: 533184 - RNA, 19 nt, Human
uaagacuugagaacuggaa

SEQ ID NO: 533185 - RNA, 23 nt, Human
uacuacauuuauuaaaauuccua

SEQ ID NO: 533186 - RNA, 19 nt, Human
uagcauuuuaaauguaaaa

SEQ ID NO: 533187 - RNA, 23 nt, Human
ucacuugagcccaggaguucaag

SEQ ID NO: 533188 - RNA, 24 nt, Human
uccauaguugcaaagaaccggggc

SEQ ID NO: 533189 - RNA, 23 nt, Human
ucggccaggugcacugucucaca

SEQ ID NO: 533190 - RNA, 21 nt, Human
ucuacaauauucagcaaagua

SEQ ID NO: 533191 - RNA, 22 nt, Human
ucuugccaaaaaaaaaaaaaaa

SEQ ID NO: 533192 - RNA, 23 nt, Human
ucuugccaaaaaaaaaaaaaaaa

SEQ ID NO: 533193 - RNA, 23 nt, Human
ucuuugagccauucagcucuuaa

SEQ ID NO: 533194 - RNA, 18 nt, Human
ugaagcuuuaaauucuuu

SEQ ID NO: 533195 - RNA, 23 nt, Human
ugagcccaggaguucaagaccgg

SEQ ID NO: 533196 - RNA, 24 nt, Human
ugcacugucucacaccuguaaucc

SEQ ID NO: 533197 - RNA, 18 nt, Human
ugccaaaaaaaaaaaaaa

SEQ ID NO: 533198 - RNA, 21 nt, Human
ugccaaaaaaaaaaaaaaaac

SEQ ID NO: 533199 - RNA, 24 nt, Human
ugccaaaaaaaaaaaaaaaaccaa

SEQ ID NO: 533200 - RNA, 26 nt, Human
uggaauaaaagacauaaagcugggca

SEQ ID NO: 533201 - RNA, 22 nt, Human
ugucucacaccuguaaucccaa

SEQ ID NO: 533202 - RNA, 19 nt, Human
uucaagguuuuccuaauuu

SEQ ID NO: 533203 - RNA, 20 nt, Human
uucacagcuuccauaguugc

SEQ ID NO: 533204 - RNA, 22 nt, Human
uugagcccaggaguucaagacc

SEQ ID NO: 533205 - RNA, 24 nt, Human
uuuuuuuuuuuugagacggagucu

SEQ ID NO: 533206 - RNA, 22 nt, Human
uuuuuuuuuuuuuugagacgga

SEQ ID NO: 533207 - RNA, 18 nt, Human
uuuuuuuuuuuuuuuuug

SEQ ID NO: 533208 - RNA, 20 nt, Human
aaaucacaugucuuuaacaa

SEQ ID NO: 533209 - RNA, 23 nt, Human
acaucacaauggaauugggccug

SEQ ID NO: 533210 - RNA, 23 nt, Human
accagguacauuacccagcauuu

SEQ ID NO: 533211 - RNA, 21 nt, Human
auaaagguaaacaucacaaug

SEQ ID NO: 533212 - RNA, 28 nt, Human
aucacaauggaauugggccugucugacu

SEQ ID NO: 533213 - RNA, 19 nt, Human
cacaugucuuuaacaaggc

SEQ ID NO: 533214 - RNA, 22 nt, Human
caguugacuguaucucaaguuc

SEQ ID NO: 533215 - RNA, 21 nt, Human
caucacaauggaauugggccu

SEQ ID NO: 533216 - RNA, 21 nt, Human
caugucuuuaacaaggcaauu

SEQ ID NO: 533217 - RNA, 25 nt, Human
ccuauaauuaagacaaaccauuuua

SEQ ID NO: 533218 - RNA, 23 nt, Human
ccucuacugccuggcuuuccuca

SEQ ID NO: 533219 - RNA, 18 nt, Human
cuauaauuaagacaaacc

SEQ ID NO: 533220 - RNA, 18 nt, Human
cuguauuuuaauaggaaa

SEQ ID NO: 533221 - RNA, 22 nt, Human
gggaaaaagaucacuucaauau

SEQ ID NO: 533222 - RNA, 23 nt, Human
guaucucaaguucaaacugcacu

SEQ ID NO: 533223 - RNA, 19 nt, Human
gucuuuaacaaggcaauuu

SEQ ID NO: 533224 - RNA, 25 nt, Human
uaaaauacaaaucacaugucuuuaa

SEQ ID NO: 533225 - RNA, 21 nt, Human
uaacuuuauguuccuuaggau

SEQ ID NO: 533226 - RNA, 22 nt, Human
uaagacaaaccauuuuacacuu

SEQ ID NO: 533227 - RNA, 19 nt, Human
uaccagguacauuacccag

SEQ ID NO: 533228 - RNA, 22 nt, Human
uagccaacaaauagucuacauu

SEQ ID NO: 533229 - RNA, 19 nt, Human
uaggauccuagcaaacacu

SEQ ID NO: 533230 - RNA, 21 nt, Human
uauuuuaauaggaaacaagca

SEQ ID NO: 533231 - RNA, 19 nt, Human
ucacaauggaauugggccu

SEQ ID NO: 533232 - RNA, 23 nt, Human
ucugacuagggaaaaagaucacu

SEQ ID NO: 533233 - RNA, 18 nt, Human
uggcuauaaagguaaaca

SEQ ID NO: 533234 - RNA, 22 nt, Human
uuccuuaggauccuagcaaaca

SEQ ID NO: 533235 - RNA, 21 nt, Human
uuuccuuucuuuaaaaacaag

SEQ ID NO: 533236 - RNA, 24 nt, Human
uuuggguggggggaauuuaggaag

SEQ ID NO: 533237 - RNA, 22 nt, Human
aacuuagagggugggccaaugg

SEQ ID NO: 533238 - RNA, 21 nt, Human
aagcccagagcuggcagggga

SEQ ID NO: 533239 - RNA, 21 nt, Human
aggagcugaggccaagggagg

SEQ ID NO: 533240 - RNA, 19 nt, Human
aggcagaaggaagugacaa

SEQ ID NO: 533241 - RNA, 29 nt, Human
aggcagaaggaagugacaaaggggacccc

SEQ ID NO: 533242 - RNA, 23 nt, Human
caaagggaaagggcaugcuggag

SEQ ID NO: 533243 - RNA, 23 nt, Human
cacuccagcucacucugggugcu

SEQ ID NO: 533244 - RNA, 24 nt, Human
cagcacagcagugagaggagcuga

SEQ ID NO: 533245 - RNA, 21 nt, Human
cagcagugagaggagcugagg

SEQ ID NO: 533246 - RNA, 18 nt, Human
gagcuggcaggggagggc

SEQ ID NO: 533247 - RNA, 22 nt, Human
ggcaggggagggcaugacccag

SEQ ID NO: 533248 - RNA, 21 nt, Human
gugcugucuguaguucuggaa

SEQ ID NO: 533249 - RNA, 19 nt, Human
ugacaaaggccaccucagc

SEQ ID NO: 533250 - RNA, 22 nt, Human
ugcacaaggaaaaugccuuauc

SEQ ID NO: 533251 - RNA, 18 nt, Human
ugcuggagaggcaugggg

SEQ ID NO: 533252 - RNA, 23 nt, Human
ugcuggagaggcauggggaccca

SEQ ID NO: 533253 - RNA, 18 nt, Human
ugcugucuguaguucugg

SEQ ID NO: 533254 - RNA, 18 nt, Human
uggcaggggagggcauga

SEQ ID NO: 533255 - RNA, 25 nt, Human
uguggaggcucugaaacaggcugag

SEQ ID NO: 533256 - RNA, 24 nt, Human
uguggaggcucugaaacaggcugg

SEQ ID NO: 533257 - RNA, 18 nt, Human
uuuuucacgcucacuggg

SEQ ID NO: 533258 - RNA, 21 nt, Human
uuuuuuuuuuuuuucuugcuu

SEQ ID NO: 533259 - RNA, 20 nt, Human
uuuuuuuuuuuuuuucuugg

SEQ ID NO: 533260 - RNA, 23 nt, Human
aaaaagccuaaaauauacucuaa

SEQ ID NO: 533261 - RNA, 25 nt, Human
aaaccuccuucaggaaggagaugau

SEQ ID NO: 533262 - RNA, 18 nt, Human
aagcagauguggugaagu

SEQ ID NO: 533263 - RNA, 23 nt, Human
aauaaguuuuuauuggaacauag

SEQ ID NO: 533264 - RNA, 20 nt, Human
acacgucgccugcacgccgg

SEQ ID NO: 533265 - RNA, 22 nt, Human
acuacaccuucaggaacugcag

SEQ ID NO: 533266 - RNA, 18 nt, Human
acugcagaagcguggcug

SEQ ID NO: 533267 - RNA, 21 nt, Human
agagacacagacuacaccuuc

SEQ ID NO: 533268 - RNA, 20 nt, Human
agcagauguggugaagugcc

SEQ ID NO: 533269 - RNA, 22 nt, Human
agggagaauucuuucucuggcu

SEQ ID NO: 533270 - RNA, 19 nt, Human
aggggauggcuuccacugu

SEQ ID NO: 533271 - RNA, 20 nt, Human
caagcaggggucugaauagc

SEQ ID NO: 533272 - RNA, 18 nt, Human
caauggggaaggccacug

SEQ ID NO: 533273 - RNA, 19 nt, Human
cagcccagcccaggugucc

SEQ ID NO: 533274 - RNA, 21 nt, Human
cauacugcagaagcguggcug

SEQ ID NO: 533275 - RNA, 22 nt, Human
cauacugcagaagcguggcuga

SEQ ID NO: 533276 - RNA, 20 nt, Human
ccagcuaggaccuuuucuca

SEQ ID NO: 533277 - RNA, 22 nt, Human
ccagguguccaucucuguugca

SEQ ID NO: 533278 - RNA, 22 nt, Human
ccucccgguaguacacgucgcc

SEQ ID NO: 533279 - RNA, 20 nt, Human
ccuugcugcuucguggcagu

SEQ ID NO: 533280 - RNA, 19 nt, Human
cgagaggaggugggguggc

SEQ ID NO: 533281 - RNA, 22 nt, Human
cgcaggacucacaggugguugg

SEQ ID NO: 533282 - RNA, 20 nt, Human
cgccguugucuaaaaaaguc

SEQ ID NO: 533283 - RNA, 23 nt, Human
cguacuguucugcuuacaaagau

SEQ ID NO: 533284 - RNA, 20 nt, Human
cuaaaaaagucugaacucca

SEQ ID NO: 533285 - RNA, 22 nt, Human
cucaucuuccuggguguuagaa

SEQ ID NO: 533286 - RNA, 23 nt, Human
cuccuucaggaaggagaugaucc

SEQ ID NO: 533287 - RNA, 20 nt, Human
cugccagucgcgccguuguc

SEQ ID NO: 533288 - RNA, 22 nt, Human
cugcccagaaggcugccaccac

SEQ ID NO: 533289 - RNA, 21 nt, Human
cuggaggaccagagcaggggc

SEQ ID NO: 533290 - RNA, 20 nt, Human
cuuaaacauuguccagccca

SEQ ID NO: 533291 - RNA, 21 nt, Human
cuucaggaaggagaugauccc

SEQ ID NO: 533292 - RNA, 21 nt, Human
gccugcacgccgguuguccac

SEQ ID NO: 533293 - RNA, 22 nt, Human
gcgcuggcuuuccagcuggguc

SEQ ID NO: 533294 - RNA, 21 nt, Human
gcuggugugugcacaggccug

SEQ ID NO: 533295 - RNA, 22 nt, Human
gggaaggccacuggggugaacu

SEQ ID NO: 533296 - RNA, 18 nt, Human
gucauaaacacgcuggag

SEQ ID NO: 533297 - RNA, 20 nt, Human
gucugaauagcuuuuuccau

SEQ ID NO: 533298 - RNA, 19 nt, Human
gugggaagcagauguggug

SEQ ID NO: 533299 - RNA, 20 nt, Human
gugguuggucccagaggggu

SEQ ID NO: 533300 - RNA, 19 nt, Human
uaacuaguccauaggaugg

SEQ ID NO: 533301 - RNA, 24 nt, Human
uacccuugugacuugucauucagg

SEQ ID NO: 533302 - RNA, 21 nt, Human
ucacagaggggacugacucca

SEQ ID NO: 533303 - RNA, 18 nt, Human
ucauccaguuuuuagacc

SEQ ID NO: 533304 - RNA, 18 nt, Human
uccagcccagcccaggug

SEQ ID NO: 533305 - RNA, 21 nt, Human
uccgcagagacacagacuaca

SEQ ID NO: 533306 - RNA, 24 nt, Human
uccgcagagacacagacuacaccu

SEQ ID NO: 533307 - RNA, 24 nt, Human
uccucuagaggccugaggagagag

SEQ ID NO: 533308 - RNA, 24 nt, Human
ucuaagaucguguuuacuaccuga

SEQ ID NO: 533309 - RNA, 19 nt, Human
ucucaggguguccuuuuuc

SEQ ID NO: 533310 - RNA, 21 nt, Human
ucugcgcuacuguagccacag

SEQ ID NO: 533311 - RNA, 24 nt, Human
ucugcgcuacuguagccacaggga

SEQ ID NO: 533312 - RNA, 22 nt, Human
ucuuucuuugauacccuuguga

SEQ ID NO: 533313 - RNA, 18 nt, Human
ugaaagaggaaaggaagg

SEQ ID NO: 533314 - RNA, 21 nt, Human
ugaagccuaggugaucucaua

SEQ ID NO: 533315 - RNA, 18 nt, Human
ugacaucaccuggucucu

SEQ ID NO: 533316 - RNA, 20 nt, Human
ugaggagagaggucacagag

SEQ ID NO: 533317 - RNA, 19 nt, Human
ugccuguggcugugucugc

SEQ ID NO: 533318 - RNA, 24 nt, Human
uggacuaaaaggaaccuuaaacau

SEQ ID NO: 533319 - RNA, 24 nt, Human
uggcaauggggaaggccacugggg

SEQ ID NO: 533320 - RNA, 18 nt, Human
ugggaagcagauguggug

SEQ ID NO: 533321 - RNA, 23 nt, Human
ugggucagcggucgugaggcuca

SEQ ID NO: 533322 - RNA, 24 nt, Human
ugguccaucacaguuccuucucaa

SEQ ID NO: 533323 - RNA, 21 nt, Human
uggucccagaggggucucuca

SEQ ID NO: 533324 - RNA, 21 nt, Human
uggucucugcccuucagcccc

SEQ ID NO: 533325 - RNA, 21 nt, Human
uggugaagugccguacuguuc

SEQ ID NO: 533326 - RNA, 24 nt, Human
ugguggaguguaacaagaacgucu

SEQ ID NO: 533327 - RNA, 21 nt, Human
uggugggaagcagauguggug

SEQ ID NO: 533328 - RNA, 22 nt, Human
uguaacaagaacgucuuaaauc

SEQ ID NO: 533329 - RNA, 21 nt, Human
ugucuaagaucguguuuacua

SEQ ID NO: 533330 - RNA, 24 nt, Human
ugucuaagaucguguuuacuaccu

SEQ ID NO: 533331 - RNA, 19 nt, Human
uuagcagggggaagacagc

SEQ ID NO: 533332 - RNA, 19 nt, Human
uucaggggauggcuuccac

SEQ ID NO: 533333 - RNA, 22 nt, Human
uucaggggauggcuuccacugu

SEQ ID NO: 533334 - RNA, 23 nt, Human
uucaggggauggcuuccacuguu

SEQ ID NO: 533335 - RNA, 22 nt, Human
uucugcuuacaaagauggggau

SEQ ID NO: 533336 - RNA, 18 nt, Human
uugggccucgaagggaga

SEQ ID NO: 533337 - RNA, 23 nt, Human
uuggucccagaggggucucucag

SEQ ID NO: 533338 - RNA, 20 nt, Human
uuguccagcccagcccaggu

SEQ ID NO: 533339 - RNA, 21 nt, Human
uuuaugaaagaggaaaggaag

SEQ ID NO: 533340 - RNA, 23 nt, Human
cuugagguaucacagaaccagca

SEQ ID NO: 533341 - RNA, 21 nt, Human
ucacagaaccagcauucccca

SEQ ID NO: 533342 - RNA, 22 nt, Human
ucuguagucuccaauuccuacu

SEQ ID NO: 533343 - RNA, 25 nt, Human
ucuguagucuccaauuccuacuugg

SEQ ID NO: 533344 - RNA, 20 nt, Human
ugaaauaaaaacauauaaau

SEQ ID NO: 533345 - RNA, 21 nt, Human
ugcccaacaaaguagcuaaua

SEQ ID NO: 533346 - RNA, 20 nt, Human
uuccuacuuggcuguuuccg

SEQ ID NO: 533347 - RNA, 23 nt, Human
uugaagaaaucugauucugugcg

SEQ ID NO: 533348 - RNA, 22 nt, Human
uugaagaaaucugauucugugg

SEQ ID NO: 533349 - RNA, 19 nt, Human
uugaagaaaucugauuuua

SEQ ID NO: 533350 - RNA, 18 nt, Human
aaaacaaaaccccagaaa

SEQ ID NO: 533351 - RNA, 21 nt, Human
aaaacaaaaccccagaaaccc

SEQ ID NO: 533352 - RNA, 23 nt, Human
aaaacaaagacagaaaaauuaaa

SEQ ID NO: 533353 - RNA, 24 nt, Human
aaacaaaaccccagaaaccccuca

SEQ ID NO: 533354 - RNA, 19 nt, Human
aaaccccagaaaccccuca

SEQ ID NO: 533355 - RNA, 24 nt, Human
aaagugcugggauuacaggcauga

SEQ ID NO: 533356 - RNA, 19 nt, Human
aaauagcugggauuacagg

SEQ ID NO: 533357 - RNA, 26 nt, Human
aaauagcugggauuacaggcgccugc

SEQ ID NO: 533358 - RNA, 25 nt, Human
aacauuuccuuuuuuuuuuuuuuuu

SEQ ID NO: 533359 - RNA, 22 nt, Human
aaccuugugauccaccugccuc

SEQ ID NO: 533360 - RNA, 22 nt, Human
aaccuugugauccaccugccuc

SEQ ID NO: 533361 - RNA, 24 nt, Human
aaccuugugauccaccugccucgg

SEQ ID NO: 533362 - RNA, 25 nt, Human
aagcgauucuucugccucagccucc

SEQ ID NO: 533363 - RNA, 19 nt, Human
aagugcugggauuacaggc

SEQ ID NO: 533364 - RNA, 21 nt, Human
aagugcugggauuacaggcau

SEQ ID NO: 533365 - RNA, 22 nt, Human
aaucucugcucacugcaaccuc

SEQ ID NO: 533366 - RNA, 24 nt, Human
acaaaaccccagaaaccccucagc

SEQ ID NO: 533367 - RNA, 24 nt, Human
accauguuggccaggcuggucucg

SEQ ID NO: 533368 - RNA, 19 nt, Human
accccagaaaccccucagc

SEQ ID NO: 533369 - RNA, 25 nt, Human
acccugucgcccagacuugagugca

SEQ ID NO: 533370 - RNA, 24 nt, Human
accuugugauccaccugccucggc

SEQ ID NO: 533371 - RNA, 18 nt, Human
acgggguuucaccauguu

SEQ ID NO: 533372 - RNA, 23 nt, Human
acgggguuucaccauguuggcca

SEQ ID NO: 533373 - RNA, 24 nt, Human
acgggguuucaccauguuggccag

SEQ ID NO: 533374 - RNA, 19 nt, Human
agaaggaaggaagggagag

SEQ ID NO: 533375 - RNA, 18 nt, Human
agacagaaaaauuaaaau

SEQ ID NO: 533376 - RNA, 22 nt, Human
agcaggaauugaugacaacaac

SEQ ID NO: 533377 - RNA, 24 nt, Human
agugacuucaagccacagugacac

SEQ ID NO: 533378 - RNA, 21 nt, Human
agugcaguggcgcaaucucug

SEQ ID NO: 533379 - RNA, 18 nt, Human
agugcugggauuacaggc

SEQ ID NO: 533380 - RNA, 18 nt, Human
auagcugggauuacaggc

SEQ ID NO: 533381 - RNA, 24 nt, Human
auuuuuguguuuuuaguagagacg

SEQ ID NO: 533382 - RNA, 24 nt, Human
caaagugcugggauuacaggcaug

SEQ ID NO: 533383 - RNA, 20 nt, Human
caacacccgguugucaccac

SEQ ID NO: 533384 - RNA, 22 nt, Human
caagcgauucuucugccucagc

SEQ ID NO: 533385 - RNA, 23 nt, Human
caccaugcccagcuaauuuuugu

SEQ ID NO: 533386 - RNA, 21 nt, Human
caccauguuggccaggcuggu

SEQ ID NO: 533387 - RNA, 24 nt, Human
caccauguuggccaggcuggucuc

SEQ ID NO: 533388 - RNA, 19 nt, Human
cacccugucgcccagacuu

SEQ ID NO: 533389 - RNA, 24 nt, Human
cacccugucgcccagacuugagug

SEQ ID NO: 533390 - RNA, 23 nt, Human
caccugccucggccucccaaagu

SEQ ID NO: 533391 - RNA, 24 nt, Human
cagcagaagcuucaguucuuugau

SEQ ID NO: 533392 - RNA, 23 nt, Human
cauguuggccaggcuggucucga

SEQ ID NO: 533393 - RNA, 23 nt, Human
ccaaagugcugggauuacaggca

SEQ ID NO: 533394 - RNA, 24 nt, Human
ccaaagugcugggauuacaggcau

SEQ ID NO: 533395 - RNA, 18 nt, Human
ccagguucaagcgauucu

SEQ ID NO: 533396 - RNA, 22 nt, Human
ccagguucaagcgauucuucug

SEQ ID NO: 533397 - RNA, 24 nt, Human
cccaaagugcugggauuacaggca

SEQ ID NO: 533398 - RNA, 23 nt, Human
cccaaauagcugggauuacaggc

SEQ ID NO: 533399 - RNA, 24 nt, Human
cccaaauagcugggauuacaggcg

SEQ ID NO: 533400 - RNA, 22 nt, Human
cccaacacccgguugucaccac

SEQ ID NO: 533401 - RNA, 21 nt, Human
ccccagaaaccccucagcagg

SEQ ID NO: 533402 - RNA, 24 nt, Human
ccgccuuccagguucaagcgauuc

SEQ ID NO: 533403 - RNA, 19 nt, Human
ccucgagggcugagaagga

SEQ ID NO: 533404 - RNA, 24 nt, Human
ccuuccagguucaagcgauucuuc

SEQ ID NO: 533405 - RNA, 19 nt, Human
cgcccagacuugagugcag

SEQ ID NO: 533406 - RNA, 20 nt, Human
cuacccaucacuggcacuug

SEQ ID NO: 533407 - RNA, 24 nt, Human
cucccaaauagcugggauuacagg

SEQ ID NO: 533408 - RNA, 24 nt, Human
cugcaaccuccgccuuccagguuc

SEQ ID NO: 533409 - RNA, 23 nt, Human
cugccucagccucccaaauagcu

SEQ ID NO: 533410 - RNA, 23 nt, Human
cugccucggccucccaaagugcu

SEQ ID NO: 533411 - RNA, 23 nt, Human
cuggucucgagcucccaaccuug

SEQ ID NO: 533412 - RNA, 19 nt, Human
cuuuuuuuuuuuuuuuuug

SEQ ID NO: 533413 - RNA, 20 nt, Human
cuuuuuuuuuuuuuuuuugg

SEQ ID NO: 533414 - RNA, 22 nt, Human
gacaacaacagaggaauccaac

SEQ ID NO: 533415 - RNA, 24 nt, Human
gagacgggguuucaccauguuggc

SEQ ID NO: 533416 - RNA, 20 nt, Human
gagugcaguggcgcaaucuc

SEQ ID NO: 533417 - RNA, 18 nt, Human
gauuacaggcgccugcca

SEQ ID NO: 533418 - RNA, 22 nt, Human
gauuacaggcgccugccaccau

SEQ ID NO: 533419 - RNA, 21 nt, Human
gauucuucugccucagccucc

SEQ ID NO: 533420 - RNA, 22 nt, Human
gcaaccuccgccuuccagguuc

SEQ ID NO: 533421 - RNA, 24 nt, Human
gcgauucuucugccucagccuccc

SEQ ID NO: 533422 - RNA, 21 nt, Human
gcugcagaugaccaggucugg

SEQ ID NO: 533423 - RNA, 23 nt, Human
ggaaggaagggagaguccgcaag

SEQ ID NO: 533424 - RNA, 20 nt, Human
gggagcucuguuugguacca

SEQ ID NO: 533425 - RNA, 23 nt, Human
gggguuucaccauguuggccagg

SEQ ID NO: 533426 - RNA, 22 nt, Human
ggguuucaccauguuggccagg

SEQ ID NO: 533427 - RNA, 23 nt, Human
guagagacgggguuucaccaugu

SEQ ID NO: 533428 - RNA, 20 nt, Human
gugacaaaggcuacaaagga

SEQ ID NO: 533429 - RNA, 24 nt, Human
gugauccaccugccucggccuccc

SEQ ID NO: 533430 - RNA, 20 nt, Human
guggacagcagaagcuucag

SEQ ID NO: 533431 - RNA, 22 nt, Human
uaaaaacaaaaccccagaaacc

SEQ ID NO: 533432 - RNA, 26 nt, Human
uaaaaacaaaaccccagaaaccccuc

SEQ ID NO: 533433 - RNA, 24 nt, Human
uaauuuuuguguuuuuaguagaga

SEQ ID NO: 533434 - RNA, 22 nt, Human
uagagacgggguuucaccaugu

SEQ ID NO: 533435 - RNA, 24 nt, Human
uaguagagacgggguuucaccaug

SEQ ID NO: 533436 - RNA, 26 nt, Human
uaguagagacgggguuucaccauguu

SEQ ID NO: 533437 - RNA, 18 nt, Human
ucacugcaaccuccgccu

SEQ ID NO: 533438 - RNA, 19 nt, Human
ucacugcaaccuccgccuu

SEQ ID NO: 533439 - RNA, 24 nt, Human
ucacugcaaccuccgccuuccagg

SEQ ID NO: 533440 - RNA, 25 nt, Human
ucacugcaaccuccgccuuccaggu

SEQ ID NO: 533441 - RNA, 27 nt, Human
ucacugcaaccuccgccuuccagguuc

SEQ ID NO: 533442 - RNA, 20 nt, Human
ucagccucccaaauagcugg

SEQ ID NO: 533443 - RNA, 19 nt, Human
ucauuuuggagccccccuc

SEQ ID NO: 533444 - RNA, 24 nt, Human
ucccaaagugcugggauuacaggc

SEQ ID NO: 533445 - RNA, 24 nt, Human
ucccaaauagcugggauuacaggc

SEQ ID NO: 533446 - RNA, 23 nt, Human
ucccaaccuugugauccaccugc

SEQ ID NO: 533447 - RNA, 18 nt, Human
uccuuuuuuuuuuuuuuu

SEQ ID NO: 533448 - RNA, 18 nt, Human
ucggccucccaaagugcu

SEQ ID NO: 533449 - RNA, 18 nt, Human
ucuaugacugggccagag

SEQ ID NO: 533450 - RNA, 24 nt, Human
ucucacccugucgcccagacuuga

SEQ ID NO: 533451 - RNA, 25 nt, Human
ucucacccugucgcccagacuugag

SEQ ID NO: 533452 - RNA, 22 nt, Human
ucucugggccugcuuaauuagc

SEQ ID NO: 533453 - RNA, 22 nt, Human
ugacccacugccaggauaacau

SEQ ID NO: 533454 - RNA, 20 nt, Human
ugacugggccagagcugcag

SEQ ID NO: 533455 - RNA, 19 nt, Human
ugagaaggaaggaagggag

SEQ ID NO: 533456 - RNA, 22 nt, Human
ugagauggagucucacccuguc

SEQ ID NO: 533457 - RNA, 26 nt, Human
ugccucagccucccaaauagcuggga

SEQ ID NO: 533458 - RNA, 21 nt, Human
ugccucggccucccaaagugc

SEQ ID NO: 533459 - RNA, 24 nt, Human
ugccucggccucccaaagugcugg

SEQ ID NO: 533460 - RNA, 20 nt, Human
ugcugggauuacaggcauga

SEQ ID NO: 533461 - RNA, 23 nt, Human
uggccaggcuggucucgagcucc

SEQ ID NO: 533462 - RNA, 18 nt, Human
ugggauuacaggcaugaa

SEQ ID NO: 533463 - RNA, 18 nt, Human
ugggauuacaggcaugaa

SEQ ID NO: 533464 - RNA, 18 nt, Human
ugggauuacaggcaugaa

SEQ ID NO: 533465 - RNA, 18 nt, Human
ugggauuacaggcaugaa

SEQ ID NO: 533466 - RNA, 18 nt, Human
ugggauuacaggcaugaa

SEQ ID NO: 533467 - RNA, 19 nt, Human
ugggauuacaggcaugaag

SEQ ID NO: 533468 - RNA, 21 nt, Human
ugggauuacaggcaugaagga

SEQ ID NO: 533469 - RNA, 22 nt, Human
ugggauuacaggcaugaaggau

SEQ ID NO: 533470 - RNA, 23 nt, Human
ugggauuacaggcaugaaggaua

SEQ ID NO: 533471 - RNA, 24 nt, Human
ugggauuacaggcaugaaggauaa

SEQ ID NO: 533472 - RNA, 21 nt, Human
ugggauuacaggcgccugcca

SEQ ID NO: 533473 - RNA, 22 nt, Human
ugggauuacaggcgccugccac

SEQ ID NO: 533474 - RNA, 24 nt, Human
ugggauuacaggcgccugccacca

SEQ ID NO: 533475 - RNA, 25 nt, Human
ugggauuacaggcgccugccaccau

SEQ ID NO: 533476 - RNA, 21 nt, Human
ugggccagagcugcagaugac

SEQ ID NO: 533477 - RNA, 18 nt, Human
uuaguagagacgggguuu

SEQ ID NO: 533478 - RNA, 22 nt, Human
uuaguagagacgggguuucacc

SEQ ID NO: 533479 - RNA, 24 nt, Human
uuaguagagacgggguuucaccau

SEQ ID NO: 533480 - RNA, 23 nt, Human
uucaagcgauucuucugccucag

SEQ ID NO: 533481 - RNA, 24 nt, Human
uucaagcgauucuucugccucagc

SEQ ID NO: 533482 - RNA, 24 nt, Human
uuccagguucaagcgauucuucug

SEQ ID NO: 533483 - RNA, 22 nt, Human
uugacaacaggaugggugcccc

SEQ ID NO: 533484 - RNA, 24 nt, Human
uuucaccauguuggccaggcuggu

SEQ ID NO: 533485 - RNA, 24 nt, Human
uuuguguuuuuaguagagacgggg

SEQ ID NO: 533486 - RNA, 24 nt, Human
uuuuuaguagagacgggguuucac

SEQ ID NO: 533487 - RNA, 20 nt, Human
uuuuuguguuuuuaguagag

SEQ ID NO: 533488 - RNA, 26 nt, Human
uuuuuuuuuuuugagauggagucuca

SEQ ID NO: 533489 - RNA, 22 nt, Human
uuuuuuuuuuuuuugagaugga

SEQ ID NO: 533490 - RNA, 21 nt, Human
aaacagccccgugaaccuggc

SEQ ID NO: 533491 - RNA, 26 nt, Human
aagacaaugggggaacuccggguggc

SEQ ID NO: 533492 - RNA, 18 nt, Human
aagcccucggucaccagc

SEQ ID NO: 533493 - RNA, 21 nt, Human
aagucccgcaggaggcucugc

SEQ ID NO: 533494 - RNA, 22 nt, Human
aauccacccauuuacuuuggcc

SEQ ID NO: 533495 - RNA, 21 nt, Human
aaugcccuguccuuuaaucuc

SEQ ID NO: 533496 - RNA, 25 nt, Human
acacagcaccccauccccuaccccu

SEQ ID NO: 533497 - RNA, 25 nt, Human
acagacugugccugaugcugccccc

SEQ ID NO: 533498 - RNA, 18 nt, Human
acagcaccccauccccua

SEQ ID NO: 533499 - RNA, 20 nt, Human
acugaggcccuaggggugag

SEQ ID NO: 533500 - RNA, 23 nt, Human
agaauccacccauuuacuuuggc

SEQ ID NO: 533501 - RNA, 19 nt, Human
agaauucgagggcaaggcc

SEQ ID NO: 533502 - RNA, 18 nt, Human
agcccaggcaccaaagac

SEQ ID NO: 533503 - RNA, 19 nt, Human
agcuccucguuguacuccu

SEQ ID NO: 533504 - RNA, 21 nt, Human
aggaggaaacagccccgugaa

SEQ ID NO: 533505 - RNA, 18 nt, Human
aggcccuggccucggcag

SEQ ID NO: 533506 - RNA, 21 nt, Human
aggcccuggccucggcagccu

SEQ ID NO: 533507 - RNA, 19 nt, Human
agggcaaggccgugagggg

SEQ ID NO: 533508 - RNA, 21 nt, Human
aggggggacaucugggggagg

SEQ ID NO: 533509 - RNA, 21 nt, Human
aguagagcuuggagggccugg

SEQ ID NO: 533510 - RNA, 20 nt, Human
augcccuguccuuuaaucuc

SEQ ID NO: 533511 - RNA, 21 nt, Human
caaaacaagagcugaggccau

SEQ ID NO: 533512 - RNA, 18 nt, Human
caaaccuuugaagaacaa

SEQ ID NO: 533513 - RNA, 20 nt, Human
caaccauaccccgacauggu

SEQ ID NO: 533514 - RNA, 21 nt, Human
caagccccugggggcuuuuca

SEQ ID NO: 533515 - RNA, 25 nt, Human
cacagcaccccauccccuaccccuu

SEQ ID NO: 533516 - RNA, 21 nt, Human
cacccagggggagugcauggc

SEQ ID NO: 533517 - RNA, 23 nt, Human
cacccagggggagugcauggcuu

SEQ ID NO: 533518 - RNA, 18 nt, Human
caccuucugaaaugccug

SEQ ID NO: 533519 - RNA, 21 nt, Human
cagaaaccaucaagcugggga

SEQ ID NO: 533520 - RNA, 24 nt, Human
cagaaaggccucuucuccuggccc

SEQ ID NO: 533521 - RNA, 22 nt, Human
cagcagcaaaacaagagcugag

SEQ ID NO: 533522 - RNA, 18 nt, Human
cagccccgugaaccuggc

SEQ ID NO: 533523 - RNA, 22 nt, Human
cagcucuagggcagaggagaug

SEQ ID NO: 533524 - RNA, 18 nt, Human
caggagccccaguuggga

SEQ ID NO: 533525 - RNA, 23 nt, Human
caggccacuggaugcccacauua

SEQ ID NO: 533526 - RNA, 23 nt, Human
cagggggggguccacaggccacu

SEQ ID NO: 533527 - RNA, 25 nt, Human
caguccccagugggaccuguuugcc

SEQ ID NO: 533528 - RNA, 19 nt, Human
caucuccccuuugcccauc

SEQ ID NO: 533529 - RNA, 24 nt, Human
cauuuacuuuggccccuaaaacca

SEQ ID NO: 533530 - RNA, 22 nt, Human
ccaaagacaaugggggaacucc

SEQ ID NO: 533531 - RNA, 18 nt, Human
ccacaggccacuggaugc

SEQ ID NO: 533532 - RNA, 22 nt, Human
ccagcagcaaaacaagagcuga

SEQ ID NO: 533533 - RNA, 23 nt, Human
ccagcagcaaaacaagagcugag

SEQ ID NO: 533534 - RNA, 20 nt, Human
ccagcuccucguuguacucc

SEQ ID NO: 533535 - RNA, 21 nt, Human
ccccuaaaaccagcagcaaaa

SEQ ID NO: 533536 - RNA, 24 nt, Human
ccccuaaaaccagcagcaaaacaa

SEQ ID NO: 533537 - RNA, 19 nt, Human
ccccuugccccuccaugcc

SEQ ID NO: 533538 - RNA, 20 nt, Human
cccuaaaaccagcagcaaaa

SEQ ID NO: 533539 - RNA, 22 nt, Human
cccuaaaaccagcagcaaaaca

SEQ ID NO: 533540 - RNA, 18 nt, Human
cccuaccccuugccccuc

SEQ ID NO: 533541 - RNA, 18 nt, Human
cccuccaugccagacuua

SEQ ID NO: 533542 - RNA, 22 nt, Human
cccuggcaccuccacaggcccu

SEQ ID NO: 533543 - RNA, 21 nt, Human
ccuccaugccagacuuagcuc

SEQ ID NO: 533544 - RNA, 31 nt, Human
ccuggcaccuccacaggcccuggccucggcc

SEQ ID NO: 533545 - RNA, 18 nt, Human
ccuuaccuuccaucaaug

SEQ ID NO: 533546 - RNA, 18 nt, Human
cgagggcaaggccgugag

SEQ ID NO: 533547 - RNA, 18 nt, Human
cuccaagagucacagucc

SEQ ID NO: 533548 - RNA, 20 nt, Human
cuccaagagucacagucccc

SEQ ID NO: 533549 - RNA, 27 nt, Human
cuccucguuguacuccuccucucugau

SEQ ID NO: 533550 - RNA, 22 nt, Human
cuccuggcccuuaccuuccauc

SEQ ID NO: 533551 - RNA, 24 nt, Human
cucugcaccaccgaguaccgcgac

SEQ ID NO: 533552 - RNA, 18 nt, Human
cucugcugcuaacugagc

SEQ ID NO: 533553 - RNA, 18 nt, Human
cugcccucugcugcuaac

SEQ ID NO: 533554 - RNA, 19 nt, Human
cugcccucugcugcuaacu

SEQ ID NO: 533555 - RNA, 18 nt, Human
cuggccucggcagccucc

SEQ ID NO: 533556 - RNA, 21 nt, Human
gacugugccugaugcugcccc

SEQ ID NO: 533557 - RNA, 23 nt, Human
gaggaaacagccccgugaaccug

SEQ ID NO: 533558 - RNA, 24 nt, Human
gagguuccagaauccacccauuua

SEQ ID NO: 533559 - RNA, 18 nt, Human
gagugccaccuucugaaa

SEQ ID NO: 533560 - RNA, 20 nt, Human
gcaccaccgaguaccgcgac

SEQ ID NO: 533561 - RNA, 21 nt, Human
gcagaggagaugagggugagc

SEQ ID NO: 533562 - RNA, 20 nt, Human
gcggccagacagcugaagaa

SEQ ID NO: 533563 - RNA, 22 nt, Human
gcuuggagggccugggcggagg

SEQ ID NO: 533564 - RNA, 22 nt, Human
ggagaugagggugagcugcccg

SEQ ID NO: 533565 - RNA, 21 nt, Human
ggcaaggccgugaggggacac

SEQ ID NO: 533566 - RNA, 20 nt, Human
gggaccuguuugcccagcuc

SEQ ID NO: 533567 - RNA, 21 nt, Human
gggauggucugaguuuacuga

SEQ ID NO: 533568 - RNA, 21 nt, Human
gggccuacaaccauaccccga

SEQ ID NO: 533569 - RNA, 25 nt, Human
gggggaacuccggguggcagcaguc

SEQ ID NO: 533570 - RNA, 20 nt, Human
gucugaguuuacugaggccc

SEQ ID NO: 533571 - RNA, 18 nt, Human
uaaaaccagcagcaaaac

SEQ ID NO: 533572 - RNA, 27 nt, Human
uagggcagaggagaugagggugagccg

SEQ ID NO: 533573 - RNA, 18 nt, Human
ucacaguccccaguggga

SEQ ID NO: 533574 - RNA, 18 nt, Human
ucaggggagcccagggcc

SEQ ID NO: 533575 - RNA, 20 nt, Human
uccacaggcccuggccucgg

SEQ ID NO: 533576 - RNA, 20 nt, Human
ucuagggcagaggagaugag

SEQ ID NO: 533577 - RNA, 20 nt, Human
ucugguccauaaauaugaca

SEQ ID NO: 533578 - RNA, 21 nt, Human
ucugguccauaaauaugacag

SEQ ID NO: 533579 - RNA, 22 nt, Human
ucugguccauaaauaugacagg

SEQ ID NO: 533580 - RNA, 26 nt, Human
ucugguccauaaauaugacagguguu

SEQ ID NO: 533581 - RNA, 19 nt, Human
ugaccugcaggaggggaga

SEQ ID NO: 533582 - RNA, 19 nt, Human
ugauugaacaaacagcucu

SEQ ID NO: 533583 - RNA, 18 nt, Human
ugcaagcccucggucacc

SEQ ID NO: 533584 - RNA, 21 nt, Human
ugccagacuuagcucagaaac

SEQ ID NO: 533585 - RNA, 21 nt, Human
ugcccggugacaggggggaca

SEQ ID NO: 533586 - RNA, 23 nt, Human
uggaagcccaggcaccaaagaca

SEQ ID NO: 533587 - RNA, 19 nt, Human
uggagggccugggcggagg

SEQ ID NO: 533588 - RNA, 20 nt, Human
uggagggccugggcggaggu

SEQ ID NO: 533589 - RNA, 19 nt, Human
uggaugcccacauuaagcc

SEQ ID NO: 533590 - RNA, 21 nt, Human
uggcagcagucgugguggcag

SEQ ID NO: 533591 - RNA, 20 nt, Human
ugggagggacucuggaagcc

SEQ ID NO: 533592 - RNA, 26 nt, Human
uggggauuugggcagccuuugcuaug

SEQ ID NO: 533593 - RNA, 20 nt, Human
ugggggaggaggaggaaaca

SEQ ID NO: 533594 - RNA, 23 nt, Human
ugucaggggagcccagggccugc

SEQ ID NO: 533595 - RNA, 19 nt, Human
uugcccagcucucaauccu

SEQ ID NO: 533596 - RNA, 18 nt, Human
cagcagccugugggugcc

SEQ ID NO: 533597 - RNA, 22 nt, Human
cagccugugggugccuccuccu

SEQ ID NO: 533598 - RNA, 23 nt, Human
ccagcagccugugggugccuccu

SEQ ID NO: 533599 - RNA, 21 nt, Human
cccagcagccugugggugccu

SEQ ID NO: 533600 - RNA, 19 nt, Human
ccuccuccuuccucagcca

SEQ ID NO: 533601 - RNA, 22 nt, Human
cucagccacgccggaguucacu

SEQ ID NO: 533602 - RNA, 24 nt, Human
cuguuuuuaccauuuuauuuuugu

SEQ ID NO: 533603 - RNA, 19 nt, Human
gcucuccucccagcagccu

SEQ ID NO: 533604 - RNA, 21 nt, Human
ucuguuuuuaccauuuuauuu

SEQ ID NO: 533605 - RNA, 21 nt, Human
ugggugccuccuccuuccuca

SEQ ID NO: 533606 - RNA, 18 nt, Human
uuuuuuuuuuuuuuucug

SEQ ID NO: 533607 - RNA, 25 nt, Human
uuuuuuuuuuuuuuuuuucuguuuu

SEQ ID NO: 533608 - RNA, 26 nt, Human
uuuuuuuuuuuuuuuuuucuguuuuu

SEQ ID NO: 533609 - RNA, 26 nt, Human
uuuuuuuuuuuuuuuuuuucuguuuu

SEQ ID NO: 533610 - RNA, 24 nt, Human
uuuuuuuuuuuuuuuuuuuuucuu

SEQ ID NO: 533611 - RNA, 21 nt, Human
aaaaaauagcaaaucucacaa

SEQ ID NO: 533612 - RNA, 27 nt, Human
aaagagaaaucccuccgcccugucaag

SEQ ID NO: 533613 - RNA, 19 nt, Human
aagcaguaagugaaaacga

SEQ ID NO: 533614 - RNA, 23 nt, Human
aagcaguaagugaaaacgauccg

SEQ ID NO: 533615 - RNA, 20 nt, Human
acagcagcacaaucucugcg

SEQ ID NO: 533616 - RNA, 21 nt, Human
aggaaagagaaaucccuccgc

SEQ ID NO: 533617 - RNA, 21 nt, Human
caacaaggccuaggccuccag

SEQ ID NO: 533618 - RNA, 21 nt, Human
caagaaagcaaacuacauuuc

SEQ ID NO: 533619 - RNA, 20 nt, Human
caagacgcaauaagcgggug

SEQ ID NO: 533620 - RNA, 24 nt, Human
cagcgagucacauuuacuaaaagc

SEQ ID NO: 533621 - RNA, 18 nt, Human
cauugcuuccccuguccu

SEQ ID NO: 533622 - RNA, 20 nt, Human
cauuucaaguauaaucccau

SEQ ID NO: 533623 - RNA, 19 nt, Human
cuggaaaaguaaagacugc

SEQ ID NO: 533624 - RNA, 25 nt, Human
gaugaagccuucaacaaggccuagg

SEQ ID NO: 533625 - RNA, 19 nt, Human
gccugugcaucaacagcuu

SEQ ID NO: 533626 - RNA, 19 nt, Human
gcuacuggauuuggcugga

SEQ ID NO: 533627 - RNA, 21 nt, Human
gcucugugacccaggagcaag

SEQ ID NO: 533628 - RNA, 18 nt, Human
gcuuccccuguccuuccu

SEQ ID NO: 533629 - RNA, 20 nt, Human
ggaaaugcaguacccuuucc

SEQ ID NO: 533630 - RNA, 19 nt, Human
uaaaaaauagcaaaucuca

SEQ ID NO: 533631 - RNA, 22 nt, Human
uaaaaaauagcaaaucucacaa

SEQ ID NO: 533632 - RNA, 20 nt, Human
uaucacuggccauuggaaaa

SEQ ID NO: 533633 - RNA, 23 nt, Human
uauggugaauuacagcgagucac

SEQ ID NO: 533634 - RNA, 21 nt, Human
ucaacaaggccuaggccucca

SEQ ID NO: 533635 - RNA, 21 nt, Human
ucaaguauaaucccauaaggc

SEQ ID NO: 533636 - RNA, 23 nt, Human
uccccuguccuuccuuuagcugu

SEQ ID NO: 533637 - RNA, 20 nt, Human
uccuuuagcuguaacuccgg

SEQ ID NO: 533638 - RNA, 27 nt, Human
ucucacaaauacuuauuuaauuucuua

SEQ ID NO: 533639 - RNA, 21 nt, Human
ugaagcugggcuugccacaag

SEQ ID NO: 533640 - RNA, 21 nt, Human
ugacccaggagcaagacgcaa

SEQ ID NO: 533641 - RNA, 23 nt, Human
ugcaguggagguagaaacgggaa

SEQ ID NO: 533642 - RNA, 27 nt, Human
uggaagaugauucugcuacuggauuug

SEQ ID NO: 533643 - RNA, 22 nt, Human
uggcuggaaaaguaaagacugc

SEQ ID NO: 533644 - RNA, 25 nt, Human
uguggaagaugauucugcuacugga

SEQ ID NO: 533645 - RNA, 21 nt, Human
uuaaaaaauagcaaaucucac

SEQ ID NO: 533646 - RNA, 23 nt, Human
uuaaaaaauagcaaaucucacaa

SEQ ID NO: 533647 - RNA, 22 nt, Human
uucaacaaggccuaggccucca

SEQ ID NO: 533648 - RNA, 25 nt, Human
uuuaaaacaauuacuuuauuaaaaa

SEQ ID NO: 533649 - RNA, 19 nt, Human
aaacauuucauagaaucuc

SEQ ID NO: 533650 - RNA, 18 nt, Human
aguaguacuagaaagaag

SEQ ID NO: 533651 - RNA, 19 nt, Human
auagaaucucaaauaugac

SEQ ID NO: 533652 - RNA, 22 nt, Human
cagguaccacauuuuacaggga

SEQ ID NO: 533653 - RNA, 20 nt, Human
gaaacaguuggcucccuguu

SEQ ID NO: 533654 - RNA, 19 nt, Human
uacagauuucaaaaggcuu

SEQ ID NO: 533655 - RNA, 23 nt, Human
uaguaguacuagaaagaagaaaa

SEQ ID NO: 533656 - RNA, 19 nt, Human
ucaguagaaauaguaguac

SEQ ID NO: 533657 - RNA, 23 nt, Human
ugagaggaauuuuauguuuacag

SEQ ID NO: 533658 - RNA, 19 nt, Human
ugauuugguucauuaauaa

SEQ ID NO: 533659 - RNA, 18 nt, Human
uuacagauuucaaaaggc

SEQ ID NO: 533660 - RNA, 21 nt, Human
aaaacaauaaaauguggacaa

SEQ ID NO: 533661 - RNA, 23 nt, Human
aaacuccugggcuugagcaauuc

SEQ ID NO: 533662 - RNA, 24 nt, Human
aaagcgcuaggauuacagguguga

SEQ ID NO: 533663 - RNA, 24 nt, Human
aaaguguuggaauuacagguguga

SEQ ID NO: 533664 - RNA, 24 nt, Human
aaccauguuggccaggcuggucuc

SEQ ID NO: 533665 - RNA, 22 nt, Human
aacccucggccucaagcaaucc

SEQ ID NO: 533666 - RNA, 26 nt, Human
aagcgcuaggauuacaggugugagcc

SEQ ID NO: 533667 - RNA, 26 nt, Human
aaguagcuaggaucacaggugcacac

SEQ ID NO: 533668 - RNA, 26 nt, Human
aaguguuggaauuacaggugugagcc

SEQ ID NO: 533669 - RNA, 23 nt, Human
aaugcaguggugaaaucauagcu

SEQ ID NO: 533670 - RNA, 18 nt, Human
aauuacaggugugagcca

SEQ ID NO: 533671 - RNA, 22 nt, Human
aauuacaggugugagccauugc

SEQ ID NO: 533672 - RNA, 23 nt, Human
aauuacaggugugagccauugca

SEQ ID NO: 533673 - RNA, 20 nt, Human
accauguuggccaggcuggu

SEQ ID NO: 533674 - RNA, 23 nt, Human
accauguuggccaggcuggucuc

SEQ ID NO: 533675 - RNA, 24 nt, Human
accauguuggccaggcuggucucg

SEQ ID NO: 533676 - RNA, 24 nt, Human
acccaggcugaagugcaguggcau

SEQ ID NO: 533677 - RNA, 18 nt, Human
acgggguuuaaccauguu

SEQ ID NO: 533678 - RNA, 20 nt, Human
acgggguuuaaccauguugg

SEQ ID NO: 533679 - RNA, 24 nt, Human
acgggguuuaaccauguuggccag

SEQ ID NO: 533680 - RNA, 25 nt, Human
acucuguugcccaggcuagaaugca

SEQ ID NO: 533681 - RNA, 22 nt, Human
agcaauccucccgccucugccu

SEQ ID NO: 533682 - RNA, 25 nt, Human
agcaauccucccgccucugccuccc

SEQ ID NO: 533683 - RNA, 24 nt, Human
agcgauucuccugccucagccucu

SEQ ID NO: 533684 - RNA, 24 nt, Human
aggcugaagugcaguggcauaauc

SEQ ID NO: 533685 - RNA, 24 nt, Human
aggugauccacccaccgcggccuc

SEQ ID NO: 533686 - RNA, 25 nt, Human
aguaauauacccaaaauuugaaucc

SEQ ID NO: 533687 - RNA, 18 nt, Human
aguaccugggauuaccag

SEQ ID NO: 533688 - RNA, 20 nt, Human
agugcaguggcauaaucuug

SEQ ID NO: 533689 - RNA, 23 nt, Human
agugcaguggcauaaucuuggcu

SEQ ID NO: 533690 - RNA, 24 nt, Human
agugcaguggcauaaucuuggcuc

SEQ ID NO: 533691 - RNA, 19 nt, Human
agugcccaccaccacgccc

SEQ ID NO: 533692 - RNA, 18 nt, Human
auagcucauugcaacuuc

SEQ ID NO: 533693 - RNA, 24 nt, Human
auccaugggauggaaauaaaagga

SEQ ID NO: 533694 - RNA, 20 nt, Human
aucucacucuguugcccagg

SEQ ID NO: 533695 - RNA, 19 nt, Human
auguugcccaggcuagucu

SEQ ID NO: 533696 - RNA, 23 nt, Human
caaagaaucgccaucaucagcac

SEQ ID NO: 533697 - RNA, 24 nt, Human
caaagcgcuaggauuacaggugug

SEQ ID NO: 533698 - RNA, 24 nt, Human
caaaguguuggaauuacaggugug

SEQ ID NO: 533699 - RNA, 24 nt, Human
caacuucaaacuccugggcuugag

SEQ ID NO: 533700 - RNA, 28 nt, Human
caagcaauccucccgccucugccuccca

SEQ ID NO: 533701 - RNA, 20 nt, Human
caagcgauucuccugccuca

SEQ ID NO: 533702 - RNA, 22 nt, Human
caagcgauucuccugccucagc

SEQ ID NO: 533703 - RNA, 24 nt, Human
caccacgcccggcuaauuuuugua

SEQ ID NO: 533704 - RNA, 23 nt, Human
cacccaccgcggccucccaaagc

SEQ ID NO: 533705 - RNA, 23 nt, Human
cacccaggcugaagugcaguggc

SEQ ID NO: 533706 - RNA, 24 nt, Human
caccucagccucccaaguagcuag

SEQ ID NO: 533707 - RNA, 24 nt, Human
cacucuguugcccaggcuagaaug

SEQ ID NO: 533708 - RNA, 18 nt, Human
cacugcaaccucugccuc

SEQ ID NO: 533709 - RNA, 21 nt, Human
cacugcaaccucugccuccca

SEQ ID NO: 533710 - RNA, 20 nt, Human
cagccucuugaguaccuggg

SEQ ID NO: 533711 - RNA, 24 nt, Human
caggaucucacucuguugcccagg

SEQ ID NO: 533712 - RNA, 20 nt, Human
caggugauccacccaccgcg

SEQ ID NO: 533713 - RNA, 21 nt, Human
caggugcacaccauuacaccu

SEQ ID NO: 533714 - RNA, 22 nt, Human
cagucucgcuauguugcccagg

SEQ ID NO: 533715 - RNA, 21 nt, Human
cauccaaagaaucgccaucau

SEQ ID NO: 533716 - RNA, 24 nt, Human
cauguuggccaggcuggucucgaa

SEQ ID NO: 533717 - RNA, 21 nt, Human
cauugcaacuucaaacuccug

SEQ ID NO: 533718 - RNA, 21 nt, Human
ccaaagcgcuaggauuacagg

SEQ ID NO: 533719 - RNA, 24 nt, Human
ccaaagcgcuaggauuacaggugu

SEQ ID NO: 533720 - RNA, 21 nt, Human
ccaaaguguuggaauuacagg

SEQ ID NO: 533721 - RNA, 24 nt, Human
ccaaaguguuggaauuacaggugu

SEQ ID NO: 533722 - RNA, 19 nt, Human
ccacagucauugguuaggu

SEQ ID NO: 533723 - RNA, 24 nt, Human
ccagugcccaccaccacgcccggc

SEQ ID NO: 533724 - RNA, 23 nt, Human
cccaccucagccucccaaguagc

SEQ ID NO: 533725 - RNA, 20 nt, Human
cccagguucaagcgauucuc

SEQ ID NO: 533726 - RNA, 23 nt, Human
cccagguucaagcgauucuccug

SEQ ID NO: 533727 - RNA, 24 nt, Human
ccgccucugccucccaaaguguug

SEQ ID NO: 533728 - RNA, 24 nt, Human
ccucccagguucaagcgauucucc

SEQ ID NO: 533729 - RNA, 19 nt, Human
ccucccgccucugccuccc

SEQ ID NO: 533730 - RNA, 22 nt, Human
ccucccgccucugccucccaaa

SEQ ID NO: 533731 - RNA, 24 nt, Human
ccugaccucaggugauccacccac

SEQ ID NO: 533732 - RNA, 24 nt, Human
cgcuaggauuacaggugugagcca

SEQ ID NO: 533733 - RNA, 20 nt, Human
cgcuauguugcccaggcuag

SEQ ID NO: 533734 - RNA, 27 nt, Human
cgcuauguugcccaggcuagucuugaa

SEQ ID NO: 533735 - RNA, 20 nt, Human
cggccucaagcaauccuccc

SEQ ID NO: 533736 - RNA, 24 nt, Human
cggccucaagcaauccucccgccu

SEQ ID NO: 533737 - RNA, 24 nt, Human
cgggguuuaaccauguuggccagg

SEQ ID NO: 533738 - RNA, 25 nt, Human
cuagagguccuuucaaggucucuuc

SEQ ID NO: 533739 - RNA, 24 nt, Human
cucaagcaauccucccgccucugc

SEQ ID NO: 533740 - RNA, 24 nt, Human
cucacugcaaccucugccucccag

SEQ ID NO: 533741 - RNA, 24 nt, Human
cucacugcaaccucugccucccag

SEQ ID NO: 533742 - RNA, 24 nt, Human
cucccaaguagcuaggaucacagg

SEQ ID NO: 533743 - RNA, 21 nt, Human
cuccugggcuugagcaauucu

SEQ ID NO: 533744 - RNA, 23 nt, Human
cuccugggcuugagcaauucucc

SEQ ID NO: 533745 - RNA, 23 nt, Human
cugcaaccucugccucccagguu

SEQ ID NO: 533746 - RNA, 24 nt, Human
cugcaaccucugccucccagguuc

SEQ ID NO: 533747 - RNA, 23 nt, Human
cugccucagccucuugaguaccu

SEQ ID NO: 533748 - RNA, 20 nt, Human
cuucuuauuuauuuauuugg

SEQ ID NO: 533749 - RNA, 24 nt, Human
cuugagcaauucucccaccucagc

SEQ ID NO: 533750 - RNA, 23 nt, Human
cuugaguaccugggauuaccagu

SEQ ID NO: 533751 - RNA, 22 nt, Human
gaccucaggugauccacccacc

SEQ ID NO: 533752 - RNA, 25 nt, Human
gagcaauucucccaccucagccucc

SEQ ID NO: 533753 - RNA, 18 nt, Human
gauuacaggugugagcca

SEQ ID NO: 533754 - RNA, 22 nt, Human
gauuacaggugugagccacggc

SEQ ID NO: 533755 - RNA, 22 nt, Human
gcaaccucugccucccagguuc

SEQ ID NO: 533756 - RNA, 20 nt, Human
gcaacuucaaacuccugggc

SEQ ID NO: 533757 - RNA, 23 nt, Human
gccucugccucccaaaguguugg

SEQ ID NO: 533758 - RNA, 22 nt, Human
gcgauucuccugccucagccuc

SEQ ID NO: 533759 - RNA, 21 nt, Human
gcucacugcaaccucugccuc

SEQ ID NO: 533760 - RNA, 25 nt, Human
gcucugucacccaggcugaagugca

SEQ ID NO: 533761 - RNA, 19 nt, Human
gcugaagugcaguggcaua

SEQ ID NO: 533762 - RNA, 23 nt, Human
gcuggucucgaacuccugaccuc

SEQ ID NO: 533763 - RNA, 19 nt, Human
ggaucacaggugcacacca

SEQ ID NO: 533764 - RNA, 24 nt, Human
ggauuacaggugugagccacggcg

SEQ ID NO: 533765 - RNA, 19 nt, Human
ggcaacugcucuucuuauu

SEQ ID NO: 533766 - RNA, 24 nt, Human
ggcuggucucgaacuccugaccuc

SEQ ID NO: 533767 - RNA, 18 nt, Human
gggauggaaauaaaagga

SEQ ID NO: 533768 - RNA, 23 nt, Human
gggguuuaaccauguuggccagg

SEQ ID NO: 533769 - RNA, 19 nt, Human
ggucucgaacuccugaccu

SEQ ID NO: 533770 - RNA, 23 nt, Human
guagagacgggguuuaaccaugu

SEQ ID NO: 533771 - RNA, 24 nt, Human
gugauccacccaccgcggccuccc

SEQ ID NO: 533772 - RNA, 23 nt, Human
guggugaaaucauagcucauugc

SEQ ID NO: 533773 - RNA, 26 nt, Human
uaauuuuuguacuauuuuaguagaga

SEQ ID NO: 533774 - RNA, 24 nt, Human
uacaggugugagccacggcgccca

SEQ ID NO: 533775 - RNA, 19 nt, Human
uacaggugugagccauugc

SEQ ID NO: 533776 - RNA, 24 nt, Human
uaccacaaaacaguaauauuauca

SEQ ID NO: 533777 - RNA, 18 nt, Human
uaggauuacaggugugag

SEQ ID NO: 533778 - RNA, 19 nt, Human
uaggauuacaggugugagc

SEQ ID NO: 533779 - RNA, 21 nt, Human
uaggauuacaggugugagcca

SEQ ID NO: 533780 - RNA, 22 nt, Human
uaggauuacaggugugagccac

SEQ ID NO: 533781 - RNA, 22 nt, Human
uaggauuacaggugugagccac

SEQ ID NO: 533782 - RNA, 24 nt, Human
uaguagagacgggguuuaaccaug

SEQ ID NO: 533783 - RNA, 20 nt, Human
uauguugcccaggcuagucu

SEQ ID NO: 533784 - RNA, 24 nt, Human
uauguugcccaggcuagucuugaa

SEQ ID NO: 533785 - RNA, 19 nt, Human
ucacugcaaccucugccuc

SEQ ID NO: 533786 - RNA, 24 nt, Human
ucacugcaaccucugccucccagg

SEQ ID NO: 533787 - RNA, 25 nt, Human
ucacugcaaccucugccucccaggu

SEQ ID NO: 533788 - RNA, 20 nt, Human
ucagccucccaaguagcuag

SEQ ID NO: 533789 - RNA, 24 nt, Human
ucauugcaacuucaaacuccuggg

SEQ ID NO: 533790 - RNA, 23 nt, Human
ucccaaagcgcuaggauuacagg

SEQ ID NO: 533791 - RNA, 23 nt, Human
ucccaaaguguuggaauuacagg

SEQ ID NO: 533792 - RNA, 21 nt, Human
ucccagguucaagcgauucuc

SEQ ID NO: 533793 - RNA, 24 nt, Human
ucccagguucaagcgauucuccug

SEQ ID NO: 533794 - RNA, 23 nt, Human
uccucccgccucugccucccaaa

SEQ ID NO: 533795 - RNA, 21 nt, Human
uccugggcuugagcaauucuc

SEQ ID NO: 533796 - RNA, 23 nt, Human
uccugggcuugagcaauucuccc

SEQ ID NO: 533797 - RNA, 18 nt, Human
ucggccucaagcaauccu

SEQ ID NO: 533798 - RNA, 19 nt, Human
ucucacucuguugcccagg

SEQ ID NO: 533799 - RNA, 21 nt, Human
ucucacucuguugcccaggcu

SEQ ID NO: 533800 - RNA, 23 nt, Human
ucucacucuguugcccaggcuag

SEQ ID NO: 533801 - RNA, 24 nt, Human
ucucacucuguugcccaggcuaga

SEQ ID NO: 533802 - RNA, 26 nt, Human
ucucacucuguugcccaggcuagaau

SEQ ID NO: 533803 - RNA, 27 nt, Human
ucucacucuguugcccaggcuagaaug

SEQ ID NO: 533804 - RNA, 23 nt, Human
ucucccaccucagccucccaagu

SEQ ID NO: 533805 - RNA, 26 nt, Human
ucucccaccucagccucccaaguagc

SEQ ID NO: 533806 - RNA, 23 nt, Human
ucucgaacuccugaccucaggug

SEQ ID NO: 533807 - RNA, 19 nt, Human
ucucgcuauguugcccagg

SEQ ID NO: 533808 - RNA, 26 nt, Human
ucucgcuauguugcccaggcuagucu

SEQ ID NO: 533809 - RNA, 27 nt, Human
ucucgcuauguugcccaggcuagucuu

SEQ ID NO: 533810 - RNA, 23 nt, Human
ucugcauaaccaagaaggaaacu

SEQ ID NO: 533811 - RNA, 24 nt, Human
ucugucacccaggcugaagugcag

SEQ ID NO: 533812 - RNA, 18 nt, Human
ucuguugcccaggcuaga

SEQ ID NO: 533813 - RNA, 24 nt, Human
ucuguugcccaggcuagaaugcag

SEQ ID NO: 533814 - RNA, 23 nt, Human
ucuuauuuauuuauuugagucag

SEQ ID NO: 533815 - RNA, 24 nt, Human
ucuugaguaccugggauuaccagu

SEQ ID NO: 533816 - RNA, 19 nt, Human
ucuugcucugucacccagg

SEQ ID NO: 533817 - RNA, 23 nt, Human
ucuugcucugucacccaggcuga

SEQ ID NO: 533818 - RNA, 24 nt, Human
ucuugcucugucacccaggcugaa

SEQ ID NO: 533819 - RNA, 21 nt, Human
ugaaaucauagcucauugcaa

SEQ ID NO: 533820 - RNA, 24 nt, Human
ugaacccucggccucaagcaaucc

SEQ ID NO: 533821 - RNA, 24 nt, Human
ugaagugcaguggcauaaucuugg

SEQ ID NO: 533822 - RNA, 20 nt, Human
ugaauaaguacuauguggua

SEQ ID NO: 533823 - RNA, 19 nt, Human
ugaccucaggugauccacc

SEQ ID NO: 533824 - RNA, 21 nt, Human
ugaccucaggugauccaccca

SEQ ID NO: 533825 - RNA, 23 nt, Human
ugagauaagagucuugcucuguc

SEQ ID NO: 533826 - RNA, 27 nt, Human
ugagcaauucucccaccucagccuccc

SEQ ID NO: 533827 - RNA, 21 nt, Human
ugagccacggcgcccaaccca

SEQ ID NO: 533828 - RNA, 21 nt, Human
ugauaauacuacaauauccuc

SEQ ID NO: 533829 - RNA, 20 nt, Human
ugauguauguaauuucccuc

SEQ ID NO: 533830 - RNA, 24 nt, Human
ugcagucucgcuauguugcccagg

SEQ ID NO: 533831 - RNA, 22 nt, Human
ugcaguggcauaaucuuggcuc

SEQ ID NO: 533832 - RNA, 21 nt, Human
ugcccaggcuagaaugcagug

SEQ ID NO: 533833 - RNA, 24 nt, Human
ugcccaggcuagaaugcaguggug

SEQ ID NO: 533834 - RNA, 23 nt, Human
ugcccaggcuagucuugaacccu

SEQ ID NO: 533835 - RNA, 24 nt, Human
ugccucagccucuugaguaccugg

SEQ ID NO: 533836 - RNA, 24 nt, Human
ugcucugucacccaggcugaagug

SEQ ID NO: 533837 - RNA, 18 nt, Human
uggaaugauuuaaguggg

SEQ ID NO: 533838 - RNA, 19 nt, Human
uggaauuacaggugugagc

SEQ ID NO: 533839 - RNA, 21 nt, Human
uggaauuacaggugugagcca

SEQ ID NO: 533840 - RNA, 21 nt, Human
uggaauuacaggugugagcca

SEQ ID NO: 533841 - RNA, 22 nt, Human
uggaauuacaggugugagccau

SEQ ID NO: 533842 - RNA, 24 nt, Human
uggaauuacaggugugagccauug

SEQ ID NO: 533843 - RNA, 24 nt, Human
uggaauuacaggugugagccauug

SEQ ID NO: 533844 - RNA, 24 nt, Human
uggccaggcuggucucgaacuccu

SEQ ID NO: 533845 - RNA, 24 nt, Human
ugggauuaccagugcccaccacca

SEQ ID NO: 533846 - RNA, 21 nt, Human
ugugagccauugcacagggcc

SEQ ID NO: 533847 - RNA, 19 nt, Human
ugugcagaaguagcauuac

SEQ ID NO: 533848 - RNA, 18 nt, Human
uuaguagagacgggguuu

SEQ ID NO: 533849 - RNA, 24 nt, Human
uuaguagagacgggguuuaaccau

SEQ ID NO: 533850 - RNA, 21 nt, Human
uucaagcgauucuccugccuc

SEQ ID NO: 533851 - RNA, 23 nt, Human
uucaagcgauucuccugccucag

SEQ ID NO: 533852 - RNA, 24 nt, Human
uucaagcgauucuccugccucagc

SEQ ID NO: 533853 - RNA, 23 nt, Human
uucccauccaaagaaucgccauc

SEQ ID NO: 533854 - RNA, 24 nt, Human
uuguagagaugcagucucgcuaug

SEQ ID NO: 533855 - RNA, 24 nt, Human
uuuaaccauguuggccaggcuggu

SEQ ID NO: 533856 - RNA, 21 nt, Human
uuucaaggucucuucccaucc

SEQ ID NO: 533857 - RNA, 24 nt, Human
uuuguagagaugcagucucgcuau

SEQ ID NO: 533858 - RNA, 22 nt, Human
uuuuuguacuauuuuaguagag

SEQ ID NO: 533859 - RNA, 25 nt, Human
uuuuuguacuauuuuaguagagacg

SEQ ID NO: 533860 - RNA, 24 nt, Human
uuuuuuguagagaugcagucucgc

SEQ ID NO: 533861 - RNA, 22 nt, Human
uuuuuuuuuuuuaaauguucuc

SEQ ID NO: 533862 - RNA, 23 nt, Human
uuuuuuuuuuuuuuuuuuaaaug

SEQ ID NO: 533863 - RNA, 22 nt, Human
aagacaauuucuaaggauuuau

SEQ ID NO: 533864 - RNA, 19 nt, Human
aagcugauuucuuuuucuc

SEQ ID NO: 533865 - RNA, 24 nt, Human
agaauugcaaggccuuuagccuuc

SEQ ID NO: 533866 - RNA, 25 nt, Human
agacagaauugcaaggccuuuagcc

SEQ ID NO: 533867 - RNA, 25 nt, Human
agcacaauuuguccuuccagucacu

SEQ ID NO: 533868 - RNA, 25 nt, Human
agcaggaaugaucuuaucaggucca

SEQ ID NO: 533869 - RNA, 20 nt, Human
aguaaaaggauggagaaaga

SEQ ID NO: 533870 - RNA, 18 nt, Human
auggaaggcagccagggc

SEQ ID NO: 533871 - RNA, 27 nt, Human
caagauucucaaauuaaaacacagcua

SEQ ID NO: 533872 - RNA, 25 nt, Human
cagccagggcaaugcucagagggaa

SEQ ID NO: 533873 - RNA, 21 nt, Human
ccacuacaaucccgcugccuc

SEQ ID NO: 533874 - RNA, 18 nt, Human
ccgcugccuccucuggca

SEQ ID NO: 533875 - RNA, 19 nt, Human
ccgcugccuccucuggcag

SEQ ID NO: 533876 - RNA, 19 nt, Human
ccuacaacucuaaacauua

SEQ ID NO: 533877 - RNA, 23 nt, Human
cuaguaaauccugucaguguaga

SEQ ID NO: 533878 - RNA, 21 nt, Human
cugagacucaaauugcugcac

SEQ ID NO: 533879 - RNA, 22 nt, Human
cuguaaaugugucucaauuccu

SEQ ID NO: 533880 - RNA, 22 nt, Human
cuuagcgauguuugaaguguuc

SEQ ID NO: 533881 - RNA, 18 nt, Human
gaauugaaauuuguggcu

SEQ ID NO: 533882 - RNA, 24 nt, Human
gauugacaguaaaaggauggagaa

SEQ ID NO: 533883 - RNA, 18 nt, Human
gcagccuuuuuugcuucu

SEQ ID NO: 533884 - RNA, 21 nt, Human
gcuggaguggcacuccacacu

SEQ ID NO: 533885 - RNA, 19 nt, Human
ggcagccuuuuuugcuucu

SEQ ID NO: 533886 - RNA, 23 nt, Human
gguauaaagacaauuucuaagga

SEQ ID NO: 533887 - RNA, 21 nt, Human
uaaauccugucaguguagaaa

SEQ ID NO: 533888 - RNA, 19 nt, Human
uaagaaagcuggaguggca

SEQ ID NO: 533889 - RNA, 18 nt, Human
uacauacggaauggaaau

SEQ ID NO: 533890 - RNA, 18 nt, Human
uacccucaagauucucaa

SEQ ID NO: 533891 - RNA, 24 nt, Human
uaccuacaacucuaaacauuacuu

SEQ ID NO: 533892 - RNA, 24 nt, Human
uacugagacucaaauugcugcaca

SEQ ID NO: 533893 - RNA, 22 nt, Human
uagccccauaaggaagaaaagu

SEQ ID NO: 533894 - RNA, 22 nt, Human
uauuucugugaauucucuuaau

SEQ ID NO: 533895 - RNA, 26 nt, Human
ucaauuccuauuucaaauccuccacc

SEQ ID NO: 533896 - RNA, 26 nt, Human
ucacuguugauagacaauuggguugu

SEQ ID NO: 533897 - RNA, 21 nt, Human
ucuaugacacaguaaguguga

SEQ ID NO: 533898 - RNA, 23 nt, Human
ucucaaauuaaaacacagcuacc

SEQ ID NO: 533899 - RNA, 23 nt, Human
ucuuuuacauacggaauggaaau

SEQ ID NO: 533900 - RNA, 19 nt, Human
ugacacaguaagugugaua

SEQ ID NO: 533901 - RNA, 20 nt, Human
ugccauauguuuaaagacau

SEQ ID NO: 533902 - RNA, 18 nt, Human
uggaaggcagccagggca

SEQ ID NO: 533903 - RNA, 21 nt, Human
uggacauagcacaauuugucc

SEQ ID NO: 533904 - RNA, 19 nt, Human
uggcaaccuaagaaagcug

SEQ ID NO: 533905 - RNA, 23 nt, Human
uuaauauuuuggcagccuuuuuu

SEQ ID NO: 533906 - RNA, 24 nt, Human
uugacaguaaaaggauggagaaag

SEQ ID NO: 533907 - RNA, 22 nt, Human
uuggcagccuuuuuugcuucug

SEQ ID NO: 533908 - RNA, 25 nt, Human
aaacaggcacaugcccuaccagggg

SEQ ID NO: 533909 - RNA, 18 nt, Human
accaggggggcagcuccc

SEQ ID NO: 533910 - RNA, 25 nt, Human
accccuccccacaaaaagaacccca

SEQ ID NO: 533911 - RNA, 22 nt, Human
agaaggggagccugagacucug

SEQ ID NO: 533912 - RNA, 19 nt, Human
agacucugggagcagaaau

SEQ ID NO: 533913 - RNA, 20 nt, Human
agacucugggagcagaaaug

SEQ ID NO: 533914 - RNA, 18 nt, Human
agaguuguucuucccggu

SEQ ID NO: 533915 - RNA, 19 nt, Human
agcgcccgcccggcugcug

SEQ ID NO: 533916 - RNA, 21 nt, Human
aggaaaagaaauccuaagaau

SEQ ID NO: 533917 - RNA, 18 nt, Human
agggcuggcacacccauu

SEQ ID NO: 533918 - RNA, 19 nt, Human
aggggagccugagacucug

SEQ ID NO: 533919 - RNA, 25 nt, Human
cacaaaaagaaccccacaaucaaau

SEQ ID NO: 533920 - RNA, 23 nt, Human
cacccccgccaacuagcugagag

SEQ ID NO: 533921 - RNA, 25 nt, Human
caccccuccccacaaaaagaacccc

SEQ ID NO: 533922 - RNA, 24 nt, Human
cacugcaguggcggaggaaaagaa

SEQ ID NO: 533923 - RNA, 23 nt, Human
cagccuccaggcugagagggaaa

SEQ ID NO: 533924 - RNA, 20 nt, Human
cagugcuaagagccaggcca

SEQ ID NO: 533925 - RNA, 20 nt, Human
caucucuggcucuuggaaau

SEQ ID NO: 533926 - RNA, 22 nt, Human
caucucuggcucuuggaaaucu

SEQ ID NO: 533927 - RNA, 21 nt, Human
ccacaaucaaauuaagagacc

SEQ ID NO: 533928 - RNA, 19 nt, Human
ccaguccagcacccccgcc

SEQ ID NO: 533929 - RNA, 26 nt, Human
cccuccccacaaaaagaaccccacaa

SEQ ID NO: 533930 - RNA, 20 nt, Human
ccuccccacaaaaagaaccc

SEQ ID NO: 533931 - RNA, 18 nt, Human
ccucccuccucuccuggg

SEQ ID NO: 533932 - RNA, 19 nt, Human
ccugagacucugggagcag

SEQ ID NO: 533933 - RNA, 20 nt, Human
ccugagacucugggagcaga

SEQ ID NO: 533934 - RNA, 21 nt, Human
cuccgacccugacacuggccu

SEQ ID NO: 533935 - RNA, 19 nt, Human
cuggaugcuuggcagaguc

SEQ ID NO: 533936 - RNA, 23 nt, Human
cuuggaggugucccacauggguc

SEQ ID NO: 533937 - RNA, 18 nt, Human
gacuggcuugccucccuc

SEQ ID NO: 533938 - RNA, 23 nt, Human
gagaggcacagugacccuaggag

SEQ ID NO: 533939 - RNA, 21 nt, Human
gaggaggccagccuuggaggu

SEQ ID NO: 533940 - RNA, 24 nt, Human
gaugcagcacaauucaucucuggg

SEQ ID NO: 533941 - RNA, 20 nt, Human
gcaaggguggccaagcgugc

SEQ ID NO: 533942 - RNA, 20 nt, Human
gcuccucagccaaauuccug

SEQ ID NO: 533943 - RNA, 21 nt, Human
ggagauguccagccagccucc

SEQ ID NO: 533944 - RNA, 18 nt, Human
ggccacuccgacccugac

SEQ ID NO: 533945 - RNA, 19 nt, Human
guccagcacccccgccaac

SEQ ID NO: 533946 - RNA, 18 nt, Human
uaaagugaacaagagucc

SEQ ID NO: 533947 - RNA, 21 nt, Human
uaagagacccacuguggccca

SEQ ID NO: 533948 - RNA, 21 nt, Human
uaccaccccuccccacaaaaa

SEQ ID NO: 533949 - RNA, 18 nt, Human
uagcuugacuuagucauc

SEQ ID NO: 533950 - RNA, 24 nt, Human
uaugaggaggccagccuuggaggu

SEQ ID NO: 533951 - RNA, 18 nt, Human
ucacugcaguggcggagg

SEQ ID NO: 533952 - RNA, 18 nt, Human
uccaggcugagagggaaa

SEQ ID NO: 533953 - RNA, 20 nt, Human
ucuccugggccuagcgaggc

SEQ ID NO: 533954 - RNA, 20 nt, Human
ugagagaagcucaggaagua

SEQ ID NO: 533955 - RNA, 24 nt, Human
ugagaggcacagugacccuaggag

SEQ ID NO: 533956 - RNA, 24 nt, Human
uggcagaagguaaagugaacaaga

SEQ ID NO: 533957 - RNA, 21 nt, Human
uggcggaggaaaagaaauccu

SEQ ID NO: 533958 - RNA, 21 nt, Human
uggggagagaagaguucugca

SEQ ID NO: 533959 - RNA, 20 nt, Human
uuauaccaccccuccccaca

SEQ ID NO: 533960 - RNA, 18 nt, Human
uuggaggugucccacaug

SEQ ID NO: 533961 - RNA, 23 nt, Human
aaacaaaaaggagaaacuccugg

SEQ ID NO: 533962 - RNA, 24 nt, Human
aaacaaaaaggagaaacuccugga

SEQ ID NO: 533963 - RNA, 23 nt, Human
aaagacccucucgggccggagcc

SEQ ID NO: 533964 - RNA, 22 nt, Human
acaaaaaggagaaacuccugga

SEQ ID NO: 533965 - RNA, 23 nt, Human
acaaaaaggagaaacuccuggau

SEQ ID NO: 533966 - RNA, 19 nt, Human
agagcugcuucucucugcc

SEQ ID NO: 533967 - RNA, 25 nt, Human
agccuuggcggucagcccagagcug

SEQ ID NO: 533968 - RNA, 19 nt, Human
ccccagcagguccagggcu

SEQ ID NO: 533969 - RNA, 24 nt, Human
cuaaagcaucuauuggagcaauua

SEQ ID NO: 533970 - RNA, 22 nt, Human
cuccuggauuuguugcagaaaa

SEQ ID NO: 533971 - RNA, 22 nt, Human
ggagcggggucuugaagacugg

SEQ ID NO: 533972 - RNA, 21 nt, Human
gggcauugucucucacggaug

SEQ ID NO: 533973 - RNA, 19 nt, Human
uacuccacuuaaagacccu

SEQ ID NO: 533974 - RNA, 21 nt, Human
uauaaaacaaaaaggagaaac

SEQ ID NO: 533975 - RNA, 22 nt, Human
uauucuucaauauuuucugaga

SEQ ID NO: 533976 - RNA, 23 nt, Human
ugccuggaaacugggccauggag

SEQ ID NO: 533977 - RNA, 23 nt, Human
ugggagcggggucuugaagacug

SEQ ID NO: 533978 - RNA, 19 nt, Human
uuggcggucagcccagagc

SEQ ID NO: 533979 - RNA, 21 nt, Human
uuucgugguugcacaccuggg

SEQ ID NO: 533980 - RNA, 26 nt, Human
aagccccccucccccgcuaccccucc

SEQ ID NO: 533981 - RNA, 19 nt, Human
aagggcuggauggacaugg

SEQ ID NO: 533982 - RNA, 22 nt, Human
accguggguggggggccugggu

SEQ ID NO: 533983 - RNA, 19 nt, Human
agagggaaaggcagggggc

SEQ ID NO: 533984 - RNA, 22 nt, Human
aggcagggggcgggguucccug

SEQ ID NO: 533985 - RNA, 20 nt, Human
agggagugccgggaggaggg

SEQ ID NO: 533986 - RNA, 19 nt, Human
aggggagagggaaaggcag

SEQ ID NO: 533987 - RNA, 24 nt, Human
aggggaggaccguggguggggggc

SEQ ID NO: 533988 - RNA, 24 nt, Human
agggggggugucuccaagggggcu

SEQ ID NO: 533989 - RNA, 19 nt, Human
auggaacccggacuaggga

SEQ ID NO: 533990 - RNA, 22 nt, Human
auuucugucccccccggacccc

SEQ ID NO: 533991 - RNA, 20 nt, Human
caggaucccgccugcucccc

SEQ ID NO: 533992 - RNA, 18 nt, Human
caugcuggggacccaggc

SEQ ID NO: 533993 - RNA, 20 nt, Human
ccaagugccggagaugcccc

SEQ ID NO: 533994 - RNA, 19 nt, Human
cccaggaucccgccugcuc

SEQ ID NO: 533995 - RNA, 20 nt, Human
cccccccggaccccgaccuc

SEQ ID NO: 533996 - RNA, 23 nt, Human
cccccgcuaccccuccccuuucc

SEQ ID NO: 533997 - RNA, 20 nt, Human
cccccggaccccgaccaugg

SEQ ID NO: 533998 - RNA, 21 nt, Human
cccccuacggaggacgggggu

SEQ ID NO: 533999 - RNA, 23 nt, Human
cccccuucugaagccccccuccu

SEQ ID NO: 534000 - RNA, 22 nt, Human
ccccuccccuuuccuggaaccc

SEQ ID NO: 534001 - RNA, 21 nt, Human
cccgcuaccccuccccuuucc

SEQ ID NO: 534002 - RNA, 19 nt, Human
cccucccccgcuaccccuc

SEQ ID NO: 534003 - RNA, 24 nt, Human
cccugcaaugggcccggcuagacc

SEQ ID NO: 534004 - RNA, 23 nt, Human
ccggaccccgaccauggcuugug

SEQ ID NO: 534005 - RNA, 20 nt, Human
ccuccccuuuccuggaaccc

SEQ ID NO: 534006 - RNA, 21 nt, Human
ccuggaaccccguaucucggg

SEQ ID NO: 534007 - RNA, 26 nt, Human
ccuggggcuagggcauggugcggggc

SEQ ID NO: 534008 - RNA, 20 nt, Human
cgagggaaaggucuauggug

SEQ ID NO: 534009 - RNA, 22 nt, Human
cgcccgggguuccgcgucgcuc

SEQ ID NO: 534010 - RNA, 21 nt, Human
cgcuaccccuccccuuuccug

SEQ ID NO: 534011 - RNA, 24 nt, Human
cgggggugggggagaggugucaca

SEQ ID NO: 534012 - RNA, 21 nt, Human
cucccgggucggcggcugaag

SEQ ID NO: 534013 - RNA, 23 nt, Human
cucgggguggggggggggaagga

SEQ ID NO: 534014 - RNA, 20 nt, Human
gaaaaaggggaggaccgugg

SEQ ID NO: 534015 - RNA, 18 nt, Human
gaaaccacggagucgggg

SEQ ID NO: 534016 - RNA, 20 nt, Human
gaccauggcuugugaacccc

SEQ ID NO: 534017 - RNA, 18 nt, Human
gagggacccaggaucccg

SEQ ID NO: 534018 - RNA, 19 nt, Human
gaucugggguguucccccc

SEQ ID NO: 534019 - RNA, 22 nt, Human
gcacagugagguugcaggcggu

SEQ ID NO: 534020 - RNA, 19 nt, Human
gcaguggaggugacuggug

SEQ ID NO: 534021 - RNA, 18 nt, Human
gccaagaaaauccauuuc

SEQ ID NO: 534022 - RNA, 23 nt, Human
gcuuuugggagggggggugucuc

SEQ ID NO: 534023 - RNA, 20 nt, Human
ggaggugacuggugggaggg

SEQ ID NO: 534024 - RNA, 20 nt, Human
ggagguggggaguugaaugg

SEQ ID NO: 534025 - RNA, 24 nt, Human
ggagguggggaguugaaugggagg

SEQ ID NO: 534026 - RNA, 22 nt, Human
ggagugccgggaggaggggcgg

SEQ ID NO: 534027 - RNA, 24 nt, Human
ggcgaugggugcuggugaaaagaa

SEQ ID NO: 534028 - RNA, 18 nt, Human
ggcucgggggugagacgg

SEQ ID NO: 534029 - RNA, 22 nt, Human
gggaagggcgggggcgaggcuu

SEQ ID NO: 534030 - RNA, 19 nt, Human
gggaaggggaagaccagug

SEQ ID NO: 534031 - RNA, 22 nt, Human
gggggccuggguugcuacauuu

SEQ ID NO: 534032 - RNA, 21 nt, Human
gggggugagacggcccccccu

SEQ ID NO: 534033 - RNA, 22 nt, Human
ggguagggagccggagucccag

SEQ ID NO: 534034 - RNA, 22 nt, Human
ggugaaaagaauggaacccgga

SEQ ID NO: 534035 - RNA, 20 nt, Human
gugucuccaagggggcucgg

SEQ ID NO: 534036 - RNA, 23 nt, Human
guguucccccccuucugaagccc

SEQ ID NO: 534037 - RNA, 22 nt, Human
uagggagugccgggaggagggg

SEQ ID NO: 534038 - RNA, 20 nt, Human
uaggggagagggaaaggcag

SEQ ID NO: 534039 - RNA, 23 nt, Human
uauugucagggagaggaaaaagg

SEQ ID NO: 534040 - RNA, 22 nt, Human
uccuuggucccacccaagugcc

SEQ ID NO: 534041 - RNA, 22 nt, Human
ucggcgaauccugcgaagggga

SEQ ID NO: 534042 - RNA, 23 nt, Human
ucuaggggagagggaaaggcagg

SEQ ID NO: 534043 - RNA, 24 nt, Human
ucuccaagggggcucgggggugag

SEQ ID NO: 534044 - RNA, 21 nt, Human
ucugaagccccccucccccgc

SEQ ID NO: 534045 - RNA, 24 nt, Human
ucugaagccccccucccccgcuac

SEQ ID NO: 534046 - RNA, 18 nt, Human
ugaaugggagggguucag

SEQ ID NO: 534047 - RNA, 20 nt, Human
ugacgauacggaaaccacgg

SEQ ID NO: 534048 - RNA, 21 nt, Human
ugagacggcccccccuuuucu

SEQ ID NO: 534049 - RNA, 21 nt, Human
ugaugggaaggggaagaccag

SEQ ID NO: 534050 - RNA, 21 nt, Human
ugcaaugggcccggcuagacc

SEQ ID NO: 534051 - RNA, 18 nt, Human
ugcaguggaggugacugg

SEQ ID NO: 534052 - RNA, 18 nt, Human
ugccggagaugcccccaa

SEQ ID NO: 534053 - RNA, 21 nt, Human
ugccguagcagaggcaggggc

SEQ ID NO: 534054 - RNA, 21 nt, Human
uggcaucuccuuggucccacc

SEQ ID NO: 534055 - RNA, 20 nt, Human
ugggaaggggaagaccagug

SEQ ID NO: 534056 - RNA, 20 nt, Human
ugggagcccggacgccuggg

SEQ ID NO: 534057 - RNA, 19 nt, Human
ugggaggggacagccauga

SEQ ID NO: 534058 - RNA, 20 nt, Human
ugggagggguucaggguuga

SEQ ID NO: 534059 - RNA, 22 nt, Human
ugggagggguucaggguugagg

SEQ ID NO: 534060 - RNA, 18 nt, Human
uggggaguugaaugggag

SEQ ID NO: 534061 - RNA, 19 nt, Human
uggggggggggaaggagag

SEQ ID NO: 534062 - RNA, 19 nt, Human
ugugaaccccguuuugugc

SEQ ID NO: 534063 - RNA, 19 nt, Human
uucacggaagcgcuucagu

SEQ ID NO: 534064 - RNA, 18 nt, Human
uugcucacaguuuugcgg

SEQ ID NO: 534065 - RNA, 23 nt, Human
uugggguagggagccggaguccc

SEQ ID NO: 534066 - RNA, 21 nt, Human
uuggucccacccaagugccgg

SEQ ID NO: 534067 - RNA, 23 nt, Human
accaccauccuucccagccgugc

SEQ ID NO: 534068 - RNA, 21 nt, Human
caccaccauccuucccagccg

SEQ ID NO: 534069 - RNA, 26 nt, Human
cagggccagcaccgccaugaucuccu

SEQ ID NO: 534070 - RNA, 24 nt, Human
cgccugccgguaauggcccuucuc

SEQ ID NO: 534071 - RNA, 22 nt, Human
cugcagcaaggagaaucacauc

SEQ ID NO: 534072 - RNA, 20 nt, Human
cuggccaccaccauccuucc

SEQ ID NO: 534073 - RNA, 24 nt, Human
cuguccgucagggccagcaccgcc

SEQ ID NO: 534074 - RNA, 18 nt, Human
gccgguaauggcccuucu

SEQ ID NO: 534075 - RNA, 25 nt, Human
guaauggcccuucucuguguuuccc

SEQ ID NO: 534076 - RNA, 21 nt, Human
uaauggcccuucucuguguuu

SEQ ID NO: 534077 - RNA, 23 nt, Human
uccaauacucucugccacgugau

SEQ ID NO: 534078 - RNA, 23 nt, Human
ucggucauuuguauccaauacuc

SEQ ID NO: 534079 - RNA, 19 nt, Human
ugaucucgcuggccacugc

SEQ ID NO: 534080 - RNA, 22 nt, Human
ugccgguaauggcccuucucug

SEQ ID NO: 534081 - RNA, 22 nt, Human
ugucacaggcugcccgcuuuug

SEQ ID NO: 534082 - RNA, 21 nt, Human
aaaagccccaagaggacuucu

SEQ ID NO: 534083 - RNA, 18 nt, Human
aaacaugaagggcuggca

SEQ ID NO: 534084 - RNA, 18 nt, Human
aaacuaaaaagccccaag

SEQ ID NO: 534085 - RNA, 19 nt, Human
aaacugucaacacucuugu

SEQ ID NO: 534086 - RNA, 23 nt, Human
aaagcaaaagguaaacaugaagg

SEQ ID NO: 534087 - RNA, 20 nt, Human
aaagguaaacaugaagggcu

SEQ ID NO: 534088 - RNA, 20 nt, Human
aaaucaccugggguugugac

SEQ ID NO: 534089 - RNA, 19 nt, Human
aacacucuuguuauccuag

SEQ ID NO: 534090 - RNA, 21 nt, Human
aagcagggcuugugcugggcc

SEQ ID NO: 534091 - RNA, 22 nt, Human
acagagaacagaagcugugcag

SEQ ID NO: 534092 - RNA, 25 nt, Human
acagcgguaaaaacagcugacagca

SEQ ID NO: 534093 - RNA, 20 nt, Human
acaggggcccugccucccuu

SEQ ID NO: 534094 - RNA, 19 nt, Human
accaggcagaccccagccc

SEQ ID NO: 534095 - RNA, 21 nt, Human
accaggcagaccccagccccu

SEQ ID NO: 534096 - RNA, 24 nt, Human
acuacaguugugaugaugguggga

SEQ ID NO: 534097 - RNA, 23 nt, Human
agaccccagccccugaaucaaga

SEQ ID NO: 534098 - RNA, 19 nt, Human
agcacaggggccgccucuc

SEQ ID NO: 534099 - RNA, 19 nt, Human
agcauuucuaguuuggagg

SEQ ID NO: 534100 - RNA, 21 nt, Human
agccccugaaucaagagcccu

SEQ ID NO: 534101 - RNA, 25 nt, Human
aggggcucaaggaccaggcagaccc

SEQ ID NO: 534102 - RNA, 23 nt, Human
agguaguaacauuuuacagaugc

SEQ ID NO: 534103 - RNA, 18 nt, Human
auaauaacagcgguaaaa

SEQ ID NO: 534104 - RNA, 25 nt, Human
auagagggccacuucuaaagcuaca

SEQ ID NO: 534105 - RNA, 23 nt, Human
aucaagagcccucuucacccuga

SEQ ID NO: 534106 - RNA, 19 nt, Human
auccauauuggauguggaa

SEQ ID NO: 534107 - RNA, 20 nt, Human
augaggucagaggcaggcac

SEQ ID NO: 534108 - RNA, 23 nt, Human
caagcacaggggccgccucucuu

SEQ ID NO: 534109 - RNA, 18 nt, Human
caaguuuagggauuugcu

SEQ ID NO: 534110 - RNA, 19 nt, Human
caauccaauuauagaguuc

SEQ ID NO: 534111 - RNA, 22 nt, Human
cacagcauucuagaaauccaua

SEQ ID NO: 534112 - RNA, 22 nt, Human
cacagccucugcugagcugagg

SEQ ID NO: 534113 - RNA, 21 nt, Human
cacucagcaaaagcaucagcc

SEQ ID NO: 534114 - RNA, 25 nt, Human
cagaccccagccccugaaucaagag

SEQ ID NO: 534115 - RNA, 21 nt, Human
cagccccugaaucaagagccc

SEQ ID NO: 534116 - RNA, 22 nt, Human
caucgauacuaaaagcugcccc

SEQ ID NO: 534117 - RNA, 23 nt, Human
caugcacaaccacacuuaagccu

SEQ ID NO: 534118 - RNA, 21 nt, Human
cauugccacacacuaugcuaa

SEQ ID NO: 534119 - RNA, 21 nt, Human
ccagccccugaaucaagagcc

SEQ ID NO: 534120 - RNA, 18 nt, Human
ccauuucugaaucagugg

SEQ ID NO: 534121 - RNA, 22 nt, Human
cccaacaccaccaacuuuggau

SEQ ID NO: 534122 - RNA, 23 nt, Human
cccaacaccaccaacuuuggauu

SEQ ID NO: 534123 - RNA, 22 nt, Human
ccccaaacaggcaaauuuuacc

SEQ ID NO: 534124 - RNA, 24 nt, Human
ccccagccccugaaucaagagccc

SEQ ID NO: 534125 - RNA, 23 nt, Human
cccccugcuuucccaacaccacc

SEQ ID NO: 534126 - RNA, 19 nt, Human
ccccugcuuucccaacacc

SEQ ID NO: 534127 - RNA, 19 nt, Human
cccuuagcgcacucagcaa

SEQ ID NO: 534128 - RNA, 21 nt, Human
ccucuguuccucuuuugaggc

SEQ ID NO: 534129 - RNA, 22 nt, Human
ccucuguuccucuuuugaggcc

SEQ ID NO: 534130 - RNA, 24 nt, Human
ccuggaucacagaccuaaugaccg

SEQ ID NO: 534131 - RNA, 20 nt, Human
ccuguggggccucuuguggg

SEQ ID NO: 534132 - RNA, 19 nt, Human
cucgcagcaccucuguucc

SEQ ID NO: 534133 - RNA, 23 nt, Human
cucugcucccuguggggccucuu

SEQ ID NO: 534134 - RNA, 18 nt, Human
cugaaccauuuggccagc

SEQ ID NO: 534135 - RNA, 22 nt, Human
cugcaauguuccccccaggacg

SEQ ID NO: 534136 - RNA, 23 nt, Human
cugcucccuguggggccucuugu

SEQ ID NO: 534137 - RNA, 24 nt, Human
cuggaggcccucuaggagucugag

SEQ ID NO: 534138 - RNA, 18 nt, Human
cugguggaagccauagau

SEQ ID NO: 534139 - RNA, 18 nt, Human
cuuugaccggaccaaauc

SEQ ID NO: 534140 - RNA, 25 nt, Human
cuuuuggguggccuaggcuaccuug

SEQ ID NO: 534141 - RNA, 22 nt, Human
gaagggcuggcauggagcuggg

SEQ ID NO: 534142 - RNA, 23 nt, Human
gacacugggaucaacacguaagc

SEQ ID NO: 534143 - RNA, 19 nt, Human
gaccauguuguaccacagc

SEQ ID NO: 534144 - RNA, 23 nt, Human
gagacucaacacuaauuggaaug

SEQ ID NO: 534145 - RNA, 20 nt, Human
gagaucugccagcaucucaa

SEQ ID NO: 534146 - RNA, 23 nt, Human
gaguucuguaugagaacuagaac

SEQ ID NO: 534147 - RNA, 24 nt, Human
gcaauguuccccccaggacggcag

SEQ ID NO: 534148 - RNA, 22 nt, Human
gcguugcaagcacaggggccgc

SEQ ID NO: 534149 - RNA, 20 nt, Human
ggacacaugucccccugcuu

SEQ ID NO: 534150 - RNA, 23 nt, Human
ggcagaaacuaaaaagccccaag

SEQ ID NO: 534151 - RNA, 19 nt, Human
ggcaggcacuuugcccaca

SEQ ID NO: 534152 - RNA, 19 nt, Human
ggccucuugugggauaugc

SEQ ID NO: 534153 - RNA, 18 nt, Human
ggcuggcauggagcuggg

SEQ ID NO: 534154 - RNA, 19 nt, Human
gggcucaaggaccaggcag

SEQ ID NO: 534155 - RNA, 22 nt, Human
ggggugcaggucuucaccaagg

SEQ ID NO: 534156 - RNA, 21 nt, Human
gucuaggggggcucccucuuc

SEQ ID NO: 534157 - RNA, 22 nt, Human
guggaaugugauuuccauuucu

SEQ ID NO: 534158 - RNA, 21 nt, Human
guuugucccucccucccccaa

SEQ ID NO: 534159 - RNA, 25 nt, Human
uaaaagcugccccaaacaggcaaau

SEQ ID NO: 534160 - RNA, 22 nt, Human
uaacugcaauguuccccccagg

SEQ ID NO: 534161 - RNA, 25 nt, Human
uaggagagccaucugagggcugguc

SEQ ID NO: 534162 - RNA, 24 nt, Human
uagugcccacaggggcccugccuc

SEQ ID NO: 534163 - RNA, 18 nt, Human
ucaaaggcagauucgugg

SEQ ID NO: 534164 - RNA, 18 nt, Human
ucaccugggguugugaca

SEQ ID NO: 534165 - RNA, 19 nt, Human
ucccaacaccaccaacuuu

SEQ ID NO: 534166 - RNA, 18 nt, Human
uccuggaggccuccagac

SEQ ID NO: 534167 - RNA, 24 nt, Human
ucuccacugcaaaugagacuacag

SEQ ID NO: 534168 - RNA, 19 nt, Human
ucucugcucccuguggggc

SEQ ID NO: 534169 - RNA, 21 nt, Human
ucugcagugagugccagaccc

SEQ ID NO: 534170 - RNA, 23 nt, Human
ugaaacacugcccuguaaagcug

SEQ ID NO: 534171 - RNA, 21 nt, Human
ugaaauggaggcucagagaag

SEQ ID NO: 534172 - RNA, 21 nt, Human
ugaagggcuggcauggagcug

SEQ ID NO: 534173 - RNA, 22 nt, Human
ugaagggcuggcauggagcugg

SEQ ID NO: 534174 - RNA, 21 nt, Human
ugacaaaguugaaaaggcucu

SEQ ID NO: 534175 - RNA, 18 nt, Human
ugacugguggaugauugg

SEQ ID NO: 534176 - RNA, 18 nt, Human
ugagaacuagaaccauga

SEQ ID NO: 534177 - RNA, 18 nt, Human
ugagugccagacccuggg

SEQ ID NO: 534178 - RNA, 21 nt, Human
ugagugccagacccugggggg

SEQ ID NO: 534179 - RNA, 23 nt, Human
ugcaaaugagacuacaguuguga

SEQ ID NO: 534180 - RNA, 22 nt, Human
ugcagacagguggccaaagcag

SEQ ID NO: 534181 - RNA, 18 nt, Human
ugccaaggggacaugagg

SEQ ID NO: 534182 - RNA, 18 nt, Human
ugccagacccuggggggc

SEQ ID NO: 534183 - RNA, 22 nt, Human
uggaagccauagauuguggaau

SEQ ID NO: 534184 - RNA, 22 nt, Human
uggccaaagcagggcuugugcu

SEQ ID NO: 534185 - RNA, 20 nt, Human
uggccagcaccuuuuacacc

SEQ ID NO: 534186 - RNA, 23 nt, Human
ugggaaaacacaguaauauaaua

SEQ ID NO: 534187 - RNA, 18 nt, Human
uggguguauaucuggcug

SEQ ID NO: 534188 - RNA, 19 nt, Human
ugugggacgucggguucuu

SEQ ID NO: 534189 - RNA, 21 nt, Human
uguuugucccucccuccccca

SEQ ID NO: 534190 - RNA, 23 nt, Human
uuccugggcuagcugguggaagc

SEQ ID NO: 534191 - RNA, 21 nt, Human
uugacauuucaaauacccaga

SEQ ID NO: 534192 - RNA, 26 nt, Human
uugcauuuuucuuuuuaaaaggcaca

SEQ ID NO: 534193 - RNA, 24 nt, Human
uugcccacaguugauccuggaggc

SEQ ID NO: 534194 - RNA, 22 nt, Human
uugugccuggagagugcuaaaa

SEQ ID NO: 534195 - RNA, 27 nt, Human
uuuuuuuuuuuuuuuucaaguuuaggg

SEQ ID NO: 534196 - RNA, 21 nt, Human
uuuuuuuuuuuuuuuuucaag

SEQ ID NO: 534197 - RNA, 25 nt, Human
aacuuacuucuugcaagcccuggca

SEQ ID NO: 534198 - RNA, 22 nt, Human
aagaaacuuacuucuugcaagc

SEQ ID NO: 534199 - RNA, 23 nt, Human
aaggggccucaugaagcccagau

SEQ ID NO: 534200 - RNA, 18 nt, Human
acaggcagcucucuagaa

SEQ ID NO: 534201 - RNA, 23 nt, Human
agacggauauacagaaacacuuc

SEQ ID NO: 534202 - RNA, 25 nt, Human
agacggauauacagaaacacuucuc

SEQ ID NO: 534203 - RNA, 21 nt, Human
agagauggggaaggaaaagga

SEQ ID NO: 534204 - RNA, 18 nt, Human
agagguuuuguauauggu

SEQ ID NO: 534205 - RNA, 24 nt, Human
agcugauggcauucguauaacuga

SEQ ID NO: 534206 - RNA, 19 nt, Human
aggagugcaugagcauggu

SEQ ID NO: 534207 - RNA, 19 nt, Human
aggucuacucacccuucac

SEQ ID NO: 534208 - RNA, 21 nt, Human
augcaccacaucccagcucug

SEQ ID NO: 534209 - RNA, 19 nt, Human
auguacacaaaggcaugca

SEQ ID NO: 534210 - RNA, 24 nt, Human
cagaagcccuggcacagcccaagu

SEQ ID NO: 534211 - RNA, 21 nt, Human
cagcccaaguucacaggccaa

SEQ ID NO: 534212 - RNA, 19 nt, Human
cagcucugcugcccugggc

SEQ ID NO: 534213 - RNA, 18 nt, Human
caucccagcucugcugcc

SEQ ID NO: 534214 - RNA, 24 nt, Human
caugcaccacaucccagcucugcu

SEQ ID NO: 534215 - RNA, 25 nt, Human
cauucguauaacugaaaguugggga

SEQ ID NO: 534216 - RNA, 18 nt, Human
cccacacugcuucacgca

SEQ ID NO: 534217 - RNA, 19 nt, Human
ggcaucagccuaccagcaa

SEQ ID NO: 534218 - RNA, 18 nt, Human
guacagacggauauacag

SEQ ID NO: 534219 - RNA, 20 nt, Human
gucaguggaguggagagguu

SEQ ID NO: 534220 - RNA, 18 nt, Human
uagaacuugagagccuca

SEQ ID NO: 534221 - RNA, 20 nt, Human
ucagaagccaacccuuauuu

SEQ ID NO: 534222 - RNA, 22 nt, Human
ucaggcccacacugcuucacgc

SEQ ID NO: 534223 - RNA, 23 nt, Human
ucccagcucugcugcccugggcu

SEQ ID NO: 534224 - RNA, 19 nt, Human
ucccugaagucagaagccc

SEQ ID NO: 534225 - RNA, 22 nt, Human
ucccugaagucagaagcccugg

SEQ ID NO: 534226 - RNA, 22 nt, Human
ucucuagaacuugagagccuca

SEQ ID NO: 534227 - RNA, 24 nt, Human
ugaguuuugucccugaagucagaa

SEQ ID NO: 534228 - RNA, 22 nt, Human
ugcccugggcugucccacaggc

SEQ ID NO: 534229 - RNA, 18 nt, Human
uggaguggagagguuuug

SEQ ID NO: 534230 - RNA, 31 nt, Human
uucguauaacugaaaguuggggaagaccacc

SEQ ID NO: 534231 - RNA, 21 nt, Human
uuugaagaaacuuacuucuug

SEQ ID NO: 534232 - RNA, 21 nt, Human
aaacugccccaugccccccca

SEQ ID NO: 534233 - RNA, 22 nt, Human
aaccaggagguaaccaaaucua

SEQ ID NO: 534234 - RNA, 21 nt, Human
aacugccccaugcccccccac

SEQ ID NO: 534235 - RNA, 23 nt, Human
aacugccccaugcccccccacuc

SEQ ID NO: 534236 - RNA, 19 nt, Human
aagaaagaaauauuauuga

SEQ ID NO: 534237 - RNA, 20 nt, Human
aagaaagaaauauuauugaa

SEQ ID NO: 534238 - RNA, 20 nt, Human
acaggcugggcuccagcagg

SEQ ID NO: 534239 - RNA, 19 nt, Human
agaagcgguuguagcgggc

SEQ ID NO: 534240 - RNA, 19 nt, Human
agagaggggcugggcagca

SEQ ID NO: 534241 - RNA, 18 nt, Human
agcaggugggcaggggag

SEQ ID NO: 534242 - RNA, 19 nt, Human
agcauuuauuucaaccagg

SEQ ID NO: 534243 - RNA, 26 nt, Human
agccagugccugugcacagcgcggcc

SEQ ID NO: 534244 - RNA, 21 nt, Human
aggcucgccgagcaugggacg

SEQ ID NO: 534245 - RNA, 22 nt, Human
aggcugggcuccagcagguggg

SEQ ID NO: 534246 - RNA, 18 nt, Human
aggcuguguugugugguc

SEQ ID NO: 534247 - RNA, 23 nt, Human
caaccucaaggccacacacagcc

SEQ ID NO: 534248 - RNA, 19 nt, Human
cacagccuggccuggaucc

SEQ ID NO: 534249 - RNA, 18 nt, Human
cacagguggaaggcuggg

SEQ ID NO: 534250 - RNA, 24 nt, Human
caggaaacagaggugccuggcuca

SEQ ID NO: 534251 - RNA, 22 nt, Human
ccagagaaacaaaaagguauaa

SEQ ID NO: 534252 - RNA, 24 nt, Human
ccagagccuguccaccuaugccca

SEQ ID NO: 534253 - RNA, 23 nt, Human
ccagcagcuugggugugacgagu

SEQ ID NO: 534254 - RNA, 24 nt, Human
ccagcuguccccccaggccucucc

SEQ ID NO: 534255 - RNA, 19 nt, Human
ccaggccucuccucagagg

SEQ ID NO: 534256 - RNA, 18 nt, Human
ccauguggccagccuggc

SEQ ID NO: 534257 - RNA, 18 nt, Human
ccccaggccucuccucag

SEQ ID NO: 534258 - RNA, 21 nt, Human
ccccaugcccccccacucaca

SEQ ID NO: 534259 - RNA, 19 nt, Human
ccccccacucacagcagcc

SEQ ID NO: 534260 - RNA, 21 nt, Human
ccccccacucacagcagccag

SEQ ID NO: 534261 - RNA, 19 nt, Human
ccccccggagaagcgguug

SEQ ID NO: 534262 - RNA, 21 nt, Human
ccccuuccugcugucucaccc

SEQ ID NO: 534263 - RNA, 19 nt, Human
cccucccuuuuccucucuc

SEQ ID NO: 534264 - RNA, 19 nt, Human
cccuuuuccucucuccucc

SEQ ID NO: 534265 - RNA, 24 nt, Human
ccgaaguccugggguccaccaaag

SEQ ID NO: 534266 - RNA, 20 nt, Human
ccggagaagcgguuguagcg

SEQ ID NO: 534267 - RNA, 24 nt, Human
ccucaaggccacacacagcccccu

SEQ ID NO: 534268 - RNA, 26 nt, Human
ccucaaggccacacacagcccccuug

SEQ ID NO: 534269 - RNA, 18 nt, Human
ccucccuuuuccucucuc

SEQ ID NO: 534270 - RNA, 19 nt, Human
ccuccggccagaguggagg

SEQ ID NO: 534271 - RNA, 21 nt, Human
ccuccugcccccuccaagaag

SEQ ID NO: 534272 - RNA, 22 nt, Human
ccucugagggugugccuggccc

SEQ ID NO: 534273 - RNA, 18 nt, Human
ccugcugucucaccccgu

SEQ ID NO: 534274 - RNA, 20 nt, Human
ccugugcacaccaaccucaa

SEQ ID NO: 534275 - RNA, 22 nt, Human
cgaagucuagcuccggacaaaa

SEQ ID NO: 534276 - RNA, 19 nt, Human
cggcugucaauaaacagca

SEQ ID NO: 534277 - RNA, 22 nt, Human
cggggcaggcagaaaccccgag

SEQ ID NO: 534278 - RNA, 19 nt, Human
cuaggguggggauggaggg

SEQ ID NO: 534279 - RNA, 26 nt, Human
cuaugcccacggggcaggcagaaacc

SEQ ID NO: 534280 - RNA, 22 nt, Human
cuccaagaaguacugacugguc

SEQ ID NO: 534281 - RNA, 25 nt, Human
cuccaagaaguacugacuggucucc

SEQ ID NO: 534282 - RNA, 24 nt, Human
cuccaggggcugugcaggcagccc

SEQ ID NO: 534283 - RNA, 19 nt, Human
cuccuccgugcuucucucc

SEQ ID NO: 534284 - RNA, 25 nt, Human
cugccagagccuguccaccuaugcc

SEQ ID NO: 534285 - RNA, 23 nt, Human
cugccccaugcccccccacucac

SEQ ID NO: 534286 - RNA, 18 nt, Human
cuguccccacucacagcc

SEQ ID NO: 534287 - RNA, 25 nt, Human
cuugcagcuccucugagggugugcc

SEQ ID NO: 534288 - RNA, 25 nt, Human
gaaacugccccaugcccccccacuc

SEQ ID NO: 534289 - RNA, 19 nt, Human
gaaggcuggggcccggggg

SEQ ID NO: 534290 - RNA, 24 nt, Human
gacaaaagcuguuagaggcccagg

SEQ ID NO: 534291 - RNA, 19 nt, Human
gagcaugggacggggaggg

SEQ ID NO: 534292 - RNA, 20 nt, Human
gauggaggguggggauggag

SEQ ID NO: 534293 - RNA, 19 nt, Human
gcccauccaccccagugga

SEQ ID NO: 534294 - RNA, 19 nt, Human
gcggcuggcggagguggcg

SEQ ID NO: 534295 - RNA, 21 nt, Human
gcucacuuuuugggggcacau

SEQ ID NO: 534296 - RNA, 18 nt, Human
gcuuguaggugcuggucc

SEQ ID NO: 534297 - RNA, 22 nt, Human
ggaaacagaggugccuggcuca

SEQ ID NO: 534298 - RNA, 19 nt, Human
ggaaaccacagccuggccu

SEQ ID NO: 534299 - RNA, 18 nt, Human
ggagguaaccaaaucuac

SEQ ID NO: 534300 - RNA, 18 nt, Human
ggauggagggugggccgg

SEQ ID NO: 534301 - RNA, 20 nt, Human
ggccacgggcuugcagcucc

SEQ ID NO: 534302 - RNA, 24 nt, Human
ggccaggccacgggcuugcagcuc

SEQ ID NO: 534303 - RNA, 26 nt, Human
ggccccuuccugcugucucaccccgu

SEQ ID NO: 534304 - RNA, 21 nt, Human
ggcgucccggcgugcagggcc

SEQ ID NO: 534305 - RNA, 21 nt, Human
ggcugggcuccagcagguggg

SEQ ID NO: 534306 - RNA, 19 nt, Human
ggcuggggcccgggggcgg

SEQ ID NO: 534307 - RNA, 21 nt, Human
gggcaggcagaaaccccgaga

SEQ ID NO: 534308 - RNA, 18 nt, Human
gggcggcacaggcugggc

SEQ ID NO: 534309 - RNA, 24 nt, Human
gggcgggugcucugccgggggccg

SEQ ID NO: 534310 - RNA, 20 nt, Human
ggggagaugggacuggaggc

SEQ ID NO: 534311 - RNA, 18 nt, Human
ggggauggagggugggga

SEQ ID NO: 534312 - RNA, 19 nt, Human
gggugugucagcguggcag

SEQ ID NO: 534313 - RNA, 18 nt, Human
ggugggcaggggaggucu

SEQ ID NO: 534314 - RNA, 24 nt, Human
gguucaggggaaaccacagccugg

SEQ ID NO: 534315 - RNA, 21 nt, Human
guagcgggcacucuugccuga

SEQ ID NO: 534316 - RNA, 20 nt, Human
gucagcuuuugugauggugg

SEQ ID NO: 534317 - RNA, 20 nt, Human
guccuuccuccggccagagu

SEQ ID NO: 534318 - RNA, 20 nt, Human
gugcugcuuguaggugcugg

SEQ ID NO: 534319 - RNA, 22 nt, Human
guggaggccccaggcugcuagc

SEQ ID NO: 534320 - RNA, 21 nt, Human
gugggugugucagcguggcag

SEQ ID NO: 534321 - RNA, 22 nt, Human
uaaaaaaugccgaaaaccagcg

SEQ ID NO: 534322 - RNA, 25 nt, Human
uaaccaaaucuacauacagucuaaa

SEQ ID NO: 534323 - RNA, 22 nt, Human
uagaaaaccauuuaccaacuga

SEQ ID NO: 534324 - RNA, 20 nt, Human
uagcagggaggggaggcccc

SEQ ID NO: 534325 - RNA, 20 nt, Human
uaggguggggauggagggug

SEQ ID NO: 534326 - RNA, 23 nt, Human
uauagaaaaccauuuaccaacug

SEQ ID NO: 534327 - RNA, 19 nt, Human
ucacagcagccagugccug

SEQ ID NO: 534328 - RNA, 19 nt, Human
ucagaaagguccagggcug

SEQ ID NO: 534329 - RNA, 24 nt, Human
uccagggcugguucaggggaaacc

SEQ ID NO: 534330 - RNA, 19 nt, Human
uccccagagaaacaaaaag

SEQ ID NO: 534331 - RNA, 21 nt, Human
uccuccggccagaguggaggc

SEQ ID NO: 534332 - RNA, 18 nt, Human
uccucugagggugugccu

SEQ ID NO: 534333 - RNA, 20 nt, Human
ucggcggccguguccuccuc

SEQ ID NO: 534334 - RNA, 19 nt, Human
ucguaccuggcacccagag

SEQ ID NO: 534335 - RNA, 25 nt, Human
ucuaggguggggauggagggugggg

SEQ ID NO: 534336 - RNA, 23 nt, Human
ucucaccccguguuucccugcga

SEQ ID NO: 534337 - RNA, 23 nt, Human
ucuccuaaguucucugcgcccca

SEQ ID NO: 534338 - RNA, 21 nt, Human
ucugccugcgguccuuccucc

SEQ ID NO: 534339 - RNA, 23 nt, Human
ugaguaaaaaggcccucgcucca

SEQ ID NO: 534340 - RNA, 24 nt, Human
ugauccacaguguugggcacaacu

SEQ ID NO: 534341 - RNA, 22 nt, Human
ugcccagcuguccccccaggcc

SEQ ID NO: 534342 - RNA, 29 nt, Human
ugccccaugcccccccacucacagcagcc

SEQ ID NO: 534343 - RNA, 18 nt, Human
ugcccccccacucacagc

SEQ ID NO: 534344 - RNA, 21 nt, Human
ugcccggcugccagagccugu

SEQ ID NO: 534345 - RNA, 18 nt, Human
ugccugcgguccuuccuc

SEQ ID NO: 534346 - RNA, 23 nt, Human
ugccuggcccccucuccaggggc

SEQ ID NO: 534347 - RNA, 19 nt, Human
ugccuggcucacuuuuugg

SEQ ID NO: 534348 - RNA, 23 nt, Human
ugccuggcucacuuuuugggggc

SEQ ID NO: 534349 - RNA, 21 nt, Human
ugcugggccccccggagaagc

SEQ ID NO: 534350 - RNA, 21 nt, Human
uggaaggcuggggcccggggg

SEQ ID NO: 534351 - RNA, 20 nt, Human
uggaggcggcuggcggaggu

SEQ ID NO: 534352 - RNA, 18 nt, Human
uggaggguggggauggag

SEQ ID NO: 534353 - RNA, 25 nt, Human
uggaggguggggauggagggugggc

SEQ ID NO: 534354 - RNA, 20 nt, Human
uggcagccacguggaagcag

SEQ ID NO: 534355 - RNA, 22 nt, Human
uggggauggaggguggggaugg

SEQ ID NO: 534356 - RNA, 22 nt, Human
ugggggagaugggacuggagaa

SEQ ID NO: 534357 - RNA, 22 nt, Human
uggggugggaagauugcugggc

SEQ ID NO: 534358 - RNA, 23 nt, Human
uggggugggaagauugcugggcc

SEQ ID NO: 534359 - RNA, 22 nt, Human
ugggugugucagcguggcagcc

SEQ ID NO: 534360 - RNA, 18 nt, Human
uguagcgggcacucuugc

SEQ ID NO: 534361 - RNA, 18 nt, Human
ugucucaccccguguuuc

SEQ ID NO: 534362 - RNA, 20 nt, Human
ugugccuggcccccucucca

SEQ ID NO: 534363 - RNA, 21 nt, Human
uguggggcggguggaggcggc

SEQ ID NO: 534364 - RNA, 20 nt, Human
uuaaaaaaugccgaaaacca

SEQ ID NO: 534365 - RNA, 20 nt, Human
uuucuuuuuuuuuuuuuuau

SEQ ID NO: 534366 - RNA, 24 nt, Human
uuucuuuuuuuuuuuuuuaucaag

SEQ ID NO: 534367 - RNA, 24 nt, Human
uuuuugggggcacauguguugggg

SEQ ID NO: 534368 - RNA, 25 nt, Human
aaacagagacccugagcgcacauag

SEQ ID NO: 534369 - RNA, 25 nt, Human
aaacagagacccugagcgcacauag

SEQ ID NO: 534370 - RNA, 23 nt, Human
aaauggccccagaaugguagggc

SEQ ID NO: 534371 - RNA, 23 nt, Human
aaauggccccagaaugguagggc

SEQ ID NO: 534372 - RNA, 22 nt, Human
aacaagaagaaaucgagaagaa

SEQ ID NO: 534373 - RNA, 21 nt, Human
aagaagaaaucgagaagaaga

SEQ ID NO: 534374 - RNA, 21 nt, Human
aagaagaaaucgagaagaaga

SEQ ID NO: 534375 - RNA, 23 nt, Human
aagaagaaaucgagaagaagagc

SEQ ID NO: 534376 - RNA, 18 nt, Human
aagaagagcagucagaca

SEQ ID NO: 534377 - RNA, 19 nt, Human
aagauggggaaguagcaga

SEQ ID NO: 534378 - RNA, 19 nt, Human
aagccaagacugagggaga

SEQ ID NO: 534379 - RNA, 19 nt, Human
aagccaagacugagggaga

SEQ ID NO: 534380 - RNA, 19 nt, Human
aaggaagggcucgcugggg

SEQ ID NO: 534381 - RNA, 20 nt, Human
aaggugccccggccagcccc

SEQ ID NO: 534382 - RNA, 20 nt, Human
aaggugccccggccagcccc

SEQ ID NO: 534383 - RNA, 25 nt, Human
aagucacaguuacaaugacaggaac

SEQ ID NO: 534384 - RNA, 21 nt, Human
aagugcagagacuacagagac

SEQ ID NO: 534385 - RNA, 18 nt, Human
acaaggaaggaagggcuc

SEQ ID NO: 534386 - RNA, 22 nt, Human
acagggacagaagcccucucca

SEQ ID NO: 534387 - RNA, 22 nt, Human
acagggacagaagcccucucca

SEQ ID NO: 534388 - RNA, 19 nt, Human
accccagagcccuggagaa

SEQ ID NO: 534389 - RNA, 19 nt, Human
accccagagcccuggagaa

SEQ ID NO: 534390 - RNA, 23 nt, Human
accccagagcccuggagaagcca

SEQ ID NO: 534391 - RNA, 23 nt, Human
accccagagcccuggagaagcca

SEQ ID NO: 534392 - RNA, 24 nt, Human
accgcaucuccccagcuucuccag

SEQ ID NO: 534393 - RNA, 24 nt, Human
accgcaucuccccagcuucuccag

SEQ ID NO: 534394 - RNA, 18 nt, Human
acuccucuucccaccuuc

SEQ ID NO: 534395 - RNA, 30 nt, Human
agaaaucgagaagaagagcagucagacaaa

SEQ ID NO: 534396 - RNA, 24 nt, Human
agaacaagaagaaaucgagaagaa

SEQ ID NO: 534397 - RNA, 21 nt, Human
agaaggcagaacaagaagaaa

SEQ ID NO: 534398 - RNA, 18 nt, Human
agacaagugcagagacua

SEQ ID NO: 534399 - RNA, 22 nt, Human
agcaagagcucccaccucccuu

SEQ ID NO: 534400 - RNA, 22 nt, Human
agcaagagcucccaccucccuu

SEQ ID NO: 534401 - RNA, 21 nt, Human
agcacaucuuuagcugauacu

SEQ ID NO: 534402 - RNA, 21 nt, Human
agcacaucuuuagcugauacu

SEQ ID NO: 534403 - RNA, 18 nt, Human
aggaacagaaacacggac

SEQ ID NO: 534404 - RNA, 24 nt, Human
aggaacagaaacacggacagucac

SEQ ID NO: 534405 - RNA, 26 nt, Human
aggaacagaaacacggacagucacca

SEQ ID NO: 534406 - RNA, 23 nt, Human
aggaagggcucgcuggggcugca

SEQ ID NO: 534407 - RNA, 19 nt, Human
aggagaaagggcgggagcg

SEQ ID NO: 534408 - RNA, 21 nt, Human
aggcagaacaagaagaaaucg

SEQ ID NO: 534409 - RNA, 19 nt, Human
agugcagagacuacagaga

SEQ ID NO: 534410 - RNA, 21 nt, Human
agugcagagacuacagagacg

SEQ ID NO: 534411 - RNA, 20 nt, Human
auccgcaccguguacuccuc

SEQ ID NO: 534412 - RNA, 19 nt, Human
auggaggaaaggucccaca

SEQ ID NO: 534413 - RNA, 19 nt, Human
auggaggaaaggucccaca

SEQ ID NO: 534414 - RNA, 19 nt, Human
caaaccgagaaggcagaac

SEQ ID NO: 534415 - RNA, 21 nt, Human
caaggugccccggccagcccc

SEQ ID NO: 534416 - RNA, 21 nt, Human
caccagaacagagcucgucga

SEQ ID NO: 534417 - RNA, 22 nt, Human
cacccucugccucgcugagcuc

SEQ ID NO: 534418 - RNA, 22 nt, Human
cacccucugccucgcugagcuc

SEQ ID NO: 534419 - RNA, 20 nt, Human
caccucccuucaaaacacug

SEQ ID NO: 534420 - RNA, 19 nt, Human
cacugugcccaucccgggc

SEQ ID NO: 534421 - RNA, 19 nt, Human
cacugugcccaucccgggc

SEQ ID NO: 534422 - RNA, 25 nt, Human
cagaacagagcucgucgagcccgcu

SEQ ID NO: 534423 - RNA, 21 nt, Human
cagccuccugggcuuccuccu

SEQ ID NO: 534424 - RNA, 19 nt, Human
cagcucagccuucaacugu

SEQ ID NO: 534425 - RNA, 18 nt, Human
caggagagcaagagcucc

SEQ ID NO: 534426 - RNA, 18 nt, Human
caggagagcaagagcucc

SEQ ID NO: 534427 - RNA, 22 nt, Human
caggagagccccaacuguggug

SEQ ID NO: 534428 - RNA, 23 nt, Human
cagucaccaagggccagacacac

SEQ ID NO: 534429 - RNA, 27 nt, Human
cauacacccgcgcacacaugcauggug

SEQ ID NO: 534430 - RNA, 23 nt, Human
caugcauggagcuucaccuucuc

SEQ ID NO: 534431 - RNA, 19 nt, Human
cauggagcuucaccuucuc

SEQ ID NO: 534432 - RNA, 19 nt, Human
cauggagcuucaccuucuc

SEQ ID NO: 534433 - RNA, 22 nt, Human
ccacagccacauacacuccacc

SEQ ID NO: 534434 - RNA, 23 nt, Human
ccaggccgcgcuucaugcugcac

SEQ ID NO: 534435 - RNA, 19 nt, Human
ccaguccccagggaccggc

SEQ ID NO: 534436 - RNA, 19 nt, Human
ccaguccccagggaccggc

SEQ ID NO: 534437 - RNA, 22 nt, Human
cccaccucccuucaaaacacug

SEQ ID NO: 534438 - RNA, 22 nt, Human
cccaccucccuucaaaacacug

SEQ ID NO: 534439 - RNA, 21 nt, Human
cccauggaugggaccuggaac

SEQ ID NO: 534440 - RNA, 22 nt, Human
ccccagaaugguagggccaagc

SEQ ID NO: 534441 - RNA, 22 nt, Human
ccccagaaugguagggccaagc

SEQ ID NO: 534442 - RNA, 23 nt, Human
ccccagagcccuggagaagccaa

SEQ ID NO: 534443 - RNA, 23 nt, Human
ccccagagcccuggagaagccaa

SEQ ID NO: 534444 - RNA, 24 nt, Human
ccccagagcccuggagaagccaag

SEQ ID NO: 534445 - RNA, 24 nt, Human
ccccagagcccuggagaagccaag

SEQ ID NO: 534446 - RNA, 25 nt, Human
ccccaucgggcuggcggggccccuc

SEQ ID NO: 534447 - RNA, 18 nt, Human
cccgcaccagaacagagc

SEQ ID NO: 534448 - RNA, 18 nt, Human
cccgccuccugcccgcac

SEQ ID NO: 534449 - RNA, 19 nt, Human
cccgcgcacacaugcaugg

SEQ ID NO: 534450 - RNA, 19 nt, Human
cccgcgcacacaugcaugg

SEQ ID NO: 534451 - RNA, 23 nt, Human
cccgcugcccugccucuuguggu

SEQ ID NO: 534452 - RNA, 23 nt, Human
cccggccagccccaacgcccucu

SEQ ID NO: 534453 - RNA, 23 nt, Human
cccggccagccccaacgcccucu

SEQ ID NO: 534454 - RNA, 18 nt, Human
cccucugccgcugacagg

SEQ ID NO: 534455 - RNA, 18 nt, Human
cccucugccgcugacagg

SEQ ID NO: 534456 - RNA, 21 nt, Human
ccgcaccagaacagagcucgu

SEQ ID NO: 534457 - RNA, 19 nt, Human
ccggguuuugaacagggac

SEQ ID NO: 534458 - RNA, 22 nt, Human
ccuauaccgaggcauugugaac

SEQ ID NO: 534459 - RNA, 22 nt, Human
ccuauaccgaggcauugugaac

SEQ ID NO: 534460 - RNA, 20 nt, Human
ccucagucuccucccaaguc

SEQ ID NO: 534461 - RNA, 20 nt, Human
ccucauccccaucgggcugg

SEQ ID NO: 534462 - RNA, 21 nt, Human
ccuccugggcuuccuccugga

SEQ ID NO: 534463 - RNA, 21 nt, Human
ccucgcuuggcggcggcggcg

SEQ ID NO: 534464 - RNA, 26 nt, Human
ccucugccgcugacagggacagaagc

SEQ ID NO: 534465 - RNA, 18 nt, Human
ccucugugcagccccacc

SEQ ID NO: 534466 - RNA, 18 nt, Human
ccucugugcagccccacc

SEQ ID NO: 534467 - RNA, 22 nt, Human
ccugcccgcaccagaacagagc

SEQ ID NO: 534468 - RNA, 18 nt, Human
ccugggcuuccuccugga

SEQ ID NO: 534469 - RNA, 21 nt, Human
ccuucaaaacacugugcccau

SEQ ID NO: 534470 - RNA, 21 nt, Human
ccuucaaaacacugugcccau

SEQ ID NO: 534471 - RNA, 25 nt, Human
ccuugcgcucccgcuuccgcccccc

SEQ ID NO: 534472 - RNA, 20 nt, Human
cgagaagaagagcagucaga

SEQ ID NO: 534473 - RNA, 18 nt, Human
cgcacacaugcauggagc

SEQ ID NO: 534474 - RNA, 22 nt, Human
cgccccaguccccagggaccgg

SEQ ID NO: 534475 - RNA, 19 nt, Human
cgcgaucggaguccucagc

SEQ ID NO: 534476 - RNA, 19 nt, Human
cgcucccgcuuccgccccc

SEQ ID NO: 534477 - RNA, 19 nt, Human
cggcaccuccacgagggag

SEQ ID NO: 534478 - RNA, 19 nt, Human
cggcaccuccacgagggag

SEQ ID NO: 534479 - RNA, 21 nt, Human
cguaucuuuaaucaccuucuc

SEQ ID NO: 534480 - RNA, 24 nt, Human
cgugugcugcagaggccaugcgua

SEQ ID NO: 534481 - RNA, 24 nt, Human
cgugugcugcagaggccaugcgua

SEQ ID NO: 534482 - RNA, 25 nt, Human
cuacagagacgaggccgggugcaug

SEQ ID NO: 534483 - RNA, 19 nt, Human
cucaacacagccuccuaua

SEQ ID NO: 534484 - RNA, 19 nt, Human
cucaacacagccuccuaua

SEQ ID NO: 534485 - RNA, 21 nt, Human
cuccacgagggagggccacag

SEQ ID NO: 534486 - RNA, 21 nt, Human
cuccacgagggagggccacag

SEQ ID NO: 534487 - RNA, 21 nt, Human
cucccaccucccuucaaaaca

SEQ ID NO: 534488 - RNA, 21 nt, Human
cucccaccucccuucaaaaca

SEQ ID NO: 534489 - RNA, 20 nt, Human
cuccucauccccaucgggcu

SEQ ID NO: 534490 - RNA, 21 nt, Human
cugagggagaaagccugaggg

SEQ ID NO: 534491 - RNA, 21 nt, Human
cugcccgcaccagaacagagc

SEQ ID NO: 534492 - RNA, 20 nt, Human
cuggugcagagcugcagcug

SEQ ID NO: 534493 - RNA, 20 nt, Human
cuggugcagagcugcagcug

SEQ ID NO: 534494 - RNA, 18 nt, Human
cugugcagccccacccuc

SEQ ID NO: 534495 - RNA, 18 nt, Human
cugugcagccccacccuc

SEQ ID NO: 534496 - RNA, 23 nt, Human
cuucccaccuucagucgcacaga

SEQ ID NO: 534497 - RNA, 20 nt, Human
gaacaagaagaaaucgagaa

SEQ ID NO: 534498 - RNA, 24 nt, Human
gaaccgcaucuccccagcuucucc

SEQ ID NO: 534499 - RNA, 24 nt, Human
gaaccgcaucuccccagcuucucc

SEQ ID NO: 534500 - RNA, 22 nt, Human
gaagaccaccagcucagccuuc

SEQ ID NO: 534501 - RNA, 21 nt, Human
gacaccccagagcccuggaga

SEQ ID NO: 534502 - RNA, 21 nt, Human
gacaccccagagcccuggaga

SEQ ID NO: 534503 - RNA, 25 nt, Human
gagaagaagagcagucagacaagga

SEQ ID NO: 534504 - RNA, 25 nt, Human
gagacgaggccgggugcaugaggag

SEQ ID NO: 534505 - RNA, 23 nt, Human
gagccccaacugugguggaaaug

SEQ ID NO: 534506 - RNA, 23 nt, Human
gagccccaacugugguggaaaug

SEQ ID NO: 534507 - RNA, 21 nt, Human
gaggagaaagggcgggagcgg

SEQ ID NO: 534508 - RNA, 20 nt, Human
gagggccucgggugcaaggg

SEQ ID NO: 534509 - RNA, 20 nt, Human
gagggccucgggugcaaggg

SEQ ID NO: 534510 - RNA, 18 nt, Human
gagggugggaauggggga

SEQ ID NO: 534511 - RNA, 22 nt, Human
gcaagagcucccaccucccuuc

SEQ ID NO: 534512 - RNA, 22 nt, Human
gcaagagcucccaccucccuuc

SEQ ID NO: 534513 - RNA, 25 nt, Human
gcacagauccgggcucccgccuccu

SEQ ID NO: 534514 - RNA, 19 nt, Human
gcacuaaggccucuuuaaa

SEQ ID NO: 534515 - RNA, 19 nt, Human
gcacuaaggccucuuuaaa

SEQ ID NO: 534516 - RNA, 21 nt, Human
gcagagagggugggaaugggg

SEQ ID NO: 534517 - RNA, 22 nt, Human
gcagagcugcagcugauguucc

SEQ ID NO: 534518 - RNA, 22 nt, Human
gcagagcugcagcugauguucc

SEQ ID NO: 534519 - RNA, 18 nt, Human
gcagccccacccucugcc

SEQ ID NO: 534520 - RNA, 18 nt, Human
gcagccccacccucugcc

SEQ ID NO: 534521 - RNA, 23 nt, Human
gccacagccacauacacuccacc

SEQ ID NO: 534522 - RNA, 23 nt, Human
gccacagccacauacacuccacc

SEQ ID NO: 534523 - RNA, 19 nt, Human
gccccaacgcccucugccg

SEQ ID NO: 534524 - RNA, 19 nt, Human
gccccaacgcccucugccg

SEQ ID NO: 534525 - RNA, 21 nt, Human
gccccaguccccagggaccgg

SEQ ID NO: 534526 - RNA, 21 nt, Human
gccccaguccccagggaccgg

SEQ ID NO: 534527 - RNA, 18 nt, Human
gcgaucggaguccucagc

SEQ ID NO: 534528 - RNA, 21 nt, Human
gcgggagcgggaggccgggca

SEQ ID NO: 534529 - RNA, 22 nt, Human
gcucccgccuccugcccgcacc

SEQ ID NO: 534530 - RNA, 21 nt, Human
gcuggggcugcagucagaugu

SEQ ID NO: 534531 - RNA, 21 nt, Human
ggaagcacaucuuuagcugau

SEQ ID NO: 534532 - RNA, 19 nt, Human
ggaaggaagggcucgcugg

SEQ ID NO: 534533 - RNA, 19 nt, Human
ggacaacagggauggagga

SEQ ID NO: 534534 - RNA, 19 nt, Human
ggacaacagggauggagga

SEQ ID NO: 534535 - RNA, 22 nt, Human
ggcagagagggugggaaugggg

SEQ ID NO: 534536 - RNA, 24 nt, Human
ggcuggcggggccccucacucucc

SEQ ID NO: 534537 - RNA, 23 nt, Human
gggccaagccuagcuccagacac

SEQ ID NO: 534538 - RNA, 23 nt, Human
gggccaagccuagcuccagacac

SEQ ID NO: 534539 - RNA, 21 nt, Human
gggugggaaugggggagaagc

SEQ ID NO: 534540 - RNA, 19 nt, Human
ggugggaaugggggagaag

SEQ ID NO: 534541 - RNA, 22 nt, Human
guaggaagggggggcagacaga

SEQ ID NO: 534542 - RNA, 23 nt, Human
gugugcugcagaggccaugcgua

SEQ ID NO: 534543 - RNA, 25 nt, Human
uaaacagagacccugagcgcacaua

SEQ ID NO: 534544 - RNA, 25 nt, Human
uaaacagagacccugagcgcacaua

SEQ ID NO: 534545 - RNA, 18 nt, Human
uaaggccucuuuaaagca

SEQ ID NO: 534546 - RNA, 18 nt, Human
uaaggccucuuuaaagca

SEQ ID NO: 534547 - RNA, 22 nt, Human
uacaaugacaggaacagaaaca

SEQ ID NO: 534548 - RNA, 23 nt, Human
uacaaugacaggaacagaaacac

SEQ ID NO: 534549 - RNA, 21 nt, Human
uagcugauacuuaaacagaga

SEQ ID NO: 534550 - RNA, 21 nt, Human
uagcugauacuuaaacagaga

SEQ ID NO: 534551 - RNA, 25 nt, Human
ucaauggucuccugauacuccuucu

SEQ ID NO: 534552 - RNA, 21 nt, Human
ucacaguuacaaugacaggaa

SEQ ID NO: 534553 - RNA, 19 nt, Human
ucagcucaacacagccucc

SEQ ID NO: 534554 - RNA, 19 nt, Human
ucagcucaacacagccucc

SEQ ID NO: 534555 - RNA, 23 nt, Human
ucaugucguucuuggccguggcc

SEQ ID NO: 534556 - RNA, 23 nt, Human
uccccagcuucuccaggcuuuuc

SEQ ID NO: 534557 - RNA, 23 nt, Human
uccccagcuucuccaggcuuuuc

SEQ ID NO: 534558 - RNA, 19 nt, Human
uccucguugaugcugaggg

SEQ ID NO: 534559 - RNA, 22 nt, Human
uccucuucccaccuucagucgc

SEQ ID NO: 534560 - RNA, 20 nt, Human
uccugcugcucucccugggc

SEQ ID NO: 534561 - RNA, 18 nt, Human
ucuccucagucuccuccc

SEQ ID NO: 534562 - RNA, 21 nt, Human
ucuuccugcugcucucccugg

SEQ ID NO: 534563 - RNA, 21 nt, Human
ugacaggaacagaaacacgga

SEQ ID NO: 534564 - RNA, 22 nt, Human
ugacaggaacagaaacacggac

SEQ ID NO: 534565 - RNA, 19 nt, Human
ugaccaggagagcaagagc

SEQ ID NO: 534566 - RNA, 19 nt, Human
ugaccaggagagcaagagc

SEQ ID NO: 534567 - RNA, 19 nt, Human
ugagaaauccucccaaagc

SEQ ID NO: 534568 - RNA, 22 nt, Human
ugagcauguggaccauagcagg

SEQ ID NO: 534569 - RNA, 22 nt, Human
ugagcauguggaccauagcagg

SEQ ID NO: 534570 - RNA, 28 nt, Human
ugagcgcacauacacccgcgcacacaug

SEQ ID NO: 534571 - RNA, 28 nt, Human
ugagcgcacauacacccgcgcacacaug

SEQ ID NO: 534572 - RNA, 20 nt, Human
ugagggagaaagccugaggg

SEQ ID NO: 534573 - RNA, 18 nt, Human
ugagggaggagcgcccca

SEQ ID NO: 534574 - RNA, 18 nt, Human
ugagggaggagcgcccca

SEQ ID NO: 534575 - RNA, 27 nt, Human
ugcagugaccaggagagcaagagcucc

SEQ ID NO: 534576 - RNA, 18 nt, Human
ugccagcuccuccuggca

SEQ ID NO: 534577 - RNA, 23 nt, Human
ugccagcuccuccuggcaggcau

SEQ ID NO: 534578 - RNA, 22 nt, Human
ugccugggccaguuagcaccag

SEQ ID NO: 534579 - RNA, 22 nt, Human
ugccugggccaguuagcaccag

SEQ ID NO: 534580 - RNA, 23 nt, Human
uggaacaucuggaucauguccuc

SEQ ID NO: 534581 - RNA, 18 nt, Human
uggcaggcaucagccucc

SEQ ID NO: 534582 - RNA, 19 nt, Human
uggcaggcaucagccuccu

SEQ ID NO: 534583 - RNA, 20 nt, Human
uggccguggccaacuccagc

SEQ ID NO: 534584 - RNA, 19 nt, Human
uggcggcggcggcgggucg

SEQ ID NO: 534585 - RNA, 19 nt, Human
ugggaaugggggagaagca

SEQ ID NO: 534586 - RNA, 19 nt, Human
uggugcagagcugcagcug

SEQ ID NO: 534587 - RNA, 19 nt, Human
uggugcagagcugcagcug

SEQ ID NO: 534588 - RNA, 22 nt, Human
uguuccccucugugcagcccca

SEQ ID NO: 534589 - RNA, 27 nt, Human
uuaaucaccuucuccaggcuaucuucc

SEQ ID NO: 534590 - RNA, 22 nt, Human
uucucugucauucugcagugac

SEQ ID NO: 534591 - RNA, 22 nt, Human
uugcagcuggauccgcaccgug

SEQ ID NO: 534592 - RNA, 23 nt, Human
uugcgcugcugagccacaucgca

SEQ ID NO: 534593 - RNA, 20 nt, Human
uuuacacggucuugcagcug

SEQ ID NO: 534594 - RNA, 18 nt, Human
uuuuuuuuuuuuugaggg

SEQ ID NO: 534595 - RNA, 22 nt, Human
uuuuuuuuuuuuuuuuugaggg

SEQ ID NO: 534596 - RNA, 27 nt, Human
uuuuuuuuuuuuuuuuugaggguaggg

SEQ ID NO: 534597 - RNA, 18 nt, Human
acagaaggcagucccaca

SEQ ID NO: 534598 - RNA, 23 nt, Human
aggaagcagcucaggugguucug

SEQ ID NO: 534599 - RNA, 19 nt, Human
aggaaggagauggcugcug

SEQ ID NO: 534600 - RNA, 22 nt, Human
aggaaggagauggcugcugggg

SEQ ID NO: 534601 - RNA, 23 nt, Human
aggaaggagauggcugcuggggc

SEQ ID NO: 534602 - RNA, 20 nt, Human
aggcagccagauggcgggag

SEQ ID NO: 534603 - RNA, 21 nt, Human
aggcagucccacagcgccccc

SEQ ID NO: 534604 - RNA, 23 nt, Human
aggggcaaggagccggcugagcu

SEQ ID NO: 534605 - RNA, 21 nt, Human
augaaggcagccagauggcgg

SEQ ID NO: 534606 - RNA, 21 nt, Human
cagcagcuccagcaggcccag

SEQ ID NO: 534607 - RNA, 19 nt, Human
cagcccaggccaugcccgg

SEQ ID NO: 534608 - RNA, 20 nt, Human
caggaaggagauggcugcug

SEQ ID NO: 534609 - RNA, 24 nt, Human
caggaucucgggucuccccccgag

SEQ ID NO: 534610 - RNA, 20 nt, Human
caguacaugaacgugggcag

SEQ ID NO: 534611 - RNA, 20 nt, Human
ccaccucaaaguccuggcug

SEQ ID NO: 534612 - RNA, 21 nt, Human
ccaccucaaaguccuggcugc

SEQ ID NO: 534613 - RNA, 20 nt, Human
ccaggccucggucgguccug

SEQ ID NO: 534614 - RNA, 24 nt, Human
cccaggccaugcccggggggaucc

SEQ ID NO: 534615 - RNA, 22 nt, Human
ccccagggcucggaguauugcu

SEQ ID NO: 534616 - RNA, 21 nt, Human
cccuccaccguuuggccccgg

SEQ ID NO: 534617 - RNA, 19 nt, Human
ccgccgccgccacccggcc

SEQ ID NO: 534618 - RNA, 23 nt, Human
ccggcggcugcggcgucaccucu

SEQ ID NO: 534619 - RNA, 20 nt, Human
ccuccucggacagaccagcu

SEQ ID NO: 534620 - RNA, 23 nt, Human
ccucggagaucugcgcgcugggg

SEQ ID NO: 534621 - RNA, 21 nt, Human
cgcagggccaggcugaaggcg

SEQ ID NO: 534622 - RNA, 21 nt, Human
cgcgaccggagcgccgccgcc

SEQ ID NO: 534623 - RNA, 23 nt, Human
cggcggcugcggcgucaccucug

SEQ ID NO: 534624 - RNA, 19 nt, Human
cucaaaguccuggcugccc

SEQ ID NO: 534625 - RNA, 21 nt, Human
cuccagcagaucuggcguggg

SEQ ID NO: 534626 - RNA, 21 nt, Human
cuccucggacagaccagcaac

SEQ ID NO: 534627 - RNA, 25 nt, Human
cuccucggacagaccagcaacgccc

SEQ ID NO: 534628 - RNA, 19 nt, Human
cuccugggccugccuggcc

SEQ ID NO: 534629 - RNA, 19 nt, Human
cuccugggccugccuggcc

SEQ ID NO: 534630 - RNA, 23 nt, Human
cucgcggcucccggcggcugcgg

SEQ ID NO: 534631 - RNA, 20 nt, Human
cucggcgcccucaccuccuc

SEQ ID NO: 534632 - RNA, 18 nt, Human
cugcaaugcuggggcugu

SEQ ID NO: 534633 - RNA, 18 nt, Human
cuuggaggggggucggcu

SEQ ID NO: 534634 - RNA, 21 nt, Human
gagaagaagcucaggaucucg

SEQ ID NO: 534635 - RNA, 18 nt, Human
gagagcguacucaggcag

SEQ ID NO: 534636 - RNA, 21 nt, Human
gaggauccccggggacgggac

SEQ ID NO: 534637 - RNA, 20 nt, Human
gcaggaagcagcucaggugg

SEQ ID NO: 534638 - RNA, 22 nt, Human
gcauggagcgcagggccaggcu

SEQ ID NO: 534639 - RNA, 23 nt, Human
gccccgucccucgcggcucccgg

SEQ ID NO: 534640 - RNA, 20 nt, Human
ggagauggcugcuggggcau

SEQ ID NO: 534641 - RNA, 21 nt, Human
ggcugagcucuccuccucgcc

SEQ ID NO: 534642 - RNA, 18 nt, Human
ggcuuggaggggggucgg

SEQ ID NO: 534643 - RNA, 21 nt, Human
gggacgggacgggccggggcu

SEQ ID NO: 534644 - RNA, 18 nt, Human
gggcaaggagccggcuga

SEQ ID NO: 534645 - RNA, 19 nt, Human
ggugaacagggagacgcug

SEQ ID NO: 534646 - RNA, 20 nt, Human
guccaggccucggucggucc

SEQ ID NO: 534647 - RNA, 21 nt, Human
gucccugcugggcaggcugag

SEQ ID NO: 534648 - RNA, 24 nt, Human
uagguaauguacuuauggaugaac

SEQ ID NO: 534649 - RNA, 22 nt, Human
ucaaaaccagcccaggccaugc

SEQ ID NO: 534650 - RNA, 22 nt, Human
ucaccaggucacuguugucgac

SEQ ID NO: 534651 - RNA, 20 nt, Human
ucagggccucggagaucugc

SEQ ID NO: 534652 - RNA, 25 nt, Human
uccaccguuuggccccgggaaagcc

SEQ ID NO: 534653 - RNA, 23 nt, Human
ucccggcggcugcggcgucaccu

SEQ ID NO: 534654 - RNA, 20 nt, Human
ucccugcugggcaggcugag

SEQ ID NO: 534655 - RNA, 23 nt, Human
uccucagggccucggagaucugc

SEQ ID NO: 534656 - RNA, 19 nt, Human
uccugggccugccuggccu

SEQ ID NO: 534657 - RNA, 20 nt, Human
ucggcgcccucaccuccucg

SEQ ID NO: 534658 - RNA, 23 nt, Human
ucuggcgugggugaagcagggcc

SEQ ID NO: 534659 - RNA, 23 nt, Human
ugaacugcacaaacuuguugaug

SEQ ID NO: 534660 - RNA, 18 nt, Human
ugaaggcagccagauggc

SEQ ID NO: 534661 - RNA, 25 nt, Human
ugaccaggggcaaggagccggcuga

SEQ ID NO: 534662 - RNA, 25 nt, Human
ugaugaaggcagccagauggcggga

SEQ ID NO: 534663 - RNA, 22 nt, Human
ugcaaggagggauuucagcauc

SEQ ID NO: 534664 - RNA, 18 nt, Human
ugcaccaccucaaagucc

SEQ ID NO: 534665 - RNA, 18 nt, Human
ugcccaccaggaaggccc

SEQ ID NO: 534666 - RNA, 23 nt, Human
ugcccaggcaguacaugaacgug

SEQ ID NO: 534667 - RNA, 22 nt, Human
ugccucgaggauccccggggac

SEQ ID NO: 534668 - RNA, 19 nt, Human
ugcggccgugcaggagcgc

SEQ ID NO: 534669 - RNA, 21 nt, Human
ugcugggcaggcugagcccug

SEQ ID NO: 534670 - RNA, 20 nt, Human
uggccucagggcucggcgcc

SEQ ID NO: 534671 - RNA, 23 nt, Human
uucaaaaccagcccaggccaugc

SEQ ID NO: 534672 - RNA, 22 nt, Human
uucauguagggggccaucucgg

SEQ ID NO: 534673 - RNA, 25 nt, Human
uuguagguaauguacuuauggauga

SEQ ID NO: 534674 - RNA, 20 nt, Human
aaaacccagggcccagcccc

SEQ ID NO: 534675 - RNA, 21 nt, Human
aaagcugaacucaacagcagc

SEQ ID NO: 534676 - RNA, 20 nt, Human
aagcugaacucaacagcagc

SEQ ID NO: 534677 - RNA, 21 nt, Human
acagacccagagacucggcca

SEQ ID NO: 534678 - RNA, 21 nt, Human
acagccaggugcccucagacc

SEQ ID NO: 534679 - RNA, 18 nt, Human
acccagagacucggccag

SEQ ID NO: 534680 - RNA, 20 nt, Human
agaccccuggcucugcacaa

SEQ ID NO: 534681 - RNA, 21 nt, Human
agccaggugcccucagacccc

SEQ ID NO: 534682 - RNA, 18 nt, Human
agcccggcccccgcccca

SEQ ID NO: 534683 - RNA, 21 nt, Human
aggagcaggccccacccagag

SEQ ID NO: 534684 - RNA, 19 nt, Human
aggccugugugcugggaug

SEQ ID NO: 534685 - RNA, 19 nt, Human
aggccugugugcugggaug

SEQ ID NO: 534686 - RNA, 18 nt, Human
aggcggcccagccccagg

SEQ ID NO: 534687 - RNA, 18 nt, Human
agggagggggugggcagg

SEQ ID NO: 534688 - RNA, 18 nt, Human
agggagggggugggcagg

SEQ ID NO: 534689 - RNA, 22 nt, Human
agggagggggugggcagggagg

SEQ ID NO: 534690 - RNA, 21 nt, Human
aggucccggugcagagggagu

SEQ ID NO: 534691 - RNA, 22 nt, Human
augaaccccauggagggaugcc

SEQ ID NO: 534692 - RNA, 23 nt, Human
augugggcugcugggcugcuggg

SEQ ID NO: 534693 - RNA, 22 nt, Human
caaaacccagggcccagcccca

SEQ ID NO: 534694 - RNA, 23 nt, Human
caaaggcccgagggguggggcca

SEQ ID NO: 534695 - RNA, 22 nt, Human
cacagccaggugcccucagacc

SEQ ID NO: 534696 - RNA, 18 nt, Human
cacagggcgggauccucc

SEQ ID NO: 534697 - RNA, 20 nt, Human
cagacagucggagacucggc

SEQ ID NO: 534698 - RNA, 18 nt, Human
cagcagcaaugagagugc

SEQ ID NO: 534699 - RNA, 18 nt, Human
cagccccagcugggcccc

SEQ ID NO: 534700 - RNA, 19 nt, Human
cagcgaguuucucaaaacc

SEQ ID NO: 534701 - RNA, 21 nt, Human
cagcugggcacauccggggca

SEQ ID NO: 534702 - RNA, 21 nt, Human
cagcugggccccugccaagcc

SEQ ID NO: 534703 - RNA, 19 nt, Human
caggagccagcugggcaca

SEQ ID NO: 534704 - RNA, 23 nt, Human
caggcagagguggcugguccagc

SEQ ID NO: 534705 - RNA, 18 nt, Human
ccacccagagccuccucu

SEQ ID NO: 534706 - RNA, 21 nt, Human
ccagagccuccucugaaggaa

SEQ ID NO: 534707 - RNA, 22 nt, Human
ccagcugcgcggccggguccag

SEQ ID NO: 534708 - RNA, 20 nt, Human
ccaggagccagcugggcaca

SEQ ID NO: 534709 - RNA, 22 nt, Human
ccaggcgaggcauggcagguca

SEQ ID NO: 534710 - RNA, 26 nt, Human
cccacagcugagccuccaggcgaggc

SEQ ID NO: 534711 - RNA, 19 nt, Human
ccccagcugggccccugcc

SEQ ID NO: 534712 - RNA, 20 nt, Human
ccccagggacugcagccucu

SEQ ID NO: 534713 - RNA, 22 nt, Human
cccccagggacugcagccucug

SEQ ID NO: 534714 - RNA, 25 nt, Human
cccccgccccagcccucccucagcu

SEQ ID NO: 534715 - RNA, 19 nt, Human
ccccgccccagcccucccu

SEQ ID NO: 534716 - RNA, 20 nt, Human
ccccgccccagcccucccuc

SEQ ID NO: 534717 - RNA, 27 nt, Human
cccggcccccgccccagcccucccuca

SEQ ID NO: 534718 - RNA, 18 nt, Human
cccuacaguccaccagcu

SEQ ID NO: 534719 - RNA, 19 nt, Human
cccucagaccccuggcucu

SEQ ID NO: 534720 - RNA, 19 nt, Human
ccugcugcccagacugccc

SEQ ID NO: 534721 - RNA, 19 nt, Human
ccuggcucugcacaagggg

SEQ ID NO: 534722 - RNA, 23 nt, Human
cgccccagcccucccucagcugg

SEQ ID NO: 534723 - RNA, 21 nt, Human
cggcccccgccccagcccucc

SEQ ID NO: 534724 - RNA, 18 nt, Human
cuaaguaagcagggaugg

SEQ ID NO: 534725 - RNA, 20 nt, Human
cuacacuguaacuagcagca

SEQ ID NO: 534726 - RNA, 19 nt, Human
cugggcggaggccucugcc

SEQ ID NO: 534727 - RNA, 21 nt, Human
cuuggggggaugaggagcagg

SEQ ID NO: 534728 - RNA, 21 nt, Human
gaaagcacagacagucggaga

SEQ ID NO: 534729 - RNA, 18 nt, Human
gagagugcugggugggcu

SEQ ID NO: 534730 - RNA, 18 nt, Human
gaucgauacggcagggag

SEQ ID NO: 534731 - RNA, 20 nt, Human
gcagcccggcgacgcuggcc

SEQ ID NO: 534732 - RNA, 23 nt, Human
gcagggaggguccugaacacaug

SEQ ID NO: 534733 - RNA, 22 nt, Human
gcccacagcugagccuccagga

SEQ ID NO: 534734 - RNA, 19 nt, Human
gcccacagcugagccuccg

SEQ ID NO: 534735 - RNA, 25 nt, Human
gcccccgccccagcccucccucagc

SEQ ID NO: 534736 - RNA, 19 nt, Human
gccccugccaagccccagg

SEQ ID NO: 534737 - RNA, 21 nt, Human
ggaacacagccaggugcccuc

SEQ ID NO: 534738 - RNA, 21 nt, Human
ggaccggaacccacaggggga

SEQ ID NO: 534739 - RNA, 21 nt, Human
ggacugcagccucugcggcca

SEQ ID NO: 534740 - RNA, 24 nt, Human
ggcagggaggguccugaacacaug

SEQ ID NO: 534741 - RNA, 21 nt, Human
gggcagggaggguccugaaca

SEQ ID NO: 534742 - RNA, 20 nt, Human
gggcugcugggcugcugggc

SEQ ID NO: 534743 - RNA, 20 nt, Human
ggggagcacgaggcggccca

SEQ ID NO: 534744 - RNA, 21 nt, Human
gggguggggccaggagccagc

SEQ ID NO: 534745 - RNA, 24 nt, Human
gggugggcuuggggggaugaggag

SEQ ID NO: 534746 - RNA, 18 nt, Human
ggguggggccaggagcca

SEQ ID NO: 534747 - RNA, 24 nt, Human
ggguggggccaggagccagcuggg

SEQ ID NO: 534748 - RNA, 20 nt, Human
gugcagagggaguggccuga

SEQ ID NO: 534749 - RNA, 19 nt, Human
uacacagucccggggagca

SEQ ID NO: 534750 - RNA, 18 nt, Human
uacaguccaccagcugcg

SEQ ID NO: 534751 - RNA, 19 nt, Human
uacggcagggagggggugg

SEQ ID NO: 534752 - RNA, 20 nt, Human
uagacagacccagagacucg

SEQ ID NO: 534753 - RNA, 20 nt, Human
uaugaaccccauggagggau

SEQ ID NO: 534754 - RNA, 23 nt, Human
ucagugccuggccgcugagcauc

SEQ ID NO: 534755 - RNA, 22 nt, Human
uccacacugaggcugguaaaag

SEQ ID NO: 534756 - RNA, 20 nt, Human
uccacgggccacagggcggg

SEQ ID NO: 534757 - RNA, 24 nt, Human
uccagcuucuugcggcgaccggag

SEQ ID NO: 534758 - RNA, 20 nt, Human
ucucaaaacccagggcccag

SEQ ID NO: 534759 - RNA, 23 nt, Human
ucucaaaacccagggcccagccc

SEQ ID NO: 534760 - RNA, 23 nt, Human
ugaaagcacagacagucggagac

SEQ ID NO: 534761 - RNA, 25 nt, Human
ugcccagacugccccuaccgggucc

SEQ ID NO: 534762 - RNA, 25 nt, Human
ugcccucagaccccuggcucugcac

SEQ ID NO: 534763 - RNA, 20 nt, Human
ugcugggauggagccuccac

SEQ ID NO: 534764 - RNA, 21 nt, Human
ugcugggcugcugggccgggg

SEQ ID NO: 534765 - RNA, 19 nt, Human
uggacaaaagcugggagcu

SEQ ID NO: 534766 - RNA, 23 nt, Human
uggacaaaagcugggagcuccug

SEQ ID NO: 534767 - RNA, 23 nt, Human
uggcaagaggaguguaagugaaa

SEQ ID NO: 534768 - RNA, 18 nt, Human
uggccguggacaaaagcu

SEQ ID NO: 534769 - RNA, 19 nt, Human
uggccguggacaaaagcug

SEQ ID NO: 534770 - RNA, 24 nt, Human
uggccugauggugacugggcggag

SEQ ID NO: 534771 - RNA, 24 nt, Human
uggccugauggugacugggcggag

SEQ ID NO: 534772 - RNA, 25 nt, Human
uggccugauggugacugggcggagg

SEQ ID NO: 534773 - RNA, 18 nt, Human
ugggaacacagccaggug

SEQ ID NO: 534774 - RNA, 19 nt, Human
ugggccccugccaagcccc

SEQ ID NO: 534775 - RNA, 24 nt, Human
ugggccccugccaagccccaggcc

SEQ ID NO: 534776 - RNA, 21 nt, Human
ugggcuuggggggaugaggag

SEQ ID NO: 534777 - RNA, 20 nt, Human
uggggccaggagccagcugg

SEQ ID NO: 534778 - RNA, 21 nt, Human
uggggccaggagccagcuggg

SEQ ID NO: 534779 - RNA, 20 nt, Human
ugggggguggcaagaggagu

SEQ ID NO: 534780 - RNA, 24 nt, Human
ugguaaaagcugaacucaacagca

SEQ ID NO: 534781 - RNA, 21 nt, Human
ugugcugggauggagccucca

SEQ ID NO: 534782 - RNA, 18 nt, Human
uguuucggggguguagaa

SEQ ID NO: 534783 - RNA, 19 nt, Human
aaacgcggcgaucaacagc

SEQ ID NO: 534784 - RNA, 21 nt, Human
acuccaaucccaggaaggccc

SEQ ID NO: 534785 - RNA, 22 nt, Human
agaaagcucgagacuccaaucc

SEQ ID NO: 534786 - RNA, 18 nt, Human
caaccccuuccccagccu

SEQ ID NO: 534787 - RNA, 19 nt, Human
cagccccgaggcgcgagaa

SEQ ID NO: 534788 - RNA, 18 nt, Human
ccagccucgcagccccga

SEQ ID NO: 534789 - RNA, 24 nt, Human
cccacgcguccgcccacgcguccg

SEQ ID NO: 534790 - RNA, 24 nt, Human
ccccuccaaccccuuccccagccu

SEQ ID NO: 534791 - RNA, 18 nt, Human
cccuuccccagccucgca

SEQ ID NO: 534792 - RNA, 21 nt, Human
cgagaagggcgcgaacccgcc

SEQ ID NO: 534793 - RNA, 24 nt, Human
cgagaagggcgcgaacccgccggc

SEQ ID NO: 534794 - RNA, 20 nt, Human
cgcagccccgaggcgcgaga

SEQ ID NO: 534795 - RNA, 23 nt, Human
cgcggcgaucaacagcccccucc

SEQ ID NO: 534796 - RNA, 20 nt, Human
cggcgaacgaacgaagaaag

SEQ ID NO: 534797 - RNA, 18 nt, Human
cuccaaucccaggaaggc

SEQ ID NO: 534798 - RNA, 19 nt, Human
cucgagacuccaaucccag

SEQ ID NO: 534799 - RNA, 24 nt, Human
cuuaaacgcggcgaucaacagccc

SEQ ID NO: 534800 - RNA, 27 nt, Human
gcccccuccaaccccuuccccagccuc

SEQ ID NO: 534801 - RNA, 26 nt, Human
guaaauuucuuaaacauuauccagaa

SEQ ID NO: 534802 - RNA, 23 nt, Human
guacuaauauacacaaaaggcca

SEQ ID NO: 534803 - RNA, 22 nt, Human
uaauauacacaaaaggccaaaa

SEQ ID NO: 534804 - RNA, 18 nt, Human
uacacaaaaggccaaaac

SEQ ID NO: 534805 - RNA, 25 nt, Human
ucaacagcccccuccaaccccuucc

SEQ ID NO: 534806 - RNA, 20 nt, Human
uccagaaaaauaacaagagg

SEQ ID NO: 534807 - RNA, 23 nt, Human
uggaaaaaaaguuaacuuuucau

SEQ ID NO: 534808 - RNA, 23 nt, Human
uucauacuaacaaacagaacaag

SEQ ID NO: 534809 - RNA, 20 nt, Human
uuccccagccucgcagcccc

SEQ ID NO: 534810 - RNA, 23 nt, Human
uuuggaaaaaaaguuaacuuuuc

SEQ ID NO: 534811 - RNA, 23 nt, Human
uuuucauacuaacaaacagaaca

SEQ ID NO: 534812 - RNA, 21 nt, Human
aaaccugcaguccuaccccgg

SEQ ID NO: 534813 - RNA, 18 nt, Human
aacagguucaugugaaac

SEQ ID NO: 534814 - RNA, 20 nt, Human
aauguccacagccuagaaca

SEQ ID NO: 534815 - RNA, 22 nt, Human
accaauguccacagccuagaac

SEQ ID NO: 534816 - RNA, 21 nt, Human
agaaccucuccacaccaaugu

SEQ ID NO: 534817 - RNA, 22 nt, Human
agaaccucuccacaccaauguc

SEQ ID NO: 534818 - RNA, 22 nt, Human
cacaccaauguccacagccuag

SEQ ID NO: 534819 - RNA, 18 nt, Human
uccacaccaauguccaca

SEQ ID NO: 534820 - RNA, 21 nt, Human
ugccuggaugaagcaagaguu

SEQ ID NO: 534821 - RNA, 23 nt, Human
uuacauauuuuuaaaaaauugca

SEQ ID NO: 534822 - RNA, 19 nt, Human
uucacauaaaagagcuuua

SEQ ID NO: 534823 - RNA, 24 nt, Human
aaaaaaaaaaagcguuuuucuggg

SEQ ID NO: 534824 - RNA, 18 nt, Human
aacaacacauacccaccu

SEQ ID NO: 534825 - RNA, 23 nt, Human
acacacacgugcgcgcacacaca

SEQ ID NO: 534826 - RNA, 33 nt, Human
acacauacccaccuacacacacgugcgcgcagu

SEQ ID NO: 534827 - RNA, 24 nt, Human
acauagcacuucuuucuugccucu

SEQ ID NO: 534828 - RNA, 25 nt, Human
acgugcgcgcacacacauacacaca

SEQ ID NO: 534829 - RNA, 22 nt, Human
acuggggaggaugagaccagca

SEQ ID NO: 534830 - RNA, 18 nt, Human
agcugaucuucaaucagc

SEQ ID NO: 534831 - RNA, 23 nt, Human
augacagugggcugggaggccgg

SEQ ID NO: 534832 - RNA, 30 nt, Human
caacacauacccaccuacacacacgugcgg

SEQ ID NO: 534833 - RNA, 21 nt, Human
caccgcugaaaaacucaucuu

SEQ ID NO: 534834 - RNA, 25 nt, Human
ccuccugcaagacccagaugaagaa

SEQ ID NO: 534835 - RNA, 24 nt, Human
ccugccuccugcaagacccagaug

SEQ ID NO: 534836 - RNA, 22 nt, Human
cuagugaccccucugugcuucu

SEQ ID NO: 534837 - RNA, 20 nt, Human
cucagguggaccugccucug

SEQ ID NO: 534838 - RNA, 20 nt, Human
cucucagguggaccugccuc

SEQ ID NO: 534839 - RNA, 18 nt, Human
cuggaggggcugaaggcu

SEQ ID NO: 534840 - RNA, 23 nt, Human
ggaggggcugaaggcuugaagga

SEQ ID NO: 534841 - RNA, 20 nt, Human
uaaaaaaauagacccaaauu

SEQ ID NO: 534842 - RNA, 23 nt, Human
uacaauccauauaaaaaaauaga

SEQ ID NO: 534843 - RNA, 24 nt, Human
uauuaaaaaaaaaaagcguuuuuc

SEQ ID NO: 534844 - RNA, 21 nt, Human
ucaauggucgagaucugagac

SEQ ID NO: 534845 - RNA, 24 nt, Human
ucauucucuucuucagagaccuug

SEQ ID NO: 534846 - RNA, 23 nt, Human
uccugcaagacccagaugaagaa

SEQ ID NO: 534847 - RNA, 21 nt, Human
ucugcuuguggggacaagggu

SEQ ID NO: 534848 - RNA, 18 nt, Human
ucuuucuugccucuuuca

SEQ ID NO: 534849 - RNA, 21 nt, Human
ugaaggcuugaaggaaggugg

SEQ ID NO: 534850 - RNA, 21 nt, Human
ugacagugggcugggaggccg

SEQ ID NO: 534851 - RNA, 27 nt, Human
ugcgcgcacacacauacacacaaggug

SEQ ID NO: 534852 - RNA, 18 nt, Human
uggauugaucuacaaucc

SEQ ID NO: 534853 - RNA, 21 nt, Human
uuaaacaacacauacccaccu

SEQ ID NO: 534854 - RNA, 18 nt, Human
aaggguccuuggagcugg

SEQ ID NO: 534855 - RNA, 21 nt, Human
ccaagagacguuccacucacc

SEQ ID NO: 534856 - RNA, 20 nt, Human
ccacugcuuucaggcccaag

SEQ ID NO: 534857 - RNA, 22 nt, Human
cccaagagacguuccacucacc

SEQ ID NO: 534858 - RNA, 21 nt, Human
uggagcugggcagauggugcc

SEQ ID NO: 534859 - RNA, 23 nt, Human
uggauuccagucuccugguccuc

SEQ ID NO: 534860 - RNA, 23 nt, Human
ugggcagauggugccgggguagc

SEQ ID NO: 534861 - RNA, 22 nt, Human
aaaaaagcagcauaguaaauaa

SEQ ID NO: 534862 - RNA, 22 nt, Human
aaaaacaaggggaaaauauagc

SEQ ID NO: 534863 - RNA, 24 nt, Human
aaaaagcagcauaguaaauaaagc

SEQ ID NO: 534864 - RNA, 21 nt, Human
aaaaauguuaagguucccuca

SEQ ID NO: 534865 - RNA, 23 nt, Human
aaacaacaacaaauuaucugauc

SEQ ID NO: 534866 - RNA, 29 nt, Human
aaacaacaacaaauuaucugaucccuuuc

SEQ ID NO: 534867 - RNA, 19 nt, Human
aaacaaggggaaaauauag

SEQ ID NO: 534868 - RNA, 20 nt, Human
aaaccuuuuaaaaacaaggg

SEQ ID NO: 534869 - RNA, 22 nt, Human
aagcagcauaguaaauaaagcu

SEQ ID NO: 534870 - RNA, 24 nt, Human
aaucacugaugacauaugccugag

SEQ ID NO: 534871 - RNA, 18 nt, Human
aaugauaugaauuauuca

SEQ ID NO: 534872 - RNA, 24 nt, Human
acaauucacauuuugcuaacugaa

SEQ ID NO: 534873 - RNA, 21 nt, Human
agaauauauuuccccaaagaa

SEQ ID NO: 534874 - RNA, 19 nt, Human
agaauccuuaccaccaccu

SEQ ID NO: 534875 - RNA, 21 nt, Human
agauggaugcucuaauaaagg

SEQ ID NO: 534876 - RNA, 23 nt, Human
caaccuccagaaaccuccugagg

SEQ ID NO: 534877 - RNA, 21 nt, Human
caagaguaaagacuguaacaa

SEQ ID NO: 534878 - RNA, 22 nt, Human
cacaaaaaagcagcauaguaaa

SEQ ID NO: 534879 - RNA, 23 nt, Human
caccuguugagaagcaaagaaaa

SEQ ID NO: 534880 - RNA, 21 nt, Human
cacuaaaaaccaaagcauaau

SEQ ID NO: 534881 - RNA, 24 nt, Human
cagcauaguaaauaaagcugaaga

SEQ ID NO: 534882 - RNA, 20 nt, Human
cagucaguuacagagcccua

SEQ ID NO: 534883 - RNA, 19 nt, Human
caucauucaaaugaaaagc

SEQ ID NO: 534884 - RNA, 18 nt, Human
ccaauagguaggcaccug

SEQ ID NO: 534885 - RNA, 23 nt, Human
cccaaggaaaguuggcaaaauac

SEQ ID NO: 534886 - RNA, 24 nt, Human
ccuccagaaaccuccugaggcaaa

SEQ ID NO: 534887 - RNA, 18 nt, Human
ccuccugaggcaaagcca

SEQ ID NO: 534888 - RNA, 24 nt, Human
ccuguccugcugccaacucaaaag

SEQ ID NO: 534889 - RNA, 19 nt, Human
ccuuuagaaucacugauga

SEQ ID NO: 534890 - RNA, 18 nt, Human
gaaggaugcagcuguuuc

SEQ ID NO: 534891 - RNA, 23 nt, Human
gacacacuaauucacuuuaacac

SEQ ID NO: 534892 - RNA, 19 nt, Human
gaggucuccuuucaccaaa

SEQ ID NO: 534893 - RNA, 19 nt, Human
gcaccuguugagaagcaaa

SEQ ID NO: 534894 - RNA, 21 nt, Human
ggcggcccaauagguaggcac

SEQ ID NO: 534895 - RNA, 26 nt, Human
gucuccuuucaccaaaaguuguaucc

SEQ ID NO: 534896 - RNA, 18 nt, Human
guucauacaauucacauu

SEQ ID NO: 534897 - RNA, 19 nt, Human
uaaaaacaaggggaaaaua

SEQ ID NO: 534898 - RNA, 21 nt, Human
uaaaacauaaucuguaaacaa

SEQ ID NO: 534899 - RNA, 21 nt, Human
uaaaaucagugaacuguagaa

SEQ ID NO: 534900 - RNA, 20 nt, Human
uaaauaaagcugaagaggua

SEQ ID NO: 534901 - RNA, 19 nt, Human
uaacugaaaacucaaggua

SEQ ID NO: 534902 - RNA, 18 nt, Human
uaagagcaaaugugugua

SEQ ID NO: 534903 - RNA, 19 nt, Human
uagaaaaugcaaaugccau

SEQ ID NO: 534904 - RNA, 21 nt, Human
uagaaaaugcaaaugccauga

SEQ ID NO: 534905 - RNA, 24 nt, Human
uagaaaaugcaaaugccaugaaga

SEQ ID NO: 534906 - RNA, 18 nt, Human
uauccuaaaagugcgaga

SEQ ID NO: 534907 - RNA, 19 nt, Human
uauuucacagcccuggcug

SEQ ID NO: 534908 - RNA, 23 nt, Human
ucaaccuccagaaaccuccugag

SEQ ID NO: 534909 - RNA, 21 nt, Human
ucauucacuaaaaaccaaagc

SEQ ID NO: 534910 - RNA, 21 nt, Human
ucccuccagcuccuguggccu

SEQ ID NO: 534911 - RNA, 19 nt, Human
ugagaagcaaagaaaacaa

SEQ ID NO: 534912 - RNA, 24 nt, Human
ugaucccuguccugcugccaacuc

SEQ ID NO: 534913 - RNA, 23 nt, Human
ugccagggucaccagauggaugc

SEQ ID NO: 534914 - RNA, 21 nt, Human
ugccugacaaauaaaauaaga

SEQ ID NO: 534915 - RNA, 22 nt, Human
uuccaguacuucuguuguaauu

SEQ ID NO: 534916 - RNA, 27 nt, Human
uuccaguacuucuguuguaauuccuuu

SEQ ID NO: 534917 - RNA, 21 nt, Human
uucuuaauuuuuucauucacu

SEQ ID NO: 534918 - RNA, 21 nt, Human
uuucuaaggaucuuacccacu

SEQ ID NO: 534919 - RNA, 24 nt, Human
uuucuuuuuaucaagaguaaagac

SEQ ID NO: 534920 - RNA, 21 nt, Human
uuugcaaucccuccagcuccu

SEQ ID NO: 534921 - RNA, 21 nt, Human
uuuucauucacuaaaaaccaa

SEQ ID NO: 534922 - RNA, 21 nt, Human
uuuuuugucuuugcuaaguug

SEQ ID NO: 534923 - RNA, 18 nt, Human
uuuuuuuuuuuuuuuuug

SEQ ID NO: 534924 - RNA, 23 nt, Human
uuuuuuuuuuuuuuuuuggagau

SEQ ID NO: 534925 - RNA, 21 nt, Human
aaggucccagcaaaccucccc

SEQ ID NO: 534926 - RNA, 23 nt, Human
acacacacacacacacacacaca

SEQ ID NO: 534927 - RNA, 23 nt, Human
acacacacacacacacacacaca

SEQ ID NO: 534928 - RNA, 23 nt, Human
acacacacacacacacacacaca

SEQ ID NO: 534929 - RNA, 23 nt, Human
acacacacacacacacacacaca

SEQ ID NO: 534930 - RNA, 23 nt, Human
acacacacacacacacacacaca

SEQ ID NO: 534931 - RNA, 23 nt, Human
acacacacacacacacacacaca

SEQ ID NO: 534932 - RNA, 23 nt, Human
acacacacacacacacacacaca

SEQ ID NO: 534933 - RNA, 22 nt, Human
acacugggucccagggcccagc

SEQ ID NO: 534934 - RNA, 19 nt, Human
agccaaggucccagcaaac

SEQ ID NO: 534935 - RNA, 23 nt, Human
agggcccagccccaagggucccc

SEQ ID NO: 534936 - RNA, 19 nt, Human
agggggcucgaagggcugg

SEQ ID NO: 534937 - RNA, 19 nt, Human
agggucccccaccagccac

SEQ ID NO: 534938 - RNA, 20 nt, Human
aucuagacgcagcacugagg

SEQ ID NO: 534939 - RNA, 24 nt, Human
augacaguacagaagagcaugggc

SEQ ID NO: 534940 - RNA, 18 nt, Human
cacacacacacacacaca

SEQ ID NO: 534941 - RNA, 20 nt, Human
cacacacacacacacacaca

SEQ ID NO: 534942 - RNA, 20 nt, Human
cacacacacacacacacaca

SEQ ID NO: 534943 - RNA, 20 nt, Human
cacacacacacacacacaca

SEQ ID NO: 534944 - RNA, 20 nt, Human
cacacacacacacacacaca

SEQ ID NO: 534945 - RNA, 20 nt, Human
cacacacacacacacacaca

SEQ ID NO: 534946 - RNA, 20 nt, Human
cacacacacacacacacaca

SEQ ID NO: 534947 - RNA, 20 nt, Human
cacacacacacacacacaca

SEQ ID NO: 534948 - RNA, 20 nt, Human
cacacacacacacacacaca

SEQ ID NO: 534949 - RNA, 20 nt, Human
cacacacacacacacacaca

SEQ ID NO: 534950 - RNA, 20 nt, Human
cacacacacacacacacaca

SEQ ID NO: 534951 - RNA, 20 nt, Human
cacacacacacacacacaca

SEQ ID NO: 534952 - RNA, 22 nt, Human
cacacacacacacacacacaca

SEQ ID NO: 534953 - RNA, 22 nt, Human
cacacacacacacacacacaca

SEQ ID NO: 534954 - RNA, 22 nt, Human
cacacacacacacacacacaca

SEQ ID NO: 534955 - RNA, 22 nt, Human
cacacacacacacacacacaca

SEQ ID NO: 534956 - RNA, 26 nt, Human
cacacacacacacacacacacacaca

SEQ ID NO: 534957 - RNA, 26 nt, Human
cacacacacacacacacacacacaca

SEQ ID NO: 534958 - RNA, 26 nt, Human
cacacacacacacacacacacacaca

SEQ ID NO: 534959 - RNA, 26 nt, Human
cacacacacacacacacacacacaca

SEQ ID NO: 534960 - RNA, 28 nt, Human
cacacacacacacacacacacacaggca

SEQ ID NO: 534961 - RNA, 26 nt, Human
cacacacacacacacacaggcagcca

SEQ ID NO: 534962 - RNA, 22 nt, Human
cacacacacacacaggcagcca

SEQ ID NO: 534963 - RNA, 24 nt, Human
cacacugggucccagggcccagcc

SEQ ID NO: 534964 - RNA, 23 nt, Human
cacugggucccagggcccagccc

SEQ ID NO: 534965 - RNA, 22 nt, Human
cagcaaaccuccccugcagaau

SEQ ID NO: 534966 - RNA, 20 nt, Human
cagccacaccccucuagcgg

SEQ ID NO: 534967 - RNA, 18 nt, Human
caguacagaagagcaugg

SEQ ID NO: 534968 - RNA, 21 nt, Human
caugggcugcgcuacccccuc

SEQ ID NO: 534969 - RNA, 22 nt, Human
cccagccccaagggucccccac

SEQ ID NO: 534970 - RNA, 19 nt, Human
ccccaccagccacaccccu

SEQ ID NO: 534971 - RNA, 20 nt, Human
ccccaccagccacaccccuc

SEQ ID NO: 534972 - RNA, 21 nt, Human
ccccaccagccacaccccucu

SEQ ID NO: 534973 - RNA, 23 nt, Human
ccccgcggcguccgcgacuccgg

SEQ ID NO: 534974 - RNA, 19 nt, Human
ccccucagcugacagggcu

SEQ ID NO: 534975 - RNA, 19 nt, Human
ccucagcugacagggcugu

SEQ ID NO: 534976 - RNA, 18 nt, Human
ccucugcgaccgcagcuc

SEQ ID NO: 534977 - RNA, 21 nt, Human
cgacuccggcuccgucggccu

SEQ ID NO: 534978 - RNA, 25 nt, Human
cgcacacacacacacacacacacac

SEQ ID NO: 534979 - RNA, 25 nt, Human
cgcgcacacacacacacacacacac

SEQ ID NO: 534980 - RNA, 18 nt, Human
cgcgcgcgcgcgcgcgca

SEQ ID NO: 534981 - RNA, 24 nt, Human
cgcgcgcgcgcgcgcgcgcacaca

SEQ ID NO: 534982 - RNA, 24 nt, Human
cgcgcgcgcgcgcgcgcgcgcaca

SEQ ID NO: 534983 - RNA, 24 nt, Human
cgcgcgcgcgcgcgcgcgcgcgcg

SEQ ID NO: 534984 - RNA, 23 nt, Human
cggccucugcgaccgcagcuccc

SEQ ID NO: 534985 - RNA, 19 nt, Human
cggcuccgucggccucugc

SEQ ID NO: 534986 - RNA, 20 nt, Human
cugcgaccgcagcucccggg

SEQ ID NO: 534987 - RNA, 21 nt, Human
gagccaaggucccagcaaacc

SEQ ID NO: 534988 - RNA, 23 nt, Human
gcgcgcacacacacacacacaca

SEQ ID NO: 534989 - RNA, 21 nt, Human
gcgcgcgcgcgcgcgcgcgcg

SEQ ID NO: 534990 - RNA, 23 nt, Human
gcgcgcgcgcgcgcgcgcgcgca

SEQ ID NO: 534991 - RNA, 20 nt, Human
gcggcguccgcgacuccggc

SEQ ID NO: 534992 - RNA, 20 nt, Human
ggagggggcucgaagggcug

SEQ ID NO: 534993 - RNA, 18 nt, Human
ggcuggggcaggcucugg

SEQ ID NO: 534994 - RNA, 21 nt, Human
gggagggggcucgaagggcug

SEQ ID NO: 534995 - RNA, 22 nt, Human
gggcuggggcaggcucugggag

SEQ ID NO: 534996 - RNA, 23 nt, Human
ggggagggggcucgaagggcugg

SEQ ID NO: 534997 - RNA, 19 nt, Human
ucccagcaaaccuccccug

SEQ ID NO: 534998 - RNA, 20 nt, Human
uccgucggccucugcgaccg

SEQ ID NO: 534999 - RNA, 22 nt, Human
uccgucggccucugcgaccgca

SEQ ID NO: 535000 - RNA, 24 nt, Human
uccgucggccucugcgaccgcagc

SEQ ID NO: 535001 - RNA, 22 nt, Human
uccugucccggagaccccgcgg

SEQ ID NO: 535002 - RNA, 18 nt, Human
ucggccucugcgaccgca

SEQ ID NO: 535003 - RNA, 23 nt, Human
uggagccaaggucccagcaaacc

SEQ ID NO: 535004 - RNA, 19 nt, Human
uggggagggggcucgaagg

SEQ ID NO: 535005 - RNA, 24 nt, Human
uggggagggggcucgaagggcugg

SEQ ID NO: 535006 - RNA, 20 nt, Human
uuggggagggggcucgaagg

SEQ ID NO: 535007 - RNA, 19 nt, Human
uuuuuuuuuuuggaggaug

SEQ ID NO: 535008 - RNA, 19 nt, Human
uuuuuuuuuuuuuuuuugg

SEQ ID NO: 535009 - RNA, 23 nt, Human
aaacacauguaugugcuguucuc

SEQ ID NO: 535010 - RNA, 20 nt, Human
aaacucgacaagugcuucuc

SEQ ID NO: 535011 - RNA, 24 nt, Human
aaagaccacccaucuugacccucc

SEQ ID NO: 535012 - RNA, 24 nt, Human
aaagugcugggauuacaggcguga

SEQ ID NO: 535013 - RNA, 20 nt, Human
aacacacacacacacagcca

SEQ ID NO: 535014 - RNA, 24 nt, Human
aagaccaggaggagcggaaggcag

SEQ ID NO: 535015 - RNA, 25 nt, Human
aagcgauccucccgccucagccucu

SEQ ID NO: 535016 - RNA, 21 nt, Human
aagcucuguuuuccgcuucuc

SEQ ID NO: 535017 - RNA, 22 nt, Human
aaggcugggagcugcugccuca

SEQ ID NO: 535018 - RNA, 19 nt, Human
aagugcugggauuacaggc

SEQ ID NO: 535019 - RNA, 19 nt, Human
aagugcugggauuacaggc

SEQ ID NO: 535020 - RNA, 18 nt, Human
acaaaacaguacuuacaa

SEQ ID NO: 535021 - RNA, 21 nt, Human
acaaaacaguacuuacaaggg

SEQ ID NO: 535022 - RNA, 22 nt, Human
acaagggugcugcuggaaucac

SEQ ID NO: 535023 - RNA, 23 nt, Human
acaccacuucagacucccagccu

SEQ ID NO: 535024 - RNA, 19 nt, Human
acacuuguccuggucuuac

SEQ ID NO: 535025 - RNA, 20 nt, Human
acauguaugugcuguucucg

SEQ ID NO: 535026 - RNA, 19 nt, Human
accaggccaucauuguucu

SEQ ID NO: 535027 - RNA, 24 nt, Human
acuccuagucucaagcgauucuuc

SEQ ID NO: 535028 - RNA, 19 nt, Human
acugcagccucaaacuccu

SEQ ID NO: 535029 - RNA, 24 nt, Human
acugcagccucaaacuccuagucu

SEQ ID NO: 535030 - RNA, 19 nt, Human
acuuagugcugaguugcag

SEQ ID NO: 535031 - RNA, 23 nt, Human
agagcaaaagguacuccucaaaa

SEQ ID NO: 535032 - RNA, 18 nt, Human
agagggagcugcccuuuc

SEQ ID NO: 535033 - RNA, 23 nt, Human
agagguuggagcuggggaaagca

SEQ ID NO: 535034 - RNA, 22 nt, Human
agaguugauucuggucaccagc

SEQ ID NO: 535035 - RNA, 18 nt, Human
aggaaugcuggcaccucu

SEQ ID NO: 535036 - RNA, 23 nt, Human
aggauuacuggugugugccacca

SEQ ID NO: 535037 - RNA, 23 nt, Human
agggacugugagccccaggaggg

SEQ ID NO: 535038 - RNA, 22 nt, Human
agggagcugcccuuucucuccu

SEQ ID NO: 535039 - RNA, 23 nt, Human
aggggcugcaaggugggcagggg

SEQ ID NO: 535040 - RNA, 20 nt, Human
agugucuuccacgugggggu

SEQ ID NO: 535041 - RNA, 19 nt, Human
augacaccaacuuagggug

SEQ ID NO: 535042 - RNA, 19 nt, Human
augacccucaccagguuuu

SEQ ID NO: 535043 - RNA, 21 nt, Human
auggagcgcuccccucgcccc

SEQ ID NO: 535044 - RNA, 27 nt, Human
augucgccacauuccagguuguccagu

SEQ ID NO: 535045 - RNA, 22 nt, Human
caaaaaccucuccccacugacu

SEQ ID NO: 535046 - RNA, 21 nt, Human
caaagugcugggauuacaggc

SEQ ID NO: 535047 - RNA, 25 nt, Human
caaccauauuaacucccucaccauc

SEQ ID NO: 535048 - RNA, 23 nt, Human
caacuuagggugaauccuggcuu

SEQ ID NO: 535049 - RNA, 22 nt, Human
caagaaagcuacagccugccac

SEQ ID NO: 535050 - RNA, 24 nt, Human
cacaccacuucagacucccagccu

SEQ ID NO: 535051 - RNA, 19 nt, Human
cacacucuucucucccucc

SEQ ID NO: 535052 - RNA, 22 nt, Human
cacagccaacccccucuccuuu

SEQ ID NO: 535053 - RNA, 20 nt, Human
cacauggguucugggaaaug

SEQ ID NO: 535054 - RNA, 18 nt, Human
cacccugugcauuuggca

SEQ ID NO: 535055 - RNA, 23 nt, Human
caccgcacuggcucaucccccug

SEQ ID NO: 535056 - RNA, 19 nt, Human
cacguuuucccugaugaua

SEQ ID NO: 535057 - RNA, 20 nt, Human
cacucccaacagcccucagc

SEQ ID NO: 535058 - RNA, 22 nt, Human
cacucuguugcccaggcuggag

SEQ ID NO: 535059 - RNA, 20 nt, Human
cacugacuuccaggauaggg

SEQ ID NO: 535060 - RNA, 20 nt, Human
cacuuggcccagccacagca

SEQ ID NO: 535061 - RNA, 24 nt, Human
cagaagaaugagcucaccucucau

SEQ ID NO: 535062 - RNA, 20 nt, Human
cagagcaaaagguacuccuc

SEQ ID NO: 535063 - RNA, 24 nt, Human
cagcacagagcaaaagguacuccu

SEQ ID NO: 535064 - RNA, 24 nt, Human
cagcagcauccgaugagguucaau

SEQ ID NO: 535065 - RNA, 20 nt, Human
cagcauaaagaccacccauc

SEQ ID NO: 535066 - RNA, 24 nt, Human
cagccucaaacuccuagucucaag

SEQ ID NO: 535067 - RNA, 21 nt, Human
cagccucccgcgcaugggcag

SEQ ID NO: 535068 - RNA, 25 nt, Human
cagcugcaucgccagauucuggcac

SEQ ID NO: 535069 - RNA, 20 nt, Human
caggaacacuuguccugguc

SEQ ID NO: 535070 - RNA, 20 nt, Human
caggagccacagcaauggag

SEQ ID NO: 535071 - RNA, 24 nt, Human
caggccuucuggcccucuuuuagg

SEQ ID NO: 535072 - RNA, 22 nt, Human
cagggaaaucagggaaagacca

SEQ ID NO: 535073 - RNA, 24 nt, Human
cagguaggacagauuguugcccuc

SEQ ID NO: 535074 - RNA, 23 nt, Human
caguaauacaaguaggauggcac

SEQ ID NO: 535075 - RNA, 19 nt, Human
caucaccuccagggaaaca

SEQ ID NO: 535076 - RNA, 21 nt, Human
caugcugcagccucccgcgca

SEQ ID NO: 535077 - RNA, 23 nt, Human
cauuguucugagggucgggaaac

SEQ ID NO: 535078 - RNA, 22 nt, Human
ccaacacacacacacacagcca

SEQ ID NO: 535079 - RNA, 23 nt, Human
ccaacacacacacacacagccaa

SEQ ID NO: 535080 - RNA, 19 nt, Human
ccacagggcugcugcuagc

SEQ ID NO: 535081 - RNA, 20 nt, Human
ccaccacaccuggcuaauuu

SEQ ID NO: 535082 - RNA, 19 nt, Human
ccagcccuccucagcuucu

SEQ ID NO: 535083 - RNA, 21 nt, Human
ccaggugaucccaccuguacc

SEQ ID NO: 535084 - RNA, 20 nt, Human
ccccagacuggguguucucc

SEQ ID NO: 535085 - RNA, 21 nt, Human
cccccagcucacuccaugugc

SEQ ID NO: 535086 - RNA, 22 nt, Human
ccccucuccuuuggguuuccca

SEQ ID NO: 535087 - RNA, 20 nt, Human
ccccugccaucacacucuuc

SEQ ID NO: 535088 - RNA, 25 nt, Human
ccccuguaccuggccaggaaugcug

SEQ ID NO: 535089 - RNA, 22 nt, Human
ccccuuaccugccugcccaaca

SEQ ID NO: 535090 - RNA, 29 nt, Human
cccugccaucacacucuucucucccuccc

SEQ ID NO: 535091 - RNA, 22 nt, Human
cccugggaacgcacacaaaaca

SEQ ID NO: 535092 - RNA, 20 nt, Human
cccugggccuuccucgacuc

SEQ ID NO: 535093 - RNA, 22 nt, Human
ccuauguugcccaggcuggucu

SEQ ID NO: 535094 - RNA, 22 nt, Human
ccuauguugcccaggcuggucu

SEQ ID NO: 535095 - RNA, 21 nt, Human
ccuccagcccugacucugccc

SEQ ID NO: 535096 - RNA, 22 nt, Human
ccucuagaacuuaguccccguc

SEQ ID NO: 535097 - RNA, 21 nt, Human
ccugccugcccaacacacaca

SEQ ID NO: 535098 - RNA, 18 nt, Human
ccuggcugcuugcccucc

SEQ ID NO: 535099 - RNA, 23 nt, Human
ccuucagcauaaagaccacccau

SEQ ID NO: 535100 - RNA, 23 nt, Human
ccuucuggcccucuuuuagggaa

SEQ ID NO: 535101 - RNA, 20 nt, Human
ccuuggcucaagcgauccuc

SEQ ID NO: 535102 - RNA, 19 nt, Human
cgacucccugccccugccc

SEQ ID NO: 535103 - RNA, 24 nt, Human
cgccucagccucucaaagugcugg

SEQ ID NO: 535104 - RNA, 22 nt, Human
cgggacaagcccaggggcucug

SEQ ID NO: 535105 - RNA, 20 nt, Human
cucaagcgauccucccgccu

SEQ ID NO: 535106 - RNA, 24 nt, Human
cucaagcgauccucccgccucagc

SEQ ID NO: 535107 - RNA, 24 nt, Human
cucaagcgauucuucuaccucggc

SEQ ID NO: 535108 - RNA, 22 nt, Human
cucacaagcuccgaacccuggg

SEQ ID NO: 535109 - RNA, 23 nt, Human
cucacucccaacagcccucagca

SEQ ID NO: 535110 - RNA, 24 nt, Human
cuccagcugggccugcaucagguu

SEQ ID NO: 535111 - RNA, 28 nt, Human
cuccaggggcugcaagguggggcaaauc

SEQ ID NO: 535112 - RNA, 22 nt, Human
cuccuuggcucaagcgauccuc

SEQ ID NO: 535113 - RNA, 24 nt, Human
cucggccccugccaucacacucuu

SEQ ID NO: 535114 - RNA, 20 nt, Human
cugaggugucacuugacgug

SEQ ID NO: 535115 - RNA, 18 nt, Human
cugcaggcugcaaugcgg

SEQ ID NO: 535116 - RNA, 23 nt, Human
cuggcacuugugcccagggccca

SEQ ID NO: 535117 - RNA, 20 nt, Human
cuggcccuuggcucucucca

SEQ ID NO: 535118 - RNA, 21 nt, Human
cuggcucaucccccuguaccu

SEQ ID NO: 535119 - RNA, 19 nt, Human
cugggagccuacugcaaac

SEQ ID NO: 535120 - RNA, 18 nt, Human
cugggagcugcugccuca

SEQ ID NO: 535121 - RNA, 19 nt, Human
cugugagguggcccuggga

SEQ ID NO: 535122 - RNA, 27 nt, Human
cuguuaauauugcuccugggaugacac

SEQ ID NO: 535123 - RNA, 23 nt, Human
cuuagugcugaguugcagccucc

SEQ ID NO: 535124 - RNA, 22 nt, Human
cuuugccuuuagaguacccgga

SEQ ID NO: 535125 - RNA, 18 nt, Human
gaacccugggccuuccuc

SEQ ID NO: 535126 - RNA, 22 nt, Human
gaacugaccccucugcucucuc

SEQ ID NO: 535127 - RNA, 20 nt, Human
gacacucaggucucuaccuc

SEQ ID NO: 535128 - RNA, 18 nt, Human
gacagugcaggauggcug

SEQ ID NO: 535129 - RNA, 18 nt, Human
gacggcgggagacagacu

SEQ ID NO: 535130 - RNA, 27 nt, Human
gacucccugccccugccccacaccucc

SEQ ID NO: 535131 - RNA, 23 nt, Human
gagauggggucucccuauguugc

SEQ ID NO: 535132 - RNA, 22 nt, Human
gaggcccucaguaggagcgggc

SEQ ID NO: 535133 - RNA, 20 nt, Human
gagggcaggaccacagggcu

SEQ ID NO: 535134 - RNA, 20 nt, Human
gagguuccuccgagccacac

SEQ ID NO: 535135 - RNA, 22 nt, Human
gagugccccacucccaucugcu

SEQ ID NO: 535136 - RNA, 18 nt, Human
gauuacaggcgugagcca

SEQ ID NO: 535137 - RNA, 21 nt, Human
gauuacaggcgugagccacug

SEQ ID NO: 535138 - RNA, 22 nt, Human
gauuacaggcgugagccacugc

SEQ ID NO: 535139 - RNA, 24 nt, Human
gcaaccagcuccucuaaucacaga

SEQ ID NO: 535140 - RNA, 20 nt, Human
gcccagccacagcagcaucc

SEQ ID NO: 535141 - RNA, 24 nt, Human
gcccaggcuggagugcaauggcau

SEQ ID NO: 535142 - RNA, 22 nt, Human
gccccgaguuaagcaaaggccc

SEQ ID NO: 535143 - RNA, 24 nt, Human
gccccuggcacugugcgcugcuuc

SEQ ID NO: 535144 - RNA, 22 nt, Human
gcccuuggcucucuccaccgca

SEQ ID NO: 535145 - RNA, 22 nt, Human
gccuuaccuccagcugcuccac

SEQ ID NO: 535146 - RNA, 24 nt, Human
gcgauccucccgccucagccucuc

SEQ ID NO: 535147 - RNA, 21 nt, Human
gcgccugcucguccuccagcu

SEQ ID NO: 535148 - RNA, 18 nt, Human
gcugcuugcccuccuugg

SEQ ID NO: 535149 - RNA, 25 nt, Human
gcuggagcacagcaguuugccccag

SEQ ID NO: 535150 - RNA, 19 nt, Human
gcuggggcuggugcuaugu

SEQ ID NO: 535151 - RNA, 25 nt, Human
ggaaagcagcagaguuuuacacaac

SEQ ID NO: 535152 - RNA, 24 nt, Human
ggaagaaugguguuggggaucgcg

SEQ ID NO: 535153 - RNA, 22 nt, Human
ggagcacagcaguuugccccau

SEQ ID NO: 535154 - RNA, 23 nt, Human
ggcaggcugggguucccggggcc

SEQ ID NO: 535155 - RNA, 21 nt, Human
ggcagggguggaaucuauagg

SEQ ID NO: 535156 - RNA, 20 nt, Human
ggccaugcuccgauguuggc

SEQ ID NO: 535157 - RNA, 21 nt, Human
ggcccggcgcgucccugaugc

SEQ ID NO: 535158 - RNA, 19 nt, Human
ggcccgggaggagcaggcc

SEQ ID NO: 535159 - RNA, 21 nt, Human
ggccugagccucugauggccu

SEQ ID NO: 535160 - RNA, 25 nt, Human
ggccuucuggcccucuuuuagggaa

SEQ ID NO: 535161 - RNA, 23 nt, Human
ggcugcaaggugggcaggggugg

SEQ ID NO: 535162 - RNA, 18 nt, Human
ggcuggucuugaacuccu

SEQ ID NO: 535163 - RNA, 20 nt, Human
gggaaggaggacaacaggac

SEQ ID NO: 535164 - RNA, 18 nt, Human
gggacaguguguggaaga

SEQ ID NO: 535165 - RNA, 22 nt, Human
gggucucccuauguugcccagg

SEQ ID NO: 535166 - RNA, 23 nt, Human
ggucaguauucccagcuccagca

SEQ ID NO: 535167 - RNA, 20 nt, Human
ggugaauccuggcuuggccu

SEQ ID NO: 535168 - RNA, 18 nt, Human
guagagauggggucuccc

SEQ ID NO: 535169 - RNA, 18 nt, Human
guccagaggccgggacaa

SEQ ID NO: 535170 - RNA, 21 nt, Human
guccuuguaggucucaaggag

SEQ ID NO: 535171 - RNA, 22 nt, Human
gugccugaaaaggcugggagcu

SEQ ID NO: 535172 - RNA, 19 nt, Human
guuaacaugcauauuuaga

SEQ ID NO: 535173 - RNA, 23 nt, Human
uaagcaaaggcccgggaggagca

SEQ ID NO: 535174 - RNA, 25 nt, Human
uaagcaaaggcccgggaggagcagg

SEQ ID NO: 535175 - RNA, 18 nt, Human
uacaacuugucucccuga

SEQ ID NO: 535176 - RNA, 20 nt, Human
uacaggcgugagccacugcu

SEQ ID NO: 535177 - RNA, 24 nt, Human
uacaggcgugagccacugcuccca

SEQ ID NO: 535178 - RNA, 18 nt, Human
uaccuccagcccugacuc

SEQ ID NO: 535179 - RNA, 21 nt, Human
uaccucggccuugugaguagc

SEQ ID NO: 535180 - RNA, 24 nt, Human
uacuggugugugccaccacaccug

SEQ ID NO: 535181 - RNA, 22 nt, Human
uagaacuuaguccccguccccc

SEQ ID NO: 535182 - RNA, 19 nt, Human
uagauguccagcacagagc

SEQ ID NO: 535183 - RNA, 23 nt, Human
uagccaggauuacuggugugugc

SEQ ID NO: 535184 - RNA, 18 nt, Human
uagggcuggucacgaggg

SEQ ID NO: 535185 - RNA, 18 nt, Human
uaggugcuaucacuuggc

SEQ ID NO: 535186 - RNA, 19 nt, Human
uagugucuuccacgugggg

SEQ ID NO: 535187 - RNA, 24 nt, Human
uaguucacugcagccucaaacucc

SEQ ID NO: 535188 - RNA, 20 nt, Human
uauguugcccaggcuggucu

SEQ ID NO: 535189 - RNA, 23 nt, Human
uauguugcccaggcuggucuuga

SEQ ID NO: 535190 - RNA, 24 nt, Human
uauguugcccaggcuggucuugaa

SEQ ID NO: 535191 - RNA, 22 nt, Human
ucaaaaaccucuccccacugac

SEQ ID NO: 535192 - RNA, 22 nt, Human
ucaaagugcugggauuacaggc

SEQ ID NO: 535193 - RNA, 24 nt, Human
ucaaagugcugggauuacaggcgu

SEQ ID NO: 535194 - RNA, 19 nt, Human
ucaacggaguggccuccuc

SEQ ID NO: 535195 - RNA, 21 nt, Human
ucacagauaacagauccagaa

SEQ ID NO: 535196 - RNA, 20 nt, Human
ucacgcagaugaugacaaac

SEQ ID NO: 535197 - RNA, 20 nt, Human
ucacuacuuagugcugaguu

SEQ ID NO: 535198 - RNA, 21 nt, Human
ucacucuguugcccaggcugg

SEQ ID NO: 535199 - RNA, 22 nt, Human
ucacucuguugcccaggcugga

SEQ ID NO: 535200 - RNA, 23 nt, Human
ucacucuguugcccaggcuggag

SEQ ID NO: 535201 - RNA, 24 nt, Human
ucacucuguugcccaggcuggagu

SEQ ID NO: 535202 - RNA, 20 nt, Human
ucacugcagccucaaacucc

SEQ ID NO: 535203 - RNA, 20 nt, Human
ucagacccuguggaacauuc

SEQ ID NO: 535204 - RNA, 18 nt, Human
ucagcaggccuucuggcc

SEQ ID NO: 535205 - RNA, 21 nt, Human
ucauaugagaacaaucaugcu

SEQ ID NO: 535206 - RNA, 23 nt, Human
ucauuuuccacaagaaucacuuc

SEQ ID NO: 535207 - RNA, 24 nt, Human
uccaaccauauuaacucccucacc

SEQ ID NO: 535208 - RNA, 20 nt, Human
uccacaagaaucacuuccaa

SEQ ID NO: 535209 - RNA, 20 nt, Human
uccaccgcacuggcucaucc

SEQ ID NO: 535210 - RNA, 21 nt, Human
uccccaagugggggugcgcuu

SEQ ID NO: 535211 - RNA, 20 nt, Human
uccgcaagcuuuuucugacc

SEQ ID NO: 535212 - RNA, 21 nt, Human
uccgugccugaaaaggcuggg

SEQ ID NO: 535213 - RNA, 21 nt, Human
uccuagucucaagcgauucuu

SEQ ID NO: 535214 - RNA, 19 nt, Human
uccucaaaauuuagcaacc

SEQ ID NO: 535215 - RNA, 18 nt, Human
uccucgacucccugcccc

SEQ ID NO: 535216 - RNA, 24 nt, Human
uccuuggcucaagcgauccucccg

SEQ ID NO: 535217 - RNA, 23 nt, Human
uccuuguaggucucaaggagcuc

SEQ ID NO: 535218 - RNA, 22 nt, Human
ucuacuuuuggaaguuuuucca

SEQ ID NO: 535219 - RNA, 24 nt, Human
ucucaaagugcugggauuacaggc

SEQ ID NO: 535220 - RNA, 19 nt, Human
ucuccaggccugccacucu

SEQ ID NO: 535221 - RNA, 22 nt, Human
ucuccagggugcugauagagau

SEQ ID NO: 535222 - RNA, 23 nt, Human
ucucccuauguugcccaggcugg

SEQ ID NO: 535223 - RNA, 24 nt, Human
ucucccuauguugcccaggcuggu

SEQ ID NO: 535224 - RNA, 19 nt, Human
ucuccuaguugugggcagg

SEQ ID NO: 535225 - RNA, 18 nt, Human
ucucucccuccugcaugg

SEQ ID NO: 535226 - RNA, 20 nt, Human
ucugcagugccugugcucuc

SEQ ID NO: 535227 - RNA, 23 nt, Human
ucugccaugccgccucugccaug

SEQ ID NO: 535228 - RNA, 24 nt, Human
ucuguugcccaggcuggagugcaa

SEQ ID NO: 535229 - RNA, 23 nt, Human
ucuugaacuccuuggcucaagcg

SEQ ID NO: 535230 - RNA, 18 nt, Human
ugaccagggaacgggagu

SEQ ID NO: 535231 - RNA, 19 nt, Human
ugagccccaggagggcagg

SEQ ID NO: 535232 - RNA, 21 nt, Human
ugagggacugugagccccagg

SEQ ID NO: 535233 - RNA, 25 nt, Human
ugagguggcccugggacagugugug

SEQ ID NO: 535234 - RNA, 19 nt, Human
ugagguuaaaugagucacu

SEQ ID NO: 535235 - RNA, 22 nt, Human
ugaugagcaagaaagcuacagc

SEQ ID NO: 535236 - RNA, 23 nt, Human
ugaugagcaagaaagcuacagcc

SEQ ID NO: 535237 - RNA, 18 nt, Human
ugcccaggcuggagugca

SEQ ID NO: 535238 - RNA, 21 nt, Human
ugcccaggcuggagugcaaug

SEQ ID NO: 535239 - RNA, 24 nt, Human
ugcccaggcuggagugcaauggca

SEQ ID NO: 535240 - RNA, 24 nt, Human
ugcccaggcuggucuugaacuccu

SEQ ID NO: 535241 - RNA, 23 nt, Human
ugcccuccuugggccuccucaac

SEQ ID NO: 535242 - RNA, 20 nt, Human
ugccugaaaaggcugggagc

SEQ ID NO: 535243 - RNA, 21 nt, Human
ugcgccugcucguccuccagc

SEQ ID NO: 535244 - RNA, 23 nt, Human
ugcuagcuggagcacagcaguuu

SEQ ID NO: 535245 - RNA, 24 nt, Human
ugcugggauuacaggcgugagcca

SEQ ID NO: 535246 - RNA, 21 nt, Human
uggaagaggccuggccccugg

SEQ ID NO: 535247 - RNA, 25 nt, Human
uggaagaugugaucuccaggccucc

SEQ ID NO: 535248 - RNA, 23 nt, Human
uggagugcaauggcaucuucuua

SEQ ID NO: 535249 - RNA, 22 nt, Human
uggcaggcugggguucccggga

SEQ ID NO: 535250 - RNA, 24 nt, Human
uggccugguucccucuggagcuca

SEQ ID NO: 535251 - RNA, 21 nt, Human
uggcguuguggugagguuaaa

SEQ ID NO: 535252 - RNA, 21 nt, Human
uggcugacauucaucuagucu

SEQ ID NO: 535253 - RNA, 21 nt, Human
ugggaugacaccaacuuaggg

SEQ ID NO: 535254 - RNA, 19 nt, Human
ugggauuacaggcgugagc

SEQ ID NO: 535255 - RNA, 22 nt, Human
ugggauuacaggcgugagccac

SEQ ID NO: 535256 - RNA, 22 nt, Human
ugggauuacaggcgugagccac

SEQ ID NO: 535257 - RNA, 23 nt, Human
ugggauuacaggcgugagccacu

SEQ ID NO: 535258 - RNA, 24 nt, Human
ugggauuacaggcgugagccacug

SEQ ID NO: 535259 - RNA, 24 nt, Human
uggggaaggucaucacagaaagga

SEQ ID NO: 535260 - RNA, 24 nt, Human
ugggggaagaaugguguuggggau

SEQ ID NO: 535261 - RNA, 24 nt, Human
uggggucucccuauguugcccagg

SEQ ID NO: 535262 - RNA, 24 nt, Human
uggguuaacugcuucucacccugu

SEQ ID NO: 535263 - RNA, 20 nt, Human
uggguucugggaaauguuug

SEQ ID NO: 535264 - RNA, 24 nt, Human
uggugugugccaccacaccuggcu

SEQ ID NO: 535265 - RNA, 22 nt, Human
uguagagauggggucucccuau

SEQ ID NO: 535266 - RNA, 24 nt, Human
uguagagauggggucucccuaugu

SEQ ID NO: 535267 - RNA, 19 nt, Human
ugugaaagccaugaggucu

SEQ ID NO: 535268 - RNA, 18 nt, Human
ugugcgcugcuucugcag

SEQ ID NO: 535269 - RNA, 21 nt, Human
uguggaagaggccuggccccu

SEQ ID NO: 535270 - RNA, 21 nt, Human
uguuaaagaacacaguuaaca

SEQ ID NO: 535271 - RNA, 20 nt, Human
uguucugagggucgggaaac

SEQ ID NO: 535272 - RNA, 20 nt, Human
uguugcccaggcuggagugc

SEQ ID NO: 535273 - RNA, 21 nt, Human
uuaccagagguuccuccgagc

SEQ ID NO: 535274 - RNA, 19 nt, Human
uucaaacacauguaugugc

SEQ ID NO: 535275 - RNA, 20 nt, Human
uucaggccauacucaaaaau

SEQ ID NO: 535276 - RNA, 22 nt, Human
uuccagguuguccaguucgcuc

SEQ ID NO: 535277 - RNA, 18 nt, Human
uucuccuggcuggggcug

SEQ ID NO: 535278 - RNA, 24 nt, Human
uucuucaucuggaaaacuagacag

SEQ ID NO: 535279 - RNA, 20 nt, Human
uugaaaagcaugauugcgcu

SEQ ID NO: 535280 - RNA, 26 nt, Human
uugcaaggugccugacagagaggagg

SEQ ID NO: 535281 - RNA, 18 nt, Human
uugcccaggcuggagugc

SEQ ID NO: 535282 - RNA, 24 nt, Human
uuggcaccacuuguugccucuaca

SEQ ID NO: 535283 - RNA, 20 nt, Human
uuguggugagguuaaaugag

SEQ ID NO: 535284 - RNA, 22 nt, Human
uuuagggaaggaggacaacagg

SEQ ID NO: 535285 - RNA, 22 nt, Human
uuucacucuguugcccaggcug

SEQ ID NO: 535286 - RNA, 24 nt, Human
uuucacucuguugcccaggcugga

SEQ ID NO: 535287 - RNA, 24 nt, Human
uuuucacucuguugcccaggcugg

SEQ ID NO: 535288 - RNA, 23 nt, Human
aaaugcagguuccugggccccac

SEQ ID NO: 535289 - RNA, 24 nt, Human
acuccccaguuaauucugagaauc

SEQ ID NO: 535290 - RNA, 22 nt, Human
aggaaacucguaauagcagcug

SEQ ID NO: 535291 - RNA, 20 nt, Human
caacccagaacaagucaugg

SEQ ID NO: 535292 - RNA, 20 nt, Human
cagguuccugggccccaccc

SEQ ID NO: 535293 - RNA, 21 nt, Human
caugcaugcuuuaugugcaau

SEQ ID NO: 535294 - RNA, 21 nt, Human
cauuaaaaauaaaacucccca

SEQ ID NO: 535295 - RNA, 21 nt, Human
ccagaacaagucaugggacau

SEQ ID NO: 535296 - RNA, 22 nt, Human
cccacccuagaucuccugaauc

SEQ ID NO: 535297 - RNA, 24 nt, Human
ccugggccccacccuagaucuccu

SEQ ID NO: 535298 - RNA, 20 nt, Human
cuccugaaucagauagggaa

SEQ ID NO: 535299 - RNA, 24 nt, Human
cucuuccugggugcauguacugcc

SEQ ID NO: 535300 - RNA, 22 nt, Human
gugcaugcaugcuuuaugugca

SEQ ID NO: 535301 - RNA, 19 nt, Human
uccugggugcauguacugc

SEQ ID NO: 535302 - RNA, 20 nt, Human
ugaguaucuugggaagggcg

SEQ ID NO: 535303 - RNA, 19 nt, Human
ugggaaccugcaauguaac

SEQ ID NO: 535304 - RNA, 24 nt, Human
uuaaaaauaaaacuccccaguuaa

SEQ ID NO: 535305 - RNA, 24 nt, Human
uugaaaaugcagguuccugggccc

SEQ ID NO: 535306 - RNA, 23 nt, Human
aaaaaaaaaaaauacaacacaga

SEQ ID NO: 535307 - RNA, 24 nt, Human
aaaaacaccagaauacuagaguau

SEQ ID NO: 535308 - RNA, 20 nt, Human
aaaaagccacuacacccucc

SEQ ID NO: 535309 - RNA, 24 nt, Human
aaaaagccacuacacccuccacca

SEQ ID NO: 535310 - RNA, 22 nt, Human
aaaacaccagaauacuagagua

SEQ ID NO: 535311 - RNA, 18 nt, Human
aagaagcgagguggggag

SEQ ID NO: 535312 - RNA, 19 nt, Human
aaggcuucuuggauagaug

SEQ ID NO: 535313 - RNA, 22 nt, Human
aaguuagaaaaaucuaaaacac

SEQ ID NO: 535314 - RNA, 20 nt, Human
acacagacaacauaaggaca

SEQ ID NO: 535315 - RNA, 22 nt, Human
acuuacaagaggaagagaggga

SEQ ID NO: 535316 - RNA, 24 nt, Human
agaaaaauaaacaaacuaagcaca

SEQ ID NO: 535317 - RNA, 22 nt, Human
agaaaaaucuaaaacacuauaa

SEQ ID NO: 535318 - RNA, 18 nt, Human
agagagggaaugagagga

SEQ ID NO: 535319 - RNA, 22 nt, Human
agaggaagagagggaaugagag

SEQ ID NO: 535320 - RNA, 20 nt, Human
agcacaagcugcaaagugaa

SEQ ID NO: 535321 - RNA, 18 nt, Human
agcccagggcaggggcaa

SEQ ID NO: 535322 - RNA, 27 nt, Human
agcccaucaucuccccaccaucaccuc

SEQ ID NO: 535323 - RNA, 19 nt, Human
agccgaguugcaacagcag

SEQ ID NO: 535324 - RNA, 24 nt, Human
agcgagguggggaggggagagagg

SEQ ID NO: 535325 - RNA, 21 nt, Human
aggacaauggagacgucugcc

SEQ ID NO: 535326 - RNA, 21 nt, Human
agguggggaggggagagagga

SEQ ID NO: 535327 - RNA, 19 nt, Human
aguuagaaaaaucuaaaac

SEQ ID NO: 535328 - RNA, 23 nt, Human
auaaauauaaaaacaccagaaua

SEQ ID NO: 535329 - RNA, 22 nt, Human
caacacagacaacauaaggaca

SEQ ID NO: 535330 - RNA, 22 nt, Human
caacagcagcagugaaggugag

SEQ ID NO: 535331 - RNA, 22 nt, Human
caccaucaccuccccaugggag

SEQ ID NO: 535332 - RNA, 25 nt, Human
caccauggucaauaaaaaaaaaaaa

SEQ ID NO: 535333 - RNA, 22 nt, Human
cacccuccaccaacauucagaa

SEQ ID NO: 535334 - RNA, 22 nt, Human
cacccuccaccaacauucagaa

SEQ ID NO: 535335 - RNA, 19 nt, Human
cagcagcagugaaggugag

SEQ ID NO: 535336 - RNA, 23 nt, Human
cagcagcagugaaggugagugaa

SEQ ID NO: 535337 - RNA, 23 nt, Human
cagccugccaggaagguggccaa

SEQ ID NO: 535338 - RNA, 18 nt, Human
caggaagguggccaacug

SEQ ID NO: 535339 - RNA, 21 nt, Human
ccaacucuuccagccacuguc

SEQ ID NO: 535340 - RNA, 27 nt, Human
ccacuacacccuccaccaacauucaga

SEQ ID NO: 535341 - RNA, 23 nt, Human
ccagcacuccucuagaacugccc

SEQ ID NO: 535342 - RNA, 19 nt, Human
ccccaccaucaccucccca

SEQ ID NO: 535343 - RNA, 26 nt, Human
ccccaucccuccacacacaucagagu

SEQ ID NO: 535344 - RNA, 19 nt, Human
ccccuagcaagggaguggg

SEQ ID NO: 535345 - RNA, 19 nt, Human
ccucaugugugcucuuccu

SEQ ID NO: 535346 - RNA, 21 nt, Human
ccucuagaacugcccugguuu

SEQ ID NO: 535347 - RNA, 23 nt, Human
ccucuugcccuuuucaacugucc

SEQ ID NO: 535348 - RNA, 18 nt, Human
ccuuuuuuuuuuuuuuuu

SEQ ID NO: 535349 - RNA, 21 nt, Human
cucuugcccuuuucaacuguc

SEQ ID NO: 535350 - RNA, 23 nt, Human
cuuucuguagucuugaguaaaag

SEQ ID NO: 535351 - RNA, 18 nt, Human
gagaauuucucaauccag

SEQ ID NO: 535352 - RNA, 19 nt, Human
gcccaucaucuccccacca

SEQ ID NO: 535353 - RNA, 18 nt, Human
gcugggguagcuaccuac

SEQ ID NO: 535354 - RNA, 19 nt, Human
gcuugguucagaggacccu

SEQ ID NO: 535355 - RNA, 21 nt, Human
ggaagaagcgagguggggagg

SEQ ID NO: 535356 - RNA, 19 nt, Human
ggaggggagagaggaaagg

SEQ ID NO: 535357 - RNA, 21 nt, Human
ggcccagauuugacucagagc

SEQ ID NO: 535358 - RNA, 23 nt, Human
gggaagaagcgagguggggaggg

SEQ ID NO: 535359 - RNA, 18 nt, Human
ggggagcccagggcaggg

SEQ ID NO: 535360 - RNA, 20 nt, Human
ggucaauaaaaaaaaaaaaa

SEQ ID NO: 535361 - RNA, 20 nt, Human
gucaauguucuauuccccau

SEQ ID NO: 535362 - RNA, 21 nt, Human
guccaaacucuaggaagccaa

SEQ ID NO: 535363 - RNA, 20 nt, Human
guuuuugaaaaguugccugu

SEQ ID NO: 535364 - RNA, 27 nt, Human
uaaucaccauggucaauaaaaaaaaaa

SEQ ID NO: 535365 - RNA, 18 nt, Human
uacaacacagacaacaua

SEQ ID NO: 535366 - RNA, 18 nt, Human
uacaugaggcaaguuucu

SEQ ID NO: 535367 - RNA, 20 nt, Human
uagaagggcacuuacaagag

SEQ ID NO: 535368 - RNA, 19 nt, Human
ucaccuccccaugggagau

SEQ ID NO: 535369 - RNA, 19 nt, Human
ucagaacuggcugugcccc

SEQ ID NO: 535370 - RNA, 21 nt, Human
ucagaguccagaacagccgag

SEQ ID NO: 535371 - RNA, 21 nt, Human
ucaggucuacagccugccagg

SEQ ID NO: 535372 - RNA, 20 nt, Human
uccacacacaucagagucca

SEQ ID NO: 535373 - RNA, 22 nt, Human
uccaccaacauucagaacuggc

SEQ ID NO: 535374 - RNA, 19 nt, Human
uccagcacaggccuguaau

SEQ ID NO: 535375 - RNA, 18 nt, Human
uccccaccaucaccuccc

SEQ ID NO: 535376 - RNA, 21 nt, Human
uccccaugggagaugcuucau

SEQ ID NO: 535377 - RNA, 25 nt, Human
ucccuccacacacaucagaguccag

SEQ ID NO: 535378 - RNA, 22 nt, Human
ucuaaaacacuauaaauacaua

SEQ ID NO: 535379 - RNA, 20 nt, Human
ucuaggaagccaaggggaga

SEQ ID NO: 535380 - RNA, 19 nt, Human
ucuccccaccaucaccucc

SEQ ID NO: 535381 - RNA, 18 nt, Human
ucugccagcagccuugcc

SEQ ID NO: 535382 - RNA, 18 nt, Human
ucuuccagccacuguccu

SEQ ID NO: 535383 - RNA, 19 nt, Human
ugcaacagcagcagugaag

SEQ ID NO: 535384 - RNA, 19 nt, Human
ugcccugguuuccucuugc

SEQ ID NO: 535385 - RNA, 26 nt, Human
ugcccugguuuccucuugcccuuuuc

SEQ ID NO: 535386 - RNA, 19 nt, Human
ugcugaagacaaggaucug

SEQ ID NO: 535387 - RNA, 23 nt, Human
ugcuucaucaucauuuuggaucc

SEQ ID NO: 535388 - RNA, 25 nt, Human
uggaaggugcugaagacaaggaucu

SEQ ID NO: 535389 - RNA, 23 nt, Human
uggggaggggagagaggaaaggg

SEQ ID NO: 535390 - RNA, 24 nt, Human
uggggaggggagagaggaaaggga

SEQ ID NO: 535391 - RNA, 19 nt, Human
uguccaaacucuaggaagc

SEQ ID NO: 535392 - RNA, 19 nt, Human
uguccaaacucuaggaagc

SEQ ID NO: 535393 - RNA, 24 nt, Human
uguccaaacucuaggaagccaagg

SEQ ID NO: 535394 - RNA, 19 nt, Human
ugucugaaugguuuuaaga

SEQ ID NO: 535395 - RNA, 21 nt, Human
uguucuauuccccaucccucc

SEQ ID NO: 535396 - RNA, 20 nt, Human
uucagaacuggcugugcccc

SEQ ID NO: 535397 - RNA, 19 nt, Human
uugcguacguuuuucugcu

SEQ ID NO: 535398 - RNA, 19 nt, Human
uuuaagaaauuauuacaua

SEQ ID NO: 535399 - RNA, 24 nt, Human
uuugacucagagcugucuguuuuu

SEQ ID NO: 535400 - RNA, 20 nt, Human
uuuuuuuuuuuuuuuuccau

SEQ ID NO: 535401 - RNA, 24 nt, Human
uuuuuuuuuuuuuuuuuuuccaug

SEQ ID NO: 535402 - RNA, 18 nt, Human
cacaaccugccccgaacc

SEQ ID NO: 535403 - RNA, 21 nt, Human
cagcucauaucugcaacuguu

SEQ ID NO: 535404 - RNA, 18 nt, Human
ccccgaaccaggcugccc

SEQ ID NO: 535405 - RNA, 20 nt, Human
cccgaaccaggcugcccagc

SEQ ID NO: 535406 - RNA, 25 nt, Human
cguugugcuggcaggacuuuggugg

SEQ ID NO: 535407 - RNA, 21 nt, Human
cucacaaccugccccgaaccu

SEQ ID NO: 535408 - RNA, 19 nt, Human
ggaguccagagggagugug

SEQ ID NO: 535409 - RNA, 20 nt, Human
ggcaggacuuugguggggcc

SEQ ID NO: 535410 - RNA, 19 nt, Human
guccagagggagugugagg

SEQ ID NO: 535411 - RNA, 19 nt, Human
ugagguuccacacacuugg

SEQ ID NO: 535412 - RNA, 23 nt, Human
ugguggggcccggaguccagagg

SEQ ID NO: 535413 - RNA, 21 nt, Human
uugaggguaaugcaacuucuu

SEQ ID NO: 535414 - RNA, 20 nt, Human
uugugcuggcaggacuuugg

SEQ ID NO: 535415 - RNA, 24 nt, Human
uugugcuggcaggacuuugguggg

SEQ ID NO: 535416 - RNA, 23 nt, Human
aaaaaggagcugaaauucuggca

SEQ ID NO: 535417 - RNA, 20 nt, Human
aagcugcuugcgaaucccug

SEQ ID NO: 535418 - RNA, 22 nt, Human
aaggacacuggggggcguuucu

SEQ ID NO: 535419 - RNA, 23 nt, Human
acagcauaaaaauaauuuguauc

SEQ ID NO: 535420 - RNA, 19 nt, Human
accacagaaaaaaggagcu

SEQ ID NO: 535421 - RNA, 22 nt, Human
agauaaaaaguuugaaggaagu

SEQ ID NO: 535422 - RNA, 27 nt, Human
agcugaaauucuggcaaguggacacug

SEQ ID NO: 535423 - RNA, 18 nt, Human
agcugacuugcaacacca

SEQ ID NO: 535424 - RNA, 18 nt, Human
aucugggagggugguggc

SEQ ID NO: 535425 - RNA, 20 nt, Human
caagauggucccuacagcuc

SEQ ID NO: 535426 - RNA, 25 nt, Human
caugucccuccuccccaacuuuuaa

SEQ ID NO: 535427 - RNA, 21 nt, Human
ccagggucuaggcugcuggca

SEQ ID NO: 535428 - RNA, 18 nt, Human
ccccuuccucuccuaauu

SEQ ID NO: 535429 - RNA, 21 nt, Human
ccuccugcaagcuggacaaag

SEQ ID NO: 535430 - RNA, 18 nt, Human
ccugagcaucugggaggg

SEQ ID NO: 535431 - RNA, 19 nt, Human
ccugcaagcuggacaaagc

SEQ ID NO: 535432 - RNA, 19 nt, Human
ccuggugccuccugcaagc

SEQ ID NO: 535433 - RNA, 23 nt, Human
ccuuugccucaccacagaaaaaa

SEQ ID NO: 535434 - RNA, 20 nt, Human
cuccuggugcugugagaugg

SEQ ID NO: 535435 - RNA, 18 nt, Human
cuccuuccccccagcccc

SEQ ID NO: 535436 - RNA, 19 nt, Human
cugaagaugcagggauuca

SEQ ID NO: 535437 - RNA, 21 nt, Human
cugaaggagccagaccuggug

SEQ ID NO: 535438 - RNA, 23 nt, Human
cugcacaugcucuucauggcgug

SEQ ID NO: 535439 - RNA, 24 nt, Human
cuuugccucaccacagaaaaaagg

SEQ ID NO: 535440 - RNA, 22 nt, Human
gaacaaugaccuucagagcugg

SEQ ID NO: 535441 - RNA, 20 nt, Human
gaacucaaagcugcuugcga

SEQ ID NO: 535442 - RNA, 25 nt, Human
gagcaucugggagggugguggccuu

SEQ ID NO: 535443 - RNA, 19 nt, Human
gcccuaggauuuccuugac

SEQ ID NO: 535444 - RNA, 21 nt, Human
ggaaguaccucugaaucugau

SEQ ID NO: 535445 - RNA, 18 nt, Human
ggauacacuggcucccag

SEQ ID NO: 535446 - RNA, 18 nt, Human
ggauucaugaaaccggcg

SEQ ID NO: 535447 - RNA, 21 nt, Human
gggcacuccuccagucugggc

SEQ ID NO: 535448 - RNA, 23 nt, Human
ggggcacuccuccagucugggcu

SEQ ID NO: 535449 - RNA, 20 nt, Human
gggugggcucaugccagcag

SEQ ID NO: 535450 - RNA, 22 nt, Human
gggugguggccuuguugcuucu

SEQ ID NO: 535451 - RNA, 20 nt, Human
guccugcaucuucaggcaga

SEQ ID NO: 535452 - RNA, 21 nt, Human
uaaguuaaaagcaugguuaau

SEQ ID NO: 535453 - RNA, 23 nt, Human
uaccucugaaucugaucaagcuc

SEQ ID NO: 535454 - RNA, 19 nt, Human
uaggcugcuggcaccuggc

SEQ ID NO: 535455 - RNA, 26 nt, Human
uaugcacaaugcacacaaucuacaug

SEQ ID NO: 535456 - RNA, 19 nt, Human
ucaaacacaggcaagaaca

SEQ ID NO: 535457 - RNA, 24 nt, Human
ucacauggcaagggugccucuccc

SEQ ID NO: 535458 - RNA, 22 nt, Human
ucagaauggagguuugggagga

SEQ ID NO: 535459 - RNA, 23 nt, Human
ucagauaaaaaguuugaaggaag

SEQ ID NO: 535460 - RNA, 23 nt, Human
ucccagggucuaggcugcuggca

SEQ ID NO: 535461 - RNA, 25 nt, Human
uccccaacuuuuaaggcaaaaauug

SEQ ID NO: 535462 - RNA, 20 nt, Human
uccccccagccccucaggcu

SEQ ID NO: 535463 - RNA, 24 nt, Human
ucccuggugauagucugcagaucu

SEQ ID NO: 535464 - RNA, 20 nt, Human
uccuggcucggugagaacuc

SEQ ID NO: 535465 - RNA, 21 nt, Human
ucuacaugucccuccucccca

SEQ ID NO: 535466 - RNA, 24 nt, Human
ucuacaugucccuccuccccaacu

SEQ ID NO: 535467 - RNA, 23 nt, Human
ucucccugaagaugcagggauug

SEQ ID NO: 535468 - RNA, 19 nt, Human
ucugggagggugguggccu

SEQ ID NO: 535469 - RNA, 19 nt, Human
ucugugauuaaggagcuga

SEQ ID NO: 535470 - RNA, 22 nt, Human
ugagagaagucagaauggaggu

SEQ ID NO: 535471 - RNA, 22 nt, Human
ugcaagcuggacaaagcugacg

SEQ ID NO: 535472 - RNA, 23 nt, Human
ugcagggauucaugaaaccggcg

SEQ ID NO: 535473 - RNA, 18 nt, Human
ugccugcuugggucccac

SEQ ID NO: 535474 - RNA, 22 nt, Human
uggacaaagcugacggagggug

SEQ ID NO: 535475 - RNA, 18 nt, Human
uggcaagggugccucucc

SEQ ID NO: 535476 - RNA, 22 nt, Human
uggcaagggugccucucccuga

SEQ ID NO: 535477 - RNA, 24 nt, Human
uggcgugaugcuuggcuucuugug

SEQ ID NO: 535478 - RNA, 19 nt, Human
ugggaggacaaaggugaug

SEQ ID NO: 535479 - RNA, 19 nt, Human
ugggaggacaaaggugaug

SEQ ID NO: 535480 - RNA, 19 nt, Human
ugggagggugguggccuug

SEQ ID NO: 535481 - RNA, 21 nt, Human
uguccugagcaucugggaggg

SEQ ID NO: 535482 - RNA, 19 nt, Human
uguucccacacaaaugaac

SEQ ID NO: 535483 - RNA, 19 nt, Human
uuaaggcaaaaaugguccu

SEQ ID NO: 535484 - RNA, 18 nt, Human
uucagagcuggguaaaaa

SEQ ID NO: 535485 - RNA, 22 nt, Human
uucaggcagagggugggcucau

SEQ ID NO: 535486 - RNA, 18 nt, Human
acccaguaggagauaauu

SEQ ID NO: 535487 - RNA, 19 nt, Human
auccauaggccauuuccuu

SEQ ID NO: 535488 - RNA, 18 nt, Human
caaaauucucaguccuuc

SEQ ID NO: 535489 - RNA, 23 nt, Human
caaauaaccgcccuuucagacac

SEQ ID NO: 535490 - RNA, 24 nt, Human
caccaguggcccuuccugggugcc

SEQ ID NO: 535491 - RNA, 18 nt, Human
cacccaaaucucaucuug

SEQ ID NO: 535492 - RNA, 19 nt, Human
caguggcccuuccugggug

SEQ ID NO: 535493 - RNA, 20 nt, Human
ccaguggcccuuccugggug

SEQ ID NO: 535494 - RNA, 18 nt, Human
cucacuuuuacuccuccc

SEQ ID NO: 535495 - RNA, 21 nt, Human
cucacuuuuacuccucccaaa

SEQ ID NO: 535496 - RNA, 21 nt, Human
cucccaaaacugucaggccaa

SEQ ID NO: 535497 - RNA, 22 nt, Human
cuuagcaccaguggcccuuccu

SEQ ID NO: 535498 - RNA, 24 nt, Human
cuuccugggugcccagugcaaaua

SEQ ID NO: 535499 - RNA, 23 nt, Human
gacacucacuuuuacuccuccca

SEQ ID NO: 535500 - RNA, 26 nt, Human
gacacucacuuuuacuccucccaaaa

SEQ ID NO: 535501 - RNA, 19 nt, Human
gaguauucugauugcaguu

SEQ ID NO: 535502 - RNA, 21 nt, Human
gcccagugcaaauaaccgccc

SEQ ID NO: 535503 - RNA, 19 nt, Human
ucccaaaacugucaggcca

SEQ ID NO: 535504 - RNA, 22 nt, Human
ucccaaaacugucaggccaagu

SEQ ID NO: 535505 - RNA, 25 nt, Human
uccccacccaaaucucaucuugaau

SEQ ID NO: 535506 - RNA, 18 nt, Human
ugcaaauaaccgcccuuu

SEQ ID NO: 535507 - RNA, 22 nt, Human
ugcccagugcaaauaaccgccc

SEQ ID NO: 535508 - RNA, 18 nt, Human
ugggagggacccaguagg

SEQ ID NO: 535509 - RNA, 23 nt, Human
aaacuccuggccucaagcaaucc

SEQ ID NO: 535510 - RNA, 24 nt, Human
aaagugccgggauuauaggcauga

SEQ ID NO: 535511 - RNA, 19 nt, Human
aaaguugccaaccccugcc

SEQ ID NO: 535512 - RNA, 23 nt, Human
aaccuaacaccucuuuggcccca

SEQ ID NO: 535513 - RNA, 19 nt, Human
aacucccagcaucccccuc

SEQ ID NO: 535514 - RNA, 25 nt, Human
aagcaauccuccugccacagacucc

SEQ ID NO: 535515 - RNA, 21 nt, Human
aaggagcugcccuccuccuuc

SEQ ID NO: 535516 - RNA, 21 nt, Human
aaugcaguggugcgaucauag

SEQ ID NO: 535517 - RNA, 23 nt, Human
aaugcaguggugcgaucauagcu

SEQ ID NO: 535518 - RNA, 24 nt, Human
aaugcaguggugcgaucauagcuc

SEQ ID NO: 535519 - RNA, 22 nt, Human
acauccagcaaacguaaaaaug

SEQ ID NO: 535520 - RNA, 20 nt, Human
acccaccugccuccucugcu

SEQ ID NO: 535521 - RNA, 22 nt, Human
acccugggcccuucuuggcccc

SEQ ID NO: 535522 - RNA, 22 nt, Human
accucuuuggccccagcugcug

SEQ ID NO: 535523 - RNA, 21 nt, Human
acucccagcaucccccuccac

SEQ ID NO: 535524 - RNA, 21 nt, Human
agaagcgauggagaaugugga

SEQ ID NO: 535525 - RNA, 20 nt, Human
agccacccacaaaaagcaag

SEQ ID NO: 535526 - RNA, 22 nt, Human
agcggcggugguggcagcagcc

SEQ ID NO: 535527 - RNA, 19 nt, Human
aggcaugagccacugcgcc

SEQ ID NO: 535528 - RNA, 22 nt, Human
aggccuggaggccgccguugcu

SEQ ID NO: 535529 - RNA, 24 nt, Human
agggauccucccaccucagccucc

SEQ ID NO: 535530 - RNA, 24 nt, Human
auagcucacugcagacucaaacuc

SEQ ID NO: 535531 - RNA, 26 nt, Human
auauagcagcggcggugguggcagca

SEQ ID NO: 535532 - RNA, 24 nt, Human
augagccacugcgccuggcagagc

SEQ ID NO: 535533 - RNA, 24 nt, Human
caaagugccgggauuauaggcaug

SEQ ID NO: 535534 - RNA, 21 nt, Human
cacccaccugccuccucugcu

SEQ ID NO: 535535 - RNA, 22 nt, Human
cacccugggcccuucuuggccc

SEQ ID NO: 535536 - RNA, 23 nt, Human
caccucagccuccugaguagcua

SEQ ID NO: 535537 - RNA, 27 nt, Human
caccucagccuccugaguagcuacguu

SEQ ID NO: 535538 - RNA, 18 nt, Human
caccucccacggacagcu

SEQ ID NO: 535539 - RNA, 21 nt, Human
caccugccuccucugcuucug

SEQ ID NO: 535540 - RNA, 24 nt, Human
caccugccuccucugcuucugaga

SEQ ID NO: 535541 - RNA, 19 nt, Human
cacggacagcucugccucc

SEQ ID NO: 535542 - RNA, 18 nt, Human
cacugcgccuggcagagc

SEQ ID NO: 535543 - RNA, 24 nt, Human
cacuugcagacccuccugcaagcu

SEQ ID NO: 535544 - RNA, 19 nt, Human
cagagccugguuuuuuuuu

SEQ ID NO: 535545 - RNA, 25 nt, Human
cagcaaacguaaaaaugucagugcu

SEQ ID NO: 535546 - RNA, 20 nt, Human
cagccuccugaguagcuacg

SEQ ID NO: 535547 - RNA, 20 nt, Human
cagcucugccuccuuccugc

SEQ ID NO: 535548 - RNA, 23 nt, Human
caggaaaauguccucggccucca

SEQ ID NO: 535549 - RNA, 23 nt, Human
caggacaggcucacaaaccucag

SEQ ID NO: 535550 - RNA, 19 nt, Human
caguccaaggggggccggg

SEQ ID NO: 535551 - RNA, 22 nt, Human
caucccccuccacccaccugcc

SEQ ID NO: 535552 - RNA, 25 nt, Human
caugagccacugcgccuggcagagc

SEQ ID NO: 535553 - RNA, 18 nt, Human
ccaaagugccgggauuau

SEQ ID NO: 535554 - RNA, 24 nt, Human
ccaaagugccgggauuauaggcau

SEQ ID NO: 535555 - RNA, 19 nt, Human
ccacaaaaagcaagaggca

SEQ ID NO: 535556 - RNA, 23 nt, Human
ccacccacaaaaagcaagaggca

SEQ ID NO: 535557 - RNA, 23 nt, Human
ccaccucagccuccugaguagcu

SEQ ID NO: 535558 - RNA, 22 nt, Human
cccacaaaaagcaagaggcagg

SEQ ID NO: 535559 - RNA, 23 nt, Human
cccaccucagccuccugaguagc

SEQ ID NO: 535560 - RNA, 18 nt, Human
cccccuccacccaccugc

SEQ ID NO: 535561 - RNA, 18 nt, Human
cccccuccacccaccugc

SEQ ID NO: 535562 - RNA, 20 nt, Human
cccuccccacucccucucaa

SEQ ID NO: 535563 - RNA, 20 nt, Human
cccugggcccuucuuggccc

SEQ ID NO: 535564 - RNA, 21 nt, Human
cccugggcccuucuuggcccc

SEQ ID NO: 535565 - RNA, 20 nt, Human
cccuguacuaccgccggggg

SEQ ID NO: 535566 - RNA, 27 nt, Human
cccugugccaguccaaggggggccggg

SEQ ID NO: 535567 - RNA, 18 nt, Human
cccuucuuggccccaaga

SEQ ID NO: 535568 - RNA, 23 nt, Human
ccuccaccucccacggacagcuc

SEQ ID NO: 535569 - RNA, 21 nt, Human
ccuccccacucccucucaccc

SEQ ID NO: 535570 - RNA, 20 nt, Human
ccuccuccuccuccacuucc

SEQ ID NO: 535571 - RNA, 18 nt, Human
ccuccuucuccuccuccu

SEQ ID NO: 535572 - RNA, 20 nt, Human
ccuccuucuccuccuccucc

SEQ ID NO: 535573 - RNA, 21 nt, Human
ccuccuucuccuccuccuccu

SEQ ID NO: 535574 - RNA, 20 nt, Human
ccucggcucaagggauccuc

SEQ ID NO: 535575 - RNA, 22 nt, Human
ccucucccuccccacucccucu

SEQ ID NO: 535576 - RNA, 18 nt, Human
ccucugacucuguaggac

SEQ ID NO: 535577 - RNA, 25 nt, Human
ccugacccacccugggcccuucuug

SEQ ID NO: 535578 - RNA, 23 nt, Human
ccugcaagcucacccuguacuac

SEQ ID NO: 535579 - RNA, 27 nt, Human
ccuggccucaagcaauccuccugccac

SEQ ID NO: 535580 - RNA, 23 nt, Human
ccugggcccuucuuggccccaag

SEQ ID NO: 535581 - RNA, 21 nt, Human
ccuguggcuggcagaagaggc

SEQ ID NO: 535582 - RNA, 21 nt, Human
ccuuccugcccucucccuccc

SEQ ID NO: 535583 - RNA, 21 nt, Human
ccuucuccuccuccuccucca

SEQ ID NO: 535584 - RNA, 22 nt, Human
cgagauggggucuggaaugcag

SEQ ID NO: 535585 - RNA, 24 nt, Human
cgcuauguugcccaggcuggucuc

SEQ ID NO: 535586 - RNA, 21 nt, Human
cgggauuauaggcaugagcca

SEQ ID NO: 535587 - RNA, 22 nt, Human
cgggauuauaggcaugagccac

SEQ ID NO: 535588 - RNA, 24 nt, Human
cgggauuauaggcaugagccacug

SEQ ID NO: 535589 - RNA, 24 nt, Human
cguugcugggugccuggaaaagaa

SEQ ID NO: 535590 - RNA, 21 nt, Human
cucaagcaauccuccugccac

SEQ ID NO: 535591 - RNA, 19 nt, Human
cucaagggauccucccacc

SEQ ID NO: 535592 - RNA, 24 nt, Human
cucaagggauccucccaccucagc

SEQ ID NO: 535593 - RNA, 23 nt, Human
cucacaaaccucagaaaccuaaa

SEQ ID NO: 535594 - RNA, 18 nt, Human
cucccucucacccuaguc

SEQ ID NO: 535595 - RNA, 22 nt, Human
cuccuccuccuccuccacuucc

SEQ ID NO: 535596 - RNA, 24 nt, Human
cuggccucaagcaauccuccugcc

SEQ ID NO: 535597 - RNA, 22 nt, Human
gaacuagccagagcugaucuug

SEQ ID NO: 535598 - RNA, 18 nt, Human
gagaagcgauggagaaug

SEQ ID NO: 535599 - RNA, 20 nt, Human
gagcauccugccuguggcuc

SEQ ID NO: 535600 - RNA, 18 nt, Human
gagcugcccuccuccuuc

SEQ ID NO: 535601 - RNA, 22 nt, Human
gauuauaggcaugagccacugc

SEQ ID NO: 535602 - RNA, 22 nt, Human
gauuauaggcaugagccacugc

SEQ ID NO: 535603 - RNA, 18 nt, Human
gcagcggcggugguggca

SEQ ID NO: 535604 - RNA, 23 nt, Human
gccaaaaggcugagaagcgaugg

SEQ ID NO: 535605 - RNA, 25 nt, Human
gcuauguugcccaggcuggucucaa

SEQ ID NO: 535606 - RNA, 24 nt, Human
gcuggcagaagaggccauucacug

SEQ ID NO: 535607 - RNA, 23 nt, Human
gcuggucucaaacuccuggccuc

SEQ ID NO: 535608 - RNA, 19 nt, Human
ggacaggcucacaaaccuc

SEQ ID NO: 535609 - RNA, 24 nt, Human
ggcuggucucaaacuccuggccuc

SEQ ID NO: 535610 - RNA, 21 nt, Human
gggauuauaggcaugagccac

SEQ ID NO: 535611 - RNA, 23 nt, Human
gggauuauaggcaugagccacug

SEQ ID NO: 535612 - RNA, 23 nt, Human
gggauuauaggcaugagccacug

SEQ ID NO: 535613 - RNA, 22 nt, Human
ggggucucgcuauguugcccag

SEQ ID NO: 535614 - RNA, 22 nt, Human
gggucucgcuauguugcccagg

SEQ ID NO: 535615 - RNA, 23 nt, Human
ggugagggggccugaggccugga

SEQ ID NO: 535616 - RNA, 21 nt, Human
gugccuggaaaagaaacaaaa

SEQ ID NO: 535617 - RNA, 22 nt, Human
gugguggcagcagccacccaca

SEQ ID NO: 535618 - RNA, 22 nt, Human
uagagauggggucucgcuaugu

SEQ ID NO: 535619 - RNA, 23 nt, Human
uauguugcccaggcuggucucaa

SEQ ID NO: 535620 - RNA, 24 nt, Human
uauguugcccaggcuggucucaaa

SEQ ID NO: 535621 - RNA, 20 nt, Human
ucaaggagcauccugccugu

SEQ ID NO: 535622 - RNA, 23 nt, Human
ucauagcucacugcagacucaaa

SEQ ID NO: 535623 - RNA, 23 nt, Human
uccacagugcacacgccugaccc

SEQ ID NO: 535624 - RNA, 24 nt, Human
ucccaaagugccgggauuauaggc

SEQ ID NO: 535625 - RNA, 24 nt, Human
ucccacggacagcucugccuccuu

SEQ ID NO: 535626 - RNA, 18 nt, Human
ucccagcaucccccucca

SEQ ID NO: 535627 - RNA, 19 nt, Human
uccccacucccucucaccc

SEQ ID NO: 535628 - RNA, 26 nt, Human
uccucccaccucagccuccugaguag

SEQ ID NO: 535629 - RNA, 24 nt, Human
uccucggcucaagggauccuccca

SEQ ID NO: 535630 - RNA, 20 nt, Human
uccugcccucucccucccca

SEQ ID NO: 535631 - RNA, 22 nt, Human
uccugcccucucccuccccacu

SEQ ID NO: 535632 - RNA, 19 nt, Human
uccuuccugcccucucccu

SEQ ID NO: 535633 - RNA, 24 nt, Human
ucucacacacuagaagacggguua

SEQ ID NO: 535634 - RNA, 24 nt, Human
ucuccuccuccuccuccacuuccc

SEQ ID NO: 535635 - RNA, 19 nt, Human
ucucgcuauguugcccagg

SEQ ID NO: 535636 - RNA, 23 nt, Human
ucucgcuauguugcccaggcugg

SEQ ID NO: 535637 - RNA, 24 nt, Human
ucucgcuauguugcccaggcuggu

SEQ ID NO: 535638 - RNA, 26 nt, Human
ucucgcuauguugcccaggcuggucu

SEQ ID NO: 535639 - RNA, 27 nt, Human
ucucgcuauguugcccaggcuggucuc

SEQ ID NO: 535640 - RNA, 22 nt, Human
ucugccuccuuccugcccucuc

SEQ ID NO: 535641 - RNA, 23 nt, Human
ucugcuucugagaguuaagguca

SEQ ID NO: 535642 - RNA, 19 nt, Human
ucuguaggacccugugcca

SEQ ID NO: 535643 - RNA, 19 nt, Human
ucuguuggguuugguuuuc

SEQ ID NO: 535644 - RNA, 22 nt, Human
ucuucugaggccuugggccacu

SEQ ID NO: 535645 - RNA, 23 nt, Human
ugagaagcgauggagaaugugga

SEQ ID NO: 535646 - RNA, 26 nt, Human
ugccacagacucccaaagugccggga

SEQ ID NO: 535647 - RNA, 24 nt, Human
ugcccaggcuggucucaaacuccu

SEQ ID NO: 535648 - RNA, 19 nt, Human
uggaaugcaguggugcgau

SEQ ID NO: 535649 - RNA, 19 nt, Human
uggcagaagaggccauuca

SEQ ID NO: 535650 - RNA, 18 nt, Human
uggccccaagacucuccc

SEQ ID NO: 535651 - RNA, 20 nt, Human
uggccucaagcaauccuccu

SEQ ID NO: 535652 - RNA, 21 nt, Human
uggccucaagcaauccuccug

SEQ ID NO: 535653 - RNA, 24 nt, Human
uggggucucgcuauguugcccagg

SEQ ID NO: 535654 - RNA, 24 nt, Human
uggugcgaucauagcucacugcag

SEQ ID NO: 535655 - RNA, 24 nt, Human
ugguggcagcagccacccacaaaa

SEQ ID NO: 535656 - RNA, 24 nt, Human
uguagagauggggucucgcuaugu

SEQ ID NO: 535657 - RNA, 18 nt, Human
uuccacagugcacacgcc

SEQ ID NO: 535658 - RNA, 24 nt, Human
uuccacagugcacacgccugaccc

SEQ ID NO: 535659 - RNA, 22 nt, Human
uugcagacccuccugcaagcuc

SEQ ID NO: 535660 - RNA, 24 nt, Human
uuguagagauggggucucgcuaug

SEQ ID NO: 535661 - RNA, 18 nt, Human
uuuguagagauggggucu

SEQ ID NO: 535662 - RNA, 24 nt, Human
uuuguagagauggggucucgcuau

SEQ ID NO: 535663 - RNA, 21 nt, Human
agagcagcgguccucaggagg

SEQ ID NO: 535664 - RNA, 22 nt, Human
cagcgguccucaggagguccuu

SEQ ID NO: 535665 - RNA, 20 nt, Human
ccccgcacacacagcuaacc

SEQ ID NO: 535666 - RNA, 18 nt, Human
ccccgcgggccggccggg

SEQ ID NO: 535667 - RNA, 21 nt, Human
gcuccgcgccccgcgggccgg

SEQ ID NO: 535668 - RNA, 25 nt, Human
uaagcccccgcacacacagcuaacc

SEQ ID NO: 535669 - RNA, 25 nt, Human
uaagcccccgcacacacagcuaacc

SEQ ID NO: 535670 - RNA, 24 nt, Human
uccuuaagcccccgcacacacagc

SEQ ID NO: 535671 - RNA, 24 nt, Human
aaaaaaaaaaaaaaucacacaggg

SEQ ID NO: 535672 - RNA, 25 nt, Human
aaaaaaaaaaaaaaucacacaggga

SEQ ID NO: 535673 - RNA, 24 nt, Human
aaaaaaagagucuucuccccccuc

SEQ ID NO: 535674 - RNA, 23 nt, Human
aaaaacugugaaaauuuccggca

SEQ ID NO: 535675 - RNA, 19 nt, Human
aaaaccccaaccauuaagc

SEQ ID NO: 535676 - RNA, 18 nt, Human
aaaauuaaaacaagaaaa

SEQ ID NO: 535677 - RNA, 26 nt, Human
aaacaaaaacaaaacaaaaauuaaaa

SEQ ID NO: 535678 - RNA, 24 nt, Human
aaacaagaaaaaaaaauaccaaag

SEQ ID NO: 535679 - RNA, 24 nt, Human
aaacauggaaacaaaaacaaaaca

SEQ ID NO: 535680 - RNA, 22 nt, Human
aaacgcagagauuucugaagcu

SEQ ID NO: 535681 - RNA, 22 nt, Human
aacaaaacaaaaauuaaaacaa

SEQ ID NO: 535682 - RNA, 24 nt, Human
aacaaugggaaccacagcuaggaa

SEQ ID NO: 535683 - RNA, 18 nt, Human
aacagagaagggugaagg

SEQ ID NO: 535684 - RNA, 22 nt, Human
aaccaaggggacccagccagga

SEQ ID NO: 535685 - RNA, 18 nt, Human
aaccugagcagccacagc

SEQ ID NO: 535686 - RNA, 20 nt, Human
aagaaaaaaaaauaccaaag

SEQ ID NO: 535687 - RNA, 24 nt, Human
aagaaaacauggaaacaaaaacaa

SEQ ID NO: 535688 - RNA, 25 nt, Human
aagcaggaaaagaaaauauuuacaa

SEQ ID NO: 535689 - RNA, 22 nt, Human
aaggaaacauggcaaagugaau

SEQ ID NO: 535690 - RNA, 20 nt, Human
aaggggagcgugaaagacca

SEQ ID NO: 535691 - RNA, 24 nt, Human
aauguugaaaauugugaaaaaacc

SEQ ID NO: 535692 - RNA, 22 nt, Human
acaaaauggccaaaaaaaaaga

SEQ ID NO: 535693 - RNA, 22 nt, Human
acaagaaaacauggaaacaaaa

SEQ ID NO: 535694 - RNA, 18 nt, Human
acuagucugugcuuugcg

SEQ ID NO: 535695 - RNA, 21 nt, Human
agaaaugagcaagaagucuua

SEQ ID NO: 535696 - RNA, 21 nt, Human
agcagacagggaaggguacca

SEQ ID NO: 535697 - RNA, 20 nt, Human
agcagccacagccagguuac

SEQ ID NO: 535698 - RNA, 22 nt, Human
agccacagccagguuacugcag

SEQ ID NO: 535699 - RNA, 24 nt, Human
agcuccacggccccuuacugccuc

SEQ ID NO: 535700 - RNA, 23 nt, Human
aggaaaagaaaauauuuacaaaa

SEQ ID NO: 535701 - RNA, 19 nt, Human
aggaagugcucaggugugu

SEQ ID NO: 535702 - RNA, 19 nt, Human
aggagggccacagcagagc

SEQ ID NO: 535703 - RNA, 26 nt, Human
aggcaaggggagcgugaaagaccaag

SEQ ID NO: 535704 - RNA, 21 nt, Human
aggccagcagggucucauccu

SEQ ID NO: 535705 - RNA, 21 nt, Human
aggccaugcuaaacuguagcc

SEQ ID NO: 535706 - RNA, 22 nt, Human
aggggaaccugagcagccacag

SEQ ID NO: 535707 - RNA, 21 nt, Human
aggggcaugaggaggggaacc

SEQ ID NO: 535708 - RNA, 25 nt, Human
aucagagggaaaaaaaaaaaaaauc

SEQ ID NO: 535709 - RNA, 20 nt, Human
auuccuuaaguucacuaaaa

SEQ ID NO: 535710 - RNA, 19 nt, Human
caaaauggccaaaaaaaaa

SEQ ID NO: 535711 - RNA, 20 nt, Human
caaagugaaucagagggaaa

SEQ ID NO: 535712 - RNA, 25 nt, Human
caaaugcagaugaaacaaaaaauca

SEQ ID NO: 535713 - RNA, 21 nt, Human
caaccauuaagcaguugucua

SEQ ID NO: 535714 - RNA, 18 nt, Human
caaggggacccagccagg

SEQ ID NO: 535715 - RNA, 23 nt, Human
caaugcuaaaaggguuauucaga

SEQ ID NO: 535716 - RNA, 22 nt, Human
cacagcagagccaagccacaga

SEQ ID NO: 535717 - RNA, 20 nt, Human
cacagcuccaaagcaggaaa

SEQ ID NO: 535718 - RNA, 21 nt, Human
cacccugccccauuccacccu

SEQ ID NO: 535719 - RNA, 26 nt, Human
cacgaaaaaccaaggggacccagcca

SEQ ID NO: 535720 - RNA, 22 nt, Human
cagagaagaccaaaugcagaug

SEQ ID NO: 535721 - RNA, 26 nt, Human
cagaugaaacaaaaaaucagucucuu

SEQ ID NO: 535722 - RNA, 18 nt, Human
cagcacagagagacagga

SEQ ID NO: 535723 - RNA, 25 nt, Human
cagcacgaaaaaccaaggggaccca

SEQ ID NO: 535724 - RNA, 22 nt, Human
cagcuucucugaagaaaagcau

SEQ ID NO: 535725 - RNA, 22 nt, Human
ccaaccauuaagcaguugucua

SEQ ID NO: 535726 - RNA, 26 nt, Human
ccacagcuaggaccagaccggggucc

SEQ ID NO: 535727 - RNA, 26 nt, Human
cccugccccauuccacccuagcucaa

SEQ ID NO: 535728 - RNA, 21 nt, Human
cccuuacugccuccccagaga

SEQ ID NO: 535729 - RNA, 22 nt, Human
ccgccaggcuguucugcccugc

SEQ ID NO: 535730 - RNA, 19 nt, Human
cuauagaacaaagacagcu

SEQ ID NO: 535731 - RNA, 19 nt, Human
cucacuucccacaaccccc

SEQ ID NO: 535732 - RNA, 21 nt, Human
cuccacggccccuuacugccu

SEQ ID NO: 535733 - RNA, 21 nt, Human
cugaagcuuuaaugccaauag

SEQ ID NO: 535734 - RNA, 19 nt, Human
cugagcagccacagccagg

SEQ ID NO: 535735 - RNA, 18 nt, Human
cugcucacuucccacaac

SEQ ID NO: 535736 - RNA, 25 nt, Human
cuggcaguuauggcagagaggcucu

SEQ ID NO: 535737 - RNA, 20 nt, Human
gacaagaaaacauggaaaca

SEQ ID NO: 535738 - RNA, 21 nt, Human
gaccaaaugcagaugaaacaa

SEQ ID NO: 535739 - RNA, 18 nt, Human
gagagcagcuggcaguua

SEQ ID NO: 535740 - RNA, 22 nt, Human
gagcagcuggcaguuauggcag

SEQ ID NO: 535741 - RNA, 23 nt, Human
gauauaaagacaauacucagaaa

SEQ ID NO: 535742 - RNA, 22 nt, Human
gcacgaaaaaccaaggggaccc

SEQ ID NO: 535743 - RNA, 19 nt, Human
gccagcagggucucauccu

SEQ ID NO: 535744 - RNA, 25 nt, Human
ggaaaagaaaauauuuacaaaauac

SEQ ID NO: 535745 - RNA, 22 nt, Human
ggaggggguaagaguccagagc

SEQ ID NO: 535746 - RNA, 21 nt, Human
ggcagagaggcucuggugggg

SEQ ID NO: 535747 - RNA, 20 nt, Human
gggagagcagacagggaagg

SEQ ID NO: 535748 - RNA, 19 nt, Human
gggagcgugaaagaccaag

SEQ ID NO: 535749 - RNA, 21 nt, Human
gggaggggaggggguaagagu

SEQ ID NO: 535750 - RNA, 21 nt, Human
gggucucauccugaacuucug

SEQ ID NO: 535751 - RNA, 22 nt, Human
gugaaucagagggaaaaaaaaa

SEQ ID NO: 535752 - RNA, 23 nt, Human
uaaaacaagaaaaaaaaauacca

SEQ ID NO: 535753 - RNA, 21 nt, Human
uaaagaaacaaugacaaaccc

SEQ ID NO: 535754 - RNA, 18 nt, Human
uaacuugcaaacagaaaa

SEQ ID NO: 535755 - RNA, 19 nt, Human
uaagaggcauccaaguagc

SEQ ID NO: 535756 - RNA, 23 nt, Human
uacaaaauggccaaaaaaaaaga

SEQ ID NO: 535757 - RNA, 20 nt, Human
uaggaccagacaauguucca

SEQ ID NO: 535758 - RNA, 24 nt, Human
uauaaagacaauacucagaaauga

SEQ ID NO: 535759 - RNA, 24 nt, Human
uauucagaauuuucaaccuuauaa

SEQ ID NO: 535760 - RNA, 24 nt, Human
uauuuuuuuuuaaagaaacaauga

SEQ ID NO: 535761 - RNA, 19 nt, Human
ucaauuuuuccuucuuuuu

SEQ ID NO: 535762 - RNA, 22 nt, Human
ucagagggaaaaaaaaaaaaaa

SEQ ID NO: 535763 - RNA, 22 nt, Human
ucagagggaaaaaaaaaaaaaa

SEQ ID NO: 535764 - RNA, 23 nt, Human
ucagucucuuaaguucuggguga

SEQ ID NO: 535765 - RNA, 18 nt, Human
uccacaggcaaggggagc

SEQ ID NO: 535766 - RNA, 23 nt, Human
uccacggccccuuacugccuccc

SEQ ID NO: 535767 - RNA, 23 nt, Human
uccagagcacccugccccauucc

SEQ ID NO: 535768 - RNA, 23 nt, Human
ucccacaacccccaguuugcagg

SEQ ID NO: 535769 - RNA, 18 nt, Human
uccccagagaacagacuu

SEQ ID NO: 535770 - RNA, 26 nt, Human
uccccagagaacagacuuaagaggcu

SEQ ID NO: 535771 - RNA, 23 nt, Human
ucgcugccauuacacagcuccaa

SEQ ID NO: 535772 - RNA, 22 nt, Human
ucugggugagaaaggaaaggug

SEQ ID NO: 535773 - RNA, 21 nt, Human
ugaaaaaaccccaaccauuaa

SEQ ID NO: 535774 - RNA, 23 nt, Human
ugaaaaaaccccaaccauuaagc

SEQ ID NO: 535775 - RNA, 19 nt, Human
ugaagggggaacaauggga

SEQ ID NO: 535776 - RNA, 19 nt, Human
ugagggaggggguggucau

SEQ ID NO: 535777 - RNA, 20 nt, Human
ugcaaacagaaaaaaaaauc

SEQ ID NO: 535778 - RNA, 22 nt, Human
ugccccauuccacccuagcuca

SEQ ID NO: 535779 - RNA, 19 nt, Human
ugccgaggccgaggccagc

SEQ ID NO: 535780 - RNA, 21 nt, Human
uggaaacaaaaacaaaacaaa

SEQ ID NO: 535781 - RNA, 25 nt, Human
uggcagagaggcucugguggggaug

SEQ ID NO: 535782 - RNA, 22 nt, Human
ugggagagcagacagggaaggg

SEQ ID NO: 535783 - RNA, 18 nt, Human
uggugcauuauuguauuu

SEQ ID NO: 535784 - RNA, 18 nt, Human
ugugaaaaaaccccaacc

SEQ ID NO: 535785 - RNA, 20 nt, Human
ugugaaaaaaccccaaccau

SEQ ID NO: 535786 - RNA, 18 nt, Human
ugugaaggaaacauggca

SEQ ID NO: 535787 - RNA, 21 nt, Human
uguuccacaggcaaggggagc

SEQ ID NO: 535788 - RNA, 26 nt, Human
uguuucgcugccauuacacagcucca

SEQ ID NO: 535789 - RNA, 24 nt, Human
uuaaaacaagaaaaaaaaauacca

SEQ ID NO: 535790 - RNA, 22 nt, Human
uuccacaggcaaggggagcgug

SEQ ID NO: 535791 - RNA, 26 nt, Human
uuccuuaaguucacuaaaaacuguga

SEQ ID NO: 535792 - RNA, 23 nt, Human
uucugggugagaaaggaaaggug

SEQ ID NO: 535793 - RNA, 25 nt, Human
uuucaauuuuuccuucuuuuuuuuu

SEQ ID NO: 535794 - RNA, 24 nt, Human
uuuuuuuuuccauuuuuuguuuuu

SEQ ID NO: 535795 - RNA, 21 nt, Human
aaaaggcacugugggagcuga

SEQ ID NO: 535796 - RNA, 21 nt, Human
aaacugacacuuccucucccg

SEQ ID NO: 535797 - RNA, 24 nt, Human
aacagauaaacagaguuugagggg

SEQ ID NO: 535798 - RNA, 27 nt, Human
aacagauaaacagaguuugagggggug

SEQ ID NO: 535799 - RNA, 18 nt, Human
aacuggggacaaagaccu

SEQ ID NO: 535800 - RNA, 27 nt, Human
aaggcacuuuuguccauuuuccaauca

SEQ ID NO: 535801 - RNA, 20 nt, Human
aaguaugugcggggcccugg

SEQ ID NO: 535802 - RNA, 18 nt, Human
aagucccuccacaugcuc

SEQ ID NO: 535803 - RNA, 21 nt, Human
aagucccuccacaugcucucc

SEQ ID NO: 535804 - RNA, 21 nt, Human
acacagccucucucuuucccc

SEQ ID NO: 535805 - RNA, 22 nt, Human
acacuggcuccaagucccucca

SEQ ID NO: 535806 - RNA, 21 nt, Human
acaggaggugaggucccccuu

SEQ ID NO: 535807 - RNA, 21 nt, Human
acauguggauggaagcuugug

SEQ ID NO: 535808 - RNA, 24 nt, Human
accaccccccacccccguccccca

SEQ ID NO: 535809 - RNA, 24 nt, Human
accagaaacagguuuagcaagaca

SEQ ID NO: 535810 - RNA, 19 nt, Human
acgaccuucuccaccccca

SEQ ID NO: 535811 - RNA, 30 nt, Human
acugacacuuccucucccgcugcgccucuu

SEQ ID NO: 535812 - RNA, 18 nt, Human
agaacagauaaacagagu

SEQ ID NO: 535813 - RNA, 19 nt, Human
agcagcaguuggcaaggcu

SEQ ID NO: 535814 - RNA, 24 nt, Human
agccuggagaaagcuggggagccu

SEQ ID NO: 535815 - RNA, 20 nt, Human
aggagccagcaggcccagag

SEQ ID NO: 535816 - RNA, 20 nt, Human
aggaggcccuggaacagagc

SEQ ID NO: 535817 - RNA, 24 nt, Human
aggcaggcagggcauucugccagg

SEQ ID NO: 535818 - RNA, 20 nt, Human
aggccaggcccagcucuaug

SEQ ID NO: 535819 - RNA, 18 nt, Human
agggaagguccagaugua

SEQ ID NO: 535820 - RNA, 19 nt, Human
agguagagaggggucaggc

SEQ ID NO: 535821 - RNA, 22 nt, Human
aguggcaggaaaguggaagaga

SEQ ID NO: 535822 - RNA, 18 nt, Human
aucccaccaccucucucc

SEQ ID NO: 535823 - RNA, 22 nt, Human
aucccaguucccacagcacccc

SEQ ID NO: 535824 - RNA, 19 nt, Human
auggaaaaacagcuccugc

SEQ ID NO: 535825 - RNA, 20 nt, Human
auugucugcugugugguguc

SEQ ID NO: 535826 - RNA, 20 nt, Human
cacacaggaugugcgaacac

SEQ ID NO: 535827 - RNA, 21 nt, Human
caccacuaccaccccccaccc

SEQ ID NO: 535828 - RNA, 22 nt, Human
caccacuaccaccccccacccc

SEQ ID NO: 535829 - RNA, 22 nt, Human
caccccagccuggagaaagcug

SEQ ID NO: 535830 - RNA, 21 nt, Human
cacgucaaggcacuuuugucc

SEQ ID NO: 535831 - RNA, 26 nt, Human
cacuugggcauguggugguguggccg

SEQ ID NO: 535832 - RNA, 18 nt, Human
cagcaguuggcaaggcug

SEQ ID NO: 535833 - RNA, 21 nt, Human
cagcucgucuaugccugggcu

SEQ ID NO: 535834 - RNA, 22 nt, Human
caguuggcaaggcugguccccc

SEQ ID NO: 535835 - RNA, 22 nt, Human
caguuucuaauaucucuggaag

SEQ ID NO: 535836 - RNA, 24 nt, Human
caucccaccaccucucuccgaggg

SEQ ID NO: 535837 - RNA, 21 nt, Human
caucuaaacuaucucagggac

SEQ ID NO: 535838 - RNA, 20 nt, Human
caugcucuccacuacagcca

SEQ ID NO: 535839 - RNA, 18 nt, Human
cauuccagcaaggccagg

SEQ ID NO: 535840 - RNA, 20 nt, Human
cauuucagggcagggcaagg

SEQ ID NO: 535841 - RNA, 23 nt, Human
ccaaaaauucucuuucaaacccc

SEQ ID NO: 535842 - RNA, 19 nt, Human
ccaagcuggaggccacagc

SEQ ID NO: 535843 - RNA, 24 nt, Human
ccacacacagccucucucuuuccc

SEQ ID NO: 535844 - RNA, 21 nt, Human
ccacuggcaagggcuucccuu

SEQ ID NO: 535845 - RNA, 27 nt, Human
ccagaugguggcguggccacgaccuuc

SEQ ID NO: 535846 - RNA, 20 nt, Human
ccagguggugcagacacccc

SEQ ID NO: 535847 - RNA, 23 nt, Human
ccaguucccacagcaccccuggg

SEQ ID NO: 535848 - RNA, 19 nt, Human
cccacagcaccccugggcu

SEQ ID NO: 535849 - RNA, 21 nt, Human
cccacagcaccccugggcuag

SEQ ID NO: 535850 - RNA, 22 nt, Human
cccaccacuaccaccccccacc

SEQ ID NO: 535851 - RNA, 23 nt, Human
cccaccacuaccaccccccaccc

SEQ ID NO: 535852 - RNA, 24 nt, Human
cccaccacuaccaccccccacccc

SEQ ID NO: 535853 - RNA, 21 nt, Human
cccacucccaucuccuuuuuc

SEQ ID NO: 535854 - RNA, 21 nt, Human
ccccacucccaucuccuuuuu

SEQ ID NO: 535855 - RNA, 21 nt, Human
ccccacucccaucuccuuuuu

SEQ ID NO: 535856 - RNA, 18 nt, Human
ccccagagcccagguagg

SEQ ID NO: 535857 - RNA, 23 nt, Human
ccccagguuuggaaggaugccuc

SEQ ID NO: 535858 - RNA, 22 nt, Human
ccccaucuggugcccacccucc

SEQ ID NO: 535859 - RNA, 19 nt, Human
cccccacccccguccccca

SEQ ID NO: 535860 - RNA, 23 nt, Human
cccccacccccgucccccagguu

SEQ ID NO: 535861 - RNA, 20 nt, Human
cccccuuaaaaggcacugug

SEQ ID NO: 535862 - RNA, 23 nt, Human
ccccucccuccuuuucccucucc

SEQ ID NO: 535863 - RNA, 22 nt, Human
ccccugggcuagggguuggcuu

SEQ ID NO: 535864 - RNA, 25 nt, Human
ccccuguggcagcagcuguggggcu

SEQ ID NO: 535865 - RNA, 21 nt, Human
cccgucccccagguuuggaag

SEQ ID NO: 535866 - RNA, 19 nt, Human
cccucccuccuuuucccuc

SEQ ID NO: 535867 - RNA, 19 nt, Human
cccuccuuuucccucucca

SEQ ID NO: 535868 - RNA, 24 nt, Human
cccuccuuuucccucuccaggccc

SEQ ID NO: 535869 - RNA, 19 nt, Human
ccgcacccgccuccacccu

SEQ ID NO: 535870 - RNA, 19 nt, Human
ccgccagugccucuugcug

SEQ ID NO: 535871 - RNA, 24 nt, Human
ccgcccgcccggccaggggccagg

SEQ ID NO: 535872 - RNA, 21 nt, Human
ccuccacaugcucuccacuac

SEQ ID NO: 535873 - RNA, 22 nt, Human
ccucccaccacuaccacccccc

SEQ ID NO: 535874 - RNA, 24 nt, Human
ccucucccgcugcgccucuaggag

SEQ ID NO: 535875 - RNA, 19 nt, Human
ccugcaaaaccagccaagc

SEQ ID NO: 535876 - RNA, 20 nt, Human
ccugcuuccuucucccaccc

SEQ ID NO: 535877 - RNA, 26 nt, Human
ccugggcccuggaagugggccaaggg

SEQ ID NO: 535878 - RNA, 23 nt, Human
ccugggcccuggugcuggugccu

SEQ ID NO: 535879 - RNA, 21 nt, Human
ccugggcugugccagggaagc

SEQ ID NO: 535880 - RNA, 22 nt, Human
ccuucucccaugcucucucaaa

SEQ ID NO: 535881 - RNA, 21 nt, Human
ccuuuucccucuccaggccca

SEQ ID NO: 535882 - RNA, 23 nt, Human
cgaccuucuccacccccacuccc

SEQ ID NO: 535883 - RNA, 22 nt, Human
cgagagaggucaaggcacacaa

SEQ ID NO: 535884 - RNA, 22 nt, Human
cgcccggcgcugcgaggucccc

SEQ ID NO: 535885 - RNA, 19 nt, Human
cggggcccuggggcgagcc

SEQ ID NO: 535886 - RNA, 21 nt, Human
cuaaacuaucucagggacccc

SEQ ID NO: 535887 - RNA, 23 nt, Human
cuaccaccccccacccccguccc

SEQ ID NO: 535888 - RNA, 21 nt, Human
cuaucuucccagguggugcag

SEQ ID NO: 535889 - RNA, 21 nt, Human
cucccaccccagccuggagaa

SEQ ID NO: 535890 - RNA, 23 nt, Human
cucccaucccaccaccucucucc

SEQ ID NO: 535891 - RNA, 19 nt, Human
cuccugcaggccugcugcc

SEQ ID NO: 535892 - RNA, 27 nt, Human
cugggcccuggugcuggugccuucuga

SEQ ID NO: 535893 - RNA, 19 nt, Human
cuggugggucuggggaugg

SEQ ID NO: 535894 - RNA, 21 nt, Human
cugguugaugggcugaaagaa

SEQ ID NO: 535895 - RNA, 22 nt, Human
cugugcacacacaggaugugcg

SEQ ID NO: 535896 - RNA, 18 nt, Human
cuguucacagggagagag

SEQ ID NO: 535897 - RNA, 24 nt, Human
cuucccagguggugcagacacccc

SEQ ID NO: 535898 - RNA, 26 nt, Human
cuucugggaccuccaaagcugacauu

SEQ ID NO: 535899 - RNA, 23 nt, Human
cuuugguuuucaggaccccuggc

SEQ ID NO: 535900 - RNA, 22 nt, Human
gaccugggccucaggaggaagg

SEQ ID NO: 535901 - RNA, 18 nt, Human
gaggccagagaacagaag

SEQ ID NO: 535902 - RNA, 23 nt, Human
gagggggugaggccagagaacag

SEQ ID NO: 535903 - RNA, 23 nt, Human
gagucaguuucuaauaucucugg

SEQ ID NO: 535904 - RNA, 22 nt, Human
gauccaguggagggacagcugu

SEQ ID NO: 535905 - RNA, 19 nt, Human
gcaccagaaacagguuuag

SEQ ID NO: 535906 - RNA, 18 nt, Human
gcaggccuuggccuggca

SEQ ID NO: 535907 - RNA, 23 nt, Human
gccacgaccuucuccacccccac

SEQ ID NO: 535908 - RNA, 21 nt, Human
gcccuggaacagagcugguac

SEQ ID NO: 535909 - RNA, 18 nt, Human
gcccuggugcuggugccu

SEQ ID NO: 535910 - RNA, 22 nt, Human
gcuccccagaugguggcguggc

SEQ ID NO: 535911 - RNA, 19 nt, Human
gcugguccccaucuggugc

SEQ ID NO: 535912 - RNA, 20 nt, Human
gcuuccuucucccaccccag

SEQ ID NO: 535913 - RNA, 21 nt, Human
ggaggagccagcaggcccaga

SEQ ID NO: 535914 - RNA, 18 nt, Human
ggaguggcaggaaagugg

SEQ ID NO: 535915 - RNA, 22 nt, Human
ggcaagggcuucccuuugaggg

SEQ ID NO: 535916 - RNA, 20 nt, Human
ggcauguggugguguggccg

SEQ ID NO: 535917 - RNA, 21 nt, Human
ggccaggccggggccgcugca

SEQ ID NO: 535918 - RNA, 22 nt, Human
ggcuagggguuggcuucucagg

SEQ ID NO: 535919 - RNA, 18 nt, Human
gggcugaaaagggggaag

SEQ ID NO: 535920 - RNA, 19 nt, Human
ggggauccaguggagggac

SEQ ID NO: 535921 - RNA, 19 nt, Human
guacaacacauguggaugg

SEQ ID NO: 535922 - RNA, 19 nt, Human
gucuggugggucuggggau

SEQ ID NO: 535923 - RNA, 20 nt, Human
gucuggugggucuggggaug

SEQ ID NO: 535924 - RNA, 21 nt, Human
gugcagaggguuauaagguca

SEQ ID NO: 535925 - RNA, 18 nt, Human
gugccagggaagcagagg

SEQ ID NO: 535926 - RNA, 18 nt, Human
guggagggacagcuguga

SEQ ID NO: 535927 - RNA, 21 nt, Human
guggagggacagcugugcaca

SEQ ID NO: 535928 - RNA, 22 nt, Human
uaaaaggcacugugggagcuga

SEQ ID NO: 535929 - RNA, 25 nt, Human
uaacaggauugcucaucccaggcuu

SEQ ID NO: 535930 - RNA, 24 nt, Human
uaccaccccccacccccguccccc

SEQ ID NO: 535931 - RNA, 22 nt, Human
uagagcugaaaguacaacacau

SEQ ID NO: 535932 - RNA, 21 nt, Human
uagggaagguccagauguacu

SEQ ID NO: 535933 - RNA, 19 nt, Human
uaugaaagagggugagucc

SEQ ID NO: 535934 - RNA, 22 nt, Human
ucaaacccccacuggcaagggc

SEQ ID NO: 535935 - RNA, 18 nt, Human
ucacaggcuuucacaggg

SEQ ID NO: 535936 - RNA, 23 nt, Human
ucagcuccccuuccaccuggccc

SEQ ID NO: 535937 - RNA, 19 nt, Human
ucagggguccucuuccccc

SEQ ID NO: 535938 - RNA, 24 nt, Human
uccaccuggcccuaguuggccccc

SEQ ID NO: 535939 - RNA, 19 nt, Human
uccacuacagccacacaca

SEQ ID NO: 535940 - RNA, 19 nt, Human
uccaguggagggacagcug

SEQ ID NO: 535941 - RNA, 20 nt, Human
ucccaguucccacagcaccc

SEQ ID NO: 535942 - RNA, 22 nt, Human
ucccaucuccuuuuucuccagc

SEQ ID NO: 535943 - RNA, 22 nt, Human
ucccuccuuuucccucuccagg

SEQ ID NO: 535944 - RNA, 19 nt, Human
ucccugggaggacuggcug

SEQ ID NO: 535945 - RNA, 21 nt, Human
ucuccacccccacucccaucu

SEQ ID NO: 535946 - RNA, 22 nt, Human
ucuccacuacagccacacacag

SEQ ID NO: 535947 - RNA, 25 nt, Human
ucucccaccccagccuggagaaagc

SEQ ID NO: 535948 - RNA, 24 nt, Human
ucugcuguguggugucuggugggu

SEQ ID NO: 535949 - RNA, 21 nt, Human
ucuguguggugcgugugugua

SEQ ID NO: 535950 - RNA, 18 nt, Human
ucuuauccaccuucuccc

SEQ ID NO: 535951 - RNA, 19 nt, Human
ugaaagagggugagucccc

SEQ ID NO: 535952 - RNA, 22 nt, Human
ugaaaugcugggguggggaguc

SEQ ID NO: 535953 - RNA, 18 nt, Human
ugagggggugaggccaga

SEQ ID NO: 535954 - RNA, 23 nt, Human
ugaugggcugaaagaaggagcgg

SEQ ID NO: 535955 - RNA, 28 nt, Human
ugcaaaaccagccaagcuggaggccaca

SEQ ID NO: 535956 - RNA, 26 nt, Human
ugcaggccugcugccccgccagugcc

SEQ ID NO: 535957 - RNA, 22 nt, Human
ugcagguucacaaacugacacu

SEQ ID NO: 535958 - RNA, 25 nt, Human
ugccaggcacuugcagcucuguccu

SEQ ID NO: 535959 - RNA, 19 nt, Human
ugccagggagugugugaag

SEQ ID NO: 535960 - RNA, 21 nt, Human
ugccccgccagugccucuugc

SEQ ID NO: 535961 - RNA, 18 nt, Human
ugccugggcugugccagg

SEQ ID NO: 535962 - RNA, 23 nt, Human
ugccugggcugugccagggaagc

SEQ ID NO: 535963 - RNA, 21 nt, Human
uggaaaaacagcuccugcagg

SEQ ID NO: 535964 - RNA, 21 nt, Human
uggaaagcaggccuagaaggu

SEQ ID NO: 535965 - RNA, 19 nt, Human
uggaacagagcugguacag

SEQ ID NO: 535966 - RNA, 19 nt, Human
uggaagagaaaagcacuga

SEQ ID NO: 535967 - RNA, 25 nt, Human
uggagggacagcugugcacacacag

SEQ ID NO: 535968 - RNA, 20 nt, Human
uggauggaagcuugugcgag

SEQ ID NO: 535969 - RNA, 25 nt, Human
uggcaggcaggcaggcagggcauuc

SEQ ID NO: 535970 - RNA, 21 nt, Human
uggcccuaguuggccccugug

SEQ ID NO: 535971 - RNA, 18 nt, Human
uggcuucucagcuccccu

SEQ ID NO: 535972 - RNA, 21 nt, Human
ugggaccuccaaagcugacau

SEQ ID NO: 535973 - RNA, 20 nt, Human
ugggcccuggugcuggugcc

SEQ ID NO: 535974 - RNA, 18 nt, Human
ugggcuagggguuggcuu

SEQ ID NO: 535975 - RNA, 19 nt, Human
uggugcguguguguacucc

SEQ ID NO: 535976 - RNA, 21 nt, Human
ugguguggccgugugggguug

SEQ ID NO: 535977 - RNA, 21 nt, Human
uguagagacacaggcacaggg

SEQ ID NO: 535978 - RNA, 19 nt, Human
uguccugcuuccuucuccc

SEQ ID NO: 535979 - RNA, 21 nt, Human
ugugcacacacaggaugugcg

SEQ ID NO: 535980 - RNA, 22 nt, Human
uguggccauggcgcugggcacc

SEQ ID NO: 535981 - RNA, 23 nt, Human
ugugggagcugaggucuaagaug

SEQ ID NO: 535982 - RNA, 23 nt, Human
uguggugcguguguguacuccug

SEQ ID NO: 535983 - RNA, 20 nt, Human
uguguacacuugggcaugug

SEQ ID NO: 535984 - RNA, 18 nt, Human
uguguggugcgugugugu

SEQ ID NO: 535985 - RNA, 19 nt, Human
uuccccugacacuggcucc

SEQ ID NO: 535986 - RNA, 22 nt, Human
uucccucccaccacuaccaccc

SEQ ID NO: 535987 - RNA, 26 nt, Human
uucccucccaccacuaccacccccca

SEQ ID NO: 535988 - RNA, 19 nt, Human
uugcugggcucucugaagc

SEQ ID NO: 535989 - RNA, 24 nt, Human
aaguaacugggacugcaggcaugu

SEQ ID NO: 535990 - RNA, 22 nt, Human
accauguuggccaggcuggucu

SEQ ID NO: 535991 - RNA, 20 nt, Human
acgcuguugcccaggcugga

SEQ ID NO: 535992 - RNA, 25 nt, Human
acgcuguugcccaggcuggaaugca

SEQ ID NO: 535993 - RNA, 22 nt, Human
agguuucuauuuuuaguagaga

SEQ ID NO: 535994 - RNA, 22 nt, Human
aguagagaugggguuucaccau

SEQ ID NO: 535995 - RNA, 18 nt, Human
agugggauuaucucagcu

SEQ ID NO: 535996 - RNA, 24 nt, Human
aucucugccuuccugguuuaagag

SEQ ID NO: 535997 - RNA, 19 nt, Human
augagaucagguuuugcua

SEQ ID NO: 535998 - RNA, 22 nt, Human
augggguuucaccauguuggcc

SEQ ID NO: 535999 - RNA, 23 nt, Human
augggguuucaccauguuggcca

SEQ ID NO: 536000 - RNA, 24 nt, Human
augggguuucaccauguuggccag

SEQ ID NO: 536001 - RNA, 21 nt, Human
caccauguuggccaggcuggu

SEQ ID NO: 536002 - RNA, 24 nt, Human
caccauguuggccaggcuggucuu

SEQ ID NO: 536003 - RNA, 27 nt, Human
caccauguuggccaggcuggucuugaa

SEQ ID NO: 536004 - RNA, 24 nt, Human
cacgcuguugcccaggcuggaaug

SEQ ID NO: 536005 - RNA, 20 nt, Human
caggcaugugccaccacgcc

SEQ ID NO: 536006 - RNA, 24 nt, Human
cauguuggccaggcuggucuugaa

SEQ ID NO: 536007 - RNA, 24 nt, Human
ccaccacaccuggcuauacacaga

SEQ ID NO: 536008 - RNA, 18 nt, Human
ccacugcugggauuacag

SEQ ID NO: 536009 - RNA, 20 nt, Human
ccacugcugggauuacaggc

SEQ ID NO: 536010 - RNA, 22 nt, Human
ccacugcugggauuacaggcgu

SEQ ID NO: 536011 - RNA, 24 nt, Human
cccaaguaacugggacugcaggca

SEQ ID NO: 536012 - RNA, 21 nt, Human
cccacugcugggauuacaggc

SEQ ID NO: 536013 - RNA, 21 nt, Human
cccacugcugggauuacaggc

SEQ ID NO: 536014 - RNA, 22 nt, Human
ccucaggcacccaaguaacugg

SEQ ID NO: 536015 - RNA, 24 nt, Human
ccuuccugguuuaagagauucucc

SEQ ID NO: 536016 - RNA, 24 nt, Human
cucaagugaucugcccaccucggu

SEQ ID NO: 536017 - RNA, 25 nt, Human
cucacugcaaucucugccuuccugg

SEQ ID NO: 536018 - RNA, 21 nt, Human
cucccacugcugggauuacag

SEQ ID NO: 536019 - RNA, 23 nt, Human
cugcaaucucugccuuccugguu

SEQ ID NO: 536020 - RNA, 24 nt, Human
gaacucaagugaucugcccaccuc

SEQ ID NO: 536021 - RNA, 18 nt, Human
gagaugggguuucaccau

SEQ ID NO: 536022 - RNA, 24 nt, Human
gagaugggguuucaccauguuggc

SEQ ID NO: 536023 - RNA, 18 nt, Human
gauuacaggcguaagcca

SEQ ID NO: 536024 - RNA, 21 nt, Human
gauuacaggcguaagccacca

SEQ ID NO: 536025 - RNA, 19 nt, Human
ggacugcaggcaugugcca

SEQ ID NO: 536026 - RNA, 19 nt, Human
ggauuacaggcguaagcca

SEQ ID NO: 536027 - RNA, 18 nt, Human
gggacugcaggcaugugc

SEQ ID NO: 536028 - RNA, 20 nt, Human
gggggacagcgcuugccacc

SEQ ID NO: 536029 - RNA, 22 nt, Human
gggguuucaccauguuggccag

SEQ ID NO: 536030 - RNA, 23 nt, Human
gggguuucaccauguuggccagg

SEQ ID NO: 536031 - RNA, 23 nt, Human
gguuucuauuuuuaguagagaug

SEQ ID NO: 536032 - RNA, 23 nt, Human
guagagaugggguuucaccaugu

SEQ ID NO: 536033 - RNA, 24 nt, Human
gugaucugcccaccucggucuccc

SEQ ID NO: 536034 - RNA, 22 nt, Human
uacaggcguaagccaccacacc

SEQ ID NO: 536035 - RNA, 22 nt, Human
uagagaugggguuucaccaugu

SEQ ID NO: 536036 - RNA, 24 nt, Human
uaguagagaugggguuucaccaug

SEQ ID NO: 536037 - RNA, 26 nt, Human
uaguagagaugggguuucaccauguu

SEQ ID NO: 536038 - RNA, 24 nt, Human
uauccagggacaccucugcugggg

SEQ ID NO: 536039 - RNA, 24 nt, Human
ucacgcuguugcccaggcuggaau

SEQ ID NO: 536040 - RNA, 18 nt, Human
ucacugcaaucucugccu

SEQ ID NO: 536041 - RNA, 24 nt, Human
ucacugcaaucucugccuuccugg

SEQ ID NO: 536042 - RNA, 24 nt, Human
ucacugcaaucucugccuuccugg

SEQ ID NO: 536043 - RNA, 25 nt, Human
ucacugcaaucucugccuuccuggu

SEQ ID NO: 536044 - RNA, 22 nt, Human
ucccacugcugggauuacaggc

SEQ ID NO: 536045 - RNA, 22 nt, Human
ucccacugcugggauuacaggc

SEQ ID NO: 536046 - RNA, 24 nt, Human
ucccacugcugggauuacaggcgu

SEQ ID NO: 536047 - RNA, 23 nt, Human
uccugguuuaagagauucuccug

SEQ ID NO: 536048 - RNA, 22 nt, Human
ucucacgcuguugcccaggcug

SEQ ID NO: 536049 - RNA, 23 nt, Human
ucucacgcuguugcccaggcugg

SEQ ID NO: 536050 - RNA, 24 nt, Human
ucucacgcuguugcccaggcugga

SEQ ID NO: 536051 - RNA, 24 nt, Human
ucucccacugcugggauuacaggc

SEQ ID NO: 536052 - RNA, 18 nt, Human
ugaacucaagugaucugc

SEQ ID NO: 536053 - RNA, 22 nt, Human
ugagaugaagucucacgcuguu

SEQ ID NO: 536054 - RNA, 24 nt, Human
ugaucugcccaccucggucuccca

SEQ ID NO: 536055 - RNA, 22 nt, Human
ugcagugggauuaucucagcuc

SEQ ID NO: 536056 - RNA, 21 nt, Human
ugccucaggcacccaaguaac

SEQ ID NO: 536057 - RNA, 23 nt, Human
ugcuauccuguauccagggacac

SEQ ID NO: 536058 - RNA, 27 nt, Human
ugcugggauuacaggcguaagccacca

SEQ ID NO: 536059 - RNA, 21 nt, Human
ugcugggggacagcgcuugcc

SEQ ID NO: 536060 - RNA, 23 nt, Human
uggccaggcuggucuugaacuca

SEQ ID NO: 536061 - RNA, 18 nt, Human
ugggacugcaggcaugug

SEQ ID NO: 536062 - RNA, 21 nt, Human
ugggacugcaggcaugugcca

SEQ ID NO: 536063 - RNA, 24 nt, Human
ugggacugcaggcaugugccacca

SEQ ID NO: 536064 - RNA, 18 nt, Human
ugggauuacaggcguaag

SEQ ID NO: 536065 - RNA, 19 nt, Human
ugggauuacaggcguaagc

SEQ ID NO: 536066 - RNA, 22 nt, Human
ugggauuacaggcguaagccac

SEQ ID NO: 536067 - RNA, 24 nt, Human
ugggauuacaggcguaagccacca

SEQ ID NO: 536068 - RNA, 24 nt, Human
ugggauuaucucagcucacugcaa

SEQ ID NO: 536069 - RNA, 24 nt, Human
ugggguuucaccauguuggccagg

SEQ ID NO: 536070 - RNA, 18 nt, Human
uuaguagagaugggguuu

SEQ ID NO: 536071 - RNA, 22 nt, Human
uuaguagagaugggguuucacc

SEQ ID NO: 536072 - RNA, 24 nt, Human
uuaguagagaugggguuucaccau

SEQ ID NO: 536073 - RNA, 20 nt, Human
uucagguuccaggaacuggc

SEQ ID NO: 536074 - RNA, 23 nt, Human
uugcccaggcuggaaugcagugg

SEQ ID NO: 536075 - RNA, 23 nt, Human
uuuaagagauucuccugccucag

SEQ ID NO: 536076 - RNA, 24 nt, Human
uuucaccauguuggccaggcuggu

SEQ ID NO: 536077 - RNA, 18 nt, Human
uuucuauuuuuaguagag

SEQ ID NO: 536078 - RNA, 19 nt, Human
uuucuauuuuuaguagaga

SEQ ID NO: 536079 - RNA, 24 nt, Human
uuuuuaguagagaugggguuucac

SEQ ID NO: 536080 - RNA, 26 nt, Human
uuuuuuuuuuuugagaugaagucuca

SEQ ID NO: 536081 - RNA, 21 nt, Human
aagggaccaaagcugggggca

SEQ ID NO: 536082 - RNA, 20 nt, Human
acagaccuucagaagcccca

SEQ ID NO: 536083 - RNA, 22 nt, Human
accagccugggcccugcugaug

SEQ ID NO: 536084 - RNA, 25 nt, Human
accagcugcacugcuggggcugcac

SEQ ID NO: 536085 - RNA, 21 nt, Human
agcacagaccuucagaagccc

SEQ ID NO: 536086 - RNA, 20 nt, Human
agcagggaaagcaacaccac

SEQ ID NO: 536087 - RNA, 25 nt, Human
aggaagaggaaaccagcauccaaaa

SEQ ID NO: 536088 - RNA, 24 nt, Human
aggagcuccucaucuccaggagcc

SEQ ID NO: 536089 - RNA, 20 nt, Human
aggggucacgggcaaugcca

SEQ ID NO: 536090 - RNA, 22 nt, Human
agggguugggaguuagguaaga

SEQ ID NO: 536091 - RNA, 22 nt, Human
agguccuggguaugucaccucc

SEQ ID NO: 536092 - RNA, 19 nt, Human
aguggccagggcugggccu

SEQ ID NO: 536093 - RNA, 22 nt, Human
aucagccgagggcacuccagga

SEQ ID NO: 536094 - RNA, 24 nt, Human
augcacaacuauagcauucauaug

SEQ ID NO: 536095 - RNA, 24 nt, Human
augguggugcagacccaggugggu

SEQ ID NO: 536096 - RNA, 20 nt, Human
caaccaagcuggggucaagc

SEQ ID NO: 536097 - RNA, 30 nt, Human
caacguacccaucuuuccaucuauaucaaa

SEQ ID NO: 536098 - RNA, 20 nt, Human
caacuggugggcaagaacuc

SEQ ID NO: 536099 - RNA, 18 nt, Human
caaugccagagcuggggc

SEQ ID NO: 536100 - RNA, 20 nt, Human
caccgcagguccuggguaug

SEQ ID NO: 536101 - RNA, 21 nt, Human
cacggcacccucuggugggcc

SEQ ID NO: 536102 - RNA, 24 nt, Human
cagcaggcugguagccaggagccc

SEQ ID NO: 536103 - RNA, 18 nt, Human
cagccucucuucuggguc

SEQ ID NO: 536104 - RNA, 19 nt, Human
cagccucucuucugggucc

SEQ ID NO: 536105 - RNA, 22 nt, Human
cagcuccuguagggaauacccc

SEQ ID NO: 536106 - RNA, 24 nt, Human
cagcuucuugaucccugagccccu

SEQ ID NO: 536107 - RNA, 18 nt, Human
caggagccaccagcagag

SEQ ID NO: 536108 - RNA, 19 nt, Human
caggagccaccagcagagc

SEQ ID NO: 536109 - RNA, 21 nt, Human
caggagccccuugaugacauc

SEQ ID NO: 536110 - RNA, 23 nt, Human
caguggccagggcugggccuggc

SEQ ID NO: 536111 - RNA, 19 nt, Human
ccaacaucaccacaucccg

SEQ ID NO: 536112 - RNA, 18 nt, Human
ccacucugucauccaagg

SEQ ID NO: 536113 - RNA, 18 nt, Human
ccagauaucaggauguaa

SEQ ID NO: 536114 - RNA, 21 nt, Human
ccagcacguagcgcagccgag

SEQ ID NO: 536115 - RNA, 19 nt, Human
ccagcagagcccgaagagc

SEQ ID NO: 536116 - RNA, 27 nt, Human
ccagcugccuccccaguacgacucucu

SEQ ID NO: 536117 - RNA, 18 nt, Human
cccagggcagggguuggg

SEQ ID NO: 536118 - RNA, 24 nt, Human
cccauccacucugucauccaagga

SEQ ID NO: 536119 - RNA, 23 nt, Human
ccccaaacucaccagccugggcc

SEQ ID NO: 536120 - RNA, 25 nt, Human
ccccaaacucaccagccugggcccu

SEQ ID NO: 536121 - RNA, 18 nt, Human
ccccuugaugacaucaug

SEQ ID NO: 536122 - RNA, 23 nt, Human
cccgaugguccuggagugcguca

SEQ ID NO: 536123 - RNA, 23 nt, Human
cccugagccccuucccugugacc

SEQ ID NO: 536124 - RNA, 23 nt, Human
cccugcccccacaggagaccaac

SEQ ID NO: 536125 - RNA, 18 nt, Human
ccucagaggcugucucuc

SEQ ID NO: 536126 - RNA, 20 nt, Human
ccucagcccagggcaggggu

SEQ ID NO: 536127 - RNA, 20 nt, Human
ccucauccuccuuguccucc

SEQ ID NO: 536128 - RNA, 24 nt, Human
ccugcaggaucuccucaggagcca

SEQ ID NO: 536129 - RNA, 23 nt, Human
ccugcagucuugcuauguucucu

SEQ ID NO: 536130 - RNA, 21 nt, Human
ccuuguggcugauuccaggga

SEQ ID NO: 536131 - RNA, 19 nt, Human
ccuuuuugcuuuuccugcu

SEQ ID NO: 536132 - RNA, 22 nt, Human
cgaaggaacacagcagggaaag

SEQ ID NO: 536133 - RNA, 22 nt, Human
cgaugguccuggagcggaggcc

SEQ ID NO: 536134 - RNA, 19 nt, Human
cucaaacaaccugcuccca

SEQ ID NO: 536135 - RNA, 24 nt, Human
cuccaggagccaccagcagagccc

SEQ ID NO: 536136 - RNA, 23 nt, Human
cuccaggccugucugggcgccgc

SEQ ID NO: 536137 - RNA, 26 nt, Human
cucccagcacagaccuucagaagccc

SEQ ID NO: 536138 - RNA, 25 nt, Human
cucuaaaacagcucaaacaaccugc

SEQ ID NO: 536139 - RNA, 18 nt, Human
cugcuccagcugccuccc

SEQ ID NO: 536140 - RNA, 19 nt, Human
cuggggcugcaccagcugc

SEQ ID NO: 536141 - RNA, 18 nt, Human
cuggguccucauccucag

SEQ ID NO: 536142 - RNA, 26 nt, Human
gaaggugcugucgaggagcuccucau

SEQ ID NO: 536143 - RNA, 22 nt, Human
gacagcaucuugcugcuccagc

SEQ ID NO: 536144 - RNA, 23 nt, Human
gagcgaaggaacacagcagggaa

SEQ ID NO: 536145 - RNA, 19 nt, Human
gcacaggcagauucacggc

SEQ ID NO: 536146 - RNA, 20 nt, Human
gcagcccugguuccuaggag

SEQ ID NO: 536147 - RNA, 23 nt, Human
gccagggcugggccuggcucucu

SEQ ID NO: 536148 - RNA, 24 nt, Human
gcccugcccccacaggagaccaac

SEQ ID NO: 536149 - RNA, 27 nt, Human
gccuccucuccaugguggugcagaccc

SEQ ID NO: 536150 - RNA, 22 nt, Human
gcucucucugccuccucuccau

SEQ ID NO: 536151 - RNA, 25 nt, Human
gcuggauacaggacaacguacccag

SEQ ID NO: 536152 - RNA, 18 nt, Human
gcuggcagcccugguucc

SEQ ID NO: 536153 - RNA, 21 nt, Human
gcuggggcuucuggcuccagc

SEQ ID NO: 536154 - RNA, 20 nt, Human
gcuucagcuauccuccuugc

SEQ ID NO: 536155 - RNA, 20 nt, Human
gcuucggucucgacagcauc

SEQ ID NO: 536156 - RNA, 21 nt, Human
ggaaaccuggcugcgggucag

SEQ ID NO: 536157 - RNA, 19 nt, Human
ggaacacagcagggaaagc

SEQ ID NO: 536158 - RNA, 18 nt, Human
ggagaagggaccaaagcu

SEQ ID NO: 536159 - RNA, 21 nt, Human
ggagcggaggccggucugagu

SEQ ID NO: 536160 - RNA, 19 nt, Human
ggagcuucuccagcucgac

SEQ ID NO: 536161 - RNA, 18 nt, Human
ggcaaugccagagcuggg

SEQ ID NO: 536162 - RNA, 19 nt, Human
ggcagguccacgucagggg

SEQ ID NO: 536163 - RNA, 20 nt, Human
ggcuccagcuugucucucuu

SEQ ID NO: 536164 - RNA, 19 nt, Human
gggcaaguccuggguccag

SEQ ID NO: 536165 - RNA, 20 nt, Human
gggcaaguccuggguccagu

SEQ ID NO: 536166 - RNA, 21 nt, Human
gggcacaggcagauucacggc

SEQ ID NO: 536167 - RNA, 19 nt, Human
gggcauucuucauccuugu

SEQ ID NO: 536168 - RNA, 19 nt, Human
gggcugcaccagcugcgag

SEQ ID NO: 536169 - RNA, 19 nt, Human
ggggucacgggcaaugcca

SEQ ID NO: 536170 - RNA, 21 nt, Human
ggguccuccuggccucugcuc

SEQ ID NO: 536171 - RNA, 22 nt, Human
ggugacauuagcagaggguccu

SEQ ID NO: 536172 - RNA, 18 nt, Human
ggugcagacccagguggg

SEQ ID NO: 536173 - RNA, 18 nt, Human
guccuggguccaguggag

SEQ ID NO: 536174 - RNA, 19 nt, Human
gucugggcuuccugcucag

SEQ ID NO: 536175 - RNA, 18 nt, Human
guggcugugagaucucaa

SEQ ID NO: 536176 - RNA, 19 nt, Human
uaagacacugccugcuagc

SEQ ID NO: 536177 - RNA, 24 nt, Human
uaggacacaauguucuucgucugg

SEQ ID NO: 536178 - RNA, 18 nt, Human
ucacggccacugaacuug

SEQ ID NO: 536179 - RNA, 20 nt, Human
ucaugccuccucagccucuc

SEQ ID NO: 536180 - RNA, 22 nt, Human
uccaacaucaccacaucccgau

SEQ ID NO: 536181 - RNA, 25 nt, Human
uccaacaucaccacaucccgauggu

SEQ ID NO: 536182 - RNA, 20 nt, Human
uccagcacguagcgcagccg

SEQ ID NO: 536183 - RNA, 18 nt, Human
uccaggagauaaaaaaca

SEQ ID NO: 536184 - RNA, 26 nt, Human
uccagggaaugccgggccaggcggau

SEQ ID NO: 536185 - RNA, 20 nt, Human
uccaguggagcuucuccagc

SEQ ID NO: 536186 - RNA, 25 nt, Human
ucccugugaccagauugggucccug

SEQ ID NO: 536187 - RNA, 21 nt, Human
uccuggagcggaggccggucu

SEQ ID NO: 536188 - RNA, 26 nt, Human
ucuaucagccgagggcacuccaggac

SEQ ID NO: 536189 - RNA, 21 nt, Human
ucucaagaaagcaaccaagcu

SEQ ID NO: 536190 - RNA, 21 nt, Human
ucuccagcagugucuccgugu

SEQ ID NO: 536191 - RNA, 25 nt, Human
ucuccaggagccaccagcagagccc

SEQ ID NO: 536192 - RNA, 22 nt, Human
ucucgacagcaucuugcugcuc

SEQ ID NO: 536193 - RNA, 19 nt, Human
ucuuauucauccgugcucc

SEQ ID NO: 536194 - RNA, 20 nt, Human
ugaucccugagccccuuccc

SEQ ID NO: 536195 - RNA, 21 nt, Human
ugaucccugagccccuucccu

SEQ ID NO: 536196 - RNA, 21 nt, Human
ugccagagcuggggcuucugg

SEQ ID NO: 536197 - RNA, 20 nt, Human
ugccuccucagccucucuuc

SEQ ID NO: 536198 - RNA, 23 nt, Human
ugcuccagcugccuccccaguac

SEQ ID NO: 536199 - RNA, 19 nt, Human
ugcugggaaaccuggcugc

SEQ ID NO: 536200 - RNA, 19 nt, Human
ugcugucgaggagcuccuc

SEQ ID NO: 536201 - RNA, 20 nt, Human
uggauacaggacaacguacc

SEQ ID NO: 536202 - RNA, 21 nt, Human
uggcaaaagcugacaugaggg

SEQ ID NO: 536203 - RNA, 24 nt, Human
uggcagcccugguuccuaggagug

SEQ ID NO: 536204 - RNA, 21 nt, Human
ugggcacaggcagauucacgg

SEQ ID NO: 536205 - RNA, 23 nt, Human
ugggcauucuucauccuuguccu

SEQ ID NO: 536206 - RNA, 18 nt, Human
ugggcccugcugaugacc

SEQ ID NO: 536207 - RNA, 22 nt, Human
ugggcuaacacaugcagugcca

SEQ ID NO: 536208 - RNA, 23 nt, Human
ugggcucacuggcaaaagcugac

SEQ ID NO: 536209 - RNA, 20 nt, Human
uggggcugcaccagcugcga

SEQ ID NO: 536210 - RNA, 23 nt, Human
ugucgaggagcuccucaucucca

SEQ ID NO: 536211 - RNA, 19 nt, Human
uguggcugugagaucucaa

SEQ ID NO: 536212 - RNA, 24 nt, Human
uuaguuugcccuguccccaaagag

SEQ ID NO: 536213 - RNA, 23 nt, Human
uucacucccagcacagaccuuca

SEQ ID NO: 536214 - RNA, 21 nt, Human
uuccagggaaugccgggccag

SEQ ID NO: 536215 - RNA, 22 nt, Human
uuccugggcaaagaugcuucuc

SEQ ID NO: 536216 - RNA, 19 nt, Human
uucuggcuccagcuugucu

SEQ ID NO: 536217 - RNA, 20 nt, Human
uucuggcuccagcuugucuc

SEQ ID NO: 536218 - RNA, 22 nt, Human
uuguccaacaucaccacauccc

SEQ ID NO: 536219 - RNA, 21 nt, Human
uuuuuuuuuuuuuuuuuccag

SEQ ID NO: 536220 - RNA, 23 nt, Human
uuuuuuuuuuuuuuuuuuccagg

SEQ ID NO: 536221 - RNA, 22 nt, Human
aacccggaugagggggcuagug

SEQ ID NO: 536222 - RNA, 19 nt, Human
acccggcgcggggcacgcc

SEQ ID NO: 536223 - RNA, 18 nt, Human
acugccgaguacccccca

SEQ ID NO: 536224 - RNA, 22 nt, Human
agaacccggaugagggggcuag

SEQ ID NO: 536225 - RNA, 24 nt, Human
aggcggcggcggcggcggcggcgg

SEQ ID NO: 536226 - RNA, 24 nt, Human
caaguuuauugcuacgcuuguucc

SEQ ID NO: 536227 - RNA, 18 nt, Human
ccccaacaaacccggcgc

SEQ ID NO: 536228 - RNA, 22 nt, Human
ccgaguaccccccaacaaaccc

SEQ ID NO: 536229 - RNA, 20 nt, Human
cggauguaaaguccaagauu

SEQ ID NO: 536230 - RNA, 19 nt, Human
cucuccaaguccagcaagu

SEQ ID NO: 536231 - RNA, 23 nt, Human
gcggaggcggcggcggcggcggc

SEQ ID NO: 536232 - RNA, 19 nt, Human
gcggcggcggcggcggcgg

SEQ ID NO: 536233 - RNA, 20 nt, Human
gcggcggcggcggcggcggc

SEQ ID NO: 536234 - RNA, 20 nt, Human
gcggcggcggcggcggcggc

SEQ ID NO: 536235 - RNA, 20 nt, Human
gcggcggcggcggcggcggc

SEQ ID NO: 536236 - RNA, 23 nt, Human
gcggcggcggcggcggcggcggc

SEQ ID NO: 536237 - RNA, 24 nt, Human
gcggcggcggcggcggcggcggug

SEQ ID NO: 536238 - RNA, 20 nt, Human
gcggcggcggcggcggcggu

SEQ ID NO: 536239 - RNA, 24 nt, Human
gcggcggcggcggcggcgguggcg

SEQ ID NO: 536240 - RNA, 20 nt, Human
gcggcggcggcggcgguggc

SEQ ID NO: 536241 - RNA, 23 nt, Human
gcggcggcggcggcgguggcggc

SEQ ID NO: 536242 - RNA, 19 nt, Human
gcggcggcgguggcggcgc

SEQ ID NO: 536243 - RNA, 18 nt, Human
gcggcgguggcggcgcgc

SEQ ID NO: 536244 - RNA, 20 nt, Human
gcggcgguggcggcgcgcga

SEQ ID NO: 536245 - RNA, 18 nt, Human
gcuacgcuuguuccggcc

SEQ ID NO: 536246 - RNA, 23 nt, Human
ggaggcggcggcggcggcggcgg

SEQ ID NO: 536247 - RNA, 23 nt, Human
ggcgcggggcacgccgggagaga

SEQ ID NO: 536248 - RNA, 23 nt, Human
ggcggaggcggcggcggcggcgg

SEQ ID NO: 536249 - RNA, 20 nt, Human
ggcggcggcggcggcggcgg

SEQ ID NO: 536250 - RNA, 23 nt, Human
ggcggcggcggcggcggcggcgg

SEQ ID NO: 536251 - RNA, 19 nt, Human
ggcggcggcggcggcggug

SEQ ID NO: 536252 - RNA, 23 nt, Human
ggcggcggcggcggcgguggcgg

SEQ ID NO: 536253 - RNA, 24 nt, Human
gggcacgccgggagagaacccgga

SEQ ID NO: 536254 - RNA, 19 nt, Human
uaccccccaacaaacccgg

SEQ ID NO: 536255 - RNA, 19 nt, Human
ugagggggcuaguguagug

SEQ ID NO: 536256 - RNA, 20 nt, Human
ugcuacgcuuguuccggccu

SEQ ID NO: 536257 - RNA, 21 nt, Human
uuugucuuagccuucucucca

SEQ ID NO: 536258 - RNA, 19 nt, Human
aagcagaggagaagcaggg

SEQ ID NO: 536259 - RNA, 20 nt, Human
aaggcgccaccgcccugccc

SEQ ID NO: 536260 - RNA, 19 nt, Human
acaagcagaggagaagcag

SEQ ID NO: 536261 - RNA, 21 nt, Human
accauccaagaauuccuccug

SEQ ID NO: 536262 - RNA, 23 nt, Human
acccgcugucccugggugauggc

SEQ ID NO: 536263 - RNA, 20 nt, Human
acuggugaagccacacucug

SEQ ID NO: 536264 - RNA, 21 nt, Human
agagcggggccucgccaggug

SEQ ID NO: 536265 - RNA, 24 nt, Human
aggacaccauccaagaauuccucc

SEQ ID NO: 536266 - RNA, 20 nt, Human
agugaaggaccucgcggcug

SEQ ID NO: 536267 - RNA, 18 nt, Human
caacuugccaggggacag

SEQ ID NO: 536268 - RNA, 18 nt, Human
caagcagaggagaagcag

SEQ ID NO: 536269 - RNA, 18 nt, Human
caagcgccagcucugagc

SEQ ID NO: 536270 - RNA, 18 nt, Human
caccgugcugagcagagc

SEQ ID NO: 536271 - RNA, 19 nt, Human
cacuuugcaccgugcugag

SEQ ID NO: 536272 - RNA, 19 nt, Human
cagcaggcggccagagacc

SEQ ID NO: 536273 - RNA, 22 nt, Human
cagcaggcggccagagaccagg

SEQ ID NO: 536274 - RNA, 18 nt, Human
cagcugcgucugcaagcg

SEQ ID NO: 536275 - RNA, 22 nt, Human
caggaagcugcccccguagcac

SEQ ID NO: 536276 - RNA, 19 nt, Human
caggaaggccuacccagca

SEQ ID NO: 536277 - RNA, 18 nt, Human
caggaaggccuacccagg

SEQ ID NO: 536278 - RNA, 22 nt, Human
ccagggcacgugugcccagcgc

SEQ ID NO: 536279 - RNA, 18 nt, Human
cccaggaugccgcuggcc

SEQ ID NO: 536280 - RNA, 19 nt, Human
cccaggauggaccugggcc

SEQ ID NO: 536281 - RNA, 24 nt, Human
cccccacaauuacagggugggagu

SEQ ID NO: 536282 - RNA, 25 nt, Human
ccccccacaauuacagggugggagu

SEQ ID NO: 536283 - RNA, 20 nt, Human
ccccuggacuggcucccauc

SEQ ID NO: 536284 - RNA, 23 nt, Human
ccuacccagcaccuguccagaaa

SEQ ID NO: 536285 - RNA, 21 nt, Human
ccuccugaggagacgcgaaga

SEQ ID NO: 536286 - RNA, 22 nt, Human
ccucugguuuggccggcuccgg

SEQ ID NO: 536287 - RNA, 24 nt, Human
ccugggugauggcccggcuccggc

SEQ ID NO: 536288 - RNA, 18 nt, Human
cgcuggccucagccaggg

SEQ ID NO: 536289 - RNA, 23 nt, Human
cggacugcucccucugacuggug

SEQ ID NO: 536290 - RNA, 21 nt, Human
cgguggggucaucuugccucu

SEQ ID NO: 536291 - RNA, 24 nt, Human
cguacaagcagaggagaagcaggg

SEQ ID NO: 536292 - RNA, 25 nt, Human
cguacaagcagaggagaagcagggg

SEQ ID NO: 536293 - RNA, 21 nt, Human
cuccaagacagcagcauucac

SEQ ID NO: 536294 - RNA, 22 nt, Human
cugaccccuggacuggcuccca

SEQ ID NO: 536295 - RNA, 19 nt, Human
cuggggauggccacacccu

SEQ ID NO: 536296 - RNA, 18 nt, Human
cuuugcugcccaggaugg

SEQ ID NO: 536297 - RNA, 21 nt, Human
gaccugggccacccaggaugc

SEQ ID NO: 536298 - RNA, 23 nt, Human
gagaagcaggggugcccaggcug

SEQ ID NO: 536299 - RNA, 19 nt, Human
gaggagacgcgaagaccau

SEQ ID NO: 536300 - RNA, 22 nt, Human
gaggagacgcgaagaccaucga

SEQ ID NO: 536301 - RNA, 23 nt, Human
gcagucccgguggggucaucuug

SEQ ID NO: 536302 - RNA, 23 nt, Human
gccucugguuuggccggcuccgg

SEQ ID NO: 536303 - RNA, 21 nt, Human
gcggcugcggacagguccuug

SEQ ID NO: 536304 - RNA, 20 nt, Human
ggagaagcaggggugcccag

SEQ ID NO: 536305 - RNA, 21 nt, Human
ggagaagcaggggugcccagg

SEQ ID NO: 536306 - RNA, 18 nt, Human
ggagcuccucugcccaca

SEQ ID NO: 536307 - RNA, 19 nt, Human
ggagcuccucugcccacau

SEQ ID NO: 536308 - RNA, 22 nt, Human
ggccagagaccaggaaggccua

SEQ ID NO: 536309 - RNA, 26 nt, Human
ggggugcccaggcugucacagccuug

SEQ ID NO: 536310 - RNA, 23 nt, Human
guccuuguuaguaaggaggaggc

SEQ ID NO: 536311 - RNA, 19 nt, Human
gugcagcgcguggucccgg

SEQ ID NO: 536312 - RNA, 20 nt, Human
gugcagcgcguggucccggc

SEQ ID NO: 536313 - RNA, 19 nt, Human
guggaugggaagugccugu

SEQ ID NO: 536314 - RNA, 23 nt, Human
guguggguugaccuggccuaugc

SEQ ID NO: 536315 - RNA, 24 nt, Human
uccaaaggucaggaaggcgccacc

SEQ ID NO: 536316 - RNA, 18 nt, Human
uccccaaacgugcccagg

SEQ ID NO: 536317 - RNA, 22 nt, Human
uccccaaacgugcccaggcucu

SEQ ID NO: 536318 - RNA, 22 nt, Human
ucccugggugauggcccggcuc

SEQ ID NO: 536319 - RNA, 26 nt, Human
uccggacugcucccucugacugguga

SEQ ID NO: 536320 - RNA, 18 nt, Human
ucgccagguggaaagccc

SEQ ID NO: 536321 - RNA, 20 nt, Human
ugaccccuggacuggcuccc

SEQ ID NO: 536322 - RNA, 19 nt, Human
ugaccuggccuaugcgggg

SEQ ID NO: 536323 - RNA, 20 nt, Human
ugacuggugaagccacacuc

SEQ ID NO: 536324 - RNA, 24 nt, Human
ugacuggugaagccacacucugug

SEQ ID NO: 536325 - RNA, 18 nt, Human
ugccaggggacaggccug

SEQ ID NO: 536326 - RNA, 19 nt, Human
ugcccaggcuccaagacag

SEQ ID NO: 536327 - RNA, 20 nt, Human
ugcccaggcuccaagacagc

SEQ ID NO: 536328 - RNA, 19 nt, Human
ugccgcuggccucagccag

SEQ ID NO: 536329 - RNA, 19 nt, Human
ugccuguguggaugugaag

SEQ ID NO: 536330 - RNA, 20 nt, Human
ugcuaagccaaaccuaggug

SEQ ID NO: 536331 - RNA, 18 nt, Human
ugcucugcaaacccaggg

SEQ ID NO: 536332 - RNA, 25 nt, Human
uggaagaaugaaaagaaguuucugc

SEQ ID NO: 536333 - RNA, 20 nt, Human
uggaaggagcacagaaagga

SEQ ID NO: 536334 - RNA, 21 nt, Human
uggaaggagcacagaaaggaa

SEQ ID NO: 536335 - RNA, 18 nt, Human
uggaccugggccacccag

SEQ ID NO: 536336 - RNA, 18 nt, Human
uggcagcaggcggccaga

SEQ ID NO: 536337 - RNA, 18 nt, Human
uggccucagccagggcac

SEQ ID NO: 536338 - RNA, 20 nt, Human
ugggcggcucggagcuccuc

SEQ ID NO: 536339 - RNA, 22 nt, Human
uggggucaucuugccucuccgg

SEQ ID NO: 536340 - RNA, 23 nt, Human
uggugaagccacacucugugaag

SEQ ID NO: 536341 - RNA, 21 nt, Human
ugguguggguugaccuggccu

SEQ ID NO: 536342 - RNA, 22 nt, Human
ugugaagccaccuugggugggc

SEQ ID NO: 536343 - RNA, 20 nt, Human
uguugcuggcacucccccca

SEQ ID NO: 536344 - RNA, 23 nt, Human
uguugcuggcacuccccccacaa

SEQ ID NO: 536345 - RNA, 22 nt, Human
uuccaaaggucaggaaggcgcc

SEQ ID NO: 536346 - RNA, 21 nt, Human
uuguagaggaacgacucgugu

SEQ ID NO: 536347 - RNA, 20 nt, Human
uuuuuuuuuuuuuugaugga

SEQ ID NO: 536348 - RNA, 18 nt, Human
uuuuuuuuuuuuuuuuug

SEQ ID NO: 536349 - RNA, 22 nt, Human
uuuuuuuuuuuuuuuuugaugg

SEQ ID NO: 536350 - RNA, 21 nt, Human
aagaggccaccucuggagcuc

SEQ ID NO: 536351 - RNA, 20 nt, Human
aagagggaaaaacagggcaa

SEQ ID NO: 536352 - RNA, 20 nt, Human
aaggagaucaacgccacaaa

SEQ ID NO: 536353 - RNA, 23 nt, Human
acaacagcccuuccagcuucucc

SEQ ID NO: 536354 - RNA, 24 nt, Human
acaagcaucuuugggcuuguugac

SEQ ID NO: 536355 - RNA, 18 nt, Human
acacacaaaaaagaugag

SEQ ID NO: 536356 - RNA, 18 nt, Human
acaggcuuucugcacccc

SEQ ID NO: 536357 - RNA, 21 nt, Human
acauacucaauagccccuugc

SEQ ID NO: 536358 - RNA, 21 nt, Human
acggcaucuccaucuccuggg

SEQ ID NO: 536359 - RNA, 20 nt, Human
acugaaugugccaucacccc

SEQ ID NO: 536360 - RNA, 23 nt, Human
acugaccccgaaacucacagaac

SEQ ID NO: 536361 - RNA, 22 nt, Human
acugccucccccuucccuccua

SEQ ID NO: 536362 - RNA, 28 nt, Human
agaaauagcgacagaaaaaccgguaccc

SEQ ID NO: 536363 - RNA, 24 nt, Human
agaacuuuugaggcagcaugggga

SEQ ID NO: 536364 - RNA, 22 nt, Human
agacagagugucuuuuauuccu

SEQ ID NO: 536365 - RNA, 19 nt, Human
agaccuggcagcaccaaca

SEQ ID NO: 536366 - RNA, 18 nt, Human
agagcuccuggcucugcu

SEQ ID NO: 536367 - RNA, 21 nt, Human
agaggaaggaggaggagaaag

SEQ ID NO: 536368 - RNA, 20 nt, Human
agaugguuugggucuaaaac

SEQ ID NO: 536369 - RNA, 22 nt, Human
aggaaggaggaggagaaagggu

SEQ ID NO: 536370 - RNA, 23 nt, Human
aggaaugccagggggccaggugc

SEQ ID NO: 536371 - RNA, 24 nt, Human
aggaggaggagaaagggugggguu

SEQ ID NO: 536372 - RNA, 21 nt, Human
agucacaggucagcuggaaga

SEQ ID NO: 536373 - RNA, 22 nt, Human
aucuguccacagcugccagagc

SEQ ID NO: 536374 - RNA, 24 nt, Human
caaacggcaucuccaucuccuggg

SEQ ID NO: 536375 - RNA, 21 nt, Human
caaauauaaacagggccgugg

SEQ ID NO: 536376 - RNA, 21 nt, Human
caaauuccuggccaaacuaca

SEQ ID NO: 536377 - RNA, 20 nt, Human
caacauaaagacccaaauau

SEQ ID NO: 536378 - RNA, 19 nt, Human
caagaggccaccucuggag

SEQ ID NO: 536379 - RNA, 20 nt, Human
caagcagccauuugcgagac

SEQ ID NO: 536380 - RNA, 20 nt, Human
cacaggcuuucugcaccccu

SEQ ID NO: 536381 - RNA, 20 nt, Human
caccuuuucccacaaccaag

SEQ ID NO: 536382 - RNA, 21 nt, Human
cacugaaugugccaucacccc

SEQ ID NO: 536383 - RNA, 20 nt, Human
cagaacuuuugaggcagcau

SEQ ID NO: 536384 - RNA, 23 nt, Human
cagagcuccuggcucugcucucc

SEQ ID NO: 536385 - RNA, 30 nt, Human
cagcaccaacauaaagacccaaauauaaaa

SEQ ID NO: 536386 - RNA, 19 nt, Human
caugugauggagucagcuu

SEQ ID NO: 536387 - RNA, 19 nt, Human
ccacaaacggcaucuccau

SEQ ID NO: 536388 - RNA, 24 nt, Human
ccacaaacggcaucuccaucuccu

SEQ ID NO: 536389 - RNA, 22 nt, Human
ccacaggcuuucugcaccccuc

SEQ ID NO: 536390 - RNA, 23 nt, Human
ccacaggcuuucugcaccccucu

SEQ ID NO: 536391 - RNA, 21 nt, Human
ccacuggagacaucugcccac

SEQ ID NO: 536392 - RNA, 18 nt, Human
cccaaauauaaacagggc

SEQ ID NO: 536393 - RNA, 24 nt, Human
ccccacuggagacaucugcccacc

SEQ ID NO: 536394 - RNA, 19 nt, Human
ccgccgcggguccggccuc

SEQ ID NO: 536395 - RNA, 22 nt, Human
ccgcgcccgcccgcgucccuuc

SEQ ID NO: 536396 - RNA, 20 nt, Human
ccggagccgcgauguggaga

SEQ ID NO: 536397 - RNA, 20 nt, Human
ccuagagucaagaccugccc

SEQ ID NO: 536398 - RNA, 25 nt, Human
ccuggcuuauuuuauuaacuaagug

SEQ ID NO: 536399 - RNA, 22 nt, Human
cgcugcugguccccgccgcggg

SEQ ID NO: 536400 - RNA, 22 nt, Human
cggagcugcccgcgcccgcccg

SEQ ID NO: 536401 - RNA, 19 nt, Human
cggggccaucggaggccgc

SEQ ID NO: 536402 - RNA, 22 nt, Human
cgucaaguggcaaauuucucca

SEQ ID NO: 536403 - RNA, 21 nt, Human
cuauagcaguagaucugucca

SEQ ID NO: 536404 - RNA, 18 nt, Human
cuccucuagaccgcugcu

SEQ ID NO: 536405 - RNA, 25 nt, Human
cuccuggcucugcucuccacucacc

SEQ ID NO: 536406 - RNA, 18 nt, Human
cuccugggcccacaggcu

SEQ ID NO: 536407 - RNA, 19 nt, Human
cucuagcugcccaucaacu

SEQ ID NO: 536408 - RNA, 18 nt, Human
cugcugguccccgccgcg

SEQ ID NO: 536409 - RNA, 19 nt, Human
cuggcucugcucuccacuc

SEQ ID NO: 536410 - RNA, 19 nt, Human
cuucauagccacacugaau

SEQ ID NO: 536411 - RNA, 24 nt, Human
cuucauagccacacugaaugugcc

SEQ ID NO: 536412 - RNA, 19 nt, Human
cuuuuguggugccacaugg

SEQ ID NO: 536413 - RNA, 19 nt, Human
gaaggaggaggagaaaggg

SEQ ID NO: 536414 - RNA, 21 nt, Human
gaaugccagggggccaggugc

SEQ ID NO: 536415 - RNA, 23 nt, Human
gacaucugcccacccuggggucu

SEQ ID NO: 536416 - RNA, 26 nt, Human
gaggaggagaaagggugggguuccag

SEQ ID NO: 536417 - RNA, 19 nt, Human
gaggauucgcucuucauag

SEQ ID NO: 536418 - RNA, 25 nt, Human
gagucagcuuuacacugaaagggca

SEQ ID NO: 536419 - RNA, 24 nt, Human
gcaguagaucuguccaagaggcca

SEQ ID NO: 536420 - RNA, 19 nt, Human
gccacauggcguuuucaau

SEQ ID NO: 536421 - RNA, 23 nt, Human
gccccuggcuggaauugugcucc

SEQ ID NO: 536422 - RNA, 18 nt, Human
gcugcugggaggagagga

SEQ ID NO: 536423 - RNA, 18 nt, Human
ggaaaguacagagagcuc

SEQ ID NO: 536424 - RNA, 19 nt, Human
ggaagcacaucuguccaca

SEQ ID NO: 536425 - RNA, 21 nt, Human
ggagaggagcuugaugagaaa

SEQ ID NO: 536426 - RNA, 18 nt, Human
ggaggagaggauggugcu

SEQ ID NO: 536427 - RNA, 22 nt, Human
ggaggaggagaaaggguggggu

SEQ ID NO: 536428 - RNA, 25 nt, Human
ggcacaacccaugcucaggaagcac

SEQ ID NO: 536429 - RNA, 19 nt, Human
ggccaccucuggagcucag

SEQ ID NO: 536430 - RNA, 19 nt, Human
ggccaggugcagccauccu

SEQ ID NO: 536431 - RNA, 24 nt, Human
gggguuccagcugagaccuagagu

SEQ ID NO: 536432 - RNA, 19 nt, Human
gguggucggcagaccugcu

SEQ ID NO: 536433 - RNA, 24 nt, Human
uagagucaagaccugcccucacac

SEQ ID NO: 536434 - RNA, 22 nt, Human
uagauuuauuuucaucucaucu

SEQ ID NO: 536435 - RNA, 23 nt, Human
uaguacaguaguacauguauaua

SEQ ID NO: 536436 - RNA, 23 nt, Human
uauagcaguagaucuguccaaga

SEQ ID NO: 536437 - RNA, 20 nt, Human
uauugugaugugaggcagga

SEQ ID NO: 536438 - RNA, 24 nt, Human
ucaagaccugcccucacacacaaa

SEQ ID NO: 536439 - RNA, 22 nt, Human
ucauagccacacugaaugugcc

SEQ ID NO: 536440 - RNA, 19 nt, Human
uccaagaggccaccucugg

SEQ ID NO: 536441 - RNA, 24 nt, Human
uccaaguggccccuggcuggaauu

SEQ ID NO: 536442 - RNA, 22 nt, Human
uccacagcugccagagcuccug

SEQ ID NO: 536443 - RNA, 20 nt, Human
uccaccuuuucccacaacca

SEQ ID NO: 536444 - RNA, 21 nt, Human
uccaccuuuucccacaaccaa

SEQ ID NO: 536445 - RNA, 21 nt, Human
ucccagauguggccuuggcua

SEQ ID NO: 536446 - RNA, 19 nt, Human
ucccauccgacucacaccc

SEQ ID NO: 536447 - RNA, 20 nt, Human
ucccccuucccuccuagagc

SEQ ID NO: 536448 - RNA, 19 nt, Human
ucccgccccgccgccgccg

SEQ ID NO: 536449 - RNA, 21 nt, Human
ucccgccccgccgccgccggu

SEQ ID NO: 536450 - RNA, 22 nt, Human
ucccgccccgccgccgccgguc

SEQ ID NO: 536451 - RNA, 25 nt, Human
uccgccuguccuggcugcuccuggu

SEQ ID NO: 536452 - RNA, 18 nt, Human
uccuggcugcuccuggga

SEQ ID NO: 536453 - RNA, 18 nt, Human
uccugggcccacaggcuu

SEQ ID NO: 536454 - RNA, 19 nt, Human
ucuccaucuccugggccca

SEQ ID NO: 536455 - RNA, 21 nt, Human
ucuccaucuccugggcccaca

SEQ ID NO: 536456 - RNA, 23 nt, Human
ucugcccacccuggggucugcaa

SEQ ID NO: 536457 - RNA, 23 nt, Human
ugaccccacuggagacaucugcc

SEQ ID NO: 536458 - RNA, 19 nt, Human
ugagaagagaaagaccugg

SEQ ID NO: 536459 - RNA, 20 nt, Human
ugaggagaggagcuugauga

SEQ ID NO: 536460 - RNA, 22 nt, Human
ugaggcaggagaccugggcaug

SEQ ID NO: 536461 - RNA, 22 nt, Human
ugagugggccuguaaaguuaga

SEQ ID NO: 536462 - RNA, 19 nt, Human
ugcccggagaugcccaagg

SEQ ID NO: 536463 - RNA, 24 nt, Human
ugccucaaaugugagugggccugu

SEQ ID NO: 536464 - RNA, 19 nt, Human
ugcugggaggagaggaugg

SEQ ID NO: 536465 - RNA, 21 nt, Human
uggagaaaugcagggcuuaaa

SEQ ID NO: 536466 - RNA, 23 nt, Human
uggaugcacaugugauggaguca

SEQ ID NO: 536467 - RNA, 21 nt, Human
uggcguuuucaauuucauuua

SEQ ID NO: 536468 - RNA, 19 nt, Human
ugggacacugaccccgaaa

SEQ ID NO: 536469 - RNA, 19 nt, Human
ugggaggagaggauggugc

SEQ ID NO: 536470 - RNA, 22 nt, Human
ugggaggagaggauggugcugg

SEQ ID NO: 536471 - RNA, 20 nt, Human
ugguggagaggaaaacaagg

SEQ ID NO: 536472 - RNA, 20 nt, Human
ugugcucacugaccccacug

SEQ ID NO: 536473 - RNA, 23 nt, Human
uuaagugaacauuuacuuccucu

SEQ ID NO: 536474 - RNA, 23 nt, Human
uuccaguuccaaaaccaucuuuc

SEQ ID NO: 536475 - RNA, 24 nt, Human
uuggagaaaugcagggcuuaaagg

SEQ ID NO: 536476 - RNA, 22 nt, Human
uuuaaaucacuacaucucucca

SEQ ID NO: 536477 - RNA, 23 nt, Human
uuuaagugaacauuuacuuccuc

SEQ ID NO: 536478 - RNA, 18 nt, Human
uuuuggaacuuugacuua

SEQ ID NO: 536479 - RNA, 24 nt, Human
uuuuuuuuuuuuuuuuggaacuuu

SEQ ID NO: 536480 - RNA, 19 nt, Human
uuuuuuuuuuuuuuuuugg

SEQ ID NO: 536481 - RNA, 19 nt, Human
aaaaaaaccgaaacuuaag

SEQ ID NO: 536482 - RNA, 24 nt, Human
aaaaacaccaaaaaguacagugua

SEQ ID NO: 536483 - RNA, 23 nt, Human
aaaacaccaaaaaguacagugua

SEQ ID NO: 536484 - RNA, 23 nt, Human
aaaacaccuuuauaccauauuuu

SEQ ID NO: 536485 - RNA, 21 nt, Human
aaagaucagauuuaauucuuu

SEQ ID NO: 536486 - RNA, 23 nt, Human
aaaguuuucccaaaaaauggcau

SEQ ID NO: 536487 - RNA, 22 nt, Human
aacauuuuauuuguuaaaaaug

SEQ ID NO: 536488 - RNA, 19 nt, Human
aaccaaagaagucaaacag

SEQ ID NO: 536489 - RNA, 20 nt, Human
aacuugcuacuuacuuccuc

SEQ ID NO: 536490 - RNA, 20 nt, Human
aacuugcuacuuacuuccuc

SEQ ID NO: 536491 - RNA, 22 nt, Human
aagaaaucagugaaagguaaac

SEQ ID NO: 536492 - RNA, 23 nt, Human
aagcaugagagacaacaaugaaa

SEQ ID NO: 536493 - RNA, 25 nt, Human
aagggcaagugacagcaaccaaggg

SEQ ID NO: 536494 - RNA, 21 nt, Human
aaguacaguguaaagcaccuc

SEQ ID NO: 536495 - RNA, 24 nt, Human
aaugccugaacuuuaauuuauacc

SEQ ID NO: 536496 - RNA, 24 nt, Human
acaaugcagggcaggccaagaacc

SEQ ID NO: 536497 - RNA, 24 nt, Human
acuaaagcuguguaauuccagggg

SEQ ID NO: 536498 - RNA, 23 nt, Human
agaaaucagugaaagguaaacaa

SEQ ID NO: 536499 - RNA, 20 nt, Human
agacagcaaacuugagcuca

SEQ ID NO: 536500 - RNA, 22 nt, Human
agacagcaaacuugagcucagc

SEQ ID NO: 536501 - RNA, 26 nt, Human
agauauuaaagaucagauucgagucc

SEQ ID NO: 536502 - RNA, 23 nt, Human
aggcauucauccuugcaaaaaug

SEQ ID NO: 536503 - RNA, 19 nt, Human
aggccggagucgcaggccu

SEQ ID NO: 536504 - RNA, 18 nt, Human
augaagcaacucaagaag

SEQ ID NO: 536505 - RNA, 19 nt, Human
caaaggugaugagauccug

SEQ ID NO: 536506 - RNA, 23 nt, Human
caaccacauuccaauaaagaaaa

SEQ ID NO: 536507 - RNA, 20 nt, Human
cagcuucagaauagaucuaa

SEQ ID NO: 536508 - RNA, 22 nt, Human
ccaaaaaguacaguguaaagca

SEQ ID NO: 536509 - RNA, 18 nt, Human
ccaaagaagucaaacaga

SEQ ID NO: 536510 - RNA, 21 nt, Human
ccaaccaugaaaucuuuaaga

SEQ ID NO: 536511 - RNA, 22 nt, Human
ccuguccuucaacuugcuacuu

SEQ ID NO: 536512 - RNA, 19 nt, Human
cgcgccgagagcgggcgcg

SEQ ID NO: 536513 - RNA, 23 nt, Human
cgucugaaagaggaagcacguuc

SEQ ID NO: 536514 - RNA, 24 nt, Human
cucaguacuaucuuagcacagacu

SEQ ID NO: 536515 - RNA, 20 nt, Human
cugaacuuuaauuuauacca

SEQ ID NO: 536516 - RNA, 19 nt, Human
gaaacuguuacugauagcu

SEQ ID NO: 536517 - RNA, 19 nt, Human
gaacucuucaagcaauuca

SEQ ID NO: 536518 - RNA, 21 nt, Human
gcaagugacagcaaccaaggg

SEQ ID NO: 536519 - RNA, 21 nt, Human
gcgagcauaaaccaugaagca

SEQ ID NO: 536520 - RNA, 19 nt, Human
guggcgggucgguggggag

SEQ ID NO: 536521 - RNA, 19 nt, Human
uaaaaugucaagcuucaaa

SEQ ID NO: 536522 - RNA, 21 nt, Human
uaaagcuguguaauuccaggg

SEQ ID NO: 536523 - RNA, 25 nt, Human
uaagaaaucagugaaagguaaacaa

SEQ ID NO: 536524 - RNA, 21 nt, Human
uaagaacagacagguauaauc

SEQ ID NO: 536525 - RNA, 23 nt, Human
uaagaacaggaaaaugaaaacac

SEQ ID NO: 536526 - RNA, 27 nt, Human
uaauggcaaacuaaaaugucaagcuuc

SEQ ID NO: 536527 - RNA, 25 nt, Human
uacaauaauagguaagaacaggaaa

SEQ ID NO: 536528 - RNA, 21 nt, Human
uagcacagacuaacuucuccc

SEQ ID NO: 536529 - RNA, 22 nt, Human
uaugaaaagcaucaaauagcua

SEQ ID NO: 536530 - RNA, 25 nt, Human
uaugaaaagcaucaaauagcuaagg

SEQ ID NO: 536531 - RNA, 20 nt, Human
ucaaauagcuaaggagagac

SEQ ID NO: 536532 - RNA, 21 nt, Human
ucaacacuaacaaucuacucc

SEQ ID NO: 536533 - RNA, 18 nt, Human
ucaacacuauuaaagggc

SEQ ID NO: 536534 - RNA, 21 nt, Human
ucaagcuucaaaaugaccaaa

SEQ ID NO: 536535 - RNA, 18 nt, Human
ucagagguggcagguggc

SEQ ID NO: 536536 - RNA, 22 nt, Human
uccaaaaaacaccaaaaaguac

SEQ ID NO: 536537 - RNA, 18 nt, Human
uccccauaaaugccugaa

SEQ ID NO: 536538 - RNA, 21 nt, Human
ucccccuaagucuucaaaccc

SEQ ID NO: 536539 - RNA, 21 nt, Human
ugaaaagcaucaaauagcuaa

SEQ ID NO: 536540 - RNA, 22 nt, Human
ugaacaaggauuacaaccacau

SEQ ID NO: 536541 - RNA, 19 nt, Human
ugacaaagucuaaaacacg

SEQ ID NO: 536542 - RNA, 25 nt, Human
ugacuacaucaacacuauuaaaggg

SEQ ID NO: 536543 - RNA, 25 nt, Human
ugacugacuuccaauaaucccuuau

SEQ ID NO: 536544 - RNA, 19 nt, Human
ugacuuccaauaaucccuu

SEQ ID NO: 536545 - RNA, 18 nt, Human
ugagauccugaauaccgc

SEQ ID NO: 536546 - RNA, 18 nt, Human
ugcaaagaaaaguuuaag

SEQ ID NO: 536547 - RNA, 23 nt, Human
ugcuacauccaaacaguacaucu

SEQ ID NO: 536548 - RNA, 21 nt, Human
uggaagauuuugcugcauuug

SEQ ID NO: 536549 - RNA, 19 nt, Human
uggaugucccccuaagucu

SEQ ID NO: 536550 - RNA, 19 nt, Human
uggcagguggcgggucggu

SEQ ID NO: 536551 - RNA, 23 nt, Human
uggccuauaugaaaagcaucaaa

SEQ ID NO: 536552 - RNA, 21 nt, Human
uggggcaauuuuuaaaguuuu

SEQ ID NO: 536553 - RNA, 22 nt, Human
ugucaagcuucaaaaugaccaa

SEQ ID NO: 536554 - RNA, 24 nt, Human
ugugaauaugcauuuacagucucu

SEQ ID NO: 536555 - RNA, 19 nt, Human
uguuaaaagcucagcacua

SEQ ID NO: 536556 - RNA, 21 nt, Human
uguuucaucucaacuaccugu

SEQ ID NO: 536557 - RNA, 21 nt, Human
uguuuuguuuauauacaauau

SEQ ID NO: 536558 - RNA, 22 nt, Human
uuacagaugcaugaagaauaaa

SEQ ID NO: 536559 - RNA, 20 nt, Human
uucaaaaauaaaaauaagag

SEQ ID NO: 536560 - RNA, 21 nt, Human
uucaaacccacagcuggaaau

SEQ ID NO: 536561 - RNA, 30 nt, Human
uucacaaaccauucuaaagacagcaaacuu

SEQ ID NO: 536562 - RNA, 23 nt, Human
uucuaaaucagacuaaaauguac

SEQ ID NO: 536563 - RNA, 19 nt, Human
uucuugaauuuccgugaug

SEQ ID NO: 536564 - RNA, 24 nt, Human
uucuuggccuauaugaaaagcauc

SEQ ID NO: 536565 - RNA, 21 nt, Human
uuuacaggaaaagucaacacu

SEQ ID NO: 536566 - RNA, 21 nt, Human
uuuugcauuuuuuuucucugu

SEQ ID NO: 536567 - RNA, 22 nt, Human
uuuuuuuuuaaaaaaaaaaacc

SEQ ID NO: 536568 - RNA, 21 nt, Human
aaaaaaacauuaaugaaagua

SEQ ID NO: 536569 - RNA, 20 nt, Human
aaguaccaaugcaaacugaa

SEQ ID NO: 536570 - RNA, 19 nt, Human
acauuaaugaaaguagaau

SEQ ID NO: 536571 - RNA, 24 nt, Human
agaacaaaaaaacauuaaugaaag

SEQ ID NO: 536572 - RNA, 23 nt, Human
agcuaugaaguccacaguaagua

SEQ ID NO: 536573 - RNA, 20 nt, Human
caaaaaaacauuaaugaaag

SEQ ID NO: 536574 - RNA, 25 nt, Human
caaacugaacagauuuagaaaguca

SEQ ID NO: 536575 - RNA, 19 nt, Human
caguaaguaccaaugcaaa

SEQ ID NO: 536576 - RNA, 19 nt, Human
ccaaugcaaacugaacaga

SEQ ID NO: 536577 - RNA, 19 nt, Human
cuggaaaaagucagaagcc

SEQ ID NO: 536578 - RNA, 20 nt, Human
ggaaaaagucagaagcccau

SEQ ID NO: 536579 - RNA, 19 nt, Human
uaaguaccaaugcaaacug

SEQ ID NO: 536580 - RNA, 21 nt, Human
uacacccuggaaaaagucaga

SEQ ID NO: 536581 - RNA, 21 nt, Human
uguacaauauaauaucacuuu

SEQ ID NO: 536582 - RNA, 19 nt, Human
ugucaguaagcuaugaagu

SEQ ID NO: 536583 - RNA, 24 nt, Human
uuacaggacauuacauuuuuauuu

SEQ ID NO: 536584 - RNA, 25 nt, Human
uucagaacaaaaaaacauuaaugaa

SEQ ID NO: 536585 - RNA, 21 nt, Human
uuuagaaagucaauccauacu

SEQ ID NO: 536586 - RNA, 18 nt, Human
uuuuuuuuuuuuacagga

SEQ ID NO: 536587 - RNA, 22 nt, Human
uuuuuuuuuuuuuuuuacagga

SEQ ID NO: 536588 - RNA, 24 nt, Human
uuuuuuuuuuuuuuuuuuuacagg

SEQ ID NO: 536589 - RNA, 19 nt, Human
aaaaagcaaaaacaaaaag

SEQ ID NO: 536590 - RNA, 21 nt, Human
aaacaaaaagaaaauuucaca

SEQ ID NO: 536591 - RNA, 25 nt, Human
aaacaaaaagaaaauuucacaucug

SEQ ID NO: 536592 - RNA, 26 nt, Human
aaacaaaaagaaaauuucacaucuga

SEQ ID NO: 536593 - RNA, 19 nt, Human
aaacaguguaagcugccuu

SEQ ID NO: 536594 - RNA, 18 nt, Human
aaacugccaugaaacuuc

SEQ ID NO: 536595 - RNA, 19 nt, Human
aacaugcuacauuuuccuu

SEQ ID NO: 536596 - RNA, 24 nt, Human
aagaaauaauguucaacacagccc

SEQ ID NO: 536597 - RNA, 23 nt, Human
aagcaaaaacaaaaagaaaauuu

SEQ ID NO: 536598 - RNA, 24 nt, Human
aagcugccuuuuuucuuaagaccu

SEQ ID NO: 536599 - RNA, 23 nt, Human
aagucccccaaaaaauccucuuc

SEQ ID NO: 536600 - RNA, 22 nt, Human
aauaaguuuucucacaagacuc

SEQ ID NO: 536601 - RNA, 26 nt, Human
acaaaaagaaaauuucacaucugaaa

SEQ ID NO: 536602 - RNA, 19 nt, Human
acacuaagauuucuaaagc

SEQ ID NO: 536603 - RNA, 23 nt, Human
accaaaauacugaagaaaugcug

SEQ ID NO: 536604 - RNA, 18 nt, Human
acucagugaaacaaggcu

SEQ ID NO: 536605 - RNA, 21 nt, Human
acucagugaaacaaggcuuca

SEQ ID NO: 536606 - RNA, 20 nt, Human
acuucagcaauacucaguca

SEQ ID NO: 536607 - RNA, 22 nt, Human
agccaaaaagcaaaaacaaaaa

SEQ ID NO: 536608 - RNA, 28 nt, Human
agccaaaaagcaaaaacaaaagggaccc

SEQ ID NO: 536609 - RNA, 18 nt, Human
aggugccccuggccuggg

SEQ ID NO: 536610 - RNA, 23 nt, Human
auaaaagauaaaaggaaaaaaac

SEQ ID NO: 536611 - RNA, 21 nt, Human
auauugaagucccccaaaaaa

SEQ ID NO: 536612 - RNA, 23 nt, Human
aucaaagucuucuuuauuauucc

SEQ ID NO: 536613 - RNA, 25 nt, Human
aucaguuuuucugcguguguaauaa

SEQ ID NO: 536614 - RNA, 18 nt, Human
auggccacuuaaaauauc

SEQ ID NO: 536615 - RNA, 24 nt, Human
caaaaacaaaaagaaaauuucaca

SEQ ID NO: 536616 - RNA, 26 nt, Human
caaaaagaaaauuucacaucugaaga

SEQ ID NO: 536617 - RNA, 24 nt, Human
caaaaagcaaaaacaaaaagaaaa

SEQ ID NO: 536618 - RNA, 22 nt, Human
caacacagcccaacaaaacauu

SEQ ID NO: 536619 - RNA, 23 nt, Human
caacacagcccaacaaaacauuc

SEQ ID NO: 536620 - RNA, 23 nt, Human
caacaccucauggcaaguccaaa

SEQ ID NO: 536621 - RNA, 19 nt, Human
caacaggacugcacaggaa

SEQ ID NO: 536622 - RNA, 24 nt, Human
caauuuacgagccaaaaagcaaaa

SEQ ID NO: 536623 - RNA, 25 nt, Human
caccuucugccccaccagaggugcc

SEQ ID NO: 536624 - RNA, 19 nt, Human
cacguaaauaaaagauaaa

SEQ ID NO: 536625 - RNA, 21 nt, Human
cagcaauacucagucauuuga

SEQ ID NO: 536626 - RNA, 25 nt, Human
cagugaaacaaggcuucaacaccuc

SEQ ID NO: 536627 - RNA, 21 nt, Human
cauauacagagacacacauag

SEQ ID NO: 536628 - RNA, 20 nt, Human
caucgucacauugcuaguca

SEQ ID NO: 536629 - RNA, 24 nt, Human
caucugaagagcauuccuaaacau

SEQ ID NO: 536630 - RNA, 22 nt, Human
ccaaaauacugaagaaaugcug

SEQ ID NO: 536631 - RNA, 23 nt, Human
ccaaaauacugaagaaaugcugc

SEQ ID NO: 536632 - RNA, 20 nt, Human
ccaccagcugaaauacugua

SEQ ID NO: 536633 - RNA, 22 nt, Human
cccaaaauggcgccgacccgau

SEQ ID NO: 536634 - RNA, 24 nt, Human
ccucauggcaaguccaaauuccaa

SEQ ID NO: 536635 - RNA, 24 nt, Human
cgagccaaaaagcaaaaacaaaaa

SEQ ID NO: 536636 - RNA, 23 nt, Human
cuaaaacuuucaauaaagguaaa

SEQ ID NO: 536637 - RNA, 24 nt, Human
cuccagaugaaauauccaauuuac

SEQ ID NO: 536638 - RNA, 21 nt, Human
cugccccaccagaggugcccc

SEQ ID NO: 536639 - RNA, 18 nt, Human
gaagaaccccaacaacgg

SEQ ID NO: 536640 - RNA, 23 nt, Human
gcccaacaaaacauucuugguuu

SEQ ID NO: 536641 - RNA, 20 nt, Human
gcugaagucaaaaauuccua

SEQ ID NO: 536642 - RNA, 21 nt, Human
gggcaaaauuauccaaaaaca

SEQ ID NO: 536643 - RNA, 19 nt, Human
ggugccccuggccuggggg

SEQ ID NO: 536644 - RNA, 19 nt, Human
gguuuuuguuuuguuguug

SEQ ID NO: 536645 - RNA, 18 nt, Human
guuguacuuguccacucc

SEQ ID NO: 536646 - RNA, 24 nt, Human
uaaaauauccagggccuuuuacac

SEQ ID NO: 536647 - RNA, 18 nt, Human
uaaaugagaaaaucucau

SEQ ID NO: 536648 - RNA, 18 nt, Human
uaagacagaagcuuugca

SEQ ID NO: 536649 - RNA, 21 nt, Human
uacaauucaccccaaacugua

SEQ ID NO: 536650 - RNA, 21 nt, Human
uacacaauuuuuuauuauuaa

SEQ ID NO: 536651 - RNA, 21 nt, Human
uacuucaagucagcuacccau

SEQ ID NO: 536652 - RNA, 24 nt, Human
uauacagagacacacauagcuauc

SEQ ID NO: 536653 - RNA, 21 nt, Human
uauuuuguauccucugaaaua

SEQ ID NO: 536654 - RNA, 22 nt, Human
ucaacacagcccaacaaaacau

SEQ ID NO: 536655 - RNA, 23 nt, Human
ucaacaccucauggcaaguccaa

SEQ ID NO: 536656 - RNA, 20 nt, Human
ucaagucagcuacccauacu

SEQ ID NO: 536657 - RNA, 18 nt, Human
ucaaucucuucauucaga

SEQ ID NO: 536658 - RNA, 20 nt, Human
ucacuacuaucaauucacuu

SEQ ID NO: 536659 - RNA, 20 nt, Human
ucagaaaaagugucccauug

SEQ ID NO: 536660 - RNA, 20 nt, Human
ucagugaaacaaggcuucaa

SEQ ID NO: 536661 - RNA, 19 nt, Human
uccaaaaacacuguaaauc

SEQ ID NO: 536662 - RNA, 24 nt, Human
uccaaaaacacuguaaauccaaaa

SEQ ID NO: 536663 - RNA, 24 nt, Human
uccaaaauggccacuuaaaauauc

SEQ ID NO: 536664 - RNA, 21 nt, Human
uccaacucagugaaacaaggc

SEQ ID NO: 536665 - RNA, 20 nt, Human
uccaugucguggacagaucc

SEQ ID NO: 536666 - RNA, 18 nt, Human
ucccccaaaaaauccucu

SEQ ID NO: 536667 - RNA, 23 nt, Human
uccgcaauguucugggccaaguc

SEQ ID NO: 536668 - RNA, 23 nt, Human
uccucauuccuacaacauucauu

SEQ ID NO: 536669 - RNA, 21 nt, Human
ucucuuuuuaaguagcuugcu

SEQ ID NO: 536670 - RNA, 18 nt, Human
ucugaagagcauuccuaa

SEQ ID NO: 536671 - RNA, 23 nt, Human
ucugcaagcaaaacaguguaagc

SEQ ID NO: 536672 - RNA, 18 nt, Human
ucuggggcaaaauuaucc

SEQ ID NO: 536673 - RNA, 21 nt, Human
ucuuaaauuuccacguaaaua

SEQ ID NO: 536674 - RNA, 20 nt, Human
ucuugguuuucuucauauug

SEQ ID NO: 536675 - RNA, 19 nt, Human
ugaaagagcugaagucaaa

SEQ ID NO: 536676 - RNA, 24 nt, Human
ugaaagagcugaagucaaaaauuc

SEQ ID NO: 536677 - RNA, 20 nt, Human
ugaagaaagucaauguugga

SEQ ID NO: 536678 - RNA, 25 nt, Human
ugacaacauaccccaauaaagcuuu

SEQ ID NO: 536679 - RNA, 18 nt, Human
ugcagugaugaagaaagu

SEQ ID NO: 536680 - RNA, 27 nt, Human
ugcagugaugaagaaagucaauguugg

SEQ ID NO: 536681 - RNA, 24 nt, Human
ugccugggucucuuuuuaaguagc

SEQ ID NO: 536682 - RNA, 24 nt, Human
uggcgccgacccgauccgcaaggc

SEQ ID NO: 536683 - RNA, 19 nt, Human
uggcuaaagagcaauuuau

SEQ ID NO: 536684 - RNA, 18 nt, Human
ugggggaaggagagggag

SEQ ID NO: 536685 - RNA, 18 nt, Human
ugugccaagucuuuuccu

SEQ ID NO: 536686 - RNA, 21 nt, Human
uguuuuaaaguuuucauaugg

SEQ ID NO: 536687 - RNA, 20 nt, Human
uucaacacagcccaacaaaa

SEQ ID NO: 536688 - RNA, 19 nt, Human
uucggcugaagaaccccaa

SEQ ID NO: 536689 - RNA, 22 nt, Human
uuggaccaacccaaguccucau

SEQ ID NO: 536690 - RNA, 21 nt, Human
uuguuguuuuuugggggaagg

SEQ ID NO: 536691 - RNA, 23 nt, Human
uuguuuuguuguuguuguuuuuu

SEQ ID NO: 536692 - RNA, 25 nt, Human
uuuaaaguuuucauauggcuaucuc

SEQ ID NO: 536693 - RNA, 22 nt, Human
uuucacaucugaagagcauucc

SEQ ID NO: 536694 - RNA, 20 nt, Human
uuuccacguaaauaaaagau

SEQ ID NO: 536695 - RNA, 20 nt, Human
uuugaaacugcugaaacuac

SEQ ID NO: 536696 - RNA, 25 nt, Human
uuugaauaauccccuuuugccgcuu

SEQ ID NO: 536697 - RNA, 23 nt, Human
uuuuccuuuuugguuuuuguuuu

SEQ ID NO: 536698 - RNA, 25 nt, Human
uuuugggggaaggagagggagaccg

SEQ ID NO: 536699 - RNA, 24 nt, Human
aaaaauguuuauucugcuuucuuc

SEQ ID NO: 536700 - RNA, 18 nt, Human
aaacacgcauuccacagc

SEQ ID NO: 536701 - RNA, 21 nt, Human
aaacacgcauuccacagccag

SEQ ID NO: 536702 - RNA, 24 nt, Human
acaccacuaaggacaccugugagc

SEQ ID NO: 536703 - RNA, 24 nt, Human
acagagcagcuccagugucuacug

SEQ ID NO: 536704 - RNA, 19 nt, Human
agacccagggaagggccca

SEQ ID NO: 536705 - RNA, 20 nt, Human
agcacaggagggaaaagggg

SEQ ID NO: 536706 - RNA, 24 nt, Human
aggaaccaagucacaccccccaug

SEQ ID NO: 536707 - RNA, 18 nt, Human
agggaagggcccacuucc

SEQ ID NO: 536708 - RNA, 24 nt, Human
auccugcugggggagacccuugcu

SEQ ID NO: 536709 - RNA, 21 nt, Human
augacuccuugggggacagag

SEQ ID NO: 536710 - RNA, 19 nt, Human
auucugcuuucuuccuugg

SEQ ID NO: 536711 - RNA, 20 nt, Human
caaggcacagaggugagucc

SEQ ID NO: 536712 - RNA, 20 nt, Human
caagucacaccccccaugcu

SEQ ID NO: 536713 - RNA, 25 nt, Human
cacaccccccaugcuagaggauccc

SEQ ID NO: 536714 - RNA, 22 nt, Human
cacagcacaugcagccaguaga

SEQ ID NO: 536715 - RNA, 19 nt, Human
cacaggagggaaaagggga

SEQ ID NO: 536716 - RNA, 20 nt, Human
caccagggucaggagugggg

SEQ ID NO: 536717 - RNA, 25 nt, Human
cagcucugcccaagguggccaggga

SEQ ID NO: 536718 - RNA, 21 nt, Human
caggagcagcaaggcacagag

SEQ ID NO: 536719 - RNA, 20 nt, Human
ccaguagacagcugcaacac

SEQ ID NO: 536720 - RNA, 22 nt, Human
cccaagguggccagggagaccc

SEQ ID NO: 536721 - RNA, 24 nt, Human
ccccuguagcuccgggaagggcug

SEQ ID NO: 536722 - RNA, 19 nt, Human
cccguugaggcccaguacc

SEQ ID NO: 536723 - RNA, 18 nt, Human
cccugaguuccaugacuc

SEQ ID NO: 536724 - RNA, 21 nt, Human
cccuugggccucaggagcagc

SEQ ID NO: 536725 - RNA, 26 nt, Human
ccugugagcggccacgggcucagcuc

SEQ ID NO: 536726 - RNA, 21 nt, Human
ccuugggccucaggagcagca

SEQ ID NO: 536727 - RNA, 20 nt, Human
cggcgugggcgugugagcac

SEQ ID NO: 536728 - RNA, 19 nt, Human
cucagggaggaugcugggc

SEQ ID NO: 536729 - RNA, 18 nt, Human
cuccuugggggacagagc

SEQ ID NO: 536730 - RNA, 21 nt, Human
cugacccaaacacgcauucca

SEQ ID NO: 536731 - RNA, 18 nt, Human
cuggucacuggucguggg

SEQ ID NO: 536732 - RNA, 21 nt, Human
gaaccaagucacaccccccau

SEQ ID NO: 536733 - RNA, 24 nt, Human
gacccaaacacgcauuccacagcc

SEQ ID NO: 536734 - RNA, 24 nt, Human
gacccagcucugcccaagguggcc

SEQ ID NO: 536735 - RNA, 25 nt, Human
gacccagcucugcccaagguggcca

SEQ ID NO: 536736 - RNA, 22 nt, Human
gagcagcuccagugucuacuga

SEQ ID NO: 536737 - RNA, 24 nt, Human
gaggcccuguguggggacucaggg

SEQ ID NO: 536738 - RNA, 20 nt, Human
gcacggcgugggcgugugag

SEQ ID NO: 536739 - RNA, 25 nt, Human
gcugcaacaccacuaaggacaccug

SEQ ID NO: 536740 - RNA, 21 nt, Human
gcugcaugacccagcucugcc

SEQ ID NO: 536741 - RNA, 18 nt, Human
ggacagagcacaggaggg

SEQ ID NO: 536742 - RNA, 21 nt, Human
ggacccugguggggugcagag

SEQ ID NO: 536743 - RNA, 27 nt, Human
ggaggaugcugggcgggagagaggccc

SEQ ID NO: 536744 - RNA, 21 nt, Human
ggauauucacagcacaugcag

SEQ ID NO: 536745 - RNA, 18 nt, Human
ggcugcgaagcuggaagc

SEQ ID NO: 536746 - RNA, 22 nt, Human
gggaagggcccacuucccagga

SEQ ID NO: 536747 - RNA, 22 nt, Human
ggggagaggcaggcgcuugcca

SEQ ID NO: 536748 - RNA, 24 nt, Human
ggggugcagagugaggcccugugu

SEQ ID NO: 536749 - RNA, 20 nt, Human
gggugcagagugaggcccug

SEQ ID NO: 536750 - RNA, 26 nt, Human
gggugggucaucaggcugcuuuggcu

SEQ ID NO: 536751 - RNA, 18 nt, Human
gugcagagugaggcccug

SEQ ID NO: 536752 - RNA, 20 nt, Human
guggggugcagagugaggcc

SEQ ID NO: 536753 - RNA, 22 nt, Human
guggggugcagagugaggcccu

SEQ ID NO: 536754 - RNA, 21 nt, Human
uagaggaucccccuguagcuc

SEQ ID NO: 536755 - RNA, 19 nt, Human
ucaggagcagcaaggcaca

SEQ ID NO: 536756 - RNA, 21 nt, Human
ucagguucccguugaggccca

SEQ ID NO: 536757 - RNA, 19 nt, Human
ucaucaggcugcuuuggcu

SEQ ID NO: 536758 - RNA, 18 nt, Human
uccacaggcucuggcugg

SEQ ID NO: 536759 - RNA, 25 nt, Human
ucccaaaguuuaacuccuggucacu

SEQ ID NO: 536760 - RNA, 20 nt, Human
ucccccuguagcuccgggaa

SEQ ID NO: 536761 - RNA, 19 nt, Human
ucccugggugugaucaugg

SEQ ID NO: 536762 - RNA, 22 nt, Human
uccgggaagggcugcgaagcug

SEQ ID NO: 536763 - RNA, 23 nt, Human
ugacccaaacacgcauuccacag

SEQ ID NO: 536764 - RNA, 20 nt, Human
ugacccagcucugcccaagg

SEQ ID NO: 536765 - RNA, 23 nt, Human
ugacccagcucugcccaaggugg

SEQ ID NO: 536766 - RNA, 22 nt, Human
ugcaacaccacuaaggacaccu

SEQ ID NO: 536767 - RNA, 24 nt, Human
ugcaacaccacuaaggacaccugu

SEQ ID NO: 536768 - RNA, 24 nt, Human
ugcccaagguggccagggagacca

SEQ ID NO: 536769 - RNA, 23 nt, Human
ugcccuugggccucaggagcagc

SEQ ID NO: 536770 - RNA, 18 nt, Human
ugcugcugcccaguggcg

SEQ ID NO: 536771 - RNA, 18 nt, Human
uggcaaggagagggcacc

SEQ ID NO: 536772 - RNA, 19 nt, Human
uggcaaggagagggcaccg

SEQ ID NO: 536773 - RNA, 22 nt, Human
ugggcgggagagaggcccaggg

SEQ ID NO: 536774 - RNA, 19 nt, Human
uggggugggggacggccug

SEQ ID NO: 536775 - RNA, 22 nt, Human
ugguggggugcagagugaggcc

SEQ ID NO: 536776 - RNA, 22 nt, Human
uuuuuuuuuuuuuuuuuuuagg

SEQ ID NO: 536777 - RNA, 23 nt, Human
aaaaacagagcacaaauaaauaa

SEQ ID NO: 536778 - RNA, 24 nt, Human
aaaaauucucuaguuauuuaugga

SEQ ID NO: 536779 - RNA, 19 nt, Human
aaaaggaaggacguaaaaa

SEQ ID NO: 536780 - RNA, 22 nt, Human
aaaaugaaacaaaaccaggaug

SEQ ID NO: 536781 - RNA, 21 nt, Human
aaacagagcaaaaugaaacaa

SEQ ID NO: 536782 - RNA, 20 nt, Human
aaauagccuagcccagaaag

SEQ ID NO: 536783 - RNA, 22 nt, Human
aaauagccuagcccagaaagau

SEQ ID NO: 536784 - RNA, 21 nt, Human
aaauggcacuaucaaaauccc

SEQ ID NO: 536785 - RNA, 23 nt, Human
aacacaauuuuuccaugagucau

SEQ ID NO: 536786 - RNA, 26 nt, Human
aaccaaaaacagagcacaaauaaaua

SEQ ID NO: 536787 - RNA, 19 nt, Human
aaguguuuugagacagaaa

SEQ ID NO: 536788 - RNA, 20 nt, Human
aaguguuuugagacagaaac

SEQ ID NO: 536789 - RNA, 27 nt, Human
aaugaaacaaaaccaggaugccuuuaa

SEQ ID NO: 536790 - RNA, 19 nt, Human
acaagcacaucauuaaaca

SEQ ID NO: 536791 - RNA, 21 nt, Human
acaugcuaauaaaacugcuuc

SEQ ID NO: 536792 - RNA, 24 nt, Human
accacuauaugaaaauauggcuac

SEQ ID NO: 536793 - RNA, 24 nt, Human
agauuuguacaaaaaaggaaggac

SEQ ID NO: 536794 - RNA, 22 nt, Human
agcaaaaugaaacaaaaccagg

SEQ ID NO: 536795 - RNA, 20 nt, Human
agcacaaauaaauaaaggca

SEQ ID NO: 536796 - RNA, 20 nt, Human
agcagugcuagcaguguaca

SEQ ID NO: 536797 - RNA, 20 nt, Human
agcaguguaagagagaagca

SEQ ID NO: 536798 - RNA, 23 nt, Human
augaaacaaaaccaggaugccuu

SEQ ID NO: 536799 - RNA, 24 nt, Human
caacagauaacaaaaauucucuag

SEQ ID NO: 536800 - RNA, 25 nt, Human
caacuauaccauaaauucauucuuc

SEQ ID NO: 536801 - RNA, 18 nt, Human
cauacagacaaaaauaug

SEQ ID NO: 536802 - RNA, 25 nt, Human
cauccagaaauuaauacaauacaga

SEQ ID NO: 536803 - RNA, 24 nt, Human
ccaagccaacacaauuuuuccaug

SEQ ID NO: 536804 - RNA, 21 nt, Human
ccacuggguucaacuauacca

SEQ ID NO: 536805 - RNA, 20 nt, Human
cccaaauggaagagcagaau

SEQ ID NO: 536806 - RNA, 19 nt, Human
ccuuugcugaacauacuuc

SEQ ID NO: 536807 - RNA, 22 nt, Human
cuaaucauacagacaaaaauau

SEQ ID NO: 536808 - RNA, 22 nt, Human
cuaguucaagcaguguaagaga

SEQ ID NO: 536809 - RNA, 23 nt, Human
cuaguucaagcaguguaagagag

SEQ ID NO: 536810 - RNA, 20 nt, Human
cugaacauacuucauauuug

SEQ ID NO: 536811 - RNA, 21 nt, Human
gaaaaacaaacauuuuggcca

SEQ ID NO: 536812 - RNA, 20 nt, Human
gaacuguuggagaacaagcu

SEQ ID NO: 536813 - RNA, 21 nt, Human
gagcaaaaugaaacaaaacca

SEQ ID NO: 536814 - RNA, 22 nt, Human
gagcaaaaugaaacaaaaccag

SEQ ID NO: 536815 - RNA, 21 nt, Human
gcaaauauaacuucagaguuu

SEQ ID NO: 536816 - RNA, 23 nt, Human
gcuguguacacaucuaaaacccu

SEQ ID NO: 536817 - RNA, 18 nt, Human
ggagaaugauaaagugcu

SEQ ID NO: 536818 - RNA, 18 nt, Human
guccacgguaacauugca

SEQ ID NO: 536819 - RNA, 21 nt, Human
uaaaaaaaacauuuacugucu

SEQ ID NO: 536820 - RNA, 23 nt, Human
uaaaaaauacugauaaauacugu

SEQ ID NO: 536821 - RNA, 19 nt, Human
uaaaagcaguuauauucuu

SEQ ID NO: 536822 - RNA, 20 nt, Human
uaaacaugcagaccaagcca

SEQ ID NO: 536823 - RNA, 19 nt, Human
uaaaccaaaaacagagcac

SEQ ID NO: 536824 - RNA, 19 nt, Human
uaaauuaauaaaauguaac

SEQ ID NO: 536825 - RNA, 20 nt, Human
uaacaacagauaacaaaaag

SEQ ID NO: 536826 - RNA, 22 nt, Human
uaacaugcuaauaaaacugcuu

SEQ ID NO: 536827 - RNA, 22 nt, Human
uaacucucuuaggcuuuccaag

SEQ ID NO: 536828 - RNA, 20 nt, Human
uacacaucuaaaacccugaa

SEQ ID NO: 536829 - RNA, 19 nt, Human
uacauuuuauuuaaaacac

SEQ ID NO: 536830 - RNA, 25 nt, Human
uaggucccaagccaguauaucaaaa

SEQ ID NO: 536831 - RNA, 26 nt, Human
uaggucccaagccaguauaucaaaaa

SEQ ID NO: 536832 - RNA, 23 nt, Human
uaguaaacaaagugaccccuuuu

SEQ ID NO: 536833 - RNA, 26 nt, Human
uagucugaaaauacucuuguacaauc

SEQ ID NO: 536834 - RNA, 22 nt, Human
uaugaaccauaugcugguacua

SEQ ID NO: 536835 - RNA, 24 nt, Human
uauguaaaaaaaguaacuacauga

SEQ ID NO: 536836 - RNA, 19 nt, Human
ucaagcaguguaagagaga

SEQ ID NO: 536837 - RNA, 19 nt, Human
ucaucuaaaaauuuggcuu

SEQ ID NO: 536838 - RNA, 23 nt, Human
uccagaaauuaauacaauacaga

SEQ ID NO: 536839 - RNA, 20 nt, Human
ugaaaaacaaacauuuuggc

SEQ ID NO: 536840 - RNA, 25 nt, Human
ugaaaaacaaacauuuuggccaaaa

SEQ ID NO: 536841 - RNA, 19 nt, Human
ugacauacuucaucaauga

SEQ ID NO: 536842 - RNA, 22 nt, Human
ugacauacuucaucaaugauua

SEQ ID NO: 536843 - RNA, 23 nt, Human
ugagacagaaacaugaaaaggcu

SEQ ID NO: 536844 - RNA, 21 nt, Human
ugcaauuuagugauaaaugau

SEQ ID NO: 536845 - RNA, 19 nt, Human
ugcugaacauacuucauau

SEQ ID NO: 536846 - RNA, 22 nt, Human
ugcugaacauacuucauauuug

SEQ ID NO: 536847 - RNA, 18 nt, Human
ugcuuugcuacugugugc

SEQ ID NO: 536848 - RNA, 20 nt, Human
uggaagagcagaaucacuuc

SEQ ID NO: 536849 - RNA, 22 nt, Human
uggacuucgucaucuaaaaauu

SEQ ID NO: 536850 - RNA, 22 nt, Human
uggcaauauuuguaacaugcua

SEQ ID NO: 536851 - RNA, 20 nt, Human
uggggaaaguauuauuugca

SEQ ID NO: 536852 - RNA, 22 nt, Human
uggguuggcuucagaacuguug

SEQ ID NO: 536853 - RNA, 23 nt, Human
uggguuggcuucagaacuguugg

SEQ ID NO: 536854 - RNA, 24 nt, Human
ugguagagaagucuugguuuggca

SEQ ID NO: 536855 - RNA, 18 nt, Human
uguaaaccaaaaacagag

SEQ ID NO: 536856 - RNA, 22 nt, Human
uguaacugacauacuucaucaa

SEQ ID NO: 536857 - RNA, 18 nt, Human
uguacacaucuaaaaccc

SEQ ID NO: 536858 - RNA, 20 nt, Human
ugucaaaguguuuugagaca

SEQ ID NO: 536859 - RNA, 20 nt, Human
uguggagaaugauaaagugc

SEQ ID NO: 536860 - RNA, 22 nt, Human
uguggagaaugauaaagugcua

SEQ ID NO: 536861 - RNA, 19 nt, Human
uguggcagauacaaaaauc

SEQ ID NO: 536862 - RNA, 19 nt, Human
uguguguuuuuagaaaauu

SEQ ID NO: 536863 - RNA, 27 nt, Human
uuaacaauaaauggcacuaucaaaauc

SEQ ID NO: 536864 - RNA, 23 nt, Human
uucagaauccagugaaaaacaaa

SEQ ID NO: 536865 - RNA, 24 nt, Human
uucagaauccagugaaaaacaaac

SEQ ID NO: 536866 - RNA, 21 nt, Human
uucccaguggaaugccuguga

SEQ ID NO: 536867 - RNA, 22 nt, Human
uuguauaccacuauaugaaaau

SEQ ID NO: 536868 - RNA, 18 nt, Human
uuugacacaaguguuauu

SEQ ID NO: 536869 - RNA, 22 nt, Human
uuugcuguaaauuaaaaaaaac

SEQ ID NO: 536870 - RNA, 18 nt, Human
uuuuauuuuuauacuaag

SEQ ID NO: 536871 - RNA, 22 nt, Human
uuuucaaaaauuaguguuuugg

SEQ ID NO: 536872 - RNA, 19 nt, Human
aaaaauacaguaaaaugau

SEQ ID NO: 536873 - RNA, 24 nt, Human
aaacaaaaagaccacaaaauucua

SEQ ID NO: 536874 - RNA, 20 nt, Human
aaacugaaucagggaaauaa

SEQ ID NO: 536875 - RNA, 21 nt, Human
aaagcagguggcuuaaugcaa

SEQ ID NO: 536876 - RNA, 20 nt, Human
aaagugauccugggaccuuu

SEQ ID NO: 536877 - RNA, 20 nt, Human
aaguagcugcagucacucca

SEQ ID NO: 536878 - RNA, 19 nt, Human
aauguaagcagauaucuua

SEQ ID NO: 536879 - RNA, 19 nt, Human
accaccugcaucugauuua

SEQ ID NO: 536880 - RNA, 24 nt, Human
aggaaaaagauaaaugcaaucaga

SEQ ID NO: 536881 - RNA, 25 nt, Human
aggaaaaagauaaaugcaaucagaa

SEQ ID NO: 536882 - RNA, 23 nt, Human
aggaaaaggauacaccaagaaaa

SEQ ID NO: 536883 - RNA, 18 nt, Human
aggaugggaaugagaggg

SEQ ID NO: 536884 - RNA, 23 nt, Human
auaaaacaagagacauguagauu

SEQ ID NO: 536885 - RNA, 25 nt, Human
auccuccuuagggucucuuuuuuau

SEQ ID NO: 536886 - RNA, 18 nt, Human
caagagacauguagauuc

SEQ ID NO: 536887 - RNA, 25 nt, Human
caaggaaccaugcaaaaauacagua

SEQ ID NO: 536888 - RNA, 18 nt, Human
caauacaaggaaccaugc

SEQ ID NO: 536889 - RNA, 24 nt, Human
cagauaccugccagugacuuaaau

SEQ ID NO: 536890 - RNA, 23 nt, Human
cagcaaaaacugaaucagggaaa

SEQ ID NO: 536891 - RNA, 21 nt, Human
cagcagcaaaaacugaaucag

SEQ ID NO: 536892 - RNA, 23 nt, Human
cagcagucuaaauguaugauauc

SEQ ID NO: 536893 - RNA, 18 nt, Human
caucugauuuauaugggu

SEQ ID NO: 536894 - RNA, 22 nt, Human
ccagcacucuaaguucaaugcu

SEQ ID NO: 536895 - RNA, 18 nt, Human
ccagcuucaauucccagu

SEQ ID NO: 536896 - RNA, 21 nt, Human
ccaucuuugguugacugcagu

SEQ ID NO: 536897 - RNA, 18 nt, Human
gacaacaaauucuacaug

SEQ ID NO: 536898 - RNA, 22 nt, Human
gcaagaguucugaaacauggug

SEQ ID NO: 536899 - RNA, 22 nt, Human
gcagaagacaacaaauucuaca

SEQ ID NO: 536900 - RNA, 21 nt, Human
ggaugggaaugagagggaggg

SEQ ID NO: 536901 - RNA, 22 nt, Human
guaaaaaacaaaaagaccacaa

SEQ ID NO: 536902 - RNA, 21 nt, Human
uaaaugcaaucagaacagcag

SEQ ID NO: 536903 - RNA, 25 nt, Human
uaauacacaauauuaucauuuucua

SEQ ID NO: 536904 - RNA, 28 nt, Human
uacaaggaaccaugcaaaaauacaguag

SEQ ID NO: 536905 - RNA, 23 nt, Human
uacacaauauuaucauuuucuag

SEQ ID NO: 536906 - RNA, 24 nt, Human
uacagaaaaaugucaaaucuagaa

SEQ ID NO: 536907 - RNA, 21 nt, Human
uauguaaaaaacaaaaagacc

SEQ ID NO: 536908 - RNA, 19 nt, Human
ucccuaacgaaaggaugag

SEQ ID NO: 536909 - RNA, 22 nt, Human
ucccuaacgaaaggaugagaac

SEQ ID NO: 536910 - RNA, 18 nt, Human
ucuacuuacuaaagcagc

SEQ ID NO: 536911 - RNA, 19 nt, Human
ugaaaguaucuugauaauu

SEQ ID NO: 536912 - RNA, 21 nt, Human
ugaagugggaguauauaaccc

SEQ ID NO: 536913 - RNA, 21 nt, Human
ugacaucuucacauaugaucc

SEQ ID NO: 536914 - RNA, 22 nt, Human
ugauccaugggaacauguccuc

SEQ ID NO: 536915 - RNA, 19 nt, Human
ugaucgacucuugguaaug

SEQ ID NO: 536916 - RNA, 26 nt, Human
ugcacuguguugaaaggaaaaggaua

SEQ ID NO: 536917 - RNA, 20 nt, Human
ugcaguaccaggaaggaugg

SEQ ID NO: 536918 - RNA, 22 nt, Human
uguaaaaaacaaaaagaccaca

SEQ ID NO: 536919 - RNA, 24 nt, Human
uguaaaaaacaaaaagaccacaaa

SEQ ID NO: 536920 - RNA, 22 nt, Human
ugucaaaucuagaaaaaaaagc

SEQ ID NO: 536921 - RNA, 18 nt, Human
ugugcaaagaaaugcaau

SEQ ID NO: 536922 - RNA, 22 nt, Human
uucacauaugauccaugggaac

SEQ ID NO: 536923 - RNA, 25 nt, Human
uucuaugaaugcacagauaccugcc

SEQ ID NO: 536924 - RNA, 23 nt, Human
uugauaauaauaugcauccugaa

SEQ ID NO: 536925 - RNA, 24 nt, Human
uuuagagagaaauaaaacaagaga

SEQ ID NO: 536926 - RNA, 20 nt, Human
uuuauaaguucuaugaaugc

SEQ ID NO: 536927 - RNA, 24 nt, Human
aaaaaagcaucaaccaacuaugaa

SEQ ID NO: 536928 - RNA, 25 nt, Human
aaaaacugccccaccccuaaucccc

SEQ ID NO: 536929 - RNA, 22 nt, Human
aaaagaaguaaaugccaaaaag

SEQ ID NO: 536930 - RNA, 20 nt, Human
aaaaugccagauuuaagaug

SEQ ID NO: 536931 - RNA, 18 nt, Human
aaagaccuaaaaaccuaa

SEQ ID NO: 536932 - RNA, 21 nt, Human
aaaugccaaaaagaccuaaaa

SEQ ID NO: 536933 - RNA, 22 nt, Human
aacaagcuuuguguuugucagu

SEQ ID NO: 536934 - RNA, 26 nt, Human
aaccaacuaugaacuaauuagauuuu

SEQ ID NO: 536935 - RNA, 23 nt, Human
aaccaaggcagcaaaaagcugcc

SEQ ID NO: 536936 - RNA, 19 nt, Human
aauacccaucauacucagc

SEQ ID NO: 536937 - RNA, 20 nt, Human
aauggaaacaaaauaaauau

SEQ ID NO: 536938 - RNA, 18 nt, Human
acaaugcagaaacuuaaa

SEQ ID NO: 536939 - RNA, 18 nt, Human
acagcagacaaaaacugc

SEQ ID NO: 536940 - RNA, 22 nt, Human
acugccccaccccuaauccccu

SEQ ID NO: 536941 - RNA, 19 nt, Human
acuuacagagaaauagacc

SEQ ID NO: 536942 - RNA, 21 nt, Human
acuuacagcagacaaaaacug

SEQ ID NO: 536943 - RNA, 25 nt, Human
agacaaaaacugccccaccccuaau

SEQ ID NO: 536944 - RNA, 19 nt, Human
agcagacaaaaacugcccc

SEQ ID NO: 536945 - RNA, 23 nt, Human
aguguugaguguaaugagaacaa

SEQ ID NO: 536946 - RNA, 19 nt, Human
augaggccuugauuuacua

SEQ ID NO: 536947 - RNA, 21 nt, Human
auuucacuuuucucaggggaa

SEQ ID NO: 536948 - RNA, 24 nt, Human
auuucacuuuucucaggggaauag

SEQ ID NO: 536949 - RNA, 22 nt, Human
caaaaagcugccucuguaacac

SEQ ID NO: 536950 - RNA, 22 nt, Human
caaaaccaaggcagcaaaaagc

SEQ ID NO: 536951 - RNA, 21 nt, Human
caaaucacugcacagcccuua

SEQ ID NO: 536952 - RNA, 20 nt, Human
cacuuacagcagacaaaaac

SEQ ID NO: 536953 - RNA, 18 nt, Human
cagaagaugcaauaguau

SEQ ID NO: 536954 - RNA, 20 nt, Human
cagcagacaaaaacugcccc

SEQ ID NO: 536955 - RNA, 23 nt, Human
ccaaaagcaaauuuccuuagcug

SEQ ID NO: 536956 - RNA, 22 nt, Human
ccuagguuaagacacuuacagc

SEQ ID NO: 536957 - RNA, 21 nt, Human
ccucuguaacaccccuaauuc

SEQ ID NO: 536958 - RNA, 25 nt, Human
cuaguaaauauauauauauauauau

SEQ ID NO: 536959 - RNA, 19 nt, Human
cuauaauauaaaaacaaga

SEQ ID NO: 536960 - RNA, 27 nt, Human
cucaaagauagguuacuauacugaugg

SEQ ID NO: 536961 - RNA, 20 nt, Human
gacacuuacagcagacaaaa

SEQ ID NO: 536962 - RNA, 22 nt, Human
gacuagucaaccacuuuauuua

SEQ ID NO: 536963 - RNA, 22 nt, Human
gcaaaaagcugccucuguaaca

SEQ ID NO: 536964 - RNA, 18 nt, Human
gccagauuuaagauggua

SEQ ID NO: 536965 - RNA, 23 nt, Human
gcuuggugagcuguuacauagac

SEQ ID NO: 536966 - RNA, 18 nt, Human
ggaauuaaaagaaaggug

SEQ ID NO: 536967 - RNA, 21 nt, Human
guaaugagaacaaugcagaaa

SEQ ID NO: 536968 - RNA, 22 nt, Human
uaaaaaguuagaaaagccaaug

SEQ ID NO: 536969 - RNA, 18 nt, Human
uaaaagaaguaaaugcca

SEQ ID NO: 536970 - RNA, 19 nt, Human
uaaaugccaaaaagaccua

SEQ ID NO: 536971 - RNA, 22 nt, Human
uaacaaugugcuaugaggccuu

SEQ ID NO: 536972 - RNA, 23 nt, Human
uaaguguauagaauccugugugg

SEQ ID NO: 536973 - RNA, 18 nt, Human
uacaaaacaaaucacugc

SEQ ID NO: 536974 - RNA, 25 nt, Human
uacaacacaaugaauugaugguaaa

SEQ ID NO: 536975 - RNA, 21 nt, Human
uacccaugauguaccuuaaac

SEQ ID NO: 536976 - RNA, 19 nt, Human
uacugugacuacuuuccug

SEQ ID NO: 536977 - RNA, 18 nt, Human
uagaccaaaggaugaagg

SEQ ID NO: 536978 - RNA, 18 nt, Human
uagcauuguaaacauaag

SEQ ID NO: 536979 - RNA, 24 nt, Human
uauagaaaggaaaaaauuaguuuc

SEQ ID NO: 536980 - RNA, 28 nt, Human
uauauauauauauauauguaucauaaua

SEQ ID NO: 536981 - RNA, 26 nt, Human
uaucuaguaaauauauauauauauau

SEQ ID NO: 536982 - RNA, 20 nt, Human
uauggucgagucucuaaaac

SEQ ID NO: 536983 - RNA, 21 nt, Human
uauggucgagucucuaaaacc

SEQ ID NO: 536984 - RNA, 30 nt, Human
ucuaguaaauauauauauauauauauguaa

SEQ ID NO: 536985 - RNA, 21 nt, Human
ucugaaugauaaaugucugug

SEQ ID NO: 536986 - RNA, 18 nt, Human
ucugcaauagaaaugcug

SEQ ID NO: 536987 - RNA, 25 nt, Human
ugaaaaaaaaaugccagauuuaaga

SEQ ID NO: 536988 - RNA, 20 nt, Human
ugaaaauagaggucugcaau

SEQ ID NO: 536989 - RNA, 26 nt, Human
ugaagcaggcaaguuucucaagguca

SEQ ID NO: 536990 - RNA, 21 nt, Human
ugaaucucauucugacucuga

SEQ ID NO: 536991 - RNA, 23 nt, Human
ugacagucauaauacacuuuagc

SEQ ID NO: 536992 - RNA, 18 nt, Human
ugagauuaauagcaugac

SEQ ID NO: 536993 - RNA, 21 nt, Human
ugagauuaauagcaugacccc

SEQ ID NO: 536994 - RNA, 21 nt, Human
ugccaaaaagaccuaaaaacc

SEQ ID NO: 536995 - RNA, 24 nt, Human
ugccaaaaagaccuaaaaaccuaa

SEQ ID NO: 536996 - RNA, 21 nt, Human
ugccauggcaagaaccaugcu

SEQ ID NO: 536997 - RNA, 18 nt, Human
ugccucuguaacaccccu

SEQ ID NO: 536998 - RNA, 22 nt, Human
uggaaacaaaauaaauauaaau

SEQ ID NO: 536999 - RNA, 20 nt, Human
ugggaaaaacaucacuacaa

SEQ ID NO: 537000 - RNA, 24 nt, Human
uguaaaagaaguaaaugccaaaaa

SEQ ID NO: 537001 - RNA, 21 nt, Human
uguauagaauccuguguggga

SEQ ID NO: 537002 - RNA, 23 nt, Human
uguguuauuuauuucuuuccuug

SEQ ID NO: 537003 - RNA, 22 nt, Human
uuaagcaccacaaaauuuugcc

SEQ ID NO: 537004 - RNA, 24 nt, Human
uuaagcaccacaaaauuuugccug

SEQ ID NO: 537005 - RNA, 20 nt, Human
uuagcaccauuuauuuagcc

SEQ ID NO: 537006 - RNA, 21 nt, Human
uuuagcaccauuuauuuagcc

SEQ ID NO: 537007 - RNA, 20 nt, Human
uuuuuuucauuuuucuguuc

SEQ ID NO: 537008 - RNA, 23 nt, Human
uuuuuuucauuuuucuguucucu

SEQ ID NO: 537009 - RNA, 25 nt, Human
aaaaacacaggaggauaccgguacc

SEQ ID NO: 537010 - RNA, 24 nt, Human
aaacucuccuucuggaucuaaaca

SEQ ID NO: 537011 - RNA, 19 nt, Human
aagcuuauuuuuucauucu

SEQ ID NO: 537012 - RNA, 20 nt, Human
aaugagaguacaauuuacaa

SEQ ID NO: 537013 - RNA, 20 nt, Human
acacaaguuauaaaaauaag

SEQ ID NO: 537014 - RNA, 23 nt, Human
acaucuucuuuacucuugauuau

SEQ ID NO: 537015 - RNA, 24 nt, Human
accauuaacaauauuacaccuaga

SEQ ID NO: 537016 - RNA, 18 nt, Human
acgugagguaucauuccc

SEQ ID NO: 537017 - RNA, 24 nt, Human
agaaauugguuuauguuuaaauaa

SEQ ID NO: 537018 - RNA, 21 nt, Human
agcaagcacugauagaggagu

SEQ ID NO: 537019 - RNA, 22 nt, Human
aguaagaucaucuauucagagu

SEQ ID NO: 537020 - RNA, 23 nt, Human
aguaaguuuguuucuuuuucuuc

SEQ ID NO: 537021 - RNA, 18 nt, Human
aucaucuauucagaguaa

SEQ ID NO: 537022 - RNA, 18 nt, Human
auuacuuaaaaacacauu

SEQ ID NO: 537023 - RNA, 20 nt, Human
auuuaugaagcuuauuuuuu

SEQ ID NO: 537024 - RNA, 23 nt, Human
caacugagacucccgaagaaguu

SEQ ID NO: 537025 - RNA, 23 nt, Human
cacaaucucauuuuagaaguaaa

SEQ ID NO: 537026 - RNA, 26 nt, Human
cagcaauccccacauuugcgaaacug

SEQ ID NO: 537027 - RNA, 21 nt, Human
caggaggauacgauuccaggu

SEQ ID NO: 537028 - RNA, 20 nt, Human
caguucaacuacggaaaguc

SEQ ID NO: 537029 - RNA, 19 nt, Human
caguuuuauacaaugaauc

SEQ ID NO: 537030 - RNA, 22 nt, Human
ccagacugcuguagggggccaa

SEQ ID NO: 537031 - RNA, 20 nt, Human
cccauacuggaugaguaaga

SEQ ID NO: 537032 - RNA, 19 nt, Human
cccgaagaaguuugucuuu

SEQ ID NO: 537033 - RNA, 21 nt, Human
cucagcguuuugauuccugug

SEQ ID NO: 537034 - RNA, 19 nt, Human
cugaaaaaacacaggagga

SEQ ID NO: 537035 - RNA, 19 nt, Human
gaaaucacagaugaaaguc

SEQ ID NO: 537036 - RNA, 20 nt, Human
gacuuaaaggaagacuaaca

SEQ ID NO: 537037 - RNA, 20 nt, Human
ggaaagucuugaaaucuuaa

SEQ ID NO: 537038 - RNA, 24 nt, Human
guaguuaagacuucaacaucuucu

SEQ ID NO: 537039 - RNA, 21 nt, Human
guuuuauacaaugaauccuaa

SEQ ID NO: 537040 - RNA, 21 nt, Human
uaaaaugcuaaaacucaagug

SEQ ID NO: 537041 - RNA, 19 nt, Human
uaaguucuaugacuuaaaa

SEQ ID NO: 537042 - RNA, 19 nt, Human
uaauauguggcacccccuu

SEQ ID NO: 537043 - RNA, 19 nt, Human
uacaaugaauccuaaucau

SEQ ID NO: 537044 - RNA, 20 nt, Human
uacauuuuugauaacucucc

SEQ ID NO: 537045 - RNA, 18 nt, Human
uacucuccauugauuuug

SEQ ID NO: 537046 - RNA, 24 nt, Human
uauaaacaauugccagucacaauc

SEQ ID NO: 537047 - RNA, 19 nt, Human
uauucagaguaacuaagca

SEQ ID NO: 537048 - RNA, 19 nt, Human
ucaggaaugguaaaaugcu

SEQ ID NO: 537049 - RNA, 24 nt, Human
ucauccaaaaggaaauuuauuaca

SEQ ID NO: 537050 - RNA, 18 nt, Human
uccaagaauggcaaagau

SEQ ID NO: 537051 - RNA, 20 nt, Human
uccaaggagucugaaaaaac

SEQ ID NO: 537052 - RNA, 22 nt, Human
ugagguaucauucccccauacu

SEQ ID NO: 537053 - RNA, 22 nt, Human
ugaguaagaucaucuauucaga

SEQ ID NO: 537054 - RNA, 19 nt, Human
ugcagauauugguuuguuu

SEQ ID NO: 537055 - RNA, 23 nt, Human
ugcuguagggggccaacugagag

SEQ ID NO: 537056 - RNA, 21 nt, Human
uggaauuuagaauuuugcauu

SEQ ID NO: 537057 - RNA, 22 nt, Human
uggcagggccagauugaauaau

SEQ ID NO: 537058 - RNA, 23 nt, Human
ugguaaaacaaaucauuuuggac

SEQ ID NO: 537059 - RNA, 18 nt, Human
ugguuuuagucugacuga

SEQ ID NO: 537060 - RNA, 26 nt, Human
ugucauaaauuccauguuucauggaa

SEQ ID NO: 537061 - RNA, 22 nt, Human
uuaaaacucuccuucuggaucu

SEQ ID NO: 537062 - RNA, 18 nt, Human
uuacacaaguuauaaaaa

SEQ ID NO: 537063 - RNA, 22 nt, Human
uucuauuuugguuucaaaauca

SEQ ID NO: 537064 - RNA, 23 nt, Human
uucucauacaucaguucuccauu

SEQ ID NO: 537065 - RNA, 19 nt, Human
uuguuucuuuuucuucugg

SEQ ID NO: 537066 - RNA, 18 nt, Human
aauuauaggaaaaguacu

SEQ ID NO: 537067 - RNA, 19 nt, Human
acagaucuguauguagccu

SEQ ID NO: 537068 - RNA, 26 nt, Human
auaggacaauagaaauugcaucaaag

SEQ ID NO: 537069 - RNA, 19 nt, Human
aucacaguguacaucagga

SEQ ID NO: 537070 - RNA, 18 nt, Human
caaagcaaugcugccuaa

SEQ ID NO: 537071 - RNA, 24 nt, Human
caaagcaaugcugccuaacagaca

SEQ ID NO: 537072 - RNA, 18 nt, Human
cagaacaccugcccagca

SEQ ID NO: 537073 - RNA, 20 nt, Human
cagaacaccugcccagcagc

SEQ ID NO: 537074 - RNA, 24 nt, Human
caggcaucacucagaggaaguccc

SEQ ID NO: 537075 - RNA, 23 nt, Human
cccgcgccuccucccggggcccu

SEQ ID NO: 537076 - RNA, 22 nt, Human
ccggcgcgcccgcgccuccucc

SEQ ID NO: 537077 - RNA, 23 nt, Human
ccuguagcagggaagaccggggc

SEQ ID NO: 537078 - RNA, 20 nt, Human
ccuguagcagggaagacuca

SEQ ID NO: 537079 - RNA, 18 nt, Human
cggaagucacacggagcc

SEQ ID NO: 537080 - RNA, 25 nt, Human
cugggaauggagaaaguugcaggcc

SEQ ID NO: 537081 - RNA, 19 nt, Human
gaacaccugcccagcagca

SEQ ID NO: 537082 - RNA, 20 nt, Human
gaagcggggggcgcugcggg

SEQ ID NO: 537083 - RNA, 21 nt, Human
gcccagcagcagugcauccuc

SEQ ID NO: 537084 - RNA, 18 nt, Human
uaguauauuuucucauua

SEQ ID NO: 537085 - RNA, 20 nt, Human
uccuguagcagggaagacuc

SEQ ID NO: 537086 - RNA, 18 nt, Human
ugcagagauaaggcuaca

SEQ ID NO: 537087 - RNA, 21 nt, Human
aaaacaaacaaacaaacaaac

SEQ ID NO: 537088 - RNA, 19 nt, Human
aaacaaaagaaaagaaaac

SEQ ID NO: 537089 - RNA, 21 nt, Human
aaacaaacaaacgaacgaaca

SEQ ID NO: 537090 - RNA, 24 nt, Human
aaagaaaaaauauccaaaauaagc

SEQ ID NO: 537091 - RNA, 23 nt, Human
aacaagaccccaucuuuaaaaac

SEQ ID NO: 537092 - RNA, 20 nt, Human
aaccugaagcagggggaaaa

SEQ ID NO: 537093 - RNA, 21 nt, Human
aaccugaagcagggggaaaaa

SEQ ID NO: 537094 - RNA, 21 nt, Human
aaguguggaaagcugaacgcc

SEQ ID NO: 537095 - RNA, 24 nt, Human
aaugugcugggauuacaggcauga

SEQ ID NO: 537096 - RNA, 22 nt, Human
acaaacaaacgaacgaacaaac

SEQ ID NO: 537097 - RNA, 21 nt, Human
acugcauuccagccuaggcaa

SEQ ID NO: 537098 - RNA, 23 nt, Human
agaaaagaaaacacacauauuag

SEQ ID NO: 537099 - RNA, 22 nt, Human
agaaaggaaaaaagagcucuag

SEQ ID NO: 537100 - RNA, 20 nt, Human
agcaaaucagcagaaaggaa

SEQ ID NO: 537101 - RNA, 23 nt, Human
aggaccagagacagccaaaaaca

SEQ ID NO: 537102 - RNA, 19 nt, Human
aggauggcuugaggccagg

SEQ ID NO: 537103 - RNA, 22 nt, Human
aggccugggauauggccugagc

SEQ ID NO: 537104 - RNA, 25 nt, Human
agucccaucuauuugggaggauggc

SEQ ID NO: 537105 - RNA, 22 nt, Human
augcacuguauuuccuuguuac

SEQ ID NO: 537106 - RNA, 24 nt, Human
auggagccuggacugcaucagcuu

SEQ ID NO: 537107 - RNA, 24 nt, Human
caaaaacaaaagaaaagaaaacac

SEQ ID NO: 537108 - RNA, 18 nt, Human
caaaaagaaaaaucacug

SEQ ID NO: 537109 - RNA, 19 nt, Human
caaaaagaaaaaucacuga

SEQ ID NO: 537110 - RNA, 24 nt, Human
caagaccccaucuuuaaaaacaaa

SEQ ID NO: 537111 - RNA, 22 nt, Human
caagugaucuucccaaugugcu

SEQ ID NO: 537112 - RNA, 24 nt, Human
caaugugcugggauuacaggcaug

SEQ ID NO: 537113 - RNA, 19 nt, Human
cacugcauuccagccuagg

SEQ ID NO: 537114 - RNA, 21 nt, Human
cacugcauuccagccuaggca

SEQ ID NO: 537115 - RNA, 22 nt, Human
cacugcauuccagccuaggcaa

SEQ ID NO: 537116 - RNA, 23 nt, Human
cacugcauuccagccuaggcaau

SEQ ID NO: 537117 - RNA, 27 nt, Human
cacugcauuccagccuaggcaauauaa

SEQ ID NO: 537118 - RNA, 20 nt, Human
cagaguacuggaauguuguc

SEQ ID NO: 537119 - RNA, 18 nt, Human
cagccaaaaacaaaagaa

SEQ ID NO: 537120 - RNA, 26 nt, Human
cagugcccgggggcugagcggccggg

SEQ ID NO: 537121 - RNA, 25 nt, Human
caucuuuaaaaacaaacaaacaaac

SEQ ID NO: 537122 - RNA, 26 nt, Human
caucuuuaaaaacaaacaaacaaacc

SEQ ID NO: 537123 - RNA, 24 nt, Human
caugagccaccaugcccagccuau

SEQ ID NO: 537124 - RNA, 27 nt, Human
ccaaaaacaaaagaaaagaaaacacaa

SEQ ID NO: 537125 - RNA, 25 nt, Human
ccaaugccugugacccgucaccaaa

SEQ ID NO: 537126 - RNA, 19 nt, Human
ccaaugugcugggauuaca

SEQ ID NO: 537127 - RNA, 24 nt, Human
ccaaugugcugggauuacaggcau

SEQ ID NO: 537128 - RNA, 21 nt, Human
ccaccaugcccagccuauguc

SEQ ID NO: 537129 - RNA, 19 nt, Human
ccacugcauuccagccuag

SEQ ID NO: 537130 - RNA, 20 nt, Human
ccacugcauuccagccuagg

SEQ ID NO: 537131 - RNA, 20 nt, Human
ccacugcauuccagccuagg

SEQ ID NO: 537132 - RNA, 21 nt, Human
ccacugcauuccagccuaggc

SEQ ID NO: 537133 - RNA, 24 nt, Human
ccacugcauuccagccuaggcaau

SEQ ID NO: 537134 - RNA, 27 nt, Human
ccagagacagccaaaaacaaaagaaaa

SEQ ID NO: 537135 - RNA, 24 nt, Human
cccaaugugcugggauuacaggca

SEQ ID NO: 537136 - RNA, 19 nt, Human
ccccacagcagugcccggg

SEQ ID NO: 537137 - RNA, 23 nt, Human
ccccacagcagugcccgggggcu

SEQ ID NO: 537138 - RNA, 22 nt, Human
cccuuggaugaaucaaaauaca

SEQ ID NO: 537139 - RNA, 24 nt, Human
ccgccggcagccacagcuuccucc

SEQ ID NO: 537140 - RNA, 21 nt, Human
ccggcagccacagcuuccucc

SEQ ID NO: 537141 - RNA, 28 nt, Human
ccugugaauaaccacugcauuccagccu

SEQ ID NO: 537142 - RNA, 21 nt, Human
ccuuggguuuuaacaagccuu

SEQ ID NO: 537143 - RNA, 24 nt, Human
cgcccgggaccucuggccggaagc

SEQ ID NO: 537144 - RNA, 22 nt, Human
cuaaagcuagaccagugguuuu

SEQ ID NO: 537145 - RNA, 25 nt, Human
cuaaugaacucucuaaugauccucu

SEQ ID NO: 537146 - RNA, 23 nt, Human
cuaaugauccucucacccuuucu

SEQ ID NO: 537147 - RNA, 25 nt, Human
cucaaacuccuugccucaagugauc

SEQ ID NO: 537148 - RNA, 23 nt, Human
cucaagugaucuucccaaugugc

SEQ ID NO: 537149 - RNA, 25 nt, Human
cugagcuacuacaaaaagaaaaauc

SEQ ID NO: 537150 - RNA, 18 nt, Human
cuguauguucucccccau

SEQ ID NO: 537151 - RNA, 22 nt, Human
cugugguugguucaguuuucaa

SEQ ID NO: 537152 - RNA, 20 nt, Human
cuucaaaacuaccaaugccu

SEQ ID NO: 537153 - RNA, 25 nt, Human
cuugaaucaaggaccagagacagcc

SEQ ID NO: 537154 - RNA, 25 nt, Human
gacagccaaaaacaaaagaaaagaa

SEQ ID NO: 537155 - RNA, 21 nt, Human
gaccagagacagccaaaaaca

SEQ ID NO: 537156 - RNA, 24 nt, Human
gagccaccaugcccagccuauguc

SEQ ID NO: 537157 - RNA, 18 nt, Human
gauuacaggcaugagcca

SEQ ID NO: 537158 - RNA, 21 nt, Human
gauuacaggcaugagccacca

SEQ ID NO: 537159 - RNA, 24 nt, Human
gauuacaggcaugagccaccaugc

SEQ ID NO: 537160 - RNA, 23 nt, Human
gccaggaguuagagagaguagug

SEQ ID NO: 537161 - RNA, 22 nt, Human
gcggcuugcuuugccccaagug

SEQ ID NO: 537162 - RNA, 27 nt, Human
ggaccagagacagccaaaaacaaaaga

SEQ ID NO: 537163 - RNA, 23 nt, Human
ggaccucuggccggaagcagucc

SEQ ID NO: 537164 - RNA, 21 nt, Human
ggagagcuucaaaacuaccaa

SEQ ID NO: 537165 - RNA, 24 nt, Human
ggauuacaggcaugagccaccaug

SEQ ID NO: 537166 - RNA, 25 nt, Human
ggcacgcugggcuguauguucuccc

SEQ ID NO: 537167 - RNA, 18 nt, Human
gggccuagcagccuuggg

SEQ ID NO: 537168 - RNA, 22 nt, Human
ggggucucgcuguguuggccag

SEQ ID NO: 537169 - RNA, 24 nt, Human
ggggugggccuagcagccuugggu

SEQ ID NO: 537170 - RNA, 24 nt, Human
gggugggccuagcagccuuggguu

SEQ ID NO: 537171 - RNA, 21 nt, Human
ggugggccuagcagccuuggg

SEQ ID NO: 537172 - RNA, 24 nt, Human
guaagcuaaauuuggaagccccug

SEQ ID NO: 537173 - RNA, 18 nt, Human
gugcugggauuacaggca

SEQ ID NO: 537174 - RNA, 21 nt, Human
gugcugggauuacaggcauga

SEQ ID NO: 537175 - RNA, 21 nt, Human
gugcuuccagcaaaucagcag

SEQ ID NO: 537176 - RNA, 22 nt, Human
guggaaagcugaacgccccaca

SEQ ID NO: 537177 - RNA, 18 nt, Human
guggaagcaacauuuucu

SEQ ID NO: 537178 - RNA, 19 nt, Human
uaaauuggcucaauauccu

SEQ ID NO: 537179 - RNA, 24 nt, Human
uaaccacugcauuccagccuaggc

SEQ ID NO: 537180 - RNA, 23 nt, Human
uacaaaaagaaaaaucacugaau

SEQ ID NO: 537181 - RNA, 24 nt, Human
uacaggcaugagccaccaugccca

SEQ ID NO: 537182 - RNA, 22 nt, Human
uacucucuaaugaacucucuaa

SEQ ID NO: 537183 - RNA, 25 nt, Human
uagaaaugcaaauuuuuggguccca

SEQ ID NO: 537184 - RNA, 21 nt, Human
uaggcaauauaacaagacccc

SEQ ID NO: 537185 - RNA, 22 nt, Human
uaggcaauauaacaagacccca

SEQ ID NO: 537186 - RNA, 18 nt, Human
uaggccugggauauggcc

SEQ ID NO: 537187 - RNA, 24 nt, Human
uauaacaagaccccaucuuuaaaa

SEQ ID NO: 537188 - RNA, 24 nt, Human
uauaacaagaccccaucuuuaaaa

SEQ ID NO: 537189 - RNA, 18 nt, Human
uauuaggaauaaauacuc

SEQ ID NO: 537190 - RNA, 20 nt, Human
uauuaggaauaaauacucuc

SEQ ID NO: 537191 - RNA, 18 nt, Human
ucaaagaaguuuccuggc

SEQ ID NO: 537192 - RNA, 24 nt, Human
ucagauggccagcuaaagagagaa

SEQ ID NO: 537193 - RNA, 24 nt, Human
ucccaaugugcugggauuacaggc

SEQ ID NO: 537194 - RNA, 21 nt, Human
ucccaccgccggcagccacag

SEQ ID NO: 537195 - RNA, 25 nt, Human
ucgcuguguuggccagucuggucuc

SEQ ID NO: 537196 - RNA, 21 nt, Human
ucuagaguaagaacaguugau

SEQ ID NO: 537197 - RNA, 23 nt, Human
ucucgcuguguuggccagucugg

SEQ ID NO: 537198 - RNA, 21 nt, Human
ugaaacuucuaaaaaugaaac

SEQ ID NO: 537199 - RNA, 27 nt, Human
ugacugagcuacuacaaaaagaaaaau

SEQ ID NO: 537200 - RNA, 20 nt, Human
ugagauacacuuacuggaaa

SEQ ID NO: 537201 - RNA, 23 nt, Human
ugagauacacuuacuggaaagaa

SEQ ID NO: 537202 - RNA, 18 nt, Human
ugcccgggggcugagcgg

SEQ ID NO: 537203 - RNA, 24 nt, Human
ugcuguuaccuguuuugacugagc

SEQ ID NO: 537204 - RNA, 18 nt, Human
ugcuuccagcaaaucagc

SEQ ID NO: 537205 - RNA, 23 nt, Human
uggaaagaagcuggacccaggcc

SEQ ID NO: 537206 - RNA, 25 nt, Human
uggaaagaagcuggacccaggccca

SEQ ID NO: 537207 - RNA, 19 nt, Human
uggagccuggacugcauca

SEQ ID NO: 537208 - RNA, 24 nt, Human
uggccagucuggucucaaacuccu

SEQ ID NO: 537209 - RNA, 18 nt, Human
ugggauuacaggcaugag

SEQ ID NO: 537210 - RNA, 22 nt, Human
ugggauuacaggcaugagccac

SEQ ID NO: 537211 - RNA, 23 nt, Human
ugggauuacaggcaugagccacc

SEQ ID NO: 537212 - RNA, 24 nt, Human
ugggauuacaggcaugagccacca

SEQ ID NO: 537213 - RNA, 25 nt, Human
ugggauuacaggcaugagccaccau

SEQ ID NO: 537214 - RNA, 24 nt, Human
ugggggucucgcuguguuggccag

SEQ ID NO: 537215 - RNA, 21 nt, Human
uggguuucugaaauauccaaa

SEQ ID NO: 537216 - RNA, 24 nt, Human
ugguuuucaaagcauggagccugg

SEQ ID NO: 537217 - RNA, 24 nt, Human
uguguuggccagucuggucucaaa

SEQ ID NO: 537218 - RNA, 19 nt, Human
uguuaccuguuuugacuga

SEQ ID NO: 537219 - RNA, 19 nt, Human
uguuggccagucuggucuc

SEQ ID NO: 537220 - RNA, 24 nt, Human
uucuaugauuaaucugcuguuacc

SEQ ID NO: 537221 - RNA, 23 nt, Human
uugguucaguuuucaaauuuguc

SEQ ID NO: 537222 - RNA, 23 nt, Human
uuuaacaagccuuccaagugauu

SEQ ID NO: 537223 - RNA, 22 nt, Human
uuuaauaggccugggauauggc

SEQ ID NO: 537224 - RNA, 22 nt, Human
uuuggaagccccugagauacac

SEQ ID NO: 537225 - RNA, 20 nt, Human
uuuucugaaauaaauuccug

SEQ ID NO: 537226 - RNA, 21 nt, Human
uuuuuuuuuuagagauggggg

SEQ ID NO: 537227 - RNA, 27 nt, Human
uuuuuuuuuuuuagagaugggggucuc

SEQ ID NO: 537228 - RNA, 24 nt, Human
uuuuuuuuuuuuuuagagaugggg

SEQ ID NO: 537229 - RNA, 18 nt, Human
uuuuuuuuuuuuuuuuug

SEQ ID NO: 537230 - RNA, 22 nt, Human
aaaagagcacagcgaaauccua

SEQ ID NO: 537231 - RNA, 23 nt, Human
aaaccaggugcuuggguagcaaa

SEQ ID NO: 537232 - RNA, 24 nt, Human
aaagaaacccaguaaaugcucaag

SEQ ID NO: 537233 - RNA, 20 nt, Human
aaaucucaaccccagccucc

SEQ ID NO: 537234 - RNA, 18 nt, Human
aagaugguggaaacaguc

SEQ ID NO: 537235 - RNA, 23 nt, Human
aaucaaaagagcacagcgaaauc

SEQ ID NO: 537236 - RNA, 21 nt, Human
aauguccacgucauucucugc

SEQ ID NO: 537237 - RNA, 21 nt, Human
acauggauuucuaagagacca

SEQ ID NO: 537238 - RNA, 25 nt, Human
accaccuucuccuccaucccucucc

SEQ ID NO: 537239 - RNA, 20 nt, Human
acccaugagauaccaauagc

SEQ ID NO: 537240 - RNA, 18 nt, Human
agaaaaugacaacagcag

SEQ ID NO: 537241 - RNA, 23 nt, Human
agaaagacagccagugagacaga

SEQ ID NO: 537242 - RNA, 21 nt, Human
agaaucagagauaggauggcc

SEQ ID NO: 537243 - RNA, 28 nt, Human
agauaccaauagcaguccccaccaagcu

SEQ ID NO: 537244 - RNA, 20 nt, Human
agcacaacccaccucggggc

SEQ ID NO: 537245 - RNA, 23 nt, Human
agcgggccgauggcagcugcagg

SEQ ID NO: 537246 - RNA, 18 nt, Human
aggcaggaaaucagcuug

SEQ ID NO: 537247 - RNA, 21 nt, Human
agggugccucuagagcugaca

SEQ ID NO: 537248 - RNA, 18 nt, Human
agucuggggguccccaca

SEQ ID NO: 537249 - RNA, 24 nt, Human
auaguaagguuucugcaaaagauu

SEQ ID NO: 537250 - RNA, 23 nt, Human
auauagagcccuugucagaacca

SEQ ID NO: 537251 - RNA, 27 nt, Human
augacaacagcagcaacgcuaacaaag

SEQ ID NO: 537252 - RNA, 25 nt, Human
caaaaagaaacccaguaaaugcuca

SEQ ID NO: 537253 - RNA, 21 nt, Human
caaaccuccucuuggggaggc

SEQ ID NO: 537254 - RNA, 19 nt, Human
caaccucacaaagcaguaa

SEQ ID NO: 537255 - RNA, 23 nt, Human
caacgugcuggaccacggacccc

SEQ ID NO: 537256 - RNA, 19 nt, Human
caagccucucagagauuca

SEQ ID NO: 537257 - RNA, 22 nt, Human
cacaaccucacaaagcaguaag

SEQ ID NO: 537258 - RNA, 24 nt, Human
cacaaguccucuuaagacaggccu

SEQ ID NO: 537259 - RNA, 18 nt, Human
cacacggccucagcugcu

SEQ ID NO: 537260 - RNA, 26 nt, Human
caccccauuccuaagcucuuccccaa

SEQ ID NO: 537261 - RNA, 21 nt, Human
cagaauccccggggaccgcac

SEQ ID NO: 537262 - RNA, 18 nt, Human
cagagauucauuuuccuc

SEQ ID NO: 537263 - RNA, 23 nt, Human
cagccuccgaggccucauauccc

SEQ ID NO: 537264 - RNA, 20 nt, Human
cagcucagcccaacccuggc

SEQ ID NO: 537265 - RNA, 21 nt, Human
caggaccaaaucucaaccccg

SEQ ID NO: 537266 - RNA, 21 nt, Human
caggggccuguggagugggcc

SEQ ID NO: 537267 - RNA, 28 nt, Human
cauaucccgagaugguccaucccagggg

SEQ ID NO: 537268 - RNA, 21 nt, Human
cauccagaauccccggggacc

SEQ ID NO: 537269 - RNA, 19 nt, Human
cauggugaaaccaggugcu

SEQ ID NO: 537270 - RNA, 20 nt, Human
cauucaggaucuggcuguuc

SEQ ID NO: 537271 - RNA, 24 nt, Human
ccaaggcagaauggggcucaaacc

SEQ ID NO: 537272 - RNA, 23 nt, Human
ccacacggccucagcugcucucc

SEQ ID NO: 537273 - RNA, 24 nt, Human
cccaacccuggcacuugcucgggg

SEQ ID NO: 537274 - RNA, 28 nt, Human
cccagcagucccaugcccaccccauucc

SEQ ID NO: 537275 - RNA, 19 nt, Human
cccaugcccaccccauucc

SEQ ID NO: 537276 - RNA, 18 nt, Human
ccccacacucccauccac

SEQ ID NO: 537277 - RNA, 19 nt, Human
ccccggggaccgcaccacc

SEQ ID NO: 537278 - RNA, 19 nt, Human
cccuggaggucccagagac

SEQ ID NO: 537279 - RNA, 21 nt, Human
ccgccugccccuuuccuggac

SEQ ID NO: 537280 - RNA, 25 nt, Human
ccucuggguucucaguacucaguuc

SEQ ID NO: 537281 - RNA, 20 nt, Human
ccucuuaagacaggccuggc

SEQ ID NO: 537282 - RNA, 23 nt, Human
ccucuuccucaaaaagaaaccca

SEQ ID NO: 537283 - RNA, 23 nt, Human
ccucuuggggaggcaggaaauca

SEQ ID NO: 537284 - RNA, 23 nt, Human
ccugaccucggcacuauuggccg

SEQ ID NO: 537285 - RNA, 20 nt, Human
ccugcaaauucccugcaaau

SEQ ID NO: 537286 - RNA, 21 nt, Human
ccuggcacuugcucggggaca

SEQ ID NO: 537287 - RNA, 18 nt, Human
ccugggcucaagaccccu

SEQ ID NO: 537288 - RNA, 22 nt, Human
ccuucugccagcauauagagcc

SEQ ID NO: 537289 - RNA, 19 nt, Human
cgacuggccucaugaaagc

SEQ ID NO: 537290 - RNA, 21 nt, Human
cgcauggugaaaccaggugcu

SEQ ID NO: 537291 - RNA, 22 nt, Human
cgcauggugaaaccaggugcuu

SEQ ID NO: 537292 - RNA, 22 nt, Human
cggaccccugggccaggagccc

SEQ ID NO: 537293 - RNA, 23 nt, Human
cggucaaaagaccagcauccaga

SEQ ID NO: 537294 - RNA, 22 nt, Human
cgugcuggaccacggaccccug

SEQ ID NO: 537295 - RNA, 21 nt, Human
cucaaccccagccuccgaggc

SEQ ID NO: 537296 - RNA, 19 nt, Human
cucagcccaacccuggcac

SEQ ID NO: 537297 - RNA, 22 nt, Human
cuccagacauugcugauggccc

SEQ ID NO: 537298 - RNA, 21 nt, Human
cucccugagcagaacucccug

SEQ ID NO: 537299 - RNA, 19 nt, Human
cuccgugagugaccauggu

SEQ ID NO: 537300 - RNA, 18 nt, Human
cucuucucaaagaccuuc

SEQ ID NO: 537301 - RNA, 27 nt, Human
cugcuacccagcagucccaugcccacc

SEQ ID NO: 537302 - RNA, 28 nt, Human
cuggcuacagcagcgucuggccucuucu

SEQ ID NO: 537303 - RNA, 20 nt, Human
cugggaguugcagaucacug

SEQ ID NO: 537304 - RNA, 22 nt, Human
cuuacauuuacaaguugaucau

SEQ ID NO: 537305 - RNA, 20 nt, Human
gaaagacagccagugagaca

SEQ ID NO: 537306 - RNA, 19 nt, Human
gaagcugugggcucugucc

SEQ ID NO: 537307 - RNA, 19 nt, Human
gaccagcauccagaauccc

SEQ ID NO: 537308 - RNA, 20 nt, Human
gaccauggucaggggccugg

SEQ ID NO: 537309 - RNA, 21 nt, Human
gacucagaacacaucauacac

SEQ ID NO: 537310 - RNA, 19 nt, Human
gagcagaacucccugggcc

SEQ ID NO: 537311 - RNA, 19 nt, Human
gauacaggggacacagggg

SEQ ID NO: 537312 - RNA, 19 nt, Human
gauuagaugcucucuaaag

SEQ ID NO: 537313 - RNA, 19 nt, Human
gcagaugacagccuugcca

SEQ ID NO: 537314 - RNA, 19 nt, Human
gcagccucuccgaggacca

SEQ ID NO: 537315 - RNA, 22 nt, Human
gcaugaagaauugguaucugga

SEQ ID NO: 537316 - RNA, 20 nt, Human
gccacggucaaaagaccagc

SEQ ID NO: 537317 - RNA, 23 nt, Human
gccacucacaaccucacaaagca

SEQ ID NO: 537318 - RNA, 23 nt, Human
gccaggguggguggggcuggggc

SEQ ID NO: 537319 - RNA, 20 nt, Human
gcuugaaaaagggacccaag

SEQ ID NO: 537320 - RNA, 20 nt, Human
gcuuggaagcugugggcucu

SEQ ID NO: 537321 - RNA, 20 nt, Human
ggaacugauaaaucccuggu

SEQ ID NO: 537322 - RNA, 23 nt, Human
ggaccccugggccaggagcccag

SEQ ID NO: 537323 - RNA, 19 nt, Human
ggaggcaggaaaucagcuu

SEQ ID NO: 537324 - RNA, 18 nt, Human
ggaucacccuggugggca

SEQ ID NO: 537325 - RNA, 19 nt, Human
ggcaucccuggccuccacc

SEQ ID NO: 537326 - RNA, 22 nt, Human
ggcuggggcagguaaucccggg

SEQ ID NO: 537327 - RNA, 24 nt, Human
gggaggcaggaaaucagcuugaaa

SEQ ID NO: 537328 - RNA, 22 nt, Human
gggccaggguggguggggcugg

SEQ ID NO: 537329 - RNA, 19 nt, Human
gggcuggggcaggugaaca

SEQ ID NO: 537330 - RNA, 19 nt, Human
ggugaaaccaggugcuugg

SEQ ID NO: 537331 - RNA, 24 nt, Human
gguuauccagauuuuucagagagg

SEQ ID NO: 537332 - RNA, 21 nt, Human
gucagcucuccacuaauuuuc

SEQ ID NO: 537333 - RNA, 21 nt, Human
guccugggcucaagaccccug

SEQ ID NO: 537334 - RNA, 21 nt, Human
gugcacugccgccugccccuu

SEQ ID NO: 537335 - RNA, 21 nt, Human
guggaaugggcucugauuccc

SEQ ID NO: 537336 - RNA, 18 nt, Human
gugguucuuuaagaaacu

SEQ ID NO: 537337 - RNA, 24 nt, Human
uaaagaauauuaguaugccuucaa

SEQ ID NO: 537338 - RNA, 22 nt, Human
uaacaaagugagauuucacaga

SEQ ID NO: 537339 - RNA, 22 nt, Human
uaagacacaaaaacauuuccga

SEQ ID NO: 537340 - RNA, 22 nt, Human
uacccagcagucccaugcccac

SEQ ID NO: 537341 - RNA, 21 nt, Human
uagaaaaugacaacagcagca

SEQ ID NO: 537342 - RNA, 19 nt, Human
uagaacauucaggaucugg

SEQ ID NO: 537343 - RNA, 23 nt, Human
uagcagcucagcccaacccuggc

SEQ ID NO: 537344 - RNA, 20 nt, Human
ucaggaccaaaucucaaccc

SEQ ID NO: 537345 - RNA, 20 nt, Human
ucaguacucaguucaaccac

SEQ ID NO: 537346 - RNA, 24 nt, Human
ucauguuuucuucuuuucucuuuu

SEQ ID NO: 537347 - RNA, 20 nt, Human
uccacagaaaaaugcgacag

SEQ ID NO: 537348 - RNA, 22 nt, Human
uccacuuuguagggcuuucucc

SEQ ID NO: 537349 - RNA, 19 nt, Human
ucccagggggaucacccug

SEQ ID NO: 537350 - RNA, 19 nt, Human
uccccacaaaugcccaaga

SEQ ID NO: 537351 - RNA, 22 nt, Human
ucccucuuccucaaaaagaaac

SEQ ID NO: 537352 - RNA, 18 nt, Human
ucccugagcagaacuccc

SEQ ID NO: 537353 - RNA, 22 nt, Human
ucccugagcagaacucccuggg

SEQ ID NO: 537354 - RNA, 23 nt, Human
ucccugagcagaacucccugggc

SEQ ID NO: 537355 - RNA, 19 nt, Human
ucccuggaggucccagaga

SEQ ID NO: 537356 - RNA, 23 nt, Human
ucccuggaggucccagagacaca

SEQ ID NO: 537357 - RNA, 27 nt, Human
uccgugagugaccauggucaggggccu

SEQ ID NO: 537358 - RNA, 19 nt, Human
uccuccaucccucuccgug

SEQ ID NO: 537359 - RNA, 23 nt, Human
ucgauaguuaguuguccugggcu

SEQ ID NO: 537360 - RNA, 24 nt, Human
ucucgauuagaugcucucuaaagc

SEQ ID NO: 537361 - RNA, 18 nt, Human
ucugcucuuuucuaucuu

SEQ ID NO: 537362 - RNA, 23 nt, Human
ucuuuuaagguuagauauuuuua

SEQ ID NO: 537363 - RNA, 18 nt, Human
ugaaaccaggugcuuggg

SEQ ID NO: 537364 - RNA, 22 nt, Human
ugaacgcacaacgugcuggacc

SEQ ID NO: 537365 - RNA, 22 nt, Human
ugaagucaacugcuuacauuua

SEQ ID NO: 537366 - RNA, 26 nt, Human
ugacaacagcagcaacgcuaacaaag

SEQ ID NO: 537367 - RNA, 20 nt, Human
ugacagccuugccaaauguc

SEQ ID NO: 537368 - RNA, 21 nt, Human
ugaccucggcacuauuggcau

SEQ ID NO: 537369 - RNA, 22 nt, Human
ugagauaccaauagcagucccc

SEQ ID NO: 537370 - RNA, 20 nt, Human
ugcccugugcauuguaggau

SEQ ID NO: 537371 - RNA, 18 nt, Human
ugccugggucccuggaag

SEQ ID NO: 537372 - RNA, 19 nt, Human
ugccugggucccuggaagc

SEQ ID NO: 537373 - RNA, 21 nt, Human
ugcuacccagcagucccaugc

SEQ ID NO: 537374 - RNA, 25 nt, Human
uggaagcacaaguccucuuaagaca

SEQ ID NO: 537375 - RNA, 19 nt, Human
uggaaugggcucugauucc

SEQ ID NO: 537376 - RNA, 21 nt, Human
uggagugggccagggugggug

SEQ ID NO: 537377 - RNA, 21 nt, Human
uggauuucuaagagaccacau

SEQ ID NO: 537378 - RNA, 23 nt, Human
uggcagaaauaggacugggcacg

SEQ ID NO: 537379 - RNA, 19 nt, Human
uggcagcugcagggagcac

SEQ ID NO: 537380 - RNA, 18 nt, Human
uggcaguaacuguuuucu

SEQ ID NO: 537381 - RNA, 20 nt, Human
uggcaguaacuguuuucucg

SEQ ID NO: 537382 - RNA, 24 nt, Human
uggcaguaacuguuuucucgcucc

SEQ ID NO: 537383 - RNA, 22 nt, Human
uggcucccugagcagaacuccc

SEQ ID NO: 537384 - RNA, 18 nt, Human
ugggcacguggaaaaagg

SEQ ID NO: 537385 - RNA, 23 nt, Human
uggggcucaaaccuccucuuggg

SEQ ID NO: 537386 - RNA, 21 nt, Human
uggggggcugcccugugcauu

SEQ ID NO: 537387 - RNA, 23 nt, Human
ugggucccuggaagcacaagucc

SEQ ID NO: 537388 - RNA, 19 nt, Human
uggguggggcuggggcagg

SEQ ID NO: 537389 - RNA, 20 nt, Human
uggguggggcuggggcaggu

SEQ ID NO: 537390 - RNA, 20 nt, Human
ugguaucuggagaguagcaa

SEQ ID NO: 537391 - RNA, 24 nt, Human
uggucaggggccuguggagugggc

SEQ ID NO: 537392 - RNA, 21 nt, Human
ugguggaaacagucacaugga

SEQ ID NO: 537393 - RNA, 22 nt, Human
uguccucuggguucucaguacu

SEQ ID NO: 537394 - RNA, 26 nt, Human
uguggaaugggcucugauucccccaa

SEQ ID NO: 537395 - RNA, 19 nt, Human
uguggagugggccagggug

SEQ ID NO: 537396 - RNA, 26 nt, Human
uuaaaggucucgauuagaugcucucu

SEQ ID NO: 537397 - RNA, 23 nt, Human
uuaagaaagagucuucacuguag

SEQ ID NO: 537398 - RNA, 19 nt, Human
uuaauuuacucaaugacuc

SEQ ID NO: 537399 - RNA, 19 nt, Human
uucaaccaccuucuccucc

SEQ ID NO: 537400 - RNA, 23 nt, Human
uucagccccacacucccauccac

SEQ ID NO: 537401 - RNA, 22 nt, Human
uucccuuuggcucccugagcag

SEQ ID NO: 537402 - RNA, 18 nt, Human
uugcucaaaggcugcuac

SEQ ID NO: 537403 - RNA, 22 nt, Human
uuggaagcugugggcucugucc

SEQ ID NO: 537404 - RNA, 26 nt, Human
uuuaaucaaaagagcacagcgaaauc

SEQ ID NO: 537405 - RNA, 23 nt, Human
uuucagagaggucccuuuuccug

SEQ ID NO: 537406 - RNA, 23 nt, Human
aaaacaaaaacucuuacaacccu

SEQ ID NO: 537407 - RNA, 20 nt, Human
aaacaaaaacucuuacaacc

SEQ ID NO: 537408 - RNA, 26 nt, Human
aaauagcugcauguacgaaaccucuu

SEQ ID NO: 537409 - RNA, 18 nt, Human
aagaagaagagauuggaa

SEQ ID NO: 537410 - RNA, 20 nt, Human
aagaagagauuggaauggcu

SEQ ID NO: 537411 - RNA, 22 nt, Human
aagcagucugaugacccauggc

SEQ ID NO: 537412 - RNA, 23 nt, Human
aagcuuggccgugugagugcccc

SEQ ID NO: 537413 - RNA, 19 nt, Human
aauacagcuaaugaagugg

SEQ ID NO: 537414 - RNA, 23 nt, Human
aaugcgugauuaaaaacaaaaac

SEQ ID NO: 537415 - RNA, 21 nt, Human
acaauuacucagcaaacaaga

SEQ ID NO: 537416 - RNA, 19 nt, Human
acccauggcaggccgauca

SEQ ID NO: 537417 - RNA, 21 nt, Human
acucucauuuuuacuuauagu

SEQ ID NO: 537418 - RNA, 23 nt, Human
acugguggaagagcagggaaggg

SEQ ID NO: 537419 - RNA, 24 nt, Human
agaagcacccagccuuccuaaagg

SEQ ID NO: 537420 - RNA, 21 nt, Human
agacucuaccaaaugcgugau

SEQ ID NO: 537421 - RNA, 21 nt, Human
agcaagaagcacccagccuuc

SEQ ID NO: 537422 - RNA, 19 nt, Human
agcagggaagggcccuugu

SEQ ID NO: 537423 - RNA, 21 nt, Human
agcagggaagggcccuuguug

SEQ ID NO: 537424 - RNA, 18 nt, Human
agcugcauguacgaaacc

SEQ ID NO: 537425 - RNA, 21 nt, Human
aggcagaagaguggaaaucug

SEQ ID NO: 537426 - RNA, 22 nt, Human
aggcagaagaguggaaaucuga

SEQ ID NO: 537427 - RNA, 22 nt, Human
agugguggcagaagcuuggccg

SEQ ID NO: 537428 - RNA, 20 nt, Human
caacguaagagucaucuccc

SEQ ID NO: 537429 - RNA, 18 nt, Human
caaggccaccauccccuu

SEQ ID NO: 537430 - RNA, 19 nt, Human
cacccagccuuccuaaagg

SEQ ID NO: 537431 - RNA, 22 nt, Human
cagaaguucacagcgucuugga

SEQ ID NO: 537432 - RNA, 20 nt, Human
cagagacauuagaaacaauu

SEQ ID NO: 537433 - RNA, 18 nt, Human
cagcgcguggggucugac

SEQ ID NO: 537434 - RNA, 24 nt, Human
caggguaaaagucucucuucuguc

SEQ ID NO: 537435 - RNA, 22 nt, Human
cauacuauggagaauacagcua

SEQ ID NO: 537436 - RNA, 21 nt, Human
cauuagaaacaauuacucagc

SEQ ID NO: 537437 - RNA, 21 nt, Human
cauuagaaacaauuacucagc

SEQ ID NO: 537438 - RNA, 22 nt, Human
cauuagaaacaauuacucagca

SEQ ID NO: 537439 - RNA, 27 nt, Human
ccaaagauguggccagugaggugccag

SEQ ID NO: 537440 - RNA, 26 nt, Human
ccacccaguugacuucuuaaucacac

SEQ ID NO: 537441 - RNA, 18 nt, Human
ccaguagguaaggaggug

SEQ ID NO: 537442 - RNA, 26 nt, Human
ccccagacuggcugucagagcaagaa

SEQ ID NO: 537443 - RNA, 19 nt, Human
cccccguggacagcagccu

SEQ ID NO: 537444 - RNA, 21 nt, Human
ccuaaaggcagaagaguggaa

SEQ ID NO: 537445 - RNA, 20 nt, Human
ccuggacuggggagcuggga

SEQ ID NO: 537446 - RNA, 25 nt, Human
cgugauuaaaaacaaaaacucuuac

SEQ ID NO: 537447 - RNA, 21 nt, Human
cucaguuucucucaauuuagg

SEQ ID NO: 537448 - RNA, 27 nt, Human
cucuccccagucagggcucuuucuggg

SEQ ID NO: 537449 - RNA, 21 nt, Human
cugaugagaggccaggagccu

SEQ ID NO: 537450 - RNA, 24 nt, Human
cugccaccaagacucaagcaacgu

SEQ ID NO: 537451 - RNA, 23 nt, Human
cuggaaugagcccuuugggagcc

SEQ ID NO: 537452 - RNA, 23 nt, Human
cuggggucaggccaggaaggggc

SEQ ID NO: 537453 - RNA, 21 nt, Human
gcagauccugaugagaggcca

SEQ ID NO: 537454 - RNA, 18 nt, Human
gccaccaagacucaagca

SEQ ID NO: 537455 - RNA, 21 nt, Human
gccaccaagacucaagcaacg

SEQ ID NO: 537456 - RNA, 18 nt, Human
gccaggcacugcgucugg

SEQ ID NO: 537457 - RNA, 22 nt, Human
ggagugaggucaggucacguga

SEQ ID NO: 537458 - RNA, 24 nt, Human
ggcaggccgaucaaggcaguugcc

SEQ ID NO: 537459 - RNA, 20 nt, Human
ggccaccauccccuuccaaa

SEQ ID NO: 537460 - RNA, 19 nt, Human
ggcggcggcggggagcccg

SEQ ID NO: 537461 - RNA, 22 nt, Human
ggggcgcacggggcggcggcgg

SEQ ID NO: 537462 - RNA, 19 nt, Human
gggucucuggggggcagau

SEQ ID NO: 537463 - RNA, 19 nt, Human
gguggcagaagcuuggccg

SEQ ID NO: 537464 - RNA, 23 nt, Human
gucugggggggucucuggggggc

SEQ ID NO: 537465 - RNA, 19 nt, Human
gugcacugacguacacgua

SEQ ID NO: 537466 - RNA, 23 nt, Human
gugcuuuggugguguaaggaacu

SEQ ID NO: 537467 - RNA, 20 nt, Human
guggccagugaggugccagc

SEQ ID NO: 537468 - RNA, 22 nt, Human
gugucugggggggucucugggg

SEQ ID NO: 537469 - RNA, 18 nt, Human
uaaaggcagaagagugga

SEQ ID NO: 537470 - RNA, 18 nt, Human
uaacccagaaaaggccac

SEQ ID NO: 537471 - RNA, 25 nt, Human
uauagcaguggcugagagauugcuc

SEQ ID NO: 537472 - RNA, 19 nt, Human
uauaguagugucuuaaaaa

SEQ ID NO: 537473 - RNA, 22 nt, Human
uauuuauuggaaaagcagaaca

SEQ ID NO: 537474 - RNA, 24 nt, Human
uauuucaccauacuauggagaaua

SEQ ID NO: 537475 - RNA, 20 nt, Human
ucagggcucuuucugggcug

SEQ ID NO: 537476 - RNA, 23 nt, Human
ucuuguuuaauuaccugcugccc

SEQ ID NO: 537477 - RNA, 21 nt, Human
ucuuucugggcugcucugcag

SEQ ID NO: 537478 - RNA, 18 nt, Human
ugaagugcuuugguggug

SEQ ID NO: 537479 - RNA, 21 nt, Human
ugaagugguggcagaagcuug

SEQ ID NO: 537480 - RNA, 21 nt, Human
ugaauacucucauuuuuacuu

SEQ ID NO: 537481 - RNA, 21 nt, Human
ugacguaaggacaagugcacu

SEQ ID NO: 537482 - RNA, 18 nt, Human
ugaggaaauguccccagg

SEQ ID NO: 537483 - RNA, 21 nt, Human
ugaggucaggucacgugaucc

SEQ ID NO: 537484 - RNA, 24 nt, Human
ugagugccccaggguaaaagucuc

SEQ ID NO: 537485 - RNA, 25 nt, Human
ugauuaaaaacaaaaacucuuacaa

SEQ ID NO: 537486 - RNA, 21 nt, Human
ugccucuggacugccaggcac

SEQ ID NO: 537487 - RNA, 22 nt, Human
uggaaaucugacagugccugcc

SEQ ID NO: 537488 - RNA, 18 nt, Human
uggaagagcagggaaggg

SEQ ID NO: 537489 - RNA, 21 nt, Human
uggaaggaaaaugcuggcugg

SEQ ID NO: 537490 - RNA, 18 nt, Human
uggaauggcuggaaugag

SEQ ID NO: 537491 - RNA, 18 nt, Human
uggagcaccucacuuuga

SEQ ID NO: 537492 - RNA, 21 nt, Human
uggcugggagugaggucaggu

SEQ ID NO: 537493 - RNA, 20 nt, Human
ugggcugcucugcaggcgaa

SEQ ID NO: 537494 - RNA, 19 nt, Human
uggguugaaaggccaugau

SEQ ID NO: 537495 - RNA, 23 nt, Human
uuccagcaccagcgucagcucac

SEQ ID NO: 537496 - RNA, 20 nt, Human
uuccaugguucuccaagcac

SEQ ID NO: 537497 - RNA, 24 nt, Human
uuccaugguucuccaagcacgggc

SEQ ID NO: 537498 - RNA, 18 nt, Human
uucccuugcgggggcgca

SEQ ID NO: 537499 - RNA, 22 nt, Human
uuccuaaaggcagaagagugga

SEQ ID NO: 537500 - RNA, 18 nt, Human
uugcagaaguucacagcg

SEQ ID NO: 537501 - RNA, 25 nt, Human
uuugcagaaguucacagcgucuugg

SEQ ID NO: 537502 - RNA, 21 nt, Human
uuuuuuuuuuuuuuuucgugg

SEQ ID NO: 537503 - RNA, 23 nt, Human
uuuuuuuuuuuuuuuucgugguu

SEQ ID NO: 537504 - RNA, 20 nt, Human
uuuuuuuuuuuuuuuuucgu

SEQ ID NO: 537505 - RNA, 23 nt, Human
uuuuuuuuuuuuuuuuuuucggg

SEQ ID NO: 537506 - RNA, 21 nt, Human
aaccccugggcgcccggcacc

SEQ ID NO: 537507 - RNA, 26 nt, Human
aagaagccaaaauaucugcaguggga

SEQ ID NO: 537508 - RNA, 18 nt, Human
aagccaaaauaucugcau

SEQ ID NO: 537509 - RNA, 23 nt, Human
aagcuggagggucucgggacaca

SEQ ID NO: 537510 - RNA, 22 nt, Human
aagugucuuuguaaguucuucc

SEQ ID NO: 537511 - RNA, 28 nt, Human
aauacaaagaaagcuccaacuaaucaaa

SEQ ID NO: 537512 - RNA, 23 nt, Human
acaaaaugaaaaugcugauguua

SEQ ID NO: 537513 - RNA, 19 nt, Human
acaaugcugaaagcaaaac

SEQ ID NO: 537514 - RNA, 21 nt, Human
acacugguuuucuuucgaugu

SEQ ID NO: 537515 - RNA, 24 nt, Human
acccuggaaacucugggguuucuu

SEQ ID NO: 537516 - RNA, 21 nt, Human
acucuauuagccagaggcaag

SEQ ID NO: 537517 - RNA, 22 nt, Human
acugggaggaguuccacaaucu

SEQ ID NO: 537518 - RNA, 18 nt, Human
acuuuuuacaaaccaucc

SEQ ID NO: 537519 - RNA, 23 nt, Human
agaaaggaaacccagggauagaa

SEQ ID NO: 537520 - RNA, 23 nt, Human
agaagauuccugaggagcaacug

SEQ ID NO: 537521 - RNA, 22 nt, Human
agaauaucugcauugcuugaaa

SEQ ID NO: 537522 - RNA, 18 nt, Human
agaauuaaaaaaacagga

SEQ ID NO: 537523 - RNA, 23 nt, Human
agauauuuuuccaauuuaagaac

SEQ ID NO: 537524 - RNA, 18 nt, Human
agcaacugauaggggcaa

SEQ ID NO: 537525 - RNA, 25 nt, Human
aggaaaaaaaauuuuuaauuuugaa

SEQ ID NO: 537526 - RNA, 24 nt, Human
aggcagccagagcuacaccccuga

SEQ ID NO: 537527 - RNA, 21 nt, Human
auacugauacaguggaaacca

SEQ ID NO: 537528 - RNA, 20 nt, Human
caaaaucagaaaauuucaac

SEQ ID NO: 537529 - RNA, 24 nt, Human
caaaccauccgcacaaccaaaaua

SEQ ID NO: 537530 - RNA, 20 nt, Human
caaauauacacauauacaca

SEQ ID NO: 537531 - RNA, 20 nt, Human
caauuugcccaccauaaaaa

SEQ ID NO: 537532 - RNA, 23 nt, Human
caccgccuggaacgccuccucca

SEQ ID NO: 537533 - RNA, 25 nt, Human
cagaagauuccugaggagcaacuga

SEQ ID NO: 537534 - RNA, 21 nt, Human
cagcacuuccagaagcagcca

SEQ ID NO: 537535 - RNA, 18 nt, Human
cagcaggcugggaaccaa

SEQ ID NO: 537536 - RNA, 23 nt, Human
cagcaggcugggaaccaagcuga

SEQ ID NO: 537537 - RNA, 25 nt, Human
cagcaggcugggaaccaagcugagg

SEQ ID NO: 537538 - RNA, 20 nt, Human
cagcccaagucaaucagcag

SEQ ID NO: 537539 - RNA, 19 nt, Human
ccagagcuacaccccugac

SEQ ID NO: 537540 - RNA, 22 nt, Human
ccagccuagccuuauuaaguaa

SEQ ID NO: 537541 - RNA, 18 nt, Human
ccagugccaauagagaga

SEQ ID NO: 537542 - RNA, 20 nt, Human
ccaugaaauuacugaaccuu

SEQ ID NO: 537543 - RNA, 23 nt, Human
cccagcgcggcaaccccugggcg

SEQ ID NO: 537544 - RNA, 21 nt, Human
cccauagcuaagaaaggaaac

SEQ ID NO: 537545 - RNA, 20 nt, Human
ccccaccgcccucucaggcg

SEQ ID NO: 537546 - RNA, 23 nt, Human
ccccaccgcccucucaggcgcug

SEQ ID NO: 537547 - RNA, 23 nt, Human
ccccgccaccccaccgcccucuc

SEQ ID NO: 537548 - RNA, 24 nt, Human
ccccugggcgcccggcaccggcuu

SEQ ID NO: 537549 - RNA, 23 nt, Human
ccgccaccccaccgcccucucag

SEQ ID NO: 537550 - RNA, 21 nt, Human
ccuaccacuuuggaauguggg

SEQ ID NO: 537551 - RNA, 19 nt, Human
ccuccuaucuuccacccca

SEQ ID NO: 537552 - RNA, 28 nt, Human
ccuuugcuucuuagggggaaucuggggc

SEQ ID NO: 537553 - RNA, 20 nt, Human
cuaaugaaucaucuguggga

SEQ ID NO: 537554 - RNA, 21 nt, Human
cucccugauggcuagaaacag

SEQ ID NO: 537555 - RNA, 21 nt, Human
cucccugauggcuagaaacag

SEQ ID NO: 537556 - RNA, 24 nt, Human
cuggacacaaaaugaaaaugcuga

SEQ ID NO: 537557 - RNA, 18 nt, Human
cuuccagaagcagccaca

SEQ ID NO: 537558 - RNA, 20 nt, Human
cuuccagcacuuccagaagc

SEQ ID NO: 537559 - RNA, 19 nt, Human
gaaacucauuuucuucauu

SEQ ID NO: 537560 - RNA, 23 nt, Human
gaaccccgccaccccaccgcccu

SEQ ID NO: 537561 - RNA, 19 nt, Human
gacacaaaaugaaaaugcu

SEQ ID NO: 537562 - RNA, 18 nt, Human
gacucaaggcaccagcag

SEQ ID NO: 537563 - RNA, 19 nt, Human
gagcuacaccccugacucu

SEQ ID NO: 537564 - RNA, 23 nt, Human
gaucucccccuccuaucuuccac

SEQ ID NO: 537565 - RNA, 22 nt, Human
gauguugucuuucaugaaaucu

SEQ ID NO: 537566 - RNA, 22 nt, Human
gcacuuccagaagcagccacag

SEQ ID NO: 537567 - RNA, 22 nt, Human
gcgcaggaaccccgccacccca

SEQ ID NO: 537568 - RNA, 20 nt, Human
gcugaaagcaaaacaaacaa

SEQ ID NO: 537569 - RNA, 18 nt, Human
gcugcccucccgcccagc

SEQ ID NO: 537570 - RNA, 21 nt, Human
ggcaccagcagcccaagucaa

SEQ ID NO: 537571 - RNA, 24 nt, Human
gggaguuugggucagauuugcuug

SEQ ID NO: 537572 - RNA, 21 nt, Human
ggucagauuugcuuggaguuu

SEQ ID NO: 537573 - RNA, 24 nt, Human
uaaaaaaacaggauacuuuuuaca

SEQ ID NO: 537574 - RNA, 23 nt, Human
uaaaaauaacaauuacaaaggua

SEQ ID NO: 537575 - RNA, 19 nt, Human
uaaacaguaguagagaugg

SEQ ID NO: 537576 - RNA, 22 nt, Human
uaaacagugucucagaaacuca

SEQ ID NO: 537577 - RNA, 18 nt, Human
uaacaaguauugguuuua

SEQ ID NO: 537578 - RNA, 24 nt, Human
uaacugcccucuacuuaaagcuuu

SEQ ID NO: 537579 - RNA, 25 nt, Human
uaagaaaggaaacccagggauagaa

SEQ ID NO: 537580 - RNA, 19 nt, Human
uaagugucuuuguaaguuc

SEQ ID NO: 537581 - RNA, 24 nt, Human
uaauauuuacuagguucuuacugu

SEQ ID NO: 537582 - RNA, 20 nt, Human
uacaaaccauccgcacaacc

SEQ ID NO: 537583 - RNA, 18 nt, Human
uacaaaccauccgcacac

SEQ ID NO: 537584 - RNA, 23 nt, Human
uacacauauacacauucucuaca

SEQ ID NO: 537585 - RNA, 19 nt, Human
uacugggaggaguuccaca

SEQ ID NO: 537586 - RNA, 26 nt, Human
uaguagaaauggaaauucugaaaaca

SEQ ID NO: 537587 - RNA, 20 nt, Human
uaucaaagauaauuucauuu

SEQ ID NO: 537588 - RNA, 22 nt, Human
uaucaaagauaauuucauuuuc

SEQ ID NO: 537589 - RNA, 26 nt, Human
uaugaagagcccaacuaauaaucaag

SEQ ID NO: 537590 - RNA, 20 nt, Human
ucaaaaggagaaaauuuuga

SEQ ID NO: 537591 - RNA, 25 nt, Human
ucaaggcaccagcagcccaagucaa

SEQ ID NO: 537592 - RNA, 21 nt, Human
ucacugggaaagugaccuaaa

SEQ ID NO: 537593 - RNA, 20 nt, Human
ucagaaacucauuuucuuca

SEQ ID NO: 537594 - RNA, 20 nt, Human
ucauuuacuaugcaugauuu

SEQ ID NO: 537595 - RNA, 23 nt, Human
uccaagagguuaguagaaaugga

SEQ ID NO: 537596 - RNA, 21 nt, Human
ucccuggacacaaaaugaaaa

SEQ ID NO: 537597 - RNA, 24 nt, Human
uccgcacaaccaaaauuccugugg

SEQ ID NO: 537598 - RNA, 23 nt, Human
ucuauuuuuacaacucucuuagg

SEQ ID NO: 537599 - RNA, 25 nt, Human
ucuuaaauauuguccaaaucccuca

SEQ ID NO: 537600 - RNA, 21 nt, Human
ucuuccucucuuccuauucug

SEQ ID NO: 537601 - RNA, 23 nt, Human
ugaaagcaaaacaaacaaaaauu

SEQ ID NO: 537602 - RNA, 22 nt, Human
ugaaauaagcaacugauggcca

SEQ ID NO: 537603 - RNA, 23 nt, Human
ugaaauaagcaacugauggcccc

SEQ ID NO: 537604 - RNA, 20 nt, Human
ugaaaucucuagaaacaaau

SEQ ID NO: 537605 - RNA, 20 nt, Human
ugaauagaauuaaaaaaaca

SEQ ID NO: 537606 - RNA, 21 nt, Human
ugaccucugggugcuuuuccc

SEQ ID NO: 537607 - RNA, 23 nt, Human
ugauguugucuuucaugaaaucu

SEQ ID NO: 537608 - RNA, 23 nt, Human
ugcaugauuuugaaguacuagaa

SEQ ID NO: 537609 - RNA, 24 nt, Human
ugcccucccgcccagcgcggcaac

SEQ ID NO: 537610 - RNA, 19 nt, Human
ugccuaagcuuguugacuc

SEQ ID NO: 537611 - RNA, 23 nt, Human
ugcugaaagcaaaacaaacaaaa

SEQ ID NO: 537612 - RNA, 18 nt, Human
uggaaauucugaaaacac

SEQ ID NO: 537613 - RNA, 19 nt, Human
uggaacaaagucauaacac

SEQ ID NO: 537614 - RNA, 21 nt, Human
uggaacgccuccuccaccucc

SEQ ID NO: 537615 - RNA, 22 nt, Human
uggcuagaaacaguaauauuua

SEQ ID NO: 537616 - RNA, 28 nt, Human
ugggacucaaggcaccagcagcccaagu

SEQ ID NO: 537617 - RNA, 18 nt, Human
ugggcgcccggcaccggc

SEQ ID NO: 537618 - RNA, 20 nt, Human
uuaacaacuauucucucaau

SEQ ID NO: 537619 - RNA, 24 nt, Human
uuaccuaaacagugucucagaaac

SEQ ID NO: 537620 - RNA, 22 nt, Human
uuacugggcugugguuguaacu

SEQ ID NO: 537621 - RNA, 21 nt, Human
uuaggaaaucaaauacaagau

SEQ ID NO: 537622 - RNA, 23 nt, Human
uuauuacauucacaagaagccaa

SEQ ID NO: 537623 - RNA, 24 nt, Human
uucaaauuguagaucucccccucc

SEQ ID NO: 537624 - RNA, 18 nt, Human
uucaacaugguuucuuuc

SEQ ID NO: 537625 - RNA, 23 nt, Human
uuccagcacuuccagaagcagcc

SEQ ID NO: 537626 - RNA, 20 nt, Human
uucuauuuaccucuaauuca

SEQ ID NO: 537627 - RNA, 24 nt, Human
uugagaaggggucuauuuuccaga

SEQ ID NO: 537628 - RNA, 19 nt, Human
uuuaagaauaacuuuuaag

SEQ ID NO: 537629 - RNA, 20 nt, Human
uuugccucauuuuguuuauu

SEQ ID NO: 537630 - RNA, 22 nt, Human
uuugggucagauuugcuuggag

SEQ ID NO: 537631 - RNA, 25 nt, Human
uuuuaagugucuuuguaaguucuuc

SEQ ID NO: 537632 - RNA, 19 nt, Human
uuuuguuuauuugcucauu

SEQ ID NO: 537633 - RNA, 18 nt, Human
aaaaaagccucugucucc

SEQ ID NO: 537634 - RNA, 18 nt, Human
aaaaaagccucugucuuu

SEQ ID NO: 537635 - RNA, 20 nt, Human
aaaaagccaguggaaacgga

SEQ ID NO: 537636 - RNA, 22 nt, Human
aaaaagccaguggaaacggaua

SEQ ID NO: 537637 - RNA, 19 nt, Human
aaagggcaggggaggcagg

SEQ ID NO: 537638 - RNA, 24 nt, Human
aaagugcugggauuacaggcauga

SEQ ID NO: 537639 - RNA, 21 nt, Human
aacccagucaaccccaggcuc

SEQ ID NO: 537640 - RNA, 22 nt, Human
aagcagcaggaggcagacaagg

SEQ ID NO: 537641 - RNA, 18 nt, Human
aaggaaaggcacagcaca

SEQ ID NO: 537642 - RNA, 19 nt, Human
aaguagcugggauuacagg

SEQ ID NO: 537643 - RNA, 25 nt, Human
aaguagcugggauuacagguguuca

SEQ ID NO: 537644 - RNA, 19 nt, Human
aagugcugggauuacaggc

SEQ ID NO: 537645 - RNA, 21 nt, Human
aagugcugggauuacaggcau

SEQ ID NO: 537646 - RNA, 26 nt, Human
aagugcugggauuacaggcaugagcc

SEQ ID NO: 537647 - RNA, 22 nt, Human
acaacccccaucucccagguuc

SEQ ID NO: 537648 - RNA, 20 nt, Human
acaaggaaaggcacagcaca

SEQ ID NO: 537649 - RNA, 19 nt, Human
acaaggacagcagucagca

SEQ ID NO: 537650 - RNA, 22 nt, Human
acacacacacacgcaaggcuca

SEQ ID NO: 537651 - RNA, 20 nt, Human
acaggaaaaaauagcucuca

SEQ ID NO: 537652 - RNA, 22 nt, Human
acccagucaaccccaggcucaa

SEQ ID NO: 537653 - RNA, 23 nt, Human
accucagccucccaaagugcugg

SEQ ID NO: 537654 - RNA, 30 nt, Human
acuccuucacccaggcuggaguccgauggg

SEQ ID NO: 537655 - RNA, 22 nt, Human
agaaaucagaaagaaugcugaa

SEQ ID NO: 537656 - RNA, 28 nt, Human
agaagcagcaggaggcagaccgguaccc

SEQ ID NO: 537657 - RNA, 19 nt, Human
agagauggggauaggaaga

SEQ ID NO: 537658 - RNA, 21 nt, Human
agcccccguuccccacacgcc

SEQ ID NO: 537659 - RNA, 23 nt, Human
agcccucuccuuuccuucugagg

SEQ ID NO: 537660 - RNA, 19 nt, Human
aggaggcagacaaggaaag

SEQ ID NO: 537661 - RNA, 20 nt, Human
agguuccuaucuguggucuu

SEQ ID NO: 537662 - RNA, 19 nt, Human
agugauccacccaccucag

SEQ ID NO: 537663 - RNA, 18 nt, Human
agugcugggauuacaggc

SEQ ID NO: 537664 - RNA, 23 nt, Human
aguuguguuuggggugguauugg

SEQ ID NO: 537665 - RNA, 23 nt, Human
augggacagcaggggucagggag

SEQ ID NO: 537666 - RNA, 24 nt, Human
augggguuuugccauauuacccag

SEQ ID NO: 537667 - RNA, 25 nt, Human
auuuuuguauuuuuuaguagagaug

SEQ ID NO: 537668 - RNA, 24 nt, Human
caaagugcugggauuacaggcaug

SEQ ID NO: 537669 - RNA, 23 nt, Human
caacccccaucucccagguucaa

SEQ ID NO: 537670 - RNA, 20 nt, Human
caacuccuaugccucagccu

SEQ ID NO: 537671 - RNA, 19 nt, Human
caagagcccccguucccca

SEQ ID NO: 537672 - RNA, 27 nt, Human
caagcaacuccuaugccucagccuucc

SEQ ID NO: 537673 - RNA, 28 nt, Human
caagcaggcaccccauuguuguaaugac

SEQ ID NO: 537674 - RNA, 21 nt, Human
cacagcacaagacccaggaaa

SEQ ID NO: 537675 - RNA, 21 nt, Human
cacagugaauucaaaaaagcc

SEQ ID NO: 537676 - RNA, 24 nt, Human
caccauaccuggcuaauuuuugua

SEQ ID NO: 537677 - RNA, 22 nt, Human
cacccaccucagccucccaaag

SEQ ID NO: 537678 - RNA, 23 nt, Human
cacccaccucagccucccaaagu

SEQ ID NO: 537679 - RNA, 23 nt, Human
cacccaggcuggaguccgauggc

SEQ ID NO: 537680 - RNA, 21 nt, Human
cacuacaacccccaucuccca

SEQ ID NO: 537681 - RNA, 24 nt, Human
cagaauccuggcaucgugggcccu

SEQ ID NO: 537682 - RNA, 18 nt, Human
cagccagaaagacucuca

SEQ ID NO: 537683 - RNA, 23 nt, Human
cagcugcugagaagcagagagga

SEQ ID NO: 537684 - RNA, 24 nt, Human
cagguguucaccaccauaccuggc

SEQ ID NO: 537685 - RNA, 20 nt, Human
caguuacagaagcagcagga

SEQ ID NO: 537686 - RNA, 24 nt, Human
cauauuacccaggcuggucucaaa

SEQ ID NO: 537687 - RNA, 23 nt, Human
ccaaagugcugggauuacaggca

SEQ ID NO: 537688 - RNA, 24 nt, Human
ccaaagugcugggauuacaggcau

SEQ ID NO: 537689 - RNA, 21 nt, Human
ccaaguagcugggauuacagg

SEQ ID NO: 537690 - RNA, 23 nt, Human
ccaaguagcugggauuacaggug

SEQ ID NO: 537691 - RNA, 24 nt, Human
ccaaguagcugggauuacaggugu

SEQ ID NO: 537692 - RNA, 26 nt, Human
ccacccaccucagccucccaaagugc

SEQ ID NO: 537693 - RNA, 20 nt, Human
ccagcccaagcaggcacccc

SEQ ID NO: 537694 - RNA, 22 nt, Human
ccaggcucaagacuguuucagc

SEQ ID NO: 537695 - RNA, 21 nt, Human
ccagucaaccccaggcucaag

SEQ ID NO: 537696 - RNA, 22 nt, Human
ccauauuacccaggcuggucuc

SEQ ID NO: 537697 - RNA, 25 nt, Human
cccaaacuuuaaaaaaaaaaaaaaa

SEQ ID NO: 537698 - RNA, 24 nt, Human
cccaaagugcugggauuacaggca

SEQ ID NO: 537699 - RNA, 20 nt, Human
cccagguucaagcaacuccu

SEQ ID NO: 537700 - RNA, 21 nt, Human
cccagguucaagcaacuccua

SEQ ID NO: 537701 - RNA, 25 nt, Human
ccuaugccucagccuuccaaguagc

SEQ ID NO: 537702 - RNA, 24 nt, Human
ccugaccucaagugauccacccac

SEQ ID NO: 537703 - RNA, 20 nt, Human
ccugccucuuucuuuacucc

SEQ ID NO: 537704 - RNA, 23 nt, Human
cuacaacccccaucucccagguu

SEQ ID NO: 537705 - RNA, 24 nt, Human
cucaagugauccacccaccucagc

SEQ ID NO: 537706 - RNA, 24 nt, Human
cucacuacaacccccaucucccag

SEQ ID NO: 537707 - RNA, 23 nt, Human
cucagccuuccaaguagcuggga

SEQ ID NO: 537708 - RNA, 22 nt, Human
cucccagguucaagcaacuccu

SEQ ID NO: 537709 - RNA, 19 nt, Human
cucuaacccagucaacccc

SEQ ID NO: 537710 - RNA, 25 nt, Human
cucuggggacugacugagacagcag

SEQ ID NO: 537711 - RNA, 23 nt, Human
cucuuccacacacacacacgcaa

SEQ ID NO: 537712 - RNA, 19 nt, Human
cugacagaccccaaacuuu

SEQ ID NO: 537713 - RNA, 19 nt, Human
cuguaccacugucuuucuc

SEQ ID NO: 537714 - RNA, 21 nt, Human
cuucaagagcccccguucccc

SEQ ID NO: 537715 - RNA, 21 nt, Human
cuuccacacacacacacgcaa

SEQ ID NO: 537716 - RNA, 24 nt, Human
cuuuaaaaaaaaaaaaaaagccuc

SEQ ID NO: 537717 - RNA, 22 nt, Human
cuuuuuuguuuguuuuuggaga

SEQ ID NO: 537718 - RNA, 23 nt, Human
gaaacggauaaauaccuauagcg

SEQ ID NO: 537719 - RNA, 24 nt, Human
gaccucaagugauccacccaccuc

SEQ ID NO: 537720 - RNA, 18 nt, Human
gagaugggguuuugccau

SEQ ID NO: 537721 - RNA, 24 nt, Human
gagcaaggcagugagggcgaggaa

SEQ ID NO: 537722 - RNA, 18 nt, Human
gauuacaggcaugagcca

SEQ ID NO: 537723 - RNA, 18 nt, Human
gauuacaggcaugagcca

SEQ ID NO: 537724 - RNA, 22 nt, Human
gauuacaggcaugagccauugc

SEQ ID NO: 537725 - RNA, 24 nt, Human
gauuacagguguucaccaccauac

SEQ ID NO: 537726 - RNA, 20 nt, Human
gcaauugggccuggggucug

SEQ ID NO: 537727 - RNA, 22 nt, Human
gcagaaguauguccaagguuuu

SEQ ID NO: 537728 - RNA, 21 nt, Human
gcagcugagaaagggcagggg

SEQ ID NO: 537729 - RNA, 23 nt, Human
gcccagaagguguggugagagac

SEQ ID NO: 537730 - RNA, 19 nt, Human
gccgagggcuugcaauugg

SEQ ID NO: 537731 - RNA, 18 nt, Human
gcuauggcacaagugaua

SEQ ID NO: 537732 - RNA, 23 nt, Human
gcuggucucaaacuccugaccuc

SEQ ID NO: 537733 - RNA, 22 nt, Human
ggauuacaggcaugagccauug

SEQ ID NO: 537734 - RNA, 20 nt, Human
ggcagugagggcgaggaaag

SEQ ID NO: 537735 - RNA, 24 nt, Human
ggcuggucucaaacuccugaccuc

SEQ ID NO: 537736 - RNA, 20 nt, Human
ggcuguuucuucccccacuc

SEQ ID NO: 537737 - RNA, 20 nt, Human
gggcagacaccauagucccc

SEQ ID NO: 537738 - RNA, 25 nt, Human
ggggaguaggacagcugcugagaag

SEQ ID NO: 537739 - RNA, 22 nt, Human
gggguuuugccauauuacccag

SEQ ID NO: 537740 - RNA, 23 nt, Human
gggguuuugccauauuacccagg

SEQ ID NO: 537741 - RNA, 22 nt, Human
ggguuuugccauauuacccagg

SEQ ID NO: 537742 - RNA, 21 nt, Human
guagagaugggguuuugccau

SEQ ID NO: 537743 - RNA, 20 nt, Human
guauuuuuuaguagagaugg

SEQ ID NO: 537744 - RNA, 18 nt, Human
gucucacuccuucaccca

SEQ ID NO: 537745 - RNA, 24 nt, Human
gugauccacccaccucagccuccc

SEQ ID NO: 537746 - RNA, 20 nt, Human
guugaguuguguuuggggug

SEQ ID NO: 537747 - RNA, 22 nt, Human
guuguauugaauucuggcuguu

SEQ ID NO: 537748 - RNA, 19 nt, Human
uaaaaaaaaaaaaaaagcc

SEQ ID NO: 537749 - RNA, 24 nt, Human
uaacccagucaaccccaggcucaa

SEQ ID NO: 537750 - RNA, 18 nt, Human
uaacucccgcucuuuguu

SEQ ID NO: 537751 - RNA, 23 nt, Human
uaauuuuuguauuuuuuaguaga

SEQ ID NO: 537752 - RNA, 25 nt, Human
uaauuuuuguauuuuuuaguagaga

SEQ ID NO: 537753 - RNA, 22 nt, Human
uacaggcaugagccauugcgcc

SEQ ID NO: 537754 - RNA, 20 nt, Human
uagagaugggguuuugccau

SEQ ID NO: 537755 - RNA, 18 nt, Human
uaggacagcugcugagaa

SEQ ID NO: 537756 - RNA, 23 nt, Human
uaguagagaugggguuuugccau

SEQ ID NO: 537757 - RNA, 24 nt, Human
uaguagagaugggguuuugccaua

SEQ ID NO: 537758 - RNA, 19 nt, Human
uaguucuagaaaucagaaa

SEQ ID NO: 537759 - RNA, 23 nt, Human
ucaaccccaggcucaagacuguu

SEQ ID NO: 537760 - RNA, 20 nt, Human
ucaagugauccacccaccuc

SEQ ID NO: 537761 - RNA, 24 nt, Human
ucacuacaacccccaucucccagg

SEQ ID NO: 537762 - RNA, 24 nt, Human
ucacuccuucacccaggcuggagu

SEQ ID NO: 537763 - RNA, 23 nt, Human
ucagcagagccuucgacccagcc

SEQ ID NO: 537764 - RNA, 22 nt, Human
uccaaguagcugggauuacagg

SEQ ID NO: 537765 - RNA, 23 nt, Human
uccaaguagcugggauuacaggu

SEQ ID NO: 537766 - RNA, 24 nt, Human
uccaaguagcugggauuacaggug

SEQ ID NO: 537767 - RNA, 21 nt, Human
uccacccaccucagccuccca

SEQ ID NO: 537768 - RNA, 24 nt, Human
ucccaaagugcugggauuacaggc

SEQ ID NO: 537769 - RNA, 19 nt, Human
ucccagguucaagcaacuc

SEQ ID NO: 537770 - RNA, 22 nt, Human
ucccagguucaagcaacuccua

SEQ ID NO: 537771 - RNA, 23 nt, Human
uccuuuuuuguuuguuuuuggag

SEQ ID NO: 537772 - RNA, 18 nt, Human
ucgguggguacaaaaagc

SEQ ID NO: 537773 - RNA, 24 nt, Human
ucucacuccuucacccaggcugga

SEQ ID NO: 537774 - RNA, 21 nt, Human
ucuccaauuucccgagauugc

SEQ ID NO: 537775 - RNA, 22 nt, Human
ucucccagguucaagcaacucc

SEQ ID NO: 537776 - RNA, 20 nt, Human
ucuggcuguuucuuccccca

SEQ ID NO: 537777 - RNA, 21 nt, Human
ugagccauugcgccugccucu

SEQ ID NO: 537778 - RNA, 18 nt, Human
ugagggcaggggaggcag

SEQ ID NO: 537779 - RNA, 20 nt, Human
ugagggcaggggaggcagcu

SEQ ID NO: 537780 - RNA, 24 nt, Human
ugagguggauaguucuagaaauca

SEQ ID NO: 537781 - RNA, 20 nt, Human
ugaguggugacaaccucacu

SEQ ID NO: 537782 - RNA, 24 nt, Human
ugauaagugagcccucuccuuucc

SEQ ID NO: 537783 - RNA, 26 nt, Human
ugauaagugagcccucuccuuuccuu

SEQ ID NO: 537784 - RNA, 24 nt, Human
ugauccacccaccucagccuccca

SEQ ID NO: 537785 - RNA, 27 nt, Human
ugccauauuacccaggcuggucucaaa

SEQ ID NO: 537786 - RNA, 22 nt, Human
ugccucagccuuccaaguagcu

SEQ ID NO: 537787 - RNA, 24 nt, Human
ugccucagccuuccaaguagcugg

SEQ ID NO: 537788 - RNA, 24 nt, Human
uggcacgaacuuggcucacuacaa

SEQ ID NO: 537789 - RNA, 21 nt, Human
uggcaggggguuagaaagcca

SEQ ID NO: 537790 - RNA, 22 nt, Human
uggcuuugcuuuucuugggagg

SEQ ID NO: 537791 - RNA, 18 nt, Human
ugggauuacaggcaugag

SEQ ID NO: 537792 - RNA, 19 nt, Human
ugggauuacaggcaugagc

SEQ ID NO: 537793 - RNA, 21 nt, Human
ugggauuacaggcaugagcca

SEQ ID NO: 537794 - RNA, 21 nt, Human
ugggauuacaggcaugagcca

SEQ ID NO: 537795 - RNA, 21 nt, Human
ugggauuacaggcaugagcca

SEQ ID NO: 537796 - RNA, 22 nt, Human
ugggauuacaggcaugagccau

SEQ ID NO: 537797 - RNA, 24 nt, Human
ugggauuacaggcaugagccauug

SEQ ID NO: 537798 - RNA, 24 nt, Human
ugggauuacaggcaugagccauug

SEQ ID NO: 537799 - RNA, 27 nt, Human
ugggauuacaggcaugagccauugcgc

SEQ ID NO: 537800 - RNA, 19 nt, Human
ugggauuacagguguucac

SEQ ID NO: 537801 - RNA, 21 nt, Human
ugggauuacagguguucacca

SEQ ID NO: 537802 - RNA, 24 nt, Human
ugggauuacagguguucaccacca

SEQ ID NO: 537803 - RNA, 25 nt, Human
ugggauuacagguguucaccaccau

SEQ ID NO: 537804 - RNA, 24 nt, Human
ugggguuuugccauauuacccagg

SEQ ID NO: 537805 - RNA, 18 nt, Human
uuaguagagaugggguuu

SEQ ID NO: 537806 - RNA, 22 nt, Human
uuaguagagaugggguuuugcc

SEQ ID NO: 537807 - RNA, 24 nt, Human
uuaguagagaugggguuuugccau

SEQ ID NO: 537808 - RNA, 24 nt, Human
uuccaaguagcugggauuacaggu

SEQ ID NO: 537809 - RNA, 28 nt, Human
uucuaaggcaaggucuuucccucugggg

SEQ ID NO: 537810 - RNA, 23 nt, Human
uucucuaacccagucaaccccag

SEQ ID NO: 537811 - RNA, 22 nt, Human
uugcaauugggccuggggucug

SEQ ID NO: 537812 - RNA, 22 nt, Human
uuuaaaaaaaaaaaaaaagccu

SEQ ID NO: 537813 - RNA, 21 nt, Human
uuuuuaguagagaugggguuu

SEQ ID NO: 537814 - RNA, 21 nt, Human
uuuuuguauuuuuuaguagag

SEQ ID NO: 537815 - RNA, 22 nt, Human
uuuuuuaguagagaugggguuu

SEQ ID NO: 537816 - RNA, 21 nt, Human
aaaaccuguccaaagaugucc

SEQ ID NO: 537817 - RNA, 25 nt, Human
aaacaagaauccucgaccagguccg

SEQ ID NO: 537818 - RNA, 18 nt, Human
aaccacaaguacagaauu

SEQ ID NO: 537819 - RNA, 20 nt, Human
aacccgaucaguccaaccag

SEQ ID NO: 537820 - RNA, 19 nt, Human
aaccgccuccccaccaaac

SEQ ID NO: 537821 - RNA, 18 nt, Human
aaccuggggcacagaggc

SEQ ID NO: 537822 - RNA, 23 nt, Human
aauaaauaggaaaaccgccuccc

SEQ ID NO: 537823 - RNA, 18 nt, Human
acacacucagacacagga

SEQ ID NO: 537824 - RNA, 18 nt, Human
acacagccugcuguuaga

SEQ ID NO: 537825 - RNA, 22 nt, Human
acagcccgguguaccucaaagc

SEQ ID NO: 537826 - RNA, 23 nt, Human
acaggacaugcccagccuugccc

SEQ ID NO: 537827 - RNA, 19 nt, Human
acagggcauugcagcccca

SEQ ID NO: 537828 - RNA, 22 nt, Human
accaagcuucccaagccccaac

SEQ ID NO: 537829 - RNA, 24 nt, Human
accacaggacagcgugagccccac

SEQ ID NO: 537830 - RNA, 19 nt, Human
acccaacaaaaggacagcu

SEQ ID NO: 537831 - RNA, 24 nt, Human
acccauucccaggcacuucuccag

SEQ ID NO: 537832 - RNA, 18 nt, Human
agaauaaauaggaaaacc

SEQ ID NO: 537833 - RNA, 22 nt, Human
agaaucccaaacaagaauccuc

SEQ ID NO: 537834 - RNA, 18 nt, Human
agaggcagggggaggaau

SEQ ID NO: 537835 - RNA, 25 nt, Human
agcaagugccagagaacuuggcuca

SEQ ID NO: 537836 - RNA, 19 nt, Human
agccccaacccccagcagc

SEQ ID NO: 537837 - RNA, 20 nt, Human
agcuggacauccaguaacuc

SEQ ID NO: 537838 - RNA, 18 nt, Human
agcuuccaacccacagcc

SEQ ID NO: 537839 - RNA, 20 nt, Human
aggacagcuccugcugccaa

SEQ ID NO: 537840 - RNA, 23 nt, Human
aggcagugcccuggcacagugcc

SEQ ID NO: 537841 - RNA, 23 nt, Human
aggcuggaggcccuuuccuggca

SEQ ID NO: 537842 - RNA, 23 nt, Human
aggggaaagggcugccccuguga

SEQ ID NO: 537843 - RNA, 21 nt, Human
aggggggaaaagggagaggcc

SEQ ID NO: 537844 - RNA, 21 nt, Human
agggucccugcuggaccaagc

SEQ ID NO: 537845 - RNA, 19 nt, Human
auaaagcagcaccguuccc

SEQ ID NO: 537846 - RNA, 21 nt, Human
augccaccuggguggggguca

SEQ ID NO: 537847 - RNA, 23 nt, Human
caaaaggacagcuccugcugcca

SEQ ID NO: 537848 - RNA, 27 nt, Human
caaagcagaaucccaaacaagaaucuu

SEQ ID NO: 537849 - RNA, 22 nt, Human
caagaagaaguagccacacuug

SEQ ID NO: 537850 - RNA, 18 nt, Human
cacagcguuuacaaaguu

SEQ ID NO: 537851 - RNA, 24 nt, Human
cacaggacagcgugagccccaccc

SEQ ID NO: 537852 - RNA, 25 nt, Human
caccccuuccccuccacugacaacc

SEQ ID NO: 537853 - RNA, 18 nt, Human
cacccucucuucccaccc

SEQ ID NO: 537854 - RNA, 20 nt, Human
cacccucucuucccacccaa

SEQ ID NO: 537855 - RNA, 21 nt, Human
cacggggccaccccaggaggg

SEQ ID NO: 537856 - RNA, 23 nt, Human
cacucugugccugccuaccccug

SEQ ID NO: 537857 - RNA, 20 nt, Human
cacugguugaaaaccugucc

SEQ ID NO: 537858 - RNA, 22 nt, Human
cagaauaaauaacuuaaaagcg

SEQ ID NO: 537859 - RNA, 22 nt, Human
cagagaacuuggcucaggguca

SEQ ID NO: 537860 - RNA, 19 nt, Human
cagcccacuccccagacug

SEQ ID NO: 537861 - RNA, 23 nt, Human
cagccucccgggucgccacauug

SEQ ID NO: 537862 - RNA, 23 nt, Human
cagccuugccccucagcuccaag

SEQ ID NO: 537863 - RNA, 20 nt, Human
cagcgugagccccacccccc

SEQ ID NO: 537864 - RNA, 22 nt, Human
cagcgugagccccaccccccuc

SEQ ID NO: 537865 - RNA, 18 nt, Human
cagcuccugcugccaagg

SEQ ID NO: 537866 - RNA, 23 nt, Human
cagcuuccaacccacagccuccc

SEQ ID NO: 537867 - RNA, 24 nt, Human
caggauacaggguggacgacaccu

SEQ ID NO: 537868 - RNA, 19 nt, Human
cagugacaccccuuccccu

SEQ ID NO: 537869 - RNA, 20 nt, Human
caguucccaagcuacuuccc

SEQ ID NO: 537870 - RNA, 18 nt, Human
caguuccugggguggggg

SEQ ID NO: 537871 - RNA, 18 nt, Human
cauaaucggauccucugc

SEQ ID NO: 537872 - RNA, 18 nt, Human
ccacagaggggcagugac

SEQ ID NO: 537873 - RNA, 21 nt, Human
ccacaggacagcgugagcccc

SEQ ID NO: 537874 - RNA, 19 nt, Human
ccaccaagcuucccaagcc

SEQ ID NO: 537875 - RNA, 24 nt, Human
ccaccccccucccccaaugacccc

SEQ ID NO: 537876 - RNA, 19 nt, Human
ccagcccaggucgcggucc

SEQ ID NO: 537877 - RNA, 23 nt, Human
ccaggcucagcuuccaacccaca

SEQ ID NO: 537878 - RNA, 19 nt, Human
ccaggucaggccccuggcc

SEQ ID NO: 537879 - RNA, 22 nt, Human
cccaagccccaacccccagcag

SEQ ID NO: 537880 - RNA, 20 nt, Human
cccacacacacucagacaca

SEQ ID NO: 537881 - RNA, 18 nt, Human
cccacagccuuccucccu

SEQ ID NO: 537882 - RNA, 24 nt, Human
cccacagccuuccucccuucaccu

SEQ ID NO: 537883 - RNA, 19 nt, Human
cccaccaagcuucccaagc

SEQ ID NO: 537884 - RNA, 24 nt, Human
cccaucucuuacccagccugggca

SEQ ID NO: 537885 - RNA, 20 nt, Human
cccaugucagucagcucugc

SEQ ID NO: 537886 - RNA, 22 nt, Human
cccauucacauugcugagggcg

SEQ ID NO: 537887 - RNA, 26 nt, Human
cccauucacauugcugagggcggccg

SEQ ID NO: 537888 - RNA, 23 nt, Human
ccccaaaccacaaguacagaaua

SEQ ID NO: 537889 - RNA, 29 nt, Human
ccccaccccccucccccaaugaccccagg

SEQ ID NO: 537890 - RNA, 24 nt, Human
ccccccacacacacucagacacag

SEQ ID NO: 537891 - RNA, 21 nt, Human
cccccccacacacacucagac

SEQ ID NO: 537892 - RNA, 21 nt, Human
ccccucagcagggcuuagucc

SEQ ID NO: 537893 - RNA, 23 nt, Human
ccccugugaggggcagggaaggu

SEQ ID NO: 537894 - RNA, 21 nt, Human
ccccuuccccuccacugacaa

SEQ ID NO: 537895 - RNA, 19 nt, Human
cccuccaggcucagcuucc

SEQ ID NO: 537896 - RNA, 20 nt, Human
cccuccaggcucagcuucca

SEQ ID NO: 537897 - RNA, 23 nt, Human
cccucccuuucccauuccuugaa

SEQ ID NO: 537898 - RNA, 18 nt, Human
cccucucuucccacccaa

SEQ ID NO: 537899 - RNA, 18 nt, Human
cccucuuccuacccuccc

SEQ ID NO: 537900 - RNA, 21 nt, Human
cccugagggcgggccaaggaa

SEQ ID NO: 537901 - RNA, 19 nt, Human
ccuaccccugggacugggg

SEQ ID NO: 537902 - RNA, 18 nt, Human
ccucagagccccaaacca

SEQ ID NO: 537903 - RNA, 26 nt, Human
ccucagcuccaagcaccggacccauu

SEQ ID NO: 537904 - RNA, 23 nt, Human
ccucagggucccugcuggaccaa

SEQ ID NO: 537905 - RNA, 18 nt, Human
ccuccaaccagaaggggg

SEQ ID NO: 537906 - RNA, 23 nt, Human
ccuccacccaugucagucagcuc

SEQ ID NO: 537907 - RNA, 23 nt, Human
ccuccagcuuggcuccugggagu

SEQ ID NO: 537908 - RNA, 18 nt, Human
ccuccaggcucagcuucc

SEQ ID NO: 537909 - RNA, 21 nt, Human
ccuccucucccucuggccucc

SEQ ID NO: 537910 - RNA, 19 nt, Human
ccucuagggucccuaaccc

SEQ ID NO: 537911 - RNA, 19 nt, Human
ccugagcgauggccucuag

SEQ ID NO: 537912 - RNA, 22 nt, Human
ccugcugagauccuccucuccc

SEQ ID NO: 537913 - RNA, 21 nt, Human
ccugggucagggaggagaggc

SEQ ID NO: 537914 - RNA, 23 nt, Human
ccuguccaaagauguccaagccc

SEQ ID NO: 537915 - RNA, 22 nt, Human
ccuugcucuuccacugguugaa

SEQ ID NO: 537916 - RNA, 19 nt, Human
ccuuggggccccacuccuc

SEQ ID NO: 537917 - RNA, 19 nt, Human
cgcgguccuccagcuuggc

SEQ ID NO: 537918 - RNA, 19 nt, Human
cgcuaaggaagggaaacag

SEQ ID NO: 537919 - RNA, 21 nt, Human
cgguuggcgauucggcugcug

SEQ ID NO: 537920 - RNA, 22 nt, Human
cgguuggcgauucggcugcugu

SEQ ID NO: 537921 - RNA, 22 nt, Human
cucaaagcagaaucccaaacaa

SEQ ID NO: 537922 - RNA, 21 nt, Human
cucacagaauaaauaggaaaa

SEQ ID NO: 537923 - RNA, 18 nt, Human
cucagagccccaaaccac

SEQ ID NO: 537924 - RNA, 24 nt, Human
cuccaggcucagcuuccaacccac

SEQ ID NO: 537925 - RNA, 18 nt, Human
cucccccaaugaccccag

SEQ ID NO: 537926 - RNA, 22 nt, Human
cucccucuggccuccucucgga

SEQ ID NO: 537927 - RNA, 19 nt, Human
cucccucuuccuacccucc

SEQ ID NO: 537928 - RNA, 20 nt, Human
cucucaccuuggggccccac

SEQ ID NO: 537929 - RNA, 20 nt, Human
cucuuacccagccugggcag

SEQ ID NO: 537930 - RNA, 18 nt, Human
cucuucccacccaacucc

SEQ ID NO: 537931 - RNA, 20 nt, Human
cucuugggaagaggguaggg

SEQ ID NO: 537932 - RNA, 20 nt, Human
cugaguccugcacgccgagg

SEQ ID NO: 537933 - RNA, 21 nt, Human
cugcaauuggggcaaacacac

SEQ ID NO: 537934 - RNA, 23 nt, Human
cugcaauuggggcaaaccggggc

SEQ ID NO: 537935 - RNA, 23 nt, Human
cugcuguuagagggaggggagug

SEQ ID NO: 537936 - RNA, 25 nt, Human
cugggugggggucaggagagagggc

SEQ ID NO: 537937 - RNA, 21 nt, Human
cugugccugccuaccccuggg

SEQ ID NO: 537938 - RNA, 22 nt, Human
cuucaccuucagcccacucccc

SEQ ID NO: 537939 - RNA, 21 nt, Human
cuuccaacccacagccucccg

SEQ ID NO: 537940 - RNA, 18 nt, Human
cuuccuggggcagggaau

SEQ ID NO: 537941 - RNA, 21 nt, Human
cuuggcuccugggaguggugg

SEQ ID NO: 537942 - RNA, 23 nt, Human
gaagcagcaguugggaaccuggg

SEQ ID NO: 537943 - RNA, 19 nt, Human
gacaccccuuccccuccac

SEQ ID NO: 537944 - RNA, 21 nt, Human
gacagcgugagccccaccccc

SEQ ID NO: 537945 - RNA, 22 nt, Human
gaggaacacggggccaccccag

SEQ ID NO: 537946 - RNA, 24 nt, Human
gaggcuggaggcccuuuccuggcc

SEQ ID NO: 537947 - RNA, 22 nt, Human
gaggggcagggaagguggcggc

SEQ ID NO: 537948 - RNA, 22 nt, Human
gagggugaggcugggucccuuc

SEQ ID NO: 537949 - RNA, 24 nt, Human
gaguuccagacagggcauugcagc

SEQ ID NO: 537950 - RNA, 27 nt, Human
gcacccaacaaaaggacagccgguuuc

SEQ ID NO: 537951 - RNA, 25 nt, Human
gcaggcccccuccaggcucagcuuc

SEQ ID NO: 537952 - RNA, 25 nt, Human
gccccaacccccagcagccguccau

SEQ ID NO: 537953 - RNA, 19 nt, Human
gcugccccugugaggggca

SEQ ID NO: 537954 - RNA, 19 nt, Human
gcuggaccaagcccaucuc

SEQ ID NO: 537955 - RNA, 19 nt, Human
ggaaaaccgccuccccacc

SEQ ID NO: 537956 - RNA, 20 nt, Human
ggacaaaccaguucccaagg

SEQ ID NO: 537957 - RNA, 20 nt, Human
ggacugaggggaaagggcug

SEQ ID NO: 537958 - RNA, 18 nt, Human
ggacuuugacacccccca

SEQ ID NO: 537959 - RNA, 18 nt, Human
ggagugguggugcccgca

SEQ ID NO: 537960 - RNA, 22 nt, Human
ggcaaacacacuccuugcucuu

SEQ ID NO: 537961 - RNA, 23 nt, Human
ggcacucucuccccagaaggaaa

SEQ ID NO: 537962 - RNA, 19 nt, Human
ggcagggaagguggcggca

SEQ ID NO: 537963 - RNA, 20 nt, Human
ggcagggaagguggcggcag

SEQ ID NO: 537964 - RNA, 24 nt, Human
ggccauggaaauuaguacagaacc

SEQ ID NO: 537965 - RNA, 19 nt, Human
ggccccuggccuagcugga

SEQ ID NO: 537966 - RNA, 20 nt, Human
ggccgaggcaggcccccucc

SEQ ID NO: 537967 - RNA, 18 nt, Human
gggagcuccuagccccug

SEQ ID NO: 537968 - RNA, 23 nt, Human
gggcaaacacacuccuugcucuu

SEQ ID NO: 537969 - RNA, 26 nt, Human
gggcaguggggcagggugggcaggag

SEQ ID NO: 537970 - RNA, 21 nt, Human
gggcucugcccugagggcggg

SEQ ID NO: 537971 - RNA, 21 nt, Human
ggguggggggcaggcagugcc

SEQ ID NO: 537972 - RNA, 18 nt, Human
gugaggcugggucccuuc

SEQ ID NO: 537973 - RNA, 18 nt, Human
gugaggggcagggaaggu

SEQ ID NO: 537974 - RNA, 18 nt, Human
guggugcccgcauggagg

SEQ ID NO: 537975 - RNA, 20 nt, Human
guuagagggaggggaguggg

SEQ ID NO: 537976 - RNA, 23 nt, Human
guuccugggguggggggcaggca

SEQ ID NO: 537977 - RNA, 19 nt, Human
guuggcgauucggcugcug

SEQ ID NO: 537978 - RNA, 20 nt, Human
uaaaaaauaaucacaauuug

SEQ ID NO: 537979 - RNA, 21 nt, Human
uaaauaggaaaaccgccuccc

SEQ ID NO: 537980 - RNA, 31 nt, Human
uaacucacagaauaaauaggaaaaccgccuu

SEQ ID NO: 537981 - RNA, 22 nt, Human
uacacagcguuuacaaaguuag

SEQ ID NO: 537982 - RNA, 20 nt, Human
uacaccagcagccauggggg

SEQ ID NO: 537983 - RNA, 24 nt, Human
uaccuguacagaauggauuacaua

SEQ ID NO: 537984 - RNA, 24 nt, Human
uaggaaaaccgccuccccaccaaa

SEQ ID NO: 537985 - RNA, 25 nt, Human
uagggcaguggggcagggugggcag

SEQ ID NO: 537986 - RNA, 21 nt, Human
ucaccuuggggccccacuccu

SEQ ID NO: 537987 - RNA, 21 nt, Human
ucagaaccaccccagcgggag

SEQ ID NO: 537988 - RNA, 22 nt, Human
ucagaagggagaguggcccaca

SEQ ID NO: 537989 - RNA, 19 nt, Human
ucagcccacuccccagacu

SEQ ID NO: 537990 - RNA, 19 nt, Human
uccagauggggagcaaagc

SEQ ID NO: 537991 - RNA, 20 nt, Human
uccaggccagacaaagacau

SEQ ID NO: 537992 - RNA, 23 nt, Human
uccaguuccugggguggggggca

SEQ ID NO: 537993 - RNA, 19 nt, Human
ucccaagccccaaccccca

SEQ ID NO: 537994 - RNA, 25 nt, Human
ucccaagccccaacccccagcagcc

SEQ ID NO: 537995 - RNA, 20 nt, Human
ucccacuucucccuccucca

SEQ ID NO: 537996 - RNA, 22 nt, Human
uccccagacugcaucuggaagc

SEQ ID NO: 537997 - RNA, 21 nt, Human
ucccgggucgccacauugccc

SEQ ID NO: 537998 - RNA, 23 nt, Human
ucccucagggucccugcuggacc

SEQ ID NO: 537999 - RNA, 20 nt, Human
uccuccagcuuggcuccugg

SEQ ID NO: 538000 - RNA, 20 nt, Human
ucgcgguccuccagcuuggc

SEQ ID NO: 538001 - RNA, 22 nt, Human
ucguccaagaagaaguagccac

SEQ ID NO: 538002 - RNA, 19 nt, Human
ucucaaaauccuucaugcu

SEQ ID NO: 538003 - RNA, 21 nt, Human
ucucccucuuccuacccuccc

SEQ ID NO: 538004 - RNA, 21 nt, Human
ucuccugagcgauggccucua

SEQ ID NO: 538005 - RNA, 21 nt, Human
ucucuuacccagccugggcag

SEQ ID NO: 538006 - RNA, 24 nt, Human
ucugugccugccuaccccugggac

SEQ ID NO: 538007 - RNA, 19 nt, Human
ucuuacccagccugggcag

SEQ ID NO: 538008 - RNA, 24 nt, Human
ucuucccacccaacuccuagcaaa

SEQ ID NO: 538009 - RNA, 24 nt, Human
ugaaacccacacagccugcuguua

SEQ ID NO: 538010 - RNA, 19 nt, Human
ugacacuucucccucuucc

SEQ ID NO: 538011 - RNA, 22 nt, Human
ugaccccagcaugcgguaaugc

SEQ ID NO: 538012 - RNA, 19 nt, Human
ugagccccaccccccuccc

SEQ ID NO: 538013 - RNA, 23 nt, Human
ugaggcugggucccuuccugggg

SEQ ID NO: 538014 - RNA, 18 nt, Human
ugcagcugccucucagaa

SEQ ID NO: 538015 - RNA, 28 nt, Human
ugcagcugccucucagaagggagagugg

SEQ ID NO: 538016 - RNA, 23 nt, Human
ugccaggcggguggccccugggc

SEQ ID NO: 538017 - RNA, 24 nt, Human
ugcgacugcaauuggggcaaacac

SEQ ID NO: 538018 - RNA, 20 nt, Human
ugcgggggggagugaugcau

SEQ ID NO: 538019 - RNA, 24 nt, Human
uggaagcagcaguugggaaccugg

SEQ ID NO: 538020 - RNA, 22 nt, Human
uggaaggaaaagccaccggcca

SEQ ID NO: 538021 - RNA, 23 nt, Human
uggcccacagccuuccucccuuc

SEQ ID NO: 538022 - RNA, 21 nt, Human
ugggcugccccgguagggcag

SEQ ID NO: 538023 - RNA, 21 nt, Human
uggggcagggugggcaggagg

SEQ ID NO: 538024 - RNA, 20 nt, Human
ugggguggggggcaggcagu

SEQ ID NO: 538025 - RNA, 19 nt, Human
ugguagggggggcacucuc

SEQ ID NO: 538026 - RNA, 19 nt, Human
uguccaaagauguccaagc

SEQ ID NO: 538027 - RNA, 21 nt, Human
uguccaagcccggcuggucca

SEQ ID NO: 538028 - RNA, 20 nt, Human
uguccaggucugaguccugg

SEQ ID NO: 538029 - RNA, 24 nt, Human
uuaaaaaccaauuugcaaccaggc

SEQ ID NO: 538030 - RNA, 22 nt, Human
uucacauugcugagggcggccg

SEQ ID NO: 538031 - RNA, 22 nt, Human
uucaccuucagcccacucccca

SEQ ID NO: 538032 - RNA, 24 nt, Human
uuccaacccacagccucccggguc

SEQ ID NO: 538033 - RNA, 22 nt, Human
uucccaagccccaacccccagc

SEQ ID NO: 538034 - RNA, 24 nt, Human
uucccacuucucccuccuccaacc

SEQ ID NO: 538035 - RNA, 25 nt, Human
uugcagccccaucucuguuguuccc

SEQ ID NO: 538036 - RNA, 18 nt, Human
uugccccucagcuccaag

SEQ ID NO: 538037 - RNA, 21 nt, Human
uugccccucagcuccaagcac

SEQ ID NO: 538038 - RNA, 25 nt, Human
uuuaaaaaauaaucacaauuugugg

SEQ ID NO: 538039 - RNA, 22 nt, Human
uuugcuguuauccaggccagac

SEQ ID NO: 538040 - RNA, 21 nt, Human
uuuguaaacucuuguggagac

SEQ ID NO: 538041 - RNA, 26 nt, Human
agcucugcagccucaaagaccagcuc

SEQ ID NO: 538042 - RNA, 23 nt, Human
cagcacaucauaccuugcacuuu

SEQ ID NO: 538043 - RNA, 23 nt, Human
cagccccccaagcucugcagccu

SEQ ID NO: 538044 - RNA, 26 nt, Human
cccccaagcucugcagccucaaagac

SEQ ID NO: 538045 - RNA, 23 nt, Human
ccucaaagaccagcucagucccc

SEQ ID NO: 538046 - RNA, 23 nt, Human
uaccuugcacuuucaggcagcca

SEQ ID NO: 538047 - RNA, 21 nt, Human
ucagugccccaguuggggccu

SEQ ID NO: 538048 - RNA, 19 nt, Human
ucccugacagcacaucaua

SEQ ID NO: 538049 - RNA, 23 nt, Human
ugccagccccccaagcucugcag

SEQ ID NO: 538050 - RNA, 23 nt, Human
uuaagguggcgauugccuuuucc

SEQ ID NO: 538051 - RNA, 22 nt, Human
aaaagccgggagggaagugaag

SEQ ID NO: 538052 - RNA, 21 nt, Human
aaacagaagucucuggaccug

SEQ ID NO: 538053 - RNA, 23 nt, Human
aagcuaugcaauuuucccucuaa

SEQ ID NO: 538054 - RNA, 25 nt, Human
aauuuugguuauaaauuccuagaag

SEQ ID NO: 538055 - RNA, 23 nt, Human
acaaaacauaccucaagccauau

SEQ ID NO: 538056 - RNA, 25 nt, Human
acaaaacauaccucaagccauauaa

SEQ ID NO: 538057 - RNA, 20 nt, Human
acaccuggauuuacaaaaca

SEQ ID NO: 538058 - RNA, 20 nt, Human
acuagaguacaggugaccug

SEQ ID NO: 538059 - RNA, 20 nt, Human
agaacuccuccauacgucuu

SEQ ID NO: 538060 - RNA, 21 nt, Human
agacgccccuaaaguggauaa

SEQ ID NO: 538061 - RNA, 18 nt, Human
agccaggggaggcagugg

SEQ ID NO: 538062 - RNA, 23 nt, Human
agccauauaaauauauccuguuu

SEQ ID NO: 538063 - RNA, 18 nt, Human
aggaacaaccugaccaaa

SEQ ID NO: 538064 - RNA, 22 nt, Human
aggaacaaccugaccaaagacg

SEQ ID NO: 538065 - RNA, 18 nt, Human
aggaggaggggguggggg

SEQ ID NO: 538066 - RNA, 18 nt, Human
aucuagaaauauaggcua

SEQ ID NO: 538067 - RNA, 20 nt, Human
augaagccaguagcuacacu

SEQ ID NO: 538068 - RNA, 24 nt, Human
caaaagcaccaaucuuaacaaggu

SEQ ID NO: 538069 - RNA, 19 nt, Human
caacaggaggagggggugg

SEQ ID NO: 538070 - RNA, 24 nt, Human
caacaguaggagcuacaucuucag

SEQ ID NO: 538071 - RNA, 22 nt, Human
caacuggccaucagacugaaca

SEQ ID NO: 538072 - RNA, 23 nt, Human
caaggaacaaccugaccaaagac

SEQ ID NO: 538073 - RNA, 24 nt, Human
caccaagaggcucaaguuuuggaa

SEQ ID NO: 538074 - RNA, 22 nt, Human
cagauuccccgaauucuuauuc

SEQ ID NO: 538075 - RNA, 21 nt, Human
caucacuggaauccacaacaa

SEQ ID NO: 538076 - RNA, 24 nt, Human
cauuggauauaaagguuuguuuuc

SEQ ID NO: 538077 - RNA, 28 nt, Human
ccaccucccaagucaaagauggugacuu

SEQ ID NO: 538078 - RNA, 18 nt, Human
ccagauuccccgaauucu

SEQ ID NO: 538079 - RNA, 23 nt, Human
ccaggggaggcaguggcuccggg

SEQ ID NO: 538080 - RNA, 21 nt, Human
cccauguacaaacuccaagaa

SEQ ID NO: 538081 - RNA, 19 nt, Human
ccccgcucuuccccggggg

SEQ ID NO: 538082 - RNA, 22 nt, Human
cccucuaaaauccuuuucaaag

SEQ ID NO: 538083 - RNA, 22 nt, Human
ccucccaccacuucccauccga

SEQ ID NO: 538084 - RNA, 25 nt, Human
ccucccaccacuucccauccgagcc

SEQ ID NO: 538085 - RNA, 23 nt, Human
cgcgacgacugcccucuuagcca

SEQ ID NO: 538086 - RNA, 22 nt, Human
cgcuugaaccagccgcagcaac

SEQ ID NO: 538087 - RNA, 20 nt, Human
cggcacuccgagacgccccu

SEQ ID NO: 538088 - RNA, 24 nt, Human
cggcacuccgagacgccccuaaag

SEQ ID NO: 538089 - RNA, 22 nt, Human
cuagugacuuuagggguucccc

SEQ ID NO: 538090 - RNA, 18 nt, Human
cuccucccaccacuuccc

SEQ ID NO: 538091 - RNA, 22 nt, Human
cuccucccaccacuucccaucc

SEQ ID NO: 538092 - RNA, 23 nt, Human
cucuucaucacuggaauccacaa

SEQ ID NO: 538093 - RNA, 24 nt, Human
cugauauuaagagaacuccuccau

SEQ ID NO: 538094 - RNA, 18 nt, Human
cuuaagugcaagagaagu

SEQ ID NO: 538095 - RNA, 18 nt, Human
cuuuagggguuccccagc

SEQ ID NO: 538096 - RNA, 24 nt, Human
cuuuuuuuuuuuuuuuuuuucggg

SEQ ID NO: 538097 - RNA, 22 nt, Human
gaaaacacaaauuuuaaaaaca

SEQ ID NO: 538098 - RNA, 19 nt, Human
gagaagugcuaucauuuua

SEQ ID NO: 538099 - RNA, 20 nt, Human
gagcccggagcggacaccgg

SEQ ID NO: 538100 - RNA, 20 nt, Human
gaggaggggguggggguggc

SEQ ID NO: 538101 - RNA, 21 nt, Human
gcaacuggccaucagacugaa

SEQ ID NO: 538102 - RNA, 23 nt, Human
gcacuaagccuugcuaaccgcgu

SEQ ID NO: 538103 - RNA, 23 nt, Human
gcuaugcaauuuucccucuaaaa

SEQ ID NO: 538104 - RNA, 23 nt, Human
gcucccgccaccgcuugaaccag

SEQ ID NO: 538105 - RNA, 22 nt, Human
gcucuuuuuguaaaguuuuccu

SEQ ID NO: 538106 - RNA, 24 nt, Human
ggaauccacaacaaauauuacccc

SEQ ID NO: 538107 - RNA, 18 nt, Human
ggaggagggggugggggu

SEQ ID NO: 538108 - RNA, 25 nt, Human
ggggguggggguggcguuggacucu

SEQ ID NO: 538109 - RNA, 25 nt, Human
gggguggcguuggacucucaggagc

SEQ ID NO: 538110 - RNA, 19 nt, Human
gggguggggguggcguugg

SEQ ID NO: 538111 - RNA, 18 nt, Human
guaaaguuuuccuucaga

SEQ ID NO: 538112 - RNA, 20 nt, Human
guaaaguuuuccuucagaag

SEQ ID NO: 538113 - RNA, 23 nt, Human
guaauucuuccagauuccccgaa

SEQ ID NO: 538114 - RNA, 22 nt, Human
uaaaaagauagcaaaaguauga

SEQ ID NO: 538115 - RNA, 21 nt, Human
uaaaacagaagucucuggacc

SEQ ID NO: 538116 - RNA, 25 nt, Human
uaaacagauagaaaacacaaauuuu

SEQ ID NO: 538117 - RNA, 23 nt, Human
uaaagaacaacgcuauuacaaaa

SEQ ID NO: 538118 - RNA, 21 nt, Human
uaacauauaacaaaauaggca

SEQ ID NO: 538119 - RNA, 19 nt, Human
uaagagaacuccuccauac

SEQ ID NO: 538120 - RNA, 23 nt, Human
uaaguaaauguuacaaaaagcua

SEQ ID NO: 538121 - RNA, 21 nt, Human
uaauuuaaacaaaucaucuau

SEQ ID NO: 538122 - RNA, 19 nt, Human
uaccucaagccauauaaau

SEQ ID NO: 538123 - RNA, 24 nt, Human
uagaaaacacaaauuuuaaaaaca

SEQ ID NO: 538124 - RNA, 25 nt, Human
uagaauaaagaucugagaaucuacu

SEQ ID NO: 538125 - RNA, 26 nt, Human
uagccaaggaacaaccugaccaaaga

SEQ ID NO: 538126 - RNA, 20 nt, Human
uaguaaacagauagaaaaca

SEQ ID NO: 538127 - RNA, 19 nt, Human
ucacugcagcuucugaugg

SEQ ID NO: 538128 - RNA, 28 nt, Human
ucacugcagcuucugaugggggcccucc

SEQ ID NO: 538129 - RNA, 20 nt, Human
ucagauacuagcacaugucu

SEQ ID NO: 538130 - RNA, 19 nt, Human
ucagugugguugcuaaguc

SEQ ID NO: 538131 - RNA, 26 nt, Human
uccccgaauucuuauuccaccuccua

SEQ ID NO: 538132 - RNA, 21 nt, Human
ucccgggucgcuccucccacc

SEQ ID NO: 538133 - RNA, 22 nt, Human
ucccucuaaaauccuuuucaaa

SEQ ID NO: 538134 - RNA, 20 nt, Human
ucgauauaaauuauuuuuau

SEQ ID NO: 538135 - RNA, 19 nt, Human
ucugucucaucuucauucu

SEQ ID NO: 538136 - RNA, 19 nt, Human
ucuuaagugcaagagaagu

SEQ ID NO: 538137 - RNA, 23 nt, Human
ucuuccagauuccccgaauucuu

SEQ ID NO: 538138 - RNA, 19 nt, Human
ugaaaaugucaaaauucag

SEQ ID NO: 538139 - RNA, 19 nt, Human
ugaaaucaaaugcuuuuac

SEQ ID NO: 538140 - RNA, 18 nt, Human
ugagaucacaucaugagc

SEQ ID NO: 538141 - RNA, 18 nt, Human
ugcaauuuucccucuaaa

SEQ ID NO: 538142 - RNA, 23 nt, Human
ugcuaagucccauguacaaacuc

SEQ ID NO: 538143 - RNA, 21 nt, Human
uguuaaaauacaccuggauuu

SEQ ID NO: 538144 - RNA, 23 nt, Human
uuaaugccuccuuauaauuuucu

SEQ ID NO: 538145 - RNA, 25 nt, Human
uucaaaguuuacauugucuuuucgu

SEQ ID NO: 538146 - RNA, 18 nt, Human
uuccaaugauggccgggg

SEQ ID NO: 538147 - RNA, 22 nt, Human
uuccaccucccaagucaaagag

SEQ ID NO: 538148 - RNA, 21 nt, Human
uuggaagucuagugacuuuag

SEQ ID NO: 538149 - RNA, 20 nt, Human
uuuaaccaugaaaaacacaa

SEQ ID NO: 538150 - RNA, 19 nt, Human
uuuccaguuuuucugccuu

SEQ ID NO: 538151 - RNA, 21 nt, Human
aaaaaaauagaaucuaugaaa

SEQ ID NO: 538152 - RNA, 23 nt, Human
aaagagguuguauuuacauguuu

SEQ ID NO: 538153 - RNA, 21 nt, Human
aaauauaaagugcauuuccau

SEQ ID NO: 538154 - RNA, 24 nt, Human
aacaggaggcuuuauuggacagaa

SEQ ID NO: 538155 - RNA, 19 nt, Human
aaccauuguaaacagagca

SEQ ID NO: 538156 - RNA, 23 nt, Human
accccacuuuucacagacaugaa

SEQ ID NO: 538157 - RNA, 27 nt, Human
agaaaaaccaccccaggugguaauggg

SEQ ID NO: 538158 - RNA, 18 nt, Human
agaaaacagcuguuggca

SEQ ID NO: 538159 - RNA, 25 nt, Human
agaaggacggacaggaguggcuaaa

SEQ ID NO: 538160 - RNA, 18 nt, Human
agaagguaauauugccgu

SEQ ID NO: 538161 - RNA, 21 nt, Human
agccugugaaaauuaaaucug

SEQ ID NO: 538162 - RNA, 23 nt, Human
aucaauucuaucauaaaaauaua

SEQ ID NO: 538163 - RNA, 21 nt, Human
auccagauggcaggauuugau

SEQ ID NO: 538164 - RNA, 18 nt, Human
auccugguuuccaaaagu

SEQ ID NO: 538165 - RNA, 19 nt, Human
auguauccacaaaacacaa

SEQ ID NO: 538166 - RNA, 19 nt, Human
auugaaugcuaaaccagcu

SEQ ID NO: 538167 - RNA, 24 nt, Human
caaaacacaaaccauuguaaacag

SEQ ID NO: 538168 - RNA, 23 nt, Human
caacacaaacacacagauguccc

SEQ ID NO: 538169 - RNA, 23 nt, Human
caacacaaacacacagauguccc

SEQ ID NO: 538170 - RNA, 22 nt, Human
caacagaaaacagcuguuggca

SEQ ID NO: 538171 - RNA, 26 nt, Human
cacacaaacauucacccauaugcaua

SEQ ID NO: 538172 - RNA, 21 nt, Human
cacacagacuuaugggagcac

SEQ ID NO: 538173 - RNA, 23 nt, Human
caccuuuuuaauuugugcuguuu

SEQ ID NO: 538174 - RNA, 24 nt, Human
caccuuuuuaauuugugcuguuug

SEQ ID NO: 538175 - RNA, 21 nt, Human
cagaaaacagcuguuggcaag

SEQ ID NO: 538176 - RNA, 20 nt, Human
cagagcaggcagcauuggcc

SEQ ID NO: 538177 - RNA, 18 nt, Human
cagcuguuggcaagugga

SEQ ID NO: 538178 - RNA, 20 nt, Human
caggaggacugaggauagca

SEQ ID NO: 538179 - RNA, 22 nt, Human
cauuacuaggagccuccaggag

SEQ ID NO: 538180 - RNA, 20 nt, Human
cauucacuccaacacaaaca

SEQ ID NO: 538181 - RNA, 21 nt, Human
cauuuagccagcuguccucuc

SEQ ID NO: 538182 - RNA, 21 nt, Human
cauuugcaggucacuuugucc

SEQ ID NO: 538183 - RNA, 26 nt, Human
ccaacacaaacacacagaugucccac

SEQ ID NO: 538184 - RNA, 24 nt, Human
ccagcauuaauaaugcacauccag

SEQ ID NO: 538185 - RNA, 22 nt, Human
cccacccauuuuccuaagaguc

SEQ ID NO: 538186 - RNA, 21 nt, Human
ccgcaaauguuucugcacucc

SEQ ID NO: 538187 - RNA, 23 nt, Human
cgacauacuauggcagaaggaga

SEQ ID NO: 538188 - RNA, 22 nt, Human
cucauuacuaggagccuccagg

SEQ ID NO: 538189 - RNA, 18 nt, Human
gagcacaggguuaugggc

SEQ ID NO: 538190 - RNA, 21 nt, Human
gaguuccccaccccacuuuuc

SEQ ID NO: 538191 - RNA, 21 nt, Human
gaucacgggcacacagacuua

SEQ ID NO: 538192 - RNA, 22 nt, Human
gcaggucacuuuguccccagga

SEQ ID NO: 538193 - RNA, 19 nt, Human
ggcaaguggauuacacaga

SEQ ID NO: 538194 - RNA, 19 nt, Human
ggcagaaggagagaucuau

SEQ ID NO: 538195 - RNA, 18 nt, Human
gggcacauucacuccaac

SEQ ID NO: 538196 - RNA, 19 nt, Human
gugaguuccccaccccacu

SEQ ID NO: 538197 - RNA, 19 nt, Human
guucucccauuggacacug

SEQ ID NO: 538198 - RNA, 23 nt, Human
uaacuggacucccuucuaucauc

SEQ ID NO: 538199 - RNA, 23 nt, Human
uagaagaaaguaaauguaaaacu

SEQ ID NO: 538200 - RNA, 20 nt, Human
ucaccuauaugcauaaaauc

SEQ ID NO: 538201 - RNA, 19 nt, Human
ucacgggcacacagacuua

SEQ ID NO: 538202 - RNA, 25 nt, Human
uccaacacaaacacacagauguccc

SEQ ID NO: 538203 - RNA, 19 nt, Human
uccacaaaacacaaaccau

SEQ ID NO: 538204 - RNA, 24 nt, Human
uccacaaaacacaaaccauuguaa

SEQ ID NO: 538205 - RNA, 22 nt, Human
uccagauggcaggauuugaucc

SEQ ID NO: 538206 - RNA, 19 nt, Human
uccccuggggaaauccuga

SEQ ID NO: 538207 - RNA, 25 nt, Human
uccccuggggaaauccugaugggga

SEQ ID NO: 538208 - RNA, 24 nt, Human
ugaaaaaaauagaaucuaugaaaa

SEQ ID NO: 538209 - RNA, 21 nt, Human
ugaagaaggacggacaggagu

SEQ ID NO: 538210 - RNA, 19 nt, Human
ugacacacaugagaggaug

SEQ ID NO: 538211 - RNA, 21 nt, Human
ugagaggaugcuaaacuuuug

SEQ ID NO: 538212 - RNA, 20 nt, Human
ugauauguauccacaaaaca

SEQ ID NO: 538213 - RNA, 24 nt, Human
uggaacaauuucagcuugcaaggg

SEQ ID NO: 538214 - RNA, 19 nt, Human
uggaugccccaagcuaugg

SEQ ID NO: 538215 - RNA, 27 nt, Human
uggcaggauuugauccuuucccugucg

SEQ ID NO: 538216 - RNA, 24 nt, Human
uggcuaaaguugucuacuggcauu

SEQ ID NO: 538217 - RNA, 20 nt, Human
ugggcacacaaacauucacc

SEQ ID NO: 538218 - RNA, 26 nt, Human
ugggcacacaaacauucacccauaug

SEQ ID NO: 538219 - RNA, 21 nt, Human
ugggcacauucacuccaacac

SEQ ID NO: 538220 - RNA, 23 nt, Human
ugggcacauucacuccaacacaa

SEQ ID NO: 538221 - RNA, 21 nt, Human
uguaaaacuacaauguugaca

SEQ ID NO: 538222 - RNA, 22 nt, Human
uguggcgaaaugaguguguucc

SEQ ID NO: 538223 - RNA, 22 nt, Human
uucacagacaugaaaaaaauag

SEQ ID NO: 538224 - RNA, 19 nt, Human
uugaaugcuaaaccagcug

SEQ ID NO: 538225 - RNA, 20 nt, Human
uuucugcacuccaaaagagg

SEQ ID NO: 538226 - RNA, 23 nt, Human
uuuuuuuuuuuuuuuauaacagg

SEQ ID NO: 538227 - RNA, 22 nt, Human
aaaccagccuuagauugguuug

SEQ ID NO: 538228 - RNA, 19 nt, Human
aaucuucgaaaccagacaa

SEQ ID NO: 538229 - RNA, 23 nt, Human
agacaaugcucggagaacaguac

SEQ ID NO: 538230 - RNA, 19 nt, Human
aguccccgugaaucuauga

SEQ ID NO: 538231 - RNA, 19 nt, Human
cgaaaccagacaaugcucg

SEQ ID NO: 538232 - RNA, 27 nt, Human
cugcaucaucucauuuaauccucacaa

SEQ ID NO: 538233 - RNA, 20 nt, Human
cuggaaaaucuucgaaacca

SEQ ID NO: 538234 - RNA, 24 nt, Human
gaaaaucuucgaaaccagacaaug

SEQ ID NO: 538235 - RNA, 27 nt, Human
gagaacaguacagagagaccgguaccc

SEQ ID NO: 538236 - RNA, 18 nt, Human
gaggaaaccagccuuaga

SEQ ID NO: 538237 - RNA, 25 nt, Human
uaugaucgaaccuuuaauauuugcc

SEQ ID NO: 538238 - RNA, 21 nt, Human
ugaaauuaauagaaauaagac

SEQ ID NO: 538239 - RNA, 20 nt, Human
ugagcacuggagaaagcaau

SEQ ID NO: 538240 - RNA, 18 nt, Human
ugcacagaugaggaaacc

SEQ ID NO: 538241 - RNA, 20 nt, Human
ugcaucaucucauuuaaucc

SEQ ID NO: 538242 - RNA, 24 nt, Human
uggaaaccucaccuuuuauaagaa

SEQ ID NO: 538243 - RNA, 19 nt, Human
uguagaugcuauuauuagc

SEQ ID NO: 538244 - RNA, 18 nt, Human
aagcaggcuggguggggg

SEQ ID NO: 538245 - RNA, 23 nt, Human
aagcaggcugggugggggcaggc

SEQ ID NO: 538246 - RNA, 22 nt, Human
acacuauguacauuguugugcu

SEQ ID NO: 538247 - RNA, 23 nt, Human
accccgaggccucugcuugaagc

SEQ ID NO: 538248 - RNA, 24 nt, Human
acuggagccaaaggcccaggggac

SEQ ID NO: 538249 - RNA, 24 nt, Human
agagccagcccugccagaugcccc

SEQ ID NO: 538250 - RNA, 23 nt, Human
agagcccacccacccaccuuggc

SEQ ID NO: 538251 - RNA, 23 nt, Human
agagggagguggcaagggcugcc

SEQ ID NO: 538252 - RNA, 21 nt, Human
agaucaggcaagaagggagac

SEQ ID NO: 538253 - RNA, 21 nt, Human
agcaaaaaccguucugcagca

SEQ ID NO: 538254 - RNA, 23 nt, Human
agcaaaaaccguucugcagcagc

SEQ ID NO: 538255 - RNA, 19 nt, Human
agcaggcuuggcagaggga

SEQ ID NO: 538256 - RNA, 24 nt, Human
agccgcaacucgucacaaggcccg

SEQ ID NO: 538257 - RNA, 23 nt, Human
agcgcagcccgcuagagaaucuu

SEQ ID NO: 538258 - RNA, 20 nt, Human
agcuccaggcccccaagagg

SEQ ID NO: 538259 - RNA, 21 nt, Human
agcuccaggcccccaagaggc

SEQ ID NO: 538260 - RNA, 23 nt, Human
agcucccccaccccgaggccucu

SEQ ID NO: 538261 - RNA, 20 nt, Human
agcuggaagacaugguugcu

SEQ ID NO: 538262 - RNA, 21 nt, Human
aggaucaaugcuggacaagaa

SEQ ID NO: 538263 - RNA, 20 nt, Human
aggcaagaagggagacuuga

SEQ ID NO: 538264 - RNA, 19 nt, Human
aggggccacuggagccaaa

SEQ ID NO: 538265 - RNA, 23 nt, Human
aggugugaggcugugagaccagg

SEQ ID NO: 538266 - RNA, 18 nt, Human
agguguguuuugggggag

SEQ ID NO: 538267 - RNA, 26 nt, Human
agguguguuuugggggagguuuggga

SEQ ID NO: 538268 - RNA, 18 nt, Human
caaaaaccguucugcagc

SEQ ID NO: 538269 - RNA, 20 nt, Human
caccccaucgcgcacaggga

SEQ ID NO: 538270 - RNA, 20 nt, Human
cagagcaggggaacuuggga

SEQ ID NO: 538271 - RNA, 19 nt, Human
cagcuggcuccccucuccu

SEQ ID NO: 538272 - RNA, 18 nt, Human
caggcuuggcagagggag

SEQ ID NO: 538273 - RNA, 22 nt, Human
ccacccacccaccuuggccagg

SEQ ID NO: 538274 - RNA, 19 nt, Human
ccacuggagccaaaggccc

SEQ ID NO: 538275 - RNA, 21 nt, Human
ccaggcacggacagggacugg

SEQ ID NO: 538276 - RNA, 21 nt, Human
ccgaagcucacugucccccac

SEQ ID NO: 538277 - RNA, 18 nt, Human
ccgggcuugggguaaaca

SEQ ID NO: 538278 - RNA, 21 nt, Human
ccucccaucgagcacagggcu

SEQ ID NO: 538279 - RNA, 23 nt, Human
ccucugcuugaagcugggguggg

SEQ ID NO: 538280 - RNA, 19 nt, Human
ccugccagaugcccagcuc

SEQ ID NO: 538281 - RNA, 19 nt, Human
ccugggagccccucccauc

SEQ ID NO: 538282 - RNA, 20 nt, Human
ccugggagccccucccaucg

SEQ ID NO: 538283 - RNA, 20 nt, Human
ccuuggccaggccgaagcuc

SEQ ID NO: 538284 - RNA, 22 nt, Human
cgaagcucacugucccccaccc

SEQ ID NO: 538285 - RNA, 23 nt, Human
cgcuagagaaucuuuacacagag

SEQ ID NO: 538286 - RNA, 18 nt, Human
cggcugggcugccagagc

SEQ ID NO: 538287 - RNA, 19 nt, Human
cgggugucccauggggcug

SEQ ID NO: 538288 - RNA, 21 nt, Human
cgggugucccauggggcuggg

SEQ ID NO: 538289 - RNA, 18 nt, Human
cucccccaccccgaggcc

SEQ ID NO: 538290 - RNA, 23 nt, Human
cucguggugguagcacuugaauu

SEQ ID NO: 538291 - RNA, 23 nt, Human
cugcagcagcaggcuuggcagag

SEQ ID NO: 538292 - RNA, 22 nt, Human
cugggcaugaagggcagggcug

SEQ ID NO: 538293 - RNA, 20 nt, Human
cugugagcguguccccgccu

SEQ ID NO: 538294 - RNA, 19 nt, Human
gacaagaagcaggcugggu

SEQ ID NO: 538295 - RNA, 18 nt, Human
gacagagccagcccugcc

SEQ ID NO: 538296 - RNA, 22 nt, Human
gacaugguugcuuacagccagg

SEQ ID NO: 538297 - RNA, 26 nt, Human
gagccaaaggcccaggggacagagcc

SEQ ID NO: 538298 - RNA, 22 nt, Human
gagccccucccaucgagcacag

SEQ ID NO: 538299 - RNA, 19 nt, Human
gagcgcagcccgcuagaga

SEQ ID NO: 538300 - RNA, 20 nt, Human
gagcguguccccgccgggcc

SEQ ID NO: 538301 - RNA, 23 nt, Human
gagcguguccccgccgggcuugg

SEQ ID NO: 538302 - RNA, 18 nt, Human
gagguugggcuugagauc

SEQ ID NO: 538303 - RNA, 22 nt, Human
gcagucccguggggccaggcac

SEQ ID NO: 538304 - RNA, 22 nt, Human
gcaugaagggcagggcuguggu

SEQ ID NO: 538305 - RNA, 22 nt, Human
gcccacucaggccagguuggcu

SEQ ID NO: 538306 - RNA, 18 nt, Human
gcccaggggacagagcca

SEQ ID NO: 538307 - RNA, 21 nt, Human
gcccaguggaggaguuguuga

SEQ ID NO: 538308 - RNA, 24 nt, Human
gcccccaagaggcugccauucagc

SEQ ID NO: 538309 - RNA, 20 nt, Human
gcggcagaaggcucuggcuc

SEQ ID NO: 538310 - RNA, 22 nt, Human
gcgugggguucccuggcagugg

SEQ ID NO: 538311 - RNA, 24 nt, Human
ggacaagaagcaggcugggugggg

SEQ ID NO: 538312 - RNA, 18 nt, Human
ggacaaggugugaggcug

SEQ ID NO: 538313 - RNA, 24 nt, Human
ggagacuugaccucuugguuuggu

SEQ ID NO: 538314 - RNA, 18 nt, Human
gggcagggcuguggugac

SEQ ID NO: 538315 - RNA, 22 nt, Human
ggggaacuugggagcgcagccc

SEQ ID NO: 538316 - RNA, 21 nt, Human
ggggacagagccagcccugcc

SEQ ID NO: 538317 - RNA, 23 nt, Human
gggggagguuugggaaagaccac

SEQ ID NO: 538318 - RNA, 20 nt, Human
gggucauggguggcgugggg

SEQ ID NO: 538319 - RNA, 20 nt, Human
ggugucccauggggcugggc

SEQ ID NO: 538320 - RNA, 19 nt, Human
guccccgccgggcuugggg

SEQ ID NO: 538321 - RNA, 19 nt, Human
guuuugggggagguuuggg

SEQ ID NO: 538322 - RNA, 18 nt, Human
uagcccgggauggaacgg

SEQ ID NO: 538323 - RNA, 19 nt, Human
ucagcaaaaaccguucugc

SEQ ID NO: 538324 - RNA, 23 nt, Human
ucagcaaaaaccguucugcagca

SEQ ID NO: 538325 - RNA, 24 nt, Human
ucgagcacagggcugcuuccaauu

SEQ ID NO: 538326 - RNA, 20 nt, Human
ugacauguaagggacgcugc

SEQ ID NO: 538327 - RNA, 21 nt, Human
ugagauguguguguggacaag

SEQ ID NO: 538328 - RNA, 22 nt, Human
ugagguugggcuugagaucagg

SEQ ID NO: 538329 - RNA, 21 nt, Human
ugagugcaaggaguugagguu

SEQ ID NO: 538330 - RNA, 24 nt, Human
ugcaggcggaagggcuccaggacc

SEQ ID NO: 538331 - RNA, 20 nt, Human
ugcccagcucugcccagugg

SEQ ID NO: 538332 - RNA, 24 nt, Human
uggaacggguaggcccacucaggc

SEQ ID NO: 538333 - RNA, 21 nt, Human
uggaagacaugguugcuuaca

SEQ ID NO: 538334 - RNA, 20 nt, Human
uggaaggacaaggugugagg

SEQ ID NO: 538335 - RNA, 21 nt, Human
uggcaagggcugccggccugg

SEQ ID NO: 538336 - RNA, 24 nt, Human
uggcagagggagguggcaagggcu

SEQ ID NO: 538337 - RNA, 25 nt, Human
uggcagagggagguggcaagggcug

SEQ ID NO: 538338 - RNA, 21 nt, Human
uggcgugggguucccuggcag

SEQ ID NO: 538339 - RNA, 19 nt, Human
ugggaaagaccaccgggug

SEQ ID NO: 538340 - RNA, 23 nt, Human
uggggccaggcacggacagggac

SEQ ID NO: 538341 - RNA, 22 nt, Human
ugggggcaggcagggguggaag

SEQ ID NO: 538342 - RNA, 24 nt, Human
ugggggcaggcagggguggaagga

SEQ ID NO: 538343 - RNA, 21 nt, Human
uguguggacaaggcuggacag

SEQ ID NO: 538344 - RNA, 23 nt, Human
uguguggacaaggcuggacaggg

SEQ ID NO: 538345 - RNA, 18 nt, Human
uguguguggacaaggcug

SEQ ID NO: 538346 - RNA, 22 nt, Human
uuaaaaaacacagcuguacuaa

SEQ ID NO: 538347 - RNA, 22 nt, Human
uuccaagagcuggacugcuggg

SEQ ID NO: 538348 - RNA, 22 nt, Human
uucccuggcaguggggaacugg

SEQ ID NO: 538349 - RNA, 22 nt, Human
uucuucacuuucacagagcagg

SEQ ID NO: 538350 - RNA, 18 nt, Human
uugggaaagaccaccggg

SEQ ID NO: 538351 - RNA, 19 nt, Human
uuucacagagcaggggaac

SEQ ID NO: 538352 - RNA, 20 nt, Human
uuuuuuuuuuuuuuggcuuu

SEQ ID NO: 538353 - RNA, 18 nt, Human
uuuuuuuuuuuuuuuuug

SEQ ID NO: 538354 - RNA, 24 nt, Human
uuuuuuuuuuuuuuuuuuggcuuu

SEQ ID NO: 538355 - RNA, 22 nt, Human
uuuuuuuuuuuuuuuuuuuggc

SEQ ID NO: 538356 - RNA, 22 nt, Human
aaaaaaaaaaaaaaaggucaag

SEQ ID NO: 538357 - RNA, 20 nt, Human
aaaacaacaaaacuaaagag

SEQ ID NO: 538358 - RNA, 18 nt, Human
aaaauuagcugggcgugg

SEQ ID NO: 538359 - RNA, 23 nt, Human
aaacaacaaaacuaaagagacau

SEQ ID NO: 538360 - RNA, 18 nt, Human
aaacuaaaacaaaaacca

SEQ ID NO: 538361 - RNA, 19 nt, Human
aaacuaaaacaaaaaccaa

SEQ ID NO: 538362 - RNA, 25 nt, Human
aaacuaaaacaaaaaccaaaucccu

SEQ ID NO: 538363 - RNA, 24 nt, Human
aaagugcugggauuacaggcguga

SEQ ID NO: 538364 - RNA, 28 nt, Human
aacaacaaaaacaacaaaacuaaagaga

SEQ ID NO: 538365 - RNA, 23 nt, Human
aacagaaagaccccuuccacaga

SEQ ID NO: 538366 - RNA, 19 nt, Human
aacauggucaaaccccauc

SEQ ID NO: 538367 - RNA, 20 nt, Human
aacauggucaaaccccaucu

SEQ ID NO: 538368 - RNA, 21 nt, Human
aacauggucaaaccccaucuc

SEQ ID NO: 538369 - RNA, 20 nt, Human
aaccucugccgccagggcuc

SEQ ID NO: 538370 - RNA, 23 nt, Human
aagagcaaaacucugucucaaaa

SEQ ID NO: 538371 - RNA, 21 nt, Human
aagcggcccacccacaggcgg

SEQ ID NO: 538372 - RNA, 24 nt, Human
aagcugaggcaggagaaucgcuug

SEQ ID NO: 538373 - RNA, 24 nt, Human
aaggccagguggaucacaagguca

SEQ ID NO: 538374 - RNA, 19 nt, Human
aagggguuucaccauguug

SEQ ID NO: 538375 - RNA, 24 nt, Human
aagggguuucaccauguugcccag

SEQ ID NO: 538376 - RNA, 19 nt, Human
aagugcugggauuacaggc

SEQ ID NO: 538377 - RNA, 19 nt, Human
aagugcugggauuacaggc

SEQ ID NO: 538378 - RNA, 26 nt, Human
aagugcugggauuacaggcgugagcc

SEQ ID NO: 538379 - RNA, 23 nt, Human
aauagcugggauuacaggcgcgu

SEQ ID NO: 538380 - RNA, 24 nt, Human
aaucgcuugaacucaagaggugga

SEQ ID NO: 538381 - RNA, 19 nt, Human
acaaaaaaaauuuuuacag

SEQ ID NO: 538382 - RNA, 21 nt, Human
acaaaaacaacaaaacuaaag

SEQ ID NO: 538383 - RNA, 25 nt, Human
acaaaaacaacaaaacuaaagagac

SEQ ID NO: 538384 - RNA, 19 nt, Human
acaaaacuaaagagacaug

SEQ ID NO: 538385 - RNA, 21 nt, Human
acaaaacuaaagagacaugcu

SEQ ID NO: 538386 - RNA, 19 nt, Human
acaaucagguauacaacua

SEQ ID NO: 538387 - RNA, 24 nt, Human
acacaaccacgaaacggcccaacc

SEQ ID NO: 538388 - RNA, 19 nt, Human
acauaaaucuaccacuuac

SEQ ID NO: 538389 - RNA, 21 nt, Human
accagcaucccuggcaacccc

SEQ ID NO: 538390 - RNA, 19 nt, Human
accauguugcccagggugg

SEQ ID NO: 538391 - RNA, 24 nt, Human
accccaucucuacuaaaaauacaa

SEQ ID NO: 538392 - RNA, 18 nt, Human
acugcacuccagccuggg

SEQ ID NO: 538393 - RNA, 25 nt, Human
acugcacuccagccugggugacaag

SEQ ID NO: 538394 - RNA, 21 nt, Human
agaaaagagugauauugaugc

SEQ ID NO: 538395 - RNA, 22 nt, Human
agacagaauaaagaaaauuguu

SEQ ID NO: 538396 - RNA, 20 nt, Human
agagaagggguuucaccaug

SEQ ID NO: 538397 - RNA, 18 nt, Human
agagcaaaacucugucuc

SEQ ID NO: 538398 - RNA, 18 nt, Human
agccucccgaauagcugg

SEQ ID NO: 538399 - RNA, 20 nt, Human
agcugggcgugguggcgcac

SEQ ID NO: 538400 - RNA, 21 nt, Human
aggcaggagaaucgcuugaac

SEQ ID NO: 538401 - RNA, 23 nt, Human
aggcaggagaaucgcuugaacuc

SEQ ID NO: 538402 - RNA, 24 nt, Human
aggccaaggccagguggaucacaa

SEQ ID NO: 538403 - RNA, 24 nt, Human
aggccagguggaucacaaggucag

SEQ ID NO: 538404 - RNA, 24 nt, Human
agggguuucaccauguugcccagg

SEQ ID NO: 538405 - RNA, 24 nt, Human
agguggacguugcagugagcugag

SEQ ID NO: 538406 - RNA, 19 nt, Human
agguggaucacaaggucag

SEQ ID NO: 538407 - RNA, 22 nt, Human
agguggaucacaaggucaggau

SEQ ID NO: 538408 - RNA, 22 nt, Human
aguagagaagggguuucaccau

SEQ ID NO: 538409 - RNA, 22 nt, Human
agugcagugggcgaucuuggcu

SEQ ID NO: 538410 - RNA, 23 nt, Human
agugcagugggcgaucuuggcuc

SEQ ID NO: 538411 - RNA, 18 nt, Human
agugcugggauuacaggc

SEQ ID NO: 538412 - RNA, 24 nt, Human
auagacagaauaaagaaaauuguu

SEQ ID NO: 538413 - RNA, 18 nt, Human
auagcugggauuacaggc

SEQ ID NO: 538414 - RNA, 20 nt, Human
auauaaaucagauaguaaua

SEQ ID NO: 538415 - RNA, 30 nt, Human
aucuuauucuuuucuucaauuuucuccaag

SEQ ID NO: 538416 - RNA, 22 nt, Human
augagaacauucagccauaauc

SEQ ID NO: 538417 - RNA, 19 nt, Human
auuacaggcgcgugccacc

SEQ ID NO: 538418 - RNA, 24 nt, Human
auugcgccacugcacuccagccug

SEQ ID NO: 538419 - RNA, 24 nt, Human
auuuuaguagagaagggguuucac

SEQ ID NO: 538420 - RNA, 21 nt, Human
caaaaacaacaaaacuaaaga

SEQ ID NO: 538421 - RNA, 28 nt, Human
caaaaacaacaaaacuaaagagacaugc

SEQ ID NO: 538422 - RNA, 24 nt, Human
caaagugcugggauuacaggcgug

SEQ ID NO: 538423 - RNA, 18 nt, Human
caacaaaaacaacaaaac

SEQ ID NO: 538424 - RNA, 22 nt, Human
caacaaaaacaacaaaacuaaa

SEQ ID NO: 538425 - RNA, 26 nt, Human
caacaaaaacaacaaaacuaaagaga

SEQ ID NO: 538426 - RNA, 24 nt, Human
caaggccagguggaucacaagguc

SEQ ID NO: 538427 - RNA, 23 nt, Human
caagucccacagcuacuuucucc

SEQ ID NO: 538428 - RNA, 19 nt, Human
cacacaaccacgaaacggc

SEQ ID NO: 538429 - RNA, 19 nt, Human
cacaugcuacauaacauuu

SEQ ID NO: 538430 - RNA, 24 nt, Human
caccaccugggaagcugaggcagg

SEQ ID NO: 538431 - RNA, 18 nt, Human
caccauguugcccagggu

SEQ ID NO: 538432 - RNA, 24 nt, Human
caccauguugcccaggguggucuc

SEQ ID NO: 538433 - RNA, 27 nt, Human
caccauguugcccaggguggucucgaa

SEQ ID NO: 538434 - RNA, 19 nt, Human
caccgcgcuaccgcgcagc

SEQ ID NO: 538435 - RNA, 19 nt, Human
caccucaccgcgcuaccgc

SEQ ID NO: 538436 - RNA, 24 nt, Human
cacgccuguaaucccagcacuuug

SEQ ID NO: 538437 - RNA, 20 nt, Human
cacuccagccugggugacaa

SEQ ID NO: 538438 - RNA, 21 nt, Human
cacuccagccugggugacaag

SEQ ID NO: 538439 - RNA, 24 nt, Human
cacuccagccugggugacaagagc

SEQ ID NO: 538440 - RNA, 24 nt, Human
cacucuguagcccaaccuggagug

SEQ ID NO: 538441 - RNA, 19 nt, Human
cacugcacuccagccuggg

SEQ ID NO: 538442 - RNA, 21 nt, Human
cacugcacuccagccugggug

SEQ ID NO: 538443 - RNA, 22 nt, Human
cacugcacuccagccuggguga

SEQ ID NO: 538444 - RNA, 23 nt, Human
cacugcacuccagccugggugac

SEQ ID NO: 538445 - RNA, 24 nt, Human
cacugcacuccagccugggugaca

SEQ ID NO: 538446 - RNA, 25 nt, Human
cacugcacuccagccugggugacaa

SEQ ID NO: 538447 - RNA, 21 nt, Human
cacuuuaccagcgcacucuuc

SEQ ID NO: 538448 - RNA, 20 nt, Human
cagcacuuugggaggccaag

SEQ ID NO: 538449 - RNA, 23 nt, Human
cagcacuuugggaggccaaggcc

SEQ ID NO: 538450 - RNA, 24 nt, Human
cagcagccggagcccaacagcuga

SEQ ID NO: 538451 - RNA, 20 nt, Human
cagcgcacucuucgcugaag

SEQ ID NO: 538452 - RNA, 21 nt, Human
cagcuacuuucucccaaucuu

SEQ ID NO: 538453 - RNA, 19 nt, Human
cagcucagggacccagcgg

SEQ ID NO: 538454 - RNA, 18 nt, Human
caggaugaucccgggcuu

SEQ ID NO: 538455 - RNA, 23 nt, Human
cauauacaagcauaaugcuuaca

SEQ ID NO: 538456 - RNA, 23 nt, Human
caucaacaacaaaaacaacaaaa

SEQ ID NO: 538457 - RNA, 20 nt, Human
caucccuggcaaccccccaa

SEQ ID NO: 538458 - RNA, 18 nt, Human
cauggucaaaccccaucu

SEQ ID NO: 538459 - RNA, 21 nt, Human
cauguugcccaggguggucuc

SEQ ID NO: 538460 - RNA, 24 nt, Human
cauguugcccaggguggucucgaa

SEQ ID NO: 538461 - RNA, 22 nt, Human
ccaaagugcugggauuacaggc

SEQ ID NO: 538462 - RNA, 22 nt, Human
ccaaagugcugggauuacaggc

SEQ ID NO: 538463 - RNA, 24 nt, Human
ccaaagugcugggauuacaggcgu

SEQ ID NO: 538464 - RNA, 21 nt, Human
ccacaccaguuaaaaaaggug

SEQ ID NO: 538465 - RNA, 20 nt, Human
ccaccacgcccagcuaauuu

SEQ ID NO: 538466 - RNA, 20 nt, Human
ccacugcacuccagccuggg

SEQ ID NO: 538467 - RNA, 20 nt, Human
ccacugcacuccagccuggg

SEQ ID NO: 538468 - RNA, 21 nt, Human
ccacugcacuccagccugggu

SEQ ID NO: 538469 - RNA, 21 nt, Human
ccacugcacuccagccugggu

SEQ ID NO: 538470 - RNA, 23 nt, Human
ccacugcacuccagccuggguga

SEQ ID NO: 538471 - RNA, 24 nt, Human
ccacugcacuccagccugggugac

SEQ ID NO: 538472 - RNA, 22 nt, Human
ccagccagcucagggacccagc

SEQ ID NO: 538473 - RNA, 20 nt, Human
ccagggcucaagcgauucuc

SEQ ID NO: 538474 - RNA, 19 nt, Human
ccaugcguaagugcccuau

SEQ ID NO: 538475 - RNA, 21 nt, Human
cccacagcuacuuucucccaa

SEQ ID NO: 538476 - RNA, 21 nt, Human
ccccagagcagccgaguuggc

SEQ ID NO: 538477 - RNA, 25 nt, Human
ccccagcagccggagcccaacagcu

SEQ ID NO: 538478 - RNA, 19 nt, Human
ccccccaagucucagcucc

SEQ ID NO: 538479 - RNA, 20 nt, Human
ccccuagacagcccgcgcuc

SEQ ID NO: 538480 - RNA, 23 nt, Human
cccgaauagcugggauuacaggc

SEQ ID NO: 538481 - RNA, 24 nt, Human
cccgaauagcugggauuacaggcg

SEQ ID NO: 538482 - RNA, 24 nt, Human
cccgcgcuccagccagcucaggga

SEQ ID NO: 538483 - RNA, 24 nt, Human
ccgccucgaccucccaaagugcug

SEQ ID NO: 538484 - RNA, 22 nt, Human
ccgcgcccggccuaaauuauca

SEQ ID NO: 538485 - RNA, 23 nt, Human
ccuaucuccaagucccacagcua

SEQ ID NO: 538486 - RNA, 22 nt, Human
ccucaccucaccgcgcuaccgc

SEQ ID NO: 538487 - RNA, 24 nt, Human
ccuggccaacauggucaaacccca

SEQ ID NO: 538488 - RNA, 22 nt, Human
ccuguaaucccagcacuuuggg

SEQ ID NO: 538489 - RNA, 24 nt, Human
cgaaacggcccaaccauuucucau

SEQ ID NO: 538490 - RNA, 24 nt, Human
cgagaccauccuggccaacauggu

SEQ ID NO: 538491 - RNA, 26 nt, Human
cgccacugcacuccagccugggugac

SEQ ID NO: 538492 - RNA, 24 nt, Human
cgccucgaccucccaaagugcugg

SEQ ID NO: 538493 - RNA, 21 nt, Human
cgcgugccaccacgcccagcu

SEQ ID NO: 538494 - RNA, 23 nt, Human
cuaacauaaaucuaccacuuacc

SEQ ID NO: 538495 - RNA, 24 nt, Human
cucaaaaaaaaaaaaaaaggucaa

SEQ ID NO: 538496 - RNA, 22 nt, Human
cucacgccuguaaucccagcac

SEQ ID NO: 538497 - RNA, 24 nt, Human
cucacgccuguaaucccagcacuu

SEQ ID NO: 538498 - RNA, 18 nt, Human
cucacugcaaccucugcc

SEQ ID NO: 538499 - RNA, 18 nt, Human
cuccaugcguaagugccc

SEQ ID NO: 538500 - RNA, 24 nt, Human
cucccgaauagcugggauuacagg

SEQ ID NO: 538501 - RNA, 19 nt, Human
cuccgucucaaaaaaaaaa

SEQ ID NO: 538502 - RNA, 25 nt, Human
cucgggccucagccucccgaauagc

SEQ ID NO: 538503 - RNA, 22 nt, Human
cucuuguagucccagcuacagg

SEQ ID NO: 538504 - RNA, 20 nt, Human
cugaggucgccgccccuaga

SEQ ID NO: 538505 - RNA, 20 nt, Human
cugcaaccucugccgccagg

SEQ ID NO: 538506 - RNA, 24 nt, Human
cugcaaccucugccgccagggcuc

SEQ ID NO: 538507 - RNA, 23 nt, Human
cuggccaacauggucaaacccca

SEQ ID NO: 538508 - RNA, 25 nt, Human
cuuaccgcgcacgaaucccccagaa

SEQ ID NO: 538509 - RNA, 24 nt, Human
cuuaguuuauaacaacaaaaaaaa

SEQ ID NO: 538510 - RNA, 22 nt, Human
gaagggguuucaccauguugcc

SEQ ID NO: 538511 - RNA, 26 nt, Human
gaauagcugggauuacaggcgcgugc

SEQ ID NO: 538512 - RNA, 23 nt, Human
gacguugcagugagcugagauug

SEQ ID NO: 538513 - RNA, 23 nt, Human
gagauugcgccacugcacuccag

SEQ ID NO: 538514 - RNA, 24 nt, Human
gagcagccgaguuggcgagccggg

SEQ ID NO: 538515 - RNA, 25 nt, Human
gagccaagaaaacaauauaaccaaa

SEQ ID NO: 538516 - RNA, 22 nt, Human
gaucugcccgccucgaccuccc

SEQ ID NO: 538517 - RNA, 18 nt, Human
gauguggaggaagaaaag

SEQ ID NO: 538518 - RNA, 18 nt, Human
gauuacaggcgcgugcca

SEQ ID NO: 538519 - RNA, 18 nt, Human
gauuacaggcgugagcca

SEQ ID NO: 538520 - RNA, 22 nt, Human
gauuacaggcgugagccaccgc

SEQ ID NO: 538521 - RNA, 22 nt, Human
gauuacaggcgugagccaccgc

SEQ ID NO: 538522 - RNA, 21 nt, Human
gauucucgggccucagccucc

SEQ ID NO: 538523 - RNA, 24 nt, Human
gccaacauggucaaaccccaucuc

SEQ ID NO: 538524 - RNA, 19 nt, Human
gccaagcggcccacccaca

SEQ ID NO: 538525 - RNA, 19 nt, Human
gccacugcacuccagccug

SEQ ID NO: 538526 - RNA, 24 nt, Human
gccacugcacuccagccuggguga

SEQ ID NO: 538527 - RNA, 23 nt, Human
gcccagcuaauuuuuuguauuuu

SEQ ID NO: 538528 - RNA, 23 nt, Human
gccucagccucccgaauagcugg

SEQ ID NO: 538529 - RNA, 24 nt, Human
gcgauucucgggccucagccuccc

SEQ ID NO: 538530 - RNA, 18 nt, Human
gcgugccaccacgcccag

SEQ ID NO: 538531 - RNA, 21 nt, Human
gcuaccgacagcccugcaagc

SEQ ID NO: 538532 - RNA, 21 nt, Human
ggaagaaaagagugauauuga

SEQ ID NO: 538533 - RNA, 22 nt, Human
ggaccgaagcuguucaaaagga

SEQ ID NO: 538534 - RNA, 18 nt, Human
ggacguugcagugagcug

SEQ ID NO: 538535 - RNA, 24 nt, Human
ggacguugcagugagcugagauug

SEQ ID NO: 538536 - RNA, 24 nt, Human
ggagaucugcccgccucgaccucc

SEQ ID NO: 538537 - RNA, 24 nt, Human
ggccagguggaucacaaggucagg

SEQ ID NO: 538538 - RNA, 19 nt, Human
ggcccacccacaggcggau

SEQ ID NO: 538539 - RNA, 19 nt, Human
ggcuccaacauaaaaugga

SEQ ID NO: 538540 - RNA, 20 nt, Human
ggcucuggguuaucaagagg

SEQ ID NO: 538541 - RNA, 22 nt, Human
gggguuucaccauguugcccag

SEQ ID NO: 538542 - RNA, 23 nt, Human
gggguuucaccauguugcccagg

SEQ ID NO: 538543 - RNA, 23 nt, Human
gguaugguggcucacgccuguaa

SEQ ID NO: 538544 - RNA, 20 nt, Human
ggucucgaacuccugagcuc

SEQ ID NO: 538545 - RNA, 24 nt, Human
gguggcucacgccuguaaucccag

SEQ ID NO: 538546 - RNA, 23 nt, Human
gguggucucgaacuccugagcuc

SEQ ID NO: 538547 - RNA, 31 nt, Human
gguuauuaccuuauuuuuaauaaacuuagaa

SEQ ID NO: 538548 - RNA, 22 nt, Human
guaaacaaaccugggaugccag

SEQ ID NO: 538549 - RNA, 18 nt, Human
gucacuuacauacuaccu

SEQ ID NO: 538550 - RNA, 21 nt, Human
gucucaaaaaaaaaaaaaaag

SEQ ID NO: 538551 - RNA, 19 nt, Human
gugcagugggcgaucuugg

SEQ ID NO: 538552 - RNA, 20 nt, Human
guggacguugcagugagcug

SEQ ID NO: 538553 - RNA, 24 nt, Human
gugggccggguaugguggcucacg

SEQ ID NO: 538554 - RNA, 21 nt, Human
guuaugucuaaguucugucuc

SEQ ID NO: 538555 - RNA, 22 nt, Human
uaaaacaaaaaccaaaucccug

SEQ ID NO: 538556 - RNA, 24 nt, Human
uaaaacaaaaaccaaaucccuguu

SEQ ID NO: 538557 - RNA, 24 nt, Human
uaaaauggaaaaaaguuuugguca

SEQ ID NO: 538558 - RNA, 19 nt, Human
uaaccaaaaauucauuugu

SEQ ID NO: 538559 - RNA, 19 nt, Human
uaacucgugaagcgggccu

SEQ ID NO: 538560 - RNA, 22 nt, Human
uaagauauauuucacaccaaaa

SEQ ID NO: 538561 - RNA, 23 nt, Human
uaauuuuuuguauuuuaguagag

SEQ ID NO: 538562 - RNA, 24 nt, Human
uaauuuuuuguauuuuaguagaga

SEQ ID NO: 538563 - RNA, 24 nt, Human
uacaggcgcgugccaccacgccca

SEQ ID NO: 538564 - RNA, 23 nt, Human
uacaggcgugagccaccgcgccc

SEQ ID NO: 538565 - RNA, 21 nt, Human
uacuuucucccaaucuucuug

SEQ ID NO: 538566 - RNA, 22 nt, Human
uagagaagggguuucaccaugu

SEQ ID NO: 538567 - RNA, 20 nt, Human
uagauacacaccauccuuuu

SEQ ID NO: 538568 - RNA, 25 nt, Human
uagccaucaacaacaaaaacaacaa

SEQ ID NO: 538569 - RNA, 19 nt, Human
uaggagaugacagcuccau

SEQ ID NO: 538570 - RNA, 26 nt, Human
uaguaacagaaagaccccuuccacag

SEQ ID NO: 538571 - RNA, 24 nt, Human
uaguagagaagggguuucaccaug

SEQ ID NO: 538572 - RNA, 19 nt, Human
uaguguacaguaauacccu

SEQ ID NO: 538573 - RNA, 21 nt, Human
uaucaccuuuuaagaccagca

SEQ ID NO: 538574 - RNA, 21 nt, Human
uaucuccaagucccacagcua

SEQ ID NO: 538575 - RNA, 19 nt, Human
ucaaaaaaaaaaaaaaagg

SEQ ID NO: 538576 - RNA, 20 nt, Human
ucaaaaaaaaaaaaaaaggu

SEQ ID NO: 538577 - RNA, 24 nt, Human
ucacaaggucaggauaucgagacc

SEQ ID NO: 538578 - RNA, 22 nt, Human
ucacaccaaaaucuguaucuug

SEQ ID NO: 538579 - RNA, 18 nt, Human
ucacugcaaccucugccg

SEQ ID NO: 538580 - RNA, 23 nt, Human
ucacugcaaccucugccgccagg

SEQ ID NO: 538581 - RNA, 24 nt, Human
ucacugcaaccucugccgccaggg

SEQ ID NO: 538582 - RNA, 18 nt, Human
ucagaaauaacuuuucau

SEQ ID NO: 538583 - RNA, 20 nt, Human
ucagccucccgaauagcugg

SEQ ID NO: 538584 - RNA, 19 nt, Human
uccagccugggugacaaga

SEQ ID NO: 538585 - RNA, 21 nt, Human
uccauucauguuacugccccu

SEQ ID NO: 538586 - RNA, 24 nt, Human
ucccaaagugcugggauuacaggc

SEQ ID NO: 538587 - RNA, 23 nt, Human
ucccacagcuacuuucucccaau

SEQ ID NO: 538588 - RNA, 24 nt, Human
ucccgaauagcugggauuacaggc

SEQ ID NO: 538589 - RNA, 23 nt, Human
uccgucucaaaaaaaaaaaaaaa

SEQ ID NO: 538590 - RNA, 20 nt, Human
uccuaguaacagaaagaccc

SEQ ID NO: 538591 - RNA, 19 nt, Human
ucuacaguaguguacagua

SEQ ID NO: 538592 - RNA, 24 nt, Human
ucucacucuguagcccaaccugga

SEQ ID NO: 538593 - RNA, 23 nt, Human
ucucgaacuccugagcucaggag

SEQ ID NO: 538594 - RNA, 21 nt, Human
ucucuacuaaaaauacaaaaa

SEQ ID NO: 538595 - RNA, 24 nt, Human
ucuguagcccaaccuggagugcag

SEQ ID NO: 538596 - RNA, 24 nt, Human
ugaaaaacuaucuuaagaaaccaa

SEQ ID NO: 538597 - RNA, 21 nt, Human
ugacuugaaucauaagauaua

SEQ ID NO: 538598 - RNA, 22 nt, Human
ugagcugagauugcgccacugc

SEQ ID NO: 538599 - RNA, 20 nt, Human
ugaggcaggagaaucgcuug

SEQ ID NO: 538600 - RNA, 23 nt, Human
ugaggcaggagaaucgcuugaac

SEQ ID NO: 538601 - RNA, 24 nt, Human
ugaggcaggagaaucgcuugaacu

SEQ ID NO: 538602 - RNA, 25 nt, Human
ugaggcaggagaaucgcuugaacuc

SEQ ID NO: 538603 - RNA, 21 nt, Human
ugcagugggcgaucuuggcuc

SEQ ID NO: 538604 - RNA, 24 nt, Human
ugcccaggguggucucgaacuccu

SEQ ID NO: 538605 - RNA, 28 nt, Human
ugcccaggguggucucgaacuccugagc

SEQ ID NO: 538606 - RNA, 21 nt, Human
ugcccgccucgaccucccaaa

SEQ ID NO: 538607 - RNA, 24 nt, Human
ugcugggauuacaggcgugagcca

SEQ ID NO: 538608 - RNA, 18 nt, Human
ugcugguguaaacaaacc

SEQ ID NO: 538609 - RNA, 18 nt, Human
ugcuucgucugccauuuc

SEQ ID NO: 538610 - RNA, 19 nt, Human
uggaggauauuuuuuuccu

SEQ ID NO: 538611 - RNA, 21 nt, Human
uggagugcagugggcgaucuu

SEQ ID NO: 538612 - RNA, 23 nt, Human
uggagugcagugggcgaucuugg

SEQ ID NO: 538613 - RNA, 22 nt, Human
uggcaaccccccaagucucagc

SEQ ID NO: 538614 - RNA, 21 nt, Human
uggcgagccggggaagaccgc

SEQ ID NO: 538615 - RNA, 24 nt, Human
uggcucacgccuguaaucccagca

SEQ ID NO: 538616 - RNA, 23 nt, Human
ugggaagggggaggcucuggguu

SEQ ID NO: 538617 - RNA, 25 nt, Human
ugggaggccaaggccagguggauca

SEQ ID NO: 538618 - RNA, 18 nt, Human
ugggauuacaggcgcgug

SEQ ID NO: 538619 - RNA, 21 nt, Human
ugggauuacaggcgcgugcca

SEQ ID NO: 538620 - RNA, 22 nt, Human
ugggauuacaggcgcgugccac

SEQ ID NO: 538621 - RNA, 24 nt, Human
ugggauuacaggcgcgugccacca

SEQ ID NO: 538622 - RNA, 18 nt, Human
ugggauuacaggcgugag

SEQ ID NO: 538623 - RNA, 19 nt, Human
ugggauuacaggcgugagc

SEQ ID NO: 538624 - RNA, 21 nt, Human
ugggauuacaggcgugagcca

SEQ ID NO: 538625 - RNA, 22 nt, Human
ugggauuacaggcgugagccac

SEQ ID NO: 538626 - RNA, 23 nt, Human
ugggauuacaggcgugagccacc

SEQ ID NO: 538627 - RNA, 24 nt, Human
ugggauuacaggcgugagccaccg

SEQ ID NO: 538628 - RNA, 24 nt, Human
ugguggcucacgccuguaauccca

SEQ ID NO: 538629 - RNA, 20 nt, Human
ugguggcugagaaccucacc

SEQ ID NO: 538630 - RNA, 20 nt, Human
ugucauaguggggaccgaag

SEQ ID NO: 538631 - RNA, 20 nt, Human
ugucugugguaaugcuggug

SEQ ID NO: 538632 - RNA, 21 nt, Human
uuaaacuuuuaauuauuaaaa

SEQ ID NO: 538633 - RNA, 22 nt, Human
uuaagacaagcaugggugguua

SEQ ID NO: 538634 - RNA, 24 nt, Human
uuacauacuaccuagugauuugga

SEQ ID NO: 538635 - RNA, 24 nt, Human
uuacuaaguauacagaaaucaugu

SEQ ID NO: 538636 - RNA, 19 nt, Human
uuacuaaucaagguauaag

SEQ ID NO: 538637 - RNA, 18 nt, Human
uuagccaucaacaacaaa

SEQ ID NO: 538638 - RNA, 27 nt, Human
uuagccaucaacaacaaaaacaacaaa

SEQ ID NO: 538639 - RNA, 18 nt, Human
uuagcugggcgugguggc

SEQ ID NO: 538640 - RNA, 20 nt, Human
uuagcugggcgugguggcgc

SEQ ID NO: 538641 - RNA, 18 nt, Human
uuaguagagaagggguuu

SEQ ID NO: 538642 - RNA, 22 nt, Human
uuaguagagaagggguuucacc

SEQ ID NO: 538643 - RNA, 24 nt, Human
uuaguagagaagggguuucaccau

SEQ ID NO: 538644 - RNA, 24 nt, Human
uucaaaacuaaaacaaaaaccaaa

SEQ ID NO: 538645 - RNA, 24 nt, Human
uucaauucuauuuaaauuaugacu

SEQ ID NO: 538646 - RNA, 23 nt, Human
uucacacaaccacgaaacggccc

SEQ ID NO: 538647 - RNA, 19 nt, Human
uugcagugagcugagauug

SEQ ID NO: 538648 - RNA, 20 nt, Human
uugcagugagcugagauugc

SEQ ID NO: 538649 - RNA, 22 nt, Human
uugcagugagcugagauugcgc

SEQ ID NO: 538650 - RNA, 23 nt, Human
uugcgccacugcacuccagccug

SEQ ID NO: 538651 - RNA, 26 nt, Human
uuuaagaccagcaucccuggcaaccc

SEQ ID NO: 538652 - RNA, 19 nt, Human
uuucaccauguugcccagg

SEQ ID NO: 538653 - RNA, 19 nt, Human
uuuccugcaaugaaugaga

SEQ ID NO: 538654 - RNA, 25 nt, Human
uuuuacauuuaugcauaauuuugcu

SEQ ID NO: 538655 - RNA, 19 nt, Human
uuuuagagaauucauuuaa

SEQ ID NO: 538656 - RNA, 20 nt, Human
uuuuuguauuuuaguagaga

SEQ ID NO: 538657 - RNA, 21 nt, Human
agaaacaaaggucaggaaaga

SEQ ID NO: 538658 - RNA, 20 nt, Human
agaaagaaacaaaggucagg

SEQ ID NO: 538659 - RNA, 19 nt, Human
agagggaacuggccgagug

SEQ ID NO: 538660 - RNA, 21 nt, Human
agaugaccucacugccccugg

SEQ ID NO: 538661 - RNA, 23 nt, Human
agcaaggcccacacugaugggag

SEQ ID NO: 538662 - RNA, 20 nt, Human
aggggcugcugccggagacc

SEQ ID NO: 538663 - RNA, 22 nt, Human
cagagcuggcugagugccccuc

SEQ ID NO: 538664 - RNA, 23 nt, Human
caggguuggcuucggaaguagaa

SEQ ID NO: 538665 - RNA, 19 nt, Human
caguaguucccugcggguc

SEQ ID NO: 538666 - RNA, 21 nt, Human
ccgcuuccgggguuuugauuu

SEQ ID NO: 538667 - RNA, 23 nt, Human
ccucacugccccuggcuuggggc

SEQ ID NO: 538668 - RNA, 19 nt, Human
cggaaguagaagcacuuuc

SEQ ID NO: 538669 - RNA, 23 nt, Human
cggagaaagccgugagcuggaag

SEQ ID NO: 538670 - RNA, 19 nt, Human
gacagggacaaggagugcg

SEQ ID NO: 538671 - RNA, 19 nt, Human
gccccuggcuuggggccuc

SEQ ID NO: 538672 - RNA, 19 nt, Human
gcuuggggccuccuuggcu

SEQ ID NO: 538673 - RNA, 21 nt, Human
ggccuuuggcgcuccuucuga

SEQ ID NO: 538674 - RNA, 20 nt, Human
gggacugaugguuccugaac

SEQ ID NO: 538675 - RNA, 22 nt, Human
uaaaagccacauuuuguugaga

SEQ ID NO: 538676 - RNA, 24 nt, Human
uaaaccuccauaagaaaacuaaag

SEQ ID NO: 538677 - RNA, 20 nt, Human
uaagaaaacuaaagauggca

SEQ ID NO: 538678 - RNA, 22 nt, Human
uaccaccuuuauuacaagggga

SEQ ID NO: 538679 - RNA, 18 nt, Human
uagaagcacuuuccaagg

SEQ ID NO: 538680 - RNA, 23 nt, Human
uagaagcacuuuccaaggagccu

SEQ ID NO: 538681 - RNA, 20 nt, Human
uagaucacugacaggcuaaa

SEQ ID NO: 538682 - RNA, 20 nt, Human
ucaaaguuucaaucuaaaac

SEQ ID NO: 538683 - RNA, 21 nt, Human
ucuccaugcgagacagggacu

SEQ ID NO: 538684 - RNA, 20 nt, Human
ugagcuggaaggggcugcug

SEQ ID NO: 538685 - RNA, 20 nt, Human
ugagugccccucaggguugg

SEQ ID NO: 538686 - RNA, 24 nt, Human
ugagugccccucaggguuggcuuc

SEQ ID NO: 538687 - RNA, 18 nt, Human
ugaugaccuuggagacua

SEQ ID NO: 538688 - RNA, 19 nt, Human
ugcuagaugaccucacugc

SEQ ID NO: 538689 - RNA, 22 nt, Human
ugcuauuucuuugaucuccaug

SEQ ID NO: 538690 - RNA, 21 nt, Human
uggcuuggggccuccuuggcu

SEQ ID NO: 538691 - RNA, 22 nt, Human
uggcuuucuucuaaccgcuucc

SEQ ID NO: 538692 - RNA, 20 nt, Human
ugggaguggguggggugaug

SEQ ID NO: 538693 - RNA, 22 nt, Human
uggggugaugaccuuggagacu

SEQ ID NO: 538694 - RNA, 19 nt, Human
uucccugcggguccugcuu

SEQ ID NO: 538695 - RNA, 23 nt, Human
uuuggccuuuggcgcuccuucug

SEQ ID NO: 538696 - RNA, 21 nt, Human
uuuuuuuuuuuuuuuuuuaag

SEQ ID NO: 538697 - RNA, 24 nt, Human
aaaaguaucuuaacagcauuaaaa

SEQ ID NO: 538698 - RNA, 24 nt, Human
aaaaugaaacguuuugcuucuccu

SEQ ID NO: 538699 - RNA, 22 nt, Human
aaaaugaugcacaccagcuucu

SEQ ID NO: 538700 - RNA, 24 nt, Human
aaacugcuaaugccgacaguuucg

SEQ ID NO: 538701 - RNA, 24 nt, Human
aaagaagaccaccacaaacgccau

SEQ ID NO: 538702 - RNA, 21 nt, Human
aaaugaugcacaccagcuucu

SEQ ID NO: 538703 - RNA, 20 nt, Human
aacacacucagucacugcuu

SEQ ID NO: 538704 - RNA, 19 nt, Human
aagaaccaauuaggaaaaa

SEQ ID NO: 538705 - RNA, 18 nt, Human
aagaagaccaccacaaac

SEQ ID NO: 538706 - RNA, 21 nt, Human
aagcugcuaagcuagcacuug

SEQ ID NO: 538707 - RNA, 22 nt, Human
acaaaauauccccaacuuauaa

SEQ ID NO: 538708 - RNA, 19 nt, Human
acaacaacaaaaaaaugcc

SEQ ID NO: 538709 - RNA, 22 nt, Human
accccacaauucaaacucucug

SEQ ID NO: 538710 - RNA, 23 nt, Human
accuuggaaaaugaugcacacca

SEQ ID NO: 538711 - RNA, 21 nt, Human
acucagucacucucggaguug

SEQ ID NO: 538712 - RNA, 19 nt, Human
acuuauaaaaacacaggaa

SEQ ID NO: 538713 - RNA, 19 nt, Human
acuuuacuguccccuaagc

SEQ ID NO: 538714 - RNA, 24 nt, Human
agaaauggguuccuaaagcuugag

SEQ ID NO: 538715 - RNA, 21 nt, Human
agaugcuggagagcugcugcu

SEQ ID NO: 538716 - RNA, 19 nt, Human
agcuucugggacuucaccc

SEQ ID NO: 538717 - RNA, 25 nt, Human
aggaaaaaugauauauuugcaaaaa

SEQ ID NO: 538718 - RNA, 26 nt, Human
aggaaaaaugauauauuugcaaaaaa

SEQ ID NO: 538719 - RNA, 22 nt, Human
aggaauugaaguuagggugcuu

SEQ ID NO: 538720 - RNA, 22 nt, Human
aggggacauauggcaccaggac

SEQ ID NO: 538721 - RNA, 22 nt, Human
auccccaacuuauaaaaacaca

SEQ ID NO: 538722 - RNA, 23 nt, Human
caaaagacacugcacucagccac

SEQ ID NO: 538723 - RNA, 18 nt, Human
caacaaaauauccccaac

SEQ ID NO: 538724 - RNA, 26 nt, Human
caaccacuuuacuguccccuaagcuc

SEQ ID NO: 538725 - RNA, 22 nt, Human
caacuuauaaaaacacaggaac

SEQ ID NO: 538726 - RNA, 24 nt, Human
caaggcugacaauauaaauucucc

SEQ ID NO: 538727 - RNA, 18 nt, Human
cacaagaaagaaugugau

SEQ ID NO: 538728 - RNA, 30 nt, Human
cacacucagucacugcuuuaaauauaccaa

SEQ ID NO: 538729 - RNA, 19 nt, Human
cacccccucuguucaucac

SEQ ID NO: 538730 - RNA, 25 nt, Human
cacgucaagaaccaauuaggaaaaa

SEQ ID NO: 538731 - RNA, 19 nt, Human
caugucaacuuuucuccuu

SEQ ID NO: 538732 - RNA, 23 nt, Human
cauuuacauguaucauauacaua

SEQ ID NO: 538733 - RNA, 19 nt, Human
ccaccacaaacgccaucgu

SEQ ID NO: 538734 - RNA, 23 nt, Human
ccacccccucuguucaucaccuc

SEQ ID NO: 538735 - RNA, 25 nt, Human
ccucaaguguaacuaccaaccauug

SEQ ID NO: 538736 - RNA, 22 nt, Human
cgcaaaacuaagacccugccaa

SEQ ID NO: 538737 - RNA, 25 nt, Human
cgcaaaacuaagacccugccaauca

SEQ ID NO: 538738 - RNA, 21 nt, Human
cgccagcuuacccaaaacugc

SEQ ID NO: 538739 - RNA, 23 nt, Human
cguaaaacaacaaaauaucccca

SEQ ID NO: 538740 - RNA, 21 nt, Human
cucagccacucacucaaacac

SEQ ID NO: 538741 - RNA, 23 nt, Human
cucccaccccacaauucaaacuc

SEQ ID NO: 538742 - RNA, 22 nt, Human
cugcaauagaacugaaaugauu

SEQ ID NO: 538743 - RNA, 18 nt, Human
cugggacuucacccaggc

SEQ ID NO: 538744 - RNA, 18 nt, Human
gaaucaaauggcuguuuc

SEQ ID NO: 538745 - RNA, 24 nt, Human
gagaugcuggagagcugcugcuug

SEQ ID NO: 538746 - RNA, 21 nt, Human
gaggugguuaggccuuuaccu

SEQ ID NO: 538747 - RNA, 22 nt, Human
gcucugccaccuuggaaaauga

SEQ ID NO: 538748 - RNA, 21 nt, Human
gcuucaauuuggucuaauuac

SEQ ID NO: 538749 - RNA, 23 nt, Human
guaccgccagcuuacccaaaacu

SEQ ID NO: 538750 - RNA, 19 nt, Human
gugaauauaacucaguuau

SEQ ID NO: 538751 - RNA, 23 nt, Human
guugccguaaaacaacaaaauau

SEQ ID NO: 538752 - RNA, 21 nt, Human
uaaaacauucacugugugugc

SEQ ID NO: 538753 - RNA, 22 nt, Human
uaacaacaacaaaaaaaugccu

SEQ ID NO: 538754 - RNA, 19 nt, Human
uaauuaacaacaacaaaaa

SEQ ID NO: 538755 - RNA, 19 nt, Human
uaauugucaaaauauucuu

SEQ ID NO: 538756 - RNA, 19 nt, Human
uacauuuacauguaucaua

SEQ ID NO: 538757 - RNA, 22 nt, Human
uacucuuguuccuacaguuuua

SEQ ID NO: 538758 - RNA, 21 nt, Human
uaggccuuuaccuaacagcuc

SEQ ID NO: 538759 - RNA, 27 nt, Human
uauguuuguauaacuuaaaacauucac

SEQ ID NO: 538760 - RNA, 24 nt, Human
ucaaaugguuaaggcccaaaaaug

SEQ ID NO: 538761 - RNA, 20 nt, Human
ucacucaaacacacucaguc

SEQ ID NO: 538762 - RNA, 22 nt, Human
ucacugugugugcaugugugca

SEQ ID NO: 538763 - RNA, 20 nt, Human
ucacuugucuacaagguuua

SEQ ID NO: 538764 - RNA, 23 nt, Human
ucacuugucuacaagguuuagau

SEQ ID NO: 538765 - RNA, 21 nt, Human
ucagaggucccagacauguca

SEQ ID NO: 538766 - RNA, 23 nt, Human
ucaggaggagaggacuaaccaca

SEQ ID NO: 538767 - RNA, 22 nt, Human
ucauauacauauuuuaaauccu

SEQ ID NO: 538768 - RNA, 18 nt, Human
ucaugugccacgcucagu

SEQ ID NO: 538769 - RNA, 21 nt, Human
uccacacaaauuacuguuccu

SEQ ID NO: 538770 - RNA, 21 nt, Human
uccacugcacgucaagaacca

SEQ ID NO: 538771 - RNA, 18 nt, Human
uccguccguaguuagaac

SEQ ID NO: 538772 - RNA, 24 nt, Human
ucucuuaccaguaaagcucagagg

SEQ ID NO: 538773 - RNA, 24 nt, Human
ugagauauaagagacugcagggag

SEQ ID NO: 538774 - RNA, 19 nt, Human
ugaggaacagguuuccagu

SEQ ID NO: 538775 - RNA, 21 nt, Human
ugcaaagguaaaauacguggu

SEQ ID NO: 538776 - RNA, 24 nt, Human
uggauuuauuucuuucuaaaguuu

SEQ ID NO: 538777 - RNA, 24 nt, Human
ugguucugaaucucaggaggagag

SEQ ID NO: 538778 - RNA, 21 nt, Human
uguacauuuacauguaucaua

SEQ ID NO: 538779 - RNA, 28 nt, Human
ugucacuaauuacuuucacaauuugcag

SEQ ID NO: 538780 - RNA, 19 nt, Human
ugugcaagcauguguacac

SEQ ID NO: 538781 - RNA, 19 nt, Human
ugugcauauauauacucuc

SEQ ID NO: 538782 - RNA, 24 nt, Human
ugugugcaagcauguguacacaug

SEQ ID NO: 538783 - RNA, 18 nt, Human
ugugugugcaugugugca

SEQ ID NO: 538784 - RNA, 27 nt, Human
uguuucuucacuuguacuccucucuca

SEQ ID NO: 538785 - RNA, 23 nt, Human
uuuacuguccccuaagcuucaau

SEQ ID NO: 538786 - RNA, 21 nt, Human
uuucaaaugguuaaggcccaa

SEQ ID NO: 538787 - RNA, 18 nt, Human
uuuuuuuuuuuuuuuuug

SEQ ID NO: 538788 - RNA, 22 nt, Human
aaaaacucuuaaccgaaaacuc

SEQ ID NO: 538789 - RNA, 19 nt, Human
aaaaauugaugauaaauug

SEQ ID NO: 538790 - RNA, 19 nt, Human
aaaagcagccaaaaugacc

SEQ ID NO: 538791 - RNA, 19 nt, Human
aaaggggaggaaggggaag

SEQ ID NO: 538792 - RNA, 20 nt, Human
aagagaaaggggaggaaggg

SEQ ID NO: 538793 - RNA, 22 nt, Human
aagcagccaaaaugaccaucug

SEQ ID NO: 538794 - RNA, 19 nt, Human
aauaccuucauaauauccu

SEQ ID NO: 538795 - RNA, 22 nt, Human
acacaacauucucuuaaccucu

SEQ ID NO: 538796 - RNA, 19 nt, Human
acagcuagacauaaccaaa

SEQ ID NO: 538797 - RNA, 21 nt, Human
acuaagaaaagugacaaccag

SEQ ID NO: 538798 - RNA, 22 nt, Human
acucucaagagaaagagaaagg

SEQ ID NO: 538799 - RNA, 18 nt, Human
agaaaggggaggaagggg

SEQ ID NO: 538800 - RNA, 18 nt, Human
agacaaaccacacuggcu

SEQ ID NO: 538801 - RNA, 19 nt, Human
agacaaaccacacuggcuc

SEQ ID NO: 538802 - RNA, 20 nt, Human
agagaaaggggaggaagggg

SEQ ID NO: 538803 - RNA, 24 nt, Human
aggaguugcuaauuaggaauucau

SEQ ID NO: 538804 - RNA, 18 nt, Human
aggggaggaaggggaagg

SEQ ID NO: 538805 - RNA, 19 nt, Human
aggggaggaaggggaaggg

SEQ ID NO: 538806 - RNA, 20 nt, Human
agucuaccaccuccugcuuc

SEQ ID NO: 538807 - RNA, 18 nt, Human
agugacaaccagaauccc

SEQ ID NO: 538808 - RNA, 22 nt, Human
caaaagcagccaaaaugaccau

SEQ ID NO: 538809 - RNA, 19 nt, Human
caaacucucaagagaaaga

SEQ ID NO: 538810 - RNA, 22 nt, Human
caaccagaaucccuagugaauu

SEQ ID NO: 538811 - RNA, 19 nt, Human
cacagcuagacauaaccaa

SEQ ID NO: 538812 - RNA, 19 nt, Human
cauuaugugacagcaaaag

SEQ ID NO: 538813 - RNA, 25 nt, Human
cucaagagaaagagaaaggggagga

SEQ ID NO: 538814 - RNA, 18 nt, Human
gaaauacacaacauucuc

SEQ ID NO: 538815 - RNA, 21 nt, Human
gaauucauuauuuuuccccac

SEQ ID NO: 538816 - RNA, 22 nt, Human
gaguugcuaauuaggaauucau

SEQ ID NO: 538817 - RNA, 22 nt, Human
gcagccaaaaugaccaucugaa

SEQ ID NO: 538818 - RNA, 19 nt, Human
ggaagagaaaacauguccu

SEQ ID NO: 538819 - RNA, 22 nt, Human
uaaaauaaucaaaagcagccaa

SEQ ID NO: 538820 - RNA, 19 nt, Human
uaacuaagaaaagugacaa

SEQ ID NO: 538821 - RNA, 21 nt, Human
uaagcuaaggaagagaaaaca

SEQ ID NO: 538822 - RNA, 21 nt, Human
uaccaccuccugcuuccccca

SEQ ID NO: 538823 - RNA, 25 nt, Human
ucaaaaaacucuuaaccgaaaacuc

SEQ ID NO: 538824 - RNA, 19 nt, Human
ucaauuagacaaaccacac

SEQ ID NO: 538825 - RNA, 19 nt, Human
ucagguacuacacauugcu

SEQ ID NO: 538826 - RNA, 19 nt, Human
uccacaguggagaagaaaa

SEQ ID NO: 538827 - RNA, 19 nt, Human
ucccccacaacacuuucua

SEQ ID NO: 538828 - RNA, 19 nt, Human
ucucaagagaaagagaaag

SEQ ID NO: 538829 - RNA, 22 nt, Human
ucuugcgcucaaacucucaaga

SEQ ID NO: 538830 - RNA, 22 nt, Human
ugaaagaaguucgcagaaauac

SEQ ID NO: 538831 - RNA, 18 nt, Human
uggcugccuuaauaacua

SEQ ID NO: 538832 - RNA, 21 nt, Human
ugggagagauuauuguaaaau

SEQ ID NO: 538833 - RNA, 27 nt, Human
uuagucuaccaccuccugcuuccccca

SEQ ID NO: 538834 - RNA, 21 nt, Human
uucagguacuacacauugcug

SEQ ID NO: 538835 - RNA, 18 nt, Human
uucgcagaaauacacaac

SEQ ID NO: 538836 - RNA, 23 nt, Human
uuuagucuaccaccuccugcuuc

SEQ ID NO: 538837 - RNA, 21 nt, Human
uuucagguacuacacauugcu

SEQ ID NO: 538838 - RNA, 22 nt, Human
uuuuuuuuuuuuuuuuuuuggg

SEQ ID NO: 538839 - RNA, 21 nt, Human
aaaacaaaagaagggguuaga

SEQ ID NO: 538840 - RNA, 22 nt, Human
aaaagaaaaaaaaaaaaaaaag

SEQ ID NO: 538841 - RNA, 28 nt, Human
aaaagaaagaaaagaagcaagcaaagaa

SEQ ID NO: 538842 - RNA, 18 nt, Human
aaaagaagcaagcaaaga

SEQ ID NO: 538843 - RNA, 21 nt, Human
aaaauaguuuuauacaaaaca

SEQ ID NO: 538844 - RNA, 18 nt, Human
aaaauccacaaugcaaga

SEQ ID NO: 538845 - RNA, 20 nt, Human
aaaccaaacaaaacgaacga

SEQ ID NO: 538846 - RNA, 22 nt, Human
aaagaaaaccaaacaaaacgaa

SEQ ID NO: 538847 - RNA, 23 nt, Human
aaagaaaagaagcaagcaaagaa

SEQ ID NO: 538848 - RNA, 19 nt, Human
aacacaugcuuacugcauu

SEQ ID NO: 538849 - RNA, 23 nt, Human
aagaaaaccaaacaaaacgaacg

SEQ ID NO: 538850 - RNA, 21 nt, Human
aagaaaagaagcaagcaaaga

SEQ ID NO: 538851 - RNA, 24 nt, Human
aagaaagaaaagaagcaagcaaag

SEQ ID NO: 538852 - RNA, 28 nt, Human
aagaaagaaaagaagcaagcaaagaaaa

SEQ ID NO: 538853 - RNA, 20 nt, Human
aagcuaaauaacacuaaaau

SEQ ID NO: 538854 - RNA, 27 nt, Human
aauugccuucuacacauuaucuuuagg

SEQ ID NO: 538855 - RNA, 19 nt, Human
acgccaaagaaaacaacua

SEQ ID NO: 538856 - RNA, 25 nt, Human
acgccaaagaaaacaacuagagaau

SEQ ID NO: 538857 - RNA, 19 nt, Human
acuagcuugcuugggcuag

SEQ ID NO: 538858 - RNA, 21 nt, Human
agaaaaaaaaaaaaaaaagga

SEQ ID NO: 538859 - RNA, 18 nt, Human
agaaaacaaaagaagggg

SEQ ID NO: 538860 - RNA, 23 nt, Human
agaaaacaaaagaagggguuaga

SEQ ID NO: 538861 - RNA, 24 nt, Human
agaaaacaacuagagaaucucaac

SEQ ID NO: 538862 - RNA, 21 nt, Human
agaaagaaaagaagcaagcaa

SEQ ID NO: 538863 - RNA, 18 nt, Human
agcaagcaaagaaaacua

SEQ ID NO: 538864 - RNA, 21 nt, Human
aggaaaaaagaaagaaaagaa

SEQ ID NO: 538865 - RNA, 22 nt, Human
aggaaggaaaaaagaaagaaaa

SEQ ID NO: 538866 - RNA, 20 nt, Human
caaaaacacucuagcugugc

SEQ ID NO: 538867 - RNA, 20 nt, Human
caaaaacacucuagcugugc

SEQ ID NO: 538868 - RNA, 22 nt, Human
caacuagguaaaaagaaaacca

SEQ ID NO: 538869 - RNA, 23 nt, Human
caacuagguaaaaagaaaaccaa

SEQ ID NO: 538870 - RNA, 24 nt, Human
caacuagguaaaaagaaaaccaaa

SEQ ID NO: 538871 - RNA, 30 nt, Human
cacuauagcaacuagguaaaaagaaaacca

SEQ ID NO: 538872 - RNA, 18 nt, Human
caguauuuuuaugucuau

SEQ ID NO: 538873 - RNA, 24 nt, Human
ccagaaccucuuucuguaacacau

SEQ ID NO: 538874 - RNA, 22 nt, Human
cgaacgagcuuuacugaaaucu

SEQ ID NO: 538875 - RNA, 25 nt, Human
cgccaaagaaaacaacuagagaauc

SEQ ID NO: 538876 - RNA, 19 nt, Human
cuuccauuucugccggucc

SEQ ID NO: 538877 - RNA, 18 nt, Human
gacaaaaauagaaaucug

SEQ ID NO: 538878 - RNA, 19 nt, Human
gcagugcaauagguuugau

SEQ ID NO: 538879 - RNA, 23 nt, Human
gguaaaaagaaaaccaaacaaaa

SEQ ID NO: 538880 - RNA, 22 nt, Human
guuaaaaaagaaaaaaaaaaaa

SEQ ID NO: 538881 - RNA, 24 nt, Human
uaaaauccacaaugcaagagcgug

SEQ ID NO: 538882 - RNA, 21 nt, Human
uaaaauucuggaaucauacau

SEQ ID NO: 538883 - RNA, 24 nt, Human
uaacacuaaaauaaaaggaaauau

SEQ ID NO: 538884 - RNA, 26 nt, Human
uagcaacuagguaaaaagaaaaccaa

SEQ ID NO: 538885 - RNA, 20 nt, Human
uaugugcugucacauacagu

SEQ ID NO: 538886 - RNA, 27 nt, Human
ucucaacauguuaaaaaagaaaaaaaa

SEQ ID NO: 538887 - RNA, 19 nt, Human
ugaaaggaaccaugaaguu

SEQ ID NO: 538888 - RNA, 25 nt, Human
ugacaaaaauagaaaucuguaauaa

SEQ ID NO: 538889 - RNA, 23 nt, Human
uggauacuuccauuucugccggu

SEQ ID NO: 538890 - RNA, 24 nt, Human
uggcaaaaaagaucuugaaaggaa

SEQ ID NO: 538891 - RNA, 18 nt, Human
ugggaaaacuacucuaug

SEQ ID NO: 538892 - RNA, 26 nt, Human
ugucucacacgcaccuuucucuccca

SEQ ID NO: 538893 - RNA, 23 nt, Human
uuacaaaaacacucuagcugugc

SEQ ID NO: 538894 - RNA, 18 nt, Human
uucuguauauuacaugac

SEQ ID NO: 538895 - RNA, 22 nt, Human
uuuacugaaaucuauuaaucca

SEQ ID NO: 538896 - RNA, 20 nt, Human
uuuagcacauauuuagcauu

SEQ ID NO: 538897 - RNA, 24 nt, Human
uuugacaaaaauagaaaucuguaa

SEQ ID NO: 538898 - RNA, 21 nt, Human
uuuuacaauuuguauagucac

SEQ ID NO: 538899 - RNA, 19 nt, Human
uuuuaugucuauguauauu

SEQ ID NO: 538900 - RNA, 20 nt, Human
aaaauugcacauucuccucc

SEQ ID NO: 538901 - RNA, 20 nt, Human
aaacaacagcaaaaaucauc

SEQ ID NO: 538902 - RNA, 23 nt, Human
aacacaaaccacgcguggcuuug

SEQ ID NO: 538903 - RNA, 24 nt, Human
aacuaguauggaauucacagcccu

SEQ ID NO: 538904 - RNA, 22 nt, Human
aagacgcgggcagagucagagg

SEQ ID NO: 538905 - RNA, 23 nt, Human
aagcaagagguugaaaaagggac

SEQ ID NO: 538906 - RNA, 19 nt, Human
acaauggugugaaaugguu

SEQ ID NO: 538907 - RNA, 20 nt, Human
acacugauuggaaaucugca

SEQ ID NO: 538908 - RNA, 21 nt, Human
agacaacaaaucugggaugga

SEQ ID NO: 538909 - RNA, 21 nt, Human
aggaagcugguugugccagag

SEQ ID NO: 538910 - RNA, 19 nt, Human
aggcaggcuugcagcucgg

SEQ ID NO: 538911 - RNA, 18 nt, Human
aucagacacagagugacu

SEQ ID NO: 538912 - RNA, 21 nt, Human
caacagcaaaaaucaucaaca

SEQ ID NO: 538913 - RNA, 23 nt, Human
caaguccaaaacaacaguuaagg

SEQ ID NO: 538914 - RNA, 23 nt, Human
caaguccaaaacaacaguuaagg

SEQ ID NO: 538915 - RNA, 20 nt, Human
caccccucaggcccuaguaa

SEQ ID NO: 538916 - RNA, 23 nt, Human
caccuuugaccuuaaaguuugga

SEQ ID NO: 538917 - RNA, 23 nt, Human
cacuccauuuucaaggcuagaga

SEQ ID NO: 538918 - RNA, 23 nt, Human
cacucggcacauucaugaaacaa

SEQ ID NO: 538919 - RNA, 21 nt, Human
cagagugacugagccaaucaa

SEQ ID NO: 538920 - RNA, 23 nt, Human
cagugaacagagggauucuuugu

SEQ ID NO: 538921 - RNA, 24 nt, Human
cauaaccccaucauaagucaaaga

SEQ ID NO: 538922 - RNA, 19 nt, Human
ccaccacagugaacagagg

SEQ ID NO: 538923 - RNA, 21 nt, Human
ccacgcguggcuuugccuccu

SEQ ID NO: 538924 - RNA, 22 nt, Human
ccaggaagcugguugugccaga

SEQ ID NO: 538925 - RNA, 18 nt, Human
ccaggagucaaaguuaau

SEQ ID NO: 538926 - RNA, 22 nt, Human
ccccauaucagaguauaaagca

SEQ ID NO: 538927 - RNA, 21 nt, Human
ccccucaggcccuaguaaucc

SEQ ID NO: 538928 - RNA, 18 nt, Human
ccgcucuccagccccggc

SEQ ID NO: 538929 - RNA, 21 nt, Human
ccuuccuucucaccuuugacc

SEQ ID NO: 538930 - RNA, 24 nt, Human
cggcacauucaugaaacaacagca

SEQ ID NO: 538931 - RNA, 24 nt, Human
cgucagaauguucaagauaacuga

SEQ ID NO: 538932 - RNA, 19 nt, Human
cuagugcagccuucacugc

SEQ ID NO: 538933 - RNA, 20 nt, Human
cucucuguaaacucauuacc

SEQ ID NO: 538934 - RNA, 23 nt, Human
cugcugagguaacuccaggaagc

SEQ ID NO: 538935 - RNA, 24 nt, Human
cuuccgagauccgcaguggucgcc

SEQ ID NO: 538936 - RNA, 22 nt, Human
gaacauaccaccaacacaaacc

SEQ ID NO: 538937 - RNA, 23 nt, Human
gaacggacaccccucaggcccua

SEQ ID NO: 538938 - RNA, 24 nt, Human
gaagauauauauacucuacauuuu

SEQ ID NO: 538939 - RNA, 19 nt, Human
ggcccuaguaauccauuca

SEQ ID NO: 538940 - RNA, 23 nt, Human
gguccuuuacacgucagaauguu

SEQ ID NO: 538941 - RNA, 23 nt, Human
gugaucuuucccaccacagugaa

SEQ ID NO: 538942 - RNA, 26 nt, Human
uaaaccucaauaggccaagacccguc

SEQ ID NO: 538943 - RNA, 22 nt, Human
uaaaugauguaccuuauggucc

SEQ ID NO: 538944 - RNA, 18 nt, Human
uaacugauguaccuuaug

SEQ ID NO: 538945 - RNA, 26 nt, Human
uagaagaaaaggucuuucccuuuucu

SEQ ID NO: 538946 - RNA, 23 nt, Human
uaucagaguauaaagcaagaggu

SEQ ID NO: 538947 - RNA, 20 nt, Human
uauggaauucacagcccuga

SEQ ID NO: 538948 - RNA, 22 nt, Human
uaugguccuuuacacgucagaa

SEQ ID NO: 538949 - RNA, 24 nt, Human
uauucaacacucgauuauaaaaua

SEQ ID NO: 538950 - RNA, 18 nt, Human
ucaaagaugacccacucu

SEQ ID NO: 538951 - RNA, 21 nt, Human
ucaccuuugaccuuaaaguuu

SEQ ID NO: 538952 - RNA, 22 nt, Human
ucacuccauuuucaaggcuaga

SEQ ID NO: 538953 - RNA, 18 nt, Human
ucaguaaaugagcaauac

SEQ ID NO: 538954 - RNA, 21 nt, Human
ucccaccacagugaacagagg

SEQ ID NO: 538955 - RNA, 18 nt, Human
uccuugaaaggaagacuc

SEQ ID NO: 538956 - RNA, 24 nt, Human
ucguauuuucccuuuuugucagua

SEQ ID NO: 538957 - RNA, 22 nt, Human
ucuaaaaauagacuaagcagau

SEQ ID NO: 538958 - RNA, 24 nt, Human
ugaaacaacagcaaaaaucaucaa

SEQ ID NO: 538959 - RNA, 25 nt, Human
ugaaacaacagcaaaaaucaucaac

SEQ ID NO: 538960 - RNA, 24 nt, Human
ugaaaggaagacucaauacuucca

SEQ ID NO: 538961 - RNA, 23 nt, Human
ugacugagccaaucaacaggcau

SEQ ID NO: 538962 - RNA, 18 nt, Human
ugagccaaucaacaggca

SEQ ID NO: 538963 - RNA, 21 nt, Human
ugagugauuuacaucauuucc

SEQ ID NO: 538964 - RNA, 24 nt, Human
ugcauuugacuuccaauggguuag

SEQ ID NO: 538965 - RNA, 20 nt, Human
uggacgaggcuaagcugugg

SEQ ID NO: 538966 - RNA, 22 nt, Human
uggacgaggcuaagcuguggug

SEQ ID NO: 538967 - RNA, 27 nt, Human
uuacaucauuucuuccuuccgagaucc

SEQ ID NO: 538968 - RNA, 19 nt, Human
uucacuccauuuucaaggc

SEQ ID NO: 538969 - RNA, 23 nt, Human
uucacuccauuuucaaggcuaga

SEQ ID NO: 538970 - RNA, 18 nt, Human
uucccagacaacaaaucu

SEQ ID NO: 538971 - RNA, 20 nt, Human
uucccagacaacaaaucugg

SEQ ID NO: 538972 - RNA, 20 nt, Human
uugacacuuacuagaagaaa

SEQ ID NO: 538973 - RNA, 20 nt, Human
uuuacugggacauaacccca

SEQ ID NO: 538974 - RNA, 22 nt, Human
uuucccuuuuugucaguaaaug

SEQ ID NO: 538975 - RNA, 21 nt, Human
uuuuuuuuuuuuuuuuucauu

SEQ ID NO: 538976 - RNA, 25 nt, Human
aaaaauacaaaaaauuagcugugcg

SEQ ID NO: 538977 - RNA, 22 nt, Human
aaaacaaaaacaaaaacaaaaa

SEQ ID NO: 538978 - RNA, 24 nt, Human
aaaacaaaaacaaaaacaaaaaaa

SEQ ID NO: 538979 - RNA, 24 nt, Human
aaacaaaaacaaaaaaagauguaa

SEQ ID NO: 538980 - RNA, 20 nt, Human
aaauguaauugauuuaauua

SEQ ID NO: 538981 - RNA, 24 nt, Human
aacaaaaacaaaaacaaaaaaaga

SEQ ID NO: 538982 - RNA, 22 nt, Human
aacaaauuagucacaaucaacu

SEQ ID NO: 538983 - RNA, 19 nt, Human
aacacggugaaaucccguc

SEQ ID NO: 538984 - RNA, 20 nt, Human
aacacggugaaaucccgucu

SEQ ID NO: 538985 - RNA, 21 nt, Human
aacacggugaaaucccgucuc

SEQ ID NO: 538986 - RNA, 24 nt, Human
aacagagugagacucugucucaaa

SEQ ID NO: 538987 - RNA, 24 nt, Human
aacauccauuucauucuccugggc

SEQ ID NO: 538988 - RNA, 20 nt, Human
aaccaugaucacuuaauuuu

SEQ ID NO: 538989 - RNA, 22 nt, Human
aagaaccuuuuagugucaggcg

SEQ ID NO: 538990 - RNA, 24 nt, Human
aagaagauaacuugagaagccagg

SEQ ID NO: 538991 - RNA, 24 nt, Human
acaaaaacaaaaaaagauguaaaa

SEQ ID NO: 538992 - RNA, 26 nt, Human
acaagaaaaauacaacugcuuuuuca

SEQ ID NO: 538993 - RNA, 21 nt, Human
acagagugagacucugucuca

SEQ ID NO: 538994 - RNA, 24 nt, Human
acagagugagacucugucucaaaa

SEQ ID NO: 538995 - RNA, 18 nt, Human
accacaagaaaaauacaa

SEQ ID NO: 538996 - RNA, 23 nt, Human
accaccacccagcuuucugaaac

SEQ ID NO: 538997 - RNA, 22 nt, Human
accaggacucaauuuaauuucc

SEQ ID NO: 538998 - RNA, 19 nt, Human
acccagcuuucugaaacag

SEQ ID NO: 538999 - RNA, 18 nt, Human
acgccacugcauuccagc

SEQ ID NO: 539000 - RNA, 23 nt, Human
acgccacugcauuccagccuggc

SEQ ID NO: 539001 - RNA, 23 nt, Human
acugcauuccagccuggcaacag

SEQ ID NO: 539002 - RNA, 23 nt, Human
acugcauuccagccuggcaacag

SEQ ID NO: 539003 - RNA, 22 nt, Human
agaaucgcuugaaacugggagg

SEQ ID NO: 539004 - RNA, 24 nt, Human
agacgggcagaucaugaggucagg

SEQ ID NO: 539005 - RNA, 21 nt, Human
agagcgccuccaccaccaccc

SEQ ID NO: 539006 - RNA, 24 nt, Human
agagcgccuccaccaccacccagc

SEQ ID NO: 539007 - RNA, 24 nt, Human
agcacuuugggaggccgagacggg

SEQ ID NO: 539008 - RNA, 21 nt, Human
agccuggcaacagagugagac

SEQ ID NO: 539009 - RNA, 23 nt, Human
agccuggcaacagagugagacuc

SEQ ID NO: 539010 - RNA, 21 nt, Human
agcuauugaugucugcagcag

SEQ ID NO: 539011 - RNA, 20 nt, Human
aggcaggagaaucgcuugaa

SEQ ID NO: 539012 - RNA, 24 nt, Human
aggcaggagaaucgcuugaaacug

SEQ ID NO: 539013 - RNA, 21 nt, Human
aggccgagacgggcagaucau

SEQ ID NO: 539014 - RNA, 23 nt, Human
aggccgagacgggcagaucauga

SEQ ID NO: 539015 - RNA, 25 nt, Human
aggcggagguugcagugacaacggu

SEQ ID NO: 539016 - RNA, 21 nt, Human
aggcggagguugcagugagcc

SEQ ID NO: 539017 - RNA, 24 nt, Human
aggcggagguugcagugagccgag

SEQ ID NO: 539018 - RNA, 20 nt, Human
aggcugaggcaggagaaucg

SEQ ID NO: 539019 - RNA, 24 nt, Human
aggcugaggcaggagaaucgcuug

SEQ ID NO: 539020 - RNA, 19 nt, Human
agugaaaagcacgaaaauc

SEQ ID NO: 539021 - RNA, 24 nt, Human
aguggcucacgccuguaaucccag

SEQ ID NO: 539022 - RNA, 22 nt, Human
aucauauauaguaauuccacca

SEQ ID NO: 539023 - RNA, 24 nt, Human
augacgccacugcauuccagccug

SEQ ID NO: 539024 - RNA, 19 nt, Human
augguccaugcaugaggug

SEQ ID NO: 539025 - RNA, 24 nt, Human
caagaccauccuggcuaacacggu

SEQ ID NO: 539026 - RNA, 24 nt, Human
cacgccuguaaucccagcacuuug

SEQ ID NO: 539027 - RNA, 18 nt, Human
cacugcauuccagccugg

SEQ ID NO: 539028 - RNA, 20 nt, Human
cacugcauuccagccuggca

SEQ ID NO: 539029 - RNA, 24 nt, Human
cacugcauuccagccuggcaacag

SEQ ID NO: 539030 - RNA, 24 nt, Human
cagcacuuugggaggccgagacgg

SEQ ID NO: 539031 - RNA, 19 nt, Human
cagccuggcaacagaguga

SEQ ID NO: 539032 - RNA, 24 nt, Human
cagcuacuugggaggcugaggcag

SEQ ID NO: 539033 - RNA, 20 nt, Human
caggacugaucccugucuaa

SEQ ID NO: 539034 - RNA, 23 nt, Human
cauuccagccuggcaacagagug

SEQ ID NO: 539035 - RNA, 21 nt, Human
ccacaagaaaaauacaacugc

SEQ ID NO: 539036 - RNA, 23 nt, Human
ccaccaggcugauuucaagcuac

SEQ ID NO: 539037 - RNA, 19 nt, Human
ccacugcauuccagccugg

SEQ ID NO: 539038 - RNA, 19 nt, Human
ccacugcauuccagccugg

SEQ ID NO: 539039 - RNA, 20 nt, Human
ccacugcauuccagccuggc

SEQ ID NO: 539040 - RNA, 23 nt, Human
ccacugcauuccagccuggcaac

SEQ ID NO: 539041 - RNA, 24 nt, Human
ccaguuagccuugauuacuagcag

SEQ ID NO: 539042 - RNA, 22 nt, Human
cccgucucuacuaaaaauacaa

SEQ ID NO: 539043 - RNA, 19 nt, Human
ccucaguaaccugcccagg

SEQ ID NO: 539044 - RNA, 23 nt, Human
ccugcccagggccacacagcuag

SEQ ID NO: 539045 - RNA, 21 nt, Human
ccuggcaacagagugagacuc

SEQ ID NO: 539046 - RNA, 23 nt, Human
ccuggcuaacacggugaaauccc

SEQ ID NO: 539047 - RNA, 24 nt, Human
ccuggcuaacacggugaaaucccg

SEQ ID NO: 539048 - RNA, 22 nt, Human
ccuguaaucccagcacuuuggg

SEQ ID NO: 539049 - RNA, 21 nt, Human
ccuguagucacagcuacuugg

SEQ ID NO: 539050 - RNA, 22 nt, Human
ccuguagucacagcuacuuggg

SEQ ID NO: 539051 - RNA, 24 nt, Human
cgagacgggcagaucaugagguca

SEQ ID NO: 539052 - RNA, 21 nt, Human
cgccuguagucacagcuacuu

SEQ ID NO: 539053 - RNA, 23 nt, Human
cgccuguagucacagcuacuugg

SEQ ID NO: 539054 - RNA, 24 nt, Human
cgccuguagucacagcuacuuggg

SEQ ID NO: 539055 - RNA, 18 nt, Human
cgcggcugucuccuuccu

SEQ ID NO: 539056 - RNA, 22 nt, Human
cgggcagaucaugaggucagga

SEQ ID NO: 539057 - RNA, 22 nt, Human
cucaaaaacaaaaacaaaaaca

SEQ ID NO: 539058 - RNA, 22 nt, Human
cucacgccuguaaucccagcac

SEQ ID NO: 539059 - RNA, 24 nt, Human
cucacgccuguaaucccagcacuu

SEQ ID NO: 539060 - RNA, 20 nt, Human
cucgggucccugccccgucc

SEQ ID NO: 539061 - RNA, 19 nt, Human
cugcccagggccacacagc

SEQ ID NO: 539062 - RNA, 18 nt, Human
cuggcuaacacggugaaa

SEQ ID NO: 539063 - RNA, 21 nt, Human
cugucaaaaugaaaauuuuac

SEQ ID NO: 539064 - RNA, 23 nt, Human
cugucucaaaaacaaaaacaaaa

SEQ ID NO: 539065 - RNA, 27 nt, Human
cugucucaaaaacaaaaacaaaaacaa

SEQ ID NO: 539066 - RNA, 21 nt, Human
gaaaugccauuuuacauguga

SEQ ID NO: 539067 - RNA, 24 nt, Human
gaauauuuauuaccuuuguuuuaa

SEQ ID NO: 539068 - RNA, 23 nt, Human
gacgggcagaucaugaggucagg

SEQ ID NO: 539069 - RNA, 18 nt, Human
gagagagcgccuccacca

SEQ ID NO: 539070 - RNA, 23 nt, Human
gagaugacgccacugcauuccag

SEQ ID NO: 539071 - RNA, 21 nt, Human
gagccucaguaaccugcccag

SEQ ID NO: 539072 - RNA, 20 nt, Human
gagcgccuccaccaccaccc

SEQ ID NO: 539073 - RNA, 21 nt, Human
gagguugcagugagccgagau

SEQ ID NO: 539074 - RNA, 20 nt, Human
gcaaaaccauuauacaguua

SEQ ID NO: 539075 - RNA, 24 nt, Human
gcaacagagugagacucugucuca

SEQ ID NO: 539076 - RNA, 25 nt, Human
gcacgaaaauccuuugagcaugcca

SEQ ID NO: 539077 - RNA, 23 nt, Human
gcauuccagccuggcaacagagu

SEQ ID NO: 539078 - RNA, 24 nt, Human
gcuaacacggugaaaucccgucuc

SEQ ID NO: 539079 - RNA, 24 nt, Human
gcugugcugcugguggucacagcu

SEQ ID NO: 539080 - RNA, 18 nt, Human
ggacacucgggucccugc

SEQ ID NO: 539081 - RNA, 18 nt, Human
ggagguugcagugagccg

SEQ ID NO: 539082 - RNA, 20 nt, Human
ggagguugcagugagccgag

SEQ ID NO: 539083 - RNA, 22 nt, Human
ggagguugcagugagccgagau

SEQ ID NO: 539084 - RNA, 23 nt, Human
ggagguugcagugagccgagaug

SEQ ID NO: 539085 - RNA, 19 nt, Human
ggcaacagagugagacucu

SEQ ID NO: 539086 - RNA, 21 nt, Human
ggcagaucaugaggucaggag

SEQ ID NO: 539087 - RNA, 19 nt, Human
ggcugggugcaguggcuca

SEQ ID NO: 539088 - RNA, 21 nt, Human
ggcugggugcaguggcucacg

SEQ ID NO: 539089 - RNA, 23 nt, Human
ggugcaguggcucacgccuguaa

SEQ ID NO: 539090 - RNA, 19 nt, Human
guaaaauuuucauuaggua

SEQ ID NO: 539091 - RNA, 21 nt, Human
gugaagcgcgcggcugucucc

SEQ ID NO: 539092 - RNA, 24 nt, Human
guugcagugagccgagaugacgcc

SEQ ID NO: 539093 - RNA, 22 nt, Human
uaacacggugaaaucccgucuc

SEQ ID NO: 539094 - RNA, 24 nt, Human
uaacacggugaaaucccgucucua

SEQ ID NO: 539095 - RNA, 21 nt, Human
uaaugauuuugaccagguacc

SEQ ID NO: 539096 - RNA, 19 nt, Human
uacaguuacucuaauagcc

SEQ ID NO: 539097 - RNA, 18 nt, Human
uacauguacauuuguaua

SEQ ID NO: 539098 - RNA, 18 nt, Human
uacauuuguauauacaua

SEQ ID NO: 539099 - RNA, 21 nt, Human
uaccaaagagagcaagauuca

SEQ ID NO: 539100 - RNA, 23 nt, Human
uaccaaagagagcaagauucaac

SEQ ID NO: 539101 - RNA, 18 nt, Human
uaccaacagucugaacca

SEQ ID NO: 539102 - RNA, 25 nt, Human
uaccauggacguaaauuaccucaag

SEQ ID NO: 539103 - RNA, 22 nt, Human
uagcauaccacuacauuaguau

SEQ ID NO: 539104 - RNA, 22 nt, Human
uagccauuugcuacugccagca

SEQ ID NO: 539105 - RNA, 21 nt, Human
uagguacuuuuagaaaugcca

SEQ ID NO: 539106 - RNA, 21 nt, Human
uagguauuuucagaaagucuu

SEQ ID NO: 539107 - RNA, 21 nt, Human
uauauacauagagaaagugca

SEQ ID NO: 539108 - RNA, 19 nt, Human
uauuuuauuuuaggaaagg

SEQ ID NO: 539109 - RNA, 20 nt, Human
uauuuuauuuuaggaaaggu

SEQ ID NO: 539110 - RNA, 21 nt, Human
ucaaaaacaaaaacaaaaaca

SEQ ID NO: 539111 - RNA, 23 nt, Human
ucaaaaugaaaauuuuacaauca

SEQ ID NO: 539112 - RNA, 23 nt, Human
ucacagcuggcugacuggaccag

SEQ ID NO: 539113 - RNA, 19 nt, Human
ucagcacucagcugugcug

SEQ ID NO: 539114 - RNA, 18 nt, Human
ucaugaggucaggagauc

SEQ ID NO: 539115 - RNA, 24 nt, Human
ucaugaggucaggagaucaagacc

SEQ ID NO: 539116 - RNA, 23 nt, Human
uccaccacacagguaccauggac

SEQ ID NO: 539117 - RNA, 18 nt, Human
uccagccuggcaacagag

SEQ ID NO: 539118 - RNA, 22 nt, Human
uccagccuggcaacagagugag

SEQ ID NO: 539119 - RNA, 23 nt, Human
uccagccuggcaacagagugaga

SEQ ID NO: 539120 - RNA, 25 nt, Human
uccuuccuucccaucuggguaucug

SEQ ID NO: 539121 - RNA, 24 nt, Human
ucgcuugaaacugggaggcggagg

SEQ ID NO: 539122 - RNA, 19 nt, Human
ucuccugggcgauuucugg

SEQ ID NO: 539123 - RNA, 22 nt, Human
ucucuacuaaaaauacaaaaaa

SEQ ID NO: 539124 - RNA, 22 nt, Human
ucucuugccuucuucacccagu

SEQ ID NO: 539125 - RNA, 23 nt, Human
ucugcagcaggaauuuaagagac

SEQ ID NO: 539126 - RNA, 21 nt, Human
ugaaagaaaaggccuugccau

SEQ ID NO: 539127 - RNA, 18 nt, Human
ugaccagguaccaggacu

SEQ ID NO: 539128 - RNA, 27 nt, Human
ugacuggaccaggaagaaccuuuuagu

SEQ ID NO: 539129 - RNA, 21 nt, Human
ugagagagcgccuccaccacc

SEQ ID NO: 539130 - RNA, 24 nt, Human
ugaggcaggagaaucgcuugaaac

SEQ ID NO: 539131 - RNA, 20 nt, Human
ugccccguccuuuggaguca

SEQ ID NO: 539132 - RNA, 22 nt, Human
ugcugcugguggucacagcugg

SEQ ID NO: 539133 - RNA, 21 nt, Human
ugcuuuauacaaauucacuua

SEQ ID NO: 539134 - RNA, 21 nt, Human
uggaacauccauuucauucuc

SEQ ID NO: 539135 - RNA, 22 nt, Human
uggagugaagcgcgcggcuguc

SEQ ID NO: 539136 - RNA, 22 nt, Human
uggcucacgccuguaaucccag

SEQ ID NO: 539137 - RNA, 24 nt, Human
uggcucacgccuguaaucccagca

SEQ ID NO: 539138 - RNA, 20 nt, Human
ugggaggccgagacgggcag

SEQ ID NO: 539139 - RNA, 24 nt, Human
ugggaggccgagacgggcagauca

SEQ ID NO: 539140 - RNA, 24 nt, Human
ugggaggcggagguugcagugagc

SEQ ID NO: 539141 - RNA, 19 nt, Human
ugggaggcugaggcaggag

SEQ ID NO: 539142 - RNA, 23 nt, Human
ugggaggcugaggcaggagaauc

SEQ ID NO: 539143 - RNA, 18 nt, Human
ugguaaauguuuaaccac

SEQ ID NO: 539144 - RNA, 24 nt, Human
uguauuaacaaauuagucacaauc

SEQ ID NO: 539145 - RNA, 18 nt, Human
ugugaaagaaaaggccuu

SEQ ID NO: 539146 - RNA, 22 nt, Human
uuagcugugcgugauggcaugc

SEQ ID NO: 539147 - RNA, 21 nt, Human
uuagugcuguuucuauaccuu

SEQ ID NO: 539148 - RNA, 22 nt, Human
uucauugcccaggucaguuacu

SEQ ID NO: 539149 - RNA, 24 nt, Human
uugaaacugggaggcggagguugc

SEQ ID NO: 539150 - RNA, 23 nt, Human
uugauucuucuuucuaaaucugu

SEQ ID NO: 539151 - RNA, 18 nt, Human
uugcagcuuguuuugcuu

SEQ ID NO: 539152 - RNA, 18 nt, Human
uugcagugagccgagaug

SEQ ID NO: 539153 - RNA, 20 nt, Human
uugcagugagccgagaugac

SEQ ID NO: 539154 - RNA, 24 nt, Human
uugggaggcugaggcaggagaauc

SEQ ID NO: 539155 - RNA, 21 nt, Human
uuuacaaacuucaaugaagaa

SEQ ID NO: 539156 - RNA, 22 nt, Human
uuuauacauguacauuuguaua

SEQ ID NO: 539157 - RNA, 19 nt, Human
uuuccagccagauucucag

SEQ ID NO: 539158 - RNA, 20 nt, Human
uuuucagaaagucuuagugc

SEQ ID NO: 539159 - RNA, 19 nt, Human
aaaaacgucauggucacag

SEQ ID NO: 539160 - RNA, 22 nt, Human
aaaaaugcaaaauuagcagggc

SEQ ID NO: 539161 - RNA, 19 nt, Human
aaaacaacaacaacaacaa

SEQ ID NO: 539162 - RNA, 22 nt, Human
aaaacaacaacaacaacaaaac

SEQ ID NO: 539163 - RNA, 22 nt, Human
aaacaacaacaacaacaacaaa

SEQ ID NO: 539164 - RNA, 25 nt, Human
aaacauagcuacuguaaaaauacac

SEQ ID NO: 539165 - RNA, 19 nt, Human
aaacucaaaaggacuaaug

SEQ ID NO: 539166 - RNA, 21 nt, Human
aacaacaacaacaacaacaaa

SEQ ID NO: 539167 - RNA, 20 nt, Human
aacauggagaaaccccgucu

SEQ ID NO: 539168 - RNA, 21 nt, Human
aacauggagaaaccccgucuc

SEQ ID NO: 539169 - RNA, 22 nt, Human
aagaagaaaaaauaagugguag

SEQ ID NO: 539170 - RNA, 24 nt, Human
aagaagaaaaaauaagugguagaa

SEQ ID NO: 539171 - RNA, 27 nt, Human
aagcaagaagaaaaaauaaggggaccc

SEQ ID NO: 539172 - RNA, 23 nt, Human
aagcaagaagaaaaaauaagugg

SEQ ID NO: 539173 - RNA, 18 nt, Human
aagcauguccuuaagucc

SEQ ID NO: 539174 - RNA, 23 nt, Human
aaggaagaaauauuaccugaaaa

SEQ ID NO: 539175 - RNA, 18 nt, Human
aauaagugguagaaauuu

SEQ ID NO: 539176 - RNA, 23 nt, Human
aaucagaaacaagcuuccagcaa

SEQ ID NO: 539177 - RNA, 22 nt, Human
acaacaacaacaacaaacaaua

SEQ ID NO: 539178 - RNA, 23 nt, Human
acaacaacaacaacaacaaacaa

SEQ ID NO: 539179 - RNA, 19 nt, Human
acaagagcgaaacuccauc

SEQ ID NO: 539180 - RNA, 20 nt, Human
acaagagcgaaacuccaucu

SEQ ID NO: 539181 - RNA, 21 nt, Human
acaagagcgaaacuccaucuc

SEQ ID NO: 539182 - RNA, 29 nt, Human
acagucagagcucuucugcacugguaccc

SEQ ID NO: 539183 - RNA, 21 nt, Human
accaaccaccaacuccaggac

SEQ ID NO: 539184 - RNA, 20 nt, Human
accaugagaccuguuugcac

SEQ ID NO: 539185 - RNA, 23 nt, Human
accuggugacacugcccacaguc

SEQ ID NO: 539186 - RNA, 18 nt, Human
acugcacucaagccuggg

SEQ ID NO: 539187 - RNA, 21 nt, Human
acugcacucaagccugggcaa

SEQ ID NO: 539188 - RNA, 20 nt, Human
agaacaccaaccaccaacuc

SEQ ID NO: 539189 - RNA, 24 nt, Human
agaagaaauagagagacccuuagu

SEQ ID NO: 539190 - RNA, 27 nt, Human
agcaagaagaaaaaauaagugguagaa

SEQ ID NO: 539191 - RNA, 20 nt, Human
agcaauacuggccgggcgcg

SEQ ID NO: 539192 - RNA, 23 nt, Human
agcagggcgugguggugcacgcc

SEQ ID NO: 539193 - RNA, 25 nt, Human
agcgaagugcaaagagagacucuag

SEQ ID NO: 539194 - RNA, 22 nt, Human
aggaagaaauauuaccugaaaa

SEQ ID NO: 539195 - RNA, 27 nt, Human
aggcaggagaacagccugaccccagga

SEQ ID NO: 539196 - RNA, 21 nt, Human
aggcauaaaagggguucuugg

SEQ ID NO: 539197 - RNA, 21 nt, Human
aggcauaaaagggguucuugg

SEQ ID NO: 539198 - RNA, 22 nt, Human
aggcauaaaagggguucuuggg

SEQ ID NO: 539199 - RNA, 21 nt, Human
aggccgaggcggguggaucac

SEQ ID NO: 539200 - RNA, 19 nt, Human
aggcggaggcugcggugag

SEQ ID NO: 539201 - RNA, 24 nt, Human
aggcggaggcugcggugagccaag

SEQ ID NO: 539202 - RNA, 20 nt, Human
aggcggguggaucacccgag

SEQ ID NO: 539203 - RNA, 24 nt, Human
aggcggguggaucacccgaguccg

SEQ ID NO: 539204 - RNA, 19 nt, Human
aguccgggaguucaagacc

SEQ ID NO: 539205 - RNA, 19 nt, Human
agugcaaagagagacucua

SEQ ID NO: 539206 - RNA, 19 nt, Human
aucaggauuuguaccaguc

SEQ ID NO: 539207 - RNA, 20 nt, Human
auggagaaaccccgucucca

SEQ ID NO: 539208 - RNA, 24 nt, Human
auugcaucacugcacucaagccug

SEQ ID NO: 539209 - RNA, 23 nt, Human
caaaaaugcaaaauuagcagggc

SEQ ID NO: 539210 - RNA, 25 nt, Human
caacaacaacaacaaacaauacuug

SEQ ID NO: 539211 - RNA, 23 nt, Human
caacaacaacaacaacaaacaag

SEQ ID NO: 539212 - RNA, 30 nt, Human
cacagucagagcucuucugcacugguaccc

SEQ ID NO: 539213 - RNA, 23 nt, Human
caccaaaaaugcaaaauuagcag

SEQ ID NO: 539214 - RNA, 21 nt, Human
caccaagacccuccuccccag

SEQ ID NO: 539215 - RNA, 19 nt, Human
cacgccuauaaucccagcc

SEQ ID NO: 539216 - RNA, 21 nt, Human
cacgccuauaaucccagccac

SEQ ID NO: 539217 - RNA, 21 nt, Human
cacgccuguaaaucucagcac

SEQ ID NO: 539218 - RNA, 19 nt, Human
cacugcacucaagccuggg

SEQ ID NO: 539219 - RNA, 22 nt, Human
cacugcacucaagccugggcaa

SEQ ID NO: 539220 - RNA, 23 nt, Human
cacugcacucaagccugggcaac

SEQ ID NO: 539221 - RNA, 24 nt, Human
cacugcacucaagccugggcaaca

SEQ ID NO: 539222 - RNA, 21 nt, Human
cacuuagugggaccuggugac

SEQ ID NO: 539223 - RNA, 22 nt, Human
cagcacaaguguugccacuuag

SEQ ID NO: 539224 - RNA, 22 nt, Human
cagcacucugggaggccgaggc

SEQ ID NO: 539225 - RNA, 24 nt, Human
cagcacucugggaggccgaggcgg

SEQ ID NO: 539226 - RNA, 24 nt, Human
cagccugaccaacauggagaaacc

SEQ ID NO: 539227 - RNA, 20 nt, Human
caggagaacagccugacccc

SEQ ID NO: 539228 - RNA, 20 nt, Human
caggaggcggaggcugcggu

SEQ ID NO: 539229 - RNA, 18 nt, Human
cagucuuuuccuuuuucc

SEQ ID NO: 539230 - RNA, 23 nt, Human
cagugcagggcuggguauaaguc

SEQ ID NO: 539231 - RNA, 21 nt, Human
caucgcauucaccaugagacc

SEQ ID NO: 539232 - RNA, 22 nt, Human
caucucaaaacaacaacaacaa

SEQ ID NO: 539233 - RNA, 23 nt, Human
caucucaaaacaacaacaacaac

SEQ ID NO: 539234 - RNA, 18 nt, Human
caucugcuuucuguuuuc

SEQ ID NO: 539235 - RNA, 19 nt, Human
ccaaaaaugcaaaauuagc

SEQ ID NO: 539236 - RNA, 18 nt, Human
ccaagacccuccucccca

SEQ ID NO: 539237 - RNA, 21 nt, Human
ccaaucagaaacaagcuucca

SEQ ID NO: 539238 - RNA, 21 nt, Human
ccacucgggagacccaggcag

SEQ ID NO: 539239 - RNA, 18 nt, Human
ccaucucaaaacaacaac

SEQ ID NO: 539240 - RNA, 22 nt, Human
ccuaggcugaggguagugagac

SEQ ID NO: 539241 - RNA, 19 nt, Human
ccuauaaucccagccacuc

SEQ ID NO: 539242 - RNA, 22 nt, Human
ccuauaaucccagccacucggg

SEQ ID NO: 539243 - RNA, 30 nt, Human
ccuauaaucccagccacucgggagacccaa

SEQ ID NO: 539244 - RNA, 21 nt, Human
ccuccuccccagcugagagac

SEQ ID NO: 539245 - RNA, 23 nt, Human
ccugaccaacauggagaaacccc

SEQ ID NO: 539246 - RNA, 24 nt, Human
ccugaccaacauggagaaaccccg

SEQ ID NO: 539247 - RNA, 22 nt, Human
cgaggcggguggaucacccgag

SEQ ID NO: 539248 - RNA, 19 nt, Human
cgccuauaaucccagccac

SEQ ID NO: 539249 - RNA, 19 nt, Human
cgccuguaaaucucagcac

SEQ ID NO: 539250 - RNA, 24 nt, Human
cggguggaucacccgaguccggga

SEQ ID NO: 539251 - RNA, 20 nt, Human
cucaaggaagaaauauuacc

SEQ ID NO: 539252 - RNA, 24 nt, Human
cucacgccuguaaaucucagcacu

SEQ ID NO: 539253 - RNA, 21 nt, Human
cugcggugagccaagauugca

SEQ ID NO: 539254 - RNA, 24 nt, Human
cuggguauaagucuaugcauuggu

SEQ ID NO: 539255 - RNA, 21 nt, Human
gaauccauuucaaauuaaagc

SEQ ID NO: 539256 - RNA, 20 nt, Human
gacccuccuccccagcugag

SEQ ID NO: 539257 - RNA, 21 nt, Human
gagaaaccccgucuccaccaa

SEQ ID NO: 539258 - RNA, 26 nt, Human
gagcaacccaucccuaauauaacauu

SEQ ID NO: 539259 - RNA, 20 nt, Human
gaggcggguggaucacccga

SEQ ID NO: 539260 - RNA, 23 nt, Human
gaggcugcggugagccaagauug

SEQ ID NO: 539261 - RNA, 24 nt, Human
gaucacccgaguccgggaguucaa

SEQ ID NO: 539262 - RNA, 22 nt, Human
gauuuguaccagucuuuuccuu

SEQ ID NO: 539263 - RNA, 22 nt, Human
ggaggcugcggugagccaagau

SEQ ID NO: 539264 - RNA, 24 nt, Human
ggaggcugcggugagccaagauug

SEQ ID NO: 539265 - RNA, 21 nt, Human
ggccgggcgcgguggcucacg

SEQ ID NO: 539266 - RNA, 24 nt, Human
ggccuaggcugaggguagugagac

SEQ ID NO: 539267 - RNA, 24 nt, Human
gggcgcgguggcucacgccuguaa

SEQ ID NO: 539268 - RNA, 24 nt, Human
gggcgugguggugcacgccuauaa

SEQ ID NO: 539269 - RNA, 22 nt, Human
ggguauaagucuaugcauuggu

SEQ ID NO: 539270 - RNA, 21 nt, Human
ggugcacgccuauaaucccag

SEQ ID NO: 539271 - RNA, 25 nt, Human
gguggcucacgccuguaaaucucag

SEQ ID NO: 539272 - RNA, 20 nt, Human
gugcucauuccuacaacugg

SEQ ID NO: 539273 - RNA, 23 nt, Human
guggugcacgccuauaaucccag

SEQ ID NO: 539274 - RNA, 22 nt, Human
guguugccacuuagugggaccu

SEQ ID NO: 539275 - RNA, 19 nt, Human
uaaaagggguucuugggca

SEQ ID NO: 539276 - RNA, 24 nt, Human
uaacaaacgugacaucugcuuucu

SEQ ID NO: 539277 - RNA, 28 nt, Human
uaaccaaaugagcaacccaucccuaaua

SEQ ID NO: 539278 - RNA, 22 nt, Human
uagauagaacaccaaccaccaa

SEQ ID NO: 539279 - RNA, 18 nt, Human
uagcagggcgugguggug

SEQ ID NO: 539280 - RNA, 18 nt, Human
uagcagggcgugguggug

SEQ ID NO: 539281 - RNA, 22 nt, Human
ucaccaaucagaaacaagcuuc

SEQ ID NO: 539282 - RNA, 21 nt, Human
ucacugcacucaagccugggc

SEQ ID NO: 539283 - RNA, 24 nt, Human
ucacugcacucaagccugggcaac

SEQ ID NO: 539284 - RNA, 20 nt, Human
ucagagcucuucugcacugg

SEQ ID NO: 539285 - RNA, 18 nt, Human
uccaggacgugaacauuc

SEQ ID NO: 539286 - RNA, 24 nt, Human
ucgccuagauagaacaccaaccac

SEQ ID NO: 539287 - RNA, 24 nt, Human
ucuucauauaaaauguagcgguca

SEQ ID NO: 539288 - RNA, 27 nt, Human
ugaacuguuaaaguguuuuccaaggga

SEQ ID NO: 539289 - RNA, 21 nt, Human
ugaccccaggaggcggaggcu

SEQ ID NO: 539290 - RNA, 23 nt, Human
ugaguuaaauucuuaauuugagc

SEQ ID NO: 539291 - RNA, 19 nt, Human
ugaguuuuaucuuccuguc

SEQ ID NO: 539292 - RNA, 21 nt, Human
ugauuaaccacuuccuugaaa

SEQ ID NO: 539293 - RNA, 26 nt, Human
ugcacugguaccuucucugcccuugu

SEQ ID NO: 539294 - RNA, 21 nt, Human
ugcuaccagauaaaugagcaa

SEQ ID NO: 539295 - RNA, 22 nt, Human
uggagaggugaguuaaauucuu

SEQ ID NO: 539296 - RNA, 24 nt, Human
uggaucacccgaguccgggaguuc

SEQ ID NO: 539297 - RNA, 23 nt, Human
uggcucacgccuguaaaucucag

SEQ ID NO: 539298 - RNA, 25 nt, Human
uggcucacgccuguaaaucucagca

SEQ ID NO: 539299 - RNA, 23 nt, Human
ugggaggccgaggcggguggauc

SEQ ID NO: 539300 - RNA, 24 nt, Human
ugggaggccgaggcggguggauca

SEQ ID NO: 539301 - RNA, 21 nt, Human
uggucaagagaagaaauagag

SEQ ID NO: 539302 - RNA, 22 nt, Human
uggugcacgccuauaaucccag

SEQ ID NO: 539303 - RNA, 21 nt, Human
uuaaauaucaggauuuguacc

SEQ ID NO: 539304 - RNA, 20 nt, Human
uuagcagggcgugguggugc

SEQ ID NO: 539305 - RNA, 22 nt, Human
uuagcagggcgugguggugcac

SEQ ID NO: 539306 - RNA, 24 nt, Human
uuagcagggcgugguggugcacgc

SEQ ID NO: 539307 - RNA, 18 nt, Human
uuagcauugaugaucuuu

SEQ ID NO: 539308 - RNA, 22 nt, Human
uuauacaucaagaugggucaag

SEQ ID NO: 539309 - RNA, 21 nt, Human
uuccacuggaaaaauuuuugg

SEQ ID NO: 539310 - RNA, 18 nt, Human
uuccuccagcgaagugca

SEQ ID NO: 539311 - RNA, 18 nt, Human
uugaaaucaauaaaacac

SEQ ID NO: 539312 - RNA, 23 nt, Human
uuuaagacuuuagggaagauaag

SEQ ID NO: 539313 - RNA, 21 nt, Human
uuuuaagacuuuagggaagau

SEQ ID NO: 539314 - RNA, 21 nt, Human
aaaagacagacacaguggagg

SEQ ID NO: 539315 - RNA, 19 nt, Human
aaacagcaaagagacagag

SEQ ID NO: 539316 - RNA, 23 nt, Human
aaacagcaaagagacagagacag

SEQ ID NO: 539317 - RNA, 20 nt, Human
aaagagacagagacagacag

SEQ ID NO: 539318 - RNA, 20 nt, Human
aaaggaaggaugggcaaagg

SEQ ID NO: 539319 - RNA, 23 nt, Human
aagaaaagacagacacaguggaa

SEQ ID NO: 539320 - RNA, 18 nt, Human
aagagggcagaaauuagg

SEQ ID NO: 539321 - RNA, 22 nt, Human
aaggaauuaggaguagacagac

SEQ ID NO: 539322 - RNA, 21 nt, Human
acaaacagcaaagagacagag

SEQ ID NO: 539323 - RNA, 23 nt, Human
acaaacagcaaagagacagagac

SEQ ID NO: 539324 - RNA, 20 nt, Human
acagagacagacagaggguu

SEQ ID NO: 539325 - RNA, 19 nt, Human
agaagggguggacacaggu

SEQ ID NO: 539326 - RNA, 23 nt, Human
agacaagagggcagaaauuaggg

SEQ ID NO: 539327 - RNA, 23 nt, Human
agacacaguggaggcugaaugac

SEQ ID NO: 539328 - RNA, 21 nt, Human
agacagaggguuuuggggggc

SEQ ID NO: 539329 - RNA, 23 nt, Human
agagauggagaagggcagugaag

SEQ ID NO: 539330 - RNA, 20 nt, Human
agaugggaaacagaauggga

SEQ ID NO: 539331 - RNA, 19 nt, Human
agcaccaacuacgcccuac

SEQ ID NO: 539332 - RNA, 20 nt, Human
agcagcagcaguggggggac

SEQ ID NO: 539333 - RNA, 21 nt, Human
agccugguccgaucccgggcc

SEQ ID NO: 539334 - RNA, 23 nt, Human
aggaaaggaugggguccugaggg

SEQ ID NO: 539335 - RNA, 23 nt, Human
aggaagagauggagaagggggac

SEQ ID NO: 539336 - RNA, 22 nt, Human
aggaaggaugggcaaaggggac

SEQ ID NO: 539337 - RNA, 19 nt, Human
aggaggaagagauggagaa

SEQ ID NO: 539338 - RNA, 24 nt, Human
agggagccugguccgaucccgggc

SEQ ID NO: 539339 - RNA, 24 nt, Human
agggauggagauucgaggaagaag

SEQ ID NO: 539340 - RNA, 19 nt, Human
aggguuuuggggggcaggg

SEQ ID NO: 539341 - RNA, 23 nt, Human
augagcagacaaggugccagcca

SEQ ID NO: 539342 - RNA, 18 nt, Human
augggaaacagaauggga

SEQ ID NO: 539343 - RNA, 25 nt, Human
cacaguggaggcugaaugaccccca

SEQ ID NO: 539344 - RNA, 21 nt, Human
caccaacuacgcccuacgugc

SEQ ID NO: 539345 - RNA, 20 nt, Human
cagcagagaacaagguccug

SEQ ID NO: 539346 - RNA, 22 nt, Human
cagcagagaacaagguccugga

SEQ ID NO: 539347 - RNA, 18 nt, Human
cagcagcaguggggggac

SEQ ID NO: 539348 - RNA, 21 nt, Human
cagcagcaguggggggaccgg

SEQ ID NO: 539349 - RNA, 23 nt, Human
cagggacaaaugaacaaggagga

SEQ ID NO: 539350 - RNA, 20 nt, Human
cauccagcaccaacuacgcc

SEQ ID NO: 539351 - RNA, 21 nt, Human
cauccagcaccaacuacgccc

SEQ ID NO: 539352 - RNA, 23 nt, Human
cauucaacaaacauccauccagc

SEQ ID NO: 539353 - RNA, 25 nt, Human
cauucaacaaacauccauccagcac

SEQ ID NO: 539354 - RNA, 21 nt, Human
cccagggaagaaaagacagac

SEQ ID NO: 539355 - RNA, 19 nt, Human
cccccagacaugcauggcc

SEQ ID NO: 539356 - RNA, 22 nt, Human
cucucgcuuccaggguuaggaa

SEQ ID NO: 539357 - RNA, 20 nt, Human
cugaaugacccccacccuga

SEQ ID NO: 539358 - RNA, 22 nt, Human
cugagucuuggacaaacagcaa

SEQ ID NO: 539359 - RNA, 22 nt, Human
gaaaagacagacacaguggagg

SEQ ID NO: 539360 - RNA, 22 nt, Human
gaaagagacaccgagaaaagga

SEQ ID NO: 539361 - RNA, 22 nt, Human
gaagaaggacaaggugacaggu

SEQ ID NO: 539362 - RNA, 23 nt, Human
gacaagagggcagaaauuaggga

SEQ ID NO: 539363 - RNA, 22 nt, Human
gagacagacagaggguuuuggg

SEQ ID NO: 539364 - RNA, 23 nt, Human
gaugaaggaacaggaguuaggga

SEQ ID NO: 539365 - RNA, 19 nt, Human
gaugggcaugaguggagua

SEQ ID NO: 539366 - RNA, 22 nt, Human
gcagcagcaguggggggaccgg

SEQ ID NO: 539367 - RNA, 19 nt, Human
gcaggaaaggauggggucc

SEQ ID NO: 539368 - RNA, 19 nt, Human
gcagggugggcaggugugg

SEQ ID NO: 539369 - RNA, 20 nt, Human
gccuagggccagggcugccc

SEQ ID NO: 539370 - RNA, 23 nt, Human
ggaaagagacaccgagaaaagga

SEQ ID NO: 539371 - RNA, 21 nt, Human
ggagauaaggguggaaagaga

SEQ ID NO: 539372 - RNA, 20 nt, Human
ggagccccagggaagaaaag

SEQ ID NO: 539373 - RNA, 22 nt, Human
ggauggagauaguagcagggac

SEQ ID NO: 539374 - RNA, 18 nt, Human
ggcaggaaaggauggggu

SEQ ID NO: 539375 - RNA, 23 nt, Human
ggcagugaaggggcuaagaauga

SEQ ID NO: 539376 - RNA, 20 nt, Human
gggaagaaaagacagacaca

SEQ ID NO: 539377 - RNA, 23 nt, Human
gggaagaaaagacagacacagug

SEQ ID NO: 539378 - RNA, 22 nt, Human
gggauggagauucgaggaagaa

SEQ ID NO: 539379 - RNA, 19 nt, Human
ggguccugagggagccugg

SEQ ID NO: 539380 - RNA, 22 nt, Human
gugggagggauggggcaagggu

SEQ ID NO: 539381 - RNA, 19 nt, Human
uagacagacaagagggcag

SEQ ID NO: 539382 - RNA, 23 nt, Human
uagcagcagcaguggggggaccg

SEQ ID NO: 539383 - RNA, 20 nt, Human
uagcagggacuggguaaguc

SEQ ID NO: 539384 - RNA, 20 nt, Human
ucaacaaacauccauccagc

SEQ ID NO: 539385 - RNA, 21 nt, Human
uccgggcaggaaaggaugggg

SEQ ID NO: 539386 - RNA, 26 nt, Human
ucgagggggagccccagggaaggaag

SEQ ID NO: 539387 - RNA, 21 nt, Human
ugaaagaaggagcugggccgg

SEQ ID NO: 539388 - RNA, 19 nt, Human
ugaaggaacaggaguuagg

SEQ ID NO: 539389 - RNA, 21 nt, Human
ugacagguauuagggauggac

SEQ ID NO: 539390 - RNA, 22 nt, Human
ugaccucccggugucacaaucc

SEQ ID NO: 539391 - RNA, 21 nt, Human
ugagucuuggacaaacagcaa

SEQ ID NO: 539392 - RNA, 23 nt, Human
ugagucuuggacaaacagcaaag

SEQ ID NO: 539393 - RNA, 19 nt, Human
uggaaagagacaccgagaa

SEQ ID NO: 539394 - RNA, 24 nt, Human
uggaaagagacaccgagaaaagga

SEQ ID NO: 539395 - RNA, 21 nt, Human
uggagauaaggguggaaagag

SEQ ID NO: 539396 - RNA, 20 nt, Human
uggagauaguagcagggacu

SEQ ID NO: 539397 - RNA, 25 nt, Human
uggagugagacccacagaguguguu

SEQ ID NO: 539398 - RNA, 19 nt, Human
ugggagugcagggugggca

SEQ ID NO: 539399 - RNA, 18 nt, Human
uggggggcaggggucccc

SEQ ID NO: 539400 - RNA, 24 nt, Human
ugggguccugagggagccuggucc

SEQ ID NO: 539401 - RNA, 22 nt, Human
ugucugaaaggacagagaggau

SEQ ID NO: 539402 - RNA, 18 nt, Human
uguggcgaacagaagggg

SEQ ID NO: 539403 - RNA, 25 nt, Human
uguggcgaacagaagggguggacac

SEQ ID NO: 539404 - RNA, 18 nt, Human
uuuuuuuuuuuuuuuuug

SEQ ID NO: 539405 - RNA, 22 nt, Human
uuuuuuuuuuuuuuuuuggagu

SEQ ID NO: 539406 - RNA, 24 nt, Human
aaaacuguaucauuacagaagaca

SEQ ID NO: 539407 - RNA, 21 nt, Human
aaacagccugugcacaaagau

SEQ ID NO: 539408 - RNA, 23 nt, Human
aaagcaucucccuucccccacuu

SEQ ID NO: 539409 - RNA, 25 nt, Human
aacagaacuuuccuucacaugcacu

SEQ ID NO: 539410 - RNA, 24 nt, Human
aacagcauuagugauuggcaacug

SEQ ID NO: 539411 - RNA, 19 nt, Human
aaccuucuccccuacucug

SEQ ID NO: 539412 - RNA, 23 nt, Human
aacucagguccccaagagacaga

SEQ ID NO: 539413 - RNA, 25 nt, Human
aagcaucucccuucccccacuuucg

SEQ ID NO: 539414 - RNA, 19 nt, Human
aaggacacugacaauccac

SEQ ID NO: 539415 - RNA, 23 nt, Human
acagaguugauggugagugggug

SEQ ID NO: 539416 - RNA, 24 nt, Human
acagcaacaaaacuauguuaaaac

SEQ ID NO: 539417 - RNA, 21 nt, Human
accccaaaauauguacaaagc

SEQ ID NO: 539418 - RNA, 18 nt, Human
accccaaccuucuccccu

SEQ ID NO: 539419 - RNA, 22 nt, Human
accccagcaaccacugaauguc

SEQ ID NO: 539420 - RNA, 24 nt, Human
accccagcaaccacugaauguccu

SEQ ID NO: 539421 - RNA, 25 nt, Human
acggaagugaggagcuggguuuccu

SEQ ID NO: 539422 - RNA, 18 nt, Human
acuccaaaauaaaauauu

SEQ ID NO: 539423 - RNA, 19 nt, Human
acuuucuggguuuuguuuu

SEQ ID NO: 539424 - RNA, 27 nt, Human
agaagucagugaaaugccaacugaaac

SEQ ID NO: 539425 - RNA, 21 nt, Human
agacagagacacaggggcugu

SEQ ID NO: 539426 - RNA, 20 nt, Human
agacccaccuugugccuacc

SEQ ID NO: 539427 - RNA, 19 nt, Human
agaccuaguagguuuggug

SEQ ID NO: 539428 - RNA, 21 nt, Human
agccacuccaaaauaaaauau

SEQ ID NO: 539429 - RNA, 26 nt, Human
agccuacuuaccaaaaggguaccaug

SEQ ID NO: 539430 - RNA, 21 nt, Human
aggggauacaaauauuuccgg

SEQ ID NO: 539431 - RNA, 20 nt, Human
aguggguggcaguagucugc

SEQ ID NO: 539432 - RNA, 25 nt, Human
auagagcaaaggacacugacaaucc

SEQ ID NO: 539433 - RNA, 22 nt, Human
aucgcagucacuuuucccagca

SEQ ID NO: 539434 - RNA, 23 nt, Human
augacaacaggagcgugugcguc

SEQ ID NO: 539435 - RNA, 18 nt, Human
augagaagaccuaguagg

SEQ ID NO: 539436 - RNA, 25 nt, Human
auuuaucuaacaugugguuuacaug

SEQ ID NO: 539437 - RNA, 21 nt, Human
caaaaugcuuuaggacauuaa

SEQ ID NO: 539438 - RNA, 24 nt, Human
caaagaaugucaaaaccauggaaa

SEQ ID NO: 539439 - RNA, 24 nt, Human
caaaggacacugacaauccacaaa

SEQ ID NO: 539440 - RNA, 21 nt, Human
caaaggacacugacaauccag

SEQ ID NO: 539441 - RNA, 19 nt, Human
caagauggacauguuuauc

SEQ ID NO: 539442 - RNA, 26 nt, Human
cacccaaacucagguccccaagagac

SEQ ID NO: 539443 - RNA, 20 nt, Human
cacccagagcucugccccca

SEQ ID NO: 539444 - RNA, 20 nt, Human
caccccacccaaacucaggu

SEQ ID NO: 539445 - RNA, 24 nt, Human
caccccuucacuaacucccaucuc

SEQ ID NO: 539446 - RNA, 19 nt, Human
cagcucagccaugucccuu

SEQ ID NO: 539447 - RNA, 21 nt, Human
cagguccccaagagacagaga

SEQ ID NO: 539448 - RNA, 18 nt, Human
cauccuccuuagcuggag

SEQ ID NO: 539449 - RNA, 23 nt, Human
caugacaacaggagcgugugcgu

SEQ ID NO: 539450 - RNA, 20 nt, Human
ccaaagaaugucaaaaccau

SEQ ID NO: 539451 - RNA, 23 nt, Human
ccaaagaaugucaaaaccaugga

SEQ ID NO: 539452 - RNA, 23 nt, Human
ccaacagucugcucuugcuuccc

SEQ ID NO: 539453 - RNA, 21 nt, Human
ccaagcagaggugccaugagc

SEQ ID NO: 539454 - RNA, 27 nt, Human
ccaccugaacagccuuggcuggagucc

SEQ ID NO: 539455 - RNA, 20 nt, Human
ccacugaauguccuugaccu

SEQ ID NO: 539456 - RNA, 24 nt, Human
ccccaaccuucuccccuacucucc

SEQ ID NO: 539457 - RNA, 19 nt, Human
ccccaagagacagagacac

SEQ ID NO: 539458 - RNA, 26 nt, Human
ccccagaagauagagcaaaggacacu

SEQ ID NO: 539459 - RNA, 18 nt, Human
ccccagcaaccacugaau

SEQ ID NO: 539460 - RNA, 20 nt, Human
cccuaagucaaccucagcac

SEQ ID NO: 539461 - RNA, 22 nt, Human
cccuacucuggggagcuucucc

SEQ ID NO: 539462 - RNA, 24 nt, Human
cccuacucuggggagcuucuccug

SEQ ID NO: 539463 - RNA, 20 nt, Human
ccggaaaccauuuugucaau

SEQ ID NO: 539464 - RNA, 19 nt, Human
ccucagcacaugcccagcu

SEQ ID NO: 539465 - RNA, 23 nt, Human
ccuucacuccccuacaggcugga

SEQ ID NO: 539466 - RNA, 26 nt, Human
ccuugcugguggcaguguaaggggau

SEQ ID NO: 539467 - RNA, 21 nt, Human
ccuuggcuggaguccagggga

SEQ ID NO: 539468 - RNA, 18 nt, Human
cgccucauccuccuuagc

SEQ ID NO: 539469 - RNA, 22 nt, Human
cgguucuucagaaucgcaguca

SEQ ID NO: 539470 - RNA, 23 nt, Human
cuaagugaaaacagcugcacaaa

SEQ ID NO: 539471 - RNA, 24 nt, Human
cucccuucccccacuuucguagcc

SEQ ID NO: 539472 - RNA, 23 nt, Human
cuccuguuggcccaacagucugc

SEQ ID NO: 539473 - RNA, 20 nt, Human
gacaacaggagcgugugcgu

SEQ ID NO: 539474 - RNA, 23 nt, Human
gaccccagcaaccacugaauguc

SEQ ID NO: 539475 - RNA, 21 nt, Human
gaggaaauacaaucgcuccac

SEQ ID NO: 539476 - RNA, 23 nt, Human
gcaaaggacacugacaauccaca

SEQ ID NO: 539477 - RNA, 19 nt, Human
gcacugaagccuacuuacc

SEQ ID NO: 539478 - RNA, 23 nt, Human
gcagggcaauugggcuaacagag

SEQ ID NO: 539479 - RNA, 21 nt, Human
gccaacugccaccccacccaa

SEQ ID NO: 539480 - RNA, 24 nt, Human
gccuuggcuggaguccaggggaac

SEQ ID NO: 539481 - RNA, 20 nt, Human
ggaaaacagaacuuuccuuc

SEQ ID NO: 539482 - RNA, 26 nt, Human
ggcaagauggacauguuuauccuugc

SEQ ID NO: 539483 - RNA, 22 nt, Human
gggaaagccugagagacaccaa

SEQ ID NO: 539484 - RNA, 19 nt, Human
guggaaggcccuacacccc

SEQ ID NO: 539485 - RNA, 19 nt, Human
guggaaggcccuacacccc

SEQ ID NO: 539486 - RNA, 20 nt, Human
guuuuauuuccuucuuuccu

SEQ ID NO: 539487 - RNA, 22 nt, Human
guuuuguuuuccacuccuccuc

SEQ ID NO: 539488 - RNA, 22 nt, Human
uaaccccaaaauauguacaaag

SEQ ID NO: 539489 - RNA, 22 nt, Human
uacaaagcaucucccuuccccc

SEQ ID NO: 539490 - RNA, 21 nt, Human
uacaccccaaccuucuccccu

SEQ ID NO: 539491 - RNA, 24 nt, Human
uacagaagacagcaacaaaacuag

SEQ ID NO: 539492 - RNA, 21 nt, Human
uaccaaaaggguaccaugugg

SEQ ID NO: 539493 - RNA, 23 nt, Human
uauaaccccaaaauauguacaaa

SEQ ID NO: 539494 - RNA, 24 nt, Human
uauuuuuucauuaucaaauuagca

SEQ ID NO: 539495 - RNA, 22 nt, Human
ucacaauacaguccaaagaaug

SEQ ID NO: 539496 - RNA, 22 nt, Human
ucaccccuucacuaacucccau

SEQ ID NO: 539497 - RNA, 20 nt, Human
ucacuccccuacaggcugga

SEQ ID NO: 539498 - RNA, 24 nt, Human
uccaaaauaaaauauuuaguaauc

SEQ ID NO: 539499 - RNA, 24 nt, Human
uccccuacaggcuggaacugccag

SEQ ID NO: 539500 - RNA, 20 nt, Human
ucccuaaaccagugcuuucc

SEQ ID NO: 539501 - RNA, 23 nt, Human
ucccuaaaccagugcuuuccaag

SEQ ID NO: 539502 - RNA, 25 nt, Human
ucccuaaaccagugcuuuccaagca

SEQ ID NO: 539503 - RNA, 19 nt, Human
ucccucuggggcugcgccu

SEQ ID NO: 539504 - RNA, 21 nt, Human
ucccucuggggcugcgccuca

SEQ ID NO: 539505 - RNA, 18 nt, Human
uccuucacaugcacuguu

SEQ ID NO: 539506 - RNA, 22 nt, Human
ucuaagucccuaaaccagugac

SEQ ID NO: 539507 - RNA, 29 nt, Human
ucuugcuucccuuacccaggagacccacc

SEQ ID NO: 539508 - RNA, 22 nt, Human
ugaaaacagcugcacaaaacug

SEQ ID NO: 539509 - RNA, 19 nt, Human
ugauggugaguggguggca

SEQ ID NO: 539510 - RNA, 22 nt, Human
ugauguuuuauuuccuucuuuc

SEQ ID NO: 539511 - RNA, 26 nt, Human
ugccaccccacccaaacucagguccc

SEQ ID NO: 539512 - RNA, 18 nt, Human
ugccaugagccuuacaac

SEQ ID NO: 539513 - RNA, 19 nt, Human
ugcugguggcaguguaagg

SEQ ID NO: 539514 - RNA, 24 nt, Human
uggcaguagucugcggaccccagc

SEQ ID NO: 539515 - RNA, 18 nt, Human
uggguuuccucccaucuc

SEQ ID NO: 539516 - RNA, 21 nt, Human
uggguuuuguuuuccacuccu

SEQ ID NO: 539517 - RNA, 19 nt, Human
uguaugcaaaggcaugagg

SEQ ID NO: 539518 - RNA, 18 nt, Human
ugucuguuccacguggaa

SEQ ID NO: 539519 - RNA, 19 nt, Human
uuaccaaaaggguaccaug

SEQ ID NO: 539520 - RNA, 20 nt, Human
uuagccagaugauaauuccc

SEQ ID NO: 539521 - RNA, 21 nt, Human
uuaggaucucuucccucuucc

SEQ ID NO: 539522 - RNA, 21 nt, Human
uucacuccccuacaggcugga

SEQ ID NO: 539523 - RNA, 19 nt, Human
uucccuaagucaaccucag

SEQ ID NO: 539524 - RNA, 22 nt, Human
uugaagaaucccaccuccugga

SEQ ID NO: 539525 - RNA, 18 nt, Human
uuggcuggaguccagggg

SEQ ID NO: 539526 - RNA, 21 nt, Human
uugggggggaaagccugagag

SEQ ID NO: 539527 - RNA, 21 nt, Human
uuuccucccaucucuaccgca

SEQ ID NO: 539528 - RNA, 20 nt, Human
uuucuggguuuuguuuucca

SEQ ID NO: 539529 - RNA, 18 nt, Human
uuuuuuuuuuuuuuuuug

SEQ ID NO: 539530 - RNA, 20 nt, Human
aaaggaagaucaagaaucca

SEQ ID NO: 539531 - RNA, 20 nt, Human
aaauacauacucaaaacgua

SEQ ID NO: 539532 - RNA, 18 nt, Human
aacacguuuauugagcgc

SEQ ID NO: 539533 - RNA, 22 nt, Human
aacucuuuuauuggauuucuau

SEQ ID NO: 539534 - RNA, 22 nt, Human
aauccaugucccauuucucccu

SEQ ID NO: 539535 - RNA, 21 nt, Human
acacacacacacacacacaca

SEQ ID NO: 539536 - RNA, 22 nt, Human
acacacacacacacacacacag

SEQ ID NO: 539537 - RNA, 20 nt, Human
acacacacacacacacagaa

SEQ ID NO: 539538 - RNA, 21 nt, Human
acagaauuuaccugucucaga

SEQ ID NO: 539539 - RNA, 23 nt, Human
accaccuuuucuugaaggaggug

SEQ ID NO: 539540 - RNA, 23 nt, Human
agaacaaccuugugaaaggucac

SEQ ID NO: 539541 - RNA, 19 nt, Human
agcaagaagaaccuuaaau

SEQ ID NO: 539542 - RNA, 21 nt, Human
aggacugggacagcagaagug

SEQ ID NO: 539543 - RNA, 18 nt, Human
aucacuuuuauuuguaca

SEQ ID NO: 539544 - RNA, 20 nt, Human
cacacacacacacacacaca

SEQ ID NO: 539545 - RNA, 20 nt, Human
cacacacacacacacacaca

SEQ ID NO: 539546 - RNA, 22 nt, Human
cacacacacacacacacacaga

SEQ ID NO: 539547 - RNA, 26 nt, Human
cacacacacacacagaauucuuuuca

SEQ ID NO: 539548 - RNA, 19 nt, Human
cacagggcuguccccuucc

SEQ ID NO: 539549 - RNA, 19 nt, Human
cagcagaagugagacugac

SEQ ID NO: 539550 - RNA, 19 nt, Human
caugccccaacaaauacug

SEQ ID NO: 539551 - RNA, 21 nt, Human
ccaaauuuucaucuagauaaa

SEQ ID NO: 539552 - RNA, 18 nt, Human
ccaccacuucuacccagg

SEQ ID NO: 539553 - RNA, 21 nt, Human
cccacauguagggcucaggac

SEQ ID NO: 539554 - RNA, 22 nt, Human
cccauuucucccuuuguguccc

SEQ ID NO: 539555 - RNA, 30 nt, Human
ccuauuuauugugcacacacacacacagug

SEQ ID NO: 539556 - RNA, 26 nt, Human
ccuccaaccccacauguagggcucag

SEQ ID NO: 539557 - RNA, 20 nt, Human
ccucggacgggagggaugag

SEQ ID NO: 539558 - RNA, 18 nt, Human
ccuuugcacagguccacc

SEQ ID NO: 539559 - RNA, 23 nt, Human
cguuauaguucuccuccaacccc

SEQ ID NO: 539560 - RNA, 24 nt, Human
cuaggcccacagagaaugcacaca

SEQ ID NO: 539561 - RNA, 33 nt, Human
cuauuuauugugcacacacacacacacacagug

SEQ ID NO: 539562 - RNA, 24 nt, Human
cucagaaucagauaaaaggggacc

SEQ ID NO: 539563 - RNA, 22 nt, Human
cuccaaccccacauguagggcu

SEQ ID NO: 539564 - RNA, 18 nt, Human
cugagcuacuaagccuuc

SEQ ID NO: 539565 - RNA, 18 nt, Human
cuguccccuucccugcua

SEQ ID NO: 539566 - RNA, 24 nt, Human
gaacaauacauguugaauguucuu

SEQ ID NO: 539567 - RNA, 19 nt, Human
gaacauauacucaugcaug

SEQ ID NO: 539568 - RNA, 19 nt, Human
gaauugauuccaagaacau

SEQ ID NO: 539569 - RNA, 20 nt, Human
ggccugcuacugcauuuccu

SEQ ID NO: 539570 - RNA, 19 nt, Human
uaaaaggagaaacacguuu

SEQ ID NO: 539571 - RNA, 26 nt, Human
uaacaaacagaauuuaccugucucag

SEQ ID NO: 539572 - RNA, 18 nt, Human
uaaggugaaacucagagg

SEQ ID NO: 539573 - RNA, 28 nt, Human
uaaggugaaacucagagguuuuuccguu

SEQ ID NO: 539574 - RNA, 23 nt, Human
uauaguucuccuccaaccccaca

SEQ ID NO: 539575 - RNA, 18 nt, Human
uauccccauuuacacaua

SEQ ID NO: 539576 - RNA, 25 nt, Human
uauccccauuuacacauaaagaauc

SEQ ID NO: 539577 - RNA, 22 nt, Human
ucaauccucagaacaaccuugu

SEQ ID NO: 539578 - RNA, 22 nt, Human
uccauaucuguaauccugagca

SEQ ID NO: 539579 - RNA, 23 nt, Human
ucccugggaaagaccauucucug

SEQ ID NO: 539580 - RNA, 25 nt, Human
ucccugggaaagaccauucucuguu

SEQ ID NO: 539581 - RNA, 19 nt, Human
ucccuucaacucuuuuauu

SEQ ID NO: 539582 - RNA, 23 nt, Human
uccuuagucuaaucggaacuagg

SEQ ID NO: 539583 - RNA, 22 nt, Human
ucuaaaaccuccuuugcacagg

SEQ ID NO: 539584 - RNA, 28 nt, Human
ucuaggacugggacagcagaagugagac

SEQ ID NO: 539585 - RNA, 22 nt, Human
ucuauaccuaaggugaaacuca

SEQ ID NO: 539586 - RNA, 20 nt, Human
ugcacacacacacacacaca

SEQ ID NO: 539587 - RNA, 19 nt, Human
ugcacacagcacagcugug

SEQ ID NO: 539588 - RNA, 26 nt, Human
ugccacagggcuguccccuucccugc

SEQ ID NO: 539589 - RNA, 22 nt, Human
ugccccaacaaauacugcagag

SEQ ID NO: 539590 - RNA, 22 nt, Human
ugggaaagaccauucucuguuc

SEQ ID NO: 539591 - RNA, 25 nt, Human
uguacaaauacauacucaaaacgua

SEQ ID NO: 539592 - RNA, 25 nt, Human
ugugcacacacacacacacacacac

SEQ ID NO: 539593 - RNA, 25 nt, Human
ugugcacacacacacacacacacag

SEQ ID NO: 539594 - RNA, 24 nt, Human
uguugguccauaucuguaauccug

SEQ ID NO: 539595 - RNA, 24 nt, Human
uucaacucuuuuauuggauuucua

SEQ ID NO: 539596 - RNA, 21 nt, Human
uuccguuauaguucuccucca

SEQ ID NO: 539597 - RNA, 21 nt, Human
uuucucccuuugugucccugg

SEQ ID NO: 539598 - RNA, 19 nt, Human
uuuuuuuuuuuuaaaagga

SEQ ID NO: 539599 - RNA, 21 nt, Human
uuuuuuuuuuuuuuaaaagga

SEQ ID NO: 539600 - RNA, 24 nt, Human
uuuuuuuuuuuuuuuuuuaaaagg

SEQ ID NO: 539601 - RNA, 21 nt, Human
aaagaaguuccacaugccuuu

SEQ ID NO: 539602 - RNA, 22 nt, Human
aagcaugaacaucacauucacc

SEQ ID NO: 539603 - RNA, 18 nt, Human
aagcccauuucacagaua

SEQ ID NO: 539604 - RNA, 20 nt, Human
acacgagguccucaaaggug

SEQ ID NO: 539605 - RNA, 19 nt, Human
accucacucuucaccugaa

SEQ ID NO: 539606 - RNA, 23 nt, Human
agaagucuaccgaguuuauauuc

SEQ ID NO: 539607 - RNA, 18 nt, Human
agaccagaccagggucag

SEQ ID NO: 539608 - RNA, 18 nt, Human
agaccagaccagggucag

SEQ ID NO: 539609 - RNA, 22 nt, Human
agcagaagugaggugaaaucca

SEQ ID NO: 539610 - RNA, 18 nt, Human
agcagguggagaagcgga

SEQ ID NO: 539611 - RNA, 21 nt, Human
agcuccccgggagcaggugga

SEQ ID NO: 539612 - RNA, 23 nt, Human
aggaagaacuuucaacaccaaaa

SEQ ID NO: 539613 - RNA, 23 nt, Human
aggaagaacuuucaacaccaaaa

SEQ ID NO: 539614 - RNA, 18 nt, Human
aggaggaauaucaagccc

SEQ ID NO: 539615 - RNA, 19 nt, Human
agggaccagaagucuaccg

SEQ ID NO: 539616 - RNA, 18 nt, Human
agucugugugauaucaau

SEQ ID NO: 539617 - RNA, 18 nt, Human
aguggcugggcugagacu

SEQ ID NO: 539618 - RNA, 18 nt, Human
aguggcugggcugagacu

SEQ ID NO: 539619 - RNA, 21 nt, Human
auggugcccuggaggaaggac

SEQ ID NO: 539620 - RNA, 21 nt, Human
caaaaccauccucggggcuga

SEQ ID NO: 539621 - RNA, 22 nt, Human
caaaguaaauaacuuauauccc

SEQ ID NO: 539622 - RNA, 22 nt, Human
caaaguaaauaacuuauauccc

SEQ ID NO: 539623 - RNA, 20 nt, Human
caaagucuuuugggacacga

SEQ ID NO: 539624 - RNA, 23 nt, Human
caagcaugaacaucacauucacc

SEQ ID NO: 539625 - RNA, 22 nt, Human
cacuucuguuuugaaauaaaga

SEQ ID NO: 539626 - RNA, 21 nt, Human
cagaaguggaguggaucuuca

SEQ ID NO: 539627 - RNA, 23 nt, Human
cagcgggugauucucuggauccc

SEQ ID NO: 539628 - RNA, 26 nt, Human
cagcgggugauucucuggggacuacu

SEQ ID NO: 539629 - RNA, 18 nt, Human
cagcuggcucccauggcc

SEQ ID NO: 539630 - RNA, 21 nt, Human
cagcuuaaccgucucucccag

SEQ ID NO: 539631 - RNA, 21 nt, Human
cagggagagcagaagugaggu

SEQ ID NO: 539632 - RNA, 23 nt, Human
caucucaauuuuacagaugggaa

SEQ ID NO: 539633 - RNA, 23 nt, Human
caucucaauuuuacagaugggaa

SEQ ID NO: 539634 - RNA, 21 nt, Human
caucuccccuggagucaaggg

SEQ ID NO: 539635 - RNA, 19 nt, Human
cauggcccuugggguggcc

SEQ ID NO: 539636 - RNA, 20 nt, Human
cauggcccuugggguggccu

SEQ ID NO: 539637 - RNA, 22 nt, Human
ccagagcccacgcguccgccca

SEQ ID NO: 539638 - RNA, 25 nt, Human
ccagagcccacgcguccgcccacgc

SEQ ID NO: 539639 - RNA, 18 nt, Human
cccagagcccacgcgucc

SEQ ID NO: 539640 - RNA, 23 nt, Human
cccuucuugaaaacauccccaaa

SEQ ID NO: 539641 - RNA, 23 nt, Human
cccuucuugaaaacauccccaaa

SEQ ID NO: 539642 - RNA, 19 nt, Human
ccuaaaaccuucuaggaca

SEQ ID NO: 539643 - RNA, 24 nt, Human
ccucggggcugaaaagugagggcu

SEQ ID NO: 539644 - RNA, 19 nt, Human
ccugaaaauuuaacccgug

SEQ ID NO: 539645 - RNA, 19 nt, Human
ccugaaaauuuaacccgug

SEQ ID NO: 539646 - RNA, 25 nt, Human
ccuggagucaagggucugccaaggc

SEQ ID NO: 539647 - RNA, 24 nt, Human
ccugucugcuccucuuuuucccag

SEQ ID NO: 539648 - RNA, 24 nt, Human
ccugucugcuccucuuuuucccag

SEQ ID NO: 539649 - RNA, 21 nt, Human
ccuugggguggccugacucug

SEQ ID NO: 539650 - RNA, 21 nt, Human
ccuugggguggccugacucug

SEQ ID NO: 539651 - RNA, 20 nt, Human
cgaauucugaauaccguccc

SEQ ID NO: 539652 - RNA, 23 nt, Human
cucccagagcccacgcguccgcc

SEQ ID NO: 539653 - RNA, 20 nt, Human
cuccugcgcucgaauucuga

SEQ ID NO: 539654 - RNA, 19 nt, Human
cucuggaucccaauagcuc

SEQ ID NO: 539655 - RNA, 24 nt, Human
cugugaguucucuagccaaggcug

SEQ ID NO: 539656 - RNA, 24 nt, Human
cugugaguucucuagccaaggcug

SEQ ID NO: 539657 - RNA, 21 nt, Human
cuuauaucccuucuugaaaac

SEQ ID NO: 539658 - RNA, 24 nt, Human
cuugggguggccugacucugucac

SEQ ID NO: 539659 - RNA, 28 nt, Human
cuuuauuuugugugugugugugugugug

SEQ ID NO: 539660 - RNA, 19 nt, Human
gcaagccaagcccuuccuu

SEQ ID NO: 539661 - RNA, 24 nt, Human
gcacucuugagggagagccaggaa

SEQ ID NO: 539662 - RNA, 24 nt, Human
gcacucuugagggagagccaggaa

SEQ ID NO: 539663 - RNA, 24 nt, Human
gcacuuggaaaauuccucuggcag

SEQ ID NO: 539664 - RNA, 21 nt, Human
gcccagggaacccugucugcu

SEQ ID NO: 539665 - RNA, 21 nt, Human
gcccagggaacccugucugcu

SEQ ID NO: 539666 - RNA, 24 nt, Human
gcuaagugcaaggagacacuucug

SEQ ID NO: 539667 - RNA, 20 nt, Human
ggagccaaacaggccuaaag

SEQ ID NO: 539668 - RNA, 20 nt, Human
ggagccaaacaggccuaaag

SEQ ID NO: 539669 - RNA, 19 nt, Human
ggccuggggaaaaaccauc

SEQ ID NO: 539670 - RNA, 20 nt, Human
ggcugggcugagacugggcc

SEQ ID NO: 539671 - RNA, 20 nt, Human
ggcugggcugagacugggcc

SEQ ID NO: 539672 - RNA, 19 nt, Human
ggguagaggaggaauauca

SEQ ID NO: 539673 - RNA, 21 nt, Human
gguggaagaugaacaaaacca

SEQ ID NO: 539674 - RNA, 22 nt, Human
gugaggugaaauccaggaauuc

SEQ ID NO: 539675 - RNA, 20 nt, Human
guggcagaggauccaggcac

SEQ ID NO: 539676 - RNA, 20 nt, Human
guggcagaggauccaggcac

SEQ ID NO: 539677 - RNA, 21 nt, Human
gugugugugugugugugugug

SEQ ID NO: 539678 - RNA, 21 nt, Human
gugugugugugugugugugug

SEQ ID NO: 539679 - RNA, 20 nt, Human
uaaaaccuucuaggacaucu

SEQ ID NO: 539680 - RNA, 20 nt, Human
uaaaaccuucuaggacaucu

SEQ ID NO: 539681 - RNA, 19 nt, Human
uaaaauuauucccgagaga

SEQ ID NO: 539682 - RNA, 19 nt, Human
uaaaauuauucccgagaga

SEQ ID NO: 539683 - RNA, 20 nt, Human
uaacccguggcagaggaucc

SEQ ID NO: 539684 - RNA, 20 nt, Human
uaacccguggcagaggaucc

SEQ ID NO: 539685 - RNA, 19 nt, Human
uaaccgucucucccaguuu

SEQ ID NO: 539686 - RNA, 19 nt, Human
uauaaaauuauucccgaga

SEQ ID NO: 539687 - RNA, 19 nt, Human
uauaaaauuauucccgaga

SEQ ID NO: 539688 - RNA, 18 nt, Human
uauuuugugugugugugu

SEQ ID NO: 539689 - RNA, 23 nt, Human
ucaacaccaaaauucaucucaau

SEQ ID NO: 539690 - RNA, 23 nt, Human
ucaacaccaaaauucaucucaau

SEQ ID NO: 539691 - RNA, 24 nt, Human
ucaaggucacaugggaaggaacac

SEQ ID NO: 539692 - RNA, 21 nt, Human
ucacaaucaagucugcuguuu

SEQ ID NO: 539693 - RNA, 22 nt, Human
ucaccugaugucacaaucaagu

SEQ ID NO: 539694 - RNA, 23 nt, Human
ucaccugcagggagagcagaagu

SEQ ID NO: 539695 - RNA, 22 nt, Human
uccaggaagaacuuucaacacc

SEQ ID NO: 539696 - RNA, 22 nt, Human
uccaggaagaacuuucaacacc

SEQ ID NO: 539697 - RNA, 24 nt, Human
uccaugaccaaugaagggaccaga

SEQ ID NO: 539698 - RNA, 25 nt, Human
uccaugaccaaugaagggaccagag

SEQ ID NO: 539699 - RNA, 18 nt, Human
ucccccaggucaucuccc

SEQ ID NO: 539700 - RNA, 18 nt, Human
ucccccaggucaucuccc

SEQ ID NO: 539701 - RNA, 22 nt, Human
uccccuggagucaagggucugc

SEQ ID NO: 539702 - RNA, 21 nt, Human
uccuugugugucuuuauuuug

SEQ ID NO: 539703 - RNA, 19 nt, Human
ucggggcugaaaagugagg

SEQ ID NO: 539704 - RNA, 19 nt, Human
ucucccaguuucacacucc

SEQ ID NO: 539705 - RNA, 20 nt, Human
ucucccaguuucacacuccc

SEQ ID NO: 539706 - RNA, 19 nt, Human
ucucugguuguuucaggcc

SEQ ID NO: 539707 - RNA, 23 nt, Human
ucucugguuguuucaggccuggg

SEQ ID NO: 539708 - RNA, 23 nt, Human
ucucugguuguuucaggccuggg

SEQ ID NO: 539709 - RNA, 19 nt, Human
ucugucacuauuccuaaaa

SEQ ID NO: 539710 - RNA, 19 nt, Human
ucugucacuauuccuaaaa

SEQ ID NO: 539711 - RNA, 18 nt, Human
ugaaaacauccccaaaga

SEQ ID NO: 539712 - RNA, 18 nt, Human
ugaaaacauccccaaaga

SEQ ID NO: 539713 - RNA, 18 nt, Human
ugaaaacauccccaaaga

SEQ ID NO: 539714 - RNA, 18 nt, Human
ugaaaacauccccaaaga

SEQ ID NO: 539715 - RNA, 20 nt, Human
ugaagggaccagaagucuac

SEQ ID NO: 539716 - RNA, 22 nt, Human
ugagaccagaccagggucaggc

SEQ ID NO: 539717 - RNA, 22 nt, Human
ugagaccagaccagggucaggc

SEQ ID NO: 539718 - RNA, 24 nt, Human
ugagaccagaccagggucaggcca

SEQ ID NO: 539719 - RNA, 24 nt, Human
ugagaccagaccagggucaggcca

SEQ ID NO: 539720 - RNA, 26 nt, Human
ugagacugggcccagggaacccuguc

SEQ ID NO: 539721 - RNA, 26 nt, Human
ugagacugggcccagggaacccuguc

SEQ ID NO: 539722 - RNA, 28 nt, Human
ugaggugaaauccaggaauucugaacaa

SEQ ID NO: 539723 - RNA, 18 nt, Human
ugauaucaaucugcuugg

SEQ ID NO: 539724 - RNA, 21 nt, Human
ugcaaggagacacuucuguuu

SEQ ID NO: 539725 - RNA, 24 nt, Human
ugccaaggcuaagugcaaggagac

SEQ ID NO: 539726 - RNA, 24 nt, Human
ugcccuggaggaaggacuuucagu

SEQ ID NO: 539727 - RNA, 23 nt, Human
uggcaagcaugaacaucacauuc

SEQ ID NO: 539728 - RNA, 24 nt, Human
uggcaagccaagcccuuccuuucc

SEQ ID NO: 539729 - RNA, 20 nt, Human
uggcugggcugagacugggc

SEQ ID NO: 539730 - RNA, 20 nt, Human
uggcugggcugagacugggc

SEQ ID NO: 539731 - RNA, 18 nt, Human
ugugugugugugugugug

SEQ ID NO: 539732 - RNA, 18 nt, Human
ugugugugugugugugug

SEQ ID NO: 539733 - RNA, 18 nt, Human
ugugugugugugugugug

SEQ ID NO: 539734 - RNA, 18 nt, Human
ugugugugugugugugug

SEQ ID NO: 539735 - RNA, 18 nt, Human
ugugugugugugugugug

SEQ ID NO: 539736 - RNA, 22 nt, Human
ugugugugugugugugugugag

SEQ ID NO: 539737 - RNA, 21 nt, Human
ugugugugugugugugugugu

SEQ ID NO: 539738 - RNA, 21 nt, Human
ugugugugugugugugugugu

SEQ ID NO: 539739 - RNA, 21 nt, Human
ugugugugugugugugugugu

SEQ ID NO: 539740 - RNA, 21 nt, Human
ugugugugugugugugugugu

SEQ ID NO: 539741 - RNA, 21 nt, Human
ugugugugugugugugugugu

SEQ ID NO: 539742 - RNA, 21 nt, Human
ugugugugugugugugugugu

SEQ ID NO: 539743 - RNA, 21 nt, Human
ugugugugugugugugugugu

SEQ ID NO: 539744 - RNA, 21 nt, Human
ugugugugugugugugugugu

SEQ ID NO: 539745 - RNA, 22 nt, Human
ugugugugugugugugugugug

SEQ ID NO: 539746 - RNA, 21 nt, Human
uguguguguguguguguuuug

SEQ ID NO: 539747 - RNA, 18 nt, Human
uguuuggucuugcuucuu

SEQ ID NO: 539748 - RNA, 19 nt, Human
uuacuaggucaccugaugu

SEQ ID NO: 539749 - RNA, 23 nt, Human
uucacacucccagagcccacgcg

SEQ ID NO: 539750 - RNA, 24 nt, Human
uucacagauaaagaaacagaggcc

SEQ ID NO: 539751 - RNA, 23 nt, Human
uugggguggccugacucugucac

SEQ ID NO: 539752 - RNA, 20 nt, Human
uuuacagaugggaaaaguga

SEQ ID NO: 539753 - RNA, 20 nt, Human
uuuacagaugggaaaaguga

SEQ ID NO: 539754 - RNA, 22 nt, Human
uuuacagaugggaaaagugauu

SEQ ID NO: 539755 - RNA, 22 nt, Human
uuuacagaugggaaaagugauu

SEQ ID NO: 539756 - RNA, 22 nt, Human
uuugagucugugugauaucaau

SEQ ID NO: 539757 - RNA, 18 nt, Human
uuuuuuuuuuuuuuuuug

SEQ ID NO: 539758 - RNA, 22 nt, Human
uuuuuuuuuuuuuuuuugccuu

SEQ ID NO: 539759 - RNA, 26 nt, Human
uuuuuuuuuuuuuuuuuuugccuuag

SEQ ID NO: 539760 - RNA, 23 nt, Human
aaauacaauauaaaugcuaugua

SEQ ID NO: 539761 - RNA, 18 nt, Human
aaggggccccccaccucc

SEQ ID NO: 539762 - RNA, 19 nt, Human
aaggggccccccaccuccc

SEQ ID NO: 539763 - RNA, 25 nt, Human
acaccacuucagaaagaggggaacc

SEQ ID NO: 539764 - RNA, 18 nt, Human
accgagguggucuggaac

SEQ ID NO: 539765 - RNA, 21 nt, Human
acgcggcugcagcccgggccu

SEQ ID NO: 539766 - RNA, 19 nt, Human
agcuaugccucaguaucca

SEQ ID NO: 539767 - RNA, 22 nt, Human
aggaagggucccccuuuucagg

SEQ ID NO: 539768 - RNA, 22 nt, Human
aggccccgggcuccccgcccag

SEQ ID NO: 539769 - RNA, 21 nt, Human
agguggucuggaacugaaccc

SEQ ID NO: 539770 - RNA, 23 nt, Human
augagaaggccccggggggagga

SEQ ID NO: 539771 - RNA, 18 nt, Human
caacccucagacaccgac

SEQ ID NO: 539772 - RNA, 21 nt, Human
caacucccaagccaccucuuc

SEQ ID NO: 539773 - RNA, 18 nt, Human
caauaugcaguaaacaug

SEQ ID NO: 539774 - RNA, 18 nt, Human
cacagcgguggccucucc

SEQ ID NO: 539775 - RNA, 24 nt, Human
cacccccuccccgguccuggccca

SEQ ID NO: 539776 - RNA, 18 nt, Human
caccccgccgcugucacc

SEQ ID NO: 539777 - RNA, 20 nt, Human
caccggggcccuggcuuggg

SEQ ID NO: 539778 - RNA, 19 nt, Human
cacguaaccuacgcacacc

SEQ ID NO: 539779 - RNA, 27 nt, Human
cacugcacagcgguggccucuccagcg

SEQ ID NO: 539780 - RNA, 21 nt, Human
cacuggggggccagucagagg

SEQ ID NO: 539781 - RNA, 23 nt, Human
cacuucagaaagagcaauacagg

SEQ ID NO: 539782 - RNA, 20 nt, Human
caggacugcaaccucaaccc

SEQ ID NO: 539783 - RNA, 22 nt, Human
caggccuugguggcggccccgg

SEQ ID NO: 539784 - RNA, 23 nt, Human
cauaaugcuauugcacauuuagu

SEQ ID NO: 539785 - RNA, 20 nt, Human
cauaccucauucuacuaugg

SEQ ID NO: 539786 - RNA, 22 nt, Human
caugggcugcuccaaggcccug

SEQ ID NO: 539787 - RNA, 23 nt, Human
ccaagccaccucuucagaaucac

SEQ ID NO: 539788 - RNA, 20 nt, Human
ccacgcgccgggccagcucc

SEQ ID NO: 539789 - RNA, 27 nt, Human
cccacaauaucuccgagauauaccugu

SEQ ID NO: 539790 - RNA, 19 nt, Human
ccccgcccagcuccccagc

SEQ ID NO: 539791 - RNA, 26 nt, Human
ccccgcccagcuccccagccccgcgg

SEQ ID NO: 539792 - RNA, 22 nt, Human
ccccgggcuccccgcccagcuc

SEQ ID NO: 539793 - RNA, 22 nt, Human
cccggcgcuggccccgcccucc

SEQ ID NO: 539794 - RNA, 18 nt, Human
cccuccgucccaccuucc

SEQ ID NO: 539795 - RNA, 24 nt, Human
cccuccgucccaccuuccggcugc

SEQ ID NO: 539796 - RNA, 19 nt, Human
cccuggcuuggguugcggg

SEQ ID NO: 539797 - RNA, 23 nt, Human
ccugagaccccaggaccugcagg

SEQ ID NO: 539798 - RNA, 19 nt, Human
ccugcagcaggugcucuga

SEQ ID NO: 539799 - RNA, 20 nt, Human
ccuggcccaccccgccgcug

SEQ ID NO: 539800 - RNA, 19 nt, Human
ccuuagggggagccggggg

SEQ ID NO: 539801 - RNA, 23 nt, Human
ccuuccggcugcgccgggccuuc

SEQ ID NO: 539802 - RNA, 23 nt, Human
cgcccggccuuagggggagccgg

SEQ ID NO: 539803 - RNA, 20 nt, Human
cgcccuccgucccaccuucc

SEQ ID NO: 539804 - RNA, 25 nt, Human
cgcccuccgucccaccuuccggcug

SEQ ID NO: 539805 - RNA, 20 nt, Human
cgggaagccacgcgccgggc

SEQ ID NO: 539806 - RNA, 20 nt, Human
cuaguuccuagaguuuuaag

SEQ ID NO: 539807 - RNA, 22 nt, Human
cucagcagacgccuccgaagcc

SEQ ID NO: 539808 - RNA, 20 nt, Human
cucccaagaugagaaggccc

SEQ ID NO: 539809 - RNA, 20 nt, Human
cuccgagcugcgcccggccu

SEQ ID NO: 539810 - RNA, 22 nt, Human
cugcaggggggugggauccagu

SEQ ID NO: 539811 - RNA, 22 nt, Human
cugcggcaggcaggccuuuacu

SEQ ID NO: 539812 - RNA, 21 nt, Human
gagaaggccccggggggagga

SEQ ID NO: 539813 - RNA, 18 nt, Human
gagcgugaucacuucccc

SEQ ID NO: 539814 - RNA, 22 nt, Human
gaggcccuggcagggcgagucu

SEQ ID NO: 539815 - RNA, 22 nt, Human
gcaaccucaacccucagacacc

SEQ ID NO: 539816 - RNA, 25 nt, Human
gcaauacaggcauaccucauucuac

SEQ ID NO: 539817 - RNA, 24 nt, Human
gccccggcgcuggccccgcccucc

SEQ ID NO: 539818 - RNA, 25 nt, Human
gcgcccggagaagaguccugggaac

SEQ ID NO: 539819 - RNA, 19 nt, Human
gcgccgggccagcuccugg

SEQ ID NO: 539820 - RNA, 23 nt, Human
gcgccgggccuuccgggaagcca

SEQ ID NO: 539821 - RNA, 22 nt, Human
gcuuuauugugauguuggcuuu

SEQ ID NO: 539822 - RNA, 21 nt, Human
ggagaaguucagagggacagu

SEQ ID NO: 539823 - RNA, 20 nt, Human
ggcaggcaggccuuuacucu

SEQ ID NO: 539824 - RNA, 19 nt, Human
ggccccgggcuccccgccc

SEQ ID NO: 539825 - RNA, 21 nt, Human
ggccuggcaggccccgggcuc

SEQ ID NO: 539826 - RNA, 20 nt, Human
ggccuugguggcggccccgg

SEQ ID NO: 539827 - RNA, 19 nt, Human
gggaggaugaagugugguc

SEQ ID NO: 539828 - RNA, 18 nt, Human
ggggaggaugaagugugg

SEQ ID NO: 539829 - RNA, 22 nt, Human
ggggccccccaccuccccggag

SEQ ID NO: 539830 - RNA, 18 nt, Human
gggggugggauccagucc

SEQ ID NO: 539831 - RNA, 22 nt, Human
ggugggauccaguccugcagca

SEQ ID NO: 539832 - RNA, 20 nt, Human
uaaccuacgcacaccuuccu

SEQ ID NO: 539833 - RNA, 23 nt, Human
uaagaguauuuccaucacaaugc

SEQ ID NO: 539834 - RNA, 21 nt, Human
uaauaccaaauacaauauaaa

SEQ ID NO: 539835 - RNA, 20 nt, Human
uacagcuaugccucaguauc

SEQ ID NO: 539836 - RNA, 22 nt, Human
uacgcacaccuuccuguauaau

SEQ ID NO: 539837 - RNA, 25 nt, Human
ucaaauauuuccuauccaaggcugg

SEQ ID NO: 539838 - RNA, 21 nt, Human
ucacaaugccacucuaguucc

SEQ ID NO: 539839 - RNA, 22 nt, Human
ucacaccacuucagaaagagca

SEQ ID NO: 539840 - RNA, 21 nt, Human
ucacuggggggccagucagag

SEQ ID NO: 539841 - RNA, 21 nt, Human
ucagcaggccgcccguccccu

SEQ ID NO: 539842 - RNA, 18 nt, Human
uccaugggggauggguuc

SEQ ID NO: 539843 - RNA, 18 nt, Human
ucccaagaugagaaggcc

SEQ ID NO: 539844 - RNA, 18 nt, Human
uccccagacccaugcggg

SEQ ID NO: 539845 - RNA, 18 nt, Human
uccccagggggcauccgc

SEQ ID NO: 539846 - RNA, 22 nt, Human
uccccagggggcauccgcuggg

SEQ ID NO: 539847 - RNA, 21 nt, Human
ucccccuuuucaggaaagcuc

SEQ ID NO: 539848 - RNA, 23 nt, Human
uccccgcccagcuccccagcccc

SEQ ID NO: 539849 - RNA, 19 nt, Human
uccccgguccuggcccacc

SEQ ID NO: 539850 - RNA, 21 nt, Human
uccccgguccuggcccacccc

SEQ ID NO: 539851 - RNA, 20 nt, Human
ucccuggguaggggacgguu

SEQ ID NO: 539852 - RNA, 20 nt, Human
ucuacuaugcuuugugaaua

SEQ ID NO: 539853 - RNA, 23 nt, Human
ugagaccccaggaccugcagggg

SEQ ID NO: 539854 - RNA, 19 nt, Human
ugcagccuagugggggccg

SEQ ID NO: 539855 - RNA, 19 nt, Human
ugcagccuagugggggccg

SEQ ID NO: 539856 - RNA, 19 nt, Human
ugcuauugcacauuuagug

SEQ ID NO: 539857 - RNA, 21 nt, Human
ugcuccaaggcccugagaccc

SEQ ID NO: 539858 - RNA, 20 nt, Human
uggcaccauuuuccaacagc

SEQ ID NO: 539859 - RNA, 21 nt, Human
uggcaggccccgggcuccccg

SEQ ID NO: 539860 - RNA, 25 nt, Human
uggcgggccuucgagggagaaguuc

SEQ ID NO: 539861 - RNA, 18 nt, Human
uggcuccgagcugcgccc

SEQ ID NO: 539862 - RNA, 22 nt, Human
ugggaagagcgaggcccuggca

SEQ ID NO: 539863 - RNA, 19 nt, Human
uggguuccaggacugcaac

SEQ ID NO: 539864 - RNA, 22 nt, Human
uggucagaccgucggcugagcg

SEQ ID NO: 539865 - RNA, 22 nt, Human
ugugauguuggcuuuaccgagg

SEQ ID NO: 539866 - RNA, 18 nt, Human
uucaaauauuuccuaucc

SEQ ID NO: 539867 - RNA, 23 nt, Human
uucucccaacucccaagccaccu

SEQ ID NO: 539868 - RNA, 22 nt, Human
uugaagguuuguagcagccuga

SEQ ID NO: 539869 - RNA, 23 nt, Human
uuuagggaauaauggcaagaaaa

SEQ ID NO: 539870 - RNA, 20 nt, Human
uuucaaauauuuccuaucca

SEQ ID NO: 539871 - RNA, 18 nt, Human
uuuucaggaaagcucagc

SEQ ID NO: 539872 - RNA, 23 nt, Human
aaaacaaaaauacaaacagagag

SEQ ID NO: 539873 - RNA, 18 nt, Human
aaaauacaaacagagagc

SEQ ID NO: 539874 - RNA, 23 nt, Human
aaacaaaaauacaaacagagagc

SEQ ID NO: 539875 - RNA, 22 nt, Human
aacaaaacaaaaauacaaacag

SEQ ID NO: 539876 - RNA, 18 nt, Human
aagaaucaaaaacaaaac

SEQ ID NO: 539877 - RNA, 23 nt, Human
acaaaacaaaaauacaaacagag

SEQ ID NO: 539878 - RNA, 24 nt, Human
acaaaacaaaaauacaaacagaga

SEQ ID NO: 539879 - RNA, 26 nt, Human
acaaaacaaaaauacaaacagagagc

SEQ ID NO: 539880 - RNA, 21 nt, Human
agcagcuggucgucuuccacg

SEQ ID NO: 539881 - RNA, 19 nt, Human
agcugcugcuacuggucuc

SEQ ID NO: 539882 - RNA, 22 nt, Human
aggcacugcaggugcuaaggcc

SEQ ID NO: 539883 - RNA, 22 nt, Human
aggcugcagcuugcacggagcc

SEQ ID NO: 539884 - RNA, 23 nt, Human
agggcagagaagucaaccaaguc

SEQ ID NO: 539885 - RNA, 18 nt, Human
aggugcuaaggcccaagc

SEQ ID NO: 539886 - RNA, 20 nt, Human
auucacauaauuucuacacc

SEQ ID NO: 539887 - RNA, 21 nt, Human
caaaaauacaaacagagagca

SEQ ID NO: 539888 - RNA, 18 nt, Human
caccccaaauucucaauc

SEQ ID NO: 539889 - RNA, 19 nt, Human
cacucaaaauacucugcac

SEQ ID NO: 539890 - RNA, 25 nt, Human
cccaaauucucaaucccuguggcgu

SEQ ID NO: 539891 - RNA, 23 nt, Human
ccuccauggcgcgcagcguaccc

SEQ ID NO: 539892 - RNA, 22 nt, Human
ccuuguagcaguauauccacuu

SEQ ID NO: 539893 - RNA, 18 nt, Human
cgccucuggaagcggcgg

SEQ ID NO: 539894 - RNA, 20 nt, Human
cggcucccaggacugugcgg

SEQ ID NO: 539895 - RNA, 23 nt, Human
cgggguguccucgaagggcuggu

SEQ ID NO: 539896 - RNA, 23 nt, Human
cguacaucccuuccagcucuguu

SEQ ID NO: 539897 - RNA, 19 nt, Human
cucaaaauacucugcaccu

SEQ ID NO: 539898 - RNA, 23 nt, Human
cucacagucucaagaaucaaaaa

SEQ ID NO: 539899 - RNA, 24 nt, Human
cucuccuuuguuucuuuccuuuuc

SEQ ID NO: 539900 - RNA, 22 nt, Human
cugcagcagcuggucgucuucc

SEQ ID NO: 539901 - RNA, 19 nt, Human
cuggcccugagcuucugca

SEQ ID NO: 539902 - RNA, 27 nt, Human
cuuaagaagcugcugcuacuggucucu

SEQ ID NO: 539903 - RNA, 19 nt, Human
cuuguagggagaggcuguc

SEQ ID NO: 539904 - RNA, 18 nt, Human
gaaggcagcggagucaca

SEQ ID NO: 539905 - RNA, 20 nt, Human
gagcuucugcagcagcuggu

SEQ ID NO: 539906 - RNA, 25 nt, Human
gcccaagcaacugacucuuccuggu

SEQ ID NO: 539907 - RNA, 18 nt, Human
gcccugagcuucugcagc

SEQ ID NO: 539908 - RNA, 21 nt, Human
gcccugagcuucugcagcagc

SEQ ID NO: 539909 - RNA, 22 nt, Human
gcuugcacggagccaucugucc

SEQ ID NO: 539910 - RNA, 21 nt, Human
ggcaggcacggcaggugaggc

SEQ ID NO: 539911 - RNA, 21 nt, Human
gggguguccucgaagggcugg

SEQ ID NO: 539912 - RNA, 18 nt, Human
guguccucgaagggcugg

SEQ ID NO: 539913 - RNA, 20 nt, Human
uacuaaggccaugucugugg

SEQ ID NO: 539914 - RNA, 23 nt, Human
uacucugcaccuuguagcaguau

SEQ ID NO: 539915 - RNA, 23 nt, Human
ucaagaaucaaaaacaaaacaaa

SEQ ID NO: 539916 - RNA, 26 nt, Human
ucgcugggucaccaggacucuuuccc

SEQ ID NO: 539917 - RNA, 26 nt, Human
ucgcugggucaccaggacucuuuccg

SEQ ID NO: 539918 - RNA, 20 nt, Human
ucucugggagaugaagcugg

SEQ ID NO: 539919 - RNA, 21 nt, Human
ucucuuguagggagaggcugu

SEQ ID NO: 539920 - RNA, 23 nt, Human
ucuguggaggaaggaugcaaagg

SEQ ID NO: 539921 - RNA, 19 nt, Human
ugcaguauccgggggcagg

SEQ ID NO: 539922 - RNA, 22 nt, Human
ugcaguauccgggggcaggcac

SEQ ID NO: 539923 - RNA, 24 nt, Human
uggcaucgaccucaccgcuuuuug

SEQ ID NO: 539924 - RNA, 20 nt, Human
uggcccugagcuucugcagc

SEQ ID NO: 539925 - RNA, 19 nt, Human
uguccuguccgcgggcuuc

SEQ ID NO: 539926 - RNA, 25 nt, Human
uguuucuuuccuuuauuagucuucc

SEQ ID NO: 539927 - RNA, 19 nt, Human
uuccacguccucgcccucc

SEQ ID NO: 539928 - RNA, 20 nt, Human
uucucuaucagccgcugcau

SEQ ID NO: 539929 - RNA, 21 nt, Human
uuugcaccaccgggguguccu

SEQ ID NO: 539930 - RNA, 23 nt, Human
uuuuuuuuuuuuuuuucuaauug

SEQ ID NO: 539931 - RNA, 23 nt, Human
uuuuuuuuuuuuuuuuucuaauu

SEQ ID NO: 539932 - RNA, 18 nt, Human
aaaaaaacaaaaaacaag

SEQ ID NO: 539933 - RNA, 18 nt, Human
aaaguacuuuggcugcuc

SEQ ID NO: 539934 - RNA, 23 nt, Human
aacuuuuuuuauccaccccccua

SEQ ID NO: 539935 - RNA, 22 nt, Human
aagaaucacaacaaacugagcc

SEQ ID NO: 539936 - RNA, 18 nt, Human
aagcacauggauggaaac

SEQ ID NO: 539937 - RNA, 22 nt, Human
aagcugcugucucccgaccugg

SEQ ID NO: 539938 - RNA, 18 nt, Human
acugcaaaaguagaucgg

SEQ ID NO: 539939 - RNA, 20 nt, Human
agcagcaccuaacgcucggc

SEQ ID NO: 539940 - RNA, 19 nt, Human
agcugcaguuuugcucagu

SEQ ID NO: 539941 - RNA, 20 nt, Human
auccaccccccuaucagccu

SEQ ID NO: 539942 - RNA, 21 nt, Human
auguacacacacaagcauaug

SEQ ID NO: 539943 - RNA, 19 nt, Human
caaggggaagaaaaggggg

SEQ ID NO: 539944 - RNA, 22 nt, Human
cagccuccuccuuggguccaag

SEQ ID NO: 539945 - RNA, 23 nt, Human
caggggcaccagcagagggaagc

SEQ ID NO: 539946 - RNA, 28 nt, Human
cauguacacacacaagcauaugccucca

SEQ ID NO: 539947 - RNA, 22 nt, Human
ccaaccugugcaccuggccugu

SEQ ID NO: 539948 - RNA, 23 nt, Human
ccaaccugugcaccuggccugug

SEQ ID NO: 539949 - RNA, 18 nt, Human
ccaggggcaccagcagag

SEQ ID NO: 539950 - RNA, 23 nt, Human
cccuaucagccuccuccuugggu

SEQ ID NO: 539951 - RNA, 28 nt, Human
cccugcuccaaacucagccugcucuccc

SEQ ID NO: 539952 - RNA, 20 nt, Human
ccuccuuggguccaaggauu

SEQ ID NO: 539953 - RNA, 22 nt, Human
ccuggggcaggaggggcugagg

SEQ ID NO: 539954 - RNA, 20 nt, Human
cgaccuggggcaggaggggc

SEQ ID NO: 539955 - RNA, 18 nt, Human
cgcaagcacauggaugga

SEQ ID NO: 539956 - RNA, 21 nt, Human
cgcagccgggaucugcauggc

SEQ ID NO: 539957 - RNA, 19 nt, Human
cucaaggggaagaaaaggg

SEQ ID NO: 539958 - RNA, 23 nt, Human
cucaaggggaagaaaagggggga

SEQ ID NO: 539959 - RNA, 19 nt, Human
cuccagccccaccuggagg

SEQ ID NO: 539960 - RNA, 19 nt, Human
cugccgcugccgccgcugc

SEQ ID NO: 539961 - RNA, 18 nt, Human
cugccggauggacccugc

SEQ ID NO: 539962 - RNA, 27 nt, Human
gaaaaucaggugaaaugaggccuggug

SEQ ID NO: 539963 - RNA, 21 nt, Human
gacacacacucacuccacacc

SEQ ID NO: 539964 - RNA, 19 nt, Human
gaccuggggcaggaggggc

SEQ ID NO: 539965 - RNA, 19 nt, Human
gaggggcucuggccggcuu

SEQ ID NO: 539966 - RNA, 21 nt, Human
gagggucaucauggggcagga

SEQ ID NO: 539967 - RNA, 19 nt, Human
gaucugugguugucuccuu

SEQ ID NO: 539968 - RNA, 22 nt, Human
gcaaaacgccgcgcagagagca

SEQ ID NO: 539969 - RNA, 20 nt, Human
gcucaaggggaagaaaaggg

SEQ ID NO: 539970 - RNA, 22 nt, Human
gcugggcugccgcugccgccgc

SEQ ID NO: 539971 - RNA, 20 nt, Human
ggcaugcugggcagaggggc

SEQ ID NO: 539972 - RNA, 21 nt, Human
ggcuguggauuggcaccugga

SEQ ID NO: 539973 - RNA, 19 nt, Human
gggcaggaggggcugagga

SEQ ID NO: 539974 - RNA, 24 nt, Human
gggugguuuuuguuuccuuuuuuu

SEQ ID NO: 539975 - RNA, 18 nt, Human
ggucaucauggggcagga

SEQ ID NO: 539976 - RNA, 24 nt, Human
gguugucuccuuuugacaaucuca

SEQ ID NO: 539977 - RNA, 21 nt, Human
gugaaaaucaggugaaaugag

SEQ ID NO: 539978 - RNA, 22 nt, Human
guuguggaucuuggggccucuc

SEQ ID NO: 539979 - RNA, 18 nt, Human
uagcaugucucaaagccu

SEQ ID NO: 539980 - RNA, 20 nt, Human
uaucaacaaaaagaaucaca

SEQ ID NO: 539981 - RNA, 25 nt, Human
ucaacaaaaagaaucacaacaaacc

SEQ ID NO: 539982 - RNA, 21 nt, Human
ucagccugcucuccuugugac

SEQ ID NO: 539983 - RNA, 21 nt, Human
ucauggggcaggagacagaca

SEQ ID NO: 539984 - RNA, 24 nt, Human
ucccaggacugccggauggacccu

SEQ ID NO: 539985 - RNA, 21 nt, Human
ucccgacggggcgaaaaaaac

SEQ ID NO: 539986 - RNA, 19 nt, Human
uccuccgggugucucccuc

SEQ ID NO: 539987 - RNA, 19 nt, Human
uccucgggcugggggaagu

SEQ ID NO: 539988 - RNA, 22 nt, Human
uccuugugacagcagagccuuu

SEQ ID NO: 539989 - RNA, 22 nt, Human
ucucggcugaagcagcuccugc

SEQ ID NO: 539990 - RNA, 18 nt, Human
ucuggccggcuucaucuu

SEQ ID NO: 539991 - RNA, 20 nt, Human
ucugucucuuuugugucucc

SEQ ID NO: 539992 - RNA, 18 nt, Human
ugaggccugguggggcug

SEQ ID NO: 539993 - RNA, 21 nt, Human
ugaggccugguggggcugugg

SEQ ID NO: 539994 - RNA, 21 nt, Human
ugcugggcagaggggcucugg

SEQ ID NO: 539995 - RNA, 18 nt, Human
ugggucaaaaaaacaaaa

SEQ ID NO: 539996 - RNA, 20 nt, Human
uguacacacacaagcauaug

SEQ ID NO: 539997 - RNA, 27 nt, Human
uguacacacacaagcauaugccuccag

SEQ ID NO: 539998 - RNA, 19 nt, Human
uucaucuucccaccugcuc

SEQ ID NO: 539999 - RNA, 18 nt, Human
uugcauuuuccuuccaca

SEQ ID NO: 540000 - RNA, 20 nt, Human
aaaaaaagaaacagccuauc

SEQ ID NO: 540001 - RNA, 22 nt, Human
aaaaagaacuucaaaugagaca

SEQ ID NO: 540002 - RNA, 26 nt, Human
aaaaguauggauauaacaacaacaac

SEQ ID NO: 540003 - RNA, 21 nt, Human
aaacaaaacacauggaacuca

SEQ ID NO: 540004 - RNA, 21 nt, Human
aaacagccuaucauugaaaau

SEQ ID NO: 540005 - RNA, 21 nt, Human
aaagaaacagccuaucauuga

SEQ ID NO: 540006 - RNA, 22 nt, Human
aaagaaacagccuaucauugaa

SEQ ID NO: 540007 - RNA, 21 nt, Human
aaagaaagauuuaauaaagag

SEQ ID NO: 540008 - RNA, 23 nt, Human
aaagaacuucaaaugagacaagc

SEQ ID NO: 540009 - RNA, 21 nt, Human
aacaaaaaaagaaacagccua

SEQ ID NO: 540010 - RNA, 22 nt, Human
aaccucuucuuuuacucuucug

SEQ ID NO: 540011 - RNA, 22 nt, Human
aacuacuauuuagagaggaaga

SEQ ID NO: 540012 - RNA, 23 nt, Human
aagaugcauccuaaaacucgaaa

SEQ ID NO: 540013 - RNA, 20 nt, Human
aagcaaaaacaagacauaag

SEQ ID NO: 540014 - RNA, 22 nt, Human
aagcaaaaacaagacauaagca

SEQ ID NO: 540015 - RNA, 21 nt, Human
aagcaaaagccgggagaggga

SEQ ID NO: 540016 - RNA, 20 nt, Human
aaggaauuaauccauggagc

SEQ ID NO: 540017 - RNA, 24 nt, Human
aauucaguuaguggcaaaaaguug

SEQ ID NO: 540018 - RNA, 18 nt, Human
acaaaauucaacagcgac

SEQ ID NO: 540019 - RNA, 24 nt, Human
acaacaacaacaauaacaacaaaa

SEQ ID NO: 540020 - RNA, 22 nt, Human
acaagcaaaaacaagacauaag

SEQ ID NO: 540021 - RNA, 24 nt, Human
acagucaauaucgugaaguauaac

SEQ ID NO: 540022 - RNA, 18 nt, Human
acauguaaaaaucuacac

SEQ ID NO: 540023 - RNA, 19 nt, Human
agaaacacaaagauaucca

SEQ ID NO: 540024 - RNA, 26 nt, Human
agacaagaugcauccuaaaacucgaa

SEQ ID NO: 540025 - RNA, 20 nt, Human
agagaggaagagaauuggag

SEQ ID NO: 540026 - RNA, 18 nt, Human
agcagaaacacaaagaua

SEQ ID NO: 540027 - RNA, 26 nt, Human
aguuuauuuauaaugauauuuacaua

SEQ ID NO: 540028 - RNA, 23 nt, Human
auaucuucaaagaucaggucagg

SEQ ID NO: 540029 - RNA, 21 nt, Human
augcacaagauuaggcagagu

SEQ ID NO: 540030 - RNA, 18 nt, Human
auguacaaggagguagua

SEQ ID NO: 540031 - RNA, 24 nt, Human
caaaaacaagacauaagcauuguc

SEQ ID NO: 540032 - RNA, 19 nt, Human
caacaaaaaaagaaacagc

SEQ ID NO: 540033 - RNA, 22 nt, Human
caacaaaaaaagaaacagccua

SEQ ID NO: 540034 - RNA, 22 nt, Human
caacaacaauaacaacaaaaaa

SEQ ID NO: 540035 - RNA, 19 nt, Human
caacaauaacaacaaaaaa

SEQ ID NO: 540036 - RNA, 26 nt, Human
caacaauaacaacaaaaaaagaaaca

SEQ ID NO: 540037 - RNA, 21 nt, Human
caagaugcauccuaaaacucg

SEQ ID NO: 540038 - RNA, 24 nt, Human
caaguuaaugaccuauuuccaugc

SEQ ID NO: 540039 - RNA, 24 nt, Human
caaguuaggaugcuuugaaaagca

SEQ ID NO: 540040 - RNA, 21 nt, Human
caccuugcagggaugggggcu

SEQ ID NO: 540041 - RNA, 22 nt, Human
cacuuugucacucacacugaau

SEQ ID NO: 540042 - RNA, 19 nt, Human
cagcaauauagacugacag

SEQ ID NO: 540043 - RNA, 21 nt, Human
caggcuagaaaaaugucacca

SEQ ID NO: 540044 - RNA, 22 nt, Human
caugcacaagauuaggcagagu

SEQ ID NO: 540045 - RNA, 20 nt, Human
cauguguggcauaacaaaau

SEQ ID NO: 540046 - RNA, 22 nt, Human
cuaaaacucgaaauuuuccaga

SEQ ID NO: 540047 - RNA, 24 nt, Human
cuaauccccauucagaaaacugcu

SEQ ID NO: 540048 - RNA, 22 nt, Human
cuccugcuucuccgacauugca

SEQ ID NO: 540049 - RNA, 24 nt, Human
cugggguuaagccgugaguucuca

SEQ ID NO: 540050 - RNA, 21 nt, Human
cuuuagaugaagucacauuca

SEQ ID NO: 540051 - RNA, 23 nt, Human
gaaaucaaugaaaacaugcacaa

SEQ ID NO: 540052 - RNA, 19 nt, Human
gaaccucuaagauauccag

SEQ ID NO: 540053 - RNA, 19 nt, Human
gaagucacauucagucugc

SEQ ID NO: 540054 - RNA, 20 nt, Human
gagguagaaauaauuacaaa

SEQ ID NO: 540055 - RNA, 21 nt, Human
gcugaugcauggagauguggc

SEQ ID NO: 540056 - RNA, 22 nt, Human
ggcacauguaaaaaucuacaca

SEQ ID NO: 540057 - RNA, 24 nt, Human
gggucguacuaccuagcaucuuag

SEQ ID NO: 540058 - RNA, 27 nt, Human
gucaggguuagccucacaauguguagg

SEQ ID NO: 540059 - RNA, 19 nt, Human
gucccuuggcuuauuaguu

SEQ ID NO: 540060 - RNA, 18 nt, Human
guggcuauaucugcuggc

SEQ ID NO: 540061 - RNA, 22 nt, Human
uaaaaaagaacuucaaaugaga

SEQ ID NO: 540062 - RNA, 23 nt, Human
uaaaaacaaaacacauggaacuc

SEQ ID NO: 540063 - RNA, 18 nt, Human
uaaauguucauaaacccc

SEQ ID NO: 540064 - RNA, 18 nt, Human
uaacaacaacaacaauaa

SEQ ID NO: 540065 - RNA, 26 nt, Human
uaacaacaacaacaauaacaacaaaa

SEQ ID NO: 540066 - RNA, 23 nt, Human
uaacauaauaaaaaagaacuuca

SEQ ID NO: 540067 - RNA, 24 nt, Human
uaacauaauaaaaaagaacuucaa

SEQ ID NO: 540068 - RNA, 21 nt, Human
uaagaguuucaaguuaaugac

SEQ ID NO: 540069 - RNA, 18 nt, Human
uacaaagaaacugaugua

SEQ ID NO: 540070 - RNA, 18 nt, Human
uacuacuaaacaugugug

SEQ ID NO: 540071 - RNA, 24 nt, Human
uagaaccucuaagauauccagcau

SEQ ID NO: 540072 - RNA, 20 nt, Human
uagaguugcuccugcuucuc

SEQ ID NO: 540073 - RNA, 21 nt, Human
uagcagaaacacaaagauauc

SEQ ID NO: 540074 - RNA, 25 nt, Human
uagcagaaacacaaagauauccaua

SEQ ID NO: 540075 - RNA, 20 nt, Human
uagcauauuuguuacaaaca

SEQ ID NO: 540076 - RNA, 26 nt, Human
uagcauggauucuucaaucgucccuu

SEQ ID NO: 540077 - RNA, 21 nt, Human
uagcuuuaaguaaucuguucu

SEQ ID NO: 540078 - RNA, 30 nt, Human
uauaacaacaacaacaauaacaacaaaaaa

SEQ ID NO: 540079 - RNA, 19 nt, Human
uauaacaacauuugcugaa

SEQ ID NO: 540080 - RNA, 21 nt, Human
uauuucacaggcccauugaug

SEQ ID NO: 540081 - RNA, 18 nt, Human
ucaaugaaaacaugcaca

SEQ ID NO: 540082 - RNA, 22 nt, Human
ucaauuagaugaauccuuucag

SEQ ID NO: 540083 - RNA, 19 nt, Human
ucacuggaaaacaacuuag

SEQ ID NO: 540084 - RNA, 30 nt, Human
ucacuguaagaguuuuauuugccuuccaaa

SEQ ID NO: 540085 - RNA, 18 nt, Human
ucacuucuaaauuucacu

SEQ ID NO: 540086 - RNA, 21 nt, Human
ucacuuugucacucacacuga

SEQ ID NO: 540087 - RNA, 21 nt, Human
uccagcaucaugguaaauugg

SEQ ID NO: 540088 - RNA, 19 nt, Human
uccuguucuaguuucaauu

SEQ ID NO: 540089 - RNA, 24 nt, Human
uccuugaguuuuucagcuguguaa

SEQ ID NO: 540090 - RNA, 24 nt, Human
ucuauacagcugcauucuuuaaca

SEQ ID NO: 540091 - RNA, 22 nt, Human
ucuguguuuuuuuccaaguuau

SEQ ID NO: 540092 - RNA, 22 nt, Human
ugaaaugaaauagcuuuaagua

SEQ ID NO: 540093 - RNA, 26 nt, Human
ugaauuggaauugaacaauggcucuc

SEQ ID NO: 540094 - RNA, 22 nt, Human
ugacauuggugaacaucugcuu

SEQ ID NO: 540095 - RNA, 23 nt, Human
ugacauuucuaaagcauuagcau

SEQ ID NO: 540096 - RNA, 24 nt, Human
ugagaauaaauggcuuuauaauuu

SEQ ID NO: 540097 - RNA, 20 nt, Human
ugauagcagaaacacaaaga

SEQ ID NO: 540098 - RNA, 18 nt, Human
ugauuggccauuuuccuc

SEQ ID NO: 540099 - RNA, 19 nt, Human
ugcuggcauacucccuuca

SEQ ID NO: 540100 - RNA, 23 nt, Human
uggaaaacaacuuagugccuagc

SEQ ID NO: 540101 - RNA, 18 nt, Human
uggaacucacaaguuaua

SEQ ID NO: 540102 - RNA, 23 nt, Human
uggccauuuuccucaacugcauc

SEQ ID NO: 540103 - RNA, 18 nt, Human
uggcuuauuaguuuuaua

SEQ ID NO: 540104 - RNA, 18 nt, Human
uggcuuauuaguuuuaua

SEQ ID NO: 540105 - RNA, 24 nt, Human
uggcuuauuaguuuuauaacuagu

SEQ ID NO: 540106 - RNA, 21 nt, Human
uuaaacucaucaauuagaugg

SEQ ID NO: 540107 - RNA, 24 nt, Human
uuaaauaucaaauagacaacuuca

SEQ ID NO: 540108 - RNA, 18 nt, Human
uuacaaaaauacugacau

SEQ ID NO: 540109 - RNA, 25 nt, Human
uuacaaacaaucaccaacuaauccc

SEQ ID NO: 540110 - RNA, 20 nt, Human
uucaaaugagacaagcaaaa

SEQ ID NO: 540111 - RNA, 19 nt, Human
uucaagagaagcaaaagcc

SEQ ID NO: 540112 - RNA, 22 nt, Human
uugcaugugcuauucucuccuu

SEQ ID NO: 540113 - RNA, 21 nt, Human
uuggagcagaagugacugggc

SEQ ID NO: 540114 - RNA, 18 nt, Human
uuucacuuugucacucac

SEQ ID NO: 540115 - RNA, 23 nt, Human
uuucacuuugucacucacacuga

SEQ ID NO: 540116 - RNA, 21 nt, Human
uuugaaaugaaauagcuuuaa

SEQ ID NO: 540117 - RNA, 21 nt, Human
uuuggguauagugauguacaa

SEQ ID NO: 540118 - RNA, 18 nt, Human
uuugucuuagaggaaaac

SEQ ID NO: 540119 - RNA, 19 nt, Human
aaaagacccaaacaaauga

SEQ ID NO: 540120 - RNA, 23 nt, Human
aaaagacccaaacaaaugaggca

SEQ ID NO: 540121 - RNA, 27 nt, Human
aaaagacccaaacaaaugaggcagccg

SEQ ID NO: 540122 - RNA, 23 nt, Human
aaacaaaugaggcagccgaggcc

SEQ ID NO: 540123 - RNA, 24 nt, Human
aaacaaaugaggcagccgaggccu

SEQ ID NO: 540124 - RNA, 20 nt, Human
aacugggagccacggcacaa

SEQ ID NO: 540125 - RNA, 18 nt, Human
aagccagagggaggggag

SEQ ID NO: 540126 - RNA, 23 nt, Human
aagcuaaagccagagggagggga

SEQ ID NO: 540127 - RNA, 20 nt, Human
aaucuuccccuugccgaggc

SEQ ID NO: 540128 - RNA, 20 nt, Human
agacagaagaucugaggcaa

SEQ ID NO: 540129 - RNA, 20 nt, Human
agacagaagaucugaggcag

SEQ ID NO: 540130 - RNA, 23 nt, Human
agacccuccgcgccgggcagcuc

SEQ ID NO: 540131 - RNA, 23 nt, Human
agagagacagcgagccagccuuc

SEQ ID NO: 540132 - RNA, 19 nt, Human
agauacaauuagugaagca

SEQ ID NO: 540133 - RNA, 20 nt, Human
agccacggcacaaaagaccc

SEQ ID NO: 540134 - RNA, 22 nt, Human
agccgcacggcccgcagucccc

SEQ ID NO: 540135 - RNA, 18 nt, Human
agccuggaagacgcaaug

SEQ ID NO: 540136 - RNA, 18 nt, Human
agcgugaaggcaauggga

SEQ ID NO: 540137 - RNA, 21 nt, Human
aggcagccgaggccuccgggg

SEQ ID NO: 540138 - RNA, 23 nt, Human
aggcggggagggggcgggcgggg

SEQ ID NO: 540139 - RNA, 24 nt, Human
aggcggggagggggcgggcggggu

SEQ ID NO: 540140 - RNA, 18 nt, Human
agggaggggaggccacgg

SEQ ID NO: 540141 - RNA, 18 nt, Human
aguccccgggagacaguc

SEQ ID NO: 540142 - RNA, 22 nt, Human
auaaaugugaaaagcaauacuc

SEQ ID NO: 540143 - RNA, 21 nt, Human
aucacagaggcucgagcgggg

SEQ ID NO: 540144 - RNA, 23 nt, Human
auuuucccagccccuccucgucg

SEQ ID NO: 540145 - RNA, 22 nt, Human
auuuuuuguuuuuuugcccuag

SEQ ID NO: 540146 - RNA, 21 nt, Human
caaccccaaaggaagcuaaag

SEQ ID NO: 540147 - RNA, 26 nt, Human
caaccccaaaggaagcuaaagccaga

SEQ ID NO: 540148 - RNA, 22 nt, Human
caacugggagccacggcacaaa

SEQ ID NO: 540149 - RNA, 19 nt, Human
caaguggccugcagcgcuu

SEQ ID NO: 540150 - RNA, 24 nt, Human
cacaaccgcacacgccggggcgcc

SEQ ID NO: 540151 - RNA, 18 nt, Human
cacauuuucccagccccu

SEQ ID NO: 540152 - RNA, 19 nt, Human
cacgcccccccacaccccc

SEQ ID NO: 540153 - RNA, 19 nt, Human
cacggcacaaaagacccaa

SEQ ID NO: 540154 - RNA, 20 nt, Human
cagagccauaaaugugaaaa

SEQ ID NO: 540155 - RNA, 21 nt, Human
cagcacaguuuaaguaaacac

SEQ ID NO: 540156 - RNA, 19 nt, Human
cagccgaggccuccggggc

SEQ ID NO: 540157 - RNA, 18 nt, Human
cagcgcaggagugcuugg

SEQ ID NO: 540158 - RNA, 18 nt, Human
caugacauugaaaaugcg

SEQ ID NO: 540159 - RNA, 23 nt, Human
ccaaccccaaaggaagcuaaagc

SEQ ID NO: 540160 - RNA, 30 nt, Human
ccaaccccaaaggaagcuaaagccagaggg

SEQ ID NO: 540161 - RNA, 21 nt, Human
ccacacccccacggcgaaggc

SEQ ID NO: 540162 - RNA, 24 nt, Human
ccacacccccacggcgaaggcucc

SEQ ID NO: 540163 - RNA, 18 nt, Human
ccaccugcgccaacccca

SEQ ID NO: 540164 - RNA, 21 nt, Human
ccacggcacaaaagacccaaa

SEQ ID NO: 540165 - RNA, 24 nt, Human
cccaaacaaaugaggcagccgagg

SEQ ID NO: 540166 - RNA, 23 nt, Human
cccacaaccgcacacgccggggc

SEQ ID NO: 540167 - RNA, 23 nt, Human
cccaccugcgccaaccccaaagg

SEQ ID NO: 540168 - RNA, 23 nt, Human
ccccacacccccacggcgaaggc

SEQ ID NO: 540169 - RNA, 23 nt, Human
cccccacggcgaaggcuccgauu

SEQ ID NO: 540170 - RNA, 23 nt, Human
ccccggcgcuggcuggcucugcc

SEQ ID NO: 540171 - RNA, 21 nt, Human
cccgauccucggggccucagc

SEQ ID NO: 540172 - RNA, 22 nt, Human
cccgcaguccccggcgcuggcu

SEQ ID NO: 540173 - RNA, 18 nt, Human
cccggcggcggcgcgggg

SEQ ID NO: 540174 - RNA, 20 nt, Human
ccgcacacgccggggcgccg

SEQ ID NO: 540175 - RNA, 21 nt, Human
ccgcacacgccggggcgccgg

SEQ ID NO: 540176 - RNA, 19 nt, Human
ccgccccgauccucggggc

SEQ ID NO: 540177 - RNA, 21 nt, Human
ccgcgggccuaucagccgcac

SEQ ID NO: 540178 - RNA, 20 nt, Human
ccgcgucguccccgcgacug

SEQ ID NO: 540179 - RNA, 21 nt, Human
ccgcucggagagagacagcga

SEQ ID NO: 540180 - RNA, 21 nt, Human
ccgcugcaguccccgggagac

SEQ ID NO: 540181 - RNA, 22 nt, Human
ccggcccuccccacgccccccc

SEQ ID NO: 540182 - RNA, 20 nt, Human
ccggggcugacccgggaucg

SEQ ID NO: 540183 - RNA, 23 nt, Human
ccuccccacgcccccccacaccc

SEQ ID NO: 540184 - RNA, 21 nt, Human
ccucggggccucagcgccggg

SEQ ID NO: 540185 - RNA, 21 nt, Human
ccucucucccucuggaguccc

SEQ ID NO: 540186 - RNA, 21 nt, Human
ccucucucccucuggaguccc

SEQ ID NO: 540187 - RNA, 20 nt, Human
ccuuggcagcugccccagcc

SEQ ID NO: 540188 - RNA, 21 nt, Human
cgagcucccccacaaccgcac

SEQ ID NO: 540189 - RNA, 21 nt, Human
cgccagcggcggguccggccc

SEQ ID NO: 540190 - RNA, 21 nt, Human
cggcacaaaagacccaaacaa

SEQ ID NO: 540191 - RNA, 19 nt, Human
cggcccuccccacgccccc

SEQ ID NO: 540192 - RNA, 20 nt, Human
cggcccuccccacgcccccc

SEQ ID NO: 540193 - RNA, 23 nt, Human
cggcggcggcgcggggaccuugg

SEQ ID NO: 540194 - RNA, 18 nt, Human
cggggagggggcgggcgg

SEQ ID NO: 540195 - RNA, 18 nt, Human
cuccgcgccgggcagcuc

SEQ ID NO: 540196 - RNA, 19 nt, Human
cugccuccgcugcaguccc

SEQ ID NO: 540197 - RNA, 22 nt, Human
cugcgcacauuuucccagcccc

SEQ ID NO: 540198 - RNA, 21 nt, Human
cugugcgugcgcgcgggugga

SEQ ID NO: 540199 - RNA, 24 nt, Human
cuuccucucucccucuggaguccc

SEQ ID NO: 540200 - RNA, 20 nt, Human
gacagcagcugcggcgggcg

SEQ ID NO: 540201 - RNA, 23 nt, Human
gaccugccgccccgauccucuuu

SEQ ID NO: 540202 - RNA, 22 nt, Human
gaggccacggcgagcuccccca

SEQ ID NO: 540203 - RNA, 22 nt, Human
gcaaaaguauacauaucacccc

SEQ ID NO: 540204 - RNA, 22 nt, Human
gcagcgugaaggcaaugggagc

SEQ ID NO: 540205 - RNA, 24 nt, Human
gcaugugcccccuacacaugcaug

SEQ ID NO: 540206 - RNA, 23 nt, Human
gccaaccccaaaggaagcuaaag

SEQ ID NO: 540207 - RNA, 23 nt, Human
gccaaccccaaaggaagcuaaag

SEQ ID NO: 540208 - RNA, 23 nt, Human
gccucgucaaucuuccccuugcc

SEQ ID NO: 540209 - RNA, 21 nt, Human
gcgcggguggauggcugggug

SEQ ID NO: 540210 - RNA, 19 nt, Human
gcggcgcggggaccuuggc

SEQ ID NO: 540211 - RNA, 18 nt, Human
gcgugcgggaggccggag

SEQ ID NO: 540212 - RNA, 19 nt, Human
ggagggggcgggcggggug

SEQ ID NO: 540213 - RNA, 18 nt, Human
ggcagccgaggccuccgg

SEQ ID NO: 540214 - RNA, 22 nt, Human
ggcagcucagcgcgaggcgugg

SEQ ID NO: 540215 - RNA, 25 nt, Human
ggccacggcgagcucccccacaacc

SEQ ID NO: 540216 - RNA, 20 nt, Human
ggcgagcucccccacaaccg

SEQ ID NO: 540217 - RNA, 23 nt, Human
ggcggcggcgcggggaccuuggc

SEQ ID NO: 540218 - RNA, 24 nt, Human
ggcggcggcgcggggaccuuggca

SEQ ID NO: 540219 - RNA, 18 nt, Human
gggaggccggaggggcgg

SEQ ID NO: 540220 - RNA, 19 nt, Human
gggcggcggcagacccucc

SEQ ID NO: 540221 - RNA, 19 nt, Human
ggggagggggcgggcgggg

SEQ ID NO: 540222 - RNA, 19 nt, Human
ggggcgggcgggguggggg

SEQ ID NO: 540223 - RNA, 27 nt, Human
gugaagcaaaaguauacauaucacccc

SEQ ID NO: 540224 - RNA, 23 nt, Human
uaaaugugaaaagcaauacucug

SEQ ID NO: 540225 - RNA, 21 nt, Human
uaaguuagaacgcgguuccca

SEQ ID NO: 540226 - RNA, 24 nt, Human
uagcagcacaguuuaaguaaacac

SEQ ID NO: 540227 - RNA, 20 nt, Human
ucccaucaggcuucucauuu

SEQ ID NO: 540228 - RNA, 22 nt, Human
uccccacgcccccccacacccc

SEQ ID NO: 540229 - RNA, 20 nt, Human
uccccgcgacugcagcgccu

SEQ ID NO: 540230 - RNA, 18 nt, Human
uccccggccgggaggagg

SEQ ID NO: 540231 - RNA, 19 nt, Human
uccccgggagacagucuuc

SEQ ID NO: 540232 - RNA, 20 nt, Human
uccccgggagacagucuuca

SEQ ID NO: 540233 - RNA, 19 nt, Human
ucccgguguaagucaccgc

SEQ ID NO: 540234 - RNA, 22 nt, Human
ucucaugcuaaucaccaggcug

SEQ ID NO: 540235 - RNA, 22 nt, Human
ugaaaagcaauacucugaaaua

SEQ ID NO: 540236 - RNA, 22 nt, Human
ugaaaaugcguauuacacuuac

SEQ ID NO: 540237 - RNA, 23 nt, Human
ugaagcaaaaguauacauaucac

SEQ ID NO: 540238 - RNA, 22 nt, Human
ugacccgggaucgggcgugcgg

SEQ ID NO: 540239 - RNA, 18 nt, Human
ugcagacagcagcugcgg

SEQ ID NO: 540240 - RNA, 23 nt, Human
ugcagcgcuuccucucucccucu

SEQ ID NO: 540241 - RNA, 20 nt, Human
ugccccagccuggagccagc

SEQ ID NO: 540242 - RNA, 22 nt, Human
ugcccuagcccuacuuagcagc

SEQ ID NO: 540243 - RNA, 19 nt, Human
ugccuggcccaccugcgcc

SEQ ID NO: 540244 - RNA, 19 nt, Human
ugccuggcccaccugcgcc

SEQ ID NO: 540245 - RNA, 20 nt, Human
ugcuuggccaacugggagcc

SEQ ID NO: 540246 - RNA, 21 nt, Human
uggagucccgguguaagucac

SEQ ID NO: 540247 - RNA, 22 nt, Human
uggagucccgguguaagucacc

SEQ ID NO: 540248 - RNA, 22 nt, Human
uggcagcugccccagccuggag

SEQ ID NO: 540249 - RNA, 18 nt, Human
uggccgaggcggcgccgg

SEQ ID NO: 540250 - RNA, 22 nt, Human
ugggagcaacacgcaucugugg

SEQ ID NO: 540251 - RNA, 19 nt, Human
ugggagccacggcacaaaa

SEQ ID NO: 540252 - RNA, 22 nt, Human
ugggagcgcagacaauggcccg

SEQ ID NO: 540253 - RNA, 21 nt, Human
uggggggaaaggcacguuagg

SEQ ID NO: 540254 - RNA, 22 nt, Human
ugggugcgccgacacgcaugug

SEQ ID NO: 540255 - RNA, 19 nt, Human
ugucaaggaucaguucugu

SEQ ID NO: 540256 - RNA, 20 nt, Human
ugucaaggaucaguucugug

SEQ ID NO: 540257 - RNA, 18 nt, Human
ugugcgugcgcgcgggug

SEQ ID NO: 540258 - RNA, 24 nt, Human
uguggcaccguuuaaccacagacu

SEQ ID NO: 540259 - RNA, 25 nt, Human
uguuuuguuuuguuuuuuuuuuuuu

SEQ ID NO: 540260 - RNA, 18 nt, Human
uguuuuuuuuuuuuugga

SEQ ID NO: 540261 - RNA, 22 nt, Human
uuguuuuguuuuguuuuuuuuu

SEQ ID NO: 540262 - RNA, 18 nt, Human
uuuguuuuguuuuguuuu

SEQ ID NO: 540263 - RNA, 25 nt, Human
aaaaaaaaaaaguacaucauaaaag

SEQ ID NO: 540264 - RNA, 19 nt, Human
aaaaccagaauguugaaug

SEQ ID NO: 540265 - RNA, 32 nt, Human
aaacagaccuacgagugcccuguguauagaag

SEQ ID NO: 540266 - RNA, 20 nt, Human
aaagguugcagugagccgag

SEQ ID NO: 540267 - RNA, 24 nt, Human
aaagguugcagugagccgagguug

SEQ ID NO: 540268 - RNA, 20 nt, Human
aacagaacaagacuccaucu

SEQ ID NO: 540269 - RNA, 24 nt, Human
aacuugaucauuaucauuaguagg

SEQ ID NO: 540270 - RNA, 20 nt, Human
aagaaaccaaacagaccuac

SEQ ID NO: 540271 - RNA, 25 nt, Human
aagaaaccaaacagaccuacgagug

SEQ ID NO: 540272 - RNA, 20 nt, Human
aagcagcaggccccagguga

SEQ ID NO: 540273 - RNA, 21 nt, Human
aaguccucuucggugauaucc

SEQ ID NO: 540274 - RNA, 24 nt, Human
aaucacuugaaccuaggaggcaaa

SEQ ID NO: 540275 - RNA, 23 nt, Human
aauugcagaucccacgacagggg

SEQ ID NO: 540276 - RNA, 19 nt, Human
acaagaaaccaaacagacc

SEQ ID NO: 540277 - RNA, 22 nt, Human
acacuggcauuccucuagccuc

SEQ ID NO: 540278 - RNA, 24 nt, Human
acagaacaagacuccaucucaaaa

SEQ ID NO: 540279 - RNA, 30 nt, Human
accacagcaacccugguuccgacacacugg

SEQ ID NO: 540280 - RNA, 18 nt, Human
acucccggcauuuccccc

SEQ ID NO: 540281 - RNA, 24 nt, Human
acugcacucccuccugggcaacag

SEQ ID NO: 540282 - RNA, 22 nt, Human
agaaccaaacugagaggcccca

SEQ ID NO: 540283 - RNA, 23 nt, Human
agaaccaaacugagaggccccag

SEQ ID NO: 540284 - RNA, 19 nt, Human
agacaagaaaccaaacaga

SEQ ID NO: 540285 - RNA, 21 nt, Human
agacaagaaaccaaacagacc

SEQ ID NO: 540286 - RNA, 22 nt, Human
agacagugaaguucucuagagc

SEQ ID NO: 540287 - RNA, 20 nt, Human
agcaaugcagccggaaagaa

SEQ ID NO: 540288 - RNA, 21 nt, Human
aggaggcaaagguugcaguga

SEQ ID NO: 540289 - RNA, 21 nt, Human
aggcaaagguugcagugagcc

SEQ ID NO: 540290 - RNA, 24 nt, Human
aggcaaagguugcagugagccgag

SEQ ID NO: 540291 - RNA, 18 nt, Human
agguaggagaaucacuug

SEQ ID NO: 540292 - RNA, 23 nt, Human
agguaggagaaucacuugaaccu

SEQ ID NO: 540293 - RNA, 22 nt, Human
caaauuaaauuauuagcccuua

SEQ ID NO: 540294 - RNA, 21 nt, Human
caacuugaucauuaucauuag

SEQ ID NO: 540295 - RNA, 22 nt, Human
caagaacgccccgcgcccgagc

SEQ ID NO: 540296 - RNA, 21 nt, Human
caagacuccaucucaaaaaaa

SEQ ID NO: 540297 - RNA, 24 nt, Human
cacagaacuguccucgcacaccac

SEQ ID NO: 540298 - RNA, 28 nt, Human
caccacagcaacccugguuccgacacac

SEQ ID NO: 540299 - RNA, 20 nt, Human
caccacggcccggcgcacca

SEQ ID NO: 540300 - RNA, 20 nt, Human
caccacugcacucccuccug

SEQ ID NO: 540301 - RNA, 24 nt, Human
caccacugcacucccuccugggca

SEQ ID NO: 540302 - RNA, 23 nt, Human
cacccccguggacagacaagaaa

SEQ ID NO: 540303 - RNA, 19 nt, Human
cacgacuguaaucccaguu

SEQ ID NO: 540304 - RNA, 23 nt, Human
cacugcacucccuccugggcaac

SEQ ID NO: 540305 - RNA, 24 nt, Human
cacugcacucccuccugggcaaca

SEQ ID NO: 540306 - RNA, 24 nt, Human
cacugucuuggugucgauggucuu

SEQ ID NO: 540307 - RNA, 19 nt, Human
cagaucccacgacaggggg

SEQ ID NO: 540308 - RNA, 24 nt, Human
cagcaggccccaggugaguccuga

SEQ ID NO: 540309 - RNA, 23 nt, Human
caggaaccauuguugaagcccgu

SEQ ID NO: 540310 - RNA, 24 nt, Human
caggccccaggugaguccugaagg

SEQ ID NO: 540311 - RNA, 23 nt, Human
caugcaaaagcaaugcagccgga

SEQ ID NO: 540312 - RNA, 24 nt, Human
ccacagcaacccugguuccgacac

SEQ ID NO: 540313 - RNA, 19 nt, Human
ccacgacaggggggacaca

SEQ ID NO: 540314 - RNA, 24 nt, Human
ccacugcacucccuccugggcaac

SEQ ID NO: 540315 - RNA, 19 nt, Human
ccacuggccgaaaagaaga

SEQ ID NO: 540316 - RNA, 23 nt, Human
ccaggugaguccugaaggaagag

SEQ ID NO: 540317 - RNA, 21 nt, Human
ccccagcuacaucuggaccuu

SEQ ID NO: 540318 - RNA, 20 nt, Human
ccgcgcacuccggguugggu

SEQ ID NO: 540319 - RNA, 20 nt, Human
ccucgcacaccacagcaacc

SEQ ID NO: 540320 - RNA, 25 nt, Human
ccuuuuguaagcucuccagauauuc

SEQ ID NO: 540321 - RNA, 25 nt, Human
cuccaucucaaaaaaaaaaaaguac

SEQ ID NO: 540322 - RNA, 19 nt, Human
cucccggcauuucccccca

SEQ ID NO: 540323 - RNA, 24 nt, Human
cugcacucccuccugggcaacaga

SEQ ID NO: 540324 - RNA, 19 nt, Human
cugcacuguucccaugcac

SEQ ID NO: 540325 - RNA, 18 nt, Human
cuggcuggaguggcucug

SEQ ID NO: 540326 - RNA, 18 nt, Human
cuguaaucccaguuacuc

SEQ ID NO: 540327 - RNA, 21 nt, Human
cuguaaucccaguuacucagg

SEQ ID NO: 540328 - RNA, 22 nt, Human
cuuagagugaaagucagaaaaa

SEQ ID NO: 540329 - RNA, 20 nt, Human
cuucucaggaggccgcgcac

SEQ ID NO: 540330 - RNA, 23 nt, Human
gagaaucacuugaaccuaggagg

SEQ ID NO: 540331 - RNA, 25 nt, Human
gcuggagugcagugaggauuuucua

SEQ ID NO: 540332 - RNA, 24 nt, Human
gcugguucuguuuguuuuccucuu

SEQ ID NO: 540333 - RNA, 19 nt, Human
ggaccuucaggcugaagag

SEQ ID NO: 540334 - RNA, 21 nt, Human
ggaggcaaagguugcagugag

SEQ ID NO: 540335 - RNA, 20 nt, Human
ggagguaggagaaucacuug

SEQ ID NO: 540336 - RNA, 24 nt, Human
ggagguaggagaaucacuugaacc

SEQ ID NO: 540337 - RNA, 25 nt, Human
ggcaugguccacagaacuguccucg

SEQ ID NO: 540338 - RNA, 20 nt, Human
ggcauuccucuagccucugc

SEQ ID NO: 540339 - RNA, 25 nt, Human
ggcuggaguggcucugcuucuagaa

SEQ ID NO: 540340 - RNA, 20 nt, Human
gggcuccagucuccucccag

SEQ ID NO: 540341 - RNA, 21 nt, Human
guccagcaaugccgaucugac

SEQ ID NO: 540342 - RNA, 26 nt, Human
guugaugguccccuuuuguucaguca

SEQ ID NO: 540343 - RNA, 24 nt, Human
guugcaccacugcacucccuccug

SEQ ID NO: 540344 - RNA, 19 nt, Human
guugcagugagccgagguu

SEQ ID NO: 540345 - RNA, 20 nt, Human
uaacucagggcugagcgugg

SEQ ID NO: 540346 - RNA, 23 nt, Human
uaagcucuccagauauuccuuaa

SEQ ID NO: 540347 - RNA, 23 nt, Human
uagaaacuaacucagggcugagc

SEQ ID NO: 540348 - RNA, 19 nt, Human
uagcaagcugccacacaau

SEQ ID NO: 540349 - RNA, 24 nt, Human
uaggaggcaaagguugcagugagc

SEQ ID NO: 540350 - RNA, 24 nt, Human
uccgcaaauuuagcggcugagaca

SEQ ID NO: 540351 - RNA, 21 nt, Human
uccuuaacauugucauaacca

SEQ ID NO: 540352 - RNA, 22 nt, Human
ucuaacuuuuuaguaacucaca

SEQ ID NO: 540353 - RNA, 24 nt, Human
ucuagaagcguaagguaacacugg

SEQ ID NO: 540354 - RNA, 20 nt, Human
ucuguaaggccuccaguguc

SEQ ID NO: 540355 - RNA, 20 nt, Human
ucuuccuucuucggaagcug

SEQ ID NO: 540356 - RNA, 21 nt, Human
ugaagagcgaagagaagacug

SEQ ID NO: 540357 - RNA, 22 nt, Human
ugagccgagguugcaccacugc

SEQ ID NO: 540358 - RNA, 19 nt, Human
ugccauaggcgcccgcugg

SEQ ID NO: 540359 - RNA, 22 nt, Human
uggacagacaagaaaccaaaca

SEQ ID NO: 540360 - RNA, 21 nt, Human
uggcacacgacuguaauccca

SEQ ID NO: 540361 - RNA, 22 nt, Human
uggcacacgacuguaaucccag

SEQ ID NO: 540362 - RNA, 25 nt, Human
ugggacacccaagcaggaagggagc

SEQ ID NO: 540363 - RNA, 21 nt, Human
uguacucccggcauuuccccc

SEQ ID NO: 540364 - RNA, 23 nt, Human
ugucauaaccauaaaacuuggcc

SEQ ID NO: 540365 - RNA, 25 nt, Human
uucaaaauauaaaagcagcaggccc

SEQ ID NO: 540366 - RNA, 19 nt, Human
uuccccccaauugucuucc

SEQ ID NO: 540367 - RNA, 18 nt, Human
uuccuucuucggaagcug

SEQ ID NO: 540368 - RNA, 21 nt, Human
uugcaaaagccacccccgugg

SEQ ID NO: 540369 - RNA, 23 nt, Human
uugcaaccgcuguguuuuugcca

SEQ ID NO: 540370 - RNA, 22 nt, Human
uugcagugagccgagguugcac

SEQ ID NO: 540371 - RNA, 25 nt, Human
aaaaaaaaaaaaaaaggcaguaaaa

SEQ ID NO: 540372 - RNA, 25 nt, Human
aaaaaaaggcaguaaaaucucagaa

SEQ ID NO: 540373 - RNA, 21 nt, Human
aaaccucggcuggaaggcugg

SEQ ID NO: 540374 - RNA, 20 nt, Human
aaagaacagcucgggccacc

SEQ ID NO: 540375 - RNA, 25 nt, Human
aaauucacuuauggaguccaacaaa

SEQ ID NO: 540376 - RNA, 21 nt, Human
aacaccaaaccaaccgaaagc

SEQ ID NO: 540377 - RNA, 21 nt, Human
aaggucuugugucuuuuccua

SEQ ID NO: 540378 - RNA, 25 nt, Human
acaccaaaccaaccgaaagcuaugc

SEQ ID NO: 540379 - RNA, 21 nt, Human
acagaacaccaaaccaaccga

SEQ ID NO: 540380 - RNA, 22 nt, Human
acagaacaccaaaccaaccgaa

SEQ ID NO: 540381 - RNA, 21 nt, Human
acggcaaaaaaaaaaaaaaau

SEQ ID NO: 540382 - RNA, 19 nt, Human
agacggaggaucagagccc

SEQ ID NO: 540383 - RNA, 20 nt, Human
agaggggaugggaggcagaa

SEQ ID NO: 540384 - RNA, 23 nt, Human
agcaccaaaggcucgcuaacacc

SEQ ID NO: 540385 - RNA, 22 nt, Human
agcggcuggaguuaucuggcca

SEQ ID NO: 540386 - RNA, 23 nt, Human
agcugaaagaacagcucgggcca

SEQ ID NO: 540387 - RNA, 18 nt, Human
aggcaagaacgagcaucu

SEQ ID NO: 540388 - RNA, 20 nt, Human
aggcagaguggccugcaguu

SEQ ID NO: 540389 - RNA, 22 nt, Human
aggcuucuagcaccaaaggcuc

SEQ ID NO: 540390 - RNA, 20 nt, Human
auaaaaauguacggucaccc

SEQ ID NO: 540391 - RNA, 20 nt, Human
aucucaggcaccacaaaauc

SEQ ID NO: 540392 - RNA, 20 nt, Human
augccgcagccggauuuccc

SEQ ID NO: 540393 - RNA, 20 nt, Human
caaauuccucacacauacag

SEQ ID NO: 540394 - RNA, 23 nt, Human
caaauuccucacacauacagcuc

SEQ ID NO: 540395 - RNA, 19 nt, Human
caaggcagaguggccugca

SEQ ID NO: 540396 - RNA, 22 nt, Human
caaguggcaggcugcccugggc

SEQ ID NO: 540397 - RNA, 21 nt, Human
cacaaugaaaucagaggccac

SEQ ID NO: 540398 - RNA, 21 nt, Human
caccaaaggcucgcuaacacc

SEQ ID NO: 540399 - RNA, 23 nt, Human
cacuccugauuucuguuuggaag

SEQ ID NO: 540400 - RNA, 23 nt, Human
cagaacaccaaaccaaccgaaag

SEQ ID NO: 540401 - RNA, 24 nt, Human
cagagcccugccugucugccaggg

SEQ ID NO: 540402 - RNA, 19 nt, Human
cagggacaccauuucccac

SEQ ID NO: 540403 - RNA, 21 nt, Human
cagggacaccauuucccaccu

SEQ ID NO: 540404 - RNA, 22 nt, Human
cauuucugugcucugugcuuug

SEQ ID NO: 540405 - RNA, 26 nt, Human
cauuucugugcucugugcuuugggag

SEQ ID NO: 540406 - RNA, 19 nt, Human
ccaaaggcucgcuaacacc

SEQ ID NO: 540407 - RNA, 18 nt, Human
cccacaaugaaaucagag

SEQ ID NO: 540408 - RNA, 20 nt, Human
cccacaaugaaaucagaggc

SEQ ID NO: 540409 - RNA, 20 nt, Human
ccccgcaggcuucuagcacc

SEQ ID NO: 540410 - RNA, 22 nt, Human
ccccgcaggcuucuagcaccaa

SEQ ID NO: 540411 - RNA, 23 nt, Human
ccccgcaggcuucuagcaccaaa

SEQ ID NO: 540412 - RNA, 21 nt, Human
ccccggucacugcuccuccua

SEQ ID NO: 540413 - RNA, 18 nt, Human
cccggagaaagacugucc

SEQ ID NO: 540414 - RNA, 18 nt, Human
cccugagucacgggaacc

SEQ ID NO: 540415 - RNA, 21 nt, Human
cccugcugcuguuugcugcug

SEQ ID NO: 540416 - RNA, 25 nt, Human
ccucggcugaguuaaaaccgggguc

SEQ ID NO: 540417 - RNA, 25 nt, Human
ccucuagguaacaaggcaaaggccu

SEQ ID NO: 540418 - RNA, 23 nt, Human
ccugagucacgggaaccugagac

SEQ ID NO: 540419 - RNA, 21 nt, Human
ccuuuuucaugaugacuuggg

SEQ ID NO: 540420 - RNA, 22 nt, Human
cgcuugcaaccugcccacuuau

SEQ ID NO: 540421 - RNA, 25 nt, Human
cggcaaaaaaaaaaaaaaauccaaa

SEQ ID NO: 540422 - RNA, 22 nt, Human
cuaacacggcaaaaaaaaaaaa

SEQ ID NO: 540423 - RNA, 19 nt, Human
cuauggcaaugcagaccca

SEQ ID NO: 540424 - RNA, 21 nt, Human
cucacacauacagcucacucc

SEQ ID NO: 540425 - RNA, 24 nt, Human
cucagcaggagaggggagagguga

SEQ ID NO: 540426 - RNA, 24 nt, Human
cucggcuggaaggcuggucuuggc

SEQ ID NO: 540427 - RNA, 23 nt, Human
cugaaagaacagcucgggccacc

SEQ ID NO: 540428 - RNA, 23 nt, Human
cugcuaugccgcagccggauuuc

SEQ ID NO: 540429 - RNA, 19 nt, Human
cugcuguuugcugcugucu

SEQ ID NO: 540430 - RNA, 21 nt, Human
cugggcagagcccugccuguc

SEQ ID NO: 540431 - RNA, 18 nt, Human
cuuaaaaaaaaaaaaaaa

SEQ ID NO: 540432 - RNA, 24 nt, Human
cuuaaaaaaaaaaaaaaaggcagu

SEQ ID NO: 540433 - RNA, 25 nt, Human
cuuaaaaaaaaaaaaaaaggcagua

SEQ ID NO: 540434 - RNA, 22 nt, Human
cuuacccugagucacgggaacc

SEQ ID NO: 540435 - RNA, 18 nt, Human
gagaggggagaggugagg

SEQ ID NO: 540436 - RNA, 18 nt, Human
gagaggggagaggugagg

SEQ ID NO: 540437 - RNA, 26 nt, Human
gagagguggucucauucccugaaaaa

SEQ ID NO: 540438 - RNA, 18 nt, Human
gcaaaaaaaaaaaaaaaa

SEQ ID NO: 540439 - RNA, 19 nt, Human
gcaaaggccucccuaaccc

SEQ ID NO: 540440 - RNA, 20 nt, Human
gcccugggcagagcccugcc

SEQ ID NO: 540441 - RNA, 21 nt, Human
gccucccuaacccaggcagac

SEQ ID NO: 540442 - RNA, 23 nt, Human
ggcaaaaaaaaaaaaaaauccaa

SEQ ID NO: 540443 - RNA, 23 nt, Human
ggcagacaggauguggggaaggu

SEQ ID NO: 540444 - RNA, 19 nt, Human
ggcaggcugcccugggcag

SEQ ID NO: 540445 - RNA, 22 nt, Human
ggcaggcugcccugggcagagc

SEQ ID NO: 540446 - RNA, 23 nt, Human
gggaaggaacgcaauggcuucag

SEQ ID NO: 540447 - RNA, 18 nt, Human
gggacggggagacggagg

SEQ ID NO: 540448 - RNA, 20 nt, Human
gggacuacgguggcacggga

SEQ ID NO: 540449 - RNA, 20 nt, Human
gucacuccugauuucuguuu

SEQ ID NO: 540450 - RNA, 18 nt, Human
uaaacagaacaccaaacc

SEQ ID NO: 540451 - RNA, 19 nt, Human
uaaacagaacaccaaacca

SEQ ID NO: 540452 - RNA, 24 nt, Human
uaaacagaacaccaaaccaaccga

SEQ ID NO: 540453 - RNA, 27 nt, Human
uaaacagaacaccaaaccaaccgaaag

SEQ ID NO: 540454 - RNA, 22 nt, Human
uaaauaaacagaacaccaaacc

SEQ ID NO: 540455 - RNA, 18 nt, Human
uaacacggcaaaaaaaaa

SEQ ID NO: 540456 - RNA, 23 nt, Human
uaacacggcaaaaaaaaaaaaaa

SEQ ID NO: 540457 - RNA, 20 nt, Human
uaacucgggcacuauggcaa

SEQ ID NO: 540458 - RNA, 23 nt, Human
uagcaccaaaggcucgcuaacac

SEQ ID NO: 540459 - RNA, 19 nt, Human
uagcagggaaggaacgcaa

SEQ ID NO: 540460 - RNA, 21 nt, Human
uagcagggaaggaacgcaaug

SEQ ID NO: 540461 - RNA, 23 nt, Human
uaucucgcucaccaaauuccuca

SEQ ID NO: 540462 - RNA, 23 nt, Human
uauuucuggacacccccggucac

SEQ ID NO: 540463 - RNA, 18 nt, Human
ucaacuucuuccuguguu

SEQ ID NO: 540464 - RNA, 23 nt, Human
uccaacaaacaacuuucuuaaaa

SEQ ID NO: 540465 - RNA, 20 nt, Human
ucccuaacccaggcagacag

SEQ ID NO: 540466 - RNA, 24 nt, Human
ucccugcugcuguuugcugcuguc

SEQ ID NO: 540467 - RNA, 24 nt, Human
uccuaacacuguauucagcggcug

SEQ ID NO: 540468 - RNA, 18 nt, Human
uccuaagggccuggccgu

SEQ ID NO: 540469 - RNA, 23 nt, Human
uccucaacuucuuccuguguuuc

SEQ ID NO: 540470 - RNA, 24 nt, Human
ucggcuggaaggcuggucuuggca

SEQ ID NO: 540471 - RNA, 24 nt, Human
ucgggccaccuguggaugcaccca

SEQ ID NO: 540472 - RNA, 26 nt, Human
ucucagcaggagaggggagaggugag

SEQ ID NO: 540473 - RNA, 22 nt, Human
ucuuugcuggguggcaaagugu

SEQ ID NO: 540474 - RNA, 21 nt, Human
ugaaagaacagcucgggccac

SEQ ID NO: 540475 - RNA, 21 nt, Human
ugaaaucagaggccacugcaa

SEQ ID NO: 540476 - RNA, 22 nt, Human
ugaccccgcaggcuucuagcac

SEQ ID NO: 540477 - RNA, 25 nt, Human
ugcaaguggcaggcugcccugggcc

SEQ ID NO: 540478 - RNA, 22 nt, Human
ugcagggaggaugcagugagaa

SEQ ID NO: 540479 - RNA, 23 nt, Human
ugcccugggcagagcccugccug

SEQ ID NO: 540480 - RNA, 18 nt, Human
ugccugaaggaggcaaga

SEQ ID NO: 540481 - RNA, 19 nt, Human
ugcuccuccuaagggccug

SEQ ID NO: 540482 - RNA, 24 nt, Human
ugcuggguggcaaaguguuuucag

SEQ ID NO: 540483 - RNA, 22 nt, Human
ugcuugaaauucacuuauggag

SEQ ID NO: 540484 - RNA, 21 nt, Human
uggagcagcugaaagaacagc

SEQ ID NO: 540485 - RNA, 21 nt, Human
uggcaaugcagacccaaacca

SEQ ID NO: 540486 - RNA, 20 nt, Human
uggcaggcugcccugggcag

SEQ ID NO: 540487 - RNA, 19 nt, Human
uggccaagaaccugcuccc

SEQ ID NO: 540488 - RNA, 25 nt, Human
uguaaaaucggaaagccuguaaaag

SEQ ID NO: 540489 - RNA, 20 nt, Human
uguaaacggccucauuucug

SEQ ID NO: 540490 - RNA, 20 nt, Human
uguccaaaccucggcuggaa

SEQ ID NO: 540491 - RNA, 21 nt, Human
ugugucuuuuccuaacucaga

SEQ ID NO: 540492 - RNA, 24 nt, Human
uuaaauaaacagaacaccaaacca

SEQ ID NO: 540493 - RNA, 20 nt, Human
uuccuaacacggcaaaaaaa

SEQ ID NO: 540494 - RNA, 22 nt, Human
uugacaaaaaucuugcuggggc

SEQ ID NO: 540495 - RNA, 21 nt, Human
uugcugcugucuacgcuggcc

SEQ ID NO: 540496 - RNA, 18 nt, Human
uugugccaguucuuugcu

SEQ ID NO: 540497 - RNA, 22 nt, Human
uugugucuuuuccuaacucaga

SEQ ID NO: 540498 - RNA, 21 nt, Human
aaaaagcagcuuuguucugau

SEQ ID NO: 540499 - RNA, 20 nt, Human
aaacgcaccaaaaguugugc

SEQ ID NO: 540500 - RNA, 29 nt, Human
aagcagcuuuguucugucuucucuuuucu

SEQ ID NO: 540501 - RNA, 21 nt, Human
agaagucuucuaccgucaugg

SEQ ID NO: 540502 - RNA, 28 nt, Human
aguugcuccccaaugagaagucuucuac

SEQ ID NO: 540503 - RNA, 20 nt, Human
augaugaagauccggaagaa

SEQ ID NO: 540504 - RNA, 20 nt, Human
cacacagguaccagugcuuu

SEQ ID NO: 540505 - RNA, 21 nt, Human
caccguaccauugggaggugc

SEQ ID NO: 540506 - RNA, 22 nt, Human
ccacauauuccaaccauuuaaa

SEQ ID NO: 540507 - RNA, 18 nt, Human
cccaagccagcccuccca

SEQ ID NO: 540508 - RNA, 22 nt, Human
ccccaaugagaagucuucuacc

SEQ ID NO: 540509 - RNA, 20 nt, Human
ccggaagaaaagauguagug

SEQ ID NO: 540510 - RNA, 26 nt, Human
cucccacaacugaccgauugcuguag

SEQ ID NO: 540511 - RNA, 22 nt, Human
cugguaguggacaagcacuccc

SEQ ID NO: 540512 - RNA, 18 nt, Human
gaagauccggaagaaaag

SEQ ID NO: 540513 - RNA, 20 nt, Human
gacaagcacucccacaacug

SEQ ID NO: 540514 - RNA, 23 nt, Human
gagccacauauuccaaccauuua

SEQ ID NO: 540515 - RNA, 18 nt, Human
gucaaaaaguugcucccc

SEQ ID NO: 540516 - RNA, 22 nt, Human
gucuucucuuuucugucccucc

SEQ ID NO: 540517 - RNA, 18 nt, Human
guggacaagcacucccac

SEQ ID NO: 540518 - RNA, 21 nt, Human
uaccauugggaggugcuucca

SEQ ID NO: 540519 - RNA, 22 nt, Human
uccaugaugaagauccggaaga

SEQ ID NO: 540520 - RNA, 19 nt, Human
ucccucccuucucagccca

SEQ ID NO: 540521 - RNA, 29 nt, Human
uccgcaacaaaugaaacuuccaugaugaa

SEQ ID NO: 540522 - RNA, 22 nt, Human
ucugucuucucuuuucuguccc

SEQ ID NO: 540523 - RNA, 25 nt, Human
ucugucuucucuuuucugucccucc

SEQ ID NO: 540524 - RNA, 21 nt, Human
ucugucuucucuuuucuguug

SEQ ID NO: 540525 - RNA, 23 nt, Human
ucuucucuuuucugucccucccu

SEQ ID NO: 540526 - RNA, 23 nt, Human
ugagaagucuucuaccgucaugg

SEQ ID NO: 540527 - RNA, 20 nt, Human
ugggaggagccugucugaua

SEQ ID NO: 540528 - RNA, 23 nt, Human
uguagugauggaaaaggagccac

SEQ ID NO: 540529 - RNA, 23 nt, Human
ugucuucucuuuucugucccucc

SEQ ID NO: 540530 - RNA, 23 nt, Human
uguuuuuuguuuuuuguuuuuuu

SEQ ID NO: 540531 - RNA, 23 nt, Human
uucaaguaagguuugauuaagaa

SEQ ID NO: 540532 - RNA, 18 nt, Human
uucugucuucucuuuucu

SEQ ID NO: 540533 - RNA, 23 nt, Human
uucugucuucucuuuucuguccc

SEQ ID NO: 540534 - RNA, 22 nt, Human
uuguucugucuucucuuuucug

SEQ ID NO: 540535 - RNA, 20 nt, Human
cagcggcggggccuggggag

SEQ ID NO: 540536 - RNA, 19 nt, Human
cauaaaccagaauggaauc

SEQ ID NO: 540537 - RNA, 20 nt, Human
cggcagcggcggggccuggg

SEQ ID NO: 540538 - RNA, 18 nt, Human
cucugcugccgcugcugc

SEQ ID NO: 540539 - RNA, 21 nt, Human
cucugcugccgcugcugccgc

SEQ ID NO: 540540 - RNA, 23 nt, Human
gaacugcuagacacucucaccug

SEQ ID NO: 540541 - RNA, 21 nt, Human
gcugccucugcugccgcugcu

SEQ ID NO: 540542 - RNA, 19 nt, Human
ggagugguggcuacugcug

SEQ ID NO: 540543 - RNA, 18 nt, Human
ggccuggggaggccgagc

SEQ ID NO: 540544 - RNA, 26 nt, Human
ggcggagugguggcuacugcugcugc

SEQ ID NO: 540545 - RNA, 20 nt, Human
gggaggccgagccgggguug

SEQ ID NO: 540546 - RNA, 23 nt, Human
uaccaagaacugcuagacacucu

SEQ ID NO: 540547 - RNA, 21 nt, Human
uacugcugcugccucugcugc

SEQ ID NO: 540548 - RNA, 18 nt, Human
uagcuuaccaagaacugc

SEQ ID NO: 540549 - RNA, 21 nt, Human
uccagaguagcuuaccaagaa

SEQ ID NO: 540550 - RNA, 21 nt, Human
ugccucugcugccgcugcugc

SEQ ID NO: 540551 - RNA, 23 nt, Human
ugcggccucggcggagugguggc

SEQ ID NO: 540552 - RNA, 18 nt, Human
uucauaaaagacucccaa

SEQ ID NO: 540553 - RNA, 18 nt, Human
aaaaaaaaccaaaagacc

SEQ ID NO: 540554 - RNA, 19 nt, Human
aaaaaaaccaaaagaccca

SEQ ID NO: 540555 - RNA, 23 nt, Human
aaaaaaaccaaaagacccacagg

SEQ ID NO: 540556 - RNA, 23 nt, Human
aaaaaacaacaacaacaacaaaa

SEQ ID NO: 540557 - RNA, 20 nt, Human
aaaaaacaaggauagcuggu

SEQ ID NO: 540558 - RNA, 19 nt, Human
aaaaaaccaaaagacccac

SEQ ID NO: 540559 - RNA, 20 nt, Human
aaaaaaccaaaagacccaca

SEQ ID NO: 540560 - RNA, 23 nt, Human
aaaaauauggcaucccuuaagcc

SEQ ID NO: 540561 - RNA, 22 nt, Human
aaaacaacaacaacaacaaaac

SEQ ID NO: 540562 - RNA, 21 nt, Human
aaaagcaggccuggaggccca

SEQ ID NO: 540563 - RNA, 18 nt, Human
aaaauagcaaaguagaaa

SEQ ID NO: 540564 - RNA, 19 nt, Human
aaacaacaacaacaacaaa

SEQ ID NO: 540565 - RNA, 21 nt, Human
aaacagaaagcacccggucac

SEQ ID NO: 540566 - RNA, 24 nt, Human
aaacaggaaacagaaagcacccgg

SEQ ID NO: 540567 - RNA, 24 nt, Human
aacaacaaaaaaaaaaccaaaaga

SEQ ID NO: 540568 - RNA, 23 nt, Human
aacaacaacaacaacaaaaaaaa

SEQ ID NO: 540569 - RNA, 20 nt, Human
aacaugaugaaacccugucu

SEQ ID NO: 540570 - RNA, 21 nt, Human
aacaugaugaaacccugucuc

SEQ ID NO: 540571 - RNA, 18 nt, Human
aagaaaaaaggagaauca

SEQ ID NO: 540572 - RNA, 23 nt, Human
aagaaacacacacauggggagac

SEQ ID NO: 540573 - RNA, 24 nt, Human
aagagugguggcucacgccuguaa

SEQ ID NO: 540574 - RNA, 19 nt, Human
aagcccagaaagucggcaa

SEQ ID NO: 540575 - RNA, 20 nt, Human
aaggcaucuuuuagaaguca

SEQ ID NO: 540576 - RNA, 24 nt, Human
aaucaccugaacccgagaggcgga

SEQ ID NO: 540577 - RNA, 25 nt, Human
acaacaaaaaaaaaaccaaaagacc

SEQ ID NO: 540578 - RNA, 25 nt, Human
acaacaacaaaaaaaaaaccaaaag

SEQ ID NO: 540579 - RNA, 26 nt, Human
acaacaacaaaaaaaaaaccaaaaga

SEQ ID NO: 540580 - RNA, 28 nt, Human
acaacaacaacaacaaaaaaaaaaccaa

SEQ ID NO: 540581 - RNA, 19 nt, Human
acaagagugaaacuccauc

SEQ ID NO: 540582 - RNA, 20 nt, Human
acaagagugaaacuccaucu

SEQ ID NO: 540583 - RNA, 20 nt, Human
acaagagugaaacuccaucu

SEQ ID NO: 540584 - RNA, 23 nt, Human
acaagcaggauccacagcacaga

SEQ ID NO: 540585 - RNA, 20 nt, Human
acagaaagcacccggucaca

SEQ ID NO: 540586 - RNA, 20 nt, Human
acauccccaucaaaacccac

SEQ ID NO: 540587 - RNA, 22 nt, Human
accaaaauacaaaggacuccug

SEQ ID NO: 540588 - RNA, 24 nt, Human
accaagacccccagaagcagcccu

SEQ ID NO: 540589 - RNA, 26 nt, Human
accaagacccccagaagcagcccuga

SEQ ID NO: 540590 - RNA, 22 nt, Human
accauugcacuccagccugggc

SEQ ID NO: 540591 - RNA, 20 nt, Human
acccaguggaacugccacuc

SEQ ID NO: 540592 - RNA, 31 nt, Human
acccugacaacucugagguaggacacacugg

SEQ ID NO: 540593 - RNA, 24 nt, Human
acccugucucuacuaaaaauacaa

SEQ ID NO: 540594 - RNA, 22 nt, Human
accugcacuugcaccacauccu

SEQ ID NO: 540595 - RNA, 25 nt, Human
acuccagccugggcaacaagaguga

SEQ ID NO: 540596 - RNA, 20 nt, Human
agaacaccugagacuagcuc

SEQ ID NO: 540597 - RNA, 19 nt, Human
agcaggccuggaggcccag

SEQ ID NO: 540598 - RNA, 23 nt, Human
agccgggagugguggugggcgcc

SEQ ID NO: 540599 - RNA, 18 nt, Human
aggaaaaaaaggcuggaa

SEQ ID NO: 540600 - RNA, 23 nt, Human
aggaaaaaaaggcuggaauggag

SEQ ID NO: 540601 - RNA, 19 nt, Human
aggaauacugggagucacu

SEQ ID NO: 540602 - RNA, 23 nt, Human
aggaggcugaggcaggagaauca

SEQ ID NO: 540603 - RNA, 18 nt, Human
aggcaggagaaucaccug

SEQ ID NO: 540604 - RNA, 18 nt, Human
aggcaggagaaucaccug

SEQ ID NO: 540605 - RNA, 24 nt, Human
aggcaggagaaucaccugaacccg

SEQ ID NO: 540606 - RNA, 21 nt, Human
aggccgaggugugcgggucac

SEQ ID NO: 540607 - RNA, 19 nt, Human
aggcggagguugcagugag

SEQ ID NO: 540608 - RNA, 24 nt, Human
aggcggagguugcagugagcggag

SEQ ID NO: 540609 - RNA, 24 nt, Human
aggcugaggcaggagaaucaccug

SEQ ID NO: 540610 - RNA, 24 nt, Human
agucuggacaacaugaugaaaccc

SEQ ID NO: 540611 - RNA, 19 nt, Human
aguuuggggcccaaccagg

SEQ ID NO: 540612 - RNA, 26 nt, Human
aucuuacacacccaugaacacugagc

SEQ ID NO: 540613 - RNA, 24 nt, Human
auugcacuccagccugggcaacaa

SEQ ID NO: 540614 - RNA, 25 nt, Human
auugcacuccagccugggcaacaag

SEQ ID NO: 540615 - RNA, 24 nt, Human
auuguaccauugcacuccagccug

SEQ ID NO: 540616 - RNA, 26 nt, Human
caaaaaaaaaaccaaaagacccacag

SEQ ID NO: 540617 - RNA, 21 nt, Human
caaaacaaaaaucccaggucc

SEQ ID NO: 540618 - RNA, 22 nt, Human
caaaacccacaggcugggccaa

SEQ ID NO: 540619 - RNA, 23 nt, Human
caaaagacccacaggcuggugga

SEQ ID NO: 540620 - RNA, 21 nt, Human
caaaauucuuagccugaggca

SEQ ID NO: 540621 - RNA, 23 nt, Human
caaacccaagggagccuggcuga

SEQ ID NO: 540622 - RNA, 19 nt, Human
caaaguagaaaacuuucca

SEQ ID NO: 540623 - RNA, 20 nt, Human
caaaugaggaaaccgaggac

SEQ ID NO: 540624 - RNA, 25 nt, Human
caacaaaaaaaaaaccaaaagaccc

SEQ ID NO: 540625 - RNA, 19 nt, Human
caacaacaaaaaaaaaacc

SEQ ID NO: 540626 - RNA, 22 nt, Human
caacaacaaaaaaaaaacccca

SEQ ID NO: 540627 - RNA, 25 nt, Human
caacaacaacaaaaaaaaaaccaaa

SEQ ID NO: 540628 - RNA, 22 nt, Human
caacaugaugaaacccugucuc

SEQ ID NO: 540629 - RNA, 24 nt, Human
caacaugaugaaacccugucucua

SEQ ID NO: 540630 - RNA, 22 nt, Human
caaccagggcucccacugaguc

SEQ ID NO: 540631 - RNA, 20 nt, Human
caagaaacacacacaugggg

SEQ ID NO: 540632 - RNA, 22 nt, Human
caagcaggauccacagcacaga

SEQ ID NO: 540633 - RNA, 18 nt, Human
caaggcgguaaaaaacaa

SEQ ID NO: 540634 - RNA, 18 nt, Human
cacagugccagacaaggc

SEQ ID NO: 540635 - RNA, 20 nt, Human
caccagaagggcagcuagcu

SEQ ID NO: 540636 - RNA, 23 nt, Human
cacgccuguaaucccagcacuuc

SEQ ID NO: 540637 - RNA, 23 nt, Human
cacuccagccugggcaacaagag

SEQ ID NO: 540638 - RNA, 24 nt, Human
cacuccagccugggcaacaagagu

SEQ ID NO: 540639 - RNA, 25 nt, Human
cacuccagccugggcaacaagagug

SEQ ID NO: 540640 - RNA, 22 nt, Human
cagaacaccugagacuagcucc

SEQ ID NO: 540641 - RNA, 22 nt, Human
cagagcccaaagugcucaaggg

SEQ ID NO: 540642 - RNA, 19 nt, Human
cagcaaugcuaccauuggc

SEQ ID NO: 540643 - RNA, 23 nt, Human
cagcaaugcuaccauuggccccc

SEQ ID NO: 540644 - RNA, 24 nt, Human
cagcuacucaggaggcugaggcag

SEQ ID NO: 540645 - RNA, 26 nt, Human
caggaggccgaggugugcgggucacc

SEQ ID NO: 540646 - RNA, 22 nt, Human
cagggugcuuucugggguccag

SEQ ID NO: 540647 - RNA, 19 nt, Human
cauugcacuccagccuggg

SEQ ID NO: 540648 - RNA, 21 nt, Human
cauugcacuccagccugggca

SEQ ID NO: 540649 - RNA, 22 nt, Human
cauugcacuccagccugggcaa

SEQ ID NO: 540650 - RNA, 24 nt, Human
cauugcacuccagccugggcaaca

SEQ ID NO: 540651 - RNA, 22 nt, Human
ccaaacccaagggagccuggcu

SEQ ID NO: 540652 - RNA, 19 nt, Human
ccaagacauccccaucaaa

SEQ ID NO: 540653 - RNA, 21 nt, Human
ccagcugacaacaaaaguaaa

SEQ ID NO: 540654 - RNA, 23 nt, Human
ccagggcucccacugagucuggg

SEQ ID NO: 540655 - RNA, 20 nt, Human
ccauugcacuccagccuggg

SEQ ID NO: 540656 - RNA, 21 nt, Human
ccauugcacuccagccugggc

SEQ ID NO: 540657 - RNA, 23 nt, Human
ccauugcacuccagccugggcaa

SEQ ID NO: 540658 - RNA, 24 nt, Human
ccauugcacuccagccugggcaac

SEQ ID NO: 540659 - RNA, 18 nt, Human
ccccagagcccaaagugc

SEQ ID NO: 540660 - RNA, 20 nt, Human
ccccagagcccaaagugcuc

SEQ ID NO: 540661 - RNA, 19 nt, Human
cccccagaagcagcccuga

SEQ ID NO: 540662 - RNA, 20 nt, Human
ccuaacaucaggaguucgag

SEQ ID NO: 540663 - RNA, 27 nt, Human
ccucagccagaccaagggccuccuccu

SEQ ID NO: 540664 - RNA, 19 nt, Human
ccuguaaucccagcuacuc

SEQ ID NO: 540665 - RNA, 21 nt, Human
ccuguaaucccagcuacucag

SEQ ID NO: 540666 - RNA, 21 nt, Human
ccuuugacagaagaggaacau

SEQ ID NO: 540667 - RNA, 23 nt, Human
cgagccucacauggaaaagccga

SEQ ID NO: 540668 - RNA, 19 nt, Human
cgaggugugcgggucaccu

SEQ ID NO: 540669 - RNA, 24 nt, Human
cgccuguaaucccagcuacucagg

SEQ ID NO: 540670 - RNA, 24 nt, Human
cgggucaccuaacaucaggaguuc

SEQ ID NO: 540671 - RNA, 22 nt, Human
cgguaaaaaacaaggauagcug

SEQ ID NO: 540672 - RNA, 22 nt, Human
cuaacaucaggaguucgagacc

SEQ ID NO: 540673 - RNA, 20 nt, Human
cucaaaguuugagcacauug

SEQ ID NO: 540674 - RNA, 24 nt, Human
cucacgccuguaaucccagcacuu

SEQ ID NO: 540675 - RNA, 25 nt, Human
cucacgccuguaaucccagcacuuc

SEQ ID NO: 540676 - RNA, 25 nt, Human
cuccugcaccacaaagcuucgguug

SEQ ID NO: 540677 - RNA, 24 nt, Human
cuccuggggaacagagccccaugg

SEQ ID NO: 540678 - RNA, 22 nt, Human
cucuacagacagcguccgcagu

SEQ ID NO: 540679 - RNA, 20 nt, Human
cugaacccaguggaacugcc

SEQ ID NO: 540680 - RNA, 24 nt, Human
cugaacccgagaggcggagguugc

SEQ ID NO: 540681 - RNA, 20 nt, Human
cugccccucagggugcuuuc

SEQ ID NO: 540682 - RNA, 21 nt, Human
cuggacaacaugaugaaaccc

SEQ ID NO: 540683 - RNA, 21 nt, Human
cuggugcagcagcaggcucuu

SEQ ID NO: 540684 - RNA, 20 nt, Human
cugguuugugaagcuccugg

SEQ ID NO: 540685 - RNA, 22 nt, Human
cuucacaguucucuugggcuuc

SEQ ID NO: 540686 - RNA, 21 nt, Human
cuuucacugaacccaguggaa

SEQ ID NO: 540687 - RNA, 19 nt, Human
gaaacccugucucuacuaa

SEQ ID NO: 540688 - RNA, 20 nt, Human
gaaaccgaggacccugcugg

SEQ ID NO: 540689 - RNA, 24 nt, Human
gaaacuccaucuuaaaaaaacaac

SEQ ID NO: 540690 - RNA, 21 nt, Human
gacauccccaucaaaacccac

SEQ ID NO: 540691 - RNA, 23 nt, Human
gagaggcggagguugcagugagc

SEQ ID NO: 540692 - RNA, 21 nt, Human
gagguugcagugagcggagau

SEQ ID NO: 540693 - RNA, 23 nt, Human
gagguugcagugagcggagauug

SEQ ID NO: 540694 - RNA, 20 nt, Human
gcaaggaaauggcacaucca

SEQ ID NO: 540695 - RNA, 18 nt, Human
gcacaaaacaaaaauccc

SEQ ID NO: 540696 - RNA, 20 nt, Human
gcagcagcaggcucuugcgc

SEQ ID NO: 540697 - RNA, 22 nt, Human
gcaggagaaucaccugaacccg

SEQ ID NO: 540698 - RNA, 25 nt, Human
gccaagacauccccaucaaaaccca

SEQ ID NO: 540699 - RNA, 19 nt, Human
gccaagagugguggcucac

SEQ ID NO: 540700 - RNA, 19 nt, Human
ggaaggacuaggaauacug

SEQ ID NO: 540701 - RNA, 18 nt, Human
ggaagggccaugaucucu

SEQ ID NO: 540702 - RNA, 24 nt, Human
ggagauuguaccauugcacuccag

SEQ ID NO: 540703 - RNA, 22 nt, Human
ggagguugcagugagcggagau

SEQ ID NO: 540704 - RNA, 24 nt, Human
ggagguugcagugagcggagauug

SEQ ID NO: 540705 - RNA, 23 nt, Human
ggcauuagccaaccaagcccaga

SEQ ID NO: 540706 - RNA, 19 nt, Human
ggccuggaggcccagggug

SEQ ID NO: 540707 - RNA, 20 nt, Human
gggagacguguccaggcuuc

SEQ ID NO: 540708 - RNA, 24 nt, Human
gggagugguggugggcgccuguaa

SEQ ID NO: 540709 - RNA, 23 nt, Human
gggcauuuggcauuagccaacca

SEQ ID NO: 540710 - RNA, 20 nt, Human
gggccaugaucucugguccu

SEQ ID NO: 540711 - RNA, 23 nt, Human
gggucaccuaacaucaggaguuc

SEQ ID NO: 540712 - RNA, 19 nt, Human
ggugacagcaggcaggaga

SEQ ID NO: 540713 - RNA, 24 nt, Human
gguggcucacgccuguaaucccag

SEQ ID NO: 540714 - RNA, 24 nt, Human
gguggugggcgccuguaaucccag

SEQ ID NO: 540715 - RNA, 22 nt, Human
gugcaccugcacuugcaccaca

SEQ ID NO: 540716 - RNA, 22 nt, Human
uaaaaaaacaacaacaacaaca

SEQ ID NO: 540717 - RNA, 22 nt, Human
uaacaacuacacacauuuacaa

SEQ ID NO: 540718 - RNA, 19 nt, Human
uaagccuuaaggcaucuuu

SEQ ID NO: 540719 - RNA, 24 nt, Human
uacacacccaugaacacugagccc

SEQ ID NO: 540720 - RNA, 24 nt, Human
uaccauugcacuccagccugggca

SEQ ID NO: 540721 - RNA, 20 nt, Human
uagcucaaaguuugagcaca

SEQ ID NO: 540722 - RNA, 21 nt, Human
uagcuccccuuucagcucugc

SEQ ID NO: 540723 - RNA, 25 nt, Human
uagcuggggucccaucacuccagcu

SEQ ID NO: 540724 - RNA, 25 nt, Human
uaugaaaaaaagaaaaaaggagaau

SEQ ID NO: 540725 - RNA, 18 nt, Human
ucacaagaccuagcucaa

SEQ ID NO: 540726 - RNA, 19 nt, Human
ucaccagaagggcagcuag

SEQ ID NO: 540727 - RNA, 22 nt, Human
ucaccuaacaucaggaguucga

SEQ ID NO: 540728 - RNA, 23 nt, Human
ucaccuaacaucaggaguucgag

SEQ ID NO: 540729 - RNA, 18 nt, Human
ucagccagaccaagggcc

SEQ ID NO: 540730 - RNA, 20 nt, Human
ucaggaaugcagaaaaggcc

SEQ ID NO: 540731 - RNA, 19 nt, Human
ucaggccauccauccacuc

SEQ ID NO: 540732 - RNA, 18 nt, Human
uccaagacagcagccaag

SEQ ID NO: 540733 - RNA, 20 nt, Human
uccacagcacagaagggcag

SEQ ID NO: 540734 - RNA, 20 nt, Human
uccaucuuaaaaaaacaaca

SEQ ID NO: 540735 - RNA, 18 nt, Human
ucccaaacccaagggagc

SEQ ID NO: 540736 - RNA, 19 nt, Human
ucccaaacccaagggagcc

SEQ ID NO: 540737 - RNA, 22 nt, Human
ucccagagaugacagcaaugcu

SEQ ID NO: 540738 - RNA, 20 nt, Human
ucccaggaaaaggaagaacc

SEQ ID NO: 540739 - RNA, 19 nt, Human
ucccagguccccgaugucu

SEQ ID NO: 540740 - RNA, 19 nt, Human
uccccagaacaccugagac

SEQ ID NO: 540741 - RNA, 24 nt, Human
uccccgaugucucuaucgccccca

SEQ ID NO: 540742 - RNA, 21 nt, Human
uccgacuuugcaaaaggcaaa

SEQ ID NO: 540743 - RNA, 21 nt, Human
uccugggcucucucugcacug

SEQ ID NO: 540744 - RNA, 21 nt, Human
ucucuacuaaaaauacaaaaa

SEQ ID NO: 540745 - RNA, 22 nt, Human
ucugaacugaggcagucugaac

SEQ ID NO: 540746 - RNA, 24 nt, Human
ucuggacaacaugaugaaacccug

SEQ ID NO: 540747 - RNA, 18 nt, Human
ugaaaaaaagaaaaaagg

SEQ ID NO: 540748 - RNA, 23 nt, Human
ugaaaagcaggccuggaggccca

SEQ ID NO: 540749 - RNA, 20 nt, Human
ugaacugucacugacuugua

SEQ ID NO: 540750 - RNA, 21 nt, Human
ugacaggaaaaaaaggcugga

SEQ ID NO: 540751 - RNA, 20 nt, Human
ugacuaaaggauucacccag

SEQ ID NO: 540752 - RNA, 23 nt, Human
ugacuuguauacucacucuccuc

SEQ ID NO: 540753 - RNA, 18 nt, Human
ugaggaaaccgaggaccc

SEQ ID NO: 540754 - RNA, 20 nt, Human
ugaggcaggagaaucaccug

SEQ ID NO: 540755 - RNA, 24 nt, Human
ugaggcaggagaaucaccugaacc

SEQ ID NO: 540756 - RNA, 25 nt, Human
ugaggcaggagaaucaccugaaccc

SEQ ID NO: 540757 - RNA, 22 nt, Human
ugcaaacaggaaacagaaagca

SEQ ID NO: 540758 - RNA, 19 nt, Human
ugcacuccagccugggcaa

SEQ ID NO: 540759 - RNA, 22 nt, Human
ugccucuucccaaacccaaggg

SEQ ID NO: 540760 - RNA, 25 nt, Human
uggaagaagugugagggucagaagg

SEQ ID NO: 540761 - RNA, 23 nt, Human
uggaagggccaugaucucugguc

SEQ ID NO: 540762 - RNA, 18 nt, Human
uggaauggaguagaaagg

SEQ ID NO: 540763 - RNA, 19 nt, Human
uggaauggaguagaaagga

SEQ ID NO: 540764 - RNA, 24 nt, Human
uggacaacaugaugaaacccuguc

SEQ ID NO: 540765 - RNA, 21 nt, Human
uggaggcccaggguggacgug

SEQ ID NO: 540766 - RNA, 22 nt, Human
uggcucacgccuguaaucccag

SEQ ID NO: 540767 - RNA, 24 nt, Human
uggcucacgccuguaaucccagca

SEQ ID NO: 540768 - RNA, 20 nt, Human
uggcugaacugucacugacu

SEQ ID NO: 540769 - RNA, 19 nt, Human
ugggagaguuuggggccca

SEQ ID NO: 540770 - RNA, 26 nt, Human
ugggagaguuuggggcccaaccaggg

SEQ ID NO: 540771 - RNA, 23 nt, Human
uggggaaggacuaggaauacugg

SEQ ID NO: 540772 - RNA, 24 nt, Human
ugguggcucacgccuguaauccca

SEQ ID NO: 540773 - RNA, 24 nt, Human
ugguggugggcgccuguaauccca

SEQ ID NO: 540774 - RNA, 20 nt, Human
ugucccagugccuguuacuu

SEQ ID NO: 540775 - RNA, 21 nt, Human
ugugaaaagcaggccuggagg

SEQ ID NO: 540776 - RNA, 19 nt, Human
ugugcaggcgcuggugcag

SEQ ID NO: 540777 - RNA, 24 nt, Human
uuagccgggagugguggugggcgc

SEQ ID NO: 540778 - RNA, 25 nt, Human
uucacaaaugaggaaaccgaggacc

SEQ ID NO: 540779 - RNA, 22 nt, Human
uucacccagaucuccuagccca

SEQ ID NO: 540780 - RNA, 24 nt, Human
uucaggaggccgaggugugcgggu

SEQ ID NO: 540781 - RNA, 21 nt, Human
uucauauuugucccagugccu

SEQ ID NO: 540782 - RNA, 24 nt, Human
uugaauggguaaaaacaacaaacc

SEQ ID NO: 540783 - RNA, 22 nt, Human
uugcagugagcggagauuguac

SEQ ID NO: 540784 - RNA, 23 nt, Human
uuguaccauugcacuccagccug

SEQ ID NO: 540785 - RNA, 20 nt, Human
uuuggggcccaaccagggcu

SEQ ID NO: 540786 - RNA, 25 nt, Human
uuuggggcccaaccagggcucccac

SEQ ID NO: 540787 - RNA, 21 nt, Human
acccaaggugcaagaaaaccc

SEQ ID NO: 540788 - RNA, 24 nt, Human
acccaaggugcaagaaaacccagc

SEQ ID NO: 540789 - RNA, 20 nt, Human
acccgcuucuccaccaggac

SEQ ID NO: 540790 - RNA, 30 nt, Human
acucaguugcuuuucucuccucucuuuucc

SEQ ID NO: 540791 - RNA, 20 nt, Human
agaaaacccagcccugugga

SEQ ID NO: 540792 - RNA, 20 nt, Human
agaaauuagcggaacccaag

SEQ ID NO: 540793 - RNA, 22 nt, Human
agaaauuagcggaacccaagcg

SEQ ID NO: 540794 - RNA, 22 nt, Human
agcggaacccaagcgagacccg

SEQ ID NO: 540795 - RNA, 21 nt, Human
aggggugggaaugcaaaggga

SEQ ID NO: 540796 - RNA, 24 nt, Human
cacacgcgcacucacaguugcccc

SEQ ID NO: 540797 - RNA, 21 nt, Human
cagcgcagcgaugccuaggga

SEQ ID NO: 540798 - RNA, 23 nt, Human
caggaagacgcaaagcccggagg

SEQ ID NO: 540799 - RNA, 18 nt, Human
ccaaggugcaagaaaacc

SEQ ID NO: 540800 - RNA, 18 nt, Human
cccacacgcgcacucaca

SEQ ID NO: 540801 - RNA, 18 nt, Human
cccaggaagacgcaaagc

SEQ ID NO: 540802 - RNA, 19 nt, Human
cccggaccgaauccucgag

SEQ ID NO: 540803 - RNA, 21 nt, Human
cccuguggaucgcaccgcuuc

SEQ ID NO: 540804 - RNA, 20 nt, Human
ccgcaccuccuuggucccgc

SEQ ID NO: 540805 - RNA, 23 nt, Human
ccugguucggggacccaggaccc

SEQ ID NO: 540806 - RNA, 20 nt, Human
cgagacccgcuucuccaccg

SEQ ID NO: 540807 - RNA, 22 nt, Human
cucacaagagacagcgaaucgc

SEQ ID NO: 540808 - RNA, 23 nt, Human
cucuccucucuuuuccuauccuu

SEQ ID NO: 540809 - RNA, 19 nt, Human
cuuccguuccuucuugccc

SEQ ID NO: 540810 - RNA, 18 nt, Human
gaagacgcaaagcccgga

SEQ ID NO: 540811 - RNA, 19 nt, Human
gaagagaaucgaggucccc

SEQ ID NO: 540812 - RNA, 19 nt, Human
gacccuaugaacucagucc

SEQ ID NO: 540813 - RNA, 23 nt, Human
gaggggugggaaugcaaagggag

SEQ ID NO: 540814 - RNA, 23 nt, Human
gaggggugggaaugcaaagggag

SEQ ID NO: 540815 - RNA, 19 nt, Human
gcaggacacagugcuccuu

SEQ ID NO: 540816 - RNA, 18 nt, Human
gccccgaagcguuguccc

SEQ ID NO: 540817 - RNA, 22 nt, Human
gcuuuaguaggggaucaggaga

SEQ ID NO: 540818 - RNA, 22 nt, Human
gcuuuucucuccucucuuuucc

SEQ ID NO: 540819 - RNA, 18 nt, Human
ucacaguugccccgaagc

SEQ ID NO: 540820 - RNA, 24 nt, Human
ucucacgccucaggacagaaauug

SEQ ID NO: 540821 - RNA, 25 nt, Human
ucuccucucuuuuccuauccuuuau

SEQ ID NO: 540822 - RNA, 20 nt, Human
ucucggcgguuuaacucucc

SEQ ID NO: 540823 - RNA, 25 nt, Human
ugacucacaagagacagcgaaucgc

SEQ ID NO: 540824 - RNA, 20 nt, Human
uggaagcaaucaaaugcgag

SEQ ID NO: 540825 - RNA, 22 nt, Human
uucccucaacccuuccugguuc

SEQ ID NO: 540826 - RNA, 18 nt, Human
ccgccgcccccucgugcc

SEQ ID NO: 540827 - RNA, 23 nt, Human
cucugcgcccgcagccgccgccc

SEQ ID NO: 540828 - RNA, 19 nt, Human
gcgcccgcagccgccgccc

SEQ ID NO: 540829 - RNA, 21 nt, Human
gcgcccgcagccgccgccccc

SEQ ID NO: 540830 - RNA, 21 nt, Human
uccgcucugcgcccgcagccg

SEQ ID NO: 540831 - RNA, 19 nt, Human
cacugugcgucaccaaagc

SEQ ID NO: 540832 - RNA, 18 nt, Human
cccggggcuccuggaggg

SEQ ID NO: 540833 - RNA, 21 nt, Human
cucuccacccagagcagagcu

SEQ ID NO: 540834 - RNA, 20 nt, Human
cuggcagcucagcacgucgu

SEQ ID NO: 540835 - RNA, 24 nt, Human
gcagagcuuccacuaagcuggcag

SEQ ID NO: 540836 - RNA, 18 nt, Human
gcuggcagcucagcacgu

SEQ ID NO: 540837 - RNA, 24 nt, Human
ucaaucccggggcuccuggagggu

SEQ ID NO: 540838 - RNA, 20 nt, Human
uguggauucuucuuuauuuu

SEQ ID NO: 540839 - RNA, 21 nt, Human
uuuuuuuuuuuuuuuuugcaa

SEQ ID NO: 540840 - RNA, 22 nt, Human
uuuuuuuuuuuuuuuuugcaau

SEQ ID NO: 540841 - RNA, 20 nt, Human
uuuuuuuuuuuuuuuuuugg

SEQ ID NO: 540842 - RNA, 19 nt, Human
cacagcccggccucgugcc

SEQ ID NO: 540843 - RNA, 21 nt, Human
cagggucugaugggggcuaca

SEQ ID NO: 540844 - RNA, 27 nt, Human
cuuuaugcuagaccacagcccggccuc

SEQ ID NO: 540845 - RNA, 18 nt, Human
gggcagggucugaugggg

SEQ ID NO: 540846 - RNA, 21 nt, Human
ggugcuccccgguccccaccc

SEQ ID NO: 540847 - RNA, 18 nt, Human
gugcuccccgguccccac

SEQ ID NO: 540848 - RNA, 23 nt, Human
uccgccuuuaugcuagaccacag

SEQ ID NO: 540849 - RNA, 19 nt, Human
aaacgcccacaacauuucu

SEQ ID NO: 540850 - RNA, 21 nt, Human
acaggccuuuaaaauauaaag

SEQ ID NO: 540851 - RNA, 19 nt, Human
accagcuacccagccugca

SEQ ID NO: 540852 - RNA, 27 nt, Human
agacguugggguugcagaccaagagcu

SEQ ID NO: 540853 - RNA, 26 nt, Human
agauaggcuguguuguuacucugcag

SEQ ID NO: 540854 - RNA, 26 nt, Human
agguggcugggauggagcagcuauag

SEQ ID NO: 540855 - RNA, 24 nt, Human
cagccagaacccuugaacucuguu

SEQ ID NO: 540856 - RNA, 22 nt, Human
ccacuuacaaacgcccacaaca

SEQ ID NO: 540857 - RNA, 18 nt, Human
ggaggaaacugagggaug

SEQ ID NO: 540858 - RNA, 20 nt, Human
ggguugcagaccaagagcug

SEQ ID NO: 540859 - RNA, 20 nt, Human
guugcagaccaagagcugag

SEQ ID NO: 540860 - RNA, 21 nt, Human
uaaaccuuugguguguccaua

SEQ ID NO: 540861 - RNA, 19 nt, Human
uaugcagaugccacuuugu

SEQ ID NO: 540862 - RNA, 25 nt, Human
ucaaugauaguaccuguguccuuuc

SEQ ID NO: 540863 - RNA, 20 nt, Human
ucacagguuuagggacucca

SEQ ID NO: 540864 - RNA, 20 nt, Human
uggaggaaacugagggaugg

SEQ ID NO: 540865 - RNA, 21 nt, Human
uggauaaucauagccuucuuc

SEQ ID NO: 540866 - RNA, 20 nt, Human
ugguguguccauacuuucug

SEQ ID NO: 540867 - RNA, 21 nt, Human
uuauaauggcguaaaucuucc

SEQ ID NO: 540868 - RNA, 26 nt, Human
uugcagaccaagagcugagaaucuau

SEQ ID NO: 540869 - RNA, 18 nt, Human
uuucugcuguaauucaca

SEQ ID NO: 540870 - RNA, 24 nt, Human
uuuuuuuuuuuuuuuuuuaacaug

SEQ ID NO: 540871 - RNA, 24 nt, Human
aaccccccacaccccaaaaccaac

SEQ ID NO: 540872 - RNA, 18 nt, Human
accaaccccccacacccc

SEQ ID NO: 540873 - RNA, 25 nt, Human
accacaauucuaccuaucguacauu

SEQ ID NO: 540874 - RNA, 18 nt, Human
accccaaaaccaacgccg

SEQ ID NO: 540875 - RNA, 18 nt, Human
accccccacaccccaaaa

SEQ ID NO: 540876 - RNA, 22 nt, Human
acuggcuagggcagugggagcc

SEQ ID NO: 540877 - RNA, 23 nt, Human
agaggucuaagaaaaugcugacu

SEQ ID NO: 540878 - RNA, 19 nt, Human
agaguuuagaaauucuuga

SEQ ID NO: 540879 - RNA, 19 nt, Human
agcagcggcguugccguca

SEQ ID NO: 540880 - RNA, 20 nt, Human
agcuuucuggaaaagcugga

SEQ ID NO: 540881 - RNA, 23 nt, Human
aggagccaggaaucgcccgcgag

SEQ ID NO: 540882 - RNA, 21 nt, Human
aggaguguuccagaggggccu

SEQ ID NO: 540883 - RNA, 19 nt, Human
agugccaccaaccccccac

SEQ ID NO: 540884 - RNA, 19 nt, Human
aucguacauuuccuagagg

SEQ ID NO: 540885 - RNA, 19 nt, Human
auggacugggccgcgcccc

SEQ ID NO: 540886 - RNA, 18 nt, Human
auucaagcccuuccccca

SEQ ID NO: 540887 - RNA, 24 nt, Human
caccccaaaaccaacgccgucucc

SEQ ID NO: 540888 - RNA, 18 nt, Human
caccuuuauguacuuguc

SEQ ID NO: 540889 - RNA, 19 nt, Human
ccaaccccccacaccccaa

SEQ ID NO: 540890 - RNA, 21 nt, Human
ccaaccccccacaccccaaaa

SEQ ID NO: 540891 - RNA, 25 nt, Human
ccaccaaccccccacaccccaaaac

SEQ ID NO: 540892 - RNA, 23 nt, Human
ccaggccagaaaugcgcggcacg

SEQ ID NO: 540893 - RNA, 22 nt, Human
ccccaaaaccaacgccgucucc

SEQ ID NO: 540894 - RNA, 19 nt, Human
ccccacaccccaaaaccaa

SEQ ID NO: 540895 - RNA, 20 nt, Human
ccccacaccccaaaaccaac

SEQ ID NO: 540896 - RNA, 21 nt, Human
ccccacaccccaaaaccaacg

SEQ ID NO: 540897 - RNA, 20 nt, Human
ccccccacaccccaaaacca

SEQ ID NO: 540898 - RNA, 21 nt, Human
ccccccacaccccaaaaccaa

SEQ ID NO: 540899 - RNA, 24 nt, Human
cccgcuccccaggccagaaaugcg

SEQ ID NO: 540900 - RNA, 22 nt, Human
cccuuaauuaggaguacagagc

SEQ ID NO: 540901 - RNA, 22 nt, Human
cggaaagggguggaaaguggua

SEQ ID NO: 540902 - RNA, 21 nt, Human
cggagcggggacgaggggcac

SEQ ID NO: 540903 - RNA, 23 nt, Human
cuccacccgcuccccaggccaga

SEQ ID NO: 540904 - RNA, 19 nt, Human
cucugcuucugcgcauccg

SEQ ID NO: 540905 - RNA, 19 nt, Human
cuuucuggaaaagcuggaa

SEQ ID NO: 540906 - RNA, 21 nt, Human
gaaggagccaggaaucgcccc

SEQ ID NO: 540907 - RNA, 18 nt, Human
gaccgagggggaggggcc

SEQ ID NO: 540908 - RNA, 22 nt, Human
gaguggccugagagucugggcc

SEQ ID NO: 540909 - RNA, 23 nt, Human
gccgaguggccugagagucuggg

SEQ ID NO: 540910 - RNA, 18 nt, Human
gccuaaaaaggcgcagag

SEQ ID NO: 540911 - RNA, 22 nt, Human
ggagugcugggguggugaagga

SEQ ID NO: 540912 - RNA, 25 nt, Human
ggcaggaguguuccagaggggccug

SEQ ID NO: 540913 - RNA, 18 nt, Human
ggccugagagucugggcc

SEQ ID NO: 540914 - RNA, 18 nt, Human
gggcaggaguguuccaga

SEQ ID NO: 540915 - RNA, 18 nt, Human
gggcagugggagccucag

SEQ ID NO: 540916 - RNA, 20 nt, Human
ggggccuaagagaugacaag

SEQ ID NO: 540917 - RNA, 22 nt, Human
gggggaggggccuaaaaaggcg

SEQ ID NO: 540918 - RNA, 22 nt, Human
gggucuuggagugcuggggugg

SEQ ID NO: 540919 - RNA, 24 nt, Human
gugcugggguggugaaggagccag

SEQ ID NO: 540920 - RNA, 23 nt, Human
guggaaagugguaggguucuagg

SEQ ID NO: 540921 - RNA, 19 nt, Human
uaaaaagaaccaccuguuu

SEQ ID NO: 540922 - RNA, 22 nt, Human
uaaaaagaaccaccuguuuaau

SEQ ID NO: 540923 - RNA, 20 nt, Human
uaagaaaaugcugacuuuua

SEQ ID NO: 540924 - RNA, 20 nt, Human
uagggcagugggagccucag

SEQ ID NO: 540925 - RNA, 18 nt, Human
ucaggccaaagggcgggg

SEQ ID NO: 540926 - RNA, 22 nt, Human
uccacccgcuccccaggccaga

SEQ ID NO: 540927 - RNA, 22 nt, Human
ugccaccaaccccccacacccc

SEQ ID NO: 540928 - RNA, 18 nt, Human
ugccgucagccacaccgc

SEQ ID NO: 540929 - RNA, 18 nt, Human
uggaaaagcuggaaguga

SEQ ID NO: 540930 - RNA, 21 nt, Human
uggaaaagcuggaagugagcc

SEQ ID NO: 540931 - RNA, 21 nt, Human
uggccaagcuuucuggaaaag

SEQ ID NO: 540932 - RNA, 25 nt, Human
ugggccgaggggcguggccaagcuu

SEQ ID NO: 540933 - RNA, 19 nt, Human
ugggguggugaaggagcca

SEQ ID NO: 540934 - RNA, 20 nt, Human
ugguaggguucuaggggagg

SEQ ID NO: 540935 - RNA, 20 nt, Human
uggugaaggagccaggaauc

SEQ ID NO: 540936 - RNA, 19 nt, Human
uucauagaaaaauaaacaa

SEQ ID NO: 540937 - RNA, 22 nt, Human
uuucuggaaaagcuggaaguga

SEQ ID NO: 540938 - RNA, 21 nt, Human
uuuuccugauuucucuuucuc

SEQ ID NO: 540939 - RNA, 22 nt, Human
acuucacggaggcgaguccgca

SEQ ID NO: 540940 - RNA, 23 nt, Human
agccauuggagaggacauccuga

SEQ ID NO: 540941 - RNA, 24 nt, Human
agccauuggagaggacauccugau

SEQ ID NO: 540942 - RNA, 22 nt, Human
aggcaggggcgguguucccugg

SEQ ID NO: 540943 - RNA, 20 nt, Human
cacugggcccuggggaggag

SEQ ID NO: 540944 - RNA, 20 nt, Human
ccaucgcugccgccgccacu

SEQ ID NO: 540945 - RNA, 24 nt, Human
ccgcagcccgaggccgaucgcucc

SEQ ID NO: 540946 - RNA, 21 nt, Human
ccgcccgcccgcccgcccgcc

SEQ ID NO: 540947 - RNA, 22 nt, Human
ccgccgccgccgcggucuccgg

SEQ ID NO: 540948 - RNA, 19 nt, Human
ccgccgcggucuccggcuc

SEQ ID NO: 540949 - RNA, 21 nt, Human
ccgccugcuugccaucgcugc

SEQ ID NO: 540950 - RNA, 18 nt, Human
ccgcgcuccgccucgcgc

SEQ ID NO: 540951 - RNA, 24 nt, Human
ccucgcgccgcccgcccgcccgcc

SEQ ID NO: 540952 - RNA, 20 nt, Human
ccugcagcugcagcagccgc

SEQ ID NO: 540953 - RNA, 18 nt, Human
ccugccgcgguccgcccu

SEQ ID NO: 540954 - RNA, 24 nt, Human
cgaggccgaucgcucccugccgcg

SEQ ID NO: 540955 - RNA, 19 nt, Human
cgaguccgcacugggcccu

SEQ ID NO: 540956 - RNA, 21 nt, Human
cggcucccgcagcccgaggcc

SEQ ID NO: 540957 - RNA, 20 nt, Human
cugccgccgccacugacacc

SEQ ID NO: 540958 - RNA, 27 nt, Human
cuugccaucgcugccgccgccacugac

SEQ ID NO: 540959 - RNA, 19 nt, Human
gacauacacaugaaaucga

SEQ ID NO: 540960 - RNA, 20 nt, Human
gaggcagagcacaggcaggg

SEQ ID NO: 540961 - RNA, 22 nt, Human
gaucgcucccugccgcgguccg

SEQ ID NO: 540962 - RNA, 19 nt, Human
gccaucgcugccgccgcca

SEQ ID NO: 540963 - RNA, 21 nt, Human
gcccgaggccgaucgcucccu

SEQ ID NO: 540964 - RNA, 21 nt, Human
gcggucuccggcucccgcagc

SEQ ID NO: 540965 - RNA, 21 nt, Human
ggucuccggcucccgcagccc

SEQ ID NO: 540966 - RNA, 20 nt, Human
gugacacuucacggaggcga

SEQ ID NO: 540967 - RNA, 22 nt, Human
uacacaugaaaucgaguauaca

SEQ ID NO: 540968 - RNA, 25 nt, Human
uagcacagccauuggagaggacauc

SEQ ID NO: 540969 - RNA, 25 nt, Human
uauacaguccaugcaguagcacagc

SEQ ID NO: 540970 - RNA, 20 nt, Human
uccaugcaguagcacagcca

SEQ ID NO: 540971 - RNA, 25 nt, Human
uccugcagcugcagcagccgccgcc

SEQ ID NO: 540972 - RNA, 19 nt, Human
ucuccggcucccgcagccc

SEQ ID NO: 540973 - RNA, 24 nt, Human
ucuccggcucccgcagcccgaggc

SEQ ID NO: 540974 - RNA, 24 nt, Human
uggcccgaggcagagcacaggcag

SEQ ID NO: 540975 - RNA, 22 nt, Human
uguuuacugcgacauacacaug

SEQ ID NO: 540976 - RNA, 19 nt, Human
uucacggaggcgaguccgc

SEQ ID NO: 540977 - RNA, 18 nt, Human
uuuuuuuuuuuuuuuuug

SEQ ID NO: 540978 - RNA, 23 nt, Human
uuuuuuuuuuuuuuuuuuugagg

SEQ ID NO: 540979 - RNA, 21 nt, Human
aaguggggggcugaggggggc

SEQ ID NO: 540980 - RNA, 20 nt, Human
agcggccgggggaggagggg

SEQ ID NO: 540981 - RNA, 18 nt, Human
agggucauggacacccgg

SEQ ID NO: 540982 - RNA, 20 nt, Human
cauggacacccggaagucaa

SEQ ID NO: 540983 - RNA, 23 nt, Human
ccagggucauggacacccggaag

SEQ ID NO: 540984 - RNA, 18 nt, Human
ccgggggaggaggggaca

SEQ ID NO: 540985 - RNA, 19 nt, Human
ccucagguaacuaugacuc

SEQ ID NO: 540986 - RNA, 20 nt, Human
ccugcaggguccaggcuguc

SEQ ID NO: 540987 - RNA, 20 nt, Human
cgagagaacugaggacggcg

SEQ ID NO: 540988 - RNA, 21 nt, Human
cgagguggacaacuacaccgc

SEQ ID NO: 540989 - RNA, 18 nt, Human
cgccagggucauggacac

SEQ ID NO: 540990 - RNA, 20 nt, Human
cggaccggaagcagccgcca

SEQ ID NO: 540991 - RNA, 22 nt, Human
cggcagaggagcggccggggga

SEQ ID NO: 540992 - RNA, 21 nt, Human
cggcaucaggacagggggcga

SEQ ID NO: 540993 - RNA, 19 nt, Human
cgggagcggacgggcucgg

SEQ ID NO: 540994 - RNA, 23 nt, Human
cgggggaggaggggacagaugcu

SEQ ID NO: 540995 - RNA, 22 nt, Human
cuggagcggaacuuuggugaug

SEQ ID NO: 540996 - RNA, 19 nt, Human
gagagaacugaggacggcg

SEQ ID NO: 540997 - RNA, 18 nt, Human
gagguggacaacuacacc

SEQ ID NO: 540998 - RNA, 18 nt, Human
ggaaguggggggcugagg

SEQ ID NO: 540999 - RNA, 19 nt, Human
ggaggaggggacagaugcu

SEQ ID NO: 541000 - RNA, 19 nt, Human
gggaaguggggggcugagg

SEQ ID NO: 541001 - RNA, 21 nt, Human
gggacagaugcuuggcggcgg

SEQ ID NO: 541002 - RNA, 20 nt, Human
gggcugaggggggcccgggg

SEQ ID NO: 541003 - RNA, 23 nt, Human
gggcugaggggggcccggggggc

SEQ ID NO: 541004 - RNA, 21 nt, Human
ggggcugaggggggcccgggg

SEQ ID NO: 541005 - RNA, 20 nt, Human
ggguacgggaaguggggggc

SEQ ID NO: 541006 - RNA, 21 nt, Human
uacacagguggguuuggcuuu

SEQ ID NO: 541007 - RNA, 22 nt, Human
uacacagguggguuuggcuuug

SEQ ID NO: 541008 - RNA, 21 nt, Human
uacgggaaguggggggcugag

SEQ ID NO: 541009 - RNA, 21 nt, Human
ucaccgagcucgggagcggac

SEQ ID NO: 541010 - RNA, 22 nt, Human
ugcccucagguaacuaugacuc

SEQ ID NO: 541011 - RNA, 21 nt, Human
uggaucucaguaugaggcagg

SEQ ID NO: 541012 - RNA, 23 nt, Human
uggaucucaguaugaggcagggc

SEQ ID NO: 541013 - RNA, 18 nt, Human
uggcggcggcggccgggc

SEQ ID NO: 541014 - RNA, 19 nt, Human
ugggcaaacggguacggga

SEQ ID NO: 541015 - RNA, 23 nt, Human
uggggggcugaggggggcccggg

SEQ ID NO: 541016 - RNA, 24 nt, Human
uggggggcugaggggggcccgggg

SEQ ID NO: 541017 - RNA, 21 nt, Human
uuggcggcggcggccgggcuu

SEQ ID NO: 541018 - RNA, 19 nt, Human
aaagccggucuccgccucu

SEQ ID NO: 541019 - RNA, 23 nt, Human
aaagcgcccuugccucgcccuug

SEQ ID NO: 541020 - RNA, 22 nt, Human
aaauauacacucaggcagugca

SEQ ID NO: 541021 - RNA, 23 nt, Human
aagaaaagacuggcucauaagaa

SEQ ID NO: 541022 - RNA, 26 nt, Human
aagaauccaaaauauacacucaggca

SEQ ID NO: 541023 - RNA, 21 nt, Human
aagucccgccgaaaccaagga

SEQ ID NO: 541024 - RNA, 21 nt, Human
acagcggcggacgcgcggggg

SEQ ID NO: 541025 - RNA, 22 nt, Human
accugcucggucugaacucggu

SEQ ID NO: 541026 - RNA, 19 nt, Human
acuucguuucccuucucca

SEQ ID NO: 541027 - RNA, 21 nt, Human
aggcaaccucgggaaaccggg

SEQ ID NO: 541028 - RNA, 22 nt, Human
aggcagugcaugcuucuuaggc

SEQ ID NO: 541029 - RNA, 25 nt, Human
caaaaaauaacacacaucuuuucca

SEQ ID NO: 541030 - RNA, 23 nt, Human
caaaaaggacaauaaaggcagug

SEQ ID NO: 541031 - RNA, 19 nt, Human
caagaaaagacuggcucau

SEQ ID NO: 541032 - RNA, 20 nt, Human
cauagacccgaagugccuuu

SEQ ID NO: 541033 - RNA, 24 nt, Human
caucuucguaucaaaaaggacaau

SEQ ID NO: 541034 - RNA, 18 nt, Human
ccaaaauauacacucagg

SEQ ID NO: 541035 - RNA, 20 nt, Human
ccacgcgcgagccugggggg

SEQ ID NO: 541036 - RNA, 23 nt, Human
ccccacuucucuccuuagaacag

SEQ ID NO: 541037 - RNA, 18 nt, Human
ccccagaaguugggcccc

SEQ ID NO: 541038 - RNA, 23 nt, Human
ccggucuccgccucuucccaaag

SEQ ID NO: 541039 - RNA, 20 nt, Human
ccucaggaggagaaccugcu

SEQ ID NO: 541040 - RNA, 23 nt, Human
ccuucuccaggccccagaaguug

SEQ ID NO: 541041 - RNA, 23 nt, Human
cgcccaagccgcaggaccaagac

SEQ ID NO: 541042 - RNA, 19 nt, Human
cgcccuugccucgcccaag

SEQ ID NO: 541043 - RNA, 24 nt, Human
cuccaggccccagaaguugggccc

SEQ ID NO: 541044 - RNA, 20 nt, Human
cuucccaaaggcgccguucu

SEQ ID NO: 541045 - RNA, 21 nt, Human
gaaaagacuggcucauaagaa

SEQ ID NO: 541046 - RNA, 20 nt, Human
gaagugccuuuguacauauu

SEQ ID NO: 541047 - RNA, 24 nt, Human
gaggaccucaggaggagaaccugc

SEQ ID NO: 541048 - RNA, 20 nt, Human
gccccagaaguugggccccg

SEQ ID NO: 541049 - RNA, 21 nt, Human
gcccuugccucgcccuugccu

SEQ ID NO: 541050 - RNA, 20 nt, Human
gccgaaaccaaggaugcccg

SEQ ID NO: 541051 - RNA, 24 nt, Human
guccacgaggccucccuccucuuc

SEQ ID NO: 541052 - RNA, 18 nt, Human
uaaaaaacgaacaucaca

SEQ ID NO: 541053 - RNA, 21 nt, Human
uaaaggcaguguuuguguuuc

SEQ ID NO: 541054 - RNA, 24 nt, Human
uaacaaaacaguaaaaaacucaaa

SEQ ID NO: 541055 - RNA, 22 nt, Human
uacauauuuaccaaaauuuaaa

SEQ ID NO: 541056 - RNA, 21 nt, Human
ucaaaaaggacaauaaaggca

SEQ ID NO: 541057 - RNA, 21 nt, Human
uccaaaauauacacucaggca

SEQ ID NO: 541058 - RNA, 18 nt, Human
ucuccaggccccagaagu

SEQ ID NO: 541059 - RNA, 24 nt, Human
ucugaacucgguuucucagcagca

SEQ ID NO: 541060 - RNA, 19 nt, Human
ucuuaagagcaacugucca

SEQ ID NO: 541061 - RNA, 22 nt, Human
ugccucgcccuugccucgccca

SEQ ID NO: 541062 - RNA, 21 nt, Human
uggcacaauauuccauaaaua

SEQ ID NO: 541063 - RNA, 19 nt, Human
uuaaagccggucuccgccu

SEQ ID NO: 541064 - RNA, 22 nt, Human
uuccauaaauacauuuauauac

SEQ ID NO: 541065 - RNA, 18 nt, Human
aacccgcgcuucuccucc

SEQ ID NO: 541066 - RNA, 18 nt, Human
cagcucgaggcugcacgg

SEQ ID NO: 541067 - RNA, 22 nt, Human
ccaacgccgcugucgcucccug

SEQ ID NO: 541068 - RNA, 18 nt, Human
cccgcucgcauugcucca

SEQ ID NO: 541069 - RNA, 24 nt, Human
ccucugcuucccuuuugggggucu

SEQ ID NO: 541070 - RNA, 23 nt, Human
ccuggggcccgcucgcauugcuc

SEQ ID NO: 541071 - RNA, 18 nt, Human
cgcucccuggggcccgcu

SEQ ID NO: 541072 - RNA, 23 nt, Human
cuccucugcuucccuuuuggggg

SEQ ID NO: 541073 - RNA, 23 nt, Human
cucgcauugcuccaggcccagcu

SEQ ID NO: 541074 - RNA, 23 nt, Human
gacuuucucuccucugcuucccu

SEQ ID NO: 541075 - RNA, 24 nt, Human
gcugcacgggucugauuaaagcag

SEQ ID NO: 541076 - RNA, 18 nt, Human
ggacuuucucuccucugc

SEQ ID NO: 541077 - RNA, 21 nt, Human
uaaagcagugcgcguggagag

SEQ ID NO: 541078 - RNA, 22 nt, Human
ucccuuuugggggucucuaugu

SEQ ID NO: 541079 - RNA, 23 nt, Human
uccucugcuucccuuuugggggu

SEQ ID NO: 541080 - RNA, 18 nt, Human
ucucuauguuuucggccg

SEQ ID NO: 541081 - RNA, 23 nt, Human
ucucuccucugcuucccuuuugg

SEQ ID NO: 541082 - RNA, 21 nt, Human
uucccuuuugggggucucuau

SEQ ID NO: 541083 - RNA, 21 nt, Human
uucggccgcugcgccaacgcc

SEQ ID NO: 541084 - RNA, 21 nt, Human
aacaaaacccaaaaaccaccu

SEQ ID NO: 541085 - RNA, 18 nt, Human
acaaaacccaaaaaccac

SEQ ID NO: 541086 - RNA, 24 nt, Human
acaccugcaccugucuguagcugc

SEQ ID NO: 541087 - RNA, 23 nt, Human
acccuccuaaacaaaacccaaaa

SEQ ID NO: 541088 - RNA, 24 nt, Human
accugcaccugucuguagcugcuc

SEQ ID NO: 541089 - RNA, 22 nt, Human
cacccuccuaaacaaaacccaa

SEQ ID NO: 541090 - RNA, 21 nt, Human
ccacccuccuaaacaaaaccc

SEQ ID NO: 541091 - RNA, 24 nt, Human
ccacccuccuaaacaaaacccaaa

SEQ ID NO: 541092 - RNA, 23 nt, Human
ccagggcgcagagagagcgcugg

SEQ ID NO: 541093 - RNA, 19 nt, Human
cccacccacccuccuaaac

SEQ ID NO: 541094 - RNA, 26 nt, Human
cccacccacccuccuaaacaaaaccc

SEQ ID NO: 541095 - RNA, 22 nt, Human
cccaggccgcgcacccccuccg

SEQ ID NO: 541096 - RNA, 19 nt, Human
ccccacccacccuccuaaa

SEQ ID NO: 541097 - RNA, 21 nt, Human
ccccacccacccuccuaaaca

SEQ ID NO: 541098 - RNA, 22 nt, Human
ccccacccacccuccuaaacaa

SEQ ID NO: 541099 - RNA, 21 nt, Human
ccuuugcucagccuuccccac

SEQ ID NO: 541100 - RNA, 19 nt, Human
cgagaacaccugcaccugu

SEQ ID NO: 541101 - RNA, 19 nt, Human
cgagaacaccugcaccugu

SEQ ID NO: 541102 - RNA, 20 nt, Human
cgagaacaccugcaccuguc

SEQ ID NO: 541103 - RNA, 22 nt, Human
cgcgcacccccuccgagaacac

SEQ ID NO: 541104 - RNA, 22 nt, Human
cuaaacaaaacccaaaaaccac

SEQ ID NO: 541105 - RNA, 24 nt, Human
cuaaacaaaacccaaaaaccaccu

SEQ ID NO: 541106 - RNA, 24 nt, Human
gccuuccccacccacccuccuaaa

SEQ ID NO: 541107 - RNA, 20 nt, Human
gcucccccuuugcucagccu

SEQ ID NO: 541108 - RNA, 18 nt, Human
gcugggcgaagagggguc

SEQ ID NO: 541109 - RNA, 19 nt, Human
ggcugggguuccuguuugg

SEQ ID NO: 541110 - RNA, 20 nt, Human
ucagccuuccccacccaccc

SEQ ID NO: 541111 - RNA, 25 nt, Human
ucagccuuccccacccacccuccua

SEQ ID NO: 541112 - RNA, 24 nt, Human
uccccacccacccuccuaaacaaa

SEQ ID NO: 541113 - RNA, 30 nt, Human
uccccacccacccuccuaaacaaaacccaa

SEQ ID NO: 541114 - RNA, 24 nt, Human
uccuaaacaaaacccaaaaaccac

SEQ ID NO: 541115 - RNA, 18 nt, Human
ugggguuccuguuugggg

SEQ ID NO: 541116 - RNA, 20 nt, Human
ugucuguagcugcucccccu

SEQ ID NO: 541117 - RNA, 21 nt, Human
aaaggcagcagaaggcugaaa

SEQ ID NO: 541118 - RNA, 18 nt, Human
aacacaaccaccaccucu

SEQ ID NO: 541119 - RNA, 22 nt, Human
aaguagccccagcagccaggau

SEQ ID NO: 541120 - RNA, 21 nt, Human
aauugcucuccuuccuccuau

SEQ ID NO: 541121 - RNA, 22 nt, Human
acucugcuggccaggagggcgg

SEQ ID NO: 541122 - RNA, 21 nt, Human
acuggaaucuugaugucugug

SEQ ID NO: 541123 - RNA, 19 nt, Human
agcgcccacuccucagagc

SEQ ID NO: 541124 - RNA, 22 nt, Human
aggcaggaugcugcagaaccug

SEQ ID NO: 541125 - RNA, 18 nt, Human
aucacuauaaaaacauca

SEQ ID NO: 541126 - RNA, 24 nt, Human
aucaguugccaucuaugcuaucaa

SEQ ID NO: 541127 - RNA, 18 nt, Human
caaaggcagcagaaggcu

SEQ ID NO: 541128 - RNA, 23 nt, Human
caaucacuauaaaaacaucaaau

SEQ ID NO: 541129 - RNA, 27 nt, Human
cacaaccaccaccucugggagcugcag

SEQ ID NO: 541130 - RNA, 21 nt, Human
cagaagcaccauucuauuccc

SEQ ID NO: 541131 - RNA, 25 nt, Human
cagcaaggcaggaugcugcagaaag

SEQ ID NO: 541132 - RNA, 19 nt, Human
cagcagaaggcugaaauag

SEQ ID NO: 541133 - RNA, 22 nt, Human
caucagugcuuaugaacagccu

SEQ ID NO: 541134 - RNA, 25 nt, Human
ccagugccccacucugcuggccagg

SEQ ID NO: 541135 - RNA, 19 nt, Human
ccccacucugcuggccagg

SEQ ID NO: 541136 - RNA, 18 nt, Human
ccccagcagccaggaugc

SEQ ID NO: 541137 - RNA, 19 nt, Human
cccccagugccccacucug

SEQ ID NO: 541138 - RNA, 20 nt, Human
ccccuuagaggaggggcaag

SEQ ID NO: 541139 - RNA, 22 nt, Human
ccucagagcccuggcccucccc

SEQ ID NO: 541140 - RNA, 22 nt, Human
ccucugggagcugcagagcaag

SEQ ID NO: 541141 - RNA, 18 nt, Human
ccuggcugcuggcuccag

SEQ ID NO: 541142 - RNA, 26 nt, Human
cucccagcgcccacuccucagagccc

SEQ ID NO: 541143 - RNA, 21 nt, Human
cugcuggcuccagccaccugg

SEQ ID NO: 541144 - RNA, 22 nt, Human
cugcuggcuccagccaccugga

SEQ ID NO: 541145 - RNA, 23 nt, Human
cugcuggcuccagccaccuggau

SEQ ID NO: 541146 - RNA, 21 nt, Human
cuggggcuuguuccaauaaau

SEQ ID NO: 541147 - RNA, 21 nt, Human
cugucaacgacccugguccug

SEQ ID NO: 541148 - RNA, 22 nt, Human
cuucucccagcgcccacuccuc

SEQ ID NO: 541149 - RNA, 21 nt, Human
gacccugguccuggcugcugg

SEQ ID NO: 541150 - RNA, 27 nt, Human
gcaaggcaggaugcugcagaaccugcu

SEQ ID NO: 541151 - RNA, 22 nt, Human
gcccacuccucagagcccuggc

SEQ ID NO: 541152 - RNA, 20 nt, Human
gcuaucaaccuccuuccucc

SEQ ID NO: 541153 - RNA, 21 nt, Human
ggacagagcagcaaggcagga

SEQ ID NO: 541154 - RNA, 22 nt, Human
ggagcuucucccagcgcccacu

SEQ ID NO: 541155 - RNA, 24 nt, Human
uaaaaacaucaaauagucaaacua

SEQ ID NO: 541156 - RNA, 22 nt, Human
uaacacaaccaccaccucuggg

SEQ ID NO: 541157 - RNA, 26 nt, Human
uaacacaaccaccaccucugggagcu

SEQ ID NO: 541158 - RNA, 22 nt, Human
uagaaauugcucuccuuccucc

SEQ ID NO: 541159 - RNA, 19 nt, Human
uaguaaaaccccuuagagg

SEQ ID NO: 541160 - RNA, 19 nt, Human
ucacagaagaaacuguuca

SEQ ID NO: 541161 - RNA, 22 nt, Human
ucacugaaugaagacaagaaaa

SEQ ID NO: 541162 - RNA, 22 nt, Human
uccucacagaagaaacuguuca

SEQ ID NO: 541163 - RNA, 23 nt, Human
uccucacagaagaaacuguucau

SEQ ID NO: 541164 - RNA, 18 nt, Human
uccucagagcccuggccc

SEQ ID NO: 541165 - RNA, 18 nt, Human
ucucccagcgcccacucc

SEQ ID NO: 541166 - RNA, 19 nt, Human
ucucccagcgcccacuccu

SEQ ID NO: 541167 - RNA, 21 nt, Human
ucuccuuccuccuaucuuaaa

SEQ ID NO: 541168 - RNA, 21 nt, Human
ugaagacaagaaaacuguugc

SEQ ID NO: 541169 - RNA, 21 nt, Human
ugcagaaccugcugucaacga

SEQ ID NO: 541170 - RNA, 24 nt, Human
ugcuggccaggagggcgggccugg

SEQ ID NO: 541171 - RNA, 23 nt, Human
ugcuguugccccccagugcccca

SEQ ID NO: 541172 - RNA, 19 nt, Human
uggaggaccaggcaaaggc

SEQ ID NO: 541173 - RNA, 24 nt, Human
uggccaggaagaugugggggacag

SEQ ID NO: 541174 - RNA, 23 nt, Human
ugucaacgacccugguccuggcu

SEQ ID NO: 541175 - RNA, 21 nt, Human
uuagaggaggggcaaggggcu

SEQ ID NO: 541176 - RNA, 21 nt, Human
uuccuccacacucuucuucaa

SEQ ID NO: 541177 - RNA, 23 nt, Human
aaaaagcccgaagcuuguacuac

SEQ ID NO: 541178 - RNA, 19 nt, Human
aaacaaacaaaaaagcccg

SEQ ID NO: 541179 - RNA, 23 nt, Human
aaacaaacaaaaaagcccgaagc

SEQ ID NO: 541180 - RNA, 19 nt, Human
aaacaaacaaacaaacaaa

SEQ ID NO: 541181 - RNA, 23 nt, Human
aaagcuuaaacaaacaaacaaac

SEQ ID NO: 541182 - RNA, 24 nt, Human
aagcuaaugaagcaccugaaagcu

SEQ ID NO: 541183 - RNA, 25 nt, Human
acaaacaaacaaaaaagcccgaagc

SEQ ID NO: 541184 - RNA, 18 nt, Human
acaaacaaacaaacaaac

SEQ ID NO: 541185 - RNA, 18 nt, Human
acaaacaaacaaacaaac

SEQ ID NO: 541186 - RNA, 22 nt, Human
acacuaaauauacagugccagc

SEQ ID NO: 541187 - RNA, 18 nt, Human
agaaucauggaauccugg

SEQ ID NO: 541188 - RNA, 22 nt, Human
agacacaaaaugaaaacaggga

SEQ ID NO: 541189 - RNA, 21 nt, Human
agacagccuccaucucugggg

SEQ ID NO: 541190 - RNA, 22 nt, Human
agcaagacagccuccaucucug

SEQ ID NO: 541191 - RNA, 21 nt, Human
aguaagacacuaaauauacag

SEQ ID NO: 541192 - RNA, 22 nt, Human
caaacaaacaaaaaagcccgaa

SEQ ID NO: 541193 - RNA, 21 nt, Human
caaacaaacaaacaaaaaagc

SEQ ID NO: 541194 - RNA, 25 nt, Human
caagaauauccacugucagccaagg

SEQ ID NO: 541195 - RNA, 20 nt, Human
cagccaaggaaaugcccaca

SEQ ID NO: 541196 - RNA, 22 nt, Human
ccaaaggaacugaaagcuaaug

SEQ ID NO: 541197 - RNA, 24 nt, Human
cccaggacccaagaaggguacaag

SEQ ID NO: 541198 - RNA, 24 nt, Human
gaaaugaacaaguccuuucuguca

SEQ ID NO: 541199 - RNA, 20 nt, Human
gaagcaccugaaagcuuaaa

SEQ ID NO: 541200 - RNA, 22 nt, Human
gaagcaccugaaagcuuaaaca

SEQ ID NO: 541201 - RNA, 18 nt, Human
gauaacagauuuuucacu

SEQ ID NO: 541202 - RNA, 20 nt, Human
gaucccaggacccaagaagg

SEQ ID NO: 541203 - RNA, 18 nt, Human
ggaaaugcccacacuacc

SEQ ID NO: 541204 - RNA, 19 nt, Human
ggaaaugcccacacuacca

SEQ ID NO: 541205 - RNA, 22 nt, Human
gguacaagaauauccacuguca

SEQ ID NO: 541206 - RNA, 22 nt, Human
uacagaaucauggaauccuggg

SEQ ID NO: 541207 - RNA, 22 nt, Human
uagacacaaaaugaaaacacuc

SEQ ID NO: 541208 - RNA, 18 nt, Human
uagcacaacucucucuuu

SEQ ID NO: 541209 - RNA, 22 nt, Human
uagcuauuggauaacagauuuu

SEQ ID NO: 541210 - RNA, 18 nt, Human
ucacacaaaccuagacac

SEQ ID NO: 541211 - RNA, 22 nt, Human
ucccaggacccaagaaggguac

SEQ ID NO: 541212 - RNA, 20 nt, Human
ucccugccauagcaagacag

SEQ ID NO: 541213 - RNA, 20 nt, Human
ugaaaacacucuccuguuuu

SEQ ID NO: 541214 - RNA, 21 nt, Human
ugaaaacacucuccuguuuuc

SEQ ID NO: 541215 - RNA, 19 nt, Human
ugagaagcgaaaugaacaa

SEQ ID NO: 541216 - RNA, 19 nt, Human
ugagaagcgaaaugaacaa

SEQ ID NO: 541217 - RNA, 26 nt, Human
ugcuuacucacacaaaccuagacaca

SEQ ID NO: 541218 - RNA, 23 nt, Human
uggcuuacaacaacaaagguuua

SEQ ID NO: 541219 - RNA, 20 nt, Human
uuauagauacuggucagcuu

SEQ ID NO: 541220 - RNA, 25 nt, Human
aaaaagcccaaaaggcuaccuuugc

SEQ ID NO: 541221 - RNA, 21 nt, Human
aaaaagucauagcagcaacaa

SEQ ID NO: 541222 - RNA, 18 nt, Human
aaaacacagugaaaagac

SEQ ID NO: 541223 - RNA, 21 nt, Human
aaaauaccaggauggaggaag

SEQ ID NO: 541224 - RNA, 18 nt, Human
aaaggagguaaaaaguca

SEQ ID NO: 541225 - RNA, 22 nt, Human
aaccaaauguaccaccacaaga

SEQ ID NO: 541226 - RNA, 24 nt, Human
aaccaaauguaccaccacaagacc

SEQ ID NO: 541227 - RNA, 24 nt, Human
aagcaaauauuguuuuuuuaaaau

SEQ ID NO: 541228 - RNA, 23 nt, Human
aauuaacagugugccuucuuugc

SEQ ID NO: 541229 - RNA, 21 nt, Human
acaaaacacagugaaaagaca

SEQ ID NO: 541230 - RNA, 20 nt, Human
acacagugaaaagacaacuu

SEQ ID NO: 541231 - RNA, 23 nt, Human
acagugccaugucugaucuuuag

SEQ ID NO: 541232 - RNA, 19 nt, Human
acuaaugacagugguuucu

SEQ ID NO: 541233 - RNA, 21 nt, Human
acuacaauuuaauuucacguu

SEQ ID NO: 541234 - RNA, 22 nt, Human
agacaacggauggaucagcuac

SEQ ID NO: 541235 - RNA, 20 nt, Human
agaucagaagaucacuggua

SEQ ID NO: 541236 - RNA, 19 nt, Human
agcagcaacaaugugugug

SEQ ID NO: 541237 - RNA, 20 nt, Human
aggauggaagcuccaaaaaa

SEQ ID NO: 541238 - RNA, 24 nt, Human
agugaaaagacaacuuugugaaga

SEQ ID NO: 541239 - RNA, 22 nt, Human
auggaggaagcagccacgggcg

SEQ ID NO: 541240 - RNA, 18 nt, Human
auucuuagauuuguuucc

SEQ ID NO: 541241 - RNA, 23 nt, Human
caaaaaaccuguagugaauuuua

SEQ ID NO: 541242 - RNA, 22 nt, Human
caaaacacagugaaaagacaac

SEQ ID NO: 541243 - RNA, 23 nt, Human
caaaaggcuaccuuugccuuaac

SEQ ID NO: 541244 - RNA, 22 nt, Human
caaauguaccaccacaagacca

SEQ ID NO: 541245 - RNA, 23 nt, Human
caaggguuuuuuuuucuugacuu

SEQ ID NO: 541246 - RNA, 24 nt, Human
caagucucaaacuuagucuucuug

SEQ ID NO: 541247 - RNA, 25 nt, Human
caauggguuaaccaaauguaccacc

SEQ ID NO: 541248 - RNA, 19 nt, Human
cagaaucaaguugccuucc

SEQ ID NO: 541249 - RNA, 22 nt, Human
cagaaucaaguugccuucccuu

SEQ ID NO: 541250 - RNA, 21 nt, Human
cagcuacagcccuucccacag

SEQ ID NO: 541251 - RNA, 22 nt, Human
cagcuacagcccuucccacaga

SEQ ID NO: 541252 - RNA, 28 nt, Human
ccaaaaaauaccaggauggaggaagcaa

SEQ ID NO: 541253 - RNA, 23 nt, Human
ccaaauguaccaccacaagacca

SEQ ID NO: 541254 - RNA, 18 nt, Human
ccaccggaaacggagcug

SEQ ID NO: 541255 - RNA, 21 nt, Human
ccaggauggaagcuccaaaaa

SEQ ID NO: 541256 - RNA, 19 nt, Human
cccacagaaucaaguugcc

SEQ ID NO: 541257 - RNA, 20 nt, Human
ccuaggcaaccaacuuuugc

SEQ ID NO: 541258 - RNA, 20 nt, Human
ccucuuggggguuugcuccu

SEQ ID NO: 541259 - RNA, 20 nt, Human
ccugccuaaaucagcucccc

SEQ ID NO: 541260 - RNA, 20 nt, Human
ccuucuguaguacaggaauu

SEQ ID NO: 541261 - RNA, 20 nt, Human
cuaaaucagcucccacugcc

SEQ ID NO: 541262 - RNA, 21 nt, Human
cuaaaucagcucccacugcca

SEQ ID NO: 541263 - RNA, 24 nt, Human
cuccaaaaaauaccaggauggagg

SEQ ID NO: 541264 - RNA, 22 nt, Human
cucccagccuccacucaacuac

SEQ ID NO: 541265 - RNA, 24 nt, Human
cucgaguuuuuuuuuuuuuuuuuc

SEQ ID NO: 541266 - RNA, 23 nt, Human
cuuaaaacucccagccuccacuc

SEQ ID NO: 541267 - RNA, 22 nt, Human
gagggggugaaaacugcuuaga

SEQ ID NO: 541268 - RNA, 20 nt, Human
gaguuuuuuuuuuuuuuuuu

SEQ ID NO: 541269 - RNA, 23 nt, Human
gauggaagcuccaaaaaauacca

SEQ ID NO: 541270 - RNA, 23 nt, Human
gcaaaacaucuaauaaaugguca

SEQ ID NO: 541271 - RNA, 19 nt, Human
gcuuaaaacucccagccuc

SEQ ID NO: 541272 - RNA, 20 nt, Human
gggguuugcuccuauuucuu

SEQ ID NO: 541273 - RNA, 18 nt, Human
gugaaaagacaacuuugu

SEQ ID NO: 541274 - RNA, 25 nt, Human
uaaaaagcccaaaaggcuaccuuuu

SEQ ID NO: 541275 - RNA, 24 nt, Human
uaacuacaauuuaauuucacguug

SEQ ID NO: 541276 - RNA, 18 nt, Human
uacaggaaugauucuuag

SEQ ID NO: 541277 - RNA, 19 nt, Human
uacaggaaugauucuuaga

SEQ ID NO: 541278 - RNA, 22 nt, Human
uaccccaccagcuaacacacua

SEQ ID NO: 541279 - RNA, 24 nt, Human
uacuuccuuccucauuuaguuuua

SEQ ID NO: 541280 - RNA, 21 nt, Human
uacuuuaaaccacagcaguua

SEQ ID NO: 541281 - RNA, 18 nt, Human
uaucaaggauagguaaca

SEQ ID NO: 541282 - RNA, 19 nt, Human
uaugcuggucaagucucaa

SEQ ID NO: 541283 - RNA, 22 nt, Human
uauuguaccccaccagcuaaca

SEQ ID NO: 541284 - RNA, 18 nt, Human
ucagcuacagcccuuccc

SEQ ID NO: 541285 - RNA, 21 nt, Human
ucauauucauuaaaaagccca

SEQ ID NO: 541286 - RNA, 23 nt, Human
ucauguuacccagauuguuucuc

SEQ ID NO: 541287 - RNA, 24 nt, Human
ucccauguaacacuaaacagggau

SEQ ID NO: 541288 - RNA, 24 nt, Human
ucccuaggcaaccaacuuuugcuu

SEQ ID NO: 541289 - RNA, 23 nt, Human
ucccuuagcaaccagcaucacuu

SEQ ID NO: 541290 - RNA, 18 nt, Human
uccuaggucucuauacuu

SEQ ID NO: 541291 - RNA, 23 nt, Human
ucuuagauuuguuuccuuuuguu

SEQ ID NO: 541292 - RNA, 22 nt, Human
ugaaaagacaacuuugugaaga

SEQ ID NO: 541293 - RNA, 22 nt, Human
ugacaaaacacagugaaaagaa

SEQ ID NO: 541294 - RNA, 20 nt, Human
ugcuuauccauauucccuuu

SEQ ID NO: 541295 - RNA, 21 nt, Human
uggaagaaccaggauggaagc

SEQ ID NO: 541296 - RNA, 20 nt, Human
uggaggaagcagccacgggc

SEQ ID NO: 541297 - RNA, 23 nt, Human
uggguuaaccaaauguaccacca

SEQ ID NO: 541298 - RNA, 21 nt, Human
uguaccaccacaagaccaccu

SEQ ID NO: 541299 - RNA, 25 nt, Human
uguaccccaccagcuaacacacuaa

SEQ ID NO: 541300 - RNA, 26 nt, Human
uguuuuuuuaaaauagccugagauga

SEQ ID NO: 541301 - RNA, 19 nt, Human
uuugccuuaacccuucugu

SEQ ID NO: 541302 - RNA, 22 nt, Human
uuuuuaaaauagccugagauga

SEQ ID NO: 541303 - RNA, 20 nt, Human
uuuuuuuuuuaagacaaaua

SEQ ID NO: 541304 - RNA, 19 nt, Human
uuuuuuuuuuuuuuuuuaa

SEQ ID NO: 541305 - RNA, 21 nt, Human
aaaagcacagacaauagcaag

SEQ ID NO: 541306 - RNA, 27 nt, Human
aaaagcacagacaauagcuggagaccc

SEQ ID NO: 541307 - RNA, 20 nt, Human
aaaauagcuccuuggccccu

SEQ ID NO: 541308 - RNA, 21 nt, Human
aacagcuugcugguguccuuu

SEQ ID NO: 541309 - RNA, 21 nt, Human
aaccgcuccucauugaacagc

SEQ ID NO: 541310 - RNA, 28 nt, Human
aagaggaaucugagcucuucuuuccagg

SEQ ID NO: 541311 - RNA, 21 nt, Human
acaaggcugaggccacaaggg

SEQ ID NO: 541312 - RNA, 20 nt, Human
accugcugcccaaaggcugg

SEQ ID NO: 541313 - RNA, 23 nt, Human
agaaacauuucgggggguggagg

SEQ ID NO: 541314 - RNA, 23 nt, Human
agagggccaggccugagaaacua

SEQ ID NO: 541315 - RNA, 23 nt, Human
agcaguccauccaucaugguuag

SEQ ID NO: 541316 - RNA, 23 nt, Human
agcuccuuggccccuggccgggg

SEQ ID NO: 541317 - RNA, 23 nt, Human
aggaggcaaggaccgaggagucc

SEQ ID NO: 541318 - RNA, 21 nt, Human
aggaggcugggggcauggggu

SEQ ID NO: 541319 - RNA, 24 nt, Human
aggcugggggaggaaaguggugga

SEQ ID NO: 541320 - RNA, 22 nt, Human
aggggacagacccgcugagaaa

SEQ ID NO: 541321 - RNA, 19 nt, Human
caaaauagcuccuuggccc

SEQ ID NO: 541322 - RNA, 22 nt, Human
cacacagguccucuacaucauc

SEQ ID NO: 541323 - RNA, 20 nt, Human
cacccccggcccugcccacu

SEQ ID NO: 541324 - RNA, 21 nt, Human
cacggcccaaguugaagcaga

SEQ ID NO: 541325 - RNA, 22 nt, Human
cagcauagacagagaagcccuc

SEQ ID NO: 541326 - RNA, 25 nt, Human
caggaacaggcucuccgacucaggc

SEQ ID NO: 541327 - RNA, 26 nt, Human
cagguacugcacuugacccccugaag

SEQ ID NO: 541328 - RNA, 25 nt, Human
cagguggccacuggcgugugaugcc

SEQ ID NO: 541329 - RNA, 20 nt, Human
cauuguacuuggcagugggu

SEQ ID NO: 541330 - RNA, 18 nt, Human
cauuucgggggguggagg

SEQ ID NO: 541331 - RNA, 22 nt, Human
ccagcagcgagauggucucggu

SEQ ID NO: 541332 - RNA, 19 nt, Human
ccagguacugcacuugacc

SEQ ID NO: 541333 - RNA, 21 nt, Human
cccaaaauagcuccuuggccc

SEQ ID NO: 541334 - RNA, 24 nt, Human
cccaaguugaagcagaccgggguc

SEQ ID NO: 541335 - RNA, 22 nt, Human
ccccaaaauagcuccuuggccc

SEQ ID NO: 541336 - RNA, 23 nt, Human
cccccaaauuuugugcagguggg

SEQ ID NO: 541337 - RNA, 23 nt, Human
cccccggcccugcccacucaacu

SEQ ID NO: 541338 - RNA, 18 nt, Human
cccggcccugcccacuca

SEQ ID NO: 541339 - RNA, 18 nt, Human
cccucagagccugaacag

SEQ ID NO: 541340 - RNA, 24 nt, Human
cccugggcaaacgagaccccaaaa

SEQ ID NO: 541341 - RNA, 20 nt, Human
ccuagaaccacagaguacac

SEQ ID NO: 541342 - RNA, 19 nt, Human
ccucccugggcaaacgaga

SEQ ID NO: 541343 - RNA, 23 nt, Human
ccucgcccugcuucagcaggcug

SEQ ID NO: 541344 - RNA, 22 nt, Human
ccugcccacucaacugaggggc

SEQ ID NO: 541345 - RNA, 20 nt, Human
ccugcgggacagggaggaac

SEQ ID NO: 541346 - RNA, 25 nt, Human
cgacucaggcagccacuucagauau

SEQ ID NO: 541347 - RNA, 25 nt, Human
cgcccguguccgggccagucugggg

SEQ ID NO: 541348 - RNA, 20 nt, Human
cgguggcagcagugaacugg

SEQ ID NO: 541349 - RNA, 22 nt, Human
cguuguacagguacagguggcc

SEQ ID NO: 541350 - RNA, 20 nt, Human
cuccccaggagugaccaguc

SEQ ID NO: 541351 - RNA, 21 nt, Human
cucccugcggcuccgagagcc

SEQ ID NO: 541352 - RNA, 18 nt, Human
cugcagaccuggggcucu

SEQ ID NO: 541353 - RNA, 24 nt, Human
cugggcugggagcaggccugcacu

SEQ ID NO: 541354 - RNA, 21 nt, Human
gaaauagagcucacggcccaa

SEQ ID NO: 541355 - RNA, 23 nt, Human
gaagacacacucccugcggcucc

SEQ ID NO: 541356 - RNA, 19 nt, Human
gagaaggcgaacucguuga

SEQ ID NO: 541357 - RNA, 19 nt, Human
gagccacauuccugcccag

SEQ ID NO: 541358 - RNA, 18 nt, Human
gagguggggaaggggugg

SEQ ID NO: 541359 - RNA, 20 nt, Human
gcagcuggggugggggccgg

SEQ ID NO: 541360 - RNA, 23 nt, Human
gcaggaugcucuucuccccaaga

SEQ ID NO: 541361 - RNA, 26 nt, Human
gccgggcgagggcuggaugcuggagc

SEQ ID NO: 541362 - RNA, 18 nt, Human
gccugggccuugagaggg

SEQ ID NO: 541363 - RNA, 21 nt, Human
gcgcugggcugggagcaggcc

SEQ ID NO: 541364 - RNA, 21 nt, Human
gcugggggaggaaaguggugg

SEQ ID NO: 541365 - RNA, 18 nt, Human
gcuucagcaggcuguacu

SEQ ID NO: 541366 - RNA, 19 nt, Human
ggaaagcggacugccuaga

SEQ ID NO: 541367 - RNA, 23 nt, Human
ggagucccagcugggcagggccg

SEQ ID NO: 541368 - RNA, 21 nt, Human
ggcagcauagacagagaagcc

SEQ ID NO: 541369 - RNA, 18 nt, Human
ggcaugggguuggggggg

SEQ ID NO: 541370 - RNA, 20 nt, Human
ggccccuggccggggagccc

SEQ ID NO: 541371 - RNA, 18 nt, Human
ggccgaggcgcaggggug

SEQ ID NO: 541372 - RNA, 20 nt, Human
ggccuggggugccugggccu

SEQ ID NO: 541373 - RNA, 19 nt, Human
ggcuaggaggcugggggca

SEQ ID NO: 541374 - RNA, 23 nt, Human
ggcucccacgacgacagcagccu

SEQ ID NO: 541375 - RNA, 22 nt, Human
gggccuugagagggccaggccu

SEQ ID NO: 541376 - RNA, 24 nt, Human
ggggcggggagucucuccccagga

SEQ ID NO: 541377 - RNA, 20 nt, Human
gggggcaugggguugggggg

SEQ ID NO: 541378 - RNA, 20 nt, Human
gggggcccccaaauuuugug

SEQ ID NO: 541379 - RNA, 18 nt, Human
ggggguggaggguggcgc

SEQ ID NO: 541380 - RNA, 18 nt, Human
ggggugccugggccuuga

SEQ ID NO: 541381 - RNA, 22 nt, Human
ggggugggaggcgcugggcugg

SEQ ID NO: 541382 - RNA, 18 nt, Human
ggguggaggguggcgcgg

SEQ ID NO: 541383 - RNA, 24 nt, Human
ggguuauggcuaggaggcuggggg

SEQ ID NO: 541384 - RNA, 21 nt, Human
ggguugggggggcccgauauc

SEQ ID NO: 541385 - RNA, 20 nt, Human
gguccugggcaguucugauu

SEQ ID NO: 541386 - RNA, 22 nt, Human
ggugcccuuguagauccgcuug

SEQ ID NO: 541387 - RNA, 19 nt, Human
ggugggcugggugcccuug

SEQ ID NO: 541388 - RNA, 21 nt, Human
ggugggggacaaggcugaggc

SEQ ID NO: 541389 - RNA, 22 nt, Human
gguggugaggacaggaccagga

SEQ ID NO: 541390 - RNA, 21 nt, Human
gucuggggggcccccaaauuu

SEQ ID NO: 541391 - RNA, 18 nt, Human
gugggaggcgcugggcug

SEQ ID NO: 541392 - RNA, 19 nt, Human
gugggugggggacaaggcu

SEQ ID NO: 541393 - RNA, 18 nt, Human
uaaaaaacaccgaggacu

SEQ ID NO: 541394 - RNA, 22 nt, Human
uacagguacagguggccacugg

SEQ ID NO: 541395 - RNA, 19 nt, Human
uacaucgcccguguccggg

SEQ ID NO: 541396 - RNA, 20 nt, Human
uacuggggcggggccgaggc

SEQ ID NO: 541397 - RNA, 18 nt, Human
uagaaccacagaguacac

SEQ ID NO: 541398 - RNA, 20 nt, Human
uagcuccuuggccccuggcc

SEQ ID NO: 541399 - RNA, 18 nt, Human
uaggaggcugggggcaug

SEQ ID NO: 541400 - RNA, 21 nt, Human
uaggaggcugggggcaugggg

SEQ ID NO: 541401 - RNA, 25 nt, Human
uaggaggcugggggcaugggguugg

SEQ ID NO: 541402 - RNA, 21 nt, Human
uauggcuaggaggcugggggc

SEQ ID NO: 541403 - RNA, 26 nt, Human
ucagaggaagaggucauuguacuugg

SEQ ID NO: 541404 - RNA, 18 nt, Human
ucagcaggcuguacuggg

SEQ ID NO: 541405 - RNA, 23 nt, Human
uccccaggagugaccagucacau

SEQ ID NO: 541406 - RNA, 22 nt, Human
ucccugggcaaacgagacccca

SEQ ID NO: 541407 - RNA, 23 nt, Human
ucccugggcaaacgagaccccaa

SEQ ID NO: 541408 - RNA, 21 nt, Human
ucccugggcuccggcuuuucc

SEQ ID NO: 541409 - RNA, 21 nt, Human
ucccugggcuccggcuuuucc

SEQ ID NO: 541410 - RNA, 18 nt, Human
ucgcagguccguucccuc

SEQ ID NO: 541411 - RNA, 20 nt, Human
ucgguggcagcagugaacug

SEQ ID NO: 541412 - RNA, 24 nt, Human
ucgguggcagcagugaacugguug

SEQ ID NO: 541413 - RNA, 21 nt, Human
ucuccccaagaggguccugcu

SEQ ID NO: 541414 - RNA, 18 nt, Human
ugacccgcugagaagccc

SEQ ID NO: 541415 - RNA, 22 nt, Human
ugaccugcugcccaaaggcugg

SEQ ID NO: 541416 - RNA, 25 nt, Human
ugacucgcagguccguucccucccu

SEQ ID NO: 541417 - RNA, 18 nt, Human
ugaggccacaagggcuau

SEQ ID NO: 541418 - RNA, 26 nt, Human
ugaucugugaggucagcagggagggu

SEQ ID NO: 541419 - RNA, 22 nt, Human
ugcccaggcugggauuagaaac

SEQ ID NO: 541420 - RNA, 24 nt, Human
ugcccaggcugggauuagaaacag

SEQ ID NO: 541421 - RNA, 20 nt, Human
ugccuagaaccacagaguac

SEQ ID NO: 541422 - RNA, 22 nt, Human
ugcuggggacagggaugagggu

SEQ ID NO: 541423 - RNA, 19 nt, Human
uggaccacccccggcccug

SEQ ID NO: 541424 - RNA, 21 nt, Human
uggcgcgggaagacacacucc

SEQ ID NO: 541425 - RNA, 27 nt, Human
ugggagcaggccugcacuccuccucug

SEQ ID NO: 541426 - RNA, 23 nt, Human
ugggauuagaaacagaaacauuu

SEQ ID NO: 541427 - RNA, 18 nt, Human
ugggggaggaaaguggug

SEQ ID NO: 541428 - RNA, 18 nt, Human
uggggugggggccgggcg

SEQ ID NO: 541429 - RNA, 20 nt, Human
uggggugggggccgggcgag

SEQ ID NO: 541430 - RNA, 24 nt, Human
uggggugggggccgggcgagggcu

SEQ ID NO: 541431 - RNA, 25 nt, Human
uggggugggggccgggcgagggcug

SEQ ID NO: 541432 - RNA, 24 nt, Human
ugggugcccuuguagauccgcuug

SEQ ID NO: 541433 - RNA, 25 nt, Human
ugggugcccuuguagauccgcuugu

SEQ ID NO: 541434 - RNA, 22 nt, Human
uuacaucgcccguguccgggcc

SEQ ID NO: 541435 - RNA, 24 nt, Human
uucagcaggcuguacuggggcggg

SEQ ID NO: 541436 - RNA, 24 nt, Human
uuguagauccgcuugucaauuggc

SEQ ID NO: 541437 - RNA, 23 nt, Human
ccaccaccucuugucccugcccc

SEQ ID NO: 541438 - RNA, 21 nt, Human
cucuugucccugccccaggga

SEQ ID NO: 541439 - RNA, 19 nt, Human
ucugcagccacguccaggg

SEQ ID NO: 541440 - RNA, 21 nt, Human
uugucccugccccagggacac

SEQ ID NO: 541441 - RNA, 18 nt, Human
acaaacaaaaaaaaaggu

SEQ ID NO: 541442 - RNA, 24 nt, Human
agccagccaacaagaaauaggaac

SEQ ID NO: 541443 - RNA, 19 nt, Human
aggcagggccccgggacuu

SEQ ID NO: 541444 - RNA, 24 nt, Human
caacaagaaauaggaacaaggaaa

SEQ ID NO: 541445 - RNA, 21 nt, Human
caagaaauaggaacaaggaaa

SEQ ID NO: 541446 - RNA, 22 nt, Human
ccccuaggacgauggaggcagg

SEQ ID NO: 541447 - RNA, 22 nt, Human
cgcggaaccccuaggacgaugg

SEQ ID NO: 541448 - RNA, 21 nt, Human
cucagccagccaacaagaaau

SEQ ID NO: 541449 - RNA, 25 nt, Human
gacgauggaggcagggccccgggaa

SEQ ID NO: 541450 - RNA, 21 nt, Human
ggaggcagggccccgggacuu

SEQ ID NO: 541451 - RNA, 21 nt, Human
uaaguaaauucauaauuauaa

SEQ ID NO: 541452 - RNA, 21 nt, Human
ugcuccugcccgcggaacccc

SEQ ID NO: 541453 - RNA, 18 nt, Human
ugcuucuggguugcuccu

SEQ ID NO: 541454 - RNA, 24 nt, Human
ugcuucuggguugcuccugcccgc

SEQ ID NO: 541455 - RNA, 18 nt, Human
uguuuucuuuagucuuua

SEQ ID NO: 541456 - RNA, 19 nt, Human
augaagggucaauuuucag

SEQ ID NO: 541457 - RNA, 20 nt, Human
cacacacaucacugaguccc

SEQ ID NO: 541458 - RNA, 18 nt, Human
cacaggcugucuaugugg

SEQ ID NO: 541459 - RNA, 24 nt, Human
ccugucucucuuuuaauguuuccu

SEQ ID NO: 541460 - RNA, 19 nt, Human
cuuucccuugccucucuaa

SEQ ID NO: 541461 - RNA, 22 nt, Human
gccaagauuuucugcuagaauu

SEQ ID NO: 541462 - RNA, 19 nt, Human
gccccuuuaguugcuccag

SEQ ID NO: 541463 - RNA, 22 nt, Human
gcccugagcagauggaaaugaa

SEQ ID NO: 541464 - RNA, 20 nt, Human
uaucuggaggaccuccggga

SEQ ID NO: 541465 - RNA, 21 nt, Human
ugcuagaauuucaaauauaua

SEQ ID NO: 541466 - RNA, 22 nt, Human
uguccaggccaagauuuucugc

SEQ ID NO: 541467 - RNA, 18 nt, Human
aaaacaaaaacaagagca

SEQ ID NO: 541468 - RNA, 22 nt, Human
aaaacaagagcaaguagugagc

SEQ ID NO: 541469 - RNA, 21 nt, Human
aaacaagagcaaguagugaag

SEQ ID NO: 541470 - RNA, 23 nt, Human
acugccggugcgggcugaggcgg

SEQ ID NO: 541471 - RNA, 22 nt, Human
gagcgggaaggagcgccgagcu

SEQ ID NO: 541472 - RNA, 18 nt, Human
gagcugugcgcagccggg

SEQ ID NO: 541473 - RNA, 24 nt, Human
ugaggcggugugugagggagcggg

SEQ ID NO: 541474 - RNA, 18 nt, Human
ugcgcagccgggguaguu

SEQ ID NO: 541475 - RNA, 22 nt, Human
uuauuaaaacaaaaacaagagc

SEQ ID NO: 541476 - RNA, 24 nt, Human
aaaaaaacuuuacaaccacagcua

SEQ ID NO: 541477 - RNA, 24 nt, Human
aaaaaacuuuacaaccacagcuaa

SEQ ID NO: 541478 - RNA, 22 nt, Human
aaaaaagaaaaaaaaaacaaaa

SEQ ID NO: 541479 - RNA, 18 nt, Human
aaaaagaaaaaagaaaaa

SEQ ID NO: 541480 - RNA, 22 nt, Human
aaaacaaaaccaaaaacaaaaa

SEQ ID NO: 541481 - RNA, 24 nt, Human
aaaagaaaaaaaaaacaaaaccaa

SEQ ID NO: 541482 - RNA, 23 nt, Human
aaacaaaaccaaaaacaaaaaaa

SEQ ID NO: 541483 - RNA, 20 nt, Human
aaacaaaaccaaaaacaaag

SEQ ID NO: 541484 - RNA, 21 nt, Human
aaaguuauacauagaccaaca

SEQ ID NO: 541485 - RNA, 22 nt, Human
aaaugaagauguaaagcuuugu

SEQ ID NO: 541486 - RNA, 19 nt, Human
aaauuguacaaacuuuaca

SEQ ID NO: 541487 - RNA, 25 nt, Human
aaccaaaaacaaaaaaacuuuacaa

SEQ ID NO: 541488 - RNA, 27 nt, Human
aagaaaaaagaaaaaaaaaacaaaacc

SEQ ID NO: 541489 - RNA, 19 nt, Human
acaaagcuucaggacaaau

SEQ ID NO: 541490 - RNA, 24 nt, Human
agaaaaaaaaaacaaaaccaaaaa

SEQ ID NO: 541491 - RNA, 21 nt, Human
agcuuugugguuaguuuaaau

SEQ ID NO: 541492 - RNA, 18 nt, Human
aguuauacauagaccaac

SEQ ID NO: 541493 - RNA, 21 nt, Human
augcaggugcagccaaacaca

SEQ ID NO: 541494 - RNA, 26 nt, Human
caaaaaaacuuuacaaccacagcuaa

SEQ ID NO: 541495 - RNA, 22 nt, Human
caaaaacaaaaaaacuuuacaa

SEQ ID NO: 541496 - RNA, 26 nt, Human
caaaaacaaaaaaacuuuacaaccac

SEQ ID NO: 541497 - RNA, 19 nt, Human
caaaaccaaaaacaaaaaa

SEQ ID NO: 541498 - RNA, 28 nt, Human
caaaaccaaaaacaaaaaaacuuuacaa

SEQ ID NO: 541499 - RNA, 22 nt, Human
caaaacugauaaaaaucaagca

SEQ ID NO: 541500 - RNA, 21 nt, Human
cagaugucccucaguucaucu

SEQ ID NO: 541501 - RNA, 19 nt, Human
cagcuggauugcugagaac

SEQ ID NO: 541502 - RNA, 24 nt, Human
caggcaaauguggaaagaaaaucc

SEQ ID NO: 541503 - RNA, 22 nt, Human
cauagaccaacagaugucccuc

SEQ ID NO: 541504 - RNA, 18 nt, Human
cauugugugcaaagccca

SEQ ID NO: 541505 - RNA, 21 nt, Human
ccaaaaacaaaaaaacuuuac

SEQ ID NO: 541506 - RNA, 23 nt, Human
ccaaaaacaaaaaaacuuuacaa

SEQ ID NO: 541507 - RNA, 20 nt, Human
cuggauugauaagacacucc

SEQ ID NO: 541508 - RNA, 22 nt, Human
gaaaaaaaaaacaaaaccaaaa

SEQ ID NO: 541509 - RNA, 18 nt, Human
gaaagggagucuuguuuc

SEQ ID NO: 541510 - RNA, 21 nt, Human
gcaaauguggaaagaaaaucc

SEQ ID NO: 541511 - RNA, 20 nt, Human
ggacaaauuguacaaacuuu

SEQ ID NO: 541512 - RNA, 20 nt, Human
ggccgggcagugcucgggga

SEQ ID NO: 541513 - RNA, 19 nt, Human
uaaaaaaaaaaaaaaagaa

SEQ ID NO: 541514 - RNA, 22 nt, Human
uaaaaaucaagcacagauacca

SEQ ID NO: 541515 - RNA, 22 nt, Human
uacauagaccaacagauguccc

SEQ ID NO: 541516 - RNA, 21 nt, Human
uaguuuaaauuauacacucug

SEQ ID NO: 541517 - RNA, 22 nt, Human
uaucgaguuucagaaaccuuuc

SEQ ID NO: 541518 - RNA, 21 nt, Human
ucaagcacagauaccaggauu

SEQ ID NO: 541519 - RNA, 24 nt, Human
ucacaagaugguaaaaaaaaaaaa

SEQ ID NO: 541520 - RNA, 22 nt, Human
ucccagucagcuccaaacccau

SEQ ID NO: 541521 - RNA, 20 nt, Human
uggaacagucaaaaugaaga

SEQ ID NO: 541522 - RNA, 24 nt, Human
uggaacagucaaaaugaagaugua

SEQ ID NO: 541523 - RNA, 21 nt, Human
uguggaaagaaaauccaccug

SEQ ID NO: 541524 - RNA, 20 nt, Human
ugugugcaaagcccauuuuu

SEQ ID NO: 541525 - RNA, 18 nt, Human
uucaagugcuuuauucug

SEQ ID NO: 541526 - RNA, 24 nt, Human
uuuaaaauaugaaacauaaaaauc

SEQ ID NO: 541527 - RNA, 19 nt, Human
aaaaaggaaacuguugaga

SEQ ID NO: 541528 - RNA, 22 nt, Human
aacaguguaagugggagaacca

SEQ ID NO: 541529 - RNA, 18 nt, Human
aaccaucucccucugccu

SEQ ID NO: 541530 - RNA, 20 nt, Human
aagucuggccagcacagugc

SEQ ID NO: 541531 - RNA, 18 nt, Human
acaggacucaauagucag

SEQ ID NO: 541532 - RNA, 21 nt, Human
accacccacacggucagagca

SEQ ID NO: 541533 - RNA, 22 nt, Human
accagcagaggcuggggaaugg

SEQ ID NO: 541534 - RNA, 18 nt, Human
agaaccaagccccugacu

SEQ ID NO: 541535 - RNA, 20 nt, Human
agcagagcagcugaugccuc

SEQ ID NO: 541536 - RNA, 21 nt, Human
aggcagcugaagucuggccag

SEQ ID NO: 541537 - RNA, 26 nt, Human
aggggaggacggugcugguggggccu

SEQ ID NO: 541538 - RNA, 21 nt, Human
agugcugcaaugggcuguggc

SEQ ID NO: 541539 - RNA, 19 nt, Human
auaaaggaaaacaaaaagg

SEQ ID NO: 541540 - RNA, 20 nt, Human
auaaaggaaaacaaaaagga

SEQ ID NO: 541541 - RNA, 22 nt, Human
aucacuucguaacuugaugcag

SEQ ID NO: 541542 - RNA, 25 nt, Human
caacauuuacaaaggaaaaaacaau

SEQ ID NO: 541543 - RNA, 20 nt, Human
caagccccugacuagcaaca

SEQ ID NO: 541544 - RNA, 22 nt, Human
caaggcagcugaagucuggcca

SEQ ID NO: 541545 - RNA, 23 nt, Human
caauuccaaauuagaguuuuagc

SEQ ID NO: 541546 - RNA, 20 nt, Human
cagcagaagggcaggagccc

SEQ ID NO: 541547 - RNA, 21 nt, Human
cagccucuggggcugcauccu

SEQ ID NO: 541548 - RNA, 22 nt, Human
caggagcccuccaugccuggcc

SEQ ID NO: 541549 - RNA, 22 nt, Human
caggugcccuggcccuuggagg

SEQ ID NO: 541550 - RNA, 21 nt, Human
caguucccaaggcagcugaag

SEQ ID NO: 541551 - RNA, 20 nt, Human
caucucccucugccugagcc

SEQ ID NO: 541552 - RNA, 20 nt, Human
cauggaaacugcgacaugcu

SEQ ID NO: 541553 - RNA, 19 nt, Human
cauucuggaaccucccgga

SEQ ID NO: 541554 - RNA, 24 nt, Human
ccagaggcucugcgggugggagcu

SEQ ID NO: 541555 - RNA, 23 nt, Human
ccaguggaucuuuuuccucggcu

SEQ ID NO: 541556 - RNA, 22 nt, Human
ccaucccggauggggugggagc

SEQ ID NO: 541557 - RNA, 23 nt, Human
ccaugccuggcuuacaacaacag

SEQ ID NO: 541558 - RNA, 21 nt, Human
cccagggacucucugggccuc

SEQ ID NO: 541559 - RNA, 23 nt, Human
ccccagggacucucugggccucu

SEQ ID NO: 541560 - RNA, 25 nt, Human
cccccagggacucucugggccucua

SEQ ID NO: 541561 - RNA, 19 nt, Human
cccuuggaggggcugcugc

SEQ ID NO: 541562 - RNA, 19 nt, Human
ccucuacgugccucccagg

SEQ ID NO: 541563 - RNA, 18 nt, Human
ccucugccugagccaggg

SEQ ID NO: 541564 - RNA, 19 nt, Human
cuagcaacaguggcagggc

SEQ ID NO: 541565 - RNA, 19 nt, Human
cucauucuggaaccucccg

SEQ ID NO: 541566 - RNA, 22 nt, Human
cucccaggcaccgacugugcag

SEQ ID NO: 541567 - RNA, 24 nt, Human
cucccaggcaccgacugugcagcu

SEQ ID NO: 541568 - RNA, 28 nt, Human
cugcugcuucccggccuaguuuccagug

SEQ ID NO: 541569 - RNA, 18 nt, Human
cuggaauccucccgucuc

SEQ ID NO: 541570 - RNA, 19 nt, Human
cuucaacugcuuagccugu

SEQ ID NO: 541571 - RNA, 24 nt, Human
gagccaggggccgucaccuaccaa

SEQ ID NO: 541572 - RNA, 19 nt, Human
gagucuaaccaucucccuc

SEQ ID NO: 541573 - RNA, 22 nt, Human
gaucaccacccacacggucaga

SEQ ID NO: 541574 - RNA, 20 nt, Human
gcaacaguggcagggcuuca

SEQ ID NO: 541575 - RNA, 24 nt, Human
gccaaggccguccagaggcucugc

SEQ ID NO: 541576 - RNA, 22 nt, Human
gcccgaagauccugaaacacau

SEQ ID NO: 541577 - RNA, 23 nt, Human
gcccuuggaggggcugcugcuuc

SEQ ID NO: 541578 - RNA, 21 nt, Human
ggagcccuccaugccuggcuu

SEQ ID NO: 541579 - RNA, 21 nt, Human
ggcuucaguucccaaggcagc

SEQ ID NO: 541580 - RNA, 18 nt, Human
gggaauggggguucugcu

SEQ ID NO: 541581 - RNA, 18 nt, Human
gugcagcugcuugguacc

SEQ ID NO: 541582 - RNA, 21 nt, Human
guggaucuuuuuccucggcug

SEQ ID NO: 541583 - RNA, 22 nt, Human
uaaaggaaaacaaaaaggaaac

SEQ ID NO: 541584 - RNA, 20 nt, Human
uaaggcuucauuucuaagcu

SEQ ID NO: 541585 - RNA, 22 nt, Human
uagcaacaguggcagggcuuca

SEQ ID NO: 541586 - RNA, 22 nt, Human
uagcacugaauaauuuaaacac

SEQ ID NO: 541587 - RNA, 24 nt, Human
uauucaauuccaaauuagaguuuu

SEQ ID NO: 541588 - RNA, 19 nt, Human
ucacugaaugguggggaac

SEQ ID NO: 541589 - RNA, 23 nt, Human
uccacaauauucaauuccaaauu

SEQ ID NO: 541590 - RNA, 21 nt, Human
ucccaugauuuugcuguugcc

SEQ ID NO: 541591 - RNA, 21 nt, Human
uccuacugcccgggcugucca

SEQ ID NO: 541592 - RNA, 19 nt, Human
ucucccaggugcccuggcc

SEQ ID NO: 541593 - RNA, 23 nt, Human
ucucugggccucuacgugccucc

SEQ ID NO: 541594 - RNA, 23 nt, Human
ucuggggcugcauccuacugccc

SEQ ID NO: 541595 - RNA, 21 nt, Human
ugaaacacauggaaacugcga

SEQ ID NO: 541596 - RNA, 21 nt, Human
ugcuaccagcagaggcugggg

SEQ ID NO: 541597 - RNA, 22 nt, Human
uggaaacugcgacaugcuacca

SEQ ID NO: 541598 - RNA, 21 nt, Human
uggaggggcugcugcuucccg

SEQ ID NO: 541599 - RNA, 19 nt, Human
uggcucagcagaagggcag

SEQ ID NO: 541600 - RNA, 19 nt, Human
uggcuuacaacaacaggac

SEQ ID NO: 541601 - RNA, 22 nt, Human
ugggccucuacgugccucccag

SEQ ID NO: 541602 - RNA, 19 nt, Human
uggggugggagcaaggacu

SEQ ID NO: 541603 - RNA, 18 nt, Human
ugguaccccgggaauaaa

SEQ ID NO: 541604 - RNA, 22 nt, Human
uguaagugggagaaccaagccc

SEQ ID NO: 541605 - RNA, 21 nt, Human
uguggcucagcagaagggcag

SEQ ID NO: 541606 - RNA, 21 nt, Human
uuuaaacacacuucagaaaau

SEQ ID NO: 541607 - RNA, 20 nt, Human
aaagaggucccgcuucccuu

SEQ ID NO: 541608 - RNA, 24 nt, Human
aaagggaacaugcagccacaaaca

SEQ ID NO: 541609 - RNA, 22 nt, Human
aaaguaauagagguauucugcc

SEQ ID NO: 541610 - RNA, 18 nt, Human
aacccaaaccaaggccag

SEQ ID NO: 541611 - RNA, 21 nt, Human
aaccucaugcaggcacaaggc

SEQ ID NO: 541612 - RNA, 27 nt, Human
aagaauaagggagagaagccgguaccc

SEQ ID NO: 541613 - RNA, 24 nt, Human
aagaggcugucugugaucucaagg

SEQ ID NO: 541614 - RNA, 19 nt, Human
aagcuggggcugccugagc

SEQ ID NO: 541615 - RNA, 24 nt, Human
aaggugcuguauuugggggaaucu

SEQ ID NO: 541616 - RNA, 22 nt, Human
aaguaaaccucagcaagaacac

SEQ ID NO: 541617 - RNA, 19 nt, Human
acacagcacucccugcccc

SEQ ID NO: 541618 - RNA, 21 nt, Human
acacagcacucccugccccgg

SEQ ID NO: 541619 - RNA, 23 nt, Human
acacgauaagaauaagggagaga

SEQ ID NO: 541620 - RNA, 20 nt, Human
acauggaauggaaauaaggc

SEQ ID NO: 541621 - RNA, 24 nt, Human
acccaaaccaaggccagguaagac

SEQ ID NO: 541622 - RNA, 22 nt, Human
acuccgaaagauucuagaggaa

SEQ ID NO: 541623 - RNA, 21 nt, Human
acuuuaaaagagagagagaga

SEQ ID NO: 541624 - RNA, 24 nt, Human
agccacaaacacuuacacaagccc

SEQ ID NO: 541625 - RNA, 19 nt, Human
agcuaaaauggaaaaaggc

SEQ ID NO: 541626 - RNA, 18 nt, Human
aggaagacacuccgaaag

SEQ ID NO: 541627 - RNA, 26 nt, Human
aggaagucgagaccagcuaggauacc

SEQ ID NO: 541628 - RNA, 22 nt, Human
aggcagggagggguggcuagga

SEQ ID NO: 541629 - RNA, 19 nt, Human
agucagcuugcacacucaa

SEQ ID NO: 541630 - RNA, 18 nt, Human
auagagguauucugcccc

SEQ ID NO: 541631 - RNA, 19 nt, Human
auagagguauucugccccc

SEQ ID NO: 541632 - RNA, 20 nt, Human
augcagcacauggggaaaug

SEQ ID NO: 541633 - RNA, 27 nt, Human
augcagccacaaacacuuacacaagcc

SEQ ID NO: 541634 - RNA, 20 nt, Human
augccacaccaccagcauag

SEQ ID NO: 541635 - RNA, 19 nt, Human
auggaauggaaauaaggcc

SEQ ID NO: 541636 - RNA, 24 nt, Human
caaaaugaauagcaggagaaggug

SEQ ID NO: 541637 - RNA, 20 nt, Human
caaaccaaggccagguaaga

SEQ ID NO: 541638 - RNA, 21 nt, Human
cacaaacacuuacacaagccc

SEQ ID NO: 541639 - RNA, 20 nt, Human
cacaggguuuaggcauguuu

SEQ ID NO: 541640 - RNA, 19 nt, Human
caccagacaggaagucgag

SEQ ID NO: 541641 - RNA, 18 nt, Human
caccagcauagggucacc

SEQ ID NO: 541642 - RNA, 23 nt, Human
cauuaccacuggcucaccuccuc

SEQ ID NO: 541643 - RNA, 18 nt, Human
ccacuggcucaccuccuc

SEQ ID NO: 541644 - RNA, 19 nt, Human
ccacuucccggggcacagg

SEQ ID NO: 541645 - RNA, 18 nt, Human
ccagacaggaagucgaga

SEQ ID NO: 541646 - RNA, 19 nt, Human
ccagacaggaagucgagac

SEQ ID NO: 541647 - RNA, 30 nt, Human
cccccaaacccuugaacuagccagucuauu

SEQ ID NO: 541648 - RNA, 23 nt, Human
cccggggcacagggugcaugacu

SEQ ID NO: 541649 - RNA, 23 nt, Human
cccugccccgggccugugaugcc

SEQ ID NO: 541650 - RNA, 20 nt, Human
ccucaugcaggcacaaggcu

SEQ ID NO: 541651 - RNA, 21 nt, Human
ccuccucaugggaaucauuuc

SEQ ID NO: 541652 - RNA, 24 nt, Human
ccucuaaccagauagagccaggac

SEQ ID NO: 541653 - RNA, 23 nt, Human
cuaauccggcugcaccagacagg

SEQ ID NO: 541654 - RNA, 22 nt, Human
cuucuuuaauugccugcucucc

SEQ ID NO: 541655 - RNA, 21 nt, Human
cuuuauucaucaagucuccca

SEQ ID NO: 541656 - RNA, 18 nt, Human
gaacacuuuggcagguga

SEQ ID NO: 541657 - RNA, 20 nt, Human
gaagagaagcuggggcugcc

SEQ ID NO: 541658 - RNA, 21 nt, Human
gaaggugcuguauuuggggga

SEQ ID NO: 541659 - RNA, 23 nt, Human
gccacaaacacuuacacaagccc

SEQ ID NO: 541660 - RNA, 22 nt, Human
gcccccaaacccuugaacuagc

SEQ ID NO: 541661 - RNA, 22 nt, Human
ggaaacaagaggaauucauggc

SEQ ID NO: 541662 - RNA, 22 nt, Human
ggaagggugaagagaagacugg

SEQ ID NO: 541663 - RNA, 23 nt, Human
ggcuugagaaugucaggagaugg

SEQ ID NO: 541664 - RNA, 21 nt, Human
gggaaauguggagaaagggaa

SEQ ID NO: 541665 - RNA, 22 nt, Human
gggauucuuuauucaucaaguc

SEQ ID NO: 541666 - RNA, 24 nt, Human
ggggcacagggugcaugacuuggg

SEQ ID NO: 541667 - RNA, 22 nt, Human
ggugguagggacacgauaagaa

SEQ ID NO: 541668 - RNA, 23 nt, Human
gugagcaucuaaccacgugccag

SEQ ID NO: 541669 - RNA, 22 nt, Human
uaaaagagagagagagagagau

SEQ ID NO: 541670 - RNA, 18 nt, Human
uaacccaaaccaaggcca

SEQ ID NO: 541671 - RNA, 23 nt, Human
uaagaauaagggagagaagccag

SEQ ID NO: 541672 - RNA, 21 nt, Human
uaagcaaaccugccauauaaa

SEQ ID NO: 541673 - RNA, 19 nt, Human
uaccuacuccuuugguaaa

SEQ ID NO: 541674 - RNA, 18 nt, Human
uagagccaggacucuggg

SEQ ID NO: 541675 - RNA, 21 nt, Human
uauggccaaugagcaucagaa

SEQ ID NO: 541676 - RNA, 24 nt, Human
ucagcuugcacacucaaggcacag

SEQ ID NO: 541677 - RNA, 21 nt, Human
ucccuuggcauaauguggggc

SEQ ID NO: 541678 - RNA, 21 nt, Human
uccucaugggaaucauuucac

SEQ ID NO: 541679 - RNA, 19 nt, Human
ugaaagcacuucauaugcc

SEQ ID NO: 541680 - RNA, 23 nt, Human
ugaagagaagcuggggcugccug

SEQ ID NO: 541681 - RNA, 23 nt, Human
ugacaaaagaggucccgcuuccc

SEQ ID NO: 541682 - RNA, 24 nt, Human
ugccccgggccugugaugccacac

SEQ ID NO: 541683 - RNA, 23 nt, Human
uggaaaaaggccuuaaaaugaug

SEQ ID NO: 541684 - RNA, 19 nt, Human
uggaauggaaauaaggcca

SEQ ID NO: 541685 - RNA, 22 nt, Human
uggaauggaaauaaggccagga

SEQ ID NO: 541686 - RNA, 21 nt, Human
uggcaggugacauggaaugga

SEQ ID NO: 541687 - RNA, 20 nt, Human
ugggggaaucugaugcagca

SEQ ID NO: 541688 - RNA, 23 nt, Human
ugguaaagugggaaacacagggc

SEQ ID NO: 541689 - RNA, 18 nt, Human
uuaaacaguaaguccuuu

SEQ ID NO: 541690 - RNA, 23 nt, Human
uugccugcucuccgccuugguca

SEQ ID NO: 541691 - RNA, 26 nt, Human
uuggaaagccacagaaucaucggaau

SEQ ID NO: 541692 - RNA, 19 nt, Human
aaaaaaaccuugcagauaa

SEQ ID NO: 541693 - RNA, 25 nt, Human
aaacacacacaaaaaaaccuugcag

SEQ ID NO: 541694 - RNA, 22 nt, Human
acacacaaaaaaaccuugcaga

SEQ ID NO: 541695 - RNA, 21 nt, Human
agagacagcuagcuagccccc

SEQ ID NO: 541696 - RNA, 19 nt, Human
agauaaaaaaauuaagccu

SEQ ID NO: 541697 - RNA, 21 nt, Human
caaauggacaaauucuuaagc

SEQ ID NO: 541698 - RNA, 20 nt, Human
cagcccacccggcccuguga

SEQ ID NO: 541699 - RNA, 20 nt, Human
cccccucuucugcucgugcc

SEQ ID NO: 541700 - RNA, 26 nt, Human
cggccgccaccgcgguggagcuccag

SEQ ID NO: 541701 - RNA, 24 nt, Human
cuauauuguguuucuuuugcuccu

SEQ ID NO: 541702 - RNA, 21 nt, Human
cucuuauucauuucaugauga

SEQ ID NO: 541703 - RNA, 22 nt, Human
cuugcauauugaaaauaaaaac

SEQ ID NO: 541704 - RNA, 18 nt, Human
gacagcuagcuagccccc

SEQ ID NO: 541705 - RNA, 22 nt, Human
gccaccgcgguggagcuccagc

SEQ ID NO: 541706 - RNA, 18 nt, Human
guccgcagagacagcuag

SEQ ID NO: 541707 - RNA, 22 nt, Human
uaaaaacaaaaacacacacaaa

SEQ ID NO: 541708 - RNA, 22 nt, Human
uagcuagcccccucuucugcuc

SEQ ID NO: 541709 - RNA, 24 nt, Human
uauuguguuucuuuugcuccugga

SEQ ID NO: 541710 - RNA, 21 nt, Human
uccccugguccgcagagacag

SEQ ID NO: 541711 - RNA, 25 nt, Human
uccgcagagacagcuagcuagcccc

SEQ ID NO: 541712 - RNA, 20 nt, Human
uccuccgccgccgcgucggc

SEQ ID NO: 541713 - RNA, 23 nt, Human
ucuccccugguccgcagagacug

SEQ ID NO: 541714 - RNA, 24 nt, Human
ucuuaagcccucuuauucauuuca

SEQ ID NO: 541715 - RNA, 21 nt, Human
ugaaaauaaaaacaaaaacac

SEQ ID NO: 541716 - RNA, 18 nt, Human
ugaaacucaggcggcagc

SEQ ID NO: 541717 - RNA, 20 nt, Human
uuccacacacuccucacagc

SEQ ID NO: 541718 - RNA, 19 nt, Human
uugcuaacaacuccaaccc

SEQ ID NO: 541719 - RNA, 19 nt, Human
uuugcuccuggaguccucu

SEQ ID NO: 541720 - RNA, 19 nt, Human
uuuugcuccuggaguccuc

SEQ ID NO: 541721 - RNA, 23 nt, Human
caugucaccaaaaauucuccagg

SEQ ID NO: 541722 - RNA, 19 nt, Human
cggaaccagaacgcggaac

SEQ ID NO: 541723 - RNA, 23 nt, Human
gaaccagaacgcggaaccaggga

SEQ ID NO: 541724 - RNA, 19 nt, Human
gugguguggcuggcccagg

SEQ ID NO: 541725 - RNA, 21 nt, Human
uauacaguccaucaccuuggc

SEQ ID NO: 541726 - RNA, 22 nt, Human
uguuugucuuuccucaaauaua

SEQ ID NO: 541727 - RNA, 20 nt, Human
uuggaccucggugguguggc

SEQ ID NO: 541728 - RNA, 25 nt, Human
aguccuuuuauauuuucagugccuu

SEQ ID NO: 541729 - RNA, 21 nt, Human
cacaucuuuauacagaauuca

SEQ ID NO: 541730 - RNA, 21 nt, Human
cagcaauucagcuagcugucu

SEQ ID NO: 541731 - RNA, 19 nt, Human
ccagucuuagcaacagauu

SEQ ID NO: 541732 - RNA, 18 nt, Human
uaacuuagauuucccuuu

SEQ ID NO: 541733 - RNA, 22 nt, Human
uacaucaguaaacuaccagucc

SEQ ID NO: 541734 - RNA, 20 nt, Human
uuuucagugccuuaucaaaa

SEQ ID NO: 541735 - RNA, 20 nt, Human
aaaaaaacuacuauaaaaac

SEQ ID NO: 541736 - RNA, 18 nt, Human
aacauuuuccugaaaacc

SEQ ID NO: 541737 - RNA, 19 nt, Human
aacauuuuccugaaaacca

SEQ ID NO: 541738 - RNA, 21 nt, Human
aagcagucuucccccagcuuc

SEQ ID NO: 541739 - RNA, 20 nt, Human
acauaucacaaaagugggau

SEQ ID NO: 541740 - RNA, 20 nt, Human
acccccaacagcaggaagcc

SEQ ID NO: 541741 - RNA, 22 nt, Human
acuacuauaaaaacauucgggg

SEQ ID NO: 541742 - RNA, 18 nt, Human
agcaggaagccaaaggga

SEQ ID NO: 541743 - RNA, 19 nt, Human
agcccuuucccuuccugau

SEQ ID NO: 541744 - RNA, 19 nt, Human
agcucuccccaccucccuc

SEQ ID NO: 541745 - RNA, 21 nt, Human
auagcugccaccugaccccaa

SEQ ID NO: 541746 - RNA, 24 nt, Human
caacagcaggaagccaaagggaag

SEQ ID NO: 541747 - RNA, 18 nt, Human
cacauaucacaaaagugg

SEQ ID NO: 541748 - RNA, 18 nt, Human
caccugaccccaaagccc

SEQ ID NO: 541749 - RNA, 19 nt, Human
cacuccccccaggcagccc

SEQ ID NO: 541750 - RNA, 20 nt, Human
cagcucugcagguguaggca

SEQ ID NO: 541751 - RNA, 18 nt, Human
caggaucuggcugaagca

SEQ ID NO: 541752 - RNA, 19 nt, Human
caggucacucuccagccac

SEQ ID NO: 541753 - RNA, 23 nt, Human
cagguugugaacuuucccuucuu

SEQ ID NO: 541754 - RNA, 23 nt, Human
cauuacaaaaaaauacaaaaaaa

SEQ ID NO: 541755 - RNA, 19 nt, Human
ccaaagcccuuucccuucc

SEQ ID NO: 541756 - RNA, 19 nt, Human
ccaccucccucccacuccc

SEQ ID NO: 541757 - RNA, 23 nt, Human
ccaccucccucccacucccccca

SEQ ID NO: 541758 - RNA, 21 nt, Human
cccaaagcccuuucccuuccu

SEQ ID NO: 541759 - RNA, 20 nt, Human
cccagcucuaaaagggguca

SEQ ID NO: 541760 - RNA, 18 nt, Human
cccaggcagcccagcucu

SEQ ID NO: 541761 - RNA, 22 nt, Human
cccaggcagcccagcucuaaaa

SEQ ID NO: 541762 - RNA, 24 nt, Human
ccccacacagccuccaaggguaag

SEQ ID NO: 541763 - RNA, 26 nt, Human
ccccaccucccucccacuccccccag

SEQ ID NO: 541764 - RNA, 21 nt, Human
ccccccugcuccagaugaaaa

SEQ ID NO: 541765 - RNA, 24 nt, Human
cccuugaacacuccugagagcagc

SEQ ID NO: 541766 - RNA, 19 nt, Human
ccuaaagaccccaccccag

SEQ ID NO: 541767 - RNA, 22 nt, Human
ccucaggccccauucccugccc

SEQ ID NO: 541768 - RNA, 23 nt, Human
ccucccucccacuccccccaggc

SEQ ID NO: 541769 - RNA, 18 nt, Human
ccucucuccuuucuccca

SEQ ID NO: 541770 - RNA, 21 nt, Human
cuagcucuccccaccucccuc

SEQ ID NO: 541771 - RNA, 23 nt, Human
cucccacuccccccaggcagccc

SEQ ID NO: 541772 - RNA, 18 nt, Human
cucccucccacucccccc

SEQ ID NO: 541773 - RNA, 18 nt, Human
cucuaaaaggggucaggg

SEQ ID NO: 541774 - RNA, 18 nt, Human
cucuccccaccucccucc

SEQ ID NO: 541775 - RNA, 20 nt, Human
cucuccccaccucccuccca

SEQ ID NO: 541776 - RNA, 20 nt, Human
cugcagguguaggcagggca

SEQ ID NO: 541777 - RNA, 26 nt, Human
cuggaaauuccccacacagccuccaa

SEQ ID NO: 541778 - RNA, 22 nt, Human
cuggggguggggcugagaaagc

SEQ ID NO: 541779 - RNA, 23 nt, Human
cuuaauaccucaggccccauucc

SEQ ID NO: 541780 - RNA, 19 nt, Human
cuugugcaugaauaugugu

SEQ ID NO: 541781 - RNA, 26 nt, Human
gaacauuuuccugaaaaccaguggcu

SEQ ID NO: 541782 - RNA, 22 nt, Human
gaauaugugugccauuaccuug

SEQ ID NO: 541783 - RNA, 24 nt, Human
gaccccaaagcccuuucccuuccu

SEQ ID NO: 541784 - RNA, 22 nt, Human
gagagcagcagggaggacagaa

SEQ ID NO: 541785 - RNA, 23 nt, Human
gagagcagcagggaggacagaac

SEQ ID NO: 541786 - RNA, 27 nt, Human
gagcagcagggaggacagaaccuccag

SEQ ID NO: 541787 - RNA, 21 nt, Human
gaguggagugaguguuggggg

SEQ ID NO: 541788 - RNA, 19 nt, Human
gccccauucccugcccucc

SEQ ID NO: 541789 - RNA, 26 nt, Human
gcccugucccccacuucuuagccuua

SEQ ID NO: 541790 - RNA, 21 nt, Human
ggaaaaaccugugacccugaa

SEQ ID NO: 541791 - RNA, 18 nt, Human
ggaaauuccccacacagc

SEQ ID NO: 541792 - RNA, 18 nt, Human
ggagcucaccccccugcu

SEQ ID NO: 541793 - RNA, 23 nt, Human
ggaggacagaaccuccagcucug

SEQ ID NO: 541794 - RNA, 19 nt, Human
ggauuuggaaguuuggggg

SEQ ID NO: 541795 - RNA, 20 nt, Human
guggagugaguguugggggu

SEQ ID NO: 541796 - RNA, 22 nt, Human
uaccucaggccccauucccugc

SEQ ID NO: 541797 - RNA, 18 nt, Human
uagaugggcccugucccc

SEQ ID NO: 541798 - RNA, 21 nt, Human
uagcucuccccaccucccucc

SEQ ID NO: 541799 - RNA, 19 nt, Human
uagcugccaccugacccca

SEQ ID NO: 541800 - RNA, 22 nt, Human
ucaaagugagaaaaccuaaaga

SEQ ID NO: 541801 - RNA, 27 nt, Human
ucacauaucacaaaagugggauuugga

SEQ ID NO: 541802 - RNA, 19 nt, Human
ucaccccccugcuccagau

SEQ ID NO: 541803 - RNA, 21 nt, Human
uccaguggacaucaagcuggg

SEQ ID NO: 541804 - RNA, 24 nt, Human
ucccacuccccccaggcagcccag

SEQ ID NO: 541805 - RNA, 22 nt, Human
ucccagagaggcacagacagcu

SEQ ID NO: 541806 - RNA, 21 nt, Human
uccccaccucccucccacucc

SEQ ID NO: 541807 - RNA, 24 nt, Human
uccccccaggcagcccagcucuaa

SEQ ID NO: 541808 - RNA, 25 nt, Human
uccugaugaaggcugguagaugggc

SEQ ID NO: 541809 - RNA, 20 nt, Human
ucuaaaaggggucagggaca

SEQ ID NO: 541810 - RNA, 21 nt, Human
ugagaaaaccuaaagacccca

SEQ ID NO: 541811 - RNA, 22 nt, Human
ugagaaaaccuaaagaccccac

SEQ ID NO: 541812 - RNA, 19 nt, Human
ugagagcagcagggaggac

SEQ ID NO: 541813 - RNA, 21 nt, Human
ugagagcagcagggaggacag

SEQ ID NO: 541814 - RNA, 23 nt, Human
ugagagcagcagggaggacagaa

SEQ ID NO: 541815 - RNA, 22 nt, Human
ugaguagcuucacauaucacaa

SEQ ID NO: 541816 - RNA, 22 nt, Human
ugaugaaggcugguagaugggc

SEQ ID NO: 541817 - RNA, 19 nt, Human
uggacaucaagcugggugc

SEQ ID NO: 541818 - RNA, 21 nt, Human
uggccugggcuagcucucccc

SEQ ID NO: 541819 - RNA, 18 nt, Human
ugggaucacacaggcaua

SEQ ID NO: 541820 - RNA, 21 nt, Human
uggggguggggugggaucaca

SEQ ID NO: 541821 - RNA, 21 nt, Human
ugguagaugggcccugucccc

SEQ ID NO: 541822 - RNA, 21 nt, Human
uguuggggguauugcuguggu

SEQ ID NO: 541823 - RNA, 20 nt, Human
uuuuagaaaaaguugccagu

SEQ ID NO: 541824 - RNA, 24 nt, Human
uuuuuuuuuuuuuuccauauuuuu

SEQ ID NO: 541825 - RNA, 22 nt, Human
aaaaauguuccuguuaauccuc

SEQ ID NO: 541826 - RNA, 20 nt, Human
aaagcaaaugacaaagaccc

SEQ ID NO: 541827 - RNA, 23 nt, Human
aacucaaaagucuaugacaaaua

SEQ ID NO: 541828 - RNA, 23 nt, Human
acaacuagaaaacauccuuaauu

SEQ ID NO: 541829 - RNA, 21 nt, Human
acacuaaagagucaagacuca

SEQ ID NO: 541830 - RNA, 21 nt, Human
acccaguuuaccagcuuuacu

SEQ ID NO: 541831 - RNA, 20 nt, Human
agacaaaaaaaaaauggucc

SEQ ID NO: 541832 - RNA, 22 nt, Human
agacaaaaaaaaaaugguccua

SEQ ID NO: 541833 - RNA, 24 nt, Human
agcaaaugacaaagacccaguuua

SEQ ID NO: 541834 - RNA, 21 nt, Human
caaaacuuacuaaguugccag

SEQ ID NO: 541835 - RNA, 25 nt, Human
caacaauuuuaaagacaaaaaaaaa

SEQ ID NO: 541836 - RNA, 19 nt, Human
cagacacaaugaaaagcag

SEQ ID NO: 541837 - RNA, 24 nt, Human
caggccgacacuacguggcucaca

SEQ ID NO: 541838 - RNA, 23 nt, Human
caugcacaacuagaaaacauccu

SEQ ID NO: 541839 - RNA, 22 nt, Human
caugcugguguuaguguacaau

SEQ ID NO: 541840 - RNA, 19 nt, Human
cgaggacagaagcggccgg

SEQ ID NO: 541841 - RNA, 21 nt, Human
cuagaaaacauccuuaauuua

SEQ ID NO: 541842 - RNA, 26 nt, Human
cuagaaaacauccuuaauuuauauua

SEQ ID NO: 541843 - RNA, 23 nt, Human
cuuaauuuauauuaaaccagaaa

SEQ ID NO: 541844 - RNA, 21 nt, Human
ggccgguggcgggacgcagga

SEQ ID NO: 541845 - RNA, 20 nt, Human
uaaaaaagcaaagugcauac

SEQ ID NO: 541846 - RNA, 22 nt, Human
uaaagcaaaugacaaagaccca

SEQ ID NO: 541847 - RNA, 23 nt, Human
uaacuucacagcaggccgacacu

SEQ ID NO: 541848 - RNA, 21 nt, Human
ucagacacaaugaaaagcagg

SEQ ID NO: 541849 - RNA, 20 nt, Human
uccuacacuaaagagucaag

SEQ ID NO: 541850 - RNA, 22 nt, Human
ugcaccaacacauucgcauuua

SEQ ID NO: 541851 - RNA, 21 nt, Human
uuaaagcaaaugacaaagacc

SEQ ID NO: 541852 - RNA, 24 nt, Human
uuacuaaguugccagcauucaugc

SEQ ID NO: 541853 - RNA, 19 nt, Human
uucaugcacaacuagaaaa

SEQ ID NO: 541854 - RNA, 20 nt, Human
uugaaauuauuucuguagaa

SEQ ID NO: 541855 - RNA, 22 nt, Human
uuuaaagcaaaugacaaagacc

SEQ ID NO: 541856 - RNA, 24 nt, Human
uuuucuuuuuuuuuuuuuuuaaag

SEQ ID NO: 541857 - RNA, 20 nt, Human
uuuuuuuuuuuaaagcaaau

SEQ ID NO: 541858 - RNA, 24 nt, Human
aaaaaaacagaagaccguagcuac

SEQ ID NO: 541859 - RNA, 20 nt, Human
aaaauaacagacacaggcca

SEQ ID NO: 541860 - RNA, 21 nt, Human
aaaauaacagacacaggccag

SEQ ID NO: 541861 - RNA, 21 nt, Human
aacacggcgaaggacacaccu

SEQ ID NO: 541862 - RNA, 21 nt, Human
aacagacacaggccaguccug

SEQ ID NO: 541863 - RNA, 21 nt, Human
aaccaaaauaacagacacagg

SEQ ID NO: 541864 - RNA, 24 nt, Human
aaccccaacacggcgaaggacaca

SEQ ID NO: 541865 - RNA, 24 nt, Human
aaccugaaccuacccuucugcaca

SEQ ID NO: 541866 - RNA, 22 nt, Human
aagaaaccagaggccauuucag

SEQ ID NO: 541867 - RNA, 18 nt, Human
aagaugggaggggggaga

SEQ ID NO: 541868 - RNA, 19 nt, Human
aagcagcuuccaugcgugu

SEQ ID NO: 541869 - RNA, 21 nt, Human
aagcaggcaggggugcugggg

SEQ ID NO: 541870 - RNA, 18 nt, Human
aagcggcacggaggcacc

SEQ ID NO: 541871 - RNA, 18 nt, Human
aagcugcccaggaccuag

SEQ ID NO: 541872 - RNA, 20 nt, Human
aagugcaggaacacagacaa

SEQ ID NO: 541873 - RNA, 20 nt, Human
aaucacaaucaccaccguga

SEQ ID NO: 541874 - RNA, 19 nt, Human
acaaagccuuaaagccaac

SEQ ID NO: 541875 - RNA, 21 nt, Human
acaaagccuuaaagccaacag

SEQ ID NO: 541876 - RNA, 22 nt, Human
acaacacagacauggaacagaa

SEQ ID NO: 541877 - RNA, 18 nt, Human
acaaccaaaauaacagac

SEQ ID NO: 541878 - RNA, 18 nt, Human
acaaccaaaauaacagac

SEQ ID NO: 541879 - RNA, 20 nt, Human
acaaccaaaauaacagacac

SEQ ID NO: 541880 - RNA, 23 nt, Human
acaaccaaaauaacagacacagg

SEQ ID NO: 541881 - RNA, 21 nt, Human
acacacacggacacaccacag

SEQ ID NO: 541882 - RNA, 26 nt, Human
acacacacggacacaccacagcccac

SEQ ID NO: 541883 - RNA, 28 nt, Human
acacagcccccaggauggggggaacgcc

SEQ ID NO: 541884 - RNA, 19 nt, Human
acacaggccaguccugcgc

SEQ ID NO: 541885 - RNA, 18 nt, Human
acagaaccccauacaugc

SEQ ID NO: 541886 - RNA, 21 nt, Human
acagacccccaagccaaccau

SEQ ID NO: 541887 - RNA, 24 nt, Human
acagacccccaagccaaccaugcc

SEQ ID NO: 541888 - RNA, 21 nt, Human
acagaguguggaccagacccc

SEQ ID NO: 541889 - RNA, 18 nt, Human
acaugcuauuaaaaaagg

SEQ ID NO: 541890 - RNA, 18 nt, Human
accacagacccccaagcc

SEQ ID NO: 541891 - RNA, 20 nt, Human
accccgggcccagccccuuc

SEQ ID NO: 541892 - RNA, 20 nt, Human
acccguucccccugcucccc

SEQ ID NO: 541893 - RNA, 22 nt, Human
accuccgagaaccagaacggca

SEQ ID NO: 541894 - RNA, 24 nt, Human
acguccuaagcuacaucuacaaaa

SEQ ID NO: 541895 - RNA, 20 nt, Human
acucuguaacugaaaagcca

SEQ ID NO: 541896 - RNA, 23 nt, Human
acugcagccucaaggcugggagc

SEQ ID NO: 541897 - RNA, 23 nt, Human
acuggaccaaccugaccgacagc

SEQ ID NO: 541898 - RNA, 22 nt, Human
agaacgccugagagcagccucg

SEQ ID NO: 541899 - RNA, 18 nt, Human
agaagaaacaaagaaaag

SEQ ID NO: 541900 - RNA, 23 nt, Human
agacaaaucuauacagcagcagc

SEQ ID NO: 541901 - RNA, 25 nt, Human
agacaaaucuauacagcagcagcug

SEQ ID NO: 541902 - RNA, 26 nt, Human
agacccccaagccaaccaugcccagg

SEQ ID NO: 541903 - RNA, 21 nt, Human
agagcagccucgacggcguga

SEQ ID NO: 541904 - RNA, 22 nt, Human
agagcgcugaaaacgguucugc

SEQ ID NO: 541905 - RNA, 20 nt, Human
agagggucccucugguccag

SEQ ID NO: 541906 - RNA, 19 nt, Human
agaguccuacugcagccuc

SEQ ID NO: 541907 - RNA, 22 nt, Human
agcauugucugcggcccgagag

SEQ ID NO: 541908 - RNA, 19 nt, Human
agccaaccaugcccagcac

SEQ ID NO: 541909 - RNA, 18 nt, Human
agccaccuuuaauuguac

SEQ ID NO: 541910 - RNA, 19 nt, Human
agcccccguccccaguagc

SEQ ID NO: 541911 - RNA, 21 nt, Human
aggaacacagacaaauaaccc

SEQ ID NO: 541912 - RNA, 23 nt, Human
aggaacacagacaaauaacccca

SEQ ID NO: 541913 - RNA, 18 nt, Human
aggaggcucaucugguug

SEQ ID NO: 541914 - RNA, 21 nt, Human
aggcagggaagggggcuucag

SEQ ID NO: 541915 - RNA, 18 nt, Human
aggcaggggugcuggggg

SEQ ID NO: 541916 - RNA, 19 nt, Human
aggcaggggugcugggggc

SEQ ID NO: 541917 - RNA, 19 nt, Human
aggcaggggugcugggggc

SEQ ID NO: 541918 - RNA, 23 nt, Human
aggcgcggaagcugccccaggac

SEQ ID NO: 541919 - RNA, 22 nt, Human
agggacccaacccuccugagcc

SEQ ID NO: 541920 - RNA, 18 nt, Human
aggggugcugggggcguc

SEQ ID NO: 541921 - RNA, 20 nt, Human
aucuacaaaaauugcaaagg

SEQ ID NO: 541922 - RNA, 20 nt, Human
aucucuacagggaccucugc

SEQ ID NO: 541923 - RNA, 19 nt, Human
augacacuccugcugcgug

SEQ ID NO: 541924 - RNA, 18 nt, Human
caaaagcaggcaggggug

SEQ ID NO: 541925 - RNA, 25 nt, Human
caaaaggaagacaaaaaaaucccac

SEQ ID NO: 541926 - RNA, 21 nt, Human
caaaauaacagacacaggcca

SEQ ID NO: 541927 - RNA, 30 nt, Human
caaaaugguccacuggacucuguaacugaa

SEQ ID NO: 541928 - RNA, 23 nt, Human
caacacggcgaaggacacaccuc

SEQ ID NO: 541929 - RNA, 25 nt, Human
caacauagagaacuaggaaaguuca

SEQ ID NO: 541930 - RNA, 19 nt, Human
caacucugcagcggccacc

SEQ ID NO: 541931 - RNA, 21 nt, Human
caagggacccacaauggucca

SEQ ID NO: 541932 - RNA, 23 nt, Human
cacacagcccccaggaugggcac

SEQ ID NO: 541933 - RNA, 21 nt, Human
cacagccuccuccucagcuuu

SEQ ID NO: 541934 - RNA, 23 nt, Human
cacaggaggaggggucgugggaa

SEQ ID NO: 541935 - RNA, 18 nt, Human
cacagugggcucagcgcu

SEQ ID NO: 541936 - RNA, 19 nt, Human
caccaaggaaugacaguga

SEQ ID NO: 541937 - RNA, 19 nt, Human
caccacagcccacacucac

SEQ ID NO: 541938 - RNA, 27 nt, Human
caccccacugucucgccaccucaccuu

SEQ ID NO: 541939 - RNA, 25 nt, Human
cacgcggucaugccgcggaaugucc

SEQ ID NO: 541940 - RNA, 21 nt, Human
cacuccucagccuggagaccc

SEQ ID NO: 541941 - RNA, 19 nt, Human
cagaacgccugagagcagc

SEQ ID NO: 541942 - RNA, 20 nt, Human
cagacauggaacagaacccc

SEQ ID NO: 541943 - RNA, 21 nt, Human
cagacccccaagccaaccaug

SEQ ID NO: 541944 - RNA, 24 nt, Human
cagacccccaagccaaccaugccc

SEQ ID NO: 541945 - RNA, 19 nt, Human
cagagcuaagggagggugg

SEQ ID NO: 541946 - RNA, 18 nt, Human
cagagggucccucugguc

SEQ ID NO: 541947 - RNA, 21 nt, Human
cagcaaggccagggcaggcag

SEQ ID NO: 541948 - RNA, 19 nt, Human
cagcacagacaccaaggaa

SEQ ID NO: 541949 - RNA, 21 nt, Human
cagcacagggccccuucccag

SEQ ID NO: 541950 - RNA, 18 nt, Human
cagcagcggcguccaaag

SEQ ID NO: 541951 - RNA, 22 nt, Human
cagccagcaucucaggcugaac

SEQ ID NO: 541952 - RNA, 24 nt, Human
cagccugcaugcuggugcccuucc

SEQ ID NO: 541953 - RNA, 22 nt, Human
cagcugccgugaaagggcccgc

SEQ ID NO: 541954 - RNA, 18 nt, Human
caggcccaacagagggcc

SEQ ID NO: 541955 - RNA, 18 nt, Human
cagguaggaaaggggcag

SEQ ID NO: 541956 - RNA, 19 nt, Human
caguucacgcggucaugcc

SEQ ID NO: 541957 - RNA, 19 nt, Human
cauacaagacggagaucac

SEQ ID NO: 541958 - RNA, 19 nt, Human
caucagacccguucccccu

SEQ ID NO: 541959 - RNA, 22 nt, Human
caugacacacagcccccaggau

SEQ ID NO: 541960 - RNA, 19 nt, Human
ccaaaauaacagacacagg

SEQ ID NO: 541961 - RNA, 22 nt, Human
ccaacagggcagagcgcugaaa

SEQ ID NO: 541962 - RNA, 21 nt, Human
ccacagagcugugugcaggcc

SEQ ID NO: 541963 - RNA, 20 nt, Human
ccacagcccacacucacagc

SEQ ID NO: 541964 - RNA, 19 nt, Human
ccacaguaggaugcacuga

SEQ ID NO: 541965 - RNA, 25 nt, Human
ccaccugaccggcugcagucacccc

SEQ ID NO: 541966 - RNA, 23 nt, Human
ccacgggagaaacccugccacaa

SEQ ID NO: 541967 - RNA, 19 nt, Human
ccacugggugcuggcugca

SEQ ID NO: 541968 - RNA, 25 nt, Human
ccaggaugggcaccccacccugcag

SEQ ID NO: 541969 - RNA, 24 nt, Human
ccagggacccaacccuccugagcc

SEQ ID NO: 541970 - RNA, 18 nt, Human
ccagucaguccuuccucc

SEQ ID NO: 541971 - RNA, 22 nt, Human
cccacccuaccccaccuuccgc

SEQ ID NO: 541972 - RNA, 21 nt, Human
cccaggaaaccacagaccccc

SEQ ID NO: 541973 - RNA, 27 nt, Human
cccauggccacacuugcucacagcauu

SEQ ID NO: 541974 - RNA, 18 nt, Human
ccccaggaugggcacccc

SEQ ID NO: 541975 - RNA, 24 nt, Human
cccccaagccaaccaugcccagca

SEQ ID NO: 541976 - RNA, 18 nt, Human
ccccucacuggaccaacc

SEQ ID NO: 541977 - RNA, 21 nt, Human
ccccuggcagcccccagcagc

SEQ ID NO: 541978 - RNA, 19 nt, Human
cccggaacagaacgccuga

SEQ ID NO: 541979 - RNA, 22 nt, Human
cccguccgcccgcccgcccgcc

SEQ ID NO: 541980 - RNA, 21 nt, Human
ccgcccgcccgcccucccgcc

SEQ ID NO: 541981 - RNA, 18 nt, Human
ccgcccuucagaugcagc

SEQ ID NO: 541982 - RNA, 20 nt, Human
ccucaaggcugggagcacag

SEQ ID NO: 541983 - RNA, 18 nt, Human
ccuccagaccugcuccuc

SEQ ID NO: 541984 - RNA, 23 nt, Human
ccuccuaugcuuuccacaccaaa

SEQ ID NO: 541985 - RNA, 22 nt, Human
ccucugcaacucugcagcggcc

SEQ ID NO: 541986 - RNA, 19 nt, Human
ccugcaggaccccgggccc

SEQ ID NO: 541987 - RNA, 20 nt, Human
ccugcaggaccccgggccca

SEQ ID NO: 541988 - RNA, 18 nt, Human
ccugccacaaggcccagg

SEQ ID NO: 541989 - RNA, 21 nt, Human
ccugcugggaaagccuccugc

SEQ ID NO: 541990 - RNA, 24 nt, Human
ccugguggggcugagcuagggccc

SEQ ID NO: 541991 - RNA, 19 nt, Human
ccuucugcacagccucggg

SEQ ID NO: 541992 - RNA, 22 nt, Human
cgggcccagccccuucuggagg

SEQ ID NO: 541993 - RNA, 19 nt, Human
cggggucccgucacugcca

SEQ ID NO: 541994 - RNA, 20 nt, Human
cggugucaaccucggaaggg

SEQ ID NO: 541995 - RNA, 22 nt, Human
cuacugcagccucaaggcuggg

SEQ ID NO: 541996 - RNA, 20 nt, Human
cuaggucaggcagggggagg

SEQ ID NO: 541997 - RNA, 20 nt, Human
cucacacaugcacaaucuac

SEQ ID NO: 541998 - RNA, 22 nt, Human
cuccccgauucgcggcgcugcu

SEQ ID NO: 541999 - RNA, 22 nt, Human
cuccucagccuggagaccccgg

SEQ ID NO: 542000 - RNA, 19 nt, Human
cuccucugaccacagcucc

SEQ ID NO: 542001 - RNA, 22 nt, Human
cugaccgacagcccugaggcag

SEQ ID NO: 542002 - RNA, 19 nt, Human
cugccacaaggcccaggaa

SEQ ID NO: 542003 - RNA, 23 nt, Human
cuuccaguccccuccucgauuuc

SEQ ID NO: 542004 - RNA, 18 nt, Human
gaacacagacaaauaacc

SEQ ID NO: 542005 - RNA, 22 nt, Human
gagaaacccugccacaaggccc

SEQ ID NO: 542006 - RNA, 23 nt, Human
gagaagaaacaaagaaaagugga

SEQ ID NO: 542007 - RNA, 25 nt, Human
gagcagaggccaaugcugguggggg

SEQ ID NO: 542008 - RNA, 29 nt, Human
gaggucugauuuugauaaauuauuucuaa

SEQ ID NO: 542009 - RNA, 22 nt, Human
gcacagggccccuucccaggcc

SEQ ID NO: 542010 - RNA, 19 nt, Human
gccaggcgccggcuccucc

SEQ ID NO: 542011 - RNA, 23 nt, Human
gcccaccugaccggcugcaguca

SEQ ID NO: 542012 - RNA, 20 nt, Human
gcuccgcggcuccgcucccc

SEQ ID NO: 542013 - RNA, 19 nt, Human
gcucuuggccagucugcgg

SEQ ID NO: 542014 - RNA, 20 nt, Human
gcugguccuaucaucugugg

SEQ ID NO: 542015 - RNA, 21 nt, Human
ggacagcagcaugaaugacac

SEQ ID NO: 542016 - RNA, 23 nt, Human
ggcaaacacaggaggaggggucg

SEQ ID NO: 542017 - RNA, 19 nt, Human
ggcagaugggagcucuggc

SEQ ID NO: 542018 - RNA, 24 nt, Human
ggcaggugagaucagaguccuacu

SEQ ID NO: 542019 - RNA, 20 nt, Human
ggcccagccccuucuggagg

SEQ ID NO: 542020 - RNA, 21 nt, Human
ggccguggcagugcccugggc

SEQ ID NO: 542021 - RNA, 22 nt, Human
ggccucccagggacccaacccu

SEQ ID NO: 542022 - RNA, 18 nt, Human
gggaaagccuccugcagg

SEQ ID NO: 542023 - RNA, 18 nt, Human
gggcacgugugcaugcca

SEQ ID NO: 542024 - RNA, 19 nt, Human
gggcagaugggagcucugg

SEQ ID NO: 542025 - RNA, 20 nt, Human
gggccccuggcagcccccag

SEQ ID NO: 542026 - RNA, 20 nt, Human
gggcugguccuaucaucugu

SEQ ID NO: 542027 - RNA, 20 nt, Human
gguggggcugagcuagggcc

SEQ ID NO: 542028 - RNA, 20 nt, Human
guggcucauugggcuggucc

SEQ ID NO: 542029 - RNA, 21 nt, Human
gugguucuaaagguccaaaaa

SEQ ID NO: 542030 - RNA, 22 nt, Human
gugucugggcuucccggggguc

SEQ ID NO: 542031 - RNA, 22 nt, Human
uaaaaaagggaaaaaaacagaa

SEQ ID NO: 542032 - RNA, 20 nt, Human
uaacugaaaagccaccuggc

SEQ ID NO: 542033 - RNA, 23 nt, Human
uaagacaaagccuuaaagccaac

SEQ ID NO: 542034 - RNA, 19 nt, Human
uacaaccaaaauaacagac

SEQ ID NO: 542035 - RNA, 21 nt, Human
uacaaccaaaauaacagacac

SEQ ID NO: 542036 - RNA, 18 nt, Human
uacagggaccucugcaac

SEQ ID NO: 542037 - RNA, 26 nt, Human
uacauauacacauauguacacacacg

SEQ ID NO: 542038 - RNA, 22 nt, Human
uacaucuacaaaaauugcaaag

SEQ ID NO: 542039 - RNA, 21 nt, Human
uagcuacacugcuuuaaauac

SEQ ID NO: 542040 - RNA, 21 nt, Human
uaggaugcacugagucagagc

SEQ ID NO: 542041 - RNA, 24 nt, Human
uaggaugcacugagucagagcuaa

SEQ ID NO: 542042 - RNA, 22 nt, Human
uaggggucagcugggggcccuc

SEQ ID NO: 542043 - RNA, 26 nt, Human
uauauacauauacacauauguacaca

SEQ ID NO: 542044 - RNA, 21 nt, Human
uauuagguuuuacagauucug

SEQ ID NO: 542045 - RNA, 20 nt, Human
ucaaccugaaccuacccuuc

SEQ ID NO: 542046 - RNA, 19 nt, Human
ucaaggcagggaagggcuu

SEQ ID NO: 542047 - RNA, 21 nt, Human
ucaccaggggacagcagcaug

SEQ ID NO: 542048 - RNA, 19 nt, Human
ucagacccguucccccugc

SEQ ID NO: 542049 - RNA, 18 nt, Human
ucagaguccuacugcagc

SEQ ID NO: 542050 - RNA, 22 nt, Human
ucaguccuuccuccagggaccu

SEQ ID NO: 542051 - RNA, 21 nt, Human
uccacaaaccuccagaccugc

SEQ ID NO: 542052 - RNA, 22 nt, Human
uccacaacacagacauggaaca

SEQ ID NO: 542053 - RNA, 20 nt, Human
uccacacgacgagacgacca

SEQ ID NO: 542054 - RNA, 24 nt, Human
ucccacccuaccccaccuuccgca

SEQ ID NO: 542055 - RNA, 28 nt, Human
ucccagggacccaacccuccugagccag

SEQ ID NO: 542056 - RNA, 21 nt, Human
ucccgccggcuccgcggcucc

SEQ ID NO: 542057 - RNA, 21 nt, Human
uccugagccagagggucccuc

SEQ ID NO: 542058 - RNA, 21 nt, Human
uccuuuuucuaguaggucccc

SEQ ID NO: 542059 - RNA, 22 nt, Human
ucuacaaaaauugcaaaggcug

SEQ ID NO: 542060 - RNA, 21 nt, Human
ucuaggucaggcagggggagg

SEQ ID NO: 542061 - RNA, 23 nt, Human
ucugcaacucugcagcggccacc

SEQ ID NO: 542062 - RNA, 19 nt, Human
ucugcagaaaccaggccca

SEQ ID NO: 542063 - RNA, 23 nt, Human
ucugcagaaaccaggcccacugg

SEQ ID NO: 542064 - RNA, 21 nt, Human
ucugccaggcagcaccugccu

SEQ ID NO: 542065 - RNA, 20 nt, Human
ucuguaacugaaaagccacc

SEQ ID NO: 542066 - RNA, 19 nt, Human
ugaaugacacuccugcugc

SEQ ID NO: 542067 - RNA, 18 nt, Human
ugacagcgccugcacccc

SEQ ID NO: 542068 - RNA, 20 nt, Human
ugacagcgccugcaccccac

SEQ ID NO: 542069 - RNA, 18 nt, Human
ugacagugacgccgguga

SEQ ID NO: 542070 - RNA, 19 nt, Human
ugacagugacgccggugac

SEQ ID NO: 542071 - RNA, 19 nt, Human
ugacgccggugacgccagg

SEQ ID NO: 542072 - RNA, 20 nt, Human
ugagaagaaacaaagaaaaa

SEQ ID NO: 542073 - RNA, 21 nt, Human
ugagaauggccacaaccauga

SEQ ID NO: 542074 - RNA, 22 nt, Human
ugagcaugacacacagccccca

SEQ ID NO: 542075 - RNA, 22 nt, Human
ugaggcuccagggccucuucug

SEQ ID NO: 542076 - RNA, 19 nt, Human
ugagggcaaugagugagcu

SEQ ID NO: 542077 - RNA, 23 nt, Human
ugagucagagcuaagggagggug

SEQ ID NO: 542078 - RNA, 21 nt, Human
ugauauauacauauacacaua

SEQ ID NO: 542079 - RNA, 26 nt, Human
ugauauauacauauacacauauggca

SEQ ID NO: 542080 - RNA, 24 nt, Human
ugcagcggccaccauggacauucu

SEQ ID NO: 542081 - RNA, 20 nt, Human
ugcccaggaccuagugcugg

SEQ ID NO: 542082 - RNA, 19 nt, Human
ugcccgacucccaagaaac

SEQ ID NO: 542083 - RNA, 18 nt, Human
ugcccggacccccucgug

SEQ ID NO: 542084 - RNA, 20 nt, Human
ugcccggacccccucgugaa

SEQ ID NO: 542085 - RNA, 19 nt, Human
ugccuccggccccucaagc

SEQ ID NO: 542086 - RNA, 23 nt, Human
ugccugaaucaucgaugacgggg

SEQ ID NO: 542087 - RNA, 19 nt, Human
ugcucgagccaggaucagc

SEQ ID NO: 542088 - RNA, 19 nt, Human
ugcugggaaagccuccugc

SEQ ID NO: 542089 - RNA, 18 nt, Human
ugcuggugggggccgugg

SEQ ID NO: 542090 - RNA, 22 nt, Human
uggaacagaaccccauacaugc

SEQ ID NO: 542091 - RNA, 19 nt, Human
uggacaagcagcuuccaug

SEQ ID NO: 542092 - RNA, 19 nt, Human
uggacaagcgcugaacucu

SEQ ID NO: 542093 - RNA, 18 nt, Human
uggcaaggggcccacucu

SEQ ID NO: 542094 - RNA, 26 nt, Human
uggcagcagccgacgugaagacgaag

SEQ ID NO: 542095 - RNA, 19 nt, Human
uggcaggugagaucagagu

SEQ ID NO: 542096 - RNA, 18 nt, Human
uggccaggcgccggcucc

SEQ ID NO: 542097 - RNA, 20 nt, Human
uggcuugaaacauuuucccc

SEQ ID NO: 542098 - RNA, 18 nt, Human
ugggaggggggagacugg

SEQ ID NO: 542099 - RNA, 21 nt, Human
ugggaggggggagacuggccc

SEQ ID NO: 542100 - RNA, 22 nt, Human
ugggcagcggccgacgcacucc

SEQ ID NO: 542101 - RNA, 18 nt, Human
ugggcguggaggcaggag

SEQ ID NO: 542102 - RNA, 21 nt, Human
uggguaccgaagggccuugga

SEQ ID NO: 542103 - RNA, 23 nt, Human
ugggucaagggucgacgcugggu

SEQ ID NO: 542104 - RNA, 18 nt, Human
ugggugggcguggaggca

SEQ ID NO: 542105 - RNA, 24 nt, Human
ugggugggcguggaggcaggaggg

SEQ ID NO: 542106 - RNA, 20 nt, Human
ugguggggcugagcuagggc

SEQ ID NO: 542107 - RNA, 20 nt, Human
uguccccacaguaggaugca

SEQ ID NO: 542108 - RNA, 22 nt, Human
ugugcaggcccaacagagggcc

SEQ ID NO: 542109 - RNA, 18 nt, Human
ugugcaugccaguuccuu

SEQ ID NO: 542110 - RNA, 18 nt, Human
uguucuagccacagagcu

SEQ ID NO: 542111 - RNA, 21 nt, Human
uuaaagccaacagggcagagc

SEQ ID NO: 542112 - RNA, 22 nt, Human
uucacagcucugaauacuggga

SEQ ID NO: 542113 - RNA, 20 nt, Human
uuuaucucuacagggaccuc

SEQ ID NO: 542114 - RNA, 23 nt, Human
uuuccacaccaaauucucccacg

SEQ ID NO: 542115 - RNA, 25 nt, Human
aaaaggccaaaaagcaauuggaauu

SEQ ID NO: 542116 - RNA, 19 nt, Human
aaacaaaaacaaaaaauga

SEQ ID NO: 542117 - RNA, 25 nt, Human
aaacaaaagagagaaagaggggacc

SEQ ID NO: 542118 - RNA, 18 nt, Human
aaacaggucacagcaaca

SEQ ID NO: 542119 - RNA, 24 nt, Human
aaacaggucacagcaacaugucuc

SEQ ID NO: 542120 - RNA, 22 nt, Human
aaacauauaucauguagcauaa

SEQ ID NO: 542121 - RNA, 21 nt, Human
aaaccaaacauccacauuccu

SEQ ID NO: 542122 - RNA, 22 nt, Human
aaagaaaaacaggucacagcaa

SEQ ID NO: 542123 - RNA, 24 nt, Human
aaagaccuguuggucugcauauag

SEQ ID NO: 542124 - RNA, 25 nt, Human
aaccaaacauccacauuccuuauca

SEQ ID NO: 542125 - RNA, 19 nt, Human
aacugcucacaaaccuaga

SEQ ID NO: 542126 - RNA, 20 nt, Human
aagagcauuaagccuuacag

SEQ ID NO: 542127 - RNA, 19 nt, Human
acaaaacaaaagagagaaa

SEQ ID NO: 542128 - RNA, 23 nt, Human
acaaaacaaaagagagaaagaga

SEQ ID NO: 542129 - RNA, 19 nt, Human
acaaacaaacaaacaaaac

SEQ ID NO: 542130 - RNA, 26 nt, Human
acacugaguccacacuagauauuggu

SEQ ID NO: 542131 - RNA, 20 nt, Human
agaaaaacaggucacagcaa

SEQ ID NO: 542132 - RNA, 19 nt, Human
agaaagaaaaacaggucac

SEQ ID NO: 542133 - RNA, 23 nt, Human
agacaagcacauacuggaucaaa

SEQ ID NO: 542134 - RNA, 23 nt, Human
aguuggugguaaucacuggacug

SEQ ID NO: 542135 - RNA, 24 nt, Human
augaacuuuaacaaacaaacaaac

SEQ ID NO: 542136 - RNA, 22 nt, Human
augagaaccagccaacacacug

SEQ ID NO: 542137 - RNA, 22 nt, Human
augugugcgugcaugugugugu

SEQ ID NO: 542138 - RNA, 22 nt, Human
augugugugugugugugugugu

SEQ ID NO: 542139 - RNA, 23 nt, Human
auguguguguguguguguguguu

SEQ ID NO: 542140 - RNA, 20 nt, Human
caaaacaacuuuuaaaagcu

SEQ ID NO: 542141 - RNA, 18 nt, Human
caaacaaacaaacaaaac

SEQ ID NO: 542142 - RNA, 23 nt, Human
caaacauccacauuccuuaucaa

SEQ ID NO: 542143 - RNA, 18 nt, Human
caaaugagcaggaaaguc

SEQ ID NO: 542144 - RNA, 25 nt, Human
cacaauaucuacaaaugugaaugag

SEQ ID NO: 542145 - RNA, 18 nt, Human
cacuagauauugguccug

SEQ ID NO: 542146 - RNA, 19 nt, Human
cacugugaucgugccauuc

SEQ ID NO: 542147 - RNA, 23 nt, Human
cagaauagcaaacugcuuacccc

SEQ ID NO: 542148 - RNA, 21 nt, Human
cagacuuccagguucaauccu

SEQ ID NO: 542149 - RNA, 18 nt, Human
cagcagagauggaaaagc

SEQ ID NO: 542150 - RNA, 23 nt, Human
cagcagagauggaaaagcucaua

SEQ ID NO: 542151 - RNA, 23 nt, Human
cagcggucucgggggcgaagucu

SEQ ID NO: 542152 - RNA, 19 nt, Human
caugaaaaucuuuuugccc

SEQ ID NO: 542153 - RNA, 21 nt, Human
caugucagaagguggcauuca

SEQ ID NO: 542154 - RNA, 24 nt, Human
caugugugugugugugugugugag

SEQ ID NO: 542155 - RNA, 23 nt, Human
caugugugugugugugugugugu

SEQ ID NO: 542156 - RNA, 23 nt, Human
cauuaagccuuacagcaaaauua

SEQ ID NO: 542157 - RNA, 23 nt, Human
cauucaagcuccucauuguauuc

SEQ ID NO: 542158 - RNA, 22 nt, Human
cauucucuuaccacaacugcuc

SEQ ID NO: 542159 - RNA, 22 nt, Human
ccauucucuuaccacaacugcu

SEQ ID NO: 542160 - RNA, 23 nt, Human
ccucugcugcaaaugagcaggaa

SEQ ID NO: 542161 - RNA, 18 nt, Human
ccuuaaaaguaaaucaug

SEQ ID NO: 542162 - RNA, 20 nt, Human
ccuuguggggaggugggacc

SEQ ID NO: 542163 - RNA, 22 nt, Human
ccuuguggggaggugggaccug

SEQ ID NO: 542164 - RNA, 20 nt, Human
cuaagcauuagcacaggucu

SEQ ID NO: 542165 - RNA, 20 nt, Human
cuaugauaaagucccagacu

SEQ ID NO: 542166 - RNA, 22 nt, Human
cucuccucauaacuuuccuuaa

SEQ ID NO: 542167 - RNA, 21 nt, Human
cugcaacccugacuuuugauu

SEQ ID NO: 542168 - RNA, 23 nt, Human
cugcucacaaaccuagagaacac

SEQ ID NO: 542169 - RNA, 20 nt, Human
cuggacuauuaucacucccc

SEQ ID NO: 542170 - RNA, 18 nt, Human
gaacaggccaaacuacuu

SEQ ID NO: 542171 - RNA, 24 nt, Human
gaacaggccaaacuacuuuaccac

SEQ ID NO: 542172 - RNA, 24 nt, Human
gaauugugacacacacuaagcauu

SEQ ID NO: 542173 - RNA, 21 nt, Human
gacuguguuucauucacggca

SEQ ID NO: 542174 - RNA, 19 nt, Human
gcagcagagauggaaaagc

SEQ ID NO: 542175 - RNA, 24 nt, Human
gcuuagucagaaaguuggugguaa

SEQ ID NO: 542176 - RNA, 22 nt, Human
ggaggugggaccugguuccuca

SEQ ID NO: 542177 - RNA, 24 nt, Human
ggcuaggagaccaggauuucuaug

SEQ ID NO: 542178 - RNA, 20 nt, Human
gggaggugggaccugguucc

SEQ ID NO: 542179 - RNA, 25 nt, Human
gggcaggguggaaugcggugguucu

SEQ ID NO: 542180 - RNA, 24 nt, Human
ggggcgaagucucucaacggagga

SEQ ID NO: 542181 - RNA, 19 nt, Human
gugauggguguuaugccuu

SEQ ID NO: 542182 - RNA, 21 nt, Human
gugugugugugugugugugug

SEQ ID NO: 542183 - RNA, 21 nt, Human
gugugugugugugugugugug

SEQ ID NO: 542184 - RNA, 21 nt, Human
gugugugugugugugugugug

SEQ ID NO: 542185 - RNA, 21 nt, Human
guuuaugacuguauauuuaaa

SEQ ID NO: 542186 - RNA, 21 nt, Human
uaaaaggaaugcaaagaccug

SEQ ID NO: 542187 - RNA, 22 nt, Human
uaaaaugagaaccagccaacac

SEQ ID NO: 542188 - RNA, 21 nt, Human
uaaaauuagaugcuacauuua

SEQ ID NO: 542189 - RNA, 20 nt, Human
uaacaaacaaacaaacaaaa

SEQ ID NO: 542190 - RNA, 22 nt, Human
uaacaaacaaacaaacaaaaca

SEQ ID NO: 542191 - RNA, 19 nt, Human
uaacgguuuaguacugaaa

SEQ ID NO: 542192 - RNA, 19 nt, Human
uaagacaagcacauacugg

SEQ ID NO: 542193 - RNA, 23 nt, Human
uaagacaagcacauacuggauca

SEQ ID NO: 542194 - RNA, 24 nt, Human
uacaaaacaaaaaauauauuacaa

SEQ ID NO: 542195 - RNA, 21 nt, Human
uacagcaaaauuagauguuuc

SEQ ID NO: 542196 - RNA, 21 nt, Human
uacagcauuuguuuccaaaga

SEQ ID NO: 542197 - RNA, 20 nt, Human
uacaguauuaugcuaaaggc

SEQ ID NO: 542198 - RNA, 23 nt, Human
uacauuacaaauauuuuagacca

SEQ ID NO: 542199 - RNA, 23 nt, Human
uaccacaacugcucacaaaccua

SEQ ID NO: 542200 - RNA, 22 nt, Human
uacguauaaauccagaaauccu

SEQ ID NO: 542201 - RNA, 19 nt, Human
uagaaguuccucucaugcu

SEQ ID NO: 542202 - RNA, 20 nt, Human
uagagaacacugaguccaca

SEQ ID NO: 542203 - RNA, 21 nt, Human
uagcacaggucugcagcagag

SEQ ID NO: 542204 - RNA, 24 nt, Human
uagcuuagucagaaaguugguggu

SEQ ID NO: 542205 - RNA, 18 nt, Human
uauaauguauccggaaaa

SEQ ID NO: 542206 - RNA, 19 nt, Human
uauggugggaacuuuggag

SEQ ID NO: 542207 - RNA, 24 nt, Human
ucaaaauacgugacauccacagaa

SEQ ID NO: 542208 - RNA, 21 nt, Human
ucacauugucaguaaaaggua

SEQ ID NO: 542209 - RNA, 23 nt, Human
ucacuggacuauuaucacucccc

SEQ ID NO: 542210 - RNA, 20 nt, Human
ucagagcagauacugacaag

SEQ ID NO: 542211 - RNA, 29 nt, Human
ucaugugugcgugcaugugugugugugug

SEQ ID NO: 542212 - RNA, 21 nt, Human
uccaagaaaaaucuagaaacc

SEQ ID NO: 542213 - RNA, 18 nt, Human
uccccagguagaaugcug

SEQ ID NO: 542214 - RNA, 20 nt, Human
ucccuauuuucuuuagccac

SEQ ID NO: 542215 - RNA, 21 nt, Human
ucccuguaugaaugucguucc

SEQ ID NO: 542216 - RNA, 18 nt, Human
ucugcagcagagauggaa

SEQ ID NO: 542217 - RNA, 18 nt, Human
ucugcgaaaaccucagaa

SEQ ID NO: 542218 - RNA, 19 nt, Human
ucugcuuccucccucugcu

SEQ ID NO: 542219 - RNA, 19 nt, Human
ugaaacagugaaucugauc

SEQ ID NO: 542220 - RNA, 24 nt, Human
ugacugggucugcaggugagugca

SEQ ID NO: 542221 - RNA, 22 nt, Human
ugaucugaauccagccagucug

SEQ ID NO: 542222 - RNA, 21 nt, Human
ugauggguguuaugccuucau

SEQ ID NO: 542223 - RNA, 19 nt, Human
ugcagcagagauggaaaag

SEQ ID NO: 542224 - RNA, 22 nt, Human
ugcagcucucucacugugaucg

SEQ ID NO: 542225 - RNA, 21 nt, Human
ugcaugugugugugugugugu

SEQ ID NO: 542226 - RNA, 22 nt, Human
ugccacaagaaaguuaaaacaa

SEQ ID NO: 542227 - RNA, 27 nt, Human
ugccacaagaaaguuaaaacaaaaaca

SEQ ID NO: 542228 - RNA, 21 nt, Human
ugccucaacauacagauucgu

SEQ ID NO: 542229 - RNA, 19 nt, Human
ugcgugcaugugugugugu

SEQ ID NO: 542230 - RNA, 24 nt, Human
ugcgugcaugugugugugugugug

SEQ ID NO: 542231 - RNA, 22 nt, Human
ugcucacaaaccuagagaacac

SEQ ID NO: 542232 - RNA, 23 nt, Human
ugcuuugcuuucacaaauguccc

SEQ ID NO: 542233 - RNA, 23 nt, Human
ugcuuuggaucuuuuaugguggg

SEQ ID NO: 542234 - RNA, 20 nt, Human
uggaaugcggugguucugca

SEQ ID NO: 542235 - RNA, 18 nt, Human
uggacuauuaucacuccc

SEQ ID NO: 542236 - RNA, 21 nt, Human
uggagaaaccaaacauccaca

SEQ ID NO: 542237 - RNA, 20 nt, Human
ugggaacuuuggagaaacca

SEQ ID NO: 542238 - RNA, 21 nt, Human
uggggaggugggaccugguuc

SEQ ID NO: 542239 - RNA, 19 nt, Human
uggggcaggagugauuacg

SEQ ID NO: 542240 - RNA, 23 nt, Human
uggugcaugcuuuuuguauucuc

SEQ ID NO: 542241 - RNA, 19 nt, Human
ugguucugcaaggucaucu

SEQ ID NO: 542242 - RNA, 20 nt, Human
ugguuuuguucuuggagucu

SEQ ID NO: 542243 - RNA, 21 nt, Human
ugucagauuacauuuuggugc

SEQ ID NO: 542244 - RNA, 21 nt, Human
ugugcacacaaaagagaucua

SEQ ID NO: 542245 - RNA, 21 nt, Human
ugugcgugcaugugugugugu

SEQ ID NO: 542246 - RNA, 31 nt, Human
ugugcgugcaugugugugugugugugugugg

SEQ ID NO: 542247 - RNA, 25 nt, Human
uguggauauauuuaauauauaugua

SEQ ID NO: 542248 - RNA, 20 nt, Human
ugugugcgugcaugugugug

SEQ ID NO: 542249 - RNA, 22 nt, Human
ugugugcgugcaugugugugug

SEQ ID NO: 542250 - RNA, 18 nt, Human
ugugugugugugugugug

SEQ ID NO: 542251 - RNA, 18 nt, Human
ugugugugugugugugug

SEQ ID NO: 542252 - RNA, 18 nt, Human
ugugugugugugugugug

SEQ ID NO: 542253 - RNA, 18 nt, Human
ugugugugugugugugug

SEQ ID NO: 542254 - RNA, 18 nt, Human
ugugugugugugugugug

SEQ ID NO: 542255 - RNA, 18 nt, Human
ugugugugugugugugug

SEQ ID NO: 542256 - RNA, 18 nt, Human
ugugugugugugugugug

SEQ ID NO: 542257 - RNA, 18 nt, Human
ugugugugugugugugug

SEQ ID NO: 542258 - RNA, 18 nt, Human
ugugugugugugugugug

SEQ ID NO: 542259 - RNA, 18 nt, Human
ugugugugugugugugug

SEQ ID NO: 542260 - RNA, 18 nt, Human
ugugugugugugugugug

SEQ ID NO: 542261 - RNA, 18 nt, Human
ugugugugugugugugug

SEQ ID NO: 542262 - RNA, 21 nt, Human
ugugugugugugugugugugu

SEQ ID NO: 542263 - RNA, 21 nt, Human
ugugugugugugugugugugu

SEQ ID NO: 542264 - RNA, 21 nt, Human
ugugugugugugugugugugu

SEQ ID NO: 542265 - RNA, 21 nt, Human
ugugugugugugugugugugu

SEQ ID NO: 542266 - RNA, 21 nt, Human
ugugugugugugugugugugu

SEQ ID NO: 542267 - RNA, 21 nt, Human
ugugugugugugugugugugu

SEQ ID NO: 542268 - RNA, 21 nt, Human
ugugugugugugugugugugu

SEQ ID NO: 542269 - RNA, 21 nt, Human
ugugugugugugugugugugu

SEQ ID NO: 542270 - RNA, 21 nt, Human
ugugugugugugugugugugu

SEQ ID NO: 542271 - RNA, 21 nt, Human
ugugugugugugugugugugu

SEQ ID NO: 542272 - RNA, 21 nt, Human
ugugugugugugugugugugu

SEQ ID NO: 542273 - RNA, 21 nt, Human
ugugugugugugugugugugu

SEQ ID NO: 542274 - RNA, 21 nt, Human
ugugugugugugugugugugu

SEQ ID NO: 542275 - RNA, 21 nt, Human
ugugugugugugugugugugu

SEQ ID NO: 542276 - RNA, 21 nt, Human
ugugugugugugugugugugu

SEQ ID NO: 542277 - RNA, 21 nt, Human
ugugugugugugugugugugu

SEQ ID NO: 542278 - RNA, 21 nt, Human
ugugugugugugugugugugu

SEQ ID NO: 542279 - RNA, 21 nt, Human
ugugugugugugugugugugu

SEQ ID NO: 542280 - RNA, 21 nt, Human
ugugugugugugugugugugu

SEQ ID NO: 542281 - RNA, 22 nt, Human
ugugugugugugugugugugug

SEQ ID NO: 542282 - RNA, 22 nt, Human
ugugugugugugugugugugug

SEQ ID NO: 542283 - RNA, 22 nt, Human
ugugugugugugugugugugug

SEQ ID NO: 542284 - RNA, 22 nt, Human
ugugugugugugugugugugug

SEQ ID NO: 542285 - RNA, 22 nt, Human
ugugugugugugugugugugug

SEQ ID NO: 542286 - RNA, 22 nt, Human
ugugugugugugugugugugug

SEQ ID NO: 542287 - RNA, 22 nt, Human
ugugugugugugugugugugug

SEQ ID NO: 542288 - RNA, 19 nt, Human
uguguguguguguguguug

SEQ ID NO: 542289 - RNA, 20 nt, Human
uguuuccaacuaagaauguu

SEQ ID NO: 542290 - RNA, 19 nt, Human
uuaaaaugagaaccagcca

SEQ ID NO: 542291 - RNA, 19 nt, Human
uuaaaccaucauauaacuc

SEQ ID NO: 542292 - RNA, 22 nt, Human
uuauaucuuuccaagaaaaauc

SEQ ID NO: 542293 - RNA, 24 nt, Human
uucaaaauacgugacauccacaga

SEQ ID NO: 542294 - RNA, 22 nt, Human
uucaacuugaacauucuuccac

SEQ ID NO: 542295 - RNA, 21 nt, Human
uucacagucagcggucucggg

SEQ ID NO: 542296 - RNA, 21 nt, Human
uuccagguucaauccuuuugc

SEQ ID NO: 542297 - RNA, 18 nt, Human
uuccccagguagaaugcu

SEQ ID NO: 542298 - RNA, 20 nt, Human
uugaauuacagcauuuguuu

SEQ ID NO: 542299 - RNA, 24 nt, Human
uuuacaguauuaugcuaaaggccu

SEQ ID NO: 542300 - RNA, 20 nt, Human
uuucauucauuuuuagcuua

SEQ ID NO: 542301 - RNA, 21 nt, Human
uuucuaaagggaaagaagggu

SEQ ID NO: 542302 - RNA, 23 nt, Human
uuugaaacauauaucauguagca

SEQ ID NO: 542303 - RNA, 23 nt, Human
aaacaccacagggcaucagaugc

SEQ ID NO: 542304 - RNA, 23 nt, Human
aagcaggaagggagauagcaggg

SEQ ID NO: 542305 - RNA, 22 nt, Human
aaggggcuuccuaaggugcccc

SEQ ID NO: 542306 - RNA, 22 nt, Human
aaguuucuaaccaucacaauuc

SEQ ID NO: 542307 - RNA, 21 nt, Human
aauggacuaaaaagcaaauac

SEQ ID NO: 542308 - RNA, 24 nt, Human
aauggacuaaaaagcaaauacuac

SEQ ID NO: 542309 - RNA, 20 nt, Human
acugaagcgaaggggcuucc

SEQ ID NO: 542310 - RNA, 23 nt, Human
aggcagcaccaaugguggcaccu

SEQ ID NO: 542311 - RNA, 18 nt, Human
aggugccccuuccaggcu

SEQ ID NO: 542312 - RNA, 22 nt, Human
auguugggguggaagugggagg

SEQ ID NO: 542313 - RNA, 22 nt, Human
caaaacacugaguuacaggcug

SEQ ID NO: 542314 - RNA, 24 nt, Human
caaaacacugaguuacaggcugug

SEQ ID NO: 542315 - RNA, 21 nt, Human
cagacaggcuaggacauggua

SEQ ID NO: 542316 - RNA, 19 nt, Human
cagaugcugcucugugugc

SEQ ID NO: 542317 - RNA, 21 nt, Human
ccuaaggugccccuuccaggg

SEQ ID NO: 542318 - RNA, 23 nt, Human
cgugggccucaugccacacugau

SEQ ID NO: 542319 - RNA, 20 nt, Human
gaaagguuuggguggcgugg

SEQ ID NO: 542320 - RNA, 21 nt, Human
gaagggagcacacccagaagc

SEQ ID NO: 542321 - RNA, 19 nt, Human
gaaguuucuaaccaucaca

SEQ ID NO: 542322 - RNA, 22 nt, Human
gagcacacccagaagcgagcaa

SEQ ID NO: 542323 - RNA, 23 nt, Human
gaggacggcuagcucuuuggaaa

SEQ ID NO: 542324 - RNA, 20 nt, Human
gcagcaccaaugguggcacc

SEQ ID NO: 542325 - RNA, 19 nt, Human
ggcagggagagggaaaggu

SEQ ID NO: 542326 - RNA, 23 nt, Human
ggggcagggagagggaaaggucu

SEQ ID NO: 542327 - RNA, 20 nt, Human
guucugugccugugaccuug

SEQ ID NO: 542328 - RNA, 21 nt, Human
uacaaaacacugaguuacagg

SEQ ID NO: 542329 - RNA, 20 nt, Human
uaggggcagggagagggaaa

SEQ ID NO: 542330 - RNA, 25 nt, Human
uaggggcagggagagggaaaggucu

SEQ ID NO: 542331 - RNA, 22 nt, Human
ucuuuuuuuaaaccaagccccu

SEQ ID NO: 542332 - RNA, 24 nt, Human
ugaguuacaggcugugggaagaga

SEQ ID NO: 542333 - RNA, 23 nt, Human
ugccccuuccaggcuugucucug

SEQ ID NO: 542334 - RNA, 24 nt, Human
ugcucugugugcucacaaguguuc

SEQ ID NO: 542335 - RNA, 18 nt, Human
ugggaagagaaggcagca

SEQ ID NO: 542336 - RNA, 19 nt, Human
ugggguggaagugggagga

SEQ ID NO: 542337 - RNA, 25 nt, Human
uggguggaggacggcuagcucuuug

SEQ ID NO: 542338 - RNA, 19 nt, Human
uuaccacuaacaaaugcag

SEQ ID NO: 542339 - RNA, 24 nt, Human
uucuaauacugguuguucuagggg

SEQ ID NO: 542340 - RNA, 21 nt, Human
uuuuuuuuuuuuuuuuugggu

SEQ ID NO: 542341 - RNA, 24 nt, Human
uuuuuuuuuuuuuuuuuuuuuggg

SEQ ID NO: 542342 - RNA, 19 nt, Human
aggcacaugacguagaaau

SEQ ID NO: 542343 - RNA, 19 nt, Human
cgagagcugggacguggcg

SEQ ID NO: 542344 - RNA, 23 nt, Human
gcggcgcuggcuguggggaacag

SEQ ID NO: 542345 - RNA, 19 nt, Human
gcgggcggcgcuggcugug

SEQ ID NO: 542346 - RNA, 23 nt, Human
uacaaaaugcaaauuucugcaua

SEQ ID NO: 542347 - RNA, 19 nt, Human
ucacccgccgcgcagcucc

SEQ ID NO: 542348 - RNA, 19 nt, Human
ucugcauaagauuuuuaag

SEQ ID NO: 542349 - RNA, 18 nt, Human
uggccgagagcugggacg

SEQ ID NO: 542350 - RNA, 19 nt, Human
uggccgagagcugggacgu

SEQ ID NO: 542351 - RNA, 22 nt, Human
uggcgggcggcgcuggcugugg

SEQ ID NO: 542352 - RNA, 23 nt, Human
uggcgggcggcgcuggcuguggg

SEQ ID NO: 542353 - RNA, 22 nt, Human
uuuuggaaaaugaaggugaaca

SEQ ID NO: 542354 - RNA, 23 nt, Human
aaagacaaaaagaaaagacccca

SEQ ID NO: 542355 - RNA, 20 nt, Human
aagaacauagaaaacccagc

SEQ ID NO: 542356 - RNA, 23 nt, Human
aagacaaaaagaaaagaccccaa

SEQ ID NO: 542357 - RNA, 21 nt, Human
aagcagccucguggugagagc

SEQ ID NO: 542358 - RNA, 20 nt, Human
aaggcccugcaggggacggg

SEQ ID NO: 542359 - RNA, 20 nt, Human
aaugacaaggacggccgaca

SEQ ID NO: 542360 - RNA, 23 nt, Human
acaaagacaaaaagaaaagaccc

SEQ ID NO: 542361 - RNA, 24 nt, Human
acaaagacaaaaagaaaagacccc

SEQ ID NO: 542362 - RNA, 21 nt, Human
acaccgccccaccccacgucu

SEQ ID NO: 542363 - RNA, 24 nt, Human
acacucgaaaagaacauagaaaac

SEQ ID NO: 542364 - RNA, 25 nt, Human
acacuucccggcaguacuggggaug

SEQ ID NO: 542365 - RNA, 23 nt, Human
acccugucacaccgccccacccc

SEQ ID NO: 542366 - RNA, 22 nt, Human
acuccgagggagacgguugaga

SEQ ID NO: 542367 - RNA, 19 nt, Human
agacaaaaagaaaagaccc

SEQ ID NO: 542368 - RNA, 20 nt, Human
agacaaaaagaaaagacccc

SEQ ID NO: 542369 - RNA, 21 nt, Human
agacaaaaagaaaagacccca

SEQ ID NO: 542370 - RNA, 22 nt, Human
agagagcaguacaaaucagcau

SEQ ID NO: 542371 - RNA, 19 nt, Human
agcacuccugcccaggugu

SEQ ID NO: 542372 - RNA, 20 nt, Human
agcagaaaaugucuuucccc

SEQ ID NO: 542373 - RNA, 20 nt, Human
aggaagcaggcccugccaac

SEQ ID NO: 542374 - RNA, 18 nt, Human
aggugcugggacuggcag

SEQ ID NO: 542375 - RNA, 19 nt, Human
aucucaucucccaccuccu

SEQ ID NO: 542376 - RNA, 22 nt, Human
aucucaucucccaccuccucua

SEQ ID NO: 542377 - RNA, 22 nt, Human
cacaccgccccaccccacgucu

SEQ ID NO: 542378 - RNA, 20 nt, Human
caccagaggcucggugaccc

SEQ ID NO: 542379 - RNA, 19 nt, Human
cacugggcguggcucagga

SEQ ID NO: 542380 - RNA, 20 nt, Human
cagcucccacacaccagccc

SEQ ID NO: 542381 - RNA, 22 nt, Human
cagcucccacacaccagccccu

SEQ ID NO: 542382 - RNA, 19 nt, Human
caggaaaaggcccugcagg

SEQ ID NO: 542383 - RNA, 21 nt, Human
cagggcaguggggcucccagg

SEQ ID NO: 542384 - RNA, 22 nt, Human
cagguagcagcucccacacacc

SEQ ID NO: 542385 - RNA, 21 nt, Human
caguacaaaucagcaugcggu

SEQ ID NO: 542386 - RNA, 23 nt, Human
cauagaaaacccagcagagagca

SEQ ID NO: 542387 - RNA, 19 nt, Human
ccaccccagaugaguggca

SEQ ID NO: 542388 - RNA, 25 nt, Human
ccaccuccucuacccugucacaccg

SEQ ID NO: 542389 - RNA, 21 nt, Human
ccagccccuggcucucaacug

SEQ ID NO: 542390 - RNA, 22 nt, Human
ccagccccuggcucucaacugu

SEQ ID NO: 542391 - RNA, 23 nt, Human
ccagccccuggcucucaacugua

SEQ ID NO: 542392 - RNA, 26 nt, Human
cccaccuccucuacccugucacaccg

SEQ ID NO: 542393 - RNA, 18 nt, Human
cccaugcccgcugccccg

SEQ ID NO: 542394 - RNA, 23 nt, Human
cccaugcccgcugccccguccac

SEQ ID NO: 542395 - RNA, 24 nt, Human
cccaugcccgcugccccguccaca

SEQ ID NO: 542396 - RNA, 22 nt, Human
ccccagaugaguggcaggaaaa

SEQ ID NO: 542397 - RNA, 20 nt, Human
cccugagacuccgagggaga

SEQ ID NO: 542398 - RNA, 22 nt, Human
cccuggagaaagggggacuggc

SEQ ID NO: 542399 - RNA, 21 nt, Human
cccuugaaagaaucaucuccu

SEQ ID NO: 542400 - RNA, 19 nt, Human
ccgcagccagcgaaccccc

SEQ ID NO: 542401 - RNA, 21 nt, Human
ccugccuagggcugcucccca

SEQ ID NO: 542402 - RNA, 24 nt, Human
ccugccuagggcugcuccccaccc

SEQ ID NO: 542403 - RNA, 18 nt, Human
ccuggggucaaguugggg

SEQ ID NO: 542404 - RNA, 22 nt, Human
ccugugcggaagaucucaucuc

SEQ ID NO: 542405 - RNA, 25 nt, Human
cucccaccuccucuacccugucaca

SEQ ID NO: 542406 - RNA, 22 nt, Human
cuccuuggaaaaaccaggaccu

SEQ ID NO: 542407 - RNA, 24 nt, Human
cuggggucaaguugggggaagggg

SEQ ID NO: 542408 - RNA, 23 nt, Human
cugguacacaaagacaaaaagaa

SEQ ID NO: 542409 - RNA, 24 nt, Human
cugguacacaaagacaaaaagaaa

SEQ ID NO: 542410 - RNA, 19 nt, Human
gaggugcugggacuggcag

SEQ ID NO: 542411 - RNA, 21 nt, Human
gaguggcaggaaaaggcccug

SEQ ID NO: 542412 - RNA, 22 nt, Human
gccccuggcucucaacuguacg

SEQ ID NO: 542413 - RNA, 21 nt, Human
gcccgcugccccguccacacc

SEQ ID NO: 542414 - RNA, 20 nt, Human
gcucccaggaugcaagggga

SEQ ID NO: 542415 - RNA, 19 nt, Human
gcugcuccccaccccagau

SEQ ID NO: 542416 - RNA, 22 nt, Human
ggaagcaggcccugccaacucg

SEQ ID NO: 542417 - RNA, 18 nt, Human
ggagagaagcugccugug

SEQ ID NO: 542418 - RNA, 19 nt, Human
ggccggagccggggccgca

SEQ ID NO: 542419 - RNA, 22 nt, Human
ggccggagccggggccgcagcc

SEQ ID NO: 542420 - RNA, 18 nt, Human
gggucaaguugggggaag

SEQ ID NO: 542421 - RNA, 25 nt, Human
gguacacaaagacaaaaagaaaaga

SEQ ID NO: 542422 - RNA, 22 nt, Human
gguagcagcucccacacaccag

SEQ ID NO: 542423 - RNA, 27 nt, Human
guaaaaaccaagacauuuauauaaaua

SEQ ID NO: 542424 - RNA, 24 nt, Human
uacacaaagacaaaaagaaaagac

SEQ ID NO: 542425 - RNA, 20 nt, Human
uacuggggauggcagggcag

SEQ ID NO: 542426 - RNA, 25 nt, Human
ucacaccgccccaccccacgucucc

SEQ ID NO: 542427 - RNA, 20 nt, Human
ucccacacagacccaugccc

SEQ ID NO: 542428 - RNA, 18 nt, Human
ucccaccuccucuacccu

SEQ ID NO: 542429 - RNA, 18 nt, Human
uccccaccaaggcugggg

SEQ ID NO: 542430 - RNA, 18 nt, Human
uccccagaggacaaggag

SEQ ID NO: 542431 - RNA, 18 nt, Human
uccccggggggugcugcu

SEQ ID NO: 542432 - RNA, 22 nt, Human
uccccggggggugcugcuccug

SEQ ID NO: 542433 - RNA, 25 nt, Human
uccccggggggugcugcuccugcgg

SEQ ID NO: 542434 - RNA, 18 nt, Human
ucccugcggaagcagccu

SEQ ID NO: 542435 - RNA, 21 nt, Human
ucuacuaaaacccuuuuccca

SEQ ID NO: 542436 - RNA, 24 nt, Human
ucucccaccuccucuacccuguca

SEQ ID NO: 542437 - RNA, 21 nt, Human
ugcaaggggaaggcagcccug

SEQ ID NO: 542438 - RNA, 19 nt, Human
ugcccaggugucccaccag

SEQ ID NO: 542439 - RNA, 23 nt, Human
ugcccaggugucccaccagaggc

SEQ ID NO: 542440 - RNA, 22 nt, Human
ugccccguccacacccugagac

SEQ ID NO: 542441 - RNA, 19 nt, Human
ugcggaagaucucaucucc

SEQ ID NO: 542442 - RNA, 24 nt, Human
uggaaaaaccaggaccugccuagg

SEQ ID NO: 542443 - RNA, 19 nt, Human
ugggggcugggggggcugc

SEQ ID NO: 542444 - RNA, 20 nt, Human
ugggggcugggggggcugcu

SEQ ID NO: 542445 - RNA, 21 nt, Human
uuccugugcggaagaucucau

SEQ ID NO: 542446 - RNA, 19 nt, Human
uucugaggggucagcaccu

SEQ ID NO: 542447 - RNA, 24 nt, Human
aaaaauugcauaaagauccaugca

SEQ ID NO: 542448 - RNA, 21 nt, Human
aaaaguagacaaaauaugucc

SEQ ID NO: 542449 - RNA, 22 nt, Human
aaaguaacucaauucagacaac

SEQ ID NO: 542450 - RNA, 19 nt, Human
aaauagcccuugcccaaag

SEQ ID NO: 542451 - RNA, 18 nt, Human
aagcuccccgcugcuccc

SEQ ID NO: 542452 - RNA, 26 nt, Human
agaagcaaacucucuaccagacagaa

SEQ ID NO: 542453 - RNA, 20 nt, Human
agaagccaguuuaugcccau

SEQ ID NO: 542454 - RNA, 22 nt, Human
agacagaaacaaggauguauga

SEQ ID NO: 542455 - RNA, 19 nt, Human
aggaaagccugcaugagag

SEQ ID NO: 542456 - RNA, 22 nt, Human
aggccaagaccagggaaaugga

SEQ ID NO: 542457 - RNA, 23 nt, Human
aggcuagaccugggauggcggca

SEQ ID NO: 542458 - RNA, 18 nt, Human
agguuuucugaaacaguu

SEQ ID NO: 542459 - RNA, 23 nt, Human
auaauucucaaaaguagacaaaa

SEQ ID NO: 542460 - RNA, 23 nt, Human
aucuccccuggaucauucuguua

SEQ ID NO: 542461 - RNA, 21 nt, Human
caucugcgucuugguuaagga

SEQ ID NO: 542462 - RNA, 18 nt, Human
ccaaagcuuaaucucccc

SEQ ID NO: 542463 - RNA, 19 nt, Human
ccauccuaugccaccacuu

SEQ ID NO: 542464 - RNA, 23 nt, Human
ccauuccauccuuucuggucaug

SEQ ID NO: 542465 - RNA, 20 nt, Human
ccccgcugcucccucccuua

SEQ ID NO: 542466 - RNA, 19 nt, Human
ccccuuuccucuucuaacc

SEQ ID NO: 542467 - RNA, 19 nt, Human
cguggccuccuagccucaa

SEQ ID NO: 542468 - RNA, 18 nt, Human
cuccccgcugcucccucc

SEQ ID NO: 542469 - RNA, 24 nt, Human
cuccccgcugcucccucccuuaau

SEQ ID NO: 542470 - RNA, 21 nt, Human
cuccccuuuccucuucuaacc

SEQ ID NO: 542471 - RNA, 26 nt, Human
cuccuagccucaacacccucuugguc

SEQ ID NO: 542472 - RNA, 18 nt, Human
cugcaagcuccccgcugc

SEQ ID NO: 542473 - RNA, 20 nt, Human
cuggaaagggauucagaagc

SEQ ID NO: 542474 - RNA, 22 nt, Human
cuguacccucccaauuucuuuu

SEQ ID NO: 542475 - RNA, 24 nt, Human
cuucuaaccaugcucugaauugcc

SEQ ID NO: 542476 - RNA, 27 nt, Human
gagaauaguaaaggauugccgguaccc

SEQ ID NO: 542477 - RNA, 19 nt, Human
gauagaguggauucuagaa

SEQ ID NO: 542478 - RNA, 22 nt, Human
gcaaacucucuaccagacagaa

SEQ ID NO: 542479 - RNA, 21 nt, Human
gcccauacuuaauucuagaca

SEQ ID NO: 542480 - RNA, 22 nt, Human
gccuccuagccucaacacccuc

SEQ ID NO: 542481 - RNA, 21 nt, Human
ggaaagggauucagaagccag

SEQ ID NO: 542482 - RNA, 19 nt, Human
gguuugauuccuuucuccu

SEQ ID NO: 542483 - RNA, 18 nt, Human
gugaagcagaaguuuccc

SEQ ID NO: 542484 - RNA, 21 nt, Human
uaccauccuaugccaccacuu

SEQ ID NO: 542485 - RNA, 19 nt, Human
uagcacugcaggagcugag

SEQ ID NO: 542486 - RNA, 18 nt, Human
uaguaaaggauugcccuc

SEQ ID NO: 542487 - RNA, 21 nt, Human
uaguaaaggauugcccucucg

SEQ ID NO: 542488 - RNA, 24 nt, Human
uaucaaaguaacucaauucagaca

SEQ ID NO: 542489 - RNA, 23 nt, Human
ucacugcaagcuccccgcugcuc

SEQ ID NO: 542490 - RNA, 19 nt, Human
ucagaagccaguuuaugcc

SEQ ID NO: 542491 - RNA, 22 nt, Human
ucgcucuaacgcuucuucccau

SEQ ID NO: 542492 - RNA, 28 nt, Human
ucguggccuccuagccucaacacccucu

SEQ ID NO: 542493 - RNA, 20 nt, Human
ucuaacgcuucuucccaucu

SEQ ID NO: 542494 - RNA, 26 nt, Human
ucuacccuaccauccuaugccaccac

SEQ ID NO: 542495 - RNA, 22 nt, Human
ucuagaauccaucccauauuuc

SEQ ID NO: 542496 - RNA, 19 nt, Human
ucucagcucuagaagugaa

SEQ ID NO: 542497 - RNA, 23 nt, Human
ucuccagcuuugagacuccccuu

SEQ ID NO: 542498 - RNA, 24 nt, Human
ucucuaccagacagaaacaaggau

SEQ ID NO: 542499 - RNA, 25 nt, Human
ucugugguuugauuccuuucuccug

SEQ ID NO: 542500 - RNA, 25 nt, Human
ucuucuaaccaugcucugaauugcc

SEQ ID NO: 542501 - RNA, 23 nt, Human
ucuuuuuucccucccaaauuucu

SEQ ID NO: 542502 - RNA, 21 nt, Human
ugcauaaagauccaugcauga

SEQ ID NO: 542503 - RNA, 25 nt, Human
ugccugacccuuuugagagaauuua

SEQ ID NO: 542504 - RNA, 24 nt, Human
ugcuuugacccugcuucucagcuc

SEQ ID NO: 542505 - RNA, 22 nt, Human
uggaaaaaaauugcauaaagau

SEQ ID NO: 542506 - RNA, 23 nt, Human
uggccuccuagccucaacacccu

SEQ ID NO: 542507 - RNA, 24 nt, Human
uggcggcaagaauucuauacagaa

SEQ ID NO: 542508 - RNA, 22 nt, Human
uucuagaaguauggacagagau

SEQ ID NO: 542509 - RNA, 22 nt, Human
uugcuccuaaggcuagaccugg

SEQ ID NO: 542510 - RNA, 22 nt, Human
uuugacccugcuucucagcucu

SEQ ID NO: 542511 - RNA, 22 nt, Human
uuugagacuccccuuuccucuu

SEQ ID NO: 542512 - RNA, 21 nt, Human
uuugcuccuaaggcuagaccu

SEQ ID NO: 542513 - RNA, 24 nt, Human
uuuuuuuucaagguaaccaugaca

SEQ ID NO: 542514 - RNA, 25 nt, Human
uuuuuuuuuuuuuuuuuuuucaagg

SEQ ID NO: 542515 - RNA, 18 nt, Human
acccaccccuucccuccg

SEQ ID NO: 542516 - RNA, 25 nt, Human
acccugaaggggccacuguuggggg

SEQ ID NO: 542517 - RNA, 18 nt, Human
agcgagaggcugggaggg

SEQ ID NO: 542518 - RNA, 21 nt, Human
cagacccaccgacccaccccu

SEQ ID NO: 542519 - RNA, 20 nt, Human
ccgacccaccccuucccucc

SEQ ID NO: 542520 - RNA, 26 nt, Human
ccgucccacagauggggaacggaggu

SEQ ID NO: 542521 - RNA, 19 nt, Human
gccccugguccacgcccag

SEQ ID NO: 542522 - RNA, 18 nt, Human
gccuacgcagacccgcug

SEQ ID NO: 542523 - RNA, 19 nt, Human
ggagcgagaggcugggagg

SEQ ID NO: 542524 - RNA, 20 nt, Human
guggcugccacccugaaggg

SEQ ID NO: 542525 - RNA, 18 nt, Human
ugccuuggggccucacug

SEQ ID NO: 542526 - RNA, 19 nt, Human
uggggccucacugaagggu

SEQ ID NO: 542527 - RNA, 23 nt, Human
uguccaugccccugguccacgcc

SEQ ID NO: 542528 - RNA, 20 nt, Human
uuccucagagccagggucug

SEQ ID NO: 542529 - RNA, 20 nt, Human
acaagcucagaccuuccaaa

SEQ ID NO: 542530 - RNA, 18 nt, Human
acagaaaggggcagcuag

SEQ ID NO: 542531 - RNA, 21 nt, Human
caaaggagccacgccauuggc

SEQ ID NO: 542532 - RNA, 23 nt, Human
caaccacuuucuuuucacaagcu

SEQ ID NO: 542533 - RNA, 24 nt, Human
cagcuuccuccaaccucagaccaa

SEQ ID NO: 542534 - RNA, 25 nt, Human
ccauuggccuucccaaauaccuccu

SEQ ID NO: 542535 - RNA, 21 nt, Human
ccuccaaccucagaccaacca

SEQ ID NO: 542536 - RNA, 20 nt, Human
cuccaaccucagaccaaccu

SEQ ID NO: 542537 - RNA, 20 nt, Human
cuuccaauuuccaccacucc

SEQ ID NO: 542538 - RNA, 18 nt, Human
cuucccaaauaccuccug

SEQ ID NO: 542539 - RNA, 21 nt, Human
ggagccacgccauuggccuuc

SEQ ID NO: 542540 - RNA, 23 nt, Human
uaaauaccaacuuucacuauuac

SEQ ID NO: 542541 - RNA, 25 nt, Human
ucaaaggagccacgccauuggccuu

SEQ ID NO: 542542 - RNA, 19 nt, Human
uccaccacucccaaccguc

SEQ ID NO: 542543 - RNA, 19 nt, Human
uccauucagcuuccuccaa

SEQ ID NO: 542544 - RNA, 23 nt, Human
ucccaaauaccuccugguauccu

SEQ ID NO: 542545 - RNA, 22 nt, Human
ugguauccuuccaauuuccacc

SEQ ID NO: 542546 - RNA, 20 nt, Human
uucagcuuccuccaaccuca

SEQ ID NO: 542547 - RNA, 18 nt, Human
uuccaccacucccaaccg

SEQ ID NO: 542548 - RNA, 18 nt, Human
aaagagggaugggcggcg

SEQ ID NO: 542549 - RNA, 21 nt, Human
aagaaccuuucccaaauccac

SEQ ID NO: 542550 - RNA, 25 nt, Human
aagaguccucccgccugcaacuucc

SEQ ID NO: 542551 - RNA, 18 nt, Human
acaaagagggaugggcgg

SEQ ID NO: 542552 - RNA, 21 nt, Human
accagcuccgcggcuuuccaa

SEQ ID NO: 542553 - RNA, 20 nt, Human
caaaauaacuaauaccaaau

SEQ ID NO: 542554 - RNA, 23 nt, Human
caaaauaacuaauaccaaauaua

SEQ ID NO: 542555 - RNA, 24 nt, Human
caacaccaacuguagccaccacca

SEQ ID NO: 542556 - RNA, 20 nt, Human
caacuucccgguaacguccc

SEQ ID NO: 542557 - RNA, 22 nt, Human
cagcuauauuaaaaaaugacac

SEQ ID NO: 542558 - RNA, 21 nt, Human
cccccaacaccaacuguagcc

SEQ ID NO: 542559 - RNA, 21 nt, Human
cgccuaagcccccaacaccaa

SEQ ID NO: 542560 - RNA, 19 nt, Human
cuaagcccccaacaccaac

SEQ ID NO: 542561 - RNA, 26 nt, Human
cuacggcuaaggagaaaccggggucc

SEQ ID NO: 542562 - RNA, 20 nt, Human
cucgccuaagcccccaacac

SEQ ID NO: 542563 - RNA, 22 nt, Human
cuuaagaaccuuucccaaaucc

SEQ ID NO: 542564 - RNA, 19 nt, Human
gaacucaaaauaacuaaua

SEQ ID NO: 542565 - RNA, 24 nt, Human
gcagaacuuauuucaucugugcuu

SEQ ID NO: 542566 - RNA, 21 nt, Human
gccuaagcccccaacaccaac

SEQ ID NO: 542567 - RNA, 23 nt, Human
gccuaagcccccaacaccaacug

SEQ ID NO: 542568 - RNA, 24 nt, Human
uaaagacaacaaaggaugucagaa

SEQ ID NO: 542569 - RNA, 26 nt, Human
uaagcccccaacaccaacuguagccu

SEQ ID NO: 542570 - RNA, 21 nt, Human
uaaguugaaaagaacucaaaa

SEQ ID NO: 542571 - RNA, 19 nt, Human
uaauccaugaaauuuccuu

SEQ ID NO: 542572 - RNA, 21 nt, Human
uagaaauaacuguauacagug

SEQ ID NO: 542573 - RNA, 21 nt, Human
uagaauucaaaaaagcugcuu

SEQ ID NO: 542574 - RNA, 20 nt, Human
ugaaaagaacucaaaauaac

SEQ ID NO: 542575 - RNA, 25 nt, Human
ugacacaaauccaaaacaagaugca

SEQ ID NO: 542576 - RNA, 19 nt, Human
uggggaagaguccucccgc

SEQ ID NO: 542577 - RNA, 21 nt, Human
uuagacagaagcaugcaaaua

SEQ ID NO: 542578 - RNA, 22 nt, Human
uucccaaauccacuaguuacac

SEQ ID NO: 542579 - RNA, 23 nt, Human
aaacaaaaaaggggguauauuaa

SEQ ID NO: 542580 - RNA, 23 nt, Human
aaccacacacacacacacacaca

SEQ ID NO: 542581 - RNA, 19 nt, Human
aaccucugcauuuuucuuu

SEQ ID NO: 542582 - RNA, 26 nt, Human
aagccauauauauauauauauaugua

SEQ ID NO: 542583 - RNA, 23 nt, Human
aagucacaaacaaaaaagggggu

SEQ ID NO: 542584 - RNA, 20 nt, Human
aauaaccucugcauuuuucu

SEQ ID NO: 542585 - RNA, 25 nt, Human
acacacacacacacacacacacgac

SEQ ID NO: 542586 - RNA, 24 nt, Human
accacacacacacacacacacaca

SEQ ID NO: 542587 - RNA, 21 nt, Human
agaaaacagaauaaauggcuu

SEQ ID NO: 542588 - RNA, 19 nt, Human
aggaucagugauugagaca

SEQ ID NO: 542589 - RNA, 18 nt, Human
aggcaaagccauauauau

SEQ ID NO: 542590 - RNA, 19 nt, Human
aggcaaagccauauauaua

SEQ ID NO: 542591 - RNA, 24 nt, Human
aggcggcugaggcgguggcggugg

SEQ ID NO: 542592 - RNA, 20 nt, Human
aggcgguggcgguggaggcg

SEQ ID NO: 542593 - RNA, 24 nt, Human
aggcgguggcgguggaggcggcgg

SEQ ID NO: 542594 - RNA, 18 nt, Human
aucacaccacucccggca

SEQ ID NO: 542595 - RNA, 19 nt, Human
auggcaaugcaaacagcaa

SEQ ID NO: 542596 - RNA, 21 nt, Human
auggcaaugcaaacagcaauc

SEQ ID NO: 542597 - RNA, 26 nt, Human
caaaauggcaaugcaaacagcaaucc

SEQ ID NO: 542598 - RNA, 20 nt, Human
cacacacacacacacacaca

SEQ ID NO: 542599 - RNA, 20 nt, Human
cacacacacacacacacaca

SEQ ID NO: 542600 - RNA, 22 nt, Human
cacacacacacacacacacaca

SEQ ID NO: 542601 - RNA, 26 nt, Human
cacacacacacacacacacacacacg

SEQ ID NO: 542602 - RNA, 25 nt, Human
cacacacacgacauaaauuuagucc

SEQ ID NO: 542603 - RNA, 21 nt, Human
cacacgacauaaauuuagucc

SEQ ID NO: 542604 - RNA, 19 nt, Human
cauauauauauauauauau

SEQ ID NO: 542605 - RNA, 22 nt, Human
caucugaagaagcacuccagcu

SEQ ID NO: 542606 - RNA, 19 nt, Human
ccacacacacacacacaca

SEQ ID NO: 542607 - RNA, 21 nt, Human
ccacacacacacacacacaca

SEQ ID NO: 542608 - RNA, 26 nt, Human
cuaaaauaagcuuagacuuccaaguc

SEQ ID NO: 542609 - RNA, 19 nt, Human
cugcauuuuucuuuuacac

SEQ ID NO: 542610 - RNA, 22 nt, Human
cuucuguacggcuccuucuaaa

SEQ ID NO: 542611 - RNA, 22 nt, Human
gaggcggcugaggcgguggcgg

SEQ ID NO: 542612 - RNA, 22 nt, Human
gcaaugcaaacagcaauccuac

SEQ ID NO: 542613 - RNA, 31 nt, Human
gguaaccacacacacacacacacacacacag

SEQ ID NO: 542614 - RNA, 18 nt, Human
ggugguacauuuauugug

SEQ ID NO: 542615 - RNA, 18 nt, Human
uaaaaaauggguaaccac

SEQ ID NO: 542616 - RNA, 21 nt, Human
uaucccagaaaacagaauaaa

SEQ ID NO: 542617 - RNA, 28 nt, Human
ucagugauugagacaaugaccggggucc

SEQ ID NO: 542618 - RNA, 22 nt, Human
ucaguuaaagcaacaccuuggc

SEQ ID NO: 542619 - RNA, 25 nt, Human
uccucaguuaaagcaacaccuuggc

SEQ ID NO: 542620 - RNA, 20 nt, Human
ugaaugcagagaauaaauac

SEQ ID NO: 542621 - RNA, 18 nt, Human
ugaggcgguggcggugga

SEQ ID NO: 542622 - RNA, 18 nt, Human
uuaaagcaacaccuuggc

SEQ ID NO: 542623 - RNA, 24 nt, Human
uugaaggaaaaggcagaggcaugu

SEQ ID NO: 542624 - RNA, 23 nt, Human
uuuacauuaucccagaaaacaga

SEQ ID NO: 542625 - RNA, 23 nt, Human
uuuuucuucuguacggcuccuuc

SEQ ID NO: 542626 - RNA, 19 nt, Human
aaaguucaucuccccugcc

SEQ ID NO: 542627 - RNA, 20 nt, Human
aaaguucaucuccccugccc

SEQ ID NO: 542628 - RNA, 21 nt, Human
ccaaaaaacugauagcaugug

SEQ ID NO: 542629 - RNA, 21 nt, Human
ccccaaaaaacugauagcaug

SEQ ID NO: 542630 - RNA, 24 nt, Human
cugccccaaaaaacugauagcaug

SEQ ID NO: 542631 - RNA, 23 nt, Human
uaucagaaaaauccuggucuuag

SEQ ID NO: 542632 - RNA, 24 nt, Human
aaccacagaaauuaaucugggucu

SEQ ID NO: 542633 - RNA, 22 nt, Human
aacucgaaagaauguuccacaa

SEQ ID NO: 542634 - RNA, 25 nt, Human
acagugaaaagagcacacacuagua

SEQ ID NO: 542635 - RNA, 23 nt, Human
acucgaaagaauguuccacaaag

SEQ ID NO: 542636 - RNA, 22 nt, Human
agacuuauucuguaacaaccac

SEQ ID NO: 542637 - RNA, 19 nt, Human
agcagcuagcauuuuaaau

SEQ ID NO: 542638 - RNA, 18 nt, Human
agugacggcggcggcggg

SEQ ID NO: 542639 - RNA, 22 nt, Human
agugacggcggcggcgguggca

SEQ ID NO: 542640 - RNA, 21 nt, Human
auuagacuuauucuguaacaa

SEQ ID NO: 542641 - RNA, 19 nt, Human
auuucauucggguuaggaa

SEQ ID NO: 542642 - RNA, 21 nt, Human
auuucauucggguuaggaaua

SEQ ID NO: 542643 - RNA, 19 nt, Human
ccacaaaacgaacauuuca

SEQ ID NO: 542644 - RNA, 19 nt, Human
ccacagaaauuaaucuggg

SEQ ID NO: 542645 - RNA, 19 nt, Human
cccaugcacagaauaaggc

SEQ ID NO: 542646 - RNA, 23 nt, Human
cgggagccggagccaggacgcag

SEQ ID NO: 542647 - RNA, 26 nt, Human
cucuacucagaaagccggcacucaaa

SEQ ID NO: 542648 - RNA, 22 nt, Human
gagcacacacuaguagaagcac

SEQ ID NO: 542649 - RNA, 19 nt, Human
gagggcgcgggagccggag

SEQ ID NO: 542650 - RNA, 20 nt, Human
gcagugacggcggcggcggu

SEQ ID NO: 542651 - RNA, 25 nt, Human
ggacgcagugacggcggcggcggug

SEQ ID NO: 542652 - RNA, 22 nt, Human
gugacggcggcggcgguggcuu

SEQ ID NO: 542653 - RNA, 24 nt, Human
uaacucuacucagaaagccggcac

SEQ ID NO: 542654 - RNA, 21 nt, Human
uagaagcacacaguuuagaga

SEQ ID NO: 542655 - RNA, 20 nt, Human
ucaacaaaacagugcagaaa

SEQ ID NO: 542656 - RNA, 23 nt, Human
uccaaacuaaaagcugcagaaaa

SEQ ID NO: 542657 - RNA, 24 nt, Human
uccaaacuaaaagcugcagaaaau

SEQ ID NO: 542658 - RNA, 21 nt, Human
uccacaaaguucaacaaaaca

SEQ ID NO: 542659 - RNA, 21 nt, Human
ugaaaagagcacacacuagua

SEQ ID NO: 542660 - RNA, 24 nt, Human
ugaaaagagcacacacuaguagaa

SEQ ID NO: 542661 - RNA, 27 nt, Human
ugaaaagagcacacacuaguagaagca

SEQ ID NO: 542662 - RNA, 21 nt, Human
ugagcagcuagcauuuuaaau

SEQ ID NO: 542663 - RNA, 20 nt, Human
uguaguaucucaucuuuuug

SEQ ID NO: 542664 - RNA, 20 nt, Human
uucaacaaaacagugcagaa

SEQ ID NO: 542665 - RNA, 20 nt, Human
uugaaaaauaauccaaaaaa

SEQ ID NO: 542666 - RNA, 24 nt, Human
uugauuagacuuauucuguaacaa

SEQ ID NO: 542667 - RNA, 18 nt, Human
uuuuccacaaaacgaaca

SEQ ID NO: 542668 - RNA, 19 nt, Human
aaguggccccaaggaagcg

SEQ ID NO: 542669 - RNA, 22 nt, Human
acagccucccgggaugucaaaa

SEQ ID NO: 542670 - RNA, 21 nt, Human
agaaggaaguggccccaagga

SEQ ID NO: 542671 - RNA, 27 nt, Human
ccaacccagugucgcuuaaacagccuu

SEQ ID NO: 542672 - RNA, 18 nt, Human
ccggcggcacagccuccc

SEQ ID NO: 542673 - RNA, 20 nt, Human
cguugcuaggaaaaaaagaa

SEQ ID NO: 542674 - RNA, 23 nt, Human
cguugcuaggaaaaaaagaagga

SEQ ID NO: 542675 - RNA, 22 nt, Human
cucaggccggcggcacagccuc

SEQ ID NO: 542676 - RNA, 21 nt, Human
gccaaguguuuccaacccagu

SEQ ID NO: 542677 - RNA, 20 nt, Human
gcuuaaacagccuuggccau

SEQ ID NO: 542678 - RNA, 21 nt, Human
ggaggccgcgaaacucugggc

SEQ ID NO: 542679 - RNA, 19 nt, Human
ucaaaaacgcuacccgccg

SEQ ID NO: 542680 - RNA, 22 nt, Human
ucgcuuaaacagccuuggccau

SEQ ID NO: 542681 - RNA, 21 nt, Human
aaaguagcuauuaccaaugca

SEQ ID NO: 542682 - RNA, 24 nt, Human
aaauggacccagaauuggaagggc

SEQ ID NO: 542683 - RNA, 21 nt, Human
aagaagcucagaaaaaacuaa

SEQ ID NO: 542684 - RNA, 18 nt, Human
acaguaugcacaccacag

SEQ ID NO: 542685 - RNA, 23 nt, Human
acaucaaaggcugcaaagaagcu

SEQ ID NO: 542686 - RNA, 21 nt, Human
accaagucuuucuagauaauc

SEQ ID NO: 542687 - RNA, 24 nt, Human
acucugaaaacacggggccccagu

SEQ ID NO: 542688 - RNA, 23 nt, Human
agucauaugaaauguugucuugg

SEQ ID NO: 542689 - RNA, 21 nt, Human
caaauggacccagaauuggaa

SEQ ID NO: 542690 - RNA, 20 nt, Human
caaugcauacauacaguaca

SEQ ID NO: 542691 - RNA, 21 nt, Human
cacaccacagccaugucagug

SEQ ID NO: 542692 - RNA, 22 nt, Human
cacagauccucuugugcauuca

SEQ ID NO: 542693 - RNA, 24 nt, Human
cagguuuaaguaugaaucaaagca

SEQ ID NO: 542694 - RNA, 22 nt, Human
cauuccugcuuucagguuuaag

SEQ ID NO: 542695 - RNA, 23 nt, Human
ccacaggcaaacugcuuugcaca

SEQ ID NO: 542696 - RNA, 20 nt, Human
cuaaaaggaacugaccauca

SEQ ID NO: 542697 - RNA, 19 nt, Human
gcaauacacaggaguucau

SEQ ID NO: 542698 - RNA, 22 nt, Human
gcauucagcuuucuuaaaaaca

SEQ ID NO: 542699 - RNA, 19 nt, Human
ggccacggcaaugaauggc

SEQ ID NO: 542700 - RNA, 21 nt, Human
uaaaaacacaucaaaggcugc

SEQ ID NO: 542701 - RNA, 24 nt, Human
uaaauugaaggacagguggaauac

SEQ ID NO: 542702 - RNA, 27 nt, Human
uaaguaugaaucaaagcauauuuuaau

SEQ ID NO: 542703 - RNA, 21 nt, Human
uacacaguaugcacaccacag

SEQ ID NO: 542704 - RNA, 22 nt, Human
uaccaagucuuucuagauaauc

SEQ ID NO: 542705 - RNA, 18 nt, Human
uagauggcuguuuuuaau

SEQ ID NO: 542706 - RNA, 26 nt, Human
uauaguacaugcauuauagucauaug

SEQ ID NO: 542707 - RNA, 19 nt, Human
uaugcacaccacagccaug

SEQ ID NO: 542708 - RNA, 23 nt, Human
uauguaacuacacaguaugcaca

SEQ ID NO: 542709 - RNA, 21 nt, Human
uaugugaggaacuugccaacu

SEQ ID NO: 542710 - RNA, 21 nt, Human
ucaaaggcugcaaagaagcuc

SEQ ID NO: 542711 - RNA, 22 nt, Human
ucacaucuuucaaagccagauc

SEQ ID NO: 542712 - RNA, 25 nt, Human
ucagaaaaaacuaaauugaaggaca

SEQ ID NO: 542713 - RNA, 18 nt, Human
uccacaggcaaacugcuu

SEQ ID NO: 542714 - RNA, 20 nt, Human
uccacaggcaaacugcuuug

SEQ ID NO: 542715 - RNA, 20 nt, Human
ucugcaauuuagaauacacu

SEQ ID NO: 542716 - RNA, 18 nt, Human
ugcauacauacaguacac

SEQ ID NO: 542717 - RNA, 19 nt, Human
ugucuuggugcuuucuucu

SEQ ID NO: 542718 - RNA, 23 nt, Human
ugugauguguucugcaauuugga

SEQ ID NO: 542719 - RNA, 22 nt, Human
ugugugauguguucugcaauuu

SEQ ID NO: 542720 - RNA, 24 nt, Human
uuacacaggucaucuuauccacag

SEQ ID NO: 542721 - RNA, 18 nt, Human
uuucuagauaaucaaggg

SEQ ID NO: 542722 - RNA, 21 nt, Human
uuuuuuuuuuuugaaacagcc

SEQ ID NO: 542723 - RNA, 18 nt, Human
uuuuuuuuuuuuuuuuug

SEQ ID NO: 542724 - RNA, 23 nt, Human
cagcugagaacuuccccucucag

SEQ ID NO: 542725 - RNA, 21 nt, Human
caggucccccgcgugccccuu

SEQ ID NO: 542726 - RNA, 22 nt, Human
ccaccgcgccgccugccccgcc

SEQ ID NO: 542727 - RNA, 19 nt, Human
ccagcuucagcucagcuga

SEQ ID NO: 542728 - RNA, 24 nt, Human
ccccgccccucacuagcuuugcag

SEQ ID NO: 542729 - RNA, 20 nt, Human
cccgcccccaccgcgccgcc

SEQ ID NO: 542730 - RNA, 24 nt, Human
ccgcacucguaggccuucaucacc

SEQ ID NO: 542731 - RNA, 19 nt, Human
ccgcgccgccugccccgcc

SEQ ID NO: 542732 - RNA, 21 nt, Human
ccgcgccgccugccccgcccc

SEQ ID NO: 542733 - RNA, 18 nt, Human
ccgggcucggcccgcccc

SEQ ID NO: 542734 - RNA, 21 nt, Human
cgcccccaccgcgccgccugc

SEQ ID NO: 542735 - RNA, 19 nt, Human
cuucaggccgcgccgcacu

SEQ ID NO: 542736 - RNA, 20 nt, Human
gcucaucuggccuccgggcu

SEQ ID NO: 542737 - RNA, 21 nt, Human
ucaggugcaaagggauggcag

SEQ ID NO: 542738 - RNA, 19 nt, Human
uccgcucaucuggccuccg

SEQ ID NO: 542739 - RNA, 19 nt, Human
ugccccgccccucacuagc

SEQ ID NO: 542740 - RNA, 25 nt, Human
uggccuccgggcucggcccgccccc

SEQ ID NO: 542741 - RNA, 18 nt, Human
uuuuuuuuuuuuuuucug

SEQ ID NO: 542742 - RNA, 22 nt, Human
uuuuuuuuuuuuuuuuuuuucu

SEQ ID NO: 542743 - RNA, 21 nt, Human
aagugcugggaagggcugagc

SEQ ID NO: 542744 - RNA, 21 nt, Human
agacgcugaggccgaggcgcu

SEQ ID NO: 542745 - RNA, 22 nt, Human
aggcagggaggugccaggccug

SEQ ID NO: 542746 - RNA, 19 nt, Human
aggccagggagaagcgggu

SEQ ID NO: 542747 - RNA, 18 nt, Human
aggcccuagaggcggggc

SEQ ID NO: 542748 - RNA, 20 nt, Human
cacaggacaggaagcccagg

SEQ ID NO: 542749 - RNA, 21 nt, Human
caggaagcccaggaugguuag

SEQ ID NO: 542750 - RNA, 19 nt, Human
caggacaggaagcccagga

SEQ ID NO: 542751 - RNA, 20 nt, Human
caggucgcaaccgccgccga

SEQ ID NO: 542752 - RNA, 20 nt, Human
ccccaggcccuagaggcggg

SEQ ID NO: 542753 - RNA, 18 nt, Human
ccccugguaaauagaggu

SEQ ID NO: 542754 - RNA, 24 nt, Human
cccuagaggcggggccuugggaac

SEQ ID NO: 542755 - RNA, 21 nt, Human
ccuagaggcggggccuuggga

SEQ ID NO: 542756 - RNA, 21 nt, Human
ccucacucgcgcugcuucaga

SEQ ID NO: 542757 - RNA, 22 nt, Human
ccucacucgcgcugcuucagaa

SEQ ID NO: 542758 - RNA, 24 nt, Human
cgcaaccgccgccgauuggccucc

SEQ ID NO: 542759 - RNA, 20 nt, Human
cgcaccugucugcuccggau

SEQ ID NO: 542760 - RNA, 21 nt, Human
cgccuuccggaccucgcaccu

SEQ ID NO: 542761 - RNA, 24 nt, Human
cgcucugcccaguuucggcccaau

SEQ ID NO: 542762 - RNA, 20 nt, Human
cggggguuggcugcggggcc

SEQ ID NO: 542763 - RNA, 22 nt, Human
cgucgccgcugccaccggugcc

SEQ ID NO: 542764 - RNA, 24 nt, Human
cucgcgccucacucgcgcugcuuc

SEQ ID NO: 542765 - RNA, 21 nt, Human
gaagaugucacucgagccucc

SEQ ID NO: 542766 - RNA, 19 nt, Human
gaagugcugggaagggcug

SEQ ID NO: 542767 - RNA, 21 nt, Human
gagcgguaggggccacaaaag

SEQ ID NO: 542768 - RNA, 26 nt, Human
gccaccuggagggccacuccuugguu

SEQ ID NO: 542769 - RNA, 19 nt, Human
gccggcgcgcucucaaucc

SEQ ID NO: 542770 - RNA, 24 nt, Human
gcgagcgggcacgaaugcucccuc

SEQ ID NO: 542771 - RNA, 18 nt, Human
ggacccggggcugggcug

SEQ ID NO: 542772 - RNA, 23 nt, Human
ggagggccacuccuugguuccug

SEQ ID NO: 542773 - RNA, 22 nt, Human
ggcaagcgggcugcacgccccu

SEQ ID NO: 542774 - RNA, 25 nt, Human
ggccuugggaaccgggacccggggc

SEQ ID NO: 542775 - RNA, 24 nt, Human
ggcugagcgguaggggccacaaaa

SEQ ID NO: 542776 - RNA, 19 nt, Human
ggcugggcugccgguucgc

SEQ ID NO: 542777 - RNA, 22 nt, Human
gggccuugggaaccgggacccg

SEQ ID NO: 542778 - RNA, 23 nt, Human
ggggaccucgcugcuaacucuug

SEQ ID NO: 542779 - RNA, 20 nt, Human
ggggagaaggaggcucggga

SEQ ID NO: 542780 - RNA, 20 nt, Human
guucgcgccgaggggucuuc

SEQ ID NO: 542781 - RNA, 20 nt, Human
uaaaaagggcauauuuagca

SEQ ID NO: 542782 - RNA, 21 nt, Human
uccucggggguuggcugcggg

SEQ ID NO: 542783 - RNA, 21 nt, Human
ucgcggcccgggccggcgcgc

SEQ ID NO: 542784 - RNA, 18 nt, Human
ugcugggaagggcugagc

SEQ ID NO: 542785 - RNA, 20 nt, Human
uggcucaggacacaaggcag

SEQ ID NO: 542786 - RNA, 24 nt, Human
ugggaaccgggacccggggcuggg

SEQ ID NO: 542787 - RNA, 19 nt, Human
ugggaagggcugagcggua

SEQ ID NO: 542788 - RNA, 22 nt, Human
ugggagaagugcugggaagggc

SEQ ID NO: 542789 - RNA, 19 nt, Human
ugguuagugcaacucggga

SEQ ID NO: 542790 - RNA, 19 nt, Human
uuggccgagaccugcccca

SEQ ID NO: 542791 - RNA, 21 nt, Human
uuuuuuuuuuuugagagcaca

SEQ ID NO: 542792 - RNA, 23 nt, Human
uuuuuuuuuuuuuuuuuuuuggg

SEQ ID NO: 542793 - RNA, 18 nt, Human
agacucacaaaauaggua

SEQ ID NO: 542794 - RNA, 20 nt, Human
aggaagucaccguggguccc

SEQ ID NO: 542795 - RNA, 19 nt, Human
caggguggggcagcccacc

SEQ ID NO: 542796 - RNA, 18 nt, Human
ccccucagcuccagcgcc

SEQ ID NO: 542797 - RNA, 26 nt, Human
ccccucaugagcagacagacccgggu

SEQ ID NO: 542798 - RNA, 20 nt, Human
ccgcacugccccucagcucc

SEQ ID NO: 542799 - RNA, 21 nt, Human
ccgcacugccccucagcucca

SEQ ID NO: 542800 - RNA, 19 nt, Human
ccguggguccccucuuccu

SEQ ID NO: 542801 - RNA, 18 nt, Human
cggcucugagcacugccc

SEQ ID NO: 542802 - RNA, 18 nt, Human
cgugcaacacacucgugc

SEQ ID NO: 542803 - RNA, 20 nt, Human
gagcgcggggccugggcggc

SEQ ID NO: 542804 - RNA, 21 nt, Human
gcacugccccucagcuccagc

SEQ ID NO: 542805 - RNA, 23 nt, Human
gcauauuugcagggacuagcgag

SEQ ID NO: 542806 - RNA, 18 nt, Human
gcggcucugagcacugcc

SEQ ID NO: 542807 - RNA, 23 nt, Human
gggcagcguggagaggcaggagu

SEQ ID NO: 542808 - RNA, 19 nt, Human
uagaacuccgcagccccuc

SEQ ID NO: 542809 - RNA, 19 nt, Human
uaggagccuuccuggggca

SEQ ID NO: 542810 - RNA, 23 nt, Human
uccgcagccccucaugagcagac

SEQ ID NO: 542811 - RNA, 18 nt, Human
uccuaggagccuuccugg

SEQ ID NO: 542812 - RNA, 21 nt, Human
ugagcagacagacccggguca

SEQ ID NO: 542813 - RNA, 18 nt, Human
ugaggagcgcggggccug

SEQ ID NO: 542814 - RNA, 23 nt, Human
ugaggagcgcggggccugggcgg

SEQ ID NO: 542815 - RNA, 19 nt, Human
ugcagggacuagcgaguca

SEQ ID NO: 542816 - RNA, 21 nt, Human
ugcaguaguagggggguuugc

SEQ ID NO: 542817 - RNA, 18 nt, Human
agcaguggcgggugggcg

SEQ ID NO: 542818 - RNA, 22 nt, Human
aggcgcccccacacuccugucc

SEQ ID NO: 542819 - RNA, 21 nt, Human
caaggcgcccccacacuccuu

SEQ ID NO: 542820 - RNA, 21 nt, Human
caccaccggccucuugggccc

SEQ ID NO: 542821 - RNA, 21 nt, Human
caccucccuccucuguuccca

SEQ ID NO: 542822 - RNA, 18 nt, Human
cagcgccgccccgccccg

SEQ ID NO: 542823 - RNA, 22 nt, Human
cagcuccuugcccuccccgucc

SEQ ID NO: 542824 - RNA, 23 nt, Human
caggagccuccgggaacucuggc

SEQ ID NO: 542825 - RNA, 26 nt, Human
ccaccugucugucugcucaccaccuc

SEQ ID NO: 542826 - RNA, 24 nt, Human
cccagagagcugagagccccccac

SEQ ID NO: 542827 - RNA, 18 nt, Human
cccagcuccuugcccucc

SEQ ID NO: 542828 - RNA, 21 nt, Human
cccagcuccuugcccuccccg

SEQ ID NO: 542829 - RNA, 19 nt, Human
ccccacacuccuguccucu

SEQ ID NO: 542830 - RNA, 24 nt, Human
ccccaccccagcuccuugcccucc

SEQ ID NO: 542831 - RNA, 23 nt, Human
ccccagagagcugagagcccccc

SEQ ID NO: 542832 - RNA, 26 nt, Human
ccccagagagcugagagccccccacc

SEQ ID NO: 542833 - RNA, 25 nt, Human
cccccacacuccuguccucucagcc

SEQ ID NO: 542834 - RNA, 21 nt, Human
cccccagugugggggccacag

SEQ ID NO: 542835 - RNA, 21 nt, Human
ccccccaccccagcuccuugc

SEQ ID NO: 542836 - RNA, 20 nt, Human
cccccggacggcccugacuu

SEQ ID NO: 542837 - RNA, 20 nt, Human
ccccgccccgggcgcggccc

SEQ ID NO: 542838 - RNA, 20 nt, Human
ccccgggcgcggcccggccc

SEQ ID NO: 542839 - RNA, 22 nt, Human
cccggcccggcgcgaccccggc

SEQ ID NO: 542840 - RNA, 22 nt, Human
cccugugucucauucaccccca

SEQ ID NO: 542841 - RNA, 18 nt, Human
ccgccccgccccgggcgc

SEQ ID NO: 542842 - RNA, 21 nt, Human
ccgcgcccccggacggcccug

SEQ ID NO: 542843 - RNA, 25 nt, Human
ccuccccgucccagaguggcugagc

SEQ ID NO: 542844 - RNA, 20 nt, Human
ccuccgagcggggacugcag

SEQ ID NO: 542845 - RNA, 18 nt, Human
ccuugguggcugcugggg

SEQ ID NO: 542846 - RNA, 23 nt, Human
cgccccgccccgggcgcggcccg

SEQ ID NO: 542847 - RNA, 18 nt, Human
cggcccggcccggcgcga

SEQ ID NO: 542848 - RNA, 22 nt, Human
cggcccgggggcggcucagcag

SEQ ID NO: 542849 - RNA, 22 nt, Human
cggccgcgcccccggacggccc

SEQ ID NO: 542850 - RNA, 19 nt, Human
cggccggcaggcccgcuuc

SEQ ID NO: 542851 - RNA, 24 nt, Human
cggccucuugggccccagagagcu

SEQ ID NO: 542852 - RNA, 20 nt, Human
cggcucagcaggcccggcgg

SEQ ID NO: 542853 - RNA, 19 nt, Human
gaccccggcccgggggcgg

SEQ ID NO: 542854 - RNA, 22 nt, Human
gagcugagagccccccacccca

SEQ ID NO: 542855 - RNA, 19 nt, Human
gaguggcugagcccuccac

SEQ ID NO: 542856 - RNA, 21 nt, Human
gccaaggcgcccccacacucc

SEQ ID NO: 542857 - RNA, 20 nt, Human
gccgcgcccccggacggccc

SEQ ID NO: 542858 - RNA, 21 nt, Human
gccgcgcccccggacggcccu

SEQ ID NO: 542859 - RNA, 19 nt, Human
gccggccgcgcccccggac

SEQ ID NO: 542860 - RNA, 19 nt, Human
gcgcggcgggggcugcggg

SEQ ID NO: 542861 - RNA, 20 nt, Human
gcguguccccuuccccuggg

SEQ ID NO: 542862 - RNA, 23 nt, Human
gcugagagccccccaccccagcu

SEQ ID NO: 542863 - RNA, 18 nt, Human
ggacugcaguggcucugu

SEQ ID NO: 542864 - RNA, 21 nt, Human
gggaacucuggcagacuuucg

SEQ ID NO: 542865 - RNA, 21 nt, Human
gggcgcagguggcggcagggg

SEQ ID NO: 542866 - RNA, 18 nt, Human
gggcgcggcccggcccgg

SEQ ID NO: 542867 - RNA, 21 nt, Human
gggcuggagcagccagucuuc

SEQ ID NO: 542868 - RNA, 19 nt, Human
guggcugcuggggaagccc

SEQ ID NO: 542869 - RNA, 23 nt, Human
gugggggccacaggccuuggugg

SEQ ID NO: 542870 - RNA, 18 nt, Human
uagaagggucuuugcucc

SEQ ID NO: 542871 - RNA, 18 nt, Human
ucagcaggcccggcgggg

SEQ ID NO: 542872 - RNA, 27 nt, Human
ucauucacccccagggcuuguggaauc

SEQ ID NO: 542873 - RNA, 20 nt, Human
ucccagaugggcgugucccc

SEQ ID NO: 542874 - RNA, 19 nt, Human
ucccugagggcaggcccug

SEQ ID NO: 542875 - RNA, 21 nt, Human
uccucuguucccacuguccgc

SEQ ID NO: 542876 - RNA, 24 nt, Human
ucggccggcaggcccgcuucuucc

SEQ ID NO: 542877 - RNA, 18 nt, Human
ucucccccaguguggggg

SEQ ID NO: 542878 - RNA, 20 nt, Human
ucugucugcucaccaccucc

SEQ ID NO: 542879 - RNA, 28 nt, Human
ucuugggccccagagagcugagagcccc

SEQ ID NO: 542880 - RNA, 22 nt, Human
ugacuagaugggaacucccuga

SEQ ID NO: 542881 - RNA, 23 nt, Human
ugagagccccccaccccagcucc

SEQ ID NO: 542882 - RNA, 18 nt, Human
ugagugaagcaugugcca

SEQ ID NO: 542883 - RNA, 22 nt, Human
ugcucaccaccucccuccucug

SEQ ID NO: 542884 - RNA, 18 nt, Human
ugcuggggaagcccgggg

SEQ ID NO: 542885 - RNA, 22 nt, Human
uggcucuguguccaagcagggg

SEQ ID NO: 542886 - RNA, 18 nt, Human
ugggcaggugcugagguc

SEQ ID NO: 542887 - RNA, 19 nt, Human
ugggccccagagagcugag

SEQ ID NO: 542888 - RNA, 20 nt, Human
ugggcgcagguggcggcagg

SEQ ID NO: 542889 - RNA, 19 nt, Human
uguccccuuccccugggca

SEQ ID NO: 542890 - RNA, 21 nt, Human
ugucugcucaccaccucccuc

SEQ ID NO: 542891 - RNA, 19 nt, Human
uugguggcugcuggggaag

SEQ ID NO: 542892 - RNA, 23 nt, Human
aacuccccucccuggcucuccca

SEQ ID NO: 542893 - RNA, 22 nt, Human
acugguugguuguauaaaaaaa

SEQ ID NO: 542894 - RNA, 21 nt, Human
auucaagcucugggaccugau

SEQ ID NO: 542895 - RNA, 22 nt, Human
cacagccccaggggaugcuggg

SEQ ID NO: 542896 - RNA, 19 nt, Human
caccaugaucacagcccca

SEQ ID NO: 542897 - RNA, 20 nt, Human
cagcaacucuucagagauga

SEQ ID NO: 542898 - RNA, 21 nt, Human
ccaccaugaucacagccccag

SEQ ID NO: 542899 - RNA, 19 nt, Human
cugauggggacagucuccc

SEQ ID NO: 542900 - RNA, 26 nt, Human
cuuguuagcauucaagcucugggacc

SEQ ID NO: 542901 - RNA, 18 nt, Human
gaaacagcaacucuucag

SEQ ID NO: 542902 - RNA, 18 nt, Human
gagaaggcauucuugcug

SEQ ID NO: 542903 - RNA, 24 nt, Human
ggggagagcacacugggagaaggc

SEQ ID NO: 542904 - RNA, 24 nt, Human
guaaaguacaaaacuguuaaucua

SEQ ID NO: 542905 - RNA, 27 nt, Human
uaaaaggcuuccuuuucuguuaaguuc

SEQ ID NO: 542906 - RNA, 24 nt, Human
uaaaugagauaaaaacaguuucuu

SEQ ID NO: 542907 - RNA, 25 nt, Human
ucacagccccaggggaugcugggcu

SEQ ID NO: 542908 - RNA, 23 nt, Human
ucauccaccaugaucacagcccc

SEQ ID NO: 542909 - RNA, 19 nt, Human
uccagaaacuccccucccu

SEQ ID NO: 542910 - RNA, 24 nt, Human
uccagaaacuccccucccuggcuc

SEQ ID NO: 542911 - RNA, 27 nt, Human
ugagauaaaaacaguuucuuacaccua

SEQ ID NO: 542912 - RNA, 19 nt, Human
uggcuagaaaagaaacugg

SEQ ID NO: 542913 - RNA, 21 nt, Human
uggcuagaaaagaaacugguu

SEQ ID NO: 542914 - RNA, 23 nt, Human
uggcuagaaaagaaacugguugg

SEQ ID NO: 542915 - RNA, 19 nt, Human
ugucaguaagaaacagcaa

SEQ ID NO: 542916 - RNA, 27 nt, Human
uguuccacgcauggcuuuccucuucca

SEQ ID NO: 542917 - RNA, 24 nt, Human
uuucuguuaaguucugagacuuaa

SEQ ID NO: 542918 - RNA, 25 nt, Human
aaaaauccaagguggaguaggagac

SEQ ID NO: 542919 - RNA, 22 nt, Human
aaaaggagaagcccccucccac

SEQ ID NO: 542920 - RNA, 25 nt, Human
aaaaggagaagcccccucccacccu

SEQ ID NO: 542921 - RNA, 24 nt, Human
aaacacauuuauagugcugaauac

SEQ ID NO: 542922 - RNA, 24 nt, Human
aaacuacccuccugccagccccga

SEQ ID NO: 542923 - RNA, 18 nt, Human
aaauccaaaacuagcccc

SEQ ID NO: 542924 - RNA, 18 nt, Human
aacccuggcagugcccug

SEQ ID NO: 542925 - RNA, 20 nt, Human
aacuuaaaagcacccuggua

SEQ ID NO: 542926 - RNA, 21 nt, Human
aacuuaaaagcacccugguaa

SEQ ID NO: 542927 - RNA, 21 nt, Human
aagcugugggucagggucagu

SEQ ID NO: 542928 - RNA, 27 nt, Human
aauucauucuccuuguccuuggggccu

SEQ ID NO: 542929 - RNA, 21 nt, Human
aauuuccauucggugcaucuc

SEQ ID NO: 542930 - RNA, 18 nt, Human
acagagacguuggugacu

SEQ ID NO: 542931 - RNA, 19 nt, Human
acaggccagcagaagagga

SEQ ID NO: 542932 - RNA, 20 nt, Human
accacuugcuggaacagggc

SEQ ID NO: 542933 - RNA, 18 nt, Human
acccauauccucagcagc

SEQ ID NO: 542934 - RNA, 25 nt, Human
accccauggcucagagguagugcug

SEQ ID NO: 542935 - RNA, 23 nt, Human
acccugaguggugguccccaugg

SEQ ID NO: 542936 - RNA, 18 nt, Human
acccuggcagugcccugg

SEQ ID NO: 542937 - RNA, 18 nt, Human
acccuucaugcugcugug

SEQ ID NO: 542938 - RNA, 19 nt, Human
accugggguugggauacgc

SEQ ID NO: 542939 - RNA, 22 nt, Human
agccccucaguagcacacuccu

SEQ ID NO: 542940 - RNA, 24 nt, Human
aggagacuuuuucagccacagaca

SEQ ID NO: 542941 - RNA, 21 nt, Human
aggcacaugcuuagcagguua

SEQ ID NO: 542942 - RNA, 18 nt, Human
aggcgggggugguagggc

SEQ ID NO: 542943 - RNA, 23 nt, Human
aggcgggggugguagggcuuggg

SEQ ID NO: 542944 - RNA, 21 nt, Human
agggaaaacaaacgguuucac

SEQ ID NO: 542945 - RNA, 24 nt, Human
agggaaaacaaacgguuucaccuu

SEQ ID NO: 542946 - RNA, 18 nt, Human
agggagcguagcuccugg

SEQ ID NO: 542947 - RNA, 20 nt, Human
aggggcaggugggcaggcau

SEQ ID NO: 542948 - RNA, 20 nt, Human
auaaacccccagaaaaaccc

SEQ ID NO: 542949 - RNA, 22 nt, Human
auccucagcagccuuccgcccc

SEQ ID NO: 542950 - RNA, 20 nt, Human
augacaauucuaccugcaug

SEQ ID NO: 542951 - RNA, 23 nt, Human
auggagccuugcggugcaggccu

SEQ ID NO: 542952 - RNA, 22 nt, Human
auugacagcugcaucaaugaca

SEQ ID NO: 542953 - RNA, 22 nt, Human
caaaugaacccauacuccccuc

SEQ ID NO: 542954 - RNA, 21 nt, Human
caacaaggcagccuugugacc

SEQ ID NO: 542955 - RNA, 22 nt, Human
caacaaggcagccuugugacca

SEQ ID NO: 542956 - RNA, 21 nt, Human
caaggggcuugggcccagggc

SEQ ID NO: 542957 - RNA, 22 nt, Human
cacaccccacacucuuacacca

SEQ ID NO: 542958 - RNA, 19 nt, Human
caccccacacucuuacacc

SEQ ID NO: 542959 - RNA, 20 nt, Human
caccccacacucuuacacca

SEQ ID NO: 542960 - RNA, 21 nt, Human
cacccuggggcugaguggcuc

SEQ ID NO: 542961 - RNA, 18 nt, Human
cacugcuugggcgguccc

SEQ ID NO: 542962 - RNA, 19 nt, Human
cagacugacuuauucucca

SEQ ID NO: 542963 - RNA, 18 nt, Human
cagacuggggagacugga

SEQ ID NO: 542964 - RNA, 20 nt, Human
cagagguaaucaucugggau

SEQ ID NO: 542965 - RNA, 22 nt, Human
cagagguagugcugaaaauccc

SEQ ID NO: 542966 - RNA, 25 nt, Human
cagcagguugguccagccagccccc

SEQ ID NO: 542967 - RNA, 22 nt, Human
caggcuggaggaagaagggcuu

SEQ ID NO: 542968 - RNA, 19 nt, Human
caggguuugcaggcuccga

SEQ ID NO: 542969 - RNA, 22 nt, Human
cagguccucaggagcaucaccc

SEQ ID NO: 542970 - RNA, 19 nt, Human
caucuggaacugaucaauu

SEQ ID NO: 542971 - RNA, 20 nt, Human
caugaaccugcuccugcaua

SEQ ID NO: 542972 - RNA, 26 nt, Human
cauucggugcaucucuacccuggagg

SEQ ID NO: 542973 - RNA, 18 nt, Human
ccaaaugaacccauacuc

SEQ ID NO: 542974 - RNA, 23 nt, Human
ccaccugacccuauccccccaaa

SEQ ID NO: 542975 - RNA, 22 nt, Human
ccagcaucaccauguuuccugc

SEQ ID NO: 542976 - RNA, 19 nt, Human
ccagucacaugccugagcc

SEQ ID NO: 542977 - RNA, 19 nt, Human
cccagcaucaccauguuuc

SEQ ID NO: 542978 - RNA, 21 nt, Human
cccaggccaugcgggccugcu

SEQ ID NO: 542979 - RNA, 24 nt, Human
cccccagaaaaacccuggagguaa

SEQ ID NO: 542980 - RNA, 22 nt, Human
cccccucccacccucuuuaccc

SEQ ID NO: 542981 - RNA, 21 nt, Human
ccccucccuaccucuugugcc

SEQ ID NO: 542982 - RNA, 24 nt, Human
cccucagacugacuuauucuccaa

SEQ ID NO: 542983 - RNA, 18 nt, Human
ccggcgccugccacaccc

SEQ ID NO: 542984 - RNA, 25 nt, Human
ccuaccuaugaaucaaauccaaaac

SEQ ID NO: 542985 - RNA, 23 nt, Human
ccucccacccucuuuacccagga

SEQ ID NO: 542986 - RNA, 25 nt, Human
ccuccucucucgaaaucccccuucu

SEQ ID NO: 542987 - RNA, 19 nt, Human
ccucguugccccucacugc

SEQ ID NO: 542988 - RNA, 20 nt, Human
ccucguugccccucacugcu

SEQ ID NO: 542989 - RNA, 24 nt, Human
ccucguugccccucacugcucccc

SEQ ID NO: 542990 - RNA, 21 nt, Human
ccucuaacaccugugaacacc

SEQ ID NO: 542991 - RNA, 23 nt, Human
ccugaacaugcaggacuuagcuu

SEQ ID NO: 542992 - RNA, 18 nt, Human
ccuggagugaaccuggug

SEQ ID NO: 542993 - RNA, 24 nt, Human
ccugugaacaccagaugguccaga

SEQ ID NO: 542994 - RNA, 19 nt, Human
ccuuccgccccacucugcc

SEQ ID NO: 542995 - RNA, 22 nt, Human
cgcacccuggggcugaguggcu

SEQ ID NO: 542996 - RNA, 24 nt, Human
cucaaaccccagagggcgggagau

SEQ ID NO: 542997 - RNA, 19 nt, Human
cucaucgugcuccagggcc

SEQ ID NO: 542998 - RNA, 23 nt, Human
cuccaccaguucccuccucucca

SEQ ID NO: 542999 - RNA, 21 nt, Human
cuccauaccuccacucaaacc

SEQ ID NO: 543000 - RNA, 22 nt, Human
cucccacuccugggcccugcag

SEQ ID NO: 543001 - RNA, 23 nt, Human
cucgaaaucccccuucuccaggg

SEQ ID NO: 543002 - RNA, 24 nt, Human
cugacccauauccucagcagccuu

SEQ ID NO: 543003 - RNA, 22 nt, Human
cugcuguggccucuguacaugg

SEQ ID NO: 543004 - RNA, 18 nt, Human
cuggagggagggccuggg

SEQ ID NO: 543005 - RNA, 23 nt, Human
cuggauacauggcacugcuuggg

SEQ ID NO: 543006 - RNA, 25 nt, Human
cuggcagugcccugggcaugcaguu

SEQ ID NO: 543007 - RNA, 18 nt, Human
cuggcccauugaacccug

SEQ ID NO: 543008 - RNA, 23 nt, Human
cuguauguggccacuugggagau

SEQ ID NO: 543009 - RNA, 22 nt, Human
cuucacgcagcagcacccccuc

SEQ ID NO: 543010 - RNA, 23 nt, Human
cuuuccuccucucucgaaauccc

SEQ ID NO: 543011 - RNA, 20 nt, Human
cuuugaggauuuccggcgcc

SEQ ID NO: 543012 - RNA, 21 nt, Human
gaacccugagugguggucccc

SEQ ID NO: 543013 - RNA, 18 nt, Human
gaacugcuagcccaacuc

SEQ ID NO: 543014 - RNA, 21 nt, Human
gaagaggggcaggugggcagg

SEQ ID NO: 543015 - RNA, 22 nt, Human
gaauucauucuccuuguccuug

SEQ ID NO: 543016 - RNA, 21 nt, Human
gaccauggccuuuacugucug

SEQ ID NO: 543017 - RNA, 20 nt, Human
gacuugcuuuucagaccugg

SEQ ID NO: 543018 - RNA, 18 nt, Human
gagacuuuuucagccaca

SEQ ID NO: 543019 - RNA, 21 nt, Human
gagaugccaggcaagcugugg

SEQ ID NO: 543020 - RNA, 19 nt, Human
gcaaaacggcuuguggccc

SEQ ID NO: 543021 - RNA, 24 nt, Human
gcacccccucaucgugcuccaggg

SEQ ID NO: 543022 - RNA, 19 nt, Human
gcagagagggagagccucg

SEQ ID NO: 543023 - RNA, 20 nt, Human
gccaugcgggccugcuccuc

SEQ ID NO: 543024 - RNA, 20 nt, Human
gccuggaagccuggcugggc

SEQ ID NO: 543025 - RNA, 21 nt, Human
gcuaugggaugccagaacauu

SEQ ID NO: 543026 - RNA, 22 nt, Human
gcugcuggauacauggcacugc

SEQ ID NO: 543027 - RNA, 18 nt, Human
gcuugugggggaggcugg

SEQ ID NO: 543028 - RNA, 23 nt, Human
ggagaagggacaaggggcuuggg

SEQ ID NO: 543029 - RNA, 21 nt, Human
ggagcguagcuccugguucuu

SEQ ID NO: 543030 - RNA, 26 nt, Human
ggauacgcgagcugcaugugguggua

SEQ ID NO: 543031 - RNA, 20 nt, Human
ggcacuggaaggggcagagg

SEQ ID NO: 543032 - RNA, 21 nt, Human
ggcauggcugggccuugaugg

SEQ ID NO: 543033 - RNA, 21 nt, Human
gggcagagguaaucaucuggg

SEQ ID NO: 543034 - RNA, 25 nt, Human
gggcagccaaccccauggcucagag

SEQ ID NO: 543035 - RNA, 21 nt, Human
gggccuccgaggagugcccaa

SEQ ID NO: 543036 - RNA, 20 nt, Human
gggccugggcucccacuccu

SEQ ID NO: 543037 - RNA, 18 nt, Human
ggugggucaucuugaugc

SEQ ID NO: 543038 - RNA, 22 nt, Human
guaaaguacuacuauacccacc

SEQ ID NO: 543039 - RNA, 20 nt, Human
gucacccagcaucaccaugu

SEQ ID NO: 543040 - RNA, 18 nt, Human
gucaucuugaugcucucc

SEQ ID NO: 543041 - RNA, 22 nt, Human
guccuuggggccuuugugaaaa

SEQ ID NO: 543042 - RNA, 22 nt, Human
gugggucaucuugaugcucucc

SEQ ID NO: 543043 - RNA, 24 nt, Human
gugggucaucuugaugcucuccgg

SEQ ID NO: 543044 - RNA, 24 nt, Human
gugguagggcuugggcggcagcgc

SEQ ID NO: 543045 - RNA, 19 nt, Human
uaaaagcacccugguaaag

SEQ ID NO: 543046 - RNA, 19 nt, Human
uaaacccccagaaaaaccc

SEQ ID NO: 543047 - RNA, 26 nt, Human
uaaagacaccaacagacuggggagac

SEQ ID NO: 543048 - RNA, 22 nt, Human
uaaccccuaacccucuaacacc

SEQ ID NO: 543049 - RNA, 19 nt, Human
uaagcuccuugagcugggu

SEQ ID NO: 543050 - RNA, 22 nt, Human
uaauaaacugagaggaaaauca

SEQ ID NO: 543051 - RNA, 25 nt, Human
uacacucuuuccuccucucucgaaa

SEQ ID NO: 543052 - RNA, 21 nt, Human
uacccuccugccagccccgaa

SEQ ID NO: 543053 - RNA, 20 nt, Human
uacccuggagggagggccug

SEQ ID NO: 543054 - RNA, 18 nt, Human
uaccuaugaaucaaaucc

SEQ ID NO: 543055 - RNA, 18 nt, Human
uacgcgagcugcaugugg

SEQ ID NO: 543056 - RNA, 21 nt, Human
uagaagcucuugacucgaucu

SEQ ID NO: 543057 - RNA, 20 nt, Human
uagaccuccaucuuucccag

SEQ ID NO: 543058 - RNA, 19 nt, Human
uagcccaacuccaaggaca

SEQ ID NO: 543059 - RNA, 21 nt, Human
uagccccuaaccccuaacccu

SEQ ID NO: 543060 - RNA, 19 nt, Human
uaggagacggcuggcccau

SEQ ID NO: 543061 - RNA, 21 nt, Human
uaggccagucacaugccugag

SEQ ID NO: 543062 - RNA, 19 nt, Human
uagguauuuacaaauaagc

SEQ ID NO: 543063 - RNA, 19 nt, Human
uagugcugaaaaucccuga

SEQ ID NO: 543064 - RNA, 21 nt, Human
uaucaaagaaggccuccugau

SEQ ID NO: 543065 - RNA, 19 nt, Human
ucaccacuggggcuccugu

SEQ ID NO: 543066 - RNA, 20 nt, Human
ucagaauguguccuuuucau

SEQ ID NO: 543067 - RNA, 23 nt, Human
ucagggccuggaagccuggcugg

SEQ ID NO: 543068 - RNA, 20 nt, Human
ucagggucagugugguacgu

SEQ ID NO: 543069 - RNA, 18 nt, Human
ucaugcugcuguggccuc

SEQ ID NO: 543070 - RNA, 20 nt, Human
ucauucuccuuguccuuggg

SEQ ID NO: 543071 - RNA, 26 nt, Human
uccaaaacuagccccuaaccccuaac

SEQ ID NO: 543072 - RNA, 21 nt, Human
uccaaaccuggaaacucaugg

SEQ ID NO: 543073 - RNA, 21 nt, Human
uccacaggcucuugaauucau

SEQ ID NO: 543074 - RNA, 21 nt, Human
uccagggccggcaggcggggg

SEQ ID NO: 543075 - RNA, 23 nt, Human
uccauugacagcugcaucaauga

SEQ ID NO: 543076 - RNA, 25 nt, Human
ucccagccgccucguugccccucac

SEQ ID NO: 543077 - RNA, 21 nt, Human
ucccaggccaugcgggccugc

SEQ ID NO: 543078 - RNA, 21 nt, Human
uccccguggggugcuggugcc

SEQ ID NO: 543079 - RNA, 23 nt, Human
uccucagggccuggaagccuggc

SEQ ID NO: 543080 - RNA, 18 nt, Human
uccugccagccccgaacc

SEQ ID NO: 543081 - RNA, 22 nt, Human
uccuuggggccuuugugaaaag

SEQ ID NO: 543082 - RNA, 22 nt, Human
ucuccaacaaaagggauuucag

SEQ ID NO: 543083 - RNA, 18 nt, Human
ucuccaggauggcugcug

SEQ ID NO: 543084 - RNA, 20 nt, Human
ucucgaaaucccccuucucc

SEQ ID NO: 543085 - RNA, 22 nt, Human
ucucgaaaucccccuucuccag

SEQ ID NO: 543086 - RNA, 22 nt, Human
ugacugggggcuugugggggag

SEQ ID NO: 543087 - RNA, 23 nt, Human
ugacugggggcuugugggggagg

SEQ ID NO: 543088 - RNA, 26 nt, Human
ugacugggggcuugugggggaggcug

SEQ ID NO: 543089 - RNA, 26 nt, Human
ugacugggggcuuguggggggagcac

SEQ ID NO: 543090 - RNA, 21 nt, Human
ugaggagagagaggaugauga

SEQ ID NO: 543091 - RNA, 22 nt, Human
ugagugcaagccucucuggcuc

SEQ ID NO: 543092 - RNA, 23 nt, Human
ugcacaaacuucucaugaacugc

SEQ ID NO: 543093 - RNA, 21 nt, Human
ugcccaacaaggcagccuugu

SEQ ID NO: 543094 - RNA, 21 nt, Human
ugccugagccagcagguuggu

SEQ ID NO: 543095 - RNA, 22 nt, Human
ugcggugcaggccucgaggccu

SEQ ID NO: 543096 - RNA, 24 nt, Human
ugcuggauacauggcacugcuugg

SEQ ID NO: 543097 - RNA, 23 nt, Human
uggaggucauacaggccagcaga

SEQ ID NO: 543098 - RNA, 21 nt, Human
uggcauggaguccaugguguc

SEQ ID NO: 543099 - RNA, 20 nt, Human
uggcucaagaucuucgucag

SEQ ID NO: 543100 - RNA, 25 nt, Human
ugggauacgcgagcugcauguggug

SEQ ID NO: 543101 - RNA, 23 nt, Human
ugggauaggguggagaggagacu

SEQ ID NO: 543102 - RNA, 22 nt, Human
ugggcggcagcgcaggcggguc

SEQ ID NO: 543103 - RNA, 19 nt, Human
uggggcugggggacuugcu

SEQ ID NO: 543104 - RNA, 21 nt, Human
ugggggcuugugggggaggcu

SEQ ID NO: 543105 - RNA, 18 nt, Human
ugggguggggcuggggga

SEQ ID NO: 543106 - RNA, 24 nt, Human
ugggguggggcugggggacuugcu

SEQ ID NO: 543107 - RNA, 20 nt, Human
ugggguuuguuuacaagaga

SEQ ID NO: 543108 - RNA, 22 nt, Human
ugucuggaaagaggggcagugg

SEQ ID NO: 543109 - RNA, 25 nt, Human
ugugaacaccagaugguccagagau

SEQ ID NO: 543110 - RNA, 19 nt, Human
ugugaugacugccuugucc

SEQ ID NO: 543111 - RNA, 18 nt, Human
ugugauggagagaaaaau

SEQ ID NO: 543112 - RNA, 18 nt, Human
ugugcaauuucuccaugu

SEQ ID NO: 543113 - RNA, 20 nt, Human
uguggaggucauacaggcca

SEQ ID NO: 543114 - RNA, 18 nt, Human
uguguugauacuggcuga

SEQ ID NO: 543115 - RNA, 20 nt, Human
uguugauacuggcugaucag

SEQ ID NO: 543116 - RNA, 22 nt, Human
uucaugcugcuguggccucugu

SEQ ID NO: 543117 - RNA, 21 nt, Human
uuccuccucucucgaaauccc

SEQ ID NO: 543118 - RNA, 22 nt, Human
uugaauucauucuccuuguccu

SEQ ID NO: 543119 - RNA, 21 nt, Human
uugggggugguucucuccuga

SEQ ID NO: 543120 - RNA, 18 nt, Human
uugugggggaggcuggga

SEQ ID NO: 543121 - RNA, 21 nt, Human
uuuucagaccuggagugauug

SEQ ID NO: 543122 - RNA, 22 nt, Human
aaaaaacaacaaaaaaccccac

SEQ ID NO: 543123 - RNA, 25 nt, Human
aaaaaacaacaaaaaaccccacaca

SEQ ID NO: 543124 - RNA, 27 nt, Human
aaaaaacaacaaaaaaccccacacaac

SEQ ID NO: 543125 - RNA, 22 nt, Human
aaaaaaccccacacaaccaaaa

SEQ ID NO: 543126 - RNA, 20 nt, Human
aaaaacaaaacccaaaaaac

SEQ ID NO: 543127 - RNA, 23 nt, Human
aaaacaacaaaaaaccccacaca

SEQ ID NO: 543128 - RNA, 21 nt, Human
aaacaaaacccaaaaaacaac

SEQ ID NO: 543129 - RNA, 21 nt, Human
aaacccaaaaaacaacaaaaa

SEQ ID NO: 543130 - RNA, 23 nt, Human
aaacuccaacugcaaggcuggca

SEQ ID NO: 543131 - RNA, 18 nt, Human
aaagagcacaacauaauc

SEQ ID NO: 543132 - RNA, 22 nt, Human
aacagggcaagggggcucccuc

SEQ ID NO: 543133 - RNA, 20 nt, Human
aacccaaaaaacaacaaaaa

SEQ ID NO: 543134 - RNA, 21 nt, Human
aacccaaaaaacaacaaaaaa

SEQ ID NO: 543135 - RNA, 24 nt, Human
aacccaaaaaacaacaaaaaaccu

SEQ ID NO: 543136 - RNA, 24 nt, Human
aagcaggaaggagccugugcagaa

SEQ ID NO: 543137 - RNA, 20 nt, Human
aaggucuguucccacaaauc

SEQ ID NO: 543138 - RNA, 21 nt, Human
acaaaacccaaaaaacaacaa

SEQ ID NO: 543139 - RNA, 20 nt, Human
acaaagcaggaaggagccug

SEQ ID NO: 543140 - RNA, 22 nt, Human
acaaaucaggacccuaaaguau

SEQ ID NO: 543141 - RNA, 21 nt, Human
accucugcuuaaaacuccaac

SEQ ID NO: 543142 - RNA, 19 nt, Human
acggcaguccugcugcggc

SEQ ID NO: 543143 - RNA, 18 nt, Human
acgugaauagaaagauag

SEQ ID NO: 543144 - RNA, 22 nt, Human
agaccuuuggaccccaguuccc

SEQ ID NO: 543145 - RNA, 21 nt, Human
agaugucaccucugcuuaaaa

SEQ ID NO: 543146 - RNA, 19 nt, Human
agccagcucugccucccuc

SEQ ID NO: 543147 - RNA, 21 nt, Human
agccccgcagcaggcagcccc

SEQ ID NO: 543148 - RNA, 22 nt, Human
agcugagccagccagcucugcc

SEQ ID NO: 543149 - RNA, 24 nt, Human
aggcccagaggaacugagaagcca

SEQ ID NO: 543150 - RNA, 20 nt, Human
aggcucuuggccgacagccc

SEQ ID NO: 543151 - RNA, 23 nt, Human
aggugguguggccagcccuuugc

SEQ ID NO: 543152 - RNA, 23 nt, Human
aguauuaaaaaacaaaacccaaa

SEQ ID NO: 543153 - RNA, 24 nt, Human
aguccagccucauccuugggggca

SEQ ID NO: 543154 - RNA, 21 nt, Human
auccuugggggcaaggagggg

SEQ ID NO: 543155 - RNA, 26 nt, Human
auccuugggggcaaggagggggcagc

SEQ ID NO: 543156 - RNA, 20 nt, Human
auggaggauggacacgacug

SEQ ID NO: 543157 - RNA, 22 nt, Human
caaaaaacaacaaaaaacccca

SEQ ID NO: 543158 - RNA, 18 nt, Human
caaaaaaccccacacaac

SEQ ID NO: 543159 - RNA, 18 nt, Human
caaaaaaccccacacaac

SEQ ID NO: 543160 - RNA, 20 nt, Human
caaaacccaaaaaacaacaa

SEQ ID NO: 543161 - RNA, 27 nt, Human
caaaacccaaaaaacaacaaaaaaccc

SEQ ID NO: 543162 - RNA, 22 nt, Human
caaauagugguuauuuacaaga

SEQ ID NO: 543163 - RNA, 23 nt, Human
caacaaaaaaccccacacaacca

SEQ ID NO: 543164 - RNA, 22 nt, Human
caacaaaaaaccccacacaacu

SEQ ID NO: 543165 - RNA, 21 nt, Human
caagcuccagccuuccuccac

SEQ ID NO: 543166 - RNA, 24 nt, Human
cagaaguuacauuuuaaaaccaga

SEQ ID NO: 543167 - RNA, 26 nt, Human
cagaugucaccucugcuuaaaacucc

SEQ ID NO: 543168 - RNA, 20 nt, Human
cagcacagaggaagugcaga

SEQ ID NO: 543169 - RNA, 19 nt, Human
cagcaccauguggggagga

SEQ ID NO: 543170 - RNA, 22 nt, Human
cagcaccccuaccccaggggca

SEQ ID NO: 543171 - RNA, 23 nt, Human
cagcaggagggcugugccaugga

SEQ ID NO: 543172 - RNA, 19 nt, Human
cagcaggcagcccccagca

SEQ ID NO: 543173 - RNA, 25 nt, Human
cagccagcucugccucccuccccaa

SEQ ID NO: 543174 - RNA, 21 nt, Human
caggaacaagcuccagccuuc

SEQ ID NO: 543175 - RNA, 27 nt, Human
caggacccuaaaguauuaaaaaacaaa

SEQ ID NO: 543176 - RNA, 18 nt, Human
caggagggcugugccaug

SEQ ID NO: 543177 - RNA, 21 nt, Human
cagggcaagggggcucccucu

SEQ ID NO: 543178 - RNA, 19 nt, Human
ccaggugccugggucuccg

SEQ ID NO: 543179 - RNA, 25 nt, Human
cccaaaaaacaacaaaaaaccccac

SEQ ID NO: 543180 - RNA, 21 nt, Human
ccccaaagaccuuuggacccc

SEQ ID NO: 543181 - RNA, 18 nt, Human
ccccucuacaggcuagcu

SEQ ID NO: 543182 - RNA, 26 nt, Human
cccgcgucacggcgcggcuggcgggg

SEQ ID NO: 543183 - RNA, 21 nt, Human
cccuaccccaggggcaucuuc

SEQ ID NO: 543184 - RNA, 24 nt, Human
cccuaccccaggggcaucuuccca

SEQ ID NO: 543185 - RNA, 19 nt, Human
ccgcagcaggcagccccca

SEQ ID NO: 543186 - RNA, 18 nt, Human
ccgccucagcauuguucu

SEQ ID NO: 543187 - RNA, 23 nt, Human
ccucaagcucugauuaucccccu

SEQ ID NO: 543188 - RNA, 22 nt, Human
ccuccaaucaccuguuccagac

SEQ ID NO: 543189 - RNA, 20 nt, Human
ccuggcagcaggagggcugu

SEQ ID NO: 543190 - RNA, 19 nt, Human
ccuggccuauuccuggggc

SEQ ID NO: 543191 - RNA, 18 nt, Human
ccuggggcaggaacaagc

SEQ ID NO: 543192 - RNA, 24 nt, Human
ccugugucacuccaggcccagagg

SEQ ID NO: 543193 - RNA, 22 nt, Human
cgccgaggcccgggccaggagc

SEQ ID NO: 543194 - RNA, 23 nt, Human
cuccaaccccucacacaugcuca

SEQ ID NO: 543195 - RNA, 20 nt, Human
cuccuggccuauuccugggg

SEQ ID NO: 543196 - RNA, 20 nt, Human
cugcucagcggcgccgcgga

SEQ ID NO: 543197 - RNA, 20 nt, Human
cugggcgccgaggcccgggc

SEQ ID NO: 543198 - RNA, 21 nt, Human
cuguucccacaaaucaggacc

SEQ ID NO: 543199 - RNA, 22 nt, Human
cuucaugcgucaucgugccacu

SEQ ID NO: 543200 - RNA, 18 nt, Human
cuugggggcaaggagggg

SEQ ID NO: 543201 - RNA, 22 nt, Human
cuuuaucauccuccugccacaa

SEQ ID NO: 543202 - RNA, 24 nt, Human
gagaggggggcagcaggggugcuu

SEQ ID NO: 543203 - RNA, 20 nt, Human
gagcacaacauaaucuccuu

SEQ ID NO: 543204 - RNA, 25 nt, Human
gagcacaacauaaucuccuucaugc

SEQ ID NO: 543205 - RNA, 18 nt, Human
gagccagccagcucugcc

SEQ ID NO: 543206 - RNA, 21 nt, Human
gcagcaggcagcccccagcag

SEQ ID NO: 543207 - RNA, 18 nt, Human
gccagcucugccucccuc

SEQ ID NO: 543208 - RNA, 22 nt, Human
gcccagaggaacugagaagcca

SEQ ID NO: 543209 - RNA, 20 nt, Human
gcgccgcggagcaggcucau

SEQ ID NO: 543210 - RNA, 19 nt, Human
gcggagcaggcucaugccc

SEQ ID NO: 543211 - RNA, 19 nt, Human
gcggcagggcggcggcggc

SEQ ID NO: 543212 - RNA, 24 nt, Human
gcuccuucgccccgcgccugcugg

SEQ ID NO: 543213 - RNA, 18 nt, Human
ggaaaagccagcagucag

SEQ ID NO: 543214 - RNA, 25 nt, Human
ggaaggauggggugagggugagggg

SEQ ID NO: 543215 - RNA, 21 nt, Human
ggacccuaaaguauuaaaaaa

SEQ ID NO: 543216 - RNA, 20 nt, Human
ggcuccuuugggaggggccg

SEQ ID NO: 543217 - RNA, 26 nt, Human
gggaaggaugcccaggugccuggguc

SEQ ID NO: 543218 - RNA, 18 nt, Human
gggcaaggagggggcagc

SEQ ID NO: 543219 - RNA, 18 nt, Human
gggcaagggggcucccuc

SEQ ID NO: 543220 - RNA, 24 nt, Human
gggcaggaacaagcuccagccuuc

SEQ ID NO: 543221 - RNA, 23 nt, Human
gggcgccgaggcccgggccagga

SEQ ID NO: 543222 - RNA, 22 nt, Human
gggggcggcagggcggcggcgg

SEQ ID NO: 543223 - RNA, 19 nt, Human
guccacgguacacugcagc

SEQ ID NO: 543224 - RNA, 23 nt, Human
guccacgguacacugcagccagc

SEQ ID NO: 543225 - RNA, 21 nt, Human
gucuccggcuccuccaaucac

SEQ ID NO: 543226 - RNA, 23 nt, Human
uaaaaaacaaaacccaaaaaaca

SEQ ID NO: 543227 - RNA, 24 nt, Human
uaaaaaacaaaacccaaaaaacaa

SEQ ID NO: 543228 - RNA, 28 nt, Human
uaaaaaacaaaacccaaaaaacaacaaa

SEQ ID NO: 543229 - RNA, 25 nt, Human
uaaucagcaccccuaccccaggggc

SEQ ID NO: 543230 - RNA, 21 nt, Human
uaccccaggggcaucuuccca

SEQ ID NO: 543231 - RNA, 24 nt, Human
uagcugagccagccagcucugccu

SEQ ID NO: 543232 - RNA, 18 nt, Human
uagucccacgguagcucc

SEQ ID NO: 543233 - RNA, 24 nt, Human
uauuaaaaaacaaaacccaaaaaa

SEQ ID NO: 543234 - RNA, 19 nt, Human
ucaacaaauaccagcacua

SEQ ID NO: 543235 - RNA, 21 nt, Human
ucaggugguguggccagcccu

SEQ ID NO: 543236 - RNA, 24 nt, Human
ucagugagaggggggcagcagggg

SEQ ID NO: 543237 - RNA, 18 nt, Human
uccacgguacacugcagc

SEQ ID NO: 543238 - RNA, 20 nt, Human
uccacgguacacugcagcca

SEQ ID NO: 543239 - RNA, 21 nt, Human
uccacgguacacugcagccag

SEQ ID NO: 543240 - RNA, 22 nt, Human
uccccaaagaccuuuggacccc

SEQ ID NO: 543241 - RNA, 22 nt, Human
uccccacggcaguccugcugcg

SEQ ID NO: 543242 - RNA, 24 nt, Human
uccccacggcaguccugcugcggc

SEQ ID NO: 543243 - RNA, 18 nt, Human
ucccuagcucaagggcuc

SEQ ID NO: 543244 - RNA, 19 nt, Human
ucccuccccaaagaccuuu

SEQ ID NO: 543245 - RNA, 23 nt, Human
ugagguaaucagcaccccuaccc

SEQ ID NO: 543246 - RNA, 24 nt, Human
ugcacucauacucaaaaacagccu

SEQ ID NO: 543247 - RNA, 24 nt, Human
ugcagaaguuacauuuuaaaacca

SEQ ID NO: 543248 - RNA, 24 nt, Human
ugcauugcagcagggagccucagc

SEQ ID NO: 543249 - RNA, 22 nt, Human
ugccauggaggauggacacgac

SEQ ID NO: 543250 - RNA, 22 nt, Human
ugcccaggugccugggucuccg

SEQ ID NO: 543251 - RNA, 20 nt, Human
ugcuuuaucauccuccugcc

SEQ ID NO: 543252 - RNA, 18 nt, Human
uggcaagcagcacagagg

SEQ ID NO: 543253 - RNA, 19 nt, Human
ugggaaaagccagcaguca

SEQ ID NO: 543254 - RNA, 24 nt, Human
ugggauuaaaaaauuuguguguau

SEQ ID NO: 543255 - RNA, 24 nt, Human
uggggcaggaacaagcuccagccu

SEQ ID NO: 543256 - RNA, 23 nt, Human
ugucggggcugccgcgaggggcu

SEQ ID NO: 543257 - RNA, 18 nt, Human
uuaaaaccagauuuucac

SEQ ID NO: 543258 - RNA, 20 nt, Human
uucaccugaggcgucaacca

SEQ ID NO: 543259 - RNA, 19 nt, Human
uucagagugcuuuuggcug

SEQ ID NO: 543260 - RNA, 18 nt, Human
uuccagacacucugucgg

SEQ ID NO: 543261 - RNA, 27 nt, Human
uucuuuuuaaaaguguuuauuuuuggc

SEQ ID NO: 543262 - RNA, 19 nt, Human
uugggaggggccgcgugcu

SEQ ID NO: 543263 - RNA, 18 nt, Human
uugguggggaaggauggg

SEQ ID NO: 543264 - RNA, 20 nt, Human
uuuggcuggccagagggugg

SEQ ID NO: 543265 - RNA, 24 nt, Human
uuuuuuucuuuuuaaaaguguuua

SEQ ID NO: 543266 - RNA, 23 nt, Human
uuuuuuuuuuuucuuuuuaaaag

SEQ ID NO: 543267 - RNA, 25 nt, Human
uuuuuuuuuuuuuuuuuuucuuuuu

SEQ ID NO: 543268 - RNA, 21 nt, Human
aaacauuucaguauauuccuu

SEQ ID NO: 543269 - RNA, 20 nt, Human
agaaucuugaauuuccuugc

SEQ ID NO: 543270 - RNA, 22 nt, Human
agagacuucccgcgcgcgccgg

SEQ ID NO: 543271 - RNA, 23 nt, Human
ccgcgcgcgccgggcccgccccu

SEQ ID NO: 543272 - RNA, 20 nt, Human
ccucaaagauuccuuuuagg

SEQ ID NO: 543273 - RNA, 23 nt, Human
ccuugcuagaaggcuuuuuuccu

SEQ ID NO: 543274 - RNA, 25 nt, Human
cuagaaggcuuuuuuccucccaaug

SEQ ID NO: 543275 - RNA, 22 nt, Human
cuguaguaaaaguuauguuuau

SEQ ID NO: 543276 - RNA, 21 nt, Human
gcggcugaggguagccggccg

SEQ ID NO: 543277 - RNA, 18 nt, Human
gucacaaugccauggggu

SEQ ID NO: 543278 - RNA, 26 nt, Human
uagaaggcuuuuuuccucaaagauuc

SEQ ID NO: 543279 - RNA, 22 nt, Human
ugaaacaagaaccugcuaacag

SEQ ID NO: 543280 - RNA, 19 nt, Human
ugaguuaucugaguuuuuc

SEQ ID NO: 543281 - RNA, 19 nt, Human
ugcuaugugauuucccauu

SEQ ID NO: 543282 - RNA, 18 nt, Human
uuucccauuugcaaggaa

SEQ ID NO: 543283 - RNA, 19 nt, Human
aaacaaauauacaaauacc

SEQ ID NO: 543284 - RNA, 20 nt, Human
aaacccggcuuuugcuggua

SEQ ID NO: 543285 - RNA, 24 nt, Human
aaagaaaacgcucaguagcaccau

SEQ ID NO: 543286 - RNA, 18 nt, Human
aaauagaaauguuacaga

SEQ ID NO: 543287 - RNA, 21 nt, Human
aacaacacagcaaaauccuca

SEQ ID NO: 543288 - RNA, 18 nt, Human
aaccagcuccaaacacgg

SEQ ID NO: 543289 - RNA, 22 nt, Human
aagaaauacauaagauagaaca

SEQ ID NO: 543290 - RNA, 25 nt, Human
aagaagacugcagcccauggcauuu

SEQ ID NO: 543291 - RNA, 24 nt, Human
aagaaucaaugggguacaaacuuc

SEQ ID NO: 543292 - RNA, 20 nt, Human
acaaaagcaaaagaaaauaa

SEQ ID NO: 543293 - RNA, 22 nt, Human
acaccacuguauuccacccugg

SEQ ID NO: 543294 - RNA, 22 nt, Human
accaagaaucaaugggguacaa

SEQ ID NO: 543295 - RNA, 24 nt, Human
accacuguauuccacccuggguga

SEQ ID NO: 543296 - RNA, 21 nt, Human
accagagaagacauggaaaac

SEQ ID NO: 543297 - RNA, 18 nt, Human
acugcagcccauggcauu

SEQ ID NO: 543298 - RNA, 22 nt, Human
agaaguccaaaauccagcuggg

SEQ ID NO: 543299 - RNA, 25 nt, Human
agcaaaauccucaaauaacuaggcc

SEQ ID NO: 543300 - RNA, 19 nt, Human
aggaauuccaggcugcagu

SEQ ID NO: 543301 - RNA, 24 nt, Human
aggcugagguggcaggguugcuug

SEQ ID NO: 543302 - RNA, 24 nt, Human
aggugaccagagaagacauggaaa

SEQ ID NO: 543303 - RNA, 22 nt, Human
auacugagaguaaccuaugcag

SEQ ID NO: 543304 - RNA, 24 nt, Human
aucacaccacuguauuccacccug

SEQ ID NO: 543305 - RNA, 20 nt, Human
auggaccugguagggaaaag

SEQ ID NO: 543306 - RNA, 24 nt, Human
augggguacaaacuuccccuuaga

SEQ ID NO: 543307 - RNA, 23 nt, Human
auuucuauuucaaaguugugcaa

SEQ ID NO: 543308 - RNA, 26 nt, Human
caaaaacugccacaaucuugcucaaa

SEQ ID NO: 543309 - RNA, 22 nt, Human
caaaagcaaaagaaaauaaugc

SEQ ID NO: 543310 - RNA, 26 nt, Human
caaaauccucaaauaacuaggccauu

SEQ ID NO: 543311 - RNA, 27 nt, Human
caagauagaguaccagguauuucuauu

SEQ ID NO: 543312 - RNA, 24 nt, Human
cacacucauuauuaaacaaaauug

SEQ ID NO: 543313 - RNA, 19 nt, Human
cacuguauuccacccuggg

SEQ ID NO: 543314 - RNA, 25 nt, Human
cacuguauuccacccugggugacaa

SEQ ID NO: 543315 - RNA, 28 nt, Human
cauuuauuuaacguaugcaguuuacaca

SEQ ID NO: 543316 - RNA, 18 nt, Human
ccacuggggcuugagggg

SEQ ID NO: 543317 - RNA, 24 nt, Human
ccacuguauuccacccugggugac

SEQ ID NO: 543318 - RNA, 22 nt, Human
ccaggaauuccaggcugcagug

SEQ ID NO: 543319 - RNA, 18 nt, Human
ccccuuagagaaaggugg

SEQ ID NO: 543320 - RNA, 19 nt, Human
ccccuuagagaaaggugga

SEQ ID NO: 543321 - RNA, 21 nt, Human
cccuaaagccucaaguuuucu

SEQ ID NO: 543322 - RNA, 21 nt, Human
ccgauauaaauagaaauguua

SEQ ID NO: 543323 - RNA, 24 nt, Human
ccugggugacaccgugaggcccug

SEQ ID NO: 543324 - RNA, 19 nt, Human
cuaguucuggaggccagaa

SEQ ID NO: 543325 - RNA, 22 nt, Human
cucauuauuaaacaaaauugga

SEQ ID NO: 543326 - RNA, 18 nt, Human
cugaacacagaaaaugua

SEQ ID NO: 543327 - RNA, 19 nt, Human
gaauauccuacuugguucc

SEQ ID NO: 543328 - RNA, 24 nt, Human
gagguggcaggguugcuugagccc

SEQ ID NO: 543329 - RNA, 20 nt, Human
gagugugucuuugguaggcu

SEQ ID NO: 543330 - RNA, 20 nt, Human
gcuaucauggauguucugua

SEQ ID NO: 543331 - RNA, 23 nt, Human
gcugaacacagaaaauguaucug

SEQ ID NO: 543332 - RNA, 18 nt, Human
gcuugaggggagaaugug

SEQ ID NO: 543333 - RNA, 22 nt, Human
ggcaaacacacaaaacaugcuu

SEQ ID NO: 543334 - RNA, 26 nt, Human
uaaaauaacuggcacuaguguuauaa

SEQ ID NO: 543335 - RNA, 22 nt, Human
uaacuaggccauuaaaacccag

SEQ ID NO: 543336 - RNA, 18 nt, Human
uaacugcuaucauugagg

SEQ ID NO: 543337 - RNA, 26 nt, Human
uaacugcuaucauugagguuaaccuu

SEQ ID NO: 543338 - RNA, 27 nt, Human
uaacugcuaucauugagguuaaccuuc

SEQ ID NO: 543339 - RNA, 21 nt, Human
uaacuggcacuaguguuauaa

SEQ ID NO: 543340 - RNA, 23 nt, Human
uaaguaugugcuucaagcaaugu

SEQ ID NO: 543341 - RNA, 22 nt, Human
uaauuacuuaccuuuacauuuu

SEQ ID NO: 543342 - RNA, 20 nt, Human
uacaaguucugcaccgugcu

SEQ ID NO: 543343 - RNA, 24 nt, Human
uagcuacuuggaaggcugaggugg

SEQ ID NO: 543344 - RNA, 21 nt, Human
uauacaaauaccauaagcauu

SEQ ID NO: 543345 - RNA, 25 nt, Human
uauacaaauaccauaagcauuauca

SEQ ID NO: 543346 - RNA, 23 nt, Human
ucacaccacuguauuccacccug

SEQ ID NO: 543347 - RNA, 20 nt, Human
uccacaugacacacaaugcc

SEQ ID NO: 543348 - RNA, 21 nt, Human
uccacaugacacacaaugccu

SEQ ID NO: 543349 - RNA, 21 nt, Human
uccacccugggugacaccgug

SEQ ID NO: 543350 - RNA, 19 nt, Human
uccuuugacucuuccagcu

SEQ ID NO: 543351 - RNA, 22 nt, Human
ucgaucccaaaggcaccaagaa

SEQ ID NO: 543352 - RNA, 20 nt, Human
ugacaccgugaggcccuguc

SEQ ID NO: 543353 - RNA, 19 nt, Human
ugaggggagaauguguccu

SEQ ID NO: 543354 - RNA, 18 nt, Human
ugagguggcaggguugcu

SEQ ID NO: 543355 - RNA, 24 nt, Human
ugagguggcaggguugcuugagcc

SEQ ID NO: 543356 - RNA, 27 nt, Human
ugcacuuuuaaagccuucacuucauag

SEQ ID NO: 543357 - RNA, 22 nt, Human
ugcuaucauggauguucuguag

SEQ ID NO: 543358 - RNA, 20 nt, Human
ugcuuugcucuucaaauuua

SEQ ID NO: 543359 - RNA, 21 nt, Human
uggaagaagacugcagcccau

SEQ ID NO: 543360 - RNA, 25 nt, Human
uggaagaagacugcagcccauggca

SEQ ID NO: 543361 - RNA, 19 nt, Human
uggaaggcugagguggcag

SEQ ID NO: 543362 - RNA, 19 nt, Human
uggaaggcugagguggcag

SEQ ID NO: 543363 - RNA, 20 nt, Human
uggaaggcugagguggcagg

SEQ ID NO: 543364 - RNA, 24 nt, Human
uggaaggcugagguggcaggguug

SEQ ID NO: 543365 - RNA, 23 nt, Human
uggggcuugaggggagaaugugu

SEQ ID NO: 543366 - RNA, 26 nt, Human
ugguaacuaagauccacaugacacac

SEQ ID NO: 543367 - RNA, 20 nt, Human
ugguacaaguucugcaccgu

SEQ ID NO: 543368 - RNA, 25 nt, Human
uguuacagaguaucauauacugaga

SEQ ID NO: 543369 - RNA, 19 nt, Human
uucuauuucaaaguugugc

SEQ ID NO: 543370 - RNA, 22 nt, Human
uucuguaguccuagcuacuugg

SEQ ID NO: 543371 - RNA, 19 nt, Human
uugcugguaaccugaaacu

SEQ ID NO: 543372 - RNA, 24 nt, Human
uugcuugagcccaggaauuccagg

SEQ ID NO: 543373 - RNA, 19 nt, Human
uuggaaggcugagguggca

SEQ ID NO: 543374 - RNA, 20 nt, Human
uugguacaaguucugcaccg

SEQ ID NO: 543375 - RNA, 24 nt, Human
uuucaaaguugugcaaaaacugcc

SEQ ID NO: 543376 - RNA, 23 nt, Human
uuugcugguaaccugaaacuuaa

SEQ ID NO: 543377 - RNA, 19 nt, Human
uuuguacuugguacaaguu

SEQ ID NO: 543378 - RNA, 18 nt, Human
uuuuuuuuuuuuuuuuug

SEQ ID NO: 543379 - RNA, 21 nt, Human
uuuuuuuuuuuuuuuuugcag

SEQ ID NO: 543380 - RNA, 21 nt, Human
aaaaaaggucaauagacagaa

SEQ ID NO: 543381 - RNA, 21 nt, Human
aaaacacacacagaugaaaug

SEQ ID NO: 543382 - RNA, 20 nt, Human
aaaauccagaaaacacacac

SEQ ID NO: 543383 - RNA, 26 nt, Human
aaaauccccuccuugcguguccaccc

SEQ ID NO: 543384 - RNA, 18 nt, Human
aaaaugggggugggggca

SEQ ID NO: 543385 - RNA, 26 nt, Human
aacaccuuuucauucucagaccauua

SEQ ID NO: 543386 - RNA, 20 nt, Human
aagcuacagcuggcuuuugg

SEQ ID NO: 543387 - RNA, 21 nt, Human
aauccagaaaacacacacaga

SEQ ID NO: 543388 - RNA, 26 nt, Human
aauccccuccuugcguguccacccac

SEQ ID NO: 543389 - RNA, 21 nt, Human
agaacagaugaaggguuaaua

SEQ ID NO: 543390 - RNA, 21 nt, Human
agacaggaaaauaaaugcuga

SEQ ID NO: 543391 - RNA, 18 nt, Human
agagaugagccuguuuac

SEQ ID NO: 543392 - RNA, 20 nt, Human
agaucagugggugagacugc

SEQ ID NO: 543393 - RNA, 20 nt, Human
agaugaaaugccuacaagga

SEQ ID NO: 543394 - RNA, 18 nt, Human
aggaggaaaacuugaauc

SEQ ID NO: 543395 - RNA, 19 nt, Human
aggaggaaaacuugaaucu

SEQ ID NO: 543396 - RNA, 24 nt, Human
auccguuuuuuuuguuuuuuuuuu

SEQ ID NO: 543397 - RNA, 23 nt, Human
auggaagagccagggcugggcgc

SEQ ID NO: 543398 - RNA, 23 nt, Human
caaacaccuuuucauucucagac

SEQ ID NO: 543399 - RNA, 21 nt, Human
caagaacagaugaaggguuaa

SEQ ID NO: 543400 - RNA, 18 nt, Human
caaggaggaaaacuugaa

SEQ ID NO: 543401 - RNA, 19 nt, Human
cacccacaacccagcaagc

SEQ ID NO: 543402 - RNA, 18 nt, Human
cagugcaguguucugcau

SEQ ID NO: 543403 - RNA, 23 nt, Human
cauggaagagccagggcugggcg

SEQ ID NO: 543404 - RNA, 20 nt, Human
ccauaaaccccacucacaag

SEQ ID NO: 543405 - RNA, 22 nt, Human
cccacaacccagcaagccaaac

SEQ ID NO: 543406 - RNA, 23 nt, Human
ccccuaaacuuacacccuccuug

SEQ ID NO: 543407 - RNA, 19 nt, Human
ccucccuuuccccauaaac

SEQ ID NO: 543408 - RNA, 24 nt, Human
ccucccuuuccccauaaaccccac

SEQ ID NO: 543409 - RNA, 18 nt, Human
ccugaaacccagagacuu

SEQ ID NO: 543410 - RNA, 20 nt, Human
ccuguagucccggaaauaga

SEQ ID NO: 543411 - RNA, 26 nt, Human
cuuccuguagucccggaaauagaaau

SEQ ID NO: 543412 - RNA, 20 nt, Human
gagaagauggguaacuuuua

SEQ ID NO: 543413 - RNA, 20 nt, Human
gagaauggggacaguagaga

SEQ ID NO: 543414 - RNA, 20 nt, Human
gcaaggguccugagaacuca

SEQ ID NO: 543415 - RNA, 24 nt, Human
gcugagacaccaaucagggaaggu

SEQ ID NO: 543416 - RNA, 21 nt, Human
gcuuaucaccucauuccccaa

SEQ ID NO: 543417 - RNA, 20 nt, Human
ggaaaggggcagagcaugga

SEQ ID NO: 543418 - RNA, 23 nt, Human
ggcauggagagaguggagaagga

SEQ ID NO: 543419 - RNA, 20 nt, Human
gggacaguagagaagauggg

SEQ ID NO: 543420 - RNA, 22 nt, Human
ggggacaguagagaagaugggu

SEQ ID NO: 543421 - RNA, 20 nt, Human
gggguggagaucagugggug

SEQ ID NO: 543422 - RNA, 19 nt, Human
uaaguaauagugaauggaa

SEQ ID NO: 543423 - RNA, 20 nt, Human
uaaugcuguccugaaaccca

SEQ ID NO: 543424 - RNA, 21 nt, Human
uacaaggaggaaaacuugaau

SEQ ID NO: 543425 - RNA, 21 nt, Human
uaggaaaacuaagggauuugg

SEQ ID NO: 543426 - RNA, 24 nt, Human
ucacaagucagucuggggcauugc

SEQ ID NO: 543427 - RNA, 19 nt, Human
ucaguauucucugcccuuc

SEQ ID NO: 543428 - RNA, 20 nt, Human
ucaguauucucugcccuucc

SEQ ID NO: 543429 - RNA, 23 nt, Human
ucagugcaguguucugcauuggu

SEQ ID NO: 543430 - RNA, 24 nt, Human
ucauuaaaaaaauggggguggggg

SEQ ID NO: 543431 - RNA, 22 nt, Human
uccacuguagacauuuaggaaa

SEQ ID NO: 543432 - RNA, 20 nt, Human
uccaggaaaggggcagagca

SEQ ID NO: 543433 - RNA, 25 nt, Human
uccagggcauggagagaguggagaa

SEQ ID NO: 543434 - RNA, 21 nt, Human
uccccuaaacuuacacccucc

SEQ ID NO: 543435 - RNA, 24 nt, Human
uccuuuaggacucagugcaguguu

SEQ ID NO: 543436 - RNA, 22 nt, Human
ugaaacccagagacucugcccu

SEQ ID NO: 543437 - RNA, 18 nt, Human
ugaaaugccuacaaggag

SEQ ID NO: 543438 - RNA, 19 nt, Human
uggaagagacaggaaaaua

SEQ ID NO: 543439 - RNA, 19 nt, Human
uggaagagccagggcuggg

SEQ ID NO: 543440 - RNA, 18 nt, Human
ugggggugggggcaaggg

SEQ ID NO: 543441 - RNA, 22 nt, Human
ugggggugggggcaaggguccu

SEQ ID NO: 543442 - RNA, 21 nt, Human
uggggugaaggugggaggaga

SEQ ID NO: 543443 - RNA, 24 nt, Human
uguccccuaaacuuacacccuccu

SEQ ID NO: 543444 - RNA, 22 nt, Human
uuauucauucuuucuucuuugu

SEQ ID NO: 543445 - RNA, 24 nt, Human
uuccccauaaaccccacucacaag

SEQ ID NO: 543446 - RNA, 18 nt, Human
uucuuucuucuuuguccc

SEQ ID NO: 543447 - RNA, 21 nt, Human
uuuaugauuucuucuggacuu

SEQ ID NO: 543448 - RNA, 24 nt, Human
uuuccccauaaaccccacucacaa

SEQ ID NO: 543449 - RNA, 18 nt, Human
uuugguggaagagacagg

SEQ ID NO: 543450 - RNA, 19 nt, Human
agaguacauuuuauacaaa

SEQ ID NO: 543451 - RNA, 20 nt, Human
ugaaaugaacguaacuauaa

SEQ ID NO: 543452 - RNA, 23 nt, Human
uuaugcaaaaaaaaauauacauu

SEQ ID NO: 543453 - RNA, 18 nt, Human
gaggaagggcuguccgca

SEQ ID NO: 543454 - RNA, 25 nt, Human
ucccagagguccgaacuugagugcc

SEQ ID NO: 543455 - RNA, 20 nt, Human
ugagugcccacaaaaggugg

SEQ ID NO: 543456 - RNA, 19 nt, Human
caagcuccugccccucccc

SEQ ID NO: 543457 - RNA, 19 nt, Human
cacacgaauggagggccac

SEQ ID NO: 543458 - RNA, 21 nt, Human
cccccuccccagccccuaaau

SEQ ID NO: 543459 - RNA, 19 nt, Human
ccccuaaauacacacacga

SEQ ID NO: 543460 - RNA, 21 nt, Human
cccuagcugucacgugccacc

SEQ ID NO: 543461 - RNA, 20 nt, Human
ccugccccucccccucccca

SEQ ID NO: 543462 - RNA, 21 nt, Human
ccugcugcagcagcugcucuu

SEQ ID NO: 543463 - RNA, 18 nt, Human
cguuuugaacccuagcug

SEQ ID NO: 543464 - RNA, 18 nt, Human
cguuuugaacccuagcug

SEQ ID NO: 543465 - RNA, 18 nt, Human
cucccccuccccagcccc

SEQ ID NO: 543466 - RNA, 23 nt, Human
cuccugccccucccccuccccag

SEQ ID NO: 543467 - RNA, 21 nt, Human
gaacugccauuuccucaucug

SEQ ID NO: 543468 - RNA, 21 nt, Human
gaacugccauuuccucaucug

SEQ ID NO: 543469 - RNA, 20 nt, Human
gagaacguuuugaacccuag

SEQ ID NO: 543470 - RNA, 20 nt, Human
gagaacguuuugaacccuag

SEQ ID NO: 543471 - RNA, 19 nt, Human
gaggggaagcaauuggcag

SEQ ID NO: 543472 - RNA, 19 nt, Human
gaggggaagcaauuggcag

SEQ ID NO: 543473 - RNA, 28 nt, Human
gcuccugccccucccccuccccagcccc

SEQ ID NO: 543474 - RNA, 19 nt, Human
ggaauugggggcaaggcca

SEQ ID NO: 543475 - RNA, 19 nt, Human
ggcccugcagcagcugcuc

SEQ ID NO: 543476 - RNA, 18 nt, Human
uagcugucacgugccacc

SEQ ID NO: 543477 - RNA, 24 nt, Human
uauggcagugcagaugaaaugaga

SEQ ID NO: 543478 - RNA, 24 nt, Human
uauggcagugcagaugaaaugaga

SEQ ID NO: 543479 - RNA, 20 nt, Human
ucacagaggggaagcaauug

SEQ ID NO: 543480 - RNA, 20 nt, Human
ucacagaggggaagcaauug

SEQ ID NO: 543481 - RNA, 18 nt, Human
uccugccccucccccucc

SEQ ID NO: 543482 - RNA, 23 nt, Human
ugauggaauugggggcaaggcca

SEQ ID NO: 543483 - RNA, 23 nt, Human
ugcagaugaaaugagaucacaga

SEQ ID NO: 543484 - RNA, 23 nt, Human
ugcagaugaaaugagaucacaga

SEQ ID NO: 543485 - RNA, 19 nt, Human
ugccauuuccucaucuggu

SEQ ID NO: 543486 - RNA, 19 nt, Human
ugccauuuccucaucuggu

SEQ ID NO: 543487 - RNA, 20 nt, Human
uucgcaaacucacuuccugc

SEQ ID NO: 543488 - RNA, 22 nt, Human
uuuuuuuuugguugucucuaau

SEQ ID NO: 543489 - RNA, 24 nt, Human
uuuuuuuuuuugguugucucuaau

SEQ ID NO: 543490 - RNA, 18 nt, Human
uuuuuuuuuuuuuuuuug

SEQ ID NO: 543491 - RNA, 18 nt, Human
uuuuuuuuuuuuuuuuug

SEQ ID NO: 543492 - RNA, 18 nt, Human
uuuuuuuuuuuuuuuuug

SEQ ID NO: 543493 - RNA, 18 nt, Human
uuuuuuuuuuuuuuuuug

SEQ ID NO: 543494 - RNA, 22 nt, Human
agaccccugcauggcaccacau

SEQ ID NO: 543495 - RNA, 26 nt, Human
agcggcggcaguagcagcggccuugg

SEQ ID NO: 543496 - RNA, 18 nt, Human
caggcggcgaacgcggca

SEQ ID NO: 543497 - RNA, 19 nt, Human
ccccccggccccgcccgga

SEQ ID NO: 543498 - RNA, 19 nt, Human
ccccccggccccgcccgga

SEQ ID NO: 543499 - RNA, 20 nt, Human
ccgccuccacuccgguccug

SEQ ID NO: 543500 - RNA, 20 nt, Human
ccugcgccgcuucaugcugc

SEQ ID NO: 543501 - RNA, 22 nt, Human
cggcaguagcagcggccuuggc

SEQ ID NO: 543502 - RNA, 21 nt, Human
cggccuuggccucggaggcuu

SEQ ID NO: 543503 - RNA, 23 nt, Human
cggcggcaguagcagcggccuug

SEQ ID NO: 543504 - RNA, 20 nt, Human
cugguugcaguggcuuccuc

SEQ ID NO: 543505 - RNA, 20 nt, Human
cuucaugcugcgccgccucc

SEQ ID NO: 543506 - RNA, 23 nt, Human
gcggcaguagcagcggccuuggc

SEQ ID NO: 543507 - RNA, 22 nt, Human
gcgggccugcgccgcuucaugc

SEQ ID NO: 543508 - RNA, 21 nt, Human
gucccgacgugcgcuauggag

SEQ ID NO: 543509 - RNA, 28 nt, Human
uaccagagaguucuacacaggucaagau

SEQ ID NO: 543510 - RNA, 22 nt, Human
uguauaccagagaguucuacac

SEQ ID NO: 543511 - RNA, 18 nt, Human
uucaugcugcgccgccuc

SEQ ID NO: 543512 - RNA, 18 nt, Human
uuccuuccccccggcccc

SEQ ID NO: 543513 - RNA, 21 nt, Human
uucuuaugguauugcuggguc

SEQ ID NO: 543514 - RNA, 19 nt, Human
aacuuccgguguucuccuu

SEQ ID NO: 543515 - RNA, 19 nt, Human
caacuuccgguguucuccu

SEQ ID NO: 543516 - RNA, 20 nt, Human
ccucggggcuggccagcgcu

SEQ ID NO: 543517 - RNA, 22 nt, Human
ccugguuccccgcggaggcugc

SEQ ID NO: 543518 - RNA, 18 nt, Human
cgcggaggcugcagccac

SEQ ID NO: 543519 - RNA, 21 nt, Human
cggggcuggccagcgcugggc

SEQ ID NO: 543520 - RNA, 19 nt, Human
cugcagccacuugugcugu

SEQ ID NO: 543521 - RNA, 18 nt, Human
gcagcggcuccucggggc

SEQ ID NO: 543522 - RNA, 23 nt, Human
uccaacuuccgguguucuccuug

SEQ ID NO: 543523 - RNA, 21 nt, Human
uccccgcggaggcugcagcca

SEQ ID NO: 543524 - RNA, 24 nt, Human
uccccgcggaggcugcagccacuu

SEQ ID NO: 543525 - RNA, 21 nt, Human
uccucggggcuggccagcgcu

SEQ ID NO: 543526 - RNA, 21 nt, Human
ucggggcggugaaggcagcgg

SEQ ID NO: 543527 - RNA, 21 nt, Human
ugaaggcagcggcuccucggg

SEQ ID NO: 543528 - RNA, 22 nt, Human
ugcagccacuugugcugugaug

SEQ ID NO: 543529 - RNA, 19 nt, Human
ugugauguggcggcucccg

SEQ ID NO: 543530 - RNA, 20 nt, Human
aagaagccugguguccagcu

SEQ ID NO: 543531 - RNA, 24 nt, Human
aggacagugucuuccuaaaggauc

SEQ ID NO: 543532 - RNA, 18 nt, Human
aggagggcucugcgccca

SEQ ID NO: 543533 - RNA, 22 nt, Human
aggcgggacucggccccucgcc

SEQ ID NO: 543534 - RNA, 20 nt, Human
aggggcggcacaagcggggg

SEQ ID NO: 543535 - RNA, 20 nt, Human
caaagcugcuacuaagaagc

SEQ ID NO: 543536 - RNA, 23 nt, Human
caaaugcccaccaggcgggacuc

SEQ ID NO: 543537 - RNA, 25 nt, Human
cacaagcgggggcgggcgggcggac

SEQ ID NO: 543538 - RNA, 21 nt, Human
caccaggcgggacucggcccc

SEQ ID NO: 543539 - RNA, 19 nt, Human
cacugugagcccggcaggu

SEQ ID NO: 543540 - RNA, 23 nt, Human
cagguucccuguccccaggcugg

SEQ ID NO: 543541 - RNA, 21 nt, Human
cagugacaucuccccagguuc

SEQ ID NO: 543542 - RNA, 24 nt, Human
caguguacaaagcugcuacuaaga

SEQ ID NO: 543543 - RNA, 21 nt, Human
ccaccaggcgggacucggccc

SEQ ID NO: 543544 - RNA, 23 nt, Human
cccaccaggcgggacucggcccc

SEQ ID NO: 543545 - RNA, 20 nt, Human
cccacuuuccucccaggccu

SEQ ID NO: 543546 - RNA, 20 nt, Human
ccccagguucagcccuucuc

SEQ ID NO: 543547 - RNA, 23 nt, Human
ccccagguucagcccuucucuug

SEQ ID NO: 543548 - RNA, 19 nt, Human
ccucacccuggcagugaca

SEQ ID NO: 543549 - RNA, 22 nt, Human
ccugguguccagcugcucccac

SEQ ID NO: 543550 - RNA, 25 nt, Human
cgccaagcaccuucgagaaacuucu

SEQ ID NO: 543551 - RNA, 24 nt, Human
cgcgugagccgggacgcgugcgug

SEQ ID NO: 543552 - RNA, 21 nt, Human
cggcugcgggaguguagggcu

SEQ ID NO: 543553 - RNA, 21 nt, Human
cuccguuccagucccgccccc

SEQ ID NO: 543554 - RNA, 22 nt, Human
cucugcgcccacuuuccuccca

SEQ ID NO: 543555 - RNA, 22 nt, Human
cugcgcccacuuuccucccagg

SEQ ID NO: 543556 - RNA, 20 nt, Human
cuggcagugacaucucccca

SEQ ID NO: 543557 - RNA, 18 nt, Human
gaagucucagcagcugug

SEQ ID NO: 543558 - RNA, 18 nt, Human
gacggcgggagacagacu

SEQ ID NO: 543559 - RNA, 20 nt, Human
gaggagcggcugcgggagug

SEQ ID NO: 543560 - RNA, 19 nt, Human
gaggcaggaugacugccug

SEQ ID NO: 543561 - RNA, 19 nt, Human
gaggcagugacugguggug

SEQ ID NO: 543562 - RNA, 19 nt, Human
gcaagaccgccaagcaccu

SEQ ID NO: 543563 - RNA, 22 nt, Human
gccgguucaccaagaagccugg

SEQ ID NO: 543564 - RNA, 23 nt, Human
gcucugcgcccacuuuccuccca

SEQ ID NO: 543565 - RNA, 18 nt, Human
ggaaggcaagaccgccaa

SEQ ID NO: 543566 - RNA, 22 nt, Human
ggagagccuguggggaggggga

SEQ ID NO: 543567 - RNA, 18 nt, Human
ggaguguagggcucugcg

SEQ ID NO: 543568 - RNA, 21 nt, Human
ggcgggcggacgcgugagccg

SEQ ID NO: 543569 - RNA, 19 nt, Human
gggaguguagggcucugcg

SEQ ID NO: 543570 - RNA, 20 nt, Human
ggggggcgagugcccugggg

SEQ ID NO: 543571 - RNA, 19 nt, Human
ggugguggggaggcggcag

SEQ ID NO: 543572 - RNA, 25 nt, Human
guccagcugcucccacacugugagc

SEQ ID NO: 543573 - RNA, 22 nt, Human
gugcccuggggcccccgcggcc

SEQ ID NO: 543574 - RNA, 22 nt, Human
uaaaagggacccuccacgggcg

SEQ ID NO: 543575 - RNA, 19 nt, Human
uaagaggacagugucuucc

SEQ ID NO: 543576 - RNA, 21 nt, Human
uaaggaggggggcgagugccc

SEQ ID NO: 543577 - RNA, 19 nt, Human
uacaaagcugcuacuaaga

SEQ ID NO: 543578 - RNA, 21 nt, Human
ucacagggccgguccugggcg

SEQ ID NO: 543579 - RNA, 21 nt, Human
uccccaggcugggcccagcgg

SEQ ID NO: 543580 - RNA, 21 nt, Human
uccccagguucagcccuucuc

SEQ ID NO: 543581 - RNA, 24 nt, Human
uccccagguucagcccuucucuug

SEQ ID NO: 543582 - RNA, 19 nt, Human
ucccugaagucucagcagc

SEQ ID NO: 543583 - RNA, 23 nt, Human
ucccugccauguggcuccaccuc

SEQ ID NO: 543584 - RNA, 23 nt, Human
ucgagaaacuucuacaaaagaaa

SEQ ID NO: 543585 - RNA, 19 nt, Human
ucuacaaaagaaaaugcua

SEQ ID NO: 543586 - RNA, 18 nt, Human
ucucuugaggggcucuug

SEQ ID NO: 543587 - RNA, 23 nt, Human
ucucuugaggggcucuuggcagc

SEQ ID NO: 543588 - RNA, 18 nt, Human
ucuuggcagcaggaccug

SEQ ID NO: 543589 - RNA, 21 nt, Human
ugaagucucagcagcugugug

SEQ ID NO: 543590 - RNA, 19 nt, Human
ugagcaggagggcucugcg

SEQ ID NO: 543591 - RNA, 21 nt, Human
ugaggggcucuuggcagcagg

SEQ ID NO: 543592 - RNA, 20 nt, Human
ugcccuggggcccccgcggc

SEQ ID NO: 543593 - RNA, 22 nt, Human
ugccugggcucaggcugccggc

SEQ ID NO: 543594 - RNA, 19 nt, Human
uggcagcaggaccugggac

SEQ ID NO: 543595 - RNA, 19 nt, Human
uggcaugcacagguuccug

SEQ ID NO: 543596 - RNA, 24 nt, Human
uggcuacaguguccucaguguaca

SEQ ID NO: 543597 - RNA, 21 nt, Human
ugggaccccacaaggagagcc

SEQ ID NO: 543598 - RNA, 19 nt, Human
uggggacggcgggagacag

SEQ ID NO: 543599 - RNA, 19 nt, Human
ugggucccugaagucucag

SEQ ID NO: 543600 - RNA, 22 nt, Human
uggugguggggaggcggcagca

SEQ ID NO: 543601 - RNA, 18 nt, Human
uguggggagggggaaggc

SEQ ID NO: 543602 - RNA, 22 nt, Human
aaccuguccuuucuggaacccu

SEQ ID NO: 543603 - RNA, 25 nt, Human
aaccuguccuuucuggaacccucug

SEQ ID NO: 543604 - RNA, 22 nt, Human
aagagaagggaagcccaucaaa

SEQ ID NO: 543605 - RNA, 21 nt, Human
acccuaaacuuugggcuucua

SEQ ID NO: 543606 - RNA, 19 nt, Human
agacugugguuuaccccau

SEQ ID NO: 543607 - RNA, 26 nt, Human
agagaagggaagcccaucaaaggggu

SEQ ID NO: 543608 - RNA, 19 nt, Human
aguagcgggaagagaaggg

SEQ ID NO: 543609 - RNA, 24 nt, Human
auaguagcgggaagagaagggaag

SEQ ID NO: 543610 - RNA, 23 nt, Human
cacagccaguucagacuccccag

SEQ ID NO: 543611 - RNA, 23 nt, Human
cagcgcaaacucugcacaccacc

SEQ ID NO: 543612 - RNA, 22 nt, Human
ccaacugcuccaagaagguaaa

SEQ ID NO: 543613 - RNA, 22 nt, Human
ccccauucuuuccauucccagu

SEQ ID NO: 543614 - RNA, 20 nt, Human
cccgcagagccaggcucccg

SEQ ID NO: 543615 - RNA, 24 nt, Human
cccgcagagccaggcucccgggcu

SEQ ID NO: 543616 - RNA, 21 nt, Human
cuccccagacaccagcaccac

SEQ ID NO: 543617 - RNA, 26 nt, Human
cugaguaacaguaaccuguccuuucu

SEQ ID NO: 543618 - RNA, 22 nt, Human
cuugccagaaccaggcucccca

SEQ ID NO: 543619 - RNA, 21 nt, Human
cuuucuggaacccucuggcca

SEQ ID NO: 543620 - RNA, 18 nt, Human
gagaaggcuaaggaaaga

SEQ ID NO: 543621 - RNA, 19 nt, Human
ggaagagaagggaagccca

SEQ ID NO: 543622 - RNA, 18 nt, Human
ggcaaggcuuggcgcugc

SEQ ID NO: 543623 - RNA, 24 nt, Human
gggcaaggcuuggcgcugcuucag

SEQ ID NO: 543624 - RNA, 22 nt, Human
ggugcucuugccagaaccaggc

SEQ ID NO: 543625 - RNA, 21 nt, Human
guccuuucuggaacccucugg

SEQ ID NO: 543626 - RNA, 19 nt, Human
uaccauuucuugggacuca

SEQ ID NO: 543627 - RNA, 22 nt, Human
uaccccauucuuuccauuccca

SEQ ID NO: 543628 - RNA, 23 nt, Human
uaccccauucuuuccauucccag

SEQ ID NO: 543629 - RNA, 23 nt, Human
uauagaucacaagggaguacaag

SEQ ID NO: 543630 - RNA, 20 nt, Human
ucagcagcucauaguagcgg

SEQ ID NO: 543631 - RNA, 26 nt, Human
ucagcagcucauaguagcgggaagag

SEQ ID NO: 543632 - RNA, 19 nt, Human
uccagugggguuacucucc

SEQ ID NO: 543633 - RNA, 22 nt, Human
uccccagacaccagcaccacuc

SEQ ID NO: 543634 - RNA, 24 nt, Human
uccccagacaccagcaccacucca

SEQ ID NO: 543635 - RNA, 23 nt, Human
uccccaggacuugggccauacuc

SEQ ID NO: 543636 - RNA, 22 nt, Human
ugagaggcugagaggucauggu

SEQ ID NO: 543637 - RNA, 18 nt, Human
ugagaugaacccagcucc

SEQ ID NO: 543638 - RNA, 21 nt, Human
ugagaugaacccagcuccauu

SEQ ID NO: 543639 - RNA, 21 nt, Human
ugagggauaaucuaaugugau

SEQ ID NO: 543640 - RNA, 19 nt, Human
uggcaggacuugcagcucu

SEQ ID NO: 543641 - RNA, 19 nt, Human
uggcaucauagaaaaaucu

SEQ ID NO: 543642 - RNA, 25 nt, Human
ugggacucagguuccaggguuuaca

SEQ ID NO: 543643 - RNA, 19 nt, Human
ugucugggugcuuuggugu

SEQ ID NO: 543644 - RNA, 19 nt, Human
ugucugggugcuuuggugu

SEQ ID NO: 543645 - RNA, 18 nt, Human
uuuuuuuuuuuuuuuuug

SEQ ID NO: 543646 - RNA, 22 nt, Human
uuuuuuuuuuuuuuuuuggcau

SEQ ID NO: 543647 - RNA, 22 nt, Human
uuuuuuuuuuuuuuuuuuuggc

SEQ ID NO: 543648 - RNA, 19 nt, Human
aaaaccaacuaaaaggggc

SEQ ID NO: 543649 - RNA, 18 nt, Human
accuucucuccucccccc

SEQ ID NO: 543650 - RNA, 24 nt, Human
agacacugagauucccuuuuauuu

SEQ ID NO: 543651 - RNA, 21 nt, Human
agccucccggcucccgggccu

SEQ ID NO: 543652 - RNA, 22 nt, Human
aggggcuauggucuggggggca

SEQ ID NO: 543653 - RNA, 19 nt, Human
cagggcccuagugcccucc

SEQ ID NO: 543654 - RNA, 20 nt, Human
ccagagcaacuaaaaccaac

SEQ ID NO: 543655 - RNA, 18 nt, Human
cccagagcaacuaaaacc

SEQ ID NO: 543656 - RNA, 23 nt, Human
cccccagagcaacuaaaaccaac

SEQ ID NO: 543657 - RNA, 21 nt, Human
ccccuggguccuggugccgcc

SEQ ID NO: 543658 - RNA, 25 nt, Human
cccgcagccucccggcucccgggcc

SEQ ID NO: 543659 - RNA, 26 nt, Human
cccgcagccucccggcucccgggccu

SEQ ID NO: 543660 - RNA, 18 nt, Human
cccuagugcccuccucuu

SEQ ID NO: 543661 - RNA, 21 nt, Human
cccuggguccuggugccgccc

SEQ ID NO: 543662 - RNA, 18 nt, Human
ccgcccccgccguuuccc

SEQ ID NO: 543663 - RNA, 19 nt, Human
ccgcccccgccguuucccg

SEQ ID NO: 543664 - RNA, 18 nt, Human
ccgcuccgcccccgccgu

SEQ ID NO: 543665 - RNA, 20 nt, Human
ccgcuccgcccccgccguuu

SEQ ID NO: 543666 - RNA, 21 nt, Human
ccgcuccgcccccgccguuuc

SEQ ID NO: 543667 - RNA, 19 nt, Human
ccuagugcccuccucuuga

SEQ ID NO: 543668 - RNA, 19 nt, Human
ccuccccccagagcaacua

SEQ ID NO: 543669 - RNA, 23 nt, Human
cuaccuucucuccuccccccaga

SEQ ID NO: 543670 - RNA, 26 nt, Human
cuagugcccuccucuugaagccuccu

SEQ ID NO: 543671 - RNA, 21 nt, Human
cucccgggccugcucgccgcc

SEQ ID NO: 543672 - RNA, 22 nt, Human
cucuaccuucucuccucccccc

SEQ ID NO: 543673 - RNA, 22 nt, Human
cuggccggugcgcgucccuccc

SEQ ID NO: 543674 - RNA, 27 nt, Human
gcccuagugcccuccucuugaagccuc

SEQ ID NO: 543675 - RNA, 19 nt, Human
gccucucucgccgcgucgg

SEQ ID NO: 543676 - RNA, 25 nt, Human
gcucuaccuucucuccuccccccag

SEQ ID NO: 543677 - RNA, 18 nt, Human
ggccugcucgccgcccgc

SEQ ID NO: 543678 - RNA, 20 nt, Human
uaaaaccaacuaaaaggggc

SEQ ID NO: 543679 - RNA, 24 nt, Human
uaaaaggggcuauggucugggggg

SEQ ID NO: 543680 - RNA, 19 nt, Human
uaagaacagcucuaccuuc

SEQ ID NO: 543681 - RNA, 24 nt, Human
uaagaacagcucuaccuucucucc

SEQ ID NO: 543682 - RNA, 20 nt, Human
ucccgcggaguccuagcgcc

SEQ ID NO: 543683 - RNA, 21 nt, Human
ucccgggccugcucgccgccc

SEQ ID NO: 543684 - RNA, 24 nt, Human
uggccggugcgcgucccuccccag

SEQ ID NO: 543685 - RNA, 24 nt, Human
aaaaaaccaaaccaaaccaaaaca

SEQ ID NO: 543686 - RNA, 21 nt, Human
aaaaagacaucuguaaauuca

SEQ ID NO: 543687 - RNA, 26 nt, Human
aaaacaagaaaaaccaccuuacaacc

SEQ ID NO: 543688 - RNA, 21 nt, Human
aaaaccaaaccaaaccaaaac

SEQ ID NO: 543689 - RNA, 21 nt, Human
aaaagacucaaaccaagggga

SEQ ID NO: 543690 - RNA, 24 nt, Human
aaaaugccaaauuaguuuuuaaua

SEQ ID NO: 543691 - RNA, 18 nt, Human
aaacaagaaaaaccaccu

SEQ ID NO: 543692 - RNA, 21 nt, Human
aaaccaaaccaaaacaagaaa

SEQ ID NO: 543693 - RNA, 26 nt, Human
aaaccaaaccaaaccaaaacaagaaa

SEQ ID NO: 543694 - RNA, 22 nt, Human
aacauaaacaacuuuaguuaau

SEQ ID NO: 543695 - RNA, 22 nt, Human
aaccaaaccaaaacaagaaaaa

SEQ ID NO: 543696 - RNA, 23 nt, Human
aaccaaaccaaaccaaaacaaga

SEQ ID NO: 543697 - RNA, 18 nt, Human
aagaacacaaacauaaac

SEQ ID NO: 543698 - RNA, 21 nt, Human
aagaacacaaacauaaacaac

SEQ ID NO: 543699 - RNA, 26 nt, Human
aagaacucgguuuaaacugguagcca

SEQ ID NO: 543700 - RNA, 20 nt, Human
aagagccaagaacuggacag

SEQ ID NO: 543701 - RNA, 23 nt, Human
aaugacaaaaagacaucuguaaa

SEQ ID NO: 543702 - RNA, 19 nt, Human
acaaauaagaggagggaaa

SEQ ID NO: 543703 - RNA, 24 nt, Human
acaaucuucccuucauaaagucag

SEQ ID NO: 543704 - RNA, 23 nt, Human
acaugcuaaauccagauaaaaca

SEQ ID NO: 543705 - RNA, 21 nt, Human
accaaaacaagaaaaaccacc

SEQ ID NO: 543706 - RNA, 23 nt, Human
accaaaacaagaaaaaccaccac

SEQ ID NO: 543707 - RNA, 19 nt, Human
acuaagauauuuaaaacag

SEQ ID NO: 543708 - RNA, 24 nt, Human
acuacaauuuauggcaauagaucu

SEQ ID NO: 543709 - RNA, 22 nt, Human
agaaagacauuucuuuuucuuc

SEQ ID NO: 543710 - RNA, 18 nt, Human
agaacacaaacauaaaca

SEQ ID NO: 543711 - RNA, 24 nt, Human
agcaagggacuaugaagaaggaaa

SEQ ID NO: 543712 - RNA, 19 nt, Human
agcuauuaaaaaaccaaac

SEQ ID NO: 543713 - RNA, 23 nt, Human
agcuuuacagccuauuauaccuu

SEQ ID NO: 543714 - RNA, 23 nt, Human
aggaacaagaggaaaacacuagc

SEQ ID NO: 543715 - RNA, 21 nt, Human
aucuucccccuccucucacug

SEQ ID NO: 543716 - RNA, 21 nt, Human
augcacaggggaaauucauug

SEQ ID NO: 543717 - RNA, 18 nt, Human
caaaacaagaaaaaccac

SEQ ID NO: 543718 - RNA, 21 nt, Human
caacaauaacaaauaagagga

SEQ ID NO: 543719 - RNA, 19 nt, Human
caaccagggcggcugccgg

SEQ ID NO: 543720 - RNA, 26 nt, Human
caaccucacaugagacauaaccaacu

SEQ ID NO: 543721 - RNA, 19 nt, Human
caagaaaaaccaccuuaca

SEQ ID NO: 543722 - RNA, 20 nt, Human
cacacagccaucaaaauagg

SEQ ID NO: 543723 - RNA, 23 nt, Human
cacuggguuaccaggcauuuucc

SEQ ID NO: 543724 - RNA, 27 nt, Human
cacuucaaaacaacacaccuaccagca

SEQ ID NO: 543725 - RNA, 19 nt, Human
cagauaaaacacuucaaaa

SEQ ID NO: 543726 - RNA, 21 nt, Human
cagcaguaggguaaaucagcu

SEQ ID NO: 543727 - RNA, 19 nt, Human
cagcuccuuaggucuuccu

SEQ ID NO: 543728 - RNA, 22 nt, Human
cauacagauacauacaaguuug

SEQ ID NO: 543729 - RNA, 23 nt, Human
caucuucccccuccucucacuga

SEQ ID NO: 543730 - RNA, 18 nt, Human
ccaaaacaagaaaaacca

SEQ ID NO: 543731 - RNA, 20 nt, Human
ccaaaacaagaaaaaccacc

SEQ ID NO: 543732 - RNA, 25 nt, Human
ccccuccucucacugacugacaacc

SEQ ID NO: 543733 - RNA, 28 nt, Human
ccgaguagcagcaccaccugcuccccuu

SEQ ID NO: 543734 - RNA, 24 nt, Human
ccgcaaccauagccaaaaggacca

SEQ ID NO: 543735 - RNA, 18 nt, Human
ccggugagccaucuuccc

SEQ ID NO: 543736 - RNA, 21 nt, Human
ccucccgaguagcagcaccac

SEQ ID NO: 543737 - RNA, 26 nt, Human
ccuucaaccagggcggcugccggagc

SEQ ID NO: 543738 - RNA, 23 nt, Human
ccuucagaauuuaagacaucagg

SEQ ID NO: 543739 - RNA, 19 nt, Human
cuggaguugugccucugcc

SEQ ID NO: 543740 - RNA, 23 nt, Human
cuggaguugugccucugccccau

SEQ ID NO: 543741 - RNA, 23 nt, Human
cuuccuagcagaacgggucccgg

SEQ ID NO: 543742 - RNA, 19 nt, Human
gaaaaaccaccuuacaacc

SEQ ID NO: 543743 - RNA, 21 nt, Human
gaaaugccucuagccaucccc

SEQ ID NO: 543744 - RNA, 19 nt, Human
gaacaagaggaaaacacua

SEQ ID NO: 543745 - RNA, 20 nt, Human
gaacucgguuuaaacuggua

SEQ ID NO: 543746 - RNA, 23 nt, Human
gaucuucacaugcuaaauccaga

SEQ ID NO: 543747 - RNA, 21 nt, Human
ggaaaacacuagcaugcucuc

SEQ ID NO: 543748 - RNA, 22 nt, Human
ggaacaagaggaaaacacuagc

SEQ ID NO: 543749 - RNA, 21 nt, Human
ggaagucuuccaaugacguau

SEQ ID NO: 543750 - RNA, 21 nt, Human
ggaggcugcucugcuuccucc

SEQ ID NO: 543751 - RNA, 23 nt, Human
ggaggcugcucugcuuccucccg

SEQ ID NO: 543752 - RNA, 27 nt, Human
ggcaacaauaacaaauaagaggaggga

SEQ ID NO: 543753 - RNA, 20 nt, Human
gggaaaaaaaagacucaaac

SEQ ID NO: 543754 - RNA, 22 nt, Human
gggcaacaauaacaaauaagag

SEQ ID NO: 543755 - RNA, 18 nt, Human
guauuuccagguucacua

SEQ ID NO: 543756 - RNA, 24 nt, Human
uaaaaaaccaaaccaaaccaaaac

SEQ ID NO: 543757 - RNA, 24 nt, Human
uaaaacaguucccauacaugcaga

SEQ ID NO: 543758 - RNA, 18 nt, Human
uaaacugguagccaaagc

SEQ ID NO: 543759 - RNA, 19 nt, Human
uaagaacacaaacauaaac

SEQ ID NO: 543760 - RNA, 24 nt, Human
uaagaacacaaacauaaacaacuu

SEQ ID NO: 543761 - RNA, 28 nt, Human
uaagaacacaaacauaaacuggagaccc

SEQ ID NO: 543762 - RNA, 21 nt, Human
uaagaggagggaaaaaaaaga

SEQ ID NO: 543763 - RNA, 23 nt, Human
uacagcaagggacuaugaagaag

SEQ ID NO: 543764 - RNA, 18 nt, Human
uagccaaagcaguugcag

SEQ ID NO: 543765 - RNA, 19 nt, Human
uauucuaggcacuggguua

SEQ ID NO: 543766 - RNA, 26 nt, Human
uauuucacuaccuuuauuuucuuuca

SEQ ID NO: 543767 - RNA, 23 nt, Human
ucaaauucauuuaugucaaaauc

SEQ ID NO: 543768 - RNA, 24 nt, Human
ucaggugcuuuucauacacaucau

SEQ ID NO: 543769 - RNA, 18 nt, Human
ucauaaagucaggggagc

SEQ ID NO: 543770 - RNA, 21 nt, Human
ucauaaagucaggggagcccc

SEQ ID NO: 543771 - RNA, 18 nt, Human
ucauauaauauucuaggc

SEQ ID NO: 543772 - RNA, 22 nt, Human
ucauauaauauucuaggcacug

SEQ ID NO: 543773 - RNA, 19 nt, Human
uccacauuguaaacagggc

SEQ ID NO: 543774 - RNA, 24 nt, Human
ucccauacaugcagacucccuuug

SEQ ID NO: 543775 - RNA, 18 nt, Human
ucccggugagccaucuuc

SEQ ID NO: 543776 - RNA, 20 nt, Human
ucccuuugacucugaaggcc

SEQ ID NO: 543777 - RNA, 22 nt, Human
ucucagcgacagcgacggaggc

SEQ ID NO: 543778 - RNA, 27 nt, Human
ucucagcgacagcgacggaggcugcuc

SEQ ID NO: 543779 - RNA, 24 nt, Human
ugaagaaggaaaccgcugugcagu

SEQ ID NO: 543780 - RNA, 27 nt, Human
ugaaggccaaacacacagccaucaaaa

SEQ ID NO: 543781 - RNA, 18 nt, Human
ugaaugaaaacgaguuca

SEQ ID NO: 543782 - RNA, 23 nt, Human
ugacugacaacccagccgggaga

SEQ ID NO: 543783 - RNA, 24 nt, Human
ugagagcuauguugcaagauuuac

SEQ ID NO: 543784 - RNA, 22 nt, Human
ugagcaaauuguucuaaucaua

SEQ ID NO: 543785 - RNA, 24 nt, Human
ugagcaaauuguucuaaucauaaa

SEQ ID NO: 543786 - RNA, 18 nt, Human
ugccucugccccauucuc

SEQ ID NO: 543787 - RNA, 20 nt, Human
uggagcuaaaagaaaaucaa

SEQ ID NO: 543788 - RNA, 21 nt, Human
uuaagaacacaaacauaaaca

SEQ ID NO: 543789 - RNA, 24 nt, Human
uucuuuugauaucauacuaagaua

SEQ ID NO: 543790 - RNA, 23 nt, Human
uugauuauucuuuugauaucaua

SEQ ID NO: 543791 - RNA, 20 nt, Human
uuuauugucacugacaaucu

SEQ ID NO: 543792 - RNA, 24 nt, Human
aaaaaagaaauaaaguagugagga

SEQ ID NO: 543793 - RNA, 22 nt, Human
aaaaacaugauuccauuuacgg

SEQ ID NO: 543794 - RNA, 20 nt, Human
aaaaaucauuagaacacacc

SEQ ID NO: 543795 - RNA, 24 nt, Human
aacuccuuuaaggauuucagggaa

SEQ ID NO: 543796 - RNA, 24 nt, Human
aagaagcaaaacucaacuguacaa

SEQ ID NO: 543797 - RNA, 19 nt, Human
aagccaaaccaauaaaaaa

SEQ ID NO: 543798 - RNA, 24 nt, Human
aaucuccccuucccccaagucuga

SEQ ID NO: 543799 - RNA, 20 nt, Human
aauuugcaauaaucuccccu

SEQ ID NO: 543800 - RNA, 23 nt, Human
acacggucuucaucaaaccauau

SEQ ID NO: 543801 - RNA, 23 nt, Human
agaaaaaaacaaaguucagugua

SEQ ID NO: 543802 - RNA, 22 nt, Human
agaaagaauuucuaaacaugaa

SEQ ID NO: 543803 - RNA, 22 nt, Human
agaaugaguuguauuuuucuua

SEQ ID NO: 543804 - RNA, 21 nt, Human
agaguugauaaaaauccacaa

SEQ ID NO: 543805 - RNA, 23 nt, Human
agccauugacacucaguaagcaa

SEQ ID NO: 543806 - RNA, 25 nt, Human
agggagcgggugagcgggcuccgca

SEQ ID NO: 543807 - RNA, 24 nt, Human
auaaaguaauucuucagguuuuaa

SEQ ID NO: 543808 - RNA, 21 nt, Human
auaaaguucucuacuugaaag

SEQ ID NO: 543809 - RNA, 19 nt, Human
auaaccacaaucucauauu

SEQ ID NO: 543810 - RNA, 18 nt, Human
auggcagcauuucugggu

SEQ ID NO: 543811 - RNA, 30 nt, Human
auggguuccucuauggcagcauuucugggu

SEQ ID NO: 543812 - RNA, 26 nt, Human
cacagccagcccgccagcagucuccu

SEQ ID NO: 543813 - RNA, 23 nt, Human
cacucaguaagcaacacugccau

SEQ ID NO: 543814 - RNA, 22 nt, Human
caugaaagaauaucaguggcua

SEQ ID NO: 543815 - RNA, 23 nt, Human
ccaaaaaaguuuauuagcaugau

SEQ ID NO: 543816 - RNA, 19 nt, Human
ccaaaccaauaaaaaaugc

SEQ ID NO: 543817 - RNA, 25 nt, Human
ccaagucugaagccuuccuuccccc

SEQ ID NO: 543818 - RNA, 20 nt, Human
ccacaaaacagcacuuuuaa

SEQ ID NO: 543819 - RNA, 21 nt, Human
ccaccgccgccaccgcccgag

SEQ ID NO: 543820 - RNA, 24 nt, Human
ccauugacacucaguaagcaacac

SEQ ID NO: 543821 - RNA, 20 nt, Human
cccauccagcccccuucagg

SEQ ID NO: 543822 - RNA, 19 nt, Human
ccccaaggguccucccuuc

SEQ ID NO: 543823 - RNA, 23 nt, Human
ccgccgccaccgcccgagcucga

SEQ ID NO: 543824 - RNA, 19 nt, Human
ccuuccuuccccccuauuc

SEQ ID NO: 543825 - RNA, 22 nt, Human
ccuugcccauccagcccccuuc

SEQ ID NO: 543826 - RNA, 18 nt, Human
cgccgccaccgcccgagc

SEQ ID NO: 543827 - RNA, 25 nt, Human
cgccuugcccauccagcccccuuca

SEQ ID NO: 543828 - RNA, 20 nt, Human
cggggcgaggaggaggaggc

SEQ ID NO: 543829 - RNA, 22 nt, Human
cugaagccaaaccaauaaaaaa

SEQ ID NO: 543830 - RNA, 18 nt, Human
cuggguuuaugguuggag

SEQ ID NO: 543831 - RNA, 21 nt, Human
gaaugaguuguauuuuucuua

SEQ ID NO: 543832 - RNA, 24 nt, Human
gacaugagugaucacaaagucaga

SEQ ID NO: 543833 - RNA, 20 nt, Human
gaccugcauuggagaguggc

SEQ ID NO: 543834 - RNA, 20 nt, Human
gagcgggugagcgggcuccg

SEQ ID NO: 543835 - RNA, 24 nt, Human
gccuugcccauccagcccccuuca

SEQ ID NO: 543836 - RNA, 19 nt, Human
gcuauaccuuaaaaccagu

SEQ ID NO: 543837 - RNA, 18 nt, Human
ggggggugguuaagaaug

SEQ ID NO: 543838 - RNA, 20 nt, Human
guaauugugaacacagaccc

SEQ ID NO: 543839 - RNA, 24 nt, Human
gucagaaccagguuauuuugcauu

SEQ ID NO: 543840 - RNA, 21 nt, Human
gugaauguguugaucugauga

SEQ ID NO: 543841 - RNA, 20 nt, Human
uaaaaugcauaaauguaugu

SEQ ID NO: 543842 - RNA, 26 nt, Human
uaaauuccuacaugauauuuagaaug

SEQ ID NO: 543843 - RNA, 23 nt, Human
uaacagcaaccccugauuuuaac

SEQ ID NO: 543844 - RNA, 19 nt, Human
uaacaguggaagauauugg

SEQ ID NO: 543845 - RNA, 20 nt, Human
uaacccaacucuuauuauga

SEQ ID NO: 543846 - RNA, 20 nt, Human
uaaucuccccuucccccaag

SEQ ID NO: 543847 - RNA, 21 nt, Human
uacuugaaaguuagaaaacac

SEQ ID NO: 543848 - RNA, 25 nt, Human
uacuugaaaguuagaaaacacuuug

SEQ ID NO: 543849 - RNA, 24 nt, Human
uacuugaauuccuggaaaaaaauc

SEQ ID NO: 543850 - RNA, 28 nt, Human
uagaauggcgguccccaaggguccuccc

SEQ ID NO: 543851 - RNA, 21 nt, Human
uauaaagaagcaaaacucaac

SEQ ID NO: 543852 - RNA, 22 nt, Human
ucaguguaugggacaugaguga

SEQ ID NO: 543853 - RNA, 21 nt, Human
ucccggagggugcggacucug

SEQ ID NO: 543854 - RNA, 22 nt, Human
uccuggaaaaaaaucauuagaa

SEQ ID NO: 543855 - RNA, 24 nt, Human
uccuugaacauccaucacuucugc

SEQ ID NO: 543856 - RNA, 20 nt, Human
ucgugacuauugcuuugucu

SEQ ID NO: 543857 - RNA, 23 nt, Human
ucuaaacaugaaagaauaucagu

SEQ ID NO: 543858 - RNA, 25 nt, Human
ucuaacagcaaccccugauuuuaac

SEQ ID NO: 543859 - RNA, 22 nt, Human
ucuccaaaaaaguuuauuagca

SEQ ID NO: 543860 - RNA, 18 nt, Human
ugaaagaauaucaguggc

SEQ ID NO: 543861 - RNA, 19 nt, Human
ugaacacagacccucuucc

SEQ ID NO: 543862 - RNA, 22 nt, Human
ugaacauccaucacuucugcuu

SEQ ID NO: 543863 - RNA, 20 nt, Human
ugaauaauaacagaaagaau

SEQ ID NO: 543864 - RNA, 22 nt, Human
ugagaaccugagauuguccaga

SEQ ID NO: 543865 - RNA, 20 nt, Human
ugcaauuugcaauaaucucc

SEQ ID NO: 543866 - RNA, 20 nt, Human
ugcauuuugucaguagacaa

SEQ ID NO: 543867 - RNA, 21 nt, Human
uggaagauauuggugugagga

SEQ ID NO: 543868 - RNA, 21 nt, Human
uggcuauaccuuaaaaccagu

SEQ ID NO: 543869 - RNA, 21 nt, Human
uggugugaggaugugggaaug

SEQ ID NO: 543870 - RNA, 18 nt, Human
uguccagaaaaaaacaaa

SEQ ID NO: 543871 - RNA, 24 nt, Human
ugugaacacagacccucuuccaag

SEQ ID NO: 543872 - RNA, 20 nt, Human
uguguuuucucuguuuuggg

SEQ ID NO: 543873 - RNA, 21 nt, Human
uguuuugggggggugguuaag

SEQ ID NO: 543874 - RNA, 23 nt, Human
uuaaaacauuuuuaguugcauuu

SEQ ID NO: 543875 - RNA, 20 nt, Human
uuaaaugcucugcucuuugg

SEQ ID NO: 543876 - RNA, 21 nt, Human
uuagaaaacacuuuggggcaa

SEQ ID NO: 543877 - RNA, 25 nt, Human
uucaauucugagaaccugagauugu

SEQ ID NO: 543878 - RNA, 19 nt, Human
uucacugcaauuugcaaua

SEQ ID NO: 543879 - RNA, 20 nt, Human
uugcuuugucugggaaugag

SEQ ID NO: 543880 - RNA, 18 nt, Human
uugggggagaaaaacaug

SEQ ID NO: 543881 - RNA, 20 nt, Human
uuugggggagaaaaacauga

SEQ ID NO: 543882 - RNA, 22 nt, Human
uuuuuuuuuuuuacugacucag

SEQ ID NO: 543883 - RNA, 18 nt, Human
uuuuuuuuuuuuuuuuug

SEQ ID NO: 543884 - RNA, 24 nt, Human
aaagugcugggauuacagguguga

SEQ ID NO: 543885 - RNA, 24 nt, Human
aaagugcugggauuauaggcguga

SEQ ID NO: 543886 - RNA, 23 nt, Human
aacccugucccgccacaucccac

SEQ ID NO: 543887 - RNA, 21 nt, Human
aagaaccugggaagaagagug

SEQ ID NO: 543888 - RNA, 20 nt, Human
aagaaggaaauaaugacaau

SEQ ID NO: 543889 - RNA, 25 nt, Human
aagacauccuguccuccacauggcc

SEQ ID NO: 543890 - RNA, 20 nt, Human
aaggaacagaugcuucugag

SEQ ID NO: 543891 - RNA, 23 nt, Human
aagugauucuucugcuucagcca

SEQ ID NO: 543892 - RNA, 18 nt, Human
aagugcugggauuacagg

SEQ ID NO: 543893 - RNA, 19 nt, Human
aagugcugggauuacaggu

SEQ ID NO: 543894 - RNA, 26 nt, Human
aagugcugggauuacaggugugagcc

SEQ ID NO: 543895 - RNA, 19 nt, Human
aagugcugggauuauaggc

SEQ ID NO: 543896 - RNA, 19 nt, Human
aagugcugggauuauaggc

SEQ ID NO: 543897 - RNA, 26 nt, Human
aagugcugggauuauaggcgugagcc

SEQ ID NO: 543898 - RNA, 20 nt, Human
acaaacacggugaccaucau

SEQ ID NO: 543899 - RNA, 19 nt, Human
acacaacaaacacggugac

SEQ ID NO: 543900 - RNA, 23 nt, Human
acagagucagguaggagcagaga

SEQ ID NO: 543901 - RNA, 20 nt, Human
accaauucucccuccacagg

SEQ ID NO: 543902 - RNA, 24 nt, Human
accacguuggucaggcuggucucg

SEQ ID NO: 543903 - RNA, 21 nt, Human
acccagcaacccugucccgcc

SEQ ID NO: 543904 - RNA, 19 nt, Human
acccaggcuggagugcagu

SEQ ID NO: 543905 - RNA, 25 nt, Human
acccgccuuggccucccaaagugcu

SEQ ID NO: 543906 - RNA, 24 nt, Human
accuugugauccacccgccuuggc

SEQ ID NO: 543907 - RNA, 18 nt, Human
acgggguuucaccacguu

SEQ ID NO: 543908 - RNA, 20 nt, Human
acgggguuucaccacguugg

SEQ ID NO: 543909 - RNA, 24 nt, Human
acgggguuucaccacguuggucag

SEQ ID NO: 543910 - RNA, 19 nt, Human
acuacaggugcgugccacc

SEQ ID NO: 543911 - RNA, 18 nt, Human
acugcaaccucugccucc

SEQ ID NO: 543912 - RNA, 22 nt, Human
acugcaaccucugccuccuggg

SEQ ID NO: 543913 - RNA, 22 nt, Human
acugccuccuccacugaugcuc

SEQ ID NO: 543914 - RNA, 21 nt, Human
agagacuccccaaggccugaa

SEQ ID NO: 543915 - RNA, 20 nt, Human
agaucuucccccuccacugg

SEQ ID NO: 543916 - RNA, 18 nt, Human
agcagcaccaccuccccc

SEQ ID NO: 543917 - RNA, 19 nt, Human
agccaccacacccagccua

SEQ ID NO: 543918 - RNA, 21 nt, Human
agccaccacacccagccuaga

SEQ ID NO: 543919 - RNA, 24 nt, Human
agcuggucuugaacuccuggccuc

SEQ ID NO: 543920 - RNA, 19 nt, Human
aggagcagagacuccccaa

SEQ ID NO: 543921 - RNA, 20 nt, Human
aggaggcugcugcugccccc

SEQ ID NO: 543922 - RNA, 21 nt, Human
aggcgugagccaccacaccca

SEQ ID NO: 543923 - RNA, 25 nt, Human
aggcuggagugcaguagcaugaucu

SEQ ID NO: 543924 - RNA, 25 nt, Human
aggcuggagugcaguggcacaaucu

SEQ ID NO: 543925 - RNA, 20 nt, Human
agggacugcagggaggcagg

SEQ ID NO: 543926 - RNA, 23 nt, Human
agguaggagcagagacuccccaa

SEQ ID NO: 543927 - RNA, 19 nt, Human
agguucaagugauucuucu

SEQ ID NO: 543928 - RNA, 21 nt, Human
agguucaagugauucuucugc

SEQ ID NO: 543929 - RNA, 18 nt, Human
aguagcugggauuacagg

SEQ ID NO: 543930 - RNA, 22 nt, Human
agucaccaauucucccuccaca

SEQ ID NO: 543931 - RNA, 21 nt, Human
agugaaggggacagauagaaa

SEQ ID NO: 543932 - RNA, 24 nt, Human
agugcaguagcaugaucuuggcug

SEQ ID NO: 543933 - RNA, 20 nt, Human
agugcaguggcacaaucucg

SEQ ID NO: 543934 - RNA, 24 nt, Human
agugcaguggcacaaucucggcuc

SEQ ID NO: 543935 - RNA, 19 nt, Human
agugguccacccaccucag

SEQ ID NO: 543936 - RNA, 19 nt, Human
auccacccgccuuggccuc

SEQ ID NO: 543937 - RNA, 24 nt, Human
augcuucuauuuuuaguagagacg

SEQ ID NO: 543938 - RNA, 23 nt, Human
augggguuucgccauguuggcca

SEQ ID NO: 543939 - RNA, 18 nt, Human
auucuccugccucagccu

SEQ ID NO: 543940 - RNA, 24 nt, Human
caaagugcugggauuacaggugug

SEQ ID NO: 543941 - RNA, 24 nt, Human
caaagugcugggauuauaggcgug

SEQ ID NO: 543942 - RNA, 19 nt, Human
caacaaacacggugaccau

SEQ ID NO: 543943 - RNA, 20 nt, Human
caagugauucuccugccuca

SEQ ID NO: 543944 - RNA, 22 nt, Human
caagugauucuccugccucagc

SEQ ID NO: 543945 - RNA, 22 nt, Human
caagugauucuucugcuucagc

SEQ ID NO: 543946 - RNA, 23 nt, Human
caauucucccuccacaggagccc

SEQ ID NO: 543947 - RNA, 20 nt, Human
cacagaaaggguaccaucca

SEQ ID NO: 543948 - RNA, 21 nt, Human
cacagccauguaccccuccug

SEQ ID NO: 543949 - RNA, 22 nt, Human
cacaguaaguacacaacaaaca

SEQ ID NO: 543950 - RNA, 23 nt, Human
cacaguaaguacacaacaaacac

SEQ ID NO: 543951 - RNA, 21 nt, Human
caccacacccagccuagaguu

SEQ ID NO: 543952 - RNA, 22 nt, Human
caccacacccagccuagaguua

SEQ ID NO: 543953 - RNA, 19 nt, Human
caccaccucccccaucaca

SEQ ID NO: 543954 - RNA, 21 nt, Human
caccacguuggucaggcuggu

SEQ ID NO: 543955 - RNA, 24 nt, Human
caccacguuggucaggcuggucuc

SEQ ID NO: 543956 - RNA, 22 nt, Human
cacccaccucagccucccaaag

SEQ ID NO: 543957 - RNA, 23 nt, Human
cacccaccucagccucccaaagu

SEQ ID NO: 543958 - RNA, 23 nt, Human
cacccgccuuggccucccaaagu

SEQ ID NO: 543959 - RNA, 24 nt, Human
cacccgccuuggccucccaaagug

SEQ ID NO: 543960 - RNA, 22 nt, Human
caccgcuuucccccuuccccac

SEQ ID NO: 543961 - RNA, 24 nt, Human
caccucagccucccaaagugcugg

SEQ ID NO: 543962 - RNA, 18 nt, Human
caccucccccaucacagc

SEQ ID NO: 543963 - RNA, 21 nt, Human
caccucgugaccaggaaggaa

SEQ ID NO: 543964 - RNA, 19 nt, Human
caccugcguagcggggacu

SEQ ID NO: 543965 - RNA, 19 nt, Human
caccuuaacuccuccuccu

SEQ ID NO: 543966 - RNA, 19 nt, Human
cagaauccucacuccccaa

SEQ ID NO: 543967 - RNA, 18 nt, Human
cagaucuucccccuccac

SEQ ID NO: 543968 - RNA, 18 nt, Human
cagcacaguaaguacaca

SEQ ID NO: 543969 - RNA, 18 nt, Human
cagccauguaccccuccu

SEQ ID NO: 543970 - RNA, 20 nt, Human
cagccuccugaguagcuggg

SEQ ID NO: 543971 - RNA, 18 nt, Human
caggagcccagcacagaa

SEQ ID NO: 543972 - RNA, 19 nt, Human
caggagcccagcacagaaa

SEQ ID NO: 543973 - RNA, 21 nt, Human
cagguucaagugauucuucug

SEQ ID NO: 543974 - RNA, 24 nt, Human
caucacagccauguaccccuccug

SEQ ID NO: 543975 - RNA, 24 nt, Human
cauguuggccaagcuggucuugaa

SEQ ID NO: 543976 - RNA, 23 nt, Human
cauugggagaggaaggaccacug

SEQ ID NO: 543977 - RNA, 20 nt, Human
ccaaagugcugggauuacag

SEQ ID NO: 543978 - RNA, 21 nt, Human
ccaaagugcugggauuacagg

SEQ ID NO: 543979 - RNA, 21 nt, Human
ccaaagugcugggauuacagg

SEQ ID NO: 543980 - RNA, 24 nt, Human
ccaaagugcugggauuacaggugu

SEQ ID NO: 543981 - RNA, 20 nt, Human
ccaaagugcugggauuauag

SEQ ID NO: 543982 - RNA, 22 nt, Human
ccaaagugcugggauuauaggc

SEQ ID NO: 543983 - RNA, 24 nt, Human
ccaaagugcugggauuauaggcgu

SEQ ID NO: 543984 - RNA, 18 nt, Human
ccacauccucccaccuuu

SEQ ID NO: 543985 - RNA, 25 nt, Human
ccacauccucccaccuuuguggauc

SEQ ID NO: 543986 - RNA, 20 nt, Human
ccaccacacccugcuaauuu

SEQ ID NO: 543987 - RNA, 26 nt, Human
ccacccaccucagccucccaaagugc

SEQ ID NO: 543988 - RNA, 24 nt, Human
ccaccugcguagcggggacuacag

SEQ ID NO: 543989 - RNA, 20 nt, Human
ccacuaaacuuuaacagccc

SEQ ID NO: 543990 - RNA, 20 nt, Human
ccaugagcucuucccgauuc

SEQ ID NO: 543991 - RNA, 21 nt, Human
ccauguuggccaagcuggucu

SEQ ID NO: 543992 - RNA, 21 nt, Human
ccauguuggccaagcuggucu

SEQ ID NO: 543993 - RNA, 24 nt, Human
ccccaaggccugaaagugaagggg

SEQ ID NO: 543994 - RNA, 25 nt, Human
ccccacauccucccaccuuugugga

SEQ ID NO: 543995 - RNA, 26 nt, Human
ccccaucacagccauguaccccuccu

SEQ ID NO: 543996 - RNA, 22 nt, Human
cccccaucacagccauguaccc

SEQ ID NO: 543997 - RNA, 20 nt, Human
cccgccacaucccacauccc

SEQ ID NO: 543998 - RNA, 19 nt, Human
cccugucccgccacauccc

SEQ ID NO: 543999 - RNA, 22 nt, Human
ccucaagugguccacccaccuc

SEQ ID NO: 544000 - RNA, 24 nt, Human
ccuccuggguucaagugauucucc

SEQ ID NO: 544001 - RNA, 22 nt, Human
ccucugccuccuggguucaagu

SEQ ID NO: 544002 - RNA, 18 nt, Human
ccucugcgaggaaagcuc

SEQ ID NO: 544003 - RNA, 23 nt, Human
ccugaguagcugggauuacaggc

SEQ ID NO: 544004 - RNA, 24 nt, Human
ccugaguagcugggauuacaggca

SEQ ID NO: 544005 - RNA, 23 nt, Human
ccugccucagccuccugaguagc

SEQ ID NO: 544006 - RNA, 18 nt, Human
ccuggccucaaguggucc

SEQ ID NO: 544007 - RNA, 24 nt, Human
ccuggccucaagugguccacccac

SEQ ID NO: 544008 - RNA, 23 nt, Human
ccuggguucaagugauucuccuc

SEQ ID NO: 544009 - RNA, 23 nt, Human
ccuggguucaagugauucuccug

SEQ ID NO: 544010 - RNA, 27 nt, Human
cgccauguuggccaagcuggucuugaa

SEQ ID NO: 544011 - RNA, 24 nt, Human
cgcucugucacccaggcuggagug

SEQ ID NO: 544012 - RNA, 20 nt, Human
cggccuccguacuccuuccu

SEQ ID NO: 544013 - RNA, 18 nt, Human
cggcuccuucucggccuc

SEQ ID NO: 544014 - RNA, 24 nt, Human
cgguagagaugggguuucgccaug

SEQ ID NO: 544015 - RNA, 24 nt, Human
cucacugcaaccuccaccucucag

SEQ ID NO: 544016 - RNA, 24 nt, Human
cucagccuccugaguagcugggau

SEQ ID NO: 544017 - RNA, 23 nt, Human
cuccuccugccacuaaacuuuaa

SEQ ID NO: 544018 - RNA, 23 nt, Human
cuccugccacuaaacuuuaacag

SEQ ID NO: 544019 - RNA, 23 nt, Human
cuccuggccucaagugguccacc

SEQ ID NO: 544020 - RNA, 20 nt, Human
cuccuggguucaagugauuc

SEQ ID NO: 544021 - RNA, 21 nt, Human
cuccuggguucaagugauucu

SEQ ID NO: 544022 - RNA, 24 nt, Human
cucgcucugucacccaggcuggag

SEQ ID NO: 544023 - RNA, 20 nt, Human
cucuaucgcccaggcuggag

SEQ ID NO: 544024 - RNA, 23 nt, Human
cucuaucgcccaggcuggagugc

SEQ ID NO: 544025 - RNA, 19 nt, Human
cucucagguucaagugauu

SEQ ID NO: 544026 - RNA, 19 nt, Human
cucugcguccucaccgcuu

SEQ ID NO: 544027 - RNA, 21 nt, Human
cucuucccgauuccacagucc

SEQ ID NO: 544028 - RNA, 24 nt, Human
cucuugaccuugugauccacccgc

SEQ ID NO: 544029 - RNA, 24 nt, Human
cugacugcaaccucugccuccugg

SEQ ID NO: 544030 - RNA, 23 nt, Human
cugaguagcugggauuacaggca

SEQ ID NO: 544031 - RNA, 21 nt, Human
cugaugcuccccugaaauuac

SEQ ID NO: 544032 - RNA, 19 nt, Human
cugcaaccucugccuccug

SEQ ID NO: 544033 - RNA, 23 nt, Human
cugcaaccucugccuccuggguu

SEQ ID NO: 544034 - RNA, 24 nt, Human
cugcaaccucugccuccuggguuc

SEQ ID NO: 544035 - RNA, 20 nt, Human
cugcagaucuucccccucca

SEQ ID NO: 544036 - RNA, 23 nt, Human
cugccucagccuccugaguagcu

SEQ ID NO: 544037 - RNA, 19 nt, Human
cugccuccuccacugaugc

SEQ ID NO: 544038 - RNA, 22 nt, Human
cugccuccuccacugaugcucc

SEQ ID NO: 544039 - RNA, 23 nt, Human
cugccuccuggguucaagugauu

SEQ ID NO: 544040 - RNA, 24 nt, Human
cuggagugcaguagcaugaucuug

SEQ ID NO: 544041 - RNA, 26 nt, Human
gaccaucauccucacugagcaugaaa

SEQ ID NO: 544042 - RNA, 20 nt, Human
gaccuugugauccacccgcc

SEQ ID NO: 544043 - RNA, 21 nt, Human
gaccuugugauccacccgccu

SEQ ID NO: 544044 - RNA, 21 nt, Human
gaccuugugauccacccgccu

SEQ ID NO: 544045 - RNA, 24 nt, Human
gaccuugugauccacccgccuugg

SEQ ID NO: 544046 - RNA, 23 nt, Human
gagacgggguuucaccacguugg

SEQ ID NO: 544047 - RNA, 24 nt, Human
gagacgggguuucaccacguuggu

SEQ ID NO: 544048 - RNA, 18 nt, Human
gagaugggguuucgccau

SEQ ID NO: 544049 - RNA, 24 nt, Human
gagaugggguuucgccauguuggc

SEQ ID NO: 544050 - RNA, 24 nt, Human
gaguagcugggauuacaggcacgc

SEQ ID NO: 544051 - RNA, 18 nt, Human
gauuacaggugugagcca

SEQ ID NO: 544052 - RNA, 20 nt, Human
gauuacaggugugagccacc

SEQ ID NO: 544053 - RNA, 24 nt, Human
gauuacaggugugagccaccucgc

SEQ ID NO: 544054 - RNA, 18 nt, Human
gauuauaggcgugagcca

SEQ ID NO: 544055 - RNA, 21 nt, Human
gauuauaggcgugagccacca

SEQ ID NO: 544056 - RNA, 22 nt, Human
gauuauaggcgugagccaccac

SEQ ID NO: 544057 - RNA, 21 nt, Human
gauucuccugccucagccucc

SEQ ID NO: 544058 - RNA, 22 nt, Human
gcaaccuccaccucucagguuc

SEQ ID NO: 544059 - RNA, 22 nt, Human
gcaaccucugccuccuggguuc

SEQ ID NO: 544060 - RNA, 25 nt, Human
gcagagacuccccaaggccugaaag

SEQ ID NO: 544061 - RNA, 19 nt, Human
gcauuuguaaaacaggauc

SEQ ID NO: 544062 - RNA, 19 nt, Human
gcccaggcuggagugcagu

SEQ ID NO: 544063 - RNA, 23 nt, Human
gcccaggcuggagugcaguggca

SEQ ID NO: 544064 - RNA, 19 nt, Human
gcccccacugccuccucca

SEQ ID NO: 544065 - RNA, 22 nt, Human
gccuuggccucccaaagugcug

SEQ ID NO: 544066 - RNA, 22 nt, Human
gcucuaucgcccaggcuggagu

SEQ ID NO: 544067 - RNA, 25 nt, Human
gcucugucacccaggcuggagugca

SEQ ID NO: 544068 - RNA, 19 nt, Human
gcuggagugcaguggcaca

SEQ ID NO: 544069 - RNA, 25 nt, Human
ggcauguucuagggaccuccugcgg

SEQ ID NO: 544070 - RNA, 23 nt, Human
gggacuacaggugcgugccacca

SEQ ID NO: 544071 - RNA, 21 nt, Human
gggacugcagggaggcaggua

SEQ ID NO: 544072 - RNA, 23 nt, Human
gggguuucaccacguuggucagg

SEQ ID NO: 544073 - RNA, 18 nt, Human
gggguuucgccauguugg

SEQ ID NO: 544074 - RNA, 22 nt, Human
gggguuucgccauguuggccaa

SEQ ID NO: 544075 - RNA, 22 nt, Human
ggguuucaccacguuggucagg

SEQ ID NO: 544076 - RNA, 20 nt, Human
ggugaccaucauccucacug

SEQ ID NO: 544077 - RNA, 21 nt, Human
guagagaugggguuucgccau

SEQ ID NO: 544078 - RNA, 22 nt, Human
guagagaugggguuucgccaug

SEQ ID NO: 544079 - RNA, 23 nt, Human
guagagaugggguuucgccaugu

SEQ ID NO: 544080 - RNA, 18 nt, Human
guagcugggauuacaggc

SEQ ID NO: 544081 - RNA, 24 nt, Human
gugauccacccgccuuggccuccc

SEQ ID NO: 544082 - RNA, 23 nt, Human
gugauucuccugccucagccucc

SEQ ID NO: 544083 - RNA, 24 nt, Human
gugguccacccaccucagccuccc

SEQ ID NO: 544084 - RNA, 25 nt, Human
guuacuuguuuuuuguuuuuuuuuu

SEQ ID NO: 544085 - RNA, 20 nt, Human
guuuuuuuuuugagacagag

SEQ ID NO: 544086 - RNA, 21 nt, Human
uaaaagaacgccguagcugcg

SEQ ID NO: 544087 - RNA, 24 nt, Human
uaaugcuucuauuuuuaguagaga

SEQ ID NO: 544088 - RNA, 22 nt, Human
uacaacacagagucagguagga

SEQ ID NO: 544089 - RNA, 18 nt, Human
uacaggugugagccaccu

SEQ ID NO: 544090 - RNA, 22 nt, Human
uacaggugugagccaccucgcc

SEQ ID NO: 544091 - RNA, 22 nt, Human
uagagacgggguuucaccacgu

SEQ ID NO: 544092 - RNA, 22 nt, Human
uagagaugggguuucgccaugu

SEQ ID NO: 544093 - RNA, 24 nt, Human
uaguagagacgggguuucaccacg

SEQ ID NO: 544094 - RNA, 26 nt, Human
uaguagagacgggguuucaccacguu

SEQ ID NO: 544095 - RNA, 19 nt, Human
uaucgcccaggcuggagug

SEQ ID NO: 544096 - RNA, 21 nt, Human
uaucgcccaggcuggagugca

SEQ ID NO: 544097 - RNA, 19 nt, Human
uaucucagggcagcuacag

SEQ ID NO: 544098 - RNA, 19 nt, Human
ucaagugauucuccugccu

SEQ ID NO: 544099 - RNA, 24 nt, Human
ucacccaggcuggagugcaguagc

SEQ ID NO: 544100 - RNA, 21 nt, Human
ucacugagcaugaaacuaugc

SEQ ID NO: 544101 - RNA, 24 nt, Human
ucacugcaaccuccaccucucagg

SEQ ID NO: 544102 - RNA, 24 nt, Human
ucacugcaaccuccaccucucagg

SEQ ID NO: 544103 - RNA, 27 nt, Human
ucacugcaaccuccaccucucagguuc

SEQ ID NO: 544104 - RNA, 18 nt, Human
ucagccucccaaagugcu

SEQ ID NO: 544105 - RNA, 20 nt, Human
ucagccuccugaguagcugg

SEQ ID NO: 544106 - RNA, 26 nt, Human
ucaguccagcagcaccaccuccccca

SEQ ID NO: 544107 - RNA, 23 nt, Human
uccacaggagcccagcacagaaa

SEQ ID NO: 544108 - RNA, 21 nt, Human
uccacccaccucagccuccca

SEQ ID NO: 544109 - RNA, 23 nt, Human
ucccaaagugcugggauuacagg

SEQ ID NO: 544110 - RNA, 24 nt, Human
ucccaaagugcugggauuauaggc

SEQ ID NO: 544111 - RNA, 22 nt, Human
ucccaacccccaggaagacauc

SEQ ID NO: 544112 - RNA, 24 nt, Human
ucccccaucacagccauguacccc

SEQ ID NO: 544113 - RNA, 24 nt, Human
uccugaguagcugggauuacaggc

SEQ ID NO: 544114 - RNA, 21 nt, Human
uccuggguucaagugauucuc

SEQ ID NO: 544115 - RNA, 24 nt, Human
uccuggguucaagugauucuccug

SEQ ID NO: 544116 - RNA, 22 nt, Human
ucgccauguuggccaagcuggu

SEQ ID NO: 544117 - RNA, 24 nt, Human
ucgccauguuggccaagcuggucu

SEQ ID NO: 544118 - RNA, 22 nt, Human
ucgcccaggcuggagugcagug

SEQ ID NO: 544119 - RNA, 24 nt, Human
ucgcucugucacccaggcuggagu

SEQ ID NO: 544120 - RNA, 24 nt, Human
ucggccuccguacuccuuccucag

SEQ ID NO: 544121 - RNA, 24 nt, Human
ucgguagagaugggguuucgccau

SEQ ID NO: 544122 - RNA, 20 nt, Human
ucuaaaagcugacacuccug

SEQ ID NO: 544123 - RNA, 23 nt, Human
ucuagcucuaucgcccaggcugg

SEQ ID NO: 544124 - RNA, 24 nt, Human
ucuagcucuaucgcccaggcugga

SEQ ID NO: 544125 - RNA, 21 nt, Human
ucucagguucaagugauucuu

SEQ ID NO: 544126 - RNA, 24 nt, Human
ucucagguucaagugauucuucug

SEQ ID NO: 544127 - RNA, 24 nt, Human
ucuccugccucagccuccugagua

SEQ ID NO: 544128 - RNA, 19 nt, Human
ucucgaacucuugaccuug

SEQ ID NO: 544129 - RNA, 19 nt, Human
ucucgcucugucacccagg

SEQ ID NO: 544130 - RNA, 23 nt, Human
ucucgcucugucacccaggcugg

SEQ ID NO: 544131 - RNA, 24 nt, Human
ucucgcucugucacccaggcugga

SEQ ID NO: 544132 - RNA, 26 nt, Human
ucucgcucugucacccaggcuggagu

SEQ ID NO: 544133 - RNA, 27 nt, Human
ucucgcucugucacccaggcuggagug

SEQ ID NO: 544134 - RNA, 18 nt, Human
ucucuuggcguuuucggc

SEQ ID NO: 544135 - RNA, 18 nt, Human
ucucuugguaggcuccag

SEQ ID NO: 544136 - RNA, 24 nt, Human
ucugucacccaggcuggagugcag

SEQ ID NO: 544137 - RNA, 24 nt, Human
ucuugaacuccuggccucaagugg

SEQ ID NO: 544138 - RNA, 21 nt, Human
ugaaacuaugcuagcugcaga

SEQ ID NO: 544139 - RNA, 21 nt, Human
ugaaauuacaacacagaguca

SEQ ID NO: 544140 - RNA, 18 nt, Human
ugaccaggaaggaacaga

SEQ ID NO: 544141 - RNA, 18 nt, Human
ugaccuugugauccaccc

SEQ ID NO: 544142 - RNA, 24 nt, Human
ugacugcaaccucugccuccuggg

SEQ ID NO: 544143 - RNA, 22 nt, Human
ugagacagagucuagcucuauc

SEQ ID NO: 544144 - RNA, 22 nt, Human
ugagacggagucucgcucuguc

SEQ ID NO: 544145 - RNA, 18 nt, Human
ugauguagaagaaggaaa

SEQ ID NO: 544146 - RNA, 20 nt, Human
ugcagaauccucacucccca

SEQ ID NO: 544147 - RNA, 22 nt, Human
ugcaguggcacaaucucggcuc

SEQ ID NO: 544148 - RNA, 20 nt, Human
ugcccagagaguccauccca

SEQ ID NO: 544149 - RNA, 19 nt, Human
ugcccccacugccuccucc

SEQ ID NO: 544150 - RNA, 24 nt, Human
ugccucagccuccugaguagcugg

SEQ ID NO: 544151 - RNA, 22 nt, Human
ugccuccuggguucaagugauu

SEQ ID NO: 544152 - RNA, 24 nt, Human
ugcgugccaccacacccugcuaau

SEQ ID NO: 544153 - RNA, 18 nt, Human
ugcucuggccaccucgug

SEQ ID NO: 544154 - RNA, 24 nt, Human
ugcugggauuacaggugugagcca

SEQ ID NO: 544155 - RNA, 24 nt, Human
uggagguggcucuggcuccgaccc

SEQ ID NO: 544156 - RNA, 19 nt, Human
uggagugcaguagcaugau

SEQ ID NO: 544157 - RNA, 24 nt, Human
uggagugcaguagcaugaucuugg

SEQ ID NO: 544158 - RNA, 23 nt, Human
uggagugcaguggcacaaucucg

SEQ ID NO: 544159 - RNA, 24 nt, Human
uggagugcaguggcacaaucucgg

SEQ ID NO: 544160 - RNA, 24 nt, Human
uggcacaaucucggcucacugcaa

SEQ ID NO: 544161 - RNA, 24 nt, Human
uggccaagcuggucuugaacuccu

SEQ ID NO: 544162 - RNA, 23 nt, Human
uggcuucuguacccagcaacccu

SEQ ID NO: 544163 - RNA, 21 nt, Human
ugggagggacugcagggaggc

SEQ ID NO: 544164 - RNA, 21 nt, Human
ugggauuacaggcacgcacca

SEQ ID NO: 544165 - RNA, 24 nt, Human
ugggauuacaggcacgcaccacca

SEQ ID NO: 544166 - RNA, 18 nt, Human
ugggauuacaggugugag

SEQ ID NO: 544167 - RNA, 19 nt, Human
ugggauuacaggugugagc

SEQ ID NO: 544168 - RNA, 21 nt, Human
ugggauuacaggugugagcca

SEQ ID NO: 544169 - RNA, 22 nt, Human
ugggauuacaggugugagccac

SEQ ID NO: 544170 - RNA, 23 nt, Human
ugggauuacaggugugagccacc

SEQ ID NO: 544171 - RNA, 23 nt, Human
ugggauuacaggugugagccacc

SEQ ID NO: 544172 - RNA, 25 nt, Human
ugggauuacaggugugagccaccuc

SEQ ID NO: 544173 - RNA, 27 nt, Human
ugggauuacaggugugagccaccucgc

SEQ ID NO: 544174 - RNA, 18 nt, Human
ugggauuauaggcgugag

SEQ ID NO: 544175 - RNA, 19 nt, Human
ugggauuauaggcgugagc

SEQ ID NO: 544176 - RNA, 22 nt, Human
ugggauuauaggcgugagccac

SEQ ID NO: 544177 - RNA, 23 nt, Human
ugggauuauaggcgugagccacc

SEQ ID NO: 544178 - RNA, 24 nt, Human
ugggauuauaggcgugagccacca

SEQ ID NO: 544179 - RNA, 24 nt, Human
ugggguuucgccauguuggccaag

SEQ ID NO: 544180 - RNA, 23 nt, Human
ugggugcuucagaagaaccuggg

SEQ ID NO: 544181 - RNA, 23 nt, Human
uggguucaagugauucuccugcc

SEQ ID NO: 544182 - RNA, 24 nt, Human
uggguucaagugauucuccugccu

SEQ ID NO: 544183 - RNA, 24 nt, Human
uggucaggcuggucucgaacucuu

SEQ ID NO: 544184 - RNA, 24 nt, Human
ugguccacccaccucagccuccca

SEQ ID NO: 544185 - RNA, 25 nt, Human
ugucccgccacaucccacaucccca

SEQ ID NO: 544186 - RNA, 19 nt, Human
ugucugagccuccacuacc

SEQ ID NO: 544187 - RNA, 24 nt, Human
uguuuuuuuuuugagacagagucu

SEQ ID NO: 544188 - RNA, 18 nt, Human
uuaguagagacgggguuu

SEQ ID NO: 544189 - RNA, 22 nt, Human
uuaguagagacgggguuucacc

SEQ ID NO: 544190 - RNA, 25 nt, Human
uuaguagagacgggguuucaccacg

SEQ ID NO: 544191 - RNA, 21 nt, Human
uucaagugauucuccugccuc

SEQ ID NO: 544192 - RNA, 23 nt, Human
uucaagugauucuccugccucag

SEQ ID NO: 544193 - RNA, 24 nt, Human
uucaagugauucuccugccucagc

SEQ ID NO: 544194 - RNA, 23 nt, Human
uucaagugauucuucugcuucag

SEQ ID NO: 544195 - RNA, 26 nt, Human
uucaagugauucuucugcuucagcca

SEQ ID NO: 544196 - RNA, 23 nt, Human
uucucacaagaucaccuuaacuc

SEQ ID NO: 544197 - RNA, 18 nt, Human
uuggccucccaaagugcu

SEQ ID NO: 544198 - RNA, 21 nt, Human
uuucaccacguuggucaggcu

SEQ ID NO: 544199 - RNA, 21 nt, Human
uuucgccauguuggccaagcu

SEQ ID NO: 544200 - RNA, 24 nt, Human
uuuucgguagagaugggguuucgc

SEQ ID NO: 544201 - RNA, 24 nt, Human
uuuuuaguagagacgggguuucac

SEQ ID NO: 544202 - RNA, 24 nt, Human
uuuuucgguagagaugggguuucg

SEQ ID NO: 544203 - RNA, 25 nt, Human
uuuuuuuuuuuugagacggagucuc

SEQ ID NO: 544204 - RNA, 24 nt, Human
aaguuccaguuugggugccuccau

SEQ ID NO: 544205 - RNA, 20 nt, Human
acccgcggcaaacugccacc

SEQ ID NO: 544206 - RNA, 21 nt, Human
acccuguggccuccacacugu

SEQ ID NO: 544207 - RNA, 19 nt, Human
agaaagaacugggguaggg

SEQ ID NO: 544208 - RNA, 24 nt, Human
agugacugccaaaaccagaaagaa

SEQ ID NO: 544209 - RNA, 18 nt, Human
aucucccuccccuggauc

SEQ ID NO: 544210 - RNA, 22 nt, Human
augaaguuccaguuugggugcc

SEQ ID NO: 544211 - RNA, 19 nt, Human
cacccgcggcaaacugcca

SEQ ID NO: 544212 - RNA, 19 nt, Human
cagugacugccaaaaccag

SEQ ID NO: 544213 - RNA, 26 nt, Human
ccacacugucucccuucacacacccg

SEQ ID NO: 544214 - RNA, 28 nt, Human
ccacacugucucccuucacacacccgcg

SEQ ID NO: 544215 - RNA, 24 nt, Human
ccuguggccuccacacugucuccc

SEQ ID NO: 544216 - RNA, 21 nt, Human
cguggcgaguacccuguggcc

SEQ ID NO: 544217 - RNA, 23 nt, Human
cuguggccuccacacugucuccc

SEQ ID NO: 544218 - RNA, 18 nt, Human
ggggaacgcuguuguggu

SEQ ID NO: 544219 - RNA, 19 nt, Human
guggcgaguacccuguggc

SEQ ID NO: 544220 - RNA, 19 nt, Human
uacccuguggccuccacac

SEQ ID NO: 544221 - RNA, 22 nt, Human
ucccuucacacacccgcggcaa

SEQ ID NO: 544222 - RNA, 23 nt, Human
ucgacauacaaggugacaccaag

SEQ ID NO: 544223 - RNA, 26 nt, Human
ugacugccaaaaccagaaagaacugg

SEQ ID NO: 544224 - RNA, 20 nt, Human
uggccuccacacugucuccc

SEQ ID NO: 544225 - RNA, 19 nt, Human
ugggugccuccaucucccu

SEQ ID NO: 544226 - RNA, 21 nt, Human
aaaaaaacaaaagucagcaaa

SEQ ID NO: 544227 - RNA, 22 nt, Human
aacugggcuccucacuggcacc

SEQ ID NO: 544228 - RNA, 21 nt, Human
aagacgcaguugagcagagcu

SEQ ID NO: 544229 - RNA, 19 nt, Human
acaacgcugucuguccugc

SEQ ID NO: 544230 - RNA, 22 nt, Human
acacacacccacgccacgcgcg

SEQ ID NO: 544231 - RNA, 22 nt, Human
acacugugcccugagcugggag

SEQ ID NO: 544232 - RNA, 21 nt, Human
acuccaccuccccgcccccac

SEQ ID NO: 544233 - RNA, 24 nt, Human
agagcaggaggggacagagcugcc

SEQ ID NO: 544234 - RNA, 20 nt, Human
agagcggcagcucaggcccc

SEQ ID NO: 544235 - RNA, 22 nt, Human
agcaggaccugaauggagccug

SEQ ID NO: 544236 - RNA, 21 nt, Human
agccccgaggcucugccuucc

SEQ ID NO: 544237 - RNA, 19 nt, Human
agcugccugcucccgcgca

SEQ ID NO: 544238 - RNA, 18 nt, Human
agcugggggugggggugu

SEQ ID NO: 544239 - RNA, 22 nt, Human
agggcaaguggggagcaugagg

SEQ ID NO: 544240 - RNA, 19 nt, Human
aggggagggaaauggaggg

SEQ ID NO: 544241 - RNA, 21 nt, Human
aggugccagggcugggcagcc

SEQ ID NO: 544242 - RNA, 23 nt, Human
agguggcuggggaacccuggagg

SEQ ID NO: 544243 - RNA, 21 nt, Human
auccaaugaccggaaagacac

SEQ ID NO: 544244 - RNA, 23 nt, Human
auggagagcaggaggggacagag

SEQ ID NO: 544245 - RNA, 22 nt, Human
auguguguguguguguguaugu

SEQ ID NO: 544246 - RNA, 19 nt, Human
auucugugcaucaacuucc

SEQ ID NO: 544247 - RNA, 23 nt, Human
caacugggcuccucacuggcacc

SEQ ID NO: 544248 - RNA, 20 nt, Human
caagauggccccauaagaaa

SEQ ID NO: 544249 - RNA, 21 nt, Human
caaugucuggccaaauggugc

SEQ ID NO: 544250 - RNA, 25 nt, Human
cacacacacccacgccaccccugag

SEQ ID NO: 544251 - RNA, 19 nt, Human
caccacgucccagaugccc

SEQ ID NO: 544252 - RNA, 21 nt, Human
cacccacagacccccacccag

SEQ ID NO: 544253 - RNA, 21 nt, Human
caccuccccgcccccacgauc

SEQ ID NO: 544254 - RNA, 21 nt, Human
cacuccaccuccccgccccca

SEQ ID NO: 544255 - RNA, 18 nt, Human
cagacuauuagaaggggg

SEQ ID NO: 544256 - RNA, 20 nt, Human
cagaugcccugugggcccuu

SEQ ID NO: 544257 - RNA, 18 nt, Human
cagcccaccaggcacacu

SEQ ID NO: 544258 - RNA, 23 nt, Human
cagcucaggccccggcgcggcag

SEQ ID NO: 544259 - RNA, 23 nt, Human
caggacaaucccugauuggacaa

SEQ ID NO: 544260 - RNA, 24 nt, Human
caggguccaggaggagcuguggag

SEQ ID NO: 544261 - RNA, 21 nt, Human
caugccuccacccaccuccuc

SEQ ID NO: 544262 - RNA, 29 nt, Human
caugcucuuggcuccuggcagccccacaa

SEQ ID NO: 544263 - RNA, 21 nt, Human
ccaaaccccugagaaagacau

SEQ ID NO: 544264 - RNA, 21 nt, Human
ccaacgguguggccaggcgag

SEQ ID NO: 544265 - RNA, 21 nt, Human
ccacgcgcggugucucccacu

SEQ ID NO: 544266 - RNA, 21 nt, Human
cccacacccugcaggcugagg

SEQ ID NO: 544267 - RNA, 22 nt, Human
cccacagacccccacccaguuc

SEQ ID NO: 544268 - RNA, 18 nt, Human
cccacaugggacuuaaaa

SEQ ID NO: 544269 - RNA, 19 nt, Human
cccagaguacagcaggacc

SEQ ID NO: 544270 - RNA, 25 nt, Human
ccccagccugccugugcccugagcu

SEQ ID NO: 544271 - RNA, 19 nt, Human
ccccaucccaugcucugca

SEQ ID NO: 544272 - RNA, 24 nt, Human
ccccgcccccacgaucccugaguc

SEQ ID NO: 544273 - RNA, 18 nt, Human
ccccucuagccucucccu

SEQ ID NO: 544274 - RNA, 24 nt, Human
ccccugcaugccuccacccaccuc

SEQ ID NO: 544275 - RNA, 20 nt, Human
cccgcccccacgaucccuga

SEQ ID NO: 544276 - RNA, 18 nt, Human
cccgcgcaggguccagga

SEQ ID NO: 544277 - RNA, 23 nt, Human
cccugaacugcccucacagccuc

SEQ ID NO: 544278 - RNA, 20 nt, Human
cccugugggcccuggcccug

SEQ ID NO: 544279 - RNA, 19 nt, Human
ccgaggcucugccuuccca

SEQ ID NO: 544280 - RNA, 19 nt, Human
ccucaagcuucacccacag

SEQ ID NO: 544281 - RNA, 19 nt, Human
ccucaucgggcucugggug

SEQ ID NO: 544282 - RNA, 20 nt, Human
ccuccccgcccccacgaucc

SEQ ID NO: 544283 - RNA, 19 nt, Human
ccucuccacuccaccuccc

SEQ ID NO: 544284 - RNA, 19 nt, Human
cgacccggugugagagcgg

SEQ ID NO: 544285 - RNA, 20 nt, Human
cgaucccugagucgucuccc

SEQ ID NO: 544286 - RNA, 19 nt, Human
cgcaggguccaggaggagc

SEQ ID NO: 544287 - RNA, 20 nt, Human
cgggcucugggugacacccu

SEQ ID NO: 544288 - RNA, 25 nt, Human
cggugucucccacugccacagcccc

SEQ ID NO: 544289 - RNA, 19 nt, Human
cgugggggcaccugcuggc

SEQ ID NO: 544290 - RNA, 22 nt, Human
cgugggggcaccugcuggcacc

SEQ ID NO: 544291 - RNA, 24 nt, Human
cguguggggauggugaggccaaga

SEQ ID NO: 544292 - RNA, 19 nt, Human
cucacugccuaggcuaccu

SEQ ID NO: 544293 - RNA, 22 nt, Human
cucccugcccccagaguacagc

SEQ ID NO: 544294 - RNA, 22 nt, Human
cucugcccacacccugcaggcu

SEQ ID NO: 544295 - RNA, 25 nt, Human
cugaagaaggcugaagaaggcuggg

SEQ ID NO: 544296 - RNA, 25 nt, Human
cugaagaaggcuggggaggacuggg

SEQ ID NO: 544297 - RNA, 24 nt, Human
cugccacacacacccacgccacgc

SEQ ID NO: 544298 - RNA, 23 nt, Human
cuggacacccacagacccccacc

SEQ ID NO: 544299 - RNA, 22 nt, Human
cuggcaccccucaucgggcucu

SEQ ID NO: 544300 - RNA, 22 nt, Human
cuggccaaaugucugagacacc

SEQ ID NO: 544301 - RNA, 21 nt, Human
gaaauauaaacauucgagaac

SEQ ID NO: 544302 - RNA, 19 nt, Human
gaagcaggugccagggcug

SEQ ID NO: 544303 - RNA, 20 nt, Human
gagaguggcaagugggaagc

SEQ ID NO: 544304 - RNA, 20 nt, Human
gagcgggccucuccacucca

SEQ ID NO: 544305 - RNA, 22 nt, Human
gaggacuggggagggcugaaga

SEQ ID NO: 544306 - RNA, 23 nt, Human
gagggaaauggagggccuccagc

SEQ ID NO: 544307 - RNA, 18 nt, Human
gagggccuccagcccugc

SEQ ID NO: 544308 - RNA, 18 nt, Human
gagguguccucugccucc

SEQ ID NO: 544309 - RNA, 20 nt, Human
gauggcaccuucaggggaag

SEQ ID NO: 544310 - RNA, 20 nt, Human
gccccacucgugggggcacc

SEQ ID NO: 544311 - RNA, 18 nt, Human
gcccgacccggugugaga

SEQ ID NO: 544312 - RNA, 22 nt, Human
gcucaggccccggcgcggcagc

SEQ ID NO: 544313 - RNA, 24 nt, Human
gcugaagagggcuggggaaaggau

SEQ ID NO: 544314 - RNA, 21 nt, Human
ggacagacggacacguccaaa

SEQ ID NO: 544315 - RNA, 22 nt, Human
ggaccugaauggagccuggaca

SEQ ID NO: 544316 - RNA, 26 nt, Human
ggagccuggacagacggacacgucca

SEQ ID NO: 544317 - RNA, 25 nt, Human
ggagcugccugcucccgcgcagggu

SEQ ID NO: 544318 - RNA, 20 nt, Human
ggauggugaggccaagaugg

SEQ ID NO: 544319 - RNA, 21 nt, Human
ggcaaagugggcuggaagggc

SEQ ID NO: 544320 - RNA, 21 nt, Human
ggcagaaaacggucuucagaa

SEQ ID NO: 544321 - RNA, 20 nt, Human
ggcagaaggcagggucaggg

SEQ ID NO: 544322 - RNA, 21 nt, Human
ggccaagauggccccauaaga

SEQ ID NO: 544323 - RNA, 22 nt, Human
ggccaauaagggcaagugggga

SEQ ID NO: 544324 - RNA, 19 nt, Human
ggcgcggcagcugcgucuc

SEQ ID NO: 544325 - RNA, 21 nt, Human
gggaaugcugagugaugggga

SEQ ID NO: 544326 - RNA, 22 nt, Human
gggcaaguggggagcaugaggu

SEQ ID NO: 544327 - RNA, 21 nt, Human
gggcagccccgaggcucugcc

SEQ ID NO: 544328 - RNA, 19 nt, Human
ggggaggacuggggagggc

SEQ ID NO: 544329 - RNA, 20 nt, Human
ggggagggaaauggagggcc

SEQ ID NO: 544330 - RNA, 22 nt, Human
ggggauggugaggccaagaugg

SEQ ID NO: 544331 - RNA, 21 nt, Human
gguaugugugugugugugugu

SEQ ID NO: 544332 - RNA, 21 nt, Human
ggucagcugggggugggggug

SEQ ID NO: 544333 - RNA, 18 nt, Human
gguccaggaggagcugug

SEQ ID NO: 544334 - RNA, 21 nt, Human
ggugggaagaguccauccuuu

SEQ ID NO: 544335 - RNA, 21 nt, Human
guaugugugugugugugugua

SEQ ID NO: 544336 - RNA, 18 nt, Human
gucuaaaccugugcgggg

SEQ ID NO: 544337 - RNA, 20 nt, Human
gugggaagaguccauccuuu

SEQ ID NO: 544338 - RNA, 23 nt, Human
uaaaaaaaaaacaaaagucagca

SEQ ID NO: 544339 - RNA, 24 nt, Human
uaaaaaaaaaacaaaagucagcaa

SEQ ID NO: 544340 - RNA, 22 nt, Human
uaacaguaggcaaagugggcug

SEQ ID NO: 544341 - RNA, 21 nt, Human
uaagaaauagaagagggcuga

SEQ ID NO: 544342 - RNA, 19 nt, Human
uaagauagaaaauaaccac

SEQ ID NO: 544343 - RNA, 21 nt, Human
uacagcaggaccugaauggag

SEQ ID NO: 544344 - RNA, 23 nt, Human
uacuggccaaaugucugagacac

SEQ ID NO: 544345 - RNA, 18 nt, Human
uaugugugugugugugug

SEQ ID NO: 544346 - RNA, 21 nt, Human
uauguguguguguguguguau

SEQ ID NO: 544347 - RNA, 23 nt, Human
uauguguguguguguguguaugu

SEQ ID NO: 544348 - RNA, 24 nt, Human
uauguguguguguguguguaugug

SEQ ID NO: 544349 - RNA, 18 nt, Human
ucacuggcaccacguccc

SEQ ID NO: 544350 - RNA, 18 nt, Human
uccccgcccccacgaucc

SEQ ID NO: 544351 - RNA, 21 nt, Human
ucccugcauccucuggguggg

SEQ ID NO: 544352 - RNA, 19 nt, Human
ucccuggucagcugggggu

SEQ ID NO: 544353 - RNA, 23 nt, Human
ucccuuuccucuccuacacagga

SEQ ID NO: 544354 - RNA, 22 nt, Human
ugaagaaggcugaagaaggcug

SEQ ID NO: 544355 - RNA, 20 nt, Human
ugaagagggcuggggaaagg

SEQ ID NO: 544356 - RNA, 22 nt, Human
ugagaaagacauacuggccaaa

SEQ ID NO: 544357 - RNA, 20 nt, Human
ugagcugggaaugcugagug

SEQ ID NO: 544358 - RNA, 23 nt, Human
ugagggcagugaggguucacucc

SEQ ID NO: 544359 - RNA, 20 nt, Human
ugccagggcugggcagcccc

SEQ ID NO: 544360 - RNA, 31 nt, Human
ugcuugggccaaggccccacucgugggggcc

SEQ ID NO: 544361 - RNA, 19 nt, Human
uggacacccacagaccccc

SEQ ID NO: 544362 - RNA, 24 nt, Human
uggagagcaggaggggacagagcu

SEQ ID NO: 544363 - RNA, 18 nt, Human
uggaggaagcuggacacc

SEQ ID NO: 544364 - RNA, 22 nt, Human
uggcaccuucaggggaagcucu

SEQ ID NO: 544365 - RNA, 18 nt, Human
uggcagaaggcaggguca

SEQ ID NO: 544366 - RNA, 27 nt, Human
uggcagaaggcagggucaaccggaacg

SEQ ID NO: 544367 - RNA, 22 nt, Human
uggcagaaggcagggucaggga

SEQ ID NO: 544368 - RNA, 18 nt, Human
uggcaugacucugaaccu

SEQ ID NO: 544369 - RNA, 23 nt, Human
uggcaugacucugaaccugggca

SEQ ID NO: 544370 - RNA, 21 nt, Human
uggccaaaugucugagacacc

SEQ ID NO: 544371 - RNA, 23 nt, Human
uggccaggcgagcugccugggga

SEQ ID NO: 544372 - RNA, 18 nt, Human
uggcuccuggcagccccu

SEQ ID NO: 544373 - RNA, 24 nt, Human
uggcuuugggggugaucuguuuuc

SEQ ID NO: 544374 - RNA, 18 nt, Human
ugggaaugcugagugaug

SEQ ID NO: 544375 - RNA, 23 nt, Human
uggggguggggguguggcagaaa

SEQ ID NO: 544376 - RNA, 20 nt, Human
ugggguaugugugugugugu

SEQ ID NO: 544377 - RNA, 23 nt, Human
ugggguaugugugugugugugug

SEQ ID NO: 544378 - RNA, 28 nt, Human
ugugcccugagcugggagguggcugggg

SEQ ID NO: 544379 - RNA, 18 nt, Human
uguggggauggugaggcc

SEQ ID NO: 544380 - RNA, 22 nt, Human
uguguguaugugugugggagug

SEQ ID NO: 544381 - RNA, 18 nt, Human
ugugugugggaguggggg

SEQ ID NO: 544382 - RNA, 19 nt, Human
uguguguguguaugugugu

SEQ ID NO: 544383 - RNA, 21 nt, Human
uguguguguguguaugugugu

SEQ ID NO: 544384 - RNA, 23 nt, Human
uguguguguguguguaugugugu

SEQ ID NO: 544385 - RNA, 21 nt, Human
uguguguguguguguguaugu

SEQ ID NO: 544386 - RNA, 25 nt, Human
uguguguguguguguguaugugugu

SEQ ID NO: 544387 - RNA, 19 nt, Human
uucauggcagaaggcaggg

SEQ ID NO: 544388 - RNA, 20 nt, Human
uucccaucagcagaugcccu

SEQ ID NO: 544389 - RNA, 21 nt, Human
uucucugcccacacccugcag

SEQ ID NO: 544390 - RNA, 24 nt, Human
uugagggaagggccagaggggccg

SEQ ID NO: 544391 - RNA, 19 nt, Human
uuggacaacgcugucuguc

SEQ ID NO: 544392 - RNA, 20 nt, Human
uuggacaacgcugucugucc

SEQ ID NO: 544393 - RNA, 20 nt, Human
uuucagggcccgacccggug

SEQ ID NO: 544394 - RNA, 21 nt, Human
uuugauucccuuuccucuccu

SEQ ID NO: 544395 - RNA, 24 nt, Human
aaaaaaaacgccucccccuacccc

SEQ ID NO: 544396 - RNA, 21 nt, Human
aaaacgccucccccuacccca

SEQ ID NO: 544397 - RNA, 20 nt, Human
aacauggcgaaauccuguuu

SEQ ID NO: 544398 - RNA, 22 nt, Human
aacccagguugaggcugcagug

SEQ ID NO: 544399 - RNA, 23 nt, Human
acagagugagaccuugucucaaa

SEQ ID NO: 544400 - RNA, 24 nt, Human
acagagugagaccuugucucaaaa

SEQ ID NO: 544401 - RNA, 18 nt, Human
acugcacuccgccuuggg

SEQ ID NO: 544402 - RNA, 24 nt, Human
acugcacuccgccuugggugacag

SEQ ID NO: 544403 - RNA, 24 nt, Human
agacuagcagaauauuccagaaag

SEQ ID NO: 544404 - RNA, 24 nt, Human
agcacuuugggaggccgaggcagg

SEQ ID NO: 544405 - RNA, 21 nt, Human
agcagaauauuccagaaaguu

SEQ ID NO: 544406 - RNA, 24 nt, Human
agccuggccaacauggcgaaaucc

SEQ ID NO: 544407 - RNA, 19 nt, Human
aggaggggaaagcggcuca

SEQ ID NO: 544408 - RNA, 26 nt, Human
aggcaggcggaucaguugagcccagg

SEQ ID NO: 544409 - RNA, 18 nt, Human
aggccgaggcaggcggau

SEQ ID NO: 544410 - RNA, 24 nt, Human
aggcugaggugagaggaucacuug

SEQ ID NO: 544411 - RNA, 18 nt, Human
aggugagaggaucacuug

SEQ ID NO: 544412 - RNA, 22 nt, Human
agguugaggcugcagugagcug

SEQ ID NO: 544413 - RNA, 18 nt, Human
auaaaaccugguugagca

SEQ ID NO: 544414 - RNA, 24 nt, Human
caacauggcgaaauccuguuucua

SEQ ID NO: 544415 - RNA, 24 nt, Human
cacaccuauaaucccagcacuuug

SEQ ID NO: 544416 - RNA, 19 nt, Human
caccuauaaucccagcacu

SEQ ID NO: 544417 - RNA, 24 nt, Human
caccuauaaucccagcacuuuggg

SEQ ID NO: 544418 - RNA, 22 nt, Human
cacuccgccuugggugacagag

SEQ ID NO: 544419 - RNA, 22 nt, Human
cacuccgccuugggugacagag

SEQ ID NO: 544420 - RNA, 24 nt, Human
cacuccgccuugggugacagagug

SEQ ID NO: 544421 - RNA, 19 nt, Human
cacugcacuccgccuuggg

SEQ ID NO: 544422 - RNA, 19 nt, Human
cacugcacuccgccuuggg

SEQ ID NO: 544423 - RNA, 23 nt, Human
cacugcacuccgccuugggugac

SEQ ID NO: 544424 - RNA, 24 nt, Human
cacugcacuccgccuugggugaca

SEQ ID NO: 544425 - RNA, 24 nt, Human
cagcacuuugggaggccgaggcag

SEQ ID NO: 544426 - RNA, 26 nt, Human
cagcacuuugggaggccgaggcaggc

SEQ ID NO: 544427 - RNA, 23 nt, Human
ccccagacaaccugcuguaauuu

SEQ ID NO: 544428 - RNA, 22 nt, Human
ccucccccuaccccagacaacc

SEQ ID NO: 544429 - RNA, 22 nt, Human
ccuggccaacauggcgaaaucc

SEQ ID NO: 544430 - RNA, 24 nt, Human
ccuggccaacauggcgaaauccug

SEQ ID NO: 544431 - RNA, 21 nt, Human
cgagaccagccuggccaacau

SEQ ID NO: 544432 - RNA, 22 nt, Human
cucaaaaaaaaaacgccucccc

SEQ ID NO: 544433 - RNA, 22 nt, Human
cucacaccuauaaucccagcac

SEQ ID NO: 544434 - RNA, 24 nt, Human
cucacaccuauaaucccagcacuu

SEQ ID NO: 544435 - RNA, 22 nt, Human
cucccccuaccccagacaaccu

SEQ ID NO: 544436 - RNA, 25 nt, Human
cucccccuaccccagacaaccugcu

SEQ ID NO: 544437 - RNA, 22 nt, Human
cuccgaaucccagaugcccaga

SEQ ID NO: 544438 - RNA, 19 nt, Human
cugcagagggccaguggcc

SEQ ID NO: 544439 - RNA, 19 nt, Human
gagcaugauuacauuaaac

SEQ ID NO: 544440 - RNA, 21 nt, Human
gaucacuugaacccagguuga

SEQ ID NO: 544441 - RNA, 21 nt, Human
gccaacauggcgaaauccugu

SEQ ID NO: 544442 - RNA, 22 nt, Human
gccuaggaggcacaacuacuug

SEQ ID NO: 544443 - RNA, 24 nt, Human
gccuugggugacagagugagaccu

SEQ ID NO: 544444 - RNA, 23 nt, Human
ggaggcugaggugagaggaucac

SEQ ID NO: 544445 - RNA, 24 nt, Human
gguggcucacaccuauaaucccag

SEQ ID NO: 544446 - RNA, 24 nt, Human
gucacugcacuccgccuuggguga

SEQ ID NO: 544447 - RNA, 23 nt, Human
uauccaaaguuuaacuaacuuaa

SEQ ID NO: 544448 - RNA, 18 nt, Human
ucacaggcuauacucucc

SEQ ID NO: 544449 - RNA, 21 nt, Human
ucacgugcggcuugagccccu

SEQ ID NO: 544450 - RNA, 21 nt, Human
ucacugcacuccgccuugggu

SEQ ID NO: 544451 - RNA, 24 nt, Human
ucacugcacuccgccuugggugac

SEQ ID NO: 544452 - RNA, 22 nt, Human
ucccagaugcccagacuuucuc

SEQ ID NO: 544453 - RNA, 24 nt, Human
uccgccuugggugacagagugaga

SEQ ID NO: 544454 - RNA, 22 nt, Human
ucgggagugucgaagggaugca

SEQ ID NO: 544455 - RNA, 22 nt, Human
ugagcaggguggcucacaccua

SEQ ID NO: 544456 - RNA, 23 nt, Human
ugagcccagguguucgagaccag

SEQ ID NO: 544457 - RNA, 19 nt, Human
ugaggugagaggaucacuu

SEQ ID NO: 544458 - RNA, 19 nt, Human
ugaggugagaggaucacuu

SEQ ID NO: 544459 - RNA, 21 nt, Human
ugaggugagaggaucacuuga

SEQ ID NO: 544460 - RNA, 24 nt, Human
uggccaacauggcgaaauccuguu

SEQ ID NO: 544461 - RNA, 24 nt, Human
uggcucacaccuauaaucccagca

SEQ ID NO: 544462 - RNA, 20 nt, Human
ugggaggccgaggcaggcgg

SEQ ID NO: 544463 - RNA, 24 nt, Human
ugggaggccgaggcaggcggauca

SEQ ID NO: 544464 - RNA, 19 nt, Human
ugggaggcugaggugagag

SEQ ID NO: 544465 - RNA, 24 nt, Human
ugggaggcugaggugagaggauca

SEQ ID NO: 544466 - RNA, 19 nt, Human
ugggugacagagugagacc

SEQ ID NO: 544467 - RNA, 18 nt, Human
ugugugccuaggaggcac

SEQ ID NO: 544468 - RNA, 21 nt, Human
uugccgggcauaguguugugu

SEQ ID NO: 544469 - RNA, 25 nt, Human
uugggaggccgaggcaggcggauca

SEQ ID NO: 544470 - RNA, 18 nt, Human
uugggaggcugaggugag

SEQ ID NO: 544471 - RNA, 25 nt, Human
uugggaggcugaggugagaggauca

SEQ ID NO: 544472 - RNA, 19 nt, Human
uuucuacaaaaaauacaaa

SEQ ID NO: 544473 - RNA, 24 nt, Human
uuuuuuuuuuuuuuuuuacuauag

SEQ ID NO: 544474 - RNA, 19 nt, Human
agguauuaacacauaagca

SEQ ID NO: 544475 - RNA, 26 nt, Human
caccuagacuggggggaaggugaggg

SEQ ID NO: 544476 - RNA, 22 nt, Human
cagccgagcuggcguguggggc

SEQ ID NO: 544477 - RNA, 26 nt, Human
gagcuggcguguggggcugcggcgcg

SEQ ID NO: 544478 - RNA, 18 nt, Human
gcgcggcgcggcccaggc

SEQ ID NO: 544479 - RNA, 20 nt, Human
ggggaaggugaggaggaggg

SEQ ID NO: 544480 - RNA, 18 nt, Human
ggugaggaggagggaaaa

SEQ ID NO: 544481 - RNA, 19 nt, Human
gguuuuuguuuugucguug

SEQ ID NO: 544482 - RNA, 24 nt, Human
gucugucuauauauguauauauau

SEQ ID NO: 544483 - RNA, 21 nt, Human
uaaugcagaaaaacagccgag

SEQ ID NO: 544484 - RNA, 22 nt, Human
uauauguauauauaucuccaca

SEQ ID NO: 544485 - RNA, 21 nt, Human
uccacacauauuuuguggggu

SEQ ID NO: 544486 - RNA, 23 nt, Human
ucucugaguugggauuuuggucu

SEQ ID NO: 544487 - RNA, 23 nt, Human
ucugucuauauauguauauauau

SEQ ID NO: 544488 - RNA, 23 nt, Human
ugcagugucucugaguugggauu

SEQ ID NO: 544489 - RNA, 20 nt, Human
uggggggaaggugaggagga

SEQ ID NO: 544490 - RNA, 21 nt, Human
uguauauauaucuccacacau

SEQ ID NO: 544491 - RNA, 24 nt, Human
uguauauauaucuccacacauauu

SEQ ID NO: 544492 - RNA, 18 nt, Human
ugucuauauauguauaua

SEQ ID NO: 544493 - RNA, 20 nt, Human
uuucauuuguacaaaagagu

SEQ ID NO: 544494 - RNA, 18 nt, Human
uuuuguggggugggggau

SEQ ID NO: 544495 - RNA, 27 nt, Human
aaaaccaaaaaccuccacagcaaagga

SEQ ID NO: 544496 - RNA, 18 nt, Human
aaacaaccaaacacccag

SEQ ID NO: 544497 - RNA, 24 nt, Human
aaacacccaggaauuuaaaggcaa

SEQ ID NO: 544498 - RNA, 18 nt, Human
aaccaaaaaccuccacag

SEQ ID NO: 544499 - RNA, 24 nt, Human
aaccuagugaaggaauuacuugau

SEQ ID NO: 544500 - RNA, 19 nt, Human
aaguaauccauuaauguac

SEQ ID NO: 544501 - RNA, 19 nt, Human
aaguggccaggagagaaca

SEQ ID NO: 544502 - RNA, 19 nt, Human
aaucacacguaacaaaaac

SEQ ID NO: 544503 - RNA, 22 nt, Human
acaaccaaacacccaggaauuu

SEQ ID NO: 544504 - RNA, 22 nt, Human
accacaacaaucccucaaucug

SEQ ID NO: 544505 - RNA, 24 nt, Human
agaaaacaaucauucagacaccau

SEQ ID NO: 544506 - RNA, 22 nt, Human
agaauggucauuucaacuuuua

SEQ ID NO: 544507 - RNA, 23 nt, Human
agaguucuacaggggaguggugu

SEQ ID NO: 544508 - RNA, 20 nt, Human
aggaaggaaucucaaacaac

SEQ ID NO: 544509 - RNA, 21 nt, Human
agucaaaaaccacaacaaucc

SEQ ID NO: 544510 - RNA, 24 nt, Human
aucacuaaauaaaaaacauccaga

SEQ ID NO: 544511 - RNA, 20 nt, Human
aucucaaacaaccaaacacc

SEQ ID NO: 544512 - RNA, 25 nt, Human
augaaaguacuuccccacuccauug

SEQ ID NO: 544513 - RNA, 21 nt, Human
augauaaagaggagacggcua

SEQ ID NO: 544514 - RNA, 21 nt, Human
auuguguuucuuuuaugacua

SEQ ID NO: 544515 - RNA, 18 nt, Human
caaaugacccacagauga

SEQ ID NO: 544516 - RNA, 19 nt, Human
caaguaacuuuuuugagca

SEQ ID NO: 544517 - RNA, 27 nt, Human
caaucacuaaauaaaaaacauccagau

SEQ ID NO: 544518 - RNA, 19 nt, Human
cacacguaacaaaaacaag

SEQ ID NO: 544519 - RNA, 18 nt, Human
cacccuggacaagccucc

SEQ ID NO: 544520 - RNA, 24 nt, Human
cacuccucagauuuuauuuuuaaa

SEQ ID NO: 544521 - RNA, 20 nt, Human
cacugcacgcagcccuccgc

SEQ ID NO: 544522 - RNA, 20 nt, Human
cauaaugugcgucauggaaa

SEQ ID NO: 544523 - RNA, 20 nt, Human
cauccagauuuuuuaaaagc

SEQ ID NO: 544524 - RNA, 23 nt, Human
ccaaacacccaggaauuuaaagg

SEQ ID NO: 544525 - RNA, 18 nt, Human
ccccccuccccaaaccca

SEQ ID NO: 544526 - RNA, 19 nt, Human
ccccccuccccaaacccaa

SEQ ID NO: 544527 - RNA, 23 nt, Human
ccccucuuuuccccccuccccaa

SEQ ID NO: 544528 - RNA, 20 nt, Human
cccucaaucuguuugcugug

SEQ ID NO: 544529 - RNA, 19 nt, Human
ccucagaguugggagugaa

SEQ ID NO: 544530 - RNA, 24 nt, Human
cucacaauagugaguauacccaga

SEQ ID NO: 544531 - RNA, 20 nt, Human
cuccagaggccauacacuuc

SEQ ID NO: 544532 - RNA, 21 nt, Human
cuccuggagcccgcucccacu

SEQ ID NO: 544533 - RNA, 25 nt, Human
cugcauucuggggauuuagcuucau

SEQ ID NO: 544534 - RNA, 22 nt, Human
cuggagcccgcucccacugcac

SEQ ID NO: 544535 - RNA, 24 nt, Human
cuuguguguuuuucugaggcuugg

SEQ ID NO: 544536 - RNA, 24 nt, Human
gacauaucaccuuuuccuagcccu

SEQ ID NO: 544537 - RNA, 21 nt, Human
gagucagcuuugaaaggcugg

SEQ ID NO: 544538 - RNA, 18 nt, Human
gaguugggagugaaggga

SEQ ID NO: 544539 - RNA, 18 nt, Human
gaucauuuuccuaaucua

SEQ ID NO: 544540 - RNA, 23 nt, Human
gauuuuauuuuuaaaaggaguuu

SEQ ID NO: 544541 - RNA, 20 nt, Human
gcucccacugcacgcagccc

SEQ ID NO: 544542 - RNA, 21 nt, Human
gcugcagugcucugcaucuga

SEQ ID NO: 544543 - RNA, 21 nt, Human
gcuggaggcucgggcuccugg

SEQ ID NO: 544544 - RNA, 22 nt, Human
ggaaaaagcaugauaaagagga

SEQ ID NO: 544545 - RNA, 19 nt, Human
gggaaaaagcaugauaaag

SEQ ID NO: 544546 - RNA, 23 nt, Human
gggagugguguuugaaaucuauu

SEQ ID NO: 544547 - RNA, 22 nt, Human
gugcugccuugcucugaggacg

SEQ ID NO: 544548 - RNA, 22 nt, Human
guuaaaguuuucaaccuuaaaa

SEQ ID NO: 544549 - RNA, 27 nt, Human
uaaaaaacauccagauuuuuuaaaagc

SEQ ID NO: 544550 - RNA, 22 nt, Human
uaaaacaaguggucuugauagc

SEQ ID NO: 544551 - RNA, 22 nt, Human
uaaaauagugcuaaagagauuu

SEQ ID NO: 544552 - RNA, 20 nt, Human
uaaaguuuucaaccuuaaaa

SEQ ID NO: 544553 - RNA, 22 nt, Human
uaaugugcgucauggaaaugcu

SEQ ID NO: 544554 - RNA, 19 nt, Human
uacuuuuuucccuagaacc

SEQ ID NO: 544555 - RNA, 21 nt, Human
uagagaaauaggaaaaucaca

SEQ ID NO: 544556 - RNA, 19 nt, Human
uagaggacaccauuucucc

SEQ ID NO: 544557 - RNA, 21 nt, Human
uagaggacaccauuucuccac

SEQ ID NO: 544558 - RNA, 29 nt, Human
uaggaaaagccccucuuuuccccccuccc

SEQ ID NO: 544559 - RNA, 22 nt, Human
uaucaucaaugaaaaaccaaaa

SEQ ID NO: 544560 - RNA, 18 nt, Human
uaucgagaaggagcaggc

SEQ ID NO: 544561 - RNA, 21 nt, Human
uauugaggaauaucuuugggg

SEQ ID NO: 544562 - RNA, 19 nt, Human
ucaaaugacccacagauga

SEQ ID NO: 544563 - RNA, 22 nt, Human
ucacaguaaaacggacuuuaau

SEQ ID NO: 544564 - RNA, 24 nt, Human
ucacccuggacaagccuccccaac

SEQ ID NO: 544565 - RNA, 21 nt, Human
ucagcugcugcugcauucugg

SEQ ID NO: 544566 - RNA, 22 nt, Human
uccgcguuugaggcagcacagc

SEQ ID NO: 544567 - RNA, 18 nt, Human
uccuaggaaaagccccuc

SEQ ID NO: 544568 - RNA, 19 nt, Human
ucgggcuccuggagcccgc

SEQ ID NO: 544569 - RNA, 24 nt, Human
ucuaaaguaauccauuaauguaca

SEQ ID NO: 544570 - RNA, 22 nt, Human
ucuacaggggagugguggggag

SEQ ID NO: 544571 - RNA, 20 nt, Human
ucucaaacaaccaaacaccc

SEQ ID NO: 544572 - RNA, 20 nt, Human
ucucaugcagucaaagucaa

SEQ ID NO: 544573 - RNA, 20 nt, Human
ucucucaucuagauuucuuu

SEQ ID NO: 544574 - RNA, 19 nt, Human
ucucuggcuuggaucaaca

SEQ ID NO: 544575 - RNA, 19 nt, Human
ugaaaaaccaaaaaccucc

SEQ ID NO: 544576 - RNA, 19 nt, Human
ugaaaguacuuccccacuc

SEQ ID NO: 544577 - RNA, 25 nt, Human
ugacaaacaacagggggaaaaagca

SEQ ID NO: 544578 - RNA, 21 nt, Human
ugagcacacgggugucgcgug

SEQ ID NO: 544579 - RNA, 19 nt, Human
ugagcuauacacgugcaca

SEQ ID NO: 544580 - RNA, 18 nt, Human
ugagugagaccagauagg

SEQ ID NO: 544581 - RNA, 21 nt, Human
ugauaacaaggaaggaaucuc

SEQ ID NO: 544582 - RNA, 24 nt, Human
ugaucaugcauguccugggaaugu

SEQ ID NO: 544583 - RNA, 22 nt, Human
ugaugaaacuaacauacaccuu

SEQ ID NO: 544584 - RNA, 19 nt, Human
ugcgucauggaaaugcuga

SEQ ID NO: 544585 - RNA, 24 nt, Human
ugcugcugcauucuggggauuuag

SEQ ID NO: 544586 - RNA, 27 nt, Human
uggaaaucuuccccuuccccuucauug

SEQ ID NO: 544587 - RNA, 24 nt, Human
uggauauugcuguggccaggccuc

SEQ ID NO: 544588 - RNA, 22 nt, Human
uggaugcugacaaucugugagu

SEQ ID NO: 544589 - RNA, 18 nt, Human
uggccaggccucggugcu

SEQ ID NO: 544590 - RNA, 22 nt, Human
uggccaggccucggugcugccu

SEQ ID NO: 544591 - RNA, 22 nt, Human
ugucgcgugaguaggaccggca

SEQ ID NO: 544592 - RNA, 19 nt, Human
uguggccaggccucggugc

SEQ ID NO: 544593 - RNA, 23 nt, Human
uguggccaggccucggugcugcc

SEQ ID NO: 544594 - RNA, 24 nt, Human
uuaacauugacacagagcaauaag

SEQ ID NO: 544595 - RNA, 27 nt, Human
uuacuaagacuaacuccagaggccaua

SEQ ID NO: 544596 - RNA, 21 nt, Human
uuacuaaguuguuaaaaaugu

SEQ ID NO: 544597 - RNA, 21 nt, Human
uuacuugaucugagacagguu

SEQ ID NO: 544598 - RNA, 23 nt, Human
uucaucccaauaaucuacaacug

SEQ ID NO: 544599 - RNA, 22 nt, Human
uucuuuagaaccugcauucugg

SEQ ID NO: 544600 - RNA, 22 nt, Human
uugcuguguuauuguucuugug

SEQ ID NO: 544601 - RNA, 19 nt, Human
uuuacuaagacuaacucca

SEQ ID NO: 544602 - RNA, 21 nt, Human
uuuaucaucaaugaaaaacca

SEQ ID NO: 544603 - RNA, 21 nt, Human
uuucuuuuaugacuacacaga

SEQ ID NO: 544604 - RNA, 20 nt, Human
aacauggugaaaccgagucu

SEQ ID NO: 544605 - RNA, 21 nt, Human
aacauggugaaaccgagucuc

SEQ ID NO: 544606 - RNA, 24 nt, Human
aagacaccacauguaagauaagua

SEQ ID NO: 544607 - RNA, 22 nt, Human
aagagcaaaacuccgucacaaa

SEQ ID NO: 544608 - RNA, 20 nt, Human
aagccucuagccucugcaca

SEQ ID NO: 544609 - RNA, 21 nt, Human
aagcgcugggagggggcagga

SEQ ID NO: 544610 - RNA, 26 nt, Human
aaguaggagguggaguggggggaccc

SEQ ID NO: 544611 - RNA, 24 nt, Human
aaguggagguugcagugagccgag

SEQ ID NO: 544612 - RNA, 19 nt, Human
aaucacuugaacccaagaa

SEQ ID NO: 544613 - RNA, 24 nt, Human
aaucacuugaacccaagaagugga

SEQ ID NO: 544614 - RNA, 22 nt, Human
aauugccaggggaaagaaaagu

SEQ ID NO: 544615 - RNA, 23 nt, Human
aauugucuccuaaaaaucccuau

SEQ ID NO: 544616 - RNA, 24 nt, Human
aauuuuguauuuuuaguagagaca

SEQ ID NO: 544617 - RNA, 22 nt, Human
acaaugcagaaggagcuuugaa

SEQ ID NO: 544618 - RNA, 23 nt, Human
acaaugcagaaggagcuuugaaa

SEQ ID NO: 544619 - RNA, 22 nt, Human
acaggagaaucacuugaaccca

SEQ ID NO: 544620 - RNA, 21 nt, Human
acauagaccuucucuuucucc

SEQ ID NO: 544621 - RNA, 19 nt, Human
acauggugaaaccgagucu

SEQ ID NO: 544622 - RNA, 24 nt, Human
accaacauggugaaaccgagucuc

SEQ ID NO: 544623 - RNA, 22 nt, Human
acgggggcggggcggcgcgggc

SEQ ID NO: 544624 - RNA, 21 nt, Human
acuccagccugggagacaaga

SEQ ID NO: 544625 - RNA, 18 nt, Human
acugcacuccagccuggg

SEQ ID NO: 544626 - RNA, 18 nt, Human
acugcacuccagccuggg

SEQ ID NO: 544627 - RNA, 18 nt, Human
agacagaguuucuccacg

SEQ ID NO: 544628 - RNA, 18 nt, Human
agacaggagaaucacuug

SEQ ID NO: 544629 - RNA, 23 nt, Human
agacaggagaaucacuugaaccc

SEQ ID NO: 544630 - RNA, 24 nt, Human
agacaggagaaucacuugaaccca

SEQ ID NO: 544631 - RNA, 18 nt, Human
agagaacgugaggggcag

SEQ ID NO: 544632 - RNA, 21 nt, Human
agccaggcgugguagcucaug

SEQ ID NO: 544633 - RNA, 20 nt, Human
agccauucuccugccucagc

SEQ ID NO: 544634 - RNA, 21 nt, Human
aggaagacaccacauguaaga

SEQ ID NO: 544635 - RNA, 21 nt, Human
aggagcuuugaaaacuggcuc

SEQ ID NO: 544636 - RNA, 23 nt, Human
aggagguggagugggcgacuauc

SEQ ID NO: 544637 - RNA, 21 nt, Human
aggcaugcaugagugcaccaa

SEQ ID NO: 544638 - RNA, 21 nt, Human
aggccaaggcggguggaucac

SEQ ID NO: 544639 - RNA, 20 nt, Human
aggccccaaacagucaccaa

SEQ ID NO: 544640 - RNA, 22 nt, Human
aggcggguggaucaccugaggu

SEQ ID NO: 544641 - RNA, 26 nt, Human
aggcggguggaucaccugaggucagg

SEQ ID NO: 544642 - RNA, 21 nt, Human
aggcgugguagcucaugccug

SEQ ID NO: 544643 - RNA, 24 nt, Human
aggcugagacaggagaaucacuug

SEQ ID NO: 544644 - RNA, 18 nt, Human
aggggcaggucccagagc

SEQ ID NO: 544645 - RNA, 21 nt, Human
aguagcugggaucacaggcau

SEQ ID NO: 544646 - RNA, 20 nt, Human
agugagugacaaugcagaag

SEQ ID NO: 544647 - RNA, 24 nt, Human
aguggcucacgccuguaaucccag

SEQ ID NO: 544648 - RNA, 21 nt, Human
aucuaauugucuccuaaaaau

SEQ ID NO: 544649 - RNA, 20 nt, Human
augccugcaaucccagccac

SEQ ID NO: 544650 - RNA, 24 nt, Human
auugugucacugcacuccagccug

SEQ ID NO: 544651 - RNA, 24 nt, Human
caacauggugaaaccgagucucua

SEQ ID NO: 544652 - RNA, 25 nt, Human
caagagcaaaacuccgucacaaaac

SEQ ID NO: 544653 - RNA, 24 nt, Human
caaggcggguggaucaccugaggu

SEQ ID NO: 544654 - RNA, 26 nt, Human
caaggcggguggaucaccugagguca

SEQ ID NO: 544655 - RNA, 22 nt, Human
cacacaggccuccuuauacagu

SEQ ID NO: 544656 - RNA, 22 nt, Human
cacaggcaugagccaucacgcc

SEQ ID NO: 544657 - RNA, 19 nt, Human
caccaaaaacgaauugcca

SEQ ID NO: 544658 - RNA, 24 nt, Human
cacgccuguaaucccagcacuuug

SEQ ID NO: 544659 - RNA, 24 nt, Human
cacuccagccugggagacaagagc

SEQ ID NO: 544660 - RNA, 18 nt, Human
cacugcacuccagccugg

SEQ ID NO: 544661 - RNA, 19 nt, Human
cacugcacuccagccuggg

SEQ ID NO: 544662 - RNA, 19 nt, Human
cacugcacuccagccuggg

SEQ ID NO: 544663 - RNA, 21 nt, Human
cacugcacuccagccugggag

SEQ ID NO: 544664 - RNA, 22 nt, Human
cacugcacuccagccugggaga

SEQ ID NO: 544665 - RNA, 23 nt, Human
cacugcacuccagccugggagac

SEQ ID NO: 544666 - RNA, 24 nt, Human
cacugcacuccagccugggagaca

SEQ ID NO: 544667 - RNA, 25 nt, Human
cacugcacuccagccugggagacaa

SEQ ID NO: 544668 - RNA, 19 nt, Human
cagaaauagcuaaauaaug

SEQ ID NO: 544669 - RNA, 24 nt, Human
cagcacuuugggaggccaaggcgg

SEQ ID NO: 544670 - RNA, 19 nt, Human
cagggcccaggagacagag

SEQ ID NO: 544671 - RNA, 25 nt, Human
caggucccagagcagggcccaggag

SEQ ID NO: 544672 - RNA, 21 nt, Human
caugccugcaaucccagccac

SEQ ID NO: 544673 - RNA, 19 nt, Human
ccacgcuggucaggcuggu

SEQ ID NO: 544674 - RNA, 24 nt, Human
ccagccauucuccugccucagccu

SEQ ID NO: 544675 - RNA, 20 nt, Human
ccaggccccaaacagucacc

SEQ ID NO: 544676 - RNA, 22 nt, Human
cccaaacagucaccaacuaaga

SEQ ID NO: 544677 - RNA, 21 nt, Human
cccaagaaguggagguugcag

SEQ ID NO: 544678 - RNA, 19 nt, Human
cccgaguagcugggaucac

SEQ ID NO: 544679 - RNA, 18 nt, Human
ccgggcucaguggcucac

SEQ ID NO: 544680 - RNA, 24 nt, Human
ccucccggguuccagccauucucc

SEQ ID NO: 544681 - RNA, 24 nt, Human
ccucccggguuccagccccgaccc

SEQ ID NO: 544682 - RNA, 22 nt, Human
ccucugcacacucagcagggau

SEQ ID NO: 544683 - RNA, 21 nt, Human
ccugaccaacauggugaaacc

SEQ ID NO: 544684 - RNA, 22 nt, Human
ccugaccaacauggugaaaccg

SEQ ID NO: 544685 - RNA, 22 nt, Human
ccugaggucaggaguucaaagc

SEQ ID NO: 544686 - RNA, 18 nt, Human
ccugcaaucccagccacu

SEQ ID NO: 544687 - RNA, 19 nt, Human
ccugcaaucccagccacuu

SEQ ID NO: 544688 - RNA, 22 nt, Human
ccugcaaucccagccacuuggg

SEQ ID NO: 544689 - RNA, 24 nt, Human
ccuggcucggguguccccaagaga

SEQ ID NO: 544690 - RNA, 22 nt, Human
ccuguaaucccagcacuuuggg

SEQ ID NO: 544691 - RNA, 22 nt, Human
cgacucacggcaaccuccgccu

SEQ ID NO: 544692 - RNA, 28 nt, Human
cgccucccggguuccagccauucuccuu

SEQ ID NO: 544693 - RNA, 23 nt, Human
cgccuguaaucccagcacuuugg

SEQ ID NO: 544694 - RNA, 18 nt, Human
cgggggcggggcggcgcg

SEQ ID NO: 544695 - RNA, 21 nt, Human
cgggggcggggcggcgcgggc

SEQ ID NO: 544696 - RNA, 24 nt, Human
cggguggaucaccugaggucagga

SEQ ID NO: 544697 - RNA, 24 nt, Human
cgucacaaaaccaaaccaaaccuu

SEQ ID NO: 544698 - RNA, 22 nt, Human
cuaauugucuccuaaaaauccc

SEQ ID NO: 544699 - RNA, 24 nt, Human
cuaauuuuguauuuuuaguagaga

SEQ ID NO: 544700 - RNA, 26 nt, Human
cuauuaaaauaccaggccccaaacag

SEQ ID NO: 544701 - RNA, 22 nt, Human
cucacgccuguaaucccagcac

SEQ ID NO: 544702 - RNA, 24 nt, Human
cucacgccuguaaucccagcacuu

SEQ ID NO: 544703 - RNA, 24 nt, Human
cucacggcaaccuccgccucccgg

SEQ ID NO: 544704 - RNA, 23 nt, Human
cucagccucccgaguagcuggga

SEQ ID NO: 544705 - RNA, 25 nt, Human
cucaugccugcaaucccagccacuu

SEQ ID NO: 544706 - RNA, 21 nt, Human
cucccggguuccagccauucu

SEQ ID NO: 544707 - RNA, 23 nt, Human
cugccucagccucccgaguagcu

SEQ ID NO: 544708 - RNA, 18 nt, Human
cugggagggggcaggacc

SEQ ID NO: 544709 - RNA, 19 nt, Human
cugguccuuuuuguuacuc

SEQ ID NO: 544710 - RNA, 21 nt, Human
cuuuuuuuuuuuuuuuuuuuu

SEQ ID NO: 544711 - RNA, 18 nt, Human
gaaguggagguugcagug

SEQ ID NO: 544712 - RNA, 21 nt, Human
gaaguggagguugcagugagc

SEQ ID NO: 544713 - RNA, 19 nt, Human
gaaucacuugaacccaaga

SEQ ID NO: 544714 - RNA, 23 nt, Human
gagauugugucacugcacuccag

SEQ ID NO: 544715 - RNA, 19 nt, Human
gagcuuugaaaacuggcuc

SEQ ID NO: 544716 - RNA, 23 nt, Human
gagguugcagugagccgagauug

SEQ ID NO: 544717 - RNA, 25 nt, Human
gaguagcugggaucacaggcaugag

SEQ ID NO: 544718 - RNA, 18 nt, Human
gaucacaggcaugagcca

SEQ ID NO: 544719 - RNA, 23 nt, Human
gaucaccugaggucaggaguuca

SEQ ID NO: 544720 - RNA, 24 nt, Human
gaucaccugaggucaggaguucaa

SEQ ID NO: 544721 - RNA, 19 nt, Human
gcaaaacuccgucacaaaa

SEQ ID NO: 544722 - RNA, 22 nt, Human
gcaaccuccgccucccggguuc

SEQ ID NO: 544723 - RNA, 21 nt, Human
gcaagcgcugggagggggcag

SEQ ID NO: 544724 - RNA, 20 nt, Human
gccucagccucccgaguagc

SEQ ID NO: 544725 - RNA, 18 nt, Human
gcggcgcgggcaagcgcu

SEQ ID NO: 544726 - RNA, 19 nt, Human
gcguaguguccuggcucgg

SEQ ID NO: 544727 - RNA, 20 nt, Human
ggagguugcagugagccgag

SEQ ID NO: 544728 - RNA, 22 nt, Human
ggagguugcagugagccgagau

SEQ ID NO: 544729 - RNA, 24 nt, Human
ggagguugcagugagccgagauug

SEQ ID NO: 544730 - RNA, 19 nt, Human
ggaucacaggcaugagcca

SEQ ID NO: 544731 - RNA, 22 nt, Human
ggaucaccugaggucaggaguu

SEQ ID NO: 544732 - RNA, 23 nt, Human
gggcaagcgcugggagggggcag

SEQ ID NO: 544733 - RNA, 21 nt, Human
gggcaggacccgaggagcucc

SEQ ID NO: 544734 - RNA, 22 nt, Human
gggcaggacccgaggagcuccg

SEQ ID NO: 544735 - RNA, 22 nt, Human
gggcggcgcgggcaagcgcugg

SEQ ID NO: 544736 - RNA, 24 nt, Human
gggcucaguggcucacgccuguaa

SEQ ID NO: 544737 - RNA, 24 nt, Human
gguagcucaugccugcaaucccag

SEQ ID NO: 544738 - RNA, 21 nt, Human
gguggaucaccugaggucagg

SEQ ID NO: 544739 - RNA, 24 nt, Human
guugcagugagccgagauuguguc

SEQ ID NO: 544740 - RNA, 24 nt, Human
uaaaaaaauaaaaaauuaaaaaag

SEQ ID NO: 544741 - RNA, 21 nt, Human
uaaugagucucagguuaagua

SEQ ID NO: 544742 - RNA, 21 nt, Human
uacaucuacccuuggaugaua

SEQ ID NO: 544743 - RNA, 24 nt, Human
uagccaggcgugguagcucaugcc

SEQ ID NO: 544744 - RNA, 18 nt, Human
uaggagguggagugggcg

SEQ ID NO: 544745 - RNA, 24 nt, Human
uaguagagacagaguuucuccacg

SEQ ID NO: 544746 - RNA, 21 nt, Human
uauauacaggaagacaccaca

SEQ ID NO: 544747 - RNA, 21 nt, Human
ucaaagccagccugaccaaca

SEQ ID NO: 544748 - RNA, 24 nt, Human
ucacggcaaccuccgccucccggg

SEQ ID NO: 544749 - RNA, 25 nt, Human
ucacggcaaccuccgccucccgggu

SEQ ID NO: 544750 - RNA, 24 nt, Human
ucacugcacuccagccugggagac

SEQ ID NO: 544751 - RNA, 20 nt, Human
ucagccucccgaguagcugg

SEQ ID NO: 544752 - RNA, 23 nt, Human
uccaaaaugcuacuaagcaacua

SEQ ID NO: 544753 - RNA, 18 nt, Human
ucccagccacuugggagg

SEQ ID NO: 544754 - RNA, 18 nt, Human
uccccaagagaacgugag

SEQ ID NO: 544755 - RNA, 24 nt, Human
ucccgaguagcugggaucacaggc

SEQ ID NO: 544756 - RNA, 21 nt, Human
ucccggguuccagccauucuc

SEQ ID NO: 544757 - RNA, 24 nt, Human
ucccggguuccagccauucuccug

SEQ ID NO: 544758 - RNA, 23 nt, Human
uccgucacaaaaccaaaccaaac

SEQ ID NO: 544759 - RNA, 18 nt, Human
uccgugaggggugcggag

SEQ ID NO: 544760 - RNA, 22 nt, Human
ucgcucuuguugcccaggcugg

SEQ ID NO: 544761 - RNA, 23 nt, Human
ucgcucuuguugcccaggcugga

SEQ ID NO: 544762 - RNA, 20 nt, Human
ucuccuagaauccuuucuca

SEQ ID NO: 544763 - RNA, 24 nt, Human
ucuccugccucagccucccgagua

SEQ ID NO: 544764 - RNA, 22 nt, Human
ucucuacuaaaaauacaaaaaa

SEQ ID NO: 544765 - RNA, 19 nt, Human
ucuguuacucuuuucuuuc

SEQ ID NO: 544766 - RNA, 22 nt, Human
ucuuguugcccaggcuggaaug

SEQ ID NO: 544767 - RNA, 18 nt, Human
ucuuuuuuuuuuuuuuuu

SEQ ID NO: 544768 - RNA, 24 nt, Human
ugaccaacauggugaaaccgaguc

SEQ ID NO: 544769 - RNA, 20 nt, Human
ugagacaggagaaucacuug

SEQ ID NO: 544770 - RNA, 24 nt, Human
ugagacaggagaaucacuugaacc

SEQ ID NO: 544771 - RNA, 22 nt, Human
ugagccgagauugugucacugc

SEQ ID NO: 544772 - RNA, 21 nt, Human
ugcacacucagcagggaugcg

SEQ ID NO: 544773 - RNA, 24 nt, Human
ugcagaaggagcuuugaaaacugg

SEQ ID NO: 544774 - RNA, 21 nt, Human
ugcccaggcuggaaugcaaug

SEQ ID NO: 544775 - RNA, 24 nt, Human
ugccucagccucccgaguagcugg

SEQ ID NO: 544776 - RNA, 23 nt, Human
uggaaugcaauggugcgaucucg

SEQ ID NO: 544777 - RNA, 24 nt, Human
uggaucaccugaggucaggaguuc

SEQ ID NO: 544778 - RNA, 26 nt, Human
uggaucaccugaggucaggaguucaa

SEQ ID NO: 544779 - RNA, 22 nt, Human
uggcucacgccuguaaucccag

SEQ ID NO: 544780 - RNA, 24 nt, Human
uggcucacgccuguaaucccagca

SEQ ID NO: 544781 - RNA, 24 nt, Human
ugggaggccaaggcggguggauca

SEQ ID NO: 544782 - RNA, 24 nt, Human
ugggaggcugagacaggagaauca

SEQ ID NO: 544783 - RNA, 21 nt, Human
ugggaucacaggcaugagcca

SEQ ID NO: 544784 - RNA, 22 nt, Human
ugggaucacaggcaugagccau

SEQ ID NO: 544785 - RNA, 23 nt, Human
ugggaucacaggcaugagccauc

SEQ ID NO: 544786 - RNA, 24 nt, Human
ugggaucacaggcaugagccauca

SEQ ID NO: 544787 - RNA, 24 nt, Human
ugggaucacaggcaugagccauca

SEQ ID NO: 544788 - RNA, 27 nt, Human
ugggaucacaggcaugagccaucacgc

SEQ ID NO: 544789 - RNA, 24 nt, Human
ugguagcucaugccugcaauccca

SEQ ID NO: 544790 - RNA, 21 nt, Human
uucaaagccagccugaccaac

SEQ ID NO: 544791 - RNA, 20 nt, Human
uucauggguuaaggguaggg

SEQ ID NO: 544792 - RNA, 24 nt, Human
uucgcucuuguugcccaggcugga

SEQ ID NO: 544793 - RNA, 23 nt, Human
uucuccuagaauccuuucucaaa

SEQ ID NO: 544794 - RNA, 18 nt, Human
uugcagugagccgagauu

SEQ ID NO: 544795 - RNA, 19 nt, Human
uugcagugagccgagauug

SEQ ID NO: 544796 - RNA, 22 nt, Human
uugcagugagccgagauugugu

SEQ ID NO: 544797 - RNA, 18 nt, Human
uugcccaggcuggaaugc

SEQ ID NO: 544798 - RNA, 25 nt, Human
uugggaggcugagacaggagaauca

SEQ ID NO: 544799 - RNA, 23 nt, Human
uugugucacugcacuccagccug

SEQ ID NO: 544800 - RNA, 23 nt, Human
uuguugcccaggcuggaaugcaa

SEQ ID NO: 544801 - RNA, 24 nt, Human
uuucgcucuuguugcccaggcugg

SEQ ID NO: 544802 - RNA, 19 nt, Human
uuuuguauuuuuaguagag

SEQ ID NO: 544803 - RNA, 20 nt, Human
uuuuguauuuuuaguagaga

SEQ ID NO: 544804 - RNA, 24 nt, Human
uuuuuucuuuuuuuuccaaaaugc

SEQ ID NO: 544805 - RNA, 25 nt, Human
uuuuuuuuuuuugagacggaguuuc

SEQ ID NO: 544806 - RNA, 22 nt, Human
uuuuuuuuuuuuuugagacgga

SEQ ID NO: 544807 - RNA, 18 nt, Human
uuuuuuuuuuuuuuuuug

SEQ ID NO: 544808 - RNA, 20 nt, Human
agaacuaacaauaaaaagga

SEQ ID NO: 544809 - RNA, 21 nt, Human
auguucuaaauggcagcucca

SEQ ID NO: 544810 - RNA, 18 nt, Human
caagacggccccugccaa

SEQ ID NO: 544811 - RNA, 19 nt, Human
caauaaaaaggaguuccaa

SEQ ID NO: 544812 - RNA, 22 nt, Human
cagcaagaugaagcugggauua

SEQ ID NO: 544813 - RNA, 21 nt, Human
ccaucuucucuuuuugccacc

SEQ ID NO: 544814 - RNA, 24 nt, Human
cuaaauggcagcuccaucuucucu

SEQ ID NO: 544815 - RNA, 21 nt, Human
gagaacuaacaauaaaaagga

SEQ ID NO: 544816 - RNA, 24 nt, Human
gaugaagcugggauuaggcauguu

SEQ ID NO: 544817 - RNA, 28 nt, Human
ggaaacaagugagaacuaaccgguaccc

SEQ ID NO: 544818 - RNA, 23 nt, Human
uggaaacaagugagaacuaacaa

SEQ ID NO: 544819 - RNA, 24 nt, Human
uggcagcuccaucuucucuuuuug

SEQ ID NO: 544820 - RNA, 21 nt, Human
caccacgcuggcuccggaggc

SEQ ID NO: 544821 - RNA, 21 nt, Human
cggaggcaccggcucugaagc

SEQ ID NO: 544822 - RNA, 21 nt, Human
cucugcccacccugaggacag

SEQ ID NO: 544823 - RNA, 22 nt, Human
cucugcccacccugaggacaga

SEQ ID NO: 544824 - RNA, 24 nt, Human
gcugguaagcuuccggccuucucc

SEQ ID NO: 544825 - RNA, 19 nt, Human
uaggaauuccuucucggcu

SEQ ID NO: 544826 - RNA, 21 nt, Human
uaguggcucugcccacccuga

SEQ ID NO: 544827 - RNA, 21 nt, Human
uccggaggcaccggcucugaa

SEQ ID NO: 544828 - RNA, 21 nt, Human
uggccaccacgcuggcuccgg

SEQ ID NO: 544829 - RNA, 20 nt, Human
aacaggcauuuggccaauaa

SEQ ID NO: 544830 - RNA, 19 nt, Human
aagcaaaagaaacaaagua

SEQ ID NO: 544831 - RNA, 20 nt, Human
aaugaugugccugaaauagc

SEQ ID NO: 544832 - RNA, 21 nt, Human
aauuuccuaagcaaaagaaac

SEQ ID NO: 544833 - RNA, 25 nt, Human
acaaagcagauuacaauguagcccu

SEQ ID NO: 544834 - RNA, 18 nt, Human
acauuaaacauggaagcu

SEQ ID NO: 544835 - RNA, 19 nt, Human
acucuaaaagaugacaaga

SEQ ID NO: 544836 - RNA, 23 nt, Human
agcaaaagaaacaaaguaaaugc

SEQ ID NO: 544837 - RNA, 25 nt, Human
aggaagaauaaagaauuuggaccgg

SEQ ID NO: 544838 - RNA, 24 nt, Human
aguaaaugcugagguuaauaaaga

SEQ ID NO: 544839 - RNA, 22 nt, Human
auuuccuaagcaaaagaaacaa

SEQ ID NO: 544840 - RNA, 23 nt, Human
caacucaucaaaacaggcauuug

SEQ ID NO: 544841 - RNA, 19 nt, Human
ccaggucacucuuccaauc

SEQ ID NO: 544842 - RNA, 20 nt, Human
ccccucagugagacccuggc

SEQ ID NO: 544843 - RNA, 22 nt, Human
ccccucagugagacccuggccu

SEQ ID NO: 544844 - RNA, 21 nt, Human
cucuuccaaucagugaauggc

SEQ ID NO: 544845 - RNA, 24 nt, Human
gcucaaggaagaauaaagaauuug

SEQ ID NO: 544846 - RNA, 20 nt, Human
gggacgcgggggagggagcc

SEQ ID NO: 544847 - RNA, 25 nt, Human
gggagggagccggcgggcagcgagu

SEQ ID NO: 544848 - RNA, 20 nt, Human
gucgcagggacgcgggggag

SEQ ID NO: 544849 - RNA, 28 nt, Human
uaacaaagcagauuacaauguagcccua

SEQ ID NO: 544850 - RNA, 24 nt, Human
uagauuuauuuagggcuguuugca

SEQ ID NO: 544851 - RNA, 22 nt, Human
ugacaagacagcucccccucag

SEQ ID NO: 544852 - RNA, 21 nt, Human
ugagguuaauaaagauguaau

SEQ ID NO: 544853 - RNA, 20 nt, Human
ugccaggucacucuuccaau

SEQ ID NO: 544854 - RNA, 21 nt, Human
ugcugagguuaauaaagaugu

SEQ ID NO: 544855 - RNA, 24 nt, Human
uguaauuuaaaauccugagcuuaa

SEQ ID NO: 544856 - RNA, 22 nt, Human
uuaguuguuacaagacacugca

SEQ ID NO: 544857 - RNA, 19 nt, Human
uuaugagcaauuuccuaag

SEQ ID NO: 544858 - RNA, 19 nt, Human
uuuuuuuuuuuuuuauucu

SEQ ID NO: 544859 - RNA, 19 nt, Human
aaagcccagcucuuccaag

SEQ ID NO: 544860 - RNA, 20 nt, Human
aaagcccagcucuuccaagc

SEQ ID NO: 544861 - RNA, 23 nt, Human
aacagcaaauaagggcccaaagc

SEQ ID NO: 544862 - RNA, 22 nt, Human
aagguccccccacccccaagac

SEQ ID NO: 544863 - RNA, 23 nt, Human
aagguccccccacccccaagacc

SEQ ID NO: 544864 - RNA, 23 nt, Human
aagguccccccacccccaagacc

SEQ ID NO: 544865 - RNA, 21 nt, Human
acccagccagcccccuaucac

SEQ ID NO: 544866 - RNA, 24 nt, Human
accccuacagacaacucuuagaac

SEQ ID NO: 544867 - RNA, 18 nt, Human
agacagaaaacaaagccc

SEQ ID NO: 544868 - RNA, 22 nt, Human
agacagaaaacaaagcccagcu

SEQ ID NO: 544869 - RNA, 21 nt, Human
agccucaccccugaacucaaa

SEQ ID NO: 544870 - RNA, 21 nt, Human
aggaguaaggaaagagguuag

SEQ ID NO: 544871 - RNA, 22 nt, Human
aggguggagaugggguaaccag

SEQ ID NO: 544872 - RNA, 21 nt, Human
aucucaccauuccugacccag

SEQ ID NO: 544873 - RNA, 24 nt, Human
caaaaaaaaaaccccuacagacaa

SEQ ID NO: 544874 - RNA, 25 nt, Human
caaaaaaaaaaccccuacagacaac

SEQ ID NO: 544875 - RNA, 23 nt, Human
caaaagacacuguacuggggaac

SEQ ID NO: 544876 - RNA, 23 nt, Human
caaaguaccaggcugcuagggug

SEQ ID NO: 544877 - RNA, 21 nt, Human
caaauaagggcccaaagccau

SEQ ID NO: 544878 - RNA, 20 nt, Human
caccauuccugacccagccg

SEQ ID NO: 544879 - RNA, 21 nt, Human
cacccacacucacucaucccc

SEQ ID NO: 544880 - RNA, 21 nt, Human
cagaaaacaaagcccagcucu

SEQ ID NO: 544881 - RNA, 25 nt, Human
cagaaaacaaagcccagcucuucca

SEQ ID NO: 544882 - RNA, 22 nt, Human
cauccccuuccucacaaugacc

SEQ ID NO: 544883 - RNA, 21 nt, Human
caucuguuugguuguccaaag

SEQ ID NO: 544884 - RNA, 22 nt, Human
ccaaauccaccugcccacuguc

SEQ ID NO: 544885 - RNA, 19 nt, Human
ccagccacacccacacuca

SEQ ID NO: 544886 - RNA, 21 nt, Human
ccaggggaauaugcuggaaaa

SEQ ID NO: 544887 - RNA, 25 nt, Human
cccacacucacucauccccuuccuc

SEQ ID NO: 544888 - RNA, 21 nt, Human
cccacuguccaccggcaucua

SEQ ID NO: 544889 - RNA, 19 nt, Human
ccccacccccaagaccaag

SEQ ID NO: 544890 - RNA, 19 nt, Human
cccccaagaccaaggaccc

SEQ ID NO: 544891 - RNA, 20 nt, Human
cccccaagaccaaggacccu

SEQ ID NO: 544892 - RNA, 24 nt, Human
cccccacccccaagaccaaggacc

SEQ ID NO: 544893 - RNA, 23 nt, Human
ccccugaacucaaaugggauggg

SEQ ID NO: 544894 - RNA, 18 nt, Human
ccucaaaaaaaaaacccc

SEQ ID NO: 544895 - RNA, 22 nt, Human
ccucaaaaaaaaaaccccuaca

SEQ ID NO: 544896 - RNA, 25 nt, Human
ccucaaaaaaaaaaccccuacagac

SEQ ID NO: 544897 - RNA, 24 nt, Human
ccucaccccugaacucaaauggga

SEQ ID NO: 544898 - RNA, 24 nt, Human
ccuccagccacacccacacucacu

SEQ ID NO: 544899 - RNA, 24 nt, Human
ccuccccaaauccaccugcccacu

SEQ ID NO: 544900 - RNA, 24 nt, Human
cuagcuccuccuccagccacaccc

SEQ ID NO: 544901 - RNA, 26 nt, Human
cucaccccugaacucaaaagguuuuc

SEQ ID NO: 544902 - RNA, 20 nt, Human
cucaccccugaacucaaaug

SEQ ID NO: 544903 - RNA, 20 nt, Human
cucacucauccccuuccuca

SEQ ID NO: 544904 - RNA, 18 nt, Human
cucauccccuuccucaca

SEQ ID NO: 544905 - RNA, 24 nt, Human
cuggaaaagguccccccaccccca

SEQ ID NO: 544906 - RNA, 22 nt, Human
cuuaagccucaccccugaacuc

SEQ ID NO: 544907 - RNA, 22 nt, Human
gaaaacaaagcccagcucuucc

SEQ ID NO: 544908 - RNA, 20 nt, Human
gaaaagguccccccaccccc

SEQ ID NO: 544909 - RNA, 18 nt, Human
gaacaggggagagggugg

SEQ ID NO: 544910 - RNA, 18 nt, Human
gaccgcacccaaaagaca

SEQ ID NO: 544911 - RNA, 20 nt, Human
gagaggguggagauggggua

SEQ ID NO: 544912 - RNA, 23 nt, Human
gauccucuccuccccaaauccac

SEQ ID NO: 544913 - RNA, 24 nt, Human
gccacacccacacucacucauccc

SEQ ID NO: 544914 - RNA, 24 nt, Human
gcccaaagccauuuccaaucaucc

SEQ ID NO: 544915 - RNA, 24 nt, Human
gcugcuagggugggcccagaaacu

SEQ ID NO: 544916 - RNA, 20 nt, Human
gcugcugcugauccucuccu

SEQ ID NO: 544917 - RNA, 22 nt, Human
ggaacccaggacuggaggcugg

SEQ ID NO: 544918 - RNA, 18 nt, Human
ggacuggaggcugggcug

SEQ ID NO: 544919 - RNA, 21 nt, Human
ggagaugggguaaccagucca

SEQ ID NO: 544920 - RNA, 20 nt, Human
ggaugggauaaggaguaagg

SEQ ID NO: 544921 - RNA, 28 nt, Human
ggcugcuagggugggcccagaaacugcu

SEQ ID NO: 544922 - RNA, 21 nt, Human
gggauaaggaguaaggaaaga

SEQ ID NO: 544923 - RNA, 19 nt, Human
gggcagggguacagagcug

SEQ ID NO: 544924 - RNA, 18 nt, Human
guccccccacccccaaga

SEQ ID NO: 544925 - RNA, 24 nt, Human
uaaacucugaagcugagcucccag

SEQ ID NO: 544926 - RNA, 21 nt, Human
uacagacaacucuuagaacag

SEQ ID NO: 544927 - RNA, 23 nt, Human
uacagagcuguugcgugugugug

SEQ ID NO: 544928 - RNA, 19 nt, Human
uagaacagcaaauaagggc

SEQ ID NO: 544929 - RNA, 19 nt, Human
uagaacagcaaauaagggc

SEQ ID NO: 544930 - RNA, 22 nt, Human
uagaacagcaaauaagggccca

SEQ ID NO: 544931 - RNA, 21 nt, Human
ucacucauccccuuccucaca

SEQ ID NO: 544932 - RNA, 23 nt, Human
ucacugaguacugcugcugcugc

SEQ ID NO: 544933 - RNA, 19 nt, Human
uccccaaauccaccugccc

SEQ ID NO: 544934 - RNA, 20 nt, Human
uccccuuccucacaaugacc

SEQ ID NO: 544935 - RNA, 20 nt, Human
ucccuuguaaacucugaagc

SEQ ID NO: 544936 - RNA, 22 nt, Human
ucccuuguaaacucugaagcuc

SEQ ID NO: 544937 - RNA, 22 nt, Human
uccucaaaaaaaaaaccccuac

SEQ ID NO: 544938 - RNA, 22 nt, Human
ucggauguuaacuaaaggccca

SEQ ID NO: 544939 - RNA, 26 nt, Human
ucuuaagccucaccccugaacucaaa

SEQ ID NO: 544940 - RNA, 23 nt, Human
ugcaauccucaaaaaaaaaaccc

SEQ ID NO: 544941 - RNA, 23 nt, Human
ugcugcugauccucuccucccca

SEQ ID NO: 544942 - RNA, 20 nt, Human
ugcuggaaaaggucccccca

SEQ ID NO: 544943 - RNA, 18 nt, Human
uggagaugggguaaccag

SEQ ID NO: 544944 - RNA, 23 nt, Human
ugggagguuccaaguucugggca

SEQ ID NO: 544945 - RNA, 19 nt, Human
ugggaugggauaaggagua

SEQ ID NO: 544946 - RNA, 18 nt, Human
ugggcugaaggaaggcag

SEQ ID NO: 544947 - RNA, 18 nt, Human
ugggguaaccaguccaca

SEQ ID NO: 544948 - RNA, 23 nt, Human
uucaucucaccauuccugaccca

SEQ ID NO: 544949 - RNA, 21 nt, Human
uuucaacuauucucucuucca

SEQ ID NO: 544950 - RNA, 24 nt, Human
uuucaacuauucucucuuccacuu

SEQ ID NO: 544951 - RNA, 22 nt, Human
aagaagcugacccagaacccac

SEQ ID NO: 544952 - RNA, 20 nt, Human
aauucccagaggggaggagg

SEQ ID NO: 544953 - RNA, 22 nt, Human
acaaaauugagguaaaagaagc

SEQ ID NO: 544954 - RNA, 20 nt, Human
acaacugcccagggcugccc

SEQ ID NO: 544955 - RNA, 19 nt, Human
acccucaacaaaccuccca

SEQ ID NO: 544956 - RNA, 21 nt, Human
acccucaacaaaccucccagc

SEQ ID NO: 544957 - RNA, 19 nt, Human
accgcgggcccgaagcagc

SEQ ID NO: 544958 - RNA, 21 nt, Human
acucgccccacaccaggcccc

SEQ ID NO: 544959 - RNA, 22 nt, Human
agcugacccagaacccacgccc

SEQ ID NO: 544960 - RNA, 18 nt, Human
agcuuccgagcgagccgc

SEQ ID NO: 544961 - RNA, 25 nt, Human
aggcaggcagggggagccccggcuu

SEQ ID NO: 544962 - RNA, 20 nt, Human
aggcagggggagccccggcu

SEQ ID NO: 544963 - RNA, 22 nt, Human
aggccccgagcaccgcgggccc

SEQ ID NO: 544964 - RNA, 23 nt, Human
aguacaacugcccagggcugccc

SEQ ID NO: 544965 - RNA, 22 nt, Human
caacaaaccucccagccucucg

SEQ ID NO: 544966 - RNA, 21 nt, Human
cacacccucaacaaaccuccc

SEQ ID NO: 544967 - RNA, 27 nt, Human
caccaggccccgagcaccgcgggcccc

SEQ ID NO: 544968 - RNA, 18 nt, Human
caccccacacccucaaca

SEQ ID NO: 544969 - RNA, 20 nt, Human
caccccacacccucaacaaa

SEQ ID NO: 544970 - RNA, 19 nt, Human
cagcuucagaccccucugg

SEQ ID NO: 544971 - RNA, 22 nt, Human
cagcuucagaccccucuggccu

SEQ ID NO: 544972 - RNA, 19 nt, Human
caggcagggggagccccgg

SEQ ID NO: 544973 - RNA, 20 nt, Human
cccagaacccacgcccgucc

SEQ ID NO: 544974 - RNA, 23 nt, Human
ccccacaccaggccccgagcacc

SEQ ID NO: 544975 - RNA, 22 nt, Human
ccccacacccucaacaaaccuc

SEQ ID NO: 544976 - RNA, 23 nt, Human
ccccaugaguacaacugcccagg

SEQ ID NO: 544977 - RNA, 23 nt, Human
cccccagaggacagacgggcccu

SEQ ID NO: 544978 - RNA, 22 nt, Human
ccccgagcaccgcgggcccgaa

SEQ ID NO: 544979 - RNA, 22 nt, Human
ccgagcaccgcgggcccgaagc

SEQ ID NO: 544980 - RNA, 22 nt, Human
ccguccaggcuggggaaguccu

SEQ ID NO: 544981 - RNA, 21 nt, Human
ccuaagcccccaugaguacaa

SEQ ID NO: 544982 - RNA, 19 nt, Human
ccuccggcagaucgaggcu

SEQ ID NO: 544983 - RNA, 20 nt, Human
cugcagcuccggcucggccu

SEQ ID NO: 544984 - RNA, 20 nt, Human
gacaagaggacggggcugag

SEQ ID NO: 544985 - RNA, 22 nt, Human
gagaggcaggcagggggagccc

SEQ ID NO: 544986 - RNA, 19 nt, Human
gaggacagacgggcccugc

SEQ ID NO: 544987 - RNA, 21 nt, Human
gccaccagaggcgggcgugcu

SEQ ID NO: 544988 - RNA, 21 nt, Human
gcugcagcuccggcucggccu

SEQ ID NO: 544989 - RNA, 23 nt, Human
ggacaagaggacggggcugaggg

SEQ ID NO: 544990 - RNA, 19 nt, Human
ggaggagagagaggcaggc

SEQ ID NO: 544991 - RNA, 24 nt, Human
ggaggagagagaggcaggcagggg

SEQ ID NO: 544992 - RNA, 22 nt, Human
ggcaggcagggggagccccggc

SEQ ID NO: 544993 - RNA, 23 nt, Human
gggaagucucuacucgccccaca

SEQ ID NO: 544994 - RNA, 21 nt, Human
gggcagcgggguggccaccag

SEQ ID NO: 544995 - RNA, 22 nt, Human
gggcagggcucuggcuguggcu

SEQ ID NO: 544996 - RNA, 23 nt, Human
gggcagggcucuggcuguggcuc

SEQ ID NO: 544997 - RNA, 19 nt, Human
gggcccgaagcagccccca

SEQ ID NO: 544998 - RNA, 23 nt, Human
ggggaggaggagagagaggcaga

SEQ ID NO: 544999 - RNA, 20 nt, Human
guggggcacaccccacaccc

SEQ ID NO: 545000 - RNA, 21 nt, Human
uaaaagaagcugacccagaac

SEQ ID NO: 545001 - RNA, 22 nt, Human
uaaaagaagcugacccagaacc

SEQ ID NO: 545002 - RNA, 24 nt, Human
uaaaagaagcugacccagaaccca

SEQ ID NO: 545003 - RNA, 19 nt, Human
uccaggcuggggaagucuc

SEQ ID NO: 545004 - RNA, 21 nt, Human
ucccaaacagcuucagacccc

SEQ ID NO: 545005 - RNA, 24 nt, Human
ucccaaacagcuucagaccccucu

SEQ ID NO: 545006 - RNA, 20 nt, Human
uccuaagcccccaugaguac

SEQ ID NO: 545007 - RNA, 20 nt, Human
ugagguaaaagaagcugacc

SEQ ID NO: 545008 - RNA, 22 nt, Human
ugagguagcugcauccuaagcc

SEQ ID NO: 545009 - RNA, 21 nt, Human
ugcccagcgccuccggcagau

SEQ ID NO: 545010 - RNA, 18 nt, Human
uggagucccggggucauu

SEQ ID NO: 545011 - RNA, 21 nt, Human
uuucccaaacagcuucagacc

SEQ ID NO: 545012 - RNA, 24 nt, Human
aaaaaaaaaauccagagcaugaaa

SEQ ID NO: 545013 - RNA, 20 nt, Human
aaaaaaaaauccagagcaug

SEQ ID NO: 545014 - RNA, 21 nt, Human
aaaaaaaaccagaauccaucc

SEQ ID NO: 545015 - RNA, 20 nt, Human
aaaaaaaucucuuaaaccca

SEQ ID NO: 545016 - RNA, 24 nt, Human
aaaaaaauuacuucuuuaaccucc

SEQ ID NO: 545017 - RNA, 22 nt, Human
aaacccagagaaggaaaaaaaa

SEQ ID NO: 545018 - RNA, 20 nt, Human
aaacuacuaaguccacuuca

SEQ ID NO: 545019 - RNA, 22 nt, Human
aaccagaauccauccuccuucc

SEQ ID NO: 545020 - RNA, 21 nt, Human
aacccagagaaggaaaaaaaa

SEQ ID NO: 545021 - RNA, 22 nt, Human
aacccagagaaggaaaaaaaaa

SEQ ID NO: 545022 - RNA, 22 nt, Human
aagaaaaaaaaccagaauccau

SEQ ID NO: 545023 - RNA, 20 nt, Human
aagaacucaagacaguuuca

SEQ ID NO: 545024 - RNA, 20 nt, Human
aagaagaacucaagacaguu

SEQ ID NO: 545025 - RNA, 22 nt, Human
aagaagccagugaaggcauaua

SEQ ID NO: 545026 - RNA, 19 nt, Human
aagcugcccugaucuucuc

SEQ ID NO: 545027 - RNA, 27 nt, Human
aagggcaagaugggggugagcucagcg

SEQ ID NO: 545028 - RNA, 19 nt, Human
aaucucuuaaacccagaga

SEQ ID NO: 545029 - RNA, 21 nt, Human
acaaaaaaaaaaagaaagaaa

SEQ ID NO: 545030 - RNA, 23 nt, Human
acaaaaaaaaaaagaaagaaaaa

SEQ ID NO: 545031 - RNA, 21 nt, Human
acacacaaaaucaaagguauc

SEQ ID NO: 545032 - RNA, 25 nt, Human
accagaaucaaaucagaaaaaaaaa

SEQ ID NO: 545033 - RNA, 23 nt, Human
accagaauccauccuccuuccuc

SEQ ID NO: 545034 - RNA, 21 nt, Human
agaaaaaaaaaaaaaaaagga

SEQ ID NO: 545035 - RNA, 26 nt, Human
agaaaaaaaaaaaaaaaaggaaaaag

SEQ ID NO: 545036 - RNA, 25 nt, Human
agaaggaaaaaaaaaaaaaauccag

SEQ ID NO: 545037 - RNA, 18 nt, Human
agggcaagauggggguga

SEQ ID NO: 545038 - RNA, 19 nt, Human
aggggugguggggaugggc

SEQ ID NO: 545039 - RNA, 25 nt, Human
auaaauuuuuacacaaucaacagaa

SEQ ID NO: 545040 - RNA, 20 nt, Human
auccagagcaugaaacacac

SEQ ID NO: 545041 - RNA, 22 nt, Human
auugccaaggaacaggaagggc

SEQ ID NO: 545042 - RNA, 19 nt, Human
caaaaaaaaucucuuaaac

SEQ ID NO: 545043 - RNA, 20 nt, Human
caagaagaacucaagacagu

SEQ ID NO: 545044 - RNA, 22 nt, Human
cacaaucaacagaaacacacca

SEQ ID NO: 545045 - RNA, 23 nt, Human
cacaaucaacagaaacacaccaa

SEQ ID NO: 545046 - RNA, 19 nt, Human
cagagaaggaaaaaaaaaa

SEQ ID NO: 545047 - RNA, 26 nt, Human
cagcccagguugaucccaggccuugg

SEQ ID NO: 545048 - RNA, 21 nt, Human
cagcugccagcucuaacuugu

SEQ ID NO: 545049 - RNA, 23 nt, Human
cagcugccagcucuaacuuguuu

SEQ ID NO: 545050 - RNA, 21 nt, Human
caggaagggcaagaugggggu

SEQ ID NO: 545051 - RNA, 20 nt, Human
cauucagcccccauucacuc

SEQ ID NO: 545052 - RNA, 22 nt, Human
ccaacuacaaaaaaaaaaagaa

SEQ ID NO: 545053 - RNA, 26 nt, Human
ccaacuacaaaaaaaaaaagaaagaa

SEQ ID NO: 545054 - RNA, 20 nt, Human
ccagcagcaacauaguuacu

SEQ ID NO: 545055 - RNA, 26 nt, Human
ccagcagcaacauaguuacuuucucu

SEQ ID NO: 545056 - RNA, 25 nt, Human
ccaucuggcgcuccucuucagcuau

SEQ ID NO: 545057 - RNA, 25 nt, Human
cccagagaaggaaaaaaaaaaaaaa

SEQ ID NO: 545058 - RNA, 23 nt, Human
ccucccggcacucuuggagcugg

SEQ ID NO: 545059 - RNA, 26 nt, Human
cgcggaugcgccgccccccaccuccc

SEQ ID NO: 545060 - RNA, 23 nt, Human
cuacaaaaaaaaaaagaaagaaa

SEQ ID NO: 545061 - RNA, 21 nt, Human
cugcccugaucuucucuuugc

SEQ ID NO: 545062 - RNA, 20 nt, Human
cuuaaaaggaaaagggggag

SEQ ID NO: 545063 - RNA, 21 nt, Human
cuuuugcuacacuguaaaugu

SEQ ID NO: 545064 - RNA, 19 nt, Human
gaaacacacaaaaucaaag

SEQ ID NO: 545065 - RNA, 22 nt, Human
gaaaguauuugauauauuguug

SEQ ID NO: 545066 - RNA, 19 nt, Human
gaaggaaaaaaaaaaaaaa

SEQ ID NO: 545067 - RNA, 19 nt, Human
gaccacuuaagcugcccug

SEQ ID NO: 545068 - RNA, 18 nt, Human
gagcacaacagggcuugg

SEQ ID NO: 545069 - RNA, 23 nt, Human
gaugggggugagcucagcguucu

SEQ ID NO: 545070 - RNA, 20 nt, Human
gauuuuuuuuuuuuuugcga

SEQ ID NO: 545071 - RNA, 23 nt, Human
ggaugcgccgccccccaccuccc

SEQ ID NO: 545072 - RNA, 23 nt, Human
gggugguggggaugggcugaggu

SEQ ID NO: 545073 - RNA, 20 nt, Human
gucacagagguuuucauggu

SEQ ID NO: 545074 - RNA, 19 nt, Human
gugguggggaugggcugag

SEQ ID NO: 545075 - RNA, 21 nt, Human
guuggguuuuuguuuucugug

SEQ ID NO: 545076 - RNA, 22 nt, Human
uaaacccagagaaggaaaaaaa

SEQ ID NO: 545077 - RNA, 24 nt, Human
uaaacucuacaaauagcuuaaaag

SEQ ID NO: 545078 - RNA, 21 nt, Human
uacaaaaaaaaaaagaaagaa

SEQ ID NO: 545079 - RNA, 18 nt, Human
uagaccacuuaagcugcc

SEQ ID NO: 545080 - RNA, 18 nt, Human
uauuugauauauuguuga

SEQ ID NO: 545081 - RNA, 19 nt, Human
ucaagaagaacucaagaca

SEQ ID NO: 545082 - RNA, 21 nt, Human
ucagaaaaaaaaaaaaaaaaa

SEQ ID NO: 545083 - RNA, 25 nt, Human
ucagaaaaaaaaaaaaaaaaggaaa

SEQ ID NO: 545084 - RNA, 21 nt, Human
ucaggggugguggggaugggc

SEQ ID NO: 545085 - RNA, 21 nt, Human
uccagcagcaacauaguuacu

SEQ ID NO: 545086 - RNA, 23 nt, Human
uccagguccugagcauccugcuc

SEQ ID NO: 545087 - RNA, 25 nt, Human
ucccaacuacaaaaaaaaaaagaaa

SEQ ID NO: 545088 - RNA, 26 nt, Human
ucccaacuacaaaaaaaaaaagaaag

SEQ ID NO: 545089 - RNA, 22 nt, Human
uccugagcauccugcucauugc

SEQ ID NO: 545090 - RNA, 24 nt, Human
ucuccagcagcaacauaguuacuu

SEQ ID NO: 545091 - RNA, 23 nt, Human
ucuuagaccacuuaagcugcccu

SEQ ID NO: 545092 - RNA, 21 nt, Human
ugaaacacacaaaaucaaagg

SEQ ID NO: 545093 - RNA, 20 nt, Human
ugcacaagaagccagugaag

SEQ ID NO: 545094 - RNA, 19 nt, Human
ugccaaggaacaggaaggg

SEQ ID NO: 545095 - RNA, 22 nt, Human
ugggggugagcucagcguucuc

SEQ ID NO: 545096 - RNA, 25 nt, Human
uuaaagaaugccugaaggauucuua

SEQ ID NO: 545097 - RNA, 18 nt, Human
uugguucuuuuuaauugg

SEQ ID NO: 545098 - RNA, 24 nt, Human
uugguuggguuuuuguuuucugug

SEQ ID NO: 545099 - RNA, 25 nt, Human
uuucaugguucugcuuaaaacuacu

SEQ ID NO: 545100 - RNA, 21 nt, Human
uuuuuauuguuggcuuaaaaa

SEQ ID NO: 545101 - RNA, 19 nt, Human
aagaagcaaaggcagcaca

SEQ ID NO: 545102 - RNA, 22 nt, Human
caagugauuuuaucuucuccca

SEQ ID NO: 545103 - RNA, 20 nt, Human
ccagguuacaucaagugauu

SEQ ID NO: 545104 - RNA, 21 nt, Human
ccaugaaugauaagaagcaaa

SEQ ID NO: 545105 - RNA, 19 nt, Human
guacaugaucaaaaggcuu

SEQ ID NO: 545106 - RNA, 19 nt, Human
ucccaagcuauaaaauauc

SEQ ID NO: 545107 - RNA, 28 nt, Human
ucugccaugaaugauaagaagcaaaggc

SEQ ID NO: 545108 - RNA, 19 nt, Human
ugaaagcacuaacaaucug

SEQ ID NO: 545109 - RNA, 18 nt, Human
ugauaagaagcaaaggca

SEQ ID NO: 545110 - RNA, 22 nt, Human
ugccauguaaagcauaguuucc

SEQ ID NO: 545111 - RNA, 23 nt, Human
uuuccagguuacaucaagugauu

SEQ ID NO: 545112 - RNA, 24 nt, Human
uuuccagguuacaucaagugauuu

SEQ ID NO: 545113 - RNA, 23 nt, Human
uuuuuuuuuuuuuuuuucugguu

SEQ ID NO: 545114 - RNA, 28 nt, Human
uuuuuuuuuuuuuuuuuuuuucuggggg

SEQ ID NO: 545115 - RNA, 24 nt, Human
aagcauauagauuuauuaaaaaua

SEQ ID NO: 545116 - RNA, 21 nt, Human
aagugauuuuugcacugagcu

SEQ ID NO: 545117 - RNA, 20 nt, Human
agaguccagugugcgcugcc

SEQ ID NO: 545118 - RNA, 20 nt, Human
auaguuacuuaacagcuaaa

SEQ ID NO: 545119 - RNA, 24 nt, Human
auguaugcauucccuuuauguccc

SEQ ID NO: 545120 - RNA, 18 nt, Human
caaccuucccuaagcauc

SEQ ID NO: 545121 - RNA, 23 nt, Human
cacauggauuccaagagagauuu

SEQ ID NO: 545122 - RNA, 21 nt, Human
caguagagacugaagcuggua

SEQ ID NO: 545123 - RNA, 23 nt, Human
cauggauuccaagagagauuuug

SEQ ID NO: 545124 - RNA, 20 nt, Human
ccaguagagacugaagcugg

SEQ ID NO: 545125 - RNA, 18 nt, Human
ccccucccucccuaucuc

SEQ ID NO: 545126 - RNA, 23 nt, Human
cuccugcaccuaccaaggugcca

SEQ ID NO: 545127 - RNA, 19 nt, Human
cugguccgcagccuggggc

SEQ ID NO: 545128 - RNA, 23 nt, Human
gagcagaugccggccccgcucgg

SEQ ID NO: 545129 - RNA, 18 nt, Human
gagggagaaccagaaguc

SEQ ID NO: 545130 - RNA, 23 nt, Human
gauuuuugcacugagcuccuccu

SEQ ID NO: 545131 - RNA, 25 nt, Human
gcaaagcuugucucuaaaggguuaa

SEQ ID NO: 545132 - RNA, 23 nt, Human
gcagugcuggugacaguggauac

SEQ ID NO: 545133 - RNA, 18 nt, Human
gcgcggcgcggguugcgg

SEQ ID NO: 545134 - RNA, 22 nt, Human
gcugccugggucuggauccagg

SEQ ID NO: 545135 - RNA, 21 nt, Human
ggauccagaaaguccuaagug

SEQ ID NO: 545136 - RNA, 22 nt, Human
ggcacauggauuccaagagaga

SEQ ID NO: 545137 - RNA, 19 nt, Human
ggcaugagauucagaagag

SEQ ID NO: 545138 - RNA, 23 nt, Human
ggcuccguccuccugcgcggcca

SEQ ID NO: 545139 - RNA, 24 nt, Human
ggggcaaagcuugucucuaaaggg

SEQ ID NO: 545140 - RNA, 20 nt, Human
uaaaagcuaaagauuuccau

SEQ ID NO: 545141 - RNA, 24 nt, Human
uccauaaacacuauuccaaaaugu

SEQ ID NO: 545142 - RNA, 22 nt, Human
ucccuaagcaucugucuggucc

SEQ ID NO: 545143 - RNA, 24 nt, Human
ucucuuaaaauaaauuugaacacc

SEQ ID NO: 545144 - RNA, 18 nt, Human
ugagaagagaguggagag

SEQ ID NO: 545145 - RNA, 18 nt, Human
ugcuggugacaguggaua

SEQ ID NO: 545146 - RNA, 19 nt, Human
uggauuccaagagagauuu

SEQ ID NO: 545147 - RNA, 22 nt, Human
uguaaaaaacacuugagggaga

SEQ ID NO: 545148 - RNA, 19 nt, Human
uguaugcauucccuuuaug

SEQ ID NO: 545149 - RNA, 19 nt, Human
uguuuuauuuuccuccacc

SEQ ID NO: 545150 - RNA, 23 nt, Human
uuugagaagagaguggagaggga

SEQ ID NO: 545151 - RNA, 19 nt, Human
uuugcacugagcuccuccu

SEQ ID NO: 545152 - RNA, 22 nt, Human
uuuuuuuuuuuuuuuuuuuaag

SEQ ID NO: 545153 - RNA, 18 nt, Human
aaaaaaaacaaaacagcc

SEQ ID NO: 545154 - RNA, 23 nt, Human
aaaaaaacaaaacagcccaccag

SEQ ID NO: 545155 - RNA, 24 nt, Human
aaaaaaacaaaacagcccaccaga

SEQ ID NO: 545156 - RNA, 26 nt, Human
aaaaaaacaaaacagcccaccagaug

SEQ ID NO: 545157 - RNA, 22 nt, Human
aaaaacaaacaagcauagaucc

SEQ ID NO: 545158 - RNA, 20 nt, Human
aaacagcccaccagaugugu

SEQ ID NO: 545159 - RNA, 21 nt, Human
aaccaccuggagagggaaccc

SEQ ID NO: 545160 - RNA, 22 nt, Human
aagaggaaaaaaaaaaacaaaa

SEQ ID NO: 545161 - RNA, 18 nt, Human
aagcacacacacgcacac

SEQ ID NO: 545162 - RNA, 23 nt, Human
aaguagcagcggcugugugggcc

SEQ ID NO: 545163 - RNA, 18 nt, Human
acaccagugauggcaaac

SEQ ID NO: 545164 - RNA, 22 nt, Human
acacccgugggugggggugggg

SEQ ID NO: 545165 - RNA, 31 nt, Human
acgugcgcacacacaagcacacacacgcaca

SEQ ID NO: 545166 - RNA, 20 nt, Human
agaaacagggaggugacaac

SEQ ID NO: 545167 - RNA, 24 nt, Human
agccacugggauccagugcaacga

SEQ ID NO: 545168 - RNA, 18 nt, Human
agcgcagggaggcgcagg

SEQ ID NO: 545169 - RNA, 22 nt, Human
aggaacaauuaaagaaagcaac

SEQ ID NO: 545170 - RNA, 19 nt, Human
aggcacguugauuaggacg

SEQ ID NO: 545171 - RNA, 22 nt, Human
aggcacguugauuaggacggca

SEQ ID NO: 545172 - RNA, 20 nt, Human
agugaucccgucaagacauc

SEQ ID NO: 545173 - RNA, 22 nt, Human
agugauggcaaacgccucuccc

SEQ ID NO: 545174 - RNA, 19 nt, Human
auagauccucuccaggcuc

SEQ ID NO: 545175 - RNA, 22 nt, Human
auagauccucuccaggcuccag

SEQ ID NO: 545176 - RNA, 22 nt, Human
auccucuccaggcuccagggug

SEQ ID NO: 545177 - RNA, 24 nt, Human
augacugugugugucugcagcuug

SEQ ID NO: 545178 - RNA, 25 nt, Human
caaaacagcccaccagauguguggc

SEQ ID NO: 545179 - RNA, 23 nt, Human
caaaagugaggccuucuucuucc

SEQ ID NO: 545180 - RNA, 23 nt, Human
caagcccuugguggagaaacagg

SEQ ID NO: 545181 - RNA, 21 nt, Human
cacaaagagccccagugaucc

SEQ ID NO: 545182 - RNA, 23 nt, Human
cacaaagagccccagugaucccg

SEQ ID NO: 545183 - RNA, 27 nt, Human
cacaagcacacacacgcacacccgcca

SEQ ID NO: 545184 - RNA, 22 nt, Human
cacacacacgcacacccgccac

SEQ ID NO: 545185 - RNA, 22 nt, Human
caccagugauggcaaacgccuc

SEQ ID NO: 545186 - RNA, 18 nt, Human
cacccccaucccgcaaag

SEQ ID NO: 545187 - RNA, 19 nt, Human
cacccugcucaggccgagc

SEQ ID NO: 545188 - RNA, 22 nt, Human
caccucuggguccccauccccu

SEQ ID NO: 545189 - RNA, 21 nt, Human
caccuggagagggaaccccca

SEQ ID NO: 545190 - RNA, 28 nt, Human
cacgugcgcacacacaagcacacacacg

SEQ ID NO: 545191 - RNA, 18 nt, Human
cagcagcaaaagugaggc

SEQ ID NO: 545192 - RNA, 23 nt, Human
cagcggcugugugggccccgcag

SEQ ID NO: 545193 - RNA, 18 nt, Human
cagggccgggaccugggc

SEQ ID NO: 545194 - RNA, 23 nt, Human
cagugcaacgagguggcacacac

SEQ ID NO: 545195 - RNA, 23 nt, Human
ccagugaucccgucaagacaucu

SEQ ID NO: 545196 - RNA, 19 nt, Human
cccagggccgggaccuggg

SEQ ID NO: 545197 - RNA, 19 nt, Human
ccccaaaguagcagcggcu

SEQ ID NO: 545198 - RNA, 25 nt, Human
ccccaagcagccacugggauccagu

SEQ ID NO: 545199 - RNA, 21 nt, Human
ccccagcacccugcucaggcc

SEQ ID NO: 545200 - RNA, 21 nt, Human
ccccagccccgagaggcccaa

SEQ ID NO: 545201 - RNA, 24 nt, Human
ccccagccccgagaggcccaagcc

SEQ ID NO: 545202 - RNA, 23 nt, Human
cccccaagcagccacugggaucc

SEQ ID NO: 545203 - RNA, 21 nt, Human
ccccgcagcagcaaaagugag

SEQ ID NO: 545204 - RNA, 20 nt, Human
ccccugggaggccccagccc

SEQ ID NO: 545205 - RNA, 19 nt, Human
cccuccccucccuugccac

SEQ ID NO: 545206 - RNA, 22 nt, Human
cccugcgucgcggccgggaagu

SEQ ID NO: 545207 - RNA, 18 nt, Human
ccuccugcccuccccucc

SEQ ID NO: 545208 - RNA, 23 nt, Human
ccugaagggggaagcgcagggag

SEQ ID NO: 545209 - RNA, 20 nt, Human
cgcaaagaaaaaguaacagu

SEQ ID NO: 545210 - RNA, 23 nt, Human
cgcggccgggaaguuuccgaagc

SEQ ID NO: 545211 - RNA, 25 nt, Human
cggcagcccgcgugagguauugcgc

SEQ ID NO: 545212 - RNA, 22 nt, Human
cgggaccugggcuuggacaacc

SEQ ID NO: 545213 - RNA, 24 nt, Human
cucacaaagagccccagugauccc

SEQ ID NO: 545214 - RNA, 19 nt, Human
cucucgcucugagacccca

SEQ ID NO: 545215 - RNA, 20 nt, Human
cugcaaagacugccagcccu

SEQ ID NO: 545216 - RNA, 22 nt, Human
cugcaccucuggguccccaucc

SEQ ID NO: 545217 - RNA, 23 nt, Human
gaaaaaaaaaaacaaaacagccc

SEQ ID NO: 545218 - RNA, 18 nt, Human
gagggaacccccaccccc

SEQ ID NO: 545219 - RNA, 18 nt, Human
gaugugggcggccacugc

SEQ ID NO: 545220 - RNA, 31 nt, Human
gcacacacaagcacacacacgcacacccgcc

SEQ ID NO: 545221 - RNA, 23 nt, Human
gccgagcuggcugagcacccagg

SEQ ID NO: 545222 - RNA, 20 nt, Human
gcgcuccgcucugcucgguu

SEQ ID NO: 545223 - RNA, 21 nt, Human
gcuuggccccuuccccacccc

SEQ ID NO: 545224 - RNA, 22 nt, Human
ggacacccgugggugggggugg

SEQ ID NO: 545225 - RNA, 21 nt, Human
ggccgggaccugggcuuggac

SEQ ID NO: 545226 - RNA, 19 nt, Human
ggccuagccgagcuggcug

SEQ ID NO: 545227 - RNA, 19 nt, Human
gggaagaggaaaaaaaaaa

SEQ ID NO: 545228 - RNA, 20 nt, Human
gggaaguuuccgaagcucgg

SEQ ID NO: 545229 - RNA, 21 nt, Human
gggaaguuuccgaagcucggg

SEQ ID NO: 545230 - RNA, 21 nt, Human
gggccgggaccugggcuugga

SEQ ID NO: 545231 - RNA, 19 nt, Human
uccccccagcacccugcuc

SEQ ID NO: 545232 - RNA, 23 nt, Human
uccccugggaggccccagccccc

SEQ ID NO: 545233 - RNA, 20 nt, Human
ucccgcaaagaaaaaguaac

SEQ ID NO: 545234 - RNA, 21 nt, Human
ucccuacacgcuggaccacgg

SEQ ID NO: 545235 - RNA, 24 nt, Human
uccgcagcucucgcucugagaccc

SEQ ID NO: 545236 - RNA, 18 nt, Human
ucugcagcuuggccccuu

SEQ ID NO: 545237 - RNA, 26 nt, Human
ucugcagcuuggccccuuccccaccc

SEQ ID NO: 545238 - RNA, 19 nt, Human
ugaaugacugugugugucu

SEQ ID NO: 545239 - RNA, 20 nt, Human
uggauuacaaaaacaaacaa

SEQ ID NO: 545240 - RNA, 21 nt, Human
uggcaaacgccucucccccaa

SEQ ID NO: 545241 - RNA, 20 nt, Human
uggccccuuccccacccccc

SEQ ID NO: 545242 - RNA, 18 nt, Human
ugggaggccccagccccg

SEQ ID NO: 545243 - RNA, 21 nt, Human
uggggcaggggccggccugcc

SEQ ID NO: 545244 - RNA, 22 nt, Human
ugucugcagcuuggccccuucc

SEQ ID NO: 545245 - RNA, 19 nt, Human
uguggccgggaaccugccc

SEQ ID NO: 545246 - RNA, 26 nt, Human
ugugugagcgccgacacgugcgcaca

SEQ ID NO: 545247 - RNA, 21 nt, Human
ugugugucugcagcuuggccc

SEQ ID NO: 545248 - RNA, 21 nt, Human
uucagaaggaacaauuaaaga

SEQ ID NO: 545249 - RNA, 23 nt, Human
uucagaaggaacaauuaaagaaa

SEQ ID NO: 545250 - RNA, 20 nt, Human
uuggccccuuccccaccccc

SEQ ID NO: 545251 - RNA, 24 nt, Human
uugguggagaaacagggaggugac

SEQ ID NO: 545252 - RNA, 22 nt, Human
uuuuuuuuuuuuuuuuuaucuu

SEQ ID NO: 545253 - RNA, 22 nt, Human
aaacucuauuuuaacccccaaa

SEQ ID NO: 545254 - RNA, 22 nt, Human
aaauguaagaaacucuauuuua

SEQ ID NO: 545255 - RNA, 26 nt, Human
agggggaggaaccaggcacugcucca

SEQ ID NO: 545256 - RNA, 21 nt, Human
cacacaccaggagcgcccggc

SEQ ID NO: 545257 - RNA, 18 nt, Human
caggagcgcccggcccag

SEQ ID NO: 545258 - RNA, 22 nt, Human
cccccaaaaaggcuuauaaaaa

SEQ ID NO: 545259 - RNA, 21 nt, Human
ccccugagccaagggggagga

SEQ ID NO: 545260 - RNA, 21 nt, Human
ccccugagccaagggggagga

SEQ ID NO: 545261 - RNA, 19 nt, Human
cccugagccaagggggagg

SEQ ID NO: 545262 - RNA, 21 nt, Human
ccggcccagccuggccccaca

SEQ ID NO: 545263 - RNA, 21 nt, Human
ccugagccaagggggaggaac

SEQ ID NO: 545264 - RNA, 25 nt, Human
cucuauuuuaacccccaaaaaggcu

SEQ ID NO: 545265 - RNA, 25 nt, Human
gcgcccggcccagccuggccccaca

SEQ ID NO: 545266 - RNA, 20 nt, Human
ggcacuguaagagcaagcac

SEQ ID NO: 545267 - RNA, 21 nt, Human
uaaaaaaggucccaaaaaugu

SEQ ID NO: 545268 - RNA, 23 nt, Human
uaaaaaaggucccaaaaauguaa

SEQ ID NO: 545269 - RNA, 18 nt, Human
uauaaaaaaacaaagcua

SEQ ID NO: 545270 - RNA, 25 nt, Human
ucaaaggucccuugucuaccccuga

SEQ ID NO: 545271 - RNA, 20 nt, Human
ucuauuuuaacccccaaaaa

SEQ ID NO: 545272 - RNA, 22 nt, Human
ucuccuguauggcagcagcugg

SEQ ID NO: 545273 - RNA, 23 nt, Human
ugagagucacaguggccacaauc

SEQ ID NO: 545274 - RNA, 22 nt, Human
ugagccaagggggaggaaccag

SEQ ID NO: 545275 - RNA, 26 nt, Human
uguaagaaacucuauuuuaaccccca

SEQ ID NO: 545276 - RNA, 23 nt, Human
aaaacaaaaacguuuagcaaaaa

SEQ ID NO: 545277 - RNA, 19 nt, Human
aaaagaaaugaaaagagac

SEQ ID NO: 545278 - RNA, 22 nt, Human
aaaaggucauauuucauaaaga

SEQ ID NO: 545279 - RNA, 26 nt, Human
aaguagcucuuuaaaauggauccccu

SEQ ID NO: 545280 - RNA, 23 nt, Human
aauaacuggaggauuagaaaaaa

SEQ ID NO: 545281 - RNA, 20 nt, Human
acaaagcagaauaaacguuu

SEQ ID NO: 545282 - RNA, 22 nt, Human
acaacagacaaagcagaauaaa

SEQ ID NO: 545283 - RNA, 19 nt, Human
acagaacaaugaaacaaag

SEQ ID NO: 545284 - RNA, 22 nt, Human
acuuacaucuaauaggucucaa

SEQ ID NO: 545285 - RNA, 21 nt, Human
aguaaaaaacaaaaacguuua

SEQ ID NO: 545286 - RNA, 22 nt, Human
aguaaaaaacaaaaacguuuag

SEQ ID NO: 545287 - RNA, 24 nt, Human
auccagaggucaggugauacagaa

SEQ ID NO: 545288 - RNA, 18 nt, Human
cagagggaaauaaaagaa

SEQ ID NO: 545289 - RNA, 23 nt, Human
caugguaguuaaaagaaaugaaa

SEQ ID NO: 545290 - RNA, 21 nt, Human
cauuccacacaugcuaagcac

SEQ ID NO: 545291 - RNA, 19 nt, Human
ccagggucagaagggaugg

SEQ ID NO: 545292 - RNA, 22 nt, Human
ccuaagacaucuacaaacaaac

SEQ ID NO: 545293 - RNA, 18 nt, Human
cuaaaauucuacaacaga

SEQ ID NO: 545294 - RNA, 23 nt, Human
gaagcuggaauacaaaaagacuu

SEQ ID NO: 545295 - RNA, 24 nt, Human
ggaagccagggucagaagggaugg

SEQ ID NO: 545296 - RNA, 23 nt, Human
ggacugaaacuagagaaaaguaa

SEQ ID NO: 545297 - RNA, 21 nt, Human
uaaaauggaucccugucuaca

SEQ ID NO: 545298 - RNA, 18 nt, Human
uaaauuguuuuacaguug

SEQ ID NO: 545299 - RNA, 19 nt, Human
uaacuggaggauuagaaaa

SEQ ID NO: 545300 - RNA, 20 nt, Human
uaagcuauggcucuuuccuc

SEQ ID NO: 545301 - RNA, 21 nt, Human
uagugacaguaaaaaacaaaa

SEQ ID NO: 545302 - RNA, 20 nt, Human
ucagaauuuuaaaaauuaaa

SEQ ID NO: 545303 - RNA, 22 nt, Human
uccagaggucaggugauacaga

SEQ ID NO: 545304 - RNA, 18 nt, Human
uccucguguaagaaugcc

SEQ ID NO: 545305 - RNA, 22 nt, Human
ucucuaaguagcucuuuaaaau

SEQ ID NO: 545306 - RNA, 18 nt, Human
ucugcucugaguguugcc

SEQ ID NO: 545307 - RNA, 23 nt, Human
ucuuuaaaaaaaaaaaaguuuua

SEQ ID NO: 545308 - RNA, 24 nt, Human
ucuuucuuuaucucucauuccuuc

SEQ ID NO: 545309 - RNA, 19 nt, Human
ugaagaugcaguuauacag

SEQ ID NO: 545310 - RNA, 24 nt, Human
ugacagaacaaugaaacaaagaua

SEQ ID NO: 545311 - RNA, 24 nt, Human
ugacagaacaaugaaacaaagaua

SEQ ID NO: 545312 - RNA, 20 nt, Human
ugacaguaagggagaucugc

SEQ ID NO: 545313 - RNA, 19 nt, Human
ugccaugugggccuuugaa

SEQ ID NO: 545314 - RNA, 19 nt, Human
ugccauuaauagcuuuauc

SEQ ID NO: 545315 - RNA, 24 nt, Human
ugcccuagugacaguaaaaaacaa

SEQ ID NO: 545316 - RNA, 22 nt, Human
ugccuaagacaucuacaaacaa

SEQ ID NO: 545317 - RNA, 23 nt, Human
ugccuaagacaucuacaaacaaa

SEQ ID NO: 545318 - RNA, 19 nt, Human
uggccuuagcucuaaauau

SEQ ID NO: 545319 - RNA, 25 nt, Human
uggccuuagcucuaaauaugaaguu

SEQ ID NO: 545320 - RNA, 21 nt, Human
ugguagguuagaagauuucug

SEQ ID NO: 545321 - RNA, 18 nt, Human
uguaauacccuuguaugg

SEQ ID NO: 545322 - RNA, 23 nt, Human
uuaaaagacauaggucccuggaa

SEQ ID NO: 545323 - RNA, 20 nt, Human
uuccucaguggccuuagcuc

SEQ ID NO: 545324 - RNA, 25 nt, Human
uuggaacuguggaaaauuauuucuc

SEQ ID NO: 545325 - RNA, 19 nt, Human
uuuaaaauggaucccuguc

SEQ ID NO: 545326 - RNA, 23 nt, Human
aaaaaggggcucaaaccaacagg

SEQ ID NO: 545327 - RNA, 22 nt, Human
aaaacacccagagggcaaaaca

SEQ ID NO: 545328 - RNA, 23 nt, Human
aaacaaaaaggggcucaaaccaa

SEQ ID NO: 545329 - RNA, 22 nt, Human
aaacacccagagggcaaaacaa

SEQ ID NO: 545330 - RNA, 23 nt, Human
aaaccaacaggaagucagcccca

SEQ ID NO: 545331 - RNA, 23 nt, Human
aaccgaacucucccacagcagcc

SEQ ID NO: 545332 - RNA, 22 nt, Human
aacucgugcucuccacgcucag

SEQ ID NO: 545333 - RNA, 22 nt, Human
aagcagaagggcacaaacagaa

SEQ ID NO: 545334 - RNA, 23 nt, Human
aagggaaugggggaagcagaagg

SEQ ID NO: 545335 - RNA, 22 nt, Human
aaguacuggagggagaggccgg

SEQ ID NO: 545336 - RNA, 23 nt, Human
aagucagccccaccgcaagccgg

SEQ ID NO: 545337 - RNA, 18 nt, Human
aaugugcuuggagagugu

SEQ ID NO: 545338 - RNA, 25 nt, Human
acccagagggcaaaacaaaaagggg

SEQ ID NO: 545339 - RNA, 21 nt, Human
accgaacucucccacagcagc

SEQ ID NO: 545340 - RNA, 22 nt, Human
accuguuccacccacccuccug

SEQ ID NO: 545341 - RNA, 22 nt, Human
agcagccccggccccgccccuc

SEQ ID NO: 545342 - RNA, 21 nt, Human
aggcaggggaggaaggaggcc

SEQ ID NO: 545343 - RNA, 21 nt, Human
aggcguggaagccaaggcuuc

SEQ ID NO: 545344 - RNA, 20 nt, Human
agggaaugggggaagcagaa

SEQ ID NO: 545345 - RNA, 21 nt, Human
caaagaaaacacccagagggc

SEQ ID NO: 545346 - RNA, 23 nt, Human
caaagaaaacacccagagggcaa

SEQ ID NO: 545347 - RNA, 24 nt, Human
caaccgaacucucccacagcagcc

SEQ ID NO: 545348 - RNA, 23 nt, Human
caagccggacuacaacuaacucg

SEQ ID NO: 545349 - RNA, 20 nt, Human
cacccuccugcgggaccaaa

SEQ ID NO: 545350 - RNA, 18 nt, Human
caccuguuccacccaccc

SEQ ID NO: 545351 - RNA, 21 nt, Human
caccuguuccacccacccucc

SEQ ID NO: 545352 - RNA, 19 nt, Human
cagaaguacuggagggaga

SEQ ID NO: 545353 - RNA, 22 nt, Human
cagcaaccgaacucucccacag

SEQ ID NO: 545354 - RNA, 19 nt, Human
ccaccuguuccacccaccc

SEQ ID NO: 545355 - RNA, 19 nt, Human
ccagagggcaaaacaaaaa

SEQ ID NO: 545356 - RNA, 19 nt, Human
ccagagggcaaaacaaaaa

SEQ ID NO: 545357 - RNA, 26 nt, Human
ccaggccaagcaggaugacagcaaac

SEQ ID NO: 545358 - RNA, 21 nt, Human
ccaggccuggccaggccaagc

SEQ ID NO: 545359 - RNA, 19 nt, Human
cccacagcagccccggccc

SEQ ID NO: 545360 - RNA, 23 nt, Human
cccacagcagccccggccccgcc

SEQ ID NO: 545361 - RNA, 22 nt, Human
cccacagucaacgugcaggccc

SEQ ID NO: 545362 - RNA, 23 nt, Human
ccccaccgcaagccggacuacaa

SEQ ID NO: 545363 - RNA, 25 nt, Human
ccccgccccucauaccgcggccgga

SEQ ID NO: 545364 - RNA, 22 nt, Human
cccgccccucauaccgcggccg

SEQ ID NO: 545365 - RNA, 18 nt, Human
cccggccccgccccucau

SEQ ID NO: 545366 - RNA, 19 nt, Human
ccggccccgccccucauac

SEQ ID NO: 545367 - RNA, 23 nt, Human
ccucaagagaaacuccaguccac

SEQ ID NO: 545368 - RNA, 19 nt, Human
cgaacucucccacagcagc

SEQ ID NO: 545369 - RNA, 18 nt, Human
cgagaugacgagcuauga

SEQ ID NO: 545370 - RNA, 23 nt, Human
cgcagcaaccgaacucucccaca

SEQ ID NO: 545371 - RNA, 20 nt, Human
cgggaccaaagaaaacaccc

SEQ ID NO: 545372 - RNA, 21 nt, Human
gaagcagcaggcacgugccag

SEQ ID NO: 545373 - RNA, 18 nt, Human
gaagccagcugcaggcag

SEQ ID NO: 545374 - RNA, 25 nt, Human
gaagggaaugggggaagcagaaggg

SEQ ID NO: 545375 - RNA, 25 nt, Human
gagaugacgagcuaugagcuguggg

SEQ ID NO: 545376 - RNA, 21 nt, Human
gagggagaggccgggcucuca

SEQ ID NO: 545377 - RNA, 24 nt, Human
gcaaaacaaaaaggggcucaaacc

SEQ ID NO: 545378 - RNA, 19 nt, Human
gcagccccggccccgcccc

SEQ ID NO: 545379 - RNA, 18 nt, Human
gcaggccccgccgcagca

SEQ ID NO: 545380 - RNA, 24 nt, Human
gcuuguuuccgaguuucccacagu

SEQ ID NO: 545381 - RNA, 21 nt, Human
ggaccaaagaaaacacccaga

SEQ ID NO: 545382 - RNA, 23 nt, Human
ggagggagaggccgggcucucag

SEQ ID NO: 545383 - RNA, 19 nt, Human
ggcaaaacaaaaaggggcu

SEQ ID NO: 545384 - RNA, 20 nt, Human
gggaagcagaagggcacaaa

SEQ ID NO: 545385 - RNA, 23 nt, Human
uccacccacccuccugcgggacc

SEQ ID NO: 545386 - RNA, 18 nt, Human
ugccaggccuggccaggc

SEQ ID NO: 545387 - RNA, 21 nt, Human
ugccaggccuggccaggccaa

SEQ ID NO: 545388 - RNA, 25 nt, Human
ugcuuggagaguguggacaagggcc

SEQ ID NO: 545389 - RNA, 18 nt, Human
uguggaagggaauggggg

SEQ ID NO: 545390 - RNA, 25 nt, Human
uguuccacccacccuccugcgggac

SEQ ID NO: 545391 - RNA, 20 nt, Human
uugcuagaagguuucccaca

SEQ ID NO: 545392 - RNA, 18 nt, Human
uuggagaguguggacaag

SEQ ID NO: 545393 - RNA, 18 nt, Human
aaaacaugaggcccuccc

SEQ ID NO: 545394 - RNA, 21 nt, Human
aaacaugaggcccucccagga

SEQ ID NO: 545395 - RNA, 23 nt, Human
aaacaugaggcccucccaggaaa

SEQ ID NO: 545396 - RNA, 18 nt, Human
aggccaggcuuagcggga

SEQ ID NO: 545397 - RNA, 22 nt, Human
caaagugggaccucgcuccauu

SEQ ID NO: 545398 - RNA, 24 nt, Human
ccaggccaggcuuagcgggaaacg

SEQ ID NO: 545399 - RNA, 27 nt, Human
ccucgcuccauuugcccaggccaggcu

SEQ ID NO: 545400 - RNA, 22 nt, Human
ggauggacgcacugccuacaag

SEQ ID NO: 545401 - RNA, 23 nt, Human
ggccaggcuuagcgggaaacggg

SEQ ID NO: 545402 - RNA, 21 nt, Human
ggggcccaaagcgcugcaugg

SEQ ID NO: 545403 - RNA, 23 nt, Human
uaacaaacauuuaagaaccagau

SEQ ID NO: 545404 - RNA, 18 nt, Human
uaccucaguuuuauuuuc

SEQ ID NO: 545405 - RNA, 19 nt, Human
uaccucaguuuuauuuucu

SEQ ID NO: 545406 - RNA, 23 nt, Human
uaccucaguuuuauuuucuguag

SEQ ID NO: 545407 - RNA, 24 nt, Human
uaccucaguuuuauuuucuguagu

SEQ ID NO: 545408 - RNA, 24 nt, Human
ugcccaggccaggcuuagcgggaa

SEQ ID NO: 545409 - RNA, 18 nt, Human
ugcccuagggaaggaugg

SEQ ID NO: 545410 - RNA, 21 nt, Human
acacugagggagcugaggagc

SEQ ID NO: 545411 - RNA, 20 nt, Human
acuucuuuauuggaaaagaa

SEQ ID NO: 545412 - RNA, 23 nt, Human
agcggcggcggcggcggcggcgg

SEQ ID NO: 545413 - RNA, 22 nt, Human
cacaaugcaggcgcuccagcuc

SEQ ID NO: 545414 - RNA, 23 nt, Human
cagcgacagcggcagcggcagcg

SEQ ID NO: 545415 - RNA, 19 nt, Human
cagcggcagcggcagcggc

SEQ ID NO: 545416 - RNA, 28 nt, Human
cggcgacagcgacagcggcagcggcagg

SEQ ID NO: 545417 - RNA, 21 nt, Human
cggcggcgacagcgacagcgg

SEQ ID NO: 545418 - RNA, 20 nt, Human
cggcggcggcggcgggcggc

SEQ ID NO: 545419 - RNA, 20 nt, Human
cgggcggcggcggcggcgac

SEQ ID NO: 545420 - RNA, 18 nt, Human
cggugacaccacggggca

SEQ ID NO: 545421 - RNA, 22 nt, Human
cuccagcucugacacgugcacu

SEQ ID NO: 545422 - RNA, 19 nt, Human
cugccguccuccucccagc

SEQ ID NO: 545423 - RNA, 20 nt, Human
gacagcgacagcggcagcgg

SEQ ID NO: 545424 - RNA, 26 nt, Human
gagccggggccgcgcagccuccugga

SEQ ID NO: 545425 - RNA, 22 nt, Human
gcagcggcggcggcggcggcuu

SEQ ID NO: 545426 - RNA, 23 nt, Human
gcggcggcgacagcgacagcggc

SEQ ID NO: 545427 - RNA, 20 nt, Human
gcggcggcggcggcggcggc

SEQ ID NO: 545428 - RNA, 20 nt, Human
gcggcggcggcggcggcggc

SEQ ID NO: 545429 - RNA, 20 nt, Human
gcggcggcggcggcggcggc

SEQ ID NO: 545430 - RNA, 23 nt, Human
gcggcggcggcggcggcggcggc

SEQ ID NO: 545431 - RNA, 23 nt, Human
gcggcggcggcggcggcggcggc

SEQ ID NO: 545432 - RNA, 21 nt, Human
gcggcggcggcggcggcgggc

SEQ ID NO: 545433 - RNA, 24 nt, Human
gcggcggcggcggcgggcggcggc

SEQ ID NO: 545434 - RNA, 24 nt, Human
gcggcggcgggcggcggcggcggc

SEQ ID NO: 545435 - RNA, 23 nt, Human
ggcagcggcggcggcggcggcgg

SEQ ID NO: 545436 - RNA, 18 nt, Human
ggcggcggcggcggcgac

SEQ ID NO: 545437 - RNA, 23 nt, Human
ggcggcggcggcggcggcggcgg

SEQ ID NO: 545438 - RNA, 23 nt, Human
ggcggcggcggcggcggcggcgg

SEQ ID NO: 545439 - RNA, 24 nt, Human
ggcggcggcgggcggcggcggcgg

SEQ ID NO: 545440 - RNA, 22 nt, Human
gggcaggacacgagcagcugcc

SEQ ID NO: 545441 - RNA, 21 nt, Human
gggcggcggcggcggcgacag

SEQ ID NO: 545442 - RNA, 23 nt, Human
gggcggcggcggcggcgacagcg

SEQ ID NO: 545443 - RNA, 24 nt, Human
ggucgcaggggagcgggugccugg

SEQ ID NO: 545444 - RNA, 24 nt, Human
ucgcaggggagcgggugccuggag

SEQ ID NO: 545445 - RNA, 20 nt, Human
ugacaccacggggcacacug

SEQ ID NO: 545446 - RNA, 21 nt, Human
ugccuggagucccggugacac

SEQ ID NO: 545447 - RNA, 18 nt, Human
uggagucccggugacacc

SEQ ID NO: 545448 - RNA, 19 nt, Human
uggucgcaggggagcgggu

SEQ ID NO: 545449 - RNA, 20 nt, Human
uggucgcaggggagcgggug

SEQ ID NO: 545450 - RNA, 20 nt, Human
aaaaaaaacagucugaagua

SEQ ID NO: 545451 - RNA, 24 nt, Human
acaaaucacugguggaaaggagca

SEQ ID NO: 545452 - RNA, 22 nt, Human
acacugguguuuagcugcaggc

SEQ ID NO: 545453 - RNA, 20 nt, Human
acagcagggaugacuucagc

SEQ ID NO: 545454 - RNA, 21 nt, Human
aggggagugaaguaacacugg

SEQ ID NO: 545455 - RNA, 20 nt, Human
cagcaggacuuucuugcuaa

SEQ ID NO: 545456 - RNA, 20 nt, Human
caggcuuucaacagcucaca

SEQ ID NO: 545457 - RNA, 22 nt, Human
ccacaaaggggagugaaguaac

SEQ ID NO: 545458 - RNA, 21 nt, Human
ccuugguguccacaaagggga

SEQ ID NO: 545459 - RNA, 22 nt, Human
cugcaggcuuucaacagcucac

SEQ ID NO: 545460 - RNA, 23 nt, Human
ggaaaggagcaggacauacccuc

SEQ ID NO: 545461 - RNA, 23 nt, Human
uaaaaaaaacagucugaaguauu

SEQ ID NO: 545462 - RNA, 18 nt, Human
uauuguacaauauaagug

SEQ ID NO: 545463 - RNA, 20 nt, Human
uccacaaaggggagugaagu

SEQ ID NO: 545464 - RNA, 20 nt, Human
ucuccugauacagcagggau

SEQ ID NO: 545465 - RNA, 22 nt, Human
ugcaggcuuucaacagcucaca

SEQ ID NO: 545466 - RNA, 25 nt, Human
uuaccguauucuucuuccccuuggu

SEQ ID NO: 545467 - RNA, 20 nt, Human
aaaacauacauaugugaauu

SEQ ID NO: 545468 - RNA, 18 nt, Human
aaacgugucuggucuggg

SEQ ID NO: 545469 - RNA, 20 nt, Human
accagacaucaggaauuuuu

SEQ ID NO: 545470 - RNA, 23 nt, Human
accccaccccccucccgcccccu

SEQ ID NO: 545471 - RNA, 20 nt, Human
accccccucccgcccccucc

SEQ ID NO: 545472 - RNA, 19 nt, Human
agcaaagcggagagaggca

SEQ ID NO: 545473 - RNA, 18 nt, Human
aggaauuuuuuuucuuuc

SEQ ID NO: 545474 - RNA, 26 nt, Human
aggauaccccaccccccucccgcccc

SEQ ID NO: 545475 - RNA, 26 nt, Human
aggcagaagcacuagaaucauggagg

SEQ ID NO: 545476 - RNA, 28 nt, Human
caaauuacugaaacacugugauacugaa

SEQ ID NO: 545477 - RNA, 18 nt, Human
caaguuauaaaaaugcaa

SEQ ID NO: 545478 - RNA, 19 nt, Human
cacaggggacccagacccc

SEQ ID NO: 545479 - RNA, 19 nt, Human
cacccagaacccuuacaaa

SEQ ID NO: 545480 - RNA, 24 nt, Human
caccucagccucccaaguagcugg

SEQ ID NO: 545481 - RNA, 19 nt, Human
caggaauuuuuuuucuuuc

SEQ ID NO: 545482 - RNA, 20 nt, Human
caggauaccccaccccccuc

SEQ ID NO: 545483 - RNA, 20 nt, Human
cauuccccaauccaccgggg

SEQ ID NO: 545484 - RNA, 23 nt, Human
ccagacauuccccaauccaccgg

SEQ ID NO: 545485 - RNA, 19 nt, Human
cccaaguagcugggauuaa

SEQ ID NO: 545486 - RNA, 20 nt, Human
cccaccucagccucccaagu

SEQ ID NO: 545487 - RNA, 23 nt, Human
cccaccucagccucccaaguagc

SEQ ID NO: 545488 - RNA, 25 nt, Human
cccagccugggccgccucccgggcc

SEQ ID NO: 545489 - RNA, 19 nt, Human
cccagguccggaccuggag

SEQ ID NO: 545490 - RNA, 21 nt, Human
ccccaccccccucccgccccc

SEQ ID NO: 545491 - RNA, 25 nt, Human
ccccaccccccucccgcccccuccc

SEQ ID NO: 545492 - RNA, 22 nt, Human
cccgcggaggccgaggagcagc

SEQ ID NO: 545493 - RNA, 20 nt, Human
cccuuacaaacuugggucgg

SEQ ID NO: 545494 - RNA, 23 nt, Human
ccuagaaccccagcugcgcgcuc

SEQ ID NO: 545495 - RNA, 21 nt, Human
ccucaggagcgggagaaggcc

SEQ ID NO: 545496 - RNA, 26 nt, Human
ccucccaccucagccucccaaguagc

SEQ ID NO: 545497 - RNA, 24 nt, Human
ccucccgcccccuccccuccgcga

SEQ ID NO: 545498 - RNA, 22 nt, Human
ccucgcuuccgcggcggcggcg

SEQ ID NO: 545499 - RNA, 22 nt, Human
ccuuacaaacuugggucggggc

SEQ ID NO: 545500 - RNA, 22 nt, Human
cgcggaggccgaggagcagcaa

SEQ ID NO: 545501 - RNA, 18 nt, Human
cuagggccuuccagacuc

SEQ ID NO: 545502 - RNA, 21 nt, Human
cuaugggucuucugggggccu

SEQ ID NO: 545503 - RNA, 24 nt, Human
cucaaguuauccucccaccucagc

SEQ ID NO: 545504 - RNA, 23 nt, Human
cucagccucccaaguagcuggga

SEQ ID NO: 545505 - RNA, 18 nt, Human
cucgcuuccgcggcggcg

SEQ ID NO: 545506 - RNA, 19 nt, Human
cugaggaaaagccagacau

SEQ ID NO: 545507 - RNA, 23 nt, Human
cuggcgccgcucuagggccuucc

SEQ ID NO: 545508 - RNA, 18 nt, Human
cuggucugggcaaguugu

SEQ ID NO: 545509 - RNA, 21 nt, Human
gaaacacugugauacugaaau

SEQ ID NO: 545510 - RNA, 19 nt, Human
gaacaagagcuguggucuc

SEQ ID NO: 545511 - RNA, 22 nt, Human
gacacaggggacccagacccca

SEQ ID NO: 545512 - RNA, 21 nt, Human
gacucaggauaccccaccccc

SEQ ID NO: 545513 - RNA, 24 nt, Human
gacucaggauaccccaccccccuc

SEQ ID NO: 545514 - RNA, 21 nt, Human
gacuuguagaccucaggccuc

SEQ ID NO: 545515 - RNA, 19 nt, Human
gcgcuccugggcgggugcc

SEQ ID NO: 545516 - RNA, 19 nt, Human
gcgggcgggggcgacacag

SEQ ID NO: 545517 - RNA, 24 nt, Human
gcuauauugcccacgcuggucuug

SEQ ID NO: 545518 - RNA, 19 nt, Human
ggaccuggagcaaagggcg

SEQ ID NO: 545519 - RNA, 21 nt, Human
ggcucaaagcugaaugugaca

SEQ ID NO: 545520 - RNA, 18 nt, Human
ggucuugaacuccugugc

SEQ ID NO: 545521 - RNA, 20 nt, Human
guauacgucccuagaacccc

SEQ ID NO: 545522 - RNA, 24 nt, Human
uaaaaaaaaacauacauaugugaa

SEQ ID NO: 545523 - RNA, 25 nt, Human
uaaaaaaaauucacuaaaaaauuag

SEQ ID NO: 545524 - RNA, 25 nt, Human
uaaaacccaacaaaucuuuuaguua

SEQ ID NO: 545525 - RNA, 21 nt, Human
uaaaauaacuauacuuuauuc

SEQ ID NO: 545526 - RNA, 23 nt, Human
uaagcugaggaaaagccagacau

SEQ ID NO: 545527 - RNA, 22 nt, Human
uacuuuuuugggguguggaggg

SEQ ID NO: 545528 - RNA, 18 nt, Human
uagaaucauggaggcaaa

SEQ ID NO: 545529 - RNA, 19 nt, Human
uagauucuggacuccaucc

SEQ ID NO: 545530 - RNA, 23 nt, Human
uaguaauucaaaccaaaacaugc

SEQ ID NO: 545531 - RNA, 20 nt, Human
uauauugcccacgcuggucu

SEQ ID NO: 545532 - RNA, 24 nt, Human
uauauugcccacgcuggucuugaa

SEQ ID NO: 545533 - RNA, 23 nt, Human
uauccucccaccucagccuccca

SEQ ID NO: 545534 - RNA, 23 nt, Human
ucaaaccaaaacaugcuguaagu

SEQ ID NO: 545535 - RNA, 21 nt, Human
ucaaugacauguuauuuuuaa

SEQ ID NO: 545536 - RNA, 20 nt, Human
ucagccucccaaguagcugg

SEQ ID NO: 545537 - RNA, 21 nt, Human
ucagcgugcacccagaacccu

SEQ ID NO: 545538 - RNA, 24 nt, Human
ucccaaguagcugggauuaaaggu

SEQ ID NO: 545539 - RNA, 22 nt, Human
ucccgcccccuccccuccgcga

SEQ ID NO: 545540 - RNA, 18 nt, Human
ucccuagaaccccagcug

SEQ ID NO: 545541 - RNA, 20 nt, Human
ucccuagaaccccagcugcg

SEQ ID NO: 545542 - RNA, 21 nt, Human
ucccuagaaccccagcugcgc

SEQ ID NO: 545543 - RNA, 25 nt, Human
uccgcgaucucccuccggccucuuc

SEQ ID NO: 545544 - RNA, 18 nt, Human
uccggaccacggacgacu

SEQ ID NO: 545545 - RNA, 22 nt, Human
ucggggcugcauucugggcuuu

SEQ ID NO: 545546 - RNA, 21 nt, Human
ucugauuuucaauacuguauu

SEQ ID NO: 545547 - RNA, 22 nt, Human
ucuguagauucuggacuccauc

SEQ ID NO: 545548 - RNA, 23 nt, Human
ucuguagauucuggacuccaucc

SEQ ID NO: 545549 - RNA, 21 nt, Human
ucuugaacuccugugcucaag

SEQ ID NO: 545550 - RNA, 23 nt, Human
ucuugcuauauugcccacgcugg

SEQ ID NO: 545551 - RNA, 24 nt, Human
ucuugcuauauugcccacgcuggu

SEQ ID NO: 545552 - RNA, 20 nt, Human
ugaaaagagaucuaaaaccu

SEQ ID NO: 545553 - RNA, 22 nt, Human
ugaaauacugcuggcuucugga

SEQ ID NO: 545554 - RNA, 22 nt, Human
ugaggaaaagccagacauuccc

SEQ ID NO: 545555 - RNA, 23 nt, Human
ugaggaaaagccagacauucccc

SEQ ID NO: 545556 - RNA, 24 nt, Human
ugcccacgcuggucuugaacuccu

SEQ ID NO: 545557 - RNA, 21 nt, Human
uggaccagacaucaggaauuu

SEQ ID NO: 545558 - RNA, 21 nt, Human
uggaggcaaauuacugaaaca

SEQ ID NO: 545559 - RNA, 23 nt, Human
uggcucaaagcugaaugugacaa

SEQ ID NO: 545560 - RNA, 19 nt, Human
ugggaaacacgguaaggca

SEQ ID NO: 545561 - RNA, 19 nt, Human
ugggauuaaaggugaacac

SEQ ID NO: 545562 - RNA, 24 nt, Human
ugggauuaaaggugaacaccacca

SEQ ID NO: 545563 - RNA, 20 nt, Human
ugggcaaguuguggcgaggc

SEQ ID NO: 545564 - RNA, 22 nt, Human
ugggcaaguuguggcgaggcga

SEQ ID NO: 545565 - RNA, 18 nt, Human
ugggguguggaggggugg

SEQ ID NO: 545566 - RNA, 23 nt, Human
ugguuccaccaauucaauuuuaa

SEQ ID NO: 545567 - RNA, 21 nt, Human
uguaacuaaauuacuuuugag

SEQ ID NO: 545568 - RNA, 19 nt, Human
uuacaaacuugggucgggg

SEQ ID NO: 545569 - RNA, 22 nt, Human
uuaguugaaaaaaauacacuua

SEQ ID NO: 545570 - RNA, 26 nt, Human
uucacuaaaaaauuaguugaaaaaaa

SEQ ID NO: 545571 - RNA, 23 nt, Human
uuccagacuccggaccacggacg

SEQ ID NO: 545572 - RNA, 18 nt, Human
uugaaucagucucugugu

SEQ ID NO: 545573 - RNA, 27 nt, Human
uugacaaaugaaaagagaucuaaaacc

SEQ ID NO: 545574 - RNA, 18 nt, Human
uugcugugggaaacacgg

SEQ ID NO: 545575 - RNA, 19 nt, Human
auggggcagaggagcaaag

SEQ ID NO: 545576 - RNA, 20 nt, Human
caugcuugccuucucacuua

SEQ ID NO: 545577 - RNA, 21 nt, Human
ccuacgcuggauaaacaagaa

SEQ ID NO: 545578 - RNA, 20 nt, Human
cuuccuacgcuggauaaaca

SEQ ID NO: 545579 - RNA, 29 nt, Human
uaaauagugaauggggcagaggagcaaag

SEQ ID NO: 545580 - RNA, 25 nt, Human
ucgccgggugacuccuuuguugcgc

SEQ ID NO: 545581 - RNA, 26 nt, Human
uucuuuuccuucuuccuacgcuggau

SEQ ID NO: 545582 - RNA, 25 nt, Human
aaaaaaaagcgcauaauuaccaaaa

SEQ ID NO: 545583 - RNA, 23 nt, Human
aaaacaaaacgaaaccaaacaaa

SEQ ID NO: 545584 - RNA, 25 nt, Human
aaaacaaaacgaaaccaaacaaaaa

SEQ ID NO: 545585 - RNA, 22 nt, Human
aaaaggaagaagguaggaagaa

SEQ ID NO: 545586 - RNA, 19 nt, Human
aaacagaaaauaaaagggg

SEQ ID NO: 545587 - RNA, 22 nt, Human
aaacagaaaauaaaagggggac

SEQ ID NO: 545588 - RNA, 22 nt, Human
aaaccaaacaaaacagggcaaa

SEQ ID NO: 545589 - RNA, 22 nt, Human
aaacgaaaccaaacaaaacagg

SEQ ID NO: 545590 - RNA, 21 nt, Human
aaagucacugcuuccuccccc

SEQ ID NO: 545591 - RNA, 20 nt, Human
aaaguuauggggaacugggg

SEQ ID NO: 545592 - RNA, 25 nt, Human
aacaaaacgaaaccaaacaaaacag

SEQ ID NO: 545593 - RNA, 19 nt, Human
aacaggagguggaaggcug

SEQ ID NO: 545594 - RNA, 20 nt, Human
aacaggagguggaaggcugg

SEQ ID NO: 545595 - RNA, 27 nt, Human
aaccuccccuucuucccucucacccac

SEQ ID NO: 545596 - RNA, 21 nt, Human
aagaaaacaaaacgaaaccaa

SEQ ID NO: 545597 - RNA, 22 nt, Human
aagccggcaggggccuccggga

SEQ ID NO: 545598 - RNA, 24 nt, Human
acaaaacgaaaccaaacaaaacag

SEQ ID NO: 545599 - RNA, 23 nt, Human
acaguaaaaagacaaauucuaaa

SEQ ID NO: 545600 - RNA, 21 nt, Human
accccauccccagcaccacgg

SEQ ID NO: 545601 - RNA, 20 nt, Human
accuccccuucuucccucuc

SEQ ID NO: 545602 - RNA, 21 nt, Human
accuccccuucuucccucuca

SEQ ID NO: 545603 - RNA, 23 nt, Human
acgaaaccaaacaaaacagggca

SEQ ID NO: 545604 - RNA, 20 nt, Human
acgggaucuggcgggggcag

SEQ ID NO: 545605 - RNA, 21 nt, Human
agaaaaaaaugccuggcccua

SEQ ID NO: 545606 - RNA, 26 nt, Human
agaaaacaaaacgaaaccaaacaaaa

SEQ ID NO: 545607 - RNA, 21 nt, Human
agacaguaaaacagcuccugg

SEQ ID NO: 545608 - RNA, 21 nt, Human
agccccucagaggggaggcag

SEQ ID NO: 545609 - RNA, 19 nt, Human
aggaaaagcuuuugggucu

SEQ ID NO: 545610 - RNA, 21 nt, Human
aggaaagaaaugcuuaucuug

SEQ ID NO: 545611 - RNA, 23 nt, Human
aggaagaacaggagguggaaggc

SEQ ID NO: 545612 - RNA, 20 nt, Human
aggagguggaaggcugggga

SEQ ID NO: 545613 - RNA, 25 nt, Human
aggcgaagggggaaagggggggggc

SEQ ID NO: 545614 - RNA, 19 nt, Human
aggguaucacuguaggaaa

SEQ ID NO: 545615 - RNA, 27 nt, Human
caaaaaaaagucacugcuuccuccccc

SEQ ID NO: 545616 - RNA, 24 nt, Human
caaaacgaaaccaaacaaaacagg

SEQ ID NO: 545617 - RNA, 21 nt, Human
caaaauggccgccgccaccgc

SEQ ID NO: 545618 - RNA, 30 nt, Human
caaagaaaacaaaacgaaaccaaacaaaaa

SEQ ID NO: 545619 - RNA, 23 nt, Human
caaaguuauggggaacuggggca

SEQ ID NO: 545620 - RNA, 26 nt, Human
caacccugcuuccuuccugcuaggag

SEQ ID NO: 545621 - RNA, 22 nt, Human
cacugcuuccucccccucccca

SEQ ID NO: 545622 - RNA, 23 nt, Human
cacugcuuccucccccuccccau

SEQ ID NO: 545623 - RNA, 21 nt, Human
cagaaaaaaaugccuggcccu

SEQ ID NO: 545624 - RNA, 22 nt, Human
cagaaaaaaaugccuggcccua

SEQ ID NO: 545625 - RNA, 21 nt, Human
cagaagcuugugugcaaaguu

SEQ ID NO: 545626 - RNA, 22 nt, Human
cagcaccacgggaucuggcggg

SEQ ID NO: 545627 - RNA, 22 nt, Human
ccaaaaaaaagucacugcuucc

SEQ ID NO: 545628 - RNA, 24 nt, Human
ccaaccuccccuucuucccucuca

SEQ ID NO: 545629 - RNA, 24 nt, Human
ccaauggcggcagcggcucaaaau

SEQ ID NO: 545630 - RNA, 19 nt, Human
ccaguccagacaccccgcc

SEQ ID NO: 545631 - RNA, 18 nt, Human
cccacccacaguaaaaag

SEQ ID NO: 545632 - RNA, 24 nt, Human
cccagcaccacgggaucuggcggg

SEQ ID NO: 545633 - RNA, 20 nt, Human
ccccaaccuccccuucuucc

SEQ ID NO: 545634 - RNA, 22 nt, Human
ccccaaccuccccuucuucccu

SEQ ID NO: 545635 - RNA, 21 nt, Human
cccccgagcccggcccggccu

SEQ ID NO: 545636 - RNA, 24 nt, Human
cccccgagcccggcccggccuccc

SEQ ID NO: 545637 - RNA, 19 nt, Human
ccccgagcccggcccggcc

SEQ ID NO: 545638 - RNA, 22 nt, Human
ccccgccccucgcccacguccg

SEQ ID NO: 545639 - RNA, 27 nt, Human
ccccgggguggcccccgagcccggccc

SEQ ID NO: 545640 - RNA, 21 nt, Human
ccccuucuucccucucaccca

SEQ ID NO: 545641 - RNA, 21 nt, Human
cccggcccggccucccagggc

SEQ ID NO: 545642 - RNA, 23 nt, Human
cccuccccauuuugcuuuuuaaa

SEQ ID NO: 545643 - RNA, 18 nt, Human
cccuucuucccucucacc

SEQ ID NO: 545644 - RNA, 19 nt, Human
ccgccaccgccuccccccu

SEQ ID NO: 545645 - RNA, 21 nt, Human
ccgccaccgccuccccccuca

SEQ ID NO: 545646 - RNA, 26 nt, Human
ccucgcccacguccgacuuccucucu

SEQ ID NO: 545647 - RNA, 18 nt, Human
ccuggcccuauggagggg

SEQ ID NO: 545648 - RNA, 26 nt, Human
cgcauaauuaccaaaaaaaagucacu

SEQ ID NO: 545649 - RNA, 26 nt, Human
cgggggcagaggaggggccgaggcag

SEQ ID NO: 545650 - RNA, 19 nt, Human
cucccccuccccauuuugc

SEQ ID NO: 545651 - RNA, 24 nt, Human
gaaaaaaaugccuggcccuaugga

SEQ ID NO: 545652 - RNA, 23 nt, Human
gaaaccaaacaaaacagggcaaa

SEQ ID NO: 545653 - RNA, 18 nt, Human
gaagcugaggggcuggag

SEQ ID NO: 545654 - RNA, 22 nt, Human
gaaggcuggggagguggggaca

SEQ ID NO: 545655 - RNA, 18 nt, Human
gagccucugggucacacu

SEQ ID NO: 545656 - RNA, 22 nt, Human
gaggggcuggagcaggguuggg

SEQ ID NO: 545657 - RNA, 18 nt, Human
gagguggaaggcugggga

SEQ ID NO: 545658 - RNA, 21 nt, Human
gcagaggaggggccgaggcag

SEQ ID NO: 545659 - RNA, 18 nt, Human
gcagcccugggaugaccc

SEQ ID NO: 545660 - RNA, 18 nt, Human
gcuuuugggucuggcacc

SEQ ID NO: 545661 - RNA, 22 nt, Human
ggaagccggcaggggccuccgg

SEQ ID NO: 545662 - RNA, 18 nt, Human
ggagaccacuggagagga

SEQ ID NO: 545663 - RNA, 20 nt, Human
ggagguggaaggcuggggag

SEQ ID NO: 545664 - RNA, 19 nt, Human
ggcagaggaggggccgagg

SEQ ID NO: 545665 - RNA, 19 nt, Human
ggcccagagguuccagucc

SEQ ID NO: 545666 - RNA, 21 nt, Human
ggccgaggcaggcgcuggugg

SEQ ID NO: 545667 - RNA, 22 nt, Human
ggcgggggcagaggaggggccg

SEQ ID NO: 545668 - RNA, 19 nt, Human
gggaagcugaggggcugga

SEQ ID NO: 545669 - RNA, 23 nt, Human
gggaggcagcccugggaugaccc

SEQ ID NO: 545670 - RNA, 21 nt, Human
gggaggcagugggcuggaggg

SEQ ID NO: 545671 - RNA, 21 nt, Human
gggcagaggaggggccgaggc

SEQ ID NO: 545672 - RNA, 23 nt, Human
gggcagaggaggggccgaggcag

SEQ ID NO: 545673 - RNA, 26 nt, Human
gggccgaggcaggcgcugguggagga

SEQ ID NO: 545674 - RNA, 22 nt, Human
ggggaggcagugggcuggaggg

SEQ ID NO: 545675 - RNA, 21 nt, Human
ggggagguggggacaaacaga

SEQ ID NO: 545676 - RNA, 20 nt, Human
ggggcuggagcaggguuggg

SEQ ID NO: 545677 - RNA, 24 nt, Human
gucacugcuuccucccccucccca

SEQ ID NO: 545678 - RNA, 19 nt, Human
gucuggcaccugggagacc

SEQ ID NO: 545679 - RNA, 18 nt, Human
guuguguuuuguuuugug

SEQ ID NO: 545680 - RNA, 26 nt, Human
guuuuguuuuguggcucuuccucagu

SEQ ID NO: 545681 - RNA, 26 nt, Human
uaaaaaaaagcgcauaauuaccaaaa

SEQ ID NO: 545682 - RNA, 19 nt, Human
uaaaacagcuccugggaga

SEQ ID NO: 545683 - RNA, 20 nt, Human
uacaaccaacugcaugaggg

SEQ ID NO: 545684 - RNA, 23 nt, Human
uaccaaaaaaaagucacugcuuc

SEQ ID NO: 545685 - RNA, 24 nt, Human
uaccaaaaaaaagucacugcuucc

SEQ ID NO: 545686 - RNA, 21 nt, Human
uaccaagacgcccggaauaaa

SEQ ID NO: 545687 - RNA, 22 nt, Human
uaggaaaagcuuuugggucugg

SEQ ID NO: 545688 - RNA, 24 nt, Human
uaugaucaagggagguggggauua

SEQ ID NO: 545689 - RNA, 25 nt, Human
uaugaucaagggagguggggauuau

SEQ ID NO: 545690 - RNA, 19 nt, Human
ucacccacugaaucccacc

SEQ ID NO: 545691 - RNA, 26 nt, Human
ucacugcuuccucccccuccccauuu

SEQ ID NO: 545692 - RNA, 23 nt, Human
ucacuguaggaaaagcuuuuggg

SEQ ID NO: 545693 - RNA, 21 nt, Human
ucaggaaagaaaugcuuaucu

SEQ ID NO: 545694 - RNA, 21 nt, Human
uccagaaaaaaaugccuggcc

SEQ ID NO: 545695 - RNA, 19 nt, Human
uccagacaccccgccccuc

SEQ ID NO: 545696 - RNA, 23 nt, Human
ucccccuuaaaccuuuccuguca

SEQ ID NO: 545697 - RNA, 25 nt, Human
uccgggagccucugggucacacugg

SEQ ID NO: 545698 - RNA, 24 nt, Human
ucucacccacugaaucccaccaga

SEQ ID NO: 545699 - RNA, 19 nt, Human
ucuucccucucacccacug

SEQ ID NO: 545700 - RNA, 18 nt, Human
ucuugaugaaauaucaac

SEQ ID NO: 545701 - RNA, 21 nt, Human
ugaaauaucaacagcccaccc

SEQ ID NO: 545702 - RNA, 19 nt, Human
ugaccccauccccagcacc

SEQ ID NO: 545703 - RNA, 18 nt, Human
uggagcaggguugggaga

SEQ ID NO: 545704 - RNA, 19 nt, Human
uggaggaagccggcagggg

SEQ ID NO: 545705 - RNA, 19 nt, Human
uggcccccgagcccggccc

SEQ ID NO: 545706 - RNA, 19 nt, Human
ugggaagcugaggggcugg

SEQ ID NO: 545707 - RNA, 21 nt, Human
ugggaagcugaggggcuggag

SEQ ID NO: 545708 - RNA, 18 nt, Human
ugggcuggagggaggcag

SEQ ID NO: 545709 - RNA, 19 nt, Human
ugggcuggagggaggcagc

SEQ ID NO: 545710 - RNA, 19 nt, Human
uguuuuguggcucuuccuc

SEQ ID NO: 545711 - RNA, 24 nt, Human
uuaccaaaaaaaagucacugcuuc

SEQ ID NO: 545712 - RNA, 18 nt, Human
uuagucaaaaaggaagaa

SEQ ID NO: 545713 - RNA, 25 nt, Human
uuagucaaaaaggaagaagguagga

SEQ ID NO: 545714 - RNA, 24 nt, Human
uucaaagaaaacaaaacgaaacca

SEQ ID NO: 545715 - RNA, 27 nt, Human
uuuauucaaagaaaacaaaacgaaacc

SEQ ID NO: 545716 - RNA, 24 nt, Human
uuuuguuguguuuuguuuuguggc

SEQ ID NO: 545717 - RNA, 20 nt, Human
acccuccccgaccccagcca

SEQ ID NO: 545718 - RNA, 22 nt, Human
agaaaaacaaauccagguccca

SEQ ID NO: 545719 - RNA, 21 nt, Human
aggggacaggagagguugggg

SEQ ID NO: 545720 - RNA, 22 nt, Human
agguuggggucacgguggaagg

SEQ ID NO: 545721 - RNA, 19 nt, Human
agugcccccuguacccucc

SEQ ID NO: 545722 - RNA, 21 nt, Human
caaauccaggucccagugccc

SEQ ID NO: 545723 - RNA, 22 nt, Human
caggagagguuggggucacggu

SEQ ID NO: 545724 - RNA, 23 nt, Human
caggagagguuggggucacggug

SEQ ID NO: 545725 - RNA, 22 nt, Human
cccagugcccccuguacccucc

SEQ ID NO: 545726 - RNA, 23 nt, Human
ccuguacccuccccgaccccagc

SEQ ID NO: 545727 - RNA, 25 nt, Human
ccuguacccuccccgaccccagcca

SEQ ID NO: 545728 - RNA, 18 nt, Human
cggguccccccggccccc

SEQ ID NO: 545729 - RNA, 18 nt, Human
ggccgggggcgggucccc

SEQ ID NO: 545730 - RNA, 18 nt, Human
ggcugcggccggccgggg

SEQ ID NO: 545731 - RNA, 19 nt, Human
gggacaggagagguugggg

SEQ ID NO: 545732 - RNA, 20 nt, Human
guccccccggcccccuuccu

SEQ ID NO: 545733 - RNA, 19 nt, Human
uagagacagaguuggaggg

SEQ ID NO: 545734 - RNA, 26 nt, Human
ucccagugcccccuguacccuccccg

SEQ ID NO: 545735 - RNA, 18 nt, Human
uccccccggcccccuucc

SEQ ID NO: 545736 - RNA, 21 nt, Human
uggggucacgguggaaggagg

SEQ ID NO: 545737 - RNA, 19 nt, Human
aacagaucuuuccuauaac

SEQ ID NO: 545738 - RNA, 27 nt, Human
aagaagaaaaaacggaaggauucacaa

SEQ ID NO: 545739 - RNA, 19 nt, Human
agaaaaaacggaaggauuc

SEQ ID NO: 545740 - RNA, 23 nt, Human
agaaggacauacagaaauacagg

SEQ ID NO: 545741 - RNA, 24 nt, Human
aggcauuggcacauuuuaaaaaca

SEQ ID NO: 545742 - RNA, 24 nt, Human
aguaaagaaaguauuagggaagaa

SEQ ID NO: 545743 - RNA, 20 nt, Human
auuagaagaaaaguugaaau

SEQ ID NO: 545744 - RNA, 23 nt, Human
caauuagaagaaaaguugaaauc

SEQ ID NO: 545745 - RNA, 23 nt, Human
cuuaagaagaaaaaacggaagga

SEQ ID NO: 545746 - RNA, 22 nt, Human
gaaaguggaaugucagaaguca

SEQ ID NO: 545747 - RNA, 21 nt, Human
uaaaacagaaggcacuucaca

SEQ ID NO: 545748 - RNA, 22 nt, Human
uaagacaaguaaugaguccuug

SEQ ID NO: 545749 - RNA, 21 nt, Human
uauccucguuuacauccuuca

SEQ ID NO: 545750 - RNA, 25 nt, Human
ugaacuaaaaaagguguuacauuca

SEQ ID NO: 545751 - RNA, 18 nt, Human
ugaugaccuguagugucc

SEQ ID NO: 545752 - RNA, 21 nt, Human
uggcaguaaaaauauaagaca

SEQ ID NO: 545753 - RNA, 21 nt, Human
uggcagugaacgucuguuugg

SEQ ID NO: 545754 - RNA, 18 nt, Human
ugugaaguaaagaaagua

SEQ ID NO: 545755 - RNA, 24 nt, Human
ugugauaaacuuaaagugcuaaaa

SEQ ID NO: 545756 - RNA, 21 nt, Human
uuaagaagaaaaaacggaagg

SEQ ID NO: 545757 - RNA, 22 nt, Human
uucagaaucagugaacuaaaaa

SEQ ID NO: 545758 - RNA, 24 nt, Human
uuuacauccuucacuuuacaagug

SEQ ID NO: 545759 - RNA, 21 nt, Human
uuuccuccuuaagaagaaaaa

SEQ ID NO: 545760 - RNA, 18 nt, Human
uuugggaguggggacguu

SEQ ID NO: 545761 - RNA, 23 nt, Human
uuuuuuuuuuuuuuuaauguuuu

SEQ ID NO: 545762 - RNA, 19 nt, Human
uuuuuuuuuuuuuuuuuaa

SEQ ID NO: 545763 - RNA, 21 nt, Human
aaaaagucucuucuaacccuc

SEQ ID NO: 545764 - RNA, 18 nt, Human
aaagacacuacuggccau

SEQ ID NO: 545765 - RNA, 21 nt, Human
aacuacagaguaaacugaggc

SEQ ID NO: 545766 - RNA, 25 nt, Human
aagacacuacuggccaugaugccgc

SEQ ID NO: 545767 - RNA, 24 nt, Human
aaugugggagcagagcuggagaga

SEQ ID NO: 545768 - RNA, 18 nt, Human
accccuuggacugacuca

SEQ ID NO: 545769 - RNA, 22 nt, Human
agcaaggcugcauacacaaaca

SEQ ID NO: 545770 - RNA, 26 nt, Human
agccacugggcaugccaccccaucag

SEQ ID NO: 545771 - RNA, 22 nt, Human
aggcacagagugguaaaugagu

SEQ ID NO: 545772 - RNA, 22 nt, Human
agguagacagcuuaaaaccaag

SEQ ID NO: 545773 - RNA, 21 nt, Human
auuugaugcguaauucuccac

SEQ ID NO: 545774 - RNA, 23 nt, Human
caaaaaccugaaaggaguuucca

SEQ ID NO: 545775 - RNA, 20 nt, Human
caaagucccucaaggagcuc

SEQ ID NO: 545776 - RNA, 22 nt, Human
cacauuuaugauacuucuacau

SEQ ID NO: 545777 - RNA, 22 nt, Human
cagagcuggagagagggcaagg

SEQ ID NO: 545778 - RNA, 20 nt, Human
cagaguaaacugaggcacag

SEQ ID NO: 545779 - RNA, 25 nt, Human
cagauauauacaaagacaucacaau

SEQ ID NO: 545780 - RNA, 21 nt, Human
cauuucagccugacugucugu

SEQ ID NO: 545781 - RNA, 22 nt, Human
ccacaaagaacuguccauuuca

SEQ ID NO: 545782 - RNA, 22 nt, Human
ccccuuggacugacucaacagc

SEQ ID NO: 545783 - RNA, 20 nt, Human
ccucaaagacacuacuggcc

SEQ ID NO: 545784 - RNA, 19 nt, Human
ccuugaagggaaggguaga

SEQ ID NO: 545785 - RNA, 21 nt, Human
cuucauggauaauuuauugcu

SEQ ID NO: 545786 - RNA, 19 nt, Human
cuuggacugacucaacagc

SEQ ID NO: 545787 - RNA, 20 nt, Human
cuuggacugacucaacagca

SEQ ID NO: 545788 - RNA, 27 nt, Human
gaaaaagucucuucuaacccucaucca

SEQ ID NO: 545789 - RNA, 21 nt, Human
gagcuggagagagggcaaggu

SEQ ID NO: 545790 - RNA, 18 nt, Human
gaguuuccaauuaucacc

SEQ ID NO: 545791 - RNA, 22 nt, Human
ggaaggguagaguccacaaaga

SEQ ID NO: 545792 - RNA, 20 nt, Human
uaaacuacagaguaaacuga

SEQ ID NO: 545793 - RNA, 24 nt, Human
uaaguaaucucaacauuauacaga

SEQ ID NO: 545794 - RNA, 19 nt, Human
uacagaguaaacugaggca

SEQ ID NO: 545795 - RNA, 26 nt, Human
uagcacugaaaaccauauuaaaauac

SEQ ID NO: 545796 - RNA, 24 nt, Human
uagguagacagcuuaaaaccaaga

SEQ ID NO: 545797 - RNA, 20 nt, Human
uaugacauacuccuugaagg

SEQ ID NO: 545798 - RNA, 18 nt, Human
uccacaaacauaaaugug

SEQ ID NO: 545799 - RNA, 18 nt, Human
ucuaacccucauccagag

SEQ ID NO: 545800 - RNA, 22 nt, Human
ucuaaguggugaacuccucaaa

SEQ ID NO: 545801 - RNA, 21 nt, Human
ugacugaauucauguuucaca

SEQ ID NO: 545802 - RNA, 21 nt, Human
ugagguagaaacagcuaggua

SEQ ID NO: 545803 - RNA, 22 nt, Human
ugcccccaaagccacugggcau

SEQ ID NO: 545804 - RNA, 18 nt, Human
uggugugaggcacuggga

SEQ ID NO: 545805 - RNA, 18 nt, Human
ugugaggcacugggaugu

SEQ ID NO: 545806 - RNA, 21 nt, Human
uguguacaucuaugcaaugua

SEQ ID NO: 545807 - RNA, 23 nt, Human
uguguacaucuaugcaauguaca

SEQ ID NO: 545808 - RNA, 24 nt, Human
uuacaaaaucuacuugcaaaaacc

SEQ ID NO: 545809 - RNA, 23 nt, Human
uucuccacgaagauauucccaaa

SEQ ID NO: 545810 - RNA, 24 nt, Human
uugcccccaaagccacugggcaug

SEQ ID NO: 545811 - RNA, 26 nt, Human
uuggaaaaagucucuucuaacccuca

SEQ ID NO: 545812 - RNA, 26 nt, Human
uuuccauauauacauuauuuuggcug

SEQ ID NO: 545813 - RNA, 19 nt, Human
accgccucucugcgugcgc

SEQ ID NO: 545814 - RNA, 24 nt, Human
auacauauucacaaaauuuacaca

SEQ ID NO: 545815 - RNA, 22 nt, Human
ccagauaacuacuuccacucac

SEQ ID NO: 545816 - RNA, 24 nt, Human
ccgccguaaagugcgucaccgccu

SEQ ID NO: 545817 - RNA, 22 nt, Human
cgcgggcacgcagugucgcgcg

SEQ ID NO: 545818 - RNA, 23 nt, Human
uacauauucacaaaauuuacaca

SEQ ID NO: 545819 - RNA, 20 nt, Human
uaccauaacuuauacagaga

SEQ ID NO: 545820 - RNA, 21 nt, Human
uauacagagaacaguuuagca

SEQ ID NO: 545821 - RNA, 18 nt, Human
uuccacucacaaugagau

SEQ ID NO: 545822 - RNA, 26 nt, Human
uuuuuuuuuuuuuuuuuuucaauagg

SEQ ID NO: 545823 - RNA, 22 nt, Human
aacaccccaacacaggcccagg

SEQ ID NO: 545824 - RNA, 18 nt, Human
aagcaggaggggacccga

SEQ ID NO: 545825 - RNA, 18 nt, Human
aagcaggaggggacccga

SEQ ID NO: 545826 - RNA, 18 nt, Human
aagcaggaggggacccga

SEQ ID NO: 545827 - RNA, 23 nt, Human
aagcaggaggggacccgagucug

SEQ ID NO: 545828 - RNA, 24 nt, Human
aagcaggaggggacccgagucugg

SEQ ID NO: 545829 - RNA, 19 nt, Human
acaaaugacaugucuccau

SEQ ID NO: 545830 - RNA, 20 nt, Human
acagcccaggguucggaagc

SEQ ID NO: 545831 - RNA, 23 nt, Human
accccaacacaggcccaggacaa

SEQ ID NO: 545832 - RNA, 24 nt, Human
acgcugccacauaggccugcgggc

SEQ ID NO: 545833 - RNA, 24 nt, Human
agacaagaaagugcauuggguccg

SEQ ID NO: 545834 - RNA, 22 nt, Human
agacagagcucacugcccugug

SEQ ID NO: 545835 - RNA, 24 nt, Human
agagugacuuagcccaugccgcac

SEQ ID NO: 545836 - RNA, 23 nt, Human
agccuuuuuccuucucaaggccu

SEQ ID NO: 545837 - RNA, 20 nt, Human
aggaugcucaggggaaaaug

SEQ ID NO: 545838 - RNA, 21 nt, Human
aggcccaggacaauauuacaa

SEQ ID NO: 545839 - RNA, 25 nt, Human
aggcccaggacaauauuacaaaagu

SEQ ID NO: 545840 - RNA, 18 nt, Human
aggcggggaggguggggc

SEQ ID NO: 545841 - RNA, 21 nt, Human
aggugggggaagacagagcuc

SEQ ID NO: 545842 - RNA, 22 nt, Human
augaagcgggccucauggccuc

SEQ ID NO: 545843 - RNA, 26 nt, Human
augggcccaaggggacacucagccca

SEQ ID NO: 545844 - RNA, 22 nt, Human
cacagcuggucagaggcccaga

SEQ ID NO: 545845 - RNA, 18 nt, Human
cagagucccacuugugag

SEQ ID NO: 545846 - RNA, 22 nt, Human
cagcagggggucccacccaccc

SEQ ID NO: 545847 - RNA, 19 nt, Human
cagcagggguaggggaggc

SEQ ID NO: 545848 - RNA, 19 nt, Human
cagcccaggacagcagucu

SEQ ID NO: 545849 - RNA, 22 nt, Human
cagcccaggguucggaagcuga

SEQ ID NO: 545850 - RNA, 21 nt, Human
caggaggcugugcuccaguca

SEQ ID NO: 545851 - RNA, 20 nt, Human
cagguccaaagccucuccua

SEQ ID NO: 545852 - RNA, 22 nt, Human
cauggcaaagaaagggcuaugu

SEQ ID NO: 545853 - RNA, 21 nt, Human
ccaaagccucuccuaggccca

SEQ ID NO: 545854 - RNA, 21 nt, Human
ccaacaccccaacacaggccc

SEQ ID NO: 545855 - RNA, 19 nt, Human
ccauguggccacugaugcc

SEQ ID NO: 545856 - RNA, 24 nt, Human
cccagagucccacuugugaggcuc

SEQ ID NO: 545857 - RNA, 19 nt, Human
cccaggcggggaggguggg

SEQ ID NO: 545858 - RNA, 25 nt, Human
cccaugccgcacagcuggucagagg

SEQ ID NO: 545859 - RNA, 22 nt, Human
ccccaacaccccaacacaggcc

SEQ ID NO: 545860 - RNA, 23 nt, Human
cccccaacaccccaacacaggcc

SEQ ID NO: 545861 - RNA, 19 nt, Human
cccggccagcagggguagg

SEQ ID NO: 545862 - RNA, 22 nt, Human
cccucugcucaugguuugggga

SEQ ID NO: 545863 - RNA, 28 nt, Human
cccucugcucaugguuuggggccccggc

SEQ ID NO: 545864 - RNA, 22 nt, Human
ccugcugcugcuacuccugugc

SEQ ID NO: 545865 - RNA, 18 nt, Human
ccuguggggucucugugg

SEQ ID NO: 545866 - RNA, 24 nt, Human
cgaagggcagagugacuuagccca

SEQ ID NO: 545867 - RNA, 23 nt, Human
cgggaccugaggcagcccaggac

SEQ ID NO: 545868 - RNA, 18 nt, Human
cuccuaggcccacaacuc

SEQ ID NO: 545869 - RNA, 24 nt, Human
cuccuaggcccacaacuccugugg

SEQ ID NO: 545870 - RNA, 23 nt, Human
cucgggaccugaggcagcccagg

SEQ ID NO: 545871 - RNA, 26 nt, Human
cuugggggauaaguggggaagggaag

SEQ ID NO: 545872 - RNA, 18 nt, Human
gaagacagagcucacugc

SEQ ID NO: 545873 - RNA, 18 nt, Human
gaccuugucuccuuucac

SEQ ID NO: 545874 - RNA, 22 nt, Human
gcaaagaaagggcuauguuaga

SEQ ID NO: 545875 - RNA, 21 nt, Human
gcccuguggggucucuguggg

SEQ ID NO: 545876 - RNA, 18 nt, Human
gcuucccccaacacccca

SEQ ID NO: 545877 - RNA, 20 nt, Human
ggaggcaggaggcugugcuc

SEQ ID NO: 545878 - RNA, 18 nt, Human
ggaggguaagaagggcug

SEQ ID NO: 545879 - RNA, 18 nt, Human
ggcugggaggcaggaggc

SEQ ID NO: 545880 - RNA, 22 nt, Human
gggaaaauggguagguuuccag

SEQ ID NO: 545881 - RNA, 21 nt, Human
gggaacaggcaagggcagccg

SEQ ID NO: 545882 - RNA, 22 nt, Human
gggaagcaggaggggacccgag

SEQ ID NO: 545883 - RNA, 24 nt, Human
gggagcccaggcggggaggguggg

SEQ ID NO: 545884 - RNA, 18 nt, Human
gggccucauggccucaug

SEQ ID NO: 545885 - RNA, 18 nt, Human
gggggaagacagagcuca

SEQ ID NO: 545886 - RNA, 23 nt, Human
gggguaggggaggccgguugaaa

SEQ ID NO: 545887 - RNA, 22 nt, Human
gggucccacccacccucugccc

SEQ ID NO: 545888 - RNA, 20 nt, Human
gucccacccacccucugccc

SEQ ID NO: 545889 - RNA, 22 nt, Human
guggcccugggccacaccauuu

SEQ ID NO: 545890 - RNA, 22 nt, Human
guggcucccagguccaaagccu

SEQ ID NO: 545891 - RNA, 22 nt, Human
uaaaaugaagacuaaggaaaca

SEQ ID NO: 545892 - RNA, 18 nt, Human
uaaggaaacagcccaggg

SEQ ID NO: 545893 - RNA, 26 nt, Human
uagaggaugcucaggggaaaaugggu

SEQ ID NO: 545894 - RNA, 24 nt, Human
uagccuuuuuccuucucaaggccu

SEQ ID NO: 545895 - RNA, 22 nt, Human
uauguuagaaaagaaacucgcc

SEQ ID NO: 545896 - RNA, 20 nt, Human
ucaugccacugcccgcagga

SEQ ID NO: 545897 - RNA, 18 nt, Human
ucccagguccaaagccuc

SEQ ID NO: 545898 - RNA, 20 nt, Human
ucccagguccaaagccucuc

SEQ ID NO: 545899 - RNA, 20 nt, Human
uccugcugcugcuacuccug

SEQ ID NO: 545900 - RNA, 24 nt, Human
ucucaaggccucaguuuccccauc

SEQ ID NO: 545901 - RNA, 22 nt, Human
ucuccuaggcccacaacuccug

SEQ ID NO: 545902 - RNA, 21 nt, Human
ucuugccuguccugcugcugc

SEQ ID NO: 545903 - RNA, 24 nt, Human
ugacacuccguuaaaaaggcaaca

SEQ ID NO: 545904 - RNA, 21 nt, Human
ugacuuagcccaugccgcaca

SEQ ID NO: 545905 - RNA, 19 nt, Human
ugccacauaggccugcggg

SEQ ID NO: 545906 - RNA, 18 nt, Human
ugcccauugcgggucagg

SEQ ID NO: 545907 - RNA, 20 nt, Human
ugcccuaagcuuccagaggc

SEQ ID NO: 545908 - RNA, 18 nt, Human
ugccuguccugcugcugc

SEQ ID NO: 545909 - RNA, 27 nt, Human
uggcucccagguccaaagccucuccuu

SEQ ID NO: 545910 - RNA, 20 nt, Human
uggggaagggaagcaggagg

SEQ ID NO: 545911 - RNA, 26 nt, Human
uggggaagggaagcaggaggggaccc

SEQ ID NO: 545912 - RNA, 22 nt, Human
uggggccagccccugaugcccc

SEQ ID NO: 545913 - RNA, 24 nt, Human
ugggggaccccaacccagggugag

SEQ ID NO: 545914 - RNA, 22 nt, Human
uguuagaaaagaaacucgcccc

SEQ ID NO: 545915 - RNA, 19 nt, Human
uuccagucuggaugcuggg

SEQ ID NO: 545916 - RNA, 21 nt, Human
uugcuccuagguguggcuccc

SEQ ID NO: 545917 - RNA, 20 nt, Human
uugugaggcucuugccuguc

SEQ ID NO: 545918 - RNA, 25 nt, Human
uuucacggcauuccugggaggguaa

SEQ ID NO: 545919 - RNA, 18 nt, Human
aaacagcccaguugagaa

SEQ ID NO: 545920 - RNA, 22 nt, Human
acuuugauaaugggaagagaag

SEQ ID NO: 545921 - RNA, 19 nt, Human
agaaaaacagcccaguuga

SEQ ID NO: 545922 - RNA, 19 nt, Human
agaaggcuggcccuccaag

SEQ ID NO: 545923 - RNA, 23 nt, Human
augaagcuaagaggugacuugug

SEQ ID NO: 545924 - RNA, 22 nt, Human
caacuggccuuccuuaucuccu

SEQ ID NO: 545925 - RNA, 22 nt, Human
cacuugcucuccgccgaccagc

SEQ ID NO: 545926 - RNA, 22 nt, Human
cagcgcagaacuucgccgggga

SEQ ID NO: 545927 - RNA, 21 nt, Human
caggugguaagaaaaacagcc

SEQ ID NO: 545928 - RNA, 24 nt, Human
cauuuuucuccaaaaggcugagag

SEQ ID NO: 545929 - RNA, 23 nt, Human
ccagcgcagaacuucgccgggga

SEQ ID NO: 545930 - RNA, 18 nt, Human
ccaucugccagcauguuc

SEQ ID NO: 545931 - RNA, 22 nt, Human
ccuccaucugccagcauguuca

SEQ ID NO: 545932 - RNA, 19 nt, Human
ccuuagaaauuccuggcug

SEQ ID NO: 545933 - RNA, 23 nt, Human
ccuuagaaauuccuggcuggacc

SEQ ID NO: 545934 - RNA, 18 nt, Human
cgccggggacgguggcgc

SEQ ID NO: 545935 - RNA, 19 nt, Human
cuaaaagccuccaucugcc

SEQ ID NO: 545936 - RNA, 25 nt, Human
cuaaggcaugaagcuaagaggugac

SEQ ID NO: 545937 - RNA, 18 nt, Human
cuccaaaaggcugagagg

SEQ ID NO: 545938 - RNA, 22 nt, Human
cuccuaaaagccuccaucugcc

SEQ ID NO: 545939 - RNA, 23 nt, Human
cuuagaaauuccuggcuggaccu

SEQ ID NO: 545940 - RNA, 26 nt, Human
gcugcaccugggccauauacucaacu

SEQ ID NO: 545941 - RNA, 25 nt, Human
gguaagaaaaacagcccaguugaga

SEQ ID NO: 545942 - RNA, 28 nt, Human
guccuuagaaauuccuggcuggacccca

SEQ ID NO: 545943 - RNA, 23 nt, Human
uaaaaaacuauucuccuaaaagc

SEQ ID NO: 545944 - RNA, 18 nt, Human
uaaaagccuccaucugcc

SEQ ID NO: 545945 - RNA, 19 nt, Human
uaaguccuuagaaauuccu

SEQ ID NO: 545946 - RNA, 20 nt, Human
uacuuugauaaugggaagag

SEQ ID NO: 545947 - RNA, 21 nt, Human
ucaaaacaauaaaacacaguc

SEQ ID NO: 545948 - RNA, 19 nt, Human
uccccaccaguacaccagg

SEQ ID NO: 545949 - RNA, 24 nt, Human
ucuccaaaaggcugagaggcuaca

SEQ ID NO: 545950 - RNA, 24 nt, Human
ugacccccaagcaacuccaugaca

SEQ ID NO: 545951 - RNA, 23 nt, Human
uggaucaaaacaauaaaacacag

SEQ ID NO: 545952 - RNA, 21 nt, Human
ugggaagagaaguaagauaug

SEQ ID NO: 545953 - RNA, 24 nt, Human
ugggaagagaaguaagauauggua

SEQ ID NO: 545954 - RNA, 23 nt, Human
ugucagaauguuuaaaaaacuau

SEQ ID NO: 545955 - RNA, 19 nt, Human
uuauagaauguggucuggc

SEQ ID NO: 545956 - RNA, 19 nt, Human
uuugauaaugggaagagaa

SEQ ID NO: 545957 - RNA, 22 nt, Human
aaccgccgccgccgcugcagcc

SEQ ID NO: 545958 - RNA, 18 nt, Human
aggauggcgaggaggaag

SEQ ID NO: 545959 - RNA, 23 nt, Human
caugaaacagauuccaaaaauuc

SEQ ID NO: 545960 - RNA, 23 nt, Human
ccagggggacaaaggcaaaccac

SEQ ID NO: 545961 - RNA, 21 nt, Human
cccgcgcugcccugaagcugc

SEQ ID NO: 545962 - RNA, 20 nt, Human
ccgccgccgccgcugcagcc

SEQ ID NO: 545963 - RNA, 20 nt, Human
ccgcgcugcccugaagcugc

SEQ ID NO: 545964 - RNA, 21 nt, Human
ccgcugcagcccgcgcugccc

SEQ ID NO: 545965 - RNA, 22 nt, Human
ccgcugcagcccgcgcugcccu

SEQ ID NO: 545966 - RNA, 18 nt, Human
ccuaaccgccgccgccgc

SEQ ID NO: 545967 - RNA, 22 nt, Human
ccucgcccuacacagcccuaac

SEQ ID NO: 545968 - RNA, 24 nt, Human
cgcugcagcccgcgcugcccugaa

SEQ ID NO: 545969 - RNA, 23 nt, Human
gaaacaagagaacacucaguuac

SEQ ID NO: 545970 - RNA, 22 nt, Human
ggccucgcccuacacagcccua

SEQ ID NO: 545971 - RNA, 24 nt, Human
gggaggccucgcccuacacagccc

SEQ ID NO: 545972 - RNA, 23 nt, Human
uaaaucuucaaacacuugcaauu

SEQ ID NO: 545973 - RNA, 24 nt, Human
uaaaucuucaaacacuugcaauuu

SEQ ID NO: 545974 - RNA, 19 nt, Human
uaaccgccgccgccgcugc

SEQ ID NO: 545975 - RNA, 21 nt, Human
uacauuaaugcaaagaaacaa

SEQ ID NO: 545976 - RNA, 23 nt, Human
uacauuaaugcaaagaaacaaga

SEQ ID NO: 545977 - RNA, 22 nt, Human
uccaugaaacagauuccaaaaa

SEQ ID NO: 545978 - RNA, 25 nt, Human
ugacgaggaggaggaaggcgaggag

SEQ ID NO: 545979 - RNA, 20 nt, Human
ugacgaggagggaggaguag

SEQ ID NO: 545980 - RNA, 26 nt, Human
ugacgaggagggaggaguaggaugga

SEQ ID NO: 545981 - RNA, 21 nt, Human
ugcaaagaaacaagagaacac

SEQ ID NO: 545982 - RNA, 21 nt, Human
uggcgaggaggaagggggagg

SEQ ID NO: 545983 - RNA, 25 nt, Human
uuuuuuuuuuuuuuuugcccuccaa

SEQ ID NO: 545984 - RNA, 18 nt, Human
uuuuuuuuuuuuuuuuug

SEQ ID NO: 545985 - RNA, 22 nt, Human
uuuuuuuuuuuuuuuuugcccu

SEQ ID NO: 545986 - RNA, 19 nt, Human
aagacaaggagagccgagc

SEQ ID NO: 545987 - RNA, 19 nt, Human
aaguagguuucgaaagauc

SEQ ID NO: 545988 - RNA, 18 nt, Human
aggagagccgagccggca

SEQ ID NO: 545989 - RNA, 21 nt, Human
aggagagccgagccggcaccc

SEQ ID NO: 545990 - RNA, 23 nt, Human
cacccacccggguccagaagcaa

SEQ ID NO: 545991 - RNA, 24 nt, Human
ccaccgcucuggaagacaaggaga

SEQ ID NO: 545992 - RNA, 19 nt, Human
ccccgcaccugccucgcac

SEQ ID NO: 545993 - RNA, 20 nt, Human
ccccgcaccugccucgcacc

SEQ ID NO: 545994 - RNA, 22 nt, Human
ccccgcaccugccucgcaccca

SEQ ID NO: 545995 - RNA, 21 nt, Human
cccgcaccugccucgcaccca

SEQ ID NO: 545996 - RNA, 19 nt, Human
ccgagcuucuggcgcuggc

SEQ ID NO: 545997 - RNA, 25 nt, Human
ccucgcacccagaucggcgcucucc

SEQ ID NO: 545998 - RNA, 18 nt, Human
cgcucuggaagacaagga

SEQ ID NO: 545999 - RNA, 20 nt, Human
cugugcuuccgggccaccgc

SEQ ID NO: 546000 - RNA, 19 nt, Human
gagccggcacccacccggg

SEQ ID NO: 546001 - RNA, 23 nt, Human
gagccggcacccacccgggucca

SEQ ID NO: 546002 - RNA, 21 nt, Human
gagcuucuggcgcuggcgucu

SEQ ID NO: 546003 - RNA, 24 nt, Human
aaaaauaaaagaaugagggaagaa

SEQ ID NO: 546004 - RNA, 18 nt, Human
aaaugcaacgugaaggca

SEQ ID NO: 546005 - RNA, 24 nt, Human
aacuuggaacuuuuuuucuauuuu

SEQ ID NO: 546006 - RNA, 18 nt, Human
acccugggcccgcgggcc

SEQ ID NO: 546007 - RNA, 25 nt, Human
acccugggcccgcgggccgcccggc

SEQ ID NO: 546008 - RNA, 23 nt, Human
aggaaacaacccacauucuaggc

SEQ ID NO: 546009 - RNA, 20 nt, Human
cacauucuaggcccagcucu

SEQ ID NO: 546010 - RNA, 19 nt, Human
cagaugaccuacaaaaauc

SEQ ID NO: 546011 - RNA, 25 nt, Human
cagcuacaaagacuagacaggccag

SEQ ID NO: 546012 - RNA, 21 nt, Human
caggccaggaaacaacccaca

SEQ ID NO: 546013 - RNA, 23 nt, Human
caggccaggaaacaacccacauu

SEQ ID NO: 546014 - RNA, 23 nt, Human
caugaacuugcagaugaccuaca

SEQ ID NO: 546015 - RNA, 21 nt, Human
cccugggcccgcgggccgccc

SEQ ID NO: 546016 - RNA, 20 nt, Human
cgcgggccgcccggcugccg

SEQ ID NO: 546017 - RNA, 18 nt, Human
cuaggcccagcucuucca

SEQ ID NO: 546018 - RNA, 18 nt, Human
cucccugccugcugcugu

SEQ ID NO: 546019 - RNA, 19 nt, Human
gagauaaggaacauuuuau

SEQ ID NO: 546020 - RNA, 23 nt, Human
gcugccgggaccccgggucucca

SEQ ID NO: 546021 - RNA, 22 nt, Human
ggcccagcucuuccaugaacuu

SEQ ID NO: 546022 - RNA, 21 nt, Human
uaaaaaugcaacgugaaggca

SEQ ID NO: 546023 - RNA, 18 nt, Human
uauaaacaaaauugccca

SEQ ID NO: 546024 - RNA, 33 nt, Human
ucacagcuacaaagacuagacaggccaggaaaa

SEQ ID NO: 546025 - RNA, 19 nt, Human
uccaauaaaaaugcaacgu

SEQ ID NO: 546026 - RNA, 20 nt, Human
uccucccugccugcugcugu

SEQ ID NO: 546027 - RNA, 22 nt, Human
ugagggaagaaagaaaaacuug

SEQ ID NO: 546028 - RNA, 22 nt, Human
ugccgggaccccgggucuccac

SEQ ID NO: 546029 - RNA, 23 nt, Human
ugccugcugcugugugcccuucc

SEQ ID NO: 546030 - RNA, 19 nt, Human
ugcuugccguucucugugu

SEQ ID NO: 546031 - RNA, 26 nt, Human
ugucucacagcuacaaagacuagaca

SEQ ID NO: 546032 - RNA, 23 nt, Human
uuacugaacgagcgagguuuucc

SEQ ID NO: 546033 - RNA, 27 nt, Human
uuuauuugccaccuccgccuccucccc

SEQ ID NO: 546034 - RNA, 23 nt, Human
aaauugcugugaccccaaaucuc

SEQ ID NO: 546035 - RNA, 23 nt, Human
aacaccauauccuauuagaaaug

SEQ ID NO: 546036 - RNA, 19 nt, Human
aaccaggaggagaguagcc

SEQ ID NO: 546037 - RNA, 20 nt, Human
aacuaggcacagcucugggc

SEQ ID NO: 546038 - RNA, 24 nt, Human
aacucacagacaagugugccccuc

SEQ ID NO: 546039 - RNA, 22 nt, Human
acaagaacgucaguucucuccu

SEQ ID NO: 546040 - RNA, 22 nt, Human
acacagccacaggacuggaacu

SEQ ID NO: 546041 - RNA, 23 nt, Human
acccaaccacagagacaaagaaa

SEQ ID NO: 546042 - RNA, 19 nt, Human
acuggagaggguuuugaaa

SEQ ID NO: 546043 - RNA, 22 nt, Human
agaaccacauucaugcuguuga

SEQ ID NO: 546044 - RNA, 22 nt, Human
agacaaagaaacuaagaccugg

SEQ ID NO: 546045 - RNA, 21 nt, Human
agaggguuuugaaauugcucc

SEQ ID NO: 546046 - RNA, 18 nt, Human
agccacaggacuggaacu

SEQ ID NO: 546047 - RNA, 21 nt, Human
aggaaagagaaaauaaaaugu

SEQ ID NO: 546048 - RNA, 20 nt, Human
agucaguuucuaugaacuag

SEQ ID NO: 546049 - RNA, 24 nt, Human
aucccucaccuucaccugacacaa

SEQ ID NO: 546050 - RNA, 19 nt, Human
aucucacaaugcuccacac

SEQ ID NO: 546051 - RNA, 23 nt, Human
augaacuaggcacagcucugggc

SEQ ID NO: 546052 - RNA, 23 nt, Human
auuacuacaauuugaugauaggu

SEQ ID NO: 546053 - RNA, 23 nt, Human
caacaaaccucccucagcaaugu

SEQ ID NO: 546054 - RNA, 20 nt, Human
caacagagagacuggggcaa

SEQ ID NO: 546055 - RNA, 19 nt, Human
caagaacauggauguggca

SEQ ID NO: 546056 - RNA, 23 nt, Human
caaggaaagagaaaauaaaaugu

SEQ ID NO: 546057 - RNA, 18 nt, Human
caagggagacccaaccgu

SEQ ID NO: 546058 - RNA, 24 nt, Human
cacacagccacaggacuggaacuc

SEQ ID NO: 546059 - RNA, 18 nt, Human
cacaggacuggaacucag

SEQ ID NO: 546060 - RNA, 20 nt, Human
cacagugucuguucaucugu

SEQ ID NO: 546061 - RNA, 24 nt, Human
cacccccaagucaagggacagcuc

SEQ ID NO: 546062 - RNA, 20 nt, Human
cacuguggaagauacaaggg

SEQ ID NO: 546063 - RNA, 24 nt, Human
caugaaagggcaaaaaagaugacc

SEQ ID NO: 546064 - RNA, 22 nt, Human
ccaauucaacaaaccucccuca

SEQ ID NO: 546065 - RNA, 22 nt, Human
ccacagagacaaagaaacuaag

SEQ ID NO: 546066 - RNA, 23 nt, Human
cccaagaacauggauguggcaug

SEQ ID NO: 546067 - RNA, 18 nt, Human
cccacccaaccacagaga

SEQ ID NO: 546068 - RNA, 19 nt, Human
ccccucugacugcaugguc

SEQ ID NO: 546069 - RNA, 23 nt, Human
ccucuguauaaagcugccccucu

SEQ ID NO: 546070 - RNA, 22 nt, Human
ccugcagaagugggucaucagu

SEQ ID NO: 546071 - RNA, 23 nt, Human
cuaagccaguuuugaaaaguaaa

SEQ ID NO: 546072 - RNA, 27 nt, Human
cucacaaugcuccacacuuuggggcuu

SEQ ID NO: 546073 - RNA, 18 nt, Human
cuccaucacucccgaucc

SEQ ID NO: 546074 - RNA, 20 nt, Human
cuccaugaaagggcaaaaaa

SEQ ID NO: 546075 - RNA, 18 nt, Human
cuccugguauaugucugg

SEQ ID NO: 546076 - RNA, 21 nt, Human
cucuguauaaagcugccccuc

SEQ ID NO: 546077 - RNA, 23 nt, Human
cugaccagguccuaauucacauu

SEQ ID NO: 546078 - RNA, 24 nt, Human
cuggaacucagggcuucaaacuca

SEQ ID NO: 546079 - RNA, 21 nt, Human
gaaagaaccaggaggagagua

SEQ ID NO: 546080 - RNA, 18 nt, Human
gacaaaaucauuuacaua

SEQ ID NO: 546081 - RNA, 18 nt, Human
gagaggguuaacauuuca

SEQ ID NO: 546082 - RNA, 20 nt, Human
gagaguagcccaggcuggag

SEQ ID NO: 546083 - RNA, 18 nt, Human
gagagucugaauugucca

SEQ ID NO: 546084 - RNA, 25 nt, Human
gagugaccucuggugcuggugggcc

SEQ ID NO: 546085 - RNA, 19 nt, Human
gcucaccaggaaguuuaag

SEQ ID NO: 546086 - RNA, 19 nt, Human
gcucugggcagcacaaauu

SEQ ID NO: 546087 - RNA, 20 nt, Human
gcugugaccccaaaucucac

SEQ ID NO: 546088 - RNA, 21 nt, Human
ggaagcccuguuggccugaaa

SEQ ID NO: 546089 - RNA, 19 nt, Human
ggauguggagagugaccuc

SEQ ID NO: 546090 - RNA, 18 nt, Human
ggcaaaaaagaugaccca

SEQ ID NO: 546091 - RNA, 24 nt, Human
ggcaaaaaagaugacccaagaaca

SEQ ID NO: 546092 - RNA, 23 nt, Human
ggcagcacaaauuucuacacacu

SEQ ID NO: 546093 - RNA, 23 nt, Human
ggcucaacagagagacuggggca

SEQ ID NO: 546094 - RNA, 21 nt, Human
ggggguccagcagguacagag

SEQ ID NO: 546095 - RNA, 27 nt, Human
guaaaccuuaaaaaccaauucaacaaa

SEQ ID NO: 546096 - RNA, 20 nt, Human
uaagauaucauuuacagcaa

SEQ ID NO: 546097 - RNA, 25 nt, Human
uaagcaaaaccagggagaaaguguu

SEQ ID NO: 546098 - RNA, 25 nt, Human
uaagcagcuguaccuccuguggagc

SEQ ID NO: 546099 - RNA, 23 nt, Human
uaaguggaauuaagcaaaaccag

SEQ ID NO: 546100 - RNA, 19 nt, Human
uacaagggagacccaaccg

SEQ ID NO: 546101 - RNA, 20 nt, Human
uacacacuguggaagauaca

SEQ ID NO: 546102 - RNA, 23 nt, Human
uacauuacuacaauuugaugaua

SEQ ID NO: 546103 - RNA, 19 nt, Human
uaccagacccagggaauag

SEQ ID NO: 546104 - RNA, 26 nt, Human
uagaaaacacaauagaaucaacaggu

SEQ ID NO: 546105 - RNA, 23 nt, Human
uagaaucaacagguaaacuagua

SEQ ID NO: 546106 - RNA, 19 nt, Human
uauagaagaaucaaggucc

SEQ ID NO: 546107 - RNA, 21 nt, Human
uauuagaaauguaauaaaaca

SEQ ID NO: 546108 - RNA, 23 nt, Human
uauuucaaacugaccagguccua

SEQ ID NO: 546109 - RNA, 19 nt, Human
ucaaagucacacagccaca

SEQ ID NO: 546110 - RNA, 19 nt, Human
ucaacagagagacuggggc

SEQ ID NO: 546111 - RNA, 20 nt, Human
ucaccaacaccauauccuag

SEQ ID NO: 546112 - RNA, 18 nt, Human
ucaccaggaaguuuaaga

SEQ ID NO: 546113 - RNA, 21 nt, Human
ucaguucucuccuauuuacaa

SEQ ID NO: 546114 - RNA, 20 nt, Human
uccaaaggagggugucaacc

SEQ ID NO: 546115 - RNA, 26 nt, Human
uccacauacaucacuguacagaacca

SEQ ID NO: 546116 - RNA, 20 nt, Human
uccagcagguacagagaagg

SEQ ID NO: 546117 - RNA, 23 nt, Human
uccagcagguacagagaaggugc

SEQ ID NO: 546118 - RNA, 22 nt, Human
ucccucagcaaugugcuuccag

SEQ ID NO: 546119 - RNA, 24 nt, Human
uccucuguauaaagcugccccucu

SEQ ID NO: 546120 - RNA, 18 nt, Human
ucuccacauacaucacug

SEQ ID NO: 546121 - RNA, 20 nt, Human
ucuccacauacaucacugua

SEQ ID NO: 546122 - RNA, 18 nt, Human
ucugaauuguccacuaga

SEQ ID NO: 546123 - RNA, 20 nt, Human
ugaaaaguaaaagaggacau

SEQ ID NO: 546124 - RNA, 23 nt, Human
ugaacuagcagaaaaauucagca

SEQ ID NO: 546125 - RNA, 19 nt, Human
ugaauaccuaagccaguuu

SEQ ID NO: 546126 - RNA, 22 nt, Human
ugacugaugcauaaguggaauu

SEQ ID NO: 546127 - RNA, 23 nt, Human
ugaggagagauguguaagcagcu

SEQ ID NO: 546128 - RNA, 20 nt, Human
ugauguagggugguaccuuu

SEQ ID NO: 546129 - RNA, 23 nt, Human
ugcaucuccaucacucccgaucc

SEQ ID NO: 546130 - RNA, 21 nt, Human
ugccccucugacugcaugguc

SEQ ID NO: 546131 - RNA, 21 nt, Human
ugcugugaccccaaaucucac

SEQ ID NO: 546132 - RNA, 18 nt, Human
ugggaaaacaucacaaga

SEQ ID NO: 546133 - RNA, 21 nt, Human
ugggaaaacaucacaagaacg

SEQ ID NO: 546134 - RNA, 19 nt, Human
ugggaggcggggaugugga

SEQ ID NO: 546135 - RNA, 18 nt, Human
ugggcagaacaucuucag

SEQ ID NO: 546136 - RNA, 23 nt, Human
uggugggcagaacaucuucaguu

SEQ ID NO: 546137 - RNA, 19 nt, Human
uguagggugguaccuuuaa

SEQ ID NO: 546138 - RNA, 22 nt, Human
uguaugcaucuccaucacuccc

SEQ ID NO: 546139 - RNA, 18 nt, Human
uguccuaccuaccagacc

SEQ ID NO: 546140 - RNA, 22 nt, Human
uguggaagauacaagggagacc

SEQ ID NO: 546141 - RNA, 20 nt, Human
uguggcauguuuaugcaugg

SEQ ID NO: 546142 - RNA, 25 nt, Human
uguugaaaugacugaugcauaagug

SEQ ID NO: 546143 - RNA, 27 nt, Human
uuaaaacucugaagauaaguccagugg

SEQ ID NO: 546144 - RNA, 23 nt, Human
uuaccucuaagucgagagcuccu

SEQ ID NO: 546145 - RNA, 18 nt, Human
uuccaagaaagaagagug

SEQ ID NO: 546146 - RNA, 24 nt, Human
acaaagaaaaacaaauaguaucca

SEQ ID NO: 546147 - RNA, 25 nt, Human
caaagaaaaacaaauaguauccaaa

SEQ ID NO: 546148 - RNA, 23 nt, Human
caccacuacacccccaaaagagc

SEQ ID NO: 546149 - RNA, 19 nt, Human
ccacuacacccccaaaagg

SEQ ID NO: 546150 - RNA, 20 nt, Human
ccaucagaguaaguaguuuu

SEQ ID NO: 546151 - RNA, 21 nt, Human
gcagacccaaggguguccaac

SEQ ID NO: 546152 - RNA, 23 nt, Human
ggggcaccacuacacccccaaaa

SEQ ID NO: 546153 - RNA, 21 nt, Human
uaagcaaacacacauacaaca

SEQ ID NO: 546154 - RNA, 22 nt, Human
uacaaagaaaaacaaauaguau

SEQ ID NO: 546155 - RNA, 25 nt, Human
uacacccccaaaagagcuccuagug

SEQ ID NO: 546156 - RNA, 21 nt, Human
uaucugaaaggcuucauagaa

SEQ ID NO: 546157 - RNA, 23 nt, Human
uaucugaaaggcuucauagaaaa

SEQ ID NO: 546158 - RNA, 19 nt, Human
uccuugcagacccaagggu

SEQ ID NO: 546159 - RNA, 22 nt, Human
ugacaucuuuuguccuuguccc

SEQ ID NO: 546160 - RNA, 22 nt, Human
uggcuccuugcagacccaaggg

SEQ ID NO: 546161 - RNA, 23 nt, Human
uggcuuugaugcaggggguagcu

SEQ ID NO: 546162 - RNA, 21 nt, Human
uucaacuuuuuuuuccuacaa

SEQ ID NO: 546163 - RNA, 18 nt, Human
uucauuuuuuaaagagau

SEQ ID NO: 546164 - RNA, 18 nt, Human
uuuuaagaaagucuuccg

SEQ ID NO: 546165 - RNA, 28 nt, Human
acaccaacagaagggaucaaaguguguc

SEQ ID NO: 546166 - RNA, 26 nt, Human
agaaacgggguaucccgagacccaag

SEQ ID NO: 546167 - RNA, 20 nt, Human
auaaaaugaaggcaauuuga

SEQ ID NO: 546168 - RNA, 22 nt, Human
caggaagaaacgggguaucccg

SEQ ID NO: 546169 - RNA, 24 nt, Human
caugacaccaacagaagggaucaa

SEQ ID NO: 546170 - RNA, 21 nt, Human
ccgcacgcacgucccacaccu

SEQ ID NO: 546171 - RNA, 20 nt, Human
ccuacaggaagaaacggggu

SEQ ID NO: 546172 - RNA, 21 nt, Human
cuacucccacgccguggcucc

SEQ ID NO: 546173 - RNA, 19 nt, Human
cucccacgccguggcucca

SEQ ID NO: 546174 - RNA, 18 nt, Human
cugcugccugccuucagc

SEQ ID NO: 546175 - RNA, 24 nt, Human
ucaauagauagcaauggaaaguaa

SEQ ID NO: 546176 - RNA, 24 nt, Human
ucuagacuauuuaaccaaagguau

SEQ ID NO: 546177 - RNA, 19 nt, Human
aacaauacaaaaacaaagu

SEQ ID NO: 546178 - RNA, 26 nt, Human
aauacaaaaacaaaguguagacugga

SEQ ID NO: 546179 - RNA, 19 nt, Human
aauuugaaacagguuguuc

SEQ ID NO: 546180 - RNA, 23 nt, Human
acaauacaaaaacaaaguguaga

SEQ ID NO: 546181 - RNA, 21 nt, Human
aggagcaacaauacaaaaaca

SEQ ID NO: 546182 - RNA, 22 nt, Human
auugaacaacaauacaacgaaa

SEQ ID NO: 546183 - RNA, 27 nt, Human
caacaauacaacgaaaacuggucgccu

SEQ ID NO: 546184 - RNA, 21 nt, Human
cggcccaggaccaugcggcag

SEQ ID NO: 546185 - RNA, 21 nt, Human
ggaccaugcggcagaggaaag

SEQ ID NO: 546186 - RNA, 24 nt, Human
ggcccaggaccaugcggcagagga

SEQ ID NO: 546187 - RNA, 21 nt, Human
uccgacgccaacggcccagga

SEQ ID NO: 546188 - RNA, 18 nt, Human
uuuuuuuuuuuuuuuuug

SEQ ID NO: 546189 - RNA, 19 nt, Human
uuuuuuuuuuuuuuuuugu

SEQ ID NO: 546190 - RNA, 19 nt, Human
aaccaguacccgcuacaca

SEQ ID NO: 546191 - RNA, 18 nt, Human
aacuggccuccccaccca

SEQ ID NO: 546192 - RNA, 24 nt, Human
accacacccucccacccucuuuuc

SEQ ID NO: 546193 - RNA, 20 nt, Human
acccucccacccucuuuucu

SEQ ID NO: 546194 - RNA, 23 nt, Human
acucuguucuuccuuuucccugc

SEQ ID NO: 546195 - RNA, 24 nt, Human
acucuguucuuccuuuucccugcu

SEQ ID NO: 546196 - RNA, 20 nt, Human
agaggcccuugggcuuccac

SEQ ID NO: 546197 - RNA, 18 nt, Human
aggaggcuuucagaggcc

SEQ ID NO: 546198 - RNA, 23 nt, Human
aggaggcuuucagaggcccuugg

SEQ ID NO: 546199 - RNA, 19 nt, Human
aggcaggggcacccccaaa

SEQ ID NO: 546200 - RNA, 19 nt, Human
aggccugugggucacagug

SEQ ID NO: 546201 - RNA, 21 nt, Human
agugaauggugggggcucugc

SEQ ID NO: 546202 - RNA, 21 nt, Human
aucacggccgccgcgcagcac

SEQ ID NO: 546203 - RNA, 25 nt, Human
caacccaagagcaaacagcuuuguc

SEQ ID NO: 546204 - RNA, 18 nt, Human
caauguggugauugagga

SEQ ID NO: 546205 - RNA, 24 nt, Human
cacacccucccacccucuuuucug

SEQ ID NO: 546206 - RNA, 21 nt, Human
caccacccaggccuguggguc

SEQ ID NO: 546207 - RNA, 25 nt, Human
cacggaaagaugucacagugaaugg

SEQ ID NO: 546208 - RNA, 21 nt, Human
cagcccagggaaacagugggc

SEQ ID NO: 546209 - RNA, 20 nt, Human
cagcugggcauuucuccccu

SEQ ID NO: 546210 - RNA, 19 nt, Human
caggaggcuuucagaggcc

SEQ ID NO: 546211 - RNA, 24 nt, Human
cagggagaaucaaucauuugcuag

SEQ ID NO: 546212 - RNA, 22 nt, Human
caguacccgcuacacauaugca

SEQ ID NO: 546213 - RNA, 19 nt, Human
ccaacccaagagcaaacag

SEQ ID NO: 546214 - RNA, 19 nt, Human
ccaacccaagagcaaacag

SEQ ID NO: 546215 - RNA, 24 nt, Human
ccccacccagaccucuuccaggca

SEQ ID NO: 546216 - RNA, 20 nt, Human
cccccgcucggccgcggccg

SEQ ID NO: 546217 - RNA, 18 nt, Human
cccuaagacacaggaacc

SEQ ID NO: 546218 - RNA, 20 nt, Human
cccucccacccucuuuucug

SEQ ID NO: 546219 - RNA, 24 nt, Human
ccgccgucaccagccaucacgggg

SEQ ID NO: 546220 - RNA, 21 nt, Human
ccgcucccgggccgcggcccc

SEQ ID NO: 546221 - RNA, 23 nt, Human
ccgcucccgggccgcggccccgg

SEQ ID NO: 546222 - RNA, 19 nt, Human
ccucuuccaggcaggguga

SEQ ID NO: 546223 - RNA, 18 nt, Human
ccuggggacagaagaggc

SEQ ID NO: 546224 - RNA, 21 nt, Human
cggcaggccccauggccgcca

SEQ ID NO: 546225 - RNA, 24 nt, Human
cucccaacccaagagcaaacagcu

SEQ ID NO: 546226 - RNA, 27 nt, Human
cucccaacccaagagcaaacagcuuug

SEQ ID NO: 546227 - RNA, 18 nt, Human
cucccgggccgcggcccc

SEQ ID NO: 546228 - RNA, 19 nt, Human
cucccgggccgcggccccg

SEQ ID NO: 546229 - RNA, 20 nt, Human
cugcuuuccugcuuugucca

SEQ ID NO: 546230 - RNA, 19 nt, Human
cuuucagaggcccuugggc

SEQ ID NO: 546231 - RNA, 20 nt, Human
cuuuccugcuuuguccaggg

SEQ ID NO: 546232 - RNA, 20 nt, Human
gaaacagugggcagcaggag

SEQ ID NO: 546233 - RNA, 21 nt, Human
gaaccaguacccgcuacacau

SEQ ID NO: 546234 - RNA, 22 nt, Human
gcagcacugggagcaguggcac

SEQ ID NO: 546235 - RNA, 24 nt, Human
gccaggcugagugagccuggggac

SEQ ID NO: 546236 - RNA, 19 nt, Human
gccugugggucacaguggg

SEQ ID NO: 546237 - RNA, 20 nt, Human
gcuggaggcaggggcacccc

SEQ ID NO: 546238 - RNA, 23 nt, Human
ggaaacagugggcagcaggaggc

SEQ ID NO: 546239 - RNA, 18 nt, Human
ggacagaagaggcagacu

SEQ ID NO: 546240 - RNA, 19 nt, Human
ggagcacagggugaggugg

SEQ ID NO: 546241 - RNA, 24 nt, Human
ggccaagaccacacccucccaccc

SEQ ID NO: 546242 - RNA, 19 nt, Human
ggcugagugagccugggga

SEQ ID NO: 546243 - RNA, 20 nt, Human
guacucaugucaccuguggg

SEQ ID NO: 546244 - RNA, 24 nt, Human
gugggcagcaggaggcuuucagag

SEQ ID NO: 546245 - RNA, 22 nt, Human
uaaaaauaaacucuguucuucc

SEQ ID NO: 546246 - RNA, 25 nt, Human
uacaccacccaggccugugggucaa

SEQ ID NO: 546247 - RNA, 23 nt, Human
ucaugucaccugugggggggagg

SEQ ID NO: 546248 - RNA, 21 nt, Human
uccccacccagaccucuucca

SEQ ID NO: 546249 - RNA, 21 nt, Human
uccucccaacccaagagcaaa

SEQ ID NO: 546250 - RNA, 18 nt, Human
ucugcuggaggcaggggc

SEQ ID NO: 546251 - RNA, 18 nt, Human
ucuguucuuccuuuuccc

SEQ ID NO: 546252 - RNA, 22 nt, Human
ugaggagggucuguacucaugu

SEQ ID NO: 546253 - RNA, 22 nt, Human
ugauucagggcucccggcagcu

SEQ ID NO: 546254 - RNA, 24 nt, Human
ugccccaggucuggugacagcugg

SEQ ID NO: 546255 - RNA, 23 nt, Human
ugcccggccccgccgucaccagc

SEQ ID NO: 546256 - RNA, 21 nt, Human
uggagucgggccaggcgguga

SEQ ID NO: 546257 - RNA, 18 nt, Human
ugggagcaguggcacaag

SEQ ID NO: 546258 - RNA, 19 nt, Human
ugggagcaguggcacaagg

SEQ ID NO: 546259 - RNA, 23 nt, Human
ugggagcaguggcacaaggagca

SEQ ID NO: 546260 - RNA, 25 nt, Human
ugggcagcaggaggcuuucagaggc

SEQ ID NO: 546261 - RNA, 21 nt, Human
uggggcaggcacggcaggccc

SEQ ID NO: 546262 - RNA, 25 nt, Human
uguggugauugaggagggucuguac

SEQ ID NO: 546263 - RNA, 21 nt, Human
uugugcccuaagacacaggaa

SEQ ID NO: 546264 - RNA, 21 nt, Human
uuucagaggcccuugggcuuc

SEQ ID NO: 546265 - RNA, 23 nt, Human
uuucagaggcccuugggcuucca

SEQ ID NO: 546266 - RNA, 19 nt, Human
uuugucaggagagcugccc

SEQ ID NO: 546267 - RNA, 24 nt, Human
aaagaaacucagucagagccuggg

SEQ ID NO: 546268 - RNA, 18 nt, Human
aagaaacucagucagagc

SEQ ID NO: 546269 - RNA, 28 nt, Human
aagaaacucagucagagccugggaugau

SEQ ID NO: 546270 - RNA, 21 nt, Human
agaacaucaguaaaacugaaa

SEQ ID NO: 546271 - RNA, 23 nt, Human
ccacccagaacaucaguaaaacu

SEQ ID NO: 546272 - RNA, 19 nt, Human
cuggcucugucccccaccc

SEQ ID NO: 546273 - RNA, 22 nt, Human
gaaacuuucuccauucagucaa

SEQ ID NO: 546274 - RNA, 24 nt, Human
gacguguuaaaaaaaaaaugcugg

SEQ ID NO: 546275 - RNA, 18 nt, Human
ucccccacccagaacauc

SEQ ID NO: 546276 - RNA, 21 nt, Human
ugagauugucacuacagcugc

SEQ ID NO: 546277 - RNA, 18 nt, Human
ugggagauuauuuuuuua

SEQ ID NO: 546278 - RNA, 23 nt, Human
ugggaugaugaagaugaugauga

SEQ ID NO: 546279 - RNA, 19 nt, Human
ugguguugaagcugcucug

SEQ ID NO: 546280 - RNA, 24 nt, Human
uuuuuuuuuuuuuuuuuuucuggg

SEQ ID NO: 546281 - RNA, 21 nt, Human
acuucgaggugcugcgaggga

SEQ ID NO: 546282 - RNA, 18 nt, Human
cauuaggagauacaugaa

SEQ ID NO: 546283 - RNA, 21 nt, Human
uagagcaaaucagaaaccaag

SEQ ID NO: 546284 - RNA, 24 nt, Human
ugaaauagagcaaaucagaaacca

SEQ ID NO: 546285 - RNA, 28 nt, Human
ugaaauagagcaaaucagaaaccaagua

SEQ ID NO: 546286 - RNA, 19 nt, Human
cagcaggaaugggcugggg

SEQ ID NO: 546287 - RNA, 24 nt, Human
gaacuggcggccaaggggaaccgg

SEQ ID NO: 546288 - RNA, 18 nt, Human
gaggagaacggaacuggc

SEQ ID NO: 546289 - RNA, 24 nt, Human
gcgcacugauuucgaggcuuugug

SEQ ID NO: 546290 - RNA, 23 nt, Human
gguuuuguuuguuugacagcagg

SEQ ID NO: 546291 - RNA, 22 nt, Human
ucccccgcaagcuggaccccuu

SEQ ID NO: 546292 - RNA, 20 nt, Human
uccguucggcccgugaggag

SEQ ID NO: 546293 - RNA, 24 nt, Human
aaacaaauacauucaaaaaucaag

SEQ ID NO: 546294 - RNA, 18 nt, Human
aaagagacgcuuucacau

SEQ ID NO: 546295 - RNA, 24 nt, Human
aaaugauccacaaaagucagaaac

SEQ ID NO: 546296 - RNA, 24 nt, Human
aacaaauacauucaaaaaggguuc

SEQ ID NO: 546297 - RNA, 27 nt, Human
aagaaaucaaagugacuucagugggca

SEQ ID NO: 546298 - RNA, 22 nt, Human
aagcuccagacaaagagacgcu

SEQ ID NO: 546299 - RNA, 25 nt, Human
aauuacuaucuaaugaauagcugga

SEQ ID NO: 546300 - RNA, 19 nt, Human
accgcagccucgcucaagc

SEQ ID NO: 546301 - RNA, 20 nt, Human
agaaaccuauuaaauacuau

SEQ ID NO: 546302 - RNA, 21 nt, Human
agcagaagugcacacacucac

SEQ ID NO: 546303 - RNA, 20 nt, Human
aggagcuugacaaugcuaga

SEQ ID NO: 546304 - RNA, 20 nt, Human
aggaggggccaaaugaaccc

SEQ ID NO: 546305 - RNA, 20 nt, Human
agugcacacacucacuuggg

SEQ ID NO: 546306 - RNA, 26 nt, Human
caaccaaauuccaaaaaacggauccc

SEQ ID NO: 546307 - RNA, 18 nt, Human
cacuggcuucaggggugg

SEQ ID NO: 546308 - RNA, 21 nt, Human
ccaacacccgacaccaccagg

SEQ ID NO: 546309 - RNA, 25 nt, Human
ccacaaaagucagaaaccuauuaaa

SEQ ID NO: 546310 - RNA, 19 nt, Human
ccuccaaaccaucuucauc

SEQ ID NO: 546311 - RNA, 18 nt, Human
ccuuaugcagauuucggc

SEQ ID NO: 546312 - RNA, 23 nt, Human
cguacucaacauagccuauuugc

SEQ ID NO: 546313 - RNA, 20 nt, Human
cuaacucuacccaccaacac

SEQ ID NO: 546314 - RNA, 24 nt, Human
cuaggacaccaaggauccuggcua

SEQ ID NO: 546315 - RNA, 20 nt, Human
cucggaaaccgcagccucgc

SEQ ID NO: 546316 - RNA, 25 nt, Human
cugcugcccccgacugacugcguag

SEQ ID NO: 546317 - RNA, 26 nt, Human
cuucgcaucuugcugcugcccccgac

SEQ ID NO: 546318 - RNA, 19 nt, Human
cuuggcuggagagggccuc

SEQ ID NO: 546319 - RNA, 20 nt, Human
gaaaacaucuccucaaagcu

SEQ ID NO: 546320 - RNA, 21 nt, Human
gaacccuuuaggagcuugaca

SEQ ID NO: 546321 - RNA, 22 nt, Human
gauccacaaaagucagaaaccu

SEQ ID NO: 546322 - RNA, 20 nt, Human
ggacugaaaaguuucuggcg

SEQ ID NO: 546323 - RNA, 18 nt, Human
ggagggugggguguggga

SEQ ID NO: 546324 - RNA, 21 nt, Human
ggccaaaugaacccuuuagga

SEQ ID NO: 546325 - RNA, 18 nt, Human
ggccucggaaaccgcagc

SEQ ID NO: 546326 - RNA, 20 nt, Human
uaaacaucaacaaaagugcc

SEQ ID NO: 546327 - RNA, 21 nt, Human
uaaacaucaacaaaagugcca

SEQ ID NO: 546328 - RNA, 21 nt, Human
uaaaguaaugcuuuuaagggc

SEQ ID NO: 546329 - RNA, 20 nt, Human
uaacacauuucauugaaaaa

SEQ ID NO: 546330 - RNA, 21 nt, Human
uaacacggguuagaaaaaucc

SEQ ID NO: 546331 - RNA, 21 nt, Human
ucaacaaaagugccaaagaca

SEQ ID NO: 546332 - RNA, 20 nt, Human
ucacuggcuucagggguggu

SEQ ID NO: 546333 - RNA, 22 nt, Human
uccacaaaagucagaaaccuau

SEQ ID NO: 546334 - RNA, 24 nt, Human
uccagacaaagagacgcuuucaca

SEQ ID NO: 546335 - RNA, 20 nt, Human
uccaggccgggaccugaucu

SEQ ID NO: 546336 - RNA, 19 nt, Human
ucccccuuccucccucugg

SEQ ID NO: 546337 - RNA, 19 nt, Human
ucccuaaagaagcagaagu

SEQ ID NO: 546338 - RNA, 23 nt, Human
ucccucuggcuugcagcagcucc

SEQ ID NO: 546339 - RNA, 24 nt, Human
ucccucuggcuugcagcagcuccc

SEQ ID NO: 546340 - RNA, 21 nt, Human
uccgguggguggacagcuucc

SEQ ID NO: 546341 - RNA, 24 nt, Human
ucuacccaccaacacccgacacca

SEQ ID NO: 546342 - RNA, 23 nt, Human
ucucccuugguuugcaaaaguug

SEQ ID NO: 546343 - RNA, 22 nt, Human
ucuuugaggaggggccaaauga

SEQ ID NO: 546344 - RNA, 24 nt, Human
ugaaacaaauacauucaaaaauca

SEQ ID NO: 546345 - RNA, 31 nt, Human
ugaaauaaacaucaacaaaagugccaaagag

SEQ ID NO: 546346 - RNA, 25 nt, Human
ugaaucacacaacauucugaaauaa

SEQ ID NO: 546347 - RNA, 19 nt, Human
ugacaaugcuagaccuuug

SEQ ID NO: 546348 - RNA, 19 nt, Human
ugacugcguagugcucucg

SEQ ID NO: 546349 - RNA, 19 nt, Human
ugacuucaaccaaauucca

SEQ ID NO: 546350 - RNA, 21 nt, Human
ugaggagggguaugaagggaa

SEQ ID NO: 546351 - RNA, 23 nt, Human
ugaggagggguaugaagggaagg

SEQ ID NO: 546352 - RNA, 25 nt, Human
ugaggagggguaugaagggaaggga

SEQ ID NO: 546353 - RNA, 18 nt, Human
ugauccacaaaagucaga

SEQ ID NO: 546354 - RNA, 22 nt, Human
ugauccacaaaagucagaaacc

SEQ ID NO: 546355 - RNA, 23 nt, Human
ugauccacaaaagucagaaaccu

SEQ ID NO: 546356 - RNA, 23 nt, Human
ugcaaaaugauccacaaaaguca

SEQ ID NO: 546357 - RNA, 21 nt, Human
ugcacugaaaaccauacuaaa

SEQ ID NO: 546358 - RNA, 18 nt, Human
uggcagcagucgaagccc

SEQ ID NO: 546359 - RNA, 24 nt, Human
ugguaacacauuucauugaaaaga

SEQ ID NO: 546360 - RNA, 26 nt, Human
uguuuuacaccuccaaaccaucuuca

SEQ ID NO: 546361 - RNA, 21 nt, Human
uucauugaaaagauguuuuuu

SEQ ID NO: 546362 - RNA, 19 nt, Human
uuccaaaaaacggaucccg

SEQ ID NO: 546363 - RNA, 19 nt, Human
uuccgguggguggacagcu

SEQ ID NO: 546364 - RNA, 21 nt, Human
aaaaauaaaaaagggaagccg

SEQ ID NO: 546365 - RNA, 25 nt, Human
aaaauuagaaacaaccuaaauaguu

SEQ ID NO: 546366 - RNA, 27 nt, Human
aaaccacacaaaaucuuuuaaaagucu

SEQ ID NO: 546367 - RNA, 23 nt, Human
aacgcacggccacccacccgcgc

SEQ ID NO: 546368 - RNA, 23 nt, Human
aacgcacggccacccacccgcgc

SEQ ID NO: 546369 - RNA, 20 nt, Human
aaugaaaauuagaaacaacc

SEQ ID NO: 546370 - RNA, 23 nt, Human
acacaaaaucuuuuaaaagucua

SEQ ID NO: 546371 - RNA, 22 nt, Human
accacaaagcccguccgcggcg

SEQ ID NO: 546372 - RNA, 18 nt, Human
acccacacucucacuggc

SEQ ID NO: 546373 - RNA, 18 nt, Human
acccacacucucacuggc

SEQ ID NO: 546374 - RNA, 24 nt, Human
acuggcacucgcacgcgcgccccc

SEQ ID NO: 546375 - RNA, 21 nt, Human
agcccguccgcggcgggacag

SEQ ID NO: 546376 - RNA, 22 nt, Human
aggcauacauggggguugcuuu

SEQ ID NO: 546377 - RNA, 21 nt, Human
agggauggggaucaagaugag

SEQ ID NO: 546378 - RNA, 20 nt, Human
auaauuccaacuuacaguuu

SEQ ID NO: 546379 - RNA, 21 nt, Human
auacauuucugcauuuuucaa

SEQ ID NO: 546380 - RNA, 18 nt, Human
auggaauauaauauagcc

SEQ ID NO: 546381 - RNA, 28 nt, Human
caaaccacacaaaaucuuuuaaaagucu

SEQ ID NO: 546382 - RNA, 18 nt, Human
caagaacgcacggccacc

SEQ ID NO: 546383 - RNA, 18 nt, Human
caagaacgcacggccacc

SEQ ID NO: 546384 - RNA, 21 nt, Human
cacaaaaucuuuuaaaagucu

SEQ ID NO: 546385 - RNA, 21 nt, Human
cacaaagcccguccgcggcgg

SEQ ID NO: 546386 - RNA, 22 nt, Human
cacccgcgccgcggcccacagc

SEQ ID NO: 546387 - RNA, 22 nt, Human
cacccgcgccgcggcccacagc

SEQ ID NO: 546388 - RNA, 22 nt, Human
cacgccccagaacuacgggaga

SEQ ID NO: 546389 - RNA, 22 nt, Human
cacgccccagaacuacgggaga

SEQ ID NO: 546390 - RNA, 18 nt, Human
cagcgcgcacccacacuc

SEQ ID NO: 546391 - RNA, 18 nt, Human
cagcgcgcacccacacuc

SEQ ID NO: 546392 - RNA, 26 nt, Human
caguccugagaagucagguacucaga

SEQ ID NO: 546393 - RNA, 29 nt, Human
cauacugcauacauacauuacaugcaugg

SEQ ID NO: 546394 - RNA, 22 nt, Human
caugcaugcuuucuaaacaaaa

SEQ ID NO: 546395 - RNA, 18 nt, Human
ccaaccacaaagcccguc

SEQ ID NO: 546396 - RNA, 18 nt, Human
cccacccgcgccgcggcc

SEQ ID NO: 546397 - RNA, 18 nt, Human
cccacccgcgccgcggcc

SEQ ID NO: 546398 - RNA, 18 nt, Human
cccacccgcgccgcggcc

SEQ ID NO: 546399 - RNA, 18 nt, Human
cccacccgcgccgcggcc

SEQ ID NO: 546400 - RNA, 20 nt, Human
cccacccgcgccgcggccca

SEQ ID NO: 546401 - RNA, 20 nt, Human
cccacccgcgccgcggccca

SEQ ID NO: 546402 - RNA, 19 nt, Human
cccccaaccacaaagcccg

SEQ ID NO: 546403 - RNA, 19 nt, Human
cccgcgccgcggcccacag

SEQ ID NO: 546404 - RNA, 19 nt, Human
cccgcgccgcggcccacag

SEQ ID NO: 546405 - RNA, 26 nt, Human
ccgggcggcugcaggcaacuucccuc

SEQ ID NO: 546406 - RNA, 25 nt, Human
ccgggcggcugcggcaacuucccuc

SEQ ID NO: 546407 - RNA, 24 nt, Human
ccuaaacaaauacuggcuuugaag

SEQ ID NO: 546408 - RNA, 26 nt, Human
ccuccugcaggccggcucgcaagaac

SEQ ID NO: 546409 - RNA, 26 nt, Human
ccuccugcaggccggcucgcaagaac

SEQ ID NO: 546410 - RNA, 20 nt, Human
ccugagaagucagguacuca

SEQ ID NO: 546411 - RNA, 20 nt, Human
cgcacgcgcgcccccaacca

SEQ ID NO: 546412 - RNA, 21 nt, Human
cgcccccaaccacaaagcccg

SEQ ID NO: 546413 - RNA, 24 nt, Human
cgcccccaaccacaaagcccgucc

SEQ ID NO: 546414 - RNA, 26 nt, Human
cgcccccaaccacaaagcccguccgc

SEQ ID NO: 546415 - RNA, 20 nt, Human
cgcggcccacagcgcgcacc

SEQ ID NO: 546416 - RNA, 20 nt, Human
cgcggcccacagcgcgcacc

SEQ ID NO: 546417 - RNA, 19 nt, Human
cgcgggacaggagggccgg

SEQ ID NO: 546418 - RNA, 19 nt, Human
cgcgggacaggagggccgg

SEQ ID NO: 546419 - RNA, 19 nt, Human
cggcccgggcggcugcagg

SEQ ID NO: 546420 - RNA, 21 nt, Human
cggcccgggcggcugcggcaa

SEQ ID NO: 546421 - RNA, 18 nt, Human
cuaaauggacacuccaga

SEQ ID NO: 546422 - RNA, 21 nt, Human
cuccaagagaggacggcuggu

SEQ ID NO: 546423 - RNA, 20 nt, Human
cucgcacgcgcgcccccaaa

SEQ ID NO: 546424 - RNA, 22 nt, Human
gauauuaucaguaaucauuuuu

SEQ ID NO: 546425 - RNA, 21 nt, Human
gauggggagcuucauaaauca

SEQ ID NO: 546426 - RNA, 20 nt, Human
gcaagaacgcacggccaccc

SEQ ID NO: 546427 - RNA, 20 nt, Human
gcaagaacgcacggccaccc

SEQ ID NO: 546428 - RNA, 23 nt, Human
gcacccacacucucacuggcacu

SEQ ID NO: 546429 - RNA, 23 nt, Human
gcacccacacucucacuggcacu

SEQ ID NO: 546430 - RNA, 18 nt, Human
gccggcggcccgggcggc

SEQ ID NO: 546431 - RNA, 21 nt, Human
gcgcgcccccaaccacaaagc

SEQ ID NO: 546432 - RNA, 20 nt, Human
ggaggccaggggagccucgc

SEQ ID NO: 546433 - RNA, 20 nt, Human
ggaggccaggggagccucgc

SEQ ID NO: 546434 - RNA, 19 nt, Human
ggcauacugcauacauaca

SEQ ID NO: 546435 - RNA, 19 nt, Human
ggcccgggcggcugcggca

SEQ ID NO: 546436 - RNA, 20 nt, Human
gggauggggaucaagaugag

SEQ ID NO: 546437 - RNA, 20 nt, Human
gggccggcggcccgggcggc

SEQ ID NO: 546438 - RNA, 22 nt, Human
gguggugaacacgccccagaac

SEQ ID NO: 546439 - RNA, 22 nt, Human
gguggugaacacgccccagaac

SEQ ID NO: 546440 - RNA, 24 nt, Human
uaaacaaauacuggcuuugaaguc

SEQ ID NO: 546441 - RNA, 23 nt, Human
uaaacaguuaauauugugauuag

SEQ ID NO: 546442 - RNA, 21 nt, Human
uaaaucagacguccaccuggc

SEQ ID NO: 546443 - RNA, 21 nt, Human
uacaugcaugcuuucuaaaca

SEQ ID NO: 546444 - RNA, 24 nt, Human
uacgggagacaaauuuucuuguuu

SEQ ID NO: 546445 - RNA, 24 nt, Human
uacgggagacaaauuuucuuguuu

SEQ ID NO: 546446 - RNA, 27 nt, Human
uagccagaauuuauucugacuugcacc

SEQ ID NO: 546447 - RNA, 23 nt, Human
uaggagaagcuguguaccugaug

SEQ ID NO: 546448 - RNA, 23 nt, Human
uaggagaagcuguguaccuggcg

SEQ ID NO: 546449 - RNA, 19 nt, Human
uagguggugaacacgcccc

SEQ ID NO: 546450 - RNA, 19 nt, Human
uagguggugaacacgcccc

SEQ ID NO: 546451 - RNA, 24 nt, Human
uauacaauacacauauaggcauac

SEQ ID NO: 546452 - RNA, 22 nt, Human
uauaucaagucuuguggggucc

SEQ ID NO: 546453 - RNA, 21 nt, Human
uccgcggcgggacagugugag

SEQ ID NO: 546454 - RNA, 19 nt, Human
ucgcacgcgcgcccccaaa

SEQ ID NO: 546455 - RNA, 25 nt, Human
ucgcacgcgcgcccccaaacacccc

SEQ ID NO: 546456 - RNA, 21 nt, Human
ucuaugacuuuuuuggaauac

SEQ ID NO: 546457 - RNA, 19 nt, Human
ucugugguuguagguggug

SEQ ID NO: 546458 - RNA, 19 nt, Human
ucugugguuguagguggug

SEQ ID NO: 546459 - RNA, 20 nt, Human
ucuuguuugcugaucagauc

SEQ ID NO: 546460 - RNA, 20 nt, Human
ucuuguuugcugaucagauc

SEQ ID NO: 546461 - RNA, 18 nt, Human
ugaccuaaacaaauacug

SEQ ID NO: 546462 - RNA, 20 nt, Human
ugaccuaaacaaauacuggc

SEQ ID NO: 546463 - RNA, 23 nt, Human
ugcauacauacauuacaugcaug

SEQ ID NO: 546464 - RNA, 27 nt, Human
ugcauacauacauuacaugcaugcuuu

SEQ ID NO: 546465 - RNA, 28 nt, Human
ugcauacauacauuacaugcaugcuuuc

SEQ ID NO: 546466 - RNA, 22 nt, Human
uggcaauuuugcaaugaaaaag

SEQ ID NO: 546467 - RNA, 22 nt, Human
uggcacucgcacgcgcgccccc

SEQ ID NO: 546468 - RNA, 21 nt, Human
uggcgcgggacaggagggccg

SEQ ID NO: 546469 - RNA, 21 nt, Human
uggcgcgggacaggagggccg

SEQ ID NO: 546470 - RNA, 19 nt, Human
ugggaacaauauuauagug

SEQ ID NO: 546471 - RNA, 24 nt, Human
uguggcaauuuugcaaugaaaaag

SEQ ID NO: 546472 - RNA, 22 nt, Human
ugugguuguagguggugaacac

SEQ ID NO: 546473 - RNA, 22 nt, Human
ugugguuguagguggugaacac

SEQ ID NO: 546474 - RNA, 23 nt, Human
uuacaguaugacuccaauuaugu

SEQ ID NO: 546475 - RNA, 18 nt, Human
uuaguauccuuuuaaucu

SEQ ID NO: 546476 - RNA, 31 nt, Human
uucuaugacuuuuuuggaauacauaucacuu

SEQ ID NO: 546477 - RNA, 24 nt, Human
uuuacaguaugacuccaauuaugu

SEQ ID NO: 546478 - RNA, 24 nt, Human
uuuauacauuucugcauuuuucaa

SEQ ID NO: 546479 - RNA, 18 nt, Human
uuucagaagggauggggu

SEQ ID NO: 546480 - RNA, 22 nt, Human
uuugaagucuagguucuauuuc

SEQ ID NO: 546481 - RNA, 22 nt, Human
uuuuucaaguuuucuaugauga

SEQ ID NO: 546482 - RNA, 18 nt, Human
accugggugggccgagag

SEQ ID NO: 546483 - RNA, 18 nt, Human
ggugggccgagaggcauc

SEQ ID NO: 546484 - RNA, 21 nt, Human
gugggccgagaggcauccaga

SEQ ID NO: 546485 - RNA, 18 nt, Human
ugggccgagaggcaucca

SEQ ID NO: 546486 - RNA, 24 nt, Human
ugggugggccgagaggcauccaga

SEQ ID NO: 546487 - RNA, 19 nt, Human
cagcgcagggcagcagcag

SEQ ID NO: 546488 - RNA, 20 nt, Human
cucccggacgugaccccggc

SEQ ID NO: 546489 - RNA, 22 nt, Human
ggagggcaguguagccgaggug

SEQ ID NO: 546490 - RNA, 25 nt, Human
gggcaguguagccgaggucgggccc

SEQ ID NO: 546491 - RNA, 18 nt, Human
gugaaauguagccucccc

SEQ ID NO: 546492 - RNA, 23 nt, Human
uaaaaacaccguuaguugccuac

SEQ ID NO: 546493 - RNA, 20 nt, Human
ugaaaaaaaaaaaaaaacca

SEQ ID NO: 546494 - RNA, 21 nt, Human
uucaguuuccuacagauuuug

SEQ ID NO: 546495 - RNA, 22 nt, Human
uucaugaaaaaaaaaaaaaaac

SEQ ID NO: 546496 - RNA, 24 nt, Human
uuucaugaaaaaaaaaaaaaaacc

SEQ ID NO: 546497 - RNA, 22 nt, Human
aaaaaacucugagccacagcua

SEQ ID NO: 546498 - RNA, 26 nt, Human
aaagaaaaaacucugagccacagcua

SEQ ID NO: 546499 - RNA, 21 nt, Human
aacaaaaagaaaaaacucuga

SEQ ID NO: 546500 - RNA, 22 nt, Human
aacaacucuuucuucccugcaa

SEQ ID NO: 546501 - RNA, 18 nt, Human
aacagccacaugugcccc

SEQ ID NO: 546502 - RNA, 21 nt, Human
aacagugggaugcagaaagaa

SEQ ID NO: 546503 - RNA, 20 nt, Human
aaccugacauuccacccagu

SEQ ID NO: 546504 - RNA, 21 nt, Human
aauagugccuaaggcagguac

SEQ ID NO: 546505 - RNA, 19 nt, Human
acacaagcuagaaaaaccc

SEQ ID NO: 546506 - RNA, 18 nt, Human
acaguggagagugucugc

SEQ ID NO: 546507 - RNA, 23 nt, Human
acuucugucacacaagcuagaaa

SEQ ID NO: 546508 - RNA, 21 nt, Human
agaaaaacccuaccucuccca

SEQ ID NO: 546509 - RNA, 18 nt, Human
agaaaauaacauaaauug

SEQ ID NO: 546510 - RNA, 19 nt, Human
agaaagaaugacaacagcc

SEQ ID NO: 546511 - RNA, 19 nt, Human
agugccuaaggcagguacu

SEQ ID NO: 546512 - RNA, 21 nt, Human
caaaaagaaaaaacucugagc

SEQ ID NO: 546513 - RNA, 19 nt, Human
caacaaaaagaaaaaacuc

SEQ ID NO: 546514 - RNA, 21 nt, Human
cacaagcuagaaaaacccuac

SEQ ID NO: 546515 - RNA, 20 nt, Human
caccagcaaccaauucuugc

SEQ ID NO: 546516 - RNA, 20 nt, Human
cacuucucuucccugucuca

SEQ ID NO: 546517 - RNA, 24 nt, Human
cagaaagaaugacaacagccacau

SEQ ID NO: 546518 - RNA, 21 nt, Human
caggcugggcugggcgccggc

SEQ ID NO: 546519 - RNA, 26 nt, Human
ccauacuauguauuccuccucuugga

SEQ ID NO: 546520 - RNA, 24 nt, Human
ccccucgccuccuccccuuucugg

SEQ ID NO: 546521 - RNA, 23 nt, Human
ccccuuucuggaggggcgggggc

SEQ ID NO: 546522 - RNA, 18 nt, Human
ccgcggcgggcuccccuc

SEQ ID NO: 546523 - RNA, 20 nt, Human
ccucgccuccuccccuuucu

SEQ ID NO: 546524 - RNA, 29 nt, Human
ccugaccucagccccacacaccgguuccg

SEQ ID NO: 546525 - RNA, 25 nt, Human
ccugaccucagccccacaccgguuc

SEQ ID NO: 546526 - RNA, 21 nt, Human
cggccuccgcggcgggcuccc

SEQ ID NO: 546527 - RNA, 22 nt, Human
cggcgggcuccccucgccuccu

SEQ ID NO: 546528 - RNA, 23 nt, Human
cuagaaaaacccuaccucuccca

SEQ ID NO: 546529 - RNA, 19 nt, Human
cucggccuccgcggcgggc

SEQ ID NO: 546530 - RNA, 21 nt, Human
cuggggauccugccauggaug

SEQ ID NO: 546531 - RNA, 20 nt, Human
cuuauacuccugaccucagc

SEQ ID NO: 546532 - RNA, 18 nt, Human
cuugcacuucucuucccu

SEQ ID NO: 546533 - RNA, 20 nt, Human
gaaaaacccuaccucuccca

SEQ ID NO: 546534 - RNA, 18 nt, Human
gaacagugggaugcagaa

SEQ ID NO: 546535 - RNA, 20 nt, Human
gcagaaagaaugacaacagc

SEQ ID NO: 546536 - RNA, 21 nt, Human
gcagcagaagaugccaaccaa

SEQ ID NO: 546537 - RNA, 19 nt, Human
ggaacugaaaaacagggua

SEQ ID NO: 546538 - RNA, 22 nt, Human
guagaacccagagaaaauguca

SEQ ID NO: 546539 - RNA, 25 nt, Human
uaaaguagaacccagagaaaauguc

SEQ ID NO: 546540 - RNA, 24 nt, Human
uaggcugguuugugcaagagggcc

SEQ ID NO: 546541 - RNA, 24 nt, Human
uauacuccugaccucagccccaca

SEQ ID NO: 546542 - RNA, 22 nt, Human
uauuccuccucuuggagaauua

SEQ ID NO: 546543 - RNA, 21 nt, Human
ucacacaagcuagaaaaaccc

SEQ ID NO: 546544 - RNA, 22 nt, Human
uccgcggcgggcuccccucgcc

SEQ ID NO: 546545 - RNA, 21 nt, Human
uccuaguucucuagacugccu

SEQ ID NO: 546546 - RNA, 20 nt, Human
ugaaauggugagaacuguaa

SEQ ID NO: 546547 - RNA, 22 nt, Human
ugacaacagccacaugugcccc

SEQ ID NO: 546548 - RNA, 21 nt, Human
ugaccucagccccacacacuc

SEQ ID NO: 546549 - RNA, 25 nt, Human
ugcagaaagaaugacaacagccaca

SEQ ID NO: 546550 - RNA, 21 nt, Human
ugcagcagaagaugccaacca

SEQ ID NO: 546551 - RNA, 18 nt, Human
ugggaggggggaggacca

SEQ ID NO: 546552 - RNA, 18 nt, Human
uguaaagauuuuaaaaaa

SEQ ID NO: 546553 - RNA, 18 nt, Human
ugucugccuuaggcuggu

SEQ ID NO: 546554 - RNA, 18 nt, Human
uuagucccugcagcagaa

SEQ ID NO: 546555 - RNA, 20 nt, Human
uucuugcacuucucuucccu

SEQ ID NO: 546556 - RNA, 19 nt, Human
uuggaggggaacaguggga

SEQ ID NO: 546557 - RNA, 22 nt, Human
uuuaaaaaauaaaguagaaccc

SEQ ID NO: 546558 - RNA, 27 nt, Human
aaaaguccuucauuuccaacccugccu

SEQ ID NO: 546559 - RNA, 18 nt, Human
aacaggcugaagggggag

SEQ ID NO: 546560 - RNA, 23 nt, Human
aacccuggcugcugcagaaacag

SEQ ID NO: 546561 - RNA, 20 nt, Human
aaguggcuguuugcuacaaa

SEQ ID NO: 546562 - RNA, 18 nt, Human
agaaaggugccuaccucc

SEQ ID NO: 546563 - RNA, 20 nt, Human
agaggcaggcccucgcccuu

SEQ ID NO: 546564 - RNA, 20 nt, Human
agaggggaagagagcggggc

SEQ ID NO: 546565 - RNA, 24 nt, Human
agaggggaagagagcggggcuaga

SEQ ID NO: 546566 - RNA, 22 nt, Human
agcacaggccgugacugcuggg

SEQ ID NO: 546567 - RNA, 18 nt, Human
aggaaggaaggcaagggc

SEQ ID NO: 546568 - RNA, 21 nt, Human
aggaaugucugucuggcucug

SEQ ID NO: 546569 - RNA, 22 nt, Human
aggcaagggcuuucuaggccuc

SEQ ID NO: 546570 - RNA, 24 nt, Human
agggcggucaggggaacuucacag

SEQ ID NO: 546571 - RNA, 23 nt, Human
agugggaggaaggaaggcaaggg

SEQ ID NO: 546572 - RNA, 19 nt, Human
aucacaaauuggggcugcg

SEQ ID NO: 546573 - RNA, 25 nt, Human
caaaggacacggcaggucagaggca

SEQ ID NO: 546574 - RNA, 23 nt, Human
caacggaagaguuaaccaggccu

SEQ ID NO: 546575 - RNA, 21 nt, Human
caagcauaaagccccaucuuc

SEQ ID NO: 546576 - RNA, 22 nt, Human
cacagaaaugaaaggccccuga

SEQ ID NO: 546577 - RNA, 20 nt, Human
caccgcagcuuucuuaaugc

SEQ ID NO: 546578 - RNA, 22 nt, Human
caccuaccucucugccccuccc

SEQ ID NO: 546579 - RNA, 22 nt, Human
cagugcggggaggggugucugg

SEQ ID NO: 546580 - RNA, 19 nt, Human
ccacagaaaugaaaggccc

SEQ ID NO: 546581 - RNA, 24 nt, Human
ccacagaaaugaaaggccccugag

SEQ ID NO: 546582 - RNA, 18 nt, Human
ccaggccuggagaaagaa

SEQ ID NO: 546583 - RNA, 20 nt, Human
ccccugagagccauggagga

SEQ ID NO: 546584 - RNA, 22 nt, Human
ccccuggaaaaugggggacaga

SEQ ID NO: 546585 - RNA, 18 nt, Human
cccuuucugcccugccuc

SEQ ID NO: 546586 - RNA, 22 nt, Human
ccgcagcuuucuuaaugcucuu

SEQ ID NO: 546587 - RNA, 21 nt, Human
ccuaccucucugccccuccca

SEQ ID NO: 546588 - RNA, 24 nt, Human
ccuaccucucugccccucccacag

SEQ ID NO: 546589 - RNA, 19 nt, Human
ccucccacagaaaugaaag

SEQ ID NO: 546590 - RNA, 18 nt, Human
ccugcagaggguguaggg

SEQ ID NO: 546591 - RNA, 19 nt, Human
cgcccuuucugcccugccu

SEQ ID NO: 546592 - RNA, 20 nt, Human
cucccacagaaaugaaaggc

SEQ ID NO: 546593 - RNA, 22 nt, Human
cucugcgcugaggcugccauuc

SEQ ID NO: 546594 - RNA, 22 nt, Human
cugagagccauggaggaggugc

SEQ ID NO: 546595 - RNA, 25 nt, Human
cugaguggaguccaggacaaagcac

SEQ ID NO: 546596 - RNA, 18 nt, Human
cugcugcuggaucacaaa

SEQ ID NO: 546597 - RNA, 26 nt, Human
cugcuggaucacaaauuggggcugca

SEQ ID NO: 546598 - RNA, 21 nt, Human
cugggcuggagggccacgcuu

SEQ ID NO: 546599 - RNA, 18 nt, Human
cuucacagugcggggagg

SEQ ID NO: 546600 - RNA, 20 nt, Human
gaaaaugggggacagaaaga

SEQ ID NO: 546601 - RNA, 23 nt, Human
gaacccuggcugcugcagaaaca

SEQ ID NO: 546602 - RNA, 18 nt, Human
gacuuuggaggaagccag

SEQ ID NO: 546603 - RNA, 19 nt, Human
gaggaaggaaggcaagggc

SEQ ID NO: 546604 - RNA, 20 nt, Human
gaggaaggaaggcaagggcu

SEQ ID NO: 546605 - RNA, 19 nt, Human
gcaugggccucugagcugg

SEQ ID NO: 546606 - RNA, 21 nt, Human
gccagagaguagcccuuggcc

SEQ ID NO: 546607 - RNA, 21 nt, Human
gccauggaggaggugcccaga

SEQ ID NO: 546608 - RNA, 20 nt, Human
gccccuagggagagccccug

SEQ ID NO: 546609 - RNA, 20 nt, Human
gcugaagggggagaagcuga

SEQ ID NO: 546610 - RNA, 22 nt, Human
gcuuggagagacugaggcgagc

SEQ ID NO: 546611 - RNA, 18 nt, Human
ggccaggaggcucagccc

SEQ ID NO: 546612 - RNA, 20 nt, Human
gggaagagagcggggcuaga

SEQ ID NO: 546613 - RNA, 19 nt, Human
gggcaggcaggccaggagg

SEQ ID NO: 546614 - RNA, 22 nt, Human
gggcaggcaggccaggaggcuc

SEQ ID NO: 546615 - RNA, 26 nt, Human
gggcgggcaggcaggccaggaggcuc

SEQ ID NO: 546616 - RNA, 22 nt, Human
ggggagcccugaccauauaccc

SEQ ID NO: 546617 - RNA, 19 nt, Human
ggggcggcggcugcugcug

SEQ ID NO: 546618 - RNA, 22 nt, Human
gggguggggcucagcuuggagc

SEQ ID NO: 546619 - RNA, 19 nt, Human
ggugggcgggcaggcaggc

SEQ ID NO: 546620 - RNA, 18 nt, Human
uacccccuggaaaauggg

SEQ ID NO: 546621 - RNA, 23 nt, Human
uauuccccauccugaggcugagu

SEQ ID NO: 546622 - RNA, 19 nt, Human
ucaauauuuacaagcauaa

SEQ ID NO: 546623 - RNA, 19 nt, Human
ucacaucaacagaaacucc

SEQ ID NO: 546624 - RNA, 19 nt, Human
ucaccacugggacucccag

SEQ ID NO: 546625 - RNA, 23 nt, Human
ucagaaaggugccuaccuccuuc

SEQ ID NO: 546626 - RNA, 20 nt, Human
ucagucgggaggaggcgccc

SEQ ID NO: 546627 - RNA, 24 nt, Human
uccagcuguucuuuccccuuagca

SEQ ID NO: 546628 - RNA, 21 nt, Human
uccaggcucccacacagucac

SEQ ID NO: 546629 - RNA, 20 nt, Human
ucccacacagucacacaguc

SEQ ID NO: 546630 - RNA, 19 nt, Human
ucgggaggaggcgcccugg

SEQ ID NO: 546631 - RNA, 19 nt, Human
ucuccaccugcagagggug

SEQ ID NO: 546632 - RNA, 20 nt, Human
ucugagcugggcuggagggc

SEQ ID NO: 546633 - RNA, 18 nt, Human
ugagcugggcuggagggc

SEQ ID NO: 546634 - RNA, 19 nt, Human
ugaggcugccauucuuggc

SEQ ID NO: 546635 - RNA, 18 nt, Human
ugcccuugaaguaaccca

SEQ ID NO: 546636 - RNA, 18 nt, Human
ugccugggggugugggug

SEQ ID NO: 546637 - RNA, 18 nt, Human
ugccugggggugugggug

SEQ ID NO: 546638 - RNA, 20 nt, Human
ugcggggaggggugucugga

SEQ ID NO: 546639 - RNA, 18 nt, Human
ugcugcagaaacaggcug

SEQ ID NO: 546640 - RNA, 19 nt, Human
ugcuggggcggcggcugcu

SEQ ID NO: 546641 - RNA, 24 nt, Human
uggaaaggaaacucugaagcgccg

SEQ ID NO: 546642 - RNA, 23 nt, Human
uggagcacaggccgugacugcug

SEQ ID NO: 546643 - RNA, 18 nt, Human
uggcucugcucagucggg

SEQ ID NO: 546644 - RNA, 20 nt, Human
uggcugcugcagaaacaggc

SEQ ID NO: 546645 - RNA, 21 nt, Human
ugggaggaaggaaggcaaggg

SEQ ID NO: 546646 - RNA, 24 nt, Human
ugggaggaaggaaggcaagggcuu

SEQ ID NO: 546647 - RNA, 18 nt, Human
ugggaggccaagagcugc

SEQ ID NO: 546648 - RNA, 22 nt, Human
ugggagugggaggccaagagcu

SEQ ID NO: 546649 - RNA, 21 nt, Human
ugggccagaauccuggcugcc

SEQ ID NO: 546650 - RNA, 18 nt, Human
ugggcgggcaggcaggcc

SEQ ID NO: 546651 - RNA, 21 nt, Human
ugggcuggagggccacgcuug

SEQ ID NO: 546652 - RNA, 23 nt, Human
ugucuggaaaggaaacucugaag

SEQ ID NO: 546653 - RNA, 20 nt, Human
ugucuggcucugcucagucg

SEQ ID NO: 546654 - RNA, 28 nt, Human
ugugccaccuaccucucugccccuccca

SEQ ID NO: 546655 - RNA, 18 nt, Human
ugugggagugggaggcca

SEQ ID NO: 546656 - RNA, 21 nt, Human
ugugggagugggaggccaaga

SEQ ID NO: 546657 - RNA, 24 nt, Human
uguucuuuccccuuagcaguucuc

SEQ ID NO: 546658 - RNA, 18 nt, Human
uucuuggcuauuccccau

SEQ ID NO: 546659 - RNA, 21 nt, Human
uuggcuauuccccauccugag

SEQ ID NO: 546660 - RNA, 20 nt, Human
uuucugcccugccuccuccu

SEQ ID NO: 546661 - RNA, 27 nt, Human
cugccccaucagggccacuuggacgac

SEQ ID NO: 546662 - RNA, 24 nt, Human
gcacagaaucuucaugagaagcca

SEQ ID NO: 546663 - RNA, 18 nt, Human
ucgcugccccaucagggc

SEQ ID NO: 546664 - RNA, 24 nt, Human
ucgcugccccaucagggccacuug

SEQ ID NO: 546665 - RNA, 20 nt, Human
aaccaaguguccaaaccaaa

SEQ ID NO: 546666 - RNA, 26 nt, Human
accaccacccgggcccgccgcgguga

SEQ ID NO: 546667 - RNA, 18 nt, Human
accaugaacccacauaua

SEQ ID NO: 546668 - RNA, 21 nt, Human
agaaagaaguaagcuauggaa

SEQ ID NO: 546669 - RNA, 24 nt, Human
caaaccaaauaguaguccaagacc

SEQ ID NO: 546670 - RNA, 20 nt, Human
ccaaaccaaauaguagucca

SEQ ID NO: 546671 - RNA, 27 nt, Human
ccaaaccaaauaguaguccaagaccuc

SEQ ID NO: 546672 - RNA, 22 nt, Human
ccaccacccgggcccgccgcgg

SEQ ID NO: 546673 - RNA, 24 nt, Human
ccauaacauuccaaaauauacuaa

SEQ ID NO: 546674 - RNA, 22 nt, Human
cccacauauaagagaaaaaggc

SEQ ID NO: 546675 - RNA, 23 nt, Human
cccacauauaagagaaaaaggca

SEQ ID NO: 546676 - RNA, 24 nt, Human
ccugcgcggggccacucacuacuc

SEQ ID NO: 546677 - RNA, 23 nt, Human
cgccgcggugacucuccagaccc

SEQ ID NO: 546678 - RNA, 21 nt, Human
ggaccgggaaggaggucgggc

SEQ ID NO: 546679 - RNA, 21 nt, Human
uaacauaacaaucgaacugaa

SEQ ID NO: 546680 - RNA, 18 nt, Human
uaaccaccacccgggccc

SEQ ID NO: 546681 - RNA, 19 nt, Human
uaacuucacaaagagaaua

SEQ ID NO: 546682 - RNA, 22 nt, Human
uaacuucacaaagagaauauuu

SEQ ID NO: 546683 - RNA, 22 nt, Human
uaagagaaaaaggcagaggaaa

SEQ ID NO: 546684 - RNA, 23 nt, Human
uaagagaaaaaggcagaggaaag

SEQ ID NO: 546685 - RNA, 24 nt, Human
uaagauaaacuguauuuagaacac

SEQ ID NO: 546686 - RNA, 24 nt, Human
uaauuaauauuguuaaaacaaaaa

SEQ ID NO: 546687 - RNA, 20 nt, Human
uagaacacccaaguaguaaa

SEQ ID NO: 546688 - RNA, 23 nt, Human
uagaacacccaaguaguaaauuc

SEQ ID NO: 546689 - RNA, 28 nt, Human
uaggagaaagaaguaagcuauggaaaaa

SEQ ID NO: 546690 - RNA, 18 nt, Human
ucacaaaaauagaagagu

SEQ ID NO: 546691 - RNA, 24 nt, Human
uccaggggcuaaaugggaaaaaag

SEQ ID NO: 546692 - RNA, 19 nt, Human
ucuaaacuuggcaugaaag

SEQ ID NO: 546693 - RNA, 18 nt, Human
ucucacaaaaauagaaga

SEQ ID NO: 546694 - RNA, 26 nt, Human
ugcuauuuucuguccaaaguuuauuu

SEQ ID NO: 546695 - RNA, 21 nt, Human
ugggcgggcgggagggacugg

SEQ ID NO: 546696 - RNA, 25 nt, Human
uguccaaaccaaauaguaguccaag

SEQ ID NO: 546697 - RNA, 21 nt, Human
uucauuggcuaauucuaaacu

SEQ ID NO: 546698 - RNA, 18 nt, Human
uuugaauucauauuacua

SEQ ID NO: 546699 - RNA, 22 nt, Human
aaaauugcaaaacuucagcuaa

SEQ ID NO: 546700 - RNA, 18 nt, Human
aaaugucaucuacuaaaa

SEQ ID NO: 546701 - RNA, 21 nt, Human
agaguacauuuuccauuuaaa

SEQ ID NO: 546702 - RNA, 24 nt, Human
caacuucaacaaauaaugaaugac

SEQ ID NO: 546703 - RNA, 21 nt, Human
cauaaaaauugcaaaacuuca

SEQ ID NO: 546704 - RNA, 19 nt, Human
caucugucuucccuuuugg

SEQ ID NO: 546705 - RNA, 24 nt, Human
ccuguggucuagaguacauuuucc

SEQ ID NO: 546706 - RNA, 24 nt, Human
gucuucccuuuuggcuuccuuggc

SEQ ID NO: 546707 - RNA, 21 nt, Human
uaaaaauugcaaaacuucagc

SEQ ID NO: 546708 - RNA, 22 nt, Human
uaaaaauugcaaaacuucagcu

SEQ ID NO: 546709 - RNA, 18 nt, Human
ucaucuacuaaaaacaag

SEQ ID NO: 546710 - RNA, 24 nt, Human
ucccuuuuggcuuccuuggcacaa

SEQ ID NO: 546711 - RNA, 23 nt, Human
ucuagaguacauuuuccauuuaa

SEQ ID NO: 546712 - RNA, 20 nt, Human
ucucaacuuguuuaauagca

SEQ ID NO: 546713 - RNA, 21 nt, Human
ucugucuucccuuuuggcuuc

SEQ ID NO: 546714 - RNA, 22 nt, Human
ugacauaaaaauugcaaaacuu

SEQ ID NO: 546715 - RNA, 28 nt, Human
uuaauaaauagccaaauauuguaaugac

SEQ ID NO: 546716 - RNA, 30 nt, Human
uuucccacauuuacuagcucacauaaacaa

SEQ ID NO: 546717 - RNA, 26 nt, Human
uuuuuuuuuuuuuuuuucccacauuu

SEQ ID NO: 546718 - RNA, 22 nt, Human
aaaaggugcauuagcuaucaag

SEQ ID NO: 546719 - RNA, 25 nt, Human
aaaaugcuuucuauccucugcaucu

SEQ ID NO: 546720 - RNA, 18 nt, Human
aaacaagagaaaaccaaa

SEQ ID NO: 546721 - RNA, 19 nt, Human
aaacaagagaaaaccaaaa

SEQ ID NO: 546722 - RNA, 23 nt, Human
aaacuccaacuuggacaauuccu

SEQ ID NO: 546723 - RNA, 20 nt, Human
aacaagcucaugacugcaaa

SEQ ID NO: 546724 - RNA, 23 nt, Human
aacugagcagacugcaaacaaga

SEQ ID NO: 546725 - RNA, 23 nt, Human
aagauuccucaguuuuccaacca

SEQ ID NO: 546726 - RNA, 24 nt, Human
aagccagcaugcgagguggggaca

SEQ ID NO: 546727 - RNA, 19 nt, Human
aagcugccucauauuggag

SEQ ID NO: 546728 - RNA, 21 nt, Human
aaggaacucaauuucaaggac

SEQ ID NO: 546729 - RNA, 21 nt, Human
aaguauuuuuaggagaaaguu

SEQ ID NO: 546730 - RNA, 18 nt, Human
aaguggcuaucaaggaga

SEQ ID NO: 546731 - RNA, 20 nt, Human
aaucacgauccccuccuccu

SEQ ID NO: 546732 - RNA, 23 nt, Human
aaugacauucucucuaugaagac

SEQ ID NO: 546733 - RNA, 18 nt, Human
acaaagaaagcaacugca

SEQ ID NO: 546734 - RNA, 24 nt, Human
acacaaccccaugcccacacacgc

SEQ ID NO: 546735 - RNA, 23 nt, Human
acacacacgcacgcacacacaca

SEQ ID NO: 546736 - RNA, 24 nt, Human
acagacagcaaccuucagaagccu

SEQ ID NO: 546737 - RNA, 18 nt, Human
acagaggggaaggaagua

SEQ ID NO: 546738 - RNA, 21 nt, Human
acagugcuauaguggugcuga

SEQ ID NO: 546739 - RNA, 23 nt, Human
acagugcuauaguggugcugaug

SEQ ID NO: 546740 - RNA, 20 nt, Human
accccaugcccacacacgca

SEQ ID NO: 546741 - RNA, 22 nt, Human
accccaugcccacacacgcaca

SEQ ID NO: 546742 - RNA, 21 nt, Human
acgaugccaccaucugcagac

SEQ ID NO: 546743 - RNA, 19 nt, Human
agaaaaccaaaagagaagg

SEQ ID NO: 546744 - RNA, 24 nt, Human
agaaauacuguagcaagguaccau

SEQ ID NO: 546745 - RNA, 24 nt, Human
aggaagaccucaauaucacaacca

SEQ ID NO: 546746 - RNA, 24 nt, Human
aggaugccacuuugguucuuuguu

SEQ ID NO: 546747 - RNA, 22 nt, Human
aggcagagaguuaaaagugagg

SEQ ID NO: 546748 - RNA, 19 nt, Human
aggugggcgacggaggugg

SEQ ID NO: 546749 - RNA, 18 nt, Human
aguggugcugaugcuagc

SEQ ID NO: 546750 - RNA, 21 nt, Human
auacaacuauaaauacccaca

SEQ ID NO: 546751 - RNA, 19 nt, Human
auccucaauuucuucuggc

SEQ ID NO: 546752 - RNA, 21 nt, Human
auccuuuagcaaacaaaauua

SEQ ID NO: 546753 - RNA, 24 nt, Human
augcaaucuacacacugaugcauu

SEQ ID NO: 546754 - RNA, 18 nt, Human
augcauuuacauacauac

SEQ ID NO: 546755 - RNA, 18 nt, Human
auguacauguaccauaca

SEQ ID NO: 546756 - RNA, 20 nt, Human
augucagaaauacuguagca

SEQ ID NO: 546757 - RNA, 21 nt, Human
caaagcaaaagaaaucaagag

SEQ ID NO: 546758 - RNA, 24 nt, Human
caaagcaaaagaaaucaagagcaa

SEQ ID NO: 546759 - RNA, 25 nt, Human
caaagcucuaggucucagugggcua

SEQ ID NO: 546760 - RNA, 23 nt, Human
caaccugcugaaaacucgaccaa

SEQ ID NO: 546761 - RNA, 19 nt, Human
caacugagcagacugcaaa

SEQ ID NO: 546762 - RNA, 23 nt, Human
caacugagcagacugcaaacaag

SEQ ID NO: 546763 - RNA, 20 nt, Human
caacugcagcuacguuuucc

SEQ ID NO: 546764 - RNA, 18 nt, Human
caagagcaaagacaaucu

SEQ ID NO: 546765 - RNA, 20 nt, Human
caaguugcaaaaaucaucaa

SEQ ID NO: 546766 - RNA, 19 nt, Human
cacaaaagaaccuuuaaag

SEQ ID NO: 546767 - RNA, 23 nt, Human
cacaaagcucuaggucucagugg

SEQ ID NO: 546768 - RNA, 23 nt, Human
cacaaccccaugcccacacacgc

SEQ ID NO: 546769 - RNA, 20 nt, Human
cacaagaaaagcuguuucau

SEQ ID NO: 546770 - RNA, 21 nt, Human
cacaagaccacugcaccaaaa

SEQ ID NO: 546771 - RNA, 24 nt, Human
cacacacacgcacgcacacacaca

SEQ ID NO: 546772 - RNA, 23 nt, Human
cacugugauucuuacuggagcau

SEQ ID NO: 546773 - RNA, 19 nt, Human
cagacagcaaccuucagaa

SEQ ID NO: 546774 - RNA, 19 nt, Human
cagaggcgcaucugccugc

SEQ ID NO: 546775 - RNA, 23 nt, Human
cagcucaugacaagcaggcccug

SEQ ID NO: 546776 - RNA, 22 nt, Human
caggacacaaccccaugcccac

SEQ ID NO: 546777 - RNA, 25 nt, Human
caggaugcaacaugcuuaacugaug

SEQ ID NO: 546778 - RNA, 19 nt, Human
caucaaagcaaaagaaauc

SEQ ID NO: 546779 - RNA, 23 nt, Human
caugucacuuuugcccaggggcc

SEQ ID NO: 546780 - RNA, 20 nt, Human
ccaggacacaaccccaugcc

SEQ ID NO: 546781 - RNA, 21 nt, Human
cccacacacgcacacacacgg

SEQ ID NO: 546782 - RNA, 23 nt, Human
ccgaucucaacaacaagugcuaa

SEQ ID NO: 546783 - RNA, 21 nt, Human
ccucauaaacuagacuucagg

SEQ ID NO: 546784 - RNA, 20 nt, Human
ccuguaagaauagucuccaa

SEQ ID NO: 546785 - RNA, 22 nt, Human
cgaucucaacaacaagugcuaa

SEQ ID NO: 546786 - RNA, 21 nt, Human
cggcagucugagauccuggcu

SEQ ID NO: 546787 - RNA, 22 nt, Human
cuaaaugucagaaauacuguag

SEQ ID NO: 546788 - RNA, 22 nt, Human
cucucuauugcuaucaauaauc

SEQ ID NO: 546789 - RNA, 22 nt, Human
cugaaaucacgauccccuccuc

SEQ ID NO: 546790 - RNA, 19 nt, Human
cugcagcuacguuuuccuu

SEQ ID NO: 546791 - RNA, 20 nt, Human
cugguuccucccauagcaua

SEQ ID NO: 546792 - RNA, 20 nt, Human
cuucaaagggacuguaacug

SEQ ID NO: 546793 - RNA, 20 nt, Human
cuugcaaaauuuuccugcug

SEQ ID NO: 546794 - RNA, 22 nt, Human
gaagggauacauaauucauucu

SEQ ID NO: 546795 - RNA, 20 nt, Human
gacugcaaacaagagaaaac

SEQ ID NO: 546796 - RNA, 21 nt, Human
gagauccuggcucacaaaaga

SEQ ID NO: 546797 - RNA, 22 nt, Human
gaggcuacaaaaaucaaucuga

SEQ ID NO: 546798 - RNA, 21 nt, Human
gaguaguagcagagugaagug

SEQ ID NO: 546799 - RNA, 24 nt, Human
gccauauugguaacuauccuguuu

SEQ ID NO: 546800 - RNA, 22 nt, Human
gcccugccucucauccuuccca

SEQ ID NO: 546801 - RNA, 18 nt, Human
gcgcaucugccugcaaag

SEQ ID NO: 546802 - RNA, 19 nt, Human
gcgcugaggugggcgacgg

SEQ ID NO: 546803 - RNA, 20 nt, Human
ggaaaaaauucugucauuug

SEQ ID NO: 546804 - RNA, 22 nt, Human
ggaaaaagaaaaaucaaaguga

SEQ ID NO: 546805 - RNA, 18 nt, Human
ggaaagggaaggggugcu

SEQ ID NO: 546806 - RNA, 18 nt, Human
ggauauccugaugucccc

SEQ ID NO: 546807 - RNA, 18 nt, Human
ggcauggccugggagaca

SEQ ID NO: 546808 - RNA, 23 nt, Human
ggccacagggugaaauacaaacc

SEQ ID NO: 546809 - RNA, 19 nt, Human
gugcagcucaugacaagca

SEQ ID NO: 546810 - RNA, 22 nt, Human
uaaaguaaggacucugcauccc

SEQ ID NO: 546811 - RNA, 21 nt, Human
uaacaacucuuaggaugccac

SEQ ID NO: 546812 - RNA, 20 nt, Human
uaacuugcaaaauuuuccug

SEQ ID NO: 546813 - RNA, 23 nt, Human
uaacuugcuuguggauauguugg

SEQ ID NO: 546814 - RNA, 21 nt, Human
uaagacaauggagaaacuucu

SEQ ID NO: 546815 - RNA, 18 nt, Human
uaagaugcuauaagacug

SEQ ID NO: 546816 - RNA, 25 nt, Human
uaaggacacaagaaaagcuggagac

SEQ ID NO: 546817 - RNA, 22 nt, Human
uacacugcaaaagauucacaaa

SEQ ID NO: 546818 - RNA, 22 nt, Human
uaccauggcuuuacagcagguu

SEQ ID NO: 546819 - RNA, 21 nt, Human
uaccuucagaggaaagggaag

SEQ ID NO: 546820 - RNA, 22 nt, Human
uacuaaaacuacaguuugucca

SEQ ID NO: 546821 - RNA, 20 nt, Human
uagacacuaccauggcuuua

SEQ ID NO: 546822 - RNA, 21 nt, Human
uagaguaagaaaaaucuauuc

SEQ ID NO: 546823 - RNA, 26 nt, Human
uagaugcuuugagacaaaagcagaua

SEQ ID NO: 546824 - RNA, 25 nt, Human
uagcaaacaaaauuaacuggguauc

SEQ ID NO: 546825 - RNA, 22 nt, Human
uagcauaaacucuuggccuccu

SEQ ID NO: 546826 - RNA, 23 nt, Human
uauagaacuagagaaacuuucua

SEQ ID NO: 546827 - RNA, 26 nt, Human
uaucaaucuuuccucagccuucaaag

SEQ ID NO: 546828 - RNA, 23 nt, Human
uaucacaaccaggacacaacccc

SEQ ID NO: 546829 - RNA, 20 nt, Human
uauccagaagucccuggagu

SEQ ID NO: 546830 - RNA, 23 nt, Human
uauccagaagucccuggaguuaa

SEQ ID NO: 546831 - RNA, 20 nt, Human
uauccuguuuguuuugcagu

SEQ ID NO: 546832 - RNA, 20 nt, Human
uaugggccagacucucagaa

SEQ ID NO: 546833 - RNA, 18 nt, Human
uauugcuaucaauaaucu

SEQ ID NO: 546834 - RNA, 23 nt, Human
ucaagggccgauuauugccccca

SEQ ID NO: 546835 - RNA, 24 nt, Human
ucacaagguuaguugaaagucauu

SEQ ID NO: 546836 - RNA, 20 nt, Human
ucacagacuuuuuuuuuuuu

SEQ ID NO: 546837 - RNA, 23 nt, Human
ucagaggacucucucccaucaug

SEQ ID NO: 546838 - RNA, 20 nt, Human
ucauuugaaaagucaaggga

SEQ ID NO: 546839 - RNA, 24 nt, Human
ucccaaaggaaaaugugguuggcu

SEQ ID NO: 546840 - RNA, 20 nt, Human
ucccaaggcuccugggcgcu

SEQ ID NO: 546841 - RNA, 18 nt, Human
uccugggcgcugaggugg

SEQ ID NO: 546842 - RNA, 25 nt, Human
uccuucaugcacucaugacagacag

SEQ ID NO: 546843 - RNA, 22 nt, Human
ucucagaaguucuguagcuugg

SEQ ID NO: 546844 - RNA, 19 nt, Human
ucucuaauucacuggaacc

SEQ ID NO: 546845 - RNA, 18 nt, Human
ucugaaguugugccacuu

SEQ ID NO: 546846 - RNA, 23 nt, Human
ucugccugcaaagcugacuuacc

SEQ ID NO: 546847 - RNA, 21 nt, Human
ugacaagcaggcccugccucu

SEQ ID NO: 546848 - RNA, 18 nt, Human
ugacagcauuuucuuuga

SEQ ID NO: 546849 - RNA, 23 nt, Human
ugacagcauuuucuuugaugacu

SEQ ID NO: 546850 - RNA, 18 nt, Human
ugaccagcacuuccuggc

SEQ ID NO: 546851 - RNA, 19 nt, Human
ugacugcaaggaaaaaugc

SEQ ID NO: 546852 - RNA, 21 nt, Human
ugagacaaaagcagauacuau

SEQ ID NO: 546853 - RNA, 23 nt, Human
ugaggugggcgacggaggugggu

SEQ ID NO: 546854 - RNA, 21 nt, Human
ugaguagacagaaagaaagga

SEQ ID NO: 546855 - RNA, 26 nt, Human
ugaguuuaaguuuaauaaaacaauac

SEQ ID NO: 546856 - RNA, 20 nt, Human
ugcaaaaaucaucaaagcaa

SEQ ID NO: 546857 - RNA, 22 nt, Human
ugcaaaaauucuuccacaaucu

SEQ ID NO: 546858 - RNA, 21 nt, Human
ugcaaaagauucacaagguua

SEQ ID NO: 546859 - RNA, 21 nt, Human
ugcaaagcugacuuaccauuu

SEQ ID NO: 546860 - RNA, 24 nt, Human
ugcaacaacacuaugaccaaggca

SEQ ID NO: 546861 - RNA, 21 nt, Human
ugcccaggggccaguccucau

SEQ ID NO: 546862 - RNA, 18 nt, Human
ugcgcuaaagauggacag

SEQ ID NO: 546863 - RNA, 22 nt, Human
uggacagcaucaugcuacggca

SEQ ID NO: 546864 - RNA, 21 nt, Human
ugggcaaacacauucaagcca

SEQ ID NO: 546865 - RNA, 23 nt, Human
ugggccaauuauugucauaagca

SEQ ID NO: 546866 - RNA, 21 nt, Human
uggucaauuuugcaacaacac

SEQ ID NO: 546867 - RNA, 18 nt, Human
ugucacuuuugcccaggg

SEQ ID NO: 546868 - RNA, 21 nt, Human
ugucuuaaggacacaagaaaa

SEQ ID NO: 546869 - RNA, 18 nt, Human
ugugaugauuugaucaug

SEQ ID NO: 546870 - RNA, 27 nt, Human
uuaaauauauucacggauuaccagaaa

SEQ ID NO: 546871 - RNA, 20 nt, Human
uuacaaagaaagcaacugca

SEQ ID NO: 546872 - RNA, 19 nt, Human
uuacugccuuuacccaaac

SEQ ID NO: 546873 - RNA, 21 nt, Human
uuacugccuuuacccaaacaa

SEQ ID NO: 546874 - RNA, 25 nt, Human
uucaaaggcaaaaugacuccacuuc

SEQ ID NO: 546875 - RNA, 22 nt, Human
uuccaaccauaauucauucuga

SEQ ID NO: 546876 - RNA, 18 nt, Human
uuccugcagacugagcac

SEQ ID NO: 546877 - RNA, 21 nt, Human
uuccugcagacugagcacaug

SEQ ID NO: 546878 - RNA, 25 nt, Human
uucuaagggaggaaaaagaaaaauc

SEQ ID NO: 546879 - RNA, 22 nt, Human
uucuagucuagacccuguggga

SEQ ID NO: 546880 - RNA, 21 nt, Human
uugguucuuuguuuuacagug

SEQ ID NO: 546881 - RNA, 19 nt, Human
uuuggauuucaguccuucc

SEQ ID NO: 546882 - RNA, 23 nt, Human
uuugucuuaaggacacaagaaaa

SEQ ID NO: 546883 - RNA, 18 nt, Human
agggcugguccuggggcg

SEQ ID NO: 546884 - RNA, 18 nt, Human
caccccggccccucgggc

SEQ ID NO: 546885 - RNA, 19 nt, Human
caccccggccccucgggcu

SEQ ID NO: 546886 - RNA, 21 nt, Human
caccgccagcccgcuucaagc

SEQ ID NO: 546887 - RNA, 21 nt, Human
cccucgggcuccggggggggg

SEQ ID NO: 546888 - RNA, 25 nt, Human
ccggcccgcgggcccggguucuccg

SEQ ID NO: 546889 - RNA, 18 nt, Human
ccggcgggggcggcuccu

SEQ ID NO: 546890 - RNA, 22 nt, Human
ccuccugcgaccaccgccagcc

SEQ ID NO: 546891 - RNA, 19 nt, Human
ccuggggcggguggauggc

SEQ ID NO: 546892 - RNA, 20 nt, Human
cgacgccccagaggagaugg

SEQ ID NO: 546893 - RNA, 19 nt, Human
cgccccagaggagauggcc

SEQ ID NO: 546894 - RNA, 20 nt, Human
cgguccgcauccacaccccg

SEQ ID NO: 546895 - RNA, 18 nt, Human
cucccugagggcuggucc

SEQ ID NO: 546896 - RNA, 19 nt, Human
cucgggcuccggggggggg

SEQ ID NO: 546897 - RNA, 23 nt, Human
cuggggcggguggauggccccug

SEQ ID NO: 546898 - RNA, 22 nt, Human
gcccggcgggggcggcuccugg

SEQ ID NO: 546899 - RNA, 19 nt, Human
ggcugguccuggggcgggu

SEQ ID NO: 546900 - RNA, 21 nt, Human
gggccgaggucaggcggucca

SEQ ID NO: 546901 - RNA, 22 nt, Human
gggcggguggauggccccugcc

SEQ ID NO: 546902 - RNA, 20 nt, Human
gggcugguccuggggcgggu

SEQ ID NO: 546903 - RNA, 18 nt, Human
gggggggcucucggccgu

SEQ ID NO: 546904 - RNA, 22 nt, Human
guccaggcagggucggcguccu

SEQ ID NO: 546905 - RNA, 24 nt, Human
ucaacggcgagggccacgccuccu

SEQ ID NO: 546906 - RNA, 22 nt, Human
uccgcauccacaccccggcccc

SEQ ID NO: 546907 - RNA, 19 nt, Human
ucucggaggcgggggccgc

SEQ ID NO: 546908 - RNA, 22 nt, Human
uggccuggccacgguccgcauc

SEQ ID NO: 546909 - RNA, 24 nt, Human
uggccuggccacgguccgcaucca

SEQ ID NO: 546910 - RNA, 26 nt, Human
aaaaaggaaucacaagauggagagaa

SEQ ID NO: 546911 - RNA, 20 nt, Human
aaaaaugaaagggggcgaga

SEQ ID NO: 546912 - RNA, 21 nt, Human
aaaacccucccagcccuagcc

SEQ ID NO: 546913 - RNA, 25 nt, Human
aaacaaaaaucugacaucugccaaa

SEQ ID NO: 546914 - RNA, 22 nt, Human
aaugaaagggggcgagaaagga

SEQ ID NO: 546915 - RNA, 22 nt, Human
acaggagcugacgaaccacugg

SEQ ID NO: 546916 - RNA, 21 nt, Human
agaaaggaaagaggcgcccac

SEQ ID NO: 546917 - RNA, 24 nt, Human
agaaaggaaagaggcgcccaccaa

SEQ ID NO: 546918 - RNA, 24 nt, Human
agccagcgcuggcugcaucugcca

SEQ ID NO: 546919 - RNA, 21 nt, Human
aggagagcgagaagaaaagaa

SEQ ID NO: 546920 - RNA, 18 nt, Human
aggcggugggaugggggg

SEQ ID NO: 546921 - RNA, 19 nt, Human
agggagggaggcaggcaaa

SEQ ID NO: 546922 - RNA, 19 nt, Human
agggggcgagaaaggaaag

SEQ ID NO: 546923 - RNA, 22 nt, Human
caggcaaagggacagagagaga

SEQ ID NO: 546924 - RNA, 20 nt, Human
caggcugaaagaaagaaaac

SEQ ID NO: 546925 - RNA, 19 nt, Human
ccagggcuggggguggggc

SEQ ID NO: 546926 - RNA, 20 nt, Human
ccagggcuggggguggggcg

SEQ ID NO: 546927 - RNA, 22 nt, Human
cccagcccuagccagcgcuggc

SEQ ID NO: 546928 - RNA, 24 nt, Human
cccccaaccugaaguuguugcuua

SEQ ID NO: 546929 - RNA, 20 nt, Human
ccucccagcccuagccagcc

SEQ ID NO: 546930 - RNA, 22 nt, Human
cgagaaaggaaagaggcgccca

SEQ ID NO: 546931 - RNA, 25 nt, Human
cgccaaauaaauaugaauaaauaaa

SEQ ID NO: 546932 - RNA, 23 nt, Human
cuuaauaccuccccuccggaccu

SEQ ID NO: 546933 - RNA, 20 nt, Human
gaaagggggcgagaaaggaa

SEQ ID NO: 546934 - RNA, 20 nt, Human
gacacagugcgcuaacggag

SEQ ID NO: 546935 - RNA, 22 nt, Human
gcccccaaccugaaguuguugc

SEQ ID NO: 546936 - RNA, 23 nt, Human
gcuggggguggggcggggugggg

SEQ ID NO: 546937 - RNA, 19 nt, Human
ggaaucacaagauggagag

SEQ ID NO: 546938 - RNA, 21 nt, Human
ggagcugacgaaccacuggug

SEQ ID NO: 546939 - RNA, 21 nt, Human
ggaguccauuuaauuugggag

SEQ ID NO: 546940 - RNA, 21 nt, Human
ggcuggggguggggcggggug

SEQ ID NO: 546941 - RNA, 22 nt, Human
ggcuggggguggggcggggugg

SEQ ID NO: 546942 - RNA, 18 nt, Human
gggccagggcugggggug

SEQ ID NO: 546943 - RNA, 20 nt, Human
gggccagggcuggggguggg

SEQ ID NO: 546944 - RNA, 19 nt, Human
gggcgggguggggugaggg

SEQ ID NO: 546945 - RNA, 20 nt, Human
gggcuggggguggggcgggg

SEQ ID NO: 546946 - RNA, 23 nt, Human
gggcuggggguggggcggggugg

SEQ ID NO: 546947 - RNA, 24 nt, Human
gggcuggggguggggcgggguggg

SEQ ID NO: 546948 - RNA, 20 nt, Human
ggggguggggcggggugggg

SEQ ID NO: 546949 - RNA, 19 nt, Human
ggggugagggaggcaggaa

SEQ ID NO: 546950 - RNA, 19 nt, Human
gggguggggcggggugggg

SEQ ID NO: 546951 - RNA, 19 nt, Human
uaggaugagcaguuaggug

SEQ ID NO: 546952 - RNA, 18 nt, Human
ucaggcugaaagaaagaa

SEQ ID NO: 546953 - RNA, 19 nt, Human
uccggaccugacaugguga

SEQ ID NO: 546954 - RNA, 20 nt, Human
uccggagggagggaggcagg

SEQ ID NO: 546955 - RNA, 19 nt, Human
ugacacagugcgcuaacgg

SEQ ID NO: 546956 - RNA, 19 nt, Human
ugagagaagccaagggcca

SEQ ID NO: 546957 - RNA, 22 nt, Human
uggcugcaucugccacuauucu

SEQ ID NO: 546958 - RNA, 18 nt, Human
uggggagggguaggagag

SEQ ID NO: 546959 - RNA, 21 nt, Human
uggggugagggaggcaggaac

SEQ ID NO: 546960 - RNA, 24 nt, Human
ugucucaaccuuuuagaagccugu

SEQ ID NO: 546961 - RNA, 19 nt, Human
uuucaucuggaguccauuu

SEQ ID NO: 546962 - RNA, 23 nt, Human
uuucugugacaagugaugggagg

SEQ ID NO: 546963 - RNA, 23 nt, Human
aaacaggaaaagagagaggggac

SEQ ID NO: 546964 - RNA, 18 nt, Human
aaagccuuccagccaccc

SEQ ID NO: 546965 - RNA, 21 nt, Human
aaagccuuccagccacccaag

SEQ ID NO: 546966 - RNA, 23 nt, Human
aacaaagccuuccagccacccaa

SEQ ID NO: 546967 - RNA, 20 nt, Human
aacccacaaaacuucccaaa

SEQ ID NO: 546968 - RNA, 19 nt, Human
aagccuuccagccacccaa

SEQ ID NO: 546969 - RNA, 19 nt, Human
acaggaaaagagagaggcu

SEQ ID NO: 546970 - RNA, 21 nt, Human
accagggcugcucaccaugcu

SEQ ID NO: 546971 - RNA, 19 nt, Human
acccacaaaacuucccaaa

SEQ ID NO: 546972 - RNA, 20 nt, Human
acccaugucugagccccagc

SEQ ID NO: 546973 - RNA, 21 nt, Human
acccccauuucuccuaguccc

SEQ ID NO: 546974 - RNA, 21 nt, Human
acccuaggcugaggagagaag

SEQ ID NO: 546975 - RNA, 24 nt, Human
acucuggacaguuuaugucuugcc

SEQ ID NO: 546976 - RNA, 23 nt, Human
agaaaacccacaaaacuucccaa

SEQ ID NO: 546977 - RNA, 21 nt, Human
agaaagaaaacccacaaaacu

SEQ ID NO: 546978 - RNA, 20 nt, Human
agaagacaccucugugagag

SEQ ID NO: 546979 - RNA, 19 nt, Human
agcagaaagggcaggaaag

SEQ ID NO: 546980 - RNA, 21 nt, Human
aggagcggggcgggccggggc

SEQ ID NO: 546981 - RNA, 25 nt, Human
aggaggagaaagaaaacccacaaaa

SEQ ID NO: 546982 - RNA, 18 nt, Human
aggcaggaggaggagcgg

SEQ ID NO: 546983 - RNA, 21 nt, Human
aggcaggaggaggagcggggc

SEQ ID NO: 546984 - RNA, 25 nt, Human
auccgaaaauucccuucccgggccu

SEQ ID NO: 546985 - RNA, 23 nt, Human
aucucccccaaacccuaaaggca

SEQ ID NO: 546986 - RNA, 19 nt, Human
cacaauauacuugcagaac

SEQ ID NO: 546987 - RNA, 22 nt, Human
caccaugcucccaagaagcaga

SEQ ID NO: 546988 - RNA, 24 nt, Human
cagagucagggaggcagacagcag

SEQ ID NO: 546989 - RNA, 21 nt, Human
ccagccacccaaggccuaaag

SEQ ID NO: 546990 - RNA, 20 nt, Human
ccccaaacccuaaaggcauc

SEQ ID NO: 546991 - RNA, 18 nt, Human
ccccagagccuaguaccu

SEQ ID NO: 546992 - RNA, 20 nt, Human
ccccagagccuaguaccugc

SEQ ID NO: 546993 - RNA, 24 nt, Human
ccccagguuucugccaccugacuu

SEQ ID NO: 546994 - RNA, 19 nt, Human
cccccaaacccuaaaggca

SEQ ID NO: 546995 - RNA, 18 nt, Human
ccccgggagcugcccgcc

SEQ ID NO: 546996 - RNA, 19 nt, Human
ccccgggagcugcccgccc

SEQ ID NO: 546997 - RNA, 21 nt, Human
cccgggccggggcgggugagc

SEQ ID NO: 546998 - RNA, 21 nt, Human
cccuaggccgcgggggcgccc

SEQ ID NO: 546999 - RNA, 21 nt, Human
cccuccggucuuuccgagaac

SEQ ID NO: 547000 - RNA, 18 nt, Human
cccuucccgggccggggc

SEQ ID NO: 547001 - RNA, 18 nt, Human
cccuucccgggccggggc

SEQ ID NO: 547002 - RNA, 19 nt, Human
ccucaggccaggcucgguu

SEQ ID NO: 547003 - RNA, 19 nt, Human
ccucccgggcgccaccggc

SEQ ID NO: 547004 - RNA, 23 nt, Human
ccuuccagccacccaaggccuaa

SEQ ID NO: 547005 - RNA, 23 nt, Human
cgaaaauucccuucccgggccgg

SEQ ID NO: 547006 - RNA, 19 nt, Human
cgccggggcgguugggcug

SEQ ID NO: 547007 - RNA, 22 nt, Human
cgcucaggagagccucgagggc

SEQ ID NO: 547008 - RNA, 19 nt, Human
cgcugggcugcgcucgacg

SEQ ID NO: 547009 - RNA, 22 nt, Human
cgggccggggcgggugagcagg

SEQ ID NO: 547010 - RNA, 21 nt, Human
cgggccggggcgucgcugcgg

SEQ ID NO: 547011 - RNA, 28 nt, Human
cucacugccccagagccuaguaccugcu

SEQ ID NO: 547012 - RNA, 24 nt, Human
cuccaggccgcucaggagagccuc

SEQ ID NO: 547013 - RNA, 22 nt, Human
cucgguuuugcugacuucagcg

SEQ ID NO: 547014 - RNA, 22 nt, Human
cugagccccagcucucuccgcc

SEQ ID NO: 547015 - RNA, 21 nt, Human
cugaucuucuagagccaagaa

SEQ ID NO: 547016 - RNA, 25 nt, Human
cugcgugcuguccccgcggccuccc

SEQ ID NO: 547017 - RNA, 25 nt, Human
cuuuccgagaaccuucaaacucugg

SEQ ID NO: 547018 - RNA, 19 nt, Human
gaaagaaaacccacaaaac

SEQ ID NO: 547019 - RNA, 22 nt, Human
gaccuccacccuaggcugagga

SEQ ID NO: 547020 - RNA, 22 nt, Human
gagagguugagaugagcagaaa

SEQ ID NO: 547021 - RNA, 22 nt, Human
gagcagaaagggcaggaaaggg

SEQ ID NO: 547022 - RNA, 19 nt, Human
gagcugcccgcccuaggcc

SEQ ID NO: 547023 - RNA, 21 nt, Human
gcaggcaggggaggagcagag

SEQ ID NO: 547024 - RNA, 19 nt, Human
gccaaccgucuccacccgc

SEQ ID NO: 547025 - RNA, 23 nt, Human
gccccagcucucuccgccuucug

SEQ ID NO: 547026 - RNA, 19 nt, Human
gccccgggcucgcaggauc

SEQ ID NO: 547027 - RNA, 21 nt, Human
gcgcugcagagcggugcuccc

SEQ ID NO: 547028 - RNA, 18 nt, Human
gcggggcgggccggggcg

SEQ ID NO: 547029 - RNA, 19 nt, Human
ggagcggggcgggccgggg

SEQ ID NO: 547030 - RNA, 18 nt, Human
ggcaggaaaggggaaagg

SEQ ID NO: 547031 - RNA, 18 nt, Human
ggcaggggaggagcagag

SEQ ID NO: 547032 - RNA, 22 nt, Human
ggcgggcgcugggcugcgcucg

SEQ ID NO: 547033 - RNA, 18 nt, Human
gggcaggaaaggggaaag

SEQ ID NO: 547034 - RNA, 22 nt, Human
gggccggggcgucgcugcggga

SEQ ID NO: 547035 - RNA, 20 nt, Human
gggcgccccgggcucgcagg

SEQ ID NO: 547036 - RNA, 18 nt, Human
gggcgggugagcaggcgg

SEQ ID NO: 547037 - RNA, 22 nt, Human
ggggagaagacaccucugugag

SEQ ID NO: 547038 - RNA, 21 nt, Human
gggggcuuuggcaggcagggg

SEQ ID NO: 547039 - RNA, 19 nt, Human
ggggggcuuuggcaggcag

SEQ ID NO: 547040 - RNA, 25 nt, Human
guaaaaucucccccaaacccuaaag

SEQ ID NO: 547041 - RNA, 21 nt, Human
uaacaaagccuuccagccacc

SEQ ID NO: 547042 - RNA, 24 nt, Human
uaaggugcacacccaugucugagc

SEQ ID NO: 547043 - RNA, 21 nt, Human
uagaacaauacauucacaaua

SEQ ID NO: 547044 - RNA, 24 nt, Human
uagagccaagaaacaggaaaagag

SEQ ID NO: 547045 - RNA, 21 nt, Human
uagggggagaagacaccucug

SEQ ID NO: 547046 - RNA, 21 nt, Human
uagugcagugaccuccacccu

SEQ ID NO: 547047 - RNA, 19 nt, Human
ucagggaggcagacagcag

SEQ ID NO: 547048 - RNA, 21 nt, Human
ucccagggcuggggucugcgg

SEQ ID NO: 547049 - RNA, 19 nt, Human
ucccgggcgccaccggcuc

SEQ ID NO: 547050 - RNA, 18 nt, Human
ucuccgccuucugugggg

SEQ ID NO: 547051 - RNA, 24 nt, Human
ugacuuauuuguguaucccacuag

SEQ ID NO: 547052 - RNA, 22 nt, Human
ugcagugcugaucuucuagagc

SEQ ID NO: 547053 - RNA, 19 nt, Human
uggcaggcaggggaggagc

SEQ ID NO: 547054 - RNA, 20 nt, Human
uggcgccugagucguggccu

SEQ ID NO: 547055 - RNA, 20 nt, Human
uggcuuguacaaaaagcugu

SEQ ID NO: 547056 - RNA, 20 nt, Human
ugggagaagccgccggggcg

SEQ ID NO: 547057 - RNA, 18 nt, Human
ugucuugcccgcacucuc

SEQ ID NO: 547058 - RNA, 21 nt, Human
ugucuugcccgcacucucagc

SEQ ID NO: 547059 - RNA, 20 nt, Human
ugugagagguugagaugagc

SEQ ID NO: 547060 - RNA, 23 nt, Human
uucagcgguggcugccccgcacc

SEQ ID NO: 547061 - RNA, 21 nt, Human
uucccuucccgggccggggcg

SEQ ID NO: 547062 - RNA, 24 nt, Human
uugcugacuucagcgguggcugcc

SEQ ID NO: 547063 - RNA, 22 nt, Human
uuggcaggcaggggaggagcag

SEQ ID NO: 547064 - RNA, 26 nt, Human
aaaaacacauuucuugaaacuauaua

SEQ ID NO: 547065 - RNA, 21 nt, Human
aaacuauacaauauaacauaa

SEQ ID NO: 547066 - RNA, 19 nt, Human
aaagauuggaucuuucuag

SEQ ID NO: 547067 - RNA, 20 nt, Human
aaauccugucucaacuacau

SEQ ID NO: 547068 - RNA, 21 nt, Human
aacuagaugaccuuuaagguc

SEQ ID NO: 547069 - RNA, 20 nt, Human
aagaaaccuucagcuuugcc

SEQ ID NO: 547070 - RNA, 21 nt, Human
aagaagcaggaagcccagagc

SEQ ID NO: 547071 - RNA, 18 nt, Human
aagaggaagagggugcug

SEQ ID NO: 547072 - RNA, 27 nt, Human
aagaggagacaaguguuaggccgagaa

SEQ ID NO: 547073 - RNA, 22 nt, Human
aagcaaucuggcaauauaaaac

SEQ ID NO: 547074 - RNA, 24 nt, Human
aagcagaucugacacauaggaaau

SEQ ID NO: 547075 - RNA, 18 nt, Human
aagcagguuagaagagga

SEQ ID NO: 547076 - RNA, 18 nt, Human
aagcccaugcaucccuuc

SEQ ID NO: 547077 - RNA, 19 nt, Human
aagcccgcgccgaggccga

SEQ ID NO: 547078 - RNA, 19 nt, Human
aaggagaggggcaggagag

SEQ ID NO: 547079 - RNA, 25 nt, Human
aaguggucauaagaaaugaaugaac

SEQ ID NO: 547080 - RNA, 24 nt, Human
aaucauacaaaaucaaaugguuga

SEQ ID NO: 547081 - RNA, 22 nt, Human
aaugaaauaaaacaacucuuca

SEQ ID NO: 547082 - RNA, 18 nt, Human
aaugacucuuuaacaaac

SEQ ID NO: 547083 - RNA, 25 nt, Human
acaaaggagaauguacacaacgauc

SEQ ID NO: 547084 - RNA, 19 nt, Human
acgacaugaaucgaucaac

SEQ ID NO: 547085 - RNA, 20 nt, Human
agaaaccuucagcuuugccc

SEQ ID NO: 547086 - RNA, 20 nt, Human
agaaagauuucccucaaaaa

SEQ ID NO: 547087 - RNA, 25 nt, Human
agccaagcagaucugacacauagga

SEQ ID NO: 547088 - RNA, 18 nt, Human
agccaagcccuacacaua

SEQ ID NO: 547089 - RNA, 21 nt, Human
agcccagagccuccuggaaac

SEQ ID NO: 547090 - RNA, 21 nt, Human
agccgccugcgggcgcgccgg

SEQ ID NO: 547091 - RNA, 20 nt, Human
agggguaaaaggacccaaac

SEQ ID NO: 547092 - RNA, 24 nt, Human
auaaaaauggcaaaacccaauacu

SEQ ID NO: 547093 - RNA, 18 nt, Human
auaccuauuaaacuagca

SEQ ID NO: 547094 - RNA, 22 nt, Human
auagaaaaacucuaaugcuuag

SEQ ID NO: 547095 - RNA, 19 nt, Human
caaaaagcccaugcauccc

SEQ ID NO: 547096 - RNA, 22 nt, Human
caaaaauaaauaaaaauggcaa

SEQ ID NO: 547097 - RNA, 19 nt, Human
caaccuucagaaacuucaa

SEQ ID NO: 547098 - RNA, 18 nt, Human
caacucuucaagaacaac

SEQ ID NO: 547099 - RNA, 23 nt, Human
caagcccgcgccgaggccgaggc

SEQ ID NO: 547100 - RNA, 19 nt, Human
cacugcaccguaccaaggu

SEQ ID NO: 547101 - RNA, 21 nt, Human
cagaagccucagaaagcaggu

SEQ ID NO: 547102 - RNA, 24 nt, Human
cagucaaagcucggugcaaguuuc

SEQ ID NO: 547103 - RNA, 18 nt, Human
cauagaguaauagaaaaa

SEQ ID NO: 547104 - RNA, 24 nt, Human
caucagugagaacagcauaauauc

SEQ ID NO: 547105 - RNA, 21 nt, Human
caucccuucuuggaagccaag

SEQ ID NO: 547106 - RNA, 18 nt, Human
cauccuggcugggggcgc

SEQ ID NO: 547107 - RNA, 21 nt, Human
ccaaaaagcccaugcaucccu

SEQ ID NO: 547108 - RNA, 26 nt, Human
ccagagccuccuggaaacacuggcca

SEQ ID NO: 547109 - RNA, 19 nt, Human
ccauaaaagucaagccaga

SEQ ID NO: 547110 - RNA, 21 nt, Human
cccccugccuccgcccccugc

SEQ ID NO: 547111 - RNA, 20 nt, Human
cccguuuucccaucuuucuu

SEQ ID NO: 547112 - RNA, 21 nt, Human
cccucggccgcccgcgccgcc

SEQ ID NO: 547113 - RNA, 18 nt, Human
ccgccgccgccgccgccg

SEQ ID NO: 547114 - RNA, 18 nt, Human
ccgccgccgccgccgcgc

SEQ ID NO: 547115 - RNA, 18 nt, Human
ccgccgccgccgccgcgc

SEQ ID NO: 547116 - RNA, 27 nt, Human
ccgccgccgccgccgcgcgcucuccgg

SEQ ID NO: 547117 - RNA, 24 nt, Human
ccgcugccgcugccgcugccgcug

SEQ ID NO: 547118 - RNA, 20 nt, Human
ccgcugccgcugccgcugcg

SEQ ID NO: 547119 - RNA, 21 nt, Human
ccgcugccgcugccgcugcgc

SEQ ID NO: 547120 - RNA, 23 nt, Human
ccgcugccgcugcgccgccgccc

SEQ ID NO: 547121 - RNA, 21 nt, Human
ccgucccgccgccgccgccgc

SEQ ID NO: 547122 - RNA, 21 nt, Human
ccguucagugcccucggccgc

SEQ ID NO: 547123 - RNA, 18 nt, Human
ccucggccgcccgcgccg

SEQ ID NO: 547124 - RNA, 19 nt, Human
cgcccgcgccgccucucgc

SEQ ID NO: 547125 - RNA, 22 nt, Human
cgcuacaauugccccggauagc

SEQ ID NO: 547126 - RNA, 23 nt, Human
cggcccggggcaagcccgcgccg

SEQ ID NO: 547127 - RNA, 18 nt, Human
cggcggccaaagguccgg

SEQ ID NO: 547128 - RNA, 21 nt, Human
cuaaagcuguuuuaaaaguau

SEQ ID NO: 547129 - RNA, 24 nt, Human
cuagcaaaaauaaauaaaaauggc

SEQ ID NO: 547130 - RNA, 21 nt, Human
cuagcaauuaaugaaauaaaa

SEQ ID NO: 547131 - RNA, 19 nt, Human
cuaguaaaucaucacaugg

SEQ ID NO: 547132 - RNA, 23 nt, Human
cuccuggaaacacuggccaaaaa

SEQ ID NO: 547133 - RNA, 23 nt, Human
cugaauauucacauacauuccuc

SEQ ID NO: 547134 - RNA, 18 nt, Human
cugccgcugcgccgccgc

SEQ ID NO: 547135 - RNA, 24 nt, Human
cugcgcugccgcugccgcugccgc

SEQ ID NO: 547136 - RNA, 20 nt, Human
gaaaaaccagcaauaaagaa

SEQ ID NO: 547137 - RNA, 24 nt, Human
gaacauuuuacacacaaggaaaua

SEQ ID NO: 547138 - RNA, 20 nt, Human
gaagaagcaggaagcccaga

SEQ ID NO: 547139 - RNA, 18 nt, Human
gaagaggaagagggugcu

SEQ ID NO: 547140 - RNA, 21 nt, Human
gaccuuguaaucccucuuugg

SEQ ID NO: 547141 - RNA, 20 nt, Human
gaccuuuaagguccuuccaa

SEQ ID NO: 547142 - RNA, 22 nt, Human
gagcaggaggugaagagcagaa

SEQ ID NO: 547143 - RNA, 20 nt, Human
gaggggguggggaggcuaaa

SEQ ID NO: 547144 - RNA, 18 nt, Human
gagggugcuggguuggca

SEQ ID NO: 547145 - RNA, 23 nt, Human
gcaaaacccaauacuggcagagc

SEQ ID NO: 547146 - RNA, 21 nt, Human
gcaguaaaaaaccaucaguga

SEQ ID NO: 547147 - RNA, 27 nt, Human
gcccagagccuccuggaaacacuggcc

SEQ ID NO: 547148 - RNA, 20 nt, Human
gccccauauuguacgggaac

SEQ ID NO: 547149 - RNA, 21 nt, Human
gccgcugccgcugcgccgccg

SEQ ID NO: 547150 - RNA, 18 nt, Human
gccgcugcgccgccgccc

SEQ ID NO: 547151 - RNA, 24 nt, Human
gccgucccgccgccgccgccgccg

SEQ ID NO: 547152 - RNA, 19 nt, Human
gcuacggcccggggcaagc

SEQ ID NO: 547153 - RNA, 22 nt, Human
gcuuccccaagaaaccuucagc

SEQ ID NO: 547154 - RNA, 22 nt, Human
ggagaccugggcgaacaaagca

SEQ ID NO: 547155 - RNA, 21 nt, Human
gggaagcggggaagaagcagg

SEQ ID NO: 547156 - RNA, 20 nt, Human
gggaagugcguaauacauuu

SEQ ID NO: 547157 - RNA, 19 nt, Human
ggguaaaaggacccaaacg

SEQ ID NO: 547158 - RNA, 22 nt, Human
gugaagagcagaagccucagaa

SEQ ID NO: 547159 - RNA, 21 nt, Human
uaaaaaaccaucagugagaac

SEQ ID NO: 547160 - RNA, 21 nt, Human
uaaaaaaccaucagugagaac

SEQ ID NO: 547161 - RNA, 22 nt, Human
uaaaaaaccaucagugagaaca

SEQ ID NO: 547162 - RNA, 23 nt, Human
uaaaacaaaggagaauguacaca

SEQ ID NO: 547163 - RNA, 22 nt, Human
uaaaacaagagcuauaaaauac

SEQ ID NO: 547164 - RNA, 26 nt, Human
uaaagauccuacaucauauuaacccc

SEQ ID NO: 547165 - RNA, 20 nt, Human
uaaauucuguuuauuccaaa

SEQ ID NO: 547166 - RNA, 30 nt, Human
uaagaaaugaaugaacauuuuacacacaaa

SEQ ID NO: 547167 - RNA, 23 nt, Human
uaagguccuuccaacccaaagau

SEQ ID NO: 547168 - RNA, 21 nt, Human
uacaacaauacuaguaaauga

SEQ ID NO: 547169 - RNA, 23 nt, Human
uacauagaguaauagaaaaacuc

SEQ ID NO: 547170 - RNA, 28 nt, Human
uagcaaaaauaaauaaaaauggcaaaag

SEQ ID NO: 547171 - RNA, 20 nt, Human
uauaaaacaagagcuauaaa

SEQ ID NO: 547172 - RNA, 23 nt, Human
ucagcacuuaaaggguuaauccu

SEQ ID NO: 547173 - RNA, 18 nt, Human
ucagcgagcaggagguga

SEQ ID NO: 547174 - RNA, 23 nt, Human
ucagugcccucggccgcccgcgc

SEQ ID NO: 547175 - RNA, 21 nt, Human
ucccgccgccgccgccgccgc

SEQ ID NO: 547176 - RNA, 23 nt, Human
ucccucaaaaaaaaauauauuaa

SEQ ID NO: 547177 - RNA, 20 nt, Human
uccuggaaacacuggccaaa

SEQ ID NO: 547178 - RNA, 19 nt, Human
ucggccgcccgcgccgccu

SEQ ID NO: 547179 - RNA, 25 nt, Human
ugaaaaggaaucccguuuucccauc

SEQ ID NO: 547180 - RNA, 22 nt, Human
ugaaacuauauaaaaagagcaa

SEQ ID NO: 547181 - RNA, 21 nt, Human
ugaaauaaaacaacucuucaa

SEQ ID NO: 547182 - RNA, 20 nt, Human
ugaagugagguuacccaugu

SEQ ID NO: 547183 - RNA, 20 nt, Human
ugaccuuguaaucccucuuu

SEQ ID NO: 547184 - RNA, 23 nt, Human
ugacgucaaccuucagaaacuuc

SEQ ID NO: 547185 - RNA, 19 nt, Human
ugagaacagcauaauaucc

SEQ ID NO: 547186 - RNA, 19 nt, Human
ugagagcagaaucuguguu

SEQ ID NO: 547187 - RNA, 22 nt, Human
ugcucagccuugcuagcaauua

SEQ ID NO: 547188 - RNA, 18 nt, Human
uggccaaaaagcccaugc

SEQ ID NO: 547189 - RNA, 21 nt, Human
uggccgcacggggagggcgcg

SEQ ID NO: 547190 - RNA, 22 nt, Human
uuaccuuuuuuuguagucauua

SEQ ID NO: 547191 - RNA, 18 nt, Human
uucagugcccucggccgc

SEQ ID NO: 547192 - RNA, 22 nt, Human
uucauagcagcacuauuuauaa

SEQ ID NO: 547193 - RNA, 21 nt, Human
uuccaacccaaagauuggauc

SEQ ID NO: 547194 - RNA, 22 nt, Human
uuccccaagaaaccuucagcuu

SEQ ID NO: 547195 - RNA, 19 nt, Human
uucuugauauugaaucauc

SEQ ID NO: 547196 - RNA, 22 nt, Human
uugaaucaucuuaaccuuguaa

SEQ ID NO: 547197 - RNA, 20 nt, Human
uugcuuuauuccugcaaagu

SEQ ID NO: 547198 - RNA, 21 nt, Human
uuuguagucauuaguaucaaa

SEQ ID NO: 547199 - RNA, 23 nt, Human
uuuuaaagauucagcacuuaaag

SEQ ID NO: 547200 - RNA, 19 nt, Human
uuuuuuguagucauuagua

SEQ ID NO: 547201 - RNA, 28 nt, Human
aaaaggaaggagucugacuugcucagaa

SEQ ID NO: 547202 - RNA, 22 nt, Human
aggccaaaaggaaggagucuga

SEQ ID NO: 547203 - RNA, 24 nt, Human
ccccgcacgcgcaaccgcucccag

SEQ ID NO: 547204 - RNA, 22 nt, Human
cccgcacgcgcaaccgcuccca

SEQ ID NO: 547205 - RNA, 25 nt, Human
cccgcacgcgcaaccgcucccagcg

SEQ ID NO: 547206 - RNA, 22 nt, Human
ccggccaacaucuguggcuuug

SEQ ID NO: 547207 - RNA, 20 nt, Human
gcagggcagaagucacagcu

SEQ ID NO: 547208 - RNA, 23 nt, Human
uaaacaggugggccggccaacau

SEQ ID NO: 547209 - RNA, 21 nt, Human
uauaacucagcuccccgcacg

SEQ ID NO: 547210 - RNA, 26 nt, Human
uuuaccuuuggaagcccuucuuuauu

SEQ ID NO: 547211 - RNA, 25 nt, Human
uuuuuuuuuuuuuuuuaccuuugga

SEQ ID NO: 547212 - RNA, 23 nt, Human
uuuuuuuuuuuuuuuuuaccuuu

SEQ ID NO: 547213 - RNA, 27 nt, Human
uuuuuuuuuuuuuuuuuuuaccuuugg

SEQ ID NO: 547214 - RNA, 26 nt, Human
uuuuuuuuuuuuuuuuuuuuaccuuu

SEQ ID NO: 547215 - RNA, 26 nt, Human
uuuuuuuuuuuuuuuuuuuuuaccuu

SEQ ID NO: 547216 - RNA, 24 nt, Human
aaacaaguaaauugaaugaccaaa

SEQ ID NO: 547217 - RNA, 18 nt, Human
aagcagcuuauagauuuu

SEQ ID NO: 547218 - RNA, 21 nt, Human
aaguaaauugaaugaccaaau

SEQ ID NO: 547219 - RNA, 18 nt, Human
acacggcaccugcggacg

SEQ ID NO: 547220 - RNA, 21 nt, Human
acugguuuuaggagauuuuua

SEQ ID NO: 547221 - RNA, 25 nt, Human
agagaaucauguauuaaaaacaagu

SEQ ID NO: 547222 - RNA, 23 nt, Human
auaacagugaaaaaggauuguac

SEQ ID NO: 547223 - RNA, 22 nt, Human
aucagaauguucaaggcuuuaa

SEQ ID NO: 547224 - RNA, 21 nt, Human
cacuuguguuuuguguugcuu

SEQ ID NO: 547225 - RNA, 25 nt, Human
cagcuuauagauuuuagcaaaccau

SEQ ID NO: 547226 - RNA, 18 nt, Human
caggggcacacgagcauc

SEQ ID NO: 547227 - RNA, 21 nt, Human
ccacugcuccuuaguucaggc

SEQ ID NO: 547228 - RNA, 22 nt, Human
ccuucugccacugcuccuuagu

SEQ ID NO: 547229 - RNA, 23 nt, Human
ccuucugccacugcuccuuaguu

SEQ ID NO: 547230 - RNA, 19 nt, Human
cuggaaaugcuguaaacac

SEQ ID NO: 547231 - RNA, 23 nt, Human
gacccguauucuuuaaaaacuuu

SEQ ID NO: 547232 - RNA, 23 nt, Human
gcccaccuucugccacugcuccu

SEQ ID NO: 547233 - RNA, 18 nt, Human
gugagccacgccaggggc

SEQ ID NO: 547234 - RNA, 19 nt, Human
uauagauuuuagcaaacca

SEQ ID NO: 547235 - RNA, 27 nt, Human
ugacaacaucagaauguucaaggcuuu

SEQ ID NO: 547236 - RNA, 21 nt, Human
uggcagaacacggcaccugcg

SEQ ID NO: 547237 - RNA, 19 nt, Human
uggguucucauacaggucu

SEQ ID NO: 547238 - RNA, 26 nt, Human
uggguucucauacaggucugcaguuc

SEQ ID NO: 547239 - RNA, 24 nt, Human
uuaggagauuuuuaggacacaugg

SEQ ID NO: 547240 - RNA, 24 nt, Human
uuuaaaaacuuuggaaaauaaaug

SEQ ID NO: 547241 - RNA, 22 nt, Human
aaaaaaaaaaaaacaacaguaa

SEQ ID NO: 547242 - RNA, 23 nt, Human
aaaguguuggagcuacuguguga

SEQ ID NO: 547243 - RNA, 23 nt, Human
aaauagauaaaaggcacagaacc

SEQ ID NO: 547244 - RNA, 18 nt, Human
aacaaauuucaguaaaca

SEQ ID NO: 547245 - RNA, 21 nt, Human
aagugccaggguuacaggcau

SEQ ID NO: 547246 - RNA, 26 nt, Human
aagugccaggguuacaggcaugagcu

SEQ ID NO: 547247 - RNA, 19 nt, Human
acaaaaucaaaagaaaaaa

SEQ ID NO: 547248 - RNA, 20 nt, Human
acaaaaucaaaagaaaaaaa

SEQ ID NO: 547249 - RNA, 19 nt, Human
acaacaaagaagcaccugu

SEQ ID NO: 547250 - RNA, 22 nt, Human
acucccuuaaaaaugcucaaaa

SEQ ID NO: 547251 - RNA, 23 nt, Human
acuggccucaagugauccuccug

SEQ ID NO: 547252 - RNA, 21 nt, Human
agaaauucaagauuuggauaa

SEQ ID NO: 547253 - RNA, 23 nt, Human
agacagaagugaaaauuauaugc

SEQ ID NO: 547254 - RNA, 25 nt, Human
agacagaagugaaaauuauaugcca

SEQ ID NO: 547255 - RNA, 22 nt, Human
agagaccagacuugcuuccccc

SEQ ID NO: 547256 - RNA, 18 nt, Human
aguagucuagucuuggau

SEQ ID NO: 547257 - RNA, 22 nt, Human
auagcaauaaaaauaaaaaauu

SEQ ID NO: 547258 - RNA, 26 nt, Human
auggaaacauguaaaaaaaaaaaaac

SEQ ID NO: 547259 - RNA, 23 nt, Human
auuuacagccaggaagcgcugcu

SEQ ID NO: 547260 - RNA, 24 nt, Human
caacugguaccucaaguaucauaa

SEQ ID NO: 547261 - RNA, 22 nt, Human
caagugauccuccugccuuggc

SEQ ID NO: 547262 - RNA, 21 nt, Human
cagagaccagacuugcuuccc

SEQ ID NO: 547263 - RNA, 22 nt, Human
caguuccacaucaagacuaaaa

SEQ ID NO: 547264 - RNA, 20 nt, Human
caucagaaauggaaaucaca

SEQ ID NO: 547265 - RNA, 22 nt, Human
cauguugccagcuuucuaaacu

SEQ ID NO: 547266 - RNA, 22 nt, Human
ccaacacacucuucuauuuucc

SEQ ID NO: 547267 - RNA, 21 nt, Human
ccucaagugauccuccugccu

SEQ ID NO: 547268 - RNA, 23 nt, Human
ccuuaagugccaggguuacaggc

SEQ ID NO: 547269 - RNA, 24 nt, Human
cucaaaguguuggagcuacugugu

SEQ ID NO: 547270 - RNA, 24 nt, Human
cucaagugauccuccugccuuggc

SEQ ID NO: 547271 - RNA, 23 nt, Human
cucucagaaaccagccacuggaa

SEQ ID NO: 547272 - RNA, 21 nt, Human
cucuucuauuuuccagacccu

SEQ ID NO: 547273 - RNA, 19 nt, Human
cuuaaagacagaaaugaug

SEQ ID NO: 547274 - RNA, 23 nt, Human
cuuaagugccaggguuacaggca

SEQ ID NO: 547275 - RNA, 24 nt, Human
cuuaagugccaggguuacaggcau

SEQ ID NO: 547276 - RNA, 23 nt, Human
cuuagaaauaaaaaauauucagc

SEQ ID NO: 547277 - RNA, 20 nt, Human
cuuugccaagccuguucuuc

SEQ ID NO: 547278 - RNA, 23 nt, Human
gaacauuuaaauacuuagaaaua

SEQ ID NO: 547279 - RNA, 19 nt, Human
gacagaagugaaaauuaua

SEQ ID NO: 547280 - RNA, 18 nt, Human
gacuugcuucccccucac

SEQ ID NO: 547281 - RNA, 19 nt, Human
gagguaugugugugauucc

SEQ ID NO: 547282 - RNA, 19 nt, Human
gaguagucuagucuuggau

SEQ ID NO: 547283 - RNA, 24 nt, Human
gagugcacuggagugaucacagcu

SEQ ID NO: 547284 - RNA, 22 nt, Human
gauuguuugccuuggaugcccc

SEQ ID NO: 547285 - RNA, 20 nt, Human
gccaggguuacaggcaugag

SEQ ID NO: 547286 - RNA, 20 nt, Human
gcccugucacccaggcucga

SEQ ID NO: 547287 - RNA, 18 nt, Human
ggauuucaaaagcuagua

SEQ ID NO: 547288 - RNA, 22 nt, Human
ggccucaagugauccuccugcc

SEQ ID NO: 547289 - RNA, 22 nt, Human
ggguuacaggcaugagcuacca

SEQ ID NO: 547290 - RNA, 24 nt, Human
ggguuacaggcaugagcuaccaug

SEQ ID NO: 547291 - RNA, 22 nt, Human
ggugccaaucuggagacaucag

SEQ ID NO: 547292 - RNA, 24 nt, Human
gguuacaggcaugagcuaccaugc

SEQ ID NO: 547293 - RNA, 23 nt, Human
gugaaaugaggccacucccuuaa

SEQ ID NO: 547294 - RNA, 19 nt, Human
gugccaggguuacaggcau

SEQ ID NO: 547295 - RNA, 24 nt, Human
guucuuuuccucgugguaucagug

SEQ ID NO: 547296 - RNA, 21 nt, Human
uaaaaaauauucagcuuugaa

SEQ ID NO: 547297 - RNA, 24 nt, Human
uaagugccaggguuacaggcauga

SEQ ID NO: 547298 - RNA, 22 nt, Human
uacaaacuaccugcccaacaca

SEQ ID NO: 547299 - RNA, 25 nt, Human
uacaaacuaccugcccaacacacuu

SEQ ID NO: 547300 - RNA, 19 nt, Human
uacaacaaagaagcaccug

SEQ ID NO: 547301 - RNA, 22 nt, Human
uacaggcaugagcuaccaugcc

SEQ ID NO: 547302 - RNA, 22 nt, Human
uacauccagguucuccucuaca

SEQ ID NO: 547303 - RNA, 25 nt, Human
uacugaucuauucucuggcuagggu

SEQ ID NO: 547304 - RNA, 21 nt, Human
uacugugugacaacagcugac

SEQ ID NO: 547305 - RNA, 22 nt, Human
uagugaaaugaggccacucccu

SEQ ID NO: 547306 - RNA, 22 nt, Human
uaucuugucccugcugucuuuu

SEQ ID NO: 547307 - RNA, 20 nt, Human
ucaaacagaucccuguuuug

SEQ ID NO: 547308 - RNA, 21 nt, Human
ucaaaguguuggagcuacugu

SEQ ID NO: 547309 - RNA, 20 nt, Human
ucaacuuucacugugguuaa

SEQ ID NO: 547310 - RNA, 22 nt, Human
ucacaagcccaauuuuagaacu

SEQ ID NO: 547311 - RNA, 19 nt, Human
ucacagagaccagacuugc

SEQ ID NO: 547312 - RNA, 23 nt, Human
ucaguaaacaaaaucaaaagaaa

SEQ ID NO: 547313 - RNA, 23 nt, Human
ucuuaaguacauccagguucucc

SEQ ID NO: 547314 - RNA, 22 nt, Human
ucuucaaucacagagaccagac

SEQ ID NO: 547315 - RNA, 19 nt, Human
ucuugcccugucacccagg

SEQ ID NO: 547316 - RNA, 24 nt, Human
ucuugcccugucacccaggcucga

SEQ ID NO: 547317 - RNA, 23 nt, Human
ugacaacagcugacauuuaggag

SEQ ID NO: 547318 - RNA, 24 nt, Human
ugacaacagcugacauuuaggagg

SEQ ID NO: 547319 - RNA, 22 nt, Human
ugagacagggucuugcccuguc

SEQ ID NO: 547320 - RNA, 18 nt, Human
ugcagcugcuuuuuaaaa

SEQ ID NO: 547321 - RNA, 19 nt, Human
ugcccugucacccaggcuc

SEQ ID NO: 547322 - RNA, 23 nt, Human
ugccucaacagacagaagugaaa

SEQ ID NO: 547323 - RNA, 19 nt, Human
ugccuuggaugccccuggc

SEQ ID NO: 547324 - RNA, 20 nt, Human
ugccuuggccccuuaagugc

SEQ ID NO: 547325 - RNA, 20 nt, Human
ugcguacaacaaagaagcac

SEQ ID NO: 547326 - RNA, 23 nt, Human
uggaaacauguaaaaaaaaaaaa

SEQ ID NO: 547327 - RNA, 21 nt, Human
uggaugccccuggcaaaucuc

SEQ ID NO: 547328 - RNA, 18 nt, Human
uggccucaagugauccuc

SEQ ID NO: 547329 - RNA, 24 nt, Human
uggccucaagugauccuccugccu

SEQ ID NO: 547330 - RNA, 25 nt, Human
ugugugauucccgcacuggagccca

SEQ ID NO: 547331 - RNA, 23 nt, Human
uuaagugccaggguuacaggcau

SEQ ID NO: 547332 - RNA, 19 nt, Human
uuacaggcaugagcuacca

SEQ ID NO: 547333 - RNA, 22 nt, Human
uuagaaauaaaaaauauucagc

SEQ ID NO: 547334 - RNA, 20 nt, Human
uuaguucuuaaagacagaaa

SEQ ID NO: 547335 - RNA, 22 nt, Human
uucaaguuauucagaacugggu

SEQ ID NO: 547336 - RNA, 18 nt, Human
uucccaauauggaaugcu

SEQ ID NO: 547337 - RNA, 22 nt, Human
uugaaguuuucaauacuggaaa

SEQ ID NO: 547338 - RNA, 19 nt, Human
uugaaugcauucuucaugu

SEQ ID NO: 547339 - RNA, 22 nt, Human
uugagacagggucuugcccugu

SEQ ID NO: 547340 - RNA, 21 nt, Human
uuguuuguucuuuuccucgug

SEQ ID NO: 547341 - RNA, 22 nt, Human
uuuaauagcaauaaaaauaaaa

SEQ ID NO: 547342 - RNA, 24 nt, Human
uuuuuuuuuugagacagggucuug

SEQ ID NO: 547343 - RNA, 20 nt, Human
uuuuuuuuuuugagacaggg

SEQ ID NO: 547344 - RNA, 23 nt, Human
uuuuuuuuuuuugagacaggguc

SEQ ID NO: 547345 - RNA, 24 nt, Human
uuuuuuuuuuuugagacagggucu

SEQ ID NO: 547346 - RNA, 24 nt, Human
uuuuuuuuuuuuuuugagacaggg

SEQ ID NO: 547347 - RNA, 21 nt, Human
aaaaaagcaccuccuuacccc

SEQ ID NO: 547348 - RNA, 22 nt, Human
accacucgccaaaaaucuuggc

SEQ ID NO: 547349 - RNA, 19 nt, Human
accccauaucacguuucuc

SEQ ID NO: 547350 - RNA, 22 nt, Human
agccccaggccccggcggcagc

SEQ ID NO: 547351 - RNA, 21 nt, Human
agcgcugccccugccgauacc

SEQ ID NO: 547352 - RNA, 23 nt, Human
agucagacgggucagccccaggc

SEQ ID NO: 547353 - RNA, 20 nt, Human
caagcuuugcaaaaucagug

SEQ ID NO: 547354 - RNA, 19 nt, Human
cacaucuccacaacaagcu

SEQ ID NO: 547355 - RNA, 19 nt, Human
cagacgggucagccccagg

SEQ ID NO: 547356 - RNA, 21 nt, Human
cagcgcugccccugccgauac

SEQ ID NO: 547357 - RNA, 20 nt, Human
caggccccggcggcagcgcu

SEQ ID NO: 547358 - RNA, 18 nt, Human
ccacaacaagcuuugcaa

SEQ ID NO: 547359 - RNA, 20 nt, Human
ccccggcggcagcgcugccc

SEQ ID NO: 547360 - RNA, 19 nt, Human
ccccugccgauaccucucc

SEQ ID NO: 547361 - RNA, 20 nt, Human
cccugccgauaccucuccca

SEQ ID NO: 547362 - RNA, 26 nt, Human
ccgauaccucucccaccaaucgguug

SEQ ID NO: 547363 - RNA, 22 nt, Human
ccgauaccucucccaccacccg

SEQ ID NO: 547364 - RNA, 20 nt, Human
ccggcggcagcgcugccccu

SEQ ID NO: 547365 - RNA, 18 nt, Human
cgcugccccugccgauac

SEQ ID NO: 547366 - RNA, 18 nt, Human
cugccgauaccucuccca

SEQ ID NO: 547367 - RNA, 18 nt, Human
gccccaggccccggcggc

SEQ ID NO: 547368 - RNA, 18 nt, Human
ggaagucagacgggucag

SEQ ID NO: 547369 - RNA, 19 nt, Human
ucagaccaaccacucgcca

SEQ ID NO: 547370 - RNA, 18 nt, Human
ucagccccaggccccggc

SEQ ID NO: 547371 - RNA, 21 nt, Human
uccacaacaagcuuugcaaaa

SEQ ID NO: 547372 - RNA, 24 nt, Human
ucugauggcaaaccuguccagcca

SEQ ID NO: 547373 - RNA, 21 nt, Human
ugauggcaaaccuguccagcc

SEQ ID NO: 547374 - RNA, 23 nt, Human
ugccccugccgauaccucuccca

SEQ ID NO: 547375 - RNA, 19 nt, Human
uuuacagaagucuaugaac

SEQ ID NO: 547376 - RNA, 21 nt, Human
uuuacagaagucuaugaacga

SEQ ID NO: 547377 - RNA, 18 nt, Human
aaaggaaaggaaaggaaa

SEQ ID NO: 547378 - RNA, 18 nt, Human
aacacuaaccacacauuu

SEQ ID NO: 547379 - RNA, 22 nt, Human
aacauaacaauuuaccaaacug

SEQ ID NO: 547380 - RNA, 22 nt, Human
aacugcuuuucuugacaaguua

SEQ ID NO: 547381 - RNA, 23 nt, Human
aagaugacaccaagaaaagauaa

SEQ ID NO: 547382 - RNA, 27 nt, Human
aagcagucuucuucacaauguauuuuu

SEQ ID NO: 547383 - RNA, 22 nt, Human
aaugcaauaauggaaagguuua

SEQ ID NO: 547384 - RNA, 22 nt, Human
acaaagauuuguuucucagaca

SEQ ID NO: 547385 - RNA, 18 nt, Human
acaggcucaguuacucca

SEQ ID NO: 547386 - RNA, 19 nt, Human
acucccaagagcuguguuc

SEQ ID NO: 547387 - RNA, 21 nt, Human
acugcacuucugauuguagca

SEQ ID NO: 547388 - RNA, 28 nt, Human
agacacuuaaaucaggcaaauaaaaaua

SEQ ID NO: 547389 - RNA, 22 nt, Human
aggaaaucuuagcccuugucug

SEQ ID NO: 547390 - RNA, 21 nt, Human
aggaaucuuuauuuaauuuac

SEQ ID NO: 547391 - RNA, 21 nt, Human
aggaaucuuuauuuaauuuac

SEQ ID NO: 547392 - RNA, 23 nt, Human
aggagaagacauaauaaagauuc

SEQ ID NO: 547393 - RNA, 24 nt, Human
aggagaagacauaauaaagauucc

SEQ ID NO: 547394 - RNA, 25 nt, Human
aggagaagacauaauaaagauuccc

SEQ ID NO: 547395 - RNA, 18 nt, Human
auaagcagucuucuucac

SEQ ID NO: 547396 - RNA, 24 nt, Human
augcccuugcugcaaacugcuuuu

SEQ ID NO: 547397 - RNA, 25 nt, Human
caaaucacuuagaugauggucuuuu

SEQ ID NO: 547398 - RNA, 23 nt, Human
cacaaaagauacugcacuucuga

SEQ ID NO: 547399 - RNA, 23 nt, Human
cacaauguauuuuuaauauccuc

SEQ ID NO: 547400 - RNA, 20 nt, Human
cacacauuugguuaaacugc

SEQ ID NO: 547401 - RNA, 18 nt, Human
caccaagaaaagauaaaa

SEQ ID NO: 547402 - RNA, 20 nt, Human
caccaagaaaagauaaaaug

SEQ ID NO: 547403 - RNA, 20 nt, Human
cagaugucauaauuguuaac

SEQ ID NO: 547404 - RNA, 18 nt, Human
cagccuaagagaacaaag

SEQ ID NO: 547405 - RNA, 21 nt, Human
caguuaaggaacaggugauac

SEQ ID NO: 547406 - RNA, 20 nt, Human
ccagcacaaaagauacugca

SEQ ID NO: 547407 - RNA, 18 nt, Human
cccucccccaccugaagc

SEQ ID NO: 547408 - RNA, 24 nt, Human
ccuugcugcaaacugcuuuucuug

SEQ ID NO: 547409 - RNA, 25 nt, Human
ccuugcugcaaacugcuuuucuuga

SEQ ID NO: 547410 - RNA, 19 nt, Human
cuauggugacaacauaagg

SEQ ID NO: 547411 - RNA, 20 nt, Human
cuuaguagguauacagagcu

SEQ ID NO: 547412 - RNA, 19 nt, Human
gcagcccuauaccuuuguu

SEQ ID NO: 547413 - RNA, 24 nt, Human
gucacguugcaaccuuuuguuucc

SEQ ID NO: 547414 - RNA, 23 nt, Human
guugcaaccuuuuguuuccaauu

SEQ ID NO: 547415 - RNA, 22 nt, Human
uaaaaauaaguuucccuccccc

SEQ ID NO: 547416 - RNA, 20 nt, Human
uaaauaagaggaaggcagcc

SEQ ID NO: 547417 - RNA, 24 nt, Human
uaacacaaaauuuaaguccucaca

SEQ ID NO: 547418 - RNA, 19 nt, Human
uacagagcuuugacguucc

SEQ ID NO: 547419 - RNA, 20 nt, Human
uaggagaagacauaauaaag

SEQ ID NO: 547420 - RNA, 18 nt, Human
uauaaaggaaaggaaagg

SEQ ID NO: 547421 - RNA, 18 nt, Human
uauacuuaacagccauaa

SEQ ID NO: 547422 - RNA, 21 nt, Human
uaugaaaucagauagcaacaa

SEQ ID NO: 547423 - RNA, 22 nt, Human
uauugcuguguagucacuacuu

SEQ ID NO: 547424 - RNA, 18 nt, Human
ucccaauuuuaaccagca

SEQ ID NO: 547425 - RNA, 19 nt, Human
uccccaaauaaauaagagg

SEQ ID NO: 547426 - RNA, 24 nt, Human
uccccaaauaaauaagaggaaggc

SEQ ID NO: 547427 - RNA, 19 nt, Human
ucuauggugacaacauaag

SEQ ID NO: 547428 - RNA, 20 nt, Human
ugaaaucagauagcaacaac

SEQ ID NO: 547429 - RNA, 19 nt, Human
ugaagcaguucaucaguag

SEQ ID NO: 547430 - RNA, 20 nt, Human
ugacaaguuaugaaguaguu

SEQ ID NO: 547431 - RNA, 21 nt, Human
ugagagggagagcuagcgagg

SEQ ID NO: 547432 - RNA, 19 nt, Human
ugcccuugcugcaaacugc

SEQ ID NO: 547433 - RNA, 22 nt, Human
uggaaagguuuaccuucuuuag

SEQ ID NO: 547434 - RNA, 21 nt, Human
ugggcaacauaaagaugacac

SEQ ID NO: 547435 - RNA, 22 nt, Human
uguucuauacucucaaaaagua

SEQ ID NO: 547436 - RNA, 21 nt, Human
uuaauuaauuaggccuuggua

SEQ ID NO: 547437 - RNA, 23 nt, Human
uuaggggaauaaaaaaacacuaa

SEQ ID NO: 547438 - RNA, 20 nt, Human
uugcaaccuuuuguuuccaa

SEQ ID NO: 547439 - RNA, 28 nt, Human
uuucucagacacuuaaaucaggcaaaua

SEQ ID NO: 547440 - RNA, 19 nt, Human
uuucuguaauaaaauagau

SEQ ID NO: 547441 - RNA, 22 nt, Human
uuugaacuaugauuuaguagca

SEQ ID NO: 547442 - RNA, 24 nt, Human
uuugaacuaugauuuaguagcaac

SEQ ID NO: 547443 - RNA, 18 nt, Human
uuuguuagaaacugaucu

SEQ ID NO: 547444 - RNA, 21 nt, Human
uuuuuuguucuuucugucuua

SEQ ID NO: 547445 - RNA, 23 nt, Human
aggcugucuucugucgccaaggg

SEQ ID NO: 547446 - RNA, 21 nt, Human
cuuggagcccgcgcucucgga

SEQ ID NO: 547447 - RNA, 18 nt, Human
gaguacacgguggcagcu

SEQ ID NO: 547448 - RNA, 18 nt, Human
gcugucuucugucgccaa

SEQ ID NO: 547449 - RNA, 20 nt, Human
uauugcccuuggagcccgcg

SEQ ID NO: 547450 - RNA, 18 nt, Human
uuuugagaguggagcugc

SEQ ID NO: 547451 - RNA, 23 nt, Human
uuuuuuuuuuuuuugagagugga

SEQ ID NO: 547452 - RNA, 18 nt, Human
uuuuuuuuuuuuuuuuug

SEQ ID NO: 547453 - RNA, 23 nt, Human
aacccauuucuccuucacuucug

SEQ ID NO: 547454 - RNA, 20 nt, Human
cacaaaaaacccauuucucc

SEQ ID NO: 547455 - RNA, 19 nt, Human
uagagucacacacaacuga

SEQ ID NO: 547456 - RNA, 26 nt, Human
ucaagaccacaaaaaacccauuucuc

SEQ ID NO: 547457 - RNA, 19 nt, Human
agauccuuuacugagaucc

SEQ ID NO: 547458 - RNA, 18 nt, Human
caaaacagguuccugaau

SEQ ID NO: 547459 - RNA, 25 nt, Human
caaaacagguuccugaaugugugug

SEQ ID NO: 547460 - RNA, 21 nt, Human
ccugccuauaauacaucaaaa

SEQ ID NO: 547461 - RNA, 20 nt, Human
ccuuaacuuguuaacugagu

SEQ ID NO: 547462 - RNA, 19 nt, Human
uacaucaaaacagguuccu

SEQ ID NO: 547463 - RNA, 21 nt, Human
uacugagauccacuugaaaca

SEQ ID NO: 547464 - RNA, 22 nt, Human
uuuacugagauccacuugaaac

SEQ ID NO: 547465 - RNA, 18 nt, Human
aaaagacuaaacagauau

SEQ ID NO: 547466 - RNA, 22 nt, Human
auggcaacagauggugcgugcc

SEQ ID NO: 547467 - RNA, 20 nt, Human
caaaaucugcaauggccucg

SEQ ID NO: 547468 - RNA, 21 nt, Human
cacuaagcaucaaaggcccuc

SEQ ID NO: 547469 - RNA, 22 nt, Human
ccgcguuagcucgugccgaauu

SEQ ID NO: 547470 - RNA, 18 nt, Human
cugcaauggccucggccg

SEQ ID NO: 547471 - RNA, 19 nt, Human
ggacaaacuccagcuccac

SEQ ID NO: 547472 - RNA, 18 nt, Human
gugcgugccggggaccgc

SEQ ID NO: 547473 - RNA, 22 nt, Human
ucaaaggcccucguagucucgg

SEQ ID NO: 547474 - RNA, 24 nt, Human
uggaaggacaaacuccagcuccac

SEQ ID NO: 547475 - RNA, 18 nt, Human
uuuuuuuuuuuuaaaaga

SEQ ID NO: 547476 - RNA, 23 nt, Human
uuuuuuuuuuuuuuuuuuaaaag

SEQ ID NO: 547477 - RNA, 22 nt, Human
aagguuggauggcccaggcggg

SEQ ID NO: 547478 - RNA, 19 nt, Human
acaccgcaggcccugacag

SEQ ID NO: 547479 - RNA, 22 nt, Human
caacaagcaaucaaccagaaca

SEQ ID NO: 547480 - RNA, 19 nt, Human
caacacaccuuuguggcaa

SEQ ID NO: 547481 - RNA, 20 nt, Human
cacaccuuuguggcaacaag

SEQ ID NO: 547482 - RNA, 25 nt, Human
cacaccuuuguggcaacaagcaauc

SEQ ID NO: 547483 - RNA, 23 nt, Human
cagcucagaaguauaaucagcaa

SEQ ID NO: 547484 - RNA, 19 nt, Human
cccaggcgggaaacagagu

SEQ ID NO: 547485 - RNA, 19 nt, Human
cgcggaggugcuacggccg

SEQ ID NO: 547486 - RNA, 19 nt, Human
cucaacacaccuuuguggc

SEQ ID NO: 547487 - RNA, 19 nt, Human
cugagcccgcgagucacac

SEQ ID NO: 547488 - RNA, 20 nt, Human
gaaugggcucaacacaccuu

SEQ ID NO: 547489 - RNA, 23 nt, Human
gacagcggaaacgccgagagaga

SEQ ID NO: 547490 - RNA, 18 nt, Human
ggcgggaaacagagugga

SEQ ID NO: 547491 - RNA, 25 nt, Human
ucaauucaccucuucaucugagccu

SEQ ID NO: 547492 - RNA, 20 nt, Human
ucaccucuucaucugagccu

SEQ ID NO: 547493 - RNA, 23 nt, Human
ugaaugggcucaacacaccuuug

SEQ ID NO: 547494 - RNA, 19 nt, Human
uggcccaggcgggaaacag

SEQ ID NO: 547495 - RNA, 23 nt, Human
uuaaacagaccuuuagugacuga

SEQ ID NO: 547496 - RNA, 21 nt, Human
aaccugcggagaaaaccggcc

SEQ ID NO: 547497 - RNA, 19 nt, Human
aagaaagaaguggaagcgg

SEQ ID NO: 547498 - RNA, 23 nt, Human
acugggcgcaggagaaggugccg

SEQ ID NO: 547499 - RNA, 20 nt, Human
agaaggugccgccagugcgu

SEQ ID NO: 547500 - RNA, 21 nt, Human
agcacugcccgcaauggggau

SEQ ID NO: 547501 - RNA, 23 nt, Human
agccaacgccggcgguuccaaca

SEQ ID NO: 547502 - RNA, 19 nt, Human
caaccugcggagaaaaccg

SEQ ID NO: 547503 - RNA, 20 nt, Human
cagaaaacuccaaacaagaa

SEQ ID NO: 547504 - RNA, 21 nt, Human
ccgcggccgccggccuucggu

SEQ ID NO: 547505 - RNA, 19 nt, Human
cggaaaugcugcucggcug

SEQ ID NO: 547506 - RNA, 23 nt, Human
cucgaguuuuuuuuuuuuuuuuu

SEQ ID NO: 547507 - RNA, 30 nt, Human
gagccaacgccggcgguuccaacagaaaaa

SEQ ID NO: 547508 - RNA, 20 nt, Human
gaguuuuuuuuuuuuuuuuu

SEQ ID NO: 547509 - RNA, 22 nt, Human
gaguuuuuuuuuuuuuuuuuuu

SEQ ID NO: 547510 - RNA, 19 nt, Human
gcaauggggaugcaagucc

SEQ ID NO: 547511 - RNA, 19 nt, Human
gcggagaaaaccggccaca

SEQ ID NO: 547512 - RNA, 21 nt, Human
gggcuccgcggccgccggccu

SEQ ID NO: 547513 - RNA, 19 nt, Human
uacaaggcaugcggcgccc

SEQ ID NO: 547514 - RNA, 19 nt, Human
ucacugggcgcaggagaag

SEQ ID NO: 547515 - RNA, 22 nt, Human
ucacugggcgcaggagaaggug

SEQ ID NO: 547516 - RNA, 19 nt, Human
ucuucggagccaacgccgg

SEQ ID NO: 547517 - RNA, 23 nt, Human
ugcugcucggcuguguacaggca

SEQ ID NO: 547518 - RNA, 18 nt, Human
ugggucuccgggacacgu

SEQ ID NO: 547519 - RNA, 22 nt, Human
uuccaacagaaaacuccaaaca

SEQ ID NO: 547520 - RNA, 20 nt, Human
aaaaaaggaauucccucuag

SEQ ID NO: 547521 - RNA, 25 nt, Human
aaaacccuuucaaucuucaauacuc

SEQ ID NO: 547522 - RNA, 21 nt, Human
aaaagcaggcaaguuuagcua

SEQ ID NO: 547523 - RNA, 21 nt, Human
aaacaaaaaacccacaaccca

SEQ ID NO: 547524 - RNA, 23 nt, Human
aaacacugggaauuaccacgacc

SEQ ID NO: 547525 - RNA, 18 nt, Human
aaagaucagauuuauuug

SEQ ID NO: 547526 - RNA, 24 nt, Human
aaaucccaucaagguuguaagaaa

SEQ ID NO: 547527 - RNA, 20 nt, Human
aaauucacuugguacacacc

SEQ ID NO: 547528 - RNA, 20 nt, Human
aaccacgauuuucccauuua

SEQ ID NO: 547529 - RNA, 27 nt, Human
aagcuucuuuucaaaccacgauuuucc

SEQ ID NO: 547530 - RNA, 20 nt, Human
aauuaccacgacccccaagu

SEQ ID NO: 547531 - RNA, 21 nt, Human
acacaauuuuccccuauuacc

SEQ ID NO: 547532 - RNA, 23 nt, Human
accaagcugaucccuacaaaaau

SEQ ID NO: 547533 - RNA, 19 nt, Human
accacaacuuuuccucuaa

SEQ ID NO: 547534 - RNA, 19 nt, Human
accacgacccccaagugcu

SEQ ID NO: 547535 - RNA, 21 nt, Human
acuaggacacagaaaacacug

SEQ ID NO: 547536 - RNA, 18 nt, Human
acuguguugcaagagaaa

SEQ ID NO: 547537 - RNA, 23 nt, Human
agaaaaacccuuucaaucuucaa

SEQ ID NO: 547538 - RNA, 22 nt, Human
agaaaccaggaccuuguuaaau

SEQ ID NO: 547539 - RNA, 24 nt, Human
agacaugaagagggcaaacccuag

SEQ ID NO: 547540 - RNA, 22 nt, Human
agaguagcaugaagaacuuaag

SEQ ID NO: 547541 - RNA, 21 nt, Human
agaugaugauaagagucuaaa

SEQ ID NO: 547542 - RNA, 18 nt, Human
agcaggcaaggagaacca

SEQ ID NO: 547543 - RNA, 21 nt, Human
agcaucaggagcaggcaagga

SEQ ID NO: 547544 - RNA, 22 nt, Human
agcaugcaaaauaauuucauuu

SEQ ID NO: 547545 - RNA, 26 nt, Human
agguaggggagagggaaaaacaguuu

SEQ ID NO: 547546 - RNA, 21 nt, Human
auaaaccaacaccccugcaug

SEQ ID NO: 547547 - RNA, 18 nt, Human
aucacugucauuaccauu

SEQ ID NO: 547548 - RNA, 20 nt, Human
aucucacacuuuuccuucua

SEQ ID NO: 547549 - RNA, 18 nt, Human
auucaggagcgggacauu

SEQ ID NO: 547550 - RNA, 22 nt, Human
caaaaaacccacaacccaaagg

SEQ ID NO: 547551 - RNA, 21 nt, Human
caacaaaacaacacauugguc

SEQ ID NO: 547552 - RNA, 25 nt, Human
caagaucaagguguuucuccgcuaa

SEQ ID NO: 547553 - RNA, 20 nt, Human
caagguaggggagagggaaa

SEQ ID NO: 547554 - RNA, 19 nt, Human
caccacaacuuuuccucua

SEQ ID NO: 547555 - RNA, 22 nt, Human
caccacaacuuuuccucuaaaa

SEQ ID NO: 547556 - RNA, 20 nt, Human
cacgcauaaaccaacacccc

SEQ ID NO: 547557 - RNA, 23 nt, Human
cagcacgcauaaaccaacacccc

SEQ ID NO: 547558 - RNA, 19 nt, Human
cagcagcaugcaaaauaau

SEQ ID NO: 547559 - RNA, 27 nt, Human
ccacuggguaaauuauauucauuaugc

SEQ ID NO: 547560 - RNA, 22 nt, Human
cccaaccagguuccaggcauua

SEQ ID NO: 547561 - RNA, 23 nt, Human
cccacugcugcagcacgcauaaa

SEQ ID NO: 547562 - RNA, 24 nt, Human
ccccuauuaccuggugcaaaauga

SEQ ID NO: 547563 - RNA, 20 nt, Human
ccccugggggguuaaaaaaa

SEQ ID NO: 547564 - RNA, 21 nt, Human
cccugcauggcugaacagggc

SEQ ID NO: 547565 - RNA, 24 nt, Human
ccuauagucucacucccaacuacc

SEQ ID NO: 547566 - RNA, 20 nt, Human
ccuccccuacugcccaacca

SEQ ID NO: 547567 - RNA, 22 nt, Human
ccucuaggcuggcccccaaaac

SEQ ID NO: 547568 - RNA, 19 nt, Human
ccuucuaccucccuccccu

SEQ ID NO: 547569 - RNA, 18 nt, Human
cucaucacuucccaaaag

SEQ ID NO: 547570 - RNA, 18 nt, Human
cucccuccccuacugccc

SEQ ID NO: 547571 - RNA, 22 nt, Human
cuggcagccuccuggagacuag

SEQ ID NO: 547572 - RNA, 27 nt, Human
cugucuaccaagcugaucccuacaaaa

SEQ ID NO: 547573 - RNA, 21 nt, Human
cuuguuaaauaguucucucca

SEQ ID NO: 547574 - RNA, 22 nt, Human
cuuuauggccuauagucucacu

SEQ ID NO: 547575 - RNA, 24 nt, Human
gaaaacacugggaauuaccacgac

SEQ ID NO: 547576 - RNA, 23 nt, Human
gaauucauauaugccacaauagg

SEQ ID NO: 547577 - RNA, 24 nt, Human
gacucaucacuucccaaaagcuuc

SEQ ID NO: 547578 - RNA, 22 nt, Human
gagaaaacaaaaaacccacaac

SEQ ID NO: 547579 - RNA, 18 nt, Human
gagaauucauauaugcca

SEQ ID NO: 547580 - RNA, 22 nt, Human
gagaccccuaggcacuaaucac

SEQ ID NO: 547581 - RNA, 20 nt, Human
gagagggaaaaacaguuuug

SEQ ID NO: 547582 - RNA, 20 nt, Human
gauucuuccuuucagaguuc

SEQ ID NO: 547583 - RNA, 20 nt, Human
gcccacugcugcagcacgca

SEQ ID NO: 547584 - RNA, 23 nt, Human
gcugcagcacgcauaaaccaaca

SEQ ID NO: 547585 - RNA, 18 nt, Human
gcuguagucccuuucucu

SEQ ID NO: 547586 - RNA, 18 nt, Human
ggaaaaaucccaucaagg

SEQ ID NO: 547587 - RNA, 18 nt, Human
ggagaaaacaaaaaaccc

SEQ ID NO: 547588 - RNA, 24 nt, Human
ggagaaaagcacaggauguagagg

SEQ ID NO: 547589 - RNA, 22 nt, Human
ggggacaagguaggggagaggg

SEQ ID NO: 547590 - RNA, 23 nt, Human
ggggacaagguaggggagaggga

SEQ ID NO: 547591 - RNA, 23 nt, Human
guuuugauuugcucucgaauguu

SEQ ID NO: 547592 - RNA, 31 nt, Human
uaaaaaaacaacaacaaaacaacacauuggg

SEQ ID NO: 547593 - RNA, 25 nt, Human
uaaaaaagaaagaaaaacccuuuca

SEQ ID NO: 547594 - RNA, 20 nt, Human
uaaaagcaggcaaguuuagc

SEQ ID NO: 547595 - RNA, 19 nt, Human
uaaaagguagaaaucucac

SEQ ID NO: 547596 - RNA, 18 nt, Human
uacaucaagacaucuccc

SEQ ID NO: 547597 - RNA, 21 nt, Human
uacaucaagacaucucccagg

SEQ ID NO: 547598 - RNA, 23 nt, Human
uaccaagcugaucccuacaaaaa

SEQ ID NO: 547599 - RNA, 26 nt, Human
uaccacgacccccaagugcuuccggc

SEQ ID NO: 547600 - RNA, 19 nt, Human
uaccuggugcaaaaugacu

SEQ ID NO: 547601 - RNA, 19 nt, Human
uagaaaucucacacuuuuc

SEQ ID NO: 547602 - RNA, 24 nt, Human
uagcaugaagaacuuaagaugaug

SEQ ID NO: 547603 - RNA, 23 nt, Human
uagcuacuggccaauccacacca

SEQ ID NO: 547604 - RNA, 28 nt, Human
uaggcuggcccccaaaacucagaauuaa

SEQ ID NO: 547605 - RNA, 25 nt, Human
uaguuuguuuuucuuuuuuaaaaaa

SEQ ID NO: 547606 - RNA, 21 nt, Human
uauucuagagcacucugauca

SEQ ID NO: 547607 - RNA, 19 nt, Human
ucacacuuuuccuucuacc

SEQ ID NO: 547608 - RNA, 25 nt, Human
ucacuucccaaaagcuucuuuucaa

SEQ ID NO: 547609 - RNA, 21 nt, Human
uccaagaguggaaaauuuauu

SEQ ID NO: 547610 - RNA, 21 nt, Human
uccaagcaucaggagcaggca

SEQ ID NO: 547611 - RNA, 23 nt, Human
uccaagcaucaggagcaggcaag

SEQ ID NO: 547612 - RNA, 23 nt, Human
uccaucauccaagaccauccauu

SEQ ID NO: 547613 - RNA, 26 nt, Human
uccauggcugagaaaaugcccaagac

SEQ ID NO: 547614 - RNA, 18 nt, Human
ucccucuaggcuggcccc

SEQ ID NO: 547615 - RNA, 22 nt, Human
ucccucuaggcuggcccccaaa

SEQ ID NO: 547616 - RNA, 19 nt, Human
ucuaggcuggcccccaaaa

SEQ ID NO: 547617 - RNA, 19 nt, Human
ucuccauuaccauuuauuc

SEQ ID NO: 547618 - RNA, 21 nt, Human
ucuggauagagguuuugauuu

SEQ ID NO: 547619 - RNA, 23 nt, Human
ucuuuuuuaaaaaagaaagaaaa

SEQ ID NO: 547620 - RNA, 20 nt, Human
ugaguuuuauuuugucuugu

SEQ ID NO: 547621 - RNA, 20 nt, Human
ugaugggagaagggcuugca

SEQ ID NO: 547622 - RNA, 20 nt, Human
ugcaaaccaagaucaaggug

SEQ ID NO: 547623 - RNA, 19 nt, Human
ugccacaauaggauaaaaa

SEQ ID NO: 547624 - RNA, 19 nt, Human
ugcucucgaauguuccagg

SEQ ID NO: 547625 - RNA, 24 nt, Human
ugcugcagcacgcauaaaccaaca

SEQ ID NO: 547626 - RNA, 18 nt, Human
uggauauaacuauuugga

SEQ ID NO: 547627 - RNA, 21 nt, Human
ugggggguuaaaaaaaaaaaa

SEQ ID NO: 547628 - RNA, 22 nt, Human
ugggggguuaaaaaaaaaaaag

SEQ ID NO: 547629 - RNA, 25 nt, Human
uggucuggccaccucaugaauccaa

SEQ ID NO: 547630 - RNA, 18 nt, Human
ugucuugucuggauagag

SEQ ID NO: 547631 - RNA, 24 nt, Human
uuagcuacuggccaauccacacca

SEQ ID NO: 547632 - RNA, 19 nt, Human
uuauucagauaauguuuga

SEQ ID NO: 547633 - RNA, 21 nt, Human
uucaaaccacgauuuucccau

SEQ ID NO: 547634 - RNA, 23 nt, Human
uucaauacucuuuaaaagcccac

SEQ ID NO: 547635 - RNA, 22 nt, Human
uucacuugguacacaccuuugu

SEQ ID NO: 547636 - RNA, 24 nt, Human
uucaggagauggugaguuuuauuu

SEQ ID NO: 547637 - RNA, 23 nt, Human
uugcuggaggucacacaauuuuc

SEQ ID NO: 547638 - RNA, 19 nt, Human
uugggagguuaagaguagc

SEQ ID NO: 547639 - RNA, 21 nt, Human
uuuaaaaaagaaagaaaaacc

SEQ ID NO: 547640 - RNA, 22 nt, Human
uuuccccuauuaccuggugcaa

SEQ ID NO: 547641 - RNA, 22 nt, Human
uuugcucucgaauguuccaggg

SEQ ID NO: 547642 - RNA, 23 nt, Human
uuuuucuuuuuuaaaaaagaaag

SEQ ID NO: 547643 - RNA, 23 nt, Human
aaaaaaauccaaacuguugacac

SEQ ID NO: 547644 - RNA, 20 nt, Human
aaaagaaaaucccaaaugua

SEQ ID NO: 547645 - RNA, 21 nt, Human
aaaagcccauaaaccaacccg

SEQ ID NO: 547646 - RNA, 19 nt, Human
aacagcuucacacagagug

SEQ ID NO: 547647 - RNA, 21 nt, Human
aagaaaaucccaaauguacaa

SEQ ID NO: 547648 - RNA, 23 nt, Human
aagauccuuccaucauaaugcgg

SEQ ID NO: 547649 - RNA, 18 nt, Human
aagcaggguccugcccag

SEQ ID NO: 547650 - RNA, 18 nt, Human
acacacuuagcauaugca

SEQ ID NO: 547651 - RNA, 27 nt, Human
accaaacagcuucacacagagugcucc

SEQ ID NO: 547652 - RNA, 23 nt, Human
auaaugcggaccacaccagaugc

SEQ ID NO: 547653 - RNA, 23 nt, Human
auaucuuacaaaaaagaaagacc

SEQ ID NO: 547654 - RNA, 23 nt, Human
augaagcaggguccugcccagug

SEQ ID NO: 547655 - RNA, 24 nt, Human
caaauguacaagugaaaaaaaucc

SEQ ID NO: 547656 - RNA, 18 nt, Human
cccauaaaccaacccgag

SEQ ID NO: 547657 - RNA, 26 nt, Human
cuauacauuuauuuccucagaacccu

SEQ ID NO: 547658 - RNA, 19 nt, Human
cugcacucggugccuccgc

SEQ ID NO: 547659 - RNA, 18 nt, Human
cuucacacagagugcucc

SEQ ID NO: 547660 - RNA, 19 nt, Human
gcccauaaaccaacccgag

SEQ ID NO: 547661 - RNA, 23 nt, Human
ggauugacaacauugugcauccu

SEQ ID NO: 547662 - RNA, 21 nt, Human
uaaucaaccaaaagaaaaucc

SEQ ID NO: 547663 - RNA, 25 nt, Human
uacaaaaaagaaagaccauuuccag

SEQ ID NO: 547664 - RNA, 26 nt, Human
uccaaaguaaaagcccauaaaccaac

SEQ ID NO: 547665 - RNA, 21 nt, Human
ucuguacauaagggucuauac

SEQ ID NO: 547666 - RNA, 19 nt, Human
uggguuccaccaaacagcu

SEQ ID NO: 547667 - RNA, 22 nt, Human
uguacauaagggucuauacauu

SEQ ID NO: 547668 - RNA, 18 nt, Human
uuuauacacaggucugua

SEQ ID NO: 547669 - RNA, 23 nt, Human
aaaaagaaaagauuaaaacagaa

SEQ ID NO: 547670 - RNA, 25 nt, Human
aaaaagaaaagauuaaaacagaaaa

SEQ ID NO: 547671 - RNA, 22 nt, Human
aacuuuuuuuuuuuuuugcuaa

SEQ ID NO: 547672 - RNA, 18 nt, Human
aaggggaugggguagggg

SEQ ID NO: 547673 - RNA, 18 nt, Human
aguuguuuacagaaacug

SEQ ID NO: 547674 - RNA, 24 nt, Human
augccaaaaaaaaaaaaaucuuuc

SEQ ID NO: 547675 - RNA, 28 nt, Human
augugcugaauaaggggaugggguaggg

SEQ ID NO: 547676 - RNA, 25 nt, Human
auuugaugccaaaaaaaaaaaaauc

SEQ ID NO: 547677 - RNA, 20 nt, Human
caaacuucaguuuccucauc

SEQ ID NO: 547678 - RNA, 22 nt, Human
cauguacaccuuuuuuucucuu

SEQ ID NO: 547679 - RNA, 18 nt, Human
cgcaagauuuggaugccc

SEQ ID NO: 547680 - RNA, 20 nt, Human
gaauaaggggaugggguagg

SEQ ID NO: 547681 - RNA, 22 nt, Human
gcaauguuugucuuuauuuugu

SEQ ID NO: 547682 - RNA, 23 nt, Human
gcagaaagauuugaugccaaaaa

SEQ ID NO: 547683 - RNA, 22 nt, Human
guuaccuugggaaaaugaugug

SEQ ID NO: 547684 - RNA, 18 nt, Human
uaccuuguucaccccaaa

SEQ ID NO: 547685 - RNA, 22 nt, Human
uaccuuguucaccccaaacuuu

SEQ ID NO: 547686 - RNA, 25 nt, Human
uaccuuguucaccccaaacuuucuc

SEQ ID NO: 547687 - RNA, 22 nt, Human
uauuuuguucuuuauauuuuca

SEQ ID NO: 547688 - RNA, 23 nt, Human
ucaggguagcacuuuuuuuuuuu

SEQ ID NO: 547689 - RNA, 19 nt, Human
uccaaacuucaguuuccuc

SEQ ID NO: 547690 - RNA, 20 nt, Human
ucucaggguagcacuuuuuu

SEQ ID NO: 547691 - RNA, 19 nt, Human
ucugaagcaagcugagagg

SEQ ID NO: 547692 - RNA, 25 nt, Human
ucuuuuguuucauuuuguguauuug

SEQ ID NO: 547693 - RNA, 20 nt, Human
ugaagcaagcugagaggcag

SEQ ID NO: 547694 - RNA, 22 nt, Human
ugagagaguccaggggacgaug

SEQ ID NO: 547695 - RNA, 25 nt, Human
uggaugccccuuguuuauuucaugu

SEQ ID NO: 547696 - RNA, 25 nt, Human
ugggaaaaugaugugaucgcuccaa

SEQ ID NO: 547697 - RNA, 21 nt, Human
ugggguagggguucccggcug

SEQ ID NO: 547698 - RNA, 22 nt, Human
ugggguagggguucccggcugg

SEQ ID NO: 547699 - RNA, 19 nt, Human
ugucccgggggcguugccg

SEQ ID NO: 547700 - RNA, 23 nt, Human
uguuuugauuacuauugugauuu

SEQ ID NO: 547701 - RNA, 26 nt, Human
uucaaagugaaaagaaauaguacuga

SEQ ID NO: 547702 - RNA, 23 nt, Human
uucuauguauuuacaagccuuaa

SEQ ID NO: 547703 - RNA, 20 nt, Human
uugaugccaaaaaaaaaaaa

SEQ ID NO: 547704 - RNA, 23 nt, Human
uugaugccaaaaaaaaaaaaauc

SEQ ID NO: 547705 - RNA, 27 nt, Human
uugaugccaaaaaaaaaaaaaucuuuc

SEQ ID NO: 547706 - RNA, 20 nt, Human
uuuacaagccuuaaaguugc

SEQ ID NO: 547707 - RNA, 26 nt, Human
uuuuuucucuuuccccucucccacuc

SEQ ID NO: 547708 - RNA, 22 nt, Human
uuuuuuuuuuuuaaacaauucu

SEQ ID NO: 547709 - RNA, 23 nt, Human
aaaaaaaaagaaaaaagaaagaa

SEQ ID NO: 547710 - RNA, 26 nt, Human
aaaaaaaauccucuuuggugugacaa

SEQ ID NO: 547711 - RNA, 20 nt, Human
aaaaaaacagaggugaaugg

SEQ ID NO: 547712 - RNA, 18 nt, Human
aaaaagaaaaaagaaaga

SEQ ID NO: 547713 - RNA, 27 nt, Human
aaaaauaucccaagucuuacaccaaaa

SEQ ID NO: 547714 - RNA, 21 nt, Human
aaacagucagaacccauaaua

SEQ ID NO: 547715 - RNA, 23 nt, Human
aaagccacacugaacgaaaaaau

SEQ ID NO: 547716 - RNA, 18 nt, Human
aaaguguagcaugauguu

SEQ ID NO: 547717 - RNA, 23 nt, Human
aagcaaccaaaaucuaaaaagca

SEQ ID NO: 547718 - RNA, 19 nt, Human
aaguucucucaguacaaag

SEQ ID NO: 547719 - RNA, 24 nt, Human
acacgacuucaaagacaauuuggg

SEQ ID NO: 547720 - RNA, 22 nt, Human
acaguaugucuaacauuuugga

SEQ ID NO: 547721 - RNA, 18 nt, Human
acauguugcacuucuggc

SEQ ID NO: 547722 - RNA, 21 nt, Human
acccaacgcugcucgcccggg

SEQ ID NO: 547723 - RNA, 18 nt, Human
acccuaagggcaaaagcu

SEQ ID NO: 547724 - RNA, 25 nt, Human
acccuaagggcaaaagcugaaaaau

SEQ ID NO: 547725 - RNA, 19 nt, Human
acccuuccuuguuucuccc

SEQ ID NO: 547726 - RNA, 22 nt, Human
agaaaaaagaaagaaaaucaag

SEQ ID NO: 547727 - RNA, 22 nt, Human
agaucagccuugcggcaaagaa

SEQ ID NO: 547728 - RNA, 20 nt, Human
aggcauuacagaacaaacug

SEQ ID NO: 547729 - RNA, 21 nt, Human
aggguaacugccaagagguuu

SEQ ID NO: 547730 - RNA, 25 nt, Human
agguaccaauggcugcgcaacagcu

SEQ ID NO: 547731 - RNA, 24 nt, Human
aguuaucaacucuuguguguccaa

SEQ ID NO: 547732 - RNA, 20 nt, Human
aucaacucuuguguguccaa

SEQ ID NO: 547733 - RNA, 19 nt, Human
aucaagccaaccaaguuuu

SEQ ID NO: 547734 - RNA, 22 nt, Human
aucuuugauugcaacuuuuugg

SEQ ID NO: 547735 - RNA, 25 nt, Human
auuacaauuaaguuugcuuuacauc

SEQ ID NO: 547736 - RNA, 19 nt, Human
caaagcacauucccuccag

SEQ ID NO: 547737 - RNA, 19 nt, Human
caaauccuuaagacaguuc

SEQ ID NO: 547738 - RNA, 20 nt, Human
cacaaaaaaacagaggugaa

SEQ ID NO: 547739 - RNA, 21 nt, Human
caccaguaucuccuacagaau

SEQ ID NO: 547740 - RNA, 22 nt, Human
cacccgaaucuugaucaaaggc

SEQ ID NO: 547741 - RNA, 20 nt, Human
cacugaguaugcugagugca

SEQ ID NO: 547742 - RNA, 22 nt, Human
cagaggugaaugguauaagcca

SEQ ID NO: 547743 - RNA, 19 nt, Human
caggaccuaacaauaucug

SEQ ID NO: 547744 - RNA, 26 nt, Human
caucugaagaacgaccaaaaucaaac

SEQ ID NO: 547745 - RNA, 19 nt, Human
cauugggcuuaauaacaga

SEQ ID NO: 547746 - RNA, 24 nt, Human
ccacacccgucagcgccggagcug

SEQ ID NO: 547747 - RNA, 21 nt, Human
ccacacugaacgaaaaaauac

SEQ ID NO: 547748 - RNA, 22 nt, Human
ccacacugaacgaaaaaauaca

SEQ ID NO: 547749 - RNA, 18 nt, Human
ccccaaagcaaguucucu

SEQ ID NO: 547750 - RNA, 24 nt, Human
cccgggacugggaugaagugaggc

SEQ ID NO: 547751 - RNA, 21 nt, Human
ccgccgagcagcggggagggg

SEQ ID NO: 547752 - RNA, 22 nt, Human
cgcgguccacacccgucagcgc

SEQ ID NO: 547753 - RNA, 18 nt, Human
cgggccagaugccgccgc

SEQ ID NO: 547754 - RNA, 22 nt, Human
cuaaagcccugcaugggcucug

SEQ ID NO: 547755 - RNA, 24 nt, Human
cuagaagcccugaacauguuuucc

SEQ ID NO: 547756 - RNA, 18 nt, Human
cuggagaagaagggauga

SEQ ID NO: 547757 - RNA, 22 nt, Human
cuuaagucauucagagccaaac

SEQ ID NO: 547758 - RNA, 23 nt, Human
gcaacauacaaguuugaagaaaa

SEQ ID NO: 547759 - RNA, 21 nt, Human
gcaaguucucucaguacaaag

SEQ ID NO: 547760 - RNA, 21 nt, Human
gccacacugaacgaaaaaaua

SEQ ID NO: 547761 - RNA, 20 nt, Human
ggacugggaugaagugaggc

SEQ ID NO: 547762 - RNA, 22 nt, Human
ggcaaagaauuugaaaccuagg

SEQ ID NO: 547763 - RNA, 25 nt, Human
ggcaagaaagcaaccaaaaucuaaa

SEQ ID NO: 547764 - RNA, 23 nt, Human
ggggaggggcugucccagcgacg

SEQ ID NO: 547765 - RNA, 22 nt, Human
ggucucugacaugaaaaaauuu

SEQ ID NO: 547766 - RNA, 22 nt, Human
guaugcugagugcaacuuagcu

SEQ ID NO: 547767 - RNA, 24 nt, Human
gucagcgccggagcugggcgaccu

SEQ ID NO: 547768 - RNA, 20 nt, Human
uaaacaaauccuuaagacag

SEQ ID NO: 547769 - RNA, 23 nt, Human
uaaacccuaagggcaaaagcuga

SEQ ID NO: 547770 - RNA, 24 nt, Human
uaaaguaaggagccaguuacuuca

SEQ ID NO: 547771 - RNA, 22 nt, Human
uaaauaagcaaacuacaucugc

SEQ ID NO: 547772 - RNA, 21 nt, Human
uaacaauaucuggcaggcucc

SEQ ID NO: 547773 - RNA, 18 nt, Human
uaacagaccacucacagu

SEQ ID NO: 547774 - RNA, 23 nt, Human
uaacuacuacgcacacacaaaau

SEQ ID NO: 547775 - RNA, 21 nt, Human
uacaaaguaacuacuacgcac

SEQ ID NO: 547776 - RNA, 21 nt, Human
uagaaccucauuagcuugaca

SEQ ID NO: 547777 - RNA, 24 nt, Human
uagaaccucauuagcuugacacug

SEQ ID NO: 547778 - RNA, 18 nt, Human
uagaugucucauugggcu

SEQ ID NO: 547779 - RNA, 21 nt, Human
uaguuaagugcacccuuccuu

SEQ ID NO: 547780 - RNA, 21 nt, Human
uauaagccacugcuccaaaau

SEQ ID NO: 547781 - RNA, 24 nt, Human
ucaagccaaccaaguuuuauuaca

SEQ ID NO: 547782 - RNA, 22 nt, Human
ucauucagagccaaacaucuga

SEQ ID NO: 547783 - RNA, 28 nt, Human
uccaaaauuaacccuaucgauucucgau

SEQ ID NO: 547784 - RNA, 19 nt, Human
ucccaagucuuacaccaaa

SEQ ID NO: 547785 - RNA, 23 nt, Human
ucccaagucuuacaccaaaauag

SEQ ID NO: 547786 - RNA, 19 nt, Human
uccuguugaggaccucuuu

SEQ ID NO: 547787 - RNA, 20 nt, Human
uccuuguuucucccaaauaa

SEQ ID NO: 547788 - RNA, 24 nt, Human
ucuagaagcccugaacauguuuuc

SEQ ID NO: 547789 - RNA, 23 nt, Human
ucuccaaguuucaaauccugcuc

SEQ ID NO: 547790 - RNA, 23 nt, Human
ugaacaaaguucagauuauguga

SEQ ID NO: 547791 - RNA, 24 nt, Human
ugaacaaaguucagauuaugugaa

SEQ ID NO: 547792 - RNA, 22 nt, Human
ugaagaacgaccaaaaucaaaa

SEQ ID NO: 547793 - RNA, 18 nt, Human
ugaaguaaaaaauauccc

SEQ ID NO: 547794 - RNA, 22 nt, Human
ugacaaagcacauucccuccag

SEQ ID NO: 547795 - RNA, 18 nt, Human
ugaggaaguuaucaacuc

SEQ ID NO: 547796 - RNA, 23 nt, Human
ugaggaccucuuugcagccccag

SEQ ID NO: 547797 - RNA, 19 nt, Human
ugccgccgccgagcagcgg

SEQ ID NO: 547798 - RNA, 23 nt, Human
uguguguccaaaucuaaagcccu

SEQ ID NO: 547799 - RNA, 18 nt, Human
uguugaggaccucuuugc

SEQ ID NO: 547800 - RNA, 20 nt, Human
uucaugaggaaguuaucaac

SEQ ID NO: 547801 - RNA, 23 nt, Human
uucccuggcucauccaacgugca

SEQ ID NO: 547802 - RNA, 21 nt, Human
uucgaaguuuggcaccagacu

SEQ ID NO: 547803 - RNA, 23 nt, Human
uucgaaguuuggcaccagacuga

SEQ ID NO: 547804 - RNA, 23 nt, Human
uugcacauacauguugcacuucu

SEQ ID NO: 547805 - RNA, 18 nt, Human
uugguaucuucugucugg

SEQ ID NO: 547806 - RNA, 24 nt, Human
uuguaugcuauguuuccccaauac

SEQ ID NO: 547807 - RNA, 24 nt, Human
uuuaaacaaauccuuaagacaguu

SEQ ID NO: 547808 - RNA, 21 nt, Human
uuuggcaagaaagcaaccaaa

SEQ ID NO: 547809 - RNA, 25 nt, Human
uuuuauaacuguauaaaugugaucc

SEQ ID NO: 547810 - RNA, 22 nt, Human
aaaaacagucacagaaucgugc

SEQ ID NO: 547811 - RNA, 21 nt, Human
aaagcaagauaaccaaauuaa

SEQ ID NO: 547812 - RNA, 19 nt, Human
aacacauuucuaauccacc

SEQ ID NO: 547813 - RNA, 21 nt, Human
acagagaaaaacagucacaga

SEQ ID NO: 547814 - RNA, 19 nt, Human
accacauacggauagcagu

SEQ ID NO: 547815 - RNA, 19 nt, Human
agagaaaaacagucacaga

SEQ ID NO: 547816 - RNA, 19 nt, Human
caacauagguuaaauuauc

SEQ ID NO: 547817 - RNA, 23 nt, Human
caacgaacgugaaacagagaaaa

SEQ ID NO: 547818 - RNA, 24 nt, Human
caacgaacgugaaacagagaaaaa

SEQ ID NO: 547819 - RNA, 22 nt, Human
cagugaauguauuucaccuucc

SEQ ID NO: 547820 - RNA, 26 nt, Human
cauuugaaaacauuauuuaauacaga

SEQ ID NO: 547821 - RNA, 23 nt, Human
ccccaaaaagaaauacuuucuaa

SEQ ID NO: 547822 - RNA, 18 nt, Human
cgucacgcgcggggcggg

SEQ ID NO: 547823 - RNA, 24 nt, Human
cucaacgaacgugaaacagagaaa

SEQ ID NO: 547824 - RNA, 18 nt, Human
gcgcugcgucagggugcc

SEQ ID NO: 547825 - RNA, 23 nt, Human
gugaaacagagaaaaacagucac

SEQ ID NO: 547826 - RNA, 28 nt, Human
uaagaaaagauucacaagcauugcucag

SEQ ID NO: 547827 - RNA, 21 nt, Human
uaauaaauaauucacauacaa

SEQ ID NO: 547828 - RNA, 26 nt, Human
uauugaauucaacaagauguaccacc

SEQ ID NO: 547829 - RNA, 19 nt, Human
ucaaaaauagauuugauug

SEQ ID NO: 547830 - RNA, 29 nt, Human
ucaacaagauguaccaccaacagagacaa

SEQ ID NO: 547831 - RNA, 21 nt, Human
ugaaacagagaaaaacaguca

SEQ ID NO: 547832 - RNA, 20 nt, Human
ugaauguauuucaccuuccu

SEQ ID NO: 547833 - RNA, 24 nt, Human
acagaacuaaaguacuaaacagaa

SEQ ID NO: 547834 - RNA, 21 nt, Human
acauauguauuaauaugaaga

SEQ ID NO: 547835 - RNA, 20 nt, Human
acccauacccuaaaaccaag

SEQ ID NO: 547836 - RNA, 18 nt, Human
acccuaaaaccaagagaa

SEQ ID NO: 547837 - RNA, 27 nt, Human
agaaaacacagguuucccccuucuccc

SEQ ID NO: 547838 - RNA, 23 nt, Human
agacccauacccuaaaaccaaga

SEQ ID NO: 547839 - RNA, 22 nt, Human
auucagaaaugauucaagucaa

SEQ ID NO: 547840 - RNA, 18 nt, Human
caagggcaagcuuaauuc

SEQ ID NO: 547841 - RNA, 20 nt, Human
cccccuucucccaucauccc

SEQ ID NO: 547842 - RNA, 23 nt, Human
cccccuucucccaucaucccaag

SEQ ID NO: 547843 - RNA, 20 nt, Human
cccuaaaaccaagagaaaac

SEQ ID NO: 547844 - RNA, 19 nt, Human
cgccagcaccucgcggacu

SEQ ID NO: 547845 - RNA, 18 nt, Human
cggccgggagcccggcgu

SEQ ID NO: 547846 - RNA, 25 nt, Human
cuauaccaaaacauauuuuguuaca

SEQ ID NO: 547847 - RNA, 28 nt, Human
gaaguagacccauacccuaaaaccaaga

SEQ ID NO: 547848 - RNA, 21 nt, Human
gccugcuugguugcuagggaa

SEQ ID NO: 547849 - RNA, 26 nt, Human
guagacccauacccuaaaaccaagag

SEQ ID NO: 547850 - RNA, 21 nt, Human
uaaaaccaagagaaaacacag

SEQ ID NO: 547851 - RNA, 21 nt, Human
uaaacagaaagcgauucugua

SEQ ID NO: 547852 - RNA, 24 nt, Human
uagauuuacuuauucagaaaugau

SEQ ID NO: 547853 - RNA, 21 nt, Human
ucaguaaguguccugguaacu

SEQ ID NO: 547854 - RNA, 20 nt, Human
ucccagcgugcuccggcgcc

SEQ ID NO: 547855 - RNA, 23 nt, Human
uggggccagaguagucugcugga

SEQ ID NO: 547856 - RNA, 25 nt, Human
uuaaaaaacuuauaacaauacuuag

SEQ ID NO: 547857 - RNA, 22 nt, Human
uucaaagaaguagacccauacc

SEQ ID NO: 547858 - RNA, 19 nt, Human
uuuuguuacaagggcaagc

SEQ ID NO: 547859 - RNA, 26 nt, Human
auuauuuuccuucugugaccuuucca

SEQ ID NO: 547860 - RNA, 19 nt, Human
caagucugaaacaguccca

SEQ ID NO: 547861 - RNA, 18 nt, Human
ugugaccuuuccaagucg

SEQ ID NO: 547862 - RNA, 19 nt, Human
ugugaccuuuccaagucug

SEQ ID NO: 547863 - RNA, 18 nt, Human
uuuuuuuuuuuuuuuuug

SEQ ID NO: 547864 - RNA, 21 nt, Human
uuuuuuuuuuuuuuuuugcau

SEQ ID NO: 547865 - RNA, 24 nt, Human
uuuuuuuuuuuuuuuuuugcauag

SEQ ID NO: 547866 - RNA, 25 nt, Human
uuuuuuuuuuuuuuuuuuuauuuuu

SEQ ID NO: 547867 - RNA, 22 nt, Human
cgaucagcacugccagcugggc

SEQ ID NO: 547868 - RNA, 21 nt, Human
ugggaucgaucagcacugcca

SEQ ID NO: 547869 - RNA, 21 nt, Human
uuuuuuuuuuuuuuuuuccga

SEQ ID NO: 547870 - RNA, 23 nt, Human
uuuuuuuuuuuuuuuuuuuuccg

SEQ ID NO: 547871 - RNA, 27 nt, Human
uuuuuuuuuuuuuuuuuuuuuccgggg

SEQ ID NO: 547872 - RNA, 24 nt, Human
uuuuuuuuuuuuuuuuuuuuuccu

SEQ ID NO: 547873 - RNA, 22 nt, Human
cgaucagcacugccagcugggc

SEQ ID NO: 547874 - RNA, 21 nt, Human
ugggaucgaucagcacugcca

SEQ ID NO: 547875 - RNA, 22 nt, Human
aaaauaccauuuuuagccacga

SEQ ID NO: 547876 - RNA, 22 nt, Human
aaacaagaaauaaaaaaacugg

SEQ ID NO: 547877 - RNA, 23 nt, Human
aaacaagaaauaaaaaaacugga

SEQ ID NO: 547878 - RNA, 25 nt, Human
aaacugccaaaauaccauuuuuagc

SEQ ID NO: 547879 - RNA, 26 nt, Human
aaauaauuucagacuaaaacaagaaa

SEQ ID NO: 547880 - RNA, 22 nt, Human
aacaucccuuaucccugcugac

SEQ ID NO: 547881 - RNA, 19 nt, Human
aacgucucaugacauuucu

SEQ ID NO: 547882 - RNA, 20 nt, Human
aagaaauaaaaaaacuggac

SEQ ID NO: 547883 - RNA, 18 nt, Human
acacauucacucuuuagg

SEQ ID NO: 547884 - RNA, 21 nt, Human
aguaguaccaccacuaccacc

SEQ ID NO: 547885 - RNA, 23 nt, Human
auacugagccaauucaucaaugc

SEQ ID NO: 547886 - RNA, 25 nt, Human
auagcagcaauaaagcugggcagaa

SEQ ID NO: 547887 - RNA, 23 nt, Human
caagaaaacauacccauaauuuc

SEQ ID NO: 547888 - RNA, 20 nt, Human
caccccucuccccgaggccc

SEQ ID NO: 547889 - RNA, 20 nt, Human
cacucuuuaggauuugacuu

SEQ ID NO: 547890 - RNA, 19 nt, Human
cagcaauaaagcugggcag

SEQ ID NO: 547891 - RNA, 24 nt, Human
cauuaugucacuaauuuugguaaa

SEQ ID NO: 547892 - RNA, 24 nt, Human
ccaaaauaccauuuuuagccacga

SEQ ID NO: 547893 - RNA, 19 nt, Human
ccaccccucuccccgaggc

SEQ ID NO: 547894 - RNA, 20 nt, Human
ccacuaccaccaccguacuc

SEQ ID NO: 547895 - RNA, 18 nt, Human
cccgcacccuggcccagc

SEQ ID NO: 547896 - RNA, 25 nt, Human
cgaggcccgcgccaggagccgaggg

SEQ ID NO: 547897 - RNA, 23 nt, Human
cuaaaacaagaaauaaaaaaacu

SEQ ID NO: 547898 - RNA, 22 nt, Human
cuggacuauagguucaguaaca

SEQ ID NO: 547899 - RNA, 24 nt, Human
cuuccaccccucuccccgaggccc

SEQ ID NO: 547900 - RNA, 21 nt, Human
gacuucaaaaaggaugcuggg

SEQ ID NO: 547901 - RNA, 19 nt, Human
gagccgagggaggcgcagg

SEQ ID NO: 547902 - RNA, 21 nt, Human
gaggcccgcgccaggagccga

SEQ ID NO: 547903 - RNA, 23 nt, Human
gcaggcccgcacccuggcccagc

SEQ ID NO: 547904 - RNA, 20 nt, Human
gcuauggucaugcuaucauc

SEQ ID NO: 547905 - RNA, 20 nt, Human
gcuguguaucucaaugggcc

SEQ ID NO: 547906 - RNA, 21 nt, Human
gggcagaagcuaagcccagga

SEQ ID NO: 547907 - RNA, 24 nt, Human
ggugagaugauucuuuauuguaua

SEQ ID NO: 547908 - RNA, 22 nt, Human
uaaaauaaacaccuagccaaac

SEQ ID NO: 547909 - RNA, 24 nt, Human
uaaaauaaacaccuagccaaaccc

SEQ ID NO: 547910 - RNA, 26 nt, Human
uaaaauaaacaccuagccaaacccug

SEQ ID NO: 547911 - RNA, 19 nt, Human
uacaaacugccaaaauacc

SEQ ID NO: 547912 - RNA, 20 nt, Human
uacaaacugccaaaauacca

SEQ ID NO: 547913 - RNA, 21 nt, Human
uaccuccagguucauaagcuu

SEQ ID NO: 547914 - RNA, 21 nt, Human
uaucaaaaaguuugcucccuu

SEQ ID NO: 547915 - RNA, 22 nt, Human
uaucucaaugggccugcaauuu

SEQ ID NO: 547916 - RNA, 19 nt, Human
ucaauacaaacugccaaaa

SEQ ID NO: 547917 - RNA, 20 nt, Human
ugacaagaaaacauacccau

SEQ ID NO: 547918 - RNA, 20 nt, Human
ugagccaauucaucaaugca

SEQ ID NO: 547919 - RNA, 23 nt, Human
ugcuguguaucucaaugggccug

SEQ ID NO: 547920 - RNA, 19 nt, Human
uggcccagcuguccgcggg

SEQ ID NO: 547921 - RNA, 20 nt, Human
ugggcagaagcuaagcccag

SEQ ID NO: 547922 - RNA, 25 nt, Human
uggguuaagacccaaauagaaaguu

SEQ ID NO: 547923 - RNA, 20 nt, Human
ugugguaguagcacaaaaua

SEQ ID NO: 547924 - RNA, 20 nt, Human
uuaaaauaaacaccuagcca

SEQ ID NO: 547925 - RNA, 25 nt, Human
uuaaaauaaacaccuagccaaaccc

SEQ ID NO: 547926 - RNA, 20 nt, Human
uucagacuaaaacaagaaau

SEQ ID NO: 547927 - RNA, 24 nt, Human
uucauaagcuucacuuaauggcuc

SEQ ID NO: 547928 - RNA, 22 nt, Human
uuccagcaaagcuauggucaug

SEQ ID NO: 547929 - RNA, 23 nt, Human
uugcuguguaucucaaugggccu

SEQ ID NO: 547930 - RNA, 19 nt, Human
uuugcaggacagcuaacau

SEQ ID NO: 547931 - RNA, 21 nt, Human
aaauucacucuguaauaugaa

SEQ ID NO: 547932 - RNA, 23 nt, Human
aacaauuacaaaauuagaaaccu

SEQ ID NO: 547933 - RNA, 18 nt, Human
aacauuuuagcuauucuu

SEQ ID NO: 547934 - RNA, 24 nt, Human
aagaagauucacguaucaggcagc

SEQ ID NO: 547935 - RNA, 20 nt, Human
accaauuaaagauacaaaaa

SEQ ID NO: 547936 - RNA, 21 nt, Human
acuauccugcuucugaaacag

SEQ ID NO: 547937 - RNA, 23 nt, Human
agaaaaucuaauacaauguaaaa

SEQ ID NO: 547938 - RNA, 22 nt, Human
agaaagagucuugacucucuca

SEQ ID NO: 547939 - RNA, 19 nt, Human
agauccacaugagaaaaau

SEQ ID NO: 547940 - RNA, 18 nt, Human
aggcagcaaaauccagga

SEQ ID NO: 547941 - RNA, 21 nt, Human
auagcaacugaaauaaaaauc

SEQ ID NO: 547942 - RNA, 21 nt, Human
caaagcacaguggccuaaaga

SEQ ID NO: 547943 - RNA, 19 nt, Human
caacugaaauaaaaaucuc

SEQ ID NO: 547944 - RNA, 20 nt, Human
cacguaucaggcagcaaaau

SEQ ID NO: 547945 - RNA, 21 nt, Human
cagcucugucuguggaguaau

SEQ ID NO: 547946 - RNA, 19 nt, Human
ccccccaaguccgccccca

SEQ ID NO: 547947 - RNA, 18 nt, Human
cccuuagauccacaugag

SEQ ID NO: 547948 - RNA, 22 nt, Human
ccugucuucaguggcuucuuuu

SEQ ID NO: 547949 - RNA, 22 nt, Human
cgcccccaguaaaaaaugaucc

SEQ ID NO: 547950 - RNA, 25 nt, Human
cuaaagucaaucuaagugacaccau

SEQ ID NO: 547951 - RNA, 25 nt, Human
cuaagugacaccauaauuuuaacaa

SEQ ID NO: 547952 - RNA, 22 nt, Human
cuauauaaauuuccuguugccu

SEQ ID NO: 547953 - RNA, 18 nt, Human
cugaaauuuuucuucucu

SEQ ID NO: 547954 - RNA, 22 nt, Human
gaauuaaaaaaauuagaacuag

SEQ ID NO: 547955 - RNA, 21 nt, Human
gcaaagcacaguggccuaaag

SEQ ID NO: 547956 - RNA, 23 nt, Human
uaaagcauuccccuuagauccac

SEQ ID NO: 547957 - RNA, 21 nt, Human
uaaauguacauuauuuacagu

SEQ ID NO: 547958 - RNA, 23 nt, Human
uaagaaagagucuugacucucuc

SEQ ID NO: 547959 - RNA, 22 nt, Human
uaagugacaccauaauuuuaac

SEQ ID NO: 547960 - RNA, 19 nt, Human
uaaucuaaaaacauuucau

SEQ ID NO: 547961 - RNA, 19 nt, Human
uacacaaguggaaugaaaa

SEQ ID NO: 547962 - RNA, 23 nt, Human
uagaaaagaaacuuuaaaaaugc

SEQ ID NO: 547963 - RNA, 19 nt, Human
uagaacuagaagagaaagu

SEQ ID NO: 547964 - RNA, 19 nt, Human
uagaaucagucagucugca

SEQ ID NO: 547965 - RNA, 26 nt, Human
uagcaguauucuguuuagcacuuagc

SEQ ID NO: 547966 - RNA, 18 nt, Human
uaggaagaauuuauggca

SEQ ID NO: 547967 - RNA, 19 nt, Human
uauaacugacuacucagcc

SEQ ID NO: 547968 - RNA, 19 nt, Human
uauccugcuucugaaacag

SEQ ID NO: 547969 - RNA, 21 nt, Human
ucaagacuuaacuuacacaag

SEQ ID NO: 547970 - RNA, 20 nt, Human
ucagaaaaucuaauacaaug

SEQ ID NO: 547971 - RNA, 18 nt, Human
uccgcccccaguaaaaaa

SEQ ID NO: 547972 - RNA, 21 nt, Human
uccuucacgauugaauucuga

SEQ ID NO: 547973 - RNA, 20 nt, Human
ucucuuccuuuuaugagagg

SEQ ID NO: 547974 - RNA, 21 nt, Human
ucuguaauaugaaaacauagc

SEQ ID NO: 547975 - RNA, 22 nt, Human
ugaaaaaguaaucuaaaaacau

SEQ ID NO: 547976 - RNA, 25 nt, Human
ugaaaacauagcauuagaccucuaa

SEQ ID NO: 547977 - RNA, 18 nt, Human
ugagaggaacuaaagccc

SEQ ID NO: 547978 - RNA, 19 nt, Human
ugagaggaacuaaagccca

SEQ ID NO: 547979 - RNA, 21 nt, Human
ugauccaaaauauaaagcaau

SEQ ID NO: 547980 - RNA, 24 nt, Human
uggauauauauguuaucuuuguau

SEQ ID NO: 547981 - RNA, 20 nt, Human
uguaaaauuagaaaagaaac

SEQ ID NO: 547982 - RNA, 23 nt, Human
uguuuagaggauuccaaaauuua

SEQ ID NO: 547983 - RNA, 19 nt, Human
uuaaauguacauuauuuac

SEQ ID NO: 547984 - RNA, 25 nt, Human
uuaggaaauaaccugauaaugauuu

SEQ ID NO: 547985 - RNA, 22 nt, Human
uuagggaaggugcuucaguuuu

SEQ ID NO: 547986 - RNA, 19 nt, Human
uucuuggcccuuaagaaag

SEQ ID NO: 547987 - RNA, 24 nt, Human
uuguaugcaaccccccccaagucc

SEQ ID NO: 547988 - RNA, 20 nt, Human
uuuguaugcaacccccccca

SEQ ID NO: 547989 - RNA, 23 nt, Human
aaaaaaaacaaagaaaacuccag

SEQ ID NO: 547990 - RNA, 21 nt, Human
aaaaaaacaaagaaaacucca

SEQ ID NO: 547991 - RNA, 24 nt, Human
aaaaaaagaaaaaaaaacaaagaa

SEQ ID NO: 547992 - RNA, 23 nt, Human
aaaaaagaaaaaaaaacaaagaa

SEQ ID NO: 547993 - RNA, 22 nt, Human
aaaaagcuuuacacaaacaagc

SEQ ID NO: 547994 - RNA, 18 nt, Human
aaaacacuucuauacuga

SEQ ID NO: 547995 - RNA, 21 nt, Human
aaaagaaaaaaaaacaaagaa

SEQ ID NO: 547996 - RNA, 22 nt, Human
aaagaaaaaaaaacaaagaaaa

SEQ ID NO: 547997 - RNA, 19 nt, Human
aaauguugaauauacaaac

SEQ ID NO: 547998 - RNA, 22 nt, Human
aacuaaaaaaaagaaaaaaaga

SEQ ID NO: 547999 - RNA, 23 nt, Human
aagaggcaguuuucugucagcau

SEQ ID NO: 548000 - RNA, 20 nt, Human
accaaaacagaagauaaauu

SEQ ID NO: 548001 - RNA, 22 nt, Human
acccaucccaaccccucccacu

SEQ ID NO: 548002 - RNA, 23 nt, Human
acccaucccaaccccucccacug

SEQ ID NO: 548003 - RNA, 21 nt, Human
acugugcuagguacaagauuu

SEQ ID NO: 548004 - RNA, 20 nt, Human
agagaccaaaacagaagaua

SEQ ID NO: 548005 - RNA, 21 nt, Human
agagaccaaaacagaagauaa

SEQ ID NO: 548006 - RNA, 23 nt, Human
agagaccaaaacagaagauaaau

SEQ ID NO: 548007 - RNA, 18 nt, Human
agcaaaaggccagagcca

SEQ ID NO: 548008 - RNA, 20 nt, Human
agguauuagagcuaccugcc

SEQ ID NO: 548009 - RNA, 22 nt, Human
agucuuaguguaacuugauauc

SEQ ID NO: 548010 - RNA, 24 nt, Human
auagaauauacuucaaauguugaa

SEQ ID NO: 548011 - RNA, 19 nt, Human
auauauauauauauauaua

SEQ ID NO: 548012 - RNA, 19 nt, Human
auauauauauauauauaua

SEQ ID NO: 548013 - RNA, 19 nt, Human
auauauauauauauauaua

SEQ ID NO: 548014 - RNA, 19 nt, Human
auauauauauauauauaua

SEQ ID NO: 548015 - RNA, 19 nt, Human
auauauguauguauauaua

SEQ ID NO: 548016 - RNA, 23 nt, Human
auaugauauauauauauguaugu

SEQ ID NO: 548017 - RNA, 18 nt, Human
auguauauauauauauau

SEQ ID NO: 548018 - RNA, 19 nt, Human
auguauauauauauauaua

SEQ ID NO: 548019 - RNA, 22 nt, Human
auucaugcugagccugaacuuc

SEQ ID NO: 548020 - RNA, 23 nt, Human
auucuucaauucacauucuaaaa

SEQ ID NO: 548021 - RNA, 23 nt, Human
caacaaaauagaauauacuucaa

SEQ ID NO: 548022 - RNA, 23 nt, Human
caaccccucccacugaaaaacua

SEQ ID NO: 548023 - RNA, 20 nt, Human
caagccauuagcuuauuuca

SEQ ID NO: 548024 - RNA, 24 nt, Human
caagugacagcagaacugaaaaug

SEQ ID NO: 548025 - RNA, 19 nt, Human
cacacgccgugcgaccgac

SEQ ID NO: 548026 - RNA, 23 nt, Human
cagcaaaaggccagagccaacug

SEQ ID NO: 548027 - RNA, 21 nt, Human
caguacugccacuaacagccu

SEQ ID NO: 548028 - RNA, 23 nt, Human
caucccaaccccucccacugaaa

SEQ ID NO: 548029 - RNA, 22 nt, Human
ccaaaacagaagauaaauuuca

SEQ ID NO: 548030 - RNA, 20 nt, Human
ccacugaaacaugggauagg

SEQ ID NO: 548031 - RNA, 18 nt, Human
ccggagacacacgccgug

SEQ ID NO: 548032 - RNA, 19 nt, Human
cgcggccggagacacacgc

SEQ ID NO: 548033 - RNA, 24 nt, Human
cggaacccgcggccggagacacac

SEQ ID NO: 548034 - RNA, 23 nt, Human
cggcggcaggggaggaggcggaa

SEQ ID NO: 548035 - RNA, 25 nt, Human
cuaaaacacuucuauacugacuuuu

SEQ ID NO: 548036 - RNA, 19 nt, Human
cugcuuggucccuuucgau

SEQ ID NO: 548037 - RNA, 19 nt, Human
gaacccgcggccggagaca

SEQ ID NO: 548038 - RNA, 24 nt, Human
gcacuagaucuuuuuuugcuaucc

SEQ ID NO: 548039 - RNA, 18 nt, Human
gcagcggcggcaggggag

SEQ ID NO: 548040 - RNA, 18 nt, Human
gcggccggagacacacgc

SEQ ID NO: 548041 - RNA, 25 nt, Human
uaaaaaaaagaaaaaaaaacaaaga

SEQ ID NO: 548042 - RNA, 27 nt, Human
uaaaauaucaccagagaccaaaacaga

SEQ ID NO: 548043 - RNA, 19 nt, Human
uaacuugauaucguaguga

SEQ ID NO: 548044 - RNA, 24 nt, Human
uacaagauuuuuaaaauuuuucuu

SEQ ID NO: 548045 - RNA, 21 nt, Human
uacccaucccaaccccuccca

SEQ ID NO: 548046 - RNA, 22 nt, Human
uacuguaagaggcaguuuucug

SEQ ID NO: 548047 - RNA, 20 nt, Human
uagaauuucuucaugcagua

SEQ ID NO: 548048 - RNA, 18 nt, Human
uagcagagucuucacaua

SEQ ID NO: 548049 - RNA, 21 nt, Human
uagcagagucuucacauagca

SEQ ID NO: 548050 - RNA, 19 nt, Human
uauauauauauauauauau

SEQ ID NO: 548051 - RNA, 19 nt, Human
uauauauauauauauauau

SEQ ID NO: 548052 - RNA, 19 nt, Human
uauauauauauauauauau

SEQ ID NO: 548053 - RNA, 20 nt, Human
uauauauauguauguauaua

SEQ ID NO: 548054 - RNA, 18 nt, Human
uauaugauauauauauau

SEQ ID NO: 548055 - RNA, 20 nt, Human
uauauguauguauauauaua

SEQ ID NO: 548056 - RNA, 20 nt, Human
uauauguauguauauauaua

SEQ ID NO: 548057 - RNA, 22 nt, Human
uauauguauguauauauauaua

SEQ ID NO: 548058 - RNA, 28 nt, Human
uaucacuuccuaacuaaaacacuucuau

SEQ ID NO: 548059 - RNA, 23 nt, Human
uaugauauauauauauguaugua

SEQ ID NO: 548060 - RNA, 18 nt, Human
uauguauauauauauaua

SEQ ID NO: 548061 - RNA, 19 nt, Human
uauguauauauauauauau

SEQ ID NO: 548062 - RNA, 22 nt, Human
uauguauauauauauauauaua

SEQ ID NO: 548063 - RNA, 18 nt, Human
uauguauguauauauaua

SEQ ID NO: 548064 - RNA, 20 nt, Human
uauguauguauauauauaua

SEQ ID NO: 548065 - RNA, 22 nt, Human
uauguauguauauauauauaua

SEQ ID NO: 548066 - RNA, 25 nt, Human
ucaacuaaaaaaaagaaaaaaaaac

SEQ ID NO: 548067 - RNA, 21 nt, Human
ucacuuccuaacuaaaacacu

SEQ ID NO: 548068 - RNA, 18 nt, Human
ucagaaaaccuacuugaa

SEQ ID NO: 548069 - RNA, 24 nt, Human
uccacaauuaagaaacugacagac

SEQ ID NO: 548070 - RNA, 22 nt, Human
ucccggggcuggagcuggguac

SEQ ID NO: 548071 - RNA, 20 nt, Human
ucuaaaauaccuauauuagc

SEQ ID NO: 548072 - RNA, 23 nt, Human
ucugaaguuuuugggauccauuc

SEQ ID NO: 548073 - RNA, 21 nt, Human
ucuucaauucacauucuaaaa

SEQ ID NO: 548074 - RNA, 18 nt, Human
ucuucacauagcaccagu

SEQ ID NO: 548075 - RNA, 19 nt, Human
ugauaucguagugagcugc

SEQ ID NO: 548076 - RNA, 19 nt, Human
ugccacuaacagccugaag

SEQ ID NO: 548077 - RNA, 20 nt, Human
uggaaguagaauuucuucau

SEQ ID NO: 548078 - RNA, 18 nt, Human
uguauauauauauauaua

SEQ ID NO: 548079 - RNA, 22 nt, Human
uguauauauauauauauauaua

SEQ ID NO: 548080 - RNA, 22 nt, Human
uguauguauauauauauauaua

SEQ ID NO: 548081 - RNA, 19 nt, Human
ugucaguacugccacuaac

SEQ ID NO: 548082 - RNA, 20 nt, Human
ugucaguacugccacuaaca

SEQ ID NO: 548083 - RNA, 21 nt, Human
uguuuuaaagucuucuuugga

SEQ ID NO: 548084 - RNA, 19 nt, Human
uuaaaauaucaccagagac

SEQ ID NO: 548085 - RNA, 22 nt, Human
uuaagaaacugacagacuuaaa

SEQ ID NO: 548086 - RNA, 24 nt, Human
uuacagcaaaaggccagagccaac

SEQ ID NO: 548087 - RNA, 26 nt, Human
uuuaaaauaucaccagagaccaaaac

SEQ ID NO: 548088 - RNA, 23 nt, Human
uuuaucacuuccuaacuaaaaca

SEQ ID NO: 548089 - RNA, 25 nt, Human
uuucugaaguuuuugggauccauuc

SEQ ID NO: 548090 - RNA, 23 nt, Human
aaaaaggcacuuuaaugccaacu

SEQ ID NO: 548091 - RNA, 23 nt, Human
aaauacucaaugaauucagcucu

SEQ ID NO: 548092 - RNA, 21 nt, Human
aaggcacuuuaaugccaacug

SEQ ID NO: 548093 - RNA, 23 nt, Human
aaugcugcucaauuuugccuggu

SEQ ID NO: 548094 - RNA, 22 nt, Human
acaaagaagagaagagcgagag

SEQ ID NO: 548095 - RNA, 20 nt, Human
acccuggccacaaacuucug

SEQ ID NO: 548096 - RNA, 21 nt, Human
acugaaaugcaggggcaggug

SEQ ID NO: 548097 - RNA, 21 nt, Human
acugaaucucggcaugaacaa

SEQ ID NO: 548098 - RNA, 23 nt, Human
acugaaucucggcaugaacaaag

SEQ ID NO: 548099 - RNA, 20 nt, Human
agaaaaaggcacuuuaaugc

SEQ ID NO: 548100 - RNA, 18 nt, Human
agaagggagaggggagga

SEQ ID NO: 548101 - RNA, 19 nt, Human
agaccucacagcuacagcc

SEQ ID NO: 548102 - RNA, 19 nt, Human
agagggaagggggaagcag

SEQ ID NO: 548103 - RNA, 24 nt, Human
agagggaagggggaagcagggagc

SEQ ID NO: 548104 - RNA, 23 nt, Human
agauagagccagguagaagggcu

SEQ ID NO: 548105 - RNA, 21 nt, Human
agcagcagaaaccauguggua

SEQ ID NO: 548106 - RNA, 20 nt, Human
agccccgccagcccguccuc

SEQ ID NO: 548107 - RNA, 18 nt, Human
aggaggucuucugcaguc

SEQ ID NO: 548108 - RNA, 30 nt, Human
aggcacuuuaaugccaacugcuggaaacag

SEQ ID NO: 548109 - RNA, 18 nt, Human
agggaagggggaagcagg

SEQ ID NO: 548110 - RNA, 21 nt, Human
agggagaggggaggagaucca

SEQ ID NO: 548111 - RNA, 22 nt, Human
agggggcagggagaaagaagag

SEQ ID NO: 548112 - RNA, 21 nt, Human
aggggguggagagagcuggag

SEQ ID NO: 548113 - RNA, 21 nt, Human
agguacuuuggagccuagagc

SEQ ID NO: 548114 - RNA, 23 nt, Human
caaacagcccaagcccuaggcac

SEQ ID NO: 548115 - RNA, 21 nt, Human
caacaaguacacacaaguaca

SEQ ID NO: 548116 - RNA, 21 nt, Human
caagauuccagccugacugca

SEQ ID NO: 548117 - RNA, 21 nt, Human
cacacaaguacauacagggga

SEQ ID NO: 548118 - RNA, 21 nt, Human
cacacacccuuggagacaaga

SEQ ID NO: 548119 - RNA, 22 nt, Human
cacagcuacagcccuguccucc

SEQ ID NO: 548120 - RNA, 26 nt, Human
cacauuacccaaagucaccagauauu

SEQ ID NO: 548121 - RNA, 20 nt, Human
cacugugggguggcccaaga

SEQ ID NO: 548122 - RNA, 19 nt, Human
cagcaaagguccucaggca

SEQ ID NO: 548123 - RNA, 22 nt, Human
cagccccgccagcccguccucu

SEQ ID NO: 548124 - RNA, 24 nt, Human
cagcuacagcccuguccuccccaa

SEQ ID NO: 548125 - RNA, 23 nt, Human
caggaucggggaaguagacuggg

SEQ ID NO: 548126 - RNA, 20 nt, Human
cagggccgggggacuugggg

SEQ ID NO: 548127 - RNA, 19 nt, Human
cagucaggcugagcagcag

SEQ ID NO: 548128 - RNA, 20 nt, Human
cagugagauagagccaggua

SEQ ID NO: 548129 - RNA, 22 nt, Human
caucacagaggcaggcuggucc

SEQ ID NO: 548130 - RNA, 20 nt, Human
cauucugggcuggaccaacc

SEQ ID NO: 548131 - RNA, 19 nt, Human
ccaaagaaacuaagauaca

SEQ ID NO: 548132 - RNA, 20 nt, Human
ccacgggaacuccuggcugc

SEQ ID NO: 548133 - RNA, 22 nt, Human
ccaggaagaguaccuuggucca

SEQ ID NO: 548134 - RNA, 27 nt, Human
ccaggcagggccgggggacuugggguc

SEQ ID NO: 548135 - RNA, 19 nt, Human
ccaggggagguaguuaggu

SEQ ID NO: 548136 - RNA, 20 nt, Human
ccaggggagguaguuagguc

SEQ ID NO: 548137 - RNA, 20 nt, Human
cccaaagaaacuaagauaca

SEQ ID NO: 548138 - RNA, 20 nt, Human
cccauagucucagagcaacu

SEQ ID NO: 548139 - RNA, 24 nt, Human
cccaugcuugagcaggaauggggg

SEQ ID NO: 548140 - RNA, 19 nt, Human
ccccgccagcccguccucu

SEQ ID NO: 548141 - RNA, 23 nt, Human
ccccgccagcccguccucucccc

SEQ ID NO: 548142 - RNA, 23 nt, Human
ccccugagcugcaguaaaauagg

SEQ ID NO: 548143 - RNA, 21 nt, Human
cccguccucuccccucggaag

SEQ ID NO: 548144 - RNA, 20 nt, Human
ccuacccccugagcugcagu

SEQ ID NO: 548145 - RNA, 23 nt, Human
ccugagcugcaguaaaauagggg

SEQ ID NO: 548146 - RNA, 22 nt, Human
cgacucccgucuucuuggugaa

SEQ ID NO: 548147 - RNA, 19 nt, Human
cgaguggcucacgggccca

SEQ ID NO: 548148 - RNA, 20 nt, Human
cgccaggaacucggcgccgg

SEQ ID NO: 548149 - RNA, 23 nt, Human
cgccaggaacucggcgccggcga

SEQ ID NO: 548150 - RNA, 20 nt, Human
cggaagccgggccgggcgag

SEQ ID NO: 548151 - RNA, 19 nt, Human
cgggccgggcgagcggcgc

SEQ ID NO: 548152 - RNA, 24 nt, Human
cggggucugucuccgugguccccg

SEQ ID NO: 548153 - RNA, 23 nt, Human
cucaaacuuggcaggagggaggc

SEQ ID NO: 548154 - RNA, 19 nt, Human
cucacagcuacagcccugu

SEQ ID NO: 548155 - RNA, 22 nt, Human
cugcacaaacccuggccacaaa

SEQ ID NO: 548156 - RNA, 20 nt, Human
cugcagucaucacagaggca

SEQ ID NO: 548157 - RNA, 24 nt, Human
cugccggacuagccccagugaugc

SEQ ID NO: 548158 - RNA, 22 nt, Human
cuggccacaaacuucuccuucg

SEQ ID NO: 548159 - RNA, 24 nt, Human
cuuagccuugcccucaaacuuggc

SEQ ID NO: 548160 - RNA, 22 nt, Human
cuugcccucaaacuuggcagga

SEQ ID NO: 548161 - RNA, 18 nt, Human
cuuuuuuuuuuuuuuuug

SEQ ID NO: 548162 - RNA, 23 nt, Human
gaagcagggagccacgaagagag

SEQ ID NO: 548163 - RNA, 19 nt, Human
gaaguagacugggguguca

SEQ ID NO: 548164 - RNA, 20 nt, Human
gaauuccuuuuuuuuuuuuu

SEQ ID NO: 548165 - RNA, 20 nt, Human
gagaaagaagaguaggagag

SEQ ID NO: 548166 - RNA, 19 nt, Human
gagaagagcgagagcgcgg

SEQ ID NO: 548167 - RNA, 22 nt, Human
gagccuagagccuacccccuga

SEQ ID NO: 548168 - RNA, 25 nt, Human
gagcgaccugaggccgaguggcuca

SEQ ID NO: 548169 - RNA, 21 nt, Human
gagcugcaguaaaauaggggg

SEQ ID NO: 548170 - RNA, 24 nt, Human
gagcugcaguaaaauagggggugg

SEQ ID NO: 548171 - RNA, 18 nt, Human
gagggaagggggaagcag

SEQ ID NO: 548172 - RNA, 19 nt, Human
gagguaguuaggucaagug

SEQ ID NO: 548173 - RNA, 22 nt, Human
gagguaguuaggucaaguggau

SEQ ID NO: 548174 - RNA, 21 nt, Human
gaguggcucacgggcccagcu

SEQ ID NO: 548175 - RNA, 25 nt, Human
gcaaacuccaggaagaggggaacgc

SEQ ID NO: 548176 - RNA, 21 nt, Human
gcaacugaaucucggcaugaa

SEQ ID NO: 548177 - RNA, 20 nt, Human
gcaaggugacugugguugcu

SEQ ID NO: 548178 - RNA, 21 nt, Human
gcaggcugguccgccuucgag

SEQ ID NO: 548179 - RNA, 18 nt, Human
gccacagugacaccaggc

SEQ ID NO: 548180 - RNA, 19 nt, Human
gccaggggagguaguuagg

SEQ ID NO: 548181 - RNA, 18 nt, Human
gccgagacgcgggucccc

SEQ ID NO: 548182 - RNA, 26 nt, Human
gcugagcagcagaaaccaugugguag

SEQ ID NO: 548183 - RNA, 21 nt, Human
ggagaaagaagaguaggagag

SEQ ID NO: 548184 - RNA, 22 nt, Human
ggcugccgacucccgucuucuu

SEQ ID NO: 548185 - RNA, 26 nt, Human
gggaagcagggagccacgaagagaga

SEQ ID NO: 548186 - RNA, 18 nt, Human
gggccgggggacuugggg

SEQ ID NO: 548187 - RNA, 20 nt, Human
gggccggggucugucuccgu

SEQ ID NO: 548188 - RNA, 22 nt, Human
ggguccccagccccgccagccc

SEQ ID NO: 548189 - RNA, 22 nt, Human
gucuucuuggugaaggagucag

SEQ ID NO: 548190 - RNA, 26 nt, Human
gucuucuuggugaaggagucaggguu

SEQ ID NO: 548191 - RNA, 22 nt, Human
guggcugacauuucuuagccuu

SEQ ID NO: 548192 - RNA, 21 nt, Human
guggggcuuucuugaugaagg

SEQ ID NO: 548193 - RNA, 26 nt, Human
uaaaaacaaaaucccuaucccugugg

SEQ ID NO: 548194 - RNA, 19 nt, Human
uacagcaaagcacuguggg

SEQ ID NO: 548195 - RNA, 19 nt, Human
uaccccauagucucagagc

SEQ ID NO: 548196 - RNA, 21 nt, Human
uacuuuggagccuagagccua

SEQ ID NO: 548197 - RNA, 24 nt, Human
uaggggguggagagagcuggagua

SEQ ID NO: 548198 - RNA, 21 nt, Human
ucacacaaacagcccaagccc

SEQ ID NO: 548199 - RNA, 22 nt, Human
ucaccaagucagcccguuaugc

SEQ ID NO: 548200 - RNA, 22 nt, Human
ucagagagcugacaacgggauu

SEQ ID NO: 548201 - RNA, 21 nt, Human
uccagagcuguggggcuuucu

SEQ ID NO: 548202 - RNA, 23 nt, Human
uccagagcuguggggcuuucuug

SEQ ID NO: 548203 - RNA, 20 nt, Human
uccagggggcagggagaaag

SEQ ID NO: 548204 - RNA, 18 nt, Human
ucccagagcugacuuccc

SEQ ID NO: 548205 - RNA, 18 nt, Human
uccccaaagaaacuaaga

SEQ ID NO: 548206 - RNA, 18 nt, Human
uccccaaagaaacuaaga

SEQ ID NO: 548207 - RNA, 19 nt, Human
uccccagccccgccagccc

SEQ ID NO: 548208 - RNA, 21 nt, Human
uccccagccccgccagcccgu

SEQ ID NO: 548209 - RNA, 22 nt, Human
ucccuuaaaaacaaaaucccua

SEQ ID NO: 548210 - RNA, 24 nt, Human
ucccuucgugguuuuaccccacuc

SEQ ID NO: 548211 - RNA, 20 nt, Human
uccgugguccccgcuccggg

SEQ ID NO: 548212 - RNA, 20 nt, Human
uccuacagcaaagcacugug

SEQ ID NO: 548213 - RNA, 18 nt, Human
uccuuuuuuuuuuuuuuu

SEQ ID NO: 548214 - RNA, 21 nt, Human
uccuuuuuuuuuuuuuuuugg

SEQ ID NO: 548215 - RNA, 20 nt, Human
ucugcagucaucacagaggc

SEQ ID NO: 548216 - RNA, 23 nt, Human
ucuguaccaaggacacagcaaag

SEQ ID NO: 548217 - RNA, 24 nt, Human
ucuguaccaaggacacagcaaagg

SEQ ID NO: 548218 - RNA, 22 nt, Human
ugaaaaugcugcucaauuuugc

SEQ ID NO: 548219 - RNA, 18 nt, Human
ugagcaggaaugggggug

SEQ ID NO: 548220 - RNA, 22 nt, Human
ugagggcugcucccagagcuga

SEQ ID NO: 548221 - RNA, 20 nt, Human
ugaggggcauugguacaccc

SEQ ID NO: 548222 - RNA, 23 nt, Human
ugaugaagggacaauacccaggu

SEQ ID NO: 548223 - RNA, 22 nt, Human
ugccacgggaacuccuggcugc

SEQ ID NO: 548224 - RNA, 21 nt, Human
ugccagggaugcuuaagcugg

SEQ ID NO: 548225 - RNA, 21 nt, Human
ugccuggcucaaggcuuuuuc

SEQ ID NO: 548226 - RNA, 18 nt, Human
uggccacaaacuucugcc

SEQ ID NO: 548227 - RNA, 22 nt, Human
uggcccaagauuccagccugac

SEQ ID NO: 548228 - RNA, 20 nt, Human
uggcugacauuucuuagccu

SEQ ID NO: 548229 - RNA, 19 nt, Human
ugggagaugaggggcauug

SEQ ID NO: 548230 - RNA, 22 nt, Human
ugggcuggaccaaccacaggag

SEQ ID NO: 548231 - RNA, 21 nt, Human
uggggguggaccccaucuagg

SEQ ID NO: 548232 - RNA, 19 nt, Human
uuaaagaagggagagggga

SEQ ID NO: 548233 - RNA, 20 nt, Human
uuuccguggcugacauuucu

SEQ ID NO: 548234 - RNA, 25 nt, Human
uuugcacaaccaaacacagugcccu

SEQ ID NO: 548235 - RNA, 22 nt, Human
aaaaccuucauuuaugcuagaa

SEQ ID NO: 548236 - RNA, 23 nt, Human
aaacacaccuuaagaucggggag

SEQ ID NO: 548237 - RNA, 23 nt, Human
aacaacaacaacaaaaaugggaa

SEQ ID NO: 548238 - RNA, 21 nt, Human
aagaagcuggguaggaaaggc

SEQ ID NO: 548239 - RNA, 18 nt, Human
aagagcaacgggcaucug

SEQ ID NO: 548240 - RNA, 29 nt, Human
aagcagaaaggcagaguaagagggacccc

SEQ ID NO: 548241 - RNA, 23 nt, Human
aagcagaaaggcagaguaagaug

SEQ ID NO: 548242 - RNA, 24 nt, Human
aagcagaagagacaguaaaaagaa

SEQ ID NO: 548243 - RNA, 20 nt, Human
aagccucagcacuagcgaca

SEQ ID NO: 548244 - RNA, 23 nt, Human
aagcuggguaggaaaggcgaaag

SEQ ID NO: 548245 - RNA, 22 nt, Human
aaggaauguguguaggaggaaa

SEQ ID NO: 548246 - RNA, 18 nt, Human
aaguggccuuuucaagga

SEQ ID NO: 548247 - RNA, 25 nt, Human
aauuuuuuguagagacagggucacg

SEQ ID NO: 548248 - RNA, 22 nt, Human
acaacaacaaaaaugggaaccu

SEQ ID NO: 548249 - RNA, 25 nt, Human
acaacaacaacaacaaaaaugggaa

SEQ ID NO: 548250 - RNA, 18 nt, Human
accagcccaagagcaacg

SEQ ID NO: 548251 - RNA, 20 nt, Human
agaaaacacaccuuaagauc

SEQ ID NO: 548252 - RNA, 18 nt, Human
agacagggucacgcuaug

SEQ ID NO: 548253 - RNA, 23 nt, Human
agcagaaaaucaacaacaacaac

SEQ ID NO: 548254 - RNA, 22 nt, Human
agcugguggagugaguccacgg

SEQ ID NO: 548255 - RNA, 23 nt, Human
aggaaggaauguguguaggagga

SEQ ID NO: 548256 - RNA, 21 nt, Human
agguccccagcuguccaaucu

SEQ ID NO: 548257 - RNA, 21 nt, Human
agguguucaggggaaaccagc

SEQ ID NO: 548258 - RNA, 21 nt, Human
aguguagagaccacauccaaa

SEQ ID NO: 548259 - RNA, 21 nt, Human
aucaacaacaacaacaacaaa

SEQ ID NO: 548260 - RNA, 21 nt, Human
aucaagaagguuaguguagag

SEQ ID NO: 548261 - RNA, 19 nt, Human
auccugaagcugcccccgg

SEQ ID NO: 548262 - RNA, 18 nt, Human
augaagacucagaccuug

SEQ ID NO: 548263 - RNA, 26 nt, Human
caacaacaacaaaaaugggaacccug

SEQ ID NO: 548264 - RNA, 24 nt, Human
caacaacaacaacaaaaaugggaa

SEQ ID NO: 548265 - RNA, 28 nt, Human
caacaacaacaacaaaaaugggaaccuu

SEQ ID NO: 548266 - RNA, 19 nt, Human
caagaagguuaguguagag

SEQ ID NO: 548267 - RNA, 19 nt, Human
caagagcaacgggcaucug

SEQ ID NO: 548268 - RNA, 22 nt, Human
cacagaauccacuacaucucuc

SEQ ID NO: 548269 - RNA, 23 nt, Human
caccagcucccacaguucuccac

SEQ ID NO: 548270 - RNA, 18 nt, Human
caccgccgccgccgccac

SEQ ID NO: 548271 - RNA, 21 nt, Human
cagcccaagagcaacgggcau

SEQ ID NO: 548272 - RNA, 22 nt, Human
cagcuccgccccugcccggggg

SEQ ID NO: 548273 - RNA, 26 nt, Human
caggaaaggugugagcagaaaaucaa

SEQ ID NO: 548274 - RNA, 19 nt, Human
caggagagacugguggaga

SEQ ID NO: 548275 - RNA, 18 nt, Human
caggaggugagaggcucc

SEQ ID NO: 548276 - RNA, 18 nt, Human
ccaaagcagaaaggcaga

SEQ ID NO: 548277 - RNA, 20 nt, Human
ccagcccgggccgugagcaa

SEQ ID NO: 548278 - RNA, 22 nt, Human
cccccuucucuuuuucuaaucu

SEQ ID NO: 548279 - RNA, 19 nt, Human
cccuucucuuuuucuaauc

SEQ ID NO: 548280 - RNA, 25 nt, Human
ccgccgccacuaccgccgccgccgg

SEQ ID NO: 548281 - RNA, 20 nt, Human
ccgcgcugucgccgccgccg

SEQ ID NO: 548282 - RNA, 22 nt, Human
ccgcggccgucucaccguccuc

SEQ ID NO: 548283 - RNA, 19 nt, Human
ccucagggcugccgcuacu

SEQ ID NO: 548284 - RNA, 24 nt, Human
ccucagggcugccgcuacugcugc

SEQ ID NO: 548285 - RNA, 24 nt, Human
ccugcucacagcuccccgguacaa

SEQ ID NO: 548286 - RNA, 23 nt, Human
cgcugucgccgccgccgcggccg

SEQ ID NO: 548287 - RNA, 24 nt, Human
cgggacaauggucugcuaucugcu

SEQ ID NO: 548288 - RNA, 18 nt, Human
cugcauugucccguucac

SEQ ID NO: 548289 - RNA, 19 nt, Human
cugccgcugccgcccgggc

SEQ ID NO: 548290 - RNA, 22 nt, Human
cugccgcugccgcccgggcacc

SEQ ID NO: 548291 - RNA, 21 nt, Human
cuuccgcgcugucgccgccgc

SEQ ID NO: 548292 - RNA, 20 nt, Human
cuucuucaagugagcaaguu

SEQ ID NO: 548293 - RNA, 22 nt, Human
cuucuuguuaacuggccgagga

SEQ ID NO: 548294 - RNA, 22 nt, Human
cuuucaaccucacauguucuuc

SEQ ID NO: 548295 - RNA, 24 nt, Human
gaagcuggguaggaaaggcgaaag

SEQ ID NO: 548296 - RNA, 24 nt, Human
gaaggcugcgacagacaggcaggg

SEQ ID NO: 548297 - RNA, 18 nt, Human
gacacgggugcuggcaag

SEQ ID NO: 548298 - RNA, 24 nt, Human
gcagcucauucucccaagccgccu

SEQ ID NO: 548299 - RNA, 25 nt, Human
gccgcccgggcaccgccgccgccgg

SEQ ID NO: 548300 - RNA, 24 nt, Human
ggaaucacacuucuucaagugagc

SEQ ID NO: 548301 - RNA, 20 nt, Human
ggcaaagcuagcagggugag

SEQ ID NO: 548302 - RNA, 18 nt, Human
gggaaaccagcccaagag

SEQ ID NO: 548303 - RNA, 18 nt, Human
gggcagagccaccagcuc

SEQ ID NO: 548304 - RNA, 20 nt, Human
gggcgcguugcccugcccag

SEQ ID NO: 548305 - RNA, 26 nt, Human
ggggaaaccagcccaagagcaacggg

SEQ ID NO: 548306 - RNA, 18 nt, Human
guagagacagggucacgc

SEQ ID NO: 548307 - RNA, 20 nt, Human
guagagaccacauccaaagc

SEQ ID NO: 548308 - RNA, 19 nt, Human
guccaaucuugaagaagua

SEQ ID NO: 548309 - RNA, 20 nt, Human
guggagaacaccucacacca

SEQ ID NO: 548310 - RNA, 19 nt, Human
guggagugaguccacggag

SEQ ID NO: 548311 - RNA, 20 nt, Human
guuauaggaagcugguggag

SEQ ID NO: 548312 - RNA, 18 nt, Human
uaagaggggcuggaugau

SEQ ID NO: 548313 - RNA, 23 nt, Human
uacagcuccgccccugcccgggg

SEQ ID NO: 548314 - RNA, 22 nt, Human
uagagacagggucacgcuaugu

SEQ ID NO: 548315 - RNA, 21 nt, Human
uaggaaaggcgaaagccucag

SEQ ID NO: 548316 - RNA, 24 nt, Human
uaggagaaagcaccuauugugaua

SEQ ID NO: 548317 - RNA, 18 nt, Human
uaucuuacaccauaucua

SEQ ID NO: 548318 - RNA, 18 nt, Human
uauguugcccuggcuggu

SEQ ID NO: 548319 - RNA, 19 nt, Human
uauguugcccuggcuggug

SEQ ID NO: 548320 - RNA, 21 nt, Human
ucaacaacaacaacaacaaaa

SEQ ID NO: 548321 - RNA, 24 nt, Human
ucacgcuauguugcccuggcuggu

SEQ ID NO: 548322 - RNA, 18 nt, Human
ucaugucagaggacagga

SEQ ID NO: 548323 - RNA, 18 nt, Human
uccauggcucucugucag

SEQ ID NO: 548324 - RNA, 23 nt, Human
ucccaagccaucgugaggccugc

SEQ ID NO: 548325 - RNA, 19 nt, Human
uccccccuucucuuuuucu

SEQ ID NO: 548326 - RNA, 25 nt, Human
uccccccuucucuuuuucuaaucuu

SEQ ID NO: 548327 - RNA, 19 nt, Human
ucccuuccccccuucucuu

SEQ ID NO: 548328 - RNA, 28 nt, Human
uccgcgcugucgccgccgccgcggccgg

SEQ ID NO: 548329 - RNA, 21 nt, Human
ucggucauggcagaggguugu

SEQ ID NO: 548330 - RNA, 21 nt, Human
ucuacagcuccgccccugccc

SEQ ID NO: 548331 - RNA, 18 nt, Human
ucucacagaauccacuac

SEQ ID NO: 548332 - RNA, 20 nt, Human
ucucuuuucuuggcuccugg

SEQ ID NO: 548333 - RNA, 18 nt, Human
ucugaaugaaauaaccga

SEQ ID NO: 548334 - RNA, 26 nt, Human
ucuguuacuggggcaaagcugcaggc

SEQ ID NO: 548335 - RNA, 18 nt, Human
ugaaauaaccgaggaagg

SEQ ID NO: 548336 - RNA, 20 nt, Human
ugaacuccaaguccauuccu

SEQ ID NO: 548337 - RNA, 23 nt, Human
ugaggaaggcugcgacagacagg

SEQ ID NO: 548338 - RNA, 18 nt, Human
ugcagcucauucucccaa

SEQ ID NO: 548339 - RNA, 21 nt, Human
ugcccuggcuggugcucuuuc

SEQ ID NO: 548340 - RNA, 22 nt, Human
ugcccuggcuggugcucuuuca

SEQ ID NO: 548341 - RNA, 21 nt, Human
uggaaaguaagcagaagagac

SEQ ID NO: 548342 - RNA, 19 nt, Human
uggagugaguccacggagg

SEQ ID NO: 548343 - RNA, 21 nt, Human
uggcuccuggguugacuaccu

SEQ ID NO: 548344 - RNA, 20 nt, Human
ugggaaccuugugagguguu

SEQ ID NO: 548345 - RNA, 21 nt, Human
ugguggagugaguccacggag

SEQ ID NO: 548346 - RNA, 24 nt, Human
uguagagacagggucacgcuaugu

SEQ ID NO: 548347 - RNA, 26 nt, Human
ugucccguucaccuuucucuaacuca

SEQ ID NO: 548348 - RNA, 23 nt, Human
ugucgccgccgccgcggccgucu

SEQ ID NO: 548349 - RNA, 23 nt, Human
uucaaccucacauguucuucaau

SEQ ID NO: 548350 - RNA, 24 nt, Human
uuccugguuucauucucaugucag

SEQ ID NO: 548351 - RNA, 23 nt, Human
uuggcaaacuccugcaguucugc

SEQ ID NO: 548352 - RNA, 19 nt, Human
uuguagagacagggucacg

SEQ ID NO: 548353 - RNA, 20 nt, Human
uuuguagagacagggucacg

SEQ ID NO: 548354 - RNA, 26 nt, Human
uuuguaguguuuggugccaagaaggu

SEQ ID NO: 548355 - RNA, 27 nt, Human
uuuucucuucccuuccccccuucuccc

SEQ ID NO: 548356 - RNA, 23 nt, Human
uuuuuuguagagacagggucacg

SEQ ID NO: 548357 - RNA, 24 nt, Human
aaaaaaacaaaaaaacacccuaca

SEQ ID NO: 548358 - RNA, 24 nt, Human
aaaaaaacaaaaaaacacccuaca

SEQ ID NO: 548359 - RNA, 25 nt, Human
aaaaaacaaaaaaacaaaaaaacac

SEQ ID NO: 548360 - RNA, 27 nt, Human
aaaaaacaaaaaaacaaaaaaacaccc

SEQ ID NO: 548361 - RNA, 24 nt, Human
aaaacaaaaaaacaaaaaaacacc

SEQ ID NO: 548362 - RNA, 21 nt, Human
aaauuucuaaauauucuacca

SEQ ID NO: 548363 - RNA, 26 nt, Human
aagaaaaaaaacaaaaaaacaaaaaa

SEQ ID NO: 548364 - RNA, 23 nt, Human
aagucacuagaguuuugcuccug

SEQ ID NO: 548365 - RNA, 26 nt, Human
aauaacaaacacaaguuuuugaggaa

SEQ ID NO: 548366 - RNA, 22 nt, Human
acaaaaaaacaaaaaaacaccc

SEQ ID NO: 548367 - RNA, 21 nt, Human
acaucuuuauuaaagacacua

SEQ ID NO: 548368 - RNA, 25 nt, Human
acuauguacacaacuagcaaacacc

SEQ ID NO: 548369 - RNA, 19 nt, Human
agaagaaaaaaaacaaaaa

SEQ ID NO: 548370 - RNA, 29 nt, Human
agaagaaaaaaaacaaaaaaacaaaaaag

SEQ ID NO: 548371 - RNA, 18 nt, Human
agagcaacucauuuggaa

SEQ ID NO: 548372 - RNA, 25 nt, Human
agaugcugguaggccacaguaugcu

SEQ ID NO: 548373 - RNA, 22 nt, Human
agcaaacaccuuaaggcaacca

SEQ ID NO: 548374 - RNA, 19 nt, Human
agccagaccucggacugcc

SEQ ID NO: 548375 - RNA, 22 nt, Human
aggaaaaaaaacugauuugaaa

SEQ ID NO: 548376 - RNA, 21 nt, Human
aggcugacgucuaggugacgc

SEQ ID NO: 548377 - RNA, 22 nt, Human
auacugaaacuuucaacagcca

SEQ ID NO: 548378 - RNA, 21 nt, Human
auagaagaaaaaaaacaaaaa

SEQ ID NO: 548379 - RNA, 28 nt, Human
aucaaugucaacagauaaacuccaguuu

SEQ ID NO: 548380 - RNA, 18 nt, Human
caaaaaaacaaaaaaaca

SEQ ID NO: 548381 - RNA, 24 nt, Human
caaaaaaacacccuacaguaacac

SEQ ID NO: 548382 - RNA, 22 nt, Human
caagugggaagcaguguagcua

SEQ ID NO: 548383 - RNA, 22 nt, Human
cacaguaugcuucccauugcuc

SEQ ID NO: 548384 - RNA, 19 nt, Human
cacaguauguuaugguuaa

SEQ ID NO: 548385 - RNA, 20 nt, Human
cacaugauaaaacaagugac

SEQ ID NO: 548386 - RNA, 23 nt, Human
cacccgccccacccuccggcccc

SEQ ID NO: 548387 - RNA, 24 nt, Human
cacccuccggccccgcgccccgcc

SEQ ID NO: 548388 - RNA, 24 nt, Human
caccgccgccacccgccccacccu

SEQ ID NO: 548389 - RNA, 25 nt, Human
cacuuugaaaagacaauacaauaag

SEQ ID NO: 548390 - RNA, 26 nt, Human
cagauaaacuccaugaaaugaaaguu

SEQ ID NO: 548391 - RNA, 24 nt, Human
caugcacgcucacauccacaccac

SEQ ID NO: 548392 - RNA, 19 nt, Human
ccaauaccuaaaaaaauua

SEQ ID NO: 548393 - RNA, 21 nt, Human
ccaccgccgccacccgcccca

SEQ ID NO: 548394 - RNA, 23 nt, Human
ccaccgccgccacccgccccacc

SEQ ID NO: 548395 - RNA, 20 nt, Human
ccccgccccgggcucgucuc

SEQ ID NO: 548396 - RNA, 19 nt, Human
ccccgcgccccgccccggg

SEQ ID NO: 548397 - RNA, 19 nt, Human
cccuccggccccgcgcccc

SEQ ID NO: 548398 - RNA, 18 nt, Human
ccgccccgggcucgucuc

SEQ ID NO: 548399 - RNA, 26 nt, Human
ccgccgccacccgccccacccuccgg

SEQ ID NO: 548400 - RNA, 21 nt, Human
ccgccgccgccgccgcuccgg

SEQ ID NO: 548401 - RNA, 22 nt, Human
ccuggcaccaggaugaaaaaaa

SEQ ID NO: 548402 - RNA, 22 nt, Human
cgccccacccuccggccccgcg

SEQ ID NO: 548403 - RNA, 18 nt, Human
cggccgcccuccacucuc

SEQ ID NO: 548404 - RNA, 20 nt, Human
cgucucauuggucuuguucc

SEQ ID NO: 548405 - RNA, 22 nt, Human
cugcggccgcggcugcuugggc

SEQ ID NO: 548406 - RNA, 23 nt, Human
cugcggccgcggcugcuugggcu

SEQ ID NO: 548407 - RNA, 22 nt, Human
cuggaugcuggagacaaacauc

SEQ ID NO: 548408 - RNA, 25 nt, Human
cuggcaccaggaugaaaaaaaaaaa

SEQ ID NO: 548409 - RNA, 28 nt, Human
cuuuauagcaguauauaaauagguuacc

SEQ ID NO: 548410 - RNA, 21 nt, Human
gaaaaaaaacaaaaaaacaaa

SEQ ID NO: 548411 - RNA, 24 nt, Human
gaaaaaaaacaaaaaaacaaaaaa

SEQ ID NO: 548412 - RNA, 20 nt, Human
gacaauacaauaagacaauu

SEQ ID NO: 548413 - RNA, 23 nt, Human
gaggaaaaaaaacugauuugaaa

SEQ ID NO: 548414 - RNA, 26 nt, Human
gauuuguaaacauaaugcuucccuuu

SEQ ID NO: 548415 - RNA, 23 nt, Human
gcaauuugauagaagaaaaaaaa

SEQ ID NO: 548416 - RNA, 24 nt, Human
gcaauuugauagaagaaaaaaaac

SEQ ID NO: 548417 - RNA, 21 nt, Human
gcacgcucacauccacaccac

SEQ ID NO: 548418 - RNA, 21 nt, Human
gcagcacuuugaaaagacaau

SEQ ID NO: 548419 - RNA, 22 nt, Human
gccaccgccgccacccgcccca

SEQ ID NO: 548420 - RNA, 22 nt, Human
gcccucaucggccgcccuccac

SEQ ID NO: 548421 - RNA, 21 nt, Human
gccgccgccgccgccgcuccg

SEQ ID NO: 548422 - RNA, 21 nt, Human
ggggugguggggaggaccaga

SEQ ID NO: 548423 - RNA, 20 nt, Human
ggguggggugguggggagga

SEQ ID NO: 548424 - RNA, 24 nt, Human
ggguggggugguggggaggaccag

SEQ ID NO: 548425 - RNA, 18 nt, Human
gguggggugguggggagg

SEQ ID NO: 548426 - RNA, 21 nt, Human
guauauacauauguguaugug

SEQ ID NO: 548427 - RNA, 20 nt, Human
gugccgccgccgccgccgcu

SEQ ID NO: 548428 - RNA, 24 nt, Human
uaaaacaagugacaguuuaaauca

SEQ ID NO: 548429 - RNA, 20 nt, Human
uaacaaacacaagucuuggg

SEQ ID NO: 548430 - RNA, 23 nt, Human
uaacaaacacaaguuuuugagga

SEQ ID NO: 548431 - RNA, 20 nt, Human
uaaguguggacacuggaucc

SEQ ID NO: 548432 - RNA, 22 nt, Human
uagaagaaaaaaaacaaaaaaa

SEQ ID NO: 548433 - RNA, 18 nt, Human
uagcaaacaccuuaaggc

SEQ ID NO: 548434 - RNA, 22 nt, Human
uaggugacgcgccaacuuaucc

SEQ ID NO: 548435 - RNA, 18 nt, Human
uauacauauguguaugug

SEQ ID NO: 548436 - RNA, 19 nt, Human
uauauacauauguguaugu

SEQ ID NO: 548437 - RNA, 24 nt, Human
uauguacacaacuagcaaacaccu

SEQ ID NO: 548438 - RNA, 22 nt, Human
uauguguaugugaaucuauaca

SEQ ID NO: 548439 - RNA, 27 nt, Human
ucaacuggcagcacuuugaaaagacaa

SEQ ID NO: 548440 - RNA, 18 nt, Human
ucacuagaguuuugcucc

SEQ ID NO: 548441 - RNA, 25 nt, Human
uccacaccaccucugcacacauaca

SEQ ID NO: 548442 - RNA, 26 nt, Human
uccccggggugccgccgccgccgccg

SEQ ID NO: 548443 - RNA, 23 nt, Human
ucucauuggucuuguucccuuca

SEQ ID NO: 548444 - RNA, 21 nt, Human
ugacaaacucguugaaaugga

SEQ ID NO: 548445 - RNA, 18 nt, Human
ugaggaaaaaaaacugau

SEQ ID NO: 548446 - RNA, 24 nt, Human
ugcacacauacagaucgagcacac

SEQ ID NO: 548447 - RNA, 25 nt, Human
ugcacacauacagaucgagcacaca

SEQ ID NO: 548448 - RNA, 21 nt, Human
ugcacgcucacauccacacca

SEQ ID NO: 548449 - RNA, 20 nt, Human
ugcuugggcuucugcagccg

SEQ ID NO: 548450 - RNA, 22 nt, Human
uggcaccaggaugaaaaaaaaa

SEQ ID NO: 548451 - RNA, 23 nt, Human
uggggaggaccagaaagagcagc

SEQ ID NO: 548452 - RNA, 21 nt, Human
uggggguggggugguggggag

SEQ ID NO: 548453 - RNA, 18 nt, Human
uggggugguggggaggac

SEQ ID NO: 548454 - RNA, 18 nt, Human
uguaaacauaaugcuucc

SEQ ID NO: 548455 - RNA, 22 nt, Human
uguacacaacuagcaaacaccu

SEQ ID NO: 548456 - RNA, 21 nt, Human
uguauauacauauguguaugu

SEQ ID NO: 548457 - RNA, 24 nt, Human
uguguaugugaaucuauacacaua

SEQ ID NO: 548458 - RNA, 26 nt, Human
uguuugaugaaucacaguauguuaug

SEQ ID NO: 548459 - RNA, 24 nt, Human
uugcaaugggggguuaacuugcag

SEQ ID NO: 548460 - RNA, 20 nt, Human
uuuuaaguguggacacugga

SEQ ID NO: 548461 - RNA, 20 nt, Human
uuuucuggaugcuggagaca

SEQ ID NO: 548462 - RNA, 18 nt, Human
uuuuuuuuuuuuuuucug

SEQ ID NO: 548463 - RNA, 20 nt, Human
uuuuuuuuuuuuuuuucugg

SEQ ID NO: 548464 - RNA, 20 nt, Human
aaaaaggccacgagacccuu

SEQ ID NO: 548465 - RNA, 18 nt, Human
aaccaaagccgugguccc

SEQ ID NO: 548466 - RNA, 23 nt, Human
aacuguacagcccuuuuagcccc

SEQ ID NO: 548467 - RNA, 25 nt, Human
aacuguacagcccuuuuagccccca

SEQ ID NO: 548468 - RNA, 23 nt, Human
aaggacuccguaggggccaggcg

SEQ ID NO: 548469 - RNA, 18 nt, Human
acagcaaugaggccacau

SEQ ID NO: 548470 - RNA, 25 nt, Human
acagcaaugaggccacaucccugga

SEQ ID NO: 548471 - RNA, 19 nt, Human
agcagcuguggggagggga

SEQ ID NO: 548472 - RNA, 19 nt, Human
agcccccagcucuggagug

SEQ ID NO: 548473 - RNA, 22 nt, Human
agggagcagggccagagagaag

SEQ ID NO: 548474 - RNA, 25 nt, Human
agggagggggaaauaacuguacagc

SEQ ID NO: 548475 - RNA, 24 nt, Human
agugacauuauugcugaccucuuc

SEQ ID NO: 548476 - RNA, 18 nt, Human
agugcuccucucccaagu

SEQ ID NO: 548477 - RNA, 21 nt, Human
auaacuguacagcccuuuuag

SEQ ID NO: 548478 - RNA, 21 nt, Human
cacacagccuccgugguuucc

SEQ ID NO: 548479 - RNA, 20 nt, Human
cacaucccuggagcugcccg

SEQ ID NO: 548480 - RNA, 21 nt, Human
cacugacggacacugcccuaa

SEQ ID NO: 548481 - RNA, 19 nt, Human
cagccugccugccugccac

SEQ ID NO: 548482 - RNA, 19 nt, Human
cagcuguggggaggggagg

SEQ ID NO: 548483 - RNA, 23 nt, Human
ccagcucuggaguggcagacagc

SEQ ID NO: 548484 - RNA, 25 nt, Human
cccacccugaccuuuggcccagaag

SEQ ID NO: 548485 - RNA, 26 nt, Human
ccccgcccacccugaccuuuggccca

SEQ ID NO: 548486 - RNA, 18 nt, Human
cccggggccagccugccu

SEQ ID NO: 548487 - RNA, 21 nt, Human
ccugaccuuuggcccagaagc

SEQ ID NO: 548488 - RNA, 18 nt, Human
ccugccugccacuuccuc

SEQ ID NO: 548489 - RNA, 18 nt, Human
ccuuggucacagguguag

SEQ ID NO: 548490 - RNA, 19 nt, Human
cgugguuuccucugucacu

SEQ ID NO: 548491 - RNA, 21 nt, Human
cucucccaaguuuuaaggcag

SEQ ID NO: 548492 - RNA, 21 nt, Human
gagcagcuguggggaggggag

SEQ ID NO: 548493 - RNA, 25 nt, Human
gagcagggccagagagaaguccccc

SEQ ID NO: 548494 - RNA, 18 nt, Human
gaggggagggccaguccc

SEQ ID NO: 548495 - RNA, 21 nt, Human
gcccugagugcuccucuccca

SEQ ID NO: 548496 - RNA, 19 nt, Human
gcuaaggacuccguagggg

SEQ ID NO: 548497 - RNA, 19 nt, Human
ggcacugacggacacugcc

SEQ ID NO: 548498 - RNA, 18 nt, Human
ggugaggaaccaaagccg

SEQ ID NO: 548499 - RNA, 20 nt, Human
guauacacacagccuccgug

SEQ ID NO: 548500 - RNA, 25 nt, Human
uaagacacaaguugaguaagcagcc

SEQ ID NO: 548501 - RNA, 19 nt, Human
ucacagguguagguggaga

SEQ ID NO: 548502 - RNA, 22 nt, Human
ucccaaguuuuaaggcagggag

SEQ ID NO: 548503 - RNA, 20 nt, Human
ucccaggcccccgcccaccc

SEQ ID NO: 548504 - RNA, 19 nt, Human
uccccggggccagccugcc

SEQ ID NO: 548505 - RNA, 18 nt, Human
ucccuggagcugcccggg

SEQ ID NO: 548506 - RNA, 18 nt, Human
uccugaccacauaagccu

SEQ ID NO: 548507 - RNA, 23 nt, Human
ucggagggagcagggccagagag

SEQ ID NO: 548508 - RNA, 22 nt, Human
ucuguucacauacguauacaca

SEQ ID NO: 548509 - RNA, 18 nt, Human
ugagacuggguccacagu

SEQ ID NO: 548510 - RNA, 19 nt, Human
ugaggaaccaaagccgugg

SEQ ID NO: 548511 - RNA, 25 nt, Human
ugaguaagcagccuccacaggcugu

SEQ ID NO: 548512 - RNA, 26 nt, Human
ugccugccacuuccucaucugcuggu

SEQ ID NO: 548513 - RNA, 18 nt, Human
uggcccagaagcuacugc

SEQ ID NO: 548514 - RNA, 28 nt, Human
ugggguggaggagugagacuggguccac

SEQ ID NO: 548515 - RNA, 23 nt, Human
uguauucccaggcccccgcccac

SEQ ID NO: 548516 - RNA, 18 nt, Human
uguggacagggcuaagcg

SEQ ID NO: 548517 - RNA, 18 nt, Human
ugugugaggaaaaaggcc

SEQ ID NO: 548518 - RNA, 19 nt, Human
ugugugaggaaaaaggcca

SEQ ID NO: 548519 - RNA, 18 nt, Human
uguguucccccaccuccu

SEQ ID NO: 548520 - RNA, 23 nt, Human
uguucccccaccuccucuguuca

SEQ ID NO: 548521 - RNA, 21 nt, Human
uuagcccccagcucuggagug

SEQ ID NO: 548522 - RNA, 24 nt, Human
uuuuaaggcagggagggggaaaua

SEQ ID NO: 548523 - RNA, 20 nt, Human
aacagauuaaccuaauagca

SEQ ID NO: 548524 - RNA, 18 nt, Human
aaccuaggcugacuggca

SEQ ID NO: 548525 - RNA, 20 nt, Human
aagcugcaccaguucugagg

SEQ ID NO: 548526 - RNA, 22 nt, Human
aaguaggcucacaaaaaagagu

SEQ ID NO: 548527 - RNA, 23 nt, Human
acagaggaacaauccuauccaca

SEQ ID NO: 548528 - RNA, 23 nt, Human
acuccaucuuuuuccucccagcu

SEQ ID NO: 548529 - RNA, 22 nt, Human
agaaaguaaacgggcagccaga

SEQ ID NO: 548530 - RNA, 22 nt, Human
agacaagacucuggcuuacaga

SEQ ID NO: 548531 - RNA, 22 nt, Human
aggagugcugaguuugccaaac

SEQ ID NO: 548532 - RNA, 21 nt, Human
aguagugaguaacaguccugc

SEQ ID NO: 548533 - RNA, 18 nt, Human
aguuugccaaacuggcau

SEQ ID NO: 548534 - RNA, 24 nt, Human
auagacaagacucuggcuuacaga

SEQ ID NO: 548535 - RNA, 20 nt, Human
cagaagcauuuuuuucuccu

SEQ ID NO: 548536 - RNA, 19 nt, Human
cagcagcaugcauguucaa

SEQ ID NO: 548537 - RNA, 18 nt, Human
cccuuuuuauuuggagac

SEQ ID NO: 548538 - RNA, 18 nt, Human
cggaguggacuccagugc

SEQ ID NO: 548539 - RNA, 19 nt, Human
cugagguccucggagguga

SEQ ID NO: 548540 - RNA, 21 nt, Human
gacagcuucuggcgaaagguu

SEQ ID NO: 548541 - RNA, 18 nt, Human
gacccgggcgggcggcga

SEQ ID NO: 548542 - RNA, 24 nt, Human
gagaaaggaaauacucauuaauac

SEQ ID NO: 548543 - RNA, 19 nt, Human
gagagagaagcugcaccag

SEQ ID NO: 548544 - RNA, 18 nt, Human
gagggagagagaagcugc

SEQ ID NO: 548545 - RNA, 21 nt, Human
gaguggacuccagugcuugcu

SEQ ID NO: 548546 - RNA, 21 nt, Human
gcagggaacaggagugcugag

SEQ ID NO: 548547 - RNA, 20 nt, Human
gcgcggcgacccgggcgggc

SEQ ID NO: 548548 - RNA, 23 nt, Human
ggaaucuuuccaagcuacuccau

SEQ ID NO: 548549 - RNA, 20 nt, Human
ggagggagagagaagcugca

SEQ ID NO: 548550 - RNA, 19 nt, Human
ggagggagggagagagaag

SEQ ID NO: 548551 - RNA, 24 nt, Human
ggagugcugaguuugccaaacugg

SEQ ID NO: 548552 - RNA, 24 nt, Human
guaaacauuuuaaucugaacaaaa

SEQ ID NO: 548553 - RNA, 18 nt, Human
guaugaucccauuuuaau

SEQ ID NO: 548554 - RNA, 21 nt, Human
uaaccugugaagagugacaac

SEQ ID NO: 548555 - RNA, 19 nt, Human
uacuuuugugcuugcuucu

SEQ ID NO: 548556 - RNA, 18 nt, Human
uagauuagaacauacccu

SEQ ID NO: 548557 - RNA, 20 nt, Human
uagccgggucccucugcccu

SEQ ID NO: 548558 - RNA, 19 nt, Human
uagugaguaacaguccugc

SEQ ID NO: 548559 - RNA, 24 nt, Human
ucaaugcugaucaaagcauucagu

SEQ ID NO: 548560 - RNA, 21 nt, Human
ucaguagagaucgcauauacc

SEQ ID NO: 548561 - RNA, 22 nt, Human
ucugcuacuucugcuaguucug

SEQ ID NO: 548562 - RNA, 24 nt, Human
ucugcuaguucugauuuauacaua

SEQ ID NO: 548563 - RNA, 19 nt, Human
ugagguccucggaggugag

SEQ ID NO: 548564 - RNA, 19 nt, Human
ugauagacaagacucuggc

SEQ ID NO: 548565 - RNA, 23 nt, Human
ugcuaaaggaacaaauggaauga

SEQ ID NO: 548566 - RNA, 18 nt, Human
uggagacucucugugaga

SEQ ID NO: 548567 - RNA, 21 nt, Human
uggcacaagagggagacauga

SEQ ID NO: 548568 - RNA, 21 nt, Human
uggucuacuuuugugcuugcu

SEQ ID NO: 548569 - RNA, 18 nt, Human
uuaacagauuaaccuaau

SEQ ID NO: 548570 - RNA, 24 nt, Human
uucagugccuauuuugcucccauc

SEQ ID NO: 548571 - RNA, 21 nt, Human
uuuauacauauuccagcagca

SEQ ID NO: 548572 - RNA, 22 nt, Human
uuuccuggcuguguaugcguau

SEQ ID NO: 548573 - RNA, 18 nt, Human
uuuuuuuuuuuuuuuuug

SEQ ID NO: 548574 - RNA, 20 nt, Human
aagcagguggugcagagggu

SEQ ID NO: 548575 - RNA, 19 nt, Human
cucagccucaguauggcgg

SEQ ID NO: 548576 - RNA, 22 nt, Human
gggauugguugaauggcuuugg

SEQ ID NO: 548577 - RNA, 18 nt, Human
ggggauugguugaauggc

SEQ ID NO: 548578 - RNA, 20 nt, Human
ggggauugguugaauggcuu

SEQ ID NO: 548579 - RNA, 20 nt, Human
gugcagaggguauuucuaaa

SEQ ID NO: 548580 - RNA, 18 nt, Human
gugcucagccucaguaug

SEQ ID NO: 548581 - RNA, 23 nt, Human
ucaagacuccuuuauuggugguu

SEQ ID NO: 548582 - RNA, 23 nt, Human
ucaguauggcggcagucuuccuc

SEQ ID NO: 548583 - RNA, 19 nt, Human
uccucugaagauauuucuc

SEQ ID NO: 548584 - RNA, 18 nt, Human
ugaaaaagacaaaucugu

SEQ ID NO: 548585 - RNA, 18 nt, Human
ugaagauauuucuccuuu

SEQ ID NO: 548586 - RNA, 25 nt, Human
ugacagaugcaaugaaaaagacaaa

SEQ ID NO: 548587 - RNA, 24 nt, Human
ugccgcauucucucuacguucuuc

SEQ ID NO: 548588 - RNA, 22 nt, Human
uggcuuuggccccagccugucu

SEQ ID NO: 548589 - RNA, 25 nt, Human
uuggugguuaugccgcauucucucu

SEQ ID NO: 548590 - RNA, 22 nt, Human
agggguucuugggggaucgcgc

SEQ ID NO: 548591 - RNA, 21 nt, Human
ccccaggagcccgccgccccc

SEQ ID NO: 548592 - RNA, 18 nt, Human
ccccgagccucccugagc

SEQ ID NO: 548593 - RNA, 20 nt, Human
cccuggagggguucuugggg

SEQ ID NO: 548594 - RNA, 20 nt, Human
ccgcaggccggcccuggagg

SEQ ID NO: 548595 - RNA, 20 nt, Human
ccucccugagccggcgcgcc

SEQ ID NO: 548596 - RNA, 24 nt, Human
cgcgccaggccaaaagucugcaug

SEQ ID NO: 548597 - RNA, 21 nt, Human
cggcuccuccgcaggccggcc

SEQ ID NO: 548598 - RNA, 18 nt, Human
cgggcccgggugcggcgc

SEQ ID NO: 548599 - RNA, 24 nt, Human
cgucucaggcgagaccccaggagc

SEQ ID NO: 548600 - RNA, 22 nt, Human
cucgcccagggcuaggugcccc

SEQ ID NO: 548601 - RNA, 18 nt, Human
gaccuggagggccagugg

SEQ ID NO: 548602 - RNA, 20 nt, Human
gccccgagccucccugagcc

SEQ ID NO: 548603 - RNA, 21 nt, Human
gcccgccgcccccgcugucuc

SEQ ID NO: 548604 - RNA, 23 nt, Human
gcuccuccgcaggccggcccugg

SEQ ID NO: 548605 - RNA, 23 nt, Human
ggagggguucuugggggaucgcg

SEQ ID NO: 548606 - RNA, 20 nt, Human
ggggagaggccgcucugggc

SEQ ID NO: 548607 - RNA, 21 nt, Human
ggggagaggccgcucugggcg

SEQ ID NO: 548608 - RNA, 25 nt, Human
gucuuuauuccucgaucguuuagua

SEQ ID NO: 548609 - RNA, 24 nt, Human
uccgcaggccggcccuggaggggu

SEQ ID NO: 548610 - RNA, 20 nt, Human
ucucaggcgagaccccagga

SEQ ID NO: 548611 - RNA, 18 nt, Human
agcccaacaagcuuuggg

SEQ ID NO: 548612 - RNA, 21 nt, Human
aggcggcaauggugagccaag

SEQ ID NO: 548613 - RNA, 23 nt, Human
aggcugccggcggccagggcgcc

SEQ ID NO: 548614 - RNA, 18 nt, Human
aguccagggcccucagag

SEQ ID NO: 548615 - RNA, 23 nt, Human
aguguagauacagguggaggccu

SEQ ID NO: 548616 - RNA, 19 nt, Human
aguuguccaguuagagugg

SEQ ID NO: 548617 - RNA, 28 nt, Human
aucuaucuuuccccugacaucuccccag

SEQ ID NO: 548618 - RNA, 23 nt, Human
caaccagugcuccgcggccgccc

SEQ ID NO: 548619 - RNA, 25 nt, Human
caagcucaggcccaguccagggccc

SEQ ID NO: 548620 - RNA, 18 nt, Human
cagacagcuggccacagg

SEQ ID NO: 548621 - RNA, 19 nt, Human
caggcccaguccagggccc

SEQ ID NO: 548622 - RNA, 19 nt, Human
ccacaaggcugccggcggc

SEQ ID NO: 548623 - RNA, 21 nt, Human
ccaguccagggcccucagagu

SEQ ID NO: 548624 - RNA, 20 nt, Human
ccccgccugcccggguccgg

SEQ ID NO: 548625 - RNA, 19 nt, Human
ccccugccucccuccuccc

SEQ ID NO: 548626 - RNA, 23 nt, Human
ccggcucuccccugccucccucc

SEQ ID NO: 548627 - RNA, 25 nt, Human
ccucacucccugcagccuggcugga

SEQ ID NO: 548628 - RNA, 21 nt, Human
ccucccagcccacagucagac

SEQ ID NO: 548629 - RNA, 22 nt, Human
ccucuguggcaagcucaggccc

SEQ ID NO: 548630 - RNA, 21 nt, Human
cgcggcggaucggggcaccgg

SEQ ID NO: 548631 - RNA, 26 nt, Human
cgcuccaaccagugcuccgcggccgc

SEQ ID NO: 548632 - RNA, 22 nt, Human
cggagccucuguggcaagcuca

SEQ ID NO: 548633 - RNA, 21 nt, Human
cggccacaaggcugccggcgg

SEQ ID NO: 548634 - RNA, 21 nt, Human
cggccagggcgccgcccgcga

SEQ ID NO: 548635 - RNA, 22 nt, Human
cggcggcacgggccacuucggc

SEQ ID NO: 548636 - RNA, 20 nt, Human
cgggcgcggcgcggcgcucc

SEQ ID NO: 548637 - RNA, 19 nt, Human
cggggcaccggccacaagg

SEQ ID NO: 548638 - RNA, 22 nt, Human
cggggcaccggccacaaggcug

SEQ ID NO: 548639 - RNA, 19 nt, Human
cucugugcggcggcacggg

SEQ ID NO: 548640 - RNA, 20 nt, Human
cucugugcggcggcacgggc

SEQ ID NO: 548641 - RNA, 18 nt, Human
gaccggcucuccccugcc

SEQ ID NO: 548642 - RNA, 21 nt, Human
gaucggggcaccggccacaag

SEQ ID NO: 548643 - RNA, 18 nt, Human
gccccgccugcccggguc

SEQ ID NO: 548644 - RNA, 24 nt, Human
gccccgccugcccggguccggagc

SEQ ID NO: 548645 - RNA, 18 nt, Human
gcgcagcgggcgcgcccc

SEQ ID NO: 548646 - RNA, 22 nt, Human
ggagcccaacaagcuuugggaa

SEQ ID NO: 548647 - RNA, 21 nt, Human
ggagccucuguggcaagcuca

SEQ ID NO: 548648 - RNA, 22 nt, Human
ggcccaguccagggcccucaga

SEQ ID NO: 548649 - RNA, 20 nt, Human
ggcggcaauggugagccaag

SEQ ID NO: 548650 - RNA, 21 nt, Human
ggcucuccccugccucccucc

SEQ ID NO: 548651 - RNA, 18 nt, Human
gguccggagcgcggcgga

SEQ ID NO: 548652 - RNA, 26 nt, Human
gugcggcggcacgggccacuucggca

SEQ ID NO: 548653 - RNA, 18 nt, Human
uaaacuucugcaugcagu

SEQ ID NO: 548654 - RNA, 25 nt, Human
ucccagcccacagucagacggagcc

SEQ ID NO: 548655 - RNA, 18 nt, Human
uccccugacaucucccca

SEQ ID NO: 548656 - RNA, 20 nt, Human
uccccugccucccuccuccc

SEQ ID NO: 548657 - RNA, 21 nt, Human
uccccugccucccuccuccca

SEQ ID NO: 548658 - RNA, 22 nt, Human
ucccuccucccagcccacaguc

SEQ ID NO: 548659 - RNA, 19 nt, Human
ucugcaugcaguguaaaga

SEQ ID NO: 548660 - RNA, 20 nt, Human
ugagcagguuaagucccagg

SEQ ID NO: 548661 - RNA, 18 nt, Human
ugccucacucccugcagc

SEQ ID NO: 548662 - RNA, 22 nt, Human
ugccucacucccugcagccugg

SEQ ID NO: 548663 - RNA, 21 nt, Human
ugccucccuccucccagccca

SEQ ID NO: 548664 - RNA, 18 nt, Human
uggaugcaguaaggcaug

SEQ ID NO: 548665 - RNA, 20 nt, Human
uguaaagacagacagcuggc

SEQ ID NO: 548666 - RNA, 20 nt, Human
uguggcaagcucaggcccag

SEQ ID NO: 548667 - RNA, 22 nt, Human
uuggggccuauguggaaacucu

SEQ ID NO: 548668 - RNA, 23 nt, Human
aaacaccaauggauccccaaagc

SEQ ID NO: 548669 - RNA, 20 nt, Human
aaacaccccaaaccaaacac

SEQ ID NO: 548670 - RNA, 19 nt, Human
aaccaaacaccaauggauc

SEQ ID NO: 548671 - RNA, 23 nt, Human
aagaaaaaacuuaaaaaacaccc

SEQ ID NO: 548672 - RNA, 24 nt, Human
acccucccgcccccauaacccccu

SEQ ID NO: 548673 - RNA, 18 nt, Human
agcgaugugacucccucu

SEQ ID NO: 548674 - RNA, 25 nt, Human
caaaccaaacaccaauggauccccc

SEQ ID NO: 548675 - RNA, 25 nt, Human
caauggauccccaaagcgaugugac

SEQ ID NO: 548676 - RNA, 22 nt, Human
caccugacucuucccuggccgc

SEQ ID NO: 548677 - RNA, 26 nt, Human
ccaaaccaaacaccaauggaucccca

SEQ ID NO: 548678 - RNA, 23 nt, Human
ccauaacccccucugcuauagac

SEQ ID NO: 548679 - RNA, 22 nt, Human
ccccaaagcgaugugacucccu

SEQ ID NO: 548680 - RNA, 23 nt, Human
cccccauaacccccucugcuaua

SEQ ID NO: 548681 - RNA, 24 nt, Human
ccugacaccugacucuucccuggc

SEQ ID NO: 548682 - RNA, 23 nt, Human
cgcccccauaacccccucugcua

SEQ ID NO: 548683 - RNA, 25 nt, Human
cuacucggcaauagacaucucccga

SEQ ID NO: 548684 - RNA, 23 nt, Human
cucccucuucccacccggauaaa

SEQ ID NO: 548685 - RNA, 20 nt, Human
gaaaaaacuuaaaaaacacc

SEQ ID NO: 548686 - RNA, 19 nt, Human
gaaaauagaauuccugccc

SEQ ID NO: 548687 - RNA, 25 nt, Human
gcgaugugacucccucuucccaccc

SEQ ID NO: 548688 - RNA, 21 nt, Human
uaaaaaacaccccaaaccaaa

SEQ ID NO: 548689 - RNA, 25 nt, Human
uaaaaaacaccccaaaccaaacacc

SEQ ID NO: 548690 - RNA, 22 nt, Human
ucccgaaaauagaauuccugcc

SEQ ID NO: 548691 - RNA, 27 nt, Human
ucccgcccccauaacccccucugcuag

SEQ ID NO: 548692 - RNA, 22 nt, Human
ucggcaauagacaucucccgaa

SEQ ID NO: 548693 - RNA, 22 nt, Human
ucucccgaaaauagaauuccug

SEQ ID NO: 548694 - RNA, 18 nt, Human
ugugacucccucuuccca

SEQ ID NO: 548695 - RNA, 19 nt, Human
aaaaaacugcuacacagca

SEQ ID NO: 548696 - RNA, 20 nt, Human
aaaaaaguaguacagucuga

SEQ ID NO: 548697 - RNA, 25 nt, Human
aaaacaaaucacauggaaaccaaaa

SEQ ID NO: 548698 - RNA, 18 nt, Human
aaaacagaguugcacaca

SEQ ID NO: 548699 - RNA, 24 nt, Human
aaacaaaucacauggaaaccaaaa

SEQ ID NO: 548700 - RNA, 25 nt, Human
aaacaaaucacauggaaaccaaaau

SEQ ID NO: 548701 - RNA, 23 nt, Human
aaacuaccaccgaagaguaucau

SEQ ID NO: 548702 - RNA, 27 nt, Human
aagaaaacaaaucacauggaaaccaaa

SEQ ID NO: 548703 - RNA, 27 nt, Human
aagaaaacaaaucacauggaaaccaag

SEQ ID NO: 548704 - RNA, 21 nt, Human
aagcaccaauucaauaaucua

SEQ ID NO: 548705 - RNA, 21 nt, Human
aagccgcggccgcccgaacca

SEQ ID NO: 548706 - RNA, 18 nt, Human
aauuucauaaccccaccc

SEQ ID NO: 548707 - RNA, 24 nt, Human
acaaaaccaauaaauuucaagcac

SEQ ID NO: 548708 - RNA, 23 nt, Human
acacacccacacccuuccauaca

SEQ ID NO: 548709 - RNA, 23 nt, Human
acagaacauacauacugaagaaa

SEQ ID NO: 548710 - RNA, 21 nt, Human
acagaacuuaaaaaaaauacc

SEQ ID NO: 548711 - RNA, 19 nt, Human
acagauaccuauacacaua

SEQ ID NO: 548712 - RNA, 20 nt, Human
acauuuggggugagagggua

SEQ ID NO: 548713 - RNA, 21 nt, Human
aguagugucuuuugaaacuac

SEQ ID NO: 548714 - RNA, 20 nt, Human
auaaccccacccacuuccaa

SEQ ID NO: 548715 - RNA, 25 nt, Human
auuaaaaauuuuccauuacacauuu

SEQ ID NO: 548716 - RNA, 25 nt, Human
auucacuugaaucucaaacauuuga

SEQ ID NO: 548717 - RNA, 22 nt, Human
caaaagaguaggauagccacau

SEQ ID NO: 548718 - RNA, 23 nt, Human
caacaccauugcacuuggcaaaa

SEQ ID NO: 548719 - RNA, 24 nt, Human
caacaccauugcacuuggcaaaac

SEQ ID NO: 548720 - RNA, 20 nt, Human
caacuccaccagaaaaaaac

SEQ ID NO: 548721 - RNA, 19 nt, Human
cacacaagaaauuaaggga

SEQ ID NO: 548722 - RNA, 19 nt, Human
cacacacccacacccuucc

SEQ ID NO: 548723 - RNA, 19 nt, Human
cacaugcugaucugaugau

SEQ ID NO: 548724 - RNA, 20 nt, Human
cacugguaguguaagaaaac

SEQ ID NO: 548725 - RNA, 22 nt, Human
cagcaacuccaccagaaaaaaa

SEQ ID NO: 548726 - RNA, 18 nt, Human
cagcggaccgacagagug

SEQ ID NO: 548727 - RNA, 19 nt, Human
cauagcuagccaacagaac

SEQ ID NO: 548728 - RNA, 24 nt, Human
cauuaaauagcuggaacgcuuccu

SEQ ID NO: 548729 - RNA, 22 nt, Human
cauugcacuuggcaaaacugaa

SEQ ID NO: 548730 - RNA, 24 nt, Human
ccaaaaaaauagaaaguaucaaaa

SEQ ID NO: 548731 - RNA, 25 nt, Human
ccacucgccccuucacacacaccca

SEQ ID NO: 548732 - RNA, 25 nt, Human
ccccagguacuuaaagaaaugcucu

SEQ ID NO: 548733 - RNA, 18 nt, Human
ccgccugcccggccuccc

SEQ ID NO: 548734 - RNA, 21 nt, Human
ccgcgccgcucagccgccugc

SEQ ID NO: 548735 - RNA, 29 nt, Human
ccuauacacauagagaucuacacugaguu

SEQ ID NO: 548736 - RNA, 19 nt, Human
cgcccggcucggcuaccgg

SEQ ID NO: 548737 - RNA, 18 nt, Human
cgcccugggguaguaagc

SEQ ID NO: 548738 - RNA, 18 nt, Human
cucaaauaaacucccugc

SEQ ID NO: 548739 - RNA, 19 nt, Human
cucccgccuccgucguccg

SEQ ID NO: 548740 - RNA, 22 nt, Human
cugauguccucaaauaaacucc

SEQ ID NO: 548741 - RNA, 23 nt, Human
cugcugaucacugagagcuguau

SEQ ID NO: 548742 - RNA, 25 nt, Human
cuguauuuauauuucuccuauuacu

SEQ ID NO: 548743 - RNA, 23 nt, Human
cuuagaaaaggcagcaccucucu

SEQ ID NO: 548744 - RNA, 19 nt, Human
cuucacacacacccacacc

SEQ ID NO: 548745 - RNA, 23 nt, Human
cuucacacacacccacacccuuc

SEQ ID NO: 548746 - RNA, 19 nt, Human
cuuccccgucacguugaga

SEQ ID NO: 548747 - RNA, 20 nt, Human
gaacaaauuaugaugaaggc

SEQ ID NO: 548748 - RNA, 20 nt, Human
gacaguucugaugcacuuug

SEQ ID NO: 548749 - RNA, 23 nt, Human
gacuuacagcaacuccaccagaa

SEQ ID NO: 548750 - RNA, 18 nt, Human
gacuuagaaaaggcagca

SEQ ID NO: 548751 - RNA, 19 nt, Human
gcuccgggcuuagaggggc

SEQ ID NO: 548752 - RNA, 23 nt, Human
guaguacagucugagccaguaga

SEQ ID NO: 548753 - RNA, 20 nt, Human
guuaaaaaaucaaaacaaaa

SEQ ID NO: 548754 - RNA, 19 nt, Human
uaaaauuacaacaaaacca

SEQ ID NO: 548755 - RNA, 23 nt, Human
uaaccccacccacuuccaaccau

SEQ ID NO: 548756 - RNA, 24 nt, Human
uaauacaugcauugcccaaaagag

SEQ ID NO: 548757 - RNA, 23 nt, Human
uacagcaacuccaccagaaaaaa

SEQ ID NO: 548758 - RNA, 22 nt, Human
uaccucugguuguuccugaaga

SEQ ID NO: 548759 - RNA, 22 nt, Human
uaggaaauguacugaaaaccau

SEQ ID NO: 548760 - RNA, 19 nt, Human
uaguagacuaagagcaugu

SEQ ID NO: 548761 - RNA, 19 nt, Human
uaucacaaaaucacaugca

SEQ ID NO: 548762 - RNA, 20 nt, Human
uauguacagaacauacauag

SEQ ID NO: 548763 - RNA, 23 nt, Human
uauugaagaaaacaaaucacaug

SEQ ID NO: 548764 - RNA, 24 nt, Human
ucagccgccugcccggccucccuc

SEQ ID NO: 548765 - RNA, 21 nt, Human
uccacugguaguguaagaaaa

SEQ ID NO: 548766 - RNA, 23 nt, Human
ucuaaacaugauuugaccaaaaa

SEQ ID NO: 548767 - RNA, 24 nt, Human
ucuacaauuucauaaccccaccca

SEQ ID NO: 548768 - RNA, 22 nt, Human
ucuccaagaacugccuguucau

SEQ ID NO: 548769 - RNA, 19 nt, Human
ucucuaggucgcccggcuc

SEQ ID NO: 548770 - RNA, 19 nt, Human
ucucuaggucgcccggcuc

SEQ ID NO: 548771 - RNA, 22 nt, Human
ucucuaggucgcccggcucggc

SEQ ID NO: 548772 - RNA, 22 nt, Human
ucucucuucuuuugaagagaac

SEQ ID NO: 548773 - RNA, 23 nt, Human
ucugaugcacuuuggaauggcac

SEQ ID NO: 548774 - RNA, 24 nt, Human
ucuugcagggaguauagcacaugc

SEQ ID NO: 548775 - RNA, 26 nt, Human
ugaagaaaacaaaucacauggaaacc

SEQ ID NO: 548776 - RNA, 22 nt, Human
ugauacuuacuggcgcgcuccg

SEQ ID NO: 548777 - RNA, 22 nt, Human
ugauucagucuucuccuaguau

SEQ ID NO: 548778 - RNA, 21 nt, Human
ugcagcugaaggaaaagaguu

SEQ ID NO: 548779 - RNA, 18 nt, Human
ugcauaauacaugcauug

SEQ ID NO: 548780 - RNA, 22 nt, Human
uggcaaccccaaaggugacuga

SEQ ID NO: 548781 - RNA, 19 nt, Human
uguaaaaaaaagaauuugc

SEQ ID NO: 548782 - RNA, 24 nt, Human
uguaaacaaaaggaaagauauaca

SEQ ID NO: 548783 - RNA, 23 nt, Human
uguccuugggaguucacuggagu

SEQ ID NO: 548784 - RNA, 19 nt, Human
ugucuccacucgccccuuc

SEQ ID NO: 548785 - RNA, 23 nt, Human
ugugagacaucauuaaugauuca

SEQ ID NO: 548786 - RNA, 22 nt, Human
uguuugugauaccucugguugu

SEQ ID NO: 548787 - RNA, 20 nt, Human
uuaaagaaggcaacaccauu

SEQ ID NO: 548788 - RNA, 21 nt, Human
uuaacucauccaaaguuucua

SEQ ID NO: 548789 - RNA, 18 nt, Human
uuaacugaccauuaaaca

SEQ ID NO: 548790 - RNA, 21 nt, Human
uuacagcaacuccaccagaaa

SEQ ID NO: 548791 - RNA, 22 nt, Human
uuacaucacaccacuuagguac

SEQ ID NO: 548792 - RNA, 20 nt, Human
uuaguagugucuuuugaaac

SEQ ID NO: 548793 - RNA, 21 nt, Human
uuaguucuaggauaaaacaga

SEQ ID NO: 548794 - RNA, 18 nt, Human
uucaaaauuuucugccau

SEQ ID NO: 548795 - RNA, 22 nt, Human
uucaggaaaaaaaaaaaaaaaa

SEQ ID NO: 548796 - RNA, 23 nt, Human
uugaagguuuuaauauacauuga

SEQ ID NO: 548797 - RNA, 18 nt, Human
acaaaaacaaaaacaaaa

SEQ ID NO: 548798 - RNA, 27 nt, Human
acaacaaaaacaaaaacaaaaaauuaa

SEQ ID NO: 548799 - RNA, 19 nt, Human
acuagagaacaacaaaaac

SEQ ID NO: 548800 - RNA, 22 nt, Human
acuucauuuuccccuaaaagcu

SEQ ID NO: 548801 - RNA, 26 nt, Human
agaacaacaaaaacaaaaacaaaaaa

SEQ ID NO: 548802 - RNA, 24 nt, Human
agagaacaacaaaaacaaaaacaa

SEQ ID NO: 548803 - RNA, 26 nt, Human
agagaacaacaaaaacaaaaacaaaa

SEQ ID NO: 548804 - RNA, 18 nt, Human
caacaaaaacaaaaacaa

SEQ ID NO: 548805 - RNA, 22 nt, Human
cagaacaaagucuuuucuuucc

SEQ ID NO: 548806 - RNA, 23 nt, Human
caggaauugaaugccaagcacgc

SEQ ID NO: 548807 - RNA, 20 nt, Human
cagggcauggaagauuuccg

SEQ ID NO: 548808 - RNA, 18 nt, Human
cauccuucauauugcuga

SEQ ID NO: 548809 - RNA, 27 nt, Human
cauuuuccccuaaaagcuccaugaagg

SEQ ID NO: 548810 - RNA, 24 nt, Human
ccauaacauccuucauauugcuga

SEQ ID NO: 548811 - RNA, 25 nt, Human
ccccuaaaagcuccaugaaggcagg

SEQ ID NO: 548812 - RNA, 22 nt, Human
ccguagaacuagagaacaacaa

SEQ ID NO: 548813 - RNA, 24 nt, Human
ccuuccauaacauccuucauauug

SEQ ID NO: 548814 - RNA, 19 nt, Human
cggcaggagcagcagggga

SEQ ID NO: 548815 - RNA, 20 nt, Human
cggcuucugagucaacucuu

SEQ ID NO: 548816 - RNA, 22 nt, Human
cugagucaacucuagcugcaag

SEQ ID NO: 548817 - RNA, 26 nt, Human
cugcaagagccacuucauuuuccccu

SEQ ID NO: 548818 - RNA, 24 nt, Human
gagcagcaggggaaagagugagug

SEQ ID NO: 548819 - RNA, 19 nt, Human
gagucaacucuagcugcaa

SEQ ID NO: 548820 - RNA, 22 nt, Human
gauuuuccaccggcaaagaggg

SEQ ID NO: 548821 - RNA, 21 nt, Human
guccucuuaggcuuguuuucc

SEQ ID NO: 548822 - RNA, 23 nt, Human
gugaauuucuugaaacacacaga

SEQ ID NO: 548823 - RNA, 27 nt, Human
gugaauuucuugaaacacacagaacaa

SEQ ID NO: 548824 - RNA, 20 nt, Human
uagcugcaagagccacuuca

SEQ ID NO: 548825 - RNA, 24 nt, Human
uccagaucguggugugaacauucu

SEQ ID NO: 548826 - RNA, 30 nt, Human
uccccuaaaagcuccaugaaggcaggagcu

SEQ ID NO: 548827 - RNA, 22 nt, Human
ugagcacauugcagggcaugga

SEQ ID NO: 548828 - RNA, 27 nt, Human
ugccaagcacgccuuccauaacauccu

SEQ ID NO: 548829 - RNA, 24 nt, Human
uggccguccauaugcugagaguuu

SEQ ID NO: 548830 - RNA, 25 nt, Human
uuuggaggagucuuuguaggaagga

SEQ ID NO: 548831 - RNA, 19 nt, Human
uuuuaagauuuggaggagu

SEQ ID NO: 548832 - RNA, 20 nt, Human
aaugcaauuuaccacacauu

SEQ ID NO: 548833 - RNA, 18 nt, Human
agguugauuacuuccucu

SEQ ID NO: 548834 - RNA, 25 nt, Human
cggguaucccacgccagccagcccu

SEQ ID NO: 548835 - RNA, 23 nt, Human
cuggaagcucucuacugugccgu

SEQ ID NO: 548836 - RNA, 21 nt, Human
gauuuuccauauggaguugaa

SEQ ID NO: 548837 - RNA, 18 nt, Human
uaagccaaccaccuuucc

SEQ ID NO: 548838 - RNA, 25 nt, Human
uaaugaauucccuuuuccuuagcuu

SEQ ID NO: 548839 - RNA, 19 nt, Human
aaaaaaaucccucauccaa

SEQ ID NO: 548840 - RNA, 20 nt, Human
aaaaagaauccagaugcagg

SEQ ID NO: 548841 - RNA, 22 nt, Human
aaaaaucccucauccaaacuuc

SEQ ID NO: 548842 - RNA, 22 nt, Human
aaaagcagcuucauucaggaac

SEQ ID NO: 548843 - RNA, 18 nt, Human
aaaauguccacaugcaua

SEQ ID NO: 548844 - RNA, 21 nt, Human
aaacuacacuaucaacaagcu

SEQ ID NO: 548845 - RNA, 23 nt, Human
aaauuauuccuccccuuccuccc

SEQ ID NO: 548846 - RNA, 22 nt, Human
aacaauuuaggaaggcaucuaa

SEQ ID NO: 548847 - RNA, 20 nt, Human
aacauguaggauuucucccc

SEQ ID NO: 548848 - RNA, 22 nt, Human
aagaacaaaccugagagaaaca

SEQ ID NO: 548849 - RNA, 21 nt, Human
aaguacaauaauaaagaugaa

SEQ ID NO: 548850 - RNA, 23 nt, Human
acaaagaaaaaaaaaaucccuca

SEQ ID NO: 548851 - RNA, 25 nt, Human
acaauaauaaagaugaaaaugccuc

SEQ ID NO: 548852 - RNA, 22 nt, Human
accaguuucaaaggaaagaaaa

SEQ ID NO: 548853 - RNA, 18 nt, Human
agaaaaacuuccuaagcc

SEQ ID NO: 548854 - RNA, 21 nt, Human
agaaagcagaugaaagugaau

SEQ ID NO: 548855 - RNA, 22 nt, Human
aggaagaacaaaccugagagaa

SEQ ID NO: 548856 - RNA, 19 nt, Human
aggcagagugucuaauucc

SEQ ID NO: 548857 - RNA, 21 nt, Human
aggcagagugucuaauuccuu

SEQ ID NO: 548858 - RNA, 22 nt, Human
aggugguggaggaggagggggu

SEQ ID NO: 548859 - RNA, 23 nt, Human
agguugguuuuucccuccuucuu

SEQ ID NO: 548860 - RNA, 19 nt, Human
augcagggagggguggggc

SEQ ID NO: 548861 - RNA, 21 nt, Human
auguacaaaaucuagaaagca

SEQ ID NO: 548862 - RNA, 19 nt, Human
auuagaccaaggcacaaaa

SEQ ID NO: 548863 - RNA, 23 nt, Human
caaaaucaaaagagguugcugac

SEQ ID NO: 548864 - RNA, 20 nt, Human
caaauauggcacauaacaac

SEQ ID NO: 548865 - RNA, 19 nt, Human
cacaguuuaaucuaaaaau

SEQ ID NO: 548866 - RNA, 18 nt, Human
caccagagucauaauguc

SEQ ID NO: 548867 - RNA, 26 nt, Human
cacgugcgcgagagcacacacacgca

SEQ ID NO: 548868 - RNA, 19 nt, Human
cagaugcagggaggggugg

SEQ ID NO: 548869 - RNA, 21 nt, Human
caguuuaaucuaaaaaugaaa

SEQ ID NO: 548870 - RNA, 18 nt, Human
cauauagacagcacgugc

SEQ ID NO: 548871 - RNA, 27 nt, Human
caugacaaugaauaucugauagaaaaa

SEQ ID NO: 548872 - RNA, 20 nt, Human
ccaaaaagaauccagaugca

SEQ ID NO: 548873 - RNA, 22 nt, Human
ccagaaaaaagcagcaaacgga

SEQ ID NO: 548874 - RNA, 20 nt, Human
cccaccacccaagucucacu

SEQ ID NO: 548875 - RNA, 19 nt, Human
ccccuuccucccacucccc

SEQ ID NO: 548876 - RNA, 23 nt, Human
ccuguguaacagcggggguaccu

SEQ ID NO: 548877 - RNA, 22 nt, Human
ccuucuucccaccacccaaguc

SEQ ID NO: 548878 - RNA, 18 nt, Human
ccuucuucccaccuuccu

SEQ ID NO: 548879 - RNA, 22 nt, Human
cucugcagaaaaacuuccuaag

SEQ ID NO: 548880 - RNA, 23 nt, Human
cugucugcaauuaaaaaagcuaa

SEQ ID NO: 548881 - RNA, 21 nt, Human
gagagaaacauuacaauacaa

SEQ ID NO: 548882 - RNA, 22 nt, Human
gaggugguggaggaggaggggg

SEQ ID NO: 548883 - RNA, 20 nt, Human
gcagcaaacggagagggaaa

SEQ ID NO: 548884 - RNA, 24 nt, Human
gcaggaggugguggaggaggaggg

SEQ ID NO: 548885 - RNA, 22 nt, Human
gcgagagcacacacacgcagag

SEQ ID NO: 548886 - RNA, 20 nt, Human
ggaagaacaaaccugagaga

SEQ ID NO: 548887 - RNA, 22 nt, Human
ggaggugguggaggaggagggg

SEQ ID NO: 548888 - RNA, 25 nt, Human
ggcaggaggugguggaggaggaggg

SEQ ID NO: 548889 - RNA, 21 nt, Human
gggaaagagcuuaucaccaga

SEQ ID NO: 548890 - RNA, 26 nt, Human
gggcaggaggugguggaggaggaggg

SEQ ID NO: 548891 - RNA, 18 nt, Human
gggguggggcaggaggug

SEQ ID NO: 548892 - RNA, 20 nt, Human
ggugguggaggaggaggggg

SEQ ID NO: 548893 - RNA, 18 nt, Human
gguuaaaauacaaauagc

SEQ ID NO: 548894 - RNA, 21 nt, Human
guugguuuuucccuccuucug

SEQ ID NO: 548895 - RNA, 22 nt, Human
uaaaugauucucuuccauucug

SEQ ID NO: 548896 - RNA, 24 nt, Human
uaacuuacccaacaaaaucaaaag

SEQ ID NO: 548897 - RNA, 18 nt, Human
uaccaauuaaagucacaa

SEQ ID NO: 548898 - RNA, 23 nt, Human
uagaaaacuacacuaucaacaag

SEQ ID NO: 548899 - RNA, 24 nt, Human
uagaaagcagaugaaagugaauua

SEQ ID NO: 548900 - RNA, 22 nt, Human
uaguauuuucugcauaacuguu

SEQ ID NO: 548901 - RNA, 24 nt, Human
uagugcagaaaucaacuuuaaaua

SEQ ID NO: 548902 - RNA, 18 nt, Human
ucaaagcaaauauggcac

SEQ ID NO: 548903 - RNA, 20 nt, Human
ucauggaauaucaaacauga

SEQ ID NO: 548904 - RNA, 26 nt, Human
uccacaguuaagauauuaugugaagc

SEQ ID NO: 548905 - RNA, 27 nt, Human
uccacaugcauaaaucuaaaaaagguu

SEQ ID NO: 548906 - RNA, 22 nt, Human
uccccuuccucccacuccccua

SEQ ID NO: 548907 - RNA, 20 nt, Human
uccuucuucccaccuuccuc

SEQ ID NO: 548908 - RNA, 19 nt, Human
ucuacaaaauguuuucccu

SEQ ID NO: 548909 - RNA, 25 nt, Human
ucugcaauuaaaaaagcuaaccuug

SEQ ID NO: 548910 - RNA, 18 nt, Human
ugauaggaagaacaaacc

SEQ ID NO: 548911 - RNA, 22 nt, Human
uggaggaggaggggguacuuga

SEQ ID NO: 548912 - RNA, 19 nt, Human
uggcacauaacaacucaag

SEQ ID NO: 548913 - RNA, 23 nt, Human
uggcacauaacaacucaagcaua

SEQ ID NO: 548914 - RNA, 18 nt, Human
ugggacuaggccuugaaa

SEQ ID NO: 548915 - RNA, 19 nt, Human
uguaaaggccagaaaaaag

SEQ ID NO: 548916 - RNA, 19 nt, Human
ugucugaaggcuuucagag

SEQ ID NO: 548917 - RNA, 24 nt, Human
uuacuacuacugcaugacaaugaa

SEQ ID NO: 548918 - RNA, 19 nt, Human
uucccuccuucuguuuguc

SEQ ID NO: 548919 - RNA, 24 nt, Human
uucuaaaauuucucaagcugaaga

SEQ ID NO: 548920 - RNA, 19 nt, Human
uucugugaccuuaauugcu

SEQ ID NO: 548921 - RNA, 18 nt, Human
uugauguuuuuacuacua

SEQ ID NO: 548922 - RNA, 20 nt, Human
uuuagucucuuaucuuaguu

SEQ ID NO: 548923 - RNA, 19 nt, Human
uuucccugggacuaggccu

SEQ ID NO: 548924 - RNA, 22 nt, Human
uuugcauaaccaaaaguacaau

SEQ ID NO: 548925 - RNA, 23 nt, Human
uuuucccuccuucuguuugucuc

SEQ ID NO: 548926 - RNA, 19 nt, Human
aaagaggcucucguucccc

SEQ ID NO: 548927 - RNA, 22 nt, Human
aaggggugggagagaaggggcg

SEQ ID NO: 548928 - RNA, 22 nt, Human
accagcccaggcucugcccagc

SEQ ID NO: 548929 - RNA, 24 nt, Human
acccaccuaggccccuccugccac

SEQ ID NO: 548930 - RNA, 26 nt, Human
accccaccagcccaggcucugcccag

SEQ ID NO: 548931 - RNA, 21 nt, Human
acccgugcccugguucucagg

SEQ ID NO: 548932 - RNA, 18 nt, Human
acgcugcacucagcuggg

SEQ ID NO: 548933 - RNA, 27 nt, Human
agaaggaaggggugggagagaaggggc

SEQ ID NO: 548934 - RNA, 19 nt, Human
agacacaacagaucugccc

SEQ ID NO: 548935 - RNA, 19 nt, Human
agacugacccagggcccca

SEQ ID NO: 548936 - RNA, 19 nt, Human
agagggugaacucugggcc

SEQ ID NO: 548937 - RNA, 21 nt, Human
agcccagcagacaccacaccc

SEQ ID NO: 548938 - RNA, 24 nt, Human
agcccccucagcugacccucauca

SEQ ID NO: 548939 - RNA, 18 nt, Human
agcuccucccgcccuggc

SEQ ID NO: 548940 - RNA, 20 nt, Human
agcuccucccgcccuggccc

SEQ ID NO: 548941 - RNA, 18 nt, Human
agcugggucucagcccag

SEQ ID NO: 548942 - RNA, 22 nt, Human
agcugguggggggccagacuga

SEQ ID NO: 548943 - RNA, 21 nt, Human
aggcccccccagaaagggaaa

SEQ ID NO: 548944 - RNA, 21 nt, Human
aggccccuccugccacgcccc

SEQ ID NO: 548945 - RNA, 23 nt, Human
aggccccuccugccacgccccac

SEQ ID NO: 548946 - RNA, 18 nt, Human
aggccugggccgggggcu

SEQ ID NO: 548947 - RNA, 22 nt, Human
aggggcagagcccucccccgcc

SEQ ID NO: 548948 - RNA, 18 nt, Human
aggggcgagagggagcag

SEQ ID NO: 548949 - RNA, 21 nt, Human
caaaccagagccaggagcugg

SEQ ID NO: 548950 - RNA, 24 nt, Human
caaaccagagccaggagcuggaga

SEQ ID NO: 548951 - RNA, 22 nt, Human
cacagagcugaggcugccaggu

SEQ ID NO: 548952 - RNA, 27 nt, Human
caccacacccgugcccugguucucagg

SEQ ID NO: 548953 - RNA, 20 nt, Human
caccccaccagcccaggcuc

SEQ ID NO: 548954 - RNA, 18 nt, Human
caccuaggccccuccugc

SEQ ID NO: 548955 - RNA, 18 nt, Human
cacgccccacagccaccc

SEQ ID NO: 548956 - RNA, 22 nt, Human
cagacaccacacccgugcccug

SEQ ID NO: 548957 - RNA, 18 nt, Human
cagcccagcccuuguggg

SEQ ID NO: 548958 - RNA, 19 nt, Human
cagcuccccagcuccuccc

SEQ ID NO: 548959 - RNA, 21 nt, Human
cagcuccucccgcccuggccc

SEQ ID NO: 548960 - RNA, 26 nt, Human
cagcuccucccgcccuggcccugccc

SEQ ID NO: 548961 - RNA, 22 nt, Human
caggagaugacaucccagcccg

SEQ ID NO: 548962 - RNA, 24 nt, Human
cagggccccagcuccccagcuccu

SEQ ID NO: 548963 - RNA, 22 nt, Human
cagggcucgggugcugcuccuc

SEQ ID NO: 548964 - RNA, 21 nt, Human
caucaggaacaagagggcucc

SEQ ID NO: 548965 - RNA, 22 nt, Human
cauuuaaaaaaucaacuacaga

SEQ ID NO: 548966 - RNA, 19 nt, Human
ccaaaccagagccaggagc

SEQ ID NO: 548967 - RNA, 22 nt, Human
ccaaaccagagccaggagcugg

SEQ ID NO: 548968 - RNA, 18 nt, Human
ccacgcugucgcaccagg

SEQ ID NO: 548969 - RNA, 21 nt, Human
ccagacuccugcuccucuggg

SEQ ID NO: 548970 - RNA, 22 nt, Human
ccagcccggcccagcucccacc

SEQ ID NO: 548971 - RNA, 21 nt, Human
ccagcuccggcucccaacagc

SEQ ID NO: 548972 - RNA, 23 nt, Human
ccaggacucuggcaacccuuccc

SEQ ID NO: 548973 - RNA, 23 nt, Human
cccacagccaccccagcaggcac

SEQ ID NO: 548974 - RNA, 28 nt, Human
cccacagccaccccagcaggcacaggag

SEQ ID NO: 548975 - RNA, 22 nt, Human
cccaccagcccaggcucugccc

SEQ ID NO: 548976 - RNA, 22 nt, Human
cccaccuaggccccuccugcca

SEQ ID NO: 548977 - RNA, 24 nt, Human
cccagggccccagcuccccagcuc

SEQ ID NO: 548978 - RNA, 18 nt, Human
cccccaggacucuggcaa

SEQ ID NO: 548979 - RNA, 18 nt, Human
ccccgcccggcaggagau

SEQ ID NO: 548980 - RNA, 19 nt, Human
ccccgcccggcaggagaug

SEQ ID NO: 548981 - RNA, 19 nt, Human
cccggcccagcucccaccc

SEQ ID NO: 548982 - RNA, 18 nt, Human
cccucccagacuccugcu

SEQ ID NO: 548983 - RNA, 18 nt, Human
cccucccauccuaccucu

SEQ ID NO: 548984 - RNA, 24 nt, Human
cccuuccauaggccaacuggacag

SEQ ID NO: 548985 - RNA, 26 nt, Human
cccuugcuccaaaccagagccaggag

SEQ ID NO: 548986 - RNA, 20 nt, Human
ccucccauccuaccucuggu

SEQ ID NO: 548987 - RNA, 22 nt, Human
ccucccauccuaccucugguuc

SEQ ID NO: 548988 - RNA, 19 nt, Human
ccucccccgcccggcagga

SEQ ID NO: 548989 - RNA, 19 nt, Human
ccucccgcccuggcccugc

SEQ ID NO: 548990 - RNA, 21 nt, Human
ccucuggggcccccaggacuc

SEQ ID NO: 548991 - RNA, 27 nt, Human
ccugccacgccccacagccaccccagc

SEQ ID NO: 548992 - RNA, 22 nt, Human
ccuggcccugcccacgcgccug

SEQ ID NO: 548993 - RNA, 24 nt, Human
ccuggcccugcccacgcgccuggc

SEQ ID NO: 548994 - RNA, 24 nt, Human
ccugggagguuggggugucucucc

SEQ ID NO: 548995 - RNA, 20 nt, Human
ccuugcuccaaaccagagcc

SEQ ID NO: 548996 - RNA, 21 nt, Human
cgccccacagccaccccagca

SEQ ID NO: 548997 - RNA, 22 nt, Human
cgcggaucaacaggccugggcc

SEQ ID NO: 548998 - RNA, 24 nt, Human
cgcuguggcagccccgaggcuggg

SEQ ID NO: 548999 - RNA, 18 nt, Human
cggcccagcucccacccu

SEQ ID NO: 549000 - RNA, 21 nt, Human
cuccagggcucgggugcugcu

SEQ ID NO: 549001 - RNA, 18 nt, Human
cucccaacagcgacuccc

SEQ ID NO: 549002 - RNA, 19 nt, Human
cuccccagucuuaucucca

SEQ ID NO: 549003 - RNA, 18 nt, Human
cuccugcuccucuggggc

SEQ ID NO: 549004 - RNA, 23 nt, Human
cuccuggauccacuagaggguga

SEQ ID NO: 549005 - RNA, 20 nt, Human
cucuccccagucuuaucucc

SEQ ID NO: 549006 - RNA, 23 nt, Human
cucucguucccccucccauccua

SEQ ID NO: 549007 - RNA, 19 nt, Human
gaccucaggcccccccaga

SEQ ID NO: 549008 - RNA, 19 nt, Human
gagggcgcacaggcgcaac

SEQ ID NO: 549009 - RNA, 20 nt, Human
gcagacaccacacccgugcc

SEQ ID NO: 549010 - RNA, 19 nt, Human
gcagccccgaggcugggcu

SEQ ID NO: 549011 - RNA, 23 nt, Human
gccacgccccacagccaccccag

SEQ ID NO: 549012 - RNA, 18 nt, Human
gcccaggcucugcccagc

SEQ ID NO: 549013 - RNA, 23 nt, Human
gcgcaacgcgcuguggcagcccc

SEQ ID NO: 549014 - RNA, 22 nt, Human
gcucucguucccccucccaucc

SEQ ID NO: 549015 - RNA, 19 nt, Human
ggagaugacaucccagccc

SEQ ID NO: 549016 - RNA, 23 nt, Human
ggcaacccuuccccuugcuccaa

SEQ ID NO: 549017 - RNA, 18 nt, Human
ggccugggccgggggcuc

SEQ ID NO: 549018 - RNA, 23 nt, Human
gggacaggggaggcuccucgggc

SEQ ID NO: 549019 - RNA, 20 nt, Human
gggcccggcucagaaggaag

SEQ ID NO: 549020 - RNA, 22 nt, Human
gggcccucccagacuccugcuc

SEQ ID NO: 549021 - RNA, 18 nt, Human
ggggcacaggaccaggug

SEQ ID NO: 549022 - RNA, 18 nt, Human
ggggcccccaggacucug

SEQ ID NO: 549023 - RNA, 20 nt, Human
gggugucucuccccagucuu

SEQ ID NO: 549024 - RNA, 18 nt, Human
guggcaccccaccagccc

SEQ ID NO: 549025 - RNA, 19 nt, Human
guucucaggcccaacccac

SEQ ID NO: 549026 - RNA, 18 nt, Human
uauuuugguccccacagg

SEQ ID NO: 549027 - RNA, 23 nt, Human
ucacauugucccacgcugucgca

SEQ ID NO: 549028 - RNA, 21 nt, Human
ucagcccccucagcugacccu

SEQ ID NO: 549029 - RNA, 20 nt, Human
ucccagcccggcccagcucc

SEQ ID NO: 549030 - RNA, 19 nt, Human
uccccagcuccucccgccc

SEQ ID NO: 549031 - RNA, 20 nt, Human
uccugcuccucuggggcccc

SEQ ID NO: 549032 - RNA, 18 nt, Human
ucgggcucugcaaagaag

SEQ ID NO: 549033 - RNA, 20 nt, Human
ucgggugcugcuccuccugg

SEQ ID NO: 549034 - RNA, 24 nt, Human
ucucaggcccaacccaccuaggcc

SEQ ID NO: 549035 - RNA, 27 nt, Human
ugaacucugggcccucccagacuccuu

SEQ ID NO: 549036 - RNA, 23 nt, Human
ugacaagaccucaggccccccca

SEQ ID NO: 549037 - RNA, 18 nt, Human
ugaggggcacagagcuga

SEQ ID NO: 549038 - RNA, 19 nt, Human
ugcaaagaaggggguccug

SEQ ID NO: 549039 - RNA, 21 nt, Human
ugcccgaggggacaggggagg

SEQ ID NO: 549040 - RNA, 18 nt, Human
ugcuccaaaccagagcca

SEQ ID NO: 549041 - RNA, 23 nt, Human
ugcuccaaaccagagccaggagc

SEQ ID NO: 549042 - RNA, 19 nt, Human
uggagauguuagggaacuu

SEQ ID NO: 549043 - RNA, 18 nt, Human
aaaaaaccuguuucaggc

SEQ ID NO: 549044 - RNA, 24 nt, Human
aaaaagaguuuaucuaauuaugga

SEQ ID NO: 549045 - RNA, 21 nt, Human
aacaauuucaaauacauagga

SEQ ID NO: 549046 - RNA, 26 nt, Human
aacuucaggcacauaauuccaauuuu

SEQ ID NO: 549047 - RNA, 23 nt, Human
aaggcaaaauucugauuauaauc

SEQ ID NO: 549048 - RNA, 21 nt, Human
acaaagcagauauuuccuuca

SEQ ID NO: 549049 - RNA, 21 nt, Human
agaaauccuugucuuuuuagu

SEQ ID NO: 549050 - RNA, 24 nt, Human
agaagaaaaaaggcaaaauucuga

SEQ ID NO: 549051 - RNA, 18 nt, Human
agacuuuagaaaccagua

SEQ ID NO: 549052 - RNA, 24 nt, Human
aggaaaaaaaauaaugcauuguga

SEQ ID NO: 549053 - RNA, 23 nt, Human
aguugccaagaaauuucuaagga

SEQ ID NO: 549054 - RNA, 21 nt, Human
caaaaggcagcugaauauaag

SEQ ID NO: 549055 - RNA, 22 nt, Human
cacuauauuuagaaaacauaaa

SEQ ID NO: 549056 - RNA, 18 nt, Human
cagccccugcggagcuuu

SEQ ID NO: 549057 - RNA, 23 nt, Human
cauucagaauauguucuugcuau

SEQ ID NO: 549058 - RNA, 22 nt, Human
cauuccugccuaaagagcaaag

SEQ ID NO: 549059 - RNA, 23 nt, Human
ccccugcggagcuuuuugggaac

SEQ ID NO: 549060 - RNA, 23 nt, Human
cuaacuggcauauacacaaagca

SEQ ID NO: 549061 - RNA, 22 nt, Human
cucuccuagcuugagaccucag

SEQ ID NO: 549062 - RNA, 19 nt, Human
cuggaaugcaggagagaag

SEQ ID NO: 549063 - RNA, 23 nt, Human
cugucccaucauggaacagcccu

SEQ ID NO: 549064 - RNA, 23 nt, Human
gaaguugccaagaaauuucuaag

SEQ ID NO: 549065 - RNA, 19 nt, Human
gagguaggucuccacucca

SEQ ID NO: 549066 - RNA, 23 nt, Human
ggaaagcucuguaacaauuucaa

SEQ ID NO: 549067 - RNA, 21 nt, Human
ggaaggaaaggaggaaaaaaa

SEQ ID NO: 549068 - RNA, 23 nt, Human
uaaaagaaauccuugucuuuuua

SEQ ID NO: 549069 - RNA, 25 nt, Human
uaaaguggaaguaaaaaaaccuguu

SEQ ID NO: 549070 - RNA, 21 nt, Human
uaaaugacaggacuacaauau

SEQ ID NO: 549071 - RNA, 21 nt, Human
uaacuggcauauacacaaagc

SEQ ID NO: 549072 - RNA, 21 nt, Human
uaauggaugagaucaccuccc

SEQ ID NO: 549073 - RNA, 18 nt, Human
uacagugguauaguuugg

SEQ ID NO: 549074 - RNA, 19 nt, Human
uacuuuggcuuagcauuua

SEQ ID NO: 549075 - RNA, 20 nt, Human
uagaagugguaaauacagug

SEQ ID NO: 549076 - RNA, 19 nt, Human
uauaagucuaagaccucaa

SEQ ID NO: 549077 - RNA, 22 nt, Human
uauauaauacauacauauguaa

SEQ ID NO: 549078 - RNA, 23 nt, Human
uaugaaaacaaauccaaagcugg

SEQ ID NO: 549079 - RNA, 18 nt, Human
uauuacacaugagaaugu

SEQ ID NO: 549080 - RNA, 21 nt, Human
uauuacacaugagaauguuuu

SEQ ID NO: 549081 - RNA, 22 nt, Human
ucaaaaaucagacauauuuaua

SEQ ID NO: 549082 - RNA, 21 nt, Human
ucaaaacugguuuuugugccc

SEQ ID NO: 549083 - RNA, 19 nt, Human
ucauuuauugcuacauaau

SEQ ID NO: 549084 - RNA, 24 nt, Human
ucuggaaugcaggagagaagucug

SEQ ID NO: 549085 - RNA, 25 nt, Human
ugaaaagaucauuccugccuaaaga

SEQ ID NO: 549086 - RNA, 20 nt, Human
ugaagagcuaccccggccgg

SEQ ID NO: 549087 - RNA, 22 nt, Human
ugacuugaucuucaaguugaga

SEQ ID NO: 549088 - RNA, 20 nt, Human
ugagaacauccugggagaga

SEQ ID NO: 549089 - RNA, 22 nt, Human
ugcauugugauacaaaaauauu

SEQ ID NO: 549090 - RNA, 24 nt, Human
ugccuaaagagcaaagcuuaugug

SEQ ID NO: 549091 - RNA, 27 nt, Human
ugccuccaaacuucaggcacauaauuc

SEQ ID NO: 549092 - RNA, 18 nt, Human
ugcgaaguugccaagaaa

SEQ ID NO: 549093 - RNA, 22 nt, Human
uggaaggaaaggaggaaaaaaa

SEQ ID NO: 549094 - RNA, 23 nt, Human
uguagagauuuuaugaaaacaaa

SEQ ID NO: 549095 - RNA, 22 nt, Human
uuagauauuuaaauauugugcu

SEQ ID NO: 549096 - RNA, 24 nt, Human
uugugcuaaugauuugaaaagauc

SEQ ID NO: 549097 - RNA, 22 nt, Human
uuugagaagaaaaaaggcaaaa

SEQ ID NO: 549098 - RNA, 21 nt, Human
aaaacaccaaagaaguuguag

SEQ ID NO: 549099 - RNA, 25 nt, Human
aaacaccaaagaaguuguagaauac

SEQ ID NO: 549100 - RNA, 24 nt, Human
aacagcaugggggaaccgccccca

SEQ ID NO: 549101 - RNA, 24 nt, Human
aagaacagcaugggggaaccgccc

SEQ ID NO: 549102 - RNA, 27 nt, Human
aagaacagcaugggggaaccgguaccc

SEQ ID NO: 549103 - RNA, 19 nt, Human
aagcauuccaguccuucuc

SEQ ID NO: 549104 - RNA, 22 nt, Human
aaguagcuccagaaacugcuag

SEQ ID NO: 549105 - RNA, 23 nt, Human
accauauccuacaaggaaugacu

SEQ ID NO: 549106 - RNA, 21 nt, Human
agacagugaagaggaaccaag

SEQ ID NO: 549107 - RNA, 23 nt, Human
agugaagaggaaccaaggcaucu

SEQ ID NO: 549108 - RNA, 19 nt, Human
auggcagacagugaagagg

SEQ ID NO: 549109 - RNA, 24 nt, Human
caaaacaccaaagaaguuguagaa

SEQ ID NO: 549110 - RNA, 19 nt, Human
caagaacagcaugggggaa

SEQ ID NO: 549111 - RNA, 25 nt, Human
caagaacagcaugggggaaccgccc

SEQ ID NO: 549112 - RNA, 18 nt, Human
cacaagaacagcaugggg

SEQ ID NO: 549113 - RNA, 25 nt, Human
cacaagaacagcaugggggaaccgc

SEQ ID NO: 549114 - RNA, 18 nt, Human
cacaccaucuuugcagaa

SEQ ID NO: 549115 - RNA, 25 nt, Human
cacacucagccuuggcaaguagcuc

SEQ ID NO: 549116 - RNA, 22 nt, Human
caccacaccaucuuugcagaag

SEQ ID NO: 549117 - RNA, 22 nt, Human
cagacagugaagaggaaccaag

SEQ ID NO: 549118 - RNA, 23 nt, Human
caggaggagcaaaacaccaaaga

SEQ ID NO: 549119 - RNA, 22 nt, Human
ccaaagaaguuguagaauacag

SEQ ID NO: 549120 - RNA, 21 nt, Human
ccaaccacaggaggagcaaaa

SEQ ID NO: 549121 - RNA, 24 nt, Human
ccaaccacaggaggagcaaaacac

SEQ ID NO: 549122 - RNA, 22 nt, Human
ccaccugaucucucccuugaug

SEQ ID NO: 549123 - RNA, 24 nt, Human
ccagcccauccuuggccagagccc

SEQ ID NO: 549124 - RNA, 24 nt, Human
cccaagauccaauuaccuccaccu

SEQ ID NO: 549125 - RNA, 19 nt, Human
ccuccagcccauccuuggc

SEQ ID NO: 549126 - RNA, 25 nt, Human
ccugaucucucccuugaugugggga

SEQ ID NO: 549127 - RNA, 27 nt, Human
cuaaaccauauccuacaaggaaugacu

SEQ ID NO: 549128 - RNA, 23 nt, Human
cucagcucacacucagccuuggc

SEQ ID NO: 549129 - RNA, 23 nt, Human
cuuggugguggggcaggcucagc

SEQ ID NO: 549130 - RNA, 19 nt, Human
gaaggcaugccaagccaag

SEQ ID NO: 549131 - RNA, 18 nt, Human
gagaaauggccaagcccc

SEQ ID NO: 549132 - RNA, 23 nt, Human
gauaagggagaagagaagaggaa

SEQ ID NO: 549133 - RNA, 23 nt, Human
gcccggagaagcauuccaguccu

SEQ ID NO: 549134 - RNA, 19 nt, Human
gcugggcgaguccaugaug

SEQ ID NO: 549135 - RNA, 18 nt, Human
ggccgaggagagcugggc

SEQ ID NO: 549136 - RNA, 19 nt, Human
ggguguggugaagaguugg

SEQ ID NO: 549137 - RNA, 21 nt, Human
ggugaagaguuggagcccagg

SEQ ID NO: 549138 - RNA, 19 nt, Human
gguggggcaggcucagcuc

SEQ ID NO: 549139 - RNA, 23 nt, Human
guggcaggaaggagaaugaacac

SEQ ID NO: 549140 - RNA, 19 nt, Human
gugguggggcaggcucagc

SEQ ID NO: 549141 - RNA, 22 nt, Human
guuuaauugacucacuguucca

SEQ ID NO: 549142 - RNA, 25 nt, Human
uacaggguguggugaagaguuggag

SEQ ID NO: 549143 - RNA, 19 nt, Human
uaggugggggcacagcuaa

SEQ ID NO: 549144 - RNA, 23 nt, Human
uauaaaaucaucagaucucguga

SEQ ID NO: 549145 - RNA, 21 nt, Human
uaucacaagaacagcaugggg

SEQ ID NO: 549146 - RNA, 20 nt, Human
ucacuguuccacauggcugg

SEQ ID NO: 549147 - RNA, 19 nt, Human
uccacauggcuggggaggc

SEQ ID NO: 549148 - RNA, 18 nt, Human
uccagggaagagacagac

SEQ ID NO: 549149 - RNA, 21 nt, Human
uccuuggccagagccccaggc

SEQ ID NO: 549150 - RNA, 24 nt, Human
ucugagaaggcaugccaagccaag

SEQ ID NO: 549151 - RNA, 18 nt, Human
ugaccuccagcccauccu

SEQ ID NO: 549152 - RNA, 23 nt, Human
ugauauuuuaggugggggcacag

SEQ ID NO: 549153 - RNA, 20 nt, Human
ugccaagccaagguucaggc

SEQ ID NO: 549154 - RNA, 21 nt, Human
uggagaaauggccaagcccca

SEQ ID NO: 549155 - RNA, 20 nt, Human
uggcaaguagcuccagaaac

SEQ ID NO: 549156 - RNA, 20 nt, Human
uggccaagccccaugugguu

SEQ ID NO: 549157 - RNA, 20 nt, Human
uggccaggcugucgucuuuc

SEQ ID NO: 549158 - RNA, 24 nt, Human
ugggggaaccgcccccaagaucca

SEQ ID NO: 549159 - RNA, 24 nt, Human
ugugguuacagggaagccacguac

SEQ ID NO: 549160 - RNA, 19 nt, Human
uuggugguggggcaggcuc

SEQ ID NO: 549161 - RNA, 19 nt, Human
aaaauacaagcagaggaag

SEQ ID NO: 549162 - RNA, 18 nt, Human
aaaauacacaccaaaacc

SEQ ID NO: 549163 - RNA, 24 nt, Human
aaaaugccucucaacaaccacaaa

SEQ ID NO: 549164 - RNA, 21 nt, Human
aaauaaauacuauucuucuug

SEQ ID NO: 549165 - RNA, 22 nt, Human
aacagcuuaagacauaauggug

SEQ ID NO: 549166 - RNA, 18 nt, Human
aacccuuggcucugaaca

SEQ ID NO: 549167 - RNA, 18 nt, Human
aagaaggagacacccaaa

SEQ ID NO: 549168 - RNA, 20 nt, Human
aagaaggagacacccaaaaa

SEQ ID NO: 549169 - RNA, 22 nt, Human
aagaaggagacacccaaaaaca

SEQ ID NO: 549170 - RNA, 20 nt, Human
acaaaacacaaggaaaacaa

SEQ ID NO: 549171 - RNA, 22 nt, Human
acaaaacacaaggaaaacaaag

SEQ ID NO: 549172 - RNA, 20 nt, Human
acaagaaggagacacccaaa

SEQ ID NO: 549173 - RNA, 20 nt, Human
acacaaccacacacaaacac

SEQ ID NO: 549174 - RNA, 24 nt, Human
acacaccaaaaccuuaaugugaaa

SEQ ID NO: 549175 - RNA, 21 nt, Human
acauaccuuccuguuccaucc

SEQ ID NO: 549176 - RNA, 19 nt, Human
acauaugaauggugugaaa

SEQ ID NO: 549177 - RNA, 19 nt, Human
agacacccaaaaacaaugu

SEQ ID NO: 549178 - RNA, 21 nt, Human
agacacccaaaaacaauguaa

SEQ ID NO: 549179 - RNA, 21 nt, Human
agagcacuugucucucuuuuc

SEQ ID NO: 549180 - RNA, 25 nt, Human
agagcacuugucucucuuuucuucc

SEQ ID NO: 549181 - RNA, 24 nt, Human
agagccaaauacuuucuacaccca

SEQ ID NO: 549182 - RNA, 18 nt, Human
agauuuguauuuggguca

SEQ ID NO: 549183 - RNA, 22 nt, Human
agccaaauacuuucuacaccca

SEQ ID NO: 549184 - RNA, 20 nt, Human
agcccaauuuuuccccuacu

SEQ ID NO: 549185 - RNA, 23 nt, Human
aggaaagacaaauagguaaaugu

SEQ ID NO: 549186 - RNA, 21 nt, Human
aggcagcaaauaccaggcuca

SEQ ID NO: 549187 - RNA, 24 nt, Human
auaaauuuauuagaaaaacaugcc

SEQ ID NO: 549188 - RNA, 21 nt, Human
auagauuucugaaacucauaa

SEQ ID NO: 549189 - RNA, 26 nt, Human
aucacagagcauuuccuaccucaaga

SEQ ID NO: 549190 - RNA, 20 nt, Human
auuugcuauaucuuuucugu

SEQ ID NO: 549191 - RNA, 20 nt, Human
auuugcuuuuuaauggaaau

SEQ ID NO: 549192 - RNA, 21 nt, Human
caaaacacaaggaaaacaaag

SEQ ID NO: 549193 - RNA, 22 nt, Human
caaagacacuuuguauaagccc

SEQ ID NO: 549194 - RNA, 24 nt, Human
caaaugcaccgaaacaaaacacaa

SEQ ID NO: 549195 - RNA, 22 nt, Human
caacaaacaugagagaguuaaa

SEQ ID NO: 549196 - RNA, 21 nt, Human
caaccuaguuucuucauauua

SEQ ID NO: 549197 - RNA, 18 nt, Human
cacaagaaggagacaccc

SEQ ID NO: 549198 - RNA, 24 nt, Human
cacacaaccacacacaaacacacu

SEQ ID NO: 549199 - RNA, 22 nt, Human
cacacacaaacacacuugcaca

SEQ ID NO: 549200 - RNA, 22 nt, Human
cacaccaaaaccuuaaugugaa

SEQ ID NO: 549201 - RNA, 22 nt, Human
caccaaucacgauaaugcaauc

SEQ ID NO: 549202 - RNA, 22 nt, Human
caccauugcaaggaccaaguau

SEQ ID NO: 549203 - RNA, 22 nt, Human
cacccaaaaacaauguaaaaac

SEQ ID NO: 549204 - RNA, 21 nt, Human
caccgaaacaaaacacaagga

SEQ ID NO: 549205 - RNA, 25 nt, Human
cacuaaggcuauucugccacuuaac

SEQ ID NO: 549206 - RNA, 22 nt, Human
cacuugucucucuuuucuucug

SEQ ID NO: 549207 - RNA, 21 nt, Human
cagcagcagaacugucccuau

SEQ ID NO: 549208 - RNA, 21 nt, Human
caggguuugaaaaugccucuc

SEQ ID NO: 549209 - RNA, 19 nt, Human
cagguuacaacaaacauga

SEQ ID NO: 549210 - RNA, 21 nt, Human
ccacuacuuuaaaugaaaagc

SEQ ID NO: 549211 - RNA, 21 nt, Human
cccaaaaacaauguaaaaaca

SEQ ID NO: 549212 - RNA, 21 nt, Human
cuaaguaacuuacauaaaggc

SEQ ID NO: 549213 - RNA, 19 nt, Human
cucaagaaauuagcaguga

SEQ ID NO: 549214 - RNA, 22 nt, Human
cucaagaaauuagcagugacuc

SEQ ID NO: 549215 - RNA, 21 nt, Human
cuuaagacauaauggugacaa

SEQ ID NO: 549216 - RNA, 23 nt, Human
cuucaucgcaaaauacaagcaga

SEQ ID NO: 549217 - RNA, 22 nt, Human
cuugucccaucaacauauacuu

SEQ ID NO: 549218 - RNA, 20 nt, Human
cuuguccuucauuuauaacu

SEQ ID NO: 549219 - RNA, 20 nt, Human
cuuuggauguauucuuaguu

SEQ ID NO: 549220 - RNA, 23 nt, Human
cuuuuauauuuguaaaacaguua

SEQ ID NO: 549221 - RNA, 22 nt, Human
gaaaaugccucucaacaaccac

SEQ ID NO: 549222 - RNA, 19 nt, Human
gaccaaguauaaaauauuc

SEQ ID NO: 549223 - RNA, 18 nt, Human
gacuggcaccacuguugu

SEQ ID NO: 549224 - RNA, 26 nt, Human
uaaaacccuccaaauaaaaggaauua

SEQ ID NO: 549225 - RNA, 18 nt, Human
uaacaaaauacacaccaa

SEQ ID NO: 549226 - RNA, 21 nt, Human
uaacaaaauacacaccaaaac

SEQ ID NO: 549227 - RNA, 22 nt, Human
uaacaaaauacacaccaaaacc

SEQ ID NO: 549228 - RNA, 23 nt, Human
uaacagcagcagaacugucccua

SEQ ID NO: 549229 - RNA, 20 nt, Human
uaacucaaacuuuuccuauu

SEQ ID NO: 549230 - RNA, 23 nt, Human
uaaggcauaaagucccaaagaua

SEQ ID NO: 549231 - RNA, 21 nt, Human
uaaguucuuugucuuucaaag

SEQ ID NO: 549232 - RNA, 26 nt, Human
uaaugauuuacuaacaauuuuacuau

SEQ ID NO: 549233 - RNA, 18 nt, Human
uacaaauauauaaauuua

SEQ ID NO: 549234 - RNA, 21 nt, Human
uaccucaagaggguacuugag

SEQ ID NO: 549235 - RNA, 21 nt, Human
uaccucagguuacaacaaaca

SEQ ID NO: 549236 - RNA, 22 nt, Human
uaccucagguuacaacaaacau

SEQ ID NO: 549237 - RNA, 21 nt, Human
uagaaaaacaugccuacuaaa

SEQ ID NO: 549238 - RNA, 19 nt, Human
uagcaaaggcaggaugaca

SEQ ID NO: 549239 - RNA, 23 nt, Human
uaggacgcacuguauguuugaug

SEQ ID NO: 549240 - RNA, 23 nt, Human
uaggauaauuguuuuaugugaaa

SEQ ID NO: 549241 - RNA, 20 nt, Human
uagucugucacaaccuaguu

SEQ ID NO: 549242 - RNA, 22 nt, Human
uauacacaaacauugaaauaug

SEQ ID NO: 549243 - RNA, 19 nt, Human
uaucaaauggucuuugcuu

SEQ ID NO: 549244 - RNA, 21 nt, Human
uauuugcuuuuuaauggaaau

SEQ ID NO: 549245 - RNA, 21 nt, Human
uccaauuuuauuuaccaucac

SEQ ID NO: 549246 - RNA, 18 nt, Human
uccacacaaccacacaca

SEQ ID NO: 549247 - RNA, 25 nt, Human
uccacacaaccacacacaaacacac

SEQ ID NO: 549248 - RNA, 22 nt, Human
ucuauagccuaaaaaguaaggc

SEQ ID NO: 549249 - RNA, 20 nt, Human
ucucucuuuucuucugaauu

SEQ ID NO: 549250 - RNA, 23 nt, Human
ucuguagcauuuggauaccucag

SEQ ID NO: 549251 - RNA, 22 nt, Human
ucuuuggauguauucuuaguuu

SEQ ID NO: 549252 - RNA, 23 nt, Human
ugaaacucauaaccaccaaucac

SEQ ID NO: 549253 - RNA, 22 nt, Human
ugaauggugugaaagaccaaaa

SEQ ID NO: 549254 - RNA, 19 nt, Human
ugaaugguucuugagccca

SEQ ID NO: 549255 - RNA, 22 nt, Human
ugaauuaaaaacacuuaacuca

SEQ ID NO: 549256 - RNA, 22 nt, Human
uguccacacaaccacacacaaa

SEQ ID NO: 549257 - RNA, 19 nt, Human
ugugauuaaucaaagacac

SEQ ID NO: 549258 - RNA, 21 nt, Human
uuaaaugcaauaauccauaaa

SEQ ID NO: 549259 - RNA, 21 nt, Human
uuagaaaaacaugccuacuaa

SEQ ID NO: 549260 - RNA, 20 nt, Human
uuagauacuucaaaaacauc

SEQ ID NO: 549261 - RNA, 19 nt, Human
uuccaucuccuccuugucc

SEQ ID NO: 549262 - RNA, 20 nt, Human
uuccuuaaaauauuucuuca

SEQ ID NO: 549263 - RNA, 21 nt, Human
uucuucacaauaaacccuugg

SEQ ID NO: 549264 - RNA, 18 nt, Human
uugaaggacagcaaucaa

SEQ ID NO: 549265 - RNA, 22 nt, Human
uuuauuauacuuuuauauuugu

SEQ ID NO: 549266 - RNA, 23 nt, Human
uuuccuagagccaaauacuuucu

SEQ ID NO: 549267 - RNA, 21 nt, Human
uuuuccaucuccuccuugucc

SEQ ID NO: 549268 - RNA, 18 nt, Human
uuuuuuuucaaauagguu

SEQ ID NO: 549269 - RNA, 24 nt, Human
aaaaaaaaaaaaagagagaaagag

SEQ ID NO: 549270 - RNA, 18 nt, Human
aaaagauccagagaaaac

SEQ ID NO: 549271 - RNA, 22 nt, Human
aaaauccacaacaaggauccuc

SEQ ID NO: 549272 - RNA, 18 nt, Human
aacccacacccagagucc

SEQ ID NO: 549273 - RNA, 18 nt, Human
aaccuccuacaagcugca

SEQ ID NO: 549274 - RNA, 22 nt, Human
aaggaccaggacacagagggug

SEQ ID NO: 549275 - RNA, 22 nt, Human
aagguguaugucaucacugaca

SEQ ID NO: 549276 - RNA, 22 nt, Human
aaguagcuuguggcagacaagc

SEQ ID NO: 549277 - RNA, 24 nt, Human
aaugucuacuucccuuccuguggc

SEQ ID NO: 549278 - RNA, 18 nt, Human
acaaagagaaggaugggg

SEQ ID NO: 549279 - RNA, 20 nt, Human
acagagagcacacgcauaca

SEQ ID NO: 549280 - RNA, 21 nt, Human
agaaagaaccugguguaugga

SEQ ID NO: 549281 - RNA, 18 nt, Human
agaagaagaaaugauuca

SEQ ID NO: 549282 - RNA, 21 nt, Human
agacagaaaaugacagcaaga

SEQ ID NO: 549283 - RNA, 21 nt, Human
agagcacacgcauacagcacg

SEQ ID NO: 549284 - RNA, 22 nt, Human
agaggaaaaggcuuagcuggga

SEQ ID NO: 549285 - RNA, 18 nt, Human
agagggaggucuccaagc

SEQ ID NO: 549286 - RNA, 19 nt, Human
agcccagugucaagaucca

SEQ ID NO: 549287 - RNA, 20 nt, Human
agccuaugagcaacaucacc

SEQ ID NO: 549288 - RNA, 22 nt, Human
aggacugggagguaaaauggaa

SEQ ID NO: 549289 - RNA, 21 nt, Human
aggauccucccucugaggugu

SEQ ID NO: 549290 - RNA, 19 nt, Human
agggagauaaggacuaagc

SEQ ID NO: 549291 - RNA, 23 nt, Human
agggagauaaggacuaagccagg

SEQ ID NO: 549292 - RNA, 21 nt, Human
agggcaggaagaagguucugu

SEQ ID NO: 549293 - RNA, 21 nt, Human
aggggcggcccccucggcucc

SEQ ID NO: 549294 - RNA, 20 nt, Human
agguagguuuugcagcccag

SEQ ID NO: 549295 - RNA, 19 nt, Human
agguggcacagagaggaug

SEQ ID NO: 549296 - RNA, 20 nt, Human
agguuuugcagcccaguguc

SEQ ID NO: 549297 - RNA, 22 nt, Human
aguagaaaaagacccuggagag

SEQ ID NO: 549298 - RNA, 23 nt, Human
auagcaaaguagaaaaagacccu

SEQ ID NO: 549299 - RNA, 27 nt, Human
auauacauaacuucaaagcacauccgu

SEQ ID NO: 549300 - RNA, 19 nt, Human
auauaucuauauauauaug

SEQ ID NO: 549301 - RNA, 19 nt, Human
auauaucuauaucucuaua

SEQ ID NO: 549302 - RNA, 22 nt, Human
auccagaaaguaagaauccagu

SEQ ID NO: 549303 - RNA, 19 nt, Human
auccagagaaaacaaaaua

SEQ ID NO: 549304 - RNA, 20 nt, Human
aucccugggcuaugccccga

SEQ ID NO: 549305 - RNA, 22 nt, Human
augagaaaccauaagcauacaa

SEQ ID NO: 549306 - RNA, 19 nt, Human
caaaaaagagaaaaggaaa

SEQ ID NO: 549307 - RNA, 25 nt, Human
caaaaaagagaaaaggaaaaguagg

SEQ ID NO: 549308 - RNA, 24 nt, Human
caaaauccacaacaaggauccucc

SEQ ID NO: 549309 - RNA, 19 nt, Human
caaagaugaguuccuagac

SEQ ID NO: 549310 - RNA, 22 nt, Human
caaagccaggugcaaaauccac

SEQ ID NO: 549311 - RNA, 23 nt, Human
caaagccaggugcaaaauccaca

SEQ ID NO: 549312 - RNA, 20 nt, Human
caagcagguaaucaguaaau

SEQ ID NO: 549313 - RNA, 21 nt, Human
caagccaaagggacgcaucua

SEQ ID NO: 549314 - RNA, 23 nt, Human
caccggccugcaccagggggaau

SEQ ID NO: 549315 - RNA, 19 nt, Human
cacugccugcaucuccgua

SEQ ID NO: 549316 - RNA, 18 nt, Human
cagcagcagagucccaga

SEQ ID NO: 549317 - RNA, 20 nt, Human
cagcagcagugcaaggaugc

SEQ ID NO: 549318 - RNA, 19 nt, Human
cagcagugcaaggaugcgg

SEQ ID NO: 549319 - RNA, 25 nt, Human
caggauggucacccagaacuccuaa

SEQ ID NO: 549320 - RNA, 23 nt, Human
caggggagggcuuugcaaaugca

SEQ ID NO: 549321 - RNA, 21 nt, Human
caucugguucuuucugcuuau

SEQ ID NO: 549322 - RNA, 20 nt, Human
ccaaacccugguggcccaua

SEQ ID NO: 549323 - RNA, 23 nt, Human
ccaaucaaccaauuacaaacacc

SEQ ID NO: 549324 - RNA, 26 nt, Human
ccacacacaguauuacuacacugaac

SEQ ID NO: 549325 - RNA, 26 nt, Human
ccacacccagaguccaggucucccca

SEQ ID NO: 549326 - RNA, 23 nt, Human
ccagagaaaacaaaauaagagaa

SEQ ID NO: 549327 - RNA, 21 nt, Human
ccagccccagcagcagugcaa

SEQ ID NO: 549328 - RNA, 23 nt, Human
ccaguaccugagcacagaccagg

SEQ ID NO: 549329 - RNA, 20 nt, Human
ccaugguugaaauauaaagc

SEQ ID NO: 549330 - RNA, 21 nt, Human
cccaaagccaggugcaaaauc

SEQ ID NO: 549331 - RNA, 21 nt, Human
cccacacccagaguccagguc

SEQ ID NO: 549332 - RNA, 25 nt, Human
cccagaacuccuaaccgcccucagg

SEQ ID NO: 549333 - RNA, 19 nt, Human
ccccaaacccugguggccc

SEQ ID NO: 549334 - RNA, 21 nt, Human
ccccaccccuccccaccaauc

SEQ ID NO: 549335 - RNA, 21 nt, Human
ccccccaccccuccccaccaa

SEQ ID NO: 549336 - RNA, 23 nt, Human
ccccucccaccuucuucagccug

SEQ ID NO: 549337 - RNA, 19 nt, Human
ccccuccccaccaaucaac

SEQ ID NO: 549338 - RNA, 22 nt, Human
cccuccccucccaccuucuuca

SEQ ID NO: 549339 - RNA, 18 nt, Human
ccgcccuccccucccacc

SEQ ID NO: 549340 - RNA, 24 nt, Human
ccuccccucccaccuucuucagcc

SEQ ID NO: 549341 - RNA, 18 nt, Human
ccuccucccucguggcac

SEQ ID NO: 549342 - RNA, 24 nt, Human
ccucuggcaggcaggccgcggggc

SEQ ID NO: 549343 - RNA, 19 nt, Human
ccugacuguuacuaccagg

SEQ ID NO: 549344 - RNA, 19 nt, Human
ccugcaaagaugaguuccu

SEQ ID NO: 549345 - RNA, 18 nt, Human
ccuggguggagagguggc

SEQ ID NO: 549346 - RNA, 18 nt, Human
ccuuagcugggccaguuc

SEQ ID NO: 549347 - RNA, 23 nt, Human
cgagaaaggagagaaggguguga

SEQ ID NO: 549348 - RNA, 25 nt, Human
cgggaaacugaggcccaagaggggg

SEQ ID NO: 549349 - RNA, 20 nt, Human
cuccauuagggccccccacc

SEQ ID NO: 549350 - RNA, 24 nt, Human
cuccauuagggccccccaccccuc

SEQ ID NO: 549351 - RNA, 20 nt, Human
cuccucagguuccgcccucc

SEQ ID NO: 549352 - RNA, 24 nt, Human
cucuccauuagggccccccacccc

SEQ ID NO: 549353 - RNA, 19 nt, Human
cucugcggagcagccuguu

SEQ ID NO: 549354 - RNA, 22 nt, Human
cugcaguggcccucagaaggac

SEQ ID NO: 549355 - RNA, 21 nt, Human
cugugagccaacccacaccca

SEQ ID NO: 549356 - RNA, 19 nt, Human
cuguggcaacuucagcagc

SEQ ID NO: 549357 - RNA, 24 nt, Human
cuguucggcgacacccccgcccgc

SEQ ID NO: 549358 - RNA, 23 nt, Human
cuugccaaacccacaccucucca

SEQ ID NO: 549359 - RNA, 24 nt, Human
cuuuuucucauuucaaaggagagu

SEQ ID NO: 549360 - RNA, 19 nt, Human
gaaaggggugagcaaggga

SEQ ID NO: 549361 - RNA, 19 nt, Human
gaaauauaaagcuggcuca

SEQ ID NO: 549362 - RNA, 22 nt, Human
gagagguggcacagagaggaug

SEQ ID NO: 549363 - RNA, 23 nt, Human
gagcaacaucacccgucagucuc

SEQ ID NO: 549364 - RNA, 23 nt, Human
gagccaacccacacccagagucc

SEQ ID NO: 549365 - RNA, 24 nt, Human
gagccaacccacacccagagucca

SEQ ID NO: 549366 - RNA, 18 nt, Human
gagccuaugagcaacauc

SEQ ID NO: 549367 - RNA, 19 nt, Human
gaggaaacagugcccuaga

SEQ ID NO: 549368 - RNA, 23 nt, Human
gaggacugggagguaaaauggaa

SEQ ID NO: 549369 - RNA, 23 nt, Human
gcacagagaggaugagaaacaaa

SEQ ID NO: 549370 - RNA, 21 nt, Human
gcaggcaggccgcggggcggg

SEQ ID NO: 549371 - RNA, 22 nt, Human
gcccaagagggggaauggggau

SEQ ID NO: 549372 - RNA, 20 nt, Human
gcccagagaggauggagcca

SEQ ID NO: 549373 - RNA, 18 nt, Human
gcccauaaacuccacaag

SEQ ID NO: 549374 - RNA, 18 nt, Human
gccccccaccccucccca

SEQ ID NO: 549375 - RNA, 21 nt, Human
gcccgggguuccccaugucgg

SEQ ID NO: 549376 - RNA, 18 nt, Human
gccgcggggcggggcggc

SEQ ID NO: 549377 - RNA, 19 nt, Human
gcggagcagccuguucggc

SEQ ID NO: 549378 - RNA, 20 nt, Human
gcggcccccucggcuccucu

SEQ ID NO: 549379 - RNA, 18 nt, Human
ggaaauguagguguucag

SEQ ID NO: 549380 - RNA, 24 nt, Human
ggaaccucaggauacaucaaucac

SEQ ID NO: 549381 - RNA, 18 nt, Human
ggaagggggaagggggag

SEQ ID NO: 549382 - RNA, 19 nt, Human
ggaagggggaagggggagg

SEQ ID NO: 549383 - RNA, 19 nt, Human
ggauggggaggaaacagug

SEQ ID NO: 549384 - RNA, 18 nt, Human
ggcacuuucugagcucag

SEQ ID NO: 549385 - RNA, 21 nt, Human
ggccuccuggguggagaggug

SEQ ID NO: 549386 - RNA, 24 nt, Human
ggcggcccccucggcuccucuggc

SEQ ID NO: 549387 - RNA, 25 nt, Human
gggaaacugaggcccaagaggggga

SEQ ID NO: 549388 - RNA, 18 nt, Human
gggaagggggaggaggga

SEQ ID NO: 549389 - RNA, 27 nt, Human
gggcaggaagaagguucuguggcuuuu

SEQ ID NO: 549390 - RNA, 20 nt, Human
ggggaaaggggugagcaagg

SEQ ID NO: 549391 - RNA, 19 nt, Human
ggggcggggcggcgcgggg

SEQ ID NO: 549392 - RNA, 19 nt, Human
ggguguggggugggggaag

SEQ ID NO: 549393 - RNA, 22 nt, Human
ggguguggggugggggaagggg

SEQ ID NO: 549394 - RNA, 20 nt, Human
ggucagggaagggcagaaug

SEQ ID NO: 549395 - RNA, 22 nt, Human
ggugauuuccccaaacccuggu

SEQ ID NO: 549396 - RNA, 24 nt, Human
gguucuguggcuuuuccaccagga

SEQ ID NO: 549397 - RNA, 21 nt, Human
guggcuccucagguuccgccc

SEQ ID NO: 549398 - RNA, 24 nt, Human
uacaaacaccacacacaguauuac

SEQ ID NO: 549399 - RNA, 18 nt, Human
uacacugaacccgucagc

SEQ ID NO: 549400 - RNA, 23 nt, Human
uacacugaacccgucagccccua

SEQ ID NO: 549401 - RNA, 24 nt, Human
uacagcacggagcacugagguggg

SEQ ID NO: 549402 - RNA, 20 nt, Human
uaccugagcacagaccaggc

SEQ ID NO: 549403 - RNA, 18 nt, Human
uagaaaaagacccuggag

SEQ ID NO: 549404 - RNA, 21 nt, Human
uagaaaaagacccuggagagc

SEQ ID NO: 549405 - RNA, 24 nt, Human
uagaaagaaccugguguauggaaa

SEQ ID NO: 549406 - RNA, 18 nt, Human
uagaagggaggucacagc

SEQ ID NO: 549407 - RNA, 21 nt, Human
uagguuuugcagcccaguguc

SEQ ID NO: 549408 - RNA, 26 nt, Human
uauaaagcuggcucagguggcuccuc

SEQ ID NO: 549409 - RNA, 19 nt, Human
uauauaucuauauauauau

SEQ ID NO: 549410 - RNA, 18 nt, Human
ucaccccugccccaaagc

SEQ ID NO: 549411 - RNA, 19 nt, Human
ucagaguucagcuguugac

SEQ ID NO: 549412 - RNA, 20 nt, Human
ucagauggaaaagauccaga

SEQ ID NO: 549413 - RNA, 21 nt, Human
ucagcaucaaacacauuuauu

SEQ ID NO: 549414 - RNA, 18 nt, Human
ucagggaagggcagaaug

SEQ ID NO: 549415 - RNA, 19 nt, Human
ucagguggcuccucagguu

SEQ ID NO: 549416 - RNA, 18 nt, Human
ucccugggcuaugccccg

SEQ ID NO: 549417 - RNA, 23 nt, Human
uccucagguuccgcccuccccuc

SEQ ID NO: 549418 - RNA, 20 nt, Human
uccugggacaggggagggcu

SEQ ID NO: 549419 - RNA, 19 nt, Human
uccuggguggagagguggc

SEQ ID NO: 549420 - RNA, 23 nt, Human
ucucuugcuuugcugugcaagug

SEQ ID NO: 549421 - RNA, 24 nt, Human
ucugcaguggcccucagaaggacc

SEQ ID NO: 549422 - RNA, 19 nt, Human
ugacagcaagacauugaga

SEQ ID NO: 549423 - RNA, 20 nt, Human
ugacaguacgucgcagcugg

SEQ ID NO: 549424 - RNA, 22 nt, Human
ugacuguuacuaccaggggggc

SEQ ID NO: 549425 - RNA, 21 nt, Human
ugagaaaccauaagcauacaa

SEQ ID NO: 549426 - RNA, 19 nt, Human
ugagauagcaaaguagaaa

SEQ ID NO: 549427 - RNA, 20 nt, Human
ugagccaacccacacccaga

SEQ ID NO: 549428 - RNA, 18 nt, Human
ugaguaaaaaggaacagg

SEQ ID NO: 549429 - RNA, 20 nt, Human
ugauucagaacaaggaagag

SEQ ID NO: 549430 - RNA, 19 nt, Human
ugauuuccugcccugccuc

SEQ ID NO: 549431 - RNA, 20 nt, Human
ugcagugggacauuuucccu

SEQ ID NO: 549432 - RNA, 21 nt, Human
ugccaagcuugugaugggagc

SEQ ID NO: 549433 - RNA, 20 nt, Human
ugcuuugcugugcaaguguu

SEQ ID NO: 549434 - RNA, 21 nt, Human
uggagagguggcacagagagg

SEQ ID NO: 549435 - RNA, 18 nt, Human
uggaguggacccaccggc

SEQ ID NO: 549436 - RNA, 22 nt, Human
uggcaacuucagcagcagaguc

SEQ ID NO: 549437 - RNA, 21 nt, Human
uggcaggcaggccgcggggcg

SEQ ID NO: 549438 - RNA, 24 nt, Human
uggcuccucagguuccgcccuccc

SEQ ID NO: 549439 - RNA, 21 nt, Human
ugggguaauuucugggcacaa

SEQ ID NO: 549440 - RNA, 19 nt, Human
uggggucagggaagggcag

SEQ ID NO: 549441 - RNA, 21 nt, Human
uggggucagggaagggcagaa

SEQ ID NO: 549442 - RNA, 18 nt, Human
uggggugggggaaggggg

SEQ ID NO: 549443 - RNA, 22 nt, Human
ugguggcccauaaacuccacaa

SEQ ID NO: 549444 - RNA, 18 nt, Human
uguagaaagaaccuggug

SEQ ID NO: 549445 - RNA, 22 nt, Human
uguccugggacaggggagggcu

SEQ ID NO: 549446 - RNA, 19 nt, Human
ugugagccaacccacaccc

SEQ ID NO: 549447 - RNA, 21 nt, Human
uguggcagacaagccugagga

SEQ ID NO: 549448 - RNA, 24 nt, Human
uucagcaucaaacacauuuauuuc

SEQ ID NO: 549449 - RNA, 22 nt, Human
uucagugugcucaggacuccug

SEQ ID NO: 549450 - RNA, 23 nt, Human
uuccuguacccucagauggaaaa

SEQ ID NO: 549451 - RNA, 20 nt, Human
uucgagugauguugcucaug

SEQ ID NO: 549452 - RNA, 18 nt, Human
uugcagguccccuccucc

SEQ ID NO: 549453 - RNA, 21 nt, Human
uugcuuugcugugcaaguguu

SEQ ID NO: 549454 - RNA, 23 nt, Human
uuuguccugggacaggggagggc

SEQ ID NO: 549455 - RNA, 21 nt, Human
uuuuuuuucuugaaaaaaauc

SEQ ID NO: 549456 - RNA, 19 nt, Human
aacugaucgcuccccaucu

SEQ ID NO: 549457 - RNA, 19 nt, Human
acccugagcauccgaagaa

SEQ ID NO: 549458 - RNA, 18 nt, Human
agaaugccugaugcggau

SEQ ID NO: 549459 - RNA, 20 nt, Human
caagaucuguuuuugaauuc

SEQ ID NO: 549460 - RNA, 22 nt, Human
cccagaacccugagcauccgaa

SEQ ID NO: 549461 - RNA, 18 nt, Human
cgcuccccaucugaacac

SEQ ID NO: 549462 - RNA, 20 nt, Human
cugagcauccgaagaauggg

SEQ ID NO: 549463 - RNA, 18 nt, Human
cuguagcauccccagaac

SEQ ID NO: 549464 - RNA, 19 nt, Human
gagaaugccugaugcggau

SEQ ID NO: 549465 - RNA, 21 nt, Human
ugaggcgggaagcuuguauag

SEQ ID NO: 549466 - RNA, 23 nt, Human
uguuuuugaauucacuuccgaga

SEQ ID NO: 549467 - RNA, 21 nt, Human
uuccgagagaacugaucgcuc

SEQ ID NO: 549468 - RNA, 22 nt, Human
uuuauuguuuuugcuguguguu

SEQ ID NO: 549469 - RNA, 24 nt, Human
agugcaguucuucaauuaaagugc

SEQ ID NO: 549470 - RNA, 19 nt, Human
cauggaugagguaaacuaa

SEQ ID NO: 549471 - RNA, 20 nt, Human
uaauuucaagaguuuugagu

SEQ ID NO: 549472 - RNA, 20 nt, Human
ugcauggaugagguaaacua

SEQ ID NO: 549473 - RNA, 19 nt, Human
aaaaucacucuauaaacaa

SEQ ID NO: 549474 - RNA, 23 nt, Human
aaacaauaucaaaacagcacuga

SEQ ID NO: 549475 - RNA, 18 nt, Human
aaggacccaggacaucac

SEQ ID NO: 549476 - RNA, 21 nt, Human
aaguuucuugcaucaguguuc

SEQ ID NO: 549477 - RNA, 21 nt, Human
aauaaagcuuuaaaaacaagc

SEQ ID NO: 549478 - RNA, 22 nt, Human
acagcacugauuaaacagaaua

SEQ ID NO: 549479 - RNA, 22 nt, Human
accugccaauuagcaaacaaua

SEQ ID NO: 549480 - RNA, 23 nt, Human
agaauaaaauggcacaaaaagga

SEQ ID NO: 549481 - RNA, 19 nt, Human
agacaaaaaggagguuaga

SEQ ID NO: 549482 - RNA, 19 nt, Human
aggagguuagagagcucaa

SEQ ID NO: 549483 - RNA, 21 nt, Human
auaguucugcuuucagagacu

SEQ ID NO: 549484 - RNA, 22 nt, Human
auucuuuuuaaaaaauaucaga

SEQ ID NO: 549485 - RNA, 20 nt, Human
caaaaaggagguuagagagc

SEQ ID NO: 549486 - RNA, 22 nt, Human
caaaacagcacugauuaaacag

SEQ ID NO: 549487 - RNA, 24 nt, Human
caaagcuauaaacagcuuucuaaa

SEQ ID NO: 549488 - RNA, 23 nt, Human
ccaaagcuauaaacagcuuucua

SEQ ID NO: 549489 - RNA, 19 nt, Human
cccccccacuccuguucgc

SEQ ID NO: 549490 - RNA, 22 nt, Human
ccuggccaccgaugguggaucc

SEQ ID NO: 549491 - RNA, 24 nt, Human
ccuggccaccgaugguggauccua

SEQ ID NO: 549492 - RNA, 21 nt, Human
cuggccaccgaugguggaucc

SEQ ID NO: 549493 - RNA, 29 nt, Human
cuuauaguauguauggaucauuauugcuu

SEQ ID NO: 549494 - RNA, 19 nt, Human
cuuuuuaaaaaauaucaga

SEQ ID NO: 549495 - RNA, 24 nt, Human
cuuuuuuuaauuucccccccacuc

SEQ ID NO: 549496 - RNA, 19 nt, Human
gguaguacuuuguuuauug

SEQ ID NO: 549497 - RNA, 26 nt, Human
gguuagagagcucaagguguuuggau

SEQ ID NO: 549498 - RNA, 19 nt, Human
guguucacaaacaaaagac

SEQ ID NO: 549499 - RNA, 21 nt, Human
uaaagcuuuaaaaacaagcca

SEQ ID NO: 549500 - RNA, 19 nt, Human
uaacacuaaaaagguccaa

SEQ ID NO: 549501 - RNA, 24 nt, Human
uagcaaacaauaucaaaacagcac

SEQ ID NO: 549502 - RNA, 19 nt, Human
ucaaagguacccaguguag

SEQ ID NO: 549503 - RNA, 25 nt, Human
ucaacuauuuauccuaaauuuccua

SEQ ID NO: 549504 - RNA, 18 nt, Human
ucacuguuggaaggaccc

SEQ ID NO: 549505 - RNA, 20 nt, Human
ugacuaccugccaauuagca

SEQ ID NO: 549506 - RNA, 24 nt, Human
ugauuaaacagaauaaaauggcac

SEQ ID NO: 549507 - RNA, 21 nt, Human
ugcaugagcagguuuuauuuu

SEQ ID NO: 549508 - RNA, 22 nt, Human
ugccuucaccaacauucuucag

SEQ ID NO: 549509 - RNA, 19 nt, Human
uggauccuaaauucccuuu

SEQ ID NO: 549510 - RNA, 22 nt, Human
uguuuuguuuuguuuugaacug

SEQ ID NO: 549511 - RNA, 25 nt, Human
uucucgguccccgaucggcugcucc

SEQ ID NO: 549512 - RNA, 21 nt, Human
uugcaucgauuccccuucucg

SEQ ID NO: 549513 - RNA, 22 nt, Human
uuucccccccacuccuguucgc

SEQ ID NO: 549514 - RNA, 27 nt, Human
uuuugaaauuugagauucuuucaaagg

SEQ ID NO: 549515 - RNA, 21 nt, Human
aaagaacaccccacccuuucc

SEQ ID NO: 549516 - RNA, 20 nt, Human
aaccccaccagaggcagaac

SEQ ID NO: 549517 - RNA, 20 nt, Human
acacaaagaacaccccaccc

SEQ ID NO: 549518 - RNA, 24 nt, Human
accucgaugacgcugccgauaccg

SEQ ID NO: 549519 - RNA, 18 nt, Human
accugugaguguacacag

SEQ ID NO: 549520 - RNA, 19 nt, Human
agacuccagcccagcccag

SEQ ID NO: 549521 - RNA, 23 nt, Human
agagaagucuuuggaagccuggg

SEQ ID NO: 549522 - RNA, 18 nt, Human
agcccaguggccaggcag

SEQ ID NO: 549523 - RNA, 20 nt, Human
agccccgagcaccguguucc

SEQ ID NO: 549524 - RNA, 21 nt, Human
aggaagccuuuggggaauggc

SEQ ID NO: 549525 - RNA, 24 nt, Human
aggaggccccaccccccaggcccc

SEQ ID NO: 549526 - RNA, 19 nt, Human
aggcagaacggaggucagc

SEQ ID NO: 549527 - RNA, 25 nt, Human
agucaauaaaaacagaagagagaga

SEQ ID NO: 549528 - RNA, 18 nt, Human
aguggccaggcagcuugg

SEQ ID NO: 549529 - RNA, 22 nt, Human
aguguacacagguguccgcgua

SEQ ID NO: 549530 - RNA, 26 nt, Human
caaagaacaccccacccuuuccccuc

SEQ ID NO: 549531 - RNA, 21 nt, Human
caaccccaccagaggcagaac

SEQ ID NO: 549532 - RNA, 22 nt, Human
cacaaagaacaccccacccuuu

SEQ ID NO: 549533 - RNA, 19 nt, Human
caccccacccuuuccccuc

SEQ ID NO: 549534 - RNA, 26 nt, Human
caccccacccuuuccccucacaccag

SEQ ID NO: 549535 - RNA, 18 nt, Human
caccccccaggcccuagc

SEQ ID NO: 549536 - RNA, 21 nt, Human
cacccuaacccuggggagcau

SEQ ID NO: 549537 - RNA, 21 nt, Human
cacccuuuccccucacaccag

SEQ ID NO: 549538 - RNA, 22 nt, Human
cagaacagggggcucguuccag

SEQ ID NO: 549539 - RNA, 24 nt, Human
cagaggcagaacggaggucagcgg

SEQ ID NO: 549540 - RNA, 19 nt, Human
cagcggggcagcuggccca

SEQ ID NO: 549541 - RNA, 21 nt, Human
cagcggggcagcuggcccagg

SEQ ID NO: 549542 - RNA, 21 nt, Human
ccaggaagccuuuggggaaug

SEQ ID NO: 549543 - RNA, 18 nt, Human
cccaggaagccuuugggg

SEQ ID NO: 549544 - RNA, 21 nt, Human
ccccaccccccaggcccuagc

SEQ ID NO: 549545 - RNA, 19 nt, Human
cccccaggaggagggggcu

SEQ ID NO: 549546 - RNA, 21 nt, Human
ccccccaggcccuagcuucug

SEQ ID NO: 549547 - RNA, 21 nt, Human
ccccgcccuggaggccuuagc

SEQ ID NO: 549548 - RNA, 22 nt, Human
ccgcccuggaggccuuagcugc

SEQ ID NO: 549549 - RNA, 22 nt, Human
ccucacaccagcacccuaaccc

SEQ ID NO: 549550 - RNA, 18 nt, Human
ccugggucgaggggagag

SEQ ID NO: 549551 - RNA, 30 nt, Human
ccuuccugccgccgcuggaggaccucgauu

SEQ ID NO: 549552 - RNA, 22 nt, Human
cgcgcggacccgaccccgccgc

SEQ ID NO: 549553 - RNA, 23 nt, Human
cuagcaccugcccacuccaccug

SEQ ID NO: 549554 - RNA, 19 nt, Human
cuagccgcgcccgccgccu

SEQ ID NO: 549555 - RNA, 21 nt, Human
cucacaccagcacccuaaccc

SEQ ID NO: 549556 - RNA, 21 nt, Human
cucacaccagcacccuaaccc

SEQ ID NO: 549557 - RNA, 21 nt, Human
cuccagcccagcccaguggcc

SEQ ID NO: 549558 - RNA, 25 nt, Human
cuucugccugcccuggcugggccag

SEQ ID NO: 549559 - RNA, 24 nt, Human
gaaaauaaauaaggaggcucaggc

SEQ ID NO: 549560 - RNA, 25 nt, Human
gaaaauaaauaaggaggcucaggca

SEQ ID NO: 549561 - RNA, 19 nt, Human
gagugccacuguaaagaaa

SEQ ID NO: 549562 - RNA, 22 nt, Human
gcccaguggccaggcagcuugg

SEQ ID NO: 549563 - RNA, 22 nt, Human
gcccuggcugggccagccugag

SEQ ID NO: 549564 - RNA, 20 nt, Human
ggaauggcucaggccucagg

SEQ ID NO: 549565 - RNA, 19 nt, Human
ggagaggcacugucaggac

SEQ ID NO: 549566 - RNA, 23 nt, Human
ggccccaggagggagaggcacug

SEQ ID NO: 549567 - RNA, 21 nt, Human
gggccucaggaagccaggccu

SEQ ID NO: 549568 - RNA, 24 nt, Human
uaacaagucaauaaaaacagaaga

SEQ ID NO: 549569 - RNA, 18 nt, Human
uaaggaaauagcuuagag

SEQ ID NO: 549570 - RNA, 18 nt, Human
ucaggcagaaucuguguu

SEQ ID NO: 549571 - RNA, 18 nt, Human
ucaggcagggacugugca

SEQ ID NO: 549572 - RNA, 18 nt, Human
ucugccugcccuggcugg

SEQ ID NO: 549573 - RNA, 21 nt, Human
ucuuuggaagccugggucgag

SEQ ID NO: 549574 - RNA, 19 nt, Human
ugaaggaggccccaccccc

SEQ ID NO: 549575 - RNA, 21 nt, Human
ugcccacuccaccugugagug

SEQ ID NO: 549576 - RNA, 23 nt, Human
ugccugcacgcagcuuacauaca

SEQ ID NO: 549577 - RNA, 23 nt, Human
ugcucuguugcccaugggccuca

SEQ ID NO: 549578 - RNA, 19 nt, Human
uguugcccaugggccucag

SEQ ID NO: 549579 - RNA, 19 nt, Human
uuauauggagaccccgccc

SEQ ID NO: 549580 - RNA, 19 nt, Human
uuccugccgccgcuggagg

SEQ ID NO: 549581 - RNA, 23 nt, Human
uuccugccgccgcuggaggaccu

SEQ ID NO: 549582 - RNA, 21 nt, Human
uuccuuggaggccccaggagg

SEQ ID NO: 549583 - RNA, 20 nt, Human
uuuuacacaaagaacacccc

SEQ ID NO: 549584 - RNA, 24 nt, Human
aaauacuaaaaaauuaaauuggua

SEQ ID NO: 549585 - RNA, 23 nt, Human
aaaucaauauauuucagagcuag

SEQ ID NO: 549586 - RNA, 23 nt, Human
aagacaccucucccucccaucca

SEQ ID NO: 549587 - RNA, 18 nt, Human
aagggaaauacaggguuu

SEQ ID NO: 549588 - RNA, 21 nt, Human
acagcaagaaaauuaaccuaa

SEQ ID NO: 549589 - RNA, 20 nt, Human
acccugagaauacugugaua

SEQ ID NO: 549590 - RNA, 20 nt, Human
acugugcccuuuauacuaaa

SEQ ID NO: 549591 - RNA, 18 nt, Human
agaaaagaaagcaaucau

SEQ ID NO: 549592 - RNA, 21 nt, Human
agaaaagaaagcaaucauuug

SEQ ID NO: 549593 - RNA, 19 nt, Human
agaaaagccuacagcuuaa

SEQ ID NO: 549594 - RNA, 23 nt, Human
agaaucugggcuauuaucaggug

SEQ ID NO: 549595 - RNA, 21 nt, Human
agacacugaaauaccuggcua

SEQ ID NO: 549596 - RNA, 23 nt, Human
agcacagauaucaccagaaaaga

SEQ ID NO: 549597 - RNA, 24 nt, Human
auaaaaaucaauauauuucagagc

SEQ ID NO: 549598 - RNA, 23 nt, Human
caagaaaaaggccuauaguuggu

SEQ ID NO: 549599 - RNA, 20 nt, Human
caccagaaaagaaagcaauc

SEQ ID NO: 549600 - RNA, 18 nt, Human
caccucucccucccaucc

SEQ ID NO: 549601 - RNA, 19 nt, Human
caccucucccucccaucca

SEQ ID NO: 549602 - RNA, 20 nt, Human
caguaaauucacuggcagau

SEQ ID NO: 549603 - RNA, 20 nt, Human
ccaguuacaagccuuacagc

SEQ ID NO: 549604 - RNA, 20 nt, Human
ccauacaauuuggaauauca

SEQ ID NO: 549605 - RNA, 24 nt, Human
ccuggcuaaaagccgccuuuccug

SEQ ID NO: 549606 - RNA, 25 nt, Human
ccuggcuaaaagccgccuuuccugu

SEQ ID NO: 549607 - RNA, 23 nt, Human
cuuucaguaauuaugagaagcac

SEQ ID NO: 549608 - RNA, 21 nt, Human
cuuuuccaaaguuacuuccaa

SEQ ID NO: 549609 - RNA, 24 nt, Human
gaagaugggggacagugaucccga

SEQ ID NO: 549610 - RNA, 22 nt, Human
gaagcacagauaucaccagaaa

SEQ ID NO: 549611 - RNA, 23 nt, Human
gagacagcagaucucucuaagca

SEQ ID NO: 549612 - RNA, 18 nt, Human
gcaaucauuuggaguaca

SEQ ID NO: 549613 - RNA, 23 nt, Human
gcuuaagacaccucucccuccca

SEQ ID NO: 549614 - RNA, 26 nt, Human
gcuuaagacaccucucccucccaucc

SEQ ID NO: 549615 - RNA, 23 nt, Human
guaagacaguucuuucuucuucc

SEQ ID NO: 549616 - RNA, 19 nt, Human
uaagaaagcagaauguuuu

SEQ ID NO: 549617 - RNA, 19 nt, Human
uaagacuagaaaaucaucc

SEQ ID NO: 549618 - RNA, 22 nt, Human
uacaaacugugcccuuuauacu

SEQ ID NO: 549619 - RNA, 19 nt, Human
uacaaagaaaagccuacag

SEQ ID NO: 549620 - RNA, 18 nt, Human
uaccuagcgccucgugcc

SEQ ID NO: 549621 - RNA, 18 nt, Human
ucacaggucccggcgcuc

SEQ ID NO: 549622 - RNA, 20 nt, Human
ucacauuuugacaaagggca

SEQ ID NO: 549623 - RNA, 21 nt, Human
ucagguggaauauuuccccag

SEQ ID NO: 549624 - RNA, 22 nt, Human
uccccaguuacaagccuuacag

SEQ ID NO: 549625 - RNA, 23 nt, Human
uccugugcgcugcuaccagcccu

SEQ ID NO: 549626 - RNA, 18 nt, Human
ucucuaagcaccgaagag

SEQ ID NO: 549627 - RNA, 20 nt, Human
ugaaauaccuggcuaaaagc

SEQ ID NO: 549628 - RNA, 26 nt, Human
uguguuuuuuuguuuuguuuuugauu

SEQ ID NO: 549629 - RNA, 24 nt, Human
uuacuuccaaguaaauuacauuuc

SEQ ID NO: 549630 - RNA, 24 nt, Human
uuccccaguuacaagccuuacagc

SEQ ID NO: 549631 - RNA, 22 nt, Human
uuugauuuuaagaaggaauucu

SEQ ID NO: 549632 - RNA, 20 nt, Human
aaaaaaagacuauuagauaa

SEQ ID NO: 549633 - RNA, 23 nt, Human
aaaaacaggagcuaaagaaagga

SEQ ID NO: 549634 - RNA, 18 nt, Human
aaaaccagccaccggccu

SEQ ID NO: 549635 - RNA, 26 nt, Human
aaacaggagcuaaagaaaggggaccc

SEQ ID NO: 549636 - RNA, 25 nt, Human
aaagguacacaagcauagagccacg

SEQ ID NO: 549637 - RNA, 26 nt, Human
aacugccauuuccacauuauccccau

SEQ ID NO: 549638 - RNA, 21 nt, Human
aagauggggcagggggcuguc

SEQ ID NO: 549639 - RNA, 19 nt, Human
aagcaccccccaccccacg

SEQ ID NO: 549640 - RNA, 21 nt, Human
aagcaccccccaccccacgcc

SEQ ID NO: 549641 - RNA, 22 nt, Human
aagcaccccccaccccacgccc

SEQ ID NO: 549642 - RNA, 24 nt, Human
aagcaccuuucugggcaagcaucc

SEQ ID NO: 549643 - RNA, 24 nt, Human
aagcauccugccucccaucccauu

SEQ ID NO: 549644 - RNA, 19 nt, Human
aagcuggaguaagaucccu

SEQ ID NO: 549645 - RNA, 27 nt, Human
aauucugcaaacucaaauaugaaacug

SEQ ID NO: 549646 - RNA, 24 nt, Human
acacaggauugggggaaugucccc

SEQ ID NO: 549647 - RNA, 22 nt, Human
acauuauccccaucuuuagccu

SEQ ID NO: 549648 - RNA, 25 nt, Human
accacuaaaaugacacgugccaaca

SEQ ID NO: 549649 - RNA, 22 nt, Human
acccagcacuuagcacugugcc

SEQ ID NO: 549650 - RNA, 20 nt, Human
acucagagccugcauguccc

SEQ ID NO: 549651 - RNA, 18 nt, Human
agacagcccuuucaucag

SEQ ID NO: 549652 - RNA, 24 nt, Human
agagaggggcuggcagguggucag

SEQ ID NO: 549653 - RNA, 19 nt, Human
agagggagguaauauuagu

SEQ ID NO: 549654 - RNA, 21 nt, Human
agauucgaaaagcuggaagcc

SEQ ID NO: 549655 - RNA, 18 nt, Human
aggcaacuggaggcuagg

SEQ ID NO: 549656 - RNA, 21 nt, Human
agggucugaggguuggggcug

SEQ ID NO: 549657 - RNA, 20 nt, Human
agguggaucagggccagccc

SEQ ID NO: 549658 - RNA, 23 nt, Human
agguggucagcugcccuuagagc

SEQ ID NO: 549659 - RNA, 20 nt, Human
auaugaggcuccuguccaca

SEQ ID NO: 549660 - RNA, 22 nt, Human
aucaacagucaacacaaguuca

SEQ ID NO: 549661 - RNA, 21 nt, Human
aucucuuccuuuuaaaauuuu

SEQ ID NO: 549662 - RNA, 20 nt, Human
auggccugugccagaagaug

SEQ ID NO: 549663 - RNA, 20 nt, Human
caaaaacaggagcuaaagaa

SEQ ID NO: 549664 - RNA, 22 nt, Human
caaaaaggcugaaagucaauca

SEQ ID NO: 549665 - RNA, 24 nt, Human
caaacucuuggaucccgucccaca

SEQ ID NO: 549666 - RNA, 24 nt, Human
caaagguacacaagcauagagcca

SEQ ID NO: 549667 - RNA, 22 nt, Human
caaguucaaaaccagccaccgg

SEQ ID NO: 549668 - RNA, 23 nt, Human
cacacgagucaaagaaaaauaaa

SEQ ID NO: 549669 - RNA, 23 nt, Human
cacaggugcucuggguggguccc

SEQ ID NO: 549670 - RNA, 24 nt, Human
caccccccaccccacgcccucggg

SEQ ID NO: 549671 - RNA, 28 nt, Human
caccccccaccccacgcccucgggacaa

SEQ ID NO: 549672 - RNA, 25 nt, Human
cacuuagcacugugcccgacacaga

SEQ ID NO: 549673 - RNA, 21 nt, Human
cagcacaggugcucugggugg

SEQ ID NO: 549674 - RNA, 24 nt, Human
cagcagcccagagaccauuuaaga

SEQ ID NO: 549675 - RNA, 24 nt, Human
cagcccuuucaucaggaagcugga

SEQ ID NO: 549676 - RNA, 27 nt, Human
caggaacagcaugagugggugcagucc

SEQ ID NO: 549677 - RNA, 21 nt, Human
caggcaacauccuggagaccc

SEQ ID NO: 549678 - RNA, 21 nt, Human
cagguagguggaucagggcca

SEQ ID NO: 549679 - RNA, 22 nt, Human
cagucaacacaaguucaaaacc

SEQ ID NO: 549680 - RNA, 22 nt, Human
caucccauugcaccuccccacc

SEQ ID NO: 549681 - RNA, 22 nt, Human
ccaggaccucagugcuuuggag

SEQ ID NO: 549682 - RNA, 20 nt, Human
cccaaaaggugucuuaugga

SEQ ID NO: 549683 - RNA, 18 nt, Human
cccacucagagccugcau

SEQ ID NO: 549684 - RNA, 18 nt, Human
cccaugguggaaaaaggg

SEQ ID NO: 549685 - RNA, 19 nt, Human
ccccaccccacgcccucgg

SEQ ID NO: 549686 - RNA, 21 nt, Human
ccccaccccacgcccucggga

SEQ ID NO: 549687 - RNA, 24 nt, Human
ccccccaccccacgcccucgggac

SEQ ID NO: 549688 - RNA, 21 nt, Human
ccccugucuuagccuagggac

SEQ ID NO: 549689 - RNA, 21 nt, Human
cccuuagccccccaccccugu

SEQ ID NO: 549690 - RNA, 18 nt, Human
ccgacacagaaaugaaca

SEQ ID NO: 549691 - RNA, 21 nt, Human
ccgccgccaccgccgcgucug

SEQ ID NO: 549692 - RNA, 27 nt, Human
ccgccgccaccgccgcgucuggcucag

SEQ ID NO: 549693 - RNA, 21 nt, Human
ccgcggagccgccgccaccgc

SEQ ID NO: 549694 - RNA, 21 nt, Human
ccgggccggcgugggugcgcc

SEQ ID NO: 549695 - RNA, 21 nt, Human
ccuaagacccagccgcaggcc

SEQ ID NO: 549696 - RNA, 22 nt, Human
ccuaauaccccuaauccccaaa

SEQ ID NO: 549697 - RNA, 21 nt, Human
ccuaauccccaaacucuugga

SEQ ID NO: 549698 - RNA, 25 nt, Human
ccuccaccacggugcccaucaggag

SEQ ID NO: 549699 - RNA, 23 nt, Human
ccuccagcacaggugcucugggu

SEQ ID NO: 549700 - RNA, 26 nt, Human
ccucccaucccauugcaccuccccac

SEQ ID NO: 549701 - RNA, 20 nt, Human
ccuccccacccuucccccgg

SEQ ID NO: 549702 - RNA, 22 nt, Human
ccuccgggccggcgugggugcg

SEQ ID NO: 549703 - RNA, 21 nt, Human
ccuggggugucccuagggcug

SEQ ID NO: 549704 - RNA, 23 nt, Human
cgaaaagcuggaagccaugacca

SEQ ID NO: 549705 - RNA, 25 nt, Human
cgagaccagccaccggcuuaccccu

SEQ ID NO: 549706 - RNA, 23 nt, Human
cguccaaggccucagaggagccc

SEQ ID NO: 549707 - RNA, 20 nt, Human
cucucaggaucuagccaaaa

SEQ ID NO: 549708 - RNA, 22 nt, Human
cugaaaagcccuaauaccccua

SEQ ID NO: 549709 - RNA, 20 nt, Human
cugcuccuccgggccggcgu

SEQ ID NO: 549710 - RNA, 24 nt, Human
cuuucaggauguugguauauucgu

SEQ ID NO: 549711 - RNA, 19 nt, Human
gaaaagcuggaagccauga

SEQ ID NO: 549712 - RNA, 22 nt, Human
gaaaugaacacucugcuccucc

SEQ ID NO: 549713 - RNA, 23 nt, Human
gaaccagagaggggcuggcaggu

SEQ ID NO: 549714 - RNA, 20 nt, Human
gaagauggggcagggggcug

SEQ ID NO: 549715 - RNA, 24 nt, Human
gaagcaccccccaccccacgcccu

SEQ ID NO: 549716 - RNA, 24 nt, Human
gacaguaggaguuuggaagaggga

SEQ ID NO: 549717 - RNA, 23 nt, Human
gagggagcacgauggcacaggug

SEQ ID NO: 549718 - RNA, 18 nt, Human
gcaaagguacacaagcau

SEQ ID NO: 549719 - RNA, 20 nt, Human
gcaccccccaccccacgccu

SEQ ID NO: 549720 - RNA, 22 nt, Human
gcaugucccagcagcccagaga

SEQ ID NO: 549721 - RNA, 19 nt, Human
gccagcccuggucccuuag

SEQ ID NO: 549722 - RNA, 24 nt, Human
gccugagcguggauuaagacagag

SEQ ID NO: 549723 - RNA, 18 nt, Human
gccuggggugucccuagg

SEQ ID NO: 549724 - RNA, 21 nt, Human
gcuggucaggaacucuagaca

SEQ ID NO: 549725 - RNA, 22 nt, Human
ggacugagaaacagcuggguga

SEQ ID NO: 549726 - RNA, 24 nt, Human
ggauuuaaaccacuaaaaugacac

SEQ ID NO: 549727 - RNA, 25 nt, Human
ggcaacagggacaugcacucgggaa

SEQ ID NO: 549728 - RNA, 22 nt, Human
ggcagaagguggcuggucagga

SEQ ID NO: 549729 - RNA, 20 nt, Human
ggcagggggcugucuucuug

SEQ ID NO: 549730 - RNA, 18 nt, Human
ggcugggggguggggagg

SEQ ID NO: 549731 - RNA, 18 nt, Human
gggacuggagagggcggc

SEQ ID NO: 549732 - RNA, 24 nt, Human
gggcaacagggacaugcacucggg

SEQ ID NO: 549733 - RNA, 22 nt, Human
gggcaagcauccugccucccau

SEQ ID NO: 549734 - RNA, 19 nt, Human
gggggguggggaggacaaa

SEQ ID NO: 549735 - RNA, 24 nt, Human
gggucccgguggcccaguggcugu

SEQ ID NO: 549736 - RNA, 24 nt, Human
gguggggaggacaaagacaaggcc

SEQ ID NO: 549737 - RNA, 18 nt, Human
ggugggucccaggcccag

SEQ ID NO: 549738 - RNA, 22 nt, Human
uaaaauuuucuuagaguuaaaa

SEQ ID NO: 549739 - RNA, 23 nt, Human
uaaagacagcccuuucaucagga

SEQ ID NO: 549740 - RNA, 29 nt, Human
uaaagcccuucaaacagagaaaccuuccc

SEQ ID NO: 549741 - RNA, 23 nt, Human
uaaauaaguaucaacagucaaca

SEQ ID NO: 549742 - RNA, 26 nt, Human
uaagacagaggagaucacagacacac

SEQ ID NO: 549743 - RNA, 22 nt, Human
uacaaaagaaucacugacccca

SEQ ID NO: 549744 - RNA, 21 nt, Human
uacccaaauggcagcgggagc

SEQ ID NO: 549745 - RNA, 22 nt, Human
uagccaaaaaaagacuauuaga

SEQ ID NO: 549746 - RNA, 24 nt, Human
uauuagauaauucugcaaacucaa

SEQ ID NO: 549747 - RNA, 21 nt, Human
ucaacacaaguucaaaaccag

SEQ ID NO: 549748 - RNA, 23 nt, Human
ucacugaccccaaguagucgagu

SEQ ID NO: 549749 - RNA, 21 nt, Human
ucccacagacgagagucccug

SEQ ID NO: 549750 - RNA, 21 nt, Human
ucccccggcagacgagaccag

SEQ ID NO: 549751 - RNA, 21 nt, Human
ucccuagggcugggggguggg

SEQ ID NO: 549752 - RNA, 19 nt, Human
ucccuuagccccccacccc

SEQ ID NO: 549753 - RNA, 23 nt, Human
uccgggccggcgugggugcgccg

SEQ ID NO: 549754 - RNA, 18 nt, Human
uccuccuuuggagccuca

SEQ ID NO: 549755 - RNA, 27 nt, Human
uccugggccaggcaacauccuggagac

SEQ ID NO: 549756 - RNA, 19 nt, Human
ucuugggucccgguggccc

SEQ ID NO: 549757 - RNA, 22 nt, Human
ugacuccacguccucguccaag

SEQ ID NO: 549758 - RNA, 23 nt, Human
ugaggacaguaggaguuuggaag

SEQ ID NO: 549759 - RNA, 20 nt, Human
ugaggcuccuguccacaagu

SEQ ID NO: 549760 - RNA, 24 nt, Human
ugcaaagguacacaagcauagagg

SEQ ID NO: 549761 - RNA, 22 nt, Human
ugccagaagauggggcaggggg

SEQ ID NO: 549762 - RNA, 19 nt, Human
ugcccgacacagaaaugaa

SEQ ID NO: 549763 - RNA, 23 nt, Human
ugccucccaucccauugcaccuc

SEQ ID NO: 549764 - RNA, 18 nt, Human
ugccuggggugucccuag

SEQ ID NO: 549765 - RNA, 23 nt, Human
ugccuggggugucccuagggcug

SEQ ID NO: 549766 - RNA, 18 nt, Human
ugcucuggguggguccca

SEQ ID NO: 549767 - RNA, 21 nt, Human
uggaaaaagggccagaaacau

SEQ ID NO: 549768 - RNA, 18 nt, Human
uggaaccagagaggggcu

SEQ ID NO: 549769 - RNA, 19 nt, Human
uggaaccagagaggggcug

SEQ ID NO: 549770 - RNA, 20 nt, Human
uggaaggcgagggucugagg

SEQ ID NO: 549771 - RNA, 18 nt, Human
uggaggagguggugagag

SEQ ID NO: 549772 - RNA, 21 nt, Human
uggaggagguggugagagcag

SEQ ID NO: 549773 - RNA, 22 nt, Human
uggcagaagguggcuggucagg

SEQ ID NO: 549774 - RNA, 24 nt, Human
uggcuggucaggaacucuagacac

SEQ ID NO: 549775 - RNA, 20 nt, Human
uggggaggacaaagacaagg

SEQ ID NO: 549776 - RNA, 23 nt, Human
ugggggguggggaggacaaagac

SEQ ID NO: 549777 - RNA, 24 nt, Human
ugguacaaaugauaaauuauauuu

SEQ ID NO: 549778 - RNA, 19 nt, Human
uggugagagcaggccaggc

SEQ ID NO: 549779 - RNA, 23 nt, Human
uguaaagacagcccuuucaucag

SEQ ID NO: 549780 - RNA, 24 nt, Human
ugugccagaagauggggcaggggg

SEQ ID NO: 549781 - RNA, 22 nt, Human
uguuuguuaaaaaucccuccca

SEQ ID NO: 549782 - RNA, 19 nt, Human
uuaaaaauaauaucuggag

SEQ ID NO: 549783 - RNA, 23 nt, Human
uuaaaauuuucuuagaguuaaaa

SEQ ID NO: 549784 - RNA, 20 nt, Human
uuaagacagaggagaucaca

SEQ ID NO: 549785 - RNA, 25 nt, Human
uuagugcauguuuguuaaaaauccc

SEQ ID NO: 549786 - RNA, 22 nt, Human
uuauaaaaauauuagccaaaaa

SEQ ID NO: 549787 - RNA, 23 nt, Human
uucaccaaaaacaggagcuaaag

SEQ ID NO: 549788 - RNA, 19 nt, Human
uuccuccuuuggagccuca

SEQ ID NO: 549789 - RNA, 20 nt, Human
uuggaaggcgagggucugag

SEQ ID NO: 549790 - RNA, 20 nt, Human
uuggaaggcgagggucugag

SEQ ID NO: 549791 - RNA, 24 nt, Human
uuggugagucacauucauacauua

SEQ ID NO: 549792 - RNA, 21 nt, Human
uuguugcuguuguuuuuuuuu

SEQ ID NO: 549793 - RNA, 26 nt, Human
uuuaaaccacuaaaaugacacgugcc

SEQ ID NO: 549794 - RNA, 24 nt, Human
uuuaaagcccuucaaacagagaaa

SEQ ID NO: 549795 - RNA, 21 nt, Human
uuucaucaggaagcuggagcu

SEQ ID NO: 549796 - RNA, 25 nt, Human
uuucugggcaagcauccugccuccc

SEQ ID NO: 549797 - RNA, 19 nt, Human
uuuggaggagguggugaga

SEQ ID NO: 549798 - RNA, 21 nt, Human
aaaaaguccacuuggugagag

SEQ ID NO: 549799 - RNA, 24 nt, Human
aaaugaccgaauugagugacagcc

SEQ ID NO: 549800 - RNA, 22 nt, Human
aaguccacuuggugagagcuga

SEQ ID NO: 549801 - RNA, 20 nt, Human
acagucucgaaggaugggcu

SEQ ID NO: 549802 - RNA, 20 nt, Human
agcaccggcgccccgcccag

SEQ ID NO: 549803 - RNA, 18 nt, Human
agcagagcagcugcaucc

SEQ ID NO: 549804 - RNA, 21 nt, Human
agccuggcagcaucuggaagc

SEQ ID NO: 549805 - RNA, 20 nt, Human
agcugcaguuuccuaaacag

SEQ ID NO: 549806 - RNA, 23 nt, Human
agcuuccagagccgccgcgggau

SEQ ID NO: 549807 - RNA, 19 nt, Human
agguggagggcugagggcc

SEQ ID NO: 549808 - RNA, 22 nt, Human
caccauggacccucgucccaga

SEQ ID NO: 549809 - RNA, 21 nt, Human
caccggcgccccgcccagccc

SEQ ID NO: 549810 - RNA, 22 nt, Human
caccggcgccccgcccagcccc

SEQ ID NO: 549811 - RNA, 18 nt, Human
cacuguggcgaggucaca

SEQ ID NO: 549812 - RNA, 20 nt, Human
cacuguggcgaggucacagu

SEQ ID NO: 549813 - RNA, 18 nt, Human
cagccggugauccacgcu

SEQ ID NO: 549814 - RNA, 21 nt, Human
ccaccauggacccucguccca

SEQ ID NO: 549815 - RNA, 22 nt, Human
ccagagacccaccugcucccag

SEQ ID NO: 549816 - RNA, 19 nt, Human
ccagagccgccgcgggaua

SEQ ID NO: 549817 - RNA, 25 nt, Human
cccaaccccagugcccaugugugau

SEQ ID NO: 549818 - RNA, 24 nt, Human
cccagagacccaccugcucccagg

SEQ ID NO: 549819 - RNA, 22 nt, Human
ccccacagauuauguagccggg

SEQ ID NO: 549820 - RNA, 22 nt, Human
ccccgcccagccccggguccgg

SEQ ID NO: 549821 - RNA, 25 nt, Human
ccccggguccggaggcggggccgac

SEQ ID NO: 549822 - RNA, 20 nt, Human
cccucggccccagccccagc

SEQ ID NO: 549823 - RNA, 22 nt, Human
cccucggccccagccccagccc

SEQ ID NO: 549824 - RNA, 18 nt, Human
ccucagaggggcagcggc

SEQ ID NO: 549825 - RNA, 28 nt, Human
ccucggccccagccccagcccgaguagc

SEQ ID NO: 549826 - RNA, 23 nt, Human
ccucgucccagagacccaccugc

SEQ ID NO: 549827 - RNA, 23 nt, Human
ccucugcggugacccuccgaccu

SEQ ID NO: 549828 - RNA, 25 nt, Human
cgaguagccucugcggugacccucc

SEQ ID NO: 549829 - RNA, 20 nt, Human
cgcaaaaaguccacuuggug

SEQ ID NO: 549830 - RNA, 24 nt, Human
cucccucggccccagccccagccc

SEQ ID NO: 549831 - RNA, 23 nt, Human
cugagggccacuguggcgagguc

SEQ ID NO: 549832 - RNA, 22 nt, Human
cugcaguuuccuaaacagccgg

SEQ ID NO: 549833 - RNA, 24 nt, Human
cuggaauggguagcagcucuuccc

SEQ ID NO: 549834 - RNA, 20 nt, Human
gagcgucuccagagccaucc

SEQ ID NO: 549835 - RNA, 20 nt, Human
gcagcggcagggucccugga

SEQ ID NO: 549836 - RNA, 21 nt, Human
gccccagccccagcccgagua

SEQ ID NO: 549837 - RNA, 25 nt, Human
gccccagccccagcccgaguagccu

SEQ ID NO: 549838 - RNA, 20 nt, Human
gccccggguccggaggcggg

SEQ ID NO: 549839 - RNA, 21 nt, Human
gccgguaugggacggggcggg

SEQ ID NO: 549840 - RNA, 20 nt, Human
gcguucaguuucuagcuccc

SEQ ID NO: 549841 - RNA, 20 nt, Human
ggcagcggcagggucccugg

SEQ ID NO: 549842 - RNA, 19 nt, Human
ggccgugguccgcguccag

SEQ ID NO: 549843 - RNA, 21 nt, Human
ggcguucaguuucuagcuccc

SEQ ID NO: 549844 - RNA, 25 nt, Human
gggcucccucggccccagccccagc

SEQ ID NO: 549845 - RNA, 25 nt, Human
ggggauggaggugaggguugagaag

SEQ ID NO: 549846 - RNA, 21 nt, Human
gggggauggaggugaggguug

SEQ ID NO: 549847 - RNA, 25 nt, Human
gggucccuggaauggguagcagcuc

SEQ ID NO: 549848 - RNA, 19 nt, Human
ggugaggguugagaagagc

SEQ ID NO: 549849 - RNA, 19 nt, Human
guggucgagacccggccgc

SEQ ID NO: 549850 - RNA, 18 nt, Human
gugugauaaaugaaugaa

SEQ ID NO: 549851 - RNA, 21 nt, Human
uaaaugaaugaaaugaccgaa

SEQ ID NO: 549852 - RNA, 19 nt, Human
uagccucugcggugacccu

SEQ ID NO: 549853 - RNA, 20 nt, Human
uagcucccgggccguggucc

SEQ ID NO: 549854 - RNA, 22 nt, Human
ucccgcgugcguuugccuccuu

SEQ ID NO: 549855 - RNA, 21 nt, Human
uccgcguccagcuuccagagc

SEQ ID NO: 549856 - RNA, 20 nt, Human
uccuaaacagccggugaucc

SEQ ID NO: 549857 - RNA, 22 nt, Human
uccuaaacagccggugauccac

SEQ ID NO: 549858 - RNA, 19 nt, Human
ucuccagagccauccacca

SEQ ID NO: 549859 - RNA, 20 nt, Human
ugacccuccgaccugugcag

SEQ ID NO: 549860 - RNA, 23 nt, Human
ugagaagagcuguaaaggaagcg

SEQ ID NO: 549861 - RNA, 18 nt, Human
ugagagcugagaacgugg

SEQ ID NO: 549862 - RNA, 21 nt, Human
ugagugacagccuggcagcau

SEQ ID NO: 549863 - RNA, 19 nt, Human
ugcagcugcaguuuccuaa

SEQ ID NO: 549864 - RNA, 18 nt, Human
uggaauggguagcagcuc

SEQ ID NO: 549865 - RNA, 18 nt, Human
uggaauggguagcagcuc

SEQ ID NO: 549866 - RNA, 21 nt, Human
ugugauaaaugaaugaaauga

SEQ ID NO: 549867 - RNA, 22 nt, Human
uguggucgagacccggccgcca

SEQ ID NO: 549868 - RNA, 19 nt, Human
ugugugauaaaugaaugaa

SEQ ID NO: 549869 - RNA, 19 nt, Human
uuuuuuuuuuugaacaagg

SEQ ID NO: 549870 - RNA, 23 nt, Human
uuuuuuuuuuugaacaaggagcc

SEQ ID NO: 549871 - RNA, 23 nt, Human
uuuuuuuuuuuuuugaacaagga

SEQ ID NO: 549872 - RNA, 18 nt, Human
uuuuuuuuuuuuuuuuug

SEQ ID NO: 549873 - RNA, 23 nt, Human
aaaaggagacaaaaaucccaggg

SEQ ID NO: 549874 - RNA, 19 nt, Human
aaagaagcugggagguuug

SEQ ID NO: 549875 - RNA, 18 nt, Human
aaaggagacaaaaauccc

SEQ ID NO: 549876 - RNA, 22 nt, Human
aaggagacaaaaaucccaggga

SEQ ID NO: 549877 - RNA, 23 nt, Human
agggagugggguggcccggaggc

SEQ ID NO: 549878 - RNA, 24 nt, Human
agguaccaagaggcuaaagaagcu

SEQ ID NO: 549879 - RNA, 22 nt, Human
gcgagggacagagagugugagg

SEQ ID NO: 549880 - RNA, 23 nt, Human
gggaagcugcaagcggaagggag

SEQ ID NO: 549881 - RNA, 18 nt, Human
gguggcccggaggcggag

SEQ ID NO: 549882 - RNA, 21 nt, Human
ucccagggaagcugcaagcgg

SEQ ID NO: 549883 - RNA, 23 nt, Human
ugagaaacuguuuuucuuacaga

SEQ ID NO: 549884 - RNA, 23 nt, Human
uggcaguguagaauaaauaacgc

SEQ ID NO: 549885 - RNA, 22 nt, Human
uuaaaaggagacaaaaauccca

SEQ ID NO: 549886 - RNA, 22 nt, Human
aaaccccacugccuuccagaac

SEQ ID NO: 549887 - RNA, 21 nt, Human
accuugaaggaugaguuugac

SEQ ID NO: 549888 - RNA, 19 nt, Human
aggaggaggacaggcugcc

SEQ ID NO: 549889 - RNA, 20 nt, Human
aggaggagggcaggccagga

SEQ ID NO: 549890 - RNA, 22 nt, Human
aguccguucucccacggggccu

SEQ ID NO: 549891 - RNA, 20 nt, Human
aucaccuugaaggaugaguu

SEQ ID NO: 549892 - RNA, 23 nt, Human
auccuagaagauagggguguucu

SEQ ID NO: 549893 - RNA, 24 nt, Human
augggggaagaccagggccggagc

SEQ ID NO: 549894 - RNA, 22 nt, Human
caaaccccacugccuuccagaa

SEQ ID NO: 549895 - RNA, 21 nt, Human
caccgggaugggggaagacca

SEQ ID NO: 549896 - RNA, 25 nt, Human
ccaccuucauguucuaucuugaccc

SEQ ID NO: 549897 - RNA, 18 nt, Human
ccacugcacccucucggg

SEQ ID NO: 549898 - RNA, 21 nt, Human
ccacugcacccucucgggggu

SEQ ID NO: 549899 - RNA, 22 nt, Human
cccuggguccaaucucaaaccc

SEQ ID NO: 549900 - RNA, 23 nt, Human
cccuggguccaaucucaaacccc

SEQ ID NO: 549901 - RNA, 19 nt, Human
ccguucucccacggggccu

SEQ ID NO: 549902 - RNA, 18 nt, Human
cgcccuccccacucccag

SEQ ID NO: 549903 - RNA, 20 nt, Human
cugccuggaggaggagggcc

SEQ ID NO: 549904 - RNA, 19 nt, Human
gaaucaccuugaaggauga

SEQ ID NO: 549905 - RNA, 20 nt, Human
gaggacacgaggggcucugc

SEQ ID NO: 549906 - RNA, 23 nt, Human
gaggggcucugccaaggccagga

SEQ ID NO: 549907 - RNA, 20 nt, Human
ggaggacacgaggggcucug

SEQ ID NO: 549908 - RNA, 18 nt, Human
gucuccacgcccucccca

SEQ ID NO: 549909 - RNA, 20 nt, Human
uagacugucuccacgcccuc

SEQ ID NO: 549910 - RNA, 22 nt, Human
ucaaaccccacugccuuccaga

SEQ ID NO: 549911 - RNA, 20 nt, Human
ucaccuugaaggaugaguuu

SEQ ID NO: 549912 - RNA, 22 nt, Human
uccaaucucaaaccccacugcc

SEQ ID NO: 549913 - RNA, 23 nt, Human
uccaccgggaugggggaagacca

SEQ ID NO: 549914 - RNA, 19 nt, Human
ucccagguccccugcccuu

SEQ ID NO: 549915 - RNA, 23 nt, Human
ucucccacggggccucgucacuc

SEQ ID NO: 549916 - RNA, 18 nt, Human
ugacccuggguccaaucu

SEQ ID NO: 549917 - RNA, 23 nt, Human
ugccaaggccaggagaggcugcc

SEQ ID NO: 549918 - RNA, 27 nt, Human
ugccaaggccaggagaggcugcuccgc

SEQ ID NO: 549919 - RNA, 20 nt, Human
ugccuggaggaggaggacag

SEQ ID NO: 549920 - RNA, 21 nt, Human
ugcucagggcuccacugcacc

SEQ ID NO: 549921 - RNA, 21 nt, Human
ugcugagggucaggacaggcu

SEQ ID NO: 549922 - RNA, 24 nt, Human
ugcugagggucaggacaggcugcc

SEQ ID NO: 549923 - RNA, 25 nt, Human
uggaggaggaggacaggcugccugg

SEQ ID NO: 549924 - RNA, 18 nt, Human
uuuuuuuuuuuuuuuuug

SEQ ID NO: 549925 - RNA, 20 nt, Human
uuuuuuuuuuuuuuuuugcu

SEQ ID NO: 549926 - RNA, 23 nt, Human
uuuuuuuuuuuuuuuuuugcuaa

SEQ ID NO: 549927 - RNA, 18 nt, Human
agaaggagagggacugaa

SEQ ID NO: 549928 - RNA, 19 nt, Human
aggcuccaacacagccaga

SEQ ID NO: 549929 - RNA, 19 nt, Human
caacacagccagaagggac

SEQ ID NO: 549930 - RNA, 21 nt, Human
caacacagccagaagggacac

SEQ ID NO: 549931 - RNA, 18 nt, Human
cagaucugccaucuugca

SEQ ID NO: 549932 - RNA, 18 nt, Human
ccucugggccuguccauu

SEQ ID NO: 549933 - RNA, 21 nt, Human
ccugguccccccaggaggcug

SEQ ID NO: 549934 - RNA, 21 nt, Human
gagagggacugaacagauucu

SEQ ID NO: 549935 - RNA, 23 nt, Human
ggaauucucggggcucuaauggg

SEQ ID NO: 549936 - RNA, 23 nt, Human
ggagagggacugaacagauucuu

SEQ ID NO: 549937 - RNA, 22 nt, Human
gggacugaacagauucuugguc

SEQ ID NO: 549938 - RNA, 18 nt, Human
gggaggcuccaacacagc

SEQ ID NO: 549939 - RNA, 25 nt, Human
gggaggcuccaacacagccagaagg

SEQ ID NO: 549940 - RNA, 26 nt, Human
ggggaggcuccaacacagccagaagg

SEQ ID NO: 549941 - RNA, 20 nt, Human
ggugccugguccccccagga

SEQ ID NO: 549942 - RNA, 24 nt, Human
ggugguccggugcuggugguggaa

SEQ ID NO: 549943 - RNA, 23 nt, Human
uaaaauaaauaggugguuacugg

SEQ ID NO: 549944 - RNA, 19 nt, Human
uaauggguaucagaucugc

SEQ ID NO: 549945 - RNA, 21 nt, Human
uaggugguuacuggggaggcu

SEQ ID NO: 549946 - RNA, 25 nt, Human
uaggugguuacuggggaggcucccc

SEQ ID NO: 549947 - RNA, 18 nt, Human
uaguggccacaggcagag

SEQ ID NO: 549948 - RNA, 23 nt, Human
ucccugggugccagugaaggccg

SEQ ID NO: 549949 - RNA, 19 nt, Human
ucucugcuaguggccacag

SEQ ID NO: 549950 - RNA, 18 nt, Human
ugagaaggagagggacug

SEQ ID NO: 549951 - RNA, 18 nt, Human
ugcaucagcggggccugg

SEQ ID NO: 549952 - RNA, 19 nt, Human
ugcuaguggccacaggcag

SEQ ID NO: 549953 - RNA, 21 nt, Human
ugcugaggacggcucccuggg

SEQ ID NO: 549954 - RNA, 19 nt, Human
ugcuucagccucugggccu

SEQ ID NO: 549955 - RNA, 19 nt, Human
ugugggguuugcugcaaac

SEQ ID NO: 549956 - RNA, 22 nt, Human
uguuugcuucagccucugggcc

SEQ ID NO: 549957 - RNA, 19 nt, Human
uuuugcugugugagcuggg

SEQ ID NO: 549958 - RNA, 23 nt, Human
uuuuuuuuuacaagcuugaagau

SEQ ID NO: 549959 - RNA, 23 nt, Human
uuuuuuuuuuuuuuuuuuacaag

SEQ ID NO: 549960 - RNA, 23 nt, Human
aaagagacacauagaaaccuggg

SEQ ID NO: 549961 - RNA, 24 nt, Human
aaauaagagauaagaaaaauggaa

SEQ ID NO: 549962 - RNA, 23 nt, Human
aaccggggaagccagaagaccag

SEQ ID NO: 549963 - RNA, 19 nt, Human
aaccugggcagagggagcu

SEQ ID NO: 549964 - RNA, 22 nt, Human
aagaaaaauggaaucuaauggc

SEQ ID NO: 549965 - RNA, 21 nt, Human
aagaaagaggcccagaaacaa

SEQ ID NO: 549966 - RNA, 22 nt, Human
aaggauagcggaagcccaaggc

SEQ ID NO: 549967 - RNA, 23 nt, Human
aaggcugcggcaggugcuggcag

SEQ ID NO: 549968 - RNA, 20 nt, Human
aaguaacucucuggaguccc

SEQ ID NO: 549969 - RNA, 20 nt, Human
acagaaagagacacauagaa

SEQ ID NO: 549970 - RNA, 19 nt, Human
accugcagcgcacaccucc

SEQ ID NO: 549971 - RNA, 21 nt, Human
accugcagcgcacaccuccuu

SEQ ID NO: 549972 - RNA, 27 nt, Human
agaaaaauggaaucuaauggcaaagaa

SEQ ID NO: 549973 - RNA, 20 nt, Human
agaaaccugggcagagggaa

SEQ ID NO: 549974 - RNA, 18 nt, Human
agaaagagacacauagaa

SEQ ID NO: 549975 - RNA, 18 nt, Human
agaaagccaggcaccuga

SEQ ID NO: 549976 - RNA, 22 nt, Human
agacacaaugagaaaaacacag

SEQ ID NO: 549977 - RNA, 24 nt, Human
agacacaaugagaaaaacacaggc

SEQ ID NO: 549978 - RNA, 23 nt, Human
agacagggaggcaggaggccaag

SEQ ID NO: 549979 - RNA, 24 nt, Human
agacagggaggcaggaggccaagg

SEQ ID NO: 549980 - RNA, 21 nt, Human
agagaccuggcgcugagaaau

SEQ ID NO: 549981 - RNA, 23 nt, Human
agcagccugguuccagagccagc

SEQ ID NO: 549982 - RNA, 26 nt, Human
aggaagaaagaggcccagaaacaaaa

SEQ ID NO: 549983 - RNA, 24 nt, Human
aggaagaaccggggaagccagaag

SEQ ID NO: 549984 - RNA, 19 nt, Human
agggacauuaccuuuuuca

SEQ ID NO: 549985 - RNA, 24 nt, Human
agggagcuaggcagagacacaaug

SEQ ID NO: 549986 - RNA, 18 nt, Human
auggggcagccggaugga

SEQ ID NO: 549987 - RNA, 19 nt, Human
caaaacagccccagccuaa

SEQ ID NO: 549988 - RNA, 24 nt, Human
cacaccuccuugagacacaguuug

SEQ ID NO: 549989 - RNA, 24 nt, Human
caccucaggccagaaagccaggca

SEQ ID NO: 549990 - RNA, 21 nt, Human
caccugaagacagauguagcu

SEQ ID NO: 549991 - RNA, 22 nt, Human
cagagccagcucugaucacccc

SEQ ID NO: 549992 - RNA, 19 nt, Human
cagagggagcuaggcagag

SEQ ID NO: 549993 - RNA, 22 nt, Human
caggaagaaccggggaagccag

SEQ ID NO: 549994 - RNA, 22 nt, Human
caggagagauaaggaaccuaac

SEQ ID NO: 549995 - RNA, 23 nt, Human
caggagagauaaggaaccuaaca

SEQ ID NO: 549996 - RNA, 19 nt, Human
cauuucacaugcacucaca

SEQ ID NO: 549997 - RNA, 22 nt, Human
ccaaggaagaaagaggcccaga

SEQ ID NO: 549998 - RNA, 20 nt, Human
ccagaaagccaggcaccuga

SEQ ID NO: 549999 - RNA, 20 nt, Human
cccagaaacaaaaagagacc

SEQ ID NO: 550000 - RNA, 19 nt, Human
cccggcugcagcagcaagg

SEQ ID NO: 550001 - RNA, 21 nt, Human
cucacaacacugaucucccag

SEQ ID NO: 550002 - RNA, 22 nt, Human
cucacaacacugaucucccagg

SEQ ID NO: 550003 - RNA, 22 nt, Human
cucaggccagaaagccaggcac

SEQ ID NO: 550004 - RNA, 21 nt, Human
cuccaagaagccacagaggga

SEQ ID NO: 550005 - RNA, 24 nt, Human
cugcaugcaaagacugggcuccuu

SEQ ID NO: 550006 - RNA, 20 nt, Human
cuggagcagccugguuccag

SEQ ID NO: 550007 - RNA, 22 nt, Human
cugggucccugcugugugccag

SEQ ID NO: 550008 - RNA, 23 nt, Human
cugggucccugcugugugccagg

SEQ ID NO: 550009 - RNA, 22 nt, Human
cugugugccaggugcucgcuca

SEQ ID NO: 550010 - RNA, 25 nt, Human
cuuccaccucaggccagaaagccag

SEQ ID NO: 550011 - RNA, 22 nt, Human
gaaaaacacaggcagcagcaga

SEQ ID NO: 550012 - RNA, 21 nt, Human
gacaguucugacagaaagaga

SEQ ID NO: 550013 - RNA, 23 nt, Human
gagcagccugguuccagagccag

SEQ ID NO: 550014 - RNA, 18 nt, Human
gagccagcucugaucacc

SEQ ID NO: 550015 - RNA, 22 nt, Human
gcagcagauacaagaacauggg

SEQ ID NO: 550016 - RNA, 19 nt, Human
gcagcagcaaggggcacag

SEQ ID NO: 550017 - RNA, 19 nt, Human
ggaagccagaagaccagac

SEQ ID NO: 550018 - RNA, 22 nt, Human
ggagauagggaugacggagaga

SEQ ID NO: 550019 - RNA, 22 nt, Human
ggagauuuucaaagccccgcca

SEQ ID NO: 550020 - RNA, 23 nt, Human
ggagccaggcccccuuccgcccu

SEQ ID NO: 550021 - RNA, 25 nt, Human
ggauagcggaagcccaaggcucagg

SEQ ID NO: 550022 - RNA, 19 nt, Human
gggaagccagaagaccaga

SEQ ID NO: 550023 - RNA, 24 nt, Human
gggcagagggagcuaggcagagac

SEQ ID NO: 550024 - RNA, 18 nt, Human
gucccugcugugugccag

SEQ ID NO: 550025 - RNA, 24 nt, Human
uaagcccaggggagauagggauga

SEQ ID NO: 550026 - RNA, 26 nt, Human
uagaagacaguucugacagaaagaga

SEQ ID NO: 550027 - RNA, 21 nt, Human
uagcggaagcccaaggcucag

SEQ ID NO: 550028 - RNA, 24 nt, Human
uagcuaguuaaaaaguaacucucu

SEQ ID NO: 550029 - RNA, 21 nt, Human
uaugcggcuccaagaagccac

SEQ ID NO: 550030 - RNA, 22 nt, Human
ucacccaucuaugcggcuccaa

SEQ ID NO: 550031 - RNA, 19 nt, Human
uccaagaagccacagaggg

SEQ ID NO: 550032 - RNA, 22 nt, Human
uccaccucaggccagaaagcca

SEQ ID NO: 550033 - RNA, 19 nt, Human
uccagggcggcaggaagaa

SEQ ID NO: 550034 - RNA, 21 nt, Human
uccagggcggcaggaagaaga

SEQ ID NO: 550035 - RNA, 19 nt, Human
ucuaugcggcuccaagaag

SEQ ID NO: 550036 - RNA, 24 nt, Human
ugaagagaugauguaacaaaugca

SEQ ID NO: 550037 - RNA, 21 nt, Human
ugagaagaaauagaagacagu

SEQ ID NO: 550038 - RNA, 19 nt, Human
ugcccggcugcagcagcaa

SEQ ID NO: 550039 - RNA, 22 nt, Human
uggagccaggcccccuuccgcc

SEQ ID NO: 550040 - RNA, 25 nt, Human
uggcaaagaauauaaaauguggguu

SEQ ID NO: 550041 - RNA, 22 nt, Human
ugggcagagggagcuaggcagg

SEQ ID NO: 550042 - RNA, 24 nt, Human
ugggucccugcugugugccaggug

SEQ ID NO: 550043 - RNA, 18 nt, Human
ugugccaggugcucgcuc

SEQ ID NO: 550044 - RNA, 22 nt, Human
uucaacacugcaugcaaagacu

SEQ ID NO: 550045 - RNA, 20 nt, Human
aaaaagcaucucaugaggcu

SEQ ID NO: 550046 - RNA, 20 nt, Human
agaaagacaagccuguagca

SEQ ID NO: 550047 - RNA, 22 nt, Human
agccagucacuccugacugcac

SEQ ID NO: 550048 - RNA, 24 nt, Human
agcuccuccaaacaugcauaaaug

SEQ ID NO: 550049 - RNA, 21 nt, Human
aggagaagccagucacuccug

SEQ ID NO: 550050 - RNA, 21 nt, Human
aggcuuuucgaggucaguuga

SEQ ID NO: 550051 - RNA, 27 nt, Human
agguaaaaacagugaggcugaacaaaa

SEQ ID NO: 550052 - RNA, 22 nt, Human
cacagcccgcgggucccgggcc

SEQ ID NO: 550053 - RNA, 23 nt, Human
caggaaucagcuccuccaaacau

SEQ ID NO: 550054 - RNA, 22 nt, Human
cauuaagaaaaagcaucucaug

SEQ ID NO: 550055 - RNA, 21 nt, Human
ccugaaagcaucaagugacuc

SEQ ID NO: 550056 - RNA, 24 nt, Human
cuaccaacaucacucuaauuauac

SEQ ID NO: 550057 - RNA, 24 nt, Human
uaaaaacagugaggcugaacaaaa

SEQ ID NO: 550058 - RNA, 18 nt, Human
uaaaaagacccccaaagc

SEQ ID NO: 550059 - RNA, 21 nt, Human
uaaaaucuaaaaagaccccca

SEQ ID NO: 550060 - RNA, 23 nt, Human
uaaaaucuaaaaagacccccaaa

SEQ ID NO: 550061 - RNA, 24 nt, Human
uaaaugaggacaaggagaagccag

SEQ ID NO: 550062 - RNA, 25 nt, Human
uaagguaaaaacagugaggcugaac

SEQ ID NO: 550063 - RNA, 21 nt, Human
uagaaagacaagccuguagca

SEQ ID NO: 550064 - RNA, 22 nt, Human
uagaaagacaagccuguagcac

SEQ ID NO: 550065 - RNA, 26 nt, Human
uagcucugauuaaccugaaagcauca

SEQ ID NO: 550066 - RNA, 20 nt, Human
ucuaaaaagacccccaaagc

SEQ ID NO: 550067 - RNA, 18 nt, Human
ugaggacaaggagaagcc

SEQ ID NO: 550068 - RNA, 22 nt, Human
ugaggacaaggagaagccaguc

SEQ ID NO: 550069 - RNA, 19 nt, Human
uuaagguaaaaacagugag

SEQ ID NO: 550070 - RNA, 24 nt, Human
uucacagcccgcgggucccgggcc

SEQ ID NO: 550071 - RNA, 22 nt, Human
uuguguaaaagaauauaagacc

SEQ ID NO: 550072 - RNA, 26 nt, Human
uuuuuuuuuuuuacagaaggaguuca

SEQ ID NO: 550073 - RNA, 19 nt, Human
agaguuucucagagaggag

SEQ ID NO: 550074 - RNA, 20 nt, Human
aggagcacagccuaaggaca

SEQ ID NO: 550075 - RNA, 24 nt, Human
aguggcaggagcacagccuaagga

SEQ ID NO: 550076 - RNA, 19 nt, Human
gaggaggggcugggucccu

SEQ ID NO: 550077 - RNA, 22 nt, Human
gcacagccuaaggacaugaagg

SEQ ID NO: 550078 - RNA, 18 nt, Human
gcacuggucuuuauugag

SEQ ID NO: 550079 - RNA, 21 nt, Human
ggucagaguuucucagagagg

SEQ ID NO: 550080 - RNA, 24 nt, Human
ucucagagaggaggggcugggucc

SEQ ID NO: 550081 - RNA, 24 nt, Human
acuggggagagggaugggguggga

SEQ ID NO: 550082 - RNA, 21 nt, Human
acugugcagacucaacagggc

SEQ ID NO: 550083 - RNA, 23 nt, Human
agcaacagcgacucagggagaaa

SEQ ID NO: 550084 - RNA, 19 nt, Human
aggcagaggaaccaccugg

SEQ ID NO: 550085 - RNA, 21 nt, Human
aggcagggugacauugcuccc

SEQ ID NO: 550086 - RNA, 18 nt, Human
caggaagagaaaucuccc

SEQ ID NO: 550087 - RNA, 22 nt, Human
ccaccuggaaacugagcuaagg

SEQ ID NO: 550088 - RNA, 21 nt, Human
cgacucagggagaaacucugg

SEQ ID NO: 550089 - RNA, 18 nt, Human
gaaccagaaugcuuauau

SEQ ID NO: 550090 - RNA, 20 nt, Human
gacucagggagaaacucugg

SEQ ID NO: 550091 - RNA, 24 nt, Human
gacucagggagaaacucugggccc

SEQ ID NO: 550092 - RNA, 19 nt, Human
gacuggggagagggauggg

SEQ ID NO: 550093 - RNA, 22 nt, Human
gacugugcagacucaacagggc

SEQ ID NO: 550094 - RNA, 21 nt, Human
gagaaacucugggcccauagc

SEQ ID NO: 550095 - RNA, 20 nt, Human
gaggcgcuaccucacucagg

SEQ ID NO: 550096 - RNA, 19 nt, Human
gaggguccccagccaagga

SEQ ID NO: 550097 - RNA, 23 nt, Human
gccagcagcuugagcuggaaugc

SEQ ID NO: 550098 - RNA, 22 nt, Human
ggaaccaccuggaaacugagcu

SEQ ID NO: 550099 - RNA, 22 nt, Human
ggaggguccccagccaaggaca

SEQ ID NO: 550100 - RNA, 22 nt, Human
ggcagguuccuucuuccaacag

SEQ ID NO: 550101 - RNA, 20 nt, Human
uagcuguggugccaggcaga

SEQ ID NO: 550102 - RNA, 19 nt, Human
ucaagaauuggggagcaga

SEQ ID NO: 550103 - RNA, 23 nt, Human
ucaccagugccuggagggucccc

SEQ ID NO: 550104 - RNA, 20 nt, Human
uccaagacuggggagaggga

SEQ ID NO: 550105 - RNA, 23 nt, Human
ucccaccaaugggccaucuucuu

SEQ ID NO: 550106 - RNA, 28 nt, Human
uccccagccaaggacagaaccggggucc

SEQ ID NO: 550107 - RNA, 21 nt, Human
ucucucaccagugccuggagg

SEQ ID NO: 550108 - RNA, 25 nt, Human
ucuucuuagcuacaccuuuguagcu

SEQ ID NO: 550109 - RNA, 18 nt, Human
ugaaagaagugagggcag

SEQ ID NO: 550110 - RNA, 22 nt, Human
ugcccugggagggucaguagag

SEQ ID NO: 550111 - RNA, 22 nt, Human
ugcccugggagggucaguagag

SEQ ID NO: 550112 - RNA, 21 nt, Human
uggggugggagagaucaagaa

SEQ ID NO: 550113 - RNA, 18 nt, Human
ugugcagacucaacaggg

SEQ ID NO: 550114 - RNA, 19 nt, Human
uugcucccaccaaugggcc

SEQ ID NO: 550115 - RNA, 20 nt, Human
uugcucccaccaaugggcca

SEQ ID NO: 550116 - RNA, 26 nt, Human
aaaaacugccgacacauuucagacaa

SEQ ID NO: 550117 - RNA, 20 nt, Human
aaaaauguacgcuuuuauug

SEQ ID NO: 550118 - RNA, 21 nt, Human
aaaaugucuaaaauaggagaa

SEQ ID NO: 550119 - RNA, 24 nt, Human
aaacaaucagggcaaaaaaaauuc

SEQ ID NO: 550120 - RNA, 21 nt, Human
aaacagauuuguucccaaaac

SEQ ID NO: 550121 - RNA, 23 nt, Human
aaagaaaaaaaacugccgacaca

SEQ ID NO: 550122 - RNA, 19 nt, Human
aaagaacacuccgaaaaua

SEQ ID NO: 550123 - RNA, 19 nt, Human
aaagugcugggauuacagg

SEQ ID NO: 550124 - RNA, 24 nt, Human
aaagugcugggauuacaggcaaga

SEQ ID NO: 550125 - RNA, 24 nt, Human
aaauaaaugaaucaagaaaccaag

SEQ ID NO: 550126 - RNA, 24 nt, Human
aaaugaccauuuuguuuuuuucca

SEQ ID NO: 550127 - RNA, 21 nt, Human
aagaaaaaaaacugccgacac

SEQ ID NO: 550128 - RNA, 20 nt, Human
aagcaggauuuguucuaagu

SEQ ID NO: 550129 - RNA, 23 nt, Human
aagcaggauuuguucuaagucua

SEQ ID NO: 550130 - RNA, 18 nt, Human
aagugcugggauuacagg

SEQ ID NO: 550131 - RNA, 19 nt, Human
aagugcugggauuacaggc

SEQ ID NO: 550132 - RNA, 26 nt, Human
aagugcugggauuacaggcaagagcc

SEQ ID NO: 550133 - RNA, 26 nt, Human
aauuauacacucauauauauguauau

SEQ ID NO: 550134 - RNA, 19 nt, Human
acagauauauagauauaug

SEQ ID NO: 550135 - RNA, 19 nt, Human
acauacacacacacauaua

SEQ ID NO: 550136 - RNA, 19 nt, Human
acuaaacuaggucagagug

SEQ ID NO: 550137 - RNA, 22 nt, Human
aggaagugggaguacaaagucu

SEQ ID NO: 550138 - RNA, 18 nt, Human
aggcaggcugggcugggg

SEQ ID NO: 550139 - RNA, 20 nt, Human
aggcaggcugggcuggggcu

SEQ ID NO: 550140 - RNA, 22 nt, Human
aguaagucuuuauuauuauuau

SEQ ID NO: 550141 - RNA, 18 nt, Human
aguaggugggauuacagg

SEQ ID NO: 550142 - RNA, 20 nt, Human
agugauccaccugccucggc

SEQ ID NO: 550143 - RNA, 23 nt, Human
agugauccaccugccucggccuc

SEQ ID NO: 550144 - RNA, 24 nt, Human
agugcaaaguauuugaaaaagucc

SEQ ID NO: 550145 - RNA, 20 nt, Human
agugcaguggcacgaucuug

SEQ ID NO: 550146 - RNA, 23 nt, Human
agugcaguggcacgaucuuggcu

SEQ ID NO: 550147 - RNA, 24 nt, Human
agugcaguggcacgaucuuggcuc

SEQ ID NO: 550148 - RNA, 18 nt, Human
agugcugggauuacaggc

SEQ ID NO: 550149 - RNA, 21 nt, Human
auagagaacacagcaucugga

SEQ ID NO: 550150 - RNA, 24 nt, Human
auauacauacacacacacauauag

SEQ ID NO: 550151 - RNA, 24 nt, Human
auauuuguacuuuuaguagagaug

SEQ ID NO: 550152 - RNA, 24 nt, Human
aucuauaaacacucugauuccucu

SEQ ID NO: 550153 - RNA, 21 nt, Human
auggcagaaaggaagcauugg

SEQ ID NO: 550154 - RNA, 18 nt, Human
augggguuucaccauguu

SEQ ID NO: 550155 - RNA, 22 nt, Human
augggguuucaccauguuggcc

SEQ ID NO: 550156 - RNA, 24 nt, Human
augggguuucaccauguuggccag

SEQ ID NO: 550157 - RNA, 26 nt, Human
auuuuuuuucaaaagcaggauuuguu

SEQ ID NO: 550158 - RNA, 23 nt, Human
caaaagugcaaaguauuugaaaa

SEQ ID NO: 550159 - RNA, 27 nt, Human
caaagugcugggauuacaggcaagagc

SEQ ID NO: 550160 - RNA, 22 nt, Human
caaaguugaguuauaucuuacu

SEQ ID NO: 550161 - RNA, 20 nt, Human
caaccucugcuucccggauu

SEQ ID NO: 550162 - RNA, 22 nt, Human
caagcaauucuccugccucagc

SEQ ID NO: 550163 - RNA, 22 nt, Human
caauuuguucucuuucacaaaa

SEQ ID NO: 550164 - RNA, 19 nt, Human
cacaaaaugucuaaaauag

SEQ ID NO: 550165 - RNA, 25 nt, Human
cacacacauauaucucuauauaccc

SEQ ID NO: 550166 - RNA, 21 nt, Human
caccauguuggccagacuggu

SEQ ID NO: 550167 - RNA, 24 nt, Human
caccauguuggccagacuggucuc

SEQ ID NO: 550168 - RNA, 18 nt, Human
cacccaggcuacagauuu

SEQ ID NO: 550169 - RNA, 23 nt, Human
caccugccucggccucccaaagu

SEQ ID NO: 550170 - RNA, 19 nt, Human
caguggcacgaucuuggcu

SEQ ID NO: 550171 - RNA, 24 nt, Human
cauguuggccagacuggucucaaa

SEQ ID NO: 550172 - RNA, 22 nt, Human
cauuggggugggaugaggcagg

SEQ ID NO: 550173 - RNA, 19 nt, Human
ccaaagugcugggauuaca

SEQ ID NO: 550174 - RNA, 23 nt, Human
ccaaagugcugggauuacaggca

SEQ ID NO: 550175 - RNA, 24 nt, Human
ccaacacauuauuuaacgagcagg

SEQ ID NO: 550176 - RNA, 24 nt, Human
cccaaagugcugggauuacaggca

SEQ ID NO: 550177 - RNA, 21 nt, Human
cccacauacagauauauagau

SEQ ID NO: 550178 - RNA, 23 nt, Human
cccgaguaggugggauuacaggu

SEQ ID NO: 550179 - RNA, 23 nt, Human
cccggauucaagcaauucuccug

SEQ ID NO: 550180 - RNA, 24 nt, Human
ccugccucagccucccgaguaggu

SEQ ID NO: 550181 - RNA, 24 nt, Human
ccugccucggccucccaaagugcu

SEQ ID NO: 550182 - RNA, 24 nt, Human
cucacuacaaccucugcuucccgg

SEQ ID NO: 550183 - RNA, 24 nt, Human
cuucccggauucaagcaauucucc

SEQ ID NO: 550184 - RNA, 24 nt, Human
cuuuuaguagagaugggguuucac

SEQ ID NO: 550185 - RNA, 22 nt, Human
gacacauuaaaagaaaaaaaac

SEQ ID NO: 550186 - RNA, 24 nt, Human
gaccuugagugauccaccugccuc

SEQ ID NO: 550187 - RNA, 24 nt, Human
gaccuugagugauccaccugccuc

SEQ ID NO: 550188 - RNA, 18 nt, Human
gagaugggguuucaccau

SEQ ID NO: 550189 - RNA, 24 nt, Human
gagaugggguuucaccauguuggc

SEQ ID NO: 550190 - RNA, 18 nt, Human
gauuacaggcaagagcca

SEQ ID NO: 550191 - RNA, 24 nt, Human
gauuacaggcaagagccacuaugc

SEQ ID NO: 550192 - RNA, 18 nt, Human
gauuacaggugcccgcca

SEQ ID NO: 550193 - RNA, 21 nt, Human
gcauucaacucauauaucuau

SEQ ID NO: 550194 - RNA, 30 nt, Human
gcauuggggugggaugaggcaggcugggac

SEQ ID NO: 550195 - RNA, 24 nt, Human
ggauuacaggcaagagccacuaug

SEQ ID NO: 550196 - RNA, 19 nt, Human
gggaugaggcaggcugggc

SEQ ID NO: 550197 - RNA, 22 nt, Human
gggguuucaccauguuggccag

SEQ ID NO: 550198 - RNA, 18 nt, Human
ggguuucaccauguuggc

SEQ ID NO: 550199 - RNA, 21 nt, Human
ggguuucaccauguuggccag

SEQ ID NO: 550200 - RNA, 23 nt, Human
guagagaugggguuucaccaugu

SEQ ID NO: 550201 - RNA, 21 nt, Human
gucaauauccauaaaugaagg

SEQ ID NO: 550202 - RNA, 22 nt, Human
gucaauauccauaaaugaaggg

SEQ ID NO: 550203 - RNA, 24 nt, Human
gugauccaccugccucggccuccc

SEQ ID NO: 550204 - RNA, 21 nt, Human
uaaaaaaaaaaaaaccucaua

SEQ ID NO: 550205 - RNA, 24 nt, Human
uaaaagaaaaaaaacugccgacac

SEQ ID NO: 550206 - RNA, 23 nt, Human
uaaauacacaaggcauguauaua

SEQ ID NO: 550207 - RNA, 22 nt, Human
uaaaugaaucaagaaaccaaga

SEQ ID NO: 550208 - RNA, 24 nt, Human
uaaaugguaaacgugauaucauga

SEQ ID NO: 550209 - RNA, 26 nt, Human
uaagacagaggccugcucguuaaugu

SEQ ID NO: 550210 - RNA, 24 nt, Human
uaagacugugagaaaugauguauu

SEQ ID NO: 550211 - RNA, 21 nt, Human
uaaggugaaacugccaguaug

SEQ ID NO: 550212 - RNA, 19 nt, Human
uaauauugguuaaguaagu

SEQ ID NO: 550213 - RNA, 23 nt, Human
uaauauuuguacuuuuaguagag

SEQ ID NO: 550214 - RNA, 24 nt, Human
uaauauuuguacuuuuaguagaga

SEQ ID NO: 550215 - RNA, 19 nt, Human
uacacucauauauauguau

SEQ ID NO: 550216 - RNA, 22 nt, Human
uacaggcaagagccacuaugcc

SEQ ID NO: 550217 - RNA, 26 nt, Human
uacauacacacacacauauaucucua

SEQ ID NO: 550218 - RNA, 26 nt, Human
uaccaaaaauaaaaauugcauucaac

SEQ ID NO: 550219 - RNA, 22 nt, Human
uagagaugggguuucaccaugu

SEQ ID NO: 550220 - RNA, 23 nt, Human
uagagugcaguggcacgaucuug

SEQ ID NO: 550221 - RNA, 24 nt, Human
uagagugcaguggcacgaucuugg

SEQ ID NO: 550222 - RNA, 24 nt, Human
uaguagagaugggguuucaccaug

SEQ ID NO: 550223 - RNA, 26 nt, Human
uaguagagaugggguuucaccauguu

SEQ ID NO: 550224 - RNA, 21 nt, Human
uauacacucauauauauguau

SEQ ID NO: 550225 - RNA, 22 nt, Human
uauacauacacacacacauaua

SEQ ID NO: 550226 - RNA, 29 nt, Human
uauacauacacacacacauauaucucuau

SEQ ID NO: 550227 - RNA, 27 nt, Human
uauaguaucauggacuaaacuagguca

SEQ ID NO: 550228 - RNA, 24 nt, Human
uauauacccacauacagauauaua

SEQ ID NO: 550229 - RNA, 20 nt, Human
uauauguauauguacauaua

SEQ ID NO: 550230 - RNA, 22 nt, Human
uauauguauauguacauauaca

SEQ ID NO: 550231 - RNA, 25 nt, Human
uaucacccuaaacaaucagggcaaa

SEQ ID NO: 550232 - RNA, 21 nt, Human
uaucauggacuaaacuagguc

SEQ ID NO: 550233 - RNA, 24 nt, Human
uaucucuauauacccacauacaga

SEQ ID NO: 550234 - RNA, 18 nt, Human
uaugacagaccauuuuuc

SEQ ID NO: 550235 - RNA, 27 nt, Human
uauguacauauacauacacacacacag

SEQ ID NO: 550236 - RNA, 24 nt, Human
uauguacauauacauacacacagu

SEQ ID NO: 550237 - RNA, 21 nt, Human
ucaaaaauuaccggggaaauu

SEQ ID NO: 550238 - RNA, 24 nt, Human
ucaaauaaaugaaucaagaaacca

SEQ ID NO: 550239 - RNA, 19 nt, Human
ucacaaaaugucuaaaaua

SEQ ID NO: 550240 - RNA, 18 nt, Human
ucacuacaaccucugcuu

SEQ ID NO: 550241 - RNA, 19 nt, Human
ucacuacaaccucugcuuc

SEQ ID NO: 550242 - RNA, 23 nt, Human
ucacuacaaccucugcuucccgg

SEQ ID NO: 550243 - RNA, 24 nt, Human
ucacuacaaccucugcuucccgga

SEQ ID NO: 550244 - RNA, 28 nt, Human
ucacuacaaccucugcuucgggcccucc

SEQ ID NO: 550245 - RNA, 18 nt, Human
ucaguaggagaacuugag

SEQ ID NO: 550246 - RNA, 22 nt, Human
ucagugagucguaaccuugacu

SEQ ID NO: 550247 - RNA, 24 nt, Human
ucauggacuaaacuaggucagagu

SEQ ID NO: 550248 - RNA, 24 nt, Human
ucccaaagugcugggauuacaggc

SEQ ID NO: 550249 - RNA, 23 nt, Human
ucccgaguaggugggauuacagg

SEQ ID NO: 550250 - RNA, 24 nt, Human
ucccgaguaggugggauuacaggu

SEQ ID NO: 550251 - RNA, 21 nt, Human
ucccggauucaagcaauucuc

SEQ ID NO: 550252 - RNA, 24 nt, Human
ucccggauucaagcaauucuccug

SEQ ID NO: 550253 - RNA, 21 nt, Human
ucccuuuuaagacagaggccu

SEQ ID NO: 550254 - RNA, 18 nt, Human
ucggccucccaaagugcu

SEQ ID NO: 550255 - RNA, 24 nt, Human
ucuauaaacacucugauuccucac

SEQ ID NO: 550256 - RNA, 19 nt, Human
ucuauaaauaucaacuuaa

SEQ ID NO: 550257 - RNA, 19 nt, Human
ucuccugccucagccuccc

SEQ ID NO: 550258 - RNA, 23 nt, Human
ucugacaggaggccacuggacaa

SEQ ID NO: 550259 - RNA, 22 nt, Human
ucugacaggaggccacuggacc

SEQ ID NO: 550260 - RNA, 19 nt, Human
ucugcaaugugaucaugcu

SEQ ID NO: 550261 - RNA, 24 nt, Human
ugaccuugagugauccaccugccu

SEQ ID NO: 550262 - RNA, 27 nt, Human
ugaccuugagugauccaccugccucgg

SEQ ID NO: 550263 - RNA, 19 nt, Human
ugagaugauggcagaaagg

SEQ ID NO: 550264 - RNA, 19 nt, Human
ugagucguaaccuugacuc

SEQ ID NO: 550265 - RNA, 22 nt, Human
ugauaugaaugcauuucuuugu

SEQ ID NO: 550266 - RNA, 20 nt, Human
ugauuuaaaaaaugcagaaa

SEQ ID NO: 550267 - RNA, 21 nt, Human
ugcccucugcaucuacuuuau

SEQ ID NO: 550268 - RNA, 24 nt, Human
ugccucagccucccgaguaggugg

SEQ ID NO: 550269 - RNA, 21 nt, Human
ugccucggccucccaaagugc

SEQ ID NO: 550270 - RNA, 24 nt, Human
ugccucggccucccaaagugcugg

SEQ ID NO: 550271 - RNA, 21 nt, Human
ugcugggauuacaggcaagag

SEQ ID NO: 550272 - RNA, 18 nt, Human
uggaaagcuggccuauaa

SEQ ID NO: 550273 - RNA, 22 nt, Human
uggaggaagugggaguacaaag

SEQ ID NO: 550274 - RNA, 24 nt, Human
uggcacgaucuuggcucacuacaa

SEQ ID NO: 550275 - RNA, 21 nt, Human
uggcagaaaggaagcauuggg

SEQ ID NO: 550276 - RNA, 24 nt, Human
uggcagaaaggaagcauuggggug

SEQ ID NO: 550277 - RNA, 21 nt, Human
uggccagacuggucucaaacu

SEQ ID NO: 550278 - RNA, 22 nt, Human
ugggauuacaggcaagagccac

SEQ ID NO: 550279 - RNA, 22 nt, Human
ugggauuacaggcaagagccac

SEQ ID NO: 550280 - RNA, 23 nt, Human
ugggauuacaggcaagagccacu

SEQ ID NO: 550281 - RNA, 23 nt, Human
ugggauuacaggcaagagccacu

SEQ ID NO: 550282 - RNA, 24 nt, Human
ugggauuacaggcaagagccacua

SEQ ID NO: 550283 - RNA, 18 nt, Human
ugggauuacaggugcccg

SEQ ID NO: 550284 - RNA, 21 nt, Human
ugggauuacaggugcccgcca

SEQ ID NO: 550285 - RNA, 22 nt, Human
ugggauuacaggugcccgccac

SEQ ID NO: 550286 - RNA, 20 nt, Human
uggggugggaugaggcaggc

SEQ ID NO: 550287 - RNA, 23 nt, Human
ugggguuucaccauguuggccag

SEQ ID NO: 550288 - RNA, 19 nt, Human
uguauauauccacaguauc

SEQ ID NO: 550289 - RNA, 18 nt, Human
uguauauguacauauaca

SEQ ID NO: 550290 - RNA, 18 nt, Human
ugugagcaaguucauuac

SEQ ID NO: 550291 - RNA, 24 nt, Human
uguuagucaagaguccucaguagg

SEQ ID NO: 550292 - RNA, 21 nt, Human
uuaaaaaaaaaaaaaccucau

SEQ ID NO: 550293 - RNA, 26 nt, Human
uuacugcccucugcaucuacuuuaug

SEQ ID NO: 550294 - RNA, 18 nt, Human
uuaguagagaugggguuu

SEQ ID NO: 550295 - RNA, 22 nt, Human
uuaguagagaugggguuucacc

SEQ ID NO: 550296 - RNA, 24 nt, Human
uuaguagagaugggguuucaccau

SEQ ID NO: 550297 - RNA, 21 nt, Human
uucaagcaauucuccugccuc

SEQ ID NO: 550298 - RNA, 24 nt, Human
uucaagcaauucuccugccucagc

SEQ ID NO: 550299 - RNA, 18 nt, Human
uuccauggcaaauaauag

SEQ ID NO: 550300 - RNA, 21 nt, Human
uucccaaaacauagcacaaaa

SEQ ID NO: 550301 - RNA, 21 nt, Human
uuucaccauguuggccagacu

SEQ ID NO: 550302 - RNA, 24 nt, Human
uuuccauggcaaauaauagcugua

SEQ ID NO: 550303 - RNA, 22 nt, Human
uuuuaaaaaaaaaaaaaccuca

SEQ ID NO: 550304 - RNA, 23 nt, Human
aaaaguugauuugauaccuggug

SEQ ID NO: 550305 - RNA, 20 nt, Human
aaaauauucagacucuccuc

SEQ ID NO: 550306 - RNA, 22 nt, Human
aaaauuaauaauaucuuguaaa

SEQ ID NO: 550307 - RNA, 18 nt, Human
aaaauuagcugggcaugg

SEQ ID NO: 550308 - RNA, 27 nt, Human
aaacauuaaaauauacaccagaaauac

SEQ ID NO: 550309 - RNA, 18 nt, Human
aaagaucuaacuauuuua

SEQ ID NO: 550310 - RNA, 26 nt, Human
aaauaggaaacagaaauaagggaccc

SEQ ID NO: 550311 - RNA, 21 nt, Human
aacacaggaccuauauuugcu

SEQ ID NO: 550312 - RNA, 20 nt, Human
aacagagcgagacuccaucu

SEQ ID NO: 550313 - RNA, 18 nt, Human
aacauggugaaaccccgc

SEQ ID NO: 550314 - RNA, 20 nt, Human
aacauggugaaaccccgccu

SEQ ID NO: 550315 - RNA, 21 nt, Human
aacauggugaaaccccgccuc

SEQ ID NO: 550316 - RNA, 26 nt, Human
aacauuaaaauauacaccagaaauac

SEQ ID NO: 550317 - RNA, 24 nt, Human
aaccugggcaacagagcgagacuc

SEQ ID NO: 550318 - RNA, 22 nt, Human
aaguaaauaguuguuauaaugu

SEQ ID NO: 550319 - RNA, 24 nt, Human
aagugggucagauacagguuuuua

SEQ ID NO: 550320 - RNA, 24 nt, Human
acagagcgagacuccaucucaaaa

SEQ ID NO: 550321 - RNA, 24 nt, Human
acaggacacaucagcugagagcaa

SEQ ID NO: 550322 - RNA, 21 nt, Human
acagguuuuuaaaaacugcau

SEQ ID NO: 550323 - RNA, 20 nt, Human
acaugcuuaagaucaacuga

SEQ ID NO: 550324 - RNA, 24 nt, Human
accccgccucuacuaaaaauacaa

SEQ ID NO: 550325 - RNA, 23 nt, Human
accugggcaacagagcgagacuc

SEQ ID NO: 550326 - RNA, 24 nt, Human
acgugcgguggcucacgccuguaa

SEQ ID NO: 550327 - RNA, 18 nt, Human
acugcacuccaaccuggg

SEQ ID NO: 550328 - RNA, 24 nt, Human
acugcacuccaaccugggcaacag

SEQ ID NO: 550329 - RNA, 23 nt, Human
acuguauuuccaucuuaagacaa

SEQ ID NO: 550330 - RNA, 19 nt, Human
agagugcagaagaaaucuu

SEQ ID NO: 550331 - RNA, 23 nt, Human
agauuuuuuugaaacagccaaga

SEQ ID NO: 550332 - RNA, 20 nt, Human
agcaguuugggaggcugugg

SEQ ID NO: 550333 - RNA, 23 nt, Human
agcugggcaugguggcaugcgcc

SEQ ID NO: 550334 - RNA, 21 nt, Human
agcuuguuucaaauguguagu

SEQ ID NO: 550335 - RNA, 19 nt, Human
aggaaacagaaauaacugu

SEQ ID NO: 550336 - RNA, 19 nt, Human
aggaacauaaaaaacauac

SEQ ID NO: 550337 - RNA, 24 nt, Human
aggcaggaggaucucuugaacccg

SEQ ID NO: 550338 - RNA, 24 nt, Human
aggcugaggcaggaggaucucuug

SEQ ID NO: 550339 - RNA, 20 nt, Human
aggugagguugcagugagcc

SEQ ID NO: 550340 - RNA, 23 nt, Human
aggugagguugcagugagccgag

SEQ ID NO: 550341 - RNA, 18 nt, Human
auacaaaaaugacuuguu

SEQ ID NO: 550342 - RNA, 22 nt, Human
auaccaguauaccaauucuccc

SEQ ID NO: 550343 - RNA, 20 nt, Human
augcauuuaugcauuugugg

SEQ ID NO: 550344 - RNA, 24 nt, Human
caaaauggcucuucaaacuuaaaa

SEQ ID NO: 550345 - RNA, 24 nt, Human
caacauggugaaaccccgccucua

SEQ ID NO: 550346 - RNA, 21 nt, Human
caaguccuggcaccuggugcu

SEQ ID NO: 550347 - RNA, 24 nt, Human
cacgccuguaaucccagcaguuug

SEQ ID NO: 550348 - RNA, 23 nt, Human
cacuccaaccugggcaacagagc

SEQ ID NO: 550349 - RNA, 23 nt, Human
cacugcacuccaaccugggcaac

SEQ ID NO: 550350 - RNA, 24 nt, Human
cacugcacuccaaccugggcaaca

SEQ ID NO: 550351 - RNA, 21 nt, Human
cagcaguuugggaggcugugg

SEQ ID NO: 550352 - RNA, 24 nt, Human
cagcugcucaggaggcugaggcag

SEQ ID NO: 550353 - RNA, 19 nt, Human
cauaaauaaaaaucugacu

SEQ ID NO: 550354 - RNA, 18 nt, Human
cauuuuacauaggcagaa

SEQ ID NO: 550355 - RNA, 20 nt, Human
cauuuuacauaggcagaauc

SEQ ID NO: 550356 - RNA, 23 nt, Human
ccacugcacuccaaccugggcaa

SEQ ID NO: 550357 - RNA, 24 nt, Human
ccacugcacuccaaccugggcaac

SEQ ID NO: 550358 - RNA, 23 nt, Human
ccaggcacacuguuaucccugcc

SEQ ID NO: 550359 - RNA, 19 nt, Human
ccagggagacucuacucaa

SEQ ID NO: 550360 - RNA, 24 nt, Human
ccaucucaaaaagaaaaaaaaaaa

SEQ ID NO: 550361 - RNA, 19 nt, Human
cccaagaaaaauaaauaaa

SEQ ID NO: 550362 - RNA, 18 nt, Human
ccccucauauaacagaau

SEQ ID NO: 550363 - RNA, 22 nt, Human
ccuggccaacauggugaaaccc

SEQ ID NO: 550364 - RNA, 23 nt, Human
ccuggccaacauggugaaacccc

SEQ ID NO: 550365 - RNA, 24 nt, Human
ccuggccaacauggugaaaccccg

SEQ ID NO: 550366 - RNA, 22 nt, Human
ccuguaaucccagcaguuuggg

SEQ ID NO: 550367 - RNA, 19 nt, Human
ccuguagucccagcugcuc

SEQ ID NO: 550368 - RNA, 21 nt, Human
ccuguagucccagcugcucag

SEQ ID NO: 550369 - RNA, 22 nt, Human
ccuguagucccagcugcucagg

SEQ ID NO: 550370 - RNA, 19 nt, Human
ccuugaauaaaagaugaaa

SEQ ID NO: 550371 - RNA, 19 nt, Human
cgagaucgugccacugcac

SEQ ID NO: 550372 - RNA, 24 nt, Human
cgccuguagucccagcugcucagg

SEQ ID NO: 550373 - RNA, 19 nt, Human
cgggaggugagguugcagu

SEQ ID NO: 550374 - RNA, 23 nt, Human
cgggaggugagguugcagugagc

SEQ ID NO: 550375 - RNA, 21 nt, Human
cucacgccuguaaucccagca

SEQ ID NO: 550376 - RNA, 21 nt, Human
cucacgccuguaaucccagca

SEQ ID NO: 550377 - RNA, 21 nt, Human
cucagagugcagaagaaaucc

SEQ ID NO: 550378 - RNA, 21 nt, Human
cucccauaaaauccaaaagug

SEQ ID NO: 550379 - RNA, 20 nt, Human
cucgcggcaguggcuggaga

SEQ ID NO: 550380 - RNA, 20 nt, Human
cucuacuaaaaauacaaaaa

SEQ ID NO: 550381 - RNA, 23 nt, Human
cugaaaauauucagacucuccuc

SEQ ID NO: 550382 - RNA, 18 nt, Human
cugaggcaggaggaucuc

SEQ ID NO: 550383 - RNA, 23 nt, Human
cuucucccaaauucuaauugcau

SEQ ID NO: 550384 - RNA, 19 nt, Human
gaaaccccgccucuacuaa

SEQ ID NO: 550385 - RNA, 23 nt, Human
gaccuaacacuugacccaacaua

SEQ ID NO: 550386 - RNA, 18 nt, Human
gagcgggcgcuggggcuu

SEQ ID NO: 550387 - RNA, 22 nt, Human
gagguugcagugagccgagauc

SEQ ID NO: 550388 - RNA, 23 nt, Human
gagguugcagugagccgagaucg

SEQ ID NO: 550389 - RNA, 24 nt, Human
gccaacauggugaaaccccgccuc

SEQ ID NO: 550390 - RNA, 19 nt, Human
gccacugcacuccaaccug

SEQ ID NO: 550391 - RNA, 24 nt, Human
gccacugcacuccaaccugggcaa

SEQ ID NO: 550392 - RNA, 20 nt, Human
gccgagaucgugccacugca

SEQ ID NO: 550393 - RNA, 21 nt, Human
gcugauuuauugaaaagucaa

SEQ ID NO: 550394 - RNA, 20 nt, Human
gcuuuuuuaagcauucuuaa

SEQ ID NO: 550395 - RNA, 24 nt, Human
ggagagugcacgggcagggcggga

SEQ ID NO: 550396 - RNA, 22 nt, Human
ggcaugguggcaugcgccugua

SEQ ID NO: 550397 - RNA, 19 nt, Human
gguggcagcaguggcuccu

SEQ ID NO: 550398 - RNA, 24 nt, Human
gguggcaugcgccuguagucccag

SEQ ID NO: 550399 - RNA, 23 nt, Human
gguggcucacgccuguaauccca

SEQ ID NO: 550400 - RNA, 24 nt, Human
gguggcucacgccuguaaucccag

SEQ ID NO: 550401 - RNA, 20 nt, Human
guauaugaauauauauacaa

SEQ ID NO: 550402 - RNA, 23 nt, Human
guggcucacgccuguaaucccag

SEQ ID NO: 550403 - RNA, 24 nt, Human
guugcagugagccgagaucgugcc

SEQ ID NO: 550404 - RNA, 23 nt, Human
uaaaauacaguguuauugaccua

SEQ ID NO: 550405 - RNA, 22 nt, Human
uaaaauauacaccagaaauacu

SEQ ID NO: 550406 - RNA, 18 nt, Human
uaagaucaacugaaaaac

SEQ ID NO: 550407 - RNA, 21 nt, Human
uaagguuaagguuaaggaaau

SEQ ID NO: 550408 - RNA, 18 nt, Human
uacagaauggauauugga

SEQ ID NO: 550409 - RNA, 24 nt, Human
uacagagugcaaaauaaaaagaaa

SEQ ID NO: 550410 - RNA, 18 nt, Human
uaccuugguauccacagg

SEQ ID NO: 550411 - RNA, 23 nt, Human
uagcacaugccaggauaaacgua

SEQ ID NO: 550412 - RNA, 20 nt, Human
uagcugggcaugguggcaug

SEQ ID NO: 550413 - RNA, 23 nt, Human
uauaaccuauucacauccuccug

SEQ ID NO: 550414 - RNA, 19 nt, Human
uauaccaauucucccauca

SEQ ID NO: 550415 - RNA, 25 nt, Human
uauauuugcugcauaaaaguugauu

SEQ ID NO: 550416 - RNA, 21 nt, Human
uauuaugccuucguuuacccu

SEQ ID NO: 550417 - RNA, 22 nt, Human
ucaucucagccuccacaggaag

SEQ ID NO: 550418 - RNA, 19 nt, Human
uccaaaaaauaaacaaaug

SEQ ID NO: 550419 - RNA, 21 nt, Human
uccacagauguggaacuaacc

SEQ ID NO: 550420 - RNA, 23 nt, Human
uccaucucaaaaagaaaaaaaaa

SEQ ID NO: 550421 - RNA, 18 nt, Human
ucccagaucgccccccug

SEQ ID NO: 550422 - RNA, 18 nt, Human
ucccauaugaacaagaau

SEQ ID NO: 550423 - RNA, 18 nt, Human
uccuccuguauacuuaaa

SEQ ID NO: 550424 - RNA, 23 nt, Human
ucgugccacugcacuccaaccug

SEQ ID NO: 550425 - RNA, 24 nt, Human
ucucaagguuaggagauugagacc

SEQ ID NO: 550426 - RNA, 20 nt, Human
ugaaaaaccaagauugagag

SEQ ID NO: 550427 - RNA, 18 nt, Human
ugaacacaaacaaauuga

SEQ ID NO: 550428 - RNA, 20 nt, Human
ugaauccacagauguggaac

SEQ ID NO: 550429 - RNA, 18 nt, Human
ugacuuguuuuuaugaau

SEQ ID NO: 550430 - RNA, 24 nt, Human
ugagaccauccuggccaacauggu

SEQ ID NO: 550431 - RNA, 22 nt, Human
ugagccgagaucgugccacugc

SEQ ID NO: 550432 - RNA, 20 nt, Human
ugaggcaggaggaucucuug

SEQ ID NO: 550433 - RNA, 24 nt, Human
ugaggcaggaggaucucuugaacc

SEQ ID NO: 550434 - RNA, 25 nt, Human
ugaggcaggaggaucucuugaaccc

SEQ ID NO: 550435 - RNA, 19 nt, Human
ugagugaagagaccauaga

SEQ ID NO: 550436 - RNA, 21 nt, Human
ugauucccagaucgccccccu

SEQ ID NO: 550437 - RNA, 22 nt, Human
ugauuugaggaacauaaaaaac

SEQ ID NO: 550438 - RNA, 22 nt, Human
ugcauauaaccuauucacaucc

SEQ ID NO: 550439 - RNA, 24 nt, Human
ugccacugcacuccaaccugggca

SEQ ID NO: 550440 - RNA, 23 nt, Human
ugcgccuguagucccagcugcuc

SEQ ID NO: 550441 - RNA, 25 nt, Human
ugcggagagugcacgggcagggcgg

SEQ ID NO: 550442 - RNA, 20 nt, Human
uggaacuaaccacagagggc

SEQ ID NO: 550443 - RNA, 20 nt, Human
uggaggguggaucucaaggu

SEQ ID NO: 550444 - RNA, 21 nt, Human
uggcaugcgccuguaguccca

SEQ ID NO: 550445 - RNA, 18 nt, Human
uggccaacauggugaaac

SEQ ID NO: 550446 - RNA, 22 nt, Human
uggcucacgccuguaaucccag

SEQ ID NO: 550447 - RNA, 24 nt, Human
uggcucacgccuguaaucccagca

SEQ ID NO: 550448 - RNA, 19 nt, Human
uggcuggagagcggcuguc

SEQ ID NO: 550449 - RNA, 24 nt, Human
uggguuauuauguggccuugguug

SEQ ID NO: 550450 - RNA, 18 nt, Human
ugguacagucaaaccaau

SEQ ID NO: 550451 - RNA, 24 nt, Human
ugguggcaugcgccuguaguccca

SEQ ID NO: 550452 - RNA, 22 nt, Human
uguauacauacauguuuguaua

SEQ ID NO: 550453 - RNA, 30 nt, Human
uguauacauacauguuuguauaugaauauu

SEQ ID NO: 550454 - RNA, 18 nt, Human
ugucaaaaauaaaacaaa

SEQ ID NO: 550455 - RNA, 20 nt, Human
ugucaaaaauaaaacaaaaa

SEQ ID NO: 550456 - RNA, 21 nt, Human
ugucaagauacaacuuuaaau

SEQ ID NO: 550457 - RNA, 23 nt, Human
uuacuaaaucgauuugacuauau

SEQ ID NO: 550458 - RNA, 22 nt, Human
uuagcugggcaugguggcaugc

SEQ ID NO: 550459 - RNA, 22 nt, Human
uuaugcauuugugguugcuuug

SEQ ID NO: 550460 - RNA, 23 nt, Human
uucaagucacuuauauaaaaggg

SEQ ID NO: 550461 - RNA, 23 nt, Human
uucaaugcauuuuuauuuauuuc

SEQ ID NO: 550462 - RNA, 22 nt, Human
uucaauucccaagaaaaauaaa

SEQ ID NO: 550463 - RNA, 18 nt, Human
uugcagugagccgagauc

SEQ ID NO: 550464 - RNA, 21 nt, Human
uugcagugagccgagaucgug

SEQ ID NO: 550465 - RNA, 22 nt, Human
uugcagugagccgagaucgugc

SEQ ID NO: 550466 - RNA, 19 nt, Human
uugguugaauccacagaug

SEQ ID NO: 550467 - RNA, 21 nt, Human
uuugugguugcuuugguucuc

SEQ ID NO: 550468 - RNA, 19 nt, Human
uuuuccguccuugguuggu

SEQ ID NO: 550469 - RNA, 25 nt, Human
uuuucuccuucaauaucuuaaggua

SEQ ID NO: 550470 - RNA, 21 nt, Human
aaauugucccucccuccccug

SEQ ID NO: 550471 - RNA, 20 nt, Human
aacuucccccucccuccccc

SEQ ID NO: 550472 - RNA, 23 nt, Human
aagagacaagagagcugcccuca

SEQ ID NO: 550473 - RNA, 21 nt, Human
aagaggcagagaacagggagg

SEQ ID NO: 550474 - RNA, 24 nt, Human
aaguuuuauacaaaauguggggag

SEQ ID NO: 550475 - RNA, 21 nt, Human
aauguggggagggaaaaggga

SEQ ID NO: 550476 - RNA, 22 nt, Human
accccaccccagaggccccagc

SEQ ID NO: 550477 - RNA, 30 nt, Human
acccccuuaacuucccccucccucccccuu

SEQ ID NO: 550478 - RNA, 21 nt, Human
acccccuucccauccccccac

SEQ ID NO: 550479 - RNA, 22 nt, Human
acuccccccacccucagucccc

SEQ ID NO: 550480 - RNA, 21 nt, Human
acuucccccucccucccccua

SEQ ID NO: 550481 - RNA, 18 nt, Human
agccccccaccccacccc

SEQ ID NO: 550482 - RNA, 24 nt, Human
agccccccaccccaccccagaggc

SEQ ID NO: 550483 - RNA, 23 nt, Human
agcccugggcacccacccacccc

SEQ ID NO: 550484 - RNA, 23 nt, Human
aggcacucauggcccccuggagg

SEQ ID NO: 550485 - RNA, 18 nt, Human
agggcuggggcugaggag

SEQ ID NO: 550486 - RNA, 21 nt, Human
agggcuggggcugaggagggc

SEQ ID NO: 550487 - RNA, 23 nt, Human
aggggcagggcaggcagggcugg

SEQ ID NO: 550488 - RNA, 19 nt, Human
agggguacaagaggcagag

SEQ ID NO: 550489 - RNA, 20 nt, Human
agguccccugcccacagccc

SEQ ID NO: 550490 - RNA, 21 nt, Human
auagaaaaguuccuggguguu

SEQ ID NO: 550491 - RNA, 19 nt, Human
auguggggagggaaaaggg

SEQ ID NO: 550492 - RNA, 21 nt, Human
auugucccucccuccccugcu

SEQ ID NO: 550493 - RNA, 20 nt, Human
caccccagaggccccagcug

SEQ ID NO: 550494 - RNA, 22 nt, Human
caccccagaggccccagcuggg

SEQ ID NO: 550495 - RNA, 23 nt, Human
cacccccuucccauccccccacc

SEQ ID NO: 550496 - RNA, 21 nt, Human
caccccucacccuccuccgcc

SEQ ID NO: 550497 - RNA, 23 nt, Human
cacccgccugcccaugggccagu

SEQ ID NO: 550498 - RNA, 19 nt, Human
cacccucaguccccaauac

SEQ ID NO: 550499 - RNA, 21 nt, Human
cacccuccuccgccccccacc

SEQ ID NO: 550500 - RNA, 20 nt, Human
cagccccccaccccacccca

SEQ ID NO: 550501 - RNA, 26 nt, Human
cagccccccaccccaccccagaggcc

SEQ ID NO: 550502 - RNA, 21 nt, Human
cagguccccugcccacagccc

SEQ ID NO: 550503 - RNA, 19 nt, Human
cauccccccacccgccugc

SEQ ID NO: 550504 - RNA, 19 nt, Human
cauggcccccuggaggggc

SEQ ID NO: 550505 - RNA, 22 nt, Human
cauggcccccuggaggggcagg

SEQ ID NO: 550506 - RNA, 23 nt, Human
ccacagagacagggaauagcccc

SEQ ID NO: 550507 - RNA, 23 nt, Human
ccaccccaccccagaggccccag

SEQ ID NO: 550508 - RNA, 21 nt, Human
ccacccccaccauuuuuaaaa

SEQ ID NO: 550509 - RNA, 23 nt, Human
ccagagcuuagaaacccacagag

SEQ ID NO: 550510 - RNA, 22 nt, Human
ccagcggccccucuacuccccc

SEQ ID NO: 550511 - RNA, 22 nt, Human
ccaguccuaggagcagcugggg

SEQ ID NO: 550512 - RNA, 18 nt, Human
cccaauacagaauaaggc

SEQ ID NO: 550513 - RNA, 24 nt, Human
cccacagagacagggaauagcccc

SEQ ID NO: 550514 - RNA, 19 nt, Human
cccaccccaccccagaggc

SEQ ID NO: 550515 - RNA, 23 nt, Human
cccaccccaccccagaggcccca

SEQ ID NO: 550516 - RNA, 21 nt, Human
ccccaccccaccccagaggcc

SEQ ID NO: 550517 - RNA, 21 nt, Human
ccccaccccagaggccccagc

SEQ ID NO: 550518 - RNA, 18 nt, Human
ccccacccucagucccca

SEQ ID NO: 550519 - RNA, 20 nt, Human
ccccacccucaguccccaau

SEQ ID NO: 550520 - RNA, 19 nt, Human
ccccagaauggaggugacc

SEQ ID NO: 550521 - RNA, 26 nt, Human
ccccagaggccccagcugggaggcag

SEQ ID NO: 550522 - RNA, 20 nt, Human
cccccaccauuuuuaaaaaa

SEQ ID NO: 550523 - RNA, 22 nt, Human
ccccccaccccaccccagaggc

SEQ ID NO: 550524 - RNA, 23 nt, Human
ccccccaccccaccccagaggcc

SEQ ID NO: 550525 - RNA, 22 nt, Human
ccccccaccccccaacacaugg

SEQ ID NO: 550526 - RNA, 19 nt, Human
ccccccacccgccugccca

SEQ ID NO: 550527 - RNA, 20 nt, Human
cccccuaccaccaauuugcc

SEQ ID NO: 550528 - RNA, 24 nt, Human
cccccuggaggggcagggcaggca

SEQ ID NO: 550529 - RNA, 21 nt, Human
ccccgucccgucccgcgcccg

SEQ ID NO: 550530 - RNA, 26 nt, Human
ccccuagcccugggcacccacccacc

SEQ ID NO: 550531 - RNA, 20 nt, Human
ccccucccucccccuaccac

SEQ ID NO: 550532 - RNA, 19 nt, Human
ccccucuacuccccccacc

SEQ ID NO: 550533 - RNA, 22 nt, Human
ccccuuaacuucccccucccuc

SEQ ID NO: 550534 - RNA, 20 nt, Human
cccugggcacccacccaccc

SEQ ID NO: 550535 - RNA, 18 nt, Human
ccgccccccaccccccaa

SEQ ID NO: 550536 - RNA, 20 nt, Human
ccgcccucgccgccucaccc

SEQ ID NO: 550537 - RNA, 20 nt, Human
ccgcgcccgucgggccgccc

SEQ ID NO: 550538 - RNA, 21 nt, Human
ccgcgcccgucgggccgcccu

SEQ ID NO: 550539 - RNA, 23 nt, Human
ccgucgggccgcccucgccgccu

SEQ ID NO: 550540 - RNA, 21 nt, Human
ccuaccaccaauuugcccaga

SEQ ID NO: 550541 - RNA, 18 nt, Human
ccuagcccugggcaccca

SEQ ID NO: 550542 - RNA, 18 nt, Human
ccucacccggccucgccu

SEQ ID NO: 550543 - RNA, 21 nt, Human
ccucacccuccuccgcccccc

SEQ ID NO: 550544 - RNA, 21 nt, Human
ccucccucccccuaccaccaa

SEQ ID NO: 550545 - RNA, 21 nt, Human
cgauuccgggccgcggcuccc

SEQ ID NO: 550546 - RNA, 25 nt, Human
cggcucccggcgcccucgcugcccc

SEQ ID NO: 550547 - RNA, 19 nt, Human
cuaggcacucauggccccc

SEQ ID NO: 550548 - RNA, 21 nt, Human
cucacccuccuccgcccccca

SEQ ID NO: 550549 - RNA, 21 nt, Human
cucauggcccccuggaggggc

SEQ ID NO: 550550 - RNA, 23 nt, Human
cucccccuaccaccaauuugccc

SEQ ID NO: 550551 - RNA, 18 nt, Human
cuccgccccccacccccc

SEQ ID NO: 550552 - RNA, 23 nt, Human
cuccuccgccccccaccccccaa

SEQ ID NO: 550553 - RNA, 23 nt, Human
cugggcacccacccacccccacc

SEQ ID NO: 550554 - RNA, 19 nt, Human
cuuccaguuugguuucagg

SEQ ID NO: 550555 - RNA, 24 nt, Human
cuugaccacagccccccaccccac

SEQ ID NO: 550556 - RNA, 25 nt, Human
gaccacagccccccaccccacccca

SEQ ID NO: 550557 - RNA, 24 nt, Human
gagaacagggagggagaccgguac

SEQ ID NO: 550558 - RNA, 20 nt, Human
gagcugcccucaccuccagg

SEQ ID NO: 550559 - RNA, 24 nt, Human
gagggcugggaguggggcagagcg

SEQ ID NO: 550560 - RNA, 24 nt, Human
gcacccccuucccauccccccacc

SEQ ID NO: 550561 - RNA, 21 nt, Human
gccaguccuaggagcagcugg

SEQ ID NO: 550562 - RNA, 26 nt, Human
ggcacccccuucccauccccccaccc

SEQ ID NO: 550563 - RNA, 24 nt, Human
ggcaccccucacccuccuccgccc

SEQ ID NO: 550564 - RNA, 21 nt, Human
ggccccucuacuccccccacc

SEQ ID NO: 550565 - RNA, 22 nt, Human
ggccccucuacuccccccaccc

SEQ ID NO: 550566 - RNA, 18 nt, Human
ggcccggggcgaagcgcc

SEQ ID NO: 550567 - RNA, 21 nt, Human
ggcuugaccacagccccccac

SEQ ID NO: 550568 - RNA, 21 nt, Human
gggaggcagagggggcuucca

SEQ ID NO: 550569 - RNA, 22 nt, Human
gggagggaaaagggaggaggca

SEQ ID NO: 550570 - RNA, 23 nt, Human
gggcccggggcgaagcgccccga

SEQ ID NO: 550571 - RNA, 24 nt, Human
gggcugggaguggggcagagcggg

SEQ ID NO: 550572 - RNA, 19 nt, Human
gggcuuaaggcagcaaaag

SEQ ID NO: 550573 - RNA, 21 nt, Human
ggggcuuaaggcagcaaaaga

SEQ ID NO: 550574 - RNA, 20 nt, Human
gggggugcggggcacacagg

SEQ ID NO: 550575 - RNA, 21 nt, Human
ggguggggagugggagaggga

SEQ ID NO: 550576 - RNA, 18 nt, Human
gguggggagugggagagg

SEQ ID NO: 550577 - RNA, 19 nt, Human
gugcugggguggggagugg

SEQ ID NO: 550578 - RNA, 24 nt, Human
guggggcagagcgggugggucaga

SEQ ID NO: 550579 - RNA, 21 nt, Human
uaacuucccccucccuccccc

SEQ ID NO: 550580 - RNA, 21 nt, Human
uacaaaauguggggagggaaa

SEQ ID NO: 550581 - RNA, 19 nt, Human
uaccaccaauuugcccaga

SEQ ID NO: 550582 - RNA, 25 nt, Human
uagcccugggcacccacccaccccc

SEQ ID NO: 550583 - RNA, 20 nt, Human
uauaaaauugucccucccuc

SEQ ID NO: 550584 - RNA, 22 nt, Human
uccagcggccccucuacucccc

SEQ ID NO: 550585 - RNA, 22 nt, Human
ucccgcgcccgucgggccgccc

SEQ ID NO: 550586 - RNA, 19 nt, Human
ucccggcgcccucgcugcc

SEQ ID NO: 550587 - RNA, 20 nt, Human
ucccggcgcccucgcugccc

SEQ ID NO: 550588 - RNA, 23 nt, Human
uccgccccccaccccccaacaca

SEQ ID NO: 550589 - RNA, 21 nt, Human
ucgccgccucacccggccucg

SEQ ID NO: 550590 - RNA, 19 nt, Human
ugaagggguuggaccggug

SEQ ID NO: 550591 - RNA, 19 nt, Human
ugagaaaccuaggcacuca

SEQ ID NO: 550592 - RNA, 22 nt, Human
ugcccagagcuuagaaacccac

SEQ ID NO: 550593 - RNA, 20 nt, Human
ugcggggcacacaggucccc

SEQ ID NO: 550594 - RNA, 18 nt, Human
ugcugggguggggagugg

SEQ ID NO: 550595 - RNA, 21 nt, Human
ugcugugaccuugugggguau

SEQ ID NO: 550596 - RNA, 23 nt, Human
ugggaggcagagggggcuuccag

SEQ ID NO: 550597 - RNA, 22 nt, Human
ugggaguggggcagagcgggug

SEQ ID NO: 550598 - RNA, 27 nt, Human
ugggcacccacccacccccaccauuuu

SEQ ID NO: 550599 - RNA, 22 nt, Human
ugggcggcaccccucacccucc

SEQ ID NO: 550600 - RNA, 18 nt, Human
uggggagggaaaagggag

SEQ ID NO: 550601 - RNA, 20 nt, Human
uggggagggaaaagggagga

SEQ ID NO: 550602 - RNA, 22 nt, Human
ugggguggggagugggagaggg

SEQ ID NO: 550603 - RNA, 20 nt, Human
uguaauagaaaaguuccugg

SEQ ID NO: 550604 - RNA, 22 nt, Human
uucagggcacccccuucccauc

SEQ ID NO: 550605 - RNA, 21 nt, Human
uucccccucccucccccuacc

SEQ ID NO: 550606 - RNA, 21 nt, Human
uugaccacagccccccacccc

SEQ ID NO: 550607 - RNA, 21 nt, Human
uuucagggcacccccuuccca

SEQ ID NO: 550608 - RNA, 18 nt, Human
aaagucacacccucccuu

SEQ ID NO: 550609 - RNA, 21 nt, Human
aaggauccuuccaggguaucc

SEQ ID NO: 550610 - RNA, 23 nt, Human
agaaaauaaagucacacccuccc

SEQ ID NO: 550611 - RNA, 25 nt, Human
agagggaaucuuuauacuauugcca

SEQ ID NO: 550612 - RNA, 18 nt, Human
agccuucaugaagcagcc

SEQ ID NO: 550613 - RNA, 19 nt, Human
auccagguaaccgccacag

SEQ ID NO: 550614 - RNA, 21 nt, Human
cacacggccacagacuugucc

SEQ ID NO: 550615 - RNA, 21 nt, Human
cagcucagaaacagccuucau

SEQ ID NO: 550616 - RNA, 18 nt, Human
cagggcagagagggaauc

SEQ ID NO: 550617 - RNA, 23 nt, Human
cagggcagagagggaaucuuuau

SEQ ID NO: 550618 - RNA, 19 nt, Human
cauagauggcaagaaaauc

SEQ ID NO: 550619 - RNA, 18 nt, Human
caucaaaauagagacugc

SEQ ID NO: 550620 - RNA, 24 nt, Human
caucaaaauagagacugcuuuuaa

SEQ ID NO: 550621 - RNA, 23 nt, Human
ccaaucaggccagaguuggugga

SEQ ID NO: 550622 - RNA, 20 nt, Human
cccuuucuucccaugacucc

SEQ ID NO: 550623 - RNA, 19 nt, Human
ccuggagaaacaugucuca

SEQ ID NO: 550624 - RNA, 18 nt, Human
ccuucuguucuauccucc

SEQ ID NO: 550625 - RNA, 21 nt, Human
cuccucagcugucagcuccag

SEQ ID NO: 550626 - RNA, 24 nt, Human
cugaauugcgccauagaaaauaaa

SEQ ID NO: 550627 - RNA, 19 nt, Human
gaaacagccuucaugaagc

SEQ ID NO: 550628 - RNA, 19 nt, Human
gccacaguuuggaauagcu

SEQ ID NO: 550629 - RNA, 21 nt, Human
gccacaguuuggaauagcuga

SEQ ID NO: 550630 - RNA, 20 nt, Human
gccauagaaaauaaagucac

SEQ ID NO: 550631 - RNA, 24 nt, Human
gcccuuggucucuccuuuccccag

SEQ ID NO: 550632 - RNA, 22 nt, Human
gccugugugucacuuucaggcc

SEQ ID NO: 550633 - RNA, 20 nt, Human
gcggcuuuggguaauugggg

SEQ ID NO: 550634 - RNA, 22 nt, Human
ggaggggccaucauagauggca

SEQ ID NO: 550635 - RNA, 18 nt, Human
ggaugugaagguggucaa

SEQ ID NO: 550636 - RNA, 25 nt, Human
ggcuggugaaggauccuuccagggu

SEQ ID NO: 550637 - RNA, 23 nt, Human
uaaccgccacaguuuggaauagc

SEQ ID NO: 550638 - RNA, 20 nt, Human
ucaaagcucagcucagaaac

SEQ ID NO: 550639 - RNA, 21 nt, Human
uccagguaaccgccacaguuu

SEQ ID NO: 550640 - RNA, 18 nt, Human
ucccaccuccaccuaccc

SEQ ID NO: 550641 - RNA, 19 nt, Human
ucccaccuccaccuacccu

SEQ ID NO: 550642 - RNA, 19 nt, Human
ucccaccuccaccuacccu

SEQ ID NO: 550643 - RNA, 21 nt, Human
ucuaggcuagagaaugagggc

SEQ ID NO: 550644 - RNA, 24 nt, Human
ucuguucuauccucccuuucuucc

SEQ ID NO: 550645 - RNA, 23 nt, Human
ugaaauggaugugaaggugguca

SEQ ID NO: 550646 - RNA, 21 nt, Human
ugacuccucagcugucagcuc

SEQ ID NO: 550647 - RNA, 20 nt, Human
ugaguccucuucccugacuc

SEQ ID NO: 550648 - RNA, 23 nt, Human
ugauuccaucucuaucuuuccca

SEQ ID NO: 550649 - RNA, 22 nt, Human
uggcaagaaaaucaaauuugca

SEQ ID NO: 550650 - RNA, 24 nt, Human
uggcaagaaaaucaaauuugcacu

SEQ ID NO: 550651 - RNA, 22 nt, Human
uguucuauccucccuuucuucc

SEQ ID NO: 550652 - RNA, 24 nt, Human
uguucuauccucccuuucuuccca

SEQ ID NO: 550653 - RNA, 25 nt, Human
uucauggccuucuguucuauccucc

SEQ ID NO: 550654 - RNA, 24 nt, Human
uucuauccucccuuucuucccaug

SEQ ID NO: 550655 - RNA, 22 nt, Human
uugaaauuucuguccacuggug

SEQ ID NO: 550656 - RNA, 21 nt, Human
uugaaguuuaguuuuaucuug

SEQ ID NO: 550657 - RNA, 26 nt, Human
uuuccagucucauccgccacuacuuc

SEQ ID NO: 550658 - RNA, 23 nt, Human
uuucuaggcuagagaaugagggc

SEQ ID NO: 550659 - RNA, 20 nt, Human
uuuuuuuuuuuugcaggccu

SEQ ID NO: 550660 - RNA, 18 nt, Human
uuuuuuuuuuuuuuuuug

SEQ ID NO: 550661 - RNA, 21 nt, Human
uuuuuuuuuuuuuuuuugcag

SEQ ID NO: 550662 - RNA, 22 nt, Human
uuuuuuuuuuuuuuuuugcagg

SEQ ID NO: 550663 - RNA, 18 nt, Human
acaggguuucaccauguu

SEQ ID NO: 550664 - RNA, 21 nt, Human
acaggguuucaccauguuggc

SEQ ID NO: 550665 - RNA, 24 nt, Human
acaggguuucaccauguuggccag

SEQ ID NO: 550666 - RNA, 24 nt, Human
accauguuggccaggauggucucg

SEQ ID NO: 550667 - RNA, 21 nt, Human
accuugugaucugcccgaugg

SEQ ID NO: 550668 - RNA, 22 nt, Human
agaaggguauccagccccaggc

SEQ ID NO: 550669 - RNA, 21 nt, Human
caagcccccacccaagacacu

SEQ ID NO: 550670 - RNA, 18 nt, Human
caccauguuggccaggau

SEQ ID NO: 550671 - RNA, 22 nt, Human
caccauguuggccaggaugguc

SEQ ID NO: 550672 - RNA, 24 nt, Human
caccauguuggccaggauggucuc

SEQ ID NO: 550673 - RNA, 24 nt, Human
caggguuucaccauguuggccagg

SEQ ID NO: 550674 - RNA, 24 nt, Human
caguagagacaggguuucaccaug

SEQ ID NO: 550675 - RNA, 26 nt, Human
caguagagacaggguuucaccauguu

SEQ ID NO: 550676 - RNA, 21 nt, Human
ccaagcccccacccaagacac

SEQ ID NO: 550677 - RNA, 19 nt, Human
ccacccaagacacugccug

SEQ ID NO: 550678 - RNA, 22 nt, Human
ccagccccaggcaaugccagcc

SEQ ID NO: 550679 - RNA, 18 nt, Human
ccuuuaacgaggugggag

SEQ ID NO: 550680 - RNA, 23 nt, Human
cgugagcgcccucgugccgaauu

SEQ ID NO: 550681 - RNA, 21 nt, Human
cucgugccgaauuacgcgacc

SEQ ID NO: 550682 - RNA, 19 nt, Human
gaccuugugaucugcccga

SEQ ID NO: 550683 - RNA, 25 nt, Human
gccagccuugggccuuugaagcuga

SEQ ID NO: 550684 - RNA, 21 nt, Human
gcugagcuuguacucaaccug

SEQ ID NO: 550685 - RNA, 22 nt, Human
ggguuucaccauguuggccagg

SEQ ID NO: 550686 - RNA, 24 nt, Human
gguuucaccauguuggccaggaug

SEQ ID NO: 550687 - RNA, 24 nt, Human
uaauuuuuguauuuucaguagaga

SEQ ID NO: 550688 - RNA, 21 nt, Human
uagagacaggguuucaccaug

SEQ ID NO: 550689 - RNA, 22 nt, Human
uagagacaggguuucaccaugu

SEQ ID NO: 550690 - RNA, 24 nt, Human
ucaccauguuggccaggauggucu

SEQ ID NO: 550691 - RNA, 24 nt, Human
ucaguagagacaggguuucaccau

SEQ ID NO: 550692 - RNA, 25 nt, Human
ugaccaagcccccacccaagacacu

SEQ ID NO: 550693 - RNA, 18 nt, Human
ugagcgcccucgugccga

SEQ ID NO: 550694 - RNA, 21 nt, Human
uggccaggauggucucgaucu

SEQ ID NO: 550695 - RNA, 19 nt, Human
ugggccuuugaagcugagc

SEQ ID NO: 550696 - RNA, 23 nt, Human
uugaagcugagcuuguacucaac

SEQ ID NO: 550697 - RNA, 19 nt, Human
uuucaccauguuggccagg

SEQ ID NO: 550698 - RNA, 20 nt, Human
uuucaccauguuggccagga

SEQ ID NO: 550699 - RNA, 24 nt, Human
uuuucaguagagacaggguuucac

SEQ ID NO: 550700 - RNA, 22 nt, Human
uuuuguauuuucaguagagaca

SEQ ID NO: 550701 - RNA, 20 nt, Human
uuuuuguauuuucaguagag

SEQ ID NO: 550702 - RNA, 23 nt, Human
uuuuuuuuuuuugagagggaaau

SEQ ID NO: 550703 - RNA, 25 nt, Human
uuuuuuuuuuuugagagggaaauca

SEQ ID NO: 550704 - RNA, 18 nt, Human
uuuuuuuuuuuuuuuuug

SEQ ID NO: 550705 - RNA, 24 nt, Human
uuuuuuuuuuuuuuuuugagaggg

SEQ ID NO: 550706 - RNA, 21 nt, Human
aaaacacaaauaccaaacuuu

SEQ ID NO: 550707 - RNA, 22 nt, Human
aaacuguacaaaagcaaacaaa

SEQ ID NO: 550708 - RNA, 18 nt, Human
aaagggucuggauuuggg

SEQ ID NO: 550709 - RNA, 24 nt, Human
aacacauauucaacaucuccaccu

SEQ ID NO: 550710 - RNA, 24 nt, Human
aaccuugacuaauacaggaacuaa

SEQ ID NO: 550711 - RNA, 23 nt, Human
aacugggucacaagaugcccagc

SEQ ID NO: 550712 - RNA, 23 nt, Human
aacuguguuucccagcucccuga

SEQ ID NO: 550713 - RNA, 18 nt, Human
aagcaaacaaaaaauucc

SEQ ID NO: 550714 - RNA, 23 nt, Human
aauaaccaccgccccccugcccc

SEQ ID NO: 550715 - RNA, 24 nt, Human
acaacagacucaacagacugagcc

SEQ ID NO: 550716 - RNA, 21 nt, Human
acacccaaaaaucaaggucau

SEQ ID NO: 550717 - RNA, 21 nt, Human
acaggcagauuagcuuuugaa

SEQ ID NO: 550718 - RNA, 19 nt, Human
accuaguuaucaucaacag

SEQ ID NO: 550719 - RNA, 23 nt, Human
acugaggccugggagaaaagugg

SEQ ID NO: 550720 - RNA, 21 nt, Human
acuguacaaaagcaaacaaaa

SEQ ID NO: 550721 - RNA, 24 nt, Human
agaauucuuccugccuaauagccu

SEQ ID NO: 550722 - RNA, 23 nt, Human
agcaaacaaaaaauuccacugag

SEQ ID NO: 550723 - RNA, 19 nt, Human
agccugcugccaucagacu

SEQ ID NO: 550724 - RNA, 26 nt, Human
agccuuuggacaggaccaucagcuuu

SEQ ID NO: 550725 - RNA, 19 nt, Human
agcucccugaugugcuccu

SEQ ID NO: 550726 - RNA, 19 nt, Human
aggaaggccuagggaugug

SEQ ID NO: 550727 - RNA, 20 nt, Human
aggaauccucccuccagguc

SEQ ID NO: 550728 - RNA, 21 nt, Human
aggccagaacugagagagaga

SEQ ID NO: 550729 - RNA, 21 nt, Human
aggccugaauagaacaaaaga

SEQ ID NO: 550730 - RNA, 21 nt, Human
agggcaggaugaggcagagaa

SEQ ID NO: 550731 - RNA, 19 nt, Human
agggugcugggcuggaugg

SEQ ID NO: 550732 - RNA, 24 nt, Human
aguaagaagucagggacugggggc

SEQ ID NO: 550733 - RNA, 22 nt, Human
auagaacaaaagagcuaacucu

SEQ ID NO: 550734 - RNA, 23 nt, Human
auagaacaaaagagcuaacucug

SEQ ID NO: 550735 - RNA, 20 nt, Human
aucagcuuuuuccuugccuu

SEQ ID NO: 550736 - RNA, 23 nt, Human
caaaucaguagacugaguaaugc

SEQ ID NO: 550737 - RNA, 21 nt, Human
cacuuuuucuagcuggaccuc

SEQ ID NO: 550738 - RNA, 18 nt, Human
cagcucccugaugugcuc

SEQ ID NO: 550739 - RNA, 19 nt, Human
caucagacuggaacuaaac

SEQ ID NO: 550740 - RNA, 18 nt, Human
caugggguugggccaggc

SEQ ID NO: 550741 - RNA, 22 nt, Human
ccaaacuauguuguaaacagca

SEQ ID NO: 550742 - RNA, 19 nt, Human
ccaccgccccccugcccca

SEQ ID NO: 550743 - RNA, 23 nt, Human
ccucucacaggcaaagcuggagu

SEQ ID NO: 550744 - RNA, 26 nt, Human
ccucucacaggcaaagcuggaguuug

SEQ ID NO: 550745 - RNA, 26 nt, Human
cucuggaaaaccuugacuaauacagg

SEQ ID NO: 550746 - RNA, 22 nt, Human
cugaaggucugggccaagguca

SEQ ID NO: 550747 - RNA, 20 nt, Human
cugaguguuccugugagggu

SEQ ID NO: 550748 - RNA, 20 nt, Human
cugcaauacacacccaaaaa

SEQ ID NO: 550749 - RNA, 18 nt, Human
cugggaacacuccuuccc

SEQ ID NO: 550750 - RNA, 19 nt, Human
cugggaacacuccuucccc

SEQ ID NO: 550751 - RNA, 21 nt, Human
cuuuggacaggaccaucagcu

SEQ ID NO: 550752 - RNA, 19 nt, Human
gaccagggagcaggcaagc

SEQ ID NO: 550753 - RNA, 21 nt, Human
gagaacuucugacaaacagaa

SEQ ID NO: 550754 - RNA, 20 nt, Human
gagggcaggaugaggcagag

SEQ ID NO: 550755 - RNA, 21 nt, Human
gcagagaaagugucuucuaaa

SEQ ID NO: 550756 - RNA, 18 nt, Human
ggaaaaaaaagcuucuac

SEQ ID NO: 550757 - RNA, 23 nt, Human
ggaacuaacggagaacuucugac

SEQ ID NO: 550758 - RNA, 19 nt, Human
ggacaggaccaucagcuuu

SEQ ID NO: 550759 - RNA, 23 nt, Human
gggcagaggccagaacugagaga

SEQ ID NO: 550760 - RNA, 22 nt, Human
guacaaauagaaaccacaaaag

SEQ ID NO: 550761 - RNA, 21 nt, Human
uaaccaccgccccccugcccc

SEQ ID NO: 550762 - RNA, 22 nt, Human
uaaccaccgccccccugcccca

SEQ ID NO: 550763 - RNA, 24 nt, Human
uaagacagucacaacagacucaac

SEQ ID NO: 550764 - RNA, 18 nt, Human
uacguuggugguuaaaac

SEQ ID NO: 550765 - RNA, 23 nt, Human
uagagagcugacuuuggggggca

SEQ ID NO: 550766 - RNA, 19 nt, Human
uagcuuuugaaagcaugua

SEQ ID NO: 550767 - RNA, 18 nt, Human
uauugauucuguuucucu

SEQ ID NO: 550768 - RNA, 18 nt, Human
ucaugggacuccaucuug

SEQ ID NO: 550769 - RNA, 20 nt, Human
uccaugguuaggccagaucg

SEQ ID NO: 550770 - RNA, 22 nt, Human
ucucaugggacuccaucuugcu

SEQ ID NO: 550771 - RNA, 23 nt, Human
ucugcaacuguguuucccagcuc

SEQ ID NO: 550772 - RNA, 21 nt, Human
ucugggccaaggucagagggc

SEQ ID NO: 550773 - RNA, 21 nt, Human
ucuugacuaaagcuugagggc

SEQ ID NO: 550774 - RNA, 18 nt, Human
ugaaaucaauacucucca

SEQ ID NO: 550775 - RNA, 18 nt, Human
ugaagaaagagggaaaga

SEQ ID NO: 550776 - RNA, 18 nt, Human
ugaauagaacaaaagagc

SEQ ID NO: 550777 - RNA, 24 nt, Human
ugacuaauacaggaacuaacggag

SEQ ID NO: 550778 - RNA, 20 nt, Human
ugaguguuccugugagggug

SEQ ID NO: 550779 - RNA, 22 nt, Human
ugcccuaagagaauucuuccug

SEQ ID NO: 550780 - RNA, 18 nt, Human
uggaguuugcaagcuggg

SEQ ID NO: 550781 - RNA, 23 nt, Human
uggauggugaugggagcagguaa

SEQ ID NO: 550782 - RNA, 20 nt, Human
ugggagcagguaauguggca

SEQ ID NO: 550783 - RNA, 21 nt, Human
uggggaaaaaaaagcuucuac

SEQ ID NO: 550784 - RNA, 21 nt, Human
uggggggcagaggccagaacu

SEQ ID NO: 550785 - RNA, 19 nt, Human
ugguacaaauagaaaccac

SEQ ID NO: 550786 - RNA, 23 nt, Human
uggucuuguggggaaaaaaaagc

SEQ ID NO: 550787 - RNA, 22 nt, Human
uggugaugggagcagguaaugu

SEQ ID NO: 550788 - RNA, 24 nt, Human
uguacaaaagcaaacaaaaaauuc

SEQ ID NO: 550789 - RNA, 19 nt, Human
ugucuucuaaauaaccccu

SEQ ID NO: 550790 - RNA, 20 nt, Human
uguggggaaaaaaaagcuuc

SEQ ID NO: 550791 - RNA, 22 nt, Human
uguguauucaucugcaaacuga

SEQ ID NO: 550792 - RNA, 20 nt, Human
uuaacauucaaaucaguaga

SEQ ID NO: 550793 - RNA, 18 nt, Human
uugauucuguuucucugg

SEQ ID NO: 550794 - RNA, 18 nt, Human
uuggacaggaccaucagc

SEQ ID NO: 550795 - RNA, 21 nt, Human
uuggucaaacauuauucugag

SEQ ID NO: 550796 - RNA, 21 nt, Human
uuuacucaucagccuuuccca

SEQ ID NO: 550797 - RNA, 21 nt, Human
uuuccaggaauccucccucca

SEQ ID NO: 550798 - RNA, 20 nt, Human
acagcuggggccaccagaac

SEQ ID NO: 550799 - RNA, 23 nt, Human
accagaacagaggggccgcccuc

SEQ ID NO: 550800 - RNA, 22 nt, Human
aggaauuuaaaaagucugaagc

SEQ ID NO: 550801 - RNA, 21 nt, Human
aggcagcucaaggcacuuggu

SEQ ID NO: 550802 - RNA, 23 nt, Human
cacccucugaacuccguccuccc

SEQ ID NO: 550803 - RNA, 20 nt, Human
cacgcaagcaaaauguacga

SEQ ID NO: 550804 - RNA, 21 nt, Human
cacgcaagcaaaauguacgau

SEQ ID NO: 550805 - RNA, 18 nt, Human
cagacaucaugaccguaa

SEQ ID NO: 550806 - RNA, 24 nt, Human
cagcuggggccaccagaacagagg

SEQ ID NO: 550807 - RNA, 21 nt, Human
ccagcaucuucccaguucccu

SEQ ID NO: 550808 - RNA, 18 nt, Human
ccuggcuccgggggcggu

SEQ ID NO: 550809 - RNA, 18 nt, Human
cgacagcgaggcggugac

SEQ ID NO: 550810 - RNA, 21 nt, Human
cuccucagcaucccccaccuc

SEQ ID NO: 550811 - RNA, 19 nt, Human
cuccuuugcagacaucaug

SEQ ID NO: 550812 - RNA, 21 nt, Human
cucggcccuggcuccgggggc

SEQ ID NO: 550813 - RNA, 24 nt, Human
cugacauuaagcaggaauuuaaaa

SEQ ID NO: 550814 - RNA, 24 nt, Human
cuggcuccgggggcgguacggaca

SEQ ID NO: 550815 - RNA, 19 nt, Human
cugggggugcuacucgcgc

SEQ ID NO: 550816 - RNA, 24 nt, Human
cuggucucccugcaaagccgggag

SEQ ID NO: 550817 - RNA, 23 nt, Human
gcaagcaaaauguacgauucccu

SEQ ID NO: 550818 - RNA, 19 nt, Human
gcuguacuuggugcaucuc

SEQ ID NO: 550819 - RNA, 19 nt, Human
gggcugcagagcaggcagc

SEQ ID NO: 550820 - RNA, 18 nt, Human
gggcuggcuccugcugcc

SEQ ID NO: 550821 - RNA, 18 nt, Human
guagacugacauuaagca

SEQ ID NO: 550822 - RNA, 18 nt, Human
uacgauucccuccucucc

SEQ ID NO: 550823 - RNA, 24 nt, Human
uagcugucccagcacgcaagcaaa

SEQ ID NO: 550824 - RNA, 21 nt, Human
ucaagcucuaauuguggugac

SEQ ID NO: 550825 - RNA, 25 nt, Human
ucagcaucccccaccucucaauucc

SEQ ID NO: 550826 - RNA, 20 nt, Human
ucccagcacgcaagcaaaau

SEQ ID NO: 550827 - RNA, 20 nt, Human
uccucucccuuccugaaagg

SEQ ID NO: 550828 - RNA, 21 nt, Human
uccuggggucagcacuguccu

SEQ ID NO: 550829 - RNA, 23 nt, Human
ugaccaggcccucagucacagcu

SEQ ID NO: 550830 - RNA, 21 nt, Human
ugaucaaugagaaaucucaua

SEQ ID NO: 550831 - RNA, 21 nt, Human
ugugggcugcagagcaggcag

SEQ ID NO: 550832 - RNA, 23 nt, Human
uucccuccucucccuuccugaaa

SEQ ID NO: 550833 - RNA, 19 nt, Human
aaggcuuuccacagucacu

SEQ ID NO: 550834 - RNA, 19 nt, Human
aguucagaauucuugaagu

SEQ ID NO: 550835 - RNA, 20 nt, Human
cacuccgguccggaggcagg

SEQ ID NO: 550836 - RNA, 20 nt, Human
caggcgacgacccaagggga

SEQ ID NO: 550837 - RNA, 18 nt, Human
ccagggucagaggucugc

SEQ ID NO: 550838 - RNA, 27 nt, Human
cccaacacccggccucgugccgguucc

SEQ ID NO: 550839 - RNA, 19 nt, Human
cccacaccgcggccagccg

SEQ ID NO: 550840 - RNA, 21 nt, Human
cccacaccgcggccagccgga

SEQ ID NO: 550841 - RNA, 24 nt, Human
cccacaccgcggccagccggaccc

SEQ ID NO: 550842 - RNA, 22 nt, Human
ccccaacacccggccucgugcc

SEQ ID NO: 550843 - RNA, 22 nt, Human
ccggaggcaggcgacucuuucc

SEQ ID NO: 550844 - RNA, 21 nt, Human
cugcacuccgguccggaggca

SEQ ID NO: 550845 - RNA, 19 nt, Human
gacgacccaaggggacggu

SEQ ID NO: 550846 - RNA, 19 nt, Human
gguccggaggcaggcgacu

SEQ ID NO: 550847 - RNA, 18 nt, Human
guucagaauucuugaagu

SEQ ID NO: 550848 - RNA, 19 nt, Human
ucuacccacaccgcggcca

SEQ ID NO: 550849 - RNA, 19 nt, Human
ugaccucuacccacaccgc

SEQ ID NO: 550850 - RNA, 20 nt, Human
uuuuuuuuuuuuuuuuuugg

SEQ ID NO: 550851 - RNA, 23 nt, Human
uuuuuuuuuuuuuuuuuuguuuu

SEQ ID NO: 550852 - RNA, 25 nt, Human
uuuuuuuuuuuuuuuuuuguuuuaa

SEQ ID NO: 550853 - RNA, 21 nt, Human
aaaauaaauagccuacccuau

SEQ ID NO: 550854 - RNA, 22 nt, Human
aaacaaaaaugaaacuggguau

SEQ ID NO: 550855 - RNA, 23 nt, Human
aaaguguuccccaaauuuuauuu

SEQ ID NO: 550856 - RNA, 23 nt, Human
aacaacccaaucaaaauagcaau

SEQ ID NO: 550857 - RNA, 20 nt, Human
aacacagcaaaaccuugucu

SEQ ID NO: 550858 - RNA, 21 nt, Human
aacacagcaaaaccuugucuc

SEQ ID NO: 550859 - RNA, 22 nt, Human
aaccccacuuuacuacuaaugu

SEQ ID NO: 550860 - RNA, 22 nt, Human
aacccuaaauguacugaaaaau

SEQ ID NO: 550861 - RNA, 25 nt, Human
aagaagaaguauacagcaguguaaa

SEQ ID NO: 550862 - RNA, 20 nt, Human
aagcauaaaacgggcaacaa

SEQ ID NO: 550863 - RNA, 23 nt, Human
aaguguuccccaaauuuuauuua

SEQ ID NO: 550864 - RNA, 23 nt, Human
acacagaagaagaaguauacagc

SEQ ID NO: 550865 - RNA, 21 nt, Human
acagagaaagcaugaaagaua

SEQ ID NO: 550866 - RNA, 20 nt, Human
acccuauuacuauacacauc

SEQ ID NO: 550867 - RNA, 23 nt, Human
agaaacaggcacauaucagcuug

SEQ ID NO: 550868 - RNA, 18 nt, Human
agagaaagcaugaaagau

SEQ ID NO: 550869 - RNA, 24 nt, Human
agcuacuugggaggcugagguggg

SEQ ID NO: 550870 - RNA, 24 nt, Human
agcuugggcaacacagcaaaaccu

SEQ ID NO: 550871 - RNA, 19 nt, Human
aggcugaggugggaagauc

SEQ ID NO: 550872 - RNA, 20 nt, Human
aguauuauuuauucuaaggc

SEQ ID NO: 550873 - RNA, 18 nt, Human
aguuccagaauuguggga

SEQ ID NO: 550874 - RNA, 26 nt, Human
auaaauaaaccccacuuuacuacuaa

SEQ ID NO: 550875 - RNA, 22 nt, Human
auguaaagagggcacgauuuug

SEQ ID NO: 550876 - RNA, 26 nt, Human
caaaaacaacccaaucaaaauagcaa

SEQ ID NO: 550877 - RNA, 19 nt, Human
caaaauagcaauauacuuc

SEQ ID NO: 550878 - RNA, 22 nt, Human
caacacagcaaaaccuugucuc

SEQ ID NO: 550879 - RNA, 24 nt, Human
caacacagcaaaaccuugucucua

SEQ ID NO: 550880 - RNA, 18 nt, Human
caacccaaucaaaauagc

SEQ ID NO: 550881 - RNA, 23 nt, Human
caaguuccagcuugggcaacaca

SEQ ID NO: 550882 - RNA, 27 nt, Human
cacagcaaaaccuugucucuaaaaaaa

SEQ ID NO: 550883 - RNA, 18 nt, Human
cacauaucagcuuguuuu

SEQ ID NO: 550884 - RNA, 23 nt, Human
caccuguauucccagcuacuugg

SEQ ID NO: 550885 - RNA, 24 nt, Human
caccuguauucccagcuacuuggg

SEQ ID NO: 550886 - RNA, 18 nt, Human
cagcaaaaccuugucucu

SEQ ID NO: 550887 - RNA, 21 nt, Human
cagcuacuugggaggcugagg

SEQ ID NO: 550888 - RNA, 24 nt, Human
cagcuacuugggaggcugaggugg

SEQ ID NO: 550889 - RNA, 23 nt, Human
cauuucaacauguuauaccugau

SEQ ID NO: 550890 - RNA, 20 nt, Human
ccaccuccgggccgccuccc

SEQ ID NO: 550891 - RNA, 23 nt, Human
ccaccuccgggccgccucccagg

SEQ ID NO: 550892 - RNA, 22 nt, Human
ccacuaaugaaaaccucccaaa

SEQ ID NO: 550893 - RNA, 23 nt, Human
ccaggcccgccucggcccuccug

SEQ ID NO: 550894 - RNA, 21 nt, Human
cccgcgccggcagcccggggc

SEQ ID NO: 550895 - RNA, 21 nt, Human
ccgccucccaggcccgccucg

SEQ ID NO: 550896 - RNA, 21 nt, Human
ccucccaggcccgccucggcc

SEQ ID NO: 550897 - RNA, 21 nt, Human
ccuccgggccgccucccaggc

SEQ ID NO: 550898 - RNA, 19 nt, Human
ccucucagcgaucgccacc

SEQ ID NO: 550899 - RNA, 21 nt, Human
ccuguauucccagcuacuugg

SEQ ID NO: 550900 - RNA, 22 nt, Human
cgcccgcgccggcagcccgggg

SEQ ID NO: 550901 - RNA, 22 nt, Human
cgccuccauuguccagaaacag

SEQ ID NO: 550902 - RNA, 26 nt, Human
cuaaauccagcaacccuaaauguacu

SEQ ID NO: 550903 - RNA, 25 nt, Human
cucucagcgaucgccaccucgcgac

SEQ ID NO: 550904 - RNA, 20 nt, Human
cuguaccaggccuuagggac

SEQ ID NO: 550905 - RNA, 21 nt, Human
cuguauucccagcuacuuggg

SEQ ID NO: 550906 - RNA, 23 nt, Human
gaaagauaaagcacguaugaaca

SEQ ID NO: 550907 - RNA, 19 nt, Human
gagggcacgauuuugaggu

SEQ ID NO: 550908 - RNA, 20 nt, Human
gauaaaauacaagacuccca

SEQ ID NO: 550909 - RNA, 24 nt, Human
gcgccggcagcccggggcucgugc

SEQ ID NO: 550910 - RNA, 24 nt, Human
ggaaaaauuugugugugugugugu

SEQ ID NO: 550911 - RNA, 23 nt, Human
gggccgccucccaggcccgccuc

SEQ ID NO: 550912 - RNA, 20 nt, Human
guggacgugccgcggcgccc

SEQ ID NO: 550913 - RNA, 20 nt, Human
uaacugacuuucaaaugauu

SEQ ID NO: 550914 - RNA, 18 nt, Human
uacacacaaaaacaaccc

SEQ ID NO: 550915 - RNA, 22 nt, Human
uacacaucaagcauaaaacggg

SEQ ID NO: 550916 - RNA, 23 nt, Human
uauaaguauuuuccaaauauucc

SEQ ID NO: 550917 - RNA, 24 nt, Human
uauacagcaguguaaacugacauu

SEQ ID NO: 550918 - RNA, 21 nt, Human
uauaguuccagaauuguggga

SEQ ID NO: 550919 - RNA, 20 nt, Human
uauguaaagagggcacgauu

SEQ ID NO: 550920 - RNA, 20 nt, Human
uauuacacacugaaguauuu

SEQ ID NO: 550921 - RNA, 23 nt, Human
ucaaaauagcaauauacuucuaa

SEQ ID NO: 550922 - RNA, 23 nt, Human
ucauauaugaauuugauaauccu

SEQ ID NO: 550923 - RNA, 23 nt, Human
uccacuaaugaaaaccucccaaa

SEQ ID NO: 550924 - RNA, 20 nt, Human
uccagcaacccuaaauguac

SEQ ID NO: 550925 - RNA, 21 nt, Human
ucccaggcccgccucggcccu

SEQ ID NO: 550926 - RNA, 26 nt, Human
ucuuaaccacuauauaaauaaacccc

SEQ ID NO: 550927 - RNA, 25 nt, Human
ugaaagauaaagcacguaugaacaa

SEQ ID NO: 550928 - RNA, 23 nt, Human
ugaagcccgugcgggccggcccc

SEQ ID NO: 550929 - RNA, 21 nt, Human
ugagaauaaauauauaaucua

SEQ ID NO: 550930 - RNA, 21 nt, Human
ugaggugggaagaucacuuca

SEQ ID NO: 550931 - RNA, 20 nt, Human
ugggaggcugaggugggaag

SEQ ID NO: 550932 - RNA, 24 nt, Human
ugggaggcugaggugggaagauca

SEQ ID NO: 550933 - RNA, 19 nt, Human
ugggcaacacagcaaaacc

SEQ ID NO: 550934 - RNA, 22 nt, Human
ugguggcagacaccuguauucc

SEQ ID NO: 550935 - RNA, 21 nt, Human
uguguguguguguguguacag

SEQ ID NO: 550936 - RNA, 18 nt, Human
ugugugugugugugugug

SEQ ID NO: 550937 - RNA, 19 nt, Human
ugugugugugugugugugu

SEQ ID NO: 550938 - RNA, 20 nt, Human
ugugugugugugugugugua

SEQ ID NO: 550939 - RNA, 18 nt, Human
uuaaaugcuugucacauu

SEQ ID NO: 550940 - RNA, 23 nt, Human
uuagaaaucuccugugccuuuga

SEQ ID NO: 550941 - RNA, 22 nt, Human
uuagauuggaacuugaaaguau

SEQ ID NO: 550942 - RNA, 20 nt, Human
uucacuuuuaucauauauga

SEQ ID NO: 550943 - RNA, 25 nt, Human
uugggaggcugaggugggaagauca

SEQ ID NO: 550944 - RNA, 18 nt, Human
uuuagggagacaaaggaa

SEQ ID NO: 550945 - RNA, 23 nt, Human
aaaacuauggaaacuuuggauaa

SEQ ID NO: 550946 - RNA, 20 nt, Human
aaagaaaaaaaaaaaagccu

SEQ ID NO: 550947 - RNA, 24 nt, Human
aacaccuauucaucuuuuuaaagc

SEQ ID NO: 550948 - RNA, 20 nt, Human
aaccguguucuucagucugg

SEQ ID NO: 550949 - RNA, 21 nt, Human
aacgcugggguccgugacagg

SEQ ID NO: 550950 - RNA, 18 nt, Human
aagaagcagaaaggcccc

SEQ ID NO: 550951 - RNA, 21 nt, Human
aagaauccaaaaaaauaccac

SEQ ID NO: 550952 - RNA, 24 nt, Human
aagcaaaacagccuuaacauccau

SEQ ID NO: 550953 - RNA, 22 nt, Human
aagcacauacgacacaggaaac

SEQ ID NO: 550954 - RNA, 20 nt, Human
aagcccaauaugcaugaaug

SEQ ID NO: 550955 - RNA, 21 nt, Human
aaguauguuuaaguuacacau

SEQ ID NO: 550956 - RNA, 23 nt, Human
aaguauguuuaaguuacacauua

SEQ ID NO: 550957 - RNA, 23 nt, Human
aaguuucuggcaaugucaccuuu

SEQ ID NO: 550958 - RNA, 23 nt, Human
aauguccucaaaucucugcaauu

SEQ ID NO: 550959 - RNA, 21 nt, Human
acaauauauacuacaaacccc

SEQ ID NO: 550960 - RNA, 23 nt, Human
acacaggaaacaucccuaagucc

SEQ ID NO: 550961 - RNA, 22 nt, Human
accagcucccauuucuuuuucu

SEQ ID NO: 550962 - RNA, 20 nt, Human
acuacaaaccccuuagucug

SEQ ID NO: 550963 - RNA, 20 nt, Human
acugaaaauaccaacagaau

SEQ ID NO: 550964 - RNA, 24 nt, Human
acugaaaucugcuucccugugacu

SEQ ID NO: 550965 - RNA, 19 nt, Human
acugggcuagguuggguug

SEQ ID NO: 550966 - RNA, 22 nt, Human
agaaaggcccccuuuugguucu

SEQ ID NO: 550967 - RNA, 23 nt, Human
agaggccucucacacccucacuu

SEQ ID NO: 550968 - RNA, 22 nt, Human
agagguagcuggcuaagaagca

SEQ ID NO: 550969 - RNA, 24 nt, Human
agcaaaacagccuuaacauccagu

SEQ ID NO: 550970 - RNA, 20 nt, Human
aggcgcuggcggcugggacu

SEQ ID NO: 550971 - RNA, 21 nt, Human
auacaacuauaacaagacucu

SEQ ID NO: 550972 - RNA, 21 nt, Human
auccaaaaaaauaccacuaug

SEQ ID NO: 550973 - RNA, 20 nt, Human
augccaguuuucccuucuuu

SEQ ID NO: 550974 - RNA, 20 nt, Human
auggaucucuucugccuaca

SEQ ID NO: 550975 - RNA, 21 nt, Human
caaaauaaaaauaauguccuc

SEQ ID NO: 550976 - RNA, 18 nt, Human
cacacaaggcccugugug

SEQ ID NO: 550977 - RNA, 18 nt, Human
cacaguacacagugugaa

SEQ ID NO: 550978 - RNA, 18 nt, Human
caccaacccaggcccaga

SEQ ID NO: 550979 - RNA, 19 nt, Human
cacccgggacaacuuccag

SEQ ID NO: 550980 - RNA, 20 nt, Human
cacccgggacaacuuccaga

SEQ ID NO: 550981 - RNA, 27 nt, Human
caccucguccucucgacccgggcucca

SEQ ID NO: 550982 - RNA, 19 nt, Human
cagccacuuuaucaucuua

SEQ ID NO: 550983 - RNA, 22 nt, Human
cagcggcaccucguccucucga

SEQ ID NO: 550984 - RNA, 22 nt, Human
cagcggcaccucguccucucga

SEQ ID NO: 550985 - RNA, 20 nt, Human
cagcucccauuucuuuuucu

SEQ ID NO: 550986 - RNA, 26 nt, Human
caucagagagcucugagaugccuuag

SEQ ID NO: 550987 - RNA, 21 nt, Human
caucccuaaguccucccuacc

SEQ ID NO: 550988 - RNA, 20 nt, Human
ccacauuuuuagacaaacac

SEQ ID NO: 550989 - RNA, 25 nt, Human
ccaggcagcggcaccucguccucuc

SEQ ID NO: 550990 - RNA, 20 nt, Human
cccaaccccaaaugccuuac

SEQ ID NO: 550991 - RNA, 23 nt, Human
ccgacggcagcggaggauucucc

SEQ ID NO: 550992 - RNA, 22 nt, Human
ccuccugagaacaccuauucau

SEQ ID NO: 550993 - RNA, 18 nt, Human
ccucucacacccucacuu

SEQ ID NO: 550994 - RNA, 18 nt, Human
ccugacuaggcugugaac

SEQ ID NO: 550995 - RNA, 23 nt, Human
ccugucuguccucuggcacuggg

SEQ ID NO: 550996 - RNA, 19 nt, Human
ccugugugaccagcuccca

SEQ ID NO: 550997 - RNA, 19 nt, Human
ccuuaucaccuuauuaaca

SEQ ID NO: 550998 - RNA, 18 nt, Human
cgacccgggcuccagcgg

SEQ ID NO: 550999 - RNA, 21 nt, Human
cgacccgggcuccagcggcga

SEQ ID NO: 551000 - RNA, 20 nt, Human
cggggagaaaaaaauuaaaa

SEQ ID NO: 551001 - RNA, 23 nt, Human
cggggagaaaaaaauuaaaaacc

SEQ ID NO: 551002 - RNA, 26 nt, Human
cuaagcccaauaugcaugaaugcuaa

SEQ ID NO: 551003 - RNA, 19 nt, Human
cucuaucuuauuggcuagg

SEQ ID NO: 551004 - RNA, 27 nt, Human
cucucaagccagcucucugcaaccuaa

SEQ ID NO: 551005 - RNA, 20 nt, Human
cugaauaaaugucagacuga

SEQ ID NO: 551006 - RNA, 20 nt, Human
cuggcacagggacccaucuu

SEQ ID NO: 551007 - RNA, 21 nt, Human
cuguccuuucauccaagcacu

SEQ ID NO: 551008 - RNA, 25 nt, Human
cuucugccuacaauauauacuacaa

SEQ ID NO: 551009 - RNA, 18 nt, Human
gaaaucagggaaucuaga

SEQ ID NO: 551010 - RNA, 18 nt, Human
gaaugugaauuuccaugc

SEQ ID NO: 551011 - RNA, 23 nt, Human
gagaaaugagauacugaaaauac

SEQ ID NO: 551012 - RNA, 22 nt, Human
gagguagcuggcuaagaagcag

SEQ ID NO: 551013 - RNA, 23 nt, Human
gagguagcuggcuaagaagcaga

SEQ ID NO: 551014 - RNA, 19 nt, Human
gcacacaaggcccugugug

SEQ ID NO: 551015 - RNA, 21 nt, Human
gcgcuggcggcugggacuggg

SEQ ID NO: 551016 - RNA, 18 nt, Human
gcuuccugauaugacacu

SEQ ID NO: 551017 - RNA, 20 nt, Human
ggaaacaucccuaaguccuc

SEQ ID NO: 551018 - RNA, 19 nt, Human
ggacugggcuagguugggu

SEQ ID NO: 551019 - RNA, 23 nt, Human
ggacugggcuagguuggguuggg

SEQ ID NO: 551020 - RNA, 21 nt, Human
ggagccgacggcagcggagga

SEQ ID NO: 551021 - RNA, 18 nt, Human
gguuggguuaggaaaggg

SEQ ID NO: 551022 - RNA, 22 nt, Human
guccucagugacuucacagucc

SEQ ID NO: 551023 - RNA, 19 nt, Human
gugcugagccccucagggu

SEQ ID NO: 551024 - RNA, 28 nt, Human
uaaaaauacacauagaauuaugaaaaua

SEQ ID NO: 551025 - RNA, 23 nt, Human
uaaaagcaaugaggauaacagaa

SEQ ID NO: 551026 - RNA, 20 nt, Human
uaaaauuacugaaauacaau

SEQ ID NO: 551027 - RNA, 24 nt, Human
uaaaucaugcauaacgaggaauua

SEQ ID NO: 551028 - RNA, 23 nt, Human
uaacuacucucaagccagcucuc

SEQ ID NO: 551029 - RNA, 19 nt, Human
uacacauuaagaauccaaa

SEQ ID NO: 551030 - RNA, 19 nt, Human
uacccaaguauaaaaugac

SEQ ID NO: 551031 - RNA, 19 nt, Human
uaccugaaauggucugauu

SEQ ID NO: 551032 - RNA, 22 nt, Human
uacuuuucauuuucuuuuucuu

SEQ ID NO: 551033 - RNA, 22 nt, Human
uagaaugucaucuaaaaguuuc

SEQ ID NO: 551034 - RNA, 18 nt, Human
uagcaccaacccaggccc

SEQ ID NO: 551035 - RNA, 21 nt, Human
uagguauaauucauucaaagu

SEQ ID NO: 551036 - RNA, 20 nt, Human
uauagcaccaacccaggccc

SEQ ID NO: 551037 - RNA, 21 nt, Human
uaucuaaagacugucccaguc

SEQ ID NO: 551038 - RNA, 20 nt, Human
ucaaaguuuuaaaugccauc

SEQ ID NO: 551039 - RNA, 22 nt, Human
ucaggguaaaaaaguaaccaag

SEQ ID NO: 551040 - RNA, 27 nt, Human
ucagguuuaaaaaagaaaaaaaaaaaa

SEQ ID NO: 551041 - RNA, 22 nt, Human
uccaaaaaaauaccacuaugga

SEQ ID NO: 551042 - RNA, 23 nt, Human
uccauaaucuaaccugaagacca

SEQ ID NO: 551043 - RNA, 19 nt, Human
ucccaagucuucuccaagc

SEQ ID NO: 551044 - RNA, 27 nt, Human
ucccauuucuuuuucuagcuuccccaa

SEQ ID NO: 551045 - RNA, 24 nt, Human
uccgugacagggacaggcgcuggc

SEQ ID NO: 551046 - RNA, 23 nt, Human
uccuaaugagugcugagccccuc

SEQ ID NO: 551047 - RNA, 20 nt, Human
uccuacuuucuuauucacaa

SEQ ID NO: 551048 - RNA, 22 nt, Human
uccucuaaccauuuuauaauga

SEQ ID NO: 551049 - RNA, 18 nt, Human
uccuuguccucagugacu

SEQ ID NO: 551050 - RNA, 21 nt, Human
ucggggagaaaaaaauuaaaa

SEQ ID NO: 551051 - RNA, 21 nt, Human
ucugcaauugagugcuccuuu

SEQ ID NO: 551052 - RNA, 23 nt, Human
ucugccuacaauauauacuacaa

SEQ ID NO: 551053 - RNA, 26 nt, Human
ucugguuuuauucccuggcaguauug

SEQ ID NO: 551054 - RNA, 20 nt, Human
ucuguagcuuuugucaugcc

SEQ ID NO: 551055 - RNA, 21 nt, Human
ucuguagcuuuugucaugcca

SEQ ID NO: 551056 - RNA, 20 nt, Human
ugaaaggcuuacaaacuguu

SEQ ID NO: 551057 - RNA, 19 nt, Human
ugaauuuccaugcugaccc

SEQ ID NO: 551058 - RNA, 18 nt, Human
ugacaaccuggcuucauc

SEQ ID NO: 551059 - RNA, 19 nt, Human
ugauugcaugugcugcucu

SEQ ID NO: 551060 - RNA, 24 nt, Human
ugcaauugagugcuccuuuaugcc

SEQ ID NO: 551061 - RNA, 26 nt, Human
ugccaaauguucugucuuaugacucu

SEQ ID NO: 551062 - RNA, 28 nt, Human
ugccuacaauauauacuacaaaccccuu

SEQ ID NO: 551063 - RNA, 21 nt, Human
uggaauuuucauaagcaauau

SEQ ID NO: 551064 - RNA, 23 nt, Human
uggaauuuucauaagcaauaucc

SEQ ID NO: 551065 - RNA, 20 nt, Human
uggcaguauugaggccuggc

SEQ ID NO: 551066 - RNA, 22 nt, Human
uggcggcugggacugggcuagg

SEQ ID NO: 551067 - RNA, 23 nt, Human
ugggguccgugacagggacaggc

SEQ ID NO: 551068 - RNA, 20 nt, Human
uggguuggguuaggaaaggg

SEQ ID NO: 551069 - RNA, 24 nt, Human
uggguuggguuaggaaagggcugg

SEQ ID NO: 551070 - RNA, 22 nt, Human
uguuucauaaggacaauuccug

SEQ ID NO: 551071 - RNA, 23 nt, Human
uuaaagugaacauacuuccuugc

SEQ ID NO: 551072 - RNA, 23 nt, Human
uuacuguaugcugcaggccuggg

SEQ ID NO: 551073 - RNA, 23 nt, Human
uuccaugcugacccucacagauc

SEQ ID NO: 551074 - RNA, 22 nt, Human
uucccuucuuuugcaaaugauc

SEQ ID NO: 551075 - RNA, 22 nt, Human
uuuaguuuccuuguccucagug

SEQ ID NO: 551076 - RNA, 22 nt, Human
uuuuaaauccuagcagguuuuu

SEQ ID NO: 551077 - RNA, 23 nt, Human
uuuuaaaugccauccauaugcca

SEQ ID NO: 551078 - RNA, 22 nt, Human
uuuuacaggacagauuuaaagu

SEQ ID NO: 551079 - RNA, 29 nt, Human
aaaaaagaaaacauuuucacacagaagag

SEQ ID NO: 551080 - RNA, 21 nt, Human
aaaauuuuucaaaccccaaau

SEQ ID NO: 551081 - RNA, 24 nt, Human
aacaccaaaguauaaaaaauuaaa

SEQ ID NO: 551082 - RNA, 23 nt, Human
aagaaaacauuuucacacagaag

SEQ ID NO: 551083 - RNA, 20 nt, Human
acgcagggcgucugccuccu

SEQ ID NO: 551084 - RNA, 24 nt, Human
agggcgucugccuccucccaccuu

SEQ ID NO: 551085 - RNA, 24 nt, Human
auaaugauaaaaauagauguaucc

SEQ ID NO: 551086 - RNA, 23 nt, Human
auuaaaaaaaaaaaaaaaggaau

SEQ ID NO: 551087 - RNA, 22 nt, Human
ccaaaguauaaaaaauuaaaaa

SEQ ID NO: 551088 - RNA, 22 nt, Human
ccacgcagggcgucugccuccu

SEQ ID NO: 551089 - RNA, 21 nt, Human
cgggggcggagcgcggccucc

SEQ ID NO: 551090 - RNA, 18 nt, Human
cuuugagaaauaaagaaa

SEQ ID NO: 551091 - RNA, 24 nt, Human
gagcaaaaucaacaugauuuggaa

SEQ ID NO: 551092 - RNA, 26 nt, Human
gccggccucggcguggacgccccgac

SEQ ID NO: 551093 - RNA, 24 nt, Human
uaaaaaauuaaaaaaaaaaaaaaa

SEQ ID NO: 551094 - RNA, 22 nt, Human
ucugccuccucccaccuuccgc

SEQ ID NO: 551095 - RNA, 20 nt, Human
ucuggacuaaacuauucagu

SEQ ID NO: 551096 - RNA, 24 nt, Human
ugauaaaaauagauguauccucug

SEQ ID NO: 551097 - RNA, 24 nt, Human
ugccggccucggcguggacgcccc

SEQ ID NO: 551098 - RNA, 23 nt, Human
uggaaaaggaauuuuaaaccuua

SEQ ID NO: 551099 - RNA, 24 nt, Human
aaccuaaccaagccagccugacag

SEQ ID NO: 551100 - RNA, 21 nt, Human
acggaccugcaggugccgagg

SEQ ID NO: 551101 - RNA, 24 nt, Human
agagaccccaaauccuuuagccaa

SEQ ID NO: 551102 - RNA, 18 nt, Human
agagaggugggggcagag

SEQ ID NO: 551103 - RNA, 21 nt, Human
agagauucccuauccucugcc

SEQ ID NO: 551104 - RNA, 22 nt, Human
agaucaagggggccugggagac

SEQ ID NO: 551105 - RNA, 18 nt, Human
aggaaggagagaccccaa

SEQ ID NO: 551106 - RNA, 21 nt, Human
agggagcuggagugggagcca

SEQ ID NO: 551107 - RNA, 24 nt, Human
aggugccgaggcugcgcgacggcc

SEQ ID NO: 551108 - RNA, 23 nt, Human
aggugggggcagaguacuaaggg

SEQ ID NO: 551109 - RNA, 22 nt, Human
agucaggggcgccagccgcggg

SEQ ID NO: 551110 - RNA, 18 nt, Human
cacccagggcggcuccgg

SEQ ID NO: 551111 - RNA, 21 nt, Human
cacuuccucuucuccuucugu

SEQ ID NO: 551112 - RNA, 19 nt, Human
caguaaaaccuaaccaagc

SEQ ID NO: 551113 - RNA, 19 nt, Human
ccacuuccucuucuccuuc

SEQ ID NO: 551114 - RNA, 21 nt, Human
ccagauccacuuccucuucuc

SEQ ID NO: 551115 - RNA, 26 nt, Human
ccucccuggccgggacggagucaggg

SEQ ID NO: 551116 - RNA, 21 nt, Human
ccuuuagccaaugaguggugg

SEQ ID NO: 551117 - RNA, 18 nt, Human
cggccggagcgugcgcgg

SEQ ID NO: 551118 - RNA, 20 nt, Human
cuauccucugccccaguaaa

SEQ ID NO: 551119 - RNA, 22 nt, Human
cucccaauuccagauccacuuc

SEQ ID NO: 551120 - RNA, 22 nt, Human
cuggccgggacggagucagggg

SEQ ID NO: 551121 - RNA, 19 nt, Human
cuuccucuucuccuucugu

SEQ ID NO: 551122 - RNA, 20 nt, Human
gagauucccuauccucugcc

SEQ ID NO: 551123 - RNA, 21 nt, Human
gccgcugacacccagggcggc

SEQ ID NO: 551124 - RNA, 18 nt, Human
gcgugcgcgggagccgag

SEQ ID NO: 551125 - RNA, 20 nt, Human
ggcuucauaaggaggaguca

SEQ ID NO: 551126 - RNA, 18 nt, Human
uaaagagaggugggggca

SEQ ID NO: 551127 - RNA, 21 nt, Human
uaaagagaggugggggcagaa

SEQ ID NO: 551128 - RNA, 25 nt, Human
ucccacaguaaagagaggugggggc

SEQ ID NO: 551129 - RNA, 20 nt, Human
ucccaugacucaggccucug

SEQ ID NO: 551130 - RNA, 22 nt, Human
ugacucaggccucugugcuagg

SEQ ID NO: 551131 - RNA, 20 nt, Human
ugagaugguuuucccacagu

SEQ ID NO: 551132 - RNA, 25 nt, Human
uggagugggagccaagggugguguu

SEQ ID NO: 551133 - RNA, 18 nt, Human
uggccgggacggagucag

SEQ ID NO: 551134 - RNA, 23 nt, Human
uuagauaggggugggguacagau

SEQ ID NO: 551135 - RNA, 24 nt, Human
aaaaaaaaaaaaaauagaaaaccu

SEQ ID NO: 551136 - RNA, 23 nt, Human
aaaaaaccauaccacaaaaggac

SEQ ID NO: 551137 - RNA, 21 nt, Human
aaaaaacuuaauccaauauac

SEQ ID NO: 551138 - RNA, 22 nt, Human
aaaaaccauaccacaaaaggac

SEQ ID NO: 551139 - RNA, 20 nt, Human
aaaaacccaaaacuaaacaa

SEQ ID NO: 551140 - RNA, 25 nt, Human
aaaacaaaacaaaacaaaaaaaaac

SEQ ID NO: 551141 - RNA, 25 nt, Human
aaaacuaaacaacaacaacaaaaac

SEQ ID NO: 551142 - RNA, 25 nt, Human
aaaaggacaggaagccugcagaaau

SEQ ID NO: 551143 - RNA, 23 nt, Human
aaaaguacuguucaacauuaaau

SEQ ID NO: 551144 - RNA, 19 nt, Human
aaacaaaacaaaacaaaaa

SEQ ID NO: 551145 - RNA, 25 nt, Human
aaacaaaacaaaacaaaaaaaaaca

SEQ ID NO: 551146 - RNA, 23 nt, Human
aaacaacaacaacaaaaaccucc

SEQ ID NO: 551147 - RNA, 21 nt, Human
aaacaaugcuuauaucacuaa

SEQ ID NO: 551148 - RNA, 21 nt, Human
aaacagacuagaauuucaagc

SEQ ID NO: 551149 - RNA, 21 nt, Human
aaacccaaaacuaaacaacaa

SEQ ID NO: 551150 - RNA, 23 nt, Human
aaacccaaaacuaaacaacaacc

SEQ ID NO: 551151 - RNA, 23 nt, Human
aaagguuuauggaagagggaaug

SEQ ID NO: 551152 - RNA, 22 nt, Human
aaauacugagugacuacaguac

SEQ ID NO: 551153 - RNA, 18 nt, Human
aacaaaaaaaaacaguca

SEQ ID NO: 551154 - RNA, 23 nt, Human
aacaacaaaaaccuccaggaaaa

SEQ ID NO: 551155 - RNA, 19 nt, Human
aacagguauauuacuugag

SEQ ID NO: 551156 - RNA, 20 nt, Human
aacagguauauuacuugagg

SEQ ID NO: 551157 - RNA, 20 nt, Human
aaccauuugaaucaggcuca

SEQ ID NO: 551158 - RNA, 24 nt, Human
aacuuaauccaauauaccagugag

SEQ ID NO: 551159 - RNA, 23 nt, Human
aagcaaaggauaaaaauucaagg

SEQ ID NO: 551160 - RNA, 23 nt, Human
aagcagaaaaaccauuugaauca

SEQ ID NO: 551161 - RNA, 23 nt, Human
aagccagugaaaauaaggccaaa

SEQ ID NO: 551162 - RNA, 22 nt, Human
aagugcauuauagggagcuuuu

SEQ ID NO: 551163 - RNA, 24 nt, Human
aauaaggccaaaaaaccauaccac

SEQ ID NO: 551164 - RNA, 19 nt, Human
aaugcaaagugcaaacagu

SEQ ID NO: 551165 - RNA, 21 nt, Human
aaugucuguucccuaggugac

SEQ ID NO: 551166 - RNA, 21 nt, Human
acaaaaaaaaacagucacaag

SEQ ID NO: 551167 - RNA, 21 nt, Human
acaaaacaaaaaaaaacaguc

SEQ ID NO: 551168 - RNA, 19 nt, Human
acaaaugaacacauuaaaa

SEQ ID NO: 551169 - RNA, 26 nt, Human
acaacaacaacaaaaaccuccaggaa

SEQ ID NO: 551170 - RNA, 19 nt, Human
acagagccaucucgaguuc

SEQ ID NO: 551171 - RNA, 20 nt, Human
acagaucuuaagauggauaa

SEQ ID NO: 551172 - RNA, 22 nt, Human
acaggaucuauuuagauuuaca

SEQ ID NO: 551173 - RNA, 19 nt, Human
accauaacaccuuaaagca

SEQ ID NO: 551174 - RNA, 23 nt, Human
accccgcgccgggacccuuccgc

SEQ ID NO: 551175 - RNA, 22 nt, Human
accccgcuuucaccuacuccuc

SEQ ID NO: 551176 - RNA, 20 nt, Human
accucuuaccacacaaagug

SEQ ID NO: 551177 - RNA, 21 nt, Human
agaauaucacugacgcucaaa

SEQ ID NO: 551178 - RNA, 19 nt, Human
agagugucacaaagugaaa

SEQ ID NO: 551179 - RNA, 23 nt, Human
auaaagcagaaaaaccauuugaa

SEQ ID NO: 551180 - RNA, 22 nt, Human
augagacuaaggcaagcaucac

SEQ ID NO: 551181 - RNA, 25 nt, Human
auuagguauuucaagaacaguaccg

SEQ ID NO: 551182 - RNA, 24 nt, Human
auucaugagacuaaggcaagcauc

SEQ ID NO: 551183 - RNA, 21 nt, Human
auugcauuaacaggaaaaaac

SEQ ID NO: 551184 - RNA, 24 nt, Human
caaaaaaccauaccacaaaaggac

SEQ ID NO: 551185 - RNA, 23 nt, Human
caaaaacaaggcaugaauauuca

SEQ ID NO: 551186 - RNA, 23 nt, Human
caaaaggacaggaagccugcaga

SEQ ID NO: 551187 - RNA, 24 nt, Human
caacaacaaaaaccuccaggaaaa

SEQ ID NO: 551188 - RNA, 25 nt, Human
caacaacaaaaaccuccaggaaaaa

SEQ ID NO: 551189 - RNA, 25 nt, Human
caagacauauauacauuaaaaacaa

SEQ ID NO: 551190 - RNA, 23 nt, Human
caagcaucacucaucagaaauac

SEQ ID NO: 551191 - RNA, 19 nt, Human
caaguaacagccaagucag

SEQ ID NO: 551192 - RNA, 21 nt, Human
cacacaaaaacaaaacaaaac

SEQ ID NO: 551193 - RNA, 30 nt, Human
cacacaaaaacaaaacaaaacaaaaaaaag

SEQ ID NO: 551194 - RNA, 21 nt, Human
cacacacacaaaaacaaaaca

SEQ ID NO: 551195 - RNA, 22 nt, Human
cacacacacaaaaacaaaacaa

SEQ ID NO: 551196 - RNA, 24 nt, Human
cacacacacaaaaacaaaacaaaa

SEQ ID NO: 551197 - RNA, 21 nt, Human
cacacacacacaaaaacaaaa

SEQ ID NO: 551198 - RNA, 26 nt, Human
cacacacacacaaaaacaaaacaaaa

SEQ ID NO: 551199 - RNA, 20 nt, Human
caccacauuuuccccaacca

SEQ ID NO: 551200 - RNA, 22 nt, Human
caccccgcuuucaccuacuccu

SEQ ID NO: 551201 - RNA, 19 nt, Human
caccugaaaagggaugacu

SEQ ID NO: 551202 - RNA, 19 nt, Human
cagaaaagaauauaggaau

SEQ ID NO: 551203 - RNA, 18 nt, Human
caggggaggggagggaag

SEQ ID NO: 551204 - RNA, 24 nt, Human
cagugccacacacacacacacaaa

SEQ ID NO: 551205 - RNA, 22 nt, Human
caguuguuacuugauugucucc

SEQ ID NO: 551206 - RNA, 22 nt, Human
caugagacuaaggcaagcauca

SEQ ID NO: 551207 - RNA, 19 nt, Human
ccaaaacuaaacaacaaca

SEQ ID NO: 551208 - RNA, 21 nt, Human
ccagugaaaauaaggccaaaa

SEQ ID NO: 551209 - RNA, 27 nt, Human
ccagugccacacacacacacacaaaaa

SEQ ID NO: 551210 - RNA, 23 nt, Human
ccauuagguauuucaagaacagu

SEQ ID NO: 551211 - RNA, 24 nt, Human
cccagugccacacacacacacaca

SEQ ID NO: 551212 - RNA, 20 nt, Human
cccaucacauccaacaggau

SEQ ID NO: 551213 - RNA, 23 nt, Human
ccccgcgccgagaccccaggccc

SEQ ID NO: 551214 - RNA, 28 nt, Human
ccccgcgccgggacccuuccgccccucc

SEQ ID NO: 551215 - RNA, 19 nt, Human
ccccgcgcgccucuggccg

SEQ ID NO: 551216 - RNA, 21 nt, Human
ccccgcgcgccucuggccgcg

SEQ ID NO: 551217 - RNA, 25 nt, Human
ccccgcuuucaccuacuccuccuuc

SEQ ID NO: 551218 - RNA, 24 nt, Human
cccgcgccgagaccccaggccgga

SEQ ID NO: 551219 - RNA, 26 nt, Human
cccgcgccgagaccccaggccggagc

SEQ ID NO: 551220 - RNA, 21 nt, Human
cccgcgccgcgcuccucacca

SEQ ID NO: 551221 - RNA, 18 nt, Human
cccgcgcgccucuggccg

SEQ ID NO: 551222 - RNA, 18 nt, Human
cccuucccuccgcucccc

SEQ ID NO: 551223 - RNA, 25 nt, Human
ccgagaccccaggccggagcgcagg

SEQ ID NO: 551224 - RNA, 19 nt, Human
ccgcgccgcgcuccucacc

SEQ ID NO: 551225 - RNA, 19 nt, Human
cgccgagaccccaggccgg

SEQ ID NO: 551226 - RNA, 19 nt, Human
cgccgcgcucacccgcggc

SEQ ID NO: 551227 - RNA, 18 nt, Human
cgccgggacccuuccgcc

SEQ ID NO: 551228 - RNA, 18 nt, Human
cgggacccuuccgccccu

SEQ ID NO: 551229 - RNA, 19 nt, Human
cgucccuucccuccgcucc

SEQ ID NO: 551230 - RNA, 19 nt, Human
cuccccgcgccgagacccc

SEQ ID NO: 551231 - RNA, 24 nt, Human
cucgaaccguuuacaucagcgaau

SEQ ID NO: 551232 - RNA, 22 nt, Human
cuggccgcggcacccgaccagg

SEQ ID NO: 551233 - RNA, 22 nt, Human
cugugcuguuuccuaagaucaa

SEQ ID NO: 551234 - RNA, 21 nt, Human
gaaaagaauauaggaauagaa

SEQ ID NO: 551235 - RNA, 22 nt, Human
gaaacaagaaaacaaauacugu

SEQ ID NO: 551236 - RNA, 20 nt, Human
gaauagaagaggaaaucaug

SEQ ID NO: 551237 - RNA, 20 nt, Human
gaauuuugucagauaugguu

SEQ ID NO: 551238 - RNA, 23 nt, Human
gagacggcggcagcggcgggaga

SEQ ID NO: 551239 - RNA, 18 nt, Human
gcaaggaugagaccaggc

SEQ ID NO: 551240 - RNA, 23 nt, Human
gcagcccucgccucaccccgcgc

SEQ ID NO: 551241 - RNA, 21 nt, Human
gccgagaccccaggccggagc

SEQ ID NO: 551242 - RNA, 23 nt, Human
ggaaaaguauauucucuguguac

SEQ ID NO: 551243 - RNA, 19 nt, Human
ggacaggaagccugcagaa

SEQ ID NO: 551244 - RNA, 23 nt, Human
ggacaggaagccugcagaaauaa

SEQ ID NO: 551245 - RNA, 20 nt, Human
ggacuucaaguucagaaccc

SEQ ID NO: 551246 - RNA, 19 nt, Human
ggagacggcggcagcggcg

SEQ ID NO: 551247 - RNA, 18 nt, Human
ggagauggggagaggcaa

SEQ ID NO: 551248 - RNA, 19 nt, Human
ggaggggagggaaggaagc

SEQ ID NO: 551249 - RNA, 23 nt, Human
ggccaaaaaaccauaccacaaaa

SEQ ID NO: 551250 - RNA, 27 nt, Human
gggcaaagguguuuaagcuuugucacc

SEQ ID NO: 551251 - RNA, 21 nt, Human
gguggcucaggccaacagaag

SEQ ID NO: 551252 - RNA, 19 nt, Human
guaaaaagcagcaucaucu

SEQ ID NO: 551253 - RNA, 19 nt, Human
guggaacacgcaaggauga

SEQ ID NO: 551254 - RNA, 19 nt, Human
gugggucauguuuacagua

SEQ ID NO: 551255 - RNA, 24 nt, Human
uaaaaaaaaaaaaacccaaaacua

SEQ ID NO: 551256 - RNA, 21 nt, Human
uaaaaaaaaaaggccaugugc

SEQ ID NO: 551257 - RNA, 23 nt, Human
uaaaaacaaaugaacacauuaaa

SEQ ID NO: 551258 - RNA, 21 nt, Human
uaaaagcauuuuaauaaccac

SEQ ID NO: 551259 - RNA, 19 nt, Human
uaaaauaccuugagacuca

SEQ ID NO: 551260 - RNA, 19 nt, Human
uaaacaacaacaacaaaaa

SEQ ID NO: 551261 - RNA, 22 nt, Human
uaaacacaagaauggggcaaga

SEQ ID NO: 551262 - RNA, 20 nt, Human
uaaagcagaaaaaccauuug

SEQ ID NO: 551263 - RNA, 25 nt, Human
uaaagcagaaaaaccauuugaauca

SEQ ID NO: 551264 - RNA, 26 nt, Human
uaaagcagaaaaaccauuugaaucag

SEQ ID NO: 551265 - RNA, 28 nt, Human
uaaauguaguaaaaaaaaaaaaaaaaaa

SEQ ID NO: 551266 - RNA, 19 nt, Human
uaacugugccaccauaaca

SEQ ID NO: 551267 - RNA, 22 nt, Human
uaaggccaaaaaaccauaccac

SEQ ID NO: 551268 - RNA, 22 nt, Human
uacaagucagaaaaucccagcu

SEQ ID NO: 551269 - RNA, 19 nt, Human
uacagcauuuaauaaagua

SEQ ID NO: 551270 - RNA, 18 nt, Human
uaccacaaaaggacagga

SEQ ID NO: 551271 - RNA, 19 nt, Human
uaccacaaaaggacaggaa

SEQ ID NO: 551272 - RNA, 26 nt, Human
uaccucagucaccacauuuuccccaa

SEQ ID NO: 551273 - RNA, 24 nt, Human
uacucaaaccucuuaccacacaaa

SEQ ID NO: 551274 - RNA, 19 nt, Human
uaguaaaaaaaaaaaaaaa

SEQ ID NO: 551275 - RNA, 24 nt, Human
uaguauaaggaaaagcuacaaacc

SEQ ID NO: 551276 - RNA, 22 nt, Human
uauacacaauuaacacaagaau

SEQ ID NO: 551277 - RNA, 20 nt, Human
uauauguuugugaauguaua

SEQ ID NO: 551278 - RNA, 19 nt, Human
uaucaaaaacaaggcauga

SEQ ID NO: 551279 - RNA, 18 nt, Human
uauuucaagaacaguacc

SEQ ID NO: 551280 - RNA, 21 nt, Human
ucagaaaaucccagcuacaga

SEQ ID NO: 551281 - RNA, 25 nt, Human
ucagaaauacucaaacauuuuauaa

SEQ ID NO: 551282 - RNA, 22 nt, Human
ucaguguaauuuuaugaaaccu

SEQ ID NO: 551283 - RNA, 24 nt, Human
ucauauggugagcugcucaugucg

SEQ ID NO: 551284 - RNA, 19 nt, Human
ucaucagaaauacucaaac

SEQ ID NO: 551285 - RNA, 18 nt, Human
ucccauugcaaauaaagu

SEQ ID NO: 551286 - RNA, 19 nt, Human
uccccgcgccgagaccccc

SEQ ID NO: 551287 - RNA, 19 nt, Human
ucccuuagaagccuucaac

SEQ ID NO: 551288 - RNA, 20 nt, Human
ucccuuagaagccuucaacu

SEQ ID NO: 551289 - RNA, 18 nt, Human
uccgccccucaccccgcu

SEQ ID NO: 551290 - RNA, 19 nt, Human
uccuaagaucaaguaacag

SEQ ID NO: 551291 - RNA, 20 nt, Human
uccuccuucgucccuucccu

SEQ ID NO: 551292 - RNA, 22 nt, Human
ucgccgcgcucacccgcggcuc

SEQ ID NO: 551293 - RNA, 23 nt, Human
ucucuaggugacaaugcagagcc

SEQ ID NO: 551294 - RNA, 26 nt, Human
ucuggagauggggagaggcaagugug

SEQ ID NO: 551295 - RNA, 25 nt, Human
ucuggccgcggcacccgaccaggag

SEQ ID NO: 551296 - RNA, 23 nt, Human
ugaaaaagcaaucccccugcuca

SEQ ID NO: 551297 - RNA, 24 nt, Human
ugacugcauuaauauaugugcuuu

SEQ ID NO: 551298 - RNA, 23 nt, Human
ugagcaagacauauauacauuaa

SEQ ID NO: 551299 - RNA, 21 nt, Human
ugccacacacacacacacaaa

SEQ ID NO: 551300 - RNA, 23 nt, Human
ugccacaguugacuuuaaaagca

SEQ ID NO: 551301 - RNA, 18 nt, Human
uggagauggggagaggca

SEQ ID NO: 551302 - RNA, 23 nt, Human
ugguggcucaggccaacagaagu

SEQ ID NO: 551303 - RNA, 23 nt, Human
uguauuaaaaauaguguucuaca

SEQ ID NO: 551304 - RNA, 18 nt, Human
uuacaguauucccuuaga

SEQ ID NO: 551305 - RNA, 20 nt, Human
uuacugcauuaauucuucac

SEQ ID NO: 551306 - RNA, 22 nt, Human
uucaaguucagaaccaaaaagc

SEQ ID NO: 551307 - RNA, 18 nt, Human
uucaaugaaugaaaucac

SEQ ID NO: 551308 - RNA, 19 nt, Human
uucaaugaaugaaaucacg

SEQ ID NO: 551309 - RNA, 23 nt, Human
uucagaaccaaaaagcagagaau

SEQ ID NO: 551310 - RNA, 24 nt, Human
uucagaaccaaaaagcagagaauc

SEQ ID NO: 551311 - RNA, 19 nt, Human
uucaucuggaaaguaaagu

SEQ ID NO: 551312 - RNA, 23 nt, Human
uugaggaaaaguauauucucugu

SEQ ID NO: 551313 - RNA, 19 nt, Human
uuuaauuucucugaagugc

SEQ ID NO: 551314 - RNA, 26 nt, Human
uuuauggaaaacugaaaugaaaaauu

SEQ ID NO: 551315 - RNA, 20 nt, Human
uuucaguuguuacuugauug

SEQ ID NO: 551316 - RNA, 23 nt, Human
uuuccacauccauauauguuuua

SEQ ID NO: 551317 - RNA, 18 nt, Human
uuugucagauaugguuac

SEQ ID NO: 551318 - RNA, 18 nt, Human
uuuugcaguuuagggacc

SEQ ID NO: 551319 - RNA, 23 nt, Human
aaaaaaaaaaaaaaagcacaauu

SEQ ID NO: 551320 - RNA, 22 nt, Human
aaaaaaaaaaagcacaauuaaa

SEQ ID NO: 551321 - RNA, 32 nt, Human
aaaaaaaaaaagcacaauuaaauucuagaggg

SEQ ID NO: 551322 - RNA, 26 nt, Human
aaacaaaaccuaacagcuuaugcagc

SEQ ID NO: 551323 - RNA, 23 nt, Human
aaagccaaaaaaaaaaaaaaagc

SEQ ID NO: 551324 - RNA, 21 nt, Human
aaggaagggcuaaauauuuua

SEQ ID NO: 551325 - RNA, 20 nt, Human
acacacacauuuaacaaauc

SEQ ID NO: 551326 - RNA, 19 nt, Human
accuucauacacacacaaa

SEQ ID NO: 551327 - RNA, 21 nt, Human
acgaaaauagagccuucucuc

SEQ ID NO: 551328 - RNA, 26 nt, Human
acucuguuggccaacuucaagaauaa

SEQ ID NO: 551329 - RNA, 19 nt, Human
agccaaaaaaaaaaaaaaa

SEQ ID NO: 551330 - RNA, 18 nt, Human
auagagccuucucucaga

SEQ ID NO: 551331 - RNA, 20 nt, Human
auagagccuucucucagaaa

SEQ ID NO: 551332 - RNA, 24 nt, Human
caaagccaaaaaaaaaaaaaaagc

SEQ ID NO: 551333 - RNA, 26 nt, Human
caaagccaaaaaaaaaaaaaaagcac

SEQ ID NO: 551334 - RNA, 19 nt, Human
caaggaagggcuaaauauu

SEQ ID NO: 551335 - RNA, 22 nt, Human
cacacaaaccaccaguggguaa

SEQ ID NO: 551336 - RNA, 23 nt, Human
cacacauucacaacucuguuggc

SEQ ID NO: 551337 - RNA, 25 nt, Human
cacccccuccccaucuucuccugcu

SEQ ID NO: 551338 - RNA, 24 nt, Human
ccaaagccaaaaaaaaaaaaaaag

SEQ ID NO: 551339 - RNA, 26 nt, Human
ccaaagccaaaaaaaaaaaaaaagca

SEQ ID NO: 551340 - RNA, 24 nt, Human
cccaaagccaaaaaaaaaaaaaaa

SEQ ID NO: 551341 - RNA, 21 nt, Human
cccacucccacccccucccca

SEQ ID NO: 551342 - RNA, 25 nt, Human
cccuccccaucuucuccugcucuua

SEQ ID NO: 551343 - RNA, 23 nt, Human
cccucuguugcucauuuuuugac

SEQ ID NO: 551344 - RNA, 19 nt, Human
ccuaugccccagaaccguc

SEQ ID NO: 551345 - RNA, 24 nt, Human
ccuccggcucggcucuccagucgu

SEQ ID NO: 551346 - RNA, 22 nt, Human
cuaccaaggaagggcuaaauau

SEQ ID NO: 551347 - RNA, 22 nt, Human
cuaccuaccaaggaagggcuaa

SEQ ID NO: 551348 - RNA, 22 nt, Human
cucuccagucguggucuuugcu

SEQ ID NO: 551349 - RNA, 24 nt, Human
gaaaauagagccuucucucagaaa

SEQ ID NO: 551350 - RNA, 22 nt, Human
gaacaauaauaaacauguccuu

SEQ ID NO: 551351 - RNA, 22 nt, Human
gccccagaaccguccuucagau

SEQ ID NO: 551352 - RNA, 18 nt, Human
gggcuaaauauuuuauuu

SEQ ID NO: 551353 - RNA, 19 nt, Human
gucuucagcuuugccuagc

SEQ ID NO: 551354 - RNA, 19 nt, Human
uaaaacaaaaccuaacagc

SEQ ID NO: 551355 - RNA, 23 nt, Human
uaaaauacuucugagauauuucc

SEQ ID NO: 551356 - RNA, 23 nt, Human
uaacccgggaacuacaucagcag

SEQ ID NO: 551357 - RNA, 22 nt, Human
uaauaaauuuaucaugccucag

SEQ ID NO: 551358 - RNA, 30 nt, Human
uauacacacacauuuaacaaaucuacaugg

SEQ ID NO: 551359 - RNA, 22 nt, Human
ucacugcggucuucagcuuugc

SEQ ID NO: 551360 - RNA, 24 nt, Human
ucagcagccuuuugaaauugcucu

SEQ ID NO: 551361 - RNA, 22 nt, Human
uccauaagcuucaaacaucuua

SEQ ID NO: 551362 - RNA, 21 nt, Human
ucccaaagccaaaaaaaaaaa

SEQ ID NO: 551363 - RNA, 25 nt, Human
ucccaaagccaaaaaaaaaaaaaaa

SEQ ID NO: 551364 - RNA, 27 nt, Human
ucccaaagccaaaaaaaaaaaaaaagc

SEQ ID NO: 551365 - RNA, 18 nt, Human
ucccacccccuccccauc

SEQ ID NO: 551366 - RNA, 19 nt, Human
ucuguuggccaacuucaag

SEQ ID NO: 551367 - RNA, 24 nt, Human
ucuuaagucuucauuccauauccc

SEQ ID NO: 551368 - RNA, 23 nt, Human
ugaacaauaauaaacauguccuu

SEQ ID NO: 551369 - RNA, 24 nt, Human
uggauguuauggauuguaaguauc

SEQ ID NO: 551370 - RNA, 22 nt, Human
uggccaacuucaagaauaaaau

SEQ ID NO: 551371 - RNA, 18 nt, Human
ugguuguuuuauuuugac

SEQ ID NO: 551372 - RNA, 24 nt, Human
uguaagauuaccuaaauugcauuu

SEQ ID NO: 551373 - RNA, 21 nt, Human
uguguguugaacaaucacgaa

SEQ ID NO: 551374 - RNA, 18 nt, Human
uguguuuccuaugcccca

SEQ ID NO: 551375 - RNA, 18 nt, Human
uuaaaacaaaaccuaaca

SEQ ID NO: 551376 - RNA, 23 nt, Human
uucaaauauacuccuaauuccac

SEQ ID NO: 551377 - RNA, 23 nt, Human
uucccacucccacccccucccca

SEQ ID NO: 551378 - RNA, 18 nt, Human
uucccagcugccuccggc

SEQ ID NO: 551379 - RNA, 19 nt, Human
uugccuagcucccucuuug

SEQ ID NO: 551380 - RNA, 21 nt, Human
uuggccaacuucaagaauaaa

SEQ ID NO: 551381 - RNA, 23 nt, Human
uuuaaaacaaaaccuaacagcuu

SEQ ID NO: 551382 - RNA, 18 nt, Human
uuugacauuuuuugaaau

SEQ ID NO: 551383 - RNA, 24 nt, Human
uuuucuggauccaccaugcaucac

SEQ ID NO: 551384 - RNA, 20 nt, Human
aaaagcgacggcaguguucc

SEQ ID NO: 551385 - RNA, 23 nt, Human
aaaccagcuggaggguuggacag

SEQ ID NO: 551386 - RNA, 21 nt, Human
aacagggcuucugcccccuuc

SEQ ID NO: 551387 - RNA, 20 nt, Human
aagcagagaaaagcugcccc

SEQ ID NO: 551388 - RNA, 22 nt, Human
acucuucagccuccuucuggcu

SEQ ID NO: 551389 - RNA, 24 nt, Human
acuuuaaaagaguuauccuaagga

SEQ ID NO: 551390 - RNA, 21 nt, Human
agaagagcucccucucucacc

SEQ ID NO: 551391 - RNA, 21 nt, Human
agaccauggccacuggcauca

SEQ ID NO: 551392 - RNA, 19 nt, Human
agagcucccucucucaccc

SEQ ID NO: 551393 - RNA, 18 nt, Human
agcaaggcggaguguggc

SEQ ID NO: 551394 - RNA, 23 nt, Human
aggcagagggcccucuggggaga

SEQ ID NO: 551395 - RNA, 20 nt, Human
aggcauggaggggcugagca

SEQ ID NO: 551396 - RNA, 20 nt, Human
aggggcugagcaaggcggag

SEQ ID NO: 551397 - RNA, 24 nt, Human
agucgggcagcaacucuucagccu

SEQ ID NO: 551398 - RNA, 21 nt, Human
auaaaacacuggggaaaauca

SEQ ID NO: 551399 - RNA, 18 nt, Human
caaacacaaaacagcuca

SEQ ID NO: 551400 - RNA, 19 nt, Human
caacagggcuucugccccc

SEQ ID NO: 551401 - RNA, 20 nt, Human
caaggugagcuccaagaggc

SEQ ID NO: 551402 - RNA, 21 nt, Human
cacccccaccuucaagucggg

SEQ ID NO: 551403 - RNA, 25 nt, Human
cacugccugagguccuuccuccccg

SEQ ID NO: 551404 - RNA, 23 nt, Human
cacuuuaaaagaguuauccuaag

SEQ ID NO: 551405 - RNA, 19 nt, Human
cagagcucgcccucuuucc

SEQ ID NO: 551406 - RNA, 23 nt, Human
cagagcucgcccucuuuccuagg

SEQ ID NO: 551407 - RNA, 20 nt, Human
cagggcuucugcccccuucc

SEQ ID NO: 551408 - RNA, 24 nt, Human
cauggaggggcugagcaaggcgga

SEQ ID NO: 551409 - RNA, 24 nt, Human
cccagaagagcucccucucucacc

SEQ ID NO: 551410 - RNA, 19 nt, Human
cccccagcugacauagcug

SEQ ID NO: 551411 - RNA, 21 nt, Human
cccgaccugcagcagcuuaac

SEQ ID NO: 551412 - RNA, 23 nt, Human
cccucuggggagaaagaagccca

SEQ ID NO: 551413 - RNA, 21 nt, Human
ccgagccaggcagcaccccca

SEQ ID NO: 551414 - RNA, 19 nt, Human
ccucuggggagaaagaagc

SEQ ID NO: 551415 - RNA, 23 nt, Human
ccugcagcagcuuaacccccagc

SEQ ID NO: 551416 - RNA, 21 nt, Human
ccuuagguaacugugagccuu

SEQ ID NO: 551417 - RNA, 23 nt, Human
ccuugaucagaagcuuggccacu

SEQ ID NO: 551418 - RNA, 26 nt, Human
cgaccugcagcagcuuaacccccagc

SEQ ID NO: 551419 - RNA, 21 nt, Human
cgccccagagcucgcccucuu

SEQ ID NO: 551420 - RNA, 20 nt, Human
cuaggggcuagauugguguu

SEQ ID NO: 551421 - RNA, 22 nt, Human
cucauaguccuggggagcagcc

SEQ ID NO: 551422 - RNA, 21 nt, Human
cucccucucucacccaccaag

SEQ ID NO: 551423 - RNA, 26 nt, Human
cucucacccaccaaggcucugaucac

SEQ ID NO: 551424 - RNA, 22 nt, Human
cucuggggagaaagaagcccag

SEQ ID NO: 551425 - RNA, 20 nt, Human
cugugagccuucuccacugc

SEQ ID NO: 551426 - RNA, 21 nt, Human
gaccugcagcagcuuaacccc

SEQ ID NO: 551427 - RNA, 22 nt, Human
gagaaagaagcccagaagagcu

SEQ ID NO: 551428 - RNA, 18 nt, Human
gagcucccucucucaccc

SEQ ID NO: 551429 - RNA, 19 nt, Human
gcagagucccaaaguugac

SEQ ID NO: 551430 - RNA, 19 nt, Human
gcagcagcuuaacccccag

SEQ ID NO: 551431 - RNA, 19 nt, Human
gcggaguguggccucuggg

SEQ ID NO: 551432 - RNA, 20 nt, Human
gcggaguguggccucugggc

SEQ ID NO: 551433 - RNA, 19 nt, Human
ggaggggcugagcaaggcg

SEQ ID NO: 551434 - RNA, 23 nt, Human
ggccagcucugccagcuccagca

SEQ ID NO: 551435 - RNA, 22 nt, Human
gggcagcaacucuucagccucc

SEQ ID NO: 551436 - RNA, 22 nt, Human
uaagacaaagagaauucguucc

SEQ ID NO: 551437 - RNA, 23 nt, Human
uagcagagucccaaaguugacuc

SEQ ID NO: 551438 - RNA, 21 nt, Human
uagcaucaauaagacagcucc

SEQ ID NO: 551439 - RNA, 22 nt, Human
uccaaagcagagaaaagcugcc

SEQ ID NO: 551440 - RNA, 24 nt, Human
uccaaagcagagaaaagcugcccc

SEQ ID NO: 551441 - RNA, 21 nt, Human
uccaaggugagcuccaagagg

SEQ ID NO: 551442 - RNA, 27 nt, Human
uccaaggugagcuccaagaggcagagg

SEQ ID NO: 551443 - RNA, 23 nt, Human
ucccaaaguugacucuuuugaag

SEQ ID NO: 551444 - RNA, 18 nt, Human
ucuucagccuccuucugg

SEQ ID NO: 551445 - RNA, 19 nt, Human
ugacaccggagagcgcccc

SEQ ID NO: 551446 - RNA, 22 nt, Human
ugagcuccaagaggcagagggc

SEQ ID NO: 551447 - RNA, 19 nt, Human
ugauggcuuugucauggug

SEQ ID NO: 551448 - RNA, 18 nt, Human
ugcucaggacagcugaug

SEQ ID NO: 551449 - RNA, 20 nt, Human
uggagagcaggucaucuagg

SEQ ID NO: 551450 - RNA, 18 nt, Human
ugggaaaaccagcuggag

SEQ ID NO: 551451 - RNA, 19 nt, Human
ugucaugguggcggcucca

SEQ ID NO: 551452 - RNA, 20 nt, Human
uuagcagucagcugcugguu

SEQ ID NO: 551453 - RNA, 19 nt, Human
uucaagucgggcagcaacu

SEQ ID NO: 551454 - RNA, 20 nt, Human
uuggagaagcaaagugagga

SEQ ID NO: 551455 - RNA, 20 nt, Human
uuugaagcuccucaugacac

SEQ ID NO: 551456 - RNA, 19 nt, Human
aaaugucgaggucuuaacu

SEQ ID NO: 551457 - RNA, 18 nt, Human
acagaugcagaaagcaag

SEQ ID NO: 551458 - RNA, 19 nt, Human
agagaugaucacaaauuuc

SEQ ID NO: 551459 - RNA, 18 nt, Human
agauauuaucauuuccac

SEQ ID NO: 551460 - RNA, 18 nt, Human
agcacuuucucagucucu

SEQ ID NO: 551461 - RNA, 20 nt, Human
agggauaacugcaucuuuug

SEQ ID NO: 551462 - RNA, 21 nt, Human
caccuucacaacuagaaacga

SEQ ID NO: 551463 - RNA, 24 nt, Human
caccuucacaacuagaaacgacuc

SEQ ID NO: 551464 - RNA, 26 nt, Human
cagaacucagcccuuggacacccucu

SEQ ID NO: 551465 - RNA, 18 nt, Human
cagcaucaucuucugcua

SEQ ID NO: 551466 - RNA, 24 nt, Human
cauuuccacuuuacagaugcagaa

SEQ ID NO: 551467 - RNA, 19 nt, Human
cgaggaaguuccuuuuuuc

SEQ ID NO: 551468 - RNA, 18 nt, Human
cucagcaucaucuucugc

SEQ ID NO: 551469 - RNA, 22 nt, Human
cuggcuucugcuucucagcauc

SEQ ID NO: 551470 - RNA, 20 nt, Human
gcuggcuucugcuucucagc

SEQ ID NO: 551471 - RNA, 20 nt, Human
ggaaguuccuuuuuucuuuu

SEQ ID NO: 551472 - RNA, 20 nt, Human
uacauucacucucuugguga

SEQ ID NO: 551473 - RNA, 25 nt, Human
uacauucacucucuuggugaccuca

SEQ ID NO: 551474 - RNA, 22 nt, Human
uauuuaauucuuccaggaauca

SEQ ID NO: 551475 - RNA, 27 nt, Human
ucacaacuagaaacgaccaguaacgac

SEQ ID NO: 551476 - RNA, 18 nt, Human
ucacaacuagaaacgacu

SEQ ID NO: 551477 - RNA, 23 nt, Human
ucgaggucuuaacugcuuuaguu

SEQ ID NO: 551478 - RNA, 21 nt, Human
ugaaguaucucagaacucagc

SEQ ID NO: 551479 - RNA, 20 nt, Human
ugacagagcucagucaugca

SEQ ID NO: 551480 - RNA, 22 nt, Human
ugacagagcucagucaugcaga

SEQ ID NO: 551481 - RNA, 24 nt, Human
ugugagcaaaugucgaggucuuaa

SEQ ID NO: 551482 - RNA, 21 nt, Human
uucaccaccagcacuuucuca

SEQ ID NO: 551483 - RNA, 23 nt, Human
aaacauacuccauauccagaaaa

SEQ ID NO: 551484 - RNA, 24 nt, Human
aaagugcugggaccacaggcauga

SEQ ID NO: 551485 - RNA, 25 nt, Human
aacaagagcaggagagagaagaaaa

SEQ ID NO: 551486 - RNA, 22 nt, Human
aacccccgaccucaggcgaucc

SEQ ID NO: 551487 - RNA, 20 nt, Human
aaccuccgccucccaggcuc

SEQ ID NO: 551488 - RNA, 25 nt, Human
aagaaaacauuuacauucuauaaca

SEQ ID NO: 551489 - RNA, 18 nt, Human
aagaauugagauagauga

SEQ ID NO: 551490 - RNA, 26 nt, Human
aagugcugggaccacaggcaugagcc

SEQ ID NO: 551491 - RNA, 19 nt, Human
acauucuauaacaugauua

SEQ ID NO: 551492 - RNA, 24 nt, Human
acuccguugcccagccuggagugc

SEQ ID NO: 551493 - RNA, 19 nt, Human
agcaaaacauacuccauau

SEQ ID NO: 551494 - RNA, 25 nt, Human
agcaaaacauacuccauauccagaa

SEQ ID NO: 551495 - RNA, 20 nt, Human
agcgaauucuccuaccucaa

SEQ ID NO: 551496 - RNA, 18 nt, Human
aggcagcagcccagggca

SEQ ID NO: 551497 - RNA, 18 nt, Human
aggcagcagcccagggca

SEQ ID NO: 551498 - RNA, 23 nt, Human
aggcaugcaccaccaaacccaac

SEQ ID NO: 551499 - RNA, 24 nt, Human
aggcgauccacccaccucagccuc

SEQ ID NO: 551500 - RNA, 24 nt, Human
agugcaauggcacgaucucggcuc

SEQ ID NO: 551501 - RNA, 21 nt, Human
agugcaguggcgcgaucauag

SEQ ID NO: 551502 - RNA, 23 nt, Human
agugcaguggcgcgaucauagcu

SEQ ID NO: 551503 - RNA, 24 nt, Human
agugcaguggcgcgaucauagcuc

SEQ ID NO: 551504 - RNA, 18 nt, Human
auagcucaccgcagccuc

SEQ ID NO: 551505 - RNA, 23 nt, Human
auaucuguaaacuugaacaccaa

SEQ ID NO: 551506 - RNA, 19 nt, Human
auccaggcuggagugcaau

SEQ ID NO: 551507 - RNA, 19 nt, Human
augaaaaacaacaucuuug

SEQ ID NO: 551508 - RNA, 24 nt, Human
caaagugcugggaccacaggcaug

SEQ ID NO: 551509 - RNA, 23 nt, Human
caaccuccgccucccaggcucaa

SEQ ID NO: 551510 - RNA, 24 nt, Human
caacucuggcugauuuaacagucu

SEQ ID NO: 551511 - RNA, 22 nt, Human
caagacagggucucacuccguu

SEQ ID NO: 551512 - RNA, 19 nt, Human
caccaacucuggcugauuu

SEQ ID NO: 551513 - RNA, 18 nt, Human
caccacacccagcuuugc

SEQ ID NO: 551514 - RNA, 18 nt, Human
caccacgcuggccaggcc

SEQ ID NO: 551515 - RNA, 21 nt, Human
caccacgcuggccaggccggu

SEQ ID NO: 551516 - RNA, 27 nt, Human
caccacgcuggccaggccggucucaaa

SEQ ID NO: 551517 - RNA, 22 nt, Human
cacccaccucagccucccaaag

SEQ ID NO: 551518 - RNA, 23 nt, Human
cacccaccucagccucccaaagu

SEQ ID NO: 551519 - RNA, 20 nt, Human
caccgcagccucaaucuccc

SEQ ID NO: 551520 - RNA, 24 nt, Human
caccucagccucccaaagugcugg

SEQ ID NO: 551521 - RNA, 24 nt, Human
cacgcuggccaggccggucucaaa

SEQ ID NO: 551522 - RNA, 24 nt, Human
cacuccguugcccagccuggagug

SEQ ID NO: 551523 - RNA, 24 nt, Human
cacucuugucauccaggcuggagu

SEQ ID NO: 551524 - RNA, 21 nt, Human
cacugcaaccuccgccuccca

SEQ ID NO: 551525 - RNA, 26 nt, Human
cagcagagaugaggcuucaccacgcu

SEQ ID NO: 551526 - RNA, 19 nt, Human
cagcagcccagggcaguca

SEQ ID NO: 551527 - RNA, 27 nt, Human
cagcagcuaggaucacaggcaugcacc

SEQ ID NO: 551528 - RNA, 24 nt, Human
cagccucaaucucccgggcugaag

SEQ ID NO: 551529 - RNA, 19 nt, Human
cagcggagucugagggggc

SEQ ID NO: 551530 - RNA, 24 nt, Human
caggaucuuccaacaagagcagga

SEQ ID NO: 551531 - RNA, 25 nt, Human
cauaucuguaaacuugaacaccaac

SEQ ID NO: 551532 - RNA, 24 nt, Human
caugagccaccgugaccagccuau

SEQ ID NO: 551533 - RNA, 24 nt, Human
ccaaagugcugggaccacaggcau

SEQ ID NO: 551534 - RNA, 26 nt, Human
ccaccaagcucuguguccagcugugu

SEQ ID NO: 551535 - RNA, 26 nt, Human
ccacccaccucagccucccaaagugc

SEQ ID NO: 551536 - RNA, 21 nt, Human
ccagggcagucagcucuccuc

SEQ ID NO: 551537 - RNA, 21 nt, Human
cccaggcucaagcgaauucuc

SEQ ID NO: 551538 - RNA, 22 nt, Human
cccaggcucaagcgaauucucc

SEQ ID NO: 551539 - RNA, 22 nt, Human
cccagggcagucagcucuccuc

SEQ ID NO: 551540 - RNA, 24 nt, Human
cccgaccucaggcgauccacccac

SEQ ID NO: 551541 - RNA, 20 nt, Human
cccgggcugaagcgauccuu

SEQ ID NO: 551542 - RNA, 25 nt, Human
ccuuccgucucagccuccccaacag

SEQ ID NO: 551543 - RNA, 24 nt, Human
cgauccacccaccucagccuccca

SEQ ID NO: 551544 - RNA, 26 nt, Human
cggggcgaagccacugacaauccgcc

SEQ ID NO: 551545 - RNA, 24 nt, Human
cggugcaacaccacacccagcuuu

SEQ ID NO: 551546 - RNA, 24 nt, Human
cgucucagccuccccaacagcugg

SEQ ID NO: 551547 - RNA, 22 nt, Human
cuaccucagccuccccagcagc

SEQ ID NO: 551548 - RNA, 19 nt, Human
cucaaacccccgaccucag

SEQ ID NO: 551549 - RNA, 25 nt, Human
cucaagcgaauucuccuaccucagc

SEQ ID NO: 551550 - RNA, 24 nt, Human
cucacugcaaccuccgccucccag

SEQ ID NO: 551551 - RNA, 25 nt, Human
cuccccagcagcuaggaucacaggc

SEQ ID NO: 551552 - RNA, 23 nt, Human
cugcaaccuccgccucccaggcu

SEQ ID NO: 551553 - RNA, 24 nt, Human
cuugucauccaggcuggagugcaa

SEQ ID NO: 551554 - RNA, 19 nt, Human
gaagcgauccuuccgucuc

SEQ ID NO: 551555 - RNA, 24 nt, Human
gaccucaggcgauccacccaccuc

SEQ ID NO: 551556 - RNA, 21 nt, Human
gaggcaaaugagggcagaagc

SEQ ID NO: 551557 - RNA, 19 nt, Human
gaucauagcucaccgcagc

SEQ ID NO: 551558 - RNA, 18 nt, Human
gcaaaugagggcagaagc

SEQ ID NO: 551559 - RNA, 22 nt, Human
gcaaccuccgccucccaggcuc

SEQ ID NO: 551560 - RNA, 21 nt, Human
gcagucagcucuccucggggc

SEQ ID NO: 551561 - RNA, 23 nt, Human
gccggucucaaacccccgaccuc

SEQ ID NO: 551562 - RNA, 23 nt, Human
gccucccaggcucaagcgaauuc

SEQ ID NO: 551563 - RNA, 27 nt, Human
gcgaauucuccuaccucagccucccca

SEQ ID NO: 551564 - RNA, 24 nt, Human
gcgauccacccaccucagccuccc

SEQ ID NO: 551565 - RNA, 24 nt, Human
gcgauccuuccgucucagccuccc

SEQ ID NO: 551566 - RNA, 19 nt, Human
gcuggagugcaauggcacg

SEQ ID NO: 551567 - RNA, 21 nt, Human
ggaccacaggcaugagccacc

SEQ ID NO: 551568 - RNA, 24 nt, Human
ggaccacaggcaugagccaccgug

SEQ ID NO: 551569 - RNA, 23 nt, Human
ggaguuucacucuugucauccag

SEQ ID NO: 551570 - RNA, 22 nt, Human
ggaucacaggcaugcaccacca

SEQ ID NO: 551571 - RNA, 21 nt, Human
ggcgaagagcagucaggaacg

SEQ ID NO: 551572 - RNA, 23 nt, Human
gggagaggcaaaugagggcagaa

SEQ ID NO: 551573 - RNA, 20 nt, Human
gggccggggucacagggaga

SEQ ID NO: 551574 - RNA, 23 nt, Human
gggccggggucacagggagaggc

SEQ ID NO: 551575 - RNA, 20 nt, Human
gugaccagccuauuauuauu

SEQ ID NO: 551576 - RNA, 24 nt, Human
uaccucagccuccccagcagcuag

SEQ ID NO: 551577 - RNA, 21 nt, Human
uaggaucacaggcaugcacca

SEQ ID NO: 551578 - RNA, 24 nt, Human
uaggaucacaggcaugcaccacca

SEQ ID NO: 551579 - RNA, 26 nt, Human
uauuacauagcaaaacauacuccaua

SEQ ID NO: 551580 - RNA, 23 nt, Human
ucaccgcagccucaaucucccgg

SEQ ID NO: 551581 - RNA, 24 nt, Human
ucaccgcagccucaaucucccggg

SEQ ID NO: 551582 - RNA, 23 nt, Human
ucacucuugucauccaggcugga

SEQ ID NO: 551583 - RNA, 19 nt, Human
ucacugcaaccuccgccuc

SEQ ID NO: 551584 - RNA, 24 nt, Human
ucacugcaaccuccgccucccagg

SEQ ID NO: 551585 - RNA, 25 nt, Human
ucacugcaaccuccgccucccaggc

SEQ ID NO: 551586 - RNA, 27 nt, Human
ucacugcaaccuccgccucccaggcuc

SEQ ID NO: 551587 - RNA, 18 nt, Human
ucagccucccaaagugcu

SEQ ID NO: 551588 - RNA, 18 nt, Human
ucagccuccccaacagcu

SEQ ID NO: 551589 - RNA, 20 nt, Human
ucagccuccccaacagcugg

SEQ ID NO: 551590 - RNA, 18 nt, Human
ucagccuccccagcagcu

SEQ ID NO: 551591 - RNA, 20 nt, Human
ucagccuccccagcagcuag

SEQ ID NO: 551592 - RNA, 19 nt, Human
ucaggaacggcuggacggg

SEQ ID NO: 551593 - RNA, 20 nt, Human
ucaggcgauccacccaccuc

SEQ ID NO: 551594 - RNA, 18 nt, Human
ucauccaggcuggagugc

SEQ ID NO: 551595 - RNA, 21 nt, Human
uccacccaccucagccuccca

SEQ ID NO: 551596 - RNA, 19 nt, Human
uccagcuguguuucugagg

SEQ ID NO: 551597 - RNA, 24 nt, Human
uccauacugaacaucacccaauug

SEQ ID NO: 551598 - RNA, 18 nt, Human
ucccaaagugcugggacc

SEQ ID NO: 551599 - RNA, 24 nt, Human
ucccaaagugcugggaccacaggc

SEQ ID NO: 551600 - RNA, 22 nt, Human
ucccaggcucaagcgaauucuc

SEQ ID NO: 551601 - RNA, 23 nt, Human
uccccagcagcuaggaucacagg

SEQ ID NO: 551602 - RNA, 19 nt, Human
ucgggcucuggcgaaaggg

SEQ ID NO: 551603 - RNA, 24 nt, Human
ucucacuccguugcccagccugga

SEQ ID NO: 551604 - RNA, 25 nt, Human
ucuccuaccucagccuccccagcag

SEQ ID NO: 551605 - RNA, 24 nt, Human
ucucugcauucucagcagagauug

SEQ ID NO: 551606 - RNA, 25 nt, Human
ucugccggaggcagcagcccagggc

SEQ ID NO: 551607 - RNA, 22 nt, Human
ucuucagacggagacgggccuc

SEQ ID NO: 551608 - RNA, 18 nt, Human
ucuugucauccaggcugg

SEQ ID NO: 551609 - RNA, 22 nt, Human
ugaaaaacaacaucuuugaaca

SEQ ID NO: 551610 - RNA, 22 nt, Human
ugaaaugaaaaacaacaucuuu

SEQ ID NO: 551611 - RNA, 21 nt, Human
ugagggcagaagcacucuuca

SEQ ID NO: 551612 - RNA, 22 nt, Human
ugagggggccggggucacaggg

SEQ ID NO: 551613 - RNA, 21 nt, Human
ugcaacaccacacccagcuuu

SEQ ID NO: 551614 - RNA, 24 nt, Human
ugcccagccuggagugcaguggcg

SEQ ID NO: 551615 - RNA, 19 nt, Human
ugcugggaccacaggcaug

SEQ ID NO: 551616 - RNA, 28 nt, Human
uggacggggccgagagacgacgcagcgg

SEQ ID NO: 551617 - RNA, 23 nt, Human
uggagugcaauggcacgaucucg

SEQ ID NO: 551618 - RNA, 24 nt, Human
uggagugcaauggcacgaucucgg

SEQ ID NO: 551619 - RNA, 19 nt, Human
uggagugcaguggcgcgau

SEQ ID NO: 551620 - RNA, 21 nt, Human
uggagugcaguggcgcgauca

SEQ ID NO: 551621 - RNA, 24 nt, Human
uggcgcgaucauagcucaccgcag

SEQ ID NO: 551622 - RNA, 21 nt, Human
ugggaccacaggcaugagcca

SEQ ID NO: 551623 - RNA, 23 nt, Human
ugggaccacaggcaugagccacc

SEQ ID NO: 551624 - RNA, 24 nt, Human
ugggaccacaggcaugagccaccg

SEQ ID NO: 551625 - RNA, 26 nt, Human
ugggaccacaggcaugagccaccgug

SEQ ID NO: 551626 - RNA, 21 nt, Human
uucacucuugucauccaggcu

SEQ ID NO: 551627 - RNA, 24 nt, Human
uucacucuugucauccaggcugga

SEQ ID NO: 551628 - RNA, 23 nt, Human
uucucagcagagaugaggcuuca

SEQ ID NO: 551629 - RNA, 24 nt, Human
uugcccagccuggagugcaguggc

SEQ ID NO: 551630 - RNA, 23 nt, Human
uuucacucuugucauccaggcug

SEQ ID NO: 551631 - RNA, 24 nt, Human
uuucacucuugucauccaggcugg

SEQ ID NO: 551632 - RNA, 26 nt, Human
uuuuuuuuuuuugagauggaguuuca

SEQ ID NO: 551633 - RNA, 22 nt, Human
uuuuuuuuuuuuuugagaugga

SEQ ID NO: 551634 - RNA, 18 nt, Human
uuuuuuuuuuuuuuuuug

SEQ ID NO: 551635 - RNA, 22 nt, Human
aaaccuugacaagaggaaccaa

SEQ ID NO: 551636 - RNA, 21 nt, Human
aacagcagacaccggcggggg

SEQ ID NO: 551637 - RNA, 18 nt, Human
aagaacagcagacaccgg

SEQ ID NO: 551638 - RNA, 23 nt, Human
agcagacaccggcggggguggcg

SEQ ID NO: 551639 - RNA, 23 nt, Human
caacaaagcaagaccuaugggga

SEQ ID NO: 551640 - RNA, 22 nt, Human
caaguccaucccuagacagcaa

SEQ ID NO: 551641 - RNA, 23 nt, Human
cagcucuugggcccccuguaccc

SEQ ID NO: 551642 - RNA, 22 nt, Human
caggagacagccagcccagcuc

SEQ ID NO: 551643 - RNA, 21 nt, Human
ccagcucuugggcccccugua

SEQ ID NO: 551644 - RNA, 22 nt, Human
cccucccuccccaccccuacug

SEQ ID NO: 551645 - RNA, 24 nt, Human
ccggcggggguggcggccucuccc

SEQ ID NO: 551646 - RNA, 20 nt, Human
cggccucucccucccucccc

SEQ ID NO: 551647 - RNA, 19 nt, Human
cggcggggguggcggccuc

SEQ ID NO: 551648 - RNA, 19 nt, Human
cucuugggcccccuguacc

SEQ ID NO: 551649 - RNA, 20 nt, Human
gacaagaggaaccaagucca

SEQ ID NO: 551650 - RNA, 27 nt, Human
ucccaaaccuugacaagaggaaccaag

SEQ ID NO: 551651 - RNA, 20 nt, Human
ucccucccuccccaccccua

SEQ ID NO: 551652 - RNA, 23 nt, Human
ucucccucccuccccaccccuac

SEQ ID NO: 551653 - RNA, 24 nt, Human
uggcggccucucccucccucccca

SEQ ID NO: 551654 - RNA, 22 nt, Human
aaaaacagucucuacuaacuua

SEQ ID NO: 551655 - RNA, 23 nt, Human
acaguuaaugaaaguaaaacuac

SEQ ID NO: 551656 - RNA, 19 nt, Human
accgcaccccgcaccaacg

SEQ ID NO: 551657 - RNA, 23 nt, Human
acuacuuuccucuguauaauauc

SEQ ID NO: 551658 - RNA, 21 nt, Human
agcacuacaaaccgcaccccg

SEQ ID NO: 551659 - RNA, 18 nt, Human
agcgcucucuuugguguu

SEQ ID NO: 551660 - RNA, 20 nt, Human
aggcuuuauaaaagucagca

SEQ ID NO: 551661 - RNA, 24 nt, Human
aguguauaaaaacccuuaagcaac

SEQ ID NO: 551662 - RNA, 26 nt, Human
caccaacggcagccgccauuuugguc

SEQ ID NO: 551663 - RNA, 21 nt, Human
caccgagccgcauuccuccgc

SEQ ID NO: 551664 - RNA, 21 nt, Human
cacgaaccgcgggccgaucuc

SEQ ID NO: 551665 - RNA, 23 nt, Human
cacuacaaaccgcaccccgcacc

SEQ ID NO: 551666 - RNA, 21 nt, Human
cagcacuacaaaccgcacccc

SEQ ID NO: 551667 - RNA, 19 nt, Human
cagcagucuucgugaaguc

SEQ ID NO: 551668 - RNA, 20 nt, Human
cagccgccauuuuggucggu

SEQ ID NO: 551669 - RNA, 25 nt, Human
cauuacauuucucacagagaaauca

SEQ ID NO: 551670 - RNA, 22 nt, Human
ccaccgagccgcauuccuccgc

SEQ ID NO: 551671 - RNA, 19 nt, Human
cccgcagggccacgaaccu

SEQ ID NO: 551672 - RNA, 24 nt, Human
ccgcaccccgcaccaacggcagcc

SEQ ID NO: 551673 - RNA, 18 nt, Human
ccgcauuccuccgccgcc

SEQ ID NO: 551674 - RNA, 18 nt, Human
ccgccuccaccagccgcu

SEQ ID NO: 551675 - RNA, 21 nt, Human
ccgcgggccgaucucagccgc

SEQ ID NO: 551676 - RNA, 19 nt, Human
ccuauggcccgccuccacc

SEQ ID NO: 551677 - RNA, 19 nt, Human
cgcaagcucgugccgaauu

SEQ ID NO: 551678 - RNA, 21 nt, Human
cucacagagaaaucaagaaaa

SEQ ID NO: 551679 - RNA, 23 nt, Human
cucgaguuuuuuuuuuuuuuuuu

SEQ ID NO: 551680 - RNA, 24 nt, Human
cucgaguuuuuuuuuuuuuuuuuc

SEQ ID NO: 551681 - RNA, 26 nt, Human
cuuaagcaacaguuaaugaaaguaaa

SEQ ID NO: 551682 - RNA, 18 nt, Human
cuuccaacuaauauuuca

SEQ ID NO: 551683 - RNA, 27 nt, Human
gaaaaaaaauuuccuaucaaucacaga

SEQ ID NO: 551684 - RNA, 18 nt, Human
gaaccgcgggccgaucuc

SEQ ID NO: 551685 - RNA, 18 nt, Human
gaaccgcgggccgaucuc

SEQ ID NO: 551686 - RNA, 22 nt, Human
gaaguuuuuuauuaggaaaaga

SEQ ID NO: 551687 - RNA, 22 nt, Human
gaguuuuuuuuuuuuuuuuuuu

SEQ ID NO: 551688 - RNA, 20 nt, Human
gaucucagccgccuccuccc

SEQ ID NO: 551689 - RNA, 24 nt, Human
gcaacagcacuacaaaccgcaccc

SEQ ID NO: 551690 - RNA, 21 nt, Human
gcacuacaaaccgcaccccgc

SEQ ID NO: 551691 - RNA, 20 nt, Human
gcagccgccauuuuggucgg

SEQ ID NO: 551692 - RNA, 26 nt, Human
gcccgggaggcccccucucuagcccc

SEQ ID NO: 551693 - RNA, 18 nt, Human
guaaaacuacaaaaacag

SEQ ID NO: 551694 - RNA, 21 nt, Human
uaaaacuacaaaaacagucuc

SEQ ID NO: 551695 - RNA, 20 nt, Human
uaaaguagaaguccaggcuu

SEQ ID NO: 551696 - RNA, 19 nt, Human
uaagcaacaguuaaugaaa

SEQ ID NO: 551697 - RNA, 23 nt, Human
uagaaguccaggcuuuauaaaag

SEQ ID NO: 551698 - RNA, 25 nt, Human
uaggaaaagacauuagaauaggaaa

SEQ ID NO: 551699 - RNA, 25 nt, Human
uagggcaacagcacuacaaaccgca

SEQ ID NO: 551700 - RNA, 24 nt, Human
ucagcagucuucgugaagucuucc

SEQ ID NO: 551701 - RNA, 18 nt, Human
ucccuggcucgaccaccu

SEQ ID NO: 551702 - RNA, 26 nt, Human
uccuccgccgccacuguuuugugcgg

SEQ ID NO: 551703 - RNA, 24 nt, Human
ucucgcugccgcacuggcccggga

SEQ ID NO: 551704 - RNA, 24 nt, Human
ucuggaaguguauaaaaacccuua

SEQ ID NO: 551705 - RNA, 23 nt, Human
ucuuuucacauuuugcaaaggga

SEQ ID NO: 551706 - RNA, 22 nt, Human
ugcaaagggaugaguagggcaa

SEQ ID NO: 551707 - RNA, 24 nt, Human
uggcccgccuccaccagccgcuuu

SEQ ID NO: 551708 - RNA, 20 nt, Human
uguuucauaccuuuccucgg

SEQ ID NO: 551709 - RNA, 24 nt, Human
uucauaucaaccuauguuccuaga

SEQ ID NO: 551710 - RNA, 23 nt, Human
uuccuccgccgccacuguuuugu

SEQ ID NO: 551711 - RNA, 24 nt, Human
uuucuucgggcuagggcugucauc

SEQ ID NO: 551712 - RNA, 21 nt, Human
uuuuuuuuccuuacaaauaaa

SEQ ID NO: 551713 - RNA, 20 nt, Human
acuucucguguuagaaagaa

SEQ ID NO: 551714 - RNA, 22 nt, Human
agaaaaaacaguucauucaaaa

SEQ ID NO: 551715 - RNA, 20 nt, Human
aggugguaggggacuaguuu

SEQ ID NO: 551716 - RNA, 23 nt, Human
aucuuaucauucccuuuucacug

SEQ ID NO: 551717 - RNA, 23 nt, Human
cagugguuuccuucaggacauuc

SEQ ID NO: 551718 - RNA, 23 nt, Human
caguucauucaaaauacaucuua

SEQ ID NO: 551719 - RNA, 21 nt, Human
cccuucauucucuuauguucc

SEQ ID NO: 551720 - RNA, 22 nt, Human
cuucaauuccauugcguauuuc

SEQ ID NO: 551721 - RNA, 23 nt, Human
gccacaggacugaguuaaauuuc

SEQ ID NO: 551722 - RNA, 18 nt, Human
ggagacaaggugucuugg

SEQ ID NO: 551723 - RNA, 25 nt, Human
uacagaaaaaacaguucauucaaaa

SEQ ID NO: 551724 - RNA, 30 nt, Human
uagcauaaacagaaaaacugauuuaaaauu

SEQ ID NO: 551725 - RNA, 20 nt, Human
uaggggacuaguuucaaagg

SEQ ID NO: 551726 - RNA, 21 nt, Human
uaggggacuaguuucaaaggc

SEQ ID NO: 551727 - RNA, 22 nt, Human
uauucugccccuucauucucuu

SEQ ID NO: 551728 - RNA, 20 nt, Human
uccacuuucuguaauggagc

SEQ ID NO: 551729 - RNA, 21 nt, Human
ucuacagaaaaaacaguucau

SEQ ID NO: 551730 - RNA, 21 nt, Human
ugaguuaaauuuccacauuca

SEQ ID NO: 551731 - RNA, 21 nt, Human
uggaaaaaaccacuaggagcg

SEQ ID NO: 551732 - RNA, 21 nt, Human
uguaauggagcucauuaccga

SEQ ID NO: 551733 - RNA, 23 nt, Human
uguaauggagcucauuaccgagg

SEQ ID NO: 551734 - RNA, 19 nt, Human
ugucuuggugcaauuuuga

SEQ ID NO: 551735 - RNA, 20 nt, Human
ugugcaguuguaauuaucca

SEQ ID NO: 551736 - RNA, 20 nt, Human
uucacaaauugugacaccau

SEQ ID NO: 551737 - RNA, 22 nt, Human
uucauuggcgguggccgcagug

SEQ ID NO: 551738 - RNA, 24 nt, Human
uucauuggcgguggccgcaguggu

SEQ ID NO: 551739 - RNA, 19 nt, Human
uuccuucuguguuagugca

SEQ ID NO: 551740 - RNA, 24 nt, Human
uuuuuuuguguuucuucaauucuu

SEQ ID NO: 551741 - RNA, 24 nt, Human
uuuuuuuuuuuuuuuuuuguguuu

SEQ ID NO: 551742 - RNA, 27 nt, Human
uuuuuuuuuuuuuuuuuuuuuuugggg

SEQ ID NO: 551743 - RNA, 23 nt, Human
aaaaacacaacacccaagccucc

SEQ ID NO: 551744 - RNA, 31 nt, Human
aaacaaacaaaacaaaaaacacaacaccccc

SEQ ID NO: 551745 - RNA, 25 nt, Human
aaacaaacaaacaaaacaaaaaaca

SEQ ID NO: 551746 - RNA, 21 nt, Human
aaagguaaacaaagcagaccc

SEQ ID NO: 551747 - RNA, 21 nt, Human
aacaaacaaacaaacaaaaca

SEQ ID NO: 551748 - RNA, 23 nt, Human
aacacccaagccucccuucuccc

SEQ ID NO: 551749 - RNA, 23 nt, Human
aaggcgcccgcgcccccggcuca

SEQ ID NO: 551750 - RNA, 23 nt, Human
acaaaacaaaaaacacaacaccc

SEQ ID NO: 551751 - RNA, 23 nt, Human
acaaacaaacaaaacaaaaaaca

SEQ ID NO: 551752 - RNA, 19 nt, Human
acaaacaaacaaacaaaac

SEQ ID NO: 551753 - RNA, 24 nt, Human
accuccucccaggccccacaccca

SEQ ID NO: 551754 - RNA, 24 nt, Human
agaccaggaacuucucggcugauu

SEQ ID NO: 551755 - RNA, 24 nt, Human
agcggcgggggcucccgggaggga

SEQ ID NO: 551756 - RNA, 18 nt, Human
aggaagcuccccacgccu

SEQ ID NO: 551757 - RNA, 24 nt, Human
aucuuuaaaaacaaacaaacaaac

SEQ ID NO: 551758 - RNA, 22 nt, Human
caaaacaaaaaacacaacaccc

SEQ ID NO: 551759 - RNA, 23 nt, Human
caaacaaaacaaaaaacacaaca

SEQ ID NO: 551760 - RNA, 19 nt, Human
caaagcagacccucagaaa

SEQ ID NO: 551761 - RNA, 23 nt, Human
cacagcccacaguacaaaaugaa

SEQ ID NO: 551762 - RNA, 20 nt, Human
cacccaagccucccuucucc

SEQ ID NO: 551763 - RNA, 19 nt, Human
caccccccaccccuccaca

SEQ ID NO: 551764 - RNA, 25 nt, Human
caccccuccacauucucgugauuca

SEQ ID NO: 551765 - RNA, 21 nt, Human
caccgcacgaaagguaaacaa

SEQ ID NO: 551766 - RNA, 24 nt, Human
caccgcacgaaagguaaacaaagc

SEQ ID NO: 551767 - RNA, 22 nt, Human
caccugugggcgcaggucucug

SEQ ID NO: 551768 - RNA, 21 nt, Human
cacugacaccccccaccccuc

SEQ ID NO: 551769 - RNA, 23 nt, Human
cacugacaccccccaccccucca

SEQ ID NO: 551770 - RNA, 23 nt, Human
cagaaggagagcgaaagguucac

SEQ ID NO: 551771 - RNA, 23 nt, Human
cagagucccucuccgggccucuc

SEQ ID NO: 551772 - RNA, 21 nt, Human
cagcacagcccacaguacaaa

SEQ ID NO: 551773 - RNA, 20 nt, Human
cagcucagccuuaugccuuu

SEQ ID NO: 551774 - RNA, 18 nt, Human
caggauggaggggggugg

SEQ ID NO: 551775 - RNA, 18 nt, Human
ccacugacaccccccacc

SEQ ID NO: 551776 - RNA, 18 nt, Human
ccaggccccacacccacg

SEQ ID NO: 551777 - RNA, 21 nt, Human
ccaguccacuaagacagcacc

SEQ ID NO: 551778 - RNA, 20 nt, Human
cccacaguacaaaaugaagu

SEQ ID NO: 551779 - RNA, 22 nt, Human
cccacgccugccccaugacgca

SEQ ID NO: 551780 - RNA, 22 nt, Human
cccaggauggagggggguggcc

SEQ ID NO: 551781 - RNA, 22 nt, Human
ccccacacccacgcaaggcgac

SEQ ID NO: 551782 - RNA, 19 nt, Human
ccccaccccuccacauucu

SEQ ID NO: 551783 - RNA, 19 nt, Human
ccccaggaccuccucccag

SEQ ID NO: 551784 - RNA, 24 nt, Human
ccccccaccccuccacauucucgu

SEQ ID NO: 551785 - RNA, 18 nt, Human
ccccggcucagacuccuc

SEQ ID NO: 551786 - RNA, 21 nt, Human
cccucuccgggccucucagca

SEQ ID NO: 551787 - RNA, 18 nt, Human
ccgcgcccccggcucaga

SEQ ID NO: 551788 - RNA, 28 nt, Human
ccgcgcccccggcucagacuccucggug

SEQ ID NO: 551789 - RNA, 18 nt, Human
ccggcagcgccgcucggg

SEQ ID NO: 551790 - RNA, 21 nt, Human
ccucagaaacucccuggcaag

SEQ ID NO: 551791 - RNA, 23 nt, Human
cgacucgacggcgacagcggcgg

SEQ ID NO: 551792 - RNA, 18 nt, Human
cgcccccggcucagacuc

SEQ ID NO: 551793 - RNA, 19 nt, Human
cgcccucgggccgacgguu

SEQ ID NO: 551794 - RNA, 21 nt, Human
cgcccucgggccgacgguucg

SEQ ID NO: 551795 - RNA, 21 nt, Human
cgggagggacagaacaggcag

SEQ ID NO: 551796 - RNA, 26 nt, Human
cgggagggacagaacaggcagcaggu

SEQ ID NO: 551797 - RNA, 21 nt, Human
cgggggcucccgggagggaca

SEQ ID NO: 551798 - RNA, 22 nt, Human
cggugccgucccugcacacuga

SEQ ID NO: 551799 - RNA, 25 nt, Human
cucagccuuaugccuuuccacugac

SEQ ID NO: 551800 - RNA, 20 nt, Human
cuccacgguuuucgcgggcg

SEQ ID NO: 551801 - RNA, 19 nt, Human
cucccaggccccacaccca

SEQ ID NO: 551802 - RNA, 23 nt, Human
cucccaggccccacacccacgca

SEQ ID NO: 551803 - RNA, 21 nt, Human
cuccccacugcccagggcggg

SEQ ID NO: 551804 - RNA, 19 nt, Human
cucuccuccccacugccca

SEQ ID NO: 551805 - RNA, 26 nt, Human
cuuuccacugacaccccccaccccuc

SEQ ID NO: 551806 - RNA, 30 nt, Human
gaaaaaccuugaaagggccagcacagcccc

SEQ ID NO: 551807 - RNA, 19 nt, Human
gacucgacggcgacagcgg

SEQ ID NO: 551808 - RNA, 21 nt, Human
gcacgaaagguaaacaaagca

SEQ ID NO: 551809 - RNA, 19 nt, Human
gcagcgccgcucggggucc

SEQ ID NO: 551810 - RNA, 19 nt, Human
gcaggucucugcggaaggc

SEQ ID NO: 551811 - RNA, 25 nt, Human
gccccaggaccuccucccaggcccc

SEQ ID NO: 551812 - RNA, 20 nt, Human
gcgggugcacgccccaggac

SEQ ID NO: 551813 - RNA, 18 nt, Human
ggaaggcgcccgcgcccc

SEQ ID NO: 551814 - RNA, 19 nt, Human
ggaaggcgcccgcgccccc

SEQ ID NO: 551815 - RNA, 21 nt, Human
gugaaguaacucaggccacuc

SEQ ID NO: 551816 - RNA, 20 nt, Human
uaacucaggccacucuccuc

SEQ ID NO: 551817 - RNA, 23 nt, Human
uacaaaaugaaguccgacccuga

SEQ ID NO: 551818 - RNA, 23 nt, Human
uacugggcaccucuaaugcagau

SEQ ID NO: 551819 - RNA, 25 nt, Human
uagacggaguuaaaaagaauccacc

SEQ ID NO: 551820 - RNA, 19 nt, Human
ucagacuccucggugccgu

SEQ ID NO: 551821 - RNA, 22 nt, Human
ucagcggagggggaaggggagu

SEQ ID NO: 551822 - RNA, 19 nt, Human
uccaccgcacgaaagguaa

SEQ ID NO: 551823 - RNA, 25 nt, Human
uccacugacaccccccaccccucca

SEQ ID NO: 551824 - RNA, 24 nt, Human
ucccaguccacuaagacagcaccu

SEQ ID NO: 551825 - RNA, 19 nt, Human
uccccacugcccagggcgg

SEQ ID NO: 551826 - RNA, 27 nt, Human
ucccuucucccaguccagaaggagagc

SEQ ID NO: 551827 - RNA, 18 nt, Human
ucgggccgacgguucgac

SEQ ID NO: 551828 - RNA, 21 nt, Human
ucucugcggaaggcgcccgcg

SEQ ID NO: 551829 - RNA, 19 nt, Human
ugaaagggccagcacagcc

SEQ ID NO: 551830 - RNA, 18 nt, Human
ugaaguccgacccugagg

SEQ ID NO: 551831 - RNA, 19 nt, Human
ugagaaaaacuugagaaug

SEQ ID NO: 551832 - RNA, 24 nt, Human
ugcagaugagaaaaacuugagaau

SEQ ID NO: 551833 - RNA, 20 nt, Human
uggcccaguuucaccagcaa

SEQ ID NO: 551834 - RNA, 19 nt, Human
ugugaaaguagaucagucc

SEQ ID NO: 551835 - RNA, 20 nt, Human
uuggcccaguuucaccagca

SEQ ID NO: 551836 - RNA, 25 nt, Human
aaaaaacaccaauaaaaaaaaaccc

SEQ ID NO: 551837 - RNA, 26 nt, Human
aaaaaacaccaauaaaaaaaaaccca

SEQ ID NO: 551838 - RNA, 25 nt, Human
aaaacaaauuauuuccaaaaagccc

SEQ ID NO: 551839 - RNA, 23 nt, Human
aaacaaaaauaaaaacaaaacag

SEQ ID NO: 551840 - RNA, 22 nt, Human
aaagagacagggucuugccaug

SEQ ID NO: 551841 - RNA, 22 nt, Human
aaagcacaagacaauccuacaa

SEQ ID NO: 551842 - RNA, 23 nt, Human
aaaguggguggaucaccugaggu

SEQ ID NO: 551843 - RNA, 18 nt, Human
aacaaaaauccccaaagc

SEQ ID NO: 551844 - RNA, 23 nt, Human
aacaaacaaacaaacaaacaaac

SEQ ID NO: 551845 - RNA, 18 nt, Human
aacaagcugcaucauguu

SEQ ID NO: 551846 - RNA, 21 nt, Human
aacacagugagacaccugucu

SEQ ID NO: 551847 - RNA, 22 nt, Human
aacacagugagacaccugucuc

SEQ ID NO: 551848 - RNA, 19 nt, Human
aacauagcgaaaccccauc

SEQ ID NO: 551849 - RNA, 21 nt, Human
aacauagcgaaaccccaucuc

SEQ ID NO: 551850 - RNA, 21 nt, Human
aacauagcgaaaccccaucuc

SEQ ID NO: 551851 - RNA, 19 nt, Human
aacauggugaaaccccauc

SEQ ID NO: 551852 - RNA, 20 nt, Human
aacauggugaaaccccaucu

SEQ ID NO: 551853 - RNA, 21 nt, Human
aacauggugaaaccccaucuc

SEQ ID NO: 551854 - RNA, 21 nt, Human
aacauggugaaaccccaucuc

SEQ ID NO: 551855 - RNA, 26 nt, Human
aaccacagguaaguuauuuaaccacc

SEQ ID NO: 551856 - RNA, 21 nt, Human
aacccaggauggcaaugacac

SEQ ID NO: 551857 - RNA, 23 nt, Human
aacuccuaguuuuugacagaaaa

SEQ ID NO: 551858 - RNA, 22 nt, Human
aagaguguuauuucuaguuuuu

SEQ ID NO: 551859 - RNA, 22 nt, Human
aagcaggaaaauugcuugaacc

SEQ ID NO: 551860 - RNA, 24 nt, Human
aagcaggaaaauugcuugaaccug

SEQ ID NO: 551861 - RNA, 19 nt, Human
aagcagggaauugccaggu

SEQ ID NO: 551862 - RNA, 19 nt, Human
aagcggaaguugcagugaa

SEQ ID NO: 551863 - RNA, 20 nt, Human
aagcugcaucauguucagaa

SEQ ID NO: 551864 - RNA, 18 nt, Human
aaggaacuaaauuauuuc

SEQ ID NO: 551865 - RNA, 24 nt, Human
aaguggaaguugcagugagccaag

SEQ ID NO: 551866 - RNA, 23 nt, Human
aauagcauccacuauaccuuuaa

SEQ ID NO: 551867 - RNA, 24 nt, Human
aaucgcuugaacccgggaagugga

SEQ ID NO: 551868 - RNA, 18 nt, Human
aauugcuugaaccuggga

SEQ ID NO: 551869 - RNA, 25 nt, Human
acaaaaauccccaaagcacaagaca

SEQ ID NO: 551870 - RNA, 23 nt, Human
acaaacaaacaaacaaaaaagac

SEQ ID NO: 551871 - RNA, 23 nt, Human
acaaacaaacaaacaaaaaagac

SEQ ID NO: 551872 - RNA, 22 nt, Human
acaccacagcacuccagccugg

SEQ ID NO: 551873 - RNA, 23 nt, Human
acacuuugggaggcugaggcagg

SEQ ID NO: 551874 - RNA, 18 nt, Human
acagcacuccagccuggg

SEQ ID NO: 551875 - RNA, 23 nt, Human
acagcacuccagccugggugaca

SEQ ID NO: 551876 - RNA, 21 nt, Human
acauuaaccauauaccagucu

SEQ ID NO: 551877 - RNA, 21 nt, Human
accacugcacuccagccugag

SEQ ID NO: 551878 - RNA, 24 nt, Human
accccaucucuacuaaaaauacaa

SEQ ID NO: 551879 - RNA, 24 nt, Human
accccaucucuacuaaaaauacaa

SEQ ID NO: 551880 - RNA, 23 nt, Human
accuguagucccagcuacuuggg

SEQ ID NO: 551881 - RNA, 22 nt, Human
accugucaucucagcaaacacu

SEQ ID NO: 551882 - RNA, 22 nt, Human
acgucuaguaaucccagcacuu

SEQ ID NO: 551883 - RNA, 18 nt, Human
acugcacuccagccugag

SEQ ID NO: 551884 - RNA, 23 nt, Human
acugcacuccagccugagugcag

SEQ ID NO: 551885 - RNA, 24 nt, Human
acuugagguuaggaguucgagacc

SEQ ID NO: 551886 - RNA, 23 nt, Human
agacagggucuugccauguugcc

SEQ ID NO: 551887 - RNA, 21 nt, Human
agagacagggucuugccaugu

SEQ ID NO: 551888 - RNA, 20 nt, Human
agcacuaacuaauaugugcu

SEQ ID NO: 551889 - RNA, 24 nt, Human
agcacuuugggaggcugaggcggg

SEQ ID NO: 551890 - RNA, 24 nt, Human
agcacuuugggaggucaaaguggg

SEQ ID NO: 551891 - RNA, 23 nt, Human
agccaaaaaacaaacaaacaaac

SEQ ID NO: 551892 - RNA, 18 nt, Human
agccaggcgugguggugc

SEQ ID NO: 551893 - RNA, 24 nt, Human
agcccagccaacauggugaaaccc

SEQ ID NO: 551894 - RNA, 20 nt, Human
agccugagugcagugagacu

SEQ ID NO: 551895 - RNA, 24 nt, Human
agccuggccaacauagcgaaaccc

SEQ ID NO: 551896 - RNA, 19 nt, Human
agcugacugcaauaacuug

SEQ ID NO: 551897 - RNA, 23 nt, Human
agcugaggcaggagaaucgcuug

SEQ ID NO: 551898 - RNA, 24 nt, Human
aggaccacuugaggccaggaguuc

SEQ ID NO: 551899 - RNA, 23 nt, Human
aggaguucaagaccagccuggac

SEQ ID NO: 551900 - RNA, 23 nt, Human
aggcaagcaaauagcuacaaagg

SEQ ID NO: 551901 - RNA, 24 nt, Human
aggcaggagaaucgcuugaacccg

SEQ ID NO: 551902 - RNA, 18 nt, Human
aggcaggaggaccacuug

SEQ ID NO: 551903 - RNA, 21 nt, Human
aggcggguggaucacuugagg

SEQ ID NO: 551904 - RNA, 21 nt, Human
aggcggguggaucacuugagg

SEQ ID NO: 551905 - RNA, 23 nt, Human
aggcggguggaucacuugagguu

SEQ ID NO: 551906 - RNA, 24 nt, Human
aggcugaggcaggaggaccacuug

SEQ ID NO: 551907 - RNA, 21 nt, Human
aggcugaggcggguggaucac

SEQ ID NO: 551908 - RNA, 24 nt, Human
aggcugaggcggguggaucacuug

SEQ ID NO: 551909 - RNA, 19 nt, Human
agguaauucaaauguaugu

SEQ ID NO: 551910 - RNA, 19 nt, Human
agguaggcugggugcagug

SEQ ID NO: 551911 - RNA, 22 nt, Human
agguaggcugggugcaguggcu

SEQ ID NO: 551912 - RNA, 19 nt, Human
agguuggagugcagugguu

SEQ ID NO: 551913 - RNA, 23 nt, Human
aguagcucgcaccuguaaucccc

SEQ ID NO: 551914 - RNA, 24 nt, Human
aguggcucacaccuguaaucccag

SEQ ID NO: 551915 - RNA, 21 nt, Human
auagaacaaaaacuagagauu

SEQ ID NO: 551916 - RNA, 23 nt, Human
auagagcagcaguaacuuucaag

SEQ ID NO: 551917 - RNA, 19 nt, Human
auauauauauauauauaua

SEQ ID NO: 551918 - RNA, 19 nt, Human
auauauauauauauauaua

SEQ ID NO: 551919 - RNA, 19 nt, Human
auauauauauauauauaua

SEQ ID NO: 551920 - RNA, 19 nt, Human
auauauauauauauauaua

SEQ ID NO: 551921 - RNA, 19 nt, Human
auauauauauauauauaua

SEQ ID NO: 551922 - RNA, 19 nt, Human
auauauauauauauauaua

SEQ ID NO: 551923 - RNA, 24 nt, Human
aucacaccacagcacuccagccug

SEQ ID NO: 551924 - RNA, 24 nt, Human
aucacuugagguuaggaguucgag

SEQ ID NO: 551925 - RNA, 24 nt, Human
aucguaccacugcacuccagccug

SEQ ID NO: 551926 - RNA, 23 nt, Human
caaaaagcccuaaucauaugaua

SEQ ID NO: 551927 - RNA, 23 nt, Human
caaaaauccccaaagcacaagac

SEQ ID NO: 551928 - RNA, 21 nt, Human
caaacaaacaaaaaagacggu

SEQ ID NO: 551929 - RNA, 24 nt, Human
caaaguggguggaucaccugaggu

SEQ ID NO: 551930 - RNA, 24 nt, Human
caacauggugaaaccccaucucua

SEQ ID NO: 551931 - RNA, 24 nt, Human
caagcaaauagcuacaaaaaccuu

SEQ ID NO: 551932 - RNA, 24 nt, Human
cacaccuguaaucccagcacuuug

SEQ ID NO: 551933 - RNA, 23 nt, Human
cacacuuugggaggcugaggcag

SEQ ID NO: 551934 - RNA, 24 nt, Human
cacagcacuccagccugggugaca

SEQ ID NO: 551935 - RNA, 22 nt, Human
cacaugaaauaaaagauuccac

SEQ ID NO: 551936 - RNA, 22 nt, Human
cacauuaaccauauaccagucu

SEQ ID NO: 551937 - RNA, 23 nt, Human
cacauuauaacuuugcuucuugg

SEQ ID NO: 551938 - RNA, 19 nt, Human
caccacagcacuccagccu

SEQ ID NO: 551939 - RNA, 23 nt, Human
caccaggaagguaacugucccaa

SEQ ID NO: 551940 - RNA, 19 nt, Human
caccuguaaucccagcacu

SEQ ID NO: 551941 - RNA, 24 nt, Human
caccuguaaucccagcacuuuggg

SEQ ID NO: 551942 - RNA, 22 nt, Human
caccuguaauccccacacuuug

SEQ ID NO: 551943 - RNA, 23 nt, Human
caccuguaauccccacacuuugg

SEQ ID NO: 551944 - RNA, 24 nt, Human
caccuguaauccccacacuuuggg

SEQ ID NO: 551945 - RNA, 23 nt, Human
caccuguagucccagcuacuugg

SEQ ID NO: 551946 - RNA, 24 nt, Human
caccuguagucccagcuacuuggg

SEQ ID NO: 551947 - RNA, 19 nt, Human
cacuccagccugagugcag

SEQ ID NO: 551948 - RNA, 20 nt, Human
cacuccagccugagugcagu

SEQ ID NO: 551949 - RNA, 18 nt, Human
cacuccagccugggugac

SEQ ID NO: 551950 - RNA, 19 nt, Human
cacuccagccugggugaca

SEQ ID NO: 551951 - RNA, 18 nt, Human
cacugcacuccagccuga

SEQ ID NO: 551952 - RNA, 19 nt, Human
cacugcacuccagccugag

SEQ ID NO: 551953 - RNA, 19 nt, Human
cacugcacuccagccugag

SEQ ID NO: 551954 - RNA, 23 nt, Human
cacugcacuccagccugagugca

SEQ ID NO: 551955 - RNA, 23 nt, Human
cacuugagguuaggaguucgaga

SEQ ID NO: 551956 - RNA, 23 nt, Human
cacuuuucuccccugaauauacu

SEQ ID NO: 551957 - RNA, 21 nt, Human
cagaauuuagccugguguuaa

SEQ ID NO: 551958 - RNA, 24 nt, Human
cagcacuuugggaggcugaggcgg

SEQ ID NO: 551959 - RNA, 24 nt, Human
cagcacuuugggaggucaaagugg

SEQ ID NO: 551960 - RNA, 19 nt, Human
cagccccaaacuccuguac

SEQ ID NO: 551961 - RNA, 22 nt, Human
cagcugaaacccuuucaaaagc

SEQ ID NO: 551962 - RNA, 24 nt, Human
cagggucuugccauguugcccagg

SEQ ID NO: 551963 - RNA, 25 nt, Human
caucucaaaaaacaaaaauaaaaac

SEQ ID NO: 551964 - RNA, 18 nt, Human
cauguugcccagguugga

SEQ ID NO: 551965 - RNA, 22 nt, Human
cauguugcccagguuggagugc

SEQ ID NO: 551966 - RNA, 24 nt, Human
cauguugcccagguuggagugcag

SEQ ID NO: 551967 - RNA, 20 nt, Human
cauuacacacuacagcccca

SEQ ID NO: 551968 - RNA, 20 nt, Human
cauuuucuaaacaagaaaca

SEQ ID NO: 551969 - RNA, 18 nt, Human
ccaaagcacaagacaauc

SEQ ID NO: 551970 - RNA, 24 nt, Human
ccaacaguguuuuugaacaggcau

SEQ ID NO: 551971 - RNA, 24 nt, Human
ccacacuuugggaggcugaggcag

SEQ ID NO: 551972 - RNA, 18 nt, Human
ccacagcacuccagccug

SEQ ID NO: 551973 - RNA, 20 nt, Human
ccacagcacuccagccuggg

SEQ ID NO: 551974 - RNA, 21 nt, Human
ccacagcacuccagccugggu

SEQ ID NO: 551975 - RNA, 23 nt, Human
ccacagcacuccagccuggguga

SEQ ID NO: 551976 - RNA, 24 nt, Human
ccacagcacuccagccugggugac

SEQ ID NO: 551977 - RNA, 20 nt, Human
ccacugcacuccagccugag

SEQ ID NO: 551978 - RNA, 21 nt, Human
ccacugcacuccagccugagu

SEQ ID NO: 551979 - RNA, 23 nt, Human
ccacugcacuccagccugagugc

SEQ ID NO: 551980 - RNA, 18 nt, Human
ccaggauggcaaugacac

SEQ ID NO: 551981 - RNA, 23 nt, Human
cccaaacuccuguacuccaguga

SEQ ID NO: 551982 - RNA, 20 nt, Human
cccaaagcacaagacaaucc

SEQ ID NO: 551983 - RNA, 19 nt, Human
cccagacacaaacagacaa

SEQ ID NO: 551984 - RNA, 24 nt, Human
cccagccaacauggugaaacccca

SEQ ID NO: 551985 - RNA, 19 nt, Human
ccccaaacuccuguacucc

SEQ ID NO: 551986 - RNA, 21 nt, Human
ccuaccacugagcuaaacuga

SEQ ID NO: 551987 - RNA, 24 nt, Human
ccuggccaacauagcgaaacccca

SEQ ID NO: 551988 - RNA, 21 nt, Human
ccuguagucccagcuacuugg

SEQ ID NO: 551989 - RNA, 24 nt, Human
cgagaccagcccagccaacauggu

SEQ ID NO: 551990 - RNA, 20 nt, Human
cuaacaaaaaugagaguaga

SEQ ID NO: 551991 - RNA, 20 nt, Human
cuaguaaucccagcacuuug

SEQ ID NO: 551992 - RNA, 23 nt, Human
cuauugcauccuaaaggccuggg

SEQ ID NO: 551993 - RNA, 25 nt, Human
cucaaaaaacaaaaauaaaaacaaa

SEQ ID NO: 551994 - RNA, 23 nt, Human
cucaaaacagauaaucaugaauu

SEQ ID NO: 551995 - RNA, 20 nt, Human
cucaacucuaaguguuuaac

SEQ ID NO: 551996 - RNA, 22 nt, Human
cucacaccuguaaucccagcac

SEQ ID NO: 551997 - RNA, 24 nt, Human
cucacaccuguaaucccagcacuu

SEQ ID NO: 551998 - RNA, 25 nt, Human
cuccagugauccucccugcccccac

SEQ ID NO: 551999 - RNA, 20 nt, Human
cucccugcccccaccuccuu

SEQ ID NO: 552000 - RNA, 18 nt, Human
cuccuucccaaauaacug

SEQ ID NO: 552001 - RNA, 19 nt, Human
cuccuucccaaauaacugg

SEQ ID NO: 552002 - RNA, 24 nt, Human
cucgcaccuguaauccccacacuu

SEQ ID NO: 552003 - RNA, 19 nt, Human
cugaaagcagucauuuugc

SEQ ID NO: 552004 - RNA, 21 nt, Human
cugaagaagaaaaaccugcau

SEQ ID NO: 552005 - RNA, 21 nt, Human
cuggcagcugacugcaauaac

SEQ ID NO: 552006 - RNA, 23 nt, Human
cuggccaacauagcgaaacccca

SEQ ID NO: 552007 - RNA, 18 nt, Human
gaaaccccaucucuacua

SEQ ID NO: 552008 - RNA, 21 nt, Human
gaaauguucgcugucaauguc

SEQ ID NO: 552009 - RNA, 18 nt, Human
gaaguggaaguugcagug

SEQ ID NO: 552010 - RNA, 18 nt, Human
gaaguugcagugagccaa

SEQ ID NO: 552011 - RNA, 19 nt, Human
gaaguugcagugagccaag

SEQ ID NO: 552012 - RNA, 24 nt, Human
gaccacuugaggccaggaguucaa

SEQ ID NO: 552013 - RNA, 23 nt, Human
gagaaucgcuugaacccgggaag

SEQ ID NO: 552014 - RNA, 21 nt, Human
gaguucuuuccuuucuuucuc

SEQ ID NO: 552015 - RNA, 24 nt, Human
gaucaccugaggucagaaguuuga

SEQ ID NO: 552016 - RNA, 24 nt, Human
gaucacuugagguuaggaguucga

SEQ ID NO: 552017 - RNA, 22 nt, Human
gcagugagacuucaucucaaaa

SEQ ID NO: 552018 - RNA, 21 nt, Human
gccaaaaaacaaacaaacaaa

SEQ ID NO: 552019 - RNA, 24 nt, Human
gccaacauggugaaaccccaucuc

SEQ ID NO: 552020 - RNA, 20 nt, Human
gccaagaucguaccacugca

SEQ ID NO: 552021 - RNA, 24 nt, Human
ggaaguugcagugagccaagaucg

SEQ ID NO: 552022 - RNA, 20 nt, Human
ggagcaguagcucgcaccug

SEQ ID NO: 552023 - RNA, 24 nt, Human
ggcuuacgucuaguaaucccagca

SEQ ID NO: 552024 - RNA, 23 nt, Human
gguaggcugggugcaguggcuca

SEQ ID NO: 552025 - RNA, 23 nt, Human
ggugcaguggcucacaccuguaa

SEQ ID NO: 552026 - RNA, 23 nt, Human
gguuagcaaacuuuuucuguaaa

SEQ ID NO: 552027 - RNA, 23 nt, Human
guaaaauauauauauauauauau

SEQ ID NO: 552028 - RNA, 19 nt, Human
gugagcaugggugugcccc

SEQ ID NO: 552029 - RNA, 18 nt, Human
gugcaguggcucacaccu

SEQ ID NO: 552030 - RNA, 19 nt, Human
guugugguggcgugcaccu

SEQ ID NO: 552031 - RNA, 23 nt, Human
uaaaaaggcagauaagacuguaa

SEQ ID NO: 552032 - RNA, 21 nt, Human
uaaaaauacaaaaauuagcca

SEQ ID NO: 552033 - RNA, 24 nt, Human
uaaaacaaaacuuaaaacucucaa

SEQ ID NO: 552034 - RNA, 23 nt, Human
uaaacugaagaagaaaaaccugc

SEQ ID NO: 552035 - RNA, 31 nt, Human
uaacaaaaaugagaguagaaaguacccagaa

SEQ ID NO: 552036 - RNA, 25 nt, Human
uaacucaaugcaauuuccauuuuau

SEQ ID NO: 552037 - RNA, 21 nt, Human
uaauguggcaugcaucaucuc

SEQ ID NO: 552038 - RNA, 23 nt, Human
uaccugaaggcuuaacuccuagu

SEQ ID NO: 552039 - RNA, 20 nt, Human
uagcaaacuuuuucuguaaa

SEQ ID NO: 552040 - RNA, 22 nt, Human
uagccaaaaaacaaacaaacaa

SEQ ID NO: 552041 - RNA, 23 nt, Human
uagccaaaaaacaaacaaacaaa

SEQ ID NO: 552042 - RNA, 28 nt, Human
uaggcuaacaaaaaugagaguagaaagu

SEQ ID NO: 552043 - RNA, 19 nt, Human
uagugcaaguauaauuugg

SEQ ID NO: 552044 - RNA, 26 nt, Human
uauagaacaaaaacuagagauucuga

SEQ ID NO: 552045 - RNA, 18 nt, Human
uauauauauauauauaca

SEQ ID NO: 552046 - RNA, 21 nt, Human
uauauauauauauauauacau

SEQ ID NO: 552047 - RNA, 19 nt, Human
uauauauauauauauauau

SEQ ID NO: 552048 - RNA, 19 nt, Human
uauauauauauauauauau

SEQ ID NO: 552049 - RNA, 19 nt, Human
uauauauauauauauauau

SEQ ID NO: 552050 - RNA, 24 nt, Human
uauauauauauauauauauauaca

SEQ ID NO: 552051 - RNA, 19 nt, Human
uaucagugacaggcauccu

SEQ ID NO: 552052 - RNA, 22 nt, Human
ucagcaaacacugaauaccuag

SEQ ID NO: 552053 - RNA, 20 nt, Human
ucagugacaggcauccuguc

SEQ ID NO: 552054 - RNA, 20 nt, Human
ucagugguaaagauuuggca

SEQ ID NO: 552055 - RNA, 20 nt, Human
uccaccaacaguguuuuuga

SEQ ID NO: 552056 - RNA, 23 nt, Human
uccacuauaccuuuaaccagaaa

SEQ ID NO: 552057 - RNA, 19 nt, Human
uccagccugagugcaguga

SEQ ID NO: 552058 - RNA, 22 nt, Human
uccagccugggugacaaacuga

SEQ ID NO: 552059 - RNA, 23 nt, Human
ucccaaauaacuggcugauuagu

SEQ ID NO: 552060 - RNA, 22 nt, Human
ucccaagggagcaagcuuucuu

SEQ ID NO: 552061 - RNA, 21 nt, Human
uccgaacaaaaauccccaaag

SEQ ID NO: 552062 - RNA, 21 nt, Human
ucgcuugaacccgggaagugg

SEQ ID NO: 552063 - RNA, 23 nt, Human
ucguaccacugcacuccagccug

SEQ ID NO: 552064 - RNA, 22 nt, Human
ucucaaaaaacaaaaauaaaaa

SEQ ID NO: 552065 - RNA, 19 nt, Human
ucuccaaagauacagauac

SEQ ID NO: 552066 - RNA, 21 nt, Human
ucucuacuaaaaauacaaaaa

SEQ ID NO: 552067 - RNA, 24 nt, Human
ucucuacuaaaaauacaaaaaauu

SEQ ID NO: 552068 - RNA, 23 nt, Human
ucugaagaucauguuaauagauu

SEQ ID NO: 552069 - RNA, 21 nt, Human
ucugcuaguauugaaugcuaa

SEQ ID NO: 552070 - RNA, 23 nt, Human
ucuugccauguugcccagguugg

SEQ ID NO: 552071 - RNA, 24 nt, Human
ucuugccauguugcccagguugga

SEQ ID NO: 552072 - RNA, 20 nt, Human
ucuuuccuuucuuucucccc

SEQ ID NO: 552073 - RNA, 19 nt, Human
ugaaaccccaucucuacua

SEQ ID NO: 552074 - RNA, 24 nt, Human
ugaaccugggaagcggaaguugca

SEQ ID NO: 552075 - RNA, 21 nt, Human
ugaacuucagaaaugguuccc

SEQ ID NO: 552076 - RNA, 24 nt, Human
ugaagcaggaaaauugcuugaacc

SEQ ID NO: 552077 - RNA, 25 nt, Human
ugaagcaggaaaauugcuugaaccu

SEQ ID NO: 552078 - RNA, 18 nt, Human
ugagaucagccuggccaa

SEQ ID NO: 552079 - RNA, 21 nt, Human
ugagaucagccuggccaacau

SEQ ID NO: 552080 - RNA, 20 nt, Human
ugaggcaggagaaucgcuug

SEQ ID NO: 552081 - RNA, 24 nt, Human
ugaggcaggagaaucgcuugaacc

SEQ ID NO: 552082 - RNA, 25 nt, Human
ugaggcaggagaaucgcuugaaccc

SEQ ID NO: 552083 - RNA, 25 nt, Human
ugaggcaggaggaccacuugaggcc

SEQ ID NO: 552084 - RNA, 22 nt, Human
ugaggcggguggaucacuugag

SEQ ID NO: 552085 - RNA, 24 nt, Human
ugaggcggguggaucacuugaggu

SEQ ID NO: 552086 - RNA, 19 nt, Human
ugauauaggaaaaacuggu

SEQ ID NO: 552087 - RNA, 22 nt, Human
ugcaauuucuaaaaaggcuguu

SEQ ID NO: 552088 - RNA, 24 nt, Human
ugcaccuguagucccagcuacuug

SEQ ID NO: 552089 - RNA, 25 nt, Human
ugccauguugcccagguuggagugc

SEQ ID NO: 552090 - RNA, 18 nt, Human
ugcccagguuggagugca

SEQ ID NO: 552091 - RNA, 21 nt, Human
ugcccagguuggagugcagug

SEQ ID NO: 552092 - RNA, 22 nt, Human
ugcccagguuggagugcagugg

SEQ ID NO: 552093 - RNA, 18 nt, Human
uggaaagcaucauaugca

SEQ ID NO: 552094 - RNA, 18 nt, Human
uggaauaagagacuucau

SEQ ID NO: 552095 - RNA, 22 nt, Human
uggagugcagugguuauucuuu

SEQ ID NO: 552096 - RNA, 23 nt, Human
uggaucaccugaggucagaaguu

SEQ ID NO: 552097 - RNA, 24 nt, Human
uggaucaccugaggucagaaguuu

SEQ ID NO: 552098 - RNA, 27 nt, Human
uggaucaccugaggucagaaguuugag

SEQ ID NO: 552099 - RNA, 24 nt, Human
uggaucacuugagguuaggaguuc

SEQ ID NO: 552100 - RNA, 19 nt, Human
uggcaaagauaaaaaggca

SEQ ID NO: 552101 - RNA, 21 nt, Human
uggcaaagauaaaaaggcaga

SEQ ID NO: 552102 - RNA, 20 nt, Human
uggcccaccaauaauuuuca

SEQ ID NO: 552103 - RNA, 22 nt, Human
uggcgugcaccuguagucccag

SEQ ID NO: 552104 - RNA, 21 nt, Human
uggcucacaccuguaauccca

SEQ ID NO: 552105 - RNA, 22 nt, Human
uggcucacaccuguaaucccag

SEQ ID NO: 552106 - RNA, 24 nt, Human
uggcucacaccuguaaucccagca

SEQ ID NO: 552107 - RNA, 23 nt, Human
uggcuuacgucuaguaaucccag

SEQ ID NO: 552108 - RNA, 20 nt, Human
ugggaggcugaggcaggagg

SEQ ID NO: 552109 - RNA, 24 nt, Human
ugggaggcugaggcaggaggacca

SEQ ID NO: 552110 - RNA, 20 nt, Human
ugggaggcugaggcgggugg

SEQ ID NO: 552111 - RNA, 23 nt, Human
ugggaggcugaggcggguggauc

SEQ ID NO: 552112 - RNA, 24 nt, Human
ugggaggcugaggcggguggauca

SEQ ID NO: 552113 - RNA, 21 nt, Human
ugggaggucaaagugggugga

SEQ ID NO: 552114 - RNA, 23 nt, Human
ugggaggucaaaguggguggauc

SEQ ID NO: 552115 - RNA, 19 nt, Human
ugguaaaucagugguaaag

SEQ ID NO: 552116 - RNA, 24 nt, Human
ugguggcgugcaccuguaguccca

SEQ ID NO: 552117 - RNA, 25 nt, Human
ugguggcuuacgucuaguaauccca

SEQ ID NO: 552118 - RNA, 19 nt, Human
uguauccucuacucucagc

SEQ ID NO: 552119 - RNA, 20 nt, Human
uuacacacuacagccccaaa

SEQ ID NO: 552120 - RNA, 24 nt, Human
uucccacauauagauauaguugca

SEQ ID NO: 552121 - RNA, 22 nt, Human
uugaggccaggaguucaagacc

SEQ ID NO: 552122 - RNA, 22 nt, Human
uugcagugagccaagaucguac

SEQ ID NO: 552123 - RNA, 25 nt, Human
uugcccagguuggagugcagugguu

SEQ ID NO: 552124 - RNA, 23 nt, Human
uugcuggaaagccuaguccacag

SEQ ID NO: 552125 - RNA, 21 nt, Human
uugcuugaaccugggaagcgg

SEQ ID NO: 552126 - RNA, 25 nt, Human
uugcuugaaccugggaagcggaagu

SEQ ID NO: 552127 - RNA, 24 nt, Human
uugggagcugaggcaggagaaucg

SEQ ID NO: 552128 - RNA, 25 nt, Human
uugggaggcugaggcggguggauca

SEQ ID NO: 552129 - RNA, 23 nt, Human
uuucuaguuuuuuguuguccaaa

SEQ ID NO: 552130 - RNA, 20 nt, Human
aaagggcagggagagaggaa

SEQ ID NO: 552131 - RNA, 25 nt, Human
aagaggccaaguggcgcugguggga

SEQ ID NO: 552132 - RNA, 20 nt, Human
aagcuccuccuggccugccc

SEQ ID NO: 552133 - RNA, 21 nt, Human
agaccaagaagaccacagcca

SEQ ID NO: 552134 - RNA, 21 nt, Human
agagaagaggggggaaggagg

SEQ ID NO: 552135 - RNA, 22 nt, Human
agaggaauggaggagggagagg

SEQ ID NO: 552136 - RNA, 22 nt, Human
agaggggggaaggaggagacau

SEQ ID NO: 552137 - RNA, 22 nt, Human
aggaauggaggagggagaggga

SEQ ID NO: 552138 - RNA, 18 nt, Human
aggcaggaaaagggcagg

SEQ ID NO: 552139 - RNA, 19 nt, Human
aggcgaggccccccaagcc

SEQ ID NO: 552140 - RNA, 20 nt, Human
aggcgaggccccccaagccc

SEQ ID NO: 552141 - RNA, 22 nt, Human
aggcugggccgcaggagagaga

SEQ ID NO: 552142 - RNA, 22 nt, Human
agggagaaggggggggcugagg

SEQ ID NO: 552143 - RNA, 27 nt, Human
aggggggaaggaggagacauuagggag

SEQ ID NO: 552144 - RNA, 20 nt, Human
auggaggagggagagggagg

SEQ ID NO: 552145 - RNA, 23 nt, Human
augggagggaaggaggagaggaa

SEQ ID NO: 552146 - RNA, 22 nt, Human
caagaagaccacagccaggccc

SEQ ID NO: 552147 - RNA, 21 nt, Human
caagaccaagaagaccacagc

SEQ ID NO: 552148 - RNA, 24 nt, Human
caccaagggggccuggccugcgcc

SEQ ID NO: 552149 - RNA, 23 nt, Human
cacccgcugccucccccaacccc

SEQ ID NO: 552150 - RNA, 19 nt, Human
cagcaagaccaagaagacc

SEQ ID NO: 552151 - RNA, 21 nt, Human
cagccucugcuucaccaaggg

SEQ ID NO: 552152 - RNA, 20 nt, Human
cagcuucagagccaucaccc

SEQ ID NO: 552153 - RNA, 22 nt, Human
cagguccucaccucugcucuuc

SEQ ID NO: 552154 - RNA, 19 nt, Human
ccccaaucuccugagggag

SEQ ID NO: 552155 - RNA, 22 nt, Human
cccuccccaaccagcuucacgg

SEQ ID NO: 552156 - RNA, 18 nt, Human
cccugggccccuggccuc

SEQ ID NO: 552157 - RNA, 20 nt, Human
ccgcugccucccccaacccc

SEQ ID NO: 552158 - RNA, 18 nt, Human
ccugcagcuccucccgca

SEQ ID NO: 552159 - RNA, 22 nt, Human
ccugcucugccuggcccagggg

SEQ ID NO: 552160 - RNA, 21 nt, Human
ccuggcccagggggcaaagag

SEQ ID NO: 552161 - RNA, 20 nt, Human
ccuggccugccccucagggg

SEQ ID NO: 552162 - RNA, 20 nt, Human
cuccuccuggccugccccuc

SEQ ID NO: 552163 - RNA, 18 nt, Human
cugcagcuccucccgcag

SEQ ID NO: 552164 - RNA, 19 nt, Human
cuggccugcgcccaagcuc

SEQ ID NO: 552165 - RNA, 24 nt, Human
cuggguccugcccugggccccugg

SEQ ID NO: 552166 - RNA, 18 nt, Human
gaccacagccaggcccug

SEQ ID NO: 552167 - RNA, 22 nt, Human
gagggaaggaggagaggaagag

SEQ ID NO: 552168 - RNA, 24 nt, Human
gagggagagggaggcugggccgca

SEQ ID NO: 552169 - RNA, 20 nt, Human
gcagggagagaggaauggag

SEQ ID NO: 552170 - RNA, 23 nt, Human
gccuuugggucacagggggcagc

SEQ ID NO: 552171 - RNA, 18 nt, Human
ggaagaggccaaguggcg

SEQ ID NO: 552172 - RNA, 18 nt, Human
ggagagagaagagggggg

SEQ ID NO: 552173 - RNA, 24 nt, Human
ggagagagaagaggggggaaggag

SEQ ID NO: 552174 - RNA, 21 nt, Human
ggagagaggaauggaggaggg

SEQ ID NO: 552175 - RNA, 19 nt, Human
ggagauggcgcuggccggg

SEQ ID NO: 552176 - RNA, 18 nt, Human
ggaggagggagagggagg

SEQ ID NO: 552177 - RNA, 20 nt, Human
ggaggagggagagggaggcu

SEQ ID NO: 552178 - RNA, 25 nt, Human
ggagggagagggaggcugggccgca

SEQ ID NO: 552179 - RNA, 18 nt, Human
ggcagggagagaggaaug

SEQ ID NO: 552180 - RNA, 20 nt, Human
ggcgggagauggcgcuggcc

SEQ ID NO: 552181 - RNA, 22 nt, Human
gggagggaaggaggagaggaag

SEQ ID NO: 552182 - RNA, 22 nt, Human
gggcagggagagaggaauggag

SEQ ID NO: 552183 - RNA, 20 nt, Human
gggccccuggccucuguacc

SEQ ID NO: 552184 - RNA, 18 nt, Human
ggggaaaaggaguuggaa

SEQ ID NO: 552185 - RNA, 20 nt, Human
gugagaccugagaaggaaag

SEQ ID NO: 552186 - RNA, 24 nt, Human
guggcgcugggagagagcagguac

SEQ ID NO: 552187 - RNA, 25 nt, Human
uacacacagugacuuuauuacucua

SEQ ID NO: 552188 - RNA, 19 nt, Human
ucaccaagggggccuggcc

SEQ ID NO: 552189 - RNA, 24 nt, Human
ucacccgcugccucccccaacccc

SEQ ID NO: 552190 - RNA, 22 nt, Human
ucaggcgaggccccccaagccc

SEQ ID NO: 552191 - RNA, 22 nt, Human
ucccagguccucaccucugcuc

SEQ ID NO: 552192 - RNA, 23 nt, Human
uccuagggacaagacccagaccc

SEQ ID NO: 552193 - RNA, 18 nt, Human
uccuucagccucugcuuc

SEQ ID NO: 552194 - RNA, 18 nt, Human
ucggguggugaggaaagg

SEQ ID NO: 552195 - RNA, 19 nt, Human
ugaggaaagggugugcccu

SEQ ID NO: 552196 - RNA, 20 nt, Human
ugagggaggagaauuccuag

SEQ ID NO: 552197 - RNA, 22 nt, Human
ugcccugggccccuggccucug

SEQ ID NO: 552198 - RNA, 23 nt, Human
ugcccugggccccuggccucugu

SEQ ID NO: 552199 - RNA, 19 nt, Human
uggaaaggaauaggaaggc

SEQ ID NO: 552200 - RNA, 20 nt, Human
uggaaaggaauaggaaggcg

SEQ ID NO: 552201 - RNA, 21 nt, Human
uggccucuguaccucaguccu

SEQ ID NO: 552202 - RNA, 23 nt, Human
uggccugccccucagggguccca

SEQ ID NO: 552203 - RNA, 20 nt, Human
ugggaaguucagacaaggga

SEQ ID NO: 552204 - RNA, 19 nt, Human
ugggccccuggccucugua

SEQ ID NO: 552205 - RNA, 25 nt, Human
ugggccccuggccucuguaccucag

SEQ ID NO: 552206 - RNA, 19 nt, Human
uggguucagcuucagagcc

SEQ ID NO: 552207 - RNA, 21 nt, Human
uuagggagaggccccuucaca

SEQ ID NO: 552208 - RNA, 19 nt, Human
aaaauaacauagucucccu

SEQ ID NO: 552209 - RNA, 18 nt, Human
aaaauuaaaaguauggcc

SEQ ID NO: 552210 - RNA, 22 nt, Human
aacaccacauuccugagcuccc

SEQ ID NO: 552211 - RNA, 22 nt, Human
aacauaccccaucagacaccaa

SEQ ID NO: 552212 - RNA, 18 nt, Human
aagacacacaucaagaca

SEQ ID NO: 552213 - RNA, 26 nt, Human
aagcacuaccuaugaagaacauaccc

SEQ ID NO: 552214 - RNA, 22 nt, Human
aagcugcaucuggacuccagga

SEQ ID NO: 552215 - RNA, 21 nt, Human
aaggggccugaggaagucugc

SEQ ID NO: 552216 - RNA, 19 nt, Human
aagugcacuuuggggaaca

SEQ ID NO: 552217 - RNA, 21 nt, Human
aaucacugaagccgauuuuga

SEQ ID NO: 552218 - RNA, 24 nt, Human
acaagcugcaucuggacuccagga

SEQ ID NO: 552219 - RNA, 23 nt, Human
acacacaucaagacacaagcacu

SEQ ID NO: 552220 - RNA, 22 nt, Human
accacauuccugagcuccccug

SEQ ID NO: 552221 - RNA, 21 nt, Human
accacucuaagaaacuuuggc

SEQ ID NO: 552222 - RNA, 18 nt, Human
accugcugcuguuucuuu

SEQ ID NO: 552223 - RNA, 18 nt, Human
agccacacucaccggccu

SEQ ID NO: 552224 - RNA, 23 nt, Human
agggggcaugugugaucagccag

SEQ ID NO: 552225 - RNA, 24 nt, Human
augaagaacauaccccaucagaca

SEQ ID NO: 552226 - RNA, 26 nt, Human
caaaacagaagacuguuuaaaauaac

SEQ ID NO: 552227 - RNA, 23 nt, Human
caaccaguaguaucaaauaacaa

SEQ ID NO: 552228 - RNA, 26 nt, Human
caaccggcaaacuccugccacuuccu

SEQ ID NO: 552229 - RNA, 20 nt, Human
cacagcacugcugacaaagc

SEQ ID NO: 552230 - RNA, 25 nt, Human
cacuaccuaugaagaacauacccca

SEQ ID NO: 552231 - RNA, 19 nt, Human
cagaaccaugagugacaaa

SEQ ID NO: 552232 - RNA, 22 nt, Human
cagacaacuggccaaaacagag

SEQ ID NO: 552233 - RNA, 24 nt, Human
cagauguauauacuuauugaaucc

SEQ ID NO: 552234 - RNA, 25 nt, Human
cagcagcugagcagccaucccucug

SEQ ID NO: 552235 - RNA, 20 nt, Human
cagccagccccuccacaaca

SEQ ID NO: 552236 - RNA, 23 nt, Human
cagccagccccuccacaacaccu

SEQ ID NO: 552237 - RNA, 19 nt, Human
cagcugagcagccaucccu

SEQ ID NO: 552238 - RNA, 20 nt, Human
cagcugagcagccaucccuc

SEQ ID NO: 552239 - RNA, 18 nt, Human
cagugagagcccugcaca

SEQ ID NO: 552240 - RNA, 19 nt, Human
caucuggacuccaggaugu

SEQ ID NO: 552241 - RNA, 25 nt, Human
ccacaacaccacauuccugagcucc

SEQ ID NO: 552242 - RNA, 18 nt, Human
ccagaaccaugagugaca

SEQ ID NO: 552243 - RNA, 25 nt, Human
ccaguaguaucaaauaacaaaauua

SEQ ID NO: 552244 - RNA, 22 nt, Human
cccaacccacggagaaaaugca

SEQ ID NO: 552245 - RNA, 19 nt, Human
cccagucuaaggucuuuug

SEQ ID NO: 552246 - RNA, 22 nt, Human
ccccgaggccgcgcccuccccg

SEQ ID NO: 552247 - RNA, 20 nt, Human
ccccgcagccacacucaccg

SEQ ID NO: 552248 - RNA, 23 nt, Human
ccccugaccccgaguccccaccc

SEQ ID NO: 552249 - RNA, 23 nt, Human
cccgaggccgcgcccuccccggg

SEQ ID NO: 552250 - RNA, 23 nt, Human
cccugaccccgaguccccacccc

SEQ ID NO: 552251 - RNA, 21 nt, Human
ccuccacaacaccacauuccu

SEQ ID NO: 552252 - RNA, 22 nt, Human
ccuccacaacaccacauuccug

SEQ ID NO: 552253 - RNA, 19 nt, Human
ccugaccccgaguccccac

SEQ ID NO: 552254 - RNA, 23 nt, Human
ccugcacgccgucuccccgaggc

SEQ ID NO: 552255 - RNA, 19 nt, Human
ccuugaucuuggacuuccc

SEQ ID NO: 552256 - RNA, 21 nt, Human
cuaccuaugaagaacauaccc

SEQ ID NO: 552257 - RNA, 31 nt, Human
cucacagcacugcugacaaagcgcgcagccu

SEQ ID NO: 552258 - RNA, 18 nt, Human
cuccccuccaccagcucc

SEQ ID NO: 552259 - RNA, 25 nt, Human
cuccccuccaccagcuccacuuucc

SEQ ID NO: 552260 - RNA, 22 nt, Human
cucugcugcccacggugaauag

SEQ ID NO: 552261 - RNA, 21 nt, Human
cugagcagccaucccucugcu

SEQ ID NO: 552262 - RNA, 23 nt, Human
cugcacgccgucuccccgaggcc

SEQ ID NO: 552263 - RNA, 22 nt, Human
cugcuguuuacaaccacgugaa

SEQ ID NO: 552264 - RNA, 22 nt, Human
cuugaaguguccccagauacgu

SEQ ID NO: 552265 - RNA, 25 nt, Human
gaagaacauaccccaucagacacca

SEQ ID NO: 552266 - RNA, 26 nt, Human
gaagaacauaccccaucagacaccaa

SEQ ID NO: 552267 - RNA, 20 nt, Human
gacaagcugcaucuggacuc

SEQ ID NO: 552268 - RNA, 28 nt, Human
gaccacucuaagaaacuuuggcauucaa

SEQ ID NO: 552269 - RNA, 23 nt, Human
gaggaccuuugggaggucaugag

SEQ ID NO: 552270 - RNA, 20 nt, Human
gauguaucugacaaagaggg

SEQ ID NO: 552271 - RNA, 20 nt, Human
ggaaacgguggguggaggga

SEQ ID NO: 552272 - RNA, 24 nt, Human
ggaaggcccucacgcucccaaccc

SEQ ID NO: 552273 - RNA, 23 nt, Human
ggagaugucuccucccuccccuc

SEQ ID NO: 552274 - RNA, 18 nt, Human
gggaggucaugaggucag

SEQ ID NO: 552275 - RNA, 24 nt, Human
guggaacaacuggaaaugccagaa

SEQ ID NO: 552276 - RNA, 20 nt, Human
uaaaaaacguaacagaccac

SEQ ID NO: 552277 - RNA, 25 nt, Human
uacccagucuaaggucuuuuguuac

SEQ ID NO: 552278 - RNA, 24 nt, Human
uagcugcaaaaaucacuauaaaaa

SEQ ID NO: 552279 - RNA, 23 nt, Human
uauauacuuauugaauccaugca

SEQ ID NO: 552280 - RNA, 24 nt, Human
uauuugcuaacucugaaaaaaaaa

SEQ ID NO: 552281 - RNA, 18 nt, Human
ucagacaccaaaucugcc

SEQ ID NO: 552282 - RNA, 20 nt, Human
uccacaacaccacauuccug

SEQ ID NO: 552283 - RNA, 22 nt, Human
uccacaacaccacauuccugag

SEQ ID NO: 552284 - RNA, 24 nt, Human
ucccaacccacggagaaaaugcag

SEQ ID NO: 552285 - RNA, 20 nt, Human
uccccggggccagguuccgg

SEQ ID NO: 552286 - RNA, 21 nt, Human
uccccugaccccgagucccca

SEQ ID NO: 552287 - RNA, 21 nt, Human
uccuagcuugguggcugccag

SEQ ID NO: 552288 - RNA, 19 nt, Human
uccugagcuccccugaccc

SEQ ID NO: 552289 - RNA, 19 nt, Human
uccugagcuccccugaccc

SEQ ID NO: 552290 - RNA, 18 nt, Human
uccugggcaccgccagug

SEQ ID NO: 552291 - RNA, 25 nt, Human
uccugggcaccgccagugagagccc

SEQ ID NO: 552292 - RNA, 24 nt, Human
ucucacagcacugcugacaaagcg

SEQ ID NO: 552293 - RNA, 24 nt, Human
ucucccuuaauuaaaaguuuuauu

SEQ ID NO: 552294 - RNA, 25 nt, Human
ucuguauuauuuauuuguguacacc

SEQ ID NO: 552295 - RNA, 22 nt, Human
ugaaaaaaaaauuuuuccccuc

SEQ ID NO: 552296 - RNA, 19 nt, Human
ugaaccuugaagugucccc

SEQ ID NO: 552297 - RNA, 27 nt, Human
ugaagaacauaccccaucagacaccaa

SEQ ID NO: 552298 - RNA, 22 nt, Human
ugaauaggaagacaggccugcg

SEQ ID NO: 552299 - RNA, 19 nt, Human
ugaccccgaguccccaccc

SEQ ID NO: 552300 - RNA, 20 nt, Human
ugaccccgaguccccacccc

SEQ ID NO: 552301 - RNA, 18 nt, Human
ugagagcccugcacagag

SEQ ID NO: 552302 - RNA, 21 nt, Human
ugcagggaaacggugggugga

SEQ ID NO: 552303 - RNA, 22 nt, Human
ugcagggaaacgguggguggag

SEQ ID NO: 552304 - RNA, 23 nt, Human
ugccagagccuugaucuuggacc

SEQ ID NO: 552305 - RNA, 25 nt, Human
uggccaaaacagaagacuguuuaaa

SEQ ID NO: 552306 - RNA, 23 nt, Human
ugggaggucaugaggucagggcc

SEQ ID NO: 552307 - RNA, 20 nt, Human
uggucuguuggugcuucccu

SEQ ID NO: 552308 - RNA, 19 nt, Human
ugucuccucccuccccucc

SEQ ID NO: 552309 - RNA, 20 nt, Human
ugucuccucccuccccucca

SEQ ID NO: 552310 - RNA, 23 nt, Human
uguuaccagcggccauggcucag

SEQ ID NO: 552311 - RNA, 22 nt, Human
uguuuacaaccacgugaagaca

SEQ ID NO: 552312 - RNA, 18 nt, Human
uugggaggucaugagguc

SEQ ID NO: 552313 - RNA, 23 nt, Human
uugguggcugccagcgugcacug

SEQ ID NO: 552314 - RNA, 23 nt, Human
uuucccgcugaagaaacagagau

SEQ ID NO: 552315 - RNA, 23 nt, Human
uuuccuucuugccccucccacaa

SEQ ID NO: 552316 - RNA, 22 nt, Human
uuuuuuuuuuuuuuucuguauu

SEQ ID NO: 552317 - RNA, 24 nt, Human
uuuuuuuuuuuuuuuuuuucuggg

SEQ ID NO: 552318 - RNA, 20 nt, Human
aacaaaggauaaaagauccc

SEQ ID NO: 552319 - RNA, 20 nt, Human
auaaaaaucaaguacucaug

SEQ ID NO: 552320 - RNA, 21 nt, Human
caacaaaggauaaaagauccc

SEQ ID NO: 552321 - RNA, 25 nt, Human
caccgaguccuucccagcugggucu

SEQ ID NO: 552322 - RNA, 23 nt, Human
ccacacuuuugcaacaaaggaua

SEQ ID NO: 552323 - RNA, 22 nt, Human
cucugaaacuuccauuuacacc

SEQ ID NO: 552324 - RNA, 21 nt, Human
cugccaagcugucaaaagugu

SEQ ID NO: 552325 - RNA, 26 nt, Human
gaaccacuggcaaacuguuggaaaug

SEQ ID NO: 552326 - RNA, 21 nt, Human
uacagugagagaaaaauggaa

SEQ ID NO: 552327 - RNA, 23 nt, Human
uacagugagagaaaaauggaauu

SEQ ID NO: 552328 - RNA, 25 nt, Human
uaucaagaagaggaagaaaaggcuc

SEQ ID NO: 552329 - RNA, 25 nt, Human
uauuuuguccucucugaaacuucca

SEQ ID NO: 552330 - RNA, 21 nt, Human
ucaaaaguguccacacuuuug

SEQ ID NO: 552331 - RNA, 18 nt, Human
ucaagaagaggaagaaaa

SEQ ID NO: 552332 - RNA, 19 nt, Human
ucuccaguuuuuuggcucu

SEQ ID NO: 552333 - RNA, 21 nt, Human
ugcaacaaaggauaaaagauc

SEQ ID NO: 552334 - RNA, 18 nt, Human
uucccagcugggucucau

SEQ ID NO: 552335 - RNA, 24 nt, Human
uuuuuggcucuaagaaauuacacu

SEQ ID NO: 552336 - RNA, 26 nt, Human
acuucaggggacgccugauccgagga

SEQ ID NO: 552337 - RNA, 21 nt, Human
aggcagcaccggggacggacu

SEQ ID NO: 552338 - RNA, 25 nt, Human
caaacaagugaaaggcucacaaaca

SEQ ID NO: 552339 - RNA, 21 nt, Human
cagaccacuagaaaagugcuu

SEQ ID NO: 552340 - RNA, 20 nt, Human
cgagaagagcuccagcgaga

SEQ ID NO: 552341 - RNA, 18 nt, Human
cggcagcccggacggggu

SEQ ID NO: 552342 - RNA, 22 nt, Human
gaaccagcccugaaugcccugg

SEQ ID NO: 552343 - RNA, 23 nt, Human
gaagagcuccagcgagacucagg

SEQ ID NO: 552344 - RNA, 18 nt, Human
gcagcaccggggacggac

SEQ ID NO: 552345 - RNA, 24 nt, Human
gggcgggcgagaagagcuccagcg

SEQ ID NO: 552346 - RNA, 24 nt, Human
uaacagcaaagguuuggggguggg

SEQ ID NO: 552347 - RNA, 19 nt, Human
ugaaaggcucacaaacaga

SEQ ID NO: 552348 - RNA, 21 nt, Human
ugaaaggcucacaaacagacc

SEQ ID NO: 552349 - RNA, 26 nt, Human
ugaacgcgcaggcagcaccggggacg

SEQ ID NO: 552350 - RNA, 23 nt, Human
ugaggugggcgggcgagaagagc

SEQ ID NO: 552351 - RNA, 21 nt, Human
ugucugaaccagcccugaaug

SEQ ID NO: 552352 - RNA, 24 nt, Human
aaaaaaaaggggggggggacaaaa

SEQ ID NO: 552353 - RNA, 20 nt, Human
aaacagaaaaacugaagagc

SEQ ID NO: 552354 - RNA, 19 nt, Human
aagacccuuuacaccucag

SEQ ID NO: 552355 - RNA, 23 nt, Human
aagagcucuuccaagccccgacc

SEQ ID NO: 552356 - RNA, 19 nt, Human
acaaaacuuuaauucaaau

SEQ ID NO: 552357 - RNA, 18 nt, Human
agagcucuuccaagcccc

SEQ ID NO: 552358 - RNA, 21 nt, Human
agagcucuuccaagccccgac

SEQ ID NO: 552359 - RNA, 21 nt, Human
aggaaacagaaaaacugaaga

SEQ ID NO: 552360 - RNA, 23 nt, Human
aggaaacagaaaaacugaagagc

SEQ ID NO: 552361 - RNA, 21 nt, Human
aucaccauuuuccaccuccac

SEQ ID NO: 552362 - RNA, 19 nt, Human
auuugauuuacauuccaaa

SEQ ID NO: 552363 - RNA, 18 nt, Human
caagccccgaccaggaac

SEQ ID NO: 552364 - RNA, 21 nt, Human
caaggauaaccuucuaauuaa

SEQ ID NO: 552365 - RNA, 21 nt, Human
caccuccacaccaaggauaac

SEQ ID NO: 552366 - RNA, 20 nt, Human
cagcaagcagcuccugccuu

SEQ ID NO: 552367 - RNA, 18 nt, Human
cauuuuccaccuccacac

SEQ ID NO: 552368 - RNA, 18 nt, Human
ccuccagugucccucuuu

SEQ ID NO: 552369 - RNA, 26 nt, Human
ccucuuuagagacaggagcggggauu

SEQ ID NO: 552370 - RNA, 20 nt, Human
ccuugcccuuuccccucuuu

SEQ ID NO: 552371 - RNA, 18 nt, Human
cuugaggaaacagaaaaa

SEQ ID NO: 552372 - RNA, 25 nt, Human
guuuauaaaaaaaagggggggggga

SEQ ID NO: 552373 - RNA, 21 nt, Human
uaaaacaugauaaauuuucag

SEQ ID NO: 552374 - RNA, 21 nt, Human
uaaauugcaaacacaccccuc

SEQ ID NO: 552375 - RNA, 19 nt, Human
ucacuuguuuauaaaaaaa

SEQ ID NO: 552376 - RNA, 18 nt, Human
uccugccuucuuauuugg

SEQ ID NO: 552377 - RNA, 19 nt, Human
ugcaaacacaccccuccag

SEQ ID NO: 552378 - RNA, 18 nt, Human
uggucuaauugccacugc

SEQ ID NO: 552379 - RNA, 19 nt, Human
uguuguaauaggauagcac

SEQ ID NO: 552380 - RNA, 19 nt, Human
uuauaaaaaaaaggggggg

SEQ ID NO: 552381 - RNA, 26 nt, Human
uugcaaacacaccccuccaguguccc

SEQ ID NO: 552382 - RNA, 19 nt, Human
aaaaacaaacaacaaaaaa

SEQ ID NO: 552383 - RNA, 23 nt, Human
aaaacaaacaacaaaaaaaaccc

SEQ ID NO: 552384 - RNA, 23 nt, Human
aaacaaacaacaaaaaaaaccca

SEQ ID NO: 552385 - RNA, 18 nt, Human
aaauggcccccuaaaccc

SEQ ID NO: 552386 - RNA, 25 nt, Human
aacaaaaaaaacccaguuuauucau

SEQ ID NO: 552387 - RNA, 22 nt, Human
aacaccuccucccuugccaucu

SEQ ID NO: 552388 - RNA, 25 nt, Human
aagaaaaacgagggaaaaucaacaa

SEQ ID NO: 552389 - RNA, 19 nt, Human
aagcaggaaaacucagacg

SEQ ID NO: 552390 - RNA, 21 nt, Human
aaucccgcacucucccaauga

SEQ ID NO: 552391 - RNA, 18 nt, Human
aauccgggaccccucccc

SEQ ID NO: 552392 - RNA, 18 nt, Human
aaugcaagacaaaguuaa

SEQ ID NO: 552393 - RNA, 25 nt, Human
agaaaaaaaagaagacaguggcaag

SEQ ID NO: 552394 - RNA, 23 nt, Human
agaaaaaacaaacaaacauaaaa

SEQ ID NO: 552395 - RNA, 24 nt, Human
agaugucagaagccaucaaugucu

SEQ ID NO: 552396 - RNA, 19 nt, Human
aggaaagcaggaaaacuca

SEQ ID NO: 552397 - RNA, 22 nt, Human
aggaaagcaggaaaacucagac

SEQ ID NO: 552398 - RNA, 21 nt, Human
aggaacugcagugggacaggu

SEQ ID NO: 552399 - RNA, 18 nt, Human
auaaacacaaauggcaaa

SEQ ID NO: 552400 - RNA, 21 nt, Human
auggcaagauaaacuccccaa

SEQ ID NO: 552401 - RNA, 29 nt, Human
caaacauaaaauccgggaccccucccccc

SEQ ID NO: 552402 - RNA, 22 nt, Human
caagaacaccuccucccuugcc

SEQ ID NO: 552403 - RNA, 24 nt, Human
caagaacaccuccucccuugccau

SEQ ID NO: 552404 - RNA, 19 nt, Human
cacaaccauuagcaaauuu

SEQ ID NO: 552405 - RNA, 21 nt, Human
cacacaaauggcccccuaaac

SEQ ID NO: 552406 - RNA, 18 nt, Human
cagaaggggaggauggca

SEQ ID NO: 552407 - RNA, 24 nt, Human
cagauauaccucagaaucugcacg

SEQ ID NO: 552408 - RNA, 20 nt, Human
cagcgggagccuccuccugu

SEQ ID NO: 552409 - RNA, 25 nt, Human
cagugccgagaggcuguguuguaga

SEQ ID NO: 552410 - RNA, 18 nt, Human
cauuagcaaauuuccgag

SEQ ID NO: 552411 - RNA, 22 nt, Human
ccaacagcguuagguuuuuuuu

SEQ ID NO: 552412 - RNA, 24 nt, Human
ccacacaaauggcccccuaaaccc

SEQ ID NO: 552413 - RNA, 22 nt, Human
ccccccuucuucucuuaaaguc

SEQ ID NO: 552414 - RNA, 22 nt, Human
cccccuaaacccauaaacacaa

SEQ ID NO: 552415 - RNA, 23 nt, Human
cccccuucuucucuuaaagucac

SEQ ID NO: 552416 - RNA, 19 nt, Human
ccuaaacccauaaacacaa

SEQ ID NO: 552417 - RNA, 21 nt, Human
ccuaaacccauaaacacaaau

SEQ ID NO: 552418 - RNA, 18 nt, Human
ccucccuuccucuucucu

SEQ ID NO: 552419 - RNA, 23 nt, Human
ccuuagauauaugagaaaaaaaa

SEQ ID NO: 552420 - RNA, 22 nt, Human
cgaguagauugguccacacaaa

SEQ ID NO: 552421 - RNA, 19 nt, Human
cugaauggggccauuggca

SEQ ID NO: 552422 - RNA, 23 nt, Human
cugcacgaggcaggaaagcagga

SEQ ID NO: 552423 - RNA, 21 nt, Human
cuucaaaugaaaacgaaagga

SEQ ID NO: 552424 - RNA, 21 nt, Human
cuucaagaacaccuccucccu

SEQ ID NO: 552425 - RNA, 23 nt, Human
cuuuccgcuuccgggucccaaca

SEQ ID NO: 552426 - RNA, 23 nt, Human
gaaccagaaggggaggauggcag

SEQ ID NO: 552427 - RNA, 20 nt, Human
gaaggcaccagcccaaucug

SEQ ID NO: 552428 - RNA, 21 nt, Human
gacccggaaguaucgaccuca

SEQ ID NO: 552429 - RNA, 24 nt, Human
gagaaaaaacaaacaaacauaaaa

SEQ ID NO: 552430 - RNA, 20 nt, Human
gagcagcagugccgagaggc

SEQ ID NO: 552431 - RNA, 21 nt, Human
gauggacgggggaaagagaga

SEQ ID NO: 552432 - RNA, 21 nt, Human
gcaggaaagcaggaaaacuca

SEQ ID NO: 552433 - RNA, 21 nt, Human
gcccuuuccgcuuccgggucc

SEQ ID NO: 552434 - RNA, 20 nt, Human
gccucccuuccucuucucuu

SEQ ID NO: 552435 - RNA, 20 nt, Human
ggaaagcaggaaaacucaga

SEQ ID NO: 552436 - RNA, 18 nt, Human
ggaagaauggagcucagg

SEQ ID NO: 552437 - RNA, 21 nt, Human
ggaggaagaauggagcucagg

SEQ ID NO: 552438 - RNA, 20 nt, Human
ggcacguguccuggugggcc

SEQ ID NO: 552439 - RNA, 20 nt, Human
ggcuggaggaagaauggagc

SEQ ID NO: 552440 - RNA, 18 nt, Human
gggaaagagagaaagaaa

SEQ ID NO: 552441 - RNA, 21 nt, Human
ggugacaggaagagagaagaa

SEQ ID NO: 552442 - RNA, 19 nt, Human
gucauggcaguaggguagg

SEQ ID NO: 552443 - RNA, 18 nt, Human
guccuggugggccuggaa

SEQ ID NO: 552444 - RNA, 18 nt, Human
uaaacacaaauggcaaaa

SEQ ID NO: 552445 - RNA, 18 nt, Human
uacaugaggcacaaccug

SEQ ID NO: 552446 - RNA, 18 nt, Human
ucacgcgaggucccggcu

SEQ ID NO: 552447 - RNA, 18 nt, Human
ucacuggcucaagcugua

SEQ ID NO: 552448 - RNA, 18 nt, Human
ucagggccaaaguucaga

SEQ ID NO: 552449 - RNA, 21 nt, Human
ucagggguuggcuggaggaag

SEQ ID NO: 552450 - RNA, 21 nt, Human
ucaggguauucuaggcccaag

SEQ ID NO: 552451 - RNA, 22 nt, Human
ucauuguaccaugugugcauug

SEQ ID NO: 552452 - RNA, 18 nt, Human
uccccgaguagauugguc

SEQ ID NO: 552453 - RNA, 23 nt, Human
uccucuucucuuuucucaucagg

SEQ ID NO: 552454 - RNA, 23 nt, Human
ucgcgggguuugucaacuucgcc

SEQ ID NO: 552455 - RNA, 20 nt, Human
ucuaucauuguaccaugugu

SEQ ID NO: 552456 - RNA, 24 nt, Human
ucugcacgaggcaggaaagcagga

SEQ ID NO: 552457 - RNA, 21 nt, Human
ugaaaacgaaaggaaaaauac

SEQ ID NO: 552458 - RNA, 18 nt, Human
ugaauggggccauuggca

SEQ ID NO: 552459 - RNA, 21 nt, Human
ugacccggaaguaucgaccuc

SEQ ID NO: 552460 - RNA, 21 nt, Human
ugacuccuuugagccuuccuc

SEQ ID NO: 552461 - RNA, 24 nt, Human
ugcagagaaccagaaggggaggau

SEQ ID NO: 552462 - RNA, 18 nt, Human
ugcgaugcaaagagucga

SEQ ID NO: 552463 - RNA, 26 nt, Human
ugcggaaggucauggcaguaggguag

SEQ ID NO: 552464 - RNA, 23 nt, Human
ugcuaaggagaaaaaacaaacaa

SEQ ID NO: 552465 - RNA, 24 nt, Human
ugcuaaggagaaaaaacaaacaaa

SEQ ID NO: 552466 - RNA, 20 nt, Human
ugcuucuuaugucuuccaag

SEQ ID NO: 552467 - RNA, 19 nt, Human
uggaauuccccgaguagau

SEQ ID NO: 552468 - RNA, 21 nt, Human
uggcaagauaaacuccccaaa

SEQ ID NO: 552469 - RNA, 21 nt, Human
uggcacguguccuggugggcc

SEQ ID NO: 552470 - RNA, 21 nt, Human
uggccucccuuccucuucucu

SEQ ID NO: 552471 - RNA, 21 nt, Human
uguagauauggccucccuucc

SEQ ID NO: 552472 - RNA, 21 nt, Human
uuacaaaaacaaacaacaaaa

SEQ ID NO: 552473 - RNA, 19 nt, Human
uucaaaugaaaacgaaagg

SEQ ID NO: 552474 - RNA, 25 nt, Human
uuccucuucucuuuucucaucaggg

SEQ ID NO: 552475 - RNA, 23 nt, Human
uugaaaauaucaaguccuacugc

SEQ ID NO: 552476 - RNA, 22 nt, Human
uuggaggauugaaugugcuggu

SEQ ID NO: 552477 - RNA, 24 nt, Human
uuggcagaaggugacaggaagaga

SEQ ID NO: 552478 - RNA, 23 nt, Human
uuguuuguuuguuuuguuuuuuu

SEQ ID NO: 552479 - RNA, 24 nt, Human
uuuauucaucuuuuaguucuucca

SEQ ID NO: 552480 - RNA, 21 nt, Human
uuuuguuuuuuuccaacccuc

SEQ ID NO: 552481 - RNA, 22 nt, Human
agggcagaggguucaccccggg

SEQ ID NO: 552482 - RNA, 18 nt, Human
cacacugaaaaauaauaa

SEQ ID NO: 552483 - RNA, 19 nt, Human
cccucugucccagcgaggg

SEQ ID NO: 552484 - RNA, 18 nt, Human
ccucugucccagcgaggg

SEQ ID NO: 552485 - RNA, 19 nt, Human
cgccggggcgcacgcggcg

SEQ ID NO: 552486 - RNA, 20 nt, Human
gaaauguugaguuauccucc

SEQ ID NO: 552487 - RNA, 18 nt, Human
gagcagguguagucguau

SEQ ID NO: 552488 - RNA, 20 nt, Human
ggaaauguugaguuauccuc

SEQ ID NO: 552489 - RNA, 21 nt, Human
gugcagcgcggcgacugggcg

SEQ ID NO: 552490 - RNA, 21 nt, Human
uaaaaaauaaugccuucccuc

SEQ ID NO: 552491 - RNA, 20 nt, Human
ucaaucaaauuaaaguugga

SEQ ID NO: 552492 - RNA, 18 nt, Human
ucccuuuacggguaugca

SEQ ID NO: 552493 - RNA, 25 nt, Human
ugaaggggaagacagagcuccuccg

SEQ ID NO: 552494 - RNA, 18 nt, Human
aaaagaugaaagagcuuu

SEQ ID NO: 552495 - RNA, 18 nt, Human
aaagagcuuuuuaaauag

SEQ ID NO: 552496 - RNA, 18 nt, Human
aaagaggugaaaagaaga

SEQ ID NO: 552497 - RNA, 22 nt, Human
aaaguguugggauuacaggcau

SEQ ID NO: 552498 - RNA, 24 nt, Human
aaaguguugggauuacaggcauga

SEQ ID NO: 552499 - RNA, 20 nt, Human
aaccuccaccuccccgguuc

SEQ ID NO: 552500 - RNA, 18 nt, Human
aagccuauuugguuucca

SEQ ID NO: 552501 - RNA, 21 nt, Human
aaguguugggauuacaggcau

SEQ ID NO: 552502 - RNA, 26 nt, Human
aaguguugggauuacaggcaugagcc

SEQ ID NO: 552503 - RNA, 21 nt, Human
acaaagauaaacauagaaguu

SEQ ID NO: 552504 - RNA, 19 nt, Human
acaccacacccaaaaggug

SEQ ID NO: 552505 - RNA, 23 nt, Human
acacccaaaagguggcaaagaau

SEQ ID NO: 552506 - RNA, 18 nt, Human
acacugcuguaggcugag

SEQ ID NO: 552507 - RNA, 23 nt, Human
acagugguucaggugcuuugagg

SEQ ID NO: 552508 - RNA, 19 nt, Human
accaacuaccugcaugugc

SEQ ID NO: 552509 - RNA, 30 nt, Human
accacagucuugaccuuugcccugccugcc

SEQ ID NO: 552510 - RNA, 19 nt, Human
accccugccccaacagcuc

SEQ ID NO: 552511 - RNA, 20 nt, Human
acugcaaccuccaccucccc

SEQ ID NO: 552512 - RNA, 21 nt, Human
agaggcagcuuuuccucucua

SEQ ID NO: 552513 - RNA, 19 nt, Human
agaguuagauacuugaaca

SEQ ID NO: 552514 - RNA, 20 nt, Human
aggaaggaucagcaccuauu

SEQ ID NO: 552515 - RNA, 21 nt, Human
aggauccuucagagccaaaag

SEQ ID NO: 552516 - RNA, 18 nt, Human
aggcagcuuuuccucucu

SEQ ID NO: 552517 - RNA, 21 nt, Human
aggcuccugagucauauuccu

SEQ ID NO: 552518 - RNA, 25 nt, Human
aggcuggagugcaguggugugaucu

SEQ ID NO: 552519 - RNA, 22 nt, Human
agggaugugauaacaaaauugg

SEQ ID NO: 552520 - RNA, 24 nt, Human
aggucauaccuaucccugggcagc

SEQ ID NO: 552521 - RNA, 18 nt, Human
agugaggaagccaaugga

SEQ ID NO: 552522 - RNA, 19 nt, Human
agugcaguggugugaucuc

SEQ ID NO: 552523 - RNA, 21 nt, Human
agugcaguggugugaucucag

SEQ ID NO: 552524 - RNA, 23 nt, Human
agugcaguggugugaucucagcu

SEQ ID NO: 552525 - RNA, 24 nt, Human
agugcaguggugugaucucagcuc

SEQ ID NO: 552526 - RNA, 21 nt, Human
aguggugugaucucagcucgc

SEQ ID NO: 552527 - RNA, 18 nt, Human
auccccucccaaaacuaa

SEQ ID NO: 552528 - RNA, 22 nt, Human
aucuguuuugguaagagcuagg

SEQ ID NO: 552529 - RNA, 19 nt, Human
auuacaggcgcgugccacc

SEQ ID NO: 552530 - RNA, 19 nt, Human
caaaagaccccaauaccac

SEQ ID NO: 552531 - RNA, 21 nt, Human
caaaagaccccaauaccacag

SEQ ID NO: 552532 - RNA, 24 nt, Human
caaaaguguugggauuacaggcau

SEQ ID NO: 552533 - RNA, 18 nt, Human
caaaccucuaaccuucca

SEQ ID NO: 552534 - RNA, 24 nt, Human
caacuccucaauucuaaguuuuug

SEQ ID NO: 552535 - RNA, 21 nt, Human
caacugccuuaucccucugag

SEQ ID NO: 552536 - RNA, 20 nt, Human
caagcgauucuccugccuca

SEQ ID NO: 552537 - RNA, 22 nt, Human
caagcgauucuccugccucagc

SEQ ID NO: 552538 - RNA, 28 nt, Human
caagugauccuccugccuggaccuccca

SEQ ID NO: 552539 - RNA, 20 nt, Human
caccacacccaaaagguggc

SEQ ID NO: 552540 - RNA, 22 nt, Human
caccccaggcuggagugcagug

SEQ ID NO: 552541 - RNA, 23 nt, Human
cacugcuguaggcugagaaggcc

SEQ ID NO: 552542 - RNA, 25 nt, Human
cagcaauagaaaucacaaacuguuc

SEQ ID NO: 552543 - RNA, 20 nt, Human
cagccuccuggguagcuggg

SEQ ID NO: 552544 - RNA, 22 nt, Human
caggauccuucagagccaaaag

SEQ ID NO: 552545 - RNA, 24 nt, Human
ccaaaaguguugggauuacaggca

SEQ ID NO: 552546 - RNA, 22 nt, Human
ccaaauggaaaacaucuaaauc

SEQ ID NO: 552547 - RNA, 22 nt, Human
ccaagugauccuccugccugga

SEQ ID NO: 552548 - RNA, 18 nt, Human
ccacugcauccagcuugc

SEQ ID NO: 552549 - RNA, 21 nt, Human
ccagagucuuccuccucuucu

SEQ ID NO: 552550 - RNA, 18 nt, Human
cccaaagcuacuuggcua

SEQ ID NO: 552551 - RNA, 22 nt, Human
cccaggcuggagugcaguggug

SEQ ID NO: 552552 - RNA, 19 nt, Human
ccccaaacccaacccccuc

SEQ ID NO: 552553 - RNA, 21 nt, Human
ccccaaacccaacccccucug

SEQ ID NO: 552554 - RNA, 22 nt, Human
ccccaaacccaacccccucuga

SEQ ID NO: 552555 - RNA, 23 nt, Human
ccccaauaccacagucuugaccu

SEQ ID NO: 552556 - RNA, 26 nt, Human
ccccaauaccacagucuugaccuuug

SEQ ID NO: 552557 - RNA, 24 nt, Human
ccccaggcuggagugcaguggugu

SEQ ID NO: 552558 - RNA, 23 nt, Human
ccccgguucaagcgauucuccug

SEQ ID NO: 552559 - RNA, 19 nt, Human
cccugccccaacagcuccu

SEQ ID NO: 552560 - RNA, 18 nt, Human
ccuagcuacagcaauaga

SEQ ID NO: 552561 - RNA, 20 nt, Human
ccucaagcuccccucugccu

SEQ ID NO: 552562 - RNA, 24 nt, Human
ccuccccgguucaagcgauucucc

SEQ ID NO: 552563 - RNA, 22 nt, Human
ccuccugccuggaccucccaaa

SEQ ID NO: 552564 - RNA, 18 nt, Human
ccugaggagugguuaaag

SEQ ID NO: 552565 - RNA, 24 nt, Human
ccugccucagccuccuggguagcu

SEQ ID NO: 552566 - RNA, 18 nt, Human
ccugggcccaagugaucc

SEQ ID NO: 552567 - RNA, 22 nt, Human
ccugggcccaagugauccuccu

SEQ ID NO: 552568 - RNA, 23 nt, Human
ccuggguagcugggauuacaggc

SEQ ID NO: 552569 - RNA, 24 nt, Human
ccuggguagcugggauuacaggcg

SEQ ID NO: 552570 - RNA, 19 nt, Human
cgcugcaggcuugaccucc

SEQ ID NO: 552571 - RNA, 20 nt, Human
cuaucaccccaggcuggagu

SEQ ID NO: 552572 - RNA, 24 nt, Human
cuaucaccccaggcuggagugcag

SEQ ID NO: 552573 - RNA, 25 nt, Human
cucacugcaaccuccaccuccccgg

SEQ ID NO: 552574 - RNA, 24 nt, Human
cucagccuccuggguagcugggau

SEQ ID NO: 552575 - RNA, 19 nt, Human
cuccugguucucucuguuc

SEQ ID NO: 552576 - RNA, 19 nt, Human
cugacccuaucccaacaug

SEQ ID NO: 552577 - RNA, 24 nt, Human
cugcaaccuccaccuccccgguuc

SEQ ID NO: 552578 - RNA, 24 nt, Human
cuggaguacaauggcgugaucuca

SEQ ID NO: 552579 - RNA, 24 nt, Human
cuggagugcaguggugugaucuca

SEQ ID NO: 552580 - RNA, 20 nt, Human
cuggguagcugggauuacag

SEQ ID NO: 552581 - RNA, 18 nt, Human
cuggugacaccacaccca

SEQ ID NO: 552582 - RNA, 18 nt, Human
cuuccagacugggcaggg

SEQ ID NO: 552583 - RNA, 18 nt, Human
cuucucccagugucuaaa

SEQ ID NO: 552584 - RNA, 24 nt, Human
cuucugcagcccauucuuccugug

SEQ ID NO: 552585 - RNA, 18 nt, Human
cuugucccaucugcucac

SEQ ID NO: 552586 - RNA, 20 nt, Human
cuugucccaucugcucacuu

SEQ ID NO: 552587 - RNA, 20 nt, Human
gaaaccacugggcauccccu

SEQ ID NO: 552588 - RNA, 21 nt, Human
gaaauuuuagguugggaagca

SEQ ID NO: 552589 - RNA, 20 nt, Human
gacaaaccuaaccuuccaug

SEQ ID NO: 552590 - RNA, 18 nt, Human
gacuucuguguccacccc

SEQ ID NO: 552591 - RNA, 21 nt, Human
gacuuggucuuggcucaauag

SEQ ID NO: 552592 - RNA, 25 nt, Human
gagcugagcucccacagacugaguu

SEQ ID NO: 552593 - RNA, 21 nt, Human
gaguuugagucagaggcuuua

SEQ ID NO: 552594 - RNA, 18 nt, Human
gauuacaggcaugagcca

SEQ ID NO: 552595 - RNA, 22 nt, Human
gauuacaggcaugagccacugc

SEQ ID NO: 552596 - RNA, 23 nt, Human
gauuacaggcaugagccacugca

SEQ ID NO: 552597 - RNA, 18 nt, Human
gauuacaggcgcgugcca

SEQ ID NO: 552598 - RNA, 21 nt, Human
gauucuccugccucagccucc

SEQ ID NO: 552599 - RNA, 19 nt, Human
gcagccuaugcccaaagcu

SEQ ID NO: 552600 - RNA, 20 nt, Human
gcccaggcuggaguacaaug

SEQ ID NO: 552601 - RNA, 24 nt, Human
gcccaggcuggaguacaauggcgu

SEQ ID NO: 552602 - RNA, 24 nt, Human
gcgauucuccugccucagccuccu

SEQ ID NO: 552603 - RNA, 18 nt, Human
gcgcgccgggccagcagg

SEQ ID NO: 552604 - RNA, 19 nt, Human
gcucacuugcuuauggagc

SEQ ID NO: 552605 - RNA, 23 nt, Human
gcucacuugcuuauggagcuaaa

SEQ ID NO: 552606 - RNA, 21 nt, Human
gcuccagagucuuccuccucu

SEQ ID NO: 552607 - RNA, 30 nt, Human
gcucugucgcccaggcuggaguacaauggg

SEQ ID NO: 552608 - RNA, 19 nt, Human
gcuggaguacaauggcgug

SEQ ID NO: 552609 - RNA, 23 nt, Human
gcuuauggagcuaaaagaccccc

SEQ ID NO: 552610 - RNA, 22 nt, Human
gcuugaccuccugggcccaagu

SEQ ID NO: 552611 - RNA, 21 nt, Human
ggaagcgggugugagggcuga

SEQ ID NO: 552612 - RNA, 20 nt, Human
ggacuucuguguccaccccc

SEQ ID NO: 552613 - RNA, 22 nt, Human
ggauuacaggcaugagccacug

SEQ ID NO: 552614 - RNA, 22 nt, Human
ggcuggaguacaauggcgugau

SEQ ID NO: 552615 - RNA, 22 nt, Human
ggcuggagugcaguggugugau

SEQ ID NO: 552616 - RNA, 23 nt, Human
gggaagcaaagggaaaccacugg

SEQ ID NO: 552617 - RNA, 19 nt, Human
gggcccaagugauccuccu

SEQ ID NO: 552618 - RNA, 22 nt, Human
gggcccaagugauccuccugcc

SEQ ID NO: 552619 - RNA, 19 nt, Human
ggguuggagggggaagcgg

SEQ ID NO: 552620 - RNA, 19 nt, Human
ggugacaccacacccaaaa

SEQ ID NO: 552621 - RNA, 18 nt, Human
guagcugggauuacaggc

SEQ ID NO: 552622 - RNA, 22 nt, Human
guagcugggauuacaggcgcgu

SEQ ID NO: 552623 - RNA, 24 nt, Human
gucuugcucugucgcccaggcugg

SEQ ID NO: 552624 - RNA, 19 nt, Human
gugaucucagcucgcugca

SEQ ID NO: 552625 - RNA, 21 nt, Human
guggaggcucugucuuuuccu

SEQ ID NO: 552626 - RNA, 19 nt, Human
guguugggauuacaggcau

SEQ ID NO: 552627 - RNA, 24 nt, Human
guuaaagaggugaaaagaagaggu

SEQ ID NO: 552628 - RNA, 18 nt, Human
uaaaaugaucaauaugcc

SEQ ID NO: 552629 - RNA, 22 nt, Human
uaaagccuauuugguuuccaga

SEQ ID NO: 552630 - RNA, 18 nt, Human
uaagauaccuagcuacag

SEQ ID NO: 552631 - RNA, 22 nt, Human
uaagauaccuagcuacagcaau

SEQ ID NO: 552632 - RNA, 24 nt, Human
uacaggcaugagccacugcaucca

SEQ ID NO: 552633 - RNA, 23 nt, Human
uacaggcgcgugccaccacgccc

SEQ ID NO: 552634 - RNA, 19 nt, Human
uaccugcaugugccaaacu

SEQ ID NO: 552635 - RNA, 20 nt, Human
uagaagauaaaagggaggag

SEQ ID NO: 552636 - RNA, 23 nt, Human
uagaagauaaaagggaggaguuu

SEQ ID NO: 552637 - RNA, 19 nt, Human
uagaugcugcugaagaggc

SEQ ID NO: 552638 - RNA, 19 nt, Human
uagcaccucuuguucucuu

SEQ ID NO: 552639 - RNA, 23 nt, Human
uaguuugagguucucuucuccca

SEQ ID NO: 552640 - RNA, 27 nt, Human
uaucccaacaugccuuaggacgcucau

SEQ ID NO: 552641 - RNA, 19 nt, Human
uauguccccaaacccaacc

SEQ ID NO: 552642 - RNA, 18 nt, Human
ucacaaacuguucugugg

SEQ ID NO: 552643 - RNA, 19 nt, Human
ucacugcaaccuccaccuc

SEQ ID NO: 552644 - RNA, 24 nt, Human
ucacugcaaccuccaccuccccgg

SEQ ID NO: 552645 - RNA, 25 nt, Human
ucacugcaaccuccaccuccccggu

SEQ ID NO: 552646 - RNA, 27 nt, Human
ucacugcaaccuccaccuccccgguuc

SEQ ID NO: 552647 - RNA, 20 nt, Human
ucagccuccuggguagcugg

SEQ ID NO: 552648 - RNA, 25 nt, Human
ucccaaaaguguugggauuacaggc

SEQ ID NO: 552649 - RNA, 18 nt, Human
uccccaaacccaaccccc

SEQ ID NO: 552650 - RNA, 21 nt, Human
uccccgguucaagcgauucuc

SEQ ID NO: 552651 - RNA, 24 nt, Human
uccccgguucaagcgauucuccug

SEQ ID NO: 552652 - RNA, 24 nt, Human
ucccucaagcuccccucugccuug

SEQ ID NO: 552653 - RNA, 18 nt, Human
ucccugggcagcgagcug

SEQ ID NO: 552654 - RNA, 23 nt, Human
ucccugggcagcgagcugagcuc

SEQ ID NO: 552655 - RNA, 26 nt, Human
ucccugggcagcgagcugagcuccca

SEQ ID NO: 552656 - RNA, 23 nt, Human
uccucaugacugauaauuaucuc

SEQ ID NO: 552657 - RNA, 20 nt, Human
uccugccuggaccucccaaa

SEQ ID NO: 552658 - RNA, 21 nt, Human
uccugggcccaagugauccuc

SEQ ID NO: 552659 - RNA, 24 nt, Human
uccuggguagcugggauuacaggc

SEQ ID NO: 552660 - RNA, 22 nt, Human
uccuugacugucugccaucccc

SEQ ID NO: 552661 - RNA, 24 nt, Human
ucgcugcaggcuugaccuccuggg

SEQ ID NO: 552662 - RNA, 20 nt, Human
ucuaucaccccaggcuggag

SEQ ID NO: 552663 - RNA, 24 nt, Human
ucuccugccucagccuccugggua

SEQ ID NO: 552664 - RNA, 18 nt, Human
ucugucgcccaggcugga

SEQ ID NO: 552665 - RNA, 23 nt, Human
ucuugcucugucgcccaggcugg

SEQ ID NO: 552666 - RNA, 24 nt, Human
ucuugcucugucgcccaggcugga

SEQ ID NO: 552667 - RNA, 20 nt, Human
ucuuguucuaucaccccagg

SEQ ID NO: 552668 - RNA, 24 nt, Human
ucuuguucuaucaccccaggcugg

SEQ ID NO: 552669 - RNA, 25 nt, Human
ucuuguucuaucaccccaggcugga

SEQ ID NO: 552670 - RNA, 23 nt, Human
ugaaaguaacaaagauaaacaua

SEQ ID NO: 552671 - RNA, 22 nt, Human
ugaaauggagucuugcucuguc

SEQ ID NO: 552672 - RNA, 25 nt, Human
ugaccuccugggcccaagugauccu

SEQ ID NO: 552673 - RNA, 23 nt, Human
ugacucuggguucaguagguccc

SEQ ID NO: 552674 - RNA, 24 nt, Human
ugacugucugccauccccucccaa

SEQ ID NO: 552675 - RNA, 22 nt, Human
ugagacagggucuuguucuauc

SEQ ID NO: 552676 - RNA, 20 nt, Human
ugagaucacucauuuuacca

SEQ ID NO: 552677 - RNA, 21 nt, Human
ugaggacuuggucuuggcuca

SEQ ID NO: 552678 - RNA, 23 nt, Human
ugccucagccuccuggguagcug

SEQ ID NO: 552679 - RNA, 24 nt, Human
ugccucagccuccuggguagcugg

SEQ ID NO: 552680 - RNA, 20 nt, Human
ugccuggaccucccaaaagu

SEQ ID NO: 552681 - RNA, 21 nt, Human
ugcucacuugcuuauggagcc

SEQ ID NO: 552682 - RNA, 22 nt, Human
ugcucugucgcccaggcuggag

SEQ ID NO: 552683 - RNA, 23 nt, Human
ugcuuugaggacuuggucuuggc

SEQ ID NO: 552684 - RNA, 18 nt, Human
uggaagcaaaggcugugg

SEQ ID NO: 552685 - RNA, 24 nt, Human
uggaagcaaaggcuguggguugga

SEQ ID NO: 552686 - RNA, 19 nt, Human
uggaguacaauggcgugau

SEQ ID NO: 552687 - RNA, 23 nt, Human
uggagucuugcucugucgcccag

SEQ ID NO: 552688 - RNA, 24 nt, Human
uggagucuugcucugucgcccagg

SEQ ID NO: 552689 - RNA, 23 nt, Human
uggagugaggaagccaauggagg

SEQ ID NO: 552690 - RNA, 19 nt, Human
uggagugcaguggugugau

SEQ ID NO: 552691 - RNA, 24 nt, Human
uggagugcaguggugugaucucag

SEQ ID NO: 552692 - RNA, 19 nt, Human
uggccauguaagagaccac

SEQ ID NO: 552693 - RNA, 24 nt, Human
uggcgugaucucagcucacugcaa

SEQ ID NO: 552694 - RNA, 22 nt, Human
uggcuaaacaggcuggugacac

SEQ ID NO: 552695 - RNA, 19 nt, Human
ugggaagcaaagggaaacc

SEQ ID NO: 552696 - RNA, 24 nt, Human
ugggaagcaaagggaaaccacugg

SEQ ID NO: 552697 - RNA, 19 nt, Human
ugggauuacaggcaugagc

SEQ ID NO: 552698 - RNA, 21 nt, Human
ugggauuacaggcaugagcca

SEQ ID NO: 552699 - RNA, 22 nt, Human
ugggauuacaggcaugagccac

SEQ ID NO: 552700 - RNA, 22 nt, Human
ugggauuacaggcaugagccac

SEQ ID NO: 552701 - RNA, 24 nt, Human
ugggauuacaggcaugagccacug

SEQ ID NO: 552702 - RNA, 26 nt, Human
ugggauuacaggcaugagccacugca

SEQ ID NO: 552703 - RNA, 21 nt, Human
ugggauuacaggcgcgugcca

SEQ ID NO: 552704 - RNA, 22 nt, Human
ugggauuacaggcgcgugccac

SEQ ID NO: 552705 - RNA, 24 nt, Human
ugggauuacaggcgcgugccacca

SEQ ID NO: 552706 - RNA, 24 nt, Human
ugggcccaagugauccuccugccu

SEQ ID NO: 552707 - RNA, 21 nt, Human
uggugacaccacacccaaaag

SEQ ID NO: 552708 - RNA, 24 nt, Human
uggugugaucucagcucgcugcag

SEQ ID NO: 552709 - RNA, 19 nt, Human
ugguuuuaaucuuccuauu

SEQ ID NO: 552710 - RNA, 21 nt, Human
ugugucuuuguguugacaaac

SEQ ID NO: 552711 - RNA, 18 nt, Human
uguguugacaaaccuaac

SEQ ID NO: 552712 - RNA, 23 nt, Human
uguucuaucaccccaggcuggag

SEQ ID NO: 552713 - RNA, 25 nt, Human
uguucuaucaccccaggcuggagug

SEQ ID NO: 552714 - RNA, 20 nt, Human
uguuugcucucuggagagau

SEQ ID NO: 552715 - RNA, 22 nt, Human
uuaacuuuauuuuucaacuuca

SEQ ID NO: 552716 - RNA, 21 nt, Human
uucaagcgauucuccugccuc

SEQ ID NO: 552717 - RNA, 23 nt, Human
uucaagcgauucuccugccucag

SEQ ID NO: 552718 - RNA, 24 nt, Human
uucaagcgauucuccugccucagc

SEQ ID NO: 552719 - RNA, 18 nt, Human
uuccagaagaguuagaua

SEQ ID NO: 552720 - RNA, 23 nt, Human
uuccugacucuggguucaguagg

SEQ ID NO: 552721 - RNA, 22 nt, Human
uugagaucacucauuuuaccau

SEQ ID NO: 552722 - RNA, 21 nt, Human
uugcaaaugaggauggagaag

SEQ ID NO: 552723 - RNA, 18 nt, Human
uugcccugccugcuucug

SEQ ID NO: 552724 - RNA, 24 nt, Human
uugcucugucgcccaggcuggagu

SEQ ID NO: 552725 - RNA, 28 nt, Human
uuugagaucacucauuuuaaccccuagg

SEQ ID NO: 552726 - RNA, 20 nt, Human
uuuuuuuugagacagggucu

SEQ ID NO: 552727 - RNA, 20 nt, Human
uuuuuuuuuuugagacaggg

SEQ ID NO: 552728 - RNA, 23 nt, Human
uuuuuuuuuuuugagacaggguc

SEQ ID NO: 552729 - RNA, 24 nt, Human
aaaagcuggagggugggcugagcc

SEQ ID NO: 552730 - RNA, 19 nt, Human
aagaaggggcuaggaggca

SEQ ID NO: 552731 - RNA, 22 nt, Human
aagagcaucugaagaaccaaag

SEQ ID NO: 552732 - RNA, 21 nt, Human
aaggcccagcccugccgcccc

SEQ ID NO: 552733 - RNA, 21 nt, Human
accccaagagcaucugaagaa

SEQ ID NO: 552734 - RNA, 24 nt, Human
accccaccugcaccccuuccccac

SEQ ID NO: 552735 - RNA, 18 nt, Human
acccccuccccagccccu

SEQ ID NO: 552736 - RNA, 18 nt, Human
acuugcccguccccucag

SEQ ID NO: 552737 - RNA, 23 nt, Human
agaaagauccaacaugggguccg

SEQ ID NO: 552738 - RNA, 21 nt, Human
agacucccucccgcucugccu

SEQ ID NO: 552739 - RNA, 23 nt, Human
agccuccaggccagccggccccu

SEQ ID NO: 552740 - RNA, 25 nt, Human
agccuccuccugagacucccucccg

SEQ ID NO: 552741 - RNA, 18 nt, Human
agccuuuggagaaggguc

SEQ ID NO: 552742 - RNA, 22 nt, Human
agcgccguccacacagcagccc

SEQ ID NO: 552743 - RNA, 23 nt, Human
aggagaaagggagaaagauccaa

SEQ ID NO: 552744 - RNA, 23 nt, Human
aggaggcacugggagggccaugg

SEQ ID NO: 552745 - RNA, 18 nt, Human
aggcagauugucacaagg

SEQ ID NO: 552746 - RNA, 21 nt, Human
aggccgggagggucaggggcc

SEQ ID NO: 552747 - RNA, 23 nt, Human
agggagggcaggucccaugaggg

SEQ ID NO: 552748 - RNA, 21 nt, Human
agggccaccgaggcaaggcca

SEQ ID NO: 552749 - RNA, 20 nt, Human
auugccauggcaacccagau

SEQ ID NO: 552750 - RNA, 20 nt, Human
auugucacaaggcccagccc

SEQ ID NO: 552751 - RNA, 21 nt, Human
caagagcaucugaagaaccaa

SEQ ID NO: 552752 - RNA, 21 nt, Human
caagagcaucugaagaaccag

SEQ ID NO: 552753 - RNA, 24 nt, Human
caaggccauguggugaaaggcaga

SEQ ID NO: 552754 - RNA, 21 nt, Human
caaggcccagcccugccgccc

SEQ ID NO: 552755 - RNA, 19 nt, Human
caaguuggggaggcggugg

SEQ ID NO: 552756 - RNA, 19 nt, Human
cacagacggcugccuccca

SEQ ID NO: 552757 - RNA, 19 nt, Human
cacagcagccccgagaugg

SEQ ID NO: 552758 - RNA, 18 nt, Human
cacaggcucaaguugggg

SEQ ID NO: 552759 - RNA, 22 nt, Human
caccccuuccccacgguguccc

SEQ ID NO: 552760 - RNA, 22 nt, Human
caccccuuccccacgguguccc

SEQ ID NO: 552761 - RNA, 19 nt, Human
cacugcggccuccccgcgc

SEQ ID NO: 552762 - RNA, 19 nt, Human
cagaaucuuggaccucagg

SEQ ID NO: 552763 - RNA, 20 nt, Human
cagacaggagagugccugag

SEQ ID NO: 552764 - RNA, 23 nt, Human
cagauugucacaaggcccagccc

SEQ ID NO: 552765 - RNA, 22 nt, Human
cagccccucagggcagccuccu

SEQ ID NO: 552766 - RNA, 19 nt, Human
cagccucucggacaccccu

SEQ ID NO: 552767 - RNA, 22 nt, Human
cagccucucggacaccccucag

SEQ ID NO: 552768 - RNA, 19 nt, Human
cagcgccguccacacagca

SEQ ID NO: 552769 - RNA, 18 nt, Human
caguagcuggggggcaug

SEQ ID NO: 552770 - RNA, 20 nt, Human
caucaccccaccugcacccc

SEQ ID NO: 552771 - RNA, 19 nt, Human
cauggaccgcuggucuccu

SEQ ID NO: 552772 - RNA, 21 nt, Human
caugggguccgugagcagugc

SEQ ID NO: 552773 - RNA, 18 nt, Human
cauucugccucugcgggg

SEQ ID NO: 552774 - RNA, 19 nt, Human
ccagacccauggaccgcug

SEQ ID NO: 552775 - RNA, 23 nt, Human
ccagccucucggacaccccucag

SEQ ID NO: 552776 - RNA, 19 nt, Human
ccagggcccaagguuuggg

SEQ ID NO: 552777 - RNA, 20 nt, Human
cccacggugucccgggggcu

SEQ ID NO: 552778 - RNA, 19 nt, Human
cccagcuccagugcccucc

SEQ ID NO: 552779 - RNA, 23 nt, Human
ccccaagagcaucugaagaaccc

SEQ ID NO: 552780 - RNA, 21 nt, Human
ccccaccuccuccucuucuca

SEQ ID NO: 552781 - RNA, 19 nt, Human
ccccaccugcaccccuucc

SEQ ID NO: 552782 - RNA, 22 nt, Human
ccccaccugcaccccuucccca

SEQ ID NO: 552783 - RNA, 26 nt, Human
cccccaccuccuccucuucucagcuc

SEQ ID NO: 552784 - RNA, 22 nt, Human
cccccgguggccaccucucugc

SEQ ID NO: 552785 - RNA, 23 nt, Human
cccccuccccagccccucagggc

SEQ ID NO: 552786 - RNA, 21 nt, Human
ccccucagaacaaaagcccau

SEQ ID NO: 552787 - RNA, 20 nt, Human
ccccuuccccacgguguccc

SEQ ID NO: 552788 - RNA, 22 nt, Human
cccgcgggccuggggcccugga

SEQ ID NO: 552789 - RNA, 19 nt, Human
cccucagaacaaaagccca

SEQ ID NO: 552790 - RNA, 23 nt, Human
cccucagaacaaaagcccaucau

SEQ ID NO: 552791 - RNA, 19 nt, Human
cccucagcuaccagcaccu

SEQ ID NO: 552792 - RNA, 22 nt, Human
cccucccugacagucagggcca

SEQ ID NO: 552793 - RNA, 20 nt, Human
cccugaggaaaagcuggagg

SEQ ID NO: 552794 - RNA, 24 nt, Human
cccuuccccacggugucccggggg

SEQ ID NO: 552795 - RNA, 20 nt, Human
ccgcgccggcugcucgcugc

SEQ ID NO: 552796 - RNA, 21 nt, Human
ccgcgccggcugcucgcugca

SEQ ID NO: 552797 - RNA, 19 nt, Human
ccgggcccucuucgcuuuc

SEQ ID NO: 552798 - RNA, 21 nt, Human
ccggugugugcagcccgggcc

SEQ ID NO: 552799 - RNA, 20 nt, Human
ccgugcacugcggccucccc

SEQ ID NO: 552800 - RNA, 25 nt, Human
ccuaugaaccccaagagcaucugaa

SEQ ID NO: 552801 - RNA, 18 nt, Human
ccucagcuaccagcaccu

SEQ ID NO: 552802 - RNA, 19 nt, Human
ccuccaggccagccggccc

SEQ ID NO: 552803 - RNA, 22 nt, Human
ccucccagcuccagugcccucc

SEQ ID NO: 552804 - RNA, 19 nt, Human
ccucugcgggggucggggg

SEQ ID NO: 552805 - RNA, 19 nt, Human
ccucugcugagucacaaga

SEQ ID NO: 552806 - RNA, 18 nt, Human
ccugcagccugcagggcc

SEQ ID NO: 552807 - RNA, 25 nt, Human
ccugcccuuccccugaaucuaagaa

SEQ ID NO: 552808 - RNA, 19 nt, Human
ccuggcugcuuagagcugg

SEQ ID NO: 552809 - RNA, 18 nt, Human
cgccggcugcucgcugca

SEQ ID NO: 552810 - RNA, 25 nt, Human
cgcuuucggcuuuugucuucuccua

SEQ ID NO: 552811 - RNA, 18 nt, Human
cggcugagggagggcagg

SEQ ID NO: 552812 - RNA, 24 nt, Human
cuaggcgcccuccccgaaagcccc

SEQ ID NO: 552813 - RNA, 21 nt, Human
cucaggauccucccaggacuu

SEQ ID NO: 552814 - RNA, 22 nt, Human
cucaugagguacccccucccca

SEQ ID NO: 552815 - RNA, 21 nt, Human
cuccaggccagccggccccuc

SEQ ID NO: 552816 - RNA, 21 nt, Human
cuccagugcccuccugcagcc

SEQ ID NO: 552817 - RNA, 24 nt, Human
cuccccgaaagcccccauucugag

SEQ ID NO: 552818 - RNA, 20 nt, Human
cucugccucccuggcccucc

SEQ ID NO: 552819 - RNA, 19 nt, Human
cugcaccccuuccccacgg

SEQ ID NO: 552820 - RNA, 23 nt, Human
cugcccagcugauaacagagccu

SEQ ID NO: 552821 - RNA, 20 nt, Human
cuucccucccuccccucuca

SEQ ID NO: 552822 - RNA, 21 nt, Human
gaaggggcuaggaggcacugg

SEQ ID NO: 552823 - RNA, 24 nt, Human
gacccauggaccgcuggucuccuc

SEQ ID NO: 552824 - RNA, 19 nt, Human
gaggaaaagcuggagggug

SEQ ID NO: 552825 - RNA, 27 nt, Human
gagggcaggucccaugagggcagggug

SEQ ID NO: 552826 - RNA, 18 nt, Human
gagggucaggggcccugc

SEQ ID NO: 552827 - RNA, 21 nt, Human
gagggugggcugagccuccag

SEQ ID NO: 552828 - RNA, 23 nt, Human
gaugggguggaggacucuuccag

SEQ ID NO: 552829 - RNA, 20 nt, Human
gccucccagccggugugugc

SEQ ID NO: 552830 - RNA, 21 nt, Human
gcugggacgagaccucccagc

SEQ ID NO: 552831 - RNA, 22 nt, Human
gcuuucggcuuuugucuucucc

SEQ ID NO: 552832 - RNA, 24 nt, Human
ggacgagaccucccagcuccagug

SEQ ID NO: 552833 - RNA, 24 nt, Human
ggagagugaagccaggccgggagg

SEQ ID NO: 552834 - RNA, 23 nt, Human
ggaggacucuuccagggcccaag

SEQ ID NO: 552835 - RNA, 22 nt, Human
ggaggcacugggagggccaugg

SEQ ID NO: 552836 - RNA, 21 nt, Human
ggcacugggagggccauggcu

SEQ ID NO: 552837 - RNA, 18 nt, Human
ggccauggcugauggcug

SEQ ID NO: 552838 - RNA, 22 nt, Human
ggccgggagggucaggggcccu

SEQ ID NO: 552839 - RNA, 21 nt, Human
gggcagagaguggagguagga

SEQ ID NO: 552840 - RNA, 18 nt, Human
gggcagggugcuaugggg

SEQ ID NO: 552841 - RNA, 24 nt, Human
ggggugaugccuagugaccaggcu

SEQ ID NO: 552842 - RNA, 20 nt, Human
gugaaaggcagauugucaca

SEQ ID NO: 552843 - RNA, 25 nt, Human
gugaugggguggaggacucuuccag

SEQ ID NO: 552844 - RNA, 19 nt, Human
gugggcugagccuccaggc

SEQ ID NO: 552845 - RNA, 18 nt, Human
uaagagaggccucgggua

SEQ ID NO: 552846 - RNA, 22 nt, Human
uacaccagccucucggacaccc

SEQ ID NO: 552847 - RNA, 21 nt, Human
uagacugcaacagcagcucag

SEQ ID NO: 552848 - RNA, 23 nt, Human
uaggaccugccccuaugaacccc

SEQ ID NO: 552849 - RNA, 27 nt, Human
uaggaggcacugggagggccauggcug

SEQ ID NO: 552850 - RNA, 21 nt, Human
uaggggcagagaguggaggua

SEQ ID NO: 552851 - RNA, 21 nt, Human
uaggggcagagaguggaggua

SEQ ID NO: 552852 - RNA, 19 nt, Human
uagggguggggaaguaaca

SEQ ID NO: 552853 - RNA, 24 nt, Human
ucaggacacccugaggaaaagcug

SEQ ID NO: 552854 - RNA, 25 nt, Human
ucaggacacccugaggaaaagcugg

SEQ ID NO: 552855 - RNA, 23 nt, Human
ucaggauccucccaggacuuccc

SEQ ID NO: 552856 - RNA, 21 nt, Human
uccacacagcagccccgagau

SEQ ID NO: 552857 - RNA, 20 nt, Human
uccagcccccaccuccuccu

SEQ ID NO: 552858 - RNA, 20 nt, Human
ucccaggacuucccucccuc

SEQ ID NO: 552859 - RNA, 18 nt, Human
uccccagccccucagggc

SEQ ID NO: 552860 - RNA, 19 nt, Human
uccccgaaagcccccauuc

SEQ ID NO: 552861 - RNA, 18 nt, Human
uccccgcgccggcugcuc

SEQ ID NO: 552862 - RNA, 21 nt, Human
uccccucagcuaccagcaccu

SEQ ID NO: 552863 - RNA, 23 nt, Human
ucccgcucugccucccuggcccu

SEQ ID NO: 552864 - RNA, 18 nt, Human
ucccuccccucucacuug

SEQ ID NO: 552865 - RNA, 22 nt, Human
ucccugaacguggccacugccu

SEQ ID NO: 552866 - RNA, 25 nt, Human
uccucaugagguacccccuccccag

SEQ ID NO: 552867 - RNA, 22 nt, Human
ucuucuccuacuccucccaccg

SEQ ID NO: 552868 - RNA, 21 nt, Human
ugaaaggguggaccaauggca

SEQ ID NO: 552869 - RNA, 20 nt, Human
ugaagagaaaaaggagagga

SEQ ID NO: 552870 - RNA, 22 nt, Human
ugaagagaaaaaggagaggaga

SEQ ID NO: 552871 - RNA, 20 nt, Human
ugaggaaaagcuggagggug

SEQ ID NO: 552872 - RNA, 20 nt, Human
ugaggaaaagcuggagggug

SEQ ID NO: 552873 - RNA, 19 nt, Human
ugagggagggcagguccca

SEQ ID NO: 552874 - RNA, 24 nt, Human
ugaguuguuggugccugcccuucc

SEQ ID NO: 552875 - RNA, 26 nt, Human
ugaugggguggaggacucuuccaggg

SEQ ID NO: 552876 - RNA, 21 nt, Human
ugcagccugcagggcccacgu

SEQ ID NO: 552877 - RNA, 19 nt, Human
uggaauggggcccgugaaa

SEQ ID NO: 552878 - RNA, 22 nt, Human
uggaauggggcccgugaaagcc

SEQ ID NO: 552879 - RNA, 19 nt, Human
uggccagggauuggcuggc

SEQ ID NO: 552880 - RNA, 21 nt, Human
uggcugacggcugagggaggg

SEQ ID NO: 552881 - RNA, 18 nt, Human
uggcugcuuagagcuggg

SEQ ID NO: 552882 - RNA, 22 nt, Human
ugggagggccauggcugauggc

SEQ ID NO: 552883 - RNA, 18 nt, Human
ugggcugagccuccaggc

SEQ ID NO: 552884 - RNA, 24 nt, Human
uggggaggcgguggaauggggccc

SEQ ID NO: 552885 - RNA, 18 nt, Human
ugggguggaggacucuuc

SEQ ID NO: 552886 - RNA, 23 nt, Human
ugggguggaggacucuuccaggg

SEQ ID NO: 552887 - RNA, 23 nt, Human
uucucagcuccacccugguccuc

SEQ ID NO: 552888 - RNA, 20 nt, Human
uuugucuucuccuacuccuc

SEQ ID NO: 552889 - RNA, 19 nt, Human
acaguaccaggagggcagg

SEQ ID NO: 552890 - RNA, 20 nt, Human
accccgagggaagcgaagag

SEQ ID NO: 552891 - RNA, 21 nt, Human
accccgagggaagcgaagagc

SEQ ID NO: 552892 - RNA, 18 nt, Human
aggcccagagccaaggcc

SEQ ID NO: 552893 - RNA, 18 nt, Human
aguaccaggagggcaggc

SEQ ID NO: 552894 - RNA, 23 nt, Human
cagagccaaggccauagggcugc

SEQ ID NO: 552895 - RNA, 20 nt, Human
caggcagggcacccccaggc

SEQ ID NO: 552896 - RNA, 18 nt, Human
ccaggcgguggccgaggu

SEQ ID NO: 552897 - RNA, 18 nt, Human
ccaggcuggccaguggag

SEQ ID NO: 552898 - RNA, 22 nt, Human
cccagagccaaggccauagggc

SEQ ID NO: 552899 - RNA, 23 nt, Human
cccccaggcuggccaguggagga

SEQ ID NO: 552900 - RNA, 22 nt, Human
ccccgcccugccgccgcggccg

SEQ ID NO: 552901 - RNA, 19 nt, Human
ccgccgcccgcugcuccgg

SEQ ID NO: 552902 - RNA, 19 nt, Human
ccgccgccgcccgcugcuc

SEQ ID NO: 552903 - RNA, 22 nt, Human
ccgccgccgcccgcugcuccgg

SEQ ID NO: 552904 - RNA, 21 nt, Human
ccgccgggggcuggcuugguu

SEQ ID NO: 552905 - RNA, 20 nt, Human
ccgcugcuccggccccgccc

SEQ ID NO: 552906 - RNA, 21 nt, Human
ccgcugcuccggccccgcccu

SEQ ID NO: 552907 - RNA, 25 nt, Human
ccgggcgccgccuccgccgccgccc

SEQ ID NO: 552908 - RNA, 20 nt, Human
ccguacgagcgagcgugcgc

SEQ ID NO: 552909 - RNA, 22 nt, Human
ccuccgccgccgcccgcugcuc

SEQ ID NO: 552910 - RNA, 18 nt, Human
ccuggggaucccaggcgg

SEQ ID NO: 552911 - RNA, 22 nt, Human
ccugucccaucaggcccagagc

SEQ ID NO: 552912 - RNA, 21 nt, Human
ccuucccucuaccccuguccc

SEQ ID NO: 552913 - RNA, 22 nt, Human
cgagcaagaccccgagggaagc

SEQ ID NO: 552914 - RNA, 18 nt, Human
cgaucccgccgggggcug

SEQ ID NO: 552915 - RNA, 25 nt, Human
cucaccuucccucuaccccuguccc

SEQ ID NO: 552916 - RNA, 18 nt, Human
cucccgggcgccgccucc

SEQ ID NO: 552917 - RNA, 19 nt, Human
cuccgccgccgcccgcugc

SEQ ID NO: 552918 - RNA, 19 nt, Human
gggaagcgaagagcgcucc

SEQ ID NO: 552919 - RNA, 23 nt, Human
gggcaggcagggcacccccaggc

SEQ ID NO: 552920 - RNA, 20 nt, Human
gggcgccgccuccgccgccg

SEQ ID NO: 552921 - RNA, 21 nt, Human
uaaaaauaacagcuuuccccc

SEQ ID NO: 552922 - RNA, 20 nt, Human
ugcccugagcccuucucugc

SEQ ID NO: 552923 - RNA, 22 nt, Human
ugcuaugcucaccuucccucua

SEQ ID NO: 552924 - RNA, 18 nt, Human
uggcuugguugcuggugc

SEQ ID NO: 552925 - RNA, 21 nt, Human
ugugagggggccgaggggaag

SEQ ID NO: 552926 - RNA, 21 nt, Human
uucccccaauucucgcucuag

SEQ ID NO: 552927 - RNA, 24 nt, Human
uugcuggugcccugagcccuucuc

SEQ ID NO: 552928 - RNA, 25 nt, Human
uuuuuuuuuuuuuuuuuacaucuga

SEQ ID NO: 552929 - RNA, 21 nt, Human
uuuuuuuuuuuuuuuuuuaca

SEQ ID NO: 552930 - RNA, 23 nt, Human
aagcgcgcaccugggaggcagac

SEQ ID NO: 552931 - RNA, 18 nt, Human
aggaagauuggucuggau

SEQ ID NO: 552932 - RNA, 19 nt, Human
agugugacauugaauugag

SEQ ID NO: 552933 - RNA, 20 nt, Human
caccgccgccgccgccgccg

SEQ ID NO: 552934 - RNA, 20 nt, Human
cagcgggcggggcagcgcgg

SEQ ID NO: 552935 - RNA, 21 nt, Human
ccaccgccgccgccgccgccg

SEQ ID NO: 552936 - RNA, 23 nt, Human
ccgccgccgccgccgggcgccga

SEQ ID NO: 552937 - RNA, 18 nt, Human
ccgccgccuccgccccug

SEQ ID NO: 552938 - RNA, 23 nt, Human
ccgccuccgccuccuccgcuucc

SEQ ID NO: 552939 - RNA, 20 nt, Human
ccgcggccgccuccgccucc

SEQ ID NO: 552940 - RNA, 24 nt, Human
ccuccugcgaccgucgccgccacu

SEQ ID NO: 552941 - RNA, 19 nt, Human
cgagcgagcgagcgggcgg

SEQ ID NO: 552942 - RNA, 24 nt, Human
cgccgccgccgccgccgggcgccg

SEQ ID NO: 552943 - RNA, 19 nt, Human
cgcggccgccuccgccucc

SEQ ID NO: 552944 - RNA, 19 nt, Human
cggggaaaccgagcgagcg

SEQ ID NO: 552945 - RNA, 19 nt, Human
cucccuggccgccgccucc

SEQ ID NO: 552946 - RNA, 20 nt, Human
cugcaaccugcggagcccgc

SEQ ID NO: 552947 - RNA, 24 nt, Human
cuuacagucgcgggccaggaugag

SEQ ID NO: 552948 - RNA, 19 nt, Human
gagccggcgggcgggucgg

SEQ ID NO: 552949 - RNA, 23 nt, Human
gccgccgaguuccgcggcuccgg

SEQ ID NO: 552950 - RNA, 18 nt, Human
gcgggcgagccggcgggc

SEQ ID NO: 552951 - RNA, 22 nt, Human
ggagcccgcgucgcagcagccc

SEQ ID NO: 552952 - RNA, 18 nt, Human
ggccgccgccuccgcccc

SEQ ID NO: 552953 - RNA, 19 nt, Human
gggcagcgcgggaagcgcu

SEQ ID NO: 552954 - RNA, 19 nt, Human
ggguggguuggcgaggagc

SEQ ID NO: 552955 - RNA, 23 nt, Human
gucaaggaauggcugguuccacc

SEQ ID NO: 552956 - RNA, 27 nt, Human
uaagcccggcgggggcggggaaaccga

SEQ ID NO: 552957 - RNA, 22 nt, Human
ucaaggaauggcugguuccacc

SEQ ID NO: 552958 - RNA, 19 nt, Human
uccagcaauuuugcaagag

SEQ ID NO: 552959 - RNA, 18 nt, Human
ucccuggccgccgccucc

SEQ ID NO: 552960 - RNA, 20 nt, Human
uccgcggcuccgggagcgaa

SEQ ID NO: 552961 - RNA, 23 nt, Human
uccuccgcuuccucccuggccgc

SEQ ID NO: 552962 - RNA, 28 nt, Human
ucgccgccaccgccgccgccgccgccgg

SEQ ID NO: 552963 - RNA, 25 nt, Human
ucgccgccaccgccgccgccgccgg

SEQ ID NO: 552964 - RNA, 20 nt, Human
ucggcgggccagcgggcggg

SEQ ID NO: 552965 - RNA, 22 nt, Human
ugagacgagcgugugggugggu

SEQ ID NO: 552966 - RNA, 23 nt, Human
ugcgacagcgcgcacccggauac

SEQ ID NO: 552967 - RNA, 21 nt, Human
uggcgggcgagccggcgggcg

SEQ ID NO: 552968 - RNA, 22 nt, Human
ugggaggcagacggcaccuccu

SEQ ID NO: 552969 - RNA, 24 nt, Human
uuccagcaauuuugcaagaggcag

SEQ ID NO: 552970 - RNA, 21 nt, Human
uuugaugggaaaucuuaagua

SEQ ID NO: 552971 - RNA, 23 nt, Human
uuuuuuuuuuuugaugggaaauc

SEQ ID NO: 552972 - RNA, 19 nt, Human
uuuuuuuuuuuuuugaugg

SEQ ID NO: 552973 - RNA, 18 nt, Human
uuuuuuuuuuuuuuuuug

SEQ ID NO: 552974 - RNA, 23 nt, Human
uuuuuuuuuuuuuuuuugauggg

SEQ ID NO: 552975 - RNA, 21 nt, Human
aacacauuuaauuaccacagu

SEQ ID NO: 552976 - RNA, 20 nt, Human
accgcccgccgccgccgccc

SEQ ID NO: 552977 - RNA, 19 nt, Human
agugacuuugguccauauc

SEQ ID NO: 552978 - RNA, 21 nt, Human
cccgccgccgccgcccagaga

SEQ ID NO: 552979 - RNA, 22 nt, Human
cccgcgcgggucucaccgaccg

SEQ ID NO: 552980 - RNA, 24 nt, Human
cccgcgcgggucucaccgaccgcg

SEQ ID NO: 552981 - RNA, 26 nt, Human
ccgaccgcgcagacaccgguuaaaga

SEQ ID NO: 552982 - RNA, 25 nt, Human
ccgcccgccgccgccgcccagagau

SEQ ID NO: 552983 - RNA, 21 nt, Human
cgcgggucucaccgaccgcgc

SEQ ID NO: 552984 - RNA, 23 nt, Human
gauaaguacauacugaacacauu

SEQ ID NO: 552985 - RNA, 18 nt, Human
gguuuuuuuccugacccu

SEQ ID NO: 552986 - RNA, 21 nt, Human
uaaaacauuagugacuuuggu

SEQ ID NO: 552987 - RNA, 23 nt, Human
uaauugguuuuuuuccugacccu

SEQ ID NO: 552988 - RNA, 24 nt, Human
ugacccuuggaauguuaguuucau

SEQ ID NO: 552989 - RNA, 26 nt, Human
ugauaaguacauacugaaaggguuuc

SEQ ID NO: 552990 - RNA, 26 nt, Human
aaaaaauccaaaaugauuaguaaaga

SEQ ID NO: 552991 - RNA, 25 nt, Human
agaaaaaaaauccaaaaugauuagu

SEQ ID NO: 552992 - RNA, 22 nt, Human
caaauuagagcaguaaucuucc

SEQ ID NO: 552993 - RNA, 18 nt, Human
cccaggugcuggcuuggc

SEQ ID NO: 552994 - RNA, 21 nt, Human
cccgguuccaggcccaggugc

SEQ ID NO: 552995 - RNA, 22 nt, Human
cggugggcgaagcuggggggcu

SEQ ID NO: 552996 - RNA, 21 nt, Human
gauuaguaaagaaaaauauaa

SEQ ID NO: 552997 - RNA, 23 nt, Human
ggggggcugcggcccgguuccag

SEQ ID NO: 552998 - RNA, 24 nt, Human
ggggggcugcggcccgguuccagg

SEQ ID NO: 552999 - RNA, 19 nt, Human
guaaagaaaaauauaagaa

SEQ ID NO: 553000 - RNA, 21 nt, Human
guuccaggcccaggugcuggc

SEQ ID NO: 553001 - RNA, 19 nt, Human
guuccaggcccaggugcuu

SEQ ID NO: 553002 - RNA, 18 nt, Human
uaaagcaccccagcucuc

SEQ ID NO: 553003 - RNA, 21 nt, Human
uaagaauuaacagacccuuua

SEQ ID NO: 553004 - RNA, 22 nt, Human
ucaaaugaguuauguuugccuc

SEQ ID NO: 553005 - RNA, 19 nt, Human
ucacucaaauuagagcagu

SEQ ID NO: 553006 - RNA, 25 nt, Human
ugaaugaauacccuaauggcaaacc

SEQ ID NO: 553007 - RNA, 21 nt, Human
ugaucuagguugcuuuuccuu

SEQ ID NO: 553008 - RNA, 21 nt, Human
ugaugagaagguacauugguu

SEQ ID NO: 553009 - RNA, 18 nt, Human
uucaaagaaaaaaaaucc

SEQ ID NO: 553010 - RNA, 20 nt, Human
uugcuuuuccuucagcaagg

SEQ ID NO: 553011 - RNA, 23 nt, Human
aaggaaaaauccacaaugauuag

SEQ ID NO: 553012 - RNA, 20 nt, Human
aauaauuuaaggaaaaaucc

SEQ ID NO: 553013 - RNA, 18 nt, Human
caaagcaccccagcucuc

SEQ ID NO: 553014 - RNA, 22 nt, Human
caaauuagagcaguaaucuucc

SEQ ID NO: 553015 - RNA, 21 nt, Human
cccaguuccaggcccaggugc

SEQ ID NO: 553016 - RNA, 21 nt, Human
gaagcugggggcugcggccca

SEQ ID NO: 553017 - RNA, 23 nt, Human
gagguggugggugaagcuggggg

SEQ ID NO: 553018 - RNA, 21 nt, Human
gauuaguaaagaaaaauauaa

SEQ ID NO: 553019 - RNA, 18 nt, Human
gcggcccaguuccaggcc

SEQ ID NO: 553020 - RNA, 19 nt, Human
gcuggcucggcaugaccgc

SEQ ID NO: 553021 - RNA, 30 nt, Human
ggggagagggguagggauuaucuucaaagg

SEQ ID NO: 553022 - RNA, 22 nt, Human
gggggcugcggcccaguuccag

SEQ ID NO: 553023 - RNA, 24 nt, Human
gguggugggugaagcugggggcug

SEQ ID NO: 553024 - RNA, 19 nt, Human
guaaagaaaaauauaagaa

SEQ ID NO: 553025 - RNA, 23 nt, Human
guuccaggcccaggugcuggcuc

SEQ ID NO: 553026 - RNA, 19 nt, Human
guuccaggcccaggugcuu

SEQ ID NO: 553027 - RNA, 25 nt, Human
uaacagacccuuuaaauuuguuuua

SEQ ID NO: 553028 - RNA, 24 nt, Human
uaacuuuuauuucacucaaauuag

SEQ ID NO: 553029 - RNA, 22 nt, Human
uaagaauuaacagacccuuuaa

SEQ ID NO: 553030 - RNA, 24 nt, Human
uaauaacuuuuauuucacucaaau

SEQ ID NO: 553031 - RNA, 19 nt, Human
ucacucaaauuagagcagu

SEQ ID NO: 553032 - RNA, 19 nt, Human
uccacaaugauuaguaaag

SEQ ID NO: 553033 - RNA, 22 nt, Human
uccacaaugauuaguaaagaaa

SEQ ID NO: 553034 - RNA, 25 nt, Human
ugaaugaauacccuaauggcaaacc

SEQ ID NO: 553035 - RNA, 21 nt, Human
ugaucuagguugcuuuuccuu

SEQ ID NO: 553036 - RNA, 18 nt, Human
ugccucgcacuaauaacu

SEQ ID NO: 553037 - RNA, 22 nt, Human
ugcuggcucggcaugaccgcgc

SEQ ID NO: 553038 - RNA, 21 nt, Human
uggugggugaagcugggggcu

SEQ ID NO: 553039 - RNA, 19 nt, Human
uuguuuuaaauauuugaag

SEQ ID NO: 553040 - RNA, 18 nt, Human
uuuaaaaaguguuuaaag

SEQ ID NO: 553041 - RNA, 23 nt, Human
acaaagugcggcagggcuacccc

SEQ ID NO: 553042 - RNA, 18 nt, Human
accccgggccagccugcu

SEQ ID NO: 553043 - RNA, 21 nt, Human
agagaugcacagugaggggca

SEQ ID NO: 553044 - RNA, 20 nt, Human
agcccccaccaccuugagac

SEQ ID NO: 553045 - RNA, 24 nt, Human
aggcagggcuccucggaaacgcgg

SEQ ID NO: 553046 - RNA, 21 nt, Human
aggcagucaggcucaugaagc

SEQ ID NO: 553047 - RNA, 19 nt, Human
aggggcaggcacccagggc

SEQ ID NO: 553048 - RNA, 22 nt, Human
agugcagaguggcuccagaagg

SEQ ID NO: 553049 - RNA, 24 nt, Human
agugcagaguggcuccagaaggga

SEQ ID NO: 553050 - RNA, 24 nt, Human
augaagcagccaccggguuuggcu

SEQ ID NO: 553051 - RNA, 19 nt, Human
cacuguuugggggcaaagc

SEQ ID NO: 553052 - RNA, 24 nt, Human
cagcccccauagcccccaccaccu

SEQ ID NO: 553053 - RNA, 18 nt, Human
cagcgcgcgugccucccu

SEQ ID NO: 553054 - RNA, 18 nt, Human
caggacucaagaugggga

SEQ ID NO: 553055 - RNA, 24 nt, Human
caggaggggccucaggaacccguu

SEQ ID NO: 553056 - RNA, 18 nt, Human
caggcucaugaagcagcc

SEQ ID NO: 553057 - RNA, 19 nt, Human
ccaggggucccuuccugcu

SEQ ID NO: 553058 - RNA, 23 nt, Human
cccacaggagccuccggggcugg

SEQ ID NO: 553059 - RNA, 21 nt, Human
cccccauagcccccaccaccu

SEQ ID NO: 553060 - RNA, 19 nt, Human
cccccugcagcccccauag

SEQ ID NO: 553061 - RNA, 26 nt, Human
cccgcagugcagaguggcuccagaag

SEQ ID NO: 553062 - RNA, 21 nt, Human
cccgggccagccugcuccagg

SEQ ID NO: 553063 - RNA, 23 nt, Human
cccgugacaaagugcggcagggc

SEQ ID NO: 553064 - RNA, 20 nt, Human
ccucccucggcccgguccug

SEQ ID NO: 553065 - RNA, 23 nt, Human
ccucggagccccgauguguuggg

SEQ ID NO: 553066 - RNA, 19 nt, Human
ccugcugagagcaggcgag

SEQ ID NO: 553067 - RNA, 22 nt, Human
ccugcuggguugggaccgccgg

SEQ ID NO: 553068 - RNA, 22 nt, Human
cgaaaaggaggcggguacccug

SEQ ID NO: 553069 - RNA, 21 nt, Human
cgccccaaccugccgggcugc

SEQ ID NO: 553070 - RNA, 19 nt, Human
cucaagauggggauggaga

SEQ ID NO: 553071 - RNA, 18 nt, Human
cucggcccgguccuggca

SEQ ID NO: 553072 - RNA, 21 nt, Human
cugcagcccccauagccccca

SEQ ID NO: 553073 - RNA, 25 nt, Human
cugccgggcugcucccagagaugca

SEQ ID NO: 553074 - RNA, 20 nt, Human
cugcucccagagaugcacag

SEQ ID NO: 553075 - RNA, 24 nt, Human
cuguuugggggcaaagcggaagga

SEQ ID NO: 553076 - RNA, 23 nt, Human
cuuggucuggccucccucggccc

SEQ ID NO: 553077 - RNA, 23 nt, Human
gagcgcuccugcccggguguggg

SEQ ID NO: 553078 - RNA, 21 nt, Human
gaggggcaggcacccagggcc

SEQ ID NO: 553079 - RNA, 20 nt, Human
gcgcggggaaacccugccug

SEQ ID NO: 553080 - RNA, 22 nt, Human
gcuagaugggcugaccgggggg

SEQ ID NO: 553081 - RNA, 31 nt, Human
ggccaucacuuuauuaaggggucaucuagaa

SEQ ID NO: 553082 - RNA, 22 nt, Human
gggcgcgaucggugcuacgacc

SEQ ID NO: 553083 - RNA, 20 nt, Human
guggggugugagccucagcc

SEQ ID NO: 553084 - RNA, 24 nt, Human
uacuucaccaccccgggccagccu

SEQ ID NO: 553085 - RNA, 23 nt, Human
ucaggcucaugaagcagccaccg

SEQ ID NO: 553086 - RNA, 21 nt, Human
uccaggggucccuuccugcug

SEQ ID NO: 553087 - RNA, 19 nt, Human
ucccagagaugcacaguga

SEQ ID NO: 553088 - RNA, 19 nt, Human
ucccucggcccgguccugg

SEQ ID NO: 553089 - RNA, 18 nt, Human
uccgcccggcagcgcgcg

SEQ ID NO: 553090 - RNA, 18 nt, Human
ucggcccgguccuggcac

SEQ ID NO: 553091 - RNA, 23 nt, Human
ugacaaaccgcgggacugugauc

SEQ ID NO: 553092 - RNA, 19 nt, Human
ugacaaagugcggcagggc

SEQ ID NO: 553093 - RNA, 19 nt, Human
ugagagcaggcgagaggca

SEQ ID NO: 553094 - RNA, 18 nt, Human
ugcccggguguggggugu

SEQ ID NO: 553095 - RNA, 21 nt, Human
uggaaggaaucacacuggaaa

SEQ ID NO: 553096 - RNA, 19 nt, Human
uggccaggaggggccucag

SEQ ID NO: 553097 - RNA, 23 nt, Human
uggccaggaggggccucaggaac

SEQ ID NO: 553098 - RNA, 19 nt, Human
uggcgugaggaauggagga

SEQ ID NO: 553099 - RNA, 20 nt, Human
uggcucacgaucuugcccac

SEQ ID NO: 553100 - RNA, 19 nt, Human
uggggccagggagcgcucc

SEQ ID NO: 553101 - RNA, 23 nt, Human
uggggccagggagcgcuccugcc

SEQ ID NO: 553102 - RNA, 23 nt, Human
ugugcgggaccccugcugggggc

SEQ ID NO: 553103 - RNA, 20 nt, Human
uguuggggccagggagcgcu

SEQ ID NO: 553104 - RNA, 20 nt, Human
uugggugggggucaggggca

SEQ ID NO: 553105 - RNA, 22 nt, Human
aggcgaccgcagccagcggagc

SEQ ID NO: 553106 - RNA, 19 nt, Human
aggugccgcuccccuccug

SEQ ID NO: 553107 - RNA, 18 nt, Human
auaaaaauacugcguacc

SEQ ID NO: 553108 - RNA, 27 nt, Human
cauaaaauacugguauaaaaauacugc

SEQ ID NO: 553109 - RNA, 18 nt, Human
cccaggcgaccgcagcca

SEQ ID NO: 553110 - RNA, 20 nt, Human
cccuggcggcagcucccagg

SEQ ID NO: 553111 - RNA, 18 nt, Human
ccgcuccccuccuggccc

SEQ ID NO: 553112 - RNA, 20 nt, Human
ccgcuccccuccuggcccug

SEQ ID NO: 553113 - RNA, 21 nt, Human
ccugcuaauugacaucuucac

SEQ ID NO: 553114 - RNA, 23 nt, Human
uagaaaaauaagauucuugagcg

SEQ ID NO: 553115 - RNA, 24 nt, Human
ucacuacauaaaauacugguauaa

SEQ ID NO: 553116 - RNA, 19 nt, Human
uggcccuggcggcagcucc

SEQ ID NO: 553117 - RNA, 23 nt, Human
uucuugagcgauuccagcugcau

SEQ ID NO: 553118 - RNA, 24 nt, Human
aaaaaucccaaaaguauacaaaga

SEQ ID NO: 553119 - RNA, 21 nt, Human
aaaagagacaauacucaugca

SEQ ID NO: 553120 - RNA, 20 nt, Human
aaaauauguauuaccauagc

SEQ ID NO: 553121 - RNA, 18 nt, Human
aaauccagcaagcugugg

SEQ ID NO: 553122 - RNA, 21 nt, Human
aagaaaaagaucaugaaaaga

SEQ ID NO: 553123 - RNA, 23 nt, Human
aagaaacaguacuccaaaguuca

SEQ ID NO: 553124 - RNA, 18 nt, Human
aagcaaaaccaagaguau

SEQ ID NO: 553125 - RNA, 18 nt, Human
aagcugccaccuccagcc

SEQ ID NO: 553126 - RNA, 19 nt, Human
acaaagcaaaaccaagagu

SEQ ID NO: 553127 - RNA, 20 nt, Human
acaaauccagcaagcugugg

SEQ ID NO: 553128 - RNA, 18 nt, Human
acacaaauccagcaagcu

SEQ ID NO: 553129 - RNA, 22 nt, Human
acauauauuuaaugcccugaaa

SEQ ID NO: 553130 - RNA, 20 nt, Human
agaauuuuguugugcuuuuc

SEQ ID NO: 553131 - RNA, 22 nt, Human
agcgcucaguccugccggaggc

SEQ ID NO: 553132 - RNA, 23 nt, Human
aggaaagaaaaagaucaugaaaa

SEQ ID NO: 553133 - RNA, 21 nt, Human
aggaagaaacaguacuccaaa

SEQ ID NO: 553134 - RNA, 22 nt, Human
aggaagaaacaguacuccaaag

SEQ ID NO: 553135 - RNA, 25 nt, Human
agguacaucaggagagucggggccc

SEQ ID NO: 553136 - RNA, 21 nt, Human
agguuggggaggggacuuggc

SEQ ID NO: 553137 - RNA, 22 nt, Human
auagaucuucuauauuuuuaug

SEQ ID NO: 553138 - RNA, 21 nt, Human
aucaaaagagacaauacucau

SEQ ID NO: 553139 - RNA, 24 nt, Human
caacuagccaaaucucuuuuuaau

SEQ ID NO: 553140 - RNA, 21 nt, Human
caauauauuuuucacaaacca

SEQ ID NO: 553141 - RNA, 25 nt, Human
cacaaauccagcaagcugugguccu

SEQ ID NO: 553142 - RNA, 25 nt, Human
caccaaaaaucccaaaaguauacaa

SEQ ID NO: 553143 - RNA, 27 nt, Human
caccuccagccucacucuaaauagcuu

SEQ ID NO: 553144 - RNA, 26 nt, Human
caugcacacaccaagauggcugcaug

SEQ ID NO: 553145 - RNA, 24 nt, Human
cauuacacacacaacuagccaaau

SEQ ID NO: 553146 - RNA, 23 nt, Human
cccauagcuaacacaaauccagc

SEQ ID NO: 553147 - RNA, 22 nt, Human
cccgccuuccggccucccagcg

SEQ ID NO: 553148 - RNA, 19 nt, Human
ccuaaaaucccuauuauuc

SEQ ID NO: 553149 - RNA, 22 nt, Human
ccucccgcccgccucuccgccg

SEQ ID NO: 553150 - RNA, 22 nt, Human
ccugaaaacuucugcuuaaaaa

SEQ ID NO: 553151 - RNA, 19 nt, Human
ccugguucuccaguucugu

SEQ ID NO: 553152 - RNA, 20 nt, Human
ccuuccaaaccacuugguca

SEQ ID NO: 553153 - RNA, 20 nt, Human
cuaaaaucccuauuauucca

SEQ ID NO: 553154 - RNA, 25 nt, Human
cuaacacaaauccagcaagcugugg

SEQ ID NO: 553155 - RNA, 23 nt, Human
cuauuaugaaguuagauaaacac

SEQ ID NO: 553156 - RNA, 23 nt, Human
cuccagccucacucuaaauagcu

SEQ ID NO: 553157 - RNA, 23 nt, Human
cucccgcccgccucuccgccgug

SEQ ID NO: 553158 - RNA, 22 nt, Human
cuuacacugugaauggcaguuu

SEQ ID NO: 553159 - RNA, 18 nt, Human
cuucugcuuaaaaacuga

SEQ ID NO: 553160 - RNA, 20 nt, Human
gaaaacuucugcuuaaaaac

SEQ ID NO: 553161 - RNA, 23 nt, Human
gaaaacuucugcuuaaaaacuga

SEQ ID NO: 553162 - RNA, 23 nt, Human
gaacaucugaagguaacaaaaaa

SEQ ID NO: 553163 - RNA, 24 nt, Human
gagccgccgccuccagcucgcgcc

SEQ ID NO: 553164 - RNA, 20 nt, Human
gcaugccuccuuccaaacca

SEQ ID NO: 553165 - RNA, 24 nt, Human
gcccgccucuccgccgugcgcgcc

SEQ ID NO: 553166 - RNA, 19 nt, Human
gcccugaaaacuucugcuu

SEQ ID NO: 553167 - RNA, 20 nt, Human
gcgcucaguccugccggagg

SEQ ID NO: 553168 - RNA, 20 nt, Human
gcugccaccuccagccucac

SEQ ID NO: 553169 - RNA, 21 nt, Human
ggcaguuugaucacuaaauuu

SEQ ID NO: 553170 - RNA, 20 nt, Human
ggccucccagcgcucagucc

SEQ ID NO: 553171 - RNA, 19 nt, Human
gggaaggaaagaaaaagau

SEQ ID NO: 553172 - RNA, 22 nt, Human
guacuccaaaguucaucaauau

SEQ ID NO: 553173 - RNA, 22 nt, Human
uaaaauauguauuaccauagca

SEQ ID NO: 553174 - RNA, 21 nt, Human
uaaagcaugccuccuuccaaa

SEQ ID NO: 553175 - RNA, 23 nt, Human
uaaaguauccacccuaaaauccc

SEQ ID NO: 553176 - RNA, 24 nt, Human
uaacauuacacacacaacuagcca

SEQ ID NO: 553177 - RNA, 25 nt, Human
uaagaaauuauccgaauagcuucca

SEQ ID NO: 553178 - RNA, 23 nt, Human
uacacaacauauauuuaaugccc

SEQ ID NO: 553179 - RNA, 24 nt, Human
uacacaacauauauuuaaugcccu

SEQ ID NO: 553180 - RNA, 21 nt, Human
uacacugugaauggcaguuug

SEQ ID NO: 553181 - RNA, 19 nt, Human
uauaagcaccaaaaauccc

SEQ ID NO: 553182 - RNA, 22 nt, Human
uauaagcaccaaaaaucccaaa

SEQ ID NO: 553183 - RNA, 25 nt, Human
uauaagcaccaaaaaucccaaaagu

SEQ ID NO: 553184 - RNA, 21 nt, Human
uauguagaauuggguauaaag

SEQ ID NO: 553185 - RNA, 26 nt, Human
uauuaugaaguuagauaaacacagga

SEQ ID NO: 553186 - RNA, 24 nt, Human
ucaaaauacacaugcugaauguga

SEQ ID NO: 553187 - RNA, 20 nt, Human
ucacaaagcaaaaccaagag

SEQ ID NO: 553188 - RNA, 21 nt, Human
ucaguuugaaggaagaaacag

SEQ ID NO: 553189 - RNA, 21 nt, Human
ucccagcgcucaguccugccu

SEQ ID NO: 553190 - RNA, 18 nt, Human
ucccauagcuaacacaaa

SEQ ID NO: 553191 - RNA, 21 nt, Human
ucccuauuauuccaugauauu

SEQ ID NO: 553192 - RNA, 24 nt, Human
uccgaauagcuuccaacuugguuu

SEQ ID NO: 553193 - RNA, 20 nt, Human
uccucaguuucuugggaagg

SEQ ID NO: 553194 - RNA, 22 nt, Human
ucuucaauucucuccacauuuc

SEQ ID NO: 553195 - RNA, 18 nt, Human
ugaagcugccaccuccag

SEQ ID NO: 553196 - RNA, 18 nt, Human
ugcccugaaaacuucugc

SEQ ID NO: 553197 - RNA, 18 nt, Human
ugggaaggaaagaaaaag

SEQ ID NO: 553198 - RNA, 23 nt, Human
ugguuuuucaguuuauggcacuu

SEQ ID NO: 553199 - RNA, 22 nt, Human
uguaaaauaacuauucuuuuaa

SEQ ID NO: 553200 - RNA, 21 nt, Human
ugugaugauuauuuacaaugc

SEQ ID NO: 553201 - RNA, 18 nt, Human
uguugugcuuuucacaua

SEQ ID NO: 553202 - RNA, 19 nt, Human
uuaaaugucaaaauacaca

SEQ ID NO: 553203 - RNA, 22 nt, Human
uucacauauccgauguauguuu

SEQ ID NO: 553204 - RNA, 19 nt, Human
uucaguuugaaggaagaaa

SEQ ID NO: 553205 - RNA, 24 nt, Human
uucaguuugaaggaagaaacagua

SEQ ID NO: 553206 - RNA, 19 nt, Human
uuccucaguuucuugggaa

SEQ ID NO: 553207 - RNA, 18 nt, Human
uuggggaggggacuuggc

SEQ ID NO: 553208 - RNA, 24 nt, Human
uuuaaaauauguauuaccauagca

SEQ ID NO: 553209 - RNA, 22 nt, Human
uuuacagaauugagggaaguau

SEQ ID NO: 553210 - RNA, 23 nt, Human
uuuucacaaagcaaaaccaagag

SEQ ID NO: 553211 - RNA, 19 nt, Human
uuuucaguuuauggcacuu

SEQ ID NO: 553212 - RNA, 19 nt, Human
aaggacccucugaggcugg

SEQ ID NO: 553213 - RNA, 22 nt, Human
acgcagcacccccugcuccucc

SEQ ID NO: 553214 - RNA, 20 nt, Human
agacagcugguuccagaagg

SEQ ID NO: 553215 - RNA, 22 nt, Human
agcuucuucaggccccuggcug

SEQ ID NO: 553216 - RNA, 19 nt, Human
cacccccugcuccuccucc

SEQ ID NO: 553217 - RNA, 18 nt, Human
cacccugggccagcuucu

SEQ ID NO: 553218 - RNA, 22 nt, Human
cagcugaccaccacccugggcc

SEQ ID NO: 553219 - RNA, 25 nt, Human
caggaccagccgucagcaguccccu

SEQ ID NO: 553220 - RNA, 22 nt, Human
caggagcuucuucaggccccug

SEQ ID NO: 553221 - RNA, 26 nt, Human
cagucccaccucccaguugcuggagg

SEQ ID NO: 553222 - RNA, 24 nt, Human
ccaccacccugggccagcuucuga

SEQ ID NO: 553223 - RNA, 26 nt, Human
ccagcugaccaccacccugggccaau

SEQ ID NO: 553224 - RNA, 24 nt, Human
ccccauucucuccacagacagcug

SEQ ID NO: 553225 - RNA, 21 nt, Human
ccccugccgggcucugacucc

SEQ ID NO: 553226 - RNA, 24 nt, Human
ccccugcuccuccuccucagcccc

SEQ ID NO: 553227 - RNA, 18 nt, Human
ccccuggcugaggaagag

SEQ ID NO: 553228 - RNA, 21 nt, Human
cccugacccagcugaccacca

SEQ ID NO: 553229 - RNA, 24 nt, Human
ccuccuccucagccccugccgggc

SEQ ID NO: 553230 - RNA, 22 nt, Human
ccugcagcaccuuccacgcagc

SEQ ID NO: 553231 - RNA, 21 nt, Human
cgaaagcaccccauucucucc

SEQ ID NO: 553232 - RNA, 18 nt, Human
cuccuccuccucagcccc

SEQ ID NO: 553233 - RNA, 23 nt, Human
cugacccagcugaccaccacccu

SEQ ID NO: 553234 - RNA, 20 nt, Human
cugcuccuccuccucagccc

SEQ ID NO: 553235 - RNA, 21 nt, Human
cugcuccuccuccucagcccc

SEQ ID NO: 553236 - RNA, 21 nt, Human
cugggccagcuucugacaguc

SEQ ID NO: 553237 - RNA, 18 nt, Human
cuuccggguaggaugugc

SEQ ID NO: 553238 - RNA, 21 nt, Human
gaggagaggcgcgacacagcg

SEQ ID NO: 553239 - RNA, 20 nt, Human
gccagcuucugacaguccca

SEQ ID NO: 553240 - RNA, 20 nt, Human
ggagaaggcgagguggucca

SEQ ID NO: 553241 - RNA, 23 nt, Human
ggguggcuuggggucagcuucca

SEQ ID NO: 553242 - RNA, 21 nt, Human
gguccagcaggugccguaggu

SEQ ID NO: 553243 - RNA, 19 nt, Human
ggucuuccggguaggaugu

SEQ ID NO: 553244 - RNA, 18 nt, Human
gugaaggguggcuugggg

SEQ ID NO: 553245 - RNA, 20 nt, Human
gugaaggguggcuugggguc

SEQ ID NO: 553246 - RNA, 21 nt, Human
gugaaggguggcuugggguca

SEQ ID NO: 553247 - RNA, 20 nt, Human
ucaggccccuggcugaggaa

SEQ ID NO: 553248 - RNA, 22 nt, Human
uccacagacagcugguuccaga

SEQ ID NO: 553249 - RNA, 23 nt, Human
uccaggugaaggguggcuugggg

SEQ ID NO: 553250 - RNA, 20 nt, Human
uccuuccucaggaccagccg

SEQ ID NO: 553251 - RNA, 19 nt, Human
ucuucaggccccuggcuga

SEQ ID NO: 553252 - RNA, 21 nt, Human
ugacccagcugaccaccaccc

SEQ ID NO: 553253 - RNA, 18 nt, Human
ugaggcuggucuuccggg

SEQ ID NO: 553254 - RNA, 25 nt, Human
ugccgggcucugacuccuaagucag

SEQ ID NO: 553255 - RNA, 22 nt, Human
ugccguaggucccugacccagc

SEQ ID NO: 553256 - RNA, 24 nt, Human
uggcugaggaagagccacagccac

SEQ ID NO: 553257 - RNA, 22 nt, Human
ugggcaguuuguccuuccucag

SEQ ID NO: 553258 - RNA, 18 nt, Human
uggggucagcuuccaccc

SEQ ID NO: 553259 - RNA, 18 nt, Human
uuccagaaggacccucug

SEQ ID NO: 553260 - RNA, 20 nt, Human
uucuucaggccccuggcuga

SEQ ID NO: 553261 - RNA, 21 nt, Human
aaaacacaacuggacauuuuc

SEQ ID NO: 553262 - RNA, 21 nt, Human
aaacaccaaagacaauuuccc

SEQ ID NO: 553263 - RNA, 20 nt, Human
aaacacucauuuuguaauuc

SEQ ID NO: 553264 - RNA, 20 nt, Human
aaacuggacuaguuugcuuu

SEQ ID NO: 553265 - RNA, 22 nt, Human
aacaccaaagacaauuucccca

SEQ ID NO: 553266 - RNA, 22 nt, Human
aacuauucaauuaucugagcag

SEQ ID NO: 553267 - RNA, 18 nt, Human
aacuugaauccccagcgg

SEQ ID NO: 553268 - RNA, 22 nt, Human
aagcaggagacuaccuuacaac

SEQ ID NO: 553269 - RNA, 30 nt, Human
aagcaggagacuaccuuacaaccccaagag

SEQ ID NO: 553270 - RNA, 20 nt, Human
aaguacaaaaaauuaaacug

SEQ ID NO: 553271 - RNA, 21 nt, Human
aauuuguguucucauucccuc

SEQ ID NO: 553272 - RNA, 23 nt, Human
acaguuuuaaacgucacagaaaa

SEQ ID NO: 553273 - RNA, 22 nt, Human
agaacaccaccuagauugaucc

SEQ ID NO: 553274 - RNA, 18 nt, Human
agacaauuuccccaggaa

SEQ ID NO: 553275 - RNA, 19 nt, Human
agacuaccuuacaacccca

SEQ ID NO: 553276 - RNA, 20 nt, Human
agggaacugcaguauggauu

SEQ ID NO: 553277 - RNA, 21 nt, Human
aggucugguuccuucuucccu

SEQ ID NO: 553278 - RNA, 21 nt, Human
auaguacuuagaguuaaucau

SEQ ID NO: 553279 - RNA, 22 nt, Human
caaugucagagcuggagaaaau

SEQ ID NO: 553280 - RNA, 22 nt, Human
cacacacacauaauaaaacccc

SEQ ID NO: 553281 - RNA, 21 nt, Human
cacauaauaaaaccccacaau

SEQ ID NO: 553282 - RNA, 18 nt, Human
caccaaagacaauuuccc

SEQ ID NO: 553283 - RNA, 18 nt, Human
cacccucugggauacuug

SEQ ID NO: 553284 - RNA, 22 nt, Human
cagacccaaaaugagcuuaaag

SEQ ID NO: 553285 - RNA, 18 nt, Human
cagcagcacccucuggga

SEQ ID NO: 553286 - RNA, 22 nt, Human
caguauaauaccucgaauccau

SEQ ID NO: 553287 - RNA, 19 nt, Human
caguaugccagauuuuucu

SEQ ID NO: 553288 - RNA, 19 nt, Human
caguggauuauccaauuug

SEQ ID NO: 553289 - RNA, 22 nt, Human
caucaauuaguguaacccaggg

SEQ ID NO: 553290 - RNA, 27 nt, Human
caucuaggaaaagcacacacacauaau

SEQ ID NO: 553291 - RNA, 25 nt, Human
cauuuaauauccauaccccccucaa

SEQ ID NO: 553292 - RNA, 24 nt, Human
ccccaaacuuuagcagacccaaaa

SEQ ID NO: 553293 - RNA, 24 nt, Human
ccccccaaacuuuagcagacccaa

SEQ ID NO: 553294 - RNA, 25 nt, Human
ccugccucacuugucccuuucucuu

SEQ ID NO: 553295 - RNA, 19 nt, Human
cgccuaaauuaacugccaa

SEQ ID NO: 553296 - RNA, 19 nt, Human
cuaaaaacacucauuuugu

SEQ ID NO: 553297 - RNA, 23 nt, Human
cuaauacuuucuucaugcugcac

SEQ ID NO: 553298 - RNA, 18 nt, Human
cuagacgccuaaauuaac

SEQ ID NO: 553299 - RNA, 18 nt, Human
cuuaaaccauaaauagua

SEQ ID NO: 553300 - RNA, 22 nt, Human
gagauuucaaagcugaaaaugc

SEQ ID NO: 553301 - RNA, 22 nt, Human
gauuugaaaacuucagguaagg

SEQ ID NO: 553302 - RNA, 23 nt, Human
gcagacccaaaaugagcuuaaag

SEQ ID NO: 553303 - RNA, 20 nt, Human
gcccuuuauucccaaguagc

SEQ ID NO: 553304 - RNA, 19 nt, Human
ggaaucaaaaucucggugc

SEQ ID NO: 553305 - RNA, 19 nt, Human
ggaucugacugaaccuaca

SEQ ID NO: 553306 - RNA, 20 nt, Human
gggaaugcuagucucucuug

SEQ ID NO: 553307 - RNA, 18 nt, Human
gguucuauuaugaaggca

SEQ ID NO: 553308 - RNA, 18 nt, Human
gguuuuucuucuggacaa

SEQ ID NO: 553309 - RNA, 20 nt, Human
guuaaagugaugaauauguu

SEQ ID NO: 553310 - RNA, 24 nt, Human
guuacugcuccguuucccuccccc

SEQ ID NO: 553311 - RNA, 23 nt, Human
uaaaacacucaagucacugaagg

SEQ ID NO: 553312 - RNA, 23 nt, Human
uaaacaccaaagacaauuucccc

SEQ ID NO: 553313 - RNA, 18 nt, Human
uaaauacauguucaagca

SEQ ID NO: 553314 - RNA, 22 nt, Human
uaaauuuaagaccaagaacacc

SEQ ID NO: 553315 - RNA, 18 nt, Human
uaagugaaauauaauaaa

SEQ ID NO: 553316 - RNA, 24 nt, Human
uacaaccccaagagaaaaauaugu

SEQ ID NO: 553317 - RNA, 19 nt, Human
uaccccccucaaaaagccc

SEQ ID NO: 553318 - RNA, 23 nt, Human
uacuuugacacagaaaaucaggu

SEQ ID NO: 553319 - RNA, 24 nt, Human
uagauugaucccuuaaguaaucaa

SEQ ID NO: 553320 - RNA, 20 nt, Human
uagguguuuacaaaacacaa

SEQ ID NO: 553321 - RNA, 21 nt, Human
uauaaugcauuuuuuucuauc

SEQ ID NO: 553322 - RNA, 19 nt, Human
uaugauacugacaagugaa

SEQ ID NO: 553323 - RNA, 19 nt, Human
ucaaaaagcccuuuauucc

SEQ ID NO: 553324 - RNA, 20 nt, Human
ucaguaugccagauuuuucu

SEQ ID NO: 553325 - RNA, 22 nt, Human
ucaguugggcaauacucuuuau

SEQ ID NO: 553326 - RNA, 19 nt, Human
ucccuuucucuuguagcca

SEQ ID NO: 553327 - RNA, 19 nt, Human
ucuagacgccuaaauuaac

SEQ ID NO: 553328 - RNA, 23 nt, Human
ucucacucagcuugaauacuaaa

SEQ ID NO: 553329 - RNA, 19 nt, Human
ucucucuugcuuuagagag

SEQ ID NO: 553330 - RNA, 20 nt, Human
ucuggaaagcaggagacuac

SEQ ID NO: 553331 - RNA, 21 nt, Human
ugaaaacuuacucccccacca

SEQ ID NO: 553332 - RNA, 19 nt, Human
ugaagacaacuuucuuuug

SEQ ID NO: 553333 - RNA, 24 nt, Human
ugacauguuacuugucugucagau

SEQ ID NO: 553334 - RNA, 23 nt, Human
ugacuaaguauuuauugagacaa

SEQ ID NO: 553335 - RNA, 21 nt, Human
ugagcagaaauuaugaaugaa

SEQ ID NO: 553336 - RNA, 19 nt, Human
ugagggacauuucaacuug

SEQ ID NO: 553337 - RNA, 19 nt, Human
ugcuccguuucccuccccc

SEQ ID NO: 553338 - RNA, 22 nt, Human
uggaaaacaaugucagagcugg

SEQ ID NO: 553339 - RNA, 18 nt, Human
uggaaagcaggagacuac

SEQ ID NO: 553340 - RNA, 22 nt, Human
uggaaagcaggagacuaccuua

SEQ ID NO: 553341 - RNA, 19 nt, Human
uggcauucaaguauaauca

SEQ ID NO: 553342 - RNA, 18 nt, Human
ugucaagaguggccugug

SEQ ID NO: 553343 - RNA, 23 nt, Human
ugucacaguuuuaaacgucacag

SEQ ID NO: 553344 - RNA, 20 nt, Human
uguucccuuauuguuaaagu

SEQ ID NO: 553345 - RNA, 22 nt, Human
uguucucauucccuccucuaaa

SEQ ID NO: 553346 - RNA, 21 nt, Human
uguuuacaaaacacaacugga

SEQ ID NO: 553347 - RNA, 23 nt, Human
uguuuugucauuuuuuuccaaac

SEQ ID NO: 553348 - RNA, 20 nt, Human
uuacaguaaauaugcaacug

SEQ ID NO: 553349 - RNA, 19 nt, Human
uuacgagagggaacugcag

SEQ ID NO: 553350 - RNA, 22 nt, Human
uucucauucccuccucuaaaca

SEQ ID NO: 553351 - RNA, 20 nt, Human
uuucugggaagcuggauuug

SEQ ID NO: 553352 - RNA, 21 nt, Human
uuugcguaacauuucccccca

SEQ ID NO: 553353 - RNA, 18 nt, Human
uuuguguucucauucccu

SEQ ID NO: 553354 - RNA, 20 nt, Human
aacccucgccucucccagcc

SEQ ID NO: 553355 - RNA, 28 nt, Human
aaucaaaucaaaugugaaaagagcugaa

SEQ ID NO: 553356 - RNA, 22 nt, Human
caccuccuccggcgucuuagcc

SEQ ID NO: 553357 - RNA, 21 nt, Human
cccucgccucucccagccgcc

SEQ ID NO: 553358 - RNA, 18 nt, Human
ccgccgccaccuccuccg

SEQ ID NO: 553359 - RNA, 20 nt, Human
ccuccggcgucuuagcccgc

SEQ ID NO: 553360 - RNA, 19 nt, Human
cgaugcuaaaaucggccag

SEQ ID NO: 553361 - RNA, 25 nt, Human
cggccagaacccucgccucucccag

SEQ ID NO: 553362 - RNA, 24 nt, Human
cuauuuuuaauuucugcuucauaa

SEQ ID NO: 553363 - RNA, 22 nt, Human
cucccagccgccgccaccuccu

SEQ ID NO: 553364 - RNA, 21 nt, Human
cucucccagccgccgccaccu

SEQ ID NO: 553365 - RNA, 18 nt, Human
cuguuucugcacccucug

SEQ ID NO: 553366 - RNA, 22 nt, Human
gaaugcaggaccuuaagcugca

SEQ ID NO: 553367 - RNA, 21 nt, Human
gccucuuggcuauuuuuaauu

SEQ ID NO: 553368 - RNA, 20 nt, Human
gcuuuugacauauuaagucc

SEQ ID NO: 553369 - RNA, 21 nt, Human
gugaaaagagcugaaugcagg

SEQ ID NO: 553370 - RNA, 22 nt, Human
uaaccaaauaccucaauaaauu

SEQ ID NO: 553371 - RNA, 20 nt, Human
uagggaucucuucuccacuu

SEQ ID NO: 553372 - RNA, 20 nt, Human
uauagaacaaagaucuuuag

SEQ ID NO: 553373 - RNA, 23 nt, Human
uauuagggaucucuucuccacuu

SEQ ID NO: 553374 - RNA, 19 nt, Human
ucaaucaaaucaaauguga

SEQ ID NO: 553375 - RNA, 20 nt, Human
ucaaugaguucuuccacucu

SEQ ID NO: 553376 - RNA, 22 nt, Human
ucccagccgccgccaccuccuc

SEQ ID NO: 553377 - RNA, 25 nt, Human
ucggccagaacccucgccucuccca

SEQ ID NO: 553378 - RNA, 19 nt, Human
ucucccagccgccgccacc

SEQ ID NO: 553379 - RNA, 23 nt, Human
ucucccagccgccgccaccuccu

SEQ ID NO: 553380 - RNA, 23 nt, Human
ucugcacccucugggagaaaaag

SEQ ID NO: 553381 - RNA, 20 nt, Human
ugaaaagagcugaaugcagg

SEQ ID NO: 553382 - RNA, 24 nt, Human
ugaaaagagcugaaugcaggaccu

SEQ ID NO: 553383 - RNA, 23 nt, Human
ugaaugcaggaccuuaagcugca

SEQ ID NO: 553384 - RNA, 20 nt, Human
ugaguucuuccacucgagcu

SEQ ID NO: 553385 - RNA, 23 nt, Human
uguuucugcacccucugggagaa

SEQ ID NO: 553386 - RNA, 23 nt, Human
uugucauuuucauuaucuuugau

SEQ ID NO: 553387 - RNA, 19 nt, Human
acugccccaggccccaaga

SEQ ID NO: 553388 - RNA, 19 nt, Human
aggaauucuuucuucauuc

SEQ ID NO: 553389 - RNA, 24 nt, Human
aggagcaccagcagcagggccauc

SEQ ID NO: 553390 - RNA, 22 nt, Human
auaaucuauaucuauacuguga

SEQ ID NO: 553391 - RNA, 22 nt, Human
cagaacuucggaaauacucccc

SEQ ID NO: 553392 - RNA, 23 nt, Human
cagcagcagggccaucgccuccu

SEQ ID NO: 553393 - RNA, 19 nt, Human
ccaagaggcgaggagcacc

SEQ ID NO: 553394 - RNA, 25 nt, Human
ccacgcccgccggcccccucacugc

SEQ ID NO: 553395 - RNA, 25 nt, Human
ccagcagcagggccaucgccuccuc

SEQ ID NO: 553396 - RNA, 20 nt, Human
cccaagaggcgaggagcacc

SEQ ID NO: 553397 - RNA, 23 nt, Human
ccccaggccccaagaggcgagga

SEQ ID NO: 553398 - RNA, 21 nt, Human
ccgccggcccccucacugccc

SEQ ID NO: 553399 - RNA, 22 nt, Human
ccggcccccucacugccccagg

SEQ ID NO: 553400 - RNA, 20 nt, Human
cgcccgccggcccccucacu

SEQ ID NO: 553401 - RNA, 19 nt, Human
cgucacagaaucuugugga

SEQ ID NO: 553402 - RNA, 20 nt, Human
cuuauauccucccuucuccc

SEQ ID NO: 553403 - RNA, 24 nt, Human
gagaacuugacauuagauuugacg

SEQ ID NO: 553404 - RNA, 23 nt, Human
gcagcagggccaucgccuccucg

SEQ ID NO: 553405 - RNA, 19 nt, Human
gccccaggccccaagaggc

SEQ ID NO: 553406 - RNA, 20 nt, Human
gccggcccccucacugcccc

SEQ ID NO: 553407 - RNA, 19 nt, Human
gcggccacucggcccacgc

SEQ ID NO: 553408 - RNA, 19 nt, Human
ggcgaggagcaccagcagc

SEQ ID NO: 553409 - RNA, 20 nt, Human
uaagagggcauuagugcucu

SEQ ID NO: 553410 - RNA, 19 nt, Human
uacucagaacuucggaaau

SEQ ID NO: 553411 - RNA, 23 nt, Human
uauuugguucaucuuuccuauca

SEQ ID NO: 553412 - RNA, 19 nt, Human
ucuaccagcucauccauca

SEQ ID NO: 553413 - RNA, 25 nt, Human
ucuuauauccucccuucucccauuc

SEQ ID NO: 553414 - RNA, 18 nt, Human
ucuuguggaaaggaaguu

SEQ ID NO: 553415 - RNA, 22 nt, Human
ucuuucuucauucuugaaguuc

SEQ ID NO: 553416 - RNA, 20 nt, Human
ugccccaggccccaagaggc

SEQ ID NO: 553417 - RNA, 19 nt, Human
uuaagagaacuugacauua

SEQ ID NO: 553418 - RNA, 19 nt, Human
uuagugcucuuauauccuc

SEQ ID NO: 553419 - RNA, 18 nt, Human
uucaucuuuccuaucaaa

SEQ ID NO: 553420 - RNA, 20 nt, Human
uucaucuuuccuaucaaaug

SEQ ID NO: 553421 - RNA, 24 nt, Human
uuuccaguuugaccuugguucacc

SEQ ID NO: 553422 - RNA, 23 nt, Human
uuuguaauauuuauaaucuauau

SEQ ID NO: 553423 - RNA, 20 nt, Human
uuuuuucuuuuuagaaaucu

SEQ ID NO: 553424 - RNA, 25 nt, Human
uuuuuuuuuuuuuuuuuuucuuuuu

SEQ ID NO: 553425 - RNA, 27 nt, Human
aaagaacagcgcccccagcggaugcca

SEQ ID NO: 553426 - RNA, 20 nt, Human
acagcgccggcggcugcggc

SEQ ID NO: 553427 - RNA, 22 nt, Human
agaaaggaaacgucuuccagga

SEQ ID NO: 553428 - RNA, 19 nt, Human
agaagaaaggaaacgucuu

SEQ ID NO: 553429 - RNA, 19 nt, Human
agacaggagagcugcuggg

SEQ ID NO: 553430 - RNA, 22 nt, Human
cagaagaaaggaaacgucuucc

SEQ ID NO: 553431 - RNA, 23 nt, Human
cagcgcccccagcggaugccagg

SEQ ID NO: 553432 - RNA, 18 nt, Human
cagcggaugccaggacug

SEQ ID NO: 553433 - RNA, 20 nt, Human
cagcggaugccaggacugga

SEQ ID NO: 553434 - RNA, 23 nt, Human
ccaggcuucauuaauacagaaga

SEQ ID NO: 553435 - RNA, 21 nt, Human
cugcugggaagccauguuuuu

SEQ ID NO: 553436 - RNA, 18 nt, Human
cuguggagacaggagagc

SEQ ID NO: 553437 - RNA, 21 nt, Human
gaaagcagccacugcggaaac

SEQ ID NO: 553438 - RNA, 21 nt, Human
gcgcccccagcggaugccagg

SEQ ID NO: 553439 - RNA, 21 nt, Human
ucuccacagcgccggcggcug

SEQ ID NO: 553440 - RNA, 19 nt, Human
cugcagccugagugaagug

SEQ ID NO: 553441 - RNA, 19 nt, Human
cuuucagcaaauccuggag

SEQ ID NO: 553442 - RNA, 19 nt, Human
ggagccccaagagggcugc

SEQ ID NO: 553443 - RNA, 20 nt, Human
uuuuuuuuuuucaagagcga

SEQ ID NO: 553444 - RNA, 24 nt, Human
uuuuuuuuuuuuuuuuuuuucaag

SEQ ID NO: 553445 - RNA, 21 nt, Human
aaccugcuacccaguccucug

SEQ ID NO: 553446 - RNA, 22 nt, Human
aauagguggcccacaggucucc

SEQ ID NO: 553447 - RNA, 24 nt, Human
acaggacaacagaaggaaccugcu

SEQ ID NO: 553448 - RNA, 19 nt, Human
acaggucuccucagggccc

SEQ ID NO: 553449 - RNA, 24 nt, Human
acccucacaguagacacaccacac

SEQ ID NO: 553450 - RNA, 21 nt, Human
agacaauagguggcccacagg

SEQ ID NO: 553451 - RNA, 24 nt, Human
aggacaacagaaggaaccgguacc

SEQ ID NO: 553452 - RNA, 22 nt, Human
aggugggaaagaggaagguggg

SEQ ID NO: 553453 - RNA, 24 nt, Human
caacagaaggaaccugcuacccag

SEQ ID NO: 553454 - RNA, 21 nt, Human
cacacaggacaacagaaggaa

SEQ ID NO: 553455 - RNA, 22 nt, Human
cacaguagacacaccacacagg

SEQ ID NO: 553456 - RNA, 19 nt, Human
caccacacaggacaacaga

SEQ ID NO: 553457 - RNA, 21 nt, Human
cacuggccagggaugcaaagg

SEQ ID NO: 553458 - RNA, 18 nt, Human
cagcagcagggacucggg

SEQ ID NO: 553459 - RNA, 18 nt, Human
cagcagggacucggggag

SEQ ID NO: 553460 - RNA, 25 nt, Human
cugucccugggauucugguccuggg

SEQ ID NO: 553461 - RNA, 18 nt, Human
ucccugggauucuggucc

SEQ ID NO: 553462 - RNA, 24 nt, Human
ucugguccugggacaggugggaaa

SEQ ID NO: 553463 - RNA, 18 nt, Human
ugguccugggacaggugg

SEQ ID NO: 553464 - RNA, 23 nt, Human
ugguccugggacaggugggaaag

SEQ ID NO: 553465 - RNA, 18 nt, Human
aaacaaagugcagggcuc

SEQ ID NO: 553466 - RNA, 26 nt, Human
aaaucaaaacacagggaaccaaagug

SEQ ID NO: 553467 - RNA, 26 nt, Human
aaaucaaaacacagggaaccaaagug

SEQ ID NO: 553468 - RNA, 26 nt, Human
aaaucaaaacacagggaaccaaagug

SEQ ID NO: 553469 - RNA, 19 nt, Human
aaccccacaucaaccccuc

SEQ ID NO: 553470 - RNA, 24 nt, Human
aagucgggggccccaacacccacc

SEQ ID NO: 553471 - RNA, 18 nt, Human
acaacggggaaggaaagg

SEQ ID NO: 553472 - RNA, 19 nt, Human
accccugcuucccgagccg

SEQ ID NO: 553473 - RNA, 21 nt, Human
acccugccuccuuuaccucug

SEQ ID NO: 553474 - RNA, 22 nt, Human
acccugcuccccugccucucca

SEQ ID NO: 553475 - RNA, 24 nt, Human
acccugcuccccugccucuccagc

SEQ ID NO: 553476 - RNA, 20 nt, Human
acccugggcaaagcccucug

SEQ ID NO: 553477 - RNA, 20 nt, Human
acgcgggcuccgcggcugga

SEQ ID NO: 553478 - RNA, 19 nt, Human
agaaaggacaccaguagca

SEQ ID NO: 553479 - RNA, 22 nt, Human
agcagcacccggccgucccggc

SEQ ID NO: 553480 - RNA, 20 nt, Human
agcaggaagucuggagggga

SEQ ID NO: 553481 - RNA, 21 nt, Human
agcgcaggcccagggccugga

SEQ ID NO: 553482 - RNA, 21 nt, Human
agcgcaggcccagggccugga

SEQ ID NO: 553483 - RNA, 23 nt, Human
agcgcaggcccagggccuggagc

SEQ ID NO: 553484 - RNA, 23 nt, Human
agcgcaggcccagggccuggagc

SEQ ID NO: 553485 - RNA, 21 nt, Human
agcuggggcaggccucucugg

SEQ ID NO: 553486 - RNA, 23 nt, Human
aggaggcggcggcggcacagagg

SEQ ID NO: 553487 - RNA, 23 nt, Human
aggcagccuggcccugugggcag

SEQ ID NO: 553488 - RNA, 21 nt, Human
aggcccccagcgcaggcccag

SEQ ID NO: 553489 - RNA, 21 nt, Human
aggcccccagcgcaggcccag

SEQ ID NO: 553490 - RNA, 25 nt, Human
agggcucccccacccugccuccuuu

SEQ ID NO: 553491 - RNA, 23 nt, Human
aguggucgcgcccagucuggagc

SEQ ID NO: 553492 - RNA, 23 nt, Human
aguugaugaagccaggggaaaaa

SEQ ID NO: 553493 - RNA, 26 nt, Human
augaagccaggggaaaaaacaaagug

SEQ ID NO: 553494 - RNA, 19 nt, Human
augguggccgagagcuccu

SEQ ID NO: 553495 - RNA, 22 nt, Human
caaaacacagggaaccaaagug

SEQ ID NO: 553496 - RNA, 22 nt, Human
caaaacacagggaaccaaagug

SEQ ID NO: 553497 - RNA, 22 nt, Human
caaaacacagggaaccaaagug

SEQ ID NO: 553498 - RNA, 19 nt, Human
caaagcccucugcugcuuc

SEQ ID NO: 553499 - RNA, 23 nt, Human
caaccccucagcuacuauguccu

SEQ ID NO: 553500 - RNA, 19 nt, Human
cacaacggggaaggaaagg

SEQ ID NO: 553501 - RNA, 24 nt, Human
cacaaucagagcaugaggggugcc

SEQ ID NO: 553502 - RNA, 20 nt, Human
cacagcaccagagcugcugg

SEQ ID NO: 553503 - RNA, 18 nt, Human
cacaucaaccccucagcc

SEQ ID NO: 553504 - RNA, 23 nt, Human
caccacccugcagggggagggac

SEQ ID NO: 553505 - RNA, 21 nt, Human
caccaguagcaggaagggccc

SEQ ID NO: 553506 - RNA, 20 nt, Human
cacccugccuccuuuaccuc

SEQ ID NO: 553507 - RNA, 18 nt, Human
cacccugcuccccugccu

SEQ ID NO: 553508 - RNA, 25 nt, Human
caccggcgugcacucucccgaccac

SEQ ID NO: 553509 - RNA, 18 nt, Human
cagcgcaggcccagggcc

SEQ ID NO: 553510 - RNA, 18 nt, Human
cagcgcaggcccagggcc

SEQ ID NO: 553511 - RNA, 19 nt, Human
cagcgcccaccucgcaggg

SEQ ID NO: 553512 - RNA, 18 nt, Human
cagcucccgcugcccucc

SEQ ID NO: 553513 - RNA, 22 nt, Human
cagggaaccaaagugcaaauca

SEQ ID NO: 553514 - RNA, 22 nt, Human
cagggaaccaaagugcaaauca

SEQ ID NO: 553515 - RNA, 22 nt, Human
cagggaaccaaagugcaaauca

SEQ ID NO: 553516 - RNA, 21 nt, Human
cagggcucccccacccugccu

SEQ ID NO: 553517 - RNA, 19 nt, Human
cagggcuccgucuccccgg

SEQ ID NO: 553518 - RNA, 21 nt, Human
caggggaaaaaacaaagugca

SEQ ID NO: 553519 - RNA, 22 nt, Human
cauccugaaccccacaucaucc

SEQ ID NO: 553520 - RNA, 22 nt, Human
cauccugaaccccacaucaucc

SEQ ID NO: 553521 - RNA, 24 nt, Human
caugggggggccauccugaacccc

SEQ ID NO: 553522 - RNA, 24 nt, Human
caugggggggccauccugaacccc

SEQ ID NO: 553523 - RNA, 24 nt, Human
caugggggggccauccugaacccc

SEQ ID NO: 553524 - RNA, 21 nt, Human
cauuucaccgguggagaaacg

SEQ ID NO: 553525 - RNA, 20 nt, Human
ccaacacccaccccggccca

SEQ ID NO: 553526 - RNA, 20 nt, Human
ccacaucauccccucagccc

SEQ ID NO: 553527 - RNA, 19 nt, Human
ccaccccccaugggggggc

SEQ ID NO: 553528 - RNA, 19 nt, Human
ccaccccccaugggggggc

SEQ ID NO: 553529 - RNA, 19 nt, Human
ccaccccccaugggggggc

SEQ ID NO: 553530 - RNA, 21 nt, Human
ccagccagccauccuggcugc

SEQ ID NO: 553531 - RNA, 23 nt, Human
ccagcggcgugaccuuggacaag

SEQ ID NO: 553532 - RNA, 27 nt, Human
cccaccccggcccagggacgccaggag

SEQ ID NO: 553533 - RNA, 20 nt, Human
ccccaacacccaccccggcc

SEQ ID NO: 553534 - RNA, 22 nt, Human
ccccaacacccaccccggccca

SEQ ID NO: 553535 - RNA, 22 nt, Human
ccccacccugccuccuuuaccu

SEQ ID NO: 553536 - RNA, 22 nt, Human
ccccauccaccuguacuugcag

SEQ ID NO: 553537 - RNA, 18 nt, Human
ccccgggcccugcgcagg

SEQ ID NO: 553538 - RNA, 20 nt, Human
ccccgguauccugggagcuc

SEQ ID NO: 553539 - RNA, 20 nt, Human
ccccuacaugacuccccggg

SEQ ID NO: 553540 - RNA, 21 nt, Human
cccgaccaccucccucuccca

SEQ ID NO: 553541 - RNA, 20 nt, Human
cccgcaacaccagcaccacc

SEQ ID NO: 553542 - RNA, 24 nt, Human
cccgcagcccuccccgcaggcgcc

SEQ ID NO: 553543 - RNA, 20 nt, Human
cccgcaggcgccaccccuaa

SEQ ID NO: 553544 - RNA, 23 nt, Human
cccgcaggcgccaccccuacaug

SEQ ID NO: 553545 - RNA, 24 nt, Human
cccgcaggcgccaccccuacauga

SEQ ID NO: 553546 - RNA, 21 nt, Human
cccgggccugccgccugcccc

SEQ ID NO: 553547 - RNA, 22 nt, Human
cccucagggcccucgagcccag

SEQ ID NO: 553548 - RNA, 19 nt, Human
cccucugcugcuucagggc

SEQ ID NO: 553549 - RNA, 19 nt, Human
cccugcgcaggucgcuccc

SEQ ID NO: 553550 - RNA, 19 nt, Human
cccugcgcaggucgcuccc

SEQ ID NO: 553551 - RNA, 18 nt, Human
ccgcugcccucccgcagc

SEQ ID NO: 553552 - RNA, 20 nt, Human
ccguguccagcagggagagg

SEQ ID NO: 553553 - RNA, 20 nt, Human
ccucaggggcccagccagcc

SEQ ID NO: 553554 - RNA, 20 nt, Human
ccucccgcagcccuccccgc

SEQ ID NO: 553555 - RNA, 19 nt, Human
ccugccccuugcucaccug

SEQ ID NO: 553556 - RNA, 23 nt, Human
ccugccccuugcucaccuguggc

SEQ ID NO: 553557 - RNA, 18 nt, Human
ccuggagcuucugccuca

SEQ ID NO: 553558 - RNA, 18 nt, Human
ccuucggggaaggcgggg

SEQ ID NO: 553559 - RNA, 25 nt, Human
ccuugccccaggcugccccauccac

SEQ ID NO: 553560 - RNA, 22 nt, Human
cgaccaccucccucucccacag

SEQ ID NO: 553561 - RNA, 19 nt, Human
cgcaacaccagcaccaccc

SEQ ID NO: 553562 - RNA, 21 nt, Human
cggagucggcgaagucggggg

SEQ ID NO: 553563 - RNA, 24 nt, Human
cggugaugagaggcuggggaaaga

SEQ ID NO: 553564 - RNA, 18 nt, Human
cgucccggcagaaaugcc

SEQ ID NO: 553565 - RNA, 22 nt, Human
cguggccgcugccgcuaacacc

SEQ ID NO: 553566 - RNA, 19 nt, Human
cuccacggccguguccagc

SEQ ID NO: 553567 - RNA, 18 nt, Human
cucccccacccugccucc

SEQ ID NO: 553568 - RNA, 21 nt, Human
cucccgcagcccuccccgcag

SEQ ID NO: 553569 - RNA, 24 nt, Human
cuccuuuaccucugggcagggucu

SEQ ID NO: 553570 - RNA, 19 nt, Human
cugcccucccgcagcccuc

SEQ ID NO: 553571 - RNA, 25 nt, Human
gaaaucaaaacacagggaaccaaag

SEQ ID NO: 553572 - RNA, 25 nt, Human
gaaaucaaaacacagggaaccaaag

SEQ ID NO: 553573 - RNA, 25 nt, Human
gaaaucaaaacacagggaaccaaag

SEQ ID NO: 553574 - RNA, 21 nt, Human
gacuggggcucugggcugcag

SEQ ID NO: 553575 - RNA, 19 nt, Human
gagcuggggcaggccucuc

SEQ ID NO: 553576 - RNA, 20 nt, Human
gcaaaucauccaccccccau

SEQ ID NO: 553577 - RNA, 20 nt, Human
gcaaaucauccaccccccau

SEQ ID NO: 553578 - RNA, 21 nt, Human
gcaacaccagcaccacccugc

SEQ ID NO: 553579 - RNA, 21 nt, Human
gccagggcucccccacccugc

SEQ ID NO: 553580 - RNA, 18 nt, Human
gcccaggcggcaccggcg

SEQ ID NO: 553581 - RNA, 22 nt, Human
gcgcaaccccucagcuacuaug

SEQ ID NO: 553582 - RNA, 20 nt, Human
ggacuggggcucugggcugc

SEQ ID NO: 553583 - RNA, 21 nt, Human
ggacuggggcucugggcugca

SEQ ID NO: 553584 - RNA, 18 nt, Human
ggagaggagagggcggca

SEQ ID NO: 553585 - RNA, 18 nt, Human
ggcaggaagggguccugg

SEQ ID NO: 553586 - RNA, 18 nt, Human
ggccagggcucccccacc

SEQ ID NO: 553587 - RNA, 23 nt, Human
ggcccaguuuuaugguggccgag

SEQ ID NO: 553588 - RNA, 21 nt, Human
ggccccaacacccaccccggc

SEQ ID NO: 553589 - RNA, 22 nt, Human
ggccguguccagcagggagagg

SEQ ID NO: 553590 - RNA, 18 nt, Human
gggacuggggcucugggc

SEQ ID NO: 553591 - RNA, 20 nt, Human
gggcaggccucucugggacu

SEQ ID NO: 553592 - RNA, 21 nt, Human
gggcagggucucgaguagugg

SEQ ID NO: 553593 - RNA, 18 nt, Human
gggccuggagcuucugcc

SEQ ID NO: 553594 - RNA, 22 nt, Human
gggccuggagcuucugccucag

SEQ ID NO: 553595 - RNA, 18 nt, Human
gggcucccccacccugcc

SEQ ID NO: 553596 - RNA, 18 nt, Human
ggggacuggggcucuggg

SEQ ID NO: 553597 - RNA, 18 nt, Human
ggguccuggguccucacg

SEQ ID NO: 553598 - RNA, 21 nt, Human
gguagcuguggggagaggaga

SEQ ID NO: 553599 - RNA, 21 nt, Human
ggucccucuggcuuuuccacu

SEQ ID NO: 553600 - RNA, 23 nt, Human
ggucucggggcccgggggccggg

SEQ ID NO: 553601 - RNA, 23 nt, Human
gguuaguggucgcgcccagucug

SEQ ID NO: 553602 - RNA, 22 nt, Human
gguuccccccgcggccuccuca

SEQ ID NO: 553603 - RNA, 20 nt, Human
guagcuguggggagaggaga

SEQ ID NO: 553604 - RNA, 24 nt, Human
gucgcgcccagucuggagcccagg

SEQ ID NO: 553605 - RNA, 20 nt, Human
gucuccccgggccugccgcc

SEQ ID NO: 553606 - RNA, 22 nt, Human
gugcaaaucauccaccccccau

SEQ ID NO: 553607 - RNA, 22 nt, Human
gugccaccacccugggcaaagc

SEQ ID NO: 553608 - RNA, 21 nt, Human
guggagcccgagugcaccgcu

SEQ ID NO: 553609 - RNA, 21 nt, Human
uaaccggguuaguggucgcgc

SEQ ID NO: 553610 - RNA, 19 nt, Human
uagccagggcuccgucucc

SEQ ID NO: 553611 - RNA, 21 nt, Human
uagccuggaggcacagucagg

SEQ ID NO: 553612 - RNA, 21 nt, Human
uagcuguggggagaggagagg

SEQ ID NO: 553613 - RNA, 24 nt, Human
uagugccaccacccugggcaaagc

SEQ ID NO: 553614 - RNA, 26 nt, Human
ucaaaacacagggaaccaaagugcaa

SEQ ID NO: 553615 - RNA, 26 nt, Human
ucaaaacacagggaaccaaagugcaa

SEQ ID NO: 553616 - RNA, 26 nt, Human
ucaaaacacagggaaccaaagugcaa

SEQ ID NO: 553617 - RNA, 22 nt, Human
ucaaccccucagcccccuucag

SEQ ID NO: 553618 - RNA, 20 nt, Human
ucagggcccucgagcccagc

SEQ ID NO: 553619 - RNA, 22 nt, Human
ucauccccucagcccccuucag

SEQ ID NO: 553620 - RNA, 21 nt, Human
uccaccuguacuugcagcggg

SEQ ID NO: 553621 - RNA, 18 nt, Human
uccacggccguguccagc

SEQ ID NO: 553622 - RNA, 20 nt, Human
ucccccagcagcuggcgcaa

SEQ ID NO: 553623 - RNA, 19 nt, Human
uccccccgcggccuccuca

SEQ ID NO: 553624 - RNA, 22 nt, Human
uccccccgcggccuccucaucg

SEQ ID NO: 553625 - RNA, 25 nt, Human
uccccucagcccccuucaggccccc

SEQ ID NO: 553626 - RNA, 19 nt, Human
uccccugccucuccagccc

SEQ ID NO: 553627 - RNA, 18 nt, Human
ucccgcaacaccagcacc

SEQ ID NO: 553628 - RNA, 22 nt, Human
ucccgcaacaccagcaccaccc

SEQ ID NO: 553629 - RNA, 21 nt, Human
uccugaaccccacaucaaccc

SEQ ID NO: 553630 - RNA, 22 nt, Human
uccugaaccccacaucaacccc

SEQ ID NO: 553631 - RNA, 22 nt, Human
ucgagcccagcagcacccggcc

SEQ ID NO: 553632 - RNA, 18 nt, Human
ucucccacaggaggcggc

SEQ ID NO: 553633 - RNA, 19 nt, Human
ucuccccgggccugccgcc

SEQ ID NO: 553634 - RNA, 24 nt, Human
ucucccgaccaccucccucuccca

SEQ ID NO: 553635 - RNA, 22 nt, Human
ucucggggcccgggggccgggu

SEQ ID NO: 553636 - RNA, 25 nt, Human
ucugaagggcaggcaccgcaguugg

SEQ ID NO: 553637 - RNA, 21 nt, Human
ucuugagcuggggcaggccuc

SEQ ID NO: 553638 - RNA, 23 nt, Human
ugaaaugaaaacgcagcgccccc

SEQ ID NO: 553639 - RNA, 21 nt, Human
ugaagccaggggaaaaaacaa

SEQ ID NO: 553640 - RNA, 19 nt, Human
ugacugaggagaaaggaca

SEQ ID NO: 553641 - RNA, 25 nt, Human
ugagaaaucaaaacacagggaacca

SEQ ID NO: 553642 - RNA, 25 nt, Human
ugagaaaucaaaacacagggaacca

SEQ ID NO: 553643 - RNA, 25 nt, Human
ugagaaaucaaaacacagggaacca

SEQ ID NO: 553644 - RNA, 23 nt, Human
ugagauucacaacggggaaggaa

SEQ ID NO: 553645 - RNA, 23 nt, Human
ugagauucacaacggggaaggaa

SEQ ID NO: 553646 - RNA, 19 nt, Human
ugagcuggggcaggccucu

SEQ ID NO: 553647 - RNA, 19 nt, Human
ugaggagaaaggacaccag

SEQ ID NO: 553648 - RNA, 20 nt, Human
ugaggggugccuguggggag

SEQ ID NO: 553649 - RNA, 21 nt, Human
ugccaccacccugggcaaagc

SEQ ID NO: 553650 - RNA, 22 nt, Human
ugccccaggcugccccauccac

SEQ ID NO: 553651 - RNA, 22 nt, Human
ugccccauccaccuguacuugc

SEQ ID NO: 553652 - RNA, 25 nt, Human
ugccgcuaacaccagcucccgcugc

SEQ ID NO: 553653 - RNA, 21 nt, Human
ugccucagguagcucuugagc

SEQ ID NO: 553654 - RNA, 23 nt, Human
ugccucagguagcucuugagcug

SEQ ID NO: 553655 - RNA, 19 nt, Human
uggcaggaagggguccugg

SEQ ID NO: 553656 - RNA, 19 nt, Human
uggcucagggcauggcggg

SEQ ID NO: 553657 - RNA, 20 nt, Human
uggcuucgucucucuaaguc

SEQ ID NO: 553658 - RNA, 18 nt, Human
uggggaggcggggacugg

SEQ ID NO: 553659 - RNA, 19 nt, Human
uggucccaggcuggccccu

SEQ ID NO: 553660 - RNA, 20 nt, Human
ugugacugaggagaaaggac

SEQ ID NO: 553661 - RNA, 19 nt, Human
uguggggagaggagagggc

SEQ ID NO: 553662 - RNA, 22 nt, Human
uucacaacggggaaggaaagga

SEQ ID NO: 553663 - RNA, 23 nt, Human
uucauggucccucuggcuuuucc

SEQ ID NO: 553664 - RNA, 18 nt, Human
uuccucgaaggguagcug

SEQ ID NO: 553665 - RNA, 19 nt, Human
uuuuuuuugcuccccgucc

SEQ ID NO: 553666 - RNA, 19 nt, Human
uuuuuuuuuuuuuuuugcu

SEQ ID NO: 553667 - RNA, 19 nt, Human
uuuuuuuuuuuuuuuugcu

SEQ ID NO: 553668 - RNA, 18 nt, Human
uuuuuuuuuuuuuuuuug

SEQ ID NO: 553669 - RNA, 18 nt, Human
uuuuuuuuuuuuuuuuug

SEQ ID NO: 553670 - RNA, 20 nt, Human
uuuuuuuuuuuuuuuuugcu

SEQ ID NO: 553671 - RNA, 20 nt, Human
uuuuuuuuuuuuuuuuugcu

SEQ ID NO: 553672 - RNA, 19 nt, Human
aagaaagaaggggaagcag

SEQ ID NO: 553673 - RNA, 20 nt, Human
aagaaggggaagcagggagg

SEQ ID NO: 553674 - RNA, 22 nt, Human
aagcaaacgagggaggaaaaca

SEQ ID NO: 553675 - RNA, 22 nt, Human
aagcagggagggcuccaauacg

SEQ ID NO: 553676 - RNA, 22 nt, Human
aagccacaccccugcccacaga

SEQ ID NO: 553677 - RNA, 24 nt, Human
aaugauccugacgcuccugagggc

SEQ ID NO: 553678 - RNA, 18 nt, Human
acaaagccacaccccugc

SEQ ID NO: 553679 - RNA, 23 nt, Human
acaaagccacaccccugcccaca

SEQ ID NO: 553680 - RNA, 24 nt, Human
auggcuaaggaugcacagggugcc

SEQ ID NO: 553681 - RNA, 19 nt, Human
cagcagccaggaccuccca

SEQ ID NO: 553682 - RNA, 24 nt, Human
cagcagccaggaccucccagugcc

SEQ ID NO: 553683 - RNA, 18 nt, Human
cagcccacgcaguccucc

SEQ ID NO: 553684 - RNA, 19 nt, Human
caggaacagaggagucaca

SEQ ID NO: 553685 - RNA, 23 nt, Human
cagggugccaggaacagaggagu

SEQ ID NO: 553686 - RNA, 19 nt, Human
cagguaggaggccuaacca

SEQ ID NO: 553687 - RNA, 22 nt, Human
ccagcuguucucuuguaagcua

SEQ ID NO: 553688 - RNA, 24 nt, Human
ccagugcagugaccuggccucccc

SEQ ID NO: 553689 - RNA, 24 nt, Human
ccucccagugcagugaccuggccu

SEQ ID NO: 553690 - RNA, 23 nt, Human
cuguggggcccagaugccgccau

SEQ ID NO: 553691 - RNA, 20 nt, Human
gaaagaaggggaagcaggga

SEQ ID NO: 553692 - RNA, 20 nt, Human
gagggaggaaaacaaagcca

SEQ ID NO: 553693 - RNA, 23 nt, Human
gccaggaccucccagugcaguga

SEQ ID NO: 553694 - RNA, 20 nt, Human
gcccacgcaguccuccucca

SEQ ID NO: 553695 - RNA, 18 nt, Human
ggaaagaaagaaggggaa

SEQ ID NO: 553696 - RNA, 21 nt, Human
ggcccagaugccgccaugcug

SEQ ID NO: 553697 - RNA, 21 nt, Human
gggugccaggaacagaggagu

SEQ ID NO: 553698 - RNA, 22 nt, Human
gguguuacuguggggcccagau

SEQ ID NO: 553699 - RNA, 20 nt, Human
ucgcagcagccaggaccucc

SEQ ID NO: 553700 - RNA, 25 nt, Human
ucucuuguaagcuauggcuaaggau

SEQ ID NO: 553701 - RNA, 24 nt, Human
ugaaaaugauccugacgcuccuga

SEQ ID NO: 553702 - RNA, 21 nt, Human
ugaccuggccuccccagguag

SEQ ID NO: 553703 - RNA, 20 nt, Human
ugccaggaacagaggaguca

SEQ ID NO: 553704 - RNA, 26 nt, Human
uggaagcaaacgagggaggaaaacaa

SEQ ID NO: 553705 - RNA, 25 nt, Human
uggggaaagaggaaagaaagaaggg

SEQ ID NO: 553706 - RNA, 21 nt, Human
uggggcccagaugccgccaug

SEQ ID NO: 553707 - RNA, 20 nt, Human
uuacuguggggcccagaugc

SEQ ID NO: 553708 - RNA, 25 nt, Human
uuuuuuuuugcugcuauggcugaac

SEQ ID NO: 553709 - RNA, 20 nt, Human
uuuuuuuuuuuuuuuugcug

SEQ ID NO: 553710 - RNA, 18 nt, Human
uuuuuuuuuuuuuuuuug

SEQ ID NO: 553711 - RNA, 20 nt, Human
uuuuuuuuuuuuuuuuugcu

SEQ ID NO: 553712 - RNA, 23 nt, Human
aaagaacaucccccacuucccug

SEQ ID NO: 553713 - RNA, 21 nt, Human
aagaugcuuccgcuuaaaccg

SEQ ID NO: 553714 - RNA, 22 nt, Human
acccagagucucagggagcaga

SEQ ID NO: 553715 - RNA, 24 nt, Human
accccuacucccucuuuuuguucu

SEQ ID NO: 553716 - RNA, 21 nt, Human
acucaggcacuugacaggucc

SEQ ID NO: 553717 - RNA, 18 nt, Human
acugcggagaacgugcgc

SEQ ID NO: 553718 - RNA, 20 nt, Human
agugacuccgagccaaaugc

SEQ ID NO: 553719 - RNA, 24 nt, Human
auccagaggggaggcaaguggagg

SEQ ID NO: 553720 - RNA, 23 nt, Human
aucucuguuuguccaucuuugac

SEQ ID NO: 553721 - RNA, 23 nt, Human
caaaagaacaucccccacuuccc

SEQ ID NO: 553722 - RNA, 23 nt, Human
caacacaagaacccgggucuccu

SEQ ID NO: 553723 - RNA, 22 nt, Human
cacagccaagugacuccgagcc

SEQ ID NO: 553724 - RNA, 23 nt, Human
cagcaagugggcacucguccucu

SEQ ID NO: 553725 - RNA, 21 nt, Human
cagggagcagaagccccccuc

SEQ ID NO: 553726 - RNA, 25 nt, Human
caugacucaggcacuugacaggucc

SEQ ID NO: 553727 - RNA, 20 nt, Human
ccaagugacuccgagccaaa

SEQ ID NO: 553728 - RNA, 21 nt, Human
ccccccucgcuggcuuucuuc

SEQ ID NO: 553729 - RNA, 19 nt, Human
cccuacucccucuuuuugu

SEQ ID NO: 553730 - RNA, 18 nt, Human
cuggcaucuccuguggag

SEQ ID NO: 553731 - RNA, 23 nt, Human
cuggcuuucuucacgcggggucc

SEQ ID NO: 553732 - RNA, 22 nt, Human
gacuccgagccaaaugcuggca

SEQ ID NO: 553733 - RNA, 21 nt, Human
gagauggcccaggggcccugc

SEQ ID NO: 553734 - RNA, 20 nt, Human
uagggaguggagaaauggca

SEQ ID NO: 553735 - RNA, 24 nt, Human
ucccugaccagauacauccagagg

SEQ ID NO: 553736 - RNA, 25 nt, Human
ucuccuguggagauggcccaggggc

SEQ ID NO: 553737 - RNA, 18 nt, Human
ucucgguuuaggauagag

SEQ ID NO: 553738 - RNA, 20 nt, Human
ugaacccagagucucaggga

SEQ ID NO: 553739 - RNA, 26 nt, Human
uggagaaauggcagguccagcuuggg

SEQ ID NO: 553740 - RNA, 21 nt, Human
uggcccaggggcccugcgcaa

SEQ ID NO: 553741 - RNA, 24 nt, Human
uguagggaguggagaaauggcagg

SEQ ID NO: 553742 - RNA, 22 nt, Human
uguagggaguggagaaauggcc

SEQ ID NO: 553743 - RNA, 23 nt, Human
uuucagcgugcucugugaagacc

SEQ ID NO: 553744 - RNA, 25 nt, Human
uuuuaucaaaagaacaucccccacu

SEQ ID NO: 553745 - RNA, 18 nt, Human
uuuuuuuuuuuuuuuuug

SEQ ID NO: 553746 - RNA, 23 nt, Human
uuuuuuuuuuuuuuuuugccagu

SEQ ID NO: 553747 - RNA, 21 nt, Human
acacacaucucucgcaauccu

SEQ ID NO: 553748 - RNA, 25 nt, Human
caacaguaucaacacacaucucucg

SEQ ID NO: 553749 - RNA, 21 nt, Human
cccugguuugugcggcuccgg

SEQ ID NO: 553750 - RNA, 19 nt, Human
uagaaaaacacacgugcaa

SEQ ID NO: 553751 - RNA, 20 nt, Human
uuuuuuuuuuuuuugacgga

SEQ ID NO: 553752 - RNA, 18 nt, Human
uuuuuuuuuuuuuuuuug

SEQ ID NO: 553753 - RNA, 22 nt, Human
uuuuuuuuuuuuuuuuugacgg

SEQ ID NO: 553754 - RNA, 26 nt, Human
aaaaaaaaaaaaaacaacaacaaaaa

SEQ ID NO: 553755 - RNA, 22 nt, Human
aaaaacccccaaggaacagccc

SEQ ID NO: 553756 - RNA, 18 nt, Human
aaaaacuggguaaaggac

SEQ ID NO: 553757 - RNA, 24 nt, Human
aaaaauacagacaugauuucacag

SEQ ID NO: 553758 - RNA, 18 nt, Human
aaaguacugcugcgcccu

SEQ ID NO: 553759 - RNA, 19 nt, Human
aaaugaaagcuuuacauga

SEQ ID NO: 553760 - RNA, 19 nt, Human
aacacggugaaacccuguc

SEQ ID NO: 553761 - RNA, 20 nt, Human
aacacggugaaacccugucu

SEQ ID NO: 553762 - RNA, 21 nt, Human
aacacggugaaacccugucuc

SEQ ID NO: 553763 - RNA, 24 nt, Human
aacugaccuccucuaagaagcccg

SEQ ID NO: 553764 - RNA, 25 nt, Human
aagaaacuuggcucuaaaagcaaac

SEQ ID NO: 553765 - RNA, 19 nt, Human
aagccaagcaaagaauaaa

SEQ ID NO: 553766 - RNA, 20 nt, Human
aagccuccaguggaagcucu

SEQ ID NO: 553767 - RNA, 23 nt, Human
aagggugguggcggcgggauccc

SEQ ID NO: 553768 - RNA, 23 nt, Human
aaucgccuuuuacagauucaagc

SEQ ID NO: 553769 - RNA, 19 nt, Human
acaagcgcaugaucuacag

SEQ ID NO: 553770 - RNA, 18 nt, Human
acacuuucacaaaaggca

SEQ ID NO: 553771 - RNA, 21 nt, Human
acagccccaucccuugggacc

SEQ ID NO: 553772 - RNA, 22 nt, Human
acaguggcgaucggccucacac

SEQ ID NO: 553773 - RNA, 21 nt, Human
acauaggacaacugaccuccu

SEQ ID NO: 553774 - RNA, 22 nt, Human
accaaaaggcaucgagaccuuu

SEQ ID NO: 553775 - RNA, 24 nt, Human
accaacacggugaaacccugucuc

SEQ ID NO: 553776 - RNA, 24 nt, Human
acccaggagguggagguuguagug

SEQ ID NO: 553777 - RNA, 22 nt, Human
acccagguucaacauuuaagag

SEQ ID NO: 553778 - RNA, 19 nt, Human
acccgaggcucgcaggcac

SEQ ID NO: 553779 - RNA, 24 nt, Human
acccugucucuacuaaaaauacaa

SEQ ID NO: 553780 - RNA, 24 nt, Human
accugaggucaggaguuugagacc

SEQ ID NO: 553781 - RNA, 26 nt, Human
accugccuugucuccucaggggaccc

SEQ ID NO: 553782 - RNA, 24 nt, Human
acuaaaaauacaaacauuagccgg

SEQ ID NO: 553783 - RNA, 24 nt, Human
acugcacuccagucugaacaauag

SEQ ID NO: 553784 - RNA, 26 nt, Human
acugcacuccagucugaacaauagag

SEQ ID NO: 553785 - RNA, 19 nt, Human
acuggcccggaagcaacac

SEQ ID NO: 553786 - RNA, 19 nt, Human
acuuguauucuucuuccuc

SEQ ID NO: 553787 - RNA, 19 nt, Human
agaaccguuucacauccuc

SEQ ID NO: 553788 - RNA, 22 nt, Human
agaaucgcuggaacccaggagg

SEQ ID NO: 553789 - RNA, 22 nt, Human
agacaaacaggcaacucuagga

SEQ ID NO: 553790 - RNA, 25 nt, Human
agagcacucgcuauaacauucuuuu

SEQ ID NO: 553791 - RNA, 19 nt, Human
agcaaacucaacgaauucc

SEQ ID NO: 553792 - RNA, 19 nt, Human
agcaacacccagguucaac

SEQ ID NO: 553793 - RNA, 24 nt, Human
agcacuuugggaggcugaggcggg

SEQ ID NO: 553794 - RNA, 20 nt, Human
agcccggaguccgcgcggcc

SEQ ID NO: 553795 - RNA, 23 nt, Human
agccgggcgugguggugcacgcc

SEQ ID NO: 553796 - RNA, 19 nt, Human
aggaaggcucacccgaggc

SEQ ID NO: 553797 - RNA, 22 nt, Human
aggagaaucgcuggaacccagg

SEQ ID NO: 553798 - RNA, 22 nt, Human
aggaggaaguguuuucuacagc

SEQ ID NO: 553799 - RNA, 20 nt, Human
aggaguuugagaccagccug

SEQ ID NO: 553800 - RNA, 26 nt, Human
aggcagagccaauaagaaacauggug

SEQ ID NO: 553801 - RNA, 23 nt, Human
aggcaggagaaucgcuggaaccc

SEQ ID NO: 553802 - RNA, 22 nt, Human
aggcgggcggaucaccugaggu

SEQ ID NO: 553803 - RNA, 26 nt, Human
aggcgggcggaucaccugaggucagg

SEQ ID NO: 553804 - RNA, 20 nt, Human
aggcugaggcaggagaaucg

SEQ ID NO: 553805 - RNA, 23 nt, Human
aggcugaggcaggagaaucgcug

SEQ ID NO: 553806 - RNA, 21 nt, Human
aggcugaggcgggcggaucac

SEQ ID NO: 553807 - RNA, 24 nt, Human
aggcugaggcgggcggaucaccug

SEQ ID NO: 553808 - RNA, 18 nt, Human
agggauggggcugcggag

SEQ ID NO: 553809 - RNA, 19 nt, Human
agggauggggcugcggagg

SEQ ID NO: 553810 - RNA, 21 nt, Human
agggauggggcugcggagggg

SEQ ID NO: 553811 - RNA, 19 nt, Human
aggggaccucagguuuucc

SEQ ID NO: 553812 - RNA, 22 nt, Human
agggugguggcggcgggauccc

SEQ ID NO: 553813 - RNA, 21 nt, Human
agguggagguuguagugagcc

SEQ ID NO: 553814 - RNA, 24 nt, Human
agguggagguuguagugagccgag

SEQ ID NO: 553815 - RNA, 22 nt, Human
agguggcccgggcugggcggga

SEQ ID NO: 553816 - RNA, 22 nt, Human
aguccauggcucugccgcaacc

SEQ ID NO: 553817 - RNA, 19 nt, Human
auaaaaacccccaaggaac

SEQ ID NO: 553818 - RNA, 20 nt, Human
auaggacaacugaccuccuc

SEQ ID NO: 553819 - RNA, 24 nt, Human
aucaugccacugcacuccagucug

SEQ ID NO: 553820 - RNA, 21 nt, Human
augauacauaggacaacugac

SEQ ID NO: 553821 - RNA, 27 nt, Human
augccacugcacuccagucugaacaau

SEQ ID NO: 553822 - RNA, 20 nt, Human
augcuaauccuggggcuccu

SEQ ID NO: 553823 - RNA, 18 nt, Human
augcucccagguugaggg

SEQ ID NO: 553824 - RNA, 20 nt, Human
auguuuaguaugaggugcaa

SEQ ID NO: 553825 - RNA, 22 nt, Human
caaaaaaggaagugcuacccuu

SEQ ID NO: 553826 - RNA, 20 nt, Human
caaacucaacgaauuccaca

SEQ ID NO: 553827 - RNA, 19 nt, Human
caaaggaccacgagaggca

SEQ ID NO: 553828 - RNA, 24 nt, Human
caacacggugaaacccugucucua

SEQ ID NO: 553829 - RNA, 20 nt, Human
caacaucagguuaaaauaga

SEQ ID NO: 553830 - RNA, 18 nt, Human
caaguuccucccuuucac

SEQ ID NO: 553831 - RNA, 21 nt, Human
caauuuccugguuuccacaag

SEQ ID NO: 553832 - RNA, 21 nt, Human
cacacagcaaaaugccuccaa

SEQ ID NO: 553833 - RNA, 23 nt, Human
cacacagggaaagaaacuuggcu

SEQ ID NO: 553834 - RNA, 24 nt, Human
cacaccuguaaucucagcacuuug

SEQ ID NO: 553835 - RNA, 27 nt, Human
cacagauuaggggaccucagguuuucc

SEQ ID NO: 553836 - RNA, 21 nt, Human
caccgucucaguggccugcgc

SEQ ID NO: 553837 - RNA, 23 nt, Human
caccuacuuuaaaaacccaaagc

SEQ ID NO: 553838 - RNA, 23 nt, Human
caccugaggucaggaguuugaga

SEQ ID NO: 553839 - RNA, 23 nt, Human
caccuguaaucucagcacuuugg

SEQ ID NO: 553840 - RNA, 24 nt, Human
caccuguaaucucagcacuuuggg

SEQ ID NO: 553841 - RNA, 18 nt, Human
cacgccuguaaucacagc

SEQ ID NO: 553842 - RNA, 24 nt, Human
cacgccuguaaucacagcuauuug

SEQ ID NO: 553843 - RNA, 23 nt, Human
cacggugagcaggauaaaaaccc

SEQ ID NO: 553844 - RNA, 23 nt, Human
cacuccagucugaacaauagagc

SEQ ID NO: 553845 - RNA, 24 nt, Human
cacuccagucugaacaauagagcg

SEQ ID NO: 553846 - RNA, 19 nt, Human
cacugcacuccagucugaa

SEQ ID NO: 553847 - RNA, 21 nt, Human
cacugcacuccagucugaaca

SEQ ID NO: 553848 - RNA, 22 nt, Human
cacugcacuccagucugaacaa

SEQ ID NO: 553849 - RNA, 24 nt, Human
cacugcacuccagucugaacaaua

SEQ ID NO: 553850 - RNA, 24 nt, Human
cagaaaaauacagacaugauuuca

SEQ ID NO: 553851 - RNA, 25 nt, Human
cagagccaauaagaaacaugaaacc

SEQ ID NO: 553852 - RNA, 18 nt, Human
cagauucaagcugcuucc

SEQ ID NO: 553853 - RNA, 18 nt, Human
cagcaagaggaacugagg

SEQ ID NO: 553854 - RNA, 24 nt, Human
cagcacuuugggaggcugaggcgg

SEQ ID NO: 553855 - RNA, 18 nt, Human
cagcagacagucugggac

SEQ ID NO: 553856 - RNA, 19 nt, Human
cagcccaugacaaccuucu

SEQ ID NO: 553857 - RNA, 24 nt, Human
cagcuauuugggaggcugaggcag

SEQ ID NO: 553858 - RNA, 29 nt, Human
caggagguggagguuguagugacaacggu

SEQ ID NO: 553859 - RNA, 24 nt, Human
caggagguggagguuguagugagc

SEQ ID NO: 553860 - RNA, 22 nt, Human
caguaggauucccagaguaaau

SEQ ID NO: 553861 - RNA, 21 nt, Human
caucccuugggaccuguccuu

SEQ ID NO: 553862 - RNA, 18 nt, Human
cauuucguucagguugga

SEQ ID NO: 553863 - RNA, 18 nt, Human
ccaaguccacaaugaucu

SEQ ID NO: 553864 - RNA, 25 nt, Human
ccaaugguuccucuugacuguuucu

SEQ ID NO: 553865 - RNA, 20 nt, Human
ccacgcagacuggcccggaa

SEQ ID NO: 553866 - RNA, 18 nt, Human
ccacugcacuccagucug

SEQ ID NO: 553867 - RNA, 20 nt, Human
ccacugcacuccagucugaa

SEQ ID NO: 553868 - RNA, 21 nt, Human
ccacugcacuccagucugaac

SEQ ID NO: 553869 - RNA, 22 nt, Human
ccaggaaggcucacccgaggcu

SEQ ID NO: 553870 - RNA, 19 nt, Human
ccaggccacugaaaacagg

SEQ ID NO: 553871 - RNA, 20 nt, Human
cccaaagccacuuccucuuc

SEQ ID NO: 553872 - RNA, 21 nt, Human
cccaaagccacuuccucuuca

SEQ ID NO: 553873 - RNA, 19 nt, Human
cccaaggaacagcccauga

SEQ ID NO: 553874 - RNA, 18 nt, Human
cccaggagguggagguug

SEQ ID NO: 553875 - RNA, 26 nt, Human
ccccaggccacugaaaacagggcguc

SEQ ID NO: 553876 - RNA, 25 nt, Human
cccccgagauccccgcgacggcgga

SEQ ID NO: 553877 - RNA, 18 nt, Human
ccccggcgaucccuuugc

SEQ ID NO: 553878 - RNA, 23 nt, Human
cccuugggaccuguccuuuccgu

SEQ ID NO: 553879 - RNA, 18 nt, Human
ccgcaggcuuaucuccac

SEQ ID NO: 553880 - RNA, 19 nt, Human
ccgcaggcuuaucuccacc

SEQ ID NO: 553881 - RNA, 21 nt, Human
ccggcgaucccuuugcccccc

SEQ ID NO: 553882 - RNA, 22 nt, Human
ccugaccaacacggugaaaccc

SEQ ID NO: 553883 - RNA, 24 nt, Human
ccugaccaacacggugaaacccug

SEQ ID NO: 553884 - RNA, 22 nt, Human
ccugaggucaggaguuugagac

SEQ ID NO: 553885 - RNA, 19 nt, Human
ccuggggcuccuggaaagg

SEQ ID NO: 553886 - RNA, 22 nt, Human
cgaaggggcgcuccgcgcggcg

SEQ ID NO: 553887 - RNA, 24 nt, Human
cgccuguaaucacagcuauuuggg

SEQ ID NO: 553888 - RNA, 24 nt, Human
cggaucaccugaggucaggaguuu

SEQ ID NO: 553889 - RNA, 27 nt, Human
cggaucaccugaggucaggaguuugag

SEQ ID NO: 553890 - RNA, 21 nt, Human
cggcuggggcagcagugagcu

SEQ ID NO: 553891 - RNA, 24 nt, Human
cgggcggaucaccugaggucagga

SEQ ID NO: 553892 - RNA, 23 nt, Human
cuaaggcguggcggggggggggg

SEQ ID NO: 553893 - RNA, 23 nt, Human
cuacuuuaaaaacccaaagccac

SEQ ID NO: 553894 - RNA, 22 nt, Human
cucacaccuguaaucucagcac

SEQ ID NO: 553895 - RNA, 24 nt, Human
cucacaccuguaaucucagcacuu

SEQ ID NO: 553896 - RNA, 22 nt, Human
cuccucaggggacccgugauga

SEQ ID NO: 553897 - RNA, 20 nt, Human
cuccuccggcucgcagcucc

SEQ ID NO: 553898 - RNA, 24 nt, Human
cucggcggggugcgguagcucaca

SEQ ID NO: 553899 - RNA, 21 nt, Human
cugaacaauagagcgagacuc

SEQ ID NO: 553900 - RNA, 22 nt, Human
cugaacauagcgugccaagucc

SEQ ID NO: 553901 - RNA, 18 nt, Human
cugaccaacacggugaaa

SEQ ID NO: 553902 - RNA, 24 nt, Human
cugaccaacacggugaaacccugu

SEQ ID NO: 553903 - RNA, 25 nt, Human
cugcaccaaaugagaggaggggcug

SEQ ID NO: 553904 - RNA, 20 nt, Human
cugccccccugccugccaga

SEQ ID NO: 553905 - RNA, 26 nt, Human
cugccccccugccugccagaugcucc

SEQ ID NO: 553906 - RNA, 21 nt, Human
cuuccaguguggaccucccca

SEQ ID NO: 553907 - RNA, 20 nt, Human
cuuucacaaaaggcacugug

SEQ ID NO: 553908 - RNA, 24 nt, Human
cuuugcaaucgcguucaaaucgcc

SEQ ID NO: 553909 - RNA, 19 nt, Human
gaaacccugucucuacuaa

SEQ ID NO: 553910 - RNA, 22 nt, Human
gaacaagcagacggaggcuccu

SEQ ID NO: 553911 - RNA, 21 nt, Human
gaacccaggagguggagguug

SEQ ID NO: 553912 - RNA, 22 nt, Human
gaaguuccugaagaucccuguc

SEQ ID NO: 553913 - RNA, 19 nt, Human
gacaagccgcaggcuuauc

SEQ ID NO: 553914 - RNA, 22 nt, Human
gacuuggugaggucagaaguuc

SEQ ID NO: 553915 - RNA, 18 nt, Human
gagagagagagagaccgc

SEQ ID NO: 553916 - RNA, 19 nt, Human
gagaggaggaaguguuuuc

SEQ ID NO: 553917 - RNA, 23 nt, Human
gagaucaugccacugcacuccag

SEQ ID NO: 553918 - RNA, 22 nt, Human
gaggacuucacagacucaggag

SEQ ID NO: 553919 - RNA, 23 nt, Human
gaggcgggcggaucaccugaggu

SEQ ID NO: 553920 - RNA, 22 nt, Human
gagguuguagugagccgagauc

SEQ ID NO: 553921 - RNA, 24 nt, Human
gaucaccugaggucaggaguuuga

SEQ ID NO: 553922 - RNA, 26 nt, Human
gaugauacauaggacaacugaccucc

SEQ ID NO: 553923 - RNA, 18 nt, Human
gcacgguggcgaagugac

SEQ ID NO: 553924 - RNA, 24 nt, Human
gcacuccagucugaacaauagagc

SEQ ID NO: 553925 - RNA, 22 nt, Human
gcaggagaaucgcuggaaccca

SEQ ID NO: 553926 - RNA, 19 nt, Human
gccaagcaaagaauaaagc

SEQ ID NO: 553927 - RNA, 21 nt, Human
gcccggguggacugagggccc

SEQ ID NO: 553928 - RNA, 20 nt, Human
gccgagaucaugccacugca

SEQ ID NO: 553929 - RNA, 22 nt, Human
gccgcagggagcaugcuggaga

SEQ ID NO: 553930 - RNA, 21 nt, Human
gccucagcgucucugcgcuug

SEQ ID NO: 553931 - RNA, 19 nt, Human
gccugggccucagcgucuc

SEQ ID NO: 553932 - RNA, 22 nt, Human
gcggaggggugggcuguccaca

SEQ ID NO: 553933 - RNA, 23 nt, Human
gcggcgggcgcggcuccucgcgg

SEQ ID NO: 553934 - RNA, 22 nt, Human
gcuggaauucgacuuccagugu

SEQ ID NO: 553935 - RNA, 19 nt, Human
ggagagagagagagaccgc

SEQ ID NO: 553936 - RNA, 18 nt, Human
ggaggcuccuccaggaag

SEQ ID NO: 553937 - RNA, 20 nt, Human
ggagguuguagugagccgag

SEQ ID NO: 553938 - RNA, 22 nt, Human
ggagguuguagugagccgagau

SEQ ID NO: 553939 - RNA, 23 nt, Human
ggagguuguagugagccgagauc

SEQ ID NO: 553940 - RNA, 24 nt, Human
ggagguuguagugagccgagauca

SEQ ID NO: 553941 - RNA, 22 nt, Human
ggaucaccugaggucaggaguu

SEQ ID NO: 553942 - RNA, 22 nt, Human
ggaucaccugaggucaggaguu

SEQ ID NO: 553943 - RNA, 22 nt, Human
ggcaucgagaccuuugcgcugc

SEQ ID NO: 553944 - RNA, 21 nt, Human
ggcggaucaccugaggucagg

SEQ ID NO: 553945 - RNA, 19 nt, Human
gggcagggcgcuggaggcc

SEQ ID NO: 553946 - RNA, 18 nt, Human
gggcccaggaaggagcag

SEQ ID NO: 553947 - RNA, 23 nt, Human
gggccucagcgucucugcgcuug

SEQ ID NO: 553948 - RNA, 24 nt, Human
gggcgugguggugcacgccuguaa

SEQ ID NO: 553949 - RNA, 20 nt, Human
gggcugggcgggagggcagg

SEQ ID NO: 553950 - RNA, 25 nt, Human
gggcugggcgggagggcagggccgc

SEQ ID NO: 553951 - RNA, 19 nt, Human
gggggugguggccacagau

SEQ ID NO: 553952 - RNA, 22 nt, Human
ggggugggcgcuggcgagacuu

SEQ ID NO: 553953 - RNA, 24 nt, Human
gggugcgguagcucacaccuguaa

SEQ ID NO: 553954 - RNA, 24 nt, Human
gguagcucacaccuguaaucucag

SEQ ID NO: 553955 - RNA, 19 nt, Human
ggucaggaguuugagacca

SEQ ID NO: 553956 - RNA, 24 nt, Human
gguggugcacgccuguaaucacag

SEQ ID NO: 553957 - RNA, 18 nt, Human
ggugugccugugggugug

SEQ ID NO: 553958 - RNA, 21 nt, Human
gguguguggucaaccuugguu

SEQ ID NO: 553959 - RNA, 21 nt, Human
gucucaaaaaaaaaaaaaaaa

SEQ ID NO: 553960 - RNA, 19 nt, Human
gugagcaggauaaaaaccc

SEQ ID NO: 553961 - RNA, 23 nt, Human
gugcagaggggagggccucgcuc

SEQ ID NO: 553962 - RNA, 24 nt, Human
guuguagugagccgagaucaugcc

SEQ ID NO: 553963 - RNA, 18 nt, Human
uaaaaaacaggcggagga

SEQ ID NO: 553964 - RNA, 21 nt, Human
uaaaaaacaggcggaggagug

SEQ ID NO: 553965 - RNA, 20 nt, Human
uaaaaauacaaacauuagcc

SEQ ID NO: 553966 - RNA, 22 nt, Human
uacaagcauauccuauacuggg

SEQ ID NO: 553967 - RNA, 20 nt, Human
uacuaaaaauacaaacauua

SEQ ID NO: 553968 - RNA, 18 nt, Human
uagaauccaaaaaggacc

SEQ ID NO: 553969 - RNA, 24 nt, Human
uagagcgagacucccgucucaaaa

SEQ ID NO: 553970 - RNA, 18 nt, Human
uagcacgguggcgaagug

SEQ ID NO: 553971 - RNA, 22 nt, Human
uagcucacaccuguaaucucag

SEQ ID NO: 553972 - RNA, 24 nt, Human
uagcucacaccuguaaucucagca

SEQ ID NO: 553973 - RNA, 23 nt, Human
uaggggaccucagguuuuccuca

SEQ ID NO: 553974 - RNA, 19 nt, Human
ucaccugaggucaggaguu

SEQ ID NO: 553975 - RNA, 23 nt, Human
ucaugccacugcacuccagucug

SEQ ID NO: 553976 - RNA, 22 nt, Human
uccacggugagcaggauaaaaa

SEQ ID NO: 553977 - RNA, 23 nt, Human
uccagucugaacaauagagcgag

SEQ ID NO: 553978 - RNA, 24 nt, Human
uccagucugaacaauagagcgaga

SEQ ID NO: 553979 - RNA, 23 nt, Human
ucccagagcucggugccccagcu

SEQ ID NO: 553980 - RNA, 22 nt, Human
uccccgcgacggcggaaagccc

SEQ ID NO: 553981 - RNA, 24 nt, Human
ucccgucucaaaaaaaaaaaaaaa

SEQ ID NO: 553982 - RNA, 21 nt, Human
uccucaggggacccgugauga

SEQ ID NO: 553983 - RNA, 24 nt, Human
ucgcuggaacccaggagguggagg

SEQ ID NO: 553984 - RNA, 19 nt, Human
ucggccucacacagcaaaa

SEQ ID NO: 553985 - RNA, 22 nt, Human
ucuaaaagcaaacucaacgaau

SEQ ID NO: 553986 - RNA, 22 nt, Human
ucuacagcagacagucugggac

SEQ ID NO: 553987 - RNA, 22 nt, Human
ucuagcacgguggcgaagugac

SEQ ID NO: 553988 - RNA, 18 nt, Human
ucucgaugugcugcugug

SEQ ID NO: 553989 - RNA, 23 nt, Human
ucucuacuaaaaauacaaacauu

SEQ ID NO: 553990 - RNA, 22 nt, Human
ucucuguccuuucuuucacaaa

SEQ ID NO: 553991 - RNA, 25 nt, Human
ucuucuuccuccuucgaguucuuuu

SEQ ID NO: 553992 - RNA, 20 nt, Human
ugaaagugcuaaccucggcg

SEQ ID NO: 553993 - RNA, 21 nt, Human
ugaagagcacgugauaaaaua

SEQ ID NO: 553994 - RNA, 24 nt, Human
ugaccaacacggugaaacccuguc

SEQ ID NO: 553995 - RNA, 21 nt, Human
ugacccgagccaugggggugg

SEQ ID NO: 553996 - RNA, 18 nt, Human
ugacuguuucugcaccaa

SEQ ID NO: 553997 - RNA, 23 nt, Human
ugagaccagccugaccaacacgg

SEQ ID NO: 553998 - RNA, 21 nt, Human
ugagaggaggggcugcucugc

SEQ ID NO: 553999 - RNA, 21 nt, Human
ugagcaggauaaaaaccccca

SEQ ID NO: 554000 - RNA, 22 nt, Human
ugagccgagaucaugccacugc

SEQ ID NO: 554001 - RNA, 18 nt, Human
ugagcuggugcagagggg

SEQ ID NO: 554002 - RNA, 20 nt, Human
ugagcuggugcagaggggag

SEQ ID NO: 554003 - RNA, 23 nt, Human
ugagcuggugcagaggggagggc

SEQ ID NO: 554004 - RNA, 22 nt, Human
ugaggaugcuugaggggaccac

SEQ ID NO: 554005 - RNA, 19 nt, Human
ugaggcaggagaaucgcug

SEQ ID NO: 554006 - RNA, 24 nt, Human
ugaggcaggagaaucgcuggaacc

SEQ ID NO: 554007 - RNA, 25 nt, Human
ugaggcaggagaaucgcuggaaccc

SEQ ID NO: 554008 - RNA, 20 nt, Human
ugaggcgggcggaucaccug

SEQ ID NO: 554009 - RNA, 24 nt, Human
ugaggcgggcggaucaccugaggu

SEQ ID NO: 554010 - RNA, 26 nt, Human
ugaggcgggcggaucaccugagguca

SEQ ID NO: 554011 - RNA, 18 nt, Human
ugagggcauagugaaagg

SEQ ID NO: 554012 - RNA, 18 nt, Human
ugaggucaggaguuugag

SEQ ID NO: 554013 - RNA, 21 nt, Human
ugauuuccucuccuguuucag

SEQ ID NO: 554014 - RNA, 18 nt, Human
ugcaagccuagaauccaa

SEQ ID NO: 554015 - RNA, 19 nt, Human
ugccaggacgagcccgggu

SEQ ID NO: 554016 - RNA, 23 nt, Human
ugccauguucucggagauaacuu

SEQ ID NO: 554017 - RNA, 23 nt, Human
ugccgcaacccugagcgguuugc

SEQ ID NO: 554018 - RNA, 18 nt, Human
uggcccggaagcaacacc

SEQ ID NO: 554019 - RNA, 22 nt, Human
uggcuucuauaggacuuccuuc

SEQ ID NO: 554020 - RNA, 19 nt, Human
ugggaggcugaggcaggag

SEQ ID NO: 554021 - RNA, 23 nt, Human
ugggaggcugaggcaggagaauc

SEQ ID NO: 554022 - RNA, 19 nt, Human
ugggaggcugaggcgggcg

SEQ ID NO: 554023 - RNA, 24 nt, Human
ugggaggcugaggcgggcggauca

SEQ ID NO: 554024 - RNA, 19 nt, Human
uggggaggacaggcguggg

SEQ ID NO: 554025 - RNA, 20 nt, Human
uggggagggggagcgaugag

SEQ ID NO: 554026 - RNA, 20 nt, Human
uggggcugcggagggguggg

SEQ ID NO: 554027 - RNA, 18 nt, Human
uggguguguguguaccug

SEQ ID NO: 554028 - RNA, 19 nt, Human
uggugcacgccuguaauca

SEQ ID NO: 554029 - RNA, 21 nt, Human
uggugggugugccugugggug

SEQ ID NO: 554030 - RNA, 22 nt, Human
uguaaucacagcuauuugggag

SEQ ID NO: 554031 - RNA, 21 nt, Human
ugucccuuuggcuucuauagg

SEQ ID NO: 554032 - RNA, 21 nt, Human
ugugaacugcuccagaaaaau

SEQ ID NO: 554033 - RNA, 19 nt, Human
uguguaugcgcacgcgugu

SEQ ID NO: 554034 - RNA, 18 nt, Human
uguguguguaccugcccc

SEQ ID NO: 554035 - RNA, 21 nt, Human
uguguguguuuuucuaaguug

SEQ ID NO: 554036 - RNA, 23 nt, Human
uguguguguuuuucuaaguuguc

SEQ ID NO: 554037 - RNA, 22 nt, Human
uguuucugcaccaaaugagagg

SEQ ID NO: 554038 - RNA, 19 nt, Human
uuaaaauuagucaucuuac

SEQ ID NO: 554039 - RNA, 20 nt, Human
uuagccgggcgugguggugc

SEQ ID NO: 554040 - RNA, 22 nt, Human
uuagccgggcgugguggugcac

SEQ ID NO: 554041 - RNA, 24 nt, Human
uuagccgggcgugguggugcacgc

SEQ ID NO: 554042 - RNA, 21 nt, Human
uuagugcaacacacauacgaa

SEQ ID NO: 554043 - RNA, 21 nt, Human
uucaagcugcuuccagcaagu

SEQ ID NO: 554044 - RNA, 26 nt, Human
uuccagcaagucucgaugugcugcug

SEQ ID NO: 554045 - RNA, 19 nt, Human
uucgaguucuuuuuagguu

SEQ ID NO: 554046 - RNA, 26 nt, Human
uucuucuuccuccuucgaguucuuuu

SEQ ID NO: 554047 - RNA, 24 nt, Human
uugggaggcugaggcaggagaauc

SEQ ID NO: 554048 - RNA, 25 nt, Human
uugggaggcugaggcgggcggauca

SEQ ID NO: 554049 - RNA, 24 nt, Human
uuggugaggucagaaguuccugaa

SEQ ID NO: 554050 - RNA, 18 nt, Human
uuguagugagccgagauc

SEQ ID NO: 554051 - RNA, 20 nt, Human
uuguagugagccgagaucau

SEQ ID NO: 554052 - RNA, 21 nt, Human
uuguagugagccgagaucaug

SEQ ID NO: 554053 - RNA, 22 nt, Human
uuguauucuucuuccuccuucg

SEQ ID NO: 554054 - RNA, 28 nt, Human
uugucaaacugaucccagagcucggugc

SEQ ID NO: 554055 - RNA, 27 nt, Human
uugucuuucgucugucaagucaguccu

SEQ ID NO: 554056 - RNA, 23 nt, Human
uuuuccucaaaaacccacacagg

SEQ ID NO: 554057 - RNA, 21 nt, Human
aagaagaggcugcuaggggca

SEQ ID NO: 554058 - RNA, 22 nt, Human
aagccagagggggccgggccug

SEQ ID NO: 554059 - RNA, 18 nt, Human
acaugcugcaccucccac

SEQ ID NO: 554060 - RNA, 18 nt, Human
acccugggucuguccauc

SEQ ID NO: 554061 - RNA, 21 nt, Human
accuccccuucccaagcccag

SEQ ID NO: 554062 - RNA, 24 nt, Human
acuuucugaggggcccaggggaac

SEQ ID NO: 554063 - RNA, 24 nt, Human
agagacagauccaggcuggccucc

SEQ ID NO: 554064 - RNA, 24 nt, Human
agcaggacaagaggcaaguuccaa

SEQ ID NO: 554065 - RNA, 24 nt, Human
agccucugggccaaagccaccucu

SEQ ID NO: 554066 - RNA, 23 nt, Human
agcucgacuuucugaggggccca

SEQ ID NO: 554067 - RNA, 18 nt, Human
aggggcaaggguuagagg

SEQ ID NO: 554068 - RNA, 20 nt, Human
aggggcccaggggaacaugc

SEQ ID NO: 554069 - RNA, 20 nt, Human
cacccgaccuggaccccacc

SEQ ID NO: 554070 - RNA, 19 nt, Human
caccuccccuucccaagcc

SEQ ID NO: 554071 - RNA, 21 nt, Human
caccuccccuucccaagccca

SEQ ID NO: 554072 - RNA, 22 nt, Human
caccuccccuucccaagcccag

SEQ ID NO: 554073 - RNA, 21 nt, Human
caccucccugcaccugcacca

SEQ ID NO: 554074 - RNA, 18 nt, Human
caccugguacccaucuag

SEQ ID NO: 554075 - RNA, 24 nt, Human
cagagcacggcccaugagcccacc

SEQ ID NO: 554076 - RNA, 22 nt, Human
cagagcaggucccaauccugcu

SEQ ID NO: 554077 - RNA, 18 nt, Human
cagcccuuuucugacagc

SEQ ID NO: 554078 - RNA, 21 nt, Human
caggucccaauccugcucccc

SEQ ID NO: 554079 - RNA, 20 nt, Human
cauccagggcucaugugucc

SEQ ID NO: 554080 - RNA, 24 nt, Human
caugcaguagggcgaagucaggag

SEQ ID NO: 554081 - RNA, 22 nt, Human
ccaagcccagcccuuuucugac

SEQ ID NO: 554082 - RNA, 21 nt, Human
ccaauccugcuccccaucuac

SEQ ID NO: 554083 - RNA, 20 nt, Human
ccaguugucuugccuguccc

SEQ ID NO: 554084 - RNA, 23 nt, Human
ccaguugucuugccugucccugc

SEQ ID NO: 554085 - RNA, 24 nt, Human
cccaccccacccugggucugucca

SEQ ID NO: 554086 - RNA, 21 nt, Human
cccaggggaacaugcugcacc

SEQ ID NO: 554087 - RNA, 23 nt, Human
cccaugagcccacccuccacuuc

SEQ ID NO: 554088 - RNA, 18 nt, Human
ccccaccccacccugggu

SEQ ID NO: 554089 - RNA, 21 nt, Human
cccggccugagccucugggcc

SEQ ID NO: 554090 - RNA, 20 nt, Human
ccgaccuggaccccaccccc

SEQ ID NO: 554091 - RNA, 22 nt, Human
ccuccaccuccccuucccaagc

SEQ ID NO: 554092 - RNA, 23 nt, Human
ccuccaccuccccuucccaagcc

SEQ ID NO: 554093 - RNA, 18 nt, Human
ccucugggaaccuaaccc

SEQ ID NO: 554094 - RNA, 22 nt, Human
ccucugggaaccuaaccccacc

SEQ ID NO: 554095 - RNA, 25 nt, Human
ccucuucugagcaggcaggcagagc

SEQ ID NO: 554096 - RNA, 18 nt, Human
cuaggggugggguggggg

SEQ ID NO: 554097 - RNA, 22 nt, Human
cuagggguggggugggggcuug

SEQ ID NO: 554098 - RNA, 23 nt, Human
cuagggguggggugggggcuugg

SEQ ID NO: 554099 - RNA, 22 nt, Human
cuccaccuccccuucccaagcc

SEQ ID NO: 554100 - RNA, 22 nt, Human
cuccccuucccaagcccagccc

SEQ ID NO: 554101 - RNA, 18 nt, Human
cucccugcaccugcacca

SEQ ID NO: 554102 - RNA, 23 nt, Human
cucugggccaaagccaccucuuc

SEQ ID NO: 554103 - RNA, 23 nt, Human
cugcccacacugagaggcuccac

SEQ ID NO: 554104 - RNA, 19 nt, Human
cuggccuccaagcucgacu

SEQ ID NO: 554105 - RNA, 22 nt, Human
cuggccuccaccuccccuuccc

SEQ ID NO: 554106 - RNA, 18 nt, Human
cugggccaaagccaccuc

SEQ ID NO: 554107 - RNA, 18 nt, Human
cugucccugcuccgaggg

SEQ ID NO: 554108 - RNA, 19 nt, Human
gaacaugcugcaccuccca

SEQ ID NO: 554109 - RNA, 21 nt, Human
gacaagaggcaaguuccaagg

SEQ ID NO: 554110 - RNA, 19 nt, Human
gagcagcagacaggggcag

SEQ ID NO: 554111 - RNA, 23 nt, Human
gagcagcagacaggggcagagca

SEQ ID NO: 554112 - RNA, 20 nt, Human
gccuggauuugggaggugga

SEQ ID NO: 554113 - RNA, 23 nt, Human
ggacaagaggcaaguuccaaggg

SEQ ID NO: 554114 - RNA, 21 nt, Human
gggagcagcagacaggggcag

SEQ ID NO: 554115 - RNA, 22 nt, Human
ggucuugggaauggcaguucua

SEQ ID NO: 554116 - RNA, 20 nt, Human
uacccugggacauccuguac

SEQ ID NO: 554117 - RNA, 22 nt, Human
uagcuucuggggcuccacugac

SEQ ID NO: 554118 - RNA, 26 nt, Human
uagggcgaagucaggagaacacugcu

SEQ ID NO: 554119 - RNA, 21 nt, Human
ucaaagaacacagguagaaug

SEQ ID NO: 554120 - RNA, 19 nt, Human
uccaagggugguuggcugg

SEQ ID NO: 554121 - RNA, 22 nt, Human
uccacacccgaccuggacccca

SEQ ID NO: 554122 - RNA, 21 nt, Human
uccagcaggacaagaggcaag

SEQ ID NO: 554123 - RNA, 22 nt, Human
uccagggcucauguguccagcu

SEQ ID NO: 554124 - RNA, 18 nt, Human
ucccaagcccagcccuuu

SEQ ID NO: 554125 - RNA, 23 nt, Human
ucccagauuggucagaguuacau

SEQ ID NO: 554126 - RNA, 20 nt, Human
uccucugggaaccuaacccc

SEQ ID NO: 554127 - RNA, 23 nt, Human
uccuguagcugcgcucggccgcc

SEQ ID NO: 554128 - RNA, 24 nt, Human
ugagcccacccuccacuucccaga

SEQ ID NO: 554129 - RNA, 20 nt, Human
ugagccucugggccaaagcc

SEQ ID NO: 554130 - RNA, 21 nt, Human
ugcaguagggcgaagucagga

SEQ ID NO: 554131 - RNA, 21 nt, Human
uggcccgaccccagcaugcga

SEQ ID NO: 554132 - RNA, 22 nt, Human
uggccuccaagcucgacuuucu

SEQ ID NO: 554133 - RNA, 20 nt, Human
uggcuucuggacacccuccu

SEQ ID NO: 554134 - RNA, 25 nt, Human
ugggacauccuguacaggauucccu

SEQ ID NO: 554135 - RNA, 24 nt, Human
ugggagcagcagacaggggcagag

SEQ ID NO: 554136 - RNA, 21 nt, Human
uguacaggauucccucagucc

SEQ ID NO: 554137 - RNA, 20 nt, Human
uugccaguugucuugccugu

SEQ ID NO: 554138 - RNA, 21 nt, Human
uuuuuuuuuuuuuuagacugg

SEQ ID NO: 554139 - RNA, 24 nt, Human
uuuuuuuuuuuuuuuuagacuggg

SEQ ID NO: 554140 - RNA, 20 nt, Human
aaucaagcccaaggucugga

SEQ ID NO: 554141 - RNA, 27 nt, Human
acuuuuggcuguuucgcugcuccugac

SEQ ID NO: 554142 - RNA, 18 nt, Human
agaucaggaugaguggac

SEQ ID NO: 554143 - RNA, 19 nt, Human
aggaugaguggacuuaaaa

SEQ ID NO: 554144 - RNA, 21 nt, Human
caaacucccccagucuagaag

SEQ ID NO: 554145 - RNA, 22 nt, Human
caauuuaccagcugagagagua

SEQ ID NO: 554146 - RNA, 21 nt, Human
cagcgcuacugucaaccuuaa

SEQ ID NO: 554147 - RNA, 19 nt, Human
caggcagcuucugcugacu

SEQ ID NO: 554148 - RNA, 24 nt, Human
ccuacauacagaagaugcacaggc

SEQ ID NO: 554149 - RNA, 27 nt, Human
ccuccuacauacagaagaugcacaggc

SEQ ID NO: 554150 - RNA, 20 nt, Human
cuuggcuguugaaaucaagc

SEQ ID NO: 554151 - RNA, 23 nt, Human
gaugaaguagcugacugguucag

SEQ ID NO: 554152 - RNA, 19 nt, Human
ggacuuaaaagaugaagua

SEQ ID NO: 554153 - RNA, 22 nt, Human
guugagagaagaguagaaccca

SEQ ID NO: 554154 - RNA, 20 nt, Human
uaaaggaaguuacugaaaaa

SEQ ID NO: 554155 - RNA, 21 nt, Human
uagaacccaacuuuuggcugu

SEQ ID NO: 554156 - RNA, 19 nt, Human
ucaaccuuaaagcugacau

SEQ ID NO: 554157 - RNA, 19 nt, Human
ucacaggcagcuucugcug

SEQ ID NO: 554158 - RNA, 20 nt, Human
ucagaaauaugaaaaacuuc

SEQ ID NO: 554159 - RNA, 21 nt, Human
uccaccuccuacauacagaag

SEQ ID NO: 554160 - RNA, 21 nt, Human
uggauggaacaauuuaccagc

SEQ ID NO: 554161 - RNA, 26 nt, Human
uguuucgcugcuccugacaacuggac

SEQ ID NO: 554162 - RNA, 21 nt, Human
uucauuccaccuccuacauac

SEQ ID NO: 554163 - RNA, 21 nt, Human
uuuguaauacuacauggugag

SEQ ID NO: 554164 - RNA, 24 nt, Human
agggugggcaagcuggcugaggug

SEQ ID NO: 554165 - RNA, 23 nt, Human
caagcuggcugaggugucccagg

SEQ ID NO: 554166 - RNA, 25 nt, Human
ggagggugggcaagcuggcugaggu

SEQ ID NO: 554167 - RNA, 19 nt, Human
gggcaagcuggcugaggug

SEQ ID NO: 554168 - RNA, 27 nt, Human
gggcaagcuggcugaggugucccaggu

SEQ ID NO: 554169 - RNA, 18 nt, Human
ucugaaauugggcaaagg

SEQ ID NO: 554170 - RNA, 20 nt, Human
uggagggugggcaagcuggc

SEQ ID NO: 554171 - RNA, 20 nt, Human
uggagggugggcaagcuggc

SEQ ID NO: 554172 - RNA, 18 nt, Human
ugggcaagcuggcugagg

SEQ ID NO: 554173 - RNA, 19 nt, Human
ugggcaagcuggcugaggu

SEQ ID NO: 554174 - RNA, 24 nt, Human
uuuuuuuuuuuuuuuuuuuuuccu

SEQ ID NO: 554175 - RNA, 20 nt, Human
aaaagcaacccgggucaagg

SEQ ID NO: 554176 - RNA, 23 nt, Human
aagcaacccgggucaaggccagg

SEQ ID NO: 554177 - RNA, 26 nt, Human
aagggcauucugggcagcacgguacc

SEQ ID NO: 554178 - RNA, 20 nt, Human
acagaggcaggaagcucaga

SEQ ID NO: 554179 - RNA, 22 nt, Human
acccagggcuuggccagagagc

SEQ ID NO: 554180 - RNA, 20 nt, Human
agcaggagccuguggcggca

SEQ ID NO: 554181 - RNA, 21 nt, Human
agcauuuccaggggccugugg

SEQ ID NO: 554182 - RNA, 18 nt, Human
agccuguggcggcaacac

SEQ ID NO: 554183 - RNA, 19 nt, Human
aggagggcaggcaagaggc

SEQ ID NO: 554184 - RNA, 19 nt, Human
aggcagaggcucugcuccu

SEQ ID NO: 554185 - RNA, 20 nt, Human
aggcagaggcucugcuccuc

SEQ ID NO: 554186 - RNA, 21 nt, Human
agggaggccucuuucugaucu

SEQ ID NO: 554187 - RNA, 19 nt, Human
auguucccucugggcugcc

SEQ ID NO: 554188 - RNA, 23 nt, Human
caaaaagcaacccgggucaaggc

SEQ ID NO: 554189 - RNA, 22 nt, Human
caaggccaggguuggagacugg

SEQ ID NO: 554190 - RNA, 22 nt, Human
cacccccaguccuagagggucu

SEQ ID NO: 554191 - RNA, 19 nt, Human
caggccccggcucacggcc

SEQ ID NO: 554192 - RNA, 21 nt, Human
cagggcugguuacugaccugg

SEQ ID NO: 554193 - RNA, 23 nt, Human
caggggccuguggcagcgacgug

SEQ ID NO: 554194 - RNA, 18 nt, Human
ccacugagguccagggag

SEQ ID NO: 554195 - RNA, 18 nt, Human
ccagcaccagacccugcc

SEQ ID NO: 554196 - RNA, 19 nt, Human
ccagggagguaaggccugg

SEQ ID NO: 554197 - RNA, 20 nt, Human
cccacccccaguccuagagg

SEQ ID NO: 554198 - RNA, 23 nt, Human
cccacccccaguccuagaggguc

SEQ ID NO: 554199 - RNA, 22 nt, Human
cccccaguccuagagggucugc

SEQ ID NO: 554200 - RNA, 20 nt, Human
cccgcugggggccuggccuc

SEQ ID NO: 554201 - RNA, 24 nt, Human
ccucccagcaccagacccugcccg

SEQ ID NO: 554202 - RNA, 25 nt, Human
ccucugggcugcccuggauuggccc

SEQ ID NO: 554203 - RNA, 27 nt, Human
ccucugggcugcccuggauuggccgac

SEQ ID NO: 554204 - RNA, 21 nt, Human
cgguaccaagcccaacucacg

SEQ ID NO: 554205 - RNA, 22 nt, Human
cguguagcuggaaagaggcuaa

SEQ ID NO: 554206 - RNA, 24 nt, Human
cucacggccaagagcgccccaucu

SEQ ID NO: 554207 - RNA, 18 nt, Human
cugaagcucagugcacac

SEQ ID NO: 554208 - RNA, 24 nt, Human
cugcccuggauuggccccaccccc

SEQ ID NO: 554209 - RNA, 18 nt, Human
gacuccgccaucgcaucc

SEQ ID NO: 554210 - RNA, 19 nt, Human
gacuccgccaucgcauccc

SEQ ID NO: 554211 - RNA, 20 nt, Human
gcaaaaagcaacccggguca

SEQ ID NO: 554212 - RNA, 19 nt, Human
gcacgguaccaagcccaac

SEQ ID NO: 554213 - RNA, 19 nt, Human
ggccagagagcaggagccu

SEQ ID NO: 554214 - RNA, 20 nt, Human
gggccuggccucccacccag

SEQ ID NO: 554215 - RNA, 22 nt, Human
gggucaaggccaggguuggaga

SEQ ID NO: 554216 - RNA, 21 nt, Human
gguaccaagcccaacucacga

SEQ ID NO: 554217 - RNA, 19 nt, Human
gugcugggagagucccaca

SEQ ID NO: 554218 - RNA, 18 nt, Human
uacugccaggcggugugg

SEQ ID NO: 554219 - RNA, 21 nt, Human
uagcuggaaagaggcuacugc

SEQ ID NO: 554220 - RNA, 18 nt, Human
uaucuggaauguuuaauc

SEQ ID NO: 554221 - RNA, 19 nt, Human
uccccaggcucaggcgccg

SEQ ID NO: 554222 - RNA, 21 nt, Human
ucugagcagccacugaggucc

SEQ ID NO: 554223 - RNA, 20 nt, Human
ugagaggagggcaggcaaga

SEQ ID NO: 554224 - RNA, 26 nt, Human
ugccaggcgguguggcaggauguucc

SEQ ID NO: 554225 - RNA, 23 nt, Human
uggaaagaggcuacugccaggcg

SEQ ID NO: 554226 - RNA, 22 nt, Human
ugggcagcacgguaccaagccc

SEQ ID NO: 554227 - RNA, 21 nt, Human
aaccuaugccaacaaaacuuc

SEQ ID NO: 554228 - RNA, 19 nt, Human
acccgacccgccccgcccc

SEQ ID NO: 554229 - RNA, 26 nt, Human
acccgccccgccccgccucuggcccc

SEQ ID NO: 554230 - RNA, 20 nt, Human
accgcgccucuuaaaggccc

SEQ ID NO: 554231 - RNA, 21 nt, Human
acggaucuacauucuagaagc

SEQ ID NO: 554232 - RNA, 21 nt, Human
acuuuguggcaagcacugugc

SEQ ID NO: 554233 - RNA, 20 nt, Human
agaggaggagccggagcgcu

SEQ ID NO: 554234 - RNA, 20 nt, Human
agcggaccgaggaggcuggg

SEQ ID NO: 554235 - RNA, 21 nt, Human
aggagccggagcgcugcgggc

SEQ ID NO: 554236 - RNA, 25 nt, Human
aggcccccgacccgacccgccccgc

SEQ ID NO: 554237 - RNA, 23 nt, Human
aggccuaucuacccucgaccuuu

SEQ ID NO: 554238 - RNA, 23 nt, Human
aggcugggaaaggucaggagucg

SEQ ID NO: 554239 - RNA, 28 nt, Human
agucguuuuuuuuccaacuggggagggg

SEQ ID NO: 554240 - RNA, 21 nt, Human
ccaacaaaacuucucucuccc

SEQ ID NO: 554241 - RNA, 24 nt, Human
ccccgccucuggccccgcgcccgg

SEQ ID NO: 554242 - RNA, 19 nt, Human
ccccgcgcccggccgcccc

SEQ ID NO: 554243 - RNA, 19 nt, Human
cccgacccgccccgccccg

SEQ ID NO: 554244 - RNA, 18 nt, Human
cccgccccgccccgccuc

SEQ ID NO: 554245 - RNA, 23 nt, Human
ccgacccgccccgccccgccucu

SEQ ID NO: 554246 - RNA, 19 nt, Human
ccgccccgccucuggcccc

SEQ ID NO: 554247 - RNA, 20 nt, Human
ccgcgucugugucggucccg

SEQ ID NO: 554248 - RNA, 18 nt, Human
ccggcgaccgcgccucuu

SEQ ID NO: 554249 - RNA, 25 nt, Human
ccuaugccaacaaaacuucucucuc

SEQ ID NO: 554250 - RNA, 18 nt, Human
ccuuugccccuccaggca

SEQ ID NO: 554251 - RNA, 23 nt, Human
cgccccgcagucccagcagucug

SEQ ID NO: 554252 - RNA, 19 nt, Human
cucacggaucuacauucua

SEQ ID NO: 554253 - RNA, 23 nt, Human
cucgaccuuugccccuccaggca

SEQ ID NO: 554254 - RNA, 21 nt, Human
cucucucccugcucaggggcu

SEQ ID NO: 554255 - RNA, 19 nt, Human
cugggggagaguggaggca

SEQ ID NO: 554256 - RNA, 21 nt, Human
gaggauguguggcuuggggaa

SEQ ID NO: 554257 - RNA, 19 nt, Human
gcagcugggggagagugga

SEQ ID NO: 554258 - RNA, 22 nt, Human
gcucaggggcugggaucggagc

SEQ ID NO: 554259 - RNA, 20 nt, Human
ggaggaggauguguggcuug

SEQ ID NO: 554260 - RNA, 23 nt, Human
gggacugcugggaggaggcggcu

SEQ ID NO: 554261 - RNA, 18 nt, Human
ucgcuccugggggacugc

SEQ ID NO: 554262 - RNA, 19 nt, Human
ucuacauucuagaagccgg

SEQ ID NO: 554263 - RNA, 20 nt, Human
ucuacauucuagaagccggc

SEQ ID NO: 554264 - RNA, 19 nt, Human
ucucccugcucaggggcug

SEQ ID NO: 554265 - RNA, 18 nt, Human
ugccccuccaggcagcug

SEQ ID NO: 554266 - RNA, 19 nt, Human
ugcucgaggcccggggcug

SEQ ID NO: 554267 - RNA, 20 nt, Human
ugcugggaggaggcggcuac

SEQ ID NO: 554268 - RNA, 18 nt, Human
uggcaagcacugugcuag

SEQ ID NO: 554269 - RNA, 18 nt, Human
uggcaagcacugugcuag

SEQ ID NO: 554270 - RNA, 19 nt, Human
uggcaagcacugugcuagg

SEQ ID NO: 554271 - RNA, 20 nt, Human
ugggaaaggucaggagucgu

SEQ ID NO: 554272 - RNA, 19 nt, Human
ugggaggaggcggcuacgg

SEQ ID NO: 554273 - RNA, 23 nt, Human
uguggcaagcacugugcuaggug

SEQ ID NO: 554274 - RNA, 20 nt, Human
uuuuuuccaacuggggaggg

SEQ ID NO: 554275 - RNA, 19 nt, Human
uuuuuuuuuuuuuuuuugg

SEQ ID NO: 554276 - RNA, 26 nt, Human
aaaaaggaaaucaaucaaaccagaaa

SEQ ID NO: 554277 - RNA, 22 nt, Human
aaacaagcagcaggcauucaac

SEQ ID NO: 554278 - RNA, 18 nt, Human
aaagacauucucucucuu

SEQ ID NO: 554279 - RNA, 19 nt, Human
aagacagaaugucacaaac

SEQ ID NO: 554280 - RNA, 26 nt, Human
aagagaaaagaaguugcuauauccaa

SEQ ID NO: 554281 - RNA, 20 nt, Human
aaucaaaccagaaaaccaaa

SEQ ID NO: 554282 - RNA, 21 nt, Human
acacagugccuuucagauuaa

SEQ ID NO: 554283 - RNA, 20 nt, Human
acagggcuuuuuaaaaugga

SEQ ID NO: 554284 - RNA, 24 nt, Human
acauugucuuugcagcuggggaag

SEQ ID NO: 554285 - RNA, 20 nt, Human
acucuaaggaauaacaagag

SEQ ID NO: 554286 - RNA, 18 nt, Human
acugcaugcagauggaca

SEQ ID NO: 554287 - RNA, 23 nt, Human
acuuuuuuucccuucaaaaccuu

SEQ ID NO: 554288 - RNA, 24 nt, Human
agacaggugcagagacaggccccu

SEQ ID NO: 554289 - RNA, 22 nt, Human
agagacaggccccuaacgcccc

SEQ ID NO: 554290 - RNA, 21 nt, Human
agccagugccguccgaacaca

SEQ ID NO: 554291 - RNA, 19 nt, Human
aggcaaccagcacuacugg

SEQ ID NO: 554292 - RNA, 26 nt, Human
aggcuucguccugcugccgucaggac

SEQ ID NO: 554293 - RNA, 18 nt, Human
aggcuuucccagaagacg

SEQ ID NO: 554294 - RNA, 23 nt, Human
aggugauacaggcuuccuggagc

SEQ ID NO: 554295 - RNA, 20 nt, Human
caaaguaacuagguccuaac

SEQ ID NO: 554296 - RNA, 24 nt, Human
caacaauugcaacucucagcaugc

SEQ ID NO: 554297 - RNA, 23 nt, Human
caacacgcacaucuccuuucaca

SEQ ID NO: 554298 - RNA, 24 nt, Human
caacuaacuucaggguaaaaagac

SEQ ID NO: 554299 - RNA, 21 nt, Human
caagcauacaagccaugccac

SEQ ID NO: 554300 - RNA, 19 nt, Human
cacaacuuuaccucugaau

SEQ ID NO: 554301 - RNA, 18 nt, Human
cacacaguccucacucgg

SEQ ID NO: 554302 - RNA, 20 nt, Human
cacagagaaaucagaaggaa

SEQ ID NO: 554303 - RNA, 19 nt, Human
caccacaggacaagcauac

SEQ ID NO: 554304 - RNA, 27 nt, Human
cacggucaggcuuucccagaagacgcc

SEQ ID NO: 554305 - RNA, 21 nt, Human
cacuacaaaaagaacccauca

SEQ ID NO: 554306 - RNA, 19 nt, Human
cagaaugucacaaacuguc

SEQ ID NO: 554307 - RNA, 21 nt, Human
cagcagcagcaaaggugcaau

SEQ ID NO: 554308 - RNA, 24 nt, Human
cagcagcagcaaaggugcaauguc

SEQ ID NO: 554309 - RNA, 27 nt, Human
caggacaagcauacaagccaugccacu

SEQ ID NO: 554310 - RNA, 20 nt, Human
caggucccgagggcuccgug

SEQ ID NO: 554311 - RNA, 23 nt, Human
caggucccgagggcuccguggag

SEQ ID NO: 554312 - RNA, 18 nt, Human
caggugcagagacaggcc

SEQ ID NO: 554313 - RNA, 19 nt, Human
cagucuagauacauaugua

SEQ ID NO: 554314 - RNA, 26 nt, Human
cauacaagccaugccacugacacagu

SEQ ID NO: 554315 - RNA, 19 nt, Human
caucuccuuucacacaagu

SEQ ID NO: 554316 - RNA, 22 nt, Human
ccaaggaaauguucugagacaa

SEQ ID NO: 554317 - RNA, 20 nt, Human
ccagcacuacugguggagug

SEQ ID NO: 554318 - RNA, 21 nt, Human
ccccaugaagcauucaugaag

SEQ ID NO: 554319 - RNA, 19 nt, Human
cgggaccgaacacguucca

SEQ ID NO: 554320 - RNA, 25 nt, Human
cggucaggcuuucccagaagacgcc

SEQ ID NO: 554321 - RNA, 23 nt, Human
cugauuacaaaagcaaaaccuca

SEQ ID NO: 554322 - RNA, 18 nt, Human
cuguccagccaaggaaau

SEQ ID NO: 554323 - RNA, 23 nt, Human
cuuucccagaagacgccacaaca

SEQ ID NO: 554324 - RNA, 19 nt, Human
gaaaucaaucaaaccagaa

SEQ ID NO: 554325 - RNA, 26 nt, Human
gaaaucaaucaaaccagaaaaccaac

SEQ ID NO: 554326 - RNA, 18 nt, Human
gaagagaaaagaaguugc

SEQ ID NO: 554327 - RNA, 19 nt, Human
gaugcugccaagauagcac

SEQ ID NO: 554328 - RNA, 20 nt, Human
gauuacaaaagcaaaaccuc

SEQ ID NO: 554329 - RNA, 19 nt, Human
gcaauguccucucuagacu

SEQ ID NO: 554330 - RNA, 19 nt, Human
gcacaucuccuuucacaca

SEQ ID NO: 554331 - RNA, 22 nt, Human
gcggagagcaacauugucuuug

SEQ ID NO: 554332 - RNA, 20 nt, Human
gcuuuccaaaccuuggucac

SEQ ID NO: 554333 - RNA, 22 nt, Human
ggacaagcauacaagccaugcc

SEQ ID NO: 554334 - RNA, 24 nt, Human
ggaccgaacacguuccacagagaa

SEQ ID NO: 554335 - RNA, 23 nt, Human
uaaaacacuugaaaucuguguuu

SEQ ID NO: 554336 - RNA, 24 nt, Human
uaaaaccaucuuucuugacuuuga

SEQ ID NO: 554337 - RNA, 24 nt, Human
uaacaagaggugugaaaccacuuu

SEQ ID NO: 554338 - RNA, 25 nt, Human
uaacuagguccuaacuucggaaguu

SEQ ID NO: 554339 - RNA, 24 nt, Human
uaagaaaaaaggaaaucaaucaaa

SEQ ID NO: 554340 - RNA, 22 nt, Human
uaaugcaucucauucauauuaa

SEQ ID NO: 554341 - RNA, 19 nt, Human
uacaaaaagaacccaucac

SEQ ID NO: 554342 - RNA, 23 nt, Human
uagcagcagcagcaaaggugcaa

SEQ ID NO: 554343 - RNA, 19 nt, Human
ucaaucaaaccagaaaacc

SEQ ID NO: 554344 - RNA, 26 nt, Human
ucagguggcuuuccaaaccuugguca

SEQ ID NO: 554345 - RNA, 25 nt, Human
uccaaaacacguuuuuagaaaaaua

SEQ ID NO: 554346 - RNA, 21 nt, Human
uccugauuacaaaagcaaaaa

SEQ ID NO: 554347 - RNA, 24 nt, Human
uccuggugcagcaggucccgaggg

SEQ ID NO: 554348 - RNA, 24 nt, Human
ugaaaguaguguacaauccuccca

SEQ ID NO: 554349 - RNA, 24 nt, Human
ugacuuuggauuugacugaugagg

SEQ ID NO: 554350 - RNA, 23 nt, Human
ugcaacuaacuucaggguaaaaa

SEQ ID NO: 554351 - RNA, 18 nt, Human
ugcagagacaggccccua

SEQ ID NO: 554352 - RNA, 18 nt, Human
ugccgucaggacccuggc

SEQ ID NO: 554353 - RNA, 19 nt, Human
uggacagacaggugcagag

SEQ ID NO: 554354 - RNA, 20 nt, Human
uggacagacaggugcagaga

SEQ ID NO: 554355 - RNA, 21 nt, Human
uggacagacaggugcagagac

SEQ ID NO: 554356 - RNA, 24 nt, Human
uggcggcuuggaaaagcagauucc

SEQ ID NO: 554357 - RNA, 23 nt, Human
uguacaaaaaaaucuuggcauuc

SEQ ID NO: 554358 - RNA, 26 nt, Human
uguagaugaguauggaaaaauccauu

SEQ ID NO: 554359 - RNA, 23 nt, Human
ugucacaaacugucaccacagga

SEQ ID NO: 554360 - RNA, 21 nt, Human
ugugaaaccacuuuuuuuccc

SEQ ID NO: 554361 - RNA, 21 nt, Human
ugugucuaagaaaaaaggaaa

SEQ ID NO: 554362 - RNA, 23 nt, Human
uguugagagcaaaguaacuaggu

SEQ ID NO: 554363 - RNA, 18 nt, Human
uucacacaaguccaacac

SEQ ID NO: 554364 - RNA, 25 nt, Human
uucacacaaguccaacacucuucaa

SEQ ID NO: 554365 - RNA, 23 nt, Human
uucauauuaauuaauuccguauu

SEQ ID NO: 554366 - RNA, 21 nt, Human
uuccaaaggguaaacaagcag

SEQ ID NO: 554367 - RNA, 21 nt, Human
uugaagaccauggaguaugac

SEQ ID NO: 554368 - RNA, 22 nt, Human
uugcagcuggggaagagcacac

SEQ ID NO: 554369 - RNA, 23 nt, Human
uuggaagauagcagcagcagcaa

SEQ ID NO: 554370 - RNA, 18 nt, Human
uuuaaacuuaguaggagg

SEQ ID NO: 554371 - RNA, 19 nt, Human
uuuauuagaguacaggauc

SEQ ID NO: 554372 - RNA, 21 nt, Human
uuucacacaaguccaacacuc

SEQ ID NO: 554373 - RNA, 19 nt, Human
uuuggucuuugaagaccau

SEQ ID NO: 554374 - RNA, 24 nt, Human
uuuuuggucuuugaagaccauggg

SEQ ID NO: 554375 - RNA, 22 nt, Human
aaagauacacucuaaccaugug

SEQ ID NO: 554376 - RNA, 24 nt, Human
aaccccaaagugacaaaaccugag

SEQ ID NO: 554377 - RNA, 25 nt, Human
aagcaaaagccuuaguaacaaaaaa

SEQ ID NO: 554378 - RNA, 24 nt, Human
aagccuuaguaacaaaaaagaucc

SEQ ID NO: 554379 - RNA, 19 nt, Human
accauguguuuccuuuaaa

SEQ ID NO: 554380 - RNA, 20 nt, Human
agaauuuccaaaaaccagua

SEQ ID NO: 554381 - RNA, 24 nt, Human
aggaggugacacauugaggucaca

SEQ ID NO: 554382 - RNA, 27 nt, Human
aggcaaugucaaauuuuaaggagaaug

SEQ ID NO: 554383 - RNA, 23 nt, Human
caaaaaagauccacaauuuuuaa

SEQ ID NO: 554384 - RNA, 23 nt, Human
caaagugacaaaaccugagacca

SEQ ID NO: 554385 - RNA, 25 nt, Human
caaugucuacuacaaaauggaauga

SEQ ID NO: 554386 - RNA, 22 nt, Human
cagaauuuccaaaaaccaguac

SEQ ID NO: 554387 - RNA, 25 nt, Human
cagcccgccggaaccaguccuacgg

SEQ ID NO: 554388 - RNA, 22 nt, Human
cauaaagauacacucuaaccau

SEQ ID NO: 554389 - RNA, 21 nt, Human
ccaaagugacaaaaccugaga

SEQ ID NO: 554390 - RNA, 18 nt, Human
ccccaaagugacaaaacc

SEQ ID NO: 554391 - RNA, 23 nt, Human
cgccggaaccaguccuacggcgg

SEQ ID NO: 554392 - RNA, 18 nt, Human
cugucaaaggaaagauca

SEQ ID NO: 554393 - RNA, 26 nt, Human
cuuuaaaggaggaaacuagaaaggag

SEQ ID NO: 554394 - RNA, 27 nt, Human
gacacauugaggucacacagaguacca

SEQ ID NO: 554395 - RNA, 18 nt, Human
gcaagacauucuguggaa

SEQ ID NO: 554396 - RNA, 18 nt, Human
ggaggugacacauugagg

SEQ ID NO: 554397 - RNA, 22 nt, Human
uaagccccuuagccaagacccu

SEQ ID NO: 554398 - RNA, 19 nt, Human
ucacacagaguaccacauc

SEQ ID NO: 554399 - RNA, 25 nt, Human
ucaguaagccccuuagccaaugucu

SEQ ID NO: 554400 - RNA, 20 nt, Human
ugacaaaaccugagaccauu

SEQ ID NO: 554401 - RNA, 23 nt, Human
ugaccaaacagauuugggaacug

SEQ ID NO: 554402 - RNA, 22 nt, Human
ugccauaaagauacacucuaac

SEQ ID NO: 554403 - RNA, 20 nt, Human
ugucacagguaaugcuauuc

SEQ ID NO: 554404 - RNA, 18 nt, Human
ugugacucaaggaaguuc

SEQ ID NO: 554405 - RNA, 21 nt, Human
uguggaaaaaaguuuugugac

SEQ ID NO: 554406 - RNA, 19 nt, Human
uuaaccccaaagugacaaa

SEQ ID NO: 554407 - RNA, 19 nt, Human
uucaaaagaucuaauacag

SEQ ID NO: 554408 - RNA, 22 nt, Human
aaggaggcacuccccuugggcc

SEQ ID NO: 554409 - RNA, 23 nt, Human
acacagagggaccuugacuugga

SEQ ID NO: 554410 - RNA, 24 nt, Human
accuugacuuggagcuugacgaag

SEQ ID NO: 554411 - RNA, 18 nt, Human
agaagaggcagguccaga

SEQ ID NO: 554412 - RNA, 18 nt, Human
agggggauuaggucucag

SEQ ID NO: 554413 - RNA, 23 nt, Human
auugcuccuuagucccuggccug

SEQ ID NO: 554414 - RNA, 23 nt, Human
auugcuccuuagucccuggccug

SEQ ID NO: 554415 - RNA, 24 nt, Human
cacacagagggaccuugacuugga

SEQ ID NO: 554416 - RNA, 23 nt, Human
cacagccgcagcccagcagcucc

SEQ ID NO: 554417 - RNA, 21 nt, Human
cacccccgccuccuucagccc

SEQ ID NO: 554418 - RNA, 18 nt, Human
cacccccuagcaaccccu

SEQ ID NO: 554419 - RNA, 18 nt, Human
cacccccuagcaaccccu

SEQ ID NO: 554420 - RNA, 23 nt, Human
cacccuacgaucuccuucaucuu

SEQ ID NO: 554421 - RNA, 24 nt, Human
cagcagcuccuugcugaacucuga

SEQ ID NO: 554422 - RNA, 20 nt, Human
cagccccacagccgcagccc

SEQ ID NO: 554423 - RNA, 23 nt, Human
cagggccucccagaagaaguccu

SEQ ID NO: 554424 - RNA, 21 nt, Human
cagguaacaaaccuggggaca

SEQ ID NO: 554425 - RNA, 18 nt, Human
ccacccccgccuccuuca

SEQ ID NO: 554426 - RNA, 18 nt, Human
ccacccccuagcaacccc

SEQ ID NO: 554427 - RNA, 22 nt, Human
ccacccccuagcaaccccuucc

SEQ ID NO: 554428 - RNA, 18 nt, Human
cccacacgcaugugcaca

SEQ ID NO: 554429 - RNA, 18 nt, Human
cccacacgcaugugcaca

SEQ ID NO: 554430 - RNA, 20 nt, Human
cccacacgcaugugcacaau

SEQ ID NO: 554431 - RNA, 20 nt, Human
cccacacgcaugugcacaau

SEQ ID NO: 554432 - RNA, 19 nt, Human
cccacagccgcagcccagc

SEQ ID NO: 554433 - RNA, 25 nt, Human
ccccacccccuagcaaccccuuccc

SEQ ID NO: 554434 - RNA, 25 nt, Human
ccccacccccuagcaaccccuuccc

SEQ ID NO: 554435 - RNA, 22 nt, Human
cccccagccccacagccgcagc

SEQ ID NO: 554436 - RNA, 22 nt, Human
cccccgggguccuggggugcuc

SEQ ID NO: 554437 - RNA, 18 nt, Human
cccccuagcaaccccuuc

SEQ ID NO: 554438 - RNA, 18 nt, Human
cccccuagcaaccccuuc

SEQ ID NO: 554439 - RNA, 22 nt, Human
ccccgccuccuucagcccucug

SEQ ID NO: 554440 - RNA, 20 nt, Human
ccccgggguccuggggugcc

SEQ ID NO: 554441 - RNA, 20 nt, Human
ccccuugggccagccuggga

SEQ ID NO: 554442 - RNA, 22 nt, Human
ccucgguccauuuuguccccug

SEQ ID NO: 554443 - RNA, 18 nt, Human
ccuucagcccucugcagc

SEQ ID NO: 554444 - RNA, 20 nt, Human
cggcccccagccccacagcc

SEQ ID NO: 554445 - RNA, 19 nt, Human
cgguguccccuccucuugg

SEQ ID NO: 554446 - RNA, 25 nt, Human
cugcagcauguccagggccucccuc

SEQ ID NO: 554447 - RNA, 26 nt, Human
cugcagguaacaaaccuggggacaca

SEQ ID NO: 554448 - RNA, 20 nt, Human
cuggcccccaggcugggcuc

SEQ ID NO: 554449 - RNA, 25 nt, Human
cuugcggucccucggcccguuuucc

SEQ ID NO: 554450 - RNA, 23 nt, Human
gcacaggcacacagagggaccuu

SEQ ID NO: 554451 - RNA, 21 nt, Human
gccagccugggaggcggcccc

SEQ ID NO: 554452 - RNA, 19 nt, Human
gccccuccugggcagcccc

SEQ ID NO: 554453 - RNA, 19 nt, Human
gccccuccugggcagcccc

SEQ ID NO: 554454 - RNA, 20 nt, Human
gcgguccugcaacguuuggc

SEQ ID NO: 554455 - RNA, 20 nt, Human
ggacuaggcacccccugcuu

SEQ ID NO: 554456 - RNA, 23 nt, Human
ggcccccagccccacagccgcag

SEQ ID NO: 554457 - RNA, 26 nt, Human
ggcccccagccccacagccgcagccc

SEQ ID NO: 554458 - RNA, 19 nt, Human
ggccuggggccggacuccc

SEQ ID NO: 554459 - RNA, 19 nt, Human
ggccuggggccggacuccc

SEQ ID NO: 554460 - RNA, 19 nt, Human
gggccccuccugggcagcc

SEQ ID NO: 554461 - RNA, 19 nt, Human
gggccccuccugggcagcc

SEQ ID NO: 554462 - RNA, 18 nt, Human
gguacuccucgcaggccu

SEQ ID NO: 554463 - RNA, 18 nt, Human
guagagccgucccucaga

SEQ ID NO: 554464 - RNA, 22 nt, Human
guagagccgucccucagagaag

SEQ ID NO: 554465 - RNA, 18 nt, Human
guggagugccgguguccc

SEQ ID NO: 554466 - RNA, 18 nt, Human
uagcaugagggggauuag

SEQ ID NO: 554467 - RNA, 18 nt, Human
uccagggccucccagaag

SEQ ID NO: 554468 - RNA, 19 nt, Human
uccauuuuguccccuguuc

SEQ ID NO: 554469 - RNA, 20 nt, Human
uccccacccccuagcaaccc

SEQ ID NO: 554470 - RNA, 20 nt, Human
uccccacccccuagcaaccc

SEQ ID NO: 554471 - RNA, 20 nt, Human
uccccuugggccagccuggg

SEQ ID NO: 554472 - RNA, 22 nt, Human
ucccugguggcacagagggcac

SEQ ID NO: 554473 - RNA, 23 nt, Human
ucccuguguggguuccccucggu

SEQ ID NO: 554474 - RNA, 22 nt, Human
uccuuagucccuggccuggggc

SEQ ID NO: 554475 - RNA, 22 nt, Human
uccuuagucccuggccuggggc

SEQ ID NO: 554476 - RNA, 19 nt, Human
uccuucagcccucugcagc

SEQ ID NO: 554477 - RNA, 20 nt, Human
ucugcagcauguccagggcc

SEQ ID NO: 554478 - RNA, 22 nt, Human
ugacagucacucgccuguaucu

SEQ ID NO: 554479 - RNA, 25 nt, Human
ugcagguaacaaaccuggggacaca

SEQ ID NO: 554480 - RNA, 21 nt, Human
ugcugaacucugagcucuggc

SEQ ID NO: 554481 - RNA, 23 nt, Human
ugcugaacucugagcucuggcuc

SEQ ID NO: 554482 - RNA, 18 nt, Human
uggagugccggugucccc

SEQ ID NO: 554483 - RNA, 21 nt, Human
uggcacagagggcacaggcac

SEQ ID NO: 554484 - RNA, 21 nt, Human
uggcagguggcgauagggggc

SEQ ID NO: 554485 - RNA, 21 nt, Human
uggcuggcagguggcgauagg

SEQ ID NO: 554486 - RNA, 19 nt, Human
uggggacacacggccaggg

SEQ ID NO: 554487 - RNA, 18 nt, Human
ugggggacgaggacuagg

SEQ ID NO: 554488 - RNA, 22 nt, Human
ugguagguagagccgucccuuc

SEQ ID NO: 554489 - RNA, 21 nt, Human
ugguuagccguccccaccccc

SEQ ID NO: 554490 - RNA, 21 nt, Human
ugguuagccguccccaccccc

SEQ ID NO: 554491 - RNA, 22 nt, Human
ugguuagccguccccacccccu

SEQ ID NO: 554492 - RNA, 22 nt, Human
ugguuagccguccccacccccu

SEQ ID NO: 554493 - RNA, 21 nt, Human
uguccccuccucuugguugga

SEQ ID NO: 554494 - RNA, 23 nt, Human
ugucguggcuggacaggauguau

SEQ ID NO: 554495 - RNA, 18 nt, Human
ugugcacaauggucauug

SEQ ID NO: 554496 - RNA, 18 nt, Human
ugugcacaauggucauug

SEQ ID NO: 554497 - RNA, 21 nt, Human
uguuccuagcugcccguaucu

SEQ ID NO: 554498 - RNA, 27 nt, Human
uucccacacgcaugugcacaaugguca

SEQ ID NO: 554499 - RNA, 27 nt, Human
uucccacacgcaugugcacaaugguca

SEQ ID NO: 554500 - RNA, 24 nt, Human
uucccuucggaggcucuaauuggc

SEQ ID NO: 554501 - RNA, 22 nt, Human
uugacgaaggaggcacuccccu

SEQ ID NO: 554502 - RNA, 19 nt, Human
uuggagcuugacgaaggag

SEQ ID NO: 554503 - RNA, 18 nt, Human
uuggcaacuguggaucug

SEQ ID NO: 554504 - RNA, 18 nt, Human
uuuuuuuuuuuuuuuucg

SEQ ID NO: 554505 - RNA, 18 nt, Human
uuuuuuuuuuuuuuuucg

SEQ ID NO: 554506 - RNA, 21 nt, Human
uuuuuuuuuuuuuuuuucgcu

SEQ ID NO: 554507 - RNA, 21 nt, Human
uuuuuuuuuuuuuuuuucgcu

SEQ ID NO: 554508 - RNA, 21 nt, Human
acaagauucacaucucuucca

SEQ ID NO: 554509 - RNA, 23 nt, Human
acagacagcaggauucacaaucu

SEQ ID NO: 554510 - RNA, 19 nt, Human
agggauggcaggggcagcc

SEQ ID NO: 554511 - RNA, 18 nt, Human
caacuccauccaggagau

SEQ ID NO: 554512 - RNA, 25 nt, Human
caaguuucugacuacaagauucaca

SEQ ID NO: 554513 - RNA, 20 nt, Human
cacagaacacucacuaugag

SEQ ID NO: 554514 - RNA, 19 nt, Human
cacagacagcaggauucac

SEQ ID NO: 554515 - RNA, 21 nt, Human
cagaacacucacuaugagccc

SEQ ID NO: 554516 - RNA, 22 nt, Human
ccaaaaauggcauaguucuccu

SEQ ID NO: 554517 - RNA, 20 nt, Human
ccaucuucugucuuaaucca

SEQ ID NO: 554518 - RNA, 23 nt, Human
cccaccucacagaacacucacua

SEQ ID NO: 554519 - RNA, 20 nt, Human
cccugcacagacagcaggau

SEQ ID NO: 554520 - RNA, 18 nt, Human
ccugacccaaaaauggca

SEQ ID NO: 554521 - RNA, 18 nt, Human
cugacccaaaaauggcau

SEQ ID NO: 554522 - RNA, 18 nt, Human
cuucccaggcuuucugga

SEQ ID NO: 554523 - RNA, 24 nt, Human
uaaagaaguagaaaugauuucguu

SEQ ID NO: 554524 - RNA, 19 nt, Human
uaagauaaugcugugacug

SEQ ID NO: 554525 - RNA, 20 nt, Human
uaagauaaugcugugacuga

SEQ ID NO: 554526 - RNA, 21 nt, Human
uacaaugguuauucucucuuu

SEQ ID NO: 554527 - RNA, 22 nt, Human
ucccaggcuuucuggaagcagg

SEQ ID NO: 554528 - RNA, 23 nt, Human
ucuccaauagggauggcaggggc

SEQ ID NO: 554529 - RNA, 22 nt, Human
ucuccacccaccucacagaaca

SEQ ID NO: 554530 - RNA, 22 nt, Human
ucuccaguccugacccaaaaau

SEQ ID NO: 554531 - RNA, 19 nt, Human
ucuuucaaguuucugacua

SEQ ID NO: 554532 - RNA, 24 nt, Human
uggaagcaggggcuuccgaggagu

SEQ ID NO: 554533 - RNA, 21 nt, Human
uucacaucucuuccagccauc

SEQ ID NO: 554534 - RNA, 24 nt, Human
uucacaucucuuccagccaucuuc

SEQ ID NO: 554535 - RNA, 23 nt, Human
uuugcagaagggcaguucuuccc

SEQ ID NO: 554536 - RNA, 19 nt, Human
aaacaugucacagugcugc

SEQ ID NO: 554537 - RNA, 28 nt, Human
aacucccgagcuccagugauccucccuc

SEQ ID NO: 554538 - RNA, 22 nt, Human
aagaaaauuugcaggcaaauga

SEQ ID NO: 554539 - RNA, 25 nt, Human
aagcuggucuuuuuuuuuuuuuuuu

SEQ ID NO: 554540 - RNA, 20 nt, Human
aagugcugggauuccacagg

SEQ ID NO: 554541 - RNA, 21 nt, Human
aagugcugggauuccacaggu

SEQ ID NO: 554542 - RNA, 22 nt, Human
aagugcugggauuccacaggug

SEQ ID NO: 554543 - RNA, 23 nt, Human
aagugcugggauuccacaggugu

SEQ ID NO: 554544 - RNA, 25 nt, Human
aagugcugggauuccacagguguga

SEQ ID NO: 554545 - RNA, 19 nt, Human
aauaaagggaugggcugaa

SEQ ID NO: 554546 - RNA, 21 nt, Human
acccaagccuccugaguagcu

SEQ ID NO: 554547 - RNA, 24 nt, Human
acuauguugcccaggcuggucuug

SEQ ID NO: 554548 - RNA, 25 nt, Human
acuauguugcccaggcuggucuuga

SEQ ID NO: 554549 - RNA, 18 nt, Human
acugcagccucaaccucc

SEQ ID NO: 554550 - RNA, 23 nt, Human
acugcagccucaaccuccugguc

SEQ ID NO: 554551 - RNA, 21 nt, Human
agccagaguccuggcgggcug

SEQ ID NO: 554552 - RNA, 23 nt, Human
agcggaccucugcucccugccca

SEQ ID NO: 554553 - RNA, 25 nt, Human
agcuggucuuuuuuuuuuuuuuuuu

SEQ ID NO: 554554 - RNA, 19 nt, Human
aggcaauccucccacccaa

SEQ ID NO: 554555 - RNA, 25 nt, Human
aggcaauccucccacccaagccucc

SEQ ID NO: 554556 - RNA, 24 nt, Human
aggcggcagcggcgggcuaagcuu

SEQ ID NO: 554557 - RNA, 21 nt, Human
agggaugggcugaaauaaagg

SEQ ID NO: 554558 - RNA, 19 nt, Human
agggggccccgggaccggc

SEQ ID NO: 554559 - RNA, 23 nt, Human
agggucuugcuuucucacccagg

SEQ ID NO: 554560 - RNA, 23 nt, Human
agguguggagugggaaaucaggg

SEQ ID NO: 554561 - RNA, 18 nt, Human
aguagcugggacuacagg

SEQ ID NO: 554562 - RNA, 19 nt, Human
aguagcugggacuacaggc

SEQ ID NO: 554563 - RNA, 21 nt, Human
auccugguuuagccuuuguuu

SEQ ID NO: 554564 - RNA, 21 nt, Human
augucacagugcugcagagau

SEQ ID NO: 554565 - RNA, 22 nt, Human
auugacagcaagccagugauaa

SEQ ID NO: 554566 - RNA, 22 nt, Human
caaagcuggucuuuuuuuuuuu

SEQ ID NO: 554567 - RNA, 22 nt, Human
caacaccagagauuuccccaaa

SEQ ID NO: 554568 - RNA, 22 nt, Human
caaccuccuggucucaggcaau

SEQ ID NO: 554569 - RNA, 22 nt, Human
cacaggugugagccacugcacc

SEQ ID NO: 554570 - RNA, 20 nt, Human
cacccaagccuccugaguag

SEQ ID NO: 554571 - RNA, 24 nt, Human
cacccaagccuccugaguagcugg

SEQ ID NO: 554572 - RNA, 24 nt, Human
caccucggccuccugaagugcugg

SEQ ID NO: 554573 - RNA, 21 nt, Human
caccugggagcccuacugucc

SEQ ID NO: 554574 - RNA, 19 nt, Human
cacgauggccaccacacug

SEQ ID NO: 554575 - RNA, 19 nt, Human
cacuauguugcccaggcug

SEQ ID NO: 554576 - RNA, 24 nt, Human
cacuauguugcccaggcuggucuu

SEQ ID NO: 554577 - RNA, 27 nt, Human
cacuauguugcccaggcuggucuugaa

SEQ ID NO: 554578 - RNA, 21 nt, Human
cacugcaccuggcugcaaggc

SEQ ID NO: 554579 - RNA, 19 nt, Human
cacugcagccucaaccucc

SEQ ID NO: 554580 - RNA, 23 nt, Human
cagccucaaccuccuggucucag

SEQ ID NO: 554581 - RNA, 18 nt, Human
caguagccagaguccugg

SEQ ID NO: 554582 - RNA, 19 nt, Human
caguagccagaguccuggc

SEQ ID NO: 554583 - RNA, 21 nt, Human
ccacaggugugagccacugca

SEQ ID NO: 554584 - RNA, 28 nt, Human
ccaccacacugaagcagcagcaagcaga

SEQ ID NO: 554585 - RNA, 23 nt, Human
ccacccaagccuccugaguagcu

SEQ ID NO: 554586 - RNA, 19 nt, Human
ccaccgagauccuugcagg

SEQ ID NO: 554587 - RNA, 19 nt, Human
ccacugcaccuggcugcaa

SEQ ID NO: 554588 - RNA, 20 nt, Human
ccacugcaccuggcugcaag

SEQ ID NO: 554589 - RNA, 20 nt, Human
ccacugcaccuggcugcaag

SEQ ID NO: 554590 - RNA, 21 nt, Human
ccacugcaccuggcugcaagg

SEQ ID NO: 554591 - RNA, 22 nt, Human
ccaguagccagaguccuggcgg

SEQ ID NO: 554592 - RNA, 27 nt, Human
ccagugauccucccaccucggccuccu

SEQ ID NO: 554593 - RNA, 22 nt, Human
cccaaaacaugccggcaagucu

SEQ ID NO: 554594 - RNA, 26 nt, Human
cccaacaccagagauuuccccaaaca

SEQ ID NO: 554595 - RNA, 21 nt, Human
cccacauauuuauugacagca

SEQ ID NO: 554596 - RNA, 23 nt, Human
cccacgaucauuacccccaaaac

SEQ ID NO: 554597 - RNA, 26 nt, Human
ccccaaaacaugccggcaagucucug

SEQ ID NO: 554598 - RNA, 23 nt, Human
cccccaaaacaugccggcaaguc

SEQ ID NO: 554599 - RNA, 24 nt, Human
ccucccacccaagccuccugagua

SEQ ID NO: 554600 - RNA, 23 nt, Human
ccugacacuccccuucugggggg

SEQ ID NO: 554601 - RNA, 23 nt, Human
ccugaguagcugggacuacaggc

SEQ ID NO: 554602 - RNA, 23 nt, Human
ccugaguagcugggacuacaggc

SEQ ID NO: 554603 - RNA, 23 nt, Human
ccuuucccacuuuguucugggag

SEQ ID NO: 554604 - RNA, 22 nt, Human
cggcaccaccaugccuggcuaa

SEQ ID NO: 554605 - RNA, 25 nt, Human
cggcggucugggcggucgguccucu

SEQ ID NO: 554606 - RNA, 24 nt, Human
cucacugcagccucaaccuccugg

SEQ ID NO: 554607 - RNA, 24 nt, Human
cucaggcaauccucccacccaagc

SEQ ID NO: 554608 - RNA, 24 nt, Human
cuccagugauccucccaccucggc

SEQ ID NO: 554609 - RNA, 26 nt, Human
cugaagugcugggauuccacaggugu

SEQ ID NO: 554610 - RNA, 20 nt, Human
cugcucccugcccacgauca

SEQ ID NO: 554611 - RNA, 19 nt, Human
cugcucccugcgucggcag

SEQ ID NO: 554612 - RNA, 19 nt, Human
cugggcggucgguccucuc

SEQ ID NO: 554613 - RNA, 22 nt, Human
cuuccugacacuccccuucugg

SEQ ID NO: 554614 - RNA, 22 nt, Human
cuuucccacuuuguucugggag

SEQ ID NO: 554615 - RNA, 22 nt, Human
gaagugcugggauuccacagga

SEQ ID NO: 554616 - RNA, 23 nt, Human
gacuacaggcggcaccaccaugc

SEQ ID NO: 554617 - RNA, 25 nt, Human
gaguagcugggacuacaggcggcac

SEQ ID NO: 554618 - RNA, 18 nt, Human
gccuccugaagugcuggg

SEQ ID NO: 554619 - RNA, 27 nt, Human
gcggcagcggcgggcuaagcuucccuu

SEQ ID NO: 554620 - RNA, 22 nt, Human
gcuaagcuucccuuucccacuu

SEQ ID NO: 554621 - RNA, 21 nt, Human
gcucggaggcggcagcggcgg

SEQ ID NO: 554622 - RNA, 23 nt, Human
gcugaaauaaagggaugggucug

SEQ ID NO: 554623 - RNA, 18 nt, Human
ggagugggaaaucagggg

SEQ ID NO: 554624 - RNA, 22 nt, Human
ggauuccacaggugugagccac

SEQ ID NO: 554625 - RNA, 22 nt, Human
ggauuccacaggugugagccac

SEQ ID NO: 554626 - RNA, 24 nt, Human
ggauuccacaggugugagccacug

SEQ ID NO: 554627 - RNA, 19 nt, Human
ggcaagucucugcucccug

SEQ ID NO: 554628 - RNA, 24 nt, Human
ggcuggucuugaacucccgagcuc

SEQ ID NO: 554629 - RNA, 20 nt, Human
ggucuugaacucccgagcuc

SEQ ID NO: 554630 - RNA, 24 nt, Human
gguguggagugggaaaucaggggu

SEQ ID NO: 554631 - RNA, 21 nt, Human
gguuucacuauguugcccagg

SEQ ID NO: 554632 - RNA, 24 nt, Human
gucuugcuuucucacccaggcugg

SEQ ID NO: 554633 - RNA, 24 nt, Human
gugauccucccaccucggccuccu

SEQ ID NO: 554634 - RNA, 18 nt, Human
gugcugggauuccacagg

SEQ ID NO: 554635 - RNA, 20 nt, Human
guggagacgguuucacuaug

SEQ ID NO: 554636 - RNA, 24 nt, Human
guuucacuauguugcccaggcugg

SEQ ID NO: 554637 - RNA, 18 nt, Human
uaaacccacaaccuucag

SEQ ID NO: 554638 - RNA, 21 nt, Human
uaagcgguuuuccgcccuggg

SEQ ID NO: 554639 - RNA, 24 nt, Human
uagggucuugcuuucucacccagg

SEQ ID NO: 554640 - RNA, 23 nt, Human
uauguugcccaggcuggucuuga

SEQ ID NO: 554641 - RNA, 24 nt, Human
uauguugcccaggcuggucuugaa

SEQ ID NO: 554642 - RNA, 24 nt, Human
ucacacagcacgauggccaccaca

SEQ ID NO: 554643 - RNA, 21 nt, Human
ucacuauguugcccaggcugg

SEQ ID NO: 554644 - RNA, 22 nt, Human
ucacuauguugcccaggcuggu

SEQ ID NO: 554645 - RNA, 19 nt, Human
ucacugcagccucaaccuc

SEQ ID NO: 554646 - RNA, 23 nt, Human
ucacugcagccucaaccuccugg

SEQ ID NO: 554647 - RNA, 24 nt, Human
ucacugcagccucaaccuccuggu

SEQ ID NO: 554648 - RNA, 18 nt, Human
ucagcggaccucugcucc

SEQ ID NO: 554649 - RNA, 26 nt, Human
ucaggaaccccuuuaagcgguuuucc

SEQ ID NO: 554650 - RNA, 23 nt, Human
ucccaacaccagagauuucccca

SEQ ID NO: 554651 - RNA, 21 nt, Human
ucccgagcuccagugauccuc

SEQ ID NO: 554652 - RNA, 20 nt, Human
ucccuggguauccucuggcu

SEQ ID NO: 554653 - RNA, 21 nt, Human
ucccuggguauccucuggcuu

SEQ ID NO: 554654 - RNA, 22 nt, Human
uccucuggcuucuggcugcaaa

SEQ ID NO: 554655 - RNA, 18 nt, Human
uccugaagugcugggauu

SEQ ID NO: 554656 - RNA, 26 nt, Human
uccugaagugcugggauuccacaggu

SEQ ID NO: 554657 - RNA, 24 nt, Human
uccugaguagcugggacuacaggc

SEQ ID NO: 554658 - RNA, 19 nt, Human
uccugguuuagccuuuguu

SEQ ID NO: 554659 - RNA, 22 nt, Human
ucguuccaguaaacccacaacc

SEQ ID NO: 554660 - RNA, 27 nt, Human
ucugcagcaggaacaugucguuaaggc

SEQ ID NO: 554661 - RNA, 21 nt, Human
ucuugaacucccgagcuccag

SEQ ID NO: 554662 - RNA, 19 nt, Human
ucuugcuuucucacccagg

SEQ ID NO: 554663 - RNA, 23 nt, Human
ucuugcuuucucacccaggcugg

SEQ ID NO: 554664 - RNA, 24 nt, Human
ucuugcuuucucacccaggcugga

SEQ ID NO: 554665 - RNA, 23 nt, Human
ugaaaucacggcucacugcagcc

SEQ ID NO: 554666 - RNA, 22 nt, Human
ugaacagagauuuacccacaua

SEQ ID NO: 554667 - RNA, 28 nt, Human
ugaagcagcagcaagcagauucauggaa

SEQ ID NO: 554668 - RNA, 24 nt, Human
ugagagccuugaacagagauuuac

SEQ ID NO: 554669 - RNA, 21 nt, Human
ugcccaggcuggucuugaacu

SEQ ID NO: 554670 - RNA, 19 nt, Human
ugccucagcggaccucugc

SEQ ID NO: 554671 - RNA, 19 nt, Human
uggccaccacacugaagca

SEQ ID NO: 554672 - RNA, 20 nt, Human
uggccagauuugggggccug

SEQ ID NO: 554673 - RNA, 23 nt, Human
uggccaguuuuggggccaguuua

SEQ ID NO: 554674 - RNA, 18 nt, Human
uggcccagggggccccgg

SEQ ID NO: 554675 - RNA, 19 nt, Human
uggcgggcugcucggaggc

SEQ ID NO: 554676 - RNA, 24 nt, Human
uggcuucuggcugcaaagcugguc

SEQ ID NO: 554677 - RNA, 25 nt, Human
uggcuucuggcugcaaagcuggucu

SEQ ID NO: 554678 - RNA, 21 nt, Human
ugggacuacaggcggcaccac

SEQ ID NO: 554679 - RNA, 23 nt, Human
ugggacuacaggcggcaccacca

SEQ ID NO: 554680 - RNA, 20 nt, Human
ugggccagguguuccucgcc

SEQ ID NO: 554681 - RNA, 21 nt, Human
uggucuuuuuuuuuuuuuuuu

SEQ ID NO: 554682 - RNA, 24 nt, Human
uugcuuucucacccaggcuggagu

SEQ ID NO: 554683 - RNA, 22 nt, Human
uuggggccaguuuauggccaga

SEQ ID NO: 554684 - RNA, 22 nt, Human
uuguggagacgguuucacuaug

SEQ ID NO: 554685 - RNA, 25 nt, Human
uuuauugacagcaagccagugauaa

SEQ ID NO: 554686 - RNA, 21 nt, Human
uuuguggagacgguuucacua

SEQ ID NO: 554687 - RNA, 27 nt, Human
uuuuuaaaaauuauuuguggagacggu

SEQ ID NO: 554688 - RNA, 21 nt, Human
uuuuuuuuuuuuuuuuucauu

SEQ ID NO: 554689 - RNA, 24 nt, Human
aaagugcagggauuacagguguga

SEQ ID NO: 554690 - RNA, 24 nt, Human
aaagugcugggauuacaggcauga

SEQ ID NO: 554691 - RNA, 23 nt, Human
aagaggucaguggugcggagggg

SEQ ID NO: 554692 - RNA, 24 nt, Human
aaguagcuuggacuacaggugugu

SEQ ID NO: 554693 - RNA, 19 nt, Human
aagugcugggauuacaggc

SEQ ID NO: 554694 - RNA, 21 nt, Human
aagugcugggauuacaggcau

SEQ ID NO: 554695 - RNA, 26 nt, Human
aagugcugggauuacaggcaugagcc

SEQ ID NO: 554696 - RNA, 19 nt, Human
acauugcccaggcuggucu

SEQ ID NO: 554697 - RNA, 24 nt, Human
accauguuggccaggcuggucuug

SEQ ID NO: 554698 - RNA, 24 nt, Human
acccaggcuggagugcagugguau

SEQ ID NO: 554699 - RNA, 18 nt, Human
accugggcacaaaugauc

SEQ ID NO: 554700 - RNA, 24 nt, Human
acggagucucgcuguguugcccag

SEQ ID NO: 554701 - RNA, 18 nt, Human
acgggguuucaccauguu

SEQ ID NO: 554702 - RNA, 23 nt, Human
acgggguuucaccauguuggcca

SEQ ID NO: 554703 - RNA, 24 nt, Human
acgggguuucaccauguuggccag

SEQ ID NO: 554704 - RNA, 19 nt, Human
acuacagguguguacuacu

SEQ ID NO: 554705 - RNA, 25 nt, Human
acuacauugcccaggcuggucuuga

SEQ ID NO: 554706 - RNA, 19 nt, Human
acuucagccucccaaguag

SEQ ID NO: 554707 - RNA, 19 nt, Human
agaaacaacaggagacaag

SEQ ID NO: 554708 - RNA, 20 nt, Human
agaagagaggggagggcaag

SEQ ID NO: 554709 - RNA, 25 nt, Human
agcugcaugaccuggucccagcccu

SEQ ID NO: 554710 - RNA, 23 nt, Human
aggcaugagccacugugccuggc

SEQ ID NO: 554711 - RNA, 25 nt, Human
aggcuggagugcaguggcaugaucu

SEQ ID NO: 554712 - RNA, 22 nt, Human
agggauuacaggugugagccac

SEQ ID NO: 554713 - RNA, 25 nt, Human
agggauuacaggugugagccacccu

SEQ ID NO: 554714 - RNA, 19 nt, Human
agggcugggacucucugag

SEQ ID NO: 554715 - RNA, 21 nt, Human
aggggaugguacagaggggcc

SEQ ID NO: 554716 - RNA, 24 nt, Human
aggugauccgccugccucagccuc

SEQ ID NO: 554717 - RNA, 18 nt, Human
aguagcuggaauuacagg

SEQ ID NO: 554718 - RNA, 20 nt, Human
agugcaguggcaugaucuug

SEQ ID NO: 554719 - RNA, 23 nt, Human
agugcaguggcaugaucuugguu

SEQ ID NO: 554720 - RNA, 24 nt, Human
agugcaguggcaugaucuugguuc

SEQ ID NO: 554721 - RNA, 20 nt, Human
agugcagugguaugaucaug

SEQ ID NO: 554722 - RNA, 23 nt, Human
agugcagugguaugaucauggcu

SEQ ID NO: 554723 - RNA, 24 nt, Human
agugcagugguaugaucauggcuc

SEQ ID NO: 554724 - RNA, 24 nt, Human
aguggcaugaucuugguucacugc

SEQ ID NO: 554725 - RNA, 23 nt, Human
agugggcagaaccaucuccaaau

SEQ ID NO: 554726 - RNA, 18 nt, Human
aguggugcggaggggagg

SEQ ID NO: 554727 - RNA, 24 nt, Human
caaagugcagggauuacaggugug

SEQ ID NO: 554728 - RNA, 24 nt, Human
caaagugcugggauuacaggcaug

SEQ ID NO: 554729 - RNA, 27 nt, Human
caaaugauccucccacuucagccuccc

SEQ ID NO: 554730 - RNA, 22 nt, Human
caagcaauucuccugccucagc

SEQ ID NO: 554731 - RNA, 19 nt, Human
caaggaagucccuguggca

SEQ ID NO: 554732 - RNA, 24 nt, Human
cacaaaugauccucccacuucagc

SEQ ID NO: 554733 - RNA, 21 nt, Human
caccaagcccggcuaauuuuu

SEQ ID NO: 554734 - RNA, 21 nt, Human
caccauguuggccaggcuggu

SEQ ID NO: 554735 - RNA, 23 nt, Human
caccauguuggccaggcuggucu

SEQ ID NO: 554736 - RNA, 24 nt, Human
caccauguuggccaggcuggucuu

SEQ ID NO: 554737 - RNA, 27 nt, Human
caccauguuggccaggcuggucuugaa

SEQ ID NO: 554738 - RNA, 23 nt, Human
cacugcagccucugccucccggg

SEQ ID NO: 554739 - RNA, 23 nt, Human
cagccucugccucccgggcucaa

SEQ ID NO: 554740 - RNA, 22 nt, Human
caggugauccgccugccucagc

SEQ ID NO: 554741 - RNA, 21 nt, Human
cagugguaugaucauggcuca

SEQ ID NO: 554742 - RNA, 24 nt, Human
cauguuggccaggcuggucuugaa

SEQ ID NO: 554743 - RNA, 22 nt, Human
cauugcccaggcuggucuugaa

SEQ ID NO: 554744 - RNA, 21 nt, Human
ccaaagugcagggauuacagg

SEQ ID NO: 554745 - RNA, 24 nt, Human
ccaaagugcagggauuacaggugu

SEQ ID NO: 554746 - RNA, 23 nt, Human
ccaaagugcugggauuacaggca

SEQ ID NO: 554747 - RNA, 24 nt, Human
ccaaagugcugggauuacaggcau

SEQ ID NO: 554748 - RNA, 18 nt, Human
ccacacaauuacaggucc

SEQ ID NO: 554749 - RNA, 24 nt, Human
ccaggcuggucuugaacucugggg

SEQ ID NO: 554750 - RNA, 24 nt, Human
cccaaagugcugggauuacaggca

SEQ ID NO: 554751 - RNA, 24 nt, Human
cccaaguagcuuggacuacaggug

SEQ ID NO: 554752 - RNA, 20 nt, Human
cccacuucagccucccaagu

SEQ ID NO: 554753 - RNA, 19 nt, Human
cccaggcuggagugcagug

SEQ ID NO: 554754 - RNA, 23 nt, Human
cccaggcuggagugcaguggcau

SEQ ID NO: 554755 - RNA, 23 nt, Human
cccgaguagcuggaauuacaggu

SEQ ID NO: 554756 - RNA, 23 nt, Human
cccgggcucaagcaauucuccug

SEQ ID NO: 554757 - RNA, 26 nt, Human
ccgccugccucagccucccaaagugc

SEQ ID NO: 554758 - RNA, 22 nt, Human
ccggcuguggcccggggccugg

SEQ ID NO: 554759 - RNA, 19 nt, Human
ccucccaaagugcagggau

SEQ ID NO: 554760 - RNA, 20 nt, Human
ccucccaaagugcagggauu

SEQ ID NO: 554761 - RNA, 26 nt, Human
ccucccaccuuggccucccaaagugc

SEQ ID NO: 554762 - RNA, 26 nt, Human
ccucccacuucagccucccaaguagc

SEQ ID NO: 554763 - RNA, 24 nt, Human
ccucccgggcucaagcaauucucc

SEQ ID NO: 554764 - RNA, 18 nt, Human
ccucguuuuuucagagaa

SEQ ID NO: 554765 - RNA, 18 nt, Human
ccugaccucaggugaucc

SEQ ID NO: 554766 - RNA, 21 nt, Human
ccugaccucaggugauccgcc

SEQ ID NO: 554767 - RNA, 23 nt, Human
ccugaccucaggugauccgccug

SEQ ID NO: 554768 - RNA, 23 nt, Human
ccugccucagccucccgaguagc

SEQ ID NO: 554769 - RNA, 24 nt, Human
ccugccucagccucccgaguagcu

SEQ ID NO: 554770 - RNA, 27 nt, Human
ccuggucccagcccuguagccgguucc

SEQ ID NO: 554771 - RNA, 24 nt, Human
ccuguggcagaaacaacaggagac

SEQ ID NO: 554772 - RNA, 24 nt, Human
cgcucugucacccaggcuggagug

SEQ ID NO: 554773 - RNA, 24 nt, Human
cggagucucgcuguguugcccagg

SEQ ID NO: 554774 - RNA, 24 nt, Human
cgggguuucaccauguuggccagg

SEQ ID NO: 554775 - RNA, 24 nt, Human
cucaacugauccucccaccuuggc

SEQ ID NO: 554776 - RNA, 24 nt, Human
cucaagcaauucuccugccucagc

SEQ ID NO: 554777 - RNA, 19 nt, Human
cucacuauagccucaaccu

SEQ ID NO: 554778 - RNA, 23 nt, Human
cucaggugauccgccugccucag

SEQ ID NO: 554779 - RNA, 23 nt, Human
cuccaggaugggcauucccccau

SEQ ID NO: 554780 - RNA, 25 nt, Human
cucccgggcucaagcaauucuccug

SEQ ID NO: 554781 - RNA, 26 nt, Human
cuccugaccucaggugauccgccugc

SEQ ID NO: 554782 - RNA, 24 nt, Human
cucgcucugucacccaggcuggag

SEQ ID NO: 554783 - RNA, 23 nt, Human
cugcagccucugccucccgggcu

SEQ ID NO: 554784 - RNA, 23 nt, Human
cugccucagccucccaaagugcu

SEQ ID NO: 554785 - RNA, 24 nt, Human
cugccucagccucccaaagugcug

SEQ ID NO: 554786 - RNA, 24 nt, Human
cuggagugcaguggcaugaucuug

SEQ ID NO: 554787 - RNA, 21 nt, Human
cuggucccagcccuguagcuc

SEQ ID NO: 554788 - RNA, 20 nt, Human
cuguguugcccaggcuggag

SEQ ID NO: 554789 - RNA, 24 nt, Human
gaauuaccucguuuuuucagagaa

SEQ ID NO: 554790 - RNA, 24 nt, Human
gaccucaggugauccgccugccuc

SEQ ID NO: 554791 - RNA, 21 nt, Human
gacuacagguguguacuacug

SEQ ID NO: 554792 - RNA, 18 nt, Human
gagaaaccagagugggca

SEQ ID NO: 554793 - RNA, 21 nt, Human
gagaagagaggggagggcaag

SEQ ID NO: 554794 - RNA, 24 nt, Human
gagacgggguuucaccauguuggc

SEQ ID NO: 554795 - RNA, 26 nt, Human
gaguagcuggaauuacaggugcacac

SEQ ID NO: 554796 - RNA, 19 nt, Human
gaucauggcucacuauagc

SEQ ID NO: 554797 - RNA, 21 nt, Human
gauccgccugccucagccucc

SEQ ID NO: 554798 - RNA, 18 nt, Human
gauuacaggcaugagcca

SEQ ID NO: 554799 - RNA, 21 nt, Human
gauuacaggcaugagccacug

SEQ ID NO: 554800 - RNA, 24 nt, Human
gauuacaggcaugagccacugugc

SEQ ID NO: 554801 - RNA, 18 nt, Human
gauuacaggugugagcca

SEQ ID NO: 554802 - RNA, 20 nt, Human
gauuacaggugugagccacc

SEQ ID NO: 554803 - RNA, 24 nt, Human
gauuacaggugugagccacccugc

SEQ ID NO: 554804 - RNA, 19 nt, Human
gcacaccaccaagcccggc

SEQ ID NO: 554805 - RNA, 23 nt, Human
gcagaaacaacaggagacaagag

SEQ ID NO: 554806 - RNA, 18 nt, Human
gccaggcccggcuguggc

SEQ ID NO: 554807 - RNA, 24 nt, Human
gcccaaacuuuuuuuuuuuaacgu

SEQ ID NO: 554808 - RNA, 20 nt, Human
gcccaggcuggagugcagug

SEQ ID NO: 554809 - RNA, 25 nt, Human
gcucugucacccaggcuggagugca

SEQ ID NO: 554810 - RNA, 19 nt, Human
gcuggagugcaguggcaug

SEQ ID NO: 554811 - RNA, 23 nt, Human
gcuggucuugaacuccugaccuc

SEQ ID NO: 554812 - RNA, 20 nt, Human
ggacccaggaauucucagua

SEQ ID NO: 554813 - RNA, 25 nt, Human
ggaggugagguucacacccuuaggg

SEQ ID NO: 554814 - RNA, 24 nt, Human
ggauuacaggcaugagccacugug

SEQ ID NO: 554815 - RNA, 21 nt, Human
ggcaagaauucuucuccagga

SEQ ID NO: 554816 - RNA, 19 nt, Human
ggccuggcggcgcuccucg

SEQ ID NO: 554817 - RNA, 24 nt, Human
ggcuggucuugaacuccugaccuc

SEQ ID NO: 554818 - RNA, 18 nt, Human
gggauuacaggugugagc

SEQ ID NO: 554819 - RNA, 20 nt, Human
gggauuacaggugugagcca

SEQ ID NO: 554820 - RNA, 24 nt, Human
gggggucuuacuacauugcccagg

SEQ ID NO: 554821 - RNA, 23 nt, Human
gggguuucaccauguuggccagg

SEQ ID NO: 554822 - RNA, 20 nt, Human
gguccuugaggaucaggguu

SEQ ID NO: 554823 - RNA, 19 nt, Human
ggucuugaacuccugaccu

SEQ ID NO: 554824 - RNA, 23 nt, Human
guagagacgggguuucaccaugu

SEQ ID NO: 554825 - RNA, 18 nt, Human
gugauccgccugccucag

SEQ ID NO: 554826 - RNA, 24 nt, Human
gugauccgccugccucagccuccc

SEQ ID NO: 554827 - RNA, 21 nt, Human
guguugcccaggcuggagugc

SEQ ID NO: 554828 - RNA, 24 nt, Human
uaauuuuuuggauuuuuaguagag

SEQ ID NO: 554829 - RNA, 25 nt, Human
uaauuuuuuggauuuuuaguagaga

SEQ ID NO: 554830 - RNA, 22 nt, Human
uacaggcaugagccacugugcc

SEQ ID NO: 554831 - RNA, 18 nt, Human
uacaggugugagccaccc

SEQ ID NO: 554832 - RNA, 19 nt, Human
uacaggugugagccacccu

SEQ ID NO: 554833 - RNA, 22 nt, Human
uacaggugugagccacccugcc

SEQ ID NO: 554834 - RNA, 20 nt, Human
uacauugcccaggcuggucu

SEQ ID NO: 554835 - RNA, 24 nt, Human
uacauugcccaggcuggucuugaa

SEQ ID NO: 554836 - RNA, 21 nt, Human
uaccacacaauuacagguccu

SEQ ID NO: 554837 - RNA, 27 nt, Human
uacuacauugcccaggcuggucuugaa

SEQ ID NO: 554838 - RNA, 22 nt, Human
uagagacgggguuucaccaugu

SEQ ID NO: 554839 - RNA, 24 nt, Human
uagauaagauggaagaagcuucuu

SEQ ID NO: 554840 - RNA, 27 nt, Human
uagccucaaccugggcacaaaugaucc

SEQ ID NO: 554841 - RNA, 24 nt, Human
uaguagagacgggguuucaccaug

SEQ ID NO: 554842 - RNA, 26 nt, Human
uaguagagacgggguuucaccauguu

SEQ ID NO: 554843 - RNA, 22 nt, Human
uauuuuuuguagcgaugggggu

SEQ ID NO: 554844 - RNA, 25 nt, Human
ucaacugauccucccaccuuggccu

SEQ ID NO: 554845 - RNA, 24 nt, Human
ucacccaggcuggagugcaguggu

SEQ ID NO: 554846 - RNA, 21 nt, Human
ucacuauagccucaaccuggg

SEQ ID NO: 554847 - RNA, 19 nt, Human
ucacugcagccucugccuc

SEQ ID NO: 554848 - RNA, 20 nt, Human
ucacugcagccucugccucc

SEQ ID NO: 554849 - RNA, 23 nt, Human
ucacugcagccucugccucccgg

SEQ ID NO: 554850 - RNA, 24 nt, Human
ucacugcagccucugccucccggg

SEQ ID NO: 554851 - RNA, 25 nt, Human
ucacugcagccucugccucccgggc

SEQ ID NO: 554852 - RNA, 24 nt, Human
ucagagaaaccagagugggcagaa

SEQ ID NO: 554853 - RNA, 19 nt, Human
ucagccucccaaguagcuu

SEQ ID NO: 554854 - RNA, 21 nt, Human
ucagccucccaaguagcuugg

SEQ ID NO: 554855 - RNA, 22 nt, Human
ucagccucccgaguagcuggaa

SEQ ID NO: 554856 - RNA, 22 nt, Human
ucaggugauccgccugccucag

SEQ ID NO: 554857 - RNA, 23 nt, Human
uccaaacuuuuucuuuuugagac

SEQ ID NO: 554858 - RNA, 23 nt, Human
ucccaaagugcagggauuacagg

SEQ ID NO: 554859 - RNA, 24 nt, Human
ucccaaagugcugggauuacaggc

SEQ ID NO: 554860 - RNA, 24 nt, Human
ucccaaguagcuuggacuacaggu

SEQ ID NO: 554861 - RNA, 22 nt, Human
ucccaggcccuggaaggcacag

SEQ ID NO: 554862 - RNA, 23 nt, Human
ucccgaguagcuggaauuacagg

SEQ ID NO: 554863 - RNA, 24 nt, Human
ucccgaguagcuggaauuacaggu

SEQ ID NO: 554864 - RNA, 21 nt, Human
ucccgggcucaagcaauucuc

SEQ ID NO: 554865 - RNA, 24 nt, Human
ucccgggcucaagcaauucuccug

SEQ ID NO: 554866 - RNA, 19 nt, Human
ucccugaagggaccaagga

SEQ ID NO: 554867 - RNA, 21 nt, Human
ucgccgggaugcccuagcugu

SEQ ID NO: 554868 - RNA, 23 nt, Human
ucgccgggaugcccuagcugugc

SEQ ID NO: 554869 - RNA, 24 nt, Human
ucgcucugucacccaggcuggagu

SEQ ID NO: 554870 - RNA, 24 nt, Human
ucgcuguguugcccaggcuggagu

SEQ ID NO: 554871 - RNA, 21 nt, Human
ucuagaaccugaagacagggc

SEQ ID NO: 554872 - RNA, 24 nt, Human
ucuccugccucagccucccgagua

SEQ ID NO: 554873 - RNA, 19 nt, Human
ucucgcucugucacccagg

SEQ ID NO: 554874 - RNA, 23 nt, Human
ucucgcucugucacccaggcugg

SEQ ID NO: 554875 - RNA, 24 nt, Human
ucucgcucugucacccaggcugga

SEQ ID NO: 554876 - RNA, 26 nt, Human
ucucgcucugucacccaggcuggagu

SEQ ID NO: 554877 - RNA, 27 nt, Human
ucucgcucugucacccaggcuggagug

SEQ ID NO: 554878 - RNA, 23 nt, Human
ucucgcuguguugcccaggcugg

SEQ ID NO: 554879 - RNA, 24 nt, Human
ucucgcuguguugcccaggcugga

SEQ ID NO: 554880 - RNA, 24 nt, Human
ucugucacccaggcuggagugcag

SEQ ID NO: 554881 - RNA, 23 nt, Human
ucuuacuacauugcccaggcugg

SEQ ID NO: 554882 - RNA, 23 nt, Human
ucuugaacuccugaccucaggug

SEQ ID NO: 554883 - RNA, 18 nt, Human
ugaccucaggugauccgc

SEQ ID NO: 554884 - RNA, 24 nt, Human
ugaccucaggugauccgccugccu

SEQ ID NO: 554885 - RNA, 22 nt, Human
ugaccuggucccagcccuguag

SEQ ID NO: 554886 - RNA, 22 nt, Human
ugagacagggucucgcucuguc

SEQ ID NO: 554887 - RNA, 21 nt, Human
ugagggcuucccugaagggac

SEQ ID NO: 554888 - RNA, 23 nt, Human
ugauuggcagauacaugcugcug

SEQ ID NO: 554889 - RNA, 18 nt, Human
ugcccaggcuggagugca

SEQ ID NO: 554890 - RNA, 22 nt, Human
ugcccaggcuggagugcagugg

SEQ ID NO: 554891 - RNA, 24 nt, Human
ugcccaggcuggagugcaguggca

SEQ ID NO: 554892 - RNA, 23 nt, Human
ugcccaggcuggucuugaacucu

SEQ ID NO: 554893 - RNA, 24 nt, Human
ugccucagccucccaaagugcugg

SEQ ID NO: 554894 - RNA, 24 nt, Human
ugccucagccucccgaguagcugg

SEQ ID NO: 554895 - RNA, 22 nt, Human
ugccucccgggcucaagcaauu

SEQ ID NO: 554896 - RNA, 19 nt, Human
ugcggaggggaggggaugg

SEQ ID NO: 554897 - RNA, 21 nt, Human
uggaagaagcuucuucuggua

SEQ ID NO: 554898 - RNA, 24 nt, Human
uggaauuacaggugcacaccacca

SEQ ID NO: 554899 - RNA, 18 nt, Human
uggacuacagguguguac

SEQ ID NO: 554900 - RNA, 19 nt, Human
uggagugcaguggcaugau

SEQ ID NO: 554901 - RNA, 24 nt, Human
uggagugcaguggcaugaucuugg

SEQ ID NO: 554902 - RNA, 19 nt, Human
uggagugcagugguaugau

SEQ ID NO: 554903 - RNA, 21 nt, Human
uggagugcagugguaugauca

SEQ ID NO: 554904 - RNA, 24 nt, Human
uggagugcagugguaugaucaugg

SEQ ID NO: 554905 - RNA, 19 nt, Human
uggcaugaucuugguucac

SEQ ID NO: 554906 - RNA, 21 nt, Human
uggcaugaucuugguucacug

SEQ ID NO: 554907 - RNA, 24 nt, Human
uggccaggcuggucuugaacuccu

SEQ ID NO: 554908 - RNA, 18 nt, Human
uggcccggggccuggcgg

SEQ ID NO: 554909 - RNA, 18 nt, Human
ugggauuacaggcaugag

SEQ ID NO: 554910 - RNA, 21 nt, Human
ugggauuacaggcaugagcca

SEQ ID NO: 554911 - RNA, 22 nt, Human
ugggauuacaggcaugagccac

SEQ ID NO: 554912 - RNA, 22 nt, Human
ugggauuacaggcaugagccac

SEQ ID NO: 554913 - RNA, 22 nt, Human
ugggauuacaggcaugagccac

SEQ ID NO: 554914 - RNA, 23 nt, Human
ugggauuacaggcaugagccacu

SEQ ID NO: 554915 - RNA, 24 nt, Human
ugggauuacaggcaugagccacug

SEQ ID NO: 554916 - RNA, 18 nt, Human
uggggcucaacugauccu

SEQ ID NO: 554917 - RNA, 18 nt, Human
uggggcuggaucggaggg

SEQ ID NO: 554918 - RNA, 24 nt, Human
ugguaugaucauggcucacuauag

SEQ ID NO: 554919 - RNA, 23 nt, Human
uggugcggaggggaggggauggu

SEQ ID NO: 554920 - RNA, 18 nt, Human
uguguugcccaggcugga

SEQ ID NO: 554921 - RNA, 24 nt, Human
uguguugcccaggcuggagugcag

SEQ ID NO: 554922 - RNA, 18 nt, Human
uuaguagagacgggguuu

SEQ ID NO: 554923 - RNA, 22 nt, Human
uuaguagagacgggguuucacc

SEQ ID NO: 554924 - RNA, 24 nt, Human
uuaguagagacgggguuucaccau

SEQ ID NO: 554925 - RNA, 24 nt, Human
uucuuuuuuuuuuuugagacaggg

SEQ ID NO: 554926 - RNA, 22 nt, Human
uugagacagggucucgcucugu

SEQ ID NO: 554927 - RNA, 24 nt, Human
uuucaccauguuggccaggcuggu

SEQ ID NO: 554928 - RNA, 24 nt, Human
uuuuuaguagagacgggguuucac

SEQ ID NO: 554929 - RNA, 21 nt, Human
uuuuuggauuuuuaguagaga

SEQ ID NO: 554930 - RNA, 24 nt, Human
uuuuuuggauuuuuaguagagacg

SEQ ID NO: 554931 - RNA, 24 nt, Human
uuuuuuuuuugagacagggucucg

SEQ ID NO: 554932 - RNA, 20 nt, Human
uuuuuuuuuuugagacaggg

SEQ ID NO: 554933 - RNA, 23 nt, Human
uuuuuuuuuuuugagacaggguc

SEQ ID NO: 554934 - RNA, 25 nt, Human
uuuuuuuuuuuugagacagggucuc

SEQ ID NO: 554935 - RNA, 26 nt, Human
accccaaguaaauacagggaaaagga

SEQ ID NO: 554936 - RNA, 22 nt, Human
agacggccugcagggcuggagc

SEQ ID NO: 554937 - RNA, 20 nt, Human
agcugaggccaggguggcca

SEQ ID NO: 554938 - RNA, 22 nt, Human
agugcaggggucagggagaugc

SEQ ID NO: 554939 - RNA, 21 nt, Human
caccccaaguaaauacaggga

SEQ ID NO: 554940 - RNA, 18 nt, Human
ccaaguaaauacagggaa

SEQ ID NO: 554941 - RNA, 20 nt, Human
ccaccugugaagaggugccu

SEQ ID NO: 554942 - RNA, 21 nt, Human
ccucggaggaaaagagguaag

SEQ ID NO: 554943 - RNA, 19 nt, Human
ccugcagggcuggagcugg

SEQ ID NO: 554944 - RNA, 22 nt, Human
ccugcagggcuggagcugggag

SEQ ID NO: 554945 - RNA, 23 nt, Human
ccugcagggcuggagcugggagg

SEQ ID NO: 554946 - RNA, 21 nt, Human
ccuuggaggccaggaacaagc

SEQ ID NO: 554947 - RNA, 22 nt, Human
gagcccuggcacacgccagcuu

SEQ ID NO: 554948 - RNA, 20 nt, Human
gaggaaaagagguaaggggc

SEQ ID NO: 554949 - RNA, 19 nt, Human
gaguuggcagcacguggga

SEQ ID NO: 554950 - RNA, 20 nt, Human
gcugcuuucuuccccuaaau

SEQ ID NO: 554951 - RNA, 20 nt, Human
gggaaggaggcuauguuuga

SEQ ID NO: 554952 - RNA, 24 nt, Human
gggagggcggacacacagaagcug

SEQ ID NO: 554953 - RNA, 22 nt, Human
gggcggagagcgacagggcgau

SEQ ID NO: 554954 - RNA, 23 nt, Human
gucacagaagagcaccccaagua

SEQ ID NO: 554955 - RNA, 19 nt, Human
uacuggaaggugguggugg

SEQ ID NO: 554956 - RNA, 22 nt, Human
ugaagaaaaaguacagcucuac

SEQ ID NO: 554957 - RNA, 21 nt, Human
ugaggccaggguggccagcug

SEQ ID NO: 554958 - RNA, 22 nt, Human
ugaggccaggguggccagcugg

SEQ ID NO: 554959 - RNA, 22 nt, Human
ugagggagcugaggccagggug

SEQ ID NO: 554960 - RNA, 18 nt, Human
ugcugucaggcauggcac

SEQ ID NO: 554961 - RNA, 23 nt, Human
ugcuuucuuccccuaaauguuua

SEQ ID NO: 554962 - RNA, 18 nt, Human
uggaagguggugguggca

SEQ ID NO: 554963 - RNA, 27 nt, Human
uggaagguggugguggcaagugucaca

SEQ ID NO: 554964 - RNA, 21 nt, Human
uggagcugggagggcggacac

SEQ ID NO: 554965 - RNA, 23 nt, Human
ugggcugcuuucuuccccuaaau

SEQ ID NO: 554966 - RNA, 25 nt, Human
uucccauuuuucuccuugcucccaa

SEQ ID NO: 554967 - RNA, 22 nt, Human
uuugaguuggcagcacguggga

SEQ ID NO: 554968 - RNA, 22 nt, Human
aaaaaaaauccaaguuucagga

SEQ ID NO: 554969 - RNA, 25 nt, Human
aaaaacacaaagcaaacccaaacaa

SEQ ID NO: 554970 - RNA, 26 nt, Human
aaaaucucuaggguucucuggaacac

SEQ ID NO: 554971 - RNA, 23 nt, Human
aaacacaaagcaaacccaaacaa

SEQ ID NO: 554972 - RNA, 21 nt, Human
aaacagaagcaguauuuacaa

SEQ ID NO: 554973 - RNA, 24 nt, Human
aacaaauucacaugacccccaaga

SEQ ID NO: 554974 - RNA, 24 nt, Human
aacauacuuaauccuaacauaaaa

SEQ ID NO: 554975 - RNA, 25 nt, Human
aagaaguuguuuucccagucuuaaa

SEQ ID NO: 554976 - RNA, 22 nt, Human
aaggagaaacaaaacagaagca

SEQ ID NO: 554977 - RNA, 21 nt, Human
auagaacccagggccugaaac

SEQ ID NO: 554978 - RNA, 25 nt, Human
caaaaacacaaagcaaacccaaaca

SEQ ID NO: 554979 - RNA, 19 nt, Human
caaaaacacuguaagaagu

SEQ ID NO: 554980 - RNA, 19 nt, Human
cacaaagcaaacccaaaca

SEQ ID NO: 554981 - RNA, 21 nt, Human
cacugaacagugaaaaacaag

SEQ ID NO: 554982 - RNA, 27 nt, Human
cagggccugaaacaauauuucaugcua

SEQ ID NO: 554983 - RNA, 19 nt, Human
caguguuaacccuacaaag

SEQ ID NO: 554984 - RNA, 23 nt, Human
caguucccucuccauuucuagau

SEQ ID NO: 554985 - RNA, 26 nt, Human
caugacccccaagauacuuucucaaa

SEQ ID NO: 554986 - RNA, 21 nt, Human
cucauaaucuacauuuaggcc

SEQ ID NO: 554987 - RNA, 20 nt, Human
cuccuggaagagaaaaaaaa

SEQ ID NO: 554988 - RNA, 22 nt, Human
cugcaagaagucuuuucacaga

SEQ ID NO: 554989 - RNA, 20 nt, Human
cuuuaaauuaaauccaagga

SEQ ID NO: 554990 - RNA, 20 nt, Human
gaacccagggccugaaacaa

SEQ ID NO: 554991 - RNA, 25 nt, Human
gcagagaacaauuuaguuauuuaca

SEQ ID NO: 554992 - RNA, 23 nt, Human
gccacugaacagugaaaaacaaa

SEQ ID NO: 554993 - RNA, 20 nt, Human
gguuagagacuauggagccc

SEQ ID NO: 554994 - RNA, 22 nt, Human
uaaaacagcagaaauucucugg

SEQ ID NO: 554995 - RNA, 20 nt, Human
uaaaggagaaacaaaacaga

SEQ ID NO: 554996 - RNA, 19 nt, Human
uagaacccagggccugaaa

SEQ ID NO: 554997 - RNA, 26 nt, Human
uauauaauuacaaaaaaaauccaagu

SEQ ID NO: 554998 - RNA, 21 nt, Human
ucaacaaauucacaugacccc

SEQ ID NO: 554999 - RNA, 24 nt, Human
ucaggaaaacauacuuaauccuaa

SEQ ID NO: 555000 - RNA, 23 nt, Human
ucucugguuagagacuauggagc

SEQ ID NO: 555001 - RNA, 18 nt, Human
ugaaaaacaaguugaauc

SEQ ID NO: 555002 - RNA, 22 nt, Human
ugaaaaacaaguugaaucuuua

SEQ ID NO: 555003 - RNA, 25 nt, Human
ugaaucuuuaaaacagcagaaauuc

SEQ ID NO: 555004 - RNA, 22 nt, Human
uguaagaaguuguuuucccagu

SEQ ID NO: 555005 - RNA, 22 nt, Human
uguauaaaggagaaacaaaaca

SEQ ID NO: 555006 - RNA, 28 nt, Human
uguccauuucucucaacaaauucacaug

SEQ ID NO: 555007 - RNA, 20 nt, Human
ugucuaaggacaaaccacua

SEQ ID NO: 555008 - RNA, 18 nt, Human
ugugaguacaaaauauua

SEQ ID NO: 555009 - RNA, 18 nt, Human
uuaaaacagcagaaauuc

SEQ ID NO: 555010 - RNA, 26 nt, Human
uuaauccuaacauaaaauucauguca

SEQ ID NO: 555011 - RNA, 27 nt, Human
uucacagaaugagucacauaguuucuc

SEQ ID NO: 555012 - RNA, 18 nt, Human
uucccagucuuaaagcug

SEQ ID NO: 555013 - RNA, 18 nt, Human
uugacauuaaauuggaag

SEQ ID NO: 555014 - RNA, 23 nt, Human
uugccuggcuuaucugcaguguu

SEQ ID NO: 555015 - RNA, 26 nt, Human
uuuaaacuacaugagauguugugaac

SEQ ID NO: 555016 - RNA, 22 nt, Human
uuuuuuuuuuuuuuuuuccuuu

SEQ ID NO: 555017 - RNA, 22 nt, Human
aaaaaagagaacagcaaaaugu

SEQ ID NO: 555018 - RNA, 24 nt, Human
aaaaaagagaacagcaaaaugugu

SEQ ID NO: 555019 - RNA, 25 nt, Human
aaaaaagagaacagcaaaaugugua

SEQ ID NO: 555020 - RNA, 24 nt, Human
aaaaacaaugaauuuuaaaaagca

SEQ ID NO: 555021 - RNA, 21 nt, Human
aaagaugcaauucuuacuuuc

SEQ ID NO: 555022 - RNA, 20 nt, Human
aaauauauaauaccaggagc

SEQ ID NO: 555023 - RNA, 21 nt, Human
aacaaaaaagaaagcugcaca

SEQ ID NO: 555024 - RNA, 18 nt, Human
aacaaauaaauuggucag

SEQ ID NO: 555025 - RNA, 19 nt, Human
aacugcauuaccaaacuuu

SEQ ID NO: 555026 - RNA, 21 nt, Human
aacuguacuaaggacuucauc

SEQ ID NO: 555027 - RNA, 23 nt, Human
aagaaccaaaauaugcacaccac

SEQ ID NO: 555028 - RNA, 22 nt, Human
aagcaaaaauuuaagaaccaaa

SEQ ID NO: 555029 - RNA, 18 nt, Human
aaggacuucauccaacca

SEQ ID NO: 555030 - RNA, 21 nt, Human
aaggacuucauccaaccaaaa

SEQ ID NO: 555031 - RNA, 19 nt, Human
aaguuaaugcuugugcuau

SEQ ID NO: 555032 - RNA, 20 nt, Human
acacauucuucagcaaaacu

SEQ ID NO: 555033 - RNA, 18 nt, Human
acaccacugaaaauacua

SEQ ID NO: 555034 - RNA, 22 nt, Human
acaguugaaaaagaaauuuuaa

SEQ ID NO: 555035 - RNA, 20 nt, Human
acugugccauuaggcaaagc

SEQ ID NO: 555036 - RNA, 21 nt, Human
agaaaacaacaaauaaauugg

SEQ ID NO: 555037 - RNA, 23 nt, Human
agaacagcaaaauguguaaaaga

SEQ ID NO: 555038 - RNA, 19 nt, Human
agucuuuaaugcucuguuu

SEQ ID NO: 555039 - RNA, 23 nt, Human
caaaacaaaucuuaagcuucaga

SEQ ID NO: 555040 - RNA, 26 nt, Human
caaaacaauugauuagucuuuaaugc

SEQ ID NO: 555041 - RNA, 19 nt, Human
caaaucuuaagcuucagaa

SEQ ID NO: 555042 - RNA, 20 nt, Human
caacccacagaaaacaacaa

SEQ ID NO: 555043 - RNA, 19 nt, Human
caccauuucagacuaccaa

SEQ ID NO: 555044 - RNA, 22 nt, Human
cagcaaaacuuuaaaaggcaga

SEQ ID NO: 555045 - RNA, 23 nt, Human
cagcaaguuccaaaaauuucaca

SEQ ID NO: 555046 - RNA, 21 nt, Human
caggauuuuuuuaguuuaaga

SEQ ID NO: 555047 - RNA, 20 nt, Human
cagggacaaauguaggaaga

SEQ ID NO: 555048 - RNA, 22 nt, Human
cauuucagacuaccaaaugcua

SEQ ID NO: 555049 - RNA, 23 nt, Human
cauuucagacuaccaaaugcuaa

SEQ ID NO: 555050 - RNA, 18 nt, Human
ccacagacacauucuuca

SEQ ID NO: 555051 - RNA, 22 nt, Human
ccuguccagcaaguuccaaaaa

SEQ ID NO: 555052 - RNA, 22 nt, Human
cugcacauggucacucugugug

SEQ ID NO: 555053 - RNA, 20 nt, Human
cuuacuuucuugguggugaa

SEQ ID NO: 555054 - RNA, 22 nt, Human
cuuuucuguuguuuuuuccaca

SEQ ID NO: 555055 - RNA, 19 nt, Human
gacuggugaggcaaaacaa

SEQ ID NO: 555056 - RNA, 21 nt, Human
gagcaguuucaaauuaaauua

SEQ ID NO: 555057 - RNA, 18 nt, Human
gcacuaaaagacaaaaac

SEQ ID NO: 555058 - RNA, 23 nt, Human
gcuugcuuuuuguuuguuuuugc

SEQ ID NO: 555059 - RNA, 20 nt, Human
guccagcaaguuccaaaaau

SEQ ID NO: 555060 - RNA, 20 nt, Human
guggcaucuaacaaaaaaga

SEQ ID NO: 555061 - RNA, 25 nt, Human
uaaaagaaauauaagguggaaaaau

SEQ ID NO: 555062 - RNA, 23 nt, Human
uaaaaugacuggugaggcaaaac

SEQ ID NO: 555063 - RNA, 20 nt, Human
uaacaaaaaagagaacagca

SEQ ID NO: 555064 - RNA, 19 nt, Human
uaacaaguaaucugucacc

SEQ ID NO: 555065 - RNA, 24 nt, Human
uaagaagcaaaaauuuaagaacca

SEQ ID NO: 555066 - RNA, 25 nt, Human
uaaguauauauucccaccuuugcaa

SEQ ID NO: 555067 - RNA, 19 nt, Human
uauccuaaccacagacaca

SEQ ID NO: 555068 - RNA, 22 nt, Human
uaugcacaccacugaaaauacu

SEQ ID NO: 555069 - RNA, 27 nt, Human
ucaaaggcaaacauuuaauagucaagc

SEQ ID NO: 555070 - RNA, 20 nt, Human
ucagcaaaacuuuaaaaggc

SEQ ID NO: 555071 - RNA, 21 nt, Human
ucagcaaaacuuuaaaaggca

SEQ ID NO: 555072 - RNA, 18 nt, Human
ucagggacaaauguagga

SEQ ID NO: 555073 - RNA, 22 nt, Human
ucucagggacaaauguaggaag

SEQ ID NO: 555074 - RNA, 21 nt, Human
ugauugucauuuuacaaagau

SEQ ID NO: 555075 - RNA, 19 nt, Human
uggcauaacaauaacaaaa

SEQ ID NO: 555076 - RNA, 26 nt, Human
uggcauaacaauaacaaaaaagagaa

SEQ ID NO: 555077 - RNA, 24 nt, Human
uguccagcaaguuccaaaaauuuc

SEQ ID NO: 555078 - RNA, 18 nt, Human
uuaaugcucuguuuuuca

SEQ ID NO: 555079 - RNA, 20 nt, Human
uuauaugaaaaaccuaugcu

SEQ ID NO: 555080 - RNA, 22 nt, Human
uucagaacucucuaaugcuuaa

SEQ ID NO: 555081 - RNA, 21 nt, Human
uucuugguggugaagccuaug

SEQ ID NO: 555082 - RNA, 22 nt, Human
uucuugguggugaagccuaugg

SEQ ID NO: 555083 - RNA, 18 nt, Human
uugguggugaagccuaug

SEQ ID NO: 555084 - RNA, 23 nt, Human
uuuaaaacauuagauaacuagca

SEQ ID NO: 555085 - RNA, 20 nt, Human
uuuaagcacugagaaauaag

SEQ ID NO: 555086 - RNA, 18 nt, Human
uuucuugguggugaagcc

SEQ ID NO: 555087 - RNA, 24 nt, Human
uuucuugguggugaagccuauggg

SEQ ID NO: 555088 - RNA, 22 nt, Human
uuuuccacagaaauagagacug

SEQ ID NO: 555089 - RNA, 19 nt, Human
uuuuguuuguuuuugcuuu

SEQ ID NO: 555090 - RNA, 23 nt, Human
uuuuguuuguuuuugcuuugucc

SEQ ID NO: 555091 - RNA, 21 nt, Human
uuuuucaacuguacuaaggac

SEQ ID NO: 555092 - RNA, 19 nt, Human
aacggcgcggggcacccug

SEQ ID NO: 555093 - RNA, 20 nt, Human
aacugcauuucuccccucca

SEQ ID NO: 555094 - RNA, 18 nt, Human
acaaaugaaguguccaaa

SEQ ID NO: 555095 - RNA, 19 nt, Human
acccugcgggguggcgggc

SEQ ID NO: 555096 - RNA, 21 nt, Human
agacggauggggagacggggc

SEQ ID NO: 555097 - RNA, 25 nt, Human
cauuucuccccuccaauguccucuc

SEQ ID NO: 555098 - RNA, 24 nt, Human
ccaauguccucuccaugacuuauc

SEQ ID NO: 555099 - RNA, 22 nt, Human
cccgcgacgggggcggcggggc

SEQ ID NO: 555100 - RNA, 23 nt, Human
cgggaacggcgcggggcacccug

SEQ ID NO: 555101 - RNA, 18 nt, Human
cugcauuucuccccucca

SEQ ID NO: 555102 - RNA, 27 nt, Human
cugcauuucuccccuccaauguccucu

SEQ ID NO: 555103 - RNA, 21 nt, Human
ggauggggagacggggccggc

SEQ ID NO: 555104 - RNA, 19 nt, Human
gggggcggcggggcggcgg

SEQ ID NO: 555105 - RNA, 24 nt, Human
gguggcgggcgcggagaggaucuc

SEQ ID NO: 555106 - RNA, 28 nt, Human
uccaaaugccauauucccagcucuccag

SEQ ID NO: 555107 - RNA, 22 nt, Human
ugaaguguugucgugugcuggg

SEQ ID NO: 555108 - RNA, 24 nt, Human
ugccacccggggcggaugcucggg

SEQ ID NO: 555109 - RNA, 18 nt, Human
ugccauauucccagcucu

SEQ ID NO: 555110 - RNA, 23 nt, Human
uggggagacggggccggccuggu

SEQ ID NO: 555111 - RNA, 18 nt, Human
uucuagugagaaguucac

SEQ ID NO: 555112 - RNA, 18 nt, Human
aaacagaugcccaaaucu

SEQ ID NO: 555113 - RNA, 23 nt, Human
aacagaaaguaauugcaacugcu

SEQ ID NO: 555114 - RNA, 25 nt, Human
aacuaaucuacuuaacacccuacca

SEQ ID NO: 555115 - RNA, 18 nt, Human
aagcagacaaaaugucag

SEQ ID NO: 555116 - RNA, 19 nt, Human
aagccagaagcagacaaaa

SEQ ID NO: 555117 - RNA, 26 nt, Human
acuuaacacccuaccaucacaucucu

SEQ ID NO: 555118 - RNA, 19 nt, Human
agacagaaaauauaaaaau

SEQ ID NO: 555119 - RNA, 27 nt, Human
agacagaaaauauaaaaauuaccaaaa

SEQ ID NO: 555120 - RNA, 24 nt, Human
agauuauuugaauaaagccagaag

SEQ ID NO: 555121 - RNA, 23 nt, Human
agccacgcuagcgcgucagccuc

SEQ ID NO: 555122 - RNA, 23 nt, Human
auagcccuguaauaacagaaagu

SEQ ID NO: 555123 - RNA, 18 nt, Human
augcagaagcauaaagca

SEQ ID NO: 555124 - RNA, 27 nt, Human
cacaacccaaaucuaggaauaaaaucc

SEQ ID NO: 555125 - RNA, 18 nt, Human
cacacaacccaaaucuag

SEQ ID NO: 555126 - RNA, 21 nt, Human
cagaaaguaauugcaacugcu

SEQ ID NO: 555127 - RNA, 19 nt, Human
cagaagcauaaagcaaaaa

SEQ ID NO: 555128 - RNA, 21 nt, Human
cagaugcccaaaucugauuca

SEQ ID NO: 555129 - RNA, 20 nt, Human
caguucccaagaucugaaaa

SEQ ID NO: 555130 - RNA, 23 nt, Human
cccaaaucuaggaauaaaaucca

SEQ ID NO: 555131 - RNA, 22 nt, Human
cuuagagccacgcuagcgcguc

SEQ ID NO: 555132 - RNA, 19 nt, Human
gaaagccuaucugcaaaaa

SEQ ID NO: 555133 - RNA, 19 nt, Human
gaagcauaaagcaaaaaaa

SEQ ID NO: 555134 - RNA, 20 nt, Human
gacaaggugggcugacugag

SEQ ID NO: 555135 - RNA, 23 nt, Human
gcaggacaaggugggcugacuga

SEQ ID NO: 555136 - RNA, 19 nt, Human
uaaaaaacacagcaguuau

SEQ ID NO: 555137 - RNA, 24 nt, Human
uaacagaaaguaauugcaacugcu

SEQ ID NO: 555138 - RNA, 23 nt, Human
uaauacacacaaaagugugagaa

SEQ ID NO: 555139 - RNA, 22 nt, Human
uaauaguaagggucagaaaauc

SEQ ID NO: 555140 - RNA, 23 nt, Human
uacacacaaaagugugagaacac

SEQ ID NO: 555141 - RNA, 26 nt, Human
uauaaaaaacacagcaguuauagcug

SEQ ID NO: 555142 - RNA, 19 nt, Human
ucaaaaagaugcagaagca

SEQ ID NO: 555143 - RNA, 21 nt, Human
ucaugccuaacagaucacagg

SEQ ID NO: 555144 - RNA, 23 nt, Human
ucuuuucuuguaauugauuuaug

SEQ ID NO: 555145 - RNA, 19 nt, Human
ugagcaaauauucacauca

SEQ ID NO: 555146 - RNA, 19 nt, Human
ugauaaaauaagccaucaa

SEQ ID NO: 555147 - RNA, 21 nt, Human
uggaaaaaacagaugcccaaa

SEQ ID NO: 555148 - RNA, 26 nt, Human
uggaaaaaacagaugcccaaaucuga

SEQ ID NO: 555149 - RNA, 19 nt, Human
ugggaaagauauuauaaua

SEQ ID NO: 555150 - RNA, 27 nt, Human
uuaacacccuaccaucacaucucuuua

SEQ ID NO: 555151 - RNA, 24 nt, Human
uuuccagaauuuaauauuuuuaaa

SEQ ID NO: 555152 - RNA, 23 nt, Human
uuugauuucacacaaaaauagca

SEQ ID NO: 555153 - RNA, 24 nt, Human
uuuuuuuuuuuuuguuuuuuccag

SEQ ID NO: 555154 - RNA, 24 nt, Human
uuuuuuuuuuuuuuuugcuucuaa

SEQ ID NO: 555155 - RNA, 18 nt, Human
uuuuuuuuuuuuuuuuug

SEQ ID NO: 555156 - RNA, 21 nt, Human
uuuuuuuuuuuuuuuuugcuu

SEQ ID NO: 555157 - RNA, 23 nt, Human
uuuuuuuuuuuuuuuuuguuuuu

SEQ ID NO: 555158 - RNA, 20 nt, Human
uuuuuuuuuuuuuuuuuugg

SEQ ID NO: 555159 - RNA, 18 nt, Human
aacagauggaaaaccaga

SEQ ID NO: 555160 - RNA, 23 nt, Human
aaccugccugcuucacagaccug

SEQ ID NO: 555161 - RNA, 20 nt, Human
acauauaaaaaauacagaaa

SEQ ID NO: 555162 - RNA, 18 nt, Human
agaaauaaggaaaacaag

SEQ ID NO: 555163 - RNA, 18 nt, Human
cagauggaaaaccagaca

SEQ ID NO: 555164 - RNA, 22 nt, Human
cagcugagcaaccugccugcuu

SEQ ID NO: 555165 - RNA, 24 nt, Human
cuaacagauggaaaaccagacaua

SEQ ID NO: 555166 - RNA, 19 nt, Human
gaaaaaaagcuuuagaaag

SEQ ID NO: 555167 - RNA, 19 nt, Human
ggaaaaccagacauauuua

SEQ ID NO: 555168 - RNA, 23 nt, Human
ggaaauacacacaaugaaaaaaa

SEQ ID NO: 555169 - RNA, 24 nt, Human
gggaaauacacacaaugaaaaaaa

SEQ ID NO: 555170 - RNA, 22 nt, Human
uaaaaugucugaaaugcuaaca

SEQ ID NO: 555171 - RNA, 18 nt, Human
uaagaggaacauaaaaug

SEQ ID NO: 555172 - RNA, 24 nt, Human
uacaaaaauauuaaaacagauuuc

SEQ ID NO: 555173 - RNA, 24 nt, Human
uacuacaccgauuucaacauaaaa

SEQ ID NO: 555174 - RNA, 21 nt, Human
uauguacauacaagagacaua

SEQ ID NO: 555175 - RNA, 24 nt, Human
ucaguaacaauugauuuaauaaga

SEQ ID NO: 555176 - RNA, 25 nt, Human
uccgggggcagcugagcaaccugcc

SEQ ID NO: 555177 - RNA, 21 nt, Human
ugucugaaaugcuaacagaug

SEQ ID NO: 555178 - RNA, 18 nt, Human
uucagaaauaaggaaaac

SEQ ID NO: 555179 - RNA, 20 nt, Human
uugcauggguuuccuuuacc

SEQ ID NO: 555180 - RNA, 21 nt, Human
uuuuuuuuuuuuuuuuuuaag

SEQ ID NO: 555181 - RNA, 24 nt, Human
aaagugcugggauuacaggcguga

SEQ ID NO: 555182 - RNA, 19 nt, Human
aagugcugggauuacaggc

SEQ ID NO: 555183 - RNA, 19 nt, Human
aagugcugggauuacaggc

SEQ ID NO: 555184 - RNA, 26 nt, Human
aagugcugggauuacaggcgugagcc

SEQ ID NO: 555185 - RNA, 23 nt, Human
acaaaacgucagagcuaugugac

SEQ ID NO: 555186 - RNA, 23 nt, Human
acaggcgcccgccaccacgcccg

SEQ ID NO: 555187 - RNA, 18 nt, Human
acaggguuucaccguguu

SEQ ID NO: 555188 - RNA, 23 nt, Human
acaggguuucaccguguuggcca

SEQ ID NO: 555189 - RNA, 24 nt, Human
acaggguuucaccguguuggccag

SEQ ID NO: 555190 - RNA, 24 nt, Human
acccaggcuggagugcaguggcgu

SEQ ID NO: 555191 - RNA, 19 nt, Human
acugcaagcucugccuucc

SEQ ID NO: 555192 - RNA, 18 nt, Human
agacaggguuucaccgug

SEQ ID NO: 555193 - RNA, 19 nt, Human
agagacaggguuucaccgu

SEQ ID NO: 555194 - RNA, 23 nt, Human
aggcgugagccacagugcccggc

SEQ ID NO: 555195 - RNA, 25 nt, Human
aggcuggagugcaguggcgugaucu

SEQ ID NO: 555196 - RNA, 20 nt, Human
aguagagacaggguuucacc

SEQ ID NO: 555197 - RNA, 18 nt, Human
aguagcugggacuacagg

SEQ ID NO: 555198 - RNA, 19 nt, Human
aguagcugggacuacaggc

SEQ ID NO: 555199 - RNA, 19 nt, Human
agugcaguggcgugaucuc

SEQ ID NO: 555200 - RNA, 20 nt, Human
agugcaguggcgugaucucg

SEQ ID NO: 555201 - RNA, 23 nt, Human
agugcaguggcgugaucucggcu

SEQ ID NO: 555202 - RNA, 24 nt, Human
agugcaguggcgugaucucggcuc

SEQ ID NO: 555203 - RNA, 18 nt, Human
agugcugggauuacaggc

SEQ ID NO: 555204 - RNA, 24 nt, Human
augcucagcuccugccuuccucgg

SEQ ID NO: 555205 - RNA, 24 nt, Human
caaagugcugggauuacaggcgug

SEQ ID NO: 555206 - RNA, 21 nt, Human
cacagugcccggccugaaaac

SEQ ID NO: 555207 - RNA, 24 nt, Human
cacccaggcuggagugcaguggcg

SEQ ID NO: 555208 - RNA, 19 nt, Human
caccccaugcucagcuccu

SEQ ID NO: 555209 - RNA, 21 nt, Human
caccccaugcucagcuccugc

SEQ ID NO: 555210 - RNA, 18 nt, Human
caccguguuggccaggau

SEQ ID NO: 555211 - RNA, 21 nt, Human
caccguguuggccaggauggu

SEQ ID NO: 555212 - RNA, 24 nt, Human
caccguguuggccaggauggucuc

SEQ ID NO: 555213 - RNA, 23 nt, Human
caccugccucggucucccaaagu

SEQ ID NO: 555214 - RNA, 23 nt, Human
cacugcaagcucugccuuccggg

SEQ ID NO: 555215 - RNA, 22 nt, Human
caggauggucucugucuccuga

SEQ ID NO: 555216 - RNA, 21 nt, Human
caggcgcccgccaccacgccc

SEQ ID NO: 555217 - RNA, 24 nt, Human
caggguuucaccguguuggccagg

SEQ ID NO: 555218 - RNA, 22 nt, Human
ccaaagugcugggauuacaggc

SEQ ID NO: 555219 - RNA, 22 nt, Human
ccaaagugcugggauuacaggc

SEQ ID NO: 555220 - RNA, 24 nt, Human
ccaaagugcugggauuacaggcgu

SEQ ID NO: 555221 - RNA, 22 nt, Human
ccacaccugcacccgccucccc

SEQ ID NO: 555222 - RNA, 23 nt, Human
cccgaguagcugggacuacaggc

SEQ ID NO: 555223 - RNA, 24 nt, Human
cccgaguagcugggacuacaggcg

SEQ ID NO: 555224 - RNA, 22 nt, Human
ccggguucacgccauucuucug

SEQ ID NO: 555225 - RNA, 21 nt, Human
ccuccaggcggcgggcggcuc

SEQ ID NO: 555226 - RNA, 19 nt, Human
ccugaccucgugauccacc

SEQ ID NO: 555227 - RNA, 21 nt, Human
ccugaccucgugauccaccug

SEQ ID NO: 555228 - RNA, 22 nt, Human
ccugcacccgccuccuacgcaa

SEQ ID NO: 555229 - RNA, 22 nt, Human
ccuuccggguucacgccauucu

SEQ ID NO: 555230 - RNA, 24 nt, Human
cgcucugucacccaggcuggagug

SEQ ID NO: 555231 - RNA, 20 nt, Human
cuacgcagggccgaagcucc

SEQ ID NO: 555232 - RNA, 24 nt, Human
cucacugcaagcucugccuuccgg

SEQ ID NO: 555233 - RNA, 18 nt, Human
cuccaggcggcgggcggc

SEQ ID NO: 555234 - RNA, 24 nt, Human
cuccugaccucgugauccaccugc

SEQ ID NO: 555235 - RNA, 24 nt, Human
cucgcucugucacccaggcuggag

SEQ ID NO: 555236 - RNA, 22 nt, Human
cugcacccgccuccuacgcagg

SEQ ID NO: 555237 - RNA, 23 nt, Human
cugcaucagccucccgaguagcu

SEQ ID NO: 555238 - RNA, 23 nt, Human
cugccucggucucccaaagugcu

SEQ ID NO: 555239 - RNA, 24 nt, Human
cugccucggucucccaaagugcug

SEQ ID NO: 555240 - RNA, 19 nt, Human
gaaccucuggcugacccag

SEQ ID NO: 555241 - RNA, 22 nt, Human
gaccucgugauccaccugccuc

SEQ ID NO: 555242 - RNA, 22 nt, Human
gaccucgugauccaccugccuc

SEQ ID NO: 555243 - RNA, 24 nt, Human
gaccucgugauccaccugccucgg

SEQ ID NO: 555244 - RNA, 25 nt, Human
gaguagcugggacuacaggcgcccg

SEQ ID NO: 555245 - RNA, 20 nt, Human
gaucccccgggcccgggccc

SEQ ID NO: 555246 - RNA, 18 nt, Human
gauuacaggcgugagcca

SEQ ID NO: 555247 - RNA, 19 nt, Human
gauuacaggcgugagccac

SEQ ID NO: 555248 - RNA, 19 nt, Human
gauuacaggcgugagccac

SEQ ID NO: 555249 - RNA, 20 nt, Human
gcaucagccucccgaguagc

SEQ ID NO: 555250 - RNA, 23 nt, Human
gcccggcuaauuuuuuguauuuu

SEQ ID NO: 555251 - RNA, 24 nt, Human
gccucggucucccaaagugcuggg

SEQ ID NO: 555252 - RNA, 20 nt, Human
gccugggaucccccgggccc

SEQ ID NO: 555253 - RNA, 25 nt, Human
gcucugucacccaggcuggagugca

SEQ ID NO: 555254 - RNA, 24 nt, Human
ggauggucucugucuccugaccuc

SEQ ID NO: 555255 - RNA, 22 nt, Human
ggcuggagugcaguggcgugau

SEQ ID NO: 555256 - RNA, 22 nt, Human
gggaucccccgggcccgggccc

SEQ ID NO: 555257 - RNA, 21 nt, Human
gggcggcucagcacccacacc

SEQ ID NO: 555258 - RNA, 22 nt, Human
ggguuucaccguguuggccagg

SEQ ID NO: 555259 - RNA, 24 nt, Human
gugauccaccugccucggucuccc

SEQ ID NO: 555260 - RNA, 21 nt, Human
gugaucucggcucacugcaag

SEQ ID NO: 555261 - RNA, 21 nt, Human
uaaguuaccacaagcugguag

SEQ ID NO: 555262 - RNA, 24 nt, Human
uaauuuuuuguauuuuuaguagag

SEQ ID NO: 555263 - RNA, 25 nt, Human
uaauuuuuuguauuuuuaguagaga

SEQ ID NO: 555264 - RNA, 23 nt, Human
uacaggcgcccgccaccacgccc

SEQ ID NO: 555265 - RNA, 23 nt, Human
uacaggcgugagccacagugccc

SEQ ID NO: 555266 - RNA, 22 nt, Human
uagagacaggguuucaccgugu

SEQ ID NO: 555267 - RNA, 21 nt, Human
uaguagagacaggguuucacc

SEQ ID NO: 555268 - RNA, 24 nt, Human
uaguagagacaggguuucaccgug

SEQ ID NO: 555269 - RNA, 26 nt, Human
uaguagagacaggguuucaccguguu

SEQ ID NO: 555270 - RNA, 24 nt, Human
ucacccaggcuggagugcaguggc

SEQ ID NO: 555271 - RNA, 24 nt, Human
ucaccguguuggccaggauggucu

SEQ ID NO: 555272 - RNA, 18 nt, Human
ucacugcaagcucugccu

SEQ ID NO: 555273 - RNA, 24 nt, Human
ucacugcaagcucugccuuccggg

SEQ ID NO: 555274 - RNA, 23 nt, Human
ucagagcuaugugacaguaaguu

SEQ ID NO: 555275 - RNA, 23 nt, Human
ucagccucccgaguagcugggac

SEQ ID NO: 555276 - RNA, 24 nt, Human
ucccaaagugcugggauuacaggc

SEQ ID NO: 555277 - RNA, 24 nt, Human
ucccgaguagcugggacuacaggc

SEQ ID NO: 555278 - RNA, 22 nt, Human
uccugaagcugucucccccucc

SEQ ID NO: 555279 - RNA, 24 nt, Human
ucgcucugucacccaggcuggagu

SEQ ID NO: 555280 - RNA, 19 nt, Human
ucucgcucugucacccagg

SEQ ID NO: 555281 - RNA, 23 nt, Human
ucucgcucugucacccaggcugg

SEQ ID NO: 555282 - RNA, 24 nt, Human
ucucgcucugucacccaggcugga

SEQ ID NO: 555283 - RNA, 26 nt, Human
ucucgcucugucacccaggcuggagu

SEQ ID NO: 555284 - RNA, 27 nt, Human
ucucgcucugucacccaggcuggagug

SEQ ID NO: 555285 - RNA, 24 nt, Human
ucugucacccaggcuggagugcag

SEQ ID NO: 555286 - RNA, 22 nt, Human
ugaagcugucucccccuccagg

SEQ ID NO: 555287 - RNA, 23 nt, Human
ugacccagacacaggauggacag

SEQ ID NO: 555288 - RNA, 23 nt, Human
ugaccucgugauccaccugccuc

SEQ ID NO: 555289 - RNA, 22 nt, Human
ugcaguggcgugaucucggcuc

SEQ ID NO: 555290 - RNA, 24 nt, Human
ugcaucagccucccgaguagcugg

SEQ ID NO: 555291 - RNA, 19 nt, Human
ugccuuccggguucacgcc

SEQ ID NO: 555292 - RNA, 25 nt, Human
ugcugggauuacaggcgugagccac

SEQ ID NO: 555293 - RNA, 19 nt, Human
uggagugcaguggcgugau

SEQ ID NO: 555294 - RNA, 23 nt, Human
uggagugcaguggcgugaucucg

SEQ ID NO: 555295 - RNA, 24 nt, Human
uggagugcaguggcgugaucucgg

SEQ ID NO: 555296 - RNA, 24 nt, Human
uggccaggauggucucugucuccu

SEQ ID NO: 555297 - RNA, 20 nt, Human
uggcgugaucucggcucacu

SEQ ID NO: 555298 - RNA, 21 nt, Human
ugggacuacaggcgcccgcca

SEQ ID NO: 555299 - RNA, 22 nt, Human
ugggacuacaggcgcccgccac

SEQ ID NO: 555300 - RNA, 24 nt, Human
ugggacuacaggcgcccgccacca

SEQ ID NO: 555301 - RNA, 18 nt, Human
ugggauuacaggcgugag

SEQ ID NO: 555302 - RNA, 19 nt, Human
ugggauuacaggcgugagc

SEQ ID NO: 555303 - RNA, 21 nt, Human
ugggauuacaggcgugagcca

SEQ ID NO: 555304 - RNA, 22 nt, Human
ugggauuacaggcgugagccac

SEQ ID NO: 555305 - RNA, 22 nt, Human
ugggauuacaggcgugagccac

SEQ ID NO: 555306 - RNA, 22 nt, Human
ugggauuacaggcgugagccac

SEQ ID NO: 555307 - RNA, 23 nt, Human
ugggauuacaggcgugagccaca

SEQ ID NO: 555308 - RNA, 26 nt, Human
ugggauuacaggcgugagccacagug

SEQ ID NO: 555309 - RNA, 27 nt, Human
ugggauuacaggcgugagccacagugc

SEQ ID NO: 555310 - RNA, 22 nt, Human
uuaguagagacaggguuucacc

SEQ ID NO: 555311 - RNA, 24 nt, Human
uuaguagagacaggguuucaccgu

SEQ ID NO: 555312 - RNA, 19 nt, Human
uuucaccguguuggccagg

SEQ ID NO: 555313 - RNA, 22 nt, Human
uuuuguauuuuuaguagagaca

SEQ ID NO: 555314 - RNA, 24 nt, Human
uuuuuaguagagacaggguuucac

SEQ ID NO: 555315 - RNA, 21 nt, Human
uuuuuguauuuuuaguagaga

SEQ ID NO: 555316 - RNA, 19 nt, Human
uuuuuuuuuuuuacugaaa

SEQ ID NO: 555317 - RNA, 23 nt, Human
uuuuuuuuuuuuuuuuuuacuga

SEQ ID NO: 555318 - RNA, 24 nt, Human
aaacagcacuacgacccucagaac

SEQ ID NO: 555319 - RNA, 27 nt, Human
aaacagcacuacgacccucagaacuca

SEQ ID NO: 555320 - RNA, 20 nt, Human
aacugaaguccuagcaauug

SEQ ID NO: 555321 - RNA, 19 nt, Human
acaaaauuaggaaaaauuc

SEQ ID NO: 555322 - RNA, 19 nt, Human
acugaaguccuagcaauug

SEQ ID NO: 555323 - RNA, 18 nt, Human
agaaacagcacuacgacc

SEQ ID NO: 555324 - RNA, 21 nt, Human
agaaacagcacuacgacccuc

SEQ ID NO: 555325 - RNA, 21 nt, Human
agacaauaguuucagaucaga

SEQ ID NO: 555326 - RNA, 20 nt, Human
aucccaauuuugacguuucc

SEQ ID NO: 555327 - RNA, 21 nt, Human
cauggagaagcugauucaaac

SEQ ID NO: 555328 - RNA, 19 nt, Human
cucagccgggaacuggugc

SEQ ID NO: 555329 - RNA, 18 nt, Human
cugaaguaaaaacugaag

SEQ ID NO: 555330 - RNA, 25 nt, Human
cugaaguaaaaacugaaguccuagc

SEQ ID NO: 555331 - RNA, 23 nt, Human
cugagcgaccugcgaucuccacc

SEQ ID NO: 555332 - RNA, 20 nt, Human
cugggcggggacuuuuagcc

SEQ ID NO: 555333 - RNA, 23 nt, Human
cuuaccgagacuugauuaaccca

SEQ ID NO: 555334 - RNA, 24 nt, Human
cuuaccgagacuugauuaacccag

SEQ ID NO: 555335 - RNA, 18 nt, Human
gaaacagcacuacgaccc

SEQ ID NO: 555336 - RNA, 18 nt, Human
gaccgcgaugagaauacc

SEQ ID NO: 555337 - RNA, 18 nt, Human
gagacuugauuaacccag

SEQ ID NO: 555338 - RNA, 19 nt, Human
guuaacagcuguguuagac

SEQ ID NO: 555339 - RNA, 22 nt, Human
uaaacaaaauuaggaaaaauuc

SEQ ID NO: 555340 - RNA, 18 nt, Human
uaacagcuguguuagaca

SEQ ID NO: 555341 - RNA, 21 nt, Human
uaacugccaguuuugcauagu

SEQ ID NO: 555342 - RNA, 24 nt, Human
uaauauaguaacaaaucaacacuc

SEQ ID NO: 555343 - RNA, 22 nt, Human
uacuuguccacaccgguagagg

SEQ ID NO: 555344 - RNA, 21 nt, Human
ucagaucuaacuuuuacgaag

SEQ ID NO: 555345 - RNA, 19 nt, Human
ucaggguaccuccagcugc

SEQ ID NO: 555346 - RNA, 18 nt, Human
uccaccgccgccgcgacg

SEQ ID NO: 555347 - RNA, 19 nt, Human
uccuuggguagcuuuaguc

SEQ ID NO: 555348 - RNA, 21 nt, Human
ucuaaugcacaaauacaccau

SEQ ID NO: 555349 - RNA, 21 nt, Human
ugagaauaccagaaacagcac

SEQ ID NO: 555350 - RNA, 19 nt, Human
ugcccaggccauggagaag

SEQ ID NO: 555351 - RNA, 26 nt, Human
uggaaauggauaaaguuuuucaggca

SEQ ID NO: 555352 - RNA, 19 nt, Human
uggcaaaagaaaaaaaggu

SEQ ID NO: 555353 - RNA, 22 nt, Human
uggcucagccgggaacuggugc

SEQ ID NO: 555354 - RNA, 25 nt, Human
uguacacauuacaugguauuuguau

SEQ ID NO: 555355 - RNA, 26 nt, Human
uguacacauuacaugguauuuguaua

SEQ ID NO: 555356 - RNA, 21 nt, Human
uuagacaguggcucugcuuug

SEQ ID NO: 555357 - RNA, 20 nt, Human
uuuaaaauaaaaaaucaaau

SEQ ID NO: 555358 - RNA, 21 nt, Human
uuuaaaggacuuaccgagacu

SEQ ID NO: 555359 - RNA, 22 nt, Human
uuuuuuuuuuuuuuuuaccaga

SEQ ID NO: 555360 - RNA, 25 nt, Human
uuuuuuuuuuuuuuuuuuuuaccag

SEQ ID NO: 555361 - RNA, 25 nt, Human
aaacaacaaaaccaaaucugaauca

SEQ ID NO: 555362 - RNA, 26 nt, Human
aaacagugaaauuucucaacagucac

SEQ ID NO: 555363 - RNA, 24 nt, Human
aaaguauugggauuauagguguga

SEQ ID NO: 555364 - RNA, 24 nt, Human
aaagugcugggauuauaggcauga

SEQ ID NO: 555365 - RNA, 26 nt, Human
aaauagcugggacuacaggugcaugc

SEQ ID NO: 555366 - RNA, 20 nt, Human
aagaacuccaacaauuuaaa

SEQ ID NO: 555367 - RNA, 24 nt, Human
aagcaauccuccugccuuggccuc

SEQ ID NO: 555368 - RNA, 25 nt, Human
aagcaauccuccugccuuggccucc

SEQ ID NO: 555369 - RNA, 18 nt, Human
aaguauugggauuauagg

SEQ ID NO: 555370 - RNA, 19 nt, Human
aagugcugggauuauaggc

SEQ ID NO: 555371 - RNA, 21 nt, Human
aagugcugggauuauaggcau

SEQ ID NO: 555372 - RNA, 21 nt, Human
aaguucaaacauccacugagc

SEQ ID NO: 555373 - RNA, 22 nt, Human
aaguucaaacauccacugagcu

SEQ ID NO: 555374 - RNA, 19 nt, Human
acaaaaccaaaucugaauc

SEQ ID NO: 555375 - RNA, 20 nt, Human
acaacaaaaccaaaucugaa

SEQ ID NO: 555376 - RNA, 21 nt, Human
acacacacacgcacacacaca

SEQ ID NO: 555377 - RNA, 25 nt, Human
acacacacgcacacacacacauuua

SEQ ID NO: 555378 - RNA, 24 nt, Human
acaguuuuccuagguggcuggugc

SEQ ID NO: 555379 - RNA, 20 nt, Human
accacaccuggccaacucuc

SEQ ID NO: 555380 - RNA, 24 nt, Human
accaguugcccucugcaaucuaca

SEQ ID NO: 555381 - RNA, 22 nt, Human
acccagcuagaggcaaugauuc

SEQ ID NO: 555382 - RNA, 19 nt, Human
acgguguuuugccauguug

SEQ ID NO: 555383 - RNA, 24 nt, Human
acgguguuuugccauguugcccag

SEQ ID NO: 555384 - RNA, 19 nt, Human
acuacaggugcaugccacc

SEQ ID NO: 555385 - RNA, 18 nt, Human
acuguguugcucaggcug

SEQ ID NO: 555386 - RNA, 21 nt, Human
agagaugaggucuugcuaugu

SEQ ID NO: 555387 - RNA, 24 nt, Human
agagcuccauuuuguucuucuucu

SEQ ID NO: 555388 - RNA, 19 nt, Human
agccgaggcgggggauugu

SEQ ID NO: 555389 - RNA, 22 nt, Human
agccgcccugagaagcaucgaa

SEQ ID NO: 555390 - RNA, 21 nt, Human
aggacuguuacugggcagggg

SEQ ID NO: 555391 - RNA, 24 nt, Human
aggcaauucuccugccccagccuc

SEQ ID NO: 555392 - RNA, 19 nt, Human
aggcaugagccaccacgcc

SEQ ID NO: 555393 - RNA, 23 nt, Human
aggggugcuggguguccgggugu

SEQ ID NO: 555394 - RNA, 23 nt, Human
agggucucacuguguugcucagg

SEQ ID NO: 555395 - RNA, 24 nt, Human
aggugaucugccugucuuagccuc

SEQ ID NO: 555396 - RNA, 19 nt, Human
aggugugagucaccacacc

SEQ ID NO: 555397 - RNA, 23 nt, Human
aggugugagucaccacaccuggc

SEQ ID NO: 555398 - RNA, 19 nt, Human
auaaagaccaaugaugaaa

SEQ ID NO: 555399 - RNA, 18 nt, Human
auaauuucaaacaaaucc

SEQ ID NO: 555400 - RNA, 19 nt, Human
auauauauauauauauaua

SEQ ID NO: 555401 - RNA, 19 nt, Human
auauauauauauauauaua

SEQ ID NO: 555402 - RNA, 19 nt, Human
auauauauauauauauaua

SEQ ID NO: 555403 - RNA, 19 nt, Human
auauauauauauauauaua

SEQ ID NO: 555404 - RNA, 19 nt, Human
auauauauauauauauaua

SEQ ID NO: 555405 - RNA, 19 nt, Human
auauauauauauauauaua

SEQ ID NO: 555406 - RNA, 19 nt, Human
auauauauauauauauaua

SEQ ID NO: 555407 - RNA, 19 nt, Human
auauauauauauauauaua

SEQ ID NO: 555408 - RNA, 19 nt, Human
auauauauauauauauaua

SEQ ID NO: 555409 - RNA, 19 nt, Human
auauauauauauauauaua

SEQ ID NO: 555410 - RNA, 19 nt, Human
auauauauauauauauaua

SEQ ID NO: 555411 - RNA, 19 nt, Human
auauauauauauauauaua

SEQ ID NO: 555412 - RNA, 19 nt, Human
auauauauauauauauaua

SEQ ID NO: 555413 - RNA, 19 nt, Human
auauauauauauauauaua

SEQ ID NO: 555414 - RNA, 19 nt, Human
auauauauauauauauaua

SEQ ID NO: 555415 - RNA, 19 nt, Human
auauauauauauauauaua

SEQ ID NO: 555416 - RNA, 19 nt, Human
auauauauauauauauaua

SEQ ID NO: 555417 - RNA, 19 nt, Human
auauauauauauauauaua

SEQ ID NO: 555418 - RNA, 19 nt, Human
auauauauauauauauaua

SEQ ID NO: 555419 - RNA, 19 nt, Human
auauauauauauauauaua

SEQ ID NO: 555420 - RNA, 19 nt, Human
auauauauauauauauaua

SEQ ID NO: 555421 - RNA, 19 nt, Human
auauauauauauauauaua

SEQ ID NO: 555422 - RNA, 19 nt, Human
auauauauauauauauaua

SEQ ID NO: 555423 - RNA, 19 nt, Human
auauauauauauauauaua

SEQ ID NO: 555424 - RNA, 19 nt, Human
auauauauauauauauaua

SEQ ID NO: 555425 - RNA, 18 nt, Human
auguuguccaggcugguc

SEQ ID NO: 555426 - RNA, 21 nt, Human
auuccauauauauauauauau

SEQ ID NO: 555427 - RNA, 26 nt, Human
auuccugggcuuaagcuauucuccug

SEQ ID NO: 555428 - RNA, 24 nt, Human
auuuuuuuuuuuuuuuuuuuuggg

SEQ ID NO: 555429 - RNA, 22 nt, Human
caaaacaccccaggaaucaacu

SEQ ID NO: 555430 - RNA, 24 nt, Human
caaaguauugggauuauaggugug

SEQ ID NO: 555431 - RNA, 24 nt, Human
caaagugcugggauuauaggcaug

SEQ ID NO: 555432 - RNA, 20 nt, Human
caaauuccugggcuuaagcu

SEQ ID NO: 555433 - RNA, 22 nt, Human
caagcaauccuccugccuuggc

SEQ ID NO: 555434 - RNA, 27 nt, Human
caagcaauccuccugccuuggccuccc

SEQ ID NO: 555435 - RNA, 27 nt, Human
caagcaauccuccugccuuggccuccc

SEQ ID NO: 555436 - RNA, 20 nt, Human
caccacacccagcuagaggc

SEQ ID NO: 555437 - RNA, 22 nt, Human
caccaguugcccucugcaaucu

SEQ ID NO: 555438 - RNA, 20 nt, Human
caccuggccaacucucuucc

SEQ ID NO: 555439 - RNA, 26 nt, Human
cacgcacacacacacauuuauaacuu

SEQ ID NO: 555440 - RNA, 21 nt, Human
cagaagacgacuuaugugaca

SEQ ID NO: 555441 - RNA, 23 nt, Human
cagacacaaacucugaaauuaaa

SEQ ID NO: 555442 - RNA, 18 nt, Human
cagcaggacuuucauuuu

SEQ ID NO: 555443 - RNA, 23 nt, Human
cagcccuacuggagaccccggac

SEQ ID NO: 555444 - RNA, 21 nt, Human
cauacaguuuuccuagguggc

SEQ ID NO: 555445 - RNA, 20 nt, Human
cauauauauauauauauaua

SEQ ID NO: 555446 - RNA, 19 nt, Human
caugccaccacacccagcu

SEQ ID NO: 555447 - RNA, 23 nt, Human
cauguugcccaggcuggucuugg

SEQ ID NO: 555448 - RNA, 23 nt, Human
cauguugcccaggcuggucuugg

SEQ ID NO: 555449 - RNA, 24 nt, Human
cauguugcccaggcuggucuugga

SEQ ID NO: 555450 - RNA, 21 nt, Human
ccaaaguauugggauuauagg

SEQ ID NO: 555451 - RNA, 24 nt, Human
ccaaaguauugggauuauaggugu

SEQ ID NO: 555452 - RNA, 24 nt, Human
ccaaagugcugggauuauaggcau

SEQ ID NO: 555453 - RNA, 23 nt, Human
ccacacccagcuagaggcagugg

SEQ ID NO: 555454 - RNA, 19 nt, Human
ccauccaaauauauuuucu

SEQ ID NO: 555455 - RNA, 19 nt, Human
ccauguugcccaggcuggu

SEQ ID NO: 555456 - RNA, 21 nt, Human
ccauguugcccaggcuggucu

SEQ ID NO: 555457 - RNA, 21 nt, Human
ccauguugcccaggcuggucu

SEQ ID NO: 555458 - RNA, 24 nt, Human
cccaaauagcugggacuacaggug

SEQ ID NO: 555459 - RNA, 22 nt, Human
cccaaguagcugcgacuauagg

SEQ ID NO: 555460 - RNA, 18 nt, Human
cccaugcuggacucaaac

SEQ ID NO: 555461 - RNA, 21 nt, Human
cccaugcuggacucaaacucc

SEQ ID NO: 555462 - RNA, 21 nt, Human
cccgcgccaggaaugcaggaa

SEQ ID NO: 555463 - RNA, 19 nt, Human
cccggacgccgccgcggag

SEQ ID NO: 555464 - RNA, 22 nt, Human
cccugagaagcaucgaacugga

SEQ ID NO: 555465 - RNA, 19 nt, Human
ccgccccccggaggagggg

SEQ ID NO: 555466 - RNA, 21 nt, Human
ccgccgcggagcugcccccuc

SEQ ID NO: 555467 - RNA, 22 nt, Human
ccggcguacggcagccaucuuc

SEQ ID NO: 555468 - RNA, 27 nt, Human
ccuauuuuuuuuuuuuuuaauuuuuag

SEQ ID NO: 555469 - RNA, 19 nt, Human
ccuccugccuuggccuccc

SEQ ID NO: 555470 - RNA, 25 nt, Human
ccucuugcugcucugcaaggucgau

SEQ ID NO: 555471 - RNA, 18 nt, Human
ccugaccucaagcaaucc

SEQ ID NO: 555472 - RNA, 18 nt, Human
ccugagcucaggugaucu

SEQ ID NO: 555473 - RNA, 21 nt, Human
ccugagcucaggugaucugcc

SEQ ID NO: 555474 - RNA, 23 nt, Human
ccugccccagccucccaaguagc

SEQ ID NO: 555475 - RNA, 22 nt, Human
ccugucuuagccucccaaagug

SEQ ID NO: 555476 - RNA, 23 nt, Human
ccuguuacuuuaaaaaggccauc

SEQ ID NO: 555477 - RNA, 22 nt, Human
cggcaauaacugcgggcccggc

SEQ ID NO: 555478 - RNA, 24 nt, Human
cgguguuuugccauguugcccagg

SEQ ID NO: 555479 - RNA, 20 nt, Human
cuacuggagaccccggacgc

SEQ ID NO: 555480 - RNA, 24 nt, Human
cucaagcaauccuccugccuuggc

SEQ ID NO: 555481 - RNA, 21 nt, Human
cucacuguguugcucaggcug

SEQ ID NO: 555482 - RNA, 20 nt, Human
cucagguuuacaugauccuc

SEQ ID NO: 555483 - RNA, 24 nt, Human
cucccaaauagcugggacuacagg

SEQ ID NO: 555484 - RNA, 30 nt, Human
cugacaguaucagaaugacaaucuuccucu

SEQ ID NO: 555485 - RNA, 19 nt, Human
cugcaccgccccccggagg

SEQ ID NO: 555486 - RNA, 20 nt, Human
cugccggggacucggggagu

SEQ ID NO: 555487 - RNA, 22 nt, Human
cugccggggacucggggagugg

SEQ ID NO: 555488 - RNA, 20 nt, Human
cugcucugacaguaucagaa

SEQ ID NO: 555489 - RNA, 20 nt, Human
cugggguggcggcggcugcc

SEQ ID NO: 555490 - RNA, 18 nt, Human
cuguaugcacauuucacc

SEQ ID NO: 555491 - RNA, 23 nt, Human
cugucuuagccucccaaagugcu

SEQ ID NO: 555492 - RNA, 24 nt, Human
cugucuuagccucccaaagugcug

SEQ ID NO: 555493 - RNA, 20 nt, Human
cuuggacuccugagcucagg

SEQ ID NO: 555494 - RNA, 23 nt, Human
cuuucauacuggaacaagaguua

SEQ ID NO: 555495 - RNA, 22 nt, Human
cuuuucuucuuuugccuguucu

SEQ ID NO: 555496 - RNA, 21 nt, Human
gagagcacagacagacuggag

SEQ ID NO: 555497 - RNA, 20 nt, Human
gagccuuuucuucuuuugcc

SEQ ID NO: 555498 - RNA, 24 nt, Human
gagcucaggugaucugccugucuu

SEQ ID NO: 555499 - RNA, 21 nt, Human
gauuauaggcaugagccacca

SEQ ID NO: 555500 - RNA, 22 nt, Human
gauuauaggcaugagccaccac

SEQ ID NO: 555501 - RNA, 22 nt, Human
gauuauaggugugagucaccac

SEQ ID NO: 555502 - RNA, 22 nt, Human
gcaacuuccacuucccaggcuc

SEQ ID NO: 555503 - RNA, 22 nt, Human
gcaauucuccugccccagccuc

SEQ ID NO: 555504 - RNA, 20 nt, Human
gcaucagccucccaaauagc

SEQ ID NO: 555505 - RNA, 20 nt, Human
gcauugaaauauuaggauac

SEQ ID NO: 555506 - RNA, 20 nt, Human
gccauguugcccaggcuggu

SEQ ID NO: 555507 - RNA, 27 nt, Human
gcccaggcuggucuuggacuccugagc

SEQ ID NO: 555508 - RNA, 20 nt, Human
gcccccucugcaccgccccc

SEQ ID NO: 555509 - RNA, 19 nt, Human
gcccugagaagcaucgaac

SEQ ID NO: 555510 - RNA, 22 nt, Human
gcgccaggaaugcaggaaaaca

SEQ ID NO: 555511 - RNA, 18 nt, Human
gcgcugggguggcggcgg

SEQ ID NO: 555512 - RNA, 19 nt, Human
gcuacauauaaagaccaau

SEQ ID NO: 555513 - RNA, 23 nt, Human
gcuggucuaaaacuccugaccuc

SEQ ID NO: 555514 - RNA, 18 nt, Human
gcuuuuaggaagaguucu

SEQ ID NO: 555515 - RNA, 21 nt, Human
ggaggggugcuggguguccgg

SEQ ID NO: 555516 - RNA, 19 nt, Human
ggauuauaggcaugagcca

SEQ ID NO: 555517 - RNA, 24 nt, Human
ggcuggucuaaaacuccugaccuc

SEQ ID NO: 555518 - RNA, 24 nt, Human
ggcuggucuuggacuccugagcuc

SEQ ID NO: 555519 - RNA, 21 nt, Human
gggcucuccgugcccccucug

SEQ ID NO: 555520 - RNA, 24 nt, Human
ggggacucggggaguggagggacg

SEQ ID NO: 555521 - RNA, 23 nt, Human
ggggcgcgcugggguggcggcgg

SEQ ID NO: 555522 - RNA, 20 nt, Human
gggucuuguuauguugccca

SEQ ID NO: 555523 - RNA, 23 nt, Human
gguguuuugccauguugcccagg

SEQ ID NO: 555524 - RNA, 18 nt, Human
guacaugagaauuugucu

SEQ ID NO: 555525 - RNA, 21 nt, Human
guagagacgguguuuugccau

SEQ ID NO: 555526 - RNA, 22 nt, Human
guagagacgguguuuugccaug

SEQ ID NO: 555527 - RNA, 19 nt, Human
guccucggagccucuggcu

SEQ ID NO: 555528 - RNA, 24 nt, Human
gugaucugccugucuuagccuccc

SEQ ID NO: 555529 - RNA, 23 nt, Human
guuccaguccuaagggauucacu

SEQ ID NO: 555530 - RNA, 24 nt, Human
guuuugccauguugcccaggcugg

SEQ ID NO: 555531 - RNA, 22 nt, Human
uaaaaagccuaucccauacuga

SEQ ID NO: 555532 - RNA, 21 nt, Human
uaaaaugcuuauccaguggag

SEQ ID NO: 555533 - RNA, 23 nt, Human
uaaagcaagccgcccugagaagc

SEQ ID NO: 555534 - RNA, 23 nt, Human
uaauuucaaacaaauccagaaca

SEQ ID NO: 555535 - RNA, 19 nt, Human
uacaacccaaauuuagggg

SEQ ID NO: 555536 - RNA, 22 nt, Human
uacacacacacgcacacacaca

SEQ ID NO: 555537 - RNA, 24 nt, Human
uacaggugcaugccaccacaccca

SEQ ID NO: 555538 - RNA, 22 nt, Human
uacuuuaaaaaggccauccaaa

SEQ ID NO: 555539 - RNA, 24 nt, Human
uagaagagaugaggucuugcuaug

SEQ ID NO: 555540 - RNA, 22 nt, Human
uagagacgguguuuugccaugu

SEQ ID NO: 555541 - RNA, 21 nt, Human
uagagagcuccauuuuguucu

SEQ ID NO: 555542 - RNA, 25 nt, Human
uauacacacacacgcacacacacac

SEQ ID NO: 555543 - RNA, 23 nt, Human
uauaggugugagucaccacaccu

SEQ ID NO: 555544 - RNA, 25 nt, Human
uauauacacacacacgcacacacac

SEQ ID NO: 555545 - RNA, 25 nt, Human
uauauacacacacacgcacacacag

SEQ ID NO: 555546 - RNA, 27 nt, Human
uauauauauauauacacacacacggca

SEQ ID NO: 555547 - RNA, 18 nt, Human
uauauauauauauauaca

SEQ ID NO: 555548 - RNA, 19 nt, Human
uauauauauauauauauau

SEQ ID NO: 555549 - RNA, 19 nt, Human
uauauauauauauauauau

SEQ ID NO: 555550 - RNA, 19 nt, Human
uauauauauauauauauau

SEQ ID NO: 555551 - RNA, 19 nt, Human
uauauauauauauauauau

SEQ ID NO: 555552 - RNA, 19 nt, Human
uauauauauauauauauau

SEQ ID NO: 555553 - RNA, 19 nt, Human
uauauauauauauauauau

SEQ ID NO: 555554 - RNA, 19 nt, Human
uauauauauauauauauau

SEQ ID NO: 555555 - RNA, 19 nt, Human
uauauauauauauauauau

SEQ ID NO: 555556 - RNA, 19 nt, Human
uauauauauauauauauau

SEQ ID NO: 555557 - RNA, 19 nt, Human
uauauauauauauauauau

SEQ ID NO: 555558 - RNA, 19 nt, Human
uauauauauauauauauau

SEQ ID NO: 555559 - RNA, 19 nt, Human
uauauauauauauauauau

SEQ ID NO: 555560 - RNA, 19 nt, Human
uauauauauauauauauau

SEQ ID NO: 555561 - RNA, 23 nt, Human
uauauauauauauauauauauac

SEQ ID NO: 555562 - RNA, 18 nt, Human
uauguugcccaugcugga

SEQ ID NO: 555563 - RNA, 22 nt, Human
uauguugcccaugcuggacuca

SEQ ID NO: 555564 - RNA, 24 nt, Human
uauguugcccaugcuggacucaaa

SEQ ID NO: 555565 - RNA, 23 nt, Human
uauguuguccaggcuggucuaaa

SEQ ID NO: 555566 - RNA, 19 nt, Human
uauucuccugcaucagccu

SEQ ID NO: 555567 - RNA, 25 nt, Human
ucaaaaauuuuuacaacccaaauuu

SEQ ID NO: 555568 - RNA, 21 nt, Human
ucaaaacaccccaggaaucaa

SEQ ID NO: 555569 - RNA, 24 nt, Human
ucacugcaacuuccacuucccagg

SEQ ID NO: 555570 - RNA, 20 nt, Human
ucagccucccaaauagcugg

SEQ ID NO: 555571 - RNA, 21 nt, Human
ucaucaucugcucugacagua

SEQ ID NO: 555572 - RNA, 22 nt, Human
ucauuuucuucaucaucaucug

SEQ ID NO: 555573 - RNA, 25 nt, Human
uccaauuccauauauauauauauau

SEQ ID NO: 555574 - RNA, 25 nt, Human
uccacugagcucggaacagcggacc

SEQ ID NO: 555575 - RNA, 23 nt, Human
ucccaaaguauugggauuauagg

SEQ ID NO: 555576 - RNA, 24 nt, Human
ucccaaagugcugggauuauaggc

SEQ ID NO: 555577 - RNA, 23 nt, Human
ucccaaauagcugggacuacagg

SEQ ID NO: 555578 - RNA, 24 nt, Human
ucccaaguagcugcgacuauaggu

SEQ ID NO: 555579 - RNA, 19 nt, Human
ucccagacucaaauuccug

SEQ ID NO: 555580 - RNA, 23 nt, Human
ucccagacucaaauuccugggcu

SEQ ID NO: 555581 - RNA, 21 nt, Human
ucccaggcucaggcaauucuc

SEQ ID NO: 555582 - RNA, 24 nt, Human
ucccaggcucaggcaauucuccug

SEQ ID NO: 555583 - RNA, 25 nt, Human
ucccccaacuuucauacuggaacaa

SEQ ID NO: 555584 - RNA, 21 nt, Human
uccugggcuuaagcuauucuc

SEQ ID NO: 555585 - RNA, 22 nt, Human
uccugggcuuaagcuauucucc

SEQ ID NO: 555586 - RNA, 24 nt, Human
uccugggcuuaagcuauucuccug

SEQ ID NO: 555587 - RNA, 25 nt, Human
ucuaaaacuccugaccucaagcaau

SEQ ID NO: 555588 - RNA, 18 nt, Human
ucuacauuucucauucag

SEQ ID NO: 555589 - RNA, 22 nt, Human
ucuaccagacacaaacucugaa

SEQ ID NO: 555590 - RNA, 19 nt, Human
ucucacuguguugcucagg

SEQ ID NO: 555591 - RNA, 23 nt, Human
ucucacuguguugcucaggcugg

SEQ ID NO: 555592 - RNA, 24 nt, Human
ucucacuguguugcucaggcugga

SEQ ID NO: 555593 - RNA, 26 nt, Human
ucucacuguguugcucaggcuggagu

SEQ ID NO: 555594 - RNA, 22 nt, Human
ucuccgugcccccucugcaccc

SEQ ID NO: 555595 - RNA, 22 nt, Human
ucuccugcaucagccucccaaa

SEQ ID NO: 555596 - RNA, 26 nt, Human
ucuccugccccagccucccaaguagc

SEQ ID NO: 555597 - RNA, 21 nt, Human
ucugcucugacaguaucagaa

SEQ ID NO: 555598 - RNA, 23 nt, Human
ucuguaugcacauuucaccuuua

SEQ ID NO: 555599 - RNA, 19 nt, Human
ucuugcuauguuguccagg

SEQ ID NO: 555600 - RNA, 23 nt, Human
ucuugcuauguuguccaggcugg

SEQ ID NO: 555601 - RNA, 24 nt, Human
ucuugcuauguuguccaggcuggu

SEQ ID NO: 555602 - RNA, 23 nt, Human
ucuuggacuccugagcucaggug

SEQ ID NO: 555603 - RNA, 23 nt, Human
ucuuguuauguugcccaugcugg

SEQ ID NO: 555604 - RNA, 24 nt, Human
ucuuguuauguugcccaugcugga

SEQ ID NO: 555605 - RNA, 21 nt, Human
ugaaacaacaaaaccaaaucu

SEQ ID NO: 555606 - RNA, 20 nt, Human
ugaccucaagcaauccuccu

SEQ ID NO: 555607 - RNA, 21 nt, Human
ugaccucaagcaauccuccug

SEQ ID NO: 555608 - RNA, 24 nt, Human
ugaccucaagcaauccuccugccu

SEQ ID NO: 555609 - RNA, 18 nt, Human
ugagagcacagacagacu

SEQ ID NO: 555610 - RNA, 22 nt, Human
ugagagcacagacagacuggag

SEQ ID NO: 555611 - RNA, 19 nt, Human
ugagauagggucucacugu

SEQ ID NO: 555612 - RNA, 23 nt, Human
ugagauagggucucacuguguug

SEQ ID NO: 555613 - RNA, 19 nt, Human
ugagcucaggugaucugcc

SEQ ID NO: 555614 - RNA, 24 nt, Human
ugagcucaggugaucugccugucu

SEQ ID NO: 555615 - RNA, 24 nt, Human
ugaggucuugcuauguuguccagg

SEQ ID NO: 555616 - RNA, 26 nt, Human
ugaguaaaaagguaacauuguaauga

SEQ ID NO: 555617 - RNA, 24 nt, Human
ugcaucagccucccaaauagcugg

SEQ ID NO: 555618 - RNA, 20 nt, Human
ugcaugccaccacacccagc

SEQ ID NO: 555619 - RNA, 21 nt, Human
ugcauugaaauauuaggauac

SEQ ID NO: 555620 - RNA, 20 nt, Human
ugccaugcgggaaauaaaau

SEQ ID NO: 555621 - RNA, 31 nt, Human
ugccauguugcccaggcuggucuuggacucc

SEQ ID NO: 555622 - RNA, 22 nt, Human
ugcccaggcuggucuuggacuc

SEQ ID NO: 555623 - RNA, 24 nt, Human
ugcccaggcuggucuuggacuccu

SEQ ID NO: 555624 - RNA, 25 nt, Human
ugccccagccucccaaguagcugcg

SEQ ID NO: 555625 - RNA, 19 nt, Human
ugcccccucugcaccgccc

SEQ ID NO: 555626 - RNA, 20 nt, Human
ugcccccucugcaccgcccc

SEQ ID NO: 555627 - RNA, 20 nt, Human
ugccugucucugcagcggag

SEQ ID NO: 555628 - RNA, 20 nt, Human
ugccuguucuuguuuuccuu

SEQ ID NO: 555629 - RNA, 21 nt, Human
ugcucaggcuggaguggaaug

SEQ ID NO: 555630 - RNA, 24 nt, Human
ugcucaggcuggaguggaauggca

SEQ ID NO: 555631 - RNA, 21 nt, Human
uggagagagccucuugcugcu

SEQ ID NO: 555632 - RNA, 19 nt, Human
uggaguggaauggcacgau

SEQ ID NO: 555633 - RNA, 24 nt, Human
uggaguggaauggcacgaucuugg

SEQ ID NO: 555634 - RNA, 25 nt, Human
uggcuaauuuuuuuuuuuuuuuuuu

SEQ ID NO: 555635 - RNA, 18 nt, Human
uggcuagagucccgcgcc

SEQ ID NO: 555636 - RNA, 21 nt, Human
ugggacuacaggugcaugcca

SEQ ID NO: 555637 - RNA, 22 nt, Human
ugggacuacaggugcaugccac

SEQ ID NO: 555638 - RNA, 24 nt, Human
ugggacuacaggugcaugccacca

SEQ ID NO: 555639 - RNA, 18 nt, Human
ugggauuauaggcaugag

SEQ ID NO: 555640 - RNA, 19 nt, Human
ugggauuauaggcaugagc

SEQ ID NO: 555641 - RNA, 22 nt, Human
ugggauuauaggcaugagccac

SEQ ID NO: 555642 - RNA, 23 nt, Human
ugggauuauaggcaugagccacc

SEQ ID NO: 555643 - RNA, 24 nt, Human
ugggauuauaggcaugagccacca

SEQ ID NO: 555644 - RNA, 18 nt, Human
ugggauuauaggugugag

SEQ ID NO: 555645 - RNA, 18 nt, Human
ugggauuauaggugugag

SEQ ID NO: 555646 - RNA, 22 nt, Human
ugggauuauaggugugagucac

SEQ ID NO: 555647 - RNA, 23 nt, Human
ugggauuauaggugugagucacc

SEQ ID NO: 555648 - RNA, 24 nt, Human
ugggauuauaggugugagucacca

SEQ ID NO: 555649 - RNA, 24 nt, Human
uggggucuuguuauguugcccaug

SEQ ID NO: 555650 - RNA, 23 nt, Human
ugggguggcggcggcugccgggg

SEQ ID NO: 555651 - RNA, 24 nt, Human
uggucuuggacuccugagcucagg

SEQ ID NO: 555652 - RNA, 24 nt, Human
uguagagacgguguuuugccaugu

SEQ ID NO: 555653 - RNA, 24 nt, Human
uguccaggcuggucuaaaacuccu

SEQ ID NO: 555654 - RNA, 24 nt, Human
uguccgggugucuacuccugccug

SEQ ID NO: 555655 - RNA, 22 nt, Human
uguguugcucaggcuggagugg

SEQ ID NO: 555656 - RNA, 24 nt, Human
uguuauguugcccaugcuggacuc

SEQ ID NO: 555657 - RNA, 23 nt, Human
uuaaaaguaacaguggcugcaga

SEQ ID NO: 555658 - RNA, 23 nt, Human
uuauuuuuuugagauagggucuc

SEQ ID NO: 555659 - RNA, 23 nt, Human
uucaaacauccacugagcucgga

SEQ ID NO: 555660 - RNA, 25 nt, Human
uucccaggcucaggcaauucuccug

SEQ ID NO: 555661 - RNA, 20 nt, Human
uucucgagccuuuucuucuu

SEQ ID NO: 555662 - RNA, 24 nt, Human
uucuucaucaucaucugcucugac

SEQ ID NO: 555663 - RNA, 21 nt, Human
uugccauguugcccaggcugg

SEQ ID NO: 555664 - RNA, 21 nt, Human
uugcucaggcuggaguggaau

SEQ ID NO: 555665 - RNA, 24 nt, Human
uugcucaggcuggaguggaauggc

SEQ ID NO: 555666 - RNA, 24 nt, Human
uugggauuauaggugugagucacc

SEQ ID NO: 555667 - RNA, 24 nt, Human
uuguagagacgguguuuugccaug

SEQ ID NO: 555668 - RNA, 24 nt, Human
uuuguagagacgguguuuugccau

SEQ ID NO: 555669 - RNA, 23 nt, Human
uuuugccauguugcccaggcugg

SEQ ID NO: 555670 - RNA, 21 nt, Human
uuuuuuguagagacgguguuu

SEQ ID NO: 555671 - RNA, 22 nt, Human
uuuuuuuguagagacgguguuu

SEQ ID NO: 555672 - RNA, 22 nt, Human
uuuuuuuuucuuuuaauaaggg

SEQ ID NO: 555673 - RNA, 20 nt, Human
uuuuuuuuuucuuuugcgcu

SEQ ID NO: 555674 - RNA, 18 nt, Human
uuuuuuuuuuuucuuuug

SEQ ID NO: 555675 - RNA, 22 nt, Human
uuuuuuuuuuuucuuuugcgcu

SEQ ID NO: 555676 - RNA, 24 nt, Human
uuuuuuuuuuuuuuuuuuucuuuu

SEQ ID NO: 555677 - RNA, 24 nt, Human
uuuuuuuuuuuuuuuuuuuucuuu

SEQ ID NO: 555678 - RNA, 27 nt, Human
uuuuuuuuuuuuuuuuuuuuuuucuuu

SEQ ID NO: 555679 - RNA, 19 nt, Human
aaaaagcuuuaauaacaga

SEQ ID NO: 555680 - RNA, 21 nt, Human
aaaacaagcccucccccaccc

SEQ ID NO: 555681 - RNA, 26 nt, Human
aacaagcccucccccaccccgagccc

SEQ ID NO: 555682 - RNA, 19 nt, Human
aacacugaccaacauaacu

SEQ ID NO: 555683 - RNA, 24 nt, Human
aacccaaaaugcauccucuaacac

SEQ ID NO: 555684 - RNA, 22 nt, Human
aagaaagaugaacccaaaaugc

SEQ ID NO: 555685 - RNA, 19 nt, Human
acccaaaacccgcagcccc

SEQ ID NO: 555686 - RNA, 18 nt, Human
accccgagcccuggcccc

SEQ ID NO: 555687 - RNA, 24 nt, Human
agccgugcuccuuccacaacacca

SEQ ID NO: 555688 - RNA, 22 nt, Human
agcuacuaggcacgcucggacc

SEQ ID NO: 555689 - RNA, 19 nt, Human
auaaaacaagcccuccccc

SEQ ID NO: 555690 - RNA, 23 nt, Human
caaaacccgcagccccggcaccc

SEQ ID NO: 555691 - RNA, 19 nt, Human
caagcccucccccaccccg

SEQ ID NO: 555692 - RNA, 21 nt, Human
caauaaaacaagcccuccccc

SEQ ID NO: 555693 - RNA, 23 nt, Human
caccaggugaauacuguggucag

SEQ ID NO: 555694 - RNA, 20 nt, Human
cacccaaagucagucagcgg

SEQ ID NO: 555695 - RNA, 23 nt, Human
cacucaagaaagaugaacccaaa

SEQ ID NO: 555696 - RNA, 23 nt, Human
ccacucaagaaagaugaacccaa

SEQ ID NO: 555697 - RNA, 19 nt, Human
ccagagccuugcagcggcc

SEQ ID NO: 555698 - RNA, 22 nt, Human
ccagagccuugcagcggccggg

SEQ ID NO: 555699 - RNA, 21 nt, Human
cccaaaaugcauccucuaaca

SEQ ID NO: 555700 - RNA, 20 nt, Human
ccccaccccgagcccuggcc

SEQ ID NO: 555701 - RNA, 22 nt, Human
ccccaccccgagcccuggcccc

SEQ ID NO: 555702 - RNA, 19 nt, Human
ccccggggcccgggaccuc

SEQ ID NO: 555703 - RNA, 19 nt, Human
cccgagcccuggccccugg

SEQ ID NO: 555704 - RNA, 28 nt, Human
ccucccccaccccgagcccuggccccug

SEQ ID NO: 555705 - RNA, 19 nt, Human
cgagcgccccggggcccgg

SEQ ID NO: 555706 - RNA, 18 nt, Human
cgccagagccuugcagcg

SEQ ID NO: 555707 - RNA, 19 nt, Human
gagcccuggccccuggcaa

SEQ ID NO: 555708 - RNA, 18 nt, Human
gagcgagcgccccggggc

SEQ ID NO: 555709 - RNA, 21 nt, Human
gagcgccccggggcccgggac

SEQ ID NO: 555710 - RNA, 20 nt, Human
gauaaaugauugugcacugc

SEQ ID NO: 555711 - RNA, 20 nt, Human
gccagagccuugcagcggcc

SEQ ID NO: 555712 - RNA, 24 nt, Human
gugaauacuguggucaggcaugcu

SEQ ID NO: 555713 - RNA, 18 nt, Human
guggucaggcaugcuggu

SEQ ID NO: 555714 - RNA, 18 nt, Human
uaaaacaagcccuccccc

SEQ ID NO: 555715 - RNA, 19 nt, Human
uaacacugaccaacauaac

SEQ ID NO: 555716 - RNA, 18 nt, Human
uagcaugcugcguuguau

SEQ ID NO: 555717 - RNA, 23 nt, Human
ucagucagcggugguggcucaug

SEQ ID NO: 555718 - RNA, 27 nt, Human
ucagucagcggugguggcucauggugu

SEQ ID NO: 555719 - RNA, 23 nt, Human
ucccccaccccgagcccuggccc

SEQ ID NO: 555720 - RNA, 24 nt, Human
uccuuccacaacaccaggugaaua

SEQ ID NO: 555721 - RNA, 18 nt, Human
ugagaacuuugguucaug

SEQ ID NO: 555722 - RNA, 19 nt, Human
uggaaaaauuuaccugagc

SEQ ID NO: 555723 - RNA, 22 nt, Human
ugugcacugcgugaugauacca

SEQ ID NO: 555724 - RNA, 23 nt, Human
uugcacccaaaacccgcagcccc

SEQ ID NO: 555725 - RNA, 21 nt, Human
uugcagcggccggguccgcuc

SEQ ID NO: 555726 - RNA, 20 nt, Human
uuuaccugagcgagcgcccc

SEQ ID NO: 555727 - RNA, 22 nt, Human
agcaggguaggagcacaugaug

SEQ ID NO: 555728 - RNA, 26 nt, Human
ccaccgcaaccuccagagggaccagg

SEQ ID NO: 555729 - RNA, 19 nt, Human
gguagagcaggguaggagc

SEQ ID NO: 555730 - RNA, 26 nt, Human
ucugugacccagaaaagcgguagagc

SEQ ID NO: 555731 - RNA, 28 nt, Human
aaacggacacaacaggcuggccuuccga

SEQ ID NO: 555732 - RNA, 18 nt, Human
acagaaguaaggcccggu

SEQ ID NO: 555733 - RNA, 20 nt, Human
agcacacauccucucucacc

SEQ ID NO: 555734 - RNA, 23 nt, Human
cacaguaucguuacagaaguaag

SEQ ID NO: 555735 - RNA, 21 nt, Human
cucuccccgcccuugcaaucu

SEQ ID NO: 555736 - RNA, 21 nt, Human
gucucggcccccuuccuccaa

SEQ ID NO: 555737 - RNA, 23 nt, Human
ucggcccccuuccuccaaggccc

SEQ ID NO: 555738 - RNA, 19 nt, Human
aaaaaaacaaacacaccaa

SEQ ID NO: 555739 - RNA, 24 nt, Human
aaaaaaacaaacacaccaacaaaa

SEQ ID NO: 555740 - RNA, 19 nt, Human
aaaaacaaacacaccaaca

SEQ ID NO: 555741 - RNA, 23 nt, Human
aaacaaacacaccaacaaaagac

SEQ ID NO: 555742 - RNA, 19 nt, Human
aaccuccacauggugaaac

SEQ ID NO: 555743 - RNA, 21 nt, Human
aagaauagggaagacagucau

SEQ ID NO: 555744 - RNA, 19 nt, Human
aagaguuuggcuccugggu

SEQ ID NO: 555745 - RNA, 18 nt, Human
aagcaucccgggggccug

SEQ ID NO: 555746 - RNA, 22 nt, Human
aagcugccuuccaccaucugcc

SEQ ID NO: 555747 - RNA, 18 nt, Human
aauaggagcugggagcaa

SEQ ID NO: 555748 - RNA, 21 nt, Human
aauggcuuauuaacaccaccu

SEQ ID NO: 555749 - RNA, 21 nt, Human
aauuuacagaccagugucccu

SEQ ID NO: 555750 - RNA, 25 nt, Human
acacaacucccaugcaggagaagcc

SEQ ID NO: 555751 - RNA, 26 nt, Human
acaccaacaaaagacacaugugcguc

SEQ ID NO: 555752 - RNA, 22 nt, Human
acccgacacccucccccagccu

SEQ ID NO: 555753 - RNA, 20 nt, Human
accggaauggcagagcuccg

SEQ ID NO: 555754 - RNA, 22 nt, Human
acugcaaaaaaagguuccuuga

SEQ ID NO: 555755 - RNA, 21 nt, Human
acuggcucuggggugcugggg

SEQ ID NO: 555756 - RNA, 24 nt, Human
acuggcucuggggugcuggggaaa

SEQ ID NO: 555757 - RNA, 18 nt, Human
agaaaaccuggaauacug

SEQ ID NO: 555758 - RNA, 22 nt, Human
agaaaggauuacaauuuacaga

SEQ ID NO: 555759 - RNA, 19 nt, Human
agaacagaccccuggcucu

SEQ ID NO: 555760 - RNA, 20 nt, Human
agaaggacaaggaugggagg

SEQ ID NO: 555761 - RNA, 24 nt, Human
agacgaacgcagauaaacccuucg

SEQ ID NO: 555762 - RNA, 19 nt, Human
agagacccacgggcugccu

SEQ ID NO: 555763 - RNA, 21 nt, Human
agcaaggcaggcgugcugcca

SEQ ID NO: 555764 - RNA, 19 nt, Human
agcccggaaggcccuggug

SEQ ID NO: 555765 - RNA, 23 nt, Human
agcugggagcaagagccggucca

SEQ ID NO: 555766 - RNA, 20 nt, Human
aggaaggggagggcaggggc

SEQ ID NO: 555767 - RNA, 22 nt, Human
aggcagaaucaaaccaaaaaca

SEQ ID NO: 555768 - RNA, 20 nt, Human
aggcaggcgugcugccagcc

SEQ ID NO: 555769 - RNA, 18 nt, Human
agggacugcccuccaccc

SEQ ID NO: 555770 - RNA, 23 nt, Human
aggggcccucaugggacuguggc

SEQ ID NO: 555771 - RNA, 24 nt, Human
agucaccugggcagcggggggagg

SEQ ID NO: 555772 - RNA, 24 nt, Human
auagacacuaauaagacuuaacca

SEQ ID NO: 555773 - RNA, 22 nt, Human
auaucuguaaauaugaacccac

SEQ ID NO: 555774 - RNA, 24 nt, Human
auuacaaauucacaagauauuugg

SEQ ID NO: 555775 - RNA, 18 nt, Human
auugacacuucugcaugg

SEQ ID NO: 555776 - RNA, 19 nt, Human
caaaaaaagguuccuugaa

SEQ ID NO: 555777 - RNA, 23 nt, Human
caaggcaggcgugcugccagcca

SEQ ID NO: 555778 - RNA, 25 nt, Human
caauaauacugcaaaaaaagguucc

SEQ ID NO: 555779 - RNA, 19 nt, Human
caaugggccuauccgagcc

SEQ ID NO: 555780 - RNA, 21 nt, Human
cacagcccagcuuccucccuu

SEQ ID NO: 555781 - RNA, 19 nt, Human
caccaggugauaggagcca

SEQ ID NO: 555782 - RNA, 22 nt, Human
cacccagugcaguuccacagcc

SEQ ID NO: 555783 - RNA, 22 nt, Human
cacccucccccagccuugccac

SEQ ID NO: 555784 - RNA, 21 nt, Human
caccuccagcucagcccuucc

SEQ ID NO: 555785 - RNA, 21 nt, Human
caccugggcagcggggggagg

SEQ ID NO: 555786 - RNA, 22 nt, Human
cacgccggcucacuugcaccca

SEQ ID NO: 555787 - RNA, 20 nt, Human
cacuacguggcagucgcagc

SEQ ID NO: 555788 - RNA, 22 nt, Human
cacugcaccggaauggcagagc

SEQ ID NO: 555789 - RNA, 25 nt, Human
cagcaaagcuggcuccccgcucccu

SEQ ID NO: 555790 - RNA, 26 nt, Human
cagcaggccuucaaguuaagccaagc

SEQ ID NO: 555791 - RNA, 20 nt, Human
cagcaucacaaagaggcgga

SEQ ID NO: 555792 - RNA, 24 nt, Human
cagcggggggaggggagaaccuug

SEQ ID NO: 555793 - RNA, 19 nt, Human
ccaccccaaccugcuggca

SEQ ID NO: 555794 - RNA, 20 nt, Human
ccaccgcggcaaggugaggg

SEQ ID NO: 555795 - RNA, 22 nt, Human
ccacuaaacacacccauuuccu

SEQ ID NO: 555796 - RNA, 20 nt, Human
ccacugccugccaccuguug

SEQ ID NO: 555797 - RNA, 22 nt, Human
ccagccaggcccaagggggugg

SEQ ID NO: 555798 - RNA, 19 nt, Human
cccaaagcaucccgggggc

SEQ ID NO: 555799 - RNA, 25 nt, Human
cccaaagcaucccgggggccugcag

SEQ ID NO: 555800 - RNA, 21 nt, Human
cccacagcguucuaggagguc

SEQ ID NO: 555801 - RNA, 23 nt, Human
cccagagccccgcugucgggccc

SEQ ID NO: 555802 - RNA, 20 nt, Human
cccagccuugccacuuucaa

SEQ ID NO: 555803 - RNA, 21 nt, Human
cccagugcaguuccacagcca

SEQ ID NO: 555804 - RNA, 22 nt, Human
cccagugcaguuccacagccac

SEQ ID NO: 555805 - RNA, 21 nt, Human
ccccauacuggcccugccguc

SEQ ID NO: 555806 - RNA, 24 nt, Human
cccccagaaggagacagcaggccu

SEQ ID NO: 555807 - RNA, 19 nt, Human
cccccugcccucuucccuc

SEQ ID NO: 555808 - RNA, 18 nt, Human
ccccggagguuggaggcu

SEQ ID NO: 555809 - RNA, 19 nt, Human
cccuaagaauagggaagac

SEQ ID NO: 555810 - RNA, 21 nt, Human
cccucagugagcucccugagg

SEQ ID NO: 555811 - RNA, 20 nt, Human
cccucuacccgacacccucc

SEQ ID NO: 555812 - RNA, 22 nt, Human
cccucuacccgacacccucccc

SEQ ID NO: 555813 - RNA, 21 nt, Human
cccugacccccagaaggagac

SEQ ID NO: 555814 - RNA, 21 nt, Human
cccugcccaccuccagcucag

SEQ ID NO: 555815 - RNA, 21 nt, Human
cccuggaaaaaaacaaacaca

SEQ ID NO: 555816 - RNA, 18 nt, Human
cccuggcuaggggcccuc

SEQ ID NO: 555817 - RNA, 23 nt, Human
cccuggcuaggggcccucauggg

SEQ ID NO: 555818 - RNA, 22 nt, Human
cccuggcucugcugcgcucucc

SEQ ID NO: 555819 - RNA, 20 nt, Human
ccggcucacuugcacccaca

SEQ ID NO: 555820 - RNA, 18 nt, Human
ccgggggccugcagcucc

SEQ ID NO: 555821 - RNA, 19 nt, Human
ccguugggcaccuaugacc

SEQ ID NO: 555822 - RNA, 21 nt, Human
ccuccacauggugaaacuuca

SEQ ID NO: 555823 - RNA, 22 nt, Human
ccugcagauggccucugagucc

SEQ ID NO: 555824 - RNA, 25 nt, Human
ccugccaccuguuggguccugaggc

SEQ ID NO: 555825 - RNA, 25 nt, Human
ccuggcccuggccgcagagaggagc

SEQ ID NO: 555826 - RNA, 22 nt, Human
cgccccagggucccacgugcac

SEQ ID NO: 555827 - RNA, 23 nt, Human
cggcaaggugaggggcuguggcc

SEQ ID NO: 555828 - RNA, 18 nt, Human
cggcagccaggaacagaa

SEQ ID NO: 555829 - RNA, 19 nt, Human
cggcucuagcgugccuccu

SEQ ID NO: 555830 - RNA, 21 nt, Human
cggcugagacggcccggugcc

SEQ ID NO: 555831 - RNA, 18 nt, Human
cgggccuaauaggagcug

SEQ ID NO: 555832 - RNA, 21 nt, Human
cgugcacaaccaugcugcccc

SEQ ID NO: 555833 - RNA, 19 nt, Human
cguucuaggaggucgcggc

SEQ ID NO: 555834 - RNA, 23 nt, Human
cuccaccccugcaggccugggcu

SEQ ID NO: 555835 - RNA, 25 nt, Human
cuccagcucagcccuuccuguggcu

SEQ ID NO: 555836 - RNA, 19 nt, Human
cucccugugggacagaggg

SEQ ID NO: 555837 - RNA, 20 nt, Human
cuccgugcauuuggcaaagc

SEQ ID NO: 555838 - RNA, 25 nt, Human
cuccucccccugcacugcucugacc

SEQ ID NO: 555839 - RNA, 18 nt, Human
cugaaugucugaaugaca

SEQ ID NO: 555840 - RNA, 21 nt, Human
cugaggcugggacugccucug

SEQ ID NO: 555841 - RNA, 19 nt, Human
cugaggcuucugagggaga

SEQ ID NO: 555842 - RNA, 18 nt, Human
cugcccaccuccagcuca

SEQ ID NO: 555843 - RNA, 19 nt, Human
cugcccaccuccagcucag

SEQ ID NO: 555844 - RNA, 25 nt, Human
cugcugggccugacccagggggugc

SEQ ID NO: 555845 - RNA, 18 nt, Human
cugggcagcggggggagg

SEQ ID NO: 555846 - RNA, 23 nt, Human
cugugugcuggcagcaucucccc

SEQ ID NO: 555847 - RNA, 21 nt, Human
cuuccuguggcuuggcccugc

SEQ ID NO: 555848 - RNA, 18 nt, Human
cuugggacuugucccuaa

SEQ ID NO: 555849 - RNA, 20 nt, Human
gaacccaccuggcccuggcc

SEQ ID NO: 555850 - RNA, 19 nt, Human
gaaggggagggcaggggcc

SEQ ID NO: 555851 - RNA, 18 nt, Human
gaaugcaggcagaugggc

SEQ ID NO: 555852 - RNA, 19 nt, Human
gacaagccuggggaaaggg

SEQ ID NO: 555853 - RNA, 18 nt, Human
gagcaaugggaaacuggg

SEQ ID NO: 555854 - RNA, 22 nt, Human
gagcugagaggaggccaaggug

SEQ ID NO: 555855 - RNA, 18 nt, Human
gagcugggcuggagaaag

SEQ ID NO: 555856 - RNA, 21 nt, Human
gaggccaaggugcuuggggca

SEQ ID NO: 555857 - RNA, 24 nt, Human
gaggggcuguggccugugccaugg

SEQ ID NO: 555858 - RNA, 19 nt, Human
gaguccuccccuagccccc

SEQ ID NO: 555859 - RNA, 22 nt, Human
gcacaaccaugcugccccaugc

SEQ ID NO: 555860 - RNA, 26 nt, Human
gcaguccuaguuucuuccuccucugg

SEQ ID NO: 555861 - RNA, 18 nt, Human
gcauggccauccucuggg

SEQ ID NO: 555862 - RNA, 18 nt, Human
gccaagcacaucauggcu

SEQ ID NO: 555863 - RNA, 19 nt, Human
gcccaaagcaucccggggg

SEQ ID NO: 555864 - RNA, 23 nt, Human
gcccagcuuccucccuuucuccu

SEQ ID NO: 555865 - RNA, 21 nt, Human
gccccagggucccacgugcac

SEQ ID NO: 555866 - RNA, 23 nt, Human
gcccugcccaccuccagcucagc

SEQ ID NO: 555867 - RNA, 18 nt, Human
gcccugggaacacggcug

SEQ ID NO: 555868 - RNA, 23 nt, Human
gcccuggugggccaagcacauca

SEQ ID NO: 555869 - RNA, 27 nt, Human
gcugggagcaagagccgguccaucuuc

SEQ ID NO: 555870 - RNA, 19 nt, Human
gcuugggacgaggcuaggc

SEQ ID NO: 555871 - RNA, 18 nt, Human
ggaaaacucuuccagaaa

SEQ ID NO: 555872 - RNA, 23 nt, Human
ggaacacaacucccaugcaggag

SEQ ID NO: 555873 - RNA, 22 nt, Human
ggaaggcccuggugggccaagc

SEQ ID NO: 555874 - RNA, 20 nt, Human
ggaaugcaggcagaugggcc

SEQ ID NO: 555875 - RNA, 21 nt, Human
ggaccacacagcccagcuucc

SEQ ID NO: 555876 - RNA, 22 nt, Human
ggagagggagggggccccauac

SEQ ID NO: 555877 - RNA, 22 nt, Human
ggagcuccauucuucuccagcc

SEQ ID NO: 555878 - RNA, 18 nt, Human
ggagcucucaugccuguc

SEQ ID NO: 555879 - RNA, 21 nt, Human
ggagcugcgucccugaccccc

SEQ ID NO: 555880 - RNA, 18 nt, Human
ggaggaaggggagggcag

SEQ ID NO: 555881 - RNA, 19 nt, Human
ggaugggaggaaggggagg

SEQ ID NO: 555882 - RNA, 21 nt, Human
ggccccaaggcaagggcggag

SEQ ID NO: 555883 - RNA, 24 nt, Human
ggcccggugcccacgcugggcuca

SEQ ID NO: 555884 - RNA, 23 nt, Human
ggcucagggguggggagcggcag

SEQ ID NO: 555885 - RNA, 20 nt, Human
ggcuggaagagaaggucgcc

SEQ ID NO: 555886 - RNA, 24 nt, Human
gggagaaccuugggggucaggagc

SEQ ID NO: 555887 - RNA, 19 nt, Human
gggaggaaggggagggcag

SEQ ID NO: 555888 - RNA, 21 nt, Human
gggaugcccagagccccgcug

SEQ ID NO: 555889 - RNA, 23 nt, Human
gggccuaauaggagcugggagca

SEQ ID NO: 555890 - RNA, 20 nt, Human
gggccucagcugucuccucg

SEQ ID NO: 555891 - RNA, 19 nt, Human
ggggagggcaggggccugg

SEQ ID NO: 555892 - RNA, 21 nt, Human
ggggaggggagaaccuugggg

SEQ ID NO: 555893 - RNA, 23 nt, Human
ggggccccauacuggcccugccg

SEQ ID NO: 555894 - RNA, 25 nt, Human
gggggaggggagaaccuugggggug

SEQ ID NO: 555895 - RNA, 19 nt, Human
gggggugggaaugcaggca

SEQ ID NO: 555896 - RNA, 21 nt, Human
gguguggccgaccaggacugg

SEQ ID NO: 555897 - RNA, 24 nt, Human
gucaagauggaagagcgcuccucu

SEQ ID NO: 555898 - RNA, 23 nt, Human
gucccuuuccccacuaaacacac

SEQ ID NO: 555899 - RNA, 18 nt, Human
gucugcaccccgucccuu

SEQ ID NO: 555900 - RNA, 21 nt, Human
uaaaauaaaugcuaagcucug

SEQ ID NO: 555901 - RNA, 24 nt, Human
uaaauaagagaccuuaagcaaugc

SEQ ID NO: 555902 - RNA, 22 nt, Human
uaacaccaccuggaaaaguucc

SEQ ID NO: 555903 - RNA, 20 nt, Human
uacacugaggcugcgagauc

SEQ ID NO: 555904 - RNA, 18 nt, Human
uacagaccagugucccug

SEQ ID NO: 555905 - RNA, 19 nt, Human
uagaaaauaaauucaauaa

SEQ ID NO: 555906 - RNA, 21 nt, Human
uagcgugccuccucggcgagc

SEQ ID NO: 555907 - RNA, 21 nt, Human
uauuagcaaagaaaagagaaa

SEQ ID NO: 555908 - RNA, 18 nt, Human
ucaaagcuguguaaggca

SEQ ID NO: 555909 - RNA, 22 nt, Human
ucagcugucuccucgcggcucc

SEQ ID NO: 555910 - RNA, 23 nt, Human
uccagcucagcccuuccuguggc

SEQ ID NO: 555911 - RNA, 20 nt, Human
uccaguggagccucaggcua

SEQ ID NO: 555912 - RNA, 26 nt, Human
uccaucuucucuuuggugaggucucc

SEQ ID NO: 555913 - RNA, 18 nt, Human
uccccagcuuuuguauuc

SEQ ID NO: 555914 - RNA, 18 nt, Human
ucccugacccccagaagg

SEQ ID NO: 555915 - RNA, 18 nt, Human
ucccuggaaaaaaacaaa

SEQ ID NO: 555916 - RNA, 21 nt, Human
ucccugugggacagagggcuc

SEQ ID NO: 555917 - RNA, 21 nt, Human
uccuggucaagauggaagagc

SEQ ID NO: 555918 - RNA, 19 nt, Human
ucuaaaaaccucaaugggc

SEQ ID NO: 555919 - RNA, 23 nt, Human
ucuccaggcuucacccccugguc

SEQ ID NO: 555920 - RNA, 23 nt, Human
ucuccgcgggccucagcugucuc

SEQ ID NO: 555921 - RNA, 19 nt, Human
ucugaguccuccccuagcc

SEQ ID NO: 555922 - RNA, 26 nt, Human
ucugcccgccacccagugcaguucca

SEQ ID NO: 555923 - RNA, 19 nt, Human
ucuguaaauaugaacccac

SEQ ID NO: 555924 - RNA, 24 nt, Human
ucugugcccagcugcugugcaggg

SEQ ID NO: 555925 - RNA, 21 nt, Human
ucuucccucuacccgacaccc

SEQ ID NO: 555926 - RNA, 21 nt, Human
ucuuugggacacugguguggc

SEQ ID NO: 555927 - RNA, 20 nt, Human
ugaagacaccuggugcuucu

SEQ ID NO: 555928 - RNA, 20 nt, Human
ugacccagggggugcuucaa

SEQ ID NO: 555929 - RNA, 19 nt, Human
ugaccucuggucccacccc

SEQ ID NO: 555930 - RNA, 21 nt, Human
ugaccucuggucccaccccgg

SEQ ID NO: 555931 - RNA, 23 nt, Human
ugagacagagacccacgggcugc

SEQ ID NO: 555932 - RNA, 23 nt, Human
ugagaggaggccaaggugcuugg

SEQ ID NO: 555933 - RNA, 24 nt, Human
ugaggcuucugagggagagaagga

SEQ ID NO: 555934 - RNA, 26 nt, Human
ugagggacugcccuccaccccugcag

SEQ ID NO: 555935 - RNA, 19 nt, Human
ugaguccuccccuagcccc

SEQ ID NO: 555936 - RNA, 25 nt, Human
ugaguccuccccuagcccccugccc

SEQ ID NO: 555937 - RNA, 23 nt, Human
ugauaggagccaaaccuccacag

SEQ ID NO: 555938 - RNA, 21 nt, Human
ugcaaccccugggccuuacaa

SEQ ID NO: 555939 - RNA, 23 nt, Human
ugcaggcagaugggccaagguca

SEQ ID NO: 555940 - RNA, 20 nt, Human
ugccauggacucccagcagc

SEQ ID NO: 555941 - RNA, 25 nt, Human
ugccauggacucccagcagcauccc

SEQ ID NO: 555942 - RNA, 25 nt, Human
ugcccuccaccccugcaggccuggg

SEQ ID NO: 555943 - RNA, 19 nt, Human
ugccuggagcagcccugcc

SEQ ID NO: 555944 - RNA, 18 nt, Human
ugccugggauccagccag

SEQ ID NO: 555945 - RNA, 20 nt, Human
ugccugggauccagccaggc

SEQ ID NO: 555946 - RNA, 21 nt, Human
ugcucugaccugccuggagca

SEQ ID NO: 555947 - RNA, 23 nt, Human
ugcugggccugacccagggggug

SEQ ID NO: 555948 - RNA, 19 nt, Human
uggaaaaaaacaaacacac

SEQ ID NO: 555949 - RNA, 22 nt, Human
uggaaaaaaacaaacacaccaa

SEQ ID NO: 555950 - RNA, 24 nt, Human
uggagugggggcagggggguggcu

SEQ ID NO: 555951 - RNA, 18 nt, Human
uggcaccagaccucugcc

SEQ ID NO: 555952 - RNA, 22 nt, Human
uggcaccagaccucugccaggc

SEQ ID NO: 555953 - RNA, 23 nt, Human
uggcacugauaaaacaaagagaa

SEQ ID NO: 555954 - RNA, 20 nt, Human
uggcagaaugcacaggacuc

SEQ ID NO: 555955 - RNA, 19 nt, Human
uggcagcaggagggccccu

SEQ ID NO: 555956 - RNA, 18 nt, Human
uggcagcaucuccccagg

SEQ ID NO: 555957 - RNA, 18 nt, Human
uggcauguggagcuccau

SEQ ID NO: 555958 - RNA, 23 nt, Human
uggccucugaguccuccccuagc

SEQ ID NO: 555959 - RNA, 19 nt, Human
uggcuccuggguccgcccc

SEQ ID NO: 555960 - RNA, 21 nt, Human
uggcucugcugcgcucuccuc

SEQ ID NO: 555961 - RNA, 18 nt, Human
ugggaacacggcugagac

SEQ ID NO: 555962 - RNA, 20 nt, Human
ugggacaagccuggggaaag

SEQ ID NO: 555963 - RNA, 21 nt, Human
ugggacaagccuggggaaagg

SEQ ID NO: 555964 - RNA, 20 nt, Human
ugggacagagggcucccacc

SEQ ID NO: 555965 - RNA, 20 nt, Human
ugggaggaaggggagggcaa

SEQ ID NO: 555966 - RNA, 23 nt, Human
ugggaggaaggggagggcagggg

SEQ ID NO: 555967 - RNA, 21 nt, Human
ugggcagcggggggaggggag

SEQ ID NO: 555968 - RNA, 22 nt, Human
uggggagcggcagugcugggac

SEQ ID NO: 555969 - RNA, 21 nt, Human
uggggcgggcacccuguccac

SEQ ID NO: 555970 - RNA, 23 nt, Human
uggggcucucgcugucugcaggu

SEQ ID NO: 555971 - RNA, 19 nt, Human
ugggguccuggcucagggg

SEQ ID NO: 555972 - RNA, 20 nt, Human
uggugaggguggagcugcgu

SEQ ID NO: 555973 - RNA, 18 nt, Human
ugguggguccuugggaga

SEQ ID NO: 555974 - RNA, 18 nt, Human
uuaacacagcccaacugg

SEQ ID NO: 555975 - RNA, 23 nt, Human
uucaauaauacugcaaaaaaagg

SEQ ID NO: 555976 - RNA, 22 nt, Human
uucccaaugagaccaauuugau

SEQ ID NO: 555977 - RNA, 19 nt, Human
uuccccacuaaacacaccc

SEQ ID NO: 555978 - RNA, 22 nt, Human
uuccuguggcuuggcccugcag

SEQ ID NO: 555979 - RNA, 19 nt, Human
uucgcaaggccugcacugc

SEQ ID NO: 555980 - RNA, 18 nt, Human
uuggcaaagcuauggagc

SEQ ID NO: 555981 - RNA, 25 nt, Human
uuggguccugaggcuucugagggag

SEQ ID NO: 555982 - RNA, 21 nt, Human
acugccuccuccugcgcuuuc

SEQ ID NO: 555983 - RNA, 18 nt, Human
aggcagcagugcggccca

SEQ ID NO: 555984 - RNA, 22 nt, Human
aggcggagacgcagaggaggcc

SEQ ID NO: 555985 - RNA, 24 nt, Human
aggucccaggcgccggcccuggac

SEQ ID NO: 555986 - RNA, 20 nt, Human
cacagcccauucaacagggc

SEQ ID NO: 555987 - RNA, 20 nt, Human
cacccggccuaaggccuaac

SEQ ID NO: 555988 - RNA, 18 nt, Human
caccgcugcagcugccgg

SEQ ID NO: 555989 - RNA, 22 nt, Human
cagggccgcccgccaggucccc

SEQ ID NO: 555990 - RNA, 21 nt, Human
ccaggucccaggcgccggccc

SEQ ID NO: 555991 - RNA, 21 nt, Human
ccccggagauccucgcguagg

SEQ ID NO: 555992 - RNA, 19 nt, Human
ccccggaggccgcguucgc

SEQ ID NO: 555993 - RNA, 22 nt, Human
ccccgggccucaggccggaccc

SEQ ID NO: 555994 - RNA, 23 nt, Human
ccccgggccucaggccggacccc

SEQ ID NO: 555995 - RNA, 23 nt, Human
cccgggccucaggccggaccccu

SEQ ID NO: 555996 - RNA, 22 nt, Human
ccgccccgggccucaggccgga

SEQ ID NO: 555997 - RNA, 19 nt, Human
ccgcccuucgccgucccug

SEQ ID NO: 555998 - RNA, 22 nt, Human
ccgccgccaacuccaacacccg

SEQ ID NO: 555999 - RNA, 20 nt, Human
ccgcugcagcugccgugcgc

SEQ ID NO: 556000 - RNA, 20 nt, Human
ccucaggccggaccccuccu

SEQ ID NO: 556001 - RNA, 21 nt, Human
ccuccuccugcgcuuuccgcc

SEQ ID NO: 556002 - RNA, 22 nt, Human
ccucgcgcaccccggauggcga

SEQ ID NO: 556003 - RNA, 20 nt, Human
cgccaccgcugcagcugccg

SEQ ID NO: 556004 - RNA, 24 nt, Human
cgccccgggccucaggccggaccc

SEQ ID NO: 556005 - RNA, 24 nt, Human
cgccgccccgggccucaggccgga

SEQ ID NO: 556006 - RNA, 19 nt, Human
cgccgucgccgccgccgcg

SEQ ID NO: 556007 - RNA, 19 nt, Human
cggaggccgcguucgccag

SEQ ID NO: 556008 - RNA, 19 nt, Human
cgugcgcccccggaggccg

SEQ ID NO: 556009 - RNA, 22 nt, Human
cuccaacacccguuuggucgcc

SEQ ID NO: 556010 - RNA, 18 nt, Human
cuccauggcggacgccgc

SEQ ID NO: 556011 - RNA, 21 nt, Human
cuccugcgcuuuccgcccuuc

SEQ ID NO: 556012 - RNA, 22 nt, Human
cugcagcugccgugcgcccccg

SEQ ID NO: 556013 - RNA, 18 nt, Human
gacccagcccgcgcaggg

SEQ ID NO: 556014 - RNA, 23 nt, Human
gaccccuccuuccugcgggaugc

SEQ ID NO: 556015 - RNA, 20 nt, Human
gagugccgcgaagggcacgu

SEQ ID NO: 556016 - RNA, 18 nt, Human
gcccaggcagcagugcgg

SEQ ID NO: 556017 - RNA, 21 nt, Human
gcccuggaccgaggggaucuc

SEQ ID NO: 556018 - RNA, 19 nt, Human
gcgaugcggaacgcucccg

SEQ ID NO: 556019 - RNA, 26 nt, Human
gcuuuccgcccuucgccgucccugac

SEQ ID NO: 556020 - RNA, 26 nt, Human
uccgccgagcucagaagugccaggcg

SEQ ID NO: 556021 - RNA, 19 nt, Human
ucgccgccgccgcgcccag

SEQ ID NO: 556022 - RNA, 21 nt, Human
ucuccauggcggacgccgccc

SEQ ID NO: 556023 - RNA, 25 nt, Human
ucuccugacccggcccacccggccu

SEQ ID NO: 556024 - RNA, 18 nt, Human
ugacccggcccacccggc

SEQ ID NO: 556025 - RNA, 18 nt, Human
ugacuggaggaaaccugc

SEQ ID NO: 556026 - RNA, 21 nt, Human
ugacuggaggaaaccugcagg

SEQ ID NO: 556027 - RNA, 22 nt, Human
ugccaggcgcugccaacggccc

SEQ ID NO: 556028 - RNA, 24 nt, Human
ugccgcgaagggcacguccgcgac

SEQ ID NO: 556029 - RNA, 18 nt, Human
uuuuuuuuuuuuuuuuug

SEQ ID NO: 556030 - RNA, 20 nt, Human
uuuuuuuuuuuuuuuuuugu

SEQ ID NO: 556031 - RNA, 26 nt, Human
aaaaaaaaucaaacacacaaauacug

SEQ ID NO: 556032 - RNA, 21 nt, Human
aaaaaaacccacaaaaacaga

SEQ ID NO: 556033 - RNA, 25 nt, Human
aaaaaaucaaacacacaaauacugg

SEQ ID NO: 556034 - RNA, 23 nt, Human
aaagaaaaaugauaggccuggug

SEQ ID NO: 556035 - RNA, 21 nt, Human
aacaagucuucccucccccag

SEQ ID NO: 556036 - RNA, 19 nt, Human
aagagaaacaacugaagca

SEQ ID NO: 556037 - RNA, 21 nt, Human
acaaaugccccaaaacacacc

SEQ ID NO: 556038 - RNA, 24 nt, Human
acaagcaaggaauguuuuauugug

SEQ ID NO: 556039 - RNA, 18 nt, Human
acacagugcccaaaagcu

SEQ ID NO: 556040 - RNA, 21 nt, Human
acagaacccacaaauaggagc

SEQ ID NO: 556041 - RNA, 26 nt, Human
acagccacaagaacccuggaaggccc

SEQ ID NO: 556042 - RNA, 24 nt, Human
acagugcccaaaagcuuuaaaugc

SEQ ID NO: 556043 - RNA, 18 nt, Human
accauaucuuauagaaac

SEQ ID NO: 556044 - RNA, 24 nt, Human
agagauuuacgauguaaugaauaa

SEQ ID NO: 556045 - RNA, 26 nt, Human
aggaauuugggggaaagggaagaaug

SEQ ID NO: 556046 - RNA, 21 nt, Human
agucuucccucccccagcucc

SEQ ID NO: 556047 - RNA, 23 nt, Human
augaacaauagcuuuugcuaguu

SEQ ID NO: 556048 - RNA, 19 nt, Human
augucaaacggucacauuu

SEQ ID NO: 556049 - RNA, 25 nt, Human
auugcagaggcucaucuuggugguc

SEQ ID NO: 556050 - RNA, 24 nt, Human
auuucuucucuuccucauccuggu

SEQ ID NO: 556051 - RNA, 23 nt, Human
caaaaaaaaaaaaaacccacaaa

SEQ ID NO: 556052 - RNA, 25 nt, Human
caaaaaaaaaaaaaacccacaaaaa

SEQ ID NO: 556053 - RNA, 20 nt, Human
caaaacuuaccacuacucaa

SEQ ID NO: 556054 - RNA, 24 nt, Human
caaauuuaguccuuuaguuuuauc

SEQ ID NO: 556055 - RNA, 19 nt, Human
cacaaaaacagaacccaca

SEQ ID NO: 556056 - RNA, 22 nt, Human
cacaaaugccccaaaacacacc

SEQ ID NO: 556057 - RNA, 25 nt, Human
caccauaaaaaaguuuugcccuagg

SEQ ID NO: 556058 - RNA, 18 nt, Human
cacuauauaguaacagau

SEQ ID NO: 556059 - RNA, 21 nt, Human
cagaacccacaaauaggagca

SEQ ID NO: 556060 - RNA, 19 nt, Human
cagaucucuuuaagaaguu

SEQ ID NO: 556061 - RNA, 20 nt, Human
caucacagugguggcugggu

SEQ ID NO: 556062 - RNA, 24 nt, Human
caucagccuaucuguacuuuucuu

SEQ ID NO: 556063 - RNA, 24 nt, Human
ccaacacagugaugcaguacugag

SEQ ID NO: 556064 - RNA, 19 nt, Human
ccacaaaaacagaacccac

SEQ ID NO: 556065 - RNA, 27 nt, Human
ccagucaaaaaaggcuauagagaaaaa

SEQ ID NO: 556066 - RNA, 19 nt, Human
cccacaaaaacagaaccca

SEQ ID NO: 556067 - RNA, 22 nt, Human
cccacuucuauaaaaauaucac

SEQ ID NO: 556068 - RNA, 21 nt, Human
ccccuugcuuccccagucaaa

SEQ ID NO: 556069 - RNA, 23 nt, Human
ccuguggcauacuggcugggaag

SEQ ID NO: 556070 - RNA, 22 nt, Human
cgaaaacucuaaggaacaacaa

SEQ ID NO: 556071 - RNA, 21 nt, Human
cuaaaacucauuugcuagcuc

SEQ ID NO: 556072 - RNA, 21 nt, Human
cucccauguuaacagcaccau

SEQ ID NO: 556073 - RNA, 20 nt, Human
cucuaaggaacaacaaaacc

SEQ ID NO: 556074 - RNA, 23 nt, Human
cugacaacagccacaagaacccu

SEQ ID NO: 556075 - RNA, 21 nt, Human
cuguacaaauuagccugcaua

SEQ ID NO: 556076 - RNA, 18 nt, Human
cuucucuuccucauccuc

SEQ ID NO: 556077 - RNA, 21 nt, Human
gaacaagucuucccuccccca

SEQ ID NO: 556078 - RNA, 21 nt, Human
gacugccuuuguuauuacaga

SEQ ID NO: 556079 - RNA, 20 nt, Human
gcaaagaacaguuuucuagc

SEQ ID NO: 556080 - RNA, 18 nt, Human
gcacuaccugaaaauaac

SEQ ID NO: 556081 - RNA, 20 nt, Human
gcgugacccccuuuccuuuc

SEQ ID NO: 556082 - RNA, 19 nt, Human
ggacugggcuguuucaggc

SEQ ID NO: 556083 - RNA, 26 nt, Human
gggaagagaaacaacugaagcaagcc

SEQ ID NO: 556084 - RNA, 18 nt, Human
ggggaaguuuugcugaag

SEQ ID NO: 556085 - RNA, 21 nt, Human
gggggaaagggaagaaugcgg

SEQ ID NO: 556086 - RNA, 22 nt, Human
guggagcugcuguucuuaggug

SEQ ID NO: 556087 - RNA, 20 nt, Human
guguggacgccgcccagcuc

SEQ ID NO: 556088 - RNA, 20 nt, Human
uaacacgaaaacucuaagga

SEQ ID NO: 556089 - RNA, 19 nt, Human
uaacauucaacauugugcu

SEQ ID NO: 556090 - RNA, 26 nt, Human
uaacugaacuaaaauuaauacaggaa

SEQ ID NO: 556091 - RNA, 20 nt, Human
uaccuaaugcuauaggggua

SEQ ID NO: 556092 - RNA, 25 nt, Human
uagaaacauagcuaguacaagaaca

SEQ ID NO: 556093 - RNA, 26 nt, Human
uagcaucucugggauacacagggcac

SEQ ID NO: 556094 - RNA, 18 nt, Human
uaggagauaccauaucca

SEQ ID NO: 556095 - RNA, 19 nt, Human
uaggagcaaagaacaguuu

SEQ ID NO: 556096 - RNA, 23 nt, Human
uaggaggcacuauaauaacuuua

SEQ ID NO: 556097 - RNA, 19 nt, Human
uaguaauauacauuuugca

SEQ ID NO: 556098 - RNA, 21 nt, Human
uauccuuuagguagcaggaca

SEQ ID NO: 556099 - RNA, 24 nt, Human
uaucuguacaaauuagccugcaua

SEQ ID NO: 556100 - RNA, 20 nt, Human
uauggaguaaacucagcagc

SEQ ID NO: 556101 - RNA, 26 nt, Human
uauucuauuuuccuuucaggaauuca

SEQ ID NO: 556102 - RNA, 18 nt, Human
uauuguaaacugcagaaa

SEQ ID NO: 556103 - RNA, 19 nt, Human
ucaaaaaaaaucaaacaca

SEQ ID NO: 556104 - RNA, 24 nt, Human
ucaaaaaaaaucaaacacacaaau

SEQ ID NO: 556105 - RNA, 21 nt, Human
ucaaaauaaggcaauaaccau

SEQ ID NO: 556106 - RNA, 18 nt, Human
ucaaacacacaaauacug

SEQ ID NO: 556107 - RNA, 23 nt, Human
ucaaacggucacauuuuacagaa

SEQ ID NO: 556108 - RNA, 24 nt, Human
ucagucauuacuaauggcaaugag

SEQ ID NO: 556109 - RNA, 26 nt, Human
uccacaaaugccccaaaacacaccuu

SEQ ID NO: 556110 - RNA, 24 nt, Human
ucggcauuuccuuaccacauauau

SEQ ID NO: 556111 - RNA, 24 nt, Human
ucuaaaaagaaaaaugauaggccu

SEQ ID NO: 556112 - RNA, 18 nt, Human
ucucaaaaaaaaaaaaaa

SEQ ID NO: 556113 - RNA, 24 nt, Human
ucucaaaaaaaaaaaaaacccaca

SEQ ID NO: 556114 - RNA, 22 nt, Human
ucuccacuuacuuccauauccc

SEQ ID NO: 556115 - RNA, 22 nt, Human
ucuguacaaauuagccugcaua

SEQ ID NO: 556116 - RNA, 19 nt, Human
ugaagugucuguacuugug

SEQ ID NO: 556117 - RNA, 18 nt, Human
ugacaacagccacaagaa

SEQ ID NO: 556118 - RNA, 26 nt, Human
ugacaacagccacaagaacccuggaa

SEQ ID NO: 556119 - RNA, 21 nt, Human
ugagagggacuucauuuggug

SEQ ID NO: 556120 - RNA, 24 nt, Human
ugcagaggcucaucuuggaacaag

SEQ ID NO: 556121 - RNA, 22 nt, Human
ugcauauucaggaauggaacaa

SEQ ID NO: 556122 - RNA, 18 nt, Human
ugcccuaggaauuugggg

SEQ ID NO: 556123 - RNA, 20 nt, Human
uggagcugcgugagagggac

SEQ ID NO: 556124 - RNA, 24 nt, Human
uggagcugcgugagagggacuuca

SEQ ID NO: 556125 - RNA, 19 nt, Human
uggaugauuauagcucugg

SEQ ID NO: 556126 - RNA, 19 nt, Human
uguagaggauauucacaua

SEQ ID NO: 556127 - RNA, 21 nt, Human
ugucacacagccauuaagaca

SEQ ID NO: 556128 - RNA, 19 nt, Human
uguccauucacgagacagc

SEQ ID NO: 556129 - RNA, 22 nt, Human
ugugcgugacccccuuuccuuu

SEQ ID NO: 556130 - RNA, 22 nt, Human
uguuaggaaagcaauuuaugag

SEQ ID NO: 556131 - RNA, 19 nt, Human
uucacuacacauuagcugu

SEQ ID NO: 556132 - RNA, 18 nt, Human
uucaggaauggaacaacc

SEQ ID NO: 556133 - RNA, 19 nt, Human
uuccccagucaaaaaaggc

SEQ ID NO: 556134 - RNA, 24 nt, Human
uuccuuaaucccuaucuguacaaa

SEQ ID NO: 556135 - RNA, 21 nt, Human
uucguaaguuccuaaugccac

SEQ ID NO: 556136 - RNA, 21 nt, Human
uugcugaaguaauuccagucu

SEQ ID NO: 556137 - RNA, 19 nt, Human
uuuuguuugauuuuuuguc

SEQ ID NO: 556138 - RNA, 28 nt, Human
aaaagcugaagucuagaaccgaagacac

SEQ ID NO: 556139 - RNA, 18 nt, Human
aaacgaaguggagacucg

SEQ ID NO: 556140 - RNA, 20 nt, Human
acauccauacaaaauauagc

SEQ ID NO: 556141 - RNA, 23 nt, Human
accuugaaaaauauuuugaaaaa

SEQ ID NO: 556142 - RNA, 24 nt, Human
aguggagacucgggcgcuggagcu

SEQ ID NO: 556143 - RNA, 20 nt, Human
auuuagcaauuuccaaaagc

SEQ ID NO: 556144 - RNA, 20 nt, Human
caaauaugaaguauaucacc

SEQ ID NO: 556145 - RNA, 20 nt, Human
cuacagaggcaggauucucu

SEQ ID NO: 556146 - RNA, 18 nt, Human
gagcuccgggucgcaccg

SEQ ID NO: 556147 - RNA, 19 nt, Human
gcagagauuuuugaauucu

SEQ ID NO: 556148 - RNA, 20 nt, Human
gcagagauuuuugaauucua

SEQ ID NO: 556149 - RNA, 18 nt, Human
ggcguaaccugcuacugg

SEQ ID NO: 556150 - RNA, 25 nt, Human
uagcaauuuccaaaagcugaagucu

SEQ ID NO: 556151 - RNA, 24 nt, Human
uauagcaaugguugugggcauaaa

SEQ ID NO: 556152 - RNA, 21 nt, Human
uccgggucgcaccgcccuggg

SEQ ID NO: 556153 - RNA, 19 nt, Human
ugacauggcguaaccugcu

SEQ ID NO: 556154 - RNA, 24 nt, Human
uggagacucgggcgcuggagcucc

SEQ ID NO: 556155 - RNA, 27 nt, Human
uuagaaaauaaaacuuuuaauacuuaa

SEQ ID NO: 556156 - RNA, 21 nt, Human
uugcuggaugacucuugaaau

SEQ ID NO: 556157 - RNA, 20 nt, Human
uuuuuuuuuuuuuaaaggug

SEQ ID NO: 556158 - RNA, 22 nt, Human
uuuuuuuuuuuuuuuuuaaagg

SEQ ID NO: 556159 - RNA, 20 nt, Human
aacauggugaaacccugucu

SEQ ID NO: 556160 - RNA, 21 nt, Human
aacauggugaaacccugucuc

SEQ ID NO: 556161 - RNA, 18 nt, Human
aagaagacaaaggucuuc

SEQ ID NO: 556162 - RNA, 18 nt, Human
aagacaaaggucuucagc

SEQ ID NO: 556163 - RNA, 18 nt, Human
aagcggaacacaaagcgc

SEQ ID NO: 556164 - RNA, 18 nt, Human
aagucuugaccacugagc

SEQ ID NO: 556165 - RNA, 24 nt, Human
aaucgcuugaacccaggaggugga

SEQ ID NO: 556166 - RNA, 24 nt, Human
aaucgcuugaacccaggaggugga

SEQ ID NO: 556167 - RNA, 24 nt, Human
acccugucucuacuaaaaauauaa

SEQ ID NO: 556168 - RNA, 18 nt, Human
acugcacuccaaccuggg

SEQ ID NO: 556169 - RNA, 18 nt, Human
acugcacuccaaccuggg

SEQ ID NO: 556170 - RNA, 24 nt, Human
acugcacuccaaccugggagacag

SEQ ID NO: 556171 - RNA, 24 nt, Human
acugcacuccaaccugggagacag

SEQ ID NO: 556172 - RNA, 24 nt, Human
acuugaggucagggguucaagacc

SEQ ID NO: 556173 - RNA, 19 nt, Human
agaaagacuuccaggagca

SEQ ID NO: 556174 - RNA, 22 nt, Human
agaaucgcuugaacccaggagg

SEQ ID NO: 556175 - RNA, 19 nt, Human
agaccaggaggaggaagac

SEQ ID NO: 556176 - RNA, 24 nt, Human
agcacuuugggaggcagagguggg

SEQ ID NO: 556177 - RNA, 19 nt, Human
agcagcaccaguagcagca

SEQ ID NO: 556178 - RNA, 20 nt, Human
agccgagaucgugccacugc

SEQ ID NO: 556179 - RNA, 20 nt, Human
agccgagaucgugccacugc

SEQ ID NO: 556180 - RNA, 22 nt, Human
agccuggacaacauggugaaac

SEQ ID NO: 556181 - RNA, 24 nt, Human
agccuggacaacauggugaaaccc

SEQ ID NO: 556182 - RNA, 18 nt, Human
agcuggacaugggggccc

SEQ ID NO: 556183 - RNA, 18 nt, Human
agcuggacaugggggccc

SEQ ID NO: 556184 - RNA, 28 nt, Human
aggcagaaaaagaagaugcgucagcugg

SEQ ID NO: 556185 - RNA, 21 nt, Human
aggcagagguggguggaucac

SEQ ID NO: 556186 - RNA, 23 nt, Human
aggcaggagaaucgcuugaaccc

SEQ ID NO: 556187 - RNA, 23 nt, Human
aggcaggagaaucgcuugaaccc

SEQ ID NO: 556188 - RNA, 24 nt, Human
aggcaggagaaucgcuugaaccca

SEQ ID NO: 556189 - RNA, 24 nt, Human
aggcaggagaaucgcuugaaccca

SEQ ID NO: 556190 - RNA, 22 nt, Human
aggcauugaaggguuggcaccu

SEQ ID NO: 556191 - RNA, 20 nt, Human
aggcugaggcaggagaaucg

SEQ ID NO: 556192 - RNA, 20 nt, Human
aggcugaggcaggagaaucg

SEQ ID NO: 556193 - RNA, 24 nt, Human
aggcugaggcaggagaaucgcuug

SEQ ID NO: 556194 - RNA, 24 nt, Human
aggcugaggcaggagaaucgcuug

SEQ ID NO: 556195 - RNA, 21 nt, Human
aggucagggguucaagaccag

SEQ ID NO: 556196 - RNA, 21 nt, Human
agguggagguugcagucagcc

SEQ ID NO: 556197 - RNA, 24 nt, Human
agguggagguugcagucagccgag

SEQ ID NO: 556198 - RNA, 24 nt, Human
agguggagguugcagucagccgag

SEQ ID NO: 556199 - RNA, 23 nt, Human
agguggguggaucacuugagguc

SEQ ID NO: 556200 - RNA, 19 nt, Human
agucagccgagaucgugcc

SEQ ID NO: 556201 - RNA, 19 nt, Human
agucagccgagaucgugcc

SEQ ID NO: 556202 - RNA, 19 nt, Human
auaguacuuggacccccag

SEQ ID NO: 556203 - RNA, 24 nt, Human
aucacuugaggucagggguucaag

SEQ ID NO: 556204 - RNA, 22 nt, Human
aucccugggggcagggucuccg

SEQ ID NO: 556205 - RNA, 24 nt, Human
aucgugccacugcacuccaaccug

SEQ ID NO: 556206 - RNA, 24 nt, Human
aucgugccacugcacuccaaccug

SEQ ID NO: 556207 - RNA, 22 nt, Human
augaagacaugaggucuagguu

SEQ ID NO: 556208 - RNA, 22 nt, Human
caacauggugaaacccugucuc

SEQ ID NO: 556209 - RNA, 24 nt, Human
caacauggugaaacccugucucua

SEQ ID NO: 556210 - RNA, 20 nt, Human
caaccccuucacccagcucu

SEQ ID NO: 556211 - RNA, 24 nt, Human
cacaccuguaaucccagcacuuug

SEQ ID NO: 556212 - RNA, 18 nt, Human
cacauugccacccauguc

SEQ ID NO: 556213 - RNA, 23 nt, Human
caccuguaaucccagcacuuugg

SEQ ID NO: 556214 - RNA, 24 nt, Human
caccuguaaucccagcacuuuggg

SEQ ID NO: 556215 - RNA, 23 nt, Human
cacgccuguaaucccagcuacug

SEQ ID NO: 556216 - RNA, 23 nt, Human
cacgccuguaaucccagcuacug

SEQ ID NO: 556217 - RNA, 23 nt, Human
cacuccaaccugggagacagagc

SEQ ID NO: 556218 - RNA, 23 nt, Human
cacuccaaccugggagacagagc

SEQ ID NO: 556219 - RNA, 24 nt, Human
cacugcacuccaaccugggagaca

SEQ ID NO: 556220 - RNA, 24 nt, Human
cacugcacuccaaccugggagaca

SEQ ID NO: 556221 - RNA, 18 nt, Human
cacugcaggcugccggaa

SEQ ID NO: 556222 - RNA, 23 nt, Human
cacuugaggucagggguucaaga

SEQ ID NO: 556223 - RNA, 23 nt, Human
cagagcucggggccccgggcccc

SEQ ID NO: 556224 - RNA, 27 nt, Human
cagagguggguggaucacuugagguca

SEQ ID NO: 556225 - RNA, 18 nt, Human
cagaugagaaaacagacu

SEQ ID NO: 556226 - RNA, 21 nt, Human
cagcaccagggugcgccagua

SEQ ID NO: 556227 - RNA, 18 nt, Human
cagcaccaguagcagcag

SEQ ID NO: 556228 - RNA, 21 nt, Human
cagcacuuugggaggcagagg

SEQ ID NO: 556229 - RNA, 24 nt, Human
cagcacuuugggaggcagaggugg

SEQ ID NO: 556230 - RNA, 20 nt, Human
cagcagcaccagggugcgcc

SEQ ID NO: 556231 - RNA, 19 nt, Human
cagcgaaacagauugcacc

SEQ ID NO: 556232 - RNA, 21 nt, Human
cagcgaaacagauugcaccuc

SEQ ID NO: 556233 - RNA, 25 nt, Human
caggaccagcacugcaggcugccgg

SEQ ID NO: 556234 - RNA, 18 nt, Human
caguggcgguggguggga

SEQ ID NO: 556235 - RNA, 20 nt, Human
cauaaaaaaagaaagcgguc

SEQ ID NO: 556236 - RNA, 26 nt, Human
cauccagaaccacauccuccguguuc

SEQ ID NO: 556237 - RNA, 22 nt, Human
caucucuccggugaguggauuc

SEQ ID NO: 556238 - RNA, 18 nt, Human
ccacagcguuggcacagc

SEQ ID NO: 556239 - RNA, 19 nt, Human
ccacgccuguaaucccagc

SEQ ID NO: 556240 - RNA, 19 nt, Human
ccacgccuguaaucccagc

SEQ ID NO: 556241 - RNA, 20 nt, Human
ccacugcacuccaaccuggg

SEQ ID NO: 556242 - RNA, 20 nt, Human
ccacugcacuccaaccuggg

SEQ ID NO: 556243 - RNA, 22 nt, Human
ccacugcacuccaaccugggag

SEQ ID NO: 556244 - RNA, 22 nt, Human
ccacugcacuccaaccugggag

SEQ ID NO: 556245 - RNA, 24 nt, Human
ccacugcacuccaaccugggagac

SEQ ID NO: 556246 - RNA, 24 nt, Human
ccacugcacuccaaccugggagac

SEQ ID NO: 556247 - RNA, 19 nt, Human
ccaggagcaggcauugaag

SEQ ID NO: 556248 - RNA, 20 nt, Human
cccacgccuguaaucccagc

SEQ ID NO: 556249 - RNA, 20 nt, Human
cccacgccuguaaucccagc

SEQ ID NO: 556250 - RNA, 23 nt, Human
cccacgccuguaaucccagcuac

SEQ ID NO: 556251 - RNA, 23 nt, Human
cccacgccuguaaucccagcuac

SEQ ID NO: 556252 - RNA, 21 nt, Human
cccaggagguggagguugcag

SEQ ID NO: 556253 - RNA, 21 nt, Human
cccaggagguggagguugcag

SEQ ID NO: 556254 - RNA, 20 nt, Human
cccccagucgagcuccucug

SEQ ID NO: 556255 - RNA, 23 nt, Human
cccgugaggauguacacauugcc

SEQ ID NO: 556256 - RNA, 19 nt, Human
cccuggagcuccugcagcg

SEQ ID NO: 556257 - RNA, 26 nt, Human
ccgacucccaagcccaagucuugacc

SEQ ID NO: 556258 - RNA, 19 nt, Human
ccuccacagucagcagcuc

SEQ ID NO: 556259 - RNA, 21 nt, Human
ccuccuucagcuucacuaccg

SEQ ID NO: 556260 - RNA, 24 nt, Human
ccugcaggaccagcacugcaggcu

SEQ ID NO: 556261 - RNA, 22 nt, Human
ccuggacaacauggugaaaccc

SEQ ID NO: 556262 - RNA, 24 nt, Human
ccuggacaacauggugaaacccug

SEQ ID NO: 556263 - RNA, 18 nt, Human
ccuguaaucccagcuacu

SEQ ID NO: 556264 - RNA, 22 nt, Human
ccuguaaucccagcuacugggg

SEQ ID NO: 556265 - RNA, 22 nt, Human
ccuguaaucccagcuacugggg

SEQ ID NO: 556266 - RNA, 19 nt, Human
cgagaucgugccacugcac

SEQ ID NO: 556267 - RNA, 22 nt, Human
cgccuguaaucccagcuacugg

SEQ ID NO: 556268 - RNA, 23 nt, Human
cgccuguaaucccagcuacuggg

SEQ ID NO: 556269 - RNA, 23 nt, Human
cgccuguaaucccagcuacuggg

SEQ ID NO: 556270 - RNA, 19 nt, Human
cggcccggccccauugcgg

SEQ ID NO: 556271 - RNA, 21 nt, Human
cggcgccagaugaagaagaca

SEQ ID NO: 556272 - RNA, 20 nt, Human
cggugggugggagggucccc

SEQ ID NO: 556273 - RNA, 22 nt, Human
cucacaccuguaaucccagcac

SEQ ID NO: 556274 - RNA, 24 nt, Human
cucacaccuguaaucccagcacuu

SEQ ID NO: 556275 - RNA, 22 nt, Human
cuccaaccccuucacccagcuc

SEQ ID NO: 556276 - RNA, 23 nt, Human
cucggcccggccccauugcgggc

SEQ ID NO: 556277 - RNA, 18 nt, Human
cucggggccccgggcccc

SEQ ID NO: 556278 - RNA, 22 nt, Human
cugccccuggagcuccugcaac

SEQ ID NO: 556279 - RNA, 24 nt, Human
cuggacaacauggugaaacccugu

SEQ ID NO: 556280 - RNA, 21 nt, Human
cuggccggcccuuccuccucc

SEQ ID NO: 556281 - RNA, 19 nt, Human
cuuggacccccagucgagc

SEQ ID NO: 556282 - RNA, 21 nt, Human
cuugguuggcaguggcggugg

SEQ ID NO: 556283 - RNA, 19 nt, Human
gaacuccaggucuucuggc

SEQ ID NO: 556284 - RNA, 23 nt, Human
gagaaaacagacuugaagagguu

SEQ ID NO: 556285 - RNA, 23 nt, Human
gagaaucgcuugaacccaggagg

SEQ ID NO: 556286 - RNA, 18 nt, Human
gagaucgugccacugcac

SEQ ID NO: 556287 - RNA, 19 nt, Human
gaggaagacggugagcagc

SEQ ID NO: 556288 - RNA, 30 nt, Human
gaggcagagguggguggaucacuugagguu

SEQ ID NO: 556289 - RNA, 19 nt, Human
gaggcuugaugucaacugg

SEQ ID NO: 556290 - RNA, 24 nt, Human
gagguggguggaucacuugagguu

SEQ ID NO: 556291 - RNA, 23 nt, Human
gagguugcagucagccgagaucg

SEQ ID NO: 556292 - RNA, 23 nt, Human
gagguugcagucagccgagaucg

SEQ ID NO: 556293 - RNA, 23 nt, Human
gaucacuugaggucagggguuca

SEQ ID NO: 556294 - RNA, 24 nt, Human
gaucacuugaggucagggguucaa

SEQ ID NO: 556295 - RNA, 19 nt, Human
gaucugggaugucuuccuc

SEQ ID NO: 556296 - RNA, 22 nt, Human
gaugagaaaacagacuugaaga

SEQ ID NO: 556297 - RNA, 18 nt, Human
gcaaaggguccagaccug

SEQ ID NO: 556298 - RNA, 22 nt, Human
gcagcaccaguagcagcagcac

SEQ ID NO: 556299 - RNA, 22 nt, Human
gcaggagaaucgcuugaaccca

SEQ ID NO: 556300 - RNA, 22 nt, Human
gcaggagaaucgcuugaaccca

SEQ ID NO: 556301 - RNA, 23 nt, Human
gccagacgcucaccucccgcucc

SEQ ID NO: 556302 - RNA, 19 nt, Human
gccuggcaugguggcucac

SEQ ID NO: 556303 - RNA, 18 nt, Human
gcgaaacagauugcaccu

SEQ ID NO: 556304 - RNA, 20 nt, Human
gcugcaacuccagggauccu

SEQ ID NO: 556305 - RNA, 18 nt, Human
gcuuccgccccuucccca

SEQ ID NO: 556306 - RNA, 19 nt, Human
ggagcaggcauugaagggu

SEQ ID NO: 556307 - RNA, 23 nt, Human
ggagguugcagucagccgagauc

SEQ ID NO: 556308 - RNA, 24 nt, Human
ggagguugcagucagccgagaucg

SEQ ID NO: 556309 - RNA, 24 nt, Human
ggagguugcagucagccgagaucg

SEQ ID NO: 556310 - RNA, 22 nt, Human
ggaucacuugaggucagggguu

SEQ ID NO: 556311 - RNA, 21 nt, Human
ggccacagcguuggcacagcc

SEQ ID NO: 556312 - RNA, 21 nt, Human
ggcccacgccuguaaucccag

SEQ ID NO: 556313 - RNA, 21 nt, Human
ggcccacgccuguaaucccag

SEQ ID NO: 556314 - RNA, 19 nt, Human
ggcggcggcagcgaaacag

SEQ ID NO: 556315 - RNA, 21 nt, Human
ggcucacaccuguaaucccag

SEQ ID NO: 556316 - RNA, 26 nt, Human
gggaggccacagcguuggcacagccc

SEQ ID NO: 556317 - RNA, 22 nt, Human
gggaggcugaggcaggagaauc

SEQ ID NO: 556318 - RNA, 22 nt, Human
gggaggcugaggcaggagaauc

SEQ ID NO: 556319 - RNA, 23 nt, Human
gggccccacgcaccaugucuggu

SEQ ID NO: 556320 - RNA, 24 nt, Human
gggggcccacgccuguaaucccag

SEQ ID NO: 556321 - RNA, 24 nt, Human
gggggcccacgccuguaaucccag

SEQ ID NO: 556322 - RNA, 21 nt, Human
gguggaucacuugaggucagg

SEQ ID NO: 556323 - RNA, 24 nt, Human
gguggcucacaccuguaaucccag

SEQ ID NO: 556324 - RNA, 20 nt, Human
gguguagaagaccaggagga

SEQ ID NO: 556325 - RNA, 19 nt, Human
ggugucaggaagacuuugc

SEQ ID NO: 556326 - RNA, 24 nt, Human
gucagcuggggcugguguagggac

SEQ ID NO: 556327 - RNA, 21 nt, Human
gugaaacccugucucuacuaa

SEQ ID NO: 556328 - RNA, 26 nt, Human
guggagcaggcacaucuugaggaaag

SEQ ID NO: 556329 - RNA, 19 nt, Human
guggugucaggaagacuuu

SEQ ID NO: 556330 - RNA, 19 nt, Human
uacugaucuuauuaccucu

SEQ ID NO: 556331 - RNA, 22 nt, Human
uaggaucuggagacacaaaagg

SEQ ID NO: 556332 - RNA, 19 nt, Human
uauuaccucuguuuugcag

SEQ ID NO: 556333 - RNA, 23 nt, Human
ucagccgagaucgugccacugca

SEQ ID NO: 556334 - RNA, 23 nt, Human
ucagccgagaucgugccacugca

SEQ ID NO: 556335 - RNA, 21 nt, Human
uccacagucagcagcucaaac

SEQ ID NO: 556336 - RNA, 18 nt, Human
uccagaccugcgccagac

SEQ ID NO: 556337 - RNA, 21 nt, Human
ucccaagcccaagucuugacc

SEQ ID NO: 556338 - RNA, 21 nt, Human
ucccugggggcagggucuccg

SEQ ID NO: 556339 - RNA, 24 nt, Human
ucccugggggcagggucuccggug

SEQ ID NO: 556340 - RNA, 24 nt, Human
ucgcuugaacccaggagguggagg

SEQ ID NO: 556341 - RNA, 24 nt, Human
ucgcuugaacccaggagguggagg

SEQ ID NO: 556342 - RNA, 23 nt, Human
ucgugccacugcacuccaaccug

SEQ ID NO: 556343 - RNA, 23 nt, Human
ucgugccacugcacuccaaccug

SEQ ID NO: 556344 - RNA, 18 nt, Human
ucuccagaggcucuggcu

SEQ ID NO: 556345 - RNA, 19 nt, Human
ucuccagaggcucuggcug

SEQ ID NO: 556346 - RNA, 21 nt, Human
ucucuacuaaaaauauaaaaa

SEQ ID NO: 556347 - RNA, 22 nt, Human
ucugcuuucgcuucuucuugcc

SEQ ID NO: 556348 - RNA, 20 nt, Human
ugaaaucauaggaucuggag

SEQ ID NO: 556349 - RNA, 24 nt, Human
ugaagugaacgucugucuccugcu

SEQ ID NO: 556350 - RNA, 23 nt, Human
ugagaaaacagacuugaagaggu

SEQ ID NO: 556351 - RNA, 20 nt, Human
ugaggcaggagaaucgcuug

SEQ ID NO: 556352 - RNA, 20 nt, Human
ugaggcaggagaaucgcuug

SEQ ID NO: 556353 - RNA, 24 nt, Human
ugaggcaggagaaucgcuugaacc

SEQ ID NO: 556354 - RNA, 24 nt, Human
ugaggcaggagaaucgcuugaacc

SEQ ID NO: 556355 - RNA, 25 nt, Human
ugaggcaggagaaucgcuugaaccc

SEQ ID NO: 556356 - RNA, 25 nt, Human
ugaggcaggagaaucgcuugaaccc

SEQ ID NO: 556357 - RNA, 22 nt, Human
ugccagccugagccuccugcgc

SEQ ID NO: 556358 - RNA, 19 nt, Human
ugcugcccaccuugacagc

SEQ ID NO: 556359 - RNA, 21 nt, Human
ugcuugucaugcuccaacccc

SEQ ID NO: 556360 - RNA, 24 nt, Human
uggacaacauggugaaacccuguc

SEQ ID NO: 556361 - RNA, 24 nt, Human
uggaucacuugaggucagggguuc

SEQ ID NO: 556362 - RNA, 24 nt, Human
uggcaugguggcucacaccuguaa

SEQ ID NO: 556363 - RNA, 24 nt, Human
uggcggugggugggaggguccccu

SEQ ID NO: 556364 - RNA, 21 nt, Human
uggcucacaccuguaauccca

SEQ ID NO: 556365 - RNA, 22 nt, Human
uggcucacaccuguaaucccag

SEQ ID NO: 556366 - RNA, 24 nt, Human
uggcucacaccuguaaucccagca

SEQ ID NO: 556367 - RNA, 19 nt, Human
ugggaggcagaggugggug

SEQ ID NO: 556368 - RNA, 20 nt, Human
ugggaggcagaggugggugg

SEQ ID NO: 556369 - RNA, 24 nt, Human
ugggaggcagagguggguggauca

SEQ ID NO: 556370 - RNA, 22 nt, Human
uggggcugguguagggacacag

SEQ ID NO: 556371 - RNA, 24 nt, Human
ugggggcccacgccuguaauccca

SEQ ID NO: 556372 - RNA, 24 nt, Human
ugggggcccacgccuguaauccca

SEQ ID NO: 556373 - RNA, 24 nt, Human
ugguggcucacaccuguaauccca

SEQ ID NO: 556374 - RNA, 21 nt, Human
ugguguagggacacagcuggg

SEQ ID NO: 556375 - RNA, 23 nt, Human
ugguguagggacacagcugggcc

SEQ ID NO: 556376 - RNA, 21 nt, Human
ugucaugcuccaaccccuuca

SEQ ID NO: 556377 - RNA, 18 nt, Human
ugugaagagaucccuggg

SEQ ID NO: 556378 - RNA, 21 nt, Human
ugugagcuugaauguguuugg

SEQ ID NO: 556379 - RNA, 22 nt, Human
ugugagcuugaauguguuuggc

SEQ ID NO: 556380 - RNA, 21 nt, Human
uucaaaacucccaacgggaga

SEQ ID NO: 556381 - RNA, 24 nt, Human
uugaacccaggagguggagguugc

SEQ ID NO: 556382 - RNA, 24 nt, Human
uugaacccaggagguggagguugc

SEQ ID NO: 556383 - RNA, 21 nt, Human
uugaauguguuuggccagaaa

SEQ ID NO: 556384 - RNA, 22 nt, Human
uugcagucagccgagaucgugc

SEQ ID NO: 556385 - RNA, 22 nt, Human
uugcagucagccgagaucgugc

SEQ ID NO: 556386 - RNA, 20 nt, Human
uugggaggcagaggugggug

SEQ ID NO: 556387 - RNA, 21 nt, Human
uugggaggcagaggugggugg

SEQ ID NO: 556388 - RNA, 21 nt, Human
uuuugcagaugagaaaacaga

SEQ ID NO: 556389 - RNA, 19 nt, Human
aaaaacacacaggcaugaa

SEQ ID NO: 556390 - RNA, 21 nt, Human
aaaacacacaggcaugaauaa

SEQ ID NO: 556391 - RNA, 19 nt, Human
aaaacaguguugguucuuu

SEQ ID NO: 556392 - RNA, 27 nt, Human
aaacaagcagcaagcuacaaaauccau

SEQ ID NO: 556393 - RNA, 26 nt, Human
aagcuacaaaauccaucaccaccaac

SEQ ID NO: 556394 - RNA, 22 nt, Human
aauacaagauucuaaaagugaa

SEQ ID NO: 556395 - RNA, 24 nt, Human
aauagcaagaaggguaaugguagc

SEQ ID NO: 556396 - RNA, 22 nt, Human
acaaaauccaucaccaccaaca

SEQ ID NO: 556397 - RNA, 23 nt, Human
acaguaaugagaaugggcaguuc

SEQ ID NO: 556398 - RNA, 22 nt, Human
accaguggugaaacaagcagca

SEQ ID NO: 556399 - RNA, 19 nt, Human
acuuaaauacaagauucua

SEQ ID NO: 556400 - RNA, 20 nt, Human
aguggugaaacaagcagcaa

SEQ ID NO: 556401 - RNA, 24 nt, Human
caaaauagugcccauauuuccguu

SEQ ID NO: 556402 - RNA, 19 nt, Human
caucaccaccaacaguuuc

SEQ ID NO: 556403 - RNA, 23 nt, Human
cauugauuugacuggaaccagca

SEQ ID NO: 556404 - RNA, 23 nt, Human
ccaguggugaaacaagcagcaag

SEQ ID NO: 556405 - RNA, 24 nt, Human
cucucuuaaucuacuaagagaaca

SEQ ID NO: 556406 - RNA, 20 nt, Human
gcccaccgcagauaaaguug

SEQ ID NO: 556407 - RNA, 19 nt, Human
ggcaauuuaaugguuaaaa

SEQ ID NO: 556408 - RNA, 28 nt, Human
uaaaaaaguacaauucuucacagacaca

SEQ ID NO: 556409 - RNA, 23 nt, Human
uaaaucucccaaggcuuuaaucu

SEQ ID NO: 556410 - RNA, 19 nt, Human
uaagaaaaacacacaggca

SEQ ID NO: 556411 - RNA, 25 nt, Human
uaagaaaaacacacaggcaugaaua

SEQ ID NO: 556412 - RNA, 20 nt, Human
uaaucuaguucaucagugca

SEQ ID NO: 556413 - RNA, 20 nt, Human
uacaaaauccaucaccacca

SEQ ID NO: 556414 - RNA, 26 nt, Human
uagaauucaaaauagugcccauauuu

SEQ ID NO: 556415 - RNA, 22 nt, Human
uagccagcucucagaauaaugc

SEQ ID NO: 556416 - RNA, 22 nt, Human
uaguauaaaucucccaaggcuu

SEQ ID NO: 556417 - RNA, 21 nt, Human
ucggaaaucuagcuuggagcc

SEQ ID NO: 556418 - RNA, 22 nt, Human
ucuagaauucaaaauagugccc

SEQ ID NO: 556419 - RNA, 27 nt, Human
ugaaacaagcagcaagcuacaaaaucc

SEQ ID NO: 556420 - RNA, 24 nt, Human
uggugaaacaagcagcaagcuaca

SEQ ID NO: 556421 - RNA, 25 nt, Human
uugguucuugccaucacugaauuua

SEQ ID NO: 556422 - RNA, 26 nt, Human
uuuuuuuuuuuuuuuuuacuucuuaa

SEQ ID NO: 556423 - RNA, 25 nt, Human
aagcaagucacgauucagcucacac

SEQ ID NO: 556424 - RNA, 20 nt, Human
acagcacagguccaaugugg

SEQ ID NO: 556425 - RNA, 22 nt, Human
acagcacagguccaauguggug

SEQ ID NO: 556426 - RNA, 18 nt, Human
agacaggcugggcagagg

SEQ ID NO: 556427 - RNA, 19 nt, Human
agacaggcugggcagaggc

SEQ ID NO: 556428 - RNA, 22 nt, Human
agcacagguccaaugugguggu

SEQ ID NO: 556429 - RNA, 20 nt, Human
agcaguccagggcgcucuuc

SEQ ID NO: 556430 - RNA, 21 nt, Human
agcaucaggaacagccacaaa

SEQ ID NO: 556431 - RNA, 21 nt, Human
agccacaaaucucaugcgccu

SEQ ID NO: 556432 - RNA, 21 nt, Human
aggacagcacagguccaaugu

SEQ ID NO: 556433 - RNA, 20 nt, Human
aggauggggcaggcccaccu

SEQ ID NO: 556434 - RNA, 22 nt, Human
aucaggaacagccacaaaucuc

SEQ ID NO: 556435 - RNA, 20 nt, Human
cacugcuggggcuggaggcc

SEQ ID NO: 556436 - RNA, 20 nt, Human
cagauaagcacugugugcca

SEQ ID NO: 556437 - RNA, 19 nt, Human
cagccuuucugaggaggau

SEQ ID NO: 556438 - RNA, 19 nt, Human
caggauguggcugucccug

SEQ ID NO: 556439 - RNA, 22 nt, Human
caggauguggcugucccuggca

SEQ ID NO: 556440 - RNA, 23 nt, Human
cagugcccaugcugccucuuucu

SEQ ID NO: 556441 - RNA, 21 nt, Human
cauggggccuccaacaccacc

SEQ ID NO: 556442 - RNA, 20 nt, Human
ccaaugugguggugugcagg

SEQ ID NO: 556443 - RNA, 20 nt, Human
ccaggacagcacagguccaa

SEQ ID NO: 556444 - RNA, 19 nt, Human
ccaugcugccucuuucugc

SEQ ID NO: 556445 - RNA, 22 nt, Human
cccagcagguucaaaguagagc

SEQ ID NO: 556446 - RNA, 18 nt, Human
ccccaaagccaagugucc

SEQ ID NO: 556447 - RNA, 21 nt, Human
ccccccaaagccaaguguccc

SEQ ID NO: 556448 - RNA, 22 nt, Human
ccucagcaguccagggcgcucu

SEQ ID NO: 556449 - RNA, 20 nt, Human
ccucaguuuccuucccccca

SEQ ID NO: 556450 - RNA, 21 nt, Human
ccuccaacaccaccucccagg

SEQ ID NO: 556451 - RNA, 24 nt, Human
ccucucugggccucaguuuccuuc

SEQ ID NO: 556452 - RNA, 20 nt, Human
ccugagcucugggcuguugg

SEQ ID NO: 556453 - RNA, 21 nt, Human
ccugccacucaguggcugggg

SEQ ID NO: 556454 - RNA, 23 nt, Human
ccuugaaaaucucuuccuugccc

SEQ ID NO: 556455 - RNA, 22 nt, Human
ccuuggccagugguugccccuc

SEQ ID NO: 556456 - RNA, 27 nt, Human
cgagcgaguuucuccucugggcugaac

SEQ ID NO: 556457 - RNA, 19 nt, Human
cgcugcagaccagcaggau

SEQ ID NO: 556458 - RNA, 21 nt, Human
cgggguggaccacgcugcaga

SEQ ID NO: 556459 - RNA, 18 nt, Human
cgguguagacaggcuggg

SEQ ID NO: 556460 - RNA, 20 nt, Human
cucaggagaggacagagaaa

SEQ ID NO: 556461 - RNA, 22 nt, Human
cucaggagaggacagagaaagg

SEQ ID NO: 556462 - RNA, 26 nt, Human
cuggcagugcccaugcugccucuuuc

SEQ ID NO: 556463 - RNA, 18 nt, Human
cugucuucugaaggcgag

SEQ ID NO: 556464 - RNA, 19 nt, Human
gaaccaugaguccagcuag

SEQ ID NO: 556465 - RNA, 21 nt, Human
gauggggcaggcccaccuccu

SEQ ID NO: 556466 - RNA, 28 nt, Human
gcagaaccucaggagaggagggaacgcc

SEQ ID NO: 556467 - RNA, 21 nt, Human
gcuggggcuggaggccaggcu

SEQ ID NO: 556468 - RNA, 18 nt, Human
ggcaggagcuugcacacg

SEQ ID NO: 556469 - RNA, 22 nt, Human
ggccaggcucuuagccaaaacu

SEQ ID NO: 556470 - RNA, 21 nt, Human
gggaagcaagucacgauucag

SEQ ID NO: 556471 - RNA, 24 nt, Human
gggguggaccacgcugcagaccag

SEQ ID NO: 556472 - RNA, 19 nt, Human
gggguuggccggcaggagc

SEQ ID NO: 556473 - RNA, 19 nt, Human
ggguaaguccuagcagagc

SEQ ID NO: 556474 - RNA, 19 nt, Human
uaggauggggcaggcccac

SEQ ID NO: 556475 - RNA, 24 nt, Human
uaggauggggcaggcccaccuccu

SEQ ID NO: 556476 - RNA, 21 nt, Human
uccugagcucugggcuguugg

SEQ ID NO: 556477 - RNA, 24 nt, Human
ucggccccugcucugggccacacu

SEQ ID NO: 556478 - RNA, 21 nt, Human
ucugaaggcgagcgaguuucu

SEQ ID NO: 556479 - RNA, 22 nt, Human
ucugaggaggaugcugaggguc

SEQ ID NO: 556480 - RNA, 23 nt, Human
ucugggccucaguuuccuucccc

SEQ ID NO: 556481 - RNA, 22 nt, Human
ugaaggcgagcgaguuucuccu

SEQ ID NO: 556482 - RNA, 19 nt, Human
ugagcucacugggcucagg

SEQ ID NO: 556483 - RNA, 23 nt, Human
ugcccaugcugccucuuucugcc

SEQ ID NO: 556484 - RNA, 24 nt, Human
ugcucugggccacacugcuggggc

SEQ ID NO: 556485 - RNA, 22 nt, Human
ugcuggggcuggaggccaggcu

SEQ ID NO: 556486 - RNA, 26 nt, Human
ugggaagcaagucacgauucagcuca

SEQ ID NO: 556487 - RNA, 19 nt, Human
uggugugcagggcaguggg

SEQ ID NO: 556488 - RNA, 18 nt, Human
ugugguggugugcagggc

SEQ ID NO: 556489 - RNA, 23 nt, Human
ugugugccacuagcaucaggaac

SEQ ID NO: 556490 - RNA, 21 nt, Human
uuaaagcugagcucacugggc

SEQ ID NO: 556491 - RNA, 20 nt, Human
uucauggggccuccaacacc

SEQ ID NO: 556492 - RNA, 19 nt, Human
uugcugggugacccuuggc

SEQ ID NO: 556493 - RNA, 22 nt, Human
uuggccagugguugccccucuc

SEQ ID NO: 556494 - RNA, 21 nt, Human
aaacagaacguggacucagga

SEQ ID NO: 556495 - RNA, 20 nt, Human
aaauauaauuugggggcaua

SEQ ID NO: 556496 - RNA, 24 nt, Human
aacuggccucagggggaauucuca

SEQ ID NO: 556497 - RNA, 22 nt, Human
aagaggcccgggcauggucuca

SEQ ID NO: 556498 - RNA, 24 nt, Human
aagcuaaacagaacguggacucag

SEQ ID NO: 556499 - RNA, 26 nt, Human
accccgccuccggccccagccccagc

SEQ ID NO: 556500 - RNA, 23 nt, Human
acgcugcagguaccacagccccu

SEQ ID NO: 556501 - RNA, 19 nt, Human
acggcgcggcggcuccggg

SEQ ID NO: 556502 - RNA, 18 nt, Human
acuuacauacauaaauau

SEQ ID NO: 556503 - RNA, 24 nt, Human
agaaugggggcccaggcagcagcu

SEQ ID NO: 556504 - RNA, 21 nt, Human
agccggggugaccccgcccag

SEQ ID NO: 556505 - RNA, 26 nt, Human
aggaagugaguuccccaucgauggaa

SEQ ID NO: 556506 - RNA, 18 nt, Human
aggcaggcggcggcuucu

SEQ ID NO: 556507 - RNA, 24 nt, Human
aggcggcggcuucuugucccagcc

SEQ ID NO: 556508 - RNA, 24 nt, Human
aguagcgccuuacgggccccacgg

SEQ ID NO: 556509 - RNA, 22 nt, Human
agugaugagaaaaaauuagaga

SEQ ID NO: 556510 - RNA, 23 nt, Human
auccaugacagaacuggccucag

SEQ ID NO: 556511 - RNA, 21 nt, Human
caaaacaaaccucacuuacau

SEQ ID NO: 556512 - RNA, 22 nt, Human
caacuucuagauguuucuuccu

SEQ ID NO: 556513 - RNA, 22 nt, Human
caagcagaacugagacagugca

SEQ ID NO: 556514 - RNA, 21 nt, Human
caagccuccgccccccgcaca

SEQ ID NO: 556515 - RNA, 24 nt, Human
cacacacccacucacaccccgccu

SEQ ID NO: 556516 - RNA, 22 nt, Human
caccgcgcagcggccccgaggu

SEQ ID NO: 556517 - RNA, 21 nt, Human
cacucacaccccgccuccggc

SEQ ID NO: 556518 - RNA, 21 nt, Human
cagccccagcccccuccccgg

SEQ ID NO: 556519 - RNA, 18 nt, Human
cagugcagcagcuugucc

SEQ ID NO: 556520 - RNA, 21 nt, Human
cauguuggaaaaccaagugcu

SEQ ID NO: 556521 - RNA, 19 nt, Human
ccaccgcgcagcggccccg

SEQ ID NO: 556522 - RNA, 20 nt, Human
ccacgcugcagguaccacag

SEQ ID NO: 556523 - RNA, 20 nt, Human
ccagccggggugaccccgcc

SEQ ID NO: 556524 - RNA, 22 nt, Human
cccacaugggguugagugaaau

SEQ ID NO: 556525 - RNA, 21 nt, Human
cccacgcugcagguaccacag

SEQ ID NO: 556526 - RNA, 22 nt, Human
cccacggguaggugcccaagac

SEQ ID NO: 556527 - RNA, 19 nt, Human
cccagcccccuccccgggc

SEQ ID NO: 556528 - RNA, 21 nt, Human
ccccacggguaggugcccaag

SEQ ID NO: 556529 - RNA, 21 nt, Human
ccccagccccagcccccuccc

SEQ ID NO: 556530 - RNA, 19 nt, Human
cccccuccccgggcccggg

SEQ ID NO: 556531 - RNA, 23 nt, Human
ccccgcacacacccacucacacc

SEQ ID NO: 556532 - RNA, 25 nt, Human
ccccgccuccggccccagccccagc

SEQ ID NO: 556533 - RNA, 21 nt, Human
ccccgcugcuuccacacagca

SEQ ID NO: 556534 - RNA, 19 nt, Human
ccccgggcccgggcaggca

SEQ ID NO: 556535 - RNA, 24 nt, Human
ccccuggcagcagugaagaggccc

SEQ ID NO: 556536 - RNA, 24 nt, Human
cccgcacacacccacucacacccc

SEQ ID NO: 556537 - RNA, 25 nt, Human
cccgcacacacccacucacaccccg

SEQ ID NO: 556538 - RNA, 24 nt, Human
cccuagauccuggacgcagcgcuc

SEQ ID NO: 556539 - RNA, 24 nt, Human
ccuacuccugaagccuggugggcc

SEQ ID NO: 556540 - RNA, 23 nt, Human
ccuccgccccccgcacacaccca

SEQ ID NO: 556541 - RNA, 18 nt, Human
ccugaaauuaaaacuacu

SEQ ID NO: 556542 - RNA, 21 nt, Human
cgcacacacccacucacaccc

SEQ ID NO: 556543 - RNA, 18 nt, Human
cgccccccgcacacaccc

SEQ ID NO: 556544 - RNA, 24 nt, Human
cgccuccggccccagccccagccc

SEQ ID NO: 556545 - RNA, 21 nt, Human
cgcugcggggcugugagugcc

SEQ ID NO: 556546 - RNA, 21 nt, Human
cggcagccuuauauaguagcg

SEQ ID NO: 556547 - RNA, 23 nt, Human
cggccggguuucggggaacuccu

SEQ ID NO: 556548 - RNA, 22 nt, Human
cggcuccgggccggcagccuua

SEQ ID NO: 556549 - RNA, 22 nt, Human
cucacaccccgccuccggcccc

SEQ ID NO: 556550 - RNA, 29 nt, Human
cucacaccccgccuccggccccagcccca

SEQ ID NO: 556551 - RNA, 23 nt, Human
cuccggccccagccccagccccc

SEQ ID NO: 556552 - RNA, 21 nt, Human
cuccggccccagccccagccu

SEQ ID NO: 556553 - RNA, 21 nt, Human
cuccugcucugacggcgcggc

SEQ ID NO: 556554 - RNA, 23 nt, Human
cugacggcgcggcggcuccgggc

SEQ ID NO: 556555 - RNA, 20 nt, Human
cuuguagaagcacguccccc

SEQ ID NO: 556556 - RNA, 23 nt, Human
gaagcacgucccccacgcugcag

SEQ ID NO: 556557 - RNA, 18 nt, Human
gacuuggggucuucaaau

SEQ ID NO: 556558 - RNA, 19 nt, Human
gauccuggacgcagcgcuc

SEQ ID NO: 556559 - RNA, 19 nt, Human
gaucugcgggaggaggagg

SEQ ID NO: 556560 - RNA, 20 nt, Human
gcaucaagccuccgcccccc

SEQ ID NO: 556561 - RNA, 28 nt, Human
gccccagccccagcccccuccccgggcc

SEQ ID NO: 556562 - RNA, 18 nt, Human
gccccgagguucuuggcu

SEQ ID NO: 556563 - RNA, 20 nt, Human
gccccgagguucuuggcugg

SEQ ID NO: 556564 - RNA, 21 nt, Human
gcccuagauccuggacgcagc

SEQ ID NO: 556565 - RNA, 22 nt, Human
gccggggugaccccgcccaggc

SEQ ID NO: 556566 - RNA, 19 nt, Human
gccuccgccccccgcacac

SEQ ID NO: 556567 - RNA, 18 nt, Human
gcuccuggggaagugaug

SEQ ID NO: 556568 - RNA, 22 nt, Human
ggaaaacucugaauauguacaa

SEQ ID NO: 556569 - RNA, 18 nt, Human
ggaggaggaggccucgcu

SEQ ID NO: 556570 - RNA, 22 nt, Human
ggagggauuugggaagggcaaa

SEQ ID NO: 556571 - RNA, 20 nt, Human
ggcaggcaggcggcggcuuc

SEQ ID NO: 556572 - RNA, 18 nt, Human
ggcuggugggcugggaga

SEQ ID NO: 556573 - RNA, 22 nt, Human
gggaagggcaaauggucccugg

SEQ ID NO: 556574 - RNA, 19 nt, Human
gggaggccccaauccaugg

SEQ ID NO: 556575 - RNA, 24 nt, Human
gggaggcugggcggcgaccgggau

SEQ ID NO: 556576 - RNA, 23 nt, Human
gggcagagggcuggugggcuggg

SEQ ID NO: 556577 - RNA, 23 nt, Human
gggccccacggguaggugcccaa

SEQ ID NO: 556578 - RNA, 22 nt, Human
gggcuccaggcuuccccuacuc

SEQ ID NO: 556579 - RNA, 22 nt, Human
ggggggccugggaggccccaau

SEQ ID NO: 556580 - RNA, 21 nt, Human
ggggugcgggaggcugggcgg

SEQ ID NO: 556581 - RNA, 19 nt, Human
gugggcugggagauggaag

SEQ ID NO: 556582 - RNA, 24 nt, Human
uaauauacaaaacaaaccucacuu

SEQ ID NO: 556583 - RNA, 23 nt, Human
uagauccuggacgcagcgcuccu

SEQ ID NO: 556584 - RNA, 20 nt, Human
uagcgccuuacgggccccac

SEQ ID NO: 556585 - RNA, 19 nt, Human
uaucaaaauaaauuacuca

SEQ ID NO: 556586 - RNA, 18 nt, Human
ucccagggcuggaguggg

SEQ ID NO: 556587 - RNA, 21 nt, Human
ucccagggcuggaguggggcu

SEQ ID NO: 556588 - RNA, 18 nt, Human
uccgccccccgcacacac

SEQ ID NO: 556589 - RNA, 21 nt, Human
uccgccccccgcacacaccca

SEQ ID NO: 556590 - RNA, 20 nt, Human
uccuggacgcagcgcuccug

SEQ ID NO: 556591 - RNA, 18 nt, Human
ucuucuggcugcuccugg

SEQ ID NO: 556592 - RNA, 23 nt, Human
ugagacagugcagcagcuugucc

SEQ ID NO: 556593 - RNA, 22 nt, Human
ugcgcugcggggcugugagugc

SEQ ID NO: 556594 - RNA, 26 nt, Human
uggaguggggcuccaggcuuccccua

SEQ ID NO: 556595 - RNA, 23 nt, Human
uggcacugccaauggaaaacucu

SEQ ID NO: 556596 - RNA, 23 nt, Human
uggcagcagugaagaggcccggg

SEQ ID NO: 556597 - RNA, 18 nt, Human
ugggaagggcaaaugguc

SEQ ID NO: 556598 - RNA, 21 nt, Human
ugggaagggcaaauggucccu

SEQ ID NO: 556599 - RNA, 22 nt, Human
ugggcagagggcuggugggcug

SEQ ID NO: 556600 - RNA, 22 nt, Human
uggggcucucggcgcagcuccg

SEQ ID NO: 556601 - RNA, 25 nt, Human
ugggggcccaggcagcagcugggca

SEQ ID NO: 556602 - RNA, 18 nt, Human
ugggguugagugaaauuu

SEQ ID NO: 556603 - RNA, 19 nt, Human
uggugggccaugccugcuc

SEQ ID NO: 556604 - RNA, 22 nt, Human
uucaaaucuuuucuuuuccuga

SEQ ID NO: 556605 - RNA, 19 nt, Human
uucucaggacagcauccau

SEQ ID NO: 556606 - RNA, 23 nt, Human
uuuuaauauacaaaacaaaccuc

SEQ ID NO: 556607 - RNA, 21 nt, Human
uuuuacagaguggaucaccug

SEQ ID NO: 556608 - RNA, 21 nt, Human
aaaacauucuaauauugcuaa

SEQ ID NO: 556609 - RNA, 27 nt, Human
aaaagaccagaaaaguaacagugggca

SEQ ID NO: 556610 - RNA, 19 nt, Human
aaacagaaaagaacaugcc

SEQ ID NO: 556611 - RNA, 21 nt, Human
aaaggagagcucauuuuaaaa

SEQ ID NO: 556612 - RNA, 23 nt, Human
aaagucaaaaguuaccgcguacu

SEQ ID NO: 556613 - RNA, 18 nt, Human
aacuuguucccuaaacug

SEQ ID NO: 556614 - RNA, 18 nt, Human
aagaacaugccaacguug

SEQ ID NO: 556615 - RNA, 18 nt, Human
aaggaaaauaacaguggc

SEQ ID NO: 556616 - RNA, 24 nt, Human
acacgaugccaaguguaucuucuu

SEQ ID NO: 556617 - RNA, 21 nt, Human
acagaaaagaacaugccaacg

SEQ ID NO: 556618 - RNA, 21 nt, Human
acccuguauucaugcaggcca

SEQ ID NO: 556619 - RNA, 20 nt, Human
accgauuuuauagcaaaaua

SEQ ID NO: 556620 - RNA, 25 nt, Human
acugcaguugcauccuguuugcacu

SEQ ID NO: 556621 - RNA, 18 nt, Human
agacaaaaucguggcaug

SEQ ID NO: 556622 - RNA, 23 nt, Human
agacaaaaucguggcauguucuu

SEQ ID NO: 556623 - RNA, 21 nt, Human
agagcgggagacacuguugcc

SEQ ID NO: 556624 - RNA, 27 nt, Human
auacuagugaaugccucucacagagca

SEQ ID NO: 556625 - RNA, 25 nt, Human
aucauacugccgcaguaaccuggcu

SEQ ID NO: 556626 - RNA, 22 nt, Human
auggcuaaaacaaaauuccuuc

SEQ ID NO: 556627 - RNA, 21 nt, Human
augggacaaucacaauggcag

SEQ ID NO: 556628 - RNA, 21 nt, Human
cacaugauacagacaugcaca

SEQ ID NO: 556629 - RNA, 21 nt, Human
caccuggaaucguuccugauc

SEQ ID NO: 556630 - RNA, 27 nt, Human
caccuggcucuggcaucggcagcuuca

SEQ ID NO: 556631 - RNA, 23 nt, Human
cacguaaacacaugauacagaca

SEQ ID NO: 556632 - RNA, 20 nt, Human
cacugcaguugcauccuguu

SEQ ID NO: 556633 - RNA, 21 nt, Human
cagaaagacaaaaucguggca

SEQ ID NO: 556634 - RNA, 18 nt, Human
cagaaauucucugaccca

SEQ ID NO: 556635 - RNA, 22 nt, Human
cagaaguaguagaaugugaaac

SEQ ID NO: 556636 - RNA, 24 nt, Human
cagcacgauggcaaaucgcuccuc

SEQ ID NO: 556637 - RNA, 18 nt, Human
caggaaaccaggugggcc

SEQ ID NO: 556638 - RNA, 19 nt, Human
caguacucuccacacuuuc

SEQ ID NO: 556639 - RNA, 23 nt, Human
cauugaacuuuggaaaacagcug

SEQ ID NO: 556640 - RNA, 22 nt, Human
ccaagaagauaagccagaagca

SEQ ID NO: 556641 - RNA, 24 nt, Human
cccacauucauacuagugaaugcc

SEQ ID NO: 556642 - RNA, 22 nt, Human
cccgcagguggcaguuuaaucu

SEQ ID NO: 556643 - RNA, 20 nt, Human
ccgcaguaaccuggcuuugu

SEQ ID NO: 556644 - RNA, 24 nt, Human
ccgucugaauuucuuccugguuac

SEQ ID NO: 556645 - RNA, 22 nt, Human
cgcagugcagaaugucuuccag

SEQ ID NO: 556646 - RNA, 21 nt, Human
cgccggggccgggggcugcuc

SEQ ID NO: 556647 - RNA, 23 nt, Human
cgccgucugaauuucuuccuggu

SEQ ID NO: 556648 - RNA, 20 nt, Human
cggcugccgcccgcaggcgc

SEQ ID NO: 556649 - RNA, 20 nt, Human
cgggagacacuguugcccac

SEQ ID NO: 556650 - RNA, 22 nt, Human
cguagcacauaaaguucaugug

SEQ ID NO: 556651 - RNA, 18 nt, Human
cuccccgcccuccgccgc

SEQ ID NO: 556652 - RNA, 21 nt, Human
cugaagaacacaguacugcaa

SEQ ID NO: 556653 - RNA, 26 nt, Human
cugauuacugagauguuaauuuuaau

SEQ ID NO: 556654 - RNA, 19 nt, Human
cuuauaguuaaauauauau

SEQ ID NO: 556655 - RNA, 18 nt, Human
cuuugauuuguccaccga

SEQ ID NO: 556656 - RNA, 18 nt, Human
gaaagacaaaaucguggc

SEQ ID NO: 556657 - RNA, 19 nt, Human
gaacagcucccggcggucg

SEQ ID NO: 556658 - RNA, 23 nt, Human
gaagaacacaguacugcaaauaa

SEQ ID NO: 556659 - RNA, 20 nt, Human
gaauguugaguccacagaaa

SEQ ID NO: 556660 - RNA, 20 nt, Human
gaauuucuuccugguuacag

SEQ ID NO: 556661 - RNA, 21 nt, Human
gagcucuccacaguacucucc

SEQ ID NO: 556662 - RNA, 22 nt, Human
gcgggagacacuguugcccaca

SEQ ID NO: 556663 - RNA, 20 nt, Human
gggccccuagcgugcgcguc

SEQ ID NO: 556664 - RNA, 23 nt, Human
guguaaaaagauaccuaaucaaa

SEQ ID NO: 556665 - RNA, 24 nt, Human
guugaaaggagagcucauuuuaaa

SEQ ID NO: 556666 - RNA, 23 nt, Human
uaaaaaacugcaccgauuuuaua

SEQ ID NO: 556667 - RNA, 23 nt, Human
uaaaaaccauaaaaaacugcacc

SEQ ID NO: 556668 - RNA, 27 nt, Human
uaaaaagcugccucuagcugaagaaca

SEQ ID NO: 556669 - RNA, 24 nt, Human
uacaacaucaggaaaccagguggg

SEQ ID NO: 556670 - RNA, 23 nt, Human
uaugggaaugugcccgcaggugg

SEQ ID NO: 556671 - RNA, 19 nt, Human
uauuaugaaaaguacaaau

SEQ ID NO: 556672 - RNA, 25 nt, Human
uauugcuaagaagcaggcccauuaa

SEQ ID NO: 556673 - RNA, 24 nt, Human
ucaaagaaauuuccaguucucuua

SEQ ID NO: 556674 - RNA, 24 nt, Human
ucaccuggaaucguuccugaucac

SEQ ID NO: 556675 - RNA, 24 nt, Human
ucagaaauucucugacccauccaa

SEQ ID NO: 556676 - RNA, 23 nt, Human
ucauauaacuacacauccaagga

SEQ ID NO: 556677 - RNA, 24 nt, Human
uccaaauugcaaguaaaauacaaa

SEQ ID NO: 556678 - RNA, 23 nt, Human
uccaaggaaaagggaccuucacc

SEQ ID NO: 556679 - RNA, 21 nt, Human
uccacagaaagacaaaaucgu

SEQ ID NO: 556680 - RNA, 22 nt, Human
uccccacauucauacuagugaa

SEQ ID NO: 556681 - RNA, 22 nt, Human
ucccggcggucggcugccgccc

SEQ ID NO: 556682 - RNA, 18 nt, Human
ucggcugccgcccgcagg

SEQ ID NO: 556683 - RNA, 25 nt, Human
ugaaaccauaccugauaauucauga

SEQ ID NO: 556684 - RNA, 23 nt, Human
ugaaaggagagcucauuuuaaaa

SEQ ID NO: 556685 - RNA, 19 nt, Human
ugaaaucggucugcugcga

SEQ ID NO: 556686 - RNA, 19 nt, Human
ugacccauccaaugugguu

SEQ ID NO: 556687 - RNA, 23 nt, Human
ugagugaccuuugugccacugca

SEQ ID NO: 556688 - RNA, 23 nt, Human
ugccagagaggaaggaaaauaac

SEQ ID NO: 556689 - RNA, 26 nt, Human
ugccaugaaaagaccagaaaaguaac

SEQ ID NO: 556690 - RNA, 25 nt, Human
ugcuccgggccccuagcgugcgcgu

SEQ ID NO: 556691 - RNA, 18 nt, Human
uggaucaagugcccugcc

SEQ ID NO: 556692 - RNA, 24 nt, Human
uggcuaaaacaaaauuccuucgaa

SEQ ID NO: 556693 - RNA, 21 nt, Human
ugucagaggagaguaaggcca

SEQ ID NO: 556694 - RNA, 21 nt, Human
uguguucaaggcugcaguuaa

SEQ ID NO: 556695 - RNA, 23 nt, Human
uuaaaaagaucauauaacuacac

SEQ ID NO: 556696 - RNA, 20 nt, Human
uucaccaagggguucacaua

SEQ ID NO: 556697 - RNA, 23 nt, Human
uucaccuggaaucguuccugauc

SEQ ID NO: 556698 - RNA, 21 nt, Human
uucagaaauucucugacccau

SEQ ID NO: 556699 - RNA, 25 nt, Human
uucuucaccuggaaucguuccugau

SEQ ID NO: 556700 - RNA, 21 nt, Human
uugcucccucugugcaggucc

SEQ ID NO: 556701 - RNA, 22 nt, Human
uugugccacugcaguugcaucc

SEQ ID NO: 556702 - RNA, 22 nt, Human
uuuaaaaagaucauauaacuac

SEQ ID NO: 556703 - RNA, 20 nt, Human
uuucaaagucaaaaguuacc

SEQ ID NO: 556704 - RNA, 25 nt, Human
uuugcucauaugccaugaaaagacc

SEQ ID NO: 556705 - RNA, 22 nt, Human
caacaauaucagaagcuaucuu

SEQ ID NO: 556706 - RNA, 19 nt, Human
cuaucuuugcaagcuuuga

SEQ ID NO: 556707 - RNA, 19 nt, Human
ugagaaguggaaaagugga

SEQ ID NO: 556708 - RNA, 24 nt, Human
ugcaaauugaaacuauuauauuaa

SEQ ID NO: 556709 - RNA, 18 nt, Human
uggaaaaguggaaguugg

SEQ ID NO: 556710 - RNA, 22 nt, Human
uugcaaauugaaacuauuauau

SEQ ID NO: 556711 - RNA, 20 nt, Human
uuugcaagcuuugagaccau

SEQ ID NO: 556712 - RNA, 19 nt, Human
uuuuuuuuuuuauaagagu

SEQ ID NO: 556713 - RNA, 20 nt, Human
uuuuuuuuuuuuauaagagu

SEQ ID NO: 556714 - RNA, 27 nt, Human
uuuuuuuuuuuuuuuuuuuuuauaaga

SEQ ID NO: 556715 - RNA, 19 nt, Human
aaaaguuucaguugcacug

SEQ ID NO: 556716 - RNA, 22 nt, Human
caacaauaucagaagcuaucuu

SEQ ID NO: 556717 - RNA, 20 nt, Human
uaagagugagaagugaaguu

SEQ ID NO: 556718 - RNA, 19 nt, Human
ucaguaguauaguaaugca

SEQ ID NO: 556719 - RNA, 24 nt, Human
ugcaaauugaaacuauuauauuaa

SEQ ID NO: 556720 - RNA, 22 nt, Human
uugcaaauugaaacuauuauau

SEQ ID NO: 556721 - RNA, 21 nt, Human
acaaacaggagggauuagaug

SEQ ID NO: 556722 - RNA, 18 nt, Human
acccucaccagaggcagc

SEQ ID NO: 556723 - RNA, 24 nt, Human
accugaaagaauaaaagaaguaac

SEQ ID NO: 556724 - RNA, 25 nt, Human
agaagacccucaccagaggcagccc

SEQ ID NO: 556725 - RNA, 22 nt, Human
aggaacaauuugaguuucuccu

SEQ ID NO: 556726 - RNA, 22 nt, Human
auuuaugaauaaaauuccccau

SEQ ID NO: 556727 - RNA, 22 nt, Human
caccagaggcagccccaccauc

SEQ ID NO: 556728 - RNA, 25 nt, Human
cauguacaugcucuuuugccacgug

SEQ ID NO: 556729 - RNA, 27 nt, Human
ccuauaauuugagacaaaccggggucc

SEQ ID NO: 556730 - RNA, 19 nt, Human
ccuccccggcccccgccac

SEQ ID NO: 556731 - RNA, 21 nt, Human
ccuccccggcccccgccacuc

SEQ ID NO: 556732 - RNA, 22 nt, Human
cgagaagacccucaccagaggc

SEQ ID NO: 556733 - RNA, 20 nt, Human
cuccuccccggcccccgcca

SEQ ID NO: 556734 - RNA, 24 nt, Human
cucugucucucucucucuuuuucu

SEQ ID NO: 556735 - RNA, 30 nt, Human
cugaagauagagacuaaaauaacaucuacu

SEQ ID NO: 556736 - RNA, 20 nt, Human
cuugcuacaaccacaaaagu

SEQ ID NO: 556737 - RNA, 23 nt, Human
cuuuuagauuuaugaaacaaaua

SEQ ID NO: 556738 - RNA, 22 nt, Human
gaauaaaagaaguaacuacaga

SEQ ID NO: 556739 - RNA, 19 nt, Human
gauuguuaucucaggagug

SEQ ID NO: 556740 - RNA, 20 nt, Human
guggugucuuuauaaaggau

SEQ ID NO: 556741 - RNA, 24 nt, Human
uaaagcucuaaaaauccagaguuc

SEQ ID NO: 556742 - RNA, 21 nt, Human
uaaccugaagauagagacuaa

SEQ ID NO: 556743 - RNA, 23 nt, Human
uaacuaaaaauacuccagugaug

SEQ ID NO: 556744 - RNA, 21 nt, Human
uaagugaaacauuguucucuc

SEQ ID NO: 556745 - RNA, 22 nt, Human
uacagaauuggcuacauaaugg

SEQ ID NO: 556746 - RNA, 24 nt, Human
uccagugauggugguguugcuuuu

SEQ ID NO: 556747 - RNA, 21 nt, Human
ucgagaagacccucaccagag

SEQ ID NO: 556748 - RNA, 19 nt, Human
ucucucucucuuuuucucu

SEQ ID NO: 556749 - RNA, 19 nt, Human
ucuuuugccacgugauccc

SEQ ID NO: 556750 - RNA, 22 nt, Human
ugaauaaaauuccccauguugu

SEQ ID NO: 556751 - RNA, 25 nt, Human
ugagacaaacaggagggauuagaug

SEQ ID NO: 556752 - RNA, 23 nt, Human
ugcuacaaccacaaaaguugaca

SEQ ID NO: 556753 - RNA, 19 nt, Human
ugcucuuuugccacgugau

SEQ ID NO: 556754 - RNA, 20 nt, Human
uggugguguugcuuuaaauc

SEQ ID NO: 556755 - RNA, 22 nt, Human
uguguccccgaaaguuuacgug

SEQ ID NO: 556756 - RNA, 24 nt, Human
uuaaacaacaccugaaagaauaaa

SEQ ID NO: 556757 - RNA, 22 nt, Human
uuaaugucauuaucaugggauu

SEQ ID NO: 556758 - RNA, 23 nt, Human
uuugaauguguccccgaaaguuu

SEQ ID NO: 556759 - RNA, 22 nt, Human
uuuugccacgugaucccuucca

SEQ ID NO: 556760 - RNA, 23 nt, Human
uuuuuuuuuuuuuuuuuccguuu

SEQ ID NO: 556761 - RNA, 27 nt, Human
uuuuuuuuuuuuuuuuuuuuuccgggg

SEQ ID NO: 556762 - RNA, 21 nt, Human
aaaagcagaaaucacaaagaa

SEQ ID NO: 556763 - RNA, 20 nt, Human
aaacaggaaggaagagaggg

SEQ ID NO: 556764 - RNA, 19 nt, Human
aaagaaaaaagcaggagag

SEQ ID NO: 556765 - RNA, 23 nt, Human
aaagaacaaaaagaggauauaug

SEQ ID NO: 556766 - RNA, 20 nt, Human
aaagauggguggaagauuug

SEQ ID NO: 556767 - RNA, 19 nt, Human
aacaggcucaaaacaagcc

SEQ ID NO: 556768 - RNA, 23 nt, Human
aacuucagcuacccuggcugcac

SEQ ID NO: 556769 - RNA, 26 nt, Human
aacuugugagaccauauacccccuuu

SEQ ID NO: 556770 - RNA, 21 nt, Human
aagagaaauucuccuuucccc

SEQ ID NO: 556771 - RNA, 22 nt, Human
aagcuucagccagaugaucugg

SEQ ID NO: 556772 - RNA, 19 nt, Human
aagggacaaggaagaccuc

SEQ ID NO: 556773 - RNA, 22 nt, Human
aaggggaggggaaacugaggcc

SEQ ID NO: 556774 - RNA, 19 nt, Human
aaucuccagucccagaccc

SEQ ID NO: 556775 - RNA, 25 nt, Human
acaagaaaaaguaguauucuuuuca

SEQ ID NO: 556776 - RNA, 20 nt, Human
acacaucacccaauacaaca

SEQ ID NO: 556777 - RNA, 20 nt, Human
acccgggggaggaggggagg

SEQ ID NO: 556778 - RNA, 18 nt, Human
acugcccuaucuugcccc

SEQ ID NO: 556779 - RNA, 21 nt, Human
acuggguccccugaggaugag

SEQ ID NO: 556780 - RNA, 22 nt, Human
acuucagccucacuggcacuuc

SEQ ID NO: 556781 - RNA, 19 nt, Human
acuucagcuacccuggcug

SEQ ID NO: 556782 - RNA, 19 nt, Human
agaaaagagaagugaucau

SEQ ID NO: 556783 - RNA, 18 nt, Human
agaaagaacaaaaagagg

SEQ ID NO: 556784 - RNA, 22 nt, Human
agaacaggcucaaaacaagcca

SEQ ID NO: 556785 - RNA, 22 nt, Human
agaccauauacccccuucccag

SEQ ID NO: 556786 - RNA, 19 nt, Human
agagugauaauggguuacu

SEQ ID NO: 556787 - RNA, 21 nt, Human
agcaggagagcggaacgccaa

SEQ ID NO: 556788 - RNA, 18 nt, Human
agcuaucauggcuucauc

SEQ ID NO: 556789 - RNA, 22 nt, Human
agcuggaaucucaggaggccua

SEQ ID NO: 556790 - RNA, 19 nt, Human
aggagggggagggggagga

SEQ ID NO: 556791 - RNA, 21 nt, Human
agggaugggaagaucauucgu

SEQ ID NO: 556792 - RNA, 21 nt, Human
agggggagggggaggagaagg

SEQ ID NO: 556793 - RNA, 24 nt, Human
agggggagggggaggagaaggagg

SEQ ID NO: 556794 - RNA, 24 nt, Human
aggguuuagaaaagagaagugauc

SEQ ID NO: 556795 - RNA, 21 nt, Human
agguaaacuggagucuaaaac

SEQ ID NO: 556796 - RNA, 22 nt, Human
augaaaagcagaaaucacaaag

SEQ ID NO: 556797 - RNA, 22 nt, Human
caaagccuacuugcaaaagcuu

SEQ ID NO: 556798 - RNA, 18 nt, Human
caaccaggaguugucucu

SEQ ID NO: 556799 - RNA, 26 nt, Human
caauacaacaauaaugacuacacuuu

SEQ ID NO: 556800 - RNA, 22 nt, Human
cacacccugcuuguuacccggg

SEQ ID NO: 556801 - RNA, 25 nt, Human
caccaaucuccuucaccccucaaag

SEQ ID NO: 556802 - RNA, 24 nt, Human
caccaccaucaucacuuucacccu

SEQ ID NO: 556803 - RNA, 19 nt, Human
caccccccacacccugcuu

SEQ ID NO: 556804 - RNA, 24 nt, Human
cagagugauaauggguuacuuuuu

SEQ ID NO: 556805 - RNA, 18 nt, Human
caggugacggcucucauc

SEQ ID NO: 556806 - RNA, 18 nt, Human
ccagaaaaugagggaaga

SEQ ID NO: 556807 - RNA, 23 nt, Human
ccccacacccugcuuguuacccg

SEQ ID NO: 556808 - RNA, 23 nt, Human
cccccacacccugcuuguuaccc

SEQ ID NO: 556809 - RNA, 24 nt, Human
cccccuugggggaguuccccuccu

SEQ ID NO: 556810 - RNA, 21 nt, Human
ccccucaaagccuacuugcaa

SEQ ID NO: 556811 - RNA, 20 nt, Human
ccccucccccccaaacugga

SEQ ID NO: 556812 - RNA, 19 nt, Human
ccccucuccagaaggcuga

SEQ ID NO: 556813 - RNA, 21 nt, Human
ccccucuccagaaggcugaaa

SEQ ID NO: 556814 - RNA, 20 nt, Human
cccgggggaggaggggagga

SEQ ID NO: 556815 - RNA, 20 nt, Human
cccuaccauagaagcagagu

SEQ ID NO: 556816 - RNA, 19 nt, Human
cccugugccacguagcaag

SEQ ID NO: 556817 - RNA, 20 nt, Human
ccucacugaacucuugccuc

SEQ ID NO: 556818 - RNA, 19 nt, Human
ccucuuauaggcagugagc

SEQ ID NO: 556819 - RNA, 20 nt, Human
ccuggccugaaacugauggg

SEQ ID NO: 556820 - RNA, 19 nt, Human
cgccaaaccucuuggaaau

SEQ ID NO: 556821 - RNA, 23 nt, Human
cggcagcaucuugcaguggcuuc

SEQ ID NO: 556822 - RNA, 20 nt, Human
cuacccuggcugcacgccag

SEQ ID NO: 556823 - RNA, 22 nt, Human
cucagaggacagaauuagcacc

SEQ ID NO: 556824 - RNA, 21 nt, Human
cuccaccaaucuccuucaccc

SEQ ID NO: 556825 - RNA, 22 nt, Human
cuccuuuugucccucuccucca

SEQ ID NO: 556826 - RNA, 25 nt, Human
cucucauauauaacccccuuccaaa

SEQ ID NO: 556827 - RNA, 19 nt, Human
cuggagauaggagcggagg

SEQ ID NO: 556828 - RNA, 23 nt, Human
cuuccaaaaaaaggaaaggggug

SEQ ID NO: 556829 - RNA, 19 nt, Human
cuugccccuuuacuucagc

SEQ ID NO: 556830 - RNA, 19 nt, Human
gaaaagcagaaaucacaaa

SEQ ID NO: 556831 - RNA, 22 nt, Human
gaaaagcagaaaucacaaagaa

SEQ ID NO: 556832 - RNA, 19 nt, Human
gaagggagcuggaaucuca

SEQ ID NO: 556833 - RNA, 22 nt, Human
gagggggagggggaggagaagg

SEQ ID NO: 556834 - RNA, 24 nt, Human
gagggggagggggaggagaaggag

SEQ ID NO: 556835 - RNA, 19 nt, Human
gaugaaagaaaaaagcagg

SEQ ID NO: 556836 - RNA, 18 nt, Human
gcagcaucuugcaguggc

SEQ ID NO: 556837 - RNA, 19 nt, Human
gcccuaccauagaagcaga

SEQ ID NO: 556838 - RNA, 20 nt, Human
gcgaggucuuccccucucca

SEQ ID NO: 556839 - RNA, 18 nt, Human
ggaaaaaacaggaaggaa

SEQ ID NO: 556840 - RNA, 18 nt, Human
ggaagguggcacaccccc

SEQ ID NO: 556841 - RNA, 18 nt, Human
ggagggggaggagaagga

SEQ ID NO: 556842 - RNA, 23 nt, Human
ggagggggagggggaggagaagg

SEQ ID NO: 556843 - RNA, 24 nt, Human
ggagguccuacuuggggaaggugg

SEQ ID NO: 556844 - RNA, 18 nt, Human
ggcuugguggaagggagc

SEQ ID NO: 556845 - RNA, 20 nt, Human
gggaaaaagggaugggaaga

SEQ ID NO: 556846 - RNA, 23 nt, Human
gggaaacugaggcccaaagggag

SEQ ID NO: 556847 - RNA, 21 nt, Human
gggaagaaaaaagaugggugg

SEQ ID NO: 556848 - RNA, 19 nt, Human
gggcaaaggcauuuugcca

SEQ ID NO: 556849 - RNA, 18 nt, Human
ggggaaacugaggcccaa

SEQ ID NO: 556850 - RNA, 21 nt, Human
ggggaagggacgggcuggggu

SEQ ID NO: 556851 - RNA, 19 nt, Human
ggggaggagaaggaggucc

SEQ ID NO: 556852 - RNA, 21 nt, Human
ggggagggggaggagaaggga

SEQ ID NO: 556853 - RNA, 19 nt, Human
ggugggaaugagauuccca

SEQ ID NO: 556854 - RNA, 20 nt, Human
gguuccuccggcaaagggag

SEQ ID NO: 556855 - RNA, 21 nt, Human
gugggauuagcauugaguuuc

SEQ ID NO: 556856 - RNA, 23 nt, Human
uaaaauaauaugcaugaaaagca

SEQ ID NO: 556857 - RNA, 22 nt, Human
uaaaugcaaauaagagccacaa

SEQ ID NO: 556858 - RNA, 18 nt, Human
uaagucauggccaccccu

SEQ ID NO: 556859 - RNA, 18 nt, Human
uacuugcaaaagcuucag

SEQ ID NO: 556860 - RNA, 23 nt, Human
uagagaacaggcucaaaacaagg

SEQ ID NO: 556861 - RNA, 21 nt, Human
uauauaaccaauaauaauaau

SEQ ID NO: 556862 - RNA, 20 nt, Human
uaucuugccccuuuacuuca

SEQ ID NO: 556863 - RNA, 22 nt, Human
uauuaugucauacuucaacccc

SEQ ID NO: 556864 - RNA, 24 nt, Human
ucaacaaucaacauuaaauauaca

SEQ ID NO: 556865 - RNA, 22 nt, Human
ucaagguuggaggagggggagg

SEQ ID NO: 556866 - RNA, 26 nt, Human
ucaguggcucuuccuggacgaggcug

SEQ ID NO: 556867 - RNA, 20 nt, Human
ucauacuucaaccccacuaa

SEQ ID NO: 556868 - RNA, 21 nt, Human
ucauuucaugaaggggagggg

SEQ ID NO: 556869 - RNA, 23 nt, Human
uccaagaagcuaaaaccaugcug

SEQ ID NO: 556870 - RNA, 18 nt, Human
uccaagagaagcaucugc

SEQ ID NO: 556871 - RNA, 25 nt, Human
uccaccaaucuccuucaccccucaa

SEQ ID NO: 556872 - RNA, 23 nt, Human
uccaucccuuccaauggucucca

SEQ ID NO: 556873 - RNA, 24 nt, Human
uccaucccuuccaauggucuccaa

SEQ ID NO: 556874 - RNA, 21 nt, Human
ucccagacccaaacuucagcu

SEQ ID NO: 556875 - RNA, 21 nt, Human
uccccucccccccaaacugga

SEQ ID NO: 556876 - RNA, 22 nt, Human
uccucaugcccuaccauagaag

SEQ ID NO: 556877 - RNA, 19 nt, Human
uccuccaccaaucuccuuc

SEQ ID NO: 556878 - RNA, 18 nt, Human
uccuccuaccaccaacac

SEQ ID NO: 556879 - RNA, 21 nt, Human
ucuauaccaaauaauuacucc

SEQ ID NO: 556880 - RNA, 20 nt, Human
ucucaggaggccuaauggcc

SEQ ID NO: 556881 - RNA, 21 nt, Human
ucuccaguccuggccugaaac

SEQ ID NO: 556882 - RNA, 23 nt, Human
ucuccccauccuccuaccaccaa

SEQ ID NO: 556883 - RNA, 27 nt, Human
ucucuuauuuccucuuauaggcaguga

SEQ ID NO: 556884 - RNA, 19 nt, Human
ucugacagagaaagaacaa

SEQ ID NO: 556885 - RNA, 19 nt, Human
ucugcaguuuugcacacau

SEQ ID NO: 556886 - RNA, 19 nt, Human
ucuguagcuaucauggcuu

SEQ ID NO: 556887 - RNA, 19 nt, Human
ugaaaagcagaaaucacaa

SEQ ID NO: 556888 - RNA, 22 nt, Human
ugaaaagcagaaaucacaaaga

SEQ ID NO: 556889 - RNA, 20 nt, Human
ugacuuauauuccaucccuu

SEQ ID NO: 556890 - RNA, 20 nt, Human
ugaggagcagggacugagga

SEQ ID NO: 556891 - RNA, 21 nt, Human
ugauaggaaauacagacuggc

SEQ ID NO: 556892 - RNA, 19 nt, Human
ugaugggaacaaaaaacaa

SEQ ID NO: 556893 - RNA, 21 nt, Human
ugcacacaucacccaauacaa

SEQ ID NO: 556894 - RNA, 22 nt, Human
ugcacacaucacccaauacaac

SEQ ID NO: 556895 - RNA, 25 nt, Human
ugcaccaccaucaucacuuucaccc

SEQ ID NO: 556896 - RNA, 18 nt, Human
ugcauguaugauccuacc

SEQ ID NO: 556897 - RNA, 21 nt, Human
uggagauaggagcggaggggc

SEQ ID NO: 556898 - RNA, 23 nt, Human
uggagggcucuuucugucugcug

SEQ ID NO: 556899 - RNA, 22 nt, Human
uggcucugcuaugagagguggg

SEQ ID NO: 556900 - RNA, 20 nt, Human
uggcuucucugacagagaaa

SEQ ID NO: 556901 - RNA, 23 nt, Human
ugggggaguuccccuccccccca

SEQ ID NO: 556902 - RNA, 18 nt, Human
ugggugguggcacaaagg

SEQ ID NO: 556903 - RNA, 23 nt, Human
ugggugguggcacaaaggacuca

SEQ ID NO: 556904 - RNA, 19 nt, Human
ugguacuggaguuuggggu

SEQ ID NO: 556905 - RNA, 21 nt, Human
ugguacuggaguuugggguug

SEQ ID NO: 556906 - RNA, 21 nt, Human
uggugaggggaacuggguccc

SEQ ID NO: 556907 - RNA, 20 nt, Human
uguagggacaggagacuaug

SEQ ID NO: 556908 - RNA, 23 nt, Human
uguagggacaggagacuauggac

SEQ ID NO: 556909 - RNA, 23 nt, Human
uguccagcaaugcuagaccaaca

SEQ ID NO: 556910 - RNA, 19 nt, Human
ugucucuucccccuugggg

SEQ ID NO: 556911 - RNA, 22 nt, Human
uguggccucuccaguccuggcc

SEQ ID NO: 556912 - RNA, 19 nt, Human
uucagaggcaggugacggc

SEQ ID NO: 556913 - RNA, 18 nt, Human
uuccaaaaaaaggaaagg

SEQ ID NO: 556914 - RNA, 21 nt, Human
uugcauguaugauccuacccu

SEQ ID NO: 556915 - RNA, 26 nt, Human
uuuaaaaccuccaaauucuuggcugc

SEQ ID NO: 556916 - RNA, 28 nt, Human
uuucucucuuauuuccucuuauaggcag

SEQ ID NO: 556917 - RNA, 20 nt, Human
uuugucccucuccuccacuu

SEQ ID NO: 556918 - RNA, 23 nt, Human
accaaggaaggcacacaaaacag

SEQ ID NO: 556919 - RNA, 24 nt, Human
agcagucuuuuuuauuauuauuau

SEQ ID NO: 556920 - RNA, 20 nt, Human
agggguugggcagggcaggg

SEQ ID NO: 556921 - RNA, 22 nt, Human
aucacugauauguccuguuaga

SEQ ID NO: 556922 - RNA, 19 nt, Human
cacacaaaacagaguguag

SEQ ID NO: 556923 - RNA, 23 nt, Human
cacaugagauuuuuaaaaaacca

SEQ ID NO: 556924 - RNA, 23 nt, Human
cagaaguaccaaggaaggcacag

SEQ ID NO: 556925 - RNA, 18 nt, Human
cagaauaaucuuugggaa

SEQ ID NO: 556926 - RNA, 25 nt, Human
cagaggguuuccucucagaguaacu

SEQ ID NO: 556927 - RNA, 20 nt, Human
cagaguaacucaucagacuc

SEQ ID NO: 556928 - RNA, 21 nt, Human
ccaaacucgaaucccuccagg

SEQ ID NO: 556929 - RNA, 21 nt, Human
ccuaagcacugugcucagucc

SEQ ID NO: 556930 - RNA, 18 nt, Human
cuacacuacuguaaacca

SEQ ID NO: 556931 - RNA, 24 nt, Human
cuagaccauacuucaagauaugac

SEQ ID NO: 556932 - RNA, 21 nt, Human
cuuggaaucucugaacuagca

SEQ ID NO: 556933 - RNA, 24 nt, Human
gaaaauaccucagaaguaccaagg

SEQ ID NO: 556934 - RNA, 19 nt, Human
gagaaucagacggggacaa

SEQ ID NO: 556935 - RNA, 19 nt, Human
gauucugaauuaguuguuc

SEQ ID NO: 556936 - RNA, 23 nt, Human
gccaagauugcaacuguucaaga

SEQ ID NO: 556937 - RNA, 19 nt, Human
ggaaguaacugcuccagug

SEQ ID NO: 556938 - RNA, 25 nt, Human
ggacaagcaccaaacucgaaucccu

SEQ ID NO: 556939 - RNA, 21 nt, Human
gggcagggcagggaugcggca

SEQ ID NO: 556940 - RNA, 20 nt, Human
gguugggcagggcagggaug

SEQ ID NO: 556941 - RNA, 21 nt, Human
uaaaaaaccaaaucuguccca

SEQ ID NO: 556942 - RNA, 22 nt, Human
uaaaaaaccaaaucugucccac

SEQ ID NO: 556943 - RNA, 20 nt, Human
uaauauauauacacuucaua

SEQ ID NO: 556944 - RNA, 24 nt, Human
uaaucuggaagggggcuugauugc

SEQ ID NO: 556945 - RNA, 22 nt, Human
uaccaaggaaggcacacaaaac

SEQ ID NO: 556946 - RNA, 23 nt, Human
uaccaaggaaggcacacaaaaca

SEQ ID NO: 556947 - RNA, 24 nt, Human
uauuaaaauuuuuaaaguuccaug

SEQ ID NO: 556948 - RNA, 24 nt, Human
ucugaauuaguuguucuuguuuuu

SEQ ID NO: 556949 - RNA, 25 nt, Human
ucugucccacugguaucuuuaaaaa

SEQ ID NO: 556950 - RNA, 25 nt, Human
ucuuuuuuuucccccucuuuuuccc

SEQ ID NO: 556951 - RNA, 20 nt, Human
ugaaaauaauauccuuguuc

SEQ ID NO: 556952 - RNA, 20 nt, Human
ugacaggaaaauaaacaaaa

SEQ ID NO: 556953 - RNA, 19 nt, Human
ugagaaucagacggggaca

SEQ ID NO: 556954 - RNA, 21 nt, Human
ugcucaaaaacucuauuugau

SEQ ID NO: 556955 - RNA, 21 nt, Human
ugcucaguccuccucaacaac

SEQ ID NO: 556956 - RNA, 19 nt, Human
ugggaucaugaaaauaccu

SEQ ID NO: 556957 - RNA, 18 nt, Human
uguucaagagacaguaau

SEQ ID NO: 556958 - RNA, 22 nt, Human
uucagaauaaucuuugggaagu

SEQ ID NO: 556959 - RNA, 20 nt, Human
uucuuguuuuucguuguuug

SEQ ID NO: 556960 - RNA, 19 nt, Human
uucuuuuuuuucccccucu

SEQ ID NO: 556961 - RNA, 22 nt, Human
uuguucugaauguucaaucaag

SEQ ID NO: 556962 - RNA, 23 nt, Human
uuucaagcugccaagauugcaac

SEQ ID NO: 556963 - RNA, 19 nt, Human
uuucuuuuuuuucccccuc

SEQ ID NO: 556964 - RNA, 23 nt, Human
uuuuucccccucuuuuucccccu

SEQ ID NO: 556965 - RNA, 20 nt, Human
aaaaaagaaaaggggaaaag

SEQ ID NO: 556966 - RNA, 24 nt, Human
aaaagaaggggaggagauggagag

SEQ ID NO: 556967 - RNA, 21 nt, Human
aaaauccuuccauuucuacuu

SEQ ID NO: 556968 - RNA, 21 nt, Human
aaaaugccacuuaugccaugg

SEQ ID NO: 556969 - RNA, 21 nt, Human
aaacaaaaaauaaagcaccac

SEQ ID NO: 556970 - RNA, 26 nt, Human
aaacaaaaaauaaagcaccacuccag

SEQ ID NO: 556971 - RNA, 25 nt, Human
aaaguaacauguuuggcaagcuaca

SEQ ID NO: 556972 - RNA, 26 nt, Human
aagaaaacaaaguaacauguuuggca

SEQ ID NO: 556973 - RNA, 20 nt, Human
aagagauaacuugcaaacua

SEQ ID NO: 556974 - RNA, 21 nt, Human
aagcaggagcacuacagccca

SEQ ID NO: 556975 - RNA, 26 nt, Human
aagcauuaaaggauacaaagaacaac

SEQ ID NO: 556976 - RNA, 23 nt, Human
acagcacggcaagucuauaagcu

SEQ ID NO: 556977 - RNA, 24 nt, Human
acauuuucacuuaauuaucaagga

SEQ ID NO: 556978 - RNA, 20 nt, Human
accaccacuaccaccuaugc

SEQ ID NO: 556979 - RNA, 24 nt, Human
accaccaucaccaccacuaccacc

SEQ ID NO: 556980 - RNA, 25 nt, Human
accaccaucaccaccacuaccaccu

SEQ ID NO: 556981 - RNA, 22 nt, Human
accaucaccaccacuaccaccu

SEQ ID NO: 556982 - RNA, 19 nt, Human
acuaagaacucuugcaguu

SEQ ID NO: 556983 - RNA, 18 nt, Human
acuaccaccaccaucacc

SEQ ID NO: 556984 - RNA, 22 nt, Human
acuaccaccaccaucaccacca

SEQ ID NO: 556985 - RNA, 19 nt, Human
acugcagaaauuaaggucc

SEQ ID NO: 556986 - RNA, 21 nt, Human
agaaaaggggaaaaaacccag

SEQ ID NO: 556987 - RNA, 18 nt, Human
agaaauaaagcaggagca

SEQ ID NO: 556988 - RNA, 21 nt, Human
agaaggggaggagauggagag

SEQ ID NO: 556989 - RNA, 22 nt, Human
agaaggggaggagauggagagg

SEQ ID NO: 556990 - RNA, 18 nt, Human
agcacaugccaccaaugu

SEQ ID NO: 556991 - RNA, 24 nt, Human
agcauuaaaggauacaaagaacaa

SEQ ID NO: 556992 - RNA, 23 nt, Human
aggaauacuguugcucuuaaaau

SEQ ID NO: 556993 - RNA, 23 nt, Human
agggguggggcugguagacugag

SEQ ID NO: 556994 - RNA, 23 nt, Human
aguaaaagaacuuaaaaaaaucc

SEQ ID NO: 556995 - RNA, 20 nt, Human
agucaaaaagaaggggagga

SEQ ID NO: 556996 - RNA, 20 nt, Human
auaaagcaccacuccaggca

SEQ ID NO: 556997 - RNA, 23 nt, Human
auaaagcaggagcacuacagccc

SEQ ID NO: 556998 - RNA, 19 nt, Human
auacugcagaacagacagg

SEQ ID NO: 556999 - RNA, 19 nt, Human
auagaaugacaccauuccc

SEQ ID NO: 557000 - RNA, 18 nt, Human
augcuuucugucaucugg

SEQ ID NO: 557001 - RNA, 24 nt, Human
auugcauuuauuuaaauuuuuuua

SEQ ID NO: 557002 - RNA, 21 nt, Human
caaaaaauaaagcaccacucc

SEQ ID NO: 557003 - RNA, 27 nt, Human
caaaaugagaagcaaaauugcacugac

SEQ ID NO: 557004 - RNA, 21 nt, Human
caaaaugccggaauacuucuc

SEQ ID NO: 557005 - RNA, 24 nt, Human
caaaaugccggaauacuucucugc

SEQ ID NO: 557006 - RNA, 23 nt, Human
caaacaaaaaauaaagcaccacu

SEQ ID NO: 557007 - RNA, 22 nt, Human
caaacuaccaccaccaucaccu

SEQ ID NO: 557008 - RNA, 19 nt, Human
caaaguaacauguuuggca

SEQ ID NO: 557009 - RNA, 24 nt, Human
caacuuaaucgucaucuuccccag

SEQ ID NO: 557010 - RNA, 18 nt, Human
caagaguggagucaaaaa

SEQ ID NO: 557011 - RNA, 26 nt, Human
caccaccaucaccaccacuaccaccu

SEQ ID NO: 557012 - RNA, 23 nt, Human
caccaucaccaccacuaccaccu

SEQ ID NO: 557013 - RNA, 22 nt, Human
cagacaagaacauuaaaagaaa

SEQ ID NO: 557014 - RNA, 21 nt, Human
cagcagaauggaaucaacaca

SEQ ID NO: 557015 - RNA, 19 nt, Human
caggagcacuacagcccag

SEQ ID NO: 557016 - RNA, 20 nt, Human
caguccacuggagguccuug

SEQ ID NO: 557017 - RNA, 26 nt, Human
caguccacuggagguccuugggugau

SEQ ID NO: 557018 - RNA, 19 nt, Human
caguguaccuuuuaagaac

SEQ ID NO: 557019 - RNA, 19 nt, Human
cauuuuaauauaaaguaac

SEQ ID NO: 557020 - RNA, 23 nt, Human
ccaaacaucagcccacuaucaau

SEQ ID NO: 557021 - RNA, 18 nt, Human
ccaaauaaaaggaugcuc

SEQ ID NO: 557022 - RNA, 21 nt, Human
ccaccaucaccaccacuacca

SEQ ID NO: 557023 - RNA, 22 nt, Human
ccaccuaugcaauaaaaaggca

SEQ ID NO: 557024 - RNA, 18 nt, Human
ccacuggagguccuuggg

SEQ ID NO: 557025 - RNA, 18 nt, Human
ccuaaacaggucuugugg

SEQ ID NO: 557026 - RNA, 20 nt, Human
ccuuccauuucuacuuuaaa

SEQ ID NO: 557027 - RNA, 26 nt, Human
cgagaccagcaaugucauuccagucc

SEQ ID NO: 557028 - RNA, 22 nt, Human
cgagguaaggccgucaguccac

SEQ ID NO: 557029 - RNA, 23 nt, Human
cgagguaaggccgucaguccacu

SEQ ID NO: 557030 - RNA, 19 nt, Human
cuaacaaaaaucaccgagg

SEQ ID NO: 557031 - RNA, 18 nt, Human
cuagacacuaacacaaac

SEQ ID NO: 557032 - RNA, 22 nt, Human
cugacaggucuagacacuaaca

SEQ ID NO: 557033 - RNA, 19 nt, Human
cuggcgacaccuggccaca

SEQ ID NO: 557034 - RNA, 21 nt, Human
cuugcaaacuaccaccaccau

SEQ ID NO: 557035 - RNA, 22 nt, Human
cuuuauauuagcacaugccacc

SEQ ID NO: 557036 - RNA, 21 nt, Human
gaaaaaugccacuuaugccau

SEQ ID NO: 557037 - RNA, 18 nt, Human
gaggagauggagagguuc

SEQ ID NO: 557038 - RNA, 19 nt, Human
gcaauaaaaaggcagucau

SEQ ID NO: 557039 - RNA, 23 nt, Human
gcagaacagacaggauugaggaa

SEQ ID NO: 557040 - RNA, 25 nt, Human
gcagaacagacaggauugaggaaua

SEQ ID NO: 557041 - RNA, 18 nt, Human
gccauaaaaccuccucuu

SEQ ID NO: 557042 - RNA, 20 nt, Human
ggaggagauggagagguucu

SEQ ID NO: 557043 - RNA, 25 nt, Human
ggaggagauggagagguucuuugug

SEQ ID NO: 557044 - RNA, 21 nt, Human
ggagucaaaaagaaggggagg

SEQ ID NO: 557045 - RNA, 26 nt, Human
ggcaguggcuguggaaagcuacagcc

SEQ ID NO: 557046 - RNA, 18 nt, Human
gggcugguagacugaggu

SEQ ID NO: 557047 - RNA, 18 nt, Human
ggggaggagauggagagg

SEQ ID NO: 557048 - RNA, 21 nt, Human
ggggaggagauggagagguuc

SEQ ID NO: 557049 - RNA, 20 nt, Human
gguagggguggggcugguag

SEQ ID NO: 557050 - RNA, 23 nt, Human
guaauuuuccuugcuauuuucca

SEQ ID NO: 557051 - RNA, 18 nt, Human
guccaaauaaaaggaugc

SEQ ID NO: 557052 - RNA, 19 nt, Human
guccaaauaaaaggaugcu

SEQ ID NO: 557053 - RNA, 21 nt, Human
guccagaaccggcaauuuuga

SEQ ID NO: 557054 - RNA, 22 nt, Human
gugaaagauggaagaaaacaaa

SEQ ID NO: 557055 - RNA, 23 nt, Human
gugaaagauggaagaaaacaaag

SEQ ID NO: 557056 - RNA, 22 nt, Human
gugaggcaaacaaaaaauaaag

SEQ ID NO: 557057 - RNA, 25 nt, Human
guggagucaaaaagaaggggaggag

SEQ ID NO: 557058 - RNA, 20 nt, Human
uaaaaggaugcuccgaggua

SEQ ID NO: 557059 - RNA, 19 nt, Human
uaaaaugccagugcuuugc

SEQ ID NO: 557060 - RNA, 21 nt, Human
uaaacuaaaaaaagaaaaggg

SEQ ID NO: 557061 - RNA, 22 nt, Human
uaaagcaggagcacuacagccc

SEQ ID NO: 557062 - RNA, 24 nt, Human
uaaagcauuaaaggauacaaagaa

SEQ ID NO: 557063 - RNA, 27 nt, Human
uaaagcauuaaaggauacaaagaacaa

SEQ ID NO: 557064 - RNA, 21 nt, Human
uaaguugguuuguugguuggu

SEQ ID NO: 557065 - RNA, 31 nt, Human
uacagcccagauuucaaaaugagaagcaaag

SEQ ID NO: 557066 - RNA, 19 nt, Human
uaccaccaccaucaccacc

SEQ ID NO: 557067 - RNA, 24 nt, Human
uacccugacucuaaagaugcaacu

SEQ ID NO: 557068 - RNA, 20 nt, Human
uagcacaugccaccaaugua

SEQ ID NO: 557069 - RNA, 18 nt, Human
uagcuugaacagaacuga

SEQ ID NO: 557070 - RNA, 18 nt, Human
uauauauauguguaugua

SEQ ID NO: 557071 - RNA, 25 nt, Human
uaucacacuucaguauuuuucuggg

SEQ ID NO: 557072 - RNA, 18 nt, Human
ucaaaaagaaggggagga

SEQ ID NO: 557073 - RNA, 19 nt, Human
ucaaaguaauuuuccuugc

SEQ ID NO: 557074 - RNA, 22 nt, Human
ucaacacacuugcaccuugcuc

SEQ ID NO: 557075 - RNA, 23 nt, Human
ucaacacacuugcaccuugcucu

SEQ ID NO: 557076 - RNA, 22 nt, Human
uccaagagaaauguaacaaaac

SEQ ID NO: 557077 - RNA, 25 nt, Human
uccacaggaccuuccaaaaugccgg

SEQ ID NO: 557078 - RNA, 25 nt, Human
uccucuuuaaugacagccuucacca

SEQ ID NO: 557079 - RNA, 21 nt, Human
uccuugggugauaaucucauu

SEQ ID NO: 557080 - RNA, 24 nt, Human
ucuaaacuaaaaaaagaaaagggg

SEQ ID NO: 557081 - RNA, 24 nt, Human
ucuaucaaacagcacggcaagucu

SEQ ID NO: 557082 - RNA, 18 nt, Human
ucucgagaacagcagaau

SEQ ID NO: 557083 - RNA, 24 nt, Human
ugaacagaacugagcauccacaua

SEQ ID NO: 557084 - RNA, 23 nt, Human
ugacauaaagaauuauucugcuc

SEQ ID NO: 557085 - RNA, 22 nt, Human
ugaggaauacuguugcucuuaa

SEQ ID NO: 557086 - RNA, 18 nt, Human
ugcaaacuaccaccacca

SEQ ID NO: 557087 - RNA, 23 nt, Human
ugcagaacagacaggauugagga

SEQ ID NO: 557088 - RNA, 19 nt, Human
uggagucaaaaagaagggg

SEQ ID NO: 557089 - RNA, 22 nt, Human
uggauauauauauguguaugua

SEQ ID NO: 557090 - RNA, 18 nt, Human
uggcaagcuacauugcag

SEQ ID NO: 557091 - RNA, 19 nt, Human
uggcugacaggucuagaca

SEQ ID NO: 557092 - RNA, 23 nt, Human
uggggcugguagacugaggugga

SEQ ID NO: 557093 - RNA, 24 nt, Human
uguggauauauauauguguaugua

SEQ ID NO: 557094 - RNA, 25 nt, Human
uguuuugccugucccccgaggucca

SEQ ID NO: 557095 - RNA, 20 nt, Human
uguuuugguugcuauccucu

SEQ ID NO: 557096 - RNA, 22 nt, Human
uuaccaggucgaugaggugcgu

SEQ ID NO: 557097 - RNA, 23 nt, Human
uuaugccauggguaggggugggg

SEQ ID NO: 557098 - RNA, 25 nt, Human
uucaacacauuccuuugagguacug

SEQ ID NO: 557099 - RNA, 19 nt, Human
uucacuuaauuaucaagga

SEQ ID NO: 557100 - RNA, 24 nt, Human
uucacuuucauuuuuccgaccguu

SEQ ID NO: 557101 - RNA, 23 nt, Human
uuccccaguacccuuugcaauuu

SEQ ID NO: 557102 - RNA, 22 nt, Human
uucccuauguagcagguuuuau

SEQ ID NO: 557103 - RNA, 24 nt, Human
uuccugaguuuuugcagacaagaa

SEQ ID NO: 557104 - RNA, 24 nt, Human
uuuccuccaaaucuacccugacuc

SEQ ID NO: 557105 - RNA, 19 nt, Human
uuugaaaaauguggccccc

SEQ ID NO: 557106 - RNA, 23 nt, Human
uuuguggauauauauauguguau

SEQ ID NO: 557107 - RNA, 20 nt, Human
uuuguugguugguuuuuguu

SEQ ID NO: 557108 - RNA, 20 nt, Human
uuuuuuuuuucuaaagaagu

SEQ ID NO: 557109 - RNA, 23 nt, Human
aaaaauacaauuaacacaucccc

SEQ ID NO: 557110 - RNA, 19 nt, Human
agagaugccuugauuccaa

SEQ ID NO: 557111 - RNA, 24 nt, Human
augcaaaacgggaguuaagagcac

SEQ ID NO: 557112 - RNA, 19 nt, Human
caaaacgggaguuaagagc

SEQ ID NO: 557113 - RNA, 23 nt, Human
caagcaguuucacuccagguacu

SEQ ID NO: 557114 - RNA, 18 nt, Human
cagagaugccuugauucc

SEQ ID NO: 557115 - RNA, 27 nt, Human
ccagcagugacugcaggaaaaucucuu

SEQ ID NO: 557116 - RNA, 18 nt, Human
ccugcggcugguguggga

SEQ ID NO: 557117 - RNA, 23 nt, Human
cuaugcuaaaaaauaaagaagac

SEQ ID NO: 557118 - RNA, 25 nt, Human
cuccuugaugcugcuauccaagcac

SEQ ID NO: 557119 - RNA, 24 nt, Human
cugccgguuuucaccugcggcugg

SEQ ID NO: 557120 - RNA, 22 nt, Human
gcacagggucuggagccaggcu

SEQ ID NO: 557121 - RNA, 25 nt, Human
ggcugccugcuuucaaauccuggcu

SEQ ID NO: 557122 - RNA, 22 nt, Human
uaaaaaauaaagaagacuguaa

SEQ ID NO: 557123 - RNA, 19 nt, Human
uaagagcacagggucugga

SEQ ID NO: 557124 - RNA, 25 nt, Human
uacugugcacuucugcauguacaca

SEQ ID NO: 557125 - RNA, 21 nt, Human
uaugcuaaaaaauaaagaaga

SEQ ID NO: 557126 - RNA, 19 nt, Human
ucacuccagguacugugca

SEQ ID NO: 557127 - RNA, 20 nt, Human
ucuugaugcaaaacgggagu

SEQ ID NO: 557128 - RNA, 18 nt, Human
ugagaucacacagccagu

SEQ ID NO: 557129 - RNA, 18 nt, Human
ugcuaaaaaauaaagaag

SEQ ID NO: 557130 - RNA, 21 nt, Human
uggugugggacgcuggcagcc

SEQ ID NO: 557131 - RNA, 26 nt, Human
uucaccugcggcugguguccgaguac

SEQ ID NO: 557132 - RNA, 19 nt, Human
uucaccugcggcuggugug

SEQ ID NO: 557133 - RNA, 20 nt, Human
acacuuuaugcacauauaua

SEQ ID NO: 557134 - RNA, 23 nt, Human
acagcgugggauugaaagaaagg

SEQ ID NO: 557135 - RNA, 23 nt, Human
accacacuuuaugcacauauaua

SEQ ID NO: 557136 - RNA, 19 nt, Human
agcccaggcacccgggucc

SEQ ID NO: 557137 - RNA, 22 nt, Human
agccuucaggccaaaaugacaa

SEQ ID NO: 557138 - RNA, 19 nt, Human
aucucucucuuuuccuccc

SEQ ID NO: 557139 - RNA, 27 nt, Human
auuugacuuagugcauacagcugaccc

SEQ ID NO: 557140 - RNA, 22 nt, Human
cacagggacggccacucggggg

SEQ ID NO: 557141 - RNA, 21 nt, Human
cacucgggggccaaaccccag

SEQ ID NO: 557142 - RNA, 23 nt, Human
caggcacccgggucccggggagg

SEQ ID NO: 557143 - RNA, 23 nt, Human
ccacagggacggccacucggggg

SEQ ID NO: 557144 - RNA, 22 nt, Human
ccagaucucucucuuuuccucc

SEQ ID NO: 557145 - RNA, 21 nt, Human
cccagccccagaucucucucu

SEQ ID NO: 557146 - RNA, 23 nt, Human
ccccagagucuggagguccugcu

SEQ ID NO: 557147 - RNA, 21 nt, Human
ccccccaucauccauaccccg

SEQ ID NO: 557148 - RNA, 19 nt, Human
cggaaagggaaugaggggg

SEQ ID NO: 557149 - RNA, 19 nt, Human
cggaaagggaaugaggggg

SEQ ID NO: 557150 - RNA, 21 nt, Human
cuaucgcgagccgucccccug

SEQ ID NO: 557151 - RNA, 31 nt, Human
cuccccagagucuggagguccugcucucuuu

SEQ ID NO: 557152 - RNA, 21 nt, Human
cuccggggccaccagcgcucu

SEQ ID NO: 557153 - RNA, 21 nt, Human
cuggaacaaagggagaacaca

SEQ ID NO: 557154 - RNA, 24 nt, Human
cuucaagccgagcccaggcacccc

SEQ ID NO: 557155 - RNA, 19 nt, Human
gagaacacaggaaggggcc

SEQ ID NO: 557156 - RNA, 20 nt, Human
gagcccaggcacccgggucc

SEQ ID NO: 557157 - RNA, 19 nt, Human
gccggugcgccgccgccgc

SEQ ID NO: 557158 - RNA, 22 nt, Human
gcgccgccgccgcuucaagccg

SEQ ID NO: 557159 - RNA, 22 nt, Human
gcggcgcuggaacaaagggaga

SEQ ID NO: 557160 - RNA, 22 nt, Human
gcuccggggcuucgggcgcuuc

SEQ ID NO: 557161 - RNA, 19 nt, Human
ggcgcuggaacaaagggag

SEQ ID NO: 557162 - RNA, 22 nt, Human
gggggcccaagaauggggugca

SEQ ID NO: 557163 - RNA, 22 nt, Human
ggggugcaucucccacagggac

SEQ ID NO: 557164 - RNA, 21 nt, Human
gguccugcucucuuuguccua

SEQ ID NO: 557165 - RNA, 23 nt, Human
uagaaaauugcagaauuagcuca

SEQ ID NO: 557166 - RNA, 24 nt, Human
ucaggccaaaaugacaagagguca

SEQ ID NO: 557167 - RNA, 25 nt, Human
uccccccaucauccauaccccagga

SEQ ID NO: 557168 - RNA, 26 nt, Human
ucccgcggcugugccggugcgccgcc

SEQ ID NO: 557169 - RNA, 19 nt, Human
ucccugacaguggcagagg

SEQ ID NO: 557170 - RNA, 22 nt, Human
uccuaucgcgagccgucccccu

SEQ ID NO: 557171 - RNA, 18 nt, Human
ugaaagaaaggggcaggu

SEQ ID NO: 557172 - RNA, 19 nt, Human
ugaggggggcccaagaaug

SEQ ID NO: 557173 - RNA, 25 nt, Human
ugaggggggcccaagaauggggugc

SEQ ID NO: 557174 - RNA, 27 nt, Human
ugcgagagggaggaagaaauucauuau

SEQ ID NO: 557175 - RNA, 21 nt, Human
ugcgggugggcguuggccggc

SEQ ID NO: 557176 - RNA, 21 nt, Human
uggcacaguaaagaauccuuu

SEQ ID NO: 557177 - RNA, 20 nt, Human
uggggugcaucucccacagg

SEQ ID NO: 557178 - RNA, 24 nt, Human
ugugccggugcgccgccgccgcuu

SEQ ID NO: 557179 - RNA, 23 nt, Human
uuccccccaucauccauacccca

SEQ ID NO: 557180 - RNA, 20 nt, Human
uuccuuuuucggaaagggaa

SEQ ID NO: 557181 - RNA, 18 nt, Human
uucuggugaacaucaucg

SEQ ID NO: 557182 - RNA, 22 nt, Human
gcggggcagggagccggggcac

SEQ ID NO: 557183 - RNA, 22 nt, Human
ucggguggcggcagcuaggacc

SEQ ID NO: 557184 - RNA, 25 nt, Human
ucggguggcggcagcuaggacccuc

SEQ ID NO: 557185 - RNA, 20 nt, Human
uguucggguggcggcagcua

SEQ ID NO: 557186 - RNA, 24 nt, Human
uuuuuuuuuuuuuuuuaaguuuuu

SEQ ID NO: 557187 - RNA, 19 nt, Human
uuuuuuuuuuuuuuuuuaa

SEQ ID NO: 557188 - RNA, 23 nt, Human
aaaaaacaaagcaagaaagaaca

SEQ ID NO: 557189 - RNA, 20 nt, Human
aaagaagucccuacaaaagc

SEQ ID NO: 557190 - RNA, 24 nt, Human
aaagugcugggauuacaggcauga

SEQ ID NO: 557191 - RNA, 24 nt, Human
aaagugcugggauuacaggcauga

SEQ ID NO: 557192 - RNA, 24 nt, Human
aaccucaggugauccgcccgccuc

SEQ ID NO: 557193 - RNA, 19 nt, Human
aagaaacucacacauaaau

SEQ ID NO: 557194 - RNA, 25 nt, Human
aagcaagaaagaacauuguauaagg

SEQ ID NO: 557195 - RNA, 19 nt, Human
aagcagaaauauagggugc

SEQ ID NO: 557196 - RNA, 19 nt, Human
aagugcugggauuacaggc

SEQ ID NO: 557197 - RNA, 19 nt, Human
aagugcugggauuacaggc

SEQ ID NO: 557198 - RNA, 21 nt, Human
aagugcugggauuacaggcau

SEQ ID NO: 557199 - RNA, 21 nt, Human
aagugcugggauuacaggcau

SEQ ID NO: 557200 - RNA, 26 nt, Human
aagugcugggauuacaggcaugagcc

SEQ ID NO: 557201 - RNA, 26 nt, Human
aagugcugggauuacaggcaugagcc

SEQ ID NO: 557202 - RNA, 20 nt, Human
aauaggccaccaaucacuag

SEQ ID NO: 557203 - RNA, 18 nt, Human
acaaagcaagaaagaaca

SEQ ID NO: 557204 - RNA, 20 nt, Human
acaaagcaagaaagaacauu

SEQ ID NO: 557205 - RNA, 24 nt, Human
acaagguuucaccauguuggccag

SEQ ID NO: 557206 - RNA, 24 nt, Human
accauguuggccaggcuggucuug

SEQ ID NO: 557207 - RNA, 22 nt, Human
accauuuuccucugguccuccu

SEQ ID NO: 557208 - RNA, 18 nt, Human
acccuccuuggcccccaa

SEQ ID NO: 557209 - RNA, 25 nt, Human
acccuccuuggcccccaaagugcug

SEQ ID NO: 557210 - RNA, 21 nt, Human
accgcaaccuccgccuccggg

SEQ ID NO: 557211 - RNA, 23 nt, Human
accgcaaccuccgccuccggguu

SEQ ID NO: 557212 - RNA, 18 nt, Human
acuacccauuaaagaacc

SEQ ID NO: 557213 - RNA, 22 nt, Human
acuuuuguauuuuuaguagaga

SEQ ID NO: 557214 - RNA, 24 nt, Human
acuuuuguauuuuuaguagagaua

SEQ ID NO: 557215 - RNA, 21 nt, Human
agaaagaaauggguacuuaga

SEQ ID NO: 557216 - RNA, 23 nt, Human
agacagaaaugggaaaauguaga

SEQ ID NO: 557217 - RNA, 25 nt, Human
aggcuggagugcaguggcacaaucu

SEQ ID NO: 557218 - RNA, 22 nt, Human
aggguuucuccguguuggucag

SEQ ID NO: 557219 - RNA, 24 nt, Human
aggugauccgcccgccucagccuc

SEQ ID NO: 557220 - RNA, 22 nt, Human
agguuucaccauguuggccagg

SEQ ID NO: 557221 - RNA, 18 nt, Human
aguagcugggacuacagg

SEQ ID NO: 557222 - RNA, 24 nt, Human
agugauucugccgccucagccuuc

SEQ ID NO: 557223 - RNA, 20 nt, Human
agugcaguggcacaaucuug

SEQ ID NO: 557224 - RNA, 24 nt, Human
agugcaguggcacaaucuuggcuc

SEQ ID NO: 557225 - RNA, 18 nt, Human
agugcugggauuacaggc

SEQ ID NO: 557226 - RNA, 18 nt, Human
agugcugggauuacaggc

SEQ ID NO: 557227 - RNA, 22 nt, Human
auauuaaaaggguagauguauc

SEQ ID NO: 557228 - RNA, 22 nt, Human
auccacccuccuuggcccccaa

SEQ ID NO: 557229 - RNA, 24 nt, Human
caaagugcugggauuacaggcaug

SEQ ID NO: 557230 - RNA, 24 nt, Human
caaagugcugggauuacaggcaug

SEQ ID NO: 557231 - RNA, 25 nt, Human
caagaaagaacauuguauaaaaaua

SEQ ID NO: 557232 - RNA, 24 nt, Human
caagguuucaccauguuggccagg

SEQ ID NO: 557233 - RNA, 24 nt, Human
caagugauccacccuccuuggccc

SEQ ID NO: 557234 - RNA, 22 nt, Human
caagugauucugccgccucagc

SEQ ID NO: 557235 - RNA, 21 nt, Human
caaugcauacauauuuauaug

SEQ ID NO: 557236 - RNA, 22 nt, Human
caccaccacgccuggcuaauuu

SEQ ID NO: 557237 - RNA, 24 nt, Human
caccacgccuggcuaauuuuugua

SEQ ID NO: 557238 - RNA, 21 nt, Human
caccauguuggccaggcuggu

SEQ ID NO: 557239 - RNA, 24 nt, Human
caccauguuggccaggcuggucuu

SEQ ID NO: 557240 - RNA, 27 nt, Human
caccauguuggccaggcuggucuugaa

SEQ ID NO: 557241 - RNA, 20 nt, Human
cacccuccuuggcccccaaa

SEQ ID NO: 557242 - RNA, 21 nt, Human
cacugcaaccuccgccucccg

SEQ ID NO: 557243 - RNA, 23 nt, Human
cacugcaaccuccgccucccggg

SEQ ID NO: 557244 - RNA, 18 nt, Human
cagcuaacuucaguuuuu

SEQ ID NO: 557245 - RNA, 20 nt, Human
cagcuuaaguccuagguagc

SEQ ID NO: 557246 - RNA, 21 nt, Human
caggcacgcaucaccacgccc

SEQ ID NO: 557247 - RNA, 23 nt, Human
caugagccaccaugccuggcuau

SEQ ID NO: 557248 - RNA, 24 nt, Human
cauguuggccaggcuggucuugaa

SEQ ID NO: 557249 - RNA, 23 nt, Human
ccaaagugcugggauuacaggca

SEQ ID NO: 557250 - RNA, 23 nt, Human
ccaaagugcugggauuacaggca

SEQ ID NO: 557251 - RNA, 24 nt, Human
ccaaagugcugggauuacaggcau

SEQ ID NO: 557252 - RNA, 24 nt, Human
ccaaagugcugggauuacaggcau

SEQ ID NO: 557253 - RNA, 23 nt, Human
ccagaagucuucuauucaaagac

SEQ ID NO: 557254 - RNA, 24 nt, Human
cccaaagugcugggauuacaggca

SEQ ID NO: 557255 - RNA, 24 nt, Human
cccaaagugcugggauuacaggca

SEQ ID NO: 557256 - RNA, 20 nt, Human
cccaaccucaggugauccgc

SEQ ID NO: 557257 - RNA, 24 nt, Human
cccaaccucaggugauccgcccgc

SEQ ID NO: 557258 - RNA, 24 nt, Human
ccccaaagugcugggauuacaggc

SEQ ID NO: 557259 - RNA, 23 nt, Human
cccgaguagcugggacuacaggu

SEQ ID NO: 557260 - RNA, 24 nt, Human
cccgaguagcugggacuacaggug

SEQ ID NO: 557261 - RNA, 23 nt, Human
cccggguucaagcaaaucucccc

SEQ ID NO: 557262 - RNA, 23 nt, Human
cccggguucaagcaaaucuccug

SEQ ID NO: 557263 - RNA, 23 nt, Human
ccgcaaccuccgccuccggguuc

SEQ ID NO: 557264 - RNA, 26 nt, Human
ccgcccgccucagccucccaaagugc

SEQ ID NO: 557265 - RNA, 24 nt, Human
ccgccucagccucccaaagugcug

SEQ ID NO: 557266 - RNA, 24 nt, Human
ccgccucagccuuccuggguagcu

SEQ ID NO: 557267 - RNA, 18 nt, Human
ccggguucaagugauucu

SEQ ID NO: 557268 - RNA, 19 nt, Human
ccguguuggucaggcuggu

SEQ ID NO: 557269 - RNA, 22 nt, Human
ccguguuggucaggcuggucuc

SEQ ID NO: 557270 - RNA, 23 nt, Human
ccguguuggucaggcuggucucg

SEQ ID NO: 557271 - RNA, 24 nt, Human
ccucugguccucaagcagagacug

SEQ ID NO: 557272 - RNA, 24 nt, Human
ccugaucucaagugauccacccuc

SEQ ID NO: 557273 - RNA, 23 nt, Human
ccuggguagcugggauuacaggc

SEQ ID NO: 557274 - RNA, 24 nt, Human
ccuggguagcugggauuacaggca

SEQ ID NO: 557275 - RNA, 21 nt, Human
cgcaucaccacgcccggcuac

SEQ ID NO: 557276 - RNA, 24 nt, Human
cgccucagccucccaaagugcugg

SEQ ID NO: 557277 - RNA, 21 nt, Human
cgccuccggguucaagugauu

SEQ ID NO: 557278 - RNA, 19 nt, Human
cuacccauuaaagaaccag

SEQ ID NO: 557279 - RNA, 24 nt, Human
cuagccuuaagaaguaaauauuga

SEQ ID NO: 557280 - RNA, 25 nt, Human
cucacacauaaaugauuuguccuau

SEQ ID NO: 557281 - RNA, 24 nt, Human
cucacugcaaccuccgccucccgg

SEQ ID NO: 557282 - RNA, 24 nt, Human
cucagccucccgaguagcugggac

SEQ ID NO: 557283 - RNA, 23 nt, Human
cucugucacccaggcuggagugc

SEQ ID NO: 557284 - RNA, 23 nt, Human
cugcaaccuccgccucccggguu

SEQ ID NO: 557285 - RNA, 24 nt, Human
cugcaaccuccgccucccggguuc

SEQ ID NO: 557286 - RNA, 20 nt, Human
cuggguagcugggauuacag

SEQ ID NO: 557287 - RNA, 23 nt, Human
cugucucagccucccgaguagcu

SEQ ID NO: 557288 - RNA, 21 nt, Human
cuugcucugucacccaggcug

SEQ ID NO: 557289 - RNA, 24 nt, Human
cuugcucugucacccaggcuggag

SEQ ID NO: 557290 - RNA, 21 nt, Human
cuuuaaagaugacugcccucu

SEQ ID NO: 557291 - RNA, 20 nt, Human
cuuuuguauuuuuaguagag

SEQ ID NO: 557292 - RNA, 22 nt, Human
gaaaauagagggaagcagaaau

SEQ ID NO: 557293 - RNA, 18 nt, Human
gaaaauagcaagccuugg

SEQ ID NO: 557294 - RNA, 19 nt, Human
gaagcagaaauauagggug

SEQ ID NO: 557295 - RNA, 21 nt, Human
gagaaaauagagggaagcaga

SEQ ID NO: 557296 - RNA, 25 nt, Human
gagaaaauagagggaagccgguacc

SEQ ID NO: 557297 - RNA, 24 nt, Human
gagauaggguuucuccguguuggu

SEQ ID NO: 557298 - RNA, 21 nt, Human
gagauggagucuugcucuguc

SEQ ID NO: 557299 - RNA, 24 nt, Human
gaguagcugggacuacaggugugc

SEQ ID NO: 557300 - RNA, 21 nt, Human
gauccacccuccuuggccccc

SEQ ID NO: 557301 - RNA, 24 nt, Human
gaucucaagugauccacccuccuu

SEQ ID NO: 557302 - RNA, 18 nt, Human
gauuacaggcaugagcca

SEQ ID NO: 557303 - RNA, 18 nt, Human
gauuacaggcaugagcca

SEQ ID NO: 557304 - RNA, 21 nt, Human
gauuacaggcaugagccacca

SEQ ID NO: 557305 - RNA, 21 nt, Human
gauuacaggcaugagccacca

SEQ ID NO: 557306 - RNA, 22 nt, Human
gauuacaggcaugagccaccac

SEQ ID NO: 557307 - RNA, 24 nt, Human
gauuacaggcaugagccaccaugc

SEQ ID NO: 557308 - RNA, 18 nt, Human
gccgccucagccuuccug

SEQ ID NO: 557309 - RNA, 21 nt, Human
gccucagccuuccuggguagc

SEQ ID NO: 557310 - RNA, 24 nt, Human
gccucagccuuccuggguagcugg

SEQ ID NO: 557311 - RNA, 21 nt, Human
gccuccggguucaagugauuc

SEQ ID NO: 557312 - RNA, 19 nt, Human
gcuggagugcaguggcaca

SEQ ID NO: 557313 - RNA, 23 nt, Human
gcuggucucgaacucccaaccuc

SEQ ID NO: 557314 - RNA, 19 nt, Human
ggauuacaggcaugagcca

SEQ ID NO: 557315 - RNA, 24 nt, Human
ggauuacaggcaugagccaccaug

SEQ ID NO: 557316 - RNA, 24 nt, Human
ggcuggucuugaacuccugaucuc

SEQ ID NO: 557317 - RNA, 24 nt, Human
ggguagcugggauuacaggcacgc

SEQ ID NO: 557318 - RNA, 18 nt, Human
guagcugggauuacaggc

SEQ ID NO: 557319 - RNA, 19 nt, Human
guagcugggauuacaggca

SEQ ID NO: 557320 - RNA, 22 nt, Human
gugauccacccuccuuggcccc

SEQ ID NO: 557321 - RNA, 24 nt, Human
gugauccgcccgccucagccuccc

SEQ ID NO: 557322 - RNA, 24 nt, Human
gugauucugccgccucagccuucc

SEQ ID NO: 557323 - RNA, 25 nt, Human
guuucuccguguuggucaggcuggu

SEQ ID NO: 557324 - RNA, 21 nt, Human
uaaccuggucucaugucgugg

SEQ ID NO: 557325 - RNA, 27 nt, Human
uaacuuaucagaaagaaaggccaaugg

SEQ ID NO: 557326 - RNA, 25 nt, Human
uaacuuaucagaaagaaauggguac

SEQ ID NO: 557327 - RNA, 20 nt, Human
uaaguccuagguagcauguc

SEQ ID NO: 557328 - RNA, 18 nt, Human
uaauaggccaccaaucac

SEQ ID NO: 557329 - RNA, 31 nt, Human
uaauaggccaccaaucacuaggagccaagcc

SEQ ID NO: 557330 - RNA, 24 nt, Human
uaauuuuuguauuuuuaguagaga

SEQ ID NO: 557331 - RNA, 24 nt, Human
uacaggcaugagccaccacaccca

SEQ ID NO: 557332 - RNA, 22 nt, Human
uacaggcaugagccaccaugcc

SEQ ID NO: 557333 - RNA, 22 nt, Human
uacaggugugcaccaccacgcc

SEQ ID NO: 557334 - RNA, 22 nt, Human
uaccgcaaccuccgccuccggg

SEQ ID NO: 557335 - RNA, 22 nt, Human
uagagacaagguuucaccaugu

SEQ ID NO: 557336 - RNA, 24 nt, Human
uaggguuucuccguguuggucagg

SEQ ID NO: 557337 - RNA, 24 nt, Human
uaguagagacaagguuucaccaug

SEQ ID NO: 557338 - RNA, 26 nt, Human
uaguagagacaagguuucaccauguu

SEQ ID NO: 557339 - RNA, 21 nt, Human
uaguagagauaggguuucucc

SEQ ID NO: 557340 - RNA, 24 nt, Human
uaguagagauaggguuucuccgug

SEQ ID NO: 557341 - RNA, 26 nt, Human
uaguagagauaggguuucuccguguu

SEQ ID NO: 557342 - RNA, 24 nt, Human
uauaaauauaacuuucuaccucau

SEQ ID NO: 557343 - RNA, 24 nt, Human
uauauaaaaauaaaaaacaaagca

SEQ ID NO: 557344 - RNA, 24 nt, Human
ucaaauguugaccucuaacuugga

SEQ ID NO: 557345 - RNA, 18 nt, Human
ucaaggcuuacggacaag

SEQ ID NO: 557346 - RNA, 24 nt, Human
ucacccaggcuggagugcaguggc

SEQ ID NO: 557347 - RNA, 23 nt, Human
ucacugcaaccuccgccucccgg

SEQ ID NO: 557348 - RNA, 24 nt, Human
ucacugcaaccuccgccucccggg

SEQ ID NO: 557349 - RNA, 25 nt, Human
ucacugcaaccuccgccucccgggu

SEQ ID NO: 557350 - RNA, 27 nt, Human
ucacugcaaccuccgccucccggguuc

SEQ ID NO: 557351 - RNA, 23 nt, Human
ucagccucccgaguagcugggac

SEQ ID NO: 557352 - RNA, 21 nt, Human
ucagccuuccuggguagcugg

SEQ ID NO: 557353 - RNA, 21 nt, Human
ucagguccaacaaccauuuuc

SEQ ID NO: 557354 - RNA, 19 nt, Human
uccacccuccuuggccccc

SEQ ID NO: 557355 - RNA, 20 nt, Human
uccacccuccuuggccccca

SEQ ID NO: 557356 - RNA, 24 nt, Human
ucccaaagugcugggauuacaggc

SEQ ID NO: 557357 - RNA, 23 nt, Human
ucccgaguagcugggacuacagg

SEQ ID NO: 557358 - RNA, 24 nt, Human
ucccgaguagcugggacuacaggu

SEQ ID NO: 557359 - RNA, 21 nt, Human
ucccggguucaagcaaaucuc

SEQ ID NO: 557360 - RNA, 24 nt, Human
ucccggguucaagcaaaucuccug

SEQ ID NO: 557361 - RNA, 20 nt, Human
ucccucgacuucauagauuu

SEQ ID NO: 557362 - RNA, 21 nt, Human
uccgcccgccucagccuccca

SEQ ID NO: 557363 - RNA, 23 nt, Human
uccgccuccggguucaagugauu

SEQ ID NO: 557364 - RNA, 24 nt, Human
uccuggguagcugggauuacaggc

SEQ ID NO: 557365 - RNA, 20 nt, Human
uccuuggcccccaaagugcu

SEQ ID NO: 557366 - RNA, 23 nt, Human
ucucaagugauccacccuccuug

SEQ ID NO: 557367 - RNA, 24 nt, Human
ucuccugucucagccucccgagua

SEQ ID NO: 557368 - RNA, 24 nt, Human
ucugucacccaggcuggagugcag

SEQ ID NO: 557369 - RNA, 21 nt, Human
ucuugaacuccugaucucaag

SEQ ID NO: 557370 - RNA, 23 nt, Human
ucuugcucugucacccaggcugg

SEQ ID NO: 557371 - RNA, 24 nt, Human
ucuugcucugucacccaggcugga

SEQ ID NO: 557372 - RNA, 19 nt, Human
ucuuuuuuucgagacagag

SEQ ID NO: 557373 - RNA, 21 nt, Human
ugaucucaagugauccacccu

SEQ ID NO: 557374 - RNA, 22 nt, Human
ugaucucaagugauccacccuc

SEQ ID NO: 557375 - RNA, 22 nt, Human
ugcaguggcacaaucuuggcuc

SEQ ID NO: 557376 - RNA, 24 nt, Human
ugcucugucacccaggcuggagug

SEQ ID NO: 557377 - RNA, 19 nt, Human
uggagucuugcucugucac

SEQ ID NO: 557378 - RNA, 23 nt, Human
uggagugcaguggcacaaucuug

SEQ ID NO: 557379 - RNA, 24 nt, Human
uggagugcaguggcacaaucuugg

SEQ ID NO: 557380 - RNA, 24 nt, Human
uggcacaaucuuggcucacugcaa

SEQ ID NO: 557381 - RNA, 24 nt, Human
uggccaggcuggucuugaacuccu

SEQ ID NO: 557382 - RNA, 18 nt, Human
ugggaaaauguagacugg

SEQ ID NO: 557383 - RNA, 21 nt, Human
ugggacuacaggugugcacca

SEQ ID NO: 557384 - RNA, 24 nt, Human
ugggacuacaggugugcaccacca

SEQ ID NO: 557385 - RNA, 21 nt, Human
ugggauuacaggcacgcauca

SEQ ID NO: 557386 - RNA, 24 nt, Human
ugggauuacaggcacgcaucacca

SEQ ID NO: 557387 - RNA, 18 nt, Human
ugggauuacaggcaugag

SEQ ID NO: 557388 - RNA, 18 nt, Human
ugggauuacaggcaugag

SEQ ID NO: 557389 - RNA, 19 nt, Human
ugggauuacaggcaugagc

SEQ ID NO: 557390 - RNA, 22 nt, Human
ugggauuacaggcaugagccac

SEQ ID NO: 557391 - RNA, 22 nt, Human
ugggauuacaggcaugagccac

SEQ ID NO: 557392 - RNA, 23 nt, Human
ugggauuacaggcaugagccacc

SEQ ID NO: 557393 - RNA, 23 nt, Human
ugggauuacaggcaugagccacc

SEQ ID NO: 557394 - RNA, 24 nt, Human
ugggauuacaggcaugagccacca

SEQ ID NO: 557395 - RNA, 24 nt, Human
ugggauuacaggcaugagccacca

SEQ ID NO: 557396 - RNA, 24 nt, Human
ugggauuacaggcaugagccacca

SEQ ID NO: 557397 - RNA, 25 nt, Human
ugggauuacaggcaugagccaccau

SEQ ID NO: 557398 - RNA, 22 nt, Human
uggguacuuagaaaccuaaggg

SEQ ID NO: 557399 - RNA, 23 nt, Human
uggucaggcuggucucgaacucc

SEQ ID NO: 557400 - RNA, 24 nt, Human
uguauaaaaauaaaauguucuuua

SEQ ID NO: 557401 - RNA, 22 nt, Human
uguccaggcuggaggugaucuc

SEQ ID NO: 557402 - RNA, 23 nt, Human
ugucgugguauauucccaguugc

SEQ ID NO: 557403 - RNA, 24 nt, Human
ugucucagccucccgaguagcugg

SEQ ID NO: 557404 - RNA, 23 nt, Human
uuaccgcaaccuccgccuccggg

SEQ ID NO: 557405 - RNA, 24 nt, Human
uuaccgcaaccuccgccuccgggu

SEQ ID NO: 557406 - RNA, 24 nt, Human
uuaguagagacaagguuucaccau

SEQ ID NO: 557407 - RNA, 18 nt, Human
uuaguagagauaggguuu

SEQ ID NO: 557408 - RNA, 24 nt, Human
uuaguagagauaggguuucuccgu

SEQ ID NO: 557409 - RNA, 23 nt, Human
uucaagugauucugccgccucag

SEQ ID NO: 557410 - RNA, 24 nt, Human
uugcucugucacccaggcuggagu

SEQ ID NO: 557411 - RNA, 18 nt, Human
uuggagaaaauagaggga

SEQ ID NO: 557412 - RNA, 24 nt, Human
uuucaccauguuggccaggcuggu

SEQ ID NO: 557413 - RNA, 22 nt, Human
uuuuguauuuuuaguagagaca

SEQ ID NO: 557414 - RNA, 24 nt, Human
uuuuuaguagagacaagguuucac

SEQ ID NO: 557415 - RNA, 19 nt, Human
uuuuuaguagagauagggu

SEQ ID NO: 557416 - RNA, 20 nt, Human
uuuuuguauuuuuaguagag

SEQ ID NO: 557417 - RNA, 24 nt, Human
acaguggaucaauuuuuauugagc

SEQ ID NO: 557418 - RNA, 24 nt, Human
aggcagcuaugccuuuaaagucca

SEQ ID NO: 557419 - RNA, 22 nt, Human
cccacauuuaaggcagcuaugc

SEQ ID NO: 557420 - RNA, 22 nt, Human
ccccgcugccuccgcuuuacug

SEQ ID NO: 557421 - RNA, 18 nt, Human
ccccuagggcggggcggg

SEQ ID NO: 557422 - RNA, 22 nt, Human
ccgccgcaguucggcaucgccc

SEQ ID NO: 557423 - RNA, 21 nt, Human
ccuuagagcugaagcacugcu

SEQ ID NO: 557424 - RNA, 20 nt, Human
cgauucugaauuagacaccu

SEQ ID NO: 557425 - RNA, 22 nt, Human
cggaggucgaggggcgggccuc

SEQ ID NO: 557426 - RNA, 18 nt, Human
cuagagaucuucgauucu

SEQ ID NO: 557427 - RNA, 21 nt, Human
cuccuugaauuuuccaguuga

SEQ ID NO: 557428 - RNA, 18 nt, Human
gccccgcccccuagggcg

SEQ ID NO: 557429 - RNA, 20 nt, Human
gcuaauauccuuagagcuga

SEQ ID NO: 557430 - RNA, 24 nt, Human
guaacaaguucuaacuaguugugu

SEQ ID NO: 557431 - RNA, 19 nt, Human
uaucaaccauuacccacau

SEQ ID NO: 557432 - RNA, 18 nt, Human
ucaaccauuacccacauu

SEQ ID NO: 557433 - RNA, 18 nt, Human
ucauuguugcuaauaucc

SEQ ID NO: 557434 - RNA, 22 nt, Human
ucccccgcugccuccgcuuuac

SEQ ID NO: 557435 - RNA, 18 nt, Human
ucucaaaagcugggacca

SEQ ID NO: 557436 - RNA, 27 nt, Human
ucuucgauucugaauuagacaccuuac

SEQ ID NO: 557437 - RNA, 21 nt, Human
ugaguagaagaccgcuagaga

SEQ ID NO: 557438 - RNA, 21 nt, Human
uguaaauuucuucaaggccaa

SEQ ID NO: 557439 - RNA, 19 nt, Human
uguguaaauuucuucaagg

SEQ ID NO: 557440 - RNA, 23 nt, Human
uuaaaguccagucuauaaccuau

SEQ ID NO: 557441 - RNA, 20 nt, Human
uuacugagccagcccgccgc

SEQ ID NO: 557442 - RNA, 23 nt, Human
uucuucaaggccaaguuuuauca

SEQ ID NO: 557443 - RNA, 22 nt, Human
uugcuaauauccuuagagcuga

SEQ ID NO: 557444 - RNA, 19 nt, Human
uuuacacagcuguaggaaa

SEQ ID NO: 557445 - RNA, 22 nt, Human
uuuaucucucaaaagcugggac

SEQ ID NO: 557446 - RNA, 19 nt, Human
uuuuacacagcuguaggaa

SEQ ID NO: 557447 - RNA, 23 nt, Human
uuuuuuuuuuuuuugacagugga

SEQ ID NO: 557448 - RNA, 18 nt, Human
uuuuuuuuuuuuuuuuug

SEQ ID NO: 557449 - RNA, 22 nt, Human
uuuuuuuuuuuuuuuuugacag

SEQ ID NO: 557450 - RNA, 25 nt, Human
aaacggcugcccaggagucucccuc

SEQ ID NO: 557451 - RNA, 21 nt, Human
aaacugacaggggaaauacca

SEQ ID NO: 557452 - RNA, 20 nt, Human
aagaggcugaggggauuuug

SEQ ID NO: 557453 - RNA, 24 nt, Human
aaggucuaauucacucaaaauucu

SEQ ID NO: 557454 - RNA, 18 nt, Human
acaggggaaauaccagaa

SEQ ID NO: 557455 - RNA, 19 nt, Human
accucaaucccccagccua

SEQ ID NO: 557456 - RNA, 22 nt, Human
agcuggugccggcgcgagcgca

SEQ ID NO: 557457 - RNA, 24 nt, Human
aggaagggaacagagagaagaaau

SEQ ID NO: 557458 - RNA, 23 nt, Human
agggaacaggggguggucaccau

SEQ ID NO: 557459 - RNA, 18 nt, Human
agggcugguggagagggg

SEQ ID NO: 557460 - RNA, 23 nt, Human
auaccagaacagggaacaggggg

SEQ ID NO: 557461 - RNA, 22 nt, Human
caacgugcagagaagaggcuga

SEQ ID NO: 557462 - RNA, 18 nt, Human
caccuuucccccuucccc

SEQ ID NO: 557463 - RNA, 19 nt, Human
cagugguuuuucccauguc

SEQ ID NO: 557464 - RNA, 20 nt, Human
caugacaccagaagacauca

SEQ ID NO: 557465 - RNA, 18 nt, Human
ccaugucccuagcaccca

SEQ ID NO: 557466 - RNA, 19 nt, Human
ccccaccucaaucccccag

SEQ ID NO: 557467 - RNA, 21 nt, Human
ccccuaaagccaccauccacc

SEQ ID NO: 557468 - RNA, 24 nt, Human
cggaccgcgaggaggcuugagcaa

SEQ ID NO: 557469 - RNA, 26 nt, Human
cuaauucacucaaaauucuucaguuu

SEQ ID NO: 557470 - RNA, 24 nt, Human
gaacagagagaagaaauggcauag

SEQ ID NO: 557471 - RNA, 21 nt, Human
gaagggaacagagagaagaaa

SEQ ID NO: 557472 - RNA, 19 nt, Human
gaggaaaacggcugcccag

SEQ ID NO: 557473 - RNA, 21 nt, Human
gaggcaagccuggaccuucag

SEQ ID NO: 557474 - RNA, 22 nt, Human
gaggcaagccuggaccuucagc

SEQ ID NO: 557475 - RNA, 20 nt, Human
gcagagaagaggcugagggg

SEQ ID NO: 557476 - RNA, 20 nt, Human
gcggcgcgccguuuauccgg

SEQ ID NO: 557477 - RNA, 22 nt, Human
ggagcuggugccggcgcgagcg

SEQ ID NO: 557478 - RNA, 19 nt, Human
ggaguggggagacuggggg

SEQ ID NO: 557479 - RNA, 20 nt, Human
ggaguggggagacugggggg

SEQ ID NO: 557480 - RNA, 24 nt, Human
gggaacagagagaagaaauggcau

SEQ ID NO: 557481 - RNA, 25 nt, Human
gggaacaggggguggucaccaugac

SEQ ID NO: 557482 - RNA, 20 nt, Human
gggcgcuaccugcggggcgu

SEQ ID NO: 557483 - RNA, 22 nt, Human
ggugaggaagggaacagagaga

SEQ ID NO: 557484 - RNA, 21 nt, Human
gugcagagaagaggcugaggg

SEQ ID NO: 557485 - RNA, 21 nt, Human
uaaaaugauuccccaccucaa

SEQ ID NO: 557486 - RNA, 19 nt, Human
uaccagaacagggaacagg

SEQ ID NO: 557487 - RNA, 19 nt, Human
ucaaucccccagccuacac

SEQ ID NO: 557488 - RNA, 25 nt, Human
uccacuuuauugcucaagcauggaa

SEQ ID NO: 557489 - RNA, 19 nt, Human
uccccaccucaauccccca

SEQ ID NO: 557490 - RNA, 20 nt, Human
ucccccagccuacaccuuuc

SEQ ID NO: 557491 - RNA, 20 nt, Human
ucccccuuccccuaaagcca

SEQ ID NO: 557492 - RNA, 24 nt, Human
ucuacccuuagaaaauggaccuaa

SEQ ID NO: 557493 - RNA, 19 nt, Human
ucucccucuccacccuggg

SEQ ID NO: 557494 - RNA, 21 nt, Human
ugaggaaaacggcugcccagg

SEQ ID NO: 557495 - RNA, 20 nt, Human
ugauuccccaccucaauccc

SEQ ID NO: 557496 - RNA, 18 nt, Human
ugcagagaagaggcugag

SEQ ID NO: 557497 - RNA, 23 nt, Human
ugcccaggagucucccucuccac

SEQ ID NO: 557498 - RNA, 19 nt, Human
uggaaauggacugggagag

SEQ ID NO: 557499 - RNA, 22 nt, Human
uggaacuugaggcaagccugga

SEQ ID NO: 557500 - RNA, 24 nt, Human
uggaacuugaggcaagccuggacc

SEQ ID NO: 557501 - RNA, 20 nt, Human
uggacugggagagggaaagg

SEQ ID NO: 557502 - RNA, 21 nt, Human
uggaggaagggaagaggggcu

SEQ ID NO: 557503 - RNA, 21 nt, Human
uggaggaagggaagaggggcu

SEQ ID NO: 557504 - RNA, 22 nt, Human
uggaggaagggaagaggggcug

SEQ ID NO: 557505 - RNA, 23 nt, Human
uggaguggggagacuggggggca

SEQ ID NO: 557506 - RNA, 21 nt, Human
uggauggacauauguucaugu

SEQ ID NO: 557507 - RNA, 21 nt, Human
uggcauagcagugguuuuucc

SEQ ID NO: 557508 - RNA, 23 nt, Human
ugucugacacccagguuuuauug

SEQ ID NO: 557509 - RNA, 23 nt, Human
uucaugugcaauggaggaaggga

SEQ ID NO: 557510 - RNA, 19 nt, Human
uuuacaaaacuaacagggu

SEQ ID NO: 557511 - RNA, 22 nt, Human
uuuucccaugucccuagcaccc

SEQ ID NO: 557512 - RNA, 19 nt, Human
uuuuuugucugacacccag

SEQ ID NO: 557513 - RNA, 19 nt, Human
uuuuuuuuuuuuuuugucu

SEQ ID NO: 557514 - RNA, 18 nt, Human
uuuuuuuuuuuuuuuuug

SEQ ID NO: 557515 - RNA, 19 nt, Human
uuuuuuuuuuuuuuuuugu

SEQ ID NO: 557516 - RNA, 23 nt, Human
aaaaaagacaaaagcauaaauga

SEQ ID NO: 557517 - RNA, 24 nt, Human
aaaaacaaaagcuuauccuccuuc

SEQ ID NO: 557518 - RNA, 21 nt, Human
aaaaagacaaaagcauaaagg

SEQ ID NO: 557519 - RNA, 19 nt, Human
aaaaaggugagauguucca

SEQ ID NO: 557520 - RNA, 23 nt, Human
aaaacaaaagcuuauccuccuuc

SEQ ID NO: 557521 - RNA, 23 nt, Human
aaaccugcaggugaaaccccuag

SEQ ID NO: 557522 - RNA, 23 nt, Human
aaagaacacacaaaaaagugcau

SEQ ID NO: 557523 - RNA, 24 nt, Human
aaagcgagcaacugcgugucaaac

SEQ ID NO: 557524 - RNA, 18 nt, Human
aaagcuaauccagaaacu

SEQ ID NO: 557525 - RNA, 22 nt, Human
aagaaauauuucauaaaaaaga

SEQ ID NO: 557526 - RNA, 21 nt, Human
aagaacacacaaaaaagugca

SEQ ID NO: 557527 - RNA, 20 nt, Human
aaggaggcuggcugaggagg

SEQ ID NO: 557528 - RNA, 19 nt, Human
aaguacuggagauuuaggc

SEQ ID NO: 557529 - RNA, 22 nt, Human
aaguggccucugagguucuggc

SEQ ID NO: 557530 - RNA, 18 nt, Human
aagugucuucuugagugg

SEQ ID NO: 557531 - RNA, 22 nt, Human
aauaaaguuccauaaaccagua

SEQ ID NO: 557532 - RNA, 18 nt, Human
aaugaaagaagaagcuga

SEQ ID NO: 557533 - RNA, 18 nt, Human
acaaaaaaagcugcaugg

SEQ ID NO: 557534 - RNA, 20 nt, Human
acacccuuccccuccccaca

SEQ ID NO: 557535 - RNA, 20 nt, Human
acagagcuuucccaacagga

SEQ ID NO: 557536 - RNA, 22 nt, Human
acccuuccccuccccacacaca

SEQ ID NO: 557537 - RNA, 18 nt, Human
acuguguauugaauauua

SEQ ID NO: 557538 - RNA, 19 nt, Human
agcuaauccagaaacucuc

SEQ ID NO: 557539 - RNA, 19 nt, Human
agcuacugguuuugccauu

SEQ ID NO: 557540 - RNA, 25 nt, Human
aggaaaggagaaauucaugaagcau

SEQ ID NO: 557541 - RNA, 21 nt, Human
aggaauagaggaggggagaaa

SEQ ID NO: 557542 - RNA, 23 nt, Human
aggaggcuaagucagcaagcaag

SEQ ID NO: 557543 - RNA, 22 nt, Human
aggaggcuggcugaggaggggg

SEQ ID NO: 557544 - RNA, 20 nt, Human
agguuuaagcaaaugguucc

SEQ ID NO: 557545 - RNA, 18 nt, Human
aguacuaaaaagucaaaa

SEQ ID NO: 557546 - RNA, 23 nt, Human
aguuuagcaaguaagcaaaauca

SEQ ID NO: 557547 - RNA, 24 nt, Human
augcagccuaaaaggugguugaaa

SEQ ID NO: 557548 - RNA, 24 nt, Human
caaaugguuccuuggguugccaac

SEQ ID NO: 557549 - RNA, 23 nt, Human
caacagacuacauuuauagcacu

SEQ ID NO: 557550 - RNA, 21 nt, Human
caccacagucauuucuguuug

SEQ ID NO: 557551 - RNA, 23 nt, Human
cacccuuccccuccccacacaca

SEQ ID NO: 557552 - RNA, 21 nt, Human
cacucccuccacaccacaguc

SEQ ID NO: 557553 - RNA, 25 nt, Human
cagaacagagaagcuugacagggca

SEQ ID NO: 557554 - RNA, 18 nt, Human
cagcagcaggggggcugu

SEQ ID NO: 557555 - RNA, 21 nt, Human
cagcagcaggggggcuguuuu

SEQ ID NO: 557556 - RNA, 26 nt, Human
cagcaggccgcccgcgcgccggacac

SEQ ID NO: 557557 - RNA, 21 nt, Human
cauaaaaaagacaaaagcaua

SEQ ID NO: 557558 - RNA, 19 nt, Human
ccauugaggaggggccgag

SEQ ID NO: 557559 - RNA, 21 nt, Human
ccccuaguguagaagagcaac

SEQ ID NO: 557560 - RNA, 23 nt, Human
cccgugccaccccucagugaacc

SEQ ID NO: 557561 - RNA, 24 nt, Human
cccuacccuacccaacuguaggaa

SEQ ID NO: 557562 - RNA, 23 nt, Human
ccgcgcgccggacaccgccgccc

SEQ ID NO: 557563 - RNA, 19 nt, Human
ccugaguugggggaaagcc

SEQ ID NO: 557564 - RNA, 22 nt, Human
ccuucagcccgcccagcaggcc

SEQ ID NO: 557565 - RNA, 18 nt, Human
cgcgccggacaccgccgc

SEQ ID NO: 557566 - RNA, 21 nt, Human
cgggggcucgccgacuccguc

SEQ ID NO: 557567 - RNA, 20 nt, Human
cgucugugacacugcugugg

SEQ ID NO: 557568 - RNA, 19 nt, Human
cugaggagggggacuuugg

SEQ ID NO: 557569 - RNA, 21 nt, Human
cuggcugaggagggggacuuu

SEQ ID NO: 557570 - RNA, 19 nt, Human
cugggaggaaguacugugu

SEQ ID NO: 557571 - RNA, 19 nt, Human
cuuccccuacccuacccaa

SEQ ID NO: 557572 - RNA, 22 nt, Human
cuugagugguaaugggcacccu

SEQ ID NO: 557573 - RNA, 23 nt, Human
gagacagcuggcaucaucugagu

SEQ ID NO: 557574 - RNA, 18 nt, Human
gagcaguagcaaugcugg

SEQ ID NO: 557575 - RNA, 23 nt, Human
gagguucuggcuuucacgucugu

SEQ ID NO: 557576 - RNA, 22 nt, Human
gcaugggaagcugucuucaacu

SEQ ID NO: 557577 - RNA, 21 nt, Human
gcugcuggcucacucccucca

SEQ ID NO: 557578 - RNA, 18 nt, Human
gcuggcucacucccucca

SEQ ID NO: 557579 - RNA, 23 nt, Human
gcuguuuuugggaagcuacuggu

SEQ ID NO: 557580 - RNA, 18 nt, Human
ggaaaagcuaauccagaa

SEQ ID NO: 557581 - RNA, 18 nt, Human
ggagggggacuuugggag

SEQ ID NO: 557582 - RNA, 18 nt, Human
ggccucugagguucuggc

SEQ ID NO: 557583 - RNA, 20 nt, Human
gggcagcagcaggggggcug

SEQ ID NO: 557584 - RNA, 19 nt, Human
guaagcacaagucuuaaau

SEQ ID NO: 557585 - RNA, 19 nt, Human
gugccaccccucagugaac

SEQ ID NO: 557586 - RNA, 23 nt, Human
uaaaaccuaacagccccacauug

SEQ ID NO: 557587 - RNA, 21 nt, Human
uaaaaggaauagaggagggga

SEQ ID NO: 557588 - RNA, 25 nt, Human
uaaauagauccacuccaggucaaaa

SEQ ID NO: 557589 - RNA, 20 nt, Human
uaacccuucagcccgcccag

SEQ ID NO: 557590 - RNA, 19 nt, Human
uaaguagagaaccugucgc

SEQ ID NO: 557591 - RNA, 22 nt, Human
uacccguaaggacugaaauuca

SEQ ID NO: 557592 - RNA, 22 nt, Human
uagaaagccacucucacaagga

SEQ ID NO: 557593 - RNA, 24 nt, Human
uagaaugaaagaagaagcugagca

SEQ ID NO: 557594 - RNA, 21 nt, Human
uaggaaaagcuaauccagaaa

SEQ ID NO: 557595 - RNA, 25 nt, Human
uaggaugaucuccagggacccugaa

SEQ ID NO: 557596 - RNA, 18 nt, Human
ucaaagguaaaaccuaac

SEQ ID NO: 557597 - RNA, 21 nt, Human
ucacaaauugaucccauuugu

SEQ ID NO: 557598 - RNA, 20 nt, Human
ucauaaaaaagacaaaagca

SEQ ID NO: 557599 - RNA, 24 nt, Human
ucccuaaaaggaauagaggagggg

SEQ ID NO: 557600 - RNA, 21 nt, Human
uccugaguugggggaaagccc

SEQ ID NO: 557601 - RNA, 18 nt, Human
ucgccgcgggggcucgcc

SEQ ID NO: 557602 - RNA, 20 nt, Human
ucuuggaauagcuuucuugu

SEQ ID NO: 557603 - RNA, 18 nt, Human
ugaaagaagaagcugagc

SEQ ID NO: 557604 - RNA, 21 nt, Human
ugagaccccucuacugugggu

SEQ ID NO: 557605 - RNA, 21 nt, Human
ugagcuggacuuaagcugcug

SEQ ID NO: 557606 - RNA, 24 nt, Human
ugccaguucccccuggugaaccau

SEQ ID NO: 557607 - RNA, 26 nt, Human
ugcuccgcuaacccuucagcccgccc

SEQ ID NO: 557608 - RNA, 23 nt, Human
uggcagcgcccgcgagccggccc

SEQ ID NO: 557609 - RNA, 25 nt, Human
uggcugaggagggggacuuugggag

SEQ ID NO: 557610 - RNA, 18 nt, Human
uggucccgugccaccccu

SEQ ID NO: 557611 - RNA, 19 nt, Human
ugguuuugccauuugcuuc

SEQ ID NO: 557612 - RNA, 22 nt, Human
uguaaauaaaguuccauaaacc

SEQ ID NO: 557613 - RNA, 18 nt, Human
uguaaauagauccacucc

SEQ ID NO: 557614 - RNA, 18 nt, Human
uguuuuaggaaugacaga

SEQ ID NO: 557615 - RNA, 20 nt, Human
uuauaaaaggaaauaacuug

SEQ ID NO: 557616 - RNA, 21 nt, Human
uucaaagguaaaaccuaacag

SEQ ID NO: 557617 - RNA, 20 nt, Human
uucaacucuuucacaacuca

SEQ ID NO: 557618 - RNA, 22 nt, Human
uucacugggacucuucccuccu

SEQ ID NO: 557619 - RNA, 18 nt, Human
uucaguaucucagaacuu

SEQ ID NO: 557620 - RNA, 20 nt, Human
uugacagggcaggaaaagcg

SEQ ID NO: 557621 - RNA, 18 nt, Human
uugcugaaggguguuuua

SEQ ID NO: 557622 - RNA, 23 nt, Human
uuuaagcaaaugguuccuugggu

SEQ ID NO: 557623 - RNA, 19 nt, Human
uuucuuguuuguuaucugc

SEQ ID NO: 557624 - RNA, 19 nt, Human
uuuuuaguaucaaauuuca

SEQ ID NO: 557625 - RNA, 20 nt, Human
aaaaaaaguagaaauacaaa

SEQ ID NO: 557626 - RNA, 18 nt, Human
agcagaacacugcucucc

SEQ ID NO: 557627 - RNA, 19 nt, Human
aguaaauagcuaaaaaaaa

SEQ ID NO: 557628 - RNA, 18 nt, Human
caaaacagccucacauuu

SEQ ID NO: 557629 - RNA, 18 nt, Human
cacugcucucccucccgc

SEQ ID NO: 557630 - RNA, 19 nt, Human
cagaacacugcucucccuc

SEQ ID NO: 557631 - RNA, 22 nt, Human
cagcagaacacugcucucccuc

SEQ ID NO: 557632 - RNA, 24 nt, Human
cauaaaguacaguaaauagcuaaa

SEQ ID NO: 557633 - RNA, 21 nt, Human
cccguggaugucccgcggccg

SEQ ID NO: 557634 - RNA, 21 nt, Human
cucccgcgugucacucgcgcc

SEQ ID NO: 557635 - RNA, 21 nt, Human
cucgcgccccguggauguccc

SEQ ID NO: 557636 - RNA, 21 nt, Human
gcagaacacugcucucccucc

SEQ ID NO: 557637 - RNA, 19 nt, Human
uacaacuuggagaaaagug

SEQ ID NO: 557638 - RNA, 24 nt, Human
uacaguaaauagcuaaaaaaaaaa

SEQ ID NO: 557639 - RNA, 22 nt, Human
uagcuaaaaaaaaaaaguagaa

SEQ ID NO: 557640 - RNA, 24 nt, Human
ucacucgcgccccguggauguccc

SEQ ID NO: 557641 - RNA, 18 nt, Human
agaaacugaggccagccc

SEQ ID NO: 557642 - RNA, 23 nt, Human
agaggggguggcagccaccuagg

SEQ ID NO: 557643 - RNA, 23 nt, Human
aggccagcccuggcggagaccua

SEQ ID NO: 557644 - RNA, 21 nt, Human
aggcggggacuaggcagggga

SEQ ID NO: 557645 - RNA, 18 nt, Human
agggcaguggacagggag

SEQ ID NO: 557646 - RNA, 23 nt, Human
agggcccccucccucugggcuuu

SEQ ID NO: 557647 - RNA, 21 nt, Human
agggggcggcaggcggggugg

SEQ ID NO: 557648 - RNA, 26 nt, Human
agggugggggaaaacugggucugaag

SEQ ID NO: 557649 - RNA, 22 nt, Human
cccucugggcuuuccuccuaga

SEQ ID NO: 557650 - RNA, 18 nt, Human
ccuccucuuccuccuccu

SEQ ID NO: 557651 - RNA, 20 nt, Human
ccuccucuuccuccuccucu

SEQ ID NO: 557652 - RNA, 21 nt, Human
cgacccccaauccuugcuccc

SEQ ID NO: 557653 - RNA, 19 nt, Human
cggaggagggggccagacc

SEQ ID NO: 557654 - RNA, 22 nt, Human
cuaacccggaggagggggccag

SEQ ID NO: 557655 - RNA, 22 nt, Human
cuagagggccucagucccuccu

SEQ ID NO: 557656 - RNA, 21 nt, Human
cuccuccucuuccuccucacc

SEQ ID NO: 557657 - RNA, 22 nt, Human
cuguggcggggagggaaccugg

SEQ ID NO: 557658 - RNA, 19 nt, Human
gaaccuggacagggggcgg

SEQ ID NO: 557659 - RNA, 18 nt, Human
gacagggagccuggggga

SEQ ID NO: 557660 - RNA, 21 nt, Human
gacagggggcggcaggcgggg

SEQ ID NO: 557661 - RNA, 21 nt, Human
gaccagggagggcaguggaca

SEQ ID NO: 557662 - RNA, 18 nt, Human
gacccccaauccuugcuc

SEQ ID NO: 557663 - RNA, 20 nt, Human
gacccccaauccuugcuccc

SEQ ID NO: 557664 - RNA, 18 nt, Human
gaggccagcccuggcgga

SEQ ID NO: 557665 - RNA, 21 nt, Human
gcggcaggcgggguggggggc

SEQ ID NO: 557666 - RNA, 22 nt, Human
ggagccugggggaguuggggag

SEQ ID NO: 557667 - RNA, 19 nt, Human
ggaggagggggccagacca

SEQ ID NO: 557668 - RNA, 19 nt, Human
ggagggugggggaaaacug

SEQ ID NO: 557669 - RNA, 19 nt, Human
gggcaggguccauggugug

SEQ ID NO: 557670 - RNA, 23 nt, Human
gggcggcaggcgggguggggggc

SEQ ID NO: 557671 - RNA, 18 nt, Human
ggggagcgcagggcaggg

SEQ ID NO: 557672 - RNA, 20 nt, Human
gggguaaggaggguggggga

SEQ ID NO: 557673 - RNA, 24 nt, Human
ggugggggaaaacugggucugaag

SEQ ID NO: 557674 - RNA, 24 nt, Human
guaaggagggugggggaaaacugg

SEQ ID NO: 557675 - RNA, 28 nt, Human
guccauggugugcagaggggguggcagg

SEQ ID NO: 557676 - RNA, 22 nt, Human
uaaggagggugggggaaaacug

SEQ ID NO: 557677 - RNA, 18 nt, Human
ucagucccuccugcuggc

SEQ ID NO: 557678 - RNA, 27 nt, Human
uccauggugugcagaggggguggcagg

SEQ ID NO: 557679 - RNA, 20 nt, Human
uccuccucuuccuccucacc

SEQ ID NO: 557680 - RNA, 18 nt, Human
uccugcuggcugggcugc

SEQ ID NO: 557681 - RNA, 20 nt, Human
ucuuccuccuccucuucccc

SEQ ID NO: 557682 - RNA, 18 nt, Human
ucuuccuccucuuccucc

SEQ ID NO: 557683 - RNA, 25 nt, Human
ugaggagaaacugaggccagcccug

SEQ ID NO: 557684 - RNA, 21 nt, Human
uggggggcuggcacucaggcg

SEQ ID NO: 557685 - RNA, 22 nt, Human
uuccuccuccucuuccuccuca

SEQ ID NO: 557686 - RNA, 22 nt, Human
uuccuccucuuccuccuccucc

SEQ ID NO: 557687 - RNA, 22 nt, Human
uuucacuguggcggggagggaa

SEQ ID NO: 557688 - RNA, 19 nt, Human
uuuuuuuuuuuugcagggu

SEQ ID NO: 557689 - RNA, 22 nt, Human
uuuuuuuuuuuuuugcagggug

SEQ ID NO: 557690 - RNA, 19 nt, Human
uuuuuuuuuuuuuuuuugc

SEQ ID NO: 557691 - RNA, 21 nt, Human
uuuuuuuuuuuuuuuuugcag

SEQ ID NO: 557692 - RNA, 27 nt, Human
uuuuuuuuuuuuuuuuuuuuugcaggg

SEQ ID NO: 557693 - RNA, 21 nt, Human
aaaaaaaaaagaaaggaaaag

SEQ ID NO: 557694 - RNA, 20 nt, Human
aaaaggcucuuuuaaccucc

SEQ ID NO: 557695 - RNA, 20 nt, Human
aacacggugaaaccccgucu

SEQ ID NO: 557696 - RNA, 21 nt, Human
aacacggugaaaccccgucuc

SEQ ID NO: 557697 - RNA, 22 nt, Human
aacacguugaaaguggagucuc

SEQ ID NO: 557698 - RNA, 24 nt, Human
aacacuuugggaggccgagguggg

SEQ ID NO: 557699 - RNA, 21 nt, Human
aaccccgucucuaccaaaaau

SEQ ID NO: 557700 - RNA, 21 nt, Human
aacuaaguggcuaggcauggu

SEQ ID NO: 557701 - RNA, 20 nt, Human
aaggaaaagcuaagcagaug

SEQ ID NO: 557702 - RNA, 19 nt, Human
aaggcccucugcacagauu

SEQ ID NO: 557703 - RNA, 19 nt, Human
accagguacuaugugaccc

SEQ ID NO: 557704 - RNA, 26 nt, Human
accagguacuaugugaccccccaugg

SEQ ID NO: 557705 - RNA, 24 nt, Human
accccgucucuaccaaaaauacaa

SEQ ID NO: 557706 - RNA, 24 nt, Human
accucacaaaaucagacaccugga

SEQ ID NO: 557707 - RNA, 19 nt, Human
acugcacuccagccuggcg

SEQ ID NO: 557708 - RNA, 23 nt, Human
acugcacuccagccuggcgacaa

SEQ ID NO: 557709 - RNA, 20 nt, Human
acuuccaucucggccaaggg

SEQ ID NO: 557710 - RNA, 24 nt, Human
agacaggagaaucgcuugaauacg

SEQ ID NO: 557711 - RNA, 20 nt, Human
agacagugcugcagugagcc

SEQ ID NO: 557712 - RNA, 20 nt, Human
agacagugcugcagugagcc

SEQ ID NO: 557713 - RNA, 20 nt, Human
agaguuccguccaggaacgu

SEQ ID NO: 557714 - RNA, 20 nt, Human
agccuggcgacaaacggaga

SEQ ID NO: 557715 - RNA, 20 nt, Human
agccuggcgacaaacggaga

SEQ ID NO: 557716 - RNA, 24 nt, Human
aggcauggugauucaugccuguaa

SEQ ID NO: 557717 - RNA, 21 nt, Human
aggccgaggugggcggaucac

SEQ ID NO: 557718 - RNA, 21 nt, Human
aggcggaggcugcagugagcc

SEQ ID NO: 557719 - RNA, 24 nt, Human
aggcggaggcugcagugagccgag

SEQ ID NO: 557720 - RNA, 24 nt, Human
aggcugagacaggagaaucgcuug

SEQ ID NO: 557721 - RNA, 18 nt, Human
agugcugcagugagccga

SEQ ID NO: 557722 - RNA, 23 nt, Human
auaaaguaguuucaaagggaaau

SEQ ID NO: 557723 - RNA, 21 nt, Human
auccuggccaacacggugaaa

SEQ ID NO: 557724 - RNA, 19 nt, Human
augccuguaaucccaacac

SEQ ID NO: 557725 - RNA, 24 nt, Human
auggcaccacugcacuccagccug

SEQ ID NO: 557726 - RNA, 24 nt, Human
caacacggugaaaccccgucucua

SEQ ID NO: 557727 - RNA, 24 nt, Human
caacacuuugggaggccgaggugg

SEQ ID NO: 557728 - RNA, 18 nt, Human
caacuucugaaagacccu

SEQ ID NO: 557729 - RNA, 22 nt, Human
caauacuggacacaucccaugc

SEQ ID NO: 557730 - RNA, 19 nt, Human
cacaccuguaguccuagcu

SEQ ID NO: 557731 - RNA, 20 nt, Human
cacaucccaacaagagccug

SEQ ID NO: 557732 - RNA, 21 nt, Human
caccagaaacuccuucacuuc

SEQ ID NO: 557733 - RNA, 22 nt, Human
caccagguacuaugugacccac

SEQ ID NO: 557734 - RNA, 19 nt, Human
caccccauauaucaaccca

SEQ ID NO: 557735 - RNA, 23 nt, Human
caccccauauaucaacccacccc

SEQ ID NO: 557736 - RNA, 24 nt, Human
caccuguaguccuagcuacucagg

SEQ ID NO: 557737 - RNA, 22 nt, Human
caccuuguugaugcucagcagc

SEQ ID NO: 557738 - RNA, 18 nt, Human
cacugcacuccagccugg

SEQ ID NO: 557739 - RNA, 18 nt, Human
cacugcacuccagccugg

SEQ ID NO: 557740 - RNA, 22 nt, Human
cacugcacuccagccuggcgac

SEQ ID NO: 557741 - RNA, 23 nt, Human
cacugcacuccagccuggcgaca

SEQ ID NO: 557742 - RNA, 24 nt, Human
cacugcacuccagccuggcgacaa

SEQ ID NO: 557743 - RNA, 21 nt, Human
cagaauuccaaauauccauca

SEQ ID NO: 557744 - RNA, 21 nt, Human
cagccuggcgacaaacggaga

SEQ ID NO: 557745 - RNA, 20 nt, Human
caugccuguaaucccaacac

SEQ ID NO: 557746 - RNA, 20 nt, Human
ccaaaaaaaaaaaaaaaaaa

SEQ ID NO: 557747 - RNA, 23 nt, Human
ccaaaaaaaaaaaaaaaaaaaaa

SEQ ID NO: 557748 - RNA, 19 nt, Human
ccacugcacuccagccugg

SEQ ID NO: 557749 - RNA, 19 nt, Human
ccacugcacuccagccugg

SEQ ID NO: 557750 - RNA, 22 nt, Human
ccacugcacuccagccuggcga

SEQ ID NO: 557751 - RNA, 23 nt, Human
ccacugcacuccagccuggcgac

SEQ ID NO: 557752 - RNA, 20 nt, Human
ccagcccccagcccuauuua

SEQ ID NO: 557753 - RNA, 23 nt, Human
cccauauaucaacccaccccgau

SEQ ID NO: 557754 - RNA, 20 nt, Human
ccuccaaaaaaaaaaaaaaa

SEQ ID NO: 557755 - RNA, 23 nt, Human
ccuggccaacacggugaaacccc

SEQ ID NO: 557756 - RNA, 24 nt, Human
ccuggccaacacggugaaaccccg

SEQ ID NO: 557757 - RNA, 20 nt, Human
ccuguaaucccaacacuuug

SEQ ID NO: 557758 - RNA, 22 nt, Human
ccuguaaucccaacacuuuggg

SEQ ID NO: 557759 - RNA, 25 nt, Human
cgaggugggcggaucacgaggucga

SEQ ID NO: 557760 - RNA, 18 nt, Human
cuaugggauagaaaggug

SEQ ID NO: 557761 - RNA, 22 nt, Human
cucaccccauauaucaacccac

SEQ ID NO: 557762 - RNA, 18 nt, Human
cucccuggcaccaucugg

SEQ ID NO: 557763 - RNA, 19 nt, Human
cucuauuuguggucugaga

SEQ ID NO: 557764 - RNA, 22 nt, Human
cugcagugagccgagacagugc

SEQ ID NO: 557765 - RNA, 22 nt, Human
cugcagugagccgagauggcac

SEQ ID NO: 557766 - RNA, 18 nt, Human
cuggccaacacggugaaa

SEQ ID NO: 557767 - RNA, 21 nt, Human
cuucaggguaccaccgucucc

SEQ ID NO: 557768 - RNA, 23 nt, Human
cuugcagcagcuggccucugccu

SEQ ID NO: 557769 - RNA, 23 nt, Human
gagaaucgcuugaauacgggagg

SEQ ID NO: 557770 - RNA, 19 nt, Human
gagacagugcugcagugag

SEQ ID NO: 557771 - RNA, 22 nt, Human
gagaugccuuuuccuggcccag

SEQ ID NO: 557772 - RNA, 23 nt, Human
gagauggcaccacugcacuccag

SEQ ID NO: 557773 - RNA, 19 nt, Human
gaugcaacuucugaaagac

SEQ ID NO: 557774 - RNA, 20 nt, Human
gcaugaugugcgugugcgug

SEQ ID NO: 557775 - RNA, 24 nt, Human
gccaacacggugaaaccccgucuc

SEQ ID NO: 557776 - RNA, 22 nt, Human
gcuaggcauggugauucaugcc

SEQ ID NO: 557777 - RNA, 23 nt, Human
gcuuggugucacguacucccugg

SEQ ID NO: 557778 - RNA, 18 nt, Human
ggaggcugcagugagccg

SEQ ID NO: 557779 - RNA, 22 nt, Human
ggaggcugcagugagccgagac

SEQ ID NO: 557780 - RNA, 22 nt, Human
ggcgugguggugcacaccugua

SEQ ID NO: 557781 - RNA, 22 nt, Human
ggcuaggcauggugauucaugc

SEQ ID NO: 557782 - RNA, 24 nt, Human
gggaaugacaaaaaacuaaguggc

SEQ ID NO: 557783 - RNA, 20 nt, Human
gggaggccgaggugggcgga

SEQ ID NO: 557784 - RNA, 25 nt, Human
gggcaagcaagcccuuugacucucc

SEQ ID NO: 557785 - RNA, 22 nt, Human
gggcagcagaaaaaugucaccu

SEQ ID NO: 557786 - RNA, 18 nt, Human
ggggcggggugugaugag

SEQ ID NO: 557787 - RNA, 20 nt, Human
ggggucaucaucagaauuug

SEQ ID NO: 557788 - RNA, 19 nt, Human
ggugauucaugccuguaau

SEQ ID NO: 557789 - RNA, 24 nt, Human
gguggugcacaccuguaguccuag

SEQ ID NO: 557790 - RNA, 19 nt, Human
gugcacagcauuuucauga

SEQ ID NO: 557791 - RNA, 22 nt, Human
uaagcagaugacuuauguggca

SEQ ID NO: 557792 - RNA, 26 nt, Human
uaagcagaugacuuauguuguaauga

SEQ ID NO: 557793 - RNA, 24 nt, Human
uacgcacaucccaacaagagccug

SEQ ID NO: 557794 - RNA, 18 nt, Human
uagcggggcgugguggug

SEQ ID NO: 557795 - RNA, 18 nt, Human
uaggugugaaucugaacc

SEQ ID NO: 557796 - RNA, 18 nt, Human
uaucacuggcgaucagcc

SEQ ID NO: 557797 - RNA, 22 nt, Human
ucacgaggucgagauugagacc

SEQ ID NO: 557798 - RNA, 21 nt, Human
ucacugcacguucugccacac

SEQ ID NO: 557799 - RNA, 20 nt, Human
ucaggauaagugccaccacc

SEQ ID NO: 557800 - RNA, 23 nt, Human
ucaugccuguaaucccaacacuu

SEQ ID NO: 557801 - RNA, 23 nt, Human
uccaaaaaaaaaaaaaaaaaaaa

SEQ ID NO: 557802 - RNA, 20 nt, Human
ucccugugaucagcuguccu

SEQ ID NO: 557803 - RNA, 24 nt, Human
ucgcuugaauacgggaggcggagg

SEQ ID NO: 557804 - RNA, 21 nt, Human
ucuaaaauguuuuaaccagca

SEQ ID NO: 557805 - RNA, 20 nt, Human
ucugaaagacccuugcaccc

SEQ ID NO: 557806 - RNA, 24 nt, Human
ucugccuccaaaaaaaaaaaaaaa

SEQ ID NO: 557807 - RNA, 20 nt, Human
ugagacaggagaaucgcuug

SEQ ID NO: 557808 - RNA, 25 nt, Human
ugagacaggagaaucgcuugaauac

SEQ ID NO: 557809 - RNA, 24 nt, Human
ugagaccauccuggccaacacggu

SEQ ID NO: 557810 - RNA, 19 nt, Human
ugagaugccuuuuccuggc

SEQ ID NO: 557811 - RNA, 21 nt, Human
ugagccgagacagugcugcag

SEQ ID NO: 557812 - RNA, 21 nt, Human
ugauucaugccuguaauccca

SEQ ID NO: 557813 - RNA, 23 nt, Human
ugccuccaaaaaaaaaaaaaaaa

SEQ ID NO: 557814 - RNA, 23 nt, Human
ugccuguaaucccaacacuuugg

SEQ ID NO: 557815 - RNA, 20 nt, Human
uggcaccacugcacuccagc

SEQ ID NO: 557816 - RNA, 21 nt, Human
uggcaccaucugguucgugcc

SEQ ID NO: 557817 - RNA, 19 nt, Human
uggcgaucagccuaaacuu

SEQ ID NO: 557818 - RNA, 19 nt, Human
ugggaagagccauggcugu

SEQ ID NO: 557819 - RNA, 20 nt, Human
ugggaagagccauggcuguc

SEQ ID NO: 557820 - RNA, 19 nt, Human
ugggaggccgaggugggcg

SEQ ID NO: 557821 - RNA, 24 nt, Human
ugggaggccgaggugggcggauca

SEQ ID NO: 557822 - RNA, 19 nt, Human
uggggcggggugugaugag

SEQ ID NO: 557823 - RNA, 24 nt, Human
uggugauucaugccuguaauccca

SEQ ID NO: 557824 - RNA, 18 nt, Human
uggugcacaccuguaguc

SEQ ID NO: 557825 - RNA, 22 nt, Human
ugguggugcacaccuguagucc

SEQ ID NO: 557826 - RNA, 23 nt, Human
uguagugguaccucacaaaauca

SEQ ID NO: 557827 - RNA, 22 nt, Human
uguccaaaaggcucuuuuaacc

SEQ ID NO: 557828 - RNA, 19 nt, Human
ugugaaucugaacccgguc

SEQ ID NO: 557829 - RNA, 22 nt, Human
uguguacaccagguacuaugug

SEQ ID NO: 557830 - RNA, 20 nt, Human
uuagcggggcgugguggugc

SEQ ID NO: 557831 - RNA, 22 nt, Human
uuagcggggcgugguggugcac

SEQ ID NO: 557832 - RNA, 19 nt, Human
uucaggauaagugccacca

SEQ ID NO: 557833 - RNA, 24 nt, Human
uuccaaauauccaucagaaguaca

SEQ ID NO: 557834 - RNA, 21 nt, Human
uucuaugggauagaaaggugg

SEQ ID NO: 557835 - RNA, 22 nt, Human
uugcacccucacugcacguucu

SEQ ID NO: 557836 - RNA, 25 nt, Human
uugggaggccgaggugggcggauca

SEQ ID NO: 557837 - RNA, 21 nt, Human
uuucuuaugguuccuccaaga

SEQ ID NO: 557838 - RNA, 24 nt, Human
uuuucuuaugguuccuccaagaug

SEQ ID NO: 557839 - RNA, 23 nt, Human
agaguaaaucccaagaggcccug

SEQ ID NO: 557840 - RNA, 20 nt, Human
cacccccaaguuuguccgga

SEQ ID NO: 557841 - RNA, 25 nt, Human
cacccccaaguuuguccggaggccc

SEQ ID NO: 557842 - RNA, 26 nt, Human
cagaguaaaucccaagaggcccugcu

SEQ ID NO: 557843 - RNA, 21 nt, Human
cagcuuccagggcuggcgucc

SEQ ID NO: 557844 - RNA, 19 nt, Human
ccaggcucagcccggaggg

SEQ ID NO: 557845 - RNA, 22 nt, Human
ccaggcugcugggaccugcugg

SEQ ID NO: 557846 - RNA, 23 nt, Human
ccccucacccccaaguuuguccg

SEQ ID NO: 557847 - RNA, 21 nt, Human
cccggagggugagggaccugc

SEQ ID NO: 557848 - RNA, 22 nt, Human
ccugcugggucaggcucagcuu

SEQ ID NO: 557849 - RNA, 19 nt, Human
ccuggcugagcaccgcuuc

SEQ ID NO: 557850 - RNA, 25 nt, Human
cugggucaggcucagcuuccagggc

SEQ ID NO: 557851 - RNA, 19 nt, Human
gaguaaaucccaagaggcc

SEQ ID NO: 557852 - RNA, 22 nt, Human
gcccugagagccacagaguaaa

SEQ ID NO: 557853 - RNA, 20 nt, Human
gcccugcuuccccucacccc

SEQ ID NO: 557854 - RNA, 20 nt, Human
uccuuggcucaccagggcug

SEQ ID NO: 557855 - RNA, 21 nt, Human
uccuuggcucaccagggcugg

SEQ ID NO: 557856 - RNA, 19 nt, Human
ucugugugguuguccuugg

SEQ ID NO: 557857 - RNA, 21 nt, Human
ugagagccacagaguaaaucc

SEQ ID NO: 557858 - RNA, 18 nt, Human
ugggaccugcugggucag

SEQ ID NO: 557859 - RNA, 23 nt, Human
ugggucaggcucagcuuccaggg

SEQ ID NO: 557860 - RNA, 18 nt, Human
uguccggaggccccaggg

SEQ ID NO: 557861 - RNA, 19 nt, Human
uuggcccugagagccacag

SEQ ID NO: 557862 - RNA, 24 nt, Human
uuuauuggcccugagagccacaga

SEQ ID NO: 557863 - RNA, 20 nt, Human
aaacuccaggucgccuaggc

SEQ ID NO: 557864 - RNA, 25 nt, Human
aaagaagcaccagcuggaacucaaa

SEQ ID NO: 557865 - RNA, 18 nt, Human
aaauaguccugugguucc

SEQ ID NO: 557866 - RNA, 25 nt, Human
aacaaagaauccaaagaauauugca

SEQ ID NO: 557867 - RNA, 22 nt, Human
aagaagcaccagcuggaacuca

SEQ ID NO: 557868 - RNA, 19 nt, Human
agguaagguacauuaaaug

SEQ ID NO: 557869 - RNA, 25 nt, Human
auccaaauaguccugugguuccaau

SEQ ID NO: 557870 - RNA, 19 nt, Human
augaauacaauuuuguugg

SEQ ID NO: 557871 - RNA, 20 nt, Human
auguaaccuggaagaggguc

SEQ ID NO: 557872 - RNA, 21 nt, Human
cacagcgucacaaacuccagg

SEQ ID NO: 557873 - RNA, 22 nt, Human
cagaaaaugauggcacccagaa

SEQ ID NO: 557874 - RNA, 22 nt, Human
cagaaaaugauggcacccagau

SEQ ID NO: 557875 - RNA, 21 nt, Human
cagaaccagaaaaugauggcu

SEQ ID NO: 557876 - RNA, 21 nt, Human
caucacagcgucacaaacucc

SEQ ID NO: 557877 - RNA, 22 nt, Human
cuccaggucgccuaggcgcugc

SEQ ID NO: 557878 - RNA, 20 nt, Human
cugcgcaggaagcgcuugcc

SEQ ID NO: 557879 - RNA, 23 nt, Human
gaagcaccagcuggaacucaaaa

SEQ ID NO: 557880 - RNA, 23 nt, Human
gagggucaucaacagaaccagaa

SEQ ID NO: 557881 - RNA, 18 nt, Human
gcgcaggaagcgcuugcc

SEQ ID NO: 557882 - RNA, 19 nt, Human
uaaaacacuaaagcacuca

SEQ ID NO: 557883 - RNA, 24 nt, Human
uaaaucaacaaagaauccaaagaa

SEQ ID NO: 557884 - RNA, 26 nt, Human
uaaaugaccuucccauuauaauuucu

SEQ ID NO: 557885 - RNA, 26 nt, Human
uaaccuggaagagggucaucaacagg

SEQ ID NO: 557886 - RNA, 22 nt, Human
uaauagauggcagcacaugcca

SEQ ID NO: 557887 - RNA, 21 nt, Human
uccaaagaauauugcaugagg

SEQ ID NO: 557888 - RNA, 20 nt, Human
uccugugguuccaauauccu

SEQ ID NO: 557889 - RNA, 21 nt, Human
ugaggaugcaagauguaagcu

SEQ ID NO: 557890 - RNA, 22 nt, Human
ugugaaaaaagaaaacauccuu

SEQ ID NO: 557891 - RNA, 22 nt, Human
ugugugaaaaaagaaaacaucc

SEQ ID NO: 557892 - RNA, 23 nt, Human
uuaaaacacuaaagcacucacug

SEQ ID NO: 557893 - RNA, 22 nt, Human
uuuaaacaaaucuagaaauaag

SEQ ID NO: 557894 - RNA, 18 nt, Human
uuuacagaaaauucacag

SEQ ID NO: 557895 - RNA, 27 nt, Human
uuuucagaaauaauuuuucgggucacc

SEQ ID NO: 557896 - RNA, 23 nt, Human
aaagugcugagauucaggcauga

SEQ ID NO: 557897 - RNA, 25 nt, Human
aagugcugagauucaggcaugagcc

SEQ ID NO: 557898 - RNA, 18 nt, Human
acaggguuucaucauguu

SEQ ID NO: 557899 - RNA, 21 nt, Human
acaggguuucaucauguuggc

SEQ ID NO: 557900 - RNA, 24 nt, Human
acaggguuucaucauguuggccag

SEQ ID NO: 557901 - RNA, 19 nt, Human
accuaccauuauuauuacc

SEQ ID NO: 557902 - RNA, 26 nt, Human
accucagaugaucugccugccuuggc

SEQ ID NO: 557903 - RNA, 26 nt, Human
acucugucacccaggcuggagugccg

SEQ ID NO: 557904 - RNA, 27 nt, Human
acucugucacccaggcuggagugccgu

SEQ ID NO: 557905 - RNA, 24 nt, Human
agacaccaaaaaaguugcuuucag

SEQ ID NO: 557906 - RNA, 24 nt, Human
agaugaucugccugccuuggccuc

SEQ ID NO: 557907 - RNA, 21 nt, Human
agauucaggcaugagccaccg

SEQ ID NO: 557908 - RNA, 18 nt, Human
aguaacugggauuacagg

SEQ ID NO: 557909 - RNA, 22 nt, Human
aguagagacaggguuucaucau

SEQ ID NO: 557910 - RNA, 24 nt, Human
agugauucuccugccucagccucc

SEQ ID NO: 557911 - RNA, 21 nt, Human
agugccguggugcaaucucag

SEQ ID NO: 557912 - RNA, 24 nt, Human
aucauguuggccaggcuggucucg

SEQ ID NO: 557913 - RNA, 25 nt, Human
aucauguuggccaggcuggucucga

SEQ ID NO: 557914 - RNA, 24 nt, Human
auuuuuguauuuuuaguagagaca

SEQ ID NO: 557915 - RNA, 23 nt, Human
caaagugcugagauucaggcaug

SEQ ID NO: 557916 - RNA, 20 nt, Human
caagugauucuccugccuca

SEQ ID NO: 557917 - RNA, 22 nt, Human
caagugauucuccugccucagc

SEQ ID NO: 557918 - RNA, 22 nt, Human
caccaccaugcccagcuaauuu

SEQ ID NO: 557919 - RNA, 24 nt, Human
caccaugcccagcuaauuuuugua

SEQ ID NO: 557920 - RNA, 22 nt, Human
cacucugucacccaggcuggag

SEQ ID NO: 557921 - RNA, 22 nt, Human
cacugaacucucuuuucuguuu

SEQ ID NO: 557922 - RNA, 20 nt, Human
cagccuccugaguaacuggg

SEQ ID NO: 557923 - RNA, 24 nt, Human
caggguuucaucauguuggccagg

SEQ ID NO: 557924 - RNA, 18 nt, Human
cauguuggccaggcuggu

SEQ ID NO: 557925 - RNA, 21 nt, Human
cauguuggccaggcuggucuc

SEQ ID NO: 557926 - RNA, 24 nt, Human
cauguuggccaggcuggucucgaa

SEQ ID NO: 557927 - RNA, 21 nt, Human
ccaaaaaaguugcuuucagau

SEQ ID NO: 557928 - RNA, 23 nt, Human
ccaaagugcugagauucaggcau

SEQ ID NO: 557929 - RNA, 24 nt, Human
ccgccuucuggauucaagugauuc

SEQ ID NO: 557930 - RNA, 19 nt, Human
ccugaguaacugggauuac

SEQ ID NO: 557931 - RNA, 22 nt, Human
ccugaguaacugggauuacagg

SEQ ID NO: 557932 - RNA, 22 nt, Human
ccugaguaacugggauuacagg

SEQ ID NO: 557933 - RNA, 24 nt, Human
ccugccucagccuccugaguaacu

SEQ ID NO: 557934 - RNA, 22 nt, Human
ccugccuuggccucccaaagug

SEQ ID NO: 557935 - RNA, 21 nt, Human
ccuucuggauucaagugauuc

SEQ ID NO: 557936 - RNA, 24 nt, Human
ccuucuggauucaagugauucucc

SEQ ID NO: 557937 - RNA, 24 nt, Human
cucacucugucacccaggcuggag

SEQ ID NO: 557938 - RNA, 19 nt, Human
cucacugcaaccuccgccu

SEQ ID NO: 557939 - RNA, 26 nt, Human
cucaugaccucagaugaucugccugc

SEQ ID NO: 557940 - RNA, 21 nt, Human
cugaguaacugggauuacagg

SEQ ID NO: 557941 - RNA, 23 nt, Human
cugaguaacugggauuacaggug

SEQ ID NO: 557942 - RNA, 24 nt, Human
cugaguaacugggauuacaggugu

SEQ ID NO: 557943 - RNA, 24 nt, Human
cugcaaccuccgccuucuggauuc

SEQ ID NO: 557944 - RNA, 23 nt, Human
cugccuuggccucccaaagugcu

SEQ ID NO: 557945 - RNA, 24 nt, Human
gaaaucagagccaucuuccacuga

SEQ ID NO: 557946 - RNA, 23 nt, Human
gaccucagaugaucugccugccu

SEQ ID NO: 557947 - RNA, 24 nt, Human
gaccucagaugaucugccugccuu

SEQ ID NO: 557948 - RNA, 19 nt, Human
gaguaacugggauuacagg

SEQ ID NO: 557949 - RNA, 24 nt, Human
gaguaacugggauuacaggugugc

SEQ ID NO: 557950 - RNA, 24 nt, Human
gauuacaggugugcaccaccaugc

SEQ ID NO: 557951 - RNA, 22 nt, Human
gcccaaaacacuguauuuugau

SEQ ID NO: 557952 - RNA, 22 nt, Human
gcccagcuaauuuuuguauuuu

SEQ ID NO: 557953 - RNA, 22 nt, Human
gccuuggccucccaaagugcug

SEQ ID NO: 557954 - RNA, 24 nt, Human
ggauuacaggugugcaccaccaug

SEQ ID NO: 557955 - RNA, 20 nt, Human
ggauucaagugauucuccug

SEQ ID NO: 557956 - RNA, 22 nt, Human
ggguuucaucauguuggccagg

SEQ ID NO: 557957 - RNA, 24 nt, Human
gugauucuccugccucagccuccu

SEQ ID NO: 557958 - RNA, 21 nt, Human
gugugcaccaccaugcccagc

SEQ ID NO: 557959 - RNA, 24 nt, Human
uaauuuuuguauuuuuaguagaga

SEQ ID NO: 557960 - RNA, 24 nt, Human
uacccugaaaucagagccaucuuc

SEQ ID NO: 557961 - RNA, 27 nt, Human
uacugucuuuuuuuuuucauccaacaa

SEQ ID NO: 557962 - RNA, 22 nt, Human
uagagacaggguuucaucaugu

SEQ ID NO: 557963 - RNA, 24 nt, Human
uaguagagacaggguuucaucaug

SEQ ID NO: 557964 - RNA, 18 nt, Human
uauuacccugaaaucaga

SEQ ID NO: 557965 - RNA, 19 nt, Human
ucaagugauucuccugccu

SEQ ID NO: 557966 - RNA, 18 nt, Human
ucacccaggcuggagugc

SEQ ID NO: 557967 - RNA, 24 nt, Human
ucacucugucacccaggcuggagu

SEQ ID NO: 557968 - RNA, 18 nt, Human
ucacugcaaccuccgccu

SEQ ID NO: 557969 - RNA, 19 nt, Human
ucacugcaaccuccgccuu

SEQ ID NO: 557970 - RNA, 23 nt, Human
ucacugcaaccuccgccuucugg

SEQ ID NO: 557971 - RNA, 24 nt, Human
ucacugcaaccuccgccuucugga

SEQ ID NO: 557972 - RNA, 27 nt, Human
ucacugcaaccuccgccuucuggauuc

SEQ ID NO: 557973 - RNA, 25 nt, Human
ucaucugagacaccaaaaaaguugc

SEQ ID NO: 557974 - RNA, 23 nt, Human
ucccaaagugcugagauucaggc

SEQ ID NO: 557975 - RNA, 24 nt, Human
uccugaguaacugggauuacaggu

SEQ ID NO: 557976 - RNA, 23 nt, Human
ucucacucugucacccaggcugg

SEQ ID NO: 557977 - RNA, 24 nt, Human
ucucacucugucacccaggcugga

SEQ ID NO: 557978 - RNA, 24 nt, Human
ucuccugccucagccuccugagua

SEQ ID NO: 557979 - RNA, 23 nt, Human
ucuggauucaagugauucuccug

SEQ ID NO: 557980 - RNA, 18 nt, Human
ucugucacccaggcugga

SEQ ID NO: 557981 - RNA, 22 nt, Human
ugaaaucagagccaucuuccac

SEQ ID NO: 557982 - RNA, 18 nt, Human
ugaccucagaugaucugc

SEQ ID NO: 557983 - RNA, 19 nt, Human
ugaccucagaugaucugcc

SEQ ID NO: 557984 - RNA, 27 nt, Human
ugaccucagaugaucugccugccuugg

SEQ ID NO: 557985 - RNA, 25 nt, Human
ugagacaccaaaaaaguuggagacc

SEQ ID NO: 557986 - RNA, 18 nt, Human
ugagacagagucucacuc

SEQ ID NO: 557987 - RNA, 22 nt, Human
ugagacagagucucacucuguc

SEQ ID NO: 557988 - RNA, 22 nt, Human
ugagauucaggcaugagccacc

SEQ ID NO: 557989 - RNA, 23 nt, Human
ugagauucaggcaugagccaccg

SEQ ID NO: 557990 - RNA, 20 nt, Human
ugauucuccugccucagccu

SEQ ID NO: 557991 - RNA, 22 nt, Human
ugccguggugcaaucucagcuc

SEQ ID NO: 557992 - RNA, 24 nt, Human
ugccucagccuccugaguaacugg

SEQ ID NO: 557993 - RNA, 18 nt, Human
ugccugccuuggccuccc

SEQ ID NO: 557994 - RNA, 19 nt, Human
uggagugccguggugcaau

SEQ ID NO: 557995 - RNA, 23 nt, Human
uggauucaagugauucuccugcc

SEQ ID NO: 557996 - RNA, 24 nt, Human
uggauucaagugauucuccugccu

SEQ ID NO: 557997 - RNA, 24 nt, Human
uggccaggcuggucucgaacucau

SEQ ID NO: 557998 - RNA, 21 nt, Human
ugggauuacaggugugcacca

SEQ ID NO: 557999 - RNA, 22 nt, Human
ugggauuacaggugugcaccac

SEQ ID NO: 558000 - RNA, 24 nt, Human
ugggauuacaggugugcaccacca

SEQ ID NO: 558001 - RNA, 25 nt, Human
ugggauuacaggugugcaccaccau

SEQ ID NO: 558002 - RNA, 25 nt, Human
ugggauuacaggugugcaccaccau

SEQ ID NO: 558003 - RNA, 24 nt, Human
uggugcaaucucagcucacugcaa

SEQ ID NO: 558004 - RNA, 24 nt, Human
uuacccugaaaucagagccaucuu

SEQ ID NO: 558005 - RNA, 24 nt, Human
uuaguagagacaggguuucaucau

SEQ ID NO: 558006 - RNA, 22 nt, Human
uucaaaccaagcugcaguuacu

SEQ ID NO: 558007 - RNA, 21 nt, Human
uucaagugauucuccugccuc

SEQ ID NO: 558008 - RNA, 23 nt, Human
uucaagugauucuccugccucag

SEQ ID NO: 558009 - RNA, 24 nt, Human
uucaagugauucuccugccucagc

SEQ ID NO: 558010 - RNA, 24 nt, Human
uucuggauucaagugauucuccug

SEQ ID NO: 558011 - RNA, 23 nt, Human
uugauagaaugcuguaaagaagg

SEQ ID NO: 558012 - RNA, 18 nt, Human
uuggccucccaaagugcu

SEQ ID NO: 558013 - RNA, 19 nt, Human
uuucaaaccaagcugcagu

SEQ ID NO: 558014 - RNA, 23 nt, Human
uuucaucauguuggccaggcugu

SEQ ID NO: 558015 - RNA, 24 nt, Human
uuuuuaguagagacaggguuucau

SEQ ID NO: 558016 - RNA, 20 nt, Human
uuuuuguauuuuuaguagag

SEQ ID NO: 558017 - RNA, 25 nt, Human
aaaagguuauggaaagaaagcagag

SEQ ID NO: 558018 - RNA, 22 nt, Human
aaagggacugcaguuaguaggu

SEQ ID NO: 558019 - RNA, 23 nt, Human
aauagcaagaaccagggccuggg

SEQ ID NO: 558020 - RNA, 23 nt, Human
acccucccgggucauuuccccca

SEQ ID NO: 558021 - RNA, 19 nt, Human
agagagcccacgaacuugg

SEQ ID NO: 558022 - RNA, 25 nt, Human
agcaugaaagcagucgaugaaggga

SEQ ID NO: 558023 - RNA, 18 nt, Human
aguuagaacuguggccca

SEQ ID NO: 558024 - RNA, 21 nt, Human
caaaagggacugcaguuagua

SEQ ID NO: 558025 - RNA, 25 nt, Human
caagcuagauaaacguuggggacca

SEQ ID NO: 558026 - RNA, 23 nt, Human
cacccacccccaugggccagagc

SEQ ID NO: 558027 - RNA, 23 nt, Human
caccccagccugggaaacaaccu

SEQ ID NO: 558028 - RNA, 22 nt, Human
caccucugcuccguccugagga

SEQ ID NO: 558029 - RNA, 23 nt, Human
cagaaagcagcuccuccggcccc

SEQ ID NO: 558030 - RNA, 24 nt, Human
cagaaagcagcuccuccggccccc

SEQ ID NO: 558031 - RNA, 26 nt, Human
cagaaagcagcuccuccggcccccuc

SEQ ID NO: 558032 - RNA, 23 nt, Human
cagaggcgcagucagccgggccc

SEQ ID NO: 558033 - RNA, 19 nt, Human
cagcaugaaagcagucgau

SEQ ID NO: 558034 - RNA, 19 nt, Human
cagccgggcccgccggcca

SEQ ID NO: 558035 - RNA, 21 nt, Human
cagcuucucucccuacccucc

SEQ ID NO: 558036 - RNA, 23 nt, Human
ccaggaaauagcaagaaccaggg

SEQ ID NO: 558037 - RNA, 22 nt, Human
cccacgaacuuggauucagaaa

SEQ ID NO: 558038 - RNA, 19 nt, Human
cccaugaucaucccuacuu

SEQ ID NO: 558039 - RNA, 21 nt, Human
cccaugggccagagcucugga

SEQ ID NO: 558040 - RNA, 18 nt, Human
ccccucucuccgccccuc

SEQ ID NO: 558041 - RNA, 19 nt, Human
cccuccuccagcuuuuguc

SEQ ID NO: 558042 - RNA, 20 nt, Human
cccugugcuagccuuugucc

SEQ ID NO: 558043 - RNA, 22 nt, Human
ccgcaugggacccucccggguc

SEQ ID NO: 558044 - RNA, 24 nt, Human
ccucccgggucauuucccccagcc

SEQ ID NO: 558045 - RNA, 21 nt, Human
ccuuggagucaaauaggccuc

SEQ ID NO: 558046 - RNA, 19 nt, Human
cggcccccucucuccgccc

SEQ ID NO: 558047 - RNA, 20 nt, Human
cggcccccucucuccgcccc

SEQ ID NO: 558048 - RNA, 21 nt, Human
cguucgggcacccuagugucc

SEQ ID NO: 558049 - RNA, 23 nt, Human
cuauagccgcucacccaccccca

SEQ ID NO: 558050 - RNA, 23 nt, Human
cucagcuucucucccuacccucc

SEQ ID NO: 558051 - RNA, 18 nt, Human
cuccuccagcuuuugucu

SEQ ID NO: 558052 - RNA, 19 nt, Human
cuccuccagcuuuugucuc

SEQ ID NO: 558053 - RNA, 24 nt, Human
cuccuccggcccccucucuccgcc

SEQ ID NO: 558054 - RNA, 18 nt, Human
cucucccuacccuccucc

SEQ ID NO: 558055 - RNA, 19 nt, Human
cucugcacugaacuaaguc

SEQ ID NO: 558056 - RNA, 23 nt, Human
cugccaauuuuauguagccgcau

SEQ ID NO: 558057 - RNA, 22 nt, Human
cuggaagaaguggagaauccug

SEQ ID NO: 558058 - RNA, 18 nt, Human
cuggugccugcaccucug

SEQ ID NO: 558059 - RNA, 22 nt, Human
cuggugccugcaccucuguguc

SEQ ID NO: 558060 - RNA, 19 nt, Human
cuuggauucagaaagcagc

SEQ ID NO: 558061 - RNA, 20 nt, Human
cuuuucaagagcagggauga

SEQ ID NO: 558062 - RNA, 23 nt, Human
cuuuucaagagcagggaugaaca

SEQ ID NO: 558063 - RNA, 19 nt, Human
gaaccagggccugggagga

SEQ ID NO: 558064 - RNA, 19 nt, Human
gaagaugaguuuggggaaa

SEQ ID NO: 558065 - RNA, 22 nt, Human
gaagaugaguuuggggaaaggg

SEQ ID NO: 558066 - RNA, 20 nt, Human
gaaguggagaauccuggugg

SEQ ID NO: 558067 - RNA, 21 nt, Human
gaauccuggugccugcaccuc

SEQ ID NO: 558068 - RNA, 23 nt, Human
gacccugcuccccuuuccagguc

SEQ ID NO: 558069 - RNA, 21 nt, Human
gaggcgcagucagccgggccc

SEQ ID NO: 558070 - RNA, 19 nt, Human
gagucaaauaggccuccca

SEQ ID NO: 558071 - RNA, 20 nt, Human
gcccccaccccagccuggga

SEQ ID NO: 558072 - RNA, 18 nt, Human
gcccccucucuccgcccc

SEQ ID NO: 558073 - RNA, 19 nt, Human
gcccugugcuagccuuugu

SEQ ID NO: 558074 - RNA, 21 nt, Human
gcucaggcccccaccccagcc

SEQ ID NO: 558075 - RNA, 18 nt, Human
ggagguccuacuggccag

SEQ ID NO: 558076 - RNA, 19 nt, Human
ggagguccuacuggccagg

SEQ ID NO: 558077 - RNA, 18 nt, Human
gggaugaacacuauagcc

SEQ ID NO: 558078 - RNA, 20 nt, Human
gggucauuucccccagcccc

SEQ ID NO: 558079 - RNA, 23 nt, Human
ggucuuuucaagagcagggauga

SEQ ID NO: 558080 - RNA, 22 nt, Human
gugccuagcccugugcuagccu

SEQ ID NO: 558081 - RNA, 19 nt, Human
uagccgcucacccaccccc

SEQ ID NO: 558082 - RNA, 22 nt, Human
uaguucuaaggcugccaauuuu

SEQ ID NO: 558083 - RNA, 22 nt, Human
ucagcuucucucccuacccucc

SEQ ID NO: 558084 - RNA, 18 nt, Human
ucaugcuccgcuguucuc

SEQ ID NO: 558085 - RNA, 18 nt, Human
ucccuacccuccuccagc

SEQ ID NO: 558086 - RNA, 21 nt, Human
ucucucucuuguacaaaagac

SEQ ID NO: 558087 - RNA, 20 nt, Human
ucuggaagaugaguuugggg

SEQ ID NO: 558088 - RNA, 18 nt, Human
ugaggacuucugagagag

SEQ ID NO: 558089 - RNA, 20 nt, Human
ugccuagcccugugcuagcc

SEQ ID NO: 558090 - RNA, 21 nt, Human
ugcuagccuuuguccaauaca

SEQ ID NO: 558091 - RNA, 21 nt, Human
ugcucaggcccccaccccagc

SEQ ID NO: 558092 - RNA, 18 nt, Human
uggaaagaaagcagaggc

SEQ ID NO: 558093 - RNA, 21 nt, Human
uggaagaugaguuuggggaaa

SEQ ID NO: 558094 - RNA, 22 nt, Human
uggaagaugaguuuggggaaag

SEQ ID NO: 558095 - RNA, 19 nt, Human
ugggaggaagggcaguuag

SEQ ID NO: 558096 - RNA, 18 nt, Human
uuggagguccuacuggcc

SEQ ID NO: 558097 - RNA, 19 nt, Human
uuuuuuuuuuuuuuucugu

SEQ ID NO: 558098 - RNA, 27 nt, Human
uuuuuuuuuuuuuuuuuuuuucugggg

SEQ ID NO: 558099 - RNA, 22 nt, Human
aaguaaauuuuuuuuuuuuucc

SEQ ID NO: 558100 - RNA, 20 nt, Human
aggcuuuaaugaauuugaau

SEQ ID NO: 558101 - RNA, 19 nt, Human
ccccaggaauaaacgaacc

SEQ ID NO: 558102 - RNA, 20 nt, Human
ccuuuucuguccaccuacca

SEQ ID NO: 558103 - RNA, 22 nt, Human
cuugcaaguaaauuuuuuuuuu

SEQ ID NO: 558104 - RNA, 28 nt, Human
cuuuagucuuuuugcuuuuuuuuuuuuu

SEQ ID NO: 558105 - RNA, 27 nt, Human
gcaaguaaauuuuuuuuuuuuuccuuu

SEQ ID NO: 558106 - RNA, 23 nt, Human
guaaauacaucuccauuuuacgu

SEQ ID NO: 558107 - RNA, 28 nt, Human
ugcaaguaaauuuuuuuuuuuuuccuuu

SEQ ID NO: 558108 - RNA, 29 nt, Human
aaaaauaguaaugagaagaggaggccggu

SEQ ID NO: 558109 - RNA, 24 nt, Human
aaaagcucccaacagugaccagaa

SEQ ID NO: 558110 - RNA, 22 nt, Human
aaagaugucucaucuaaaagcu

SEQ ID NO: 558111 - RNA, 21 nt, Human
aaaucaguugaaugaaacuag

SEQ ID NO: 558112 - RNA, 23 nt, Human
aagaaaaacugacuuugacccca

SEQ ID NO: 558113 - RNA, 25 nt, Human
aagggauaguaacccccuuccccca

SEQ ID NO: 558114 - RNA, 18 nt, Human
aaucauccaaaucaaagc

SEQ ID NO: 558115 - RNA, 21 nt, Human
aauccuuucuucgccccaccc

SEQ ID NO: 558116 - RNA, 23 nt, Human
aauuaaacuugaguaaaagccug

SEQ ID NO: 558117 - RNA, 21 nt, Human
acccugagacaagccaaucuu

SEQ ID NO: 558118 - RNA, 19 nt, Human
acucgaggagaaggaaggg

SEQ ID NO: 558119 - RNA, 19 nt, Human
acuucccacccugagacaa

SEQ ID NO: 558120 - RNA, 21 nt, Human
agacaagccaaucuuaucaga

SEQ ID NO: 558121 - RNA, 19 nt, Human
agcagcauuuggcuuuaag

SEQ ID NO: 558122 - RNA, 24 nt, Human
aucccauuuuuaugaaagcuccau

SEQ ID NO: 558123 - RNA, 20 nt, Human
cacccucccacuucccaccc

SEQ ID NO: 558124 - RNA, 19 nt, Human
cagugaccagaacaaggua

SEQ ID NO: 558125 - RNA, 23 nt, Human
ccauacuaacccuucuacuccug

SEQ ID NO: 558126 - RNA, 24 nt, Human
cccaaaagaaucacaaucaauucc

SEQ ID NO: 558127 - RNA, 24 nt, Human
cccaucacuaguucuguccucaau

SEQ ID NO: 558128 - RNA, 20 nt, Human
ccccacccucccacuuccca

SEQ ID NO: 558129 - RNA, 20 nt, Human
ccucccacuucccacccuga

SEQ ID NO: 558130 - RNA, 19 nt, Human
ccuggccucaccugggcag

SEQ ID NO: 558131 - RNA, 19 nt, Human
ccugggcagcccuucacuu

SEQ ID NO: 558132 - RNA, 23 nt, Human
ccuuuggaaguugggcuccacug

SEQ ID NO: 558133 - RNA, 22 nt, Human
gccccacccucccacuucccac

SEQ ID NO: 558134 - RNA, 24 nt, Human
uaaaagccuggagaaugcuaaaaa

SEQ ID NO: 558135 - RNA, 22 nt, Human
uaacccaagguucagccaaugg

SEQ ID NO: 558136 - RNA, 19 nt, Human
uaguaaugagaagaggagg

SEQ ID NO: 558137 - RNA, 24 nt, Human
uauaaaauuuuaguaaaacccuca

SEQ ID NO: 558138 - RNA, 22 nt, Human
ucaauuuuaaaagaaaaacuga

SEQ ID NO: 558139 - RNA, 21 nt, Human
uccaugagcagcauuuggcuu

SEQ ID NO: 558140 - RNA, 24 nt, Human
uccaugagcagcauuuggcuuuaa

SEQ ID NO: 558141 - RNA, 23 nt, Human
ucgccccacccucccacuuccca

SEQ ID NO: 558142 - RNA, 23 nt, Human
ucuucgccccacccucccacuuc

SEQ ID NO: 558143 - RNA, 30 nt, Human
ugagaagaggaggcuguagagcagagaguu

SEQ ID NO: 558144 - RNA, 21 nt, Human
ugagacaagccaaucuuauca

SEQ ID NO: 558145 - RNA, 19 nt, Human
ugaguaaaagccuggagaa

SEQ ID NO: 558146 - RNA, 22 nt, Human
ugaguaaaagccuggagaaugc

SEQ ID NO: 558147 - RNA, 22 nt, Human
ugcguuguacuuucacauuuac

SEQ ID NO: 558148 - RNA, 23 nt, Human
ugggcagcccuucacuuugcucu

SEQ ID NO: 558149 - RNA, 21 nt, Human
uguuaguugggaugccaaagg

SEQ ID NO: 558150 - RNA, 21 nt, Human
uucuuuauuguuaguugggau

SEQ ID NO: 558151 - RNA, 19 nt, Human
uugaccuuuggaaguuggg

SEQ ID NO: 558152 - RNA, 24 nt, Human
uuuaguaaaacccucaugcaaaau

SEQ ID NO: 558153 - RNA, 18 nt, Human
aagggggggaagggaggg

SEQ ID NO: 558154 - RNA, 25 nt, Human
aauccugccccuccaccaagcccag

SEQ ID NO: 558155 - RNA, 23 nt, Human
acagcccgggcauggccccgggc

SEQ ID NO: 558156 - RNA, 22 nt, Human
accaagcccacggaaucuugcu

SEQ ID NO: 558157 - RNA, 19 nt, Human
acccaggcuggagugcagu

SEQ ID NO: 558158 - RNA, 23 nt, Human
agaaaucugcugaggcagcccuc

SEQ ID NO: 558159 - RNA, 18 nt, Human
agagcccgccaccugaga

SEQ ID NO: 558160 - RNA, 21 nt, Human
aggcugcagaggggcccugug

SEQ ID NO: 558161 - RNA, 18 nt, Human
aggcuggagugcaguggc

SEQ ID NO: 558162 - RNA, 20 nt, Human
agggcccccaguugcccucc

SEQ ID NO: 558163 - RNA, 19 nt, Human
agggggggaagggagggca

SEQ ID NO: 558164 - RNA, 20 nt, Human
agugcaguggcgcgauuucg

SEQ ID NO: 558165 - RNA, 23 nt, Human
agugcaguggcgcgauuucggcu

SEQ ID NO: 558166 - RNA, 24 nt, Human
agugcaguggcgcgauuucggcuc

SEQ ID NO: 558167 - RNA, 24 nt, Human
cacccaggcuggagugcaguggcg

SEQ ID NO: 558168 - RNA, 23 nt, Human
ccaccugagaggcaaggcuccug

SEQ ID NO: 558169 - RNA, 22 nt, Human
ccagggcccccaguugcccucc

SEQ ID NO: 558170 - RNA, 22 nt, Human
cccccaguugcccuccuccugc

SEQ ID NO: 558171 - RNA, 18 nt, Human
cccgggcgcaaaagucac

SEQ ID NO: 558172 - RNA, 23 nt, Human
ccgggccagggcccccaguugcc

SEQ ID NO: 558173 - RNA, 18 nt, Human
ccugcggggugcagcguc

SEQ ID NO: 558174 - RNA, 22 nt, Human
cggaauccugccccuccaccaa

SEQ ID NO: 558175 - RNA, 20 nt, Human
cuccucaggaggacaaugcc

SEQ ID NO: 558176 - RNA, 18 nt, Human
cugucacccaggcuggag

SEQ ID NO: 558177 - RNA, 19 nt, Human
cugucacccaggcuggagu

SEQ ID NO: 558178 - RNA, 21 nt, Human
cuugcucugucacccaggcug

SEQ ID NO: 558179 - RNA, 26 nt, Human
gaauccugccccuccaccaagcccac

SEQ ID NO: 558180 - RNA, 25 nt, Human
gcacagcccgggcauggccccgggc

SEQ ID NO: 558181 - RNA, 25 nt, Human
gcucugucacccaggcuggagugca

SEQ ID NO: 558182 - RNA, 19 nt, Human
gcuggagugcaguggcgcg

SEQ ID NO: 558183 - RNA, 19 nt, Human
ggaauccugccccuccacc

SEQ ID NO: 558184 - RNA, 24 nt, Human
ggaugguccugagauagcagcagg

SEQ ID NO: 558185 - RNA, 19 nt, Human
ggccagggcccccaguugc

SEQ ID NO: 558186 - RNA, 30 nt, Human
gggaggcccuggccagcuuugcacagcccc

SEQ ID NO: 558187 - RNA, 20 nt, Human
ggggaaagggggggaaggga

SEQ ID NO: 558188 - RNA, 18 nt, Human
ggucugagaaaucugcug

SEQ ID NO: 558189 - RNA, 20 nt, Human
uagcagcagggcccagcauc

SEQ ID NO: 558190 - RNA, 19 nt, Human
ucacagggucgcagagccc

SEQ ID NO: 558191 - RNA, 24 nt, Human
ucacccaggcuggagugcaguggc

SEQ ID NO: 558192 - RNA, 23 nt, Human
uccggggaaagggggggaaggga

SEQ ID NO: 558193 - RNA, 27 nt, Human
uccguggucugagaaaucugcugaggc

SEQ ID NO: 558194 - RNA, 21 nt, Human
ucugcugaggcagcccucccc

SEQ ID NO: 558195 - RNA, 22 nt, Human
ucugcugaggcagcccucccca

SEQ ID NO: 558196 - RNA, 24 nt, Human
ucugucacccaggcuggagugcag

SEQ ID NO: 558197 - RNA, 23 nt, Human
ucuugcucugucacccaggcugg

SEQ ID NO: 558198 - RNA, 24 nt, Human
ucuugcucugucacccaggcugga

SEQ ID NO: 558199 - RNA, 18 nt, Human
ugagauagcagcagggcc

SEQ ID NO: 558200 - RNA, 22 nt, Human
ugcaguggcgcgauuucggcuc

SEQ ID NO: 558201 - RNA, 21 nt, Human
ugccccuccaccaagcccacg

SEQ ID NO: 558202 - RNA, 18 nt, Human
ugccgggccagggccccc

SEQ ID NO: 558203 - RNA, 24 nt, Human
ugcucugucacccaggcuggagug

SEQ ID NO: 558204 - RNA, 23 nt, Human
uggagugcaguggcgcgauuucg

SEQ ID NO: 558205 - RNA, 24 nt, Human
uggagugcaguggcgcgauuucgg

SEQ ID NO: 558206 - RNA, 18 nt, Human
ugggaggcccuggccagc

SEQ ID NO: 558207 - RNA, 18 nt, Human
ugggaggcccuggccagc

SEQ ID NO: 558208 - RNA, 21 nt, Human
uggucugagaaaucugcugag

SEQ ID NO: 558209 - RNA, 18 nt, Human
ugugggaggcccuggcca

SEQ ID NO: 558210 - RNA, 25 nt, Human
aauccugccccgccgccaagcccac

SEQ ID NO: 558211 - RNA, 25 nt, Human
aggcuggagugcaguggcgcgaucu

SEQ ID NO: 558212 - RNA, 20 nt, Human
agugcaguggcgcgaucucg

SEQ ID NO: 558213 - RNA, 23 nt, Human
agugcaguggcgcgaucucggcu

SEQ ID NO: 558214 - RNA, 24 nt, Human
agugcaguggcgcgaucucggcuc

SEQ ID NO: 558215 - RNA, 19 nt, Human
cagagcccgccaccugaga

SEQ ID NO: 558216 - RNA, 23 nt, Human
ccaccugagaggcaaggcuccug

SEQ ID NO: 558217 - RNA, 22 nt, Human
ccugccccgccgccaagcccac

SEQ ID NO: 558218 - RNA, 24 nt, Human
cgcccaggcuggagugcaguggcg

SEQ ID NO: 558219 - RNA, 24 nt, Human
cgcucugucgcccaggcuggagug

SEQ ID NO: 558220 - RNA, 24 nt, Human
cucgcucugucgcccaggcuggag

SEQ ID NO: 558221 - RNA, 19 nt, Human
gcccaggcuggagugcagu

SEQ ID NO: 558222 - RNA, 20 nt, Human
gcccaggcuggagugcagug

SEQ ID NO: 558223 - RNA, 25 nt, Human
gcucugucgcccaggcuggagugca

SEQ ID NO: 558224 - RNA, 19 nt, Human
ucgcagggucgcagagccc

SEQ ID NO: 558225 - RNA, 22 nt, Human
ucgcccaggcuggagugcagug

SEQ ID NO: 558226 - RNA, 24 nt, Human
ucgcucugucgcccaggcuggagu

SEQ ID NO: 558227 - RNA, 19 nt, Human
ucucgcucugucgcccagg

SEQ ID NO: 558228 - RNA, 23 nt, Human
ucucgcucugucgcccaggcugg

SEQ ID NO: 558229 - RNA, 24 nt, Human
ucucgcucugucgcccaggcugga

SEQ ID NO: 558230 - RNA, 26 nt, Human
ucucgcucugucgcccaggcuggagu

SEQ ID NO: 558231 - RNA, 27 nt, Human
ucucgcucugucgcccaggcuggagug

SEQ ID NO: 558232 - RNA, 24 nt, Human
ucugucgcccaggcuggagugcag

SEQ ID NO: 558233 - RNA, 18 nt, Human
ugagaggcaaggcuccug

SEQ ID NO: 558234 - RNA, 19 nt, Human
ugagaggcaaggcuccugc

SEQ ID NO: 558235 - RNA, 23 nt, Human
uggagugcaguggcgcgaucucg

SEQ ID NO: 558236 - RNA, 24 nt, Human
uggagugcaguggcgcgaucucgg

SEQ ID NO: 558237 - RNA, 23 nt, Human
auagcaguaagauagagcagaac

SEQ ID NO: 558238 - RNA, 24 nt, Human
auauguucugauguacuugcauuu

SEQ ID NO: 558239 - RNA, 22 nt, Human
caauaaucguggaucguaaugc

SEQ ID NO: 558240 - RNA, 25 nt, Human
caugucaacaucaauaaucguggau

SEQ ID NO: 558241 - RNA, 18 nt, Human
cuucccuguggcuugggu

SEQ ID NO: 558242 - RNA, 22 nt, Human
uaagauagagcagaacugaaaa

SEQ ID NO: 558243 - RNA, 18 nt, Human
uccccauagcaguaagau

SEQ ID NO: 558244 - RNA, 19 nt, Human
ucguaaugcuccaaauagg

SEQ ID NO: 558245 - RNA, 19 nt, Human
ucuagagaaacuaucuuug

SEQ ID NO: 558246 - RNA, 20 nt, Human
ugcuccaaauagguccugcu

SEQ ID NO: 558247 - RNA, 19 nt, Human
uguucugauguacuugcau

SEQ ID NO: 558248 - RNA, 20 nt, Human
uguuuugcaaguucuucccu

SEQ ID NO: 558249 - RNA, 23 nt, Human
uugcaaguucuucccuguggcuu

SEQ ID NO: 558250 - RNA, 19 nt, Human
aagccagcacagccuaaac

SEQ ID NO: 558251 - RNA, 20 nt, Human
aguucaguggcgugaucuug

SEQ ID NO: 558252 - RNA, 24 nt, Human
aguucaguggcgugaucuuggcuc

SEQ ID NO: 558253 - RNA, 20 nt, Human
cagcacagccuaaacagcag

SEQ ID NO: 558254 - RNA, 23 nt, Human
cagccuggaccucccaggccaaa

SEQ ID NO: 558255 - RNA, 24 nt, Human
cagccuggaccucccaggccaaag

SEQ ID NO: 558256 - RNA, 22 nt, Human
cagggucuugcugucucccagg

SEQ ID NO: 558257 - RNA, 20 nt, Human
caguggcgugaucuuggcuc

SEQ ID NO: 558258 - RNA, 19 nt, Human
cccaggcuggaguucagug

SEQ ID NO: 558259 - RNA, 20 nt, Human
ccucccaggccaaaggacua

SEQ ID NO: 558260 - RNA, 18 nt, Human
ccuggaccucccaggcca

SEQ ID NO: 558261 - RNA, 21 nt, Human
cucauugcagccuggaccucc

SEQ ID NO: 558262 - RNA, 21 nt, Human
gccagcacagccuaaacagca

SEQ ID NO: 558263 - RNA, 21 nt, Human
gcucauugcagccuggaccuc

SEQ ID NO: 558264 - RNA, 22 nt, Human
ggcuggaguucaguggcgugau

SEQ ID NO: 558265 - RNA, 23 nt, Human
gucuugcugucucccaggcugga

SEQ ID NO: 558266 - RNA, 24 nt, Human
ucauugcagccuggaccucccagg

SEQ ID NO: 558267 - RNA, 24 nt, Human
ucccaggcuggaguucaguggcgu

SEQ ID NO: 558268 - RNA, 18 nt, Human
ucucccaggcuggaguuc

SEQ ID NO: 558269 - RNA, 20 nt, Human
ucuugcugucucccaggcug

SEQ ID NO: 558270 - RNA, 21 nt, Human
ucuugcugucucccaggcugg

SEQ ID NO: 558271 - RNA, 22 nt, Human
ucuugcugucucccaggcugga

SEQ ID NO: 558272 - RNA, 23 nt, Human
ucuugcugucucccaggcuggag

SEQ ID NO: 558273 - RNA, 24 nt, Human
ucuugcugucucccaggcuggagu

SEQ ID NO: 558274 - RNA, 19 nt, Human
ugcagccuggaccucccag

SEQ ID NO: 558275 - RNA, 22 nt, Human
ugcugucucccaggcuggaguu

SEQ ID NO: 558276 - RNA, 23 nt, Human
uggaccucccaggccaagacccu

SEQ ID NO: 558277 - RNA, 19 nt, Human
uggaguucaguggcgugau

SEQ ID NO: 558278 - RNA, 24 nt, Human
uggcucauugcagccuggaccucc

SEQ ID NO: 558279 - RNA, 23 nt, Human
uugcagccuggaccucccaggcc

SEQ ID NO: 558280 - RNA, 25 nt, Human
aaaaaaaaaagaauccacagcaaaa

SEQ ID NO: 558281 - RNA, 18 nt, Human
aaaagacacccaaaagaa

SEQ ID NO: 558282 - RNA, 21 nt, Human
aaaagacacccaaaagaaucc

SEQ ID NO: 558283 - RNA, 26 nt, Human
aaaagacacccaaaagaauccacagc

SEQ ID NO: 558284 - RNA, 18 nt, Human
aaacaaaagacacccaaa

SEQ ID NO: 558285 - RNA, 22 nt, Human
aaacaaaagacacccaaaagaa

SEQ ID NO: 558286 - RNA, 24 nt, Human
aaacugcagaguaaugcaaacagg

SEQ ID NO: 558287 - RNA, 31 nt, Human
aaagccaggcacgguggcucaugccuguaaa

SEQ ID NO: 558288 - RNA, 23 nt, Human
aacuuuucaggaaaacaggcucc

SEQ ID NO: 558289 - RNA, 26 nt, Human
acaaaagacacccaaaagaauccaca

SEQ ID NO: 558290 - RNA, 20 nt, Human
acagcuggagaagcuaaagc

SEQ ID NO: 558291 - RNA, 18 nt, Human
accaaaacccuugcucua

SEQ ID NO: 558292 - RNA, 22 nt, Human
accaugcugcuuaacaagcauc

SEQ ID NO: 558293 - RNA, 21 nt, Human
acccaaaagaauccacagcaa

SEQ ID NO: 558294 - RNA, 24 nt, Human
accugggugcaguucugcccuugg

SEQ ID NO: 558295 - RNA, 24 nt, Human
agacugagguaggaggaucacuug

SEQ ID NO: 558296 - RNA, 18 nt, Human
agagccuguugucuuccu

SEQ ID NO: 558297 - RNA, 19 nt, Human
agaggaaacaggaaccugg

SEQ ID NO: 558298 - RNA, 18 nt, Human
agaguaaugcaaacagga

SEQ ID NO: 558299 - RNA, 24 nt, Human
agcacuuugggagacugagguagg

SEQ ID NO: 558300 - RNA, 23 nt, Human
agccaggcacgguggcucaugcc

SEQ ID NO: 558301 - RNA, 22 nt, Human
agccugggcaacaaagugagac

SEQ ID NO: 558302 - RNA, 21 nt, Human
aggaaaacaaaagacacccaa

SEQ ID NO: 558303 - RNA, 23 nt, Human
aggaacuuuucaggaaaacaggc

SEQ ID NO: 558304 - RNA, 23 nt, Human
aggaguucaagaccagccugggc

SEQ ID NO: 558305 - RNA, 24 nt, Human
aggaucacuugagcucaggaguuc

SEQ ID NO: 558306 - RNA, 20 nt, Human
aggcagagugcugacuugug

SEQ ID NO: 558307 - RNA, 18 nt, Human
agguaggaggaucacuug

SEQ ID NO: 558308 - RNA, 23 nt, Human
agguaggaggaucacuugagcuc

SEQ ID NO: 558309 - RNA, 19 nt, Human
auccacagcaaagccaggc

SEQ ID NO: 558310 - RNA, 19 nt, Human
augccuguaaucccagcac

SEQ ID NO: 558311 - RNA, 21 nt, Human
auggaaacugcagaguaaugc

SEQ ID NO: 558312 - RNA, 20 nt, Human
caaaagacacccaaaagaag

SEQ ID NO: 558313 - RNA, 22 nt, Human
caaaagacacccaaaagaaucc

SEQ ID NO: 558314 - RNA, 23 nt, Human
caaaagacacccaaaagaaucca

SEQ ID NO: 558315 - RNA, 19 nt, Human
caaacagcugcuucagaac

SEQ ID NO: 558316 - RNA, 26 nt, Human
caacccuuacacagauggucaagaca

SEQ ID NO: 558317 - RNA, 20 nt, Human
caccaugcugcuuaacaagc

SEQ ID NO: 558318 - RNA, 23 nt, Human
cacccaaaagaauccacagcaaa

SEQ ID NO: 558319 - RNA, 22 nt, Human
cagaggaaacaggaaccugggu

SEQ ID NO: 558320 - RNA, 20 nt, Human
cagcaaagccaggcacggug

SEQ ID NO: 558321 - RNA, 21 nt, Human
cagcacuuugggagacugagg

SEQ ID NO: 558322 - RNA, 25 nt, Human
cagcacuuugggagacugagguagg

SEQ ID NO: 558323 - RNA, 18 nt, Human
caggugacugaggcagag

SEQ ID NO: 558324 - RNA, 20 nt, Human
caugccuguaaucccagcac

SEQ ID NO: 558325 - RNA, 24 nt, Human
caugccuguaaucccagcacuuug

SEQ ID NO: 558326 - RNA, 20 nt, Human
ccacagcaaagccaggcacu

SEQ ID NO: 558327 - RNA, 24 nt, Human
cccacagcaacauuuccuuuaaaa

SEQ ID NO: 558328 - RNA, 21 nt, Human
cccaguauauaugauuauucc

SEQ ID NO: 558329 - RNA, 22 nt, Human
cccucuaaaaaaaaaaaaaaaa

SEQ ID NO: 558330 - RNA, 24 nt, Human
cccucuaaaaaaaaaaaaaaaaaa

SEQ ID NO: 558331 - RNA, 24 nt, Human
ccgaucuaguauccuuucagucac

SEQ ID NO: 558332 - RNA, 20 nt, Human
ccucuaaaaaaaaaaaaaaa

SEQ ID NO: 558333 - RNA, 20 nt, Human
ccucugagucaugaucaucc

SEQ ID NO: 558334 - RNA, 23 nt, Human
ccucugagucaugaucauccacc

SEQ ID NO: 558335 - RNA, 20 nt, Human
ccugggugcaguucugcccu

SEQ ID NO: 558336 - RNA, 23 nt, Human
cucaugccuguaaucccagcacu

SEQ ID NO: 558337 - RNA, 24 nt, Human
cucaugccuguaaucccagcacuu

SEQ ID NO: 558338 - RNA, 19 nt, Human
cucuaaaaaaaaaaaaaaa

SEQ ID NO: 558339 - RNA, 23 nt, Human
cuugagcucaggaguucaagacc

SEQ ID NO: 558340 - RNA, 20 nt, Human
gacucgcucagacuucccuu

SEQ ID NO: 558341 - RNA, 23 nt, Human
gaucacuugagcucaggaguuca

SEQ ID NO: 558342 - RNA, 24 nt, Human
gaucacuugagcucaggaguucaa

SEQ ID NO: 558343 - RNA, 19 nt, Human
ggaaaacaaaagacaccca

SEQ ID NO: 558344 - RNA, 22 nt, Human
ggaaguggacuuugcugcagcu

SEQ ID NO: 558345 - RNA, 23 nt, Human
ggaucacuugagcucaggaguuc

SEQ ID NO: 558346 - RNA, 23 nt, Human
gguggcucaugccuguaauccca

SEQ ID NO: 558347 - RNA, 24 nt, Human
gguggcucaugccuguaaucccag

SEQ ID NO: 558348 - RNA, 25 nt, Human
guaggaaaacaaaagacacccaaaa

SEQ ID NO: 558349 - RNA, 18 nt, Human
gucaagacaaauuuccuc

SEQ ID NO: 558350 - RNA, 23 nt, Human
uaagcggacaacccuuacacaga

SEQ ID NO: 558351 - RNA, 22 nt, Human
uaggaaaacaaaagacacccaa

SEQ ID NO: 558352 - RNA, 22 nt, Human
uauuaucucucaccaaaacccu

SEQ ID NO: 558353 - RNA, 23 nt, Human
ucacuugagcucaggaguucaag

SEQ ID NO: 558354 - RNA, 18 nt, Human
uccacagcaaagccaggc

SEQ ID NO: 558355 - RNA, 33 nt, Human
uccacagcaaagccaggcacgguggcucauggu

SEQ ID NO: 558356 - RNA, 24 nt, Human
uccucuauaaaucguguaggaaaa

SEQ ID NO: 558357 - RNA, 28 nt, Human
ucguguaggaaaacaaaagacacccaaa

SEQ ID NO: 558358 - RNA, 21 nt, Human
ucuaaaaaaaaaaaaaaaaaa

SEQ ID NO: 558359 - RNA, 25 nt, Human
ucuaacagcuagcucaucccuuuuu

SEQ ID NO: 558360 - RNA, 20 nt, Human
ugaaucccccacagcaacau

SEQ ID NO: 558361 - RNA, 20 nt, Human
ugagguaggaggaucacuug

SEQ ID NO: 558362 - RNA, 21 nt, Human
ugagguaggaggaucacuuga

SEQ ID NO: 558363 - RNA, 23 nt, Human
ugagguaggaggaucacuugagc

SEQ ID NO: 558364 - RNA, 24 nt, Human
ugagguaggaggaucacuugagcu

SEQ ID NO: 558365 - RNA, 26 nt, Human
ugcccuugggccccccagacugcagc

SEQ ID NO: 558366 - RNA, 23 nt, Human
ugccuguaaucccagcacuuugg

SEQ ID NO: 558367 - RNA, 23 nt, Human
ugccuguaaucccagcacuuugg

SEQ ID NO: 558368 - RNA, 24 nt, Human
ugccuguaaucccagcacuuuggg

SEQ ID NO: 558369 - RNA, 22 nt, Human
uggaaguggacuuugcugcagc

SEQ ID NO: 558370 - RNA, 19 nt, Human
uggcagaggaaacaggaac

SEQ ID NO: 558371 - RNA, 23 nt, Human
uggcagaggaaacaggaaccugg

SEQ ID NO: 558372 - RNA, 22 nt, Human
uggcucaugccuguaaucccag

SEQ ID NO: 558373 - RNA, 24 nt, Human
uggcucaugccuguaaucccagca

SEQ ID NO: 558374 - RNA, 24 nt, Human
ugggagacugagguaggaggauca

SEQ ID NO: 558375 - RNA, 20 nt, Human
ugggccccccagacugcagc

SEQ ID NO: 558376 - RNA, 19 nt, Human
uggucaagacaaauuuccu

SEQ ID NO: 558377 - RNA, 24 nt, Human
uuacaaugaaucccccacagcaac

SEQ ID NO: 558378 - RNA, 25 nt, Human
uugggagacugagguaggaggauca

SEQ ID NO: 558379 - RNA, 22 nt, Human
uuuuuuuuuuuuuuuuuuguuc

SEQ ID NO: 558380 - RNA, 27 nt, Human
uuuuuuuuuuuuuuuuuuuuuuugggg

SEQ ID NO: 558381 - RNA, 19 nt, Human
aaaagcuaccacagacacc

SEQ ID NO: 558382 - RNA, 24 nt, Human
aaaagcuaccacagacaccaacuc

SEQ ID NO: 558383 - RNA, 19 nt, Human
aaacagaaagggcagcccc

SEQ ID NO: 558384 - RNA, 20 nt, Human
aaagaggccuggggccugga

SEQ ID NO: 558385 - RNA, 21 nt, Human
aacucugacaaggagcaaaga

SEQ ID NO: 558386 - RNA, 19 nt, Human
aacuggacuggaaacagaa

SEQ ID NO: 558387 - RNA, 20 nt, Human
aagacccuucacauuuccaa

SEQ ID NO: 558388 - RNA, 23 nt, Human
aagacccuucacauuuccaaggg

SEQ ID NO: 558389 - RNA, 23 nt, Human
aagccuccacauccaagagccaa

SEQ ID NO: 558390 - RNA, 26 nt, Human
aagcugccguuuacuacaacguuccg

SEQ ID NO: 558391 - RNA, 19 nt, Human
aaguggccagagcucugcc

SEQ ID NO: 558392 - RNA, 20 nt, Human
acaauguccccagggaggcc

SEQ ID NO: 558393 - RNA, 23 nt, Human
acacacacacacacacacacaca

SEQ ID NO: 558394 - RNA, 23 nt, Human
acacacacacacacacacacaca

SEQ ID NO: 558395 - RNA, 23 nt, Human
acacacacacauauacacacaca

SEQ ID NO: 558396 - RNA, 23 nt, Human
acacacauauacacacacacaca

SEQ ID NO: 558397 - RNA, 25 nt, Human
acacacgcaugugcgugcacacaca

SEQ ID NO: 558398 - RNA, 22 nt, Human
acacaggcacaugcuuguccuc

SEQ ID NO: 558399 - RNA, 20 nt, Human
acaggcacaugcuuguccuc

SEQ ID NO: 558400 - RNA, 18 nt, Human
accggcagggcccagugg

SEQ ID NO: 558401 - RNA, 20 nt, Human
acuuguucccgucagcagau

SEQ ID NO: 558402 - RNA, 24 nt, Human
agagagccuggccuagagccuggc

SEQ ID NO: 558403 - RNA, 21 nt, Human
agagcucugcccucugcccuc

SEQ ID NO: 558404 - RNA, 22 nt, Human
agagcucugcccucugcccucc

SEQ ID NO: 558405 - RNA, 24 nt, Human
agccggcgccgcagcucgagcgcg

SEQ ID NO: 558406 - RNA, 20 nt, Human
agcucugcccucugcccucc

SEQ ID NO: 558407 - RNA, 18 nt, Human
aggaucagcgacccugga

SEQ ID NO: 558408 - RNA, 18 nt, Human
aggcaaacgcaccugggg

SEQ ID NO: 558409 - RNA, 20 nt, Human
aggcaauaaaugguggguua

SEQ ID NO: 558410 - RNA, 19 nt, Human
aggccagcugaagacagga

SEQ ID NO: 558411 - RNA, 23 nt, Human
aggcggcaggaggaggcgggggc

SEQ ID NO: 558412 - RNA, 19 nt, Human
aggguccagcggcgcugcc

SEQ ID NO: 558413 - RNA, 19 nt, Human
agguuuuuggaggacaacu

SEQ ID NO: 558414 - RNA, 21 nt, Human
agugaagaucgggguggcaga

SEQ ID NO: 558415 - RNA, 20 nt, Human
caaagaacaucuacuuccag

SEQ ID NO: 558416 - RNA, 21 nt, Human
caacggcuuaguggggucugc

SEQ ID NO: 558417 - RNA, 22 nt, Human
caacucugacaaggagcaaaga

SEQ ID NO: 558418 - RNA, 21 nt, Human
caagaaccugcaggcugggau

SEQ ID NO: 558419 - RNA, 18 nt, Human
cacacacacacacacaca

SEQ ID NO: 558420 - RNA, 20 nt, Human
cacacacacacacacacaca

SEQ ID NO: 558421 - RNA, 20 nt, Human
cacacacacacacacacaca

SEQ ID NO: 558422 - RNA, 20 nt, Human
cacacacacacacacacaca

SEQ ID NO: 558423 - RNA, 24 nt, Human
cacacacacauauacacacacaca

SEQ ID NO: 558424 - RNA, 18 nt, Human
cacacaggcacaugcuug

SEQ ID NO: 558425 - RNA, 22 nt, Human
cacagagugaggcagcccuucg

SEQ ID NO: 558426 - RNA, 21 nt, Human
cacagcccagugccugacacc

SEQ ID NO: 558427 - RNA, 24 nt, Human
cacccgaggagccacggcagacau

SEQ ID NO: 558428 - RNA, 18 nt, Human
cacccuugcuguugggcu

SEQ ID NO: 558429 - RNA, 19 nt, Human
cacccuugcuguugggcuu

SEQ ID NO: 558430 - RNA, 22 nt, Human
caccugcuccuuaucaccuuug

SEQ ID NO: 558431 - RNA, 24 nt, Human
caccugcuccuuaucaccuuugug

SEQ ID NO: 558432 - RNA, 24 nt, Human
caccugcuucuccaagaaccugca

SEQ ID NO: 558433 - RNA, 21 nt, Human
caccuggagcuauuguuggca

SEQ ID NO: 558434 - RNA, 18 nt, Human
cagaaagcaacaaccccu

SEQ ID NO: 558435 - RNA, 19 nt, Human
cagaaggcaauaaauggug

SEQ ID NO: 558436 - RNA, 18 nt, Human
cagaaguggccagagcuc

SEQ ID NO: 558437 - RNA, 23 nt, Human
cagagcucugcccucugcccucc

SEQ ID NO: 558438 - RNA, 20 nt, Human
cagagggugucccugugguc

SEQ ID NO: 558439 - RNA, 18 nt, Human
cagcaaagcaccugcucc

SEQ ID NO: 558440 - RNA, 22 nt, Human
cagcaacugcaggagggcaugc

SEQ ID NO: 558441 - RNA, 23 nt, Human
cagccaccacugccuaggcaaac

SEQ ID NO: 558442 - RNA, 26 nt, Human
cagccgcugcguggcugccaggccug

SEQ ID NO: 558443 - RNA, 24 nt, Human
cagcucgacaggggccugcagcgg

SEQ ID NO: 558444 - RNA, 20 nt, Human
cagcucgagcgcgagccuca

SEQ ID NO: 558445 - RNA, 22 nt, Human
caggaagagacucaacggcuua

SEQ ID NO: 558446 - RNA, 18 nt, Human
caggagccggcgccgcag

SEQ ID NO: 558447 - RNA, 21 nt, Human
cagugugggagggagggcugg

SEQ ID NO: 558448 - RNA, 20 nt, Human
caguucuccugcacgagccc

SEQ ID NO: 558449 - RNA, 23 nt, Human
caguucuccugcacgagccccac

SEQ ID NO: 558450 - RNA, 19 nt, Human
caucagugggggcuguggg

SEQ ID NO: 558451 - RNA, 21 nt, Human
ccaagucagccucuucaacuc

SEQ ID NO: 558452 - RNA, 21 nt, Human
ccacccgaggagccacggcag

SEQ ID NO: 558453 - RNA, 24 nt, Human
ccacugccuaggcaaacgcaccug

SEQ ID NO: 558454 - RNA, 23 nt, Human
ccagccuggcagcccccucccug

SEQ ID NO: 558455 - RNA, 21 nt, Human
ccaggaagagacucaacggcu

SEQ ID NO: 558456 - RNA, 20 nt, Human
ccaggccugacacagucaca

SEQ ID NO: 558457 - RNA, 20 nt, Human
cccaaaagacagaaacgcuc

SEQ ID NO: 558458 - RNA, 22 nt, Human
cccaaagaugucagguccccau

SEQ ID NO: 558459 - RNA, 24 nt, Human
cccacagaugccugcaggcucugg

SEQ ID NO: 558460 - RNA, 23 nt, Human
cccacuggguucucaucucucca

SEQ ID NO: 558461 - RNA, 22 nt, Human
cccagaaagcaacaaccccucc

SEQ ID NO: 558462 - RNA, 22 nt, Human
cccaggaccugcagcaggaggc

SEQ ID NO: 558463 - RNA, 19 nt, Human
ccccacagaugccugcagg

SEQ ID NO: 558464 - RNA, 23 nt, Human
ccccagaaagcaacaaccccucc

SEQ ID NO: 558465 - RNA, 19 nt, Human
ccccagaaccacacuggcu

SEQ ID NO: 558466 - RNA, 20 nt, Human
ccccagggccacuggcuucu

SEQ ID NO: 558467 - RNA, 24 nt, Human
cccccaaccgcagcaucaagccuc

SEQ ID NO: 558468 - RNA, 22 nt, Human
ccccgagggauggcagccacca

SEQ ID NO: 558469 - RNA, 20 nt, Human
cccgagggauggcagccacc

SEQ ID NO: 558470 - RNA, 21 nt, Human
cccgggucagggcacggggcu

SEQ ID NO: 558471 - RNA, 19 nt, Human
cccuaaugaagugggcaga

SEQ ID NO: 558472 - RNA, 18 nt, Human
cccuccugcugcccccac

SEQ ID NO: 558473 - RNA, 19 nt, Human
cccuuccucuccugcagcc

SEQ ID NO: 558474 - RNA, 21 nt, Human
cccuugccaaguacaagaguc

SEQ ID NO: 558475 - RNA, 19 nt, Human
ccgagggauggcagccacc

SEQ ID NO: 558476 - RNA, 21 nt, Human
ccuaggcaaagcugccggccc

SEQ ID NO: 558477 - RNA, 20 nt, Human
ccucccuuuccucccguucc

SEQ ID NO: 558478 - RNA, 20 nt, Human
ccucugagccuccuaggguc

SEQ ID NO: 558479 - RNA, 23 nt, Human
ccucuucccagucaugggggcgg

SEQ ID NO: 558480 - RNA, 19 nt, Human
ccucuuggccagcugcgcc

SEQ ID NO: 558481 - RNA, 26 nt, Human
ccucuuguccucucaccgaccugcaa

SEQ ID NO: 558482 - RNA, 19 nt, Human
ccugcagcggcaucagugg

SEQ ID NO: 558483 - RNA, 20 nt, Human
ccuggccaggaacaggugcu

SEQ ID NO: 558484 - RNA, 20 nt, Human
ccugugggugccacagggcu

SEQ ID NO: 558485 - RNA, 21 nt, Human
ccuuagcugggagaacaaagc

SEQ ID NO: 558486 - RNA, 19 nt, Human
ccuuguccuucccucccac

SEQ ID NO: 558487 - RNA, 20 nt, Human
cgaaaagaggugaaggacaa

SEQ ID NO: 558488 - RNA, 19 nt, Human
cgcugcguggcugccaggc

SEQ ID NO: 558489 - RNA, 20 nt, Human
cggccagggcaacugcccgg

SEQ ID NO: 558490 - RNA, 19 nt, Human
cggcuuaguggggucugcc

SEQ ID NO: 558491 - RNA, 22 nt, Human
cggggcugaggcaccuggagcu

SEQ ID NO: 558492 - RNA, 22 nt, Human
cgggggcaggggugcugggaag

SEQ ID NO: 558493 - RNA, 19 nt, Human
cucacccaccucucagaag

SEQ ID NO: 558494 - RNA, 22 nt, Human
cucaucucuccaaguggcggag

SEQ ID NO: 558495 - RNA, 21 nt, Human
cuccagcucgcuugaguccau

SEQ ID NO: 558496 - RNA, 18 nt, Human
cucccacaccacugccuc

SEQ ID NO: 558497 - RNA, 22 nt, Human
cuccccagaaagcaacaacccc

SEQ ID NO: 558498 - RNA, 20 nt, Human
cugccaggagucacccuugc

SEQ ID NO: 558499 - RNA, 18 nt, Human
cugccucccuuuccuccc

SEQ ID NO: 558500 - RNA, 21 nt, Human
cugcugcccccaccugccagg

SEQ ID NO: 558501 - RNA, 22 nt, Human
cugcuggggcagugugggaggg

SEQ ID NO: 558502 - RNA, 23 nt, Human
cuggagaguccuaggcaaagcug

SEQ ID NO: 558503 - RNA, 19 nt, Human
cugggcggccagggcaacu

SEQ ID NO: 558504 - RNA, 25 nt, Human
gaaaaguacucucccaaaagacaga

SEQ ID NO: 558505 - RNA, 18 nt, Human
gaagugcuguggggggac

SEQ ID NO: 558506 - RNA, 22 nt, Human
gaccccacuggguucucaucuc

SEQ ID NO: 558507 - RNA, 18 nt, Human
gagagaaaggggaggcgg

SEQ ID NO: 558508 - RNA, 21 nt, Human
gagcggagggagccggugggc

SEQ ID NO: 558509 - RNA, 29 nt, Human
gagcuauuguuggcaugugguuguugcaa

SEQ ID NO: 558510 - RNA, 22 nt, Human
gaggaagauggguccacaaaga

SEQ ID NO: 558511 - RNA, 23 nt, Human
gaggaagauggguccacaaagag

SEQ ID NO: 558512 - RNA, 23 nt, Human
gaggcggcaggaggaggcggggg

SEQ ID NO: 558513 - RNA, 21 nt, Human
gaguggcaggaggaggccggg

SEQ ID NO: 558514 - RNA, 18 nt, Human
gcagugugggagggaggg

SEQ ID NO: 558515 - RNA, 22 nt, Human
gcagugugggagggagggcugg

SEQ ID NO: 558516 - RNA, 18 nt, Human
gcccaggaccugcagcag

SEQ ID NO: 558517 - RNA, 23 nt, Human
gccccgcccgccucuuggccagc

SEQ ID NO: 558518 - RNA, 22 nt, Human
gccguucuggagggacagaggc

SEQ ID NO: 558519 - RNA, 23 nt, Human
gcgcugccacaggccucuuccca

SEQ ID NO: 558520 - RNA, 18 nt, Human
gcgggggcaccuggcugg

SEQ ID NO: 558521 - RNA, 20 nt, Human
gcugcgccguccggcgcugc

SEQ ID NO: 558522 - RNA, 22 nt, Human
gcugcuuccucaaggcccuccu

SEQ ID NO: 558523 - RNA, 20 nt, Human
gcugugccacccaggagucc

SEQ ID NO: 558524 - RNA, 21 nt, Human
ggaagugcuguggggggaccu

SEQ ID NO: 558525 - RNA, 19 nt, Human
ggacuggaaacagaaaggg

SEQ ID NO: 558526 - RNA, 30 nt, Human
ggagcuauuguuggcaugugguuguugcaa

SEQ ID NO: 558527 - RNA, 24 nt, Human
ggaggaagauggguccacaaagag

SEQ ID NO: 558528 - RNA, 22 nt, Human
ggaggaucagcgacccuggaga

SEQ ID NO: 558529 - RNA, 23 nt, Human
ggcaggaggaggccgggccaccc

SEQ ID NO: 558530 - RNA, 22 nt, Human
ggcagggcccaguggcggccgg

SEQ ID NO: 558531 - RNA, 18 nt, Human
ggcaggguccaccccagg

SEQ ID NO: 558532 - RNA, 20 nt, Human
ggccagcccugcuggggcag

SEQ ID NO: 558533 - RNA, 24 nt, Human
ggccuuagcugggagaacaaagcc

SEQ ID NO: 558534 - RNA, 22 nt, Human
ggcggcgguggucuccccgcag

SEQ ID NO: 558535 - RNA, 20 nt, Human
gggaggggccgggcccgggg

SEQ ID NO: 558536 - RNA, 22 nt, Human
gggcccggggcccaggcggcag

SEQ ID NO: 558537 - RNA, 22 nt, Human
ggggccgggcccggggcccagg

SEQ ID NO: 558538 - RNA, 26 nt, Human
gggggcggagugaagggccccuggca

SEQ ID NO: 558539 - RNA, 22 nt, Human
gggggcugugggagccccuucc

SEQ ID NO: 558540 - RNA, 25 nt, Human
ggguggcagaggaggaagauggguc

SEQ ID NO: 558541 - RNA, 19 nt, Human
gggugucagugaggccagc

SEQ ID NO: 558542 - RNA, 18 nt, Human
gguaggugacaggaggga

SEQ ID NO: 558543 - RNA, 21 nt, Human
ggucagagggaccuuucagaa

SEQ ID NO: 558544 - RNA, 24 nt, Human
gguccagcggcgcugccacaggcc

SEQ ID NO: 558545 - RNA, 22 nt, Human
ggugacuccguggugagugagg

SEQ ID NO: 558546 - RNA, 20 nt, Human
ggugagggccugggccccga

SEQ ID NO: 558547 - RNA, 18 nt, Human
uacugugggcugcccagg

SEQ ID NO: 558548 - RNA, 18 nt, Human
uagagccuggccaggaac

SEQ ID NO: 558549 - RNA, 26 nt, Human
uaugaacaauguccccagggaggccg

SEQ ID NO: 558550 - RNA, 19 nt, Human
ucaaccguccuccucccca

SEQ ID NO: 558551 - RNA, 24 nt, Human
ucaaggcccuccuuugcuuucauc

SEQ ID NO: 558552 - RNA, 23 nt, Human
ucagaguggcaggaggaggccgg

SEQ ID NO: 558553 - RNA, 20 nt, Human
uccaaagggcaggguccacc

SEQ ID NO: 558554 - RNA, 18 nt, Human
uccacagaaaucaagagg

SEQ ID NO: 558555 - RNA, 19 nt, Human
uccaggccugacacaguca

SEQ ID NO: 558556 - RNA, 20 nt, Human
ucccaaaagacagaaacgcu

SEQ ID NO: 558557 - RNA, 23 nt, Human
uccccagggaggccgggguguca

SEQ ID NO: 558558 - RNA, 22 nt, Human
uccccgacuuccaggcgacugg

SEQ ID NO: 558559 - RNA, 23 nt, Human
ucccuuuccucccguuccucugg

SEQ ID NO: 558560 - RNA, 20 nt, Human
uccgggccagcccugcuggg

SEQ ID NO: 558561 - RNA, 19 nt, Human
uccucccaugucuucucag

SEQ ID NO: 558562 - RNA, 24 nt, Human
uccugcugcugugccacccaggag

SEQ ID NO: 558563 - RNA, 21 nt, Human
ucucagagggugucccugugg

SEQ ID NO: 558564 - RNA, 20 nt, Human
ucuuccuuguccaggccuga

SEQ ID NO: 558565 - RNA, 18 nt, Human
ugaagaucgggguggcag

SEQ ID NO: 558566 - RNA, 21 nt, Human
ugaagugggcagaaguggcca

SEQ ID NO: 558567 - RNA, 20 nt, Human
ugacaccacagagugaggca

SEQ ID NO: 558568 - RNA, 18 nt, Human
ugagcgccuggcguggcc

SEQ ID NO: 558569 - RNA, 19 nt, Human
ugagcgccuggcguggccu

SEQ ID NO: 558570 - RNA, 23 nt, Human
ugagcucagccgcugcguggcug

SEQ ID NO: 558571 - RNA, 22 nt, Human
ugaggcagaggcuuccacggac

SEQ ID NO: 558572 - RNA, 20 nt, Human
ugagggccugggccccgagg

SEQ ID NO: 558573 - RNA, 20 nt, Human
ugagugagguuuuuggagga

SEQ ID NO: 558574 - RNA, 22 nt, Human
ugcaguuuguccucuuccuggu

SEQ ID NO: 558575 - RNA, 18 nt, Human
ugccacaggccucuuccc

SEQ ID NO: 558576 - RNA, 20 nt, Human
ugccacagggcuccucaggu

SEQ ID NO: 558577 - RNA, 20 nt, Human
ugccaggccugggggcugcu

SEQ ID NO: 558578 - RNA, 20 nt, Human
ugcccgugugccuguauccu

SEQ ID NO: 558579 - RNA, 24 nt, Human
ugcccuccugcugcccccaccugc

SEQ ID NO: 558580 - RNA, 20 nt, Human
ugcgugcacacacacacaua

SEQ ID NO: 558581 - RNA, 21 nt, Human
ugcguggcugccaggccuggg

SEQ ID NO: 558582 - RNA, 18 nt, Human
ugcucugcgcccacugca

SEQ ID NO: 558583 - RNA, 21 nt, Human
ugcuggggcagugugggaggg

SEQ ID NO: 558584 - RNA, 21 nt, Human
uggagaguccuaggcaaagcu

SEQ ID NO: 558585 - RNA, 22 nt, Human
uggaggacaacuggucaucaca

SEQ ID NO: 558586 - RNA, 20 nt, Human
uggcagaggaggaagauggg

SEQ ID NO: 558587 - RNA, 21 nt, Human
uggcaggaggaggccgggcca

SEQ ID NO: 558588 - RNA, 20 nt, Human
uggcuggcccugccucugcc

SEQ ID NO: 558589 - RNA, 19 nt, Human
uggggacccaaagauguca

SEQ ID NO: 558590 - RNA, 22 nt, Human
uggguccacaaagaggccuggg

SEQ ID NO: 558591 - RNA, 23 nt, Human
ugggugccacagggcuccucagg

SEQ ID NO: 558592 - RNA, 23 nt, Human
uguauccuccuggggccagcacc

SEQ ID NO: 558593 - RNA, 23 nt, Human
uuagcagugggccaagucagccu

SEQ ID NO: 558594 - RNA, 18 nt, Human
uuccucaaggcccuccuu

SEQ ID NO: 558595 - RNA, 22 nt, Human
uuccucccguuccucugggccu

SEQ ID NO: 558596 - RNA, 23 nt, Human
uuguugcacagaugagcccuugg

SEQ ID NO: 558597 - RNA, 18 nt, Human
uuuguucuuggacuuggg

SEQ ID NO: 558598 - RNA, 23 nt, Human
aaagacaagaaaaaauggggcuc

SEQ ID NO: 558599 - RNA, 23 nt, Human
aaccccagugacccuggcaucca

SEQ ID NO: 558600 - RNA, 20 nt, Human
aagaaaaaauggggcuuggg

SEQ ID NO: 558601 - RNA, 18 nt, Human
aaucucaucuucccauca

SEQ ID NO: 558602 - RNA, 20 nt, Human
aaucugagaaggccuccccu

SEQ ID NO: 558603 - RNA, 23 nt, Human
accacuguguucucugugggcag

SEQ ID NO: 558604 - RNA, 21 nt, Human
accccagagcuucugcagagc

SEQ ID NO: 558605 - RNA, 19 nt, Human
agaggggagggccaagcag

SEQ ID NO: 558606 - RNA, 18 nt, Human
agauagggacagcagcau

SEQ ID NO: 558607 - RNA, 23 nt, Human
agaugauagaacaaugggaaaaa

SEQ ID NO: 558608 - RNA, 23 nt, Human
agccaagcaaaccagacacuucu

SEQ ID NO: 558609 - RNA, 20 nt, Human
agcuggacacagcuugaaca

SEQ ID NO: 558610 - RNA, 23 nt, Human
aggaaggaaaaagccgcccccgg

SEQ ID NO: 558611 - RNA, 19 nt, Human
aggagcuggggcucuggug

SEQ ID NO: 558612 - RNA, 23 nt, Human
aggagcuggggcucugguggggg

SEQ ID NO: 558613 - RNA, 19 nt, Human
aggcaaaugggcagccaag

SEQ ID NO: 558614 - RNA, 18 nt, Human
aggcggucagccacugga

SEQ ID NO: 558615 - RNA, 19 nt, Human
agggaaaggggggcugagg

SEQ ID NO: 558616 - RNA, 21 nt, Human
agggaaaggggggcugaggga

SEQ ID NO: 558617 - RNA, 19 nt, Human
aggguggggaaagaggugg

SEQ ID NO: 558618 - RNA, 23 nt, Human
agucucuucuccuuccccugccu

SEQ ID NO: 558619 - RNA, 23 nt, Human
aguugcacagucucaggcugggg

SEQ ID NO: 558620 - RNA, 21 nt, Human
aucaccuacuuaaacuauuua

SEQ ID NO: 558621 - RNA, 18 nt, Human
aucaggcaccugauccca

SEQ ID NO: 558622 - RNA, 24 nt, Human
augcugaaagaacguaagaaacaa

SEQ ID NO: 558623 - RNA, 18 nt, Human
auucccaaggccuguucc

SEQ ID NO: 558624 - RNA, 24 nt, Human
caaaagugggccuuggcucuuucc

SEQ ID NO: 558625 - RNA, 23 nt, Human
caaaccagacacuucugaucacc

SEQ ID NO: 558626 - RNA, 25 nt, Human
caacaggcugccugccccgccuucc

SEQ ID NO: 558627 - RNA, 21 nt, Human
caauggcugcccucugcuugc

SEQ ID NO: 558628 - RNA, 18 nt, Human
cacagucucaggcugggg

SEQ ID NO: 558629 - RNA, 22 nt, Human
cacauugagaagcgcuauggac

SEQ ID NO: 558630 - RNA, 19 nt, Human
caccaaacucaggaugucc

SEQ ID NO: 558631 - RNA, 22 nt, Human
caccagguaggaaaacacagcc

SEQ ID NO: 558632 - RNA, 18 nt, Human
cacccuuggaggugaggg

SEQ ID NO: 558633 - RNA, 19 nt, Human
caccgcuccggugcccuuc

SEQ ID NO: 558634 - RNA, 19 nt, Human
caccgcuccggugcccuuc

SEQ ID NO: 558635 - RNA, 22 nt, Human
caccguaggcccccugcccucu

SEQ ID NO: 558636 - RNA, 18 nt, Human
caccuccugggccggcuu

SEQ ID NO: 558637 - RNA, 22 nt, Human
cagaauggaggacucagggaca

SEQ ID NO: 558638 - RNA, 24 nt, Human
cagcaagaggccuccacuuguccg

SEQ ID NO: 558639 - RNA, 19 nt, Human
cagcagauccgccucccuc

SEQ ID NO: 558640 - RNA, 19 nt, Human
cagccaagcaaaccagaca

SEQ ID NO: 558641 - RNA, 22 nt, Human
cagccccucagucucuucuccu

SEQ ID NO: 558642 - RNA, 19 nt, Human
cagccgcagcaagaggccu

SEQ ID NO: 558643 - RNA, 21 nt, Human
cagccucugaguugugguccu

SEQ ID NO: 558644 - RNA, 22 nt, Human
cagcuccugauucccaaggccu

SEQ ID NO: 558645 - RNA, 24 nt, Human
caggaagcgaagcuuucaccuccu

SEQ ID NO: 558646 - RNA, 18 nt, Human
caggacggagcccccucc

SEQ ID NO: 558647 - RNA, 24 nt, Human
cagucucuucuccuuccccugccu

SEQ ID NO: 558648 - RNA, 19 nt, Human
cagugcaccugggcucugc

SEQ ID NO: 558649 - RNA, 19 nt, Human
caucuccgcuccagcaagg

SEQ ID NO: 558650 - RNA, 23 nt, Human
caugaagggaaauggaaauguua

SEQ ID NO: 558651 - RNA, 22 nt, Human
ccaagcccagggcugcccacuc

SEQ ID NO: 558652 - RNA, 19 nt, Human
ccacuggacagcacugccc

SEQ ID NO: 558653 - RNA, 18 nt, Human
ccagacacuucugaucac

SEQ ID NO: 558654 - RNA, 18 nt, Human
ccaggggguggucagggg

SEQ ID NO: 558655 - RNA, 23 nt, Human
cccaacaccucgcuccauaugau

SEQ ID NO: 558656 - RNA, 21 nt, Human
cccaaccccagugacccuggc

SEQ ID NO: 558657 - RNA, 23 nt, Human
cccagcccaaccccagugacccu

SEQ ID NO: 558658 - RNA, 26 nt, Human
cccagcccaaccccagugacccuggc

SEQ ID NO: 558659 - RNA, 20 nt, Human
cccagcugagggaccagcuc

SEQ ID NO: 558660 - RNA, 22 nt, Human
cccagugacccuggcauccaga

SEQ ID NO: 558661 - RNA, 23 nt, Human
cccaucaucacacagugcaccug

SEQ ID NO: 558662 - RNA, 18 nt, Human
ccccacagacaggagcug

SEQ ID NO: 558663 - RNA, 25 nt, Human
ccccagagauuucaggcauuucacc

SEQ ID NO: 558664 - RNA, 18 nt, Human
ccccagcccaaccccagu

SEQ ID NO: 558665 - RNA, 20 nt, Human
ccccagguccuagccagccc

SEQ ID NO: 558666 - RNA, 22 nt, Human
ccccagugacccuggcauccag

SEQ ID NO: 558667 - RNA, 18 nt, Human
ccccaguguucccucccc

SEQ ID NO: 558668 - RNA, 21 nt, Human
ccccccagcugagggaccagc

SEQ ID NO: 558669 - RNA, 27 nt, Human
cccccgaguaaacugcaggcuuagccu

SEQ ID NO: 558670 - RNA, 24 nt, Human
cccccugagaggccacagccccag

SEQ ID NO: 558671 - RNA, 18 nt, Human
cccccugcccucuuagca

SEQ ID NO: 558672 - RNA, 18 nt, Human
ccccgccuuccccaacac

SEQ ID NO: 558673 - RNA, 20 nt, Human
ccccugagaggccacagccc

SEQ ID NO: 558674 - RNA, 21 nt, Human
cccguggugggccccuaaagc

SEQ ID NO: 558675 - RNA, 26 nt, Human
cccuccacuggacagcacugcccccc

SEQ ID NO: 558676 - RNA, 21 nt, Human
cccugcccguggugggccccu

SEQ ID NO: 558677 - RNA, 18 nt, Human
ccgcccccggacagggga

SEQ ID NO: 558678 - RNA, 21 nt, Human
ccgguccuagagaugauagaa

SEQ ID NO: 558679 - RNA, 19 nt, Human
ccguaggcccccugcccuc

SEQ ID NO: 558680 - RNA, 29 nt, Human
ccucacuccccuccucccugcuguccagg

SEQ ID NO: 558681 - RNA, 21 nt, Human
ccuccagcagauccgccuccc

SEQ ID NO: 558682 - RNA, 22 nt, Human
ccuccagccugcaggacggagc

SEQ ID NO: 558683 - RNA, 18 nt, Human
ccucccagguuccgggug

SEQ ID NO: 558684 - RNA, 21 nt, Human
ccuccccuaccuuaggccaga

SEQ ID NO: 558685 - RNA, 22 nt, Human
ccuccccuuucucucagguguc

SEQ ID NO: 558686 - RNA, 24 nt, Human
ccucccucugcugccaggucugaa

SEQ ID NO: 558687 - RNA, 24 nt, Human
ccucugcuugcuguaggaucugau

SEQ ID NO: 558688 - RNA, 23 nt, Human
ccugccccgccuuccccaacacc

SEQ ID NO: 558689 - RNA, 20 nt, Human
ccuggcauccagaguggggg

SEQ ID NO: 558690 - RNA, 22 nt, Human
ccuugccuccauugcagccgca

SEQ ID NO: 558691 - RNA, 18 nt, Human
cggcucccugaacccccc

SEQ ID NO: 558692 - RNA, 24 nt, Human
cgugaaagcccuccccuccacugg

SEQ ID NO: 558693 - RNA, 18 nt, Human
cgugauggcucccccaca

SEQ ID NO: 558694 - RNA, 19 nt, Human
cuaccacagggagcaggga

SEQ ID NO: 558695 - RNA, 21 nt, Human
cuccagcagauccgccucccu

SEQ ID NO: 558696 - RNA, 20 nt, Human
cuccccuaccuuaggccaga

SEQ ID NO: 558697 - RNA, 23 nt, Human
cucccugaaccccccgaguaaac

SEQ ID NO: 558698 - RNA, 22 nt, Human
cucuaccacagggagcagggag

SEQ ID NO: 558699 - RNA, 18 nt, Human
cucuccccagcccaaccc

SEQ ID NO: 558700 - RNA, 23 nt, Human
cugaucaccagguaggaaaacac

SEQ ID NO: 558701 - RNA, 22 nt, Human
cuggcauccagagugggguggg

SEQ ID NO: 558702 - RNA, 18 nt, Human
gaaaaagccgcccccgga

SEQ ID NO: 558703 - RNA, 21 nt, Human
gaaguagccaccaaacucagg

SEQ ID NO: 558704 - RNA, 25 nt, Human
gaccuugauggaugguuuccagccc

SEQ ID NO: 558705 - RNA, 22 nt, Human
gagaggccacagccccaggucc

SEQ ID NO: 558706 - RNA, 24 nt, Human
gagcccccucccaucaucacacag

SEQ ID NO: 558707 - RNA, 18 nt, Human
gagcguggcagcugggag

SEQ ID NO: 558708 - RNA, 18 nt, Human
gaggcccaggcccuggcc

SEQ ID NO: 558709 - RNA, 20 nt, Human
gagguagggaagguccugga

SEQ ID NO: 558710 - RNA, 19 nt, Human
gaggugaggguggaaauaa

SEQ ID NO: 558711 - RNA, 21 nt, Human
gcuuggggaaauuggggcuuc

SEQ ID NO: 558712 - RNA, 22 nt, Human
ggaaauguuacccucacucccc

SEQ ID NO: 558713 - RNA, 21 nt, Human
ggaaauuggggcuucuggggu

SEQ ID NO: 558714 - RNA, 22 nt, Human
ggaagguccuggagccccaggg

SEQ ID NO: 558715 - RNA, 19 nt, Human
ggagcccccucccaucauc

SEQ ID NO: 558716 - RNA, 22 nt, Human
ggagcuggggcucugguggggg

SEQ ID NO: 558717 - RNA, 26 nt, Human
ggaggggcccaagcccagggcugccc

SEQ ID NO: 558718 - RNA, 20 nt, Human
ggcaggugcuccagggaaag

SEQ ID NO: 558719 - RNA, 22 nt, Human
ggcggcggcugcaucuccgcuc

SEQ ID NO: 558720 - RNA, 20 nt, Human
ggcugcccccugagaggcca

SEQ ID NO: 558721 - RNA, 20 nt, Human
gggacugcacugggcugggc

SEQ ID NO: 558722 - RNA, 24 nt, Human
ggggcuuggggaaauuggggcuuc

SEQ ID NO: 558723 - RNA, 21 nt, Human
ggggucugggggagggcagcc

SEQ ID NO: 558724 - RNA, 19 nt, Human
ggucacagccccucagucu

SEQ ID NO: 558725 - RNA, 24 nt, Human
uaaagcaauagcaccguaggcccc

SEQ ID NO: 558726 - RNA, 21 nt, Human
uacuuaaacuauuuaagccuu

SEQ ID NO: 558727 - RNA, 20 nt, Human
uacuuccaccuggaguugca

SEQ ID NO: 558728 - RNA, 18 nt, Human
uagauaaagacaagaaaa

SEQ ID NO: 558729 - RNA, 24 nt, Human
uaggaaaacacagccgggacugca

SEQ ID NO: 558730 - RNA, 27 nt, Human
uagggucaugacagaagagaagguagu

SEQ ID NO: 558731 - RNA, 21 nt, Human
ucacagccccucagucucuuc

SEQ ID NO: 558732 - RNA, 18 nt, Human
ucacugggggucaaggcu

SEQ ID NO: 558733 - RNA, 18 nt, Human
ucagaccauuacagcugc

SEQ ID NO: 558734 - RNA, 20 nt, Human
ucagaccauuacagcugcuu

SEQ ID NO: 558735 - RNA, 20 nt, Human
ucagucucuucuccuucccc

SEQ ID NO: 558736 - RNA, 18 nt, Human
ucauugaugguguggucu

SEQ ID NO: 558737 - RNA, 19 nt, Human
uccaaggaaggaaaaagcc

SEQ ID NO: 558738 - RNA, 27 nt, Human
ucccaaaagugggccuuggcucuuucc

SEQ ID NO: 558739 - RNA, 21 nt, Human
ucccaaggccuguuccucucc

SEQ ID NO: 558740 - RNA, 24 nt, Human
uccccagcccaaccccagugaccc

SEQ ID NO: 558741 - RNA, 22 nt, Human
ucggggcggcggcugcaucucc

SEQ ID NO: 558742 - RNA, 18 nt, Human
ucucauuguugaccccuc

SEQ ID NO: 558743 - RNA, 18 nt, Human
ucuccccagcccaacccu

SEQ ID NO: 558744 - RNA, 22 nt, Human
ucucuaccacagggagcaggga

SEQ ID NO: 558745 - RNA, 20 nt, Human
ucucugugggcagguggggc

SEQ ID NO: 558746 - RNA, 23 nt, Human
ucugggggagggcagcccaaggc

SEQ ID NO: 558747 - RNA, 21 nt, Human
ugaaggaugcucagcuguucc

SEQ ID NO: 558748 - RNA, 20 nt, Human
ugaagggaaauggaaauguu

SEQ ID NO: 558749 - RNA, 18 nt, Human
ugaccccuccccuuucuc

SEQ ID NO: 558750 - RNA, 21 nt, Human
ugacccuggcauccagagugg

SEQ ID NO: 558751 - RNA, 24 nt, Human
ugagaaggccuccccuaccuuagg

SEQ ID NO: 558752 - RNA, 22 nt, Human
ugagggccggagggaggggccc

SEQ ID NO: 558753 - RNA, 18 nt, Human
ugcacugggcugggcucu

SEQ ID NO: 558754 - RNA, 21 nt, Human
ugccaggucugaaggaugcuc

SEQ ID NO: 558755 - RNA, 19 nt, Human
ugccugccccgccuucccc

SEQ ID NO: 558756 - RNA, 18 nt, Human
ugcugaaagaacguaaga

SEQ ID NO: 558757 - RNA, 23 nt, Human
uggaaauguuacccucacucccc

SEQ ID NO: 558758 - RNA, 19 nt, Human
uggagccaggguggggaaa

SEQ ID NO: 558759 - RNA, 19 nt, Human
uggaguugcacagucucag

SEQ ID NO: 558760 - RNA, 21 nt, Human
uggcagggccagggggugggu

SEQ ID NO: 558761 - RNA, 18 nt, Human
uggcauccagaguggggu

SEQ ID NO: 558762 - RNA, 21 nt, Human
uggcauccagagugggguggg

SEQ ID NO: 558763 - RNA, 24 nt, Human
uggccuggccuucgugcccuuuau

SEQ ID NO: 558764 - RNA, 24 nt, Human
uggggaaauuggggcuucuggggu

SEQ ID NO: 558765 - RNA, 20 nt, Human
ugggggagggcagcccaagg

SEQ ID NO: 558766 - RNA, 23 nt, Human
ugguccuaaaccccaguguuccc

SEQ ID NO: 558767 - RNA, 21 nt, Human
uguggaugccaccuccagccu

SEQ ID NO: 558768 - RNA, 19 nt, Human
uucacuuuucggggcggcg

SEQ ID NO: 558769 - RNA, 24 nt, Human
uuccucuccccagcccaaccccag

SEQ ID NO: 558770 - RNA, 23 nt, Human
uuccucuccccagcccaaccccc

SEQ ID NO: 558771 - RNA, 22 nt, Human
uucgugcccuuuauucauuguc

SEQ ID NO: 558772 - RNA, 22 nt, Human
uugaugguguggucugacagcu

SEQ ID NO: 558773 - RNA, 18 nt, Human
aaccccaaccccugcaug

SEQ ID NO: 558774 - RNA, 20 nt, Human
aaggccagcuccagucccaa

SEQ ID NO: 558775 - RNA, 27 nt, Human
acaaagaaaaacuagcguaauccccca

SEQ ID NO: 558776 - RNA, 22 nt, Human
acuagcguaaucccccaaccca

SEQ ID NO: 558777 - RNA, 24 nt, Human
agaaaaacuagcguaaucccccaa

SEQ ID NO: 558778 - RNA, 24 nt, Human
agcuccagucccaaccccaacccc

SEQ ID NO: 558779 - RNA, 22 nt, Human
caaacaggccagguccugccag

SEQ ID NO: 558780 - RNA, 25 nt, Human
caaagaaaaacuagcguaauccccc

SEQ ID NO: 558781 - RNA, 28 nt, Human
caaccccaaccccugcauggcgccgaag

SEQ ID NO: 558782 - RNA, 24 nt, Human
caaggccagcuccagucccaaccc

SEQ ID NO: 558783 - RNA, 21 nt, Human
ccugccaggccuucuucccca

SEQ ID NO: 558784 - RNA, 21 nt, Human
cuccagucccaaccccaaccu

SEQ ID NO: 558785 - RNA, 18 nt, Human
ggcuucgggcaagagcuc

SEQ ID NO: 558786 - RNA, 28 nt, Human
uaaacaaacaggccagguccugcuguaa

SEQ ID NO: 558787 - RNA, 22 nt, Human
uacaaagaaaaacuagcguaau

SEQ ID NO: 558788 - RNA, 20 nt, Human
ucccaaccccaaccccugca

SEQ ID NO: 558789 - RNA, 24 nt, Human
ucccaaccccaaccccugcauggc

SEQ ID NO: 558790 - RNA, 21 nt, Human
uuaaacaaacaggccaggucc

SEQ ID NO: 558791 - RNA, 18 nt, Human
uuuuaaacaaacaggcca

SEQ ID NO: 558792 - RNA, 22 nt, Human
aacaaagaccugaguggagaag

SEQ ID NO: 558793 - RNA, 22 nt, Human
aacaugagcaaggaggcugaag

SEQ ID NO: 558794 - RNA, 19 nt, Human
aacccucccuccaccucug

SEQ ID NO: 558795 - RNA, 19 nt, Human
aagaggccaggcgacuggu

SEQ ID NO: 558796 - RNA, 26 nt, Human
aagccccuuuccauucuggggcacuc

SEQ ID NO: 558797 - RNA, 20 nt, Human
aauagcccuccucuuccuga

SEQ ID NO: 558798 - RNA, 19 nt, Human
aauccgccaacaucugccu

SEQ ID NO: 558799 - RNA, 18 nt, Human
aaucgcuugaaccuggga

SEQ ID NO: 558800 - RNA, 24 nt, Human
aaucgcuugaaccugggaggcaga

SEQ ID NO: 558801 - RNA, 25 nt, Human
acaaugggucaggacuaaguaagcc

SEQ ID NO: 558802 - RNA, 24 nt, Human
acagagccagacccugucuuaaaa

SEQ ID NO: 558803 - RNA, 19 nt, Human
accauugcacuccagccug

SEQ ID NO: 558804 - RNA, 24 nt, Human
accauugcacuccagccuggguga

SEQ ID NO: 558805 - RNA, 19 nt, Human
acccagagccugacugcac

SEQ ID NO: 558806 - RNA, 18 nt, Human
accccaacccucccucca

SEQ ID NO: 558807 - RNA, 19 nt, Human
accccaacccucccuccac

SEQ ID NO: 558808 - RNA, 19 nt, Human
acccgcuuccugaaccccc

SEQ ID NO: 558809 - RNA, 20 nt, Human
acgagcccugucuuggcccu

SEQ ID NO: 558810 - RNA, 18 nt, Human
acgauaagcccacccagc

SEQ ID NO: 558811 - RNA, 18 nt, Human
acgggugaagguggguca

SEQ ID NO: 558812 - RNA, 20 nt, Human
agaaaaaggagaggcaagga

SEQ ID NO: 558813 - RNA, 21 nt, Human
agaaaaaggagaggcaaggag

SEQ ID NO: 558814 - RNA, 24 nt, Human
agaaggaaaaagccacacaccugg

SEQ ID NO: 558815 - RNA, 20 nt, Human
agacagcacugcgucacgcg

SEQ ID NO: 558816 - RNA, 19 nt, Human
agacccgcuuccugaaccc

SEQ ID NO: 558817 - RNA, 18 nt, Human
agagaggggagaagaggc

SEQ ID NO: 558818 - RNA, 18 nt, Human
agagguugcagugagccg

SEQ ID NO: 558819 - RNA, 23 nt, Human
agagguugcagugagccgagauc

SEQ ID NO: 558820 - RNA, 24 nt, Human
agagguugcagugagccgagauca

SEQ ID NO: 558821 - RNA, 21 nt, Human
agauccgcccgcuggagaggg

SEQ ID NO: 558822 - RNA, 18 nt, Human
agcccacccagcccuccc

SEQ ID NO: 558823 - RNA, 18 nt, Human
agccugccucucuccucc

SEQ ID NO: 558824 - RNA, 21 nt, Human
agcgccacaaaucggcagcag

SEQ ID NO: 558825 - RNA, 18 nt, Human
agcgggugcagcagccca

SEQ ID NO: 558826 - RNA, 20 nt, Human
agcgggugcagcagcccagg

SEQ ID NO: 558827 - RNA, 19 nt, Human
agcugaaggucugguuugg

SEQ ID NO: 558828 - RNA, 25 nt, Human
aggaaaaagccacacaccuggagga

SEQ ID NO: 558829 - RNA, 23 nt, Human
aggaaacgcccacucuguccuca

SEQ ID NO: 558830 - RNA, 18 nt, Human
aggaagccuggggccugu

SEQ ID NO: 558831 - RNA, 18 nt, Human
aggcagaaucuaccugug

SEQ ID NO: 558832 - RNA, 18 nt, Human
aggcagaaucuaccugug

SEQ ID NO: 558833 - RNA, 21 nt, Human
aggcagagguugcagugagcc

SEQ ID NO: 558834 - RNA, 24 nt, Human
aggcagagguugcagugagccgag

SEQ ID NO: 558835 - RNA, 25 nt, Human
aggcagcucagacaaccucacuguc

SEQ ID NO: 558836 - RNA, 22 nt, Human
aggcaggagaaucgcuugaacc

SEQ ID NO: 558837 - RNA, 24 nt, Human
aggcaggagaaucgcuugaaccug

SEQ ID NO: 558838 - RNA, 20 nt, Human
aggcugaggcaggagaaucg

SEQ ID NO: 558839 - RNA, 24 nt, Human
aggcugaggcaggagaaucgcuug

SEQ ID NO: 558840 - RNA, 20 nt, Human
agggaaccugcaggcagcuc

SEQ ID NO: 558841 - RNA, 18 nt, Human
agggcaggaagcaaacuu

SEQ ID NO: 558842 - RNA, 18 nt, Human
agggcgcacguggggucu

SEQ ID NO: 558843 - RNA, 23 nt, Human
aggucggggagcucccagcugga

SEQ ID NO: 558844 - RNA, 23 nt, Human
aggugccgagagccggggaggcc

SEQ ID NO: 558845 - RNA, 22 nt, Human
aguaagcccuggagcuccagug

SEQ ID NO: 558846 - RNA, 25 nt, Human
aucagcucccccuccuccugccccu

SEQ ID NO: 558847 - RNA, 24 nt, Human
aucauaccauugcacuccagccug

SEQ ID NO: 558848 - RNA, 24 nt, Human
augagcaaggaggcugaaggagca

SEQ ID NO: 558849 - RNA, 21 nt, Human
auugcacuccagccuggguga

SEQ ID NO: 558850 - RNA, 24 nt, Human
auugcacuccagccugggugacag

SEQ ID NO: 558851 - RNA, 20 nt, Human
caacccucccuccaccucug

SEQ ID NO: 558852 - RNA, 22 nt, Human
caagacuucccuagagcuuggg

SEQ ID NO: 558853 - RNA, 24 nt, Human
caagcuggaaggagcguggcuuca

SEQ ID NO: 558854 - RNA, 19 nt, Human
cacacagugcuuacacuug

SEQ ID NO: 558855 - RNA, 21 nt, Human
cacaccuggaggaagggccag

SEQ ID NO: 558856 - RNA, 23 nt, Human
cacagccccucuccgcaggugca

SEQ ID NO: 558857 - RNA, 19 nt, Human
cacagugagauccgcccgc

SEQ ID NO: 558858 - RNA, 24 nt, Human
caccccccgccagagcucacagcc

SEQ ID NO: 558859 - RNA, 21 nt, Human
cacccugagggcgcacguggg

SEQ ID NO: 558860 - RNA, 19 nt, Human
cacccuucucccaagacaa

SEQ ID NO: 558861 - RNA, 24 nt, Human
caccgugccagccggcagcuccag

SEQ ID NO: 558862 - RNA, 21 nt, Human
caccuguugcucuccacugug

SEQ ID NO: 558863 - RNA, 22 nt, Human
cacuccagccugggugacagag

SEQ ID NO: 558864 - RNA, 23 nt, Human
cacuccagccugggugacagagc

SEQ ID NO: 558865 - RNA, 18 nt, Human
cacugugccagcccagcu

SEQ ID NO: 558866 - RNA, 19 nt, Human
cagcaaaauagcccuccuc

SEQ ID NO: 558867 - RNA, 25 nt, Human
cagcaaaauagcccuccucuuccug

SEQ ID NO: 558868 - RNA, 21 nt, Human
cagcagcccacagacaauccg

SEQ ID NO: 558869 - RNA, 18 nt, Human
cagcagcccaggguccac

SEQ ID NO: 558870 - RNA, 24 nt, Human
cagcaggcaggaugacaacagggu

SEQ ID NO: 558871 - RNA, 22 nt, Human
cagcagucaguggaagcuucug

SEQ ID NO: 558872 - RNA, 22 nt, Human
cagcaguguggaucugucucuu

SEQ ID NO: 558873 - RNA, 18 nt, Human
cagccacaggggccgggg

SEQ ID NO: 558874 - RNA, 18 nt, Human
cagccagccacaggggcc

SEQ ID NO: 558875 - RNA, 18 nt, Human
cagccccugaguacccag

SEQ ID NO: 558876 - RNA, 21 nt, Human
cagccccugaguacccagacu

SEQ ID NO: 558877 - RNA, 24 nt, Human
cagcuacucgggaggcugaggcag

SEQ ID NO: 558878 - RNA, 21 nt, Human
cagcucccccuccuccugccc

SEQ ID NO: 558879 - RNA, 22 nt, Human
cagcucccccuccuccugcccc

SEQ ID NO: 558880 - RNA, 18 nt, Human
cagcuggacaauggaaug

SEQ ID NO: 558881 - RNA, 24 nt, Human
cagcuuaaggcaaaaguuuggcaa

SEQ ID NO: 558882 - RNA, 21 nt, Human
caggacagccuccuggcacga

SEQ ID NO: 558883 - RNA, 19 nt, Human
caggaggaaugauuaggaa

SEQ ID NO: 558884 - RNA, 22 nt, Human
cagggccaaaucgucaccaggc

SEQ ID NO: 558885 - RNA, 21 nt, Human
caggggccagccagccacagg

SEQ ID NO: 558886 - RNA, 22 nt, Human
caggugcagggauacgaccugg

SEQ ID NO: 558887 - RNA, 19 nt, Human
caggugccgagagccgggg

SEQ ID NO: 558888 - RNA, 19 nt, Human
cagugggaggggugcuggc

SEQ ID NO: 558889 - RNA, 24 nt, Human
caguuagaagugugccucucccag

SEQ ID NO: 558890 - RNA, 19 nt, Human
cauugaggcugugugucgg

SEQ ID NO: 558891 - RNA, 19 nt, Human
cauugcacuccagccuggg

SEQ ID NO: 558892 - RNA, 21 nt, Human
cauugcacuccagccugggug

SEQ ID NO: 558893 - RNA, 22 nt, Human
cauugcacuccagccuggguga

SEQ ID NO: 558894 - RNA, 24 nt, Human
cauugcacuccagccugggugaca

SEQ ID NO: 558895 - RNA, 24 nt, Human
cauugcacuccagccugggugaca

SEQ ID NO: 558896 - RNA, 21 nt, Human
ccacagcagcaggcaggauga

SEQ ID NO: 558897 - RNA, 19 nt, Human
ccacccagcccucccagcc

SEQ ID NO: 558898 - RNA, 23 nt, Human
ccagacucagggaaccugcaggc

SEQ ID NO: 558899 - RNA, 21 nt, Human
ccagagcucacagccccucuc

SEQ ID NO: 558900 - RNA, 24 nt, Human
ccagcccagccuccagaguggaac

SEQ ID NO: 558901 - RNA, 24 nt, Human
ccagcggccugagacccgcuuccu

SEQ ID NO: 558902 - RNA, 19 nt, Human
ccaggacagccuccuggca

SEQ ID NO: 558903 - RNA, 20 nt, Human
ccauugcacuccagccuggg

SEQ ID NO: 558904 - RNA, 21 nt, Human
ccauugcacuccagccugggu

SEQ ID NO: 558905 - RNA, 21 nt, Human
ccauugcacuccagccugggu

SEQ ID NO: 558906 - RNA, 22 nt, Human
ccauugcacuccagccugggug

SEQ ID NO: 558907 - RNA, 24 nt, Human
ccauugcacuccagccugggugac

SEQ ID NO: 558908 - RNA, 19 nt, Human
cccaagacaaccgggaaga

SEQ ID NO: 558909 - RNA, 19 nt, Human
cccaagacuucccuagagc

SEQ ID NO: 558910 - RNA, 23 nt, Human
cccacagcagcaggcaggaugac

SEQ ID NO: 558911 - RNA, 22 nt, Human
cccacgauggugcaggucucug

SEQ ID NO: 558912 - RNA, 19 nt, Human
ccccaacccucccuccacc

SEQ ID NO: 558913 - RNA, 22 nt, Human
ccccaacccucccuccaccucu

SEQ ID NO: 558914 - RNA, 18 nt, Human
cccccaucaggggccccc

SEQ ID NO: 558915 - RNA, 22 nt, Human
cccccgccagagcucacagccc

SEQ ID NO: 558916 - RNA, 18 nt, Human
ccccuaaggcuacugccu

SEQ ID NO: 558917 - RNA, 19 nt, Human
ccccugaguacccagacuc

SEQ ID NO: 558918 - RNA, 21 nt, Human
ccccugcaaguggccacaagg

SEQ ID NO: 558919 - RNA, 20 nt, Human
cccgcuuuggccuugccccc

SEQ ID NO: 558920 - RNA, 21 nt, Human
cccugagcccccaaaagaggc

SEQ ID NO: 558921 - RNA, 18 nt, Human
cccugaguacccagacuc

SEQ ID NO: 558922 - RNA, 19 nt, Human
cccuguccccacccauccu

SEQ ID NO: 558923 - RNA, 20 nt, Human
ccuccaccuggggguugcag

SEQ ID NO: 558924 - RNA, 21 nt, Human
ccuccuaaucagcucccccuc

SEQ ID NO: 558925 - RNA, 20 nt, Human
ccuccuagagccgcccaagg

SEQ ID NO: 558926 - RNA, 27 nt, Human
ccucucgacgauaagcccacccagccc

SEQ ID NO: 558927 - RNA, 27 nt, Human
ccugaaacucccaggcccuggcucagg

SEQ ID NO: 558928 - RNA, 18 nt, Human
ccugaccccagccuuggg

SEQ ID NO: 558929 - RNA, 25 nt, Human
ccugcagccucuccaggguguuccu

SEQ ID NO: 558930 - RNA, 18 nt, Human
ccugccccugagccccca

SEQ ID NO: 558931 - RNA, 21 nt, Human
ccugccccugagcccccaaaa

SEQ ID NO: 558932 - RNA, 24 nt, Human
ccugcuuagaucuccccucucccu

SEQ ID NO: 558933 - RNA, 21 nt, Human
ccuggcaggaagccuggggcc

SEQ ID NO: 558934 - RNA, 25 nt, Human
ccugggaggcagagguugcagugag

SEQ ID NO: 558935 - RNA, 20 nt, Human
ccuggugcagccaacagcag

SEQ ID NO: 558936 - RNA, 24 nt, Human
ccuguccccacccauccucagaca

SEQ ID NO: 558937 - RNA, 24 nt, Human
ccugugcuccaacaugagcaagga

SEQ ID NO: 558938 - RNA, 20 nt, Human
ccuuaccuuugagacuaaca

SEQ ID NO: 558939 - RNA, 19 nt, Human
ccuuccaccuccaucacug

SEQ ID NO: 558940 - RNA, 20 nt, Human
ccuugaauaaacgcaauagc

SEQ ID NO: 558941 - RNA, 28 nt, Human
cgacggcaguggcuaaacggucauuaag

SEQ ID NO: 558942 - RNA, 24 nt, Human
cgagaucauaccauugcacuccag

SEQ ID NO: 558943 - RNA, 21 nt, Human
cgagcugggcccggagaccga

SEQ ID NO: 558944 - RNA, 18 nt, Human
cgcccacucuguccucac

SEQ ID NO: 558945 - RNA, 19 nt, Human
cucacuguccggaaguacc

SEQ ID NO: 558946 - RNA, 27 nt, Human
cucagaacccuggcacaaugggucagg

SEQ ID NO: 558947 - RNA, 22 nt, Human
cucaggcaaagacaggugagga

SEQ ID NO: 558948 - RNA, 28 nt, Human
cuccaggaauaaaccagcgggguacccc

SEQ ID NO: 558949 - RNA, 19 nt, Human
cucccaagacaaccgggaa

SEQ ID NO: 558950 - RNA, 18 nt, Human
cuccuggcacgagcuggg

SEQ ID NO: 558951 - RNA, 19 nt, Human
cuccugguaagugcauugg

SEQ ID NO: 558952 - RNA, 26 nt, Human
cucuuucguuugcaaagagcugaagg

SEQ ID NO: 558953 - RNA, 21 nt, Human
cugagaaaaaggagaggcaag

SEQ ID NO: 558954 - RNA, 18 nt, Human
cugagugugggucccggg

SEQ ID NO: 558955 - RNA, 20 nt, Human
cugcaaguggccacaaggcc

SEQ ID NO: 558956 - RNA, 23 nt, Human
cuggaggacauaagaagaaucgg

SEQ ID NO: 558957 - RNA, 21 nt, Human
cuggcuccugccucgaguguu

SEQ ID NO: 558958 - RNA, 21 nt, Human
cugggaccgagggagggcagg

SEQ ID NO: 558959 - RNA, 21 nt, Human
cuggggguggguccugaggac

SEQ ID NO: 558960 - RNA, 18 nt, Human
cuguucaucucauugaaa

SEQ ID NO: 558961 - RNA, 24 nt, Human
cuuucuuucuccgauugguuuucu

SEQ ID NO: 558962 - RNA, 23 nt, Human
cuuuuacaguacaccaggggcca

SEQ ID NO: 558963 - RNA, 19 nt, Human
gaaaaagccacacaccugg

SEQ ID NO: 558964 - RNA, 22 nt, Human
gaaagaaggggcacgggugaag

SEQ ID NO: 558965 - RNA, 18 nt, Human
gaagggccagggacucaa

SEQ ID NO: 558966 - RNA, 20 nt, Human
gaccagguagcccugauuug

SEQ ID NO: 558967 - RNA, 25 nt, Human
gaccugcagccucuccaggguguuc

SEQ ID NO: 558968 - RNA, 21 nt, Human
gaccugggaccgagggagggc

SEQ ID NO: 558969 - RNA, 19 nt, Human
gagaaccugcaguuucugc

SEQ ID NO: 558970 - RNA, 22 nt, Human
gagaacgagcccugucuuggcc

SEQ ID NO: 558971 - RNA, 23 nt, Human
gagaaucgcuugaaccugggagg

SEQ ID NO: 558972 - RNA, 20 nt, Human
gagaccagaggucacccuga

SEQ ID NO: 558973 - RNA, 18 nt, Human
gagcaaggaggcugaagg

SEQ ID NO: 558974 - RNA, 20 nt, Human
gagggcggagggaccugggg

SEQ ID NO: 558975 - RNA, 21 nt, Human
gauaagcccacccagcccucc

SEQ ID NO: 558976 - RNA, 20 nt, Human
gauggagaaggaaaaagcca

SEQ ID NO: 558977 - RNA, 19 nt, Human
gcacguggggucugucugu

SEQ ID NO: 558978 - RNA, 24 nt, Human
gcacuccagccugggugacagagc

SEQ ID NO: 558979 - RNA, 21 nt, Human
gcccacagacaauccgccaac

SEQ ID NO: 558980 - RNA, 22 nt, Human
gcccacagacaauccgccaaca

SEQ ID NO: 558981 - RNA, 21 nt, Human
gcccaggguccacugucagcc

SEQ ID NO: 558982 - RNA, 24 nt, Human
gcccccaucaggggcccccugagc

SEQ ID NO: 558983 - RNA, 20 nt, Human
gcccuggagcuccagugacc

SEQ ID NO: 558984 - RNA, 19 nt, Human
gccggggaggccuucccgg

SEQ ID NO: 558985 - RNA, 18 nt, Human
gccuccauccucacaaga

SEQ ID NO: 558986 - RNA, 19 nt, Human
gcucagggccagggccaaa

SEQ ID NO: 558987 - RNA, 21 nt, Human
ggaaacgcccacucuguccuc

SEQ ID NO: 558988 - RNA, 18 nt, Human
ggaagaagggcucaagag

SEQ ID NO: 558989 - RNA, 19 nt, Human
ggaggccuucccgggggca

SEQ ID NO: 558990 - RNA, 19 nt, Human
ggcaugcagugggaggggu

SEQ ID NO: 558991 - RNA, 23 nt, Human
ggcccuggcucaggcaaagacag

SEQ ID NO: 558992 - RNA, 19 nt, Human
ggcugggggccgggcaugc

SEQ ID NO: 558993 - RNA, 23 nt, Human
ggcuguaaucccagcuacucggg

SEQ ID NO: 558994 - RNA, 19 nt, Human
gggaggccuucccgggggc

SEQ ID NO: 558995 - RNA, 18 nt, Human
gggaggggugcuggcucc

SEQ ID NO: 558996 - RNA, 21 nt, Human
gggcagggacuuugguuccca

SEQ ID NO: 558997 - RNA, 20 nt, Human
gggccagccagccacagggg

SEQ ID NO: 558998 - RNA, 21 nt, Human
gggcccggagaccgacggcag

SEQ ID NO: 558999 - RNA, 18 nt, Human
ggggaggccuucccgggg

SEQ ID NO: 559000 - RNA, 21 nt, Human
ggggggccccacagcagcagg

SEQ ID NO: 559001 - RNA, 19 nt, Human
gggguugcagcgggugcag

SEQ ID NO: 559002 - RNA, 21 nt, Human
ggguggagggagagaaggggc

SEQ ID NO: 559003 - RNA, 21 nt, Human
guccagucacagacgcgcuga

SEQ ID NO: 559004 - RNA, 22 nt, Human
guccucaccuguugcucuccac

SEQ ID NO: 559005 - RNA, 20 nt, Human
guccugaggacugagagggu

SEQ ID NO: 559006 - RNA, 22 nt, Human
gucuugugccuccugguaagug

SEQ ID NO: 559007 - RNA, 20 nt, Human
guuuuuuuaaaaaacggaaa

SEQ ID NO: 559008 - RNA, 23 nt, Human
uaaaccagcggccugagacccgc

SEQ ID NO: 559009 - RNA, 18 nt, Human
uaaaugcccauccucacc

SEQ ID NO: 559010 - RNA, 24 nt, Human
uagaaaagagauccugcuuucuuu

SEQ ID NO: 559011 - RNA, 19 nt, Human
uagaaugguuguaucuugc

SEQ ID NO: 559012 - RNA, 19 nt, Human
uagagcuugggugccuucc

SEQ ID NO: 559013 - RNA, 20 nt, Human
uagcaaaauuggggccgccg

SEQ ID NO: 559014 - RNA, 22 nt, Human
uagcccuccucuuccugacccc

SEQ ID NO: 559015 - RNA, 20 nt, Human
ucacaggagccugccucucu

SEQ ID NO: 559016 - RNA, 20 nt, Human
ucacccuucucccaagacaa

SEQ ID NO: 559017 - RNA, 22 nt, Human
ucagcucccccuccuccugccc

SEQ ID NO: 559018 - RNA, 23 nt, Human
ucauaccauugcacuccagccug

SEQ ID NO: 559019 - RNA, 25 nt, Human
uccaccuccaucacuguggcaccca

SEQ ID NO: 559020 - RNA, 21 nt, Human
uccacugucagccccagcuac

SEQ ID NO: 559021 - RNA, 24 nt, Human
uccagccugggugacagagccaga

SEQ ID NO: 559022 - RNA, 23 nt, Human
uccaucacuguggcacccagagc

SEQ ID NO: 559023 - RNA, 18 nt, Human
ucccagcccuguccccac

SEQ ID NO: 559024 - RNA, 22 nt, Human
ucccagcccuguccccacccau

SEQ ID NO: 559025 - RNA, 21 nt, Human
ucccaggacagccuccuggca

SEQ ID NO: 559026 - RNA, 23 nt, Human
ucccaggcuggcagacagcacug

SEQ ID NO: 559027 - RNA, 18 nt, Human
ucccagggaugggcuucc

SEQ ID NO: 559028 - RNA, 24 nt, Human
ucccaguccugaaacucccaggcc

SEQ ID NO: 559029 - RNA, 20 nt, Human
uccccuaauagccccugcaa

SEQ ID NO: 559030 - RNA, 22 nt, Human
uccugaaacucccaggcccugg

SEQ ID NO: 559031 - RNA, 21 nt, Human
uccugaccccagccuuggggu

SEQ ID NO: 559032 - RNA, 19 nt, Human
uccuggaggucggggagcu

SEQ ID NO: 559033 - RNA, 20 nt, Human
ucgacgauaagcccacccag

SEQ ID NO: 559034 - RNA, 19 nt, Human
ucgcgggcgaccccaaccc

SEQ ID NO: 559035 - RNA, 18 nt, Human
ucgcuugaaccugggagg

SEQ ID NO: 559036 - RNA, 24 nt, Human
ucgggaggcugaggcaggagaauc

SEQ ID NO: 559037 - RNA, 21 nt, Human
ucuccaggguguuccuagccc

SEQ ID NO: 559038 - RNA, 21 nt, Human
ucucgcgggcgaccccaaccc

SEQ ID NO: 559039 - RNA, 20 nt, Human
ucuguccucaccuguugcuc

SEQ ID NO: 559040 - RNA, 22 nt, Human
ucuguccucaccuguugcucuu

SEQ ID NO: 559041 - RNA, 21 nt, Human
ucugugguguugccguaccag

SEQ ID NO: 559042 - RNA, 22 nt, Human
ucugugguguugccguaccagg

SEQ ID NO: 559043 - RNA, 23 nt, Human
ugaacccccaggguccugucccu

SEQ ID NO: 559044 - RNA, 24 nt, Human
ugaaccugggaggcagagguugca

SEQ ID NO: 559045 - RNA, 20 nt, Human
ugaaggagcagaccggggcu

SEQ ID NO: 559046 - RNA, 21 nt, Human
ugaauaaacgcaauagcccgu

SEQ ID NO: 559047 - RNA, 21 nt, Human
ugacagagccagacccugucu

SEQ ID NO: 559048 - RNA, 22 nt, Human
ugaccugggaccgagggagggc

SEQ ID NO: 559049 - RNA, 21 nt, Human
ugacugaagagugagucugag

SEQ ID NO: 559050 - RNA, 19 nt, Human
ugagaaaaaggagaggcaa

SEQ ID NO: 559051 - RNA, 23 nt, Human
ugagaacgagcccugucuuggcu

SEQ ID NO: 559052 - RNA, 22 nt, Human
ugagacccgcuuccugaacccc

SEQ ID NO: 559053 - RNA, 21 nt, Human
ugagagggugaaaauucccug

SEQ ID NO: 559054 - RNA, 18 nt, Human
ugagcaccgugccagccg

SEQ ID NO: 559055 - RNA, 18 nt, Human
ugaggaagggcagaaaga

SEQ ID NO: 559056 - RNA, 19 nt, Human
ugaggacaggaagcagggg

SEQ ID NO: 559057 - RNA, 20 nt, Human
ugaggcaggagaaucgcuug

SEQ ID NO: 559058 - RNA, 24 nt, Human
ugaggcaggagaaucgcuugaacc

SEQ ID NO: 559059 - RNA, 24 nt, Human
ugaggcaggagaaucgcuugaacc

SEQ ID NO: 559060 - RNA, 18 nt, Human
ugcaaagagcugaagguc

SEQ ID NO: 559061 - RNA, 24 nt, Human
ugcacuccagccugggugacagag

SEQ ID NO: 559062 - RNA, 23 nt, Human
ugccaaaaagaaagagugagcag

SEQ ID NO: 559063 - RNA, 21 nt, Human
ugccucgaguguuugcucuca

SEQ ID NO: 559064 - RNA, 22 nt, Human
ugccucucuccuccuagagccg

SEQ ID NO: 559065 - RNA, 19 nt, Human
ugccuggugcagccaacag

SEQ ID NO: 559066 - RNA, 22 nt, Human
ugcggggagguccuggccccca

SEQ ID NO: 559067 - RNA, 22 nt, Human
ugcugaaugacugaagagugag

SEQ ID NO: 559068 - RNA, 22 nt, Human
ugcuuuagugcaacaaagaccu

SEQ ID NO: 559069 - RNA, 19 nt, Human
uggaaggagcguggcuuca

SEQ ID NO: 559070 - RNA, 18 nt, Human
uggagaaggaaaaagccc

SEQ ID NO: 559071 - RNA, 21 nt, Human
uggagacccuuugaggguggc

SEQ ID NO: 559072 - RNA, 18 nt, Human
uggagccaccccccgcca

SEQ ID NO: 559073 - RNA, 20 nt, Human
uggagggagagaaggggcug

SEQ ID NO: 559074 - RNA, 22 nt, Human
uggaucccuccaccuggggguu

SEQ ID NO: 559075 - RNA, 21 nt, Human
uggaucuugcccuccuggagg

SEQ ID NO: 559076 - RNA, 20 nt, Human
uggauggagaaggaaaaagc

SEQ ID NO: 559077 - RNA, 20 nt, Human
uggcaagcuggaaggagcgu

SEQ ID NO: 559078 - RNA, 20 nt, Human
uggcacaaugggucaggacu

SEQ ID NO: 559079 - RNA, 20 nt, Human
uggcacgagcugggcccgga

SEQ ID NO: 559080 - RNA, 19 nt, Human
uggcucagggccagggcca

SEQ ID NO: 559081 - RNA, 23 nt, Human
ugggaagagaggggagaagaggc

SEQ ID NO: 559082 - RNA, 24 nt, Human
ugggaggcagagguugcagugagc

SEQ ID NO: 559083 - RNA, 18 nt, Human
ugggaggggcgccccuga

SEQ ID NO: 559084 - RNA, 18 nt, Human
ugggcaucuccugcccag

SEQ ID NO: 559085 - RNA, 24 nt, Human
ugggcaucuccugcccagccccug

SEQ ID NO: 559086 - RNA, 23 nt, Human
uggggcccacgauggugcagguc

SEQ ID NO: 559087 - RNA, 22 nt, Human
ugggggccgggcaugcaguggg

SEQ ID NO: 559088 - RNA, 22 nt, Human
ugggggccuagucuccuauuuc

SEQ ID NO: 559089 - RNA, 18 nt, Human
ugggguuuucuuuccuuu

SEQ ID NO: 559090 - RNA, 18 nt, Human
ugggucagggggcaaggu

SEQ ID NO: 559091 - RNA, 22 nt, Human
ugggucagggggcaaggugggc

SEQ ID NO: 559092 - RNA, 20 nt, Human
ugggucccgggcggguagcu

SEQ ID NO: 559093 - RNA, 26 nt, Human
uggguccugaggacugaggaguucgu

SEQ ID NO: 559094 - RNA, 18 nt, Human
ugggugccuuccaccucc

SEQ ID NO: 559095 - RNA, 26 nt, Human
ugguggggcccacgauggugcagguc

SEQ ID NO: 559096 - RNA, 24 nt, Human
uguaaaaaaaaaaagguucauugu

SEQ ID NO: 559097 - RNA, 23 nt, Human
ugucacggagacucuuacaagug

SEQ ID NO: 559098 - RNA, 18 nt, Human
uguccacgccagggcggg

SEQ ID NO: 559099 - RNA, 24 nt, Human
ugucucuuugaucgggggcuggag

SEQ ID NO: 559100 - RNA, 19 nt, Human
uuccugaccccagccuugg

SEQ ID NO: 559101 - RNA, 18 nt, Human
uucugcggggagguccug

SEQ ID NO: 559102 - RNA, 19 nt, Human
uucuuuccuuucccagucc

SEQ ID NO: 559103 - RNA, 24 nt, Human
uugaaccugggaggcagagguugc

SEQ ID NO: 559104 - RNA, 18 nt, Human
uugcagugagccgagauc

SEQ ID NO: 559105 - RNA, 19 nt, Human
uugcagugagccgagauca

SEQ ID NO: 559106 - RNA, 20 nt, Human
uugcagugagccgagaucau

SEQ ID NO: 559107 - RNA, 24 nt, Human
uuucccaguccugaaacucccagg

SEQ ID NO: 559108 - RNA, 21 nt, Human
uuucgggguggcacggccucc

SEQ ID NO: 559109 - RNA, 25 nt, Human
aaaaaagcaaagcauuaucggagaa

SEQ ID NO: 559110 - RNA, 20 nt, Human
aaagcaguaucugugauuuc

SEQ ID NO: 559111 - RNA, 21 nt, Human
aagaaacuuggucccagagag

SEQ ID NO: 559112 - RNA, 21 nt, Human
aaucuccucccaaauuuccaa

SEQ ID NO: 559113 - RNA, 19 nt, Human
acaaguuugcccugccuuc

SEQ ID NO: 559114 - RNA, 22 nt, Human
acauaugcugacagacagcaca

SEQ ID NO: 559115 - RNA, 18 nt, Human
accagcaaguccuucucc

SEQ ID NO: 559116 - RNA, 21 nt, Human
agaaaaauagauaguacacaa

SEQ ID NO: 559117 - RNA, 18 nt, Human
agagugcuggcugaucag

SEQ ID NO: 559118 - RNA, 21 nt, Human
agaguggagguuuugaaguug

SEQ ID NO: 559119 - RNA, 21 nt, Human
agcaagccuggaauugacuug

SEQ ID NO: 559120 - RNA, 24 nt, Human
aggagaaaaauagauaguacacaa

SEQ ID NO: 559121 - RNA, 21 nt, Human
agucagacagcaauugaugau

SEQ ID NO: 559122 - RNA, 23 nt, Human
aucaucucucagaugggcaguga

SEQ ID NO: 559123 - RNA, 18 nt, Human
auuguaguaaggcuuccc

SEQ ID NO: 559124 - RNA, 18 nt, Human
caaaaauaacuauacagc

SEQ ID NO: 559125 - RNA, 24 nt, Human
caaauaaucuccucccaaauuucc

SEQ ID NO: 559126 - RNA, 24 nt, Human
caagagugacauaagaaaaaaagc

SEQ ID NO: 559127 - RNA, 20 nt, Human
caaggagagggcucuuucag

SEQ ID NO: 559128 - RNA, 18 nt, Human
cacaauguucugaaauga

SEQ ID NO: 559129 - RNA, 22 nt, Human
cagcaaguccuucuccaggguu

SEQ ID NO: 559130 - RNA, 23 nt, Human
caggagaagcugcuuaugccuug

SEQ ID NO: 559131 - RNA, 18 nt, Human
cagucaguccuggguggc

SEQ ID NO: 559132 - RNA, 20 nt, Human
ccagagaggagaaaaauaga

SEQ ID NO: 559133 - RNA, 19 nt, Human
cccccaguauggcaaaaau

SEQ ID NO: 559134 - RNA, 18 nt, Human
ccuccaucccgccacccc

SEQ ID NO: 559135 - RNA, 22 nt, Human
cuccaucccgccaccccccagu

SEQ ID NO: 559136 - RNA, 19 nt, Human
cucuuucagaaagccuucu

SEQ ID NO: 559137 - RNA, 21 nt, Human
cugacugcuccaaguaccgug

SEQ ID NO: 559138 - RNA, 21 nt, Human
cuggcugacugcuccaaguac

SEQ ID NO: 559139 - RNA, 21 nt, Human
gaaaaagcugcuaacgcucag

SEQ ID NO: 559140 - RNA, 20 nt, Human
gacagcacaauguucugaaa

SEQ ID NO: 559141 - RNA, 24 nt, Human
gccuuccuauaaagagugaaauuc

SEQ ID NO: 559142 - RNA, 20 nt, Human
ggagaauuguuuccauuuaa

SEQ ID NO: 559143 - RNA, 21 nt, Human
gggaguguacagucaguccug

SEQ ID NO: 559144 - RNA, 22 nt, Human
gguugcagggccacagucucca

SEQ ID NO: 559145 - RNA, 22 nt, Human
guuccucuuuuuccuaaagucc

SEQ ID NO: 559146 - RNA, 18 nt, Human
uaagugaaagcaguaucu

SEQ ID NO: 559147 - RNA, 20 nt, Human
uagauugggccaauguccuc

SEQ ID NO: 559148 - RNA, 25 nt, Human
uaguaaggcuucccuuuguagauuu

SEQ ID NO: 559149 - RNA, 20 nt, Human
uauaaaaagaaacuuggucc

SEQ ID NO: 559150 - RNA, 19 nt, Human
uauuuuguagcugauauac

SEQ ID NO: 559151 - RNA, 23 nt, Human
uauuuuguagcugauauacauau

SEQ ID NO: 559152 - RNA, 21 nt, Human
ucagaguccauuugggaauaa

SEQ ID NO: 559153 - RNA, 22 nt, Human
ucaguccuggguggcaaauguc

SEQ ID NO: 559154 - RNA, 23 nt, Human
ucaucgcuaaggcgaucuccuuc

SEQ ID NO: 559155 - RNA, 21 nt, Human
uccuggguggcaaauguccca

SEQ ID NO: 559156 - RNA, 21 nt, Human
ucgcuaaggcgaucuccuucc

SEQ ID NO: 559157 - RNA, 24 nt, Human
ucucaaauaaugucuuuguuccuc

SEQ ID NO: 559158 - RNA, 24 nt, Human
ucuggucagaguccauuugggaau

SEQ ID NO: 559159 - RNA, 22 nt, Human
ugaaguuggauccaaccccauu

SEQ ID NO: 559160 - RNA, 26 nt, Human
ugacauaagaaaaaaagcaaagcauu

SEQ ID NO: 559161 - RNA, 19 nt, Human
ugacugcuccaaguaccgu

SEQ ID NO: 559162 - RNA, 23 nt, Human
uggaaaaacacacuuuaauaaau

SEQ ID NO: 559163 - RNA, 19 nt, Human
uggagcuguagaaaucucc

SEQ ID NO: 559164 - RNA, 19 nt, Human
ugggaucccaaagcuuccc

SEQ ID NO: 559165 - RNA, 18 nt, Human
uggguggcaaauguccca

SEQ ID NO: 559166 - RNA, 24 nt, Human
ugguacauuguggaaaaacacacu

SEQ ID NO: 559167 - RNA, 20 nt, Human
uguagucagcuaaaaacuug

SEQ ID NO: 559168 - RNA, 20 nt, Human
ugucuuuguuccucuuuuuc

SEQ ID NO: 559169 - RNA, 22 nt, Human
uuaaguaccagcaaguccuucu

SEQ ID NO: 559170 - RNA, 23 nt, Human
uucacaaauaaucuccucccaaa

SEQ ID NO: 559171 - RNA, 22 nt, Human
uuccugggaucccaaagcuucc

SEQ ID NO: 559172 - RNA, 23 nt, Human
uuccugggaucccaaagcuucca

SEQ ID NO: 559173 - RNA, 24 nt, Human
uuuccuaaaguccuuugucaaaag

SEQ ID NO: 559174 - RNA, 19 nt, Human
aaaaaaaaaaguggagaau

SEQ ID NO: 559175 - RNA, 22 nt, Human
aagugaccccuugaggaagggc

SEQ ID NO: 559176 - RNA, 23 nt, Human
accccaccaucugcaccagccua

SEQ ID NO: 559177 - RNA, 24 nt, Human
accccagggauucccggcagaaaa

SEQ ID NO: 559178 - RNA, 18 nt, Human
acccggaagcccccccgg

SEQ ID NO: 559179 - RNA, 23 nt, Human
acccggaagcccccccgggucac

SEQ ID NO: 559180 - RNA, 24 nt, Human
acccggaagcccccccgggucacu

SEQ ID NO: 559181 - RNA, 23 nt, Human
agaaacccacaggcuucuggcaa

SEQ ID NO: 559182 - RNA, 21 nt, Human
agagaggcuuguccccccaag

SEQ ID NO: 559183 - RNA, 25 nt, Human
agaggccagaggucgcagcugagcu

SEQ ID NO: 559184 - RNA, 25 nt, Human
agaugguggggucuggacagcucag

SEQ ID NO: 559185 - RNA, 25 nt, Human
agcacauguggcggucggugugugc

SEQ ID NO: 559186 - RNA, 22 nt, Human
aggagggcaggggaggcggagc

SEQ ID NO: 559187 - RNA, 19 nt, Human
aggcaggcgggcucucccu

SEQ ID NO: 559188 - RNA, 22 nt, Human
agguauuuuccacagugugguc

SEQ ID NO: 559189 - RNA, 20 nt, Human
auaaaacaugcguucacccc

SEQ ID NO: 559190 - RNA, 22 nt, Human
caagcuagaaagaaacccacaa

SEQ ID NO: 559191 - RNA, 24 nt, Human
caccaucugcaccagccuaggagc

SEQ ID NO: 559192 - RNA, 19 nt, Human
cacccgacgcugccuugug

SEQ ID NO: 559193 - RNA, 22 nt, Human
caggagcaccuuccgcccuggc

SEQ ID NO: 559194 - RNA, 22 nt, Human
cagggucggggccuggcccgcu

SEQ ID NO: 559195 - RNA, 20 nt, Human
ccacccccgcccgccagcuc

SEQ ID NO: 559196 - RNA, 24 nt, Human
ccagaacuugggcaggacgggcug

SEQ ID NO: 559197 - RNA, 20 nt, Human
ccaggugggucacaacaggg

SEQ ID NO: 559198 - RNA, 26 nt, Human
ccaguggggccgggcuuggcacagcu

SEQ ID NO: 559199 - RNA, 21 nt, Human
cccaggcuacagaaggagaaa

SEQ ID NO: 559200 - RNA, 22 nt, Human
ccccaccaucugcaccagccua

SEQ ID NO: 559201 - RNA, 18 nt, Human
ccccagaacuugggcagg

SEQ ID NO: 559202 - RNA, 21 nt, Human
ccccagaacuugggcaggacg

SEQ ID NO: 559203 - RNA, 24 nt, Human
ccccagaggccagaggucgcagcu

SEQ ID NO: 559204 - RNA, 23 nt, Human
cccccaagcuagaaagaaaccca

SEQ ID NO: 559205 - RNA, 20 nt, Human
cccccaaggcuagagcugcu

SEQ ID NO: 559206 - RNA, 21 nt, Human
cccccgcccgccagcuccccg

SEQ ID NO: 559207 - RNA, 18 nt, Human
cccccgggucacucacgg

SEQ ID NO: 559208 - RNA, 19 nt, Human
ccccgagccucaguuuacc

SEQ ID NO: 559209 - RNA, 19 nt, Human
ccccgcccgccagcucccc

SEQ ID NO: 559210 - RNA, 20 nt, Human
ccccgggucacucacgggcg

SEQ ID NO: 559211 - RNA, 20 nt, Human
cccggcagaaaagcacaugu

SEQ ID NO: 559212 - RNA, 18 nt, Human
ccggcugccuggggcugc

SEQ ID NO: 559213 - RNA, 18 nt, Human
ccgggucacucacgggcg

SEQ ID NO: 559214 - RNA, 21 nt, Human
cucaagaaaaaaaaaagugga

SEQ ID NO: 559215 - RNA, 24 nt, Human
cucaagaaaaaaaaaaguggagaa

SEQ ID NO: 559216 - RNA, 20 nt, Human
cucggacacgguggccggcc

SEQ ID NO: 559217 - RNA, 19 nt, Human
cugcagcagccuccguucc

SEQ ID NO: 559218 - RNA, 20 nt, Human
cuggugucucgcucagcagc

SEQ ID NO: 559219 - RNA, 21 nt, Human
cuugugugugugcgugggugg

SEQ ID NO: 559220 - RNA, 22 nt, Human
gaacccaaggcccuguggacag

SEQ ID NO: 559221 - RNA, 18 nt, Human
gagggugggagaggggug

SEQ ID NO: 559222 - RNA, 20 nt, Human
gcagaaaagcacauguggcg

SEQ ID NO: 559223 - RNA, 20 nt, Human
gcagaaaagcacauguggcg

SEQ ID NO: 559224 - RNA, 24 nt, Human
gcccauaaaacaugcguucacccc

SEQ ID NO: 559225 - RNA, 21 nt, Human
gccccguuuauguccccagag

SEQ ID NO: 559226 - RNA, 24 nt, Human
gccggcccgucaaagggaccacgc

SEQ ID NO: 559227 - RNA, 19 nt, Human
gccuggcccgcuguggccc

SEQ ID NO: 559228 - RNA, 21 nt, Human
ggacaggugugugacggcccu

SEQ ID NO: 559229 - RNA, 23 nt, Human
ggacaggugugugacggcccucu

SEQ ID NO: 559230 - RNA, 23 nt, Human
ggagccccggcugccuggggcug

SEQ ID NO: 559231 - RNA, 20 nt, Human
ggccgggcuuggcacagcug

SEQ ID NO: 559232 - RNA, 22 nt, Human
ggccuggaggccuagcguugcg

SEQ ID NO: 559233 - RNA, 23 nt, Human
ggccugggguuaccccuggggag

SEQ ID NO: 559234 - RNA, 25 nt, Human
ggcugcgucucugcagcagccuccg

SEQ ID NO: 559235 - RNA, 23 nt, Human
ggcuucuggcaauggccaccucc

SEQ ID NO: 559236 - RNA, 22 nt, Human
gggcaggggaggcggagcuggu

SEQ ID NO: 559237 - RNA, 24 nt, Human
gggguuaccccuggggaggguggg

SEQ ID NO: 559238 - RNA, 20 nt, Human
gggugggagaggggugaggg

SEQ ID NO: 559239 - RNA, 22 nt, Human
ggucacugaagucuacucaaga

SEQ ID NO: 559240 - RNA, 22 nt, Human
gguucuggcuccuuccuggaga

SEQ ID NO: 559241 - RNA, 23 nt, Human
gucgcagcugagcuaucugugcu

SEQ ID NO: 559242 - RNA, 24 nt, Human
gucgcagcugagcuaucugugcuu

SEQ ID NO: 559243 - RNA, 18 nt, Human
gugcagagggccuggccu

SEQ ID NO: 559244 - RNA, 18 nt, Human
guggcuccaccuccaccc

SEQ ID NO: 559245 - RNA, 19 nt, Human
uaccccuggggaggguggg

SEQ ID NO: 559246 - RNA, 23 nt, Human
uagcugagagaggcuuguccccc

SEQ ID NO: 559247 - RNA, 20 nt, Human
ucagcccguuuaaccccacc

SEQ ID NO: 559248 - RNA, 24 nt, Human
uccacccggaagcccccccggguc

SEQ ID NO: 559249 - RNA, 20 nt, Human
ucccagggucucuggaacag

SEQ ID NO: 559250 - RNA, 23 nt, Human
ucccugggguccgggagauggug

SEQ ID NO: 559251 - RNA, 23 nt, Human
ucucugcagcagccuccguuccc

SEQ ID NO: 559252 - RNA, 22 nt, Human
ucugugcuuggccugggguuac

SEQ ID NO: 559253 - RNA, 21 nt, Human
ugaggguucuggcuccuuccu

SEQ ID NO: 559254 - RNA, 20 nt, Human
ugaguguccuuaacucucuu

SEQ ID NO: 559255 - RNA, 25 nt, Human
ugcagagggccuggccucaggccgu

SEQ ID NO: 559256 - RNA, 18 nt, Human
ugccccagaacuugggca

SEQ ID NO: 559257 - RNA, 19 nt, Human
ugccccagaacuugggcag

SEQ ID NO: 559258 - RNA, 23 nt, Human
ugccuggggcugcgucucugcag

SEQ ID NO: 559259 - RNA, 22 nt, Human
ugcugcugccacccccgcccgc

SEQ ID NO: 559260 - RNA, 19 nt, Human
uggaaaggguggaggcagg

SEQ ID NO: 559261 - RNA, 19 nt, Human
uggaaaggguggaggcagg

SEQ ID NO: 559262 - RNA, 22 nt, Human
uggacagugaaggagaggccag

SEQ ID NO: 559263 - RNA, 23 nt, Human
uggagagaggagggcaggggagg

SEQ ID NO: 559264 - RNA, 18 nt, Human
uggagauggaugcguggc

SEQ ID NO: 559265 - RNA, 19 nt, Human
uggccugggguuaccccug

SEQ ID NO: 559266 - RNA, 20 nt, Human
uggccugggguuaccccugg

SEQ ID NO: 559267 - RNA, 18 nt, Human
uggggagggugggagagg

SEQ ID NO: 559268 - RNA, 26 nt, Human
ugggguguguuuguucccaguuacca

SEQ ID NO: 559269 - RNA, 21 nt, Human
ugggugcggcacaccuggaau

SEQ ID NO: 559270 - RNA, 21 nt, Human
uuuuaaggaaaaacggggugg

SEQ ID NO: 559271 - RNA, 21 nt, Human
uuuuccacaguguggucacug

SEQ ID NO: 559272 - RNA, 24 nt, Human
aaaaaaaauccuccuaggaauaga

SEQ ID NO: 559273 - RNA, 24 nt, Human
aaaaauccuccuaggaauagaucc

SEQ ID NO: 559274 - RNA, 19 nt, Human
aacauggugaaauuccauc

SEQ ID NO: 559275 - RNA, 21 nt, Human
aacauggugaaauuccaucuc

SEQ ID NO: 559276 - RNA, 21 nt, Human
aacccaaaugcccaucaauga

SEQ ID NO: 559277 - RNA, 23 nt, Human
aagaccauccuggcuaacauggu

SEQ ID NO: 559278 - RNA, 19 nt, Human
aagcauucagacacugcug

SEQ ID NO: 559279 - RNA, 21 nt, Human
aaguaccuucuuaaggcgggc

SEQ ID NO: 559280 - RNA, 21 nt, Human
aaguaccuucuugggcggggc

SEQ ID NO: 559281 - RNA, 19 nt, Human
aaguggcugggacuacagg

SEQ ID NO: 559282 - RNA, 20 nt, Human
aaguggcugggacuacaggc

SEQ ID NO: 559283 - RNA, 23 nt, Human
aauacacuucaucucugcaaaau

SEQ ID NO: 559284 - RNA, 22 nt, Human
aauaggcucugcaucuucaaau

SEQ ID NO: 559285 - RNA, 18 nt, Human
acaaggaaaacauuuugu

SEQ ID NO: 559286 - RNA, 21 nt, Human
acaaggaaaacauuuuguguu

SEQ ID NO: 559287 - RNA, 18 nt, Human
acagacaugagccaccgc

SEQ ID NO: 559288 - RNA, 24 nt, Human
acagagcaagccuccaucucaaaa

SEQ ID NO: 559289 - RNA, 21 nt, Human
acaggcacccgccaccaugcc

SEQ ID NO: 559290 - RNA, 21 nt, Human
acaugagccaccgcacccagc

SEQ ID NO: 559291 - RNA, 19 nt, Human
acauggugaaauuccaucu

SEQ ID NO: 559292 - RNA, 18 nt, Human
acccaccucggcccccca

SEQ ID NO: 559293 - RNA, 20 nt, Human
accucggccccccagagugc

SEQ ID NO: 559294 - RNA, 23 nt, Human
accucggccccccagagugcugg

SEQ ID NO: 559295 - RNA, 20 nt, Human
acgggguuucaccacauuag

SEQ ID NO: 559296 - RNA, 20 nt, Human
acugcaagcucugccuccug

SEQ ID NO: 559297 - RNA, 24 nt, Human
acugcacuccagccugggugacag

SEQ ID NO: 559298 - RNA, 26 nt, Human
acugcacuccagccugggugacagag

SEQ ID NO: 559299 - RNA, 24 nt, Human
acuggcucacgccuguaaucccag

SEQ ID NO: 559300 - RNA, 20 nt, Human
agaaaaccagacaccgcaug

SEQ ID NO: 559301 - RNA, 24 nt, Human
agaagacauuauccucagcaaacu

SEQ ID NO: 559302 - RNA, 24 nt, Human
agagcuugcagugagccgagauug

SEQ ID NO: 559303 - RNA, 22 nt, Human
agaguuucaggauaacucagau

SEQ ID NO: 559304 - RNA, 19 nt, Human
agaugacucagauauagaa

SEQ ID NO: 559305 - RNA, 21 nt, Human
agcaagccuccaucucaaaaa

SEQ ID NO: 559306 - RNA, 24 nt, Human
agcacuuugggaggccgaggcggg

SEQ ID NO: 559307 - RNA, 20 nt, Human
agccaccgcacccagccuug

SEQ ID NO: 559308 - RNA, 23 nt, Human
agccgggcaugguggugggcgcc

SEQ ID NO: 559309 - RNA, 22 nt, Human
agccucccccacuaaauucaga

SEQ ID NO: 559310 - RNA, 24 nt, Human
agccugggugacagagcaagccuc

SEQ ID NO: 559311 - RNA, 22 nt, Human
agcgugauccagccucccccac

SEQ ID NO: 559312 - RNA, 18 nt, Human
agcucugccuccuggguu

SEQ ID NO: 559313 - RNA, 18 nt, Human
aggaaaacauuuuguguc

SEQ ID NO: 559314 - RNA, 21 nt, Human
aggcagagcuugcagugagcc

SEQ ID NO: 559315 - RNA, 24 nt, Human
aggcagagcuugcagugagccgag

SEQ ID NO: 559316 - RNA, 20 nt, Human
aggccgaggcgggcggauca

SEQ ID NO: 559317 - RNA, 23 nt, Human
aggccgaggcgggcggaucauga

SEQ ID NO: 559318 - RNA, 18 nt, Human
aggcgggcgagcgggggc

SEQ ID NO: 559319 - RNA, 24 nt, Human
aggcgggcggaucaugaggucagg

SEQ ID NO: 559320 - RNA, 21 nt, Human
aggcugcagcgugauccagcc

SEQ ID NO: 559321 - RNA, 25 nt, Human
aggcugcagcgugauccagccuccc

SEQ ID NO: 559322 - RNA, 25 nt, Human
aggcuggagugcaguggcgcgaucu

SEQ ID NO: 559323 - RNA, 25 nt, Human
agggaggggaacacauucacugggg

SEQ ID NO: 559324 - RNA, 23 nt, Human
agggcggugggggguaagggggc

SEQ ID NO: 559325 - RNA, 21 nt, Human
agggguuggggugauugguca

SEQ ID NO: 559326 - RNA, 18 nt, Human
agucccagcuaaucggga

SEQ ID NO: 559327 - RNA, 21 nt, Human
agugcaguggcgcgaucucag

SEQ ID NO: 559328 - RNA, 23 nt, Human
agugcaguggcgcgaucucagcu

SEQ ID NO: 559329 - RNA, 24 nt, Human
agugcaguggcgcgaucucagcuc

SEQ ID NO: 559330 - RNA, 20 nt, Human
agugcugggauuacagacau

SEQ ID NO: 559331 - RNA, 22 nt, Human
agugcugggauuacagacauga

SEQ ID NO: 559332 - RNA, 24 nt, Human
agugcugggauuacagacaugagc

SEQ ID NO: 559333 - RNA, 22 nt, Human
aguggcuaccauauuagaugac

SEQ ID NO: 559334 - RNA, 24 nt, Human
auagaauacacuucaucucugcaa

SEQ ID NO: 559335 - RNA, 24 nt, Human
augagaucauaucauuugcagaga

SEQ ID NO: 559336 - RNA, 25 nt, Human
auggcuuagcuugggcucagaggcc

SEQ ID NO: 559337 - RNA, 24 nt, Human
auugcgccacugcacuccagccug

SEQ ID NO: 559338 - RNA, 18 nt, Human
caaacuaaugcaggaaca

SEQ ID NO: 559339 - RNA, 22 nt, Human
caaaguaccuucuuaaggcggg

SEQ ID NO: 559340 - RNA, 22 nt, Human
caaaugcccaucaaugauagac

SEQ ID NO: 559341 - RNA, 23 nt, Human
caagaccaaaacaaggcaagggc

SEQ ID NO: 559342 - RNA, 18 nt, Human
caccacauuagccaggau

SEQ ID NO: 559343 - RNA, 22 nt, Human
caccacauuagccaggaugguc

SEQ ID NO: 559344 - RNA, 24 nt, Human
caccacauuagccaggauggucuc

SEQ ID NO: 559345 - RNA, 23 nt, Human
cacccaccucggccccccagagu

SEQ ID NO: 559346 - RNA, 21 nt, Human
caccgcacccagccuugaaua

SEQ ID NO: 559347 - RNA, 24 nt, Human
cacgccuguaaucccagcacuuug

SEQ ID NO: 559348 - RNA, 22 nt, Human
cacuccagccugggugacagag

SEQ ID NO: 559349 - RNA, 23 nt, Human
cacugcaagcucugccuccuggg

SEQ ID NO: 559350 - RNA, 19 nt, Human
cacugcacuccagccuggg

SEQ ID NO: 559351 - RNA, 19 nt, Human
cacugcacuccagccuggg

SEQ ID NO: 559352 - RNA, 19 nt, Human
cacugcacuccagccuggg

SEQ ID NO: 559353 - RNA, 22 nt, Human
cacugcacuccagccuggguga

SEQ ID NO: 559354 - RNA, 24 nt, Human
cacugcacuccagccugggugaca

SEQ ID NO: 559355 - RNA, 25 nt, Human
cacugcacuccagccugggugacag

SEQ ID NO: 559356 - RNA, 21 nt, Human
cagagguggcaauaccaagac

SEQ ID NO: 559357 - RNA, 24 nt, Human
cagagucuugcucuaucgcccagg

SEQ ID NO: 559358 - RNA, 24 nt, Human
cagagugcugggauuacagacaug

SEQ ID NO: 559359 - RNA, 22 nt, Human
cagcacuuugggaggccgaggc

SEQ ID NO: 559360 - RNA, 24 nt, Human
cagcacuuugggaggccgaggcgg

SEQ ID NO: 559361 - RNA, 21 nt, Human
cagcagccacacguggcucug

SEQ ID NO: 559362 - RNA, 24 nt, Human
cagcuaaucgggaggcugaggugg

SEQ ID NO: 559363 - RNA, 23 nt, Human
caucaguuaaggcuauuuucacu

SEQ ID NO: 559364 - RNA, 22 nt, Human
caugguggugggcgccuguagu

SEQ ID NO: 559365 - RNA, 21 nt, Human
caugucaccauugaugugaaa

SEQ ID NO: 559366 - RNA, 19 nt, Human
ccacacguggcucugagaa

SEQ ID NO: 559367 - RNA, 18 nt, Human
ccacugcacuccagccug

SEQ ID NO: 559368 - RNA, 20 nt, Human
ccacugcacuccagccuggg

SEQ ID NO: 559369 - RNA, 20 nt, Human
ccacugcacuccagccuggg

SEQ ID NO: 559370 - RNA, 20 nt, Human
ccacugcacuccagccuggg

SEQ ID NO: 559371 - RNA, 21 nt, Human
ccacugcacuccagccugggu

SEQ ID NO: 559372 - RNA, 24 nt, Human
ccacugcacuccagccugggugac

SEQ ID NO: 559373 - RNA, 18 nt, Human
ccagaggugagguggagg

SEQ ID NO: 559374 - RNA, 19 nt, Human
ccagagugcugggauuaca

SEQ ID NO: 559375 - RNA, 24 nt, Human
ccagagugcugggauuacagacau

SEQ ID NO: 559376 - RNA, 21 nt, Human
ccaucucuacuaaaaauacaa

SEQ ID NO: 559377 - RNA, 23 nt, Human
cccaaguggcugggacuacaggc

SEQ ID NO: 559378 - RNA, 24 nt, Human
cccaaguggcugggacuacaggca

SEQ ID NO: 559379 - RNA, 22 nt, Human
cccacaagcauucagacacugc

SEQ ID NO: 559380 - RNA, 23 nt, Human
cccacuaaauucagagaaccacc

SEQ ID NO: 559381 - RNA, 21 nt, Human
cccauccuucugccucucuca

SEQ ID NO: 559382 - RNA, 21 nt, Human
ccccacuaaauucagagaacc

SEQ ID NO: 559383 - RNA, 19 nt, Human
ccccagaacuuuaaaaaaa

SEQ ID NO: 559384 - RNA, 24 nt, Human
ccccagaggugagguggagguagg

SEQ ID NO: 559385 - RNA, 18 nt, Human
ccccagagugcugggauu

SEQ ID NO: 559386 - RNA, 20 nt, Human
ccuacguaacaaaccugcac

SEQ ID NO: 559387 - RNA, 24 nt, Human
ccuccccagaggugagguggaggu

SEQ ID NO: 559388 - RNA, 24 nt, Human
ccugacagaggugaccuucucaaa

SEQ ID NO: 559389 - RNA, 22 nt, Human
ccugaccucgugauccacccac

SEQ ID NO: 559390 - RNA, 19 nt, Human
ccugcacauccugagcaug

SEQ ID NO: 559391 - RNA, 19 nt, Human
ccuggcuaacauggugaaa

SEQ ID NO: 559392 - RNA, 24 nt, Human
ccuggcuaacauggugaaauucca

SEQ ID NO: 559393 - RNA, 22 nt, Human
ccugggugacagagcaagccuc

SEQ ID NO: 559394 - RNA, 19 nt, Human
ccuguagucccagcuaauc

SEQ ID NO: 559395 - RNA, 21 nt, Human
ccuguagucccagcuaaucgg

SEQ ID NO: 559396 - RNA, 24 nt, Human
cgagauugcgccacugcacuccag

SEQ ID NO: 559397 - RNA, 24 nt, Human
cgaggcgggcggaucaugagguca

SEQ ID NO: 559398 - RNA, 23 nt, Human
cgauagauggcccccauccuucu

SEQ ID NO: 559399 - RNA, 26 nt, Human
cgccacugcacuccagccugggugac

SEQ ID NO: 559400 - RNA, 24 nt, Human
cgcccaggcuggagugcaguggcg

SEQ ID NO: 559401 - RNA, 24 nt, Human
cgccuguaaucccagcacuuuggg

SEQ ID NO: 559402 - RNA, 24 nt, Human
cgccuguagucccagcuaaucggg

SEQ ID NO: 559403 - RNA, 23 nt, Human
cgugauccagccucccccacuaa

SEQ ID NO: 559404 - RNA, 19 nt, Human
cuagaagacauuauccuca

SEQ ID NO: 559405 - RNA, 22 nt, Human
cucacgccuguaaucccagcac

SEQ ID NO: 559406 - RNA, 24 nt, Human
cucacgccuguaaucccagcacuu

SEQ ID NO: 559407 - RNA, 24 nt, Human
cucacugcaagcucugccuccugg

SEQ ID NO: 559408 - RNA, 19 nt, Human
cuccaucucaaaaaaaaaa

SEQ ID NO: 559409 - RNA, 18 nt, Human
cuccugaccucgugaucc

SEQ ID NO: 559410 - RNA, 25 nt, Human
cuccugaccucgugauccacccacc

SEQ ID NO: 559411 - RNA, 21 nt, Human
cuccuggguucacgccauucu

SEQ ID NO: 559412 - RNA, 19 nt, Human
cugcaagcucugccuccug

SEQ ID NO: 559413 - RNA, 23 nt, Human
cugcuuguuccccgcauuucgua

SEQ ID NO: 559414 - RNA, 23 nt, Human
cuggcuaacauggugaaauucca

SEQ ID NO: 559415 - RNA, 19 nt, Human
cuugcagugagccgagauu

SEQ ID NO: 559416 - RNA, 21 nt, Human
cuugcagugagccgagauugc

SEQ ID NO: 559417 - RNA, 22 nt, Human
cuuggggcaaucuugacugccc

SEQ ID NO: 559418 - RNA, 22 nt, Human
gaacagaaaaccagacaccgca

SEQ ID NO: 559419 - RNA, 22 nt, Human
gaccucgugauccacccaccuc

SEQ ID NO: 559420 - RNA, 22 nt, Human
gaccucgugauccacccaccuc

SEQ ID NO: 559421 - RNA, 24 nt, Human
gaccucgugauccacccaccucgg

SEQ ID NO: 559422 - RNA, 25 nt, Human
gaccucgugauccacccaccucggc

SEQ ID NO: 559423 - RNA, 24 nt, Human
gacuacaggcacccgccaccaugc

SEQ ID NO: 559424 - RNA, 21 nt, Human
gagacagagucuugcucuauc

SEQ ID NO: 559425 - RNA, 18 nt, Human
gagacgggguuucaccac

SEQ ID NO: 559426 - RNA, 20 nt, Human
gagagcuaaugccugcuggg

SEQ ID NO: 559427 - RNA, 18 nt, Human
gagcuugcagugagccga

SEQ ID NO: 559428 - RNA, 23 nt, Human
gaggcgggcggaucaugagguca

SEQ ID NO: 559429 - RNA, 18 nt, Human
gaggggaacacauucacu

SEQ ID NO: 559430 - RNA, 18 nt, Human
gauuacagacaugagcca

SEQ ID NO: 559431 - RNA, 23 nt, Human
gauuacagacaugagccaccgca

SEQ ID NO: 559432 - RNA, 24 nt, Human
gcacuccagccugggugacagagc

SEQ ID NO: 559433 - RNA, 19 nt, Human
gcaggggguauggagagca

SEQ ID NO: 559434 - RNA, 19 nt, Human
gccacugcacuccagccug

SEQ ID NO: 559435 - RNA, 24 nt, Human
gccacugcacuccagccuggguga

SEQ ID NO: 559436 - RNA, 19 nt, Human
gcccaggcuggagugcagu

SEQ ID NO: 559437 - RNA, 20 nt, Human
gcccaggcuggagugcagug

SEQ ID NO: 559438 - RNA, 24 nt, Human
gccucagacucccaaguggcuggg

SEQ ID NO: 559439 - RNA, 25 nt, Human
gccuccuggguucacgccauucucc

SEQ ID NO: 559440 - RNA, 24 nt, Human
gcuaacauggugaaauuccaucuc

SEQ ID NO: 559441 - RNA, 25 nt, Human
gcucuaucgcccaggcuggagugca

SEQ ID NO: 559442 - RNA, 19 nt, Human
gcuggagugcaguggcgcg

SEQ ID NO: 559443 - RNA, 24 nt, Human
ggaagaauguccguggaaaaaaaa

SEQ ID NO: 559444 - RNA, 21 nt, Human
ggagguaggggagggguuggg

SEQ ID NO: 559445 - RNA, 24 nt, Human
ggauggucucgaucuccugaccuc

SEQ ID NO: 559446 - RNA, 22 nt, Human
ggauuacagacaugagccaccg

SEQ ID NO: 559447 - RNA, 20 nt, Human
ggcagggcggugggggguaa

SEQ ID NO: 559448 - RNA, 22 nt, Human
ggcaugguggugggcgccugua

SEQ ID NO: 559449 - RNA, 21 nt, Human
ggcggaucaugaggucaggag

SEQ ID NO: 559450 - RNA, 23 nt, Human
ggcgggcggaucaugaggucagg

SEQ ID NO: 559451 - RNA, 19 nt, Human
ggcgugagcccgggaggca

SEQ ID NO: 559452 - RNA, 24 nt, Human
gggcacacuggcucacgccuguaa

SEQ ID NO: 559453 - RNA, 24 nt, Human
gggcagggcggugggggguaaggg

SEQ ID NO: 559454 - RNA, 22 nt, Human
gggcggugggggguaagggggc

SEQ ID NO: 559455 - RNA, 19 nt, Human
gggcucagaggccugacag

SEQ ID NO: 559456 - RNA, 24 nt, Human
gguggugggcgccuguagucccag

SEQ ID NO: 559457 - RNA, 21 nt, Human
gugauccacccaccucggccc

SEQ ID NO: 559458 - RNA, 25 nt, Human
guuuuguuacauuaggucucuucca

SEQ ID NO: 559459 - RNA, 23 nt, Human
uaaaaagccauauuuggcuagug

SEQ ID NO: 559460 - RNA, 18 nt, Human
uaacagcaaagacgugga

SEQ ID NO: 559461 - RNA, 22 nt, Human
uaacauggugaaauuccaucuc

SEQ ID NO: 559462 - RNA, 24 nt, Human
uaacauggugaaauuccaucucua

SEQ ID NO: 559463 - RNA, 23 nt, Human
uaagacacuccacaagagaacuc

SEQ ID NO: 559464 - RNA, 25 nt, Human
uaagauaaucccacaagcauucaga

SEQ ID NO: 559465 - RNA, 24 nt, Human
uacagacaugagccaccgcaccca

SEQ ID NO: 559466 - RNA, 24 nt, Human
uacaggcacccgccaccaugccca

SEQ ID NO: 559467 - RNA, 22 nt, Human
uaccaagaccaaaacaaggcaa

SEQ ID NO: 559468 - RNA, 22 nt, Human
uaccaagaccaaaacaaggcaa

SEQ ID NO: 559469 - RNA, 23 nt, Human
uaccagaaggaggaagaaugucc

SEQ ID NO: 559470 - RNA, 22 nt, Human
uaccccagaacuuuaaaaaaau

SEQ ID NO: 559471 - RNA, 18 nt, Human
uacgugcaggucacaggg

SEQ ID NO: 559472 - RNA, 21 nt, Human
uagagacgggguuucaccaca

SEQ ID NO: 559473 - RNA, 24 nt, Human
uagaguuucaggauaacucagaug

SEQ ID NO: 559474 - RNA, 25 nt, Human
uagauggcccccauccuucugccuc

SEQ ID NO: 559475 - RNA, 23 nt, Human
uaguagagacgggguuucaccac

SEQ ID NO: 559476 - RNA, 26 nt, Human
uaguagagacgggguuucaccacauu

SEQ ID NO: 559477 - RNA, 19 nt, Human
uaucgcccaggcuggagug

SEQ ID NO: 559478 - RNA, 21 nt, Human
uauuacaaaguaccuucuaaa

SEQ ID NO: 559479 - RNA, 21 nt, Human
uauuacaaaguaccuucuaaa

SEQ ID NO: 559480 - RNA, 21 nt, Human
uauuacaaaguaccuucuaaa

SEQ ID NO: 559481 - RNA, 19 nt, Human
ucaaaauagaauuguagaa

SEQ ID NO: 559482 - RNA, 18 nt, Human
ucaacccaaaugcccauc

SEQ ID NO: 559483 - RNA, 24 nt, Human
ucaccacauuagccaggauggucu

SEQ ID NO: 559484 - RNA, 18 nt, Human
ucacugcaagcucugccu

SEQ ID NO: 559485 - RNA, 23 nt, Human
ucacugcaagcucugccuccugg

SEQ ID NO: 559486 - RNA, 24 nt, Human
ucacugcaagcucugccuccuggg

SEQ ID NO: 559487 - RNA, 22 nt, Human
ucacuggggccugucagaggag

SEQ ID NO: 559488 - RNA, 22 nt, Human
ucagaggagggcaggggguaug

SEQ ID NO: 559489 - RNA, 22 nt, Human
ucagcaaacuaaugcaggaaca

SEQ ID NO: 559490 - RNA, 24 nt, Human
ucaugaggucaggagauaaagacc

SEQ ID NO: 559491 - RNA, 18 nt, Human
uccacccaccucggcccc

SEQ ID NO: 559492 - RNA, 18 nt, Human
uccagccugggugacaga

SEQ ID NO: 559493 - RNA, 24 nt, Human
ucccaaguggcugggacuacaggc

SEQ ID NO: 559494 - RNA, 20 nt, Human
uccccagaggugagguggag

SEQ ID NO: 559495 - RNA, 20 nt, Human
uccguggaaaaaaaauccuc

SEQ ID NO: 559496 - RNA, 19 nt, Human
uccugagcauguaccccag

SEQ ID NO: 559497 - RNA, 24 nt, Human
uccuggguucacgccauucuccug

SEQ ID NO: 559498 - RNA, 24 nt, Human
ucgcccaggcuggagugcaguggc

SEQ ID NO: 559499 - RNA, 24 nt, Human
ucuaucgcccaggcuggagugcag

SEQ ID NO: 559500 - RNA, 23 nt, Human
ucucauggaccaucuccugcagg

SEQ ID NO: 559501 - RNA, 22 nt, Human
ucucuacuaaaaauacaaaaaa

SEQ ID NO: 559502 - RNA, 18 nt, Human
ucugacaaggaaaacauu

SEQ ID NO: 559503 - RNA, 23 nt, Human
ucuucaguugcuucaggccaucu

SEQ ID NO: 559504 - RNA, 19 nt, Human
ucuugcucuaucgcccagg

SEQ ID NO: 559505 - RNA, 22 nt, Human
ucuugcucuaucgcccaggcug

SEQ ID NO: 559506 - RNA, 23 nt, Human
ucuugcucuaucgcccaggcugg

SEQ ID NO: 559507 - RNA, 24 nt, Human
ucuugcucuaucgcccaggcugga

SEQ ID NO: 559508 - RNA, 22 nt, Human
ugaaaaagaaagucuuccagau

SEQ ID NO: 559509 - RNA, 18 nt, Human
ugaagggaaggagcaggg

SEQ ID NO: 559510 - RNA, 22 nt, Human
ugagccgagauugcgccacugc

SEQ ID NO: 559511 - RNA, 24 nt, Human
ugauccacccaccucggcccccca

SEQ ID NO: 559512 - RNA, 23 nt, Human
ugcagcaaaccaccauggcacac

SEQ ID NO: 559513 - RNA, 21 nt, Human
ugccucagacucccaaguggc

SEQ ID NO: 559514 - RNA, 24 nt, Human
ugccucagacucccaaguggcugg

SEQ ID NO: 559515 - RNA, 19 nt, Human
ugccuccuggguucacgcc

SEQ ID NO: 559516 - RNA, 24 nt, Human
ugcucuaucgcccaggcuggagug

SEQ ID NO: 559517 - RNA, 24 nt, Human
ugcugggauuacagacaugagcca

SEQ ID NO: 559518 - RNA, 22 nt, Human
uggaaaaaaaauccuccuagga

SEQ ID NO: 559519 - RNA, 24 nt, Human
uggaagaauggcgugagcccggga

SEQ ID NO: 559520 - RNA, 20 nt, Human
uggaaucaacccaaaugccc

SEQ ID NO: 559521 - RNA, 20 nt, Human
uggaaugucaucaguuaagg

SEQ ID NO: 559522 - RNA, 22 nt, Human
uggaauuuuaagauaaucccac

SEQ ID NO: 559523 - RNA, 22 nt, Human
uggagguaggggagggguuggg

SEQ ID NO: 559524 - RNA, 23 nt, Human
uggagugcaguggcgcgaucuca

SEQ ID NO: 559525 - RNA, 24 nt, Human
uggagugcaguggcgcgaucucag

SEQ ID NO: 559526 - RNA, 23 nt, Human
uggcaauaccaagaccaaaacaa

SEQ ID NO: 559527 - RNA, 18 nt, Human
uggccauguggcugagga

SEQ ID NO: 559528 - RNA, 21 nt, Human
uggcccccauccuucugccuc

SEQ ID NO: 559529 - RNA, 24 nt, Human
uggcgcgaucucagcucacugcaa

SEQ ID NO: 559530 - RNA, 18 nt, Human
uggcuaguugucuguuca

SEQ ID NO: 559531 - RNA, 22 nt, Human
uggcucacgccuguaaucccag

SEQ ID NO: 559532 - RNA, 24 nt, Human
uggcucacgccuguaaucccagca

SEQ ID NO: 559533 - RNA, 21 nt, Human
ugggacuacaggcacccgcca

SEQ ID NO: 559534 - RNA, 22 nt, Human
ugggacuacaggcacccgccac

SEQ ID NO: 559535 - RNA, 24 nt, Human
ugggacuacaggcacccgccacca

SEQ ID NO: 559536 - RNA, 25 nt, Human
ugggacuacaggcacccgccaccau

SEQ ID NO: 559537 - RNA, 19 nt, Human
ugggaggccgaggcgggcg

SEQ ID NO: 559538 - RNA, 24 nt, Human
ugggaggccgaggcgggcggauca

SEQ ID NO: 559539 - RNA, 18 nt, Human
ugggauuacagacaugag

SEQ ID NO: 559540 - RNA, 21 nt, Human
ugggauuacagacaugagcca

SEQ ID NO: 559541 - RNA, 22 nt, Human
ugggauuacagacaugagccac

SEQ ID NO: 559542 - RNA, 23 nt, Human
ugggauuacagacaugagccacc

SEQ ID NO: 559543 - RNA, 24 nt, Human
ugggauuacagacaugagccaccg

SEQ ID NO: 559544 - RNA, 24 nt, Human
ugggauuacagacaugagccaccg

SEQ ID NO: 559545 - RNA, 26 nt, Human
ugggauuacagacaugagccaccgca

SEQ ID NO: 559546 - RNA, 20 nt, Human
uggguucacgccauucuccu

SEQ ID NO: 559547 - RNA, 24 nt, Human
ugguggugggcgccuguaguccca

SEQ ID NO: 559548 - RNA, 20 nt, Human
ugucagaggagggcaggggg

SEQ ID NO: 559549 - RNA, 24 nt, Human
ugucagaggagggcaggggguaug

SEQ ID NO: 559550 - RNA, 21 nt, Human
uguucaugcuauucucuccca

SEQ ID NO: 559551 - RNA, 24 nt, Human
uguuuuguauuuuuuuaguagaga

SEQ ID NO: 559552 - RNA, 26 nt, Human
uguuuuguauuuuuuuaguagagacg

SEQ ID NO: 559553 - RNA, 19 nt, Human
uuacaaaguaccuucuaaa

SEQ ID NO: 559554 - RNA, 19 nt, Human
uuacaaaguaccuucuaaa

SEQ ID NO: 559555 - RNA, 18 nt, Human
uuagccgggcaugguggu

SEQ ID NO: 559556 - RNA, 24 nt, Human
uuagccgggcaugguggugggcgc

SEQ ID NO: 559557 - RNA, 18 nt, Human
uuaguagagacgggguuu

SEQ ID NO: 559558 - RNA, 22 nt, Human
uuaguagagacgggguuucacc

SEQ ID NO: 559559 - RNA, 25 nt, Human
uuaguagagacgggguuucaccaca

SEQ ID NO: 559560 - RNA, 21 nt, Human
uucaugcuauucucucccaca

SEQ ID NO: 559561 - RNA, 21 nt, Human
uucuaaguuaaaaagccauau

SEQ ID NO: 559562 - RNA, 18 nt, Human
uugcagugagccgagauu

SEQ ID NO: 559563 - RNA, 19 nt, Human
uugcagugagccgagauug

SEQ ID NO: 559564 - RNA, 22 nt, Human
uugcagugagccgagauugcgc

SEQ ID NO: 559565 - RNA, 24 nt, Human
uugcucuaucgcccaggcuggagu

SEQ ID NO: 559566 - RNA, 25 nt, Human
uugggaggccgaggcgggcggauca

SEQ ID NO: 559567 - RNA, 19 nt, Human
uuggggcaaucuugacugc

SEQ ID NO: 559568 - RNA, 21 nt, Human
uuuuguauuuuuuuaguagag

SEQ ID NO: 559569 - RNA, 22 nt, Human
uuuuguauuuuuuuaguagaga

SEQ ID NO: 559570 - RNA, 24 nt, Human
uuuuuaguagagacgggguuucac

SEQ ID NO: 559571 - RNA, 23 nt, Human
uuuuuuaguagagacgggguuuc

SEQ ID NO: 559572 - RNA, 18 nt, Human
agcggcaaaggcgaauuc

SEQ ID NO: 559573 - RNA, 20 nt, Human
aggcuggcgggcgggcaggc

SEQ ID NO: 559574 - RNA, 24 nt, Human
caccuccuuccaggcggugugacc

SEQ ID NO: 559575 - RNA, 22 nt, Human
caggcaugcgagccggcguucu

SEQ ID NO: 559576 - RNA, 18 nt, Human
cccccgucaccuccuucc

SEQ ID NO: 559577 - RNA, 25 nt, Human
cgcggcuaaguguucagagacugcc

SEQ ID NO: 559578 - RNA, 21 nt, Human
cggaaaaggccguacccggca

SEQ ID NO: 559579 - RNA, 22 nt, Human
cggcaaaggcgaauucuuugac

SEQ ID NO: 559580 - RNA, 18 nt, Human
cggcaggcuggcgggcgg

SEQ ID NO: 559581 - RNA, 18 nt, Human
gaccuggaagccccggcg

SEQ ID NO: 559582 - RNA, 19 nt, Human
gaguagagauggggacaca

SEQ ID NO: 559583 - RNA, 18 nt, Human
gcaggcuggcgggcgggc

SEQ ID NO: 559584 - RNA, 20 nt, Human
gcaggcuggcgggcgggcag

SEQ ID NO: 559585 - RNA, 18 nt, Human
gccccgcgccgcccccgu

SEQ ID NO: 559586 - RNA, 22 nt, Human
ggcgggcaggcaugcgagccgg

SEQ ID NO: 559587 - RNA, 28 nt, Human
gggcgggcaggcaugcgagccggcguuc

SEQ ID NO: 559588 - RNA, 18 nt, Human
ggggaguguccgcgcccc

SEQ ID NO: 559589 - RNA, 24 nt, Human
uauuguguaaaguuuauagaagua

SEQ ID NO: 559590 - RNA, 20 nt, Human
uccaaagaguccauugcgca

SEQ ID NO: 559591 - RNA, 19 nt, Human
ucuccaaagaguccauugc

SEQ ID NO: 559592 - RNA, 22 nt, Human
uggcgcggcuaaguguucagag

SEQ ID NO: 559593 - RNA, 21 nt, Human
uuaaaauaucuucuuucucca

SEQ ID NO: 559594 - RNA, 19 nt, Human
uuccuuuguacaaaguaca

SEQ ID NO: 559595 - RNA, 23 nt, Human
uuuacagacacacuaaaaauguu

SEQ ID NO: 559596 - RNA, 19 nt, Human
aaagugcugggauuacaga

SEQ ID NO: 559597 - RNA, 24 nt, Human
aaagugcugggauuacagacguga

SEQ ID NO: 559598 - RNA, 19 nt, Human
aacaaaaaaagccagagag

SEQ ID NO: 559599 - RNA, 19 nt, Human
aacaaaacaaaaaaagccg

SEQ ID NO: 559600 - RNA, 19 nt, Human
aaccgggccagccuuggcc

SEQ ID NO: 559601 - RNA, 20 nt, Human
aacuuggccucgcaggcaca

SEQ ID NO: 559602 - RNA, 21 nt, Human
aagaugcugccguccuuaaca

SEQ ID NO: 559603 - RNA, 20 nt, Human
aagcagcguugcugcacaag

SEQ ID NO: 559604 - RNA, 19 nt, Human
aagggacagguugccacug

SEQ ID NO: 559605 - RNA, 19 nt, Human
aagugcugggauuacagac

SEQ ID NO: 559606 - RNA, 26 nt, Human
aagugcugggauuacagacgugagcc

SEQ ID NO: 559607 - RNA, 19 nt, Human
acaaaacaaaaaaagccag

SEQ ID NO: 559608 - RNA, 22 nt, Human
acaaaacaaaaaaagccagaga

SEQ ID NO: 559609 - RNA, 23 nt, Human
acaaaacaaaaaaagccagagag

SEQ ID NO: 559610 - RNA, 18 nt, Human
acaagcgugccgggcccc

SEQ ID NO: 559611 - RNA, 22 nt, Human
acaccagaaccgggccagccuu

SEQ ID NO: 559612 - RNA, 18 nt, Human
acagacgugagccaccgc

SEQ ID NO: 559613 - RNA, 18 nt, Human
acgcagggugagauaaga

SEQ ID NO: 559614 - RNA, 24 nt, Human
acggagucuugcugugucgcccag

SEQ ID NO: 559615 - RNA, 21 nt, Human
acgugagccaccgcgccuggc

SEQ ID NO: 559616 - RNA, 20 nt, Human
acugcaagcucugccuccca

SEQ ID NO: 559617 - RNA, 21 nt, Human
agaaccgggccagccuuggcc

SEQ ID NO: 559618 - RNA, 22 nt, Human
agaccuuuaucucagagagggc

SEQ ID NO: 559619 - RNA, 23 nt, Human
agagaggaaaacaaaacaaaaaa

SEQ ID NO: 559620 - RNA, 22 nt, Human
agagggcaguaguggggcuggg

SEQ ID NO: 559621 - RNA, 21 nt, Human
agaugugagaggcuggcagcc

SEQ ID NO: 559622 - RNA, 24 nt, Human
agccgcuuuauccucucgggggcu

SEQ ID NO: 559623 - RNA, 21 nt, Human
agccuuccgaguagcugggac

SEQ ID NO: 559624 - RNA, 23 nt, Human
agcgugcucggcuccuagacggc

SEQ ID NO: 559625 - RNA, 27 nt, Human
aggagagggcaguaguggggcugggau

SEQ ID NO: 559626 - RNA, 25 nt, Human
aggcuggagugcaguggcgcgaucu

SEQ ID NO: 559627 - RNA, 23 nt, Human
agggaaccagcugaucagaggcc

SEQ ID NO: 559628 - RNA, 23 nt, Human
aggguggagaaggucccucuuug

SEQ ID NO: 559629 - RNA, 18 nt, Human
aguagcugggacuacagg

SEQ ID NO: 559630 - RNA, 23 nt, Human
agugcaguggcgcgaucuuggcu

SEQ ID NO: 559631 - RNA, 24 nt, Human
agugcaguggcgcgaucuuggcuc

SEQ ID NO: 559632 - RNA, 20 nt, Human
agugccccgggcagccuucc

SEQ ID NO: 559633 - RNA, 24 nt, Human
agugcugggauuacagacgugagc

SEQ ID NO: 559634 - RNA, 22 nt, Human
auaagaugcugccguccuuaac

SEQ ID NO: 559635 - RNA, 20 nt, Human
caaaaaaagccagagagaaa

SEQ ID NO: 559636 - RNA, 24 nt, Human
caaaaaaagccagagagaagcuag

SEQ ID NO: 559637 - RNA, 24 nt, Human
caaagugcugggauuacagacgug

SEQ ID NO: 559638 - RNA, 22 nt, Human
caacacaagagcaaaaucuccu

SEQ ID NO: 559639 - RNA, 26 nt, Human
caagagcaaaaucuccugcucaccag

SEQ ID NO: 559640 - RNA, 18 nt, Human
caaguaaugugcucgcaa

SEQ ID NO: 559641 - RNA, 21 nt, Human
cacacguucucugcucgcgcc

SEQ ID NO: 559642 - RNA, 23 nt, Human
cacacguucucugcucgcgccuc

SEQ ID NO: 559643 - RNA, 18 nt, Human
caccauguuagccaggau

SEQ ID NO: 559644 - RNA, 22 nt, Human
caccauguuagccaggaugguc

SEQ ID NO: 559645 - RNA, 24 nt, Human
caccauguuagccaggauggucuc

SEQ ID NO: 559646 - RNA, 22 nt, Human
caccuguagcucagggacuggg

SEQ ID NO: 559647 - RNA, 18 nt, Human
cacgacaccagcggaggg

SEQ ID NO: 559648 - RNA, 22 nt, Human
cacgccauucuccugccuuagc

SEQ ID NO: 559649 - RNA, 20 nt, Human
cacugcgugcaggccagaac

SEQ ID NO: 559650 - RNA, 25 nt, Human
cagacaaagugcucaagcauuuucc

SEQ ID NO: 559651 - RNA, 33 nt, Human
cagagagaagcuagccagucuagagcucggagg

SEQ ID NO: 559652 - RNA, 19 nt, Human
cagaggcugccagugcccc

SEQ ID NO: 559653 - RNA, 20 nt, Human
cagcaauucuaaagagagga

SEQ ID NO: 559654 - RNA, 19 nt, Human
cagcagacaaagugcucaa

SEQ ID NO: 559655 - RNA, 19 nt, Human
caggaccaccacgacacca

SEQ ID NO: 559656 - RNA, 24 nt, Human
caguaguggggcugggcuggccag

SEQ ID NO: 559657 - RNA, 19 nt, Human
caguggcgcgaucuuggcu

SEQ ID NO: 559658 - RNA, 22 nt, Human
ccaaagugcugggauuacagac

SEQ ID NO: 559659 - RNA, 24 nt, Human
ccaaagugcugggauuacagacgu

SEQ ID NO: 559660 - RNA, 18 nt, Human
ccaccgcgccuggccuca

SEQ ID NO: 559661 - RNA, 22 nt, Human
ccaccuguagcucagggacugg

SEQ ID NO: 559662 - RNA, 23 nt, Human
ccacgacaccagcggagggaaca

SEQ ID NO: 559663 - RNA, 19 nt, Human
ccagcuccaggcggaggca

SEQ ID NO: 559664 - RNA, 22 nt, Human
cccaggcuggagugcaguggcg

SEQ ID NO: 559665 - RNA, 20 nt, Human
cccagguucacgccauucuc

SEQ ID NO: 559666 - RNA, 19 nt, Human
ccccagaggcugccagugc

SEQ ID NO: 559667 - RNA, 22 nt, Human
ccccagaggcugccagugcccc

SEQ ID NO: 559668 - RNA, 22 nt, Human
ccccagggcacgcugccccucc

SEQ ID NO: 559669 - RNA, 27 nt, Human
cccccaaucaggucggugacaugucug

SEQ ID NO: 559670 - RNA, 23 nt, Human
ccucggaguggagcucucaacuu

SEQ ID NO: 559671 - RNA, 21 nt, Human
ccucucgggggcucacugccc

SEQ ID NO: 559672 - RNA, 21 nt, Human
ccugccugcugcugcccgcug

SEQ ID NO: 559673 - RNA, 23 nt, Human
ccugccuuagccuuccgaguagc

SEQ ID NO: 559674 - RNA, 24 nt, Human
ccugcugcugcccgcugcguccgu

SEQ ID NO: 559675 - RNA, 21 nt, Human
ccuguagcucagggacugggg

SEQ ID NO: 559676 - RNA, 24 nt, Human
cgaaaagguacuaaacuggcucug

SEQ ID NO: 559677 - RNA, 22 nt, Human
cgagcagccgcuuuauccucuc

SEQ ID NO: 559678 - RNA, 24 nt, Human
cgccucggccucccaaagugcugg

SEQ ID NO: 559679 - RNA, 24 nt, Human
cggagucuugcugugucgcccagg

SEQ ID NO: 559680 - RNA, 21 nt, Human
cggcuccuagacggcuuggga

SEQ ID NO: 559681 - RNA, 18 nt, Human
cgggggcucacugcccac

SEQ ID NO: 559682 - RNA, 22 nt, Human
cgugcgcugcccugccugcugc

SEQ ID NO: 559683 - RNA, 26 nt, Human
cuaaagagaggaaaacaaaacaaagg

SEQ ID NO: 559684 - RNA, 23 nt, Human
cuaauuuuuuguauuuuuaguag

SEQ ID NO: 559685 - RNA, 25 nt, Human
cuagugcugaaaaaccagaccuuua

SEQ ID NO: 559686 - RNA, 21 nt, Human
cuauguacauauauacacaua

SEQ ID NO: 559687 - RNA, 18 nt, Human
cucaagggacagguugcc

SEQ ID NO: 559688 - RNA, 21 nt, Human
cucagcacuaaaaaucucuuc

SEQ ID NO: 559689 - RNA, 24 nt, Human
cuccugaccucgugauccguccgc

SEQ ID NO: 559690 - RNA, 22 nt, Human
cucgcaaucuguucgagcagcc

SEQ ID NO: 559691 - RNA, 20 nt, Human
cucucuggcuauguacauau

SEQ ID NO: 559692 - RNA, 23 nt, Human
cugccuuagccuuccgaguagcu

SEQ ID NO: 559693 - RNA, 24 nt, Human
cuuagccuuccgaguagcugggac

SEQ ID NO: 559694 - RNA, 24 nt, Human
cuucauaguguaagcagcguugcu

SEQ ID NO: 559695 - RNA, 19 nt, Human
gaaaacaaaacaaaaaaag

SEQ ID NO: 559696 - RNA, 20 nt, Human
gaaaacaaaacaaaaaaagc

SEQ ID NO: 559697 - RNA, 23 nt, Human
gaaaacaaaacaaaaaaagccag

SEQ ID NO: 559698 - RNA, 24 nt, Human
gaaaacaaaacaaaaaaagccaga

SEQ ID NO: 559699 - RNA, 18 nt, Human
gaaugcaacaccagaacc

SEQ ID NO: 559700 - RNA, 22 nt, Human
gaccucgugauccguccgccuc

SEQ ID NO: 559701 - RNA, 24 nt, Human
gaccucgugauccguccgccucgg

SEQ ID NO: 559702 - RNA, 18 nt, Human
gagaaagaacauuucaaa

SEQ ID NO: 559703 - RNA, 21 nt, Human
gagaaagaacauuucaaaagc

SEQ ID NO: 559704 - RNA, 20 nt, Human
gaguagcugggacuacaggc

SEQ ID NO: 559705 - RNA, 27 nt, Human
gaguagcugggacuacaggcgccagcc

SEQ ID NO: 559706 - RNA, 19 nt, Human
gauacaaguauacagcaau

SEQ ID NO: 559707 - RNA, 20 nt, Human
gaucagaggccacgcccuuc

SEQ ID NO: 559708 - RNA, 18 nt, Human
gauuacagacgugagcca

SEQ ID NO: 559709 - RNA, 22 nt, Human
gauuacagacgugagccaccgc

SEQ ID NO: 559710 - RNA, 22 nt, Human
gcaaaauaaaagguauuucugc

SEQ ID NO: 559711 - RNA, 22 nt, Human
gcaagcucugccucccagguuc

SEQ ID NO: 559712 - RNA, 21 nt, Human
gcaguaguggggcugggcugg

SEQ ID NO: 559713 - RNA, 19 nt, Human
gcccaggcuggagugcagu

SEQ ID NO: 559714 - RNA, 20 nt, Human
gcccaggcuggagugcagug

SEQ ID NO: 559715 - RNA, 25 nt, Human
gccucccagguucacgccauucucc

SEQ ID NO: 559716 - RNA, 20 nt, Human
gcgccagccaccacacccgg

SEQ ID NO: 559717 - RNA, 19 nt, Human
gcgcugcccugccugcugc

SEQ ID NO: 559718 - RNA, 22 nt, Human
gcgcugcccugccugcugcugc

SEQ ID NO: 559719 - RNA, 19 nt, Human
gcgugccgggccccucaug

SEQ ID NO: 559720 - RNA, 21 nt, Human
gcucacugcaagcucugccuc

SEQ ID NO: 559721 - RNA, 21 nt, Human
ggacuggggacgagcaggaga

SEQ ID NO: 559722 - RNA, 24 nt, Human
ggauggucucgaucuccugaccuc

SEQ ID NO: 559723 - RNA, 22 nt, Human
ggauguugacauuucauucugu

SEQ ID NO: 559724 - RNA, 21 nt, Human
ggcagcccacauuauuacuau

SEQ ID NO: 559725 - RNA, 22 nt, Human
gggcagccaggaacucaugaca

SEQ ID NO: 559726 - RNA, 21 nt, Human
gggcuggccaguuucccaccg

SEQ ID NO: 559727 - RNA, 19 nt, Human
ggggguuucaccauguuag

SEQ ID NO: 559728 - RNA, 24 nt, Human
ggggguuucaccauguuagccagg

SEQ ID NO: 559729 - RNA, 18 nt, Human
gggguuucaccauguuag

SEQ ID NO: 559730 - RNA, 23 nt, Human
gggguuucaccauguuagccagg

SEQ ID NO: 559731 - RNA, 21 nt, Human
ggguggagaaggucccucuuu

SEQ ID NO: 559732 - RNA, 22 nt, Human
ggguucugacuccacaggccug

SEQ ID NO: 559733 - RNA, 24 nt, Human
gguuucaccauguuagccaggaug

SEQ ID NO: 559734 - RNA, 21 nt, Human
guaagcagcguugcugcacaa

SEQ ID NO: 559735 - RNA, 22 nt, Human
guaguggggcugggcuggccag

SEQ ID NO: 559736 - RNA, 21 nt, Human
gugaauuuuugauaucgaaaa

SEQ ID NO: 559737 - RNA, 26 nt, Human
gugaugcucuugacaucuuguuuucu

SEQ ID NO: 559738 - RNA, 23 nt, Human
gugccgggccccucaugcaggcc

SEQ ID NO: 559739 - RNA, 18 nt, Human
uaaaaugcccucaaggaa

SEQ ID NO: 559740 - RNA, 23 nt, Human
uaaaaugcccucaaggaaucuuu

SEQ ID NO: 559741 - RNA, 28 nt, Human
uaaagagaggaaaacaaaacaaaaaaag

SEQ ID NO: 559742 - RNA, 23 nt, Human
uaauagugaaaaucacucagcac

SEQ ID NO: 559743 - RNA, 24 nt, Human
uaauuuuuuguauuuuuaguagag

SEQ ID NO: 559744 - RNA, 25 nt, Human
uaauuuuuuguauuuuuaguagaga

SEQ ID NO: 559745 - RNA, 22 nt, Human
uacagacgugagccaccgcgcc

SEQ ID NO: 559746 - RNA, 23 nt, Human
uacaggcgccagccaccacaccc

SEQ ID NO: 559747 - RNA, 25 nt, Human
uaguagagacggggguuucaccaug

SEQ ID NO: 559748 - RNA, 24 nt, Human
uauauacacauauucacauauaua

SEQ ID NO: 559749 - RNA, 26 nt, Human
uauguacauauauacacauauucaca

SEQ ID NO: 559750 - RNA, 24 nt, Human
ucaccauguuagccaggauggucu

SEQ ID NO: 559751 - RNA, 18 nt, Human
ucacugcaagcucugccu

SEQ ID NO: 559752 - RNA, 18 nt, Human
ucacugcaagcucugccu

SEQ ID NO: 559753 - RNA, 19 nt, Human
ucacugcaagcucugccuc

SEQ ID NO: 559754 - RNA, 24 nt, Human
ucacugcaagcucugccucccagg

SEQ ID NO: 559755 - RNA, 20 nt, Human
ucagggagggggagcaaguc

SEQ ID NO: 559756 - RNA, 19 nt, Human
ucauuuacacacccaaaaa

SEQ ID NO: 559757 - RNA, 23 nt, Human
uccacacucaaguggccugggac

SEQ ID NO: 559758 - RNA, 18 nt, Human
uccaccucggaguggagc

SEQ ID NO: 559759 - RNA, 18 nt, Human
ucccaaagugcugggauu

SEQ ID NO: 559760 - RNA, 24 nt, Human
ucccaaagugcugggauuacagac

SEQ ID NO: 559761 - RNA, 19 nt, Human
ucccagguucacgccauuc

SEQ ID NO: 559762 - RNA, 21 nt, Human
ucccagguucacgccauucuc

SEQ ID NO: 559763 - RNA, 24 nt, Human
ucccagguucacgccauucuccug

SEQ ID NO: 559764 - RNA, 23 nt, Human
uccgaguagcugggacuacaggc

SEQ ID NO: 559765 - RNA, 24 nt, Human
uccgaguagcugggacuacaggcg

SEQ ID NO: 559766 - RNA, 21 nt, Human
uccgugccaggcaacgcaggg

SEQ ID NO: 559767 - RNA, 24 nt, Human
ucgcccaggcuggagugcaguggc

SEQ ID NO: 559768 - RNA, 18 nt, Human
ucggccucccaaagugcu

SEQ ID NO: 559769 - RNA, 21 nt, Human
ucucaacacaagagcaaaauc

SEQ ID NO: 559770 - RNA, 19 nt, Human
ucucaagggacagguugcc

SEQ ID NO: 559771 - RNA, 22 nt, Human
ucucagggagggggagcaaguc

SEQ ID NO: 559772 - RNA, 24 nt, Human
ucuccugccuuagccuuccgagua

SEQ ID NO: 559773 - RNA, 20 nt, Human
ucuccugcucaccagccugg

SEQ ID NO: 559774 - RNA, 20 nt, Human
ucucgugcgcugcccugccu

SEQ ID NO: 559775 - RNA, 24 nt, Human
ucuguaaaaugcccucaaggaauc

SEQ ID NO: 559776 - RNA, 23 nt, Human
ucuugcugugucgcccaggcugg

SEQ ID NO: 559777 - RNA, 24 nt, Human
ucuugcugugucgcccaggcugga

SEQ ID NO: 559778 - RNA, 19 nt, Human
ucuuugauuuguuuuaaac

SEQ ID NO: 559779 - RNA, 22 nt, Human
ugaaaaggcaucaaggggagca

SEQ ID NO: 559780 - RNA, 19 nt, Human
ugaugcucuugacaucuug

SEQ ID NO: 559781 - RNA, 19 nt, Human
ugccucccagguucacgcc

SEQ ID NO: 559782 - RNA, 20 nt, Human
ugccugcugcugcccgcugc

SEQ ID NO: 559783 - RNA, 24 nt, Human
ugcucucgugcgcugcccugccug

SEQ ID NO: 559784 - RNA, 19 nt, Human
ugcugaggagauacaagua

SEQ ID NO: 559785 - RNA, 24 nt, Human
ugcugggauuacagacgugagcca

SEQ ID NO: 559786 - RNA, 24 nt, Human
ugcugugucgcccaggcuggagug

SEQ ID NO: 559787 - RNA, 23 nt, Human
uggagugcaguggcgcgaucuug

SEQ ID NO: 559788 - RNA, 24 nt, Human
uggagugcaguggcgcgaucuugg

SEQ ID NO: 559789 - RNA, 24 nt, Human
uggcaaaauaaaagguauuucugc

SEQ ID NO: 559790 - RNA, 20 nt, Human
uggcuauguacauauauaca

SEQ ID NO: 559791 - RNA, 19 nt, Human
uggcucacugcaagcucug

SEQ ID NO: 559792 - RNA, 22 nt, Human
ugggacuacaggcgccagccac

SEQ ID NO: 559793 - RNA, 24 nt, Human
ugggacuacaggcgccagccacca

SEQ ID NO: 559794 - RNA, 18 nt, Human
ugggauuacagacgugag

SEQ ID NO: 559795 - RNA, 19 nt, Human
ugggauuacagacgugagc

SEQ ID NO: 559796 - RNA, 21 nt, Human
ugggauuacagacgugagcca

SEQ ID NO: 559797 - RNA, 22 nt, Human
ugggauuacagacgugagccac

SEQ ID NO: 559798 - RNA, 23 nt, Human
ugggauuacagacgugagccacc

SEQ ID NO: 559799 - RNA, 24 nt, Human
ugggauuacagacgugagccaccg

SEQ ID NO: 559800 - RNA, 21 nt, Human
uggggacgagcaggagagggc

SEQ ID NO: 559801 - RNA, 20 nt, Human
uggggcugggcuggccaguu

SEQ ID NO: 559802 - RNA, 22 nt, Human
ugguccuggacuuccuacuccc

SEQ ID NO: 559803 - RNA, 21 nt, Human
uguauuuuuaguagagacggg

SEQ ID NO: 559804 - RNA, 21 nt, Human
ugucgcccaggcuggagugca

SEQ ID NO: 559805 - RNA, 24 nt, Human
ugucgcuaaggaacacccgguggg

SEQ ID NO: 559806 - RNA, 19 nt, Human
ugugcaagaugugagaggc

SEQ ID NO: 559807 - RNA, 25 nt, Human
uuaguagagacggggguuucaccau

SEQ ID NO: 559808 - RNA, 24 nt, Human
uucaagccaguuagcucucaggga

SEQ ID NO: 559809 - RNA, 24 nt, Human
uugcugugucgcccaggcuggagu

SEQ ID NO: 559810 - RNA, 24 nt, Human
uuguauuuuuaguagagacggggg

SEQ ID NO: 559811 - RNA, 19 nt, Human
uuucaccauguuagccagg

SEQ ID NO: 559812 - RNA, 20 nt, Human
uuucaccauguuagccagga

SEQ ID NO: 559813 - RNA, 21 nt, Human
uuuuguauuuuuaguagagac

SEQ ID NO: 559814 - RNA, 25 nt, Human
uuuuuaguagagacggggguuucac

SEQ ID NO: 559815 - RNA, 21 nt, Human
uuuuuguauuuuuaguagaga

SEQ ID NO: 559816 - RNA, 19 nt, Human
aagcgggaaugccggcaau

SEQ ID NO: 559817 - RNA, 22 nt, Human
aaguuuggagauugcacuaacu

SEQ ID NO: 559818 - RNA, 21 nt, Human
accagcagaagcgggaaugcc

SEQ ID NO: 559819 - RNA, 20 nt, Human
acuugcugccccggcaccuc

SEQ ID NO: 559820 - RNA, 18 nt, Human
agaguauaaaguggaaac

SEQ ID NO: 559821 - RNA, 19 nt, Human
agaguauaaaguggaaaca

SEQ ID NO: 559822 - RNA, 21 nt, Human
aggaggaaaggaagggcaggg

SEQ ID NO: 559823 - RNA, 21 nt, Human
aguaaaaugccuacuaaugcc

SEQ ID NO: 559824 - RNA, 20 nt, Human
caccuguccccucuuucuca

SEQ ID NO: 559825 - RNA, 23 nt, Human
cagccugcagcaugaagcaacca

SEQ ID NO: 559826 - RNA, 24 nt, Human
cagccugcagcaugaagcaaccag

SEQ ID NO: 559827 - RNA, 19 nt, Human
caugaaguuuggagauugc

SEQ ID NO: 559828 - RNA, 24 nt, Human
cccucuuucucagcuuggaguuuu

SEQ ID NO: 559829 - RNA, 21 nt, Human
ccggagcucaccuccacacac

SEQ ID NO: 559830 - RNA, 26 nt, Human
ccucaacauccaaucauuucucccug

SEQ ID NO: 559831 - RNA, 28 nt, Human
ccugcagcaugaagcaaccagcagaagc

SEQ ID NO: 559832 - RNA, 19 nt, Human
ccuuaugaagaguauucca

SEQ ID NO: 559833 - RNA, 21 nt, Human
cucccugcucugacaccuguc

SEQ ID NO: 559834 - RNA, 23 nt, Human
cucccugcucugacaccuguccc

SEQ ID NO: 559835 - RNA, 23 nt, Human
cugacaccuguccccucuuucuc

SEQ ID NO: 559836 - RNA, 19 nt, Human
cuucuauaucccacuuuag

SEQ ID NO: 559837 - RNA, 18 nt, Human
gaaacugaguuuuggaca

SEQ ID NO: 559838 - RNA, 21 nt, Human
gaguauaaaguggaaacacag

SEQ ID NO: 559839 - RNA, 19 nt, Human
gccugcagcaugaagcaac

SEQ ID NO: 559840 - RNA, 19 nt, Human
ggaaaaaaaaugucugcaa

SEQ ID NO: 559841 - RNA, 21 nt, Human
guucaaaugcagcuuuccuca

SEQ ID NO: 559842 - RNA, 22 nt, Human
uaagcaccugccaguuugugcc

SEQ ID NO: 559843 - RNA, 28 nt, Human
uaagccaaaauugcuaucuaccaaagua

SEQ ID NO: 559844 - RNA, 18 nt, Human
uaaguuacaugcuucgcc

SEQ ID NO: 559845 - RNA, 24 nt, Human
uacaugcuucgcccuccgcccccu

SEQ ID NO: 559846 - RNA, 21 nt, Human
uccucaacauccaaucauuuc

SEQ ID NO: 559847 - RNA, 24 nt, Human
ucucccugcucugacaccuguccc

SEQ ID NO: 559848 - RNA, 24 nt, Human
ugaagaguauuccaagguuuucau

SEQ ID NO: 559849 - RNA, 21 nt, Human
ugacaccuguccccucuuucu

SEQ ID NO: 559850 - RNA, 22 nt, Human
ugacaccuguccccucuuucuc

SEQ ID NO: 559851 - RNA, 21 nt, Human
ugccccaaucaaaaaugauac

SEQ ID NO: 559852 - RNA, 21 nt, Human
ugcuaucuaccaaaguauuua

SEQ ID NO: 559853 - RNA, 24 nt, Human
ugucuuaucccuaugauacaucca

SEQ ID NO: 559854 - RNA, 21 nt, Human
ugugaugauuccuucaggcuu

SEQ ID NO: 559855 - RNA, 19 nt, Human
ugugccauuaagccaaaau

SEQ ID NO: 559856 - RNA, 23 nt, Human
uuaagcaccugccaguuugugcc

SEQ ID NO: 559857 - RNA, 25 nt, Human
uucaggcuuauggggaaaaaaaaug

SEQ ID NO: 559858 - RNA, 21 nt, Human
uucaugcaaaugugagggucc

SEQ ID NO: 559859 - RNA, 24 nt, Human
uuccucaacauccaaucauuucuc

SEQ ID NO: 559860 - RNA, 19 nt, Human
uucucccugcucugacacc

SEQ ID NO: 559861 - RNA, 24 nt, Human
uuuaguccuuaugaagaguauucc

SEQ ID NO: 559862 - RNA, 19 nt, Human
uuuguuucagaauugucuu

SEQ ID NO: 559863 - RNA, 26 nt, Human
uuuucaugcaaaugugagggucccau

SEQ ID NO: 559864 - RNA, 18 nt, Human
aagaaccaaauucaggca

SEQ ID NO: 559865 - RNA, 21 nt, Human
aagccacccagagcuauuuac

SEQ ID NO: 559866 - RNA, 23 nt, Human
accacccccuacaauaaguccug

SEQ ID NO: 559867 - RNA, 24 nt, Human
accauacaacauuucaacauacaa

SEQ ID NO: 559868 - RNA, 20 nt, Human
accggaaccgccaaacugaa

SEQ ID NO: 559869 - RNA, 24 nt, Human
acugaacugcgcgccggaccggcg

SEQ ID NO: 559870 - RNA, 23 nt, Human
agaaauaugcuuuccuuuuuaac

SEQ ID NO: 559871 - RNA, 24 nt, Human
aguaaaaauuauaggaacugugga

SEQ ID NO: 559872 - RNA, 21 nt, Human
auaaagcaacaugcaaucccc

SEQ ID NO: 559873 - RNA, 23 nt, Human
auaaagcaacaugcaaucccccu

SEQ ID NO: 559874 - RNA, 20 nt, Human
auagcaccuguagaagaacc

SEQ ID NO: 559875 - RNA, 21 nt, Human
aucuuuauuucuccauaaggg

SEQ ID NO: 559876 - RNA, 21 nt, Human
augguuacggagaucguggua

SEQ ID NO: 559877 - RNA, 26 nt, Human
caauaaagcaacaugcaaucccccuc

SEQ ID NO: 559878 - RNA, 23 nt, Human
caccuguagaagaaccaaauuca

SEQ ID NO: 559879 - RNA, 24 nt, Human
caguaaccagaguacccagcacac

SEQ ID NO: 559880 - RNA, 26 nt, Human
caugcaaaugguuacggagaucgugg

SEQ ID NO: 559881 - RNA, 24 nt, Human
cauuucaacauacaaguuccuauu

SEQ ID NO: 559882 - RNA, 20 nt, Human
cccaaggacuuuccuaucac

SEQ ID NO: 559883 - RNA, 23 nt, Human
cccccaguaaaaauuauaggaac

SEQ ID NO: 559884 - RNA, 22 nt, Human
ccgccgggacuauuuugaccac

SEQ ID NO: 559885 - RNA, 20 nt, Human
cucuuucucuuuuuggcuug

SEQ ID NO: 559886 - RNA, 22 nt, Human
cugaacugcgcgccggaccggc

SEQ ID NO: 559887 - RNA, 20 nt, Human
cugcuguucuacuaaugcuc

SEQ ID NO: 559888 - RNA, 21 nt, Human
cugcuguucuacuaaugcucc

SEQ ID NO: 559889 - RNA, 18 nt, Human
cuuauagaggacuucauc

SEQ ID NO: 559890 - RNA, 18 nt, Human
cuucaggaucuuccuccc

SEQ ID NO: 559891 - RNA, 24 nt, Human
gagagcgguaccggaaccgccaaa

SEQ ID NO: 559892 - RNA, 23 nt, Human
ggaaggugcgagaccaaaucuua

SEQ ID NO: 559893 - RNA, 21 nt, Human
ggcaaucagagaaauaugcuu

SEQ ID NO: 559894 - RNA, 22 nt, Human
uaaacaagguugaaauguggua

SEQ ID NO: 559895 - RNA, 19 nt, Human
uaacaagcucaucuuuaau

SEQ ID NO: 559896 - RNA, 21 nt, Human
uaaugcacauaacauaugcuu

SEQ ID NO: 559897 - RNA, 21 nt, Human
uacaacauuucaacauacaag

SEQ ID NO: 559898 - RNA, 22 nt, Human
uagaaaguauaaguauugagag

SEQ ID NO: 559899 - RNA, 21 nt, Human
uagaagaaccaaauucaggca

SEQ ID NO: 559900 - RNA, 19 nt, Human
uagcaccuguagaagaacc

SEQ ID NO: 559901 - RNA, 21 nt, Human
uauacaagaacuaccauacaa

SEQ ID NO: 559902 - RNA, 20 nt, Human
uauuuucugaaauauuuaca

SEQ ID NO: 559903 - RNA, 18 nt, Human
uauuuugaaagauuggaa

SEQ ID NO: 559904 - RNA, 22 nt, Human
ucaacauacaaguuccuauacu

SEQ ID NO: 559905 - RNA, 22 nt, Human
ucaagccacccagagcuauuua

SEQ ID NO: 559906 - RNA, 18 nt, Human
ucaauagucuucaacuuc

SEQ ID NO: 559907 - RNA, 22 nt, Human
ucaggaucuuccucccuuuucu

SEQ ID NO: 559908 - RNA, 19 nt, Human
uccauacauugcuguuuuc

SEQ ID NO: 559909 - RNA, 19 nt, Human
ucuuccucccuuuucugcu

SEQ ID NO: 559910 - RNA, 22 nt, Human
ugaugagccugugaacuccacg

SEQ ID NO: 559911 - RNA, 21 nt, Human
ugccuuauuuaucucaguaac

SEQ ID NO: 559912 - RNA, 23 nt, Human
ugcucguucucuuugucauuuca

SEQ ID NO: 559913 - RNA, 19 nt, Human
uggaaggugcgagaccaaa

SEQ ID NO: 559914 - RNA, 19 nt, Human
uguagaagaaccaaauuca

SEQ ID NO: 559915 - RNA, 22 nt, Human
ugucugcucccucuguguccuc

SEQ ID NO: 559916 - RNA, 19 nt, Human
uguggugcucguucucuuu

SEQ ID NO: 559917 - RNA, 23 nt, Human
uguuuucagguucuacaauaauu

SEQ ID NO: 559918 - RNA, 24 nt, Human
uuaaacuuucguuucaagccaccc

SEQ ID NO: 559919 - RNA, 22 nt, Human
uuacaggccaauaaagcaacau

SEQ ID NO: 559920 - RNA, 18 nt, Human
uuacuaaaaugauccugu

SEQ ID NO: 559921 - RNA, 22 nt, Human
uucagguucuacaauaauuacc

SEQ ID NO: 559922 - RNA, 23 nt, Human
aaaaaaaaaccaagagaaaagaa

SEQ ID NO: 559923 - RNA, 23 nt, Human
aaaaaaaaccaagagaaaagaaa

SEQ ID NO: 559924 - RNA, 21 nt, Human
aaaaaaauuuaaaccaagcug

SEQ ID NO: 559925 - RNA, 24 nt, Human
accccgccgacccccgcggaauaa

SEQ ID NO: 559926 - RNA, 20 nt, Human
agagcuucaccgaaacacac

SEQ ID NO: 559927 - RNA, 18 nt, Human
agcaaaacaguccggaga

SEQ ID NO: 559928 - RNA, 21 nt, Human
augaccacuaacuucugcaua

SEQ ID NO: 559929 - RNA, 19 nt, Human
caaagcgcagcggcggcgc

SEQ ID NO: 559930 - RNA, 20 nt, Human
cacacacaaagcaggccugu

SEQ ID NO: 559931 - RNA, 21 nt, Human
cacacacaaagcaggccugua

SEQ ID NO: 559932 - RNA, 22 nt, Human
cacacagugaugaacugugccc

SEQ ID NO: 559933 - RNA, 19 nt, Human
ccaccaugucugcccgccc

SEQ ID NO: 559934 - RNA, 22 nt, Human
ccaccaugucugcccgccccuc

SEQ ID NO: 559935 - RNA, 19 nt, Human
ccaggccgaccccgccgac

SEQ ID NO: 559936 - RNA, 22 nt, Human
ccccgccgacccccgcggaaua

SEQ ID NO: 559937 - RNA, 21 nt, Human
ccugaauugagagagcaaaac

SEQ ID NO: 559938 - RNA, 18 nt, Human
cgaggagggggcggcggc

SEQ ID NO: 559939 - RNA, 19 nt, Human
cgggcgcccaggccgaccc

SEQ ID NO: 559940 - RNA, 24 nt, Human
cggggccaggagccccggaaaccc

SEQ ID NO: 559941 - RNA, 22 nt, Human
cucccagaagcagugugcccag

SEQ ID NO: 559942 - RNA, 23 nt, Human
cugagaaucuucuauuaaaccag

SEQ ID NO: 559943 - RNA, 24 nt, Human
gaaaaaaaaaccaagagaaaagaa

SEQ ID NO: 559944 - RNA, 18 nt, Human
gcagcggcggcgcgggcg

SEQ ID NO: 559945 - RNA, 18 nt, Human
gccacaguccaaucaggu

SEQ ID NO: 559946 - RNA, 21 nt, Human
gccccggaaacccggcgccuu

SEQ ID NO: 559947 - RNA, 18 nt, Human
ggaagacacacacaaagc

SEQ ID NO: 559948 - RNA, 19 nt, Human
ggaagacacacacaaagca

SEQ ID NO: 559949 - RNA, 21 nt, Human
ggcgaagucuuuggggcagaa

SEQ ID NO: 559950 - RNA, 22 nt, Human
ggcggcggccgccaccaugucu

SEQ ID NO: 559951 - RNA, 22 nt, Human
gggccgaggagggggcggcggc

SEQ ID NO: 559952 - RNA, 21 nt, Human
gugcccuggcagagaugaccu

SEQ ID NO: 559953 - RNA, 20 nt, Human
uaaaaaacguacuucaguaa

SEQ ID NO: 559954 - RNA, 18 nt, Human
uaucaaagcugaugguua

SEQ ID NO: 559955 - RNA, 19 nt, Human
ucccagaagcagugugccu

SEQ ID NO: 559956 - RNA, 21 nt, Human
ucugcccgccccucccagaag

SEQ ID NO: 559957 - RNA, 18 nt, Human
ugagaaaaaaauuuaaac

SEQ ID NO: 559958 - RNA, 19 nt, Human
ugagaaaaaaauuuaaacc

SEQ ID NO: 559959 - RNA, 21 nt, Human
ugagauggcaauguacuuuac

SEQ ID NO: 559960 - RNA, 20 nt, Human
ugcccgccccucccagaagc

SEQ ID NO: 559961 - RNA, 18 nt, Human
ugccugaauugagagagc

SEQ ID NO: 559962 - RNA, 28 nt, Human
uguaucauuccuuugguuucaguuuuca

SEQ ID NO: 559963 - RNA, 22 nt, Human
uugccugaauugagagagcaaa

SEQ ID NO: 559964 - RNA, 19 nt, Human
uuggggcagaagucccgag

SEQ ID NO: 559965 - RNA, 21 nt, Human
uuguuuuuggaaaaaaaaacc

SEQ ID NO: 559966 - RNA, 21 nt, Human
uuuaaaccaagcugggugggu

SEQ ID NO: 559967 - RNA, 19 nt, Human
uuuacaaggaccauuuaca

SEQ ID NO: 559968 - RNA, 28 nt, Human
aaaaacauucaucccagcaaaagccucc

SEQ ID NO: 559969 - RNA, 20 nt, Human
aagccuccagggcuggaggg

SEQ ID NO: 559970 - RNA, 19 nt, Human
agaaagaccuccugggcug

SEQ ID NO: 559971 - RNA, 19 nt, Human
agcagaaagaccuccuggg

SEQ ID NO: 559972 - RNA, 18 nt, Human
agcaggagguuguccagg

SEQ ID NO: 559973 - RNA, 24 nt, Human
agcaggagguuguccagggacugu

SEQ ID NO: 559974 - RNA, 20 nt, Human
agccagccuggagcuccugc

SEQ ID NO: 559975 - RNA, 22 nt, Human
agccuggagcuccugcugcugg

SEQ ID NO: 559976 - RNA, 22 nt, Human
agguguccagccagccuggagc

SEQ ID NO: 559977 - RNA, 21 nt, Human
cagcaaaagccuccagggcug

SEQ ID NO: 559978 - RNA, 21 nt, Human
cagcucccucuacucacaguc

SEQ ID NO: 559979 - RNA, 24 nt, Human
ccggucguagccccggccucccuu

SEQ ID NO: 559980 - RNA, 23 nt, Human
ccucauccggcucccauagcacc

SEQ ID NO: 559981 - RNA, 21 nt, Human
ccuccagggcuggagggugag

SEQ ID NO: 559982 - RNA, 19 nt, Human
cuauaaaaacauucauccc

SEQ ID NO: 559983 - RNA, 24 nt, Human
cuccugggcuggggacauccuucc

SEQ ID NO: 559984 - RNA, 21 nt, Human
cuggcgcggcaggcggcucuc

SEQ ID NO: 559985 - RNA, 18 nt, Human
gagguuguccagggacug

SEQ ID NO: 559986 - RNA, 18 nt, Human
gccuggagcuccugcugc

SEQ ID NO: 559987 - RNA, 22 nt, Human
gggccgugcuccccugaugcga

SEQ ID NO: 559988 - RNA, 18 nt, Human
gggcuggggacauccuuc

SEQ ID NO: 559989 - RNA, 22 nt, Human
uacaacaaaaacccuauaaaaa

SEQ ID NO: 559990 - RNA, 23 nt, Human
uacaacaaaaacccuauaaaaac

SEQ ID NO: 559991 - RNA, 26 nt, Human
uacaacaaaaacccuauaaaaacauu

SEQ ID NO: 559992 - RNA, 19 nt, Human
uccagggcuggagggugag

SEQ ID NO: 559993 - RNA, 21 nt, Human
ucccacugugguccagcuccc

SEQ ID NO: 559994 - RNA, 18 nt, Human
ucccagcaaaagccucca

SEQ ID NO: 559995 - RNA, 25 nt, Human
ucccagcaaaagccuccagggcugg

SEQ ID NO: 559996 - RNA, 22 nt, Human
uccugggcuggggacauccuuc

SEQ ID NO: 559997 - RNA, 19 nt, Human
ugaugcgauugggcucuca

SEQ ID NO: 559998 - RNA, 24 nt, Human
ugcccuguccucauccggcuccca

SEQ ID NO: 559999 - RNA, 19 nt, Human
ugcguggggacccaggugu

SEQ ID NO: 560000 - RNA, 18 nt, Human
uggcgcggcaggcggcuc

SEQ ID NO: 560001 - RNA, 20 nt, Human
ugggaugcccuguccucauc

SEQ ID NO: 560002 - RNA, 19 nt, Human
ugggcuggggacauccuuc

SEQ ID NO: 560003 - RNA, 24 nt, Human
uggggcccuggcaaccugucugga

SEQ ID NO: 560004 - RNA, 24 nt, Human
uucaucccagcaaaagccuccagg

SEQ ID NO: 560005 - RNA, 21 nt, Human
uuccuuggggacgauggagca

SEQ ID NO: 560006 - RNA, 21 nt, Human
aaagggacugaagcuguaacc

SEQ ID NO: 560007 - RNA, 24 nt, Human
aaagugcugggauuacagguguga

SEQ ID NO: 560008 - RNA, 19 nt, Human
aaccagccucuccacucca

SEQ ID NO: 560009 - RNA, 20 nt, Human
aagaguggauggauggaugg

SEQ ID NO: 560010 - RNA, 18 nt, Human
aagugauccaccugccuc

SEQ ID NO: 560011 - RNA, 18 nt, Human
aagugcugggauuacagg

SEQ ID NO: 560012 - RNA, 19 nt, Human
aagugcugggauuacaggu

SEQ ID NO: 560013 - RNA, 21 nt, Human
acagauggguggauggaggaa

SEQ ID NO: 560014 - RNA, 20 nt, Human
acaggguuucgccuuguugg

SEQ ID NO: 560015 - RNA, 24 nt, Human
acaggguuucgccuuguuggccag

SEQ ID NO: 560016 - RNA, 20 nt, Human
accagccucuccacuccacc

SEQ ID NO: 560017 - RNA, 22 nt, Human
acucugccuuuucuuuuuuugu

SEQ ID NO: 560018 - RNA, 18 nt, Human
agacaaagggacugaagc

SEQ ID NO: 560019 - RNA, 18 nt, Human
agaggguggaagagugga

SEQ ID NO: 560020 - RNA, 24 nt, Human
agaguggauggauggauggacggg

SEQ ID NO: 560021 - RNA, 24 nt, Human
agcaagucucgugccucagccucc

SEQ ID NO: 560022 - RNA, 20 nt, Human
agccuuuugcuuuuucucag

SEQ ID NO: 560023 - RNA, 23 nt, Human
agcugcuccacugagcuggcccc

SEQ ID NO: 560024 - RNA, 25 nt, Human
aggcuggagugcaguggcgcgaucu

SEQ ID NO: 560025 - RNA, 20 nt, Human
aggugugaggcaccauaacc

SEQ ID NO: 560026 - RNA, 20 nt, Human
aguagagacaggguuucgcc

SEQ ID NO: 560027 - RNA, 19 nt, Human
aguagcugggauuacaggc

SEQ ID NO: 560028 - RNA, 21 nt, Human
agugcaguggcgcgaucucag

SEQ ID NO: 560029 - RNA, 23 nt, Human
agugcaguggcgcgaucucagcu

SEQ ID NO: 560030 - RNA, 24 nt, Human
agugcaguggcgcgaucucagcuc

SEQ ID NO: 560031 - RNA, 24 nt, Human
auuuuuuuauuuuuaguagagaca

SEQ ID NO: 560032 - RNA, 19 nt, Human
caaagggacugaagcugua

SEQ ID NO: 560033 - RNA, 26 nt, Human
caaagggacugaagcuguaaccaguc

SEQ ID NO: 560034 - RNA, 24 nt, Human
caaagugcugggauuacaggugug

SEQ ID NO: 560035 - RNA, 23 nt, Human
caaccuccaccuccuggguucaa

SEQ ID NO: 560036 - RNA, 20 nt, Human
caagucucgugccucagccu

SEQ ID NO: 560037 - RNA, 22 nt, Human
caagugauccaccugccucagc

SEQ ID NO: 560038 - RNA, 24 nt, Human
caagugauccaccugccucagccc

SEQ ID NO: 560039 - RNA, 21 nt, Human
caccacaaccuccaccuccug

SEQ ID NO: 560040 - RNA, 23 nt, Human
caccacaaccuccaccuccuggg

SEQ ID NO: 560041 - RNA, 24 nt, Human
cacccaggcuggagugcaguggcg

SEQ ID NO: 560042 - RNA, 27 nt, Human
caccuacccgugacugaugcucagagc

SEQ ID NO: 560043 - RNA, 23 nt, Human
caccugccucagccccccaaagu

SEQ ID NO: 560044 - RNA, 19 nt, Human
cagcaugaggucagucucu

SEQ ID NO: 560045 - RNA, 20 nt, Human
cagccuccugaguagcuggg

SEQ ID NO: 560046 - RNA, 24 nt, Human
caggguuucgccuuguuggccagg

SEQ ID NO: 560047 - RNA, 23 nt, Human
caguaucugaaacaucuguucca

SEQ ID NO: 560048 - RNA, 23 nt, Human
cagugcccuucucuucugggucc

SEQ ID NO: 560049 - RNA, 18 nt, Human
caucucugcaggucaagg

SEQ ID NO: 560050 - RNA, 21 nt, Human
ccaaagugcugggauuacagg

SEQ ID NO: 560051 - RNA, 21 nt, Human
ccaaagugcugggauuacagg

SEQ ID NO: 560052 - RNA, 24 nt, Human
ccaaagugcugggauuacaggugu

SEQ ID NO: 560053 - RNA, 18 nt, Human
ccacaaccuccaccuccu

SEQ ID NO: 560054 - RNA, 23 nt, Human
ccacaaccuccaccuccuggguu

SEQ ID NO: 560055 - RNA, 24 nt, Human
ccacaaccuccaccuccuggguuc

SEQ ID NO: 560056 - RNA, 26 nt, Human
ccaccugccucagccccccaaagugc

SEQ ID NO: 560057 - RNA, 23 nt, Human
ccccaaagugcugggauuacagg

SEQ ID NO: 560058 - RNA, 21 nt, Human
cccgugacugaugcucagagc

SEQ ID NO: 560059 - RNA, 21 nt, Human
ccgguagagugcuuugacauc

SEQ ID NO: 560060 - RNA, 19 nt, Human
ccuccaccuccuggguuca

SEQ ID NO: 560061 - RNA, 21 nt, Human
ccugaccucaagugauccacc

SEQ ID NO: 560062 - RNA, 23 nt, Human
ccugaccucaagugauccaccug

SEQ ID NO: 560063 - RNA, 23 nt, Human
ccugaccucaagugauccaccug

SEQ ID NO: 560064 - RNA, 23 nt, Human
ccugaguagcugggauuacaggc

SEQ ID NO: 560065 - RNA, 24 nt, Human
ccugaguagcugggauuacaggcg

SEQ ID NO: 560066 - RNA, 21 nt, Human
ccuggaaaacuuuguucuugg

SEQ ID NO: 560067 - RNA, 20 nt, Human
ccuggguucaagcaagucuc

SEQ ID NO: 560068 - RNA, 19 nt, Human
ccuuguuggccaggcuggu

SEQ ID NO: 560069 - RNA, 21 nt, Human
ccuuguuggccaggcuggucu
